United States Patent 10,706,955 (BIOINFORMATIC PROCESSES FOR DETERMINATION OF PEPTIDE BINDING) - sequence listing, part 36

SEQ ID NO: 1396590 - protein, 8 aa, Mycobacterium tuberculosis
AAGDPARA

SEQ ID NO: 1396591 - protein, 4 aa, Mycobacterium tuberculosis
AAGE

SEQ ID NO: 1396592 - protein, 6 aa, Mycobacterium tuberculosis
AAGEMR

SEQ ID NO: 1396593 - protein, 8 aa, Mycobacterium tuberculosis
AAGEPGAG

SEQ ID NO: 1396594 - protein, 4 aa, Mycobacterium tuberculosis
AAGG

SEQ ID NO: 1396595 - protein, 7 aa, Mycobacterium tuberculosis
AAGGQVR

SEQ ID NO: 1396596 - protein, 10 aa, Mycobacterium tuberculosis
AAGGVGAATA

SEQ ID NO: 1396597 - protein, 6 aa, Mycobacterium tuberculosis
AAGISR

SEQ ID NO: 1396598 - protein, 5 aa, Mycobacterium tuberculosis
AAGKG

SEQ ID NO: 1396599 - protein, 10 aa, Mycobacterium tuberculosis
AAGKLQGLTP

SEQ ID NO: 1396600 - protein, 11 aa, Mycobacterium tuberculosis
AAGKPITGTHA

SEQ ID NO: 1396601 - protein, 4 aa, Mycobacterium tuberculosis
AAGN

SEQ ID NO: 1396602 - protein, 8 aa, Mycobacterium tuberculosis
AAGNERRT

SEQ ID NO: 1396603 - protein, 6 aa, Mycobacterium tuberculosis
AAGPDN

SEQ ID NO: 1396604 - protein, 11 aa, Mycobacterium tuberculosis
AAGPLDRTHPA

SEQ ID NO: 1396605 - protein, 14 aa, Mycobacterium tuberculosis
AAGQAAQAAGQARL

SEQ ID NO: 1396606 - protein, 9 aa, Mycobacterium tuberculosis
AAGQGRSDD

SEQ ID NO: 1396607 - protein, 7 aa, Mycobacterium tuberculosis
AAGRASA

SEQ ID NO: 1396608 - protein, 10 aa, Mycobacterium tuberculosis
AAGRASKDVD

SEQ ID NO: 1396609 - protein, 7 aa, Mycobacterium tuberculosis
AAGSDLD

SEQ ID NO: 1396610 - protein, 7 aa, Mycobacterium tuberculosis
AAGTPAE

SEQ ID NO: 1396611 - protein, 13 aa, Mycobacterium tuberculosis
AAGTSRSDPRPAL

SEQ ID NO: 1396612 - protein, 6 aa, Mycobacterium tuberculosis
AAGTVS

SEQ ID NO: 1396613 - protein, 5 aa, Mycobacterium tuberculosis
AAGVP

SEQ ID NO: 1396614 - protein, 6 aa, Mycobacterium tuberculosis
AAGWPG

SEQ ID NO: 1396615 - protein, 8 aa, Mycobacterium tuberculosis
AAGYPADE

SEQ ID NO: 1396616 - protein, 7 aa, Mycobacterium tuberculosis
AAHGYTP

SEQ ID NO: 1396617 - protein, 10 aa, Mycobacterium tuberculosis
AAHSTKQRGK

SEQ ID NO: 1396618 - protein, 9 aa, Mycobacterium tuberculosis
AAIDTGAAE

SEQ ID NO: 1396619 - protein, 5 aa, Mycobacterium tuberculosis
AAKAG

SEQ ID NO: 1396620 - protein, 10 aa, Mycobacterium tuberculosis
AAKAGGGSIN

SEQ ID NO: 1396621 - protein, 6 aa, Mycobacterium tuberculosis
AAKDQA

SEQ ID NO: 1396622 - protein, 4 aa, Mycobacterium tuberculosis
AAKE

SEQ ID NO: 1396623 - protein, 7 aa, Mycobacterium tuberculosis
AAKGAGA

SEQ ID NO: 1396624 - protein, 6 aa, Mycobacterium tuberculosis
AAKGDV

SEQ ID NO: 1396625 - protein, 8 aa, Mycobacterium tuberculosis
AAKGNGRA

SEQ ID NO: 1396626 - protein, 7 aa, Mycobacterium tuberculosis
AAKGVPD

SEQ ID NO: 1396627 - protein, 7 aa, Mycobacterium tuberculosis
AAKNAAQ

SEQ ID NO: 1396628 - protein, 6 aa, Mycobacterium tuberculosis
AAKNAV

SEQ ID NO: 1396629 - protein, 9 aa, Mycobacterium tuberculosis
AAKPDPRAY

SEQ ID NO: 1396630 - protein, 5 aa, Mycobacterium tuberculosis
AAKPK

SEQ ID NO: 1396631 - protein, 6 aa, Mycobacterium tuberculosis
AAKPKR

SEQ ID NO: 1396632 - protein, 7 aa, Mycobacterium tuberculosis
AAKPSMG

SEQ ID NO: 1396633 - protein, 9 aa, Mycobacterium tuberculosis
AAKRPSDYR

SEQ ID NO: 1396634 - protein, 9 aa, Mycobacterium tuberculosis
AAKSGKDVG

SEQ ID NO: 1396635 - protein, 8 aa, Mycobacterium tuberculosis
AAKTGDRF

SEQ ID NO: 1396636 - protein, 5 aa, Mycobacterium tuberculosis
AALEP

SEQ ID NO: 1396637 - protein, 5 aa, Mycobacterium tuberculosis
AALGE

SEQ ID NO: 1396638 - protein, 7 aa, Mycobacterium tuberculosis
AALSETV

SEQ ID NO: 1396639 - protein, 8 aa, Mycobacterium tuberculosis
AALSGTPR

SEQ ID NO: 1396640 - protein, 7 aa, Mycobacterium tuberculosis
AALSTDE

SEQ ID NO: 1396641 - protein, 9 aa, Mycobacterium tuberculosis
AANAAAAQT

SEQ ID NO: 1396642 - protein, 8 aa, Mycobacterium tuberculosis
AANGDELQ

SEQ ID NO: 1396643 - protein, 5 aa, Mycobacterium tuberculosis
AANPL

SEQ ID NO: 1396644 - protein, 5 aa, Mycobacterium tuberculosis
AANRK

SEQ ID NO: 1396645 - protein, 5 aa, Mycobacterium tuberculosis
AANRP

SEQ ID NO: 1396646 - protein, 6 aa, Mycobacterium tuberculosis
AANRPG

SEQ ID NO: 1396647 - protein, 5 aa, Mycobacterium tuberculosis
AANSR

SEQ ID NO: 1396648 - protein, 19 aa, Mycobacterium tuberculosis
AAPAAVAAAGDAAKGLPGL

SEQ ID NO: 1396649 - protein, 7 aa, Mycobacterium tuberculosis
AAPAPDA

SEQ ID NO: 1396650 - protein, 14 aa, Mycobacterium tuberculosis
AAPAPLPSPNELTD

SEQ ID NO: 1396651 - protein, 7 aa, Mycobacterium tuberculosis
AAPAYAE

SEQ ID NO: 1396652 - protein, 10 aa, Mycobacterium tuberculosis
AAPDAGEQDL

SEQ ID NO: 1396653 - protein, 7 aa, Mycobacterium tuberculosis
AAPDTGN

SEQ ID NO: 1396654 - protein, 5 aa, Mycobacterium tuberculosis
AAPEE

SEQ ID NO: 1396655 - protein, 7 aa, Mycobacterium tuberculosis
AAPEEND

SEQ ID NO: 1396656 - protein, 7 aa, Mycobacterium tuberculosis
AAPESTC

SEQ ID NO: 1396657 - protein, 5 aa, Mycobacterium tuberculosis
AAPGA

SEQ ID NO: 1396658 - protein, 14 aa, Mycobacterium tuberculosis
AAPGATNPDDHTPV

SEQ ID NO: 1396659 - protein, 5 aa, Mycobacterium tuberculosis
AAPGQ

SEQ ID NO: 1396660 - protein, 6 aa, Mycobacterium tuberculosis
AAPGQG

SEQ ID NO: 1396661 - protein, 7 aa, Mycobacterium tuberculosis
AAPGQGE

SEQ ID NO: 1396662 - protein, 7 aa, Mycobacterium tuberculosis
AAPIPKE

SEQ ID NO: 1396663 - protein, 8 aa, Mycobacterium tuberculosis
AAPKPSKL

SEQ ID NO: 1396664 - protein, 9 aa, Mycobacterium tuberculosis
AAPPAGSKQ

SEQ ID NO: 1396665 - protein, 7 aa, Mycobacterium tuberculosis
AAPPDSY

SEQ ID NO: 1396666 - protein, 8 aa, Mycobacterium tuberculosis
AAPPPGHG

SEQ ID NO: 1396667 - protein, 7 aa, Mycobacterium tuberculosis
AAPPPLP

SEQ ID NO: 1396668 - protein, 5 aa, Mycobacterium tuberculosis
AAPPQ

SEQ ID NO: 1396669 - protein, 6 aa, Mycobacterium tuberculosis
AAPQQG

SEQ ID NO: 1396670 - protein, 4 aa, Mycobacterium tuberculosis
AAPR

SEQ ID NO: 1396671 - protein, 7 aa, Mycobacterium tuberculosis
AAPSGEI

SEQ ID NO: 1396672 - protein, 7 aa, Mycobacterium tuberculosis
AAPTSVH

SEQ ID NO: 1396673 - protein, 17 aa, Mycobacterium tuberculosis
AAPVAPAASSAGPRPDD

SEQ ID NO: 1396674 - protein, 10 aa, Mycobacterium tuberculosis
AAPYQRARER

SEQ ID NO: 1396675 - protein, 8 aa, Mycobacterium tuberculosis
AAQAEPSF

SEQ ID NO: 1396676 - protein, 11 aa, Mycobacterium tuberculosis
AAQAQRSATQA

SEQ ID NO: 1396677 - protein, 20 aa, Mycobacterium tuberculosis
AAQGDHEGAADRLSTGGDTA

SEQ ID NO: 1396678 - protein, 7 aa, Mycobacterium tuberculosis
AAQGRTP

SEQ ID NO: 1396679 - protein, 8 aa, Mycobacterium tuberculosis
AAQGTTGP

SEQ ID NO: 1396680 - protein, 8 aa, Mycobacterium tuberculosis
AAQQGRKM

SEQ ID NO: 1396681 - protein, 6 aa, Mycobacterium tuberculosis
AAQRDI

SEQ ID NO: 1396682 - protein, 19 aa, Mycobacterium tuberculosis
AAQSNTPVSKAIIVRLEPT

SEQ ID NO: 1396683 - protein, 8 aa, Mycobacterium tuberculosis
AARAAGDT

SEQ ID NO: 1396684 - protein, 9 aa, Mycobacterium tuberculosis
AARAAGHPG

SEQ ID NO: 1396685 - protein, 12 aa, Mycobacterium tuberculosis
AARADQRPLWQV

SEQ ID NO: 1396686 - protein, 6 aa, Mycobacterium tuberculosis
AAREAS

SEQ ID NO: 1396687 - protein, 11 aa, Mycobacterium tuberculosis
AARPAGPAHPA

SEQ ID NO: 1396688 - protein, 12 aa, Mycobacterium tuberculosis
AARPGPSHRDNR

SEQ ID NO: 1396689 - protein, 12 aa, Mycobacterium tuberculosis
AARQSRRARIPP

SEQ ID NO: 1396690 - protein, 6 aa, Mycobacterium tuberculosis
AARSAT

SEQ ID NO: 1396691 - protein, 9 aa, Mycobacterium tuberculosis
AARSGRADE

SEQ ID NO: 1396692 - protein, 14 aa, Mycobacterium tuberculosis
AARTGDDRSPEQVA

SEQ ID NO: 1396693 - protein, 15 aa, Mycobacterium tuberculosis
AARTRSGVILRSPAA

SEQ ID NO: 1396694 - protein, 4 aa, Mycobacterium tuberculosis
AASA

SEQ ID NO: 1396695 - protein, 7 aa, Mycobacterium tuberculosis
AASAERV

SEQ ID NO: 1396696 - protein, 14 aa, Mycobacterium tuberculosis
AASAQDAADRPPVP

SEQ ID NO: 1396697 - protein, 8 aa, Mycobacterium tuberculosis
AASAREAQ

SEQ ID NO: 1396698 - protein, 8 aa, Mycobacterium tuberculosis
AASCPDDP

SEQ ID NO: 1396699 - protein, 20 aa, Mycobacterium tuberculosis
AASDQPKPEPAPKAKRRKGV

SEQ ID NO: 1396700 - protein, 21 aa, Mycobacterium tuberculosis
AASELASRQRAMKSATDNADD

SEQ ID NO: 1396701 - protein, 7 aa, Mycobacterium tuberculosis
AASGADI

SEQ ID NO: 1396702 - protein, 5 aa, Mycobacterium tuberculosis
AASGG

SEQ ID NO: 1396703 - protein, 7 aa, Mycobacterium tuberculosis
AASGLDG

SEQ ID NO: 1396704 - protein, 7 aa, Mycobacterium tuberculosis
AASGTPL

SEQ ID NO: 1396705 - protein, 14 aa, Mycobacterium tuberculosis
AASIPTKSYDNAEG

SEQ ID NO: 1396706 - protein, 12 aa, Mycobacterium tuberculosis
AASPFRSDTDIS

SEQ ID NO: 1396707 - protein, 13 aa, Mycobacterium tuberculosis
AASREAESAFGDP

SEQ ID NO: 1396708 - protein, 8 aa, Mycobacterium tuberculosis
AASSDREV

SEQ ID NO: 1396709 - protein, 9 aa, Mycobacterium tuberculosis
AASVTRTGA

SEQ ID NO: 1396710 - protein, 7 aa, Mycobacterium tuberculosis
AASYAQG

SEQ ID NO: 1396711 - protein, 8 aa, Mycobacterium tuberculosis
AASYGSTI

SEQ ID NO: 1396712 - protein, 7 aa, Mycobacterium tuberculosis
AATAAAT

SEQ ID NO: 1396713 - protein, 7 aa, Mycobacterium tuberculosis
AATAAVE

SEQ ID NO: 1396714 - protein, 7 aa, Mycobacterium tuberculosis
AATADTG

SEQ ID NO: 1396715 - protein, 9 aa, Mycobacterium tuberculosis
AATGGGVAT

SEQ ID NO: 1396716 - protein, 6 aa, Mycobacterium tuberculosis
AATGKP

SEQ ID NO: 1396717 - protein, 15 aa, Mycobacterium tuberculosis
AATLQRAARDAAPDA

SEQ ID NO: 1396718 - protein, 6 aa, Mycobacterium tuberculosis
AATLRK

SEQ ID NO: 1396719 - protein, 11 aa, Mycobacterium tuberculosis
AATLSGGEAQR

SEQ ID NO: 1396720 - protein, 8 aa, Mycobacterium tuberculosis
AATPSRRG

SEQ ID NO: 1396721 - protein, 8 aa, Mycobacterium tuberculosis
AATRGGQR

SEQ ID NO: 1396722 - protein, 4 aa, Mycobacterium tuberculosis
AATV

SEQ ID NO: 1396723 - protein, 6 aa, Mycobacterium tuberculosis
AAVPHP

SEQ ID NO: 1396724 - protein, 6 aa, Mycobacterium tuberculosis
AAVSPG

SEQ ID NO: 1396725 - protein, 14 aa, Mycobacterium tuberculosis
AAVTGNGSADKAQV

SEQ ID NO: 1396726 - protein, 17 aa, Mycobacterium tuberculosis
ADAAAADKRRAAGDTAP

SEQ ID NO: 1396727 - protein, 12 aa, Mycobacterium tuberculosis
ADAAHSTKERGK

SEQ ID NO: 1396728 - protein, 8 aa, Mycobacterium tuberculosis
ADAARATY

SEQ ID NO: 1396729 - protein, 5 aa, Mycobacterium tuberculosis
ADADD

SEQ ID NO: 1396730 - protein, 5 aa, Mycobacterium tuberculosis
ADAGP

SEQ ID NO: 1396731 - protein, 12 aa, Mycobacterium tuberculosis
ADAPGADGPANL

SEQ ID NO: 1396732 - protein, 8 aa, Mycobacterium tuberculosis
ADAPPTVS

SEQ ID NO: 1396733 - protein, 4 aa, Mycobacterium tuberculosis
ADAT

SEQ ID NO: 1396734 - protein, 21 aa, Mycobacterium tuberculosis
ADAVDGAAAPLAGTTSQPALS

SEQ ID NO: 1396735 - protein, 11 aa, Mycobacterium tuberculosis
ADDGGSSGRLR

SEQ ID NO: 1396736 - protein, 7 aa, Mycobacterium tuberculosis
ADDRSDA

SEQ ID NO: 1396737 - protein, 15 aa, Mycobacterium tuberculosis
ADDSTPPADWEKPLD

SEQ ID NO: 1396738 - protein, 4 aa, Mycobacterium tuberculosis
ADDT

SEQ ID NO: 1396739 - protein, 10 aa, Mycobacterium tuberculosis
ADEDATVPVG

SEQ ID NO: 1396740 - protein, 9 aa, Mycobacterium tuberculosis
ADEDERDRA

SEQ ID NO: 1396741 - protein, 11 aa, Mycobacterium tuberculosis
ADEDGRTMTER

SEQ ID NO: 1396742 - protein, 8 aa, Mycobacterium tuberculosis
ADEERGLG

SEQ ID NO: 1396743 - protein, 4 aa, Mycobacterium tuberculosis
ADEF

SEQ ID NO: 1396744 - protein, 4 aa, Mycobacterium tuberculosis
ADEG

SEQ ID NO: 1396745 - protein, 6 aa, Mycobacterium tuberculosis
ADEPPR

SEQ ID NO: 1396746 - protein, 19 aa, Mycobacterium tuberculosis
ADEPSGLRDPVPAADLLIL

SEQ ID NO: 1396747 - protein, 8 aa, Mycobacterium tuberculosis
ADEQPFSD

SEQ ID NO: 1396748 - protein, 5 aa, Mycobacterium tuberculosis
ADEQR

SEQ ID NO: 1396749 - protein, 7 aa, Mycobacterium tuberculosis
ADESPRS

SEQ ID NO: 1396750 - protein, 5 aa, Mycobacterium tuberculosis
ADESR

SEQ ID NO: 1396751 - protein, 6 aa, Mycobacterium tuberculosis
ADESSV

SEQ ID NO: 1396752 - protein, 6 aa, Mycobacterium tuberculosis
ADETER

SEQ ID NO: 1396753 - protein, 8 aa, Mycobacterium tuberculosis
ADETGTSA

SEQ ID NO: 1396754 - protein, 7 aa, Mycobacterium tuberculosis
ADEVSSA

SEQ ID NO: 1396755 - protein, 13 aa, Mycobacterium tuberculosis
ADGASETSRRLCA

SEQ ID NO: 1396756 - protein, 5 aa, Mycobacterium tuberculosis
ADGDL

SEQ ID NO: 1396757 - protein, 8 aa, Mycobacterium tuberculosis
ADGEHHKE

SEQ ID NO: 1396758 - protein, 6 aa, Mycobacterium tuberculosis
ADGERM

SEQ ID NO: 1396759 - protein, 8 aa, Mycobacterium tuberculosis
ADGGGGSI

SEQ ID NO: 1396760 - protein, 10 aa, Mycobacterium tuberculosis
ADGPDAVDRE

SEQ ID NO: 1396761 - protein, 10 aa, Mycobacterium tuberculosis
ADGPSQNDEA

SEQ ID NO: 1396762 - protein, 7 aa, Mycobacterium tuberculosis
ADGQAFR

SEQ ID NO: 1396763 - protein, 7 aa, Mycobacterium tuberculosis
ADGRATL

SEQ ID NO: 1396764 - protein, 5 aa, Mycobacterium tuberculosis
ADGSP

SEQ ID NO: 1396765 - protein, 14 aa, Mycobacterium tuberculosis
ADGTKFGKSTGGGS

SEQ ID NO: 1396766 - protein, 6 aa, Mycobacterium tuberculosis
ADGTTD

SEQ ID NO: 1396767 - protein, 14 aa, Mycobacterium tuberculosis
ADGVRSDVETLRGR

SEQ ID NO: 1396768 - protein, 11 aa, Mycobacterium tuberculosis
ADGYSRSGAGF

SEQ ID NO: 1396769 - protein, 10 aa, Mycobacterium tuberculosis
ADHDYKDGPD

SEQ ID NO: 1396770 - protein, 6 aa, Mycobacterium tuberculosis
ADHGDP

SEQ ID NO: 1396771 - protein, 10 aa, Mycobacterium tuberculosis
ADHPARGEQD

SEQ ID NO: 1396772 - protein, 7 aa, Mycobacterium tuberculosis
ADHPGQP

SEQ ID NO: 1396773 - protein, 21 aa, Mycobacterium tuberculosis
ADIDGVTDAEDRVDELGAREQ

SEQ ID NO: 1396774 - protein, 4 aa, Mycobacterium tuberculosis
ADIG

SEQ ID NO: 1396775 - protein, 4 aa, Mycobacterium tuberculosis
ADIT

SEQ ID NO: 1396776 - protein, 7 aa, Mycobacterium tuberculosis
ADKEADY

SEQ ID NO: 1396777 - protein, 8 aa, Mycobacterium tuberculosis
ADKPPPEA

SEQ ID NO: 1396778 - protein, 6 aa, Mycobacterium tuberculosis
ADLPAG

SEQ ID NO: 1396779 - protein, 6 aa, Mycobacterium tuberculosis
ADLPPA

SEQ ID NO: 1396780 - protein, 7 aa, Mycobacterium tuberculosis
ADLSGEE

SEQ ID NO: 1396781 - protein, 7 aa, Mycobacterium tuberculosis
ADNASAA

SEQ ID NO: 1396782 - protein, 9 aa, Mycobacterium tuberculosis
ADNGATQVV

SEQ ID NO: 1396783 - protein, 7 aa, Mycobacterium tuberculosis
ADPAARD

SEQ ID NO: 1396784 - protein, 6 aa, Mycobacterium tuberculosis
ADPAPL

SEQ ID NO: 1396785 - protein, 20 aa, Mycobacterium tuberculosis
ADPDWQSGDYHETGRAPDAG

SEQ ID NO: 1396786 - protein, 15 aa, Mycobacterium tuberculosis
ADPEGSVYSGGAGRP

SEQ ID NO: 1396787 - protein, 7 aa, Mycobacterium tuberculosis
ADPEGVP

SEQ ID NO: 1396788 - protein, 6 aa, Mycobacterium tuberculosis
ADPGGG

SEQ ID NO: 1396789 - protein, 5 aa, Mycobacterium tuberculosis
ADPGM

SEQ ID NO: 1396790 - protein, 8 aa, Mycobacterium tuberculosis
ADPPMTKD

SEQ ID NO: 1396791 - protein, 20 aa, Mycobacterium tuberculosis
ADPREARGALTTPLPAPPAR

SEQ ID NO: 1396792 - protein, 6 aa, Mycobacterium tuberculosis
ADPRSR

SEQ ID NO: 1396793 - protein, 16 aa, Mycobacterium tuberculosis
ADPSFKGTLEDAEEAR

SEQ ID NO: 1396794 - protein, 6 aa, Mycobacterium tuberculosis
ADPSNF

SEQ ID NO: 1396795 - protein, 7 aa, Mycobacterium tuberculosis
ADPSQQL

SEQ ID NO: 1396796 - protein, 14 aa, Mycobacterium tuberculosis
ADPTPEDDPDPLNT

SEQ ID NO: 1396797 - protein, 8 aa, Mycobacterium tuberculosis
ADPTRSAH

SEQ ID NO: 1396798 - protein, 8 aa, Mycobacterium tuberculosis
ADPVDVDP

SEQ ID NO: 1396799 - protein, 9 aa, Mycobacterium tuberculosis
ADQAGQTSF

SEQ ID NO: 1396800 - protein, 16 aa, Mycobacterium tuberculosis
ADQGPTAKRIRPRAQG

SEQ ID NO: 1396801 - protein, 5 aa, Mycobacterium tuberculosis
ADQGR

SEQ ID NO: 1396802 - protein, 17 aa, Mycobacterium tuberculosis
ADQGRKDDIAFLRERTG

SEQ ID NO: 1396803 - protein, 5 aa, Mycobacterium tuberculosis
ADQIP

SEQ ID NO: 1396804 - protein, 9 aa, Mycobacterium tuberculosis
ADQKNPETL

SEQ ID NO: 1396805 - protein, 5 aa, Mycobacterium tuberculosis
ADQPA

SEQ ID NO: 1396806 - protein, 11 aa, Mycobacterium tuberculosis
ADQQGKPLTPP

SEQ ID NO: 1396807 - protein, 18 aa, Mycobacterium tuberculosis
ADQRPPQEELIADYSPWP

SEQ ID NO: 1396808 - protein, 7 aa, Mycobacterium tuberculosis
ADRAVGE

SEQ ID NO: 1396809 - protein, 4 aa, Mycobacterium tuberculosis
ADRG

SEQ ID NO: 1396810 - protein, 13 aa, Mycobacterium tuberculosis
ADRQSEPGLPPLS

SEQ ID NO: 1396811 - protein, 5 aa, Mycobacterium tuberculosis
ADRRA

SEQ ID NO: 1396812 - protein, 6 aa, Mycobacterium tuberculosis
ADRRPG

SEQ ID NO: 1396813 - protein, 8 aa, Mycobacterium tuberculosis
ADRSRAGK

SEQ ID NO: 1396814 - protein, 31 aa, Mycobacterium tuberculosis; identical to SEQ ID NO: 167717

SEQ ID NO: 1396815 - protein, 16 aa, Mycobacterium tuberculosis
ADRSSLRQLHAAIKAA

SEQ ID NO: 1396816 - protein, 8 aa, Mycobacterium tuberculosis
ADRTDEAR

SEQ ID NO: 1396817 - protein, 9 aa, Mycobacterium tuberculosis
ADSETPLSA

SEQ ID NO: 1396818 - protein, 19 aa, Mycobacterium tuberculosis
ADSLRKDSAKVSIKDGPWG

SEQ ID NO: 1396819 - protein, 7 aa, Mycobacterium tuberculosis
ADTAAAA

SEQ ID NO: 1396820 - protein, 9 aa, Mycobacterium tuberculosis
ADTEPGDGK

SEQ ID NO: 1396821 - protein, 5 aa, Mycobacterium tuberculosis
ADTLA

SEQ ID NO: 1396822 - protein, 4 aa, Mycobacterium tuberculosis
ADTT

SEQ ID NO: 1396823 - protein, 7 aa, Mycobacterium tuberculosis
ADTTPKG

SEQ ID NO: 1396824 - protein, 7 aa, Mycobacterium tuberculosis
ADTTSTI

SEQ ID NO: 1396825 - protein, 12 aa, Mycobacterium tuberculosis
ADTWPPPATTQS

SEQ ID NO: 1396826 - protein, 20 aa, Mycobacterium tuberculosis
ADVAAADAARAAADSDGTQL

SEQ ID NO: 1396827 - protein, 7 aa, Mycobacterium tuberculosis
ADVAAGR

SEQ ID NO: 1396828 - protein, 9 aa, Mycobacterium tuberculosis
ADVDAENTL

SEQ ID NO: 1396829 - protein, 6 aa, Mycobacterium tuberculosis
ADVDDD

SEQ ID NO: 1396830 - protein, 8 aa, Mycobacterium tuberculosis
ADVPPPAM

SEQ ID NO: 1396831 - protein, 8 aa, Mycobacterium tuberculosis
ADVRPGDD

SEQ ID NO: 1396832 - protein, 10 aa, Mycobacterium tuberculosis
ADWAGPTKER

SEQ ID NO: 1396833 - protein, 19 aa, Mycobacterium tuberculosis
ADYDDYRRAAGPADHTAPP

SEQ ID NO: 1396834 - protein, 7 aa, Mycobacterium tuberculosis
ADYGSGP

SEQ ID NO: 1396835 - protein, 8 aa, Mycobacterium tuberculosis
AEAAENGC

SEQ ID NO: 1396836 - protein, 32 aa, Mycobacterium tuberculosis
AEAAGRGADDQSSASSAPSEKTAGGSLASDAQ

SEQ ID NO: 1396837 - protein, 10 aa, Mycobacterium tuberculosis
AEAAKYQPQP

SEQ ID NO: 1396838 - protein, 18 aa, Mycobacterium tuberculosis
AEAEAEVQRSVERFKAGT

SEQ ID NO: 1396839 - protein, 8 aa, Mycobacterium tuberculosis
AEAEKTRK

SEQ ID NO: 1396840 - protein, 6 aa, Mycobacterium tuberculosis
AEAERR

SEQ ID NO: 1396841 - protein, 9 aa, Mycobacterium tuberculosis
AEAGHPPTR

SEQ ID NO: 1396842 - protein, 6 aa, Mycobacterium tuberculosis
AEAGKQ

SEQ ID NO: 1396843 - protein, 11 aa, Mycobacterium tuberculosis
AEAGRAPGAIH

SEQ ID NO: 1396844 - protein, 4 aa, Mycobacterium tuberculosis
AEAH

SEQ ID NO: 1396845 - protein, 12 aa, Mycobacterium tuberculosis
AEAMSDEKSASP

SEQ ID NO: 1396846 - protein, 6 aa, Mycobacterium tuberculosis
AEAPED

SEQ ID NO: 1396847 - protein, 18 aa, Mycobacterium tuberculosis
AEAQDALRAEDAEPAASA

SEQ ID NO: 1396848 - protein, 5 aa, Mycobacterium tuberculosis
AEAQV

SEQ ID NO: 1396849 - protein, 15 aa, Mycobacterium tuberculosis
AEDPDEDDAAANRAK

SEQ ID NO: 1396850 - protein, 8 aa, Mycobacterium tuberculosis
AEDPFEGE

SEQ ID NO: 1396851 - protein, 6 aa, Mycobacterium tuberculosis
AEDPRA

SEQ ID NO: 1396852 - protein, 7 aa, Mycobacterium tuberculosis
AEDPVKV

SEQ ID NO: 1396853 - protein, 7 aa, Mycobacterium tuberculosis
AEEAARE

SEQ ID NO: 1396854 - protein, 6 aa, Mycobacterium tuberculosis
AEEDPT

SEQ ID NO: 1396855 - protein, 20 aa, Mycobacterium tuberculosis
AEEELPAEATEAIEALIRQI

SEQ ID NO: 1396856 - protein, 9 aa, Mycobacterium tuberculosis
AEEEPDGAL

SEQ ID NO: 1396857 - protein, 4 aa, Mycobacterium tuberculosis
AEEL

SEQ ID NO: 1396858 - protein, 4 aa, Mycobacterium tuberculosis
AEEN

SEQ ID NO: 1396859 - protein, 6 aa, Mycobacterium tuberculosis
AEENRH

SEQ ID NO: 1396860 - protein, 5 aa, Mycobacterium tuberculosis
AEEPA

SEQ ID NO: 1396861 - protein, 5 aa, Mycobacterium tuberculosis
AEEPT

SEQ ID NO: 1396862 - protein, 7 aa, Mycobacterium tuberculosis
AEGARLD

SEQ ID NO: 1396863 - protein, 11 aa, Mycobacterium tuberculosis
AEGDAAGGNQF

SEQ ID NO: 1396864 - protein, 6 aa, Mycobacterium tuberculosis
AEGDAE

SEQ ID NO: 1396865 - protein, 23 aa, Mycobacterium tuberculosis
AEGGPGADGKLAEASAAIARLVR

SEQ ID NO: 1396866 - protein, 8 aa, Mycobacterium tuberculosis
AEGIPYDD

SEQ ID NO: 1396867 - protein, 5 aa, Mycobacterium tuberculosis
AEGLR

SEQ ID NO: 1396868 - protein, 5 aa, Mycobacterium tuberculosis
AEGPV

SEQ ID NO: 1396869 - protein, 9 aa, Mycobacterium tuberculosis
AEGTNGSFP

SEQ ID NO: 1396870 - protein, 4 aa, Mycobacterium tuberculosis
AEGV

SEQ ID NO: 1396871 - protein, 5 aa, Mycobacterium tuberculosis
AEGVP

SEQ ID NO: 1396872 - protein, 6 aa, Mycobacterium tuberculosis
AEHDEL

SEQ ID NO: 1396873 - protein, 26 aa, Mycobacterium tuberculosis
AEHGGTVTAQRSRGTTSDATEHNAAA

SEQ ID NO: 1396874 - protein, 9 aa, Mycobacterium tuberculosis
AEHNAANDR

SEQ ID NO: 1396875 - protein, 4 aa, Mycobacterium tuberculosis
AEHP

SEQ ID NO: 1396876 - protein, 6 aa, Mycobacterium tuberculosis
AEHPLR

SEQ ID NO: 1396877 - protein, 7 aa, Mycobacterium tuberculosis
AEHPSSG

SEQ ID NO: 1396878 - protein, 8 aa, Mycobacterium tuberculosis
AEKNTEEM

SEQ ID NO: 1396879 - protein, 6 aa, Mycobacterium tuberculosis
AEKPGQ

SEQ ID NO: 1396880 - protein, 19 aa, Mycobacterium tuberculosis
AEKSREFAEHGNRVYLPIT

SEQ ID NO: 1396881 - protein, 4 aa, Mycobacterium tuberculosis
AELP

SEQ ID NO: 1396882 - protein, 4 aa, Mycobacterium tuberculosis
AELY

SEQ ID NO: 1396883 - protein, 7 aa, Mycobacterium tuberculosis
AENGRSW

SEQ ID NO: 1396884 - protein, 7 aa, Mycobacterium tuberculosis
AENPGYT

SEQ ID NO: 1396885 - protein, 9 aa, Mycobacterium tuberculosis
AENPPKKYQ

SEQ ID NO: 1396886 - protein, 6 aa, Mycobacterium tuberculosis
AENQTL

SEQ ID NO: 1396887 - protein, 8 aa, Mycobacterium tuberculosis
AENTPYGR

SEQ ID NO: 1396888 - protein, 11 aa, Mycobacterium tuberculosis
AEPAKRKPGYA

SEQ ID NO: 1396889 - protein, 6 aa, Mycobacterium tuberculosis
AEPDAL

SEQ ID NO: 1396890 - protein, 7 aa, Mycobacterium tuberculosis
AEPDGLE

SEQ ID NO: 1396891 - protein, 6 aa, Mycobacterium tuberculosis
AEPDHA

SEQ ID NO: 1396892 - protein, 4 aa, Mycobacterium tuberculosis
AEPI

SEQ ID NO: 1396893 - protein, 6 aa, Mycobacterium tuberculosis
AEPPQL

SEQ ID NO: 1396894 - protein, 5 aa, Mycobacterium tuberculosis
AEPTH

SEQ ID NO: 1396895 - protein, 9 aa, Mycobacterium tuberculosis
AEPYQADPE

SEQ ID NO: 1396896 - protein, 8 aa, Mycobacterium tuberculosis
AEQARELA

SEQ ID NO: 1396897 - protein, 9 aa, Mycobacterium tuberculosis
AEQARRGDG

SEQ ID NO: 1396898 - protein, 5 aa, Mycobacterium tuberculosis
AEQGR

SEQ ID NO: 1396899 - protein, 9 aa, Mycobacterium tuberculosis
AEQKGTGRW

SEQ ID NO: 1396900 - protein, 6 aa, Mycobacterium tuberculosis
AEQRER

SEQ ID NO: 1396901 - protein, 4 aa, Mycobacterium tuberculosis
AERA

SEQ ID NO: 1396902 - protein, 7 aa, Mycobacterium tuberculosis
AERAGIT

SEQ ID NO: 1396903 - protein, 13 aa, Mycobacterium tuberculosis
AERDRGAAPRTLP

SEQ ID NO: 1396904 - protein, 6 aa, Mycobacterium tuberculosis
AEREGR

SEQ ID NO: 1396905 - protein, 8 aa, Mycobacterium tuberculosis
AERETPKS

SEQ ID NO: 1396906 - protein, 12 aa, Mycobacterium tuberculosis
AERGIDATTGDL

SEQ ID NO: 1396907 - protein, 7 aa, Mycobacterium tuberculosis
AERNEPE

SEQ ID NO: 1396908 - protein, 5 aa, Mycobacterium tuberculosis
AERSG

SEQ ID NO: 1396909 - protein, 7 aa, Mycobacterium tuberculosis
AERTDSN

SEQ ID NO: 1396910 - protein, 14 aa, Mycobacterium tuberculosis
AERTEQKDFDGRSE

SEQ ID NO: 1396911 - protein, 9 aa, Mycobacterium tuberculosis
AERVPGDER

SEQ ID NO: 1396912 - protein, 7 aa, Mycobacterium tuberculosis
AERYGVP

SEQ ID NO: 1396913 - protein, 5 aa, Mycobacterium tuberculosis
AESAD

SEQ ID NO: 1396914 - protein, 11 aa, Mycobacterium tuberculosis
AESDDADAVAA

SEQ ID NO: 1396915 - protein, 4 aa, Mycobacterium tuberculosis
AESG

SEQ ID NO: 1396916 - protein, 8 aa, Mycobacterium tuberculosis
AESQRAAA

SEQ ID NO: 1396917 - protein, 7 aa, Mycobacterium tuberculosis
AESRDVT

SEQ ID NO: 1396918 - protein, 8 aa, Mycobacterium tuberculosis
AESSAPAG

SEQ ID NO: 1396919 - protein, 20 aa, Mycobacterium tuberculosis
AESTDDAKAETILDEVLAAA

SEQ ID NO: 1396920 - protein, 12 aa, Mycobacterium tuberculosis
AESTPDTNGISR

SEQ ID NO: 1396921 - protein, 8 aa, Mycobacterium tuberculosis
AESYGSNG

SEQ ID NO: 1396922 - protein, 4 aa, Mycobacterium tuberculosis
AETD

SEQ ID NO: 1396923 - protein, 9 aa, Mycobacterium tuberculosis
AETDDPDRR

SEQ ID NO: 1396924 - protein, 8 aa, Mycobacterium tuberculosis
AETDSTVR

SEQ ID NO: 1396925 - protein, 6 aa, Mycobacterium tuberculosis
AETGAG

SEQ ID NO: 1396926 - protein, 5 aa, Mycobacterium tuberculosis
AETGY

SEQ ID NO: 1396927 - protein, 4 aa, Mycobacterium tuberculosis
AETN

SEQ ID NO: 1396928 - protein, 11 aa, Mycobacterium tuberculosis
AETPDDVEQGS

SEQ ID NO: 1396929 - protein, 18 aa, Mycobacterium tuberculosis
AETRPEPGLLATLPRRVL

SEQ ID NO: 1396930 - protein, 10 aa, Mycobacterium tuberculosis
AEVDASDDRM

SEQ ID NO: 1396931 - protein, 12 aa, Mycobacterium tuberculosis
AEVRGDDAHEAK

SEQ ID NO: 1396932 - protein, 13 aa, Mycobacterium tuberculosis
AEVSTEANPESTW

SEQ ID NO: 1396933 - protein, 7 aa, Mycobacterium tuberculosis
AFGDDKD

SEQ ID NO: 1396934 - protein, 5 aa, Mycobacterium tuberculosis
AFNTA

SEQ ID NO: 1396935 - protein, 10 aa, Mycobacterium tuberculosis
AFRDDESRGV

SEQ ID NO: 1396936 - protein, 10 aa, Mycobacterium tuberculosis
AFSSLNDTGR

SEQ ID NO: 1396937 - protein, 6 aa, Mycobacterium tuberculosis
AGAAMA

SEQ ID NO: 1396938 - protein, 12 aa, Mycobacterium tuberculosis
AGAARTLFGRDP

SEQ ID NO: 1396939 - protein, 8 aa, Mycobacterium tuberculosis
AGAASADM

SEQ ID NO: 1396940 - protein, 5 aa, Mycobacterium tuberculosis
AGADP

SEQ ID NO: 1396941 - protein, 9 aa, Mycobacterium tuberculosis
AGADPDDYT

SEQ ID NO: 1396942 - protein, 8 aa, Mycobacterium tuberculosis
AGADSDEV

SEQ ID NO: 1396943 - protein, 6 aa, Mycobacterium tuberculosis
AGAGAD

SEQ ID NO: 1396944 - protein, 13 aa, Mycobacterium tuberculosis
AGAGGAGAGPRYG

SEQ ID NO: 1396945 - protein, 18 aa, Mycobacterium tuberculosis
AGAGRHGAPAPRAEQGDT

SEQ ID NO: 1396946 - protein, 11 aa, Mycobacterium tuberculosis
AGANGGAGGAG

SEQ ID NO: 1396947 - protein, 6 aa, Mycobacterium tuberculosis
AGAPDA

SEQ ID NO: 1396948 - protein, 23 aa, Mycobacterium tuberculosis
AGAPPSPLDVPSDPGLPVMQGQV

SEQ ID NO: 1396949 - protein, 15 aa, Mycobacterium tuberculosis
AGAQRTLDGGHTDGG

SEQ ID NO: 1396950 - protein, 14 aa, Mycobacterium tuberculosis
AGARSTTSLAAGNG

SEQ ID NO: 1396951 - protein, 8 aa, Mycobacterium tuberculosis
AGASPDVA

SEQ ID NO: 1396952 - protein, 11 aa, Mycobacterium tuberculosis
AGDAEAVAERR

SEQ ID NO: 1396953 - protein, 10 aa, Mycobacterium tuberculosis
AGDEPRPGAA

SEQ ID NO: 1396954 - protein, 9 aa, Mycobacterium tuberculosis
AGDGGAPAF

SEQ ID NO: 1396955 - protein, 7 aa, Mycobacterium tuberculosis
AGDGNTH

SEQ ID NO: 1396956 - protein, 8 aa, Mycobacterium tuberculosis
AGDGRRAG

SEQ ID NO: 1396957 - protein, 10 aa, Mycobacterium tuberculosis
AGDGVETGRH

SEQ ID NO: 1396958 - protein, 7 aa, Mycobacterium tuberculosis
AGDPDQL

SEQ ID NO: 1396959 - protein, 5 aa, Mycobacterium tuberculosis
AGDRP

SEQ ID NO: 1396960 - protein, 14 aa, Mycobacterium tuberculosis
AGDSADRDQACQRA

SEQ ID NO: 1396961 - protein, 6 aa, Mycobacterium tuberculosis
AGDSGV

SEQ ID NO: 1396962 - protein, 5 aa, Mycobacterium tuberculosis
AGDTA

SEQ ID NO: 1396963 - protein, 9 aa, Mycobacterium tuberculosis
AGEAGNHGQ

SEQ ID NO: 1396964 - protein, 5 aa, Mycobacterium tuberculosis
AGEDI

SEQ ID NO: 1396965 - protein, 6 aa, Mycobacterium tuberculosis
AGEEFT

SEQ ID NO: 1396966 - protein, 6 aa, Mycobacterium tuberculosis
AGEGDA

SEQ ID NO: 1396967 - protein, 9 aa, Mycobacterium tuberculosis
AGEGEPEQV

SEQ ID NO: 1396968 - protein, 10 aa, Mycobacterium tuberculosis
AGEGESTTDL

SEQ ID NO: 1396969 - protein, 7 aa, Mycobacterium tuberculosis
AGEGTQQ

SEQ ID NO: 1396970 - protein, 10 aa, Mycobacterium tuberculosis
AGEHAGQEAQ

SEQ ID NO: 1396971 - protein, 10 aa, Mycobacterium tuberculosis
AGEKAKDDPF

SEQ ID NO: 1396972 - protein, 7 aa, Mycobacterium tuberculosis
AGEKTQV

SEQ ID NO: 1396973 - protein, 8 aa, Mycobacterium tuberculosis
AGEPDGNE

SEQ ID NO: 1396974 - protein, 7 aa, Mycobacterium tuberculosis
AGEPPLT

SEQ ID NO: 1396975 - protein, 5 aa, Mycobacterium tuberculosis
AGEPW

SEQ ID NO: 1396976 - protein, 8 aa, Mycobacterium tuberculosis
AGFPDTDS

SEQ ID NO: 1396977 - protein, 10 aa, Mycobacterium tuberculosis
AGGADASPQL

SEQ ID NO: 1396978 - protein, 6 aa, Mycobacterium tuberculosis
AGGAEL

SEQ ID NO: 1396979 - protein, 16 aa, Mycobacterium tuberculosis
AGGALGGAAARATGGF

SEQ ID NO: 1396980 - protein, 7 aa, Mycobacterium tuberculosis
AGGASGI

SEQ ID NO: 1396981 - protein, 5 aa, Mycobacterium tuberculosis
AGGAV

SEQ ID NO: 1396982 - protein, 10 aa, Mycobacterium tuberculosis
AGGELGAESS

SEQ ID NO: 1396983 - protein, 7 aa, Mycobacterium tuberculosis
AGGGIGR

SEQ ID NO: 1396984 - protein, 7 aa, Mycobacterium tuberculosis
AGGIGTS

SEQ ID NO: 1396985 - protein, 13 aa, Mycobacterium tuberculosis
AGGPIPLPAPETL

SEQ ID NO: 1396986 - protein, 8 aa, Mycobacterium tuberculosis
AGGPPLPP

SEQ ID NO: 1396987 - protein, 4 aa, Mycobacterium tuberculosis
AGGQ

SEQ ID NO: 1396988 - protein, 7 aa, Mycobacterium tuberculosis
AGGQLGS

SEQ ID NO: 1396989 - protein, 10 aa, Mycobacterium tuberculosis
AGGTADQARD

SEQ ID NO: 1396990 - protein, 7 aa, Mycobacterium tuberculosis
AGGTESV

SEQ ID NO: 1396991 - protein, 6 aa, Mycobacterium tuberculosis
AGGTGD

SEQ ID NO: 1396992 - protein, 8 aa, Mycobacterium tuberculosis
AGGTHDDW

SEQ ID NO: 1396993 - protein, 8 aa, Mycobacterium tuberculosis
AGGTREPI

SEQ ID NO: 1396994 - protein, 7 aa, Mycobacterium tuberculosis
AGGTTAT

SEQ ID NO: 1396995 - protein, 14 aa, Mycobacterium tuberculosis
AGGVHAAGSGDRAV

SEQ ID NO: 1396996 - protein, 14 aa, Mycobacterium tuberculosis
AGHGNRPPAGAATE

SEQ ID NO: 1396997 - protein, 9 aa, Mycobacterium tuberculosis
AGHPEQGGW

SEQ ID NO: 1396998 - protein, 7 aa, Mycobacterium tuberculosis
AGIGPGA

SEQ ID NO: 1396999 - protein, 8 aa, Mycobacterium tuberculosis
AGIGPSRT

SEQ ID NO: 1397000 - protein, 16 aa, Mycobacterium tuberculosis
AGKADGARLSAAVKER

SEQ ID NO: 1397001 - protein, 14 aa, Mycobacterium tuberculosis
AGKAGARDRADDLA

SEQ ID NO: 1397002 - protein, 9 aa, Mycobacterium tuberculosis
AGKETVTTL

SEQ ID NO: 1397003 - protein, 9 aa, Mycobacterium tuberculosis
AGKPAPDSF

SEQ ID NO: 1397004 - protein, 17 aa, Mycobacterium tuberculosis
AGKPEQTLVRPDDQGAQ

SEQ ID NO: 1397005 - protein, 4 aa, Mycobacterium tuberculosis
AGKQ

SEQ ID NO: 1397006 - protein, 8 aa, Mycobacterium tuberculosis
AGKTTTTE

SEQ ID NO: 1397007 - protein, 7 aa, Mycobacterium tuberculosis
AGLDGTQ

SEQ ID NO: 1397008 - protein, 10 aa, Mycobacterium tuberculosis
AGLGNAATVG

SEQ ID NO: 1397009 - protein, 6 aa, Mycobacterium tuberculosis
AGLNLR

SEQ ID NO: 1397010 - protein, 8 aa, Mycobacterium tuberculosis
AGLPPATY

SEQ ID NO: 1397011 - protein, 14 aa, Mycobacterium tuberculosis
AGLPSAIDGPTIGS

SEQ ID NO: 1397012 - protein, 9 aa, Mycobacterium tuberculosis
AGLPSRSAG

SEQ ID NO: 1397013 - protein, 11 aa, Mycobacterium tuberculosis
AGLQPYQRHRD

SEQ ID NO: 1397014 - protein, 7 aa, Mycobacterium tuberculosis
AGLRPGA

SEQ ID NO: 1397015 - protein, 9 aa, Mycobacterium tuberculosis
AGLSPTDVD

SEQ ID NO: 1397016 - protein, 4 aa, Mycobacterium tuberculosis
AGLT

SEQ ID NO: 1397017 - protein, 6 aa, Mycobacterium tuberculosis
AGMQTS

SEQ ID NO: 1397018 - protein, 9 aa, Mycobacterium tuberculosis
AGNEGASSS

SEQ ID NO: 1397019 - protein, 6 aa, Mycobacterium tuberculosis
AGNGGS

SEQ ID NO: 1397020 - protein, 7 aa, Mycobacterium tuberculosis
AGNSAAA

SEQ ID NO: 1397021 - protein, 5 aa, Mycobacterium tuberculosis
AGNTG

SEQ ID NO: 1397022 - protein, 8 aa, Mycobacterium tuberculosis
AGPAAAPR

SEQ ID NO: 1397023 - protein, 8 aa, Mycobacterium tuberculosis
AGPDRAEK

SEQ ID NO: 1397024 - protein, 15 aa, Mycobacterium tuberculosis
AGPDSTLQSQPANAI

SEQ ID NO: 1397025 - protein, 9 aa, Mycobacterium tuberculosis
AGPDTSATY

SEQ ID NO: 1397026 - protein, 9 aa, Mycobacterium tuberculosis
AGPERATEA

SEQ ID NO: 1397027 - protein, 7 aa, Mycobacterium tuberculosis
AGPGAHG

SEQ ID NO: 1397028 - protein, 15 aa, Mycobacterium tuberculosis
AGPGGAPDAKGPPLI

SEQ ID NO: 1397029 - protein, 8 aa, Mycobacterium tuberculosis
AGPGSAPM

SEQ ID NO: 1397030 - protein, 8 aa, Mycobacterium tuberculosis
AGPGTNGS

SEQ ID NO: 1397031 - protein, 6 aa, Mycobacterium tuberculosis
AGPHPF

SEQ ID NO: 1397032 - protein, 7 aa, Mycobacterium tuberculosis
AGPKEAR

SEQ ID NO: 1397033 - protein, 6 aa, Mycobacterium tuberculosis
AGPKKI

SEQ ID NO: 1397034 - protein, 6 aa, Mycobacterium tuberculosis
AGPPPQ

SEQ ID NO: 1397035 - protein, 6 aa, Mycobacterium tuberculosis
AGPPRK

SEQ ID NO: 1397036 - protein, 5 aa, Mycobacterium tuberculosis
AGPRP

SEQ ID NO: 1397037 - protein, 7 aa, Mycobacterium tuberculosis
AGPTPRL

SEQ ID NO: 1397038 - protein, 13 aa, Mycobacterium tuberculosis
AGQGGGSKGDRGG

SEQ ID NO: 1397039 - protein, 4 aa, Mycobacterium tuberculosis
AGQP

SEQ ID NO: 1397040 - protein, 13 aa, Mycobacterium tuberculosis
AGQPAKLFRATVG

SEQ ID NO: 1397041 - protein, 6 aa, Mycobacterium tuberculosis
AGQPMP

SEQ ID NO: 1397042 - protein, 6 aa, Mycobacterium tuberculosis
AGQPQL

SEQ ID NO: 1397043 - protein, 9 aa, Mycobacterium tuberculosis
AGQQPGFRG

SEQ ID NO: 1397044 - protein, 9 aa, Mycobacterium tuberculosis
AGQTALPDI

SEQ ID NO: 1397045 - protein, 9 aa, Mycobacterium tuberculosis
AGRAAVTRT

SEQ ID NO: 1397046 - protein, 15 aa, Mycobacterium tuberculosis
AGRAPSPARENTSYR

SEQ ID NO: 1397047 - protein, 6 aa, Mycobacterium tuberculosis
AGRDDT

SEQ ID NO: 1397048 - protein, 7 aa, Mycobacterium tuberculosis
AGRDERS

SEQ ID NO: 1397049 - protein, 14 aa, Mycobacterium tuberculosis
AGRGDPSPRRDPEE

SEQ ID NO: 1397050 - protein, 11 aa, Mycobacterium tuberculosis
AGRGTKGRQLS

SEQ ID NO: 1397051 - protein, 9 aa, Mycobacterium tuberculosis
AGRHGPSGR

SEQ ID NO: 1397052 - protein, 6 aa, Mycobacterium tuberculosis
AGRPEL

SEQ ID NO: 1397053 - protein, 6 aa, Mycobacterium tuberculosis
AGRRGG

SEQ ID NO: 1397054 - protein, 12 aa, Mycobacterium tuberculosis
AGRRNPAVTAQA

SEQ ID NO: 1397055 - protein, 6 aa, Mycobacterium tuberculosis
AGRSDN

SEQ ID NO: 1397056 - protein, 8 aa, Mycobacterium tuberculosis
AGRTGTDV

SEQ ID NO: 1397057 - protein, 6 aa, Mycobacterium tuberculosis
AGRTPN

SEQ ID NO: 1397058 - protein, 8 aa, Mycobacterium tuberculosis
AGRTTYRQ

SEQ ID NO: 1397059 - protein, 6 aa, Mycobacterium tuberculosis
AGRYPT

SEQ ID NO: 1397060 - protein, 5 aa, Mycobacterium tuberculosis
AGSAE

SEQ ID NO: 1397061 - protein, 29 aa, Mycobacterium tuberculosis
AGSAPRAADPKLDAANAAALASSAKNRHE

SEQ ID NO: 1397062 - protein, 6 aa, Mycobacterium tuberculosis
AGSATP

SEQ ID NO: 1397063 - protein, 10 aa, Mycobacterium tuberculosis
AGSEHGSAKT

SEQ ID NO: 1397064 - protein, 8 aa, Mycobacterium tuberculosis
AGSEPARR

SEQ ID NO: 1397065 - protein, 5 aa, Mycobacterium tuberculosis
AGSGA

SEQ ID NO: 1397066 - protein, 6 aa, Mycobacterium tuberculosis
AGSGIR

SEQ ID NO: 1397067 - protein, 7 aa, Mycobacterium tuberculosis
AGSGNVS

SEQ ID NO: 1397068 - protein, 9 aa, Mycobacterium tuberculosis
AGSNAQSQL

SEQ ID NO: 1397069 - protein, 10 aa, Mycobacterium tuberculosis
AGSNIGGIAE

SEQ ID NO: 1397070 - protein, 9 aa, Mycobacterium tuberculosis
AGSNPGSAA

SEQ ID NO: 1397071 - protein, 8 aa, Mycobacterium tuberculosis
AGSPDTSA

SEQ ID NO: 1397072 - protein, 13 aa, Mycobacterium tuberculosis
AGSPERDFGERSA

SEQ ID NO: 1397073 - protein, 7 aa, Mycobacterium tuberculosis
AGSQTGV

SEQ ID NO: 1397074 - protein, 7 aa, Mycobacterium tuberculosis
AGSSAGA

SEQ ID NO: 1397075 - protein, 7 aa, Mycobacterium tuberculosis
AGTADAR

SEQ ID NO: 1397076 - protein, 10 aa, Mycobacterium tuberculosis
AGTDAGSTIE

SEQ ID NO: 1397077 - protein, 14 aa, Mycobacterium tuberculosis
AGTDEQHPDSQGRI

SEQ ID NO: 1397078 - protein, 13 aa, Mycobacterium tuberculosis
AGTDGQDQTEARD

SEQ ID NO: 1397079 - protein, 10 aa, Mycobacterium tuberculosis
AGTGGTSATI

SEQ ID NO: 1397080 - protein, 7 aa, Mycobacterium tuberculosis
AGTGKLT

SEQ ID NO: 1397081 - protein, 9 aa, Mycobacterium tuberculosis
AGTGKTRTI

SEQ ID NO: 1397082 - protein, 7 aa, Mycobacterium tuberculosis
AGTIGAA

SEQ ID NO: 1397083 - protein, 8 aa, Mycobacterium tuberculosis
AGTNYNKT

SEQ ID NO: 1397084 - protein, 7 aa, Mycobacterium tuberculosis
AGTPPDA

SEQ ID NO: 1397085 - protein, 7 aa, Mycobacterium tuberculosis
AGTPQRR

SEQ ID NO: 1397086 - protein, 13 aa, Mycobacterium tuberculosis
AGTPVKANRSAHG

SEQ ID NO: 1397087 - protein, 6 aa, Mycobacterium tuberculosis
AGTRGV

SEQ ID NO: 1397088 - protein, 9 aa, Mycobacterium tuberculosis
AGTRSAREL

SEQ ID NO: 1397089 - protein, 7 aa, Mycobacterium tuberculosis
AGTSDDA

SEQ ID NO: 1397090 - protein, 6 aa, Mycobacterium tuberculosis
AGTTAN

SEQ ID NO: 1397091 - protein, 9 aa, Mycobacterium tuberculosis
AGTTGYSEQ

SEQ ID NO: 1397092 - protein, 7 aa, Mycobacterium tuberculosis
AGTTSPV

SEQ ID NO: 1397093 - protein, 6 aa, Mycobacterium tuberculosis
AGTVKP

SEQ ID NO: 1397094 - protein, 7 aa, Mycobacterium tuberculosis
AGTYDTA

SEQ ID NO: 1397095 - protein, 11 aa, Mycobacterium tuberculosis
AGVDGSNVGRS

SEQ ID NO: 1397096 - protein, 7 aa, Mycobacterium tuberculosis
AGVDPDS

SEQ ID NO: 1397097 - protein, 7 aa, Mycobacterium tuberculosis
AGVGGAD

SEQ ID NO: 1397098 - protein, 7 aa, Mycobacterium tuberculosis
AGVQPET

SEQ ID NO: 1397099 - protein, 17 aa, Mycobacterium tuberculosis
AGVRGEDAAEHLREAMT

SEQ ID NO: 1397100 - protein, 5 aa, Mycobacterium tuberculosis
AGVRP

SEQ ID NO: 1397101 - protein, 6 aa, Mycobacterium tuberculosis
AGWEER

SEQ ID NO: 1397102 - protein, 7 aa, Mycobacterium tuberculosis
AGYTEQD

SEQ ID NO: 1397103 - protein, 12 aa, Mycobacterium tuberculosis
AHADRRAAGAWA

SEQ ID NO: 1397104 - protein, 9 aa, Mycobacterium tuberculosis
AHGGGGKGM

SEQ ID NO: 1397105 - protein, 17 aa, Mycobacterium tuberculosis
AHKRSGAEVATGRSAGR

SEQ ID NO: 1397106 - protein, 5 aa, Mycobacterium tuberculosis
AHPDR

SEQ ID NO: 1397107 - protein, 13 aa, Mycobacterium tuberculosis
AHPELKSRPTRPH

SEQ ID NO: 1397108 - protein, 16 aa, Mycobacterium tuberculosis
AHQDRADDAEKSLAET

SEQ ID NO: 1397109 - protein, 9 aa, Mycobacterium tuberculosis
AHTAEAGAA

SEQ ID NO: 1397110 - protein, 6 aa, Mycobacterium tuberculosis
AHTEPY

SEQ ID NO: 1397111 - protein, 10 aa, Mycobacterium tuberculosis
AIANGSEPWR

SEQ ID NO: 1397112 - protein, 14 aa, Mycobacterium tuberculosis
AIGARAAGRPLDTT

SEQ ID NO: 1397113 - protein, 7 aa, Mycobacterium tuberculosis
AIGGTRA

SEQ ID NO: 1397114 - protein, 15 aa, Mycobacterium tuberculosis
AIGYEPADITDEEQT

SEQ ID NO: 1397115 - protein, 5 aa, Mycobacterium tuberculosis
AIPER

SEQ ID NO: 1397116 - protein, 9 aa, Mycobacterium tuberculosis
AIPGELDDA

SEQ ID NO: 1397117 - protein, 6 aa, Mycobacterium tuberculosis
AIPQTG

SEQ ID NO: 1397118 - protein, 12 aa, Mycobacterium tuberculosis
AIRSSAESYDRA

SEQ ID NO: 1397119 - protein, 5 aa, Mycobacterium tuberculosis
AISEG

SEQ ID NO: 1397120 - protein, 7 aa, Mycobacterium tuberculosis
AISERIA

SEQ ID NO: 1397121 - protein, 5 aa, Mycobacterium tuberculosis
AISSR

SEQ ID NO: 1397122 - protein, 15 aa, Mycobacterium tuberculosis
AISTTQRGARSGGIV

SEQ ID NO: 1397123 - protein, 19 aa, Mycobacterium tuberculosis
AKAAALAARGERDAVAGRR

SEQ ID NO: 1397124 - protein, 8 aa, Mycobacterium tuberculosis
AKAAGAAG

SEQ ID NO: 1397125 - protein, 7 aa, Mycobacterium tuberculosis
AKAAGAK

SEQ ID NO: 1397126 - protein, 12 aa, Mycobacterium tuberculosis
AKAAGDAVRNGD

SEQ ID NO: 1397127 - protein, 6 aa, Mycobacterium tuberculosis
AKAAGI

SEQ ID NO: 1397128 - protein, 9 aa, Mycobacterium tuberculosis
AKAARSGRT

SEQ ID NO: 1397129 - protein, 7 aa, Mycobacterium tuberculosis
AKADLHS

SEQ ID NO: 1397130 - protein, 9 aa, Mycobacterium tuberculosis
AKAGNPNRP

SEQ ID NO: 1397131 - protein, 6 aa, Mycobacterium tuberculosis
AKAGRQ

SEQ ID NO: 1397132 - protein, 19 aa, Mycobacterium tuberculosis
AKAKDQISGVSTTKPSPLL

SEQ ID NO: 1397133 - protein, 10 aa, Mycobacterium tuberculosis
AKAKGHLDAG

SEQ ID NO: 1397134 - protein, 7 aa, Mycobacterium tuberculosis
AKAPAAF

SEQ ID NO: 1397135 - protein, 13 aa, Mycobacterium tuberculosis
AKAQETKEKAAGA

SEQ ID NO: 1397136 - protein, 7 aa, Mycobacterium tuberculosis
AKAQTAE

SEQ ID NO: 1397137 - protein, 8 aa, Mycobacterium tuberculosis
AKATPPPF

SEQ ID NO: 1397138 - protein, 23 aa, Mycobacterium tuberculosis
AKDGAGAGTIPDPFGGPGRSPTM

SEQ ID NO: 1397139 - protein, 12 aa, Mycobacterium tuberculosis
AKDGDRRVPPTF

SEQ ID NO: 1397140 - protein, 8 aa, Mycobacterium tuberculosis
AKDGSPKI

SEQ ID NO: 1397141 - protein, 8 aa, Mycobacterium tuberculosis
AKDKSIPL

SEQ ID NO: 1397142 - protein, 9 aa, Mycobacterium tuberculosis
AKDSRTTAE

SEQ ID NO: 1397143 - protein, 8 aa, Mycobacterium tuberculosis
AKENTRRV

SEQ ID NO: 1397144 - protein, 6 aa, Mycobacterium tuberculosis
AKEQQL

SEQ ID NO: 1397145 - protein, 12 aa, Mycobacterium tuberculosis
AKFTPAREALDN

SEQ ID NO: 1397146 - protein, 8 aa, Mycobacterium tuberculosis
AKGAGISR

SEQ ID NO: 1397147 - protein, 7 aa, Mycobacterium tuberculosis
AKGASEI

SEQ ID NO: 1397148 - protein, 7 aa, Mycobacterium tuberculosis
AKGGHPV

SEQ ID NO: 1397149 - protein, 10 aa, Mycobacterium tuberculosis
AKGGVTLHPN

SEQ ID NO: 1397150 - protein, 15 aa, Mycobacterium tuberculosis
AKGHPRAQERDDALS

SEQ ID NO: 1397151 - protein, 5 aa, Mycobacterium tuberculosis
AKGKA

SEQ ID NO: 1397152 - protein, 15 aa, Mycobacterium tuberculosis
AKGNSDSWPDTKNPL

SEQ ID NO: 1397153 - protein, 13 aa, Mycobacterium tuberculosis
AKGPFDGGAEGSA

SEQ ID NO: 1397154 - protein, 7 aa, Mycobacterium tuberculosis
AKGRAAL

SEQ ID NO: 1397155 - protein, 5 aa, Mycobacterium tuberculosis
AKGRQ

SEQ ID NO: 1397156 - protein, 4 aa, Mycobacterium tuberculosis
AKGV

SEQ ID NO: 1397157 - protein, 9 aa, Mycobacterium tuberculosis
AKIGPDKDI

SEQ ID NO: 1397158 - protein, 8 aa, Mycobacterium tuberculosis
AKKPEETR

SEQ ID NO: 1397159 - protein, 7 aa, Mycobacterium tuberculosis
AKKRALH

SEQ ID NO: 1397160 - protein, 6 aa, Mycobacterium tuberculosis
AKLTNT

SEQ ID NO: 1397161 - protein, 8 aa, Mycobacterium tuberculosis
AKNHPSAA

SEQ ID NO: 1397162 - protein, 7 aa, Mycobacterium tuberculosis
AKNIPAD

SEQ ID NO: 1397163 - protein, 9 aa, Mycobacterium tuberculosis
AKNRGGTPD

SEQ ID NO: 1397164 - protein, 13 aa, Mycobacterium tuberculosis
AKPAAQQPTWPAD

SEQ ID NO: 1397165 - protein, 24 aa, Mycobacterium tuberculosis
AKPAIDRKRTTRVAPDGGSPDGPR

SEQ ID NO: 1397166 - protein, 9 aa, Mycobacterium tuberculosis
AKPEPVGNI

SEQ ID NO: 1397167 - protein, 10 aa, Mycobacterium tuberculosis
AKPGEPFQPY

SEQ ID NO: 1397168 - protein, 8 aa, Mycobacterium tuberculosis
AKPLDSIG

SEQ ID NO: 1397169 - protein, 13 aa, Mycobacterium tuberculosis
AKPPITVTDPPAD

SEQ ID NO: 1397170 - protein, 10 aa, Mycobacterium tuberculosis
AKPPPSGSPG

SEQ ID NO: 1397171 - protein, 10 aa, Mycobacterium tuberculosis
AKPTPADAAD

SEQ ID NO: 1397172 - protein, 10 aa, Mycobacterium tuberculosis
AKQTAKSGAT

SEQ ID NO: 1397173 - protein, 7 aa, Mycobacterium tuberculosis
AKRGDAS

SEQ ID NO: 1397174 - protein, 18 aa, Mycobacterium tuberculosis
AKSALDPAGILNPGVLLG

SEQ ID NO: 1397175 - protein, 12 aa, Mycobacterium tuberculosis
AKSEVTKAEKYE

SEQ ID NO: 1397176 - protein, 4 aa, Mycobacterium tuberculosis
AKSM

SEQ ID NO: 1397177 - protein, 7 aa, Mycobacterium tuberculosis
AKTAGRN

SEQ ID NO: 1397178 - protein, 9 aa, Mycobacterium tuberculosis
AKTEPIGEE

SEQ ID NO: 1397179 - protein, 5 aa, Mycobacterium tuberculosis
AKTGM

SEQ ID NO: 1397180 - protein, 4 aa, Mycobacterium tuberculosis
AKVN

SEQ ID NO: 1397181 - protein, 10 aa, Mycobacterium tuberculosis
ALADGPEGSA

SEQ ID NO: 1397182 - protein, 6 aa, Mycobacterium tuberculosis
ALAPGT

SEQ ID NO: 1397183 - protein, 10 aa, Mycobacterium tuberculosis
ALATKDPRGL

SEQ ID NO: 1397184 - protein, 8 aa, Mycobacterium tuberculosis
ALDETGCP

SEQ ID NO: 1397185 - protein, 9 aa, Mycobacterium tuberculosis
ALDSGKPVR

SEQ ID NO: 1397186 - protein, 7 aa, Mycobacterium tuberculosis
ALEQGKG

SEQ ID NO: 1397187 - protein, 4 aa, Mycobacterium tuberculosis
ALES

SEQ ID NO: 1397188 - protein, 5 aa, Mycobacterium tuberculosis
ALGEP

SEQ ID NO: 1397189 - protein, 5 aa, Mycobacterium tuberculosis
ALGNN

SEQ ID NO: 1397190 - protein, 6 aa, Mycobacterium tuberculosis
ALGPGT

SEQ ID NO: 1397191 - protein, 8 aa, Mycobacterium tuberculosis
ALNNSGTT

SEQ ID NO: 1397192 - protein, 13 aa, Mycobacterium tuberculosis
ALPAPVKPTAAPL

SEQ ID NO: 1397193 - protein, 6 aa, Mycobacterium tuberculosis
ALPDSA

SEQ ID NO: 1397194 - protein, 19 aa, Mycobacterium tuberculosis
ALPPGVGKSGQHGHGTGQY

SEQ ID NO: 1397195 - protein, 13 aa, Mycobacterium tuberculosis
ALPPSEDFESGAR

SEQ ID NO: 1397196 - protein, 8 aa, Mycobacterium tuberculosis
ALPSPGRV

SEQ ID NO: 1397197 - protein, 10 aa, Mycobacterium tuberculosis
ALPSPGSDEQ

SEQ ID NO: 1397198 - protein, 4 aa, Mycobacterium tuberculosis
ALRG

SEQ ID NO: 1397199 - protein, 11 aa, Mycobacterium tuberculosis
ALSDQETQALQ

SEQ ID NO: 1397200 - protein, 6 aa, Mycobacterium tuberculosis
ALSGEQ

SEQ ID NO: 1397201 - protein, 8 aa, Mycobacterium tuberculosis
ALSGRGVG

SEQ ID NO: 1397202 - protein, 9 aa, Mycobacterium tuberculosis
ALSSPSGVG

SEQ ID NO: 1397203 - protein, 6 aa, Mycobacterium tuberculosis
ALTESP

SEQ ID NO: 1397204 - protein, 15 aa, Mycobacterium tuberculosis
ALTGSPGQSAYSAAN

SEQ ID NO: 1397205 - protein, 5 aa, Mycobacterium tuberculosis
ALTSP

SEQ ID NO: 1397206 - protein, 16 aa, Mycobacterium tuberculosis
ALTSRSCNGSLDTQQR

SEQ ID NO: 1397207 - protein, 5 aa, Mycobacterium tuberculosis
AMENA

SEQ ID NO: 1397208 - protein, 4 aa, Mycobacterium tuberculosis
AMEP

SEQ ID NO: 1397209 - protein, 14 aa, Mycobacterium tuberculosis
AMPATRIPGRQGAG

SEQ ID NO: 1397210 - protein, 10 aa, Mycobacterium tuberculosis
ANAARLRSSA

SEQ ID NO: 1397211 - protein, 4 aa, Mycobacterium tuberculosis
ANAG

SEQ ID NO: 1397212 - protein, 5 aa, Mycobacterium tuberculosis
ANDAD

SEQ ID NO: 1397213 - protein, 12 aa, Mycobacterium tuberculosis
ANDTKRVTSLLN

SEQ ID NO: 1397214 - protein, 12 aa, Mycobacterium tuberculosis
ANDYVGKGLSGG

SEQ ID NO: 1397215 - protein, 5 aa, Mycobacterium tuberculosis
ANGDK

SEQ ID NO: 1397216 - protein, 9 aa, Mycobacterium tuberculosis
ANGEPTEDQ

SEQ ID NO: 1397217 - protein, 6 aa, Mycobacterium tuberculosis
ANGHTV

SEQ ID NO: 1397218 - protein, 7 aa, Mycobacterium tuberculosis
ANGKATL

SEQ ID NO: 1397219 - protein, 7 aa, Mycobacterium tuberculosis
ANGPSGG

SEQ ID NO: 1397220 - protein, 6 aa, Mycobacterium tuberculosis
ANKAAA

SEQ ID NO: 1397221 - protein, 17 aa, Mycobacterium tuberculosis
ANKTRESLQATAQLTQT

SEQ ID NO: 1397222 - protein, 7 aa, Mycobacterium tuberculosis
ANLGGNN

SEQ ID NO: 1397223 - protein, 9 aa, Mycobacterium tuberculosis
ANPEDYTNR

SEQ ID NO: 1397224 - protein, 8 aa, Mycobacterium tuberculosis
ANPGTITG

SEQ ID NO: 1397225 - protein, 11 aa, Mycobacterium tuberculosis
ANPPTDKSDRD

SEQ ID NO: 1397226 - protein, 6 aa, Mycobacterium tuberculosis
ANPSHL

SEQ ID NO: 1397227 - protein, 8 aa, Mycobacterium tuberculosis
ANQQAAQR

SEQ ID NO: 1397228 - protein, 15 aa, Mycobacterium tuberculosis
ANRPTALSSDPRTGL

SEQ ID NO: 1397229 - protein, 12 aa, Mycobacterium tuberculosis
ANRSAPGRPGVL

SEQ ID NO: 1397230 - protein, 6 aa, Mycobacterium tuberculosis
ANRSNA

SEQ ID NO: 1397231 - protein, 5 aa, Mycobacterium tuberculosis
ANSDL

SEQ ID NO: 1397232 - protein, 7 aa, Mycobacterium tuberculosis
ANSEDAA

SEQ ID NO: 1397233 - protein, 8 aa, Mycobacterium tuberculosis
ANSPIDAD

SEQ ID NO: 1397234 - protein, 10 aa, Mycobacterium tuberculosis
ANSQADAEDV

SEQ ID NO: 1397235 - protein, 6 aa, Mycobacterium tuberculosis
ANTAVQ

SEQ ID NO: 1397236 - protein, 5 aa, Mycobacterium tuberculosis
ANVDA

SEQ ID NO: 1397237 - protein, 6 aa, Mycobacterium tuberculosis
ANVRTR

SEQ ID NO: 1397238 - protein, 4 aa, Mycobacterium tuberculosis
ANYD

SEQ ID NO: 1397239 - protein, 13 aa, Mycobacterium tuberculosis
APAAQPAQPGSAG

SEQ ID NO: 1397240 - protein, 5 aa, Mycobacterium tuberculosis
APAAR

SEQ ID NO: 1397241 - protein, 14 aa, Mycobacterium tuberculosis
APAASGAPHAAGGR

SEQ ID NO: 1397242 - protein, 10 aa, Mycobacterium tuberculosis
APADREQKAR

SEQ ID NO: 1397243 - protein, 10 aa, Mycobacterium tuberculosis
APAGPGSSVT

SEQ ID NO: 1397244 - protein, 4 aa, Mycobacterium tuberculosis
APAI

SEQ ID NO: 1397245 - protein, 10 aa, Mycobacterium tuberculosis
APAKDDPRLV

SEQ ID NO: 1397246 - protein, 5 aa, Mycobacterium tuberculosis
APAKV

SEQ ID NO: 1397247 - protein, 13 aa, Mycobacterium tuberculosis
APAKVKGPIEGTG

SEQ ID NO: 1397248 - protein, 9 aa, Mycobacterium tuberculosis
APAPRQYTR

SEQ ID NO: 1397249 - protein, 9 aa, Mycobacterium tuberculosis
APASADRSR

SEQ ID NO: 1397250 - protein, 6 aa, Mycobacterium tuberculosis
APATTH

SEQ ID NO: 1397251 - protein, 12 aa, Mycobacterium tuberculosis
APDAAAREHDPS

SEQ ID NO: 1397252 - protein, 10 aa, Mycobacterium tuberculosis
APDAQNDPIG

SEQ ID NO: 1397253 - protein, 12 aa, Mycobacterium tuberculosis
APDDAPAAALSS

SEQ ID NO: 1397254 - protein, 5 aa, Mycobacterium tuberculosis
APDDS

SEQ ID NO: 1397255 - protein, 12 aa, Mycobacterium tuberculosis
APDFEPAHSRRT

SEQ ID NO: 1397256 - protein, 4 aa, Mycobacterium tuberculosis
APDG

SEQ ID NO: 1397257 - protein, 6 aa, Mycobacterium tuberculosis
APDPAR

SEQ ID NO: 1397258 - protein, 7 aa, Mycobacterium tuberculosis
APDPDGG

SEQ ID NO: 1397259 - protein, 6 aa, Mycobacterium tuberculosis
APEADG

SEQ ID NO: 1397260 - protein, 8 aa, Mycobacterium tuberculosis
APENPYPA

SEQ ID NO: 1397261 - protein, 6 aa, Mycobacterium tuberculosis
APERFG

SEQ ID NO: 1397262 - protein, 8 aa, Mycobacterium tuberculosis
APERPQEA

SEQ ID NO: 1397263 - protein, 5 aa, Mycobacterium tuberculosis
APGAS

SEQ ID NO: 1397264 - protein, 5 aa, Mycobacterium tuberculosis
APGDI

SEQ ID NO: 1397265 - protein, 13 aa, Mycobacterium tuberculosis
APGEPAIPTRTIP

SEQ ID NO: 1397266 - protein, 6 aa, Mycobacterium tuberculosis
APGGRA

SEQ ID NO: 1397267 - protein, 4 aa, Mycobacterium tuberculosis
APGH

SEQ ID NO: 1397268 - protein, 9 aa, Mycobacterium tuberculosis
APGHDPQLR

SEQ ID NO: 1397269 - protein, 12 aa, Mycobacterium tuberculosis
APGPPHSLLGRD

SEQ ID NO: 1397270 - protein, 5 aa, Mycobacterium tuberculosis
APGQT

SEQ ID NO: 1397271 - protein, 5 aa, Mycobacterium tuberculosis
APGSD

SEQ ID NO: 1397272 - protein, 5 aa, Mycobacterium tuberculosis
APGSP

SEQ ID NO: 1397273 - protein, 9 aa, Mycobacterium tuberculosis
APGTPDDPI

SEQ ID NO: 1397274 - protein, 5 aa, Mycobacterium tuberculosis
APGVS

SEQ ID NO: 1397275 - protein, 8 aa, Mycobacterium tuberculosis
APHSPMAG

SEQ ID NO: 1397276 - protein, 11 aa, Mycobacterium tuberculosis
APINATAKAGL

SEQ ID NO: 1397277 - protein, 7 aa, Mycobacterium tuberculosis
APKEHGS

SEQ ID NO: 1397278 - protein, 10 aa, Mycobacterium tuberculosis
APKGSGTEVT

SEQ ID NO: 1397279 - protein, 7 aa, Mycobacterium tuberculosis
APKPMLP

SEQ ID NO: 1397280 - protein, 11 aa, Mycobacterium tuberculosis
APLEKTAEATG

SEQ ID NO: 1397281 - protein, 8 aa, Mycobacterium tuberculosis
APLEPGQK

SEQ ID NO: 1397282 - protein, 7 aa, Mycobacterium tuberculosis
APLESNA

SEQ ID NO: 1397283 - protein, 12 aa, Mycobacterium tuberculosis
APLGTGAGRVRT

SEQ ID NO: 1397284 - protein, 6 aa, Mycobacterium tuberculosis
APLPCT

SEQ ID NO: 1397285 - protein, 7 aa, Mycobacterium tuberculosis
APLPPVG

SEQ ID NO: 1397286 - protein, 11 aa, Mycobacterium tuberculosis
APLSASGDAVP

SEQ ID NO: 1397287 - protein, 8 aa, Mycobacterium tuberculosis
APNAPGSI

SEQ ID NO: 1397288 - protein, 8 aa, Mycobacterium tuberculosis
APNCGEAS

SEQ ID NO: 1397289 - protein, 9 aa, Mycobacterium tuberculosis
APNDFTDPR

SEQ ID NO: 1397290 - protein, 4 aa, Mycobacterium tuberculosis
APNG

SEQ ID NO: 1397291 - protein, 7 aa, Mycobacterium tuberculosis
APNPDFP

SEQ ID NO: 1397292 - protein, 8 aa, Mycobacterium tuberculosis
APNTGGES

SEQ ID NO: 1397293 - protein, 8 aa, Mycobacterium tuberculosis
APPGTVGS

SEQ ID NO: 1397294 - protein, 4 aa, Mycobacterium tuberculosis
APPL

SEQ ID NO: 1397295 - protein, 7 aa, Mycobacterium tuberculosis
APPTAAE

SEQ ID NO: 1397296 - protein, 6 aa, Mycobacterium tuberculosis
APPTAR

SEQ ID NO: 1397297 - protein, 6 aa, Mycobacterium tuberculosis
APPVEE

SEQ ID NO: 1397298 - protein, 8 aa, Mycobacterium tuberculosis
APQKGADM

SEQ ID NO: 1397299 - protein, 9 aa, Mycobacterium tuberculosis
APQPAQPWP

SEQ ID NO: 1397300 - protein, 6 aa, Mycobacterium tuberculosis
APQRSG

SEQ ID NO: 1397301 - protein, 5 aa, Mycobacterium tuberculosis
APQST

SEQ ID NO: 1397302 - protein, 20 aa, Mycobacterium tuberculosis
APQTRADPVPGTSRRNRGAA

SEQ ID NO: 1397303 - protein, 10 aa, Mycobacterium tuberculosis
APRKRANPDM

SEQ ID NO: 1397304 - protein, 6 aa, Mycobacterium tuberculosis
APRPGQ

SEQ ID NO: 1397305 - protein, 7 aa, Mycobacterium tuberculosis
APRSPAD

SEQ ID NO: 1397306 - protein, 6 aa, Mycobacterium tuberculosis
APRSRF

SEQ ID NO: 1397307 - protein, 11 aa, Mycobacterium tuberculosis
APRYDPGGGGI

SEQ ID NO: 1397308 - protein, 7 aa, Mycobacterium tuberculosis
APSPDRL

SEQ ID NO: 1397309 - protein, 16 aa, Mycobacterium tuberculosis
APSPEPDSSRATSADT

SEQ ID NO: 1397310 - protein, 21 aa, Mycobacterium tuberculosis
APSWDAGDPRAYSVSDTANAW

SEQ ID NO: 1397311 - protein, 8 aa, Mycobacterium tuberculosis
APTADEVG

SEQ ID NO: 1397312 - protein, 33 aa, Mycobacterium tuberculosis; identical to SEQ ID NO: 169435

SEQ ID NO: 1397313 - protein, 5 aa, Mycobacterium tuberculosis
APTDG

SEQ ID NO: 1397314 - protein, 5 aa, Mycobacterium tuberculosis
APTDQ

SEQ ID NO: 1397315 - protein, 14 aa, Mycobacterium tuberculosis
APTGRFRRWRSRHL

SEQ ID NO: 1397316 - protein, 4 aa, Mycobacterium tuberculosis
APTI

SEQ ID NO: 1397317 - protein, 5 aa, Mycobacterium tuberculosis
APTLR

SEQ ID NO: 1397318 - protein, 5 aa, Mycobacterium tuberculosis
APTNG

SEQ ID NO: 1397319 - protein, 11 aa, Mycobacterium tuberculosis
APTREAQDRFN

SEQ ID NO: 1397320 - protein, 7 aa, Mycobacterium tuberculosis
APVPEGD

SEQ ID NO: 1397321 - protein, 12 aa, Mycobacterium tuberculosis
APVQTDDAEGDL

SEQ ID NO: 1397322 - protein, 7 aa, Mycobacterium tuberculosis
APVRAAD

SEQ ID NO: 1397323 - protein, 5 aa, Mycobacterium tuberculosis
APVSG

SEQ ID NO: 1397324 - protein, 7 aa, Mycobacterium tuberculosis
APVTPEA

SEQ ID NO: 1397325 - protein, 6 aa, Mycobacterium tuberculosis
APWPPE

SEQ ID NO: 1397326 - protein, 11 aa, Mycobacterium tuberculosis
APYGRGASPAE

SEQ ID NO: 1397327 - protein, 5 aa, Mycobacterium tuberculosis
AQAEE

SEQ ID NO: 1397328 - protein, 8 aa, Mycobacterium tuberculosis
AQAGNATL

SEQ ID NO: 1397329 - protein, 4 aa, Mycobacterium tuberculosis
AQAL

SEQ ID NO: 1397330 - protein, 9 aa, Mycobacterium tuberculosis
AQANGDTPV

SEQ ID NO: 1397331 - protein, 14 aa, Mycobacterium tuberculosis
AQDISETDLAGRYE

SEQ ID NO: 1397332 - protein, 7 aa, Mycobacterium tuberculosis
AQEGRSH

SEQ ID NO: 1397333 - protein, 14 aa, Mycobacterium tuberculosis
AQEPNYEAALAALG

SEQ ID NO: 1397334 - protein, 8 aa, Mycobacterium tuberculosis
AQFDAGES

SEQ ID NO: 1397335 - protein, 5 aa, Mycobacterium tuberculosis
AQGGG

SEQ ID NO: 1397336 - protein, 8 aa, Mycobacterium tuberculosis
AQGPTANP

SEQ ID NO: 1397337 - protein, 16 aa, Mycobacterium tuberculosis
AQHPATNSAQTRSEEI

SEQ ID NO: 1397338 - protein, 5 aa, Mycobacterium tuberculosis
AQHRG

SEQ ID NO: 1397339 - protein, 12 aa, Mycobacterium tuberculosis
AQIPPPDERRGY

SEQ ID NO: 1397340 - protein, 8 aa, Mycobacterium tuberculosis
AQKVSETA

SEQ ID NO: 1397341 - protein, 4 aa, Mycobacterium tuberculosis
AQLA

SEQ ID NO: 1397342 - protein, 12 aa, Mycobacterium tuberculosis
AQLPDRSGDGLR

SEQ ID NO: 1397343 - protein, 6 aa, Mycobacterium tuberculosis
AQNATK

SEQ ID NO: 1397344 - protein, 7 aa, Mycobacterium tuberculosis
AQNTTAE

SEQ ID NO: 1397345 - protein, 4 aa, Mycobacterium tuberculosis
AQNY

SEQ ID NO: 1397346 - protein, 7 aa, Mycobacterium tuberculosis
AQPAPGM

SEQ ID NO: 1397347 - protein, 11 aa, Mycobacterium tuberculosis
AQPSLHKGHRA

SEQ ID NO: 1397348 - protein, 9 aa, Mycobacterium tuberculosis
AQQAGAGGV

SEQ ID NO: 1397349 - protein, 7 aa, Mycobacterium tuberculosis
AQQAGRQ

SEQ ID NO: 1397350 - protein, 8 aa, Mycobacterium tuberculosis
AQQPNGYT

SEQ ID NO: 1397351 - protein, 5 aa, Mycobacterium tuberculosis
AQRGA

SEQ ID NO: 1397352 - protein, 15 aa, Mycobacterium tuberculosis
AQRGRGERKRPARGW

SEQ ID NO: 1397353 - protein, 4 aa, Mycobacterium tuberculosis
AQRP

SEQ ID NO: 1397354 - protein, 9 aa, Mycobacterium tuberculosis
AQRVSGADH

SEQ ID NO: 1397355 - protein, 4 aa, Mycobacterium tuberculosis
AQSA

SEQ ID NO: 1397356 - protein, 6 aa, Mycobacterium tuberculosis
AQSAHP

SEQ ID NO: 1397357 - protein, 13 aa, Mycobacterium tuberculosis
AQSHGHNAEIELV

SEQ ID NO: 1397358 - protein, 6 aa, Mycobacterium tuberculosis
AQSKGL

SEQ ID NO: 1397359 - protein, 4 aa, Mycobacterium tuberculosis
AQSV

SEQ ID NO: 1397360 - protein, 8 aa, Mycobacterium tuberculosis
AQTAGSVA

SEQ ID NO: 1397361 - protein, 7 aa, Mycobacterium tuberculosis
AQTGGAA

SEQ ID NO: 1397362 - protein, 13 aa, Mycobacterium tuberculosis
AQTGPEGGSEPQV

SEQ ID NO: 1397363 - protein, 9 aa, Mycobacterium tuberculosis
AQTGTGKTA

SEQ ID NO: 1397364 - protein, 6 aa, Mycobacterium tuberculosis
AQTPDT

SEQ ID NO: 1397365 - protein, 8 aa, Mycobacterium tuberculosis
AQTPSEVE

SEQ ID NO: 1397366 - protein, 22 aa, Mycobacterium tuberculosis
AQTRSRPYQKNDQAHVESKNNH

SEQ ID NO: 1397367 - protein, 4 aa, Mycobacterium tuberculosis
AQWR

SEQ ID NO: 1397368 - protein, 12 aa, Mycobacterium tuberculosis
AQYEDQGNPYYS

SEQ ID NO: 1397369 - protein, 5 aa, Mycobacterium tuberculosis
ARAAG

SEQ ID NO: 1397370 - protein, 8 aa, Mycobacterium tuberculosis
ARAAQSAD

SEQ ID NO: 1397371 - protein, 7 aa, Mycobacterium tuberculosis
ARADLGQ

SEQ ID NO: 1397372 - protein, 6 aa, Mycobacterium tuberculosis
ARAEPV

SEQ ID NO: 1397373 - protein, 13 aa, Mycobacterium tuberculosis
ARAEQRAPVFTDD

SEQ ID NO: 1397374 - protein, 9 aa, Mycobacterium tuberculosis
ARAERGEPD

SEQ ID NO: 1397375 - protein, 5 aa, Mycobacterium tuberculosis
ARAGE

SEQ ID NO: 1397376 - protein, 5 aa, Mycobacterium tuberculosis
ARAGG

SEQ ID NO: 1397377 - protein, 5 aa, Mycobacterium tuberculosis
ARAKM

SEQ ID NO: 1397378 - protein, 12 aa, Mycobacterium tuberculosis
ARANGGEPDAGR

SEQ ID NO: 1397379 - protein, 8 aa, Mycobacterium tuberculosis
ARAQTGKA

SEQ ID NO: 1397380 - protein, 7 aa, Mycobacterium tuberculosis
ARARDLK

SEQ ID NO: 1397381 - protein, 25 aa, Mycobacterium tuberculosis
ARARPNGGGPISRPTSGWHQQPKTR

SEQ ID NO: 1397382 - protein, 17 aa, Mycobacterium tuberculosis
ARARSGNLKPDELSGGT

SEQ ID NO: 1397383 - protein, 12 aa, Mycobacterium tuberculosis
ARARSRARTKAR

SEQ ID NO: 1397384 - protein, 5 aa, Mycobacterium tuberculosis
ARATD

SEQ ID NO: 1397385 - protein, 10 aa, Mycobacterium tuberculosis
ARDADRAGQP

SEQ ID NO: 1397386 - protein, 52 aa, Mycobacterium tuberculosis; identical to SEQ ID NO: 193731

SEQ ID NO: 1397387 - protein, 5 aa, Mycobacterium tuberculosis
ARDGA

SEQ ID NO: 1397388 - protein, 9 aa, Mycobacterium tuberculosis
ARDGHSDYG

SEQ ID NO: 1397389 - protein, 10 aa, Mycobacterium tuberculosis
ARDGKLTTED

SEQ ID NO: 1397390 - protein, 5 aa, Mycobacterium tuberculosis
ARDHR

SEQ ID NO: 1397391 - protein, 5 aa, Mycobacterium tuberculosis
AREAG

SEQ ID NO: 1397392 - protein, 7 aa, Mycobacterium tuberculosis
AREEAEQ

SEQ ID NO: 1397393 - protein, 5 aa, Mycobacterium tuberculosis
ARELN

SEQ ID NO: 1397394 - protein, 8 aa, Mycobacterium tuberculosis
AREPRREP

SEQ ID NO: 1397395 - protein, 11 aa, Mycobacterium tuberculosis
ARERDPAAPTA

SEQ ID NO: 1397396 - protein, 16 aa, Mycobacterium tuberculosis
ARERTPSPPPVDSADD

SEQ ID NO: 1397397 - protein, 7 aa, Mycobacterium tuberculosis
ARETGRA

SEQ ID NO: 1397398 - protein, 11 aa, Mycobacterium tuberculosis
AREVNKRKNER

SEQ ID NO: 1397399 - protein, 7 aa, Mycobacterium tuberculosis
AREVRDT

SEQ ID NO: 1397400 - protein, 10 aa, Mycobacterium tuberculosis
ARGAEKTPEG

SEQ ID NO: 1397401 - protein, 13 aa, Mycobacterium tuberculosis
ARGGDSARTRSCP

SEQ ID NO: 1397402 - protein, 15 aa, Mycobacterium tuberculosis
ARGGTSLGEGPARAW

SEQ ID NO: 1397403 - protein, 12 aa, Mycobacterium tuberculosis
ARGGVGAGPDVR

SEQ ID NO: 1397404 - protein, 9 aa, Mycobacterium tuberculosis
ARGQDPDKV

SEQ ID NO: 1397405 - protein, 8 aa, Mycobacterium tuberculosis
ARGQPGYR

SEQ ID NO: 1397406 - protein, 7 aa, Mycobacterium tuberculosis
ARGRGPV

SEQ ID NO: 1397407 - protein, 6 aa, Mycobacterium tuberculosis
ARGSGY

SEQ ID NO: 1397408 - protein, 4 aa, Mycobacterium tuberculosis
ARHS

SEQ ID NO: 1397409 - protein, 4 aa, Mycobacterium tuberculosis
ARID

SEQ ID NO: 1397410 - protein, 13 aa, Mycobacterium tuberculosis
ARIDPPGPSPAGP

SEQ ID NO: 1397411 - protein, 9 aa, Mycobacterium tuberculosis
ARKDGYTST

SEQ ID NO: 1397412 - protein, 8 aa, Mycobacterium tuberculosis
ARKGDNAP

SEQ ID NO: 1397413 - protein, 12 aa, Mycobacterium tuberculosis
ARKLETGDQGAS

SEQ ID NO: 1397414 - protein, 5 aa, Mycobacterium tuberculosis
ARLAG

SEQ ID NO: 1397415 - protein, 10 aa, Mycobacterium tuberculosis
ARLPSSAEAP

SEQ ID NO: 1397416 - protein, 11 aa, Mycobacterium tuberculosis
ARLTPRSSSRQ

SEQ ID NO: 1397417 - protein, 12 aa, Mycobacterium tuberculosis
ARNATAAEGLDQ

SEQ ID NO: 1397418 - protein, 6 aa, Mycobacterium tuberculosis
ARNNDK

SEQ ID NO: 1397419 - protein, 24 aa, Mycobacterium tuberculosis
ARPARPPRGSGGTRTARNGARTAS

SEQ ID NO: 1397420 - protein, 8 aa, Mycobacterium tuberculosis
ARPDGHGA

SEQ ID NO: 1397421 - protein, 5 aa, Mycobacterium tuberculosis
ARPDQ

SEQ ID NO: 1397422 - protein, 8 aa, Mycobacterium tuberculosis
ARPEDAGD

SEQ ID NO: 1397423 - protein, 5 aa, Mycobacterium tuberculosis
ARPER

SEQ ID NO: 1397424 - protein, 7 aa, Mycobacterium tuberculosis
ARPGDGP

SEQ ID NO: 1397425 - protein, 33 aa, Mycobacterium tuberculosis; identical to SEQ ID NO: 169787

SEQ ID NO: 1397426 - protein, 6 aa, Mycobacterium tuberculosis
ARPTAL

SEQ ID NO: 1397427 - protein, 4 aa, Mycobacterium tuberculosis
ARPV

SEQ ID NO: 1397428 - protein, 17 aa, Mycobacterium tuberculosis
ARPWTNRQATDNSTVPD

SEQ ID NO: 1397429 - protein, 4 aa, Mycobacterium tuberculosis
ARQK

SEQ ID NO: 1397430 - protein, 6 aa, Mycobacterium tuberculosis
ARQPGR

SEQ ID NO: 1397431 - protein, 10 aa, Mycobacterium tuberculosis
ARQRAGTADV

SEQ ID NO: 1397432 - protein, 11 aa, Mycobacterium tuberculosis
ARRAAGRDAPE

SEQ ID NO: 1397433 - protein, 8 aa, Mycobacterium tuberculosis
ARRAGADA

SEQ ID NO: 1397434 - protein, 9 aa, Mycobacterium tuberculosis
ARRAGRAPE

SEQ ID NO: 1397435 - protein, 12 aa, Mycobacterium tuberculosis
ARRDGQDPYPPA

SEQ ID NO: 1397436 - protein, 13 aa, Mycobacterium tuberculosis
ARRDQVRATGRSI

SEQ ID NO: 1397437 - protein, 7 aa, Mycobacterium tuberculosis
ARRENTT

SEQ ID NO: 1397438 - protein, 6 aa, Mycobacterium tuberculosis
ARRGER

SEQ ID NO: 1397439 - protein, 11 aa, Mycobacterium tuberculosis
ARRGSVTDLSP

SEQ ID NO: 1397440 - protein, 8 aa, Mycobacterium tuberculosis
ARRGTANS

SEQ ID NO: 1397441 - protein, 11 aa, Mycobacterium tuberculosis
ARRNPNAQTRG

SEQ ID NO: 1397442 - protein, 5 aa, Mycobacterium tuberculosis
ARRNS

SEQ ID NO: 1397443 - protein, 9 aa, Mycobacterium tuberculosis
ARRPEGATV

SEQ ID NO: 1397444 - protein, 7 aa, Mycobacterium tuberculosis
ARRQRQY

SEQ ID NO: 1397445 - protein, 14 aa, Mycobacterium tuberculosis
ARRRQGSAPPGPLQ

SEQ ID NO: 1397446 - protein, 8 aa, Mycobacterium tuberculosis
ARRRYQTG

SEQ ID NO: 1397447 - protein, 11 aa, Mycobacterium tuberculosis
ARRSGASWSDI

SEQ ID NO: 1397448 - protein, 8 aa, Mycobacterium tuberculosis
ARRSNGRR

SEQ ID NO: 1397449 - protein, 9 aa, Mycobacterium tuberculosis
ARSADPGER

SEQ ID NO: 1397450 - protein, 13 aa, Mycobacterium tuberculosis
ARSASEYGQEIPL

SEQ ID NO: 1397451 - protein, 5 aa, Mycobacterium tuberculosis
ARSEW

SEQ ID NO: 1397452 - protein, 7 aa, Mycobacterium tuberculosis
ARSGGTL

SEQ ID NO: 1397453 - protein, 7 aa, Mycobacterium tuberculosis
ARSGTPV

SEQ ID NO: 1397454 - protein, 16 aa, Mycobacterium tuberculosis
ARSHADPAAAGRRSPL

SEQ ID NO: 1397455 - protein, 12 aa, Mycobacterium tuberculosis
ARSNCGEGGEDV

SEQ ID NO: 1397456 - protein, 7 aa, Mycobacterium tuberculosis
ARSQGRK

SEQ ID NO: 1397457 - protein, 34 aa, Mycobacterium tuberculosis; identical to SEQ ID NO: 169872

SEQ ID NO: 1397458 - protein, 15 aa, Mycobacterium tuberculosis
ARSVEGAGPGPEGNI

SEQ ID NO: 1397459 - protein, 5 aa, Mycobacterium tuberculosis
ARSVG

SEQ ID NO: 1397460 - protein, 8 aa, Mycobacterium tuberculosis
ARTAGSGE

SEQ ID NO: 1397461 - protein, 19 aa, Mycobacterium tuberculosis
ARTDAERLRDEDVSTEPDA

SEQ ID NO: 1397462 - protein, 5 aa, Mycobacterium tuberculosis
ARTDQ

SEQ ID NO: 1397463 - protein, 11 aa, Mycobacterium tuberculosis
ARTGADNPFDR

SEQ ID NO: 1397464 - protein, 11 aa, Mycobacterium tuberculosis
ARTGTNQTAAV

SEQ ID NO: 1397465 - protein, 6 aa, Mycobacterium tuberculosis
ARTPTA

SEQ ID NO: 1397466 - protein, 4 aa, Mycobacterium tuberculosis
ARYD

SEQ ID NO: 1397467 - protein, 19 aa, Mycobacterium tuberculosis
ARYERSDTRVTDRNGARSR

SEQ ID NO: 1397468 - protein, 7 aa, Mycobacterium tuberculosis
ASAAEAR

SEQ ID NO: 1397469 - protein, 8 aa, Mycobacterium tuberculosis
ASAAESIE

SEQ ID NO: 1397470 - protein, 5 aa, Mycobacterium tuberculosis
ASAAR

SEQ ID NO: 1397471 - protein, 6 aa, Mycobacterium tuberculosis
ASAASI

SEQ ID NO: 1397472 - protein, 5 aa, Mycobacterium tuberculosis
ASAAT

SEQ ID NO: 1397473 - protein, 10 aa, Mycobacterium tuberculosis
ASADPGRPTN

SEQ ID NO: 1397474 - protein, 10 aa, Mycobacterium tuberculosis
ASADPPSPDE

SEQ ID NO: 1397475 - protein, 13 aa, Mycobacterium tuberculosis
ASAEKPATEQAEP

SEQ ID NO: 1397476 - protein, 7 aa, Mycobacterium tuberculosis
ASAGATA

SEQ ID NO: 1397477 - protein, 16 aa, Mycobacterium tuberculosis
ASAPEARAEILEPVPL

SEQ ID NO: 1397478 - protein, 10 aa, Mycobacterium tuberculosis
ASAPGPDIDG

SEQ ID NO: 1397479 - protein, 14 aa, Mycobacterium tuberculosis
ASAQAQLAAGQAKA

SEQ ID NO: 1397480 - protein, 8 aa, Mycobacterium tuberculosis
ASATDVSK

SEQ ID NO: 1397481 - protein, 14 aa, Mycobacterium tuberculosis
ASATFDRPALGPSA

SEQ ID NO: 1397482 - protein, 7 aa, Mycobacterium tuberculosis
ASATRPH

SEQ ID NO: 1397483 - protein, 19 aa, Mycobacterium tuberculosis
ASAVEAAAAEYANNEAAAA

SEQ ID NO: 1397484 - protein, 5 aa, Mycobacterium tuberculosis
ASDEF

SEQ ID NO: 1397485 - protein, 8 aa, Mycobacterium tuberculosis
ASDEPNRA

SEQ ID NO: 1397486 - protein, 9 aa, Mycobacterium tuberculosis
ASDPQSAGR

SEQ ID NO: 1397487 - protein, 8 aa, Mycobacterium tuberculosis
ASDRGYDE

SEQ ID NO: 1397488 - protein, 8 aa, Mycobacterium tuberculosis
ASDSEPAF

SEQ ID NO: 1397489 - protein, 7 aa, Mycobacterium tuberculosis
ASDSPHG

SEQ ID NO: 1397490 - protein, 12 aa, Mycobacterium tuberculosis
ASEAAGRDPDTL

SEQ ID NO: 1397491 - protein, 9 aa, Mycobacterium tuberculosis
ASEEALARD

SEQ ID NO: 1397492 - protein, 6 aa, Mycobacterium tuberculosis
ASEKAA

SEQ ID NO: 1397493 - protein, 6 aa, Mycobacterium tuberculosis
ASERAG

SEQ ID NO: 1397494 - protein, 6 aa, Mycobacterium tuberculosis
ASESLT

SEQ ID NO: 1397495 - protein, 8 aa, Mycobacterium tuberculosis
ASESPNHR

SEQ ID NO: 1397496 - protein, 5 aa, Mycobacterium tuberculosis
ASFEG

SEQ ID NO: 1397497 - protein, 6 aa, Mycobacterium tuberculosis
ASGAEA

SEQ ID NO: 1397498 - protein, 9 aa, Mycobacterium tuberculosis
ASGEDETAW

SEQ ID NO: 1397499 - protein, 8 aa, Mycobacterium tuberculosis
ASGEDPQR

SEQ ID NO: 1397500 - protein, 5 aa, Mycobacterium tuberculosis
ASGER

SEQ ID NO: 1397501 - protein, 5 aa, Mycobacterium tuberculosis
ASGGR

SEQ ID NO: 1397502 - protein, 7 aa, Mycobacterium tuberculosis
ASGIGRA

SEQ ID NO: 1397503 - protein, 8 aa, Mycobacterium tuberculosis
ASGNESIG

SEQ ID NO: 1397504 - protein, 13 aa, Mycobacterium tuberculosis
ASGNIDATRANPS

SEQ ID NO: 1397505 - protein, 16 aa, Mycobacterium tuberculosis
ASGNVEGDRHQPPPVT

SEQ ID NO: 1397506 - protein, 9 aa, Mycobacterium tuberculosis
ASGPEAAAR

SEQ ID NO: 1397507 - protein, 7 aa, Mycobacterium tuberculosis
ASGPVYD

SEQ ID NO: 1397508 - protein, 13 aa, Mycobacterium tuberculosis
ASGYAGRQSQAEP

SEQ ID NO: 1397509 - protein, 12 aa, Mycobacterium tuberculosis
ASHGGVDDTREL

SEQ ID NO: 1397510 - protein, 6 aa, Mycobacterium tuberculosis
ASIRNN

SEQ ID NO: 1397511 - protein, 13 aa, Mycobacterium tuberculosis
ASKATRPEVRGGL

SEQ ID NO: 1397512 - protein, 14 aa, Mycobacterium tuberculosis
ASLNDAETKASCSG

SEQ ID NO: 1397513 - protein, 7 aa, Mycobacterium tuberculosis
ASMDGNK

SEQ ID NO: 1397514 - protein, 7 aa, Mycobacterium tuberculosis
ASNPERA

SEQ ID NO: 1397515 - protein, 7 aa, Mycobacterium tuberculosis
ASNTPLQ

SEQ ID NO: 1397516 - protein, 8 aa, Mycobacterium tuberculosis
ASPAGPKV

SEQ ID NO: 1397517 - protein, 5 aa, Mycobacterium tuberculosis
ASPDL

SEQ ID NO: 1397518 - protein, 7 aa, Mycobacterium tuberculosis
ASPERRK

SEQ ID NO: 1397519 - protein, 5 aa, Mycobacterium tuberculosis
ASPFH

SEQ ID NO: 1397520 - protein, 10 aa, Mycobacterium tuberculosis
ASPLPGPSGN

SEQ ID NO: 1397521 - protein, 8 aa, Mycobacterium tuberculosis
ASPPKGID

SEQ ID NO: 1397522 - protein, 4 aa, Mycobacterium tuberculosis
ASQA

SEQ ID NO: 1397523 - protein, 5 aa, Mycobacterium tuberculosis
ASQGI

SEQ ID NO: 1397524 - protein, 10 aa, Mycobacterium tuberculosis
ASRADKSAAY

SEQ ID NO: 1397525 - protein, 8 aa, Mycobacterium tuberculosis
ASRAEQGL

SEQ ID NO: 1397526 - protein, 7 aa, Mycobacterium tuberculosis
ASREDLP

SEQ ID NO: 1397527 - protein, 6 aa, Mycobacterium tuberculosis
ASRELR

SEQ ID NO: 1397528 - protein, 7 aa, Mycobacterium tuberculosis
ASRETVN

SEQ ID NO: 1397529 - protein, 7 aa, Mycobacterium tuberculosis
ASRGEPH

SEQ ID NO: 1397530 - protein, 15 aa, Mycobacterium tuberculosis
ASRQPRETPATLPCK

SEQ ID NO: 1397531 - protein, 5 aa, Mycobacterium tuberculosis
ASRRT

SEQ ID NO: 1397532 - protein, 7 aa, Mycobacterium tuberculosis
ASRVQPG

SEQ ID NO: 1397533 - protein, 8 aa, Mycobacterium tuberculosis
ASSCGQGG

SEQ ID NO: 1397534 - protein, 12 aa, Mycobacterium tuberculosis
ASSDDGLPPGSL

SEQ ID NO: 1397535 - protein, 6 aa, Mycobacterium tuberculosis
ASSGIG

SEQ ID NO: 1397536 - protein, 12 aa, Mycobacterium tuberculosis
ASSGIGAAATKQ

SEQ ID NO: 1397537 - protein, 7 aa, Mycobacterium tuberculosis
ASSGVSA

SEQ ID NO: 1397538 - protein, 8 aa, Mycobacterium tuberculosis
ASSSGRAT

SEQ ID NO: 1397539 - protein, 4 aa, Mycobacterium tuberculosis
ASSV

SEQ ID NO: 1397540 - protein, 7 aa, Mycobacterium tuberculosis
ASTAGQR

SEQ ID NO: 1397541 - protein, 11 aa, Mycobacterium tuberculosis
ASTDGSRGSKV

SEQ ID NO: 1397542 - protein, 5 aa, Mycobacterium tuberculosis
ASTEE

SEQ ID NO: 1397543 - protein, 7 aa, Mycobacterium tuberculosis
ASTGGNI

SEQ ID NO: 1397544 - protein, 10 aa, Mycobacterium tuberculosis
ASTRQAGSAV

SEQ ID NO: 1397545 - protein, 10 aa, Mycobacterium tuberculosis
ASVPKTSTYA

SEQ ID NO: 1397546 - protein, 14 aa, Mycobacterium tuberculosis
ASVSDPDAAPPTFS

SEQ ID NO: 1397547 - protein, 8 aa, Mycobacterium tuberculosis
ASWAGPDE

SEQ ID NO: 1397548 - protein, 10 aa, Mycobacterium tuberculosis
ASYNEDTKEI

SEQ ID NO: 1397549 - protein, 9 aa, Mycobacterium tuberculosis
ATAAAASGA

SEQ ID NO: 1397550 - protein, 4 aa, Mycobacterium tuberculosis
ATAD

SEQ ID NO: 1397551 - protein, 5 aa, Mycobacterium tuberculosis
ATADG

SEQ ID NO: 1397552 - protein, 8 aa, Mycobacterium tuberculosis
ATADTASR

SEQ ID NO: 1397553 - protein, 6 aa, Mycobacterium tuberculosis
ATAKEA

SEQ ID NO: 1397554 - protein, 8 aa, Mycobacterium tuberculosis
ATANAGGL

SEQ ID NO: 1397555 - protein, 8 aa, Mycobacterium tuberculosis
ATAPGATL

SEQ ID NO: 1397556 - protein, 7 aa, Mycobacterium tuberculosis
ATAPGIE

SEQ ID NO: 1397557 - protein, 10 aa, Mycobacterium tuberculosis
ATAPPADQIA

SEQ ID NO: 1397558 - protein, 30 aa, Mycobacterium tuberculosis; identical to SEQ ID NO: 170252

SEQ ID NO: 1397559 - protein, 7 aa, Mycobacterium tuberculosis
ATATAPL

SEQ ID NO: 1397560 - protein, 8 aa, Mycobacterium tuberculosis
ATATPQVD

SEQ ID NO: 1397561 - protein, 7 aa, Mycobacterium tuberculosis
ATDAGTA

SEQ ID NO: 1397562 - protein, 9 aa, Mycobacterium tuberculosis
ATDDLDDPA

SEQ ID NO: 1397563 - protein, 14 aa, Mycobacterium tuberculosis
ATDERVAAAVGRLT

SEQ ID NO: 1397564 - protein, 20 aa, Mycobacterium tuberculosis
ATDGRTPCEPGSAANKAGTL

SEQ ID NO: 1397565 - protein, 12 aa, Mycobacterium tuberculosis
ATDNAVRGNETE

SEQ ID NO: 1397566 - protein, 8 aa, Mycobacterium tuberculosis
ATDPGTPV

SEQ ID NO: 1397567 - protein, 10 aa, Mycobacterium tuberculosis
ATDPPPGKDR

SEQ ID NO: 1397568 - protein, 8 aa, Mycobacterium tuberculosis
ATDPRHPF

SEQ ID NO: 1397569 - protein, 8 aa, Mycobacterium tuberculosis
ATDQPESL

SEQ ID NO: 1397570 - protein, 7 aa, Mycobacterium tuberculosis
ATDSAVG

SEQ ID NO: 1397571 - protein, 4 aa, Mycobacterium tuberculosis
ATEA

SEQ ID NO: 1397572 - protein, 6 aa, Mycobacterium tuberculosis
ATEAEQ

SEQ ID NO: 1397573 - protein, 8 aa, Mycobacterium tuberculosis
ATECKDRS

SEQ ID NO: 1397574 - protein, 23 aa, Mycobacterium tuberculosis
ATEELEGYRSRATAETELPPARP

SEQ ID NO: 1397575 - protein, 5 aa, Mycobacterium tuberculosis
ATEFG

SEQ ID NO: 1397576 - protein, 4 aa, Mycobacterium tuberculosis
ATEH

SEQ ID NO: 1397577 - protein, 4 aa, Mycobacterium tuberculosis
ATEN

SEQ ID NO: 1397578 - protein, 7 aa, Mycobacterium tuberculosis
ATEPTGM

SEQ ID NO: 1397579 - protein, 6 aa, Mycobacterium tuberculosis
ATGDDK

SEQ ID NO: 1397580 - protein, 10 aa, Mycobacterium tuberculosis
ATGEHTKNNA

SEQ ID NO: 1397581 - protein, 9 aa, Mycobacterium tuberculosis
ATGHADGPT

SEQ ID NO: 1397582 - protein, 6 aa, Mycobacterium tuberculosis
ATGKGA

SEQ ID NO: 1397583 - protein, 6 aa, Mycobacterium tuberculosis
ATGPED

SEQ ID NO: 1397584 - protein, 6 aa, Mycobacterium tuberculosis
ATGPQH

SEQ ID NO: 1397585 - protein, 10 aa, Mycobacterium tuberculosis
ATGTVQGPQA

SEQ ID NO: 1397586 - protein, 13 aa, Mycobacterium tuberculosis
ATGYTAQRPLTGD

SEQ ID NO: 1397587 - protein, 4 aa, Mycobacterium tuberculosis
ATHA

SEQ ID NO: 1397588 - protein, 21 aa, Mycobacterium tuberculosis
ATHSRSDRESVRGRLSGRTQE

SEQ ID NO: 1397589 - protein, 5 aa, Mycobacterium tuberculosis
ATKAD

SEQ ID NO: 1397590 - protein, 11 aa, Mycobacterium tuberculosis
ATKESTTSPSV

SEQ ID NO: 1397591 - protein, 9 aa, Mycobacterium tuberculosis
ATKGDGATI

SEQ ID NO: 1397592 - protein, 5 aa, Mycobacterium tuberculosis
ATKGI

SEQ ID NO: 1397593 - protein, 7 aa, Mycobacterium tuberculosis
ATKPERL

SEQ ID NO: 1397594 - protein, 5 aa, Mycobacterium tuberculosis
ATKRT

SEQ ID NO: 1397595 - protein, 6 aa, Mycobacterium tuberculosis
ATLEQP

SEQ ID NO: 1397596 - protein, 7 aa, Mycobacterium tuberculosis
ATNAIDP

SEQ ID NO: 1397597 - protein, 6 aa, Mycobacterium tuberculosis
ATNAST

SEQ ID NO: 1397598 - protein, 17 aa, Mycobacterium tuberculosis
ATNGAQALDRARETRPD

SEQ ID NO: 1397599 - protein, 6 aa, Mycobacterium tuberculosis
ATPAES

SEQ ID NO: 1397600 - protein, 7 aa, Mycobacterium tuberculosis
ATPAGWS

SEQ ID NO: 1397601 - protein, 7 aa, Mycobacterium tuberculosis
ATPATEL

SEQ ID NO: 1397602 - protein, 6 aa, Mycobacterium tuberculosis
ATPATL

SEQ ID NO: 1397603 - protein, 10 aa, Mycobacterium tuberculosis
ATPDKRSTTV

SEQ ID NO: 1397604 - protein, 7 aa, Mycobacterium tuberculosis
ATPDTTN

SEQ ID NO: 1397605 - protein, 9 aa, Mycobacterium tuberculosis
ATPGRDEVG

SEQ ID NO: 1397606 - protein, 4 aa, Mycobacterium tuberculosis
ATPL

SEQ ID NO: 1397607 - protein, 4 aa, Mycobacterium tuberculosis
ATPM

SEQ ID NO: 1397608 - protein, 7 aa, Mycobacterium tuberculosis
ATPPGAG

SEQ ID NO: 1397609 - protein, 6 aa, Mycobacterium tuberculosis
ATPQEA

SEQ ID NO: 1397610 - protein, 4 aa, Mycobacterium tuberculosis
ATPR

SEQ ID NO: 1397611 - protein, 11 aa, Mycobacterium tuberculosis
ATPRASQLDDA

SEQ ID NO: 1397612 - protein, 9 aa, Mycobacterium tuberculosis
ATPSQPAQV

SEQ ID NO: 1397613 - protein, 7 aa, Mycobacterium tuberculosis
ATPSRVA

SEQ ID NO: 1397614 - protein, 9 aa, Mycobacterium tuberculosis
ATPVTAGHP

SEQ ID NO: 1397615 - protein, 13 aa, Mycobacterium tuberculosis
ATQAEGAASQAQT

SEQ ID NO: 1397616 - protein, 6 aa, Mycobacterium tuberculosis
ATQEST

SEQ ID NO: 1397617 - protein, 5 aa, Mycobacterium tuberculosis
ATQHR

SEQ ID NO: 1397618 - protein, 7 aa, Mycobacterium tuberculosis
ATQLPTA

SEQ ID NO: 1397619 - protein, 5 aa, Mycobacterium tuberculosis
ATREN

SEQ ID NO: 1397620 - protein, 9 aa, Mycobacterium tuberculosis
ATRGQADAA

SEQ ID NO: 1397621 - protein, 11 aa, Mycobacterium tuberculosis
ATRKSAPDLRL

SEQ ID NO: 1397622 - protein, 6 aa, Mycobacterium tuberculosis
ATRPPA

SEQ ID NO: 1397623 - protein, 9 aa, Mycobacterium tuberculosis
ATSAPKEPL

SEQ ID NO: 1397624 - protein, 6 aa, Mycobacterium tuberculosis
ATSGQP

SEQ ID NO: 1397625 - protein, 5 aa, Mycobacterium tuberculosis
ATSHG

SEQ ID NO: 1397626 - protein, 11 aa, Mycobacterium tuberculosis
ATSKALDKQGI

SEQ ID NO: 1397627 - protein, 4 aa, Mycobacterium tuberculosis
ATSP

SEQ ID NO: 1397628 - protein, 18 aa, Mycobacterium tuberculosis
ATSPGELPNGPQPPADPV

SEQ ID NO: 1397629 - protein, 21 aa, Mycobacterium tuberculosis
ATSPGGGVSASGAGGAASVGN

SEQ ID NO: 1397630 - protein, 7 aa, Mycobacterium tuberculosis
ATSPLPG

SEQ ID NO: 1397631 - protein, 8 aa, Mycobacterium tuberculosis
ATSPMGAP

SEQ ID NO: 1397632 - protein, 6 aa, Mycobacterium tuberculosis
ATSRDF

SEQ ID NO: 1397633 - protein, 17 aa, Mycobacterium tuberculosis
ATSSDTVRSRSLTGKPA

SEQ ID NO: 1397634 - protein, 15 aa, Mycobacterium tuberculosis
ATSTTASSCRARFIR

SEQ ID NO: 1397635 - protein, 5 aa, Mycobacterium tuberculosis
ATSVA

SEQ ID NO: 1397636 - protein, 13 aa, Mycobacterium tuberculosis
ATTDASGYVDPGY

SEQ ID NO: 1397637 - protein, 4 aa, Mycobacterium tuberculosis
ATTF

SEQ ID NO: 1397638 - protein, 13 aa, Mycobacterium tuberculosis
ATTFGPACPQPAI

SEQ ID NO: 1397639 - protein, 6 aa, Mycobacterium tuberculosis
ATTGSL

SEQ ID NO: 1397640 - protein, 5 aa, Mycobacterium tuberculosis
ATTLR

SEQ ID NO: 1397641 - protein, 7 aa, Mycobacterium tuberculosis
ATTTRMR

SEQ ID NO: 1397642 - protein, 26 aa, Mycobacterium tuberculosis
ATTVASNAAAAAPTTGVVPPAADEVS

SEQ ID NO: 1397643 - protein, 6 aa, Mycobacterium tuberculosis
ATVSAG

SEQ ID NO: 1397644 - protein, 13 aa, Mycobacterium tuberculosis
ATVTDSDGNTIDT

SEQ ID NO: 1397645 - protein, 8 aa, Mycobacterium tuberculosis
ATVTTDAK

SEQ ID NO: 1397646 - protein, 7 aa, Mycobacterium tuberculosis
ATYAETG

SEQ ID NO: 1397647 - protein, 10 aa, Mycobacterium tuberculosis
AVAGDVAGAA

SEQ ID NO: 1397648 - protein, 6 aa, Mycobacterium tuberculosis
AVATDP

SEQ ID NO: 1397649 - protein, 7 aa, Mycobacterium tuberculosis
AVDATNG

SEQ ID NO: 1397650 - protein, 4 aa, Mycobacterium tuberculosis
AVDP

SEQ ID NO: 1397651 - protein, 9 aa, Mycobacterium tuberculosis
AVEESGRGR

SEQ ID NO: 1397652 - protein, 9 aa, Mycobacterium tuberculosis
AVEKASDIV

SEQ ID NO: 1397653 - protein, 17 aa, Mycobacterium tuberculosis
AVEPDPRVSGVPSTKGA

SEQ ID NO: 1397654 - protein, 7 aa, Mycobacterium tuberculosis
AVGESGR

SEQ ID NO: 1397655 - protein, 10 aa, Mycobacterium tuberculosis
AVGGSTSCPG

SEQ ID NO: 1397656 - protein, 10 aa, Mycobacterium tuberculosis
AVGGTGAYGM

SEQ ID NO: 1397657 - protein, 8 aa, Mycobacterium tuberculosis
AVGKRGGA

SEQ ID NO: 1397658 - protein, 13 aa, Mycobacterium tuberculosis
AVKSPADLDELAN

SEQ ID NO: 1397659 - protein, 7 aa, Mycobacterium tuberculosis
AVPAQDA

SEQ ID NO: 1397660 - protein, 7 aa, Mycobacterium tuberculosis
AVPPTGS

SEQ ID NO: 1397661 - protein, 6 aa, Mycobacterium tuberculosis
AVPQEK

SEQ ID NO: 1397662 - protein, 8 aa, Mycobacterium tuberculosis
AVPQPSEK

SEQ ID NO: 1397663 - protein, 15 aa, Mycobacterium tuberculosis
AVPTSAPGGPSGTSW

SEQ ID NO: 1397664 - protein, 9 aa, Mycobacterium tuberculosis
AVQPTTHEP

SEQ ID NO: 1397665 - protein, 11 aa, Mycobacterium tuberculosis
AVQRRDSRAPT

SEQ ID NO: 1397666 - protein, 9 aa, Mycobacterium tuberculosis
AVQTAESEL

SEQ ID NO: 1397667 - protein, 5 aa, Mycobacterium tuberculosis
AVRAD

SEQ ID NO: 1397668 - protein, 10 aa, Mycobacterium tuberculosis
AVRGGDRAAL

SEQ ID NO: 1397669 - protein, 5 aa, Mycobacterium tuberculosis
AVRRG

SEQ ID NO: 1397670 - protein, 5 aa, Mycobacterium tuberculosis
AVSAG

SEQ ID NO: 1397671 - protein, 6 aa, Mycobacterium tuberculosis
AVSEPV

SEQ ID NO: 1397672 - protein, 7 aa, Mycobacterium tuberculosis
AVSPTTA

SEQ ID NO: 1397673 - protein, 8 aa, Mycobacterium tuberculosis
AVTAAPDG

SEQ ID NO: 1397674 - protein, 8 aa, Mycobacterium tuberculosis
AVTDGDVD

SEQ ID NO: 1397675 - protein, 6 aa, Mycobacterium tuberculosis
AVTGGP

SEQ ID NO: 1397676 - protein, 9 aa, Mycobacterium tuberculosis
AVTPEKAAD

SEQ ID NO: 1397677 - protein, 14 aa, Mycobacterium tuberculosis
AVTRAGQAARATSV

SEQ ID NO: 1397678 - protein, 17 aa, Mycobacterium tuberculosis
AVTTGDPGPITPQPTPL

SEQ ID NO: 1397679 - protein, 7 aa, Mycobacterium tuberculosis
AWPPNAA

SEQ ID NO: 1397680 - protein, 18 aa, Mycobacterium tuberculosis
AWRSAGGSIETGQVSPQL

SEQ ID NO: 1397681 - protein, 18 aa, Mycobacterium tuberculosis
AWTGEPELAPAAQAARYT

SEQ ID NO: 1397682 - protein, 4 aa, Mycobacterium tuberculosis
AYAY

SEQ ID NO: 1397683 - protein, 5 aa, Mycobacterium tuberculosis
AYEEN

SEQ ID NO: 1397684 - protein, 5 aa, Mycobacterium tuberculosis
AYEPH

SEQ ID NO: 1397685 - protein, 5 aa, Mycobacterium tuberculosis
AYGGA

SEQ ID NO: 1397686 - protein, 7 aa, Mycobacterium tuberculosis
AYGGTVA

SEQ ID NO: 1397687 - protein, 11 aa, Mycobacterium tuberculosis
AYGPDSDEQIN

SEQ ID NO: 1397688 - protein, 6 aa, Mycobacterium tuberculosis
AYHPAN

SEQ ID NO: 1397689 - protein, 13 aa, Mycobacterium tuberculosis
AYPANTEKPEFAD

SEQ ID NO: 1397690 - protein, 5 aa, Mycobacterium tuberculosis
AYPDR

SEQ ID NO: 1397691 - protein, 9 aa, Mycobacterium tuberculosis
AYPPRADGS

SEQ ID NO: 1397692 - protein, 9 aa, Mycobacterium tuberculosis
AYPRPPRGR

SEQ ID NO: 1397693 - protein, 6 aa, Mycobacterium tuberculosis
AYQTGA

SEQ ID NO: 1397694 - protein, 6 aa, Mycobacterium tuberculosis
AYSDDP

SEQ ID NO: 1397695 - protein, 6 aa, Mycobacterium tuberculosis
AYTASG

SEQ ID NO: 1397696 - protein, 8 aa, Mycobacterium tuberculosis
CAEARGKD

SEQ ID NO: 1397697 - protein, 13 aa, Mycobacterium tuberculosis
CAPPGNSPTPAER

SEQ ID NO: 1397698 - protein, 6 aa, Mycobacterium tuberculosis
CASGSV

SEQ ID NO: 1397699 - protein, 8 aa, Mycobacterium tuberculosis
CDAGQTRK

SEQ ID NO: 1397700 - protein, 9 aa, Mycobacterium tuberculosis
CDETPREEV

SEQ ID NO: 1397701 - protein, 4 aa, Mycobacterium tuberculosis
CEEL

SEQ ID NO: 1397702 - protein, 11 aa, Mycobacterium tuberculosis
CEGAANLPDGP

SEQ ID NO: 1397703 - protein, 6 aa, Mycobacterium tuberculosis
CEQRDN

SEQ ID NO: 1397704 - protein, 10 aa, Mycobacterium tuberculosis
CERRDPKGLY

SEQ ID NO: 1397705 - protein, 4 aa, Mycobacterium tuberculosis
CETR

SEQ ID NO: 1397706 - protein, 9 aa, Mycobacterium tuberculosis
CGDRSAAVT

SEQ ID NO: 1397707 - protein, 6 aa, Mycobacterium tuberculosis
CGEGYG

SEQ ID NO: 1397708 - protein, 10 aa, Mycobacterium tuberculosis
CGEPAHDPDF

SEQ ID NO: 1397709 - protein, 12 aa, Mycobacterium tuberculosis
CGGDVGDATPVS

SEQ ID NO: 1397710 - protein, 5 aa, Mycobacterium tuberculosis
CGPDE

SEQ ID NO: 1397711 - protein, 7 aa, Mycobacterium tuberculosis
CGPDGTA

SEQ ID NO: 1397712 - protein, 4 aa, Mycobacterium tuberculosis
CGPE

SEQ ID NO: 1397713 - protein, 4 aa, Mycobacterium tuberculosis
CGPQ

SEQ ID NO: 1397714 - protein, 7 aa, Mycobacterium tuberculosis
CGSGQQA

SEQ ID NO: 1397715 - protein, 5 aa, Mycobacterium tuberculosis
CGSGR

SEQ ID NO: 1397716 - protein, 8 aa, Mycobacterium tuberculosis
CGSPPTDA

SEQ ID NO: 1397717 - protein, 4 aa, Mycobacterium tuberculosis
CGTG

SEQ ID NO: 1397718 - protein, 9 aa, Mycobacterium tuberculosis
CKPGDGLGI

SEQ ID NO: 1397719 - protein, 5 aa, Mycobacterium tuberculosis
CLDDP

SEQ ID NO: 1397720 - protein, 4 aa, Mycobacterium tuberculosis
CNMG

SEQ ID NO: 1397721 - protein, 7 aa, Mycobacterium tuberculosis
CNPTGGL

SEQ ID NO: 1397722 - protein, 14 aa, Mycobacterium tuberculosis
CPGGTGAAKFGGNY

SEQ ID NO: 1397723 - protein, 5 aa, Mycobacterium tuberculosis
CPNCS

SEQ ID NO: 1397724 - protein, 5 aa, Mycobacterium tuberculosis
CPPGA

SEQ ID NO: 1397725 - protein, 5 aa, Mycobacterium tuberculosis
CPPRP

SEQ ID NO: 1397726 - protein, 4 aa, Mycobacterium tuberculosis
CPQE

SEQ ID NO: 1397727 - protein, 9 aa, Mycobacterium tuberculosis
CPSGSGTPL

SEQ ID NO: 1397728 - protein, 4 aa, Mycobacterium tuberculosis
CPTK

SEQ ID NO: 1397729 - protein, 8 aa, Mycobacterium tuberculosis
CQDSGGGA

SEQ ID NO: 1397730 - protein, 13 aa, Mycobacterium tuberculosis
CQQPTQPPDADQT

SEQ ID NO: 1397731 - protein, 19 aa, Mycobacterium tuberculosis
CRTGPPQPLLPGRQPFSTA

SEQ ID NO: 1397732 - protein, 14 aa, Mycobacterium tuberculosis
CSEEGTTLSDNEIR

SEQ ID NO: 1397733 - protein, 6 aa, Mycobacterium tuberculosis
CSPDSF

SEQ ID NO: 1397734 - protein, 9 aa, Mycobacterium tuberculosis
CSPTSDGSA

SEQ ID NO: 1397735 - protein, 8 aa, Mycobacterium tuberculosis
CTNTSNPE

SEQ ID NO: 1397736 - protein, 10 aa, Mycobacterium tuberculosis
CTSPDGTPCR

SEQ ID NO: 1397737 - protein, 8 aa, Mycobacterium tuberculosis
CYGQPPDN

SEQ ID NO: 1397738 - protein, 6 aa, Mycobacterium tuberculosis
DAAAAD

SEQ ID NO: 1397739 - protein, 6 aa, Mycobacterium tuberculosis
DAADAA

SEQ ID NO: 1397740 - protein, 7 aa, Mycobacterium tuberculosis
DAADRGE

SEQ ID NO: 1397741 - protein, 9 aa, Mycobacterium tuberculosis
DAAEAERSG

SEQ ID NO: 1397742 - protein, 7 aa, Mycobacterium tuberculosis
DAAPDQI

SEQ ID NO: 1397743 - protein, 7 aa, Mycobacterium tuberculosis
DAAQGTR

SEQ ID NO: 1397744 - protein, 9 aa, Mycobacterium tuberculosis
DAARAGNSS

SEQ ID NO: 1397745 - protein, 6 aa, Mycobacterium tuberculosis
DAARYA

SEQ ID NO: 1397746 - protein, 9 aa, Mycobacterium tuberculosis
DAASAAAKV

SEQ ID NO: 1397747 - protein, 9 aa, Mycobacterium tuberculosis
DADADGRDV

SEQ ID NO: 1397748 - protein, 9 aa, Mycobacterium tuberculosis
DADAEDMGR

SEQ ID NO: 1397749 - protein, 16 aa, Mycobacterium tuberculosis
DADDVTSFSSGEPSLD

SEQ ID NO: 1397750 - protein, 7 aa, Mycobacterium tuberculosis
DADEDPE

SEQ ID NO: 1397751 - protein, 6 aa, Mycobacterium tuberculosis
DADGGF

SEQ ID NO: 1397752 - protein, 8 aa, Mycobacterium tuberculosis
DADGTKAG

SEQ ID NO: 1397753 - protein, 11 aa, Mycobacterium tuberculosis
DADQLRGQAGR

SEQ ID NO: 1397754 - protein, 8 aa, Mycobacterium tuberculosis
DADTVNAA

SEQ ID NO: 1397755 - protein, 7 aa, Mycobacterium tuberculosis
DAEADDD

SEQ ID NO: 1397756 - protein, 8 aa, Mycobacterium tuberculosis
DAEAEDRH

SEQ ID NO: 1397757 - protein, 8 aa, Mycobacterium tuberculosis
DAEAGPTE

SEQ ID NO: 1397758 - protein, 8 aa, Mycobacterium tuberculosis
DAEAVESG

SEQ ID NO: 1397759 - protein, 9 aa, Mycobacterium tuberculosis
DAEDLGGGA

SEQ ID NO: 1397760 - protein, 7 aa, Mycobacterium tuberculosis
DAEGADE

SEQ ID NO: 1397761 - protein, 6 aa, Mycobacterium tuberculosis
DAEHEH

SEQ ID NO: 1397762 - protein, 6 aa, Mycobacterium tuberculosis
DAEPHR

SEQ ID NO: 1397763 - protein, 5 aa, Mycobacterium tuberculosis
DAEPI

SEQ ID NO: 1397764 - protein, 6 aa, Mycobacterium tuberculosis
DAEQTH

SEQ ID NO: 1397765 - protein, 9 aa, Mycobacterium tuberculosis
DAERGTGGN

SEQ ID NO: 1397766 - protein, 7 aa, Mycobacterium tuberculosis
DAESDEV

SEQ ID NO: 1397767 - protein, 7 aa, Mycobacterium tuberculosis
DAFPPAN

SEQ ID NO: 1397768 - protein, 8 aa, Mycobacterium tuberculosis
DAGADTVD

SEQ ID NO: 1397769 - protein, 5 aa, Mycobacterium tuberculosis
DAGDE

SEQ ID NO: 1397770 - protein, 10 aa, Mycobacterium tuberculosis
DAGDHAEGAW

SEQ ID NO: 1397771 - protein, 6 aa, Mycobacterium tuberculosis
DAGDPV

SEQ ID NO: 1397772 - protein, 6 aa, Mycobacterium tuberculosis
DAGGGI

SEQ ID NO: 1397773 - protein, 7 aa, Mycobacterium tuberculosis
DAGGRPL

SEQ ID NO: 1397774 - protein, 8 aa, Mycobacterium tuberculosis
DAGHGDSI

SEQ ID NO: 1397775 - protein, 4 aa, Mycobacterium tuberculosis
DAGI

SEQ ID NO: 1397776 - protein, 9 aa, Mycobacterium tuberculosis
DAGIEDGQQ

SEQ ID NO: 1397777 - protein, 7 aa, Mycobacterium tuberculosis
DAGLPAE

SEQ ID NO: 1397778 - protein, 5 aa, Mycobacterium tuberculosis
DAGPV

SEQ ID NO: 1397779 - protein, 10 aa, Mycobacterium tuberculosis
DAGQGETELS

SEQ ID NO: 1397780 - protein, 14 aa, Mycobacterium tuberculosis
DAGQRGQLVGSQEE

SEQ ID NO: 1397781 - protein, 10 aa, Mycobacterium tuberculosis
DAGSSTYSLP

SEQ ID NO: 1397782 - protein, 4 aa, Mycobacterium tuberculosis
DAGT

SEQ ID NO: 1397783 - protein, 10 aa, Mycobacterium tuberculosis
DAGWARKTAA

SEQ ID NO: 1397784 - protein, 7 aa, Mycobacterium tuberculosis
DAHAPGQ

SEQ ID NO: 1397785 - protein, 9 aa, Mycobacterium tuberculosis
DAIDGRPRG

SEQ ID NO: 1397786 - protein, 8 aa, Mycobacterium tuberculosis
DAIRGTGS

SEQ ID NO: 1397787 - protein, 6 aa, Mycobacterium tuberculosis
DAKYGE

SEQ ID NO: 1397788 - protein, 6 aa, Mycobacterium tuberculosis
DALPNG

SEQ ID NO: 1397789 - protein, 8 aa, Mycobacterium tuberculosis
DALPRRRG

SEQ ID NO: 1397790 - protein, 6 aa, Mycobacterium tuberculosis
DALRDG

SEQ ID NO: 1397791 - protein, 5 aa, Mycobacterium tuberculosis
DAMTQ

SEQ ID NO: 1397792 - protein, 7 aa, Mycobacterium tuberculosis
DAPAVPN

SEQ ID NO: 1397793 - protein, 6 aa, Mycobacterium tuberculosis
DAPDGL

SEQ ID NO: 1397794 - protein, 7 aa, Mycobacterium tuberculosis
DAPDNEA

SEQ ID NO: 1397795 - protein, 7 aa, Mycobacterium tuberculosis
DAPEGTK

SEQ ID NO: 1397796 - protein, 13 aa, Mycobacterium tuberculosis
DAPLSDDVLERFH

SEQ ID NO: 1397797 - protein, 10 aa, Mycobacterium tuberculosis
DAPPDIGPEE

SEQ ID NO: 1397798 - protein, 8 aa, Mycobacterium tuberculosis
DAPTRANA

SEQ ID NO: 1397799 - protein, 6 aa, Mycobacterium tuberculosis
DAPVAD

SEQ ID NO: 1397800 - protein, 12 aa, Mycobacterium tuberculosis
DAPVTLSTPTDR

SEQ ID NO: 1397801 - protein, 10 aa, Mycobacterium tuberculosis
DAQAPDRHET

SEQ ID NO: 1397802 - protein, 8 aa, Mycobacterium tuberculosis
DAQDTAEL

SEQ ID NO: 1397803 - protein, 8 aa, Mycobacterium tuberculosis
DAQGRAVR

SEQ ID NO: 1397804 - protein, 12 aa, Mycobacterium tuberculosis
DAQPDGELPPFG

SEQ ID NO: 1397805 - protein, 28 aa, Mycobacterium tuberculosis
DARADAHRYSNGTDHAGRAADEPAETAH

SEQ ID NO: 1397806 - protein, 12 aa, Mycobacterium tuberculosis
DARDTKLGAEEI

SEQ ID NO: 1397807 - protein, 9 aa, Mycobacterium tuberculosis
DARHGSPAF

SEQ ID NO: 1397808 - protein, 8 aa, Mycobacterium tuberculosis
DARPADES

SEQ ID NO: 1397809 - protein, 7 aa, Mycobacterium tuberculosis
DARPTAE

SEQ ID NO: 1397810 - protein, 10 aa, Mycobacterium tuberculosis
DARTAPRPDD

SEQ ID NO: 1397811 - protein, 4 aa, Mycobacterium tuberculosis
DARV

SEQ ID NO: 1397812 - protein, 40 aa, Mycobacterium tuberculosis; identical to SEQ ID NO: 171000

SEQ ID NO: 1397813 - protein, 5 aa, Mycobacterium tuberculosis
DASPS

SEQ ID NO: 1397814 - protein, 7 aa, Mycobacterium tuberculosis
DASQQVT

SEQ ID NO: 1397815 - protein, 9 aa, Mycobacterium tuberculosis
DASSGHDGP

SEQ ID NO: 1397816 - protein, 9 aa, Mycobacterium tuberculosis
DASTDATPR

SEQ ID NO: 1397817 - protein, 4 aa, Mycobacterium tuberculosis
DASY

SEQ ID NO: 1397818 - protein, 8 aa, Mycobacterium tuberculosis
DATGAEPV

SEQ ID NO: 1397819 - protein, 8 aa, Mycobacterium tuberculosis
DATGASDQ

SEQ ID NO: 1397820 - protein, 5 aa, Mycobacterium tuberculosis
DATGF

SEQ ID NO: 1397821 - protein, 9 aa, Mycobacterium tuberculosis
DATPGQGDD

SEQ ID NO: 1397822 - protein, 6 aa, Mycobacterium tuberculosis
DATPVA

SEQ ID NO: 1397823 - protein, 5 aa, Mycobacterium tuberculosis
DATTV

SEQ ID NO: 1397824 - protein, 6 aa, Mycobacterium tuberculosis
DAVEDR

SEQ ID NO: 1397825 - protein, 9 aa, Mycobacterium tuberculosis
DAVRDGRPT

SEQ ID NO: 1397826 - protein, 6 aa, Mycobacterium tuberculosis
DAVRSP

SEQ ID NO: 1397827 - protein, 14 aa, Mycobacterium tuberculosis
DAVTNGGARPNNEE

SEQ ID NO: 1397828 - protein, 8 aa, Mycobacterium tuberculosis
DDAGAAVE

SEQ ID NO: 1397829 - protein, 10 aa, Mycobacterium tuberculosis
DDAGKASAMR

SEQ ID NO: 1397830 - protein, 14 aa, Mycobacterium tuberculosis
DDAHERQQRERYAQ

SEQ ID NO: 1397831 - protein, 10 aa, Mycobacterium tuberculosis
DDAPYGGGPG

SEQ ID NO: 1397832 - protein, 9 aa, Mycobacterium tuberculosis
DDATYRPDL

SEQ ID NO: 1397833 - protein, 9 aa, Mycobacterium tuberculosis
DDDELQNNT

SEQ ID NO: 1397834 - protein, 8 aa, Mycobacterium tuberculosis
DDDGAVVD

SEQ ID NO: 1397835 - protein, 14 aa, Mycobacterium tuberculosis
DDDGGEVPHDGETV

SEQ ID NO: 1397836 - protein, 10 aa, Mycobacterium tuberculosis
DDDGSKSSGK

SEQ ID NO: 1397837 - protein, 7 aa, Mycobacterium tuberculosis
DDDLDQA

SEQ ID NO: 1397838 - protein, 8 aa, Mycobacterium tuberculosis
DDDRPIPM

SEQ ID NO: 1397839 - protein, 12 aa, Mycobacterium tuberculosis
DDDYTGRPFSER

SEQ ID NO: 1397840 - protein, 7 aa, Mycobacterium tuberculosis
DDEAGLD

SEQ ID NO: 1397841 - protein, 8 aa, Mycobacterium tuberculosis
DDEGYPKR

SEQ ID NO: 1397842 - protein, 4 aa, Mycobacterium tuberculosis
DDEH

SEQ ID NO: 1397843 - protein, 5 aa, Mycobacterium tuberculosis
DDEMG

SEQ ID NO: 1397844 - protein, 11 aa, Mycobacterium tuberculosis
DDEQRRLTGAG

SEQ ID NO: 1397845 - protein, 5 aa, Mycobacterium tuberculosis
DDETV

SEQ ID NO: 1397846 - protein, 6 aa, Mycobacterium tuberculosis
DDEWED

SEQ ID NO: 1397847 - protein, 6 aa, Mycobacterium tuberculosis
DDEWRR

SEQ ID NO: 1397848 - protein, 6 aa, Mycobacterium tuberculosis
DDFAPG

SEQ ID NO: 1397849 - protein, 8 aa, Mycobacterium tuberculosis
DDFGGGPT

SEQ ID NO: 1397850 - protein, 5 aa, Mycobacterium tuberculosis
DDGAS

SEQ ID NO: 1397851 - protein, 5 aa, Mycobacterium tuberculosis
DDGER

SEQ ID NO: 1397852 - protein, 13 aa, Mycobacterium tuberculosis
DDGETVTKRTRDA

SEQ ID NO: 1397853 - protein, 5 aa, Mycobacterium tuberculosis
DDGGL

SEQ ID NO: 1397854 - protein, 8 aa, Mycobacterium tuberculosis
DDGHAQDA

SEQ ID NO: 1397855 - protein, 12 aa, Mycobacterium tuberculosis
DDGNEVKPGSGM

SEQ ID NO: 1397856 - protein, 5 aa, Mycobacterium tuberculosis
DDIDA

SEQ ID NO: 1397857 - protein, 7 aa, Mycobacterium tuberculosis
DDKESYR

SEQ ID NO: 1397858 - protein, 18 aa, Mycobacterium tuberculosis
DDLDDDDPTAVDGSESFN

SEQ ID NO: 1397859 - protein, 6 aa, Mycobacterium tuberculosis
DDPADR

SEQ ID NO: 1397860 - protein, 5 aa, Mycobacterium tuberculosis
DDPAL

SEQ ID NO: 1397861 - protein, 7 aa, Mycobacterium tuberculosis
DDPAQRI

SEQ ID NO: 1397862 - protein, 5 aa, Mycobacterium tuberculosis
DDPAR

SEQ ID NO: 1397863 - protein, 7 aa, Mycobacterium tuberculosis
DDPGNTT

SEQ ID NO: 1397864 - protein, 9 aa, Mycobacterium tuberculosis
DDPGRGREL

SEQ ID NO: 1397865 - protein, 7 aa, Mycobacterium tuberculosis
DDPRGLG

SEQ ID NO: 1397866 - protein, 19 aa, Mycobacterium tuberculosis
DDPRREDAAAAMKQAGARS

SEQ ID NO: 1397867 - protein, 9 aa, Mycobacterium tuberculosis
DDPSGSTNV

SEQ ID NO: 1397868 - protein, 7 aa, Mycobacterium tuberculosis
DDPSWTA

SEQ ID NO: 1397869 - protein, 15 aa, Mycobacterium tuberculosis
DDQMEPASGFDPHPH

SEQ ID NO: 1397870 - protein, 6 aa, Mycobacterium tuberculosis
DDQQRE

SEQ ID NO: 1397871 - protein, 4 aa, Mycobacterium tuberculosis
DDQR

SEQ ID NO: 1397872 - protein, 5 aa, Mycobacterium tuberculosis
DDQRT

SEQ ID NO: 1397873 - protein, 9 aa, Mycobacterium tuberculosis
DDQTGSPTY

SEQ ID NO: 1397874 - protein, 5 aa, Mycobacterium tuberculosis
DDRES

SEQ ID NO: 1397875 - protein, 9 aa, Mycobacterium tuberculosis
DDRKTTMAK

SEQ ID NO: 1397876 - protein, 20 aa, Mycobacterium tuberculosis
DDRTAAQLSPAEKDAVSHRG

SEQ ID NO: 1397877 - protein, 8 aa, Mycobacterium tuberculosis
DDRTEFAA

SEQ ID NO: 1397878 - protein, 10 aa, Mycobacterium tuberculosis
DDSDAATEYQ

SEQ ID NO: 1397879 - protein, 10 aa, Mycobacterium tuberculosis
DDSGDEAPAT

SEQ ID NO: 1397880 - protein, 6 aa, Mycobacterium tuberculosis
DDSVPD

SEQ ID NO: 1397881 - protein, 4 aa, Mycobacterium tuberculosis
DDTA

SEQ ID NO: 1397882 - protein, 10 aa, Mycobacterium tuberculosis
DDTAESSLRG

SEQ ID NO: 1397883 - protein, 5 aa, Mycobacterium tuberculosis
DDTEV

SEQ ID NO: 1397884 - protein, 4 aa, Mycobacterium tuberculosis
DDVE

SEQ ID NO: 1397885 - protein, 6 aa, Mycobacterium tuberculosis
DDVTPT

SEQ ID NO: 1397886 - protein, 6 aa, Mycobacterium tuberculosis
DDYGPD

SEQ ID NO: 1397887 - protein, 45 aa, Mycobacterium tuberculosis; identical to SEQ ID NO: 171224

SEQ ID NO: 1397888 - protein, 11 aa, Mycobacterium tuberculosis
DDYTDPAPATT

SEQ ID NO: 1397889 - protein, 4 aa, Mycobacterium tuberculosis
DEAG

SEQ ID NO: 1397890 - protein, 5 aa, Mycobacterium tuberculosis
DEAGA

SEQ ID NO: 1397891 - protein, 7 aa, Mycobacterium tuberculosis
DEAGRAA

SEQ ID NO: 1397892 - protein, 7 aa, Mycobacterium tuberculosis
DEAKNRQ

SEQ ID NO: 1397893 - protein, 13 aa, Mycobacterium tuberculosis
DEAMARSRKPEVY

SEQ ID NO: 1397894 - protein, 11 aa, Mycobacterium tuberculosis
DEDLPSGDELG

SEQ ID NO: 1397895 - protein, 8 aa, Mycobacterium tuberculosis
DEDRRPLS

SEQ ID NO: 1397896 - protein, 6 aa, Mycobacterium tuberculosis
DEDTDE

SEQ ID NO: 1397897 - protein, 6 aa, Mycobacterium tuberculosis
DEEAEA

SEQ ID NO: 1397898 - protein, 4 aa, Mycobacterium tuberculosis
DEEE

SEQ ID NO: 1397899 - protein, 6 aa, Mycobacterium tuberculosis
DEEQTE

SEQ ID NO: 1397900 - protein, 7 aa, Mycobacterium tuberculosis
DEESASE

SEQ ID NO: 1397901 - protein, 4 aa, Mycobacterium tuberculosis
DEET

SEQ ID NO: 1397902 - protein, 17 aa, Mycobacterium tuberculosis
DEETGKRVRISKRNGKD

SEQ ID NO: 1397903 - protein, 7 aa, Mycobacterium tuberculosis
DEFEDRD

SEQ ID NO: 1397904 - protein, 6 aa, Mycobacterium tuberculosis
DEFPND

SEQ ID NO: 1397905 - protein, 14 aa, Mycobacterium tuberculosis
DEGFTVGPKERKLG

SEQ ID NO: 1397906 - protein, 18 aa, Mycobacterium tuberculosis
DEGRGTQPVLGMRATRRS

SEQ ID NO: 1397907 - protein, 5 aa, Mycobacterium tuberculosis
DEGRQ

SEQ ID NO: 1397908 - protein, 7 aa, Mycobacterium tuberculosis
DEHRRHR

SEQ ID NO: 1397909 - protein, 8 aa, Mycobacterium tuberculosis
DEKSASDM

SEQ ID NO: 1397910 - protein, 13 aa, Mycobacterium tuberculosis
DEKSGGRSGHYRR

SEQ ID NO: 1397911 - protein, 7 aa, Mycobacterium tuberculosis
DELGRSN

SEQ ID NO: 1397912 - protein, 5 aa, Mycobacterium tuberculosis
DENGG

SEQ ID NO: 1397913 - protein, 9 aa, Mycobacterium tuberculosis
DENGGYPHP

SEQ ID NO: 1397914 - protein, 14 aa, Mycobacterium tuberculosis
DENQPPGSRDIPDN

SEQ ID NO: 1397915 - protein, 8 aa, Mycobacterium tuberculosis
DEPDEAAP

SEQ ID NO: 1397916 - protein, 7 aa, Mycobacterium tuberculosis
DEPDPVT

SEQ ID NO: 1397917 - protein, 6 aa, Mycobacterium tuberculosis
DEPEAQ

SEQ ID NO: 1397918 - protein, 6 aa, Mycobacterium tuberculosis
DEPEDV

SEQ ID NO: 1397919 - protein, 11 aa, Mycobacterium tuberculosis
DEPEPAQPTLT

SEQ ID NO: 1397920 - protein, 7 aa, Mycobacterium tuberculosis
DEPGYGE

SEQ ID NO: 1397921 - protein, 7 aa, Mycobacterium tuberculosis
DEPPGTR

SEQ ID NO: 1397922 - protein, 6 aa, Mycobacterium tuberculosis
DEPRKG

SEQ ID NO: 1397923 - protein, 8 aa, Mycobacterium tuberculosis
DEPRRAGV

SEQ ID NO: 1397924 - protein, 7 aa, Mycobacterium tuberculosis
DEQRTEL

SEQ ID NO: 1397925 - protein, 9 aa, Mycobacterium tuberculosis
DEQVQASAE

SEQ ID NO: 1397926 - protein, 6 aa, Mycobacterium tuberculosis
DERASQ

SEQ ID NO: 1397927 - protein, 7 aa, Mycobacterium tuberculosis
DEREGNS

SEQ ID NO: 1397928 - protein, 4 aa, Mycobacterium tuberculosis
DERG

SEQ ID NO: 1397929 - protein, 7 aa, Mycobacterium tuberculosis
DERPEQL

SEQ ID NO: 1397930 - protein, 7 aa, Mycobacterium tuberculosis
DERTRTL

SEQ ID NO: 1397931 - protein, 15 aa, Mycobacterium tuberculosis
DESGRKMSKSKGNVI

SEQ ID NO: 1397932 - protein, 5 aa, Mycobacterium tuberculosis
DESPF

SEQ ID NO: 1397933 - protein, 8 aa, Mycobacterium tuberculosis
DESQLPAA

SEQ ID NO: 1397934 - protein, 6 aa, Mycobacterium tuberculosis
DESSPN

SEQ ID NO: 1397935 - protein, 9 aa, Mycobacterium tuberculosis
DESSYSTGA

SEQ ID NO: 1397936 - protein, 7 aa, Mycobacterium tuberculosis
DETDEAR

SEQ ID NO: 1397937 - protein, 7 aa, Mycobacterium tuberculosis
DETDPTV

SEQ ID NO: 1397938 - protein, 14 aa, Mycobacterium tuberculosis
DETTRHTLSGGTEQ

SEQ ID NO: 1397939 - protein, 14 aa, Mycobacterium tuberculosis
DEVTNSTDGRADGR

SEQ ID NO: 1397940 - protein, 11 aa, Mycobacterium tuberculosis
DFSKNSGRSEL

SEQ ID NO: 1397941 - protein, 4 aa, Mycobacterium tuberculosis
DFTS

SEQ ID NO: 1397942 - protein, 5 aa, Mycobacterium tuberculosis
DGADV

SEQ ID NO: 1397943 - protein, 7 aa, Mycobacterium tuberculosis
DGAEKFT

SEQ ID NO: 1397944 - protein, 10 aa, Mycobacterium tuberculosis
DGAKDSEFPP

SEQ ID NO: 1397945 - protein, 6 aa, Mycobacterium tuberculosis
DGANGL

SEQ ID NO: 1397946 - protein, 7 aa, Mycobacterium tuberculosis
DGANKIR

SEQ ID NO: 1397947 - protein, 5 aa, Mycobacterium tuberculosis
DGAPA

SEQ ID NO: 1397948 - protein, 12 aa, Mycobacterium tuberculosis
DGAPTKPARAGW

SEQ ID NO: 1397949 - protein, 26 aa, Mycobacterium tuberculosis
DGAQERSAAAAAGADEWHDPRTDQKL

SEQ ID NO: 1397950 - protein, 9 aa, Mycobacterium tuberculosis
DGARVPPGE

SEQ ID NO: 1397951 - protein, 16 aa, Mycobacterium tuberculosis
DGASREVTRDGTPISL

SEQ ID NO: 1397952 - protein, 7 aa, Mycobacterium tuberculosis
DGATRDV

SEQ ID NO: 1397953 - protein, 9 aa, Mycobacterium tuberculosis
DGAYTGAGT

SEQ ID NO: 1397954 - protein, 5 aa, Mycobacterium tuberculosis
DGCAT

SEQ ID NO: 1397955 - protein, 8 aa, Mycobacterium tuberculosis
DGCGDSPV

SEQ ID NO: 1397956 - protein, 7 aa, Mycobacterium tuberculosis
DGDALSI

SEQ ID NO: 1397957 - protein, 12 aa, Mycobacterium tuberculosis
DGDARPDHQGSA

SEQ ID NO: 1397958 - protein, 18 aa, Mycobacterium tuberculosis
DGDGPLHRSGVDKSRAEA

SEQ ID NO: 1397959 - protein, 17 aa, Mycobacterium tuberculosis
DGDGSRGGVDSTTPGAV

SEQ ID NO: 1397960 - protein, 4 aa, Mycobacterium tuberculosis
DGDL

SEQ ID NO: 1397961 - protein, 7 aa, Mycobacterium tuberculosis
DGDPERE

SEQ ID NO: 1397962 - protein, 8 aa, Mycobacterium tuberculosis
DGDPKDVS

SEQ ID NO: 1397963 - protein, 7 aa, Mycobacterium tuberculosis
DGDRLSD

SEQ ID NO: 1397964 - protein, 7 aa, Mycobacterium tuberculosis
DGDTASS

SEQ ID NO: 1397965 - protein, 8 aa, Mycobacterium tuberculosis
DGDVSDED

SEQ ID NO: 1397966 - protein, 8 aa, Mycobacterium tuberculosis
DGEEPDPG

SEQ ID NO: 1397967 - protein, 8 aa, Mycobacterium tuberculosis
DGEKLSDD

SEQ ID NO: 1397968 - protein, 7 aa, Mycobacterium tuberculosis
DGEPTAH

SEQ ID NO: 1397969 - protein, 4 aa, Mycobacterium tuberculosis
DGET

SEQ ID NO: 1397970 - protein, 4 aa, Mycobacterium tuberculosis
DGGD

SEQ ID NO: 1397971 - protein, 9 aa, Mycobacterium tuberculosis
DGGEEREDL

SEQ ID NO: 1397972 - protein, 14 aa, Mycobacterium tuberculosis
DGGEIRNGSDLPRI

SEQ ID NO: 1397973 - protein, 6 aa, Mycobacterium tuberculosis
DGGGLV

SEQ ID NO: 1397974 - protein, 5 aa, Mycobacterium tuberculosis
DGGQA

SEQ ID NO: 1397975 - protein, 4 aa, Mycobacterium tuberculosis
DGGS

SEQ ID NO: 1397976 - protein, 4 aa, Mycobacterium tuberculosis
DGGV

SEQ ID NO: 1397977 - protein, 8 aa, Mycobacterium tuberculosis
DGHGGSVE

SEQ ID NO: 1397978 - protein, 12 aa, Mycobacterium tuberculosis
DGIAGVEQIVEK

SEQ ID NO: 1397979 - protein, 5 aa, Mycobacterium tuberculosis
DGIPS

SEQ ID NO: 1397980 - protein, 7 aa, Mycobacterium tuberculosis
DGKPVTR

SEQ ID NO: 1397981 - protein, 14 aa, Mycobacterium tuberculosis
DGKTVEAEAAHGTV

SEQ ID NO: 1397982 - protein, 7 aa, Mycobacterium tuberculosis
DGKWTDS

SEQ ID NO: 1397983 - protein, 12 aa, Mycobacterium tuberculosis
DGLDELTTTTTS

SEQ ID NO: 1397984 - protein, 4 aa, Mycobacterium tuberculosis
DGNL

SEQ ID NO: 1397985 - protein, 7 aa, Mycobacterium tuberculosis
DGNPVGE

SEQ ID NO: 1397986 - protein, 7 aa, Mycobacterium tuberculosis
DGPAGHW

SEQ ID NO: 1397987 - protein, 5 aa, Mycobacterium tuberculosis
DGPAS

SEQ ID NO: 1397988 - protein, 10 aa, Mycobacterium tuberculosis
DGPCTDDGEM

SEQ ID NO: 1397989 - protein, 7 aa, Mycobacterium tuberculosis
DGPDYDL

SEQ ID NO: 1397990 - protein, 7 aa, Mycobacterium tuberculosis
DGPGPGE

SEQ ID NO: 1397991 - protein, 8 aa, Mycobacterium tuberculosis
DGPNGPVA

SEQ ID NO: 1397992 - protein, 4 aa, Mycobacterium tuberculosis
DGQL

SEQ ID NO: 1397993 - protein, 7 aa, Mycobacterium tuberculosis
DGQPGEV

SEQ ID NO: 1397994 - protein, 4 aa, Mycobacterium tuberculosis
DGQR

SEQ ID NO: 1397995 - protein, 9 aa, Mycobacterium tuberculosis
DGRAPNGEQ

SEQ ID NO: 1397996 - protein, 7 aa, Mycobacterium tuberculosis
DGRGART

SEQ ID NO: 1397997 - protein, 10 aa, Mycobacterium tuberculosis
DGRGGAGGGM

SEQ ID NO: 1397998 - protein, 10 aa, Mycobacterium tuberculosis
DGRGPPERGS

SEQ ID NO: 1397999 - protein, 13 aa, Mycobacterium tuberculosis
DGRLTDPVATPTA

SEQ ID NO: 1398000 - protein, 8 aa, Mycobacterium tuberculosis
DGRQPDVA

SEQ ID NO: 1398001 - protein, 6 aa, Mycobacterium tuberculosis
DGSDDL

SEQ ID NO: 1398002 - protein, 9 aa, Mycobacterium tuberculosis
DGSDQDYRR

SEQ ID NO: 1398003 - protein, 6 aa, Mycobacterium tuberculosis
DGSDSV

SEQ ID NO: 1398004 - protein, 12 aa, Mycobacterium tuberculosis
DGSELPPNQPGE

SEQ ID NO: 1398005 - protein, 6 aa, Mycobacterium tuberculosis
DGSGAH

SEQ ID NO: 1398006 - protein, 19 aa, Mycobacterium tuberculosis
DGSGALSGNQIPVDKGALK

SEQ ID NO: 1398007 - protein, 8 aa, Mycobacterium tuberculosis
DGSSASEL

SEQ ID NO: 1398008 - protein, 6 aa, Mycobacterium tuberculosis
DGSSDI

SEQ ID NO: 1398009 - protein, 21 aa, Mycobacterium tuberculosis
DGSTLTNPSADEVKAKLVKIA

SEQ ID NO: 1398010 - protein, 11 aa, Mycobacterium tuberculosis
DGSTVQDPHEV

SEQ ID NO: 1398011 - protein, 15 aa, Mycobacterium tuberculosis
DGSYTAKSPATEGNL

SEQ ID NO: 1398012 - protein, 8 aa, Mycobacterium tuberculosis
DGTDEARV

SEQ ID NO: 1398013 - protein, 17 aa, Mycobacterium tuberculosis
DGTEDYWSDEYRDLIEL

SEQ ID NO: 1398014 - protein, 7 aa, Mycobacterium tuberculosis
DGTEGTR

SEQ ID NO: 1398015 - protein, 5 aa, Mycobacterium tuberculosis
DGTEL

SEQ ID NO: 1398016 - protein, 5 aa, Mycobacterium tuberculosis
DGTEV

SEQ ID NO: 1398017 - protein, 5 aa, Mycobacterium tuberculosis
DGTIT

SEQ ID NO: 1398018 - protein, 4 aa, Mycobacterium tuberculosis
DGTL

SEQ ID NO: 1398019 - protein, 8 aa, Mycobacterium tuberculosis
DGTLEAST

SEQ ID NO: 1398020 - protein, 8 aa, Mycobacterium tuberculosis
DGTLGGPV

SEQ ID NO: 1398021 - protein, 7 aa, Mycobacterium tuberculosis
DGTLPGG

SEQ ID NO: 1398022 - protein, 11 aa, Mycobacterium tuberculosis
DGTSKRRTTVG

SEQ ID NO: 1398023 - protein, 19 aa, Mycobacterium tuberculosis
DGTTPELGTARTAPSGRKP

SEQ ID NO: 1398024 - protein, 7 aa, Mycobacterium tuberculosis
DGTTRAE

SEQ ID NO: 1398025 - protein, 6 aa, Mycobacterium tuberculosis
DGTTRE

SEQ ID NO: 1398026 - protein, 5 aa, Mycobacterium tuberculosis
DGTVE

SEQ ID NO: 1398027 - protein, 7 aa, Mycobacterium tuberculosis
DGVDGEQ

SEQ ID NO: 1398028 - protein, 8 aa, Mycobacterium tuberculosis
DGVDSEAG

SEQ ID NO: 1398029 - protein, 4 aa, Mycobacterium tuberculosis
DGYA

SEQ ID NO: 1398030 - protein, 9 aa, Mycobacterium tuberculosis
DGYGHGATR

SEQ ID NO: 1398031 - protein, 14 aa, Mycobacterium tuberculosis
DGYGRTGFGLAVLE

SEQ ID NO: 1398032 - protein, 4 aa, Mycobacterium tuberculosis
DGYT

SEQ ID NO: 1398033 - protein, 6 aa, Mycobacterium tuberculosis
DGYTGR

SEQ ID NO: 1398034 - protein, 8 aa, Mycobacterium tuberculosis
DHDYETKK

SEQ ID NO: 1398035 - protein, 8 aa, Mycobacterium tuberculosis
DHEQYTGE

SEQ ID NO: 1398036 - protein, 5 aa, Mycobacterium tuberculosis
DHGEQ

SEQ ID NO: 1398037 - protein, 5 aa, Mycobacterium tuberculosis
DHGPG

SEQ ID NO: 1398038 - protein, 7 aa, Mycobacterium tuberculosis
DHGTEIA

SEQ ID NO: 1398039 - protein, 9 aa, Mycobacterium tuberculosis
DHRSYAGTV

SEQ ID NO: 1398040 - protein, 6 aa, Mycobacterium tuberculosis
DHSGRE

SEQ ID NO: 1398041 - protein, 9 aa, Mycobacterium tuberculosis
DHSTDPQPF

SEQ ID NO: 1398042 - protein, 5 aa, Mycobacterium tuberculosis
DIAKG

SEQ ID NO: 1398043 - protein, 6 aa, Mycobacterium tuberculosis
DIAPHG

SEQ ID NO: 1398044 - protein, 9 aa, Mycobacterium tuberculosis
DIDTHSPRQ

SEQ ID NO: 1398045 - protein, 6 aa, Mycobacterium tuberculosis
DIEAGD

SEQ ID NO: 1398046 - protein, 9 aa, Mycobacterium tuberculosis
DIGEYSNIG

SEQ ID NO: 1398047 - protein, 6 aa, Mycobacterium tuberculosis
DIGSSE

SEQ ID NO: 1398048 - protein, 15 aa, Mycobacterium tuberculosis
DIHDPSCSAEPVPDY

SEQ ID NO: 1398049 - protein, 9 aa, Mycobacterium tuberculosis
DIPRGPAGP

SEQ ID NO: 1398050 - protein, 5 aa, Mycobacterium tuberculosis
DIRPG

SEQ ID NO: 1398051 - protein, 9 aa, Mycobacterium tuberculosis
DISGPPRAH

SEQ ID NO: 1398052 - protein, 6 aa, Mycobacterium tuberculosis
DISSPG

SEQ ID NO: 1398053 - protein, 7 aa, Mycobacterium tuberculosis
DITDNST

SEQ ID NO: 1398054 - protein, 14 aa, Mycobacterium tuberculosis
DITPVAANTDDGRS

SEQ ID NO: 1398055 - protein, 6 aa, Mycobacterium tuberculosis
DKAEGV

SEQ ID NO: 1398056 - protein, 8 aa, Mycobacterium tuberculosis
DKAGNPHL

SEQ ID NO: 1398057 - protein, 6 aa, Mycobacterium tuberculosis
DKAGNW

SEQ ID NO: 1398058 - protein, 12 aa, Mycobacterium tuberculosis
DKALATLRAIRS

SEQ ID NO: 1398059 - protein, 9 aa, Mycobacterium tuberculosis
DKATSMSEA

SEQ ID NO: 1398060 - protein, 7 aa, Mycobacterium tuberculosis
DKDREAA

SEQ ID NO: 1398061 - protein, 4 aa, Mycobacterium tuberculosis
DKEA

SEQ ID NO: 1398062 - protein, 8 aa, Mycobacterium tuberculosis
DKEDGSLA

SEQ ID NO: 1398063 - protein, 6 aa, Mycobacterium tuberculosis
DKGRLT

SEQ ID NO: 1398064 - protein, 16 aa, Mycobacterium tuberculosis
DKLSPSGPDRYSYGEQ

SEQ ID NO: 1398065 - protein, 10 aa, Mycobacterium tuberculosis
DKPAKTTREA

SEQ ID NO: 1398066 - protein, 6 aa, Mycobacterium tuberculosis
DKPAPL

SEQ ID NO: 1398067 - protein, 5 aa, Mycobacterium tuberculosis
DKPAV

SEQ ID NO: 1398068 - protein, 6 aa, Mycobacterium tuberculosis
DKPGLR

SEQ ID NO: 1398069 - protein, 5 aa, Mycobacterium tuberculosis
DKPGV

SEQ ID NO: 1398070 - protein, 8 aa, Mycobacterium tuberculosis
DKPNNGDA

SEQ ID NO: 1398071 - protein, 7 aa, Mycobacterium tuberculosis
DKPPLPF

SEQ ID NO: 1398072 - protein, 7 aa, Mycobacterium tuberculosis
DKPRPHR

SEQ ID NO: 1398073 - protein, 4 aa, Mycobacterium tuberculosis
DKRG

SEQ ID NO: 1398074 - protein, 9 aa, Mycobacterium tuberculosis
DKRGQQAAL

SEQ ID NO: 1398075 - protein, 12 aa, Mycobacterium tuberculosis
DKSARQGSEATT

SEQ ID NO: 1398076 - protein, 7 aa, Mycobacterium tuberculosis
DKSPAAV

SEQ ID NO: 1398077 - protein, 24 aa, Mycobacterium tuberculosis
DKSTGLANPGQFAGYTGAAESPTS

SEQ ID NO: 1398078 - protein, 9 aa, Mycobacterium tuberculosis
DKVATSPAF

SEQ ID NO: 1398079 - protein, 12 aa, Mycobacterium tuberculosis
DLASRSANTPFE

SEQ ID NO: 1398080 - protein, 10 aa, Mycobacterium tuberculosis
DLESASPDLQ

SEQ ID NO: 1398081 - protein, 7 aa, Mycobacterium tuberculosis
DLGDEDA

SEQ ID NO: 1398082 - protein, 7 aa, Mycobacterium tuberculosis
DLGESDN

SEQ ID NO: 1398083 - protein, 8 aa, Mycobacterium tuberculosis
DLKDGPQG

SEQ ID NO: 1398084 - protein, 5 aa, Mycobacterium tuberculosis
DLNET

SEQ ID NO: 1398085 - protein, 13 aa, Mycobacterium tuberculosis
DLPEASRTARGQH

SEQ ID NO: 1398086 - protein, 19 aa, Mycobacterium tuberculosis
DLPEGASTQNLSLDGQGRV

SEQ ID NO: 1398087 - protein, 5 aa, Mycobacterium tuberculosis
DLPGA

SEQ ID NO: 1398088 - protein, 9 aa, Mycobacterium tuberculosis
DLPGSPARD

SEQ ID NO: 1398089 - protein, 13 aa, Mycobacterium tuberculosis
DLPGSSGSSRPER

SEQ ID NO: 1398090 - protein, 10 aa, Mycobacterium tuberculosis
DLPTAEGTGS

SEQ ID NO: 1398091 - protein, 6 aa, Mycobacterium tuberculosis
DLPTGH

SEQ ID NO: 1398092 - protein, 10 aa, Mycobacterium tuberculosis
DLQPGSSIMP

SEQ ID NO: 1398093 - protein, 14 aa, Mycobacterium tuberculosis
DLSPHDSGAYTGDV

SEQ ID NO: 1398094 - protein, 7 aa, Mycobacterium tuberculosis
DLTQETA

SEQ ID NO: 1398095 - protein, 5 aa, Mycobacterium tuberculosis
DMNDD

SEQ ID NO: 1398096 - protein, 19 aa, Mycobacterium tuberculosis
DNAAVDASSGVEAAAGLGE

SEQ ID NO: 1398097 - protein, 10 aa, Mycobacterium tuberculosis
DNAPEERQRG

SEQ ID NO: 1398098 - protein, 8 aa, Mycobacterium tuberculosis
DNEASDKA

SEQ ID NO: 1398099 - protein, 5 aa, Mycobacterium tuberculosis
DNEPD

SEQ ID NO: 1398100 - protein, 5 aa, Mycobacterium tuberculosis
DNERA

SEQ ID NO: 1398101 - protein, 15 aa, Mycobacterium tuberculosis
DNGRGLPDEFTGSGL

SEQ ID NO: 1398102 - protein, 9 aa, Mycobacterium tuberculosis
DNIDDSSDP

SEQ ID NO: 1398103 - protein, 5 aa, Mycobacterium tuberculosis
DNLPS

SEQ ID NO: 1398104 - protein, 6 aa, Mycobacterium tuberculosis
DNPDDV

SEQ ID NO: 1398105 - protein, 6 aa, Mycobacterium tuberculosis
DNPGRM

SEQ ID NO: 1398106 - protein, 15 aa, Mycobacterium tuberculosis
DNPNATGSCACGDSF

SEQ ID NO: 1398107 - protein, 4 aa, Mycobacterium tuberculosis
DNPT

SEQ ID NO: 1398108 - protein, 7 aa, Mycobacterium tuberculosis
DNQGDGP

SEQ ID NO: 1398109 - protein, 7 aa, Mycobacterium tuberculosis
DNQTTYG

SEQ ID NO: 1398110 - protein, 7 aa, Mycobacterium tuberculosis
DNSASRC

SEQ ID NO: 1398111 - protein, 4 aa, Mycobacterium tuberculosis
DNSG

SEQ ID NO: 1398112 - protein, 6 aa, Mycobacterium tuberculosis
DNTGAK

SEQ ID NO: 1398113 - protein, 9 aa, Mycobacterium tuberculosis
DNTPWGGKP

SEQ ID NO: 1398114 - protein, 5 aa, Mycobacterium tuberculosis
DNYAK

SEQ ID NO: 1398115 - protein, 8 aa, Mycobacterium tuberculosis
DPAAANDV

SEQ ID NO: 1398116 - protein, 8 aa, Mycobacterium tuberculosis
DPAAGDPL

SEQ ID NO: 1398117 - protein, 21 aa, Mycobacterium tuberculosis
DPAAYGQEPHPATDHPRPGRD

SEQ ID NO: 1398118 - protein, 9 aa, Mycobacterium tuberculosis
DPADEPVAQ

SEQ ID NO: 1398119 - protein, 6 aa, Mycobacterium tuberculosis
DPADFS

SEQ ID NO: 1398120 - protein, 5 aa, Mycobacterium tuberculosis
DPAHQ

SEQ ID NO: 1398121 - protein, 9 aa, Mycobacterium tuberculosis
DPAKPKALH

SEQ ID NO: 1398122 - protein, 12 aa, Mycobacterium tuberculosis
DPAKTAASRNKH

SEQ ID NO: 1398123 - protein, 4 aa, Mycobacterium tuberculosis
DPAL

SEQ ID NO: 1398124 - protein, 6 aa, Mycobacterium tuberculosis
DPALPE

SEQ ID NO: 1398125 - protein, 11 aa, Mycobacterium tuberculosis
DPANLTGQGLA

SEQ ID NO: 1398126 - protein, 16 aa, Mycobacterium tuberculosis
DPAPADRSTSRDGYGN

SEQ ID NO: 1398127 - protein, 6 aa, Mycobacterium tuberculosis
DPAPTP

SEQ ID NO: 1398128 - protein, 12 aa, Mycobacterium tuberculosis
DPAQRADYQRRA

SEQ ID NO: 1398129 - protein, 4 aa, Mycobacterium tuberculosis
DPAR

SEQ ID NO: 1398130 - protein, 9 aa, Mycobacterium tuberculosis
DPARRGETL

SEQ ID NO: 1398131 - protein, 19 aa, Mycobacterium tuberculosis
DPARTSPSSTSIGFKRFEA

SEQ ID NO: 1398132 - protein, 11 aa, Mycobacterium tuberculosis
DPATGSRRRYP

SEQ ID NO: 1398133 - protein, 7 aa, Mycobacterium tuberculosis
DPAYQTE

SEQ ID NO: 1398134 - protein, 4 aa, Mycobacterium tuberculosis
DPDA

SEQ ID NO: 1398135 - protein, 9 aa, Mycobacterium tuberculosis
DPDASAATL

SEQ ID NO: 1398136 - protein, 5 aa, Mycobacterium tuberculosis
DPDDV

SEQ ID NO: 1398137 - protein, 6 aa, Mycobacterium tuberculosis
DPDGRT

SEQ ID NO: 1398138 - protein, 11 aa, Mycobacterium tuberculosis
DPDGSVYPSAR

SEQ ID NO: 1398139 - protein, 6 aa, Mycobacterium tuberculosis
DPDHDM

SEQ ID NO: 1398140 - protein, 5 aa, Mycobacterium tuberculosis
DPDRD

SEQ ID NO: 1398141 - protein, 8 aa, Mycobacterium tuberculosis
DPDREATG

SEQ ID NO: 1398142 - protein, 8 aa, Mycobacterium tuberculosis
DPDRPLPE

SEQ ID NO: 1398143 - protein, 7 aa, Mycobacterium tuberculosis
DPDTARE

SEQ ID NO: 1398144 - protein, 7 aa, Mycobacterium tuberculosis
DPEAGGG

SEQ ID NO: 1398145 - protein, 6 aa, Mycobacterium tuberculosis
DPEFGT

SEQ ID NO: 1398146 - protein, 6 aa, Mycobacterium tuberculosis
DPEQYQ

SEQ ID NO: 1398147 - protein, 7 aa, Mycobacterium tuberculosis
DPEVPPA

SEQ ID NO: 1398148 - protein, 4 aa, Mycobacterium tuberculosis
DPFS

SEQ ID NO: 1398149 - protein, 10 aa, Mycobacterium tuberculosis
DPGAAAALGP

SEQ ID NO: 1398150 - protein, 6 aa, Mycobacterium tuberculosis
DPGAVT

SEQ ID NO: 1398151 - protein, 5 aa, Mycobacterium tuberculosis
DPGEV

SEQ ID NO: 1398152 - protein, 9 aa, Mycobacterium tuberculosis
DPGPDDDEH

SEQ ID NO: 1398153 - protein, 4 aa, Mycobacterium tuberculosis
DPGR

SEQ ID NO: 1398154 - protein, 6 aa, Mycobacterium tuberculosis
DPGTDR

SEQ ID NO: 1398155 - protein, 8 aa, Mycobacterium tuberculosis
DPHNKPGR

SEQ ID NO: 1398156 - protein, 6 aa, Mycobacterium tuberculosis
DPHQRQ

SEQ ID NO: 1398157 - protein, 7 aa, Mycobacterium tuberculosis
DPIPVDQ

SEQ ID NO: 1398158 - protein, 8 aa, Mycobacterium tuberculosis
DPKAEPSI

SEQ ID NO: 1398159 - protein, 5 aa, Mycobacterium tuberculosis
DPLDP

SEQ ID NO: 1398160 - protein, 8 aa, Mycobacterium tuberculosis
DPLDTGAP

SEQ ID NO: 1398161 - protein, 6 aa, Mycobacterium tuberculosis
DPLPAE

SEQ ID NO: 1398162 - protein, 5 aa, Mycobacterium tuberculosis
DPLTP

SEQ ID NO: 1398163 - protein, 12 aa, Mycobacterium tuberculosis
DPNPPGPESDYR

SEQ ID NO: 1398164 - protein, 6 aa, Mycobacterium tuberculosis
DPPAGD

SEQ ID NO: 1398165 - protein, 7 aa, Mycobacterium tuberculosis
DPPAGER

SEQ ID NO: 1398166 - protein, 4 aa, Mycobacterium tuberculosis
DPPD

SEQ ID NO: 1398167 - protein, 6 aa, Mycobacterium tuberculosis
DPPDRG

SEQ ID NO: 1398168 - protein, 6 aa, Mycobacterium tuberculosis
DPPEQA

SEQ ID NO: 1398169 - protein, 4 aa, Mycobacterium tuberculosis
DPPH

SEQ ID NO: 1398170 - protein, 10 aa, Mycobacterium tuberculosis
DPPPPPQEQG

SEQ ID NO: 1398171 - protein, 7 aa, Mycobacterium tuberculosis
DPPPRTG

SEQ ID NO: 1398172 - protein, 7 aa, Mycobacterium tuberculosis
DPPRARA

SEQ ID NO: 1398173 - protein, 10 aa, Mycobacterium tuberculosis
DPPRSGAGRE

SEQ ID NO: 1398174 - protein, 5 aa, Mycobacterium tuberculosis
DPPTT

SEQ ID NO: 1398175 - protein, 6 aa, Mycobacterium tuberculosis
DPQDTE

SEQ ID NO: 1398176 - protein, 11 aa, Mycobacterium tuberculosis
DPQGNASTALG

SEQ ID NO: 1398177 - protein, 8 aa, Mycobacterium tuberculosis
DPQIRTSQ

SEQ ID NO: 1398178 - protein, 8 aa, Mycobacterium tuberculosis
DPQKTAEV

SEQ ID NO: 1398179 - protein, 9 aa, Mycobacterium tuberculosis
DPQPGVPGR

SEQ ID NO: 1398180 - protein, 9 aa, Mycobacterium tuberculosis
DPQPPFDSG

SEQ ID NO: 1398181 - protein, 7 aa, Mycobacterium tuberculosis
DPQRPTH

SEQ ID NO: 1398182 - protein, 6 aa, Mycobacterium tuberculosis
DPQTAA

SEQ ID NO: 1398183 - protein, 4 aa, Mycobacterium tuberculosis
DPRG

SEQ ID NO: 1398184 - protein, 8 aa, Mycobacterium tuberculosis
DPRKTADA

SEQ ID NO: 1398185 - protein, 12 aa, Mycobacterium tuberculosis
DPRPNAEPLPAR

SEQ ID NO: 1398186 - protein, 6 aa, Mycobacterium tuberculosis
DPRRLA

SEQ ID NO: 1398187 - protein, 21 aa, Mycobacterium tuberculosis
DPSIPTDESGTRHRSAERAAI

SEQ ID NO: 1398188 - protein, 8 aa, Mycobacterium tuberculosis
DPSLKPQA

SEQ ID NO: 1398189 - protein, 7 aa, Mycobacterium tuberculosis
DPSPDRI

SEQ ID NO: 1398190 - protein, 15 aa, Mycobacterium tuberculosis
DPSQKADDVSGSGSY

SEQ ID NO: 1398191 - protein, 9 aa, Mycobacterium tuberculosis
DPSTDAERL

SEQ ID NO: 1398192 - protein, 10 aa, Mycobacterium tuberculosis
DPSTDPDGWS

SEQ ID NO: 1398193 - protein, 7 aa, Mycobacterium tuberculosis
DPTAGAA

SEQ ID NO: 1398194 - protein, 6 aa, Mycobacterium tuberculosis
DPTCEP

SEQ ID NO: 1398195 - protein, 9 aa, Mycobacterium tuberculosis
DPVKPRGNL

SEQ ID NO: 1398196 - protein, 9 aa, Mycobacterium tuberculosis
DPVQDSPYA

SEQ ID NO: 1398197 - protein, 9 aa, Mycobacterium tuberculosis
DPYADRPRL

SEQ ID NO: 1398198 - protein, 7 aa, Mycobacterium tuberculosis
DPYHGGT

SEQ ID NO: 1398199 - protein, 8 aa, Mycobacterium tuberculosis
DPYPTPGH

SEQ ID NO: 1398200 - protein, 11 aa, Mycobacterium tuberculosis
DQAAGNASREI

SEQ ID NO: 1398201 - protein, 21 aa, Mycobacterium tuberculosis
DQADAARAAYRTYGKGRHRAG

SEQ ID NO: 1398202 - protein, 19 aa, Mycobacterium tuberculosis
DQATAAGDAAKATEYNNAA

SEQ ID NO: 1398203 - protein, 5 aa, Mycobacterium tuberculosis
DQDHS

SEQ ID NO: 1398204 - protein, 5 aa, Mycobacterium tuberculosis
DQENG

SEQ ID NO: 1398205 - protein, 11 aa, Mycobacterium tuberculosis
DQERGLSAGEK

SEQ ID NO: 1398206 - protein, 5 aa, Mycobacterium tuberculosis
DQFED

SEQ ID NO: 1398207 - protein, 27 aa, Mycobacterium tuberculosis
DQLASGERCAATSNRNFEGRQGAGGRT

SEQ ID NO: 1398208 - protein, 8 aa, Mycobacterium tuberculosis
DQLPSTHP

SEQ ID NO: 1398209 - protein, 5 aa, Mycobacterium tuberculosis
DQPAR

SEQ ID NO: 1398210 - protein, 6 aa, Mycobacterium tuberculosis
DQPGRL

SEQ ID NO: 1398211 - protein, 10 aa, Mycobacterium tuberculosis
DQPQPQPGHG

SEQ ID NO: 1398212 - protein, 4 aa, Mycobacterium tuberculosis
DQPW

SEQ ID NO: 1398213 - protein, 11 aa, Mycobacterium tuberculosis
DQQPRPNSDEV

SEQ ID NO: 1398214 - protein, 15 aa, Mycobacterium tuberculosis
DQRHASQLRQSGDPY

SEQ ID NO: 1398215 - protein, 5 aa, Mycobacterium tuberculosis
DQRSA

SEQ ID NO: 1398216 - protein, 16 aa, Mycobacterium tuberculosis
DQSDPDLLSPERKSRR

SEQ ID NO: 1398217 - protein, 6 aa, Mycobacterium tuberculosis
DQSERM

SEQ ID NO: 1398218 - protein, 4 aa, Mycobacterium tuberculosis
DQSL

SEQ ID NO: 1398219 - protein, 12 aa, Mycobacterium tuberculosis
DQVNPQAGRDAA

SEQ ID NO: 1398220 - protein, 5 aa, Mycobacterium tuberculosis
DRAAR

SEQ ID NO: 1398221 - protein, 13 aa, Mycobacterium tuberculosis
DRARTRPADSTTV

SEQ ID NO: 1398222 - protein, 4 aa, Mycobacterium tuberculosis
DRAT

SEQ ID NO: 1398223 - protein, 7 aa, Mycobacterium tuberculosis
DRAVTTT

SEQ ID NO: 1398224 - protein, 11 aa, Mycobacterium tuberculosis
DRDNTLDPEVE

SEQ ID NO: 1398225 - protein, 5 aa, Mycobacterium tuberculosis
DRDPD

SEQ ID NO: 1398226 - protein, 15 aa, Mycobacterium tuberculosis
DRDSQTGDGPDDAGY

SEQ ID NO: 1398227 - protein, 8 aa, Mycobacterium tuberculosis
DREGRPRS

SEQ ID NO: 1398228 - protein, 7 aa, Mycobacterium tuberculosis
DRETARH

SEQ ID NO: 1398229 - protein, 11 aa, Mycobacterium tuberculosis
DRGEAHPDVDP

SEQ ID NO: 1398230 - protein, 10 aa, Mycobacterium tuberculosis
DRGEISSAAI

SEQ ID NO: 1398231 - protein, 10 aa, Mycobacterium tuberculosis
DRGGDSPHTT

SEQ ID NO: 1398232 - protein, 11 aa, Mycobacterium tuberculosis
DRGGPTYTKDT

SEQ ID NO: 1398233 - protein, 9 aa, Mycobacterium tuberculosis
DRKEQGRGL

SEQ ID NO: 1398234 - protein, 7 aa, Mycobacterium tuberculosis
DRNEDGL

SEQ ID NO: 1398235 - protein, 23 aa, Mycobacterium tuberculosis
DRNPSPGSLDEAQAKIRAALAQL

SEQ ID NO: 1398236 - protein, 12 aa, Mycobacterium tuberculosis
DRPDEMSPYAPR

SEQ ID NO: 1398237 - protein, 7 aa, Mycobacterium tuberculosis
DRPEARW

SEQ ID NO: 1398238 - protein, 5 aa, Mycobacterium tuberculosis
DRPEV

SEQ ID NO: 1398239 - protein, 7 aa, Mycobacterium tuberculosis
DRPGSLG

SEQ ID NO: 1398240 - protein, 5 aa, Mycobacterium tuberculosis
DRPLT

SEQ ID NO: 1398241 - protein, 19 aa, Mycobacterium tuberculosis
DRPPAAEPKERTKSAASSM

SEQ ID NO: 1398242 - protein, 6 aa, Mycobacterium tuberculosis
DRPPLS

SEQ ID NO: 1398243 - protein, 12 aa, Mycobacterium tuberculosis
DRPPQTNEVGRS

SEQ ID NO: 1398244 - protein, 12 aa, Mycobacterium tuberculosis
DRPRPSAVGRNA

SEQ ID NO: 1398245 - protein, 10 aa, Mycobacterium tuberculosis
DRPSPAPAKG

SEQ ID NO: 1398246 - protein, 7 aa, Mycobacterium tuberculosis
DRPTRGH

SEQ ID NO: 1398247 - protein, 13 aa, Mycobacterium tuberculosis
DRRADPDLAARTD

SEQ ID NO: 1398248 - protein, 4 aa, Mycobacterium tuberculosis
DRRG

SEQ ID NO: 1398249 - protein, 8 aa, Mycobacterium tuberculosis
DRRGTRPL

SEQ ID NO: 1398250 - protein, 9 aa, Mycobacterium tuberculosis
DRRPDLPTG

SEQ ID NO: 1398251 - protein, 8 aa, Mycobacterium tuberculosis
DRRQRQRA

SEQ ID NO: 1398252 - protein, 9 aa, Mycobacterium tuberculosis
DRRSTQGNM

SEQ ID NO: 1398253 - protein, 32 aa, Mycobacterium tuberculosis; identical to SEQ ID NO: 172383

SEQ ID NO: 1398254 - protein, 4 aa, Mycobacterium tuberculosis
DRSD

SEQ ID NO: 1398255 - protein, 5 aa, Mycobacterium tuberculosis
DRSEV

SEQ ID NO: 1398256 - protein, 9 aa, Mycobacterium tuberculosis
DRSFGQRDT

SEQ ID NO: 1398257 - protein, 11 aa, Mycobacterium tuberculosis
DRSRAKGASHW

SEQ ID NO: 1398258 - protein, 5 aa, Mycobacterium tuberculosis
DRTAE

SEQ ID NO: 1398259 - protein, 8 aa, Mycobacterium tuberculosis
DRTGALSP

SEQ ID NO: 1398260 - protein, 10 aa, Mycobacterium tuberculosis
DRTGDPNAWQ

SEQ ID NO: 1398261 - protein, 7 aa, Mycobacterium tuberculosis
DRTGGGA

SEQ ID NO: 1398262 - protein, 7 aa, Mycobacterium tuberculosis
DRTTARA

SEQ ID NO: 1398263 - protein, 4 aa, Mycobacterium tuberculosis
DRVG

SEQ ID NO: 1398264 - protein, 11 aa, Mycobacterium tuberculosis
DRWGRNAEDAL

SEQ ID NO: 1398265 - protein, 7 aa, Mycobacterium tuberculosis
DRYGPEV

SEQ ID NO: 1398266 - protein, 8 aa, Mycobacterium tuberculosis
DSAANGLG

SEQ ID NO: 1398267 - protein, 6 aa, Mycobacterium tuberculosis
DSAGGH

SEQ ID NO: 1398268 - protein, 6 aa, Mycobacterium tuberculosis
DSASSG

SEQ ID NO: 1398269 - protein, 13 aa, Mycobacterium tuberculosis
DSDNAVVAAISGG

SEQ ID NO: 1398270 - protein, 7 aa, Mycobacterium tuberculosis
DSDRNGL

SEQ ID NO: 1398271 - protein, 6 aa, Mycobacterium tuberculosis
DSEDEV

SEQ ID NO: 1398272 - protein, 10 aa, Mycobacterium tuberculosis
DSEPDWGPYA

SEQ ID NO: 1398273 - protein, 7 aa, Mycobacterium tuberculosis
DSERPLS

SEQ ID NO: 1398274 - protein, 16 aa, Mycobacterium tuberculosis
DSESDESGKLPGTDVR

SEQ ID NO: 1398275 - protein, 7 aa, Mycobacterium tuberculosis
DSFTGGA

SEQ ID NO: 1398276 - protein, 9 aa, Mycobacterium tuberculosis
DSGCSAPGC

SEQ ID NO: 1398277 - protein, 8 aa, Mycobacterium tuberculosis
DSGDRYAD

SEQ ID NO: 1398278 - protein, 7 aa, Mycobacterium tuberculosis
DSGEGPQ

SEQ ID NO: 1398279 - protein, 18 aa, Mycobacterium tuberculosis
DSGEQIGDDEPDDCGVRP

SEQ ID NO: 1398280 - protein, 16 aa, Mycobacterium tuberculosis
DSGGGSDDDARAITDT

SEQ ID NO: 1398281 - protein, 5 aa, Mycobacterium tuberculosis
DSGHN

SEQ ID NO: 1398282 - protein, 6 aa, Mycobacterium tuberculosis
DSGKDL

SEQ ID NO: 1398283 - protein, 5 aa, Mycobacterium tuberculosis
DSGLR

SEQ ID NO: 1398284 - protein, 6 aa, Mycobacterium tuberculosis
DSGNAH

SEQ ID NO: 1398285 - protein, 7 aa, Mycobacterium tuberculosis
DSGNPGL

SEQ ID NO: 1398286 - protein, 4 aa, Mycobacterium tuberculosis
DSGR

SEQ ID NO: 1398287 - protein, 9 aa, Mycobacterium tuberculosis
DSGVETGSV

SEQ ID NO: 1398288 - protein, 9 aa, Mycobacterium tuberculosis
DSHGNAAYT

SEQ ID NO: 1398289 - protein, 7 aa, Mycobacterium tuberculosis
DSITDKD

SEQ ID NO: 1398290 - protein, 16 aa, Mycobacterium tuberculosis
DSLAEQSRRNPDGTGL

SEQ ID NO: 1398291 - protein, 13 aa, Mycobacterium tuberculosis
DSLTRKDHEFERD

SEQ ID NO: 1398292 - protein, 6 aa, Mycobacterium tuberculosis
DSPAAQ

SEQ ID NO: 1398293 - protein, 6 aa, Mycobacterium tuberculosis
DSPAGQ

SEQ ID NO: 1398294 - protein, 7 aa, Mycobacterium tuberculosis
DSPGITV

SEQ ID NO: 1398295 - protein, 9 aa, Mycobacterium tuberculosis
DSPKPPPRR

SEQ ID NO: 1398296 - protein, 8 aa, Mycobacterium tuberculosis
DSPRERPG

SEQ ID NO: 1398297 - protein, 6 aa, Mycobacterium tuberculosis
DSPRPW

SEQ ID NO: 1398298 - protein, 6 aa, Mycobacterium tuberculosis
DSPTEL

SEQ ID NO: 1398299 - protein, 7 aa, Mycobacterium tuberculosis
DSQESFG

SEQ ID NO: 1398300 - protein, 6 aa, Mycobacterium tuberculosis
DSQGRG

SEQ ID NO: 1398301 - protein, 22 aa, Mycobacterium tuberculosis
DSRDEAGSGRDRHANLGSGQID

SEQ ID NO: 1398302 - protein, 14 aa, Mycobacterium tuberculosis
DSRGCGRSDGTGDL

SEQ ID NO: 1398303 - protein, 8 aa, Mycobacterium tuberculosis
DSSGASRA

SEQ ID NO: 1398304 - protein, 6 aa, Mycobacterium tuberculosis
DSSPEM

SEQ ID NO: 1398305 - protein, 7 aa, Mycobacterium tuberculosis
DSSPTLN

SEQ ID NO: 1398306 - protein, 4 aa, Mycobacterium tuberculosis
DSSR

SEQ ID NO: 1398307 - protein, 9 aa, Mycobacterium tuberculosis
DSSSRMSRL

SEQ ID NO: 1398308 - protein, 7 aa, Mycobacterium tuberculosis
DSTALSN

SEQ ID NO: 1398309 - protein, 7 aa, Mycobacterium tuberculosis
DSTDTLE

SEQ ID NO: 1398310 - protein, 5 aa, Mycobacterium tuberculosis
DSTGY

SEQ ID NO: 1398311 - protein, 12 aa, Mycobacterium tuberculosis
DSTPDERRTAYD

SEQ ID NO: 1398312 - protein, 7 aa, Mycobacterium tuberculosis
DSTPPPW

SEQ ID NO: 1398313 - protein, 7 aa, Mycobacterium tuberculosis
DSTQGAH

SEQ ID NO: 1398314 - protein, 9 aa, Mycobacterium tuberculosis
DSTTLSESA

SEQ ID NO: 1398315 - protein, 5 aa, Mycobacterium tuberculosis
DSTVR

SEQ ID NO: 1398316 - protein, 7 aa, Mycobacterium tuberculosis
DSVGGPV

SEQ ID NO: 1398317 - protein, 10 aa, Mycobacterium tuberculosis
DSVPGLGEHR

SEQ ID NO: 1398318 - protein, 15 aa, Mycobacterium tuberculosis
DSVTKSKFDNKYGTR

SEQ ID NO: 1398319 - protein, 7 aa, Mycobacterium tuberculosis
DSYRAKS

SEQ ID NO: 1398320 - protein, 12 aa, Mycobacterium tuberculosis
DTAGGTSAGLSG

SEQ ID NO: 1398321 - protein, 5 aa, Mycobacterium tuberculosis
DTAQA

SEQ ID NO: 1398322 - protein, 14 aa, Mycobacterium tuberculosis
DTAQVEGGDLLVVV

SEQ ID NO: 1398323 - protein, 6 aa, Mycobacterium tuberculosis
DTARPA

SEQ ID NO: 1398324 - protein, 7 aa, Mycobacterium tuberculosis
DTATGEQ

SEQ ID NO: 1398325 - protein, 6 aa, Mycobacterium tuberculosis
DTAYGL

SEQ ID NO: 1398326 - protein, 7 aa, Mycobacterium tuberculosis
DTDEETL

SEQ ID NO: 1398327 - protein, 23 aa, Mycobacterium tuberculosis
DTDPEPEPEEDEPVAESPAPDVV

SEQ ID NO: 1398328 - protein, 7 aa, Mycobacterium tuberculosis
DTDSHPK

SEQ ID NO: 1398329 - protein, 9 aa, Mycobacterium tuberculosis
DTEATAAAI

SEQ ID NO: 1398330 - protein, 8 aa, Mycobacterium tuberculosis
DTEEGPDA

SEQ ID NO: 1398331 - protein, 5 aa, Mycobacterium tuberculosis
DTEGK

SEQ ID NO: 1398332 - protein, 7 aa, Mycobacterium tuberculosis
DTEPYRK

SEQ ID NO: 1398333 - protein, 4 aa, Mycobacterium tuberculosis
DTET

SEQ ID NO: 1398334 - protein, 4 aa, Mycobacterium tuberculosis
DTFY

SEQ ID NO: 1398335 - protein, 11 aa, Mycobacterium tuberculosis
DTGALDDPDGR

SEQ ID NO: 1398336 - protein, 11 aa, Mycobacterium tuberculosis
DTGFGEDPATL

SEQ ID NO: 1398337 - protein, 7 aa, Mycobacterium tuberculosis
DTGGAVD

SEQ ID NO: 1398338 - protein, 4 aa, Mycobacterium tuberculosis
DTGR

SEQ ID NO: 1398339 - protein, 12 aa, Mycobacterium tuberculosis
DTIDRDSAWAAK

SEQ ID NO: 1398340 - protein, 13 aa, Mycobacterium tuberculosis
DTIGGGARSGELT

SEQ ID NO: 1398341 - protein, 7 aa, Mycobacterium tuberculosis
DTIPGTA

SEQ ID NO: 1398342 - protein, 7 aa, Mycobacterium tuberculosis
DTIRNGY

SEQ ID NO: 1398343 - protein, 7 aa, Mycobacterium tuberculosis
DTKADLP

SEQ ID NO: 1398344 - protein, 6 aa, Mycobacterium tuberculosis
DTLSGS

SEQ ID NO: 1398345 - protein, 6 aa, Mycobacterium tuberculosis
DTNGTV

SEQ ID NO: 1398346 - protein, 6 aa, Mycobacterium tuberculosis
DTNRSR

SEQ ID NO: 1398347 - protein, 13 aa, Mycobacterium tuberculosis
DTPAAPSGSFGDD

SEQ ID NO: 1398348 - protein, 10 aa, Mycobacterium tuberculosis
DTPGEADYYR

SEQ ID NO: 1398349 - protein, 7 aa, Mycobacterium tuberculosis
DTPLGRR

SEQ ID NO: 1398350 - protein, 7 aa, Mycobacterium tuberculosis
DTQARAQ

SEQ ID NO: 1398351 - protein, 9 aa, Mycobacterium tuberculosis
DTSAPGGVG

SEQ ID NO: 1398352 - protein, 6 aa, Mycobacterium tuberculosis
DTSRDI

SEQ ID NO: 1398353 - protein, 9 aa, Mycobacterium tuberculosis
DTSRPEPPI

SEQ ID NO: 1398354 - protein, 9 aa, Mycobacterium tuberculosis
DTSTSTATT

SEQ ID NO: 1398355 - protein, 7 aa, Mycobacterium tuberculosis
DTTIPAG

SEQ ID NO: 1398356 - protein, 7 aa, Mycobacterium tuberculosis
DTTNREA

SEQ ID NO: 1398357 - protein, 11 aa, Mycobacterium tuberculosis
DTTVRQSNYGV

SEQ ID NO: 1398358 - protein, 7 aa, Mycobacterium tuberculosis
DTVGGDR

SEQ ID NO: 1398359 - protein, 11 aa, Mycobacterium tuberculosis
DTYPARADEYG

SEQ ID NO: 1398360 - protein, 4 aa, Mycobacterium tuberculosis
DTYQ

SEQ ID NO: 1398361 - protein, 8 aa, Mycobacterium tuberculosis
DVATGRSA

SEQ ID NO: 1398362 - protein, 10 aa, Mycobacterium tuberculosis
DVDANGNDIA

SEQ ID NO: 1398363 - protein, 10 aa, Mycobacterium tuberculosis
DVDGAESNEA

SEQ ID NO: 1398364 - protein, 7 aa, Mycobacterium tuberculosis
DVGAGRS

SEQ ID NO: 1398365 - protein, 7 aa, Mycobacterium tuberculosis
DVGPAAV

SEQ ID NO: 1398366 - protein, 6 aa, Mycobacterium tuberculosis
DVGRSV

SEQ ID NO: 1398367 - protein, 7 aa, Mycobacterium tuberculosis
DVPAADS

SEQ ID NO: 1398368 - protein, 6 aa, Mycobacterium tuberculosis
DVPAAQ

SEQ ID NO: 1398369 - protein, 6 aa, Mycobacterium tuberculosis
DVPDDV

SEQ ID NO: 1398370 - protein, 8 aa, Mycobacterium tuberculosis
DVPEDGGA

SEQ ID NO: 1398371 - protein, 7 aa, Mycobacterium tuberculosis
DVPEDVT

SEQ ID NO: 1398372 - protein, 7 aa, Mycobacterium tuberculosis
DVPGTSA

SEQ ID NO: 1398373 - protein, 7 aa, Mycobacterium tuberculosis
DVPNDAQ

SEQ ID NO: 1398374 - protein, 6 aa, Mycobacterium tuberculosis
DVPTPA

SEQ ID NO: 1398375 - protein, 7 aa, Mycobacterium tuberculosis
DVPWDAD

SEQ ID NO: 1398376 - protein, 10 aa, Mycobacterium tuberculosis
DVQGGTTQEG

SEQ ID NO: 1398377 - protein, 5 aa, Mycobacterium tuberculosis
DVQGY

SEQ ID NO: 1398378 - protein, 5 aa, Mycobacterium tuberculosis
DVRTE

SEQ ID NO: 1398379 - protein, 9 aa, Mycobacterium tuberculosis
DVSAEEAER

SEQ ID NO: 1398380 - protein, 8 aa, Mycobacterium tuberculosis
DVSAGPGE

SEQ ID NO: 1398381 - protein, 8 aa, Mycobacterium tuberculosis
DVTGGATY

SEQ ID NO: 1398382 - protein, 5 aa, Mycobacterium tuberculosis
DVYAD

SEQ ID NO: 1398383 - protein, 5 aa, Mycobacterium tuberculosis
DYEGR

SEQ ID NO: 1398384 - protein, 17 aa, Mycobacterium tuberculosis
DYLDPAEARAEKATGAW

SEQ ID NO: 1398385 - protein, 6 aa, Mycobacterium tuberculosis
DYPTDP

SEQ ID NO: 1398386 - protein, 14 aa, Mycobacterium tuberculosis
DYYDPEPGVPGRSV

SEQ ID NO: 1398387 - protein, 6 aa, Mycobacterium tuberculosis
EAAAER

SEQ ID NO: 1398388 - protein, 13 aa, Mycobacterium tuberculosis
EAAAKGKGYSEKL

SEQ ID NO: 1398389 - protein, 9 aa, Mycobacterium tuberculosis
EAAANGEDI

SEQ ID NO: 1398390 - protein, 7 aa, Mycobacterium tuberculosis
EAADPGE

SEQ ID NO: 1398391 - protein, 11 aa, Mycobacterium tuberculosis
EAADSPARDRM

SEQ ID NO: 1398392 - protein, 6 aa, Mycobacterium tuberculosis
EAAGGR

SEQ ID NO: 1398393 - protein, 11 aa, Mycobacterium tuberculosis
EAANDASHEHP

SEQ ID NO: 1398394 - protein, 15 aa, Mycobacterium tuberculosis
EAANGSGDISYEPTN

SEQ ID NO: 1398395 - protein, 8 aa, Mycobacterium tuberculosis
EAAQAAGE

SEQ ID NO: 1398396 - protein, 7 aa, Mycobacterium tuberculosis
EAASTQV

SEQ ID NO: 1398397 - protein, 5 aa, Mycobacterium tuberculosis
EAATA

SEQ ID NO: 1398398 - protein, 7 aa, Mycobacterium tuberculosis
EADGRRP

SEQ ID NO: 1398399 - protein, 7 aa, Mycobacterium tuberculosis
EADGTIT

SEQ ID NO: 1398400 - protein, 5 aa, Mycobacterium tuberculosis
EADGY

SEQ ID NO: 1398401 - protein, 5 aa, Mycobacterium tuberculosis
EADSG

SEQ ID NO: 1398402 - protein, 4 aa, Mycobacterium tuberculosis
EAEA

SEQ ID NO: 1398403 - protein, 10 aa, Mycobacterium tuberculosis
EAERDKGGKV

SEQ ID NO: 1398404 - protein, 7 aa, Mycobacterium tuberculosis
EAGATAD

SEQ ID NO: 1398405 - protein, 8 aa, Mycobacterium tuberculosis
EAGDRQAN

SEQ ID NO: 1398406 - protein, 15 aa, Mycobacterium tuberculosis
EAGEPQASGKTYKVT

SEQ ID NO: 1398407 - protein, 6 aa, Mycobacterium tuberculosis
EAGHGD

SEQ ID NO: 1398408 - protein, 6 aa, Mycobacterium tuberculosis
EAGHRS

SEQ ID NO: 1398409 - protein, 5 aa, Mycobacterium tuberculosis
EAGNA

SEQ ID NO: 1398410 - protein, 6 aa, Mycobacterium tuberculosis
EAGPRV

SEQ ID NO: 1398411 - protein, 9 aa, Mycobacterium tuberculosis
EAGRGIPVP

SEQ ID NO: 1398412 - protein, 11 aa, Mycobacterium tuberculosis
EAGSHGKDTRG

SEQ ID NO: 1398413 - protein, 6 aa, Mycobacterium tuberculosis
EAGSVA

SEQ ID NO: 1398414 - protein, 10 aa, Mycobacterium tuberculosis
EAISASGGTI

SEQ ID NO: 1398415 - protein, 20 aa, Mycobacterium tuberculosis
EAKASGAPNVTNWGTGTPRR

SEQ ID NO: 1398416 - protein, 13 aa, Mycobacterium tuberculosis
EAKEGIETTETGE

SEQ ID NO: 1398417 - protein, 7 aa, Mycobacterium tuberculosis
EAKGRNG

SEQ ID NO: 1398418 - protein, 11 aa, Mycobacterium tuberculosis
EAKKSRDFASV

SEQ ID NO: 1398419 - protein, 12 aa, Mycobacterium tuberculosis
EALGSNGSTSMG

SEQ ID NO: 1398420 - protein, 5 aa, Mycobacterium tuberculosis
EALSK

SEQ ID NO: 1398421 - protein, 8 aa, Mycobacterium tuberculosis
EANASNAR

SEQ ID NO: 1398422 - protein, 8 aa, Mycobacterium tuberculosis
EANPRTRS

SEQ ID NO: 1398423 - protein, 4 aa, Mycobacterium tuberculosis
EAPA

SEQ ID NO: 1398424 - protein, 6 aa, Mycobacterium tuberculosis
EAPARA

SEQ ID NO: 1398425 - protein, 7 aa, Mycobacterium tuberculosis
EAPEETN

SEQ ID NO: 1398426 - protein, 10 aa, Mycobacterium tuberculosis
EAPGGEAARQ

SEQ ID NO: 1398427 - protein, 7 aa, Mycobacterium tuberculosis
EAPTTER

SEQ ID NO: 1398428 - protein, 9 aa, Mycobacterium tuberculosis
EAQQQSKGR

SEQ ID NO: 1398429 - protein, 4 aa, Mycobacterium tuberculosis
EARE

SEQ ID NO: 1398430 - protein, 10 aa, Mycobacterium tuberculosis
EARQVPGARK

SEQ ID NO: 1398431 - protein, 4 aa, Mycobacterium tuberculosis
EART

SEQ ID NO: 1398432 - protein, 20 aa, Mycobacterium tuberculosis
EASASGSSVMAGRKNKGAVA

SEQ ID NO: 1398433 - protein, 4 aa, Mycobacterium tuberculosis
EASR

SEQ ID NO: 1398434 - protein, 6 aa, Mycobacterium tuberculosis
EASRRN

SEQ ID NO: 1398435 - protein, 9 aa, Mycobacterium tuberculosis
EASSSRAGL

SEQ ID NO: 1398436 - protein, 5 aa, Mycobacterium tuberculosis
EASYA

SEQ ID NO: 1398437 - protein, 10 aa, Mycobacterium tuberculosis
EATAAEASPM

SEQ ID NO: 1398438 - protein, 8 aa, Mycobacterium tuberculosis
EATAGSGF

SEQ ID NO: 1398439 - protein, 6 aa, Mycobacterium tuberculosis
EATDET

SEQ ID NO: 1398440 - protein, 4 aa, Mycobacterium tuberculosis
EATE

SEQ ID NO: 1398441 - protein, 5 aa, Mycobacterium tuberculosis
EATEF

SEQ ID NO: 1398442 - protein, 19 aa, Mycobacterium tuberculosis
EATGCGGGKTSYNVAPTDT

SEQ ID NO: 1398443 - protein, 9 aa, Mycobacterium tuberculosis
EATGETRTY

SEQ ID NO: 1398444 - protein, 6 aa, Mycobacterium tuberculosis
EATQTE

SEQ ID NO: 1398445 - protein, 8 aa, Mycobacterium tuberculosis
EATRECPR

SEQ ID NO: 1398446 - protein, 24 aa, Mycobacterium tuberculosis
EATSRAEARAAQQRHAYLAKLKAA

SEQ ID NO: 1398447 - protein, 10 aa, Mycobacterium tuberculosis
EATTLDSNQG

SEQ ID NO: 1398448 - protein, 9 aa, Mycobacterium tuberculosis
EAYADGIGG

SEQ ID NO: 1398449 - protein, 17 aa, Mycobacterium tuberculosis
EDADERSHTAQKVDISR

SEQ ID NO: 1398450 - protein, 11 aa, Mycobacterium tuberculosis
EDAETADPSGL

SEQ ID NO: 1398451 - protein, 8 aa, Mycobacterium tuberculosis
EDAPQGTS

SEQ ID NO: 1398452 - protein, 4 aa, Mycobacterium tuberculosis
EDAR

SEQ ID NO: 1398453 - protein, 6 aa, Mycobacterium tuberculosis
EDASKD

SEQ ID NO: 1398454 - protein, 9 aa, Mycobacterium tuberculosis
EDATADAVY

SEQ ID NO: 1398455 - protein, 10 aa, Mycobacterium tuberculosis
EDCGGAGGSI

SEQ ID NO: 1398456 - protein, 8 aa, Mycobacterium tuberculosis
EDDAAAYA

SEQ ID NO: 1398457 - protein, 6 aa, Mycobacterium tuberculosis
EDDGPD

SEQ ID NO: 1398458 - protein, 15 aa, Mycobacterium tuberculosis
EDGAELATSRRGQTV

SEQ ID NO: 1398459 - protein, 8 aa, Mycobacterium tuberculosis
EDGAETDL

SEQ ID NO: 1398460 - protein, 9 aa, Mycobacterium tuberculosis
EDGPAGPKL

SEQ ID NO: 1398461 - protein, 8 aa, Mycobacterium tuberculosis
EDGQTIES

SEQ ID NO: 1398462 - protein, 13 aa, Mycobacterium tuberculosis
EDHTTTDSTLSIS

SEQ ID NO: 1398463 - protein, 6 aa, Mycobacterium tuberculosis
EDPAAG

SEQ ID NO: 1398464 - protein, 4 aa, Mycobacterium tuberculosis
EDPD

SEQ ID NO: 1398465 - protein, 5 aa, Mycobacterium tuberculosis
EDPDK

SEQ ID NO: 1398466 - protein, 4 aa, Mycobacterium tuberculosis
EDPL

SEQ ID NO: 1398467 - protein, 7 aa, Mycobacterium tuberculosis
EDPPHPQ

SEQ ID NO: 1398468 - protein, 6 aa, Mycobacterium tuberculosis
EDPPRR

SEQ ID NO: 1398469 - protein, 10 aa, Mycobacterium tuberculosis
EDPVPSDKHL

SEQ ID NO: 1398470 - protein, 4 aa, Mycobacterium tuberculosis
EDQH

SEQ ID NO: 1398471 - protein, 8 aa, Mycobacterium tuberculosis
EDQSRSAL

SEQ ID NO: 1398472 - protein, 6 aa, Mycobacterium tuberculosis
EDRDTI

SEQ ID NO: 1398473 - protein, 4 aa, Mycobacterium tuberculosis
EDRQ

SEQ ID NO: 1398474 - protein, 8 aa, Mycobacterium tuberculosis
EDSPEEIG

SEQ ID NO: 1398475 - protein, 4 aa, Mycobacterium tuberculosis
EDSR

SEQ ID NO: 1398476 - protein, 7 aa, Mycobacterium tuberculosis
EDSRIGA

SEQ ID NO: 1398477 - protein, 14 aa, Mycobacterium tuberculosis
EDSTAAATDAATVT

SEQ ID NO: 1398478 - protein, 4 aa, Mycobacterium tuberculosis
EDTI

SEQ ID NO: 1398479 - protein, 7 aa, Mycobacterium tuberculosis
EDTPLEQ

SEQ ID NO: 1398480 - protein, 8 aa, Mycobacterium tuberculosis
EDTRRRAG

SEQ ID NO: 1398481 - protein, 5 aa, Mycobacterium tuberculosis
EDVGV

SEQ ID NO: 1398482 - protein, 7 aa, Mycobacterium tuberculosis
EDVPPGA

SEQ ID NO: 1398483 - protein, 8 aa, Mycobacterium tuberculosis
EEAETPPV

SEQ ID NO: 1398484 - protein, 18 aa, Mycobacterium tuberculosis
EEAGAAAADAVAEADAEL

SEQ ID NO: 1398485 - protein, 10 aa, Mycobacterium tuberculosis
EEASKEAKEV

SEQ ID NO: 1398486 - protein, 5 aa, Mycobacterium tuberculosis
EEDAA

SEQ ID NO: 1398487 - protein, 8 aa, Mycobacterium tuberculosis
EEDLTTGR

SEQ ID NO: 1398488 - protein, 8 aa, Mycobacterium tuberculosis
EEDSRGRT

SEQ ID NO: 1398489 - protein, 4 aa, Mycobacterium tuberculosis
EEEA

SEQ ID NO: 1398490 - protein, 16 aa, Mycobacterium tuberculosis
EEEADSSGMFQPANAP

SEQ ID NO: 1398491 - protein, 10 aa, Mycobacterium tuberculosis
EEENPEAAQA

SEQ ID NO: 1398492 - protein, 5 aa, Mycobacterium tuberculosis
EEGAR

SEQ ID NO: 1398493 - protein, 6 aa, Mycobacterium tuberculosis
EEGIAD

SEQ ID NO: 1398494 - protein, 7 aa, Mycobacterium tuberculosis
EEGNADA

SEQ ID NO: 1398495 - protein, 6 aa, Mycobacterium tuberculosis
EEGPAL

SEQ ID NO: 1398496 - protein, 7 aa, Mycobacterium tuberculosis
EEGPTEQ

SEQ ID NO: 1398497 - protein, 11 aa, Mycobacterium tuberculosis
EELPDEPEPGT

SEQ ID NO: 1398498 - protein, 13 aa, Mycobacterium tuberculosis
EELQAQQTAESRA

SEQ ID NO: 1398499 - protein, 14 aa, Mycobacterium tuberculosis
EELSESTDWTATSA

SEQ ID NO: 1398500 - protein, 7 aa, Mycobacterium tuberculosis
EEPNGLQ

SEQ ID NO: 1398501 - protein, 11 aa, Mycobacterium tuberculosis
EEQGVAPEQLA

SEQ ID NO: 1398502 - protein, 4 aa, Mycobacterium tuberculosis
EERG

SEQ ID NO: 1398503 - protein, 9 aa, Mycobacterium tuberculosis
EERNRADST

SEQ ID NO: 1398504 - protein, 13 aa, Mycobacterium tuberculosis
EESADPDIDADSD

SEQ ID NO: 1398505 - protein, 6 aa, Mycobacterium tuberculosis
EESIRR

SEQ ID NO: 1398506 - protein, 8 aa, Mycobacterium tuberculosis
EESRGSTR

SEQ ID NO: 1398507 - protein, 4 aa, Mycobacterium tuberculosis
EETD

SEQ ID NO: 1398508 - protein, 8 aa, Mycobacterium tuberculosis
EETDPRIG

SEQ ID NO: 1398509 - protein, 11 aa, Mycobacterium tuberculosis
EETDRNPPRLE

SEQ ID NO: 1398510 - protein, 11 aa, Mycobacterium tuberculosis
EETTTHYSPSA

SEQ ID NO: 1398511 - protein, 11 aa, Mycobacterium tuberculosis
EEVGNGDGPEC

SEQ ID NO: 1398512 - protein, 11 aa, Mycobacterium tuberculosis
EEWSPDSESSH

SEQ ID NO: 1398513 - protein, 16 aa, Mycobacterium tuberculosis
EFAPGGPTAAVPPGSW

SEQ ID NO: 1398514 - protein, 7 aa, Mycobacterium tuberculosis
EFDGDRS

SEQ ID NO: 1398515 - protein, 7 aa, Mycobacterium tuberculosis
EFGQPGT

SEQ ID NO: 1398516 - protein, 5 aa, Mycobacterium tuberculosis
EFTKR

SEQ ID NO: 1398517 - protein, 6 aa, Mycobacterium tuberculosis
EGADGV

SEQ ID NO: 1398518 - protein, 10 aa, Mycobacterium tuberculosis
EGAEPGTQLT

SEQ ID NO: 1398519 - protein, 5 aa, Mycobacterium tuberculosis
EGAPD

SEQ ID NO: 1398520 - protein, 7 aa, Mycobacterium tuberculosis
EGDAAYD

SEQ ID NO: 1398521 - protein, 8 aa, Mycobacterium tuberculosis
EGDAGQQV

SEQ ID NO: 1398522 - protein, 8 aa, Mycobacterium tuberculosis
EGDETVRP

SEQ ID NO: 1398523 - protein, 11 aa, Mycobacterium tuberculosis
EGEDDPTEEEL

SEQ ID NO: 1398524 - protein, 7 aa, Mycobacterium tuberculosis
EGEKDHA

SEQ ID NO: 1398525 - protein, 6 aa, Mycobacterium tuberculosis
EGGAAA

SEQ ID NO: 1398526 - protein, 6 aa, Mycobacterium tuberculosis
EGGAGL

SEQ ID NO: 1398527 - protein, 10 aa, Mycobacterium tuberculosis
EGGGELADGD

SEQ ID NO: 1398528 - protein, 5 aa, Mycobacterium tuberculosis
EGGGR

SEQ ID NO: 1398529 - protein, 13 aa, Mycobacterium tuberculosis
EGGGTANVTIIER

SEQ ID NO: 1398530 - protein, 14 aa, Mycobacterium tuberculosis
EGGKITGERETDEG

SEQ ID NO: 1398531 - protein, 5 aa, Mycobacterium tuberculosis
EGGPT

SEQ ID NO: 1398532 - protein, 12 aa, Mycobacterium tuberculosis
EGGRGPKQARDC

SEQ ID NO: 1398533 - protein, 8 aa, Mycobacterium tuberculosis
EGGTAGTV

SEQ ID NO: 1398534 - protein, 8 aa, Mycobacterium tuberculosis
EGHPGHGP

SEQ ID NO: 1398535 - protein, 6 aa, Mycobacterium tuberculosis
EGHRNG

SEQ ID NO: 1398536 - protein, 4 aa, Mycobacterium tuberculosis
EGIQ

SEQ ID NO: 1398537 - protein, 9 aa, Mycobacterium tuberculosis
EGKKLSAAS

SEQ ID NO: 1398538 - protein, 5 aa, Mycobacterium tuberculosis
EGKTA

SEQ ID NO: 1398539 - protein, 10 aa, Mycobacterium tuberculosis
EGKTAGDSAR

SEQ ID NO: 1398540 - protein, 13 aa, Mycobacterium tuberculosis
EGPAVEQPGQDNV

SEQ ID NO: 1398541 - protein, 7 aa, Mycobacterium tuberculosis
EGPDGLE

SEQ ID NO: 1398542 - protein, 8 aa, Mycobacterium tuberculosis
EGPEVETE

SEQ ID NO: 1398543 - protein, 6 aa, Mycobacterium tuberculosis
EGPGLT

SEQ ID NO: 1398544 - protein, 9 aa, Mycobacterium tuberculosis
EGPKGGPGM

SEQ ID NO: 1398545 - protein, 6 aa, Mycobacterium tuberculosis
EGPKNV

SEQ ID NO: 1398546 - protein, 11 aa, Mycobacterium tuberculosis
EGPLRDSTAGR

SEQ ID NO: 1398547 - protein, 4 aa, Mycobacterium tuberculosis
EGPT

SEQ ID NO: 1398548 - protein, 24 aa, Mycobacterium tuberculosis
EGPVASATDTLDTRGDSDYENQPV

SEQ ID NO: 1398549 - protein, 5 aa, Mycobacterium tuberculosis
EGPVD

SEQ ID NO: 1398550 - protein, 5 aa, Mycobacterium tuberculosis
EGQEV

SEQ ID NO: 1398551 - protein, 9 aa, Mycobacterium tuberculosis
EGRGEPRDD

SEQ ID NO: 1398552 - protein, 13 aa, Mycobacterium tuberculosis
EGRGQANATIVEL

SEQ ID NO: 1398553 - protein, 5 aa, Mycobacterium tuberculosis
EGRGV

SEQ ID NO: 1398554 - protein, 8 aa, Mycobacterium tuberculosis
EGRPSTDA

SEQ ID NO: 1398555 - protein, 8 aa, Mycobacterium tuberculosis
EGSEERRI

SEQ ID NO: 1398556 - protein, 7 aa, Mycobacterium tuberculosis
EGSPTFG

SEQ ID NO: 1398557 - protein, 10 aa, Mycobacterium tuberculosis
EGSRPTTYDH

SEQ ID NO: 1398558 - protein, 8 aa, Mycobacterium tuberculosis
EGTAVGKA

SEQ ID NO: 1398559 - protein, 6 aa, Mycobacterium tuberculosis
EGTDTA

SEQ ID NO: 1398560 - protein, 5 aa, Mycobacterium tuberculosis
EGTGA

SEQ ID NO: 1398561 - protein, 6 aa, Mycobacterium tuberculosis
EGTGPP

SEQ ID NO: 1398562 - protein, 16 aa, Mycobacterium tuberculosis
EGTPHPARDGFPDEIA

SEQ ID NO: 1398563 - protein, 7 aa, Mycobacterium tuberculosis
EGTPPGL

SEQ ID NO: 1398564 - protein, 12 aa, Mycobacterium tuberculosis
EGTRLDTTEVGS

SEQ ID NO: 1398565 - protein, 10 aa, Mycobacterium tuberculosis
EGTRSRTGKM

SEQ ID NO: 1398566 - protein, 6 aa, Mycobacterium tuberculosis
EGVEQS

SEQ ID NO: 1398567 - protein, 6 aa, Mycobacterium tuberculosis
EGVPGE

SEQ ID NO: 1398568 - protein, 4 aa, Mycobacterium tuberculosis
EGVQ

SEQ ID NO: 1398569 - protein, 11 aa, Mycobacterium tuberculosis
EGVRRTGGNTV

SEQ ID NO: 1398570 - protein, 8 aa, Mycobacterium tuberculosis
EGVTASRA

SEQ ID NO: 1398571 - protein, 5 aa, Mycobacterium tuberculosis
EGVTP

SEQ ID NO: 1398572 - protein, 10 aa, Mycobacterium tuberculosis
EGYQQTENGY

SEQ ID NO: 1398573 - protein, 17 aa, Mycobacterium tuberculosis
EHAEAEKRAAARAGHAA

SEQ ID NO: 1398574 - protein, 8 aa, Mycobacterium tuberculosis
EHAKARGA

SEQ ID NO: 1398575 - protein, 4 aa, Mycobacterium tuberculosis
EHDR

SEQ ID NO: 1398576 - protein, 7 aa, Mycobacterium tuberculosis
EHEASDP

SEQ ID NO: 1398577 - protein, 10 aa, Mycobacterium tuberculosis
EHGASSEAAR

SEQ ID NO: 1398578 - protein, 15 aa, Mycobacterium tuberculosis
EHGKTLADARGDVQR

SEQ ID NO: 1398579 - protein, 7 aa, Mycobacterium tuberculosis
EHGNERV

SEQ ID NO: 1398580 - protein, 10 aa, Mycobacterium tuberculosis
EHGPDGEPWR

SEQ ID NO: 1398581 - protein, 4 aa, Mycobacterium tuberculosis
EHGW

SEQ ID NO: 1398582 - protein, 8 aa, Mycobacterium tuberculosis
EHLGDRSP

SEQ ID NO: 1398583 - protein, 6 aa, Mycobacterium tuberculosis
EHPDKL

SEQ ID NO: 1398584 - protein, 7 aa, Mycobacterium tuberculosis
EHPRGDA

SEQ ID NO: 1398585 - protein, 7 aa, Mycobacterium tuberculosis
EHRGSPH

SEQ ID NO: 1398586 - protein, 8 aa, Mycobacterium tuberculosis
EHSSDGKF

SEQ ID NO: 1398587 - protein, 8 aa, Mycobacterium tuberculosis
EIAGAPSD

SEQ ID NO: 1398588 - protein, 5 aa, Mycobacterium tuberculosis
EIAGP

SEQ ID NO: 1398589 - protein, 10 aa, Mycobacterium tuberculosis
EIGPSPAEAD

SEQ ID NO: 1398590 - protein, 15 aa, Mycobacterium tuberculosis
EIPDGSPDDPGAAET

SEQ ID NO: 1398591 - protein, 7 aa, Mycobacterium tuberculosis
EIPTAKA

SEQ ID NO: 1398592 - protein, 7 aa, Mycobacterium tuberculosis
EITGKPV

SEQ ID NO: 1398593 - protein, 12 aa, Mycobacterium tuberculosis
EIYGGTKSAWDY

SEQ ID NO: 1398594 - protein, 10 aa, Mycobacterium tuberculosis
EKACAADGQP

SEQ ID NO: 1398595 - protein, 6 aa, Mycobacterium tuberculosis
EKADRT

SEQ ID NO: 1398596 - protein, 18 aa, Mycobacterium tuberculosis
EKAERDLAKQATQYRPDQ

SEQ ID NO: 1398597 - protein, 4 aa, Mycobacterium tuberculosis
EKAG

SEQ ID NO: 1398598 - protein, 10 aa, Mycobacterium tuberculosis
EKEAADGIEG

SEQ ID NO: 1398599 - protein, 7 aa, Mycobacterium tuberculosis
EKEAAPL

SEQ ID NO: 1398600 - protein, 6 aa, Mycobacterium tuberculosis
EKFPTS

SEQ ID NO: 1398601 - protein, 8 aa, Mycobacterium tuberculosis
EKGAPTPV

SEQ ID NO: 1398602 - protein, 4 aa, Mycobacterium tuberculosis
EKGR

SEQ ID NO: 1398603 - protein, 6 aa, Mycobacterium tuberculosis
EKHPTP

SEQ ID NO: 1398604 - protein, 7 aa, Mycobacterium tuberculosis
EKLPAGQ

SEQ ID NO: 1398605 - protein, 6 aa, Mycobacterium tuberculosis
EKPDDV

SEQ ID NO: 1398606 - protein, 6 aa, Mycobacterium tuberculosis
EKPSLP

SEQ ID NO: 1398607 - protein, 8 aa, Mycobacterium tuberculosis
EKPTAESV

SEQ ID NO: 1398608 - protein, 5 aa, Mycobacterium tuberculosis
EKQGE

SEQ ID NO: 1398609 - protein, 18 aa, Mycobacterium tuberculosis
EKQKDVSARFGSKEPDKF

SEQ ID NO: 1398610 - protein, 11 aa, Mycobacterium tuberculosis
EKQKEGKKRMK

SEQ ID NO: 1398611 - protein, 8 aa, Mycobacterium tuberculosis
EKRPLGDG

SEQ ID NO: 1398612 - protein, 13 aa, Mycobacterium tuberculosis
EKRRTYEARARGE

SEQ ID NO: 1398613 - protein, 8 aa, Mycobacterium tuberculosis
EKRSTVSE

SEQ ID NO: 1398614 - protein, 21 aa, Mycobacterium tuberculosis
EKSGGRSGVYRRSASDLACQS

SEQ ID NO: 1398615 - protein, 6 aa, Mycobacterium tuberculosis
EKTGSL

SEQ ID NO: 1398616 - protein, 20 aa, Mycobacterium tuberculosis
EKVSEKAARRSSGRPASNTA

SEQ ID NO: 1398617 - protein, 6 aa, Mycobacterium tuberculosis
ELAPGR

SEQ ID NO: 1398618 - protein, 5 aa, Mycobacterium tuberculosis
ELAPR

SEQ ID NO: 1398619 - protein, 9 aa, Mycobacterium tuberculosis
ELEEAGGQA

SEQ ID NO: 1398620 - protein, 10 aa, Mycobacterium tuberculosis
ELEGATPDGV

SEQ ID NO: 1398621 - protein, 8 aa, Mycobacterium tuberculosis
ELENSATD

SEQ ID NO: 1398622 - protein, 13 aa, Mycobacterium tuberculosis
ELEPPGNRTGSNR

SEQ ID NO: 1398623 - protein, 21 aa, Mycobacterium tuberculosis
ELGEPAVPPESARQAPPDTSL

SEQ ID NO: 1398624 - protein, 7 aa, Mycobacterium tuberculosis
ELGPDGK

SEQ ID NO: 1398625 - protein, 27 aa, Mycobacterium tuberculosis
ELGQRGSAAPVDSNADAGGFDQFNRGK

SEQ ID NO: 1398626 - protein, 7 aa, Mycobacterium tuberculosis
ELGSAGA

SEQ ID NO: 1398627 - protein, 8 aa, Mycobacterium tuberculosis
ELGSPDRK

SEQ ID NO: 1398628 - protein, 16 aa, Mycobacterium tuberculosis
ELKPNSPYGASKAAAD

SEQ ID NO: 1398629 - protein, 6 aa, Mycobacterium tuberculosis
ELPAGH

SEQ ID NO: 1398630 - protein, 6 aa, Mycobacterium tuberculosis
ELPAPG

SEQ ID NO: 1398631 - protein, 4 aa, Mycobacterium tuberculosis
ELPD

SEQ ID NO: 1398632 - protein, 11 aa, Mycobacterium tuberculosis
ELPENSHAEPG

SEQ ID NO: 1398633 - protein, 6 aa, Mycobacterium tuberculosis
ELPGDP

SEQ ID NO: 1398634 - protein, 16 aa, Mycobacterium tuberculosis
ELPKGYPVSSAPYGSA

SEQ ID NO: 1398635 - protein, 7 aa, Mycobacterium tuberculosis
ELPKPAE

SEQ ID NO: 1398636 - protein, 4 aa, Mycobacterium tuberculosis
ELPN

SEQ ID NO: 1398637 - protein, 7 aa, Mycobacterium tuberculosis
ELPPGGR

SEQ ID NO: 1398638 - protein, 9 aa, Mycobacterium tuberculosis
ELQKRSTGR

SEQ ID NO: 1398639 - protein, 6 aa, Mycobacterium tuberculosis
ELRAPM

SEQ ID NO: 1398640 - protein, 16 aa, Mycobacterium tuberculosis
ELRDGNPGSSGQVPAP

SEQ ID NO: 1398641 - protein, 14 aa, Mycobacterium tuberculosis
ELRGPGKTRALAQS

SEQ ID NO: 1398642 - protein, 11 aa, Mycobacterium tuberculosis
ELRPGSQGRSE

SEQ ID NO: 1398643 - protein, 8 aa, Mycobacterium tuberculosis
ELRPHQQQ

SEQ ID NO: 1398644 - protein, 10 aa, Mycobacterium tuberculosis
ELSTDDSPGF

SEQ ID NO: 1398645 - protein, 11 aa, Mycobacterium tuberculosis
ELTGVKEKSTL

SEQ ID NO: 1398646 - protein, 5 aa, Mycobacterium tuberculosis
EMDPS

SEQ ID NO: 1398647 - protein, 13 aa, Mycobacterium tuberculosis
EMEEPPPATPRRP

SEQ ID NO: 1398648 - protein, 10 aa, Mycobacterium tuberculosis
EMGGNASLKR

SEQ ID NO: 1398649 - protein, 8 aa, Mycobacterium tuberculosis
ENAAGKAA

SEQ ID NO: 1398650 - protein, 8 aa, Mycobacterium tuberculosis
ENAEGADD

SEQ ID NO: 1398651 - protein, 9 aa, Mycobacterium tuberculosis
ENATGTQDE

SEQ ID NO: 1398652 - protein, 10 aa, Mycobacterium tuberculosis
ENDPVATDPE

SEQ ID NO: 1398653 - protein, 7 aa, Mycobacterium tuberculosis
ENDQRPI

SEQ ID NO: 1398654 - protein, 4 aa, Mycobacterium tuberculosis
ENDR

SEQ ID NO: 1398655 - protein, 8 aa, Mycobacterium tuberculosis
ENEAGGPL

SEQ ID NO: 1398656 - protein, 5 aa, Mycobacterium tuberculosis
ENEDE

SEQ ID NO: 1398657 - protein, 14 aa, Mycobacterium tuberculosis
ENEDLPNTTNPDDW

SEQ ID NO: 1398658 - protein, 12 aa, Mycobacterium tuberculosis
ENERPTADPNIA

SEQ ID NO: 1398659 - protein, 8 aa, Mycobacterium tuberculosis
ENGSPAVA

SEQ ID NO: 1398660 - protein, 7 aa, Mycobacterium tuberculosis
ENGVGTV

SEQ ID NO: 1398661 - protein, 13 aa, Mycobacterium tuberculosis
ENLPADDPVRNGN

SEQ ID NO: 1398662 - protein, 6 aa, Mycobacterium tuberculosis
ENLPFD

SEQ ID NO: 1398663 - protein, 6 aa, Mycobacterium tuberculosis
ENPANP

SEQ ID NO: 1398664 - protein, 5 aa, Mycobacterium tuberculosis
ENPDL

SEQ ID NO: 1398665 - protein, 5 aa, Mycobacterium tuberculosis
ENPDS

SEQ ID NO: 1398666 - protein, 8 aa, Mycobacterium tuberculosis
ENPDTGWD

SEQ ID NO: 1398667 - protein, 7 aa, Mycobacterium tuberculosis
ENPHQQA

SEQ ID NO: 1398668 - protein, 12 aa, Mycobacterium tuberculosis
ENPPAGGAESAI

SEQ ID NO: 1398669 - protein, 7 aa, Mycobacterium tuberculosis
ENPVDAT

SEQ ID NO: 1398670 - protein, 10 aa, Mycobacterium tuberculosis
ENRELGDTST

SEQ ID NO: 1398671 - protein, 7 aa, Mycobacterium tuberculosis
ENRNLQR

SEQ ID NO: 1398672 - protein, 6 aa, Mycobacterium tuberculosis
ENSEAV

SEQ ID NO: 1398673 - protein, 10 aa, Mycobacterium tuberculosis
ENSPVTEVRP

SEQ ID NO: 1398674 - protein, 10 aa, Mycobacterium tuberculosis
ENSRGRPARE

SEQ ID NO: 1398675 - protein, 9 aa, Mycobacterium tuberculosis
ENSTAAPPL

SEQ ID NO: 1398676 - protein, 17 aa, Mycobacterium tuberculosis
ENTKGKPAVGGEPAKNI

SEQ ID NO: 1398677 - protein, 8 aa, Mycobacterium tuberculosis
ENVPDQGG

SEQ ID NO: 1398678 - protein, 4 aa, Mycobacterium tuberculosis
ENYD

SEQ ID NO: 1398679 - protein, 8 aa, Mycobacterium tuberculosis
ENYDDPAA

SEQ ID NO: 1398680 - protein, 5 aa, Mycobacterium tuberculosis
ENYPG

SEQ ID NO: 1398681 - protein, 5 aa, Mycobacterium tuberculosis
EPAAG

SEQ ID NO: 1398682 - protein, 7 aa, Mycobacterium tuberculosis
EPAEWGP

SEQ ID NO: 1398683 - protein, 6 aa, Mycobacterium tuberculosis
EPAGEE

SEQ ID NO: 1398684 - protein, 6 aa, Mycobacterium tuberculosis
EPAGPI

SEQ ID NO: 1398685 - protein, 8 aa, Mycobacterium tuberculosis
EPANQGAW

SEQ ID NO: 1398686 - protein, 9 aa, Mycobacterium tuberculosis
EPAPGTHSR

SEQ ID NO: 1398687 - protein, 6 aa, Mycobacterium tuberculosis
EPAPTG

SEQ ID NO: 1398688 - protein, 12 aa, Mycobacterium tuberculosis
EPARSQPEQIQL

SEQ ID NO: 1398689 - protein, 19 aa, Mycobacterium tuberculosis
EPDAGSDAASVKTRATRVE

SEQ ID NO: 1398690 - protein, 21 aa, Mycobacterium tuberculosis
EPDAGSDVGAGRTKAFEQPDG

SEQ ID NO: 1398691 - protein, 4 aa, Mycobacterium tuberculosis
EPDD

SEQ ID NO: 1398692 - protein, 6 aa, Mycobacterium tuberculosis
EPDDAG

SEQ ID NO: 1398693 - protein, 6 aa, Mycobacterium tuberculosis
EPDDVS

SEQ ID NO: 1398694 - protein, 6 aa, Mycobacterium tuberculosis
EPDGFR

SEQ ID NO: 1398695 - protein, 6 aa, Mycobacterium tuberculosis
EPDGHA

SEQ ID NO: 1398696 - protein, 6 aa, Mycobacterium tuberculosis
EPDGPG

SEQ ID NO: 1398697 - protein, 8 aa, Mycobacterium tuberculosis
EPDGTGSL

SEQ ID NO: 1398698 - protein, 6 aa, Mycobacterium tuberculosis
EPDGTT

SEQ ID NO: 1398699 - protein, 8 aa, Mycobacterium tuberculosis
EPDPDEMH

SEQ ID NO: 1398700 - protein, 4 aa, Mycobacterium tuberculosis
EPDT

SEQ ID NO: 1398701 - protein, 4 aa, Mycobacterium tuberculosis
EPDY

SEQ ID NO: 1398702 - protein, 4 aa, Mycobacterium tuberculosis
EPEI

SEQ ID NO: 1398703 - protein, 5 aa, Mycobacterium tuberculosis
EPEIG

SEQ ID NO: 1398704 - protein, 9 aa, Mycobacterium tuberculosis
EPENSASAR

SEQ ID NO: 1398705 - protein, 7 aa, Mycobacterium tuberculosis
EPETDLD

SEQ ID NO: 1398706 - protein, 7 aa, Mycobacterium tuberculosis
EPETESG

SEQ ID NO: 1398707 - protein, 6 aa, Mycobacterium tuberculosis
EPETTE

SEQ ID NO: 1398708 - protein, 4 aa, Mycobacterium tuberculosis
EPGD

SEQ ID NO: 1398709 - protein, 8 aa, Mycobacterium tuberculosis
EPGETAGF

SEQ ID NO: 1398710 - protein, 5 aa, Mycobacterium tuberculosis
EPGIP

SEQ ID NO: 1398711 - protein, 5 aa, Mycobacterium tuberculosis
EPGIR

SEQ ID NO: 1398712 - protein, 4 aa, Mycobacterium tuberculosis
EPGK

SEQ ID NO: 1398713 - protein, 9 aa, Mycobacterium tuberculosis
EPGPDFEPS

SEQ ID NO: 1398714 - protein, 6 aa, Mycobacterium tuberculosis
EPGTDH

SEQ ID NO: 1398715 - protein, 8 aa, Mycobacterium tuberculosis
EPGTNGQH

SEQ ID NO: 1398716 - protein, 6 aa, Mycobacterium tuberculosis
EPHDGA

SEQ ID NO: 1398717 - protein, 4 aa, Mycobacterium tuberculosis
EPHI

SEQ ID NO: 1398718 - protein, 9 aa, Mycobacterium tuberculosis
EPIRSGDEV

SEQ ID NO: 1398719 - protein, 8 aa, Mycobacterium tuberculosis
EPKPDAPV

SEQ ID NO: 1398720 - protein, 17 aa, Mycobacterium tuberculosis
EPKRRGRQSASAPPLRE

SEQ ID NO: 1398721 - protein, 11 aa, Mycobacterium tuberculosis
EPKTKSDQEKL

SEQ ID NO: 1398722 - protein, 9 aa, Mycobacterium tuberculosis
EPLAGQPLD

SEQ ID NO: 1398723 - protein, 13 aa, Mycobacterium tuberculosis
EPLDQTTSRGQYA

SEQ ID NO: 1398724 - protein, 5 aa, Mycobacterium tuberculosis
EPLDT

SEQ ID NO: 1398725 - protein, 4 aa, Mycobacterium tuberculosis
EPLT

SEQ ID NO: 1398726 - protein, 5 aa, Mycobacterium tuberculosis
EPNEG

SEQ ID NO: 1398727 - protein, 9 aa, Mycobacterium tuberculosis
EPNGRGSRM

SEQ ID NO: 1398728 - protein, 14 aa, Mycobacterium tuberculosis
EPNGRRLRNRPQNW

SEQ ID NO: 1398729 - protein, 10 aa, Mycobacterium tuberculosis
EPNPADAHDA

SEQ ID NO: 1398730 - protein, 9 aa, Mycobacterium tuberculosis
EPPDHTRYR

SEQ ID NO: 1398731 - protein, 15 aa, Mycobacterium tuberculosis
EPPVEDGEYRQTPAE

SEQ ID NO: 1398732 - protein, 6 aa, Mycobacterium tuberculosis
EPQHFT

SEQ ID NO: 1398733 - protein, 14 aa, Mycobacterium tuberculosis
EPRAKTRNLRRDPR

SEQ ID NO: 1398734 - protein, 6 aa, Mycobacterium tuberculosis
EPRGEN

SEQ ID NO: 1398735 - protein, 10 aa, Mycobacterium tuberculosis
EPRSTGARHD

SEQ ID NO: 1398736 - protein, 11 aa, Mycobacterium tuberculosis
EPRVGDPEGPT

SEQ ID NO: 1398737 - protein, 6 aa, Mycobacterium tuberculosis
EPSAPL

SEQ ID NO: 1398738 - protein, 6 aa, Mycobacterium tuberculosis
EPTATL

SEQ ID NO: 1398739 - protein, 7 aa, Mycobacterium tuberculosis
EPTEVGQ

SEQ ID NO: 1398740 - protein, 12 aa, Mycobacterium tuberculosis
EPTGNLDPETSR

SEQ ID NO: 1398741 - protein, 6 aa, Mycobacterium tuberculosis
EPTSAL

SEQ ID NO: 1398742 - protein, 7 aa, Mycobacterium tuberculosis
EPTSTQT

SEQ ID NO: 1398743 - protein, 11 aa, Mycobacterium tuberculosis
EPTTVGDGYAR

SEQ ID NO: 1398744 - protein, 13 aa, Mycobacterium tuberculosis
EPTYEDGIGDRNK

SEQ ID NO: 1398745 - protein, 6 aa, Mycobacterium tuberculosis
EPVSLT

SEQ ID NO: 1398746 - protein, 7 aa, Mycobacterium tuberculosis
EQAEEYR

SEQ ID NO: 1398747 - protein, 7 aa, Mycobacterium tuberculosis
EQAGPEE

SEQ ID NO: 1398748 - protein, 5 aa, Mycobacterium tuberculosis
EQAHG

SEQ ID NO: 1398749 - protein, 9 aa, Mycobacterium tuberculosis
EQASLQDSN

SEQ ID NO: 1398750 - protein, 7 aa, Mycobacterium tuberculosis
EQEPMDG

SEQ ID NO: 1398751 - protein, 18 aa, Mycobacterium tuberculosis
EQFADRKPRQLSGGQAQR

SEQ ID NO: 1398752 - protein, 5 aa, Mycobacterium tuberculosis
EQGAA

SEQ ID NO: 1398753 - protein, 30 aa, Mycobacterium tuberculosis; identical to SEQ ID NO: 173793

SEQ ID NO: 1398754 - protein, 7 aa, Mycobacterium tuberculosis
EQIGNDY

SEQ ID NO: 1398755 - protein, 7 aa, Mycobacterium tuberculosis
EQLGGGY

SEQ ID NO: 1398756 - protein, 11 aa, Mycobacterium tuberculosis
EQLGQGKENAR

SEQ ID NO: 1398757 - protein, 4 aa, Mycobacterium tuberculosis
EQLH

SEQ ID NO: 1398758 - protein, 7 aa, Mycobacterium tuberculosis
EQNCSTS

SEQ ID NO: 1398759 - protein, 9 aa, Mycobacterium tuberculosis
EQNEPPGRR

SEQ ID NO: 1398760 - protein, 15 aa, Mycobacterium tuberculosis
EQNRRSHPLQGEQTL

SEQ ID NO: 1398761 - protein, 7 aa, Mycobacterium tuberculosis
EQPDTGV

SEQ ID NO: 1398762 - protein, 6 aa, Mycobacterium tuberculosis
EQPQNQ

SEQ ID NO: 1398763 - protein, 8 aa, Mycobacterium tuberculosis
EQPTYENA

SEQ ID NO: 1398764 - protein, 8 aa, Mycobacterium tuberculosis
EQQARPRD

SEQ ID NO: 1398765 - protein, 7 aa, Mycobacterium tuberculosis
EQQGERF

SEQ ID NO: 1398766 - protein, 6 aa, Mycobacterium tuberculosis
EQRDPA

SEQ ID NO: 1398767 - protein, 4 aa, Mycobacterium tuberculosis
EQRG

SEQ ID NO: 1398768 - protein, 7 aa, Mycobacterium tuberculosis
EQSPTQQ

SEQ ID NO: 1398769 - protein, 8 aa, Mycobacterium tuberculosis
EQSSDGGW

SEQ ID NO: 1398770 - protein, 10 aa, Mycobacterium tuberculosis
EQSSKAAGEV

SEQ ID NO: 1398771 - protein, 5 aa, Mycobacterium tuberculosis
EQTAQ

SEQ ID NO: 1398772 - protein, 19 aa, Mycobacterium tuberculosis
EQTDAAAGALPGLSEPAAK

SEQ ID NO: 1398773 - protein, 6 aa, Mycobacterium tuberculosis
EQTGRS

SEQ ID NO: 1398774 - protein, 15 aa, Mycobacterium tuberculosis
EQVDAADAVPSAGQA

SEQ ID NO: 1398775 - protein, 8 aa, Mycobacterium tuberculosis
EQYGGSPV

SEQ ID NO: 1398776 - protein, 8 aa, Mycobacterium tuberculosis
ERAAASGA

SEQ ID NO: 1398777 - protein, 8 aa, Mycobacterium tuberculosis
ERAEEVNH

SEQ ID NO: 1398778 - protein, 8 aa, Mycobacterium tuberculosis
ERAGDARS

SEQ ID NO: 1398779 - protein, 8 aa, Mycobacterium tuberculosis
ERAHDEVR

SEQ ID NO: 1398780 - protein, 6 aa, Mycobacterium tuberculosis
ERARNG

SEQ ID NO: 1398781 - protein, 21 aa, Mycobacterium tuberculosis
ERATGRLEKEARTNKARKPVY

SEQ ID NO: 1398782 - protein, 7 aa, Mycobacterium tuberculosis
ERDEEPE

SEQ ID NO: 1398783 - protein, 5 aa, Mycobacterium tuberculosis
ERDGV

SEQ ID NO: 1398784 - protein, 8 aa, Mycobacterium tuberculosis
ERDTGNYT

SEQ ID NO: 1398785 - protein, 7 aa, Mycobacterium tuberculosis
EREGEKD

SEQ ID NO: 1398786 - protein, 6 aa, Mycobacterium tuberculosis
ERGAEA

SEQ ID NO: 1398787 - protein, 7 aa, Mycobacterium tuberculosis
ERGGSHR

SEQ ID NO: 1398788 - protein, 9 aa, Mycobacterium tuberculosis
ERGPAATSI

SEQ ID NO: 1398789 - protein, 10 aa, Mycobacterium tuberculosis
ERGQADDDLP

SEQ ID NO: 1398790 - protein, 8 aa, Mycobacterium tuberculosis
ERGQTAKR

SEQ ID NO: 1398791 - protein, 6 aa, Mycobacterium tuberculosis
ERGSGR

SEQ ID NO: 1398792 - protein, 4 aa, Mycobacterium tuberculosis
ERGT

SEQ ID NO: 1398793 - protein, 8 aa, Mycobacterium tuberculosis
ERHESRRI

SEQ ID NO: 1398794 - protein, 8 aa, Mycobacterium tuberculosis
ERKLTDGD

SEQ ID NO: 1398795 - protein, 9 aa, Mycobacterium tuberculosis
ERLEPSERP

SEQ ID NO: 1398796 - protein, 10 aa, Mycobacterium tuberculosis
ERPASSGEGL

SEQ ID NO: 1398797 - protein, 10 aa, Mycobacterium tuberculosis
ERPDAEAAQD

SEQ ID NO: 1398798 - protein, 4 aa, Mycobacterium tuberculosis
ERPG

SEQ ID NO: 1398799 - protein, 7 aa, Mycobacterium tuberculosis
ERPGPVA

SEQ ID NO: 1398800 - protein, 13 aa, Mycobacterium tuberculosis
ERPGRPLEASTAE

SEQ ID NO: 1398801 - protein, 5 aa, Mycobacterium tuberculosis
ERPPL

SEQ ID NO: 1398802 - protein, 6 aa, Mycobacterium tuberculosis
ERPSGF

SEQ ID NO: 1398803 - protein, 6 aa, Mycobacterium tuberculosis
ERPYTT

SEQ ID NO: 1398804 - protein, 5 aa, Mycobacterium tuberculosis
ERQPE

SEQ ID NO: 1398805 - protein, 6 aa, Mycobacterium tuberculosis
ERRAGR

SEQ ID NO: 1398806 - protein, 10 aa, Mycobacterium tuberculosis
ERRAKDTEEL

SEQ ID NO: 1398807 - protein, 9 aa, Mycobacterium tuberculosis
ERRAPDAVT

SEQ ID NO: 1398808 - protein, 7 aa, Mycobacterium tuberculosis
ERRGEYL

SEQ ID NO: 1398809 - protein, 7 aa, Mycobacterium tuberculosis
ERRGKGL

SEQ ID NO: 1398810 - protein, 9 aa, Mycobacterium tuberculosis
ERRRGRTLA

SEQ ID NO: 1398811 - protein, 8 aa, Mycobacterium tuberculosis
ERRRPDGS

SEQ ID NO: 1398812 - protein, 4 aa, Mycobacterium tuberculosis
ERRT

SEQ ID NO: 1398813 - protein, 6 aa, Mycobacterium tuberculosis
ERRTTV

SEQ ID NO: 1398814 - protein, 9 aa, Mycobacterium tuberculosis
ERRTYHNED

SEQ ID NO: 1398815 - protein, 11 aa, Mycobacterium tuberculosis
ERSDDDSGKGR

SEQ ID NO: 1398816 - protein, 4 aa, Mycobacterium tuberculosis
ERSV

SEQ ID NO: 1398817 - protein, 9 aa, Mycobacterium tuberculosis
ERSVTGDPI

SEQ ID NO: 1398818 - protein, 5 aa, Mycobacterium tuberculosis
ERTCG

SEQ ID NO: 1398819 - protein, 7 aa, Mycobacterium tuberculosis
ERTEIPG

SEQ ID NO: 1398820 - protein, 6 aa, Mycobacterium tuberculosis
ERTSMP

SEQ ID NO: 1398821 - protein, 5 aa, Mycobacterium tuberculosis
ERVHP

SEQ ID NO: 1398822 - protein, 4 aa, Mycobacterium tuberculosis
ERVL

SEQ ID NO: 1398823 - protein, 6 aa, Mycobacterium tuberculosis
ERVPGS

SEQ ID NO: 1398824 - protein, 7 aa, Mycobacterium tuberculosis
ERYPGDA

SEQ ID NO: 1398825 - protein, 6 aa, Mycobacterium tuberculosis
ESAARA

SEQ ID NO: 1398826 - protein, 6 aa, Mycobacterium tuberculosis
ESADGG

SEQ ID NO: 1398827 - protein, 5 aa, Mycobacterium tuberculosis
ESAGA

SEQ ID NO: 1398828 - protein, 7 aa, Mycobacterium tuberculosis
ESAGYGG

SEQ ID NO: 1398829 - protein, 17 aa, Mycobacterium tuberculosis
ESARESSRPCSPPRRPR

SEQ ID NO: 1398830 - protein, 13 aa, Mycobacterium tuberculosis
ESARPWAHRRPSV

SEQ ID NO: 1398831 - protein, 6 aa, Mycobacterium tuberculosis
ESDGTL

SEQ ID NO: 1398832 - protein, 5 aa, Mycobacterium tuberculosis
ESDPF

SEQ ID NO: 1398833 - protein, 6 aa, Mycobacterium tuberculosis
ESETIR

SEQ ID NO: 1398834 - protein, 12 aa, Mycobacterium tuberculosis
ESGDNETQLDET

SEQ ID NO: 1398835 - protein, 12 aa, Mycobacterium tuberculosis
ESGESPRLSDEL

SEQ ID NO: 1398836 - protein, 6 aa, Mycobacterium tuberculosis
ESGFGS

SEQ ID NO: 1398837 - protein, 7 aa, Mycobacterium tuberculosis
ESGGAIA

SEQ ID NO: 1398838 - protein, 11 aa, Mycobacterium tuberculosis
ESGGGSGTANI

SEQ ID NO: 1398839 - protein, 6 aa, Mycobacterium tuberculosis
ESGPDC

SEQ ID NO: 1398840 - protein, 9 aa, Mycobacterium tuberculosis
ESGPKTNEL

SEQ ID NO: 1398841 - protein, 6 aa, Mycobacterium tuberculosis
ESGQLD

SEQ ID NO: 1398842 - protein, 6 aa, Mycobacterium tuberculosis
ESGSGL

SEQ ID NO: 1398843 - protein, 8 aa, Mycobacterium tuberculosis
ESKASEVV

SEQ ID NO: 1398844 - protein, 6 aa, Mycobacterium tuberculosis
ESMDPA

SEQ ID NO: 1398845 - protein, 5 aa, Mycobacterium tuberculosis
ESMGG

SEQ ID NO: 1398846 - protein, 4 aa, Mycobacterium tuberculosis
ESMS

SEQ ID NO: 1398847 - protein, 8 aa, Mycobacterium tuberculosis
ESPRRGET

SEQ ID NO: 1398848 - protein, 10 aa, Mycobacterium tuberculosis
ESPVTSAGPH

SEQ ID NO: 1398849 - protein, 10 aa, Mycobacterium tuberculosis
ESRKRGEAAE

SEQ ID NO: 1398850 - protein, 15 aa, Mycobacterium tuberculosis
ESRRLPGSGAGPSPD

SEQ ID NO: 1398851 - protein, 4 aa, Mycobacterium tuberculosis
ESRS

SEQ ID NO: 1398852 - protein, 6 aa, Mycobacterium tuberculosis
ESSALA

SEQ ID NO: 1398853 - protein, 7 aa, Mycobacterium tuberculosis
ESSASTV

SEQ ID NO: 1398854 - protein, 7 aa, Mycobacterium tuberculosis
ESSPSIV

SEQ ID NO: 1398855 - protein, 8 aa, Mycobacterium tuberculosis
ESTPQGTT

SEQ ID NO: 1398856 - protein, 6 aa, Mycobacterium tuberculosis
ESVTEG

SEQ ID NO: 1398857 - protein, 11 aa, Mycobacterium tuberculosis
ESYAEGDDEEL

SEQ ID NO: 1398858 - protein, 4 aa, Mycobacterium tuberculosis
ETAL

SEQ ID NO: 1398859 - protein, 6 aa, Mycobacterium tuberculosis
ETDEMK

SEQ ID NO: 1398860 - protein, 4 aa, Mycobacterium tuberculosis
ETDG

SEQ ID NO: 1398861 - protein, 4 aa, Mycobacterium tuberculosis
ETDQ

SEQ ID NO: 1398862 - protein, 8 aa, Mycobacterium tuberculosis
ETDRNDPR

SEQ ID NO: 1398863 - protein, 7 aa, Mycobacterium tuberculosis
ETDSGLD

SEQ ID NO: 1398864 - protein, 6 aa, Mycobacterium tuberculosis
ETGDDN

SEQ ID NO: 1398865 - protein, 5 aa, Mycobacterium tuberculosis
ETGLP

SEQ ID NO: 1398866 - protein, 6 aa, Mycobacterium tuberculosis
ETGQPG

SEQ ID NO: 1398867 - protein, 12 aa, Mycobacterium tuberculosis
ETGSQTASDDEL

SEQ ID NO: 1398868 - protein, 8 aa, Mycobacterium tuberculosis
ETGSTGDT

SEQ ID NO: 1398869 - protein, 5 aa, Mycobacterium tuberculosis
ETMAP

SEQ ID NO: 1398870 - protein, 10 aa, Mycobacterium tuberculosis
ETNAAHPNSR

SEQ ID NO: 1398871 - protein, 12 aa, Mycobacterium tuberculosis
ETPDSGSVKVGE

SEQ ID NO: 1398872 - protein, 8 aa, Mycobacterium tuberculosis
ETPTSGDV

SEQ ID NO: 1398873 - protein, 8 aa, Mycobacterium tuberculosis
ETSDEVRT

SEQ ID NO: 1398874 - protein, 8 aa, Mycobacterium tuberculosis
ETSEGIPH

SEQ ID NO: 1398875 - protein, 19 aa, Mycobacterium tuberculosis
ETSPVSTQTRADDSVDRRV

SEQ ID NO: 1398876 - protein, 4 aa, Mycobacterium tuberculosis
ETST

SEQ ID NO: 1398877 - protein, 7 aa, Mycobacterium tuberculosis
ETSVGKY

SEQ ID NO: 1398878 - protein, 5 aa, Mycobacterium tuberculosis
ETTAN

SEQ ID NO: 1398879 - protein, 22 aa, Mycobacterium tuberculosis
ETTTGPHRTECSHGSPFRSGPI

SEQ ID NO: 1398880 - protein, 4 aa, Mycobacterium tuberculosis
ETVQ

SEQ ID NO: 1398881 - protein, 5 aa, Mycobacterium tuberculosis
EVAPR

SEQ ID NO: 1398882 - protein, 13 aa, Mycobacterium tuberculosis
EVDGKPTAVTPAH

SEQ ID NO: 1398883 - protein, 14 aa, Mycobacterium tuberculosis
EVEAPMADPPTDVP

SEQ ID NO: 1398884 - protein, 7 aa, Mycobacterium tuberculosis
EVGEEPA

SEQ ID NO: 1398885 - protein, 7 aa, Mycobacterium tuberculosis
EVGSGKT

SEQ ID NO: 1398886 - protein, 16 aa, Mycobacterium tuberculosis
EVPANVSKEIIAKATG

SEQ ID NO: 1398887 - protein, 8 aa, Mycobacterium tuberculosis
EVPETGAE

SEQ ID NO: 1398888 - protein, 18 aa, Mycobacterium tuberculosis
EVPPQTASRVTSSDYTWG

SEQ ID NO: 1398889 - protein, 14 aa, Mycobacterium tuberculosis
EVREGDPSPDGAGP

SEQ ID NO: 1398890 - protein, 8 aa, Mycobacterium tuberculosis
EVREKEQQ

SEQ ID NO: 1398891 - protein, 5 aa, Mycobacterium tuberculosis
EVRGS

SEQ ID NO: 1398892 - protein, 19 aa, Mycobacterium tuberculosis
EVTAPNSEDGVARVLERWW

SEQ ID NO: 1398893 - protein, 5 aa, Mycobacterium tuberculosis
EVTSR

SEQ ID NO: 1398894 - protein, 8 aa, Mycobacterium tuberculosis
EYEVGNPA

SEQ ID NO: 1398895 - protein, 6 aa, Mycobacterium tuberculosis
EYGGMG

SEQ ID NO: 1398896 - protein, 5 aa, Mycobacterium tuberculosis
EYGGV

SEQ ID NO: 1398897 - protein, 7 aa, Mycobacterium tuberculosis
EYPHPKG

SEQ ID NO: 1398898 - protein, 10 aa, Mycobacterium tuberculosis
EYTEGAGPGI

SEQ ID NO: 1398899 - protein, 14 aa, Mycobacterium tuberculosis
EYTPDGEERRTGRP

SEQ ID NO: 1398900 - protein, 8 aa, Mycobacterium tuberculosis
EYTPGPSV

SEQ ID NO: 1398901 - protein, 11 aa, Mycobacterium tuberculosis
FAATGGGSVVP

SEQ ID NO: 1398902 - protein, 8 aa, Mycobacterium tuberculosis
FADEPEKA

SEQ ID NO: 1398903 - protein, 4 aa, Mycobacterium tuberculosis
FADP

SEQ ID NO: 1398904 - protein, 9 aa, Mycobacterium tuberculosis
FAEDSPEAY

SEQ ID NO: 1398905 - protein, 11 aa, Mycobacterium tuberculosis
FAEKPEAGTPM

SEQ ID NO: 1398906 - protein, 5 aa, Mycobacterium tuberculosis
FAEPP

SEQ ID NO: 1398907 - protein, 9 aa, Mycobacterium tuberculosis
FAEQRSRSI

SEQ ID NO: 1398908 - protein, 5 aa, Mycobacterium tuberculosis
FAERE

SEQ ID NO: 1398909 - protein, 9 aa, Mycobacterium tuberculosis
FAGGTPDGV

SEQ ID NO: 1398910 - protein, 8 aa, Mycobacterium tuberculosis
FAGPHGRT

SEQ ID NO: 1398911 - protein, 4 aa, Mycobacterium tuberculosis
FAGQ

SEQ ID NO: 1398912 - protein, 9 aa, Mycobacterium tuberculosis
FAGSSAGVV

SEQ ID NO: 1398913 - protein, 14 aa, Mycobacterium tuberculosis
FANSGQSVTGYNNS

SEQ ID NO: 1398914 - protein, 11 aa, Mycobacterium tuberculosis
FAPAAEDSTGA

SEQ ID NO: 1398915 - protein, 10 aa, Mycobacterium tuberculosis
FAPASDTAGL

SEQ ID NO: 1398916 - protein, 11 aa, Mycobacterium tuberculosis
FATQPSDAFRT

SEQ ID NO: 1398917 - protein, 6 aa, Mycobacterium tuberculosis
FDGDGT

SEQ ID NO: 1398918 - protein, 23 aa, Mycobacterium tuberculosis
FDGGPDSRQAFAASPDDNPMPGG

SEQ ID NO: 1398919 - protein, 28 aa, Mycobacterium tuberculosis
FDNSGNVNTGNGNSGNINTGSWNAGNVN

SEQ ID NO: 1398920 - protein, 7 aa, Mycobacterium tuberculosis
FDPAESA

SEQ ID NO: 1398921 - protein, 15 aa, Mycobacterium tuberculosis
FDPAGILNPGVVFGD

SEQ ID NO: 1398922 - protein, 6 aa, Mycobacterium tuberculosis
FDPATG

SEQ ID NO: 1398923 - protein, 10 aa, Mycobacterium tuberculosis
FDRPPSDHTS

SEQ ID NO: 1398924 - protein, 15 aa, Mycobacterium tuberculosis
FDTQGAGSVPRSVSG

SEQ ID NO: 1398925 - protein, 9 aa, Mycobacterium tuberculosis
FEGDAGGEL

SEQ ID NO: 1398926 - protein, 4 aa, Mycobacterium tuberculosis
FENG

SEQ ID NO: 1398927 - protein, 6 aa, Mycobacterium tuberculosis
FGAREA

SEQ ID NO: 1398928 - protein, 9 aa, Mycobacterium tuberculosis
FGDDPAAAQ

SEQ ID NO: 1398929 - protein, 10 aa, Mycobacterium tuberculosis
FGDGALKDKP

SEQ ID NO: 1398930 - protein, 8 aa, Mycobacterium tuberculosis
FGDNPATR

SEQ ID NO: 1398931 - protein, 9 aa, Mycobacterium tuberculosis
FGGEAGDTT

SEQ ID NO: 1398932 - protein, 10 aa, Mycobacterium tuberculosis
FGGEESAGAS

SEQ ID NO: 1398933 - protein, 4 aa, Mycobacterium tuberculosis
FGGS

SEQ ID NO: 1398934 - protein, 12 aa, Mycobacterium tuberculosis
FGHTGVQRALDR

SEQ ID NO: 1398935 - protein, 9 aa, Mycobacterium tuberculosis
FGNTGTGNI

SEQ ID NO: 1398936 - protein, 5 aa, Mycobacterium tuberculosis
FGPAA

SEQ ID NO: 1398937 - protein, 5 aa, Mycobacterium tuberculosis
FGPEE

SEQ ID NO: 1398938 - protein, 9 aa, Mycobacterium tuberculosis
FGPPAGDPA

SEQ ID NO: 1398939 - protein, 9 aa, Mycobacterium tuberculosis
FGRPATGLP

SEQ ID NO: 1398940 - protein, 10 aa, Mycobacterium tuberculosis
FGSGLPPAEP

SEQ ID NO: 1398941 - protein, 9 aa, Mycobacterium tuberculosis
FGSSGEGLA

SEQ ID NO: 1398942 - protein, 10 aa, Mycobacterium tuberculosis
FGTDDDNYRE

SEQ ID NO: 1398943 - protein, 5 aa, Mycobacterium tuberculosis
FGTNA

SEQ ID NO: 1398944 - protein, 9 aa, Mycobacterium tuberculosis
FKDETETDL

SEQ ID NO: 1398945 - protein, 4 aa, Mycobacterium tuberculosis
FKQS

SEQ ID NO: 1398946 - protein, 7 aa, Mycobacterium tuberculosis
FNAPTSV

SEQ ID NO: 1398947 - protein, 4 aa, Mycobacterium tuberculosis
FNEA

SEQ ID NO: 1398948 - protein, 8 aa, Mycobacterium tuberculosis
FPAPPPRE

SEQ ID NO: 1398949 - protein, 4 aa, Mycobacterium tuberculosis
FPPE

SEQ ID NO: 1398950 - protein, 10 aa, Mycobacterium tuberculosis
FPQPNQPDQL

SEQ ID NO: 1398951 - protein, 6 aa, Mycobacterium tuberculosis
FPSETR

SEQ ID NO: 1398952 - protein, 6 aa, Mycobacterium tuberculosis
FPSRKS

SEQ ID NO: 1398953 - protein, 16 aa, Mycobacterium tuberculosis
FPTSTASAGEATGRTS

SEQ ID NO: 1398954 - protein, 10 aa, Mycobacterium tuberculosis
FQRTRSGYDP

SEQ ID NO: 1398955 - protein, 5 aa, Mycobacterium tuberculosis
FREPP

SEQ ID NO: 1398956 - protein, 11 aa, Mycobacterium tuberculosis
FRGPDEANARA

SEQ ID NO: 1398957 - protein, 9 aa, Mycobacterium tuberculosis
FRGRTTGPW

SEQ ID NO: 1398958 - protein, 5 aa, Mycobacterium tuberculosis
FRNDG

SEQ ID NO: 1398959 - protein, 7 aa, Mycobacterium tuberculosis
FRNPPQA

SEQ ID NO: 1398960 - protein, 17 aa, Mycobacterium tuberculosis
FRPDRSHAKSARSVAET

SEQ ID NO: 1398961 - protein, 11 aa, Mycobacterium tuberculosis
FRPGDDDAPAH

SEQ ID NO: 1398962 - protein, 9 aa, Mycobacterium tuberculosis
FRPGKAPAK

SEQ ID NO: 1398963 - protein, 6 aa, Mycobacterium tuberculosis
FSGQTR

SEQ ID NO: 1398964 - protein, 6 aa, Mycobacterium tuberculosis
FSGSNG

SEQ ID NO: 1398965 - protein, 10 aa, Mycobacterium tuberculosis
FSNEPAGSGR

SEQ ID NO: 1398966 - protein, 7 aa, Mycobacterium tuberculosis
FSPDEDR

SEQ ID NO: 1398967 - protein, 6 aa, Mycobacterium tuberculosis
FSPGRR

SEQ ID NO: 1398968 - protein, 16 aa, Mycobacterium tuberculosis
FSPPRQTTNPAGLTAQ

SEQ ID NO: 1398969 - protein, 9 aa, Mycobacterium tuberculosis
FSRQGEHRA

SEQ ID NO: 1398970 - protein, 8 aa, Mycobacterium tuberculosis
FSSDSDAR

SEQ ID NO: 1398971 - protein, 9 aa, Mycobacterium tuberculosis
FSTAADSNA

SEQ ID NO: 1398972 - protein, 18 aa, Mycobacterium tuberculosis
FSTGETGRVGSPKRREIG

SEQ ID NO: 1398973 - protein, 9 aa, Mycobacterium tuberculosis
FTAGSPGAF

SEQ ID NO: 1398974 - protein, 9 aa, Mycobacterium tuberculosis
FTAPPQNLT

SEQ ID NO: 1398975 - protein, 42 aa, Mycobacterium tuberculosis
FTAPPQTTNPSGLAGQAAATGQATALASGTNAVTTALSSAAA

SEQ ID NO: 1398976 - protein, 10 aa, Mycobacterium tuberculosis
FTEPRNEHKR

SEQ ID NO: 1398977 - protein, 10 aa, Mycobacterium tuberculosis
FTGEEGATYE

SEQ ID NO: 1398978 - protein, 11 aa, Mycobacterium tuberculosis
FTGQPGSTVPV

SEQ ID NO: 1398979 - protein, 13 aa, Mycobacterium tuberculosis
FTGSPAPTPPTLG

SEQ ID NO: 1398980 - protein, 10 aa, Mycobacterium tuberculosis
FTPEQKARNV

SEQ ID NO: 1398981 - protein, 4 aa, Mycobacterium tuberculosis
FTPS

SEQ ID NO: 1398982 - protein, 8 aa, Mycobacterium tuberculosis
FTQPGGPQ

SEQ ID NO: 1398983 - protein, 8 aa, Mycobacterium tuberculosis
FYGPGGAQ

SEQ ID NO: 1398984 - protein, 9 aa, Mycobacterium tuberculosis
GAAAQASSL

SEQ ID NO: 1398985 - protein, 8 aa, Mycobacterium tuberculosis
GAADQIPG

SEQ ID NO: 1398986 - protein, 17 aa, Mycobacterium tuberculosis
GAAEKQDPLSGLTDQER

SEQ ID NO: 1398987 - protein, 6 aa, Mycobacterium tuberculosis
GAAELG

SEQ ID NO: 1398988 - protein, 11 aa, Mycobacterium tuberculosis
GAAGPRSSWRA

SEQ ID NO: 1398989 - protein, 7 aa, Mycobacterium tuberculosis
GAAGTGI

SEQ ID NO: 1398990 - protein, 4 aa, Mycobacterium tuberculosis
GAAM

SEQ ID NO: 1398991 - protein, 10 aa, Mycobacterium tuberculosis
GAAPAGHGSK

SEQ ID NO: 1398992 - protein, 8 aa, Mycobacterium tuberculosis
GAAPRARV

SEQ ID NO: 1398993 - protein, 5 aa, Mycobacterium tuberculosis
GAAQG

SEQ ID NO: 1398994 - protein, 7 aa, Mycobacterium tuberculosis
GAASATR

SEQ ID NO: 1398995 - protein, 12 aa, Mycobacterium tuberculosis
GAASNPDPERTI

SEQ ID NO: 1398996 - protein, 8 aa, Mycobacterium tuberculosis
GAASQGVA

SEQ ID NO: 1398997 - protein, 4 aa, Mycobacterium tuberculosis
GAAT

SEQ ID NO: 1398998 - protein, 14 aa, Mycobacterium tuberculosis
GAATEADGSPNRGY

SEQ ID NO: 1398999 - protein, 6 aa, Mycobacterium tuberculosis
GAATRQ

SEQ ID NO: 1399000 - protein, 8 aa, Mycobacterium tuberculosis
GAATSTDD

SEQ ID NO: 1399001 - protein, 7 aa, Mycobacterium tuberculosis
GADAGAG

SEQ ID NO: 1399002 - protein, 7 aa, Mycobacterium tuberculosis
GADDAEL

SEQ ID NO: 1399003 - protein, 6 aa, Mycobacterium tuberculosis
GADGAG

SEQ ID NO: 1399004 - protein, 8 aa, Mycobacterium tuberculosis
GADGMSGA

SEQ ID NO: 1399005 - protein, 4 aa, Mycobacterium tuberculosis
GADL

SEQ ID NO: 1399006 - protein, 16 aa, Mycobacterium tuberculosis
GADNTEEERFSPGERY

SEQ ID NO: 1399007 - protein, 6 aa, Mycobacterium tuberculosis
GADPAR

SEQ ID NO: 1399008 - protein, 10 aa, Mycobacterium tuberculosis
GADPQRVRPV

SEQ ID NO: 1399009 - protein, 6 aa, Mycobacterium tuberculosis
GADRDG

SEQ ID NO: 1399010 - protein, 8 aa, Mycobacterium tuberculosis
GADREEAL

SEQ ID NO: 1399011 - protein, 7 aa, Mycobacterium tuberculosis
GADSSRG

SEQ ID NO: 1399012 - protein, 11 aa, Mycobacterium tuberculosis
GADTGIGSEPP

SEQ ID NO: 1399013 - protein, 12 aa, Mycobacterium tuberculosis
GADTSVAGVPEL

SEQ ID NO: 1399014 - protein, 7 aa, Mycobacterium tuberculosis
GAEDPKL

SEQ ID NO: 1399015 - protein, 4 aa, Mycobacterium tuberculosis
GAEH

SEQ ID NO: 1399016 - protein, 9 aa, Mycobacterium tuberculosis
GAEPDLPAL

SEQ ID NO: 1399017 - protein, 12 aa, Mycobacterium tuberculosis
GAEQGGIDAQQA

SEQ ID NO: 1399018 - protein, 5 aa, Mycobacterium tuberculosis
GAESG

SEQ ID NO: 1399019 - protein, 6 aa, Mycobacterium tuberculosis
GAGAPT

SEQ ID NO: 1399020 - protein, 8 aa, Mycobacterium tuberculosis
GAGDKSLC

SEQ ID NO: 1399021 - protein, 7 aa, Mycobacterium tuberculosis
GAGERGL

SEQ ID NO: 1399022 - protein, 13 aa, Mycobacterium tuberculosis
GAGGDKPSDGPLT

SEQ ID NO: 1399023 - protein, 13 aa, Mycobacterium tuberculosis
GAGGQGDALILRA

SEQ ID NO: 1399024 - protein, 5 aa, Mycobacterium tuberculosis
GAGKT

SEQ ID NO: 1399025 - protein, 8 aa, Mycobacterium tuberculosis
GAGPAVSA

SEQ ID NO: 1399026 - protein, 7 aa, Mycobacterium tuberculosis
GAGPQGR

SEQ ID NO: 1399027 - protein, 9 aa, Mycobacterium tuberculosis
GAGPSCERE

SEQ ID NO: 1399028 - protein, 7 aa, Mycobacterium tuberculosis
GAGPSSL

SEQ ID NO: 1399029 - protein, 6 aa, Mycobacterium tuberculosis
GAGPTT

SEQ ID NO: 1399030 - protein, 9 aa, Mycobacterium tuberculosis
GAGQMPARQ

SEQ ID NO: 1399031 - protein, 13 aa, Mycobacterium tuberculosis
GAGRGGKDSPLAR

SEQ ID NO: 1399032 - protein, 5 aa, Mycobacterium tuberculosis
GAGTG

SEQ ID NO: 1399033 - protein, 5 aa, Mycobacterium tuberculosis
GAGYG

SEQ ID NO: 1399034 - protein, 7 aa, Mycobacterium tuberculosis
GAHADTA

SEQ ID NO: 1399035 - protein, 4 aa, Mycobacterium tuberculosis
GAHD

SEQ ID NO: 1399036 - protein, 7 aa, Mycobacterium tuberculosis
GAHDERT

SEQ ID NO: 1399037 - protein, 15 aa, Mycobacterium tuberculosis
GAHERTGSPDSPPRT

SEQ ID NO: 1399038 - protein, 4 aa, Mycobacterium tuberculosis
GAHG

SEQ ID NO: 1399039 - protein, 13 aa, Mycobacterium tuberculosis
GAHGGTATAIDDT

SEQ ID NO: 1399040 - protein, 7 aa, Mycobacterium tuberculosis
GAIDPAA

SEQ ID NO: 1399041 - protein, 8 aa, Mycobacterium tuberculosis
GAIGPRGR

SEQ ID NO: 1399042 - protein, 11 aa, Mycobacterium tuberculosis
GAIGSGDAKTI

SEQ ID NO: 1399043 - protein, 8 aa, Mycobacterium tuberculosis
GAKAPKLV

SEQ ID NO: 1399044 - protein, 14 aa, Mycobacterium tuberculosis
GAKARQAKSKARLQ

SEQ ID NO: 1399045 - protein, 8 aa, Mycobacterium tuberculosis
GAKERQRL

SEQ ID NO: 1399046 - protein, 4 aa, Mycobacterium tuberculosis
GAKN

SEQ ID NO: 1399047 - protein, 8 aa, Mycobacterium tuberculosis
GAKSVPAQ

SEQ ID NO: 1399048 - protein, 6 aa, Mycobacterium tuberculosis
GAKVSG

SEQ ID NO: 1399049 - protein, 13 aa, Mycobacterium tuberculosis
GALGSAPASVSDG

SEQ ID NO: 1399050 - protein, 7 aa, Mycobacterium tuberculosis
GANDLGG

SEQ ID NO: 1399051 - protein, 6 aa, Mycobacterium tuberculosis
GANINS

SEQ ID NO: 1399052 - protein, 6 aa, Mycobacterium tuberculosis
GANPTV

SEQ ID NO: 1399053 - protein, 8 aa, Mycobacterium tuberculosis
GAPANGGS

SEQ ID NO: 1399054 - protein, 7 aa, Mycobacterium tuberculosis
GAPFSGA

SEQ ID NO: 1399055 - protein, 6 aa, Mycobacterium tuberculosis
GAPGHD

SEQ ID NO: 1399056 - protein, 6 aa, Mycobacterium tuberculosis
GAPGNA

SEQ ID NO: 1399057 - protein, 7 aa, Mycobacterium tuberculosis
GAPNDGW

SEQ ID NO: 1399058 - protein, 4 aa, Mycobacterium tuberculosis
GAPQ

SEQ ID NO: 1399059 - protein, 6 aa, Mycobacterium tuberculosis
GAPRSV

SEQ ID NO: 1399060 - protein, 8 aa, Mycobacterium tuberculosis
GAPSVRSQ

SEQ ID NO: 1399061 - protein, 7 aa, Mycobacterium tuberculosis
GAPTALT

SEQ ID NO: 1399062 - protein, 7 aa, Mycobacterium tuberculosis
GAQEAEL

SEQ ID NO: 1399063 - protein, 12 aa, Mycobacterium tuberculosis
GAQSGIGGGGRY

SEQ ID NO: 1399064 - protein, 5 aa, Mycobacterium tuberculosis
GAQVR

SEQ ID NO: 1399065 - protein, 6 aa, Mycobacterium tuberculosis
GARDGP

SEQ ID NO: 1399066 - protein, 9 aa, Mycobacterium tuberculosis
GAREATTAR

SEQ ID NO: 1399067 - protein, 7 aa, Mycobacterium tuberculosis
GARGPVR

SEQ ID NO: 1399068 - protein, 5 aa, Mycobacterium tuberculosis
GARKS

SEQ ID NO: 1399069 - protein, 7 aa, Mycobacterium tuberculosis
GARPADR

SEQ ID NO: 1399070 - protein, 6 aa, Mycobacterium tuberculosis
GARPAE

SEQ ID NO: 1399071 - protein, 11 aa, Mycobacterium tuberculosis
GARSTVQRQQT

SEQ ID NO: 1399072 - protein, 9 aa, Mycobacterium tuberculosis
GARTGKTGK

SEQ ID NO: 1399073 - protein, 10 aa, Mycobacterium tuberculosis
GASAARPEHT

SEQ ID NO: 1399074 - protein, 9 aa, Mycobacterium tuberculosis
GASEVGRHQ

SEQ ID NO: 1399075 - protein, 15 aa, Mycobacterium tuberculosis
GASFPYRKDPDDKNI

SEQ ID NO: 1399076 - protein, 8 aa, Mycobacterium tuberculosis
GASGEHQR

SEQ ID NO: 1399077 - protein, 10 aa, Mycobacterium tuberculosis
GASGTPKPRF

SEQ ID NO: 1399078 - protein, 12 aa, Mycobacterium tuberculosis
GASMEGTNTGSF

SEQ ID NO: 1399079 - protein, 9 aa, Mycobacterium tuberculosis
GASPAIGSV

SEQ ID NO: 1399080 - protein, 7 aa, Mycobacterium tuberculosis
GASQSED

SEQ ID NO: 1399081 - protein, 6 aa, Mycobacterium tuberculosis
GATADP

SEQ ID NO: 1399082 - protein, 7 aa, Mycobacterium tuberculosis
GATAEVN

SEQ ID NO: 1399083 - protein, 8 aa, Mycobacterium tuberculosis
GATDEQVE

SEQ ID NO: 1399084 - protein, 8 aa, Mycobacterium tuberculosis
GATDPEIE

SEQ ID NO: 1399085 - protein, 5 aa, Mycobacterium tuberculosis
GATGD

SEQ ID NO: 1399086 - protein, 9 aa, Mycobacterium tuberculosis
GATGEGYAE

SEQ ID NO: 1399087 - protein, 5 aa, Mycobacterium tuberculosis
GATGK

SEQ ID NO: 1399088 - protein, 9 aa, Mycobacterium tuberculosis
GATGLTDRQ

SEQ ID NO: 1399089 - protein, 10 aa, Mycobacterium tuberculosis
GATGTGKTKT

SEQ ID NO: 1399090 - protein, 10 aa, Mycobacterium tuberculosis
GATPADAYPT

SEQ ID NO: 1399091 - protein, 11 aa, Mycobacterium tuberculosis
GATPANSPYPT

SEQ ID NO: 1399092 - protein, 8 aa, Mycobacterium tuberculosis
GATPIPTV

SEQ ID NO: 1399093 - protein, 10 aa, Mycobacterium tuberculosis
GATPPDSPYQ

SEQ ID NO: 1399094 - protein, 7 aa, Mycobacterium tuberculosis
GATPSQR

SEQ ID NO: 1399095 - protein, 8 aa, Mycobacterium tuberculosis
GATPTADR

SEQ ID NO: 1399096 - protein, 24 aa, Mycobacterium tuberculosis
GATRTATDLAGGQDARQGPSSNSA

SEQ ID NO: 1399097 - protein, 8 aa, Mycobacterium tuberculosis
GATSGHTQ

SEQ ID NO: 1399098 - protein, 5 aa, Mycobacterium tuberculosis
GATTF

SEQ ID NO: 1399099 - protein, 9 aa, Mycobacterium tuberculosis
GATTGSAPA

SEQ ID NO: 1399100 - protein, 8 aa, Mycobacterium tuberculosis
GAVDAGGR

SEQ ID NO: 1399101 - protein, 5 aa, Mycobacterium tuberculosis
GAYGD

SEQ ID NO: 1399102 - protein, 12 aa, Mycobacterium tuberculosis
GCETTSGAAAAL

SEQ ID NO: 1399103 - protein, 7 aa, Mycobacterium tuberculosis
GCPPPTL

SEQ ID NO: 1399104 - protein, 7 aa, Mycobacterium tuberculosis
GDAAKIN

SEQ ID NO: 1399105 - protein, 9 aa, Mycobacterium tuberculosis
GDAAQAEDV

SEQ ID NO: 1399106 - protein, 8 aa, Mycobacterium tuberculosis
GDAATDVM

SEQ ID NO: 1399107 - protein, 5 aa, Mycobacterium tuberculosis
GDAEL

SEQ ID NO: 1399108 - protein, 6 aa, Mycobacterium tuberculosis
GDAKER

SEQ ID NO: 1399109 - protein, 17 aa, Mycobacterium tuberculosis
GDANSYAATGGPGAQLP

SEQ ID NO: 1399110 - protein, 6 aa, Mycobacterium tuberculosis
GDAPLD

SEQ ID NO: 1399111 - protein, 22 aa, Mycobacterium tuberculosis
GDAPPPPPGQPEPGVSRGMAHD

SEQ ID NO: 1399112 - protein, 10 aa, Mycobacterium tuberculosis
GDAPPQRSRR

SEQ ID NO: 1399113 - protein, 6 aa, Mycobacterium tuberculosis
GDARRA

SEQ ID NO: 1399114 - protein, 18 aa, Mycobacterium tuberculosis
GDASRYPAEFSGGQKQRI

SEQ ID NO: 1399115 - protein, 7 aa, Mycobacterium tuberculosis
GDDAAAA

SEQ ID NO: 1399116 - protein, 12 aa, Mycobacterium tuberculosis
GDDDTMVPTSNS

SEQ ID NO: 1399117 - protein, 9 aa, Mycobacterium tuberculosis
GDDGTRSAE

SEQ ID NO: 1399118 - protein, 5 aa, Mycobacterium tuberculosis
GDDGW

SEQ ID NO: 1399119 - protein, 9 aa, Mycobacterium tuberculosis
GDDLDKARR

SEQ ID NO: 1399120 - protein, 7 aa, Mycobacterium tuberculosis
GDDPEHG

SEQ ID NO: 1399121 - protein, 5 aa, Mycobacterium tuberculosis
GDEAL

SEQ ID NO: 1399122 - protein, 5 aa, Mycobacterium tuberculosis
GDEGF

SEQ ID NO: 1399123 - protein, 12 aa, Mycobacterium tuberculosis
GDENPAEVTPGD

SEQ ID NO: 1399124 - protein, 7 aa, Mycobacterium tuberculosis
GDEPLKR

SEQ ID NO: 1399125 - protein, 8 aa, Mycobacterium tuberculosis
GDESCRPQ

SEQ ID NO: 1399126 - protein, 4 aa, Mycobacterium tuberculosis
GDGA

SEQ ID NO: 1399127 - protein, 5 aa, Mycobacterium tuberculosis
GDGAA

SEQ ID NO: 1399128 - protein, 7 aa, Mycobacterium tuberculosis
GDGGRTL

SEQ ID NO: 1399129 - protein, 9 aa, Mycobacterium tuberculosis
GDGRRLSGT

SEQ ID NO: 1399130 - protein, 5 aa, Mycobacterium tuberculosis
GDGSA

SEQ ID NO: 1399131 - protein, 12 aa, Mycobacterium tuberculosis
GDGSAPARRVGR

SEQ ID NO: 1399132 - protein, 8 aa, Mycobacterium tuberculosis
GDGTAGHR

SEQ ID NO: 1399133 - protein, 7 aa, Mycobacterium tuberculosis
GDGTQAL

SEQ ID NO: 1399134 - protein, 11 aa, Mycobacterium tuberculosis
GDGTQTGLPDD

SEQ ID NO: 1399135 - protein, 7 aa, Mycobacterium tuberculosis
GDHTSGI

SEQ ID NO: 1399136 - protein, 14 aa, Mycobacterium tuberculosis
GDIEEGVTSEASSL

SEQ ID NO: 1399137 - protein, 4 aa, Mycobacterium tuberculosis
GDIT

SEQ ID NO: 1399138 - protein, 17 aa, Mycobacterium tuberculosis
GDKDADEYFATDSDNRN

SEQ ID NO: 1399139 - protein, 22 aa, Mycobacterium tuberculosis
GDLANPKADLRQKAAAAAGASG

SEQ ID NO: 1399140 - protein, 6 aa, Mycobacterium tuberculosis
GDLDGR

SEQ ID NO: 1399141 - protein, 27 aa, Mycobacterium tuberculosis
GDLSGLARPGEAADKTAARAKDTGDDW

SEQ ID NO: 1399142 - protein, 5 aa, Mycobacterium tuberculosis
GDNAA

SEQ ID NO: 1399143 - protein, 7 aa, Mycobacterium tuberculosis
GDNTSRA

SEQ ID NO: 1399144 - protein, 6 aa, Mycobacterium tuberculosis
GDPARE

SEQ ID NO: 1399145 - protein, 15 aa, Mycobacterium tuberculosis
GDPAYGYSTSPPNVA

SEQ ID NO: 1399146 - protein, 9 aa, Mycobacterium tuberculosis
GDPDAFPAS

SEQ ID NO: 1399147 - protein, 6 aa, Mycobacterium tuberculosis
GDPETQ

SEQ ID NO: 1399148 - protein, 9 aa, Mycobacterium tuberculosis
GDPGQPGLL

SEQ ID NO: 1399149 - protein, 7 aa, Mycobacterium tuberculosis
GDPGVGK

SEQ ID NO: 1399150 - protein, 17 aa, Mycobacterium tuberculosis
GDPLESAAAGGNGFGGF

SEQ ID NO: 1399151 - protein, 4 aa, Mycobacterium tuberculosis
GDPQ

SEQ ID NO: 1399152 - protein, 7 aa, Mycobacterium tuberculosis
GDPRFSD

SEQ ID NO: 1399153 - protein, 5 aa, Mycobacterium tuberculosis
GDPRW

SEQ ID NO: 1399154 - protein, 19 aa, Mycobacterium tuberculosis
GDPSDGLPGVPGVGEKTAA

SEQ ID NO: 1399155 - protein, 10 aa, Mycobacterium tuberculosis
GDPSKPSDAD

SEQ ID NO: 1399156 - protein, 7 aa, Mycobacterium tuberculosis
GDQIDKG

SEQ ID NO: 1399157 - protein, 12 aa, Mycobacterium tuberculosis
GDQLPEKTYPLT

SEQ ID NO: 1399158 - protein, 9 aa, Mycobacterium tuberculosis
GDQSTPALG

SEQ ID NO: 1399159 - protein, 11 aa, Mycobacterium tuberculosis
GDRAAQTGQQI

SEQ ID NO: 1399160 - protein, 6 aa, Mycobacterium tuberculosis
GDRERT

SEQ ID NO: 1399161 - protein, 7 aa, Mycobacterium tuberculosis
GDRGAAV

SEQ ID NO: 1399162 - protein, 7 aa, Mycobacterium tuberculosis
GDRGGRA

SEQ ID NO: 1399163 - protein, 5 aa, Mycobacterium tuberculosis
GDRSH

SEQ ID NO: 1399164 - protein, 8 aa, Mycobacterium tuberculosis
GDRSTPQA

SEQ ID NO: 1399165 - protein, 8 aa, Mycobacterium tuberculosis
GDSAGGNL

SEQ ID NO: 1399166 - protein, 15 aa, Mycobacterium tuberculosis
GDSAGGVGSDTASVS

SEQ ID NO: 1399167 - protein, 8 aa, Mycobacterium tuberculosis
GDSASSPA

SEQ ID NO: 1399168 - protein, 10 aa, Mycobacterium tuberculosis
GDSDSGRAHA

SEQ ID NO: 1399169 - protein, 7 aa, Mycobacterium tuberculosis
GDSEDET

SEQ ID NO: 1399170 - protein, 7 aa, Mycobacterium tuberculosis
GDSPVAG

SEQ ID NO: 1399171 - protein, 8 aa, Mycobacterium tuberculosis
GDTAPKAA

SEQ ID NO: 1399172 - protein, 8 aa, Mycobacterium tuberculosis
GDTDVDEA

SEQ ID NO: 1399173 - protein, 4 aa, Mycobacterium tuberculosis
GDTE

SEQ ID NO: 1399174 - protein, 9 aa, Mycobacterium tuberculosis
GDTERLPGK

SEQ ID NO: 1399175 - protein, 6 aa, Mycobacterium tuberculosis
GDTPLD

SEQ ID NO: 1399176 - protein, 16 aa, Mycobacterium tuberculosis
GDTSEQLEDLHPLPTA

SEQ ID NO: 1399177 - protein, 8 aa, Mycobacterium tuberculosis
GDTSGIDE

SEQ ID NO: 1399178 - protein, 6 aa, Mycobacterium tuberculosis
GDTTDD

SEQ ID NO: 1399179 - protein, 6 aa, Mycobacterium tuberculosis
GDTTVT

SEQ ID NO: 1399180 - protein, 6 aa, Mycobacterium tuberculosis
GDTYDT

SEQ ID NO: 1399181 - protein, 4 aa, Mycobacterium tuberculosis
GDVT

SEQ ID NO: 1399182 - protein, 4 aa, Mycobacterium tuberculosis
GDWD

SEQ ID NO: 1399183 - protein, 9 aa, Mycobacterium tuberculosis
GDWSSASES

SEQ ID NO: 1399184 - protein, 7 aa, Mycobacterium tuberculosis
GEAARDA

SEQ ID NO: 1399185 - protein, 9 aa, Mycobacterium tuberculosis
GEADDGAAA

SEQ ID NO: 1399186 - protein, 25 aa, Mycobacterium tuberculosis
GEAGPGPSYLDPGSGGPENDFTNRN

SEQ ID NO: 1399187 - protein, 10 aa, Mycobacterium tuberculosis
GEASKNKATV

SEQ ID NO: 1399188 - protein, 7 aa, Mycobacterium tuberculosis
GEDAGRN

SEQ ID NO: 1399189 - protein, 5 aa, Mycobacterium tuberculosis
GEDAI

SEQ ID NO: 1399190 - protein, 4 aa, Mycobacterium tuberculosis
GEDG

SEQ ID NO: 1399191 - protein, 7 aa, Mycobacterium tuberculosis
GEDGKPV

SEQ ID NO: 1399192 - protein, 8 aa, Mycobacterium tuberculosis
GEDVGTPT

SEQ ID NO: 1399193 - protein, 5 aa, Mycobacterium tuberculosis
GEEPG

SEQ ID NO: 1399194 - protein, 8 aa, Mycobacterium tuberculosis
GEESAGQI

SEQ ID NO: 1399195 - protein, 9 aa, Mycobacterium tuberculosis
GEFSSQPSA

SEQ ID NO: 1399196 - protein, 4 aa, Mycobacterium tuberculosis
GEGA

SEQ ID NO: 1399197 - protein, 10 aa, Mycobacterium tuberculosis
GEGAAAHAEA

SEQ ID NO: 1399198 - protein, 8 aa, Mycobacterium tuberculosis
GEGDGESA

SEQ ID NO: 1399199 - protein, 13 aa, Mycobacterium tuberculosis
GEGEGRGPDGDYR

SEQ ID NO: 1399200 - protein, 13 aa, Mycobacterium tuberculosis
GEGGVKGLSEPEK

SEQ ID NO: 1399201 - protein, 15 aa, Mycobacterium tuberculosis
GEGGYIGREDAANMT

SEQ ID NO: 1399202 - protein, 6 aa, Mycobacterium tuberculosis
GEGGYQ

SEQ ID NO: 1399203 - protein, 14 aa, Mycobacterium tuberculosis
GEGNSTADTASVGS

SEQ ID NO: 1399204 - protein, 5 aa, Mycobacterium tuberculosis
GEGRA

SEQ ID NO: 1399205 - protein, 5 aa, Mycobacterium tuberculosis
GEHAD

SEQ ID NO: 1399206 - protein, 4 aa, Mycobacterium tuberculosis
GEHD

SEQ ID NO: 1399207 - protein, 6 aa, Mycobacterium tuberculosis
GEHGDL

SEQ ID NO: 1399208 - protein, 7 aa, Mycobacterium tuberculosis
GEHPPPR

SEQ ID NO: 1399209 - protein, 4 aa, Mycobacterium tuberculosis
GEHS

SEQ ID NO: 1399210 - protein, 5 aa, Mycobacterium tuberculosis
GEIPT

SEQ ID NO: 1399211 - protein, 8 aa, Mycobacterium tuberculosis
GEKTSDEA

SEQ ID NO: 1399212 - protein, 4 aa, Mycobacterium tuberculosis
GELR

SEQ ID NO: 1399213 - protein, 17 aa, Mycobacterium tuberculosis
GELSESGPSAAWKSNGL

SEQ ID NO: 1399214 - protein, 18 aa, Mycobacterium tuberculosis
GELSSSVGGNVGTNAGGM

SEQ ID NO: 1399215 - protein, 15 aa, Mycobacterium tuberculosis
GELSVDQTGKDAGAI

SEQ ID NO: 1399216 - protein, 13 aa, Mycobacterium tuberculosis
GEMPPGEALPSER

SEQ ID NO: 1399217 - protein, 4 aa, Mycobacterium tuberculosis
GENQ

SEQ ID NO: 1399218 - protein, 5 aa, Mycobacterium tuberculosis
GENVP

SEQ ID NO: 1399219 - protein, 5 aa, Mycobacterium tuberculosis
GEPAA

SEQ ID NO: 1399220 - protein, 6 aa, Mycobacterium tuberculosis
GEPADI

SEQ ID NO: 1399221 - protein, 7 aa, Mycobacterium tuberculosis
GEPDPRH

SEQ ID NO: 1399222 - protein, 6 aa, Mycobacterium tuberculosis
GEPERN

SEQ ID NO: 1399223 - protein, 5 aa, Mycobacterium tuberculosis
GEPFT

SEQ ID NO: 1399224 - protein, 8 aa, Mycobacterium tuberculosis
GEPGAGTR

SEQ ID NO: 1399225 - protein, 7 aa, Mycobacterium tuberculosis
GEPGTGF

SEQ ID NO: 1399226 - protein, 5 aa, Mycobacterium tuberculosis
GEPGV

SEQ ID NO: 1399227 - protein, 6 aa, Mycobacterium tuberculosis
GEPINP

SEQ ID NO: 1399228 - protein, 4 aa, Mycobacterium tuberculosis
GEPN

SEQ ID NO: 1399229 - protein, 5 aa, Mycobacterium tuberculosis
GEPPM

SEQ ID NO: 1399230 - protein, 7 aa, Mycobacterium tuberculosis
GEPQPTV

SEQ ID NO: 1399231 - protein, 7 aa, Mycobacterium tuberculosis
GEPRARD

SEQ ID NO: 1399232 - protein, 8 aa, Mycobacterium tuberculosis
GEPRPGNY

SEQ ID NO: 1399233 - protein, 7 aa, Mycobacterium tuberculosis
GEPRYGD

SEQ ID NO: 1399234 - protein, 7 aa, Mycobacterium tuberculosis
GEPTDLE

SEQ ID NO: 1399235 - protein, 12 aa, Mycobacterium tuberculosis
GEPTFSYKEHPK

SEQ ID NO: 1399236 - protein, 5 aa, Mycobacterium tuberculosis
GEQAA

SEQ ID NO: 1399237 - protein, 19 aa, Mycobacterium tuberculosis
GEQLSAAGTPWSPDEEEAF

SEQ ID NO: 1399238 - protein, 8 aa, Mycobacterium tuberculosis
GEQPSVPE

SEQ ID NO: 1399239 - protein, 7 aa, Mycobacterium tuberculosis
GEQSNNI

SEQ ID NO: 1399240 - protein, 28 aa, Mycobacterium tuberculosis
GERADGGESIAAPEDELASRRKHRDRKI

SEQ ID NO: 1399241 - protein, 6 aa, Mycobacterium tuberculosis
GERAQV

SEQ ID NO: 1399242 - protein, 14 aa, Mycobacterium tuberculosis
GERDGVPPIHGVLT

SEQ ID NO: 1399243 - protein, 10 aa, Mycobacterium tuberculosis
GEREGNEPYG

SEQ ID NO: 1399244 - protein, 6 aa, Mycobacterium tuberculosis
GERPRF

SEQ ID NO: 1399245 - protein, 5 aa, Mycobacterium tuberculosis
GERRP

SEQ ID NO: 1399246 - protein, 8 aa, Mycobacterium tuberculosis
GERTREGN

SEQ ID NO: 1399247 - protein, 6 aa, Mycobacterium tuberculosis
GESAEE

SEQ ID NO: 1399248 - protein, 6 aa, Mycobacterium tuberculosis
GESDDK

SEQ ID NO: 1399249 - protein, 6 aa, Mycobacterium tuberculosis
GESGAQ

SEQ ID NO: 1399250 - protein, 12 aa, Mycobacterium tuberculosis
GESGSGKSTTAA

SEQ ID NO: 1399251 - protein, 11 aa, Mycobacterium tuberculosis
GESRDHAKTAD

SEQ ID NO: 1399252 - protein, 8 aa, Mycobacterium tuberculosis
GESVTDGS

SEQ ID NO: 1399253 - protein, 6 aa, Mycobacterium tuberculosis
GESYPT

SEQ ID NO: 1399254 - protein, 8 aa, Mycobacterium tuberculosis
GETAEHPG

SEQ ID NO: 1399255 - protein, 7 aa, Mycobacterium tuberculosis
GETAPGL

SEQ ID NO: 1399256 - protein, 6 aa, Mycobacterium tuberculosis
GETAPY

SEQ ID NO: 1399257 - protein, 5 aa, Mycobacterium tuberculosis
GETDP

SEQ ID NO: 1399258 - protein, 9 aa, Mycobacterium tuberculosis
GETEAKTNA

SEQ ID NO: 1399259 - protein, 7 aa, Mycobacterium tuberculosis
GETLTDG

SEQ ID NO: 1399260 - protein, 6 aa, Mycobacterium tuberculosis
GETRQQ

SEQ ID NO: 1399261 - protein, 6 aa, Mycobacterium tuberculosis
GETTID

SEQ ID NO: 1399262 - protein, 6 aa, Mycobacterium tuberculosis
GEVGKG

SEQ ID NO: 1399263 - protein, 10 aa, Mycobacterium tuberculosis
GEVGNAEQAN

SEQ ID NO: 1399264 - protein, 4 aa, Mycobacterium tuberculosis
GEVQ

SEQ ID NO: 1399265 - protein, 6 aa, Mycobacterium tuberculosis
GEYGGP

SEQ ID NO: 1399266 - protein, 5 aa, Mycobacterium tuberculosis
GEYGP

SEQ ID NO: 1399267 - protein, 10 aa, Mycobacterium tuberculosis
GFAEDSTTET

SEQ ID NO: 1399268 - protein, 9 aa, Mycobacterium tuberculosis
GFDPNQPSA

SEQ ID NO: 1399269 - protein, 11 aa, Mycobacterium tuberculosis
GFDPTQPTAWS

SEQ ID NO: 1399270 - protein, 10 aa, Mycobacterium tuberculosis
GFGADTATAI

SEQ ID NO: 1399271 - protein, 5 aa, Mycobacterium tuberculosis
GFGPE

SEQ ID NO: 1399272 - protein, 12 aa, Mycobacterium tuberculosis
GFSEDPKALEPA

SEQ ID NO: 1399273 - protein, 10 aa, Mycobacterium tuberculosis
GFTVEPDGHG

SEQ ID NO: 1399274 - protein, 9 aa, Mycobacterium tuberculosis
GGAASPKET

SEQ ID NO: 1399275 - protein, 9 aa, Mycobacterium tuberculosis
GGADDDAIE

SEQ ID NO: 1399276 - protein, 5 aa, Mycobacterium tuberculosis
GGAGD

SEQ ID NO: 1399277 - protein, 21 aa, Mycobacterium tuberculosis
GGAGTRKRAAPAHGGHRPPRL

SEQ ID NO: 1399278 - protein, 14 aa, Mycobacterium tuberculosis
GGAGYTAAKHAQGA

SEQ ID NO: 1399279 - protein, 6 aa, Mycobacterium tuberculosis
GGANVA

SEQ ID NO: 1399280 - protein, 5 aa, Mycobacterium tuberculosis
GGAPG

SEQ ID NO: 1399281 - protein, 6 aa, Mycobacterium tuberculosis
GGAPYY

SEQ ID NO: 1399282 - protein, 9 aa, Mycobacterium tuberculosis
GGAQAPTES

SEQ ID NO: 1399283 - protein, 12 aa, Mycobacterium tuberculosis
GGATAAASVSDV

SEQ ID NO: 1399284 - protein, 4 aa, Mycobacterium tuberculosis
GGAY

SEQ ID NO: 1399285 - protein, 9 aa, Mycobacterium tuberculosis
GGDAKTWGD

SEQ ID NO: 1399286 - protein, 6 aa, Mycobacterium tuberculosis
GGDPEK

SEQ ID NO: 1399287 - protein, 8 aa, Mycobacterium tuberculosis
GGDPLDGD

SEQ ID NO: 1399288 - protein, 8 aa, Mycobacterium tuberculosis
GGDPMAPA

SEQ ID NO: 1399289 - protein, 14 aa, Mycobacterium tuberculosis
GGDPPIELPPAGRY

SEQ ID NO: 1399290 - protein, 6 aa, Mycobacterium tuberculosis
GGDRFT

SEQ ID NO: 1399291 - protein, 5 aa, Mycobacterium tuberculosis
GGDTG

SEQ ID NO: 1399292 - protein, 7 aa, Mycobacterium tuberculosis
GGDTGAD

SEQ ID NO: 1399293 - protein, 9 aa, Mycobacterium tuberculosis
GGDVESNSA

SEQ ID NO: 1399294 - protein, 10 aa, Mycobacterium tuberculosis
GGEADDAERR

SEQ ID NO: 1399295 - protein, 9 aa, Mycobacterium tuberculosis
GGEAGGHCG

SEQ ID NO: 1399296 - protein, 8 aa, Mycobacterium tuberculosis
GGEGYQPG

SEQ ID NO: 1399297 - protein, 7 aa, Mycobacterium tuberculosis
GGEPTVR

SEQ ID NO: 1399298 - protein, 10 aa, Mycobacterium tuberculosis
GGERKGDPDW

SEQ ID NO: 1399299 - protein, 8 aa, Mycobacterium tuberculosis
GGESRDLD

SEQ ID NO: 1399300 - protein, 17 aa, Mycobacterium tuberculosis
GGESSRPGATRVDPAVE

SEQ ID NO: 1399301 - protein, 8 aa, Mycobacterium tuberculosis
GGFPGTAA

SEQ ID NO: 1399302 - protein, 5 aa, Mycobacterium tuberculosis
GGFTS

SEQ ID NO: 1399303 - protein, 11 aa, Mycobacterium tuberculosis
GGGAPTVEESR

SEQ ID NO: 1399304 - protein, 8 aa, Mycobacterium tuberculosis
GGGDPDEL

SEQ ID NO: 1399305 - protein, 8 aa, Mycobacterium tuberculosis
GGGDSAAA

SEQ ID NO: 1399306 - protein, 10 aa, Mycobacterium tuberculosis
GGGEGGHNGL

SEQ ID NO: 1399307 - protein, 7 aa, Mycobacterium tuberculosis
GGGERKT

SEQ ID NO: 1399308 - protein, 6 aa, Mycobacterium tuberculosis
GGGGGA

SEQ ID NO: 1399309 - protein, 9 aa, Mycobacterium tuberculosis
GGGGPGVGP

SEQ ID NO: 1399310 - protein, 5 aa, Mycobacterium tuberculosis
GGGGV

SEQ ID NO: 1399311 - protein, 4 aa, Mycobacterium tuberculosis
GGGL

SEQ ID NO: 1399312 - protein, 5 aa, Mycobacterium tuberculosis
GGGLA

SEQ ID NO: 1399313 - protein, 9 aa, Mycobacterium tuberculosis
GGGLGKGGE

SEQ ID NO: 1399314 - protein, 6 aa, Mycobacterium tuberculosis
GGGPGY

SEQ ID NO: 1399315 - protein, 8 aa, Mycobacterium tuberculosis
GGGPPTAI

SEQ ID NO: 1399316 - protein, 6 aa, Mycobacterium tuberculosis
GGGQVT

SEQ ID NO: 1399317 - protein, 15 aa, Mycobacterium tuberculosis
GGGRANPGLDAGGYV

SEQ ID NO: 1399318 - protein, 7 aa, Mycobacterium tuberculosis
GGGRNKV

SEQ ID NO: 1399319 - protein, 6 aa, Mycobacterium tuberculosis
GGGSNA

SEQ ID NO: 1399320 - protein, 6 aa, Mycobacterium tuberculosis
GGGSTE

SEQ ID NO: 1399321 - protein, 5 aa, Mycobacterium tuberculosis
GGGSV

SEQ ID NO: 1399322 - protein, 14 aa, Mycobacterium tuberculosis
GGGTLSTWQADRLP

SEQ ID NO: 1399323 - protein, 9 aa, Mycobacterium tuberculosis
GGGTSKPTN

SEQ ID NO: 1399324 - protein, 10 aa, Mycobacterium tuberculosis
GGGYGGDSDW

SEQ ID NO: 1399325 - protein, 8 aa, Mycobacterium tuberculosis
GGHPVGAS

SEQ ID NO: 1399326 - protein, 4 aa, Mycobacterium tuberculosis
GGHT

SEQ ID NO: 1399327 - protein, 12 aa, Mycobacterium tuberculosis
GGHTRDHGKAPV

SEQ ID NO: 1399328 - protein, 8 aa, Mycobacterium tuberculosis
GGINSPDK

SEQ ID NO: 1399329 - protein, 8 aa, Mycobacterium tuberculosis
GGIRPDQP

SEQ ID NO: 1399330 - protein, 5 aa, Mycobacterium tuberculosis
GGITG

SEQ ID NO: 1399331 - protein, 10 aa, Mycobacterium tuberculosis
GGKAERDQRI

SEQ ID NO: 1399332 - protein, 6 aa, Mycobacterium tuberculosis
GGKPAR

SEQ ID NO: 1399333 - protein, 9 aa, Mycobacterium tuberculosis
GGKPHDPAV

SEQ ID NO: 1399334 - protein, 4 aa, Mycobacterium tuberculosis
GGKS

SEQ ID NO: 1399335 - protein, 9 aa, Mycobacterium tuberculosis
GGKSETFPG

SEQ ID NO: 1399336 - protein, 5 aa, Mycobacterium tuberculosis
GGLAG

SEQ ID NO: 1399337 - protein, 8 aa, Mycobacterium tuberculosis
GGLDGESV

SEQ ID NO: 1399338 - protein, 6 aa, Mycobacterium tuberculosis
GGLEGT

SEQ ID NO: 1399339 - protein, 9 aa, Mycobacterium tuberculosis
GGLGPTADD

SEQ ID NO: 1399340 - protein, 8 aa, Mycobacterium tuberculosis
GGLPPESG

SEQ ID NO: 1399341 - protein, 5 aa, Mycobacterium tuberculosis
GGLPS

SEQ ID NO: 1399342 - protein, 6 aa, Mycobacterium tuberculosis
GGMPPM

SEQ ID NO: 1399343 - protein, 6 aa, Mycobacterium tuberculosis
GGMSDN

SEQ ID NO: 1399344 - protein, 12 aa, Mycobacterium tuberculosis
GGMYGDESPGAG

SEQ ID NO: 1399345 - protein, 7 aa, Mycobacterium tuberculosis
GGNDTVT

SEQ ID NO: 1399346 - protein, 7 aa, Mycobacterium tuberculosis
GGNEYRR

SEQ ID NO: 1399347 - protein, 4 aa, Mycobacterium tuberculosis
GGNG

SEQ ID NO: 1399348 - protein, 7 aa, Mycobacterium tuberculosis
GGNGSGR

SEQ ID NO: 1399349 - protein, 4 aa, Mycobacterium tuberculosis
GGNN

SEQ ID NO: 1399350 - protein, 4 aa, Mycobacterium tuberculosis
GGPA

SEQ ID NO: 1399351 - protein, 13 aa, Mycobacterium tuberculosis
GGPAERRRDGTAR

SEQ ID NO: 1399352 - protein, 6 aa, Mycobacterium tuberculosis
GGPANF

SEQ ID NO: 1399353 - protein, 16 aa, Mycobacterium tuberculosis
GGPASVYADGAPKLDP

SEQ ID NO: 1399354 - protein, 10 aa, Mycobacterium tuberculosis
GGPEPYTGAP

SEQ ID NO: 1399355 - protein, 8 aa, Mycobacterium tuberculosis
GGPGAASW

SEQ ID NO: 1399356 - protein, 7 aa, Mycobacterium tuberculosis
GGPGAGA

SEQ ID NO: 1399357 - protein, 7 aa, Mycobacterium tuberculosis
GGPGGLA

SEQ ID NO: 1399358 - protein, 4 aa, Mycobacterium tuberculosis
GGPM

SEQ ID NO: 1399359 - protein, 5 aa, Mycobacterium tuberculosis
GGPQI

SEQ ID NO: 1399360 - protein, 9 aa, Mycobacterium tuberculosis
GGPQPPPVA

SEQ ID NO: 1399361 - protein, 9 aa, Mycobacterium tuberculosis
GGPSDDPFG

SEQ ID NO: 1399362 - protein, 5 aa, Mycobacterium tuberculosis
GGPTL

SEQ ID NO: 1399363 - protein, 9 aa, Mycobacterium tuberculosis
GGPVGSGKT

SEQ ID NO: 1399364 - protein, 6 aa, Mycobacterium tuberculosis
GGPVPI

SEQ ID NO: 1399365 - protein, 12 aa, Mycobacterium tuberculosis
GGPVSDNKGISL

SEQ ID NO: 1399366 - protein, 6 aa, Mycobacterium tuberculosis
GGQAGN

SEQ ID NO: 1399367 - protein, 14 aa, Mycobacterium tuberculosis
GGQAVADGSDISDW

SEQ ID NO: 1399368 - protein, 11 aa, Mycobacterium tuberculosis
GGQDPGAQSSV

SEQ ID NO: 1399369 - protein, 5 aa, Mycobacterium tuberculosis
GGQTI

SEQ ID NO: 1399370 - protein, 8 aa, Mycobacterium tuberculosis
GGRGGAGA

SEQ ID NO: 1399371 - protein, 13 aa, Mycobacterium tuberculosis
GGRGIRVDVVDTD

SEQ ID NO: 1399372 - protein, 5 aa, Mycobacterium tuberculosis
GGRIT

SEQ ID NO: 1399373 - protein, 7 aa, Mycobacterium tuberculosis
GGRITQE

SEQ ID NO: 1399374 - protein, 7 aa, Mycobacterium tuberculosis
GGRLSRQ

SEQ ID NO: 1399375 - protein, 5 aa, Mycobacterium tuberculosis
GGRNR

SEQ ID NO: 1399376 - protein, 20 aa, Mycobacterium tuberculosis
GGRPMSPARSQDVELGGDKE

SEQ ID NO: 1399377 - protein, 7 aa, Mycobacterium tuberculosis
GGRPPAD

SEQ ID NO: 1399378 - protein, 5 aa, Mycobacterium tuberculosis
GGRTP

SEQ ID NO: 1399379 - protein, 10 aa, Mycobacterium tuberculosis
GGRTRTGKLR

SEQ ID NO: 1399380 - protein, 9 aa, Mycobacterium tuberculosis
GGSAAGTNE

SEQ ID NO: 1399381 - protein, 5 aa, Mycobacterium tuberculosis
GGSDL

SEQ ID NO: 1399382 - protein, 7 aa, Mycobacterium tuberculosis
GGSGIKG

SEQ ID NO: 1399383 - protein, 9 aa, Mycobacterium tuberculosis
GGSGTRGYG

SEQ ID NO: 1399384 - protein, 8 aa, Mycobacterium tuberculosis
GGSNRTDT

SEQ ID NO: 1399385 - protein, 9 aa, Mycobacterium tuberculosis
GGSPGASTA

SEQ ID NO: 1399386 - protein, 19 aa, Mycobacterium tuberculosis
GGSSGIGAAAAKKIAEAGG

SEQ ID NO: 1399387 - protein, 8 aa, Mycobacterium tuberculosis
GGSSQDSV

SEQ ID NO: 1399388 - protein, 26 aa, Mycobacterium tuberculosis
GGSTHGYDVTDPTTVSPELGGSDGLA

SEQ ID NO: 1399389 - protein, 6 aa, Mycobacterium tuberculosis
GGTAKD

SEQ ID NO: 1399390 - protein, 7 aa, Mycobacterium tuberculosis
GGTDAKA

SEQ ID NO: 1399391 - protein, 10 aa, Mycobacterium tuberculosis
GGTDTDGAAL

SEQ ID NO: 1399392 - protein, 5 aa, Mycobacterium tuberculosis
GGTMP

SEQ ID NO: 1399393 - protein, 7 aa, Mycobacterium tuberculosis
GGTNEVQ

SEQ ID NO: 1399394 - protein, 11 aa, Mycobacterium tuberculosis
GGTPDSALTGP

SEQ ID NO: 1399395 - protein, 15 aa, Mycobacterium tuberculosis
GGTPKMPETAGQTPE

SEQ ID NO: 1399396 - protein, 15 aa, Mycobacterium tuberculosis
GGTPPPYPGWPTEPA

SEQ ID NO: 1399397 - protein, 8 aa, Mycobacterium tuberculosis
GGTPSLLG

SEQ ID NO: 1399398 - protein, 5 aa, Mycobacterium tuberculosis
GGTRE

SEQ ID NO: 1399399 - protein, 6 aa, Mycobacterium tuberculosis
GGTSLR

SEQ ID NO: 1399400 - protein, 5 aa, Mycobacterium tuberculosis
GGTTY

SEQ ID NO: 1399401 - protein, 13 aa, Mycobacterium tuberculosis
GGVDDRDRDADLG

SEQ ID NO: 1399402 - protein, 11 aa, Mycobacterium tuberculosis
GGVPDGPWPDA

SEQ ID NO: 1399403 - protein, 7 aa, Mycobacterium tuberculosis
GGVPYSE

SEQ ID NO: 1399404 - protein, 10 aa, Mycobacterium tuberculosis
GGVRANHPDM

SEQ ID NO: 1399405 - protein, 6 aa, Mycobacterium tuberculosis
GGYGDR

SEQ ID NO: 1399406 - protein, 6 aa, Mycobacterium tuberculosis
GGYGPS

SEQ ID NO: 1399407 - protein, 7 aa, Mycobacterium tuberculosis
GHAGDGN

SEQ ID NO: 1399408 - protein, 4 aa, Mycobacterium tuberculosis
GHEA

SEQ ID NO: 1399409 - protein, 6 aa, Mycobacterium tuberculosis
GHEPDN

SEQ ID NO: 1399410 - protein, 4 aa, Mycobacterium tuberculosis
GHGE

SEQ ID NO: 1399411 - protein, 12 aa, Mycobacterium tuberculosis
GHGESDWSSEGD

SEQ ID NO: 1399412 - protein, 4 aa, Mycobacterium tuberculosis
GHGG

SEQ ID NO: 1399413 - protein, 8 aa, Mycobacterium tuberculosis
GHHRGPSI

SEQ ID NO: 1399414 - protein, 8 aa, Mycobacterium tuberculosis
GHHRSGVR

SEQ ID NO: 1399415 - protein, 12 aa, Mycobacterium tuberculosis
GHNEGDDPSMTN

SEQ ID NO: 1399416 - protein, 27 aa, Mycobacterium tuberculosis
GHQPGDTVTYSTPQGPNQVQLLAVKLP

SEQ ID NO: 1399417 - protein, 10 aa, Mycobacterium tuberculosis
GHRANPVATG

SEQ ID NO: 1399418 - protein, 13 aa, Mycobacterium tuberculosis
GHRPKTVSTTAGD

SEQ ID NO: 1399419 - protein, 13 aa, Mycobacterium tuberculosis
GHTPGQAAKPMAA

SEQ ID NO: 1399420 - protein, 13 aa, Mycobacterium tuberculosis
GHTPSAQVPTTDD

SEQ ID NO: 1399421 - protein, 4 aa, Mycobacterium tuberculosis
GHWP

SEQ ID NO: 1399422 - protein, 14 aa, Mycobacterium tuberculosis
GIAGPSGGTPEKPV

SEQ ID NO: 1399423 - protein, 5 aa, Mycobacterium tuberculosis
GIARD

SEQ ID NO: 1399424 - protein, 5 aa, Mycobacterium tuberculosis
GIDPD

SEQ ID NO: 1399425 - protein, 7 aa, Mycobacterium tuberculosis
GIERPDY

SEQ ID NO: 1399426 - protein, 13 aa, Mycobacterium tuberculosis
GIGATENAEGFTT

SEQ ID NO: 1399427 - protein, 8 aa, Mycobacterium tuberculosis
GIGDRPRA

SEQ ID NO: 1399428 - protein, 5 aa, Mycobacterium tuberculosis
GIGPG

SEQ ID NO: 1399429 - protein, 7 aa, Mycobacterium tuberculosis
GIGPGDR

SEQ ID NO: 1399430 - protein, 7 aa, Mycobacterium tuberculosis
GIGPKTA

SEQ ID NO: 1399431 - protein, 9 aa, Mycobacterium tuberculosis
GIGSSNKKL

SEQ ID NO: 1399432 - protein, 7 aa, Mycobacterium tuberculosis
GIPGQDA

SEQ ID NO: 1399433 - protein, 7 aa, Mycobacterium tuberculosis
GIPTPGF

SEQ ID NO: 1399434 - protein, 10 aa, Mycobacterium tuberculosis
GISESEEQQQ

SEQ ID NO: 1399435 - protein, 8 aa, Mycobacterium tuberculosis
GISPPEDN

SEQ ID NO: 1399436 - protein, 6 aa, Mycobacterium tuberculosis
GISRKA

SEQ ID NO: 1399437 - protein, 11 aa, Mycobacterium tuberculosis
GITASYQQQEI

SEQ ID NO: 1399438 - protein, 11 aa, Mycobacterium tuberculosis
GITSDGASRRV

SEQ ID NO: 1399439 - protein, 4 aa, Mycobacterium tuberculosis
GKAE

SEQ ID NO: 1399440 - protein, 8 aa, Mycobacterium tuberculosis
GKAQPGQV

SEQ ID NO: 1399441 - protein, 7 aa, Mycobacterium tuberculosis
GKATPEA

SEQ ID NO: 1399442 - protein, 9 aa, Mycobacterium tuberculosis
GKDKGAKGK

SEQ ID NO: 1399443 - protein, 22 aa, Mycobacterium tuberculosis
GKFTGAGGNLEQTVTKNNLEAA

SEQ ID NO: 1399444 - protein, 15 aa, Mycobacterium tuberculosis
GKGCAEAMKGQGARV

SEQ ID NO: 1399445 - protein, 7 aa, Mycobacterium tuberculosis
GKGGKQR

SEQ ID NO: 1399446 - protein, 5 aa, Mycobacterium tuberculosis
GKGRI

SEQ ID NO: 1399447 - protein, 5 aa, Mycobacterium tuberculosis
GKHTG

SEQ ID NO: 1399448 - protein, 7 aa, Mycobacterium tuberculosis
GKKKREV

SEQ ID NO: 1399449 - protein, 8 aa, Mycobacterium tuberculosis
GKKREDGV

SEQ ID NO: 1399450 - protein, 8 aa, Mycobacterium tuberculosis
GKLDGTPE

SEQ ID NO: 1399451 - protein, 10 aa, Mycobacterium tuberculosis
GKLGEGRTAL

SEQ ID NO: 1399452 - protein, 8 aa, Mycobacterium tuberculosis
GKLSDPRP

SEQ ID NO: 1399453 - protein, 7 aa, Mycobacterium tuberculosis
GKLSNSL

SEQ ID NO: 1399454 - protein, 4 aa, Mycobacterium tuberculosis
GKLT

SEQ ID NO: 1399455 - protein, 13 aa, Mycobacterium tuberculosis
GKPATRRHEPDGG

SEQ ID NO: 1399456 - protein, 4 aa, Mycobacterium tuberculosis
GKPE

SEQ ID NO: 1399457 - protein, 5 aa, Mycobacterium tuberculosis
GKPGR

SEQ ID NO: 1399458 - protein, 5 aa, Mycobacterium tuberculosis
GKPRF

SEQ ID NO: 1399459 - protein, 8 aa, Mycobacterium tuberculosis
GKQGDRGV

SEQ ID NO: 1399460 - protein, 16 aa, Mycobacterium tuberculosis
GKQIARGSARMASGGT

SEQ ID NO: 1399461 - protein, 9 aa, Mycobacterium tuberculosis
GKQRPGSVR

SEQ ID NO: 1399462 - protein, 5 aa, Mycobacterium tuberculosis
GKRAN

SEQ ID NO: 1399463 - protein, 5 aa, Mycobacterium tuberculosis
GKRKG

SEQ ID NO: 1399464 - protein, 7 aa, Mycobacterium tuberculosis
GKRPSVR

SEQ ID NO: 1399465 - protein, 12 aa, Mycobacterium tuberculosis
GKRRSNQAENGI

SEQ ID NO: 1399466 - protein, 4 aa, Mycobacterium tuberculosis
GKTG

SEQ ID NO: 1399467 - protein, 9 aa, Mycobacterium tuberculosis
GKTPGRQGR

SEQ ID NO: 1399468 - protein, 7 aa, Mycobacterium tuberculosis
GKTTAMR

SEQ ID NO: 1399469 - protein, 6 aa, Mycobacterium tuberculosis
GKTTLT

SEQ ID NO: 1399470 - protein, 5 aa, Mycobacterium tuberculosis
GKTVS

SEQ ID NO: 1399471 - protein, 5 aa, Mycobacterium tuberculosis
GKYGA

SEQ ID NO: 1399472 - protein, 9 aa, Mycobacterium tuberculosis
GKYPPPPGV

SEQ ID NO: 1399473 - protein, 4 aa, Mycobacterium tuberculosis
GKYT

SEQ ID NO: 1399474 - protein, 8 aa, Mycobacterium tuberculosis
GLAAAGTH

SEQ ID NO: 1399475 - protein, 10 aa, Mycobacterium tuberculosis
GLADGDAAEL

SEQ ID NO: 1399476 - protein, 16 aa, Mycobacterium tuberculosis
GLAPGPLLGDGQLHER

SEQ ID NO: 1399477 - protein, 10 aa, Mycobacterium tuberculosis
GLARTEGHKM

SEQ ID NO: 1399478 - protein, 6 aa, Mycobacterium tuberculosis
GLDEDR

SEQ ID NO: 1399479 - protein, 4 aa, Mycobacterium tuberculosis
GLDG

SEQ ID NO: 1399480 - protein, 9 aa, Mycobacterium tuberculosis
GLDPAGPAA

SEQ ID NO: 1399481 - protein, 13 aa, Mycobacterium tuberculosis
GLDPNTATAGELA

SEQ ID NO: 1399482 - protein, 6 aa, Mycobacterium tuberculosis
GLGEPT

SEQ ID NO: 1399483 - protein, 10 aa, Mycobacterium tuberculosis
GLGGENAPGV

SEQ ID NO: 1399484 - protein, 10 aa, Mycobacterium tuberculosis
GLGKPDKKAV

SEQ ID NO: 1399485 - protein, 7 aa, Mycobacterium tuberculosis
GLGQGNR

SEQ ID NO: 1399486 - protein, 5 aa, Mycobacterium tuberculosis
GLGSA

SEQ ID NO: 1399487 - protein, 6 aa, Mycobacterium tuberculosis
GLGSQR

SEQ ID NO: 1399488 - protein, 6 aa, Mycobacterium tuberculosis
GLKQPD

SEQ ID NO: 1399489 - protein, 17 aa, Mycobacterium tuberculosis
GLNDGTRVREDPLTYAG

SEQ ID NO: 1399490 - protein, 5 aa, Mycobacterium tuberculosis
GLPAQ

SEQ ID NO: 1399491 - protein, 10 aa, Mycobacterium tuberculosis
GLPDNTVGPP

SEQ ID NO: 1399492 - protein, 11 aa, Mycobacterium tuberculosis
GLPDQPGRSTM

SEQ ID NO: 1399493 - protein, 10 aa, Mycobacterium tuberculosis
GLPDRKDVKD

SEQ ID NO: 1399494 - protein, 8 aa, Mycobacterium tuberculosis
GLPGAQGR

SEQ ID NO: 1399495 - protein, 13 aa, Mycobacterium tuberculosis
GLPGARARRRGLS

SEQ ID NO: 1399496 - protein, 6 aa, Mycobacterium tuberculosis
GLPGDT

SEQ ID NO: 1399497 - protein, 12 aa, Mycobacterium tuberculosis
GLPKGDLPPPLP

SEQ ID NO: 1399498 - protein, 15 aa, Mycobacterium tuberculosis
GLPPAGVTDLGSRSR

SEQ ID NO: 1399499 - protein, 13 aa, Mycobacterium tuberculosis
GLPPPWQPALPRL

SEQ ID NO: 1399500 - protein, 7 aa, Mycobacterium tuberculosis
GLPSASA

SEQ ID NO: 1399501 - protein, 13 aa, Mycobacterium tuberculosis
GLRPDKKPSEVVR

SEQ ID NO: 1399502 - protein, 7 aa, Mycobacterium tuberculosis
GLSPATP

SEQ ID NO: 1399503 - protein, 8 aa, Mycobacterium tuberculosis
GLSPSQDE

SEQ ID NO: 1399504 - protein, 22 aa, Mycobacterium tuberculosis
GLSQGDVVESGANADIKPGNNL

SEQ ID NO: 1399505 - protein, 10 aa, Mycobacterium tuberculosis
GLSRQGRHGP

SEQ ID NO: 1399506 - protein, 12 aa, Mycobacterium tuberculosis
GLSSDRATVAAA

SEQ ID NO: 1399507 - protein, 7 aa, Mycobacterium tuberculosis
GLTATRH

SEQ ID NO: 1399508 - protein, 5 aa, Mycobacterium tuberculosis
GLTEA

SEQ ID NO: 1399509 - protein, 5 aa, Mycobacterium tuberculosis
GLTGP

SEQ ID NO: 1399510 - protein, 9 aa, Mycobacterium tuberculosis
GLTSGADDY

SEQ ID NO: 1399511 - protein, 33 aa, Mycobacterium tuberculosis; identical to SEQ ID NO: 176346

SEQ ID NO: 1399512 - protein, 8 aa, Mycobacterium tuberculosis
GMESGHAY

SEQ ID NO: 1399513 - protein, 7 aa, Mycobacterium tuberculosis
GMGGSQR

SEQ ID NO: 1399514 - protein, 6 aa, Mycobacterium tuberculosis
GMGREG

SEQ ID NO: 1399515 - protein, 6 aa, Mycobacterium tuberculosis
GMGRES

SEQ ID NO: 1399516 - protein, 6 aa, Mycobacterium tuberculosis
GMKPGD

SEQ ID NO: 1399517 - protein, 5 aa, Mycobacterium tuberculosis
GMNPP

SEQ ID NO: 1399518 - protein, 13 aa, Mycobacterium tuberculosis
GMPAAPGPALRGG

SEQ ID NO: 1399519 - protein, 6 aa, Mycobacterium tuberculosis
GMRTGG

SEQ ID NO: 1399520 - protein, 11 aa, Mycobacterium tuberculosis
GMTGTAQTEAA

SEQ ID NO: 1399521 - protein, 4 aa, Mycobacterium tuberculosis
GNAA

SEQ ID NO: 1399522 - protein, 7 aa, Mycobacterium tuberculosis
GNAGKAG

SEQ ID NO: 1399523 - protein, 5 aa, Mycobacterium tuberculosis
GNAGN

SEQ ID NO: 1399524 - protein, 8 aa, Mycobacterium tuberculosis
GNAMTDDT

SEQ ID NO: 1399525 - protein, 18 aa, Mycobacterium tuberculosis
GNAPTDEADAEKIPVTTD

SEQ ID NO: 1399526 - protein, 7 aa, Mycobacterium tuberculosis
GNARPAQ

SEQ ID NO: 1399527 - protein, 8 aa, Mycobacterium tuberculosis
GNDEQRRW

SEQ ID NO: 1399528 - protein, 9 aa, Mycobacterium tuberculosis
GNDNRDTGV

SEQ ID NO: 1399529 - protein, 5 aa, Mycobacterium tuberculosis
GNDRG

SEQ ID NO: 1399530 - protein, 5 aa, Mycobacterium tuberculosis
GNDYD

SEQ ID NO: 1399531 - protein, 6 aa, Mycobacterium tuberculosis
GNEDGV

SEQ ID NO: 1399532 - protein, 11 aa, Mycobacterium tuberculosis
GNESTDGVGGA

SEQ ID NO: 1399533 - protein, 8 aa, Mycobacterium tuberculosis
GNGKFNTI

SEQ ID NO: 1399534 - protein, 6 aa, Mycobacterium tuberculosis
GNGLRR

SEQ ID NO: 1399535 - protein, 4 aa, Mycobacterium tuberculosis
GNGN

SEQ ID NO: 1399536 - protein, 14 aa, Mycobacterium tuberculosis
GNGNFGIGNSGNFS

SEQ ID NO: 1399537 - protein, 10 aa, Mycobacterium tuberculosis
GNGPSPKDGG

SEQ ID NO: 1399538 - protein, 4 aa, Mycobacterium tuberculosis
GNNH

SEQ ID NO: 1399539 - protein, 9 aa, Mycobacterium tuberculosis
GNNKSVSEL

SEQ ID NO: 1399540 - protein, 6 aa, Mycobacterium tuberculosis
GNNPVG

SEQ ID NO: 1399541 - protein, 4 aa, Mycobacterium tuberculosis
GNNQ

SEQ ID NO: 1399542 - protein, 6 aa, Mycobacterium tuberculosis
GNPAEL

SEQ ID NO: 1399543 - protein, 9 aa, Mycobacterium tuberculosis
GNPALTASH

SEQ ID NO: 1399544 - protein, 8 aa, Mycobacterium tuberculosis
GNPDTAKH

SEQ ID NO: 1399545 - protein, 6 aa, Mycobacterium tuberculosis
GNPTSS

SEQ ID NO: 1399546 - protein, 15 aa, Mycobacterium tuberculosis
GNRAASSLSGGADTL

SEQ ID NO: 1399547 - protein, 5 aa, Mycobacterium tuberculosis
GNRAP

SEQ ID NO: 1399548 - protein, 13 aa, Mycobacterium tuberculosis
GNSGGAPETVQHN

SEQ ID NO: 1399549 - protein, 5 aa, Mycobacterium tuberculosis
GNTGR

SEQ ID NO: 1399550 - protein, 11 aa, Mycobacterium tuberculosis
GNTHESSTGFK

SEQ ID NO: 1399551 - protein, 5 aa, Mycobacterium tuberculosis
GNTNF

SEQ ID NO: 1399552 - protein, 7 aa, Mycobacterium tuberculosis
GNTRSYG

SEQ ID NO: 1399553 - protein, 5 aa, Mycobacterium tuberculosis
GNYKS

SEQ ID NO: 1399554 - protein, 11 aa, Mycobacterium tuberculosis
GPAAGGHRGTF

SEQ ID NO: 1399555 - protein, 8 aa, Mycobacterium tuberculosis
GPAAPQRL

SEQ ID NO: 1399556 - protein, 13 aa, Mycobacterium tuberculosis
GPAEDWADWADAA

SEQ ID NO: 1399557 - protein, 11 aa, Mycobacterium tuberculosis
GPAEPANVEPL

SEQ ID NO: 1399558 - protein, 7 aa, Mycobacterium tuberculosis
GPAFTGR

SEQ ID NO: 1399559 - protein, 4 aa, Mycobacterium tuberculosis
GPAI

SEQ ID NO: 1399560 - protein, 8 aa, Mycobacterium tuberculosis
GPAIAGGT

SEQ ID NO: 1399561 - protein, 8 aa, Mycobacterium tuberculosis
GPASADGA

SEQ ID NO: 1399562 - protein, 6 aa, Mycobacterium tuberculosis
GPDGSG

SEQ ID NO: 1399563 - protein, 15 aa, Mycobacterium tuberculosis
GPDPLRSDANPSSAW

SEQ ID NO: 1399564 - protein, 4 aa, Mycobacterium tuberculosis
GPDR

SEQ ID NO: 1399565 - protein, 9 aa, Mycobacterium tuberculosis
GPDSDAARR

SEQ ID NO: 1399566 - protein, 5 aa, Mycobacterium tuberculosis
GPDTR

SEQ ID NO: 1399567 - protein, 4 aa, Mycobacterium tuberculosis
GPDY

SEQ ID NO: 1399568 - protein, 15 aa, Mycobacterium tuberculosis
GPEKALGDAAHRPDE

SEQ ID NO: 1399569 - protein, 5 aa, Mycobacterium tuberculosis
GPEPL

SEQ ID NO: 1399570 - protein, 6 aa, Mycobacterium tuberculosis
GPGAAV

SEQ ID NO: 1399571 - protein, 6 aa, Mycobacterium tuberculosis
GPGDDA

SEQ ID NO: 1399572 - protein, 11 aa, Mycobacterium tuberculosis
GPGDPALADPR

SEQ ID NO: 1399573 - protein, 8 aa, Mycobacterium tuberculosis
GPGEAPEL

SEQ ID NO: 1399574 - protein, 9 aa, Mycobacterium tuberculosis
GPGEAREAD

SEQ ID NO: 1399575 - protein, 5 aa, Mycobacterium tuberculosis
GPGGY

SEQ ID NO: 1399576 - protein, 6 aa, Mycobacterium tuberculosis
GPGHAA

SEQ ID NO: 1399577 - protein, 5 aa, Mycobacterium tuberculosis
GPGSI

SEQ ID NO: 1399578 - protein, 4 aa, Mycobacterium tuberculosis
GPGT

SEQ ID NO: 1399579 - protein, 8 aa, Mycobacterium tuberculosis
GPGTGKST

SEQ ID NO: 1399580 - protein, 17 aa, Mycobacterium tuberculosis
GPHGSKRSLPQQLRAMV

SEQ ID NO: 1399581 - protein, 5 aa, Mycobacterium tuberculosis
GPISR

SEQ ID NO: 1399582 - protein, 11 aa, Mycobacterium tuberculosis
GPKGTDAQLRE

SEQ ID NO: 1399583 - protein, 13 aa, Mycobacterium tuberculosis
GPKQGEDDGSTGG

SEQ ID NO: 1399584 - protein, 9 aa, Mycobacterium tuberculosis
GPLKQSGAA

SEQ ID NO: 1399585 - protein, 8 aa, Mycobacterium tuberculosis
GPLPMPPS

SEQ ID NO: 1399586 - protein, 4 aa, Mycobacterium tuberculosis
GPLT

SEQ ID NO: 1399587 - protein, 9 aa, Mycobacterium tuberculosis
GPNGAGKTT

SEQ ID NO: 1399588 - protein, 9 aa, Mycobacterium tuberculosis
GPNHDGTPG

SEQ ID NO: 1399589 - protein, 8 aa, Mycobacterium tuberculosis
GPNTPRGR

SEQ ID NO: 1399590 - protein, 8 aa, Mycobacterium tuberculosis
GPPGLGKT

SEQ ID NO: 1399591 - protein, 9 aa, Mycobacterium tuberculosis
GPPGSGKTT

SEQ ID NO: 1399592 - protein, 7 aa, Mycobacterium tuberculosis
GPPGTAE

SEQ ID NO: 1399593 - protein, 5 aa, Mycobacterium tuberculosis
GPPHA

SEQ ID NO: 1399594 - protein, 9 aa, Mycobacterium tuberculosis
GPPLSQGEL

SEQ ID NO: 1399595 - protein, 9 aa, Mycobacterium tuberculosis
GPPPDSPRD

SEQ ID NO: 1399596 - protein, 6 aa, Mycobacterium tuberculosis
GPPREL

SEQ ID NO: 1399597 - protein, 8 aa, Mycobacterium tuberculosis
GPQAQPFG

SEQ ID NO: 1399598 - protein, 5 aa, Mycobacterium tuberculosis
GPQAR

SEQ ID NO: 1399599 - protein, 6 aa, Mycobacterium tuberculosis
GPQETV

SEQ ID NO: 1399600 - protein, 5 aa, Mycobacterium tuberculosis
GPRDR

SEQ ID NO: 1399601 - protein, 9 aa, Mycobacterium tuberculosis
GPRGQGLPK

SEQ ID NO: 1399602 - protein, 5 aa, Mycobacterium tuberculosis
GPRKT

SEQ ID NO: 1399603 - protein, 6 aa, Mycobacterium tuberculosis
GPRPDQ

SEQ ID NO: 1399604 - protein, 10 aa, Mycobacterium tuberculosis
GPRQAGKTTL

SEQ ID NO: 1399605 - protein, 12 aa, Mycobacterium tuberculosis
GPRTYSEQRGHP

SEQ ID NO: 1399606 - protein, 11 aa, Mycobacterium tuberculosis
GPSGAGKSTTQ

SEQ ID NO: 1399607 - protein, 8 aa, Mycobacterium tuberculosis
GPSGCGKT

SEQ ID NO: 1399608 - protein, 6 aa, Mycobacterium tuberculosis
GPSGNY

SEQ ID NO: 1399609 - protein, 7 aa, Mycobacterium tuberculosis
GPSPLRA

SEQ ID NO: 1399610 - protein, 8 aa, Mycobacterium tuberculosis
GPSRATGL

SEQ ID NO: 1399611 - protein, 6 aa, Mycobacterium tuberculosis
GPSSAA

SEQ ID NO: 1399612 - protein, 10 aa, Mycobacterium tuberculosis
GPSSAGGDTI

SEQ ID NO: 1399613 - protein, 7 aa, Mycobacterium tuberculosis
GPTEAIN

SEQ ID NO: 1399614 - protein, 5 aa, Mycobacterium tuberculosis
GPTEP

SEQ ID NO: 1399615 - protein, 7 aa, Mycobacterium tuberculosis
GPTETTV

SEQ ID NO: 1399616 - protein, 6 aa, Mycobacterium tuberculosis
GPTGFI

SEQ ID NO: 1399617 - protein, 11 aa, Mycobacterium tuberculosis
GPTGGLPADDP

SEQ ID NO: 1399618 - protein, 13 aa, Mycobacterium tuberculosis
GPTGLSSEVPAPD

SEQ ID NO: 1399619 - protein, 9 aa, Mycobacterium tuberculosis
GPTGNQRDE

SEQ ID NO: 1399620 - protein, 10 aa, Mycobacterium tuberculosis
GPTLDQPGAG

SEQ ID NO: 1399621 - protein, 6 aa, Mycobacterium tuberculosis
GPTLGR

SEQ ID NO: 1399622 - protein, 8 aa, Mycobacterium tuberculosis
GPTPATRK

SEQ ID NO: 1399623 - protein, 4 aa, Mycobacterium tuberculosis
GPVA

SEQ ID NO: 1399624 - protein, 7 aa, Mycobacterium tuberculosis
GPVEPGP

SEQ ID NO: 1399625 - protein, 4 aa, Mycobacterium tuberculosis
GPVP

SEQ ID NO: 1399626 - protein, 13 aa, Mycobacterium tuberculosis
GPYDDAPTAPGSA

SEQ ID NO: 1399627 - protein, 12 aa, Mycobacterium tuberculosis
GQAAYSASKGGV

SEQ ID NO: 1399628 - protein, 11 aa, Mycobacterium tuberculosis
GQAKGKDSGIT

SEQ ID NO: 1399629 - protein, 4 aa, Mycobacterium tuberculosis
GQDC

SEQ ID NO: 1399630 - protein, 10 aa, Mycobacterium tuberculosis
GQDGHDRGQK

SEQ ID NO: 1399631 - protein, 9 aa, Mycobacterium tuberculosis
GQDGSYSDE

SEQ ID NO: 1399632 - protein, 10 aa, Mycobacterium tuberculosis
GQDPKLAPAP

SEQ ID NO: 1399633 - protein, 4 aa, Mycobacterium tuberculosis
GQEG

SEQ ID NO: 1399634 - protein, 6 aa, Mycobacterium tuberculosis
GQERPF

SEQ ID NO: 1399635 - protein, 4 aa, Mycobacterium tuberculosis
GQGA

SEQ ID NO: 1399636 - protein, 5 aa, Mycobacterium tuberculosis
GQGCR

SEQ ID NO: 1399637 - protein, 5 aa, Mycobacterium tuberculosis
GQGGV

SEQ ID NO: 1399638 - protein, 10 aa, Mycobacterium tuberculosis
GQGNCDSAPS

SEQ ID NO: 1399639 - protein, 9 aa, Mycobacterium tuberculosis
GQGSSRPPR

SEQ ID NO: 1399640 - protein, 10 aa, Mycobacterium tuberculosis
GQHESSDDES

SEQ ID NO: 1399641 - protein, 4 aa, Mycobacterium tuberculosis
GQHL

SEQ ID NO: 1399642 - protein, 10 aa, Mycobacterium tuberculosis
GQKPEVRRAR

SEQ ID NO: 1399643 - protein, 11 aa, Mycobacterium tuberculosis
GQLAGAGYGSP

SEQ ID NO: 1399644 - protein, 18 aa, Mycobacterium tuberculosis
GQLPSASADVAAASAGTH

SEQ ID NO: 1399645 - protein, 4 aa, Mycobacterium tuberculosis
GQPA

SEQ ID NO: 1399646 - protein, 12 aa, Mycobacterium tuberculosis
GQPRRAARKAGY

SEQ ID NO: 1399647 - protein, 7 aa, Mycobacterium tuberculosis
GQPTDQE

SEQ ID NO: 1399648 - protein, 4 aa, Mycobacterium tuberculosis
GQPV

SEQ ID NO: 1399649 - protein, 5 aa, Mycobacterium tuberculosis
GQPVR

SEQ ID NO: 1399650 - protein, 5 aa, Mycobacterium tuberculosis
GQQDS

SEQ ID NO: 1399651 - protein, 10 aa, Mycobacterium tuberculosis
GQQGDGSARL

SEQ ID NO: 1399652 - protein, 7 aa, Mycobacterium tuberculosis
GQQPDKL

SEQ ID NO: 1399653 - protein, 4 aa, Mycobacterium tuberculosis
GQRS

SEQ ID NO: 1399654 - protein, 9 aa, Mycobacterium tuberculosis
GQRTPRKNE

SEQ ID NO: 1399655 - protein, 9 aa, Mycobacterium tuberculosis
GQSAAAARD

SEQ ID NO: 1399656 - protein, 5 aa, Mycobacterium tuberculosis
GQSEA

SEQ ID NO: 1399657 - protein, 7 aa, Mycobacterium tuberculosis
GQSERGL

SEQ ID NO: 1399658 - protein, 11 aa, Mycobacterium tuberculosis
GQSQPSPGGPF

SEQ ID NO: 1399659 - protein, 9 aa, Mycobacterium tuberculosis
GQTGKTVSP

SEQ ID NO: 1399660 - protein, 4 aa, Mycobacterium tuberculosis
GQTH

SEQ ID NO: 1399661 - protein, 5 aa, Mycobacterium tuberculosis
GQTKY

SEQ ID NO: 1399662 - protein, 15 aa, Mycobacterium tuberculosis
GQTPLGVETDRDIAQ

SEQ ID NO: 1399663 - protein, 13 aa, Mycobacterium tuberculosis
GQVLPNDGNAVGE

SEQ ID NO: 1399664 - protein, 6 aa, Mycobacterium tuberculosis
GQVRNR

SEQ ID NO: 1399665 - protein, 5 aa, Mycobacterium tuberculosis
GQYPR

SEQ ID NO: 1399666 - protein, 6 aa, Mycobacterium tuberculosis
GRAAAA

SEQ ID NO: 1399667 - protein, 6 aa, Mycobacterium tuberculosis
GRAGQL

SEQ ID NO: 1399668 - protein, 7 aa, Mycobacterium tuberculosis
GRANSIG

SEQ ID NO: 1399669 - protein, 4 aa, Mycobacterium tuberculosis
GRAP

SEQ ID NO: 1399670 - protein, 8 aa, Mycobacterium tuberculosis
GRARTRAS

SEQ ID NO: 1399671 - protein, 5 aa, Mycobacterium tuberculosis
GRDED

SEQ ID NO: 1399672 - protein, 13 aa, Mycobacterium tuberculosis
GRDPAQTLRDGTA

SEQ ID NO: 1399673 - protein, 13 aa, Mycobacterium tuberculosis
GRDPYHPSQRQQR

SEQ ID NO: 1399674 - protein, 9 aa, Mycobacterium tuberculosis
GRDTAARAR

SEQ ID NO: 1399675 - protein, 5 aa, Mycobacterium tuberculosis
GREQT

SEQ ID NO: 1399676 - protein, 9 aa, Mycobacterium tuberculosis
GRETQPHIP

SEQ ID NO: 1399677 - protein, 22 aa, Mycobacterium tuberculosis
GRGAQEGRTAFSAPGGGTRVGE

SEQ ID NO: 1399678 - protein, 5 aa, Mycobacterium tuberculosis
GRGDG

SEQ ID NO: 1399679 - protein, 4 aa, Mycobacterium tuberculosis
GRGE

SEQ ID NO: 1399680 - protein, 5 aa, Mycobacterium tuberculosis
GRGFN

SEQ ID NO: 1399681 - protein, 4 aa, Mycobacterium tuberculosis
GRGG

SEQ ID NO: 1399682 - protein, 5 aa, Mycobacterium tuberculosis
GRGGE

SEQ ID NO: 1399683 - protein, 22 aa, Mycobacterium tuberculosis
GRGGRNAHGRITTRHKGGGHKR

SEQ ID NO: 1399684 - protein, 9 aa, Mycobacterium tuberculosis
GRGGRTATA

SEQ ID NO: 1399685 - protein, 5 aa, Mycobacterium tuberculosis
GRGLG

SEQ ID NO: 1399686 - protein, 12 aa, Mycobacterium tuberculosis
GRGPDGSLPPNN

SEQ ID NO: 1399687 - protein, 8 aa, Mycobacterium tuberculosis
GRGTETAD

SEQ ID NO: 1399688 - protein, 9 aa, Mycobacterium tuberculosis
GRGVGSAEN

SEQ ID NO: 1399689 - protein, 15 aa, Mycobacterium tuberculosis
GRHDPSGFADWSTLA

SEQ ID NO: 1399690 - protein, 6 aa, Mycobacterium tuberculosis
GRKGVS

SEQ ID NO: 1399691 - protein, 13 aa, Mycobacterium tuberculosis
GRKTGQPRRTAVG

SEQ ID NO: 1399692 - protein, 4 aa, Mycobacterium tuberculosis
GRLE

SEQ ID NO: 1399693 - protein, 11 aa, Mycobacterium tuberculosis
GRLNPERITES

SEQ ID NO: 1399694 - protein, 6 aa, Mycobacterium tuberculosis
GRLPGL

SEQ ID NO: 1399695 - protein, 6 aa, Mycobacterium tuberculosis
GRLPST

SEQ ID NO: 1399696 - protein, 7 aa, Mycobacterium tuberculosis
GRNATTV

SEQ ID NO: 1399697 - protein, 9 aa, Mycobacterium tuberculosis
GRNDSDAEV

SEQ ID NO: 1399698 - protein, 8 aa, Mycobacterium tuberculosis
GRNGESPV

SEQ ID NO: 1399699 - protein, 8 aa, Mycobacterium tuberculosis
GRNPTGVA

SEQ ID NO: 1399700 - protein, 10 aa, Mycobacterium tuberculosis
GRNRDDVEEA

SEQ ID NO: 1399701 - protein, 7 aa, Mycobacterium tuberculosis
GRPAETA

SEQ ID NO: 1399702 - protein, 6 aa, Mycobacterium tuberculosis
GRPARK

SEQ ID NO: 1399703 - protein, 7 aa, Mycobacterium tuberculosis
GRPDRTL

SEQ ID NO: 1399704 - protein, 7 aa, Mycobacterium tuberculosis
GRPEELR

SEQ ID NO: 1399705 - protein, 7 aa, Mycobacterium tuberculosis
GRPEETR

SEQ ID NO: 1399706 - protein, 6 aa, Mycobacterium tuberculosis
GRPETY

SEQ ID NO: 1399707 - protein, 5 aa, Mycobacterium tuberculosis
GRPGP

SEQ ID NO: 1399708 - protein, 11 aa, Mycobacterium tuberculosis
GRPKDGPDPTL

SEQ ID NO: 1399709 - protein, 8 aa, Mycobacterium tuberculosis
GRPNPTGP

SEQ ID NO: 1399710 - protein, 10 aa, Mycobacterium tuberculosis
GRPPADAPTR

SEQ ID NO: 1399711 - protein, 5 aa, Mycobacterium tuberculosis
GRPPC

SEQ ID NO: 1399712 - protein, 10 aa, Mycobacterium tuberculosis
GRPPGRKDPA

SEQ ID NO: 1399713 - protein, 5 aa, Mycobacterium tuberculosis
GRPPR

SEQ ID NO: 1399714 - protein, 5 aa, Mycobacterium tuberculosis
GRPQR

SEQ ID NO: 1399715 - protein, 7 aa, Mycobacterium tuberculosis
GRPSTYS

SEQ ID NO: 1399716 - protein, 10 aa, Mycobacterium tuberculosis
GRQETDPELT

SEQ ID NO: 1399717 - protein, 6 aa, Mycobacterium tuberculosis
GRRAAQ

SEQ ID NO: 1399718 - protein, 7 aa, Mycobacterium tuberculosis
GRRGASV

SEQ ID NO: 1399719 - protein, 8 aa, Mycobacterium tuberculosis
GRRGTTTD

SEQ ID NO: 1399720 - protein, 6 aa, Mycobacterium tuberculosis
GRRQPA

SEQ ID NO: 1399721 - protein, 16 aa, Mycobacterium tuberculosis
GRSATLTAESGDAEPI

SEQ ID NO: 1399722 - protein, 6 aa, Mycobacterium tuberculosis
GRSDRL

SEQ ID NO: 1399723 - protein, 5 aa, Mycobacterium tuberculosis
GRSIR

SEQ ID NO: 1399724 - protein, 6 aa, Mycobacterium tuberculosis
GRSPDI

SEQ ID NO: 1399725 - protein, 10 aa, Mycobacterium tuberculosis
GRSRAPGQTP

SEQ ID NO: 1399726 - protein, 6 aa, Mycobacterium tuberculosis
GRSVGD

SEQ ID NO: 1399727 - protein, 6 aa, Mycobacterium tuberculosis
GRTGRP

SEQ ID NO: 1399728 - protein, 6 aa, Mycobacterium tuberculosis
GRTPEQ

SEQ ID NO: 1399729 - protein, 7 aa, Mycobacterium tuberculosis
GRTTTRT

SEQ ID NO: 1399730 - protein, 6 aa, Mycobacterium tuberculosis
GRTVEG

SEQ ID NO: 1399731 - protein, 6 aa, Mycobacterium tuberculosis
GRYQSG

SEQ ID NO: 1399732 - protein, 7 aa, Mycobacterium tuberculosis
GSAASRF

SEQ ID NO: 1399733 - protein, 12 aa, Mycobacterium tuberculosis
GSADAGGTRPWQ

SEQ ID NO: 1399734 - protein, 12 aa, Mycobacterium tuberculosis
GSAEQVRDLAAL

SEQ ID NO: 1399735 - protein, 7 aa, Mycobacterium tuberculosis
GSAPDAM

SEQ ID NO: 1399736 - protein, 10 aa, Mycobacterium tuberculosis
GSAPQDVPGM

SEQ ID NO: 1399737 - protein, 12 aa, Mycobacterium tuberculosis
GSATGVVPTPDE

SEQ ID NO: 1399738 - protein, 6 aa, Mycobacterium tuberculosis
GSATRD

SEQ ID NO: 1399739 - protein, 7 aa, Mycobacterium tuberculosis
GSAVPTP

SEQ ID NO: 1399740 - protein, 5 aa, Mycobacterium tuberculosis
GSDAY

SEQ ID NO: 1399741 - protein, 20 aa, Mycobacterium tuberculosis
GSDGADTIGTVGRQGTPARV

SEQ ID NO: 1399742 - protein, 7 aa, Mycobacterium tuberculosis
GSDNGLT

SEQ ID NO: 1399743 - protein, 7 aa, Mycobacterium tuberculosis
GSDPEFR

SEQ ID NO: 1399744 - protein, 7 aa, Mycobacterium tuberculosis
GSDPVAD

SEQ ID NO: 1399745 - protein, 8 aa, Mycobacterium tuberculosis
GSDRPAWA

SEQ ID NO: 1399746 - protein, 6 aa, Mycobacterium tuberculosis
GSDRPR

SEQ ID NO: 1399747 - protein, 8 aa, Mycobacterium tuberculosis
GSDSCDRT

SEQ ID NO: 1399748 - protein, 22 aa, Mycobacterium tuberculosis
GSFNSGAFNSGSFNGGDANSGF

SEQ ID NO: 1399749 - protein, 9 aa, Mycobacterium tuberculosis
GSGATRPAL

SEQ ID NO: 1399750 - protein, 4 aa, Mycobacterium tuberculosis
GSGE

SEQ ID NO: 1399751 - protein, 7 aa, Mycobacterium tuberculosis
GSGGLSQ

SEQ ID NO: 1399752 - protein, 9 aa, Mycobacterium tuberculosis
GSGNGEQIA

SEQ ID NO: 1399753 - protein, 6 aa, Mycobacterium tuberculosis
GSGNSI

SEQ ID NO: 1399754 - protein, 9 aa, Mycobacterium tuberculosis
GSGPAGLAA

SEQ ID NO: 1399755 - protein, 7 aa, Mycobacterium tuberculosis
GSGPRFD

SEQ ID NO: 1399756 - protein, 7 aa, Mycobacterium tuberculosis
GSGRTLS

SEQ ID NO: 1399757 - protein, 9 aa, Mycobacterium tuberculosis
GSGSESANR

SEQ ID NO: 1399758 - protein, 5 aa, Mycobacterium tuberculosis
GSGTA

SEQ ID NO: 1399759 - protein, 8 aa, Mycobacterium tuberculosis
GSGTSEKT

SEQ ID NO: 1399760 - protein, 14 aa, Mycobacterium tuberculosis
GSGTSGLPAGGWTR

SEQ ID NO: 1399761 - protein, 5 aa, Mycobacterium tuberculosis
GSGTV

SEQ ID NO: 1399762 - protein, 6 aa, Mycobacterium tuberculosis
GSHDER

SEQ ID NO: 1399763 - protein, 7 aa, Mycobacterium tuberculosis
GSHPAQL

SEQ ID NO: 1399764 - protein, 4 aa, Mycobacterium tuberculosis
GSID

SEQ ID NO: 1399765 - protein, 9 aa, Mycobacterium tuberculosis
GSIDDAEAA

SEQ ID NO: 1399766 - protein, 6 aa, Mycobacterium tuberculosis
GSIKPI

SEQ ID NO: 1399767 - protein, 7 aa, Mycobacterium tuberculosis
GSKPAVQ

SEQ ID NO: 1399768 - protein, 9 aa, Mycobacterium tuberculosis
GSKYGGYGR

SEQ ID NO: 1399769 - protein, 6 aa, Mycobacterium tuberculosis
GSLGQV

SEQ ID NO: 1399770 - protein, 7 aa, Mycobacterium tuberculosis
GSLTAPA

SEQ ID NO: 1399771 - protein, 6 aa, Mycobacterium tuberculosis
GSLTTQ

SEQ ID NO: 1399772 - protein, 6 aa, Mycobacterium tuberculosis
GSMGGA

SEQ ID NO: 1399773 - protein, 13 aa, Mycobacterium tuberculosis
GSMSSNSNGEGDI

SEQ ID NO: 1399774 - protein, 7 aa, Mycobacterium tuberculosis
GSNERQV

SEQ ID NO: 1399775 - protein, 6 aa, Mycobacterium tuberculosis
GSNPNV

SEQ ID NO: 1399776 - protein, 17 aa, Mycobacterium tuberculosis
GSNTGTPHQGSADRGAE

SEQ ID NO: 1399777 - protein, 8 aa, Mycobacterium tuberculosis
GSNTSTLP

SEQ ID NO: 1399778 - protein, 15 aa, Mycobacterium tuberculosis
GSPAEPLTAGTPDDM

SEQ ID NO: 1399779 - protein, 14 aa, Mycobacterium tuberculosis
GSPGFDATSPAKLG

SEQ ID NO: 1399780 - protein, 8 aa, Mycobacterium tuberculosis
GSPGTELT

SEQ ID NO: 1399781 - protein, 5 aa, Mycobacterium tuberculosis
GSPNI

SEQ ID NO: 1399782 - protein, 7 aa, Mycobacterium tuberculosis
GSPNPDD

SEQ ID NO: 1399783 - protein, 8 aa, Mycobacterium tuberculosis
GSPPDREQ

SEQ ID NO: 1399784 - protein, 7 aa, Mycobacterium tuberculosis
GSPPTKA

SEQ ID NO: 1399785 - protein, 12 aa, Mycobacterium tuberculosis
GSPSQARKHADA

SEQ ID NO: 1399786 - protein, 20 aa, Mycobacterium tuberculosis
GSPVGRTRDAAPGAPSDRPV

SEQ ID NO: 1399787 - protein, 6 aa, Mycobacterium tuberculosis
GSPVSE

SEQ ID NO: 1399788 - protein, 7 aa, Mycobacterium tuberculosis
GSPYEPG

SEQ ID NO: 1399789 - protein, 6 aa, Mycobacterium tuberculosis
GSQGHA

SEQ ID NO: 1399790 - protein, 6 aa, Mycobacterium tuberculosis
GSQGVH

SEQ ID NO: 1399791 - protein, 7 aa, Mycobacterium tuberculosis
GSRLTGR

SEQ ID NO: 1399792 - protein, 8 aa, Mycobacterium tuberculosis
GSRPGGPI

SEQ ID NO: 1399793 - protein, 5 aa, Mycobacterium tuberculosis
GSRRK

SEQ ID NO: 1399794 - protein, 7 aa, Mycobacterium tuberculosis
GSRRNGF

SEQ ID NO: 1399795 - protein, 5 aa, Mycobacterium tuberculosis
GSRRR

SEQ ID NO: 1399796 - protein, 10 aa, Mycobacterium tuberculosis
GSSDPGSLGY

SEQ ID NO: 1399797 - protein, 6 aa, Mycobacterium tuberculosis
GSSPEA

SEQ ID NO: 1399798 - protein, 16 aa, Mycobacterium tuberculosis
GSSPQDTSAVAAGEAE

SEQ ID NO: 1399799 - protein, 11 aa, Mycobacterium tuberculosis
GSSRSLADGTA

SEQ ID NO: 1399800 - protein, 8 aa, Mycobacterium tuberculosis
GSTATELA

SEQ ID NO: 1399801 - protein, 8 aa, Mycobacterium tuberculosis
GSTATGRA

SEQ ID NO: 1399802 - protein, 18 aa, Mycobacterium tuberculosis
GSTDQSGTPEQSTPDEVN

SEQ ID NO: 1399803 - protein, 7 aa, Mycobacterium tuberculosis
GSTPATE

SEQ ID NO: 1399804 - protein, 5 aa, Mycobacterium tuberculosis
GSTPC

SEQ ID NO: 1399805 - protein, 9 aa, Mycobacterium tuberculosis
GSVGGSTGV

SEQ ID NO: 1399806 - protein, 8 aa, Mycobacterium tuberculosis
GSVPATPT

SEQ ID NO: 1399807 - protein, 8 aa, Mycobacterium tuberculosis
GSVPRGLG

SEQ ID NO: 1399808 - protein, 9 aa, Mycobacterium tuberculosis
GSWGPEAAQ

SEQ ID NO: 1399809 - protein, 6 aa, Mycobacterium tuberculosis
GSWGTT

SEQ ID NO: 1399810 - protein, 6 aa, Mycobacterium tuberculosis
GSYGHG

SEQ ID NO: 1399811 - protein, 7 aa, Mycobacterium tuberculosis
GTAEAPG

SEQ ID NO: 1399812 - protein, 5 aa, Mycobacterium tuberculosis
GTAEP

SEQ ID NO: 1399813 - protein, 6 aa, Mycobacterium tuberculosis
GTAGDQ

SEQ ID NO: 1399814 - protein, 10 aa, Mycobacterium tuberculosis
GTAGPSAIHT

SEQ ID NO: 1399815 - protein, 27 aa, Mycobacterium tuberculosis
GTAGSKAHFSGDDSKRPLDKRGRAQAE

SEQ ID NO: 1399816 - protein, 7 aa, Mycobacterium tuberculosis
GTAGYNA

SEQ ID NO: 1399817 - protein, 9 aa, Mycobacterium tuberculosis
GTALGADGK

SEQ ID NO: 1399818 - protein, 7 aa, Mycobacterium tuberculosis
GTAPAGR

SEQ ID NO: 1399819 - protein, 9 aa, Mycobacterium tuberculosis
GTAQGPAGQ

SEQ ID NO: 1399820 - protein, 10 aa, Mycobacterium tuberculosis
GTAQHARRHA

SEQ ID NO: 1399821 - protein, 11 aa, Mycobacterium tuberculosis
GTASTAALGRR

SEQ ID NO: 1399822 - protein, 6 aa, Mycobacterium tuberculosis
GTATFG

SEQ ID NO: 1399823 - protein, 6 aa, Mycobacterium tuberculosis
GTDAAY

SEQ ID NO: 1399824 - protein, 5 aa, Mycobacterium tuberculosis
GTDGG

SEQ ID NO: 1399825 - protein, 6 aa, Mycobacterium tuberculosis
GTDGRQ

SEQ ID NO: 1399826 - protein, 6 aa, Mycobacterium tuberculosis
GTDGRV

SEQ ID NO: 1399827 - protein, 7 aa, Mycobacterium tuberculosis
GTDPVAG

SEQ ID NO: 1399828 - protein, 6 aa, Mycobacterium tuberculosis
GTDSHT

SEQ ID NO: 1399829 - protein, 10 aa, Mycobacterium tuberculosis
GTDTSRGTVG

SEQ ID NO: 1399830 - protein, 8 aa, Mycobacterium tuberculosis
GTEAATAT

SEQ ID NO: 1399831 - protein, 16 aa, Mycobacterium tuberculosis
GTEADYQAAVHNFGAS

SEQ ID NO: 1399832 - protein, 10 aa, Mycobacterium tuberculosis
GTEAGGHTGE

SEQ ID NO: 1399833 - protein, 12 aa, Mycobacterium tuberculosis
GTEGPYTGNGGA

SEQ ID NO: 1399834 - protein, 8 aa, Mycobacterium tuberculosis
GTEHRPSS

SEQ ID NO: 1399835 - protein, 5 aa, Mycobacterium tuberculosis
GTELP

SEQ ID NO: 1399836 - protein, 9 aa, Mycobacterium tuberculosis
GTETEDPVK

SEQ ID NO: 1399837 - protein, 8 aa, Mycobacterium tuberculosis
GTGAGKTT

SEQ ID NO: 1399838 - protein, 10 aa, Mycobacterium tuberculosis
GTGDRSTRPG

SEQ ID NO: 1399839 - protein, 7 aa, Mycobacterium tuberculosis
GTGGTIT

SEQ ID NO: 1399840 - protein, 10 aa, Mycobacterium tuberculosis
GTGGTITGAG

SEQ ID NO: 1399841 - protein, 9 aa, Mycobacterium tuberculosis
GTGPAGGVG

SEQ ID NO: 1399842 - protein, 9 aa, Mycobacterium tuberculosis
GTGPGVGKD

SEQ ID NO: 1399843 - protein, 5 aa, Mycobacterium tuberculosis
GTGQV

SEQ ID NO: 1399844 - protein, 15 aa, Mycobacterium tuberculosis
GTGVTPRDVTPEATR

SEQ ID NO: 1399845 - protein, 5 aa, Mycobacterium tuberculosis
GTHPG

SEQ ID NO: 1399846 - protein, 4 aa, Mycobacterium tuberculosis
GTID

SEQ ID NO: 1399847 - protein, 9 aa, Mycobacterium tuberculosis
GTIDTATEA

SEQ ID NO: 1399848 - protein, 4 aa, Mycobacterium tuberculosis
GTIR

SEQ ID NO: 1399849 - protein, 8 aa, Mycobacterium tuberculosis
GTITGEHG

SEQ ID NO: 1399850 - protein, 15 aa, Mycobacterium tuberculosis
GTKDDIKEARDNGGS

SEQ ID NO: 1399851 - protein, 8 aa, Mycobacterium tuberculosis
GTKDGPAL

SEQ ID NO: 1399852 - protein, 8 aa, Mycobacterium tuberculosis
GTKGKRYA

SEQ ID NO: 1399853 - protein, 5 aa, Mycobacterium tuberculosis
GTMKS

SEQ ID NO: 1399854 - protein, 8 aa, Mycobacterium tuberculosis
GTNGKTSV

SEQ ID NO: 1399855 - protein, 14 aa, Mycobacterium tuberculosis
GTPAGVGPIEDGDT

SEQ ID NO: 1399856 - protein, 14 aa, Mycobacterium tuberculosis
GTPAVEDDGEPIDE

SEQ ID NO: 1399857 - protein, 5 aa, Mycobacterium tuberculosis
GTPAW

SEQ ID NO: 1399858 - protein, 7 aa, Mycobacterium tuberculosis
GTPDDGD

SEQ ID NO: 1399859 - protein, 6 aa, Mycobacterium tuberculosis
GTPDEV

SEQ ID NO: 1399860 - protein, 9 aa, Mycobacterium tuberculosis
GTPDTPDRH

SEQ ID NO: 1399861 - protein, 5 aa, Mycobacterium tuberculosis
GTPDW

SEQ ID NO: 1399862 - protein, 5 aa, Mycobacterium tuberculosis
GTPEQ

SEQ ID NO: 1399863 - protein, 6 aa, Mycobacterium tuberculosis
GTPEQL

SEQ ID NO: 1399864 - protein, 8 aa, Mycobacterium tuberculosis
GTPFPTTA

SEQ ID NO: 1399865 - protein, 11 aa, Mycobacterium tuberculosis
GTPFRSDDSPI

SEQ ID NO: 1399866 - protein, 16 aa, Mycobacterium tuberculosis
GTPGEEQKASLPSSDE

SEQ ID NO: 1399867 - protein, 10 aa, Mycobacterium tuberculosis
GTPGESDDDL

SEQ ID NO: 1399868 - protein, 5 aa, Mycobacterium tuberculosis
GTPIN

SEQ ID NO: 1399869 - protein, 6 aa, Mycobacterium tuberculosis
GTPRAG

SEQ ID NO: 1399870 - protein, 5 aa, Mycobacterium tuberculosis
GTPVD

SEQ ID NO: 1399871 - protein, 11 aa, Mycobacterium tuberculosis
GTPVPPEPTEI

SEQ ID NO: 1399872 - protein, 6 aa, Mycobacterium tuberculosis
GTQQGI

SEQ ID NO: 1399873 - protein, 9 aa, Mycobacterium tuberculosis
GTQRRAEAR

SEQ ID NO: 1399874 - protein, 10 aa, Mycobacterium tuberculosis
GTRDQMARAE

SEQ ID NO: 1399875 - protein, 12 aa, Mycobacterium tuberculosis
GTREFSTPGRDD

SEQ ID NO: 1399876 - protein, 5 aa, Mycobacterium tuberculosis
GTREI

SEQ ID NO: 1399877 - protein, 19 aa, Mycobacterium tuberculosis
GTRIPTGATIEASTPDGAP

SEQ ID NO: 1399878 - protein, 8 aa, Mycobacterium tuberculosis
GTSAGGSL

SEQ ID NO: 1399879 - protein, 10 aa, Mycobacterium tuberculosis
GTSANQDGHT

SEQ ID NO: 1399880 - protein, 12 aa, Mycobacterium tuberculosis
GTSGKDLTVEQA

SEQ ID NO: 1399881 - protein, 9 aa, Mycobacterium tuberculosis
GTSGNPKAV

SEQ ID NO: 1399882 - protein, 6 aa, Mycobacterium tuberculosis
GTSVGG

SEQ ID NO: 1399883 - protein, 5 aa, Mycobacterium tuberculosis
GTTAI

SEQ ID NO: 1399884 - protein, 9 aa, Mycobacterium tuberculosis
GTTARGTPL

SEQ ID NO: 1399885 - protein, 12 aa, Mycobacterium tuberculosis
GTTASTEEITDT

SEQ ID NO: 1399886 - protein, 7 aa, Mycobacterium tuberculosis
GTTEQRD

SEQ ID NO: 1399887 - protein, 14 aa, Mycobacterium tuberculosis
GTTGESPTTTDGEK

SEQ ID NO: 1399888 - protein, 6 aa, Mycobacterium tuberculosis
GTTGFP

SEQ ID NO: 1399889 - protein, 9 aa, Mycobacterium tuberculosis
GTTGRPKGA

SEQ ID NO: 1399890 - protein, 15 aa, Mycobacterium tuberculosis
GTTGSGDDIAAQTRD

SEQ ID NO: 1399891 - protein, 6 aa, Mycobacterium tuberculosis
GTTGTL

SEQ ID NO: 1399892 - protein, 7 aa, Mycobacterium tuberculosis
GTTLGEA

SEQ ID NO: 1399893 - protein, 5 aa, Mycobacterium tuberculosis
GTTPA

SEQ ID NO: 1399894 - protein, 15 aa, Mycobacterium tuberculosis
GTTRRDDGAIVSSGG

SEQ ID NO: 1399895 - protein, 4 aa, Mycobacterium tuberculosis
GTVD

SEQ ID NO: 1399896 - protein, 5 aa, Mycobacterium tuberculosis
GTVGR

SEQ ID NO: 1399897 - protein, 8 aa, Mycobacterium tuberculosis
GTVRAGDT

SEQ ID NO: 1399898 - protein, 11 aa, Mycobacterium tuberculosis
GTVSEHNATRT

SEQ ID NO: 1399899 - protein, 9 aa, Mycobacterium tuberculosis
GTVTATTSV

SEQ ID NO: 1399900 - protein, 7 aa, Mycobacterium tuberculosis
GTWKGQR

SEQ ID NO: 1399901 - protein, 7 aa, Mycobacterium tuberculosis
GTYDTEK

SEQ ID NO: 1399902 - protein, 7 aa, Mycobacterium tuberculosis
GTYRPTV

SEQ ID NO: 1399903 - protein, 4 aa, Mycobacterium tuberculosis
GTYT

SEQ ID NO: 1399904 - protein, 6 aa, Mycobacterium tuberculosis
GVAGGT

SEQ ID NO: 1399905 - protein, 30 aa, Mycobacterium tuberculosis; identical to SEQ ID NO: 177632

SEQ ID NO: 1399906 - protein, 14 aa, Mycobacterium tuberculosis
GVARSGVSAYPPEV

SEQ ID NO: 1399907 - protein, 5 aa, Mycobacterium tuberculosis
GVDSP

SEQ ID NO: 1399908 - protein, 5 aa, Mycobacterium tuberculosis
GVESR

SEQ ID NO: 1399909 - protein, 6 aa, Mycobacterium tuberculosis
GVGAGD

SEQ ID NO: 1399910 - protein, 4 aa, Mycobacterium tuberculosis
GVGD

SEQ ID NO: 1399911 - protein, 13 aa, Mycobacterium tuberculosis
GVGETRSCGTGTV

SEQ ID NO: 1399912 - protein, 6 aa, Mycobacterium tuberculosis
GVGKST

SEQ ID NO: 1399913 - protein, 12 aa, Mycobacterium tuberculosis
GVGPATARAVAH

SEQ ID NO: 1399914 - protein, 5 aa, Mycobacterium tuberculosis
GVGPG

SEQ ID NO: 1399915 - protein, 6 aa, Mycobacterium tuberculosis
GVGPGS

SEQ ID NO: 1399916 - protein, 16 aa, Mycobacterium tuberculosis
GVGPPPYARSGPASAT

SEQ ID NO: 1399917 - protein, 13 aa, Mycobacterium tuberculosis
GVHPDKSRNRKGS

SEQ ID NO: 1399918 - protein, 19 aa, Mycobacterium tuberculosis
GVHSESEGVEPERRVVVLR

SEQ ID NO: 1399919 - protein, 6 aa, Mycobacterium tuberculosis
GVKPPW

SEQ ID NO: 1399920 - protein, 5 aa, Mycobacterium tuberculosis
GVKRQ

SEQ ID NO: 1399921 - protein, 8 aa, Mycobacterium tuberculosis
GVNGPNPR

SEQ ID NO: 1399922 - protein, 6 aa, Mycobacterium tuberculosis
GVPADE

SEQ ID NO: 1399923 - protein, 6 aa, Mycobacterium tuberculosis
GVPDGP

SEQ ID NO: 1399924 - protein, 9 aa, Mycobacterium tuberculosis
GVQAGTATG

SEQ ID NO: 1399925 - protein, 10 aa, Mycobacterium tuberculosis
GVQGDGRTYG

SEQ ID NO: 1399926 - protein, 8 aa, Mycobacterium tuberculosis
GVQTRAPR

SEQ ID NO: 1399927 - protein, 5 aa, Mycobacterium tuberculosis
GVRQG

SEQ ID NO: 1399928 - protein, 21 aa, Mycobacterium tuberculosis
GVSQDTKDVTTLGRGGSDTTA

SEQ ID NO: 1399929 - protein, 11 aa, Mycobacterium tuberculosis
GVTGPDGPSHH

SEQ ID NO: 1399930 - protein, 6 aa, Mycobacterium tuberculosis
GVTGQG

SEQ ID NO: 1399931 - protein, 6 aa, Mycobacterium tuberculosis
GWQPMP

SEQ ID NO: 1399932 - protein, 13 aa, Mycobacterium tuberculosis
GWTTRKNAHGDTE

SEQ ID NO: 1399933 - protein, 9 aa, Mycobacterium tuberculosis
GYAATGIDG

SEQ ID NO: 1399934 - protein, 11 aa, Mycobacterium tuberculosis
GYEDKAPYAFT

SEQ ID NO: 1399935 - protein, 14 aa, Mycobacterium tuberculosis
GYEPRRPAGPGDDE

SEQ ID NO: 1399936 - protein, 9 aa, Mycobacterium tuberculosis
GYESPTAIQ

SEQ ID NO: 1399937 - protein, 6 aa, Mycobacterium tuberculosis
GYGNRD

SEQ ID NO: 1399938 - protein, 4 aa, Mycobacterium tuberculosis
GYGQ

SEQ ID NO: 1399939 - protein, 7 aa, Mycobacterium tuberculosis
GYGSAGE

SEQ ID NO: 1399940 - protein, 11 aa, Mycobacterium tuberculosis
GYGSNPNLPGQ

SEQ ID NO: 1399941 - protein, 14 aa, Mycobacterium tuberculosis
GYKPNTKPHSRQVR

SEQ ID NO: 1399942 - protein, 6 aa, Mycobacterium tuberculosis
GYPGGL

SEQ ID NO: 1399943 - protein, 5 aa, Mycobacterium tuberculosis
GYQDL

SEQ ID NO: 1399944 - protein, 5 aa, Mycobacterium tuberculosis
GYRDT

SEQ ID NO: 1399945 - protein, 7 aa, Mycobacterium tuberculosis
GYRPETP

SEQ ID NO: 1399946 - protein, 10 aa, Mycobacterium tuberculosis
GYRRRTDSKD

SEQ ID NO: 1399947 - protein, 19 aa, Mycobacterium tuberculosis
GYSGETRWDPSKPDGTPRK

SEQ ID NO: 1399948 - protein, 10 aa, Mycobacterium tuberculosis
GYSGQALSDE

SEQ ID NO: 1399949 - protein, 11 aa, Mycobacterium tuberculosis
GYTDNTGSEGI

SEQ ID NO: 1399950 - protein, 7 aa, Mycobacterium tuberculosis
GYTGSPT

SEQ ID NO: 1399951 - protein, 5 aa, Mycobacterium tuberculosis
GYTYG

SEQ ID NO: 1399952 - protein, 4 aa, Mycobacterium tuberculosis
HAAG

SEQ ID NO: 1399953 - protein, 7 aa, Mycobacterium tuberculosis
HADESKL

SEQ ID NO: 1399954 - protein, 5 aa, Mycobacterium tuberculosis
HADTR

SEQ ID NO: 1399955 - protein, 8 aa, Mycobacterium tuberculosis
HAEPDEEK

SEQ ID NO: 1399956 - protein, 7 aa, Mycobacterium tuberculosis
HAGARGV

SEQ ID NO: 1399957 - protein, 12 aa, Mycobacterium tuberculosis
HAGDEISTYPTR

SEQ ID NO: 1399958 - protein, 5 aa, Mycobacterium tuberculosis
HAGGE

SEQ ID NO: 1399959 - protein, 4 aa, Mycobacterium tuberculosis
HAGK

SEQ ID NO: 1399960 - protein, 11 aa, Mycobacterium tuberculosis
HAGPRKSALDE

SEQ ID NO: 1399961 - protein, 15 aa, Mycobacterium tuberculosis
HAGPVADARSNQATA

SEQ ID NO: 1399962 - protein, 5 aa, Mycobacterium tuberculosis
HAKGE

SEQ ID NO: 1399963 - protein, 14 aa, Mycobacterium tuberculosis
HALSSPGRRSNSVP

SEQ ID NO: 1399964 - protein, 8 aa, Mycobacterium tuberculosis
HANDEGRQ

SEQ ID NO: 1399965 - protein, 6 aa, Mycobacterium tuberculosis
HAPGDD

SEQ ID NO: 1399966 - protein, 5 aa, Mycobacterium tuberculosis
HAPGE

SEQ ID NO: 1399967 - protein, 6 aa, Mycobacterium tuberculosis
HAPHAE

SEQ ID NO: 1399968 - protein, 10 aa, Mycobacterium tuberculosis
HARGEDTQRD

SEQ ID NO: 1399969 - protein, 4 aa, Mycobacterium tuberculosis
HAST

SEQ ID NO: 1399970 - protein, 5 aa, Mycobacterium tuberculosis
HATEY

SEQ ID NO: 1399971 - protein, 8 aa, Mycobacterium tuberculosis
HAYGGGSQ

SEQ ID NO: 1399972 - protein, 8 aa, Mycobacterium tuberculosis
HDADEEET

SEQ ID NO: 1399973 - protein, 8 aa, Mycobacterium tuberculosis
HDAGPENI

SEQ ID NO: 1399974 - protein, 6 aa, Mycobacterium tuberculosis
HDASTI

SEQ ID NO: 1399975 - protein, 19 aa, Mycobacterium tuberculosis
HDATTSSALRSALSLLGKA

SEQ ID NO: 1399976 - protein, 4 aa, Mycobacterium tuberculosis
HDDG

SEQ ID NO: 1399977 - protein, 7 aa, Mycobacterium tuberculosis
HDDPHTG

SEQ ID NO: 1399978 - protein, 8 aa, Mycobacterium tuberculosis
HDDSSSIT

SEQ ID NO: 1399979 - protein, 5 aa, Mycobacterium tuberculosis
HDEPG

SEQ ID NO: 1399980 - protein, 8 aa, Mycobacterium tuberculosis
HDETTSDG

SEQ ID NO: 1399981 - protein, 5 aa, Mycobacterium tuberculosis
HDGEA

SEQ ID NO: 1399982 - protein, 4 aa, Mycobacterium tuberculosis
HDGG

SEQ ID NO: 1399983 - protein, 11 aa, Mycobacterium tuberculosis
HDGGTGATPLT

SEQ ID NO: 1399984 - protein, 6 aa, Mycobacterium tuberculosis
HDGQEA

SEQ ID NO: 1399985 - protein, 7 aa, Mycobacterium tuberculosis
HDGRPHR

SEQ ID NO: 1399986 - protein, 13 aa, Mycobacterium tuberculosis
HDHNDSPEQHRTC

SEQ ID NO: 1399987 - protein, 10 aa, Mycobacterium tuberculosis
HDLGASAGAP

SEQ ID NO: 1399988 - protein, 22 aa, Mycobacterium tuberculosis
HDLGSADDIRERSPGPDQHPSY

SEQ ID NO: 1399989 - protein, 8 aa, Mycobacterium tuberculosis
HDLPPTAG

SEQ ID NO: 1399990 - protein, 5 aa, Mycobacterium tuberculosis
HDPQA

SEQ ID NO: 1399991 - protein, 9 aa, Mycobacterium tuberculosis
HDQPGGAPG

SEQ ID NO: 1399992 - protein, 5 aa, Mycobacterium tuberculosis
HDQYN

SEQ ID NO: 1399993 - protein, 4 aa, Mycobacterium tuberculosis
HDRT

SEQ ID NO: 1399994 - protein, 4 aa, Mycobacterium tuberculosis
HDTE

SEQ ID NO: 1399995 - protein, 8 aa, Mycobacterium tuberculosis
HDTPGGQL

SEQ ID NO: 1399996 - protein, 11 aa, Mycobacterium tuberculosis
HDVGRGRGGVS

SEQ ID NO: 1399997 - protein, 10 aa, Mycobacterium tuberculosis
HEANDWPSPP

SEQ ID NO: 1399998 - protein, 22 aa, Mycobacterium tuberculosis
HEANRQAHHSDATTPAPPRRKP

SEQ ID NO: 1399999 - protein, 5 aa, Mycobacterium tuberculosis
HEDQK

SEQ ID NO: 1400000 - protein, 5 aa, Mycobacterium tuberculosis
HEGAG

SEQ ID NO: 1400001 - protein, 6 aa, Mycobacterium tuberculosis
HEGESD

SEQ ID NO: 1400002 - protein, 6 aa, Mycobacterium tuberculosis
HEGLTR

SEQ ID NO: 1400003 - protein, 12 aa, Mycobacterium tuberculosis
HEGQGPDHTSAR

SEQ ID NO: 1400004 - protein, 6 aa, Mycobacterium tuberculosis
HEGSGV

SEQ ID NO: 1400005 - protein, 10 aa, Mycobacterium tuberculosis
HENVTTGHQN

SEQ ID NO: 1400006 - protein, 5 aa, Mycobacterium tuberculosis
HEPSE

SEQ ID NO: 1400007 - protein, 4 aa, Mycobacterium tuberculosis
HESM

SEQ ID NO: 1400008 - protein, 9 aa, Mycobacterium tuberculosis
HESNDALAE

SEQ ID NO: 1400009 - protein, 8 aa, Mycobacterium tuberculosis
HFPNEQSA

SEQ ID NO: 1400010 - protein, 13 aa, Mycobacterium tuberculosis
HFSGTPDYSSSWP

SEQ ID NO: 1400011 - protein, 6 aa, Mycobacterium tuberculosis
HGAEPD

SEQ ID NO: 1400012 - protein, 7 aa, Mycobacterium tuberculosis
HGANAPT

SEQ ID NO: 1400013 - protein, 7 aa, Mycobacterium tuberculosis
HGDDRRT

SEQ ID NO: 1400014 - protein, 12 aa, Mycobacterium tuberculosis
HGDSDKPRDYPY

SEQ ID NO: 1400015 - protein, 7 aa, Mycobacterium tuberculosis
HGEGGSV

SEQ ID NO: 1400016 - protein, 12 aa, Mycobacterium tuberculosis
HGERADRLRSYA

SEQ ID NO: 1400017 - protein, 5 aa, Mycobacterium tuberculosis
HGGDD

SEQ ID NO: 1400018 - protein, 6 aa, Mycobacterium tuberculosis
HGGDGV

SEQ ID NO: 1400019 - protein, 16 aa, Mycobacterium tuberculosis
HGGGEPPPYLGASSAN

SEQ ID NO: 1400020 - protein, 8 aa, Mycobacterium tuberculosis
HGGPTELA

SEQ ID NO: 1400021 - protein, 6 aa, Mycobacterium tuberculosis
HGGQAT

SEQ ID NO: 1400022 - protein, 7 aa, Mycobacterium tuberculosis
HGGRQLD

SEQ ID NO: 1400023 - protein, 6 aa, Mycobacterium tuberculosis
HGMPGV

SEQ ID NO: 1400024 - protein, 10 aa, Mycobacterium tuberculosis
HGPGTPIGDP

SEQ ID NO: 1400025 - protein, 5 aa, Mycobacterium tuberculosis
HGPGW

SEQ ID NO: 1400026 - protein, 15 aa, Mycobacterium tuberculosis
HGPKPRDYSQRTPKK

SEQ ID NO: 1400027 - protein, 11 aa, Mycobacterium tuberculosis
HGPNSEPVEEE

SEQ ID NO: 1400028 - protein, 12 aa, Mycobacterium tuberculosis
HGQVDSADLATQ

SEQ ID NO: 1400029 - protein, 4 aa, Mycobacterium tuberculosis
HGRF

SEQ ID NO: 1400030 - protein, 7 aa, Mycobacterium tuberculosis
HGRGDSK

SEQ ID NO: 1400031 - protein, 6 aa, Mycobacterium tuberculosis
HGRGGL

SEQ ID NO: 1400032 - protein, 7 aa, Mycobacterium tuberculosis
HGRPDKK

SEQ ID NO: 1400033 - protein, 10 aa, Mycobacterium tuberculosis
HGTGTPIGDP

SEQ ID NO: 1400034 - protein, 4 aa, Mycobacterium tuberculosis
HGTR

SEQ ID NO: 1400035 - protein, 13 aa, Mycobacterium tuberculosis
HGVPDSVARSGGL

SEQ ID NO: 1400036 - protein, 4 aa, Mycobacterium tuberculosis
HGVT

SEQ ID NO: 1400037 - protein, 6 aa, Mycobacterium tuberculosis
HGYGTE

SEQ ID NO: 1400038 - protein, 6 aa, Mycobacterium tuberculosis
HHASGV

SEQ ID NO: 1400039 - protein, 4 aa, Mycobacterium tuberculosis
HHED

SEQ ID NO: 1400040 - protein, 4 aa, Mycobacterium tuberculosis
HHKG

SEQ ID NO: 1400041 - protein, 4 aa, Mycobacterium tuberculosis
HHNP

SEQ ID NO: 1400042 - protein, 5 aa, Mycobacterium tuberculosis
HHQQT

SEQ ID NO: 1400043 - protein, 4 aa, Mycobacterium tuberculosis
HIET

SEQ ID NO: 1400044 - protein, 6 aa, Mycobacterium tuberculosis
HKIGPG

SEQ ID NO: 1400045 - protein, 10 aa, Mycobacterium tuberculosis
HKKQTGGSGQ

SEQ ID NO: 1400046 - protein, 11 aa, Mycobacterium tuberculosis
HKPTFAPNVDG

SEQ ID NO: 1400047 - protein, 8 aa, Mycobacterium tuberculosis
HKTTKASA

SEQ ID NO: 1400048 - protein, 8 aa, Mycobacterium tuberculosis
HKYKDSRE

SEQ ID NO: 1400049 - protein, 9 aa, Mycobacterium tuberculosis
HLERPADEA

SEQ ID NO: 1400050 - protein, 8 aa, Mycobacterium tuberculosis
HLRSSDGS

SEQ ID NO: 1400051 - protein, 5 aa, Mycobacterium tuberculosis
HMGSD

SEQ ID NO: 1400052 - protein, 4 aa, Mycobacterium tuberculosis
HNAG

SEQ ID NO: 1400053 - protein, 8 aa, Mycobacterium tuberculosis
HNGAGKST

SEQ ID NO: 1400054 - protein, 4 aa, Mycobacterium tuberculosis
HNGL

SEQ ID NO: 1400055 - protein, 8 aa, Mycobacterium tuberculosis
HNGSPRAL

SEQ ID NO: 1400056 - protein, 8 aa, Mycobacterium tuberculosis
HNPDHRTS

SEQ ID NO: 1400057 - protein, 6 aa, Mycobacterium tuberculosis
HNQAHG

SEQ ID NO: 1400058 - protein, 7 aa, Mycobacterium tuberculosis
HNQPRIT

SEQ ID NO: 1400059 - protein, 5 aa, Mycobacterium tuberculosis
HNRAQ

SEQ ID NO: 1400060 - protein, 6 aa, Mycobacterium tuberculosis
HPADTQ

SEQ ID NO: 1400061 - protein, 6 aa, Mycobacterium tuberculosis
HPDDER

SEQ ID NO: 1400062 - protein, 13 aa, Mycobacterium tuberculosis
HPDDESSKGAATL

SEQ ID NO: 1400063 - protein, 4 aa, Mycobacterium tuberculosis
HPEA

SEQ ID NO: 1400064 - protein, 14 aa, Mycobacterium tuberculosis
HPENEQVEQALSDT

SEQ ID NO: 1400065 - protein, 11 aa, Mycobacterium tuberculosis
HPGGLSQAEIG

SEQ ID NO: 1400066 - protein, 6 aa, Mycobacterium tuberculosis
HPGGPK

SEQ ID NO: 1400067 - protein, 7 aa, Mycobacterium tuberculosis
HPGPPHV

SEQ ID NO: 1400068 - protein, 5 aa, Mycobacterium tuberculosis
HPGRT

SEQ ID NO: 1400069 - protein, 10 aa, Mycobacterium tuberculosis
HPGSQQRAAD

SEQ ID NO: 1400070 - protein, 6 aa, Mycobacterium tuberculosis
HPITGS

SEQ ID NO: 1400071 - protein, 9 aa, Mycobacterium tuberculosis
HPKVDNKTG

SEQ ID NO: 1400072 - protein, 8 aa, Mycobacterium tuberculosis
HPLGTRPF

SEQ ID NO: 1400073 - protein, 6 aa, Mycobacterium tuberculosis
HPNGAD

SEQ ID NO: 1400074 - protein, 9 aa, Mycobacterium tuberculosis
HPPSGPGVR

SEQ ID NO: 1400075 - protein, 4 aa, Mycobacterium tuberculosis
HPQH

SEQ ID NO: 1400076 - protein, 6 aa, Mycobacterium tuberculosis
HPSHEG

SEQ ID NO: 1400077 - protein, 6 aa, Mycobacterium tuberculosis
HPTGSH

SEQ ID NO: 1400078 - protein, 5 aa, Mycobacterium tuberculosis
HPWPP

SEQ ID NO: 1400079 - protein, 5 aa, Mycobacterium tuberculosis
HPYEE

SEQ ID NO: 1400080 - protein, 6 aa, Mycobacterium tuberculosis
HQAAAD

SEQ ID NO: 1400081 - protein, 5 aa, Mycobacterium tuberculosis
HQGKR

SEQ ID NO: 1400082 - protein, 8 aa, Mycobacterium tuberculosis
HQITSSRA

SEQ ID NO: 1400083 - protein, 8 aa, Mycobacterium tuberculosis
HQNSATAQ

SEQ ID NO: 1400084 - protein, 21 aa, Mycobacterium tuberculosis
HQPTESAKAQAAQPERGYSSA

SEQ ID NO: 1400085 - protein, 5 aa, Mycobacterium tuberculosis
HQQSG

SEQ ID NO: 1400086 - protein, 21 aa, Mycobacterium tuberculosis
HQRGNDAAVRNGGRAREPRRA

SEQ ID NO: 1400087 - protein, 11 aa, Mycobacterium tuberculosis
HQTGPAPQRIS

SEQ ID NO: 1400088 - protein, 17 aa, Mycobacterium tuberculosis
HRDEHTQDAGDKDGRTL

SEQ ID NO: 1400089 - protein, 4 aa, Mycobacterium tuberculosis
HRDG

SEQ ID NO: 1400090 - protein, 9 aa, Mycobacterium tuberculosis
HRDGHGQAH

SEQ ID NO: 1400091 - protein, 4 aa, Mycobacterium tuberculosis
HREP

SEQ ID NO: 1400092 - protein, 4 aa, Mycobacterium tuberculosis
HRGN

SEQ ID NO: 1400093 - protein, 8 aa, Mycobacterium tuberculosis
HRGTGARG

SEQ ID NO: 1400094 - protein, 23 aa, Mycobacterium tuberculosis
HRGTTLATPPSHSGTGHVPLGRG

SEQ ID NO: 1400095 - protein, 6 aa, Mycobacterium tuberculosis
HRNTAT

SEQ ID NO: 1400096 - protein, 11 aa, Mycobacterium tuberculosis
HRQARGQSEVP

SEQ ID NO: 1400097 - protein, 5 aa, Mycobacterium tuberculosis
HRRGE

SEQ ID NO: 1400098 - protein, 13 aa, Mycobacterium tuberculosis
HRRPGSIGGCATP

SEQ ID NO: 1400099 - protein, 9 aa, Mycobacterium tuberculosis
HRSSEPGHG

SEQ ID NO: 1400100 - protein, 9 aa, Mycobacterium tuberculosis
HRTRPCPTG

SEQ ID NO: 1400101 - protein, 5 aa, Mycobacterium tuberculosis
HRTTG

SEQ ID NO: 1400102 - protein, 7 aa, Mycobacterium tuberculosis
HSDDTLS

SEQ ID NO: 1400103 - protein, 11 aa, Mycobacterium tuberculosis
HSERSGEPIEP

SEQ ID NO: 1400104 - protein, 9 aa, Mycobacterium tuberculosis
HSETGQTPL

SEQ ID NO: 1400105 - protein, 6 aa, Mycobacterium tuberculosis
HSGAGP

SEQ ID NO: 1400106 - protein, 11 aa, Mycobacterium tuberculosis
HSGASAAAAAL

SEQ ID NO: 1400107 - protein, 13 aa, Mycobacterium tuberculosis
HSPKGPQATGVRS

SEQ ID NO: 1400108 - protein, 7 aa, Mycobacterium tuberculosis
HSPKQVT

SEQ ID NO: 1400109 - protein, 7 aa, Mycobacterium tuberculosis
HSPKRLE

SEQ ID NO: 1400110 - protein, 10 aa, Mycobacterium tuberculosis
HSTGRDPASH

SEQ ID NO: 1400111 - protein, 5 aa, Mycobacterium tuberculosis
HSTPG

SEQ ID NO: 1400112 - protein, 10 aa, Mycobacterium tuberculosis
HSYRGRNGRN

SEQ ID NO: 1400113 - protein, 6 aa, Mycobacterium tuberculosis
HTDGSA

SEQ ID NO: 1400114 - protein, 7 aa, Mycobacterium tuberculosis
HTDSPNL

SEQ ID NO: 1400115 - protein, 7 aa, Mycobacterium tuberculosis
HTETHDE

SEQ ID NO: 1400116 - protein, 4 aa, Mycobacterium tuberculosis
HTGA

SEQ ID NO: 1400117 - protein, 10 aa, Mycobacterium tuberculosis
HTGGNSSGIV

SEQ ID NO: 1400118 - protein, 6 aa, Mycobacterium tuberculosis
HTGSDP

SEQ ID NO: 1400119 - protein, 22 aa, Mycobacterium tuberculosis
HTGTAGDGNDGAAAASGPVQPG

SEQ ID NO: 1400120 - protein, 6 aa, Mycobacterium tuberculosis
HTKGPK

SEQ ID NO: 1400121 - protein, 6 aa, Mycobacterium tuberculosis
HTQRQR

SEQ ID NO: 1400122 - protein, 11 aa, Mycobacterium tuberculosis
HTRAGSAVSGG

SEQ ID NO: 1400123 - protein, 6 aa, Mycobacterium tuberculosis
HTRKAG

SEQ ID NO: 1400124 - protein, 6 aa, Mycobacterium tuberculosis
HTRPED

SEQ ID NO: 1400125 - protein, 8 aa, Mycobacterium tuberculosis
HTSSGTAS

SEQ ID NO: 1400126 - protein, 5 aa, Mycobacterium tuberculosis
HVPDD

SEQ ID NO: 1400127 - protein, 5 aa, Mycobacterium tuberculosis
HVQGG

SEQ ID NO: 1400128 - protein, 7 aa, Mycobacterium tuberculosis
HVRTGSD

SEQ ID NO: 1400129 - protein, 8 aa, Mycobacterium tuberculosis
IAADGSRE

SEQ ID NO: 1400130 - protein, 11 aa, Mycobacterium tuberculosis
IAATPGSVAAA

SEQ ID NO: 1400131 - protein, 7 aa, Mycobacterium tuberculosis
IAATTTA

SEQ ID NO: 1400132 - protein, 9 aa, Mycobacterium tuberculosis
IADGQHDDQ

SEQ ID NO: 1400133 - protein, 16 aa, Mycobacterium tuberculosis
IADQRSENWLASEHGG

SEQ ID NO: 1400134 - protein, 11 aa, Mycobacterium tuberculosis
IAEPDKDGGAL

SEQ ID NO: 1400135 - protein, 4 aa, Mycobacterium tuberculosis
IAES

SEQ ID NO: 1400136 - protein, 10 aa, Mycobacterium tuberculosis
IAGASASALH

SEQ ID NO: 1400137 - protein, 5 aa, Mycobacterium tuberculosis
IAGGS

SEQ ID NO: 1400138 - protein, 10 aa, Mycobacterium tuberculosis
IAGPNADGDD

SEQ ID NO: 1400139 - protein, 7 aa, Mycobacterium tuberculosis
IAKRGSV

SEQ ID NO: 1400140 - protein, 5 aa, Mycobacterium tuberculosis
IAPDA

SEQ ID NO: 1400141 - protein, 5 aa, Mycobacterium tuberculosis
IAPGD

SEQ ID NO: 1400142 - protein, 4 aa, Mycobacterium tuberculosis
IAPL

SEQ ID NO: 1400143 - protein, 8 aa, Mycobacterium tuberculosis
IAQPGTAE

SEQ ID NO: 1400144 - protein, 5 aa, Mycobacterium tuberculosis
IARGR

SEQ ID NO: 1400145 - protein, 20 aa, Mycobacterium tuberculosis
IARKSENPSITRDVSGEGVQ

SEQ ID NO: 1400146 - protein, 12 aa, Mycobacterium tuberculosis
IARNGAGTIDAA

SEQ ID NO: 1400147 - protein, 6 aa, Mycobacterium tuberculosis
IASPTL

SEQ ID NO: 1400148 - protein, 4 aa, Mycobacterium tuberculosis
IASY

SEQ ID NO: 1400149 - protein, 6 aa, Mycobacterium tuberculosis
IATEQS

SEQ ID NO: 1400150 - protein, 4 aa, Mycobacterium tuberculosis
IATG

SEQ ID NO: 1400151 - protein, 8 aa, Mycobacterium tuberculosis
IATTASYQ

SEQ ID NO: 1400152 - protein, 17 aa, Mycobacterium tuberculosis
IDAPTAARLGKPYRQEF

SEQ ID NO: 1400153 - protein, 6 aa, Mycobacterium tuberculosis
IDDPKL

SEQ ID NO: 1400154 - protein, 19 aa, Mycobacterium tuberculosis
IDDVERGSKDSDWEPVKEA

SEQ ID NO: 1400155 - protein, 6 aa, Mycobacterium tuberculosis
IDEPGL

SEQ ID NO: 1400156 - protein, 20 aa, Mycobacterium tuberculosis
IDESDDTDVQGGVRPSATAE

SEQ ID NO: 1400157 - protein, 9 aa, Mycobacterium tuberculosis
IDESPPGDY

SEQ ID NO: 1400158 - protein, 8 aa, Mycobacterium tuberculosis
IDGAQQAS

SEQ ID NO: 1400159 - protein, 6 aa, Mycobacterium tuberculosis
IDGEPA

SEQ ID NO: 1400160 - protein, 17 aa, Mycobacterium tuberculosis
IDGETHPAQRQIRFTAM

SEQ ID NO: 1400161 - protein, 9 aa, Mycobacterium tuberculosis
IDKSTDKTL

SEQ ID NO: 1400162 - protein, 9 aa, Mycobacterium tuberculosis
IDNADRDDV

SEQ ID NO: 1400163 - protein, 8 aa, Mycobacterium tuberculosis
IDPDDGQR

SEQ ID NO: 1400164 - protein, 6 aa, Mycobacterium tuberculosis
IDPRNS

SEQ ID NO: 1400165 - protein, 9 aa, Mycobacterium tuberculosis
IDSETAELQ

SEQ ID NO: 1400166 - protein, 11 aa, Mycobacterium tuberculosis
IDSETLDDEHR

SEQ ID NO: 1400167 - protein, 6 aa, Mycobacterium tuberculosis
IDSTRG

SEQ ID NO: 1400168 - protein, 21 aa, Mycobacterium tuberculosis
IDTAGPRERSVGQAYHIWRSA

SEQ ID NO: 1400169 - protein, 6 aa, Mycobacterium tuberculosis
IDTGEK

SEQ ID NO: 1400170 - protein, 7 aa, Mycobacterium tuberculosis
IDTTGAE

SEQ ID NO: 1400171 - protein, 9 aa, Mycobacterium tuberculosis
IDVSPDSWD

SEQ ID NO: 1400172 - protein, 13 aa, Mycobacterium tuberculosis
IDYESAEASFQPS

SEQ ID NO: 1400173 - protein, 18 aa, Mycobacterium tuberculosis
IEAEPGARTASANWLNVR

SEQ ID NO: 1400174 - protein, 11 aa, Mycobacterium tuberculosis
IEEGQQVKRTG

SEQ ID NO: 1400175 - protein, 9 aa, Mycobacterium tuberculosis
IEPDPDDLA

SEQ ID NO: 1400176 - protein, 4 aa, Mycobacterium tuberculosis
IEPP

SEQ ID NO: 1400177 - protein, 14 aa, Mycobacterium tuberculosis
IEPPEEVFAAPPSA

SEQ ID NO: 1400178 - protein, 7 aa, Mycobacterium tuberculosis
IEPRSGR

SEQ ID NO: 1400179 - protein, 9 aa, Mycobacterium tuberculosis
IERSGRSAQ

SEQ ID NO: 1400180 - protein, 9 aa, Mycobacterium tuberculosis
IESENPDAV

SEQ ID NO: 1400181 - protein, 14 aa, Mycobacterium tuberculosis
IESFSDTDRKLADE

SEQ ID NO: 1400182 - protein, 4 aa, Mycobacterium tuberculosis
IETE

SEQ ID NO: 1400183 - protein, 5 aa, Mycobacterium tuberculosis
IETEK

SEQ ID NO: 1400184 - protein, 6 aa, Mycobacterium tuberculosis
IETSPA

SEQ ID NO: 1400185 - protein, 12 aa, Mycobacterium tuberculosis
IGASKKDGQRAK

SEQ ID NO: 1400186 - protein, 8 aa, Mycobacterium tuberculosis
IGDPRKDE

SEQ ID NO: 1400187 - protein, 6 aa, Mycobacterium tuberculosis
IGDSRD

SEQ ID NO: 1400188 - protein, 5 aa, Mycobacterium tuberculosis
IGEDD

SEQ ID NO: 1400189 - protein, 4 aa, Mycobacterium tuberculosis
IGEG

SEQ ID NO: 1400190 - protein, 6 aa, Mycobacterium tuberculosis
IGEPKG

SEQ ID NO: 1400191 - protein, 4 aa, Mycobacterium tuberculosis
IGER

SEQ ID NO: 1400192 - protein, 6 aa, Mycobacterium tuberculosis
IGETST

SEQ ID NO: 1400193 - protein, 12 aa, Mycobacterium tuberculosis
IGGDGETPGSRL

SEQ ID NO: 1400194 - protein, 6 aa, Mycobacterium tuberculosis
IGGQES

SEQ ID NO: 1400195 - protein, 18 aa, Mycobacterium tuberculosis
IGGRSAPARITEQTPWGT

SEQ ID NO: 1400196 - protein, 7 aa, Mycobacterium tuberculosis
IGGTPEG

SEQ ID NO: 1400197 - protein, 4 aa, Mycobacterium tuberculosis
IGHD

SEQ ID NO: 1400198 - protein, 4 aa, Mycobacterium tuberculosis
IGKG

SEQ ID NO: 1400199 - protein, 5 aa, Mycobacterium tuberculosis
IGPAS

SEQ ID NO: 1400200 - protein, 5 aa, Mycobacterium tuberculosis
IGPAT

SEQ ID NO: 1400201 - protein, 4 aa, Mycobacterium tuberculosis
IGPD

SEQ ID NO: 1400202 - protein, 9 aa, Mycobacterium tuberculosis
IGPGADPGT

SEQ ID NO: 1400203 - protein, 8 aa, Mycobacterium tuberculosis
IGPGQEEQ

SEQ ID NO: 1400204 - protein, 5 aa, Mycobacterium tuberculosis
IGPKG

SEQ ID NO: 1400205 - protein, 5 aa, Mycobacterium tuberculosis
IGPNT

SEQ ID NO: 1400206 - protein, 9 aa, Mycobacterium tuberculosis
IGPQPDAAA

SEQ ID NO: 1400207 - protein, 5 aa, Mycobacterium tuberculosis
IGPTG

SEQ ID NO: 1400208 - protein, 7 aa, Mycobacterium tuberculosis
IGREGDG

SEQ ID NO: 1400209 - protein, 7 aa, Mycobacterium tuberculosis
IGRGEHP

SEQ ID NO: 1400210 - protein, 11 aa, Mycobacterium tuberculosis
IGRGSGLAAQG

SEQ ID NO: 1400211 - protein, 16 aa, Mycobacterium tuberculosis
IGRPARQRTTTYALLA

SEQ ID NO: 1400212 - protein, 10 aa, Mycobacterium tuberculosis
IGRRAPDGRE

SEQ ID NO: 1400213 - protein, 8 aa, Mycobacterium tuberculosis
IGRSAQDA

SEQ ID NO: 1400214 - protein, 9 aa, Mycobacterium tuberculosis
IGRSGAAIG

SEQ ID NO: 1400215 - protein, 7 aa, Mycobacterium tuberculosis
IGSAGAK

SEQ ID NO: 1400216 - protein, 8 aa, Mycobacterium tuberculosis
IGSGSTAQ

SEQ ID NO: 1400217 - protein, 14 aa, Mycobacterium tuberculosis
IGSKRSPLHTPEQA

SEQ ID NO: 1400218 - protein, 7 aa, Mycobacterium tuberculosis
IGTESDR

SEQ ID NO: 1400219 - protein, 8 aa, Mycobacterium tuberculosis
IGTGGGQG

SEQ ID NO: 1400220 - protein, 14 aa, Mycobacterium tuberculosis
IGTPEGRRAALGPY

SEQ ID NO: 1400221 - protein, 28 aa, Mycobacterium tuberculosis
IGTSGAEIGGAFGGEKQTGGGRESGSDA

SEQ ID NO: 1400222 - protein, 6 aa, Mycobacterium tuberculosis
IGTSPF

SEQ ID NO: 1400223 - protein, 7 aa, Mycobacterium tuberculosis
IHSSDTD

SEQ ID NO: 1400224 - protein, 15 aa, Mycobacterium tuberculosis
IKADSVASSVTPKSV

SEQ ID NO: 1400225 - protein, 13 aa, Mycobacterium tuberculosis
IKATDVDDPDGTW

SEQ ID NO: 1400226 - protein, 4 aa, Mycobacterium tuberculosis
IKDG

SEQ ID NO: 1400227 - protein, 8 aa, Mycobacterium tuberculosis
IKGSPTTE

SEQ ID NO: 1400228 - protein, 15 aa, Mycobacterium tuberculosis
IKPRDGRFGSGPSKV

SEQ ID NO: 1400229 - protein, 18 aa, Mycobacterium tuberculosis
IKPRSRDVTDGLEKAAAR

SEQ ID NO: 1400230 - protein, 4 aa, Mycobacterium tuberculosis
IKRR

SEQ ID NO: 1400231 - protein, 9 aa, Mycobacterium tuberculosis
IMPRQGSKH

SEQ ID NO: 1400232 - protein, 6 aa, Mycobacterium tuberculosis
INEPRF

SEQ ID NO: 1400233 - protein, 4 aa, Mycobacterium tuberculosis
INGE

SEQ ID NO: 1400234 - protein, 10 aa, Mycobacterium tuberculosis
INRNSASLDE

SEQ ID NO: 1400235 - protein, 16 aa, Mycobacterium tuberculosis
INRSPSAFDRNPPADK

SEQ ID NO: 1400236 - protein, 7 aa, Mycobacterium tuberculosis
INTAATA

SEQ ID NO: 1400237 - protein, 10 aa, Mycobacterium tuberculosis
INTGGVTRDD

SEQ ID NO: 1400238 - protein, 4 aa, Mycobacterium tuberculosis
INTT

SEQ ID NO: 1400239 - protein, 15 aa, Mycobacterium tuberculosis
IPARPPETELFAGIE

SEQ ID NO: 1400240 - protein, 4 aa, Mycobacterium tuberculosis
IPAT

SEQ ID NO: 1400241 - protein, 5 aa, Mycobacterium tuberculosis
IPATR

SEQ ID NO: 1400242 - protein, 11 aa, Mycobacterium tuberculosis
IPAYGNQRTKW

SEQ ID NO: 1400243 - protein, 6 aa, Mycobacterium tuberculosis
IPDPQH

SEQ ID NO: 1400244 - protein, 6 aa, Mycobacterium tuberculosis
IPDSPA

SEQ ID NO: 1400245 - protein, 6 aa, Mycobacterium tuberculosis
IPDTEY

SEQ ID NO: 1400246 - protein, 6 aa, Mycobacterium tuberculosis
IPEGPI

SEQ ID NO: 1400247 - protein, 12 aa, Mycobacterium tuberculosis
IPEGSGEDGRPY

SEQ ID NO: 1400248 - protein, 6 aa, Mycobacterium tuberculosis
IPGAAS

SEQ ID NO: 1400249 - protein, 5 aa, Mycobacterium tuberculosis
IPGNE

SEQ ID NO: 1400250 - protein, 6 aa, Mycobacterium tuberculosis
IPGSGI

SEQ ID NO: 1400251 - protein, 14 aa, Mycobacterium tuberculosis
IPIDGGRPRGDDAW

SEQ ID NO: 1400252 - protein, 5 aa, Mycobacterium tuberculosis
IPKPT

SEQ ID NO: 1400253 - protein, 9 aa, Mycobacterium tuberculosis
IPPGTQPGS

SEQ ID NO: 1400254 - protein, 7 aa, Mycobacterium tuberculosis
IPPQADA

SEQ ID NO: 1400255 - protein, 12 aa, Mycobacterium tuberculosis
IPRTTSGKLARQ

SEQ ID NO: 1400256 - protein, 11 aa, Mycobacterium tuberculosis
IPTAADRRCGP

SEQ ID NO: 1400257 - protein, 8 aa, Mycobacterium tuberculosis
IPTPPGWA

SEQ ID NO: 1400258 - protein, 20 aa, Mycobacterium tuberculosis
IQDETGIRPTWSPESYPDAV

SEQ ID NO: 1400259 - protein, 6 aa, Mycobacterium tuberculosis
IQPGVT

SEQ ID NO: 1400260 - protein, 4 aa, Mycobacterium tuberculosis
IQRT

SEQ ID NO: 1400261 - protein, 6 aa, Mycobacterium tuberculosis
IQTAPS

SEQ ID NO: 1400262 - protein, 4 aa, Mycobacterium tuberculosis
IRGP

SEQ ID NO: 1400263 - protein, 11 aa, Mycobacterium tuberculosis
IRNDPSDGHKV

SEQ ID NO: 1400264 - protein, 11 aa, Mycobacterium tuberculosis
IRPDGRNDAAG

SEQ ID NO: 1400265 - protein, 6 aa, Mycobacterium tuberculosis
IRPSTI

SEQ ID NO: 1400266 - protein, 6 aa, Mycobacterium tuberculosis
IRRGSD

SEQ ID NO: 1400267 - protein, 4 aa, Mycobacterium tuberculosis
IRSG

SEQ ID NO: 1400268 - protein, 5 aa, Mycobacterium tuberculosis
IRSGE

SEQ ID NO: 1400269 - protein, 16 aa, Mycobacterium tuberculosis
IRSSKAAALKSNDPTT

SEQ ID NO: 1400270 - protein, 7 aa, Mycobacterium tuberculosis
IRTRRGS

SEQ ID NO: 1400271 - protein, 7 aa, Mycobacterium tuberculosis
ISAPERL

SEQ ID NO: 1400272 - protein, 5 aa, Mycobacterium tuberculosis
ISEDD

SEQ ID NO: 1400273 - protein, 13 aa, Mycobacterium tuberculosis
ISGDVPQAQRERT

SEQ ID NO: 1400274 - protein, 12 aa, Mycobacterium tuberculosis
ISGEHGVGRAKT

SEQ ID NO: 1400275 - protein, 25 aa, Mycobacterium tuberculosis
ISGGEEGALNGPSIMPGGPAESYQS

SEQ ID NO: 1400276 - protein, 8 aa, Mycobacterium tuberculosis
ISGKKGER

SEQ ID NO: 1400277 - protein, 11 aa, Mycobacterium tuberculosis
ISGNGKRSTTR

SEQ ID NO: 1400278 - protein, 14 aa, Mycobacterium tuberculosis
ISGSTPPAQPEPTR

SEQ ID NO: 1400279 - protein, 9 aa, Mycobacterium tuberculosis
ISQGPGGIA

SEQ ID NO: 1400280 - protein, 4 aa, Mycobacterium tuberculosis
ISQS

SEQ ID NO: 1400281 - protein, 22 aa, Mycobacterium tuberculosis
ISQTAQQAAQSAQGGSGPMPAQ

SEQ ID NO: 1400282 - protein, 8 aa, Mycobacterium tuberculosis
ISRRTGDI

SEQ ID NO: 1400283 - protein, 5 aa, Mycobacterium tuberculosis
ISSGE

SEQ ID NO: 1400284 - protein, 12 aa, Mycobacterium tuberculosis
ISTADDNNGADL

SEQ ID NO: 1400285 - protein, 10 aa, Mycobacterium tuberculosis
ISTEEANEQM

SEQ ID NO: 1400286 - protein, 9 aa, Mycobacterium tuberculosis
ISTPDAPSI

SEQ ID NO: 1400287 - protein, 8 aa, Mycobacterium tuberculosis
ITDARNEE

SEQ ID NO: 1400288 - protein, 5 aa, Mycobacterium tuberculosis
ITDED

SEQ ID NO: 1400289 - protein, 8 aa, Mycobacterium tuberculosis
ITEPDTAE

SEQ ID NO: 1400290 - protein, 5 aa, Mycobacterium tuberculosis
ITEPQ

SEQ ID NO: 1400291 - protein, 6 aa, Mycobacterium tuberculosis
ITGEPL

SEQ ID NO: 1400292 - protein, 5 aa, Mycobacterium tuberculosis
ITGEQ

SEQ ID NO: 1400293 - protein, 4 aa, Mycobacterium tuberculosis
ITGP

SEQ ID NO: 1400294 - protein, 7 aa, Mycobacterium tuberculosis
ITPDDDE

SEQ ID NO: 1400295 - protein, 9 aa, Mycobacterium tuberculosis
ITPPDPDGK

SEQ ID NO: 1400296 - protein, 6 aa, Mycobacterium tuberculosis
ITRNNP

SEQ ID NO: 1400297 - protein, 5 aa, Mycobacterium tuberculosis
ITRTA

SEQ ID NO: 1400298 - protein, 6 aa, Mycobacterium tuberculosis
ITSPID

SEQ ID NO: 1400299 - protein, 6 aa, Mycobacterium tuberculosis
ITSSKG

SEQ ID NO: 1400300 - protein, 10 aa, Mycobacterium tuberculosis
ITSTRGRSIT

SEQ ID NO: 1400301 - protein, 7 aa, Mycobacterium tuberculosis
ITTGPGG

SEQ ID NO: 1400302 - protein, 4 aa, Mycobacterium tuberculosis
IVPP

SEQ ID NO: 1400303 - protein, 4 aa, Mycobacterium tuberculosis
IYDA

SEQ ID NO: 1400304 - protein, 8 aa, Mycobacterium tuberculosis
IYGGSNEI

SEQ ID NO: 1400305 - protein, 8 aa, Mycobacterium tuberculosis
KAAADSAE

SEQ ID NO: 1400306 - protein, 9 aa, Mycobacterium tuberculosis
KAADPNNPT

SEQ ID NO: 1400307 - protein, 6 aa, Mycobacterium tuberculosis
KAAGAA

SEQ ID NO: 1400308 - protein, 11 aa, Mycobacterium tuberculosis
KAAGKQGSIDR

SEQ ID NO: 1400309 - protein, 17 aa, Mycobacterium tuberculosis
KAAGPSKPRLARDPVNQ

SEQ ID NO: 1400310 - protein, 8 aa, Mycobacterium tuberculosis
KAAKAAGH

SEQ ID NO: 1400311 - protein, 19 aa, Mycobacterium tuberculosis
KAAKAAKTAGDQAGDHHRD

SEQ ID NO: 1400312 - protein, 7 aa, Mycobacterium tuberculosis
KAALKDS

SEQ ID NO: 1400313 - protein, 6 aa, Mycobacterium tuberculosis
KAANAL

SEQ ID NO: 1400314 - protein, 6 aa, Mycobacterium tuberculosis
KAATAL

SEQ ID NO: 1400315 - protein, 13 aa, Mycobacterium tuberculosis
KADPAKVNPNGGA

SEQ ID NO: 1400316 - protein, 4 aa, Mycobacterium tuberculosis
KAGE

SEQ ID NO: 1400317 - protein, 19 aa, Mycobacterium tuberculosis
KAGESAATRWESSGEGTYT

SEQ ID NO: 1400318 - protein, 7 aa, Mycobacterium tuberculosis
KAGGARD

SEQ ID NO: 1400319 - protein, 8 aa, Mycobacterium tuberculosis
KAGGPNLD

SEQ ID NO: 1400320 - protein, 5 aa, Mycobacterium tuberculosis
KAGIS

SEQ ID NO: 1400321 - protein, 14 aa, Mycobacterium tuberculosis
KAGKKINKEDGIQR

SEQ ID NO: 1400322 - protein, 12 aa, Mycobacterium tuberculosis
KAGNISKRQSAT

SEQ ID NO: 1400323 - protein, 4 aa, Mycobacterium tuberculosis
KAGR

SEQ ID NO: 1400324 - protein, 9 aa, Mycobacterium tuberculosis
KAGTAHPIS

SEQ ID NO: 1400325 - protein, 12 aa, Mycobacterium tuberculosis
KAGWAAAAGEPL

SEQ ID NO: 1400326 - protein, 9 aa, Mycobacterium tuberculosis
KAHHGRAGT

SEQ ID NO: 1400327 - protein, 8 aa, Mycobacterium tuberculosis
KAHSGAPA

SEQ ID NO: 1400328 - protein, 8 aa, Mycobacterium tuberculosis
KAKANGAK

SEQ ID NO: 1400329 - protein, 8 aa, Mycobacterium tuberculosis
KAKSQKAV

SEQ ID NO: 1400330 - protein, 14 aa, Mycobacterium tuberculosis
KANPDGAGVQPWDK

SEQ ID NO: 1400331 - protein, 6 aa, Mycobacterium tuberculosis
KANVPA

SEQ ID NO: 1400332 - protein, 5 aa, Mycobacterium tuberculosis
KANVT

SEQ ID NO: 1400333 - protein, 6 aa, Mycobacterium tuberculosis
KAPDAV

SEQ ID NO: 1400334 - protein, 10 aa, Mycobacterium tuberculosis
KAPNAGPSRD

SEQ ID NO: 1400335 - protein, 7 aa, Mycobacterium tuberculosis
KAQRHQR

SEQ ID NO: 1400336 - protein, 19 aa, Mycobacterium tuberculosis
KARAAEKPAPSDRAGDDAA

SEQ ID NO: 1400337 - protein, 8 aa, Mycobacterium tuberculosis
KAREVRGA

SEQ ID NO: 1400338 - protein, 6 aa, Mycobacterium tuberculosis
KARGDG

SEQ ID NO: 1400339 - protein, 8 aa, Mycobacterium tuberculosis
KARQSGAA

SEQ ID NO: 1400340 - protein, 10 aa, Mycobacterium tuberculosis
KARYEGGPTP

SEQ ID NO: 1400341 - protein, 8 aa, Mycobacterium tuberculosis
KASISGAV

SEQ ID NO: 1400342 - protein, 7 aa, Mycobacterium tuberculosis
KATGVDE

SEQ ID NO: 1400343 - protein, 7 aa, Mycobacterium tuberculosis
KATQEDP

SEQ ID NO: 1400344 - protein, 7 aa, Mycobacterium tuberculosis
KATREDI

SEQ ID NO: 1400345 - protein, 8 aa, Mycobacterium tuberculosis
KATRQTLT

SEQ ID NO: 1400346 - protein, 8 aa, Mycobacterium tuberculosis
KATTDEPF

SEQ ID NO: 1400347 - protein, 9 aa, Mycobacterium tuberculosis
KAVGTDTQA

SEQ ID NO: 1400348 - protein, 7 aa, Mycobacterium tuberculosis
KAYDPDS

SEQ ID NO: 1400349 - protein, 5 aa, Mycobacterium tuberculosis
KAYSA

SEQ ID NO: 1400350 - protein, 7 aa, Mycobacterium tuberculosis
KDAAGVS

SEQ ID NO: 1400351 - protein, 8 aa, Mycobacterium tuberculosis
KDAEGSPV

SEQ ID NO: 1400352 - protein, 12 aa, Mycobacterium tuberculosis
KDAQARAGATAL

SEQ ID NO: 1400353 - protein, 5 aa, Mycobacterium tuberculosis
KDDQR

SEQ ID NO: 1400354 - protein, 6 aa, Mycobacterium tuberculosis
KDEEAP

SEQ ID NO: 1400355 - protein, 8 aa, Mycobacterium tuberculosis
KDEYPATA

SEQ ID NO: 1400356 - protein, 9 aa, Mycobacterium tuberculosis
KDGRSPSTE

SEQ ID NO: 1400357 - protein, 7 aa, Mycobacterium tuberculosis
KDGSGGR

SEQ ID NO: 1400358 - protein, 7 aa, Mycobacterium tuberculosis
KDIRTPA

SEQ ID NO: 1400359 - protein, 5 aa, Mycobacterium tuberculosis
KDKAD

SEQ ID NO: 1400360 - protein, 6 aa, Mycobacterium tuberculosis
KDNGRI

SEQ ID NO: 1400361 - protein, 7 aa, Mycobacterium tuberculosis
KDPATGV

SEQ ID NO: 1400362 - protein, 8 aa, Mycobacterium tuberculosis
KDPEKKKK

SEQ ID NO: 1400363 - protein, 6 aa, Mycobacterium tuberculosis
KDPRRH

SEQ ID NO: 1400364 - protein, 8 aa, Mycobacterium tuberculosis
KDQTRDGA

SEQ ID NO: 1400365 - protein, 9 aa, Mycobacterium tuberculosis
KDRADQHSA

SEQ ID NO: 1400366 - protein, 10 aa, Mycobacterium tuberculosis
KDRNPNWSPA

SEQ ID NO: 1400367 - protein, 5 aa, Mycobacterium tuberculosis
KDRRR

SEQ ID NO: 1400368 - protein, 4 aa, Mycobacterium tuberculosis
KDSI

SEQ ID NO: 1400369 - protein, 7 aa, Mycobacterium tuberculosis
KDSITGA

SEQ ID NO: 1400370 - protein, 6 aa, Mycobacterium tuberculosis
KDTISR

SEQ ID NO: 1400371 - protein, 20 aa, Mycobacterium tuberculosis
KEAADEAKAKLEAAGATVTV

SEQ ID NO: 1400372 - protein, 5 aa, Mycobacterium tuberculosis
KEAAE

SEQ ID NO: 1400373 - protein, 6 aa, Mycobacterium tuberculosis
KEAPDR

SEQ ID NO: 1400374 - protein, 10 aa, Mycobacterium tuberculosis
KEAVGADRKL

SEQ ID NO: 1400375 - protein, 7 aa, Mycobacterium tuberculosis
KEDKEGR

SEQ ID NO: 1400376 - protein, 23 aa, Mycobacterium tuberculosis
KEGEAGEDEVGRAEKDLDKTTHQ

SEQ ID NO: 1400377 - protein, 23 aa, Mycobacterium tuberculosis
KEGLSTGLGDEGGFAPDVAGTTA

SEQ ID NO: 1400378 - protein, 6 aa, Mycobacterium tuberculosis
KEGNER

SEQ ID NO: 1400379 - protein, 9 aa, Mycobacterium tuberculosis
KEHPAKPMS

SEQ ID NO: 1400380 - protein, 7 aa, Mycobacterium tuberculosis
KEHPNHK

SEQ ID NO: 1400381 - protein, 13 aa, Mycobacterium tuberculosis
KELGTTTKKDTVH

SEQ ID NO: 1400382 - protein, 5 aa, Mycobacterium tuberculosis
KENDG

SEQ ID NO: 1400383 - protein, 6 aa, Mycobacterium tuberculosis
KEPLQT

SEQ ID NO: 1400384 - protein, 24 aa, Mycobacterium tuberculosis
KEQRAEAGKRVNAARNAAQRSYDE

SEQ ID NO: 1400385 - protein, 17 aa, Mycobacterium tuberculosis
KERKEGDVLGRNQSGKA

SEQ ID NO: 1400386 - protein, 10 aa, Mycobacterium tuberculosis
KERTDPTQSE

SEQ ID NO: 1400387 - protein, 10 aa, Mycobacterium tuberculosis
KEYGGQGRSA

SEQ ID NO: 1400388 - protein, 13 aa, Mycobacterium tuberculosis
KFANSNPQTSPEY

SEQ ID NO: 1400389 - protein, 8 aa, Mycobacterium tuberculosis
KFGGPESY

SEQ ID NO: 1400390 - protein, 7 aa, Mycobacterium tuberculosis
KFHGPKG

SEQ ID NO: 1400391 - protein, 9 aa, Mycobacterium tuberculosis
KFSRPNDRR

SEQ ID NO: 1400392 - protein, 10 aa, Mycobacterium tuberculosis
KGAHGSRSSV

SEQ ID NO: 1400393 - protein, 8 aa, Mycobacterium tuberculosis
KGAPMPAP

SEQ ID NO: 1400394 - protein, 15 aa, Mycobacterium tuberculosis
KGDPTLDAGELLKAS

SEQ ID NO: 1400395 - protein, 8 aa, Mycobacterium tuberculosis
KGEKRSGL

SEQ ID NO: 1400396 - protein, 9 aa, Mycobacterium tuberculosis
KGGDPRSPG

SEQ ID NO: 1400397 - protein, 14 aa, Mycobacterium tuberculosis
KGGGSVKCCTLEIH

SEQ ID NO: 1400398 - protein, 17 aa, Mycobacterium tuberculosis
KGGKQGPRAKLVGQHPR

SEQ ID NO: 1400399 - protein, 11 aa, Mycobacterium tuberculosis
KGGVGKTTSTI

SEQ ID NO: 1400400 - protein, 13 aa, Mycobacterium tuberculosis
KGKKAGGGAKPCT

SEQ ID NO: 1400401 - protein, 7 aa, Mycobacterium tuberculosis
KGKLTAR

SEQ ID NO: 1400402 - protein, 6 aa, Mycobacterium tuberculosis
KGKRFN

SEQ ID NO: 1400403 - protein, 6 aa, Mycobacterium tuberculosis
KGLGAR

SEQ ID NO: 1400404 - protein, 7 aa, Mycobacterium tuberculosis
KGLSTHE

SEQ ID NO: 1400405 - protein, 7 aa, Mycobacterium tuberculosis
KGNPDYG

SEQ ID NO: 1400406 - protein, 6 aa, Mycobacterium tuberculosis
KGNPLP

SEQ ID NO: 1400407 - protein, 19 aa, Mycobacterium tuberculosis
KGPDQQKPAGVLSGGERNR

SEQ ID NO: 1400408 - protein, 8 aa, Mycobacterium tuberculosis
KGPMGTGQ

SEQ ID NO: 1400409 - protein, 10 aa, Mycobacterium tuberculosis
KGQGRSVTDA

SEQ ID NO: 1400410 - protein, 5 aa, Mycobacterium tuberculosis
KGRLR

SEQ ID NO: 1400411 - protein, 8 aa, Mycobacterium tuberculosis
KGRRDREV

SEQ ID NO: 1400412 - protein, 5 aa, Mycobacterium tuberculosis
KGTIR

SEQ ID NO: 1400413 - protein, 13 aa, Mycobacterium tuberculosis
KGTSEEIEHGPAP

SEQ ID NO: 1400414 - protein, 7 aa, Mycobacterium tuberculosis
KGTTSGY

SEQ ID NO: 1400415 - protein, 7 aa, Mycobacterium tuberculosis
KGVAGSR

SEQ ID NO: 1400416 - protein, 6 aa, Mycobacterium tuberculosis
KGYDGR

SEQ ID NO: 1400417 - protein, 11 aa, Mycobacterium tuberculosis
KGYSQGDPYGN

SEQ ID NO: 1400418 - protein, 7 aa, Mycobacterium tuberculosis
KHAEGDR

SEQ ID NO: 1400419 - protein, 6 aa, Mycobacterium tuberculosis
KHEPEF

SEQ ID NO: 1400420 - protein, 10 aa, Mycobacterium tuberculosis
KHGHPPPNGL

SEQ ID NO: 1400421 - protein, 11 aa, Mycobacterium tuberculosis
KHPPPQTYDEA

SEQ ID NO: 1400422 - protein, 10 aa, Mycobacterium tuberculosis
KHPVDEPDEW

SEQ ID NO: 1400423 - protein, 9 aa, Mycobacterium tuberculosis
KHSVNNPYA

SEQ ID NO: 1400424 - protein, 5 aa, Mycobacterium tuberculosis
KIAES

SEQ ID NO: 1400425 - protein, 5 aa, Mycobacterium tuberculosis
KISPR

SEQ ID NO: 1400426 - protein, 8 aa, Mycobacterium tuberculosis
KKAAAGEI

SEQ ID NO: 1400427 - protein, 7 aa, Mycobacterium tuberculosis
KKAASDA

SEQ ID NO: 1400428 - protein, 7 aa, Mycobacterium tuberculosis
KKAGYGG

SEQ ID NO: 1400429 - protein, 7 aa, Mycobacterium tuberculosis
KKEYGQD

SEQ ID NO: 1400430 - protein, 9 aa, Mycobacterium tuberculosis
KKGRDADRV

SEQ ID NO: 1400431 - protein, 9 aa, Mycobacterium tuberculosis
KKGRDQDRV

SEQ ID NO: 1400432 - protein, 7 aa, Mycobacterium tuberculosis
KKKPNRK

SEQ ID NO: 1400433 - protein, 7 aa, Mycobacterium tuberculosis
KKPLPEQ

SEQ ID NO: 1400434 - protein, 8 aa, Mycobacterium tuberculosis
KKRPEEAI

SEQ ID NO: 1400435 - protein, 9 aa, Mycobacterium tuberculosis
KKSIGPDKV

SEQ ID NO: 1400436 - protein, 5 aa, Mycobacterium tuberculosis
KKSLA

SEQ ID NO: 1400437 - protein, 6 aa, Mycobacterium tuberculosis
KLAGEQ

SEQ ID NO: 1400438 - protein, 6 aa, Mycobacterium tuberculosis
KLDGEE

SEQ ID NO: 1400439 - protein, 17 aa, Mycobacterium tuberculosis
KLENGTKAIYNPHYEIQ

SEQ ID NO: 1400440 - protein, 7 aa, Mycobacterium tuberculosis
KLGGARP

SEQ ID NO: 1400441 - protein, 7 aa, Mycobacterium tuberculosis
KLGGSKI

SEQ ID NO: 1400442 - protein, 10 aa, Mycobacterium tuberculosis
KLGTRSVASG

SEQ ID NO: 1400443 - protein, 9 aa, Mycobacterium tuberculosis
KLNPPPTRD

SEQ ID NO: 1400444 - protein, 7 aa, Mycobacterium tuberculosis
KLPDQAR

SEQ ID NO: 1400445 - protein, 6 aa, Mycobacterium tuberculosis
KLPGQP

SEQ ID NO: 1400446 - protein, 7 aa, Mycobacterium tuberculosis
KLPPPEP

SEQ ID NO: 1400447 - protein, 4 aa, Mycobacterium tuberculosis
KLPT

SEQ ID NO: 1400448 - protein, 11 aa, Mycobacterium tuberculosis
KLRGSLSASQY

SEQ ID NO: 1400449 - protein, 5 aa, Mycobacterium tuberculosis
KLRND

SEQ ID NO: 1400450 - protein, 6 aa, Mycobacterium tuberculosis
KLRPKI

SEQ ID NO: 1400451 - protein, 7 aa, Mycobacterium tuberculosis
KLSPGMQ

SEQ ID NO: 1400452 - protein, 12 aa, Mycobacterium tuberculosis
KLTDFDSNRSGG

SEQ ID NO: 1400453 - protein, 6 aa, Mycobacterium tuberculosis
KMAAGD

SEQ ID NO: 1400454 - protein, 5 aa, Mycobacterium tuberculosis
KNELR

SEQ ID NO: 1400455 - protein, 5 aa, Mycobacterium tuberculosis
KNGPY

SEQ ID NO: 1400456 - protein, 6 aa, Mycobacterium tuberculosis
KNGSYS

SEQ ID NO: 1400457 - protein, 6 aa, Mycobacterium tuberculosis
KNKGVQ

SEQ ID NO: 1400458 - protein, 16 aa, Mycobacterium tuberculosis
KNLKSREVSDDVPAEQ

SEQ ID NO: 1400459 - protein, 7 aa, Mycobacterium tuberculosis
KNPTDPA

SEQ ID NO: 1400460 - protein, 7 aa, Mycobacterium tuberculosis
KNQKDQK

SEQ ID NO: 1400461 - protein, 20 aa, Mycobacterium tuberculosis
KNSRHGLDNPNARYRKENSI

SEQ ID NO: 1400462 - protein, 10 aa, Mycobacterium tuberculosis
KNVPTSRSES

SEQ ID NO: 1400463 - protein, 7 aa, Mycobacterium tuberculosis
KNVSATV

SEQ ID NO: 1400464 - protein, 5 aa, Mycobacterium tuberculosis
KPADI

SEQ ID NO: 1400465 - protein, 15 aa, Mycobacterium tuberculosis
KPAKAEDHDHHHGHA

SEQ ID NO: 1400466 - protein, 10 aa, Mycobacterium tuberculosis
KPASIDEARE

SEQ ID NO: 1400467 - protein, 9 aa, Mycobacterium tuberculosis
KPEESKRTF

SEQ ID NO: 1400468 - protein, 7 aa, Mycobacterium tuberculosis
KPEGVDR

SEQ ID NO: 1400469 - protein, 7 aa, Mycobacterium tuberculosis
KPERQRG

SEQ ID NO: 1400470 - protein, 7 aa, Mycobacterium tuberculosis
KPESVDT

SEQ ID NO: 1400471 - protein, 5 aa, Mycobacterium tuberculosis
KPGAG

SEQ ID NO: 1400472 - protein, 7 aa, Mycobacterium tuberculosis
KPGSAPD

SEQ ID NO: 1400473 - protein, 14 aa, Mycobacterium tuberculosis
KPHDSGERANLEQA

SEQ ID NO: 1400474 - protein, 14 aa, Mycobacterium tuberculosis
KPKAETAPSRYAAA

SEQ ID NO: 1400475 - protein, 6 aa, Mycobacterium tuberculosis
KPLRND

SEQ ID NO: 1400476 - protein, 7 aa, Mycobacterium tuberculosis
KPLSPSG

SEQ ID NO: 1400477 - protein, 9 aa, Mycobacterium tuberculosis
KPLSSAERR

SEQ ID NO: 1400478 - protein, 7 aa, Mycobacterium tuberculosis
KPPEGMT

SEQ ID NO: 1400479 - protein, 9 aa, Mycobacterium tuberculosis
KPPEPPALP

SEQ ID NO: 1400480 - protein, 9 aa, Mycobacterium tuberculosis
KPQAPIPQT

SEQ ID NO: 1400481 - protein, 15 aa, Mycobacterium tuberculosis
KPRAGEEVAGEETRL

SEQ ID NO: 1400482 - protein, 4 aa, Mycobacterium tuberculosis
KPRE

SEQ ID NO: 1400483 - protein, 7 aa, Mycobacterium tuberculosis
KPRPSDI

SEQ ID NO: 1400484 - protein, 7 aa, Mycobacterium tuberculosis
KPSKADI

SEQ ID NO: 1400485 - protein, 4 aa, Mycobacterium tuberculosis
KPSL

SEQ ID NO: 1400486 - protein, 6 aa, Mycobacterium tuberculosis
KPSRED

SEQ ID NO: 1400487 - protein, 5 aa, Mycobacterium tuberculosis
KPTVR

SEQ ID NO: 1400488 - protein, 4 aa, Mycobacterium tuberculosis
KPVQ

SEQ ID NO: 1400489 - protein, 7 aa, Mycobacterium tuberculosis
KQAAGVT

SEQ ID NO: 1400490 - protein, 6 aa, Mycobacterium tuberculosis
KQAEAY

SEQ ID NO: 1400491 - protein, 9 aa, Mycobacterium tuberculosis
KQAEEATDT

SEQ ID NO: 1400492 - protein, 5 aa, Mycobacterium tuberculosis
KQAER

SEQ ID NO: 1400493 - protein, 4 aa, Mycobacterium tuberculosis
KQAG

SEQ ID NO: 1400494 - protein, 5 aa, Mycobacterium tuberculosis
KQAGS

SEQ ID NO: 1400495 - protein, 14 aa, Mycobacterium tuberculosis
KQDGGTSPPPPFAP

SEQ ID NO: 1400496 - protein, 7 aa, Mycobacterium tuberculosis
KQDTTSA

SEQ ID NO: 1400497 - protein, 8 aa, Mycobacterium tuberculosis
KQEFPSSE

SEQ ID NO: 1400498 - protein, 10 aa, Mycobacterium tuberculosis
KQGHGEPNPT

SEQ ID NO: 1400499 - protein, 7 aa, Mycobacterium tuberculosis
KQGLSGA

SEQ ID NO: 1400500 - protein, 15 aa, Mycobacterium tuberculosis
KQGSRSRPKVEEQGL

SEQ ID NO: 1400501 - protein, 6 aa, Mycobacterium tuberculosis
KQKVGQ

SEQ ID NO: 1400502 - protein, 15 aa, Mycobacterium tuberculosis
KQPKTAPLAGNSIAT

SEQ ID NO: 1400503 - protein, 15 aa, Mycobacterium tuberculosis
KQPNQVVRAGSGGVR

SEQ ID NO: 1400504 - protein, 8 aa, Mycobacterium tuberculosis
KQSPVSTS

SEQ ID NO: 1400505 - protein, 16 aa, Mycobacterium tuberculosis
KQTDADVGSFDGGYGS

SEQ ID NO: 1400506 - protein, 7 aa, Mycobacterium tuberculosis
KRATEGY

SEQ ID NO: 1400507 - protein, 8 aa, Mycobacterium tuberculosis
KRENADEK

SEQ ID NO: 1400508 - protein, 10 aa, Mycobacterium tuberculosis
KRGDSDEDVA

SEQ ID NO: 1400509 - protein, 6 aa, Mycobacterium tuberculosis
KRGKRI

SEQ ID NO: 1400510 - protein, 10 aa, Mycobacterium tuberculosis
KRGNDSRSLV

SEQ ID NO: 1400511 - protein, 5 aa, Mycobacterium tuberculosis
KRGRP

SEQ ID NO: 1400512 - protein, 10 aa, Mycobacterium tuberculosis
KRLGENRKRD

SEQ ID NO: 1400513 - protein, 9 aa, Mycobacterium tuberculosis
KRLGSDKGM

SEQ ID NO: 1400514 - protein, 13 aa, Mycobacterium tuberculosis
KRPERQVSYEPSV

SEQ ID NO: 1400515 - protein, 5 aa, Mycobacterium tuberculosis
KRPRE

SEQ ID NO: 1400516 - protein, 7 aa, Mycobacterium tuberculosis
KRRPPGQ

SEQ ID NO: 1400517 - protein, 4 aa, Mycobacterium tuberculosis
KRRQ

SEQ ID NO: 1400518 - protein, 21 aa, Mycobacterium tuberculosis
KRRQKRGYDGVTSSRRSQVGP

SEQ ID NO: 1400519 - protein, 6 aa, Mycobacterium tuberculosis
KRRVTD

SEQ ID NO: 1400520 - protein, 6 aa, Mycobacterium tuberculosis
KRSDFD

SEQ ID NO: 1400521 - protein, 5 aa, Mycobacterium tuberculosis
KRSNT

SEQ ID NO: 1400522 - protein, 4 aa, Mycobacterium tuberculosis
KRTE

SEQ ID NO: 1400523 - protein, 5 aa, Mycobacterium tuberculosis
KRTGK

SEQ ID NO: 1400524 - protein, 6 aa, Mycobacterium tuberculosis
KRTGQR

SEQ ID NO: 1400525 - protein, 5 aa, Mycobacterium tuberculosis
KRTHE

SEQ ID NO: 1400526 - protein, 7 aa, Mycobacterium tuberculosis
KRTRGGK

SEQ ID NO: 1400527 - protein, 9 aa, Mycobacterium tuberculosis
KRVKDKEAS

SEQ ID NO: 1400528 - protein, 14 aa, Mycobacterium tuberculosis
KRYEELSDKVSEER

SEQ ID NO: 1400529 - protein, 6 aa, Mycobacterium tuberculosis
KRYQEA

SEQ ID NO: 1400530 - protein, 5 aa, Mycobacterium tuberculosis
KSAGT

SEQ ID NO: 1400531 - protein, 6 aa, Mycobacterium tuberculosis
KSALRS

SEQ ID NO: 1400532 - protein, 7 aa, Mycobacterium tuberculosis
KSAPECT

SEQ ID NO: 1400533 - protein, 7 aa, Mycobacterium tuberculosis
KSARLDN

SEQ ID NO: 1400534 - protein, 4 aa, Mycobacterium tuberculosis
KSAS

SEQ ID NO: 1400535 - protein, 8 aa, Mycobacterium tuberculosis
KSASGGEL

SEQ ID NO: 1400536 - protein, 6 aa, Mycobacterium tuberculosis
KSATGL

SEQ ID NO: 1400537 - protein, 8 aa, Mycobacterium tuberculosis
KSDMSTLT

SEQ ID NO: 1400538 - protein, 6 aa, Mycobacterium tuberculosis
KSEHAA

SEQ ID NO: 1400539 - protein, 5 aa, Mycobacterium tuberculosis
KSEPY

SEQ ID NO: 1400540 - protein, 7 aa, Mycobacterium tuberculosis
KSGSDAI

SEQ ID NO: 1400541 - protein, 6 aa, Mycobacterium tuberculosis
KSHTVT

SEQ ID NO: 1400542 - protein, 12 aa, Mycobacterium tuberculosis
KSLKDSDSPDKL

SEQ ID NO: 1400543 - protein, 8 aa, Mycobacterium tuberculosis
KSMSTGGV

SEQ ID NO: 1400544 - protein, 12 aa, Mycobacterium tuberculosis
KSMTPTSLGGTP

SEQ ID NO: 1400545 - protein, 15 aa, Mycobacterium tuberculosis
KSPAGEGIGPGTKTS

SEQ ID NO: 1400546 - protein, 8 aa, Mycobacterium tuberculosis
KSQGSQVD

SEQ ID NO: 1400547 - protein, 5 aa, Mycobacterium tuberculosis
KSQRV

SEQ ID NO: 1400548 - protein, 4 aa, Mycobacterium tuberculosis
KSRE

SEQ ID NO: 1400549 - protein, 14 aa, Mycobacterium tuberculosis
KSRGRIFDQVVDLT

SEQ ID NO: 1400550 - protein, 6 aa, Mycobacterium tuberculosis
KSRRPI

SEQ ID NO: 1400551 - protein, 7 aa, Mycobacterium tuberculosis
KSSAGTL

SEQ ID NO: 1400552 - protein, 7 aa, Mycobacterium tuberculosis
KSSHDID

SEQ ID NO: 1400553 - protein, 6 aa, Mycobacterium tuberculosis
KSSPTC

SEQ ID NO: 1400554 - protein, 8 aa, Mycobacterium tuberculosis
KSSPTVAG

SEQ ID NO: 1400555 - protein, 16 aa, Mycobacterium tuberculosis
KSVTNPDGSGIKGKEA

SEQ ID NO: 1400556 - protein, 6 aa, Mycobacterium tuberculosis
KSWQES

SEQ ID NO: 1400557 - protein, 8 aa, Mycobacterium tuberculosis
KSYPGAGH

SEQ ID NO: 1400558 - protein, 4 aa, Mycobacterium tuberculosis
KTAA

SEQ ID NO: 1400559 - protein, 9 aa, Mycobacterium tuberculosis
KTADTSDTV

SEQ ID NO: 1400560 - protein, 11 aa, Mycobacterium tuberculosis
KTAQQHGQHGE

SEQ ID NO: 1400561 - protein, 8 aa, Mycobacterium tuberculosis
KTDEDTAA

SEQ ID NO: 1400562 - protein, 4 aa, Mycobacterium tuberculosis
KTEQ

SEQ ID NO: 1400563 - protein, 35 aa, Mycobacterium tuberculosis
KTGGGVDPLTDAPAPITAQQRKESGIDAQPKRVQQ

SEQ ID NO: 1400564 - protein, 7 aa, Mycobacterium tuberculosis
KTGKAEK

SEQ ID NO: 1400565 - protein, 8 aa, Mycobacterium tuberculosis
KTIRGASR

SEQ ID NO: 1400566 - protein, 5 aa, Mycobacterium tuberculosis
KTKNN

SEQ ID NO: 1400567 - protein, 4 aa, Mycobacterium tuberculosis
KTMP

SEQ ID NO: 1400568 - protein, 5 aa, Mycobacterium tuberculosis
KTNLP

SEQ ID NO: 1400569 - protein, 9 aa, Mycobacterium tuberculosis
KTPAGKVDG

SEQ ID NO: 1400570 - protein, 5 aa, Mycobacterium tuberculosis
KTPRS

SEQ ID NO: 1400571 - protein, 13 aa, Mycobacterium tuberculosis
KTQPPLVLRDLAT

SEQ ID NO: 1400572 - protein, 6 aa, Mycobacterium tuberculosis
KTRAEA

SEQ ID NO: 1400573 - protein, 7 aa, Mycobacterium tuberculosis
KTRRPSV

SEQ ID NO: 1400574 - protein, 6 aa, Mycobacterium tuberculosis
KTSTTV

SEQ ID NO: 1400575 - protein, 5 aa, Mycobacterium tuberculosis
KTSVS

SEQ ID NO: 1400576 - protein, 7 aa, Mycobacterium tuberculosis
KTVDGRS

SEQ ID NO: 1400577 - protein, 12 aa, Mycobacterium tuberculosis
KTVNPSENRASD

SEQ ID NO: 1400578 - protein, 5 aa, Mycobacterium tuberculosis
KTWTS

SEQ ID NO: 1400579 - protein, 6 aa, Mycobacterium tuberculosis
KVAPAT

SEQ ID NO: 1400580 - protein, 18 aa, Mycobacterium tuberculosis
KVATRYPAQLSGGEQQRV

SEQ ID NO: 1400581 - protein, 10 aa, Mycobacterium tuberculosis
KVDAKQPGDY

SEQ ID NO: 1400582 - protein, 8 aa, Mycobacterium tuberculosis
KVDPGPTH

SEQ ID NO: 1400583 - protein, 8 aa, Mycobacterium tuberculosis
KVEDGKTD

SEQ ID NO: 1400584 - protein, 5 aa, Mycobacterium tuberculosis
KVERP

SEQ ID NO: 1400585 - protein, 4 aa, Mycobacterium tuberculosis
KVGE

SEQ ID NO: 1400586 - protein, 8 aa, Mycobacterium tuberculosis
KVNALGPA

SEQ ID NO: 1400587 - protein, 6 aa, Mycobacterium tuberculosis
KVPGRT

SEQ ID NO: 1400588 - protein, 7 aa, Mycobacterium tuberculosis
KVPGTAM

SEQ ID NO: 1400589 - protein, 5 aa, Mycobacterium tuberculosis
KVRGT

SEQ ID NO: 1400590 - protein, 7 aa, Mycobacterium tuberculosis
KVRPDDL

SEQ ID NO: 1400591 - protein, 22 aa, Mycobacterium tuberculosis
KVRSGRSSRPRTKTRPEHADAE

SEQ ID NO: 1400592 - protein, 11 aa, Mycobacterium tuberculosis
KVSETSDHGYP

SEQ ID NO: 1400593 - protein, 6 aa, Mycobacterium tuberculosis
KVSPTV

SEQ ID NO: 1400594 - protein, 8 aa, Mycobacterium tuberculosis
KVTSDELG

SEQ ID NO: 1400595 - protein, 15 aa, Mycobacterium tuberculosis
KYESADGPDGQSAPD

SEQ ID NO: 1400596 - protein, 7 aa, Mycobacterium tuberculosis
KYGGRDA

SEQ ID NO: 1400597 - protein, 6 aa, Mycobacterium tuberculosis
KYGKKL

SEQ ID NO: 1400598 - protein, 12 aa, Mycobacterium tuberculosis
KYGPFGRNAPAA

SEQ ID NO: 1400599 - protein, 5 aa, Mycobacterium tuberculosis
KYRDT

SEQ ID NO: 1400600 - protein, 5 aa, Mycobacterium tuberculosis
LAADA

SEQ ID NO: 1400601 - protein, 10 aa, Mycobacterium tuberculosis
LAADARDTCR

SEQ ID NO: 1400602 - protein, 17 aa, Mycobacterium tuberculosis
LAAGGGAGVTPQATQAI

SEQ ID NO: 1400603 - protein, 8 aa, Mycobacterium tuberculosis
LAAGQKPT

SEQ ID NO: 1400604 - protein, 10 aa, Mycobacterium tuberculosis
LAASTGVPQE

SEQ ID NO: 1400605 - protein, 8 aa, Mycobacterium tuberculosis
LADNEAAT

SEQ ID NO: 1400606 - protein, 6 aa, Mycobacterium tuberculosis
LADPEF

SEQ ID NO: 1400607 - protein, 6 aa, Mycobacterium tuberculosis
LADQAE

SEQ ID NO: 1400608 - protein, 8 aa, Mycobacterium tuberculosis
LADSGGDG

SEQ ID NO: 1400609 - protein, 9 aa, Mycobacterium tuberculosis
LADSGSTFD

SEQ ID NO: 1400610 - protein, 13 aa, Mycobacterium tuberculosis
LAEAAKAGIGGSD

SEQ ID NO: 1400611 - protein, 7 aa, Mycobacterium tuberculosis
LAEGGGQ

SEQ ID NO: 1400612 - protein, 6 aa, Mycobacterium tuberculosis
LAEGTQ

SEQ ID NO: 1400613 - protein, 8 aa, Mycobacterium tuberculosis
LAERDEEV

SEQ ID NO: 1400614 - protein, 9 aa, Mycobacterium tuberculosis
LAETDGDFD

SEQ ID NO: 1400615 - protein, 12 aa, Mycobacterium tuberculosis
LAGATDDDRRRV

SEQ ID NO: 1400616 - protein, 8 aa, Mycobacterium tuberculosis
LAGDDESN

SEQ ID NO: 1400617 - protein, 32 aa, Mycobacterium tuberculosis; identical to SEQ ID NO: 179767

SEQ ID NO: 1400618 - protein, 7 aa, Mycobacterium tuberculosis
LAGPARP

SEQ ID NO: 1400619 - protein, 9 aa, Mycobacterium tuberculosis
LAGRRTDPQ

SEQ ID NO: 1400620 - protein, 10 aa, Mycobacterium tuberculosis
LAGSGGTDHQ

SEQ ID NO: 1400621 - protein, 7 aa, Mycobacterium tuberculosis
LAGVSGS

SEQ ID NO: 1400622 - protein, 10 aa, Mycobacterium tuberculosis
LAKNPQKAKK

SEQ ID NO: 1400623 - protein, 4 aa, Mycobacterium tuberculosis
LAPD

SEQ ID NO: 1400624 - protein, 7 aa, Mycobacterium tuberculosis
LAPDAQR

SEQ ID NO: 1400625 - protein, 9 aa, Mycobacterium tuberculosis
LAPDDSVSD

SEQ ID NO: 1400626 - protein, 6 aa, Mycobacterium tuberculosis
LAPEGA

SEQ ID NO: 1400627 - protein, 15 aa, Mycobacterium tuberculosis
LAPSDASELKARADA

SEQ ID NO: 1400628 - protein, 5 aa, Mycobacterium tuberculosis
LAPST

SEQ ID NO: 1400629 - protein, 9 aa, Mycobacterium tuberculosis
LAQPPPGSI

SEQ ID NO: 1400630 - protein, 10 aa, Mycobacterium tuberculosis
LARDRTRHQV

SEQ ID NO: 1400631 - protein, 7 aa, Mycobacterium tuberculosis
LAREDSD

SEQ ID NO: 1400632 - protein, 13 aa, Mycobacterium tuberculosis
LARPAPPSTEYTR

SEQ ID NO: 1400633 - protein, 7 aa, Mycobacterium tuberculosis
LARPTST

SEQ ID NO: 1400634 - protein, 7 aa, Mycobacterium tuberculosis
LARSPTV

SEQ ID NO: 1400635 - protein, 10 aa, Mycobacterium tuberculosis
LASAQSQALR

SEQ ID NO: 1400636 - protein, 10 aa, Mycobacterium tuberculosis
LASESGPLRP

SEQ ID NO: 1400637 - protein, 9 aa, Mycobacterium tuberculosis
LASPGPTDV

SEQ ID NO: 1400638 - protein, 6 aa, Mycobacterium tuberculosis
LASPGQ

SEQ ID NO: 1400639 - protein, 18 aa, Mycobacterium tuberculosis
LASQASRAMSATYRPSSF

SEQ ID NO: 1400640 - protein, 7 aa, Mycobacterium tuberculosis
LASRGVP

SEQ ID NO: 1400641 - protein, 7 aa, Mycobacterium tuberculosis
LASRSTA

SEQ ID NO: 1400642 - protein, 7 aa, Mycobacterium tuberculosis
LASSSTI

SEQ ID NO: 1400643 - protein, 7 aa, Mycobacterium tuberculosis
LATNGEL

SEQ ID NO: 1400644 - protein, 6 aa, Mycobacterium tuberculosis
LDAGDD

SEQ ID NO: 1400645 - protein, 9 aa, Mycobacterium tuberculosis
LDAGGSETL

SEQ ID NO: 1400646 - protein, 11 aa, Mycobacterium tuberculosis
LDDAGESSSDV

SEQ ID NO: 1400647 - protein, 5 aa, Mycobacterium tuberculosis
LDDPA

SEQ ID NO: 1400648 - protein, 10 aa, Mycobacterium tuberculosis
LDDPVGPDAP

SEQ ID NO: 1400649 - protein, 6 aa, Mycobacterium tuberculosis
LDDSQP

SEQ ID NO: 1400650 - protein, 10 aa, Mycobacterium tuberculosis
LDEDQDPPAD

SEQ ID NO: 1400651 - protein, 6 aa, Mycobacterium tuberculosis
LDEDTE

SEQ ID NO: 1400652 - protein, 8 aa, Mycobacterium tuberculosis
LDGRADPG

SEQ ID NO: 1400653 - protein, 10 aa, Mycobacterium tuberculosis
LDGRQPQLGT

SEQ ID NO: 1400654 - protein, 9 aa, Mycobacterium tuberculosis
LDGRRGPQV

SEQ ID NO: 1400655 - protein, 5 aa, Mycobacterium tuberculosis
LDGRS

SEQ ID NO: 1400656 - protein, 14 aa, Mycobacterium tuberculosis
LDGSPASGGSAAQD

SEQ ID NO: 1400657 - protein, 7 aa, Mycobacterium tuberculosis
LDGSPLR

SEQ ID NO: 1400658 - protein, 11 aa, Mycobacterium tuberculosis
LDGSTEQSTVG

SEQ ID NO: 1400659 - protein, 11 aa, Mycobacterium tuberculosis
LDKDTSALRGE

SEQ ID NO: 1400660 - protein, 12 aa, Mycobacterium tuberculosis
LDPASLAGSSTA

SEQ ID NO: 1400661 - protein, 6 aa, Mycobacterium tuberculosis
LDPDGT

SEQ ID NO: 1400662 - protein, 5 aa, Mycobacterium tuberculosis
LDPDI

SEQ ID NO: 1400663 - protein, 8 aa, Mycobacterium tuberculosis
LDPDTPRQ

SEQ ID NO: 1400664 - protein, 7 aa, Mycobacterium tuberculosis
LDPETGH

SEQ ID NO: 1400665 - protein, 8 aa, Mycobacterium tuberculosis
LDPGAGEN

SEQ ID NO: 1400666 - protein, 7 aa, Mycobacterium tuberculosis
LDPGQPV

SEQ ID NO: 1400667 - protein, 5 aa, Mycobacterium tuberculosis
LDPGT

SEQ ID NO: 1400668 - protein, 11 aa, Mycobacterium tuberculosis
LDPGTPDTATP

SEQ ID NO: 1400669 - protein, 10 aa, Mycobacterium tuberculosis
LDPKGTGQTK

SEQ ID NO: 1400670 - protein, 5 aa, Mycobacterium tuberculosis
LDPLA

SEQ ID NO: 1400671 - protein, 14 aa, Mycobacterium tuberculosis
LDPNDKVNGRPHGL

SEQ ID NO: 1400672 - protein, 12 aa, Mycobacterium tuberculosis
LDPSQPDDAPAR

SEQ ID NO: 1400673 - protein, 8 aa, Mycobacterium tuberculosis
LDPSTEKL

SEQ ID NO: 1400674 - protein, 6 aa, Mycobacterium tuberculosis
LDQGRS

SEQ ID NO: 1400675 - protein, 10 aa, Mycobacterium tuberculosis
LDQPDTGTIT

SEQ ID NO: 1400676 - protein, 6 aa, Mycobacterium tuberculosis
LDQQHP

SEQ ID NO: 1400677 - protein, 11 aa, Mycobacterium tuberculosis
LDQSGPTVSQT

SEQ ID NO: 1400678 - protein, 9 aa, Mycobacterium tuberculosis
LDRDGRGNL

SEQ ID NO: 1400679 - protein, 20 aa, Mycobacterium tuberculosis
LDREDRARAEARRAAAEQTL

SEQ ID NO: 1400680 - protein, 4 aa, Mycobacterium tuberculosis
LDRS

SEQ ID NO: 1400681 - protein, 9 aa, Mycobacterium tuberculosis
LDRTSTGAG

SEQ ID NO: 1400682 - protein, 6 aa, Mycobacterium tuberculosis
LDSEAR

SEQ ID NO: 1400683 - protein, 8 aa, Mycobacterium tuberculosis
LDSETRQD

SEQ ID NO: 1400684 - protein, 7 aa, Mycobacterium tuberculosis
LDSSEAV

SEQ ID NO: 1400685 - protein, 6 aa, Mycobacterium tuberculosis
LDSSSP

SEQ ID NO: 1400686 - protein, 6 aa, Mycobacterium tuberculosis
LDTEED

SEQ ID NO: 1400687 - protein, 22 aa, Mycobacterium tuberculosis
LDTQGVKNRKQARSRYGAKKEK

SEQ ID NO: 1400688 - protein, 6 aa, Mycobacterium tuberculosis
LEAGAD

SEQ ID NO: 1400689 - protein, 8 aa, Mycobacterium tuberculosis
LEAGGGPR

SEQ ID NO: 1400690 - protein, 9 aa, Mycobacterium tuberculosis
LEASDAARP

SEQ ID NO: 1400691 - protein, 10 aa, Mycobacterium tuberculosis
LEDAAAASAV

SEQ ID NO: 1400692 - protein, 9 aa, Mycobacterium tuberculosis
LEDDPSHPK

SEQ ID NO: 1400693 - protein, 14 aa, Mycobacterium tuberculosis
LEGGQAFTAEDQPR

SEQ ID NO: 1400694 - protein, 11 aa, Mycobacterium tuberculosis
LEGSSRSGDQL

SEQ ID NO: 1400695 - protein, 4 aa, Mycobacterium tuberculosis
LENG

SEQ ID NO: 1400696 - protein, 10 aa, Mycobacterium tuberculosis
LENRNDDEAV

SEQ ID NO: 1400697 - protein, 16 aa, Mycobacterium tuberculosis
LEPGGRPDAPEPGPSM

SEQ ID NO: 1400698 - protein, 5 aa, Mycobacterium tuberculosis
LEPGR

SEQ ID NO: 1400699 - protein, 5 aa, Mycobacterium tuberculosis
LEPSI

SEQ ID NO: 1400700 - protein, 8 aa, Mycobacterium tuberculosis
LEPTEGYR

SEQ ID NO: 1400701 - protein, 6 aa, Mycobacterium tuberculosis
LEQGTN

SEQ ID NO: 1400702 - protein, 15 aa, Mycobacterium tuberculosis
LEQYGSDVLQLVRGR

SEQ ID NO: 1400703 - protein, 12 aa, Mycobacterium tuberculosis
LERSPNSRMSAP

SEQ ID NO: 1400704 - protein, 4 aa, Mycobacterium tuberculosis
LESA

SEQ ID NO: 1400705 - protein, 9 aa, Mycobacterium tuberculosis
LESEQGEKV

SEQ ID NO: 1400706 - protein, 5 aa, Mycobacterium tuberculosis
LEVDT

SEQ ID NO: 1400707 - protein, 14 aa, Mycobacterium tuberculosis
LGAATAAAAAQTTG

SEQ ID NO: 1400708 - protein, 9 aa, Mycobacterium tuberculosis
LGAATGALA

SEQ ID NO: 1400709 - protein, 8 aa, Mycobacterium tuberculosis
LGAQPTAD

SEQ ID NO: 1400710 - protein, 5 aa, Mycobacterium tuberculosis
LGASR

SEQ ID NO: 1400711 - protein, 5 aa, Mycobacterium tuberculosis
LGATG

SEQ ID NO: 1400712 - protein, 7 aa, Mycobacterium tuberculosis
LGDDATV

SEQ ID NO: 1400713 - protein, 8 aa, Mycobacterium tuberculosis
LGDDGDPL

SEQ ID NO: 1400714 - protein, 10 aa, Mycobacterium tuberculosis
LGDGARAAFS

SEQ ID NO: 1400715 - protein, 7 aa, Mycobacterium tuberculosis
LGDNERT

SEQ ID NO: 1400716 - protein, 6 aa, Mycobacterium tuberculosis
LGDPEA

SEQ ID NO: 1400717 - protein, 11 aa, Mycobacterium tuberculosis
LGDPPGGWPEP

SEQ ID NO: 1400718 - protein, 15 aa, Mycobacterium tuberculosis
LGDRQRKALLEKFGS

SEQ ID NO: 1400719 - protein, 9 aa, Mycobacterium tuberculosis
LGDSGEADV

SEQ ID NO: 1400720 - protein, 12 aa, Mycobacterium tuberculosis
LGDTRARTRTGA

SEQ ID NO: 1400721 - protein, 8 aa, Mycobacterium tuberculosis
LGEASPLG

SEQ ID NO: 1400722 - protein, 13 aa, Mycobacterium tuberculosis
LGEDEASDNDYSE

SEQ ID NO: 1400723 - protein, 7 aa, Mycobacterium tuberculosis
LGEEAGA

SEQ ID NO: 1400724 - protein, 7 aa, Mycobacterium tuberculosis
LGEQPQV

SEQ ID NO: 1400725 - protein, 15 aa, Mycobacterium tuberculosis
LGETRQTVRTSGTPF

SEQ ID NO: 1400726 - protein, 9 aa, Mycobacterium tuberculosis
LGGAGGELA

SEQ ID NO: 1400727 - protein, 5 aa, Mycobacterium tuberculosis
LGGDD

SEQ ID NO: 1400728 - protein, 7 aa, Mycobacterium tuberculosis
LGGDPAT

SEQ ID NO: 1400729 - protein, 23 aa, Mycobacterium tuberculosis
LGGEHSDSTNTELANPSSTTTRI

SEQ ID NO: 1400730 - protein, 6 aa, Mycobacterium tuberculosis
LGGGAV

SEQ ID NO: 1400731 - protein, 4 aa, Mycobacterium tuberculosis
LGGK

SEQ ID NO: 1400732 - protein, 12 aa, Mycobacterium tuberculosis
LGGNPDKVNPLA

SEQ ID NO: 1400733 - protein, 13 aa, Mycobacterium tuberculosis
LGGRAGDPGARDA

SEQ ID NO: 1400734 - protein, 11 aa, Mycobacterium tuberculosis
LGGRKTLDPAV

SEQ ID NO: 1400735 - protein, 14 aa, Mycobacterium tuberculosis
LGGSSSRRADGAYR

SEQ ID NO: 1400736 - protein, 10 aa, Mycobacterium tuberculosis
LGNAGSSNYG

SEQ ID NO: 1400737 - protein, 6 aa, Mycobacterium tuberculosis
LGNPAT

SEQ ID NO: 1400738 - protein, 4 aa, Mycobacterium tuberculosis
LGNS

SEQ ID NO: 1400739 - protein, 8 aa, Mycobacterium tuberculosis
LGNTPQRV

SEQ ID NO: 1400740 - protein, 9 aa, Mycobacterium tuberculosis
LGPAPARES

SEQ ID NO: 1400741 - protein, 11 aa, Mycobacterium tuberculosis
LGPDDLRSRNP

SEQ ID NO: 1400742 - protein, 11 aa, Mycobacterium tuberculosis
LGPDDPTTVER

SEQ ID NO: 1400743 - protein, 9 aa, Mycobacterium tuberculosis
LGPDGARAQ

SEQ ID NO: 1400744 - protein, 9 aa, Mycobacterium tuberculosis
LGPDRVKPG

SEQ ID NO: 1400745 - protein, 5 aa, Mycobacterium tuberculosis
LGPDS

SEQ ID NO: 1400746 - protein, 6 aa, Mycobacterium tuberculosis
LGPEEC

SEQ ID NO: 1400747 - protein, 5 aa, Mycobacterium tuberculosis
LGPEH

SEQ ID NO: 1400748 - protein, 5 aa, Mycobacterium tuberculosis
LGPGH

SEQ ID NO: 1400749 - protein, 8 aa, Mycobacterium tuberculosis
LGPGTGTV

SEQ ID NO: 1400750 - protein, 8 aa, Mycobacterium tuberculosis
LGPPPPDL

SEQ ID NO: 1400751 - protein, 12 aa, Mycobacterium tuberculosis
LGPPQKAQSAKP

SEQ ID NO: 1400752 - protein, 10 aa, Mycobacterium tuberculosis
LGPSGSGKST

SEQ ID NO: 1400753 - protein, 8 aa, Mycobacterium tuberculosis
LGQAENPQ

SEQ ID NO: 1400754 - protein, 7 aa, Mycobacterium tuberculosis
LGRGPAV

SEQ ID NO: 1400755 - protein, 8 aa, Mycobacterium tuberculosis
LGSADSAH

SEQ ID NO: 1400756 - protein, 9 aa, Mycobacterium tuberculosis
LGSDGGGSI

SEQ ID NO: 1400757 - protein, 11 aa, Mycobacterium tuberculosis
LGSDRRQATAA

SEQ ID NO: 1400758 - protein, 5 aa, Mycobacterium tuberculosis
LGSSV

SEQ ID NO: 1400759 - protein, 17 aa, Mycobacterium tuberculosis
LGTNPRKSTKTGAGERD

SEQ ID NO: 1400760 - protein, 5 aa, Mycobacterium tuberculosis
LGVDT

SEQ ID NO: 1400761 - protein, 16 aa, Mycobacterium tuberculosis
LGVGSDAVRTNANADA

SEQ ID NO: 1400762 - protein, 6 aa, Mycobacterium tuberculosis
LHGGAN

SEQ ID NO: 1400763 - protein, 10 aa, Mycobacterium tuberculosis
LHPSSAETLR

SEQ ID NO: 1400764 - protein, 6 aa, Mycobacterium tuberculosis
LHTNRG

SEQ ID NO: 1400765 - protein, 10 aa, Mycobacterium tuberculosis
LKNQTYNTPA

SEQ ID NO: 1400766 - protein, 12 aa, Mycobacterium tuberculosis
LKPAQPHRQTGG

SEQ ID NO: 1400767 - protein, 8 aa, Mycobacterium tuberculosis
LKPGSPDG

SEQ ID NO: 1400768 - protein, 4 aa, Mycobacterium tuberculosis
LKPQ

SEQ ID NO: 1400769 - protein, 7 aa, Mycobacterium tuberculosis
LKPSPKI

SEQ ID NO: 1400770 - protein, 15 aa, Mycobacterium tuberculosis
LKVDSRDGSYLGRVN

SEQ ID NO: 1400771 - protein, 15 aa, Mycobacterium tuberculosis
LNAQNAAAATPTTGV

SEQ ID NO: 1400772 - protein, 7 aa, Mycobacterium tuberculosis
LNHTGSH

SEQ ID NO: 1400773 - protein, 7 aa, Mycobacterium tuberculosis
LNPAQIG

SEQ ID NO: 1400774 - protein, 8 aa, Mycobacterium tuberculosis
LNPGGNNF

SEQ ID NO: 1400775 - protein, 9 aa, Mycobacterium tuberculosis
LNPKAPEIP

SEQ ID NO: 1400776 - protein, 6 aa, Mycobacterium tuberculosis
LNPSTG

SEQ ID NO: 1400777 - protein, 8 aa, Mycobacterium tuberculosis
LNSGNGNV

SEQ ID NO: 1400778 - protein, 10 aa, Mycobacterium tuberculosis
LNTDDNVTAA

SEQ ID NO: 1400779 - protein, 22 aa, Mycobacterium tuberculosis
LNTGVGNTGNVNTGGFNSGNYS

SEQ ID NO: 1400780 - protein, 9 aa, Mycobacterium tuberculosis
LPADTVPDD

SEQ ID NO: 1400781 - protein, 9 aa, Mycobacterium tuberculosis
LPAETGPAP

SEQ ID NO: 1400782 - protein, 6 aa, Mycobacterium tuberculosis
LPAGGN

SEQ ID NO: 1400783 - protein, 18 aa, Mycobacterium tuberculosis
LPAGPAYYPDGELTDEPE

SEQ ID NO: 1400784 - protein, 6 aa, Mycobacterium tuberculosis
LPAPGC

SEQ ID NO: 1400785 - protein, 9 aa, Mycobacterium tuberculosis
LPAPGEPKR

SEQ ID NO: 1400786 - protein, 6 aa, Mycobacterium tuberculosis
LPARPA

SEQ ID NO: 1400787 - protein, 8 aa, Mycobacterium tuberculosis
LPATPQRL

SEQ ID NO: 1400788 - protein, 15 aa, Mycobacterium tuberculosis
LPATSLAAAPATQIP

SEQ ID NO: 1400789 - protein, 8 aa, Mycobacterium tuberculosis
LPDDPAGL

SEQ ID NO: 1400790 - protein, 9 aa, Mycobacterium tuberculosis
LPDDQHQHL

SEQ ID NO: 1400791 - protein, 6 aa, Mycobacterium tuberculosis
LPDTDQ

SEQ ID NO: 1400792 - protein, 6 aa, Mycobacterium tuberculosis
LPDTEI

SEQ ID NO: 1400793 - protein, 11 aa, Mycobacterium tuberculosis
LPEATSAAQLR

SEQ ID NO: 1400794 - protein, 6 aa, Mycobacterium tuberculosis
LPEDEQ

SEQ ID NO: 1400795 - protein, 6 aa, Mycobacterium tuberculosis
LPEEKR

SEQ ID NO: 1400796 - protein, 13 aa, Mycobacterium tuberculosis
LPEGYQATELTPG

SEQ ID NO: 1400797 - protein, 5 aa, Mycobacterium tuberculosis
LPEPK

SEQ ID NO: 1400798 - protein, 5 aa, Mycobacterium tuberculosis
LPEQG

SEQ ID NO: 1400799 - protein, 12 aa, Mycobacterium tuberculosis
LPERERAAKRLG

SEQ ID NO: 1400800 - protein, 4 aa, Mycobacterium tuberculosis
LPES

SEQ ID NO: 1400801 - protein, 5 aa, Mycobacterium tuberculosis
LPGEE

SEQ ID NO: 1400802 - protein, 15 aa, Mycobacterium tuberculosis
LPGGPLSKLGSKGRD

SEQ ID NO: 1400803 - protein, 13 aa, Mycobacterium tuberculosis
LPGNRSDIRERST

SEQ ID NO: 1400804 - protein, 9 aa, Mycobacterium tuberculosis
LPGPHYETP

SEQ ID NO: 1400805 - protein, 6 aa, Mycobacterium tuberculosis
LPGPRL

SEQ ID NO: 1400806 - protein, 11 aa, Mycobacterium tuberculosis
LPGSANVTTGQ

SEQ ID NO: 1400807 - protein, 12 aa, Mycobacterium tuberculosis
LPGTGPDAPTCP

SEQ ID NO: 1400808 - protein, 7 aa, Mycobacterium tuberculosis
LPKPEPL

SEQ ID NO: 1400809 - protein, 7 aa, Mycobacterium tuberculosis
LPKPQTQ

SEQ ID NO: 1400810 - protein, 7 aa, Mycobacterium tuberculosis
LPKRRPV

SEQ ID NO: 1400811 - protein, 13 aa, Mycobacterium tuberculosis
LPLPSRAHDGDAG

SEQ ID NO: 1400812 - protein, 11 aa, Mycobacterium tuberculosis
LPLSDRDDDHM

SEQ ID NO: 1400813 - protein, 6 aa, Mycobacterium tuberculosis
LPPATS

SEQ ID NO: 1400814 - protein, 5 aa, Mycobacterium tuberculosis
LPPDQ

SEQ ID NO: 1400815 - protein, 16 aa, Mycobacterium tuberculosis
LPPEEAASIPQTPTQL

SEQ ID NO: 1400816 - protein, 11 aa, Mycobacterium tuberculosis
LPPGADTPTEL

SEQ ID NO: 1400817 - protein, 6 aa, Mycobacterium tuberculosis
LPPLPT

SEQ ID NO: 1400818 - protein, 7 aa, Mycobacterium tuberculosis
LPPPASQ

SEQ ID NO: 1400819 - protein, 8 aa, Mycobacterium tuberculosis
LPPPRPAV

SEQ ID NO: 1400820 - protein, 19 aa, Mycobacterium tuberculosis
LPPSGASNGLVRRVLGRFV

SEQ ID NO: 1400821 - protein, 6 aa, Mycobacterium tuberculosis
LPPSQA

SEQ ID NO: 1400822 - protein, 5 aa, Mycobacterium tuberculosis
LPPTA

SEQ ID NO: 1400823 - protein, 15 aa, Mycobacterium tuberculosis
LPPTATGVRAAGDPD

SEQ ID NO: 1400824 - protein, 8 aa, Mycobacterium tuberculosis
LPQGGPYE

SEQ ID NO: 1400825 - protein, 12 aa, Mycobacterium tuberculosis
LPQGPPPPKAFG

SEQ ID NO: 1400826 - protein, 8 aa, Mycobacterium tuberculosis
LPQPGAQD

SEQ ID NO: 1400827 - protein, 19 aa, Mycobacterium tuberculosis
LPRDPRSEQPWNPEPLAGN

SEQ ID NO: 1400828 - protein, 15 aa, Mycobacterium tuberculosis
LPREKSPVLQTLAML

SEQ ID NO: 1400829 - protein, 7 aa, Mycobacterium tuberculosis
LPRGGAD

SEQ ID NO: 1400830 - protein, 9 aa, Mycobacterium tuberculosis
LPRPARDEL

SEQ ID NO: 1400831 - protein, 9 aa, Mycobacterium tuberculosis
LPRPEGPPI

SEQ ID NO: 1400832 - protein, 18 aa, Mycobacterium tuberculosis
LPRPRADHSRGRRVSKPV

SEQ ID NO: 1400833 - protein, 6 aa, Mycobacterium tuberculosis
LPRPRG

SEQ ID NO: 1400834 - protein, 4 aa, Mycobacterium tuberculosis
LPSA

SEQ ID NO: 1400835 - protein, 8 aa, Mycobacterium tuberculosis
LPSDATLS

SEQ ID NO: 1400836 - protein, 5 aa, Mycobacterium tuberculosis
LPSHD

SEQ ID NO: 1400837 - protein, 11 aa, Mycobacterium tuberculosis
LPSPEEAAAAE

SEQ ID NO: 1400838 - protein, 9 aa, Mycobacterium tuberculosis
LPSPSGRAG

SEQ ID NO: 1400839 - protein, 5 aa, Mycobacterium tuberculosis
LPTDA

SEQ ID NO: 1400840 - protein, 16 aa, Mycobacterium tuberculosis
LPTGVKDEFDALKERL

SEQ ID NO: 1400841 - protein, 4 aa, Mycobacterium tuberculosis
LPTI

SEQ ID NO: 1400842 - protein, 10 aa, Mycobacterium tuberculosis
LPTPSEPQQR

SEQ ID NO: 1400843 - protein, 10 aa, Mycobacterium tuberculosis
LPTSGGTAAK

SEQ ID NO: 1400844 - protein, 14 aa, Mycobacterium tuberculosis
LPTSTRTGAGMGSW

SEQ ID NO: 1400845 - protein, 6 aa, Mycobacterium tuberculosis
LPTTSI

SEQ ID NO: 1400846 - protein, 4 aa, Mycobacterium tuberculosis
LPTV

SEQ ID NO: 1400847 - protein, 10 aa, Mycobacterium tuberculosis
LQAPSTDPDV

SEQ ID NO: 1400848 - protein, 5 aa, Mycobacterium tuberculosis
LQAPY

SEQ ID NO: 1400849 - protein, 9 aa, Mycobacterium tuberculosis
LQEEARDAA

SEQ ID NO: 1400850 - protein, 11 aa, Mycobacterium tuberculosis
LQGDPASSLPD

SEQ ID NO: 1400851 - protein, 7 aa, Mycobacterium tuberculosis
LQGGFGQ

SEQ ID NO: 1400852 - protein, 6 aa, Mycobacterium tuberculosis
LQPGGL

SEQ ID NO: 1400853 - protein, 6 aa, Mycobacterium tuberculosis
LQPGPT

SEQ ID NO: 1400854 - protein, 7 aa, Mycobacterium tuberculosis
LQPGSTV

SEQ ID NO: 1400855 - protein, 4 aa, Mycobacterium tuberculosis
LQPH

SEQ ID NO: 1400856 - protein, 4 aa, Mycobacterium tuberculosis
LQPP

SEQ ID NO: 1400857 - protein, 5 aa, Mycobacterium tuberculosis
LQRPT

SEQ ID NO: 1400858 - protein, 13 aa, Mycobacterium tuberculosis
LQSNKDKAIEVTS

SEQ ID NO: 1400859 - protein, 8 aa, Mycobacterium tuberculosis
LRAGPPTV

SEQ ID NO: 1400860 - protein, 5 aa, Mycobacterium tuberculosis
LRDDS

SEQ ID NO: 1400861 - protein, 16 aa, Mycobacterium tuberculosis
LRDPGARVPANLGTEP

SEQ ID NO: 1400862 - protein, 6 aa, Mycobacterium tuberculosis
LRDSEP

SEQ ID NO: 1400863 - protein, 9 aa, Mycobacterium tuberculosis
LRGGGDATQ

SEQ ID NO: 1400864 - protein, 14 aa, Mycobacterium tuberculosis
LRGGPTRLKSSGRD

SEQ ID NO: 1400865 - protein, 7 aa, Mycobacterium tuberculosis
LRGPNGD

SEQ ID NO: 1400866 - protein, 8 aa, Mycobacterium tuberculosis
LRGQTRNQ

SEQ ID NO: 1400867 - protein, 5 aa, Mycobacterium tuberculosis
LRGSV

SEQ ID NO: 1400868 - protein, 12 aa, Mycobacterium tuberculosis
LRNSAKRKRNQG

SEQ ID NO: 1400869 - protein, 8 aa, Mycobacterium tuberculosis
LRPDRPSV

SEQ ID NO: 1400870 - protein, 9 aa, Mycobacterium tuberculosis
LRPEERQTT

SEQ ID NO: 1400871 - protein, 9 aa, Mycobacterium tuberculosis
LRPEGRNGE

SEQ ID NO: 1400872 - protein, 9 aa, Mycobacterium tuberculosis
LRPEGRNGP

SEQ ID NO: 1400873 - protein, 4 aa, Mycobacterium tuberculosis
LRPG

SEQ ID NO: 1400874 - protein, 6 aa, Mycobacterium tuberculosis
LRPGAT

SEQ ID NO: 1400875 - protein, 12 aa, Mycobacterium tuberculosis
LRPKDYSEARTI

SEQ ID NO: 1400876 - protein, 5 aa, Mycobacterium tuberculosis
LRPPD

SEQ ID NO: 1400877 - protein, 12 aa, Mycobacterium tuberculosis
LRPPDPEPGSKA

SEQ ID NO: 1400878 - protein, 5 aa, Mycobacterium tuberculosis
LRPPK

SEQ ID NO: 1400879 - protein, 6 aa, Mycobacterium tuberculosis
LRPRPE

SEQ ID NO: 1400880 - protein, 10 aa, Mycobacterium tuberculosis
LRPSGLTNTQ

SEQ ID NO: 1400881 - protein, 8 aa, Mycobacterium tuberculosis
LRQGAKGG

SEQ ID NO: 1400882 - protein, 11 aa, Mycobacterium tuberculosis
LRQTGGDPREA

SEQ ID NO: 1400883 - protein, 4 aa, Mycobacterium tuberculosis
LRRD

SEQ ID NO: 1400884 - protein, 20 aa, Mycobacterium tuberculosis
LRREESRGAHQRTDFPNRDD

SEQ ID NO: 1400885 - protein, 7 aa, Mycobacterium tuberculosis
LRSPSGV

SEQ ID NO: 1400886 - protein, 5 aa, Mycobacterium tuberculosis
LRSPT

SEQ ID NO: 1400887 - protein, 4 aa, Mycobacterium tuberculosis
LRTG

SEQ ID NO: 1400888 - protein, 7 aa, Mycobacterium tuberculosis
LSAAAAK

SEQ ID NO: 1400889 - protein, 4 aa, Mycobacterium tuberculosis
LSAD

SEQ ID NO: 1400890 - protein, 12 aa, Mycobacterium tuberculosis
LSASKGAARRTI

SEQ ID NO: 1400891 - protein, 7 aa, Mycobacterium tuberculosis
LSATTGQ

SEQ ID NO: 1400892 - protein, 6 aa, Mycobacterium tuberculosis
LSDEDL

SEQ ID NO: 1400893 - protein, 9 aa, Mycobacterium tuberculosis
LSDHPPPDL

SEQ ID NO: 1400894 - protein, 8 aa, Mycobacterium tuberculosis
LSEADPPL

SEQ ID NO: 1400895 - protein, 7 aa, Mycobacterium tuberculosis
LSEEDKQ

SEQ ID NO: 1400896 - protein, 4 aa, Mycobacterium tuberculosis
LSES

SEQ ID NO: 1400897 - protein, 8 aa, Mycobacterium tuberculosis
LSESGEAD

SEQ ID NO: 1400898 - protein, 7 aa, Mycobacterium tuberculosis
LSETGHS

SEQ ID NO: 1400899 - protein, 20 aa, Mycobacterium tuberculosis
LSGARTTGARLDDADLRGAT

SEQ ID NO: 1400900 - protein, 8 aa, Mycobacterium tuberculosis
LSGEEAER

SEQ ID NO: 1400901 - protein, 8 aa, Mycobacterium tuberculosis
LSGGQQQR

SEQ ID NO: 1400902 - protein, 8 aa, Mycobacterium tuberculosis
LSGGQRAR

SEQ ID NO: 1400903 - protein, 21 aa, Mycobacterium tuberculosis
LSGPAARRAAAARRLLAVLSQ

SEQ ID NO: 1400904 - protein, 7 aa, Mycobacterium tuberculosis
LSGPAGG

SEQ ID NO: 1400905 - protein, 6 aa, Mycobacterium tuberculosis
LSGQGT

SEQ ID NO: 1400906 - protein, 25 aa, Mycobacterium tuberculosis
LSGRHGERDHRRAGAAGELTGATRP

SEQ ID NO: 1400907 - protein, 6 aa, Mycobacterium tuberculosis
LSHDER

SEQ ID NO: 1400908 - protein, 17 aa, Mycobacterium tuberculosis
LSIGGDDDDVDVPPFMR

SEQ ID NO: 1400909 - protein, 6 aa, Mycobacterium tuberculosis
LSKQTG

SEQ ID NO: 1400910 - protein, 9 aa, Mycobacterium tuberculosis
LSNGGGCDP

SEQ ID NO: 1400911 - protein, 6 aa, Mycobacterium tuberculosis
LSPDER

SEQ ID NO: 1400912 - protein, 6 aa, Mycobacterium tuberculosis
LSPDGA

SEQ ID NO: 1400913 - protein, 6 aa, Mycobacterium tuberculosis
LSPDRL

SEQ ID NO: 1400914 - protein, 4 aa, Mycobacterium tuberculosis
LSPG

SEQ ID NO: 1400915 - protein, 7 aa, Mycobacterium tuberculosis
LSPGADV

SEQ ID NO: 1400916 - protein, 5 aa, Mycobacterium tuberculosis
LSPGI

SEQ ID NO: 1400917 - protein, 9 aa, Mycobacterium tuberculosis
LSPNEIANS

SEQ ID NO: 1400918 - protein, 6 aa, Mycobacterium tuberculosis
LSPQAL

SEQ ID NO: 1400919 - protein, 6 aa, Mycobacterium tuberculosis
LSPQHS

SEQ ID NO: 1400920 - protein, 5 aa, Mycobacterium tuberculosis
LSPQR

SEQ ID NO: 1400921 - protein, 5 aa, Mycobacterium tuberculosis
LSPTG

SEQ ID NO: 1400922 - protein, 19 aa, Mycobacterium tuberculosis
LSPTRPGRGSALTDSSTRD

SEQ ID NO: 1400923 - protein, 6 aa, Mycobacterium tuberculosis
LSPYTP

SEQ ID NO: 1400924 - protein, 9 aa, Mycobacterium tuberculosis
LSQEQRDEL

SEQ ID NO: 1400925 - protein, 14 aa, Mycobacterium tuberculosis
LSQTHSGAPIPTPR

SEQ ID NO: 1400926 - protein, 5 aa, Mycobacterium tuberculosis
LSRDE

SEQ ID NO: 1400927 - protein, 24 aa, Mycobacterium tuberculosis
LSRSGPTAGTPVLPPDGIASATAA

SEQ ID NO: 1400928 - protein, 11 aa, Mycobacterium tuberculosis
LSSADTAEQQH

SEQ ID NO: 1400929 - protein, 7 aa, Mycobacterium tuberculosis
LSSATRR

SEQ ID NO: 1400930 - protein, 4 aa, Mycobacterium tuberculosis
LSSR

SEQ ID NO: 1400931 - protein, 9 aa, Mycobacterium tuberculosis
LSTDPHDTT

SEQ ID NO: 1400932 - protein, 6 aa, Mycobacterium tuberculosis
LSTPAA

SEQ ID NO: 1400933 - protein, 6 aa, Mycobacterium tuberculosis
LSTPQI

SEQ ID NO: 1400934 - protein, 9 aa, Mycobacterium tuberculosis
LSTQPHSHE

SEQ ID NO: 1400935 - protein, 7 aa, Mycobacterium tuberculosis
LSTRRRG

SEQ ID NO: 1400936 - protein, 14 aa, Mycobacterium tuberculosis
LSYGPQSDGSLSPE

SEQ ID NO: 1400937 - protein, 7 aa, Mycobacterium tuberculosis
LTADPAE

SEQ ID NO: 1400938 - protein, 8 aa, Mycobacterium tuberculosis
LTAGGDDY

SEQ ID NO: 1400939 - protein, 5 aa, Mycobacterium tuberculosis
LTAKQ

SEQ ID NO: 1400940 - protein, 5 aa, Mycobacterium tuberculosis
LTATP

SEQ ID NO: 1400941 - protein, 7 aa, Mycobacterium tuberculosis
LTDDTGA

SEQ ID NO: 1400942 - protein, 7 aa, Mycobacterium tuberculosis
LTDGTEL

SEQ ID NO: 1400943 - protein, 10 aa, Mycobacterium tuberculosis
LTDPAATAAL

SEQ ID NO: 1400944 - protein, 5 aa, Mycobacterium tuberculosis
LTEDE

SEQ ID NO: 1400945 - protein, 7 aa, Mycobacterium tuberculosis
LTEERRR

SEQ ID NO: 1400946 - protein, 6 aa, Mycobacterium tuberculosis
LTGADT

SEQ ID NO: 1400947 - protein, 7 aa, Mycobacterium tuberculosis
LTGGTGV

SEQ ID NO: 1400948 - protein, 8 aa, Mycobacterium tuberculosis
LTGNSPSF

SEQ ID NO: 1400949 - protein, 15 aa, Mycobacterium tuberculosis
LTGQKTERLTHRPPS

SEQ ID NO: 1400950 - protein, 5 aa, Mycobacterium tuberculosis
LTGQS

SEQ ID NO: 1400951 - protein, 7 aa, Mycobacterium tuberculosis
LTGRDSG

SEQ ID NO: 1400952 - protein, 20 aa, Mycobacterium tuberculosis
LTGSRDGTQKTGETPLARYD

SEQ ID NO: 1400953 - protein, 6 aa, Mycobacterium tuberculosis
LTGTTT

SEQ ID NO: 1400954 - protein, 12 aa, Mycobacterium tuberculosis
LTIPESSRTLDE

SEQ ID NO: 1400955 - protein, 6 aa, Mycobacterium tuberculosis
LTNDGT

SEQ ID NO: 1400956 - protein, 5 aa, Mycobacterium tuberculosis
LTNKQ

SEQ ID NO: 1400957 - protein, 6 aa, Mycobacterium tuberculosis
LTPAQG

SEQ ID NO: 1400958 - protein, 4 aa, Mycobacterium tuberculosis
LTPD

SEQ ID NO: 1400959 - protein, 6 aa, Mycobacterium tuberculosis
LTPDTD

SEQ ID NO: 1400960 - protein, 13 aa, Mycobacterium tuberculosis
LTPGGLATQYSSA

SEQ ID NO: 1400961 - protein, 5 aa, Mycobacterium tuberculosis
LTPGH

SEQ ID NO: 1400962 - protein, 6 aa, Mycobacterium tuberculosis
LTPPDV

SEQ ID NO: 1400963 - protein, 6 aa, Mycobacterium tuberculosis
LTPQNQ

SEQ ID NO: 1400964 - protein, 8 aa, Mycobacterium tuberculosis
LTPQPPTI

SEQ ID NO: 1400965 - protein, 6 aa, Mycobacterium tuberculosis
LTRNGE

SEQ ID NO: 1400966 - protein, 5 aa, Mycobacterium tuberculosis
LTRTG

SEQ ID NO: 1400967 - protein, 9 aa, Mycobacterium tuberculosis
LTRTGKPDA

SEQ ID NO: 1400968 - protein, 7 aa, Mycobacterium tuberculosis
LTSPEAT

SEQ ID NO: 1400969 - protein, 8 aa, Mycobacterium tuberculosis
LTSRNPRS

SEQ ID NO: 1400970 - protein, 9 aa, Mycobacterium tuberculosis
LTTAEQPDR

SEQ ID NO: 1400971 - protein, 7 aa, Mycobacterium tuberculosis
LTTPPPI

SEQ ID NO: 1400972 - protein, 9 aa, Mycobacterium tuberculosis
LTTPRTPFN

SEQ ID NO: 1400973 - protein, 6 aa, Mycobacterium tuberculosis
LTTRTE

SEQ ID NO: 1400974 - protein, 5 aa, Mycobacterium tuberculosis
LYPPG

SEQ ID NO: 1400975 - protein, 8 aa, Mycobacterium tuberculosis
MADEGRND

SEQ ID NO: 1400976 - protein, 11 aa, Mycobacterium tuberculosis
MAGGPSTPALA

SEQ ID NO: 1400977 - protein, 6 aa, Mycobacterium tuberculosis
MAGRGT

SEQ ID NO: 1400978 - protein, 10 aa, Mycobacterium tuberculosis
MAGTDEGPGF

SEQ ID NO: 1400979 - protein, 8 aa, Mycobacterium tuberculosis
MAKESGAD

SEQ ID NO: 1400980 - protein, 16 aa, Mycobacterium tuberculosis
MATDENGRIVSPRTGS

SEQ ID NO: 1400981 - protein, 7 aa, Mycobacterium tuberculosis
MEEDTGK

SEQ ID NO: 1400982 - protein, 14 aa, Mycobacterium tuberculosis
MEGSPEGHNFPQSQ

SEQ ID NO: 1400983 - protein, 18 aa, Mycobacterium tuberculosis
MGEQDPGATPSGSPIVTV

SEQ ID NO: 1400984 - protein, 10 aa, Mycobacterium tuberculosis
MGNANPKDNW

SEQ ID NO: 1400985 - protein, 4 aa, Mycobacterium tuberculosis
MGRA

SEQ ID NO: 1400986 - protein, 12 aa, Mycobacterium tuberculosis
MKEAEDALRDYQ

SEQ ID NO: 1400987 - protein, 8 aa, Mycobacterium tuberculosis
MKEAGRGS

SEQ ID NO: 1400988 - protein, 6 aa, Mycobacterium tuberculosis
MKEGRY

SEQ ID NO: 1400989 - protein, 10 aa, Mycobacterium tuberculosis
MKPETQAAKD

SEQ ID NO: 1400990 - protein, 8 aa, Mycobacterium tuberculosis
MKTGEGKT

SEQ ID NO: 1400991 - protein, 5 aa, Mycobacterium tuberculosis
MNPNG

SEQ ID NO: 1400992 - protein, 14 aa, Mycobacterium tuberculosis
MPGPNGHRPIPWPA

SEQ ID NO: 1400993 - protein, 4 aa, Mycobacterium tuberculosis
MPGS

SEQ ID NO: 1400994 - protein, 6 aa, Mycobacterium tuberculosis
MPHPQQ

SEQ ID NO: 1400995 - protein, 6 aa, Mycobacterium tuberculosis
MPREPR

SEQ ID NO: 1400996 - protein, 4 aa, Mycobacterium tuberculosis
MPVG

SEQ ID NO: 1400997 - protein, 7 aa, Mycobacterium tuberculosis
MPVTSGG

SEQ ID NO: 1400998 - protein, 11 aa, Mycobacterium tuberculosis
MQSQSASVRRG

SEQ ID NO: 1400999 - protein, 11 aa, Mycobacterium tuberculosis
MRGEGSPAPIW

SEQ ID NO: 1401000 - protein, 5 aa, Mycobacterium tuberculosis
MRGPS

SEQ ID NO: 1401001 - protein, 13 aa, Mycobacterium tuberculosis
MRPKPACTPTRPK

SEQ ID NO: 1401002 - protein, 12 aa, Mycobacterium tuberculosis
MRPTDGRDTATA

SEQ ID NO: 1401003 - protein, 5 aa, Mycobacterium tuberculosis
MRQPN

SEQ ID NO: 1401004 - protein, 4 aa, Mycobacterium tuberculosis
MRSG

SEQ ID NO: 1401005 - protein, 4 aa, Mycobacterium tuberculosis
MRTE

SEQ ID NO: 1401006 - protein, 4 aa, Mycobacterium tuberculosis
MSAG

SEQ ID NO: 1401007 - protein, 11 aa, Mycobacterium tuberculosis
MSAPSSGSSKV

SEQ ID NO: 1401008 - protein, 19 aa, Mycobacterium tuberculosis
MSARRTRQATKRAPRAFFA

SEQ ID NO: 1401009 - protein, 8 aa, Mycobacterium tuberculosis
MSDDRGRP

SEQ ID NO: 1401010 - protein, 5 aa, Mycobacterium tuberculosis
MSEAQ

SEQ ID NO: 1401011 - protein, 7 aa, Mycobacterium tuberculosis
MSGATED

SEQ ID NO: 1401012 - protein, 8 aa, Mycobacterium tuberculosis
MSGPADDR

SEQ ID NO: 1401013 - protein, 5 aa, Mycobacterium tuberculosis
MSGTN

SEQ ID NO: 1401014 - protein, 11 aa, Mycobacterium tuberculosis
MSTSSNERGMS

SEQ ID NO: 1401015 - protein, 6 aa, Mycobacterium tuberculosis
MTDGGA

SEQ ID NO: 1401016 - protein, 10 aa, Mycobacterium tuberculosis
MTGSRQRIQP

SEQ ID NO: 1401017 - protein, 13 aa, Mycobacterium tuberculosis
NAAHGAASSEITP

SEQ ID NO: 1401018 - protein, 6 aa, Mycobacterium tuberculosis
NAANTR

SEQ ID NO: 1401019 - protein, 6 aa, Mycobacterium tuberculosis
NAAPDL

SEQ ID NO: 1401020 - protein, 8 aa, Mycobacterium tuberculosis
NAAPDRKR

SEQ ID NO: 1401021 - protein, 14 aa, Mycobacterium tuberculosis
NAASRAEALDLILR

SEQ ID NO: 1401022 - protein, 6 aa, Mycobacterium tuberculosis
NAAYSA

SEQ ID NO: 1401023 - protein, 5 aa, Mycobacterium tuberculosis
NADAK

SEQ ID NO: 1401024 - protein, 7 aa, Mycobacterium tuberculosis
NADPERI

SEQ ID NO: 1401025 - protein, 14 aa, Mycobacterium tuberculosis
NAERATDWRGNNNI

SEQ ID NO: 1401026 - protein, 7 aa, Mycobacterium tuberculosis
NAGAEPA

SEQ ID NO: 1401027 - protein, 7 aa, Mycobacterium tuberculosis
NAGGAKG

SEQ ID NO: 1401028 - protein, 14 aa, Mycobacterium tuberculosis
NAGGSRPEGIGKTP

SEQ ID NO: 1401029 - protein, 7 aa, Mycobacterium tuberculosis
NAGPATR

SEQ ID NO: 1401030 - protein, 4 aa, Mycobacterium tuberculosis
NAGR

SEQ ID NO: 1401031 - protein, 5 aa, Mycobacterium tuberculosis
NAHPD

SEQ ID NO: 1401032 - protein, 4 aa, Mycobacterium tuberculosis
NAIN

SEQ ID NO: 1401033 - protein, 9 aa, Mycobacterium tuberculosis
NAKDRTVAS

SEQ ID NO: 1401034 - protein, 4 aa, Mycobacterium tuberculosis
NAKG

SEQ ID NO: 1401035 - protein, 6 aa, Mycobacterium tuberculosis
NAKPGQ

SEQ ID NO: 1401036 - protein, 8 aa, Mycobacterium tuberculosis
NAKSPQAQ

SEQ ID NO: 1401037 - protein, 10 aa, Mycobacterium tuberculosis
NALERTPSVA

SEQ ID NO: 1401038 - protein, 7 aa, Mycobacterium tuberculosis
NANPSAR

SEQ ID NO: 1401039 - protein, 7 aa, Mycobacterium tuberculosis
NANTGSF

SEQ ID NO: 1401040 - protein, 7 aa, Mycobacterium tuberculosis
NARDRTM

SEQ ID NO: 1401041 - protein, 7 aa, Mycobacterium tuberculosis
NARRDSE

SEQ ID NO: 1401042 - protein, 7 aa, Mycobacterium tuberculosis
NASDTHP

SEQ ID NO: 1401043 - protein, 6 aa, Mycobacterium tuberculosis
NASGSR

SEQ ID NO: 1401044 - protein, 9 aa, Mycobacterium tuberculosis
NASTPAPAA

SEQ ID NO: 1401045 - protein, 5 aa, Mycobacterium tuberculosis
NAVYP

SEQ ID NO: 1401046 - protein, 6 aa, Mycobacterium tuberculosis
NAYEQA

SEQ ID NO: 1401047 - protein, 7 aa, Mycobacterium tuberculosis
NCSTGST

SEQ ID NO: 1401048 - protein, 15 aa, Mycobacterium tuberculosis
NDAAGLASPVRSAGP

SEQ ID NO: 1401049 - protein, 6 aa, Mycobacterium tuberculosis
NDAPEL

SEQ ID NO: 1401050 - protein, 5 aa, Mycobacterium tuberculosis
NDAPI

SEQ ID NO: 1401051 - protein, 6 aa, Mycobacterium tuberculosis
NDDQGI

SEQ ID NO: 1401052 - protein, 4 aa, Mycobacterium tuberculosis
NDEI

SEQ ID NO: 1401053 - protein, 7 aa, Mycobacterium tuberculosis
NDEYDNE

SEQ ID NO: 1401054 - protein, 6 aa, Mycobacterium tuberculosis
NDGATA

SEQ ID NO: 1401055 - protein, 9 aa, Mycobacterium tuberculosis
NDGEGLGGT

SEQ ID NO: 1401056 - protein, 8 aa, Mycobacterium tuberculosis
NDGKTPKT

SEQ ID NO: 1401057 - protein, 14 aa, Mycobacterium tuberculosis
NDHTAGGLATNSAP

SEQ ID NO: 1401058 - protein, 8 aa, Mycobacterium tuberculosis
NDKDGVNA

SEQ ID NO: 1401059 - protein, 20 aa, Mycobacterium tuberculosis
NDKHNEANGENNRDGESYNR

SEQ ID NO: 1401060 - protein, 7 aa, Mycobacterium tuberculosis
NDLSSGR

SEQ ID NO: 1401061 - protein, 6 aa, Mycobacterium tuberculosis
NDNGGG

SEQ ID NO: 1401062 - protein, 7 aa, Mycobacterium tuberculosis
NDPDELA

SEQ ID NO: 1401063 - protein, 7 aa, Mycobacterium tuberculosis
NDPDGDL

SEQ ID NO: 1401064 - protein, 9 aa, Mycobacterium tuberculosis
NDPEANAER

SEQ ID NO: 1401065 - protein, 6 aa, Mycobacterium tuberculosis
NDPEGL

SEQ ID NO: 1401066 - protein, 4 aa, Mycobacterium tuberculosis
NDPR

SEQ ID NO: 1401067 - protein, 5 aa, Mycobacterium tuberculosis
NDPRN

SEQ ID NO: 1401068 - protein, 7 aa, Mycobacterium tuberculosis
NDQTPEL

SEQ ID NO: 1401069 - protein, 11 aa, Mycobacterium tuberculosis
NDRANATATRL

SEQ ID NO: 1401070 - protein, 7 aa, Mycobacterium tuberculosis
NDRKGYT

SEQ ID NO: 1401071 - protein, 28 aa, Mycobacterium tuberculosis
NDRREEGDLRENGGYHAAREEQGQQEAR

SEQ ID NO: 1401072 - protein, 7 aa, Mycobacterium tuberculosis
NDSATEP

SEQ ID NO: 1401073 - protein, 9 aa, Mycobacterium tuberculosis
NDSGGARIQ

SEQ ID NO: 1401074 - protein, 8 aa, Mycobacterium tuberculosis
NDSPYGLS

SEQ ID NO: 1401075 - protein, 6 aa, Mycobacterium tuberculosis
NDTVAT

SEQ ID NO: 1401076 - protein, 12 aa, Mycobacterium tuberculosis
NDYADRKNNRQA

SEQ ID NO: 1401077 - protein, 8 aa, Mycobacterium tuberculosis
NEAATEDA

SEQ ID NO: 1401078 - protein, 13 aa, Mycobacterium tuberculosis
NEARAEKTAATVK

SEQ ID NO: 1401079 - protein, 9 aa, Mycobacterium tuberculosis
NEDGSNITK

SEQ ID NO: 1401080 - protein, 5 aa, Mycobacterium tuberculosis
NEDSR

SEQ ID NO: 1401081 - protein, 6 aa, Mycobacterium tuberculosis
NEGGLH

SEQ ID NO: 1401082 - protein, 6 aa, Mycobacterium tuberculosis
NEHEAK

SEQ ID NO: 1401083 - protein, 8 aa, Mycobacterium tuberculosis
NEHTPGIS

SEQ ID NO: 1401084 - protein, 4 aa, Mycobacterium tuberculosis
NEIT

SEQ ID NO: 1401085 - protein, 8 aa, Mycobacterium tuberculosis
NEKSQLQN

SEQ ID NO: 1401086 - protein, 6 aa, Mycobacterium tuberculosis
NENAKE

SEQ ID NO: 1401087 - protein, 8 aa, Mycobacterium tuberculosis
NENPQRPW

SEQ ID NO: 1401088 - protein, 11 aa, Mycobacterium tuberculosis
NERSQLQNKTR

SEQ ID NO: 1401089 - protein, 14 aa, Mycobacterium tuberculosis
NESAKRDYDVQGNG

SEQ ID NO: 1401090 - protein, 8 aa, Mycobacterium tuberculosis
NESEEIDG

SEQ ID NO: 1401091 - protein, 5 aa, Mycobacterium tuberculosis
NETQI

SEQ ID NO: 1401092 - protein, 7 aa, Mycobacterium tuberculosis
NETTRNA

SEQ ID NO: 1401093 - protein, 6 aa, Mycobacterium tuberculosis
NETTTK

SEQ ID NO: 1401094 - protein, 5 aa, Mycobacterium tuberculosis
NEYPG

SEQ ID NO: 1401095 - protein, 7 aa, Mycobacterium tuberculosis
NFDNDEA

SEQ ID NO: 1401096 - protein, 7 aa, Mycobacterium tuberculosis
NFETPSH

SEQ ID NO: 1401097 - protein, 10 aa, Mycobacterium tuberculosis
NFKTRGGLTT

SEQ ID NO: 1401098 - protein, 12 aa, Mycobacterium tuberculosis
NGASAEGTINGT

SEQ ID NO: 1401099 - protein, 5 aa, Mycobacterium tuberculosis
NGDEV

SEQ ID NO: 1401100 - protein, 11 aa, Mycobacterium tuberculosis
NGDGNVTRRNG

SEQ ID NO: 1401101 - protein, 13 aa, Mycobacterium tuberculosis
NGDVGAKARALAE

SEQ ID NO: 1401102 - protein, 6 aa, Mycobacterium tuberculosis
NGEPTR

SEQ ID NO: 1401103 - protein, 5 aa, Mycobacterium tuberculosis
NGERN

SEQ ID NO: 1401104 - protein, 5 aa, Mycobacterium tuberculosis
NGGEI

SEQ ID NO: 1401105 - protein, 7 aa, Mycobacterium tuberculosis
NGGEPVD

SEQ ID NO: 1401106 - protein, 7 aa, Mycobacterium tuberculosis
NGGMTPK

SEQ ID NO: 1401107 - protein, 8 aa, Mycobacterium tuberculosis
NGGTAERV

SEQ ID NO: 1401108 - protein, 5 aa, Mycobacterium tuberculosis
NGLRP

SEQ ID NO: 1401109 - protein, 6 aa, Mycobacterium tuberculosis
NGLTED

SEQ ID NO: 1401110 - protein, 4 aa, Mycobacterium tuberculosis
NGNK

SEQ ID NO: 1401111 - protein, 6 aa, Mycobacterium tuberculosis
NGQAGV

SEQ ID NO: 1401112 - protein, 7 aa, Mycobacterium tuberculosis
NGQPCRP

SEQ ID NO: 1401113 - protein, 7 aa, Mycobacterium tuberculosis
NGRGGPQ

SEQ ID NO: 1401114 - protein, 8 aa, Mycobacterium tuberculosis
NGRRSAES

SEQ ID NO: 1401115 - protein, 9 aa, Mycobacterium tuberculosis
NGRTISAGP

SEQ ID NO: 1401116 - protein, 6 aa, Mycobacterium tuberculosis
NGSGGI

SEQ ID NO: 1401117 - protein, 4 aa, Mycobacterium tuberculosis
NGSL

SEQ ID NO: 1401118 - protein, 5 aa, Mycobacterium tuberculosis
NGSNE

SEQ ID NO: 1401119 - protein, 13 aa, Mycobacterium tuberculosis
NGSPDSPHDPHSK

SEQ ID NO: 1401120 - protein, 5 aa, Mycobacterium tuberculosis
NGSPY

SEQ ID NO: 1401121 - protein, 9 aa, Mycobacterium tuberculosis
NGSYADYPS

SEQ ID NO: 1401122 - protein, 6 aa, Mycobacterium tuberculosis
NGTRRT

SEQ ID NO: 1401123 - protein, 5 aa, Mycobacterium tuberculosis
NGTTT

SEQ ID NO: 1401124 - protein, 15 aa, Mycobacterium tuberculosis
NHNQGNEDPTAGGRY

SEQ ID NO: 1401125 - protein, 6 aa, Mycobacterium tuberculosis
NHYPQD

SEQ ID NO: 1401126 - protein, 6 aa, Mycobacterium tuberculosis
NIDQRR

SEQ ID NO: 1401127 - protein, 10 aa, Mycobacterium tuberculosis
NIEDQSSDRV

SEQ ID NO: 1401128 - protein, 7 aa, Mycobacterium tuberculosis
NIEEGGS

SEQ ID NO: 1401129 - protein, 11 aa, Mycobacterium tuberculosis
NIGPTAKAVSG

SEQ ID NO: 1401130 - protein, 7 aa, Mycobacterium tuberculosis
NIKTGDG

SEQ ID NO: 1401131 - protein, 5 aa, Mycobacterium tuberculosis
NIRRN

SEQ ID NO: 1401132 - protein, 7 aa, Mycobacterium tuberculosis
NKERGPI

SEQ ID NO: 1401133 - protein, 10 aa, Mycobacterium tuberculosis
NKIEPQAPVD

SEQ ID NO: 1401134 - protein, 9 aa, Mycobacterium tuberculosis
NKPDETRHT

SEQ ID NO: 1401135 - protein, 10 aa, Mycobacterium tuberculosis
NKTAGDAEKL

SEQ ID NO: 1401136 - protein, 23 aa, Mycobacterium tuberculosis
NKTGYHKRQGHRQQLTVLKVTGI

SEQ ID NO: 1401137 - protein, 6 aa, Mycobacterium tuberculosis
NKVPNA

SEQ ID NO: 1401138 - protein, 6 aa, Mycobacterium tuberculosis
NLDPPW

SEQ ID NO: 1401139 - protein, 7 aa, Mycobacterium tuberculosis
NLPDNTS

SEQ ID NO: 1401140 - protein, 13 aa, Mycobacterium tuberculosis
NLPDTAKRRYHPD

SEQ ID NO: 1401141 - protein, 5 aa, Mycobacterium tuberculosis
NLPPP

SEQ ID NO: 1401142 - protein, 7 aa, Mycobacterium tuberculosis
NLPTSGG

SEQ ID NO: 1401143 - protein, 8 aa, Mycobacterium tuberculosis
NLQRDPDE

SEQ ID NO: 1401144 - protein, 6 aa, Mycobacterium tuberculosis
NLRKGA

SEQ ID NO: 1401145 - protein, 6 aa, Mycobacterium tuberculosis
NLTAQR

SEQ ID NO: 1401146 - protein, 4 aa, Mycobacterium tuberculosis
NMPD

SEQ ID NO: 1401147 - protein, 6 aa, Mycobacterium tuberculosis
NNDGTL

SEQ ID NO: 1401148 - protein, 8 aa, Mycobacterium tuberculosis
NNDPRTSN

SEQ ID NO: 1401149 - protein, 5 aa, Mycobacterium tuberculosis
NNFTG

SEQ ID NO: 1401150 - protein, 7 aa, Mycobacterium tuberculosis
NNGTDTV

SEQ ID NO: 1401151 - protein, 8 aa, Mycobacterium tuberculosis
NNPDRQAD

SEQ ID NO: 1401152 - protein, 7 aa, Mycobacterium tuberculosis
NNPNGGV

SEQ ID NO: 1401153 - protein, 8 aa, Mycobacterium tuberculosis
NNTGEIKS

SEQ ID NO: 1401154 - protein, 8 aa, Mycobacterium tuberculosis
NNTRSARY

SEQ ID NO: 1401155 - protein, 10 aa, Mycobacterium tuberculosis
NPADRNVPEI

SEQ ID NO: 1401156 - protein, 6 aa, Mycobacterium tuberculosis
NPAGAE

SEQ ID NO: 1401157 - protein, 6 aa, Mycobacterium tuberculosis
NPAPFG

SEQ ID NO: 1401158 - protein, 14 aa, Mycobacterium tuberculosis
NPDGNYNDTDRARR

SEQ ID NO: 1401159 - protein, 6 aa, Mycobacterium tuberculosis
NPDKLA

SEQ ID NO: 1401160 - protein, 4 aa, Mycobacterium tuberculosis
NPDR

SEQ ID NO: 1401161 - protein, 7 aa, Mycobacterium tuberculosis
NPGARED

SEQ ID NO: 1401162 - protein, 4 aa, Mycobacterium tuberculosis
NPGN

SEQ ID NO: 1401163 - protein, 8 aa, Mycobacterium tuberculosis
NPGTGGTL

SEQ ID NO: 1401164 - protein, 7 aa, Mycobacterium tuberculosis
NPHTKPP

SEQ ID NO: 1401165 - protein, 22 aa, Mycobacterium tuberculosis
NPIASNATPEGRAKNRRVEIVV

SEQ ID NO: 1401166 - protein, 5 aa, Mycobacterium tuberculosis
NPKVQ

SEQ ID NO: 1401167 - protein, 8 aa, Mycobacterium tuberculosis
NPLESGEL

SEQ ID NO: 1401168 - protein, 17 aa, Mycobacterium tuberculosis
NPLSDDTLSALSLPGVF

SEQ ID NO: 1401169 - protein, 8 aa, Mycobacterium tuberculosis
NPNITPNT

SEQ ID NO: 1401170 - protein, 10 aa, Mycobacterium tuberculosis
NPNNPNGGVA

SEQ ID NO: 1401171 - protein, 13 aa, Mycobacterium tuberculosis
NPPGTQRRGPRAL

SEQ ID NO: 1401172 - protein, 7 aa, Mycobacterium tuberculosis
NPQGSVS

SEQ ID NO: 1401173 - protein, 5 aa, Mycobacterium tuberculosis
NPQLA

SEQ ID NO: 1401174 - protein, 5 aa, Mycobacterium tuberculosis
NPQRV

SEQ ID NO: 1401175 - protein, 15 aa, Mycobacterium tuberculosis
NPRARDADTPSPAAS

SEQ ID NO: 1401176 - protein, 11 aa, Mycobacterium tuberculosis
NPRQCTPRTPA

SEQ ID NO: 1401177 - protein, 15 aa, Mycobacterium tuberculosis
NPRSYVGAESDPNAA

SEQ ID NO: 1401178 - protein, 11 aa, Mycobacterium tuberculosis
NPRTSEDGTAF

SEQ ID NO: 1401179 - protein, 9 aa, Mycobacterium tuberculosis
NPSEALTAS

SEQ ID NO: 1401180 - protein, 8 aa, Mycobacterium tuberculosis
NPSGTRKD

SEQ ID NO: 1401181 - protein, 6 aa, Mycobacterium tuberculosis
NPSGVT

SEQ ID NO: 1401182 - protein, 4 aa, Mycobacterium tuberculosis
NPSP

SEQ ID NO: 1401183 - protein, 12 aa, Mycobacterium tuberculosis
NPSVPDDEVTPE

SEQ ID NO: 1401184 - protein, 5 aa, Mycobacterium tuberculosis
NPTDL

SEQ ID NO: 1401185 - protein, 7 aa, Mycobacterium tuberculosis
NPTLGGT

SEQ ID NO: 1401186 - protein, 7 aa, Mycobacterium tuberculosis
NPTNPTS

SEQ ID NO: 1401187 - protein, 17 aa, Mycobacterium tuberculosis
NPTPGSDWDASPKPVER

SEQ ID NO: 1401188 - protein, 11 aa, Mycobacterium tuberculosis
NPTTSPFGNPI

SEQ ID NO: 1401189 - protein, 6 aa, Mycobacterium tuberculosis
NQDNAY

SEQ ID NO: 1401190 - protein, 8 aa, Mycobacterium tuberculosis
NQGLGGTA

SEQ ID NO: 1401191 - protein, 8 aa, Mycobacterium tuberculosis
NQGPDGMS

SEQ ID NO: 1401192 - protein, 18 aa, Mycobacterium tuberculosis
NQGYQDLRDGKNIRGVIV

SEQ ID NO: 1401193 - protein, 5 aa, Mycobacterium tuberculosis
NQHAR

SEQ ID NO: 1401194 - protein, 10 aa, Mycobacterium tuberculosis
NQPDATAAAF

SEQ ID NO: 1401195 - protein, 5 aa, Mycobacterium tuberculosis
NQPGA

SEQ ID NO: 1401196 - protein, 13 aa, Mycobacterium tuberculosis
NQQKTPKTKIETA

SEQ ID NO: 1401197 - protein, 6 aa, Mycobacterium tuberculosis
NRAGSA

SEQ ID NO: 1401198 - protein, 9 aa, Mycobacterium tuberculosis
NRANPIDGK

SEQ ID NO: 1401199 - protein, 8 aa, Mycobacterium tuberculosis
NRARELRE

SEQ ID NO: 1401200 - protein, 6 aa, Mycobacterium tuberculosis
NRDPAV

SEQ ID NO: 1401201 - protein, 5 aa, Mycobacterium tuberculosis
NRDPI

SEQ ID NO: 1401202 - protein, 7 aa, Mycobacterium tuberculosis
NREEPRK

SEQ ID NO: 1401203 - protein, 6 aa, Mycobacterium tuberculosis
NRGRAG

SEQ ID NO: 1401204 - protein, 8 aa, Mycobacterium tuberculosis
NRGTDALI

SEQ ID NO: 1401205 - protein, 7 aa, Mycobacterium tuberculosis
NRKARHN

SEQ ID NO: 1401206 - protein, 4 aa, Mycobacterium tuberculosis
NRKN

SEQ ID NO: 1401207 - protein, 7 aa, Mycobacterium tuberculosis
NRKPPPR

SEQ ID NO: 1401208 - protein, 6 aa, Mycobacterium tuberculosis
NRLGTN

SEQ ID NO: 1401209 - protein, 8 aa, Mycobacterium tuberculosis
NRNRAASE

SEQ ID NO: 1401210 - protein, 10 aa, Mycobacterium tuberculosis
NRPDSPVANE

SEQ ID NO: 1401211 - protein, 7 aa, Mycobacterium tuberculosis
NRRRAPG

SEQ ID NO: 1401212 - protein, 5 aa, Mycobacterium tuberculosis
NRSAE

SEQ ID NO: 1401213 - protein, 9 aa, Mycobacterium tuberculosis
NRSSGKQGY

SEQ ID NO: 1401214 - protein, 7 aa, Mycobacterium tuberculosis
NRSSLPA

SEQ ID NO: 1401215 - protein, 5 aa, Mycobacterium tuberculosis
NRTGT

SEQ ID NO: 1401216 - protein, 8 aa, Mycobacterium tuberculosis
NRTQAERA

SEQ ID NO: 1401217 - protein, 4 aa, Mycobacterium tuberculosis
NRVP

SEQ ID NO: 1401218 - protein, 12 aa, Mycobacterium tuberculosis
NRYESGDRDPDQ

SEQ ID NO: 1401219 - protein, 8 aa, Mycobacterium tuberculosis
NSAAPGNI

SEQ ID NO: 1401220 - protein, 10 aa, Mycobacterium tuberculosis
NSAATNEADP

SEQ ID NO: 1401221 - protein, 7 aa, Mycobacterium tuberculosis
NSATDYD

SEQ ID NO: 1401222 - protein, 8 aa, Mycobacterium tuberculosis
NSATKAGI

SEQ ID NO: 1401223 - protein, 5 aa, Mycobacterium tuberculosis
NSDGG

SEQ ID NO: 1401224 - protein, 18 aa, Mycobacterium tuberculosis
NSDGLSDGLTAPSGDAQT

SEQ ID NO: 1401225 - protein, 7 aa, Mycobacterium tuberculosis
NSDPYGA

SEQ ID NO: 1401226 - protein, 6 aa, Mycobacterium tuberculosis
NSEGRY

SEQ ID NO: 1401227 - protein, 19 aa, Mycobacterium tuberculosis
NSFPSSDRSASKCGTERGL

SEQ ID NO: 1401228 - protein, 9 aa, Mycobacterium tuberculosis
NSGEGWDGR

SEQ ID NO: 1401229 - protein, 7 aa, Mycobacterium tuberculosis
NSGGGSL

SEQ ID NO: 1401230 - protein, 10 aa, Mycobacterium tuberculosis
NSGINPDDLA

SEQ ID NO: 1401231 - protein, 7 aa, Mycobacterium tuberculosis
NSGPALA

SEQ ID NO: 1401232 - protein, 8 aa, Mycobacterium tuberculosis
NSGSPEDL

SEQ ID NO: 1401233 - protein, 19 aa, Mycobacterium tuberculosis
NSGTGGTSGFGNVGSGGSG

SEQ ID NO: 1401234 - protein, 12 aa, Mycobacterium tuberculosis
NSPGTIDAGYRG

SEQ ID NO: 1401235 - protein, 9 aa, Mycobacterium tuberculosis
NSPSERAEN

SEQ ID NO: 1401236 - protein, 11 aa, Mycobacterium tuberculosis
NSRPERRDPPT

SEQ ID NO: 1401237 - protein, 7 aa, Mycobacterium tuberculosis
NSRRGQI

SEQ ID NO: 1401238 - protein, 9 aa, Mycobacterium tuberculosis
NSRSSARVR

SEQ ID NO: 1401239 - protein, 13 aa, Mycobacterium tuberculosis
NSTNGTTVNNAPV

SEQ ID NO: 1401240 - protein, 6 aa, Mycobacterium tuberculosis
NSTRGA

SEQ ID NO: 1401241 - protein, 7 aa, Mycobacterium tuberculosis
NSVASGR

SEQ ID NO: 1401242 - protein, 5 aa, Mycobacterium tuberculosis
NSVKD

SEQ ID NO: 1401243 - protein, 10 aa, Mycobacterium tuberculosis
NTAAAKSSIT

SEQ ID NO: 1401244 - protein, 10 aa, Mycobacterium tuberculosis
NTAAQKVRSG

SEQ ID NO: 1401245 - protein, 10 aa, Mycobacterium tuberculosis
NTDSAGNSYG

SEQ ID NO: 1401246 - protein, 14 aa, Mycobacterium tuberculosis
NTGIGNTGNYNTGS

SEQ ID NO: 1401247 - protein, 9 aa, Mycobacterium tuberculosis
NTGRFSPET

SEQ ID NO: 1401248 - protein, 6 aa, Mycobacterium tuberculosis
NTIRAH

SEQ ID NO: 1401249 - protein, 7 aa, Mycobacterium tuberculosis
NTKPTIT

SEQ ID NO: 1401250 - protein, 10 aa, Mycobacterium tuberculosis
NTNAGNPTTR

SEQ ID NO: 1401251 - protein, 5 aa, Mycobacterium tuberculosis
NTPDP

SEQ ID NO: 1401252 - protein, 4 aa, Mycobacterium tuberculosis
NTPE

SEQ ID NO: 1401253 - protein, 9 aa, Mycobacterium tuberculosis
NTPNSAGRY

SEQ ID NO: 1401254 - protein, 6 aa, Mycobacterium tuberculosis
NTQETL

SEQ ID NO: 1401255 - protein, 9 aa, Mycobacterium tuberculosis
NTRAPADYA

SEQ ID NO: 1401256 - protein, 7 aa, Mycobacterium tuberculosis
NTSEEEF

SEQ ID NO: 1401257 - protein, 6 aa, Mycobacterium tuberculosis
NTSRRR

SEQ ID NO: 1401258 - protein, 5 aa, Mycobacterium tuberculosis
NVAEG

SEQ ID NO: 1401259 - protein, 15 aa, Mycobacterium tuberculosis
NVGDGNVGFGNSGSY

SEQ ID NO: 1401260 - protein, 6 aa, Mycobacterium tuberculosis
NVGTGN

SEQ ID NO: 1401261 - protein, 7 aa, Mycobacterium tuberculosis
NVPGPQG

SEQ ID NO: 1401262 - protein, 8 aa, Mycobacterium tuberculosis
NVPGPRRP

SEQ ID NO: 1401263 - protein, 12 aa, Mycobacterium tuberculosis
NVPSPPATPSTA

SEQ ID NO: 1401264 - protein, 11 aa, Mycobacterium tuberculosis
NVTDADDAAAA

SEQ ID NO: 1401265 - protein, 16 aa, Mycobacterium tuberculosis
NVTPEPGPGFKAKLAS

SEQ ID NO: 1401266 - protein, 10 aa, Mycobacterium tuberculosis
NYAGRPSPLY

SEQ ID NO: 1401267 - protein, 8 aa, Mycobacterium tuberculosis
NYGPGDPN

SEQ ID NO: 1401268 - protein, 6 aa, Mycobacterium tuberculosis
NYGPTI

SEQ ID NO: 1401269 - protein, 9 aa, Mycobacterium tuberculosis
NYRRPPREL

SEQ ID NO: 1401270 - protein, 9 aa, Mycobacterium tuberculosis
PAADPDRYA

SEQ ID NO: 1401271 - protein, 12 aa, Mycobacterium tuberculosis
PAAERAHPGNYS

SEQ ID NO: 1401272 - protein, 10 aa, Mycobacterium tuberculosis
PAAGQASQQA

SEQ ID NO: 1401273 - protein, 21 aa, Mycobacterium tuberculosis
PAAPALPAGLADRPNYWTCVL

SEQ ID NO: 1401274 - protein, 6 aa, Mycobacterium tuberculosis
PAAPGL

SEQ ID NO: 1401275 - protein, 7 aa, Mycobacterium tuberculosis
PAAQRRG

SEQ ID NO: 1401276 - protein, 7 aa, Mycobacterium tuberculosis
PAARNAL

SEQ ID NO: 1401277 - protein, 6 aa, Mycobacterium tuberculosis
PAARPD

SEQ ID NO: 1401278 - protein, 7 aa, Mycobacterium tuberculosis
PAARTRM

SEQ ID NO: 1401279 - protein, 7 aa, Mycobacterium tuberculosis
PAASGWT

SEQ ID NO: 1401280 - protein, 7 aa, Mycobacterium tuberculosis
PADAPGA

SEQ ID NO: 1401281 - protein, 8 aa, Mycobacterium tuberculosis
PADGPIGD

SEQ ID NO: 1401282 - protein, 21 aa, Mycobacterium tuberculosis
PADGSTMPSTAPGSGTPVPPL

SEQ ID NO: 1401283 - protein, 4 aa, Mycobacterium tuberculosis
PADL

SEQ ID NO: 1401284 - protein, 8 aa, Mycobacterium tuberculosis
PADMPPPF

SEQ ID NO: 1401285 - protein, 6 aa, Mycobacterium tuberculosis
PADPAQ

SEQ ID NO: 1401286 - protein, 13 aa, Mycobacterium tuberculosis
PADPATANATVTV

SEQ ID NO: 1401287 - protein, 6 aa, Mycobacterium tuberculosis
PADPVG

SEQ ID NO: 1401288 - protein, 13 aa, Mycobacterium tuberculosis
PAERSGSDSESRF

SEQ ID NO: 1401289 - protein, 5 aa, Mycobacterium tuberculosis
PAESK

SEQ ID NO: 1401290 - protein, 4 aa, Mycobacterium tuberculosis
PAGA

SEQ ID NO: 1401291 - protein, 17 aa, Mycobacterium tuberculosis
PAGADEVSAQAATAFTS

SEQ ID NO: 1401292 - protein, 20 aa, Mycobacterium tuberculosis
PAGAGARGGMDADRLRTALG

SEQ ID NO: 1401293 - protein, 8 aa, Mycobacterium tuberculosis
PAGGSTGS

SEQ ID NO: 1401294 - protein, 8 aa, Mycobacterium tuberculosis
PAGKPPTW

SEQ ID NO: 1401295 - protein, 4 aa, Mycobacterium tuberculosis
PAGP

SEQ ID NO: 1401296 - protein, 9 aa, Mycobacterium tuberculosis
PAGPARTGS

SEQ ID NO: 1401297 - protein, 11 aa, Mycobacterium tuberculosis
PAGPDKRTEMR

SEQ ID NO: 1401298 - protein, 10 aa, Mycobacterium tuberculosis
PAGSDGQGLP

SEQ ID NO: 1401299 - protein, 5 aa, Mycobacterium tuberculosis
PAGSF

SEQ ID NO: 1401300 - protein, 11 aa, Mycobacterium tuberculosis
PAGSGAGAGAL

SEQ ID NO: 1401301 - protein, 9 aa, Mycobacterium tuberculosis
PAGSNEPAP

SEQ ID NO: 1401302 - protein, 10 aa, Mycobacterium tuberculosis
PAGSNTPTTL

SEQ ID NO: 1401303 - protein, 13 aa, Mycobacterium tuberculosis
PAGTEAPVSDATK

SEQ ID NO: 1401304 - protein, 7 aa, Mycobacterium tuberculosis
PAGTGKT

SEQ ID NO: 1401305 - protein, 22 aa, Mycobacterium tuberculosis
PAGTTAATAVGEAGLPRRGTPD

SEQ ID NO: 1401306 - protein, 4 aa, Mycobacterium tuberculosis
PAHA

SEQ ID NO: 1401307 - protein, 7 aa, Mycobacterium tuberculosis
PAHTTAD

SEQ ID NO: 1401308 - protein, 6 aa, Mycobacterium tuberculosis
PAKKRD

SEQ ID NO: 1401309 - protein, 6 aa, Mycobacterium tuberculosis
PAKQVN

SEQ ID NO: 1401310 - protein, 5 aa, Mycobacterium tuberculosis
PALGP

SEQ ID NO: 1401311 - protein, 6 aa, Mycobacterium tuberculosis
PALPPQ

SEQ ID NO: 1401312 - protein, 8 aa, Mycobacterium tuberculosis
PALPRNRG

SEQ ID NO: 1401313 - protein, 10 aa, Mycobacterium tuberculosis
PALSPSRATD

SEQ ID NO: 1401314 - protein, 8 aa, Mycobacterium tuberculosis
PANDPNTA

SEQ ID NO: 1401315 - protein, 5 aa, Mycobacterium tuberculosis
PANSE

SEQ ID NO: 1401316 - protein, 17 aa, Mycobacterium tuberculosis
PANVSRRAKVDVLIVHT

SEQ ID NO: 1401317 - protein, 5 aa, Mycobacterium tuberculosis
PAPAR

SEQ ID NO: 1401318 - protein, 15 aa, Mycobacterium tuberculosis
PAPARRVGGHPAKRT

SEQ ID NO: 1401319 - protein, 6 aa, Mycobacterium tuberculosis
PAPDTP

SEQ ID NO: 1401320 - protein, 11 aa, Mycobacterium tuberculosis
PAPEDPEQRDR

SEQ ID NO: 1401321 - protein, 14 aa, Mycobacterium tuberculosis
PAPEDVGKGESEFR

SEQ ID NO: 1401322 - protein, 6 aa, Mycobacterium tuberculosis
PAPGPV

SEQ ID NO: 1401323 - protein, 7 aa, Mycobacterium tuberculosis
PAPGSYA

SEQ ID NO: 1401324 - protein, 17 aa, Mycobacterium tuberculosis
PAPPDREQGDAARAIAD

SEQ ID NO: 1401325 - protein, 8 aa, Mycobacterium tuberculosis
PAPPPPGL

SEQ ID NO: 1401326 - protein, 7 aa, Mycobacterium tuberculosis
PAPPPRE

SEQ ID NO: 1401327 - protein, 6 aa, Mycobacterium tuberculosis
PAPSGT

SEQ ID NO: 1401328 - protein, 19 aa, Mycobacterium tuberculosis
PAPSPKDAARGAHNVGANA

SEQ ID NO: 1401329 - protein, 5 aa, Mycobacterium tuberculosis
PAPTA

SEQ ID NO: 1401330 - protein, 9 aa, Mycobacterium tuberculosis
PAPTDRERG

SEQ ID NO: 1401331 - protein, 14 aa, Mycobacterium tuberculosis
PAPTTTSGDLAAEA

SEQ ID NO: 1401332 - protein, 8 aa, Mycobacterium tuberculosis
PAQPQLNR

SEQ ID NO: 1401333 - protein, 6 aa, Mycobacterium tuberculosis
PAQRAA

SEQ ID NO: 1401334 - protein, 5 aa, Mycobacterium tuberculosis
PAQRT

SEQ ID NO: 1401335 - protein, 8 aa, Mycobacterium tuberculosis
PARDAKGI

SEQ ID NO: 1401336 - protein, 7 aa, Mycobacterium tuberculosis
PARESNT

SEQ ID NO: 1401337 - protein, 9 aa, Mycobacterium tuberculosis
PARGGSSIG

SEQ ID NO: 1401338 - protein, 4 aa, Mycobacterium tuberculosis
PARM

SEQ ID NO: 1401339 - protein, 4 aa, Mycobacterium tuberculosis
PARP

SEQ ID NO: 1401340 - protein, 14 aa, Mycobacterium tuberculosis
PASAAARKAGHPGP

SEQ ID NO: 1401341 - protein, 10 aa, Mycobacterium tuberculosis
PASDGDDRNQ

SEQ ID NO: 1401342 - protein, 6 aa, Mycobacterium tuberculosis
PASDPA

SEQ ID NO: 1401343 - protein, 14 aa, Mycobacterium tuberculosis
PASGRYPHQPAPTG

SEQ ID NO: 1401344 - protein, 7 aa, Mycobacterium tuberculosis
PASPHAA

SEQ ID NO: 1401345 - protein, 12 aa, Mycobacterium tuberculosis
PASRNAVNGPTA

SEQ ID NO: 1401346 - protein, 7 aa, Mycobacterium tuberculosis
PASYPQT

SEQ ID NO: 1401347 - protein, 5 aa, Mycobacterium tuberculosis
PATAV

SEQ ID NO: 1401348 - protein, 8 aa, Mycobacterium tuberculosis
PATDPSVR

SEQ ID NO: 1401349 - protein, 6 aa, Mycobacterium tuberculosis
PATETP

SEQ ID NO: 1401350 - protein, 7 aa, Mycobacterium tuberculosis
PATEYTG

SEQ ID NO: 1401351 - protein, 4 aa, Mycobacterium tuberculosis
PATH

SEQ ID NO: 1401352 - protein, 7 aa, Mycobacterium tuberculosis
PATTDMA

SEQ ID NO: 1401353 - protein, 7 aa, Mycobacterium tuberculosis
PAVADPM

SEQ ID NO: 1401354 - protein, 20 aa, Mycobacterium tuberculosis
PAVASSDARNIETTISRDGA

SEQ ID NO: 1401355 - protein, 5 aa, Mycobacterium tuberculosis
PAVER

SEQ ID NO: 1401356 - protein, 8 aa, Mycobacterium tuberculosis
PAYQGRGI

SEQ ID NO: 1401357 - protein, 7 aa, Mycobacterium tuberculosis
PCRATTA

SEQ ID NO: 1401358 - protein, 4 aa, Mycobacterium tuberculosis
PDAE

SEQ ID NO: 1401359 - protein, 9 aa, Mycobacterium tuberculosis
PDAEPGASP

SEQ ID NO: 1401360 - protein, 5 aa, Mycobacterium tuberculosis
PDAGS

SEQ ID NO: 1401361 - protein, 11 aa, Mycobacterium tuberculosis
PDAKPAATGLE

SEQ ID NO: 1401362 - protein, 7 aa, Mycobacterium tuberculosis
PDALEGT

SEQ ID NO: 1401363 - protein, 8 aa, Mycobacterium tuberculosis
PDAPPDPE

SEQ ID NO: 1401364 - protein, 5 aa, Mycobacterium tuberculosis
PDAQD

SEQ ID NO: 1401365 - protein, 12 aa, Mycobacterium tuberculosis
PDATPGRPNAKT

SEQ ID NO: 1401366 - protein, 8 aa, Mycobacterium tuberculosis
PDDAAARE

SEQ ID NO: 1401367 - protein, 8 aa, Mycobacterium tuberculosis
PDDELGSN

SEQ ID NO: 1401368 - protein, 6 aa, Mycobacterium tuberculosis
PDDIEP

SEQ ID NO: 1401369 - protein, 5 aa, Mycobacterium tuberculosis
PDDYA

SEQ ID NO: 1401370 - protein, 13 aa, Mycobacterium tuberculosis
PDEAAAAAAAGLG

SEQ ID NO: 1401371 - protein, 4 aa, Mycobacterium tuberculosis
PDEG

SEQ ID NO: 1401372 - protein, 7 aa, Mycobacterium tuberculosis
PDERRGA

SEQ ID NO: 1401373 - protein, 10 aa, Mycobacterium tuberculosis
PDFGTGSSRE

SEQ ID NO: 1401374 - protein, 5 aa, Mycobacterium tuberculosis
PDGEV

SEQ ID NO: 1401375 - protein, 7 aa, Mycobacterium tuberculosis
PDGGASA

SEQ ID NO: 1401376 - protein, 14 aa, Mycobacterium tuberculosis
PDGHATNPPARYTE

SEQ ID NO: 1401377 - protein, 5 aa, Mycobacterium tuberculosis
PDGKE

SEQ ID NO: 1401378 - protein, 7 aa, Mycobacterium tuberculosis
PDGKTQV

SEQ ID NO: 1401379 - protein, 5 aa, Mycobacterium tuberculosis
PDGLD

SEQ ID NO: 1401380 - protein, 5 aa, Mycobacterium tuberculosis
PDGMD

SEQ ID NO: 1401381 - protein, 5 aa, Mycobacterium tuberculosis
PDGNG

SEQ ID NO: 1401382 - protein, 7 aa, Mycobacterium tuberculosis
PDGPAPY

SEQ ID NO: 1401383 - protein, 12 aa, Mycobacterium tuberculosis
PDGPDLRVQPGD

SEQ ID NO: 1401384 - protein, 12 aa, Mycobacterium tuberculosis
PDGSDDPEIPPR

SEQ ID NO: 1401385 - protein, 10 aa, Mycobacterium tuberculosis
PDGSPSWADP

SEQ ID NO: 1401386 - protein, 11 aa, Mycobacterium tuberculosis
PDGTTAGPGVE

SEQ ID NO: 1401387 - protein, 9 aa, Mycobacterium tuberculosis
PDHEGPKGL

SEQ ID NO: 1401388 - protein, 7 aa, Mycobacterium tuberculosis
PDHRDTY

SEQ ID NO: 1401389 - protein, 5 aa, Mycobacterium tuberculosis
PDIGA

SEQ ID NO: 1401390 - protein, 7 aa, Mycobacterium tuberculosis
PDKRPDI

SEQ ID NO: 1401391 - protein, 10 aa, Mycobacterium tuberculosis
PDLARRGRGT

SEQ ID NO: 1401392 - protein, 9 aa, Mycobacterium tuberculosis
PDMEPGTES

SEQ ID NO: 1401393 - protein, 62 aa, Mycobacterium tuberculosis; identical to SEQ ID NO: 182298

SEQ ID NO: 1401394 - protein, 9 aa, Mycobacterium tuberculosis
PDNDPRGTR

SEQ ID NO: 1401395 - protein, 13 aa, Mycobacterium tuberculosis
PDNPSYDAAADER

SEQ ID NO: 1401396 - protein, 6 aa, Mycobacterium tuberculosis
PDNTEV

SEQ ID NO: 1401397 - protein, 11 aa, Mycobacterium tuberculosis
PDNVQGAAGPF

SEQ ID NO: 1401398 - protein, 11 aa, Mycobacterium tuberculosis
PDPAPRGSAPA

SEQ ID NO: 1401399 - protein, 10 aa, Mycobacterium tuberculosis
PDPNAPEAQA

SEQ ID NO: 1401400 - protein, 10 aa, Mycobacterium tuberculosis
PDPNGERAGH

SEQ ID NO: 1401401 - protein, 17 aa, Mycobacterium tuberculosis
PDQRPDEGQGGPGAPTL

SEQ ID NO: 1401402 - protein, 5 aa, Mycobacterium tuberculosis
PDQTG

SEQ ID NO: 1401403 - protein, 7 aa, Mycobacterium tuberculosis
PDRPAAE

SEQ ID NO: 1401404 - protein, 4 aa, Mycobacterium tuberculosis
PDRS

SEQ ID NO: 1401405 - protein, 5 aa, Mycobacterium tuberculosis
PDSDN

SEQ ID NO: 1401406 - protein, 9 aa, Mycobacterium tuberculosis
PDSGSSPQL

SEQ ID NO: 1401407 - protein, 8 aa, Mycobacterium tuberculosis
PDSHTRDL

SEQ ID NO: 1401408 - protein, 8 aa, Mycobacterium tuberculosis
PDSPNQPY

SEQ ID NO: 1401409 - protein, 6 aa, Mycobacterium tuberculosis
PDTAAQ

SEQ ID NO: 1401410 - protein, 6 aa, Mycobacterium tuberculosis
PDTAPQ

SEQ ID NO: 1401411 - protein, 7 aa, Mycobacterium tuberculosis
PDTDRAR

SEQ ID NO: 1401412 - protein, 4 aa, Mycobacterium tuberculosis
PDTP

SEQ ID NO: 1401413 - protein, 5 aa, Mycobacterium tuberculosis
PDTTL

SEQ ID NO: 1401414 - protein, 24 aa, Mycobacterium tuberculosis
PDVGSDPARMASTATPIDDGQAYE

SEQ ID NO: 1401415 - protein, 7 aa, Mycobacterium tuberculosis
PDVNESG

SEQ ID NO: 1401416 - protein, 17 aa, Mycobacterium tuberculosis
PDVPGADAGAEGLPSRS

SEQ ID NO: 1401417 - protein, 14 aa, Mycobacterium tuberculosis
PDVPWTTDADGGPA

SEQ ID NO: 1401418 - protein, 8 aa, Mycobacterium tuberculosis
PEAASDEW

SEQ ID NO: 1401419 - protein, 8 aa, Mycobacterium tuberculosis
PEASQAEL

SEQ ID NO: 1401420 - protein, 7 aa, Mycobacterium tuberculosis
PEATAEA

SEQ ID NO: 1401421 - protein, 8 aa, Mycobacterium tuberculosis
PEDFQDPK

SEQ ID NO: 1401422 - protein, 4 aa, Mycobacterium tuberculosis
PEDG

SEQ ID NO: 1401423 - protein, 6 aa, Mycobacterium tuberculosis
PEDGSA

SEQ ID NO: 1401424 - protein, 6 aa, Mycobacterium tuberculosis
PEDTTR

SEQ ID NO: 1401425 - protein, 8 aa, Mycobacterium tuberculosis
PEEPGGRK

SEQ ID NO: 1401426 - protein, 4 aa, Mycobacterium tuberculosis
PEGI

SEQ ID NO: 1401427 - protein, 12 aa, Mycobacterium tuberculosis
PEGKSASSLGLD

SEQ ID NO: 1401428 - protein, 5 aa, Mycobacterium tuberculosis
PEGRG

SEQ ID NO: 1401429 - protein, 9 aa, Mycobacterium tuberculosis
PEGVPGPDR

SEQ ID NO: 1401430 - protein, 9 aa, Mycobacterium tuberculosis
PEHNPGPVL

SEQ ID NO: 1401431 - protein, 24 aa, Mycobacterium tuberculosis
PEHTPNGSSHRDGVGQPLPEPASR

SEQ ID NO: 1401432 - protein, 4 aa, Mycobacterium tuberculosis
PEIS

SEQ ID NO: 1401433 - protein, 11 aa, Mycobacterium tuberculosis
PEKQARKARET

SEQ ID NO: 1401434 - protein, 10 aa, Mycobacterium tuberculosis
PELGPTDDGL

SEQ ID NO: 1401435 - protein, 4 aa, Mycobacterium tuberculosis
PELP

SEQ ID NO: 1401436 - protein, 4 aa, Mycobacterium tuberculosis
PENK

SEQ ID NO: 1401437 - protein, 10 aa, Mycobacterium tuberculosis
PENKGEVIPP

SEQ ID NO: 1401438 - protein, 29 aa, Mycobacterium tuberculosis
PEPAADAAAAAQGVKKRQKAAGPKPRTGS

SEQ ID NO: 1401439 - protein, 10 aa, Mycobacterium tuberculosis
PEPPHGSPRN

SEQ ID NO: 1401440 - protein, 5 aa, Mycobacterium tuberculosis
PEPRL

SEQ ID NO: 1401441 - protein, 9 aa, Mycobacterium tuberculosis
PEPTGLDEA

SEQ ID NO: 1401442 - protein, 5 aa, Mycobacterium tuberculosis
PEPVY

SEQ ID NO: 1401443 - protein, 6 aa, Mycobacterium tuberculosis
PERALS

SEQ ID NO: 1401444 - protein, 7 aa, Mycobacterium tuberculosis
PERISGN

SEQ ID NO: 1401445 - protein, 8 aa, Mycobacterium tuberculosis
PERPLPPL

SEQ ID NO: 1401446 - protein, 8 aa, Mycobacterium tuberculosis
PERRRSRH

SEQ ID NO: 1401447 - protein, 8 aa, Mycobacterium tuberculosis
PERSEGDA

SEQ ID NO: 1401448 - protein, 27 aa, Mycobacterium tuberculosis
PETIEARTDPWDPDSAPTRAQTEAARH

SEQ ID NO: 1401449 - protein, 7 aa, Mycobacterium tuberculosis
PETKPGD

SEQ ID NO: 1401450 - protein, 6 aa, Mycobacterium tuberculosis
PETRRN

SEQ ID NO: 1401451 - protein, 13 aa, Mycobacterium tuberculosis
PETSQTDPTGVGD

SEQ ID NO: 1401452 - protein, 4 aa, Mycobacterium tuberculosis
PEVA

SEQ ID NO: 1401453 - protein, 4 aa, Mycobacterium tuberculosis
PEVP

SEQ ID NO: 1401454 - protein, 13 aa, Mycobacterium tuberculosis
PEWSGSESGGRRY

SEQ ID NO: 1401455 - protein, 4 aa, Mycobacterium tuberculosis
PEWT

SEQ ID NO: 1401456 - protein, 11 aa, Mycobacterium tuberculosis
PFATAGKLSGA

SEQ ID NO: 1401457 - protein, 25 aa, Mycobacterium tuberculosis
PFCPDPAEAAASPVTHAVTSSTDPM

SEQ ID NO: 1401458 - protein, 5 aa, Mycobacterium tuberculosis
PFGAH

SEQ ID NO: 1401459 - protein, 12 aa, Mycobacterium tuberculosis
PFGGYKQSGIGR

SEQ ID NO: 1401460 - protein, 13 aa, Mycobacterium tuberculosis
PFTPDQQAHREAE

SEQ ID NO: 1401461 - protein, 8 aa, Mycobacterium tuberculosis
PGAGEHGG

SEQ ID NO: 1401462 - protein, 6 aa, Mycobacterium tuberculosis
PGAGLE

SEQ ID NO: 1401463 - protein, 6 aa, Mycobacterium tuberculosis
PGAPAS

SEQ ID NO: 1401464 - protein, 9 aa, Mycobacterium tuberculosis
PGAPPSLAG

SEQ ID NO: 1401465 - protein, 12 aa, Mycobacterium tuberculosis
PGAPSAPRKVGN

SEQ ID NO: 1401466 - protein, 19 aa, Mycobacterium tuberculosis
PGAPTGGDDGDAPPGNSLR

SEQ ID NO: 1401467 - protein, 7 aa, Mycobacterium tuberculosis
PGAQGIS

SEQ ID NO: 1401468 - protein, 8 aa, Mycobacterium tuberculosis
PGATTQRH

SEQ ID NO: 1401469 - protein, 5 aa, Mycobacterium tuberculosis
PGDDA

SEQ ID NO: 1401470 - protein, 5 aa, Mycobacterium tuberculosis
PGDEG

SEQ ID NO: 1401471 - protein, 5 aa, Mycobacterium tuberculosis
PGDHQ

SEQ ID NO: 1401472 - protein, 5 aa, Mycobacterium tuberculosis
PGDRV

SEQ ID NO: 1401473 - protein, 5 aa, Mycobacterium tuberculosis
PGEAA

SEQ ID NO: 1401474 - protein, 9 aa, Mycobacterium tuberculosis
PGEAGPQAT

SEQ ID NO: 1401475 - protein, 10 aa, Mycobacterium tuberculosis
PGEAKNTYGT

SEQ ID NO: 1401476 - protein, 7 aa, Mycobacterium tuberculosis
PGEGHNL

SEQ ID NO: 1401477 - protein, 5 aa, Mycobacterium tuberculosis
PGEPP

SEQ ID NO: 1401478 - protein, 12 aa, Mycobacterium tuberculosis
PGEPQSLADDSL

SEQ ID NO: 1401479 - protein, 6 aa, Mycobacterium tuberculosis
PGERER

SEQ ID NO: 1401480 - protein, 15 aa, Mycobacterium tuberculosis
PGFAGADPVTGRRRG

SEQ ID NO: 1401481 - protein, 14 aa, Mycobacterium tuberculosis
PGFASSPQSGEDRS

SEQ ID NO: 1401482 - protein, 4 aa, Mycobacterium tuberculosis
PGFE

SEQ ID NO: 1401483 - protein, 6 aa, Mycobacterium tuberculosis
PGFGEQ

SEQ ID NO: 1401484 - protein, 6 aa, Mycobacterium tuberculosis
PGFGNT

SEQ ID NO: 1401485 - protein, 5 aa, Mycobacterium tuberculosis
PGGDE

SEQ ID NO: 1401486 - protein, 5 aa, Mycobacterium tuberculosis
PGGES

SEQ ID NO: 1401487 - protein, 7 aa, Mycobacterium tuberculosis
PGGGGVT

SEQ ID NO: 1401488 - protein, 10 aa, Mycobacterium tuberculosis
PGGPLTAQQV

SEQ ID NO: 1401489 - protein, 8 aa, Mycobacterium tuberculosis
PGGQGDDV

SEQ ID NO: 1401490 - protein, 12 aa, Mycobacterium tuberculosis
PGGRAYDEPPVN

SEQ ID NO: 1401491 - protein, 4 aa, Mycobacterium tuberculosis
PGGT

SEQ ID NO: 1401492 - protein, 7 aa, Mycobacterium tuberculosis
PGHGNTG

SEQ ID NO: 1401493 - protein, 5 aa, Mycobacterium tuberculosis
PGHGP

SEQ ID NO: 1401494 - protein, 7 aa, Mycobacterium tuberculosis
PGHTPGS

SEQ ID NO: 1401495 - protein, 7 aa, Mycobacterium tuberculosis
PGIDTGR

SEQ ID NO: 1401496 - protein, 9 aa, Mycobacterium tuberculosis
PGIGPKSAQ

SEQ ID NO: 1401497 - protein, 11 aa, Mycobacterium tuberculosis
PGKAGANAADA

SEQ ID NO: 1401498 - protein, 7 aa, Mycobacterium tuberculosis
PGKEEFS

SEQ ID NO: 1401499 - protein, 4 aa, Mycobacterium tuberculosis
PGLD

SEQ ID NO: 1401500 - protein, 8 aa, Mycobacterium tuberculosis
PGLDDRAS

SEQ ID NO: 1401501 - protein, 14 aa, Mycobacterium tuberculosis
PGLGPLPATGRGLR

SEQ ID NO: 1401502 - protein, 9 aa, Mycobacterium tuberculosis
PGLPPPPEQ

SEQ ID NO: 1401503 - protein, 10 aa, Mycobacterium tuberculosis
PGNAGTARIA

SEQ ID NO: 1401504 - protein, 9 aa, Mycobacterium tuberculosis
PGNDYAGDQ

SEQ ID NO: 1401505 - protein, 8 aa, Mycobacterium tuberculosis
PGNRPSTS

SEQ ID NO: 1401506 - protein, 5 aa, Mycobacterium tuberculosis
PGPAH

SEQ ID NO: 1401507 - protein, 11 aa, Mycobacterium tuberculosis
PGPDAVTPAAD

SEQ ID NO: 1401508 - protein, 12 aa, Mycobacterium tuberculosis
PGPEDGSVPVPV

SEQ ID NO: 1401509 - protein, 6 aa, Mycobacterium tuberculosis
PGPGEL

SEQ ID NO: 1401510 - protein, 6 aa, Mycobacterium tuberculosis
PGPGGL

SEQ ID NO: 1401511 - protein, 4 aa, Mycobacterium tuberculosis
PGPH

SEQ ID NO: 1401512 - protein, 6 aa, Mycobacterium tuberculosis
PGPPTI

SEQ ID NO: 1401513 - protein, 5 aa, Mycobacterium tuberculosis
PGPTD

SEQ ID NO: 1401514 - protein, 15 aa, Mycobacterium tuberculosis
PGPTGEQHVAYLKRP

SEQ ID NO: 1401515 - protein, 5 aa, Mycobacterium tuberculosis
PGPTL

SEQ ID NO: 1401516 - protein, 11 aa, Mycobacterium tuberculosis
PGPVTSSASAG

SEQ ID NO: 1401517 - protein, 9 aa, Mycobacterium tuberculosis
PGQAAAYGA

SEQ ID NO: 1401518 - protein, 12 aa, Mycobacterium tuberculosis
PGQDRQRRAALC

SEQ ID NO: 1401519 - protein, 6 aa, Mycobacterium tuberculosis
PGQPAL

SEQ ID NO: 1401520 - protein, 9 aa, Mycobacterium tuberculosis
PGQPESELP

SEQ ID NO: 1401521 - protein, 7 aa, Mycobacterium tuberculosis
PGQPLPT

SEQ ID NO: 1401522 - protein, 5 aa, Mycobacterium tuberculosis
PGQTG

SEQ ID NO: 1401523 - protein, 7 aa, Mycobacterium tuberculosis
PGRGGVD

SEQ ID NO: 1401524 - protein, 4 aa, Mycobacterium tuberculosis
PGRL

SEQ ID NO: 1401525 - protein, 8 aa, Mycobacterium tuberculosis
PGRNAADV

SEQ ID NO: 1401526 - protein, 13 aa, Mycobacterium tuberculosis
PGRPAAGSDPDWD

SEQ ID NO: 1401527 - protein, 8 aa, Mycobacterium tuberculosis
PGRPAPTL

SEQ ID NO: 1401528 - protein, 5 aa, Mycobacterium tuberculosis
PGRPP

SEQ ID NO: 1401529 - protein, 7 aa, Mycobacterium tuberculosis
PGRPPRH

SEQ ID NO: 1401530 - protein, 8 aa, Mycobacterium tuberculosis
PGRPRPGY

SEQ ID NO: 1401531 - protein, 6 aa, Mycobacterium tuberculosis
PGRRTD

SEQ ID NO: 1401532 - protein, 8 aa, Mycobacterium tuberculosis
PGRTVTEA

SEQ ID NO: 1401533 - protein, 22 aa, Mycobacterium tuberculosis
PGSAAPPATDRRRDGFARRSGQ

SEQ ID NO: 1401534 - protein, 10 aa, Mycobacterium tuberculosis
PGSADSEGPV

SEQ ID NO: 1401535 - protein, 4 aa, Mycobacterium tuberculosis
PGSG

SEQ ID NO: 1401536 - protein, 12 aa, Mycobacterium tuberculosis
PGSPFGERRPSD

SEQ ID NO: 1401537 - protein, 9 aa, Mycobacterium tuberculosis
PGSPGGVRD

SEQ ID NO: 1401538 - protein, 5 aa, Mycobacterium tuberculosis
PGSRF

SEQ ID NO: 1401539 - protein, 13 aa, Mycobacterium tuberculosis
PGSRFAQATRAAG

SEQ ID NO: 1401540 - protein, 7 aa, Mycobacterium tuberculosis
PGSRGIT

SEQ ID NO: 1401541 - protein, 6 aa, Mycobacterium tuberculosis
PGSTDV

SEQ ID NO: 1401542 - protein, 7 aa, Mycobacterium tuberculosis
PGTAAPL

SEQ ID NO: 1401543 - protein, 7 aa, Mycobacterium tuberculosis
PGTDQEY

SEQ ID NO: 1401544 - protein, 7 aa, Mycobacterium tuberculosis
PGTEAPA

SEQ ID NO: 1401545 - protein, 7 aa, Mycobacterium tuberculosis
PGTGLDE

SEQ ID NO: 1401546 - protein, 4 aa, Mycobacterium tuberculosis
PGTL

SEQ ID NO: 1401547 - protein, 8 aa, Mycobacterium tuberculosis
PGTNGQVS

SEQ ID NO: 1401548 - protein, 6 aa, Mycobacterium tuberculosis
PGTPGL

SEQ ID NO: 1401549 - protein, 9 aa, Mycobacterium tuberculosis
PGTSSSVKG

SEQ ID NO: 1401550 - protein, 10 aa, Mycobacterium tuberculosis
PGTTSVHSSG

SEQ ID NO: 1401551 - protein, 5 aa, Mycobacterium tuberculosis
PGVEP

SEQ ID NO: 1401552 - protein, 9 aa, Mycobacterium tuberculosis
PGVKPPDVD

SEQ ID NO: 1401553 - protein, 13 aa, Mycobacterium tuberculosis
PGVTGKPVGNDLA

SEQ ID NO: 1401554 - protein, 6 aa, Mycobacterium tuberculosis
PHADGP

SEQ ID NO: 1401555 - protein, 4 aa, Mycobacterium tuberculosis
PHAG

SEQ ID NO: 1401556 - protein, 6 aa, Mycobacterium tuberculosis
PHAGAS

SEQ ID NO: 1401557 - protein, 14 aa, Mycobacterium tuberculosis
PHGADPATGKPTSE

SEQ ID NO: 1401558 - protein, 7 aa, Mycobacterium tuberculosis
PHGGDAT

SEQ ID NO: 1401559 - protein, 11 aa, Mycobacterium tuberculosis
PHGTPDEPKGV

SEQ ID NO: 1401560 - protein, 6 aa, Mycobacterium tuberculosis
PHITYQ

SEQ ID NO: 1401561 - protein, 6 aa, Mycobacterium tuberculosis
PHKRTG

SEQ ID NO: 1401562 - protein, 18 aa, Mycobacterium tuberculosis
PHPPRDAREFRTSTGKAN

SEQ ID NO: 1401563 - protein, 4 aa, Mycobacterium tuberculosis
PHPR

SEQ ID NO: 1401564 - protein, 5 aa, Mycobacterium tuberculosis
PHQPG

SEQ ID NO: 1401565 - protein, 7 aa, Mycobacterium tuberculosis
PHRGGAV

SEQ ID NO: 1401566 - protein, 10 aa, Mycobacterium tuberculosis
PHTEEPTNWS

SEQ ID NO: 1401567 - protein, 11 aa, Mycobacterium tuberculosis
PIADPVSRTQV

SEQ ID NO: 1401568 - protein, 7 aa, Mycobacterium tuberculosis
PIDQPDY

SEQ ID NO: 1401569 - protein, 5 aa, Mycobacterium tuberculosis
PIGED

SEQ ID NO: 1401570 - protein, 5 aa, Mycobacterium tuberculosis
PIGRG

SEQ ID NO: 1401571 - protein, 6 aa, Mycobacterium tuberculosis
PIHPSG

SEQ ID NO: 1401572 - protein, 7 aa, Mycobacterium tuberculosis
PINIPSP

SEQ ID NO: 1401573 - protein, 13 aa, Mycobacterium tuberculosis
PIPDPDRAGPSTL

SEQ ID NO: 1401574 - protein, 14 aa, Mycobacterium tuberculosis
PIPPNKPNIREDEA

SEQ ID NO: 1401575 - protein, 10 aa, Mycobacterium tuberculosis
PISPERAEAK

SEQ ID NO: 1401576 - protein, 7 aa, Mycobacterium tuberculosis
PISREHA

SEQ ID NO: 1401577 - protein, 5 aa, Mycobacterium tuberculosis
PITDG

SEQ ID NO: 1401578 - protein, 7 aa, Mycobacterium tuberculosis
PITDSEA

SEQ ID NO: 1401579 - protein, 5 aa, Mycobacterium tuberculosis
PITPA

SEQ ID NO: 1401580 - protein, 6 aa, Mycobacterium tuberculosis
PKADGF

SEQ ID NO: 1401581 - protein, 10 aa, Mycobacterium tuberculosis
PKAGEPARGI

SEQ ID NO: 1401582 - protein, 11 aa, Mycobacterium tuberculosis
PKDAPTGGDPL

SEQ ID NO: 1401583 - protein, 7 aa, Mycobacterium tuberculosis
PKDLSGV

SEQ ID NO: 1401584 - protein, 10 aa, Mycobacterium tuberculosis
PKEEVSEQEY

SEQ ID NO: 1401585 - protein, 10 aa, Mycobacterium tuberculosis
PKGAPGEPIT

SEQ ID NO: 1401586 - protein, 14 aa, Mycobacterium tuberculosis
PKGKVDPGETAPVG

SEQ ID NO: 1401587 - protein, 6 aa, Mycobacterium tuberculosis
PKGPGH

SEQ ID NO: 1401588 - protein, 4 aa, Mycobacterium tuberculosis
PKHA

SEQ ID NO: 1401589 - protein, 9 aa, Mycobacterium tuberculosis
PKKKNGFEL

SEQ ID NO: 1401590 - protein, 9 aa, Mycobacterium tuberculosis
PKKSEITER

SEQ ID NO: 1401591 - protein, 9 aa, Mycobacterium tuberculosis
PKLSAGRVQ

SEQ ID NO: 1401592 - protein, 6 aa, Mycobacterium tuberculosis
PKPIPH

SEQ ID NO: 1401593 - protein, 5 aa, Mycobacterium tuberculosis
PKPLR

SEQ ID NO: 1401594 - protein, 11 aa, Mycobacterium tuberculosis
PKPSDAEEART

SEQ ID NO: 1401595 - protein, 18 aa, Mycobacterium tuberculosis
PKRPALRPTKAAATTAAT

SEQ ID NO: 1401596 - protein, 6 aa, Mycobacterium tuberculosis
PKRRRP

SEQ ID NO: 1401597 - protein, 7 aa, Mycobacterium tuberculosis
PKSERSE

SEQ ID NO: 1401598 - protein, 13 aa, Mycobacterium tuberculosis
PKSNAASPQPFRV

SEQ ID NO: 1401599 - protein, 22 aa, Mycobacterium tuberculosis
PKTAAPSISNATVASPAAPGLE

SEQ ID NO: 1401600 - protein, 4 aa, Mycobacterium tuberculosis
PKTD

SEQ ID NO: 1401601 - protein, 15 aa, Mycobacterium tuberculosis
PKTKRTKTGYTTDAD

SEQ ID NO: 1401602 - protein, 7 aa, Mycobacterium tuberculosis
PKTRSGK

SEQ ID NO: 1401603 - protein, 10 aa, Mycobacterium tuberculosis
PKVDEDSDVD

SEQ ID NO: 1401604 - protein, 11 aa, Mycobacterium tuberculosis
PLADSTASQAR

SEQ ID NO: 1401605 - protein, 5 aa, Mycobacterium tuberculosis
PLDAH

SEQ ID NO: 1401606 - protein, 7 aa, Mycobacterium tuberculosis
PLDDGTA

SEQ ID NO: 1401607 - protein, 6 aa, Mycobacterium tuberculosis
PLDDKA

SEQ ID NO: 1401608 - protein, 8 aa, Mycobacterium tuberculosis
PLDESDRR

SEQ ID NO: 1401609 - protein, 5 aa, Mycobacterium tuberculosis
PLDPE

SEQ ID NO: 1401610 - protein, 7 aa, Mycobacterium tuberculosis
PLEGPEA

SEQ ID NO: 1401611 - protein, 11 aa, Mycobacterium tuberculosis
PLGEQRAGQAD

SEQ ID NO: 1401612 - protein, 13 aa, Mycobacterium tuberculosis
PLGRQAEAAQRAA

SEQ ID NO: 1401613 - protein, 12 aa, Mycobacterium tuberculosis
PLPAGDAARDEA

SEQ ID NO: 1401614 - protein, 10 aa, Mycobacterium tuberculosis
PLPGESLPGA

SEQ ID NO: 1401615 - protein, 15 aa, Mycobacterium tuberculosis
PLPGSVTPGAAPLPV

SEQ ID NO: 1401616 - protein, 5 aa, Mycobacterium tuberculosis
PLPTA

SEQ ID NO: 1401617 - protein, 11 aa, Mycobacterium tuberculosis
PLPTSPGYTGN

SEQ ID NO: 1401618 - protein, 8 aa, Mycobacterium tuberculosis
PLRPQERR

SEQ ID NO: 1401619 - protein, 8 aa, Mycobacterium tuberculosis
PLSGIGPD

SEQ ID NO: 1401620 - protein, 7 aa, Mycobacterium tuberculosis
PLTAGSG

SEQ ID NO: 1401621 - protein, 17 aa, Mycobacterium tuberculosis
PLTDDQRTQVEEVTNEA

SEQ ID NO: 1401622 - protein, 7 aa, Mycobacterium tuberculosis
PLTPPVK

SEQ ID NO: 1401623 - protein, 10 aa, Mycobacterium tuberculosis
PMTDTNTGSY

SEQ ID NO: 1401624 - protein, 7 aa, Mycobacterium tuberculosis
PNAAAGN

SEQ ID NO: 1401625 - protein, 11 aa, Mycobacterium tuberculosis
PNAADYRKPAP

SEQ ID NO: 1401626 - protein, 5 aa, Mycobacterium tuberculosis
PNAPS

SEQ ID NO: 1401627 - protein, 4 aa, Mycobacterium tuberculosis
PNAQ

SEQ ID NO: 1401628 - protein, 6 aa, Mycobacterium tuberculosis
PNARPP

SEQ ID NO: 1401629 - protein, 9 aa, Mycobacterium tuberculosis
PNASGGTDL

SEQ ID NO: 1401630 - protein, 6 aa, Mycobacterium tuberculosis
PNATAE

SEQ ID NO: 1401631 - protein, 8 aa, Mycobacterium tuberculosis
PNGAGKTS

SEQ ID NO: 1401632 - protein, 16 aa, Mycobacterium tuberculosis
PNKGETDRRPPQGEPY

SEQ ID NO: 1401633 - protein, 13 aa, Mycobacterium tuberculosis
PNLEGGKERAIED

SEQ ID NO: 1401634 - protein, 4 aa, Mycobacterium tuberculosis
PNMT

SEQ ID NO: 1401635 - protein, 12 aa, Mycobacterium tuberculosis
PNNPETGCKSRD

SEQ ID NO: 1401636 - protein, 10 aa, Mycobacterium tuberculosis
PNNPSGQSVS

SEQ ID NO: 1401637 - protein, 7 aa, Mycobacterium tuberculosis
PNPAPLK

SEQ ID NO: 1401638 - protein, 19 aa, Mycobacterium tuberculosis
PNPDAEPDRRGVNPAPTRV

SEQ ID NO: 1401639 - protein, 10 aa, Mycobacterium tuberculosis
PNPEEPGATD

SEQ ID NO: 1401640 - protein, 6 aa, Mycobacterium tuberculosis
PNPGLA

SEQ ID NO: 1401641 - protein, 21 aa, Mycobacterium tuberculosis
PNPIEPPTDIAPDPDSTKTWL

SEQ ID NO: 1401642 - protein, 6 aa, Mycobacterium tuberculosis
PNQTEI

SEQ ID NO: 1401643 - protein, 6 aa, Mycobacterium tuberculosis
PNSDGA

SEQ ID NO: 1401644 - protein, 4 aa, Mycobacterium tuberculosis
PNTS

SEQ ID NO: 1401645 - protein, 7 aa, Mycobacterium tuberculosis
PNTSSNI

SEQ ID NO: 1401646 - protein, 5 aa, Mycobacterium tuberculosis
PPAAQ

SEQ ID NO: 1401647 - protein, 7 aa, Mycobacterium tuberculosis
PPAETGL

SEQ ID NO: 1401648 - protein, 5 aa, Mycobacterium tuberculosis
PPAFA

SEQ ID NO: 1401649 - protein, 8 aa, Mycobacterium tuberculosis
PPANADDT

SEQ ID NO: 1401650 - protein, 7 aa, Mycobacterium tuberculosis
PPANNAN

SEQ ID NO: 1401651 - protein, 10 aa, Mycobacterium tuberculosis
PPATIANNRE

SEQ ID NO: 1401652 - protein, 17 aa, Mycobacterium tuberculosis
PPATLPPGEYRQISGNT

SEQ ID NO: 1401653 - protein, 8 aa, Mycobacterium tuberculosis
PPDDPRVR

SEQ ID NO: 1401654 - protein, 6 aa, Mycobacterium tuberculosis
PPDPSS

SEQ ID NO: 1401655 - protein, 9 aa, Mycobacterium tuberculosis
PPDTPAGQR

SEQ ID NO: 1401656 - protein, 5 aa, Mycobacterium tuberculosis
PPGRS

SEQ ID NO: 1401657 - protein, 6 aa, Mycobacterium tuberculosis
PPGSPA

SEQ ID NO: 1401658 - protein, 8 aa, Mycobacterium tuberculosis
PPGTDERQ

SEQ ID NO: 1401659 - protein, 12 aa, Mycobacterium tuberculosis
PPGTGKTTTAEA

SEQ ID NO: 1401660 - protein, 7 aa, Mycobacterium tuberculosis
PPGVGPA

SEQ ID NO: 1401661 - protein, 4 aa, Mycobacterium tuberculosis
PPHG

SEQ ID NO: 1401662 - protein, 10 aa, Mycobacterium tuberculosis
PPKDEKPEWA

SEQ ID NO: 1401663 - protein, 10 aa, Mycobacterium tuberculosis
PPLGPDAPPL

SEQ ID NO: 1401664 - protein, 7 aa, Mycobacterium tuberculosis
PPLPPEY

SEQ ID NO: 1401665 - protein, 13 aa, Mycobacterium tuberculosis
PPLRTAKSSPTSI

SEQ ID NO: 1401666 - protein, 28 aa, Mycobacterium tuberculosis
PPNNSTDAPRYQAAAPTGPIEENLTDED

SEQ ID NO: 1401667 - protein, 5 aa, Mycobacterium tuberculosis
PPNPE

SEQ ID NO: 1401668 - protein, 15 aa, Mycobacterium tuberculosis
PPPAPEIPKSSLGAG

SEQ ID NO: 1401669 - protein, 6 aa, Mycobacterium tuberculosis
PPPAPR

SEQ ID NO: 1401670 - protein, 9 aa, Mycobacterium tuberculosis
PPPGTPDDQ

SEQ ID NO: 1401671 - protein, 7 aa, Mycobacterium tuberculosis
PPPHGPE

SEQ ID NO: 1401672 - protein, 8 aa, Mycobacterium tuberculosis
PPPYRSDG

SEQ ID NO: 1401673 - protein, 6 aa, Mycobacterium tuberculosis
PPQRAG

SEQ ID NO: 1401674 - protein, 10 aa, Mycobacterium tuberculosis
PPRNAPPAAL

SEQ ID NO: 1401675 - protein, 15 aa, Mycobacterium tuberculosis
PPRPLASTSIPAGGI

SEQ ID NO: 1401676 - protein, 6 aa, Mycobacterium tuberculosis
PPRSGL

SEQ ID NO: 1401677 - protein, 13 aa, Mycobacterium tuberculosis
PPRWVQPATMRAA

SEQ ID NO: 1401678 - protein, 8 aa, Mycobacterium tuberculosis
PPSAVPRA

SEQ ID NO: 1401679 - protein, 10 aa, Mycobacterium tuberculosis
PPSDDPVPPG

SEQ ID NO: 1401680 - protein, 7 aa, Mycobacterium tuberculosis
PPSHTRG

SEQ ID NO: 1401681 - protein, 7 aa, Mycobacterium tuberculosis
PPSWAGQ

SEQ ID NO: 1401682 - protein, 6 aa, Mycobacterium tuberculosis
PPTDRA

SEQ ID NO: 1401683 - protein, 9 aa, Mycobacterium tuberculosis
PPTEPLDPS

SEQ ID NO: 1401684 - protein, 7 aa, Mycobacterium tuberculosis
PPTGDDA

SEQ ID NO: 1401685 - protein, 8 aa, Mycobacterium tuberculosis
PPTGQGDP

SEQ ID NO: 1401686 - protein, 6 aa, Mycobacterium tuberculosis
PPVGSG

SEQ ID NO: 1401687 - protein, 14 aa, Mycobacterium tuberculosis
PPVPEPRADRSARE

SEQ ID NO: 1401688 - protein, 5 aa, Mycobacterium tuberculosis
PPYAG

SEQ ID NO: 1401689 - protein, 5 aa, Mycobacterium tuberculosis
PPYGI

SEQ ID NO: 1401690 - protein, 7 aa, Mycobacterium tuberculosis
PPYNVDS

SEQ ID NO: 1401691 - protein, 11 aa, Mycobacterium tuberculosis
PQADEAANYGG

SEQ ID NO: 1401692 - protein, 5 aa, Mycobacterium tuberculosis
PQDGA

SEQ ID NO: 1401693 - protein, 7 aa, Mycobacterium tuberculosis
PQDPEAL

SEQ ID NO: 1401694 - protein, 7 aa, Mycobacterium tuberculosis
PQDPKVG

SEQ ID NO: 1401695 - protein, 5 aa, Mycobacterium tuberculosis
PQEGF

SEQ ID NO: 1401696 - protein, 6 aa, Mycobacterium tuberculosis
PQEGIT

SEQ ID NO: 1401697 - protein, 10 aa, Mycobacterium tuberculosis
PQGDEQPTDL

SEQ ID NO: 1401698 - protein, 7 aa, Mycobacterium tuberculosis
PQGVPDT

SEQ ID NO: 1401699 - protein, 7 aa, Mycobacterium tuberculosis
PQHPSTH

SEQ ID NO: 1401700 - protein, 12 aa, Mycobacterium tuberculosis
PQLDPGRTGSTA

SEQ ID NO: 1401701 - protein, 10 aa, Mycobacterium tuberculosis
PQPAQPGGSY

SEQ ID NO: 1401702 - protein, 4 aa, Mycobacterium tuberculosis
PQPD

SEQ ID NO: 1401703 - protein, 6 aa, Mycobacterium tuberculosis
PQPIPE

SEQ ID NO: 1401704 - protein, 8 aa, Mycobacterium tuberculosis
PQQTTSAV

SEQ ID NO: 1401705 - protein, 7 aa, Mycobacterium tuberculosis
PQRAGSE

SEQ ID NO: 1401706 - protein, 5 aa, Mycobacterium tuberculosis
PQRDR

SEQ ID NO: 1401707 - protein, 5 aa, Mycobacterium tuberculosis
PQRGR

SEQ ID NO: 1401708 - protein, 6 aa, Mycobacterium tuberculosis
PQRPEY

SEQ ID NO: 1401709 - protein, 12 aa, Mycobacterium tuberculosis
PQRYRGGPATPT

SEQ ID NO: 1401710 - protein, 4 aa, Mycobacterium tuberculosis
PQTD

SEQ ID NO: 1401711 - protein, 6 aa, Mycobacterium tuberculosis
PQTNRL

SEQ ID NO: 1401712 - protein, 8 aa, Mycobacterium tuberculosis
PRAALPAT

SEQ ID NO: 1401713 - protein, 6 aa, Mycobacterium tuberculosis
PRAKTK

SEQ ID NO: 1401714 - protein, 4 aa, Mycobacterium tuberculosis
PRAT

SEQ ID NO: 1401715 - protein, 8 aa, Mycobacterium tuberculosis
PRATAAKF

SEQ ID NO: 1401716 - protein, 6 aa, Mycobacterium tuberculosis
PRDADP

SEQ ID NO: 1401717 - protein, 5 aa, Mycobacterium tuberculosis
PRDEW

SEQ ID NO: 1401718 - protein, 8 aa, Mycobacterium tuberculosis
PRDRNGTF

SEQ ID NO: 1401719 - protein, 14 aa, Mycobacterium tuberculosis
PRDSPLSSGDAAEL

SEQ ID NO: 1401720 - protein, 19 aa, Mycobacterium tuberculosis
PREAEQLPMPPPAYGSAEL

SEQ ID NO: 1401721 - protein, 8 aa, Mycobacterium tuberculosis
PRENGREA

SEQ ID NO: 1401722 - protein, 5 aa, Mycobacterium tuberculosis
PREQP

SEQ ID NO: 1401723 - protein, 5 aa, Mycobacterium tuberculosis
PRGAQ

SEQ ID NO: 1401724 - protein, 11 aa, Mycobacterium tuberculosis
PRGCGKTSSAR

SEQ ID NO: 1401725 - protein, 10 aa, Mycobacterium tuberculosis
PRGGRLPSER

SEQ ID NO: 1401726 - protein, 11 aa, Mycobacterium tuberculosis
PRGPERLPGNH

SEQ ID NO: 1401727 - protein, 15 aa, Mycobacterium tuberculosis
PRGRRTARPSGDDRE

SEQ ID NO: 1401728 - protein, 15 aa, Mycobacterium tuberculosis
PRGSAYHHASGPAKA

SEQ ID NO: 1401729 - protein, 4 aa, Mycobacterium tuberculosis
PRHQ

SEQ ID NO: 1401730 - protein, 19 aa, Mycobacterium tuberculosis
PRKGRPSQARRAEEQRPSF

SEQ ID NO: 1401731 - protein, 13 aa, Mycobacterium tuberculosis
PRKPSRSERRDKS

SEQ ID NO: 1401732 - protein, 6 aa, Mycobacterium tuberculosis
PRLDNQ

SEQ ID NO: 1401733 - protein, 7 aa, Mycobacterium tuberculosis
PRLNTQQ

SEQ ID NO: 1401734 - protein, 9 aa, Mycobacterium tuberculosis
PRMPPRPRD

SEQ ID NO: 1401735 - protein, 7 aa, Mycobacterium tuberculosis
PRNPAGK

SEQ ID NO: 1401736 - protein, 8 aa, Mycobacterium tuberculosis
PRNPLTGQ

SEQ ID NO: 1401737 - protein, 7 aa, Mycobacterium tuberculosis
PRNTDGE

SEQ ID NO: 1401738 - protein, 6 aa, Mycobacterium tuberculosis
PRPARP

SEQ ID NO: 1401739 - protein, 7 aa, Mycobacterium tuberculosis
PRPGNED

SEQ ID NO: 1401740 - protein, 7 aa, Mycobacterium tuberculosis
PRPGTPF

SEQ ID NO: 1401741 - protein, 14 aa, Mycobacterium tuberculosis
PRPSSRPAAASLPD

SEQ ID NO: 1401742 - protein, 9 aa, Mycobacterium tuberculosis
PRRASSPFG

SEQ ID NO: 1401743 - protein, 7 aa, Mycobacterium tuberculosis
PRSAGRE

SEQ ID NO: 1401744 - protein, 9 aa, Mycobacterium tuberculosis
PRSEGHRGG

SEQ ID NO: 1401745 - protein, 7 aa, Mycobacterium tuberculosis
PRSFTTA

SEQ ID NO: 1401746 - protein, 18 aa, Mycobacterium tuberculosis
PRTNKRTDSWGGTPANRR

SEQ ID NO: 1401747 - protein, 28 aa, Mycobacterium tuberculosis
PRTSVGKYDKKAIRSRYAEGAYQITEVH

SEQ ID NO: 1401748 - protein, 10 aa, Mycobacterium tuberculosis
PRVPSAEEMA

SEQ ID NO: 1401749 - protein, 8 aa, Mycobacterium tuberculosis
PRVSPPAS

SEQ ID NO: 1401750 - protein, 9 aa, Mycobacterium tuberculosis
PRVSPVSDG

SEQ ID NO: 1401751 - protein, 6 aa, Mycobacterium tuberculosis
PRYDSD

SEQ ID NO: 1401752 - protein, 9 aa, Mycobacterium tuberculosis
PSAGGGGKG

SEQ ID NO: 1401753 - protein, 8 aa, Mycobacterium tuberculosis
PSAGKSSL

SEQ ID NO: 1401754 - protein, 6 aa, Mycobacterium tuberculosis
PSAPGQ

SEQ ID NO: 1401755 - protein, 16 aa, Mycobacterium tuberculosis
PSAQPVSNRRGKPAIP

SEQ ID NO: 1401756 - protein, 10 aa, Mycobacterium tuberculosis
PSDDAPQDYV

SEQ ID NO: 1401757 - protein, 9 aa, Mycobacterium tuberculosis
PSDDPPPIA

SEQ ID NO: 1401758 - protein, 14 aa, Mycobacterium tuberculosis
PSDGSGVTPGTGMP

SEQ ID NO: 1401759 - protein, 7 aa, Mycobacterium tuberculosis
PSGRRRQ

SEQ ID NO: 1401760 - protein, 9 aa, Mycobacterium tuberculosis
PSGRRTAKE

SEQ ID NO: 1401761 - protein, 4 aa, Mycobacterium tuberculosis
PSGS

SEQ ID NO: 1401762 - protein, 8 aa, Mycobacterium tuberculosis
PSGSGKST

SEQ ID NO: 1401763 - protein, 12 aa, Mycobacterium tuberculosis
PSGSTLDATETV

SEQ ID NO: 1401764 - protein, 4 aa, Mycobacterium tuberculosis
PSGT

SEQ ID NO: 1401765 - protein, 30 aa, Mycobacterium tuberculosis; identical to SEQ ID NO: 183454

SEQ ID NO: 1401766 - protein, 12 aa, Mycobacterium tuberculosis
PSIEQGNNDSHA

SEQ ID NO: 1401767 - protein, 4 aa, Mycobacterium tuberculosis
PSIT

SEQ ID NO: 1401768 - protein, 22 aa, Mycobacterium tuberculosis
PSKNNPTKGPTSAPSYVRVSDN

SEQ ID NO: 1401769 - protein, 12 aa, Mycobacterium tuberculosis
PSLAPAGKQAAS

SEQ ID NO: 1401770 - protein, 20 aa, Mycobacterium tuberculosis
PSLTITRDGSRDAVSNARPV

SEQ ID NO: 1401771 - protein, 12 aa, Mycobacterium tuberculosis
PSNPAAYNAASE

SEQ ID NO: 1401772 - protein, 12 aa, Mycobacterium tuberculosis
PSPAEPATTSQV

SEQ ID NO: 1401773 - protein, 9 aa, Mycobacterium tuberculosis
PSPGSTTAH

SEQ ID NO: 1401774 - protein, 10 aa, Mycobacterium tuberculosis
PSPLGHEERR

SEQ ID NO: 1401775 - protein, 4 aa, Mycobacterium tuberculosis
PSQI

SEQ ID NO: 1401776 - protein, 5 aa, Mycobacterium tuberculosis
PSRAM

SEQ ID NO: 1401777 - protein, 8 aa, Mycobacterium tuberculosis
PSRPSPAG

SEQ ID NO: 1401778 - protein, 7 aa, Mycobacterium tuberculosis
PSSGPAI

SEQ ID NO: 1401779 - protein, 6 aa, Mycobacterium tuberculosis
PSSGRV

SEQ ID NO: 1401780 - protein, 11 aa, Mycobacterium tuberculosis
PSSLPSSRESA

SEQ ID NO: 1401781 - protein, 4 aa, Mycobacterium tuberculosis
PSTC

SEQ ID NO: 1401782 - protein, 5 aa, Mycobacterium tuberculosis
PSTMK

SEQ ID NO: 1401783 - protein, 6 aa, Mycobacterium tuberculosis
PSTPGD

SEQ ID NO: 1401784 - protein, 5 aa, Mycobacterium tuberculosis
PSTPS

SEQ ID NO: 1401785 - protein, 4 aa, Mycobacterium tuberculosis
PSVP

SEQ ID NO: 1401786 - protein, 7 aa, Mycobacterium tuberculosis
PSVSPVP

SEQ ID NO: 1401787 - protein, 4 aa, Mycobacterium tuberculosis
PSYG

SEQ ID NO: 1401788 - protein, 6 aa, Mycobacterium tuberculosis
PSYGGS

SEQ ID NO: 1401789 - protein, 5 aa, Mycobacterium tuberculosis
PTADG

SEQ ID NO: 1401790 - protein, 7 aa, Mycobacterium tuberculosis
PTAEQAR

SEQ ID NO: 1401791 - protein, 7 aa, Mycobacterium tuberculosis
PTDARRT

SEQ ID NO: 1401792 - protein, 7 aa, Mycobacterium tuberculosis
PTDSPFR

SEQ ID NO: 1401793 - protein, 7 aa, Mycobacterium tuberculosis
PTEHEGL

SEQ ID NO: 1401794 - protein, 8 aa, Mycobacterium tuberculosis
PTEPRDPT

SEQ ID NO: 1401795 - protein, 8 aa, Mycobacterium tuberculosis
PTESESLA

SEQ ID NO: 1401796 - protein, 5 aa, Mycobacterium tuberculosis
PTFTD

SEQ ID NO: 1401797 - protein, 7 aa, Mycobacterium tuberculosis
PTGATTY

SEQ ID NO: 1401798 - protein, 5 aa, Mycobacterium tuberculosis
PTGQA

SEQ ID NO: 1401799 - protein, 7 aa, Mycobacterium tuberculosis
PTGSTPV

SEQ ID NO: 1401800 - protein, 5 aa, Mycobacterium tuberculosis
PTGSV

SEQ ID NO: 1401801 - protein, 12 aa, Mycobacterium tuberculosis
PTGSYRIETGKA

SEQ ID NO: 1401802 - protein, 4 aa, Mycobacterium tuberculosis
PTGV

SEQ ID NO: 1401803 - protein, 12 aa, Mycobacterium tuberculosis
PTITRSTPEGAR

SEQ ID NO: 1401804 - protein, 5 aa, Mycobacterium tuberculosis
PTNDL

SEQ ID NO: 1401805 - protein, 6 aa, Mycobacterium tuberculosis
PTNDQL

SEQ ID NO: 1401806 - protein, 12 aa, Mycobacterium tuberculosis
PTNNLDPASREQ

SEQ ID NO: 1401807 - protein, 7 aa, Mycobacterium tuberculosis
PTPAPLG

SEQ ID NO: 1401808 - protein, 14 aa, Mycobacterium tuberculosis
PTPAVGGVPTKAAT

SEQ ID NO: 1401809 - protein, 10 aa, Mycobacterium tuberculosis
PTPEEAAAAE

SEQ ID NO: 1401810 - protein, 10 aa, Mycobacterium tuberculosis
PTPHTPASAR

SEQ ID NO: 1401811 - protein, 6 aa, Mycobacterium tuberculosis
PTPKTV

SEQ ID NO: 1401812 - protein, 7 aa, Mycobacterium tuberculosis
PTPRPPF

SEQ ID NO: 1401813 - protein, 14 aa, Mycobacterium tuberculosis
PTRADALTDAARAE

SEQ ID NO: 1401814 - protein, 4 aa, Mycobacterium tuberculosis
PTRI

SEQ ID NO: 1401815 - protein, 6 aa, Mycobacterium tuberculosis
PTRRAR

SEQ ID NO: 1401816 - protein, 12 aa, Mycobacterium tuberculosis
PTRSHTGAAQGG

SEQ ID NO: 1401817 - protein, 12 aa, Mycobacterium tuberculosis
PTSALDPTTTEK

SEQ ID NO: 1401818 - protein, 10 aa, Mycobacterium tuberculosis
PTSGLDPVNA

SEQ ID NO: 1401819 - protein, 13 aa, Mycobacterium tuberculosis
PTSPDDPAVPANR

SEQ ID NO: 1401820 - protein, 8 aa, Mycobacterium tuberculosis
PTSTGAAK

SEQ ID NO: 1401821 - protein, 7 aa, Mycobacterium tuberculosis
PTTADRD

SEQ ID NO: 1401822 - protein, 10 aa, Mycobacterium tuberculosis
PTTAQPPPMA

SEQ ID NO: 1401823 - protein, 8 aa, Mycobacterium tuberculosis
PTTPEQAD

SEQ ID NO: 1401824 - protein, 7 aa, Mycobacterium tuberculosis
PTTRPQH

SEQ ID NO: 1401825 - protein, 4 aa, Mycobacterium tuberculosis
PTTV

SEQ ID NO: 1401826 - protein, 9 aa, Mycobacterium tuberculosis
PTVAQSGGD

SEQ ID NO: 1401827 - protein, 5 aa, Mycobacterium tuberculosis
PTVRP

SEQ ID NO: 1401828 - protein, 13 aa, Mycobacterium tuberculosis
PTVTPVDTAGAGD

SEQ ID NO: 1401829 - protein, 8 aa, Mycobacterium tuberculosis
PVAPEHSP

SEQ ID NO: 1401830 - protein, 6 aa, Mycobacterium tuberculosis
PVARES

SEQ ID NO: 1401831 - protein, 6 aa, Mycobacterium tuberculosis
PVGTAP

SEQ ID NO: 1401832 - protein, 7 aa, Mycobacterium tuberculosis
PVKSSRA

SEQ ID NO: 1401833 - protein, 8 aa, Mycobacterium tuberculosis
PVNPSGGV

SEQ ID NO: 1401834 - protein, 12 aa, Mycobacterium tuberculosis
PVPDGDYTDDPN

SEQ ID NO: 1401835 - protein, 7 aa, Mycobacterium tuberculosis
PVPGAAD

SEQ ID NO: 1401836 - protein, 5 aa, Mycobacterium tuberculosis
PVPPS

SEQ ID NO: 1401837 - protein, 7 aa, Mycobacterium tuberculosis
PVPRPER

SEQ ID NO: 1401838 - protein, 5 aa, Mycobacterium tuberculosis
PVPTT

SEQ ID NO: 1401839 - protein, 9 aa, Mycobacterium tuberculosis
PVQGRGGKG

SEQ ID NO: 1401840 - protein, 8 aa, Mycobacterium tuberculosis
PVRSTDGR

SEQ ID NO: 1401841 - protein, 8 aa, Mycobacterium tuberculosis
PVSGEPSL

SEQ ID NO: 1401842 - protein, 13 aa, Mycobacterium tuberculosis
PVSGGAAAAAKGE

SEQ ID NO: 1401843 - protein, 8 aa, Mycobacterium tuberculosis
PVSGGQPL

SEQ ID NO: 1401844 - protein, 12 aa, Mycobacterium tuberculosis
PVSPPGTPEGGY

SEQ ID NO: 1401845 - protein, 5 aa, Mycobacterium tuberculosis
PVTAT

SEQ ID NO: 1401846 - protein, 7 aa, Mycobacterium tuberculosis
PVTPPAL

SEQ ID NO: 1401847 - protein, 12 aa, Mycobacterium tuberculosis
PWEPPPLPSTRQ

SEQ ID NO: 1401848 - protein, 21 aa, Mycobacterium tuberculosis
PWGPDKITEDGREQLRALGFT

SEQ ID NO: 1401849 - protein, 7 aa, Mycobacterium tuberculosis
PWPPPGR

SEQ ID NO: 1401850 - protein, 10 aa, Mycobacterium tuberculosis
PYHGSDAATR

SEQ ID NO: 1401851 - protein, 9 aa, Mycobacterium tuberculosis
QAAAQEAQQ

SEQ ID NO: 1401852 - protein, 11 aa, Mycobacterium tuberculosis
QAADTAFESRT

SEQ ID NO: 1401853 - protein, 19 aa, Mycobacterium tuberculosis
QAAGEADKMPKASNATPRE

SEQ ID NO: 1401854 - protein, 9 aa, Mycobacterium tuberculosis
QAAGLPAAT

SEQ ID NO: 1401855 - protein, 7 aa, Mycobacterium tuberculosis
QAASGPV

SEQ ID NO: 1401856 - protein, 9 aa, Mycobacterium tuberculosis
QADDPHGTN

SEQ ID NO: 1401857 - protein, 5 aa, Mycobacterium tuberculosis
QADRD

SEQ ID NO: 1401858 - protein, 7 aa, Mycobacterium tuberculosis
QADRHGR

SEQ ID NO: 1401859 - protein, 7 aa, Mycobacterium tuberculosis
QAEAAYR

SEQ ID NO: 1401860 - protein, 7 aa, Mycobacterium tuberculosis
QAEAEGL

SEQ ID NO: 1401861 - protein, 10 aa, Mycobacterium tuberculosis
QAEDSGSRQA

SEQ ID NO: 1401862 - protein, 5 aa, Mycobacterium tuberculosis
QAGAT

SEQ ID NO: 1401863 - protein, 7 aa, Mycobacterium tuberculosis
QAGDPEA

SEQ ID NO: 1401864 - protein, 25 aa, Mycobacterium tuberculosis
QAGGRPGPTNRRKCQTPPAGRCRPT

SEQ ID NO: 1401865 - protein, 11 aa, Mycobacterium tuberculosis
QAGKPTSTNPI

SEQ ID NO: 1401866 - protein, 6 aa, Mycobacterium tuberculosis
QAGKQA

SEQ ID NO: 1401867 - protein, 13 aa, Mycobacterium tuberculosis
QAHEPKDDHPLES

SEQ ID NO: 1401868 - protein, 8 aa, Mycobacterium tuberculosis
QANGFSPA

SEQ ID NO: 1401869 - protein, 8 aa, Mycobacterium tuberculosis
QANQRSDE

SEQ ID NO: 1401870 - protein, 5 aa, Mycobacterium tuberculosis
QAPPA

SEQ ID NO: 1401871 - protein, 14 aa, Mycobacterium tuberculosis
QAPQRPAPLPGQDS

SEQ ID NO: 1401872 - protein, 8 aa, Mycobacterium tuberculosis
QAQGDHSH

SEQ ID NO: 1401873 - protein, 7 aa, Mycobacterium tuberculosis
QARAAAA

SEQ ID NO: 1401874 - protein, 11 aa, Mycobacterium tuberculosis
QARDKTGTDPV

SEQ ID NO: 1401875 - protein, 6 aa, Mycobacterium tuberculosis
QARGYR

SEQ ID NO: 1401876 - protein, 11 aa, Mycobacterium tuberculosis
QARNADPTVAG

SEQ ID NO: 1401877 - protein, 14 aa, Mycobacterium tuberculosis
QARRADSSEFDPDR

SEQ ID NO: 1401878 - protein, 14 aa, Mycobacterium tuberculosis
QARWRDSAGEEYEA

SEQ ID NO: 1401879 - protein, 15 aa, Mycobacterium tuberculosis
QASGYVSRTPGEGAP

SEQ ID NO: 1401880 - protein, 16 aa, Mycobacterium tuberculosis
QATAQRPQQRAAQRRL

SEQ ID NO: 1401881 - protein, 7 aa, Mycobacterium tuberculosis
QATEEIA

SEQ ID NO: 1401882 - protein, 8 aa, Mycobacterium tuberculosis
QATGTDTF

SEQ ID NO: 1401883 - protein, 9 aa, Mycobacterium tuberculosis
QATKARAPF

SEQ ID NO: 1401884 - protein, 9 aa, Mycobacterium tuberculosis
QAVSGSGLA

SEQ ID NO: 1401885 - protein, 8 aa, Mycobacterium tuberculosis
QDDEHSVS

SEQ ID NO: 1401886 - protein, 7 aa, Mycobacterium tuberculosis
QDEKDAE

SEQ ID NO: 1401887 - protein, 11 aa, Mycobacterium tuberculosis
QDETNLPEQSK

SEQ ID NO: 1401888 - protein, 4 aa, Mycobacterium tuberculosis
QDEW

SEQ ID NO: 1401889 - protein, 5 aa, Mycobacterium tuberculosis
QDGEA

SEQ ID NO: 1401890 - protein, 5 aa, Mycobacterium tuberculosis
QDGHV

SEQ ID NO: 1401891 - protein, 7 aa, Mycobacterium tuberculosis
QDGRSIQ

SEQ ID NO: 1401892 - protein, 11 aa, Mycobacterium tuberculosis
QDKKHRGREPI

SEQ ID NO: 1401893 - protein, 11 aa, Mycobacterium tuberculosis
QDLPPNAATEI

SEQ ID NO: 1401894 - protein, 14 aa, Mycobacterium tuberculosis
QDNPRRSVRLSFVE

SEQ ID NO: 1401895 - protein, 10 aa, Mycobacterium tuberculosis
QDPGKGGGFH

SEQ ID NO: 1401896 - protein, 6 aa, Mycobacterium tuberculosis
QDPKGQ

SEQ ID NO: 1401897 - protein, 5 aa, Mycobacterium tuberculosis
QDPRA

SEQ ID NO: 1401898 - protein, 7 aa, Mycobacterium tuberculosis
QDPRGDG

SEQ ID NO: 1401899 - protein, 4 aa, Mycobacterium tuberculosis
QDPT

SEQ ID NO: 1401900 - protein, 9 aa, Mycobacterium tuberculosis
QDPTRGKDR

SEQ ID NO: 1401901 - protein, 16 aa, Mycobacterium tuberculosis
QDPTSKMSKSAGTDAG

SEQ ID NO: 1401902 - protein, 7 aa, Mycobacterium tuberculosis
QDREALE

SEQ ID NO: 1401903 - protein, 7 aa, Mycobacterium tuberculosis
QDTAKRT

SEQ ID NO: 1401904 - protein, 5 aa, Mycobacterium tuberculosis
QDTDP

SEQ ID NO: 1401905 - protein, 20 aa, Mycobacterium tuberculosis
QDTEKTDARSTVGRYDHTDS

SEQ ID NO: 1401906 - protein, 6 aa, Mycobacterium tuberculosis
QDTGHA

SEQ ID NO: 1401907 - protein, 12 aa, Mycobacterium tuberculosis
QDWDPDQSKLSD

SEQ ID NO: 1401908 - protein, 12 aa, Mycobacterium tuberculosis
QEAIEGDRVPGA

SEQ ID NO: 1401909 - protein, 5 aa, Mycobacterium tuberculosis
QEEES

SEQ ID NO: 1401910 - protein, 6 aa, Mycobacterium tuberculosis
QEHVSG

SEQ ID NO: 1401911 - protein, 6 aa, Mycobacterium tuberculosis
QEITGG

SEQ ID NO: 1401912 - protein, 13 aa, Mycobacterium tuberculosis
QEPIAAGSTAGNT

SEQ ID NO: 1401913 - protein, 15 aa, Mycobacterium tuberculosis
QEPNGGERSAIAAPT

SEQ ID NO: 1401914 - protein, 4 aa, Mycobacterium tuberculosis
QEPQ

SEQ ID NO: 1401915 - protein, 6 aa, Mycobacterium tuberculosis
QEPVRD

SEQ ID NO: 1401916 - protein, 4 aa, Mycobacterium tuberculosis
QEPY

SEQ ID NO: 1401917 - protein, 5 aa, Mycobacterium tuberculosis
QEQGA

SEQ ID NO: 1401918 - protein, 6 aa, Mycobacterium tuberculosis
QERGSG

SEQ ID NO: 1401919 - protein, 7 aa, Mycobacterium tuberculosis
QERHAAD

SEQ ID NO: 1401920 - protein, 12 aa, Mycobacterium tuberculosis
QESGTTRPIDPW

SEQ ID NO: 1401921 - protein, 4 aa, Mycobacterium tuberculosis
QESM

SEQ ID NO: 1401922 - protein, 8 aa, Mycobacterium tuberculosis
QETDGSGA

SEQ ID NO: 1401923 - protein, 4 aa, Mycobacterium tuberculosis
QETR

SEQ ID NO: 1401924 - protein, 10 aa, Mycobacterium tuberculosis
QETRNADVER

SEQ ID NO: 1401925 - protein, 5 aa, Mycobacterium tuberculosis
QFPDG

SEQ ID NO: 1401926 - protein, 17 aa, Mycobacterium tuberculosis
QFRRGKPSPLKAAADEA

SEQ ID NO: 1401927 - protein, 10 aa, Mycobacterium tuberculosis
QGAEGPGELR

SEQ ID NO: 1401928 - protein, 4 aa, Mycobacterium tuberculosis
QGAI

SEQ ID NO: 1401929 - protein, 13 aa, Mycobacterium tuberculosis
QGAKPGEGGQLPG

SEQ ID NO: 1401930 - protein, 5 aa, Mycobacterium tuberculosis
QGAPV

SEQ ID NO: 1401931 - protein, 8 aa, Mycobacterium tuberculosis
QGASEERI

SEQ ID NO: 1401932 - protein, 6 aa, Mycobacterium tuberculosis
QGATAA

SEQ ID NO: 1401933 - protein, 8 aa, Mycobacterium tuberculosis
QGDVRDRA

SEQ ID NO: 1401934 - protein, 5 aa, Mycobacterium tuberculosis
QGEAG

SEQ ID NO: 1401935 - protein, 7 aa, Mycobacterium tuberculosis
QGERAGI

SEQ ID NO: 1401936 - protein, 28 aa, Mycobacterium tuberculosis
QGGDLSKPLPIGSHSETVTAGASGTMGD

SEQ ID NO: 1401937 - protein, 5 aa, Mycobacterium tuberculosis
QGGFD

SEQ ID NO: 1401938 - protein, 9 aa, Mycobacterium tuberculosis
QGGPGAFTD

SEQ ID NO: 1401939 - protein, 4 aa, Mycobacterium tuberculosis
QGGR

SEQ ID NO: 1401940 - protein, 4 aa, Mycobacterium tuberculosis
QGIT

SEQ ID NO: 1401941 - protein, 8 aa, Mycobacterium tuberculosis
QGKDGKRS

SEQ ID NO: 1401942 - protein, 11 aa, Mycobacterium tuberculosis
QGKGTNGDSVP

SEQ ID NO: 1401943 - protein, 9 aa, Mycobacterium tuberculosis
QGKPEAAAD

SEQ ID NO: 1401944 - protein, 10 aa, Mycobacterium tuberculosis
QGLAGKRRAT

SEQ ID NO: 1401945 - protein, 5 aa, Mycobacterium tuberculosis
QGLPA

SEQ ID NO: 1401946 - protein, 4 aa, Mycobacterium tuberculosis
QGLS

SEQ ID NO: 1401947 - protein, 15 aa, Mycobacterium tuberculosis
QGNFGSPGNDPPAAM

SEQ ID NO: 1401948 - protein, 7 aa, Mycobacterium tuberculosis
QGNPEGG

SEQ ID NO: 1401949 - protein, 9 aa, Mycobacterium tuberculosis
QGPAGPISE

SEQ ID NO: 1401950 - protein, 10 aa, Mycobacterium tuberculosis
QGPPRTDGPD

SEQ ID NO: 1401951 - protein, 9 aa, Mycobacterium tuberculosis
QGPTQSPEI

SEQ ID NO: 1401952 - protein, 7 aa, Mycobacterium tuberculosis
QGRGLGE

SEQ ID NO: 1401953 - protein, 12 aa, Mycobacterium tuberculosis
QGTAGSTGAPRT

SEQ ID NO: 1401954 - protein, 15 aa, Mycobacterium tuberculosis
QGTEAGGHGHGPRST

SEQ ID NO: 1401955 - protein, 20 aa, Mycobacterium tuberculosis
QGTKDYSTQNASGGPSGPFY

SEQ ID NO: 1401956 - protein, 9 aa, Mycobacterium tuberculosis
QGVEPPRPL

SEQ ID NO: 1401957 - protein, 12 aa, Mycobacterium tuberculosis
QGYGRQKGHTEV

SEQ ID NO: 1401958 - protein, 7 aa, Mycobacterium tuberculosis
QHAADGR

SEQ ID NO: 1401959 - protein, 20 aa, Mycobacterium tuberculosis
QHDRQDEKDRRLLDKSRYFD

SEQ ID NO: 1401960 - protein, 8 aa, Mycobacterium tuberculosis
QHGEKRSM

SEQ ID NO: 1401961 - protein, 7 aa, Mycobacterium tuberculosis
QHGSKPV

SEQ ID NO: 1401962 - protein, 5 aa, Mycobacterium tuberculosis
QHSSD

SEQ ID NO: 1401963 - protein, 5 aa, Mycobacterium tuberculosis
QIAGA

SEQ ID NO: 1401964 - protein, 12 aa, Mycobacterium tuberculosis
QIGPNRPGPKGF

SEQ ID NO: 1401965 - protein, 5 aa, Mycobacterium tuberculosis
QISDT

SEQ ID NO: 1401966 - protein, 4 aa, Mycobacterium tuberculosis
QISP

SEQ ID NO: 1401967 - protein, 4 aa, Mycobacterium tuberculosis
QITN

SEQ ID NO: 1401968 - protein, 73 aa, Mycobacterium tuberculosis; identical to SEQ ID NO: 184110

SEQ ID NO: 1401969 - protein, 9 aa, Mycobacterium tuberculosis
QKGAPEGQA

SEQ ID NO: 1401970 - protein, 6 aa, Mycobacterium tuberculosis
QKGTTI

SEQ ID NO: 1401971 - protein, 6 aa, Mycobacterium tuberculosis
QKQPDA

SEQ ID NO: 1401972 - protein, 9 aa, Mycobacterium tuberculosis
QKRAGQPVS

SEQ ID NO: 1401973 - protein, 6 aa, Mycobacterium tuberculosis
QKSASA

SEQ ID NO: 1401974 - protein, 5 aa, Mycobacterium tuberculosis
QKTGA

SEQ ID NO: 1401975 - protein, 9 aa, Mycobacterium tuberculosis
QLAGGPLGS

SEQ ID NO: 1401976 - protein, 5 aa, Mycobacterium tuberculosis
QLEED

SEQ ID NO: 1401977 - protein, 16 aa, Mycobacterium tuberculosis
QLEQPAGTLSGGEKTR

SEQ ID NO: 1401978 - protein, 7 aa, Mycobacterium tuberculosis
QLGARTG

SEQ ID NO: 1401979 - protein, 7 aa, Mycobacterium tuberculosis
QLGPQSP

SEQ ID NO: 1401980 - protein, 9 aa, Mycobacterium tuberculosis
QLGTKGPSL

SEQ ID NO: 1401981 - protein, 9 aa, Mycobacterium tuberculosis
QLPEPEQPV

SEQ ID NO: 1401982 - protein, 5 aa, Mycobacterium tuberculosis
QLPGA

SEQ ID NO: 1401983 - protein, 13 aa, Mycobacterium tuberculosis
QLPPDGRPTDLPG

SEQ ID NO: 1401984 - protein, 9 aa, Mycobacterium tuberculosis
QLPRTDTGK

SEQ ID NO: 1401985 - protein, 6 aa, Mycobacterium tuberculosis
QLPTTY

SEQ ID NO: 1401986 - protein, 15 aa, Mycobacterium tuberculosis
QLRGRAGRQGDPGSS

SEQ ID NO: 1401987 - protein, 15 aa, Mycobacterium tuberculosis
QLRGRSGRQGDPGES

SEQ ID NO: 1401988 - protein, 8 aa, Mycobacterium tuberculosis
QLTPPGTA

SEQ ID NO: 1401989 - protein, 8 aa, Mycobacterium tuberculosis
QMAGRGTD

SEQ ID NO: 1401990 - protein, 9 aa, Mycobacterium tuberculosis
QMTDKTAPR

SEQ ID NO: 1401991 - protein, 10 aa, Mycobacterium tuberculosis
QMTDKTAPRV

SEQ ID NO: 1401992 - protein, 4 aa, Mycobacterium tuberculosis
QNAP

SEQ ID NO: 1401993 - protein, 9 aa, Mycobacterium tuberculosis
QNASPIAQT

SEQ ID NO: 1401994 - protein, 6 aa, Mycobacterium tuberculosis
QNNELG

SEQ ID NO: 1401995 - protein, 8 aa, Mycobacterium tuberculosis
QNPDAASE

SEQ ID NO: 1401996 - protein, 8 aa, Mycobacterium tuberculosis
QNPGTNHP

SEQ ID NO: 1401997 - protein, 6 aa, Mycobacterium tuberculosis
QNPGVT

SEQ ID NO: 1401998 - protein, 6 aa, Mycobacterium tuberculosis
QNPIEY

SEQ ID NO: 1401999 - protein, 5 aa, Mycobacterium tuberculosis
QNPYL

SEQ ID NO: 1402000 - protein, 11 aa, Mycobacterium tuberculosis
QNRRAELADDR

SEQ ID NO: 1402001 - protein, 11 aa, Mycobacterium tuberculosis
QNSGSKTTIAP

SEQ ID NO: 1402002 - protein, 11 aa, Mycobacterium tuberculosis
QPADRSRRART

SEQ ID NO: 1402003 - protein, 13 aa, Mycobacterium tuberculosis
QPAPTLSGGEAQR

SEQ ID NO: 1402004 - protein, 5 aa, Mycobacterium tuberculosis
QPAQW

SEQ ID NO: 1402005 - protein, 6 aa, Mycobacterium tuberculosis
QPATPT

SEQ ID NO: 1402006 - protein, 10 aa, Mycobacterium tuberculosis
QPDADGNRPD

SEQ ID NO: 1402007 - protein, 11 aa, Mycobacterium tuberculosis
QPDLSTKARPR

SEQ ID NO: 1402008 - protein, 6 aa, Mycobacterium tuberculosis
QPEHQW

SEQ ID NO: 1402009 - protein, 13 aa, Mycobacterium tuberculosis
QPFAASAPRIGAP

SEQ ID NO: 1402010 - protein, 7 aa, Mycobacterium tuberculosis
QPFPGPG

SEQ ID NO: 1402011 - protein, 4 aa, Mycobacterium tuberculosis
QPGG

SEQ ID NO: 1402012 - protein, 5 aa, Mycobacterium tuberculosis
QPGGH

SEQ ID NO: 1402013 - protein, 5 aa, Mycobacterium tuberculosis
QPGLG

SEQ ID NO: 1402014 - protein, 5 aa, Mycobacterium tuberculosis
QPGQC

SEQ ID NO: 1402015 - protein, 7 aa, Mycobacterium tuberculosis
QPGTEGL

SEQ ID NO: 1402016 - protein, 15 aa, Mycobacterium tuberculosis
QPGYGHSDKRAEHGQ

SEQ ID NO: 1402017 - protein, 11 aa, Mycobacterium tuberculosis
QPLGQDKDGKN

SEQ ID NO: 1402018 - protein, 9 aa, Mycobacterium tuberculosis
QPLSPERAR

SEQ ID NO: 1402019 - protein, 11 aa, Mycobacterium tuberculosis
QPNAAARRGVA

SEQ ID NO: 1402020 - protein, 5 aa, Mycobacterium tuberculosis
QPNGT

SEQ ID NO: 1402021 - protein, 13 aa, Mycobacterium tuberculosis
QPPAPIAVSGTDS

SEQ ID NO: 1402022 - protein, 6 aa, Mycobacterium tuberculosis
QPPELE

SEQ ID NO: 1402023 - protein, 10 aa, Mycobacterium tuberculosis
QPPESYRNDH

SEQ ID NO: 1402024 - protein, 5 aa, Mycobacterium tuberculosis
QPPGL

SEQ ID NO: 1402025 - protein, 6 aa, Mycobacterium tuberculosis
QPPPLT

SEQ ID NO: 1402026 - protein, 5 aa, Mycobacterium tuberculosis
QPPSA

SEQ ID NO: 1402027 - protein, 16 aa, Mycobacterium tuberculosis
QPQPAAELPMTQRYFL

SEQ ID NO: 1402028 - protein, 5 aa, Mycobacterium tuberculosis
QPQTV

SEQ ID NO: 1402029 - protein, 11 aa, Mycobacterium tuberculosis
QPRPPRKLTGQ

SEQ ID NO: 1402030 - protein, 12 aa, Mycobacterium tuberculosis
QPRVGKKAARRR

SEQ ID NO: 1402031 - protein, 5 aa, Mycobacterium tuberculosis
QPTDG

SEQ ID NO: 1402032 - protein, 8 aa, Mycobacterium tuberculosis
QPTDTAGD

SEQ ID NO: 1402033 - protein, 7 aa, Mycobacterium tuberculosis
QPTPEEQ

SEQ ID NO: 1402034 - protein, 8 aa, Mycobacterium tuberculosis
QPVSSPDV

SEQ ID NO: 1402035 - protein, 8 aa, Mycobacterium tuberculosis
QPVYGDDD

SEQ ID NO: 1402036 - protein, 11 aa, Mycobacterium tuberculosis
QQAGHSGSEIT

SEQ ID NO: 1402037 - protein, 6 aa, Mycobacterium tuberculosis
QQEASR

SEQ ID NO: 1402038 - protein, 8 aa, Mycobacterium tuberculosis
QQEQGTAD

SEQ ID NO: 1402039 - protein, 6 aa, Mycobacterium tuberculosis
QQGERL

SEQ ID NO: 1402040 - protein, 12 aa, Mycobacterium tuberculosis
QQGNPPDAPQLA

SEQ ID NO: 1402041 - protein, 15 aa, Mycobacterium tuberculosis
QQLANSEVHGQAGGG

SEQ ID NO: 1402042 - protein, 6 aa, Mycobacterium tuberculosis
QQPIDP

SEQ ID NO: 1402043 - protein, 6 aa, Mycobacterium tuberculosis
QQPRPA

SEQ ID NO: 1402044 - protein, 13 aa, Mycobacterium tuberculosis
QQRPKTPVELLTI

SEQ ID NO: 1402045 - protein, 14 aa, Mycobacterium tuberculosis
QQSQASAGKGGPAM

SEQ ID NO: 1402046 - protein, 10 aa, Mycobacterium tuberculosis
QQTLAGSATG

SEQ ID NO: 1402047 - protein, 6 aa, Mycobacterium tuberculosis
QQTQRF

SEQ ID NO: 1402048 - protein, 5 aa, Mycobacterium tuberculosis
QQTSD

SEQ ID NO: 1402049 - protein, 7 aa, Mycobacterium tuberculosis
QQVGEGH

SEQ ID NO: 1402050 - protein, 46 aa, Mycobacterium tuberculosis; identical to SEQ ID NO: 184342

SEQ ID NO: 1402051 - protein, 12 aa, Mycobacterium tuberculosis
QRADHAEHARRN

SEQ ID NO: 1402052 - protein, 5 aa, Mycobacterium tuberculosis
QRAEW

SEQ ID NO: 1402053 - protein, 9 aa, Mycobacterium tuberculosis
QRAGVSEPN

SEQ ID NO: 1402054 - protein, 7 aa, Mycobacterium tuberculosis
QRALESE

SEQ ID NO: 1402055 - protein, 17 aa, Mycobacterium tuberculosis
QRAPLDDPGAAKGADAD

SEQ ID NO: 1402056 - protein, 5 aa, Mycobacterium tuberculosis
QRDPV

SEQ ID NO: 1402057 - protein, 12 aa, Mycobacterium tuberculosis
QREGLGPFPTDR

SEQ ID NO: 1402058 - protein, 9 aa, Mycobacterium tuberculosis
QRGQQTPAP

SEQ ID NO: 1402059 - protein, 7 aa, Mycobacterium tuberculosis
QRLASQP

SEQ ID NO: 1402060 - protein, 6 aa, Mycobacterium tuberculosis
QRNGER

SEQ ID NO: 1402061 - protein, 17 aa, Mycobacterium tuberculosis
QRPAGNETRWLMVALHI

SEQ ID NO: 1402062 - protein, 6 aa, Mycobacterium tuberculosis
QRPDPF

SEQ ID NO: 1402063 - protein, 6 aa, Mycobacterium tuberculosis
QRPGEA

SEQ ID NO: 1402064 - protein, 6 aa, Mycobacterium tuberculosis
QRPRQR

SEQ ID NO: 1402065 - protein, 5 aa, Mycobacterium tuberculosis
QRPSI

SEQ ID NO: 1402066 - protein, 5 aa, Mycobacterium tuberculosis
QRPVG

SEQ ID NO: 1402067 - protein, 20 aa, Mycobacterium tuberculosis
QRQTEPHAEAVSRNRRQQAT

SEQ ID NO: 1402068 - protein, 6 aa, Mycobacterium tuberculosis
QRRAGG

SEQ ID NO: 1402069 - protein, 5 aa, Mycobacterium tuberculosis
QRRGA

SEQ ID NO: 1402070 - protein, 5 aa, Mycobacterium tuberculosis
QRSGR

SEQ ID NO: 1402071 - protein, 4 aa, Mycobacterium tuberculosis
QRSP

SEQ ID NO: 1402072 - protein, 4 aa, Mycobacterium tuberculosis
QRVG

SEQ ID NO: 1402073 - protein, 5 aa, Mycobacterium tuberculosis
QRWTT

SEQ ID NO: 1402074 - protein, 16 aa, Mycobacterium tuberculosis
QSAARREWGQLFAHAA

SEQ ID NO: 1402075 - protein, 9 aa, Mycobacterium tuberculosis
QSADPRDAH

SEQ ID NO: 1402076 - protein, 16 aa, Mycobacterium tuberculosis
QSADSLARPTAEGAGP

SEQ ID NO: 1402077 - protein, 8 aa, Mycobacterium tuberculosis
QSAETTRV

SEQ ID NO: 1402078 - protein, 5 aa, Mycobacterium tuberculosis
QSATI

SEQ ID NO: 1402079 - protein, 13 aa, Mycobacterium tuberculosis
QSDQQRATGELRL

SEQ ID NO: 1402080 - protein, 6 aa, Mycobacterium tuberculosis
QSEPLG

SEQ ID NO: 1402081 - protein, 15 aa, Mycobacterium tuberculosis
QSGAGFAEGHPLPAG

SEQ ID NO: 1402082 - protein, 5 aa, Mycobacterium tuberculosis
QSGDG

SEQ ID NO: 1402083 - protein, 5 aa, Mycobacterium tuberculosis
QSGGE

SEQ ID NO: 1402084 - protein, 8 aa, Mycobacterium tuberculosis
QSGLGPKD

SEQ ID NO: 1402085 - protein, 8 aa, Mycobacterium tuberculosis
QSGRRGRV

SEQ ID NO: 1402086 - protein, 7 aa, Mycobacterium tuberculosis
QSHSGSL

SEQ ID NO: 1402087 - protein, 5 aa, Mycobacterium tuberculosis
QSKNP

SEQ ID NO: 1402088 - protein, 8 aa, Mycobacterium tuberculosis
QSLGDPES

SEQ ID NO: 1402089 - protein, 9 aa, Mycobacterium tuberculosis
QSLPGKAIE

SEQ ID NO: 1402090 - protein, 5 aa, Mycobacterium tuberculosis
QSMDN

SEQ ID NO: 1402091 - protein, 6 aa, Mycobacterium tuberculosis
QSPAPK

SEQ ID NO: 1402092 - protein, 16 aa, Mycobacterium tuberculosis
QSPIGRTPRSNPATYT

SEQ ID NO: 1402093 - protein, 8 aa, Mycobacterium tuberculosis
QSRRRGIG

SEQ ID NO: 1402094 - protein, 16 aa, Mycobacterium tuberculosis
QSRRRKRQPVGAQARR

SEQ ID NO: 1402095 - protein, 7 aa, Mycobacterium tuberculosis
QSSARGK

SEQ ID NO: 1402096 - protein, 9 aa, Mycobacterium tuberculosis
QSSKDAAAA

SEQ ID NO: 1402097 - protein, 13 aa, Mycobacterium tuberculosis
QSSPSASGGRALT

SEQ ID NO: 1402098 - protein, 19 aa, Mycobacterium tuberculosis
QSVPPGVPTAPPAADPQRS

SEQ ID NO: 1402099 - protein, 5 aa, Mycobacterium tuberculosis
QTAPV

SEQ ID NO: 1402100 - protein, 4 aa, Mycobacterium tuberculosis
QTAR

SEQ ID NO: 1402101 - protein, 9 aa, Mycobacterium tuberculosis
QTDAKTGKP

SEQ ID NO: 1402102 - protein, 12 aa, Mycobacterium tuberculosis
QTDDRASPPETR

SEQ ID NO: 1402103 - protein, 10 aa, Mycobacterium tuberculosis
QTDETGATKR

SEQ ID NO: 1402104 - protein, 5 aa, Mycobacterium tuberculosis
QTEGA

SEQ ID NO: 1402105 - protein, 7 aa, Mycobacterium tuberculosis
QTEVPSR

SEQ ID NO: 1402106 - protein, 8 aa, Mycobacterium tuberculosis
QTGAPLPT

SEQ ID NO: 1402107 - protein, 7 aa, Mycobacterium tuberculosis
QTGGCPH

SEQ ID NO: 1402108 - protein, 16 aa, Mycobacterium tuberculosis
QTGGKALADRRMSRLL

SEQ ID NO: 1402109 - protein, 10 aa, Mycobacterium tuberculosis
QTGSKTLKDA

SEQ ID NO: 1402110 - protein, 30 aa, Mycobacterium tuberculosis; identical to SEQ ID NO: 184549

SEQ ID NO: 1402111 - protein, 22 aa, Mycobacterium tuberculosis
QTPEKGRNASDRNARETGWFSP

SEQ ID NO: 1402112 - protein, 5 aa, Mycobacterium tuberculosis
QTPID

SEQ ID NO: 1402113 - protein, 6 aa, Mycobacterium tuberculosis
QTPQGF

SEQ ID NO: 1402114 - protein, 7 aa, Mycobacterium tuberculosis
QTQSEVR

SEQ ID NO: 1402115 - protein, 10 aa, Mycobacterium tuberculosis
QTTSFDEDTT

SEQ ID NO: 1402116 - protein, 7 aa, Mycobacterium tuberculosis
QTTSTVT

SEQ ID NO: 1402117 - protein, 4 aa, Mycobacterium tuberculosis
QVNQ

SEQ ID NO: 1402118 - protein, 9 aa, Mycobacterium tuberculosis
QVPAGQTVP

SEQ ID NO: 1402119 - protein, 6 aa, Mycobacterium tuberculosis
QVRGTG

SEQ ID NO: 1402120 - protein, 9 aa, Mycobacterium tuberculosis
QVTDGDSGL

SEQ ID NO: 1402121 - protein, 10 aa, Mycobacterium tuberculosis
QYAKPRSADI

SEQ ID NO: 1402122 - protein, 6 aa, Mycobacterium tuberculosis
QYRPEP

SEQ ID NO: 1402123 - protein, 9 aa, Mycobacterium tuberculosis
QYSRTNNAE

SEQ ID NO: 1402124 - protein, 18 aa, Mycobacterium tuberculosis
RAAADGQTVRTAEEPKDV

SEQ ID NO: 1402125 - protein, 9 aa, Mycobacterium tuberculosis
RAAAEAEGY

SEQ ID NO: 1402126 - protein, 7 aa, Mycobacterium tuberculosis
RAAAPKK

SEQ ID NO: 1402127 - protein, 9 aa, Mycobacterium tuberculosis
RAAENRTKR

SEQ ID NO: 1402128 - protein, 5 aa, Mycobacterium tuberculosis
RAAGA

SEQ ID NO: 1402129 - protein, 5 aa, Mycobacterium tuberculosis
RAAGT

SEQ ID NO: 1402130 - protein, 8 aa, Mycobacterium tuberculosis
RAAPADIA

SEQ ID NO: 1402131 - protein, 6 aa, Mycobacterium tuberculosis
RAAQAD

SEQ ID NO: 1402132 - protein, 10 aa, Mycobacterium tuberculosis
RAAQNRAKRA

SEQ ID NO: 1402133 - protein, 20 aa, Mycobacterium tuberculosis
RAAQNRAKRALAAAAEESEA

SEQ ID NO: 1402134 - protein, 15 aa, Mycobacterium tuberculosis
RAASDVPAKYKSQPW

SEQ ID NO: 1402135 - protein, 7 aa, Mycobacterium tuberculosis
RADAQRC

SEQ ID NO: 1402136 - protein, 7 aa, Mycobacterium tuberculosis
RADGGEA

SEQ ID NO: 1402137 - protein, 12 aa, Mycobacterium tuberculosis
RADGTESAKPSL

SEQ ID NO: 1402138 - protein, 7 aa, Mycobacterium tuberculosis
RADGTVQ

SEQ ID NO: 1402139 - protein, 9 aa, Mycobacterium tuberculosis
RADHAAQAA

SEQ ID NO: 1402140 - protein, 11 aa, Mycobacterium tuberculosis
RAEGAHNGKGR

SEQ ID NO: 1402141 - protein, 7 aa, Mycobacterium tuberculosis
RAEGAKR

SEQ ID NO: 1402142 - protein, 5 aa, Mycobacterium tuberculosis
RAEGE

SEQ ID NO: 1402143 - protein, 5 aa, Mycobacterium tuberculosis
RAEGI

SEQ ID NO: 1402144 - protein, 9 aa, Mycobacterium tuberculosis
RAEGKRGGE

SEQ ID NO: 1402145 - protein, 7 aa, Mycobacterium tuberculosis
RAEGLTG

SEQ ID NO: 1402146 - protein, 5 aa, Mycobacterium tuberculosis
RAEPD

SEQ ID NO: 1402147 - protein, 7 aa, Mycobacterium tuberculosis
RAERTGE

SEQ ID NO: 1402148 - protein, 8 aa, Mycobacterium tuberculosis
RAESGGML

SEQ ID NO: 1402149 - protein, 9 aa, Mycobacterium tuberculosis
RAETPQQQQ

SEQ ID NO: 1402150 - protein, 9 aa, Mycobacterium tuberculosis
RAFKAKKPV

SEQ ID NO: 1402151 - protein, 7 aa, Mycobacterium tuberculosis
RAGDREA

SEQ ID NO: 1402152 - protein, 8 aa, Mycobacterium tuberculosis
RAGEAGVG

SEQ ID NO: 1402153 - protein, 7 aa, Mycobacterium tuberculosis
RAGEGVS

SEQ ID NO: 1402154 - protein, 8 aa, Mycobacterium tuberculosis
RAGEPSEV

SEQ ID NO: 1402155 - protein, 8 aa, Mycobacterium tuberculosis
RAGGTEKI

SEQ ID NO: 1402156 - protein, 10 aa, Mycobacterium tuberculosis
RAGHARGKAY

SEQ ID NO: 1402157 - protein, 7 aa, Mycobacterium tuberculosis
RAGIDPR

SEQ ID NO: 1402158 - protein, 7 aa, Mycobacterium tuberculosis
RAGPQTV

SEQ ID NO: 1402159 - protein, 9 aa, Mycobacterium tuberculosis
RAGRDPATA

SEQ ID NO: 1402160 - protein, 6 aa, Mycobacterium tuberculosis
RAGRET

SEQ ID NO: 1402161 - protein, 10 aa, Mycobacterium tuberculosis
RAGSGGNGCA

SEQ ID NO: 1402162 - protein, 8 aa, Mycobacterium tuberculosis
RAGSGQPL

SEQ ID NO: 1402163 - protein, 15 aa, Mycobacterium tuberculosis
RAGTRSAPRRRCQRY

SEQ ID NO: 1402164 - protein, 12 aa, Mycobacterium tuberculosis
RAGVKGTSGMRK

SEQ ID NO: 1402165 - protein, 6 aa, Mycobacterium tuberculosis
RAHRPV

SEQ ID NO: 1402166 - protein, 8 aa, Mycobacterium tuberculosis
RAIAGPGT

SEQ ID NO: 1402167 - protein, 10 aa, Mycobacterium tuberculosis
RAKAGGQRQF

SEQ ID NO: 1402168 - protein, 28 aa, Mycobacterium tuberculosis
RALEGRDGGYRETTSPPTGRGRNVRGSH

SEQ ID NO: 1402169 - protein, 12 aa, Mycobacterium tuberculosis
RALPGAESFPEE

SEQ ID NO: 1402170 - protein, 10 aa, Mycobacterium tuberculosis
RANARTKGRF

SEQ ID NO: 1402171 - protein, 11 aa, Mycobacterium tuberculosis
RANDESMPDEA

SEQ ID NO: 1402172 - protein, 5 aa, Mycobacterium tuberculosis
RANDF

SEQ ID NO: 1402173 - protein, 11 aa, Mycobacterium tuberculosis
RANTDGRAARR

SEQ ID NO: 1402174 - protein, 9 aa, Mycobacterium tuberculosis
RAPAGTLPG

SEQ ID NO: 1402175 - protein, 8 aa, Mycobacterium tuberculosis
RAPANRPD

SEQ ID NO: 1402176 - protein, 9 aa, Mycobacterium tuberculosis
RAPDGSPDT

SEQ ID NO: 1402177 - protein, 9 aa, Mycobacterium tuberculosis
RAPKPGSPV

SEQ ID NO: 1402178 - protein, 9 aa, Mycobacterium tuberculosis
RAPNGVRTK

SEQ ID NO: 1402179 - protein, 4 aa, Mycobacterium tuberculosis
RAQA

SEQ ID NO: 1402180 - protein, 7 aa, Mycobacterium tuberculosis
RAQTGVT

SEQ ID NO: 1402181 - protein, 6 aa, Mycobacterium tuberculosis
RAQYER

SEQ ID NO: 1402182 - protein, 8 aa, Mycobacterium tuberculosis
RARAEAGA

SEQ ID NO: 1402183 - protein, 10 aa, Mycobacterium tuberculosis
RARDGNESAG

SEQ ID NO: 1402184 - protein, 19 aa, Mycobacterium tuberculosis
RARGYDVDKPRNLAKSVTV

SEQ ID NO: 1402185 - protein, 4 aa, Mycobacterium tuberculosis
RARL

SEQ ID NO: 1402186 - protein, 6 aa, Mycobacterium tuberculosis
RARPPR

SEQ ID NO: 1402187 - protein, 5 aa, Mycobacterium tuberculosis
RARQI

SEQ ID NO: 1402188 - protein, 11 aa, Mycobacterium tuberculosis
RARREKRTAGE

SEQ ID NO: 1402189 - protein, 5 aa, Mycobacterium tuberculosis
RARRR

SEQ ID NO: 1402190 - protein, 8 aa, Mycobacterium tuberculosis
RARRRGTK

SEQ ID NO: 1402191 - protein, 9 aa, Mycobacterium tuberculosis
RASAAAREL

SEQ ID NO: 1402192 - protein, 8 aa, Mycobacterium tuberculosis
RASADRGT

SEQ ID NO: 1402193 - protein, 6 aa, Mycobacterium tuberculosis
RASRGG

SEQ ID NO: 1402194 - protein, 9 aa, Mycobacterium tuberculosis
RASRSMQRN

SEQ ID NO: 1402195 - protein, 16 aa, Mycobacterium tuberculosis
RASSPSQAITGTGCRP

SEQ ID NO: 1402196 - protein, 10 aa, Mycobacterium tuberculosis
RASTPNADPR

SEQ ID NO: 1402197 - protein, 8 aa, Mycobacterium tuberculosis
RASYERRA

SEQ ID NO: 1402198 - protein, 13 aa, Mycobacterium tuberculosis
RATADQIGTQTTQ

SEQ ID NO: 1402199 - protein, 13 aa, Mycobacterium tuberculosis
RATDDTVRPTEAE

SEQ ID NO: 1402200 - protein, 25 aa, Mycobacterium tuberculosis
RATEGAKAKSKGKARRGSQFKVLEH

SEQ ID NO: 1402201 - protein, 8 aa, Mycobacterium tuberculosis
RATEGTDI

SEQ ID NO: 1402202 - protein, 7 aa, Mycobacterium tuberculosis
RATGPES

SEQ ID NO: 1402203 - protein, 23 aa, Mycobacterium tuberculosis
RATPRADLEGSDVPVPAAAFETQ

SEQ ID NO: 1402204 - protein, 6 aa, Mycobacterium tuberculosis
RATSAR

SEQ ID NO: 1402205 - protein, 14 aa, Mycobacterium tuberculosis
RAVSDGDAVRVGGT

SEQ ID NO: 1402206 - protein, 21 aa, Mycobacterium tuberculosis
RAVSGNKVPGYYPLGKTPVPL

SEQ ID NO: 1402207 - protein, 8 aa, Mycobacterium tuberculosis
RAYPYEGN

SEQ ID NO: 1402208 - protein, 8 aa, Mycobacterium tuberculosis
RDAAGPLN

SEQ ID NO: 1402209 - protein, 14 aa, Mycobacterium tuberculosis
RDAAKTLGMAVIAP

SEQ ID NO: 1402210 - protein, 8 aa, Mycobacterium tuberculosis
RDAASREV

SEQ ID NO: 1402211 - protein, 6 aa, Mycobacterium tuberculosis
RDAPQR

SEQ ID NO: 1402212 - protein, 9 aa, Mycobacterium tuberculosis
RDARPGEVQ

SEQ ID NO: 1402213 - protein, 8 aa, Mycobacterium tuberculosis
RDDLPDGG

SEQ ID NO: 1402214 - protein, 4 aa, Mycobacterium tuberculosis
RDDR

SEQ ID NO: 1402215 - protein, 16 aa, Mycobacterium tuberculosis
RDDRGLGTLVCCVIGA

SEQ ID NO: 1402216 - protein, 6 aa, Mycobacterium tuberculosis
RDDRIT

SEQ ID NO: 1402217 - protein, 7 aa, Mycobacterium tuberculosis
RDEADER

SEQ ID NO: 1402218 - protein, 8 aa, Mycobacterium tuberculosis
RDERRRRN

SEQ ID NO: 1402219 - protein, 8 aa, Mycobacterium tuberculosis
RDETDVNP

SEQ ID NO: 1402220 - protein, 5 aa, Mycobacterium tuberculosis
RDGAE

SEQ ID NO: 1402221 - protein, 10 aa, Mycobacterium tuberculosis
RDGAGKGGAI

SEQ ID NO: 1402222 - protein, 5 aa, Mycobacterium tuberculosis
RDGAY

SEQ ID NO: 1402223 - protein, 9 aa, Mycobacterium tuberculosis
RDGDGNPVQ

SEQ ID NO: 1402224 - protein, 16 aa, Mycobacterium tuberculosis
RDGDGPGSHYRNTPET

SEQ ID NO: 1402225 - protein, 8 aa, Mycobacterium tuberculosis
RDGEAGGV

SEQ ID NO: 1402226 - protein, 7 aa, Mycobacterium tuberculosis
RDGEQGR

SEQ ID NO: 1402227 - protein, 16 aa, Mycobacterium tuberculosis
RDGGDAGEVTWLSRGV

SEQ ID NO: 1402228 - protein, 6 aa, Mycobacterium tuberculosis
RDGGYT

SEQ ID NO: 1402229 - protein, 8 aa, Mycobacterium tuberculosis
RDGPTLTK

SEQ ID NO: 1402230 - protein, 7 aa, Mycobacterium tuberculosis
RDGRPVT

SEQ ID NO: 1402231 - protein, 17 aa, Mycobacterium tuberculosis
RDHDPTSATGVSTIGSS

SEQ ID NO: 1402232 - protein, 6 aa, Mycobacterium tuberculosis
RDHPSA

SEQ ID NO: 1402233 - protein, 11 aa, Mycobacterium tuberculosis
RDITESPSTKL

SEQ ID NO: 1402234 - protein, 10 aa, Mycobacterium tuberculosis
RDKAVAQGSK

SEQ ID NO: 1402235 - protein, 7 aa, Mycobacterium tuberculosis
RDKTATA

SEQ ID NO: 1402236 - protein, 13 aa, Mycobacterium tuberculosis
RDNADDAPETRSE

SEQ ID NO: 1402237 - protein, 6 aa, Mycobacterium tuberculosis
RDPASI

SEQ ID NO: 1402238 - protein, 6 aa, Mycobacterium tuberculosis
RDPDAV

SEQ ID NO: 1402239 - protein, 14 aa, Mycobacterium tuberculosis
RDPETGEPGQWTQP

SEQ ID NO: 1402240 - protein, 9 aa, Mycobacterium tuberculosis
RDPGVPDGR

SEQ ID NO: 1402241 - protein, 13 aa, Mycobacterium tuberculosis
RDPINTPGPGRTK

SEQ ID NO: 1402242 - protein, 21 aa, Mycobacterium tuberculosis
RDPPPRSTPPQPIPEDLSPND

SEQ ID NO: 1402243 - protein, 24 aa, Mycobacterium tuberculosis
RDPRATERKKYGLKKARKAPQYSK

SEQ ID NO: 1402244 - protein, 8 aa, Mycobacterium tuberculosis
RDPRNGRN

SEQ ID NO: 1402245 - protein, 14 aa, Mycobacterium tuberculosis
RDQASASRRATHPV

SEQ ID NO: 1402246 - protein, 8 aa, Mycobacterium tuberculosis
RDQDPDHG

SEQ ID NO: 1402247 - protein, 7 aa, Mycobacterium tuberculosis
RDRDGLA

SEQ ID NO: 1402248 - protein, 6 aa, Mycobacterium tuberculosis
RDRPEI

SEQ ID NO: 1402249 - protein, 6 aa, Mycobacterium tuberculosis
RDRRQD

SEQ ID NO: 1402250 - protein, 9 aa, Mycobacterium tuberculosis
RDRYTPTPA

SEQ ID NO: 1402251 - protein, 9 aa, Mycobacterium tuberculosis
RDSENGAVA

SEQ ID NO: 1402252 - protein, 4 aa, Mycobacterium tuberculosis
RDSP

SEQ ID NO: 1402253 - protein, 15 aa, Mycobacterium tuberculosis
RDSPPQVRPLIVDRI

SEQ ID NO: 1402254 - protein, 8 aa, Mycobacterium tuberculosis
RDSSPSLA

SEQ ID NO: 1402255 - protein, 7 aa, Mycobacterium tuberculosis
RDTPQSL

SEQ ID NO: 1402256 - protein, 5 aa, Mycobacterium tuberculosis
RDTRR

SEQ ID NO: 1402257 - protein, 5 aa, Mycobacterium tuberculosis
RDVAA

SEQ ID NO: 1402258 - protein, 30 aa, Mycobacterium tuberculosis; identical to SEQ ID NO: 185056

SEQ ID NO: 1402259 - protein, 5 aa, Mycobacterium tuberculosis
RDVTG

SEQ ID NO: 1402260 - protein, 6 aa, Mycobacterium tuberculosis
RDVTGR

SEQ ID NO: 1402261 - protein, 7 aa, Mycobacterium tuberculosis
RDYADVP

SEQ ID NO: 1402262 - protein, 6 aa, Mycobacterium tuberculosis
READYS

SEQ ID NO: 1402263 - protein, 4 aa, Mycobacterium tuberculosis
REAE

SEQ ID NO: 1402264 - protein, 5 aa, Mycobacterium tuberculosis
REAEP

SEQ ID NO: 1402265 - protein, 5 aa, Mycobacterium tuberculosis
REAHG

SEQ ID NO: 1402266 - protein, 8 aa, Mycobacterium tuberculosis
REAPWPDS

SEQ ID NO: 1402267 - protein, 4 aa, Mycobacterium tuberculosis
REAS

SEQ ID NO: 1402268 - protein, 14 aa, Mycobacterium tuberculosis
REASEEAAGTEGRT

SEQ ID NO: 1402269 - protein, 11 aa, Mycobacterium tuberculosis
REATAMDPQQR

SEQ ID NO: 1402270 - protein, 9 aa, Mycobacterium tuberculosis
REATSIDPQ

SEQ ID NO: 1402271 - protein, 14 aa, Mycobacterium tuberculosis
REDGNYSPQLNSET

SEQ ID NO: 1402272 - protein, 9 aa, Mycobacterium tuberculosis
REGAGDVGY

SEQ ID NO: 1402273 - protein, 5 aa, Mycobacterium tuberculosis
REGDA

SEQ ID NO: 1402274 - protein, 5 aa, Mycobacterium tuberculosis
REGDN

SEQ ID NO: 1402275 - protein, 5 aa, Mycobacterium tuberculosis
REGEG

SEQ ID NO: 1402276 - protein, 7 aa, Mycobacterium tuberculosis
REGGIND

SEQ ID NO: 1402277 - protein, 9 aa, Mycobacterium tuberculosis
REGNGRSTR

SEQ ID NO: 1402278 - protein, 6 aa, Mycobacterium tuberculosis
REGPAA

SEQ ID NO: 1402279 - protein, 5 aa, Mycobacterium tuberculosis
REGSR

SEQ ID NO: 1402280 - protein, 6 aa, Mycobacterium tuberculosis
REGTTT

SEQ ID NO: 1402281 - protein, 9 aa, Mycobacterium tuberculosis
REHNGADQY

SEQ ID NO: 1402282 - protein, 9 aa, Mycobacterium tuberculosis
REKASEGTP

SEQ ID NO: 1402283 - protein, 8 aa, Mycobacterium tuberculosis
RELDGPNI

SEQ ID NO: 1402284 - protein, 8 aa, Mycobacterium tuberculosis
RELQRPDP

SEQ ID NO: 1402285 - protein, 18 aa, Mycobacterium tuberculosis
RENQTDQPASTILLPTSY

SEQ ID NO: 1402286 - protein, 9 aa, Mycobacterium tuberculosis
REPDGNPGQ

SEQ ID NO: 1402287 - protein, 6 aa, Mycobacterium tuberculosis
REPIPD

SEQ ID NO: 1402288 - protein, 6 aa, Mycobacterium tuberculosis
REPKKE

SEQ ID NO: 1402289 - protein, 4 aa, Mycobacterium tuberculosis
REPL

SEQ ID NO: 1402290 - protein, 5 aa, Mycobacterium tuberculosis
REPQL

SEQ ID NO: 1402291 - protein, 5 aa, Mycobacterium tuberculosis
REPVE

SEQ ID NO: 1402292 - protein, 4 aa, Mycobacterium tuberculosis
REQG

SEQ ID NO: 1402293 - protein, 8 aa, Mycobacterium tuberculosis
RERASRRV

SEQ ID NO: 1402294 - protein, 5 aa, Mycobacterium tuberculosis
RERGV

SEQ ID NO: 1402295 - protein, 7 aa, Mycobacterium tuberculosis
RESNYNA

SEQ ID NO: 1402296 - protein, 7 aa, Mycobacterium tuberculosis
RETTLDV

SEQ ID NO: 1402297 - protein, 15 aa, Mycobacterium tuberculosis
RFGPDSSARHRRSGA

SEQ ID NO: 1402298 - protein, 8 aa, Mycobacterium tuberculosis
RFPNPNDP

SEQ ID NO: 1402299 - protein, 6 aa, Mycobacterium tuberculosis
RFSGPD

SEQ ID NO: 1402300 - protein, 9 aa, Mycobacterium tuberculosis
RFSGSSGQL

SEQ ID NO: 1402301 - protein, 11 aa, Mycobacterium tuberculosis
RGADGELAGPW

SEQ ID NO: 1402302 - protein, 9 aa, Mycobacterium tuberculosis
RGAERSAQA

SEQ ID NO: 1402303 - protein, 5 aa, Mycobacterium tuberculosis
RGAGM

SEQ ID NO: 1402304 - protein, 12 aa, Mycobacterium tuberculosis
RGAGVDDCDQDP

SEQ ID NO: 1402305 - protein, 19 aa, Mycobacterium tuberculosis
RGALEGDPSGSQAADNNRV

SEQ ID NO: 1402306 - protein, 14 aa, Mycobacterium tuberculosis
RGAQGAEPRSGDGA

SEQ ID NO: 1402307 - protein, 10 aa, Mycobacterium tuberculosis
RGASGSAYGS

SEQ ID NO: 1402308 - protein, 8 aa, Mycobacterium tuberculosis
RGATDPTL

SEQ ID NO: 1402309 - protein, 9 aa, Mycobacterium tuberculosis
RGATPARRL

SEQ ID NO: 1402310 - protein, 4 aa, Mycobacterium tuberculosis
RGDE

SEQ ID NO: 1402311 - protein, 9 aa, Mycobacterium tuberculosis
RGDERPVPP

SEQ ID NO: 1402312 - protein, 7 aa, Mycobacterium tuberculosis
RGDGAPE

SEQ ID NO: 1402313 - protein, 11 aa, Mycobacterium tuberculosis
RGDGTITGSAI

SEQ ID NO: 1402314 - protein, 4 aa, Mycobacterium tuberculosis
RGDL

SEQ ID NO: 1402315 - protein, 10 aa, Mycobacterium tuberculosis
RGDPGRLAPV

SEQ ID NO: 1402316 - protein, 19 aa, Mycobacterium tuberculosis
RGDPSDNLPGIPGVGEKTA

SEQ ID NO: 1402317 - protein, 7 aa, Mycobacterium tuberculosis
RGDRADW

SEQ ID NO: 1402318 - protein, 8 aa, Mycobacterium tuberculosis
RGDTPLPV

SEQ ID NO: 1402319 - protein, 5 aa, Mycobacterium tuberculosis
RGDTT

SEQ ID NO: 1402320 - protein, 5 aa, Mycobacterium tuberculosis
RGEAT

SEQ ID NO: 1402321 - protein, 8 aa, Mycobacterium tuberculosis
RGEATEQL

SEQ ID NO: 1402322 - protein, 10 aa, Mycobacterium tuberculosis
RGEGLGVPAS

SEQ ID NO: 1402323 - protein, 8 aa, Mycobacterium tuberculosis
RGEGLNQD

SEQ ID NO: 1402324 - protein, 6 aa, Mycobacterium tuberculosis
RGELEP

SEQ ID NO: 1402325 - protein, 7 aa, Mycobacterium tuberculosis
RGELRGS

SEQ ID NO: 1402326 - protein, 10 aa, Mycobacterium tuberculosis
RGELSADDAR

SEQ ID NO: 1402327 - protein, 10 aa, Mycobacterium tuberculosis
RGEPVDSYGV

SEQ ID NO: 1402328 - protein, 5 aa, Mycobacterium tuberculosis
RGEPY

SEQ ID NO: 1402329 - protein, 9 aa, Mycobacterium tuberculosis
RGEQPGPME

SEQ ID NO: 1402330 - protein, 4 aa, Mycobacterium tuberculosis
RGFG

SEQ ID NO: 1402331 - protein, 7 aa, Mycobacterium tuberculosis
RGFSDDA

SEQ ID NO: 1402332 - protein, 6 aa, Mycobacterium tuberculosis
RGFTGD

SEQ ID NO: 1402333 - protein, 4 aa, Mycobacterium tuberculosis
RGGA

SEQ ID NO: 1402334 - protein, 7 aa, Mycobacterium tuberculosis
RGGADAE

SEQ ID NO: 1402335 - protein, 7 aa, Mycobacterium tuberculosis
RGGAGRT

SEQ ID NO: 1402336 - protein, 15 aa, Mycobacterium tuberculosis
RGGGEATVTGSADTR

SEQ ID NO: 1402337 - protein, 4 aa, Mycobacterium tuberculosis
RGGP

SEQ ID NO: 1402338 - protein, 15 aa, Mycobacterium tuberculosis
RGGPSTGLPTKTEQA

SEQ ID NO: 1402339 - protein, 8 aa, Mycobacterium tuberculosis
RGGRPVVD

SEQ ID NO: 1402340 - protein, 8 aa, Mycobacterium tuberculosis
RGGSGSIT

SEQ ID NO: 1402341 - protein, 8 aa, Mycobacterium tuberculosis
RGGTPDEV

SEQ ID NO: 1402342 - protein, 9 aa, Mycobacterium tuberculosis
RGHASGPRL

SEQ ID NO: 1402343 - protein, 9 aa, Mycobacterium tuberculosis
RGHGRSGGK

SEQ ID NO: 1402344 - protein, 5 aa, Mycobacterium tuberculosis
RGIGA

SEQ ID NO: 1402345 - protein, 4 aa, Mycobacterium tuberculosis
RGIT

SEQ ID NO: 1402346 - protein, 8 aa, Mycobacterium tuberculosis
RGKDAEPL

SEQ ID NO: 1402347 - protein, 8 aa, Mycobacterium tuberculosis
RGKESHAA

SEQ ID NO: 1402348 - protein, 5 aa, Mycobacterium tuberculosis
RGKGH

SEQ ID NO: 1402349 - protein, 8 aa, Mycobacterium tuberculosis
RGKPIPDL

SEQ ID NO: 1402350 - protein, 13 aa, Mycobacterium tuberculosis
RGKPTGPDGEPDW

SEQ ID NO: 1402351 - protein, 5 aa, Mycobacterium tuberculosis
RGKSR

SEQ ID NO: 1402352 - protein, 6 aa, Mycobacterium tuberculosis
RGLAGS

SEQ ID NO: 1402353 - protein, 6 aa, Mycobacterium tuberculosis
RGLGEK

SEQ ID NO: 1402354 - protein, 8 aa, Mycobacterium tuberculosis
RGLGRPQR

SEQ ID NO: 1402355 - protein, 10 aa, Mycobacterium tuberculosis
RGLNPSETDY

SEQ ID NO: 1402356 - protein, 11 aa, Mycobacterium tuberculosis
RGLPAQGDDVD

SEQ ID NO: 1402357 - protein, 7 aa, Mycobacterium tuberculosis
RGLSSGD

SEQ ID NO: 1402358 - protein, 9 aa, Mycobacterium tuberculosis
RGLTPASDY

SEQ ID NO: 1402359 - protein, 6 aa, Mycobacterium tuberculosis
RGNGDI

SEQ ID NO: 1402360 - protein, 5 aa, Mycobacterium tuberculosis
RGNGY

SEQ ID NO: 1402361 - protein, 5 aa, Mycobacterium tuberculosis
RGPDE

SEQ ID NO: 1402362 - protein, 7 aa, Mycobacterium tuberculosis
RGPNAGS

SEQ ID NO: 1402363 - protein, 22 aa, Mycobacterium tuberculosis
RGPNGAGWPQLGQNEQGQDLTP

SEQ ID NO: 1402364 - protein, 5 aa, Mycobacterium tuberculosis
RGPSA

SEQ ID NO: 1402365 - protein, 8 aa, Mycobacterium tuberculosis
RGQHARSR

SEQ ID NO: 1402366 - protein, 12 aa, Mycobacterium tuberculosis
RGQRGGEGPSYE

SEQ ID NO: 1402367 - protein, 7 aa, Mycobacterium tuberculosis
RGRAGHG

SEQ ID NO: 1402368 - protein, 5 aa, Mycobacterium tuberculosis
RGREA

SEQ ID NO: 1402369 - protein, 6 aa, Mycobacterium tuberculosis
RGRQLD

SEQ ID NO: 1402370 - protein, 20 aa, Mycobacterium tuberculosis
RGRRRSKRMAKSVTEPDDLA

SEQ ID NO: 1402371 - protein, 8 aa, Mycobacterium tuberculosis
RGRTDDED

SEQ ID NO: 1402372 - protein, 7 aa, Mycobacterium tuberculosis
RGRTEAL

SEQ ID NO: 1402373 - protein, 6 aa, Mycobacterium tuberculosis
RGSAKR

SEQ ID NO: 1402374 - protein, 5 aa, Mycobacterium tuberculosis
RGSDV

SEQ ID NO: 1402375 - protein, 15 aa, Mycobacterium tuberculosis
RGSEAVELSGDAADE

SEQ ID NO: 1402376 - protein, 8 aa, Mycobacterium tuberculosis
RGSEYPQR

SEQ ID NO: 1402377 - protein, 6 aa, Mycobacterium tuberculosis
RGSGQW

SEQ ID NO: 1402378 - protein, 7 aa, Mycobacterium tuberculosis
RGSPDTC

SEQ ID NO: 1402379 - protein, 9 aa, Mycobacterium tuberculosis
RGSPGNTIN

SEQ ID NO: 1402380 - protein, 12 aa, Mycobacterium tuberculosis
RGSSSAAKSNEA

SEQ ID NO: 1402381 - protein, 5 aa, Mycobacterium tuberculosis
RGSVV

SEQ ID NO: 1402382 - protein, 9 aa, Mycobacterium tuberculosis
RGTADFANE

SEQ ID NO: 1402383 - protein, 6 aa, Mycobacterium tuberculosis
RGTAEY

SEQ ID NO: 1402384 - protein, 7 aa, Mycobacterium tuberculosis
RGTDGSA

SEQ ID NO: 1402385 - protein, 6 aa, Mycobacterium tuberculosis
RGTDQI

SEQ ID NO: 1402386 - protein, 7 aa, Mycobacterium tuberculosis
RGTDSLN

SEQ ID NO: 1402387 - protein, 8 aa, Mycobacterium tuberculosis
RGTEADRI

SEQ ID NO: 1402388 - protein, 8 aa, Mycobacterium tuberculosis
RGTGQPLA

SEQ ID NO: 1402389 - protein, 7 aa, Mycobacterium tuberculosis
RGTGSHD

SEQ ID NO: 1402390 - protein, 8 aa, Mycobacterium tuberculosis
RGTSVNPV

SEQ ID NO: 1402391 - protein, 5 aa, Mycobacterium tuberculosis
RGVGA

SEQ ID NO: 1402392 - protein, 5 aa, Mycobacterium tuberculosis
RGVPA

SEQ ID NO: 1402393 - protein, 13 aa, Mycobacterium tuberculosis
RGVPGDKKARSVR

SEQ ID NO: 1402394 - protein, 7 aa, Mycobacterium tuberculosis
RGVRDGE

SEQ ID NO: 1402395 - protein, 5 aa, Mycobacterium tuberculosis
RGYAY

SEQ ID NO: 1402396 - protein, 9 aa, Mycobacterium tuberculosis
RGYDGTSIE

SEQ ID NO: 1402397 - protein, 10 aa, Mycobacterium tuberculosis
RGYSAGDSGV

SEQ ID NO: 1402398 - protein, 5 aa, Mycobacterium tuberculosis
RHARG

SEQ ID NO: 1402399 - protein, 7 aa, Mycobacterium tuberculosis
RHDGGER

SEQ ID NO: 1402400 - protein, 6 aa, Mycobacterium tuberculosis
RHGADD

SEQ ID NO: 1402401 - protein, 7 aa, Mycobacterium tuberculosis
RHGDHNH

SEQ ID NO: 1402402 - protein, 8 aa, Mycobacterium tuberculosis
RHGGSGYG

SEQ ID NO: 1402403 - protein, 8 aa, Mycobacterium tuberculosis
RHGQRGPF

SEQ ID NO: 1402404 - protein, 8 aa, Mycobacterium tuberculosis
RHHKQPPL

SEQ ID NO: 1402405 - protein, 6 aa, Mycobacterium tuberculosis
RHHTER

SEQ ID NO: 1402406 - protein, 7 aa, Mycobacterium tuberculosis
RHPDASG

SEQ ID NO: 1402407 - protein, 13 aa, Mycobacterium tuberculosis
RHPSRSQVLRDYL

SEQ ID NO: 1402408 - protein, 5 aa, Mycobacterium tuberculosis
RHPST

SEQ ID NO: 1402409 - protein, 4 aa, Mycobacterium tuberculosis
RHQN

SEQ ID NO: 1402410 - protein, 6 aa, Mycobacterium tuberculosis
RHRPGS

SEQ ID NO: 1402411 - protein, 11 aa, Mycobacterium tuberculosis
RHSEPDDEPTR

SEQ ID NO: 1402412 - protein, 15 aa, Mycobacterium tuberculosis
RHSRRGRALPARSRS

SEQ ID NO: 1402413 - protein, 6 aa, Mycobacterium tuberculosis
RIDEPG

SEQ ID NO: 1402414 - protein, 4 aa, Mycobacterium tuberculosis
RIDP

SEQ ID NO: 1402415 - protein, 6 aa, Mycobacterium tuberculosis
RIGPEY

SEQ ID NO: 1402416 - protein, 5 aa, Mycobacterium tuberculosis
RIPQG

SEQ ID NO: 1402417 - protein, 7 aa, Mycobacterium tuberculosis
RISPSGR

SEQ ID NO: 1402418 - protein, 6 aa, Mycobacterium tuberculosis
RKAHGD

SEQ ID NO: 1402419 - protein, 9 aa, Mycobacterium tuberculosis
RKAKDNRND

SEQ ID NO: 1402420 - protein, 6 aa, Mycobacterium tuberculosis
RKDGPL

SEQ ID NO: 1402421 - protein, 7 aa, Mycobacterium tuberculosis
RKDGVEA

SEQ ID NO: 1402422 - protein, 8 aa, Mycobacterium tuberculosis
RKEGAEER

SEQ ID NO: 1402423 - protein, 6 aa, Mycobacterium tuberculosis
RKEGNR

SEQ ID NO: 1402424 - protein, 13 aa, Mycobacterium tuberculosis
RKEPAKTAEAIDS

SEQ ID NO: 1402425 - protein, 10 aa, Mycobacterium tuberculosis
RKHAANNPKA

SEQ ID NO: 1402426 - protein, 17 aa, Mycobacterium tuberculosis
RKISDGDKLAGRHGNKG

SEQ ID NO: 1402427 - protein, 9 aa, Mycobacterium tuberculosis
RKKGYGTAA

SEQ ID NO: 1402428 - protein, 14 aa, Mycobacterium tuberculosis
RKKQRQPAEYPTEQ

SEQ ID NO: 1402429 - protein, 6 aa, Mycobacterium tuberculosis
RKPEIA

SEQ ID NO: 1402430 - protein, 11 aa, Mycobacterium tuberculosis
RKPGSVTTTSA

SEQ ID NO: 1402431 - protein, 13 aa, Mycobacterium tuberculosis
RKPSQLSGGQRQR

SEQ ID NO: 1402432 - protein, 8 aa, Mycobacterium tuberculosis
RKQSPTKP

SEQ ID NO: 1402433 - protein, 9 aa, Mycobacterium tuberculosis
RKRGDRDRS

SEQ ID NO: 1402434 - protein, 8 aa, Mycobacterium tuberculosis
RKRKEKAL

SEQ ID NO: 1402435 - protein, 17 aa, Mycobacterium tuberculosis
RKRPGSPAAQASKRASE

SEQ ID NO: 1402436 - protein, 6 aa, Mycobacterium tuberculosis
RKTARR

SEQ ID NO: 1402437 - protein, 7 aa, Mycobacterium tuberculosis
RKTGKTA

SEQ ID NO: 1402438 - protein, 7 aa, Mycobacterium tuberculosis
RKTYGKG

SEQ ID NO: 1402439 - protein, 5 aa, Mycobacterium tuberculosis
RLAAG

SEQ ID NO: 1402440 - protein, 8 aa, Mycobacterium tuberculosis
RLADEGIG

SEQ ID NO: 1402441 - protein, 16 aa, Mycobacterium tuberculosis
RLASEKNGVMICTDCA

SEQ ID NO: 1402442 - protein, 15 aa, Mycobacterium tuberculosis
RLDKPGGGLSGGQQQ

SEQ ID NO: 1402443 - protein, 4 aa, Mycobacterium tuberculosis
RLDP

SEQ ID NO: 1402444 - protein, 11 aa, Mycobacterium tuberculosis
RLDTTNHEAAR

SEQ ID NO: 1402445 - protein, 6 aa, Mycobacterium tuberculosis
RLESAR

SEQ ID NO: 1402446 - protein, 4 aa, Mycobacterium tuberculosis
RLGE

SEQ ID NO: 1402447 - protein, 5 aa, Mycobacterium tuberculosis
RLGRR

SEQ ID NO: 1402448 - protein, 14 aa, Mycobacterium tuberculosis
RLPTGDDHGGGDTL

SEQ ID NO: 1402449 - protein, 5 aa, Mycobacterium tuberculosis
RLRGG

SEQ ID NO: 1402450 - protein, 10 aa, Mycobacterium tuberculosis
RLSSNNAQQE

SEQ ID NO: 1402451 - protein, 13 aa, Mycobacterium tuberculosis
RLTENADSTGVDN

SEQ ID NO: 1402452 - protein, 5 aa, Mycobacterium tuberculosis
RLTES

SEQ ID NO: 1402453 - protein, 7 aa, Mycobacterium tuberculosis
RLTGGQL

SEQ ID NO: 1402454 - protein, 16 aa, Mycobacterium tuberculosis
RLTPPSPKAVAQHLPR

SEQ ID NO: 1402455 - protein, 7 aa, Mycobacterium tuberculosis
RLTREEE

SEQ ID NO: 1402456 - protein, 6 aa, Mycobacterium tuberculosis
RMAPPE

SEQ ID NO: 1402457 - protein, 5 aa, Mycobacterium tuberculosis
RMRAE

SEQ ID NO: 1402458 - protein, 15 aa, Mycobacterium tuberculosis
RNAAGKVSKPQLREL

SEQ ID NO: 1402459 - protein, 10 aa, Mycobacterium tuberculosis
RNAAPSGTAA

SEQ ID NO: 1402460 - protein, 5 aa, Mycobacterium tuberculosis
RNADG

SEQ ID NO: 1402461 - protein, 9 aa, Mycobacterium tuberculosis
RNENGGRRW

SEQ ID NO: 1402462 - protein, 8 aa, Mycobacterium tuberculosis
RNEPASYL

SEQ ID NO: 1402463 - protein, 9 aa, Mycobacterium tuberculosis
RNGAGKTTT

SEQ ID NO: 1402464 - protein, 11 aa, Mycobacterium tuberculosis
RNGGTMADPGS

SEQ ID NO: 1402465 - protein, 8 aa, Mycobacterium tuberculosis
RNGPPYSP

SEQ ID NO: 1402466 - protein, 11 aa, Mycobacterium tuberculosis
RNGQTDAAVGA

SEQ ID NO: 1402467 - protein, 8 aa, Mycobacterium tuberculosis
RNGTRGAD

SEQ ID NO: 1402468 - protein, 7 aa, Mycobacterium tuberculosis
RNKAGSL

SEQ ID NO: 1402469 - protein, 8 aa, Mycobacterium tuberculosis
RNKDYSQQ

SEQ ID NO: 1402470 - protein, 7 aa, Mycobacterium tuberculosis
RNNGPEL

SEQ ID NO: 1402471 - protein, 8 aa, Mycobacterium tuberculosis
RNPAIEPA

SEQ ID NO: 1402472 - protein, 5 aa, Mycobacterium tuberculosis
RNPAL

SEQ ID NO: 1402473 - protein, 7 aa, Mycobacterium tuberculosis
RNQGDRE

SEQ ID NO: 1402474 - protein, 11 aa, Mycobacterium tuberculosis
RNRDRASELRS

SEQ ID NO: 1402475 - protein, 7 aa, Mycobacterium tuberculosis
RNSEGKA

SEQ ID NO: 1402476 - protein, 6 aa, Mycobacterium tuberculosis
RNSPQQ

SEQ ID NO: 1402477 - protein, 4 aa, Mycobacterium tuberculosis
RNTL

SEQ ID NO: 1402478 - protein, 5 aa, Mycobacterium tuberculosis
RPAAG

SEQ ID NO: 1402479 - protein, 20 aa, Mycobacterium tuberculosis
RPAAVSDLSGPGKPTLAGRL

SEQ ID NO: 1402480 - protein, 5 aa, Mycobacterium tuberculosis
RPADI

SEQ ID NO: 1402481 - protein, 11 aa, Mycobacterium tuberculosis
RPADPADVPGG

SEQ ID NO: 1402482 - protein, 4 aa, Mycobacterium tuberculosis
RPAG

SEQ ID NO: 1402483 - protein, 5 aa, Mycobacterium tuberculosis
RPAGT

SEQ ID NO: 1402484 - protein, 7 aa, Mycobacterium tuberculosis
RPAITTA

SEQ ID NO: 1402485 - protein, 6 aa, Mycobacterium tuberculosis
RPANNL

SEQ ID NO: 1402486 - protein, 8 aa, Mycobacterium tuberculosis
RPAPYSVA

SEQ ID NO: 1402487 - protein, 34 aa, Mycobacterium tuberculosis; identical to SEQ ID NO: 185746

SEQ ID NO: 1402488 - protein, 6 aa, Mycobacterium tuberculosis
RPATSR

SEQ ID NO: 1402489 - protein, 14 aa, Mycobacterium tuberculosis
RPAYSNADAARQVA

SEQ ID NO: 1402490 - protein, 25 aa, Mycobacterium tuberculosis
RPDAASGRRGKPQPSPVAREAAERG

SEQ ID NO: 1402491 - protein, 6 aa, Mycobacterium tuberculosis
RPDGRV

SEQ ID NO: 1402492 - protein, 7 aa, Mycobacterium tuberculosis
RPDLPPT

SEQ ID NO: 1402493 - protein, 15 aa, Mycobacterium tuberculosis
RPDPRLGSANAALST

SEQ ID NO: 1402494 - protein, 25 aa, Mycobacterium tuberculosis
RPDPYKGKGVRYEGEQIRRKVGKTG

SEQ ID NO: 1402495 - protein, 7 aa, Mycobacterium tuberculosis
RPDRSTT

SEQ ID NO: 1402496 - protein, 7 aa, Mycobacterium tuberculosis
RPDSPSV

SEQ ID NO: 1402497 - protein, 9 aa, Mycobacterium tuberculosis
RPEFQSPDG

SEQ ID NO: 1402498 - protein, 5 aa, Mycobacterium tuberculosis
RPEIS

SEQ ID NO: 1402499 - protein, 4 aa, Mycobacterium tuberculosis
RPEP

SEQ ID NO: 1402500 - protein, 7 aa, Mycobacterium tuberculosis
RPEPKRA

SEQ ID NO: 1402501 - protein, 6 aa, Mycobacterium tuberculosis
RPERRR

SEQ ID NO: 1402502 - protein, 12 aa, Mycobacterium tuberculosis
RPFDQPGCPMAA

SEQ ID NO: 1402503 - protein, 6 aa, Mycobacterium tuberculosis
RPGAAD

SEQ ID NO: 1402504 - protein, 10 aa, Mycobacterium tuberculosis
RPGAKTVTAL

SEQ ID NO: 1402505 - protein, 5 aa, Mycobacterium tuberculosis
RPGDL

SEQ ID NO: 1402506 - protein, 9 aa, Mycobacterium tuberculosis
RPGDLSPGD

SEQ ID NO: 1402507 - protein, 4 aa, Mycobacterium tuberculosis
RPGE

SEQ ID NO: 1402508 - protein, 13 aa, Mycobacterium tuberculosis
RPGEPPTKESAQT

SEQ ID NO: 1402509 - protein, 15 aa, Mycobacterium tuberculosis
RPGGGAKLARSAGSS

SEQ ID NO: 1402510 - protein, 14 aa, Mycobacterium tuberculosis
RPGGTAEPAPTREE

SEQ ID NO: 1402511 - protein, 5 aa, Mycobacterium tuberculosis
RPGNQ

SEQ ID NO: 1402512 - protein, 9 aa, Mycobacterium tuberculosis
RPGPEFRPS

SEQ ID NO: 1402513 - protein, 10 aa, Mycobacterium tuberculosis
RPGPMDTGPL

SEQ ID NO: 1402514 - protein, 15 aa, Mycobacterium tuberculosis
RPGPPPARTGADRTS

SEQ ID NO: 1402515 - protein, 6 aa, Mycobacterium tuberculosis
RPGPRR

SEQ ID NO: 1402516 - protein, 6 aa, Mycobacterium tuberculosis
RPGPTM

SEQ ID NO: 1402517 - protein, 5 aa, Mycobacterium tuberculosis
RPGQI

SEQ ID NO: 1402518 - protein, 8 aa, Mycobacterium tuberculosis
RPGSSTFD

SEQ ID NO: 1402519 - protein, 6 aa, Mycobacterium tuberculosis
RPGTRY

SEQ ID NO: 1402520 - protein, 5 aa, Mycobacterium tuberculosis
RPGYE

SEQ ID NO: 1402521 - protein, 9 aa, Mycobacterium tuberculosis
RPHAPTGAQ

SEQ ID NO: 1402522 - protein, 6 aa, Mycobacterium tuberculosis
RPHSGT

SEQ ID NO: 1402523 - protein, 13 aa, Mycobacterium tuberculosis
RPITGDDPARPRE

SEQ ID NO: 1402524 - protein, 10 aa, Mycobacterium tuberculosis
RPKQRNAQTR

SEQ ID NO: 1402525 - protein, 8 aa, Mycobacterium tuberculosis
RPKSPADV

SEQ ID NO: 1402526 - protein, 7 aa, Mycobacterium tuberculosis
RPLDKSR

SEQ ID NO: 1402527 - protein, 11 aa, Mycobacterium tuberculosis
RPLGQPRTIPA

SEQ ID NO: 1402528 - protein, 6 aa, Mycobacterium tuberculosis
RPLPGR

SEQ ID NO: 1402529 - protein, 20 aa, Mycobacterium tuberculosis
RPLTKKPAETRMGSGKGSPE

SEQ ID NO: 1402530 - protein, 8 aa, Mycobacterium tuberculosis
RPNGNLSQ

SEQ ID NO: 1402531 - protein, 5 aa, Mycobacterium tuberculosis
RPNNE

SEQ ID NO: 1402532 - protein, 9 aa, Mycobacterium tuberculosis
RPNRGDGRM

SEQ ID NO: 1402533 - protein, 7 aa, Mycobacterium tuberculosis
RPNRTNR

SEQ ID NO: 1402534 - protein, 4 aa, Mycobacterium tuberculosis
RPNV

SEQ ID NO: 1402535 - protein, 19 aa, Mycobacterium tuberculosis
RPPAPAALPGTPQARGESI

SEQ ID NO: 1402536 - protein, 13 aa, Mycobacterium tuberculosis
RPPDARAESTPWP

SEQ ID NO: 1402537 - protein, 5 aa, Mycobacterium tuberculosis
RPPDV

SEQ ID NO: 1402538 - protein, 9 aa, Mycobacterium tuberculosis
RPPGREAYP

SEQ ID NO: 1402539 - protein, 7 aa, Mycobacterium tuberculosis
RPPHEEL

SEQ ID NO: 1402540 - protein, 6 aa, Mycobacterium tuberculosis
RPPPTF

SEQ ID NO: 1402541 - protein, 7 aa, Mycobacterium tuberculosis
RPPRSTL

SEQ ID NO: 1402542 - protein, 7 aa, Mycobacterium tuberculosis
RPPTNAM

SEQ ID NO: 1402543 - protein, 11 aa, Mycobacterium tuberculosis
RPPVPSLEPPY

SEQ ID NO: 1402544 - protein, 11 aa, Mycobacterium tuberculosis
RPQHPSQSVDH

SEQ ID NO: 1402545 - protein, 14 aa, Mycobacterium tuberculosis
RPQQPNVAQPGSRV

SEQ ID NO: 1402546 - protein, 6 aa, Mycobacterium tuberculosis
RPQVQE

SEQ ID NO: 1402547 - protein, 6 aa, Mycobacterium tuberculosis
RPRDEL

SEQ ID NO: 1402548 - protein, 12 aa, Mycobacterium tuberculosis
RPRLDNPTDDVR

SEQ ID NO: 1402549 - protein, 4 aa, Mycobacterium tuberculosis
RPRQ

SEQ ID NO: 1402550 - protein, 7 aa, Mycobacterium tuberculosis
RPRSEQD

SEQ ID NO: 1402551 - protein, 6 aa, Mycobacterium tuberculosis
RPSETA

SEQ ID NO: 1402552 - protein, 11 aa, Mycobacterium tuberculosis
RPSGNGPTAIA

SEQ ID NO: 1402553 - protein, 8 aa, Mycobacterium tuberculosis
RPSGRGTD

SEQ ID NO: 1402554 - protein, 8 aa, Mycobacterium tuberculosis
RPSGTEPK

SEQ ID NO: 1402555 - protein, 8 aa, Mycobacterium tuberculosis
RPSHGGYG

SEQ ID NO: 1402556 - protein, 17 aa, Mycobacterium tuberculosis
RPSPTSGTLGGVTRATR

SEQ ID NO: 1402557 - protein, 5 aa, Mycobacterium tuberculosis
RPSRG

SEQ ID NO: 1402558 - protein, 6 aa, Mycobacterium tuberculosis
RPSSLN

SEQ ID NO: 1402559 - protein, 6 aa, Mycobacterium tuberculosis
RPSTRR

SEQ ID NO: 1402560 - protein, 7 aa, Mycobacterium tuberculosis
RPTADDL

SEQ ID NO: 1402561 - protein, 12 aa, Mycobacterium tuberculosis
RPTGRGGEREIA

SEQ ID NO: 1402562 - protein, 9 aa, Mycobacterium tuberculosis
RPTKGGSAL

SEQ ID NO: 1402563 - protein, 5 aa, Mycobacterium tuberculosis
RPTLK

SEQ ID NO: 1402564 - protein, 5 aa, Mycobacterium tuberculosis
RPYDE

SEQ ID NO: 1402565 - protein, 4 aa, Mycobacterium tuberculosis
RPYR

SEQ ID NO: 1402566 - protein, 6 aa, Mycobacterium tuberculosis
RQAADE

SEQ ID NO: 1402567 - protein, 8 aa, Mycobacterium tuberculosis
RQADWDTG

SEQ ID NO: 1402568 - protein, 4 aa, Mycobacterium tuberculosis
RQAG

SEQ ID NO: 1402569 - protein, 6 aa, Mycobacterium tuberculosis
RQAGPI

SEQ ID NO: 1402570 - protein, 5 aa, Mycobacterium tuberculosis
RQAGY

SEQ ID NO: 1402571 - protein, 16 aa, Mycobacterium tuberculosis
RQAGYRPARREGAREG

SEQ ID NO: 1402572 - protein, 9 aa, Mycobacterium tuberculosis
RQASEDEHW

SEQ ID NO: 1402573 - protein, 8 aa, Mycobacterium tuberculosis
RQASPGVK

SEQ ID NO: 1402574 - protein, 4 aa, Mycobacterium tuberculosis
RQAW

SEQ ID NO: 1402575 - protein, 9 aa, Mycobacterium tuberculosis
RQDGSASYD

SEQ ID NO: 1402576 - protein, 11 aa, Mycobacterium tuberculosis
RQDRTYKPPAA

SEQ ID NO: 1402577 - protein, 10 aa, Mycobacterium tuberculosis
RQGPITSAAD

SEQ ID NO: 1402578 - protein, 16 aa, Mycobacterium tuberculosis
RQGSGGAGRWRGGDGA

SEQ ID NO: 1402579 - protein, 6 aa, Mycobacterium tuberculosis
RQGTEA

SEQ ID NO: 1402580 - protein, 8 aa, Mycobacterium tuberculosis
RQKAQSAQ

SEQ ID NO: 1402581 - protein, 8 aa, Mycobacterium tuberculosis
RQKARASQ

SEQ ID NO: 1402582 - protein, 7 aa, Mycobacterium tuberculosis
RQNAGDV

SEQ ID NO: 1402583 - protein, 5 aa, Mycobacterium tuberculosis
RQNPL

SEQ ID NO: 1402584 - protein, 6 aa, Mycobacterium tuberculosis
RQPDGR

SEQ ID NO: 1402585 - protein, 9 aa, Mycobacterium tuberculosis
RQPEDGTQH

SEQ ID NO: 1402586 - protein, 7 aa, Mycobacterium tuberculosis
RQPGGDT

SEQ ID NO: 1402587 - protein, 5 aa, Mycobacterium tuberculosis
RQPQA

SEQ ID NO: 1402588 - protein, 8 aa, Mycobacterium tuberculosis
RQPSYDDI

SEQ ID NO: 1402589 - protein, 5 aa, Mycobacterium tuberculosis
RQPYA

SEQ ID NO: 1402590 - protein, 11 aa, Mycobacterium tuberculosis
RQRADDAGGEF

SEQ ID NO: 1402591 - protein, 6 aa, Mycobacterium tuberculosis
RQRDRV

SEQ ID NO: 1402592 - protein, 9 aa, Mycobacterium tuberculosis
RQRDTGAPQ

SEQ ID NO: 1402593 - protein, 6 aa, Mycobacterium tuberculosis
RQRREK

SEQ ID NO: 1402594 - protein, 19 aa, Mycobacterium tuberculosis
RQRVAQQETERITTRLAAL

SEQ ID NO: 1402595 - protein, 8 aa, Mycobacterium tuberculosis
RQSDPQLA

SEQ ID NO: 1402596 - protein, 9 aa, Mycobacterium tuberculosis
RQSSGKGQV

SEQ ID NO: 1402597 - protein, 5 aa, Mycobacterium tuberculosis
RQTRF

SEQ ID NO: 1402598 - protein, 7 aa, Mycobacterium tuberculosis
RQVPDNG

SEQ ID NO: 1402599 - protein, 6 aa, Mycobacterium tuberculosis
RQYGIE

SEQ ID NO: 1402600 - protein, 24 aa, Mycobacterium tuberculosis
RRAERERLQAQRPPDVIDHAWVPV

SEQ ID NO: 1402601 - protein, 10 aa, Mycobacterium tuberculosis
RRAGKRDGKR

SEQ ID NO: 1402602 - protein, 26 aa, Mycobacterium tuberculosis
RRARGPAKRPARKAARKVPAKKAAKR

SEQ ID NO: 1402603 - protein, 6 aa, Mycobacterium tuberculosis
RRDAEL

SEQ ID NO: 1402604 - protein, 7 aa, Mycobacterium tuberculosis
RRDEARN

SEQ ID NO: 1402605 - protein, 8 aa, Mycobacterium tuberculosis
RRDGADTV

SEQ ID NO: 1402606 - protein, 9 aa, Mycobacterium tuberculosis
RRDKATSNI

SEQ ID NO: 1402607 - protein, 17 aa, Mycobacterium tuberculosis
RRDLGASAAELVDEARS

SEQ ID NO: 1402608 - protein, 7 aa, Mycobacterium tuberculosis
RRDPAAA

SEQ ID NO: 1402609 - protein, 10 aa, Mycobacterium tuberculosis
RRDSRYQPGR

SEQ ID NO: 1402610 - protein, 7 aa, Mycobacterium tuberculosis
RRDTDGY

SEQ ID NO: 1402611 - protein, 8 aa, Mycobacterium tuberculosis
RRDTNGRG

SEQ ID NO: 1402612 - protein, 5 aa, Mycobacterium tuberculosis
RREAT

SEQ ID NO: 1402613 - protein, 9 aa, Mycobacterium tuberculosis
RREDNDKTR

SEQ ID NO: 1402614 - protein, 13 aa, Mycobacterium tuberculosis
RREEALETGKDAM

SEQ ID NO: 1402615 - protein, 5 aa, Mycobacterium tuberculosis
RREGA

SEQ ID NO: 1402616 - protein, 5 aa, Mycobacterium tuberculosis
RREYP

SEQ ID NO: 1402617 - protein, 7 aa, Mycobacterium tuberculosis
RRFSDEE

SEQ ID NO: 1402618 - protein, 5 aa, Mycobacterium tuberculosis
RRFTP

SEQ ID NO: 1402619 - protein, 9 aa, Mycobacterium tuberculosis
RRGDKRALA

SEQ ID NO: 1402620 - protein, 6 aa, Mycobacterium tuberculosis
RRGELG

SEQ ID NO: 1402621 - protein, 7 aa, Mycobacterium tuberculosis
RRGGDTV

SEQ ID NO: 1402622 - protein, 12 aa, Mycobacterium tuberculosis
RRGPIPRPPTLE

SEQ ID NO: 1402623 - protein, 6 aa, Mycobacterium tuberculosis
RRGSGV

SEQ ID NO: 1402624 - protein, 7 aa, Mycobacterium tuberculosis
RRGSNVA

SEQ ID NO: 1402625 - protein, 11 aa, Mycobacterium tuberculosis
RRHEAADQRRV

SEQ ID NO: 1402626 - protein, 9 aa, Mycobacterium tuberculosis
RRKGRLRAQ

SEQ ID NO: 1402627 - protein, 7 aa, Mycobacterium tuberculosis
RRKTSRN

SEQ ID NO: 1402628 - protein, 8 aa, Mycobacterium tuberculosis
RRLDDAQP

SEQ ID NO: 1402629 - protein, 9 aa, Mycobacterium tuberculosis
RRLGETAAE

SEQ ID NO: 1402630 - protein, 9 aa, Mycobacterium tuberculosis
RRNDDEPAE

SEQ ID NO: 1402631 - protein, 6 aa, Mycobacterium tuberculosis
RRNDPV

SEQ ID NO: 1402632 - protein, 8 aa, Mycobacterium tuberculosis
RRNLGGAG

SEQ ID NO: 1402633 - protein, 8 aa, Mycobacterium tuberculosis
RRNPRDDH

SEQ ID NO: 1402634 - protein, 9 aa, Mycobacterium tuberculosis
RRNTAAAEL

SEQ ID NO: 1402635 - protein, 15 aa, Mycobacterium tuberculosis
RRPALPGRTKHPRIS

SEQ ID NO: 1402636 - protein, 6 aa, Mycobacterium tuberculosis
RRPDGR

SEQ ID NO: 1402637 - protein, 8 aa, Mycobacterium tuberculosis
RRPEGSDD

SEQ ID NO: 1402638 - protein, 7 aa, Mycobacterium tuberculosis
RRPENAG

SEQ ID NO: 1402639 - protein, 7 aa, Mycobacterium tuberculosis
RRPGETA

SEQ ID NO: 1402640 - protein, 7 aa, Mycobacterium tuberculosis
RRPGGPG

SEQ ID NO: 1402641 - protein, 14 aa, Mycobacterium tuberculosis
RRPNESASQASNRA

SEQ ID NO: 1402642 - protein, 7 aa, Mycobacterium tuberculosis
RRPPLGQ

SEQ ID NO: 1402643 - protein, 4 aa, Mycobacterium tuberculosis
RRPQ

SEQ ID NO: 1402644 - protein, 13 aa, Mycobacterium tuberculosis
RRPRELSGGQRQR

SEQ ID NO: 1402645 - protein, 8 aa, Mycobacterium tuberculosis
RRPRTGPA

SEQ ID NO: 1402646 - protein, 20 aa, Mycobacterium tuberculosis
RRPTATADAPTPGARAKAVA

SEQ ID NO: 1402647 - protein, 6 aa, Mycobacterium tuberculosis
RRPTTG

SEQ ID NO: 1402648 - protein, 4 aa, Mycobacterium tuberculosis
RRQE

SEQ ID NO: 1402649 - protein, 6 aa, Mycobacterium tuberculosis
RRQPAD

SEQ ID NO: 1402650 - protein, 11 aa, Mycobacterium tuberculosis
RRQREERKTLG

SEQ ID NO: 1402651 - protein, 9 aa, Mycobacterium tuberculosis
RRRADGSIE

SEQ ID NO: 1402652 - protein, 5 aa, Mycobacterium tuberculosis
RRRDT

SEQ ID NO: 1402653 - protein, 10 aa, Mycobacterium tuberculosis
RRREKAEQEL

SEQ ID NO: 1402654 - protein, 4 aa, Mycobacterium tuberculosis
RRRH

SEQ ID NO: 1402655 - protein, 15 aa, Mycobacterium tuberculosis
RRRSPRAHRRHRSTT

SEQ ID NO: 1402656 - protein, 17 aa, Mycobacterium tuberculosis
RRSASAGFTERRENRQK

SEQ ID NO: 1402657 - protein, 10 aa, Mycobacterium tuberculosis
RRSGGKTTDF

SEQ ID NO: 1402658 - protein, 10 aa, Mycobacterium tuberculosis
RRSRTHRRTP

SEQ ID NO: 1402659 - protein, 7 aa, Mycobacterium tuberculosis
RRSVGQG

SEQ ID NO: 1402660 - protein, 5 aa, Mycobacterium tuberculosis
RRSVR

SEQ ID NO: 1402661 - protein, 9 aa, Mycobacterium tuberculosis
RRTDGTTNG

SEQ ID NO: 1402662 - protein, 9 aa, Mycobacterium tuberculosis
RRTEPADDA

SEQ ID NO: 1402663 - protein, 8 aa, Mycobacterium tuberculosis
RRTGGADA

SEQ ID NO: 1402664 - protein, 7 aa, Mycobacterium tuberculosis
RRTPSRL

SEQ ID NO: 1402665 - protein, 7 aa, Mycobacterium tuberculosis
RSAAQGR

SEQ ID NO: 1402666 - protein, 14 aa, Mycobacterium tuberculosis
RSAASDAGRDPMSI

SEQ ID NO: 1402667 - protein, 6 aa, Mycobacterium tuberculosis
RSAGLP

SEQ ID NO: 1402668 - protein, 10 aa, Mycobacterium tuberculosis
RSAGQDPRLD

SEQ ID NO: 1402669 - protein, 6 aa, Mycobacterium tuberculosis
RSAGSL

SEQ ID NO: 1402670 - protein, 8 aa, Mycobacterium tuberculosis
RSAGTDNA

SEQ ID NO: 1402671 - protein, 5 aa, Mycobacterium tuberculosis
RSAPP

SEQ ID NO: 1402672 - protein, 8 aa, Mycobacterium tuberculosis
RSAPSDEV

SEQ ID NO: 1402673 - protein, 12 aa, Mycobacterium tuberculosis
RSATRRGRPTAQ

SEQ ID NO: 1402674 - protein, 12 aa, Mycobacterium tuberculosis
RSDEQPKPTPGW

SEQ ID NO: 1402675 - protein, 9 aa, Mycobacterium tuberculosis
RSDKPTRIE

SEQ ID NO: 1402676 - protein, 13 aa, Mycobacterium tuberculosis
RSDLTSDGLPADA

SEQ ID NO: 1402677 - protein, 4 aa, Mycobacterium tuberculosis
RSDP

SEQ ID NO: 1402678 - protein, 5 aa, Mycobacterium tuberculosis
RSDSD

SEQ ID NO: 1402679 - protein, 12 aa, Mycobacterium tuberculosis
RSDTPKAPTRGA

SEQ ID NO: 1402680 - protein, 7 aa, Mycobacterium tuberculosis
RSEEERE

SEQ ID NO: 1402681 - protein, 6 aa, Mycobacterium tuberculosis
RSEGER

SEQ ID NO: 1402682 - protein, 6 aa, Mycobacterium tuberculosis
RSENAT

SEQ ID NO: 1402683 - protein, 9 aa, Mycobacterium tuberculosis
RSGAANTAA

SEQ ID NO: 1402684 - protein, 9 aa, Mycobacterium tuberculosis
RSGDSQASA

SEQ ID NO: 1402685 - protein, 10 aa, Mycobacterium tuberculosis
RSGDTAPASL

SEQ ID NO: 1402686 - protein, 10 aa, Mycobacterium tuberculosis
RSGEIDPATL

SEQ ID NO: 1402687 - protein, 7 aa, Mycobacterium tuberculosis
RSGEPFP

SEQ ID NO: 1402688 - protein, 9 aa, Mycobacterium tuberculosis
RSGERKSDV

SEQ ID NO: 1402689 - protein, 6 aa, Mycobacterium tuberculosis
RSGFGG

SEQ ID NO: 1402690 - protein, 5 aa, Mycobacterium tuberculosis
RSGGS

SEQ ID NO: 1402691 - protein, 9 aa, Mycobacterium tuberculosis
RSGGSTPTA

SEQ ID NO: 1402692 - protein, 10 aa, Mycobacterium tuberculosis
RSGLPKVPTS

SEQ ID NO: 1402693 - protein, 5 aa, Mycobacterium tuberculosis
RSGPR

SEQ ID NO: 1402694 - protein, 8 aa, Mycobacterium tuberculosis
RSGQTRDG

SEQ ID NO: 1402695 - protein, 7 aa, Mycobacterium tuberculosis
RSGRISG

SEQ ID NO: 1402696 - protein, 7 aa, Mycobacterium tuberculosis
RSGSVDQ

SEQ ID NO: 1402697 - protein, 5 aa, Mycobacterium tuberculosis
RSGTA

SEQ ID NO: 1402698 - protein, 5 aa, Mycobacterium tuberculosis
RSGTD

SEQ ID NO: 1402699 - protein, 12 aa, Mycobacterium tuberculosis
RSKEDADAGGNL

SEQ ID NO: 1402700 - protein, 9 aa, Mycobacterium tuberculosis
RSKTQGRAN

SEQ ID NO: 1402701 - protein, 7 aa, Mycobacterium tuberculosis
RSKYASG

SEQ ID NO: 1402702 - protein, 6 aa, Mycobacterium tuberculosis
RSLPTA

SEQ ID NO: 1402703 - protein, 7 aa, Mycobacterium tuberculosis
RSNHGTC

SEQ ID NO: 1402704 - protein, 7 aa, Mycobacterium tuberculosis
RSNPALA

SEQ ID NO: 1402705 - protein, 7 aa, Mycobacterium tuberculosis
RSPDGAV

SEQ ID NO: 1402706 - protein, 5 aa, Mycobacterium tuberculosis
RSPHS

SEQ ID NO: 1402707 - protein, 7 aa, Mycobacterium tuberculosis
RSPQGEP

SEQ ID NO: 1402708 - protein, 4 aa, Mycobacterium tuberculosis
RSPR

SEQ ID NO: 1402709 - protein, 7 aa, Mycobacterium tuberculosis
RSPSRRR

SEQ ID NO: 1402710 - protein, 16 aa, Mycobacterium tuberculosis
RSPSSAPEQRSTAQRA

SEQ ID NO: 1402711 - protein, 7 aa, Mycobacterium tuberculosis
RSQFAGP

SEQ ID NO: 1402712 - protein, 11 aa, Mycobacterium tuberculosis
RSQQKAAEAWS

SEQ ID NO: 1402713 - protein, 8 aa, Mycobacterium tuberculosis
RSRKSGKN

SEQ ID NO: 1402714 - protein, 12 aa, Mycobacterium tuberculosis
RSRLPGQGVTQA

SEQ ID NO: 1402715 - protein, 4 aa, Mycobacterium tuberculosis
RSSA

SEQ ID NO: 1402716 - protein, 6 aa, Mycobacterium tuberculosis
RSSEVA

SEQ ID NO: 1402717 - protein, 15 aa, Mycobacterium tuberculosis
RSSGKAIGREARSRG

SEQ ID NO: 1402718 - protein, 16 aa, Mycobacterium tuberculosis
RSSGPGGQSVNTTDSA

SEQ ID NO: 1402719 - protein, 9 aa, Mycobacterium tuberculosis
RSSGPKLSG

SEQ ID NO: 1402720 - protein, 7 aa, Mycobacterium tuberculosis
RSSVDDR

SEQ ID NO: 1402721 - protein, 11 aa, Mycobacterium tuberculosis
RSTAAGSSGKY

SEQ ID NO: 1402722 - protein, 8 aa, Mycobacterium tuberculosis
RSTHAAAG

SEQ ID NO: 1402723 - protein, 4 aa, Mycobacterium tuberculosis
RSTL

SEQ ID NO: 1402724 - protein, 5 aa, Mycobacterium tuberculosis
RSTTS

SEQ ID NO: 1402725 - protein, 6 aa, Mycobacterium tuberculosis
RSVAER

SEQ ID NO: 1402726 - protein, 4 aa, Mycobacterium tuberculosis
RSYR

SEQ ID NO: 1402727 - protein, 8 aa, Mycobacterium tuberculosis
RSYTGKPA

SEQ ID NO: 1402728 - protein, 8 aa, Mycobacterium tuberculosis
RTAAADDP

SEQ ID NO: 1402729 - protein, 12 aa, Mycobacterium tuberculosis
RTAASGAAATAA

SEQ ID NO: 1402730 - protein, 7 aa, Mycobacterium tuberculosis
RTADGYA

SEQ ID NO: 1402731 - protein, 8 aa, Mycobacterium tuberculosis
RTADSSQR

SEQ ID NO: 1402732 - protein, 6 aa, Mycobacterium tuberculosis
RTAEQR

SEQ ID NO: 1402733 - protein, 7 aa, Mycobacterium tuberculosis
RTAERQA

SEQ ID NO: 1402734 - protein, 18 aa, Mycobacterium tuberculosis
RTAGGAGVRLDGSTNLGA

SEQ ID NO: 1402735 - protein, 9 aa, Mycobacterium tuberculosis
RTDEKLKET

SEQ ID NO: 1402736 - protein, 11 aa, Mycobacterium tuberculosis
RTEKPTNEQSD

SEQ ID NO: 1402737 - protein, 17 aa, Mycobacterium tuberculosis
RTETGKGASRRARRAGK

SEQ ID NO: 1402738 - protein, 6 aa, Mycobacterium tuberculosis
RTGARP

SEQ ID NO: 1402739 - protein, 7 aa, Mycobacterium tuberculosis
RTGDEIH

SEQ ID NO: 1402740 - protein, 6 aa, Mycobacterium tuberculosis
RTGDQP

SEQ ID NO: 1402741 - protein, 8 aa, Mycobacterium tuberculosis
RTGEAPEQ

SEQ ID NO: 1402742 - protein, 4 aa, Mycobacterium tuberculosis
RTGF

SEQ ID NO: 1402743 - protein, 6 aa, Mycobacterium tuberculosis
RTGGEV

SEQ ID NO: 1402744 - protein, 26 aa, Mycobacterium tuberculosis
RTGQDQYQSARRLTEGETEPTPRPLN

SEQ ID NO: 1402745 - protein, 10 aa, Mycobacterium tuberculosis
RTGQRPAEAA

SEQ ID NO: 1402746 - protein, 9 aa, Mycobacterium tuberculosis
RTGRAGRSG

SEQ ID NO: 1402747 - protein, 7 aa, Mycobacterium tuberculosis
RTGRTAT

SEQ ID NO: 1402748 - protein, 12 aa, Mycobacterium tuberculosis
RTGRTTSPHLQS

SEQ ID NO: 1402749 - protein, 9 aa, Mycobacterium tuberculosis
RTGSEGRIS

SEQ ID NO: 1402750 - protein, 5 aa, Mycobacterium tuberculosis
RTGTD

SEQ ID NO: 1402751 - protein, 12 aa, Mycobacterium tuberculosis
RTHEAPPVPGAP

SEQ ID NO: 1402752 - protein, 7 aa, Mycobacterium tuberculosis
RTHPGTT

SEQ ID NO: 1402753 - protein, 5 aa, Mycobacterium tuberculosis
RTHRS

SEQ ID NO: 1402754 - protein, 8 aa, Mycobacterium tuberculosis
RTIKGEQK

SEQ ID NO: 1402755 - protein, 25 aa, Mycobacterium tuberculosis
RTKAKQPVDATAKRPSGDDVQVSPE

SEQ ID NO: 1402756 - protein, 13 aa, Mycobacterium tuberculosis
RTKEVFTGKTDDE

SEQ ID NO: 1402757 - protein, 5 aa, Mycobacterium tuberculosis
RTKLT

SEQ ID NO: 1402758 - protein, 8 aa, Mycobacterium tuberculosis
RTKQQSDQ

SEQ ID NO: 1402759 - protein, 16 aa, Mycobacterium tuberculosis
RTLPGSGAGIIEKRDF

SEQ ID NO: 1402760 - protein, 10 aa, Mycobacterium tuberculosis
RTNANGSKGF

SEQ ID NO: 1402761 - protein, 5 aa, Mycobacterium tuberculosis
RTNNN

SEQ ID NO: 1402762 - protein, 7 aa, Mycobacterium tuberculosis
RTNSESI

SEQ ID NO: 1402763 - protein, 4 aa, Mycobacterium tuberculosis
RTPA

SEQ ID NO: 1402764 - protein, 4 aa, Mycobacterium tuberculosis
RTPD

SEQ ID NO: 1402765 - protein, 8 aa, Mycobacterium tuberculosis
RTPEGRID

SEQ ID NO: 1402766 - protein, 9 aa, Mycobacterium tuberculosis
RTPERDGYS

SEQ ID NO: 1402767 - protein, 10 aa, Mycobacterium tuberculosis
RTPGDPNALY

SEQ ID NO: 1402768 - protein, 14 aa, Mycobacterium tuberculosis
RTPGGSSGGSAAAV

SEQ ID NO: 1402769 - protein, 6 aa, Mycobacterium tuberculosis
RTPGRG

SEQ ID NO: 1402770 - protein, 6 aa, Mycobacterium tuberculosis
RTPGSD

SEQ ID NO: 1402771 - protein, 7 aa, Mycobacterium tuberculosis
RTPRGRV

SEQ ID NO: 1402772 - protein, 6 aa, Mycobacterium tuberculosis
RTREAL

SEQ ID NO: 1402773 - protein, 6 aa, Mycobacterium tuberculosis
RTRGDQ

SEQ ID NO: 1402774 - protein, 17 aa, Mycobacterium tuberculosis
RTRPGRGPGPRPGGSAM

SEQ ID NO: 1402775 - protein, 4 aa, Mycobacterium tuberculosis
RTSD

SEQ ID NO: 1402776 - protein, 6 aa, Mycobacterium tuberculosis
RTSDPD

SEQ ID NO: 1402777 - protein, 6 aa, Mycobacterium tuberculosis
RTSESE

SEQ ID NO: 1402778 - protein, 5 aa, Mycobacterium tuberculosis
RTSGL

SEQ ID NO: 1402779 - protein, 11 aa, Mycobacterium tuberculosis
RTSGRAVSSAT

SEQ ID NO: 1402780 - protein, 10 aa, Mycobacterium tuberculosis
RTSGRTPNGV

SEQ ID NO: 1402781 - protein, 5 aa, Mycobacterium tuberculosis
RTSIR

SEQ ID NO: 1402782 - protein, 7 aa, Mycobacterium tuberculosis
RTSSELD

SEQ ID NO: 1402783 - protein, 6 aa, Mycobacterium tuberculosis
RTTDKP

SEQ ID NO: 1402784 - protein, 5 aa, Mycobacterium tuberculosis
RTTHP

SEQ ID NO: 1402785 - protein, 8 aa, Mycobacterium tuberculosis
RTVADPGS

SEQ ID NO: 1402786 - protein, 6 aa, Mycobacterium tuberculosis
RTYPKT

SEQ ID NO: 1402787 - protein, 6 aa, Mycobacterium tuberculosis
RVAGGA

SEQ ID NO: 1402788 - protein, 9 aa, Mycobacterium tuberculosis
RVAKETGGH

SEQ ID NO: 1402789 - protein, 12 aa, Mycobacterium tuberculosis
RVAPGGYEPMGG

SEQ ID NO: 1402790 - protein, 6 aa, Mycobacterium tuberculosis
RVAPSG

SEQ ID NO: 1402791 - protein, 9 aa, Mycobacterium tuberculosis
RVAQGDSAP

SEQ ID NO: 1402792 - protein, 7 aa, Mycobacterium tuberculosis
RVATGRD

SEQ ID NO: 1402793 - protein, 6 aa, Mycobacterium tuberculosis
RVDGRS

SEQ ID NO: 1402794 - protein, 14 aa, Mycobacterium tuberculosis
RVGEDDTGLNTGGM

SEQ ID NO: 1402795 - protein, 8 aa, Mycobacterium tuberculosis
RVGGMSPN

SEQ ID NO: 1402796 - protein, 12 aa, Mycobacterium tuberculosis
RVGPGRGSAAGS

SEQ ID NO: 1402797 - protein, 9 aa, Mycobacterium tuberculosis
RVGPSTGTN

SEQ ID NO: 1402798 - protein, 5 aa, Mycobacterium tuberculosis
RVNPL

SEQ ID NO: 1402799 - protein, 7 aa, Mycobacterium tuberculosis
RVPAADD

SEQ ID NO: 1402800 - protein, 6 aa, Mycobacterium tuberculosis
RVPDPG

SEQ ID NO: 1402801 - protein, 8 aa, Mycobacterium tuberculosis
RVPGPDGK

SEQ ID NO: 1402802 - protein, 6 aa, Mycobacterium tuberculosis
RVPPAD

SEQ ID NO: 1402803 - protein, 8 aa, Mycobacterium tuberculosis
RVPPGPGQ

SEQ ID NO: 1402804 - protein, 8 aa, Mycobacterium tuberculosis
RVPRPAPS

SEQ ID NO: 1402805 - protein, 12 aa, Mycobacterium tuberculosis
RVPSEREREQLR

SEQ ID NO: 1402806 - protein, 6 aa, Mycobacterium tuberculosis
RVRRTE

SEQ ID NO: 1402807 - protein, 8 aa, Mycobacterium tuberculosis
RVRSSEPV

SEQ ID NO: 1402808 - protein, 4 aa, Mycobacterium tuberculosis
RVSN

SEQ ID NO: 1402809 - protein, 7 aa, Mycobacterium tuberculosis
RVSPTPV

SEQ ID NO: 1402810 - protein, 5 aa, Mycobacterium tuberculosis
RVTPD

SEQ ID NO: 1402811 - protein, 4 aa, Mycobacterium tuberculosis
RVTR

SEQ ID NO: 1402812 - protein, 5 aa, Mycobacterium tuberculosis
RVTTR

SEQ ID NO: 1402813 - protein, 7 aa, Mycobacterium tuberculosis
RWEGSPD

SEQ ID NO: 1402814 - protein, 16 aa, Mycobacterium tuberculosis
RWTPTWDDDERAAGYA

SEQ ID NO: 1402815 - protein, 17 aa, Mycobacterium tuberculosis
RYAAQTSDIPYGPGGRE

SEQ ID NO: 1402816 - protein, 6 aa, Mycobacterium tuberculosis
RYEDVR

SEQ ID NO: 1402817 - protein, 7 aa, Mycobacterium tuberculosis
RYEGGST

SEQ ID NO: 1402818 - protein, 9 aa, Mycobacterium tuberculosis
RYEGPTDPN

SEQ ID NO: 1402819 - protein, 9 aa, Mycobacterium tuberculosis
RYGDESRSI

SEQ ID NO: 1402820 - protein, 4 aa, Mycobacterium tuberculosis
RYGQ

SEQ ID NO: 1402821 - protein, 4 aa, Mycobacterium tuberculosis
RYHG

SEQ ID NO: 1402822 - protein, 5 aa, Mycobacterium tuberculosis
RYNRE

SEQ ID NO: 1402823 - protein, 5 aa, Mycobacterium tuberculosis
RYPDG

SEQ ID NO: 1402824 - protein, 6 aa, Mycobacterium tuberculosis
RYPEQR

SEQ ID NO: 1402825 - protein, 10 aa, Mycobacterium tuberculosis
RYPGTDRPAL

SEQ ID NO: 1402826 - protein, 6 aa, Mycobacterium tuberculosis
RYTGRG

SEQ ID NO: 1402827 - protein, 8 aa, Mycobacterium tuberculosis
RYTQPTGA

SEQ ID NO: 1402828 - protein, 12 aa, Mycobacterium tuberculosis
SAAAAGQARAAA

SEQ ID NO: 1402829 - protein, 12 aa, Mycobacterium tuberculosis
SAAAQAKKAVER

SEQ ID NO: 1402830 - protein, 22 aa, Mycobacterium tuberculosis
SAAASLRYSDPDSVAVENISAA

SEQ ID NO: 1402831 - protein, 6 aa, Mycobacterium tuberculosis
SAADAA

SEQ ID NO: 1402832 - protein, 10 aa, Mycobacterium tuberculosis
SAADAAEYNE

SEQ ID NO: 1402833 - protein, 8 aa, Mycobacterium tuberculosis
SAADEATL

SEQ ID NO: 1402834 - protein, 8 aa, Mycobacterium tuberculosis
SAADRQSD

SEQ ID NO: 1402835 - protein, 9 aa, Mycobacterium tuberculosis
SAAETGSHD

SEQ ID NO: 1402836 - protein, 8 aa, Mycobacterium tuberculosis
SAAGGTER

SEQ ID NO: 1402837 - protein, 6 aa, Mycobacterium tuberculosis
SAAGKI

SEQ ID NO: 1402838 - protein, 6 aa, Mycobacterium tuberculosis
SAAGSA

SEQ ID NO: 1402839 - protein, 8 aa, Mycobacterium tuberculosis
SAAPAYGS

SEQ ID NO: 1402840 - protein, 11 aa, Mycobacterium tuberculosis
SAAPEAAPGSL

SEQ ID NO: 1402841 - protein, 7 aa, Mycobacterium tuberculosis
SAARTIA

SEQ ID NO: 1402842 - protein, 5 aa, Mycobacterium tuberculosis
SAASA

SEQ ID NO: 1402843 - protein, 8 aa, Mycobacterium tuberculosis
SAASEVDQ

SEQ ID NO: 1402844 - protein, 9 aa, Mycobacterium tuberculosis
SAATDDEGR

SEQ ID NO: 1402845 - protein, 12 aa, Mycobacterium tuberculosis
SAATELDDDPDI

SEQ ID NO: 1402846 - protein, 12 aa, Mycobacterium tuberculosis
SAATGPIPHAPS

SEQ ID NO: 1402847 - protein, 5 aa, Mycobacterium tuberculosis
SACGK

SEQ ID NO: 1402848 - protein, 10 aa, Mycobacterium tuberculosis
SADGLTPREQ

SEQ ID NO: 1402849 - protein, 8 aa, Mycobacterium tuberculosis
SADGSPPY

SEQ ID NO: 1402850 - protein, 9 aa, Mycobacterium tuberculosis
SADRDSARV

SEQ ID NO: 1402851 - protein, 4 aa, Mycobacterium tuberculosis
SAEN

SEQ ID NO: 1402852 - protein, 6 aa, Mycobacterium tuberculosis
SAEQQD

SEQ ID NO: 1402853 - protein, 7 aa, Mycobacterium tuberculosis
SAETDRA

SEQ ID NO: 1402854 - protein, 7 aa, Mycobacterium tuberculosis
SAETISA

SEQ ID NO: 1402855 - protein, 16 aa, Mycobacterium tuberculosis
SAFGDAARAAQTSFDS

SEQ ID NO: 1402856 - protein, 9 aa, Mycobacterium tuberculosis
SAGASADRA

SEQ ID NO: 1402857 - protein, 8 aa, Mycobacterium tuberculosis
SAGDLQSV

SEQ ID NO: 1402858 - protein, 24 aa, Mycobacterium tuberculosis
SAGEAEEAEPADEGAARAASDEAT

SEQ ID NO: 1402859 - protein, 13 aa, Mycobacterium tuberculosis
SAGETGDFRPNPS

SEQ ID NO: 1402860 - protein, 15 aa, Mycobacterium tuberculosis
SAGLKATPGNGHYAA

SEQ ID NO: 1402861 - protein, 10 aa, Mycobacterium tuberculosis
SAGNDDTGAA

SEQ ID NO: 1402862 - protein, 9 aa, Mycobacterium tuberculosis
SAGTPDGSW

SEQ ID NO: 1402863 - protein, 7 aa, Mycobacterium tuberculosis
SAHEGRR

SEQ ID NO: 1402864 - protein, 12 aa, Mycobacterium tuberculosis
SAHGTNAASAAL

SEQ ID NO: 1402865 - protein, 27 aa, Mycobacterium tuberculosis
SALPNGPKVSHGGALSPRGDWRAPSDM

SEQ ID NO: 1402866 - protein, 4 aa, Mycobacterium tuberculosis
SALS

SEQ ID NO: 1402867 - protein, 5 aa, Mycobacterium tuberculosis
SAMSK

SEQ ID NO: 1402868 - protein, 21 aa, Mycobacterium tuberculosis
SANDPALQPGFESADTAVQAA

SEQ ID NO: 1402869 - protein, 9 aa, Mycobacterium tuberculosis
SANGLTPQQ

SEQ ID NO: 1402870 - protein, 6 aa, Mycobacterium tuberculosis
SANGPL

SEQ ID NO: 1402871 - protein, 13 aa, Mycobacterium tuberculosis
SANPTVGSSHGPH

SEQ ID NO: 1402872 - protein, 6 aa, Mycobacterium tuberculosis
SANRDN

SEQ ID NO: 1402873 - protein, 7 aa, Mycobacterium tuberculosis
SAPAAAA

SEQ ID NO: 1402874 - protein, 16 aa, Mycobacterium tuberculosis
SAPGFGNSTTTPSSGF

SEQ ID NO: 1402875 - protein, 6 aa, Mycobacterium tuberculosis
SAPGHG

SEQ ID NO: 1402876 - protein, 7 aa, Mycobacterium tuberculosis
SAPHRAE

SEQ ID NO: 1402877 - protein, 4 aa, Mycobacterium tuberculosis
SAPM

SEQ ID NO: 1402878 - protein, 9 aa, Mycobacterium tuberculosis
SAQTQVEQQ

SEQ ID NO: 1402879 - protein, 9 aa, Mycobacterium tuberculosis
SARANRGRR

SEQ ID NO: 1402880 - protein, 5 aa, Mycobacterium tuberculosis
SARGI

SEQ ID NO: 1402881 - protein, 7 aa, Mycobacterium tuberculosis
SARPSDS

SEQ ID NO: 1402882 - protein, 6 aa, Mycobacterium tuberculosis
SARRGD

SEQ ID NO: 1402883 - protein, 8 aa, Mycobacterium tuberculosis
SASANGAY

SEQ ID NO: 1402884 - protein, 8 aa, Mycobacterium tuberculosis
SASDAESA

SEQ ID NO: 1402885 - protein, 24 aa, Mycobacterium tuberculosis
SASGEGGYARELTDDERAQQQKAL

SEQ ID NO: 1402886 - protein, 8 aa, Mycobacterium tuberculosis
SASGTLGG

SEQ ID NO: 1402887 - protein, 5 aa, Mycobacterium tuberculosis
SASLR

SEQ ID NO: 1402888 - protein, 7 aa, Mycobacterium tuberculosis
SASNENP

SEQ ID NO: 1402889 - protein, 8 aa, Mycobacterium tuberculosis
SASNPWGD

SEQ ID NO: 1402890 - protein, 11 aa, Mycobacterium tuberculosis
SASPEAIDPDR

SEQ ID NO: 1402891 - protein, 9 aa, Mycobacterium tuberculosis
SASTTRGKA

SEQ ID NO: 1402892 - protein, 11 aa, Mycobacterium tuberculosis
SATPDAAQQKD

SEQ ID NO: 1402893 - protein, 7 aa, Mycobacterium tuberculosis
SATPIYD

SEQ ID NO: 1402894 - protein, 8 aa, Mycobacterium tuberculosis
SATSMRTG

SEQ ID NO: 1402895 - protein, 16 aa, Mycobacterium tuberculosis
SAVPAAEKADRGNPGH

SEQ ID NO: 1402896 - protein, 6 aa, Mycobacterium tuberculosis
SAVSQR

SEQ ID NO: 1402897 - protein, 9 aa, Mycobacterium tuberculosis
SAVSRVDDG

SEQ ID NO: 1402898 - protein, 8 aa, Mycobacterium tuberculosis
SAYQQATG

SEQ ID NO: 1402899 - protein, 4 aa, Mycobacterium tuberculosis
SAYV

SEQ ID NO: 1402900 - protein, 10 aa, Mycobacterium tuberculosis
SCASTQSVDP

SEQ ID NO: 1402901 - protein, 6 aa, Mycobacterium tuberculosis
SCGGSG

SEQ ID NO: 1402902 - protein, 7 aa, Mycobacterium tuberculosis
SCPAEKR

SEQ ID NO: 1402903 - protein, 6 aa, Mycobacterium tuberculosis
SDAEAA

SEQ ID NO: 1402904 - protein, 8 aa, Mycobacterium tuberculosis
SDAERDSL

SEQ ID NO: 1402905 - protein, 4 aa, Mycobacterium tuberculosis
SDAF

SEQ ID NO: 1402906 - protein, 12 aa, Mycobacterium tuberculosis
SDAKAGKDAAEL

SEQ ID NO: 1402907 - protein, 8 aa, Mycobacterium tuberculosis
SDAPPVPA

SEQ ID NO: 1402908 - protein, 12 aa, Mycobacterium tuberculosis
SDEAGAKSVRNL

SEQ ID NO: 1402909 - protein, 11 aa, Mycobacterium tuberculosis
SDESTAVGLPT

SEQ ID NO: 1402910 - protein, 18 aa, Mycobacterium tuberculosis
SDGAGAQEETDSAEAPQS

SEQ ID NO: 1402911 - protein, 8 aa, Mycobacterium tuberculosis
SDGKPAYI

SEQ ID NO: 1402912 - protein, 8 aa, Mycobacterium tuberculosis
SDGKPTRI

SEQ ID NO: 1402913 - protein, 8 aa, Mycobacterium tuberculosis
SDGPPPYR

SEQ ID NO: 1402914 - protein, 4 aa, Mycobacterium tuberculosis
SDGV

SEQ ID NO: 1402915 - protein, 15 aa, Mycobacterium tuberculosis
SDIEASTHQPVTGLH

SEQ ID NO: 1402916 - protein, 11 aa, Mycobacterium tuberculosis
SDKTAPKDAGL

SEQ ID NO: 1402917 - protein, 11 aa, Mycobacterium tuberculosis
SDLHGAKDIAG

SEQ ID NO: 1402918 - protein, 8 aa, Mycobacterium tuberculosis
SDMPPAVP

SEQ ID NO: 1402919 - protein, 8 aa, Mycobacterium tuberculosis
SDNPGPWK

SEQ ID NO: 1402920 - protein, 7 aa, Mycobacterium tuberculosis
SDPAAQR

SEQ ID NO: 1402921 - protein, 9 aa, Mycobacterium tuberculosis
SDPETDYTG

SEQ ID NO: 1402922 - protein, 5 aa, Mycobacterium tuberculosis
SDPGA

SEQ ID NO: 1402923 - protein, 5 aa, Mycobacterium tuberculosis
SDPGL

SEQ ID NO: 1402924 - protein, 14 aa, Mycobacterium tuberculosis
SDPGSAPEPQTDPS

SEQ ID NO: 1402925 - protein, 6 aa, Mycobacterium tuberculosis
SDPNHP

SEQ ID NO: 1402926 - protein, 9 aa, Mycobacterium tuberculosis
SDPPTLQEV

SEQ ID NO: 1402927 - protein, 5 aa, Mycobacterium tuberculosis
SDPQI

SEQ ID NO: 1402928 - protein, 9 aa, Mycobacterium tuberculosis
SDPSGGHAE

SEQ ID NO: 1402929 - protein, 5 aa, Mycobacterium tuberculosis
SDPSL

SEQ ID NO: 1402930 - protein, 9 aa, Mycobacterium tuberculosis
SDQADPRPG

SEQ ID NO: 1402931 - protein, 5 aa, Mycobacterium tuberculosis
SDQTH

SEQ ID NO: 1402932 - protein, 17 aa, Mycobacterium tuberculosis
SDQVRQAKRAQQAEQIR

SEQ ID NO: 1402933 - protein, 8 aa, Mycobacterium tuberculosis
SDRPPKQL

SEQ ID NO: 1402934 - protein, 6 aa, Mycobacterium tuberculosis
SDRRPV

SEQ ID NO: 1402935 - protein, 17 aa, Mycobacterium tuberculosis
SDSAESAQREIALWFPG

SEQ ID NO: 1402936 - protein, 8 aa, Mycobacterium tuberculosis
SDSQAMGR

SEQ ID NO: 1402937 - protein, 7 aa, Mycobacterium tuberculosis
SDSRTQA

SEQ ID NO: 1402938 - protein, 7 aa, Mycobacterium tuberculosis
SDTGELG

SEQ ID NO: 1402939 - protein, 37 aa, Mycobacterium tuberculosis; identical to SEQ ID NO: 194945

SEQ ID NO: 1402940 - protein, 5 aa, Mycobacterium tuberculosis
SDTSP

SEQ ID NO: 1402941 - protein, 12 aa, Mycobacterium tuberculosis
SDTTLLDAALAG

SEQ ID NO: 1402942 - protein, 10 aa, Mycobacterium tuberculosis
SDVDPADPRL

SEQ ID NO: 1402943 - protein, 4 aa, Mycobacterium tuberculosis
SDYL

SEQ ID NO: 1402944 - protein, 5 aa, Mycobacterium tuberculosis
SDYSR

SEQ ID NO: 1402945 - protein, 7 aa, Mycobacterium tuberculosis
SEAARQG

SEQ ID NO: 1402946 - protein, 15 aa, Mycobacterium tuberculosis
SEAGPGTRLRRIAGR

SEQ ID NO: 1402947 - protein, 4 aa, Mycobacterium tuberculosis
SEAQ

SEQ ID NO: 1402948 - protein, 5 aa, Mycobacterium tuberculosis
SEASV

SEQ ID NO: 1402949 - protein, 20 aa, Mycobacterium tuberculosis
SEDERRALKRRNARTKARTG

SEQ ID NO: 1402950 - protein, 5 aa, Mycobacterium tuberculosis
SEDEV

SEQ ID NO: 1402951 - protein, 8 aa, Mycobacterium tuberculosis
SEDGASVD

SEQ ID NO: 1402952 - protein, 6 aa, Mycobacterium tuberculosis
SEGKDG

SEQ ID NO: 1402953 - protein, 15 aa, Mycobacterium tuberculosis
SEGKPTEKHIQIRST

SEQ ID NO: 1402954 - protein, 4 aa, Mycobacterium tuberculosis
SEGN

SEQ ID NO: 1402955 - protein, 9 aa, Mycobacterium tuberculosis
SEGSRTGRV

SEQ ID NO: 1402956 - protein, 7 aa, Mycobacterium tuberculosis
SEHAAAR

SEQ ID NO: 1402957 - protein, 11 aa, Mycobacterium tuberculosis
SEHAGSGEFSD

SEQ ID NO: 1402958 - protein, 8 aa, Mycobacterium tuberculosis
SEHDFQPD

SEQ ID NO: 1402959 - protein, 6 aa, Mycobacterium tuberculosis
SEHEYG

SEQ ID NO: 1402960 - protein, 4 aa, Mycobacterium tuberculosis
SEHS

SEQ ID NO: 1402961 - protein, 16 aa, Mycobacterium tuberculosis
SEKEEADRKNKVRGGD

SEQ ID NO: 1402962 - protein, 6 aa, Mycobacterium tuberculosis
SENPGL

SEQ ID NO: 1402963 - protein, 6 aa, Mycobacterium tuberculosis
SEPAGV

SEQ ID NO: 1402964 - protein, 4 aa, Mycobacterium tuberculosis
SEPD

SEQ ID NO: 1402965 - protein, 8 aa, Mycobacterium tuberculosis
SEPDERGM

SEQ ID NO: 1402966 - protein, 9 aa, Mycobacterium tuberculosis
SEPDGGRYD

SEQ ID NO: 1402967 - protein, 6 aa, Mycobacterium tuberculosis
SEPERV

SEQ ID NO: 1402968 - protein, 20 aa, Mycobacterium tuberculosis
SEPESGSDLASLRSTASKVD

SEQ ID NO: 1402969 - protein, 9 aa, Mycobacterium tuberculosis
SEPGAGTDL

SEQ ID NO: 1402970 - protein, 5 aa, Mycobacterium tuberculosis
SEPHA

SEQ ID NO: 1402971 - protein, 8 aa, Mycobacterium tuberculosis
SESDTPEL

SEQ ID NO: 1402972 - protein, 9 aa, Mycobacterium tuberculosis
SESEADQAR

SEQ ID NO: 1402973 - protein, 19 aa, Mycobacterium tuberculosis
SETFGSGPRHNDTSDGEAS

SEQ ID NO: 1402974 - protein, 10 aa, Mycobacterium tuberculosis
SEVAAAGGDD

SEQ ID NO: 1402975 - protein, 12 aa, Mycobacterium tuberculosis
SEVKAGRGTPHG

SEQ ID NO: 1402976 - protein, 5 aa, Mycobacterium tuberculosis
SEYGG

SEQ ID NO: 1402977 - protein, 7 aa, Mycobacterium tuberculosis
SEYRQAA

SEQ ID NO: 1402978 - protein, 5 aa, Mycobacterium tuberculosis
SFAPE

SEQ ID NO: 1402979 - protein, 8 aa, Mycobacterium tuberculosis
SFGGGPVG

SEQ ID NO: 1402980 - protein, 15 aa, Mycobacterium tuberculosis
SFGTATPTGSDEEAD

SEQ ID NO: 1402981 - protein, 12 aa, Mycobacterium tuberculosis
SFPEVPAAQRAE

SEQ ID NO: 1402982 - protein, 13 aa, Mycobacterium tuberculosis
SFSRGAREEAERI

SEQ ID NO: 1402983 - protein, 6 aa, Mycobacterium tuberculosis
SFYTGR

SEQ ID NO: 1402984 - protein, 4 aa, Mycobacterium tuberculosis
SGAA

SEQ ID NO: 1402985 - protein, 7 aa, Mycobacterium tuberculosis
SGAADPR

SEQ ID NO: 1402986 - protein, 11 aa, Mycobacterium tuberculosis
SGAADRDQERY

SEQ ID NO: 1402987 - protein, 9 aa, Mycobacterium tuberculosis
SGAAGQYDP

SEQ ID NO: 1402988 - protein, 6 aa, Mycobacterium tuberculosis
SGAATV

SEQ ID NO: 1402989 - protein, 5 aa, Mycobacterium tuberculosis
SGADD

SEQ ID NO: 1402990 - protein, 19 aa, Mycobacterium tuberculosis
SGAEAGTASAKRRVKPGEP

SEQ ID NO: 1402991 - protein, 8 aa, Mycobacterium tuberculosis
SGAERVHP

SEQ ID NO: 1402992 - protein, 11 aa, Mycobacterium tuberculosis
SGAGARARPCG

SEQ ID NO: 1402993 - protein, 8 aa, Mycobacterium tuberculosis
SGAGGVDA

SEQ ID NO: 1402994 - protein, 7 aa, Mycobacterium tuberculosis
SGAKAGS

SEQ ID NO: 1402995 - protein, 5 aa, Mycobacterium tuberculosis
SGALT

SEQ ID NO: 1402996 - protein, 9 aa, Mycobacterium tuberculosis
SGATEFGAE

SEQ ID NO: 1402997 - protein, 7 aa, Mycobacterium tuberculosis
SGATIDG

SEQ ID NO: 1402998 - protein, 8 aa, Mycobacterium tuberculosis
SGATPIGA

SEQ ID NO: 1402999 - protein, 10 aa, Mycobacterium tuberculosis
SGCDTEAAQP

SEQ ID NO: 1403000 - protein, 8 aa, Mycobacterium tuberculosis
SGCGKTTS

SEQ ID NO: 1403001 - protein, 6 aa, Mycobacterium tuberculosis
SGDARE

SEQ ID NO: 1403002 - protein, 9 aa, Mycobacterium tuberculosis
SGDDPGTVD

SEQ ID NO: 1403003 - protein, 6 aa, Mycobacterium tuberculosis
SGDDTV

SEQ ID NO: 1403004 - protein, 13 aa, Mycobacterium tuberculosis
SGDPTGAKKAAQD

SEQ ID NO: 1403005 - protein, 8 aa, Mycobacterium tuberculosis
SGEAKWGQ

SEQ ID NO: 1403006 - protein, 7 aa, Mycobacterium tuberculosis
SGEQRSS

SEQ ID NO: 1403007 - protein, 12 aa, Mycobacterium tuberculosis
SGEWTGATGKRI

SEQ ID NO: 1403008 - protein, 4 aa, Mycobacterium tuberculosis
SGFG

SEQ ID NO: 1403009 - protein, 9 aa, Mycobacterium tuberculosis
SGFNNTSTV

SEQ ID NO: 1403010 - protein, 6 aa, Mycobacterium tuberculosis
SGGAGA

SEQ ID NO: 1403011 - protein, 14 aa, Mycobacterium tuberculosis
SGGAGDRDASEADV

SEQ ID NO: 1403012 - protein, 4 aa, Mycobacterium tuberculosis
SGGD

SEQ ID NO: 1403013 - protein, 7 aa, Mycobacterium tuberculosis
SGGGNRL

SEQ ID NO: 1403014 - protein, 5 aa, Mycobacterium tuberculosis
SGGHL

SEQ ID NO: 1403015 - protein, 15 aa, Mycobacterium tuberculosis
SGGKAVAEVGTGAGV

SEQ ID NO: 1403016 - protein, 6 aa, Mycobacterium tuberculosis
SGGLSL

SEQ ID NO: 1403017 - protein, 5 aa, Mycobacterium tuberculosis
SGGMT

SEQ ID NO: 1403018 - protein, 11 aa, Mycobacterium tuberculosis
SGGNPPGDGSS

SEQ ID NO: 1403019 - protein, 15 aa, Mycobacterium tuberculosis
SGGTGISPTDTTPEH

SEQ ID NO: 1403020 - protein, 8 aa, Mycobacterium tuberculosis
SGHRAGNG

SEQ ID NO: 1403021 - protein, 11 aa, Mycobacterium tuberculosis
SGHSVQSDQPR

SEQ ID NO: 1403022 - protein, 4 aa, Mycobacterium tuberculosis
SGIP

SEQ ID NO: 1403023 - protein, 18 aa, Mycobacterium tuberculosis
SGKANRLPDELSGGEQQR

SEQ ID NO: 1403024 - protein, 9 aa, Mycobacterium tuberculosis
SGKKQRGEP

SEQ ID NO: 1403025 - protein, 7 aa, Mycobacterium tuberculosis
SGKTGFT

SEQ ID NO: 1403026 - protein, 4 aa, Mycobacterium tuberculosis
SGLA

SEQ ID NO: 1403027 - protein, 14 aa, Mycobacterium tuberculosis
SGLRGRGGAGFATG

SEQ ID NO: 1403028 - protein, 4 aa, Mycobacterium tuberculosis
SGLT

SEQ ID NO: 1403029 - protein, 15 aa, Mycobacterium tuberculosis
SGLTNSGFGNTGTDV

SEQ ID NO: 1403030 - protein, 9 aa, Mycobacterium tuberculosis
SGLTPQEAQ

SEQ ID NO: 1403031 - protein, 8 aa, Mycobacterium tuberculosis
SGMSNSAA

SEQ ID NO: 1403032 - protein, 5 aa, Mycobacterium tuberculosis
SGNAA

SEQ ID NO: 1403033 - protein, 9 aa, Mycobacterium tuberculosis
SGNLRSAQR

SEQ ID NO: 1403034 - protein, 6 aa, Mycobacterium tuberculosis
SGNVSA

SEQ ID NO: 1403035 - protein, 6 aa, Mycobacterium tuberculosis
SGPADL

SEQ ID NO: 1403036 - protein, 7 aa, Mycobacterium tuberculosis
SGPAGYT

SEQ ID NO: 1403037 - protein, 8 aa, Mycobacterium tuberculosis
SGPERAQS

SEQ ID NO: 1403038 - protein, 13 aa, Mycobacterium tuberculosis
SGPFGQGSPTPVP

SEQ ID NO: 1403039 - protein, 6 aa, Mycobacterium tuberculosis
SGPGYA

SEQ ID NO: 1403040 - protein, 5 aa, Mycobacterium tuberculosis
SGPIT

SEQ ID NO: 1403041 - protein, 4 aa, Mycobacterium tuberculosis
SGPQ

SEQ ID NO: 1403042 - protein, 25 aa, Mycobacterium tuberculosis
SGPSGRANRNEPSSADQRGMRTSST

SEQ ID NO: 1403043 - protein, 11 aa, Mycobacterium tuberculosis
SGQDSRRGTFS

SEQ ID NO: 1403044 - protein, 7 aa, Mycobacterium tuberculosis
SGQEVPV

SEQ ID NO: 1403045 - protein, 4 aa, Mycobacterium tuberculosis
SGRA

SEQ ID NO: 1403046 - protein, 6 aa, Mycobacterium tuberculosis
SGREDA

SEQ ID NO: 1403047 - protein, 20 aa, Mycobacterium tuberculosis
SGRGDKDVETAAKWFGLLGN

SEQ ID NO: 1403048 - protein, 7 aa, Mycobacterium tuberculosis
SGRGRQL

SEQ ID NO: 1403049 - protein, 5 aa, Mycobacterium tuberculosis
SGRGT

SEQ ID NO: 1403050 - protein, 7 aa, Mycobacterium tuberculosis
SGRGYPL

SEQ ID NO: 1403051 - protein, 5 aa, Mycobacterium tuberculosis
SGRLD

SEQ ID NO: 1403052 - protein, 7 aa, Mycobacterium tuberculosis
SGRPAQH

SEQ ID NO: 1403053 - protein, 6 aa, Mycobacterium tuberculosis
SGRQIG

SEQ ID NO: 1403054 - protein, 4 aa, Mycobacterium tuberculosis
SGRR

SEQ ID NO: 1403055 - protein, 8 aa, Mycobacterium tuberculosis
SGRRDPGR

SEQ ID NO: 1403056 - protein, 7 aa, Mycobacterium tuberculosis
SGRSAAE

SEQ ID NO: 1403057 - protein, 7 aa, Mycobacterium tuberculosis
SGRSGTA

SEQ ID NO: 1403058 - protein, 8 aa, Mycobacterium tuberculosis
SGRTSNEA

SEQ ID NO: 1403059 - protein, 5 aa, Mycobacterium tuberculosis
SGRVD

SEQ ID NO: 1403060 - protein, 11 aa, Mycobacterium tuberculosis
SGRYGDDAANT

SEQ ID NO: 1403061 - protein, 9 aa, Mycobacterium tuberculosis
SGSADTETT

SEQ ID NO: 1403062 - protein, 6 aa, Mycobacterium tuberculosis
SGSEHT

SEQ ID NO: 1403063 - protein, 7 aa, Mycobacterium tuberculosis
SGSGKSS

SEQ ID NO: 1403064 - protein, 6 aa, Mycobacterium tuberculosis
SGSGPT

SEQ ID NO: 1403065 - protein, 6 aa, Mycobacterium tuberculosis
SGSGSS

SEQ ID NO: 1403066 - protein, 7 aa, Mycobacterium tuberculosis
SGSGSSY

SEQ ID NO: 1403067 - protein, 8 aa, Mycobacterium tuberculosis
SGSQPLYN

SEQ ID NO: 1403068 - protein, 17 aa, Mycobacterium tuberculosis
SGSRDRSVQWLRLRSTG

SEQ ID NO: 1403069 - protein, 4 aa, Mycobacterium tuberculosis
SGST

SEQ ID NO: 1403070 - protein, 16 aa, Mycobacterium tuberculosis
SGSYPPATPCTITAED

SEQ ID NO: 1403071 - protein, 6 aa, Mycobacterium tuberculosis
SGTEPA

SEQ ID NO: 1403072 - protein, 10 aa, Mycobacterium tuberculosis
SGTGDTSGYG

SEQ ID NO: 1403073 - protein, 16 aa, Mycobacterium tuberculosis
SGTHDPSKHTGMPDPR

SEQ ID NO: 1403074 - protein, 9 aa, Mycobacterium tuberculosis
SGTLAQPVR

SEQ ID NO: 1403075 - protein, 6 aa, Mycobacterium tuberculosis
SGTNEQ

SEQ ID NO: 1403076 - protein, 8 aa, Mycobacterium tuberculosis
SGTPGADF

SEQ ID NO: 1403077 - protein, 10 aa, Mycobacterium tuberculosis
SGTTGKPKGI

SEQ ID NO: 1403078 - protein, 9 aa, Mycobacterium tuberculosis
SGTTGNPKG

SEQ ID NO: 1403079 - protein, 11 aa, Mycobacterium tuberculosis
SGTTGNPKGVE

SEQ ID NO: 1403080 - protein, 11 aa, Mycobacterium tuberculosis
SGTTGPPKGVQ

SEQ ID NO: 1403081 - protein, 5 aa, Mycobacterium tuberculosis
SGVEV

SEQ ID NO: 1403082 - protein, 9 aa, Mycobacterium tuberculosis
SGVGNTDSQ

SEQ ID NO: 1403083 - protein, 5 aa, Mycobacterium tuberculosis
SGVNR

SEQ ID NO: 1403084 - protein, 9 aa, Mycobacterium tuberculosis
SGVQPTGDR

SEQ ID NO: 1403085 - protein, 6 aa, Mycobacterium tuberculosis
SGVRGT

SEQ ID NO: 1403086 - protein, 8 aa, Mycobacterium tuberculosis
SGVTEPFS

SEQ ID NO: 1403087 - protein, 21 aa, Mycobacterium tuberculosis
SGWPRPGRDGTRIRSMLPMAS

SEQ ID NO: 1403088 - protein, 7 aa, Mycobacterium tuberculosis
SGYGGNA

SEQ ID NO: 1403089 - protein, 5 aa, Mycobacterium tuberculosis
SGYKY

SEQ ID NO: 1403090 - protein, 6 aa, Mycobacterium tuberculosis
SGYQNY

SEQ ID NO: 1403091 - protein, 5 aa, Mycobacterium tuberculosis
SGYRY

SEQ ID NO: 1403092 - protein, 8 aa, Mycobacterium tuberculosis
SGYSDSEL

SEQ ID NO: 1403093 - protein, 5 aa, Mycobacterium tuberculosis
SHDRL

SEQ ID NO: 1403094 - protein, 6 aa, Mycobacterium tuberculosis
SHDTDT

SEQ ID NO: 1403095 - protein, 11 aa, Mycobacterium tuberculosis
SHDVDGAAAHG

SEQ ID NO: 1403096 - protein, 7 aa, Mycobacterium tuberculosis
SHEGGIA

SEQ ID NO: 1403097 - protein, 9 aa, Mycobacterium tuberculosis
SHGGFEGNA

SEQ ID NO: 1403098 - protein, 12 aa, Mycobacterium tuberculosis
SHPDTELSAARD

SEQ ID NO: 1403099 - protein, 18 aa, Mycobacterium tuberculosis
SHPGGGQPSSATRPTVGD

SEQ ID NO: 1403100 - protein, 19 aa, Mycobacterium tuberculosis
SHPKAKPETPTAPPKPSGI

SEQ ID NO: 1403101 - protein, 7 aa, Mycobacterium tuberculosis
SHQRQRA

SEQ ID NO: 1403102 - protein, 13 aa, Mycobacterium tuberculosis
SHRNTGKACNDPV

SEQ ID NO: 1403103 - protein, 14 aa, Mycobacterium tuberculosis
SHSDTRIATWSWGR

SEQ ID NO: 1403104 - protein, 8 aa, Mycobacterium tuberculosis
SIAPESAC

SEQ ID NO: 1403105 - protein, 8 aa, Mycobacterium tuberculosis
SIASGSGG

SEQ ID NO: 1403106 - protein, 9 aa, Mycobacterium tuberculosis
SIDSDGQRA

SEQ ID NO: 1403107 - protein, 5 aa, Mycobacterium tuberculosis
SIEDD

SEQ ID NO: 1403108 - protein, 23 aa, Mycobacterium tuberculosis
SIEGIRSASSNPALTLPEDPREI

SEQ ID NO: 1403109 - protein, 8 aa, Mycobacterium tuberculosis
SIGGSDST

SEQ ID NO: 1403110 - protein, 12 aa, Mycobacterium tuberculosis
SIGSSETGFGGT

SEQ ID NO: 1403111 - protein, 5 aa, Mycobacterium tuberculosis
SINTG

SEQ ID NO: 1403112 - protein, 8 aa, Mycobacterium tuberculosis
SIPAPGLG

SEQ ID NO: 1403113 - protein, 6 aa, Mycobacterium tuberculosis
SIPNQL

SEQ ID NO: 1403114 - protein, 6 aa, Mycobacterium tuberculosis
SIPTPA

SEQ ID NO: 1403115 - protein, 13 aa, Mycobacterium tuberculosis
SIRPGDPNDPGTV

SEQ ID NO: 1403116 - protein, 10 aa, Mycobacterium tuberculosis
SISAAGDHAT

SEQ ID NO: 1403117 - protein, 5 aa, Mycobacterium tuberculosis
SITPL

SEQ ID NO: 1403118 - protein, 6 aa, Mycobacterium tuberculosis
SKAALS

SEQ ID NO: 1403119 - protein, 8 aa, Mycobacterium tuberculosis
SKAEIDTT

SEQ ID NO: 1403120 - protein, 14 aa, Mycobacterium tuberculosis
SKASPTTKAAATAL

SEQ ID NO: 1403121 - protein, 5 aa, Mycobacterium tuberculosis
SKDAR

SEQ ID NO: 1403122 - protein, 11 aa, Mycobacterium tuberculosis
SKDSAKPANLT

SEQ ID NO: 1403123 - protein, 8 aa, Mycobacterium tuberculosis
SKGGAEKN

SEQ ID NO: 1403124 - protein, 12 aa, Mycobacterium tuberculosis
SKLESGDLSHTE

SEQ ID NO: 1403125 - protein, 7 aa, Mycobacterium tuberculosis
SKLTPAD

SEQ ID NO: 1403126 - protein, 8 aa, Mycobacterium tuberculosis
SKPTGIPP

SEQ ID NO: 1403127 - protein, 6 aa, Mycobacterium tuberculosis
SKRGGG

SEQ ID NO: 1403128 - protein, 6 aa, Mycobacterium tuberculosis
SKRSAV

SEQ ID NO: 1403129 - protein, 9 aa, Mycobacterium tuberculosis
SKRSTRMTA

SEQ ID NO: 1403130 - protein, 6 aa, Mycobacterium tuberculosis
SKSIRG

SEQ ID NO: 1403131 - protein, 5 aa, Mycobacterium tuberculosis
SKTAT

SEQ ID NO: 1403132 - protein, 22 aa, Mycobacterium tuberculosis
SKTATDGNDRPTDPVVIESITI

SEQ ID NO: 1403133 - protein, 7 aa, Mycobacterium tuberculosis
SKTPEQE

SEQ ID NO: 1403134 - protein, 7 aa, Mycobacterium tuberculosis
SKTQQDA

SEQ ID NO: 1403135 - protein, 6 aa, Mycobacterium tuberculosis
SKVSDK

SEQ ID NO: 1403136 - protein, 6 aa, Mycobacterium tuberculosis
SLAGTQ

SEQ ID NO: 1403137 - protein, 7 aa, Mycobacterium tuberculosis
SLDPQAG

SEQ ID NO: 1403138 - protein, 9 aa, Mycobacterium tuberculosis
SLDTGEQTV

SEQ ID NO: 1403139 - protein, 7 aa, Mycobacterium tuberculosis
SLGGGTA

SEQ ID NO: 1403140 - protein, 8 aa, Mycobacterium tuberculosis
SLGPETSK

SEQ ID NO: 1403141 - protein, 7 aa, Mycobacterium tuberculosis
SLGSAPR

SEQ ID NO: 1403142 - protein, 5 aa, Mycobacterium tuberculosis
SLHNS

SEQ ID NO: 1403143 - protein, 11 aa, Mycobacterium tuberculosis
SLHPPSDQVRS

SEQ ID NO: 1403144 - protein, 14 aa, Mycobacterium tuberculosis
SLNASQAQADPDGK

SEQ ID NO: 1403145 - protein, 22 aa, Mycobacterium tuberculosis
SLPPADDVGAGRRAVERLRGGI

SEQ ID NO: 1403146 - protein, 12 aa, Mycobacterium tuberculosis
SLPSSRPSPHHT

SEQ ID NO: 1403147 - protein, 6 aa, Mycobacterium tuberculosis
SLQPPD

SEQ ID NO: 1403148 - protein, 4 aa, Mycobacterium tuberculosis
SLQT

SEQ ID NO: 1403149 - protein, 8 aa, Mycobacterium tuberculosis
SLTGSATY

SEQ ID NO: 1403150 - protein, 6 aa, Mycobacterium tuberculosis
SLTQAA

SEQ ID NO: 1403151 - protein, 8 aa, Mycobacterium tuberculosis
SMHTGGRV

SEQ ID NO: 1403152 - protein, 7 aa, Mycobacterium tuberculosis
SMPKRGV

SEQ ID NO: 1403153 - protein, 6 aa, Mycobacterium tuberculosis
SMPYKS

SEQ ID NO: 1403154 - protein, 17 aa, Mycobacterium tuberculosis
SMRDGKAAIAGRSRNQA

SEQ ID NO: 1403155 - protein, 11 aa, Mycobacterium tuberculosis
SNDDGTGTADP

SEQ ID NO: 1403156 - protein, 6 aa, Mycobacterium tuberculosis
SNEAKA

SEQ ID NO: 1403157 - protein, 12 aa, Mycobacterium tuberculosis
SNEIGQLYQAVG

SEQ ID NO: 1403158 - protein, 9 aa, Mycobacterium tuberculosis
SNGDHTHGT

SEQ ID NO: 1403159 - protein, 28 aa, Mycobacterium tuberculosis
SNGLGASVKRREDTHKMAEANRAFAHYR

SEQ ID NO: 1403160 - protein, 15 aa, Mycobacterium tuberculosis
SNHGGNNLDGTPASI

SEQ ID NO: 1403161 - protein, 7 aa, Mycobacterium tuberculosis
SNIPDGQ

SEQ ID NO: 1403162 - protein, 5 aa, Mycobacterium tuberculosis
SNPVR

SEQ ID NO: 1403163 - protein, 4 aa, Mycobacterium tuberculosis
SNSD

SEQ ID NO: 1403164 - protein, 10 aa, Mycobacterium tuberculosis
SNSSATMARP

SEQ ID NO: 1403165 - protein, 6 aa, Mycobacterium tuberculosis
SNTRGD

SEQ ID NO: 1403166 - protein, 7 aa, Mycobacterium tuberculosis
SNVQTGA

SEQ ID NO: 1403167 - protein, 8 aa, Mycobacterium tuberculosis
SNVTGTSV

SEQ ID NO: 1403168 - protein, 11 aa, Mycobacterium tuberculosis
SPAASSLNGPI

SEQ ID NO: 1403169 - protein, 11 aa, Mycobacterium tuberculosis
SPAGQDRSSLQ

SEQ ID NO: 1403170 - protein, 12 aa, Mycobacterium tuberculosis
SPAGRRKSAGRR

SEQ ID NO: 1403171 - protein, 9 aa, Mycobacterium tuberculosis
SPAKETREF

SEQ ID NO: 1403172 - protein, 5 aa, Mycobacterium tuberculosis
SPAPI

SEQ ID NO: 1403173 - protein, 13 aa, Mycobacterium tuberculosis
SPARASALEESNY

SEQ ID NO: 1403174 - protein, 11 aa, Mycobacterium tuberculosis
SPASISSGTYS

SEQ ID NO: 1403175 - protein, 12 aa, Mycobacterium tuberculosis
SPDGKNHGTRSL

SEQ ID NO: 1403176 - protein, 5 aa, Mycobacterium tuberculosis
SPDLE

SEQ ID NO: 1403177 - protein, 25 aa, Mycobacterium tuberculosis
SPDTAAEIGAADGEAVTVSTSRGSI

SEQ ID NO: 1403178 - protein, 7 aa, Mycobacterium tuberculosis
SPEDEKA

SEQ ID NO: 1403179 - protein, 6 aa, Mycobacterium tuberculosis
SPENAR

SEQ ID NO: 1403180 - protein, 7 aa, Mycobacterium tuberculosis
SPEQEQA

SEQ ID NO: 1403181 - protein, 5 aa, Mycobacterium tuberculosis
SPERL

SEQ ID NO: 1403182 - protein, 8 aa, Mycobacterium tuberculosis
SPERLSGR

SEQ ID NO: 1403183 - protein, 9 aa, Mycobacterium tuberculosis
SPETTTGGK

SEQ ID NO: 1403184 - protein, 7 aa, Mycobacterium tuberculosis
SPGDGRI

SEQ ID NO: 1403185 - protein, 4 aa, Mycobacterium tuberculosis
SPGG

SEQ ID NO: 1403186 - protein, 6 aa, Mycobacterium tuberculosis
SPGGGF

SEQ ID NO: 1403187 - protein, 10 aa, Mycobacterium tuberculosis
SPGGHTSRPH

SEQ ID NO: 1403188 - protein, 7 aa, Mycobacterium tuberculosis
SPGGSIS

SEQ ID NO: 1403189 - protein, 5 aa, Mycobacterium tuberculosis
SPGKG

SEQ ID NO: 1403190 - protein, 6 aa, Mycobacterium tuberculosis
SPGMAR

SEQ ID NO: 1403191 - protein, 6 aa, Mycobacterium tuberculosis
SPGQHS

SEQ ID NO: 1403192 - protein, 7 aa, Mycobacterium tuberculosis
SPGRRNN

SEQ ID NO: 1403193 - protein, 4 aa, Mycobacterium tuberculosis
SPHV

SEQ ID NO: 1403194 - protein, 6 aa, Mycobacterium tuberculosis
SPIGKR

SEQ ID NO: 1403195 - protein, 9 aa, Mycobacterium tuberculosis
SPIKSGEPL

SEQ ID NO: 1403196 - protein, 8 aa, Mycobacterium tuberculosis
SPKGSATL

SEQ ID NO: 1403197 - protein, 8 aa, Mycobacterium tuberculosis
SPKHAETA

SEQ ID NO: 1403198 - protein, 7 aa, Mycobacterium tuberculosis
SPKQFDG

SEQ ID NO: 1403199 - protein, 11 aa, Mycobacterium tuberculosis
SPKTARLGAQE

SEQ ID NO: 1403200 - protein, 4 aa, Mycobacterium tuberculosis
SPMP

SEQ ID NO: 1403201 - protein, 7 aa, Mycobacterium tuberculosis
SPNADEN

SEQ ID NO: 1403202 - protein, 7 aa, Mycobacterium tuberculosis
SPPAPAE

SEQ ID NO: 1403203 - protein, 4 aa, Mycobacterium tuberculosis
SPPF

SEQ ID NO: 1403204 - protein, 5 aa, Mycobacterium tuberculosis
SPPPH

SEQ ID NO: 1403205 - protein, 5 aa, Mycobacterium tuberculosis
SPPPL

SEQ ID NO: 1403206 - protein, 7 aa, Mycobacterium tuberculosis
SPPQAQW

SEQ ID NO: 1403207 - protein, 9 aa, Mycobacterium tuberculosis
SPPRGAGGA

SEQ ID NO: 1403208 - protein, 7 aa, Mycobacterium tuberculosis
SPQRSYP

SEQ ID NO: 1403209 - protein, 7 aa, Mycobacterium tuberculosis
SPQSIRD

SEQ ID NO: 1403210 - protein, 14 aa, Mycobacterium tuberculosis
SPQSTVIGGTSDTV

SEQ ID NO: 1403211 - protein, 7 aa, Mycobacterium tuberculosis
SPRAGQA

SEQ ID NO: 1403212 - protein, 15 aa, Mycobacterium tuberculosis
SPRGRITRTYREAEN

SEQ ID NO: 1403213 - protein, 6 aa, Mycobacterium tuberculosis
SPRQTV

SEQ ID NO: 1403214 - protein, 5 aa, Mycobacterium tuberculosis
SPRYG

SEQ ID NO: 1403215 - protein, 7 aa, Mycobacterium tuberculosis
SPSMTQH

SEQ ID NO: 1403216 - protein, 8 aa, Mycobacterium tuberculosis
SPSNPTGR

SEQ ID NO: 1403217 - protein, 4 aa, Mycobacterium tuberculosis
SPSP

SEQ ID NO: 1403218 - protein, 6 aa, Mycobacterium tuberculosis
SPTDRR

SEQ ID NO: 1403219 - protein, 5 aa, Mycobacterium tuberculosis
SPTHN

SEQ ID NO: 1403220 - protein, 8 aa, Mycobacterium tuberculosis
SPTHPEAT

SEQ ID NO: 1403221 - protein, 7 aa, Mycobacterium tuberculosis
SPTKARK

SEQ ID NO: 1403222 - protein, 5 aa, Mycobacterium tuberculosis
SPTLQ

SEQ ID NO: 1403223 - protein, 8 aa, Mycobacterium tuberculosis
SPTTPTTA

SEQ ID NO: 1403224 - protein, 11 aa, Mycobacterium tuberculosis
SPVADTTVTVD

SEQ ID NO: 1403225 - protein, 7 aa, Mycobacterium tuberculosis
SPVDSGN

SEQ ID NO: 1403226 - protein, 9 aa, Mycobacterium tuberculosis
SPVENPPPY

SEQ ID NO: 1403227 - protein, 11 aa, Mycobacterium tuberculosis
SPVRPEGNAEQ

SEQ ID NO: 1403228 - protein, 5 aa, Mycobacterium tuberculosis
SPYDA

SEQ ID NO: 1403229 - protein, 8 aa, Mycobacterium tuberculosis
SPYRTPQT

SEQ ID NO: 1403230 - protein, 6 aa, Mycobacterium tuberculosis
SPYTDD

SEQ ID NO: 1403231 - protein, 6 aa, Mycobacterium tuberculosis
SQAADR

SEQ ID NO: 1403232 - protein, 7 aa, Mycobacterium tuberculosis
SQANVSG

SEQ ID NO: 1403233 - protein, 8 aa, Mycobacterium tuberculosis
SQAPGTTT

SEQ ID NO: 1403234 - protein, 9 aa, Mycobacterium tuberculosis
SQARAAQQG

SEQ ID NO: 1403235 - protein, 10 aa, Mycobacterium tuberculosis
SQAVDPNVTP

SEQ ID NO: 1403236 - protein, 16 aa, Mycobacterium tuberculosis
SQDAARSAPEAGDAAP

SEQ ID NO: 1403237 - protein, 8 aa, Mycobacterium tuberculosis
SQDAREFA

SEQ ID NO: 1403238 - protein, 14 aa, Mycobacterium tuberculosis
SQDELTRRVTALTS

SEQ ID NO: 1403239 - protein, 6 aa, Mycobacterium tuberculosis
SQHAGS

SEQ ID NO: 1403240 - protein, 12 aa, Mycobacterium tuberculosis
SQKLTEEAADKL

SEQ ID NO: 1403241 - protein, 14 aa, Mycobacterium tuberculosis
SQLGGAGGLGDAVG

SEQ ID NO: 1403242 - protein, 8 aa, Mycobacterium tuberculosis
SQPDTGEL

SEQ ID NO: 1403243 - protein, 9 aa, Mycobacterium tuberculosis
SQPDTGEQA

SEQ ID NO: 1403244 - protein, 9 aa, Mycobacterium tuberculosis
SQPQRRSRA

SEQ ID NO: 1403245 - protein, 5 aa, Mycobacterium tuberculosis
SQPRR

SEQ ID NO: 1403246 - protein, 6 aa, Mycobacterium tuberculosis
SQPSAG

SEQ ID NO: 1403247 - protein, 5 aa, Mycobacterium tuberculosis
SQPTL

SEQ ID NO: 1403248 - protein, 8 aa, Mycobacterium tuberculosis
SQQDVSDT

SEQ ID NO: 1403249 - protein, 5 aa, Mycobacterium tuberculosis
SQRDD

SEQ ID NO: 1403250 - protein, 4 aa, Mycobacterium tuberculosis
SQRR

SEQ ID NO: 1403251 - protein, 4 aa, Mycobacterium tuberculosis
SQSA

SEQ ID NO: 1403252 - protein, 6 aa, Mycobacterium tuberculosis
SQSATI

SEQ ID NO: 1403253 - protein, 11 aa, Mycobacterium tuberculosis
SQTDTLDPNRT

SEQ ID NO: 1403254 - protein, 6 aa, Mycobacterium tuberculosis
SQYTRG

SEQ ID NO: 1403255 - protein, 16 aa, Mycobacterium tuberculosis
SRAGDDAERSDAEERR

SEQ ID NO: 1403256 - protein, 5 aa, Mycobacterium tuberculosis
SRAHP

SEQ ID NO: 1403257 - protein, 4 aa, Mycobacterium tuberculosis
SRAR

SEQ ID NO: 1403258 - protein, 8 aa, Mycobacterium tuberculosis
SRATADRR

SEQ ID NO: 1403259 - protein, 7 aa, Mycobacterium tuberculosis
SRDAEAP

SEQ ID NO: 1403260 - protein, 4 aa, Mycobacterium tuberculosis
SRDD

SEQ ID NO: 1403261 - protein, 10 aa, Mycobacterium tuberculosis
SRDGHDGEDL

SEQ ID NO: 1403262 - protein, 18 aa, Mycobacterium tuberculosis
SREGVRAAADALSNGHPV

SEQ ID NO: 1403263 - protein, 6 aa, Mycobacterium tuberculosis
SREPIG

SEQ ID NO: 1403264 - protein, 6 aa, Mycobacterium tuberculosis
SREPRQ

SEQ ID NO: 1403265 - protein, 6 aa, Mycobacterium tuberculosis
SREQVP

SEQ ID NO: 1403266 - protein, 17 aa, Mycobacterium tuberculosis
SRFSSSNLPKSSRRISG

SEQ ID NO: 1403267 - protein, 4 aa, Mycobacterium tuberculosis
SRGA

SEQ ID NO: 1403268 - protein, 5 aa, Mycobacterium tuberculosis
SRGFR

SEQ ID NO: 1403269 - protein, 7 aa, Mycobacterium tuberculosis
SRGFSTG

SEQ ID NO: 1403270 - protein, 6 aa, Mycobacterium tuberculosis
SRGGRP

SEQ ID NO: 1403271 - protein, 6 aa, Mycobacterium tuberculosis
SRGGVG

SEQ ID NO: 1403272 - protein, 11 aa, Mycobacterium tuberculosis
SRGPIDPTASV

SEQ ID NO: 1403273 - protein, 11 aa, Mycobacterium tuberculosis
SRGPKATGALR

SEQ ID NO: 1403274 - protein, 7 aa, Mycobacterium tuberculosis
SRGRGGY

SEQ ID NO: 1403275 - protein, 7 aa, Mycobacterium tuberculosis
SRGYPRA

SEQ ID NO: 1403276 - protein, 11 aa, Mycobacterium tuberculosis
SRHDLGNPGGY

SEQ ID NO: 1403277 - protein, 10 aa, Mycobacterium tuberculosis
SRHGQGGERI

SEQ ID NO: 1403278 - protein, 8 aa, Mycobacterium tuberculosis
SRKQAAGT

SEQ ID NO: 1403279 - protein, 14 aa, Mycobacterium tuberculosis
SRKSQSAGSGPSAI

SEQ ID NO: 1403280 - protein, 5 aa, Mycobacterium tuberculosis
SRNIG

SEQ ID NO: 1403281 - protein, 12 aa, Mycobacterium tuberculosis
SRNPITGANEPF

SEQ ID NO: 1403282 - protein, 9 aa, Mycobacterium tuberculosis
SRNSGDKPE

SEQ ID NO: 1403283 - protein, 78 aa, Mycobacterium tuberculosis; identical to SEQ ID NO: 188237

SEQ ID NO: 1403284 - protein, 9 aa, Mycobacterium tuberculosis
SRPALPDLP

SEQ ID NO: 1403285 - protein, 7 aa, Mycobacterium tuberculosis
SRPDFDH

SEQ ID NO: 1403286 - protein, 13 aa, Mycobacterium tuberculosis
SRPESDSVEVTYD

SEQ ID NO: 1403287 - protein, 12 aa, Mycobacterium tuberculosis
SRPRTTRGARPE

SEQ ID NO: 1403288 - protein, 20 aa, Mycobacterium tuberculosis
SRPTNRSPSDAERAATANAV

SEQ ID NO: 1403289 - protein, 5 aa, Mycobacterium tuberculosis
SRPVI

SEQ ID NO: 1403290 - protein, 21 aa, Mycobacterium tuberculosis
SRQRSRSPGARPTGRDTPETA

SEQ ID NO: 1403291 - protein, 6 aa, Mycobacterium tuberculosis
SRRAER

SEQ ID NO: 1403292 - protein, 4 aa, Mycobacterium tuberculosis
SRRD

SEQ ID NO: 1403293 - protein, 4 aa, Mycobacterium tuberculosis
SRRG

SEQ ID NO: 1403294 - protein, 15 aa, Mycobacterium tuberculosis
SRRGGRGWVVPAGGA

SEQ ID NO: 1403295 - protein, 6 aa, Mycobacterium tuberculosis
SRRGRT

SEQ ID NO: 1403296 - protein, 13 aa, Mycobacterium tuberculosis
SRRTRSSKDVSTA

SEQ ID NO: 1403297 - protein, 14 aa, Mycobacterium tuberculosis
SRSGADTFGSDGGE

SEQ ID NO: 1403298 - protein, 8 aa, Mycobacterium tuberculosis
SRSGPPQV

SEQ ID NO: 1403299 - protein, 11 aa, Mycobacterium tuberculosis
SRSIDQRSGVS

SEQ ID NO: 1403300 - protein, 14 aa, Mycobacterium tuberculosis
SRSPGGRQSRKPSR

SEQ ID NO: 1403301 - protein, 6 aa, Mycobacterium tuberculosis
SRSTCS

SEQ ID NO: 1403302 - protein, 7 aa, Mycobacterium tuberculosis
SRTDDGL

SEQ ID NO: 1403303 - protein, 6 aa, Mycobacterium tuberculosis
SRTPPD

SEQ ID NO: 1403304 - protein, 18 aa, Mycobacterium tuberculosis
SRTTAYSGGARNHAVIPA

SEQ ID NO: 1403305 - protein, 6 aa, Mycobacterium tuberculosis
SRTTHT

SEQ ID NO: 1403306 - protein, 31 aa, Mycobacterium tuberculosis; identical to SEQ ID NO: 188309

SEQ ID NO: 1403307 - protein, 11 aa, Mycobacterium tuberculosis
SSADQKADLDR

SEQ ID NO: 1403308 - protein, 11 aa, Mycobacterium tuberculosis
SSADQKPDLDR

SEQ ID NO: 1403309 - protein, 10 aa, Mycobacterium tuberculosis
SSADVERSES

SEQ ID NO: 1403310 - protein, 5 aa, Mycobacterium tuberculosis
SSAEI

SEQ ID NO: 1403311 - protein, 7 aa, Mycobacterium tuberculosis
SSAFEQG

SEQ ID NO: 1403312 - protein, 7 aa, Mycobacterium tuberculosis
SSAGAPV

SEQ ID NO: 1403313 - protein, 5 aa, Mycobacterium tuberculosis
SSAID

SEQ ID NO: 1403314 - protein, 12 aa, Mycobacterium tuberculosis
SSARASSGSSGN

SEQ ID NO: 1403315 - protein, 10 aa, Mycobacterium tuberculosis
SSASDGREYS

SEQ ID NO: 1403316 - protein, 9 aa, Mycobacterium tuberculosis
SSATTEAES

SEQ ID NO: 1403317 - protein, 8 aa, Mycobacterium tuberculosis
SSDGSPPY

SEQ ID NO: 1403318 - protein, 4 aa, Mycobacterium tuberculosis
SSDL

SEQ ID NO: 1403319 - protein, 7 aa, Mycobacterium tuberculosis
SSDSRDI

SEQ ID NO: 1403320 - protein, 8 aa, Mycobacterium tuberculosis
SSDTTTDP

SEQ ID NO: 1403321 - protein, 4 aa, Mycobacterium tuberculosis
SSDY

SEQ ID NO: 1403322 - protein, 6 aa, Mycobacterium tuberculosis
SSEDAM

SEQ ID NO: 1403323 - protein, 7 aa, Mycobacterium tuberculosis
SSFTGYD

SEQ ID NO: 1403324 - protein, 6 aa, Mycobacterium tuberculosis
SSGDPG

SEQ ID NO: 1403325 - protein, 6 aa, Mycobacterium tuberculosis
SSGGEL

SEQ ID NO: 1403326 - protein, 6 aa, Mycobacterium tuberculosis
SSGGYA

SEQ ID NO: 1403327 - protein, 6 aa, Mycobacterium tuberculosis
SSGHHH

SEQ ID NO: 1403328 - protein, 15 aa, Mycobacterium tuberculosis
SSGKGGQGVNTTDSA

SEQ ID NO: 1403329 - protein, 13 aa, Mycobacterium tuberculosis
SSGKRDPGELSTR

SEQ ID NO: 1403330 - protein, 7 aa, Mycobacterium tuberculosis
SSGRGAL

SEQ ID NO: 1403331 - protein, 12 aa, Mycobacterium tuberculosis
SSGTTGRPKGIK

SEQ ID NO: 1403332 - protein, 14 aa, Mycobacterium tuberculosis
SSHPAANARTSTVA

SEQ ID NO: 1403333 - protein, 5 aa, Mycobacterium tuberculosis
SSIAP

SEQ ID NO: 1403334 - protein, 8 aa, Mycobacterium tuberculosis
SSIEDPAD

SEQ ID NO: 1403335 - protein, 5 aa, Mycobacterium tuberculosis
SSITQ

SEQ ID NO: 1403336 - protein, 7 aa, Mycobacterium tuberculosis
SSKEPGR

SEQ ID NO: 1403337 - protein, 4 aa, Mycobacterium tuberculosis
SSLP

SEQ ID NO: 1403338 - protein, 9 aa, Mycobacterium tuberculosis
SSLTNNRSR

SEQ ID NO: 1403339 - protein, 9 aa, Mycobacterium tuberculosis
SSNGQPEIT

SEQ ID NO: 1403340 - protein, 9 aa, Mycobacterium tuberculosis
SSNGSGTSK

SEQ ID NO: 1403341 - protein, 6 aa, Mycobacterium tuberculosis
SSNTEP

SEQ ID NO: 1403342 - protein, 6 aa, Mycobacterium tuberculosis
SSPDAM

SEQ ID NO: 1403343 - protein, 26 aa, Mycobacterium tuberculosis
SSPDFGADQGRLGCPPANDAEGIGVS

SEQ ID NO: 1403344 - protein, 14 aa, Mycobacterium tuberculosis
SSPKPPPGTPGGAA

SEQ ID NO: 1403345 - protein, 9 aa, Mycobacterium tuberculosis
SSPSASPKL

SEQ ID NO: 1403346 - protein, 6 aa, Mycobacterium tuberculosis
SSPWTY

SEQ ID NO: 1403347 - protein, 6 aa, Mycobacterium tuberculosis
SSRDRV

SEQ ID NO: 1403348 - protein, 17 aa, Mycobacterium tuberculosis
SSRTGTLATIGPDGQPH

SEQ ID NO: 1403349 - protein, 5 aa, Mycobacterium tuberculosis
SSRTV

SEQ ID NO: 1403350 - protein, 9 aa, Mycobacterium tuberculosis
SSSATASRL

SEQ ID NO: 1403351 - protein, 9 aa, Mycobacterium tuberculosis
SSTEQALPT

SEQ ID NO: 1403352 - protein, 8 aa, Mycobacterium tuberculosis
SSTTARSN

SEQ ID NO: 1403353 - protein, 5 aa, Mycobacterium tuberculosis
SSVAE

SEQ ID NO: 1403354 - protein, 13 aa, Mycobacterium tuberculosis
SSVAGYSDSPSVE

SEQ ID NO: 1403355 - protein, 6 aa, Mycobacterium tuberculosis
STAAAV

SEQ ID NO: 1403356 - protein, 12 aa, Mycobacterium tuberculosis
STAAGGGGRQPR

SEQ ID NO: 1403357 - protein, 8 aa, Mycobacterium tuberculosis
STAASSVG

SEQ ID NO: 1403358 - protein, 10 aa, Mycobacterium tuberculosis
STADGSGTTI

SEQ ID NO: 1403359 - protein, 5 aa, Mycobacterium tuberculosis
STADS

SEQ ID NO: 1403360 - protein, 20 aa, Mycobacterium tuberculosis
STAGTGYTYTTRKNRRNDPD

SEQ ID NO: 1403361 - protein, 7 aa, Mycobacterium tuberculosis
STANPLE

SEQ ID NO: 1403362 - protein, 4 aa, Mycobacterium tuberculosis
STAQ

SEQ ID NO: 1403363 - protein, 8 aa, Mycobacterium tuberculosis
STATSRYA

SEQ ID NO: 1403364 - protein, 15 aa, Mycobacterium tuberculosis
STDARPEELKSRGVR

SEQ ID NO: 1403365 - protein, 12 aa, Mycobacterium tuberculosis
STDCRQRAEQSR

SEQ ID NO: 1403366 - protein, 4 aa, Mycobacterium tuberculosis
STDG

SEQ ID NO: 1403367 - protein, 26 aa, Mycobacterium tuberculosis
STDGKPSDAAATDPPDLNADEPAGSL

SEQ ID NO: 1403368 - protein, 8 aa, Mycobacterium tuberculosis
STDPVPGD

SEQ ID NO: 1403369 - protein, 6 aa, Mycobacterium tuberculosis
STDSND

SEQ ID NO: 1403370 - protein, 7 aa, Mycobacterium tuberculosis
STDTTID

SEQ ID NO: 1403371 - protein, 4 aa, Mycobacterium tuberculosis
STEA

SEQ ID NO: 1403372 - protein, 7 aa, Mycobacterium tuberculosis
STFGGNP

SEQ ID NO: 1403373 - protein, 6 aa, Mycobacterium tuberculosis
STGADV

SEQ ID NO: 1403374 - protein, 11 aa, Mycobacterium tuberculosis
STGCHPAGGAT

SEQ ID NO: 1403375 - protein, 8 aa, Mycobacterium tuberculosis
STGEPIAP

SEQ ID NO: 1403376 - protein, 11 aa, Mycobacterium tuberculosis
STGGEFTPGSE

SEQ ID NO: 1403377 - protein, 6 aa, Mycobacterium tuberculosis
STGLRR

SEQ ID NO: 1403378 - protein, 6 aa, Mycobacterium tuberculosis
STGNGN

SEQ ID NO: 1403379 - protein, 8 aa, Mycobacterium tuberculosis
STGSVPYS

SEQ ID NO: 1403380 - protein, 5 aa, Mycobacterium tuberculosis
STGVD

SEQ ID NO: 1403381 - protein, 6 aa, Mycobacterium tuberculosis
STHPAS

SEQ ID NO: 1403382 - protein, 7 aa, Mycobacterium tuberculosis
STHVEPG

SEQ ID NO: 1403383 - protein, 6 aa, Mycobacterium tuberculosis
STKAGL

SEQ ID NO: 1403384 - protein, 10 aa, Mycobacterium tuberculosis
STLSGGQRRR

SEQ ID NO: 1403385 - protein, 7 aa, Mycobacterium tuberculosis
STPAPVR

SEQ ID NO: 1403386 - protein, 5 aa, Mycobacterium tuberculosis
STPAY

SEQ ID NO: 1403387 - protein, 5 aa, Mycobacterium tuberculosis
STPGL

SEQ ID NO: 1403388 - protein, 11 aa, Mycobacterium tuberculosis
STPGRPQGRGK

SEQ ID NO: 1403389 - protein, 10 aa, Mycobacterium tuberculosis
STPKTTGVNQ

SEQ ID NO: 1403390 - protein, 5 aa, Mycobacterium tuberculosis
STPRR

SEQ ID NO: 1403391 - protein, 9 aa, Mycobacterium tuberculosis
STPTGSTAY

SEQ ID NO: 1403392 - protein, 6 aa, Mycobacterium tuberculosis
STPVAG

SEQ ID NO: 1403393 - protein, 7 aa, Mycobacterium tuberculosis
STPVKTD

SEQ ID NO: 1403394 - protein, 6 aa, Mycobacterium tuberculosis
STQAGD

SEQ ID NO: 1403395 - protein, 20 aa, Mycobacterium tuberculosis
STQQRSQDGKYELTPKGDNT

SEQ ID NO: 1403396 - protein, 6 aa, Mycobacterium tuberculosis
STRESF

SEQ ID NO: 1403397 - protein, 6 aa, Mycobacterium tuberculosis
STRGDL

SEQ ID NO: 1403398 - protein, 10 aa, Mycobacterium tuberculosis
STRPDHREQA

SEQ ID NO: 1403399 - protein, 13 aa, Mycobacterium tuberculosis
STRQHSDEGPYTI

SEQ ID NO: 1403400 - protein, 18 aa, Mycobacterium tuberculosis
STRSEETKADVGNQVSSM

SEQ ID NO: 1403401 - protein, 14 aa, Mycobacterium tuberculosis
STRSNSALSKTDNR

SEQ ID NO: 1403402 - protein, 5 aa, Mycobacterium tuberculosis
STRSV

SEQ ID NO: 1403403 - protein, 5 aa, Mycobacterium tuberculosis
STRTE

SEQ ID NO: 1403404 - protein, 6 aa, Mycobacterium tuberculosis
STRTGQ

SEQ ID NO: 1403405 - protein, 15 aa, Mycobacterium tuberculosis
STSITDGQPLATPQV

SEQ ID NO: 1403406 - protein, 8 aa, Mycobacterium tuberculosis
STSRRPAD

SEQ ID NO: 1403407 - protein, 7 aa, Mycobacterium tuberculosis
STSTKDL

SEQ ID NO: 1403408 - protein, 6 aa, Mycobacterium tuberculosis
STTARM

SEQ ID NO: 1403409 - protein, 5 aa, Mycobacterium tuberculosis
STTHL

SEQ ID NO: 1403410 - protein, 11 aa, Mycobacterium tuberculosis
STTTTSGERPK

SEQ ID NO: 1403411 - protein, 4 aa, Mycobacterium tuberculosis
STVD

SEQ ID NO: 1403412 - protein, 6 aa, Mycobacterium tuberculosis
STVQDR

SEQ ID NO: 1403413 - protein, 7 aa, Mycobacterium tuberculosis
SVADAER

SEQ ID NO: 1403414 - protein, 9 aa, Mycobacterium tuberculosis
SVADSSQSA

SEQ ID NO: 1403415 - protein, 5 aa, Mycobacterium tuberculosis
SVDSS

SEQ ID NO: 1403416 - protein, 6 aa, Mycobacterium tuberculosis
SVERSE

SEQ ID NO: 1403417 - protein, 11 aa, Mycobacterium tuberculosis
SVGADSGPRYG

SEQ ID NO: 1403418 - protein, 6 aa, Mycobacterium tuberculosis
SVGGQG

SEQ ID NO: 1403419 - protein, 11 aa, Mycobacterium tuberculosis
SVGGQPSQATQ

SEQ ID NO: 1403420 - protein, 10 aa, Mycobacterium tuberculosis
SVGKPTAPYA

SEQ ID NO: 1403421 - protein, 6 aa, Mycobacterium tuberculosis
SVHNSQ

SEQ ID NO: 1403422 - protein, 7 aa, Mycobacterium tuberculosis
SVHPNGA

SEQ ID NO: 1403423 - protein, 15 aa, Mycobacterium tuberculosis
SVKARSKANSNVPTP

SEQ ID NO: 1403424 - protein, 5 aa, Mycobacterium tuberculosis
SVNPA

SEQ ID NO: 1403425 - protein, 12 aa, Mycobacterium tuberculosis
SVPGPVSDYTGQ

SEQ ID NO: 1403426 - protein, 5 aa, Mycobacterium tuberculosis
SVPPQ

SEQ ID NO: 1403427 - protein, 7 aa, Mycobacterium tuberculosis
SVSAPEA

SEQ ID NO: 1403428 - protein, 13 aa, Mycobacterium tuberculosis
SVTDTKTTQPAAV

SEQ ID NO: 1403429 - protein, 8 aa, Mycobacterium tuberculosis
SVTEGHPD

SEQ ID NO: 1403430 - protein, 12 aa, Mycobacterium tuberculosis
SVTSGFGNKGTG

SEQ ID NO: 1403431 - protein, 10 aa, Mycobacterium tuberculosis
SVTSNTRADA

SEQ ID NO: 1403432 - protein, 13 aa, Mycobacterium tuberculosis
SVVETERPEPLAA

SEQ ID NO: 1403433 - protein, 4 aa, Mycobacterium tuberculosis
SWGI

SEQ ID NO: 1403434 - protein, 21 aa, Mycobacterium tuberculosis
SYAPGKPGEAGEQERRALNDA

SEQ ID NO: 1403435 - protein, 10 aa, Mycobacterium tuberculosis
SYGADTAEVD

SEQ ID NO: 1403436 - protein, 6 aa, Mycobacterium tuberculosis
SYGAGN

SEQ ID NO: 1403437 - protein, 5 aa, Mycobacterium tuberculosis
SYGAP

SEQ ID NO: 1403438 - protein, 5 aa, Mycobacterium tuberculosis
SYGGA

SEQ ID NO: 1403439 - protein, 6 aa, Mycobacterium tuberculosis
SYGPIG

SEQ ID NO: 1403440 - protein, 4 aa, Mycobacterium tuberculosis
SYPE

SEQ ID NO: 1403441 - protein, 8 aa, Mycobacterium tuberculosis
SYSDRPGT

SEQ ID NO: 1403442 - protein, 7 aa, Mycobacterium tuberculosis
SYSEDGD

SEQ ID NO: 1403443 - protein, 7 aa, Mycobacterium tuberculosis
TAADALD

SEQ ID NO: 1403444 - protein, 6 aa, Mycobacterium tuberculosis
TAADGL

SEQ ID NO: 1403445 - protein, 7 aa, Mycobacterium tuberculosis
TAAESAE

SEQ ID NO: 1403446 - protein, 11 aa, Mycobacterium tuberculosis
TAAESQAGAAR

SEQ ID NO: 1403447 - protein, 10 aa, Mycobacterium tuberculosis
TAAGANSDTR

SEQ ID NO: 1403448 - protein, 7 aa, Mycobacterium tuberculosis
TAAGDAV

SEQ ID NO: 1403449 - protein, 12 aa, Mycobacterium tuberculosis
TAAGLGPDGKRW

SEQ ID NO: 1403450 - protein, 11 aa, Mycobacterium tuberculosis
TAAGNGAAAEE

SEQ ID NO: 1403451 - protein, 22 aa, Mycobacterium tuberculosis
TAAGQSAHANYTGAMATNLGMW

SEQ ID NO: 1403452 - protein, 6 aa, Mycobacterium tuberculosis
TAAPTA

SEQ ID NO: 1403453 - protein, 5 aa, Mycobacterium tuberculosis
TAARQ

SEQ ID NO: 1403454 - protein, 10 aa, Mycobacterium tuberculosis
TADDGPTARR

SEQ ID NO: 1403455 - protein, 8 aa, Mycobacterium tuberculosis
TADFTGTT

SEQ ID NO: 1403456 - protein, 4 aa, Mycobacterium tuberculosis
TADG

SEQ ID NO: 1403457 - protein, 8 aa, Mycobacterium tuberculosis
TADGDLRP

SEQ ID NO: 1403458 - protein, 8 aa, Mycobacterium tuberculosis
TADGKEIA

SEQ ID NO: 1403459 - protein, 6 aa, Mycobacterium tuberculosis
TADRDD

SEQ ID NO: 1403460 - protein, 10 aa, Mycobacterium tuberculosis
TADTSREEVG

SEQ ID NO: 1403461 - protein, 12 aa, Mycobacterium tuberculosis
TAEAEASNDVPT

SEQ ID NO: 1403462 - protein, 8 aa, Mycobacterium tuberculosis
TAEARGEV

SEQ ID NO: 1403463 - protein, 6 aa, Mycobacterium tuberculosis
TAEDTR

SEQ ID NO: 1403464 - protein, 8 aa, Mycobacterium tuberculosis
TAEEAKDY

SEQ ID NO: 1403465 - protein, 7 aa, Mycobacterium tuberculosis
TAEGLGE

SEQ ID NO: 1403466 - protein, 6 aa, Mycobacterium tuberculosis
TAEIPT

SEQ ID NO: 1403467 - protein, 10 aa, Mycobacterium tuberculosis
TAEPGRDPIS

SEQ ID NO: 1403468 - protein, 9 aa, Mycobacterium tuberculosis
TAEPHPKLP

SEQ ID NO: 1403469 - protein, 16 aa, Mycobacterium tuberculosis
TAEPVAAHKTEDARDP

SEQ ID NO: 1403470 - protein, 4 aa, Mycobacterium tuberculosis
TAEQ

SEQ ID NO: 1403471 - protein, 6 aa, Mycobacterium tuberculosis
TAESCT

SEQ ID NO: 1403472 - protein, 6 aa, Mycobacterium tuberculosis
TAEVGD

SEQ ID NO: 1403473 - protein, 5 aa, Mycobacterium tuberculosis
TAEWS

SEQ ID NO: 1403474 - protein, 7 aa, Mycobacterium tuberculosis
TAGAAQA

SEQ ID NO: 1403475 - protein, 10 aa, Mycobacterium tuberculosis
TAGASAPPRL

SEQ ID NO: 1403476 - protein, 7 aa, Mycobacterium tuberculosis
TAGEGAR

SEQ ID NO: 1403477 - protein, 7 aa, Mycobacterium tuberculosis
TAGGLAS

SEQ ID NO: 1403478 - protein, 8 aa, Mycobacterium tuberculosis
TAGQRNRA

SEQ ID NO: 1403479 - protein, 6 aa, Mycobacterium tuberculosis
TAGSTN

SEQ ID NO: 1403480 - protein, 8 aa, Mycobacterium tuberculosis
TAGSVGRN

SEQ ID NO: 1403481 - protein, 5 aa, Mycobacterium tuberculosis
TAGVH

SEQ ID NO: 1403482 - protein, 21 aa, Mycobacterium tuberculosis
TAGYDEPAVSRTYAAPGAAEC

SEQ ID NO: 1403483 - protein, 5 aa, Mycobacterium tuberculosis
TAHAA

SEQ ID NO: 1403484 - protein, 8 aa, Mycobacterium tuberculosis
TAHAQGAR

SEQ ID NO: 1403485 - protein, 9 aa, Mycobacterium tuberculosis
TAIRGEPPK

SEQ ID NO: 1403486 - protein, 9 aa, Mycobacterium tuberculosis
TAITPDEGA

SEQ ID NO: 1403487 - protein, 9 aa, Mycobacterium tuberculosis
TAKDPDGAP

SEQ ID NO: 1403488 - protein, 7 aa, Mycobacterium tuberculosis
TAKEQNV

SEQ ID NO: 1403489 - protein, 8 aa, Mycobacterium tuberculosis
TAKFGQPE

SEQ ID NO: 1403490 - protein, 6 aa, Mycobacterium tuberculosis
TAKPYF

SEQ ID NO: 1403491 - protein, 5 aa, Mycobacterium tuberculosis
TANPT

SEQ ID NO: 1403492 - protein, 4 aa, Mycobacterium tuberculosis
TANR

SEQ ID NO: 1403493 - protein, 9 aa, Mycobacterium tuberculosis
TANSGAGVL

SEQ ID NO: 1403494 - protein, 8 aa, Mycobacterium tuberculosis
TAPAEASS

SEQ ID NO: 1403495 - protein, 4 aa, Mycobacterium tuberculosis
TAPD

SEQ ID NO: 1403496 - protein, 12 aa, Mycobacterium tuberculosis
TAPEYSRSSEYC

SEQ ID NO: 1403497 - protein, 6 aa, Mycobacterium tuberculosis
TAPGSA

SEQ ID NO: 1403498 - protein, 9 aa, Mycobacterium tuberculosis
TAPMEPADP

SEQ ID NO: 1403499 - protein, 7 aa, Mycobacterium tuberculosis
TAPPGIT

SEQ ID NO: 1403500 - protein, 9 aa, Mycobacterium tuberculosis
TAPSATTLP

SEQ ID NO: 1403501 - protein, 14 aa, Mycobacterium tuberculosis
TAQDINDNHRNSRY

SEQ ID NO: 1403502 - protein, 6 aa, Mycobacterium tuberculosis
TAQQDD

SEQ ID NO: 1403503 - protein, 14 aa, Mycobacterium tuberculosis
TARGGDDESAVDAQ

SEQ ID NO: 1403504 - protein, 4 aa, Mycobacterium tuberculosis
TARQ

SEQ ID NO: 1403505 - protein, 5 aa, Mycobacterium tuberculosis
TARQL

SEQ ID NO: 1403506 - protein, 4 aa, Mycobacterium tuberculosis
TARR

SEQ ID NO: 1403507 - protein, 6 aa, Mycobacterium tuberculosis
TARRRK

SEQ ID NO: 1403508 - protein, 6 aa, Mycobacterium tuberculosis
TASAAA

SEQ ID NO: 1403509 - protein, 20 aa, Mycobacterium tuberculosis
TASAEYDKEAADLSDEKLRK

SEQ ID NO: 1403510 - protein, 8 aa, Mycobacterium tuberculosis
TASAKGKE

SEQ ID NO: 1403511 - protein, 10 aa, Mycobacterium tuberculosis
TASAKSPLAR

SEQ ID NO: 1403512 - protein, 7 aa, Mycobacterium tuberculosis
TASGSAR

SEQ ID NO: 1403513 - protein, 6 aa, Mycobacterium tuberculosis
TASGTR

SEQ ID NO: 1403514 - protein, 11 aa, Mycobacterium tuberculosis
TASRMSPEAKR

SEQ ID NO: 1403515 - protein, 9 aa, Mycobacterium tuberculosis
TATGATPHN

SEQ ID NO: 1403516 - protein, 8 aa, Mycobacterium tuberculosis
TATGIAGT

SEQ ID NO: 1403517 - protein, 19 aa, Mycobacterium tuberculosis
TATNQDGRTETLTMPSEDA

SEQ ID NO: 1403518 - protein, 5 aa, Mycobacterium tuberculosis
TATPV

SEQ ID NO: 1403519 - protein, 4 aa, Mycobacterium tuberculosis
TATR

SEQ ID NO: 1403520 - protein, 7 aa, Mycobacterium tuberculosis
TATSGAD

SEQ ID NO: 1403521 - protein, 7 aa, Mycobacterium tuberculosis
TATTGGK

SEQ ID NO: 1403522 - protein, 18 aa, Mycobacterium tuberculosis
TCGPAHGPLPADLGSHPS

SEQ ID NO: 1403523 - protein, 7 aa, Mycobacterium tuberculosis
TCPSSDG

SEQ ID NO: 1403524 - protein, 24 aa, Mycobacterium tuberculosis
TDAARTVNQAAGAMASQPPPPGSL

SEQ ID NO: 1403525 - protein, 7 aa, Mycobacterium tuberculosis
TDADPGR

SEQ ID NO: 1403526 - protein, 7 aa, Mycobacterium tuberculosis
TDADREA

SEQ ID NO: 1403527 - protein, 5 aa, Mycobacterium tuberculosis
TDAEG

SEQ ID NO: 1403528 - protein, 7 aa, Mycobacterium tuberculosis
TDAEPRW

SEQ ID NO: 1403529 - protein, 10 aa, Mycobacterium tuberculosis
TDAERADHRE

SEQ ID NO: 1403530 - protein, 4 aa, Mycobacterium tuberculosis
TDAH

SEQ ID NO: 1403531 - protein, 8 aa, Mycobacterium tuberculosis
TDAKGRRY

SEQ ID NO: 1403532 - protein, 5 aa, Mycobacterium tuberculosis
TDANQ

SEQ ID NO: 1403533 - protein, 10 aa, Mycobacterium tuberculosis
TDATPSQREI

SEQ ID NO: 1403534 - protein, 4 aa, Mycobacterium tuberculosis
TDDG

SEQ ID NO: 1403535 - protein, 13 aa, Mycobacterium tuberculosis
TDDPADRFAPGTR

SEQ ID NO: 1403536 - protein, 9 aa, Mycobacterium tuberculosis
TDDPDEGEA

SEQ ID NO: 1403537 - protein, 15 aa, Mycobacterium tuberculosis
TDDPSNDGVLPAPVD

SEQ ID NO: 1403538 - protein, 5 aa, Mycobacterium tuberculosis
TDEHG

SEQ ID NO: 1403539 - protein, 5 aa, Mycobacterium tuberculosis
TDEPD

SEQ ID NO: 1403540 - protein, 5 aa, Mycobacterium tuberculosis
TDERG

SEQ ID NO: 1403541 - protein, 7 aa, Mycobacterium tuberculosis
TDETTTQ

SEQ ID NO: 1403542 - protein, 6 aa, Mycobacterium tuberculosis
TDGPRL

SEQ ID NO: 1403543 - protein, 4 aa, Mycobacterium tuberculosis
TDGQ

SEQ ID NO: 1403544 - protein, 11 aa, Mycobacterium tuberculosis
TDGQGGLQERR

SEQ ID NO: 1403545 - protein, 16 aa, Mycobacterium tuberculosis
TDGRYRTQAASQAPDL

SEQ ID NO: 1403546 - protein, 15 aa, Mycobacterium tuberculosis
TDGSEPSRRIIAQRS

SEQ ID NO: 1403547 - protein, 6 aa, Mycobacterium tuberculosis
TDGSRI

SEQ ID NO: 1403548 - protein, 8 aa, Mycobacterium tuberculosis
TDGTADTK

SEQ ID NO: 1403549 - protein, 5 aa, Mycobacterium tuberculosis
TDGVG

SEQ ID NO: 1403550 - protein, 6 aa, Mycobacterium tuberculosis
TDKADI

SEQ ID NO: 1403551 - protein, 6 aa, Mycobacterium tuberculosis
TDLGGI

SEQ ID NO: 1403552 - protein, 4 aa, Mycobacterium tuberculosis
TDLP

SEQ ID NO: 1403553 - protein, 5 aa, Mycobacterium tuberculosis
TDNDA

SEQ ID NO: 1403554 - protein, 8 aa, Mycobacterium tuberculosis
TDNPDSIV

SEQ ID NO: 1403555 - protein, 7 aa, Mycobacterium tuberculosis
TDNPNPA

SEQ ID NO: 1403556 - protein, 31 aa, Mycobacterium tuberculosis; identical to SEQ ID NO: 189082

SEQ ID NO: 1403557 - protein, 4 aa, Mycobacterium tuberculosis
TDPD

SEQ ID NO: 1403558 - protein, 9 aa, Mycobacterium tuberculosis
TDPDAPKHK

SEQ ID NO: 1403559 - protein, 5 aa, Mycobacterium tuberculosis
TDPDS

SEQ ID NO: 1403560 - protein, 6 aa, Mycobacterium tuberculosis
TDPDSR

SEQ ID NO: 1403561 - protein, 6 aa, Mycobacterium tuberculosis
TDPESV

SEQ ID NO: 1403562 - protein, 4 aa, Mycobacterium tuberculosis
TDPH

SEQ ID NO: 1403563 - protein, 22 aa, Mycobacterium tuberculosis
TDPMGGPPAKRGAPLGEQDAEV

SEQ ID NO: 1403564 - protein, 9 aa, Mycobacterium tuberculosis
TDPPATRQA

SEQ ID NO: 1403565 - protein, 15 aa, Mycobacterium tuberculosis
TDPTESLTHLVSGSA

SEQ ID NO: 1403566 - protein, 6 aa, Mycobacterium tuberculosis
TDQRAH

SEQ ID NO: 1403567 - protein, 5 aa, Mycobacterium tuberculosis
TDRAE

SEQ ID NO: 1403568 - protein, 21 aa, Mycobacterium tuberculosis
TDRALSAKGLEDAVHRAISEG

SEQ ID NO: 1403569 - protein, 6 aa, Mycobacterium tuberculosis
TDRGRP

SEQ ID NO: 1403570 - protein, 4 aa, Mycobacterium tuberculosis
TDRL

SEQ ID NO: 1403571 - protein, 5 aa, Mycobacterium tuberculosis
TDRNG

SEQ ID NO: 1403572 - protein, 4 aa, Mycobacterium tuberculosis
TDRP

SEQ ID NO: 1403573 - protein, 12 aa, Mycobacterium tuberculosis
TDRQRSSSAGGL

SEQ ID NO: 1403574 - protein, 11 aa, Mycobacterium tuberculosis
TDRQSGTPSSY

SEQ ID NO: 1403575 - protein, 8 aa, Mycobacterium tuberculosis
TDRRTRQS

SEQ ID NO: 1403576 - protein, 9 aa, Mycobacterium tuberculosis
TDSGKSAAR

SEQ ID NO: 1403577 - protein, 8 aa, Mycobacterium tuberculosis
TDSKDSTR

SEQ ID NO: 1403578 - protein, 7 aa, Mycobacterium tuberculosis
TDTASAY

SEQ ID NO: 1403579 - protein, 14 aa, Mycobacterium tuberculosis
TDTDGDGTADGASS

SEQ ID NO: 1403580 - protein, 6 aa, Mycobacterium tuberculosis
TDTEAG

SEQ ID NO: 1403581 - protein, 6 aa, Mycobacterium tuberculosis
TDTGRQ

SEQ ID NO: 1403582 - protein, 7 aa, Mycobacterium tuberculosis
TDTPSTI

SEQ ID NO: 1403583 - protein, 7 aa, Mycobacterium tuberculosis
TDTVGNP

SEQ ID NO: 1403584 - protein, 7 aa, Mycobacterium tuberculosis
TDYPAAA

SEQ ID NO: 1403585 - protein, 5 aa, Mycobacterium tuberculosis
TEAGA

SEQ ID NO: 1403586 - protein, 8 aa, Mycobacterium tuberculosis
TEAGRHSG

SEQ ID NO: 1403587 - protein, 12 aa, Mycobacterium tuberculosis
TEAGVSEPTLPR

SEQ ID NO: 1403588 - protein, 11 aa, Mycobacterium tuberculosis
TEAKVRGYQPG

SEQ ID NO: 1403589 - protein, 6 aa, Mycobacterium tuberculosis
TEALPG

SEQ ID NO: 1403590 - protein, 5 aa, Mycobacterium tuberculosis
TEAPG

SEQ ID NO: 1403591 - protein, 4 aa, Mycobacterium tuberculosis
TEAR

SEQ ID NO: 1403592 - protein, 12 aa, Mycobacterium tuberculosis
TEASRRADNPAL

SEQ ID NO: 1403593 - protein, 11 aa, Mycobacterium tuberculosis
TEDDDGNRFSD

SEQ ID NO: 1403594 - protein, 14 aa, Mycobacterium tuberculosis
TEDEAPNTKGGMDK

SEQ ID NO: 1403595 - protein, 5 aa, Mycobacterium tuberculosis
TEDKY

SEQ ID NO: 1403596 - protein, 9 aa, Mycobacterium tuberculosis
TEDPPTDQI

SEQ ID NO: 1403597 - protein, 7 aa, Mycobacterium tuberculosis
TEDQSEG

SEQ ID NO: 1403598 - protein, 8 aa, Mycobacterium tuberculosis
TEDRADKG

SEQ ID NO: 1403599 - protein, 7 aa, Mycobacterium tuberculosis
TEEAREA

SEQ ID NO: 1403600 - protein, 4 aa, Mycobacterium tuberculosis
TEEF

SEQ ID NO: 1403601 - protein, 5 aa, Mycobacterium tuberculosis
TEEPA

SEQ ID NO: 1403602 - protein, 5 aa, Mycobacterium tuberculosis
TEEPE

SEQ ID NO: 1403603 - protein, 6 aa, Mycobacterium tuberculosis
TEEQKQ

SEQ ID NO: 1403604 - protein, 15 aa, Mycobacterium tuberculosis
TEEVSGKQARELSDD

SEQ ID NO: 1403605 - protein, 6 aa, Mycobacterium tuberculosis
TEFARR

SEQ ID NO: 1403606 - protein, 6 aa, Mycobacterium tuberculosis
TEGADG

SEQ ID NO: 1403607 - protein, 9 aa, Mycobacterium tuberculosis
TEKGSQRHA

SEQ ID NO: 1403608 - protein, 11 aa, Mycobacterium tuberculosis
TELAEHDQSDH

SEQ ID NO: 1403609 - protein, 6 aa, Mycobacterium tuberculosis
TENPAG

SEQ ID NO: 1403610 - protein, 5 aa, Mycobacterium tuberculosis
TEPEQ

SEQ ID NO: 1403611 - protein, 19 aa, Mycobacterium tuberculosis
TEPGAGSDAGSTRTTARLE

SEQ ID NO: 1403612 - protein, 10 aa, Mycobacterium tuberculosis
TEPGGGSDVG

SEQ ID NO: 1403613 - protein, 6 aa, Mycobacterium tuberculosis
TEPQTV

SEQ ID NO: 1403614 - protein, 6 aa, Mycobacterium tuberculosis
TEPSAD

SEQ ID NO: 1403615 - protein, 10 aa, Mycobacterium tuberculosis
TEPTSPQDAW

SEQ ID NO: 1403616 - protein, 7 aa, Mycobacterium tuberculosis
TEQTGGL

SEQ ID NO: 1403617 - protein, 6 aa, Mycobacterium tuberculosis
TERATA

SEQ ID NO: 1403618 - protein, 6 aa, Mycobacterium tuberculosis
TERATD

SEQ ID NO: 1403619 - protein, 12 aa, Mycobacterium tuberculosis
TERGSDYAGSLP

SEQ ID NO: 1403620 - protein, 4 aa, Mycobacterium tuberculosis
TERQ

SEQ ID NO: 1403621 - protein, 8 aa, Mycobacterium tuberculosis
TESPELSA

SEQ ID NO: 1403622 - protein, 7 aa, Mycobacterium tuberculosis
TETADEW

SEQ ID NO: 1403623 - protein, 9 aa, Mycobacterium tuberculosis
TETGETHTI

SEQ ID NO: 1403624 - protein, 5 aa, Mycobacterium tuberculosis
TETGS

SEQ ID NO: 1403625 - protein, 10 aa, Mycobacterium tuberculosis
TFADPSALDG

SEQ ID NO: 1403626 - protein, 6 aa, Mycobacterium tuberculosis
TFDGSA

SEQ ID NO: 1403627 - protein, 9 aa, Mycobacterium tuberculosis
TFGGEPNTQ

SEQ ID NO: 1403628 - protein, 5 aa, Mycobacterium tuberculosis
TFNTS

SEQ ID NO: 1403629 - protein, 15 aa, Mycobacterium tuberculosis
TFPDGTKLVTVHQPI

SEQ ID NO: 1403630 - protein, 9 aa, Mycobacterium tuberculosis
TFPSSSPDE

SEQ ID NO: 1403631 - protein, 4 aa, Mycobacterium tuberculosis
TFQQ

SEQ ID NO: 1403632 - protein, 7 aa, Mycobacterium tuberculosis
TGAAQRA

SEQ ID NO: 1403633 - protein, 9 aa, Mycobacterium tuberculosis
TGADTDPTV

SEQ ID NO: 1403634 - protein, 6 aa, Mycobacterium tuberculosis
TGAEHP

SEQ ID NO: 1403635 - protein, 9 aa, Mycobacterium tuberculosis
TGAGSDEDL

SEQ ID NO: 1403636 - protein, 6 aa, Mycobacterium tuberculosis
TGAKND

SEQ ID NO: 1403637 - protein, 8 aa, Mycobacterium tuberculosis
TGAPPAKQ

SEQ ID NO: 1403638 - protein, 5 aa, Mycobacterium tuberculosis
TGAST

SEQ ID NO: 1403639 - protein, 8 aa, Mycobacterium tuberculosis
TGCAGEPQ

SEQ ID NO: 1403640 - protein, 5 aa, Mycobacterium tuberculosis
TGCHQ

SEQ ID NO: 1403641 - protein, 4 aa, Mycobacterium tuberculosis
TGCR

SEQ ID NO: 1403642 - protein, 14 aa, Mycobacterium tuberculosis
TGDAAAGERTPEQT

SEQ ID NO: 1403643 - protein, 14 aa, Mycobacterium tuberculosis
TGDDAERSDEKERR

SEQ ID NO: 1403644 - protein, 10 aa, Mycobacterium tuberculosis
TGDDGRPSKV

SEQ ID NO: 1403645 - protein, 13 aa, Mycobacterium tuberculosis
TGDFNTGSSNTGF

SEQ ID NO: 1403646 - protein, 4 aa, Mycobacterium tuberculosis
TGDQ

SEQ ID NO: 1403647 - protein, 7 aa, Mycobacterium tuberculosis
TGDQLQG

SEQ ID NO: 1403648 - protein, 5 aa, Mycobacterium tuberculosis
TGDSE

SEQ ID NO: 1403649 - protein, 5 aa, Mycobacterium tuberculosis
TGDTF

SEQ ID NO: 1403650 - protein, 9 aa, Mycobacterium tuberculosis
TGDYQEPGL

SEQ ID NO: 1403651 - protein, 4 aa, Mycobacterium tuberculosis
TGED

SEQ ID NO: 1403652 - protein, 10 aa, Mycobacterium tuberculosis
TGEEDRPGAV

SEQ ID NO: 1403653 - protein, 5 aa, Mycobacterium tuberculosis
TGEEF

SEQ ID NO: 1403654 - protein, 5 aa, Mycobacterium tuberculosis
TGEEY

SEQ ID NO: 1403655 - protein, 11 aa, Mycobacterium tuberculosis
TGEGKGKSTAA

SEQ ID NO: 1403656 - protein, 8 aa, Mycobacterium tuberculosis
TGEGKTLA

SEQ ID NO: 1403657 - protein, 9 aa, Mycobacterium tuberculosis
TGEGTTGLG

SEQ ID NO: 1403658 - protein, 4 aa, Mycobacterium tuberculosis
TGEL

SEQ ID NO: 1403659 - protein, 8 aa, Mycobacterium tuberculosis
TGEPGERN

SEQ ID NO: 1403660 - protein, 7 aa, Mycobacterium tuberculosis
TGERGSG

SEQ ID NO: 1403661 - protein, 4 aa, Mycobacterium tuberculosis
TGFA

SEQ ID NO: 1403662 - protein, 24 aa, Mycobacterium tuberculosis
TGFGNSGQANTGIGNAGDFNTGNF

SEQ ID NO: 1403663 - protein, 7 aa, Mycobacterium tuberculosis
TGFTPGK

SEQ ID NO: 1403664 - protein, 5 aa, Mycobacterium tuberculosis
TGGCP

SEQ ID NO: 1403665 - protein, 4 aa, Mycobacterium tuberculosis
TGGE

SEQ ID NO: 1403666 - protein, 4 aa, Mycobacterium tuberculosis
TGGF

SEQ ID NO: 1403667 - protein, 6 aa, Mycobacterium tuberculosis
TGGFTP

SEQ ID NO: 1403668 - protein, 8 aa, Mycobacterium tuberculosis
TGGGRGLG

SEQ ID NO: 1403669 - protein, 8 aa, Mycobacterium tuberculosis
TGGGSGIG

SEQ ID NO: 1403670 - protein, 4 aa, Mycobacterium tuberculosis
TGGN

SEQ ID NO: 1403671 - protein, 5 aa, Mycobacterium tuberculosis
TGGPV

SEQ ID NO: 1403672 - protein, 4 aa, Mycobacterium tuberculosis
TGGQ

SEQ ID NO: 1403673 - protein, 4 aa, Mycobacterium tuberculosis
TGGS

SEQ ID NO: 1403674 - protein, 19 aa, Mycobacterium tuberculosis
TGGSGRMYKTTSNAHTLTG

SEQ ID NO: 1403675 - protein, 14 aa, Mycobacterium tuberculosis
TGGTTGKPKGVIGT

SEQ ID NO: 1403676 - protein, 12 aa, Mycobacterium tuberculosis
TGHAQRPGDPTL

SEQ ID NO: 1403677 - protein, 5 aa, Mycobacterium tuberculosis
TGHTT

SEQ ID NO: 1403678 - protein, 8 aa, Mycobacterium tuberculosis
TGISKSEV

SEQ ID NO: 1403679 - protein, 9 aa, Mycobacterium tuberculosis
TGKAGNKRW

SEQ ID NO: 1403680 - protein, 14 aa, Mycobacterium tuberculosis
TGKAHGAALGDDEV

SEQ ID NO: 1403681 - protein, 6 aa, Mycobacterium tuberculosis
TGKLER

SEQ ID NO: 1403682 - protein, 7 aa, Mycobacterium tuberculosis
TGLAEEN

SEQ ID NO: 1403683 - protein, 12 aa, Mycobacterium tuberculosis
TGLNRNGVGPAQ

SEQ ID NO: 1403684 - protein, 8 aa, Mycobacterium tuberculosis
TGMAPQPR

SEQ ID NO: 1403685 - protein, 5 aa, Mycobacterium tuberculosis
TGMGR

SEQ ID NO: 1403686 - protein, 7 aa, Mycobacterium tuberculosis
TGNAPLT

SEQ ID NO: 1403687 - protein, 6 aa, Mycobacterium tuberculosis
TGNDGD

SEQ ID NO: 1403688 - protein, 8 aa, Mycobacterium tuberculosis
TGNESPAE

SEQ ID NO: 1403689 - protein, 10 aa, Mycobacterium tuberculosis
TGNPNRPDGG

SEQ ID NO: 1403690 - protein, 17 aa, Mycobacterium tuberculosis
TGNTNTGIANSGNVNTG

SEQ ID NO: 1403691 - protein, 10 aa, Mycobacterium tuberculosis
TGNYNSKTAR

SEQ ID NO: 1403692 - protein, 6 aa, Mycobacterium tuberculosis
TGPAEM

SEQ ID NO: 1403693 - protein, 10 aa, Mycobacterium tuberculosis
TGPEVTGPGE

SEQ ID NO: 1403694 - protein, 7 aa, Mycobacterium tuberculosis
TGPGGER

SEQ ID NO: 1403695 - protein, 5 aa, Mycobacterium tuberculosis
TGPGQ

SEQ ID NO: 1403696 - protein, 6 aa, Mycobacterium tuberculosis
TGPHAL

SEQ ID NO: 1403697 - protein, 6 aa, Mycobacterium tuberculosis
TGPNQF

SEQ ID NO: 1403698 - protein, 13 aa, Mycobacterium tuberculosis
TGPPVELADATHR

SEQ ID NO: 1403699 - protein, 15 aa, Mycobacterium tuberculosis
TGPVPGARVVSAPTE

SEQ ID NO: 1403700 - protein, 7 aa, Mycobacterium tuberculosis
TGPYTDE

SEQ ID NO: 1403701 - protein, 15 aa, Mycobacterium tuberculosis
TGQAPPGPPASGPCA

SEQ ID NO: 1403702 - protein, 7 aa, Mycobacterium tuberculosis
TGQDSGV

SEQ ID NO: 1403703 - protein, 8 aa, Mycobacterium tuberculosis
TGQGEGDV

SEQ ID NO: 1403704 - protein, 5 aa, Mycobacterium tuberculosis
TGQGY

SEQ ID NO: 1403705 - protein, 4 aa, Mycobacterium tuberculosis
TGQP

SEQ ID NO: 1403706 - protein, 6 aa, Mycobacterium tuberculosis
TGQSDF

SEQ ID NO: 1403707 - protein, 15 aa, Mycobacterium tuberculosis
TGRGHRIGAPDETNF

SEQ ID NO: 1403708 - protein, 30 aa, Mycobacterium tuberculosis; identical to SEQ ID NO: 189512

SEQ ID NO: 1403709 - protein, 5 aa, Mycobacterium tuberculosis
TGRPY

SEQ ID NO: 1403710 - protein, 6 aa, Mycobacterium tuberculosis
TGRPYQ

SEQ ID NO: 1403711 - protein, 18 aa, Mycobacterium tuberculosis
TGSGDPQKFDPDASRETL

SEQ ID NO: 1403712 - protein, 12 aa, Mycobacterium tuberculosis
TGSGTSSNMNTN

SEQ ID NO: 1403713 - protein, 7 aa, Mycobacterium tuberculosis
TGSIGTQ

SEQ ID NO: 1403714 - protein, 9 aa, Mycobacterium tuberculosis
TGSNPKAKR

SEQ ID NO: 1403715 - protein, 10 aa, Mycobacterium tuberculosis
TGSPRIGPRR

SEQ ID NO: 1403716 - protein, 6 aa, Mycobacterium tuberculosis
TGTDEL

SEQ ID NO: 1403717 - protein, 11 aa, Mycobacterium tuberculosis
TGTGNSLNARH

SEQ ID NO: 1403718 - protein, 15 aa, Mycobacterium tuberculosis
TGTPKSDRTGTGTRS

SEQ ID NO: 1403719 - protein, 9 aa, Mycobacterium tuberculosis
TGTPSGAAG

SEQ ID NO: 1403720 - protein, 9 aa, Mycobacterium tuberculosis
TGTQGEPMS

SEQ ID NO: 1403721 - protein, 9 aa, Mycobacterium tuberculosis
TGTREYGRT

SEQ ID NO: 1403722 - protein, 20 aa, Mycobacterium tuberculosis
TGTWSTEGAYDEQDYAETEQ

SEQ ID NO: 1403723 - protein, 9 aa, Mycobacterium tuberculosis
TGVEPTDDA

SEQ ID NO: 1403724 - protein, 11 aa, Mycobacterium tuberculosis
TGVGSHREPSA

SEQ ID NO: 1403725 - protein, 12 aa, Mycobacterium tuberculosis
TGVKDRASVNTE

SEQ ID NO: 1403726 - protein, 10 aa, Mycobacterium tuberculosis
TGVSERDKHN

SEQ ID NO: 1403727 - protein, 11 aa, Mycobacterium tuberculosis
TGVSGSGKSTL

SEQ ID NO: 1403728 - protein, 5 aa, Mycobacterium tuberculosis
TGWSE

SEQ ID NO: 1403729 - protein, 30 aa, Mycobacterium tuberculosis; identical to SEQ ID NO: 57507

SEQ ID NO: 1403730 - protein, 5 aa, Mycobacterium tuberculosis
TGYND

SEQ ID NO: 1403731 - protein, 5 aa, Mycobacterium tuberculosis
THDSG

SEQ ID NO: 1403732 - protein, 6 aa, Mycobacterium tuberculosis
THGDGE

SEQ ID NO: 1403733 - protein, 10 aa, Mycobacterium tuberculosis
THGGRRGTGM

SEQ ID NO: 1403734 - protein, 8 aa, Mycobacterium tuberculosis
THKYPNET

SEQ ID NO: 1403735 - protein, 13 aa, Mycobacterium tuberculosis
THNDTDASASSGK

SEQ ID NO: 1403736 - protein, 14 aa, Mycobacterium tuberculosis
THPNYPDRHEPSHP

SEQ ID NO: 1403737 - protein, 12 aa, Mycobacterium tuberculosis
THRARSGPRVGV

SEQ ID NO: 1403738 - protein, 7 aa, Mycobacterium tuberculosis
TIDQPDH

SEQ ID NO: 1403739 - protein, 7 aa, Mycobacterium tuberculosis
TIDRPSA

SEQ ID NO: 1403740 - protein, 13 aa, Mycobacterium tuberculosis
TIGPDGSLRTQSG

SEQ ID NO: 1403741 - protein, 7 aa, Mycobacterium tuberculosis
TIGPGGV

SEQ ID NO: 1403742 - protein, 7 aa, Mycobacterium tuberculosis
TKAKDRG

SEQ ID NO: 1403743 - protein, 4 aa, Mycobacterium tuberculosis
TKAL

SEQ ID NO: 1403744 - protein, 7 aa, Mycobacterium tuberculosis
TKDPEKF

SEQ ID NO: 1403745 - protein, 13 aa, Mycobacterium tuberculosis
TKGPQGKRLGKTT

SEQ ID NO: 1403746 - protein, 8 aa, Mycobacterium tuberculosis
TKLRSRAD

SEQ ID NO: 1403747 - protein, 10 aa, Mycobacterium tuberculosis
TKMTPAPTQP

SEQ ID NO: 1403748 - protein, 32 aa, Mycobacterium tuberculosis; identical to SEQ ID NO: 189653

SEQ ID NO: 1403749 - protein, 13 aa, Mycobacterium tuberculosis
TKQHSAEYQSQAP

SEQ ID NO: 1403750 - protein, 5 aa, Mycobacterium tuberculosis
TKRAN

SEQ ID NO: 1403751 - protein, 10 aa, Mycobacterium tuberculosis
TKRGARKSYT

SEQ ID NO: 1403752 - protein, 6 aa, Mycobacterium tuberculosis
TKTCTG

SEQ ID NO: 1403753 - protein, 17 aa, Mycobacterium tuberculosis
TKVGEEIAKETLVVGGA

SEQ ID NO: 1403754 - protein, 9 aa, Mycobacterium tuberculosis
TKVSRSAED

SEQ ID NO: 1403755 - protein, 8 aa, Mycobacterium tuberculosis
TLAPSTAT

SEQ ID NO: 1403756 - protein, 8 aa, Mycobacterium tuberculosis
TLARDGGR

SEQ ID NO: 1403757 - protein, 10 aa, Mycobacterium tuberculosis
TLDGDQTAEF

SEQ ID NO: 1403758 - protein, 4 aa, Mycobacterium tuberculosis
TLDP

SEQ ID NO: 1403759 - protein, 4 aa, Mycobacterium tuberculosis
TLGE

SEQ ID NO: 1403760 - protein, 5 aa, Mycobacterium tuberculosis
TLGNE

SEQ ID NO: 1403761 - protein, 6 aa, Mycobacterium tuberculosis
TLGPKG

SEQ ID NO: 1403762 - protein, 12 aa, Mycobacterium tuberculosis
TLNGSAADVHRR

SEQ ID NO: 1403763 - protein, 9 aa, Mycobacterium tuberculosis
TLPAEPAKT

SEQ ID NO: 1403764 - protein, 5 aa, Mycobacterium tuberculosis
TLPAG

SEQ ID NO: 1403765 - protein, 10 aa, Mycobacterium tuberculosis
TLPAGPAGRW

SEQ ID NO: 1403766 - protein, 23 aa, Mycobacterium tuberculosis
TLPEDDDHPYRTGPWRPQTTEWD

SEQ ID NO: 1403767 - protein, 17 aa, Mycobacterium tuberculosis
TLPPGLGDAQAAAVTTA

SEQ ID NO: 1403768 - protein, 19 aa, Mycobacterium tuberculosis
TLPPGTALTPLGRDQARAF

SEQ ID NO: 1403769 - protein, 4 aa, Mycobacterium tuberculosis
TLQA

SEQ ID NO: 1403770 - protein, 7 aa, Mycobacterium tuberculosis
TLSERAD

SEQ ID NO: 1403771 - protein, 8 aa, Mycobacterium tuberculosis
TLSGAPKV

SEQ ID NO: 1403772 - protein, 6 aa, Mycobacterium tuberculosis
TLSPDD

SEQ ID NO: 1403773 - protein, 7 aa, Mycobacterium tuberculosis
TLSPDED

SEQ ID NO: 1403774 - protein, 8 aa, Mycobacterium tuberculosis
TLTDSARG

SEQ ID NO: 1403775 - protein, 6 aa, Mycobacterium tuberculosis
TLTGAQ

SEQ ID NO: 1403776 - protein, 8 aa, Mycobacterium tuberculosis
TLTPDDDA

SEQ ID NO: 1403777 - protein, 9 aa, Mycobacterium tuberculosis
TLTPDQAAG

SEQ ID NO: 1403778 - protein, 7 aa, Mycobacterium tuberculosis
TMASGQQ

SEQ ID NO: 1403779 - protein, 12 aa, Mycobacterium tuberculosis
TMRATASPGSLD

SEQ ID NO: 1403780 - protein, 12 aa, Mycobacterium tuberculosis
TNADSASPGVSD

SEQ ID NO: 1403781 - protein, 5 aa, Mycobacterium tuberculosis
TNATA

SEQ ID NO: 1403782 - protein, 5 aa, Mycobacterium tuberculosis
TNDDG

SEQ ID NO: 1403783 - protein, 14 aa, Mycobacterium tuberculosis
TNDDQGDQGDVQPA

SEQ ID NO: 1403784 - protein, 22 aa, Mycobacterium tuberculosis
TNDGASSRAKGHRSAAPGRRKI

SEQ ID NO: 1403785 - protein, 10 aa, Mycobacterium tuberculosis
TNGIGVGSSD

SEQ ID NO: 1403786 - protein, 17 aa, Mycobacterium tuberculosis
TNGTSGAVRQPGSSNPS

SEQ ID NO: 1403787 - protein, 8 aa, Mycobacterium tuberculosis
TNGWTREG

SEQ ID NO: 1403788 - protein, 12 aa, Mycobacterium tuberculosis
TNIGHTGGAAGI

SEQ ID NO: 1403789 - protein, 9 aa, Mycobacterium tuberculosis
TNKAPAPGM

SEQ ID NO: 1403790 - protein, 7 aa, Mycobacterium tuberculosis
TNLSPKD

SEQ ID NO: 1403791 - protein, 10 aa, Mycobacterium tuberculosis
TNNDDPAGAC

SEQ ID NO: 1403792 - protein, 6 aa, Mycobacterium tuberculosis
TNNLPD

SEQ ID NO: 1403793 - protein, 8 aa, Mycobacterium tuberculosis
TNPARPRA

SEQ ID NO: 1403794 - protein, 10 aa, Mycobacterium tuberculosis
TNPDAAAHQQ

SEQ ID NO: 1403795 - protein, 13 aa, Mycobacterium tuberculosis
TNPESSGAKKHRG

SEQ ID NO: 1403796 - protein, 7 aa, Mycobacterium tuberculosis
TNPGTIG

SEQ ID NO: 1403797 - protein, 9 aa, Mycobacterium tuberculosis
TNPLSGHGA

SEQ ID NO: 1403798 - protein, 5 aa, Mycobacterium tuberculosis
TNPPI

SEQ ID NO: 1403799 - protein, 12 aa, Mycobacterium tuberculosis
TNPTENMETEAT

SEQ ID NO: 1403800 - protein, 9 aa, Mycobacterium tuberculosis
TNPVADSPV

SEQ ID NO: 1403801 - protein, 8 aa, Mycobacterium tuberculosis
TNRRNPGA

SEQ ID NO: 1403802 - protein, 10 aa, Mycobacterium tuberculosis
TNSDGSPTGG

SEQ ID NO: 1403803 - protein, 10 aa, Mycobacterium tuberculosis
TNTSATGDLD

SEQ ID NO: 1403804 - protein, 18 aa, Mycobacterium tuberculosis
TNTVNYSSELPLAQGVKF

SEQ ID NO: 1403805 - protein, 8 aa, Mycobacterium tuberculosis
TPADGSAP

SEQ ID NO: 1403806 - protein, 4 aa, Mycobacterium tuberculosis
TPAE

SEQ ID NO: 1403807 - protein, 10 aa, Mycobacterium tuberculosis
TPAEESGGGK

SEQ ID NO: 1403808 - protein, 10 aa, Mycobacterium tuberculosis
TPAQLGGVSP

SEQ ID NO: 1403809 - protein, 4 aa, Mycobacterium tuberculosis
TPAR

SEQ ID NO: 1403810 - protein, 6 aa, Mycobacterium tuberculosis
TPATRA

SEQ ID NO: 1403811 - protein, 4 aa, Mycobacterium tuberculosis
TPAV

SEQ ID NO: 1403812 - protein, 5 aa, Mycobacterium tuberculosis
TPDAV

SEQ ID NO: 1403813 - protein, 6 aa, Mycobacterium tuberculosis
TPDDDQ

SEQ ID NO: 1403814 - protein, 8 aa, Mycobacterium tuberculosis
TPDDHKAL

SEQ ID NO: 1403815 - protein, 20 aa, Mycobacterium tuberculosis
TPDRSIDEQAQEVIDLLESS

SEQ ID NO: 1403816 - protein, 7 aa, Mycobacterium tuberculosis
TPEAPGI

SEQ ID NO: 1403817 - protein, 10 aa, Mycobacterium tuberculosis
TPETNGEDNR

SEQ ID NO: 1403818 - protein, 6 aa, Mycobacterium tuberculosis
TPETPL

SEQ ID NO: 1403819 - protein, 5 aa, Mycobacterium tuberculosis
TPFND

SEQ ID NO: 1403820 - protein, 9 aa, Mycobacterium tuberculosis
TPGASEAIR

SEQ ID NO: 1403821 - protein, 5 aa, Mycobacterium tuberculosis
TPGDM

SEQ ID NO: 1403822 - protein, 7 aa, Mycobacterium tuberculosis
TPGHSPG

SEQ ID NO: 1403823 - protein, 7 aa, Mycobacterium tuberculosis
TPGHTAD

SEQ ID NO: 1403824 - protein, 16 aa, Mycobacterium tuberculosis
TPGRSPADTQDSVGGG

SEQ ID NO: 1403825 - protein, 14 aa, Mycobacterium tuberculosis
TPGRTDASQEQTDV

SEQ ID NO: 1403826 - protein, 10 aa, Mycobacterium tuberculosis
TPHPGEPGSQ

SEQ ID NO: 1403827 - protein, 20 aa, Mycobacterium tuberculosis
TPIGAQPVPDADPIDDGDSL

SEQ ID NO: 1403828 - protein, 10 aa, Mycobacterium tuberculosis
TPKRGDRTVT

SEQ ID NO: 1403829 - protein, 6 aa, Mycobacterium tuberculosis
TPPARQ

SEQ ID NO: 1403830 - protein, 6 aa, Mycobacterium tuberculosis
TPPPTW

SEQ ID NO: 1403831 - protein, 5 aa, Mycobacterium tuberculosis
TPPQP

SEQ ID NO: 1403832 - protein, 12 aa, Mycobacterium tuberculosis
TPPRPDAATRAG

SEQ ID NO: 1403833 - protein, 9 aa, Mycobacterium tuberculosis
TPPSGAPPD

SEQ ID NO: 1403834 - protein, 12 aa, Mycobacterium tuberculosis
TPPVGASQPGLF

SEQ ID NO: 1403835 - protein, 8 aa, Mycobacterium tuberculosis
TPQPATPL

SEQ ID NO: 1403836 - protein, 8 aa, Mycobacterium tuberculosis
TPQPQASI

SEQ ID NO: 1403837 - protein, 8 aa, Mycobacterium tuberculosis
TPQQGRTL

SEQ ID NO: 1403838 - protein, 6 aa, Mycobacterium tuberculosis
TPQQPG

SEQ ID NO: 1403839 - protein, 13 aa, Mycobacterium tuberculosis
TPRDTRRTPADAM

SEQ ID NO: 1403840 - protein, 9 aa, Mycobacterium tuberculosis
TPRPAPTVA

SEQ ID NO: 1403841 - protein, 10 aa, Mycobacterium tuberculosis
TPSAGTPEAP

SEQ ID NO: 1403842 - protein, 7 aa, Mycobacterium tuberculosis
TPSASDL

SEQ ID NO: 1403843 - protein, 8 aa, Mycobacterium tuberculosis
TPSDTRAD

SEQ ID NO: 1403844 - protein, 9 aa, Mycobacterium tuberculosis
TPSRERVES

SEQ ID NO: 1403845 - protein, 7 aa, Mycobacterium tuberculosis
TPSSRLE

SEQ ID NO: 1403846 - protein, 8 aa, Mycobacterium tuberculosis
TPSVDPPL

SEQ ID NO: 1403847 - protein, 17 aa, Mycobacterium tuberculosis
TPTAGPSLRRPAASTAA

SEQ ID NO: 1403848 - protein, 5 aa, Mycobacterium tuberculosis
TPTAS

SEQ ID NO: 1403849 - protein, 6 aa, Mycobacterium tuberculosis
TPTGPL

SEQ ID NO: 1403850 - protein, 6 aa, Mycobacterium tuberculosis
TPTSGF

SEQ ID NO: 1403851 - protein, 9 aa, Mycobacterium tuberculosis
TPTSNGSDE

SEQ ID NO: 1403852 - protein, 13 aa, Mycobacterium tuberculosis
TPTTRSPLTQPTV

SEQ ID NO: 1403853 - protein, 5 aa, Mycobacterium tuberculosis
TPTTV

SEQ ID NO: 1403854 - protein, 7 aa, Mycobacterium tuberculosis
TPYPPAR

SEQ ID NO: 1403855 - protein, 8 aa, Mycobacterium tuberculosis
TQADVDAG

SEQ ID NO: 1403856 - protein, 7 aa, Mycobacterium tuberculosis
TQAENEG

SEQ ID NO: 1403857 - protein, 15 aa, Mycobacterium tuberculosis
TQASVPPQGGRKHPH

SEQ ID NO: 1403858 - protein, 5 aa, Mycobacterium tuberculosis
TQDAR

SEQ ID NO: 1403859 - protein, 12 aa, Mycobacterium tuberculosis
TQEHTESRHAET

SEQ ID NO: 1403860 - protein, 6 aa, Mycobacterium tuberculosis
TQGEVG

SEQ ID NO: 1403861 - protein, 8 aa, Mycobacterium tuberculosis
TQGHQTDA

SEQ ID NO: 1403862 - protein, 6 aa, Mycobacterium tuberculosis
TQGTDQ

SEQ ID NO: 1403863 - protein, 4 aa, Mycobacterium tuberculosis
TQGV

SEQ ID NO: 1403864 - protein, 5 aa, Mycobacterium tuberculosis
TQGYT

SEQ ID NO: 1403865 - protein, 12 aa, Mycobacterium tuberculosis
TQIADGGTIAAL

SEQ ID NO: 1403866 - protein, 6 aa, Mycobacterium tuberculosis
TQIDPN

SEQ ID NO: 1403867 - protein, 6 aa, Mycobacterium tuberculosis
TQIPGT

SEQ ID NO: 1403868 - protein, 9 aa, Mycobacterium tuberculosis
TQKPSDLTS

SEQ ID NO: 1403869 - protein, 17 aa, Mycobacterium tuberculosis
TQPRSGDVTTAADSINS

SEQ ID NO: 1403870 - protein, 5 aa, Mycobacterium tuberculosis
TQRVR

SEQ ID NO: 1403871 - protein, 8 aa, Mycobacterium tuberculosis
TQSPGTVA

SEQ ID NO: 1403872 - protein, 9 aa, Mycobacterium tuberculosis
TQTGTGPTV

SEQ ID NO: 1403873 - protein, 9 aa, Mycobacterium tuberculosis
TQTPSGPVA

SEQ ID NO: 1403874 - protein, 7 aa, Mycobacterium tuberculosis
TQTRPQI

SEQ ID NO: 1403875 - protein, 8 aa, Mycobacterium tuberculosis
TRAATAYG

SEQ ID NO: 1403876 - protein, 10 aa, Mycobacterium tuberculosis
TRADGERRPG

SEQ ID NO: 1403877 - protein, 5 aa, Mycobacterium tuberculosis
TRAES

SEQ ID NO: 1403878 - protein, 4 aa, Mycobacterium tuberculosis
TRAG

SEQ ID NO: 1403879 - protein, 6 aa, Mycobacterium tuberculosis
TRASVD

SEQ ID NO: 1403880 - protein, 9 aa, Mycobacterium tuberculosis
TRATKGRAR

SEQ ID NO: 1403881 - protein, 5 aa, Mycobacterium tuberculosis
TRDDA

SEQ ID NO: 1403882 - protein, 6 aa, Mycobacterium tuberculosis
TRDPLG

SEQ ID NO: 1403883 - protein, 7 aa, Mycobacterium tuberculosis
TRDRARD

SEQ ID NO: 1403884 - protein, 11 aa, Mycobacterium tuberculosis
TRDTRTEAEQR

SEQ ID NO: 1403885 - protein, 8 aa, Mycobacterium tuberculosis
TRDVPAER

SEQ ID NO: 1403886 - protein, 6 aa, Mycobacterium tuberculosis
TRERRD

SEQ ID NO: 1403887 - protein, 11 aa, Mycobacterium tuberculosis
TRFKPAKAKEI

SEQ ID NO: 1403888 - protein, 8 aa, Mycobacterium tuberculosis
TRGDTAEE

SEQ ID NO: 1403889 - protein, 15 aa, Mycobacterium tuberculosis
TRGPGDSDRAPGADY

SEQ ID NO: 1403890 - protein, 10 aa, Mycobacterium tuberculosis
TRGQDAADTI

SEQ ID NO: 1403891 - protein, 13 aa, Mycobacterium tuberculosis
TRGVGSGAPGFSP

SEQ ID NO: 1403892 - protein, 7 aa, Mycobacterium tuberculosis
TRNASTG

SEQ ID NO: 1403893 - protein, 6 aa, Mycobacterium tuberculosis
TRNGQA

SEQ ID NO: 1403894 - protein, 22 aa, Mycobacterium tuberculosis
TRPARNDREEPSSARGAATTGV

SEQ ID NO: 1403895 - protein, 12 aa, Mycobacterium tuberculosis
TRPARNIGPGTI

SEQ ID NO: 1403896 - protein, 7 aa, Mycobacterium tuberculosis
TRPDAGS

SEQ ID NO: 1403897 - protein, 9 aa, Mycobacterium tuberculosis
TRPGGNKKR

SEQ ID NO: 1403898 - protein, 6 aa, Mycobacterium tuberculosis
TRPTLR

SEQ ID NO: 1403899 - protein, 6 aa, Mycobacterium tuberculosis
TRRDGT

SEQ ID NO: 1403900 - protein, 8 aa, Mycobacterium tuberculosis
TRSTPEKS

SEQ ID NO: 1403901 - protein, 4 aa, Mycobacterium tuberculosis
TRTA

SEQ ID NO: 1403902 - protein, 6 aa, Mycobacterium tuberculosis
TRTDRI

SEQ ID NO: 1403903 - protein, 6 aa, Mycobacterium tuberculosis
TRVKPG

SEQ ID NO: 1403904 - protein, 8 aa, Mycobacterium tuberculosis
TRVPPQRR

SEQ ID NO: 1403905 - protein, 9 aa, Mycobacterium tuberculosis
TRYGDGSVA

SEQ ID NO: 1403906 - protein, 17 aa, Mycobacterium tuberculosis
TSAEAAQTQTRIALRSR

SEQ ID NO: 1403907 - protein, 5 aa, Mycobacterium tuberculosis
TSAGI

SEQ ID NO: 1403908 - protein, 9 aa, Mycobacterium tuberculosis
TSAGRHPDS

SEQ ID NO: 1403909 - protein, 5 aa, Mycobacterium tuberculosis
TSAPA

SEQ ID NO: 1403910 - protein, 13 aa, Mycobacterium tuberculosis
TSAQAKAAADQAR

SEQ ID NO: 1403911 - protein, 8 aa, Mycobacterium tuberculosis
TSASASRL

SEQ ID NO: 1403912 - protein, 5 aa, Mycobacterium tuberculosis
TSATE

SEQ ID NO: 1403913 - protein, 8 aa, Mycobacterium tuberculosis
TSATTQAA

SEQ ID NO: 1403914 - protein, 4 aa, Mycobacterium tuberculosis
TSDE

SEQ ID NO: 1403915 - protein, 5 aa, Mycobacterium tuberculosis
TSDGA

SEQ ID NO: 1403916 - protein, 7 aa, Mycobacterium tuberculosis
TSDGSTL

SEQ ID NO: 1403917 - protein, 7 aa, Mycobacterium tuberculosis
TSDPDEL

SEQ ID NO: 1403918 - protein, 7 aa, Mycobacterium tuberculosis
TSDPQEL

SEQ ID NO: 1403919 - protein, 8 aa, Mycobacterium tuberculosis
TSDPTDAA

SEQ ID NO: 1403920 - protein, 13 aa, Mycobacterium tuberculosis
TSEDPYDLTREPE

SEQ ID NO: 1403921 - protein, 9 aa, Mycobacterium tuberculosis
TSEEDETAW

SEQ ID NO: 1403922 - protein, 8 aa, Mycobacterium tuberculosis
TSEKIGQS

SEQ ID NO: 1403923 - protein, 7 aa, Mycobacterium tuberculosis
TSGAGGL

SEQ ID NO: 1403924 - protein, 7 aa, Mycobacterium tuberculosis
TSGGGLQ

SEQ ID NO: 1403925 - protein, 17 aa, Mycobacterium tuberculosis
TSGPALQQNLVAVMEGR

SEQ ID NO: 1403926 - protein, 5 aa, Mycobacterium tuberculosis
TSGQL

SEQ ID NO: 1403927 - protein, 5 aa, Mycobacterium tuberculosis
TSGRA

SEQ ID NO: 1403928 - protein, 6 aa, Mycobacterium tuberculosis
TSGRAE

SEQ ID NO: 1403929 - protein, 10 aa, Mycobacterium tuberculosis
TSGTTAYPKG

SEQ ID NO: 1403930 - protein, 9 aa, Mycobacterium tuberculosis
TSKAEPTAR

SEQ ID NO: 1403931 - protein, 7 aa, Mycobacterium tuberculosis
TSLAGGT

SEQ ID NO: 1403932 - protein, 7 aa, Mycobacterium tuberculosis
TSLGTGE

SEQ ID NO: 1403933 - protein, 6 aa, Mycobacterium tuberculosis
TSLPGR

SEQ ID NO: 1403934 - protein, 14 aa, Mycobacterium tuberculosis
TSNARRAYGLGWMR

SEQ ID NO: 1403935 - protein, 8 aa, Mycobacterium tuberculosis
TSPAGARY

SEQ ID NO: 1403936 - protein, 10 aa, Mycobacterium tuberculosis
TSPEPFGAGT

SEQ ID NO: 1403937 - protein, 8 aa, Mycobacterium tuberculosis
TSPTNESK

SEQ ID NO: 1403938 - protein, 7 aa, Mycobacterium tuberculosis
TSQCTGD

SEQ ID NO: 1403939 - protein, 8 aa, Mycobacterium tuberculosis
TSRDLTEN

SEQ ID NO: 1403940 - protein, 7 aa, Mycobacterium tuberculosis
TSRRDGK

SEQ ID NO: 1403941 - protein, 8 aa, Mycobacterium tuberculosis
TSRRPVPI

SEQ ID NO: 1403942 - protein, 13 aa, Mycobacterium tuberculosis
TSSGIRTSDGVEH

SEQ ID NO: 1403943 - protein, 9 aa, Mycobacterium tuberculosis
TSSSSGTYG

SEQ ID NO: 1403944 - protein, 7 aa, Mycobacterium tuberculosis
TSSTQRP

SEQ ID NO: 1403945 - protein, 8 aa, Mycobacterium tuberculosis
TSTADANI

SEQ ID NO: 1403946 - protein, 5 aa, Mycobacterium tuberculosis
TSTPR

SEQ ID NO: 1403947 - protein, 10 aa, Mycobacterium tuberculosis
TSTRTPVQAA

SEQ ID NO: 1403948 - protein, 6 aa, Mycobacterium tuberculosis
TSTTKS

SEQ ID NO: 1403949 - protein, 9 aa, Mycobacterium tuberculosis
TSVAAASNT

SEQ ID NO: 1403950 - protein, 9 aa, Mycobacterium tuberculosis
TSYTNDGKP

SEQ ID NO: 1403951 - protein, 10 aa, Mycobacterium tuberculosis
TTAGSDAKRE

SEQ ID NO: 1403952 - protein, 8 aa, Mycobacterium tuberculosis
TTANGVEG

SEQ ID NO: 1403953 - protein, 6 aa, Mycobacterium tuberculosis
TTARGI

SEQ ID NO: 1403954 - protein, 6 aa, Mycobacterium tuberculosis
TTDAST

SEQ ID NO: 1403955 - protein, 4 aa, Mycobacterium tuberculosis
TTDE

SEQ ID NO: 1403956 - protein, 5 aa, Mycobacterium tuberculosis
TTDIR

SEQ ID NO: 1403957 - protein, 7 aa, Mycobacterium tuberculosis
TTDPIEG

SEQ ID NO: 1403958 - protein, 5 aa, Mycobacterium tuberculosis
TTDQR

SEQ ID NO: 1403959 - protein, 12 aa, Mycobacterium tuberculosis
TTDTRRTPTELR

SEQ ID NO: 1403960 - protein, 17 aa, Mycobacterium tuberculosis
TTEDESAGSGGLPPDDV

SEQ ID NO: 1403961 - protein, 15 aa, Mycobacterium tuberculosis
TTEDPANGFRPDTGR

SEQ ID NO: 1403962 - protein, 7 aa, Mycobacterium tuberculosis
TTEGERQ

SEQ ID NO: 1403963 - protein, 4 aa, Mycobacterium tuberculosis
TTEL

SEQ ID NO: 1403964 - protein, 7 aa, Mycobacterium tuberculosis
TTENPSF

SEQ ID NO: 1403965 - protein, 9 aa, Mycobacterium tuberculosis
TTEPAEYDQ

SEQ ID NO: 1403966 - protein, 6 aa, Mycobacterium tuberculosis
TTEPIA

SEQ ID NO: 1403967 - protein, 8 aa, Mycobacterium tuberculosis
TTERNPVP

SEQ ID NO: 1403968 - protein, 18 aa, Mycobacterium tuberculosis
TTGADKYATAEADNIKTF

SEQ ID NO: 1403969 - protein, 11 aa, Mycobacterium tuberculosis
TTGRKTGQPRV

SEQ ID NO: 1403970 - protein, 7 aa, Mycobacterium tuberculosis
TTGTHGN

SEQ ID NO: 1403971 - protein, 4 aa, Mycobacterium tuberculosis
TTGV

SEQ ID NO: 1403972 - protein, 8 aa, Mycobacterium tuberculosis
TTGYGSAV

SEQ ID NO: 1403973 - protein, 18 aa, Mycobacterium tuberculosis
TTHGGHANATNHPDGGAE

SEQ ID NO: 1403974 - protein, 5 aa, Mycobacterium tuberculosis
TTHIT

SEQ ID NO: 1403975 - protein, 7 aa, Mycobacterium tuberculosis
TTHRETP

SEQ ID NO: 1403976 - protein, 9 aa, Mycobacterium tuberculosis
TTIYGGTSE

SEQ ID NO: 1403977 - protein, 15 aa, Mycobacterium tuberculosis
TTNSGEPGTTKGEAE

SEQ ID NO: 1403978 - protein, 6 aa, Mycobacterium tuberculosis
TTPEDY

SEQ ID NO: 1403979 - protein, 7 aa, Mycobacterium tuberculosis
TTPERTA

SEQ ID NO: 1403980 - protein, 11 aa, Mycobacterium tuberculosis
TTPMGGDPDSA

SEQ ID NO: 1403981 - protein, 4 aa, Mycobacterium tuberculosis
TTPP

SEQ ID NO: 1403982 - protein, 5 aa, Mycobacterium tuberculosis
TTPQC

SEQ ID NO: 1403983 - protein, 11 aa, Mycobacterium tuberculosis
TTQLGETAAEL

SEQ ID NO: 1403984 - protein, 7 aa, Mycobacterium tuberculosis
TTRRGDA

SEQ ID NO: 1403985 - protein, 5 aa, Mycobacterium tuberculosis
TTTGL

SEQ ID NO: 1403986 - protein, 11 aa, Mycobacterium tuberculosis
TTTPKKPNSAL

SEQ ID NO: 1403987 - protein, 9 aa, Mycobacterium tuberculosis
TTVPGPEGE

SEQ ID NO: 1403988 - protein, 7 aa, Mycobacterium tuberculosis
TTVYPGS

SEQ ID NO: 1403989 - protein, 6 aa, Mycobacterium tuberculosis
TTYEST

SEQ ID NO: 1403990 - protein, 11 aa, Mycobacterium tuberculosis
TVDDAAGEAYD

SEQ ID NO: 1403991 - protein, 21 aa, Mycobacterium tuberculosis
TVDGEDIPNAAAEGLSHEVGS

SEQ ID NO: 1403992 - protein, 9 aa, Mycobacterium tuberculosis
TVDRDGVSG

SEQ ID NO: 1403993 - protein, 19 aa, Mycobacterium tuberculosis
TVDTPRTETNGKRGGNHNA

SEQ ID NO: 1403994 - protein, 8 aa, Mycobacterium tuberculosis
TVEGGESL

SEQ ID NO: 1403995 - protein, 4 aa, Mycobacterium tuberculosis
TVEP

SEQ ID NO: 1403996 - protein, 5 aa, Mycobacterium tuberculosis
TVGDI

SEQ ID NO: 1403997 - protein, 6 aa, Mycobacterium tuberculosis
TVLPPG

SEQ ID NO: 1403998 - protein, 11 aa, Mycobacterium tuberculosis
TVPATDHSGRQ

SEQ ID NO: 1403999 - protein, 8 aa, Mycobacterium tuberculosis
TVPGPSGT

SEQ ID NO: 1404000 - protein, 8 aa, Mycobacterium tuberculosis
TVRTASRQ

SEQ ID NO: 1404001 - protein, 13 aa, Mycobacterium tuberculosis
TVSAPERGPECGE

SEQ ID NO: 1404002 - protein, 4 aa, Mycobacterium tuberculosis
TYAS

SEQ ID NO: 1404003 - protein, 8 aa, Mycobacterium tuberculosis
TYEASSRK

SEQ ID NO: 1404004 - protein, 7 aa, Mycobacterium tuberculosis
TYEPETS

SEQ ID NO: 1404005 - protein, 4 aa, Mycobacterium tuberculosis
TYGQ

SEQ ID NO: 1404006 - protein, 4 aa, Mycobacterium tuberculosis
TYPL

SEQ ID NO: 1404007 - protein, 12 aa, Mycobacterium tuberculosis
TYTSGTTGPPKA

SEQ ID NO: 1404008 - protein, 7 aa, Mycobacterium tuberculosis
VAAGRAG

SEQ ID NO: 1404009 - protein, 10 aa, Mycobacterium tuberculosis
VAAGTEEAAR

SEQ ID NO: 1404010 - protein, 9 aa, Mycobacterium tuberculosis
VAAPDRPRI

SEQ ID NO: 1404011 - protein, 11 aa, Mycobacterium tuberculosis
VAASAQGMLSS

SEQ ID NO: 1404012 - protein, 7 aa, Mycobacterium tuberculosis
VAEDTGA

SEQ ID NO: 1404013 - protein, 6 aa, Mycobacterium tuberculosis
VAERAG

SEQ ID NO: 1404014 - protein, 9 aa, Mycobacterium tuberculosis
VAETGDREE

SEQ ID NO: 1404015 - protein, 9 aa, Mycobacterium tuberculosis
VAGAGRSTF

SEQ ID NO: 1404016 - protein, 6 aa, Mycobacterium tuberculosis
VAGDGA

SEQ ID NO: 1404017 - protein, 7 aa, Mycobacterium tuberculosis
VAGNPPY

SEQ ID NO: 1404018 - protein, 12 aa, Mycobacterium tuberculosis
VAGSYPPGTRPD

SEQ ID NO: 1404019 - protein, 4 aa, Mycobacterium tuberculosis
VAPG

SEQ ID NO: 1404020 - protein, 14 aa, Mycobacterium tuberculosis
VAPGSGDGTGPAVH

SEQ ID NO: 1404021 - protein, 8 aa, Mycobacterium tuberculosis
VAPQPMSS

SEQ ID NO: 1404022 - protein, 8 aa, Mycobacterium tuberculosis
VAPQTDRV

SEQ ID NO: 1404023 - protein, 7 aa, Mycobacterium tuberculosis
VAPTREN

SEQ ID NO: 1404024 - protein, 5 aa, Mycobacterium tuberculosis
VAQGR

SEQ ID NO: 1404025 - protein, 11 aa, Mycobacterium tuberculosis
VARNPRTGETV

SEQ ID NO: 1404026 - protein, 8 aa, Mycobacterium tuberculosis
VARRGPAG

SEQ ID NO: 1404027 - protein, 9 aa, Mycobacterium tuberculosis
VASGNGKGQ

SEQ ID NO: 1404028 - protein, 9 aa, Mycobacterium tuberculosis
VASPAPGEL

SEQ ID NO: 1404029 - protein, 9 aa, Mycobacterium tuberculosis
VASSPDRAR

SEQ ID NO: 1404030 - protein, 4 aa, Mycobacterium tuberculosis
VATQ

SEQ ID NO: 1404031 - protein, 11 aa, Mycobacterium tuberculosis
VATQQATDSYH

SEQ ID NO: 1404032 - protein, 9 aa, Mycobacterium tuberculosis
VATRADNPL

SEQ ID NO: 1404033 - protein, 7 aa, Mycobacterium tuberculosis
VATRSAA

SEQ ID NO: 1404034 - protein, 10 aa, Mycobacterium tuberculosis
VDADTGAATV

SEQ ID NO: 1404035 - protein, 7 aa, Mycobacterium tuberculosis
VDADTYQ

SEQ ID NO: 1404036 - protein, 7 aa, Mycobacterium tuberculosis
VDAEGRR

SEQ ID NO: 1404037 - protein, 7 aa, Mycobacterium tuberculosis
VDAPRDA

SEQ ID NO: 1404038 - protein, 6 aa, Mycobacterium tuberculosis
VDDERN

SEQ ID NO: 1404039 - protein, 9 aa, Mycobacterium tuberculosis
VDDPAGIQG

SEQ ID NO: 1404040 - protein, 8 aa, Mycobacterium tuberculosis
VDDPTGDA

SEQ ID NO: 1404041 - protein, 17 aa, Mycobacterium tuberculosis
VDENAGSSLPYSSTEQS

SEQ ID NO: 1404042 - protein, 5 aa, Mycobacterium tuberculosis
VDEPL

SEQ ID NO: 1404043 - protein, 8 aa, Mycobacterium tuberculosis
VDEQTGVE

SEQ ID NO: 1404044 - protein, 7 aa, Mycobacterium tuberculosis
VDESNAR

SEQ ID NO: 1404045 - protein, 12 aa, Mycobacterium tuberculosis
VDETGRKRYPTL

SEQ ID NO: 1404046 - protein, 8 aa, Mycobacterium tuberculosis
VDGEEPPR

SEQ ID NO: 1404047 - protein, 6 aa, Mycobacterium tuberculosis
VDGGGK

SEQ ID NO: 1404048 - protein, 8 aa, Mycobacterium tuberculosis
VDGGPGMY

SEQ ID NO: 1404049 - protein, 7 aa, Mycobacterium tuberculosis
VDGNDVE

SEQ ID NO: 1404050 - protein, 8 aa, Mycobacterium tuberculosis
VDGNTEAG

SEQ ID NO: 1404051 - protein, 5 aa, Mycobacterium tuberculosis
VDGQH

SEQ ID NO: 1404052 - protein, 8 aa, Mycobacterium tuberculosis
VDNAPGAR

SEQ ID NO: 1404053 - protein, 5 aa, Mycobacterium tuberculosis
VDNDG

SEQ ID NO: 1404054 - protein, 9 aa, Mycobacterium tuberculosis
VDPAGRPIT

SEQ ID NO: 1404055 - protein, 4 aa, Mycobacterium tuberculosis
VDPN

SEQ ID NO: 1404056 - protein, 5 aa, Mycobacterium tuberculosis
VDPNE

SEQ ID NO: 1404057 - protein, 12 aa, Mycobacterium tuberculosis
VDPQPSAGQQGP

SEQ ID NO: 1404058 - protein, 16 aa, Mycobacterium tuberculosis
VDPRGDDSLPLRPWWQ

SEQ ID NO: 1404059 - protein, 7 aa, Mycobacterium tuberculosis
VDQPASD

SEQ ID NO: 1404060 - protein, 8 aa, Mycobacterium tuberculosis
VDRDDPRV

SEQ ID NO: 1404061 - protein, 8 aa, Mycobacterium tuberculosis
VDRDRRPG

SEQ ID NO: 1404062 - protein, 7 aa, Mycobacterium tuberculosis
VDRYGNQ

SEQ ID NO: 1404063 - protein, 11 aa, Mycobacterium tuberculosis
VDSADANDQFA

SEQ ID NO: 1404064 - protein, 6 aa, Mycobacterium tuberculosis
VDSGRE

SEQ ID NO: 1404065 - protein, 9 aa, Mycobacterium tuberculosis
VDSTTAATL

SEQ ID NO: 1404066 - protein, 8 aa, Mycobacterium tuberculosis
VDTDGDGR

SEQ ID NO: 1404067 - protein, 9 aa, Mycobacterium tuberculosis
VDTNPETAR

SEQ ID NO: 1404068 - protein, 6 aa, Mycobacterium tuberculosis
VDTNRS

SEQ ID NO: 1404069 - protein, 7 aa, Mycobacterium tuberculosis
VDTPAEV

SEQ ID NO: 1404070 - protein, 19 aa, Mycobacterium tuberculosis
VDVSPEERRRIAETGFYAY

SEQ ID NO: 1404071 - protein, 5 aa, Mycobacterium tuberculosis
VEADG

SEQ ID NO: 1404072 - protein, 13 aa, Mycobacterium tuberculosis
VEAEPAAGAGEQV

SEQ ID NO: 1404073 - protein, 15 aa, Mycobacterium tuberculosis
VEAGEATTQNGRAQQ

SEQ ID NO: 1404074 - protein, 11 aa, Mycobacterium tuberculosis
VEAGGAAADEL

SEQ ID NO: 1404075 - protein, 12 aa, Mycobacterium tuberculosis
VEAGNADQFDTL

SEQ ID NO: 1404076 - protein, 16 aa, Mycobacterium tuberculosis
VEAPKAYAEAALSLLV

SEQ ID NO: 1404077 - protein, 11 aa, Mycobacterium tuberculosis
VEASSGSTAVS

SEQ ID NO: 1404078 - protein, 24 aa, Mycobacterium tuberculosis
VEATQDTQEAAESDDEEADAPGDS

SEQ ID NO: 1404079 - protein, 13 aa, Mycobacterium tuberculosis
VEATSAEQIAEDA

SEQ ID NO: 1404080 - protein, 8 aa, Mycobacterium tuberculosis
VEDADEDS

SEQ ID NO: 1404081 - protein, 6 aa, Mycobacterium tuberculosis
VEDPDS

SEQ ID NO: 1404082 - protein, 6 aa, Mycobacterium tuberculosis
VEDPEW

SEQ ID NO: 1404083 - protein, 8 aa, Mycobacterium tuberculosis
VEDSSDVS

SEQ ID NO: 1404084 - protein, 6 aa, Mycobacterium tuberculosis
VEDTEG

SEQ ID NO: 1404085 - protein, 8 aa, Mycobacterium tuberculosis
VEEFRDTE

SEQ ID NO: 1404086 - protein, 4 aa, Mycobacterium tuberculosis
VEEG

SEQ ID NO: 1404087 - protein, 6 aa, Mycobacterium tuberculosis
VEGGEN

SEQ ID NO: 1404088 - protein, 15 aa, Mycobacterium tuberculosis
VEGGSAVTTGERVSA

SEQ ID NO: 1404089 - protein, 9 aa, Mycobacterium tuberculosis
VEGPTDDPD

SEQ ID NO: 1404090 - protein, 6 aa, Mycobacterium tuberculosis
VEGSGG

SEQ ID NO: 1404091 - protein, 9 aa, Mycobacterium tuberculosis
VEKDPENPT

SEQ ID NO: 1404092 - protein, 13 aa, Mycobacterium tuberculosis
VEKPKVKLPPRPL

SEQ ID NO: 1404093 - protein, 21 aa, Mycobacterium tuberculosis
VEPASIEQAGSQAGYPAPPLQ

SEQ ID NO: 1404094 - protein, 12 aa, Mycobacterium tuberculosis
VEPPGGSPGRHV

SEQ ID NO: 1404095 - protein, 9 aa, Mycobacterium tuberculosis
VEPPPSTLA

SEQ ID NO: 1404096 - protein, 4 aa, Mycobacterium tuberculosis
VEQG

SEQ ID NO: 1404097 - protein, 6 aa, Mycobacterium tuberculosis
VEQTRS

SEQ ID NO: 1404098 - protein, 12 aa, Mycobacterium tuberculosis
VEQTSKDRGHDY

SEQ ID NO: 1404099 - protein, 4 aa, Mycobacterium tuberculosis
VESE

SEQ ID NO: 1404100 - protein, 5 aa, Mycobacterium tuberculosis
VESGG

SEQ ID NO: 1404101 - protein, 11 aa, Mycobacterium tuberculosis
VESGNLSVNSH

SEQ ID NO: 1404102 - protein, 7 aa, Mycobacterium tuberculosis
VESGRLD

SEQ ID NO: 1404103 - protein, 10 aa, Mycobacterium tuberculosis
VESGTPTPQA

SEQ ID NO: 1404104 - protein, 5 aa, Mycobacterium tuberculosis
VESPQ

SEQ ID NO: 1404105 - protein, 14 aa, Mycobacterium tuberculosis
VETGDGYPPPAYPP

SEQ ID NO: 1404106 - protein, 8 aa, Mycobacterium tuberculosis
VETGTPVT

SEQ ID NO: 1404107 - protein, 6 aa, Mycobacterium tuberculosis
VETPTT

SEQ ID NO: 1404108 - protein, 8 aa, Mycobacterium tuberculosis
VETTAGDM

SEQ ID NO: 1404109 - protein, 8 aa, Mycobacterium tuberculosis
VETTPGGG

SEQ ID NO: 1404110 - protein, 13 aa, Mycobacterium tuberculosis
VGAAAGGEFDRGD

SEQ ID NO: 1404111 - protein, 4 aa, Mycobacterium tuberculosis
VGAD

SEQ ID NO: 1404112 - protein, 13 aa, Mycobacterium tuberculosis
VGADEDDIKATYD

SEQ ID NO: 1404113 - protein, 10 aa, Mycobacterium tuberculosis
VGADGDTAGT

SEQ ID NO: 1404114 - protein, 6 aa, Mycobacterium tuberculosis
VGAGQT

SEQ ID NO: 1404115 - protein, 9 aa, Mycobacterium tuberculosis
VGAGSGKQI

SEQ ID NO: 1404116 - protein, 6 aa, Mycobacterium tuberculosis
VGAKPG

SEQ ID NO: 1404117 - protein, 8 aa, Mycobacterium tuberculosis
VGAKRQAT

SEQ ID NO: 1404118 - protein, 8 aa, Mycobacterium tuberculosis
VGAPNSGW

SEQ ID NO: 1404119 - protein, 10 aa, Mycobacterium tuberculosis
VGASAGNARS

SEQ ID NO: 1404120 - protein, 11 aa, Mycobacterium tuberculosis
VGASEPPVAAT

SEQ ID NO: 1404121 - protein, 11 aa, Mycobacterium tuberculosis
VGATATGRLPA

SEQ ID NO: 1404122 - protein, 14 aa, Mycobacterium tuberculosis
VGATEGATNRKIEN

SEQ ID NO: 1404123 - protein, 4 aa, Mycobacterium tuberculosis
VGDD

SEQ ID NO: 1404124 - protein, 12 aa, Mycobacterium tuberculosis
VGDPPRLGEPGP

SEQ ID NO: 1404125 - protein, 6 aa, Mycobacterium tuberculosis
VGEENA

SEQ ID NO: 1404126 - protein, 6 aa, Mycobacterium tuberculosis
VGEHAE

SEQ ID NO: 1404127 - protein, 7 aa, Mycobacterium tuberculosis
VGESTDV

SEQ ID NO: 1404128 - protein, 10 aa, Mycobacterium tuberculosis
VGGDSAGGNL

SEQ ID NO: 1404129 - protein, 6 aa, Mycobacterium tuberculosis
VGGFSE

SEQ ID NO: 1404130 - protein, 16 aa, Mycobacterium tuberculosis
VGGGNLGNANNGLGNI

SEQ ID NO: 1404131 - protein, 5 aa, Mycobacterium tuberculosis
VGGLP

SEQ ID NO: 1404132 - protein, 30 aa, Mycobacterium tuberculosis; identical to SEQ ID NO: 190873

SEQ ID NO: 1404133 - protein, 13 aa, Mycobacterium tuberculosis
VGGSGAAVVNCAT

SEQ ID NO: 1404134 - protein, 7 aa, Mycobacterium tuberculosis
VGKPEQN

SEQ ID NO: 1404135 - protein, 29 aa, Mycobacterium tuberculosis
VGNGNTGDYNLGNGNLGNANFGGGNGSAF

SEQ ID NO: 1404136 - protein, 4 aa, Mycobacterium tuberculosis
VGNP

SEQ ID NO: 1404137 - protein, 12 aa, Mycobacterium tuberculosis
VGPDGLGNSPKH

SEQ ID NO: 1404138 - protein, 8 aa, Mycobacterium tuberculosis
VGPEGKPL

SEQ ID NO: 1404139 - protein, 10 aa, Mycobacterium tuberculosis
VGPETNPLEQ

SEQ ID NO: 1404140 - protein, 6 aa, Mycobacterium tuberculosis
VGPGVS

SEQ ID NO: 1404141 - protein, 12 aa, Mycobacterium tuberculosis
VGPGVTAADTAI

SEQ ID NO: 1404142 - protein, 8 aa, Mycobacterium tuberculosis
VGPKQTAL

SEQ ID NO: 1404143 - protein, 10 aa, Mycobacterium tuberculosis
VGPNGAGKSS

SEQ ID NO: 1404144 - protein, 11 aa, Mycobacterium tuberculosis
VGPPSDPAAQI

SEQ ID NO: 1404145 - protein, 10 aa, Mycobacterium tuberculosis
VGPQSGDPYR

SEQ ID NO: 1404146 - protein, 12 aa, Mycobacterium tuberculosis
VGQHRKQPIGAA

SEQ ID NO: 1404147 - protein, 29 aa, Mycobacterium tuberculosis
VGRDSTRGLGAGADPEVGRKAAEDAKDEI

SEQ ID NO: 1404148 - protein, 12 aa, Mycobacterium tuberculosis
VGRNGGSAVSSH

SEQ ID NO: 1404149 - protein, 6 aa, Mycobacterium tuberculosis
VGRPRA

SEQ ID NO: 1404150 - protein, 4 aa, Mycobacterium tuberculosis
VGRS

SEQ ID NO: 1404151 - protein, 8 aa, Mycobacterium tuberculosis
VGRSRERG

SEQ ID NO: 1404152 - protein, 4 aa, Mycobacterium tuberculosis
VGRT

SEQ ID NO: 1404153 - protein, 9 aa, Mycobacterium tuberculosis
VGSADDLTQ

SEQ ID NO: 1404154 - protein, 12 aa, Mycobacterium tuberculosis
VGSASGHGAQSD

SEQ ID NO: 1404155 - protein, 5 aa, Mycobacterium tuberculosis
VGSDG

SEQ ID NO: 1404156 - protein, 7 aa, Mycobacterium tuberculosis
VGSEQAY

SEQ ID NO: 1404157 - protein, 6 aa, Mycobacterium tuberculosis
VGSGNI

SEQ ID NO: 1404158 - protein, 26 aa, Mycobacterium tuberculosis
VGSNNVGLGNTGNGNIGFGNTGNGNI

SEQ ID NO: 1404159 - protein, 7 aa, Mycobacterium tuberculosis
VGSPTGT

SEQ ID NO: 1404160 - protein, 10 aa, Mycobacterium tuberculosis
VGSQSPAVGQ

SEQ ID NO: 1404161 - protein, 9 aa, Mycobacterium tuberculosis
VGTAPPPLT

SEQ ID NO: 1404162 - protein, 7 aa, Mycobacterium tuberculosis
VGTPAEV

SEQ ID NO: 1404163 - protein, 10 aa, Mycobacterium tuberculosis
VGTPNEVATE

SEQ ID NO: 1404164 - protein, 6 aa, Mycobacterium tuberculosis
VGTTTA

SEQ ID NO: 1404165 - protein, 6 aa, Mycobacterium tuberculosis
VHPGGV

SEQ ID NO: 1404166 - protein, 16 aa, Mycobacterium tuberculosis
VHQGEGVAAGKRDQRD

SEQ ID NO: 1404167 - protein, 10 aa, Mycobacterium tuberculosis
VHTGDTTGMG

SEQ ID NO: 1404168 - protein, 27 aa, Mycobacterium tuberculosis
VKDGRNAGGAGANPNSTDAARIPETAA

SEQ ID NO: 1404169 - protein, 8 aa, Mycobacterium tuberculosis
VKESNPYN

SEQ ID NO: 1404170 - protein, 11 aa, Mycobacterium tuberculosis
VKGVTEETTTG

SEQ ID NO: 1404171 - protein, 6 aa, Mycobacterium tuberculosis
VKQHAR

SEQ ID NO: 1404172 - protein, 7 aa, Mycobacterium tuberculosis
VKSGETH

SEQ ID NO: 1404173 - protein, 4 aa, Mycobacterium tuberculosis
VKTP

SEQ ID NO: 1404174 - protein, 14 aa, Mycobacterium tuberculosis
VLPSKEGAHETREA

SEQ ID NO: 1404175 - protein, 5 aa, Mycobacterium tuberculosis
VLPTA

SEQ ID NO: 1404176 - protein, 10 aa, Mycobacterium tuberculosis
VNAEPDSRPA

SEQ ID NO: 1404177 - protein, 16 aa, Mycobacterium tuberculosis
VNAGERAAGKPLPGAR

SEQ ID NO: 1404178 - protein, 15 aa, Mycobacterium tuberculosis
VNAGNLAAANPTTAV

SEQ ID NO: 1404179 - protein, 6 aa, Mycobacterium tuberculosis
VNAKNV

SEQ ID NO: 1404180 - protein, 14 aa, Mycobacterium tuberculosis
VNDSRGGSKKRKGM

SEQ ID NO: 1404181 - protein, 9 aa, Mycobacterium tuberculosis
VNGGNRTVP

SEQ ID NO: 1404182 - protein, 6 aa, Mycobacterium tuberculosis
VNGTAS

SEQ ID NO: 1404183 - protein, 47 aa, Mycobacterium tuberculosis; identical to SEQ ID NO: 191034

SEQ ID NO: 1404184 - protein, 13 aa, Mycobacterium tuberculosis
VNMSQSSNDTFPT

SEQ ID NO: 1404185 - protein, 6 aa, Mycobacterium tuberculosis
VNPPGR

SEQ ID NO: 1404186 - protein, 10 aa, Mycobacterium tuberculosis
VNPPLREASD

SEQ ID NO: 1404187 - protein, 4 aa, Mycobacterium tuberculosis
VNQT

SEQ ID NO: 1404188 - protein, 11 aa, Mycobacterium tuberculosis
VNSSQGGGSKD

SEQ ID NO: 1404189 - protein, 25 aa, Mycobacterium tuberculosis
VNTANRQGKRKRTRTGYGKRKSTKR

SEQ ID NO: 1404190 - protein, 6 aa, Mycobacterium tuberculosis
VNTPPS

SEQ ID NO: 1404191 - protein, 6 aa, Mycobacterium tuberculosis
VPAAAQ

SEQ ID NO: 1404192 - protein, 12 aa, Mycobacterium tuberculosis
VPAGDPSKGQLR

SEQ ID NO: 1404193 - protein, 8 aa, Mycobacterium tuberculosis
VPAGGEDD

SEQ ID NO: 1404194 - protein, 14 aa, Mycobacterium tuberculosis
VPAPPVAPAAEPAE

SEQ ID NO: 1404195 - protein, 10 aa, Mycobacterium tuberculosis
VPAPTPRRPL

SEQ ID NO: 1404196 - protein, 20 aa, Mycobacterium tuberculosis
VPAPVSDRRPLPERDPAPSR

SEQ ID NO: 1404197 - protein, 10 aa, Mycobacterium tuberculosis
VPAREQTRAG

SEQ ID NO: 1404198 - protein, 15 aa, Mycobacterium tuberculosis
VPARPRRVRKPGEPL

SEQ ID NO: 1404199 - protein, 9 aa, Mycobacterium tuberculosis
VPARTGRQH

SEQ ID NO: 1404200 - protein, 8 aa, Mycobacterium tuberculosis
VPASTDYE

SEQ ID NO: 1404201 - protein, 7 aa, Mycobacterium tuberculosis
VPDDDLG

SEQ ID NO: 1404202 - protein, 8 aa, Mycobacterium tuberculosis
VPDNGGRL

SEQ ID NO: 1404203 - protein, 9 aa, Mycobacterium tuberculosis
VPDPAPGKN

SEQ ID NO: 1404204 - protein, 4 aa, Mycobacterium tuberculosis
VPEA

SEQ ID NO: 1404205 - protein, 7 aa, Mycobacterium tuberculosis
VPEEDGP

SEQ ID NO: 1404206 - protein, 5 aa, Mycobacterium tuberculosis
VPGAC

SEQ ID NO: 1404207 - protein, 6 aa, Mycobacterium tuberculosis
VPGARE

SEQ ID NO: 1404208 - protein, 16 aa, Mycobacterium tuberculosis
VPGASGTVLRWSAPLS

SEQ ID NO: 1404209 - protein, 13 aa, Mycobacterium tuberculosis
VPGDDWPAYTQDD

SEQ ID NO: 1404210 - protein, 7 aa, Mycobacterium tuberculosis
VPGGDIK

SEQ ID NO: 1404211 - protein, 12 aa, Mycobacterium tuberculosis
VPGGSGGGSAAA

SEQ ID NO: 1404212 - protein, 13 aa, Mycobacterium tuberculosis
VPGPEDHPDSGDS

SEQ ID NO: 1404213 - protein, 9 aa, Mycobacterium tuberculosis
VPGPEGRAA

SEQ ID NO: 1404214 - protein, 6 aa, Mycobacterium tuberculosis
VPGPPF

SEQ ID NO: 1404215 - protein, 8 aa, Mycobacterium tuberculosis
VPGPREPR

SEQ ID NO: 1404216 - protein, 6 aa, Mycobacterium tuberculosis
VPGPVD

SEQ ID NO: 1404217 - protein, 4 aa, Mycobacterium tuberculosis
VPGQ

SEQ ID NO: 1404218 - protein, 5 aa, Mycobacterium tuberculosis
VPGRR

SEQ ID NO: 1404219 - protein, 6 aa, Mycobacterium tuberculosis
VPGRTG

SEQ ID NO: 1404220 - protein, 8 aa, Mycobacterium tuberculosis
VPHGESGK

SEQ ID NO: 1404221 - protein, 4 aa, Mycobacterium tuberculosis
VPHT

SEQ ID NO: 1404222 - protein, 15 aa, Mycobacterium tuberculosis
VPIDRTNADSAQGAL

SEQ ID NO: 1404223 - protein, 13 aa, Mycobacterium tuberculosis
VPKEGEQPNQRQK

SEQ ID NO: 1404224 - protein, 6 aa, Mycobacterium tuberculosis
VPLPTE

SEQ ID NO: 1404225 - protein, 13 aa, Mycobacterium tuberculosis
VPLPTSPGYTGNT

SEQ ID NO: 1404226 - protein, 13 aa, Mycobacterium tuberculosis
VPLSSGSFGDATG

SEQ ID NO: 1404227 - protein, 19 aa, Mycobacterium tuberculosis
VPNDGGRVIDPGTGEPVPG

SEQ ID NO: 1404228 - protein, 8 aa, Mycobacterium tuberculosis
VPNDGKGA

SEQ ID NO: 1404229 - protein, 13 aa, Mycobacterium tuberculosis
VPNQGRRGEPGPP

SEQ ID NO: 1404230 - protein, 7 aa, Mycobacterium tuberculosis
VPNTSGL

SEQ ID NO: 1404231 - protein, 12 aa, Mycobacterium tuberculosis
VPPDTLASDAER

SEQ ID NO: 1404232 - protein, 7 aa, Mycobacterium tuberculosis
VPPGPGE

SEQ ID NO: 1404233 - protein, 9 aa, Mycobacterium tuberculosis
VPPHDPASY

SEQ ID NO: 1404234 - protein, 5 aa, Mycobacterium tuberculosis
VPPIA

SEQ ID NO: 1404235 - protein, 5 aa, Mycobacterium tuberculosis
VPPIN

SEQ ID NO: 1404236 - protein, 8 aa, Mycobacterium tuberculosis
VPPNTGNL

SEQ ID NO: 1404237 - protein, 13 aa, Mycobacterium tuberculosis
VPPPQGDAEAPTR

SEQ ID NO: 1404238 - protein, 11 aa, Mycobacterium tuberculosis
VPPSWASATPA

SEQ ID NO: 1404239 - protein, 32 aa, Mycobacterium tuberculosis; identical to SEQ ID NO: 191170

SEQ ID NO: 1404240 - protein, 5 aa, Mycobacterium tuberculosis
VPQGL

SEQ ID NO: 1404241 - protein, 8 aa, Mycobacterium tuberculosis
VPQQGHSV

SEQ ID NO: 1404242 - protein, 6 aa, Mycobacterium tuberculosis
VPSAST

SEQ ID NO: 1404243 - protein, 4 aa, Mycobacterium tuberculosis
VPSD

SEQ ID NO: 1404244 - protein, 4 aa, Mycobacterium tuberculosis
VPTA

SEQ ID NO: 1404245 - protein, 11 aa, Mycobacterium tuberculosis
VPTDDSSLGAL

SEQ ID NO: 1404246 - protein, 4 aa, Mycobacterium tuberculosis
VPTG

SEQ ID NO: 1404247 - protein, 6 aa, Mycobacterium tuberculosis
VPTIET

SEQ ID NO: 1404248 - protein, 6 aa, Mycobacterium tuberculosis
VPTPDN

SEQ ID NO: 1404249 - protein, 6 aa, Mycobacterium tuberculosis
VPTRDG

SEQ ID NO: 1404250 - protein, 39 aa, Mycobacterium tuberculosis; identical to SEQ ID NO: 191203

SEQ ID NO: 1404251 - protein, 7 aa, Mycobacterium tuberculosis
VQDRNGP

SEQ ID NO: 1404252 - protein, 13 aa, Mycobacterium tuberculosis
VQEAAATANRAGV

SEQ ID NO: 1404253 - protein, 14 aa, Mycobacterium tuberculosis
VQGPETDHLLALAG

SEQ ID NO: 1404254 - protein, 17 aa, Mycobacterium tuberculosis
VQKDATQISAESGLQPM

SEQ ID NO: 1404255 - protein, 7 aa, Mycobacterium tuberculosis
VQKGHDV

SEQ ID NO: 1404256 - protein, 8 aa, Mycobacterium tuberculosis
VQKTSYDL

SEQ ID NO: 1404257 - protein, 9 aa, Mycobacterium tuberculosis
VQNEKNTKQ

SEQ ID NO: 1404258 - protein, 21 aa, Mycobacterium tuberculosis
VQRDPTAAGKRHAAQARAARP

SEQ ID NO: 1404259 - protein, 7 aa, Mycobacterium tuberculosis
VQRNPNS

SEQ ID NO: 1404260 - protein, 9 aa, Mycobacterium tuberculosis
VQRPSTGDA

SEQ ID NO: 1404261 - protein, 6 aa, Mycobacterium tuberculosis
VQRQQT

SEQ ID NO: 1404262 - protein, 15 aa, Mycobacterium tuberculosis
VQSEHDELTRSTHAE

SEQ ID NO: 1404263 - protein, 10 aa, Mycobacterium tuberculosis
VRAEAAESYD

SEQ ID NO: 1404264 - protein, 5 aa, Mycobacterium tuberculosis
VRANR

SEQ ID NO: 1404265 - protein, 10 aa, Mycobacterium tuberculosis
VRATPDARVS

SEQ ID NO: 1404266 - protein, 4 aa, Mycobacterium tuberculosis
VRDG

SEQ ID NO: 1404267 - protein, 7 aa, Mycobacterium tuberculosis
VRDGTGV

SEQ ID NO: 1404268 - protein, 6 aa, Mycobacterium tuberculosis
VRDPYG

SEQ ID NO: 1404269 - protein, 8 aa, Mycobacterium tuberculosis
VRDQDVGN

SEQ ID NO: 1404270 - protein, 5 aa, Mycobacterium tuberculosis
VREAH

SEQ ID NO: 1404271 - protein, 11 aa, Mycobacterium tuberculosis
VREKADPATLH

SEQ ID NO: 1404272 - protein, 5 aa, Mycobacterium tuberculosis
VRGEG

SEQ ID NO: 1404273 - protein, 8 aa, Mycobacterium tuberculosis
VRGKVGDA

SEQ ID NO: 1404274 - protein, 7 aa, Mycobacterium tuberculosis
VRGNATR

SEQ ID NO: 1404275 - protein, 7 aa, Mycobacterium tuberculosis
VRPDLDG

SEQ ID NO: 1404276 - protein, 9 aa, Mycobacterium tuberculosis
VRPENAASR

SEQ ID NO: 1404277 - protein, 9 aa, Mycobacterium tuberculosis
VRPKDDPLG

SEQ ID NO: 1404278 - protein, 9 aa, Mycobacterium tuberculosis
VRPNGAERA

SEQ ID NO: 1404279 - protein, 7 aa, Mycobacterium tuberculosis
VRPPAAD

SEQ ID NO: 1404280 - protein, 5 aa, Mycobacterium tuberculosis
VRPRS

SEQ ID NO: 1404281 - protein, 6 aa, Mycobacterium tuberculosis
VRPTPI

SEQ ID NO: 1404282 - protein, 14 aa, Mycobacterium tuberculosis
VRSGQRAAAEVAAL

SEQ ID NO: 1404283 - protein, 5 aa, Mycobacterium tuberculosis
VRSRT

SEQ ID NO: 1404284 - protein, 11 aa, Mycobacterium tuberculosis
VRSTASSPVSY

SEQ ID NO: 1404285 - protein, 9 aa, Mycobacterium tuberculosis
VRSTDRTGV

SEQ ID NO: 1404286 - protein, 8 aa, Mycobacterium tuberculosis
VRTANSEI

SEQ ID NO: 1404287 - protein, 12 aa, Mycobacterium tuberculosis
VRTDPDAPKHAG

SEQ ID NO: 1404288 - protein, 7 aa, Mycobacterium tuberculosis
VRTGGGV

SEQ ID NO: 1404289 - protein, 10 aa, Mycobacterium tuberculosis
VRYDRDGDQH

SEQ ID NO: 1404290 - protein, 9 aa, Mycobacterium tuberculosis
VSAASAAVA

SEQ ID NO: 1404291 - protein, 8 aa, Mycobacterium tuberculosis
VSAEGTRD

SEQ ID NO: 1404292 - protein, 7 aa, Mycobacterium tuberculosis
VSAKESH

SEQ ID NO: 1404293 - protein, 9 aa, Mycobacterium tuberculosis
VSAPEGKRK

SEQ ID NO: 1404294 - protein, 8 aa, Mycobacterium tuberculosis
VSAPGGLP

SEQ ID NO: 1404295 - protein, 5 aa, Mycobacterium tuberculosis
VSATA

SEQ ID NO: 1404296 - protein, 9 aa, Mycobacterium tuberculosis
VSDDGSTAR

SEQ ID NO: 1404297 - protein, 12 aa, Mycobacterium tuberculosis
VSDEDKSQRRDE

SEQ ID NO: 1404298 - protein, 9 aa, Mycobacterium tuberculosis
VSDEDPLAE

SEQ ID NO: 1404299 - protein, 10 aa, Mycobacterium tuberculosis
VSDGSSAPAV

SEQ ID NO: 1404300 - protein, 6 aa, Mycobacterium tuberculosis
VSDNER

SEQ ID NO: 1404301 - protein, 5 aa, Mycobacterium tuberculosis
VSDRA

SEQ ID NO: 1404302 - protein, 6 aa, Mycobacterium tuberculosis
VSDSAS

SEQ ID NO: 1404303 - protein, 6 aa, Mycobacterium tuberculosis
VSEDKR

SEQ ID NO: 1404304 - protein, 7 aa, Mycobacterium tuberculosis
VSESTAR

SEQ ID NO: 1404305 - protein, 8 aa, Mycobacterium tuberculosis
VSETHDTK

SEQ ID NO: 1404306 - protein, 5 aa, Mycobacterium tuberculosis
VSEYG

SEQ ID NO: 1404307 - protein, 8 aa, Mycobacterium tuberculosis
VSGERQGY

SEQ ID NO: 1404308 - protein, 9 aa, Mycobacterium tuberculosis
VSGGSPHAI

SEQ ID NO: 1404309 - protein, 7 aa, Mycobacterium tuberculosis
VSGGYTR

SEQ ID NO: 1404310 - protein, 11 aa, Mycobacterium tuberculosis
VSGPVSGPNED

SEQ ID NO: 1404311 - protein, 10 aa, Mycobacterium tuberculosis
VSIGGSGSYY

SEQ ID NO: 1404312 - protein, 4 aa, Mycobacterium tuberculosis
VSKA

SEQ ID NO: 1404313 - protein, 6 aa, Mycobacterium tuberculosis
VSKVSE

SEQ ID NO: 1404314 - protein, 6 aa, Mycobacterium tuberculosis
VSNAGG

SEQ ID NO: 1404315 - protein, 7 aa, Mycobacterium tuberculosis
VSPARAA

SEQ ID NO: 1404316 - protein, 8 aa, Mycobacterium tuberculosis
VSPEGLPA

SEQ ID NO: 1404317 - protein, 6 aa, Mycobacterium tuberculosis
VSPNPD

SEQ ID NO: 1404318 - protein, 10 aa, Mycobacterium tuberculosis
VSPNPGGVGP

SEQ ID NO: 1404319 - protein, 9 aa, Mycobacterium tuberculosis
VSRRPANPE

SEQ ID NO: 1404320 - protein, 4 aa, Mycobacterium tuberculosis
VSRT

SEQ ID NO: 1404321 - protein, 7 aa, Mycobacterium tuberculosis
VSSSESV

SEQ ID NO: 1404322 - protein, 12 aa, Mycobacterium tuberculosis
VSTNPYATGPAR

SEQ ID NO: 1404323 - protein, 7 aa, Mycobacterium tuberculosis
VSTTRAK

SEQ ID NO: 1404324 - protein, 9 aa, Mycobacterium tuberculosis
VSVPGAPGV

SEQ ID NO: 1404325 - protein, 6 aa, Mycobacterium tuberculosis
VTAAGD

SEQ ID NO: 1404326 - protein, 7 aa, Mycobacterium tuberculosis
VTAEAEV

SEQ ID NO: 1404327 - protein, 5 aa, Mycobacterium tuberculosis
VTAPI

SEQ ID NO: 1404328 - protein, 4 aa, Mycobacterium tuberculosis
VTAS

SEQ ID NO: 1404329 - protein, 10 aa, Mycobacterium tuberculosis
VTASGKQRSR

SEQ ID NO: 1404330 - protein, 14 aa, Mycobacterium tuberculosis
VTATGEEDHSEIDG

SEQ ID NO: 1404331 - protein, 7 aa, Mycobacterium tuberculosis
VTDPDSF

SEQ ID NO: 1404332 - protein, 29 aa, Mycobacterium tuberculosis
VTDTTASGTNCPPPPRAAARRASSPGESP

SEQ ID NO: 1404333 - protein, 10 aa, Mycobacterium tuberculosis
VTEDEATGAA

SEQ ID NO: 1404334 - protein, 6 aa, Mycobacterium tuberculosis
VTEETA

SEQ ID NO: 1404335 - protein, 11 aa, Mycobacterium tuberculosis
VTESQGRVHTS

SEQ ID NO: 1404336 - protein, 8 aa, Mycobacterium tuberculosis
VTGERSGR

SEQ ID NO: 1404337 - protein, 7 aa, Mycobacterium tuberculosis
VTGGRIP

SEQ ID NO: 1404338 - protein, 15 aa, Mycobacterium tuberculosis
VTGTTGTAADAKKEI

SEQ ID NO: 1404339 - protein, 5 aa, Mycobacterium tuberculosis
VTKTA

SEQ ID NO: 1404340 - protein, 9 aa, Mycobacterium tuberculosis
VTPAHDPND

SEQ ID NO: 1404341 - protein, 13 aa, Mycobacterium tuberculosis
VTPEGRIQVARVA

SEQ ID NO: 1404342 - protein, 11 aa, Mycobacterium tuberculosis
VTPEQAGAHPT

SEQ ID NO: 1404343 - protein, 6 aa, Mycobacterium tuberculosis
VTPGGT

SEQ ID NO: 1404344 - protein, 7 aa, Mycobacterium tuberculosis
VTPNPGA

SEQ ID NO: 1404345 - protein, 11 aa, Mycobacterium tuberculosis
VTPRRASSGYR

SEQ ID NO: 1404346 - protein, 6 aa, Mycobacterium tuberculosis
VTPSPA

SEQ ID NO: 1404347 - protein, 5 aa, Mycobacterium tuberculosis
VTQPG

SEQ ID NO: 1404348 - protein, 7 aa, Mycobacterium tuberculosis
VTRPDET

SEQ ID NO: 1404349 - protein, 5 aa, Mycobacterium tuberculosis
VTRTP

SEQ ID NO: 1404350 - protein, 6 aa, Mycobacterium tuberculosis
VTSDTA

SEQ ID NO: 1404351 - protein, 10 aa, Mycobacterium tuberculosis
VTSGPALERA

SEQ ID NO: 1404352 - protein, 7 aa, Mycobacterium tuberculosis
VTSGQRR

SEQ ID NO: 1404353 - protein, 8 aa, Mycobacterium tuberculosis
VTSPDGEL

SEQ ID NO: 1404354 - protein, 7 aa, Mycobacterium tuberculosis
VTSPGRL

SEQ ID NO: 1404355 - protein, 12 aa, Mycobacterium tuberculosis
VTSPYPAPGGGY

SEQ ID NO: 1404356 - protein, 10 aa, Mycobacterium tuberculosis
VTSTSGPGIS

SEQ ID NO: 1404357 - protein, 20 aa, Mycobacterium tuberculosis
VTTDHISPAGAIKPGTPAAR

SEQ ID NO: 1404358 - protein, 7 aa, Mycobacterium tuberculosis
VTTSGDR

SEQ ID NO: 1404359 - protein, 7 aa, Mycobacterium tuberculosis
VTTTGGP

SEQ ID NO: 1404360 - protein, 7 aa, Mycobacterium tuberculosis
VTTVDSG

SEQ ID NO: 1404361 - protein, 18 aa, Mycobacterium tuberculosis
VTTYGSAGHGPAATSDAE

SEQ ID NO: 1404362 - protein, 14 aa, Mycobacterium tuberculosis
VTYPPATSEDLGET

SEQ ID NO: 1404363 - protein, 7 aa, Mycobacterium tuberculosis
VVKSSNG

SEQ ID NO: 1404364 - protein, 12 aa, Mycobacterium tuberculosis
VVPPAEEDDPAE

SEQ ID NO: 1404365 - protein, 5 aa, Mycobacterium tuberculosis
VWTTD

SEQ ID NO: 1404366 - protein, 20 aa, Mycobacterium tuberculosis
VYGSETAMAPRVGSSAEDDG

SEQ ID NO: 1404367 - protein, 8 aa, Mycobacterium tuberculosis
WDDPQGVP

SEQ ID NO: 1404368 - protein, 6 aa, Mycobacterium tuberculosis
WDPAEL

SEQ ID NO: 1404369 - protein, 9 aa, Mycobacterium tuberculosis
WDPKAQRPE

SEQ ID NO: 1404370 - protein, 11 aa, Mycobacterium tuberculosis
WEQPESPKPLG

SEQ ID NO: 1404371 - protein, 5 aa, Mycobacterium tuberculosis
WGGPP

SEQ ID NO: 1404372 - protein, 4 aa, Mycobacterium tuberculosis
WGGV

SEQ ID NO: 1404373 - protein, 6 aa, Mycobacterium tuberculosis
WGPAGA

SEQ ID NO: 1404374 - protein, 5 aa, Mycobacterium tuberculosis
WGPLA

SEQ ID NO: 1404375 - protein, 13 aa, Mycobacterium tuberculosis
WGQTGPRSQQAGH

SEQ ID NO: 1404376 - protein, 8 aa, Mycobacterium tuberculosis
WGRAASPV

SEQ ID NO: 1404377 - protein, 10 aa, Mycobacterium tuberculosis
WGSSPTSSGK

SEQ ID NO: 1404378 - protein, 36 aa, Mycobacterium tuberculosis; identical to SEQ ID NO: 191595

SEQ ID NO: 1404379 - protein, 9 aa, Mycobacterium tuberculosis
WKPKPDTDV

SEQ ID NO: 1404380 - protein, 7 aa, Mycobacterium tuberculosis
WKRSPEE

SEQ ID NO: 1404381 - protein, 4 aa, Mycobacterium tuberculosis
WNGT

SEQ ID NO: 1404382 - protein, 7 aa, Mycobacterium tuberculosis
WNGTDER

SEQ ID NO: 1404383 - protein, 8 aa, Mycobacterium tuberculosis
WPAPSGEH

SEQ ID NO: 1404384 - protein, 18 aa, Mycobacterium tuberculosis
WPERPSPPYPEGKPVEIN

SEQ ID NO: 1404385 - protein, 9 aa, Mycobacterium tuberculosis
WPKTSGSRG

SEQ ID NO: 1404386 - protein, 12 aa, Mycobacterium tuberculosis
WPPKITPPKGIE

SEQ ID NO: 1404387 - protein, 6 aa, Mycobacterium tuberculosis
WPPPQT

SEQ ID NO: 1404388 - protein, 13 aa, Mycobacterium tuberculosis
WPPSSLSGRLAGR

SEQ ID NO: 1404389 - protein, 11 aa, Mycobacterium tuberculosis
WPRNPGSPAER

SEQ ID NO: 1404390 - protein, 10 aa, Mycobacterium tuberculosis
WPTTDPDDHA

SEQ ID NO: 1404391 - protein, 13 aa, Mycobacterium tuberculosis
WQQAQQPDASGAA

SEQ ID NO: 1404392 - protein, 12 aa, Mycobacterium tuberculosis
WQRDPKQLGRLG

SEQ ID NO: 1404393 - protein, 13 aa, Mycobacterium tuberculosis
WSSDPTRPVGRGT

SEQ ID NO: 1404394 - protein, 7 aa, Mycobacterium tuberculosis
WTDPETG

SEQ ID NO: 1404395 - protein, 7 aa, Mycobacterium tuberculosis
WTNRSGT

SEQ ID NO: 1404396 - protein, 4 aa, Mycobacterium tuberculosis
WVPQ

SEQ ID NO: 1404397 - protein, 11 aa, Mycobacterium tuberculosis
YAASGTPEVGR

SEQ ID NO: 1404398 - protein, 6 aa, Mycobacterium tuberculosis
YAASSY

SEQ ID NO: 1404399 - protein, 4 aa, Mycobacterium tuberculosis
YAGA

SEQ ID NO: 1404400 - protein, 7 aa, Mycobacterium tuberculosis
YAHNPQY

SEQ ID NO: 1404401 - protein, 12 aa, Mycobacterium tuberculosis
YANQRQSFGQPI

SEQ ID NO: 1404402 - protein, 5 aa, Mycobacterium tuberculosis
YAPPD

SEQ ID NO: 1404403 - protein, 12 aa, Mycobacterium tuberculosis
YAPTSRFGTPDD

SEQ ID NO: 1404404 - protein, 5 aa, Mycobacterium tuberculosis
YARDG

SEQ ID NO: 1404405 - protein, 7 aa, Mycobacterium tuberculosis
YATAGSQ

SEQ ID NO: 1404406 - protein, 11 aa, Mycobacterium tuberculosis
YDATKQSFLGS

SEQ ID NO: 1404407 - protein, 8 aa, Mycobacterium tuberculosis
YDDEGVAA

SEQ ID NO: 1404408 - protein, 14 aa, Mycobacterium tuberculosis
YDGDQHRSDRGRYV

SEQ ID NO: 1404409 - protein, 12 aa, Mycobacterium tuberculosis
YDPHPAIKAPVA

SEQ ID NO: 1404410 - protein, 7 aa, Mycobacterium tuberculosis
YDPNRTA

SEQ ID NO: 1404411 - protein, 9 aa, Mycobacterium tuberculosis
YDREEQTEG

SEQ ID NO: 1404412 - protein, 4 aa, Mycobacterium tuberculosis
YDRR

SEQ ID NO: 1404413 - protein, 8 aa, Mycobacterium tuberculosis
YDSEPADV

SEQ ID NO: 1404414 - protein, 30 aa, Mycobacterium tuberculosis; identical to SEQ ID NO: 191747

SEQ ID NO: 1404415 - protein, 9 aa, Mycobacterium tuberculosis
YEAGGIAKH

SEQ ID NO: 1404416 - protein, 8 aa, Mycobacterium tuberculosis
YEDGNAAT

SEQ ID NO: 1404417 - protein, 9 aa, Mycobacterium tuberculosis
YEEAGEQEA

SEQ ID NO: 1404418 - protein, 8 aa, Mycobacterium tuberculosis
YEGEDAAR

SEQ ID NO: 1404419 - protein, 14 aa, Mycobacterium tuberculosis
YEGLTTPQIRESEP

SEQ ID NO: 1404420 - protein, 7 aa, Mycobacterium tuberculosis
YEGPQTA

SEQ ID NO: 1404421 - protein, 8 aa, Mycobacterium tuberculosis
YEKEGNAR

SEQ ID NO: 1404422 - protein, 4 aa, Mycobacterium tuberculosis
YEKS

SEQ ID NO: 1404423 - protein, 5 aa, Mycobacterium tuberculosis
YENTR

SEQ ID NO: 1404424 - protein, 5 aa, Mycobacterium tuberculosis
YEQGD

SEQ ID NO: 1404425 - protein, 6 aa, Mycobacterium tuberculosis
YEQHPL

SEQ ID NO: 1404426 - protein, 7 aa, Mycobacterium tuberculosis
YEQPRQE

SEQ ID NO: 1404427 - protein, 10 aa, Mycobacterium tuberculosis
YERAGSAHAP

SEQ ID NO: 1404428 - protein, 10 aa, Mycobacterium tuberculosis
YERGGKDHPP

SEQ ID NO: 1404429 - protein, 9 aa, Mycobacterium tuberculosis
YETDTDTEL

SEQ ID NO: 1404430 - protein, 8 aa, Mycobacterium tuberculosis
YETPDPEI

SEQ ID NO: 1404431 - protein, 6 aa, Mycobacterium tuberculosis
YETTSG

SEQ ID NO: 1404432 - protein, 4 aa, Mycobacterium tuberculosis
YFTG

SEQ ID NO: 1404433 - protein, 10 aa, Mycobacterium tuberculosis
YGADPQRAAR

SEQ ID NO: 1404434 - protein, 7 aa, Mycobacterium tuberculosis
YGADTET

SEQ ID NO: 1404435 - protein, 9 aa, Mycobacterium tuberculosis
YGAESEAGR

SEQ ID NO: 1404436 - protein, 11 aa, Mycobacterium tuberculosis
YGDEPTATQEQ

SEQ ID NO: 1404437 - protein, 5 aa, Mycobacterium tuberculosis
YGDGR

SEQ ID NO: 1404438 - protein, 12 aa, Mycobacterium tuberculosis
YGEPDHSRGPFP

SEQ ID NO: 1404439 - protein, 15 aa, Mycobacterium tuberculosis
YGGGEDRRTVALLAV

SEQ ID NO: 1404440 - protein, 9 aa, Mycobacterium tuberculosis
YGGGSSVVG

SEQ ID NO: 1404441 - protein, 12 aa, Mycobacterium tuberculosis
YGGNGPHGSRPG

SEQ ID NO: 1404442 - protein, 4 aa, Mycobacterium tuberculosis
YGGR

SEQ ID NO: 1404443 - protein, 10 aa, Mycobacterium tuberculosis
YGGRDESKFD

SEQ ID NO: 1404444 - protein, 4 aa, Mycobacterium tuberculosis
YGGT

SEQ ID NO: 1404445 - protein, 7 aa, Mycobacterium tuberculosis
YGKGSNA

SEQ ID NO: 1404446 - protein, 7 aa, Mycobacterium tuberculosis
YGNPEAT

SEQ ID NO: 1404447 - protein, 14 aa, Mycobacterium tuberculosis
YGPGTRRTPRRGTP

SEQ ID NO: 1404448 - protein, 10 aa, Mycobacterium tuberculosis
YGQPGQTERA

SEQ ID NO: 1404449 - protein, 8 aa, Mycobacterium tuberculosis
YGQVGDGR

SEQ ID NO: 1404450 - protein, 9 aa, Mycobacterium tuberculosis
YGSPPLTNR

SEQ ID NO: 1404451 - protein, 6 aa, Mycobacterium tuberculosis
YGSTTV

SEQ ID NO: 1404452 - protein, 5 aa, Mycobacterium tuberculosis
YGTDG

SEQ ID NO: 1404453 - protein, 6 aa, Mycobacterium tuberculosis
YGTGHT

SEQ ID NO: 1404454 - protein, 5 aa, Mycobacterium tuberculosis
YHEQE

SEQ ID NO: 1404455 - protein, 4 aa, Mycobacterium tuberculosis
YHTS

SEQ ID NO: 1404456 - protein, 15 aa, Mycobacterium tuberculosis
YKAPAETQAQRIAIT

SEQ ID NO: 1404457 - protein, 5 aa, Mycobacterium tuberculosis
YLPGP

SEQ ID NO: 1404458 - protein, 10 aa, Mycobacterium tuberculosis
YLPPGTKPRW

SEQ ID NO: 1404459 - protein, 4 aa, Mycobacterium tuberculosis
YNGL

SEQ ID NO: 1404460 - protein, 11 aa, Mycobacterium tuberculosis
YNNASPASGRI

SEQ ID NO: 1404461 - protein, 6 aa, Mycobacterium tuberculosis
YNPQRE

SEQ ID NO: 1404462 - protein, 5 aa, Mycobacterium tuberculosis
YPAQA

SEQ ID NO: 1404463 - protein, 19 aa, Mycobacterium tuberculosis
YPAVNTSEIGKGAGIAGPG

SEQ ID NO: 1404464 - protein, 5 aa, Mycobacterium tuberculosis
YPEDI

SEQ ID NO: 1404465 - protein, 4 aa, Mycobacterium tuberculosis
YPEL

SEQ ID NO: 1404466 - protein, 4 aa, Mycobacterium tuberculosis
YPER

SEQ ID NO: 1404467 - protein, 8 aa, Mycobacterium tuberculosis
YPGADEAL

SEQ ID NO: 1404468 - protein, 7 aa, Mycobacterium tuberculosis
YPGAPGQ

SEQ ID NO: 1404469 - protein, 4 aa, Mycobacterium tuberculosis
YPGG

SEQ ID NO: 1404470 - protein, 7 aa, Mycobacterium tuberculosis
YPGGKAL

SEQ ID NO: 1404471 - protein, 6 aa, Mycobacterium tuberculosis
YPGQVR

SEQ ID NO: 1404472 - protein, 11 aa, Mycobacterium tuberculosis
YPIPGNDDAIR

SEQ ID NO: 1404473 - protein, 9 aa, Mycobacterium tuberculosis
YPKTSGGRG

SEQ ID NO: 1404474 - protein, 6 aa, Mycobacterium tuberculosis
YPLSTA

SEQ ID NO: 1404475 - protein, 4 aa, Mycobacterium tuberculosis
YPQE

SEQ ID NO: 1404476 - protein, 15 aa, Mycobacterium tuberculosis
YPTGGGSARCDGVDV

SEQ ID NO: 1404477 - protein, 5 aa, Mycobacterium tuberculosis
YPTRA

SEQ ID NO: 1404478 - protein, 5 aa, Mycobacterium tuberculosis
YQGRG

SEQ ID NO: 1404479 - protein, 5 aa, Mycobacterium tuberculosis
YQPAM

SEQ ID NO: 1404480 - protein, 9 aa, Mycobacterium tuberculosis
YQPDGTSIT

SEQ ID NO: 1404481 - protein, 5 aa, Mycobacterium tuberculosis
YQQGL

SEQ ID NO: 1404482 - protein, 6 aa, Mycobacterium tuberculosis
YQTRSE

SEQ ID NO: 1404483 - protein, 9 aa, Mycobacterium tuberculosis
YQTTQVSER

SEQ ID NO: 1404484 - protein, 12 aa, Mycobacterium tuberculosis
YRDDAKGPSASV

SEQ ID NO: 1404485 - protein, 10 aa, Mycobacterium tuberculosis
YRDEARPRAG

SEQ ID NO: 1404486 - protein, 4 aa, Mycobacterium tuberculosis
YRDS

SEQ ID NO: 1404487 - protein, 13 aa, Mycobacterium tuberculosis
YRDYGRGSGHPAR

SEQ ID NO: 1404488 - protein, 4 aa, Mycobacterium tuberculosis
YRGA

SEQ ID NO: 1404489 - protein, 10 aa, Mycobacterium tuberculosis
YRGGPPEGWQ

SEQ ID NO: 1404490 - protein, 8 aa, Mycobacterium tuberculosis
YRGSARDH

SEQ ID NO: 1404491 - protein, 20 aa, Mycobacterium tuberculosis
YRPPDAARRHNGGKPRRKHV

SEQ ID NO: 1404492 - protein, 13 aa, Mycobacterium tuberculosis
YRPSVSADLPPSA

SEQ ID NO: 1404493 - protein, 6 aa, Mycobacterium tuberculosis
YRREGK

SEQ ID NO: 1404494 - protein, 9 aa, Mycobacterium tuberculosis
YRTSGDSPI

SEQ ID NO: 1404495 - protein, 4 aa, Mycobacterium tuberculosis
YSAR

SEQ ID NO: 1404496 - protein, 8 aa, Mycobacterium tuberculosis
YSDASKMR

SEQ ID NO: 1404497 - protein, 8 aa, Mycobacterium tuberculosis
YSGADHAT

SEQ ID NO: 1404498 - protein, 9 aa, Mycobacterium tuberculosis
YSKSKGQPL

SEQ ID NO: 1404499 - protein, 4 aa, Mycobacterium tuberculosis
YSPR

SEQ ID NO: 1404500 - protein, 6 aa, Mycobacterium tuberculosis
YSQTDL

SEQ ID NO: 1404501 - protein, 17 aa, Mycobacterium tuberculosis
YSRADEEQQQALSSQMG

SEQ ID NO: 1404502 - protein, 9 aa, Mycobacterium tuberculosis
YSSDPERHE

SEQ ID NO: 1404503 - protein, 6 aa, Mycobacterium tuberculosis
YSTPHA

SEQ ID NO: 1404504 - protein, 4 aa, Mycobacterium tuberculosis
YTDA

SEQ ID NO: 1404505 - protein, 17 aa, Mycobacterium tuberculosis
YTKRGGDYVSVGPAEKI

SEQ ID NO: 1404506 - protein, 4 aa, Mycobacterium tuberculosis
YTTE

SEQ ID NO: 1404507 - protein, 7 aa, Mycobacterium tuberculosis
YVGENKE

SEQ ID NO: 1404508 - protein, 14 aa, Mycobacterium tuberculosis
YVPEDDDERNLKQA

SEQ ID NO: 1404509 - protein, 6 aa, Mycobacterium tuberculosis
YYPETN

SEQ ID NO: 1404510 - protein, 90 aa, Mycobacterium tuberculosis; identical to SEQ ID NO: 166720

SEQ ID NO: 1404511 - protein, 8 aa, Mycobacterium tuberculosis
AAAAKGKW

SEQ ID NO: 1404512 - protein, 34 aa, Mycobacterium tuberculosis; identical to SEQ ID NO: 166736

SEQ ID NO: 1404513 - protein, 5 aa, Mycobacterium tuberculosis
AAAAR

SEQ ID NO: 1404514 - protein, 16 aa, Mycobacterium tuberculosis
AAAASGVEDQEELQGP

SEQ ID NO: 1404515 - protein, 10 aa, Mycobacterium tuberculosis
AAAFGDDPAT

SEQ ID NO: 1404516 - protein, 10 aa, Mycobacterium tuberculosis
AAAGEKVGQS

SEQ ID NO: 1404517 - protein, 9 aa, Mycobacterium tuberculosis
AAAGRDADG

SEQ ID NO: 1404518 - protein, 7 aa, Mycobacterium tuberculosis
AAAGTPL

SEQ ID NO: 1404519 - protein, 8 aa, Mycobacterium tuberculosis
AAAGVSGP

SEQ ID NO: 1404520 - protein, 7 aa, Mycobacterium tuberculosis
AAAPGAS

SEQ ID NO: 1404521 - protein, 12 aa, Mycobacterium tuberculosis
AAAPPEDRAEAW

SEQ ID NO: 1404522 - protein, 8 aa, Mycobacterium tuberculosis
AAAQGEGF

SEQ ID NO: 1404523 - protein, 6 aa, Mycobacterium tuberculosis
AAARGT

SEQ ID NO: 1404524 - protein, 6 aa, Mycobacterium tuberculosis
AAASQY

SEQ ID NO: 1404525 - protein, 13 aa, Mycobacterium tuberculosis
AAATADKARVVVR

SEQ ID NO: 1404526 - protein, 7 aa, Mycobacterium tuberculosis
AAATNSL

SEQ ID NO: 1404527 - protein, 11 aa, Mycobacterium tuberculosis
AADAATALADA

SEQ ID NO: 1404528 - protein, 9 aa, Mycobacterium tuberculosis
AADADDAPA

SEQ ID NO: 1404529 - protein, 9 aa, Mycobacterium tuberculosis
AADEKESEL

SEQ ID NO: 1404530 - protein, 4 aa, Mycobacterium tuberculosis
AADG

SEQ ID NO: 1404531 - protein, 11 aa, Mycobacterium tuberculosis
AADKYAGKNRN

SEQ ID NO: 1404532 - protein, 8 aa, Mycobacterium tuberculosis
AADPGDAV

SEQ ID NO: 1404533 - protein, 6 aa, Mycobacterium tuberculosis
AADQLR

SEQ ID NO: 1404534 - protein, 8 aa, Mycobacterium tuberculosis
AADRAADG

SEQ ID NO: 1404535 - protein, 5 aa, Mycobacterium tuberculosis
AADSG

SEQ ID NO: 1404536 - protein, 22 aa, Mycobacterium tuberculosis
AADSRVDSLSPPALAAGSDPAA

SEQ ID NO: 1404537 - protein, 8 aa, Mycobacterium tuberculosis
AADSTLEQ

SEQ ID NO: 1404538 - protein, 10 aa, Mycobacterium tuberculosis
AADVDDPDAA

SEQ ID NO: 1404539 - protein, 12 aa, Mycobacterium tuberculosis
AAEAAPQSARSH

SEQ ID NO: 1404540 - protein, 8 aa, Mycobacterium tuberculosis
AAEDAGAD

SEQ ID NO: 1404541 - protein, 11 aa, Mycobacterium tuberculosis
AAEDDCPPPGY

SEQ ID NO: 1404542 - protein, 5 aa, Mycobacterium tuberculosis
AAEDL

SEQ ID NO: 1404543 - protein, 8 aa, Mycobacterium tuberculosis
AAEHPDKV

SEQ ID NO: 1404544 - protein, 6 aa, Mycobacterium tuberculosis
AAEHPP

SEQ ID NO: 1404545 - protein, 5 aa, Mycobacterium tuberculosis
AAEPG

SEQ ID NO: 1404546 - protein, 32 aa, Mycobacterium tuberculosis; identical to SEQ ID NO: 166944

SEQ ID NO: 1404547 - protein, 11 aa, Mycobacterium tuberculosis
AAEQTRLPTDD

SEQ ID NO: 1404548 - protein, 7 aa, Mycobacterium tuberculosis
AAERDPE

SEQ ID NO: 1404549 - protein, 6 aa, Mycobacterium tuberculosis
AAERGE

SEQ ID NO: 1404550 - protein, 7 aa, Mycobacterium tuberculosis
AAERPGH

SEQ ID NO: 1404551 - protein, 12 aa, Mycobacterium tuberculosis
AAGADPHSAIPG

SEQ ID NO: 1404552 - protein, 6 aa, Mycobacterium tuberculosis
AAGAQN

SEQ ID NO: 1404553 - protein, 6 aa, Mycobacterium tuberculosis
AAGATG

SEQ ID NO: 1404554 - protein, 8 aa, Mycobacterium tuberculosis
AAGDAEPR

SEQ ID NO: 1404555 - protein, 7 aa, Mycobacterium tuberculosis
AAGDQSI

SEQ ID NO: 1404556 - protein, 7 aa, Mycobacterium tuberculosis
AAGEMPG

SEQ ID NO: 1404557 - protein, 9 aa, Mycobacterium tuberculosis
AAGGPSVEE

SEQ ID NO: 1404558 - protein, 14 aa, Mycobacterium tuberculosis
AAGGREAAARSARY

SEQ ID NO: 1404559 - protein, 13 aa, Mycobacterium tuberculosis
AAGGTRGRDGAQG

SEQ ID NO: 1404560 - protein, 8 aa, Mycobacterium tuberculosis
AAGKPASV

SEQ ID NO: 1404561 - protein, 9 aa, Mycobacterium tuberculosis
AAGPMNRPS

SEQ ID NO: 1404562 - protein, 11 aa, Mycobacterium tuberculosis
AAGPSKGETPL

SEQ ID NO: 1404563 - protein, 11 aa, Mycobacterium tuberculosis
AAGQPGAKARE

SEQ ID NO: 1404564 - protein, 11 aa, Mycobacterium tuberculosis
AAGRAPRGVPP

SEQ ID NO: 1404565 - protein, 8 aa, Mycobacterium tuberculosis
AAGREKDK

SEQ ID NO: 1404566 - protein, 19 aa, Mycobacterium tuberculosis
AAGRGVSAEPGAGAAGGIG

SEQ ID NO: 1404567 - protein, 13 aa, Mycobacterium tuberculosis
AAGRTDAGVHASG

SEQ ID NO: 1404568 - protein, 8 aa, Mycobacterium tuberculosis
AAGRTPGL

SEQ ID NO: 1404569 - protein, 23 aa, Mycobacterium tuberculosis
AAGSRQTVTGQQPEQDLNSPREE

SEQ ID NO: 1404570 - protein, 11 aa, Mycobacterium tuberculosis
AAHAEGAAGLA

SEQ ID NO: 1404571 - protein, 5 aa, Mycobacterium tuberculosis
AAIAD

SEQ ID NO: 1404572 - protein, 6 aa, Mycobacterium tuberculosis
AAIPGQ

SEQ ID NO: 1404573 - protein, 7 aa, Mycobacterium tuberculosis
AAKPKIA

SEQ ID NO: 1404574 - protein, 8 aa, Mycobacterium tuberculosis
AAKRGERV

SEQ ID NO: 1404575 - protein, 9 aa, Mycobacterium tuberculosis
AAKTGAAVT

SEQ ID NO: 1404576 - protein, 18 aa, Mycobacterium tuberculosis
AALPGSRTTTAAGTPGVD

SEQ ID NO: 1404577 - protein, 9 aa, Mycobacterium tuberculosis
AALPQAQAR

SEQ ID NO: 1404578 - protein, 11 aa, Mycobacterium tuberculosis
AALQSSDDAAL

SEQ ID NO: 1404579 - protein, 11 aa, Mycobacterium tuberculosis
AAMTASDVERA

SEQ ID NO: 1404580 - protein, 6 aa, Mycobacterium tuberculosis
AANASA

SEQ ID NO: 1404581 - protein, 11 aa, Mycobacterium tuberculosis
AANKQKQELDE

SEQ ID NO: 1404582 - protein, 7 aa, Mycobacterium tuberculosis
AANPAGF

SEQ ID NO: 1404583 - protein, 10 aa, Mycobacterium tuberculosis
AANQKGVDEV

SEQ ID NO: 1404584 - protein, 12 aa, Mycobacterium tuberculosis
AANRAAEAPTTG

SEQ ID NO: 1404585 - protein, 7 aa, Mycobacterium tuberculosis
AANTRSI

SEQ ID NO: 1404586 - protein, 9 aa, Mycobacterium tuberculosis
AAPAGRNWT

SEQ ID NO: 1404587 - protein, 8 aa, Mycobacterium tuberculosis
AAPATVSE

SEQ ID NO: 1404588 - protein, 6 aa, Mycobacterium tuberculosis
AAPDAH

SEQ ID NO: 1404589 - protein, 12 aa, Mycobacterium tuberculosis
AAPLTSRSRFRP

SEQ ID NO: 1404590 - protein, 8 aa, Mycobacterium tuberculosis
AAPPGMAP

SEQ ID NO: 1404591 - protein, 9 aa, Mycobacterium tuberculosis
AAPPPATTR

SEQ ID NO: 1404592 - protein, 7 aa, Mycobacterium tuberculosis
AAPRPVR

SEQ ID NO: 1404593 - protein, 6 aa, Mycobacterium tuberculosis
AAPRPY

SEQ ID NO: 1404594 - protein, 11 aa, Mycobacterium tuberculosis
AAPSARGHQRD

SEQ ID NO: 1404595 - protein, 15 aa, Mycobacterium tuberculosis
AAQAEQAATQARAAA

SEQ ID NO: 1404596 - protein, 7 aa, Mycobacterium tuberculosis
AAQAGRA

SEQ ID NO: 1404597 - protein, 8 aa, Mycobacterium tuberculosis
AAQEGVSR

SEQ ID NO: 1404598 - protein, 8 aa, Mycobacterium tuberculosis
AAQGQSAP

SEQ ID NO: 1404599 - protein, 8 aa, Mycobacterium tuberculosis
AAQKEPEM

SEQ ID NO: 1404600 - protein, 9 aa, Mycobacterium tuberculosis
AAQLKSDHQ

SEQ ID NO: 1404601 - protein, 7 aa, Mycobacterium tuberculosis
AAQPDSV

SEQ ID NO: 1404602 - protein, 6 aa, Mycobacterium tuberculosis
AAQPEP

SEQ ID NO: 1404603 - protein, 6 aa, Mycobacterium tuberculosis
AAQQAL

SEQ ID NO: 1404604 - protein, 10 aa, Mycobacterium tuberculosis
AAQRYSGTAD

SEQ ID NO: 1404605 - protein, 15 aa, Mycobacterium tuberculosis
AAQYASAEAANSSPL

SEQ ID NO: 1404606 - protein, 10 aa, Mycobacterium tuberculosis
AARAADADIA

SEQ ID NO: 1404607 - protein, 15 aa, Mycobacterium tuberculosis
AARAKAKELGADPPW

SEQ ID NO: 1404608 - protein, 7 aa, Mycobacterium tuberculosis
AARARDA

SEQ ID NO: 1404609 - protein, 7 aa, Mycobacterium tuberculosis
AARATQP

SEQ ID NO: 1404610 - protein, 5 aa, Mycobacterium tuberculosis
AARDV

SEQ ID NO: 1404611 - protein, 5 aa, Mycobacterium tuberculosis
AAREE

SEQ ID NO: 1404612 - protein, 27 aa, Mycobacterium tuberculosis
AARGTTGGGGTRSGTSTDGQEDGRKPP

SEQ ID NO: 1404613 - protein, 10 aa, Mycobacterium tuberculosis
AARHTSGEAI

SEQ ID NO: 1404614 - protein, 7 aa, Mycobacterium tuberculosis
AARKAGH

SEQ ID NO: 1404615 - protein, 7 aa, Mycobacterium tuberculosis
AARNRAY

SEQ ID NO: 1404616 - protein, 28 aa, Mycobacterium tuberculosis
AARPGEDWTGSQQFSGDNPFGMGEGTQA

SEQ ID NO: 1404617 - protein, 6 aa, Mycobacterium tuberculosis
AARPPA

SEQ ID NO: 1404618 - protein, 7 aa, Mycobacterium tuberculosis
AARPTRT

SEQ ID NO: 1404619 - protein, 6 aa, Mycobacterium tuberculosis
AARQSD

SEQ ID NO: 1404620 - protein, 14 aa, Mycobacterium tuberculosis
AARRPQVTTPGGRA

SEQ ID NO: 1404621 - protein, 7 aa, Mycobacterium tuberculosis
AARSAGV

SEQ ID NO: 1404622 - protein, 7 aa, Mycobacterium tuberculosis
AARTPAA

SEQ ID NO: 1404623 - protein, 5 aa, Mycobacterium tuberculosis
AARTT

SEQ ID NO: 1404624 - protein, 17 aa, Mycobacterium tuberculosis
AASAAPGYPATAGTARL

SEQ ID NO: 1404625 - protein, 5 aa, Mycobacterium tuberculosis
AASAL

SEQ ID NO: 1404626 - protein, 6 aa, Mycobacterium tuberculosis
AASASL

SEQ ID NO: 1404627 - protein, 8 aa, Mycobacterium tuberculosis
AASDAAEL

SEQ ID NO: 1404628 - protein, 13 aa, Mycobacterium tuberculosis
AASDPRRDGQAAA

SEQ ID NO: 1404629 - protein, 7 aa, Mycobacterium tuberculosis
AASESAG

SEQ ID NO: 1404630 - protein, 4 aa, Mycobacterium tuberculosis
AASG

SEQ ID NO: 1404631 - protein, 6 aa, Mycobacterium tuberculosis
AASGVS

SEQ ID NO: 1404632 - protein, 8 aa, Mycobacterium tuberculosis
AASKTNPT

SEQ ID NO: 1404633 - protein, 13 aa, Mycobacterium tuberculosis
AASRASADGRPPM

SEQ ID NO: 1404634 - protein, 7 aa, Mycobacterium tuberculosis
AASRQLR

SEQ ID NO: 1404635 - protein, 10 aa, Mycobacterium tuberculosis
AASSGGISTN

SEQ ID NO: 1404636 - protein, 10 aa, Mycobacterium tuberculosis
AASSPYGGEI

SEQ ID NO: 1404637 - protein, 7 aa, Mycobacterium tuberculosis
AASSRVD

SEQ ID NO: 1404638 - protein, 10 aa, Mycobacterium tuberculosis
AASTGNPGLR

SEQ ID NO: 1404639 - protein, 7 aa, Mycobacterium tuberculosis
AATAGPQ

SEQ ID NO: 1404640 - protein, 6 aa, Mycobacterium tuberculosis
AATARL

SEQ ID NO: 1404641 - protein, 11 aa, Mycobacterium tuberculosis
AATDPAVRGGQ

SEQ ID NO: 1404642 - protein, 27 aa, Mycobacterium tuberculosis
AATDPTTQGGQYYGPDGFGEQRGHPKV

SEQ ID NO: 1404643 - protein, 18 aa, Mycobacterium tuberculosis
AATEATNRGLVALRVVLH

SEQ ID NO: 1404644 - protein, 16 aa, Mycobacterium tuberculosis
AATEERFSDGSGRGSI

SEQ ID NO: 1404645 - protein, 13 aa, Mycobacterium tuberculosis
AATGAPTAAHPID

SEQ ID NO: 1404646 - protein, 16 aa, Mycobacterium tuberculosis
AATGEADSTDALIGAQ

SEQ ID NO: 1404647 - protein, 8 aa, Mycobacterium tuberculosis
AATNGEEF

SEQ ID NO: 1404648 - protein, 10 aa, Mycobacterium tuberculosis
AATPARGGYT

SEQ ID NO: 1404649 - protein, 13 aa, Mycobacterium tuberculosis
AATPPPVRGGKQP

SEQ ID NO: 1404650 - protein, 19 aa, Mycobacterium tuberculosis
AATPTDAAKKVVPDTAAEQ

SEQ ID NO: 1404651 - protein, 5 aa, Mycobacterium tuberculosis
AATRG

SEQ ID NO: 1404652 - protein, 21 aa, Mycobacterium tuberculosis
AATRGSGRIGRSAAGRALDPE

SEQ ID NO: 1404653 - protein, 7 aa, Mycobacterium tuberculosis
AATRNGR

SEQ ID NO: 1404654 - protein, 5 aa, Mycobacterium tuberculosis
AAVGT

SEQ ID NO: 1404655 - protein, 5 aa, Mycobacterium tuberculosis
AAVSG

SEQ ID NO: 1404656 - protein, 6 aa, Mycobacterium tuberculosis
AAYAQA

SEQ ID NO: 1404657 - protein, 5 aa, Mycobacterium tuberculosis
ACGGP

SEQ ID NO: 1404658 - protein, 24 aa, Mycobacterium tuberculosis
ACGHSRRAVSPDQSLSMDPGVVLD

SEQ ID NO: 1404659 - protein, 8 aa, Mycobacterium tuberculosis
ACSSGSEA

SEQ ID NO: 1404660 - protein, 10 aa, Mycobacterium tuberculosis
ADAAATAQTS

SEQ ID NO: 1404661 - protein, 9 aa, Mycobacterium tuberculosis
ADAANIPYD

SEQ ID NO: 1404662 - protein, 13 aa, Mycobacterium tuberculosis
ADADDDHSDHDMG

SEQ ID NO: 1404663 - protein, 6 aa, Mycobacterium tuberculosis
ADADGV

SEQ ID NO: 1404664 - protein, 16 aa, Mycobacterium tuberculosis
ADADKALQQPQTRRRY

SEQ ID NO: 1404665 - protein, 8 aa, Mycobacterium tuberculosis
ADADPSAT

SEQ ID NO: 1404666 - protein, 8 aa, Mycobacterium tuberculosis
ADAGPEQM

SEQ ID NO: 1404667 - protein, 8 aa, Mycobacterium tuberculosis
ADARGADA

SEQ ID NO: 1404668 - protein, 8 aa, Mycobacterium tuberculosis
ADARPQDD

SEQ ID NO: 1404669 - protein, 7 aa, Mycobacterium tuberculosis
ADAVDDE

SEQ ID NO: 1404670 - protein, 8 aa, Mycobacterium tuberculosis
ADAVETNT

SEQ ID NO: 1404671 - protein, 9 aa, Mycobacterium tuberculosis
ADDATGYQA

SEQ ID NO: 1404672 - protein, 13 aa, Mycobacterium tuberculosis
ADDDADDSAPHET

SEQ ID NO: 1404673 - protein, 9 aa, Mycobacterium tuberculosis
ADDNDIDKG

SEQ ID NO: 1404674 - protein, 7 aa, Mycobacterium tuberculosis
ADDPAHA

SEQ ID NO: 1404675 - protein, 12 aa, Mycobacterium tuberculosis
ADDPKRARRETR

SEQ ID NO: 1404676 - protein, 5 aa, Mycobacterium tuberculosis
ADDRL

SEQ ID NO: 1404677 - protein, 7 aa, Mycobacterium tuberculosis
ADDRSDV

SEQ ID NO: 1404678 - protein, 9 aa, Mycobacterium tuberculosis
ADEQARAAK

SEQ ID NO: 1404679 - protein, 6 aa, Mycobacterium tuberculosis
ADERAA

SEQ ID NO: 1404680 - protein, 7 aa, Mycobacterium tuberculosis
ADESDGS

SEQ ID NO: 1404681 - protein, 4 aa, Mycobacterium tuberculosis
ADET

SEQ ID NO: 1404682 - protein, 5 aa, Mycobacterium tuberculosis
ADGDN

SEQ ID NO: 1404683 - protein, 7 aa, Mycobacterium tuberculosis
ADGGARV

SEQ ID NO: 1404684 - protein, 6 aa, Mycobacterium tuberculosis
ADGGSV

SEQ ID NO: 1404685 - protein, 9 aa, Mycobacterium tuberculosis
ADGKAKWSA

SEQ ID NO: 1404686 - protein, 5 aa, Mycobacterium tuberculosis
ADGPT

SEQ ID NO: 1404687 - protein, 7 aa, Mycobacterium tuberculosis
ADGQRPR

SEQ ID NO: 1404688 - protein, 7 aa, Mycobacterium tuberculosis
ADGTELA

SEQ ID NO: 1404689 - protein, 14 aa, Mycobacterium tuberculosis
ADGTEVATSPLATE

SEQ ID NO: 1404690 - protein, 5 aa, Mycobacterium tuberculosis
ADHHP

SEQ ID NO: 1404691 - protein, 21 aa, Mycobacterium tuberculosis
ADKPEKEKASVPGGGDMGGMD

SEQ ID NO: 1404692 - protein, 12 aa, Mycobacterium tuberculosis
ADLGRTVTAADT

SEQ ID NO: 1404693 - protein, 6 aa, Mycobacterium tuberculosis
ADMKSG

SEQ ID NO: 1404694 - protein, 6 aa, Mycobacterium tuberculosis
ADNAPI

SEQ ID NO: 1404695 - protein, 4 aa, Mycobacterium tuberculosis
ADNP

SEQ ID NO: 1404696 - protein, 8 aa, Mycobacterium tuberculosis
ADNTDIDG

SEQ ID NO: 1404697 - protein, 4 aa, Mycobacterium tuberculosis
ADPA

SEQ ID NO: 1404698 - protein, 5 aa, Mycobacterium tuberculosis
ADPAR

SEQ ID NO: 1404699 - protein, 13 aa, Mycobacterium tuberculosis
ADPESTAALPDGA

SEQ ID NO: 1404700 - protein, 7 aa, Mycobacterium tuberculosis
ADPETPP

SEQ ID NO: 1404701 - protein, 7 aa, Mycobacterium tuberculosis
ADPHPIS

SEQ ID NO: 1404702 - protein, 7 aa, Mycobacterium tuberculosis
ADPLSER

SEQ ID NO: 1404703 - protein, 7 aa, Mycobacterium tuberculosis
ADPLTAS

SEQ ID NO: 1404704 - protein, 7 aa, Mycobacterium tuberculosis
ADPRQTV

SEQ ID NO: 1404705 - protein, 5 aa, Mycobacterium tuberculosis
ADPRV

SEQ ID NO: 1404706 - protein, 8 aa, Mycobacterium tuberculosis
ADPSTGSI

SEQ ID NO: 1404707 - protein, 9 aa, Mycobacterium tuberculosis
ADPTSTKPA

SEQ ID NO: 1404708 - protein, 8 aa, Mycobacterium tuberculosis
ADPTTGAI

SEQ ID NO: 1404709 - protein, 8 aa, Mycobacterium tuberculosis
ADRASGAD

SEQ ID NO: 1404710 - protein, 4 aa, Mycobacterium tuberculosis
ADRK

SEQ ID NO: 1404711 - protein, 6 aa, Mycobacterium tuberculosis
ADRKGG

SEQ ID NO: 1404712 - protein, 9 aa, Mycobacterium tuberculosis
ADRNPPVFD

SEQ ID NO: 1404713 - protein, 14 aa, Mycobacterium tuberculosis
ADRQVRPVAPGSKA

SEQ ID NO: 1404714 - protein, 8 aa, Mycobacterium tuberculosis
ADRRADGE

SEQ ID NO: 1404715 - protein, 6 aa, Mycobacterium tuberculosis
ADSGAK

SEQ ID NO: 1404716 - protein, 10 aa, Mycobacterium tuberculosis
ADSPPDQQGP

SEQ ID NO: 1404717 - protein, 8 aa, Mycobacterium tuberculosis
ADTAESYP

SEQ ID NO: 1404718 - protein, 12 aa, Mycobacterium tuberculosis
ADTARGGRGSGL

SEQ ID NO: 1404719 - protein, 6 aa, Mycobacterium tuberculosis
ADTPDK

SEQ ID NO: 1404720 - protein, 7 aa, Mycobacterium tuberculosis
ADTRDAS

SEQ ID NO: 1404721 - protein, 14 aa, Mycobacterium tuberculosis
ADVKPSDGGSTEDG

SEQ ID NO: 1404722 - protein, 10 aa, Mycobacterium tuberculosis
ADVNGSGSPL

SEQ ID NO: 1404723 - protein, 6 aa, Mycobacterium tuberculosis
ADVVGS

SEQ ID NO: 1404724 - protein, 7 aa, Mycobacterium tuberculosis
ADYGGDP

SEQ ID NO: 1404725 - protein, 5 aa, Mycobacterium tuberculosis
ADYRP

SEQ ID NO: 1404726 - protein, 11 aa, Mycobacterium tuberculosis
AEADGVKPPTA

SEQ ID NO: 1404727 - protein, 6 aa, Mycobacterium tuberculosis
AEADQA

SEQ ID NO: 1404728 - protein, 12 aa, Mycobacterium tuberculosis
AEANDGRPPGCE

SEQ ID NO: 1404729 - protein, 25 aa, Mycobacterium tuberculosis
AEAPGGGVREDTATDADEADDQEER

SEQ ID NO: 1404730 - protein, 10 aa, Mycobacterium tuberculosis
AEAPHSSAVH

SEQ ID NO: 1404731 - protein, 8 aa, Mycobacterium tuberculosis
AEAQRGPM

SEQ ID NO: 1404732 - protein, 23 aa, Mycobacterium tuberculosis
AEASGQLKPGGTIVEPTSGNTGV

SEQ ID NO: 1404733 - protein, 7 aa, Mycobacterium tuberculosis
AEATPQV

SEQ ID NO: 1404734 - protein, 12 aa, Mycobacterium tuberculosis
AECRDDRAQEFP

SEQ ID NO: 1404735 - protein, 7 aa, Mycobacterium tuberculosis
AEDDPAK

SEQ ID NO: 1404736 - protein, 6 aa, Mycobacterium tuberculosis
AEDEVS

SEQ ID NO: 1404737 - protein, 19 aa, Mycobacterium tuberculosis
AEDGTDERATVDQTEAKAR

SEQ ID NO: 1404738 - protein, 9 aa, Mycobacterium tuberculosis
AEDPPAKAR

SEQ ID NO: 1404739 - protein, 7 aa, Mycobacterium tuberculosis
AEEAGPD

SEQ ID NO: 1404740 - protein, 6 aa, Mycobacterium tuberculosis
AEEGTS

SEQ ID NO: 1404741 - protein, 16 aa, Mycobacterium tuberculosis
AEERGYTATKHQREVG

SEQ ID NO: 1404742 - protein, 6 aa, Mycobacterium tuberculosis
AEERRR

SEQ ID NO: 1404743 - protein, 14 aa, Mycobacterium tuberculosis
AEETAAAVGSTTGA

SEQ ID NO: 1404744 - protein, 8 aa, Mycobacterium tuberculosis
AEEYGSHD

SEQ ID NO: 1404745 - protein, 16 aa, Mycobacterium tuberculosis
AEGDSVNNYQASKQAD

SEQ ID NO: 1404746 - protein, 12 aa, Mycobacterium tuberculosis
AEGGSNTAVATA

SEQ ID NO: 1404747 - protein, 8 aa, Mycobacterium tuberculosis
AEGMEESQ

SEQ ID NO: 1404748 - protein, 5 aa, Mycobacterium tuberculosis
AEGPI

SEQ ID NO: 1404749 - protein, 6 aa, Mycobacterium tuberculosis
AEGRDA

SEQ ID NO: 1404750 - protein, 12 aa, Mycobacterium tuberculosis
AEGRPAAEHTQS

SEQ ID NO: 1404751 - protein, 4 aa, Mycobacterium tuberculosis
AEHA

SEQ ID NO: 1404752 - protein, 5 aa, Mycobacterium tuberculosis
AEHAH

SEQ ID NO: 1404753 - protein, 4 aa, Mycobacterium tuberculosis
AEHT

SEQ ID NO: 1404754 - protein, 4 aa, Mycobacterium tuberculosis
AEIP

SEQ ID NO: 1404755 - protein, 5 aa, Mycobacterium tuberculosis
AEIPQ

SEQ ID NO: 1404756 - protein, 9 aa, Mycobacterium tuberculosis
AEKAEPPVR

SEQ ID NO: 1404757 - protein, 11 aa, Mycobacterium tuberculosis
AEKQRADAGST

SEQ ID NO: 1404758 - protein, 6 aa, Mycobacterium tuberculosis
AEKYTQ

SEQ ID NO: 1404759 - protein, 13 aa, Mycobacterium tuberculosis
AELPEATQADLRA

SEQ ID NO: 1404760 - protein, 4 aa, Mycobacterium tuberculosis
AELR

SEQ ID NO: 1404761 - protein, 13 aa, Mycobacterium tuberculosis
AENAARKAQDHGV

SEQ ID NO: 1404762 - protein, 16 aa, Mycobacterium tuberculosis
AENERTYGEFSTREGE

SEQ ID NO: 1404763 - protein, 7 aa, Mycobacterium tuberculosis
AEPAAPV

SEQ ID NO: 1404764 - protein, 9 aa, Mycobacterium tuberculosis
AEPAELDAD

SEQ ID NO: 1404765 - protein, 6 aa, Mycobacterium tuberculosis
AEPEER

SEQ ID NO: 1404766 - protein, 6 aa, Mycobacterium tuberculosis
AEPGDD

SEQ ID NO: 1404767 - protein, 12 aa, Mycobacterium tuberculosis
AEPIGSMGTDTP

SEQ ID NO: 1404768 - protein, 16 aa, Mycobacterium tuberculosis
AEPNGRNINDGCGSTH

SEQ ID NO: 1404769 - protein, 5 aa, Mycobacterium tuberculosis
AEPPC

SEQ ID NO: 1404770 - protein, 4 aa, Mycobacterium tuberculosis
AEPQ

SEQ ID NO: 1404771 - protein, 4 aa, Mycobacterium tuberculosis
AEPS

SEQ ID NO: 1404772 - protein, 11 aa, Mycobacterium tuberculosis
AEPSASLSEVK

SEQ ID NO: 1404773 - protein, 8 aa, Mycobacterium tuberculosis
AEQAAARR

SEQ ID NO: 1404774 - protein, 6 aa, Mycobacterium tuberculosis
AEQAGQ

SEQ ID NO: 1404775 - protein, 9 aa, Mycobacterium tuberculosis
AEQAGVDVE

SEQ ID NO: 1404776 - protein, 4 aa, Mycobacterium tuberculosis
AEQD

SEQ ID NO: 1404777 - protein, 5 aa, Mycobacterium tuberculosis
AEQFA

SEQ ID NO: 1404778 - protein, 10 aa, Mycobacterium tuberculosis
AEQKQRRARG

SEQ ID NO: 1404779 - protein, 7 aa, Mycobacterium tuberculosis
AEQLDDD

SEQ ID NO: 1404780 - protein, 8 aa, Mycobacterium tuberculosis
AERARTIS

SEQ ID NO: 1404781 - protein, 10 aa, Mycobacterium tuberculosis
AERASAAEHP

SEQ ID NO: 1404782 - protein, 19 aa, Mycobacterium tuberculosis
AERGNWPPGFPKSERPSYS

SEQ ID NO: 1404783 - protein, 7 aa, Mycobacterium tuberculosis
AERSTEH

SEQ ID NO: 1404784 - protein, 14 aa, Mycobacterium tuberculosis
AESDPDDELEETTT

SEQ ID NO: 1404785 - protein, 18 aa, Mycobacterium tuberculosis
AESESDADVGDRANDPVR

SEQ ID NO: 1404786 - protein, 4 aa, Mycobacterium tuberculosis
AESP

SEQ ID NO: 1404787 - protein, 14 aa, Mycobacterium tuberculosis
AESQSGARAPKHSY

SEQ ID NO: 1404788 - protein, 6 aa, Mycobacterium tuberculosis
AETADD

SEQ ID NO: 1404789 - protein, 7 aa, Mycobacterium tuberculosis
AETAGSQ

SEQ ID NO: 1404790 - protein, 8 aa, Mycobacterium tuberculosis
AETGDANG

SEQ ID NO: 1404791 - protein, 6 aa, Mycobacterium tuberculosis
AETGED

SEQ ID NO: 1404792 - protein, 5 aa, Mycobacterium tuberculosis
AETGF

SEQ ID NO: 1404793 - protein, 9 aa, Mycobacterium tuberculosis
AETGQPPTI

SEQ ID NO: 1404794 - protein, 16 aa, Mycobacterium tuberculosis
AETLDAETTDSDATSL

SEQ ID NO: 1404795 - protein, 5 aa, Mycobacterium tuberculosis
AETPV

SEQ ID NO: 1404796 - protein, 4 aa, Mycobacterium tuberculosis
AETQ

SEQ ID NO: 1404797 - protein, 6 aa, Mycobacterium tuberculosis
AETTQR

SEQ ID NO: 1404798 - protein, 4 aa, Mycobacterium tuberculosis
AEVD

SEQ ID NO: 1404799 - protein, 7 aa, Mycobacterium tuberculosis
AEVGGDA

SEQ ID NO: 1404800 - protein, 5 aa, Mycobacterium tuberculosis
AEYPD

SEQ ID NO: 1404801 - protein, 20 aa, Mycobacterium tuberculosis
AFGTPEANSVHRTGPGPMGP

SEQ ID NO: 1404802 - protein, 7 aa, Mycobacterium tuberculosis
AFNPGDT

SEQ ID NO: 1404803 - protein, 7 aa, Mycobacterium tuberculosis
AGADDVS

SEQ ID NO: 1404804 - protein, 6 aa, Mycobacterium tuberculosis
AGADHP

SEQ ID NO: 1404805 - protein, 8 aa, Mycobacterium tuberculosis
AGADSTGR

SEQ ID NO: 1404806 - protein, 9 aa, Mycobacterium tuberculosis
AGAGKTETM

SEQ ID NO: 1404807 - protein, 7 aa, Mycobacterium tuberculosis
AGAGQAA

SEQ ID NO: 1404808 - protein, 14 aa, Mycobacterium tuberculosis
AGAIDADGPETPRI

SEQ ID NO: 1404809 - protein, 7 aa, Mycobacterium tuberculosis
AGANPLG

SEQ ID NO: 1404810 - protein, 7 aa, Mycobacterium tuberculosis
AGAPGGV

SEQ ID NO: 1404811 - protein, 7 aa, Mycobacterium tuberculosis
AGAQGQV

SEQ ID NO: 1404812 - protein, 8 aa, Mycobacterium tuberculosis
AGASTGGF

SEQ ID NO: 1404813 - protein, 12 aa, Mycobacterium tuberculosis
AGAVGQAASVGG

SEQ ID NO: 1404814 - protein, 8 aa, Mycobacterium tuberculosis
AGAVPGPF

SEQ ID NO: 1404815 - protein, 5 aa, Mycobacterium tuberculosis
AGCSR

SEQ ID NO: 1404816 - protein, 8 aa, Mycobacterium tuberculosis
AGDAGAGV

SEQ ID NO: 1404817 - protein, 10 aa, Mycobacterium tuberculosis
AGDDVQPGDV

SEQ ID NO: 1404818 - protein, 8 aa, Mycobacterium tuberculosis
AGDEPGGA

SEQ ID NO: 1404819 - protein, 8 aa, Mycobacterium tuberculosis
AGDERARA

SEQ ID NO: 1404820 - protein, 6 aa, Mycobacterium tuberculosis
AGDNKF

SEQ ID NO: 1404821 - protein, 7 aa, Mycobacterium tuberculosis
AGDPMSG

SEQ ID NO: 1404822 - protein, 6 aa, Mycobacterium tuberculosis
AGDQVG

SEQ ID NO: 1404823 - protein, 11 aa, Mycobacterium tuberculosis
AGDRDAVSNHR

SEQ ID NO: 1404824 - protein, 4 aa, Mycobacterium tuberculosis
AGEE

SEQ ID NO: 1404825 - protein, 4 aa, Mycobacterium tuberculosis
AGEI

SEQ ID NO: 1404826 - protein, 5 aa, Mycobacterium tuberculosis
AGELQ

SEQ ID NO: 1404827 - protein, 7 aa, Mycobacterium tuberculosis
AGERGTD

SEQ ID NO: 1404828 - protein, 4 aa, Mycobacterium tuberculosis
AGET

SEQ ID NO: 1404829 - protein, 4 aa, Mycobacterium tuberculosis
AGGA

SEQ ID NO: 1404830 - protein, 14 aa, Mycobacterium tuberculosis
AGGDGCDSEPALTY

SEQ ID NO: 1404831 - protein, 9 aa, Mycobacterium tuberculosis
AGGKARPDI

SEQ ID NO: 1404832 - protein, 5 aa, Mycobacterium tuberculosis
AGGLR

SEQ ID NO: 1404833 - protein, 13 aa, Mycobacterium tuberculosis
AGGPGATGRSYSD

SEQ ID NO: 1404834 - protein, 8 aa, Mycobacterium tuberculosis
AGGPRKVS

SEQ ID NO: 1404835 - protein, 7 aa, Mycobacterium tuberculosis
AGGQGRY

SEQ ID NO: 1404836 - protein, 10 aa, Mycobacterium tuberculosis
AGGRAPGALP

SEQ ID NO: 1404837 - protein, 7 aa, Mycobacterium tuberculosis
AGGRPDE

SEQ ID NO: 1404838 - protein, 10 aa, Mycobacterium tuberculosis
AGGRRRPRSV

SEQ ID NO: 1404839 - protein, 7 aa, Mycobacterium tuberculosis
AGGSPYA

SEQ ID NO: 1404840 - protein, 5 aa, Mycobacterium tuberculosis
AGGTE

SEQ ID NO: 1404841 - protein, 14 aa, Mycobacterium tuberculosis
AGGVDTTSDPPIGL

SEQ ID NO: 1404842 - protein, 6 aa, Mycobacterium tuberculosis
AGHSRE

SEQ ID NO: 1404843 - protein, 11 aa, Mycobacterium tuberculosis
AGIPHESHEVP

SEQ ID NO: 1404844 - protein, 6 aa, Mycobacterium tuberculosis
AGIQSG

SEQ ID NO: 1404845 - protein, 8 aa, Mycobacterium tuberculosis
AGKNAAEV

SEQ ID NO: 1404846 - protein, 7 aa, Mycobacterium tuberculosis
AGKPARY

SEQ ID NO: 1404847 - protein, 7 aa, Mycobacterium tuberculosis
AGKPRQH

SEQ ID NO: 1404848 - protein, 6 aa, Mycobacterium tuberculosis
AGKSQL

SEQ ID NO: 1404849 - protein, 6 aa, Mycobacterium tuberculosis
AGKYGV

SEQ ID NO: 1404850 - protein, 5 aa, Mycobacterium tuberculosis
AGLPD

SEQ ID NO: 1404851 - protein, 16 aa, Mycobacterium tuberculosis
AGLPTSAEDKGAQATV

SEQ ID NO: 1404852 - protein, 4 aa, Mycobacterium tuberculosis
AGLS

SEQ ID NO: 1404853 - protein, 15 aa, Mycobacterium tuberculosis
AGMAPEAKSGYPATP

SEQ ID NO: 1404854 - protein, 8 aa, Mycobacterium tuberculosis
AGMDTGGV

SEQ ID NO: 1404855 - protein, 6 aa, Mycobacterium tuberculosis
AGNEIK

SEQ ID NO: 1404856 - protein, 10 aa, Mycobacterium tuberculosis
AGNGMAGHTA

SEQ ID NO: 1404857 - protein, 7 aa, Mycobacterium tuberculosis
AGNSGID

SEQ ID NO: 1404858 - protein, 9 aa, Mycobacterium tuberculosis
AGPGAPIDT

SEQ ID NO: 1404859 - protein, 11 aa, Mycobacterium tuberculosis
AGPGTPNQPDA

SEQ ID NO: 1404860 - protein, 7 aa, Mycobacterium tuberculosis
AGPRDKN

SEQ ID NO: 1404861 - protein, 11 aa, Mycobacterium tuberculosis
AGPSEQQAGST

SEQ ID NO: 1404862 - protein, 6 aa, Mycobacterium tuberculosis
AGPSGL

SEQ ID NO: 1404863 - protein, 7 aa, Mycobacterium tuberculosis
AGPTAGY

SEQ ID NO: 1404864 - protein, 25 aa, Mycobacterium tuberculosis
AGQADPGDARTGVGASSAAPTGVGG

SEQ ID NO: 1404865 - protein, 24 aa, Mycobacterium tuberculosis
AGQGTIRRSGDRAEGTFNSDMGGG

SEQ ID NO: 1404866 - protein, 18 aa, Mycobacterium tuberculosis
AGQSAPGVVAPREGSIGG

SEQ ID NO: 1404867 - protein, 6 aa, Mycobacterium tuberculosis
AGQSVT

SEQ ID NO: 1404868 - protein, 8 aa, Mycobacterium tuberculosis
AGRAGAQR

SEQ ID NO: 1404869 - protein, 15 aa, Mycobacterium tuberculosis
AGRAGEDGEGFSDGA

SEQ ID NO: 1404870 - protein, 11 aa, Mycobacterium tuberculosis
AGRAIENEQAA

SEQ ID NO: 1404871 - protein, 7 aa, Mycobacterium tuberculosis
AGRARGV

SEQ ID NO: 1404872 - protein, 16 aa, Mycobacterium tuberculosis
AGRDCRQASEELAADG

SEQ ID NO: 1404873 - protein, 8 aa, Mycobacterium tuberculosis
AGRGATRG

SEQ ID NO: 1404874 - protein, 6 aa, Mycobacterium tuberculosis
AGRPIS

SEQ ID NO: 1404875 - protein, 11 aa, Mycobacterium tuberculosis
AGRRAAQACTP

SEQ ID NO: 1404876 - protein, 9 aa, Mycobacterium tuberculosis
AGRRDTARR

SEQ ID NO: 1404877 - protein, 5 aa, Mycobacterium tuberculosis
AGRRH

SEQ ID NO: 1404878 - protein, 9 aa, Mycobacterium tuberculosis
AGRTSPGID

SEQ ID NO: 1404879 - protein, 11 aa, Mycobacterium tuberculosis
AGRYQRDRGPS

SEQ ID NO: 1404880 - protein, 8 aa, Mycobacterium tuberculosis
AGRYRSAS

SEQ ID NO: 1404881 - protein, 7 aa, Mycobacterium tuberculosis
AGSAGSV

SEQ ID NO: 1404882 - protein, 6 aa, Mycobacterium tuberculosis
AGSAPM

SEQ ID NO: 1404883 - protein, 9 aa, Mycobacterium tuberculosis
AGSDALPEP

SEQ ID NO: 1404884 - protein, 10 aa, Mycobacterium tuberculosis
AGSDDQKAAF

SEQ ID NO: 1404885 - protein, 8 aa, Mycobacterium tuberculosis
AGSDGVPS

SEQ ID NO: 1404886 - protein, 12 aa, Mycobacterium tuberculosis
AGSEPMSERPAA

SEQ ID NO: 1404887 - protein, 6 aa, Mycobacterium tuberculosis
AGSEVS

SEQ ID NO: 1404888 - protein, 5 aa, Mycobacterium tuberculosis
AGSGT

SEQ ID NO: 1404889 - protein, 7 aa, Mycobacterium tuberculosis
AGSPDLA

SEQ ID NO: 1404890 - protein, 14 aa, Mycobacterium tuberculosis
AGSPGAPETRANSA

SEQ ID NO: 1404891 - protein, 16 aa, Mycobacterium tuberculosis
AGSPRAASRGAFGQSP

SEQ ID NO: 1404892 - protein, 9 aa, Mycobacterium tuberculosis
AGSSSVATQ

SEQ ID NO: 1404893 - protein, 15 aa, Mycobacterium tuberculosis
AGSYAATEAANAATI

SEQ ID NO: 1404894 - protein, 6 aa, Mycobacterium tuberculosis
AGTADN

SEQ ID NO: 1404895 - protein, 18 aa, Mycobacterium tuberculosis
AGTDRPDGYRAILESHWR

SEQ ID NO: 1404896 - protein, 8 aa, Mycobacterium tuberculosis
AGTDTGPI

SEQ ID NO: 1404897 - protein, 5 aa, Mycobacterium tuberculosis
AGTEK

SEQ ID NO: 1404898 - protein, 5 aa, Mycobacterium tuberculosis
AGTGK

SEQ ID NO: 1404899 - protein, 9 aa, Mycobacterium tuberculosis
AGTGNDHAR

SEQ ID NO: 1404900 - protein, 10 aa, Mycobacterium tuberculosis
AGTGPRPGID

SEQ ID NO: 1404901 - protein, 6 aa, Mycobacterium tuberculosis
AGTGRN

SEQ ID NO: 1404902 - protein, 5 aa, Mycobacterium tuberculosis
AGTGV

SEQ ID NO: 1404903 - protein, 7 aa, Mycobacterium tuberculosis
AGTKERM

SEQ ID NO: 1404904 - protein, 7 aa, Mycobacterium tuberculosis
AGTPESQ

SEQ ID NO: 1404905 - protein, 17 aa, Mycobacterium tuberculosis
AGTPPITPEMVRRALDE

SEQ ID NO: 1404906 - protein, 6 aa, Mycobacterium tuberculosis
AGTQPQ

SEQ ID NO: 1404907 - protein, 11 aa, Mycobacterium tuberculosis
AGTSFATPDKL

SEQ ID NO: 1404908 - protein, 11 aa, Mycobacterium tuberculosis
AGTVKADERTQ

SEQ ID NO: 1404909 - protein, 5 aa, Mycobacterium tuberculosis
AGVGD

SEQ ID NO: 1404910 - protein, 6 aa, Mycobacterium tuberculosis
AGVGGG

SEQ ID NO: 1404911 - protein, 6 aa, Mycobacterium tuberculosis
AGVPQH

SEQ ID NO: 1404912 - protein, 9 aa, Mycobacterium tuberculosis
AGVSDDTPL

SEQ ID NO: 1404913 - protein, 20 aa, Mycobacterium tuberculosis
AGVSTRSVDGVDRTAPPAVS

SEQ ID NO: 1404914 - protein, 11 aa, Mycobacterium tuberculosis
AGYEDALTGEG

SEQ ID NO: 1404915 - protein, 8 aa, Mycobacterium tuberculosis
AHAGGDPG

SEQ ID NO: 1404916 - protein, 17 aa, Mycobacterium tuberculosis
AHDGEHGDRADAAPTSD

SEQ ID NO: 1404917 - protein, 8 aa, Mycobacterium tuberculosis
AHGMDSAT

SEQ ID NO: 1404918 - protein, 6 aa, Mycobacterium tuberculosis
AHGQDG

SEQ ID NO: 1404919 - protein, 6 aa, Mycobacterium tuberculosis
AHGSPT

SEQ ID NO: 1404920 - protein, 5 aa, Mycobacterium tuberculosis
AHKDE

SEQ ID NO: 1404921 - protein, 12 aa, Mycobacterium tuberculosis
AHKRTGAPISTH

SEQ ID NO: 1404922 - protein, 4 aa, Mycobacterium tuberculosis
AHPE

SEQ ID NO: 1404923 - protein, 12 aa, Mycobacterium tuberculosis
AHPGGSNTELTR

SEQ ID NO: 1404924 - protein, 9 aa, Mycobacterium tuberculosis
AHPSAEQAV

SEQ ID NO: 1404925 - protein, 7 aa, Mycobacterium tuberculosis
AHPSLPR

SEQ ID NO: 1404926 - protein, 7 aa, Mycobacterium tuberculosis
AHPSSPP

SEQ ID NO: 1404927 - protein, 19 aa, Mycobacterium tuberculosis
AHQEATAASEMAAVTQVTV

SEQ ID NO: 1404928 - protein, 6 aa, Mycobacterium tuberculosis
AHQSGA

SEQ ID NO: 1404929 - protein, 6 aa, Mycobacterium tuberculosis
AHQSGT

SEQ ID NO: 1404930 - protein, 12 aa, Mycobacterium tuberculosis
AHRPSKPLPPGG

SEQ ID NO: 1404931 - protein, 15 aa, Mycobacterium tuberculosis
AHRRETAKVEESRGR

SEQ ID NO: 1404932 - protein, 9 aa, Mycobacterium tuberculosis
AHSAANGGV

SEQ ID NO: 1404933 - protein, 6 aa, Mycobacterium tuberculosis
AHSKGV

SEQ ID NO: 1404934 - protein, 9 aa, Mycobacterium tuberculosis
AHSRDRGES

SEQ ID NO: 1404935 - protein, 7 aa, Mycobacterium tuberculosis
AHSTQGS

SEQ ID NO: 1404936 - protein, 7 aa, Mycobacterium tuberculosis
AHSVDSS

SEQ ID NO: 1404937 - protein, 12 aa, Mycobacterium tuberculosis
AHTASRRLAEER

SEQ ID NO: 1404938 - protein, 8 aa, Mycobacterium tuberculosis
AIDPDHAS

SEQ ID NO: 1404939 - protein, 10 aa, Mycobacterium tuberculosis
AIPSAGLSGV

SEQ ID NO: 1404940 - protein, 6 aa, Mycobacterium tuberculosis
AIRPSY

SEQ ID NO: 1404941 - protein, 7 aa, Mycobacterium tuberculosis
AISTPAR

SEQ ID NO: 1404942 - protein, 8 aa, Mycobacterium tuberculosis
AKAAGLTP

SEQ ID NO: 1404943 - protein, 5 aa, Mycobacterium tuberculosis
AKAAP

SEQ ID NO: 1404944 - protein, 6 aa, Mycobacterium tuberculosis
AKAGAT

SEQ ID NO: 1404945 - protein, 8 aa, Mycobacterium tuberculosis
AKAPDGSR

SEQ ID NO: 1404946 - protein, 10 aa, Mycobacterium tuberculosis
AKARDAFSAT

SEQ ID NO: 1404947 - protein, 7 aa, Mycobacterium tuberculosis
AKATRKL

SEQ ID NO: 1404948 - protein, 11 aa, Mycobacterium tuberculosis
AKDPDSTYPPI

SEQ ID NO: 1404949 - protein, 4 aa, Mycobacterium tuberculosis
AKDR

SEQ ID NO: 1404950 - protein, 22 aa, Mycobacterium tuberculosis
AKEPGGEKAAAKRDKKGIPSAR

SEQ ID NO: 1404951 - protein, 6 aa, Mycobacterium tuberculosis
AKEQKA

SEQ ID NO: 1404952 - protein, 11 aa, Mycobacterium tuberculosis
AKEVETKEQIA

SEQ ID NO: 1404953 - protein, 15 aa, Mycobacterium tuberculosis
AKGAPPERIQHDPLS

SEQ ID NO: 1404954 - protein, 7 aa, Mycobacterium tuberculosis
AKGGTSF

SEQ ID NO: 1404955 - protein, 10 aa, Mycobacterium tuberculosis
AKGPGLNPFG

SEQ ID NO: 1404956 - protein, 5 aa, Mycobacterium tuberculosis
AKGTD

SEQ ID NO: 1404957 - protein, 8 aa, Mycobacterium tuberculosis
AKIPTERS

SEQ ID NO: 1404958 - protein, 6 aa, Mycobacterium tuberculosis
AKKKAI

SEQ ID NO: 1404959 - protein, 16 aa, Mycobacterium tuberculosis
AKKTDDVAGDGTTTAT

SEQ ID NO: 1404960 - protein, 8 aa, Mycobacterium tuberculosis
AKPDAQAL

SEQ ID NO: 1404961 - protein, 11 aa, Mycobacterium tuberculosis
AKPGRMVGPDP

SEQ ID NO: 1404962 - protein, 12 aa, Mycobacterium tuberculosis
AKPPGLPDSPDL

SEQ ID NO: 1404963 - protein, 6 aa, Mycobacterium tuberculosis
AKPTSN

SEQ ID NO: 1404964 - protein, 4 aa, Mycobacterium tuberculosis
AKPY

SEQ ID NO: 1404965 - protein, 9 aa, Mycobacterium tuberculosis
AKRGYPEDI

SEQ ID NO: 1404966 - protein, 9 aa, Mycobacterium tuberculosis
AKRRLTDSV

SEQ ID NO: 1404967 - protein, 8 aa, Mycobacterium tuberculosis
AKSGTAEL

SEQ ID NO: 1404968 - protein, 15 aa, Mycobacterium tuberculosis
AKSQTAAYGSLPAQG

SEQ ID NO: 1404969 - protein, 12 aa, Mycobacterium tuberculosis
AKTDAAADGGGV

SEQ ID NO: 1404970 - protein, 7 aa, Mycobacterium tuberculosis
AKTPAEI

SEQ ID NO: 1404971 - protein, 13 aa, Mycobacterium tuberculosis
AKVGSDKDNPDIP

SEQ ID NO: 1404972 - protein, 7 aa, Mycobacterium tuberculosis
AKVPGKG

SEQ ID NO: 1404973 - protein, 17 aa, Mycobacterium tuberculosis
ALAEAGKAVAPGVTTDE

SEQ ID NO: 1404974 - protein, 15 aa, Mycobacterium tuberculosis
ALAEESRESGWDKPS

SEQ ID NO: 1404975 - protein, 6 aa, Mycobacterium tuberculosis
ALAEPA

SEQ ID NO: 1404976 - protein, 9 aa, Mycobacterium tuberculosis
ALAGGGPKY

SEQ ID NO: 1404977 - protein, 13 aa, Mycobacterium tuberculosis
ALAGTDIAPPENL

SEQ ID NO: 1404978 - protein, 7 aa, Mycobacterium tuberculosis
ALAPGLR

SEQ ID NO: 1404979 - protein, 6 aa, Mycobacterium tuberculosis
ALAPRG

SEQ ID NO: 1404980 - protein, 7 aa, Mycobacterium tuberculosis
ALATPRR

SEQ ID NO: 1404981 - protein, 9 aa, Mycobacterium tuberculosis
ALDDDDADK

SEQ ID NO: 1404982 - protein, 5 aa, Mycobacterium tuberculosis
ALDPA

SEQ ID NO: 1404983 - protein, 14 aa, Mycobacterium tuberculosis
ALEPVNPPKPPPAI

SEQ ID NO: 1404984 - protein, 6 aa, Mycobacterium tuberculosis
ALETGR

SEQ ID NO: 1404985 - protein, 6 aa, Mycobacterium tuberculosis
ALGAPT

SEQ ID NO: 1404986 - protein, 14 aa, Mycobacterium tuberculosis
ALGDAGGASGSTSM

SEQ ID NO: 1404987 - protein, 7 aa, Mycobacterium tuberculosis
ALGPAAD

SEQ ID NO: 1404988 - protein, 8 aa, Mycobacterium tuberculosis
ALGPGSPV

SEQ ID NO: 1404989 - protein, 5 aa, Mycobacterium tuberculosis
ALGRS

SEQ ID NO: 1404990 - protein, 9 aa, Mycobacterium tuberculosis
ALPAAPDSE

SEQ ID NO: 1404991 - protein, 8 aa, Mycobacterium tuberculosis
ALPDRQRR

SEQ ID NO: 1404992 - protein, 7 aa, Mycobacterium tuberculosis
ALPGSAA

SEQ ID NO: 1404993 - protein, 6 aa, Mycobacterium tuberculosis
ALPPAA

SEQ ID NO: 1404994 - protein, 22 aa, Mycobacterium tuberculosis
ALPPSDEPADPAARPATRSRVP

SEQ ID NO: 1404995 - protein, 22 aa, Mycobacterium tuberculosis
ALPSEKEIARRSEAGIGLTSPE

SEQ ID NO: 1404996 - protein, 19 aa, Mycobacterium tuberculosis
ALPTSLKGAPVSEQSGSAQ

SEQ ID NO: 1404997 - protein, 9 aa, Mycobacterium tuberculosis
ALQESRDRV

SEQ ID NO: 1404998 - protein, 5 aa, Mycobacterium tuberculosis
ALQGG

SEQ ID NO: 1404999 - protein, 11 aa, Mycobacterium tuberculosis
ALSAGSPAFTS

SEQ ID NO: 1405000 - protein, 6 aa, Mycobacterium tuberculosis
ALSTPL

SEQ ID NO: 1405001 - protein, 8 aa, Mycobacterium tuberculosis
ALTDGALS

SEQ ID NO: 1405002 - protein, 4 aa, Mycobacterium tuberculosis
ALTG

SEQ ID NO: 1405003 - protein, 8 aa, Mycobacterium tuberculosis
ALTNADEA

SEQ ID NO: 1405004 - protein, 6 aa, Mycobacterium tuberculosis
ALTQTN

SEQ ID NO: 1405005 - protein, 20 aa, Mycobacterium tuberculosis
AMGSDKYQTDGDPRTSGPGF

SEQ ID NO: 1405006 - protein, 5 aa, Mycobacterium tuberculosis
AMPGE

SEQ ID NO: 1405007 - protein, 16 aa, Mycobacterium tuberculosis
AMRERSELARKGIARA

SEQ ID NO: 1405008 - protein, 8 aa, Mycobacterium tuberculosis
ANADPLTS

SEQ ID NO: 1405009 - protein, 5 aa, Mycobacterium tuberculosis
ANADR

SEQ ID NO: 1405010 - protein, 7 aa, Mycobacterium tuberculosis
ANAESTR

SEQ ID NO: 1405011 - protein, 6 aa, Mycobacterium tuberculosis
ANAGAG

SEQ ID NO: 1405012 - protein, 9 aa, Mycobacterium tuberculosis
ANDGGGSIR

SEQ ID NO: 1405013 - protein, 8 aa, Mycobacterium tuberculosis
ANGAGKST

SEQ ID NO: 1405014 - protein, 4 aa, Mycobacterium tuberculosis
ANGV

SEQ ID NO: 1405015 - protein, 20 aa, Mycobacterium tuberculosis
ANISGHPPPVDAEQARSQLG

SEQ ID NO: 1405016 - protein, 5 aa, Mycobacterium tuberculosis
ANLET

SEQ ID NO: 1405017 - protein, 12 aa, Mycobacterium tuberculosis
ANPEPPSTGQIN

SEQ ID NO: 1405018 - protein, 7 aa, Mycobacterium tuberculosis
ANPGRRG

SEQ ID NO: 1405019 - protein, 7 aa, Mycobacterium tuberculosis
ANPTGPI

SEQ ID NO: 1405020 - protein, 17 aa, Mycobacterium tuberculosis
ANPVPGRGRIEATNPCG

SEQ ID NO: 1405021 - protein, 11 aa, Mycobacterium tuberculosis
ANRDAARDDPR

SEQ ID NO: 1405022 - protein, 11 aa, Mycobacterium tuberculosis
ANRDPRQYEDP

SEQ ID NO: 1405023 - protein, 6 aa, Mycobacterium tuberculosis
ANRKYP

SEQ ID NO: 1405024 - protein, 9 aa, Mycobacterium tuberculosis
ANRLGSNSL

SEQ ID NO: 1405025 - protein, 8 aa, Mycobacterium tuberculosis
ANRNAAGQ

SEQ ID NO: 1405026 - protein, 9 aa, Mycobacterium tuberculosis
ANRSEPDKV

SEQ ID NO: 1405027 - protein, 6 aa, Mycobacterium tuberculosis
ANSAYH

SEQ ID NO: 1405028 - protein, 4 aa, Mycobacterium tuberculosis
ANSP

SEQ ID NO: 1405029 - protein, 8 aa, Mycobacterium tuberculosis
ANSPDSPH

SEQ ID NO: 1405030 - protein, 13 aa, Mycobacterium tuberculosis
ANSPKPGRAPTGL

SEQ ID NO: 1405031 - protein, 12 aa, Mycobacterium tuberculosis
ANSPVADVIDRW

SEQ ID NO: 1405032 - protein, 6 aa, Mycobacterium tuberculosis
ANSTDV

SEQ ID NO: 1405033 - protein, 4 aa, Mycobacterium tuberculosis
ANTA

SEQ ID NO: 1405034 - protein, 7 aa, Mycobacterium tuberculosis
ANVAPPL

SEQ ID NO: 1405035 - protein, 8 aa, Mycobacterium tuberculosis
ANVDPASD

SEQ ID NO: 1405036 - protein, 6 aa, Mycobacterium tuberculosis
ANVGNT

SEQ ID NO: 1405037 - protein, 7 aa, Mycobacterium tuberculosis
ANVPVGS

SEQ ID NO: 1405038 - protein, 7 aa, Mycobacterium tuberculosis
APAADRV

SEQ ID NO: 1405039 - protein, 5 aa, Mycobacterium tuberculosis
APADG

SEQ ID NO: 1405040 - protein, 17 aa, Mycobacterium tuberculosis
APAEASEVSAHAEPAGP

SEQ ID NO: 1405041 - protein, 5 aa, Mycobacterium tuberculosis
APAGF

SEQ ID NO: 1405042 - protein, 8 aa, Mycobacterium tuberculosis
APAGTEPR

SEQ ID NO: 1405043 - protein, 7 aa, Mycobacterium tuberculosis
APANGPA

SEQ ID NO: 1405044 - protein, 17 aa, Mycobacterium tuberculosis
APANPGPAPGSGAGLPE

SEQ ID NO: 1405045 - protein, 6 aa, Mycobacterium tuberculosis
APAQGA

SEQ ID NO: 1405046 - protein, 8 aa, Mycobacterium tuberculosis
APARPGCP

SEQ ID NO: 1405047 - protein, 7 aa, Mycobacterium tuberculosis
APATDED

SEQ ID NO: 1405048 - protein, 4 aa, Mycobacterium tuberculosis
APDE

SEQ ID NO: 1405049 - protein, 6 aa, Mycobacterium tuberculosis
APDETT

SEQ ID NO: 1405050 - protein, 7 aa, Mycobacterium tuberculosis
APDIPRE

SEQ ID NO: 1405051 - protein, 4 aa, Mycobacterium tuberculosis
APDK

SEQ ID NO: 1405052 - protein, 19 aa, Mycobacterium tuberculosis
APDPMAAAGTEPQRGPVPA

SEQ ID NO: 1405053 - protein, 9 aa, Mycobacterium tuberculosis
APDPSPEAA

SEQ ID NO: 1405054 - protein, 20 aa, Mycobacterium tuberculosis
APDPVVSTTTPDDADAAAAG

SEQ ID NO: 1405055 - protein, 13 aa, Mycobacterium tuberculosis
APDTNQQVAGGAP

SEQ ID NO: 1405056 - protein, 9 aa, Mycobacterium tuberculosis
APEATPFGP

SEQ ID NO: 1405057 - protein, 5 aa, Mycobacterium tuberculosis
APENV

SEQ ID NO: 1405058 - protein, 8 aa, Mycobacterium tuberculosis
APEPDTDV

SEQ ID NO: 1405059 - protein, 6 aa, Mycobacterium tuberculosis
APEQGL

SEQ ID NO: 1405060 - protein, 6 aa, Mycobacterium tuberculosis
APESAG

SEQ ID NO: 1405061 - protein, 13 aa, Mycobacterium tuberculosis
APESARLGRRSAA

SEQ ID NO: 1405062 - protein, 12 aa, Mycobacterium tuberculosis
APEYSSAQRALS

SEQ ID NO: 1405063 - protein, 6 aa, Mycobacterium tuberculosis
APFAEA

SEQ ID NO: 1405064 - protein, 7 aa, Mycobacterium tuberculosis
APGADWE

SEQ ID NO: 1405065 - protein, 33 aa, Mycobacterium tuberculosis; identical to SEQ ID NO: 169263

SEQ ID NO: 1405066 - protein, 5 aa, Mycobacterium tuberculosis
APGAQ

SEQ ID NO: 1405067 - protein, 11 aa, Mycobacterium tuberculosis
APGDPKTLTSN

SEQ ID NO: 1405068 - protein, 7 aa, Mycobacterium tuberculosis
APGFGDR

SEQ ID NO: 1405069 - protein, 6 aa, Mycobacterium tuberculosis
APGHPE

SEQ ID NO: 1405070 - protein, 5 aa, Mycobacterium tuberculosis
APGMA

SEQ ID NO: 1405071 - protein, 28 aa, Mycobacterium tuberculosis
APGSGSTADGQTPAGGHSVPNSGGRQGY

SEQ ID NO: 1405072 - protein, 12 aa, Mycobacterium tuberculosis
APGSKMASSAVP

SEQ ID NO: 1405073 - protein, 7 aa, Mycobacterium tuberculosis
APGTGTA

SEQ ID NO: 1405074 - protein, 14 aa, Mycobacterium tuberculosis
APHAKDAEATARDA

SEQ ID NO: 1405075 - protein, 11 aa, Mycobacterium tuberculosis
APIGAPDGDGF

SEQ ID NO: 1405076 - protein, 7 aa, Mycobacterium tuberculosis
APIQGSA

SEQ ID NO: 1405077 - protein, 5 aa, Mycobacterium tuberculosis
APKPL

SEQ ID NO: 1405078 - protein, 8 aa, Mycobacterium tuberculosis
APKSAGAL

SEQ ID NO: 1405079 - protein, 5 aa, Mycobacterium tuberculosis
APLTA

SEQ ID NO: 1405080 - protein, 4 aa, Mycobacterium tuberculosis
APMG

SEQ ID NO: 1405081 - protein, 6 aa, Mycobacterium tuberculosis
APNGYT

SEQ ID NO: 1405082 - protein, 5 aa, Mycobacterium tuberculosis
APNTR

SEQ ID NO: 1405083 - protein, 6 aa, Mycobacterium tuberculosis
APPAEQ

SEQ ID NO: 1405084 - protein, 6 aa, Mycobacterium tuberculosis
APPPAT

SEQ ID NO: 1405085 - protein, 9 aa, Mycobacterium tuberculosis
APPPQEARP

SEQ ID NO: 1405086 - protein, 11 aa, Mycobacterium tuberculosis
APPPQTTNATG

SEQ ID NO: 1405087 - protein, 8 aa, Mycobacterium tuberculosis
APPRDRQG

SEQ ID NO: 1405088 - protein, 6 aa, Mycobacterium tuberculosis
APPTGR

SEQ ID NO: 1405089 - protein, 5 aa, Mycobacterium tuberculosis
APPWV

SEQ ID NO: 1405090 - protein, 19 aa, Mycobacterium tuberculosis
APQIGNTGWNGEDSESRGE

SEQ ID NO: 1405091 - protein, 6 aa, Mycobacterium tuberculosis
APQKGE

SEQ ID NO: 1405092 - protein, 7 aa, Mycobacterium tuberculosis
APQSGSI

SEQ ID NO: 1405093 - protein, 8 aa, Mycobacterium tuberculosis
APRDATRL

SEQ ID NO: 1405094 - protein, 11 aa, Mycobacterium tuberculosis
APRGTARSVDG

SEQ ID NO: 1405095 - protein, 6 aa, Mycobacterium tuberculosis
APRPGA

SEQ ID NO: 1405096 - protein, 8 aa, Mycobacterium tuberculosis
APRSYPPD

SEQ ID NO: 1405097 - protein, 6 aa, Mycobacterium tuberculosis
APRTHA

SEQ ID NO: 1405098 - protein, 6 aa, Mycobacterium tuberculosis
APSARN

SEQ ID NO: 1405099 - protein, 20 aa, Mycobacterium tuberculosis
APSEHGSRCSSARGRLCLSM

SEQ ID NO: 1405100 - protein, 4 aa, Mycobacterium tuberculosis
APSK

SEQ ID NO: 1405101 - protein, 8 aa, Mycobacterium tuberculosis
APSKSGLT

SEQ ID NO: 1405102 - protein, 23 aa, Mycobacterium tuberculosis
APSLTARSRRPPESRSRATTQAG

SEQ ID NO: 1405103 - protein, 11 aa, Mycobacterium tuberculosis
APSPALRGHRG

SEQ ID NO: 1405104 - protein, 5 aa, Mycobacterium tuberculosis
APSRA

SEQ ID NO: 1405105 - protein, 13 aa, Mycobacterium tuberculosis
APSTGAVTGEPDV

SEQ ID NO: 1405106 - protein, 10 aa, Mycobacterium tuberculosis
APSTRQSGKV

SEQ ID NO: 1405107 - protein, 7 aa, Mycobacterium tuberculosis
APTAAGT

SEQ ID NO: 1405108 - protein, 6 aa, Mycobacterium tuberculosis
APTDDD

SEQ ID NO: 1405109 - protein, 6 aa, Mycobacterium tuberculosis
APTLGA

SEQ ID NO: 1405110 - protein, 6 aa, Mycobacterium tuberculosis
APTNHQ

SEQ ID NO: 1405111 - protein, 6 aa, Mycobacterium tuberculosis
APTRDN

SEQ ID NO: 1405112 - protein, 12 aa, Mycobacterium tuberculosis
APTTTQSTPRVP

SEQ ID NO: 1405113 - protein, 13 aa, Mycobacterium tuberculosis
APTTTVGGTPIGG

SEQ ID NO: 1405114 - protein, 6 aa, Mycobacterium tuberculosis
APVDEC

SEQ ID NO: 1405115 - protein, 8 aa, Mycobacterium tuberculosis
APVEPQGP

SEQ ID NO: 1405116 - protein, 8 aa, Mycobacterium tuberculosis
APYETTNR

SEQ ID NO: 1405117 - protein, 6 aa, Mycobacterium tuberculosis
AQAAGG

SEQ ID NO: 1405118 - protein, 6 aa, Mycobacterium tuberculosis
AQAEQI

SEQ ID NO: 1405119 - protein, 4 aa, Mycobacterium tuberculosis
AQAG

SEQ ID NO: 1405120 - protein, 7 aa, Mycobacterium tuberculosis
AQATGSG

SEQ ID NO: 1405121 - protein, 6 aa, Mycobacterium tuberculosis
AQDAFG

SEQ ID NO: 1405122 - protein, 7 aa, Mycobacterium tuberculosis
AQEAGRD

SEQ ID NO: 1405123 - protein, 12 aa, Mycobacterium tuberculosis
AQEGALSQIDED

SEQ ID NO: 1405124 - protein, 7 aa, Mycobacterium tuberculosis
AQEPGRE

SEQ ID NO: 1405125 - protein, 7 aa, Mycobacterium tuberculosis
AQGEARI

SEQ ID NO: 1405126 - protein, 6 aa, Mycobacterium tuberculosis
AQGQSD

SEQ ID NO: 1405127 - protein, 5 aa, Mycobacterium tuberculosis
AQGYS

SEQ ID NO: 1405128 - protein, 10 aa, Mycobacterium tuberculosis
AQGYSDSQGI

SEQ ID NO: 1405129 - protein, 14 aa, Mycobacterium tuberculosis
AQHTGARREIDRAA

SEQ ID NO: 1405130 - protein, 8 aa, Mycobacterium tuberculosis
AQISSAPN

SEQ ID NO: 1405131 - protein, 6 aa, Mycobacterium tuberculosis
AQKAGL

SEQ ID NO: 1405132 - protein, 11 aa, Mycobacterium tuberculosis
AQLGAGQSIPT

SEQ ID NO: 1405133 - protein, 7 aa, Mycobacterium tuberculosis
AQLGTTG

SEQ ID NO: 1405134 - protein, 20 aa, Mycobacterium tuberculosis
AQLQKGATQPATSGASASVH

SEQ ID NO: 1405135 - protein, 8 aa, Mycobacterium tuberculosis
AQPAASAA

SEQ ID NO: 1405136 - protein, 13 aa, Mycobacterium tuberculosis
AQPAQGVVPSSKL

SEQ ID NO: 1405137 - protein, 14 aa, Mycobacterium tuberculosis
AQPISEGDRANPGH

SEQ ID NO: 1405138 - protein, 13 aa, Mycobacterium tuberculosis
AQPPTQAPLTQEE

SEQ ID NO: 1405139 - protein, 6 aa, Mycobacterium tuberculosis
AQPTEP

SEQ ID NO: 1405140 - protein, 9 aa, Mycobacterium tuberculosis
AQQKKPWER

SEQ ID NO: 1405141 - protein, 13 aa, Mycobacterium tuberculosis
AQRAENDYVGAPT

SEQ ID NO: 1405142 - protein, 15 aa, Mycobacterium tuberculosis
AQRAHAPADVVEVLT

SEQ ID NO: 1405143 - protein, 15 aa, Mycobacterium tuberculosis
AQRGRGERKRPSNGW

SEQ ID NO: 1405144 - protein, 4 aa, Mycobacterium tuberculosis
AQRK

SEQ ID NO: 1405145 - protein, 122 aa, Mycobacterium tuberculosis
AQRLPAEGPAVKRGVGASAAKKVAKKAPAKKATKAAKKAATKAPARKAATKAPAKKAATKAPAKKAVKATKSPAKKVTKAVKKTAVKASVRKAATKAPAKKAAAKRPATKAPAKKATARRGR

SEQ ID NO: 1405146 - protein, 7 aa, Mycobacterium tuberculosis
AQRPDAV

SEQ ID NO: 1405147 - protein, 5 aa, Mycobacterium tuberculosis
AQRRK

SEQ ID NO: 1405148 - protein, 5 aa, Mycobacterium tuberculosis
AQRTP

SEQ ID NO: 1405149 - protein, 8 aa, Mycobacterium tuberculosis
AQSSDVLS

SEQ ID NO: 1405150 - protein, 9 aa, Mycobacterium tuberculosis
AQSTDKRVN

SEQ ID NO: 1405151 - protein, 8 aa, Mycobacterium tuberculosis
AQSVSRGS

SEQ ID NO: 1405152 - protein, 13 aa, Mycobacterium tuberculosis
AQTASLDGPLPRD

SEQ ID NO: 1405153 - protein, 6 aa, Mycobacterium tuberculosis
AQTTAR

SEQ ID NO: 1405154 - protein, 17 aa, Mycobacterium tuberculosis
ARAATGADESVQTGEGR

SEQ ID NO: 1405155 - protein, 6 aa, Mycobacterium tuberculosis
ARAEGY

SEQ ID NO: 1405156 - protein, 7 aa, Mycobacterium tuberculosis
ARAGAVG

SEQ ID NO: 1405157 - protein, 6 aa, Mycobacterium tuberculosis
ARAGGL

SEQ ID NO: 1405158 - protein, 7 aa, Mycobacterium tuberculosis
ARAGPRW

SEQ ID NO: 1405159 - protein, 9 aa, Mycobacterium tuberculosis
ARAKEQDTE

SEQ ID NO: 1405160 - protein, 9 aa, Mycobacterium tuberculosis
ARAQATVGE

SEQ ID NO: 1405161 - protein, 4 aa, Mycobacterium tuberculosis
ARDA

SEQ ID NO: 1405162 - protein, 9 aa, Mycobacterium tuberculosis
ARDRDDPRP

SEQ ID NO: 1405163 - protein, 6 aa, Mycobacterium tuberculosis
ARDTEI

SEQ ID NO: 1405164 - protein, 9 aa, Mycobacterium tuberculosis
AREAEAAGY

SEQ ID NO: 1405165 - protein, 12 aa, Mycobacterium tuberculosis
ARESGTKALRDA

SEQ ID NO: 1405166 - protein, 6 aa, Mycobacterium tuberculosis
ARGAAL

SEQ ID NO: 1405167 - protein, 6 aa, Mycobacterium tuberculosis
ARGDLN

SEQ ID NO: 1405168 - protein, 7 aa, Mycobacterium tuberculosis
ARGGEPA

SEQ ID NO: 1405169 - protein, 15 aa, Mycobacterium tuberculosis
ARGGKAAGSVSKKTN

SEQ ID NO: 1405170 - protein, 6 aa, Mycobacterium tuberculosis
ARGGSA

SEQ ID NO: 1405171 - protein, 7 aa, Mycobacterium tuberculosis
ARGLGAP

SEQ ID NO: 1405172 - protein, 5 aa, Mycobacterium tuberculosis
ARGPV

SEQ ID NO: 1405173 - protein, 5 aa, Mycobacterium tuberculosis
ARGVE

SEQ ID NO: 1405174 - protein, 20 aa, Mycobacterium tuberculosis
ARHGGGAFSGKDPSKVDRSA

SEQ ID NO: 1405175 - protein, 16 aa, Mycobacterium tuberculosis
ARHPAAESTVTGSASD

SEQ ID NO: 1405176 - protein, 6 aa, Mycobacterium tuberculosis
ARITGG

SEQ ID NO: 1405177 - protein, 6 aa, Mycobacterium tuberculosis
ARNDDG

SEQ ID NO: 1405178 - protein, 9 aa, Mycobacterium tuberculosis
ARPAGLPGS

SEQ ID NO: 1405179 - protein, 7 aa, Mycobacterium tuberculosis
ARPDTLP

SEQ ID NO: 1405180 - protein, 5 aa, Mycobacterium tuberculosis
ARPPV

SEQ ID NO: 1405181 - protein, 11 aa, Mycobacterium tuberculosis
ARPRNSTELDE

SEQ ID NO: 1405182 - protein, 4 aa, Mycobacterium tuberculosis
ARQG

SEQ ID NO: 1405183 - protein, 6 aa, Mycobacterium tuberculosis
ARQGAG

SEQ ID NO: 1405184 - protein, 5 aa, Mycobacterium tuberculosis
ARQGN

SEQ ID NO: 1405185 - protein, 5 aa, Mycobacterium tuberculosis
ARQLP

SEQ ID NO: 1405186 - protein, 6 aa, Mycobacterium tuberculosis
ARQTLT

SEQ ID NO: 1405187 - protein, 8 aa, Mycobacterium tuberculosis
ARRCPDRP

SEQ ID NO: 1405188 - protein, 13 aa, Mycobacterium tuberculosis
ARRDTDPADTDAL

SEQ ID NO: 1405189 - protein, 8 aa, Mycobacterium tuberculosis
ARREGTRQ

SEQ ID NO: 1405190 - protein, 13 aa, Mycobacterium tuberculosis
ARRLSRSGAPGRR

SEQ ID NO: 1405191 - protein, 5 aa, Mycobacterium tuberculosis
ARSAK

SEQ ID NO: 1405192 - protein, 8 aa, Mycobacterium tuberculosis
ARSRATRR

SEQ ID NO: 1405193 - protein, 5 aa, Mycobacterium tuberculosis
ARSRS

SEQ ID NO: 1405194 - protein, 12 aa, Mycobacterium tuberculosis
ARSSLEKPVPVP

SEQ ID NO: 1405195 - protein, 4 aa, Mycobacterium tuberculosis
ARST

SEQ ID NO: 1405196 - protein, 7 aa, Mycobacterium tuberculosis
ARTDTLS

SEQ ID NO: 1405197 - protein, 8 aa, Mycobacterium tuberculosis
ARTGVRRP

SEQ ID NO: 1405198 - protein, 8 aa, Mycobacterium tuberculosis
ARTRRDGR

SEQ ID NO: 1405199 - protein, 6 aa, Mycobacterium tuberculosis
ARTRYP

SEQ ID NO: 1405200 - protein, 8 aa, Mycobacterium tuberculosis
ARTSAGNV

SEQ ID NO: 1405201 - protein, 7 aa, Mycobacterium tuberculosis
ARVRGAG

SEQ ID NO: 1405202 - protein, 9 aa, Mycobacterium tuberculosis
ARVTTDEEI

SEQ ID NO: 1405203 - protein, 5 aa, Mycobacterium tuberculosis
ASAAP

SEQ ID NO: 1405204 - protein, 5 aa, Mycobacterium tuberculosis
ASAAV

SEQ ID NO: 1405205 - protein, 9 aa, Mycobacterium tuberculosis
ASADRTPGF

SEQ ID NO: 1405206 - protein, 9 aa, Mycobacterium tuberculosis
ASAGNAAAA

SEQ ID NO: 1405207 - protein, 7 aa, Mycobacterium tuberculosis
ASAGPLD

SEQ ID NO: 1405208 - protein, 8 aa, Mycobacterium tuberculosis
ASAGTGKT

SEQ ID NO: 1405209 - protein, 7 aa, Mycobacterium tuberculosis
ASAIQGN

SEQ ID NO: 1405210 - protein, 8 aa, Mycobacterium tuberculosis
ASAPRPAP

SEQ ID NO: 1405211 - protein, 13 aa, Mycobacterium tuberculosis
ASAPVSGGWAGPE

SEQ ID NO: 1405212 - protein, 8 aa, Mycobacterium tuberculosis
ASATPAGL

SEQ ID NO: 1405213 - protein, 14 aa, Mycobacterium tuberculosis
ASATPPESGQPFQA

SEQ ID NO: 1405214 - protein, 9 aa, Mycobacterium tuberculosis
ASCGPDAAL

SEQ ID NO: 1405215 - protein, 16 aa, Mycobacterium tuberculosis
ASDGESNFGKIGSPQI

SEQ ID NO: 1405216 - protein, 27 aa, Mycobacterium tuberculosis
ASDGPRRSSTRSECHSSGAQSAPPNTS

SEQ ID NO: 1405217 - protein, 5 aa, Mycobacterium tuberculosis
ASDHR

SEQ ID NO: 1405218 - protein, 6 aa, Mycobacterium tuberculosis
ASDPNR

SEQ ID NO: 1405219 - protein, 7 aa, Mycobacterium tuberculosis
ASDQTVE

SEQ ID NO: 1405220 - protein, 7 aa, Mycobacterium tuberculosis
ASDVNGP

SEQ ID NO: 1405221 - protein, 7 aa, Mycobacterium tuberculosis
ASDVTAT

SEQ ID NO: 1405222 - protein, 8 aa, Mycobacterium tuberculosis
ASEYEING

SEQ ID NO: 1405223 - protein, 9 aa, Mycobacterium tuberculosis
ASGADIGRP

SEQ ID NO: 1405224 - protein, 18 aa, Mycobacterium tuberculosis
ASGEPASGPASNSPARKR

SEQ ID NO: 1405225 - protein, 7 aa, Mycobacterium tuberculosis
ASGGAGP

SEQ ID NO: 1405226 - protein, 12 aa, Mycobacterium tuberculosis
ASGGAVSLPARG

SEQ ID NO: 1405227 - protein, 8 aa, Mycobacterium tuberculosis
ASGGSVGY

SEQ ID NO: 1405228 - protein, 4 aa, Mycobacterium tuberculosis
ASGI

SEQ ID NO: 1405229 - protein, 8 aa, Mycobacterium tuberculosis
ASGRTRSV

SEQ ID NO: 1405230 - protein, 45 aa, Mycobacterium tuberculosis; identical to SEQ ID NO: 170044

SEQ ID NO: 1405231 - protein, 8 aa, Mycobacterium tuberculosis
ASGTAATG

SEQ ID NO: 1405232 - protein, 5 aa, Mycobacterium tuberculosis
ASKPI

SEQ ID NO: 1405233 - protein, 7 aa, Mycobacterium tuberculosis
ASKTSIE

SEQ ID NO: 1405234 - protein, 10 aa, Mycobacterium tuberculosis
ASLPEERSRE

SEQ ID NO: 1405235 - protein, 8 aa, Mycobacterium tuberculosis
ASPAISNR

SEQ ID NO: 1405236 - protein, 6 aa, Mycobacterium tuberculosis
ASPALQ

SEQ ID NO: 1405237 - protein, 6 aa, Mycobacterium tuberculosis
ASPAYV

SEQ ID NO: 1405238 - protein, 6 aa, Mycobacterium tuberculosis
ASPGFR

SEQ ID NO: 1405239 - protein, 6 aa, Mycobacterium tuberculosis
ASPGSH

SEQ ID NO: 1405240 - protein, 5 aa, Mycobacterium tuberculosis
ASPGY

SEQ ID NO: 1405241 - protein, 6 aa, Mycobacterium tuberculosis
ASPIKA

SEQ ID NO: 1405242 - protein, 4 aa, Mycobacterium tuberculosis
ASPM

SEQ ID NO: 1405243 - protein, 6 aa, Mycobacterium tuberculosis
ASPRAS

SEQ ID NO: 1405244 - protein, 4 aa, Mycobacterium tuberculosis
ASRG

SEQ ID NO: 1405245 - protein, 8 aa, Mycobacterium tuberculosis
ASRGEPSM

SEQ ID NO: 1405246 - protein, 20 aa, Mycobacterium tuberculosis
ASRLAGAYGEHAAAEIVAVL

SEQ ID NO: 1405247 - protein, 7 aa, Mycobacterium tuberculosis
ASRPWAT

SEQ ID NO: 1405248 - protein, 16 aa, Mycobacterium tuberculosis
ASRQKARAARRLGFEV

SEQ ID NO: 1405249 - protein, 7 aa, Mycobacterium tuberculosis
ASRSDVG

SEQ ID NO: 1405250 - protein, 8 aa, Mycobacterium tuberculosis
ASRSERGA

SEQ ID NO: 1405251 - protein, 9 aa, Mycobacterium tuberculosis
ASRTGGTTI

SEQ ID NO: 1405252 - protein, 11 aa, Mycobacterium tuberculosis
ASRYPDPERAI

SEQ ID NO: 1405253 - protein, 7 aa, Mycobacterium tuberculosis
ASSAGTG

SEQ ID NO: 1405254 - protein, 23 aa, Mycobacterium tuberculosis
ASSARPRLTPPVPSIPGRRSKPT

SEQ ID NO: 1405255 - protein, 18 aa, Mycobacterium tuberculosis
ASSASSYAATEVANAAAA

SEQ ID NO: 1405256 - protein, 7 aa, Mycobacterium tuberculosis
ASSDERA

SEQ ID NO: 1405257 - protein, 10 aa, Mycobacterium tuberculosis
ASSDKTQVSI

SEQ ID NO: 1405258 - protein, 10 aa, Mycobacterium tuberculosis
ASSEASGSTL

SEQ ID NO: 1405259 - protein, 10 aa, Mycobacterium tuberculosis
ASSHSGPASL

SEQ ID NO: 1405260 - protein, 7 aa, Mycobacterium tuberculosis
ASSYMTG

SEQ ID NO: 1405261 - protein, 22 aa, Mycobacterium tuberculosis
ASTASPGISRETIEASRRELRG

SEQ ID NO: 1405262 - protein, 4 aa, Mycobacterium tuberculosis
ASTE

SEQ ID NO: 1405263 - protein, 7 aa, Mycobacterium tuberculosis
ASTGAGA

SEQ ID NO: 1405264 - protein, 8 aa, Mycobacterium tuberculosis
ASTGAGAL

SEQ ID NO: 1405265 - protein, 8 aa, Mycobacterium tuberculosis
ASTPGCTK

SEQ ID NO: 1405266 - protein, 7 aa, Mycobacterium tuberculosis
ASTPLNR

SEQ ID NO: 1405267 - protein, 13 aa, Mycobacterium tuberculosis
ASYAPRSGGSAAL

SEQ ID NO: 1405268 - protein, 13 aa, Mycobacterium tuberculosis
ASYGTAPAGRGPL

SEQ ID NO: 1405269 - protein, 6 aa, Mycobacterium tuberculosis
ASYSGV

SEQ ID NO: 1405270 - protein, 10 aa, Mycobacterium tuberculosis
ATADSSLSPV

SEQ ID NO: 1405271 - protein, 9 aa, Mycobacterium tuberculosis
ATAEDPGGR

SEQ ID NO: 1405272 - protein, 8 aa, Mycobacterium tuberculosis
ATARETVR

SEQ ID NO: 1405273 - protein, 6 aa, Mycobacterium tuberculosis
ATARPP

SEQ ID NO: 1405274 - protein, 4 aa, Mycobacterium tuberculosis
ATAT

SEQ ID NO: 1405275 - protein, 6 aa, Mycobacterium tuberculosis
ATATAT

SEQ ID NO: 1405276 - protein, 5 aa, Mycobacterium tuberculosis
ATAVA

SEQ ID NO: 1405277 - protein, 11 aa, Mycobacterium tuberculosis
ATCTGRPATTF

SEQ ID NO: 1405278 - protein, 6 aa, Mycobacterium tuberculosis
ATDDRC

SEQ ID NO: 1405279 - protein, 5 aa, Mycobacterium tuberculosis
ATDEL

SEQ ID NO: 1405280 - protein, 7 aa, Mycobacterium tuberculosis
ATDGGVD

SEQ ID NO: 1405281 - protein, 8 aa, Mycobacterium tuberculosis
ATDRDRRP

SEQ ID NO: 1405282 - protein, 5 aa, Mycobacterium tuberculosis
ATDTG

SEQ ID NO: 1405283 - protein, 15 aa, Mycobacterium tuberculosis
ATEAIGAGRYERSDG

SEQ ID NO: 1405284 - protein, 5 aa, Mycobacterium tuberculosis
ATEPG

SEQ ID NO: 1405285 - protein, 19 aa, Mycobacterium tuberculosis
ATEPLTKTTITRRDPGPHD

SEQ ID NO: 1405286 - protein, 17 aa, Mycobacterium tuberculosis
ATEPNPATSTPEGLRPD

SEQ ID NO: 1405287 - protein, 18 aa, Mycobacterium tuberculosis
ATESPTSPGWTGARGTPT

SEQ ID NO: 1405288 - protein, 5 aa, Mycobacterium tuberculosis
ATETL

SEQ ID NO: 1405289 - protein, 11 aa, Mycobacterium tuberculosis
ATGAQTAKPSL

SEQ ID NO: 1405290 - protein, 11 aa, Mycobacterium tuberculosis
ATGARTANAGP

SEQ ID NO: 1405291 - protein, 4 aa, Mycobacterium tuberculosis
ATGD

SEQ ID NO: 1405292 - protein, 5 aa, Mycobacterium tuberculosis
ATGDE

SEQ ID NO: 1405293 - protein, 6 aa, Mycobacterium tuberculosis
ATGEGV

SEQ ID NO: 1405294 - protein, 7 aa, Mycobacterium tuberculosis
ATGIDEP

SEQ ID NO: 1405295 - protein, 16 aa, Mycobacterium tuberculosis
ATGMDPRVAGKPAPAL

SEQ ID NO: 1405296 - protein, 5 aa, Mycobacterium tuberculosis
ATGNK

SEQ ID NO: 1405297 - protein, 4 aa, Mycobacterium tuberculosis
ATGP

SEQ ID NO: 1405298 - protein, 11 aa, Mycobacterium tuberculosis
ATGPTQPEAGE

SEQ ID NO: 1405299 - protein, 14 aa, Mycobacterium tuberculosis
ATGSSTRLVPGTSL

SEQ ID NO: 1405300 - protein, 7 aa, Mycobacterium tuberculosis
ATGSSVD

SEQ ID NO: 1405301 - protein, 10 aa, Mycobacterium tuberculosis
ATGTGKSATT

SEQ ID NO: 1405302 - protein, 7 aa, Mycobacterium tuberculosis
ATGVPRG

SEQ ID NO: 1405303 - protein, 5 aa, Mycobacterium tuberculosis
ATHAK

SEQ ID NO: 1405304 - protein, 6 aa, Mycobacterium tuberculosis
ATHPDV

SEQ ID NO: 1405305 - protein, 8 aa, Mycobacterium tuberculosis
ATKDPRGL

SEQ ID NO: 1405306 - protein, 7 aa, Mycobacterium tuberculosis
ATKQPQR

SEQ ID NO: 1405307 - protein, 13 aa, Mycobacterium tuberculosis
ATKYERKAQLGGG

SEQ ID NO: 1405308 - protein, 6 aa, Mycobacterium tuberculosis
ATMDPT

SEQ ID NO: 1405309 - protein, 19 aa, Mycobacterium tuberculosis
ATPAAAQEISDTEPELSDE

SEQ ID NO: 1405310 - protein, 21 aa, Mycobacterium tuberculosis
ATPADLRTAPDTAGRPAEGTE

SEQ ID NO: 1405311 - protein, 8 aa, Mycobacterium tuberculosis
ATPAPDGT

SEQ ID NO: 1405312 - protein, 6 aa, Mycobacterium tuberculosis
ATPGPH

SEQ ID NO: 1405313 - protein, 14 aa, Mycobacterium tuberculosis
ATPGPYELSQTGGE

SEQ ID NO: 1405314 - protein, 7 aa, Mycobacterium tuberculosis
ATPPAGI

SEQ ID NO: 1405315 - protein, 6 aa, Mycobacterium tuberculosis
ATPPFT

SEQ ID NO: 1405316 - protein, 8 aa, Mycobacterium tuberculosis
ATPSDTIY

SEQ ID NO: 1405317 - protein, 18 aa, Mycobacterium tuberculosis
ATPTFSSSAGADPTALNG

SEQ ID NO: 1405318 - protein, 5 aa, Mycobacterium tuberculosis
ATPTI

SEQ ID NO: 1405319 - protein, 5 aa, Mycobacterium tuberculosis
ATPVA

SEQ ID NO: 1405320 - protein, 10 aa, Mycobacterium tuberculosis
ATPVSGKTGI

SEQ ID NO: 1405321 - protein, 9 aa, Mycobacterium tuberculosis
ATQDQPDGL

SEQ ID NO: 1405322 - protein, 7 aa, Mycobacterium tuberculosis
ATRARQT

SEQ ID NO: 1405323 - protein, 13 aa, Mycobacterium tuberculosis
ATRENAAKALRSG

SEQ ID NO: 1405324 - protein, 17 aa, Mycobacterium tuberculosis
ATRGDPSNVDIPGATAA

SEQ ID NO: 1405325 - protein, 20 aa, Mycobacterium tuberculosis
ATRGSERLATSDVGERIAAA

SEQ ID NO: 1405326 - protein, 8 aa, Mycobacterium tuberculosis
ATRSSPAL

SEQ ID NO: 1405327 - protein, 12 aa, Mycobacterium tuberculosis
ATRTQATATGVA

SEQ ID NO: 1405328 - protein, 7 aa, Mycobacterium tuberculosis
ATSAEVS

SEQ ID NO: 1405329 - protein, 17 aa, Mycobacterium tuberculosis
ATSAKGSSTEDPGPDLA

SEQ ID NO: 1405330 - protein, 4 aa, Mycobacterium tuberculosis
ATSG

SEQ ID NO: 1405331 - protein, 13 aa, Mycobacterium tuberculosis
ATSQISYTASKGG

SEQ ID NO: 1405332 - protein, 10 aa, Mycobacterium tuberculosis
ATSREGKAQV

SEQ ID NO: 1405333 - protein, 8 aa, Mycobacterium tuberculosis
ATSRPSAL

SEQ ID NO: 1405334 - protein, 6 aa, Mycobacterium tuberculosis
ATSSQA

SEQ ID NO: 1405335 - protein, 9 aa, Mycobacterium tuberculosis
ATSTPRAED

SEQ ID NO: 1405336 - protein, 7 aa, Mycobacterium tuberculosis
ATTPGKV

SEQ ID NO: 1405337 - protein, 12 aa, Mycobacterium tuberculosis
ATTRAPRPGEVD

SEQ ID NO: 1405338 - protein, 11 aa, Mycobacterium tuberculosis
ATTSAEAKYAA

SEQ ID NO: 1405339 - protein, 6 aa, Mycobacterium tuberculosis
ATVGRR

SEQ ID NO: 1405340 - protein, 5 aa, Mycobacterium tuberculosis
AVEGR

SEQ ID NO: 1405341 - protein, 12 aa, Mycobacterium tuberculosis
AVEPGQPLDQQE

SEQ ID NO: 1405342 - protein, 10 aa, Mycobacterium tuberculosis
AVETDRPDPL

SEQ ID NO: 1405343 - protein, 7 aa, Mycobacterium tuberculosis
AVGGRGQ

SEQ ID NO: 1405344 - protein, 9 aa, Mycobacterium tuberculosis
AVGKSTTAR

SEQ ID NO: 1405345 - protein, 11 aa, Mycobacterium tuberculosis
AVPEADTEAAP

SEQ ID NO: 1405346 - protein, 11 aa, Mycobacterium tuberculosis
AVPGRRDDLGG

SEQ ID NO: 1405347 - protein, 17 aa, Mycobacterium tuberculosis
AVPPEAGVPAALSPETQ

SEQ ID NO: 1405348 - protein, 6 aa, Mycobacterium tuberculosis
AVPSHD

SEQ ID NO: 1405349 - protein, 13 aa, Mycobacterium tuberculosis
AVRAGATAQEAAE

SEQ ID NO: 1405350 - protein, 11 aa, Mycobacterium tuberculosis
AVRQGDPLDTE

SEQ ID NO: 1405351 - protein, 7 aa, Mycobacterium tuberculosis
AVSAPSG

SEQ ID NO: 1405352 - protein, 7 aa, Mycobacterium tuberculosis
AVSGSGP

SEQ ID NO: 1405353 - protein, 9 aa, Mycobacterium tuberculosis
AVSSGATGL

SEQ ID NO: 1405354 - protein, 10 aa, Mycobacterium tuberculosis
AVSSGDNSNI

SEQ ID NO: 1405355 - protein, 6 aa, Mycobacterium tuberculosis
AVSSGV

SEQ ID NO: 1405356 - protein, 9 aa, Mycobacterium tuberculosis
AVTDTGEPV

SEQ ID NO: 1405357 - protein, 13 aa, Mycobacterium tuberculosis
AWGGSGSEAYQGV

SEQ ID NO: 1405358 - protein, 5 aa, Mycobacterium tuberculosis
AWHGP

SEQ ID NO: 1405359 - protein, 4 aa, Mycobacterium tuberculosis
AWPG

SEQ ID NO: 1405360 - protein, 8 aa, Mycobacterium tuberculosis
AWQGDTGI

SEQ ID NO: 1405361 - protein, 5 aa, Mycobacterium tuberculosis
AWRGP

SEQ ID NO: 1405362 - protein, 8 aa, Mycobacterium tuberculosis
AYDEPASV

SEQ ID NO: 1405363 - protein, 8 aa, Mycobacterium tuberculosis
AYEGGASI

SEQ ID NO: 1405364 - protein, 8 aa, Mycobacterium tuberculosis
AYESGDGQ

SEQ ID NO: 1405365 - protein, 7 aa, Mycobacterium tuberculosis
AYGPTRN

SEQ ID NO: 1405366 - protein, 6 aa, Mycobacterium tuberculosis
AYQGAD

SEQ ID NO: 1405367 - protein, 10 aa, Mycobacterium tuberculosis
AYTSADPVSG

SEQ ID NO: 1405368 - protein, 6 aa, Mycobacterium tuberculosis
CADPTE

SEQ ID NO: 1405369 - protein, 10 aa, Mycobacterium tuberculosis
CAQRTDHRRG

SEQ ID NO: 1405370 - protein, 12 aa, Mycobacterium tuberculosis
CASGSQALQSAR

SEQ ID NO: 1405371 - protein, 8 aa, Mycobacterium tuberculosis
CATGGGRV

SEQ ID NO: 1405372 - protein, 12 aa, Mycobacterium tuberculosis
CDEAGRDRSTLQ

SEQ ID NO: 1405373 - protein, 5 aa, Mycobacterium tuberculosis
CERAA

SEQ ID NO: 1405374 - protein, 15 aa, Mycobacterium tuberculosis
CGKTATAIGKPAAEG

SEQ ID NO: 1405375 - protein, 8 aa, Mycobacterium tuberculosis
CGSPPAGE

SEQ ID NO: 1405376 - protein, 5 aa, Mycobacterium tuberculosis
CGTGP

SEQ ID NO: 1405377 - protein, 10 aa, Mycobacterium tuberculosis
CNDPDLDPFG

SEQ ID NO: 1405378 - protein, 9 aa, Mycobacterium tuberculosis
CPGDPTPRF

SEQ ID NO: 1405379 - protein, 6 aa, Mycobacterium tuberculosis
CPGPEA

SEQ ID NO: 1405380 - protein, 5 aa, Mycobacterium tuberculosis
CQGRT

SEQ ID NO: 1405381 - protein, 7 aa, Mycobacterium tuberculosis
CRDGSDP

SEQ ID NO: 1405382 - protein, 11 aa, Mycobacterium tuberculosis
CRGDRAPEGLR

SEQ ID NO: 1405383 - protein, 18 aa, Mycobacterium tuberculosis
CRGSTGPSSLARDGKPWG

SEQ ID NO: 1405384 - protein, 12 aa, Mycobacterium tuberculosis
CRPDASPGSPEW

SEQ ID NO: 1405385 - protein, 4 aa, Mycobacterium tuberculosis
CSRQ

SEQ ID NO: 1405386 - protein, 6 aa, Mycobacterium tuberculosis
CSRRGA

SEQ ID NO: 1405387 - protein, 9 aa, Mycobacterium tuberculosis
CTGKGNDQV

SEQ ID NO: 1405388 - protein, 8 aa, Mycobacterium tuberculosis
CTKSDTVD

SEQ ID NO: 1405389 - protein, 10 aa, Mycobacterium tuberculosis
CTSGGEPGCG

SEQ ID NO: 1405390 - protein, 5 aa, Mycobacterium tuberculosis
CYGPP

SEQ ID NO: 1405391 - protein, 8 aa, Mycobacterium tuberculosis
DAAHAGEY

SEQ ID NO: 1405392 - protein, 14 aa, Mycobacterium tuberculosis
DAALTRRAKRASRL

SEQ ID NO: 1405393 - protein, 10 aa, Mycobacterium tuberculosis
DAARAARQVG

SEQ ID NO: 1405394 - protein, 9 aa, Mycobacterium tuberculosis
DAASDEMTE

SEQ ID NO: 1405395 - protein, 7 aa, Mycobacterium tuberculosis
DAATQAA

SEQ ID NO: 1405396 - protein, 8 aa, Mycobacterium tuberculosis
DADAPGAR

SEQ ID NO: 1405397 - protein, 14 aa, Mycobacterium tuberculosis
DADAVRRRKEYQAQ

SEQ ID NO: 1405398 - protein, 6 aa, Mycobacterium tuberculosis
DADDDY

SEQ ID NO: 1405399 - protein, 7 aa, Mycobacterium tuberculosis
DADGGTG

SEQ ID NO: 1405400 - protein, 8 aa, Mycobacterium tuberculosis
DADGSAFA

SEQ ID NO: 1405401 - protein, 6 aa, Mycobacterium tuberculosis
DADGTL

SEQ ID NO: 1405402 - protein, 4 aa, Mycobacterium tuberculosis
DADP

SEQ ID NO: 1405403 - protein, 7 aa, Mycobacterium tuberculosis
DADPATI

SEQ ID NO: 1405404 - protein, 9 aa, Mycobacterium tuberculosis
DAEHNRASA

SEQ ID NO: 1405405 - protein, 10 aa, Mycobacterium tuberculosis
DAEITTTAGP

SEQ ID NO: 1405406 - protein, 13 aa, Mycobacterium tuberculosis
DAELQRLAGKLTR

SEQ ID NO: 1405407 - protein, 8 aa, Mycobacterium tuberculosis
DAELTERP

SEQ ID NO: 1405408 - protein, 10 aa, Mycobacterium tuberculosis
DAGADPARFD

SEQ ID NO: 1405409 - protein, 10 aa, Mycobacterium tuberculosis
DAGAERGRAE

SEQ ID NO: 1405410 - protein, 15 aa, Mycobacterium tuberculosis
DAGDPALAADPQSLA

SEQ ID NO: 1405411 - protein, 5 aa, Mycobacterium tuberculosis
DAGLN

SEQ ID NO: 1405412 - protein, 7 aa, Mycobacterium tuberculosis
DAGPPTM

SEQ ID NO: 1405413 - protein, 5 aa, Mycobacterium tuberculosis
DAHHA

SEQ ID NO: 1405414 - protein, 9 aa, Mycobacterium tuberculosis
DAKAQADRM

SEQ ID NO: 1405415 - protein, 7 aa, Mycobacterium tuberculosis
DALDGNQ

SEQ ID NO: 1405416 - protein, 5 aa, Mycobacterium tuberculosis
DALEQ

SEQ ID NO: 1405417 - protein, 22 aa, Mycobacterium tuberculosis
DAPAQAGTESAVSGVEGLPPGS

SEQ ID NO: 1405418 - protein, 8 aa, Mycobacterium tuberculosis
DAPGGVPT

SEQ ID NO: 1405419 - protein, 4 aa, Mycobacterium tuberculosis
DAPP

SEQ ID NO: 1405420 - protein, 14 aa, Mycobacterium tuberculosis
DAPPPAPSAPTTAQ

SEQ ID NO: 1405421 - protein, 11 aa, Mycobacterium tuberculosis
DAQDKNTRELA

SEQ ID NO: 1405422 - protein, 14 aa, Mycobacterium tuberculosis
DAQPRYSAARRDAV

SEQ ID NO: 1405423 - protein, 5 aa, Mycobacterium tuberculosis
DARAG

SEQ ID NO: 1405424 - protein, 8 aa, Mycobacterium tuberculosis
DARARTYQ

SEQ ID NO: 1405425 - protein, 15 aa, Mycobacterium tuberculosis
DASEAKNDDRRSDGR

SEQ ID NO: 1405426 - protein, 5 aa, Mycobacterium tuberculosis
DASER

SEQ ID NO: 1405427 - protein, 8 aa, Mycobacterium tuberculosis
DASHGTDV

SEQ ID NO: 1405428 - protein, 7 aa, Mycobacterium tuberculosis
DASPRSV

SEQ ID NO: 1405429 - protein, 4 aa, Mycobacterium tuberculosis
DASQ

SEQ ID NO: 1405430 - protein, 11 aa, Mycobacterium tuberculosis
DASRGHARGCG

SEQ ID NO: 1405431 - protein, 5 aa, Mycobacterium tuberculosis
DASTI

SEQ ID NO: 1405432 - protein, 6 aa, Mycobacterium tuberculosis
DATADA

SEQ ID NO: 1405433 - protein, 7 aa, Mycobacterium tuberculosis
DATDPAA

SEQ ID NO: 1405434 - protein, 7 aa, Mycobacterium tuberculosis
DATGERI

SEQ ID NO: 1405435 - protein, 8 aa, Mycobacterium tuberculosis
DATGRPVE

SEQ ID NO: 1405436 - protein, 7 aa, Mycobacterium tuberculosis
DAVRDGN

SEQ ID NO: 1405437 - protein, 5 aa, Mycobacterium tuberculosis
DAYGG

SEQ ID NO: 1405438 - protein, 8 aa, Mycobacterium tuberculosis
DDAARDGP

SEQ ID NO: 1405439 - protein, 10 aa, Mycobacterium tuberculosis
DDAGRPAELG

SEQ ID NO: 1405440 - protein, 8 aa, Mycobacterium tuberculosis
DDATAQRH

SEQ ID NO: 1405441 - protein, 5 aa, Mycobacterium tuberculosis
DDAVD

SEQ ID NO: 1405442 - protein, 15 aa, Mycobacterium tuberculosis
DDCRVPEGADAMGSG

SEQ ID NO: 1405443 - protein, 7 aa, Mycobacterium tuberculosis
DDDPRFN

SEQ ID NO: 1405444 - protein, 8 aa, Mycobacterium tuberculosis
DDDPRQRL

SEQ ID NO: 1405445 - protein, 5 aa, Mycobacterium tuberculosis
DDEPR

SEQ ID NO: 1405446 - protein, 5 aa, Mycobacterium tuberculosis
DDEPS

SEQ ID NO: 1405447 - protein, 5 aa, Mycobacterium tuberculosis
DDEYR

SEQ ID NO: 1405448 - protein, 6 aa, Mycobacterium tuberculosis
DDGPIR

SEQ ID NO: 1405449 - protein, 8 aa, Mycobacterium tuberculosis
DDGRPSQV

SEQ ID NO: 1405450 - protein, 8 aa, Mycobacterium tuberculosis
DDLAGAEE

SEQ ID NO: 1405451 - protein, 5 aa, Mycobacterium tuberculosis
DDMPE

SEQ ID NO: 1405452 - protein, 6 aa, Mycobacterium tuberculosis
DDNGEL

SEQ ID NO: 1405453 - protein, 16 aa, Mycobacterium tuberculosis
DDNPPALSLPPAAYTS

SEQ ID NO: 1405454 - protein, 12 aa, Mycobacterium tuberculosis
DDNPRDEDPTAI

SEQ ID NO: 1405455 - protein, 17 aa, Mycobacterium tuberculosis
DDPAAAQRRARAARQRL

SEQ ID NO: 1405456 - protein, 6 aa, Mycobacterium tuberculosis
DDPAAP

SEQ ID NO: 1405457 - protein, 8 aa, Mycobacterium tuberculosis
DDPAGFGP

SEQ ID NO: 1405458 - protein, 9 aa, Mycobacterium tuberculosis
DDPDMPGTV

SEQ ID NO: 1405459 - protein, 6 aa, Mycobacterium tuberculosis
DDPEYP

SEQ ID NO: 1405460 - protein, 13 aa, Mycobacterium tuberculosis
DDPGGAALAQRAT

SEQ ID NO: 1405461 - protein, 8 aa, Mycobacterium tuberculosis
DDPGGVTA

SEQ ID NO: 1405462 - protein, 8 aa, Mycobacterium tuberculosis
DDPGSQAY

SEQ ID NO: 1405463 - protein, 4 aa, Mycobacterium tuberculosis
DDPS

SEQ ID NO: 1405464 - protein, 6 aa, Mycobacterium tuberculosis
DDPYPR

SEQ ID NO: 1405465 - protein, 10 aa, Mycobacterium tuberculosis
DDQLSTEARG

SEQ ID NO: 1405466 - protein, 5 aa, Mycobacterium tuberculosis
DDRAE

SEQ ID NO: 1405467 - protein, 5 aa, Mycobacterium tuberculosis
DDRAY

SEQ ID NO: 1405468 - protein, 7 aa, Mycobacterium tuberculosis
DDSETQV

SEQ ID NO: 1405469 - protein, 8 aa, Mycobacterium tuberculosis
DDSGVTGP

SEQ ID NO: 1405470 - protein, 6 aa, Mycobacterium tuberculosis
DDSPAD

SEQ ID NO: 1405471 - protein, 8 aa, Mycobacterium tuberculosis
DDSPGREG

SEQ ID NO: 1405472 - protein, 6 aa, Mycobacterium tuberculosis
DDSSRQ

SEQ ID NO: 1405473 - protein, 7 aa, Mycobacterium tuberculosis
DDSTRAE

SEQ ID NO: 1405474 - protein, 6 aa, Mycobacterium tuberculosis
DDTLDE

SEQ ID NO: 1405475 - protein, 7 aa, Mycobacterium tuberculosis
DDTPEGF

SEQ ID NO: 1405476 - protein, 6 aa, Mycobacterium tuberculosis
DEAAAE

SEQ ID NO: 1405477 - protein, 7 aa, Mycobacterium tuberculosis
DEAAGQS

SEQ ID NO: 1405478 - protein, 4 aa, Mycobacterium tuberculosis
DEAQ

SEQ ID NO: 1405479 - protein, 6 aa, Mycobacterium tuberculosis
DEARQA

SEQ ID NO: 1405480 - protein, 18 aa, Mycobacterium tuberculosis
DEDAPGPIPDVPQPSSEE

SEQ ID NO: 1405481 - protein, 5 aa, Mycobacterium tuberculosis
DEDGL

SEQ ID NO: 1405482 - protein, 7 aa, Mycobacterium tuberculosis
DEFGEPY

SEQ ID NO: 1405483 - protein, 11 aa, Mycobacterium tuberculosis
DEGDSKIGRPR

SEQ ID NO: 1405484 - protein, 8 aa, Mycobacterium tuberculosis
DEGTAAAE

SEQ ID NO: 1405485 - protein, 8 aa, Mycobacterium tuberculosis
DEHADPKV

SEQ ID NO: 1405486 - protein, 11 aa, Mycobacterium tuberculosis
DEHDPGGAATP

SEQ ID NO: 1405487 - protein, 9 aa, Mycobacterium tuberculosis
DEIGTSGGK

SEQ ID NO: 1405488 - protein, 7 aa, Mycobacterium tuberculosis
DEIPEHG

SEQ ID NO: 1405489 - protein, 6 aa, Mycobacterium tuberculosis
DEKGTL

SEQ ID NO: 1405490 - protein, 4 aa, Mycobacterium tuberculosis
DEKV

SEQ ID NO: 1405491 - protein, 8 aa, Mycobacterium tuberculosis
DEMASPQR

SEQ ID NO: 1405492 - protein, 6 aa, Mycobacterium tuberculosis
DENEDA

SEQ ID NO: 1405493 - protein, 18 aa, Mycobacterium tuberculosis
DEPADAAKVGASAAYGRY

SEQ ID NO: 1405494 - protein, 8 aa, Mycobacterium tuberculosis
DEPDAERF

SEQ ID NO: 1405495 - protein, 6 aa, Mycobacterium tuberculosis
DEPDPV

SEQ ID NO: 1405496 - protein, 4 aa, Mycobacterium tuberculosis
DEPL

SEQ ID NO: 1405497 - protein, 6 aa, Mycobacterium tuberculosis
DEPSAI

SEQ ID NO: 1405498 - protein, 6 aa, Mycobacterium tuberculosis
DEPVGE

SEQ ID NO: 1405499 - protein, 7 aa, Mycobacterium tuberculosis
DERGGSV

SEQ ID NO: 1405500 - protein, 8 aa, Mycobacterium tuberculosis
DESASATV

SEQ ID NO: 1405501 - protein, 16 aa, Mycobacterium tuberculosis
DESDEEATTAVREDEV

SEQ ID NO: 1405502 - protein, 8 aa, Mycobacterium tuberculosis
DESEPGTC

SEQ ID NO: 1405503 - protein, 10 aa, Mycobacterium tuberculosis
DESQPDSPLQ

SEQ ID NO: 1405504 - protein, 7 aa, Mycobacterium tuberculosis
DESQTAA

SEQ ID NO: 1405505 - protein, 7 aa, Mycobacterium tuberculosis
DESTLRR

SEQ ID NO: 1405506 - protein, 7 aa, Mycobacterium tuberculosis
DFDGDDV

SEQ ID NO: 1405507 - protein, 7 aa, Mycobacterium tuberculosis
DFDPAGK

SEQ ID NO: 1405508 - protein, 7 aa, Mycobacterium tuberculosis
DFPDRPD

SEQ ID NO: 1405509 - protein, 5 aa, Mycobacterium tuberculosis
DGADP

SEQ ID NO: 1405510 - protein, 9 aa, Mycobacterium tuberculosis
DGAEPDSEE

SEQ ID NO: 1405511 - protein, 4 aa, Mycobacterium tuberculosis
DGAL

SEQ ID NO: 1405512 - protein, 13 aa, Mycobacterium tuberculosis
DGANFDKPPSVQD

SEQ ID NO: 1405513 - protein, 17 aa, Mycobacterium tuberculosis
DGANGIDGTGQAGGNGG

SEQ ID NO: 1405514 - protein, 8 aa, Mycobacterium tuberculosis
DGAPDMGP

SEQ ID NO: 1405515 - protein, 9 aa, Mycobacterium tuberculosis
DGATSEGDV

SEQ ID NO: 1405516 - protein, 10 aa, Mycobacterium tuberculosis
DGDATRRGRP

SEQ ID NO: 1405517 - protein, 7 aa, Mycobacterium tuberculosis
DGDDDAV

SEQ ID NO: 1405518 - protein, 5 aa, Mycobacterium tuberculosis
DGDPV

SEQ ID NO: 1405519 - protein, 5 aa, Mycobacterium tuberculosis
DGDWA

SEQ ID NO: 1405520 - protein, 8 aa, Mycobacterium tuberculosis
DGEAAARA

SEQ ID NO: 1405521 - protein, 5 aa, Mycobacterium tuberculosis
DGEAR

SEQ ID NO: 1405522 - protein, 9 aa, Mycobacterium tuberculosis
DGEPDPSAQ

SEQ ID NO: 1405523 - protein, 11 aa, Mycobacterium tuberculosis
DGEPVGPGEEG

SEQ ID NO: 1405524 - protein, 6 aa, Mycobacterium tuberculosis
DGETTA

SEQ ID NO: 1405525 - protein, 7 aa, Mycobacterium tuberculosis
DGFGSTE

SEQ ID NO: 1405526 - protein, 9 aa, Mycobacterium tuberculosis
DGGDPKGAL

SEQ ID NO: 1405527 - protein, 5 aa, Mycobacterium tuberculosis
DGGTL

SEQ ID NO: 1405528 - protein, 5 aa, Mycobacterium tuberculosis
DGHDA

SEQ ID NO: 1405529 - protein, 10 aa, Mycobacterium tuberculosis
DGHGETVSRG

SEQ ID NO: 1405530 - protein, 4 aa, Mycobacterium tuberculosis
DGID

SEQ ID NO: 1405531 - protein, 16 aa, Mycobacterium tuberculosis
DGIGPTAPGAGPSASF

SEQ ID NO: 1405532 - protein, 8 aa, Mycobacterium tuberculosis
DGIPPPNS

SEQ ID NO: 1405533 - protein, 10 aa, Mycobacterium tuberculosis
DGKNGEHREM

SEQ ID NO: 1405534 - protein, 7 aa, Mycobacterium tuberculosis
DGKRSGL

SEQ ID NO: 1405535 - protein, 6 aa, Mycobacterium tuberculosis
DGLPGV

SEQ ID NO: 1405536 - protein, 18 aa, Mycobacterium tuberculosis
DGNAFGSVPTVDDIRGLL

SEQ ID NO: 1405537 - protein, 4 aa, Mycobacterium tuberculosis
DGNT

SEQ ID NO: 1405538 - protein, 7 aa, Mycobacterium tuberculosis
DGPAGTV

SEQ ID NO: 1405539 - protein, 9 aa, Mycobacterium tuberculosis
DGPAPEPVK

SEQ ID NO: 1405540 - protein, 12 aa, Mycobacterium tuberculosis
DGPATDPVVTDD

SEQ ID NO: 1405541 - protein, 22 aa, Mycobacterium tuberculosis
DGPENPRATHSSTGARLQTHGD

SEQ ID NO: 1405542 - protein, 18 aa, Mycobacterium tuberculosis
DGPEQREVGQSAHAGRTP

SEQ ID NO: 1405543 - protein, 10 aa, Mycobacterium tuberculosis
DGPWQGSSAA

SEQ ID NO: 1405544 - protein, 10 aa, Mycobacterium tuberculosis
DGQAHAGAAD

SEQ ID NO: 1405545 - protein, 9 aa, Mycobacterium tuberculosis
DGQAKSAKD

SEQ ID NO: 1405546 - protein, 20 aa, Mycobacterium tuberculosis
DGQPSWSGKPEVAATTEARA

SEQ ID NO: 1405547 - protein, 8 aa, Mycobacterium tuberculosis
DGREPPAL

SEQ ID NO: 1405548 - protein, 23 aa, Mycobacterium tuberculosis
DGRHTTESSFEHSSPSRSPQSDD

SEQ ID NO: 1405549 - protein, 4 aa, Mycobacterium tuberculosis
DGRP

SEQ ID NO: 1405550 - protein, 7 aa, Mycobacterium tuberculosis
DGRRRTT

SEQ ID NO: 1405551 - protein, 12 aa, Mycobacterium tuberculosis
DGRVPNPGEFAD

SEQ ID NO: 1405552 - protein, 7 aa, Mycobacterium tuberculosis
DGSEEEF

SEQ ID NO: 1405553 - protein, 10 aa, Mycobacterium tuberculosis
DGSGRTKFSS

SEQ ID NO: 1405554 - protein, 13 aa, Mycobacterium tuberculosis
DGSVTEGTPGDCH

SEQ ID NO: 1405555 - protein, 7 aa, Mycobacterium tuberculosis
DGSYGVP

SEQ ID NO: 1405556 - protein, 7 aa, Mycobacterium tuberculosis
DGTALRD

SEQ ID NO: 1405557 - protein, 5 aa, Mycobacterium tuberculosis
DGTGM

SEQ ID NO: 1405558 - protein, 6 aa, Mycobacterium tuberculosis
DGTHKT

SEQ ID NO: 1405559 - protein, 5 aa, Mycobacterium tuberculosis
DGTSA

SEQ ID NO: 1405560 - protein, 9 aa, Mycobacterium tuberculosis
DGTVTGDYD

SEQ ID NO: 1405561 - protein, 6 aa, Mycobacterium tuberculosis
DHATGG

SEQ ID NO: 1405562 - protein, 9 aa, Mycobacterium tuberculosis
DHDPTSRHG

SEQ ID NO: 1405563 - protein, 6 aa, Mycobacterium tuberculosis
DHDTEG

SEQ ID NO: 1405564 - protein, 11 aa, Mycobacterium tuberculosis
DHGDAAEAIQR

SEQ ID NO: 1405565 - protein, 5 aa, Mycobacterium tuberculosis
DHHSR

SEQ ID NO: 1405566 - protein, 15 aa, Mycobacterium tuberculosis
DHNTGSFNSGDYNTG

SEQ ID NO: 1405567 - protein, 6 aa, Mycobacterium tuberculosis
DHPGYG

SEQ ID NO: 1405568 - protein, 8 aa, Mycobacterium tuberculosis
DHPPAPAS

SEQ ID NO: 1405569 - protein, 7 aa, Mycobacterium tuberculosis
DIARAAG

SEQ ID NO: 1405570 - protein, 8 aa, Mycobacterium tuberculosis
DIGQPASV

SEQ ID NO: 1405571 - protein, 11 aa, Mycobacterium tuberculosis
DIPDPQDPQTF

SEQ ID NO: 1405572 - protein, 6 aa, Mycobacterium tuberculosis
DKENNV

SEQ ID NO: 1405573 - protein, 8 aa, Mycobacterium tuberculosis
DKGSPGEL

SEQ ID NO: 1405574 - protein, 7 aa, Mycobacterium tuberculosis
DKGTATF

SEQ ID NO: 1405575 - protein, 7 aa, Mycobacterium tuberculosis
DKKTRAG

SEQ ID NO: 1405576 - protein, 5 aa, Mycobacterium tuberculosis
DKNAA

SEQ ID NO: 1405577 - protein, 6 aa, Mycobacterium tuberculosis
DKPGVA

SEQ ID NO: 1405578 - protein, 7 aa, Mycobacterium tuberculosis
DKPTGAV

SEQ ID NO: 1405579 - protein, 7 aa, Mycobacterium tuberculosis
DLAGAGR

SEQ ID NO: 1405580 - protein, 13 aa, Mycobacterium tuberculosis
DLAGKAAQYRPDE

SEQ ID NO: 1405581 - protein, 5 aa, Mycobacterium tuberculosis
DLDRD

SEQ ID NO: 1405582 - protein, 14 aa, Mycobacterium tuberculosis
DLGPRRTLTGQPLP

SEQ ID NO: 1405583 - protein, 13 aa, Mycobacterium tuberculosis
DLPEPKKVKPPRT

SEQ ID NO: 1405584 - protein, 6 aa, Mycobacterium tuberculosis
DLPGTT

SEQ ID NO: 1405585 - protein, 9 aa, Mycobacterium tuberculosis
DLPTAADPR

SEQ ID NO: 1405586 - protein, 8 aa, Mycobacterium tuberculosis
DLSGGQRR

SEQ ID NO: 1405587 - protein, 6 aa, Mycobacterium tuberculosis
DNAEEA

SEQ ID NO: 1405588 - protein, 7 aa, Mycobacterium tuberculosis
DNARTAR

SEQ ID NO: 1405589 - protein, 6 aa, Mycobacterium tuberculosis
DNCPQR

SEQ ID NO: 1405590 - protein, 8 aa, Mycobacterium tuberculosis
DNDGTPES

SEQ ID NO: 1405591 - protein, 12 aa, Mycobacterium tuberculosis
DNGSTDGTPQAA

SEQ ID NO: 1405592 - protein, 9 aa, Mycobacterium tuberculosis
DNPADRSRI

SEQ ID NO: 1405593 - protein, 4 aa, Mycobacterium tuberculosis
DNPD

SEQ ID NO: 1405594 - protein, 5 aa, Mycobacterium tuberculosis
DNPDI

SEQ ID NO: 1405595 - protein, 7 aa, Mycobacterium tuberculosis
DNSTTWN

SEQ ID NO: 1405596 - protein, 7 aa, Mycobacterium tuberculosis
DNTADDL

SEQ ID NO: 1405597 - protein, 6 aa, Mycobacterium tuberculosis
DNWSTD

SEQ ID NO: 1405598 - protein, 10 aa, Mycobacterium tuberculosis
DPADDGPVAT

SEQ ID NO: 1405599 - protein, 9 aa, Mycobacterium tuberculosis
DPADGVESG

SEQ ID NO: 1405600 - protein, 8 aa, Mycobacterium tuberculosis
DPADTGQR

SEQ ID NO: 1405601 - protein, 5 aa, Mycobacterium tuberculosis
DPAFA

SEQ ID NO: 1405602 - protein, 4 aa, Mycobacterium tuberculosis
DPAG

SEQ ID NO: 1405603 - protein, 9 aa, Mycobacterium tuberculosis
DPAKQQDEL

SEQ ID NO: 1405604 - protein, 6 aa, Mycobacterium tuberculosis
DPANAR

SEQ ID NO: 1405605 - protein, 6 aa, Mycobacterium tuberculosis
DPAQRD

SEQ ID NO: 1405606 - protein, 8 aa, Mycobacterium tuberculosis
DPARATAS

SEQ ID NO: 1405607 - protein, 9 aa, Mycobacterium tuberculosis
DPARDKADH

SEQ ID NO: 1405608 - protein, 11 aa, Mycobacterium tuberculosis
DPARGSAANMR

SEQ ID NO: 1405609 - protein, 8 aa, Mycobacterium tuberculosis
DPASVQAT

SEQ ID NO: 1405610 - protein, 6 aa, Mycobacterium tuberculosis
DPATGV

SEQ ID NO: 1405611 - protein, 5 aa, Mycobacterium tuberculosis
DPDAE

SEQ ID NO: 1405612 - protein, 6 aa, Mycobacterium tuberculosis
DPDAVG

SEQ ID NO: 1405613 - protein, 6 aa, Mycobacterium tuberculosis
DPDDLD

SEQ ID NO: 1405614 - protein, 9 aa, Mycobacterium tuberculosis
DPDDNQNHL

SEQ ID NO: 1405615 - protein, 8 aa, Mycobacterium tuberculosis
DPDPDGPL

SEQ ID NO: 1405616 - protein, 5 aa, Mycobacterium tuberculosis
DPDRE

SEQ ID NO: 1405617 - protein, 12 aa, Mycobacterium tuberculosis
DPDRRDEVHRSA

SEQ ID NO: 1405618 - protein, 9 aa, Mycobacterium tuberculosis
DPDYPASTY

SEQ ID NO: 1405619 - protein, 6 aa, Mycobacterium tuberculosis
DPEAAS

SEQ ID NO: 1405620 - protein, 9 aa, Mycobacterium tuberculosis
DPEPPEEAR

SEQ ID NO: 1405621 - protein, 7 aa, Mycobacterium tuberculosis
DPERQEA

SEQ ID NO: 1405622 - protein, 9 aa, Mycobacterium tuberculosis
DPESDGLAR

SEQ ID NO: 1405623 - protein, 12 aa, Mycobacterium tuberculosis
DPFADDPCDPSA

SEQ ID NO: 1405624 - protein, 15 aa, Mycobacterium tuberculosis
DPFSGIGKPEPLQGE

SEQ ID NO: 1405625 - protein, 4 aa, Mycobacterium tuberculosis
DPFT

SEQ ID NO: 1405626 - protein, 4 aa, Mycobacterium tuberculosis
DPGF

SEQ ID NO: 1405627 - protein, 7 aa, Mycobacterium tuberculosis
DPGQERL

SEQ ID NO: 1405628 - protein, 5 aa, Mycobacterium tuberculosis
DPGRV

SEQ ID NO: 1405629 - protein, 7 aa, Mycobacterium tuberculosis
DPGSRGA

SEQ ID NO: 1405630 - protein, 5 aa, Mycobacterium tuberculosis
DPGVS

SEQ ID NO: 1405631 - protein, 8 aa, Mycobacterium tuberculosis
DPIPGNDA

SEQ ID NO: 1405632 - protein, 8 aa, Mycobacterium tuberculosis
DPKASSAE

SEQ ID NO: 1405633 - protein, 5 aa, Mycobacterium tuberculosis
DPKFS

SEQ ID NO: 1405634 - protein, 9 aa, Mycobacterium tuberculosis
DPKGRATRE

SEQ ID NO: 1405635 - protein, 9 aa, Mycobacterium tuberculosis
DPKVKAELT

SEQ ID NO: 1405636 - protein, 4 aa, Mycobacterium tuberculosis
DPLG

SEQ ID NO: 1405637 - protein, 6 aa, Mycobacterium tuberculosis
DPLGPY

SEQ ID NO: 1405638 - protein, 6 aa, Mycobacterium tuberculosis
DPLPDD

SEQ ID NO: 1405639 - protein, 4 aa, Mycobacterium tuberculosis
DPLT

SEQ ID NO: 1405640 - protein, 9 aa, Mycobacterium tuberculosis
DPNGGYGHP

SEQ ID NO: 1405641 - protein, 15 aa, Mycobacterium tuberculosis
DPNGIAGGGAGRLSA

SEQ ID NO: 1405642 - protein, 5 aa, Mycobacterium tuberculosis
DPPAE

SEQ ID NO: 1405643 - protein, 6 aa, Mycobacterium tuberculosis
DPPDLQ

SEQ ID NO: 1405644 - protein, 6 aa, Mycobacterium tuberculosis
DPPDRP

SEQ ID NO: 1405645 - protein, 5 aa, Mycobacterium tuberculosis
DPPST

SEQ ID NO: 1405646 - protein, 11 aa, Mycobacterium tuberculosis
DPQAALDPAGD

SEQ ID NO: 1405647 - protein, 8 aa, Mycobacterium tuberculosis
DPQGESPL

SEQ ID NO: 1405648 - protein, 4 aa, Mycobacterium tuberculosis
DPRE

SEQ ID NO: 1405649 - protein, 8 aa, Mycobacterium tuberculosis
DPRKADQM

SEQ ID NO: 1405650 - protein, 9 aa, Mycobacterium tuberculosis
DPRTVPPEQ

SEQ ID NO: 1405651 - protein, 4 aa, Mycobacterium tuberculosis
DPSA

SEQ ID NO: 1405652 - protein, 20 aa, Mycobacterium tuberculosis
DPSLRVPRRPERRTSMPPGS

SEQ ID NO: 1405653 - protein, 7 aa, Mycobacterium tuberculosis
DPTAPSL

SEQ ID NO: 1405654 - protein, 6 aa, Mycobacterium tuberculosis
DPTDAA

SEQ ID NO: 1405655 - protein, 8 aa, Mycobacterium tuberculosis
DPTEDQAK

SEQ ID NO: 1405656 - protein, 16 aa, Mycobacterium tuberculosis
DPTKKARTYSKGNRQK

SEQ ID NO: 1405657 - protein, 7 aa, Mycobacterium tuberculosis
DPTLPTE

SEQ ID NO: 1405658 - protein, 8 aa, Mycobacterium tuberculosis
DPTTGRED

SEQ ID NO: 1405659 - protein, 12 aa, Mycobacterium tuberculosis
DPTVKGGTSNPW

SEQ ID NO: 1405660 - protein, 6 aa, Mycobacterium tuberculosis
DPYRPH

SEQ ID NO: 1405661 - protein, 6 aa, Mycobacterium tuberculosis
DPYYGD

SEQ ID NO: 1405662 - protein, 7 aa, Mycobacterium tuberculosis
DQAERDR

SEQ ID NO: 1405663 - protein, 10 aa, Mycobacterium tuberculosis
DQAERSHGLA

SEQ ID NO: 1405664 - protein, 8 aa, Mycobacterium tuberculosis
DQAGNADP

SEQ ID NO: 1405665 - protein, 5 aa, Mycobacterium tuberculosis
DQAQR

SEQ ID NO: 1405666 - protein, 13 aa, Mycobacterium tuberculosis
DQATKQTFTDDER

SEQ ID NO: 1405667 - protein, 6 aa, Mycobacterium tuberculosis
DQDDQR

SEQ ID NO: 1405668 - protein, 10 aa, Mycobacterium tuberculosis
DQDHSAPNSI

SEQ ID NO: 1405669 - protein, 6 aa, Mycobacterium tuberculosis
DQDSGE

SEQ ID NO: 1405670 - protein, 6 aa, Mycobacterium tuberculosis
DQENPL

SEQ ID NO: 1405671 - protein, 5 aa, Mycobacterium tuberculosis
DQFRG

SEQ ID NO: 1405672 - protein, 6 aa, Mycobacterium tuberculosis
DQPGHE

SEQ ID NO: 1405673 - protein, 9 aa, Mycobacterium tuberculosis
DQPLADTAN

SEQ ID NO: 1405674 - protein, 4 aa, Mycobacterium tuberculosis
DQPP

SEQ ID NO: 1405675 - protein, 17 aa, Mycobacterium tuberculosis
DQPQYPYEQDGFSGSSV

SEQ ID NO: 1405676 - protein, 5 aa, Mycobacterium tuberculosis
DQPTG

SEQ ID NO: 1405677 - protein, 6 aa, Mycobacterium tuberculosis
DQQYGQ

SEQ ID NO: 1405678 - protein, 8 aa, Mycobacterium tuberculosis
DQSEGTGP

SEQ ID NO: 1405679 - protein, 9 aa, Mycobacterium tuberculosis
DQSTPVPTC

SEQ ID NO: 1405680 - protein, 20 aa, Mycobacterium tuberculosis
DQVDDDRLGRPRSDADVGPR

SEQ ID NO: 1405681 - protein, 4 aa, Mycobacterium tuberculosis
DRAD

SEQ ID NO: 1405682 - protein, 7 aa, Mycobacterium tuberculosis
DRAQPGD

SEQ ID NO: 1405683 - protein, 14 aa, Mycobacterium tuberculosis
DRDDQPYKESYGMA

SEQ ID NO: 1405684 - protein, 6 aa, Mycobacterium tuberculosis
DRDNPY

SEQ ID NO: 1405685 - protein, 7 aa, Mycobacterium tuberculosis
DRDRRAT

SEQ ID NO: 1405686 - protein, 17 aa, Mycobacterium tuberculosis
DREPRAIGRGYGPHAGG

SEQ ID NO: 1405687 - protein, 9 aa, Mycobacterium tuberculosis
DRGAGGSAY

SEQ ID NO: 1405688 - protein, 14 aa, Mycobacterium tuberculosis
DRGTQLQRARAGEI

SEQ ID NO: 1405689 - protein, 6 aa, Mycobacterium tuberculosis
DRHGDP

SEQ ID NO: 1405690 - protein, 10 aa, Mycobacterium tuberculosis
DRKARNSAKM

SEQ ID NO: 1405691 - protein, 14 aa, Mycobacterium tuberculosis
DRKPKDLSGGQRQR

SEQ ID NO: 1405692 - protein, 8 aa, Mycobacterium tuberculosis
DRLTEGAA

SEQ ID NO: 1405693 - protein, 6 aa, Mycobacterium tuberculosis
DRNPLH

SEQ ID NO: 1405694 - protein, 5 aa, Mycobacterium tuberculosis
DRNPV

SEQ ID NO: 1405695 - protein, 24 aa, Mycobacterium tuberculosis
DRPDRRGRSLRADHADRGLSARGH

SEQ ID NO: 1405696 - protein, 9 aa, Mycobacterium tuberculosis
DRPGKAKAL

SEQ ID NO: 1405697 - protein, 4 aa, Mycobacterium tuberculosis
DRPI

SEQ ID NO: 1405698 - protein, 8 aa, Mycobacterium tuberculosis
DRQSDALG

SEQ ID NO: 1405699 - protein, 8 aa, Mycobacterium tuberculosis
DRREDGYH

SEQ ID NO: 1405700 - protein, 6 aa, Mycobacterium tuberculosis
DRRGND

SEQ ID NO: 1405701 - protein, 24 aa, Mycobacterium tuberculosis
DRTGAQLVGGESAANVGRGYGLPE

SEQ ID NO: 1405702 - protein, 8 aa, Mycobacterium tuberculosis
DRTPTADR

SEQ ID NO: 1405703 - protein, 7 aa, Mycobacterium tuberculosis
DRTRRPM

SEQ ID NO: 1405704 - protein, 11 aa, Mycobacterium tuberculosis
DRVGGRSLTGR

SEQ ID NO: 1405705 - protein, 10 aa, Mycobacterium tuberculosis
DRVRRGQVGN

SEQ ID NO: 1405706 - protein, 9 aa, Mycobacterium tuberculosis
DRVSPGAVT

SEQ ID NO: 1405707 - protein, 9 aa, Mycobacterium tuberculosis
DRWPDKPGR

SEQ ID NO: 1405708 - protein, 11 aa, Mycobacterium tuberculosis
DRYGKTRGFPL

SEQ ID NO: 1405709 - protein, 4 aa, Mycobacterium tuberculosis
DRYR

SEQ ID NO: 1405710 - protein, 7 aa, Mycobacterium tuberculosis
DSAADYA

SEQ ID NO: 1405711 - protein, 14 aa, Mycobacterium tuberculosis
DSAGDLGDWGGPDA

SEQ ID NO: 1405712 - protein, 7 aa, Mycobacterium tuberculosis
DSAGEAM

SEQ ID NO: 1405713 - protein, 8 aa, Mycobacterium tuberculosis
DSAPIPAD

SEQ ID NO: 1405714 - protein, 8 aa, Mycobacterium tuberculosis
DSASEPDR

SEQ ID NO: 1405715 - protein, 6 aa, Mycobacterium tuberculosis
DSDFTA

SEQ ID NO: 1405716 - protein, 7 aa, Mycobacterium tuberculosis
DSDGNGA

SEQ ID NO: 1405717 - protein, 7 aa, Mycobacterium tuberculosis
DSDLSNQ

SEQ ID NO: 1405718 - protein, 6 aa, Mycobacterium tuberculosis
DSDSFD

SEQ ID NO: 1405719 - protein, 5 aa, Mycobacterium tuberculosis
DSDTG

SEQ ID NO: 1405720 - protein, 20 aa, Mycobacterium tuberculosis
DSGDLDELSKATRARLDTAG

SEQ ID NO: 1405721 - protein, 6 aa, Mycobacterium tuberculosis
DSGFVT

SEQ ID NO: 1405722 - protein, 5 aa, Mycobacterium tuberculosis
DSGIG

SEQ ID NO: 1405723 - protein, 5 aa, Mycobacterium tuberculosis
DSGRK

SEQ ID NO: 1405724 - protein, 5 aa, Mycobacterium tuberculosis
DSHGD

SEQ ID NO: 1405725 - protein, 16 aa, Mycobacterium tuberculosis
DSHITGPAGPGHPTPG

SEQ ID NO: 1405726 - protein, 6 aa, Mycobacterium tuberculosis
DSLGRA

SEQ ID NO: 1405727 - protein, 9 aa, Mycobacterium tuberculosis
DSLGTAQAT

SEQ ID NO: 1405728 - protein, 25 aa, Mycobacterium tuberculosis
DSLRAEQKAASKSVGGASPEERPPL

SEQ ID NO: 1405729 - protein, 9 aa, Mycobacterium tuberculosis
DSPLDGQAA

SEQ ID NO: 1405730 - protein, 9 aa, Mycobacterium tuberculosis
DSPRSATVT

SEQ ID NO: 1405731 - protein, 12 aa, Mycobacterium tuberculosis
DSRETDEGQAIR

SEQ ID NO: 1405732 - protein, 16 aa, Mycobacterium tuberculosis
DSRRHRRPPTTVYRPR

SEQ ID NO: 1405733 - protein, 6 aa, Mycobacterium tuberculosis
DSRVPT

SEQ ID NO: 1405734 - protein, 7 aa, Mycobacterium tuberculosis
DSSTPIA

SEQ ID NO: 1405735 - protein, 10 aa, Mycobacterium tuberculosis
DSTGLPDTPL

SEQ ID NO: 1405736 - protein, 7 aa, Mycobacterium tuberculosis
DSTPGLA

SEQ ID NO: 1405737 - protein, 7 aa, Mycobacterium tuberculosis
DSTVPDA

SEQ ID NO: 1405738 - protein, 10 aa, Mycobacterium tuberculosis
DSYTAGGANV

SEQ ID NO: 1405739 - protein, 18 aa, Mycobacterium tuberculosis
DTAEAHPGSNVVGAKAKR

SEQ ID NO: 1405740 - protein, 11 aa, Mycobacterium tuberculosis
DTAKEKPQEGT

SEQ ID NO: 1405741 - protein, 10 aa, Mycobacterium tuberculosis
DTATEVPAPV

SEQ ID NO: 1405742 - protein, 9 aa, Mycobacterium tuberculosis
DTDAAGGAG

SEQ ID NO: 1405743 - protein, 10 aa, Mycobacterium tuberculosis
DTDDPARPLT

SEQ ID NO: 1405744 - protein, 8 aa, Mycobacterium tuberculosis
DTDGDGLA

SEQ ID NO: 1405745 - protein, 5 aa, Mycobacterium tuberculosis
DTDLS

SEQ ID NO: 1405746 - protein, 5 aa, Mycobacterium tuberculosis
DTDTQ

SEQ ID NO: 1405747 - protein, 5 aa, Mycobacterium tuberculosis
DTEED

SEQ ID NO: 1405748 - protein, 7 aa, Mycobacterium tuberculosis
DTEHPDE

SEQ ID NO: 1405749 - protein, 6 aa, Mycobacterium tuberculosis
DTFDPD

SEQ ID NO: 1405750 - protein, 5 aa, Mycobacterium tuberculosis
DTGAD

SEQ ID NO: 1405751 - protein, 8 aa, Mycobacterium tuberculosis
DTGDTPTI

SEQ ID NO: 1405752 - protein, 5 aa, Mycobacterium tuberculosis
DTGRE

SEQ ID NO: 1405753 - protein, 8 aa, Mycobacterium tuberculosis
DTGVPRPG

SEQ ID NO: 1405754 - protein, 6 aa, Mycobacterium tuberculosis
DTLRRS

SEQ ID NO: 1405755 - protein, 9 aa, Mycobacterium tuberculosis
DTNPPLAAS

SEQ ID NO: 1405756 - protein, 7 aa, Mycobacterium tuberculosis
DTPADLT

SEQ ID NO: 1405757 - protein, 6 aa, Mycobacterium tuberculosis
DTPGFE

SEQ ID NO: 1405758 - protein, 5 aa, Mycobacterium tuberculosis
DTPGI

SEQ ID NO: 1405759 - protein, 8 aa, Mycobacterium tuberculosis
DTPGTSSL

SEQ ID NO: 1405760 - protein, 5 aa, Mycobacterium tuberculosis
DTPLP

SEQ ID NO: 1405761 - protein, 6 aa, Mycobacterium tuberculosis
DTPRSR

SEQ ID NO: 1405762 - protein, 7 aa, Mycobacterium tuberculosis
DTQARPV

SEQ ID NO: 1405763 - protein, 10 aa, Mycobacterium tuberculosis
DTRQSGGGED

SEQ ID NO: 1405764 - protein, 9 aa, Mycobacterium tuberculosis
DTSSQLVSS

SEQ ID NO: 1405765 - protein, 7 aa, Mycobacterium tuberculosis
DTTPEGY

SEQ ID NO: 1405766 - protein, 9 aa, Mycobacterium tuberculosis
DTVKDATGH

SEQ ID NO: 1405767 - protein, 5 aa, Mycobacterium tuberculosis
DTYPA

SEQ ID NO: 1405768 - protein, 5 aa, Mycobacterium tuberculosis
DVDDT

SEQ ID NO: 1405769 - protein, 12 aa, Mycobacterium tuberculosis
DVEESRGERDAR

SEQ ID NO: 1405770 - protein, 6 aa, Mycobacterium tuberculosis
DVEPGR

SEQ ID NO: 1405771 - protein, 5 aa, Mycobacterium tuberculosis
DVRGV

SEQ ID NO: 1405772 - protein, 7 aa, Mycobacterium tuberculosis
DVSRETP

SEQ ID NO: 1405773 - protein, 7 aa, Mycobacterium tuberculosis
DVTGRRP

SEQ ID NO: 1405774 - protein, 15 aa, Mycobacterium tuberculosis
DVTPLGAHPNDPVGQ

SEQ ID NO: 1405775 - protein, 7 aa, Mycobacterium tuberculosis
DWPEPSG

SEQ ID NO: 1405776 - protein, 5 aa, Mycobacterium tuberculosis
DWQGV

SEQ ID NO: 1405777 - protein, 6 aa, Mycobacterium tuberculosis
DYEEGG

SEQ ID NO: 1405778 - protein, 8 aa, Mycobacterium tuberculosis
DYRTSGRT

SEQ ID NO: 1405779 - protein, 10 aa, Mycobacterium tuberculosis
DYSLGGEQSG

SEQ ID NO: 1405780 - protein, 10 aa, Mycobacterium tuberculosis
EAAAARTEEF

SEQ ID NO: 1405781 - protein, 8 aa, Mycobacterium tuberculosis
EAADPTTH

SEQ ID NO: 1405782 - protein, 4 aa, Mycobacterium tuberculosis
EAAE

SEQ ID NO: 1405783 - protein, 6 aa, Mycobacterium tuberculosis
EAAEAS

SEQ ID NO: 1405784 - protein, 8 aa, Mycobacterium tuberculosis
EAAEQALT

SEQ ID NO: 1405785 - protein, 13 aa, Mycobacterium tuberculosis
EAARREAQSAFGD

SEQ ID NO: 1405786 - protein, 7 aa, Mycobacterium tuberculosis
EAASDID

SEQ ID NO: 1405787 - protein, 10 aa, Mycobacterium tuberculosis
EAASRAAAHG

SEQ ID NO: 1405788 - protein, 7 aa, Mycobacterium tuberculosis
EAATTAR

SEQ ID NO: 1405789 - protein, 4 aa, Mycobacterium tuberculosis
EADA

SEQ ID NO: 1405790 - protein, 5 aa, Mycobacterium tuberculosis
EAEGR

SEQ ID NO: 1405791 - protein, 5 aa, Mycobacterium tuberculosis
EAEGW

SEQ ID NO: 1405792 - protein, 11 aa, Mycobacterium tuberculosis
EAETAKPSPFA

SEQ ID NO: 1405793 - protein, 17 aa, Mycobacterium tuberculosis
EAGAAEAAAGAGGAAGW

SEQ ID NO: 1405794 - protein, 12 aa, Mycobacterium tuberculosis
EAGERSGSSTPF

SEQ ID NO: 1405795 - protein, 8 aa, Mycobacterium tuberculosis
EAGIGPED

SEQ ID NO: 1405796 - protein, 9 aa, Mycobacterium tuberculosis
EAGKARWAA

SEQ ID NO: 1405797 - protein, 4 aa, Mycobacterium tuberculosis
EAGM

SEQ ID NO: 1405798 - protein, 8 aa, Mycobacterium tuberculosis
EAGVPPPR

SEQ ID NO: 1405799 - protein, 6 aa, Mycobacterium tuberculosis
EAGVPS

SEQ ID NO: 1405800 - protein, 7 aa, Mycobacterium tuberculosis
EAIGPGD

SEQ ID NO: 1405801 - protein, 10 aa, Mycobacterium tuberculosis
EAKNAAASEE

SEQ ID NO: 1405802 - protein, 11 aa, Mycobacterium tuberculosis
EALGDAPEADG

SEQ ID NO: 1405803 - protein, 5 aa, Mycobacterium tuberculosis
EAMGG

SEQ ID NO: 1405804 - protein, 11 aa, Mycobacterium tuberculosis
EANEETGIDPS

SEQ ID NO: 1405805 - protein, 4 aa, Mycobacterium tuberculosis
EANG

SEQ ID NO: 1405806 - protein, 7 aa, Mycobacterium tuberculosis
EANKDQA

SEQ ID NO: 1405807 - protein, 7 aa, Mycobacterium tuberculosis
EANKDRA

SEQ ID NO: 1405808 - protein, 6 aa, Mycobacterium tuberculosis
EAPSPL

SEQ ID NO: 1405809 - protein, 5 aa, Mycobacterium tuberculosis
EAPTH

SEQ ID NO: 1405810 - protein, 5 aa, Mycobacterium tuberculosis
EAREH

SEQ ID NO: 1405811 - protein, 5 aa, Mycobacterium tuberculosis
EARGH

SEQ ID NO: 1405812 - protein, 4 aa, Mycobacterium tuberculosis
EARS

SEQ ID NO: 1405813 - protein, 8 aa, Mycobacterium tuberculosis
EARSDTTV

SEQ ID NO: 1405814 - protein, 25 aa, Mycobacterium tuberculosis
EASGLPHTAKGSLDRRAVAERFGHS

SEQ ID NO: 1405815 - protein, 7 aa, Mycobacterium tuberculosis
EASPGNM

SEQ ID NO: 1405816 - protein, 6 aa, Mycobacterium tuberculosis
EASRRR

SEQ ID NO: 1405817 - protein, 15 aa, Mycobacterium tuberculosis
EATDSSGKITKRGAD

SEQ ID NO: 1405818 - protein, 5 aa, Mycobacterium tuberculosis
EATGA

SEQ ID NO: 1405819 - protein, 5 aa, Mycobacterium tuberculosis
EATPL

SEQ ID NO: 1405820 - protein, 7 aa, Mycobacterium tuberculosis
EAVDGGP

SEQ ID NO: 1405821 - protein, 12 aa, Mycobacterium tuberculosis
EAVEKANDTDYG

SEQ ID NO: 1405822 - protein, 12 aa, Mycobacterium tuberculosis
EAVGGGGGDGAD

SEQ ID NO: 1405823 - protein, 9 aa, Mycobacterium tuberculosis
EAYADGIDG

SEQ ID NO: 1405824 - protein, 8 aa, Mycobacterium tuberculosis
ECTPETRE

SEQ ID NO: 1405825 - protein, 5 aa, Mycobacterium tuberculosis
EDAAR

SEQ ID NO: 1405826 - protein, 6 aa, Mycobacterium tuberculosis
EDAGSR

SEQ ID NO: 1405827 - protein, 15 aa, Mycobacterium tuberculosis
EDAPDRIAAAIIERF

SEQ ID NO: 1405828 - protein, 9 aa, Mycobacterium tuberculosis
EDASQSPFT

SEQ ID NO: 1405829 - protein, 6 aa, Mycobacterium tuberculosis
EDATER

SEQ ID NO: 1405830 - protein, 7 aa, Mycobacterium tuberculosis
EDEYPST

SEQ ID NO: 1405831 - protein, 6 aa, Mycobacterium tuberculosis
EDGQPI

SEQ ID NO: 1405832 - protein, 7 aa, Mycobacterium tuberculosis
EDKGMRD

SEQ ID NO: 1405833 - protein, 7 aa, Mycobacterium tuberculosis
EDKSADV

SEQ ID NO: 1405834 - protein, 6 aa, Mycobacterium tuberculosis
EDLPEQ

SEQ ID NO: 1405835 - protein, 7 aa, Mycobacterium tuberculosis
EDNPDDV

SEQ ID NO: 1405836 - protein, 9 aa, Mycobacterium tuberculosis
EDPAHGWQP

SEQ ID NO: 1405837 - protein, 7 aa, Mycobacterium tuberculosis
EDRPALK

SEQ ID NO: 1405838 - protein, 6 aa, Mycobacterium tuberculosis
EDRPDA

SEQ ID NO: 1405839 - protein, 8 aa, Mycobacterium tuberculosis
EDRPGDKR

SEQ ID NO: 1405840 - protein, 17 aa, Mycobacterium tuberculosis
EDSGTELAERMLSWQQA

SEQ ID NO: 1405841 - protein, 17 aa, Mycobacterium tuberculosis
EDSSSRRPFSQGFPKDS

SEQ ID NO: 1405842 - protein, 8 aa, Mycobacterium tuberculosis
EDTAAGGD

SEQ ID NO: 1405843 - protein, 14 aa, Mycobacterium tuberculosis
EDTDDLIADIDRAL

SEQ ID NO: 1405844 - protein, 5 aa, Mycobacterium tuberculosis
EDTER

SEQ ID NO: 1405845 - protein, 12 aa, Mycobacterium tuberculosis
EDTKPKRRKRKK

SEQ ID NO: 1405846 - protein, 12 aa, Mycobacterium tuberculosis
EDVTGDYGSSVG

SEQ ID NO: 1405847 - protein, 4 aa, Mycobacterium tuberculosis
EEAA

SEQ ID NO: 1405848 - protein, 8 aa, Mycobacterium tuberculosis
EEAHDNPD

SEQ ID NO: 1405849 - protein, 9 aa, Mycobacterium tuberculosis
EEARAKEDH

SEQ ID NO: 1405850 - protein, 7 aa, Mycobacterium tuberculosis
EEGTKLG

SEQ ID NO: 1405851 - protein, 8 aa, Mycobacterium tuberculosis
EEHGGKYG

SEQ ID NO: 1405852 - protein, 10 aa, Mycobacterium tuberculosis
EEKAKNPADD

SEQ ID NO: 1405853 - protein, 4 aa, Mycobacterium tuberculosis
EENA

SEQ ID NO: 1405854 - protein, 7 aa, Mycobacterium tuberculosis
EEPDGPV

SEQ ID NO: 1405855 - protein, 6 aa, Mycobacterium tuberculosis
EEPPPS

SEQ ID NO: 1405856 - protein, 9 aa, Mycobacterium tuberculosis
EERAEREAR

SEQ ID NO: 1405857 - protein, 20 aa, Mycobacterium tuberculosis
EERKGKAPSDHAPVLVDLHA

SEQ ID NO: 1405858 - protein, 7 aa, Mycobacterium tuberculosis
EESQKAT

SEQ ID NO: 1405859 - protein, 8 aa, Mycobacterium tuberculosis
EESSTLGT

SEQ ID NO: 1405860 - protein, 6 aa, Mycobacterium tuberculosis
EEVPRD

SEQ ID NO: 1405861 - protein, 16 aa, Mycobacterium tuberculosis
EEVTRTTYSREHQREY

SEQ ID NO: 1405862 - protein, 5 aa, Mycobacterium tuberculosis
EFEGP

SEQ ID NO: 1405863 - protein, 36 aa, Mycobacterium tuberculosis; identical to SEQ ID NO: 173136

SEQ ID NO: 1405864 - protein, 5 aa, Mycobacterium tuberculosis
EFGEK

SEQ ID NO: 1405865 - protein, 7 aa, Mycobacterium tuberculosis
EFGGPAV

SEQ ID NO: 1405866 - protein, 9 aa, Mycobacterium tuberculosis
EFGPSARTR

SEQ ID NO: 1405867 - protein, 7 aa, Mycobacterium tuberculosis
EFPNTRM

SEQ ID NO: 1405868 - protein, 12 aa, Mycobacterium tuberculosis
EGAAAADRSVDG

SEQ ID NO: 1405869 - protein, 6 aa, Mycobacterium tuberculosis
EGADLR

SEQ ID NO: 1405870 - protein, 11 aa, Mycobacterium tuberculosis
EGADQLPTDER

SEQ ID NO: 1405871 - protein, 13 aa, Mycobacterium tuberculosis
EGALPPPRKKSRR

SEQ ID NO: 1405872 - protein, 13 aa, Mycobacterium tuberculosis
EGALRSGRTPDRR

SEQ ID NO: 1405873 - protein, 9 aa, Mycobacterium tuberculosis
EGAPPPAAV

SEQ ID NO: 1405874 - protein, 16 aa, Mycobacterium tuberculosis
EGARPGWVGSSAGALS

SEQ ID NO: 1405875 - protein, 6 aa, Mycobacterium tuberculosis
EGATTI

SEQ ID NO: 1405876 - protein, 7 aa, Mycobacterium tuberculosis
EGDDDRI

SEQ ID NO: 1405877 - protein, 9 aa, Mycobacterium tuberculosis
EGDEATGAN

SEQ ID NO: 1405878 - protein, 6 aa, Mycobacterium tuberculosis
EGDGGW

SEQ ID NO: 1405879 - protein, 10 aa, Mycobacterium tuberculosis
EGDRNPPVFD

SEQ ID NO: 1405880 - protein, 6 aa, Mycobacterium tuberculosis
EGDRVQ

SEQ ID NO: 1405881 - protein, 7 aa, Mycobacterium tuberculosis
EGEGFDS

SEQ ID NO: 1405882 - protein, 19 aa, Mycobacterium tuberculosis
EGESESRHGLARRVVAWLG

SEQ ID NO: 1405883 - protein, 7 aa, Mycobacterium tuberculosis
EGGIAPD

SEQ ID NO: 1405884 - protein, 7 aa, Mycobacterium tuberculosis
EGGPNTN

SEQ ID NO: 1405885 - protein, 7 aa, Mycobacterium tuberculosis
EGKQSLT

SEQ ID NO: 1405886 - protein, 5 aa, Mycobacterium tuberculosis
EGPDT

SEQ ID NO: 1405887 - protein, 4 aa, Mycobacterium tuberculosis
EGPR

SEQ ID NO: 1405888 - protein, 7 aa, Mycobacterium tuberculosis
EGQSTRH

SEQ ID NO: 1405889 - protein, 11 aa, Mycobacterium tuberculosis
EGSAADNRASL

SEQ ID NO: 1405890 - protein, 8 aa, Mycobacterium tuberculosis
EGSDADGL

SEQ ID NO: 1405891 - protein, 7 aa, Mycobacterium tuberculosis
EGSEGLR

SEQ ID NO: 1405892 - protein, 5 aa, Mycobacterium tuberculosis
EGSIS

SEQ ID NO: 1405893 - protein, 5 aa, Mycobacterium tuberculosis
EGSVE

SEQ ID NO: 1405894 - protein, 5 aa, Mycobacterium tuberculosis
EGTAE

SEQ ID NO: 1405895 - protein, 5 aa, Mycobacterium tuberculosis
EGTPE

SEQ ID NO: 1405896 - protein, 6 aa, Mycobacterium tuberculosis
EGTPVT

SEQ ID NO: 1405897 - protein, 6 aa, Mycobacterium tuberculosis
EGVPAP

SEQ ID NO: 1405898 - protein, 5 aa, Mycobacterium tuberculosis
EHDEM

SEQ ID NO: 1405899 - protein, 19 aa, Mycobacterium tuberculosis
EHDPTAPGLPDVTTSAPAV

SEQ ID NO: 1405900 - protein, 6 aa, Mycobacterium tuberculosis
EHGATE

SEQ ID NO: 1405901 - protein, 9 aa, Mycobacterium tuberculosis
EHGDRRSAA

SEQ ID NO: 1405902 - protein, 12 aa, Mycobacterium tuberculosis
EHGQGPGPGENI

SEQ ID NO: 1405903 - protein, 5 aa, Mycobacterium tuberculosis
EHPRP

SEQ ID NO: 1405904 - protein, 5 aa, Mycobacterium tuberculosis
EHQGP

SEQ ID NO: 1405905 - protein, 13 aa, Mycobacterium tuberculosis
EHRSTVSPYLVKQ

SEQ ID NO: 1405906 - protein, 11 aa, Mycobacterium tuberculosis
EHTDDYPELDQ

SEQ ID NO: 1405907 - protein, 27 aa, Mycobacterium tuberculosis
EHTEHDDSEIVGEPEAGALVDLSSMDA

SEQ ID NO: 1405908 - protein, 6 aa, Mycobacterium tuberculosis
EHTGGP

SEQ ID NO: 1405909 - protein, 4 aa, Mycobacterium tuberculosis
EHTS

SEQ ID NO: 1405910 - protein, 16 aa, Mycobacterium tuberculosis
EIDPEDLEDADPFEEG

SEQ ID NO: 1405911 - protein, 5 aa, Mycobacterium tuberculosis
EIEDE

SEQ ID NO: 1405912 - protein, 14 aa, Mycobacterium tuberculosis
EIENSDSDYDREKL

SEQ ID NO: 1405913 - protein, 5 aa, Mycobacterium tuberculosis
EIGRG

SEQ ID NO: 1405914 - protein, 10 aa, Mycobacterium tuberculosis
EIPADRPALP

SEQ ID NO: 1405915 - protein, 4 aa, Mycobacterium tuberculosis
EIPE

SEQ ID NO: 1405916 - protein, 7 aa, Mycobacterium tuberculosis
EIPLDDN

SEQ ID NO: 1405917 - protein, 15 aa, Mycobacterium tuberculosis
EIPSFAPPKELQPSE

SEQ ID NO: 1405918 - protein, 8 aa, Mycobacterium tuberculosis
EKAAGPRR

SEQ ID NO: 1405919 - protein, 9 aa, Mycobacterium tuberculosis
EKADAAVAA

SEQ ID NO: 1405920 - protein, 5 aa, Mycobacterium tuberculosis
EKAQE

SEQ ID NO: 1405921 - protein, 15 aa, Mycobacterium tuberculosis
EKATQPRTVSAPTSH

SEQ ID NO: 1405922 - protein, 8 aa, Mycobacterium tuberculosis
EKGLTSKP

SEQ ID NO: 1405923 - protein, 8 aa, Mycobacterium tuberculosis
EKGQSRDL

SEQ ID NO: 1405924 - protein, 20 aa, Mycobacterium tuberculosis
EKGSPESSGSQTSPDEKPPR

SEQ ID NO: 1405925 - protein, 10 aa, Mycobacterium tuberculosis
EKKPKDVETK

SEQ ID NO: 1405926 - protein, 8 aa, Mycobacterium tuberculosis
EKQRTRVE

SEQ ID NO: 1405927 - protein, 9 aa, Mycobacterium tuberculosis
EKSSAATEA

SEQ ID NO: 1405928 - protein, 8 aa, Mycobacterium tuberculosis
EKSYGKGS

SEQ ID NO: 1405929 - protein, 7 aa, Mycobacterium tuberculosis
ELAATNP

SEQ ID NO: 1405930 - protein, 14 aa, Mycobacterium tuberculosis
ELASEQTLSFDVDR

SEQ ID NO: 1405931 - protein, 14 aa, Mycobacterium tuberculosis
ELDPSGAPDRPGGP

SEQ ID NO: 1405932 - protein, 9 aa, Mycobacterium tuberculosis
ELDTNDPVG

SEQ ID NO: 1405933 - protein, 14 aa, Mycobacterium tuberculosis
ELGEAGTNAHHGSG

SEQ ID NO: 1405934 - protein, 5 aa, Mycobacterium tuberculosis
ELGEP

SEQ ID NO: 1405935 - protein, 7 aa, Mycobacterium tuberculosis
ELGGDDK

SEQ ID NO: 1405936 - protein, 8 aa, Mycobacterium tuberculosis
ELGGSDAP

SEQ ID NO: 1405937 - protein, 9 aa, Mycobacterium tuberculosis
ELGTTAASY

SEQ ID NO: 1405938 - protein, 7 aa, Mycobacterium tuberculosis
ELPEGKD

SEQ ID NO: 1405939 - protein, 7 aa, Mycobacterium tuberculosis
ELPGDPT

SEQ ID NO: 1405940 - protein, 11 aa, Mycobacterium tuberculosis
ELPKQGSRTPW

SEQ ID NO: 1405941 - protein, 7 aa, Mycobacterium tuberculosis
ELPMPQS

SEQ ID NO: 1405942 - protein, 11 aa, Mycobacterium tuberculosis
ELPPSSWGSGK

SEQ ID NO: 1405943 - protein, 10 aa, Mycobacterium tuberculosis
ELPSGDAPVQ

SEQ ID NO: 1405944 - protein, 11 aa, Mycobacterium tuberculosis
ELQRAGGGTGY

SEQ ID NO: 1405945 - protein, 5 aa, Mycobacterium tuberculosis
ELTRQ

SEQ ID NO: 1405946 - protein, 8 aa, Mycobacterium tuberculosis
EMDPSGAG

SEQ ID NO: 1405947 - protein, 5 aa, Mycobacterium tuberculosis
EMPDD

SEQ ID NO: 1405948 - protein, 6 aa, Mycobacterium tuberculosis
EMTKSN

SEQ ID NO: 1405949 - protein, 15 aa, Mycobacterium tuberculosis
ENAVPTAELVKVAGR

SEQ ID NO: 1405950 - protein, 9 aa, Mycobacterium tuberculosis
ENDSDESSL

SEQ ID NO: 1405951 - protein, 5 aa, Mycobacterium tuberculosis
ENEIE

SEQ ID NO: 1405952 - protein, 8 aa, Mycobacterium tuberculosis
ENGAEQLE

SEQ ID NO: 1405953 - protein, 7 aa, Mycobacterium tuberculosis
ENIPRDG

SEQ ID NO: 1405954 - protein, 8 aa, Mycobacterium tuberculosis
ENPAEADH

SEQ ID NO: 1405955 - protein, 6 aa, Mycobacterium tuberculosis
ENPDMS

SEQ ID NO: 1405956 - protein, 7 aa, Mycobacterium tuberculosis
ENPDQLQ

SEQ ID NO: 1405957 - protein, 7 aa, Mycobacterium tuberculosis
ENPDSAA

SEQ ID NO: 1405958 - protein, 6 aa, Mycobacterium tuberculosis
ENQAGH

SEQ ID NO: 1405959 - protein, 23 aa, Mycobacterium tuberculosis
ENQGDVDPQSITGATATATHGTG

SEQ ID NO: 1405960 - protein, 9 aa, Mycobacterium tuberculosis
ENVAESLTR

SEQ ID NO: 1405961 - protein, 4 aa, Mycobacterium tuberculosis
EPAA

SEQ ID NO: 1405962 - protein, 6 aa, Mycobacterium tuberculosis
EPADRD

SEQ ID NO: 1405963 - protein, 12 aa, Mycobacterium tuberculosis
EPAGDAGMRSPT

SEQ ID NO: 1405964 - protein, 10 aa, Mycobacterium tuberculosis
EPAGQPGRWG

SEQ ID NO: 1405965 - protein, 10 aa, Mycobacterium tuberculosis
EPAQPGRPTM

SEQ ID NO: 1405966 - protein, 6 aa, Mycobacterium tuberculosis
EPCTDS

SEQ ID NO: 1405967 - protein, 21 aa, Mycobacterium tuberculosis
EPDAGSDVGAARTKAVQQADG

SEQ ID NO: 1405968 - protein, 9 aa, Mycobacterium tuberculosis
EPDSKSSKS

SEQ ID NO: 1405969 - protein, 4 aa, Mycobacterium tuberculosis
EPDV

SEQ ID NO: 1405970 - protein, 19 aa, Mycobacterium tuberculosis
EPEFGSDSAAVSTTATLDG

SEQ ID NO: 1405971 - protein, 5 aa, Mycobacterium tuberculosis
EPEHQ

SEQ ID NO: 1405972 - protein, 6 aa, Mycobacterium tuberculosis
EPERNQ

SEQ ID NO: 1405973 - protein, 18 aa, Mycobacterium tuberculosis
EPGAAGPGGSRGRGDISV

SEQ ID NO: 1405974 - protein, 13 aa, Mycobacterium tuberculosis
EPGAGSDAGALST

SEQ ID NO: 1405975 - protein, 9 aa, Mycobacterium tuberculosis
EPGPSTEAN

SEQ ID NO: 1405976 - protein, 6 aa, Mycobacterium tuberculosis
EPGQTR

SEQ ID NO: 1405977 - protein, 13 aa, Mycobacterium tuberculosis
EPGSGELNPGPAT

SEQ ID NO: 1405978 - protein, 6 aa, Mycobacterium tuberculosis
EPGTAL

SEQ ID NO: 1405979 - protein, 11 aa, Mycobacterium tuberculosis
EPISARPHPRT

SEQ ID NO: 1405980 - protein, 7 aa, Mycobacterium tuberculosis
EPLESGR

SEQ ID NO: 1405981 - protein, 17 aa, Mycobacterium tuberculosis
EPLNANEELKKAGNPLD

SEQ ID NO: 1405982 - protein, 7 aa, Mycobacterium tuberculosis
EPLPVPT

SEQ ID NO: 1405983 - protein, 8 aa, Mycobacterium tuberculosis
EPLQRPGR

SEQ ID NO: 1405984 - protein, 15 aa, Mycobacterium tuberculosis
EPMPESAAARVKAGA

SEQ ID NO: 1405985 - protein, 13 aa, Mycobacterium tuberculosis
EPMTGERDIRSED

SEQ ID NO: 1405986 - protein, 7 aa, Mycobacterium tuberculosis
EPNPTYA

SEQ ID NO: 1405987 - protein, 5 aa, Mycobacterium tuberculosis
EPPDH

SEQ ID NO: 1405988 - protein, 9 aa, Mycobacterium tuberculosis
EPPQGAGPE

SEQ ID NO: 1405989 - protein, 5 aa, Mycobacterium tuberculosis
EPRSG

SEQ ID NO: 1405990 - protein, 13 aa, Mycobacterium tuberculosis
EPRTAATLVAGQW

SEQ ID NO: 1405991 - protein, 11 aa, Mycobacterium tuberculosis
EPSATYRPGQA

SEQ ID NO: 1405992 - protein, 8 aa, Mycobacterium tuberculosis
EPSETSQV

SEQ ID NO: 1405993 - protein, 5 aa, Mycobacterium tuberculosis
EPSEV

SEQ ID NO: 1405994 - protein, 7 aa, Mycobacterium tuberculosis
EPSSGLD

SEQ ID NO: 1405995 - protein, 13 aa, Mycobacterium tuberculosis
EPTGNLDSDTGDK

SEQ ID NO: 1405996 - protein, 12 aa, Mycobacterium tuberculosis
EPTLPVDGSTGY

SEQ ID NO: 1405997 - protein, 18 aa, Mycobacterium tuberculosis
EPTLTEESYANNPKRGRH

SEQ ID NO: 1405998 - protein, 12 aa, Mycobacterium tuberculosis
EPTTGLDPRSRQ

SEQ ID NO: 1405999 - protein, 6 aa, Mycobacterium tuberculosis
EPVDAA

SEQ ID NO: 1406000 - protein, 4 aa, Mycobacterium tuberculosis
EPWE

SEQ ID NO: 1406001 - protein, 10 aa, Mycobacterium tuberculosis
EQAGNQREVR

SEQ ID NO: 1406002 - protein, 12 aa, Mycobacterium tuberculosis
EQAPTESPAAAA

SEQ ID NO: 1406003 - protein, 4 aa, Mycobacterium tuberculosis
EQEY

SEQ ID NO: 1406004 - protein, 8 aa, Mycobacterium tuberculosis
EQGKTDWA

SEQ ID NO: 1406005 - protein, 12 aa, Mycobacterium tuberculosis
EQGRPAESTGEL

SEQ ID NO: 1406006 - protein, 13 aa, Mycobacterium tuberculosis
EQHPLATKDSDGR

SEQ ID NO: 1406007 - protein, 4 aa, Mycobacterium tuberculosis
EQID

SEQ ID NO: 1406008 - protein, 8 aa, Mycobacterium tuberculosis
EQIPPEAF

SEQ ID NO: 1406009 - protein, 10 aa, Mycobacterium tuberculosis
EQLASSDPGV

SEQ ID NO: 1406010 - protein, 9 aa, Mycobacterium tuberculosis
EQNQPTGER

SEQ ID NO: 1406011 - protein, 6 aa, Mycobacterium tuberculosis
EQPPER

SEQ ID NO: 1406012 - protein, 7 aa, Mycobacterium tuberculosis
EQRTGRS

SEQ ID NO: 1406013 - protein, 7 aa, Mycobacterium tuberculosis
EQTHGAD

SEQ ID NO: 1406014 - protein, 5 aa, Mycobacterium tuberculosis
EQVRT

SEQ ID NO: 1406015 - protein, 5 aa, Mycobacterium tuberculosis
EQVTA

SEQ ID NO: 1406016 - protein, 10 aa, Mycobacterium tuberculosis
ERAAAGPFGT

SEQ ID NO: 1406017 - protein, 20 aa, Mycobacterium tuberculosis
ERAEETRTDTRSRVEESRAR

SEQ ID NO: 1406018 - protein, 10 aa, Mycobacterium tuberculosis
ERAGGSDLGA

SEQ ID NO: 1406019 - protein, 5 aa, Mycobacterium tuberculosis
ERAQA

SEQ ID NO: 1406020 - protein, 19 aa, Mycobacterium tuberculosis
ERAQARASRLQRRQAATDA

SEQ ID NO: 1406021 - protein, 7 aa, Mycobacterium tuberculosis
ERARQAG

SEQ ID NO: 1406022 - protein, 11 aa, Mycobacterium tuberculosis
ERASARADPEG

SEQ ID NO: 1406023 - protein, 6 aa, Mycobacterium tuberculosis
ERDETS

SEQ ID NO: 1406024 - protein, 7 aa, Mycobacterium tuberculosis
ERDNERC

SEQ ID NO: 1406025 - protein, 4 aa, Mycobacterium tuberculosis
ERDQ

SEQ ID NO: 1406026 - protein, 20 aa, Mycobacterium tuberculosis
ERDQQARGADDSGHDGGPVD

SEQ ID NO: 1406027 - protein, 8 aa, Mycobacterium tuberculosis
EREKREAE

SEQ ID NO: 1406028 - protein, 10 aa, Mycobacterium tuberculosis
ERELPEPDDE

SEQ ID NO: 1406029 - protein, 13 aa, Mycobacterium tuberculosis
ERERAANAQGDPR

SEQ ID NO: 1406030 - protein, 7 aa, Mycobacterium tuberculosis
ERGAVPK

SEQ ID NO: 1406031 - protein, 9 aa, Mycobacterium tuberculosis
ERGGTPLRS

SEQ ID NO: 1406032 - protein, 5 aa, Mycobacterium tuberculosis
ERGNA

SEQ ID NO: 1406033 - protein, 15 aa, Mycobacterium tuberculosis
ERGNVARGDDFDTSV

SEQ ID NO: 1406034 - protein, 10 aa, Mycobacterium tuberculosis
ERGSADPTVN

SEQ ID NO: 1406035 - protein, 7 aa, Mycobacterium tuberculosis
ERGYGED

SEQ ID NO: 1406036 - protein, 8 aa, Mycobacterium tuberculosis
ERIPGEAA

SEQ ID NO: 1406037 - protein, 6 aa, Mycobacterium tuberculosis
ERKPSA

SEQ ID NO: 1406038 - protein, 7 aa, Mycobacterium tuberculosis
ERLGGDG

SEQ ID NO: 1406039 - protein, 7 aa, Mycobacterium tuberculosis
ERNEFDG

SEQ ID NO: 1406040 - protein, 7 aa, Mycobacterium tuberculosis
ERNSPGS

SEQ ID NO: 1406041 - protein, 5 aa, Mycobacterium tuberculosis
ERPDN

SEQ ID NO: 1406042 - protein, 4 aa, Mycobacterium tuberculosis
ERPT

SEQ ID NO: 1406043 - protein, 10 aa, Mycobacterium tuberculosis
ERQRAATPAY

SEQ ID NO: 1406044 - protein, 7 aa, Mycobacterium tuberculosis
ERQRTHG

SEQ ID NO: 1406045 - protein, 6 aa, Mycobacterium tuberculosis
ERRAQA

SEQ ID NO: 1406046 - protein, 6 aa, Mycobacterium tuberculosis
ERRNAR

SEQ ID NO: 1406047 - protein, 5 aa, Mycobacterium tuberculosis
ERRPA

SEQ ID NO: 1406048 - protein, 6 aa, Mycobacterium tuberculosis
ERRQRL

SEQ ID NO: 1406049 - protein, 5 aa, Mycobacterium tuberculosis
ERRRR

SEQ ID NO: 1406050 - protein, 8 aa, Mycobacterium tuberculosis
ERSGATRV

SEQ ID NO: 1406051 - protein, 9 aa, Mycobacterium tuberculosis
ERSGVSNPY

SEQ ID NO: 1406052 - protein, 7 aa, Mycobacterium tuberculosis
ERTARAD

SEQ ID NO: 1406053 - protein, 5 aa, Mycobacterium tuberculosis
ERTDQ

SEQ ID NO: 1406054 - protein, 11 aa, Mycobacterium tuberculosis
ERTGAPYASTM

SEQ ID NO: 1406055 - protein, 5 aa, Mycobacterium tuberculosis
ERTGV

SEQ ID NO: 1406056 - protein, 13 aa, Mycobacterium tuberculosis
ERTRHRAETTTRE

SEQ ID NO: 1406057 - protein, 7 aa, Mycobacterium tuberculosis
ERTVTDQ

SEQ ID NO: 1406058 - protein, 7 aa, Mycobacterium tuberculosis
ERVTQDE

SEQ ID NO: 1406059 - protein, 12 aa, Mycobacterium tuberculosis
ERYSGKRDLENP

SEQ ID NO: 1406060 - protein, 8 aa, Mycobacterium tuberculosis
ESAGRGRA

SEQ ID NO: 1406061 - protein, 5 aa, Mycobacterium tuberculosis
ESAIP

SEQ ID NO: 1406062 - protein, 9 aa, Mycobacterium tuberculosis
ESDEDARRR

SEQ ID NO: 1406063 - protein, 15 aa, Mycobacterium tuberculosis
ESDMSRKTPSDNTRW

SEQ ID NO: 1406064 - protein, 8 aa, Mycobacterium tuberculosis
ESDPRHPV

SEQ ID NO: 1406065 - protein, 6 aa, Mycobacterium tuberculosis
ESEDES

SEQ ID NO: 1406066 - protein, 7 aa, Mycobacterium tuberculosis
ESEGMPG

SEQ ID NO: 1406067 - protein, 7 aa, Mycobacterium tuberculosis
ESENWSG

SEQ ID NO: 1406068 - protein, 6 aa, Mycobacterium tuberculosis
ESGRQL

SEQ ID NO: 1406069 - protein, 11 aa, Mycobacterium tuberculosis
ESIADGGSQVT

SEQ ID NO: 1406070 - protein, 11 aa, Mycobacterium tuberculosis
ESIPDPVRETD

SEQ ID NO: 1406071 - protein, 9 aa, Mycobacterium tuberculosis
ESIRKAEDP

SEQ ID NO: 1406072 - protein, 17 aa, Mycobacterium tuberculosis
ESLSAGHAKPCAGGGAT

SEQ ID NO: 1406073 - protein, 6 aa, Mycobacterium tuberculosis
ESLTPG

SEQ ID NO: 1406074 - protein, 18 aa, Mycobacterium tuberculosis
ESMGQGRASRADGAPDTV

SEQ ID NO: 1406075 - protein, 4 aa, Mycobacterium tuberculosis
ESPA

SEQ ID NO: 1406076 - protein, 5 aa, Mycobacterium tuberculosis
ESPDL

SEQ ID NO: 1406077 - protein, 6 aa, Mycobacterium tuberculosis
ESPPGA

SEQ ID NO: 1406078 - protein, 6 aa, Mycobacterium tuberculosis
ESPRGE

SEQ ID NO: 1406079 - protein, 4 aa, Mycobacterium tuberculosis
ESPS

SEQ ID NO: 1406080 - protein, 4 aa, Mycobacterium tuberculosis
ESQE

SEQ ID NO: 1406081 - protein, 11 aa, Mycobacterium tuberculosis
ESQVGTTDRAG

SEQ ID NO: 1406082 - protein, 8 aa, Mycobacterium tuberculosis
ESRGWSPD

SEQ ID NO: 1406083 - protein, 9 aa, Mycobacterium tuberculosis
ESSRPAKPR

SEQ ID NO: 1406084 - protein, 8 aa, Mycobacterium tuberculosis
ESTSGQRA

SEQ ID NO: 1406085 - protein, 7 aa, Mycobacterium tuberculosis
ESVTEGT

SEQ ID NO: 1406086 - protein, 5 aa, Mycobacterium tuberculosis
ESYGV

SEQ ID NO: 1406087 - protein, 5 aa, Mycobacterium tuberculosis
ETADE

SEQ ID NO: 1406088 - protein, 4 aa, Mycobacterium tuberculosis
ETAG

SEQ ID NO: 1406089 - protein, 8 aa, Mycobacterium tuberculosis
ETAGERPI

SEQ ID NO: 1406090 - protein, 7 aa, Mycobacterium tuberculosis
ETASEQM

SEQ ID NO: 1406091 - protein, 9 aa, Mycobacterium tuberculosis
ETDDPTVPT

SEQ ID NO: 1406092 - protein, 7 aa, Mycobacterium tuberculosis
ETDEAGN

SEQ ID NO: 1406093 - protein, 10 aa, Mycobacterium tuberculosis
ETDTGSPEAQ

SEQ ID NO: 1406094 - protein, 5 aa, Mycobacterium tuberculosis
ETFEE

SEQ ID NO: 1406095 - protein, 10 aa, Mycobacterium tuberculosis
ETGEHTAHSQ

SEQ ID NO: 1406096 - protein, 39 aa, Mycobacterium tuberculosis; identical to SEQ ID NO: 174161

SEQ ID NO: 1406097 - protein, 5 aa, Mycobacterium tuberculosis
ETGNS

SEQ ID NO: 1406098 - protein, 8 aa, Mycobacterium tuberculosis
ETGQPPWT

SEQ ID NO: 1406099 - protein, 9 aa, Mycobacterium tuberculosis
ETGYETRHR

SEQ ID NO: 1406100 - protein, 14 aa, Mycobacterium tuberculosis
ETMGTGGSGSGDSN

SEQ ID NO: 1406101 - protein, 5 aa, Mycobacterium tuberculosis
ETPEY

SEQ ID NO: 1406102 - protein, 10 aa, Mycobacterium tuberculosis
ETPHTRARSV

SEQ ID NO: 1406103 - protein, 19 aa, Mycobacterium tuberculosis
ETPVGREAETLTARSPLGQ

SEQ ID NO: 1406104 - protein, 5 aa, Mycobacterium tuberculosis
ETRPD

SEQ ID NO: 1406105 - protein, 8 aa, Mycobacterium tuberculosis
ETSTERLT

SEQ ID NO: 1406106 - protein, 7 aa, Mycobacterium tuberculosis
ETTSDEM

SEQ ID NO: 1406107 - protein, 8 aa, Mycobacterium tuberculosis
EVDDKQLD

SEQ ID NO: 1406108 - protein, 9 aa, Mycobacterium tuberculosis
EVEEDRDED

SEQ ID NO: 1406109 - protein, 8 aa, Mycobacterium tuberculosis
EVGEAPGR

SEQ ID NO: 1406110 - protein, 7 aa, Mycobacterium tuberculosis
EVGPDDI

SEQ ID NO: 1406111 - protein, 12 aa, Mycobacterium tuberculosis
EVGRPEAHHEEA

SEQ ID NO: 1406112 - protein, 5 aa, Mycobacterium tuberculosis
EVPAT

SEQ ID NO: 1406113 - protein, 12 aa, Mycobacterium tuberculosis
EVPNSDGINPHD

SEQ ID NO: 1406114 - protein, 7 aa, Mycobacterium tuberculosis
EVPTGEV

SEQ ID NO: 1406115 - protein, 6 aa, Mycobacterium tuberculosis
EVQGQD

SEQ ID NO: 1406116 - protein, 8 aa, Mycobacterium tuberculosis
EVSADGLR

SEQ ID NO: 1406117 - protein, 9 aa, Mycobacterium tuberculosis
EVSDPEQVA

SEQ ID NO: 1406118 - protein, 11 aa, Mycobacterium tuberculosis
EVSHPKPTEFR

SEQ ID NO: 1406119 - protein, 5 aa, Mycobacterium tuberculosis
EVSPA

SEQ ID NO: 1406120 - protein, 12 aa, Mycobacterium tuberculosis
EVTADGRSDRGN

SEQ ID NO: 1406121 - protein, 10 aa, Mycobacterium tuberculosis
EVTDAEGKPV

SEQ ID NO: 1406122 - protein, 5 aa, Mycobacterium tuberculosis
EWSGR

SEQ ID NO: 1406123 - protein, 21 aa, Mycobacterium tuberculosis
EYGSGVGRSKKEAEQKAAAAA

SEQ ID NO: 1406124 - protein, 11 aa, Mycobacterium tuberculosis
EYQAAAAQAAA

SEQ ID NO: 1406125 - protein, 5 aa, Mycobacterium tuberculosis
EYSQG

SEQ ID NO: 1406126 - protein, 10 aa, Mycobacterium tuberculosis
FAAPATKNLP

SEQ ID NO: 1406127 - protein, 7 aa, Mycobacterium tuberculosis
FADQPNA

SEQ ID NO: 1406128 - protein, 6 aa, Mycobacterium tuberculosis
FANAQS

SEQ ID NO: 1406129 - protein, 6 aa, Mycobacterium tuberculosis
FANPTA

SEQ ID NO: 1406130 - protein, 8 aa, Mycobacterium tuberculosis
FASGNPAT

SEQ ID NO: 1406131 - protein, 19 aa, Mycobacterium tuberculosis
FASTPLTPAAPIVSRLVAR

SEQ ID NO: 1406132 - protein, 8 aa, Mycobacterium tuberculosis
FDANRPSA

SEQ ID NO: 1406133 - protein, 5 aa, Mycobacterium tuberculosis
FDEDA

SEQ ID NO: 1406134 - protein, 14 aa, Mycobacterium tuberculosis
FDNGPWPSTPPHER

SEQ ID NO: 1406135 - protein, 4 aa, Mycobacterium tuberculosis
FDPE

SEQ ID NO: 1406136 - protein, 8 aa, Mycobacterium tuberculosis
FDQSPKDL

SEQ ID NO: 1406137 - protein, 10 aa, Mycobacterium tuberculosis
FDRDPNGDWR

SEQ ID NO: 1406138 - protein, 8 aa, Mycobacterium tuberculosis
FENDDSAA

SEQ ID NO: 1406139 - protein, 18 aa, Mycobacterium tuberculosis
FESGTSGRPVGLRPSGAL

SEQ ID NO: 1406140 - protein, 7 aa, Mycobacterium tuberculosis
FETNEDG

SEQ ID NO: 1406141 - protein, 4 aa, Mycobacterium tuberculosis
FETR

SEQ ID NO: 1406142 - protein, 7 aa, Mycobacterium tuberculosis
FGDPQER

SEQ ID NO: 1406143 - protein, 7 aa, Mycobacterium tuberculosis
FGGPPGV

SEQ ID NO: 1406144 - protein, 9 aa, Mycobacterium tuberculosis
FGNSGNNNI

SEQ ID NO: 1406145 - protein, 10 aa, Mycobacterium tuberculosis
FGNTGAQTVG

SEQ ID NO: 1406146 - protein, 8 aa, Mycobacterium tuberculosis
FGSPELQQ

SEQ ID NO: 1406147 - protein, 4 aa, Mycobacterium tuberculosis
FGST

SEQ ID NO: 1406148 - protein, 8 aa, Mycobacterium tuberculosis
FGTQEGGA

SEQ ID NO: 1406149 - protein, 9 aa, Mycobacterium tuberculosis
FKEGREKGL

SEQ ID NO: 1406150 - protein, 11 aa, Mycobacterium tuberculosis
FKSGSSQPPLQ

SEQ ID NO: 1406151 - protein, 7 aa, Mycobacterium tuberculosis
FNPDRTR

SEQ ID NO: 1406152 - protein, 12 aa, Mycobacterium tuberculosis
FPANGATADTNA

SEQ ID NO: 1406153 - protein, 6 aa, Mycobacterium tuberculosis
FPDSHR

SEQ ID NO: 1406154 - protein, 12 aa, Mycobacterium tuberculosis
FPEPQPSKDVVQ

SEQ ID NO: 1406155 - protein, 11 aa, Mycobacterium tuberculosis
FPEPSSAVEQG

SEQ ID NO: 1406156 - protein, 6 aa, Mycobacterium tuberculosis
FPESYN

SEQ ID NO: 1406157 - protein, 5 aa, Mycobacterium tuberculosis
FPGAK

SEQ ID NO: 1406158 - protein, 6 aa, Mycobacterium tuberculosis
FPGGEG

SEQ ID NO: 1406159 - protein, 9 aa, Mycobacterium tuberculosis
FPTRNGAQR

SEQ ID NO: 1406160 - protein, 4 aa, Mycobacterium tuberculosis
FQRG

SEQ ID NO: 1406161 - protein, 6 aa, Mycobacterium tuberculosis
FRDETG

SEQ ID NO: 1406162 - protein, 10 aa, Mycobacterium tuberculosis
FSERGGPQTN

SEQ ID NO: 1406163 - protein, 13 aa, Mycobacterium tuberculosis
FSGDGSLDTATAA

SEQ ID NO: 1406164 - protein, 7 aa, Mycobacterium tuberculosis
FSGSAPG

SEQ ID NO: 1406165 - protein, 4 aa, Mycobacterium tuberculosis
FSPA

SEQ ID NO: 1406166 - protein, 6 aa, Mycobacterium tuberculosis
FSPGTP

SEQ ID NO: 1406167 - protein, 7 aa, Mycobacterium tuberculosis
FTEGRSA

SEQ ID NO: 1406168 - protein, 5 aa, Mycobacterium tuberculosis
FTGRG

SEQ ID NO: 1406169 - protein, 18 aa, Mycobacterium tuberculosis
FTPGERRDASDKSSSAAR

SEQ ID NO: 1406170 - protein, 6 aa, Mycobacterium tuberculosis
FTPGPG

SEQ ID NO: 1406171 - protein, 13 aa, Mycobacterium tuberculosis
FTPKDGGRVVMRR

SEQ ID NO: 1406172 - protein, 4 aa, Mycobacterium tuberculosis
FTPR

SEQ ID NO: 1406173 - protein, 13 aa, Mycobacterium tuberculosis
FTPSPSAAATPGG

SEQ ID NO: 1406174 - protein, 23 aa, Mycobacterium tuberculosis
FTTSDAQAVPKTAADRRPPVAAD

SEQ ID NO: 1406175 - protein, 9 aa, Mycobacterium tuberculosis
GAAAAAAHT

SEQ ID NO: 1406176 - protein, 7 aa, Mycobacterium tuberculosis
GAAAPLD

SEQ ID NO: 1406177 - protein, 5 aa, Mycobacterium tuberculosis
GAAED

SEQ ID NO: 1406178 - protein, 5 aa, Mycobacterium tuberculosis
GAAER

SEQ ID NO: 1406179 - protein, 6 aa, Mycobacterium tuberculosis
GAAGIG

SEQ ID NO: 1406180 - protein, 6 aa, Mycobacterium tuberculosis
GAAGQI

SEQ ID NO: 1406181 - protein, 9 aa, Mycobacterium tuberculosis
GAAGQPHAR

SEQ ID NO: 1406182 - protein, 9 aa, Mycobacterium tuberculosis
GAAKGYAAA

SEQ ID NO: 1406183 - protein, 4 aa, Mycobacterium tuberculosis
GAAP

SEQ ID NO: 1406184 - protein, 8 aa, Mycobacterium tuberculosis
GAAPSASD

SEQ ID NO: 1406185 - protein, 8 aa, Mycobacterium tuberculosis
GAAPSYDQ

SEQ ID NO: 1406186 - protein, 8 aa, Mycobacterium tuberculosis
GAAPVSAG

SEQ ID NO: 1406187 - protein, 6 aa, Mycobacterium tuberculosis
GAARSA

SEQ ID NO: 1406188 - protein, 7 aa, Mycobacterium tuberculosis
GAATEVE

SEQ ID NO: 1406189 - protein, 8 aa, Mycobacterium tuberculosis
GAATGTRI

SEQ ID NO: 1406190 - protein, 8 aa, Mycobacterium tuberculosis
GADDGRSA

SEQ ID NO: 1406191 - protein, 7 aa, Mycobacterium tuberculosis
GADQPGR

SEQ ID NO: 1406192 - protein, 9 aa, Mycobacterium tuberculosis
GADREAGAD

SEQ ID NO: 1406193 - protein, 13 aa, Mycobacterium tuberculosis
GADTERARDLLST

SEQ ID NO: 1406194 - protein, 13 aa, Mycobacterium tuberculosis
GAEAGKPLASSDR

SEQ ID NO: 1406195 - protein, 7 aa, Mycobacterium tuberculosis
GAEANEA

SEQ ID NO: 1406196 - protein, 7 aa, Mycobacterium tuberculosis
GAEDYAQ

SEQ ID NO: 1406197 - protein, 8 aa, Mycobacterium tuberculosis
GAEQIRTG

SEQ ID NO: 1406198 - protein, 7 aa, Mycobacterium tuberculosis
GAERTEL

SEQ ID NO: 1406199 - protein, 9 aa, Mycobacterium tuberculosis
GAETTRNSI

SEQ ID NO: 1406200 - protein, 6 aa, Mycobacterium tuberculosis
GAGATV

SEQ ID NO: 1406201 - protein, 8 aa, Mycobacterium tuberculosis
GAGGGDGG

SEQ ID NO: 1406202 - protein, 13 aa, Mycobacterium tuberculosis
GAGGTEPAGGDHA

SEQ ID NO: 1406203 - protein, 5 aa, Mycobacterium tuberculosis
GAGKQ

SEQ ID NO: 1406204 - protein, 5 aa, Mycobacterium tuberculosis
GAGNI

SEQ ID NO: 1406205 - protein, 5 aa, Mycobacterium tuberculosis
GAGPG

SEQ ID NO: 1406206 - protein, 7 aa, Mycobacterium tuberculosis
GAGPRKD

SEQ ID NO: 1406207 - protein, 6 aa, Mycobacterium tuberculosis
GAGTGD

SEQ ID NO: 1406208 - protein, 8 aa, Mycobacterium tuberculosis
GAGVTGEN

SEQ ID NO: 1406209 - protein, 23 aa, Mycobacterium tuberculosis
GAHGDADAQHKGMTAQQTTELGT

SEQ ID NO: 1406210 - protein, 4 aa, Mycobacterium tuberculosis
GAKG

SEQ ID NO: 1406211 - protein, 8 aa, Mycobacterium tuberculosis
GAKPAPGT

SEQ ID NO: 1406212 - protein, 9 aa, Mycobacterium tuberculosis
GAKTGKLRK

SEQ ID NO: 1406213 - protein, 9 aa, Mycobacterium tuberculosis
GALPPGTRL

SEQ ID NO: 1406214 - protein, 9 aa, Mycobacterium tuberculosis
GANAGPDRS

SEQ ID NO: 1406215 - protein, 6 aa, Mycobacterium tuberculosis
GANDAV

SEQ ID NO: 1406216 - protein, 6 aa, Mycobacterium tuberculosis
GANQTM

SEQ ID NO: 1406217 - protein, 16 aa, Mycobacterium tuberculosis
GANRYAEADLCAAARI

SEQ ID NO: 1406218 - protein, 4 aa, Mycobacterium tuberculosis
GANS

SEQ ID NO: 1406219 - protein, 10 aa, Mycobacterium tuberculosis
GANSGQYARG

SEQ ID NO: 1406220 - protein, 7 aa, Mycobacterium tuberculosis
GANTGLG

SEQ ID NO: 1406221 - protein, 6 aa, Mycobacterium tuberculosis
GAPADE

SEQ ID NO: 1406222 - protein, 6 aa, Mycobacterium tuberculosis
GAPANV

SEQ ID NO: 1406223 - protein, 7 aa, Mycobacterium tuberculosis
GAPDDRR

SEQ ID NO: 1406224 - protein, 6 aa, Mycobacterium tuberculosis
GAPDGD

SEQ ID NO: 1406225 - protein, 5 aa, Mycobacterium tuberculosis
GAPEA

SEQ ID NO: 1406226 - protein, 7 aa, Mycobacterium tuberculosis
GAPEAEQ

SEQ ID NO: 1406227 - protein, 9 aa, Mycobacterium tuberculosis
GAPGAPGLD

SEQ ID NO: 1406228 - protein, 4 aa, Mycobacterium tuberculosis
GAPL

SEQ ID NO: 1406229 - protein, 7 aa, Mycobacterium tuberculosis
GAPLAAA

SEQ ID NO: 1406230 - protein, 6 aa, Mycobacterium tuberculosis
GAPPQR

SEQ ID NO: 1406231 - protein, 7 aa, Mycobacterium tuberculosis
GAPSGAY

SEQ ID NO: 1406232 - protein, 10 aa, Mycobacterium tuberculosis
GAPTPAETQL

SEQ ID NO: 1406233 - protein, 9 aa, Mycobacterium tuberculosis
GAQADPGLR

SEQ ID NO: 1406234 - protein, 7 aa, Mycobacterium tuberculosis
GAQVSGV

SEQ ID NO: 1406235 - protein, 8 aa, Mycobacterium tuberculosis
GARADSVP

SEQ ID NO: 1406236 - protein, 9 aa, Mycobacterium tuberculosis
GARAGGGLS

SEQ ID NO: 1406237 - protein, 7 aa, Mycobacterium tuberculosis
GARIDPD

SEQ ID NO: 1406238 - protein, 12 aa, Mycobacterium tuberculosis
GARPTRPPPPML

SEQ ID NO: 1406239 - protein, 18 aa, Mycobacterium tuberculosis
GARQEKRELSNRATPVGE

SEQ ID NO: 1406240 - protein, 8 aa, Mycobacterium tuberculosis
GARSPLGR

SEQ ID NO: 1406241 - protein, 12 aa, Mycobacterium tuberculosis
GARTAAARAQAV

SEQ ID NO: 1406242 - protein, 10 aa, Mycobacterium tuberculosis
GASAAATQLT

SEQ ID NO: 1406243 - protein, 6 aa, Mycobacterium tuberculosis
GASGMG

SEQ ID NO: 1406244 - protein, 8 aa, Mycobacterium tuberculosis
GASGPLDV

SEQ ID NO: 1406245 - protein, 30 aa, Mycobacterium tuberculosis; identical to SEQ ID NO: 194081

SEQ ID NO: 1406246 - protein, 9 aa, Mycobacterium tuberculosis
GASPGGDLA

SEQ ID NO: 1406247 - protein, 7 aa, Mycobacterium tuberculosis
GASPRAE

SEQ ID NO: 1406248 - protein, 7 aa, Mycobacterium tuberculosis
GASPRIL

SEQ ID NO: 1406249 - protein, 7 aa, Mycobacterium tuberculosis
GASPRRA

SEQ ID NO: 1406250 - protein, 18 aa, Mycobacterium tuberculosis
GASSTGISRKLPDTERQR

SEQ ID NO: 1406251 - protein, 8 aa, Mycobacterium tuberculosis
GASTGIGK

SEQ ID NO: 1406252 - protein, 11 aa, Mycobacterium tuberculosis
GATGDEGAANA

SEQ ID NO: 1406253 - protein, 7 aa, Mycobacterium tuberculosis
GATGTIE

SEQ ID NO: 1406254 - protein, 7 aa, Mycobacterium tuberculosis
GATKGLP

SEQ ID NO: 1406255 - protein, 13 aa, Mycobacterium tuberculosis
GATMPGGGATPAL

SEQ ID NO: 1406256 - protein, 5 aa, Mycobacterium tuberculosis
GATPV

SEQ ID NO: 1406257 - protein, 20 aa, Mycobacterium tuberculosis
GATRTGSGGAAQDDDLAGSS

SEQ ID NO: 1406258 - protein, 18 aa, Mycobacterium tuberculosis
GAVPQASGRGLGHTGGTL

SEQ ID NO: 1406259 - protein, 16 aa, Mycobacterium tuberculosis
GAWNPNQYGNPDNVGA

SEQ ID NO: 1406260 - protein, 19 aa, Mycobacterium tuberculosis
GAYAGSLDDAETALEGQLW

SEQ ID NO: 1406261 - protein, 8 aa, Mycobacterium tuberculosis
GAYPSTLG

SEQ ID NO: 1406262 - protein, 17 aa, Mycobacterium tuberculosis
GDADQAPSPLGRRISSL

SEQ ID NO: 1406263 - protein, 13 aa, Mycobacterium tuberculosis
GDAEDGPAATTTW

SEQ ID NO: 1406264 - protein, 13 aa, Mycobacterium tuberculosis
GDAHYGAGQAHGD

SEQ ID NO: 1406265 - protein, 14 aa, Mycobacterium tuberculosis
GDASVSSVDPADRV

SEQ ID NO: 1406266 - protein, 7 aa, Mycobacterium tuberculosis
GDATKAA

SEQ ID NO: 1406267 - protein, 8 aa, Mycobacterium tuberculosis
GDDDAPNE

SEQ ID NO: 1406268 - protein, 5 aa, Mycobacterium tuberculosis
GDDHY

SEQ ID NO: 1406269 - protein, 6 aa, Mycobacterium tuberculosis
GDDPAL

SEQ ID NO: 1406270 - protein, 5 aa, Mycobacterium tuberculosis
GDDPE

SEQ ID NO: 1406271 - protein, 9 aa, Mycobacterium tuberculosis
GDDPGDPAL

SEQ ID NO: 1406272 - protein, 11 aa, Mycobacterium tuberculosis
GDEGKGKATDL

SEQ ID NO: 1406273 - protein, 7 aa, Mycobacterium tuberculosis
GDERRRV

SEQ ID NO: 1406274 - protein, 7 aa, Mycobacterium tuberculosis
GDESPFD

SEQ ID NO: 1406275 - protein, 8 aa, Mycobacterium tuberculosis
GDESPHAK

SEQ ID NO: 1406276 - protein, 8 aa, Mycobacterium tuberculosis
GDFAGESY

SEQ ID NO: 1406277 - protein, 6 aa, Mycobacterium tuberculosis
GDGAVS

SEQ ID NO: 1406278 - protein, 4 aa, Mycobacterium tuberculosis
GDGS

SEQ ID NO: 1406279 - protein, 4 aa, Mycobacterium tuberculosis
GDGT

SEQ ID NO: 1406280 - protein, 8 aa, Mycobacterium tuberculosis
GDGTKPEN

SEQ ID NO: 1406281 - protein, 6 aa, Mycobacterium tuberculosis
GDGTVS

SEQ ID NO: 1406282 - protein, 6 aa, Mycobacterium tuberculosis
GDIDDE

SEQ ID NO: 1406283 - protein, 15 aa, Mycobacterium tuberculosis
GDIGGAGGGVSGHRG

SEQ ID NO: 1406284 - protein, 8 aa, Mycobacterium tuberculosis
GDKGEADL

SEQ ID NO: 1406285 - protein, 9 aa, Mycobacterium tuberculosis
GDKSEPDLG

SEQ ID NO: 1406286 - protein, 10 aa, Mycobacterium tuberculosis
GDLGSSAARK

SEQ ID NO: 1406287 - protein, 13 aa, Mycobacterium tuberculosis
GDLTEPPAAQVAE

SEQ ID NO: 1406288 - protein, 4 aa, Mycobacterium tuberculosis
GDLV

SEQ ID NO: 1406289 - protein, 6 aa, Mycobacterium tuberculosis
GDNGSG

SEQ ID NO: 1406290 - protein, 9 aa, Mycobacterium tuberculosis
GDNLAHPKA

SEQ ID NO: 1406291 - protein, 8 aa, Mycobacterium tuberculosis
GDNPTEVH

SEQ ID NO: 1406292 - protein, 7 aa, Mycobacterium tuberculosis
GDPGAAL

SEQ ID NO: 1406293 - protein, 6 aa, Mycobacterium tuberculosis
GDPGPF

SEQ ID NO: 1406294 - protein, 5 aa, Mycobacterium tuberculosis
GDPLR

SEQ ID NO: 1406295 - protein, 8 aa, Mycobacterium tuberculosis
GDPPGGKA

SEQ ID NO: 1406296 - protein, 8 aa, Mycobacterium tuberculosis
GDPQPGQS

SEQ ID NO: 1406297 - protein, 9 aa, Mycobacterium tuberculosis
GDPSAPDTL

SEQ ID NO: 1406298 - protein, 32 aa, Mycobacterium tuberculosis; identical to SEQ ID NO: 175138

SEQ ID NO: 1406299 - protein, 5 aa, Mycobacterium tuberculosis
GDPVI

SEQ ID NO: 1406300 - protein, 6 aa, Mycobacterium tuberculosis
GDPVRA

SEQ ID NO: 1406301 - protein, 4 aa, Mycobacterium tuberculosis
GDQA

SEQ ID NO: 1406302 - protein, 7 aa, Mycobacterium tuberculosis
GDQSGAN

SEQ ID NO: 1406303 - protein, 7 aa, Mycobacterium tuberculosis
GDRDRDL

SEQ ID NO: 1406304 - protein, 14 aa, Mycobacterium tuberculosis
GDSAGGSAKSGRDS

SEQ ID NO: 1406305 - protein, 11 aa, Mycobacterium tuberculosis
GDSATLSGADL

SEQ ID NO: 1406306 - protein, 10 aa, Mycobacterium tuberculosis
GDSEKVPSTP

SEQ ID NO: 1406307 - protein, 10 aa, Mycobacterium tuberculosis
GDSPGSKYDK

SEQ ID NO: 1406308 - protein, 9 aa, Mycobacterium tuberculosis
GDTDQTPFG

SEQ ID NO: 1406309 - protein, 5 aa, Mycobacterium tuberculosis
GDTKT

SEQ ID NO: 1406310 - protein, 4 aa, Mycobacterium tuberculosis
GDTL

SEQ ID NO: 1406311 - protein, 5 aa, Mycobacterium tuberculosis
GDTPL

SEQ ID NO: 1406312 - protein, 8 aa, Mycobacterium tuberculosis
GDTTPGRV

SEQ ID NO: 1406313 - protein, 7 aa, Mycobacterium tuberculosis
GDTVTAG

SEQ ID NO: 1406314 - protein, 7 aa, Mycobacterium tuberculosis
GDYETTM

SEQ ID NO: 1406315 - protein, 15 aa, Mycobacterium tuberculosis
GDYNTGVANTGNVNT

SEQ ID NO: 1406316 - protein, 5 aa, Mycobacterium tuberculosis
GDYQD

SEQ ID NO: 1406317 - protein, 6 aa, Mycobacterium tuberculosis
GEAGLD

SEQ ID NO: 1406318 - protein, 4 aa, Mycobacterium tuberculosis
GEAL

SEQ ID NO: 1406319 - protein, 13 aa, Mycobacterium tuberculosis
GEANTGGADKSSI

SEQ ID NO: 1406320 - protein, 9 aa, Mycobacterium tuberculosis
GEATPTGGM

SEQ ID NO: 1406321 - protein, 7 aa, Mycobacterium tuberculosis
GECEPPA

SEQ ID NO: 1406322 - protein, 10 aa, Mycobacterium tuberculosis
GEDELPDGRT

SEQ ID NO: 1406323 - protein, 10 aa, Mycobacterium tuberculosis
GEFSGERKEI

SEQ ID NO: 1406324 - protein, 5 aa, Mycobacterium tuberculosis
GEGGL

SEQ ID NO: 1406325 - protein, 6 aa, Mycobacterium tuberculosis
GEGGNL

SEQ ID NO: 1406326 - protein, 7 aa, Mycobacterium tuberculosis
GEGSSGM

SEQ ID NO: 1406327 - protein, 4 aa, Mycobacterium tuberculosis
GEGT

SEQ ID NO: 1406328 - protein, 6 aa, Mycobacterium tuberculosis
GEGTLT

SEQ ID NO: 1406329 - protein, 11 aa, Mycobacterium tuberculosis
GEHGSTFGGNP

SEQ ID NO: 1406330 - protein, 4 aa, Mycobacterium tuberculosis
GEHK

SEQ ID NO: 1406331 - protein, 13 aa, Mycobacterium tuberculosis
GEHPYTPITPESI

SEQ ID NO: 1406332 - protein, 4 aa, Mycobacterium tuberculosis
GEIE

SEQ ID NO: 1406333 - protein, 20 aa, Mycobacterium tuberculosis
GEIEAADAGDCGVRRVEIPA

SEQ ID NO: 1406334 - protein, 9 aa, Mycobacterium tuberculosis
GEKHGGVKP

SEQ ID NO: 1406335 - protein, 6 aa, Mycobacterium tuberculosis
GELGAD

SEQ ID NO: 1406336 - protein, 10 aa, Mycobacterium tuberculosis
GELGEPSEMT

SEQ ID NO: 1406337 - protein, 7 aa, Mycobacterium tuberculosis
GELSGSH

SEQ ID NO: 1406338 - protein, 5 aa, Mycobacterium tuberculosis
GEMPE

SEQ ID NO: 1406339 - protein, 5 aa, Mycobacterium tuberculosis
GENPR

SEQ ID NO: 1406340 - protein, 8 aa, Mycobacterium tuberculosis
GENPSAAE

SEQ ID NO: 1406341 - protein, 7 aa, Mycobacterium tuberculosis
GEPDPWS

SEQ ID NO: 1406342 - protein, 11 aa, Mycobacterium tuberculosis
GEPGESSEQKI

SEQ ID NO: 1406343 - protein, 18 aa, Mycobacterium tuberculosis
GEPGQPLDERRAPDSPLR

SEQ ID NO: 1406344 - protein, 6 aa, Mycobacterium tuberculosis
GEPPHL

SEQ ID NO: 1406345 - protein, 5 aa, Mycobacterium tuberculosis
GEPQL

SEQ ID NO: 1406346 - protein, 10 aa, Mycobacterium tuberculosis
GEPQQNPDRP

SEQ ID NO: 1406347 - protein, 15 aa, Mycobacterium tuberculosis
GEPSADAGPSDGKGL

SEQ ID NO: 1406348 - protein, 4 aa, Mycobacterium tuberculosis
GEPT

SEQ ID NO: 1406349 - protein, 6 aa, Mycobacterium tuberculosis
GEQSEV

SEQ ID NO: 1406350 - protein, 11 aa, Mycobacterium tuberculosis
GEQSTEEELGG

SEQ ID NO: 1406351 - protein, 4 aa, Mycobacterium tuberculosis
GERA

SEQ ID NO: 1406352 - protein, 9 aa, Mycobacterium tuberculosis
GERGYRATT

SEQ ID NO: 1406353 - protein, 5 aa, Mycobacterium tuberculosis
GERPW

SEQ ID NO: 1406354 - protein, 4 aa, Mycobacterium tuberculosis
GERS

SEQ ID NO: 1406355 - protein, 4 aa, Mycobacterium tuberculosis
GERT

SEQ ID NO: 1406356 - protein, 11 aa, Mycobacterium tuberculosis
GERTTPAGAEA

SEQ ID NO: 1406357 - protein, 6 aa, Mycobacterium tuberculosis
GESADH

SEQ ID NO: 1406358 - protein, 9 aa, Mycobacterium tuberculosis
GESFPTGRA

SEQ ID NO: 1406359 - protein, 10 aa, Mycobacterium tuberculosis
GESGSGKSTL

SEQ ID NO: 1406360 - protein, 8 aa, Mycobacterium tuberculosis
GESPQWSA

SEQ ID NO: 1406361 - protein, 9 aa, Mycobacterium tuberculosis
GETKLGETY

SEQ ID NO: 1406362 - protein, 4 aa, Mycobacterium tuberculosis
GETV

SEQ ID NO: 1406363 - protein, 6 aa, Mycobacterium tuberculosis
GETYNT

SEQ ID NO: 1406364 - protein, 19 aa, Mycobacterium tuberculosis
GEVESNAGGRFSAPDRQDV

SEQ ID NO: 1406365 - protein, 9 aa, Mycobacterium tuberculosis
GEVGSHSEG

SEQ ID NO: 1406366 - protein, 4 aa, Mycobacterium tuberculosis
GEYA

SEQ ID NO: 1406367 - protein, 6 aa, Mycobacterium tuberculosis
GEYGEV

SEQ ID NO: 1406368 - protein, 6 aa, Mycobacterium tuberculosis
GEYSSY

SEQ ID NO: 1406369 - protein, 7 aa, Mycobacterium tuberculosis
GFDPTAR

SEQ ID NO: 1406370 - protein, 6 aa, Mycobacterium tuberculosis
GFDTPS

SEQ ID NO: 1406371 - protein, 11 aa, Mycobacterium tuberculosis
GFETSRTPTYD

SEQ ID NO: 1406372 - protein, 12 aa, Mycobacterium tuberculosis
GFKGSRKSTPFA

SEQ ID NO: 1406373 - protein, 9 aa, Mycobacterium tuberculosis
GFPSGKHVS

SEQ ID NO: 1406374 - protein, 6 aa, Mycobacterium tuberculosis
GFSAQG

SEQ ID NO: 1406375 - protein, 4 aa, Mycobacterium tuberculosis
GFTS

SEQ ID NO: 1406376 - protein, 9 aa, Mycobacterium tuberculosis
GFTTPDPSY

SEQ ID NO: 1406377 - protein, 5 aa, Mycobacterium tuberculosis
GGAAA

SEQ ID NO: 1406378 - protein, 15 aa, Mycobacterium tuberculosis
GGAAAYASAEAANVQ

SEQ ID NO: 1406379 - protein, 5 aa, Mycobacterium tuberculosis
GGAAH

SEQ ID NO: 1406380 - protein, 42 aa, Mycobacterium tuberculosis; identical to SEQ ID NO: 175495

SEQ ID NO: 1406381 - protein, 9 aa, Mycobacterium tuberculosis
GGAESPQET

SEQ ID NO: 1406382 - protein, 6 aa, Mycobacterium tuberculosis
GGAGTT

SEQ ID NO: 1406383 - protein, 5 aa, Mycobacterium tuberculosis
GGAKT

SEQ ID NO: 1406384 - protein, 8 aa, Mycobacterium tuberculosis
GGAPGASS

SEQ ID NO: 1406385 - protein, 7 aa, Mycobacterium tuberculosis
GGAPKNP

SEQ ID NO: 1406386 - protein, 9 aa, Mycobacterium tuberculosis
GGAQSPKET

SEQ ID NO: 1406387 - protein, 14 aa, Mycobacterium tuberculosis
GGARRDEEKARAKE

SEQ ID NO: 1406388 - protein, 6 aa, Mycobacterium tuberculosis
GGASAE

SEQ ID NO: 1406389 - protein, 10 aa, Mycobacterium tuberculosis
GGAYAPDPAA

SEQ ID NO: 1406390 - protein, 4 aa, Mycobacterium tuberculosis
GGCA

SEQ ID NO: 1406391 - protein, 16 aa, Mycobacterium tuberculosis
GGDDPEYTAATRGAAA

SEQ ID NO: 1406392 - protein, 6 aa, Mycobacterium tuberculosis
GGDETE

SEQ ID NO: 1406393 - protein, 4 aa, Mycobacterium tuberculosis
GGDG

SEQ ID NO: 1406394 - protein, 10 aa, Mycobacterium tuberculosis
GGDHNPIHTN

SEQ ID NO: 1406395 - protein, 5 aa, Mycobacterium tuberculosis
GGDLD

SEQ ID NO: 1406396 - protein, 6 aa, Mycobacterium tuberculosis
GGDSLS

SEQ ID NO: 1406397 - protein, 7 aa, Mycobacterium tuberculosis
GGDTAKD

SEQ ID NO: 1406398 - protein, 6 aa, Mycobacterium tuberculosis
GGEAGQ

SEQ ID NO: 1406399 - protein, 6 aa, Mycobacterium tuberculosis
GGECPL

SEQ ID NO: 1406400 - protein, 11 aa, Mycobacterium tuberculosis
GGEGGGHTGPV

SEQ ID NO: 1406401 - protein, 10 aa, Mycobacterium tuberculosis
GGELPSEPDI

SEQ ID NO: 1406402 - protein, 6 aa, Mycobacterium tuberculosis
GGERGE

SEQ ID NO: 1406403 - protein, 9 aa, Mycobacterium tuberculosis
GGESGPNFR

SEQ ID NO: 1406404 - protein, 8 aa, Mycobacterium tuberculosis
GGGAPTLA

SEQ ID NO: 1406405 - protein, 7 aa, Mycobacterium tuberculosis
GGGEKKT

SEQ ID NO: 1406406 - protein, 6 aa, Mycobacterium tuberculosis
GGGETV

SEQ ID NO: 1406407 - protein, 21 aa, Mycobacterium tuberculosis
GGGGRPGPVGPEAVDTPRIRG

SEQ ID NO: 1406408 - protein, 5 aa, Mycobacterium tuberculosis
GGGGS

SEQ ID NO: 1406409 - protein, 5 aa, Mycobacterium tuberculosis
GGGLR

SEQ ID NO: 1406410 - protein, 7 aa, Mycobacterium tuberculosis
GGGPDTA

SEQ ID NO: 1406411 - protein, 8 aa, Mycobacterium tuberculosis
GGGPGDPE

SEQ ID NO: 1406412 - protein, 15 aa, Mycobacterium tuberculosis
GGGSGMARPGAVSRA

SEQ ID NO: 1406413 - protein, 4 aa, Mycobacterium tuberculosis
GGGV

SEQ ID NO: 1406414 - protein, 12 aa, Mycobacterium tuberculosis
GGGYPTGEELYI

SEQ ID NO: 1406415 - protein, 11 aa, Mycobacterium tuberculosis
GGHAGAADNAQ

SEQ ID NO: 1406416 - protein, 5 aa, Mycobacterium tuberculosis
GGHAP

SEQ ID NO: 1406417 - protein, 14 aa, Mycobacterium tuberculosis
GGIETGQALTSNPD

SEQ ID NO: 1406418 - protein, 30 aa, Mycobacterium tuberculosis; identical to SEQ ID NO: 175729

SEQ ID NO: 1406419 - protein, 18 aa, Mycobacterium tuberculosis
GGMGGAGGVGGNGGAGGQ

SEQ ID NO: 1406420 - protein, 6 aa, Mycobacterium tuberculosis
GGNAVD

SEQ ID NO: 1406421 - protein, 7 aa, Mycobacterium tuberculosis
GGNDTAR

SEQ ID NO: 1406422 - protein, 14 aa, Mycobacterium tuberculosis
GGNKAEIAPTISES

SEQ ID NO: 1406423 - protein, 7 aa, Mycobacterium tuberculosis
GGNNAGH

SEQ ID NO: 1406424 - protein, 7 aa, Mycobacterium tuberculosis
GGNPHYD

SEQ ID NO: 1406425 - protein, 8 aa, Mycobacterium tuberculosis
GGPAPRPI

SEQ ID NO: 1406426 - protein, 8 aa, Mycobacterium tuberculosis
GGPAPTAT

SEQ ID NO: 1406427 - protein, 6 aa, Mycobacterium tuberculosis
GGPAVA

SEQ ID NO: 1406428 - protein, 6 aa, Mycobacterium tuberculosis
GGPGRS

SEQ ID NO: 1406429 - protein, 9 aa, Mycobacterium tuberculosis
GGPPTPETA

SEQ ID NO: 1406430 - protein, 6 aa, Mycobacterium tuberculosis
GGPQTY

SEQ ID NO: 1406431 - protein, 13 aa, Mycobacterium tuberculosis
GGPSGSGLASPDG

SEQ ID NO: 1406432 - protein, 6 aa, Mycobacterium tuberculosis
GGPTTA

SEQ ID NO: 1406433 - protein, 15 aa, Mycobacterium tuberculosis
GGQERDIRSGTPDVA

SEQ ID NO: 1406434 - protein, 4 aa, Mycobacterium tuberculosis
GGQP

SEQ ID NO: 1406435 - protein, 5 aa, Mycobacterium tuberculosis
GGQPL

SEQ ID NO: 1406436 - protein, 14 aa, Mycobacterium tuberculosis
GGQPPTEPDEIASP

SEQ ID NO: 1406437 - protein, 6 aa, Mycobacterium tuberculosis
GGQPQH

SEQ ID NO: 1406438 - protein, 17 aa, Mycobacterium tuberculosis
GGRINTDALDNSAGVDC

SEQ ID NO: 1406439 - protein, 7 aa, Mycobacterium tuberculosis
GGRPLAD

SEQ ID NO: 1406440 - protein, 6 aa, Mycobacterium tuberculosis
GGRPPL

SEQ ID NO: 1406441 - protein, 7 aa, Mycobacterium tuberculosis
GGRQASA

SEQ ID NO: 1406442 - protein, 5 aa, Mycobacterium tuberculosis
GGRRR

SEQ ID NO: 1406443 - protein, 7 aa, Mycobacterium tuberculosis
GGSAGRR

SEQ ID NO: 1406444 - protein, 4 aa, Mycobacterium tuberculosis
GGSD

SEQ ID NO: 1406445 - protein, 15 aa, Mycobacterium tuberculosis
GGSLEVSSGVDEEPE

SEQ ID NO: 1406446 - protein, 4 aa, Mycobacterium tuberculosis
GGTD

SEQ ID NO: 1406447 - protein, 7 aa, Mycobacterium tuberculosis
GGTDQDF

SEQ ID NO: 1406448 - protein, 4 aa, Mycobacterium tuberculosis
GGTE

SEQ ID NO: 1406449 - protein, 8 aa, Mycobacterium tuberculosis
GGTESDNL

SEQ ID NO: 1406450 - protein, 58 aa, Mycobacterium tuberculosis; identical to SEQ ID NO: 175912

SEQ ID NO: 1406451 - protein, 5 aa, Mycobacterium tuberculosis
GGTPS

SEQ ID NO: 1406452 - protein, 15 aa, Mycobacterium tuberculosis
GGTSNTHPDHDEDER

SEQ ID NO: 1406453 - protein, 9 aa, Mycobacterium tuberculosis
GGTSSGAIA

SEQ ID NO: 1406454 - protein, 5 aa, Mycobacterium tuberculosis
GGTTE

SEQ ID NO: 1406455 - protein, 6 aa, Mycobacterium tuberculosis
GGTTGM

SEQ ID NO: 1406456 - protein, 8 aa, Mycobacterium tuberculosis
GGVDSPEG

SEQ ID NO: 1406457 - protein, 7 aa, Mycobacterium tuberculosis
GGVNNPE

SEQ ID NO: 1406458 - protein, 7 aa, Mycobacterium tuberculosis
GGVSAGA

SEQ ID NO: 1406459 - protein, 5 aa, Mycobacterium tuberculosis
GGVTK

SEQ ID NO: 1406460 - protein, 6 aa, Mycobacterium tuberculosis
GGYGNS

SEQ ID NO: 1406461 - protein, 12 aa, Mycobacterium tuberculosis
GGYKQSGIGREG

SEQ ID NO: 1406462 - protein, 10 aa, Mycobacterium tuberculosis
GHASATGRFD

SEQ ID NO: 1406463 - protein, 4 aa, Mycobacterium tuberculosis
GHDH

SEQ ID NO: 1406464 - protein, 4 aa, Mycobacterium tuberculosis
GHEP

SEQ ID NO: 1406465 - protein, 6 aa, Mycobacterium tuberculosis
GHGDRG

SEQ ID NO: 1406466 - protein, 5 aa, Mycobacterium tuberculosis
GHGRS

SEQ ID NO: 1406467 - protein, 7 aa, Mycobacterium tuberculosis
GHPLGAT

SEQ ID NO: 1406468 - protein, 5 aa, Mycobacterium tuberculosis
GHPPP

SEQ ID NO: 1406469 - protein, 5 aa, Mycobacterium tuberculosis
GHPPY

SEQ ID NO: 1406470 - protein, 11 aa, Mycobacterium tuberculosis
GHPTPQPAALG

SEQ ID NO: 1406471 - protein, 7 aa, Mycobacterium tuberculosis
GHPVPGG

SEQ ID NO: 1406472 - protein, 4 aa, Mycobacterium tuberculosis
GHSS

SEQ ID NO: 1406473 - protein, 5 aa, Mycobacterium tuberculosis
GHTHA

SEQ ID NO: 1406474 - protein, 27 aa, Mycobacterium tuberculosis
GHTNTGSFNAGSMNTGDFNSGNVNTGY

SEQ ID NO: 1406475 - protein, 25 aa, Mycobacterium tuberculosis
GHYSGAAALGNAQGYKYSHDDPDGV

SEQ ID NO: 1406476 - protein, 4 aa, Mycobacterium tuberculosis
GIKE

SEQ ID NO: 1406477 - protein, 5 aa, Mycobacterium tuberculosis
GINPA

SEQ ID NO: 1406478 - protein, 6 aa, Mycobacterium tuberculosis
GIPEAQ

SEQ ID NO: 1406479 - protein, 6 aa, Mycobacterium tuberculosis
GIQAPA

SEQ ID NO: 1406480 - protein, 4 aa, Mycobacterium tuberculosis
GITP

SEQ ID NO: 1406481 - protein, 5 aa, Mycobacterium tuberculosis
GITRD

SEQ ID NO: 1406482 - protein, 8 aa, Mycobacterium tuberculosis
GITTSASK

SEQ ID NO: 1406483 - protein, 8 aa, Mycobacterium tuberculosis
GKAAPDDV

SEQ ID NO: 1406484 - protein, 15 aa, Mycobacterium tuberculosis
GKAQGGMASSRSQLG

SEQ ID NO: 1406485 - protein, 6 aa, Mycobacterium tuberculosis
GKASQQ

SEQ ID NO: 1406486 - protein, 13 aa, Mycobacterium tuberculosis
GKCGSCSAEINGK

SEQ ID NO: 1406487 - protein, 8 aa, Mycobacterium tuberculosis
GKGAPEGA

SEQ ID NO: 1406488 - protein, 7 aa, Mycobacterium tuberculosis
GKGGVGV

SEQ ID NO: 1406489 - protein, 8 aa, Mycobacterium tuberculosis
GKIRSRGV

SEQ ID NO: 1406490 - protein, 19 aa, Mycobacterium tuberculosis
GKLDSITAEPVGRALRGRR

SEQ ID NO: 1406491 - protein, 6 aa, Mycobacterium tuberculosis
GKNIHE

SEQ ID NO: 1406492 - protein, 6 aa, Mycobacterium tuberculosis
GKPDGV

SEQ ID NO: 1406493 - protein, 7 aa, Mycobacterium tuberculosis
GKPISPA

SEQ ID NO: 1406494 - protein, 6 aa, Mycobacterium tuberculosis
GKPLTD

SEQ ID NO: 1406495 - protein, 20 aa, Mycobacterium tuberculosis
GKPSRYRSEPQRQHLAAAPA

SEQ ID NO: 1406496 - protein, 5 aa, Mycobacterium tuberculosis
GKPYP

SEQ ID NO: 1406497 - protein, 4 aa, Mycobacterium tuberculosis
GKQY

SEQ ID NO: 1406498 - protein, 21 aa, Mycobacterium tuberculosis
GKRKAGHAPVQPADEHVRPED

SEQ ID NO: 1406499 - protein, 7 aa, Mycobacterium tuberculosis
GKRPQAY

SEQ ID NO: 1406500 - protein, 12 aa, Mycobacterium tuberculosis
GKRSRRGQPDDQ

SEQ ID NO: 1406501 - protein, 4 aa, Mycobacterium tuberculosis
GKSP

SEQ ID NO: 1406502 - protein, 7 aa, Mycobacterium tuberculosis
GKSTHAE

SEQ ID NO: 1406503 - protein, 6 aa, Mycobacterium tuberculosis
GKTPPC

SEQ ID NO: 1406504 - protein, 6 aa, Mycobacterium tuberculosis
GKTQAK

SEQ ID NO: 1406505 - protein, 9 aa, Mycobacterium tuberculosis
GLARPQGDR

SEQ ID NO: 1406506 - protein, 4 aa, Mycobacterium tuberculosis
GLAT

SEQ ID NO: 1406507 - protein, 7 aa, Mycobacterium tuberculosis
GLDANTQ

SEQ ID NO: 1406508 - protein, 5 aa, Mycobacterium tuberculosis
GLDEN

SEQ ID NO: 1406509 - protein, 5 aa, Mycobacterium tuberculosis
GLDGI

SEQ ID NO: 1406510 - protein, 9 aa, Mycobacterium tuberculosis
GLESSNLSQ

SEQ ID NO: 1406511 - protein, 6 aa, Mycobacterium tuberculosis
GLGASP

SEQ ID NO: 1406512 - protein, 12 aa, Mycobacterium tuberculosis
GLGDPELMRQAW

SEQ ID NO: 1406513 - protein, 5 aa, Mycobacterium tuberculosis
GLGGA

SEQ ID NO: 1406514 - protein, 5 aa, Mycobacterium tuberculosis
GLGSP

SEQ ID NO: 1406515 - protein, 7 aa, Mycobacterium tuberculosis
GLGTAED

SEQ ID NO: 1406516 - protein, 4 aa, Mycobacterium tuberculosis
GLHR

SEQ ID NO: 1406517 - protein, 8 aa, Mycobacterium tuberculosis
GLHTDPRV

SEQ ID NO: 1406518 - protein, 9 aa, Mycobacterium tuberculosis
GLKPYSRDT

SEQ ID NO: 1406519 - protein, 5 aa, Mycobacterium tuberculosis
GLNQP

SEQ ID NO: 1406520 - protein, 9 aa, Mycobacterium tuberculosis
GLPADGGDA

SEQ ID NO: 1406521 - protein, 7 aa, Mycobacterium tuberculosis
GLPGGLP

SEQ ID NO: 1406522 - protein, 8 aa, Mycobacterium tuberculosis
GLPSSPWH

SEQ ID NO: 1406523 - protein, 5 aa, Mycobacterium tuberculosis
GLQRQ

SEQ ID NO: 1406524 - protein, 15 aa, Mycobacterium tuberculosis
GLRPGSIADANDAAQ

SEQ ID NO: 1406525 - protein, 5 aa, Mycobacterium tuberculosis
GLRTA

SEQ ID NO: 1406526 - protein, 13 aa, Mycobacterium tuberculosis
GLSGARARRRGLS

SEQ ID NO: 1406527 - protein, 5 aa, Mycobacterium tuberculosis
GLTPQ

SEQ ID NO: 1406528 - protein, 8 aa, Mycobacterium tuberculosis
GMADQSRT

SEQ ID NO: 1406529 - protein, 5 aa, Mycobacterium tuberculosis
GNATQ

SEQ ID NO: 1406530 - protein, 4 aa, Mycobacterium tuberculosis
GNCL

SEQ ID NO: 1406531 - protein, 6 aa, Mycobacterium tuberculosis
GNFPPT

SEQ ID NO: 1406532 - protein, 4 aa, Mycobacterium tuberculosis
GNGL

SEQ ID NO: 1406533 - protein, 11 aa, Mycobacterium tuberculosis
GNISESAYTGD

SEQ ID NO: 1406534 - protein, 18 aa, Mycobacterium tuberculosis
GNLGGVDATDDPWHGRPA

SEQ ID NO: 1406535 - protein, 4 aa, Mycobacterium tuberculosis
GNLQ

SEQ ID NO: 1406536 - protein, 8 aa, Mycobacterium tuberculosis
GNNDVSRY

SEQ ID NO: 1406537 - protein, 6 aa, Mycobacterium tuberculosis
GNNQNA

SEQ ID NO: 1406538 - protein, 5 aa, Mycobacterium tuberculosis
GNNSS

SEQ ID NO: 1406539 - protein, 10 aa, Mycobacterium tuberculosis
GNPANTDSHY

SEQ ID NO: 1406540 - protein, 7 aa, Mycobacterium tuberculosis
GNPTTDV

SEQ ID NO: 1406541 - protein, 6 aa, Mycobacterium tuberculosis
GNQGPI

SEQ ID NO: 1406542 - protein, 9 aa, Mycobacterium tuberculosis
GNSYDGTSA

SEQ ID NO: 1406543 - protein, 10 aa, Mycobacterium tuberculosis
GNTGMDDPKG

SEQ ID NO: 1406544 - protein, 7 aa, Mycobacterium tuberculosis
GNTYRSP

SEQ ID NO: 1406545 - protein, 5 aa, Mycobacterium tuberculosis
GNTYY

SEQ ID NO: 1406546 - protein, 4 aa, Mycobacterium tuberculosis
GNVG

SEQ ID NO: 1406547 - protein, 8 aa, Mycobacterium tuberculosis
GPAAYRNQ

SEQ ID NO: 1406548 - protein, 8 aa, Mycobacterium tuberculosis
GPAGVGKA

SEQ ID NO: 1406549 - protein, 8 aa, Mycobacterium tuberculosis
GPAKGQRR

SEQ ID NO: 1406550 - protein, 5 aa, Mycobacterium tuberculosis
GPDDV

SEQ ID NO: 1406551 - protein, 10 aa, Mycobacterium tuberculosis
GPDGRGASAA

SEQ ID NO: 1406552 - protein, 5 aa, Mycobacterium tuberculosis
GPDHS

SEQ ID NO: 1406553 - protein, 20 aa, Mycobacterium tuberculosis
GPEHPHSAQQPVPYELKQVA

SEQ ID NO: 1406554 - protein, 4 aa, Mycobacterium tuberculosis
GPEI

SEQ ID NO: 1406555 - protein, 6 aa, Mycobacterium tuberculosis
GPELGP

SEQ ID NO: 1406556 - protein, 6 aa, Mycobacterium tuberculosis
GPERGL

SEQ ID NO: 1406557 - protein, 9 aa, Mycobacterium tuberculosis
GPESSGKTT

SEQ ID NO: 1406558 - protein, 11 aa, Mycobacterium tuberculosis
GPESTGKTTLA

SEQ ID NO: 1406559 - protein, 9 aa, Mycobacterium tuberculosis
GPFPPDDAP

SEQ ID NO: 1406560 - protein, 8 aa, Mycobacterium tuberculosis
GPGALPSD

SEQ ID NO: 1406561 - protein, 7 aa, Mycobacterium tuberculosis
GPGGKTA

SEQ ID NO: 1406562 - protein, 8 aa, Mycobacterium tuberculosis
GPGKADAV

SEQ ID NO: 1406563 - protein, 9 aa, Mycobacterium tuberculosis
GPGKGNAMG

SEQ ID NO: 1406564 - protein, 19 aa, Mycobacterium tuberculosis
GPGPRSPESVDGWERVLTT

SEQ ID NO: 1406565 - protein, 17 aa, Mycobacterium tuberculosis
GPGREQTIVRRDVLQDR

SEQ ID NO: 1406566 - protein, 6 aa, Mycobacterium tuberculosis
GPGVTE

SEQ ID NO: 1406567 - protein, 5 aa, Mycobacterium tuberculosis
GPIAG

SEQ ID NO: 1406568 - protein, 4 aa, Mycobacterium tuberculosis
GPIP

SEQ ID NO: 1406569 - protein, 6 aa, Mycobacterium tuberculosis
GPKDQI

SEQ ID NO: 1406570 - protein, 17 aa, Mycobacterium tuberculosis
GPKNSGRTPELTHLQGI

SEQ ID NO: 1406571 - protein, 7 aa, Mycobacterium tuberculosis
GPLSEDD

SEQ ID NO: 1406572 - protein, 4 aa, Mycobacterium tuberculosis
GPND

SEQ ID NO: 1406573 - protein, 10 aa, Mycobacterium tuberculosis
GPNGAGKSTT

SEQ ID NO: 1406574 - protein, 8 aa, Mycobacterium tuberculosis
GPPGSGRS

SEQ ID NO: 1406575 - protein, 7 aa, Mycobacterium tuberculosis
GPPGVGK

SEQ ID NO: 1406576 - protein, 6 aa, Mycobacterium tuberculosis
GPQAED

SEQ ID NO: 1406577 - protein, 5 aa, Mycobacterium tuberculosis
GPQGT

SEQ ID NO: 1406578 - protein, 5 aa, Mycobacterium tuberculosis
GPRAF

SEQ ID NO: 1406579 - protein, 5 aa, Mycobacterium tuberculosis
GPRHE

SEQ ID NO: 1406580 - protein, 17 aa, Mycobacterium tuberculosis
GPRHTRGTPPNVVQTDP

SEQ ID NO: 1406581 - protein, 9 aa, Mycobacterium tuberculosis
GPRQAGKTT

SEQ ID NO: 1406582 - protein, 27 aa, Mycobacterium tuberculosis
GPRWPDVSGNSQATGTRAVTTGAPRPA

SEQ ID NO: 1406583 - protein, 4 aa, Mycobacterium tuberculosis
GPSG

SEQ ID NO: 1406584 - protein, 5 aa, Mycobacterium tuberculosis
GPSGG

SEQ ID NO: 1406585 - protein, 8 aa, Mycobacterium tuberculosis
GPSGTGKS

SEQ ID NO: 1406586 - protein, 8 aa, Mycobacterium tuberculosis
GPSRERSI

SEQ ID NO: 1406587 - protein, 6 aa, Mycobacterium tuberculosis
GPTAAR

SEQ ID NO: 1406588 - protein, 8 aa, Mycobacterium tuberculosis
GPTDIAGA

SEQ ID NO: 1406589 - protein, 4 aa, Mycobacterium tuberculosis
GPTG

SEQ ID NO: 1406590 - protein, 9 aa, Mycobacterium tuberculosis
GPTGRAAAL

SEQ ID NO: 1406591 - protein, 11 aa, Mycobacterium tuberculosis
GPTKDAQGTRR

SEQ ID NO: 1406592 - protein, 6 aa, Mycobacterium tuberculosis
GPVTGG

SEQ ID NO: 1406593 - protein, 5 aa, Mycobacterium tuberculosis
GQAAE

SEQ ID NO: 1406594 - protein, 11 aa, Mycobacterium tuberculosis
GQAAKLAPTSI

SEQ ID NO: 1406595 - protein, 10 aa, Mycobacterium tuberculosis
GQAHGGGPRV

SEQ ID NO: 1406596 - protein, 6 aa, Mycobacterium tuberculosis
GQAQLT

SEQ ID NO: 1406597 - protein, 10 aa, Mycobacterium tuberculosis
GQEARAAEEE

SEQ ID NO: 1406598 - protein, 8 aa, Mycobacterium tuberculosis
GQGGLTRN

SEQ ID NO: 1406599 - protein, 5 aa, Mycobacterium tuberculosis
GQHNG

SEQ ID NO: 1406600 - protein, 10 aa, Mycobacterium tuberculosis
GQIGDGREAA

SEQ ID NO: 1406601 - protein, 10 aa, Mycobacterium tuberculosis
GQLAGDDFGS

SEQ ID NO: 1406602 - protein, 8 aa, Mycobacterium tuberculosis
GQLDPEYQ

SEQ ID NO: 1406603 - protein, 10 aa, Mycobacterium tuberculosis
GQLGGAENAT

SEQ ID NO: 1406604 - protein, 6 aa, Mycobacterium tuberculosis
GQLPAQ

SEQ ID NO: 1406605 - protein, 9 aa, Mycobacterium tuberculosis
GQPAGSAEL

SEQ ID NO: 1406606 - protein, 5 aa, Mycobacterium tuberculosis
GQPIS

SEQ ID NO: 1406607 - protein, 9 aa, Mycobacterium tuberculosis
GQPVADTSL

SEQ ID NO: 1406608 - protein, 9 aa, Mycobacterium tuberculosis
GQQPRADSL

SEQ ID NO: 1406609 - protein, 6 aa, Mycobacterium tuberculosis
GQQTYE

SEQ ID NO: 1406610 - protein, 17 aa, Mycobacterium tuberculosis
GQRAVSAAAAAAPGGAY

SEQ ID NO: 1406611 - protein, 6 aa, Mycobacterium tuberculosis
GQRERI

SEQ ID NO: 1406612 - protein, 7 aa, Mycobacterium tuberculosis
GQRKPLA

SEQ ID NO: 1406613 - protein, 8 aa, Mycobacterium tuberculosis
GQRPGQAA

SEQ ID NO: 1406614 - protein, 4 aa, Mycobacterium tuberculosis
GQSQ

SEQ ID NO: 1406615 - protein, 7 aa, Mycobacterium tuberculosis
GQTPGNA

SEQ ID NO: 1406616 - protein, 18 aa, Mycobacterium tuberculosis
GQTPRSQPPELGAPWGTS

SEQ ID NO: 1406617 - protein, 7 aa, Mycobacterium tuberculosis
GQTTMTV

SEQ ID NO: 1406618 - protein, 8 aa, Mycobacterium tuberculosis
GRALDDPH

SEQ ID NO: 1406619 - protein, 11 aa, Mycobacterium tuberculosis
GRDEATETARR

SEQ ID NO: 1406620 - protein, 4 aa, Mycobacterium tuberculosis
GREA

SEQ ID NO: 1406621 - protein, 6 aa, Mycobacterium tuberculosis
GREAAA

SEQ ID NO: 1406622 - protein, 9 aa, Mycobacterium tuberculosis
GREDESAVG

SEQ ID NO: 1406623 - protein, 10 aa, Mycobacterium tuberculosis
GREGGSAPTA

SEQ ID NO: 1406624 - protein, 9 aa, Mycobacterium tuberculosis
GREPTPEEL

SEQ ID NO: 1406625 - protein, 5 aa, Mycobacterium tuberculosis
GRGGL

SEQ ID NO: 1406626 - protein, 5 aa, Mycobacterium tuberculosis
GRGPL

SEQ ID NO: 1406627 - protein, 15 aa, Mycobacterium tuberculosis
GRIQQAEHKPEGTRI

SEQ ID NO: 1406628 - protein, 10 aa, Mycobacterium tuberculosis
GRLEGKSSLG

SEQ ID NO: 1406629 - protein, 8 aa, Mycobacterium tuberculosis
GRNLNDAV

SEQ ID NO: 1406630 - protein, 13 aa, Mycobacterium tuberculosis
GRPATRKRWPNGV

SEQ ID NO: 1406631 - protein, 5 aa, Mycobacterium tuberculosis
GRPEE

SEQ ID NO: 1406632 - protein, 10 aa, Mycobacterium tuberculosis
GRPGTTPVRP

SEQ ID NO: 1406633 - protein, 7 aa, Mycobacterium tuberculosis
GRPLTGV

SEQ ID NO: 1406634 - protein, 7 aa, Mycobacterium tuberculosis
GRPTSAW

SEQ ID NO: 1406635 - protein, 4 aa, Mycobacterium tuberculosis
GRQG

SEQ ID NO: 1406636 - protein, 5 aa, Mycobacterium tuberculosis
GRQRV

SEQ ID NO: 1406637 - protein, 6 aa, Mycobacterium tuberculosis
GRREPL

SEQ ID NO: 1406638 - protein, 8 aa, Mycobacterium tuberculosis
GRRGMKAA

SEQ ID NO: 1406639 - protein, 5 aa, Mycobacterium tuberculosis
GRRPG

SEQ ID NO: 1406640 - protein, 13 aa, Mycobacterium tuberculosis
GRRSNWPKGSGVN

SEQ ID NO: 1406641 - protein, 12 aa, Mycobacterium tuberculosis
GRRWASAEARRH

SEQ ID NO: 1406642 - protein, 7 aa, Mycobacterium tuberculosis
GRSATEV

SEQ ID NO: 1406643 - protein, 9 aa, Mycobacterium tuberculosis
GRSDPTDEQ

SEQ ID NO: 1406644 - protein, 12 aa, Mycobacterium tuberculosis
GRSGAADRRSHT

SEQ ID NO: 1406645 - protein, 17 aa, Mycobacterium tuberculosis
GRSGVDLDEKGREQATG

SEQ ID NO: 1406646 - protein, 5 aa, Mycobacterium tuberculosis
GRSQD

SEQ ID NO: 1406647 - protein, 6 aa, Mycobacterium tuberculosis
GRSTGA

SEQ ID NO: 1406648 - protein, 7 aa, Mycobacterium tuberculosis
GRSTRGA

SEQ ID NO: 1406649 - protein, 11 aa, Mycobacterium tuberculosis
GRTDEEEKNRL

SEQ ID NO: 1406650 - protein, 12 aa, Mycobacterium tuberculosis
GRTEGLSDVERA

SEQ ID NO: 1406651 - protein, 12 aa, Mycobacterium tuberculosis
GRTGSRPRLTDD

SEQ ID NO: 1406652 - protein, 7 aa, Mycobacterium tuberculosis
GSAASPF

SEQ ID NO: 1406653 - protein, 12 aa, Mycobacterium tuberculosis
GSAATGGAGRSR

SEQ ID NO: 1406654 - protein, 9 aa, Mycobacterium tuberculosis
GSADGAAGD

SEQ ID NO: 1406655 - protein, 11 aa, Mycobacterium tuberculosis
GSAELAESSVQ

SEQ ID NO: 1406656 - protein, 4 aa, Mycobacterium tuberculosis
GSAS

SEQ ID NO: 1406657 - protein, 7 aa, Mycobacterium tuberculosis
GSDEQKR

SEQ ID NO: 1406658 - protein, 7 aa, Mycobacterium tuberculosis
GSDGHPL

SEQ ID NO: 1406659 - protein, 8 aa, Mycobacterium tuberculosis
GSEEEAPL

SEQ ID NO: 1406660 - protein, 8 aa, Mycobacterium tuberculosis
GSEKSPGF

SEQ ID NO: 1406661 - protein, 16 aa, Mycobacterium tuberculosis
GSELASPGTPLQPGQI

SEQ ID NO: 1406662 - protein, 12 aa, Mycobacterium tuberculosis
GSGARPGTSPKV

SEQ ID NO: 1406663 - protein, 9 aa, Mycobacterium tuberculosis
GSGDNGGDA

SEQ ID NO: 1406664 - protein, 5 aa, Mycobacterium tuberculosis
GSGHS

SEQ ID NO: 1406665 - protein, 9 aa, Mycobacterium tuberculosis
GSGKSTIGR

SEQ ID NO: 1406666 - protein, 7 aa, Mycobacterium tuberculosis
GSGNAGA

SEQ ID NO: 1406667 - protein, 28 aa, Mycobacterium tuberculosis
GSGNFGVGNSGVTNTGVANSGNINTGFG

SEQ ID NO: 1406668 - protein, 4 aa, Mycobacterium tuberculosis
GSGP

SEQ ID NO: 1406669 - protein, 4 aa, Mycobacterium tuberculosis
GSGT

SEQ ID NO: 1406670 - protein, 11 aa, Mycobacterium tuberculosis
GSHPSKNPLRT

SEQ ID NO: 1406671 - protein, 7 aa, Mycobacterium tuberculosis
GSIRSQQ

SEQ ID NO: 1406672 - protein, 6 aa, Mycobacterium tuberculosis
GSKPSP

SEQ ID NO: 1406673 - protein, 7 aa, Mycobacterium tuberculosis
GSKSAAV

SEQ ID NO: 1406674 - protein, 15 aa, Mycobacterium tuberculosis
GSKSRGGQQIRAQGV

SEQ ID NO: 1406675 - protein, 8 aa, Mycobacterium tuberculosis
GSLDQEPE

SEQ ID NO: 1406676 - protein, 7 aa, Mycobacterium tuberculosis
GSLPPGV

SEQ ID NO: 1406677 - protein, 5 aa, Mycobacterium tuberculosis
GSNHV

SEQ ID NO: 1406678 - protein, 9 aa, Mycobacterium tuberculosis
GSPASEAAT

SEQ ID NO: 1406679 - protein, 6 aa, Mycobacterium tuberculosis
GSPDRV

SEQ ID NO: 1406680 - protein, 4 aa, Mycobacterium tuberculosis
GSPE

SEQ ID NO: 1406681 - protein, 7 aa, Mycobacterium tuberculosis
GSPEDPG

SEQ ID NO: 1406682 - protein, 5 aa, Mycobacterium tuberculosis
GSPIT

SEQ ID NO: 1406683 - protein, 9 aa, Mycobacterium tuberculosis
GSQASNDQL

SEQ ID NO: 1406684 - protein, 6 aa, Mycobacterium tuberculosis
GSRARP

SEQ ID NO: 1406685 - protein, 6 aa, Mycobacterium tuberculosis
GSREGQ

SEQ ID NO: 1406686 - protein, 10 aa, Mycobacterium tuberculosis
GSRGPRESKY

SEQ ID NO: 1406687 - protein, 8 aa, Mycobacterium tuberculosis
GSRKQLAA

SEQ ID NO: 1406688 - protein, 27 aa, Mycobacterium tuberculosis
GSSAERSSGFGNSGELSTGIGNSGQLS

SEQ ID NO: 1406689 - protein, 6 aa, Mycobacterium tuberculosis
GSSEKA

SEQ ID NO: 1406690 - protein, 7 aa, Mycobacterium tuberculosis
GSSGGKN

SEQ ID NO: 1406691 - protein, 8 aa, Mycobacterium tuberculosis
GSSGKGGE

SEQ ID NO: 1406692 - protein, 5 aa, Mycobacterium tuberculosis
GSSKH

SEQ ID NO: 1406693 - protein, 7 aa, Mycobacterium tuberculosis
GSSSRPM

SEQ ID NO: 1406694 - protein, 15 aa, Mycobacterium tuberculosis
GSSTENSAYGPTRNP

SEQ ID NO: 1406695 - protein, 10 aa, Mycobacterium tuberculosis
GSTAADVRPD

SEQ ID NO: 1406696 - protein, 7 aa, Mycobacterium tuberculosis
GSTGDGI

SEQ ID NO: 1406697 - protein, 11 aa, Mycobacterium tuberculosis
GSTLQAGQSDH

SEQ ID NO: 1406698 - protein, 8 aa, Mycobacterium tuberculosis
GSTPGKVP

SEQ ID NO: 1406699 - protein, 7 aa, Mycobacterium tuberculosis
GSTTENH

SEQ ID NO: 1406700 - protein, 13 aa, Mycobacterium tuberculosis
GSVDGGAAEMAPP

SEQ ID NO: 1406701 - protein, 28 aa, Mycobacterium tuberculosis
GSVGQRSAASGLASGKLGEQPADPATFT

SEQ ID NO: 1406702 - protein, 10 aa, Mycobacterium tuberculosis
GTAENQAPVD

SEQ ID NO: 1406703 - protein, 6 aa, Mycobacterium tuberculosis
GTAESR

SEQ ID NO: 1406704 - protein, 9 aa, Mycobacterium tuberculosis
GTAGEAPDH

SEQ ID NO: 1406705 - protein, 8 aa, Mycobacterium tuberculosis
GTAHGRRR

SEQ ID NO: 1406706 - protein, 11 aa, Mycobacterium tuberculosis
GTANELKHRAG

SEQ ID NO: 1406707 - protein, 6 aa, Mycobacterium tuberculosis
GTATDL

SEQ ID NO: 1406708 - protein, 6 aa, Mycobacterium tuberculosis
GTAVGT

SEQ ID NO: 1406709 - protein, 7 aa, Mycobacterium tuberculosis
GTDARTA

SEQ ID NO: 1406710 - protein, 7 aa, Mycobacterium tuberculosis
GTDEQRK

SEQ ID NO: 1406711 - protein, 9 aa, Mycobacterium tuberculosis
GTDQGEAAT

SEQ ID NO: 1406712 - protein, 4 aa, Mycobacterium tuberculosis
GTEI

SEQ ID NO: 1406713 - protein, 7 aa, Mycobacterium tuberculosis
GTEIRVP

SEQ ID NO: 1406714 - protein, 7 aa, Mycobacterium tuberculosis
GTEPPSE

SEQ ID NO: 1406715 - protein, 8 aa, Mycobacterium tuberculosis
GTGGHSAG

SEQ ID NO: 1406716 - protein, 8 aa, Mycobacterium tuberculosis
GTGGSTAK

SEQ ID NO: 1406717 - protein, 6 aa, Mycobacterium tuberculosis
GTGPFT

SEQ ID NO: 1406718 - protein, 6 aa, Mycobacterium tuberculosis
GTGSNT

SEQ ID NO: 1406719 - protein, 6 aa, Mycobacterium tuberculosis
GTGVGT

SEQ ID NO: 1406720 - protein, 4 aa, Mycobacterium tuberculosis
GTHG

SEQ ID NO: 1406721 - protein, 20 aa, Mycobacterium tuberculosis
GTIPKTPSGKLRRANSVTLV

SEQ ID NO: 1406722 - protein, 5 aa, Mycobacterium tuberculosis
GTITR

SEQ ID NO: 1406723 - protein, 4 aa, Mycobacterium tuberculosis
GTKA

SEQ ID NO: 1406724 - protein, 8 aa, Mycobacterium tuberculosis
GTLPPGRL

SEQ ID NO: 1406725 - protein, 8 aa, Mycobacterium tuberculosis
GTLSGNPV

SEQ ID NO: 1406726 - protein, 10 aa, Mycobacterium tuberculosis
GTNGKTTTTS

SEQ ID NO: 1406727 - protein, 12 aa, Mycobacterium tuberculosis
GTNTDPYQRAEG

SEQ ID NO: 1406728 - protein, 5 aa, Mycobacterium tuberculosis
GTNTS

SEQ ID NO: 1406729 - protein, 7 aa, Mycobacterium tuberculosis
GTPAFGS

SEQ ID NO: 1406730 - protein, 5 aa, Mycobacterium tuberculosis
GTPDD

SEQ ID NO: 1406731 - protein, 7 aa, Mycobacterium tuberculosis
GTPRGPN

SEQ ID NO: 1406732 - protein, 4 aa, Mycobacterium tuberculosis
GTPV

SEQ ID NO: 1406733 - protein, 12 aa, Mycobacterium tuberculosis
GTPVPSGTPKQR

SEQ ID NO: 1406734 - protein, 15 aa, Mycobacterium tuberculosis
GTQSLSDAQRATDAL

SEQ ID NO: 1406735 - protein, 8 aa, Mycobacterium tuberculosis
GTQSPLAD

SEQ ID NO: 1406736 - protein, 13 aa, Mycobacterium tuberculosis
GTRGPDAKPYGAL

SEQ ID NO: 1406737 - protein, 9 aa, Mycobacterium tuberculosis
GTRNLTGAD

SEQ ID NO: 1406738 - protein, 16 aa, Mycobacterium tuberculosis
GTSFPSRLRNPDKGFP

SEQ ID NO: 1406739 - protein, 11 aa, Mycobacterium tuberculosis
GTSGMKSALNG

SEQ ID NO: 1406740 - protein, 4 aa, Mycobacterium tuberculosis
GTSI

SEQ ID NO: 1406741 - protein, 5 aa, Mycobacterium tuberculosis
GTSRY

SEQ ID NO: 1406742 - protein, 9 aa, Mycobacterium tuberculosis
GTSSPRRAA

SEQ ID NO: 1406743 - protein, 7 aa, Mycobacterium tuberculosis
GTTGEPK

SEQ ID NO: 1406744 - protein, 5 aa, Mycobacterium tuberculosis
GTTGL

SEQ ID NO: 1406745 - protein, 7 aa, Mycobacterium tuberculosis
GTTGLPK

SEQ ID NO: 1406746 - protein, 9 aa, Mycobacterium tuberculosis
GTTGTPKGV

SEQ ID NO: 1406747 - protein, 10 aa, Mycobacterium tuberculosis
GTVEYDADDR

SEQ ID NO: 1406748 - protein, 6 aa, Mycobacterium tuberculosis
GTVKSR

SEQ ID NO: 1406749 - protein, 8 aa, Mycobacterium tuberculosis
GTVTAKPS

SEQ ID NO: 1406750 - protein, 7 aa, Mycobacterium tuberculosis
GVADPDA

SEQ ID NO: 1406751 - protein, 19 aa, Mycobacterium tuberculosis
GVAGQGSSVVAGPNEVEPA

SEQ ID NO: 1406752 - protein, 5 aa, Mycobacterium tuberculosis
GVARP

SEQ ID NO: 1406753 - protein, 8 aa, Mycobacterium tuberculosis
GVDPPVDC

SEQ ID NO: 1406754 - protein, 6 aa, Mycobacterium tuberculosis
GVEEAR

SEQ ID NO: 1406755 - protein, 6 aa, Mycobacterium tuberculosis
GVEELG

SEQ ID NO: 1406756 - protein, 6 aa, Mycobacterium tuberculosis
GVETEA

SEQ ID NO: 1406757 - protein, 7 aa, Mycobacterium tuberculosis
GVGDTGG

SEQ ID NO: 1406758 - protein, 14 aa, Mycobacterium tuberculosis
GVGGQAGAAGGAGL

SEQ ID NO: 1406759 - protein, 11 aa, Mycobacterium tuberculosis
GVGGSSEHPQY

SEQ ID NO: 1406760 - protein, 6 aa, Mycobacterium tuberculosis
GVGNDQ

SEQ ID NO: 1406761 - protein, 11 aa, Mycobacterium tuberculosis
GVGNSGNANIG

SEQ ID NO: 1406762 - protein, 4 aa, Mycobacterium tuberculosis
GVGP

SEQ ID NO: 1406763 - protein, 6 aa, Mycobacterium tuberculosis
GVGRKT

SEQ ID NO: 1406764 - protein, 11 aa, Mycobacterium tuberculosis
GVPADVSDAAG

SEQ ID NO: 1406765 - protein, 8 aa, Mycobacterium tuberculosis
GVPDESYQ

SEQ ID NO: 1406766 - protein, 5 aa, Mycobacterium tuberculosis
GVPPT

SEQ ID NO: 1406767 - protein, 9 aa, Mycobacterium tuberculosis
GVPQPPLAD

SEQ ID NO: 1406768 - protein, 9 aa, Mycobacterium tuberculosis
GVPTSAPER

SEQ ID NO: 1406769 - protein, 4 aa, Mycobacterium tuberculosis
GVRP

SEQ ID NO: 1406770 - protein, 10 aa, Mycobacterium tuberculosis
GVSADRTRYD

SEQ ID NO: 1406771 - protein, 9 aa, Mycobacterium tuberculosis
GVSATPETL

SEQ ID NO: 1406772 - protein, 6 aa, Mycobacterium tuberculosis
GVTAQE

SEQ ID NO: 1406773 - protein, 8 aa, Mycobacterium tuberculosis
GVTSGASV

SEQ ID NO: 1406774 - protein, 6 aa, Mycobacterium tuberculosis
GVTSGR

SEQ ID NO: 1406775 - protein, 7 aa, Mycobacterium tuberculosis
GVTVTED

SEQ ID NO: 1406776 - protein, 5 aa, Mycobacterium tuberculosis
GVVPP

SEQ ID NO: 1406777 - protein, 6 aa, Mycobacterium tuberculosis
GVYRGD

SEQ ID NO: 1406778 - protein, 15 aa, Mycobacterium tuberculosis
GWDGRNGQDFGRGDD

SEQ ID NO: 1406779 - protein, 8 aa, Mycobacterium tuberculosis
GYAATSIS

SEQ ID NO: 1406780 - protein, 4 aa, Mycobacterium tuberculosis
GYAG

SEQ ID NO: 1406781 - protein, 8 aa, Mycobacterium tuberculosis
GYAGLSDT

SEQ ID NO: 1406782 - protein, 5 aa, Mycobacterium tuberculosis
GYENK

SEQ ID NO: 1406783 - protein, 13 aa, Mycobacterium tuberculosis
GYGGSDKPPRGYD

SEQ ID NO: 1406784 - protein, 16 aa, Mycobacterium tuberculosis
GYPDARPALEEARRRG

SEQ ID NO: 1406785 - protein, 8 aa, Mycobacterium tuberculosis
GYPDGPAA

SEQ ID NO: 1406786 - protein, 14 aa, Mycobacterium tuberculosis
GYPTDHRAAQVGTE

SEQ ID NO: 1406787 - protein, 19 aa, Mycobacterium tuberculosis
GYSGGNIPNATYRNHGTHA

SEQ ID NO: 1406788 - protein, 6 aa, Mycobacterium tuberculosis
GYSPGD

SEQ ID NO: 1406789 - protein, 5 aa, Mycobacterium tuberculosis
GYTGA

SEQ ID NO: 1406790 - protein, 6 aa, Mycobacterium tuberculosis
GYTGEH

SEQ ID NO: 1406791 - protein, 5 aa, Mycobacterium tuberculosis
GYTTD

SEQ ID NO: 1406792 - protein, 15 aa, Mycobacterium tuberculosis
HAAAPGWGKTAPAER

SEQ ID NO: 1406793 - protein, 12 aa, Mycobacterium tuberculosis
HAATAGAQAALD

SEQ ID NO: 1406794 - protein, 15 aa, Mycobacterium tuberculosis
HADPHSYQASPADAA

SEQ ID NO: 1406795 - protein, 6 aa, Mycobacterium tuberculosis
HADQLG

SEQ ID NO: 1406796 - protein, 7 aa, Mycobacterium tuberculosis
HAEADRL

SEQ ID NO: 1406797 - protein, 5 aa, Mycobacterium tuberculosis
HAGGV

SEQ ID NO: 1406798 - protein, 5 aa, Mycobacterium tuberculosis
HAGRS

SEQ ID NO: 1406799 - protein, 11 aa, Mycobacterium tuberculosis
HAPAGDQPAAI

SEQ ID NO: 1406800 - protein, 4 aa, Mycobacterium tuberculosis
HAPE

SEQ ID NO: 1406801 - protein, 11 aa, Mycobacterium tuberculosis
HAPEASEEPES

SEQ ID NO: 1406802 - protein, 14 aa, Mycobacterium tuberculosis
HAPTPTNAATARLA

SEQ ID NO: 1406803 - protein, 4 aa, Mycobacterium tuberculosis
HAQG

SEQ ID NO: 1406804 - protein, 5 aa, Mycobacterium tuberculosis
HARQA

SEQ ID NO: 1406805 - protein, 11 aa, Mycobacterium tuberculosis
HASTAGSQLEV

SEQ ID NO: 1406806 - protein, 7 aa, Mycobacterium tuberculosis
HASVPPS

SEQ ID NO: 1406807 - protein, 14 aa, Mycobacterium tuberculosis
HATGASAGAQQTTL

SEQ ID NO: 1406808 - protein, 6 aa, Mycobacterium tuberculosis
HDDQVR

SEQ ID NO: 1406809 - protein, 6 aa, Mycobacterium tuberculosis
HDGDAD

SEQ ID NO: 1406810 - protein, 8 aa, Mycobacterium tuberculosis
HDGDPPPE

SEQ ID NO: 1406811 - protein, 8 aa, Mycobacterium tuberculosis
HDGNTGHA

SEQ ID NO: 1406812 - protein, 8 aa, Mycobacterium tuberculosis
HDGRPQLS

SEQ ID NO: 1406813 - protein, 9 aa, Mycobacterium tuberculosis
HDLDQASPH

SEQ ID NO: 1406814 - protein, 7 aa, Mycobacterium tuberculosis
HDPHPSP

SEQ ID NO: 1406815 - protein, 13 aa, Mycobacterium tuberculosis
HDPRDSTSVDAEV

SEQ ID NO: 1406816 - protein, 4 aa, Mycobacterium tuberculosis
HDQR

SEQ ID NO: 1406817 - protein, 6 aa, Mycobacterium tuberculosis
HDRDID

SEQ ID NO: 1406818 - protein, 10 aa, Mycobacterium tuberculosis
HDRPLAPRGI

SEQ ID NO: 1406819 - protein, 5 aa, Mycobacterium tuberculosis
HDRPP

SEQ ID NO: 1406820 - protein, 6 aa, Mycobacterium tuberculosis
HDRSEA

SEQ ID NO: 1406821 - protein, 4 aa, Mycobacterium tuberculosis
HDSG

SEQ ID NO: 1406822 - protein, 15 aa, Mycobacterium tuberculosis
HDTSTLANDPNETEL

SEQ ID NO: 1406823 - protein, 7 aa, Mycobacterium tuberculosis
HDTTATG

SEQ ID NO: 1406824 - protein, 8 aa, Mycobacterium tuberculosis
HEEAPEEV

SEQ ID NO: 1406825 - protein, 10 aa, Mycobacterium tuberculosis
HEENKDAFAG

SEQ ID NO: 1406826 - protein, 4 aa, Mycobacterium tuberculosis
HEEY

SEQ ID NO: 1406827 - protein, 5 aa, Mycobacterium tuberculosis
HEGPM

SEQ ID NO: 1406828 - protein, 9 aa, Mycobacterium tuberculosis
HEPDRSDAA

SEQ ID NO: 1406829 - protein, 4 aa, Mycobacterium tuberculosis
HGAP

SEQ ID NO: 1406830 - protein, 7 aa, Mycobacterium tuberculosis
HGDDAGR

SEQ ID NO: 1406831 - protein, 12 aa, Mycobacterium tuberculosis
HGDRFESAAHSR

SEQ ID NO: 1406832 - protein, 6 aa, Mycobacterium tuberculosis
HGGPEA

SEQ ID NO: 1406833 - protein, 4 aa, Mycobacterium tuberculosis
HGHT

SEQ ID NO: 1406834 - protein, 4 aa, Mycobacterium tuberculosis
HGKG

SEQ ID NO: 1406835 - protein, 10 aa, Mycobacterium tuberculosis
HGKPVKQGEV

SEQ ID NO: 1406836 - protein, 5 aa, Mycobacterium tuberculosis
HGLSE

SEQ ID NO: 1406837 - protein, 10 aa, Mycobacterium tuberculosis
HGPAPRPTIP

SEQ ID NO: 1406838 - protein, 9 aa, Mycobacterium tuberculosis
HGPDALQTR

SEQ ID NO: 1406839 - protein, 12 aa, Mycobacterium tuberculosis
HGPGPSSARGAE

SEQ ID NO: 1406840 - protein, 8 aa, Mycobacterium tuberculosis
HGQPRTNS

SEQ ID NO: 1406841 - protein, 9 aa, Mycobacterium tuberculosis
HGSAAGTLT

SEQ ID NO: 1406842 - protein, 9 aa, Mycobacterium tuberculosis
HGSAKPRGF

SEQ ID NO: 1406843 - protein, 6 aa, Mycobacterium tuberculosis
HGSELQ

SEQ ID NO: 1406844 - protein, 13 aa, Mycobacterium tuberculosis
HGTATRLGDRTEL

SEQ ID NO: 1406845 - protein, 11 aa, Mycobacterium tuberculosis
HGTDPAAAVGL

SEQ ID NO: 1406846 - protein, 12 aa, Mycobacterium tuberculosis
HGTGTKIGDPIE

SEQ ID NO: 1406847 - protein, 10 aa, Mycobacterium tuberculosis
HGTGTPLGDP

SEQ ID NO: 1406848 - protein, 6 aa, Mycobacterium tuberculosis
HGTTQG

SEQ ID NO: 1406849 - protein, 15 aa, Mycobacterium tuberculosis
HGVSGRSSRKPLGLN

SEQ ID NO: 1406850 - protein, 15 aa, Mycobacterium tuberculosis
HHEADADATVAAIAS

SEQ ID NO: 1406851 - protein, 5 aa, Mycobacterium tuberculosis
HHGGK

SEQ ID NO: 1406852 - protein, 6 aa, Mycobacterium tuberculosis
HHPESE

SEQ ID NO: 1406853 - protein, 5 aa, Mycobacterium tuberculosis
HHPGT

SEQ ID NO: 1406854 - protein, 6 aa, Mycobacterium tuberculosis
HHTNAT

SEQ ID NO: 1406855 - protein, 8 aa, Mycobacterium tuberculosis
HIPKGSAA

SEQ ID NO: 1406856 - protein, 6 aa, Mycobacterium tuberculosis
HKGPDV

SEQ ID NO: 1406857 - protein, 4 aa, Mycobacterium tuberculosis
HKPA

SEQ ID NO: 1406858 - protein, 6 aa, Mycobacterium tuberculosis
HKPHGD

SEQ ID NO: 1406859 - protein, 8 aa, Mycobacterium tuberculosis
HKQAHPNI

SEQ ID NO: 1406860 - protein, 6 aa, Mycobacterium tuberculosis
HLAESA

SEQ ID NO: 1406861 - protein, 10 aa, Mycobacterium tuberculosis
HLPPGAWPPT

SEQ ID NO: 1406862 - protein, 4 aa, Mycobacterium tuberculosis
HNIP

SEQ ID NO: 1406863 - protein, 9 aa, Mycobacterium tuberculosis
HNPAGASAL

SEQ ID NO: 1406864 - protein, 7 aa, Mycobacterium tuberculosis
HNPMPDN

SEQ ID NO: 1406865 - protein, 16 aa, Mycobacterium tuberculosis
HNSGGFNSENQRSGFG

SEQ ID NO: 1406866 - protein, 8 aa, Mycobacterium tuberculosis
HPADGRGE

SEQ ID NO: 1406867 - protein, 4 aa, Mycobacterium tuberculosis
HPAT

SEQ ID NO: 1406868 - protein, 10 aa, Mycobacterium tuberculosis
HPDDAQLGPP

SEQ ID NO: 1406869 - protein, 15 aa, Mycobacterium tuberculosis
HPDNPVNRVRDGGTQ

SEQ ID NO: 1406870 - protein, 5 aa, Mycobacterium tuberculosis
HPDSA

SEQ ID NO: 1406871 - protein, 6 aa, Mycobacterium tuberculosis
HPEQST

SEQ ID NO: 1406872 - protein, 11 aa, Mycobacterium tuberculosis
HPGSVGKPIQG

SEQ ID NO: 1406873 - protein, 4 aa, Mycobacterium tuberculosis
HPGV

SEQ ID NO: 1406874 - protein, 10 aa, Mycobacterium tuberculosis
HPPGKPERVR

SEQ ID NO: 1406875 - protein, 6 aa, Mycobacterium tuberculosis
HPRQIG

SEQ ID NO: 1406876 - protein, 21 aa, Mycobacterium tuberculosis
HPRRGGRPGRGCPGRRDRDLG

SEQ ID NO: 1406877 - protein, 23 aa, Mycobacterium tuberculosis
HPSAAESVQNSAPTLGGGHSTVT

SEQ ID NO: 1406878 - protein, 5 aa, Mycobacterium tuberculosis
HPSEV

SEQ ID NO: 1406879 - protein, 5 aa, Mycobacterium tuberculosis
HPSPR

SEQ ID NO: 1406880 - protein, 4 aa, Mycobacterium tuberculosis
HPTE

SEQ ID NO: 1406881 - protein, 7 aa, Mycobacterium tuberculosis
HQDGTPD

SEQ ID NO: 1406882 - protein, 8 aa, Mycobacterium tuberculosis
HQEDPGRI

SEQ ID NO: 1406883 - protein, 9 aa, Mycobacterium tuberculosis
HQGESSAAF

SEQ ID NO: 1406884 - protein, 10 aa, Mycobacterium tuberculosis
HQRPDGSVRV

SEQ ID NO: 1406885 - protein, 12 aa, Mycobacterium tuberculosis
HQVQPQTGGVSP

SEQ ID NO: 1406886 - protein, 7 aa, Mycobacterium tuberculosis
HQVTTTQ

SEQ ID NO: 1406887 - protein, 14 aa, Mycobacterium tuberculosis
HRAQSQQWATEKGD

SEQ ID NO: 1406888 - protein, 29 aa, Mycobacterium tuberculosis
HRHTGGGTPTVPTPPTPATKYRPSVPTGS

SEQ ID NO: 1406889 - protein, 6 aa, Mycobacterium tuberculosis
HRLSDE

SEQ ID NO: 1406890 - protein, 8 aa, Mycobacterium tuberculosis
HRNERTLT

SEQ ID NO: 1406891 - protein, 12 aa, Mycobacterium tuberculosis
HRNPASTATAHA

SEQ ID NO: 1406892 - protein, 5 aa, Mycobacterium tuberculosis
HRPEV

SEQ ID NO: 1406893 - protein, 9 aa, Mycobacterium tuberculosis
HRQRPATAQ

SEQ ID NO: 1406894 - protein, 19 aa, Mycobacterium tuberculosis
HRRAAGATTSSTEATPNDL

SEQ ID NO: 1406895 - protein, 6 aa, Mycobacterium tuberculosis
HRSTGE

SEQ ID NO: 1406896 - protein, 5 aa, Mycobacterium tuberculosis
HRTPE

SEQ ID NO: 1406897 - protein, 11 aa, Mycobacterium tuberculosis
HSDEPAEAATV

SEQ ID NO: 1406898 - protein, 6 aa, Mycobacterium tuberculosis
HSDTDV

SEQ ID NO: 1406899 - protein, 18 aa, Mycobacterium tuberculosis
HSGAEEFGDIDSRNGDAA

SEQ ID NO: 1406900 - protein, 4 aa, Mycobacterium tuberculosis
HSPA

SEQ ID NO: 1406901 - protein, 9 aa, Mycobacterium tuberculosis
HSPDTAGGL

SEQ ID NO: 1406902 - protein, 6 aa, Mycobacterium tuberculosis
HSPEPR

SEQ ID NO: 1406903 - protein, 12 aa, Mycobacterium tuberculosis
HSSISPPTAAGW

SEQ ID NO: 1406904 - protein, 9 aa, Mycobacterium tuberculosis
HSTAPEGGT

SEQ ID NO: 1406905 - protein, 6 aa, Mycobacterium tuberculosis
HSTPDA

SEQ ID NO: 1406906 - protein, 13 aa, Mycobacterium tuberculosis
HTAGTSSQISDGA

SEQ ID NO: 1406907 - protein, 5 aa, Mycobacterium tuberculosis
HTDDS

SEQ ID NO: 1406908 - protein, 6 aa, Mycobacterium tuberculosis
HTEVPS

SEQ ID NO: 1406909 - protein, 5 aa, Mycobacterium tuberculosis
HTGAR

SEQ ID NO: 1406910 - protein, 8 aa, Mycobacterium tuberculosis
HTGETRVA

SEQ ID NO: 1406911 - protein, 9 aa, Mycobacterium tuberculosis
HTGTGDGGY

SEQ ID NO: 1406912 - protein, 5 aa, Mycobacterium tuberculosis
HTKRY

SEQ ID NO: 1406913 - protein, 5 aa, Mycobacterium tuberculosis
HTPGS

SEQ ID NO: 1406914 - protein, 10 aa, Mycobacterium tuberculosis
HTSPGLEDQI

SEQ ID NO: 1406915 - protein, 6 aa, Mycobacterium tuberculosis
HTTEGW

SEQ ID NO: 1406916 - protein, 4 aa, Mycobacterium tuberculosis
HTVA

SEQ ID NO: 1406917 - protein, 11 aa, Mycobacterium tuberculosis
HTVTPSPHHPI

SEQ ID NO: 1406918 - protein, 12 aa, Mycobacterium tuberculosis
HYGPPAQNRELA

SEQ ID NO: 1406919 - protein, 4 aa, Mycobacterium tuberculosis
IADP

SEQ ID NO: 1406920 - protein, 9 aa, Mycobacterium tuberculosis
IADPDIPAE

SEQ ID NO: 1406921 - protein, 5 aa, Mycobacterium tuberculosis
IAEAE

SEQ ID NO: 1406922 - protein, 7 aa, Mycobacterium tuberculosis
IAEAEGA

SEQ ID NO: 1406923 - protein, 9 aa, Mycobacterium tuberculosis
IAPAPDAVT

SEQ ID NO: 1406924 - protein, 11 aa, Mycobacterium tuberculosis
IAPGAVDPAGL

SEQ ID NO: 1406925 - protein, 8 aa, Mycobacterium tuberculosis
IAPGKGPE

SEQ ID NO: 1406926 - protein, 6 aa, Mycobacterium tuberculosis
IAPGSQ

SEQ ID NO: 1406927 - protein, 9 aa, Mycobacterium tuberculosis
IAQASPPDM

SEQ ID NO: 1406928 - protein, 12 aa, Mycobacterium tuberculosis
IDAAADPPLRDE

SEQ ID NO: 1406929 - protein, 7 aa, Mycobacterium tuberculosis
IDAANEH

SEQ ID NO: 1406930 - protein, 6 aa, Mycobacterium tuberculosis
IDASPA

SEQ ID NO: 1406931 - protein, 4 aa, Mycobacterium tuberculosis
IDDQ

SEQ ID NO: 1406932 - protein, 5 aa, Mycobacterium tuberculosis
IDEDG

SEQ ID NO: 1406933 - protein, 8 aa, Mycobacterium tuberculosis
IDGADPAA

SEQ ID NO: 1406934 - protein, 8 aa, Mycobacterium tuberculosis
IDGPAPQR

SEQ ID NO: 1406935 - protein, 8 aa, Mycobacterium tuberculosis
IDNSDNAL

SEQ ID NO: 1406936 - protein, 17 aa, Mycobacterium tuberculosis
IDPATGQATKVAGPGWT

SEQ ID NO: 1406937 - protein, 6 aa, Mycobacterium tuberculosis
IDPGKV

SEQ ID NO: 1406938 - protein, 27 aa, Mycobacterium tuberculosis
IDQAEEELAERSTPATMPRRPRSTDDV

SEQ ID NO: 1406939 - protein, 8 aa, Mycobacterium tuberculosis
IDTGPDGS

SEQ ID NO: 1406940 - protein, 12 aa, Mycobacterium tuberculosis
IDTQGRNTAVRS

SEQ ID NO: 1406941 - protein, 10 aa, Mycobacterium tuberculosis
IEASKKALER

SEQ ID NO: 1406942 - protein, 4 aa, Mycobacterium tuberculosis
IEEG

SEQ ID NO: 1406943 - protein, 5 aa, Mycobacterium tuberculosis
IEPGS

SEQ ID NO: 1406944 - protein, 21 aa, Mycobacterium tuberculosis
IEPRARRAASTRARRAPSPSV

SEQ ID NO: 1406945 - protein, 6 aa, Mycobacterium tuberculosis
IETRYG

SEQ ID NO: 1406946 - protein, 6 aa, Mycobacterium tuberculosis
IGEQDA

SEQ ID NO: 1406947 - protein, 5 aa, Mycobacterium tuberculosis
IGGSG

SEQ ID NO: 1406948 - protein, 13 aa, Mycobacterium tuberculosis
IGLPDESYYRDEQ

SEQ ID NO: 1406949 - protein, 8 aa, Mycobacterium tuberculosis
IGNSSPRV

SEQ ID NO: 1406950 - protein, 7 aa, Mycobacterium tuberculosis
IGPGYGA

SEQ ID NO: 1406951 - protein, 4 aa, Mycobacterium tuberculosis
IGPS

SEQ ID NO: 1406952 - protein, 5 aa, Mycobacterium tuberculosis
IGSED

SEQ ID NO: 1406953 - protein, 7 aa, Mycobacterium tuberculosis
IGTASDA

SEQ ID NO: 1406954 - protein, 6 aa, Mycobacterium tuberculosis
IGTTSL

SEQ ID NO: 1406955 - protein, 6 aa, Mycobacterium tuberculosis
IHPTAD

SEQ ID NO: 1406956 - protein, 9 aa, Mycobacterium tuberculosis
IKARSTRGA

SEQ ID NO: 1406957 - protein, 6 aa, Mycobacterium tuberculosis
IKGSDT

SEQ ID NO: 1406958 - protein, 4 aa, Mycobacterium tuberculosis
IKPQ

SEQ ID NO: 1406959 - protein, 7 aa, Mycobacterium tuberculosis
ILDSGGR

SEQ ID NO: 1406960 - protein, 5 aa, Mycobacterium tuberculosis
INAGE

SEQ ID NO: 1406961 - protein, 7 aa, Mycobacterium tuberculosis
INTVTGN

SEQ ID NO: 1406962 - protein, 6 aa, Mycobacterium tuberculosis
IPAATA

SEQ ID NO: 1406963 - protein, 6 aa, Mycobacterium tuberculosis
IPAGPA

SEQ ID NO: 1406964 - protein, 5 aa, Mycobacterium tuberculosis
IPAGR

SEQ ID NO: 1406965 - protein, 7 aa, Mycobacterium tuberculosis
IPARTTA

SEQ ID NO: 1406966 - protein, 4 aa, Mycobacterium tuberculosis
IPAS

SEQ ID NO: 1406967 - protein, 6 aa, Mycobacterium tuberculosis
IPDPDP

SEQ ID NO: 1406968 - protein, 9 aa, Mycobacterium tuberculosis
IPDPPPPGA

SEQ ID NO: 1406969 - protein, 4 aa, Mycobacterium tuberculosis
IPDT

SEQ ID NO: 1406970 - protein, 6 aa, Mycobacterium tuberculosis
IPEAEK

SEQ ID NO: 1406971 - protein, 6 aa, Mycobacterium tuberculosis
IPENEH

SEQ ID NO: 1406972 - protein, 7 aa, Mycobacterium tuberculosis
IPEPTIP

SEQ ID NO: 1406973 - protein, 6 aa, Mycobacterium tuberculosis
IPGAPP

SEQ ID NO: 1406974 - protein, 10 aa, Mycobacterium tuberculosis
IPGPASQALT

SEQ ID NO: 1406975 - protein, 5 aa, Mycobacterium tuberculosis
IPKWG

SEQ ID NO: 1406976 - protein, 6 aa, Mycobacterium tuberculosis
IPPNGQ

SEQ ID NO: 1406977 - protein, 5 aa, Mycobacterium tuberculosis
IPPNR

SEQ ID NO: 1406978 - protein, 5 aa, Mycobacterium tuberculosis
IPPQQ

SEQ ID NO: 1406979 - protein, 8 aa, Mycobacterium tuberculosis
IPPYGDAR

SEQ ID NO: 1406980 - protein, 5 aa, Mycobacterium tuberculosis
IPRGG

SEQ ID NO: 1406981 - protein, 10 aa, Mycobacterium tuberculosis
IPTGNSANFA

SEQ ID NO: 1406982 - protein, 11 aa, Mycobacterium tuberculosis
IPTTPTHRDGR

SEQ ID NO: 1406983 - protein, 14 aa, Mycobacterium tuberculosis
IPVTTSGKVRRSAS

SEQ ID NO: 1406984 - protein, 9 aa, Mycobacterium tuberculosis
IQDKGEGKN

SEQ ID NO: 1406985 - protein, 9 aa, Mycobacterium tuberculosis
IQGEGGDRH

SEQ ID NO: 1406986 - protein, 11 aa, Mycobacterium tuberculosis
IQQSETPRTET

SEQ ID NO: 1406987 - protein, 13 aa, Mycobacterium tuberculosis
IRAQGGVSRMSDP

SEQ ID NO: 1406988 - protein, 10 aa, Mycobacterium tuberculosis
IRGESENLAP

SEQ ID NO: 1406989 - protein, 4 aa, Mycobacterium tuberculosis
IRHP

SEQ ID NO: 1406990 - protein, 6 aa, Mycobacterium tuberculosis
IRPDTT

SEQ ID NO: 1406991 - protein, 5 aa, Mycobacterium tuberculosis
IRQQR

SEQ ID NO: 1406992 - protein, 9 aa, Mycobacterium tuberculosis
IRSRDGGFE

SEQ ID NO: 1406993 - protein, 9 aa, Mycobacterium tuberculosis
ISAEARRRS

SEQ ID NO: 1406994 - protein, 11 aa, Mycobacterium tuberculosis
ISDPGSAEGYS

SEQ ID NO: 1406995 - protein, 4 aa, Mycobacterium tuberculosis
ISEN

SEQ ID NO: 1406996 - protein, 8 aa, Mycobacterium tuberculosis
ISGPSQGG

SEQ ID NO: 1406997 - protein, 5 aa, Mycobacterium tuberculosis
ISPRS

SEQ ID NO: 1406998 - protein, 6 aa, Mycobacterium tuberculosis
ISQTPG

SEQ ID NO: 1406999 - protein, 10 aa, Mycobacterium tuberculosis
ISSGGENPAG

SEQ ID NO: 1407000 - protein, 5 aa, Mycobacterium tuberculosis
ISVTD

SEQ ID NO: 1407001 - protein, 10 aa, Mycobacterium tuberculosis
ITADGEFADR

SEQ ID NO: 1407002 - protein, 4 aa, Mycobacterium tuberculosis
ITAG

SEQ ID NO: 1407003 - protein, 11 aa, Mycobacterium tuberculosis
ITAPDARGERV

SEQ ID NO: 1407004 - protein, 4 aa, Mycobacterium tuberculosis
ITDN

SEQ ID NO: 1407005 - protein, 7 aa, Mycobacterium tuberculosis
ITDPAAA

SEQ ID NO: 1407006 - protein, 10 aa, Mycobacterium tuberculosis
ITGESQARAV

SEQ ID NO: 1407007 - protein, 7 aa, Mycobacterium tuberculosis
ITGQRPG

SEQ ID NO: 1407008 - protein, 6 aa, Mycobacterium tuberculosis
ITMPAP

SEQ ID NO: 1407009 - protein, 7 aa, Mycobacterium tuberculosis
ITPDEAR

SEQ ID NO: 1407010 - protein, 12 aa, Mycobacterium tuberculosis
ITRESGRSQGDF

SEQ ID NO: 1407011 - protein, 5 aa, Mycobacterium tuberculosis
ITRRS

SEQ ID NO: 1407012 - protein, 4 aa, Mycobacterium tuberculosis
IYEA

SEQ ID NO: 1407013 - protein, 8 aa, Mycobacterium tuberculosis
KAAAANPP

SEQ ID NO: 1407014 - protein, 7 aa, Mycobacterium tuberculosis
KAADAVS

SEQ ID NO: 1407015 - protein, 6 aa, Mycobacterium tuberculosis
KAAEGY

SEQ ID NO: 1407016 - protein, 7 aa, Mycobacterium tuberculosis
KAAEPAV

SEQ ID NO: 1407017 - protein, 5 aa, Mycobacterium tuberculosis
KAAPN

SEQ ID NO: 1407018 - protein, 5 aa, Mycobacterium tuberculosis
KACPD

SEQ ID NO: 1407019 - protein, 8 aa, Mycobacterium tuberculosis
KAEATNAR

SEQ ID NO: 1407020 - protein, 8 aa, Mycobacterium tuberculosis
KAESPSEL

SEQ ID NO: 1407021 - protein, 7 aa, Mycobacterium tuberculosis
KAGKAGL

SEQ ID NO: 1407022 - protein, 7 aa, Mycobacterium tuberculosis
KAGNPDI

SEQ ID NO: 1407023 - protein, 8 aa, Mycobacterium tuberculosis
KAHPTAPL

SEQ ID NO: 1407024 - protein, 5 aa, Mycobacterium tuberculosis
KAKKN

SEQ ID NO: 1407025 - protein, 28 aa, Mycobacterium tuberculosis
KAKKSSVPNENIERARKRGAGEEAGGAD

SEQ ID NO: 1407026 - protein, 8 aa, Mycobacterium tuberculosis
KAKPGRSV

SEQ ID NO: 1407027 - protein, 6 aa, Mycobacterium tuberculosis
KALAGN

SEQ ID NO: 1407028 - protein, 9 aa, Mycobacterium tuberculosis
KAPDALSLP

SEQ ID NO: 1407029 - protein, 10 aa, Mycobacterium tuberculosis
KAPQGPPVTK

SEQ ID NO: 1407030 - protein, 5 aa, Mycobacterium tuberculosis
KAPSV

SEQ ID NO: 1407031 - protein, 4 aa, Mycobacterium tuberculosis
KARA

SEQ ID NO: 1407032 - protein, 9 aa, Mycobacterium tuberculosis
KARHAATGF

SEQ ID NO: 1407033 - protein, 14 aa, Mycobacterium tuberculosis
KASSTPTGSPSSGV

SEQ ID NO: 1407034 - protein, 9 aa, Mycobacterium tuberculosis
KATAGTPRR

SEQ ID NO: 1407035 - protein, 29 aa, Mycobacterium tuberculosis
KATAQRPVAAGRPRPRPQRPVSDRVSDQR

SEQ ID NO: 1407036 - protein, 12 aa, Mycobacterium tuberculosis
KAYGGQGLPDGT

SEQ ID NO: 1407037 - protein, 8 aa, Mycobacterium tuberculosis
KDDLKSTV

SEQ ID NO: 1407038 - protein, 4 aa, Mycobacterium tuberculosis
KDEQ

SEQ ID NO: 1407039 - protein, 7 aa, Mycobacterium tuberculosis
KDGGKVE

SEQ ID NO: 1407040 - protein, 6 aa, Mycobacterium tuberculosis
KDGRPV

SEQ ID NO: 1407041 - protein, 8 aa, Mycobacterium tuberculosis
KDGTNSLD

SEQ ID NO: 1407042 - protein, 8 aa, Mycobacterium tuberculosis
KDGVAQEL

SEQ ID NO: 1407043 - protein, 13 aa, Mycobacterium tuberculosis
KDHRDGARGRGRG

SEQ ID NO: 1407044 - protein, 14 aa, Mycobacterium tuberculosis
KDKDPNLTGDDIRE

SEQ ID NO: 1407045 - protein, 7 aa, Mycobacterium tuberculosis
KDLTEGI

SEQ ID NO: 1407046 - protein, 6 aa, Mycobacterium tuberculosis
KDPGYS

SEQ ID NO: 1407047 - protein, 6 aa, Mycobacterium tuberculosis
KDPQVS

SEQ ID NO: 1407048 - protein, 6 aa, Mycobacterium tuberculosis
KDRATR

SEQ ID NO: 1407049 - protein, 9 aa, Mycobacterium tuberculosis
KDRPEPATL

SEQ ID NO: 1407050 - protein, 6 aa, Mycobacterium tuberculosis
KDRPKK

SEQ ID NO: 1407051 - protein, 4 aa, Mycobacterium tuberculosis
KDRT

SEQ ID NO: 1407052 - protein, 6 aa, Mycobacterium tuberculosis
KEFAGR

SEQ ID NO: 1407053 - protein, 6 aa, Mycobacterium tuberculosis
KELPAK

SEQ ID NO: 1407054 - protein, 7 aa, Mycobacterium tuberculosis
KEPQRGA

SEQ ID NO: 1407055 - protein, 16 aa, Mycobacterium tuberculosis
KERAHNAGAKNVEERP

SEQ ID NO: 1407056 - protein, 5 aa, Mycobacterium tuberculosis
KESTA

SEQ ID NO: 1407057 - protein, 13 aa, Mycobacterium tuberculosis
KEYGSGSSRDWAA

SEQ ID NO: 1407058 - protein, 13 aa, Mycobacterium tuberculosis
KFGGDSLAETQRN

SEQ ID NO: 1407059 - protein, 5 aa, Mycobacterium tuberculosis
KFSDE

SEQ ID NO: 1407060 - protein, 6 aa, Mycobacterium tuberculosis
KGAGLG

SEQ ID NO: 1407061 - protein, 5 aa, Mycobacterium tuberculosis
KGAPR

SEQ ID NO: 1407062 - protein, 10 aa, Mycobacterium tuberculosis
KGASEGAGLG

SEQ ID NO: 1407063 - protein, 4 aa, Mycobacterium tuberculosis
KGEE

SEQ ID NO: 1407064 - protein, 7 aa, Mycobacterium tuberculosis
KGGVGKT

SEQ ID NO: 1407065 - protein, 14 aa, Mycobacterium tuberculosis
KGIGESATVGSPPA

SEQ ID NO: 1407066 - protein, 4 aa, Mycobacterium tuberculosis
KGMT

SEQ ID NO: 1407067 - protein, 11 aa, Mycobacterium tuberculosis
KGPKQDHPNIG

SEQ ID NO: 1407068 - protein, 8 aa, Mycobacterium tuberculosis
KGPSGERE

SEQ ID NO: 1407069 - protein, 5 aa, Mycobacterium tuberculosis
KGQET

SEQ ID NO: 1407070 - protein, 8 aa, Mycobacterium tuberculosis
KGQVGPGG

SEQ ID NO: 1407071 - protein, 4 aa, Mycobacterium tuberculosis
KGSN

SEQ ID NO: 1407072 - protein, 5 aa, Mycobacterium tuberculosis
KGSQA

SEQ ID NO: 1407073 - protein, 10 aa, Mycobacterium tuberculosis
KGTGVTTRTR

SEQ ID NO: 1407074 - protein, 8 aa, Mycobacterium tuberculosis
KGTPGLSF

SEQ ID NO: 1407075 - protein, 11 aa, Mycobacterium tuberculosis
KGTSLSTYTPD

SEQ ID NO: 1407076 - protein, 4 aa, Mycobacterium tuberculosis
KHGE

SEQ ID NO: 1407077 - protein, 5 aa, Mycobacterium tuberculosis
KHGPP

SEQ ID NO: 1407078 - protein, 8 aa, Mycobacterium tuberculosis
KHIDGQGR

SEQ ID NO: 1407079 - protein, 6 aa, Mycobacterium tuberculosis
KHPDEQ

SEQ ID NO: 1407080 - protein, 9 aa, Mycobacterium tuberculosis
KHSTGGVGD

SEQ ID NO: 1407081 - protein, 7 aa, Mycobacterium tuberculosis
KIAEDGE

SEQ ID NO: 1407082 - protein, 11 aa, Mycobacterium tuberculosis
KIGTTGRGIGP

SEQ ID NO: 1407083 - protein, 38 aa, Mycobacterium tuberculosis; identical to SEQ ID NO: 179235

SEQ ID NO: 1407084 - protein, 6 aa, Mycobacterium tuberculosis
KKAQAA

SEQ ID NO: 1407085 - protein, 16 aa, Mycobacterium tuberculosis
KKGGLSGYPSRAESEH

SEQ ID NO: 1407086 - protein, 9 aa, Mycobacterium tuberculosis
KKGVEGPPT

SEQ ID NO: 1407087 - protein, 10 aa, Mycobacterium tuberculosis
KKHPDHDKPW

SEQ ID NO: 1407088 - protein, 10 aa, Mycobacterium tuberculosis
KKNRRNDPDR

SEQ ID NO: 1407089 - protein, 5 aa, Mycobacterium tuberculosis
KKPGI

SEQ ID NO: 1407090 - protein, 9 aa, Mycobacterium tuberculosis
KKSARGEYE

SEQ ID NO: 1407091 - protein, 5 aa, Mycobacterium tuberculosis
KLAGG

SEQ ID NO: 1407092 - protein, 16 aa, Mycobacterium tuberculosis
KLGPGVDVRMKLVEWN

SEQ ID NO: 1407093 - protein, 5 aa, Mycobacterium tuberculosis
KLPSV

SEQ ID NO: 1407094 - protein, 5 aa, Mycobacterium tuberculosis
KLSPT

SEQ ID NO: 1407095 - protein, 5 aa, Mycobacterium tuberculosis
KLTPP

SEQ ID NO: 1407096 - protein, 5 aa, Mycobacterium tuberculosis
KNPEF

SEQ ID NO: 1407097 - protein, 7 aa, Mycobacterium tuberculosis
KNPERAA

SEQ ID NO: 1407098 - protein, 8 aa, Mycobacterium tuberculosis
KNPESQAQ

SEQ ID NO: 1407099 - protein, 7 aa, Mycobacterium tuberculosis
KNQGSAI

SEQ ID NO: 1407100 - protein, 6 aa, Mycobacterium tuberculosis
KNREAG

SEQ ID NO: 1407101 - protein, 7 aa, Mycobacterium tuberculosis
KNVTPGA

SEQ ID NO: 1407102 - protein, 8 aa, Mycobacterium tuberculosis
KPAEQTPA

SEQ ID NO: 1407103 - protein, 9 aa, Mycobacterium tuberculosis
KPAPAPDMN

SEQ ID NO: 1407104 - protein, 8 aa, Mycobacterium tuberculosis
KPDENRED

SEQ ID NO: 1407105 - protein, 8 aa, Mycobacterium tuberculosis
KPDSQTPY

SEQ ID NO: 1407106 - protein, 7 aa, Mycobacterium tuberculosis
KPEARTY

SEQ ID NO: 1407107 - protein, 10 aa, Mycobacterium tuberculosis
KPNEVDEDEL

SEQ ID NO: 1407108 - protein, 16 aa, Mycobacterium tuberculosis
KPSGARTDRRGRTTGV

SEQ ID NO: 1407109 - protein, 8 aa, Mycobacterium tuberculosis
KPSRGRLP

SEQ ID NO: 1407110 - protein, 9 aa, Mycobacterium tuberculosis
KPSSSKGRY

SEQ ID NO: 1407111 - protein, 7 aa, Mycobacterium tuberculosis
KPTKGQI

SEQ ID NO: 1407112 - protein, 4 aa, Mycobacterium tuberculosis
KPTQ

SEQ ID NO: 1407113 - protein, 4 aa, Mycobacterium tuberculosis
KPVP

SEQ ID NO: 1407114 - protein, 4 aa, Mycobacterium tuberculosis
KQAL

SEQ ID NO: 1407115 - protein, 7 aa, Mycobacterium tuberculosis
KQDVDGM

SEQ ID NO: 1407116 - protein, 15 aa, Mycobacterium tuberculosis
KQEGNEWKISSLLPV

SEQ ID NO: 1407117 - protein, 6 aa, Mycobacterium tuberculosis
KQIDGA

SEQ ID NO: 1407118 - protein, 5 aa, Mycobacterium tuberculosis
KQKAR

SEQ ID NO: 1407119 - protein, 4 aa, Mycobacterium tuberculosis
KQNV

SEQ ID NO: 1407120 - protein, 7 aa, Mycobacterium tuberculosis
KQQRPAA

SEQ ID NO: 1407121 - protein, 11 aa, Mycobacterium tuberculosis
KRAARQRGVSE

SEQ ID NO: 1407122 - protein, 4 aa, Mycobacterium tuberculosis
KRAE

SEQ ID NO: 1407123 - protein, 8 aa, Mycobacterium tuberculosis
KRAEPADD

SEQ ID NO: 1407124 - protein, 4 aa, Mycobacterium tuberculosis
KRAG

SEQ ID NO: 1407125 - protein, 13 aa, Mycobacterium tuberculosis
KRAIKQGTELAAR

SEQ ID NO: 1407126 - protein, 10 aa, Mycobacterium tuberculosis
KRGDSDQDAM

SEQ ID NO: 1407127 - protein, 10 aa, Mycobacterium tuberculosis
KRGRPQGDQV

SEQ ID NO: 1407128 - protein, 9 aa, Mycobacterium tuberculosis
KRKDGTTEW

SEQ ID NO: 1407129 - protein, 5 aa, Mycobacterium tuberculosis
KRKHT

SEQ ID NO: 1407130 - protein, 6 aa, Mycobacterium tuberculosis
KRLGTT

SEQ ID NO: 1407131 - protein, 13 aa, Mycobacterium tuberculosis
KRLPAESVTHWNG

SEQ ID NO: 1407132 - protein, 5 aa, Mycobacterium tuberculosis
KRNLP

SEQ ID NO: 1407133 - protein, 6 aa, Mycobacterium tuberculosis
KRPDPH

SEQ ID NO: 1407134 - protein, 5 aa, Mycobacterium tuberculosis
KRPLV

SEQ ID NO: 1407135 - protein, 4 aa, Mycobacterium tuberculosis
KRQQ

SEQ ID NO: 1407136 - protein, 7 aa, Mycobacterium tuberculosis
KRQRRSP

SEQ ID NO: 1407137 - protein, 10 aa, Mycobacterium tuberculosis
KRRIDPETGE

SEQ ID NO: 1407138 - protein, 6 aa, Mycobacterium tuberculosis
KRRTRN

SEQ ID NO: 1407139 - protein, 8 aa, Mycobacterium tuberculosis
KRSGYGRE

SEQ ID NO: 1407140 - protein, 8 aa, Mycobacterium tuberculosis
KRWRDRGG

SEQ ID NO: 1407141 - protein, 8 aa, Mycobacterium tuberculosis
KSAHGGPF

SEQ ID NO: 1407142 - protein, 8 aa, Mycobacterium tuberculosis
KSANATVP

SEQ ID NO: 1407143 - protein, 11 aa, Mycobacterium tuberculosis
KSATDIGGLPG

SEQ ID NO: 1407144 - protein, 6 aa, Mycobacterium tuberculosis
KSFGSS

SEQ ID NO: 1407145 - protein, 5 aa, Mycobacterium tuberculosis
KSGTV

SEQ ID NO: 1407146 - protein, 10 aa, Mycobacterium tuberculosis
KSHGPQGTEC

SEQ ID NO: 1407147 - protein, 11 aa, Mycobacterium tuberculosis
KSHPADDGGKA

SEQ ID NO: 1407148 - protein, 8 aa, Mycobacterium tuberculosis
KSNAAGIE

SEQ ID NO: 1407149 - protein, 7 aa, Mycobacterium tuberculosis
KSRAAEA

SEQ ID NO: 1407150 - protein, 12 aa, Mycobacterium tuberculosis
KSTPTAEPDTPC

SEQ ID NO: 1407151 - protein, 5 aa, Mycobacterium tuberculosis
KSTTR

SEQ ID NO: 1407152 - protein, 7 aa, Mycobacterium tuberculosis
KTGNERA

SEQ ID NO: 1407153 - protein, 20 aa, Mycobacterium tuberculosis
KTHGAGPADLVGPEPEAAPL

SEQ ID NO: 1407154 - protein, 6 aa, Mycobacterium tuberculosis
KTPEGY

SEQ ID NO: 1407155 - protein, 7 aa, Mycobacterium tuberculosis
KTPETAG

SEQ ID NO: 1407156 - protein, 7 aa, Mycobacterium tuberculosis
KTPQRPV

SEQ ID NO: 1407157 - protein, 6 aa, Mycobacterium tuberculosis
KTRLGD

SEQ ID NO: 1407158 - protein, 8 aa, Mycobacterium tuberculosis
KTTDADIE

SEQ ID NO: 1407159 - protein, 5 aa, Mycobacterium tuberculosis
KTTEA

SEQ ID NO: 1407160 - protein, 8 aa, Mycobacterium tuberculosis
KTVESGSL

SEQ ID NO: 1407161 - protein, 5 aa, Mycobacterium tuberculosis
KTVGD

SEQ ID NO: 1407162 - protein, 13 aa, Mycobacterium tuberculosis
KTVTSEANRARRV

SEQ ID NO: 1407163 - protein, 5 aa, Mycobacterium tuberculosis
KVGNE

SEQ ID NO: 1407164 - protein, 6 aa, Mycobacterium tuberculosis
KVNTGL

SEQ ID NO: 1407165 - protein, 5 aa, Mycobacterium tuberculosis
KVRTR

SEQ ID NO: 1407166 - protein, 7 aa, Mycobacterium tuberculosis
KVSSGDL

SEQ ID NO: 1407167 - protein, 4 aa, Mycobacterium tuberculosis
KVTE

SEQ ID NO: 1407168 - protein, 6 aa, Mycobacterium tuberculosis
LAADGN

SEQ ID NO: 1407169 - protein, 7 aa, Mycobacterium tuberculosis
LAAGERA

SEQ ID NO: 1407170 - protein, 6 aa, Mycobacterium tuberculosis
LAAGNT

SEQ ID NO: 1407171 - protein, 7 aa, Mycobacterium tuberculosis
LAASGTP

SEQ ID NO: 1407172 - protein, 6 aa, Mycobacterium tuberculosis
LAEGAG

SEQ ID NO: 1407173 - protein, 8 aa, Mycobacterium tuberculosis
LAEKPQAT

SEQ ID NO: 1407174 - protein, 6 aa, Mycobacterium tuberculosis
LAEPSG

SEQ ID NO: 1407175 - protein, 8 aa, Mycobacterium tuberculosis
LAGADSGV

SEQ ID NO: 1407176 - protein, 11 aa, Mycobacterium tuberculosis
LAGPDGQLDPV

SEQ ID NO: 1407177 - protein, 8 aa, Mycobacterium tuberculosis
LAGSDSLR

SEQ ID NO: 1407178 - protein, 6 aa, Mycobacterium tuberculosis
LAKTKP

SEQ ID NO: 1407179 - protein, 9 aa, Mycobacterium tuberculosis
LANGATAEE

SEQ ID NO: 1407180 - protein, 6 aa, Mycobacterium tuberculosis
LAPADA

SEQ ID NO: 1407181 - protein, 4 aa, Mycobacterium tuberculosis
LAPG

SEQ ID NO: 1407182 - protein, 7 aa, Mycobacterium tuberculosis
LAPGGTT

SEQ ID NO: 1407183 - protein, 6 aa, Mycobacterium tuberculosis
LAPGRR

SEQ ID NO: 1407184 - protein, 10 aa, Mycobacterium tuberculosis
LAPSADNRRE

SEQ ID NO: 1407185 - protein, 14 aa, Mycobacterium tuberculosis
LAPTGPVRTPDDDG

SEQ ID NO: 1407186 - protein, 18 aa, Mycobacterium tuberculosis
LAREPRRGPRLPVQNIRA

SEQ ID NO: 1407187 - protein, 7 aa, Mycobacterium tuberculosis
LARPRTD

SEQ ID NO: 1407188 - protein, 9 aa, Mycobacterium tuberculosis
LARRNADGD

SEQ ID NO: 1407189 - protein, 11 aa, Mycobacterium tuberculosis
LASGTSSRSSK

SEQ ID NO: 1407190 - protein, 10 aa, Mycobacterium tuberculosis
LASTPSQRSW

SEQ ID NO: 1407191 - protein, 4 aa, Mycobacterium tuberculosis
LATG

SEQ ID NO: 1407192 - protein, 8 aa, Mycobacterium tuberculosis
LATGARES

SEQ ID NO: 1407193 - protein, 12 aa, Mycobacterium tuberculosis
LDAASKAQLERG

SEQ ID NO: 1407194 - protein, 11 aa, Mycobacterium tuberculosis
LDADGSPVSIE

SEQ ID NO: 1407195 - protein, 6 aa, Mycobacterium tuberculosis
LDAGDP

SEQ ID NO: 1407196 - protein, 9 aa, Mycobacterium tuberculosis
LDAGETLPT

SEQ ID NO: 1407197 - protein, 4 aa, Mycobacterium tuberculosis
LDDA

SEQ ID NO: 1407198 - protein, 10 aa, Mycobacterium tuberculosis
LDEDGTITDA

SEQ ID NO: 1407199 - protein, 7 aa, Mycobacterium tuberculosis
LDEQPAA

SEQ ID NO: 1407200 - protein, 9 aa, Mycobacterium tuberculosis
LDESGLRPE

SEQ ID NO: 1407201 - protein, 10 aa, Mycobacterium tuberculosis
LDGDARGGAA

SEQ ID NO: 1407202 - protein, 13 aa, Mycobacterium tuberculosis
LDPAGILNPGKLI

SEQ ID NO: 1407203 - protein, 7 aa, Mycobacterium tuberculosis
LDPAQRA

SEQ ID NO: 1407204 - protein, 9 aa, Mycobacterium tuberculosis
LDPGDGSVI

SEQ ID NO: 1407205 - protein, 10 aa, Mycobacterium tuberculosis
LDPGKARALA

SEQ ID NO: 1407206 - protein, 8 aa, Mycobacterium tuberculosis
LDPGQRDT

SEQ ID NO: 1407207 - protein, 10 aa, Mycobacterium tuberculosis
LDPKADYGPL

SEQ ID NO: 1407208 - protein, 6 aa, Mycobacterium tuberculosis
LDPQGQ

SEQ ID NO: 1407209 - protein, 10 aa, Mycobacterium tuberculosis
LDPSSRTSEA

SEQ ID NO: 1407210 - protein, 8 aa, Mycobacterium tuberculosis
LDRAERSN

SEQ ID NO: 1407211 - protein, 5 aa, Mycobacterium tuberculosis
LDSAL

SEQ ID NO: 1407212 - protein, 11 aa, Mycobacterium tuberculosis
LDTEPPPAQGY

SEQ ID NO: 1407213 - protein, 9 aa, Mycobacterium tuberculosis
LDTTPGQVT

SEQ ID NO: 1407214 - protein, 13 aa, Mycobacterium tuberculosis
LEARKTVGSVVLL

SEQ ID NO: 1407215 - protein, 10 aa, Mycobacterium tuberculosis
LEASTDPQEL

SEQ ID NO: 1407216 - protein, 20 aa, Mycobacterium tuberculosis
LEDPATGAPLATNDNEGVVD

SEQ ID NO: 1407217 - protein, 6 aa, Mycobacterium tuberculosis
LEENSA

SEQ ID NO: 1407218 - protein, 4 aa, Mycobacterium tuberculosis
LEGI

SEQ ID NO: 1407219 - protein, 9 aa, Mycobacterium tuberculosis
LEKTDGSSA

SEQ ID NO: 1407220 - protein, 8 aa, Mycobacterium tuberculosis
LEPQGADR

SEQ ID NO: 1407221 - protein, 16 aa, Mycobacterium tuberculosis
LEPRDVSAAKAAASEA

SEQ ID NO: 1407222 - protein, 6 aa, Mycobacterium tuberculosis
LEQPRS

SEQ ID NO: 1407223 - protein, 6 aa, Mycobacterium tuberculosis
LERAEN

SEQ ID NO: 1407224 - protein, 5 aa, Mycobacterium tuberculosis
LESGD

SEQ ID NO: 1407225 - protein, 9 aa, Mycobacterium tuberculosis
LESGSRARG

SEQ ID NO: 1407226 - protein, 8 aa, Mycobacterium tuberculosis
LESGTTVD

SEQ ID NO: 1407227 - protein, 8 aa, Mycobacterium tuberculosis
LETGGGEV

SEQ ID NO: 1407228 - protein, 10 aa, Mycobacterium tuberculosis
LETQDGPRLS

SEQ ID NO: 1407229 - protein, 6 aa, Mycobacterium tuberculosis
LETTHE

SEQ ID NO: 1407230 - protein, 8 aa, Mycobacterium tuberculosis
LGAEPSAI

SEQ ID NO: 1407231 - protein, 5 aa, Mycobacterium tuberculosis
LGAEQ

SEQ ID NO: 1407232 - protein, 11 aa, Mycobacterium tuberculosis
LGAESEGERAA

SEQ ID NO: 1407233 - protein, 7 aa, Mycobacterium tuberculosis
LGAGAAE

SEQ ID NO: 1407234 - protein, 8 aa, Mycobacterium tuberculosis
LGARQGAG

SEQ ID NO: 1407235 - protein, 4 aa, Mycobacterium tuberculosis
LGAT

SEQ ID NO: 1407236 - protein, 4 aa, Mycobacterium tuberculosis
LGDG

SEQ ID NO: 1407237 - protein, 7 aa, Mycobacterium tuberculosis
LGEAGGG

SEQ ID NO: 1407238 - protein, 11 aa, Mycobacterium tuberculosis
LGEPGPMSAPR

SEQ ID NO: 1407239 - protein, 8 aa, Mycobacterium tuberculosis
LGEQPCDH

SEQ ID NO: 1407240 - protein, 6 aa, Mycobacterium tuberculosis
LGGDDS

SEQ ID NO: 1407241 - protein, 8 aa, Mycobacterium tuberculosis
LGGGPQAA

SEQ ID NO: 1407242 - protein, 4 aa, Mycobacterium tuberculosis
LGGH

SEQ ID NO: 1407243 - protein, 5 aa, Mycobacterium tuberculosis
LGGPT

SEQ ID NO: 1407244 - protein, 9 aa, Mycobacterium tuberculosis
LGGQPIEAG

SEQ ID NO: 1407245 - protein, 6 aa, Mycobacterium tuberculosis
LGGSSS

SEQ ID NO: 1407246 - protein, 6 aa, Mycobacterium tuberculosis
LGGTRD

SEQ ID NO: 1407247 - protein, 4 aa, Mycobacterium tuberculosis
LGHR

SEQ ID NO: 1407248 - protein, 8 aa, Mycobacterium tuberculosis
LGKGGGRL

SEQ ID NO: 1407249 - protein, 11 aa, Mycobacterium tuberculosis
LGNPADAPQLA

SEQ ID NO: 1407250 - protein, 6 aa, Mycobacterium tuberculosis
LGPART

SEQ ID NO: 1407251 - protein, 10 aa, Mycobacterium tuberculosis
LGPDPDDEGD

SEQ ID NO: 1407252 - protein, 6 aa, Mycobacterium tuberculosis
LGPKNS

SEQ ID NO: 1407253 - protein, 4 aa, Mycobacterium tuberculosis
LGPN

SEQ ID NO: 1407254 - protein, 10 aa, Mycobacterium tuberculosis
LGQNRSGTSK

SEQ ID NO: 1407255 - protein, 11 aa, Mycobacterium tuberculosis
LGSAGLGDQPL

SEQ ID NO: 1407256 - protein, 8 aa, Mycobacterium tuberculosis
LGSDPDGW

SEQ ID NO: 1407257 - protein, 6 aa, Mycobacterium tuberculosis
LGSGGL

SEQ ID NO: 1407258 - protein, 7 aa, Mycobacterium tuberculosis
LGSGRRY

SEQ ID NO: 1407259 - protein, 9 aa, Mycobacterium tuberculosis
LGSPEDAIT

SEQ ID NO: 1407260 - protein, 7 aa, Mycobacterium tuberculosis
LGSPTTV

SEQ ID NO: 1407261 - protein, 5 aa, Mycobacterium tuberculosis
LGSSP

SEQ ID NO: 1407262 - protein, 6 aa, Mycobacterium tuberculosis
LGTERA

SEQ ID NO: 1407263 - protein, 6 aa, Mycobacterium tuberculosis
LGTPPA

SEQ ID NO: 1407264 - protein, 4 aa, Mycobacterium tuberculosis
LGTR

SEQ ID NO: 1407265 - protein, 4 aa, Mycobacterium tuberculosis
LHPG

SEQ ID NO: 1407266 - protein, 7 aa, Mycobacterium tuberculosis
LIGGQED

SEQ ID NO: 1407267 - protein, 21 aa, Mycobacterium tuberculosis
LKASNAAAAVPTTGVVPPAAD

SEQ ID NO: 1407268 - protein, 12 aa, Mycobacterium tuberculosis
LKDGTNAVGNRT

SEQ ID NO: 1407269 - protein, 7 aa, Mycobacterium tuberculosis
LKNRTPA

SEQ ID NO: 1407270 - protein, 5 aa, Mycobacterium tuberculosis
LKPES

SEQ ID NO: 1407271 - protein, 29 aa, Mycobacterium tuberculosis
LKPSPLDPPHVPAAPTADEDLSTKPAAQV

SEQ ID NO: 1407272 - protein, 8 aa, Mycobacterium tuberculosis
LKRGGTNL

SEQ ID NO: 1407273 - protein, 12 aa, Mycobacterium tuberculosis
LLGSPGQGAYAA

SEQ ID NO: 1407274 - protein, 7 aa, Mycobacterium tuberculosis
LLPSEDD

SEQ ID NO: 1407275 - protein, 8 aa, Mycobacterium tuberculosis
LNNPDAAN

SEQ ID NO: 1407276 - protein, 10 aa, Mycobacterium tuberculosis
LNPGGSSKDR

SEQ ID NO: 1407277 - protein, 8 aa, Mycobacterium tuberculosis
LNPQVGSA

SEQ ID NO: 1407278 - protein, 6 aa, Mycobacterium tuberculosis
LNTEGV

SEQ ID NO: 1407279 - protein, 11 aa, Mycobacterium tuberculosis
LNVNGSSLAAG

SEQ ID NO: 1407280 - protein, 10 aa, Mycobacterium tuberculosis
LPAEPNPAGL

SEQ ID NO: 1407281 - protein, 13 aa, Mycobacterium tuberculosis
LPAGHGLNAQTGV

SEQ ID NO: 1407282 - protein, 7 aa, Mycobacterium tuberculosis
LPAGPPR

SEQ ID NO: 1407283 - protein, 6 aa, Mycobacterium tuberculosis
LPAGTP

SEQ ID NO: 1407284 - protein, 15 aa, Mycobacterium tuberculosis
LPAPREAMTCALAAL

SEQ ID NO: 1407285 - protein, 12 aa, Mycobacterium tuberculosis
LPASNRRLTDYD

SEQ ID NO: 1407286 - protein, 4 aa, Mycobacterium tuberculosis
LPDD

SEQ ID NO: 1407287 - protein, 9 aa, Mycobacterium tuberculosis
LPDDDRAPA

SEQ ID NO: 1407288 - protein, 15 aa, Mycobacterium tuberculosis
LPDGSTTWKRSPGGL

SEQ ID NO: 1407289 - protein, 6 aa, Mycobacterium tuberculosis
LPDGSW

SEQ ID NO: 1407290 - protein, 14 aa, Mycobacterium tuberculosis
LPDPADAENGPSLA

SEQ ID NO: 1407291 - protein, 6 aa, Mycobacterium tuberculosis
LPDTDE

SEQ ID NO: 1407292 - protein, 5 aa, Mycobacterium tuberculosis
LPEAQ

SEQ ID NO: 1407293 - protein, 12 aa, Mycobacterium tuberculosis
LPEDVNAPSGEA

SEQ ID NO: 1407294 - protein, 6 aa, Mycobacterium tuberculosis
LPEGTQ

SEQ ID NO: 1407295 - protein, 8 aa, Mycobacterium tuberculosis
LPEPPLPG

SEQ ID NO: 1407296 - protein, 10 aa, Mycobacterium tuberculosis
LPETTPSTSV

SEQ ID NO: 1407297 - protein, 15 aa, Mycobacterium tuberculosis
LPGAADREVGDPEEL

SEQ ID NO: 1407298 - protein, 4 aa, Mycobacterium tuberculosis
LPGI

SEQ ID NO: 1407299 - protein, 8 aa, Mycobacterium tuberculosis
LPGPSPEL

SEQ ID NO: 1407300 - protein, 8 aa, Mycobacterium tuberculosis
LPGRGAAT

SEQ ID NO: 1407301 - protein, 8 aa, Mycobacterium tuberculosis
LPGTGTAT

SEQ ID NO: 1407302 - protein, 5 aa, Mycobacterium tuberculosis
LPHRP

SEQ ID NO: 1407303 - protein, 6 aa, Mycobacterium tuberculosis
LPLGES

SEQ ID NO: 1407304 - protein, 10 aa, Mycobacterium tuberculosis
LPNGASASID

SEQ ID NO: 1407305 - protein, 9 aa, Mycobacterium tuberculosis
LPPAAAAAT

SEQ ID NO: 1407306 - protein, 9 aa, Mycobacterium tuberculosis
LPPAQTRAA

SEQ ID NO: 1407307 - protein, 12 aa, Mycobacterium tuberculosis
LPPDPASRDICG

SEQ ID NO: 1407308 - protein, 6 aa, Mycobacterium tuberculosis
LPPEGA

SEQ ID NO: 1407309 - protein, 8 aa, Mycobacterium tuberculosis
LPPNPDTH

SEQ ID NO: 1407310 - protein, 9 aa, Mycobacterium tuberculosis
LPPQAAGTV

SEQ ID NO: 1407311 - protein, 5 aa, Mycobacterium tuberculosis
LPPSQ

SEQ ID NO: 1407312 - protein, 6 aa, Mycobacterium tuberculosis
LPQTTD

SEQ ID NO: 1407313 - protein, 6 aa, Mycobacterium tuberculosis
LPRPGA

SEQ ID NO: 1407314 - protein, 6 aa, Mycobacterium tuberculosis
LPSTAT

SEQ ID NO: 1407315 - protein, 10 aa, Mycobacterium tuberculosis
LPTAKRPPVR

SEQ ID NO: 1407316 - protein, 4 aa, Mycobacterium tuberculosis
LPTD

SEQ ID NO: 1407317 - protein, 8 aa, Mycobacterium tuberculosis
LPTPVNPW

SEQ ID NO: 1407318 - protein, 9 aa, Mycobacterium tuberculosis
LPVKTGSID

SEQ ID NO: 1407319 - protein, 9 aa, Mycobacterium tuberculosis
LPVSDRGRL

SEQ ID NO: 1407320 - protein, 8 aa, Mycobacterium tuberculosis
LQDPPSDD

SEQ ID NO: 1407321 - protein, 10 aa, Mycobacterium tuberculosis
LQNATPDIRP

SEQ ID NO: 1407322 - protein, 6 aa, Mycobacterium tuberculosis
LQPADQ

SEQ ID NO: 1407323 - protein, 6 aa, Mycobacterium tuberculosis
LQTPKA

SEQ ID NO: 1407324 - protein, 8 aa, Mycobacterium tuberculosis
LQTTASTY

SEQ ID NO: 1407325 - protein, 16 aa, Mycobacterium tuberculosis
LRDEDEGKDENHNGAN

SEQ ID NO: 1407326 - protein, 5 aa, Mycobacterium tuberculosis
LRDEP

SEQ ID NO: 1407327 - protein, 14 aa, Mycobacterium tuberculosis
LRDQQAAADRAKAS

SEQ ID NO: 1407328 - protein, 6 aa, Mycobacterium tuberculosis
LRGRES

SEQ ID NO: 1407329 - protein, 17 aa, Mycobacterium tuberculosis
LRKPGQPVPANLGPDPL

SEQ ID NO: 1407330 - protein, 16 aa, Mycobacterium tuberculosis
LRNPGAPVPANLGPEP

SEQ ID NO: 1407331 - protein, 7 aa, Mycobacterium tuberculosis
LRPPRTP

SEQ ID NO: 1407332 - protein, 6 aa, Mycobacterium tuberculosis
LRQQTR

SEQ ID NO: 1407333 - protein, 4 aa, Mycobacterium tuberculosis
LRRR

SEQ ID NO: 1407334 - protein, 4 aa, Mycobacterium tuberculosis
LRSA

SEQ ID NO: 1407335 - protein, 19 aa, Mycobacterium tuberculosis
LRTGPTPWSGSETLPGGTE

SEQ ID NO: 1407336 - protein, 10 aa, Mycobacterium tuberculosis
LRTPGDPVTR

SEQ ID NO: 1407337 - protein, 12 aa, Mycobacterium tuberculosis
LSAAATAGASHA

SEQ ID NO: 1407338 - protein, 9 aa, Mycobacterium tuberculosis
LSAARGRLG

SEQ ID NO: 1407339 - protein, 15 aa, Mycobacterium tuberculosis
LSAGDTIDVLPPFAG

SEQ ID NO: 1407340 - protein, 12 aa, Mycobacterium tuberculosis
LSAPDSRLATQS

SEQ ID NO: 1407341 - protein, 12 aa, Mycobacterium tuberculosis
LSATTAATAGAE

SEQ ID NO: 1407342 - protein, 5 aa, Mycobacterium tuberculosis
LSDEE

SEQ ID NO: 1407343 - protein, 7 aa, Mycobacterium tuberculosis
LSDPSGY

SEQ ID NO: 1407344 - protein, 10 aa, Mycobacterium tuberculosis
LSEDAEGPGA

SEQ ID NO: 1407345 - protein, 7 aa, Mycobacterium tuberculosis
LSEQRNA

SEQ ID NO: 1407346 - protein, 8 aa, Mycobacterium tuberculosis
LSGGQRRR

SEQ ID NO: 1407347 - protein, 7 aa, Mycobacterium tuberculosis
LSGNPTF

SEQ ID NO: 1407348 - protein, 11 aa, Mycobacterium tuberculosis
LSGQREPGPVP

SEQ ID NO: 1407349 - protein, 7 aa, Mycobacterium tuberculosis
LSGSESL

SEQ ID NO: 1407350 - protein, 7 aa, Mycobacterium tuberculosis
LSNGGTA

SEQ ID NO: 1407351 - protein, 15 aa, Mycobacterium tuberculosis
LSNQKHTDLTARYGR

SEQ ID NO: 1407352 - protein, 6 aa, Mycobacterium tuberculosis
LSPAQL

SEQ ID NO: 1407353 - protein, 6 aa, Mycobacterium tuberculosis
LSPARD

SEQ ID NO: 1407354 - protein, 5 aa, Mycobacterium tuberculosis
LSPPG

SEQ ID NO: 1407355 - protein, 6 aa, Mycobacterium tuberculosis
LSPRAA

SEQ ID NO: 1407356 - protein, 7 aa, Mycobacterium tuberculosis
LSRASSI

SEQ ID NO: 1407357 - protein, 6 aa, Mycobacterium tuberculosis
LSRDGA

SEQ ID NO: 1407358 - protein, 10 aa, Mycobacterium tuberculosis
LSSAATGYGA

SEQ ID NO: 1407359 - protein, 8 aa, Mycobacterium tuberculosis
LSSAGRTI

SEQ ID NO: 1407360 - protein, 7 aa, Mycobacterium tuberculosis
LSSRRGR

SEQ ID NO: 1407361 - protein, 8 aa, Mycobacterium tuberculosis
LSSSARAR

SEQ ID NO: 1407362 - protein, 8 aa, Mycobacterium tuberculosis
LSTDPATT

SEQ ID NO: 1407363 - protein, 5 aa, Mycobacterium tuberculosis
LSTNP

SEQ ID NO: 1407364 - protein, 15 aa, Mycobacterium tuberculosis
LSVEQTSELDDGRRR

SEQ ID NO: 1407365 - protein, 6 aa, Mycobacterium tuberculosis
LTDKPV

SEQ ID NO: 1407366 - protein, 7 aa, Mycobacterium tuberculosis
LTDPGEQ

SEQ ID NO: 1407367 - protein, 7 aa, Mycobacterium tuberculosis
LTDSGEH

SEQ ID NO: 1407368 - protein, 7 aa, Mycobacterium tuberculosis
LTDTNNG

SEQ ID NO: 1407369 - protein, 8 aa, Mycobacterium tuberculosis
LTGPSDDG

SEQ ID NO: 1407370 - protein, 5 aa, Mycobacterium tuberculosis
LTGTH

SEQ ID NO: 1407371 - protein, 11 aa, Mycobacterium tuberculosis
LTNSGGGFGGV

SEQ ID NO: 1407372 - protein, 7 aa, Mycobacterium tuberculosis
LTPDEAA

SEQ ID NO: 1407373 - protein, 11 aa, Mycobacterium tuberculosis
LTPGETVPSGS

SEQ ID NO: 1407374 - protein, 8 aa, Mycobacterium tuberculosis
LTPPVPGQ

SEQ ID NO: 1407375 - protein, 11 aa, Mycobacterium tuberculosis
LTPTSTRGASA

SEQ ID NO: 1407376 - protein, 4 aa, Mycobacterium tuberculosis
LTQP

SEQ ID NO: 1407377 - protein, 10 aa, Mycobacterium tuberculosis
LTRTASNMNA

SEQ ID NO: 1407378 - protein, 11 aa, Mycobacterium tuberculosis
LTSARDDLETA

SEQ ID NO: 1407379 - protein, 9 aa, Mycobacterium tuberculosis
LTSPRGKRQ

SEQ ID NO: 1407380 - protein, 7 aa, Mycobacterium tuberculosis
LTSSKLT

SEQ ID NO: 1407381 - protein, 11 aa, Mycobacterium tuberculosis
LTSSPAASGSA

SEQ ID NO: 1407382 - protein, 7 aa, Mycobacterium tuberculosis
LTSTSSV

SEQ ID NO: 1407383 - protein, 7 aa, Mycobacterium tuberculosis
LTTGEQV

SEQ ID NO: 1407384 - protein, 13 aa, Mycobacterium tuberculosis
LVSGSDAKESRGV

SEQ ID NO: 1407385 - protein, 10 aa, Mycobacterium tuberculosis
LYPDPERFDP

SEQ ID NO: 1407386 - protein, 11 aa, Mycobacterium tuberculosis
MAAEDPEAKED

SEQ ID NO: 1407387 - protein, 11 aa, Mycobacterium tuberculosis
MAGEDRTTGVA

SEQ ID NO: 1407388 - protein, 34 aa, Mycobacterium tuberculosis; identical to SEQ ID NO: 180881

SEQ ID NO: 1407389 - protein, 20 aa, Mycobacterium tuberculosis
MDGTPGHDDMPGQPAPSRGE

SEQ ID NO: 1407390 - protein, 7 aa, Mycobacterium tuberculosis
MDPDDAA

SEQ ID NO: 1407391 - protein, 18 aa, Mycobacterium tuberculosis
MEADEAAARAASRTPHES

SEQ ID NO: 1407392 - protein, 16 aa, Mycobacterium tuberculosis
MENPNAVEAEISGRTF

SEQ ID NO: 1407393 - protein, 7 aa, Mycobacterium tuberculosis
MGRNGGG

SEQ ID NO: 1407394 - protein, 14 aa, Mycobacterium tuberculosis
MGYPPAEADQAEQM

SEQ ID NO: 1407395 - protein, 9 aa, Mycobacterium tuberculosis
MKPADRERI

SEQ ID NO: 1407396 - protein, 7 aa, Mycobacterium tuberculosis
MLPPGTS

SEQ ID NO: 1407397 - protein, 6 aa, Mycobacterium tuberculosis
MPDNAT

SEQ ID NO: 1407398 - protein, 7 aa, Mycobacterium tuberculosis
MPGPTGL

SEQ ID NO: 1407399 - protein, 11 aa, Mycobacterium tuberculosis
MPNPKTGTVTA

SEQ ID NO: 1407400 - protein, 10 aa, Mycobacterium tuberculosis
MRSEGTEFRP

SEQ ID NO: 1407401 - protein, 7 aa, Mycobacterium tuberculosis
MSETSGG

SEQ ID NO: 1407402 - protein, 5 aa, Mycobacterium tuberculosis
MSPQG

SEQ ID NO: 1407403 - protein, 9 aa, Mycobacterium tuberculosis
MSRGAAKPQ

SEQ ID NO: 1407404 - protein, 7 aa, Mycobacterium tuberculosis
MTAGSGA

SEQ ID NO: 1407405 - protein, 33 aa, Mycobacterium tuberculosis; identical to SEQ ID NO: 180981

SEQ ID NO: 1407406 - protein, 7 aa, Mycobacterium tuberculosis
MTGGGFG

SEQ ID NO: 1407407 - protein, 9 aa, Mycobacterium tuberculosis
MTGNEDPEY

SEQ ID NO: 1407408 - protein, 7 aa, Mycobacterium tuberculosis
MTINGDP

SEQ ID NO: 1407409 - protein, 16 aa, Mycobacterium tuberculosis
MTPDHDGYAAVVGASK

SEQ ID NO: 1407410 - protein, 5 aa, Mycobacterium tuberculosis
MTPEA

SEQ ID NO: 1407411 - protein, 5 aa, Mycobacterium tuberculosis
MTPTS

SEQ ID NO: 1407412 - protein, 9 aa, Mycobacterium tuberculosis
NAARGTPSR

SEQ ID NO: 1407413 - protein, 9 aa, Mycobacterium tuberculosis
NADGSAAQM

SEQ ID NO: 1407414 - protein, 6 aa, Mycobacterium tuberculosis
NADPGG

SEQ ID NO: 1407415 - protein, 20 aa, Mycobacterium tuberculosis
NAEESGDDNAVDANGADQTG

SEQ ID NO: 1407416 - protein, 6 aa, Mycobacterium tuberculosis
NAEHTG

SEQ ID NO: 1407417 - protein, 8 aa, Mycobacterium tuberculosis
NAEPNAER

SEQ ID NO: 1407418 - protein, 7 aa, Mycobacterium tuberculosis
NAEVSGP

SEQ ID NO: 1407419 - protein, 10 aa, Mycobacterium tuberculosis
NAGDARHGTA

SEQ ID NO: 1407420 - protein, 7 aa, Mycobacterium tuberculosis
NANPDCT

SEQ ID NO: 1407421 - protein, 5 aa, Mycobacterium tuberculosis
NAPAQ

SEQ ID NO: 1407422 - protein, 13 aa, Mycobacterium tuberculosis
NAPTAASDEPNQV

SEQ ID NO: 1407423 - protein, 8 aa, Mycobacterium tuberculosis
NAQAYQAL

SEQ ID NO: 1407424 - protein, 5 aa, Mycobacterium tuberculosis
NAQLE

SEQ ID NO: 1407425 - protein, 11 aa, Mycobacterium tuberculosis
NARGLTPEAIG

SEQ ID NO: 1407426 - protein, 6 aa, Mycobacterium tuberculosis
NASDAL

SEQ ID NO: 1407427 - protein, 9 aa, Mycobacterium tuberculosis
NASDNNAGD

SEQ ID NO: 1407428 - protein, 6 aa, Mycobacterium tuberculosis
NASRAA

SEQ ID NO: 1407429 - protein, 5 aa, Mycobacterium tuberculosis
NATEA

SEQ ID NO: 1407430 - protein, 6 aa, Mycobacterium tuberculosis
NATGHP

SEQ ID NO: 1407431 - protein, 5 aa, Mycobacterium tuberculosis
NATSL

SEQ ID NO: 1407432 - protein, 7 aa, Mycobacterium tuberculosis
NAVDTPD

SEQ ID NO: 1407433 - protein, 4 aa, Mycobacterium tuberculosis
NAVN

SEQ ID NO: 1407434 - protein, 12 aa, Mycobacterium tuberculosis
NAVPNDPRPPMV

SEQ ID NO: 1407435 - protein, 6 aa, Mycobacterium tuberculosis
NAVQTT

SEQ ID NO: 1407436 - protein, 7 aa, Mycobacterium tuberculosis
NDALPDT

SEQ ID NO: 1407437 - protein, 9 aa, Mycobacterium tuberculosis
NDDEPLGLP

SEQ ID NO: 1407438 - protein, 10 aa, Mycobacterium tuberculosis
NDDGSDPANI

SEQ ID NO: 1407439 - protein, 5 aa, Mycobacterium tuberculosis
NDDNN

SEQ ID NO: 1407440 - protein, 10 aa, Mycobacterium tuberculosis
NDDPLDTPAR

SEQ ID NO: 1407441 - protein, 7 aa, Mycobacterium tuberculosis
NDDRNDR

SEQ ID NO: 1407442 - protein, 6 aa, Mycobacterium tuberculosis
NDEELD

SEQ ID NO: 1407443 - protein, 38 aa, Mycobacterium tuberculosis; identical to SEQ ID NO: 181133

SEQ ID NO: 1407444 - protein, 17 aa, Mycobacterium tuberculosis
NDKSPSRKTGELDNRGS

SEQ ID NO: 1407445 - protein, 27 aa, Mycobacterium tuberculosis
NDPDPALNNADTIRDRARQRAAARHGA

SEQ ID NO: 1407446 - protein, 14 aa, Mycobacterium tuberculosis
NDQPVDVPAATGRT

SEQ ID NO: 1407447 - protein, 7 aa, Mycobacterium tuberculosis
NDRANAA

SEQ ID NO: 1407448 - protein, 11 aa, Mycobacterium tuberculosis
NDRGCTKPGVR

SEQ ID NO: 1407449 - protein, 7 aa, Mycobacterium tuberculosis
NDRPTGT

SEQ ID NO: 1407450 - protein, 6 aa, Mycobacterium tuberculosis
NDSANN

SEQ ID NO: 1407451 - protein, 6 aa, Mycobacterium tuberculosis
NDTGGV

SEQ ID NO: 1407452 - protein, 11 aa, Mycobacterium tuberculosis
NDTTDGRGTTS

SEQ ID NO: 1407453 - protein, 13 aa, Mycobacterium tuberculosis
NDYAAMPDVEVIT

SEQ ID NO: 1407454 - protein, 9 aa, Mycobacterium tuberculosis
NEAETTTAS

SEQ ID NO: 1407455 - protein, 10 aa, Mycobacterium tuberculosis
NEANDKDIEE

SEQ ID NO: 1407456 - protein, 4 aa, Mycobacterium tuberculosis
NEAQ

SEQ ID NO: 1407457 - protein, 4 aa, Mycobacterium tuberculosis
NEEL

SEQ ID NO: 1407458 - protein, 8 aa, Mycobacterium tuberculosis
NEGSERSN

SEQ ID NO: 1407459 - protein, 14 aa, Mycobacterium tuberculosis
NELNAGYAADGYGR

SEQ ID NO: 1407460 - protein, 13 aa, Mycobacterium tuberculosis
NELPPQATASQEA

SEQ ID NO: 1407461 - protein, 11 aa, Mycobacterium tuberculosis
NENGNDPTPAD

SEQ ID NO: 1407462 - protein, 6 aa, Mycobacterium tuberculosis
NERGFS

SEQ ID NO: 1407463 - protein, 7 aa, Mycobacterium tuberculosis
NETLGNS

SEQ ID NO: 1407464 - protein, 13 aa, Mycobacterium tuberculosis
NFPPNNGAVPGTR

SEQ ID NO: 1407465 - protein, 8 aa, Mycobacterium tuberculosis
NGAYNQRQ

SEQ ID NO: 1407466 - protein, 9 aa, Mycobacterium tuberculosis
NGDKSDSET

SEQ ID NO: 1407467 - protein, 4 aa, Mycobacterium tuberculosis
NGDL

SEQ ID NO: 1407468 - protein, 4 aa, Mycobacterium tuberculosis
NGDR

SEQ ID NO: 1407469 - protein, 8 aa, Mycobacterium tuberculosis
NGEAGTRV

SEQ ID NO: 1407470 - protein, 5 aa, Mycobacterium tuberculosis
NGEGE

SEQ ID NO: 1407471 - protein, 6 aa, Mycobacterium tuberculosis
NGFSNG

SEQ ID NO: 1407472 - protein, 16 aa, Mycobacterium tuberculosis
NGGAASGEIELAALNI

SEQ ID NO: 1407473 - protein, 6 aa, Mycobacterium tuberculosis
NGGKST

SEQ ID NO: 1407474 - protein, 22 aa, Mycobacterium tuberculosis
NGGNGGSGAPGQAGGAGGAAGL

SEQ ID NO: 1407475 - protein, 57 aa, Mycobacterium tuberculosis; identical to SEQ ID NO: 181336

SEQ ID NO: 1407476 - protein, 10 aa, Mycobacterium tuberculosis
NGGSAQESVV

SEQ ID NO: 1407477 - protein, 4 aa, Mycobacterium tuberculosis
NGHT

SEQ ID NO: 1407478 - protein, 25 aa, Mycobacterium tuberculosis
NGIVSTSATTCNYPPAAKDSAQDGF

SEQ ID NO: 1407479 - protein, 7 aa, Mycobacterium tuberculosis
NGKPVRE

SEQ ID NO: 1407480 - protein, 7 aa, Mycobacterium tuberculosis
NGNPAPV

SEQ ID NO: 1407481 - protein, 7 aa, Mycobacterium tuberculosis
NGQQRLK

SEQ ID NO: 1407482 - protein, 10 aa, Mycobacterium tuberculosis
NGRSYAPTIG

SEQ ID NO: 1407483 - protein, 11 aa, Mycobacterium tuberculosis
NGRSYDPTAGA

SEQ ID NO: 1407484 - protein, 14 aa, Mycobacterium tuberculosis
NGTAPSASSGGVDR

SEQ ID NO: 1407485 - protein, 5 aa, Mycobacterium tuberculosis
NGTAT

SEQ ID NO: 1407486 - protein, 8 aa, Mycobacterium tuberculosis
NGTPPPEV

SEQ ID NO: 1407487 - protein, 13 aa, Mycobacterium tuberculosis
NGTTVAAASSIEA

SEQ ID NO: 1407488 - protein, 9 aa, Mycobacterium tuberculosis
NGVAPPDTT

SEQ ID NO: 1407489 - protein, 16 aa, Mycobacterium tuberculosis
NGVTGTAAAPNGGPGG

SEQ ID NO: 1407490 - protein, 10 aa, Mycobacterium tuberculosis
NGWATTPITE

SEQ ID NO: 1407491 - protein, 6 aa, Mycobacterium tuberculosis
NGWEIP

SEQ ID NO: 1407492 - protein, 4 aa, Mycobacterium tuberculosis
NHDE

SEQ ID NO: 1407493 - protein, 10 aa, Mycobacterium tuberculosis
NHDPLDASSV

SEQ ID NO: 1407494 - protein, 7 aa, Mycobacterium tuberculosis
NHHSAGM

SEQ ID NO: 1407495 - protein, 11 aa, Mycobacterium tuberculosis
NHRGHGTELGQ

SEQ ID NO: 1407496 - protein, 6 aa, Mycobacterium tuberculosis
NHYPED

SEQ ID NO: 1407497 - protein, 12 aa, Mycobacterium tuberculosis
NIAGGDETLPYT

SEQ ID NO: 1407498 - protein, 10 aa, Mycobacterium tuberculosis
NIATADPTAT

SEQ ID NO: 1407499 - protein, 8 aa, Mycobacterium tuberculosis
NIENQSSG

SEQ ID NO: 1407500 - protein, 13 aa, Mycobacterium tuberculosis
NIGNSAVTSSIAE

SEQ ID NO: 1407501 - protein, 5 aa, Mycobacterium tuberculosis
NIPDE

SEQ ID NO: 1407502 - protein, 4 aa, Mycobacterium tuberculosis
NISG

SEQ ID NO: 1407503 - protein, 6 aa, Mycobacterium tuberculosis
NKAGRW

SEQ ID NO: 1407504 - protein, 11 aa, Mycobacterium tuberculosis
NKENPVDRASA

SEQ ID NO: 1407505 - protein, 4 aa, Mycobacterium tuberculosis
NKEV

SEQ ID NO: 1407506 - protein, 9 aa, Mycobacterium tuberculosis
NKTAGQAAV

SEQ ID NO: 1407507 - protein, 4 aa, Mycobacterium tuberculosis
NLDP

SEQ ID NO: 1407508 - protein, 6 aa, Mycobacterium tuberculosis
NLPADT

SEQ ID NO: 1407509 - protein, 8 aa, Mycobacterium tuberculosis
NLRPNSSV

SEQ ID NO: 1407510 - protein, 10 aa, Mycobacterium tuberculosis
NLTEAERTGL

SEQ ID NO: 1407511 - protein, 8 aa, Mycobacterium tuberculosis
NLTPGPRA

SEQ ID NO: 1407512 - protein, 24 aa, Mycobacterium tuberculosis
NNANRYTNYQSRTSRPIPVVVLTR

SEQ ID NO: 1407513 - protein, 9 aa, Mycobacterium tuberculosis
NNDLRRGGT

SEQ ID NO: 1407514 - protein, 9 aa, Mycobacterium tuberculosis
NNPAKRVGL

SEQ ID NO: 1407515 - protein, 7 aa, Mycobacterium tuberculosis
NNRETGE

SEQ ID NO: 1407516 - protein, 9 aa, Mycobacterium tuberculosis
NNRGKKSVT

SEQ ID NO: 1407517 - protein, 5 aa, Mycobacterium tuberculosis
NNRPR

SEQ ID NO: 1407518 - protein, 7 aa, Mycobacterium tuberculosis
NPANGEP

SEQ ID NO: 1407519 - protein, 6 aa, Mycobacterium tuberculosis
NPAPYT

SEQ ID NO: 1407520 - protein, 10 aa, Mycobacterium tuberculosis
NPATDAQRES

SEQ ID NO: 1407521 - protein, 8 aa, Mycobacterium tuberculosis
NPEDPGSA

SEQ ID NO: 1407522 - protein, 6 aa, Mycobacterium tuberculosis
NPERTA

SEQ ID NO: 1407523 - protein, 9 aa, Mycobacterium tuberculosis
NPGANYART

SEQ ID NO: 1407524 - protein, 10 aa, Mycobacterium tuberculosis
NPGESPRERH

SEQ ID NO: 1407525 - protein, 4 aa, Mycobacterium tuberculosis
NPIE

SEQ ID NO: 1407526 - protein, 5 aa, Mycobacterium tuberculosis
NPIEY

SEQ ID NO: 1407527 - protein, 8 aa, Mycobacterium tuberculosis
NPLPGRPA

SEQ ID NO: 1407528 - protein, 21 aa, Mycobacterium tuberculosis
NPNALSNDSGTSSLAHGSTGQ

SEQ ID NO: 1407529 - protein, 13 aa, Mycobacterium tuberculosis
NPPAPMAPGRAEN

SEQ ID NO: 1407530 - protein, 8 aa, Mycobacterium tuberculosis
NPQQTEAT

SEQ ID NO: 1407531 - protein, 5 aa, Mycobacterium tuberculosis
NPRLT

SEQ ID NO: 1407532 - protein, 6 aa, Mycobacterium tuberculosis
NPRPED

SEQ ID NO: 1407533 - protein, 11 aa, Mycobacterium tuberculosis
NPRPTNPEGKM

SEQ ID NO: 1407534 - protein, 14 aa, Mycobacterium tuberculosis
NPRRLTKAEAAPYV

SEQ ID NO: 1407535 - protein, 9 aa, Mycobacterium tuberculosis
NPSARAEDD

SEQ ID NO: 1407536 - protein, 8 aa, Mycobacterium tuberculosis
NPTPVTGQ

SEQ ID NO: 1407537 - protein, 4 aa, Mycobacterium tuberculosis
NQHG

SEQ ID NO: 1407538 - protein, 7 aa, Mycobacterium tuberculosis
NQLRDNQ

SEQ ID NO: 1407539 - protein, 5 aa, Mycobacterium tuberculosis
NQPGV

SEQ ID NO: 1407540 - protein, 26 aa, Mycobacterium tuberculosis
NQPTPPGPGVTPTDPRPFRAGPHETS

SEQ ID NO: 1407541 - protein, 6 aa, Mycobacterium tuberculosis
NQPVQN

SEQ ID NO: 1407542 - protein, 6 aa, Mycobacterium tuberculosis
NQQEQA

SEQ ID NO: 1407543 - protein, 8 aa, Mycobacterium tuberculosis
NQSDAADR

SEQ ID NO: 1407544 - protein, 8 aa, Mycobacterium tuberculosis
NQTWSTPA

SEQ ID NO: 1407545 - protein, 7 aa, Mycobacterium tuberculosis
NRAPAKV

SEQ ID NO: 1407546 - protein, 10 aa, Mycobacterium tuberculosis
NRDGRHTTTE

SEQ ID NO: 1407547 - protein, 5 aa, Mycobacterium tuberculosis
NRDKR

SEQ ID NO: 1407548 - protein, 5 aa, Mycobacterium tuberculosis
NREDM

SEQ ID NO: 1407549 - protein, 7 aa, Mycobacterium tuberculosis
NRGPGGK

SEQ ID NO: 1407550 - protein, 9 aa, Mycobacterium tuberculosis
NRPPTQDTV

SEQ ID NO: 1407551 - protein, 58 aa, Mycobacterium tuberculosis; identical to SEQ ID NO: 181741

SEQ ID NO: 1407552 - protein, 12 aa, Mycobacterium tuberculosis
NSGGKTAEAAAH

SEQ ID NO: 1407553 - protein, 9 aa, Mycobacterium tuberculosis
NSGLANVGN

SEQ ID NO: 1407554 - protein, 9 aa, Mycobacterium tuberculosis
NSGPLPEEI

SEQ ID NO: 1407555 - protein, 31 aa, Mycobacterium tuberculosis; identical to SEQ ID NO: 181758

SEQ ID NO: 1407556 - protein, 16 aa, Mycobacterium tuberculosis
NSGSGNIGIGNSGTNN

SEQ ID NO: 1407557 - protein, 16 aa, Mycobacterium tuberculosis
NSGSGNLGFGNSGNGN

SEQ ID NO: 1407558 - protein, 4 aa, Mycobacterium tuberculosis
NSHG

SEQ ID NO: 1407559 - protein, 12 aa, Mycobacterium tuberculosis
NSMTTNGVSHSR

SEQ ID NO: 1407560 - protein, 13 aa, Mycobacterium tuberculosis
NSRDHDGQKGDRE

SEQ ID NO: 1407561 - protein, 9 aa, Mycobacterium tuberculosis
NSRSEAATE

SEQ ID NO: 1407562 - protein, 8 aa, Mycobacterium tuberculosis
NSTASIPE

SEQ ID NO: 1407563 - protein, 6 aa, Mycobacterium tuberculosis
NSTWGG

SEQ ID NO: 1407564 - protein, 10 aa, Mycobacterium tuberculosis
NSVSSPDDTT

SEQ ID NO: 1407565 - protein, 8 aa, Mycobacterium tuberculosis
NTAGGDHA

SEQ ID NO: 1407566 - protein, 7 aa, Mycobacterium tuberculosis
NTDLPGT

SEQ ID NO: 1407567 - protein, 4 aa, Mycobacterium tuberculosis
NTED

SEQ ID NO: 1407568 - protein, 9 aa, Mycobacterium tuberculosis
NTESANGGQ

SEQ ID NO: 1407569 - protein, 28 aa, Mycobacterium tuberculosis
NTGFGNSGSLNTGMGNAGGVNTGFGNGG

SEQ ID NO: 1407570 - protein, 6 aa, Mycobacterium tuberculosis
NTGQQV

SEQ ID NO: 1407571 - protein, 6 aa, Mycobacterium tuberculosis
NTGSAN

SEQ ID NO: 1407572 - protein, 12 aa, Mycobacterium tuberculosis
NTHEGGTHEEGF

SEQ ID NO: 1407573 - protein, 13 aa, Mycobacterium tuberculosis
NTQGTGMGGGTSM

SEQ ID NO: 1407574 - protein, 8 aa, Mycobacterium tuberculosis
NTSSAYAK

SEQ ID NO: 1407575 - protein, 13 aa, Mycobacterium tuberculosis
NTTSAATPAISGD

SEQ ID NO: 1407576 - protein, 9 aa, Mycobacterium tuberculosis
NTVDGGTPV

SEQ ID NO: 1407577 - protein, 8 aa, Mycobacterium tuberculosis
NVETSQAI

SEQ ID NO: 1407578 - protein, 4 aa, Mycobacterium tuberculosis
NVNG

SEQ ID NO: 1407579 - protein, 5 aa, Mycobacterium tuberculosis
NYPDG

SEQ ID NO: 1407580 - protein, 6 aa, Mycobacterium tuberculosis
NYQPGT

SEQ ID NO: 1407581 - protein, 10 aa, Mycobacterium tuberculosis
NYTTPSGQHG

SEQ ID NO: 1407582 - protein, 5 aa, Mycobacterium tuberculosis
PAAAT

SEQ ID NO: 1407583 - protein, 5 aa, Mycobacterium tuberculosis
PAAED

SEQ ID NO: 1407584 - protein, 18 aa, Mycobacterium tuberculosis
PAAKRDPARGTVSTHDPR

SEQ ID NO: 1407585 - protein, 14 aa, Mycobacterium tuberculosis
PAAPTALQAAAGDI

SEQ ID NO: 1407586 - protein, 7 aa, Mycobacterium tuberculosis
PAARATD

SEQ ID NO: 1407587 - protein, 14 aa, Mycobacterium tuberculosis
PAARSPQSQDTATT

SEQ ID NO: 1407588 - protein, 4 aa, Mycobacterium tuberculosis
PAAV

SEQ ID NO: 1407589 - protein, 5 aa, Mycobacterium tuberculosis
PAAVP

SEQ ID NO: 1407590 - protein, 4 aa, Mycobacterium tuberculosis
PADA

SEQ ID NO: 1407591 - protein, 8 aa, Mycobacterium tuberculosis
PADANETA

SEQ ID NO: 1407592 - protein, 8 aa, Mycobacterium tuberculosis
PADARDYG

SEQ ID NO: 1407593 - protein, 7 aa, Mycobacterium tuberculosis
PADASAL

SEQ ID NO: 1407594 - protein, 8 aa, Mycobacterium tuberculosis
PADPRDPD

SEQ ID NO: 1407595 - protein, 9 aa, Mycobacterium tuberculosis
PADRATDGA

SEQ ID NO: 1407596 - protein, 7 aa, Mycobacterium tuberculosis
PADTPGL

SEQ ID NO: 1407597 - protein, 9 aa, Mycobacterium tuberculosis
PAEAPTTRG

SEQ ID NO: 1407598 - protein, 10 aa, Mycobacterium tuberculosis
PAGATNGSGQ

SEQ ID NO: 1407599 - protein, 6 aa, Mycobacterium tuberculosis
PAGMTD

SEQ ID NO: 1407600 - protein, 10 aa, Mycobacterium tuberculosis
PAGPSGSPLR

SEQ ID NO: 1407601 - protein, 7 aa, Mycobacterium tuberculosis
PAGRAEA

SEQ ID NO: 1407602 - protein, 14 aa, Mycobacterium tuberculosis
PAGSPSSVPDDLDP

SEQ ID NO: 1407603 - protein, 9 aa, Mycobacterium tuberculosis
PAGSTTPPL

SEQ ID NO: 1407604 - protein, 6 aa, Mycobacterium tuberculosis
PAGTGP

SEQ ID NO: 1407605 - protein, 15 aa, Mycobacterium tuberculosis
PAGYGSSAVTPPGGY

SEQ ID NO: 1407606 - protein, 5 aa, Mycobacterium tuberculosis
PALRE

SEQ ID NO: 1407607 - protein, 7 aa, Mycobacterium tuberculosis
PAPATGA

SEQ ID NO: 1407608 - protein, 9 aa, Mycobacterium tuberculosis
PAPATTDSD

SEQ ID NO: 1407609 - protein, 17 aa, Mycobacterium tuberculosis
PAPQAPQSASGEMLPSG

SEQ ID NO: 1407610 - protein, 4 aa, Mycobacterium tuberculosis
PAPR

SEQ ID NO: 1407611 - protein, 5 aa, Mycobacterium tuberculosis
PAPRD

SEQ ID NO: 1407612 - protein, 14 aa, Mycobacterium tuberculosis
PAPVPPPSGRVGGY

SEQ ID NO: 1407613 - protein, 4 aa, Mycobacterium tuberculosis
PAQA

SEQ ID NO: 1407614 - protein, 8 aa, Mycobacterium tuberculosis
PARDPGPL

SEQ ID NO: 1407615 - protein, 4 aa, Mycobacterium tuberculosis
PARL

SEQ ID NO: 1407616 - protein, 7 aa, Mycobacterium tuberculosis
PARNADA

SEQ ID NO: 1407617 - protein, 8 aa, Mycobacterium tuberculosis
PASPGTGV

SEQ ID NO: 1407618 - protein, 4 aa, Mycobacterium tuberculosis
PATG

SEQ ID NO: 1407619 - protein, 9 aa, Mycobacterium tuberculosis
PATGTTKSD

SEQ ID NO: 1407620 - protein, 7 aa, Mycobacterium tuberculosis
PATLGTK

SEQ ID NO: 1407621 - protein, 5 aa, Mycobacterium tuberculosis
PATQD

SEQ ID NO: 1407622 - protein, 4 aa, Mycobacterium tuberculosis
PAVA

SEQ ID NO: 1407623 - protein, 8 aa, Mycobacterium tuberculosis
PAYTPAGL

SEQ ID NO: 1407624 - protein, 10 aa, Mycobacterium tuberculosis
PCGGSPRRAV

SEQ ID NO: 1407625 - protein, 4 aa, Mycobacterium tuberculosis
PDAD

SEQ ID NO: 1407626 - protein, 5 aa, Mycobacterium tuberculosis
PDAEA

SEQ ID NO: 1407627 - protein, 9 aa, Mycobacterium tuberculosis
PDAEAGKDL

SEQ ID NO: 1407628 - protein, 8 aa, Mycobacterium tuberculosis
PDAGGPRD

SEQ ID NO: 1407629 - protein, 14 aa, Mycobacterium tuberculosis
PDAGPPLWAMWREP

SEQ ID NO: 1407630 - protein, 7 aa, Mycobacterium tuberculosis
PDAHRES

SEQ ID NO: 1407631 - protein, 5 aa, Mycobacterium tuberculosis
PDATV

SEQ ID NO: 1407632 - protein, 5 aa, Mycobacterium tuberculosis
PDAVP

SEQ ID NO: 1407633 - protein, 6 aa, Mycobacterium tuberculosis
PDAVTT

SEQ ID NO: 1407634 - protein, 14 aa, Mycobacterium tuberculosis
PDDADSEPSPPLAK

SEQ ID NO: 1407635 - protein, 5 aa, Mycobacterium tuberculosis
PDDAS

SEQ ID NO: 1407636 - protein, 10 aa, Mycobacterium tuberculosis
PDDESLSNGA

SEQ ID NO: 1407637 - protein, 8 aa, Mycobacterium tuberculosis
PDDPPGRR

SEQ ID NO: 1407638 - protein, 6 aa, Mycobacterium tuberculosis
PDDRTE

SEQ ID NO: 1407639 - protein, 5 aa, Mycobacterium tuberculosis
PDEAA

SEQ ID NO: 1407640 - protein, 15 aa, Mycobacterium tuberculosis
PDEAAALGDELKGVT

SEQ ID NO: 1407641 - protein, 5 aa, Mycobacterium tuberculosis
PDEGY

SEQ ID NO: 1407642 - protein, 6 aa, Mycobacterium tuberculosis
PDEQEL

SEQ ID NO: 1407643 - protein, 7 aa, Mycobacterium tuberculosis
PDEQRGA

SEQ ID NO: 1407644 - protein, 6 aa, Mycobacterium tuberculosis
PDEVPI

SEQ ID NO: 1407645 - protein, 15 aa, Mycobacterium tuberculosis
PDGDYTDEDRARRRG

SEQ ID NO: 1407646 - protein, 6 aa, Mycobacterium tuberculosis
PDGGAT

SEQ ID NO: 1407647 - protein, 9 aa, Mycobacterium tuberculosis
PDGPDGQRT

SEQ ID NO: 1407648 - protein, 7 aa, Mycobacterium tuberculosis
PDGPGRW

SEQ ID NO: 1407649 - protein, 9 aa, Mycobacterium tuberculosis
PDKEEAQEL

SEQ ID NO: 1407650 - protein, 4 aa, Mycobacterium tuberculosis
PDLA

SEQ ID NO: 1407651 - protein, 8 aa, Mycobacterium tuberculosis
PDLPGPLS

SEQ ID NO: 1407652 - protein, 5 aa, Mycobacterium tuberculosis
PDNPV

SEQ ID NO: 1407653 - protein, 9 aa, Mycobacterium tuberculosis
PDPDWDGRT

SEQ ID NO: 1407654 - protein, 8 aa, Mycobacterium tuberculosis
PDPGTDPV

SEQ ID NO: 1407655 - protein, 8 aa, Mycobacterium tuberculosis
PDRSEGDL

SEQ ID NO: 1407656 - protein, 6 aa, Mycobacterium tuberculosis
PDRTHR

SEQ ID NO: 1407657 - protein, 4 aa, Mycobacterium tuberculosis
PDRV

SEQ ID NO: 1407658 - protein, 8 aa, Mycobacterium tuberculosis
PDRVTRDA

SEQ ID NO: 1407659 - protein, 12 aa, Mycobacterium tuberculosis
PDSHPQSAAAAR

SEQ ID NO: 1407660 - protein, 8 aa, Mycobacterium tuberculosis
PDSTIAGR

SEQ ID NO: 1407661 - protein, 4 aa, Mycobacterium tuberculosis
PDTG

SEQ ID NO: 1407662 - protein, 15 aa, Mycobacterium tuberculosis
PDTGPEAGAELPDGE

SEQ ID NO: 1407663 - protein, 4 aa, Mycobacterium tuberculosis
PDTM

SEQ ID NO: 1407664 - protein, 8 aa, Mycobacterium tuberculosis
PDTPATAT

SEQ ID NO: 1407665 - protein, 5 aa, Mycobacterium tuberculosis
PDTSI

SEQ ID NO: 1407666 - protein, 12 aa, Mycobacterium tuberculosis
PDVNPDEAAQAK

SEQ ID NO: 1407667 - protein, 7 aa, Mycobacterium tuberculosis
PDVSAPR

SEQ ID NO: 1407668 - protein, 18 aa, Mycobacterium tuberculosis
PDYGPPGGPLGDPSRRTS

SEQ ID NO: 1407669 - protein, 13 aa, Mycobacterium tuberculosis
PEAGPGDGGVPDD

SEQ ID NO: 1407670 - protein, 9 aa, Mycobacterium tuberculosis
PEAGTPNSP

SEQ ID NO: 1407671 - protein, 7 aa, Mycobacterium tuberculosis
PEARTAD

SEQ ID NO: 1407672 - protein, 13 aa, Mycobacterium tuberculosis
PEASLADATDRLR

SEQ ID NO: 1407673 - protein, 6 aa, Mycobacterium tuberculosis
PEATRR

SEQ ID NO: 1407674 - protein, 9 aa, Mycobacterium tuberculosis
PEDGGGIPW

SEQ ID NO: 1407675 - protein, 8 aa, Mycobacterium tuberculosis
PEEERNRA

SEQ ID NO: 1407676 - protein, 5 aa, Mycobacterium tuberculosis
PEEQR

SEQ ID NO: 1407677 - protein, 10 aa, Mycobacterium tuberculosis
PEGACPGPFG

SEQ ID NO: 1407678 - protein, 11 aa, Mycobacterium tuberculosis
PEGAPDSTRGV

SEQ ID NO: 1407679 - protein, 16 aa, Mycobacterium tuberculosis
PEGQRADGENTESDRA

SEQ ID NO: 1407680 - protein, 6 aa, Mycobacterium tuberculosis
PEHGGL

SEQ ID NO: 1407681 - protein, 6 aa, Mycobacterium tuberculosis
PEHGPG

SEQ ID NO: 1407682 - protein, 10 aa, Mycobacterium tuberculosis
PEHPAPAAVE

SEQ ID NO: 1407683 - protein, 21 aa, Mycobacterium tuberculosis
PEHTGAITARSDRADGSARIP

SEQ ID NO: 1407684 - protein, 10 aa, Mycobacterium tuberculosis
PEKGGSTREA

SEQ ID NO: 1407685 - protein, 7 aa, Mycobacterium tuberculosis
PELAPGR

SEQ ID NO: 1407686 - protein, 8 aa, Mycobacterium tuberculosis
PEPATEDY

SEQ ID NO: 1407687 - protein, 16 aa, Mycobacterium tuberculosis
PEPLPAPQTPAPVPDV

SEQ ID NO: 1407688 - protein, 7 aa, Mycobacterium tuberculosis
PEPQPYP

SEQ ID NO: 1407689 - protein, 10 aa, Mycobacterium tuberculosis
PEPRPPQQET

SEQ ID NO: 1407690 - protein, 4 aa, Mycobacterium tuberculosis
PERA

SEQ ID NO: 1407691 - protein, 5 aa, Mycobacterium tuberculosis
PERID

SEQ ID NO: 1407692 - protein, 5 aa, Mycobacterium tuberculosis
PESTR

SEQ ID NO: 1407693 - protein, 7 aa, Mycobacterium tuberculosis
PETGERT

SEQ ID NO: 1407694 - protein, 9 aa, Mycobacterium tuberculosis
PETVGSSAA

SEQ ID NO: 1407695 - protein, 9 aa, Mycobacterium tuberculosis
PEVGDGEAG

SEQ ID NO: 1407696 - protein, 11 aa, Mycobacterium tuberculosis
PFEPTERGGRL

SEQ ID NO: 1407697 - protein, 9 aa, Mycobacterium tuberculosis
PFGATGQAL

SEQ ID NO: 1407698 - protein, 11 aa, Mycobacterium tuberculosis
PFGSRNPDTNL

SEQ ID NO: 1407699 - protein, 7 aa, Mycobacterium tuberculosis
PFNPGSR

SEQ ID NO: 1407700 - protein, 11 aa, Mycobacterium tuberculosis
PFPSGVQTAEN

SEQ ID NO: 1407701 - protein, 4 aa, Mycobacterium tuberculosis
PGAE

SEQ ID NO: 1407702 - protein, 8 aa, Mycobacterium tuberculosis
PGAGCTED

SEQ ID NO: 1407703 - protein, 5 aa, Mycobacterium tuberculosis
PGAGP

SEQ ID NO: 1407704 - protein, 14 aa, Mycobacterium tuberculosis
PGAGVDRPILEVPV

SEQ ID NO: 1407705 - protein, 5 aa, Mycobacterium tuberculosis
PGALG

SEQ ID NO: 1407706 - protein, 6 aa, Mycobacterium tuberculosis
PGARTA

SEQ ID NO: 1407707 - protein, 7 aa, Mycobacterium tuberculosis
PGASGRI

SEQ ID NO: 1407708 - protein, 9 aa, Mycobacterium tuberculosis
PGASRGRGL

SEQ ID NO: 1407709 - protein, 5 aa, Mycobacterium tuberculosis
PGAVE

SEQ ID NO: 1407710 - protein, 14 aa, Mycobacterium tuberculosis
PGDAVDSDPLPGPD

SEQ ID NO: 1407711 - protein, 9 aa, Mycobacterium tuberculosis
PGDDGRVTG

SEQ ID NO: 1407712 - protein, 22 aa, Mycobacterium tuberculosis
PGDDYRDPEGTDTRNYGGQHGL

SEQ ID NO: 1407713 - protein, 5 aa, Mycobacterium tuberculosis
PGDGA

SEQ ID NO: 1407714 - protein, 14 aa, Mycobacterium tuberculosis
PGDLGTKGGIRTDV

SEQ ID NO: 1407715 - protein, 5 aa, Mycobacterium tuberculosis
PGDPA

SEQ ID NO: 1407716 - protein, 8 aa, Mycobacterium tuberculosis
PGDTTPGQ

SEQ ID NO: 1407717 - protein, 5 aa, Mycobacterium tuberculosis
PGESR

SEQ ID NO: 1407718 - protein, 16 aa, Mycobacterium tuberculosis
PGEYTQLTGRAGRRGI

SEQ ID NO: 1407719 - protein, 14 aa, Mycobacterium tuberculosis
PGFGNTTGAPSSGF

SEQ ID NO: 1407720 - protein, 4 aa, Mycobacterium tuberculosis
PGGA

SEQ ID NO: 1407721 - protein, 5 aa, Mycobacterium tuberculosis
PGGDV

SEQ ID NO: 1407722 - protein, 4 aa, Mycobacterium tuberculosis
PGGE

SEQ ID NO: 1407723 - protein, 7 aa, Mycobacterium tuberculosis
PGGEPTR

SEQ ID NO: 1407724 - protein, 7 aa, Mycobacterium tuberculosis
PGGESTT

SEQ ID NO: 1407725 - protein, 11 aa, Mycobacterium tuberculosis
PGGPDDSDYTR

SEQ ID NO: 1407726 - protein, 8 aa, Mycobacterium tuberculosis
PGGQPPTI

SEQ ID NO: 1407727 - protein, 5 aa, Mycobacterium tuberculosis
PGGTA

SEQ ID NO: 1407728 - protein, 4 aa, Mycobacterium tuberculosis
PGGV

SEQ ID NO: 1407729 - protein, 8 aa, Mycobacterium tuberculosis
PGHAEAGS

SEQ ID NO: 1407730 - protein, 4 aa, Mycobacterium tuberculosis
PGIA

SEQ ID NO: 1407731 - protein, 5 aa, Mycobacterium tuberculosis
PGIPK

SEQ ID NO: 1407732 - protein, 6 aa, Mycobacterium tuberculosis
PGLAEA

SEQ ID NO: 1407733 - protein, 4 aa, Mycobacterium tuberculosis
PGLG

SEQ ID NO: 1407734 - protein, 5 aa, Mycobacterium tuberculosis
PGNPV

SEQ ID NO: 1407735 - protein, 5 aa, Mycobacterium tuberculosis
PGPEV

SEQ ID NO: 1407736 - protein, 4 aa, Mycobacterium tuberculosis
PGPF

SEQ ID NO: 1407737 - protein, 7 aa, Mycobacterium tuberculosis
PGPGLTV

SEQ ID NO: 1407738 - protein, 6 aa, Mycobacterium tuberculosis
PGPGSV

SEQ ID NO: 1407739 - protein, 10 aa, Mycobacterium tuberculosis
PGPHRRTQRS

SEQ ID NO: 1407740 - protein, 10 aa, Mycobacterium tuberculosis
PGPLDVAEGD

SEQ ID NO: 1407741 - protein, 5 aa, Mycobacterium tuberculosis
PGPLR

SEQ ID NO: 1407742 - protein, 5 aa, Mycobacterium tuberculosis
PGPSI

SEQ ID NO: 1407743 - protein, 8 aa, Mycobacterium tuberculosis
PGQAAYNS

SEQ ID NO: 1407744 - protein, 12 aa, Mycobacterium tuberculosis
PGQHDRSGLPPL

SEQ ID NO: 1407745 - protein, 6 aa, Mycobacterium tuberculosis
PGRAMT

SEQ ID NO: 1407746 - protein, 12 aa, Mycobacterium tuberculosis
PGRWDEDGEKRI

SEQ ID NO: 1407747 - protein, 22 aa, Mycobacterium tuberculosis
PGSPFGGYKNSGIGRENGPEGV

SEQ ID NO: 1407748 - protein, 10 aa, Mycobacterium tuberculosis
PGSSPRPYGG

SEQ ID NO: 1407749 - protein, 5 aa, Mycobacterium tuberculosis
PGSTP

SEQ ID NO: 1407750 - protein, 8 aa, Mycobacterium tuberculosis
PGTYDPDQ

SEQ ID NO: 1407751 - protein, 11 aa, Mycobacterium tuberculosis
PGVGTRSAPDL

SEQ ID NO: 1407752 - protein, 7 aa, Mycobacterium tuberculosis
PGVPNAE

SEQ ID NO: 1407753 - protein, 7 aa, Mycobacterium tuberculosis
PGWGSKR

SEQ ID NO: 1407754 - protein, 6 aa, Mycobacterium tuberculosis
PGYTSA

SEQ ID NO: 1407755 - protein, 8 aa, Mycobacterium tuberculosis
PHASEAAS

SEQ ID NO: 1407756 - protein, 5 aa, Mycobacterium tuberculosis
PHDAP

SEQ ID NO: 1407757 - protein, 6 aa, Mycobacterium tuberculosis
PHDDKQ

SEQ ID NO: 1407758 - protein, 6 aa, Mycobacterium tuberculosis
PHETGR

SEQ ID NO: 1407759 - protein, 19 aa, Mycobacterium tuberculosis
PHKTSSRRVEVRSPDSACN

SEQ ID NO: 1407760 - protein, 4 aa, Mycobacterium tuberculosis
PHPT

SEQ ID NO: 1407761 - protein, 5 aa, Mycobacterium tuberculosis
PHTAE

SEQ ID NO: 1407762 - protein, 17 aa, Mycobacterium tuberculosis
PHTTADDPTRYRSQEEV

SEQ ID NO: 1407763 - protein, 6 aa, Mycobacterium tuberculosis
PHYGPP

SEQ ID NO: 1407764 - protein, 4 aa, Mycobacterium tuberculosis
PIPG

SEQ ID NO: 1407765 - protein, 8 aa, Mycobacterium tuberculosis
PIPRPPSI

SEQ ID NO: 1407766 - protein, 12 aa, Mycobacterium tuberculosis
PISRQSAEAKLG

SEQ ID NO: 1407767 - protein, 13 aa, Mycobacterium tuberculosis
PKAAAKELGPDGA

SEQ ID NO: 1407768 - protein, 10 aa, Mycobacterium tuberculosis
PKAEGTSPHL

SEQ ID NO: 1407769 - protein, 13 aa, Mycobacterium tuberculosis
PKRSPSEGSADNA

SEQ ID NO: 1407770 - protein, 8 aa, Mycobacterium tuberculosis
PKTAETAA

SEQ ID NO: 1407771 - protein, 5 aa, Mycobacterium tuberculosis
PKTGQ

SEQ ID NO: 1407772 - protein, 20 aa, Mycobacterium tuberculosis
PKTRKQSRPGVRTPTARAAG

SEQ ID NO: 1407773 - protein, 20 aa, Mycobacterium tuberculosis
PKTSAPTGPRVSIQFRPRDV

SEQ ID NO: 1407774 - protein, 10 aa, Mycobacterium tuberculosis
PLAAAEAEGA

SEQ ID NO: 1407775 - protein, 7 aa, Mycobacterium tuberculosis
PLAGESL

SEQ ID NO: 1407776 - protein, 6 aa, Mycobacterium tuberculosis
PLAGHA

SEQ ID NO: 1407777 - protein, 4 aa, Mycobacterium tuberculosis
PLAP

SEQ ID NO: 1407778 - protein, 12 aa, Mycobacterium tuberculosis
PLAQPGTGDAGG

SEQ ID NO: 1407779 - protein, 6 aa, Mycobacterium tuberculosis
PLDPDR

SEQ ID NO: 1407780 - protein, 10 aa, Mycobacterium tuberculosis
PLEATKEGRG

SEQ ID NO: 1407781 - protein, 14 aa, Mycobacterium tuberculosis
PLEPPGTPDDPDTT

SEQ ID NO: 1407782 - protein, 13 aa, Mycobacterium tuberculosis
PLHEGGNAARKSV

SEQ ID NO: 1407783 - protein, 6 aa, Mycobacterium tuberculosis
PLPPPS

SEQ ID NO: 1407784 - protein, 6 aa, Mycobacterium tuberculosis
PLRPDN

SEQ ID NO: 1407785 - protein, 7 aa, Mycobacterium tuberculosis
PLTAPGS

SEQ ID NO: 1407786 - protein, 13 aa, Mycobacterium tuberculosis
PMDAGRKGQKGIE

SEQ ID NO: 1407787 - protein, 4 aa, Mycobacterium tuberculosis
PMGP

SEQ ID NO: 1407788 - protein, 7 aa, Mycobacterium tuberculosis
PNAAGTA

SEQ ID NO: 1407789 - protein, 6 aa, Mycobacterium tuberculosis
PNAAPH

SEQ ID NO: 1407790 - protein, 8 aa, Mycobacterium tuberculosis
PNAPPSSA

SEQ ID NO: 1407791 - protein, 5 aa, Mycobacterium tuberculosis
PNATE

SEQ ID NO: 1407792 - protein, 11 aa, Mycobacterium tuberculosis
PNIDGTETPFP

SEQ ID NO: 1407793 - protein, 5 aa, Mycobacterium tuberculosis
PNIGG

SEQ ID NO: 1407794 - protein, 6 aa, Mycobacterium tuberculosis
PNLKPG

SEQ ID NO: 1407795 - protein, 7 aa, Mycobacterium tuberculosis
PNNPTGA

SEQ ID NO: 1407796 - protein, 13 aa, Mycobacterium tuberculosis
PNPAKKIERETVR

SEQ ID NO: 1407797 - protein, 10 aa, Mycobacterium tuberculosis
PNRVGPRKRP

SEQ ID NO: 1407798 - protein, 10 aa, Mycobacterium tuberculosis
PNWNPDDKTR

SEQ ID NO: 1407799 - protein, 8 aa, Mycobacterium tuberculosis
PPAGTLSG

SEQ ID NO: 1407800 - protein, 5 aa, Mycobacterium tuberculosis
PPARR

SEQ ID NO: 1407801 - protein, 7 aa, Mycobacterium tuberculosis
PPDAAAR

SEQ ID NO: 1407802 - protein, 19 aa, Mycobacterium tuberculosis
PPDAPTVTSEDVVRALEDD

SEQ ID NO: 1407803 - protein, 4 aa, Mycobacterium tuberculosis
PPFK

SEQ ID NO: 1407804 - protein, 6 aa, Mycobacterium tuberculosis
PPGAMP

SEQ ID NO: 1407805 - protein, 6 aa, Mycobacterium tuberculosis
PPGEIG

SEQ ID NO: 1407806 - protein, 5 aa, Mycobacterium tuberculosis
PPGEV

SEQ ID NO: 1407807 - protein, 6 aa, Mycobacterium tuberculosis
PPGPGF

SEQ ID NO: 1407808 - protein, 10 aa, Mycobacterium tuberculosis
PPGQAPDPSR

SEQ ID NO: 1407809 - protein, 5 aa, Mycobacterium tuberculosis
PPGRN

SEQ ID NO: 1407810 - protein, 7 aa, Mycobacterium tuberculosis
PPGSDSV

SEQ ID NO: 1407811 - protein, 8 aa, Mycobacterium tuberculosis
PPGTPAQV

SEQ ID NO: 1407812 - protein, 6 aa, Mycobacterium tuberculosis
PPGVRP

SEQ ID NO: 1407813 - protein, 19 aa, Mycobacterium tuberculosis
PPLPTGDPAADRDATRAEG

SEQ ID NO: 1407814 - protein, 16 aa, Mycobacterium tuberculosis
PPNVPQRRGQRRSSTA

SEQ ID NO: 1407815 - protein, 5 aa, Mycobacterium tuberculosis
PPNVT

SEQ ID NO: 1407816 - protein, 6 aa, Mycobacterium tuberculosis
PPPAIA

SEQ ID NO: 1407817 - protein, 10 aa, Mycobacterium tuberculosis
PPPDGEPPET

SEQ ID NO: 1407818 - protein, 5 aa, Mycobacterium tuberculosis
PPPHW

SEQ ID NO: 1407819 - protein, 26 aa, Mycobacterium tuberculosis
PPPRPRPVDGSEIPSVSTESKAMSRE

SEQ ID NO: 1407820 - protein, 6 aa, Mycobacterium tuberculosis
PPPSVC

SEQ ID NO: 1407821 - protein, 13 aa, Mycobacterium tuberculosis
PPRATNDTDIAGT

SEQ ID NO: 1407822 - protein, 9 aa, Mycobacterium tuberculosis
PPRNDPRDA

SEQ ID NO: 1407823 - protein, 25 aa, Mycobacterium tuberculosis
PPRRQPPKTVPPLRRPDVAARLAGS

SEQ ID NO: 1407824 - protein, 5 aa, Mycobacterium tuberculosis
PPRTV

SEQ ID NO: 1407825 - protein, 6 aa, Mycobacterium tuberculosis
PPTAEQ

SEQ ID NO: 1407826 - protein, 8 aa, Mycobacterium tuberculosis
PPTATPTG

SEQ ID NO: 1407827 - protein, 6 aa, Mycobacterium tuberculosis
PPTWTT

SEQ ID NO: 1407828 - protein, 11 aa, Mycobacterium tuberculosis
PPVETTSAVQE

SEQ ID NO: 1407829 - protein, 11 aa, Mycobacterium tuberculosis
PPVGDVTSPVK

SEQ ID NO: 1407830 - protein, 15 aa, Mycobacterium tuberculosis
PPVGSSADDLNDKKA

SEQ ID NO: 1407831 - protein, 5 aa, Mycobacterium tuberculosis
PPVHP

SEQ ID NO: 1407832 - protein, 20 aa, Mycobacterium tuberculosis
PPVRRSGGREQHLAQVWRAT

SEQ ID NO: 1407833 - protein, 9 aa, Mycobacterium tuberculosis
PQALQAPSG

SEQ ID NO: 1407834 - protein, 5 aa, Mycobacterium tuberculosis
PQEDR

SEQ ID NO: 1407835 - protein, 19 aa, Mycobacterium tuberculosis
PQGGVTDERSDSVLSDSSP

SEQ ID NO: 1407836 - protein, 7 aa, Mycobacterium tuberculosis
PQGRAVH

SEQ ID NO: 1407837 - protein, 6 aa, Mycobacterium tuberculosis
PQGREV

SEQ ID NO: 1407838 - protein, 5 aa, Mycobacterium tuberculosis
PQHQP

SEQ ID NO: 1407839 - protein, 4 aa, Mycobacterium tuberculosis
PQHR

SEQ ID NO: 1407840 - protein, 6 aa, Mycobacterium tuberculosis
PQPAPL

SEQ ID NO: 1407841 - protein, 7 aa, Mycobacterium tuberculosis
PQPDPDL

SEQ ID NO: 1407842 - protein, 10 aa, Mycobacterium tuberculosis
PQPGPSTSEI

SEQ ID NO: 1407843 - protein, 28 aa, Mycobacterium tuberculosis
PQPPVDAGSLAKASPATHRLALEFYQHR

SEQ ID NO: 1407844 - protein, 9 aa, Mycobacterium tuberculosis
PQRTGDPLQ

SEQ ID NO: 1407845 - protein, 8 aa, Mycobacterium tuberculosis
PQSDGGPG

SEQ ID NO: 1407846 - protein, 5 aa, Mycobacterium tuberculosis
PQSHT

SEQ ID NO: 1407847 - protein, 7 aa, Mycobacterium tuberculosis
PQSRGQI

SEQ ID NO: 1407848 - protein, 12 aa, Mycobacterium tuberculosis
PQSRYDDAAAFF

SEQ ID NO: 1407849 - protein, 7 aa, Mycobacterium tuberculosis
PQTADPV

SEQ ID NO: 1407850 - protein, 10 aa, Mycobacterium tuberculosis
PQTPAGEPVA

SEQ ID NO: 1407851 - protein, 10 aa, Mycobacterium tuberculosis
PREAAAMDPQ

SEQ ID NO: 1407852 - protein, 5 aa, Mycobacterium tuberculosis
PRENA

SEQ ID NO: 1407853 - protein, 7 aa, Mycobacterium tuberculosis
PRENPID

SEQ ID NO: 1407854 - protein, 4 aa, Mycobacterium tuberculosis
PREQ

SEQ ID NO: 1407855 - protein, 4 aa, Mycobacterium tuberculosis
PRGI

SEQ ID NO: 1407856 - protein, 5 aa, Mycobacterium tuberculosis
PRIPA

SEQ ID NO: 1407857 - protein, 12 aa, Mycobacterium tuberculosis
PRLSGASPMTNL

SEQ ID NO: 1407858 - protein, 6 aa, Mycobacterium tuberculosis
PRNQAP

SEQ ID NO: 1407859 - protein, 17 aa, Mycobacterium tuberculosis
PRPDTPAEAVSTPQTRP

SEQ ID NO: 1407860 - protein, 6 aa, Mycobacterium tuberculosis
PRPDWP

SEQ ID NO: 1407861 - protein, 7 aa, Mycobacterium tuberculosis
PRPGDEA

SEQ ID NO: 1407862 - protein, 7 aa, Mycobacterium tuberculosis
PRPVEGG

SEQ ID NO: 1407863 - protein, 8 aa, Mycobacterium tuberculosis
PRQEDADA

SEQ ID NO: 1407864 - protein, 11 aa, Mycobacterium tuberculosis
PRRTSGGGRRY

SEQ ID NO: 1407865 - protein, 6 aa, Mycobacterium tuberculosis
PRSDLE

SEQ ID NO: 1407866 - protein, 7 aa, Mycobacterium tuberculosis
PRSGRRS

SEQ ID NO: 1407867 - protein, 14 aa, Mycobacterium tuberculosis
PRSGRWTPDPSDRA

SEQ ID NO: 1407868 - protein, 4 aa, Mycobacterium tuberculosis
PRSV

SEQ ID NO: 1407869 - protein, 6 aa, Mycobacterium tuberculosis
PRSVEQ

SEQ ID NO: 1407870 - protein, 9 aa, Mycobacterium tuberculosis
PRTEPPVPS

SEQ ID NO: 1407871 - protein, 4 aa, Mycobacterium tuberculosis
PRTG

SEQ ID NO: 1407872 - protein, 8 aa, Mycobacterium tuberculosis
PRTGGRAG

SEQ ID NO: 1407873 - protein, 7 aa, Mycobacterium tuberculosis
PRTQSGK

SEQ ID NO: 1407874 - protein, 4 aa, Mycobacterium tuberculosis
PRTT

SEQ ID NO: 1407875 - protein, 4 aa, Mycobacterium tuberculosis
PRVE

SEQ ID NO: 1407876 - protein, 23 aa, Mycobacterium tuberculosis
PRYLTSSAATAVGATAVGPSLPA

SEQ ID NO: 1407877 - protein, 6 aa, Mycobacterium tuberculosis
PRYQGV

SEQ ID NO: 1407878 - protein, 7 aa, Mycobacterium tuberculosis
PSAFTED

SEQ ID NO: 1407879 - protein, 9 aa, Mycobacterium tuberculosis
PSAQPDGER

SEQ ID NO: 1407880 - protein, 9 aa, Mycobacterium tuberculosis
PSATPRSTE

SEQ ID NO: 1407881 - protein, 5 aa, Mycobacterium tuberculosis
PSDEQ

SEQ ID NO: 1407882 - protein, 4 aa, Mycobacterium tuberculosis
PSDI

SEQ ID NO: 1407883 - protein, 7 aa, Mycobacterium tuberculosis
PSDPLTG

SEQ ID NO: 1407884 - protein, 34 aa, Mycobacterium tuberculosis; identical to SEQ ID NO: 183426

SEQ ID NO: 1407885 - protein, 11 aa, Mycobacterium tuberculosis
PSESRKEARIA

SEQ ID NO: 1407886 - protein, 15 aa, Mycobacterium tuberculosis
PSETTPSLPECTGAA

SEQ ID NO: 1407887 - protein, 6 aa, Mycobacterium tuberculosis
PSGDGM

SEQ ID NO: 1407888 - protein, 16 aa, Mycobacterium tuberculosis
PSGSASNRDAQAAAAA

SEQ ID NO: 1407889 - protein, 5 aa, Mycobacterium tuberculosis
PSGWD

SEQ ID NO: 1407890 - protein, 8 aa, Mycobacterium tuberculosis
PSGWRGGG

SEQ ID NO: 1407891 - protein, 8 aa, Mycobacterium tuberculosis
PSIAADPA

SEQ ID NO: 1407892 - protein, 13 aa, Mycobacterium tuberculosis
PSKTFNAALEAVQ

SEQ ID NO: 1407893 - protein, 10 aa, Mycobacterium tuberculosis
PSLAENADAP

SEQ ID NO: 1407894 - protein, 8 aa, Mycobacterium tuberculosis
PSLAGTRV

SEQ ID NO: 1407895 - protein, 5 aa, Mycobacterium tuberculosis
PSLTN

SEQ ID NO: 1407896 - protein, 4 aa, Mycobacterium tuberculosis
PSMA

SEQ ID NO: 1407897 - protein, 4 aa, Mycobacterium tuberculosis
PSPS

SEQ ID NO: 1407898 - protein, 7 aa, Mycobacterium tuberculosis
PSQAPSD

SEQ ID NO: 1407899 - protein, 5 aa, Mycobacterium tuberculosis
PSSLD

SEQ ID NO: 1407900 - protein, 7 aa, Mycobacterium tuberculosis
PSVMPGP

SEQ ID NO: 1407901 - protein, 6 aa, Mycobacterium tuberculosis
PSYPQD

SEQ ID NO: 1407902 - protein, 10 aa, Mycobacterium tuberculosis
PTAAAQAPKG

SEQ ID NO: 1407903 - protein, 6 aa, Mycobacterium tuberculosis
PTAEQA

SEQ ID NO: 1407904 - protein, 6 aa, Mycobacterium tuberculosis
PTAGMD

SEQ ID NO: 1407905 - protein, 16 aa, Mycobacterium tuberculosis
PTALTTAKRRASDAGV

SEQ ID NO: 1407906 - protein, 4 aa, Mycobacterium tuberculosis
PTDE

SEQ ID NO: 1407907 - protein, 8 aa, Mycobacterium tuberculosis
PTGAGKTV

SEQ ID NO: 1407908 - protein, 20 aa, Mycobacterium tuberculosis
PTGDPPAPEPARADRRGQRT

SEQ ID NO: 1407909 - protein, 7 aa, Mycobacterium tuberculosis
PTGEPRA

SEQ ID NO: 1407910 - protein, 4 aa, Mycobacterium tuberculosis
PTGP

SEQ ID NO: 1407911 - protein, 5 aa, Mycobacterium tuberculosis
PTGRR

SEQ ID NO: 1407912 - protein, 7 aa, Mycobacterium tuberculosis
PTGSGKT

SEQ ID NO: 1407913 - protein, 11 aa, Mycobacterium tuberculosis
PTHPSPDDYDR

SEQ ID NO: 1407914 - protein, 4 aa, Mycobacterium tuberculosis
PTLR

SEQ ID NO: 1407915 - protein, 4 aa, Mycobacterium tuberculosis
PTNP

SEQ ID NO: 1407916 - protein, 7 aa, Mycobacterium tuberculosis
PTPAECD

SEQ ID NO: 1407917 - protein, 12 aa, Mycobacterium tuberculosis
PTPTKPGRAAPG

SEQ ID NO: 1407918 - protein, 4 aa, Mycobacterium tuberculosis
PTPY

SEQ ID NO: 1407919 - protein, 9 aa, Mycobacterium tuberculosis
PTQSGEEEV

SEQ ID NO: 1407920 - protein, 5 aa, Mycobacterium tuberculosis
PTRPR

SEQ ID NO: 1407921 - protein, 7 aa, Mycobacterium tuberculosis
PTRYGGV

SEQ ID NO: 1407922 - protein, 5 aa, Mycobacterium tuberculosis
PTTAY

SEQ ID NO: 1407923 - protein, 6 aa, Mycobacterium tuberculosis
PTTPLT

SEQ ID NO: 1407924 - protein, 7 aa, Mycobacterium tuberculosis
PTTQKAG

SEQ ID NO: 1407925 - protein, 4 aa, Mycobacterium tuberculosis
PTVN

SEQ ID NO: 1407926 - protein, 5 aa, Mycobacterium tuberculosis
PTYSQ

SEQ ID NO: 1407927 - protein, 8 aa, Mycobacterium tuberculosis
PVAASGGR

SEQ ID NO: 1407928 - protein, 5 aa, Mycobacterium tuberculosis
PVANE

SEQ ID NO: 1407929 - protein, 4 aa, Mycobacterium tuberculosis
PVAP

SEQ ID NO: 1407930 - protein, 5 aa, Mycobacterium tuberculosis
PVATT

SEQ ID NO: 1407931 - protein, 7 aa, Mycobacterium tuberculosis
PVDGDTG

SEQ ID NO: 1407932 - protein, 34 aa, Mycobacterium tuberculosis; identical to SEQ ID NO: 183666

SEQ ID NO: 1407933 - protein, 8 aa, Mycobacterium tuberculosis
PVDVPRAE

SEQ ID NO: 1407934 - protein, 8 aa, Mycobacterium tuberculosis
PVGAGAGG

SEQ ID NO: 1407935 - protein, 15 aa, Mycobacterium tuberculosis
PVGRSDSETKGASEG

SEQ ID NO: 1407936 - protein, 6 aa, Mycobacterium tuberculosis
PVGSGG

SEQ ID NO: 1407937 - protein, 16 aa, Mycobacterium tuberculosis
PVKRDPNSSASPAQPF

SEQ ID NO: 1407938 - protein, 11 aa, Mycobacterium tuberculosis
PVMPDAGGGGF

SEQ ID NO: 1407939 - protein, 4 aa, Mycobacterium tuberculosis
PVPV

SEQ ID NO: 1407940 - protein, 7 aa, Mycobacterium tuberculosis
PVQGEAA

SEQ ID NO: 1407941 - protein, 6 aa, Mycobacterium tuberculosis
PVQSTA

SEQ ID NO: 1407942 - protein, 14 aa, Mycobacterium tuberculosis
PVREPTDIMRDVAA

SEQ ID NO: 1407943 - protein, 12 aa, Mycobacterium tuberculosis
PVRNYRDTSHKP

SEQ ID NO: 1407944 - protein, 4 aa, Mycobacterium tuberculosis
PVTP

SEQ ID NO: 1407945 - protein, 5 aa, Mycobacterium tuberculosis
PWTGG

SEQ ID NO: 1407946 - protein, 9 aa, Mycobacterium tuberculosis
PYDKKNADT

SEQ ID NO: 1407947 - protein, 4 aa, Mycobacterium tuberculosis
PYFG

SEQ ID NO: 1407948 - protein, 8 aa, Mycobacterium tuberculosis
PYPGTGRD

SEQ ID NO: 1407949 - protein, 9 aa, Mycobacterium tuberculosis
PYQPEISQG

SEQ ID NO: 1407950 - protein, 16 aa, Mycobacterium tuberculosis
QAADASAAGDPAGDEY

SEQ ID NO: 1407951 - protein, 6 aa, Mycobacterium tuberculosis
QAAGGS

SEQ ID NO: 1407952 - protein, 5 aa, Mycobacterium tuberculosis
QAAGV

SEQ ID NO: 1407953 - protein, 13 aa, Mycobacterium tuberculosis
QAAKAGRGEPDRA

SEQ ID NO: 1407954 - protein, 4 aa, Mycobacterium tuberculosis
QAAY

SEQ ID NO: 1407955 - protein, 10 aa, Mycobacterium tuberculosis
QAESAKAIST

SEQ ID NO: 1407956 - protein, 5 aa, Mycobacterium tuberculosis
QAFGS

SEQ ID NO: 1407957 - protein, 12 aa, Mycobacterium tuberculosis
QAGTDAHDTPAV

SEQ ID NO: 1407958 - protein, 17 aa, Mycobacterium tuberculosis
QAKPTEVAAVIRSRLGP

SEQ ID NO: 1407959 - protein, 9 aa, Mycobacterium tuberculosis
QALATEHKA

SEQ ID NO: 1407960 - protein, 5 aa, Mycobacterium tuberculosis
QANPR

SEQ ID NO: 1407961 - protein, 12 aa, Mycobacterium tuberculosis
QANRQQSTMTDE

SEQ ID NO: 1407962 - protein, 8 aa, Mycobacterium tuberculosis
QAPDSGNA

SEQ ID NO: 1407963 - protein, 20 aa, Mycobacterium tuberculosis
QAPQTEAQPHAASTPPTGTP

SEQ ID NO: 1407964 - protein, 10 aa, Mycobacterium tuberculosis
QAPTGSNSQG

SEQ ID NO: 1407965 - protein, 8 aa, Mycobacterium tuberculosis
QARDTRRE

SEQ ID NO: 1407966 - protein, 6 aa, Mycobacterium tuberculosis
QARKDR

SEQ ID NO: 1407967 - protein, 6 aa, Mycobacterium tuberculosis
QARQAA

SEQ ID NO: 1407968 - protein, 7 aa, Mycobacterium tuberculosis
QATAEET

SEQ ID NO: 1407969 - protein, 6 aa, Mycobacterium tuberculosis
QATGRG

SEQ ID NO: 1407970 - protein, 11 aa, Mycobacterium tuberculosis
QAVQASGDYAS

SEQ ID NO: 1407971 - protein, 8 aa, Mycobacterium tuberculosis
QAVTPADA

SEQ ID NO: 1407972 - protein, 6 aa, Mycobacterium tuberculosis
QAYSSA

SEQ ID NO: 1407973 - protein, 8 aa, Mycobacterium tuberculosis
QDAQTARV

SEQ ID NO: 1407974 - protein, 5 aa, Mycobacterium tuberculosis
QDDNG

SEQ ID NO: 1407975 - protein, 8 aa, Mycobacterium tuberculosis
QDEQLRKR

SEQ ID NO: 1407976 - protein, 7 aa, Mycobacterium tuberculosis
QDGDEGT

SEQ ID NO: 1407977 - protein, 6 aa, Mycobacterium tuberculosis
QDGLPE

SEQ ID NO: 1407978 - protein, 4 aa, Mycobacterium tuberculosis
QDGS

SEQ ID NO: 1407979 - protein, 5 aa, Mycobacterium tuberculosis
QDPHE

SEQ ID NO: 1407980 - protein, 9 aa, Mycobacterium tuberculosis
QDQGGANGE

SEQ ID NO: 1407981 - protein, 6 aa, Mycobacterium tuberculosis
QDRGVD

SEQ ID NO: 1407982 - protein, 4 aa, Mycobacterium tuberculosis
QDRR

SEQ ID NO: 1407983 - protein, 7 aa, Mycobacterium tuberculosis
QDRTGGF

SEQ ID NO: 1407984 - protein, 4 aa, Mycobacterium tuberculosis
QDVA

SEQ ID NO: 1407985 - protein, 7 aa, Mycobacterium tuberculosis
QEGGEDV

SEQ ID NO: 1407986 - protein, 7 aa, Mycobacterium tuberculosis
QEGIKEQ

SEQ ID NO: 1407987 - protein, 7 aa, Mycobacterium tuberculosis
QEGVSDG

SEQ ID NO: 1407988 - protein, 15 aa, Mycobacterium tuberculosis
QELADAAGKSGKPTV

SEQ ID NO: 1407989 - protein, 5 aa, Mycobacterium tuberculosis
QEPGA

SEQ ID NO: 1407990 - protein, 7 aa, Mycobacterium tuberculosis
QEPIGSK

SEQ ID NO: 1407991 - protein, 4 aa, Mycobacterium tuberculosis
QERP

SEQ ID NO: 1407992 - protein, 5 aa, Mycobacterium tuberculosis
QESEG

SEQ ID NO: 1407993 - protein, 4 aa, Mycobacterium tuberculosis
QFAS

SEQ ID NO: 1407994 - protein, 4 aa, Mycobacterium tuberculosis
QFGT

SEQ ID NO: 1407995 - protein, 9 aa, Mycobacterium tuberculosis
QGAGHAASG

SEQ ID NO: 1407996 - protein, 5 aa, Mycobacterium tuberculosis
QGDGG

SEQ ID NO: 1407997 - protein, 10 aa, Mycobacterium tuberculosis
QGDTGAAAKP

SEQ ID NO: 1407998 - protein, 6 aa, Mycobacterium tuberculosis
QGERNF

SEQ ID NO: 1407999 - protein, 13 aa, Mycobacterium tuberculosis
QGEVGPGGGPAGD

SEQ ID NO: 1408000 - protein, 16 aa, Mycobacterium tuberculosis
QGGEAPTAASWGAANR

SEQ ID NO: 1408001 - protein, 11 aa, Mycobacterium tuberculosis
QGHPQRKDYPL

SEQ ID NO: 1408002 - protein, 4 aa, Mycobacterium tuberculosis
QGKG

SEQ ID NO: 1408003 - protein, 6 aa, Mycobacterium tuberculosis
QGLPAD

SEQ ID NO: 1408004 - protein, 9 aa, Mycobacterium tuberculosis
QGPAPAPVT

SEQ ID NO: 1408005 - protein, 7 aa, Mycobacterium tuberculosis
QGPGNKI

SEQ ID NO: 1408006 - protein, 4 aa, Mycobacterium tuberculosis
QGPK

SEQ ID NO: 1408007 - protein, 6 aa, Mycobacterium tuberculosis
QGPNGP

SEQ ID NO: 1408008 - protein, 7 aa, Mycobacterium tuberculosis
QGQAGDN

SEQ ID NO: 1408009 - protein, 6 aa, Mycobacterium tuberculosis
QGQGGS

SEQ ID NO: 1408010 - protein, 10 aa, Mycobacterium tuberculosis
QGSAGGRIET

SEQ ID NO: 1408011 - protein, 6 aa, Mycobacterium tuberculosis
QGSARC

SEQ ID NO: 1408012 - protein, 7 aa, Mycobacterium tuberculosis
QGSGGPA

SEQ ID NO: 1408013 - protein, 6 aa, Mycobacterium tuberculosis
QGTTST

SEQ ID NO: 1408014 - protein, 5 aa, Mycobacterium tuberculosis
QGWPA

SEQ ID NO: 1408015 - protein, 4 aa, Mycobacterium tuberculosis
QHER

SEQ ID NO: 1408016 - protein, 7 aa, Mycobacterium tuberculosis
QHGNKEA

SEQ ID NO: 1408017 - protein, 4 aa, Mycobacterium tuberculosis
QIPD

SEQ ID NO: 1408018 - protein, 6 aa, Mycobacterium tuberculosis
QIPTGF

SEQ ID NO: 1408019 - protein, 7 aa, Mycobacterium tuberculosis
QISDGAS

SEQ ID NO: 1408020 - protein, 10 aa, Mycobacterium tuberculosis
QISGGEIGTG

SEQ ID NO: 1408021 - protein, 4 aa, Mycobacterium tuberculosis
QKAN

SEQ ID NO: 1408022 - protein, 9 aa, Mycobacterium tuberculosis
QKDGPSHAP

SEQ ID NO: 1408023 - protein, 7 aa, Mycobacterium tuberculosis
QKNQRAQ

SEQ ID NO: 1408024 - protein, 7 aa, Mycobacterium tuberculosis
QKRPAVG

SEQ ID NO: 1408025 - protein, 5 aa, Mycobacterium tuberculosis
QLASV

SEQ ID NO: 1408026 - protein, 7 aa, Mycobacterium tuberculosis
QLDGDAG

SEQ ID NO: 1408027 - protein, 7 aa, Mycobacterium tuberculosis
QLKPPVE

SEQ ID NO: 1408028 - protein, 6 aa, Mycobacterium tuberculosis
QLPDGT

SEQ ID NO: 1408029 - protein, 22 aa, Mycobacterium tuberculosis
QLPDPPALPTRAGGERDRRRST

SEQ ID NO: 1408030 - protein, 25 aa, Mycobacterium tuberculosis
QLPKTDPIDPEAPPITPGEKIVTLL

SEQ ID NO: 1408031 - protein, 5 aa, Mycobacterium tuberculosis
QNMSN

SEQ ID NO: 1408032 - protein, 11 aa, Mycobacterium tuberculosis
QNREKAREQRN

SEQ ID NO: 1408033 - protein, 9 aa, Mycobacterium tuberculosis
QPAEHTDSG

SEQ ID NO: 1408034 - protein, 8 aa, Mycobacterium tuberculosis
QPAPETLD

SEQ ID NO: 1408035 - protein, 6 aa, Mycobacterium tuberculosis
QPARTQ

SEQ ID NO: 1408036 - protein, 8 aa, Mycobacterium tuberculosis
QPDADGVL

SEQ ID NO: 1408037 - protein, 6 aa, Mycobacterium tuberculosis
QPDPSY

SEQ ID NO: 1408038 - protein, 8 aa, Mycobacterium tuberculosis
QPDRDGIA

SEQ ID NO: 1408039 - protein, 7 aa, Mycobacterium tuberculosis
QPDTAAI

SEQ ID NO: 1408040 - protein, 19 aa, Mycobacterium tuberculosis
QPFGGARGSGTNDKAGSPL

SEQ ID NO: 1408041 - protein, 12 aa, Mycobacterium tuberculosis
QPFGTGGDPLVD

SEQ ID NO: 1408042 - protein, 4 aa, Mycobacterium tuberculosis
QPGE

SEQ ID NO: 1408043 - protein, 7 aa, Mycobacterium tuberculosis
QPGHPVT

SEQ ID NO: 1408044 - protein, 6 aa, Mycobacterium tuberculosis
QPGPQN

SEQ ID NO: 1408045 - protein, 9 aa, Mycobacterium tuberculosis
QPPHAATSG

SEQ ID NO: 1408046 - protein, 7 aa, Mycobacterium tuberculosis
QPPKGLT

SEQ ID NO: 1408047 - protein, 9 aa, Mycobacterium tuberculosis
QPQSQPMPV

SEQ ID NO: 1408048 - protein, 20 aa, Mycobacterium tuberculosis
QPRRRGSGRPGFYRPPGRPE

SEQ ID NO: 1408049 - protein, 6 aa, Mycobacterium tuberculosis
QPTPAW

SEQ ID NO: 1408050 - protein, 21 aa, Mycobacterium tuberculosis
QPTTIGQTPPTTALSGIGSGG

SEQ ID NO: 1408051 - protein, 5 aa, Mycobacterium tuberculosis
QPVPT

SEQ ID NO: 1408052 - protein, 14 aa, Mycobacterium tuberculosis
QQAEEAAAKIGAGE

SEQ ID NO: 1408053 - protein, 20 aa, Mycobacterium tuberculosis
QQATPGKHIRRSGEDVAAGT

SEQ ID NO: 1408054 - protein, 7 aa, Mycobacterium tuberculosis
QQDAGVA

SEQ ID NO: 1408055 - protein, 6 aa, Mycobacterium tuberculosis
QQEAGK

SEQ ID NO: 1408056 - protein, 6 aa, Mycobacterium tuberculosis
QQHDGD

SEQ ID NO: 1408057 - protein, 12 aa, Mycobacterium tuberculosis
QQLPQTDDQGRT

SEQ ID NO: 1408058 - protein, 23 aa, Mycobacterium tuberculosis
QQTDYPSVGPDRPEYEPRGCPRG

SEQ ID NO: 1408059 - protein, 13 aa, Mycobacterium tuberculosis
QRADRRSHPAADS

SEQ ID NO: 1408060 - protein, 6 aa, Mycobacterium tuberculosis
QRAEAA

SEQ ID NO: 1408061 - protein, 7 aa, Mycobacterium tuberculosis
QRAEPDL

SEQ ID NO: 1408062 - protein, 8 aa, Mycobacterium tuberculosis
QRAGTVRP

SEQ ID NO: 1408063 - protein, 10 aa, Mycobacterium tuberculosis
QRAKRRLPKS

SEQ ID NO: 1408064 - protein, 7 aa, Mycobacterium tuberculosis
QRAVGGA

SEQ ID NO: 1408065 - protein, 4 aa, Mycobacterium tuberculosis
QRAY

SEQ ID NO: 1408066 - protein, 21 aa, Mycobacterium tuberculosis
QRDAGHKTCDPAAGGTLTSVL

SEQ ID NO: 1408067 - protein, 5 aa, Mycobacterium tuberculosis
QRETA

SEQ ID NO: 1408068 - protein, 4 aa, Mycobacterium tuberculosis
QRGT

SEQ ID NO: 1408069 - protein, 6 aa, Mycobacterium tuberculosis
QRKDGA

SEQ ID NO: 1408070 - protein, 4 aa, Mycobacterium tuberculosis
QRKR

SEQ ID NO: 1408071 - protein, 6 aa, Mycobacterium tuberculosis
QRPDGS

SEQ ID NO: 1408072 - protein, 4 aa, Mycobacterium tuberculosis
QRPN

SEQ ID NO: 1408073 - protein, 18 aa, Mycobacterium tuberculosis
QRPPDRRSIESSTGDQAV

SEQ ID NO: 1408074 - protein, 9 aa, Mycobacterium tuberculosis
QRQCPSVRR

SEQ ID NO: 1408075 - protein, 6 aa, Mycobacterium tuberculosis
QRRNGV

SEQ ID NO: 1408076 - protein, 7 aa, Mycobacterium tuberculosis
QRRPVSV

SEQ ID NO: 1408077 - protein, 7 aa, Mycobacterium tuberculosis
QRSGTPA

SEQ ID NO: 1408078 - protein, 9 aa, Mycobacterium tuberculosis
QRSSRDVTT

SEQ ID NO: 1408079 - protein, 4 aa, Mycobacterium tuberculosis
QRTE

SEQ ID NO: 1408080 - protein, 19 aa, Mycobacterium tuberculosis
QRTESRGGHTRDDHPGMDP

SEQ ID NO: 1408081 - protein, 6 aa, Mycobacterium tuberculosis
QRTQFG

SEQ ID NO: 1408082 - protein, 13 aa, Mycobacterium tuberculosis
QRTRERRPDLSHP

SEQ ID NO: 1408083 - protein, 6 aa, Mycobacterium tuberculosis
QRTSAR

SEQ ID NO: 1408084 - protein, 6 aa, Mycobacterium tuberculosis
QSADGM

SEQ ID NO: 1408085 - protein, 8 aa, Mycobacterium tuberculosis
QSAPPGAG

SEQ ID NO: 1408086 - protein, 6 aa, Mycobacterium tuberculosis
QSAYDI

SEQ ID NO: 1408087 - protein, 10 aa, Mycobacterium tuberculosis
QSDEAAPARQ

SEQ ID NO: 1408088 - protein, 43 aa, Mycobacterium tuberculosis; identical to SEQ ID NO: 184445

SEQ ID NO: 1408089 - protein, 6 aa, Mycobacterium tuberculosis
QSDSRT

SEQ ID NO: 1408090 - protein, 8 aa, Mycobacterium tuberculosis
QSEPQRKA

SEQ ID NO: 1408091 - protein, 12 aa, Mycobacterium tuberculosis
QSGAAPGAGETR

SEQ ID NO: 1408092 - protein, 9 aa, Mycobacterium tuberculosis
QSGETADTL

SEQ ID NO: 1408093 - protein, 6 aa, Mycobacterium tuberculosis
QSGLRP

SEQ ID NO: 1408094 - protein, 7 aa, Mycobacterium tuberculosis
QSGPGHE

SEQ ID NO: 1408095 - protein, 10 aa, Mycobacterium tuberculosis
QSGSDGSEVS

SEQ ID NO: 1408096 - protein, 5 aa, Mycobacterium tuberculosis
QSKRR

SEQ ID NO: 1408097 - protein, 4 aa, Mycobacterium tuberculosis
QSLE

SEQ ID NO: 1408098 - protein, 14 aa, Mycobacterium tuberculosis
QSPVPGETLPGTAQ

SEQ ID NO: 1408099 - protein, 6 aa, Mycobacterium tuberculosis
QSRERQ

SEQ ID NO: 1408100 - protein, 7 aa, Mycobacterium tuberculosis
QSRNEID

SEQ ID NO: 1408101 - protein, 11 aa, Mycobacterium tuberculosis
QSSAQSHDKDL

SEQ ID NO: 1408102 - protein, 6 aa, Mycobacterium tuberculosis
QSSLPE

SEQ ID NO: 1408103 - protein, 4 aa, Mycobacterium tuberculosis
QTAD

SEQ ID NO: 1408104 - protein, 11 aa, Mycobacterium tuberculosis
QTAGTGERSRW

SEQ ID NO: 1408105 - protein, 5 aa, Mycobacterium tuberculosis
QTASL

SEQ ID NO: 1408106 - protein, 19 aa, Mycobacterium tuberculosis
QTELSEQRRYSGRGNPGLN

SEQ ID NO: 1408107 - protein, 12 aa, Mycobacterium tuberculosis
QTGTHPRTRTEA

SEQ ID NO: 1408108 - protein, 5 aa, Mycobacterium tuberculosis
QTGVE

SEQ ID NO: 1408109 - protein, 5 aa, Mycobacterium tuberculosis
QTKTG

SEQ ID NO: 1408110 - protein, 5 aa, Mycobacterium tuberculosis
QTMAG

SEQ ID NO: 1408111 - protein, 6 aa, Mycobacterium tuberculosis
QTNYGA

SEQ ID NO: 1408112 - protein, 5 aa, Mycobacterium tuberculosis
QTPAD

SEQ ID NO: 1408113 - protein, 7 aa, Mycobacterium tuberculosis
QTPDERD

SEQ ID NO: 1408114 - protein, 5 aa, Mycobacterium tuberculosis
QTPMR

SEQ ID NO: 1408115 - protein, 6 aa, Mycobacterium tuberculosis
QTPVST

SEQ ID NO: 1408116 - protein, 10 aa, Mycobacterium tuberculosis
QTQGQGHETT

SEQ ID NO: 1408117 - protein, 5 aa, Mycobacterium tuberculosis
QTQGV

SEQ ID NO: 1408118 - protein, 6 aa, Mycobacterium tuberculosis
QTQTPD

SEQ ID NO: 1408119 - protein, 9 aa, Mycobacterium tuberculosis
QTREPNAQI

SEQ ID NO: 1408120 - protein, 6 aa, Mycobacterium tuberculosis
QTRQRA

SEQ ID NO: 1408121 - protein, 7 aa, Mycobacterium tuberculosis
QVDQPGT

SEQ ID NO: 1408122 - protein, 7 aa, Mycobacterium tuberculosis
QVNPSGR

SEQ ID NO: 1408123 - protein, 6 aa, Mycobacterium tuberculosis
QVSGIA

SEQ ID NO: 1408124 - protein, 11 aa, Mycobacterium tuberculosis
QVSPSAPDSLK

SEQ ID NO: 1408125 - protein, 8 aa, Mycobacterium tuberculosis
QVTTQGEG

SEQ ID NO: 1408126 - protein, 8 aa, Mycobacterium tuberculosis
QYPDDPGK

SEQ ID NO: 1408127 - protein, 19 aa, Mycobacterium tuberculosis
QYTDGSGYSPNLPQGAPPF

SEQ ID NO: 1408128 - protein, 15 aa, Mycobacterium tuberculosis
RAAAARGCAGTSGLG

SEQ ID NO: 1408129 - protein, 9 aa, Mycobacterium tuberculosis
RAAAEDEEQ

SEQ ID NO: 1408130 - protein, 9 aa, Mycobacterium tuberculosis
RAAAPSKRA

SEQ ID NO: 1408131 - protein, 17 aa, Mycobacterium tuberculosis
RAAASGLYRGQQRRRRP

SEQ ID NO: 1408132 - protein, 5 aa, Mycobacterium tuberculosis
RAAGE

SEQ ID NO: 1408133 - protein, 7 aa, Mycobacterium tuberculosis
RAAGRGA

SEQ ID NO: 1408134 - protein, 10 aa, Mycobacterium tuberculosis
RAAGRTRHDA

SEQ ID NO: 1408135 - protein, 7 aa, Mycobacterium tuberculosis
RAAPNSE

SEQ ID NO: 1408136 - protein, 8 aa, Mycobacterium tuberculosis
RAAQQSWP

SEQ ID NO: 1408137 - protein, 4 aa, Mycobacterium tuberculosis
RAAR

SEQ ID NO: 1408138 - protein, 7 aa, Mycobacterium tuberculosis
RAARDGA

SEQ ID NO: 1408139 - protein, 8 aa, Mycobacterium tuberculosis
RAASDDGF

SEQ ID NO: 1408140 - protein, 7 aa, Mycobacterium tuberculosis
RAATAHP

SEQ ID NO: 1408141 - protein, 6 aa, Mycobacterium tuberculosis
RADDTA

SEQ ID NO: 1408142 - protein, 5 aa, Mycobacterium tuberculosis
RADEA

SEQ ID NO: 1408143 - protein, 8 aa, Mycobacterium tuberculosis
RADEIGAG

SEQ ID NO: 1408144 - protein, 4 aa, Mycobacterium tuberculosis
RADT

SEQ ID NO: 1408145 - protein, 7 aa, Mycobacterium tuberculosis
RADTSRA

SEQ ID NO: 1408146 - protein, 7 aa, Mycobacterium tuberculosis
RAEREQG

SEQ ID NO: 1408147 - protein, 10 aa, Mycobacterium tuberculosis
RAGAPERAEN

SEQ ID NO: 1408148 - protein, 19 aa, Mycobacterium tuberculosis
RAGDGDGAVRAKSSPTDPV

SEQ ID NO: 1408149 - protein, 9 aa, Mycobacterium tuberculosis
RAGERGALE

SEQ ID NO: 1408150 - protein, 17 aa, Mycobacterium tuberculosis
RAGFRTPAPAAGQDEPR

SEQ ID NO: 1408151 - protein, 9 aa, Mycobacterium tuberculosis
RAGRDEPAV

SEQ ID NO: 1408152 - protein, 6 aa, Mycobacterium tuberculosis
RAGRKR

SEQ ID NO: 1408153 - protein, 7 aa, Mycobacterium tuberculosis
RAGVGAG

SEQ ID NO: 1408154 - protein, 7 aa, Mycobacterium tuberculosis
RAHGTDA

SEQ ID NO: 1408155 - protein, 7 aa, Mycobacterium tuberculosis
RAKYDSA

SEQ ID NO: 1408156 - protein, 13 aa, Mycobacterium tuberculosis
RAMPAATGIPRGG

SEQ ID NO: 1408157 - protein, 11 aa, Mycobacterium tuberculosis
RANKDNTDPKR

SEQ ID NO: 1408158 - protein, 5 aa, Mycobacterium tuberculosis
RANNR

SEQ ID NO: 1408159 - protein, 4 aa, Mycobacterium tuberculosis
RAPA

SEQ ID NO: 1408160 - protein, 8 aa, Mycobacterium tuberculosis
RAPAGPPV

SEQ ID NO: 1408161 - protein, 9 aa, Mycobacterium tuberculosis
RAPKPAQGL

SEQ ID NO: 1408162 - protein, 5 aa, Mycobacterium tuberculosis
RAPVS

SEQ ID NO: 1408163 - protein, 29 aa, Mycobacterium tuberculosis
RAQSDGGRIGSRSRSRQKSSKPRGNQAAA

SEQ ID NO: 1408164 - protein, 9 aa, Mycobacterium tuberculosis
RAQTGRNGA

SEQ ID NO: 1408165 - protein, 9 aa, Mycobacterium tuberculosis
RARDRGKPV

SEQ ID NO: 1408166 - protein, 7 aa, Mycobacterium tuberculosis
RARENRS

SEQ ID NO: 1408167 - protein, 16 aa, Mycobacterium tuberculosis
RARKHGDLESGPLKSV

SEQ ID NO: 1408168 - protein, 16 aa, Mycobacterium tuberculosis
RARRRERDEARRANED

SEQ ID NO: 1408169 - protein, 22 aa, Mycobacterium tuberculosis
RARTDGGEVIGGDRREVGSPGA

SEQ ID NO: 1408170 - protein, 4 aa, Mycobacterium tuberculosis
RASL

SEQ ID NO: 1408171 - protein, 8 aa, Mycobacterium tuberculosis
RASQTDTE

SEQ ID NO: 1408172 - protein, 23 aa, Mycobacterium tuberculosis
RATALRRAGRSAGPRQLGGRDGE

SEQ ID NO: 1408173 - protein, 10 aa, Mycobacterium tuberculosis
RATEERPSWG

SEQ ID NO: 1408174 - protein, 9 aa, Mycobacterium tuberculosis
RATRGPASH

SEQ ID NO: 1408175 - protein, 5 aa, Mycobacterium tuberculosis
RATTA

SEQ ID NO: 1408176 - protein, 6 aa, Mycobacterium tuberculosis
RATVGG

SEQ ID NO: 1408177 - protein, 12 aa, Mycobacterium tuberculosis
RAVAGETVLAEC

SEQ ID NO: 1408178 - protein, 5 aa, Mycobacterium tuberculosis
RAVGA

SEQ ID NO: 1408179 - protein, 14 aa, Mycobacterium tuberculosis
RAVGGGGSTVGPAA

SEQ ID NO: 1408180 - protein, 7 aa, Mycobacterium tuberculosis
RCGSTGD

SEQ ID NO: 1408181 - protein, 12 aa, Mycobacterium tuberculosis
RCPDAGAPRPAV

SEQ ID NO: 1408182 - protein, 16 aa, Mycobacterium tuberculosis
RDAATAALDAYQAAAP

SEQ ID NO: 1408183 - protein, 8 aa, Mycobacterium tuberculosis
RDAGREVK

SEQ ID NO: 1408184 - protein, 6 aa, Mycobacterium tuberculosis
RDAGYD

SEQ ID NO: 1408185 - protein, 6 aa, Mycobacterium tuberculosis
RDAPCE

SEQ ID NO: 1408186 - protein, 14 aa, Mycobacterium tuberculosis
RDAPTGRFASLVWM

SEQ ID NO: 1408187 - protein, 6 aa, Mycobacterium tuberculosis
RDAQPA

SEQ ID NO: 1408188 - protein, 8 aa, Mycobacterium tuberculosis
RDATGESV

SEQ ID NO: 1408189 - protein, 7 aa, Mycobacterium tuberculosis
RDCPEHD

SEQ ID NO: 1408190 - protein, 14 aa, Mycobacterium tuberculosis
RDDEFGGSLQNRAK

SEQ ID NO: 1408191 - protein, 13 aa, Mycobacterium tuberculosis
RDDPSQPVASDPY

SEQ ID NO: 1408192 - protein, 6 aa, Mycobacterium tuberculosis
RDERGV

SEQ ID NO: 1408193 - protein, 7 aa, Mycobacterium tuberculosis
RDERGVP

SEQ ID NO: 1408194 - protein, 8 aa, Mycobacterium tuberculosis
RDGDPVRD

SEQ ID NO: 1408195 - protein, 6 aa, Mycobacterium tuberculosis
RDGGAD

SEQ ID NO: 1408196 - protein, 6 aa, Mycobacterium tuberculosis
RDGITE

SEQ ID NO: 1408197 - protein, 6 aa, Mycobacterium tuberculosis
RDGPRP

SEQ ID NO: 1408198 - protein, 6 aa, Mycobacterium tuberculosis
RDGPTG

SEQ ID NO: 1408199 - protein, 18 aa, Mycobacterium tuberculosis
RDGQRRHPSDNTDEPARA

SEQ ID NO: 1408200 - protein, 10 aa, Mycobacterium tuberculosis
RDGSANRPTT

SEQ ID NO: 1408201 - protein, 4 aa, Mycobacterium tuberculosis
RDGW

SEQ ID NO: 1408202 - protein, 7 aa, Mycobacterium tuberculosis
RDIEAGT

SEQ ID NO: 1408203 - protein, 10 aa, Mycobacterium tuberculosis
RDKPRSPEGL

SEQ ID NO: 1408204 - protein, 7 aa, Mycobacterium tuberculosis
RDPDLTP

SEQ ID NO: 1408205 - protein, 8 aa, Mycobacterium tuberculosis
RDPRASGE

SEQ ID NO: 1408206 - protein, 6 aa, Mycobacterium tuberculosis
RDPRDA

SEQ ID NO: 1408207 - protein, 7 aa, Mycobacterium tuberculosis
RDPRVPN

SEQ ID NO: 1408208 - protein, 6 aa, Mycobacterium tuberculosis
RDPTAL

SEQ ID NO: 1408209 - protein, 7 aa, Mycobacterium tuberculosis
RDQTASR

SEQ ID NO: 1408210 - protein, 8 aa, Mycobacterium tuberculosis
RDRPAPPI

SEQ ID NO: 1408211 - protein, 5 aa, Mycobacterium tuberculosis
RDSDE

SEQ ID NO: 1408212 - protein, 8 aa, Mycobacterium tuberculosis
RDSGDDVS

SEQ ID NO: 1408213 - protein, 8 aa, Mycobacterium tuberculosis
RDSRANAR

SEQ ID NO: 1408214 - protein, 6 aa, Mycobacterium tuberculosis
RDTDGK

SEQ ID NO: 1408215 - protein, 6 aa, Mycobacterium tuberculosis
RDTEDL

SEQ ID NO: 1408216 - protein, 5 aa, Mycobacterium tuberculosis
RDTGR

SEQ ID NO: 1408217 - protein, 5 aa, Mycobacterium tuberculosis
RDTGV

SEQ ID NO: 1408218 - protein, 7 aa, Mycobacterium tuberculosis
RDVRDNQ

SEQ ID NO: 1408219 - protein, 9 aa, Mycobacterium tuberculosis
RDVTTRSAN

SEQ ID NO: 1408220 - protein, 16 aa, Mycobacterium tuberculosis
REAARNHDTLSSARGV

SEQ ID NO: 1408221 - protein, 5 aa, Mycobacterium tuberculosis
REAEE

SEQ ID NO: 1408222 - protein, 12 aa, Mycobacterium tuberculosis
REAGAAHPRSLG

SEQ ID NO: 1408223 - protein, 5 aa, Mycobacterium tuberculosis
REAGE

SEQ ID NO: 1408224 - protein, 16 aa, Mycobacterium tuberculosis
REATAELADAARTRGV

SEQ ID NO: 1408225 - protein, 15 aa, Mycobacterium tuberculosis
REATDEELAAESGIP

SEQ ID NO: 1408226 - protein, 5 aa, Mycobacterium tuberculosis
REDGA

SEQ ID NO: 1408227 - protein, 9 aa, Mycobacterium tuberculosis
REEAGKTSP

SEQ ID NO: 1408228 - protein, 5 aa, Mycobacterium tuberculosis
REEEA

SEQ ID NO: 1408229 - protein, 5 aa, Mycobacterium tuberculosis
REEWP

SEQ ID NO: 1408230 - protein, 6 aa, Mycobacterium tuberculosis
REHGGG

SEQ ID NO: 1408231 - protein, 8 aa, Mycobacterium tuberculosis
RELSGAER

SEQ ID NO: 1408232 - protein, 8 aa, Mycobacterium tuberculosis
REPGNAGT

SEQ ID NO: 1408233 - protein, 17 aa, Mycobacterium tuberculosis
REQGYDGTWTGDDNIDK

SEQ ID NO: 1408234 - protein, 7 aa, Mycobacterium tuberculosis
REQKRPG

SEQ ID NO: 1408235 - protein, 9 aa, Mycobacterium tuberculosis
RERAQRAVS

SEQ ID NO: 1408236 - protein, 15 aa, Mycobacterium tuberculosis
RERATDIGAGAVTPA

SEQ ID NO: 1408237 - protein, 4 aa, Mycobacterium tuberculosis
RERE

SEQ ID NO: 1408238 - protein, 19 aa, Mycobacterium tuberculosis
RERGDETRRYGVVRFTLDV

SEQ ID NO: 1408239 - protein, 5 aa, Mycobacterium tuberculosis
RERRP

SEQ ID NO: 1408240 - protein, 9 aa, Mycobacterium tuberculosis
RESEPMARP

SEQ ID NO: 1408241 - protein, 9 aa, Mycobacterium tuberculosis
RESGGAIGG

SEQ ID NO: 1408242 - protein, 8 aa, Mycobacterium tuberculosis
RESRGAPW

SEQ ID NO: 1408243 - protein, 7 aa, Mycobacterium tuberculosis
RETEDSA

SEQ ID NO: 1408244 - protein, 7 aa, Mycobacterium tuberculosis
RETGPTQ

SEQ ID NO: 1408245 - protein, 4 aa, Mycobacterium tuberculosis
RETQ

SEQ ID NO: 1408246 - protein, 17 aa, Mycobacterium tuberculosis
REYDPELKPATTKAGIT

SEQ ID NO: 1408247 - protein, 4 aa, Mycobacterium tuberculosis
REYP

SEQ ID NO: 1408248 - protein, 4 aa, Mycobacterium tuberculosis
RFEP

SEQ ID NO: 1408249 - protein, 22 aa, Mycobacterium tuberculosis
RFPTEPPAAPLPRYPGGTSPRA

SEQ ID NO: 1408250 - protein, 6 aa, Mycobacterium tuberculosis
RFPTPE

SEQ ID NO: 1408251 - protein, 6 aa, Mycobacterium tuberculosis
RFREAE

SEQ ID NO: 1408252 - protein, 5 aa, Mycobacterium tuberculosis
RFRRG

SEQ ID NO: 1408253 - protein, 7 aa, Mycobacterium tuberculosis
RFSGGTT

SEQ ID NO: 1408254 - protein, 5 aa, Mycobacterium tuberculosis
RGAAA

SEQ ID NO: 1408255 - protein, 4 aa, Mycobacterium tuberculosis
RGAD

SEQ ID NO: 1408256 - protein, 4 aa, Mycobacterium tuberculosis
RGAF

SEQ ID NO: 1408257 - protein, 6 aa, Mycobacterium tuberculosis
RGAGSF

SEQ ID NO: 1408258 - protein, 15 aa, Mycobacterium tuberculosis
RGAGSGLSGGATALD

SEQ ID NO: 1408259 - protein, 9 aa, Mycobacterium tuberculosis
RGAPAYRQR

SEQ ID NO: 1408260 - protein, 7 aa, Mycobacterium tuberculosis
RGATDAE

SEQ ID NO: 1408261 - protein, 5 aa, Mycobacterium tuberculosis
RGATY

SEQ ID NO: 1408262 - protein, 7 aa, Mycobacterium tuberculosis
RGDDPSL

SEQ ID NO: 1408263 - protein, 4 aa, Mycobacterium tuberculosis
RGDS

SEQ ID NO: 1408264 - protein, 8 aa, Mycobacterium tuberculosis
RGEASRRI

SEQ ID NO: 1408265 - protein, 6 aa, Mycobacterium tuberculosis
RGEIDG

SEQ ID NO: 1408266 - protein, 7 aa, Mycobacterium tuberculosis
RGEITRA

SEQ ID NO: 1408267 - protein, 5 aa, Mycobacterium tuberculosis
RGGAE

SEQ ID NO: 1408268 - protein, 11 aa, Mycobacterium tuberculosis
RGGEKISPERV

SEQ ID NO: 1408269 - protein, 5 aa, Mycobacterium tuberculosis
RGGGA

SEQ ID NO: 1408270 - protein, 10 aa, Mycobacterium tuberculosis
RGGGEYGPGW

SEQ ID NO: 1408271 - protein, 17 aa, Mycobacterium tuberculosis
RGGGPRGRKALADENGG

SEQ ID NO: 1408272 - protein, 20 aa, Mycobacterium tuberculosis
RGGSARPSRPRRGNDLETET

SEQ ID NO: 1408273 - protein, 8 aa, Mycobacterium tuberculosis
RGGTPTAY

SEQ ID NO: 1408274 - protein, 14 aa, Mycobacterium tuberculosis
RGHGTDDSEVNPSG

SEQ ID NO: 1408275 - protein, 5 aa, Mycobacterium tuberculosis
RGIDD

SEQ ID NO: 1408276 - protein, 8 aa, Mycobacterium tuberculosis
RGIGGRDA

SEQ ID NO: 1408277 - protein, 9 aa, Mycobacterium tuberculosis
RGIRPESKF

SEQ ID NO: 1408278 - protein, 5 aa, Mycobacterium tuberculosis
RGITP

SEQ ID NO: 1408279 - protein, 6 aa, Mycobacterium tuberculosis
RGITRE

SEQ ID NO: 1408280 - protein, 9 aa, Mycobacterium tuberculosis
RGKARLKHD

SEQ ID NO: 1408281 - protein, 5 aa, Mycobacterium tuberculosis
RGKES

SEQ ID NO: 1408282 - protein, 19 aa, Mycobacterium tuberculosis
RGKQARDKRQDMARRDAQR

SEQ ID NO: 1408283 - protein, 10 aa, Mycobacterium tuberculosis
RGPATPGSAA

SEQ ID NO: 1408284 - protein, 4 aa, Mycobacterium tuberculosis
RGPR

SEQ ID NO: 1408285 - protein, 6 aa, Mycobacterium tuberculosis
RGPSST

SEQ ID NO: 1408286 - protein, 5 aa, Mycobacterium tuberculosis
RGQDG

SEQ ID NO: 1408287 - protein, 6 aa, Mycobacterium tuberculosis
RGQEAA

SEQ ID NO: 1408288 - protein, 10 aa, Mycobacterium tuberculosis
RGQPVSPSTV

SEQ ID NO: 1408289 - protein, 25 aa, Mycobacterium tuberculosis
RGQRTKTNARTRKGPKRTIAGKKKA

SEQ ID NO: 1408290 - protein, 10 aa, Mycobacterium tuberculosis
RGRPTSEAVE

SEQ ID NO: 1408291 - protein, 6 aa, Mycobacterium tuberculosis
RGRRAL

SEQ ID NO: 1408292 - protein, 6 aa, Mycobacterium tuberculosis
RGRVAG

SEQ ID NO: 1408293 - protein, 13 aa, Mycobacterium tuberculosis
RGRYGSAGNKDDR

SEQ ID NO: 1408294 - protein, 7 aa, Mycobacterium tuberculosis
RGSDGRV

SEQ ID NO: 1408295 - protein, 8 aa, Mycobacterium tuberculosis
RGSGARSI

SEQ ID NO: 1408296 - protein, 7 aa, Mycobacterium tuberculosis
RGSGASF

SEQ ID NO: 1408297 - protein, 24 aa, Mycobacterium tuberculosis
RGSTRKAAKGAASTAAAAEAGGLE

SEQ ID NO: 1408298 - protein, 9 aa, Mycobacterium tuberculosis
RGTDDGRLA

SEQ ID NO: 1408299 - protein, 7 aa, Mycobacterium tuberculosis
RGTNGRI

SEQ ID NO: 1408300 - protein, 12 aa, Mycobacterium tuberculosis
RGVPKRSGGSGD

SEQ ID NO: 1408301 - protein, 4 aa, Mycobacterium tuberculosis
RGWG

SEQ ID NO: 1408302 - protein, 10 aa, Mycobacterium tuberculosis
RHDAGPADLT

SEQ ID NO: 1408303 - protein, 7 aa, Mycobacterium tuberculosis
RHPGTSQ

SEQ ID NO: 1408304 - protein, 8 aa, Mycobacterium tuberculosis
RHQHSSQR

SEQ ID NO: 1408305 - protein, 5 aa, Mycobacterium tuberculosis
RHRGT

SEQ ID NO: 1408306 - protein, 4 aa, Mycobacterium tuberculosis
RITT

SEQ ID NO: 1408307 - protein, 8 aa, Mycobacterium tuberculosis
RKAAAGSA

SEQ ID NO: 1408308 - protein, 9 aa, Mycobacterium tuberculosis
RKAGDGSAR

SEQ ID NO: 1408309 - protein, 5 aa, Mycobacterium tuberculosis
RKEGK

SEQ ID NO: 1408310 - protein, 8 aa, Mycobacterium tuberculosis
RKGDADAY

SEQ ID NO: 1408311 - protein, 7 aa, Mycobacterium tuberculosis
RKINESR

SEQ ID NO: 1408312 - protein, 7 aa, Mycobacterium tuberculosis
RKNIDTG

SEQ ID NO: 1408313 - protein, 7 aa, Mycobacterium tuberculosis
RKPEQLG

SEQ ID NO: 1408314 - protein, 26 aa, Mycobacterium tuberculosis
RKPKPRKRGAHTGAAASGDAVTAPMQ

SEQ ID NO: 1408315 - protein, 7 aa, Mycobacterium tuberculosis
RKRAESS

SEQ ID NO: 1408316 - protein, 6 aa, Mycobacterium tuberculosis
RKRYER

SEQ ID NO: 1408317 - protein, 6 aa, Mycobacterium tuberculosis
RKVGDQ

SEQ ID NO: 1408318 - protein, 6 aa, Mycobacterium tuberculosis
RKYDPD

SEQ ID NO: 1408319 - protein, 9 aa, Mycobacterium tuberculosis
RLAPKGTGA

SEQ ID NO: 1408320 - protein, 7 aa, Mycobacterium tuberculosis
RLATSST

SEQ ID NO: 1408321 - protein, 4 aa, Mycobacterium tuberculosis
RLDN

SEQ ID NO: 1408322 - protein, 6 aa, Mycobacterium tuberculosis
RLDNSN

SEQ ID NO: 1408323 - protein, 5 aa, Mycobacterium tuberculosis
RLDPD

SEQ ID NO: 1408324 - protein, 4 aa, Mycobacterium tuberculosis
RLDR

SEQ ID NO: 1408325 - protein, 4 aa, Mycobacterium tuberculosis
RLGP

SEQ ID NO: 1408326 - protein, 8 aa, Mycobacterium tuberculosis
RLNGSRNP

SEQ ID NO: 1408327 - protein, 6 aa, Mycobacterium tuberculosis
RLTDER

SEQ ID NO: 1408328 - protein, 9 aa, Mycobacterium tuberculosis
RNAKRAVKS

SEQ ID NO: 1408329 - protein, 9 aa, Mycobacterium tuberculosis
RNATESGGR

SEQ ID NO: 1408330 - protein, 7 aa, Mycobacterium tuberculosis
RNGSGPV

SEQ ID NO: 1408331 - protein, 6 aa, Mycobacterium tuberculosis
RNKPND

SEQ ID NO: 1408332 - protein, 7 aa, Mycobacterium tuberculosis
RNPKLGA

SEQ ID NO: 1408333 - protein, 4 aa, Mycobacterium tuberculosis
RNPQ

SEQ ID NO: 1408334 - protein, 5 aa, Mycobacterium tuberculosis
RNRPL

SEQ ID NO: 1408335 - protein, 7 aa, Mycobacterium tuberculosis
RNSDKAA

SEQ ID NO: 1408336 - protein, 5 aa, Mycobacterium tuberculosis
RNTPR

SEQ ID NO: 1408337 - protein, 13 aa, Mycobacterium tuberculosis
RPAEHGPDDPGGV

SEQ ID NO: 1408338 - protein, 8 aa, Mycobacterium tuberculosis
RPAGRARS

SEQ ID NO: 1408339 - protein, 6 aa, Mycobacterium tuberculosis
RPASFG

SEQ ID NO: 1408340 - protein, 6 aa, Mycobacterium tuberculosis
RPATAA

SEQ ID NO: 1408341 - protein, 6 aa, Mycobacterium tuberculosis
RPATCG

SEQ ID NO: 1408342 - protein, 10 aa, Mycobacterium tuberculosis
RPDAGKTGPT

SEQ ID NO: 1408343 - protein, 11 aa, Mycobacterium tuberculosis
RPDANLAQGNL

SEQ ID NO: 1408344 - protein, 10 aa, Mycobacterium tuberculosis
RPDDERRNRS

SEQ ID NO: 1408345 - protein, 10 aa, Mycobacterium tuberculosis
RPDRDPRSCS

SEQ ID NO: 1408346 - protein, 7 aa, Mycobacterium tuberculosis
RPDYQPR

SEQ ID NO: 1408347 - protein, 12 aa, Mycobacterium tuberculosis
RPETGLRPPRPG

SEQ ID NO: 1408348 - protein, 5 aa, Mycobacterium tuberculosis
RPGGL

SEQ ID NO: 1408349 - protein, 14 aa, Mycobacterium tuberculosis
RPGKYAHSHEAGRS

SEQ ID NO: 1408350 - protein, 8 aa, Mycobacterium tuberculosis
RPGSDVEE

SEQ ID NO: 1408351 - protein, 8 aa, Mycobacterium tuberculosis
RPHSAEEA

SEQ ID NO: 1408352 - protein, 8 aa, Mycobacterium tuberculosis
RPLGYDDS

SEQ ID NO: 1408353 - protein, 6 aa, Mycobacterium tuberculosis
RPMTPD

SEQ ID NO: 1408354 - protein, 5 aa, Mycobacterium tuberculosis
RPNDV

SEQ ID NO: 1408355 - protein, 8 aa, Mycobacterium tuberculosis
RPNTGPTV

SEQ ID NO: 1408356 - protein, 7 aa, Mycobacterium tuberculosis
RPPAGAP

SEQ ID NO: 1408357 - protein, 9 aa, Mycobacterium tuberculosis
RPPKEGGYG

SEQ ID NO: 1408358 - protein, 19 aa, Mycobacterium tuberculosis
RPPRRNASRRINTDQTSTK

SEQ ID NO: 1408359 - protein, 14 aa, Mycobacterium tuberculosis
RPQQPKVTDPGSRV

SEQ ID NO: 1408360 - protein, 8 aa, Mycobacterium tuberculosis
RPQQPKVV

SEQ ID NO: 1408361 - protein, 8 aa, Mycobacterium tuberculosis
RPRAGKVD

SEQ ID NO: 1408362 - protein, 7 aa, Mycobacterium tuberculosis
RPRGAGG

SEQ ID NO: 1408363 - protein, 6 aa, Mycobacterium tuberculosis
RPRKSL

SEQ ID NO: 1408364 - protein, 10 aa, Mycobacterium tuberculosis
RPRPDAPPGA

SEQ ID NO: 1408365 - protein, 5 aa, Mycobacterium tuberculosis
RPRPG

SEQ ID NO: 1408366 - protein, 7 aa, Mycobacterium tuberculosis
RPRTQSS

SEQ ID NO: 1408367 - protein, 4 aa, Mycobacterium tuberculosis
RPSA

SEQ ID NO: 1408368 - protein, 7 aa, Mycobacterium tuberculosis
RPSGTED

SEQ ID NO: 1408369 - protein, 8 aa, Mycobacterium tuberculosis
RPSSSRDT

SEQ ID NO: 1408370 - protein, 10 aa, Mycobacterium tuberculosis
RPSTTKTTVT

SEQ ID NO: 1408371 - protein, 5 aa, Mycobacterium tuberculosis
RPTGE

SEQ ID NO: 1408372 - protein, 7 aa, Mycobacterium tuberculosis
RPTGQRD

SEQ ID NO: 1408373 - protein, 7 aa, Mycobacterium tuberculosis
RPTPGRA

SEQ ID NO: 1408374 - protein, 7 aa, Mycobacterium tuberculosis
RPTPVAG

SEQ ID NO: 1408375 - protein, 7 aa, Mycobacterium tuberculosis
RPTSEAE

SEQ ID NO: 1408376 - protein, 30 aa, Mycobacterium tuberculosis; identical to SEQ ID NO: 185939

SEQ ID NO: 1408377 - protein, 12 aa, Mycobacterium tuberculosis
RQAGSSLRTAAI

SEQ ID NO: 1408378 - protein, 126 aa, Mycobacterium tuberculosis; identical to SEQ ID NO: 185953

SEQ ID NO: 1408379 - protein, 8 aa, Mycobacterium tuberculosis
RQATSQRV

SEQ ID NO: 1408380 - protein, 4 aa, Mycobacterium tuberculosis
RQDL

SEQ ID NO: 1408381 - protein, 15 aa, Mycobacterium tuberculosis
RQEAADEAAAQVGDR

SEQ ID NO: 1408382 - protein, 6 aa, Mycobacterium tuberculosis
RQESAD

SEQ ID NO: 1408383 - protein, 8 aa, Mycobacterium tuberculosis
RQGLPAPQ

SEQ ID NO: 1408384 - protein, 9 aa, Mycobacterium tuberculosis
RQLGGQDHP

SEQ ID NO: 1408385 - protein, 8 aa, Mycobacterium tuberculosis
RQMSGGGT

SEQ ID NO: 1408386 - protein, 18 aa, Mycobacterium tuberculosis
RQNDARMEDVRPGKLHAR

SEQ ID NO: 1408387 - protein, 7 aa, Mycobacterium tuberculosis
RQNPRNL

SEQ ID NO: 1408388 - protein, 9 aa, Mycobacterium tuberculosis
RQPEPTEAW

SEQ ID NO: 1408389 - protein, 4 aa, Mycobacterium tuberculosis
RQPL

SEQ ID NO: 1408390 - protein, 9 aa, Mycobacterium tuberculosis
RQPTGGAVQ

SEQ ID NO: 1408391 - protein, 5 aa, Mycobacterium tuberculosis
RQPVR

SEQ ID NO: 1408392 - protein, 8 aa, Mycobacterium tuberculosis
RQRSPRSV

SEQ ID NO: 1408393 - protein, 9 aa, Mycobacterium tuberculosis
RQSGPDAPV

SEQ ID NO: 1408394 - protein, 8 aa, Mycobacterium tuberculosis
RQTAAPSI

SEQ ID NO: 1408395 - protein, 8 aa, Mycobacterium tuberculosis
RQTGEWKD

SEQ ID NO: 1408396 - protein, 7 aa, Mycobacterium tuberculosis
RQTRQTR

SEQ ID NO: 1408397 - protein, 6 aa, Mycobacterium tuberculosis
RQVGKT

SEQ ID NO: 1408398 - protein, 5 aa, Mycobacterium tuberculosis
RRAAT

SEQ ID NO: 1408399 - protein, 9 aa, Mycobacterium tuberculosis
RRAGAQGVG

SEQ ID NO: 1408400 - protein, 12 aa, Mycobacterium tuberculosis
RRANAAKSKRAL

SEQ ID NO: 1408401 - protein, 4 aa, Mycobacterium tuberculosis
RRAQ

SEQ ID NO: 1408402 - protein, 4 aa, Mycobacterium tuberculosis
RRCP

SEQ ID NO: 1408403 - protein, 6 aa, Mycobacterium tuberculosis
RRDGDD

SEQ ID NO: 1408404 - protein, 9 aa, Mycobacterium tuberculosis
RRDGSRNGV

SEQ ID NO: 1408405 - protein, 5 aa, Mycobacterium tuberculosis
RRDGV

SEQ ID NO: 1408406 - protein, 4 aa, Mycobacterium tuberculosis
RRDL

SEQ ID NO: 1408407 - protein, 9 aa, Mycobacterium tuberculosis
RRDPNRPRA

SEQ ID NO: 1408408 - protein, 10 aa, Mycobacterium tuberculosis
RRDSPARGGR

SEQ ID NO: 1408409 - protein, 7 aa, Mycobacterium tuberculosis
RREDYDP

SEQ ID NO: 1408410 - protein, 5 aa, Mycobacterium tuberculosis
RREPY

SEQ ID NO: 1408411 - protein, 4 aa, Mycobacterium tuberculosis
RRGA

SEQ ID NO: 1408412 - protein, 9 aa, Mycobacterium tuberculosis
RRGPGGSDT

SEQ ID NO: 1408413 - protein, 6 aa, Mycobacterium tuberculosis
RRGPNG

SEQ ID NO: 1408414 - protein, 9 aa, Mycobacterium tuberculosis
RRGRPSTPM

SEQ ID NO: 1408415 - protein, 14 aa, Mycobacterium tuberculosis
RRGSTATSSSETIT

SEQ ID NO: 1408416 - protein, 4 aa, Mycobacterium tuberculosis
RRGT

SEQ ID NO: 1408417 - protein, 16 aa, Mycobacterium tuberculosis
RRKSEALAASVLPDRT

SEQ ID NO: 1408418 - protein, 8 aa, Mycobacterium tuberculosis
RRNPRGSY

SEQ ID NO: 1408419 - protein, 7 aa, Mycobacterium tuberculosis
RRPAEPN

SEQ ID NO: 1408420 - protein, 10 aa, Mycobacterium tuberculosis
RRPGESPPSI

SEQ ID NO: 1408421 - protein, 5 aa, Mycobacterium tuberculosis
RRPPQ

SEQ ID NO: 1408422 - protein, 5 aa, Mycobacterium tuberculosis
RRPPT

SEQ ID NO: 1408423 - protein, 12 aa, Mycobacterium tuberculosis
RRPSANSKLGAV

SEQ ID NO: 1408424 - protein, 7 aa, Mycobacterium tuberculosis
RRPTDTE

SEQ ID NO: 1408425 - protein, 5 aa, Mycobacterium tuberculosis
RRPVS

SEQ ID NO: 1408426 - protein, 12 aa, Mycobacterium tuberculosis
RRRASGGPAEQT

SEQ ID NO: 1408427 - protein, 6 aa, Mycobacterium tuberculosis
RRRDDG

SEQ ID NO: 1408428 - protein, 11 aa, Mycobacterium tuberculosis
RRRDRASTQEV

SEQ ID NO: 1408429 - protein, 4 aa, Mycobacterium tuberculosis
RRRG

SEQ ID NO: 1408430 - protein, 5 aa, Mycobacterium tuberculosis
RRRPD

SEQ ID NO: 1408431 - protein, 5 aa, Mycobacterium tuberculosis
RRSAQ

SEQ ID NO: 1408432 - protein, 6 aa, Mycobacterium tuberculosis
RRSASV

SEQ ID NO: 1408433 - protein, 18 aa, Mycobacterium tuberculosis
RRSGASTVGAHPSARRSA

SEQ ID NO: 1408434 - protein, 10 aa, Mycobacterium tuberculosis
RRSGKPYRTP

SEQ ID NO: 1408435 - protein, 17 aa, Mycobacterium tuberculosis
RRTAESALRASLSPELG

SEQ ID NO: 1408436 - protein, 5 aa, Mycobacterium tuberculosis
RRTGA

SEQ ID NO: 1408437 - protein, 23 aa, Mycobacterium tuberculosis
RRTGRPPRAVTADRGCGDASVED

SEQ ID NO: 1408438 - protein, 19 aa, Mycobacterium tuberculosis
RRTPASQEEGGEGGEETVT

SEQ ID NO: 1408439 - protein, 10 aa, Mycobacterium tuberculosis
RRTSNAEGRE

SEQ ID NO: 1408440 - protein, 12 aa, Mycobacterium tuberculosis
RRTTDDDMAGRD

SEQ ID NO: 1408441 - protein, 6 aa, Mycobacterium tuberculosis
RRTTDG

SEQ ID NO: 1408442 - protein, 6 aa, Mycobacterium tuberculosis
RSAAEA

SEQ ID NO: 1408443 - protein, 15 aa, Mycobacterium tuberculosis
RSARPNSSPGAAHAA

SEQ ID NO: 1408444 - protein, 13 aa, Mycobacterium tuberculosis
RSATDYDSQQTSL

SEQ ID NO: 1408445 - protein, 9 aa, Mycobacterium tuberculosis
RSDEEAQAR

SEQ ID NO: 1408446 - protein, 12 aa, Mycobacterium tuberculosis
RSDGERSRRPRE

SEQ ID NO: 1408447 - protein, 15 aa, Mycobacterium tuberculosis
RSDPEFAYSDRERDG

SEQ ID NO: 1408448 - protein, 7 aa, Mycobacterium tuberculosis
RSDRDAA

SEQ ID NO: 1408449 - protein, 7 aa, Mycobacterium tuberculosis
RSEARNG

SEQ ID NO: 1408450 - protein, 5 aa, Mycobacterium tuberculosis
RSGAG

SEQ ID NO: 1408451 - protein, 7 aa, Mycobacterium tuberculosis
RSGAPQG

SEQ ID NO: 1408452 - protein, 9 aa, Mycobacterium tuberculosis
RSGDTPPAL

SEQ ID NO: 1408453 - protein, 9 aa, Mycobacterium tuberculosis
RSGEGSPDD

SEQ ID NO: 1408454 - protein, 7 aa, Mycobacterium tuberculosis
RSGETAV

SEQ ID NO: 1408455 - protein, 8 aa, Mycobacterium tuberculosis
RSGETEDT

SEQ ID NO: 1408456 - protein, 5 aa, Mycobacterium tuberculosis
RSGGL

SEQ ID NO: 1408457 - protein, 18 aa, Mycobacterium tuberculosis
RSGGRGRPRRASARPGNC

SEQ ID NO: 1408458 - protein, 26 aa, Mycobacterium tuberculosis
RSGGSDEATSTGRDARAPDISGHASA

SEQ ID NO: 1408459 - protein, 7 aa, Mycobacterium tuberculosis
RSGRRTF

SEQ ID NO: 1408460 - protein, 10 aa, Mycobacterium tuberculosis
RSGSTTISTG

SEQ ID NO: 1408461 - protein, 8 aa, Mycobacterium tuberculosis
RSKALGEA

SEQ ID NO: 1408462 - protein, 10 aa, Mycobacterium tuberculosis
RSKAPTTDPV

SEQ ID NO: 1408463 - protein, 5 aa, Mycobacterium tuberculosis
RSPFS

SEQ ID NO: 1408464 - protein, 7 aa, Mycobacterium tuberculosis
RSPRTPY

SEQ ID NO: 1408465 - protein, 4 aa, Mycobacterium tuberculosis
RSQE

SEQ ID NO: 1408466 - protein, 8 aa, Mycobacterium tuberculosis
RSQRGRKI

SEQ ID NO: 1408467 - protein, 8 aa, Mycobacterium tuberculosis
RSRDPSDL

SEQ ID NO: 1408468 - protein, 5 aa, Mycobacterium tuberculosis
RSREE

SEQ ID NO: 1408469 - protein, 15 aa, Mycobacterium tuberculosis
RSRGGDLPESTHAPG

SEQ ID NO: 1408470 - protein, 6 aa, Mycobacterium tuberculosis
RSRSNV

SEQ ID NO: 1408471 - protein, 13 aa, Mycobacterium tuberculosis
RSRVTEPTARSTL

SEQ ID NO: 1408472 - protein, 5 aa, Mycobacterium tuberculosis
RSSEP

SEQ ID NO: 1408473 - protein, 7 aa, Mycobacterium tuberculosis
RSSGIRS

SEQ ID NO: 1408474 - protein, 12 aa, Mycobacterium tuberculosis
RSTFGSPPDKRL

SEQ ID NO: 1408475 - protein, 8 aa, Mycobacterium tuberculosis
RSTGPANT

SEQ ID NO: 1408476 - protein, 14 aa, Mycobacterium tuberculosis
RSVEGGKPPPDPDD

SEQ ID NO: 1408477 - protein, 11 aa, Mycobacterium tuberculosis
RSWPRERTRAK

SEQ ID NO: 1408478 - protein, 8 aa, Mycobacterium tuberculosis
RTAATDGS

SEQ ID NO: 1408479 - protein, 9 aa, Mycobacterium tuberculosis
RTADPGDAR

SEQ ID NO: 1408480 - protein, 10 aa, Mycobacterium tuberculosis
RTATSGRPGG

SEQ ID NO: 1408481 - protein, 18 aa, Mycobacterium tuberculosis
RTDSSDKVQALDAGADDY

SEQ ID NO: 1408482 - protein, 6 aa, Mycobacterium tuberculosis
RTEESR

SEQ ID NO: 1408483 - protein, 5 aa, Mycobacterium tuberculosis
RTEGR

SEQ ID NO: 1408484 - protein, 10 aa, Mycobacterium tuberculosis
RTEPPLPGTR

SEQ ID NO: 1408485 - protein, 6 aa, Mycobacterium tuberculosis
RTGDGI

SEQ ID NO: 1408486 - protein, 13 aa, Mycobacterium tuberculosis
RTGHRGDALLIGV

SEQ ID NO: 1408487 - protein, 7 aa, Mycobacterium tuberculosis
RTGKIGD

SEQ ID NO: 1408488 - protein, 9 aa, Mycobacterium tuberculosis
RTGNPTRAA

SEQ ID NO: 1408489 - protein, 8 aa, Mycobacterium tuberculosis
RTGPAARA

SEQ ID NO: 1408490 - protein, 10 aa, Mycobacterium tuberculosis
RTGPGRGVRR

SEQ ID NO: 1408491 - protein, 10 aa, Mycobacterium tuberculosis
RTGRAAQAAQ

SEQ ID NO: 1408492 - protein, 9 aa, Mycobacterium tuberculosis
RTGRAGRTG

SEQ ID NO: 1408493 - protein, 11 aa, Mycobacterium tuberculosis
RTKDQAGEMSE

SEQ ID NO: 1408494 - protein, 8 aa, Mycobacterium tuberculosis
RTPDGVTI

SEQ ID NO: 1408495 - protein, 5 aa, Mycobacterium tuberculosis
RTPEG

SEQ ID NO: 1408496 - protein, 4 aa, Mycobacterium tuberculosis
RTPS

SEQ ID NO: 1408497 - protein, 5 aa, Mycobacterium tuberculosis
RTRDR

SEQ ID NO: 1408498 - protein, 8 aa, Mycobacterium tuberculosis
RTRRPPAF

SEQ ID NO: 1408499 - protein, 8 aa, Mycobacterium tuberculosis
RTSDDDMA

SEQ ID NO: 1408500 - protein, 6 aa, Mycobacterium tuberculosis
RTSKRT

SEQ ID NO: 1408501 - protein, 5 aa, Mycobacterium tuberculosis
RTSSA

SEQ ID NO: 1408502 - protein, 10 aa, Mycobacterium tuberculosis
RTSTPSISRS

SEQ ID NO: 1408503 - protein, 6 aa, Mycobacterium tuberculosis
RTTDPD

SEQ ID NO: 1408504 - protein, 8 aa, Mycobacterium tuberculosis
RTTPDPAR

SEQ ID NO: 1408505 - protein, 6 aa, Mycobacterium tuberculosis
RTTPPI

SEQ ID NO: 1408506 - protein, 8 aa, Mycobacterium tuberculosis
RTVAPGRE

SEQ ID NO: 1408507 - protein, 9 aa, Mycobacterium tuberculosis
RVASDGEPL

SEQ ID NO: 1408508 - protein, 5 aa, Mycobacterium tuberculosis
RVDEE

SEQ ID NO: 1408509 - protein, 8 aa, Mycobacterium tuberculosis
RVGDPDEH

SEQ ID NO: 1408510 - protein, 7 aa, Mycobacterium tuberculosis
RVGGAER

SEQ ID NO: 1408511 - protein, 12 aa, Mycobacterium tuberculosis
RVGHRDAAGQVA

SEQ ID NO: 1408512 - protein, 10 aa, Mycobacterium tuberculosis
RVGPGDGAWR

SEQ ID NO: 1408513 - protein, 4 aa, Mycobacterium tuberculosis
RVRE

SEQ ID NO: 1408514 - protein, 11 aa, Mycobacterium tuberculosis
RVRRSSRKLSP

SEQ ID NO: 1408515 - protein, 6 aa, Mycobacterium tuberculosis
RVTRAR

SEQ ID NO: 1408516 - protein, 5 aa, Mycobacterium tuberculosis
RYDAP

SEQ ID NO: 1408517 - protein, 22 aa, Mycobacterium tuberculosis
RYEEPGSGLNRAARRASGARGR

SEQ ID NO: 1408518 - protein, 11 aa, Mycobacterium tuberculosis
RYPGADAPTVD

SEQ ID NO: 1408519 - protein, 6 aa, Mycobacterium tuberculosis
RYPHPA

SEQ ID NO: 1408520 - protein, 7 aa, Mycobacterium tuberculosis
RYPPDAV

SEQ ID NO: 1408521 - protein, 10 aa, Mycobacterium tuberculosis
SAAADRARGV

SEQ ID NO: 1408522 - protein, 16 aa, Mycobacterium tuberculosis
SAAAEGARQSRSAKQQ

SEQ ID NO: 1408523 - protein, 4 aa, Mycobacterium tuberculosis
SAAD

SEQ ID NO: 1408524 - protein, 12 aa, Mycobacterium tuberculosis
SAADGESTSQVR

SEQ ID NO: 1408525 - protein, 8 aa, Mycobacterium tuberculosis
SAAEADPA

SEQ ID NO: 1408526 - protein, 16 aa, Mycobacterium tuberculosis
SAAENLAETASKVGGT

SEQ ID NO: 1408527 - protein, 8 aa, Mycobacterium tuberculosis
SAAPEAEA

SEQ ID NO: 1408528 - protein, 10 aa, Mycobacterium tuberculosis
SAAPGDPAPN

SEQ ID NO: 1408529 - protein, 9 aa, Mycobacterium tuberculosis
SAAPPAELS

SEQ ID NO: 1408530 - protein, 10 aa, Mycobacterium tuberculosis
SAASSKEDRL

SEQ ID NO: 1408531 - protein, 9 aa, Mycobacterium tuberculosis
SACTDGGKG

SEQ ID NO: 1408532 - protein, 8 aa, Mycobacterium tuberculosis
SADADPPL

SEQ ID NO: 1408533 - protein, 8 aa, Mycobacterium tuberculosis
SADDKDAA

SEQ ID NO: 1408534 - protein, 20 aa, Mycobacterium tuberculosis
SADGATVDLGSPAAQAIWVV

SEQ ID NO: 1408535 - protein, 4 aa, Mycobacterium tuberculosis
SADN

SEQ ID NO: 1408536 - protein, 8 aa, Mycobacterium tuberculosis
SADPHAKP

SEQ ID NO: 1408537 - protein, 4 aa, Mycobacterium tuberculosis
SAEE

SEQ ID NO: 1408538 - protein, 9 aa, Mycobacterium tuberculosis
SAEFPEADL

SEQ ID NO: 1408539 - protein, 10 aa, Mycobacterium tuberculosis
SAEIERDRRL

SEQ ID NO: 1408540 - protein, 6 aa, Mycobacterium tuberculosis
SAEPKV

SEQ ID NO: 1408541 - protein, 12 aa, Mycobacterium tuberculosis
SAERAPAGCTDG

SEQ ID NO: 1408542 - protein, 8 aa, Mycobacterium tuberculosis
SAGGGGRG

SEQ ID NO: 1408543 - protein, 15 aa, Mycobacterium tuberculosis
SAGQPSAGAPEPVRA

SEQ ID NO: 1408544 - protein, 10 aa, Mycobacterium tuberculosis
SAGSPEVDPD

SEQ ID NO: 1408545 - protein, 5 aa, Mycobacterium tuberculosis
SAIEP

SEQ ID NO: 1408546 - protein, 8 aa, Mycobacterium tuberculosis
SAKKNEPD

SEQ ID NO: 1408547 - protein, 13 aa, Mycobacterium tuberculosis
SAKRGGGAKNTDK

SEQ ID NO: 1408548 - protein, 7 aa, Mycobacterium tuberculosis
SAKTGRA

SEQ ID NO: 1408549 - protein, 8 aa, Mycobacterium tuberculosis
SALRDSAP

SEQ ID NO: 1408550 - protein, 6 aa, Mycobacterium tuberculosis
SAMRPQ

SEQ ID NO: 1408551 - protein, 12 aa, Mycobacterium tuberculosis
SAMTSSRRDHRE

SEQ ID NO: 1408552 - protein, 5 aa, Mycobacterium tuberculosis
SANAN

SEQ ID NO: 1408553 - protein, 8 aa, Mycobacterium tuberculosis
SANRDPSV

SEQ ID NO: 1408554 - protein, 19 aa, Mycobacterium tuberculosis
SANSAAMATRQETAATAYG

SEQ ID NO: 1408555 - protein, 9 aa, Mycobacterium tuberculosis
SAPDSDPHI

SEQ ID NO: 1408556 - protein, 7 aa, Mycobacterium tuberculosis
SAPHRAA

SEQ ID NO: 1408557 - protein, 6 aa, Mycobacterium tuberculosis
SAPISA

SEQ ID NO: 1408558 - protein, 8 aa, Mycobacterium tuberculosis
SAPSASVD

SEQ ID NO: 1408559 - protein, 8 aa, Mycobacterium tuberculosis
SAPVRDGR

SEQ ID NO: 1408560 - protein, 8 aa, Mycobacterium tuberculosis
SAQARRHR

SEQ ID NO: 1408561 - protein, 11 aa, Mycobacterium tuberculosis
SAQEADTAARI

SEQ ID NO: 1408562 - protein, 4 aa, Mycobacterium tuberculosis
SAQL

SEQ ID NO: 1408563 - protein, 5 aa, Mycobacterium tuberculosis
SARGP

SEQ ID NO: 1408564 - protein, 11 aa, Mycobacterium tuberculosis
SARQPGESPEQ

SEQ ID NO: 1408565 - protein, 15 aa, Mycobacterium tuberculosis
SASDRRKDAPAEGTP

SEQ ID NO: 1408566 - protein, 15 aa, Mycobacterium tuberculosis
SASGGTVVHTTSRWR

SEQ ID NO: 1408567 - protein, 8 aa, Mycobacterium tuberculosis
SASHQRDD

SEQ ID NO: 1408568 - protein, 4 aa, Mycobacterium tuberculosis
SASN

SEQ ID NO: 1408569 - protein, 13 aa, Mycobacterium tuberculosis
SASPAHTPEPFDS

SEQ ID NO: 1408570 - protein, 7 aa, Mycobacterium tuberculosis
SASRDGL

SEQ ID NO: 1408571 - protein, 11 aa, Mycobacterium tuberculosis
SASTRRERPQD

SEQ ID NO: 1408572 - protein, 7 aa, Mycobacterium tuberculosis
SATAISP

SEQ ID NO: 1408573 - protein, 11 aa, Mycobacterium tuberculosis
SATEPSGRKPA

SEQ ID NO: 1408574 - protein, 5 aa, Mycobacterium tuberculosis
SATQY

SEQ ID NO: 1408575 - protein, 4 aa, Mycobacterium tuberculosis
SAVA

SEQ ID NO: 1408576 - protein, 8 aa, Mycobacterium tuberculosis
SAWRKDPD

SEQ ID NO: 1408577 - protein, 8 aa, Mycobacterium tuberculosis
SAYPDGIA

SEQ ID NO: 1408578 - protein, 7 aa, Mycobacterium tuberculosis
SCPPETK

SEQ ID NO: 1408579 - protein, 6 aa, Mycobacterium tuberculosis
SCPPGR

SEQ ID NO: 1408580 - protein, 8 aa, Mycobacterium tuberculosis
SDAAQRGA

SEQ ID NO: 1408581 - protein, 8 aa, Mycobacterium tuberculosis
SDAERARV

SEQ ID NO: 1408582 - protein, 8 aa, Mycobacterium tuberculosis
SDATAVAG

SEQ ID NO: 1408583 - protein, 7 aa, Mycobacterium tuberculosis
SDATGRA

SEQ ID NO: 1408584 - protein, 7 aa, Mycobacterium tuberculosis
SDDERPA

SEQ ID NO: 1408585 - protein, 18 aa, Mycobacterium tuberculosis
SDDEWNAPTTTPSGPDSY

SEQ ID NO: 1408586 - protein, 6 aa, Mycobacterium tuberculosis
SDEHPG

SEQ ID NO: 1408587 - protein, 5 aa, Mycobacterium tuberculosis
SDESA

SEQ ID NO: 1408588 - protein, 9 aa, Mycobacterium tuberculosis
SDEYGPIRA

SEQ ID NO: 1408589 - protein, 7 aa, Mycobacterium tuberculosis
SDFSATE

SEQ ID NO: 1408590 - protein, 12 aa, Mycobacterium tuberculosis
SDGAYADASNQD

SEQ ID NO: 1408591 - protein, 6 aa, Mycobacterium tuberculosis
SDGFGP

SEQ ID NO: 1408592 - protein, 9 aa, Mycobacterium tuberculosis
SDGSEARYT

SEQ ID NO: 1408593 - protein, 10 aa, Mycobacterium tuberculosis
SDIRAGRPAV

SEQ ID NO: 1408594 - protein, 14 aa, Mycobacterium tuberculosis
SDLAKGGPVHAQSE

SEQ ID NO: 1408595 - protein, 7 aa, Mycobacterium tuberculosis
SDMPTTC

SEQ ID NO: 1408596 - protein, 12 aa, Mycobacterium tuberculosis
SDPAKRKEYDET

SEQ ID NO: 1408597 - protein, 6 aa, Mycobacterium tuberculosis
SDPDKR

SEQ ID NO: 1408598 - protein, 9 aa, Mycobacterium tuberculosis
SDPPNRPGN

SEQ ID NO: 1408599 - protein, 9 aa, Mycobacterium tuberculosis
SDPSDVARV

SEQ ID NO: 1408600 - protein, 8 aa, Mycobacterium tuberculosis
SDRAGSDQ

SEQ ID NO: 1408601 - protein, 8 aa, Mycobacterium tuberculosis
SDRERAYE

SEQ ID NO: 1408602 - protein, 6 aa, Mycobacterium tuberculosis
SDSDVA

SEQ ID NO: 1408603 - protein, 5 aa, Mycobacterium tuberculosis
SDSLR

SEQ ID NO: 1408604 - protein, 10 aa, Mycobacterium tuberculosis
SDSNTSWPLP

SEQ ID NO: 1408605 - protein, 10 aa, Mycobacterium tuberculosis
SDSPDDTTLA

SEQ ID NO: 1408606 - protein, 9 aa, Mycobacterium tuberculosis
SDTTPSNTM

SEQ ID NO: 1408607 - protein, 13 aa, Mycobacterium tuberculosis
SDVAGANAQRGLS

SEQ ID NO: 1408608 - protein, 6 aa, Mycobacterium tuberculosis
SEAADK

SEQ ID NO: 1408609 - protein, 4 aa, Mycobacterium tuberculosis
SEAD

SEQ ID NO: 1408610 - protein, 8 aa, Mycobacterium tuberculosis
SEAEPPDA

SEQ ID NO: 1408611 - protein, 11 aa, Mycobacterium tuberculosis
SEALSTAAAEG

SEQ ID NO: 1408612 - protein, 5 aa, Mycobacterium tuberculosis
SEDSQ

SEQ ID NO: 1408613 - protein, 10 aa, Mycobacterium tuberculosis
SEFDSAKGSA

SEQ ID NO: 1408614 - protein, 7 aa, Mycobacterium tuberculosis
SEFDSNR

SEQ ID NO: 1408615 - protein, 9 aa, Mycobacterium tuberculosis
SEGETKRKF

SEQ ID NO: 1408616 - protein, 6 aa, Mycobacterium tuberculosis
SEGSVR

SEQ ID NO: 1408617 - protein, 4 aa, Mycobacterium tuberculosis
SEHN

SEQ ID NO: 1408618 - protein, 9 aa, Mycobacterium tuberculosis
SEIADKAQH

SEQ ID NO: 1408619 - protein, 11 aa, Mycobacterium tuberculosis
SELASAGDGGM

SEQ ID NO: 1408620 - protein, 14 aa, Mycobacterium tuberculosis
SEPEWGGADEPDRP

SEQ ID NO: 1408621 - protein, 5 aa, Mycobacterium tuberculosis
SEPVT

SEQ ID NO: 1408622 - protein, 5 aa, Mycobacterium tuberculosis
SEREA

SEQ ID NO: 1408623 - protein, 21 aa, Mycobacterium tuberculosis
SEREAGSDAASMRTRAKADGD

SEQ ID NO: 1408624 - protein, 6 aa, Mycobacterium tuberculosis
SERVQA

SEQ ID NO: 1408625 - protein, 6 aa, Mycobacterium tuberculosis
SERWPG

SEQ ID NO: 1408626 - protein, 6 aa, Mycobacterium tuberculosis
SESAAS

SEQ ID NO: 1408627 - protein, 9 aa, Mycobacterium tuberculosis
SESGAGNST

SEQ ID NO: 1408628 - protein, 8 aa, Mycobacterium tuberculosis
SESLDSEP

SEQ ID NO: 1408629 - protein, 7 aa, Mycobacterium tuberculosis
SESPAAG

SEQ ID NO: 1408630 - protein, 4 aa, Mycobacterium tuberculosis
SETV

SEQ ID NO: 1408631 - protein, 22 aa, Mycobacterium tuberculosis
SFASSGLAKPPEAQANPAVPPN

SEQ ID NO: 1408632 - protein, 7 aa, Mycobacterium tuberculosis
SFGGRGH

SEQ ID NO: 1408633 - protein, 4 aa, Mycobacterium tuberculosis
SFGT

SEQ ID NO: 1408634 - protein, 13 aa, Mycobacterium tuberculosis
SFNPGSANTGSVN

SEQ ID NO: 1408635 - protein, 6 aa, Mycobacterium tuberculosis
SFPPGG

SEQ ID NO: 1408636 - protein, 7 aa, Mycobacterium tuberculosis
SGAATAA

SEQ ID NO: 1408637 - protein, 7 aa, Mycobacterium tuberculosis
SGADYPD

SEQ ID NO: 1408638 - protein, 8 aa, Mycobacterium tuberculosis
SGAFEGPQ

SEQ ID NO: 1408639 - protein, 8 aa, Mycobacterium tuberculosis
SGAGCTNR

SEQ ID NO: 1408640 - protein, 19 aa, Mycobacterium tuberculosis
SGAGGNIGIGGAPQTGKST

SEQ ID NO: 1408641 - protein, 6 aa, Mycobacterium tuberculosis
SGAGRA

SEQ ID NO: 1408642 - protein, 9 aa, Mycobacterium tuberculosis
SGAGRGTAA

SEQ ID NO: 1408643 - protein, 8 aa, Mycobacterium tuberculosis
SGAGSVSG

SEQ ID NO: 1408644 - protein, 9 aa, Mycobacterium tuberculosis
SGANNNERH

SEQ ID NO: 1408645 - protein, 6 aa, Mycobacterium tuberculosis
SGAPAH

SEQ ID NO: 1408646 - protein, 5 aa, Mycobacterium tuberculosis
SGAPE

SEQ ID NO: 1408647 - protein, 8 aa, Mycobacterium tuberculosis
SGATQSMP

SEQ ID NO: 1408648 - protein, 8 aa, Mycobacterium tuberculosis
SGATSQRP

SEQ ID NO: 1408649 - protein, 8 aa, Mycobacterium tuberculosis
SGCGKSTT

SEQ ID NO: 1408650 - protein, 8 aa, Mycobacterium tuberculosis
SGDAEAQA

SEQ ID NO: 1408651 - protein, 6 aa, Mycobacterium tuberculosis
SGDPEV

SEQ ID NO: 1408652 - protein, 6 aa, Mycobacterium tuberculosis
SGDPID

SEQ ID NO: 1408653 - protein, 8 aa, Mycobacterium tuberculosis
SGDPRGGM

SEQ ID NO: 1408654 - protein, 4 aa, Mycobacterium tuberculosis
SGDR

SEQ ID NO: 1408655 - protein, 6 aa, Mycobacterium tuberculosis
SGDSIG

SEQ ID NO: 1408656 - protein, 7 aa, Mycobacterium tuberculosis
SGDTPLL

SEQ ID NO: 1408657 - protein, 5 aa, Mycobacterium tuberculosis
SGESL

SEQ ID NO: 1408658 - protein, 5 aa, Mycobacterium tuberculosis
SGEYQ

SEQ ID NO: 1408659 - protein, 8 aa, Mycobacterium tuberculosis
SGFANTGT

SEQ ID NO: 1408660 - protein, 6 aa, Mycobacterium tuberculosis
SGFGGG

SEQ ID NO: 1408661 - protein, 7 aa, Mycobacterium tuberculosis
SGFGKST

SEQ ID NO: 1408662 - protein, 7 aa, Mycobacterium tuberculosis
SGFRPGQ

SEQ ID NO: 1408663 - protein, 9 aa, Mycobacterium tuberculosis
SGGADLPTQ

SEQ ID NO: 1408664 - protein, 9 aa, Mycobacterium tuberculosis
SGGEPARGQ

SEQ ID NO: 1408665 - protein, 5 aa, Mycobacterium tuberculosis
SGGGV

SEQ ID NO: 1408666 - protein, 9 aa, Mycobacterium tuberculosis
SGGSDRKLS

SEQ ID NO: 1408667 - protein, 8 aa, Mycobacterium tuberculosis
SGIDPRDS

SEQ ID NO: 1408668 - protein, 4 aa, Mycobacterium tuberculosis
SGIG

SEQ ID NO: 1408669 - protein, 7 aa, Mycobacterium tuberculosis
SGIPAAT

SEQ ID NO: 1408670 - protein, 5 aa, Mycobacterium tuberculosis
SGIPG

SEQ ID NO: 1408671 - protein, 8 aa, Mycobacterium tuberculosis
SGKGEELY

SEQ ID NO: 1408672 - protein, 8 aa, Mycobacterium tuberculosis
SGKGTGHE

SEQ ID NO: 1408673 - protein, 6 aa, Mycobacterium tuberculosis
SGKNFS

SEQ ID NO: 1408674 - protein, 7 aa, Mycobacterium tuberculosis
SGKNTRV

SEQ ID NO: 1408675 - protein, 6 aa, Mycobacterium tuberculosis
SGLEAD

SEQ ID NO: 1408676 - protein, 4 aa, Mycobacterium tuberculosis
SGLQ

SEQ ID NO: 1408677 - protein, 10 aa, Mycobacterium tuberculosis
SGLRSDARVE

SEQ ID NO: 1408678 - protein, 6 aa, Mycobacterium tuberculosis
SGNEER

SEQ ID NO: 1408679 - protein, 5 aa, Mycobacterium tuberculosis
SGNIS

SEQ ID NO: 1408680 - protein, 10 aa, Mycobacterium tuberculosis
SGNLGSGNVG

SEQ ID NO: 1408681 - protein, 6 aa, Mycobacterium tuberculosis
SGPATR

SEQ ID NO: 1408682 - protein, 4 aa, Mycobacterium tuberculosis
SGPI

SEQ ID NO: 1408683 - protein, 7 aa, Mycobacterium tuberculosis
SGPPAET

SEQ ID NO: 1408684 - protein, 18 aa, Mycobacterium tuberculosis
SGPQPASERRADMDGGDI

SEQ ID NO: 1408685 - protein, 8 aa, Mycobacterium tuberculosis
SGPTGGEI

SEQ ID NO: 1408686 - protein, 4 aa, Mycobacterium tuberculosis
SGPY

SEQ ID NO: 1408687 - protein, 9 aa, Mycobacterium tuberculosis
SGQAWRAPK

SEQ ID NO: 1408688 - protein, 15 aa, Mycobacterium tuberculosis
SGQIKTGAPARSERV

SEQ ID NO: 1408689 - protein, 6 aa, Mycobacterium tuberculosis
SGQPEF

SEQ ID NO: 1408690 - protein, 6 aa, Mycobacterium tuberculosis
SGREMT

SEQ ID NO: 1408691 - protein, 9 aa, Mycobacterium tuberculosis
SGRKDEAAE

SEQ ID NO: 1408692 - protein, 9 aa, Mycobacterium tuberculosis
SGRPSELSG

SEQ ID NO: 1408693 - protein, 7 aa, Mycobacterium tuberculosis
SGRTGVS

SEQ ID NO: 1408694 - protein, 8 aa, Mycobacterium tuberculosis
SGSGATEL

SEQ ID NO: 1408695 - protein, 8 aa, Mycobacterium tuberculosis
SGSGKSSL

SEQ ID NO: 1408696 - protein, 9 aa, Mycobacterium tuberculosis
SGSTDDTEI

SEQ ID NO: 1408697 - protein, 7 aa, Mycobacterium tuberculosis
SGTEATM

SEQ ID NO: 1408698 - protein, 15 aa, Mycobacterium tuberculosis
SGTGNVGIGNTGTAN

SEQ ID NO: 1408699 - protein, 5 aa, Mycobacterium tuberculosis
SGTNN

SEQ ID NO: 1408700 - protein, 7 aa, Mycobacterium tuberculosis
SGTPPSE

SEQ ID NO: 1408701 - protein, 11 aa, Mycobacterium tuberculosis
SGTTGEPKGVG

SEQ ID NO: 1408702 - protein, 7 aa, Mycobacterium tuberculosis
SGTTNTG

SEQ ID NO: 1408703 - protein, 16 aa, Mycobacterium tuberculosis
SGTTNTGIGNSGGNLV

SEQ ID NO: 1408704 - protein, 6 aa, Mycobacterium tuberculosis
SGTVNV

SEQ ID NO: 1408705 - protein, 7 aa, Mycobacterium tuberculosis
SGTYRGK

SEQ ID NO: 1408706 - protein, 7 aa, Mycobacterium tuberculosis
SGVAPDR

SEQ ID NO: 1408707 - protein, 12 aa, Mycobacterium tuberculosis
SGVGAKDRMPTP

SEQ ID NO: 1408708 - protein, 6 aa, Mycobacterium tuberculosis
SGVGES

SEQ ID NO: 1408709 - protein, 6 aa, Mycobacterium tuberculosis
SGVSRS

SEQ ID NO: 1408710 - protein, 16 aa, Mycobacterium tuberculosis
SGYPGNEYDGIDNNAY

SEQ ID NO: 1408711 - protein, 8 aa, Mycobacterium tuberculosis
SHAESDAL

SEQ ID NO: 1408712 - protein, 7 aa, Mycobacterium tuberculosis
SHDPDGE

SEQ ID NO: 1408713 - protein, 10 aa, Mycobacterium tuberculosis
SHEAESAEPQ

SEQ ID NO: 1408714 - protein, 5 aa, Mycobacterium tuberculosis
SHHPR

SEQ ID NO: 1408715 - protein, 7 aa, Mycobacterium tuberculosis
SHPDGDD

SEQ ID NO: 1408716 - protein, 5 aa, Mycobacterium tuberculosis
SHPET

SEQ ID NO: 1408717 - protein, 10 aa, Mycobacterium tuberculosis
SIPGPAGEIP

SEQ ID NO: 1408718 - protein, 15 aa, Mycobacterium tuberculosis
SIQPVGSPVGNTTIE

SEQ ID NO: 1408719 - protein, 11 aa, Mycobacterium tuberculosis
SITAPDGRPVN

SEQ ID NO: 1408720 - protein, 11 aa, Mycobacterium tuberculosis
SITDGASSRRN

SEQ ID NO: 1408721 - protein, 10 aa, Mycobacterium tuberculosis
SITPPGGESF

SEQ ID NO: 1408722 - protein, 8 aa, Mycobacterium tuberculosis
SITSRGPH

SEQ ID NO: 1408723 - protein, 15 aa, Mycobacterium tuberculosis
SKGRGYPPAEADERD

SEQ ID NO: 1408724 - protein, 7 aa, Mycobacterium tuberculosis
SKHAPTA

SEQ ID NO: 1408725 - protein, 6 aa, Mycobacterium tuberculosis
SKHPGD

SEQ ID NO: 1408726 - protein, 7 aa, Mycobacterium tuberculosis
SKIRGRE

SEQ ID NO: 1408727 - protein, 10 aa, Mycobacterium tuberculosis
SKLEPEDARR

SEQ ID NO: 1408728 - protein, 15 aa, Mycobacterium tuberculosis
SKSNRTDSAQLGDHP

SEQ ID NO: 1408729 - protein, 13 aa, Mycobacterium tuberculosis
SLAGNADQGSEDP

SEQ ID NO: 1408730 - protein, 11 aa, Mycobacterium tuberculosis
SLDAAGDARPP

SEQ ID NO: 1408731 - protein, 8 aa, Mycobacterium tuberculosis
SLDSHGRT

SEQ ID NO: 1408732 - protein, 6 aa, Mycobacterium tuberculosis
SLGRPA

SEQ ID NO: 1408733 - protein, 7 aa, Mycobacterium tuberculosis
SLGSDNA

SEQ ID NO: 1408734 - protein, 11 aa, Mycobacterium tuberculosis
SLNTPADNDHQ

SEQ ID NO: 1408735 - protein, 5 aa, Mycobacterium tuberculosis
SLRHP

SEQ ID NO: 1408736 - protein, 9 aa, Mycobacterium tuberculosis
SLSEDPPVT

SEQ ID NO: 1408737 - protein, 7 aa, Mycobacterium tuberculosis
SNAAGLG

SEQ ID NO: 1408738 - protein, 5 aa, Mycobacterium tuberculosis
SNAGG

SEQ ID NO: 1408739 - protein, 7 aa, Mycobacterium tuberculosis
SNASAQR

SEQ ID NO: 1408740 - protein, 6 aa, Mycobacterium tuberculosis
SNASDA

SEQ ID NO: 1408741 - protein, 8 aa, Mycobacterium tuberculosis
SNDAKEGA

SEQ ID NO: 1408742 - protein, 8 aa, Mycobacterium tuberculosis
SNEPAGEG

SEQ ID NO: 1408743 - protein, 5 aa, Mycobacterium tuberculosis
SNERL

SEQ ID NO: 1408744 - protein, 16 aa, Mycobacterium tuberculosis
SNGLGAAAAAEGSTHA

SEQ ID NO: 1408745 - protein, 5 aa, Mycobacterium tuberculosis
SNGMN

SEQ ID NO: 1408746 - protein, 7 aa, Mycobacterium tuberculosis
SNMSETT

SEQ ID NO: 1408747 - protein, 5 aa, Mycobacterium tuberculosis
SNQRV

SEQ ID NO: 1408748 - protein, 6 aa, Mycobacterium tuberculosis
SNREEM

SEQ ID NO: 1408749 - protein, 15 aa, Mycobacterium tuberculosis
SNRGVAGIDGTVSTA

SEQ ID NO: 1408750 - protein, 15 aa, Mycobacterium tuberculosis
SNSRRRTSDGGWEPG

SEQ ID NO: 1408751 - protein, 5 aa, Mycobacterium tuberculosis
SPAPC

SEQ ID NO: 1408752 - protein, 7 aa, Mycobacterium tuberculosis
SPAQIAD

SEQ ID NO: 1408753 - protein, 9 aa, Mycobacterium tuberculosis
SPASNAVTG

SEQ ID NO: 1408754 - protein, 7 aa, Mycobacterium tuberculosis
SPASWTS

SEQ ID NO: 1408755 - protein, 9 aa, Mycobacterium tuberculosis
SPDEVEGGM

SEQ ID NO: 1408756 - protein, 7 aa, Mycobacterium tuberculosis
SPDPGPV

SEQ ID NO: 1408757 - protein, 16 aa, Mycobacterium tuberculosis
SPEPTSQPAAEPTRVT

SEQ ID NO: 1408758 - protein, 5 aa, Mycobacterium tuberculosis
SPGLK

SEQ ID NO: 1408759 - protein, 10 aa, Mycobacterium tuberculosis
SPGQARRKIA

SEQ ID NO: 1408760 - protein, 6 aa, Mycobacterium tuberculosis
SPGVDT

SEQ ID NO: 1408761 - protein, 6 aa, Mycobacterium tuberculosis
SPHPAA

SEQ ID NO: 1408762 - protein, 7 aa, Mycobacterium tuberculosis
SPHPAEF

SEQ ID NO: 1408763 - protein, 10 aa, Mycobacterium tuberculosis
SPHPSPLSAS

SEQ ID NO: 1408764 - protein, 6 aa, Mycobacterium tuberculosis
SPIGTG

SEQ ID NO: 1408765 - protein, 4 aa, Mycobacterium tuberculosis
SPLA

SEQ ID NO: 1408766 - protein, 11 aa, Mycobacterium tuberculosis
SPLPETPETGV

SEQ ID NO: 1408767 - protein, 5 aa, Mycobacterium tuberculosis
SPLSE

SEQ ID NO: 1408768 - protein, 14 aa, Mycobacterium tuberculosis
SPLTPDHVNPERPW

SEQ ID NO: 1408769 - protein, 12 aa, Mycobacterium tuberculosis
SPNGGDKPTGEL

SEQ ID NO: 1408770 - protein, 9 aa, Mycobacterium tuberculosis
SPPKAGKTT

SEQ ID NO: 1408771 - protein, 5 aa, Mycobacterium tuberculosis
SPPPV

SEQ ID NO: 1408772 - protein, 5 aa, Mycobacterium tuberculosis
SPPQL

SEQ ID NO: 1408773 - protein, 6 aa, Mycobacterium tuberculosis
SPQHEY

SEQ ID NO: 1408774 - protein, 5 aa, Mycobacterium tuberculosis
SPRDA

SEQ ID NO: 1408775 - protein, 14 aa, Mycobacterium tuberculosis
SPSEDAREMRQNSP

SEQ ID NO: 1408776 - protein, 34 aa, Mycobacterium tuberculosis
SPSEHPYGSSRAGSKYQGQRGPTPSRSYQNFIRS

SEQ ID NO: 1408777 - protein, 18 aa, Mycobacterium tuberculosis
SPSEKTRPGLAARPSTTC

SEQ ID NO: 1408778 - protein, 8 aa, Mycobacterium tuberculosis
SPSGPRLA

SEQ ID NO: 1408779 - protein, 7 aa, Mycobacterium tuberculosis
SPTGTPH

SEQ ID NO: 1408780 - protein, 5 aa, Mycobacterium tuberculosis
SPVGA

SEQ ID NO: 1408781 - protein, 5 aa, Mycobacterium tuberculosis
SPVGP

SEQ ID NO: 1408782 - protein, 5 aa, Mycobacterium tuberculosis
SPVVE

SEQ ID NO: 1408783 - protein, 13 aa, Mycobacterium tuberculosis
SPWQRASNENSNG

SEQ ID NO: 1408784 - protein, 9 aa, Mycobacterium tuberculosis
SQAARPTGA

SEQ ID NO: 1408785 - protein, 14 aa, Mycobacterium tuberculosis
SQAGAAVGTDAQRI

SEQ ID NO: 1408786 - protein, 4 aa, Mycobacterium tuberculosis
SQAK

SEQ ID NO: 1408787 - protein, 6 aa, Mycobacterium tuberculosis
SQDEGV

SEQ ID NO: 1408788 - protein, 13 aa, Mycobacterium tuberculosis
SQFDGYTSGAAKD

SEQ ID NO: 1408789 - protein, 6 aa, Mycobacterium tuberculosis
SQLRGR

SEQ ID NO: 1408790 - protein, 6 aa, Mycobacterium tuberculosis
SQLSDR

SEQ ID NO: 1408791 - protein, 8 aa, Mycobacterium tuberculosis
SQNADKVE

SEQ ID NO: 1408792 - protein, 9 aa, Mycobacterium tuberculosis
SQPDNGTGR

SEQ ID NO: 1408793 - protein, 4 aa, Mycobacterium tuberculosis
SQPP

SEQ ID NO: 1408794 - protein, 6 aa, Mycobacterium tuberculosis
SQPPTL

SEQ ID NO: 1408795 - protein, 6 aa, Mycobacterium tuberculosis
SQPTMT

SEQ ID NO: 1408796 - protein, 9 aa, Mycobacterium tuberculosis
SQSSPDPIA

SEQ ID NO: 1408797 - protein, 12 aa, Mycobacterium tuberculosis
SQSTEQITGFSE

SEQ ID NO: 1408798 - protein, 7 aa, Mycobacterium tuberculosis
SQTEEEV

SEQ ID NO: 1408799 - protein, 6 aa, Mycobacterium tuberculosis
SQVPDD

SEQ ID NO: 1408800 - protein, 8 aa, Mycobacterium tuberculosis
SRAAGERG

SEQ ID NO: 1408801 - protein, 9 aa, Mycobacterium tuberculosis
SRAAGPAGQ

SEQ ID NO: 1408802 - protein, 8 aa, Mycobacterium tuberculosis
SRADERDQ

SEQ ID NO: 1408803 - protein, 15 aa, Mycobacterium tuberculosis
SRAETGDTLSDKAEP

SEQ ID NO: 1408804 - protein, 4 aa, Mycobacterium tuberculosis
SRAF

SEQ ID NO: 1408805 - protein, 4 aa, Mycobacterium tuberculosis
SRAK

SEQ ID NO: 1408806 - protein, 13 aa, Mycobacterium tuberculosis
SRASEIAPNTTDG

SEQ ID NO: 1408807 - protein, 16 aa, Mycobacterium tuberculosis
SRCTKGSRRYRERTTE

SEQ ID NO: 1408808 - protein, 16 aa, Mycobacterium tuberculosis
SRCTKGSRRYRERTTQ

SEQ ID NO: 1408809 - protein, 15 aa, Mycobacterium tuberculosis
SRDGNTAYRAGRDIQ

SEQ ID NO: 1408810 - protein, 8 aa, Mycobacterium tuberculosis
SREHTDPF

SEQ ID NO: 1408811 - protein, 7 aa, Mycobacterium tuberculosis
SREQTGA

SEQ ID NO: 1408812 - protein, 17 aa, Mycobacterium tuberculosis
SRETSTEFDTPIGAAAE

SEQ ID NO: 1408813 - protein, 21 aa, Mycobacterium tuberculosis
SRGAQKQADEIRRARETKSVR

SEQ ID NO: 1408814 - protein, 5 aa, Mycobacterium tuberculosis
SRGEA

SEQ ID NO: 1408815 - protein, 13 aa, Mycobacterium tuberculosis
SRGGRPDLAGDSL

SEQ ID NO: 1408816 - protein, 5 aa, Mycobacterium tuberculosis
SRGSM

SEQ ID NO: 1408817 - protein, 13 aa, Mycobacterium tuberculosis
SRHPQQETTCRRV

SEQ ID NO: 1408818 - protein, 10 aa, Mycobacterium tuberculosis
SRLDDAGRAT

SEQ ID NO: 1408819 - protein, 6 aa, Mycobacterium tuberculosis
SRLTDP

SEQ ID NO: 1408820 - protein, 8 aa, Mycobacterium tuberculosis
SRNSSNSV

SEQ ID NO: 1408821 - protein, 11 aa, Mycobacterium tuberculosis
SRNSTTINPGT

SEQ ID NO: 1408822 - protein, 6 aa, Mycobacterium tuberculosis
SRPEDR

SEQ ID NO: 1408823 - protein, 10 aa, Mycobacterium tuberculosis
SRPGSVTEGT

SEQ ID NO: 1408824 - protein, 5 aa, Mycobacterium tuberculosis
SRPRA

SEQ ID NO: 1408825 - protein, 13 aa, Mycobacterium tuberculosis
SRQHRVPDHAPSR

SEQ ID NO: 1408826 - protein, 6 aa, Mycobacterium tuberculosis
SRRATM

SEQ ID NO: 1408827 - protein, 8 aa, Mycobacterium tuberculosis
SRREPDRR

SEQ ID NO: 1408828 - protein, 4 aa, Mycobacterium tuberculosis
SRRL

SEQ ID NO: 1408829 - protein, 9 aa, Mycobacterium tuberculosis
SRRPDRPGV

SEQ ID NO: 1408830 - protein, 5 aa, Mycobacterium tuberculosis
SRRRR

SEQ ID NO: 1408831 - protein, 10 aa, Mycobacterium tuberculosis
SRRRRGPETT

SEQ ID NO: 1408832 - protein, 6 aa, Mycobacterium tuberculosis
SRSGNT

SEQ ID NO: 1408833 - protein, 10 aa, Mycobacterium tuberculosis
SRSQPSQKAL

SEQ ID NO: 1408834 - protein, 15 aa, Mycobacterium tuberculosis
SRSSAGGTIGHSTTS

SEQ ID NO: 1408835 - protein, 8 aa, Mycobacterium tuberculosis
SRTNGPCR

SEQ ID NO: 1408836 - protein, 9 aa, Mycobacterium tuberculosis
SRTPGNGQV

SEQ ID NO: 1408837 - protein, 18 aa, Mycobacterium tuberculosis
SRWADAEANRRPDQPQLW

SEQ ID NO: 1408838 - protein, 9 aa, Mycobacterium tuberculosis
SRYSGQPTF

SEQ ID NO: 1408839 - protein, 8 aa, Mycobacterium tuberculosis
SSADQKVD

SEQ ID NO: 1408840 - protein, 13 aa, Mycobacterium tuberculosis
SSADYSGTTPVGS

SEQ ID NO: 1408841 - protein, 6 aa, Mycobacterium tuberculosis
SSAEYG

SEQ ID NO: 1408842 - protein, 6 aa, Mycobacterium tuberculosis
SSARNR

SEQ ID NO: 1408843 - protein, 11 aa, Mycobacterium tuberculosis
SSASKSKVIAD

SEQ ID NO: 1408844 - protein, 9 aa, Mycobacterium tuberculosis
SSATTRSRP

SEQ ID NO: 1408845 - protein, 4 aa, Mycobacterium tuberculosis
SSAV

SEQ ID NO: 1408846 - protein, 10 aa, Mycobacterium tuberculosis
SSAVGREVGR

SEQ ID NO: 1408847 - protein, 10 aa, Mycobacterium tuberculosis
SSDNGRPGAL

SEQ ID NO: 1408848 - protein, 4 aa, Mycobacterium tuberculosis
SSEM

SEQ ID NO: 1408849 - protein, 18 aa, Mycobacterium tuberculosis
SSEPVEDQTRSRLTAATP

SEQ ID NO: 1408850 - protein, 6 aa, Mycobacterium tuberculosis
SSFAPT

SEQ ID NO: 1408851 - protein, 9 aa, Mycobacterium tuberculosis
SSFPGDPAD

SEQ ID NO: 1408852 - protein, 9 aa, Mycobacterium tuberculosis
SSGPGPGPL

SEQ ID NO: 1408853 - protein, 20 aa, Mycobacterium tuberculosis
SSGQAPSTVAASGPLPTADR

SEQ ID NO: 1408854 - protein, 17 aa, Mycobacterium tuberculosis
SSIGAPDTAAAARPTTS

SEQ ID NO: 1408855 - protein, 4 aa, Mycobacterium tuberculosis
SSKE

SEQ ID NO: 1408856 - protein, 8 aa, Mycobacterium tuberculosis
SSLGGTTT

SEQ ID NO: 1408857 - protein, 7 aa, Mycobacterium tuberculosis
SSPAGAA

SEQ ID NO: 1408858 - protein, 10 aa, Mycobacterium tuberculosis
SSPDATERAA

SEQ ID NO: 1408859 - protein, 10 aa, Mycobacterium tuberculosis
SSPGSGKTTV

SEQ ID NO: 1408860 - protein, 4 aa, Mycobacterium tuberculosis
SSPL

SEQ ID NO: 1408861 - protein, 19 aa, Mycobacterium tuberculosis
SSQSGPKDAGPSPADASAA

SEQ ID NO: 1408862 - protein, 6 aa, Mycobacterium tuberculosis
SSREPY

SEQ ID NO: 1408863 - protein, 9 aa, Mycobacterium tuberculosis
SSRHVSSAR

SEQ ID NO: 1408864 - protein, 9 aa, Mycobacterium tuberculosis
SSSGPVPSG

SEQ ID NO: 1408865 - protein, 16 aa, Mycobacterium tuberculosis
SSSRALDPTRFERPST

SEQ ID NO: 1408866 - protein, 9 aa, Mycobacterium tuberculosis
SSSTDPAIA

SEQ ID NO: 1408867 - protein, 7 aa, Mycobacterium tuberculosis
SSTQDQI

SEQ ID NO: 1408868 - protein, 6 aa, Mycobacterium tuberculosis
SSTRGL

SEQ ID NO: 1408869 - protein, 9 aa, Mycobacterium tuberculosis
SSVDPDQAS

SEQ ID NO: 1408870 - protein, 11 aa, Mycobacterium tuberculosis
SSVTGGQRRFG

SEQ ID NO: 1408871 - protein, 18 aa, Mycobacterium tuberculosis
STAAPATTAGATALEGSG

SEQ ID NO: 1408872 - protein, 6 aa, Mycobacterium tuberculosis
STAESH

SEQ ID NO: 1408873 - protein, 17 aa, Mycobacterium tuberculosis
STAKPGAAGRHASTLER

SEQ ID NO: 1408874 - protein, 10 aa, Mycobacterium tuberculosis
STALTGTAGL

SEQ ID NO: 1408875 - protein, 11 aa, Mycobacterium tuberculosis
STEEGQGVPKT

SEQ ID NO: 1408876 - protein, 8 aa, Mycobacterium tuberculosis
STEGDRSM

SEQ ID NO: 1408877 - protein, 4 aa, Mycobacterium tuberculosis
STEI

SEQ ID NO: 1408878 - protein, 4 aa, Mycobacterium tuberculosis
STER

SEQ ID NO: 1408879 - protein, 6 aa, Mycobacterium tuberculosis
STGERG

SEQ ID NO: 1408880 - protein, 9 aa, Mycobacterium tuberculosis
STGPDHDKE

SEQ ID NO: 1408881 - protein, 4 aa, Mycobacterium tuberculosis
STGQ

SEQ ID NO: 1408882 - protein, 13 aa, Mycobacterium tuberculosis
STGSTAKTIADTG

SEQ ID NO: 1408883 - protein, 6 aa, Mycobacterium tuberculosis
STGTQE

SEQ ID NO: 1408884 - protein, 5 aa, Mycobacterium tuberculosis
STGVG

SEQ ID NO: 1408885 - protein, 12 aa, Mycobacterium tuberculosis
STHDTKRGEDVR

SEQ ID NO: 1408886 - protein, 10 aa, Mycobacterium tuberculosis
STKASDVASD

SEQ ID NO: 1408887 - protein, 8 aa, Mycobacterium tuberculosis
STKPENVP

SEQ ID NO: 1408888 - protein, 12 aa, Mycobacterium tuberculosis
STLDPLRAELGG

SEQ ID NO: 1408889 - protein, 5 aa, Mycobacterium tuberculosis
STNLP

SEQ ID NO: 1408890 - protein, 4 aa, Mycobacterium tuberculosis
STNT

SEQ ID NO: 1408891 - protein, 9 aa, Mycobacterium tuberculosis
STPPTIPHS

SEQ ID NO: 1408892 - protein, 7 aa, Mycobacterium tuberculosis
STPRAAR

SEQ ID NO: 1408893 - protein, 7 aa, Mycobacterium tuberculosis
STPTRSA

SEQ ID NO: 1408894 - protein, 5 aa, Mycobacterium tuberculosis
STRTR

SEQ ID NO: 1408895 - protein, 6 aa, Mycobacterium tuberculosis
STSSDG

SEQ ID NO: 1408896 - protein, 10 aa, Mycobacterium tuberculosis
STTGDTTWEN

SEQ ID NO: 1408897 - protein, 4 aa, Mycobacterium tuberculosis
STTH

SEQ ID NO: 1408898 - protein, 19 aa, Mycobacterium tuberculosis
STTHAQLSPAEQLATGVSP

SEQ ID NO: 1408899 - protein, 20 aa, Mycobacterium tuberculosis
STTLAENGVTPSAGRREVPA

SEQ ID NO: 1408900 - protein, 9 aa, Mycobacterium tuberculosis
STTTPSSGF

SEQ ID NO: 1408901 - protein, 8 aa, Mycobacterium tuberculosis
SVADDSGL

SEQ ID NO: 1408902 - protein, 9 aa, Mycobacterium tuberculosis
SVATEDGAA

SEQ ID NO: 1408903 - protein, 8 aa, Mycobacterium tuberculosis
SVDDGKST

SEQ ID NO: 1408904 - protein, 8 aa, Mycobacterium tuberculosis
SVDPPRSF

SEQ ID NO: 1408905 - protein, 6 aa, Mycobacterium tuberculosis
SVDPRR

SEQ ID NO: 1408906 - protein, 4 aa, Mycobacterium tuberculosis
SVDR

SEQ ID NO: 1408907 - protein, 13 aa, Mycobacterium tuberculosis
SVETNGKGCSGGV

SEQ ID NO: 1408908 - protein, 4 aa, Mycobacterium tuberculosis
SVND

SEQ ID NO: 1408909 - protein, 6 aa, Mycobacterium tuberculosis
SVNGNA

SEQ ID NO: 1408910 - protein, 7 aa, Mycobacterium tuberculosis
SVPGETM

SEQ ID NO: 1408911 - protein, 6 aa, Mycobacterium tuberculosis
SVPLPD

SEQ ID NO: 1408912 - protein, 6 aa, Mycobacterium tuberculosis
SVTPQA

SEQ ID NO: 1408913 - protein, 6 aa, Mycobacterium tuberculosis
SVYGDA

SEQ ID NO: 1408914 - protein, 5 aa, Mycobacterium tuberculosis
SYAGQ

SEQ ID NO: 1408915 - protein, 6 aa, Mycobacterium tuberculosis
SYGFSG

SEQ ID NO: 1408916 - protein, 8 aa, Mycobacterium tuberculosis
SYPDGHTA

SEQ ID NO: 1408917 - protein, 13 aa, Mycobacterium tuberculosis
SYPSALATDHHHG

SEQ ID NO: 1408918 - protein, 9 aa, Mycobacterium tuberculosis
SYQTKTDRQ

SEQ ID NO: 1408919 - protein, 9 aa, Mycobacterium tuberculosis
TAAAADGTM

SEQ ID NO: 1408920 - protein, 7 aa, Mycobacterium tuberculosis
TAADDAA

SEQ ID NO: 1408921 - protein, 14 aa, Mycobacterium tuberculosis
TAADPTISQTLKGG

SEQ ID NO: 1408922 - protein, 9 aa, Mycobacterium tuberculosis
TAAEPIPGA

SEQ ID NO: 1408923 - protein, 8 aa, Mycobacterium tuberculosis
TAAGGNAA

SEQ ID NO: 1408924 - protein, 7 aa, Mycobacterium tuberculosis
TAAGSEV

SEQ ID NO: 1408925 - protein, 8 aa, Mycobacterium tuberculosis
TAAGSGCA

SEQ ID NO: 1408926 - protein, 7 aa, Mycobacterium tuberculosis
TAAGTGV

SEQ ID NO: 1408927 - protein, 6 aa, Mycobacterium tuberculosis
TAAHEP

SEQ ID NO: 1408928 - protein, 9 aa, Mycobacterium tuberculosis
TAATDDEVD

SEQ ID NO: 1408929 - protein, 7 aa, Mycobacterium tuberculosis
TAATGAA

SEQ ID NO: 1408930 - protein, 13 aa, Mycobacterium tuberculosis
TACPKGVDPAGAI

SEQ ID NO: 1408931 - protein, 9 aa, Mycobacterium tuberculosis
TADGTGREV

SEQ ID NO: 1408932 - protein, 7 aa, Mycobacterium tuberculosis
TADLADA

SEQ ID NO: 1408933 - protein, 4 aa, Mycobacterium tuberculosis
TADP

SEQ ID NO: 1408934 - protein, 6 aa, Mycobacterium tuberculosis
TADPFG

SEQ ID NO: 1408935 - protein, 7 aa, Mycobacterium tuberculosis
TADPGSV

SEQ ID NO: 1408936 - protein, 9 aa, Mycobacterium tuberculosis
TAEAGRSAA

SEQ ID NO: 1408937 - protein, 8 aa, Mycobacterium tuberculosis
TAEARQVD

SEQ ID NO: 1408938 - protein, 9 aa, Mycobacterium tuberculosis
TAEGTAKPF

SEQ ID NO: 1408939 - protein, 4 aa, Mycobacterium tuberculosis
TAEP

SEQ ID NO: 1408940 - protein, 6 aa, Mycobacterium tuberculosis
TAEQRG

SEQ ID NO: 1408941 - protein, 26 aa, Mycobacterium tuberculosis
TAFSDPARVAPRDITTTTNSLGATTT

SEQ ID NO: 1408942 - protein, 13 aa, Mycobacterium tuberculosis
TAGPGSAWQGPAA

SEQ ID NO: 1408943 - protein, 13 aa, Mycobacterium tuberculosis
TAGPWESEQTHDS

SEQ ID NO: 1408944 - protein, 18 aa, Mycobacterium tuberculosis
TAGQAEQAGSQAVAAASA

SEQ ID NO: 1408945 - protein, 14 aa, Mycobacterium tuberculosis
TAGQGSAAKLATAL

SEQ ID NO: 1408946 - protein, 7 aa, Mycobacterium tuberculosis
TAGSPEK

SEQ ID NO: 1408947 - protein, 7 aa, Mycobacterium tuberculosis
TAHPGVN

SEQ ID NO: 1408948 - protein, 12 aa, Mycobacterium tuberculosis
TAHPQRDPHTGE

SEQ ID NO: 1408949 - protein, 4 aa, Mycobacterium tuberculosis
TAKA

SEQ ID NO: 1408950 - protein, 8 aa, Mycobacterium tuberculosis
TANKARPI

SEQ ID NO: 1408951 - protein, 8 aa, Mycobacterium tuberculosis
TAPEHGKG

SEQ ID NO: 1408952 - protein, 6 aa, Mycobacterium tuberculosis
TAPGEL

SEQ ID NO: 1408953 - protein, 8 aa, Mycobacterium tuberculosis
TAPGFSDE

SEQ ID NO: 1408954 - protein, 7 aa, Mycobacterium tuberculosis
TAPGGRT

SEQ ID NO: 1408955 - protein, 23 aa, Mycobacterium tuberculosis
TAPPASSGPSTTHDDEDITTATE

SEQ ID NO: 1408956 - protein, 7 aa, Mycobacterium tuberculosis
TAPRVAA

SEQ ID NO: 1408957 - protein, 18 aa, Mycobacterium tuberculosis
TAPTESAQRSNPGQLVRQ

SEQ ID NO: 1408958 - protein, 7 aa, Mycobacterium tuberculosis
TARDRNG

SEQ ID NO: 1408959 - protein, 13 aa, Mycobacterium tuberculosis
TARGEPELARDDA

SEQ ID NO: 1408960 - protein, 8 aa, Mycobacterium tuberculosis
TASADPPV

SEQ ID NO: 1408961 - protein, 15 aa, Mycobacterium tuberculosis
TASASAAHDRLGGPG

SEQ ID NO: 1408962 - protein, 8 aa, Mycobacterium tuberculosis
TASGQPVT

SEQ ID NO: 1408963 - protein, 4 aa, Mycobacterium tuberculosis
TASL

SEQ ID NO: 1408964 - protein, 11 aa, Mycobacterium tuberculosis
TASQGVAGATT

SEQ ID NO: 1408965 - protein, 8 aa, Mycobacterium tuberculosis
TATAGDDV

SEQ ID NO: 1408966 - protein, 5 aa, Mycobacterium tuberculosis
TATDG

SEQ ID NO: 1408967 - protein, 8 aa, Mycobacterium tuberculosis
TATDPDGN

SEQ ID NO: 1408968 - protein, 5 aa, Mycobacterium tuberculosis
TATNL

SEQ ID NO: 1408969 - protein, 21 aa, Mycobacterium tuberculosis
TATTAPETNGPPPDPDDDPPP

SEQ ID NO: 1408970 - protein, 10 aa, Mycobacterium tuberculosis
TAVRDKDGIS

SEQ ID NO: 1408971 - protein, 14 aa, Mycobacterium tuberculosis
TAVTGRVQNNGQSC

SEQ ID NO: 1408972 - protein, 11 aa, Mycobacterium tuberculosis
TCDPPPVQRPH

SEQ ID NO: 1408973 - protein, 10 aa, Mycobacterium tuberculosis
TDADNPGPTL

SEQ ID NO: 1408974 - protein, 10 aa, Mycobacterium tuberculosis
TDAQRDSEES

SEQ ID NO: 1408975 - protein, 9 aa, Mycobacterium tuberculosis
TDARGSYVP

SEQ ID NO: 1408976 - protein, 8 aa, Mycobacterium tuberculosis
TDAYEQGR

SEQ ID NO: 1408977 - protein, 5 aa, Mycobacterium tuberculosis
TDDDR

SEQ ID NO: 1408978 - protein, 4 aa, Mycobacterium tuberculosis
TDDP

SEQ ID NO: 1408979 - protein, 5 aa, Mycobacterium tuberculosis
TDDQV

SEQ ID NO: 1408980 - protein, 8 aa, Mycobacterium tuberculosis
TDDRGDPV

SEQ ID NO: 1408981 - protein, 9 aa, Mycobacterium tuberculosis
TDEPGLTPG

SEQ ID NO: 1408982 - protein, 7 aa, Mycobacterium tuberculosis
TDEQKAR

SEQ ID NO: 1408983 - protein, 11 aa, Mycobacterium tuberculosis
TDFPGGDSDEM

SEQ ID NO: 1408984 - protein, 10 aa, Mycobacterium tuberculosis
TDGDQGGGNP

SEQ ID NO: 1408985 - protein, 7 aa, Mycobacterium tuberculosis
TDGEQEF

SEQ ID NO: 1408986 - protein, 23 aa, Mycobacterium tuberculosis
TDGETNASLRKGDDVASITDERA

SEQ ID NO: 1408987 - protein, 12 aa, Mycobacterium tuberculosis
TDGRDKGLHRDA

SEQ ID NO: 1408988 - protein, 9 aa, Mycobacterium tuberculosis
TDGRVADEQ

SEQ ID NO: 1408989 - protein, 5 aa, Mycobacterium tuberculosis
TDHQP

SEQ ID NO: 1408990 - protein, 19 aa, Mycobacterium tuberculosis
TDMDDGNAAELKAVVCSCA

SEQ ID NO: 1408991 - protein, 4 aa, Mycobacterium tuberculosis
TDND

SEQ ID NO: 1408992 - protein, 6 aa, Mycobacterium tuberculosis
TDPARV

SEQ ID NO: 1408993 - protein, 18 aa, Mycobacterium tuberculosis
TDPEAPPGSGKPEPFGDD

SEQ ID NO: 1408994 - protein, 8 aa, Mycobacterium tuberculosis
TDPEEVGA

SEQ ID NO: 1408995 - protein, 9 aa, Mycobacterium tuberculosis
TDPEKGAQG

SEQ ID NO: 1408996 - protein, 9 aa, Mycobacterium tuberculosis
TDPNAAKHK

SEQ ID NO: 1408997 - protein, 10 aa, Mycobacterium tuberculosis
TDPNATPRHQ

SEQ ID NO: 1408998 - protein, 17 aa, Mycobacterium tuberculosis
TDPPPTAGEHNAVFLAR

SEQ ID NO: 1408999 - protein, 7 aa, Mycobacterium tuberculosis
TDPQYQS

SEQ ID NO: 1409000 - protein, 9 aa, Mycobacterium tuberculosis
TDPSAAKHR

SEQ ID NO: 1409001 - protein, 13 aa, Mycobacterium tuberculosis
TDPVPTGGDDPHK

SEQ ID NO: 1409002 - protein, 6 aa, Mycobacterium tuberculosis
TDRDDP

SEQ ID NO: 1409003 - protein, 9 aa, Mycobacterium tuberculosis
TDRDSVGGN

SEQ ID NO: 1409004 - protein, 7 aa, Mycobacterium tuberculosis
TDSDAVD

SEQ ID NO: 1409005 - protein, 5 aa, Mycobacterium tuberculosis
TDSQL

SEQ ID NO: 1409006 - protein, 7 aa, Mycobacterium tuberculosis
TDTPPEA

SEQ ID NO: 1409007 - protein, 5 aa, Mycobacterium tuberculosis
TDTQR

SEQ ID NO: 1409008 - protein, 9 aa, Mycobacterium tuberculosis
TEAIGETQI

SEQ ID NO: 1409009 - protein, 11 aa, Mycobacterium tuberculosis
TEATNHPGGYA

SEQ ID NO: 1409010 - protein, 8 aa, Mycobacterium tuberculosis
TEDATSAM

SEQ ID NO: 1409011 - protein, 7 aa, Mycobacterium tuberculosis
TEDPAAS

SEQ ID NO: 1409012 - protein, 4 aa, Mycobacterium tuberculosis
TEEV

SEQ ID NO: 1409013 - protein, 4 aa, Mycobacterium tuberculosis
TEGL

SEQ ID NO: 1409014 - protein, 9 aa, Mycobacterium tuberculosis
TEKAASKAI

SEQ ID NO: 1409015 - protein, 26 aa, Mycobacterium tuberculosis
TEKQGGSDVRAGTTQATPNADGSYSL

SEQ ID NO: 1409016 - protein, 7 aa, Mycobacterium tuberculosis
TEPAPVT

SEQ ID NO: 1409017 - protein, 9 aa, Mycobacterium tuberculosis
TEPEAGTDL

SEQ ID NO: 1409018 - protein, 13 aa, Mycobacterium tuberculosis
TEPGTGSDLQGIT

SEQ ID NO: 1409019 - protein, 10 aa, Mycobacterium tuberculosis
TEPQGGSDPG

SEQ ID NO: 1409020 - protein, 6 aa, Mycobacterium tuberculosis
TEQVPE

SEQ ID NO: 1409021 - protein, 25 aa, Mycobacterium tuberculosis
TERGATRADDRISEAGMEDRKRQGY

SEQ ID NO: 1409022 - protein, 9 aa, Mycobacterium tuberculosis
TERPEEDSF

SEQ ID NO: 1409023 - protein, 8 aa, Mycobacterium tuberculosis
TERPPTKP

SEQ ID NO: 1409024 - protein, 5 aa, Mycobacterium tuberculosis
TERQR

SEQ ID NO: 1409025 - protein, 7 aa, Mycobacterium tuberculosis
TESGPFR

SEQ ID NO: 1409026 - protein, 8 aa, Mycobacterium tuberculosis
TETGSSLA

SEQ ID NO: 1409027 - protein, 4 aa, Mycobacterium tuberculosis
TETL

SEQ ID NO: 1409028 - protein, 4 aa, Mycobacterium tuberculosis
TEWA

SEQ ID NO: 1409029 - protein, 10 aa, Mycobacterium tuberculosis
TEYGGGGLSP

SEQ ID NO: 1409030 - protein, 14 aa, Mycobacterium tuberculosis
TFDAEGSRKKLPSV

SEQ ID NO: 1409031 - protein, 7 aa, Mycobacterium tuberculosis
TFDSGDP

SEQ ID NO: 1409032 - protein, 8 aa, Mycobacterium tuberculosis
TFDSGDPE

SEQ ID NO: 1409033 - protein, 10 aa, Mycobacterium tuberculosis
TFGPYSPGQA

SEQ ID NO: 1409034 - protein, 6 aa, Mycobacterium tuberculosis
TFPDAG

SEQ ID NO: 1409035 - protein, 16 aa, Mycobacterium tuberculosis
TGAATSVQRDRGSRSR

SEQ ID NO: 1409036 - protein, 18 aa, Mycobacterium tuberculosis
TGAGTASGFGNVGGNTSG

SEQ ID NO: 1409037 - protein, 13 aa, Mycobacterium tuberculosis
TGAPDAGAQGDDG

SEQ ID NO: 1409038 - protein, 5 aa, Mycobacterium tuberculosis
TGAQT

SEQ ID NO: 1409039 - protein, 10 aa, Mycobacterium tuberculosis
TGAYDDADPV

SEQ ID NO: 1409040 - protein, 6 aa, Mycobacterium tuberculosis
TGDEQR

SEQ ID NO: 1409041 - protein, 7 aa, Mycobacterium tuberculosis
TGDPEAF

SEQ ID NO: 1409042 - protein, 7 aa, Mycobacterium tuberculosis
TGDRSAQ

SEQ ID NO: 1409043 - protein, 13 aa, Mycobacterium tuberculosis
TGEESDDESLGGA

SEQ ID NO: 1409044 - protein, 5 aa, Mycobacterium tuberculosis
TGEKL

SEQ ID NO: 1409045 - protein, 6 aa, Mycobacterium tuberculosis
TGEPIL

SEQ ID NO: 1409046 - protein, 7 aa, Mycobacterium tuberculosis
TGETTTG

SEQ ID NO: 1409047 - protein, 6 aa, Mycobacterium tuberculosis
TGGATN

SEQ ID NO: 1409048 - protein, 8 aa, Mycobacterium tuberculosis
TGGENTTS

SEQ ID NO: 1409049 - protein, 5 aa, Mycobacterium tuberculosis
TGGET

SEQ ID NO: 1409050 - protein, 8 aa, Mycobacterium tuberculosis
TGGPSSGF

SEQ ID NO: 1409051 - protein, 7 aa, Mycobacterium tuberculosis
TGGTIGA

SEQ ID NO: 1409052 - protein, 5 aa, Mycobacterium tuberculosis
TGGTR

SEQ ID NO: 1409053 - protein, 6 aa, Mycobacterium tuberculosis
TGHEPI

SEQ ID NO: 1409054 - protein, 10 aa, Mycobacterium tuberculosis
TGHGDSTTIG

SEQ ID NO: 1409055 - protein, 12 aa, Mycobacterium tuberculosis
TGIEPEKTTPAH

SEQ ID NO: 1409056 - protein, 5 aa, Mycobacterium tuberculosis
TGIGE

SEQ ID NO: 1409057 - protein, 10 aa, Mycobacterium tuberculosis
TGKAPPAARA

SEQ ID NO: 1409058 - protein, 10 aa, Mycobacterium tuberculosis
TGKPPHGPAA

SEQ ID NO: 1409059 - protein, 10 aa, Mycobacterium tuberculosis
TGKPTPAGYA

SEQ ID NO: 1409060 - protein, 13 aa, Mycobacterium tuberculosis
TGKRESKSRPGEG

SEQ ID NO: 1409061 - protein, 4 aa, Mycobacterium tuberculosis
TGLA

SEQ ID NO: 1409062 - protein, 4 aa, Mycobacterium tuberculosis
TGLQ

SEQ ID NO: 1409063 - protein, 6 aa, Mycobacterium tuberculosis
TGLREH

SEQ ID NO: 1409064 - protein, 6 aa, Mycobacterium tuberculosis
TGMTDE

SEQ ID NO: 1409065 - protein, 4 aa, Mycobacterium tuberculosis
TGNS

SEQ ID NO: 1409066 - protein, 6 aa, Mycobacterium tuberculosis
TGNTEE

SEQ ID NO: 1409067 - protein, 5 aa, Mycobacterium tuberculosis
TGPDD

SEQ ID NO: 1409068 - protein, 8 aa, Mycobacterium tuberculosis
TGPDGMGK

SEQ ID NO: 1409069 - protein, 7 aa, Mycobacterium tuberculosis
TGPDGQP

SEQ ID NO: 1409070 - protein, 4 aa, Mycobacterium tuberculosis
TGPV

SEQ ID NO: 1409071 - protein, 7 aa, Mycobacterium tuberculosis
TGQPRAV

SEQ ID NO: 1409072 - protein, 10 aa, Mycobacterium tuberculosis
TGRDPTQPRD

SEQ ID NO: 1409073 - protein, 8 aa, Mycobacterium tuberculosis
TGREADDL

SEQ ID NO: 1409074 - protein, 9 aa, Mycobacterium tuberculosis
TGRPPGAEA

SEQ ID NO: 1409075 - protein, 5 aa, Mycobacterium tuberculosis
TGRYS

SEQ ID NO: 1409076 - protein, 6 aa, Mycobacterium tuberculosis
TGSAGA

SEQ ID NO: 1409077 - protein, 8 aa, Mycobacterium tuberculosis
TGSSLSDL

SEQ ID NO: 1409078 - protein, 9 aa, Mycobacterium tuberculosis
TGSVQPARV

SEQ ID NO: 1409079 - protein, 4 aa, Mycobacterium tuberculosis
TGTT

SEQ ID NO: 1409080 - protein, 5 aa, Mycobacterium tuberculosis
TGTTH

SEQ ID NO: 1409081 - protein, 6 aa, Mycobacterium tuberculosis
TGVDDA

SEQ ID NO: 1409082 - protein, 4 aa, Mycobacterium tuberculosis
TGVP

SEQ ID NO: 1409083 - protein, 17 aa, Mycobacterium tuberculosis
TGWDPSAADRLTGNADA

SEQ ID NO: 1409084 - protein, 7 aa, Mycobacterium tuberculosis
TGYDRTY

SEQ ID NO: 1409085 - protein, 4 aa, Mycobacterium tuberculosis
TGYR

SEQ ID NO: 1409086 - protein, 9 aa, Mycobacterium tuberculosis
TGYSEETTQ

SEQ ID NO: 1409087 - protein, 8 aa, Mycobacterium tuberculosis
THGKTTTT

SEQ ID NO: 1409088 - protein, 17 aa, Mycobacterium tuberculosis
THPATTTHRAMGPEGRA

SEQ ID NO: 1409089 - protein, 8 aa, Mycobacterium tuberculosis
THSDDPEL

SEQ ID NO: 1409090 - protein, 9 aa, Mycobacterium tuberculosis
THSTTPQLA

SEQ ID NO: 1409091 - protein, 12 aa, Mycobacterium tuberculosis
TIDDPDAPALSD

SEQ ID NO: 1409092 - protein, 10 aa, Mycobacterium tuberculosis
TIGDEGDSQL

SEQ ID NO: 1409093 - protein, 20 aa, Mycobacterium tuberculosis
TIGNASSLHTSGRSARRRIE

SEQ ID NO: 1409094 - protein, 9 aa, Mycobacterium tuberculosis
TIGSQASTC

SEQ ID NO: 1409095 - protein, 4 aa, Mycobacterium tuberculosis
TIPE

SEQ ID NO: 1409096 - protein, 6 aa, Mycobacterium tuberculosis
TISDPE

SEQ ID NO: 1409097 - protein, 9 aa, Mycobacterium tuberculosis
TKANADPRS

SEQ ID NO: 1409098 - protein, 13 aa, Mycobacterium tuberculosis
TKDTPTKPLTDAE

SEQ ID NO: 1409099 - protein, 6 aa, Mycobacterium tuberculosis
TKEQAE

SEQ ID NO: 1409100 - protein, 8 aa, Mycobacterium tuberculosis
TKGNTQRW

SEQ ID NO: 1409101 - protein, 5 aa, Mycobacterium tuberculosis
TKHAR

SEQ ID NO: 1409102 - protein, 5 aa, Mycobacterium tuberculosis
TKLPG

SEQ ID NO: 1409103 - protein, 11 aa, Mycobacterium tuberculosis
TKLRDSPVAGR

SEQ ID NO: 1409104 - protein, 8 aa, Mycobacterium tuberculosis
TKNGAPAA

SEQ ID NO: 1409105 - protein, 7 aa, Mycobacterium tuberculosis
TKPSTSD

SEQ ID NO: 1409106 - protein, 8 aa, Mycobacterium tuberculosis
TKPTRPDL

SEQ ID NO: 1409107 - protein, 9 aa, Mycobacterium tuberculosis
TKRDGGRLS

SEQ ID NO: 1409108 - protein, 5 aa, Mycobacterium tuberculosis
TKRGA

SEQ ID NO: 1409109 - protein, 11 aa, Mycobacterium tuberculosis
TKVDPAADPAV

SEQ ID NO: 1409110 - protein, 10 aa, Mycobacterium tuberculosis
TLGTAERRSL

SEQ ID NO: 1409111 - protein, 5 aa, Mycobacterium tuberculosis
TLPAD

SEQ ID NO: 1409112 - protein, 16 aa, Mycobacterium tuberculosis
TLPGDSADDAAARDTA

SEQ ID NO: 1409113 - protein, 6 aa, Mycobacterium tuberculosis
TLPPSQ

SEQ ID NO: 1409114 - protein, 9 aa, Mycobacterium tuberculosis
TLPSGTDRD

SEQ ID NO: 1409115 - protein, 15 aa, Mycobacterium tuberculosis
TLSGSTLATQSVPPV

SEQ ID NO: 1409116 - protein, 7 aa, Mycobacterium tuberculosis
TLTPSRL

SEQ ID NO: 1409117 - protein, 9 aa, Mycobacterium tuberculosis
TMPRRAPAL

SEQ ID NO: 1409118 - protein, 30 aa, Mycobacterium tuberculosis; identical to SEQ ID NO: 189743

SEQ ID NO: 1409119 - protein, 10 aa, Mycobacterium tuberculosis
TNNPLPDPEY

SEQ ID NO: 1409120 - protein, 6 aa, Mycobacterium tuberculosis
TNNTAR

SEQ ID NO: 1409121 - protein, 6 aa, Mycobacterium tuberculosis
TNPPLD

SEQ ID NO: 1409122 - protein, 4 aa, Mycobacterium tuberculosis
TNTI

SEQ ID NO: 1409123 - protein, 5 aa, Mycobacterium tuberculosis
TPAAL

SEQ ID NO: 1409124 - protein, 12 aa, Mycobacterium tuberculosis
TPAGPDTADTAA

SEQ ID NO: 1409125 - protein, 5 aa, Mycobacterium tuberculosis
TPDQP

SEQ ID NO: 1409126 - protein, 6 aa, Mycobacterium tuberculosis
TPDSDR

SEQ ID NO: 1409127 - protein, 13 aa, Mycobacterium tuberculosis
TPGAEPRAPGGYG

SEQ ID NO: 1409128 - protein, 6 aa, Mycobacterium tuberculosis
TPHGQT

SEQ ID NO: 1409129 - protein, 14 aa, Mycobacterium tuberculosis
TPIGPAGATTVPAG

SEQ ID NO: 1409130 - protein, 5 aa, Mycobacterium tuberculosis
TPIPR

SEQ ID NO: 1409131 - protein, 7 aa, Mycobacterium tuberculosis
TPLADTA

SEQ ID NO: 1409132 - protein, 5 aa, Mycobacterium tuberculosis
TPLED

SEQ ID NO: 1409133 - protein, 8 aa, Mycobacterium tuberculosis
TPLSTDEL

SEQ ID NO: 1409134 - protein, 18 aa, Mycobacterium tuberculosis
TPNSESDPRYDSAGVPTF

SEQ ID NO: 1409135 - protein, 5 aa, Mycobacterium tuberculosis
TPPAE

SEQ ID NO: 1409136 - protein, 6 aa, Mycobacterium tuberculosis
TPPALT

SEQ ID NO: 1409137 - protein, 6 aa, Mycobacterium tuberculosis
TPPEER

SEQ ID NO: 1409138 - protein, 6 aa, Mycobacterium tuberculosis
TPPQAK

SEQ ID NO: 1409139 - protein, 10 aa, Mycobacterium tuberculosis
TPQERADPKI

SEQ ID NO: 1409140 - protein, 10 aa, Mycobacterium tuberculosis
TPQQATAGGV

SEQ ID NO: 1409141 - protein, 5 aa, Mycobacterium tuberculosis
TPQQQ

SEQ ID NO: 1409142 - protein, 7 aa, Mycobacterium tuberculosis
TPRAGGA

SEQ ID NO: 1409143 - protein, 12 aa, Mycobacterium tuberculosis
TPRGKQKNGSLH

SEQ ID NO: 1409144 - protein, 4 aa, Mycobacterium tuberculosis
TPRI

SEQ ID NO: 1409145 - protein, 6 aa, Mycobacterium tuberculosis
TPRRPA

SEQ ID NO: 1409146 - protein, 11 aa, Mycobacterium tuberculosis
TPSPGTSEGPW

SEQ ID NO: 1409147 - protein, 6 aa, Mycobacterium tuberculosis
TPTSKV

SEQ ID NO: 1409148 - protein, 8 aa, Mycobacterium tuberculosis
TPTTGRTH

SEQ ID NO: 1409149 - protein, 5 aa, Mycobacterium tuberculosis
TPVNG

SEQ ID NO: 1409150 - protein, 13 aa, Mycobacterium tuberculosis
TPWPTNGRQVPRR

SEQ ID NO: 1409151 - protein, 5 aa, Mycobacterium tuberculosis
TQEQA

SEQ ID NO: 1409152 - protein, 8 aa, Mycobacterium tuberculosis
TQPDTASL

SEQ ID NO: 1409153 - protein, 16 aa, Mycobacterium tuberculosis
TQPHTSSGRVPTEKGY

SEQ ID NO: 1409154 - protein, 4 aa, Mycobacterium tuberculosis
TQPR

SEQ ID NO: 1409155 - protein, 6 aa, Mycobacterium tuberculosis
TQTADG

SEQ ID NO: 1409156 - protein, 11 aa, Mycobacterium tuberculosis
TQTDGIGKRFD

SEQ ID NO: 1409157 - protein, 7 aa, Mycobacterium tuberculosis
TQTSQSG

SEQ ID NO: 1409158 - protein, 28 aa, Mycobacterium tuberculosis
TQTSRLSTTLRADEQAHRITPSREPDDG

SEQ ID NO: 1409159 - protein, 9 aa, Mycobacterium tuberculosis
TRAADPPAM

SEQ ID NO: 1409160 - protein, 6 aa, Mycobacterium tuberculosis
TRATAS

SEQ ID NO: 1409161 - protein, 6 aa, Mycobacterium tuberculosis
TRDEFD

SEQ ID NO: 1409162 - protein, 6 aa, Mycobacterium tuberculosis
TREGRA

SEQ ID NO: 1409163 - protein, 10 aa, Mycobacterium tuberculosis
TRGKPSAEQL

SEQ ID NO: 1409164 - protein, 13 aa, Mycobacterium tuberculosis
TRGSGPGSARTFP

SEQ ID NO: 1409165 - protein, 18 aa, Mycobacterium tuberculosis
TRKGVEDAGGTYQPHPAE

SEQ ID NO: 1409166 - protein, 6 aa, Mycobacterium tuberculosis
TRLSGQ

SEQ ID NO: 1409167 - protein, 8 aa, Mycobacterium tuberculosis
TRLTADGQ

SEQ ID NO: 1409168 - protein, 8 aa, Mycobacterium tuberculosis
TRRAEARA

SEQ ID NO: 1409169 - protein, 4 aa, Mycobacterium tuberculosis
TRRT

SEQ ID NO: 1409170 - protein, 8 aa, Mycobacterium tuberculosis
TRSGDLDP

SEQ ID NO: 1409171 - protein, 11 aa, Mycobacterium tuberculosis
TRSGSSGWTTH

SEQ ID NO: 1409172 - protein, 4 aa, Mycobacterium tuberculosis
TRSP

SEQ ID NO: 1409173 - protein, 7 aa, Mycobacterium tuberculosis
TRSRPGD

SEQ ID NO: 1409174 - protein, 9 aa, Mycobacterium tuberculosis
TRTGDGYGG

SEQ ID NO: 1409175 - protein, 9 aa, Mycobacterium tuberculosis
TRTKTRPYL

SEQ ID NO: 1409176 - protein, 10 aa, Mycobacterium tuberculosis
TRVGSGPFPT

SEQ ID NO: 1409177 - protein, 8 aa, Mycobacterium tuberculosis
TRVSSSVG

SEQ ID NO: 1409178 - protein, 9 aa, Mycobacterium tuberculosis
TSAEVTEST

SEQ ID NO: 1409179 - protein, 8 aa, Mycobacterium tuberculosis
TSAGAAAR

SEQ ID NO: 1409180 - protein, 10 aa, Mycobacterium tuberculosis
TSANRDSDQF

SEQ ID NO: 1409181 - protein, 8 aa, Mycobacterium tuberculosis
TSDDGTSI

SEQ ID NO: 1409182 - protein, 8 aa, Mycobacterium tuberculosis
TSDGTHND

SEQ ID NO: 1409183 - protein, 9 aa, Mycobacterium tuberculosis
TSDPPAHTR

SEQ ID NO: 1409184 - protein, 8 aa, Mycobacterium tuberculosis
TSEEERAR

SEQ ID NO: 1409185 - protein, 5 aa, Mycobacterium tuberculosis
TSESL

SEQ ID NO: 1409186 - protein, 11 aa, Mycobacterium tuberculosis
TSEVYGSSPHD

SEQ ID NO: 1409187 - protein, 6 aa, Mycobacterium tuberculosis
TSGANG

SEQ ID NO: 1409188 - protein, 4 aa, Mycobacterium tuberculosis
TSGD

SEQ ID NO: 1409189 - protein, 6 aa, Mycobacterium tuberculosis
TSGPGF

SEQ ID NO: 1409190 - protein, 9 aa, Mycobacterium tuberculosis
TSGPYTDTD

SEQ ID NO: 1409191 - protein, 11 aa, Mycobacterium tuberculosis
TSGTTGPPKGA

SEQ ID NO: 1409192 - protein, 11 aa, Mycobacterium tuberculosis
TSKPGQPPETV

SEQ ID NO: 1409193 - protein, 11 aa, Mycobacterium tuberculosis
TSKSADGKRVV

SEQ ID NO: 1409194 - protein, 10 aa, Mycobacterium tuberculosis
TSLPAGATKA

SEQ ID NO: 1409195 - protein, 6 aa, Mycobacterium tuberculosis
TSNTAG

SEQ ID NO: 1409196 - protein, 8 aa, Mycobacterium tuberculosis
TSPDGVDA

SEQ ID NO: 1409197 - protein, 7 aa, Mycobacterium tuberculosis
TSPDPAN

SEQ ID NO: 1409198 - protein, 5 aa, Mycobacterium tuberculosis
TSPEA

SEQ ID NO: 1409199 - protein, 4 aa, Mycobacterium tuberculosis
TSQR

SEQ ID NO: 1409200 - protein, 15 aa, Mycobacterium tuberculosis
TSRERHSHKAAKQRA

SEQ ID NO: 1409201 - protein, 5 aa, Mycobacterium tuberculosis
TSRGA

SEQ ID NO: 1409202 - protein, 8 aa, Mycobacterium tuberculosis
TSRLPADN

SEQ ID NO: 1409203 - protein, 8 aa, Mycobacterium tuberculosis
TSSGDRVD

SEQ ID NO: 1409204 - protein, 9 aa, Mycobacterium tuberculosis
TSSRAPLGR

SEQ ID NO: 1409205 - protein, 5 aa, Mycobacterium tuberculosis
TSSSR

SEQ ID NO: 1409206 - protein, 5 aa, Mycobacterium tuberculosis
TSTAW

SEQ ID NO: 1409207 - protein, 4 aa, Mycobacterium tuberculosis
TSTL

SEQ ID NO: 1409208 - protein, 12 aa, Mycobacterium tuberculosis
TSTRDDRVHPGH

SEQ ID NO: 1409209 - protein, 9 aa, Mycobacterium tuberculosis
TSTRPQTTR

SEQ ID NO: 1409210 - protein, 6 aa, Mycobacterium tuberculosis
TSVGST

SEQ ID NO: 1409211 - protein, 12 aa, Mycobacterium tuberculosis
TTAGNAAVTVLI

SEQ ID NO: 1409212 - protein, 5 aa, Mycobacterium tuberculosis
TTARE

SEQ ID NO: 1409213 - protein, 9 aa, Mycobacterium tuberculosis
TTASKNPKE

SEQ ID NO: 1409214 - protein, 5 aa, Mycobacterium tuberculosis
TTDRG

SEQ ID NO: 1409215 - protein, 7 aa, Mycobacterium tuberculosis
TTEQAKQ

SEQ ID NO: 1409216 - protein, 8 aa, Mycobacterium tuberculosis
TTGDTRAG

SEQ ID NO: 1409217 - protein, 11 aa, Mycobacterium tuberculosis
TTGNLSPGRAQ

SEQ ID NO: 1409218 - protein, 6 aa, Mycobacterium tuberculosis
TTKTFT

SEQ ID NO: 1409219 - protein, 10 aa, Mycobacterium tuberculosis
TTNTEEQALD

SEQ ID NO: 1409220 - protein, 4 aa, Mycobacterium tuberculosis
TTRS

SEQ ID NO: 1409221 - protein, 7 aa, Mycobacterium tuberculosis
TTSDPYV

SEQ ID NO: 1409222 - protein, 10 aa, Mycobacterium tuberculosis
TTSPQDARTI

SEQ ID NO: 1409223 - protein, 12 aa, Mycobacterium tuberculosis
TTTAAGERSHGR

SEQ ID NO: 1409224 - protein, 4 aa, Mycobacterium tuberculosis
TTVD

SEQ ID NO: 1409225 - protein, 7 aa, Mycobacterium tuberculosis
TTVQGSG

SEQ ID NO: 1409226 - protein, 4 aa, Mycobacterium tuberculosis
TTYP

SEQ ID NO: 1409227 - protein, 8 aa, Mycobacterium tuberculosis
TTYSPLPA

SEQ ID NO: 1409228 - protein, 20 aa, Mycobacterium tuberculosis
TVDPNSSTTALTGSTEEGQF

SEQ ID NO: 1409229 - protein, 9 aa, Mycobacterium tuberculosis
TVDPQPGED

SEQ ID NO: 1409230 - protein, 6 aa, Mycobacterium tuberculosis
TVGPTM

SEQ ID NO: 1409231 - protein, 9 aa, Mycobacterium tuberculosis
TVGSIGPGS

SEQ ID NO: 1409232 - protein, 9 aa, Mycobacterium tuberculosis
TVGSRLTKP

SEQ ID NO: 1409233 - protein, 6 aa, Mycobacterium tuberculosis
TVPVGT

SEQ ID NO: 1409234 - protein, 5 aa, Mycobacterium tuberculosis
TVTSR

SEQ ID NO: 1409235 - protein, 8 aa, Mycobacterium tuberculosis
TYESPGDL

SEQ ID NO: 1409236 - protein, 7 aa, Mycobacterium tuberculosis
TYGDGGN

SEQ ID NO: 1409237 - protein, 12 aa, Mycobacterium tuberculosis
TYGGGDWGRTPH

SEQ ID NO: 1409238 - protein, 8 aa, Mycobacterium tuberculosis
TYQTASAK

SEQ ID NO: 1409239 - protein, 4 aa, Mycobacterium tuberculosis
TYRD

SEQ ID NO: 1409240 - protein, 11 aa, Mycobacterium tuberculosis
TYRDDADTEHR

SEQ ID NO: 1409241 - protein, 6 aa, Mycobacterium tuberculosis
TYSPTG

SEQ ID NO: 1409242 - protein, 9 aa, Mycobacterium tuberculosis
TYTPGDSLR

SEQ ID NO: 1409243 - protein, 7 aa, Mycobacterium tuberculosis
VAAGDNR

SEQ ID NO: 1409244 - protein, 7 aa, Mycobacterium tuberculosis
VAASPND

SEQ ID NO: 1409245 - protein, 6 aa, Mycobacterium tuberculosis
VADGDA

SEQ ID NO: 1409246 - protein, 13 aa, Mycobacterium tuberculosis
VADGGLGSLLGGA

SEQ ID NO: 1409247 - protein, 12 aa, Mycobacterium tuberculosis
VADREAPAARVS

SEQ ID NO: 1409248 - protein, 15 aa, Mycobacterium tuberculosis
VAEPGSAGPIAGADR

SEQ ID NO: 1409249 - protein, 14 aa, Mycobacterium tuberculosis
VAEPTAPRSGDNPL

SEQ ID NO: 1409250 - protein, 9 aa, Mycobacterium tuberculosis
VAEREPGVA

SEQ ID NO: 1409251 - protein, 13 aa, Mycobacterium tuberculosis
VAGPHGGSAVATN

SEQ ID NO: 1409252 - protein, 9 aa, Mycobacterium tuberculosis
VAKPGPGQR

SEQ ID NO: 1409253 - protein, 6 aa, Mycobacterium tuberculosis
VAPADK

SEQ ID NO: 1409254 - protein, 14 aa, Mycobacterium tuberculosis
VAPAQELAKRFTDF

SEQ ID NO: 1409255 - protein, 10 aa, Mycobacterium tuberculosis
VAPDHQNTKR

SEQ ID NO: 1409256 - protein, 13 aa, Mycobacterium tuberculosis
VAREARRAPELAG

SEQ ID NO: 1409257 - protein, 8 aa, Mycobacterium tuberculosis
VARQTPQQ

SEQ ID NO: 1409258 - protein, 6 aa, Mycobacterium tuberculosis
VARRQA

SEQ ID NO: 1409259 - protein, 9 aa, Mycobacterium tuberculosis
VASDSATET

SEQ ID NO: 1409260 - protein, 7 aa, Mycobacterium tuberculosis
VASPGVA

SEQ ID NO: 1409261 - protein, 6 aa, Mycobacterium tuberculosis
VDADGG

SEQ ID NO: 1409262 - protein, 4 aa, Mycobacterium tuberculosis
VDAR

SEQ ID NO: 1409263 - protein, 5 aa, Mycobacterium tuberculosis
VDDPA

SEQ ID NO: 1409264 - protein, 5 aa, Mycobacterium tuberculosis
VDDPD

SEQ ID NO: 1409265 - protein, 12 aa, Mycobacterium tuberculosis
VDEAAQSEPLTP

SEQ ID NO: 1409266 - protein, 7 aa, Mycobacterium tuberculosis
VDEDAAR

SEQ ID NO: 1409267 - protein, 10 aa, Mycobacterium tuberculosis
VDEQTGAESV

SEQ ID NO: 1409268 - protein, 6 aa, Mycobacterium tuberculosis
VDESNL

SEQ ID NO: 1409269 - protein, 15 aa, Mycobacterium tuberculosis
VDESTTRTAIAEVTA

SEQ ID NO: 1409270 - protein, 16 aa, Mycobacterium tuberculosis
VDGAEALRSATENRPD

SEQ ID NO: 1409271 - protein, 5 aa, Mycobacterium tuberculosis
VDGAG

SEQ ID NO: 1409272 - protein, 9 aa, Mycobacterium tuberculosis
VDGERLSSR

SEQ ID NO: 1409273 - protein, 10 aa, Mycobacterium tuberculosis
VDGKTKEDLG

SEQ ID NO: 1409274 - protein, 6 aa, Mycobacterium tuberculosis
VDGQYD

SEQ ID NO: 1409275 - protein, 5 aa, Mycobacterium tuberculosis
VDGRA

SEQ ID NO: 1409276 - protein, 5 aa, Mycobacterium tuberculosis
VDGYH

SEQ ID NO: 1409277 - protein, 8 aa, Mycobacterium tuberculosis
VDNGGHEL

SEQ ID NO: 1409278 - protein, 4 aa, Mycobacterium tuberculosis
VDPD

SEQ ID NO: 1409279 - protein, 5 aa, Mycobacterium tuberculosis
VDPED

SEQ ID NO: 1409280 - protein, 16 aa, Mycobacterium tuberculosis
VDPGRLAATLAPPDVP

SEQ ID NO: 1409281 - protein, 6 aa, Mycobacterium tuberculosis
VDQTGV

SEQ ID NO: 1409282 - protein, 6 aa, Mycobacterium tuberculosis
VDRARE

SEQ ID NO: 1409283 - protein, 5 aa, Mycobacterium tuberculosis
VDRDD

SEQ ID NO: 1409284 - protein, 9 aa, Mycobacterium tuberculosis
VDREPTGDG

SEQ ID NO: 1409285 - protein, 10 aa, Mycobacterium tuberculosis
VDRPPSQRFT

SEQ ID NO: 1409286 - protein, 9 aa, Mycobacterium tuberculosis
VDSDGTPAY

SEQ ID NO: 1409287 - protein, 7 aa, Mycobacterium tuberculosis
VDSQYDT

SEQ ID NO: 1409288 - protein, 14 aa, Mycobacterium tuberculosis
VDSTAPTSSVQPRA

SEQ ID NO: 1409289 - protein, 5 aa, Mycobacterium tuberculosis
VDTDH

SEQ ID NO: 1409290 - protein, 7 aa, Mycobacterium tuberculosis
VDTRGPT

SEQ ID NO: 1409291 - protein, 9 aa, Mycobacterium tuberculosis
VEATGNRGK

SEQ ID NO: 1409292 - protein, 7 aa, Mycobacterium tuberculosis
VEEPTSA

SEQ ID NO: 1409293 - protein, 51 aa, Mycobacterium tuberculosis; identical to SEQ ID NO: 195193

SEQ ID NO: 1409294 - protein, 11 aa, Mycobacterium tuberculosis
VEGGNKQLEEL

SEQ ID NO: 1409295 - protein, 17 aa, Mycobacterium tuberculosis
VEGSAGASAPTVDDVGD

SEQ ID NO: 1409296 - protein, 9 aa, Mycobacterium tuberculosis
VEGTQSSRE

SEQ ID NO: 1409297 - protein, 8 aa, Mycobacterium tuberculosis
VEITERDG

SEQ ID NO: 1409298 - protein, 6 aa, Mycobacterium tuberculosis
VENSPG

SEQ ID NO: 1409299 - protein, 6 aa, Mycobacterium tuberculosis
VEPGAP

SEQ ID NO: 1409300 - protein, 8 aa, Mycobacterium tuberculosis
VEPKYPQA

SEQ ID NO: 1409301 - protein, 5 aa, Mycobacterium tuberculosis
VEPPR

SEQ ID NO: 1409302 - protein, 7 aa, Mycobacterium tuberculosis
VEPSPHR

SEQ ID NO: 1409303 - protein, 6 aa, Mycobacterium tuberculosis
VEPSRK

SEQ ID NO: 1409304 - protein, 6 aa, Mycobacterium tuberculosis
VEPSVA

SEQ ID NO: 1409305 - protein, 7 aa, Mycobacterium tuberculosis
VEPTTGT

SEQ ID NO: 1409306 - protein, 4 aa, Mycobacterium tuberculosis
VEPV

SEQ ID NO: 1409307 - protein, 7 aa, Mycobacterium tuberculosis
VERNPNE

SEQ ID NO: 1409308 - protein, 5 aa, Mycobacterium tuberculosis
VETGR

SEQ ID NO: 1409309 - protein, 20 aa, Mycobacterium tuberculosis
VEVEGSAKPACVAESIVRYV

SEQ ID NO: 1409310 - protein, 10 aa, Mycobacterium tuberculosis
VGAESTRHAS

SEQ ID NO: 1409311 - protein, 12 aa, Mycobacterium tuberculosis
VGAPPTCGGERR

SEQ ID NO: 1409312 - protein, 8 aa, Mycobacterium tuberculosis
VGAPSSGI

SEQ ID NO: 1409313 - protein, 5 aa, Mycobacterium tuberculosis
VGATY

SEQ ID NO: 1409314 - protein, 9 aa, Mycobacterium tuberculosis
VGDDKDKAA

SEQ ID NO: 1409315 - protein, 7 aa, Mycobacterium tuberculosis
VGDGAND

SEQ ID NO: 1409316 - protein, 4 aa, Mycobacterium tuberculosis
VGDP

SEQ ID NO: 1409317 - protein, 5 aa, Mycobacterium tuberculosis
VGDPA

SEQ ID NO: 1409318 - protein, 8 aa, Mycobacterium tuberculosis
VGDPGGGA

SEQ ID NO: 1409319 - protein, 8 aa, Mycobacterium tuberculosis
VGDQTAER

SEQ ID NO: 1409320 - protein, 17 aa, Mycobacterium tuberculosis
VGDRRTQNQPGTTDEYP

SEQ ID NO: 1409321 - protein, 15 aa, Mycobacterium tuberculosis
VGEPEPAGRPADPPF

SEQ ID NO: 1409322 - protein, 15 aa, Mycobacterium tuberculosis
VGESESGSDRAPASQ

SEQ ID NO: 1409323 - protein, 15 aa, Mycobacterium tuberculosis
VGETRSYTVPNGSTV

SEQ ID NO: 1409324 - protein, 8 aa, Mycobacterium tuberculosis
VGGAAAEA

SEQ ID NO: 1409325 - protein, 12 aa, Mycobacterium tuberculosis
VGGAKPPPRGGL

SEQ ID NO: 1409326 - protein, 5 aa, Mycobacterium tuberculosis
VGGAR

SEQ ID NO: 1409327 - protein, 7 aa, Mycobacterium tuberculosis
VGGDGAE

SEQ ID NO: 1409328 - protein, 11 aa, Mycobacterium tuberculosis
VGGDSGDDGTI

SEQ ID NO: 1409329 - protein, 6 aa, Mycobacterium tuberculosis
VGGGTD

SEQ ID NO: 1409330 - protein, 14 aa, Mycobacterium tuberculosis
VGGKTGINTDAGKN

SEQ ID NO: 1409331 - protein, 6 aa, Mycobacterium tuberculosis
VGHGPS

SEQ ID NO: 1409332 - protein, 9 aa, Mycobacterium tuberculosis
VGPEMPSGV

SEQ ID NO: 1409333 - protein, 4 aa, Mycobacterium tuberculosis
VGPG

SEQ ID NO: 1409334 - protein, 6 aa, Mycobacterium tuberculosis
VGPMDN

SEQ ID NO: 1409335 - protein, 11 aa, Mycobacterium tuberculosis
VGPNGSGKSNV

SEQ ID NO: 1409336 - protein, 7 aa, Mycobacterium tuberculosis
VGPPPTH

SEQ ID NO: 1409337 - protein, 6 aa, Mycobacterium tuberculosis
VGQRDQ

SEQ ID NO: 1409338 - protein, 8 aa, Mycobacterium tuberculosis
VGSAGGRV

SEQ ID NO: 1409339 - protein, 10 aa, Mycobacterium tuberculosis
VGSSDPRLPG

SEQ ID NO: 1409340 - protein, 18 aa, Mycobacterium tuberculosis
VGSSGFQNGGSNNSGLQN

SEQ ID NO: 1409341 - protein, 4 aa, Mycobacterium tuberculosis
VGTA

SEQ ID NO: 1409342 - protein, 20 aa, Mycobacterium tuberculosis
VGTGSGPNSGFGNAGTNNSG

SEQ ID NO: 1409343 - protein, 25 aa, Mycobacterium tuberculosis
VGVGESGASYLAGDAAAAATYGVVG

SEQ ID NO: 1409344 - protein, 20 aa, Mycobacterium tuberculosis
VHSGQRRTDVTTTLGPGATV

SEQ ID NO: 1409345 - protein, 7 aa, Mycobacterium tuberculosis
VKDGDDA

SEQ ID NO: 1409346 - protein, 6 aa, Mycobacterium tuberculosis
VKDGYG

SEQ ID NO: 1409347 - protein, 9 aa, Mycobacterium tuberculosis
VKGDPSAAV

SEQ ID NO: 1409348 - protein, 7 aa, Mycobacterium tuberculosis
VKGDPTE

SEQ ID NO: 1409349 - protein, 6 aa, Mycobacterium tuberculosis
VKGTNA

SEQ ID NO: 1409350 - protein, 13 aa, Mycobacterium tuberculosis
VKPGGHFDAQHFA

SEQ ID NO: 1409351 - protein, 6 aa, Mycobacterium tuberculosis
VKPGRA

SEQ ID NO: 1409352 - protein, 4 aa, Mycobacterium tuberculosis
VKPP

SEQ ID NO: 1409353 - protein, 6 aa, Mycobacterium tuberculosis
VKPTVA

SEQ ID NO: 1409354 - protein, 37 aa, Mycobacterium tuberculosis; identical to SEQ ID NO: 191003

SEQ ID NO: 1409355 - protein, 37 aa, Mycobacterium tuberculosis; identical to SEQ ID NO: 191004

SEQ ID NO: 1409356 - protein, 9 aa, Mycobacterium tuberculosis
VKRNSPALR

SEQ ID NO: 1409357 - protein, 4 aa, Mycobacterium tuberculosis
VKRR

SEQ ID NO: 1409358 - protein, 7 aa, Mycobacterium tuberculosis
VLPGGTG

SEQ ID NO: 1409359 - protein, 7 aa, Mycobacterium tuberculosis
VNAPDGT

SEQ ID NO: 1409360 - protein, 8 aa, Mycobacterium tuberculosis
VNESRTAK

SEQ ID NO: 1409361 - protein, 9 aa, Mycobacterium tuberculosis
VNGDYAAGN

SEQ ID NO: 1409362 - protein, 4 aa, Mycobacterium tuberculosis
VNGR

SEQ ID NO: 1409363 - protein, 9 aa, Mycobacterium tuberculosis
VNGSRRPSA

SEQ ID NO: 1409364 - protein, 6 aa, Mycobacterium tuberculosis
VNSPGW

SEQ ID NO: 1409365 - protein, 17 aa, Mycobacterium tuberculosis
VNSSPARFDQKKADALN

SEQ ID NO: 1409366 - protein, 5 aa, Mycobacterium tuberculosis
VPADM

SEQ ID NO: 1409367 - protein, 9 aa, Mycobacterium tuberculosis
VPAPGGRRE

SEQ ID NO: 1409368 - protein, 10 aa, Mycobacterium tuberculosis
VPDGDGPRKV

SEQ ID NO: 1409369 - protein, 10 aa, Mycobacterium tuberculosis
VPDPAPTKRQ

SEQ ID NO: 1409370 - protein, 8 aa, Mycobacterium tuberculosis
VPETGPDA

SEQ ID NO: 1409371 - protein, 8 aa, Mycobacterium tuberculosis
VPGDRSTE

SEQ ID NO: 1409372 - protein, 4 aa, Mycobacterium tuberculosis
VPGH

SEQ ID NO: 1409373 - protein, 5 aa, Mycobacterium tuberculosis
VPGPE

SEQ ID NO: 1409374 - protein, 4 aa, Mycobacterium tuberculosis
VPGS

SEQ ID NO: 1409375 - protein, 8 aa, Mycobacterium tuberculosis
VPKGTADG

SEQ ID NO: 1409376 - protein, 4 aa, Mycobacterium tuberculosis
VPND

SEQ ID NO: 1409377 - protein, 7 aa, Mycobacterium tuberculosis
VPPPRNT

SEQ ID NO: 1409378 - protein, 13 aa, Mycobacterium tuberculosis
VPPRGTRPTTDRV

SEQ ID NO: 1409379 - protein, 4 aa, Mycobacterium tuberculosis
VPPT

SEQ ID NO: 1409380 - protein, 50 aa, Mycobacterium tuberculosis; identical to SEQ ID NO: 191176

SEQ ID NO: 1409381 - protein, 9 aa, Mycobacterium tuberculosis
VQATDNPLK

SEQ ID NO: 1409382 - protein, 7 aa, Mycobacterium tuberculosis
VQDEGSQ

SEQ ID NO: 1409383 - protein, 5 aa, Mycobacterium tuberculosis
VQDPY

SEQ ID NO: 1409384 - protein, 6 aa, Mycobacterium tuberculosis
VQGEPV

SEQ ID NO: 1409385 - protein, 9 aa, Mycobacterium tuberculosis
VQPEGDRGQ

SEQ ID NO: 1409386 - protein, 4 aa, Mycobacterium tuberculosis
VQQG

SEQ ID NO: 1409387 - protein, 16 aa, Mycobacterium tuberculosis
VQRPSSDDELGGPASP

SEQ ID NO: 1409388 - protein, 9 aa, Mycobacterium tuberculosis
VQSSRPEDY

SEQ ID NO: 1409389 - protein, 7 aa, Mycobacterium tuberculosis
VQTADGA

SEQ ID NO: 1409390 - protein, 23 aa, Mycobacterium tuberculosis
VQTPARNLPPPDERDNPTHYCPK

SEQ ID NO: 1409391 - protein, 7 aa, Mycobacterium tuberculosis
VQTPYRK

SEQ ID NO: 1409392 - protein, 5 aa, Mycobacterium tuberculosis
VQTRE

SEQ ID NO: 1409393 - protein, 6 aa, Mycobacterium tuberculosis
VQYNPK

SEQ ID NO: 1409394 - protein, 9 aa, Mycobacterium tuberculosis
VRADAESLA

SEQ ID NO: 1409395 - protein, 10 aa, Mycobacterium tuberculosis
VRDAENSEDV

SEQ ID NO: 1409396 - protein, 7 aa, Mycobacterium tuberculosis
VRGEGGR

SEQ ID NO: 1409397 - protein, 5 aa, Mycobacterium tuberculosis
VRGGD

SEQ ID NO: 1409398 - protein, 6 aa, Mycobacterium tuberculosis
VRGNTQ

SEQ ID NO: 1409399 - protein, 8 aa, Mycobacterium tuberculosis
VRGRDKAE

SEQ ID NO: 1409400 - protein, 11 aa, Mycobacterium tuberculosis
VRHGSGKGGDY

SEQ ID NO: 1409401 - protein, 5 aa, Mycobacterium tuberculosis
VRPNT

SEQ ID NO: 1409402 - protein, 11 aa, Mycobacterium tuberculosis
VRPPTPSRRLP

SEQ ID NO: 1409403 - protein, 10 aa, Mycobacterium tuberculosis
VRQPGKTGEE

SEQ ID NO: 1409404 - protein, 12 aa, Mycobacterium tuberculosis
VRQSKVGDTVTS

SEQ ID NO: 1409405 - protein, 17 aa, Mycobacterium tuberculosis
VRRGDPRLGEGGVPTDR

SEQ ID NO: 1409406 - protein, 16 aa, Mycobacterium tuberculosis
VRRSRAGVSDPNRPTG

SEQ ID NO: 1409407 - protein, 8 aa, Mycobacterium tuberculosis
VRRSTAES

SEQ ID NO: 1409408 - protein, 8 aa, Mycobacterium tuberculosis
VRSDPQAQ

SEQ ID NO: 1409409 - protein, 7 aa, Mycobacterium tuberculosis
VRSEREL

SEQ ID NO: 1409410 - protein, 4 aa, Mycobacterium tuberculosis
VRTS

SEQ ID NO: 1409411 - protein, 10 aa, Mycobacterium tuberculosis
VSAGPGTRAN

SEQ ID NO: 1409412 - protein, 7 aa, Mycobacterium tuberculosis
VSDPAHV

SEQ ID NO: 1409413 - protein, 5 aa, Mycobacterium tuberculosis
VSDQP

SEQ ID NO: 1409414 - protein, 7 aa, Mycobacterium tuberculosis
VSEPERK

SEQ ID NO: 1409415 - protein, 17 aa, Mycobacterium tuberculosis
VSESTAADNFDEMSPDA

SEQ ID NO: 1409416 - protein, 7 aa, Mycobacterium tuberculosis
VSGDADR

SEQ ID NO: 1409417 - protein, 20 aa, Mycobacterium tuberculosis
VSGDDRPVAGLNGNGPFPAV

SEQ ID NO: 1409418 - protein, 28 aa, Mycobacterium tuberculosis
VSGPGRKPVMGETGGAHRIESAKAGKLT

SEQ ID NO: 1409419 - protein, 4 aa, Mycobacterium tuberculosis
VSGQ

SEQ ID NO: 1409420 - protein, 7 aa, Mycobacterium tuberculosis
VSIDGQT

SEQ ID NO: 1409421 - protein, 8 aa, Mycobacterium tuberculosis
VSLRGGQS

SEQ ID NO: 1409422 - protein, 5 aa, Mycobacterium tuberculosis
VSPEY

SEQ ID NO: 1409423 - protein, 6 aa, Mycobacterium tuberculosis
VSPGTL

SEQ ID NO: 1409424 - protein, 17 aa, Mycobacterium tuberculosis
VSPPPPGLYTSGPALQP

SEQ ID NO: 1409425 - protein, 6 aa, Mycobacterium tuberculosis
VSPQNA

SEQ ID NO: 1409426 - protein, 11 aa, Mycobacterium tuberculosis
VSRAAARKRAE

SEQ ID NO: 1409427 - protein, 8 aa, Mycobacterium tuberculosis
VSSNPEAY

SEQ ID NO: 1409428 - protein, 8 aa, Mycobacterium tuberculosis
VSSRDEQI

SEQ ID NO: 1409429 - protein, 9 aa, Mycobacterium tuberculosis
VSTPTELES

SEQ ID NO: 1409430 - protein, 21 aa, Mycobacterium tuberculosis
VSTTTGPGIPVDPSITRNFAG

SEQ ID NO: 1409431 - protein, 4 aa, Mycobacterium tuberculosis
VTAE

SEQ ID NO: 1409432 - protein, 5 aa, Mycobacterium tuberculosis
VTASL

SEQ ID NO: 1409433 - protein, 6 aa, Mycobacterium tuberculosis
VTATTT

SEQ ID NO: 1409434 - protein, 9 aa, Mycobacterium tuberculosis
VTDAPDGTR

SEQ ID NO: 1409435 - protein, 5 aa, Mycobacterium tuberculosis
VTDKP

SEQ ID NO: 1409436 - protein, 7 aa, Mycobacterium tuberculosis
VTDSTGL

SEQ ID NO: 1409437 - protein, 17 aa, Mycobacterium tuberculosis
VTDTADGPQWSLLGGDT

SEQ ID NO: 1409438 - protein, 5 aa, Mycobacterium tuberculosis
VTEAA

SEQ ID NO: 1409439 - protein, 7 aa, Mycobacterium tuberculosis
VTEETTG

SEQ ID NO: 1409440 - protein, 4 aa, Mycobacterium tuberculosis
VTGA

SEQ ID NO: 1409441 - protein, 9 aa, Mycobacterium tuberculosis
VTGNPANTN

SEQ ID NO: 1409442 - protein, 10 aa, Mycobacterium tuberculosis
VTGSSTVASL

SEQ ID NO: 1409443 - protein, 10 aa, Mycobacterium tuberculosis
VTGTGVGGRI

SEQ ID NO: 1409444 - protein, 10 aa, Mycobacterium tuberculosis
VTKRGGGAAL

SEQ ID NO: 1409445 - protein, 7 aa, Mycobacterium tuberculosis
VTNTEGR

SEQ ID NO: 1409446 - protein, 12 aa, Mycobacterium tuberculosis
VTNTGDRSGADV

SEQ ID NO: 1409447 - protein, 7 aa, Mycobacterium tuberculosis
VTPADFG

SEQ ID NO: 1409448 - protein, 6 aa, Mycobacterium tuberculosis
VTRPDG

SEQ ID NO: 1409449 - protein, 11 aa, Mycobacterium tuberculosis
VTSALSSSHGL

SEQ ID NO: 1409450 - protein, 8 aa, Mycobacterium tuberculosis
VTSPADPE

SEQ ID NO: 1409451 - protein, 12 aa, Mycobacterium tuberculosis
VTSPAGPVTTRR

SEQ ID NO: 1409452 - protein, 5 aa, Mycobacterium tuberculosis
VTSPG

SEQ ID NO: 1409453 - protein, 10 aa, Mycobacterium tuberculosis
VTSRGYPPSI

SEQ ID NO: 1409454 - protein, 7 aa, Mycobacterium tuberculosis
VTTGRRR

SEQ ID NO: 1409455 - protein, 7 aa, Mycobacterium tuberculosis
VTTKGGN

SEQ ID NO: 1409456 - protein, 13 aa, Mycobacterium tuberculosis
VTWSGAGSISGSD

SEQ ID NO: 1409457 - protein, 5 aa, Mycobacterium tuberculosis
VVNPD

SEQ ID NO: 1409458 - protein, 8 aa, Mycobacterium tuberculosis
VVSSDGAR

SEQ ID NO: 1409459 - protein, 10 aa, Mycobacterium tuberculosis
WAPHGGESRV

SEQ ID NO: 1409460 - protein, 19 aa, Mycobacterium tuberculosis
WASEGAKAAGEAAKALPAA

SEQ ID NO: 1409461 - protein, 17 aa, Mycobacterium tuberculosis
WDGPQAGAATAEISPTG

SEQ ID NO: 1409462 - protein, 11 aa, Mycobacterium tuberculosis
WDRPDSPDPLG

SEQ ID NO: 1409463 - protein, 10 aa, Mycobacterium tuberculosis
WESRDETSAA

SEQ ID NO: 1409464 - protein, 4 aa, Mycobacterium tuberculosis
WGGP

SEQ ID NO: 1409465 - protein, 5 aa, Mycobacterium tuberculosis
WGQPN

SEQ ID NO: 1409466 - protein, 16 aa, Mycobacterium tuberculosis
WGSGEATADHGADRTA

SEQ ID NO: 1409467 - protein, 8 aa, Mycobacterium tuberculosis
WGSGPGKL

SEQ ID NO: 1409468 - protein, 11 aa, Mycobacterium tuberculosis
WGTGPAPDPRL

SEQ ID NO: 1409469 - protein, 14 aa, Mycobacterium tuberculosis
WGTPQEHRRRVLEA

SEQ ID NO: 1409470 - protein, 8 aa, Mycobacterium tuberculosis
WKKPGTSD

SEQ ID NO: 1409471 - protein, 9 aa, Mycobacterium tuberculosis
WKQKDYDEY

SEQ ID NO: 1409472 - protein, 7 aa, Mycobacterium tuberculosis
WNEDGSA

SEQ ID NO: 1409473 - protein, 6 aa, Mycobacterium tuberculosis
WNPPVT

SEQ ID NO: 1409474 - protein, 14 aa, Mycobacterium tuberculosis
WNQAPSALLGGGSG

SEQ ID NO: 1409475 - protein, 16 aa, Mycobacterium tuberculosis
WPASSADGTARPGRKA

SEQ ID NO: 1409476 - protein, 6 aa, Mycobacterium tuberculosis
WPGENR

SEQ ID NO: 1409477 - protein, 7 aa, Mycobacterium tuberculosis
WPPATTE

SEQ ID NO: 1409478 - protein, 7 aa, Mycobacterium tuberculosis
WPSGGGG

SEQ ID NO: 1409479 - protein, 14 aa, Mycobacterium tuberculosis
WPTGPAAGAQPPLV

SEQ ID NO: 1409480 - protein, 12 aa, Mycobacterium tuberculosis
WPTTGRPRRAGV

SEQ ID NO: 1409481 - protein, 7 aa, Mycobacterium tuberculosis
WRGETGE

SEQ ID NO: 1409482 - protein, 11 aa, Mycobacterium tuberculosis
WRPDGSHGDTS

SEQ ID NO: 1409483 - protein, 7 aa, Mycobacterium tuberculosis
WSPDGKP

SEQ ID NO: 1409484 - protein, 6 aa, Mycobacterium tuberculosis
WSTAEN

SEQ ID NO: 1409485 - protein, 4 aa, Mycobacterium tuberculosis
YAAY

SEQ ID NO: 1409486 - protein, 11 aa, Mycobacterium tuberculosis
YADGNLPKGRL

SEQ ID NO: 1409487 - protein, 6 aa, Mycobacterium tuberculosis
YAEPGQ

SEQ ID NO: 1409488 - protein, 5 aa, Mycobacterium tuberculosis
YAGPP

SEQ ID NO: 1409489 - protein, 8 aa, Mycobacterium tuberculosis
YANARDDY

SEQ ID NO: 1409490 - protein, 7 aa, Mycobacterium tuberculosis
YAPDSDM

SEQ ID NO: 1409491 - protein, 5 aa, Mycobacterium tuberculosis
YAPNG

SEQ ID NO: 1409492 - protein, 6 aa, Mycobacterium tuberculosis
YAPNRT

SEQ ID NO: 1409493 - protein, 7 aa, Mycobacterium tuberculosis
YAPRRQK

SEQ ID NO: 1409494 - protein, 6 aa, Mycobacterium tuberculosis
YASGGW

SEQ ID NO: 1409495 - protein, 9 aa, Mycobacterium tuberculosis
YASTDADDP

SEQ ID NO: 1409496 - protein, 12 aa, Mycobacterium tuberculosis
YDEGDSFDQSAA

SEQ ID NO: 1409497 - protein, 12 aa, Mycobacterium tuberculosis
YDGSTAGQDDAT

SEQ ID NO: 1409498 - protein, 6 aa, Mycobacterium tuberculosis
YDPDAL

SEQ ID NO: 1409499 - protein, 7 aa, Mycobacterium tuberculosis
YDPDPEL

SEQ ID NO: 1409500 - protein, 10 aa, Mycobacterium tuberculosis
YDRGPSAPSL

SEQ ID NO: 1409501 - protein, 6 aa, Mycobacterium tuberculosis
YDSEEA

SEQ ID NO: 1409502 - protein, 11 aa, Mycobacterium tuberculosis
YEDGDGPESRF

SEQ ID NO: 1409503 - protein, 10 aa, Mycobacterium tuberculosis
YEDTSSVVGP

SEQ ID NO: 1409504 - protein, 9 aa, Mycobacterium tuberculosis
YEEDSRAEV

SEQ ID NO: 1409505 - protein, 10 aa, Mycobacterium tuberculosis
YESRTAPVEG

SEQ ID NO: 1409506 - protein, 9 aa, Mycobacterium tuberculosis
YGDPDNPDD

SEQ ID NO: 1409507 - protein, 15 aa, Mycobacterium tuberculosis
YGKRKVGADKAVSTG

SEQ ID NO: 1409508 - protein, 6 aa, Mycobacterium tuberculosis
YGNAGS

SEQ ID NO: 1409509 - protein, 10 aa, Mycobacterium tuberculosis
YGNPAEPDTA

SEQ ID NO: 1409510 - protein, 4 aa, Mycobacterium tuberculosis
YGPA

SEQ ID NO: 1409511 - protein, 6 aa, Mycobacterium tuberculosis
YGPHPA

SEQ ID NO: 1409512 - protein, 8 aa, Mycobacterium tuberculosis
YGPTTGDR

SEQ ID NO: 1409513 - protein, 11 aa, Mycobacterium tuberculosis
YGQNPQAACDG

SEQ ID NO: 1409514 - protein, 6 aa, Mycobacterium tuberculosis
YGSTEA

SEQ ID NO: 1409515 - protein, 4 aa, Mycobacterium tuberculosis
YHER

SEQ ID NO: 1409516 - protein, 5 aa, Mycobacterium tuberculosis
YKDTA

SEQ ID NO: 1409517 - protein, 19 aa, Mycobacterium tuberculosis
YLDPEAAAAGAAAVAGQGR

SEQ ID NO: 1409518 - protein, 4 aa, Mycobacterium tuberculosis
YNDA

SEQ ID NO: 1409519 - protein, 9 aa, Mycobacterium tuberculosis
YNKGGPTVT

SEQ ID NO: 1409520 - protein, 4 aa, Mycobacterium tuberculosis
YNTA

SEQ ID NO: 1409521 - protein, 9 aa, Mycobacterium tuberculosis
YPAGSAGRF

SEQ ID NO: 1409522 - protein, 5 aa, Mycobacterium tuberculosis
YPDRR

SEQ ID NO: 1409523 - protein, 8 aa, Mycobacterium tuberculosis
YPDRRSGE

SEQ ID NO: 1409524 - protein, 5 aa, Mycobacterium tuberculosis
YPGET

SEQ ID NO: 1409525 - protein, 6 aa, Mycobacterium tuberculosis
YPGSSE

SEQ ID NO: 1409526 - protein, 5 aa, Mycobacterium tuberculosis
YPLPE

SEQ ID NO: 1409527 - protein, 10 aa, Mycobacterium tuberculosis
YPLPGATGYP

SEQ ID NO: 1409528 - protein, 8 aa, Mycobacterium tuberculosis
YPPDDQLA

SEQ ID NO: 1409529 - protein, 8 aa, Mycobacterium tuberculosis
YPPEEAQT

SEQ ID NO: 1409530 - protein, 11 aa, Mycobacterium tuberculosis
YPPGRGPHTSA

SEQ ID NO: 1409531 - protein, 5 aa, Mycobacterium tuberculosis
YPPPA

SEQ ID NO: 1409532 - protein, 8 aa, Mycobacterium tuberculosis
YPRGTETL

SEQ ID NO: 1409533 - protein, 8 aa, Mycobacterium tuberculosis
YPSPEEER

SEQ ID NO: 1409534 - protein, 7 aa, Mycobacterium tuberculosis
YQKERVS

SEQ ID NO: 1409535 - protein, 9 aa, Mycobacterium tuberculosis
YQKPHPPIG

SEQ ID NO: 1409536 - protein, 12 aa, Mycobacterium tuberculosis
YQPGPAPAVNPR

SEQ ID NO: 1409537 - protein, 8 aa, Mycobacterium tuberculosis
YRGQSSQA

SEQ ID NO: 1409538 - protein, 9 aa, Mycobacterium tuberculosis
YRPDPATGA

SEQ ID NO: 1409539 - protein, 9 aa, Mycobacterium tuberculosis
YRPSGGGAT

SEQ ID NO: 1409540 - protein, 6 aa, Mycobacterium tuberculosis
YRPSHE

SEQ ID NO: 1409541 - protein, 6 aa, Mycobacterium tuberculosis
YRRSKD

SEQ ID NO: 1409542 - protein, 6 aa, Mycobacterium tuberculosis
YRSTPQ

SEQ ID NO: 1409543 - protein, 7 aa, Mycobacterium tuberculosis
YSATEDS

SEQ ID NO: 1409544 - protein, 19 aa, Mycobacterium tuberculosis
YSDPGMDGPTIARATEAAL

SEQ ID NO: 1409545 - protein, 9 aa, Mycobacterium tuberculosis
YSGAGSAPM

SEQ ID NO: 1409546 - protein, 7 aa, Mycobacterium tuberculosis
YSNTGEG

SEQ ID NO: 1409547 - protein, 6 aa, Mycobacterium tuberculosis
YSPDRD

SEQ ID NO: 1409548 - protein, 13 aa, Mycobacterium tuberculosis
YTPNGARTTGAGH

SEQ ID NO: 1409549 - protein, 7 aa, Mycobacterium tuberculosis
YTTTSEQ

SEQ ID NO: 1409550 - protein, 6 aa, Mycobacterium tuberculosis
YVTPDD

SEQ ID NO: 1409551 - protein, 8 aa, Mycobacterium tuberculosis
YYPKRPAG

SEQ ID NO: 1409552 - protein, 14 aa, Mycobacterium tuberculosis
YYQPPDKRLYRKGQ

SEQ ID NO: 1409553 - protein, 59 aa, Mycobacterium tuberculosis; identical to SEQ ID NO: 166734

SEQ ID NO: 1409554 - protein, 8 aa, Mycobacterium tuberculosis
AAADPRDN

SEQ ID NO: 1409555 - protein, 23 aa, Mycobacterium tuberculosis
AAAEAAARARQDSLTKPRGALGS

SEQ ID NO: 1409556 - protein, 14 aa, Mycobacterium tuberculosis
AAAEQGRAGADGLG

SEQ ID NO: 1409557 - protein, 6 aa, Mycobacterium tuberculosis
AAAERA

SEQ ID NO: 1409558 - protein, 9 aa, Mycobacterium tuberculosis
AAAGGTTAL

SEQ ID NO: 1409559 - protein, 9 aa, Mycobacterium tuberculosis
AAAGSVGQA

SEQ ID NO: 1409560 - protein, 13 aa, Mycobacterium tuberculosis
AAAPEQTTDPGPG

SEQ ID NO: 1409561 - protein, 8 aa, Mycobacterium tuberculosis
AAAQSADI

SEQ ID NO: 1409562 - protein, 9 aa, Mycobacterium tuberculosis
AAARGGERS

SEQ ID NO: 1409563 - protein, 7 aa, Mycobacterium tuberculosis
AAARTGH

SEQ ID NO: 1409564 - protein, 16 aa, Mycobacterium tuberculosis
AAARTQARIDSGQQPV

SEQ ID NO: 1409565 - protein, 15 aa, Mycobacterium tuberculosis
AAATTTQRNPPEFAR

SEQ ID NO: 1409566 - protein, 7 aa, Mycobacterium tuberculosis
AADDASD

SEQ ID NO: 1409567 - protein, 12 aa, Mycobacterium tuberculosis
AADDDGGTTSIT

SEQ ID NO: 1409568 - protein, 13 aa, Mycobacterium tuberculosis
AADEQSATGSAGR

SEQ ID NO: 1409569 - protein, 7 aa, Mycobacterium tuberculosis
AADGADT

SEQ ID NO: 1409570 - protein, 10 aa, Mycobacterium tuberculosis
AADGTGWGEG

SEQ ID NO: 1409571 - protein, 6 aa, Mycobacterium tuberculosis
AADSGI

SEQ ID NO: 1409572 - protein, 7 aa, Mycobacterium tuberculosis
AADTPTL

SEQ ID NO: 1409573 - protein, 11 aa, Mycobacterium tuberculosis
AADTRRDGDRF

SEQ ID NO: 1409574 - protein, 10 aa, Mycobacterium tuberculosis
AADVGAPAAV

SEQ ID NO: 1409575 - protein, 5 aa, Mycobacterium tuberculosis
AAEAA

SEQ ID NO: 1409576 - protein, 7 aa, Mycobacterium tuberculosis
AAEADQL

SEQ ID NO: 1409577 - protein, 14 aa, Mycobacterium tuberculosis
AAERSRKWNRNKTG

SEQ ID NO: 1409578 - protein, 17 aa, Mycobacterium tuberculosis
AAERSSGFNPRAGWAGN

SEQ ID NO: 1409579 - protein, 16 aa, Mycobacterium tuberculosis
AAESSGPWNNAGTGHS

SEQ ID NO: 1409580 - protein, 12 aa, Mycobacterium tuberculosis
AAETATETGSDS

SEQ ID NO: 1409581 - protein, 16 aa, Mycobacterium tuberculosis
AAGDPDDDEFNPFAPD

SEQ ID NO: 1409582 - protein, 9 aa, Mycobacterium tuberculosis
AAGEPGAGV

SEQ ID NO: 1409583 - protein, 24 aa, Mycobacterium tuberculosis
AAGGHRGSHGKSEQAATVRVVDDR

SEQ ID NO: 1409584 - protein, 7 aa, Mycobacterium tuberculosis
AAGLGRA

SEQ ID NO: 1409585 - protein, 6 aa, Mycobacterium tuberculosis
AAGPAS

SEQ ID NO: 1409586 - protein, 14 aa, Mycobacterium tuberculosis
AAGSSVGKGESLRD

SEQ ID NO: 1409587 - protein, 6 aa, Mycobacterium tuberculosis
AAGTQE

SEQ ID NO: 1409588 - protein, 6 aa, Mycobacterium tuberculosis
AAHPGT

SEQ ID NO: 1409589 - protein, 4 aa, Mycobacterium tuberculosis
AAHS

SEQ ID NO: 1409590 - protein, 9 aa, Mycobacterium tuberculosis
AAIGETDEY

SEQ ID NO: 1409591 - protein, 7 aa, Mycobacterium tuberculosis
AAKGPYA

SEQ ID NO: 1409592 - protein, 7 aa, Mycobacterium tuberculosis
AAKRTGD

SEQ ID NO: 1409593 - protein, 12 aa, Mycobacterium tuberculosis
AALEDDQKVEPA

SEQ ID NO: 1409594 - protein, 11 aa, Mycobacterium tuberculosis
AALQTSDARVS

SEQ ID NO: 1409595 - protein, 9 aa, Mycobacterium tuberculosis
AAMETDAET

SEQ ID NO: 1409596 - protein, 7 aa, Mycobacterium tuberculosis
AAMGTGQ

SEQ ID NO: 1409597 - protein, 5 aa, Mycobacterium tuberculosis
AANPP

SEQ ID NO: 1409598 - protein, 8 aa, Mycobacterium tuberculosis
AAPAGAVG

SEQ ID NO: 1409599 - protein, 7 aa, Mycobacterium tuberculosis
AAPDNTL

SEQ ID NO: 1409600 - protein, 16 aa, Mycobacterium tuberculosis
AAPGFGNSTTNPSSGF

SEQ ID NO: 1409601 - protein, 16 aa, Mycobacterium tuberculosis
AAPGFGNSTTSPSSGF

SEQ ID NO: 1409602 - protein, 5 aa, Mycobacterium tuberculosis
AAPGP

SEQ ID NO: 1409603 - protein, 6 aa, Mycobacterium tuberculosis
AAPPGP

SEQ ID NO: 1409604 - protein, 11 aa, Mycobacterium tuberculosis
AAPQATAPALS

SEQ ID NO: 1409605 - protein, 11 aa, Mycobacterium tuberculosis
AAPTGKAAARL

SEQ ID NO: 1409606 - protein, 7 aa, Mycobacterium tuberculosis
AAPTPAE

SEQ ID NO: 1409607 - protein, 5 aa, Mycobacterium tuberculosis
AAPVT

SEQ ID NO: 1409608 - protein, 14 aa, Mycobacterium tuberculosis
AAQAEQAAGQAQAA

SEQ ID NO: 1409609 - protein, 8 aa, Mycobacterium tuberculosis
AAQQNQSP

SEQ ID NO: 1409610 - protein, 7 aa, Mycobacterium tuberculosis
AARAAEA

SEQ ID NO: 1409611 - protein, 4 aa, Mycobacterium tuberculosis
AARD

SEQ ID NO: 1409612 - protein, 16 aa, Mycobacterium tuberculosis
AARKVPKVAGDATRLP

SEQ ID NO: 1409613 - protein, 5 aa, Mycobacterium tuberculosis
AARQG

SEQ ID NO: 1409614 - protein, 6 aa, Mycobacterium tuberculosis
AARSGQ

SEQ ID NO: 1409615 - protein, 11 aa, Mycobacterium tuberculosis
AARTGGARPTV

SEQ ID NO: 1409616 - protein, 7 aa, Mycobacterium tuberculosis
AASANPV

SEQ ID NO: 1409617 - protein, 7 aa, Mycobacterium tuberculosis
AASARGS

SEQ ID NO: 1409618 - protein, 5 aa, Mycobacterium tuberculosis
AASAV

SEQ ID NO: 1409619 - protein, 7 aa, Mycobacterium tuberculosis
AASFGSV

SEQ ID NO: 1409620 - protein, 7 aa, Mycobacterium tuberculosis
AASGAAG

SEQ ID NO: 1409621 - protein, 9 aa, Mycobacterium tuberculosis
AASPPPGLP

SEQ ID NO: 1409622 - protein, 10 aa, Mycobacterium tuberculosis
AASSGGFGGQ

SEQ ID NO: 1409623 - protein, 11 aa, Mycobacterium tuberculosis
AASTAGNPEIR

SEQ ID NO: 1409624 - protein, 7 aa, Mycobacterium tuberculosis
AASTDQL

SEQ ID NO: 1409625 - protein, 8 aa, Mycobacterium tuberculosis
AATAPDAV

SEQ ID NO: 1409626 - protein, 10 aa, Mycobacterium tuberculosis
AATDRDLDAG

SEQ ID NO: 1409627 - protein, 9 aa, Mycobacterium tuberculosis
AATGAGHGT

SEQ ID NO: 1409628 - protein, 9 aa, Mycobacterium tuberculosis
AAVAGNPSL

SEQ ID NO: 1409629 - protein, 6 aa, Mycobacterium tuberculosis
AAVDAG

SEQ ID NO: 1409630 - protein, 6 aa, Mycobacterium tuberculosis
ADAASV

SEQ ID NO: 1409631 - protein, 8 aa, Mycobacterium tuberculosis
ADAEGVTK

SEQ ID NO: 1409632 - protein, 7 aa, Mycobacterium tuberculosis
ADAGSGR

SEQ ID NO: 1409633 - protein, 5 aa, Mycobacterium tuberculosis
ADAPL

SEQ ID NO: 1409634 - protein, 12 aa, Mycobacterium tuberculosis
ADAPRVQQGTER

SEQ ID NO: 1409635 - protein, 6 aa, Mycobacterium tuberculosis
ADAVEN

SEQ ID NO: 1409636 - protein, 12 aa, Mycobacterium tuberculosis
ADDAPDQPPQKN

SEQ ID NO: 1409637 - protein, 8 aa, Mycobacterium tuberculosis
ADDEIQPI

SEQ ID NO: 1409638 - protein, 10 aa, Mycobacterium tuberculosis
ADDETPEERD

SEQ ID NO: 1409639 - protein, 7 aa, Mycobacterium tuberculosis
ADDPGTL

SEQ ID NO: 1409640 - protein, 5 aa, Mycobacterium tuberculosis
ADDSR

SEQ ID NO: 1409641 - protein, 7 aa, Mycobacterium tuberculosis
ADDVPDG

SEQ ID NO: 1409642 - protein, 12 aa, Mycobacterium tuberculosis
ADEARAAGRDVG

SEQ ID NO: 1409643 - protein, 10 aa, Mycobacterium tuberculosis
ADEVSGSGLA

SEQ ID NO: 1409644 - protein, 8 aa, Mycobacterium tuberculosis
ADGDGEPV

SEQ ID NO: 1409645 - protein, 11 aa, Mycobacterium tuberculosis
ADGTSWDPTEL

SEQ ID NO: 1409646 - protein, 10 aa, Mycobacterium tuberculosis
ADGVRAGRAM

SEQ ID NO: 1409647 - protein, 10 aa, Mycobacterium tuberculosis
ADHDDSHGGM

SEQ ID NO: 1409648 - protein, 12 aa, Mycobacterium tuberculosis
ADHSINRLRLRK

SEQ ID NO: 1409649 - protein, 17 aa, Mycobacterium tuberculosis
ADKDPAEADTIDAVRAL

SEQ ID NO: 1409650 - protein, 26 aa, Mycobacterium tuberculosis
ADLAGSNNTTIKGADSFGPPSISTKE

SEQ ID NO: 1409651 - protein, 28 aa, Mycobacterium tuberculosis
ADLGPRRALTGEPLAPQLTATATAQRQG

SEQ ID NO: 1409652 - protein, 6 aa, Mycobacterium tuberculosis
ADNSPH

SEQ ID NO: 1409653 - protein, 8 aa, Mycobacterium tuberculosis
ADPANPYG

SEQ ID NO: 1409654 - protein, 8 aa, Mycobacterium tuberculosis
ADPETGSA

SEQ ID NO: 1409655 - protein, 6 aa, Mycobacterium tuberculosis
ADPKSV

SEQ ID NO: 1409656 - protein, 7 aa, Mycobacterium tuberculosis
ADRGRTG

SEQ ID NO: 1409657 - protein, 25 aa, Mycobacterium tuberculosis
ADSAARRPAPAPADGGDIGDGGGAG

SEQ ID NO: 1409658 - protein, 9 aa, Mycobacterium tuberculosis
ADSDDEDAL

SEQ ID NO: 1409659 - protein, 9 aa, Mycobacterium tuberculosis
ADVTDEAAV

SEQ ID NO: 1409660 - protein, 15 aa, Mycobacterium tuberculosis
ADYAPTPDAPTGEDR

SEQ ID NO: 1409661 - protein, 9 aa, Mycobacterium tuberculosis
AEALPGPLT

SEQ ID NO: 1409662 - protein, 6 aa, Mycobacterium tuberculosis
AEASMS

SEQ ID NO: 1409663 - protein, 7 aa, Mycobacterium tuberculosis
AEATRDG

SEQ ID NO: 1409664 - protein, 12 aa, Mycobacterium tuberculosis
AEAVQRARDSVD

SEQ ID NO: 1409665 - protein, 7 aa, Mycobacterium tuberculosis
AEDPAVS

SEQ ID NO: 1409666 - protein, 12 aa, Mycobacterium tuberculosis
AEDTSGATPQNP

SEQ ID NO: 1409667 - protein, 5 aa, Mycobacterium tuberculosis
AEEEV

SEQ ID NO: 1409668 - protein, 6 aa, Mycobacterium tuberculosis
AEEPRL

SEQ ID NO: 1409669 - protein, 8 aa, Mycobacterium tuberculosis
AEESSGVR

SEQ ID NO: 1409670 - protein, 19 aa, Mycobacterium tuberculosis
AEGHRGATGWRAVGLPWRQ

SEQ ID NO: 1409671 - protein, 8 aa, Mycobacterium tuberculosis
AEGLPGRR

SEQ ID NO: 1409672 - protein, 7 aa, Mycobacterium tuberculosis
AEGSEIT

SEQ ID NO: 1409673 - protein, 6 aa, Mycobacterium tuberculosis
AEKQEP

SEQ ID NO: 1409674 - protein, 10 aa, Mycobacterium tuberculosis
AEKTQQTAIQ

SEQ ID NO: 1409675 - protein, 10 aa, Mycobacterium tuberculosis
AEPARGRKRT

SEQ ID NO: 1409676 - protein, 10 aa, Mycobacterium tuberculosis
AEQKHSIDDP

SEQ ID NO: 1409677 - protein, 11 aa, Mycobacterium tuberculosis
AERADPNFADR

SEQ ID NO: 1409678 - protein, 13 aa, Mycobacterium tuberculosis
AERASARSSEASV

SEQ ID NO: 1409679 - protein, 7 aa, Mycobacterium tuberculosis
AERKGAL

SEQ ID NO: 1409680 - protein, 5 aa, Mycobacterium tuberculosis
AERPA

SEQ ID NO: 1409681 - protein, 6 aa, Mycobacterium tuberculosis
AERSPT

SEQ ID NO: 1409682 - protein, 6 aa, Mycobacterium tuberculosis
AESDDL

SEQ ID NO: 1409683 - protein, 11 aa, Mycobacterium tuberculosis
AESGAEQGDPL

SEQ ID NO: 1409684 - protein, 7 aa, Mycobacterium tuberculosis
AETANGA

SEQ ID NO: 1409685 - protein, 7 aa, Mycobacterium tuberculosis
AETDSGA

SEQ ID NO: 1409686 - protein, 5 aa, Mycobacterium tuberculosis
AFDSS

SEQ ID NO: 1409687 - protein, 9 aa, Mycobacterium tuberculosis
AGAAAAKLA

SEQ ID NO: 1409688 - protein, 8 aa, Mycobacterium tuberculosis
AGAAGRQA

SEQ ID NO: 1409689 - protein, 27 aa, Mycobacterium tuberculosis
AGAAYAQAEASNTAAMSGTAGSSGALG

SEQ ID NO: 1409690 - protein, 7 aa, Mycobacterium tuberculosis
AGAEHTH

SEQ ID NO: 1409691 - protein, 4 aa, Mycobacterium tuberculosis
AGAG

SEQ ID NO: 1409692 - protein, 4 aa, Mycobacterium tuberculosis
AGAS

SEQ ID NO: 1409693 - protein, 10 aa, Mycobacterium tuberculosis
AGATGEGAMD

SEQ ID NO: 1409694 - protein, 6 aa, Mycobacterium tuberculosis
AGCGDG

SEQ ID NO: 1409695 - protein, 9 aa, Mycobacterium tuberculosis
AGDDPEVNE

SEQ ID NO: 1409696 - protein, 6 aa, Mycobacterium tuberculosis
AGDQRS

SEQ ID NO: 1409697 - protein, 12 aa, Mycobacterium tuberculosis
AGDSATRSRRAD

SEQ ID NO: 1409698 - protein, 6 aa, Mycobacterium tuberculosis
AGDTQP

SEQ ID NO: 1409699 - protein, 8 aa, Mycobacterium tuberculosis
AGEGPRAA

SEQ ID NO: 1409700 - protein, 9 aa, Mycobacterium tuberculosis
AGGAQRGSA

SEQ ID NO: 1409701 - protein, 8 aa, Mycobacterium tuberculosis
AGGDDVSA

SEQ ID NO: 1409702 - protein, 14 aa, Mycobacterium tuberculosis
AGGGTALDDVDGTD

SEQ ID NO: 1409703 - protein, 18 aa, Mycobacterium tuberculosis
AGGHGRLKSAGPVNSGAT

SEQ ID NO: 1409704 - protein, 10 aa, Mycobacterium tuberculosis
AGGLQPGEEP

SEQ ID NO: 1409705 - protein, 6 aa, Mycobacterium tuberculosis
AGGQLT

SEQ ID NO: 1409706 - protein, 7 aa, Mycobacterium tuberculosis
AGGSELD

SEQ ID NO: 1409707 - protein, 21 aa, Mycobacterium tuberculosis
AGGSPGELGRNRVERADGSTV

SEQ ID NO: 1409708 - protein, 13 aa, Mycobacterium tuberculosis
AGIPSQAPASRPH

SEQ ID NO: 1409709 - protein, 6 aa, Mycobacterium tuberculosis
AGKGVD

SEQ ID NO: 1409710 - protein, 8 aa, Mycobacterium tuberculosis
AGLQPDDA

SEQ ID NO: 1409711 - protein, 12 aa, Mycobacterium tuberculosis
AGNMSKRQSATG

SEQ ID NO: 1409712 - protein, 5 aa, Mycobacterium tuberculosis
AGNPH

SEQ ID NO: 1409713 - protein, 5 aa, Mycobacterium tuberculosis
AGPAE

SEQ ID NO: 1409714 - protein, 12 aa, Mycobacterium tuberculosis
AGPEGSDRPERH

SEQ ID NO: 1409715 - protein, 7 aa, Mycobacterium tuberculosis
AGPEPMA

SEQ ID NO: 1409716 - protein, 6 aa, Mycobacterium tuberculosis
AGPGPM

SEQ ID NO: 1409717 - protein, 12 aa, Mycobacterium tuberculosis
AGPGSGLTGSIE

SEQ ID NO: 1409718 - protein, 6 aa, Mycobacterium tuberculosis
AGPQVG

SEQ ID NO: 1409719 - protein, 10 aa, Mycobacterium tuberculosis
AGPSHGRDKP

SEQ ID NO: 1409720 - protein, 13 aa, Mycobacterium tuberculosis
AGRAAAAGDELDT

SEQ ID NO: 1409721 - protein, 7 aa, Mycobacterium tuberculosis
AGRDADG

SEQ ID NO: 1409722 - protein, 11 aa, Mycobacterium tuberculosis
AGRGHASRGDA

SEQ ID NO: 1409723 - protein, 4 aa, Mycobacterium tuberculosis
AGRP

SEQ ID NO: 1409724 - protein, 6 aa, Mycobacterium tuberculosis
AGRPEA

SEQ ID NO: 1409725 - protein, 8 aa, Mycobacterium tuberculosis
AGRPGPVP

SEQ ID NO: 1409726 - protein, 4 aa, Mycobacterium tuberculosis
AGRR

SEQ ID NO: 1409727 - protein, 11 aa, Mycobacterium tuberculosis
AGRRPEHTGSH

SEQ ID NO: 1409728 - protein, 9 aa, Mycobacterium tuberculosis
AGRSADEQL

SEQ ID NO: 1409729 - protein, 6 aa, Mycobacterium tuberculosis
AGRSIR

SEQ ID NO: 1409730 - protein, 5 aa, Mycobacterium tuberculosis
AGSDA

SEQ ID NO: 1409731 - protein, 9 aa, Mycobacterium tuberculosis
AGSDPMNPR

SEQ ID NO: 1409732 - protein, 7 aa, Mycobacterium tuberculosis
AGSEAGL

SEQ ID NO: 1409733 - protein, 7 aa, Mycobacterium tuberculosis
AGSGKTA

SEQ ID NO: 1409734 - protein, 6 aa, Mycobacterium tuberculosis
AGSGTV

SEQ ID NO: 1409735 - protein, 7 aa, Mycobacterium tuberculosis
AGSPEAD

SEQ ID NO: 1409736 - protein, 6 aa, Mycobacterium tuberculosis
AGSSLA

SEQ ID NO: 1409737 - protein, 7 aa, Mycobacterium tuberculosis
AGSSQIQ

SEQ ID NO: 1409738 - protein, 6 aa, Mycobacterium tuberculosis
AGTDRG

SEQ ID NO: 1409739 - protein, 25 aa, Mycobacterium tuberculosis
AGTGVAPTAVAAPGDAGLSQEGEPF

SEQ ID NO: 1409740 - protein, 5 aa, Mycobacterium tuberculosis
AGTQF

SEQ ID NO: 1409741 - protein, 7 aa, Mycobacterium tuberculosis
AGTTVDP

SEQ ID NO: 1409742 - protein, 11 aa, Mycobacterium tuberculosis
AGVGTQVADGG

SEQ ID NO: 1409743 - protein, 9 aa, Mycobacterium tuberculosis
AGVTGPEAE

SEQ ID NO: 1409744 - protein, 9 aa, Mycobacterium tuberculosis
AGVTTYSTD

SEQ ID NO: 1409745 - protein, 11 aa, Mycobacterium tuberculosis
AHAGDKAKAAE

SEQ ID NO: 1409746 - protein, 25 aa, Mycobacterium tuberculosis
AHDPAKSFPAPTELPKVTSRPASPL

SEQ ID NO: 1409747 - protein, 4 aa, Mycobacterium tuberculosis
AHDR

SEQ ID NO: 1409748 - protein, 21 aa, Mycobacterium tuberculosis
AHPASGSTSSLCETGSPTTRM

SEQ ID NO: 1409749 - protein, 5 aa, Mycobacterium tuberculosis
AHPEG

SEQ ID NO: 1409750 - protein, 7 aa, Mycobacterium tuberculosis
AHPGLTK

SEQ ID NO: 1409751 - protein, 6 aa, Mycobacterium tuberculosis
AHPSAA

SEQ ID NO: 1409752 - protein, 18 aa, Mycobacterium tuberculosis
AHRAAGRDRAYPAETLPE

SEQ ID NO: 1409753 - protein, 9 aa, Mycobacterium tuberculosis
AHRSGTTTY

SEQ ID NO: 1409754 - protein, 8 aa, Mycobacterium tuberculosis
AIGPDSSL

SEQ ID NO: 1409755 - protein, 11 aa, Mycobacterium tuberculosis
AIGRPEDFSSN

SEQ ID NO: 1409756 - protein, 5 aa, Mycobacterium tuberculosis
AIPDD

SEQ ID NO: 1409757 - protein, 10 aa, Mycobacterium tuberculosis
AKAALGGSDI

SEQ ID NO: 1409758 - protein, 6 aa, Mycobacterium tuberculosis
AKAATR

SEQ ID NO: 1409759 - protein, 5 aa, Mycobacterium tuberculosis
AKAHG

SEQ ID NO: 1409760 - protein, 11 aa, Mycobacterium tuberculosis
AKALSDTVTPA

SEQ ID NO: 1409761 - protein, 8 aa, Mycobacterium tuberculosis
AKATGTSV

SEQ ID NO: 1409762 - protein, 8 aa, Mycobacterium tuberculosis
AKGRGRDM

SEQ ID NO: 1409763 - protein, 8 aa, Mycobacterium tuberculosis
AKHAGGDS

SEQ ID NO: 1409764 - protein, 26 aa, Mycobacterium tuberculosis
AKPAGEADPYRDNGSVAQSPAPGGLG

SEQ ID NO: 1409765 - protein, 5 aa, Mycobacterium tuberculosis
AKPAQ

SEQ ID NO: 1409766 - protein, 8 aa, Mycobacterium tuberculosis
AKPGVPRS

SEQ ID NO: 1409767 - protein, 11 aa, Mycobacterium tuberculosis
AKRRRTAHSAI

SEQ ID NO: 1409768 - protein, 8 aa, Mycobacterium tuberculosis
AKTDEDKL

SEQ ID NO: 1409769 - protein, 9 aa, Mycobacterium tuberculosis
AKVTSEGER

SEQ ID NO: 1409770 - protein, 8 aa, Mycobacterium tuberculosis
ALAGAHPD

SEQ ID NO: 1409771 - protein, 8 aa, Mycobacterium tuberculosis
ALAGGAGS

SEQ ID NO: 1409772 - protein, 6 aa, Mycobacterium tuberculosis
ALDDGD

SEQ ID NO: 1409773 - protein, 11 aa, Mycobacterium tuberculosis
ALEDGSGQARK

SEQ ID NO: 1409774 - protein, 5 aa, Mycobacterium tuberculosis
ALEGD

SEQ ID NO: 1409775 - protein, 8 aa, Mycobacterium tuberculosis
ALESGDSG

SEQ ID NO: 1409776 - protein, 17 aa, Mycobacterium tuberculosis
ALGEPGEHSLPASTPIT

SEQ ID NO: 1409777 - protein, 6 aa, Mycobacterium tuberculosis
ALGKGA

SEQ ID NO: 1409778 - protein, 14 aa, Mycobacterium tuberculosis
ALNEGSGSNPPRGV

SEQ ID NO: 1409779 - protein, 22 aa, Mycobacterium tuberculosis
ALPEPQIASDTEFRAPQTATER

SEQ ID NO: 1409780 - protein, 6 aa, Mycobacterium tuberculosis
ALPGDA

SEQ ID NO: 1409781 - protein, 6 aa, Mycobacterium tuberculosis
ALPTGV

SEQ ID NO: 1409782 - protein, 7 aa, Mycobacterium tuberculosis
ALTADGP

SEQ ID NO: 1409783 - protein, 7 aa, Mycobacterium tuberculosis
ALTGPDG

SEQ ID NO: 1409784 - protein, 12 aa, Mycobacterium tuberculosis
ALTTEGADRPTA

SEQ ID NO: 1409785 - protein, 5 aa, Mycobacterium tuberculosis
AMSAE

SEQ ID NO: 1409786 - protein, 8 aa, Mycobacterium tuberculosis
ANAGGGNI

SEQ ID NO: 1409787 - protein, 5 aa, Mycobacterium tuberculosis
ANGDP

SEQ ID NO: 1409788 - protein, 19 aa, Mycobacterium tuberculosis
ANGNNGDVNFGGGNTGDFN

SEQ ID NO: 1409789 - protein, 6 aa, Mycobacterium tuberculosis
ANLPPD

SEQ ID NO: 1409790 - protein, 5 aa, Mycobacterium tuberculosis
ANNRE

SEQ ID NO: 1409791 - protein, 5 aa, Mycobacterium tuberculosis
ANPDG

SEQ ID NO: 1409792 - protein, 5 aa, Mycobacterium tuberculosis
ANPQL

SEQ ID NO: 1409793 - protein, 6 aa, Mycobacterium tuberculosis
ANQADY

SEQ ID NO: 1409794 - protein, 7 aa, Mycobacterium tuberculosis
ANRGMGR

SEQ ID NO: 1409795 - protein, 6 aa, Mycobacterium tuberculosis
ANTGIG

SEQ ID NO: 1409796 - protein, 6 aa, Mycobacterium tuberculosis
ANVGTT

SEQ ID NO: 1409797 - protein, 7 aa, Mycobacterium tuberculosis
ANYGRAN

SEQ ID NO: 1409798 - protein, 6 aa, Mycobacterium tuberculosis
APADGL

SEQ ID NO: 1409799 - protein, 8 aa, Mycobacterium tuberculosis
APATSQPV

SEQ ID NO: 1409800 - protein, 9 aa, Mycobacterium tuberculosis
APDPDGGIE

SEQ ID NO: 1409801 - protein, 12 aa, Mycobacterium tuberculosis
APEPADLDERTE

SEQ ID NO: 1409802 - protein, 8 aa, Mycobacterium tuberculosis
APEPGRVK

SEQ ID NO: 1409803 - protein, 7 aa, Mycobacterium tuberculosis
APERTVS

SEQ ID NO: 1409804 - protein, 9 aa, Mycobacterium tuberculosis
APGGRRELD

SEQ ID NO: 1409805 - protein, 14 aa, Mycobacterium tuberculosis
APHYGGSTARSGGG

SEQ ID NO: 1409806 - protein, 7 aa, Mycobacterium tuberculosis
APKSYAA

SEQ ID NO: 1409807 - protein, 7 aa, Mycobacterium tuberculosis
APPYNRR

SEQ ID NO: 1409808 - protein, 8 aa, Mycobacterium tuberculosis
APRPTTPF

SEQ ID NO: 1409809 - protein, 21 aa, Mycobacterium tuberculosis
APSVSDPTAAGQIGASDGGAE

SEQ ID NO: 1409810 - protein, 29 aa, Mycobacterium tuberculosis
APTADRRAAVGTTSDINQQDPATLQDGGN

SEQ ID NO: 1409811 - protein, 11 aa, Mycobacterium tuberculosis
APTPASSEPTV

SEQ ID NO: 1409812 - protein, 6 aa, Mycobacterium tuberculosis
APTPER

SEQ ID NO: 1409813 - protein, 5 aa, Mycobacterium tuberculosis
APTQT

SEQ ID NO: 1409814 - protein, 5 aa, Mycobacterium tuberculosis
APTSI

SEQ ID NO: 1409815 - protein, 10 aa, Mycobacterium tuberculosis
AQAEQAAAQA

SEQ ID NO: 1409816 - protein, 6 aa, Mycobacterium tuberculosis
AQAREE

SEQ ID NO: 1409817 - protein, 7 aa, Mycobacterium tuberculosis
AQDEHDE

SEQ ID NO: 1409818 - protein, 5 aa, Mycobacterium tuberculosis
AQGIR

SEQ ID NO: 1409819 - protein, 8 aa, Mycobacterium tuberculosis
AQLSSPDS

SEQ ID NO: 1409820 - protein, 4 aa, Mycobacterium tuberculosis
AQNG

SEQ ID NO: 1409821 - protein, 14 aa, Mycobacterium tuberculosis
AQPTQGTTPSSKLG

SEQ ID NO: 1409822 - protein, 9 aa, Mycobacterium tuberculosis
AQQQPDAPA

SEQ ID NO: 1409823 - protein, 6 aa, Mycobacterium tuberculosis
AQRPTY

SEQ ID NO: 1409824 - protein, 12 aa, Mycobacterium tuberculosis
AQRQATKDAGQI

SEQ ID NO: 1409825 - protein, 4 aa, Mycobacterium tuberculosis
AQRV

SEQ ID NO: 1409826 - protein, 7 aa, Mycobacterium tuberculosis
AQYPAST

SEQ ID NO: 1409827 - protein, 8 aa, Mycobacterium tuberculosis
ARAAQTDW

SEQ ID NO: 1409828 - protein, 6 aa, Mycobacterium tuberculosis
ARAATR

SEQ ID NO: 1409829 - protein, 19 aa, Mycobacterium tuberculosis
ARAERRAIPSKGLTGTGYD

SEQ ID NO: 1409830 - protein, 15 aa, Mycobacterium tuberculosis
ARAGLTGGGTATLPR

SEQ ID NO: 1409831 - protein, 9 aa, Mycobacterium tuberculosis
ARARDGGIP

SEQ ID NO: 1409832 - protein, 14 aa, Mycobacterium tuberculosis
AREAARTAERAGQA

SEQ ID NO: 1409833 - protein, 22 aa, Mycobacterium tuberculosis
ARESPDPPEIAEPANGPPPPGR

SEQ ID NO: 1409834 - protein, 6 aa, Mycobacterium tuberculosis
ARGGIK

SEQ ID NO: 1409835 - protein, 8 aa, Mycobacterium tuberculosis
ARGSTRET

SEQ ID NO: 1409836 - protein, 4 aa, Mycobacterium tuberculosis
ARGV

SEQ ID NO: 1409837 - protein, 7 aa, Mycobacterium tuberculosis
ARHTPEG

SEQ ID NO: 1409838 - protein, 8 aa, Mycobacterium tuberculosis
ARKQGRER

SEQ ID NO: 1409839 - protein, 14 aa, Mycobacterium tuberculosis
ARLANDPTAPAPDK

SEQ ID NO: 1409840 - protein, 7 aa, Mycobacterium tuberculosis
ARLPGRA

SEQ ID NO: 1409841 - protein, 8 aa, Mycobacterium tuberculosis
ARNNTEAR

SEQ ID NO: 1409842 - protein, 10 aa, Mycobacterium tuberculosis
ARPNSPRPEG

SEQ ID NO: 1409843 - protein, 8 aa, Mycobacterium tuberculosis
ARPSETAT

SEQ ID NO: 1409844 - protein, 7 aa, Mycobacterium tuberculosis
ARQEPGL

SEQ ID NO: 1409845 - protein, 9 aa, Mycobacterium tuberculosis
ARRADPTDD

SEQ ID NO: 1409846 - protein, 8 aa, Mycobacterium tuberculosis
ARRDEATR

SEQ ID NO: 1409847 - protein, 7 aa, Mycobacterium tuberculosis
ARRDGAP

SEQ ID NO: 1409848 - protein, 6 aa, Mycobacterium tuberculosis
ARRDGN

SEQ ID NO: 1409849 - protein, 6 aa, Mycobacterium tuberculosis
ARRRRA

SEQ ID NO: 1409850 - protein, 8 aa, Mycobacterium tuberculosis
ARSEPRFT

SEQ ID NO: 1409851 - protein, 7 aa, Mycobacterium tuberculosis
ARSPTEE

SEQ ID NO: 1409852 - protein, 10 aa, Mycobacterium tuberculosis
ARSQRAPDEM

SEQ ID NO: 1409853 - protein, 9 aa, Mycobacterium tuberculosis
ARSTPEDAE

SEQ ID NO: 1409854 - protein, 8 aa, Mycobacterium tuberculosis
ARTDAAAG

SEQ ID NO: 1409855 - protein, 9 aa, Mycobacterium tuberculosis
ARTDENTPL

SEQ ID NO: 1409856 - protein, 10 aa, Mycobacterium tuberculosis
ASAPGGDSYA

SEQ ID NO: 1409857 - protein, 9 aa, Mycobacterium tuberculosis
ASARETAAR

SEQ ID NO: 1409858 - protein, 5 aa, Mycobacterium tuberculosis
ASARP

SEQ ID NO: 1409859 - protein, 7 aa, Mycobacterium tuberculosis
ASATNLP

SEQ ID NO: 1409860 - protein, 6 aa, Mycobacterium tuberculosis
ASDPRK

SEQ ID NO: 1409861 - protein, 8 aa, Mycobacterium tuberculosis
ASDTDTEV

SEQ ID NO: 1409862 - protein, 6 aa, Mycobacterium tuberculosis
ASEGYG

SEQ ID NO: 1409863 - protein, 8 aa, Mycobacterium tuberculosis
ASEPGHRH

SEQ ID NO: 1409864 - protein, 10 aa, Mycobacterium tuberculosis
ASGGDGGQGG

SEQ ID NO: 1409865 - protein, 6 aa, Mycobacterium tuberculosis
ASGIGS

SEQ ID NO: 1409866 - protein, 5 aa, Mycobacterium tuberculosis
ASGIP

SEQ ID NO: 1409867 - protein, 5 aa, Mycobacterium tuberculosis
ASGIS

SEQ ID NO: 1409868 - protein, 6 aa, Mycobacterium tuberculosis
ASGQPF

SEQ ID NO: 1409869 - protein, 7 aa, Mycobacterium tuberculosis
ASISGAE

SEQ ID NO: 1409870 - protein, 7 aa, Mycobacterium tuberculosis
ASNPAGH

SEQ ID NO: 1409871 - protein, 6 aa, Mycobacterium tuberculosis
ASNRSA

SEQ ID NO: 1409872 - protein, 18 aa, Mycobacterium tuberculosis
ASPAQPGEAGRHASDPVT

SEQ ID NO: 1409873 - protein, 5 aa, Mycobacterium tuberculosis
ASPGI

SEQ ID NO: 1409874 - protein, 12 aa, Mycobacterium tuberculosis
ASPSSGGTRMQE

SEQ ID NO: 1409875 - protein, 7 aa, Mycobacterium tuberculosis
ASRAGGE

SEQ ID NO: 1409876 - protein, 6 aa, Mycobacterium tuberculosis
ASRELP

SEQ ID NO: 1409877 - protein, 10 aa, Mycobacterium tuberculosis
ASSAPSEPYG

SEQ ID NO: 1409878 - protein, 8 aa, Mycobacterium tuberculosis
ASSAVPTY

SEQ ID NO: 1409879 - protein, 8 aa, Mycobacterium tuberculosis
ASTAAASL

SEQ ID NO: 1409880 - protein, 6 aa, Mycobacterium tuberculosis
ASTAAV

SEQ ID NO: 1409881 - protein, 6 aa, Mycobacterium tuberculosis
ASTDPI

SEQ ID NO: 1409882 - protein, 27 aa, Mycobacterium tuberculosis
ASTRQALRPRADGPVGAAAEQVGGQSQ

SEQ ID NO: 1409883 - protein, 14 aa, Mycobacterium tuberculosis
ASVGDDELAAKAEA

SEQ ID NO: 1409884 - protein, 13 aa, Mycobacterium tuberculosis
ASVKGHGQAPAAL

SEQ ID NO: 1409885 - protein, 7 aa, Mycobacterium tuberculosis
ASVSEAA

SEQ ID NO: 1409886 - protein, 4 aa, Mycobacterium tuberculosis
ATAA

SEQ ID NO: 1409887 - protein, 5 aa, Mycobacterium tuberculosis
ATAAI

SEQ ID NO: 1409888 - protein, 11 aa, Mycobacterium tuberculosis
ATAANATDTDM

SEQ ID NO: 1409889 - protein, 7 aa, Mycobacterium tuberculosis
ATADTAA

SEQ ID NO: 1409890 - protein, 23 aa, Mycobacterium tuberculosis
ATAGKLKGAASSEESTEVDPAVA

SEQ ID NO: 1409891 - protein, 6 aa, Mycobacterium tuberculosis
ATAGRE

SEQ ID NO: 1409892 - protein, 4 aa, Mycobacterium tuberculosis
ATAP

SEQ ID NO: 1409893 - protein, 9 aa, Mycobacterium tuberculosis
ATAQSAENA

SEQ ID NO: 1409894 - protein, 27 aa, Mycobacterium tuberculosis
ATATATAKGLTESCGQRRPAKPAGCPQ

SEQ ID NO: 1409895 - protein, 5 aa, Mycobacterium tuberculosis
ATDAE

SEQ ID NO: 1409896 - protein, 8 aa, Mycobacterium tuberculosis
ATDGARKC

SEQ ID NO: 1409897 - protein, 10 aa, Mycobacterium tuberculosis
ATDKPPVRGA

SEQ ID NO: 1409898 - protein, 15 aa, Mycobacterium tuberculosis
ATDVDNDGVVSPGGV

SEQ ID NO: 1409899 - protein, 10 aa, Mycobacterium tuberculosis
ATEAYPSRTD

SEQ ID NO: 1409900 - protein, 9 aa, Mycobacterium tuberculosis
ATEQRTNKA

SEQ ID NO: 1409901 - protein, 27 aa, Mycobacterium tuberculosis
ATGLTDQPDLSQLGDQANDTTGSSETV

SEQ ID NO: 1409902 - protein, 7 aa, Mycobacterium tuberculosis
ATGSLGR

SEQ ID NO: 1409903 - protein, 7 aa, Mycobacterium tuberculosis
ATGTPRR

SEQ ID NO: 1409904 - protein, 16 aa, Mycobacterium tuberculosis
ATKTNDVAGDGTTTAT

SEQ ID NO: 1409905 - protein, 6 aa, Mycobacterium tuberculosis
ATLPGG

SEQ ID NO: 1409906 - protein, 10 aa, Mycobacterium tuberculosis
ATNAEGANMD

SEQ ID NO: 1409907 - protein, 6 aa, Mycobacterium tuberculosis
ATPAVT

SEQ ID NO: 1409908 - protein, 7 aa, Mycobacterium tuberculosis
ATPLGGD

SEQ ID NO: 1409909 - protein, 9 aa, Mycobacterium tuberculosis
ATPSRSAQV

SEQ ID NO: 1409910 - protein, 11 aa, Mycobacterium tuberculosis
ATQAEQAATQA

SEQ ID NO: 1409911 - protein, 8 aa, Mycobacterium tuberculosis
ATQNDAAR

SEQ ID NO: 1409912 - protein, 16 aa, Mycobacterium tuberculosis
ATSGFGNSTTSPSSGF

SEQ ID NO: 1409913 - protein, 8 aa, Mycobacterium tuberculosis
ATSGLSGF

SEQ ID NO: 1409914 - protein, 5 aa, Mycobacterium tuberculosis
ATSRY

SEQ ID NO: 1409915 - protein, 6 aa, Mycobacterium tuberculosis
ATTARE

SEQ ID NO: 1409916 - protein, 7 aa, Mycobacterium tuberculosis
ATTKPDT

SEQ ID NO: 1409917 - protein, 12 aa, Mycobacterium tuberculosis
ATTLDGTELPAD

SEQ ID NO: 1409918 - protein, 4 aa, Mycobacterium tuberculosis
AVDR

SEQ ID NO: 1409919 - protein, 9 aa, Mycobacterium tuberculosis
AVETAATNP

SEQ ID NO: 1409920 - protein, 8 aa, Mycobacterium tuberculosis
AVNGDRSA

SEQ ID NO: 1409921 - protein, 5 aa, Mycobacterium tuberculosis
AVNPA

SEQ ID NO: 1409922 - protein, 18 aa, Mycobacterium tuberculosis
AVNQDGASNGLTAPNGLA

SEQ ID NO: 1409923 - protein, 8 aa, Mycobacterium tuberculosis
AVSPSGHT

SEQ ID NO: 1409924 - protein, 5 aa, Mycobacterium tuberculosis
AVTSE

SEQ ID NO: 1409925 - protein, 6 aa, Mycobacterium tuberculosis
AYSRAD

SEQ ID NO: 1409926 - protein, 8 aa, Mycobacterium tuberculosis
CAGRAPDW

SEQ ID NO: 1409927 - protein, 7 aa, Mycobacterium tuberculosis
CASGELD

SEQ ID NO: 1409928 - protein, 11 aa, Mycobacterium tuberculosis
CASQGKTSPDR

SEQ ID NO: 1409929 - protein, 7 aa, Mycobacterium tuberculosis
CENAGTE

SEQ ID NO: 1409930 - protein, 7 aa, Mycobacterium tuberculosis
CGAGPGE

SEQ ID NO: 1409931 - protein, 6 aa, Mycobacterium tuberculosis
CGPTYS

SEQ ID NO: 1409932 - protein, 21 aa, Mycobacterium tuberculosis
CGRRPKSSGWQPGPGFELTAT

SEQ ID NO: 1409933 - protein, 5 aa, Mycobacterium tuberculosis
CNASR

SEQ ID NO: 1409934 - protein, 7 aa, Mycobacterium tuberculosis
CPDQAEA

SEQ ID NO: 1409935 - protein, 7 aa, Mycobacterium tuberculosis
CRPASRG

SEQ ID NO: 1409936 - protein, 4 aa, Mycobacterium tuberculosis
CRPI

SEQ ID NO: 1409937 - protein, 6 aa, Mycobacterium tuberculosis
CRSGPL

SEQ ID NO: 1409938 - protein, 8 aa, Mycobacterium tuberculosis
DAAADRVS

SEQ ID NO: 1409939 - protein, 8 aa, Mycobacterium tuberculosis
DAADAGDR

SEQ ID NO: 1409940 - protein, 7 aa, Mycobacterium tuberculosis
DAADVSN

SEQ ID NO: 1409941 - protein, 18 aa, Mycobacterium tuberculosis
DAAGLAETRYGAGKNNPG

SEQ ID NO: 1409942 - protein, 7 aa, Mycobacterium tuberculosis
DAASRWT

SEQ ID NO: 1409943 - protein, 6 aa, Mycobacterium tuberculosis
DAATAR

SEQ ID NO: 1409944 - protein, 7 aa, Mycobacterium tuberculosis
DADRSGR

SEQ ID NO: 1409945 - protein, 5 aa, Mycobacterium tuberculosis
DAEAY

SEQ ID NO: 1409946 - protein, 4 aa, Mycobacterium tuberculosis
DAED

SEQ ID NO: 1409947 - protein, 8 aa, Mycobacterium tuberculosis
DAEQSNTS

SEQ ID NO: 1409948 - protein, 15 aa, Mycobacterium tuberculosis
DAGAPTSGKPALSDP

SEQ ID NO: 1409949 - protein, 11 aa, Mycobacterium tuberculosis
DAGDRPGHGGL

SEQ ID NO: 1409950 - protein, 7 aa, Mycobacterium tuberculosis
DAGSGVA

SEQ ID NO: 1409951 - protein, 8 aa, Mycobacterium tuberculosis
DAKSHQQL

SEQ ID NO: 1409952 - protein, 15 aa, Mycobacterium tuberculosis
DALPNAYPRAGHVGD

SEQ ID NO: 1409953 - protein, 13 aa, Mycobacterium tuberculosis
DALTGDHDLEPGP

SEQ ID NO: 1409954 - protein, 6 aa, Mycobacterium tuberculosis
DANQRA

SEQ ID NO: 1409955 - protein, 5 aa, Mycobacterium tuberculosis
DAPAR

SEQ ID NO: 1409956 - protein, 6 aa, Mycobacterium tuberculosis
DAPGVT

SEQ ID NO: 1409957 - protein, 7 aa, Mycobacterium tuberculosis
DAPLDDS

SEQ ID NO: 1409958 - protein, 5 aa, Mycobacterium tuberculosis
DAQTP

SEQ ID NO: 1409959 - protein, 5 aa, Mycobacterium tuberculosis
DARAT

SEQ ID NO: 1409960 - protein, 7 aa, Mycobacterium tuberculosis
DARERGT

SEQ ID NO: 1409961 - protein, 13 aa, Mycobacterium tuberculosis
DARPIRKGRLGKP

SEQ ID NO: 1409962 - protein, 14 aa, Mycobacterium tuberculosis
DASASDCEYCDVTR

SEQ ID NO: 1409963 - protein, 20 aa, Mycobacterium tuberculosis
DASKTPEPIPTAKPVTGDGN

SEQ ID NO: 1409964 - protein, 7 aa, Mycobacterium tuberculosis
DATATEL

SEQ ID NO: 1409965 - protein, 15 aa, Mycobacterium tuberculosis
DAVRRSQLSRGEDPA

SEQ ID NO: 1409966 - protein, 11 aa, Mycobacterium tuberculosis
DAYPRTPDDDL

SEQ ID NO: 1409967 - protein, 7 aa, Mycobacterium tuberculosis
DDADQTL

SEQ ID NO: 1409968 - protein, 9 aa, Mycobacterium tuberculosis
DDADRDCAA

SEQ ID NO: 1409969 - protein, 10 aa, Mycobacterium tuberculosis
DDADTRAAVT

SEQ ID NO: 1409970 - protein, 6 aa, Mycobacterium tuberculosis
DDDGNV

SEQ ID NO: 1409971 - protein, 7 aa, Mycobacterium tuberculosis
DDDTDKT

SEQ ID NO: 1409972 - protein, 8 aa, Mycobacterium tuberculosis
DDGNVRPT

SEQ ID NO: 1409973 - protein, 10 aa, Mycobacterium tuberculosis
DDGSGRTYQL

SEQ ID NO: 1409974 - protein, 6 aa, Mycobacterium tuberculosis
DDGTYV

SEQ ID NO: 1409975 - protein, 18 aa, Mycobacterium tuberculosis
DDHPTHYSEPDAAAAGYP

SEQ ID NO: 1409976 - protein, 9 aa, Mycobacterium tuberculosis
DDLDPRRRT

SEQ ID NO: 1409977 - protein, 6 aa, Mycobacterium tuberculosis
DDPAYP

SEQ ID NO: 1409978 - protein, 27 aa, Mycobacterium tuberculosis
DDPPEDPSGRDKRGKDGADSGSGANPL

SEQ ID NO: 1409979 - protein, 13 aa, Mycobacterium tuberculosis
DDPPPAGGAPIPS

SEQ ID NO: 1409980 - protein, 10 aa, Mycobacterium tuberculosis
DDRGGPDEDI

SEQ ID NO: 1409981 - protein, 6 aa, Mycobacterium tuberculosis
DDTPQV

SEQ ID NO: 1409982 - protein, 9 aa, Mycobacterium tuberculosis
DDTTSSSTV

SEQ ID NO: 1409983 - protein, 7 aa, Mycobacterium tuberculosis
DEAISTG

SEQ ID NO: 1409984 - protein, 7 aa, Mycobacterium tuberculosis
DEDPAPR

SEQ ID NO: 1409985 - protein, 20 aa, Mycobacterium tuberculosis
DEIASSRAAIASRKRDPRLH

SEQ ID NO: 1409986 - protein, 7 aa, Mycobacterium tuberculosis
DEPNCAG

SEQ ID NO: 1409987 - protein, 4 aa, Mycobacterium tuberculosis
DEPT

SEQ ID NO: 1409988 - protein, 6 aa, Mycobacterium tuberculosis
DEQRRA

SEQ ID NO: 1409989 - protein, 5 aa, Mycobacterium tuberculosis
DERGL

SEQ ID NO: 1409990 - protein, 15 aa, Mycobacterium tuberculosis
DETTAGLRARPKRAS

SEQ ID NO: 1409991 - protein, 10 aa, Mycobacterium tuberculosis
DEVSRPGSDR

SEQ ID NO: 1409992 - protein, 5 aa, Mycobacterium tuberculosis
DFPQT

SEQ ID NO: 1409993 - protein, 7 aa, Mycobacterium tuberculosis
DGAEGWT

SEQ ID NO: 1409994 - protein, 7 aa, Mycobacterium tuberculosis
DGAGTAA

SEQ ID NO: 1409995 - protein, 10 aa, Mycobacterium tuberculosis
DGAPMGPDEY

SEQ ID NO: 1409996 - protein, 12 aa, Mycobacterium tuberculosis
DGDGLDPDTANW

SEQ ID NO: 1409997 - protein, 6 aa, Mycobacterium tuberculosis
DGDGRL

SEQ ID NO: 1409998 - protein, 6 aa, Mycobacterium tuberculosis
DGDRFR

SEQ ID NO: 1409999 - protein, 8 aa, Mycobacterium tuberculosis
DGEKQRVA

SEQ ID NO: 1410000 - protein, 7 aa, Mycobacterium tuberculosis
DGGATHA

SEQ ID NO: 1410001 - protein, 7 aa, Mycobacterium tuberculosis
DGGYTQS

SEQ ID NO: 1410002 - protein, 8 aa, Mycobacterium tuberculosis
DGKRSYAA

SEQ ID NO: 1410003 - protein, 8 aa, Mycobacterium tuberculosis
DGLTTRAR

SEQ ID NO: 1410004 - protein, 8 aa, Mycobacterium tuberculosis
DGPAGPIG

SEQ ID NO: 1410005 - protein, 14 aa, Mycobacterium tuberculosis
DGPAGTGKSSVSRR

SEQ ID NO: 1410006 - protein, 8 aa, Mycobacterium tuberculosis
DGPGAGYD

SEQ ID NO: 1410007 - protein, 11 aa, Mycobacterium tuberculosis
DGPHDRAEPTT

SEQ ID NO: 1410008 - protein, 15 aa, Mycobacterium tuberculosis
DGPHRRREGRPGAAQ

SEQ ID NO: 1410009 - protein, 12 aa, Mycobacterium tuberculosis
DGRARCTPTDAA

SEQ ID NO: 1410010 - protein, 11 aa, Mycobacterium tuberculosis
DGRGPGTPPAT

SEQ ID NO: 1410011 - protein, 4 aa, Mycobacterium tuberculosis
DGRI

SEQ ID NO: 1410012 - protein, 8 aa, Mycobacterium tuberculosis
DGRKGGLI

SEQ ID NO: 1410013 - protein, 8 aa, Mycobacterium tuberculosis
DGRLDGPR

SEQ ID NO: 1410014 - protein, 14 aa, Mycobacterium tuberculosis
DGSHHQNAAATAAI

SEQ ID NO: 1410015 - protein, 9 aa, Mycobacterium tuberculosis
DGSLAPQQP

SEQ ID NO: 1410016 - protein, 8 aa, Mycobacterium tuberculosis
DGSPTSGL

SEQ ID NO: 1410017 - protein, 15 aa, Mycobacterium tuberculosis
DGSTDGTGDIARRSG

SEQ ID NO: 1410018 - protein, 13 aa, Mycobacterium tuberculosis
DGTATGAADPRAP

SEQ ID NO: 1410019 - protein, 15 aa, Mycobacterium tuberculosis
DGTQRIPPAAGSRDF

SEQ ID NO: 1410020 - protein, 7 aa, Mycobacterium tuberculosis
DGTRTEI

SEQ ID NO: 1410021 - protein, 10 aa, Mycobacterium tuberculosis
DGYSDEPDAI

SEQ ID NO: 1410022 - protein, 7 aa, Mycobacterium tuberculosis
DHAGTTA

SEQ ID NO: 1410023 - protein, 7 aa, Mycobacterium tuberculosis
DHKGQPT

SEQ ID NO: 1410024 - protein, 6 aa, Mycobacterium tuberculosis
DHNAGH

SEQ ID NO: 1410025 - protein, 5 aa, Mycobacterium tuberculosis
DHPGY

SEQ ID NO: 1410026 - protein, 7 aa, Mycobacterium tuberculosis
DHPSRDA

SEQ ID NO: 1410027 - protein, 5 aa, Mycobacterium tuberculosis
DHSDG

SEQ ID NO: 1410028 - protein, 11 aa, Mycobacterium tuberculosis
DIAPTDATEAT

SEQ ID NO: 1410029 - protein, 5 aa, Mycobacterium tuberculosis
DIGPR

SEQ ID NO: 1410030 - protein, 7 aa, Mycobacterium tuberculosis
DIPPGKA

SEQ ID NO: 1410031 - protein, 5 aa, Mycobacterium tuberculosis
DISRK

SEQ ID NO: 1410032 - protein, 7 aa, Mycobacterium tuberculosis
DKALTDR

SEQ ID NO: 1410033 - protein, 4 aa, Mycobacterium tuberculosis
DKDE

SEQ ID NO: 1410034 - protein, 7 aa, Mycobacterium tuberculosis
DKGEKEQ

SEQ ID NO: 1410035 - protein, 19 aa, Mycobacterium tuberculosis
DKGKQAAARITEATPGAEV

SEQ ID NO: 1410036 - protein, 7 aa, Mycobacterium tuberculosis
DLARQKP

SEQ ID NO: 1410037 - protein, 12 aa, Mycobacterium tuberculosis
DLDSAADSAEIR

SEQ ID NO: 1410038 - protein, 5 aa, Mycobacterium tuberculosis
DLPAT

SEQ ID NO: 1410039 - protein, 17 aa, Mycobacterium tuberculosis
DLPPAPAPLSDEEVAAR

SEQ ID NO: 1410040 - protein, 4 aa, Mycobacterium tuberculosis
DMER

SEQ ID NO: 1410041 - protein, 7 aa, Mycobacterium tuberculosis
DMPTKPA

SEQ ID NO: 1410042 - protein, 11 aa, Mycobacterium tuberculosis
DNGDADGGDGL

SEQ ID NO: 1410043 - protein, 7 aa, Mycobacterium tuberculosis
DNGPETY

SEQ ID NO: 1410044 - protein, 12 aa, Mycobacterium tuberculosis
DNRPTAFDGLLS

SEQ ID NO: 1410045 - protein, 7 aa, Mycobacterium tuberculosis
DPATNTL

SEQ ID NO: 1410046 - protein, 5 aa, Mycobacterium tuberculosis
DPDAV

SEQ ID NO: 1410047 - protein, 5 aa, Mycobacterium tuberculosis
DPDEP

SEQ ID NO: 1410048 - protein, 5 aa, Mycobacterium tuberculosis
DPDGP

SEQ ID NO: 1410049 - protein, 8 aa, Mycobacterium tuberculosis
DPDNGYGE

SEQ ID NO: 1410050 - protein, 11 aa, Mycobacterium tuberculosis
DPDNRRPVDYG

SEQ ID NO: 1410051 - protein, 8 aa, Mycobacterium tuberculosis
DPDRPGSL

SEQ ID NO: 1410052 - protein, 8 aa, Mycobacterium tuberculosis
DPGDSGQV

SEQ ID NO: 1410053 - protein, 11 aa, Mycobacterium tuberculosis
DPGQPGGTTSI

SEQ ID NO: 1410054 - protein, 7 aa, Mycobacterium tuberculosis
DPHSPPE

SEQ ID NO: 1410055 - protein, 6 aa, Mycobacterium tuberculosis
DPIDAR

SEQ ID NO: 1410056 - protein, 5 aa, Mycobacterium tuberculosis
DPIGP

SEQ ID NO: 1410057 - protein, 15 aa, Mycobacterium tuberculosis
DPPEPLELPGPAGTC

SEQ ID NO: 1410058 - protein, 26 aa, Mycobacterium tuberculosis
DPPLSRRNRDQRRDRPQRPKRRPDLT

SEQ ID NO: 1410059 - protein, 6 aa, Mycobacterium tuberculosis
DPPPEL

SEQ ID NO: 1410060 - protein, 8 aa, Mycobacterium tuberculosis
DPQAARSA

SEQ ID NO: 1410061 - protein, 6 aa, Mycobacterium tuberculosis
DPRALD

SEQ ID NO: 1410062 - protein, 6 aa, Mycobacterium tuberculosis
DPRHGT

SEQ ID NO: 1410063 - protein, 5 aa, Mycobacterium tuberculosis
DPSME

SEQ ID NO: 1410064 - protein, 8 aa, Mycobacterium tuberculosis
DPSSPGKL

SEQ ID NO: 1410065 - protein, 8 aa, Mycobacterium tuberculosis
DPTEDQAR

SEQ ID NO: 1410066 - protein, 6 aa, Mycobacterium tuberculosis
DPTLQP

SEQ ID NO: 1410067 - protein, 21 aa, Mycobacterium tuberculosis
DPVGGTAGSARAGHGYVHADL

SEQ ID NO: 1410068 - protein, 5 aa, Mycobacterium tuberculosis
DQAAL

SEQ ID NO: 1410069 - protein, 6 aa, Mycobacterium tuberculosis
DQAIDY

SEQ ID NO: 1410070 - protein, 10 aa, Mycobacterium tuberculosis
DQLGGPTPCS

SEQ ID NO: 1410071 - protein, 7 aa, Mycobacterium tuberculosis
DQPRDRA

SEQ ID NO: 1410072 - protein, 7 aa, Mycobacterium tuberculosis
DQPYPRG

SEQ ID NO: 1410073 - protein, 10 aa, Mycobacterium tuberculosis
DQQRTSAVSE

SEQ ID NO: 1410074 - protein, 8 aa, Mycobacterium tuberculosis
DQRADRAA

SEQ ID NO: 1410075 - protein, 9 aa, Mycobacterium tuberculosis
DQTTSAPVR

SEQ ID NO: 1410076 - protein, 9 aa, Mycobacterium tuberculosis
DRADRTERG

SEQ ID NO: 1410077 - protein, 6 aa, Mycobacterium tuberculosis
DRAGAI

SEQ ID NO: 1410078 - protein, 7 aa, Mycobacterium tuberculosis
DRAGRRR

SEQ ID NO: 1410079 - protein, 7 aa, Mycobacterium tuberculosis
DRAPVTG

SEQ ID NO: 1410080 - protein, 5 aa, Mycobacterium tuberculosis
DRDGG

SEQ ID NO: 1410081 - protein, 7 aa, Mycobacterium tuberculosis
DRDGGRG

SEQ ID NO: 1410082 - protein, 17 aa, Mycobacterium tuberculosis
DRERTFPDKLSGGEQQR

SEQ ID NO: 1410083 - protein, 15 aa, Mycobacterium tuberculosis
DRGFARGEQAHEGVS

SEQ ID NO: 1410084 - protein, 23 aa, Mycobacterium tuberculosis
DRGLSSAAQDIGPHTDDRLSDGQ

SEQ ID NO: 1410085 - protein, 5 aa, Mycobacterium tuberculosis
DRPGR

SEQ ID NO: 1410086 - protein, 7 aa, Mycobacterium tuberculosis
DRRSRAA

SEQ ID NO: 1410087 - protein, 10 aa, Mycobacterium tuberculosis
DSDAGGGGHE

SEQ ID NO: 1410088 - protein, 10 aa, Mycobacterium tuberculosis
DSDIADRAGH

SEQ ID NO: 1410089 - protein, 6 aa, Mycobacterium tuberculosis
DSFSDG

SEQ ID NO: 1410090 - protein, 7 aa, Mycobacterium tuberculosis
DSGDDCP

SEQ ID NO: 1410091 - protein, 7 aa, Mycobacterium tuberculosis
DSGTTSI

SEQ ID NO: 1410092 - protein, 6 aa, Mycobacterium tuberculosis
DSPNSA

SEQ ID NO: 1410093 - protein, 7 aa, Mycobacterium tuberculosis
DSQDGDA

SEQ ID NO: 1410094 - protein, 15 aa, Mycobacterium tuberculosis
DSRRPGLDAGTTPYG

SEQ ID NO: 1410095 - protein, 9 aa, Mycobacterium tuberculosis
DSRTGEMDT

SEQ ID NO: 1410096 - protein, 12 aa, Mycobacterium tuberculosis
DSSGAERDEDGS

SEQ ID NO: 1410097 - protein, 4 aa, Mycobacterium tuberculosis
DSTG

SEQ ID NO: 1410098 - protein, 6 aa, Mycobacterium tuberculosis
DTAANL

SEQ ID NO: 1410099 - protein, 5 aa, Mycobacterium tuberculosis
DTDPV

SEQ ID NO: 1410100 - protein, 5 aa, Mycobacterium tuberculosis
DTEAQ

SEQ ID NO: 1410101 - protein, 14 aa, Mycobacterium tuberculosis
DTEFSGGCAGRSCE

SEQ ID NO: 1410102 - protein, 15 aa, Mycobacterium tuberculosis
DTESTPTGGPVNSPD

SEQ ID NO: 1410103 - protein, 16 aa, Mycobacterium tuberculosis
DTGPTAVAQPNGEGAV

SEQ ID NO: 1410104 - protein, 12 aa, Mycobacterium tuberculosis
DTGTLTARPGAQ

SEQ ID NO: 1410105 - protein, 5 aa, Mycobacterium tuberculosis
DTHTP

SEQ ID NO: 1410106 - protein, 4 aa, Mycobacterium tuberculosis
DTHY

SEQ ID NO: 1410107 - protein, 6 aa, Mycobacterium tuberculosis
DTNPRW

SEQ ID NO: 1410108 - protein, 4 aa, Mycobacterium tuberculosis
DTPE

SEQ ID NO: 1410109 - protein, 5 aa, Mycobacterium tuberculosis
DTQPR

SEQ ID NO: 1410110 - protein, 8 aa, Mycobacterium tuberculosis
DVDERDQP

SEQ ID NO: 1410111 - protein, 8 aa, Mycobacterium tuberculosis
DVGGSGLR

SEQ ID NO: 1410112 - protein, 45 aa, Mycobacterium tuberculosis; identical to SEQ ID NO: 172701

SEQ ID NO: 1410113 - protein, 10 aa, Mycobacterium tuberculosis
DWGSPKIPEE

SEQ ID NO: 1410114 - protein, 15 aa, Mycobacterium tuberculosis
DYGPGGNYADIPTPA

SEQ ID NO: 1410115 - protein, 9 aa, Mycobacterium tuberculosis
EAAARQAGT

SEQ ID NO: 1410116 - protein, 8 aa, Mycobacterium tuberculosis
EADRPQLA

SEQ ID NO: 1410117 - protein, 12 aa, Mycobacterium tuberculosis
EADSYSSPTPCD

SEQ ID NO: 1410118 - protein, 8 aa, Mycobacterium tuberculosis
EAEAQERF

SEQ ID NO: 1410119 - protein, 9 aa, Mycobacterium tuberculosis
EAEGQPQVN

SEQ ID NO: 1410120 - protein, 16 aa, Mycobacterium tuberculosis
EAGGDGSDGGAGGSGG

SEQ ID NO: 1410121 - protein, 5 aa, Mycobacterium tuberculosis
EAGGL

SEQ ID NO: 1410122 - protein, 7 aa, Mycobacterium tuberculosis
EAGTVNG

SEQ ID NO: 1410123 - protein, 20 aa, Mycobacterium tuberculosis
EAHAEEDRKRREEADVRNQA

SEQ ID NO: 1410124 - protein, 12 aa, Mycobacterium tuberculosis
EAPPAGADTEET

SEQ ID NO: 1410125 - protein, 4 aa, Mycobacterium tuberculosis
EAQR

SEQ ID NO: 1410126 - protein, 6 aa, Mycobacterium tuberculosis
EAREDD

SEQ ID NO: 1410127 - protein, 9 aa, Mycobacterium tuberculosis
EARPPGKKI

SEQ ID NO: 1410128 - protein, 4 aa, Mycobacterium tuberculosis
EASE

SEQ ID NO: 1410129 - protein, 11 aa, Mycobacterium tuberculosis
EASSSGRAAQI

SEQ ID NO: 1410130 - protein, 5 aa, Mycobacterium tuberculosis
ECRNG

SEQ ID NO: 1410131 - protein, 14 aa, Mycobacterium tuberculosis
EDESGEPPASLSPA

SEQ ID NO: 1410132 - protein, 4 aa, Mycobacterium tuberculosis
EDFD

SEQ ID NO: 1410133 - protein, 7 aa, Mycobacterium tuberculosis
EDGREGD

SEQ ID NO: 1410134 - protein, 7 aa, Mycobacterium tuberculosis
EDGTRVT

SEQ ID NO: 1410135 - protein, 9 aa, Mycobacterium tuberculosis
EDPETAPTT

SEQ ID NO: 1410136 - protein, 7 aa, Mycobacterium tuberculosis
EDRENEG

SEQ ID NO: 1410137 - protein, 10 aa, Mycobacterium tuberculosis
EEHGGRGLST

SEQ ID NO: 1410138 - protein, 7 aa, Mycobacterium tuberculosis
EEPIDHT

SEQ ID NO: 1410139 - protein, 4 aa, Mycobacterium tuberculosis
EEPP

SEQ ID NO: 1410140 - protein, 4 aa, Mycobacterium tuberculosis
EESL

SEQ ID NO: 1410141 - protein, 6 aa, Mycobacterium tuberculosis
EGAGDT

SEQ ID NO: 1410142 - protein, 9 aa, Mycobacterium tuberculosis
EGAGSPAEI

SEQ ID NO: 1410143 - protein, 14 aa, Mycobacterium tuberculosis
EGDAATACEASLDQ

SEQ ID NO: 1410144 - protein, 6 aa, Mycobacterium tuberculosis
EGEPGD

SEQ ID NO: 1410145 - protein, 6 aa, Mycobacterium tuberculosis
EGGERV

SEQ ID NO: 1410146 - protein, 9 aa, Mycobacterium tuberculosis
EGIGGHESF

SEQ ID NO: 1410147 - protein, 4 aa, Mycobacterium tuberculosis
EGLQ

SEQ ID NO: 1410148 - protein, 9 aa, Mycobacterium tuberculosis
EGPEPGDSL

SEQ ID NO: 1410149 - protein, 18 aa, Mycobacterium tuberculosis
EGPEVGGPYGPYRQSQRA

SEQ ID NO: 1410150 - protein, 8 aa, Mycobacterium tuberculosis
EGPGDGPP

SEQ ID NO: 1410151 - protein, 14 aa, Mycobacterium tuberculosis
EGPGITDDARAGAA

SEQ ID NO: 1410152 - protein, 4 aa, Mycobacterium tuberculosis
EGPQ

SEQ ID NO: 1410153 - protein, 5 aa, Mycobacterium tuberculosis
EGPTV

SEQ ID NO: 1410154 - protein, 10 aa, Mycobacterium tuberculosis
EGSGADVSGL

SEQ ID NO: 1410155 - protein, 18 aa, Mycobacterium tuberculosis
EGTAQLTPPAAAPDDDTV

SEQ ID NO: 1410156 - protein, 9 aa, Mycobacterium tuberculosis
EGVDEPTKS

SEQ ID NO: 1410157 - protein, 13 aa, Mycobacterium tuberculosis
EHDGQPQHRTRKH

SEQ ID NO: 1410158 - protein, 12 aa, Mycobacterium tuberculosis
EHKSDPPQSLAE

SEQ ID NO: 1410159 - protein, 5 aa, Mycobacterium tuberculosis
EHRDG

SEQ ID NO: 1410160 - protein, 7 aa, Mycobacterium tuberculosis
EHRQPRV

SEQ ID NO: 1410161 - protein, 8 aa, Mycobacterium tuberculosis
EIGTGSVP

SEQ ID NO: 1410162 - protein, 16 aa, Mycobacterium tuberculosis
EIPDTTSEDGGLPTDH

SEQ ID NO: 1410163 - protein, 10 aa, Mycobacterium tuberculosis
EISEEQARAA

SEQ ID NO: 1410164 - protein, 7 aa, Mycobacterium tuberculosis
EITPQTT

SEQ ID NO: 1410165 - protein, 9 aa, Mycobacterium tuberculosis
EKATTKRTA

SEQ ID NO: 1410166 - protein, 9 aa, Mycobacterium tuberculosis
EKDCETRRQ

SEQ ID NO: 1410167 - protein, 7 aa, Mycobacterium tuberculosis
EKGNAAR

SEQ ID NO: 1410168 - protein, 6 aa, Mycobacterium tuberculosis
EKPVKT

SEQ ID NO: 1410169 - protein, 7 aa, Mycobacterium tuberculosis
ELGEPNR

SEQ ID NO: 1410170 - protein, 13 aa, Mycobacterium tuberculosis
ELGRDPDSVRAEA

SEQ ID NO: 1410171 - protein, 4 aa, Mycobacterium tuberculosis
ELGS

SEQ ID NO: 1410172 - protein, 14 aa, Mycobacterium tuberculosis
ELPTAGGEQARSVR

SEQ ID NO: 1410173 - protein, 4 aa, Mycobacterium tuberculosis
ELSD

SEQ ID NO: 1410174 - protein, 7 aa, Mycobacterium tuberculosis
EMDTPRD

SEQ ID NO: 1410175 - protein, 14 aa, Mycobacterium tuberculosis
EMPSTALSGTTGLG

SEQ ID NO: 1410176 - protein, 9 aa, Mycobacterium tuberculosis
ENIPEPGIP

SEQ ID NO: 1410177 - protein, 5 aa, Mycobacterium tuberculosis
EPATV

SEQ ID NO: 1410178 - protein, 9 aa, Mycobacterium tuberculosis
EPATVRAET

SEQ ID NO: 1410179 - protein, 4 aa, Mycobacterium tuberculosis
EPAY

SEQ ID NO: 1410180 - protein, 5 aa, Mycobacterium tuberculosis
EPDPS

SEQ ID NO: 1410181 - protein, 7 aa, Mycobacterium tuberculosis
EPDTTDV

SEQ ID NO: 1410182 - protein, 6 aa, Mycobacterium tuberculosis
EPEDES

SEQ ID NO: 1410183 - protein, 16 aa, Mycobacterium tuberculosis
EPESRRPGRPKRLTDA

SEQ ID NO: 1410184 - protein, 8 aa, Mycobacterium tuberculosis
EPGRSESQ

SEQ ID NO: 1410185 - protein, 18 aa, Mycobacterium tuberculosis
EPPLNEDKTVRGNVEEGM

SEQ ID NO: 1410186 - protein, 6 aa, Mycobacterium tuberculosis
EPSVED

SEQ ID NO: 1410187 - protein, 4 aa, Mycobacterium tuberculosis
EPTA

SEQ ID NO: 1410188 - protein, 5 aa, Mycobacterium tuberculosis
EPTAA

SEQ ID NO: 1410189 - protein, 7 aa, Mycobacterium tuberculosis
EPTGEGF

SEQ ID NO: 1410190 - protein, 5 aa, Mycobacterium tuberculosis
EPYTA

SEQ ID NO: 1410191 - protein, 6 aa, Mycobacterium tuberculosis
EQDAAR

SEQ ID NO: 1410192 - protein, 9 aa, Mycobacterium tuberculosis
EQQARNEGY

SEQ ID NO: 1410193 - protein, 10 aa, Mycobacterium tuberculosis
EQTESLGPQS

SEQ ID NO: 1410194 - protein, 13 aa, Mycobacterium tuberculosis
EQTGDAIAPEEGA

SEQ ID NO: 1410195 - protein, 8 aa, Mycobacterium tuberculosis
EQTPDTSR

SEQ ID NO: 1410196 - protein, 10 aa, Mycobacterium tuberculosis
EQTTRTPDAT

SEQ ID NO: 1410197 - protein, 8 aa, Mycobacterium tuberculosis
ERADAPLR

SEQ ID NO: 1410198 - protein, 5 aa, Mycobacterium tuberculosis
ERAGV

SEQ ID NO: 1410199 - protein, 7 aa, Mycobacterium tuberculosis
ERASGFR

SEQ ID NO: 1410200 - protein, 9 aa, Mycobacterium tuberculosis
ERAVPPYES

SEQ ID NO: 1410201 - protein, 9 aa, Mycobacterium tuberculosis
ERDESVPRT

SEQ ID NO: 1410202 - protein, 5 aa, Mycobacterium tuberculosis
ERGAP

SEQ ID NO: 1410203 - protein, 7 aa, Mycobacterium tuberculosis
ERGTGDE

SEQ ID NO: 1410204 - protein, 6 aa, Mycobacterium tuberculosis
ERGVPT

SEQ ID NO: 1410205 - protein, 11 aa, Mycobacterium tuberculosis
ERHGLGNDPIS

SEQ ID NO: 1410206 - protein, 12 aa, Mycobacterium tuberculosis
ERKPGRPHTGTA

SEQ ID NO: 1410207 - protein, 7 aa, Mycobacterium tuberculosis
ERPAGGH

SEQ ID NO: 1410208 - protein, 6 aa, Mycobacterium tuberculosis
ERPEAA

SEQ ID NO: 1410209 - protein, 8 aa, Mycobacterium tuberculosis
ERPSRVGE

SEQ ID NO: 1410210 - protein, 5 aa, Mycobacterium tuberculosis
ERRGG

SEQ ID NO: 1410211 - protein, 4 aa, Mycobacterium tuberculosis
ERTA

SEQ ID NO: 1410212 - protein, 10 aa, Mycobacterium tuberculosis
ERTANGPFTS

SEQ ID NO: 1410213 - protein, 8 aa, Mycobacterium tuberculosis
ESAERGQG

SEQ ID NO: 1410214 - protein, 8 aa, Mycobacterium tuberculosis
ESDPSHPG

SEQ ID NO: 1410215 - protein, 7 aa, Mycobacterium tuberculosis
ESGVPAE

SEQ ID NO: 1410216 - protein, 13 aa, Mycobacterium tuberculosis
ESLAAEGDALTDR

SEQ ID NO: 1410217 - protein, 34 aa, Mycobacterium tuberculosis; identical to SEQ ID NO: 34018

SEQ ID NO: 1410218 - protein, 11 aa, Mycobacterium tuberculosis
ETDDVSEDSLE

SEQ ID NO: 1410219 - protein, 6 aa, Mycobacterium tuberculosis
ETDPDL

SEQ ID NO: 1410220 - protein, 5 aa, Mycobacterium tuberculosis
ETFAR

SEQ ID NO: 1410221 - protein, 15 aa, Mycobacterium tuberculosis
ETHGPPPDPDDDPPP

SEQ ID NO: 1410222 - protein, 6 aa, Mycobacterium tuberculosis
ETNKQH

SEQ ID NO: 1410223 - protein, 5 aa, Mycobacterium tuberculosis
ETPIG

SEQ ID NO: 1410224 - protein, 6 aa, Mycobacterium tuberculosis
ETQPQG

SEQ ID NO: 1410225 - protein, 7 aa, Mycobacterium tuberculosis
ETRAQGR

SEQ ID NO: 1410226 - protein, 7 aa, Mycobacterium tuberculosis
ETRGSGV

SEQ ID NO: 1410227 - protein, 4 aa, Mycobacterium tuberculosis
ETSK

SEQ ID NO: 1410228 - protein, 9 aa, Mycobacterium tuberculosis
EVDGERLSD

SEQ ID NO: 1410229 - protein, 7 aa, Mycobacterium tuberculosis
EVGAGKT

SEQ ID NO: 1410230 - protein, 14 aa, Mycobacterium tuberculosis
EVGESASASGGPRR

SEQ ID NO: 1410231 - protein, 9 aa, Mycobacterium tuberculosis
EVGGPLPGL

SEQ ID NO: 1410232 - protein, 9 aa, Mycobacterium tuberculosis
EVQNGTDVG

SEQ ID NO: 1410233 - protein, 8 aa, Mycobacterium tuberculosis
EVSGDGGK

SEQ ID NO: 1410234 - protein, 10 aa, Mycobacterium tuberculosis
EYRQKTTVGP

SEQ ID NO: 1410235 - protein, 8 aa, Mycobacterium tuberculosis
FADAGSDG

SEQ ID NO: 1410236 - protein, 14 aa, Mycobacterium tuberculosis
FDPSSGASGGYDTP

SEQ ID NO: 1410237 - protein, 4 aa, Mycobacterium tuberculosis
FGDQ

SEQ ID NO: 1410238 - protein, 11 aa, Mycobacterium tuberculosis
FGSADYRGGDH

SEQ ID NO: 1410239 - protein, 11 aa, Mycobacterium tuberculosis
FNDGTRGGEAD

SEQ ID NO: 1410240 - protein, 7 aa, Mycobacterium tuberculosis
FNTGSGN

SEQ ID NO: 1410241 - protein, 6 aa, Mycobacterium tuberculosis
FPTDRG

SEQ ID NO: 1410242 - protein, 11 aa, Mycobacterium tuberculosis
FRSRSKAAETA

SEQ ID NO: 1410243 - protein, 12 aa, Mycobacterium tuberculosis
FSEGSEPAGIGG

SEQ ID NO: 1410244 - protein, 5 aa, Mycobacterium tuberculosis
FTGTE

SEQ ID NO: 1410245 - protein, 10 aa, Mycobacterium tuberculosis
FVPGPSDPTA

SEQ ID NO: 1410246 - protein, 5 aa, Mycobacterium tuberculosis
GAAPG

SEQ ID NO: 1410247 - protein, 5 aa, Mycobacterium tuberculosis
GADAI

SEQ ID NO: 1410248 - protein, 14 aa, Mycobacterium tuberculosis
GADERTGQPRPPAV

SEQ ID NO: 1410249 - protein, 7 aa, Mycobacterium tuberculosis
GADPSDI

SEQ ID NO: 1410250 - protein, 7 aa, Mycobacterium tuberculosis
GAEAANV

SEQ ID NO: 1410251 - protein, 8 aa, Mycobacterium tuberculosis
GAEGTENV

SEQ ID NO: 1410252 - protein, 7 aa, Mycobacterium tuberculosis
GAGAGAA

SEQ ID NO: 1410253 - protein, 10 aa, Mycobacterium tuberculosis
GAGEGSAITD

SEQ ID NO: 1410254 - protein, 6 aa, Mycobacterium tuberculosis
GAGEHG

SEQ ID NO: 1410255 - protein, 12 aa, Mycobacterium tuberculosis
GAGGAPTASAVT

SEQ ID NO: 1410256 - protein, 7 aa, Mycobacterium tuberculosis
GAGHRDL

SEQ ID NO: 1410257 - protein, 5 aa, Mycobacterium tuberculosis
GAGLG

SEQ ID NO: 1410258 - protein, 7 aa, Mycobacterium tuberculosis
GAGPAPM

SEQ ID NO: 1410259 - protein, 6 aa, Mycobacterium tuberculosis
GAGPLD

SEQ ID NO: 1410260 - protein, 7 aa, Mycobacterium tuberculosis
GAGPNCD

SEQ ID NO: 1410261 - protein, 9 aa, Mycobacterium tuberculosis
GAGQQHGPA

SEQ ID NO: 1410262 - protein, 7 aa, Mycobacterium tuberculosis
GAGSSPL

SEQ ID NO: 1410263 - protein, 16 aa, Mycobacterium tuberculosis
GAGTASGFGNFGGGAS

SEQ ID NO: 1410264 - protein, 12 aa, Mycobacterium tuberculosis
GAGTISLPLIVT

SEQ ID NO: 1410265 - protein, 11 aa, Mycobacterium tuberculosis
GAHPDSQSVGS

SEQ ID NO: 1410266 - protein, 7 aa, Mycobacterium tuberculosis
GALPRTR

SEQ ID NO: 1410267 - protein, 9 aa, Mycobacterium tuberculosis
GALRERGEL

SEQ ID NO: 1410268 - protein, 9 aa, Mycobacterium tuberculosis
GANGKSEVT

SEQ ID NO: 1410269 - protein, 6 aa, Mycobacterium tuberculosis
GAPDLP

SEQ ID NO: 1410270 - protein, 8 aa, Mycobacterium tuberculosis
GAPGAREV

SEQ ID NO: 1410271 - protein, 6 aa, Mycobacterium tuberculosis
GAPGSI

SEQ ID NO: 1410272 - protein, 9 aa, Mycobacterium tuberculosis
GAPKASPVE

SEQ ID NO: 1410273 - protein, 6 aa, Mycobacterium tuberculosis
GAPQTS

SEQ ID NO: 1410274 - protein, 7 aa, Mycobacterium tuberculosis
GAPRAST

SEQ ID NO: 1410275 - protein, 9 aa, Mycobacterium tuberculosis
GAPTITNDG

SEQ ID NO: 1410276 - protein, 8 aa, Mycobacterium tuberculosis
GAQRGSEL

SEQ ID NO: 1410277 - protein, 21 aa, Mycobacterium tuberculosis
GARAGALKGGVGTASATLQSG

SEQ ID NO: 1410278 - protein, 5 aa, Mycobacterium tuberculosis
GAREA

SEQ ID NO: 1410279 - protein, 14 aa, Mycobacterium tuberculosis
GARKGSLALSSPPA

SEQ ID NO: 1410280 - protein, 14 aa, Mycobacterium tuberculosis
GARRGGAVSGIGGH

SEQ ID NO: 1410281 - protein, 45 aa, Mycobacterium tuberculosis; identical to SEQ ID NO: 174862

SEQ ID NO: 1410282 - protein, 45 aa, Mycobacterium tuberculosis
GASAAATQLSPFNPAAQTINPAGLASQAASVGQAVSGAANAQALT

SEQ ID NO: 1410283 - protein, 30 aa, Mycobacterium tuberculosis; identical to SEQ ID NO: 174876

SEQ ID NO: 1410284 - protein, 4 aa, Mycobacterium tuberculosis
GASS

SEQ ID NO: 1410285 - protein, 6 aa, Mycobacterium tuberculosis
GATGQL

SEQ ID NO: 1410286 - protein, 10 aa, Mycobacterium tuberculosis
GATYDGAGTN

SEQ ID NO: 1410287 - protein, 5 aa, Mycobacterium tuberculosis
GAVQG

SEQ ID NO: 1410288 - protein, 7 aa, Mycobacterium tuberculosis
GAYGIDG

SEQ ID NO: 1410289 - protein, 9 aa, Mycobacterium tuberculosis
GCAGHSDGD

SEQ ID NO: 1410290 - protein, 8 aa, Mycobacterium tuberculosis
GCDPESGS

SEQ ID NO: 1410291 - protein, 7 aa, Mycobacterium tuberculosis
GCPPTPA

SEQ ID NO: 1410292 - protein, 5 aa, Mycobacterium tuberculosis
GDAFA

SEQ ID NO: 1410293 - protein, 14 aa, Mycobacterium tuberculosis
GDANLSGHTYPDQS

SEQ ID NO: 1410294 - protein, 13 aa, Mycobacterium tuberculosis
GDASGATSCLRGE

SEQ ID NO: 1410295 - protein, 10 aa, Mycobacterium tuberculosis
GDFGPQATAD

SEQ ID NO: 1410296 - protein, 9 aa, Mycobacterium tuberculosis
GDGEIDPSV

SEQ ID NO: 1410297 - protein, 6 aa, Mycobacterium tuberculosis
GDGLRD

SEQ ID NO: 1410298 - protein, 8 aa, Mycobacterium tuberculosis
GDGSLEEE

SEQ ID NO: 1410299 - protein, 21 aa, Mycobacterium tuberculosis
GDHRPAPPETEAALVPVQATL

SEQ ID NO: 1410300 - protein, 9 aa, Mycobacterium tuberculosis
GDIGAAGVS

SEQ ID NO: 1410301 - protein, 7 aa, Mycobacterium tuberculosis
GDLEREK

SEQ ID NO: 1410302 - protein, 7 aa, Mycobacterium tuberculosis
GDPNGDG

SEQ ID NO: 1410303 - protein, 5 aa, Mycobacterium tuberculosis
GDPNQ

SEQ ID NO: 1410304 - protein, 10 aa, Mycobacterium tuberculosis
GDPNYGYSTS

SEQ ID NO: 1410305 - protein, 6 aa, Mycobacterium tuberculosis
GDPPEV

SEQ ID NO: 1410306 - protein, 5 aa, Mycobacterium tuberculosis
GDPSF

SEQ ID NO: 1410307 - protein, 8 aa, Mycobacterium tuberculosis
GDQEKPGG

SEQ ID NO: 1410308 - protein, 4 aa, Mycobacterium tuberculosis
GDQR

SEQ ID NO: 1410309 - protein, 7 aa, Mycobacterium tuberculosis
GDRAPAV

SEQ ID NO: 1410310 - protein, 4 aa, Mycobacterium tuberculosis
GDRD

SEQ ID NO: 1410311 - protein, 7 aa, Mycobacterium tuberculosis
GDSPAGL

SEQ ID NO: 1410312 - protein, 36 aa, Mycobacterium tuberculosis; identical to SEQ ID NO: 175208

SEQ ID NO: 1410313 - protein, 10 aa, Mycobacterium tuberculosis
GEAGADYNVG

SEQ ID NO: 1410314 - protein, 6 aa, Mycobacterium tuberculosis
GEAGFG

SEQ ID NO: 1410315 - protein, 4 aa, Mycobacterium tuberculosis
GEDH

SEQ ID NO: 1410316 - protein, 10 aa, Mycobacterium tuberculosis
GEDQHQDTGA

SEQ ID NO: 1410317 - protein, 11 aa, Mycobacterium tuberculosis
GEEGSPRDTVT

SEQ ID NO: 1410318 - protein, 10 aa, Mycobacterium tuberculosis
GEHGENLPGD

SEQ ID NO: 1410319 - protein, 4 aa, Mycobacterium tuberculosis
GENP

SEQ ID NO: 1410320 - protein, 5 aa, Mycobacterium tuberculosis
GEPDV

SEQ ID NO: 1410321 - protein, 12 aa, Mycobacterium tuberculosis
GEPGVGKTTAAK

SEQ ID NO: 1410322 - protein, 12 aa, Mycobacterium tuberculosis
GEQALPDEIRNP

SEQ ID NO: 1410323 - protein, 8 aa, Mycobacterium tuberculosis
GEQTQNRI

SEQ ID NO: 1410324 - protein, 8 aa, Mycobacterium tuberculosis
GERTREGF

SEQ ID NO: 1410325 - protein, 6 aa, Mycobacterium tuberculosis
GESDER

SEQ ID NO: 1410326 - protein, 6 aa, Mycobacterium tuberculosis
GESHGR

SEQ ID NO: 1410327 - protein, 7 aa, Mycobacterium tuberculosis
GESTADR

SEQ ID NO: 1410328 - protein, 4 aa, Mycobacterium tuberculosis
GETA

SEQ ID NO: 1410329 - protein, 6 aa, Mycobacterium tuberculosis
GETGGK

SEQ ID NO: 1410330 - protein, 8 aa, Mycobacterium tuberculosis
GETGTGKT

SEQ ID NO: 1410331 - protein, 8 aa, Mycobacterium tuberculosis
GETRPGDR

SEQ ID NO: 1410332 - protein, 5 aa, Mycobacterium tuberculosis
GETTH

SEQ ID NO: 1410333 - protein, 8 aa, Mycobacterium tuberculosis
GEVSTAEP

SEQ ID NO: 1410334 - protein, 11 aa, Mycobacterium tuberculosis
GEYGPEKDGCG

SEQ ID NO: 1410335 - protein, 5 aa, Mycobacterium tuberculosis
GFAGG

SEQ ID NO: 1410336 - protein, 5 aa, Mycobacterium tuberculosis
GFGGT

SEQ ID NO: 1410337 - protein, 4 aa, Mycobacterium tuberculosis
GFGR

SEQ ID NO: 1410338 - protein, 13 aa, Mycobacterium tuberculosis
GFPGDPRRCKPSF

SEQ ID NO: 1410339 - protein, 8 aa, Mycobacterium tuberculosis
GGAEFGSG

SEQ ID NO: 1410340 - protein, 12 aa, Mycobacterium tuberculosis
GGAGDAGQAGQQ

SEQ ID NO: 1410341 - protein, 15 aa, Mycobacterium tuberculosis
GGAPGFGNSTTLPSS

SEQ ID NO: 1410342 - protein, 14 aa, Mycobacterium tuberculosis
GGARDGTGAGSAMA

SEQ ID NO: 1410343 - protein, 5 aa, Mycobacterium tuberculosis
GGASG

SEQ ID NO: 1410344 - protein, 53 aa, Mycobacterium tuberculosis; identical to SEQ ID NO: 175577

SEQ ID NO: 1410345 - protein, 12 aa, Mycobacterium tuberculosis
GGDAVSASADDH

SEQ ID NO: 1410346 - protein, 14 aa, Mycobacterium tuberculosis
GGDGGNGGDVGAGS

SEQ ID NO: 1410347 - protein, 4 aa, Mycobacterium tuberculosis
GGDP

SEQ ID NO: 1410348 - protein, 7 aa, Mycobacterium tuberculosis
GGDSAME

SEQ ID NO: 1410349 - protein, 11 aa, Mycobacterium tuberculosis
GGDSGPSGGTL

SEQ ID NO: 1410350 - protein, 10 aa, Mycobacterium tuberculosis
GGEEDGVANE

SEQ ID NO: 1410351 - protein, 4 aa, Mycobacterium tuberculosis
GGEG

SEQ ID NO: 1410352 - protein, 6 aa, Mycobacterium tuberculosis
GGEKAL

SEQ ID NO: 1410353 - protein, 7 aa, Mycobacterium tuberculosis
GGEPTGL

SEQ ID NO: 1410354 - protein, 8 aa, Mycobacterium tuberculosis
GGEVSPTL

SEQ ID NO: 1410355 - protein, 18 aa, Mycobacterium tuberculosis
GGGASAATSRSNRRRNVS

SEQ ID NO: 1410356 - protein, 8 aa, Mycobacterium tuberculosis
GGGPAVGA

SEQ ID NO: 1410357 - protein, 6 aa, Mycobacterium tuberculosis
GGGRPM

SEQ ID NO: 1410358 - protein, 5 aa, Mycobacterium tuberculosis
GGHDY

SEQ ID NO: 1410359 - protein, 10 aa, Mycobacterium tuberculosis
GGKAGTGKSA

SEQ ID NO: 1410360 - protein, 20 aa, Mycobacterium tuberculosis
GGKEAEERAASSVKEKNDWT

SEQ ID NO: 1410361 - protein, 8 aa, Mycobacterium tuberculosis
GGKSTPDL

SEQ ID NO: 1410362 - protein, 6 aa, Mycobacterium tuberculosis
GGLGPV

SEQ ID NO: 1410363 - protein, 4 aa, Mycobacterium tuberculosis
GGMR

SEQ ID NO: 1410364 - protein, 7 aa, Mycobacterium tuberculosis
GGMSPNG

SEQ ID NO: 1410365 - protein, 5 aa, Mycobacterium tuberculosis
GGNRG

SEQ ID NO: 1410366 - protein, 9 aa, Mycobacterium tuberculosis
GGNSNSGSF

SEQ ID NO: 1410367 - protein, 9 aa, Mycobacterium tuberculosis
GGPTTTIDG

SEQ ID NO: 1410368 - protein, 17 aa, Mycobacterium tuberculosis
GGQEAKGVRSSWPASLT

SEQ ID NO: 1410369 - protein, 9 aa, Mycobacterium tuberculosis
GGQPDNGLD

SEQ ID NO: 1410370 - protein, 17 aa, Mycobacterium tuberculosis
GGRLGESAPASGTPPAT

SEQ ID NO: 1410371 - protein, 9 aa, Mycobacterium tuberculosis
GGSARTGEL

SEQ ID NO: 1410372 - protein, 5 aa, Mycobacterium tuberculosis
GGSGA

SEQ ID NO: 1410373 - protein, 9 aa, Mycobacterium tuberculosis
GGSPTTQQA

SEQ ID NO: 1410374 - protein, 15 aa, Mycobacterium tuberculosis
GGSSGFVTDQDTAEL

SEQ ID NO: 1410375 - protein, 7 aa, Mycobacterium tuberculosis
GGTEAVE

SEQ ID NO: 1410376 - protein, 7 aa, Mycobacterium tuberculosis
GGTLESG

SEQ ID NO: 1410377 - protein, 16 aa, Mycobacterium tuberculosis
GGTPGFGNSTTGPSSG

SEQ ID NO: 1410378 - protein, 8 aa, Mycobacterium tuberculosis
GGTSTDVS

SEQ ID NO: 1410379 - protein, 8 aa, Mycobacterium tuberculosis
GGVTGSAA

SEQ ID NO: 1410380 - protein, 5 aa, Mycobacterium tuberculosis
GGYDP

SEQ ID NO: 1410381 - protein, 5 aa, Mycobacterium tuberculosis
GHDRG

SEQ ID NO: 1410382 - protein, 7 aa, Mycobacterium tuberculosis
GHRKGAV

SEQ ID NO: 1410383 - protein, 7 aa, Mycobacterium tuberculosis
GIATPAD

SEQ ID NO: 1410384 - protein, 4 aa, Mycobacterium tuberculosis
GIEA

SEQ ID NO: 1410385 - protein, 11 aa, Mycobacterium tuberculosis
GIEGPGGQVTE

SEQ ID NO: 1410386 - protein, 8 aa, Mycobacterium tuberculosis
GIGTGKTT

SEQ ID NO: 1410387 - protein, 11 aa, Mycobacterium tuberculosis
GITGSDGASHN

SEQ ID NO: 1410388 - protein, 4 aa, Mycobacterium tuberculosis
GITR

SEQ ID NO: 1410389 - protein, 21 aa, Mycobacterium tuberculosis
GITSPPPESLGRRRSRLAQLE

SEQ ID NO: 1410390 - protein, 7 aa, Mycobacterium tuberculosis
GKDGNAG

SEQ ID NO: 1410391 - protein, 7 aa, Mycobacterium tuberculosis
GKPAGKT

SEQ ID NO: 1410392 - protein, 11 aa, Mycobacterium tuberculosis
GKPGSSDTSGR

SEQ ID NO: 1410393 - protein, 13 aa, Mycobacterium tuberculosis
GKPTDQLPGPGRQ

SEQ ID NO: 1410394 - protein, 5 aa, Mycobacterium tuberculosis
GKSDH

SEQ ID NO: 1410395 - protein, 8 aa, Mycobacterium tuberculosis
GKSLSAPT

SEQ ID NO: 1410396 - protein, 4 aa, Mycobacterium tuberculosis
GKSY

SEQ ID NO: 1410397 - protein, 4 aa, Mycobacterium tuberculosis
GKTT

SEQ ID NO: 1410398 - protein, 9 aa, Mycobacterium tuberculosis
GLAETAEEI

SEQ ID NO: 1410399 - protein, 4 aa, Mycobacterium tuberculosis
GLAR

SEQ ID NO: 1410400 - protein, 6 aa, Mycobacterium tuberculosis
GLATEL

SEQ ID NO: 1410401 - protein, 9 aa, Mycobacterium tuberculosis
GLDSTAPTA

SEQ ID NO: 1410402 - protein, 7 aa, Mycobacterium tuberculosis
GLEPASP

SEQ ID NO: 1410403 - protein, 5 aa, Mycobacterium tuberculosis
GLGNS

SEQ ID NO: 1410404 - protein, 7 aa, Mycobacterium tuberculosis
GLPADAK

SEQ ID NO: 1410405 - protein, 7 aa, Mycobacterium tuberculosis
GLPEDDP

SEQ ID NO: 1410406 - protein, 5 aa, Mycobacterium tuberculosis
GLPPG

SEQ ID NO: 1410407 - protein, 11 aa, Mycobacterium tuberculosis
GLQKTPKSLPP

SEQ ID NO: 1410408 - protein, 8 aa, Mycobacterium tuberculosis
GLRPGGQA

SEQ ID NO: 1410409 - protein, 10 aa, Mycobacterium tuberculosis
GLSASSGLAH

SEQ ID NO: 1410410 - protein, 7 aa, Mycobacterium tuberculosis
GLSPDGA

SEQ ID NO: 1410411 - protein, 10 aa, Mycobacterium tuberculosis
GLTPNQMASR

SEQ ID NO: 1410412 - protein, 10 aa, Mycobacterium tuberculosis
GNAGSTNTGL

SEQ ID NO: 1410413 - protein, 4 aa, Mycobacterium tuberculosis
GNDP

SEQ ID NO: 1410414 - protein, 15 aa, Mycobacterium tuberculosis
GNGNVGIGNTGTANF

SEQ ID NO: 1410415 - protein, 5 aa, Mycobacterium tuberculosis
GNGTE

SEQ ID NO: 1410416 - protein, 11 aa, Mycobacterium tuberculosis
GNGTGTPAEES

SEQ ID NO: 1410417 - protein, 7 aa, Mycobacterium tuberculosis
GNLGSQN

SEQ ID NO: 1410418 - protein, 8 aa, Mycobacterium tuberculosis
GNLPTAPA

SEQ ID NO: 1410419 - protein, 13 aa, Mycobacterium tuberculosis
GNNNVGSGNTGDY

SEQ ID NO: 1410420 - protein, 6 aa, Mycobacterium tuberculosis
GNPDGA

SEQ ID NO: 1410421 - protein, 11 aa, Mycobacterium tuberculosis
GNQHDAEDLTQ

SEQ ID NO: 1410422 - protein, 11 aa, Mycobacterium tuberculosis
GNRTSDQPRPL

SEQ ID NO: 1410423 - protein, 7 aa, Mycobacterium tuberculosis
GPAEVGP

SEQ ID NO: 1410424 - protein, 9 aa, Mycobacterium tuberculosis
GPAGVGKTE

SEQ ID NO: 1410425 - protein, 7 aa, Mycobacterium tuberculosis
GPASYTG

SEQ ID NO: 1410426 - protein, 22 aa, Mycobacterium tuberculosis
GPAYNTGSAWGYTPKGATGVPT

SEQ ID NO: 1410427 - protein, 5 aa, Mycobacterium tuberculosis
GPGAE

SEQ ID NO: 1410428 - protein, 10 aa, Mycobacterium tuberculosis
GPGGSLTGSA

SEQ ID NO: 1410429 - protein, 7 aa, Mycobacterium tuberculosis
GPGRADG

SEQ ID NO: 1410430 - protein, 9 aa, Mycobacterium tuberculosis
GPIRPTSAA

SEQ ID NO: 1410431 - protein, 8 aa, Mycobacterium tuberculosis
GPKTGEQV

SEQ ID NO: 1410432 - protein, 5 aa, Mycobacterium tuberculosis
GPNLG

SEQ ID NO: 1410433 - protein, 9 aa, Mycobacterium tuberculosis
GPNQPPPGI

SEQ ID NO: 1410434 - protein, 5 aa, Mycobacterium tuberculosis
GPRAA

SEQ ID NO: 1410435 - protein, 4 aa, Mycobacterium tuberculosis
GPRL

SEQ ID NO: 1410436 - protein, 17 aa, Mycobacterium tuberculosis
GPRPTATPTPLIPTAES

SEQ ID NO: 1410437 - protein, 22 aa, Mycobacterium tuberculosis
GPSGDTWSWGPSDAAQRVTGSA

SEQ ID NO: 1410438 - protein, 9 aa, Mycobacterium tuberculosis
GPSGGGKTT

SEQ ID NO: 1410439 - protein, 11 aa, Mycobacterium tuberculosis
GPSSSHTVGPM

SEQ ID NO: 1410440 - protein, 5 aa, Mycobacterium tuberculosis
GPSTT

SEQ ID NO: 1410441 - protein, 5 aa, Mycobacterium tuberculosis
GPTDG

SEQ ID NO: 1410442 - protein, 7 aa, Mycobacterium tuberculosis
GPTGGLG

SEQ ID NO: 1410443 - protein, 5 aa, Mycobacterium tuberculosis
GPTLD

SEQ ID NO: 1410444 - protein, 4 aa, Mycobacterium tuberculosis
GPTV

SEQ ID NO: 1410445 - protein, 15 aa, Mycobacterium tuberculosis
GPTVAGSDGEQADAI

SEQ ID NO: 1410446 - protein, 4 aa, Mycobacterium tuberculosis
GPVN

SEQ ID NO: 1410447 - protein, 4 aa, Mycobacterium tuberculosis
GQAA

SEQ ID NO: 1410448 - protein, 7 aa, Mycobacterium tuberculosis
GQGAQRI

SEQ ID NO: 1410449 - protein, 5 aa, Mycobacterium tuberculosis
GQGAV

SEQ ID NO: 1410450 - protein, 8 aa, Mycobacterium tuberculosis
GQHGTTTG

SEQ ID NO: 1410451 - protein, 6 aa, Mycobacterium tuberculosis
GQMGSG

SEQ ID NO: 1410452 - protein, 13 aa, Mycobacterium tuberculosis
GQPWQKGRQVSAA

SEQ ID NO: 1410453 - protein, 4 aa, Mycobacterium tuberculosis
GQQV

SEQ ID NO: 1410454 - protein, 18 aa, Mycobacterium tuberculosis
GQRCGGTAGHLRTSGPHL

SEQ ID NO: 1410455 - protein, 5 aa, Mycobacterium tuberculosis
GQTPL

SEQ ID NO: 1410456 - protein, 12 aa, Mycobacterium tuberculosis
GQTTSTEDAEGQ

SEQ ID NO: 1410457 - protein, 10 aa, Mycobacterium tuberculosis
GRADVSGLGA

SEQ ID NO: 1410458 - protein, 19 aa, Mycobacterium tuberculosis
GRDGAAGLDAGQAFADSGF

SEQ ID NO: 1410459 - protein, 9 aa, Mycobacterium tuberculosis
GRDPTPPAA

SEQ ID NO: 1410460 - protein, 8 aa, Mycobacterium tuberculosis
GRDRASDD

SEQ ID NO: 1410461 - protein, 11 aa, Mycobacterium tuberculosis
GRDSNDGIPPG

SEQ ID NO: 1410462 - protein, 8 aa, Mycobacterium tuberculosis
GREANADR

SEQ ID NO: 1410463 - protein, 13 aa, Mycobacterium tuberculosis
GREARARTRMKEG

SEQ ID NO: 1410464 - protein, 4 aa, Mycobacterium tuberculosis
GRGK

SEQ ID NO: 1410465 - protein, 17 aa, Mycobacterium tuberculosis
GRGPQTGKARGDTTGAH

SEQ ID NO: 1410466 - protein, 8 aa, Mycobacterium tuberculosis
GRGSAANS

SEQ ID NO: 1410467 - protein, 7 aa, Mycobacterium tuberculosis
GRIAPGY

SEQ ID NO: 1410468 - protein, 7 aa, Mycobacterium tuberculosis
GRNQRRS

SEQ ID NO: 1410469 - protein, 9 aa, Mycobacterium tuberculosis
GRNTSGKDR

SEQ ID NO: 1410470 - protein, 7 aa, Mycobacterium tuberculosis
GRPDPTQ

SEQ ID NO: 1410471 - protein, 4 aa, Mycobacterium tuberculosis
GRPE

SEQ ID NO: 1410472 - protein, 5 aa, Mycobacterium tuberculosis
GRPGV

SEQ ID NO: 1410473 - protein, 10 aa, Mycobacterium tuberculosis
GRPNRSPTDA

SEQ ID NO: 1410474 - protein, 14 aa, Mycobacterium tuberculosis
GRPPADSPTKAAQT

SEQ ID NO: 1410475 - protein, 6 aa, Mycobacterium tuberculosis
GRPYQD

SEQ ID NO: 1410476 - protein, 5 aa, Mycobacterium tuberculosis
GRRAA

SEQ ID NO: 1410477 - protein, 7 aa, Mycobacterium tuberculosis
GRRHGPE

SEQ ID NO: 1410478 - protein, 7 aa, Mycobacterium tuberculosis
GRSAEQR

SEQ ID NO: 1410479 - protein, 7 aa, Mycobacterium tuberculosis
GRSDPAL

SEQ ID NO: 1410480 - protein, 8 aa, Mycobacterium tuberculosis
GRSRENGY

SEQ ID NO: 1410481 - protein, 7 aa, Mycobacterium tuberculosis
GRVQEPT

SEQ ID NO: 1410482 - protein, 9 aa, Mycobacterium tuberculosis
GSAAASPDV

SEQ ID NO: 1410483 - protein, 6 aa, Mycobacterium tuberculosis
GSAYGL

SEQ ID NO: 1410484 - protein, 4 aa, Mycobacterium tuberculosis
GSDT

SEQ ID NO: 1410485 - protein, 5 aa, Mycobacterium tuberculosis
GSEDG

SEQ ID NO: 1410486 - protein, 7 aa, Mycobacterium tuberculosis
GSEGGAV

SEQ ID NO: 1410487 - protein, 16 aa, Mycobacterium tuberculosis
GSGGVGGSGGDGGNGG

SEQ ID NO: 1410488 - protein, 35 aa, Mycobacterium tuberculosis; identical to SEQ ID NO: 194250

SEQ ID NO: 1410489 - protein, 9 aa, Mycobacterium tuberculosis
GSGSGTSTL

SEQ ID NO: 1410490 - protein, 9 aa, Mycobacterium tuberculosis
GSGSLKSEI

SEQ ID NO: 1410491 - protein, 9 aa, Mycobacterium tuberculosis
GSGSSRHSI

SEQ ID NO: 1410492 - protein, 13 aa, Mycobacterium tuberculosis
GSGSVVRDPEGLT

SEQ ID NO: 1410493 - protein, 9 aa, Mycobacterium tuberculosis
GSHQDAINK

SEQ ID NO: 1410494 - protein, 9 aa, Mycobacterium tuberculosis
GSISKEQRA

SEQ ID NO: 1410495 - protein, 6 aa, Mycobacterium tuberculosis
GSLGSG

SEQ ID NO: 1410496 - protein, 28 aa, Mycobacterium tuberculosis
GSPGGAAKVGMTENDPQAVKDLAPQSED

SEQ ID NO: 1410497 - protein, 7 aa, Mycobacterium tuberculosis
GSPNRGM

SEQ ID NO: 1410498 - protein, 6 aa, Mycobacterium tuberculosis
GSPPAA

SEQ ID NO: 1410499 - protein, 7 aa, Mycobacterium tuberculosis
GSPPAAE

SEQ ID NO: 1410500 - protein, 5 aa, Mycobacterium tuberculosis
GSSHT

SEQ ID NO: 1410501 - protein, 7 aa, Mycobacterium tuberculosis
GSSRRYA

SEQ ID NO: 1410502 - protein, 18 aa, Mycobacterium tuberculosis
GSTHLGGRRGKSEQGLSR

SEQ ID NO: 1410503 - protein, 12 aa, Mycobacterium tuberculosis
GSTITAANTAAA

SEQ ID NO: 1410504 - protein, 6 aa, Mycobacterium tuberculosis
GSTLGG

SEQ ID NO: 1410505 - protein, 10 aa, Mycobacterium tuberculosis
GSTQGVTTTD

SEQ ID NO: 1410506 - protein, 11 aa, Mycobacterium tuberculosis
GSVNRGNAAQA

SEQ ID NO: 1410507 - protein, 6 aa, Mycobacterium tuberculosis
GSYNTG

SEQ ID NO: 1410508 - protein, 41 aa, Mycobacterium tuberculosis; identical to SEQ ID NO: 177392

SEQ ID NO: 1410509 - protein, 8 aa, Mycobacterium tuberculosis
GTDASMSD

SEQ ID NO: 1410510 - protein, 4 aa, Mycobacterium tuberculosis
GTEA

SEQ ID NO: 1410511 - protein, 4 aa, Mycobacterium tuberculosis
GTGA

SEQ ID NO: 1410512 - protein, 7 aa, Mycobacterium tuberculosis
GTGLTDD

SEQ ID NO: 1410513 - protein, 14 aa, Mycobacterium tuberculosis
GTNTSPLAGKVGGH

SEQ ID NO: 1410514 - protein, 5 aa, Mycobacterium tuberculosis
GTPDA

SEQ ID NO: 1410515 - protein, 7 aa, Mycobacterium tuberculosis
GTPDLEA

SEQ ID NO: 1410516 - protein, 5 aa, Mycobacterium tuberculosis
GTPPI

SEQ ID NO: 1410517 - protein, 20 aa, Mycobacterium tuberculosis
GTQGRKGKLDAAETEREHAA

SEQ ID NO: 1410518 - protein, 8 aa, Mycobacterium tuberculosis
GTRAHSAR

SEQ ID NO: 1410519 - protein, 12 aa, Mycobacterium tuberculosis
GTREGSSVRGGA

SEQ ID NO: 1410520 - protein, 6 aa, Mycobacterium tuberculosis
GTRRGY

SEQ ID NO: 1410521 - protein, 15 aa, Mycobacterium tuberculosis
GTTKIEDKDGNPVDP

SEQ ID NO: 1410522 - protein, 6 aa, Mycobacterium tuberculosis
GTTTRG

SEQ ID NO: 1410523 - protein, 10 aa, Mycobacterium tuberculosis
GTVPNSHTPV

SEQ ID NO: 1410524 - protein, 4 aa, Mycobacterium tuberculosis
GVAP

SEQ ID NO: 1410525 - protein, 4 aa, Mycobacterium tuberculosis
GVAT

SEQ ID NO: 1410526 - protein, 11 aa, Mycobacterium tuberculosis
GVDNRSPGGST

SEQ ID NO: 1410527 - protein, 13 aa, Mycobacterium tuberculosis
GVDPQRGWGQRDE

SEQ ID NO: 1410528 - protein, 10 aa, Mycobacterium tuberculosis
GVDSARCDAE

SEQ ID NO: 1410529 - protein, 13 aa, Mycobacterium tuberculosis
GVEPKDVASRRLG

SEQ ID NO: 1410530 - protein, 14 aa, Mycobacterium tuberculosis
GVGGATAAGVGGAH

SEQ ID NO: 1410531 - protein, 7 aa, Mycobacterium tuberculosis
GVGNSGF

SEQ ID NO: 1410532 - protein, 5 aa, Mycobacterium tuberculosis
GVGPT

SEQ ID NO: 1410533 - protein, 7 aa, Mycobacterium tuberculosis
GVNTPAI

SEQ ID NO: 1410534 - protein, 8 aa, Mycobacterium tuberculosis
GVPEGKSI

SEQ ID NO: 1410535 - protein, 8 aa, Mycobacterium tuberculosis
GVPTPGLG

SEQ ID NO: 1410536 - protein, 7 aa, Mycobacterium tuberculosis
GVQKDDK

SEQ ID NO: 1410537 - protein, 12 aa, Mycobacterium tuberculosis
GVRPPTRTVRGL

SEQ ID NO: 1410538 - protein, 9 aa, Mycobacterium tuberculosis
GVSPDSYPT

SEQ ID NO: 1410539 - protein, 7 aa, Mycobacterium tuberculosis
GVTAESI

SEQ ID NO: 1410540 - protein, 8 aa, Mycobacterium tuberculosis
GVTKDASM

SEQ ID NO: 1410541 - protein, 15 aa, Mycobacterium tuberculosis
GYGADKLASPVGRGR

SEQ ID NO: 1410542 - protein, 9 aa, Mycobacterium tuberculosis
GYGYPEAGQ

SEQ ID NO: 1410543 - protein, 6 aa, Mycobacterium tuberculosis
GYNEDE

SEQ ID NO: 1410544 - protein, 8 aa, Mycobacterium tuberculosis
GYPASTPV

SEQ ID NO: 1410545 - protein, 7 aa, Mycobacterium tuberculosis
GYPDVPA

SEQ ID NO: 1410546 - protein, 14 aa, Mycobacterium tuberculosis
GYPPLGEDSLPRAT

SEQ ID NO: 1410547 - protein, 4 aa, Mycobacterium tuberculosis
GYQS

SEQ ID NO: 1410548 - protein, 12 aa, Mycobacterium tuberculosis
HAARGAPARGLP

SEQ ID NO: 1410549 - protein, 5 aa, Mycobacterium tuberculosis
HAERV

SEQ ID NO: 1410550 - protein, 6 aa, Mycobacterium tuberculosis
HAPDDI

SEQ ID NO: 1410551 - protein, 8 aa, Mycobacterium tuberculosis
HASGTAWA

SEQ ID NO: 1410552 - protein, 4 aa, Mycobacterium tuberculosis
HATH

SEQ ID NO: 1410553 - protein, 6 aa, Mycobacterium tuberculosis
HDGESD

SEQ ID NO: 1410554 - protein, 7 aa, Mycobacterium tuberculosis
HDRDDAM

SEQ ID NO: 1410555 - protein, 15 aa, Mycobacterium tuberculosis
HDTPDEMAYPDGTER

SEQ ID NO: 1410556 - protein, 12 aa, Mycobacterium tuberculosis
HEGDGGQGSKPV

SEQ ID NO: 1410557 - protein, 8 aa, Mycobacterium tuberculosis
HEPGTSTN

SEQ ID NO: 1410558 - protein, 5 aa, Mycobacterium tuberculosis
HEQTA

SEQ ID NO: 1410559 - protein, 6 aa, Mycobacterium tuberculosis
HERTER

SEQ ID NO: 1410560 - protein, 12 aa, Mycobacterium tuberculosis
HGGTNTRELPSA

SEQ ID NO: 1410561 - protein, 10 aa, Mycobacterium tuberculosis
HGPGTPVGDP

SEQ ID NO: 1410562 - protein, 5 aa, Mycobacterium tuberculosis
HGRWP

SEQ ID NO: 1410563 - protein, 4 aa, Mycobacterium tuberculosis
HGSA

SEQ ID NO: 1410564 - protein, 9 aa, Mycobacterium tuberculosis
HHPANSDGF

SEQ ID NO: 1410565 - protein, 5 aa, Mycobacterium tuberculosis
HIGPS

SEQ ID NO: 1410566 - protein, 5 aa, Mycobacterium tuberculosis
HKPGL

SEQ ID NO: 1410567 - protein, 4 aa, Mycobacterium tuberculosis
HKPV

SEQ ID NO: 1410568 - protein, 13 aa, Mycobacterium tuberculosis
HLASATARGPKSA

SEQ ID NO: 1410569 - protein, 14 aa, Mycobacterium tuberculosis
HLDSTRAVSPLQAA

SEQ ID NO: 1410570 - protein, 8 aa, Mycobacterium tuberculosis
HNDRGTAV

SEQ ID NO: 1410571 - protein, 6 aa, Mycobacterium tuberculosis
HNRDAT

SEQ ID NO: 1410572 - protein, 16 aa, Mycobacterium tuberculosis
HPADRPATAADVGEEL

SEQ ID NO: 1410573 - protein, 7 aa, Mycobacterium tuberculosis
HPGVSNT

SEQ ID NO: 1410574 - protein, 7 aa, Mycobacterium tuberculosis
HPKEEPS

SEQ ID NO: 1410575 - protein, 13 aa, Mycobacterium tuberculosis
HPPEPHPTIPTTP

SEQ ID NO: 1410576 - protein, 5 aa, Mycobacterium tuberculosis
HPSAS

SEQ ID NO: 1410577 - protein, 6 aa, Mycobacterium tuberculosis
HPSPVP

SEQ ID NO: 1410578 - protein, 14 aa, Mycobacterium tuberculosis
HPSTAAPEDPGSNK

SEQ ID NO: 1410579 - protein, 10 aa, Mycobacterium tuberculosis
HQDGSPGPGT

SEQ ID NO: 1410580 - protein, 19 aa, Mycobacterium tuberculosis
HQGQGGAKSKGSQQEDEAL

SEQ ID NO: 1410581 - protein, 18 aa, Mycobacterium tuberculosis
HQNEATREECPSDPTPTD

SEQ ID NO: 1410582 - protein, 6 aa, Mycobacterium tuberculosis
HRAPGP

SEQ ID NO: 1410583 - protein, 10 aa, Mycobacterium tuberculosis
HRGSGAPKGL

SEQ ID NO: 1410584 - protein, 4 aa, Mycobacterium tuberculosis
HRGT

SEQ ID NO: 1410585 - protein, 4 aa, Mycobacterium tuberculosis
HSIP

SEQ ID NO: 1410586 - protein, 8 aa, Mycobacterium tuberculosis
HSQAAKPF

SEQ ID NO: 1410587 - protein, 5 aa, Mycobacterium tuberculosis
HSQGE

SEQ ID NO: 1410588 - protein, 7 aa, Mycobacterium tuberculosis
HTATDAA

SEQ ID NO: 1410589 - protein, 6 aa, Mycobacterium tuberculosis
HTPFTT

SEQ ID NO: 1410590 - protein, 8 aa, Mycobacterium tuberculosis
HTTYPPEG

SEQ ID NO: 1410591 - protein, 5 aa, Mycobacterium tuberculosis
HYDKS

SEQ ID NO: 1410592 - protein, 7 aa, Mycobacterium tuberculosis
HYPPSQG

SEQ ID NO: 1410593 - protein, 9 aa, Mycobacterium tuberculosis
IAEPDTADR

SEQ ID NO: 1410594 - protein, 14 aa, Mycobacterium tuberculosis
IAGNRGQTNYATTK

SEQ ID NO: 1410595 - protein, 21 aa, Mycobacterium tuberculosis
IASPAQPGEAGRHASDPVTSK

SEQ ID NO: 1410596 - protein, 8 aa, Mycobacterium tuberculosis
IAYSTDEV

SEQ ID NO: 1410597 - protein, 8 aa, Mycobacterium tuberculosis
IDDDPEAA

SEQ ID NO: 1410598 - protein, 6 aa, Mycobacterium tuberculosis
IDESDQ

SEQ ID NO: 1410599 - protein, 7 aa, Mycobacterium tuberculosis
IDPRDTR

SEQ ID NO: 1410600 - protein, 9 aa, Mycobacterium tuberculosis
IDQTETPVV

SEQ ID NO: 1410601 - protein, 8 aa, Mycobacterium tuberculosis
IEAETEEL

SEQ ID NO: 1410602 - protein, 16 aa, Mycobacterium tuberculosis
IECSTGSACTAGVAQP

SEQ ID NO: 1410603 - protein, 7 aa, Mycobacterium tuberculosis
IEGDTSV

SEQ ID NO: 1410604 - protein, 6 aa, Mycobacterium tuberculosis
IEGRKD

SEQ ID NO: 1410605 - protein, 9 aa, Mycobacterium tuberculosis
IEQPAQPAF

SEQ ID NO: 1410606 - protein, 5 aa, Mycobacterium tuberculosis
IERGE

SEQ ID NO: 1410607 - protein, 6 aa, Mycobacterium tuberculosis
IGAERD

SEQ ID NO: 1410608 - protein, 6 aa, Mycobacterium tuberculosis
IGAESN

SEQ ID NO: 1410609 - protein, 5 aa, Mycobacterium tuberculosis
IGGAL

SEQ ID NO: 1410610 - protein, 7 aa, Mycobacterium tuberculosis
IGGPNTA

SEQ ID NO: 1410611 - protein, 21 aa, Mycobacterium tuberculosis
IGNGGDGGDGGGAGAPGLGGR

SEQ ID NO: 1410612 - protein, 10 aa, Mycobacterium tuberculosis
IGNPGTDNTG

SEQ ID NO: 1410613 - protein, 13 aa, Mycobacterium tuberculosis
IGSDTGGSIRQPA

SEQ ID NO: 1410614 - protein, 6 aa, Mycobacterium tuberculosis
IGSPFA

SEQ ID NO: 1410615 - protein, 6 aa, Mycobacterium tuberculosis
IGTPGS

SEQ ID NO: 1410616 - protein, 10 aa, Mycobacterium tuberculosis
IGTTNPAAAQ

SEQ ID NO: 1410617 - protein, 15 aa, Mycobacterium tuberculosis
IGVPPGSRGCANYTR

SEQ ID NO: 1410618 - protein, 5 aa, Mycobacterium tuberculosis
IPDSG

SEQ ID NO: 1410619 - protein, 8 aa, Mycobacterium tuberculosis
IPPAPRGI

SEQ ID NO: 1410620 - protein, 13 aa, Mycobacterium tuberculosis
IPRRKSQNVKSAH

SEQ ID NO: 1410621 - protein, 7 aa, Mycobacterium tuberculosis
IQPPGKK

SEQ ID NO: 1410622 - protein, 19 aa, Mycobacterium tuberculosis
ISEAGQAMASTEGNVTGMF

SEQ ID NO: 1410623 - protein, 6 aa, Mycobacterium tuberculosis
ISGRTR

SEQ ID NO: 1410624 - protein, 14 aa, Mycobacterium tuberculosis
ISQATVNRMRGVLL

SEQ ID NO: 1410625 - protein, 8 aa, Mycobacterium tuberculosis
ISRAGRDA

SEQ ID NO: 1410626 - protein, 4 aa, Mycobacterium tuberculosis
ITAP

SEQ ID NO: 1410627 - protein, 6 aa, Mycobacterium tuberculosis
ITGETP

SEQ ID NO: 1410628 - protein, 11 aa, Mycobacterium tuberculosis
ITHPSAATAEA

SEQ ID NO: 1410629 - protein, 4 aa, Mycobacterium tuberculosis
ITPG

SEQ ID NO: 1410630 - protein, 8 aa, Mycobacterium tuberculosis
ITTAPGRP

SEQ ID NO: 1410631 - protein, 5 aa, Mycobacterium tuberculosis
IVPPA

SEQ ID NO: 1410632 - protein, 9 aa, Mycobacterium tuberculosis
KAAPGGDRE

SEQ ID NO: 1410633 - protein, 4 aa, Mycobacterium tuberculosis
KAAT

SEQ ID NO: 1410634 - protein, 7 aa, Mycobacterium tuberculosis
KAEAEEK

SEQ ID NO: 1410635 - protein, 6 aa, Mycobacterium tuberculosis
KAEFDG

SEQ ID NO: 1410636 - protein, 7 aa, Mycobacterium tuberculosis
KAPPPIA

SEQ ID NO: 1410637 - protein, 7 aa, Mycobacterium tuberculosis
KAREQMS

SEQ ID NO: 1410638 - protein, 13 aa, Mycobacterium tuberculosis
KATAAAAPSVRTA

SEQ ID NO: 1410639 - protein, 16 aa, Mycobacterium tuberculosis
KATAITPGLESPTIAP

SEQ ID NO: 1410640 - protein, 5 aa, Mycobacterium tuberculosis
KATPE

SEQ ID NO: 1410641 - protein, 8 aa, Mycobacterium tuberculosis
KAYGRNSD

SEQ ID NO: 1410642 - protein, 9 aa, Mycobacterium tuberculosis
KDAPPLPAS

SEQ ID NO: 1410643 - protein, 6 aa, Mycobacterium tuberculosis
KDGGVL

SEQ ID NO: 1410644 - protein, 7 aa, Mycobacterium tuberculosis
KDLAGRP

SEQ ID NO: 1410645 - protein, 10 aa, Mycobacterium tuberculosis
KDTGVQDAPD

SEQ ID NO: 1410646 - protein, 7 aa, Mycobacterium tuberculosis
KEPPAEG

SEQ ID NO: 1410647 - protein, 5 aa, Mycobacterium tuberculosis
KETGV

SEQ ID NO: 1410648 - protein, 9 aa, Mycobacterium tuberculosis
KGAPPAPLD

SEQ ID NO: 1410649 - protein, 6 aa, Mycobacterium tuberculosis
KGGKRR

SEQ ID NO: 1410650 - protein, 9 aa, Mycobacterium tuberculosis
KGGTGKSTI

SEQ ID NO: 1410651 - protein, 6 aa, Mycobacterium tuberculosis
KGKTGL

SEQ ID NO: 1410652 - protein, 17 aa, Mycobacterium tuberculosis
KGRRGRSPARPNAPIGA

SEQ ID NO: 1410653 - protein, 9 aa, Mycobacterium tuberculosis
KKGRDPDRV

SEQ ID NO: 1410654 - protein, 13 aa, Mycobacterium tuberculosis
KKQAQESVAAEAT

SEQ ID NO: 1410655 - protein, 8 aa, Mycobacterium tuberculosis
KKYTAPEI

SEQ ID NO: 1410656 - protein, 9 aa, Mycobacterium tuberculosis
KLGQESQAL

SEQ ID NO: 1410657 - protein, 9 aa, Mycobacterium tuberculosis
KNASDADIK

SEQ ID NO: 1410658 - protein, 10 aa, Mycobacterium tuberculosis
KNIDAARAEK

SEQ ID NO: 1410659 - protein, 5 aa, Mycobacterium tuberculosis
KNSAG

SEQ ID NO: 1410660 - protein, 6 aa, Mycobacterium tuberculosis
KNTGCT

SEQ ID NO: 1410661 - protein, 23 aa, Mycobacterium tuberculosis
KNTVKSALESNQQPKYERAPQGS

SEQ ID NO: 1410662 - protein, 8 aa, Mycobacterium tuberculosis
KPAAAARL

SEQ ID NO: 1410663 - protein, 5 aa, Mycobacterium tuberculosis
KPEAI

SEQ ID NO: 1410664 - protein, 8 aa, Mycobacterium tuberculosis
KPEDREAI

SEQ ID NO: 1410665 - protein, 7 aa, Mycobacterium tuberculosis
KPEERSV

SEQ ID NO: 1410666 - protein, 7 aa, Mycobacterium tuberculosis
KPELDRD

SEQ ID NO: 1410667 - protein, 5 aa, Mycobacterium tuberculosis
KPFGL

SEQ ID NO: 1410668 - protein, 6 aa, Mycobacterium tuberculosis
KPGALD

SEQ ID NO: 1410669 - protein, 9 aa, Mycobacterium tuberculosis
KPGEPGDSG

SEQ ID NO: 1410670 - protein, 7 aa, Mycobacterium tuberculosis
KPGKEGH

SEQ ID NO: 1410671 - protein, 10 aa, Mycobacterium tuberculosis
KPGSRDDASE

SEQ ID NO: 1410672 - protein, 15 aa, Mycobacterium tuberculosis
KPHGVATGSSTGPRY

SEQ ID NO: 1410673 - protein, 11 aa, Mycobacterium tuberculosis
KPKGQKSSFGP

SEQ ID NO: 1410674 - protein, 8 aa, Mycobacterium tuberculosis
KPNVGKSS

SEQ ID NO: 1410675 - protein, 5 aa, Mycobacterium tuberculosis
KPTRA

SEQ ID NO: 1410676 - protein, 9 aa, Mycobacterium tuberculosis
KPVQPHDPD

SEQ ID NO: 1410677 - protein, 9 aa, Mycobacterium tuberculosis
KQSGGHGQY

SEQ ID NO: 1410678 - protein, 6 aa, Mycobacterium tuberculosis
KQTELQ

SEQ ID NO: 1410679 - protein, 9 aa, Mycobacterium tuberculosis
KRDSDAASL

SEQ ID NO: 1410680 - protein, 4 aa, Mycobacterium tuberculosis
KREE

SEQ ID NO: 1410681 - protein, 20 aa, Mycobacterium tuberculosis
KRGERQPQPRLPIVEHALPD

SEQ ID NO: 1410682 - protein, 6 aa, Mycobacterium tuberculosis
KRGPGI

SEQ ID NO: 1410683 - protein, 7 aa, Mycobacterium tuberculosis
KRLGGDD

SEQ ID NO: 1410684 - protein, 6 aa, Mycobacterium tuberculosis
KRPYDE

SEQ ID NO: 1410685 - protein, 5 aa, Mycobacterium tuberculosis
KRVPG

SEQ ID NO: 1410686 - protein, 8 aa, Mycobacterium tuberculosis
KSGFGPEY

SEQ ID NO: 1410687 - protein, 6 aa, Mycobacterium tuberculosis
KSQVGA

SEQ ID NO: 1410688 - protein, 8 aa, Mycobacterium tuberculosis
KSSGESVA

SEQ ID NO: 1410689 - protein, 10 aa, Mycobacterium tuberculosis
KTAPAGAGGT

SEQ ID NO: 1410690 - protein, 12 aa, Mycobacterium tuberculosis
KTAVPPPAEGDE

SEQ ID NO: 1410691 - protein, 8 aa, Mycobacterium tuberculosis
KTGTDPYQ

SEQ ID NO: 1410692 - protein, 6 aa, Mycobacterium tuberculosis
KTHPKV

SEQ ID NO: 1410693 - protein, 8 aa, Mycobacterium tuberculosis
KTNTPRNF

SEQ ID NO: 1410694 - protein, 10 aa, Mycobacterium tuberculosis
KTQSGPAAVN

SEQ ID NO: 1410695 - protein, 4 aa, Mycobacterium tuberculosis
KVPT

SEQ ID NO: 1410696 - protein, 13 aa, Mycobacterium tuberculosis
KVSKDDVGNPVAA

SEQ ID NO: 1410697 - protein, 6 aa, Mycobacterium tuberculosis
KWGQRG

SEQ ID NO: 1410698 - protein, 4 aa, Mycobacterium tuberculosis
KYGK

SEQ ID NO: 1410699 - protein, 9 aa, Mycobacterium tuberculosis
KYKETSAGG

SEQ ID NO: 1410700 - protein, 12 aa, Mycobacterium tuberculosis
LAAKSDDTNARV

SEQ ID NO: 1410701 - protein, 11 aa, Mycobacterium tuberculosis
LAARRGDVERG

SEQ ID NO: 1410702 - protein, 5 aa, Mycobacterium tuberculosis
LAATR

SEQ ID NO: 1410703 - protein, 7 aa, Mycobacterium tuberculosis
LAGERRE

SEQ ID NO: 1410704 - protein, 9 aa, Mycobacterium tuberculosis
LAPGQPGPV

SEQ ID NO: 1410705 - protein, 10 aa, Mycobacterium tuberculosis
LASEKKCGHL

SEQ ID NO: 1410706 - protein, 13 aa, Mycobacterium tuberculosis
LATDPQARQRRER

SEQ ID NO: 1410707 - protein, 6 aa, Mycobacterium tuberculosis
LATEPD

SEQ ID NO: 1410708 - protein, 4 aa, Mycobacterium tuberculosis
LATQ

SEQ ID NO: 1410709 - protein, 4 aa, Mycobacterium tuberculosis
LDDE

SEQ ID NO: 1410710 - protein, 9 aa, Mycobacterium tuberculosis
LDDSDSPIA

SEQ ID NO: 1410711 - protein, 8 aa, Mycobacterium tuberculosis
LDGGTGKM

SEQ ID NO: 1410712 - protein, 5 aa, Mycobacterium tuberculosis
LDGTE

SEQ ID NO: 1410713 - protein, 9 aa, Mycobacterium tuberculosis
LDKPPGVAE

SEQ ID NO: 1410714 - protein, 13 aa, Mycobacterium tuberculosis
LDPANSREAPRAA

SEQ ID NO: 1410715 - protein, 5 aa, Mycobacterium tuberculosis
LDPND

SEQ ID NO: 1410716 - protein, 6 aa, Mycobacterium tuberculosis
LDPTAY

SEQ ID NO: 1410717 - protein, 10 aa, Mycobacterium tuberculosis
LDSDSARPRL

SEQ ID NO: 1410718 - protein, 16 aa, Mycobacterium tuberculosis
LDSEGKPLFTLWKDYK

SEQ ID NO: 1410719 - protein, 12 aa, Mycobacterium tuberculosis
LDSRDQGAADRR

SEQ ID NO: 1410720 - protein, 6 aa, Mycobacterium tuberculosis
LDTPAS

SEQ ID NO: 1410721 - protein, 6 aa, Mycobacterium tuberculosis
LDTSPL

SEQ ID NO: 1410722 - protein, 7 aa, Mycobacterium tuberculosis
LEATPRP

SEQ ID NO: 1410723 - protein, 5 aa, Mycobacterium tuberculosis
LEGAG

SEQ ID NO: 1410724 - protein, 9 aa, Mycobacterium tuberculosis
LEGGPRPTH

SEQ ID NO: 1410725 - protein, 8 aa, Mycobacterium tuberculosis
LENRPGGV

SEQ ID NO: 1410726 - protein, 23 aa, Mycobacterium tuberculosis
LEPQAAPAPFEPPTAGSSLPTRI

SEQ ID NO: 1410727 - protein, 9 aa, Mycobacterium tuberculosis
LESASPALK

SEQ ID NO: 1410728 - protein, 5 aa, Mycobacterium tuberculosis
LESQG

SEQ ID NO: 1410729 - protein, 20 aa, Mycobacterium tuberculosis
LGAGGTGKGTGAALRGATGA

SEQ ID NO: 1410730 - protein, 6 aa, Mycobacterium tuberculosis
LGARPS

SEQ ID NO: 1410731 - protein, 4 aa, Mycobacterium tuberculosis
LGGG

SEQ ID NO: 1410732 - protein, 6 aa, Mycobacterium tuberculosis
LGHRPS

SEQ ID NO: 1410733 - protein, 11 aa, Mycobacterium tuberculosis
LGNGISSTAYD

SEQ ID NO: 1410734 - protein, 19 aa, Mycobacterium tuberculosis
LGPAPLSADVPERHFDFGS

SEQ ID NO: 1410735 - protein, 6 aa, Mycobacterium tuberculosis
LGPGTQ

SEQ ID NO: 1410736 - protein, 7 aa, Mycobacterium tuberculosis
LGRSEGA

SEQ ID NO: 1410737 - protein, 11 aa, Mycobacterium tuberculosis
LGSKSDSAGDV

SEQ ID NO: 1410738 - protein, 11 aa, Mycobacterium tuberculosis
LGSNNAGFGNT

SEQ ID NO: 1410739 - protein, 9 aa, Mycobacterium tuberculosis
LGSTSRAPR

SEQ ID NO: 1410740 - protein, 7 aa, Mycobacterium tuberculosis
LGTPEPI

SEQ ID NO: 1410741 - protein, 15 aa, Mycobacterium tuberculosis
LHPDANPGNPAAGER

SEQ ID NO: 1410742 - protein, 5 aa, Mycobacterium tuberculosis
LKRGQ

SEQ ID NO: 1410743 - protein, 24 aa, Mycobacterium tuberculosis
LLPDTGEDSDEDGHNHGGHSHGGH

SEQ ID NO: 1410744 - protein, 25 aa, Mycobacterium tuberculosis
LNGDPKVDDGPSSDANLSAPLTPQQ

SEQ ID NO: 1410745 - protein, 8 aa, Mycobacterium tuberculosis
LNPAEDNQ

SEQ ID NO: 1410746 - protein, 5 aa, Mycobacterium tuberculosis
LNPDS

SEQ ID NO: 1410747 - protein, 7 aa, Mycobacterium tuberculosis
LNPQQRQ

SEQ ID NO: 1410748 - protein, 17 aa, Mycobacterium tuberculosis
LNSGSGNIGFGNSGTGN

SEQ ID NO: 1410749 - protein, 12 aa, Mycobacterium tuberculosis
LNTAETGQRAAG

SEQ ID NO: 1410750 - protein, 5 aa, Mycobacterium tuberculosis
LPAAG

SEQ ID NO: 1410751 - protein, 7 aa, Mycobacterium tuberculosis
LPADGTR

SEQ ID NO: 1410752 - protein, 9 aa, Mycobacterium tuberculosis
LPASPAKAV

SEQ ID NO: 1410753 - protein, 4 aa, Mycobacterium tuberculosis
LPAY

SEQ ID NO: 1410754 - protein, 5 aa, Mycobacterium tuberculosis
LPDGL

SEQ ID NO: 1410755 - protein, 5 aa, Mycobacterium tuberculosis
LPDGW

SEQ ID NO: 1410756 - protein, 6 aa, Mycobacterium tuberculosis
LPDRQR

SEQ ID NO: 1410757 - protein, 6 aa, Mycobacterium tuberculosis
LPEEPE

SEQ ID NO: 1410758 - protein, 6 aa, Mycobacterium tuberculosis
LPGGQG

SEQ ID NO: 1410759 - protein, 19 aa, Mycobacterium tuberculosis
LPGPAGRSKPIEPSPYLPT

SEQ ID NO: 1410760 - protein, 11 aa, Mycobacterium tuberculosis
LPGSESEKMGP

SEQ ID NO: 1410761 - protein, 12 aa, Mycobacterium tuberculosis
LPPAKSQITWED

SEQ ID NO: 1410762 - protein, 5 aa, Mycobacterium tuberculosis
LPPDA

SEQ ID NO: 1410763 - protein, 8 aa, Mycobacterium tuberculosis
LPQGNNPV

SEQ ID NO: 1410764 - protein, 6 aa, Mycobacterium tuberculosis
LPRQPQ

SEQ ID NO: 1410765 - protein, 8 aa, Mycobacterium tuberculosis
LPSPLPPT

SEQ ID NO: 1410766 - protein, 6 aa, Mycobacterium tuberculosis
LPWPDP

SEQ ID NO: 1410767 - protein, 22 aa, Mycobacterium tuberculosis
LQGAGSSSGMTVTPQARAADSD

SEQ ID NO: 1410768 - protein, 11 aa, Mycobacterium tuberculosis
LQRAQETAAPI

SEQ ID NO: 1410769 - protein, 6 aa, Mycobacterium tuberculosis
LRADGR

SEQ ID NO: 1410770 - protein, 7 aa, Mycobacterium tuberculosis
LRDNGQT

SEQ ID NO: 1410771 - protein, 6 aa, Mycobacterium tuberculosis
LRGNPT

SEQ ID NO: 1410772 - protein, 6 aa, Mycobacterium tuberculosis
LRGQGR

SEQ ID NO: 1410773 - protein, 6 aa, Mycobacterium tuberculosis
LRPEAG

SEQ ID NO: 1410774 - protein, 7 aa, Mycobacterium tuberculosis
LRRQESG

SEQ ID NO: 1410775 - protein, 6 aa, Mycobacterium tuberculosis
LSDAGR

SEQ ID NO: 1410776 - protein, 8 aa, Mycobacterium tuberculosis
LSDGTPAP

SEQ ID NO: 1410777 - protein, 12 aa, Mycobacterium tuberculosis
LSEAGGGGGDPY

SEQ ID NO: 1410778 - protein, 9 aa, Mycobacterium tuberculosis
LSEAGSRAE

SEQ ID NO: 1410779 - protein, 13 aa, Mycobacterium tuberculosis
LSGDPNTAATPIG

SEQ ID NO: 1410780 - protein, 6 aa, Mycobacterium tuberculosis
LSGQGG

SEQ ID NO: 1410781 - protein, 7 aa, Mycobacterium tuberculosis
LSGSPDV

SEQ ID NO: 1410782 - protein, 7 aa, Mycobacterium tuberculosis
LSMGSSA

SEQ ID NO: 1410783 - protein, 5 aa, Mycobacterium tuberculosis
LSPDE

SEQ ID NO: 1410784 - protein, 20 aa, Mycobacterium tuberculosis
LSRARGAAAEALTGYREPKP

SEQ ID NO: 1410785 - protein, 9 aa, Mycobacterium tuberculosis
LSRQSDGSW

SEQ ID NO: 1410786 - protein, 8 aa, Mycobacterium tuberculosis
LSTPQARD

SEQ ID NO: 1410787 - protein, 11 aa, Mycobacterium tuberculosis
LSTSLDDAGPW

SEQ ID NO: 1410788 - protein, 9 aa, Mycobacterium tuberculosis
LSTTTDNRQ

SEQ ID NO: 1410789 - protein, 6 aa, Mycobacterium tuberculosis
LTDEDA

SEQ ID NO: 1410790 - protein, 15 aa, Mycobacterium tuberculosis
LTGGKEPNKGVNPDE

SEQ ID NO: 1410791 - protein, 9 aa, Mycobacterium tuberculosis
LTGSRTTAA

SEQ ID NO: 1410792 - protein, 5 aa, Mycobacterium tuberculosis
LTREG

SEQ ID NO: 1410793 - protein, 7 aa, Mycobacterium tuberculosis
LTSDPVP

SEQ ID NO: 1410794 - protein, 7 aa, Mycobacterium tuberculosis
LTSGYSP

SEQ ID NO: 1410795 - protein, 6 aa, Mycobacterium tuberculosis
LTTTAE

SEQ ID NO: 1410796 - protein, 7 aa, Mycobacterium tuberculosis
MAEGPGS

SEQ ID NO: 1410797 - protein, 9 aa, Mycobacterium tuberculosis
MAGDDPAGA

SEQ ID NO: 1410798 - protein, 9 aa, Mycobacterium tuberculosis
MAGKAGTFN

SEQ ID NO: 1410799 - protein, 11 aa, Mycobacterium tuberculosis
MGPGTKLPTLG

SEQ ID NO: 1410800 - protein, 10 aa, Mycobacterium tuberculosis
MGPTGSGKTT

SEQ ID NO: 1410801 - protein, 10 aa, Mycobacterium tuberculosis
MGSKRSTERM

SEQ ID NO: 1410802 - protein, 5 aa, Mycobacterium tuberculosis
MHGPA

SEQ ID NO: 1410803 - protein, 47 aa, Mycobacterium tuberculosis; identical to SEQ ID NO: 180906

SEQ ID NO: 1410804 - protein, 8 aa, Mycobacterium tuberculosis
MPHTSPPP

SEQ ID NO: 1410805 - protein, 16 aa, Mycobacterium tuberculosis
MPPDEEWPRSTVSEQT

SEQ ID NO: 1410806 - protein, 6 aa, Mycobacterium tuberculosis
MPTRED

SEQ ID NO: 1410807 - protein, 6 aa, Mycobacterium tuberculosis
MQGHSD

SEQ ID NO: 1410808 - protein, 9 aa, Mycobacterium tuberculosis
MRAPDPAEI

SEQ ID NO: 1410809 - protein, 7 aa, Mycobacterium tuberculosis
MRTAGDD

SEQ ID NO: 1410810 - protein, 18 aa, Mycobacterium tuberculosis
MSEPIGAAGGAHAGDRGN

SEQ ID NO: 1410811 - protein, 6 aa, Mycobacterium tuberculosis
MSPARK

SEQ ID NO: 1410812 - protein, 8 aa, Mycobacterium tuberculosis
NAAAAGPT

SEQ ID NO: 1410813 - protein, 20 aa, Mycobacterium tuberculosis
NAATTRAKDKGRGMQTTSRQ

SEQ ID NO: 1410814 - protein, 6 aa, Mycobacterium tuberculosis
NADDAT

SEQ ID NO: 1410815 - protein, 4 aa, Mycobacterium tuberculosis
NAEE

SEQ ID NO: 1410816 - protein, 6 aa, Mycobacterium tuberculosis
NAGDFN

SEQ ID NO: 1410817 - protein, 24 aa, Mycobacterium tuberculosis
NAGGLGPTQGHPLSSATDEPEPHW

SEQ ID NO: 1410818 - protein, 7 aa, Mycobacterium tuberculosis
NAGLREG

SEQ ID NO: 1410819 - protein, 7 aa, Mycobacterium tuberculosis
NALGGPG

SEQ ID NO: 1410820 - protein, 120 aa, Mycobacterium tuberculosis; identical to SEQ ID NO: 181058

SEQ ID NO: 1410821 - protein, 19 aa, Mycobacterium tuberculosis
NANLGNGNIGNANLGSGNA

SEQ ID NO: 1410822 - protein, 6 aa, Mycobacterium tuberculosis
NARSRR

SEQ ID NO: 1410823 - protein, 12 aa, Mycobacterium tuberculosis
NATAAAENDSAE

SEQ ID NO: 1410824 - protein, 7 aa, Mycobacterium tuberculosis
NDDAAES

SEQ ID NO: 1410825 - protein, 4 aa, Mycobacterium tuberculosis
NDGI

SEQ ID NO: 1410826 - protein, 9 aa, Mycobacterium tuberculosis
NDRNAAAAE

SEQ ID NO: 1410827 - protein, 6 aa, Mycobacterium tuberculosis
NEAGSV

SEQ ID NO: 1410828 - protein, 9 aa, Mycobacterium tuberculosis
NEANTEPLA

SEQ ID NO: 1410829 - protein, 9 aa, Mycobacterium tuberculosis
NEDGQYAYY

SEQ ID NO: 1410830 - protein, 10 aa, Mycobacterium tuberculosis
NEENASGGRV

SEQ ID NO: 1410831 - protein, 6 aa, Mycobacterium tuberculosis
NERGVD

SEQ ID NO: 1410832 - protein, 6 aa, Mycobacterium tuberculosis
NESPSI

SEQ ID NO: 1410833 - protein, 11 aa, Mycobacterium tuberculosis
NFGHTQSAAGA

SEQ ID NO: 1410834 - protein, 6 aa, Mycobacterium tuberculosis
NGERTG

SEQ ID NO: 1410835 - protein, 15 aa, Mycobacterium tuberculosis
NGGAGGNGATGGTGV

SEQ ID NO: 1410836 - protein, 39 aa, Mycobacterium tuberculosis; identical to SEQ ID NO: 181340

SEQ ID NO: 1410837 - protein, 6 aa, Mycobacterium tuberculosis
NGGPGV

SEQ ID NO: 1410838 - protein, 21 aa, Mycobacterium tuberculosis
NGGQGGDSGAGGGTDSTQTGV

SEQ ID NO: 1410839 - protein, 5 aa, Mycobacterium tuberculosis
NGGWG

SEQ ID NO: 1410840 - protein, 13 aa, Mycobacterium tuberculosis
NGNDGNTNFGSGN

SEQ ID NO: 1410841 - protein, 9 aa, Mycobacterium tuberculosis
NGPDESGVR

SEQ ID NO: 1410842 - protein, 9 aa, Mycobacterium tuberculosis
NGPGDPATA

SEQ ID NO: 1410843 - protein, 14 aa, Mycobacterium tuberculosis
NGPIKGTSNFGVFR

SEQ ID NO: 1410844 - protein, 37 aa, Mycobacterium tuberculosis; identical to SEQ ID NO: 181374

SEQ ID NO: 1410845 - protein, 10 aa, Mycobacterium tuberculosis
NGQSTSESRA

SEQ ID NO: 1410846 - protein, 9 aa, Mycobacterium tuberculosis
NGRDSAAQR

SEQ ID NO: 1410847 - protein, 8 aa, Mycobacterium tuberculosis
NGTDRRKR

SEQ ID NO: 1410848 - protein, 7 aa, Mycobacterium tuberculosis
NGTGGHL

SEQ ID NO: 1410849 - protein, 12 aa, Mycobacterium tuberculosis
NGVNGGAGSAVS

SEQ ID NO: 1410850 - protein, 8 aa, Mycobacterium tuberculosis
NHHSAGSF

SEQ ID NO: 1410851 - protein, 17 aa, Mycobacterium tuberculosis
NIAQDGKGYASGTQLGE

SEQ ID NO: 1410852 - protein, 6 aa, Mycobacterium tuberculosis
NIPQED

SEQ ID NO: 1410853 - protein, 4 aa, Mycobacterium tuberculosis
NNAE

SEQ ID NO: 1410854 - protein, 4 aa, Mycobacterium tuberculosis
NNER

SEQ ID NO: 1410855 - protein, 7 aa, Mycobacterium tuberculosis
NNSSRSL

SEQ ID NO: 1410856 - protein, 5 aa, Mycobacterium tuberculosis
NPAGW

SEQ ID NO: 1410857 - protein, 11 aa, Mycobacterium tuberculosis
NPDCAAEGRPV

SEQ ID NO: 1410858 - protein, 10 aa, Mycobacterium tuberculosis
NPDRRHGAER

SEQ ID NO: 1410859 - protein, 6 aa, Mycobacterium tuberculosis
NPGDAV

SEQ ID NO: 1410860 - protein, 6 aa, Mycobacterium tuberculosis
NPPRTV

SEQ ID NO: 1410861 - protein, 7 aa, Mycobacterium tuberculosis
NPRASRT

SEQ ID NO: 1410862 - protein, 12 aa, Mycobacterium tuberculosis
NPSEITDTRMVH

SEQ ID NO: 1410863 - protein, 9 aa, Mycobacterium tuberculosis
NPSIAADPA

SEQ ID NO: 1410864 - protein, 5 aa, Mycobacterium tuberculosis
NPTSI

SEQ ID NO: 1410865 - protein, 4 aa, Mycobacterium tuberculosis
NPVG

SEQ ID NO: 1410866 - protein, 16 aa, Mycobacterium tuberculosis
NQAANKKSALAQALNK

SEQ ID NO: 1410867 - protein, 8 aa, Mycobacterium tuberculosis
NQGGLNAG

SEQ ID NO: 1410868 - protein, 4 aa, Mycobacterium tuberculosis
NQRR

SEQ ID NO: 1410869 - protein, 9 aa, Mycobacterium tuberculosis
NQTPESARE

SEQ ID NO: 1410870 - protein, 10 aa, Mycobacterium tuberculosis
NRDDLPEQYR

SEQ ID NO: 1410871 - protein, 10 aa, Mycobacterium tuberculosis
NRDPAQFEAP

SEQ ID NO: 1410872 - protein, 17 aa, Mycobacterium tuberculosis
NRENGEHPINDSAEVQR

SEQ ID NO: 1410873 - protein, 8 aa, Mycobacterium tuberculosis
NRLRTKDS

SEQ ID NO: 1410874 - protein, 5 aa, Mycobacterium tuberculosis
NRPNH

SEQ ID NO: 1410875 - protein, 7 aa, Mycobacterium tuberculosis
NRTGPSV

SEQ ID NO: 1410876 - protein, 6 aa, Mycobacterium tuberculosis
NRYDGR

SEQ ID NO: 1410877 - protein, 10 aa, Mycobacterium tuberculosis
NSEGSRTTPS

SEQ ID NO: 1410878 - protein, 10 aa, Mycobacterium tuberculosis
NSGANNSGFF

SEQ ID NO: 1410879 - protein, 49 aa, Mycobacterium tuberculosis; identical to SEQ ID NO: 181753

SEQ ID NO: 1410880 - protein, 6 aa, Mycobacterium tuberculosis
NSGNTV

SEQ ID NO: 1410881 - protein, 15 aa, Mycobacterium tuberculosis
NSKHNSGGLNWPFTG

SEQ ID NO: 1410882 - protein, 6 aa, Mycobacterium tuberculosis
NSLPGQ

SEQ ID NO: 1410883 - protein, 11 aa, Mycobacterium tuberculosis
NSPESVAPHGQ

SEQ ID NO: 1410884 - protein, 9 aa, Mycobacterium tuberculosis
NSQSGKGGV

SEQ ID NO: 1410885 - protein, 11 aa, Mycobacterium tuberculosis
NSRSGKRDGKR

SEQ ID NO: 1410886 - protein, 16 aa, Mycobacterium tuberculosis
NSTGHGRPERGSRTRH

SEQ ID NO: 1410887 - protein, 6 aa, Mycobacterium tuberculosis
NSTRTR

SEQ ID NO: 1410888 - protein, 13 aa, Mycobacterium tuberculosis
NTDDDPNRQSRRA

SEQ ID NO: 1410889 - protein, 12 aa, Mycobacterium tuberculosis
NTGFGSAGNGNV

SEQ ID NO: 1410890 - protein, 7 aa, Mycobacterium tuberculosis
NTGNNNI

SEQ ID NO: 1410891 - protein, 5 aa, Mycobacterium tuberculosis
NTGVG

SEQ ID NO: 1410892 - protein, 13 aa, Mycobacterium tuberculosis
NTSTSDLATPAFN

SEQ ID NO: 1410893 - protein, 12 aa, Mycobacterium tuberculosis
NTSTSNLATPAF

SEQ ID NO: 1410894 - protein, 6 aa, Mycobacterium tuberculosis
NVGSDS

SEQ ID NO: 1410895 - protein, 9 aa, Mycobacterium tuberculosis
NYGETTEAF

SEQ ID NO: 1410896 - protein, 9 aa, Mycobacterium tuberculosis
NYGVPDNET

SEQ ID NO: 1410897 - protein, 10 aa, Mycobacterium tuberculosis
NYGVPDNETD

SEQ ID NO: 1410898 - protein, 5 aa, Mycobacterium tuberculosis
NYSGI

SEQ ID NO: 1410899 - protein, 7 aa, Mycobacterium tuberculosis
PAAAEVN

SEQ ID NO: 1410900 - protein, 12 aa, Mycobacterium tuberculosis
PAAARAAAQERP

SEQ ID NO: 1410901 - protein, 5 aa, Mycobacterium tuberculosis
PAAES

SEQ ID NO: 1410902 - protein, 5 aa, Mycobacterium tuberculosis
PAAGL

SEQ ID NO: 1410903 - protein, 10 aa, Mycobacterium tuberculosis
PAAGQRTAQR

SEQ ID NO: 1410904 - protein, 4 aa, Mycobacterium tuberculosis
PAAL

SEQ ID NO: 1410905 - protein, 6 aa, Mycobacterium tuberculosis
PAELTE

SEQ ID NO: 1410906 - protein, 14 aa, Mycobacterium tuberculosis
PAFRPNGTVTAGNA

SEQ ID NO: 1410907 - protein, 6 aa, Mycobacterium tuberculosis
PAFSSV

SEQ ID NO: 1410908 - protein, 5 aa, Mycobacterium tuberculosis
PAGYE

SEQ ID NO: 1410909 - protein, 13 aa, Mycobacterium tuberculosis
PAGYGGRSNGGRR

SEQ ID NO: 1410910 - protein, 5 aa, Mycobacterium tuberculosis
PAKAR

SEQ ID NO: 1410911 - protein, 8 aa, Mycobacterium tuberculosis
PAKPTDRA

SEQ ID NO: 1410912 - protein, 6 aa, Mycobacterium tuberculosis
PAKTIE

SEQ ID NO: 1410913 - protein, 5 aa, Mycobacterium tuberculosis
PALSS

SEQ ID NO: 1410914 - protein, 10 aa, Mycobacterium tuberculosis
PANSEPRTGL

SEQ ID NO: 1410915 - protein, 5 aa, Mycobacterium tuberculosis
PAPER

SEQ ID NO: 1410916 - protein, 6 aa, Mycobacterium tuberculosis
PAPGSM

SEQ ID NO: 1410917 - protein, 12 aa, Mycobacterium tuberculosis
PAPLPPSGSARA

SEQ ID NO: 1410918 - protein, 9 aa, Mycobacterium tuberculosis
PARDGPPDI

SEQ ID NO: 1410919 - protein, 9 aa, Mycobacterium tuberculosis
PASAAGPDL

SEQ ID NO: 1410920 - protein, 9 aa, Mycobacterium tuberculosis
PASARTGSR

SEQ ID NO: 1410921 - protein, 19 aa, Mycobacterium tuberculosis
PASATPAAVTDAATAAGQA

SEQ ID NO: 1410922 - protein, 9 aa, Mycobacterium tuberculosis
PASEYGTKA

SEQ ID NO: 1410923 - protein, 10 aa, Mycobacterium tuberculosis
PASNSRVPPL

SEQ ID NO: 1410924 - protein, 61 aa, Mycobacterium tuberculosis; identical to SEQ ID NO: 182149

SEQ ID NO: 1410925 - protein, 6 aa, Mycobacterium tuberculosis
PATLPK

SEQ ID NO: 1410926 - protein, 12 aa, Mycobacterium tuberculosis
PAVGRSGKAPNV

SEQ ID NO: 1410927 - protein, 8 aa, Mycobacterium tuberculosis
PCAPADPQ

SEQ ID NO: 1410928 - protein, 4 aa, Mycobacterium tuberculosis
PCEP

SEQ ID NO: 1410929 - protein, 16 aa, Mycobacterium tuberculosis
PDAASRGVVDAPEDAL

SEQ ID NO: 1410930 - protein, 5 aa, Mycobacterium tuberculosis
PDGSW

SEQ ID NO: 1410931 - protein, 19 aa, Mycobacterium tuberculosis
PDHTAGRAAVGAAPPADAL

SEQ ID NO: 1410932 - protein, 5 aa, Mycobacterium tuberculosis
PDNPE

SEQ ID NO: 1410933 - protein, 8 aa, Mycobacterium tuberculosis
PDPGPGEA

SEQ ID NO: 1410934 - protein, 9 aa, Mycobacterium tuberculosis
PDQTGTPRR

SEQ ID NO: 1410935 - protein, 15 aa, Mycobacterium tuberculosis
PDSATDETTEEDEVG

SEQ ID NO: 1410936 - protein, 6 aa, Mycobacterium tuberculosis
PDSGRV

SEQ ID NO: 1410937 - protein, 7 aa, Mycobacterium tuberculosis
PDSMPAD

SEQ ID NO: 1410938 - protein, 6 aa, Mycobacterium tuberculosis
PDVAQD

SEQ ID NO: 1410939 - protein, 9 aa, Mycobacterium tuberculosis
PDWPTGPLP

SEQ ID NO: 1410940 - protein, 10 aa, Mycobacterium tuberculosis
PEAAAGPHDA

SEQ ID NO: 1410941 - protein, 8 aa, Mycobacterium tuberculosis
PEDKPKPW

SEQ ID NO: 1410942 - protein, 7 aa, Mycobacterium tuberculosis
PEFPDRP

SEQ ID NO: 1410943 - protein, 10 aa, Mycobacterium tuberculosis
PEGGAGGGTV

SEQ ID NO: 1410944 - protein, 7 aa, Mycobacterium tuberculosis
PEMPDGS

SEQ ID NO: 1410945 - protein, 8 aa, Mycobacterium tuberculosis
PEPAAPTE

SEQ ID NO: 1410946 - protein, 11 aa, Mycobacterium tuberculosis
PEPGSGKSRAL

SEQ ID NO: 1410947 - protein, 6 aa, Mycobacterium tuberculosis
PEPNPG

SEQ ID NO: 1410948 - protein, 4 aa, Mycobacterium tuberculosis
PEPV

SEQ ID NO: 1410949 - protein, 7 aa, Mycobacterium tuberculosis
PEPYPTR

SEQ ID NO: 1410950 - protein, 4 aa, Mycobacterium tuberculosis
PEQI

SEQ ID NO: 1410951 - protein, 6 aa, Mycobacterium tuberculosis
PETTEA

SEQ ID NO: 1410952 - protein, 11 aa, Mycobacterium tuberculosis
PETVSTDYDTA

SEQ ID NO: 1410953 - protein, 4 aa, Mycobacterium tuberculosis
PEVY

SEQ ID NO: 1410954 - protein, 12 aa, Mycobacterium tuberculosis
PEYGPASPGAGF

SEQ ID NO: 1410955 - protein, 6 aa, Mycobacterium tuberculosis
PFAGAT

SEQ ID NO: 1410956 - protein, 8 aa, Mycobacterium tuberculosis
PFDPRPPM

SEQ ID NO: 1410957 - protein, 6 aa, Mycobacterium tuberculosis
PFGAAG

SEQ ID NO: 1410958 - protein, 4 aa, Mycobacterium tuberculosis
PFST

SEQ ID NO: 1410959 - protein, 12 aa, Mycobacterium tuberculosis
PGAAEPGADGAG

SEQ ID NO: 1410960 - protein, 10 aa, Mycobacterium tuberculosis
PGADPTLTTT

SEQ ID NO: 1410961 - protein, 4 aa, Mycobacterium tuberculosis
PGCG

SEQ ID NO: 1410962 - protein, 8 aa, Mycobacterium tuberculosis
PGDPSLDA

SEQ ID NO: 1410963 - protein, 9 aa, Mycobacterium tuberculosis
PGDRRAARA

SEQ ID NO: 1410964 - protein, 8 aa, Mycobacterium tuberculosis
PGETEEDF

SEQ ID NO: 1410965 - protein, 5 aa, Mycobacterium tuberculosis
PGGMS

SEQ ID NO: 1410966 - protein, 6 aa, Mycobacterium tuberculosis
PGGSPL

SEQ ID NO: 1410967 - protein, 9 aa, Mycobacterium tuberculosis
PGGSSTPLL

SEQ ID NO: 1410968 - protein, 6 aa, Mycobacterium tuberculosis
PGHDKA

SEQ ID NO: 1410969 - protein, 7 aa, Mycobacterium tuberculosis
PGHSAAG

SEQ ID NO: 1410970 - protein, 6 aa, Mycobacterium tuberculosis
PGIGKA

SEQ ID NO: 1410971 - protein, 17 aa, Mycobacterium tuberculosis
PGLQAQREQLRAELART

SEQ ID NO: 1410972 - protein, 7 aa, Mycobacterium tuberculosis
PGMPQGV

SEQ ID NO: 1410973 - protein, 6 aa, Mycobacterium tuberculosis
PGRGPQ

SEQ ID NO: 1410974 - protein, 9 aa, Mycobacterium tuberculosis
PGRGTQPTA

SEQ ID NO: 1410975 - protein, 10 aa, Mycobacterium tuberculosis
PGVESNDGDA

SEQ ID NO: 1410976 - protein, 18 aa, Mycobacterium tuberculosis
PGVGSRPPLSTNARPEGV

SEQ ID NO: 1410977 - protein, 16 aa, Mycobacterium tuberculosis
PGVQVSSDAAAARSAA

SEQ ID NO: 1410978 - protein, 12 aa, Mycobacterium tuberculosis
PGVTPGDVRDAT

SEQ ID NO: 1410979 - protein, 10 aa, Mycobacterium tuberculosis
PHAPDTHSPL

SEQ ID NO: 1410980 - protein, 16 aa, Mycobacterium tuberculosis
PHTGGQKSVSASGDTL

SEQ ID NO: 1410981 - protein, 8 aa, Mycobacterium tuberculosis
PKADGGGA

SEQ ID NO: 1410982 - protein, 6 aa, Mycobacterium tuberculosis
PKATGA

SEQ ID NO: 1410983 - protein, 4 aa, Mycobacterium tuberculosis
PKAY

SEQ ID NO: 1410984 - protein, 7 aa, Mycobacterium tuberculosis
PKRRPLD

SEQ ID NO: 1410985 - protein, 7 aa, Mycobacterium tuberculosis
PLDPARR

SEQ ID NO: 1410986 - protein, 9 aa, Mycobacterium tuberculosis
PLPAPRVSP

SEQ ID NO: 1410987 - protein, 5 aa, Mycobacterium tuberculosis
PLPDG

SEQ ID NO: 1410988 - protein, 7 aa, Mycobacterium tuberculosis
PLPEGSG

SEQ ID NO: 1410989 - protein, 10 aa, Mycobacterium tuberculosis
PLRPGPPPTV

SEQ ID NO: 1410990 - protein, 9 aa, Mycobacterium tuberculosis
PLSAQEAQA

SEQ ID NO: 1410991 - protein, 9 aa, Mycobacterium tuberculosis
PLSGRAGGL

SEQ ID NO: 1410992 - protein, 12 aa, Mycobacterium tuberculosis
PLSPHPDDPIRM

SEQ ID NO: 1410993 - protein, 13 aa, Mycobacterium tuberculosis
PNGQTAGIPPPHL

SEQ ID NO: 1410994 - protein, 10 aa, Mycobacterium tuberculosis
PNNPTSTVVG

SEQ ID NO: 1410995 - protein, 13 aa, Mycobacterium tuberculosis
PPDNRPGQPPVGP

SEQ ID NO: 1410996 - protein, 10 aa, Mycobacterium tuberculosis
PPDPASRTTY

SEQ ID NO: 1410997 - protein, 5 aa, Mycobacterium tuberculosis
PPERR

SEQ ID NO: 1410998 - protein, 8 aa, Mycobacterium tuberculosis
PPGQSGQL

SEQ ID NO: 1410999 - protein, 11 aa, Mycobacterium tuberculosis
PPGSTLPPERD

SEQ ID NO: 1411000 - protein, 5 aa, Mycobacterium tuberculosis
PPGYG

SEQ ID NO: 1411001 - protein, 6 aa, Mycobacterium tuberculosis
PPHVTP

SEQ ID NO: 1411002 - protein, 6 aa, Mycobacterium tuberculosis
PPLPGP

SEQ ID NO: 1411003 - protein, 8 aa, Mycobacterium tuberculosis
PPLPPVPD

SEQ ID NO: 1411004 - protein, 5 aa, Mycobacterium tuberculosis
PPPDP

SEQ ID NO: 1411005 - protein, 6 aa, Mycobacterium tuberculosis
PPPEIA

SEQ ID NO: 1411006 - protein, 6 aa, Mycobacterium tuberculosis
PPPGTV

SEQ ID NO: 1411007 - protein, 6 aa, Mycobacterium tuberculosis
PPPTID

SEQ ID NO: 1411008 - protein, 4 aa, Mycobacterium tuberculosis
PPVG

SEQ ID NO: 1411009 - protein, 5 aa, Mycobacterium tuberculosis
PPYIP

SEQ ID NO: 1411010 - protein, 13 aa, Mycobacterium tuberculosis
PQFDEPSINSGGQ

SEQ ID NO: 1411011 - protein, 4 aa, Mycobacterium tuberculosis
PQPA

SEQ ID NO: 1411012 - protein, 7 aa, Mycobacterium tuberculosis
PQSAPGR

SEQ ID NO: 1411013 - protein, 7 aa, Mycobacterium tuberculosis
PQVETDS

SEQ ID NO: 1411014 - protein, 17 aa, Mycobacterium tuberculosis
PRARAGWDRATGRIPAD

SEQ ID NO: 1411015 - protein, 8 aa, Mycobacterium tuberculosis
PREGGNED

SEQ ID NO: 1411016 - protein, 9 aa, Mycobacterium tuberculosis
PRKIPPGTG

SEQ ID NO: 1411017 - protein, 19 aa, Mycobacterium tuberculosis
PRLGRGGGGQLRPGVWCTG

SEQ ID NO: 1411018 - protein, 6 aa, Mycobacterium tuberculosis
PRMSSD

SEQ ID NO: 1411019 - protein, 7 aa, Mycobacterium tuberculosis
PRPDGTP

SEQ ID NO: 1411020 - protein, 6 aa, Mycobacterium tuberculosis
PRPDRE

SEQ ID NO: 1411021 - protein, 7 aa, Mycobacterium tuberculosis
PRPGYGS

SEQ ID NO: 1411022 - protein, 9 aa, Mycobacterium tuberculosis
PRRGERDRD

SEQ ID NO: 1411023 - protein, 12 aa, Mycobacterium tuberculosis
PSAGSGGGATID

SEQ ID NO: 1411024 - protein, 7 aa, Mycobacterium tuberculosis
PSASQTD

SEQ ID NO: 1411025 - protein, 7 aa, Mycobacterium tuberculosis
PSATHRR

SEQ ID NO: 1411026 - protein, 7 aa, Mycobacterium tuberculosis
PSDPSGY

SEQ ID NO: 1411027 - protein, 6 aa, Mycobacterium tuberculosis
PSGTEP

SEQ ID NO: 1411028 - protein, 6 aa, Mycobacterium tuberculosis
PSNPMQ

SEQ ID NO: 1411029 - protein, 6 aa, Mycobacterium tuberculosis
PSPEPW

SEQ ID NO: 1411030 - protein, 5 aa, Mycobacterium tuberculosis
PSRST

SEQ ID NO: 1411031 - protein, 9 aa, Mycobacterium tuberculosis
PSYDPLDGN

SEQ ID NO: 1411032 - protein, 5 aa, Mycobacterium tuberculosis
PSYPA

SEQ ID NO: 1411033 - protein, 19 aa, Mycobacterium tuberculosis
PTAQAAPVPAEPADTETER

SEQ ID NO: 1411034 - protein, 4 aa, Mycobacterium tuberculosis
PTES

SEQ ID NO: 1411035 - protein, 20 aa, Mycobacterium tuberculosis
PTGDPPRPDPARADRRGQRT

SEQ ID NO: 1411036 - protein, 8 aa, Mycobacterium tuberculosis
PTGPAAEQ

SEQ ID NO: 1411037 - protein, 4 aa, Mycobacterium tuberculosis
PTLP

SEQ ID NO: 1411038 - protein, 7 aa, Mycobacterium tuberculosis
PTLPDDM

SEQ ID NO: 1411039 - protein, 13 aa, Mycobacterium tuberculosis
PTPKTAIDSDGTY

SEQ ID NO: 1411040 - protein, 5 aa, Mycobacterium tuberculosis
PTPRT

SEQ ID NO: 1411041 - protein, 12 aa, Mycobacterium tuberculosis
PTPSATATASTA

SEQ ID NO: 1411042 - protein, 5 aa, Mycobacterium tuberculosis
PTPTE

SEQ ID NO: 1411043 - protein, 6 aa, Mycobacterium tuberculosis
PTRAYG

SEQ ID NO: 1411044 - protein, 11 aa, Mycobacterium tuberculosis
PTREKAEAELA

SEQ ID NO: 1411045 - protein, 6 aa, Mycobacterium tuberculosis
PTRNGR

SEQ ID NO: 1411046 - protein, 5 aa, Mycobacterium tuberculosis
PVASP

SEQ ID NO: 1411047 - protein, 5 aa, Mycobacterium tuberculosis
PVGAR

SEQ ID NO: 1411048 - protein, 11 aa, Mycobacterium tuberculosis
PVGDDGVAQPT

SEQ ID NO: 1411049 - protein, 5 aa, Mycobacterium tuberculosis
PVGRP

SEQ ID NO: 1411050 - protein, 7 aa, Mycobacterium tuberculosis
PVNPSGG

SEQ ID NO: 1411051 - protein, 13 aa, Mycobacterium tuberculosis
PVPAGTEPGYRPS

SEQ ID NO: 1411052 - protein, 5 aa, Mycobacterium tuberculosis
PVPGP

SEQ ID NO: 1411053 - protein, 8 aa, Mycobacterium tuberculosis
PVSARSDA

SEQ ID NO: 1411054 - protein, 12 aa, Mycobacterium tuberculosis
PVSGGVKGAAAA

SEQ ID NO: 1411055 - protein, 10 aa, Mycobacterium tuberculosis
PVSTSDPLCD

SEQ ID NO: 1411056 - protein, 13 aa, Mycobacterium tuberculosis
PYSEPRHEQAASG

SEQ ID NO: 1411057 - protein, 20 aa, Mycobacterium tuberculosis
QAADDDVKEGDTKDETQDVA

SEQ ID NO: 1411058 - protein, 14 aa, Mycobacterium tuberculosis
QAAKSRSEQLRITP

SEQ ID NO: 1411059 - protein, 4 aa, Mycobacterium tuberculosis
QADG

SEQ ID NO: 1411060 - protein, 7 aa, Mycobacterium tuberculosis
QADGHPA

SEQ ID NO: 1411061 - protein, 8 aa, Mycobacterium tuberculosis
QADPAEDL

SEQ ID NO: 1411062 - protein, 10 aa, Mycobacterium tuberculosis
QADRTDTDEH

SEQ ID NO: 1411063 - protein, 7 aa, Mycobacterium tuberculosis
QAEQAAM

SEQ ID NO: 1411064 - protein, 8 aa, Mycobacterium tuberculosis
QAKSGSGF

SEQ ID NO: 1411065 - protein, 9 aa, Mycobacterium tuberculosis
QAMQAGQGA

SEQ ID NO: 1411066 - protein, 9 aa, Mycobacterium tuberculosis
QAQGADGLA

SEQ ID NO: 1411067 - protein, 8 aa, Mycobacterium tuberculosis
QARERGEQ

SEQ ID NO: 1411068 - protein, 4 aa, Mycobacterium tuberculosis
QARS

SEQ ID NO: 1411069 - protein, 6 aa, Mycobacterium tuberculosis
QASTDR

SEQ ID NO: 1411070 - protein, 11 aa, Mycobacterium tuberculosis
QATQQECEKRL

SEQ ID NO: 1411071 - protein, 5 aa, Mycobacterium tuberculosis
QDDTR

SEQ ID NO: 1411072 - protein, 9 aa, Mycobacterium tuberculosis
QDGYQDNSG

SEQ ID NO: 1411073 - protein, 8 aa, Mycobacterium tuberculosis
QDKHGTAY

SEQ ID NO: 1411074 - protein, 7 aa, Mycobacterium tuberculosis
QDNGPWG

SEQ ID NO: 1411075 - protein, 8 aa, Mycobacterium tuberculosis
QEARGLRE

SEQ ID NO: 1411076 - protein, 8 aa, Mycobacterium tuberculosis
QEGVSASA

SEQ ID NO: 1411077 - protein, 6 aa, Mycobacterium tuberculosis
QGGGIR

SEQ ID NO: 1411078 - protein, 8 aa, Mycobacterium tuberculosis
QGPGEVTA

SEQ ID NO: 1411079 - protein, 7 aa, Mycobacterium tuberculosis
QGPSAES

SEQ ID NO: 1411080 - protein, 6 aa, Mycobacterium tuberculosis
QGQKCS

SEQ ID NO: 1411081 - protein, 11 aa, Mycobacterium tuberculosis
QGRGDAAEQTI

SEQ ID NO: 1411082 - protein, 10 aa, Mycobacterium tuberculosis
QGSGKTTLAG

SEQ ID NO: 1411083 - protein, 10 aa, Mycobacterium tuberculosis
QGSTRTSERE

SEQ ID NO: 1411084 - protein, 17 aa, Mycobacterium tuberculosis
QHSGGEPPYKGYSRTQF

SEQ ID NO: 1411085 - protein, 11 aa, Mycobacterium tuberculosis
QIPPPGTGAPE

SEQ ID NO: 1411086 - protein, 9 aa, Mycobacterium tuberculosis
QKDEGSMAH

SEQ ID NO: 1411087 - protein, 6 aa, Mycobacterium tuberculosis
QKGEPV

SEQ ID NO: 1411088 - protein, 11 aa, Mycobacterium tuberculosis
QKMSKSLRNYP

SEQ ID NO: 1411089 - protein, 16 aa, Mycobacterium tuberculosis
QLATGSWQGPASAAMT

SEQ ID NO: 1411090 - protein, 6 aa, Mycobacterium tuberculosis
QLEENP

SEQ ID NO: 1411091 - protein, 6 aa, Mycobacterium tuberculosis
QLRGRN

SEQ ID NO: 1411092 - protein, 5 aa, Mycobacterium tuberculosis
QLTER

SEQ ID NO: 1411093 - protein, 15 aa, Mycobacterium tuberculosis
QNDPRSTYKFGPEDY

SEQ ID NO: 1411094 - protein, 5 aa, Mycobacterium tuberculosis
QNPRS

SEQ ID NO: 1411095 - protein, 5 aa, Mycobacterium tuberculosis
QNQET

SEQ ID NO: 1411096 - protein, 11 aa, Mycobacterium tuberculosis
QNWESGDPKKQ

SEQ ID NO: 1411097 - protein, 10 aa, Mycobacterium tuberculosis
QPAKNQAVTN

SEQ ID NO: 1411098 - protein, 6 aa, Mycobacterium tuberculosis
QPETGV

SEQ ID NO: 1411099 - protein, 20 aa, Mycobacterium tuberculosis
QPIAPGTPLTAPEYAEQTGL

SEQ ID NO: 1411100 - protein, 8 aa, Mycobacterium tuberculosis
QPISGPGE

SEQ ID NO: 1411101 - protein, 6 aa, Mycobacterium tuberculosis
QPLTEQ

SEQ ID NO: 1411102 - protein, 7 aa, Mycobacterium tuberculosis
QPPATPV

SEQ ID NO: 1411103 - protein, 12 aa, Mycobacterium tuberculosis
QPPVVPAPAPDA

SEQ ID NO: 1411104 - protein, 7 aa, Mycobacterium tuberculosis
QPQVAPA

SEQ ID NO: 1411105 - protein, 8 aa, Mycobacterium tuberculosis
QPTEQTRG

SEQ ID NO: 1411106 - protein, 18 aa, Mycobacterium tuberculosis
QQAIPGTPGGAGDSGSSV

SEQ ID NO: 1411107 - protein, 7 aa, Mycobacterium tuberculosis
QQLDPQA

SEQ ID NO: 1411108 - protein, 8 aa, Mycobacterium tuberculosis
QRDADDTV

SEQ ID NO: 1411109 - protein, 5 aa, Mycobacterium tuberculosis
QREYR

SEQ ID NO: 1411110 - protein, 4 aa, Mycobacterium tuberculosis
QRGK

SEQ ID NO: 1411111 - protein, 17 aa, Mycobacterium tuberculosis
QRHPGGTTTQTDAAAGV

SEQ ID NO: 1411112 - protein, 9 aa, Mycobacterium tuberculosis
QRIEKPDHT

SEQ ID NO: 1411113 - protein, 4 aa, Mycobacterium tuberculosis
QRNP

SEQ ID NO: 1411114 - protein, 6 aa, Mycobacterium tuberculosis
QRRPAD

SEQ ID NO: 1411115 - protein, 7 aa, Mycobacterium tuberculosis
QRRQASL

SEQ ID NO: 1411116 - protein, 14 aa, Mycobacterium tuberculosis
QRTREGEQDAAAAT

SEQ ID NO: 1411117 - protein, 6 aa, Mycobacterium tuberculosis
QSLAPA

SEQ ID NO: 1411118 - protein, 12 aa, Mycobacterium tuberculosis
QSLKRSKGQKLP

SEQ ID NO: 1411119 - protein, 6 aa, Mycobacterium tuberculosis
QSLPAR

SEQ ID NO: 1411120 - protein, 5 aa, Mycobacterium tuberculosis
QSSGM

SEQ ID NO: 1411121 - protein, 8 aa, Mycobacterium tuberculosis
QSTRGDGR

SEQ ID NO: 1411122 - protein, 5 aa, Mycobacterium tuberculosis
QSTRQ

SEQ ID NO: 1411123 - protein, 10 aa, Mycobacterium tuberculosis
QTAEDAVRNG

SEQ ID NO: 1411124 - protein, 11 aa, Mycobacterium tuberculosis
QTARRRGSRAH

SEQ ID NO: 1411125 - protein, 5 aa, Mycobacterium tuberculosis
QTARS

SEQ ID NO: 1411126 - protein, 16 aa, Mycobacterium tuberculosis
QTEAGTTSPTTSKSRT

SEQ ID NO: 1411127 - protein, 13 aa, Mycobacterium tuberculosis
QTFEGPYGNTGTN

SEQ ID NO: 1411128 - protein, 6 aa, Mycobacterium tuberculosis
QTFGAP

SEQ ID NO: 1411129 - protein, 10 aa, Mycobacterium tuberculosis
QTIDETYGSL

SEQ ID NO: 1411130 - protein, 6 aa, Mycobacterium tuberculosis
QTPTPP

SEQ ID NO: 1411131 - protein, 7 aa, Mycobacterium tuberculosis
QTSESLA

SEQ ID NO: 1411132 - protein, 6 aa, Mycobacterium tuberculosis
QTSKTS

SEQ ID NO: 1411133 - protein, 7 aa, Mycobacterium tuberculosis
QTSVQPP

SEQ ID NO: 1411134 - protein, 20 aa, Mycobacterium tuberculosis
QTVRPSAADRLSAPDSPEAQ

SEQ ID NO: 1411135 - protein, 6 aa, Mycobacterium tuberculosis
QVPSSV

SEQ ID NO: 1411136 - protein, 12 aa, Mycobacterium tuberculosis
QYEHGRDTAPVV

SEQ ID NO: 1411137 - protein, 6 aa, Mycobacterium tuberculosis
QYGPGH

SEQ ID NO: 1411138 - protein, 6 aa, Mycobacterium tuberculosis
RAADAD

SEQ ID NO: 1411139 - protein, 5 aa, Mycobacterium tuberculosis
RADDE

SEQ ID NO: 1411140 - protein, 10 aa, Mycobacterium tuberculosis
RAEAGAGAAV

SEQ ID NO: 1411141 - protein, 9 aa, Mycobacterium tuberculosis
RAGGLGAPR

SEQ ID NO: 1411142 - protein, 5 aa, Mycobacterium tuberculosis
RAGLT

SEQ ID NO: 1411143 - protein, 5 aa, Mycobacterium tuberculosis
RAGTG

SEQ ID NO: 1411144 - protein, 8 aa, Mycobacterium tuberculosis
RAKTLSES

SEQ ID NO: 1411145 - protein, 6 aa, Mycobacterium tuberculosis
RAMTAR

SEQ ID NO: 1411146 - protein, 14 aa, Mycobacterium tuberculosis
RANPDPRAQSKLTG

SEQ ID NO: 1411147 - protein, 5 aa, Mycobacterium tuberculosis
RAPTA

SEQ ID NO: 1411148 - protein, 9 aa, Mycobacterium tuberculosis
RAQAPAQAA

SEQ ID NO: 1411149 - protein, 15 aa, Mycobacterium tuberculosis
RAQASDAGPDDDTAR

SEQ ID NO: 1411150 - protein, 5 aa, Mycobacterium tuberculosis
RAQRR

SEQ ID NO: 1411151 - protein, 6 aa, Mycobacterium tuberculosis
RARDAG

SEQ ID NO: 1411152 - protein, 10 aa, Mycobacterium tuberculosis
RARPGQTSRK

SEQ ID NO: 1411153 - protein, 14 aa, Mycobacterium tuberculosis
RASDYMRSASAADR

SEQ ID NO: 1411154 - protein, 7 aa, Mycobacterium tuberculosis
RASGDPL

SEQ ID NO: 1411155 - protein, 4 aa, Mycobacterium tuberculosis
RAST

SEQ ID NO: 1411156 - protein, 9 aa, Mycobacterium tuberculosis
RASTRAQNR

SEQ ID NO: 1411157 - protein, 9 aa, Mycobacterium tuberculosis
RASTRTQNR

SEQ ID NO: 1411158 - protein, 5 aa, Mycobacterium tuberculosis
RATAE

SEQ ID NO: 1411159 - protein, 7 aa, Mycobacterium tuberculosis
RATRPGA

SEQ ID NO: 1411160 - protein, 9 aa, Mycobacterium tuberculosis
RATTLNDDE

SEQ ID NO: 1411161 - protein, 6 aa, Mycobacterium tuberculosis
RDAGLP

SEQ ID NO: 1411162 - protein, 4 aa, Mycobacterium tuberculosis
RDAH

SEQ ID NO: 1411163 - protein, 8 aa, Mycobacterium tuberculosis
RDDGQGWA

SEQ ID NO: 1411164 - protein, 14 aa, Mycobacterium tuberculosis
RDDYNGRDIHLPVF

SEQ ID NO: 1411165 - protein, 7 aa, Mycobacterium tuberculosis
RDEAPSV

SEQ ID NO: 1411166 - protein, 5 aa, Mycobacterium tuberculosis
RDEGD

SEQ ID NO: 1411167 - protein, 6 aa, Mycobacterium tuberculosis
RDEQGV

SEQ ID NO: 1411168 - protein, 10 aa, Mycobacterium tuberculosis
RDERTDNAGF

SEQ ID NO: 1411169 - protein, 13 aa, Mycobacterium tuberculosis
RDESDRHGDGPLD

SEQ ID NO: 1411170 - protein, 6 aa, Mycobacterium tuberculosis
RDGSER

SEQ ID NO: 1411171 - protein, 4 aa, Mycobacterium tuberculosis
RDIA

SEQ ID NO: 1411172 - protein, 7 aa, Mycobacterium tuberculosis
RDIPPEA

SEQ ID NO: 1411173 - protein, 9 aa, Mycobacterium tuberculosis
RDKGGRAVA

SEQ ID NO: 1411174 - protein, 6 aa, Mycobacterium tuberculosis
RDPHRH

SEQ ID NO: 1411175 - protein, 4 aa, Mycobacterium tuberculosis
RDPK

SEQ ID NO: 1411176 - protein, 5 aa, Mycobacterium tuberculosis
RDPNA

SEQ ID NO: 1411177 - protein, 9 aa, Mycobacterium tuberculosis
RDPQPQRRA

SEQ ID NO: 1411178 - protein, 6 aa, Mycobacterium tuberculosis
RDPRTK

SEQ ID NO: 1411179 - protein, 5 aa, Mycobacterium tuberculosis
RDQLS

SEQ ID NO: 1411180 - protein, 10 aa, Mycobacterium tuberculosis
RDQTGAWDSV

SEQ ID NO: 1411181 - protein, 9 aa, Mycobacterium tuberculosis
RDTNRGGHD

SEQ ID NO: 1411182 - protein, 8 aa, Mycobacterium tuberculosis
RDTRGREI

SEQ ID NO: 1411183 - protein, 6 aa, Mycobacterium tuberculosis
RDVGRT

SEQ ID NO: 1411184 - protein, 6 aa, Mycobacterium tuberculosis
RDYPDT

SEQ ID NO: 1411185 - protein, 4 aa, Mycobacterium tuberculosis
READ

SEQ ID NO: 1411186 - protein, 5 aa, Mycobacterium tuberculosis
REDEV

SEQ ID NO: 1411187 - protein, 7 aa, Mycobacterium tuberculosis
REETWGP

SEQ ID NO: 1411188 - protein, 4 aa, Mycobacterium tuberculosis
REFK

SEQ ID NO: 1411189 - protein, 12 aa, Mycobacterium tuberculosis
REGAKEPATAAA

SEQ ID NO: 1411190 - protein, 5 aa, Mycobacterium tuberculosis
REGRE

SEQ ID NO: 1411191 - protein, 12 aa, Mycobacterium tuberculosis
REPDGGGFNPPG

SEQ ID NO: 1411192 - protein, 15 aa, Mycobacterium tuberculosis
REPRGPWGPGRPVEA

SEQ ID NO: 1411193 - protein, 15 aa, Mycobacterium tuberculosis
REQPHPSPIVPAWGQ

SEQ ID NO: 1411194 - protein, 5 aa, Mycobacterium tuberculosis
RERPV

SEQ ID NO: 1411195 - protein, 15 aa, Mycobacterium tuberculosis
RERYGPPKSAPRAYS

SEQ ID NO: 1411196 - protein, 6 aa, Mycobacterium tuberculosis
RETREA

SEQ ID NO: 1411197 - protein, 8 aa, Mycobacterium tuberculosis
REYEDDDQ

SEQ ID NO: 1411198 - protein, 6 aa, Mycobacterium tuberculosis
RFGDSD

SEQ ID NO: 1411199 - protein, 5 aa, Mycobacterium tuberculosis
RGARE

SEQ ID NO: 1411200 - protein, 9 aa, Mycobacterium tuberculosis
RGDATGVAD

SEQ ID NO: 1411201 - protein, 9 aa, Mycobacterium tuberculosis
RGDPADRRR

SEQ ID NO: 1411202 - protein, 14 aa, Mycobacterium tuberculosis
RGDPPCDDWSPPPI

SEQ ID NO: 1411203 - protein, 13 aa, Mycobacterium tuberculosis
RGEAKRTKHPRLG

SEQ ID NO: 1411204 - protein, 25 aa, Mycobacterium tuberculosis
RGEPTEPATNPDASPGLRPADGPAS

SEQ ID NO: 1411205 - protein, 25 aa, Mycobacterium tuberculosis
RGESPGEGLPPITTPPWDTKAPKDN

SEQ ID NO: 1411206 - protein, 7 aa, Mycobacterium tuberculosis
RGEVRSD

SEQ ID NO: 1411207 - protein, 8 aa, Mycobacterium tuberculosis
RGEVSGSQ

SEQ ID NO: 1411208 - protein, 4 aa, Mycobacterium tuberculosis
RGGD

SEQ ID NO: 1411209 - protein, 14 aa, Mycobacterium tuberculosis
RGGHPTPMSSTKAT

SEQ ID NO: 1411210 - protein, 6 aa, Mycobacterium tuberculosis
RGGRRT

SEQ ID NO: 1411211 - protein, 7 aa, Mycobacterium tuberculosis
RGGVRGY

SEQ ID NO: 1411212 - protein, 7 aa, Mycobacterium tuberculosis
RGLAADG

SEQ ID NO: 1411213 - protein, 7 aa, Mycobacterium tuberculosis
RGMSDDA

SEQ ID NO: 1411214 - protein, 9 aa, Mycobacterium tuberculosis
RGNPGPAGY

SEQ ID NO: 1411215 - protein, 11 aa, Mycobacterium tuberculosis
RGPLSTEEATT

SEQ ID NO: 1411216 - protein, 6 aa, Mycobacterium tuberculosis
RGPTPP

SEQ ID NO: 1411217 - protein, 11 aa, Mycobacterium tuberculosis
RGQESSAYWPA

SEQ ID NO: 1411218 - protein, 10 aa, Mycobacterium tuberculosis
RGQRRPATTR

SEQ ID NO: 1411219 - protein, 4 aa, Mycobacterium tuberculosis
RGRG

SEQ ID NO: 1411220 - protein, 6 aa, Mycobacterium tuberculosis
RGRGPF

SEQ ID NO: 1411221 - protein, 8 aa, Mycobacterium tuberculosis
RGRGVPAE

SEQ ID NO: 1411222 - protein, 13 aa, Mycobacterium tuberculosis
RGRYGPGYIPRST

SEQ ID NO: 1411223 - protein, 5 aa, Mycobacterium tuberculosis
RGSMR

SEQ ID NO: 1411224 - protein, 12 aa, Mycobacterium tuberculosis
RGTGTGISASDR

SEQ ID NO: 1411225 - protein, 11 aa, Mycobacterium tuberculosis
RGTGVSSDVET

SEQ ID NO: 1411226 - protein, 8 aa, Mycobacterium tuberculosis
RGTPPRLE

SEQ ID NO: 1411227 - protein, 12 aa, Mycobacterium tuberculosis
RGTVNPDVETHP

SEQ ID NO: 1411228 - protein, 6 aa, Mycobacterium tuberculosis
RGYRSG

SEQ ID NO: 1411229 - protein, 8 aa, Mycobacterium tuberculosis
RHGETADD

SEQ ID NO: 1411230 - protein, 7 aa, Mycobacterium tuberculosis
RIGGDQG

SEQ ID NO: 1411231 - protein, 8 aa, Mycobacterium tuberculosis
RKDRPEPV

SEQ ID NO: 1411232 - protein, 6 aa, Mycobacterium tuberculosis
RKGPWQ

SEQ ID NO: 1411233 - protein, 9 aa, Mycobacterium tuberculosis
RKGRDQDRV

SEQ ID NO: 1411234 - protein, 4 aa, Mycobacterium tuberculosis
RKTK

SEQ ID NO: 1411235 - protein, 15 aa, Mycobacterium tuberculosis
RLAAAPGLPCEIKLV

SEQ ID NO: 1411236 - protein, 5 aa, Mycobacterium tuberculosis
RLAAP

SEQ ID NO: 1411237 - protein, 8 aa, Mycobacterium tuberculosis
RLADTTGA

SEQ ID NO: 1411238 - protein, 13 aa, Mycobacterium tuberculosis
RLGGSDEADHDRV

SEQ ID NO: 1411239 - protein, 6 aa, Mycobacterium tuberculosis
RLPTEA

SEQ ID NO: 1411240 - protein, 7 aa, Mycobacterium tuberculosis
RLSRRGR

SEQ ID NO: 1411241 - protein, 7 aa, Mycobacterium tuberculosis
RMAQPGD

SEQ ID NO: 1411242 - protein, 6 aa, Mycobacterium tuberculosis
RMGDGE

SEQ ID NO: 1411243 - protein, 8 aa, Mycobacterium tuberculosis
RNAAGTPV

SEQ ID NO: 1411244 - protein, 9 aa, Mycobacterium tuberculosis
RNADNSIGA

SEQ ID NO: 1411245 - protein, 8 aa, Mycobacterium tuberculosis
RNAGRREK

SEQ ID NO: 1411246 - protein, 14 aa, Mycobacterium tuberculosis
RNAPLTRPRPGHAD

SEQ ID NO: 1411247 - protein, 6 aa, Mycobacterium tuberculosis
RNAQVD

SEQ ID NO: 1411248 - protein, 6 aa, Mycobacterium tuberculosis
RNENDP

SEQ ID NO: 1411249 - protein, 5 aa, Mycobacterium tuberculosis
RNPGQ

SEQ ID NO: 1411250 - protein, 9 aa, Mycobacterium tuberculosis
RNPLHSDPE

SEQ ID NO: 1411251 - protein, 6 aa, Mycobacterium tuberculosis
RNPPQA

SEQ ID NO: 1411252 - protein, 7 aa, Mycobacterium tuberculosis
RNTPGVT

SEQ ID NO: 1411253 - protein, 4 aa, Mycobacterium tuberculosis
RPAP

SEQ ID NO: 1411254 - protein, 8 aa, Mycobacterium tuberculosis
RPERRNAL

SEQ ID NO: 1411255 - protein, 4 aa, Mycobacterium tuberculosis
RPET

SEQ ID NO: 1411256 - protein, 7 aa, Mycobacterium tuberculosis
RPGPDAQ

SEQ ID NO: 1411257 - protein, 5 aa, Mycobacterium tuberculosis
RPGQR

SEQ ID NO: 1411258 - protein, 5 aa, Mycobacterium tuberculosis
RPLNT

SEQ ID NO: 1411259 - protein, 7 aa, Mycobacterium tuberculosis
RPNVGKS

SEQ ID NO: 1411260 - protein, 4 aa, Mycobacterium tuberculosis
RPPS

SEQ ID NO: 1411261 - protein, 5 aa, Mycobacterium tuberculosis
RPQPA

SEQ ID NO: 1411262 - protein, 9 aa, Mycobacterium tuberculosis
RPQQPNVEL

SEQ ID NO: 1411263 - protein, 7 aa, Mycobacterium tuberculosis
RPRPVTA

SEQ ID NO: 1411264 - protein, 11 aa, Mycobacterium tuberculosis
RPSPESGPPVH

SEQ ID NO: 1411265 - protein, 6 aa, Mycobacterium tuberculosis
RPSSGY

SEQ ID NO: 1411266 - protein, 5 aa, Mycobacterium tuberculosis
RPTIA

SEQ ID NO: 1411267 - protein, 8 aa, Mycobacterium tuberculosis
RPTPSANS

SEQ ID NO: 1411268 - protein, 6 aa, Mycobacterium tuberculosis
RPTPVL

SEQ ID NO: 1411269 - protein, 13 aa, Mycobacterium tuberculosis
RPVGKASASRPPL

SEQ ID NO: 1411270 - protein, 4 aa, Mycobacterium tuberculosis
RQAT

SEQ ID NO: 1411271 - protein, 16 aa, Mycobacterium tuberculosis
RQGNSDRRAPKAVKEY

SEQ ID NO: 1411272 - protein, 6 aa, Mycobacterium tuberculosis
RQGRSV

SEQ ID NO: 1411273 - protein, 10 aa, Mycobacterium tuberculosis
RQLPGEGVTR

SEQ ID NO: 1411274 - protein, 4 aa, Mycobacterium tuberculosis
RQPV

SEQ ID NO: 1411275 - protein, 5 aa, Mycobacterium tuberculosis
RQSYP

SEQ ID NO: 1411276 - protein, 6 aa, Mycobacterium tuberculosis
RQTRHG

SEQ ID NO: 1411277 - protein, 11 aa, Mycobacterium tuberculosis
RRAGDEVEAEP

SEQ ID NO: 1411278 - protein, 4 aa, Mycobacterium tuberculosis
RRAL

SEQ ID NO: 1411279 - protein, 7 aa, Mycobacterium tuberculosis
RRAPGPS

SEQ ID NO: 1411280 - protein, 13 aa, Mycobacterium tuberculosis
RRDGIDAASEIAS

SEQ ID NO: 1411281 - protein, 7 aa, Mycobacterium tuberculosis
RRDHPDE

SEQ ID NO: 1411282 - protein, 11 aa, Mycobacterium tuberculosis
RREKDDVTEVR

SEQ ID NO: 1411283 - protein, 7 aa, Mycobacterium tuberculosis
RREPERK

SEQ ID NO: 1411284 - protein, 4 aa, Mycobacterium tuberculosis
RRFP

SEQ ID NO: 1411285 - protein, 5 aa, Mycobacterium tuberculosis
RRGLE

SEQ ID NO: 1411286 - protein, 13 aa, Mycobacterium tuberculosis
RRGPAVPQRDPPR

SEQ ID NO: 1411287 - protein, 6 aa, Mycobacterium tuberculosis
RRGQQD

SEQ ID NO: 1411288 - protein, 9 aa, Mycobacterium tuberculosis
RRGSSVTVS

SEQ ID NO: 1411289 - protein, 7 aa, Mycobacterium tuberculosis
RRPAGVP

SEQ ID NO: 1411290 - protein, 8 aa, Mycobacterium tuberculosis
RRPGHTEA

SEQ ID NO: 1411291 - protein, 10 aa, Mycobacterium tuberculosis
RRPQRTGEDH

SEQ ID NO: 1411292 - protein, 7 aa, Mycobacterium tuberculosis
RRPTDDE

SEQ ID NO: 1411293 - protein, 18 aa, Mycobacterium tuberculosis
RRPVAPRKGTGRVNGSPR

SEQ ID NO: 1411294 - protein, 10 aa, Mycobacterium tuberculosis
RRQAKPGDFD

SEQ ID NO: 1411295 - protein, 9 aa, Mycobacterium tuberculosis
RRRSPATRA

SEQ ID NO: 1411296 - protein, 9 aa, Mycobacterium tuberculosis
RRRTAENSA

SEQ ID NO: 1411297 - protein, 5 aa, Mycobacterium tuberculosis
RRSRD

SEQ ID NO: 1411298 - protein, 16 aa, Mycobacterium tuberculosis
RRSRPAPETAGEAGDG

SEQ ID NO: 1411299 - protein, 14 aa, Mycobacterium tuberculosis
RRSRRRKLKLVEGR

SEQ ID NO: 1411300 - protein, 9 aa, Mycobacterium tuberculosis
RRTGEKRKL

SEQ ID NO: 1411301 - protein, 11 aa, Mycobacterium tuberculosis
RRVPSSEVERV

SEQ ID NO: 1411302 - protein, 9 aa, Mycobacterium tuberculosis
RSAAAGDPC

SEQ ID NO: 1411303 - protein, 11 aa, Mycobacterium tuberculosis
RSAAGHSAYPG

SEQ ID NO: 1411304 - protein, 15 aa, Mycobacterium tuberculosis
RSADHPATVWFTATA

SEQ ID NO: 1411305 - protein, 8 aa, Mycobacterium tuberculosis
RSAEAAGA

SEQ ID NO: 1411306 - protein, 8 aa, Mycobacterium tuberculosis
RSAPSDAG

SEQ ID NO: 1411307 - protein, 9 aa, Mycobacterium tuberculosis
RSARHGPAC

SEQ ID NO: 1411308 - protein, 9 aa, Mycobacterium tuberculosis
RSASEAISG

SEQ ID NO: 1411309 - protein, 8 aa, Mycobacterium tuberculosis
RSDERGAS

SEQ ID NO: 1411310 - protein, 8 aa, Mycobacterium tuberculosis
RSDSDHHG

SEQ ID NO: 1411311 - protein, 4 aa, Mycobacterium tuberculosis
RSNR

SEQ ID NO: 1411312 - protein, 7 aa, Mycobacterium tuberculosis
RSQDPAV

SEQ ID NO: 1411313 - protein, 12 aa, Mycobacterium tuberculosis
RSRAELGRDEAR

SEQ ID NO: 1411314 - protein, 9 aa, Mycobacterium tuberculosis
RSRKVAEGR

SEQ ID NO: 1411315 - protein, 14 aa, Mycobacterium tuberculosis
RSRPALRDQAAGAL

SEQ ID NO: 1411316 - protein, 8 aa, Mycobacterium tuberculosis
RSRTRAEL

SEQ ID NO: 1411317 - protein, 13 aa, Mycobacterium tuberculosis
RSTGTSEVASRSE

SEQ ID NO: 1411318 - protein, 5 aa, Mycobacterium tuberculosis
RSTPG

SEQ ID NO: 1411319 - protein, 7 aa, Mycobacterium tuberculosis
RTATTGM

SEQ ID NO: 1411320 - protein, 56 aa, Mycobacterium tuberculosis; identical to SEQ ID NO: 186462

SEQ ID NO: 1411321 - protein, 9 aa, Mycobacterium tuberculosis
RTDSTGTRR

SEQ ID NO: 1411322 - protein, 8 aa, Mycobacterium tuberculosis
RTEHGPDK

SEQ ID NO: 1411323 - protein, 9 aa, Mycobacterium tuberculosis
RTGGPGAAG

SEQ ID NO: 1411324 - protein, 30 aa, Mycobacterium tuberculosis; identical to SEQ ID NO: 186509

SEQ ID NO: 1411325 - protein, 19 aa, Mycobacterium tuberculosis
RTHPHNRAHTDTMQNSKPA

SEQ ID NO: 1411326 - protein, 31 aa, Mycobacterium tuberculosis; identical to SEQ ID NO: 186519

SEQ ID NO: 1411327 - protein, 13 aa, Mycobacterium tuberculosis
RTLPGKPVTLNAD

SEQ ID NO: 1411328 - protein, 7 aa, Mycobacterium tuberculosis
RTPPGAA

SEQ ID NO: 1411329 - protein, 19 aa, Mycobacterium tuberculosis
RTQRTDPDVAPEPIGPPGI

SEQ ID NO: 1411330 - protein, 10 aa, Mycobacterium tuberculosis
RTSDGPEAVE

SEQ ID NO: 1411331 - protein, 5 aa, Mycobacterium tuberculosis
RTYSA

SEQ ID NO: 1411332 - protein, 7 aa, Mycobacterium tuberculosis
RVPDGED

SEQ ID NO: 1411333 - protein, 5 aa, Mycobacterium tuberculosis
RVRGQ

SEQ ID NO: 1411334 - protein, 9 aa, Mycobacterium tuberculosis
RVRPRGEDS

SEQ ID NO: 1411335 - protein, 4 aa, Mycobacterium tuberculosis
RVSP

SEQ ID NO: 1411336 - protein, 15 aa, Mycobacterium tuberculosis
RVSRSSALASKATGF

SEQ ID NO: 1411337 - protein, 8 aa, Mycobacterium tuberculosis
RYGQPGKT

SEQ ID NO: 1411338 - protein, 7 aa, Mycobacterium tuberculosis
RYGRTRS

SEQ ID NO: 1411339 - protein, 5 aa, Mycobacterium tuberculosis
RYTDT

SEQ ID NO: 1411340 - protein, 6 aa, Mycobacterium tuberculosis
SAADHD

SEQ ID NO: 1411341 - protein, 17 aa, Mycobacterium tuberculosis
SAAGSYAAAEAANASPM

SEQ ID NO: 1411342 - protein, 13 aa, Mycobacterium tuberculosis
SAAKGTGAYAGPR

SEQ ID NO: 1411343 - protein, 24 aa, Mycobacterium tuberculosis
SAATPDTGPDLDNAHGQAETDTEQ

SEQ ID NO: 1411344 - protein, 19 aa, Mycobacterium tuberculosis
SADDPRAAAEQLRSALTAA

SEQ ID NO: 1411345 - protein, 6 aa, Mycobacterium tuberculosis
SADEHL

SEQ ID NO: 1411346 - protein, 7 aa, Mycobacterium tuberculosis
SADGSTV

SEQ ID NO: 1411347 - protein, 10 aa, Mycobacterium tuberculosis
SAEATNAAPL

SEQ ID NO: 1411348 - protein, 7 aa, Mycobacterium tuberculosis
SAEGNGN

SEQ ID NO: 1411349 - protein, 7 aa, Mycobacterium tuberculosis
SAEVAGP

SEQ ID NO: 1411350 - protein, 6 aa, Mycobacterium tuberculosis
SAFAAK

SEQ ID NO: 1411351 - protein, 10 aa, Mycobacterium tuberculosis
SAGAGDPDDV

SEQ ID NO: 1411352 - protein, 10 aa, Mycobacterium tuberculosis
SAGDDAQAAA

SEQ ID NO: 1411353 - protein, 6 aa, Mycobacterium tuberculosis
SAGEDI

SEQ ID NO: 1411354 - protein, 7 aa, Mycobacterium tuberculosis
SAGKAIN

SEQ ID NO: 1411355 - protein, 5 aa, Mycobacterium tuberculosis
SAGKI

SEQ ID NO: 1411356 - protein, 5 aa, Mycobacterium tuberculosis
SAGTA

SEQ ID NO: 1411357 - protein, 5 aa, Mycobacterium tuberculosis
SAKSD

SEQ ID NO: 1411358 - protein, 19 aa, Mycobacterium tuberculosis
SANFGSANIGGNNIGGANT

SEQ ID NO: 1411359 - protein, 5 aa, Mycobacterium tuberculosis
SAPDG

SEQ ID NO: 1411360 - protein, 8 aa, Mycobacterium tuberculosis
SAPGDVAD

SEQ ID NO: 1411361 - protein, 7 aa, Mycobacterium tuberculosis
SAPGSQV

SEQ ID NO: 1411362 - protein, 6 aa, Mycobacterium tuberculosis
SAPSSL

SEQ ID NO: 1411363 - protein, 12 aa, Mycobacterium tuberculosis
SAQGSQGMGGPV

SEQ ID NO: 1411364 - protein, 7 aa, Mycobacterium tuberculosis
SARASQT

SEQ ID NO: 1411365 - protein, 7 aa, Mycobacterium tuberculosis
SARSSAR

SEQ ID NO: 1411366 - protein, 10 aa, Mycobacterium tuberculosis
SARTAPDTAD

SEQ ID NO: 1411367 - protein, 11 aa, Mycobacterium tuberculosis
SARTPSPNTVR

SEQ ID NO: 1411368 - protein, 9 aa, Mycobacterium tuberculosis
SASTASESI

SEQ ID NO: 1411369 - protein, 12 aa, Mycobacterium tuberculosis
SATKKVSKPACV

SEQ ID NO: 1411370 - protein, 8 aa, Mycobacterium tuberculosis
SATSGASG

SEQ ID NO: 1411371 - protein, 5 aa, Mycobacterium tuberculosis
SATSV

SEQ ID NO: 1411372 - protein, 5 aa, Mycobacterium tuberculosis
SATVR

SEQ ID NO: 1411373 - protein, 17 aa, Mycobacterium tuberculosis
SDAAWQAPANDAGEPIP

SEQ ID NO: 1411374 - protein, 7 aa, Mycobacterium tuberculosis
SDDQPLA

SEQ ID NO: 1411375 - protein, 9 aa, Mycobacterium tuberculosis
SDGDFGGDL

SEQ ID NO: 1411376 - protein, 9 aa, Mycobacterium tuberculosis
SDGYEAARR

SEQ ID NO: 1411377 - protein, 5 aa, Mycobacterium tuberculosis
SDHGD

SEQ ID NO: 1411378 - protein, 5 aa, Mycobacterium tuberculosis
SDPNW

SEQ ID NO: 1411379 - protein, 7 aa, Mycobacterium tuberculosis
SDPRRRR

SEQ ID NO: 1411380 - protein, 4 aa, Mycobacterium tuberculosis
SDRA

SEQ ID NO: 1411381 - protein, 6 aa, Mycobacterium tuberculosis
SDRQEF

SEQ ID NO: 1411382 - protein, 18 aa, Mycobacterium tuberculosis
SDTHGGGGGRPVTPPPPG

SEQ ID NO: 1411383 - protein, 9 aa, Mycobacterium tuberculosis
SDTKAKELG

SEQ ID NO: 1411384 - protein, 8 aa, Mycobacterium tuberculosis
SDTRPAAR

SEQ ID NO: 1411385 - protein, 10 aa, Mycobacterium tuberculosis
SEAGAQPKTA

SEQ ID NO: 1411386 - protein, 5 aa, Mycobacterium tuberculosis
SEAQK

SEQ ID NO: 1411387 - protein, 4 aa, Mycobacterium tuberculosis
SEEG

SEQ ID NO: 1411388 - protein, 5 aa, Mycobacterium tuberculosis
SEEQL

SEQ ID NO: 1411389 - protein, 6 aa, Mycobacterium tuberculosis
SEGKGL

SEQ ID NO: 1411390 - protein, 5 aa, Mycobacterium tuberculosis
SEGNS

SEQ ID NO: 1411391 - protein, 7 aa, Mycobacterium tuberculosis
SEGPLPQ

SEQ ID NO: 1411392 - protein, 7 aa, Mycobacterium tuberculosis
SEGWPGE

SEQ ID NO: 1411393 - protein, 8 aa, Mycobacterium tuberculosis
SELGRTQA

SEQ ID NO: 1411394 - protein, 5 aa, Mycobacterium tuberculosis
SENNT

SEQ ID NO: 1411395 - protein, 6 aa, Mycobacterium tuberculosis
SEPGSR

SEQ ID NO: 1411396 - protein, 8 aa, Mycobacterium tuberculosis
SESDEPNR

SEQ ID NO: 1411397 - protein, 5 aa, Mycobacterium tuberculosis
SEVTG

SEQ ID NO: 1411398 - protein, 5 aa, Mycobacterium tuberculosis
SGAGD

SEQ ID NO: 1411399 - protein, 8 aa, Mycobacterium tuberculosis
SGAGSASG

SEQ ID NO: 1411400 - protein, 9 aa, Mycobacterium tuberculosis
SGAGSASGF

SEQ ID NO: 1411401 - protein, 4 aa, Mycobacterium tuberculosis
SGAP

SEQ ID NO: 1411402 - protein, 8 aa, Mycobacterium tuberculosis
SGAPEHRA

SEQ ID NO: 1411403 - protein, 7 aa, Mycobacterium tuberculosis
SGAQPQE

SEQ ID NO: 1411404 - protein, 13 aa, Mycobacterium tuberculosis
SGASSTTASTGDI

SEQ ID NO: 1411405 - protein, 6 aa, Mycobacterium tuberculosis
SGATNA

SEQ ID NO: 1411406 - protein, 12 aa, Mycobacterium tuberculosis
SGELSHQDERGA

SEQ ID NO: 1411407 - protein, 7 aa, Mycobacterium tuberculosis
SGEQVTV

SEQ ID NO: 1411408 - protein, 7 aa, Mycobacterium tuberculosis
SGEYAAS

SEQ ID NO: 1411409 - protein, 10 aa, Mycobacterium tuberculosis
SGFDAAAPSA

SEQ ID NO: 1411410 - protein, 4 aa, Mycobacterium tuberculosis
SGGE

SEQ ID NO: 1411411 - protein, 6 aa, Mycobacterium tuberculosis
SGGGPY

SEQ ID NO: 1411412 - protein, 6 aa, Mycobacterium tuberculosis
SGGLRG

SEQ ID NO: 1411413 - protein, 18 aa, Mycobacterium tuberculosis
SGGSAPTGDHPTPHPSTS

SEQ ID NO: 1411414 - protein, 8 aa, Mycobacterium tuberculosis
SGGTAPAA

SEQ ID NO: 1411415 - protein, 9 aa, Mycobacterium tuberculosis
SGGYAKRTA

SEQ ID NO: 1411416 - protein, 6 aa, Mycobacterium tuberculosis
SGINPD

SEQ ID NO: 1411417 - protein, 11 aa, Mycobacterium tuberculosis
SGKGGVGKSTV

SEQ ID NO: 1411418 - protein, 5 aa, Mycobacterium tuberculosis
SGKQL

SEQ ID NO: 1411419 - protein, 6 aa, Mycobacterium tuberculosis
SGLPAD

SEQ ID NO: 1411420 - protein, 7 aa, Mycobacterium tuberculosis
SGLPKGT

SEQ ID NO: 1411421 - protein, 22 aa, Mycobacterium tuberculosis
SGNPPTRERIQSPTDRARYDDT

SEQ ID NO: 1411422 - protein, 9 aa, Mycobacterium tuberculosis
SGPAGTGKA

SEQ ID NO: 1411423 - protein, 22 aa, Mycobacterium tuberculosis
SGPAIPPSGERDAWASNSGVGG

SEQ ID NO: 1411424 - protein, 6 aa, Mycobacterium tuberculosis
SGPEAV

SEQ ID NO: 1411425 - protein, 6 aa, Mycobacterium tuberculosis
SGPGID

SEQ ID NO: 1411426 - protein, 9 aa, Mycobacterium tuberculosis
SGQAREKYE

SEQ ID NO: 1411427 - protein, 16 aa, Mycobacterium tuberculosis
SGQLGAALSGAAEEQI

SEQ ID NO: 1411428 - protein, 8 aa, Mycobacterium tuberculosis
SGRRGPQA

SEQ ID NO: 1411429 - protein, 18 aa, Mycobacterium tuberculosis
SGSFNTGIGNTGNTNTGL

SEQ ID NO: 1411430 - protein, 10 aa, Mycobacterium tuberculosis
SGSGNGEPTG

SEQ ID NO: 1411431 - protein, 9 aa, Mycobacterium tuberculosis
SGSGPLRPA

SEQ ID NO: 1411432 - protein, 5 aa, Mycobacterium tuberculosis
SGSNN

SEQ ID NO: 1411433 - protein, 10 aa, Mycobacterium tuberculosis
SGSTGSPKAV

SEQ ID NO: 1411434 - protein, 15 aa, Mycobacterium tuberculosis
SGSTQLGRDETLQDT

SEQ ID NO: 1411435 - protein, 6 aa, Mycobacterium tuberculosis
SGSVSV

SEQ ID NO: 1411436 - protein, 17 aa, Mycobacterium tuberculosis
SGTGNFGIGNSGTGNFG

SEQ ID NO: 1411437 - protein, 13 aa, Mycobacterium tuberculosis
SGTSGAGRAATTD

SEQ ID NO: 1411438 - protein, 18 aa, Mycobacterium tuberculosis
SGTTGTPKGARHSGGGIG

SEQ ID NO: 1411439 - protein, 17 aa, Mycobacterium tuberculosis
SGTTMRGRGGPNRRSRP

SEQ ID NO: 1411440 - protein, 6 aa, Mycobacterium tuberculosis
SHAGSW

SEQ ID NO: 1411441 - protein, 6 aa, Mycobacterium tuberculosis
SHGGDP

SEQ ID NO: 1411442 - protein, 11 aa, Mycobacterium tuberculosis
SIADASKAISG

SEQ ID NO: 1411443 - protein, 8 aa, Mycobacterium tuberculosis
SIGRTEKI

SEQ ID NO: 1411444 - protein, 5 aa, Mycobacterium tuberculosis
SIPGV

SEQ ID NO: 1411445 - protein, 9 aa, Mycobacterium tuberculosis
SKADTPDGV

SEQ ID NO: 1411446 - protein, 15 aa, Mycobacterium tuberculosis
SKGEAGTGDVSNATT

SEQ ID NO: 1411447 - protein, 5 aa, Mycobacterium tuberculosis
SKKPQ

SEQ ID NO: 1411448 - protein, 8 aa, Mycobacterium tuberculosis
SKPGTYGA

SEQ ID NO: 1411449 - protein, 7 aa, Mycobacterium tuberculosis
SKSPRCT

SEQ ID NO: 1411450 - protein, 6 aa, Mycobacterium tuberculosis
SKTRNH

SEQ ID NO: 1411451 - protein, 9 aa, Mycobacterium tuberculosis
SLPASQRDE

SEQ ID NO: 1411452 - protein, 10 aa, Mycobacterium tuberculosis
SLPQAEPTAP

SEQ ID NO: 1411453 - protein, 10 aa, Mycobacterium tuberculosis
SLTGHAKGGA

SEQ ID NO: 1411454 - protein, 8 aa, Mycobacterium tuberculosis
SLYPSSPD

SEQ ID NO: 1411455 - protein, 7 aa, Mycobacterium tuberculosis
SNDSVPQ

SEQ ID NO: 1411456 - protein, 7 aa, Mycobacterium tuberculosis
SNGIGSD

SEQ ID NO: 1411457 - protein, 15 aa, Mycobacterium tuberculosis
SNPGTSIKDKGATRE

SEQ ID NO: 1411458 - protein, 5 aa, Mycobacterium tuberculosis
SNPNI

SEQ ID NO: 1411459 - protein, 7 aa, Mycobacterium tuberculosis
SNPTHRA

SEQ ID NO: 1411460 - protein, 7 aa, Mycobacterium tuberculosis
SNRSRDL

SEQ ID NO: 1411461 - protein, 6 aa, Mycobacterium tuberculosis
SPAEQA

SEQ ID NO: 1411462 - protein, 13 aa, Mycobacterium tuberculosis
SPANPTGTVIPPE

SEQ ID NO: 1411463 - protein, 6 aa, Mycobacterium tuberculosis
SPDGQA

SEQ ID NO: 1411464 - protein, 8 aa, Mycobacterium tuberculosis
SPDKPEKL

SEQ ID NO: 1411465 - protein, 15 aa, Mycobacterium tuberculosis
SPDRLADQLSTVAVR

SEQ ID NO: 1411466 - protein, 8 aa, Mycobacterium tuberculosis
SPDSARGR

SEQ ID NO: 1411467 - protein, 9 aa, Mycobacterium tuberculosis
SPGGRTGGN

SEQ ID NO: 1411468 - protein, 11 aa, Mycobacterium tuberculosis
SPIEPPARPDG

SEQ ID NO: 1411469 - protein, 14 aa, Mycobacterium tuberculosis
SPLAEGSHADGSAI

SEQ ID NO: 1411470 - protein, 4 aa, Mycobacterium tuberculosis
SPLG

SEQ ID NO: 1411471 - protein, 12 aa, Mycobacterium tuberculosis
SPMSADAAQPLA

SEQ ID NO: 1411472 - protein, 8 aa, Mycobacterium tuberculosis
SPPEQLPD

SEQ ID NO: 1411473 - protein, 4 aa, Mycobacterium tuberculosis
SPPM

SEQ ID NO: 1411474 - protein, 7 aa, Mycobacterium tuberculosis
SPPRTAR

SEQ ID NO: 1411475 - protein, 4 aa, Mycobacterium tuberculosis
SPQA

SEQ ID NO: 1411476 - protein, 7 aa, Mycobacterium tuberculosis
SPRDGER

SEQ ID NO: 1411477 - protein, 11 aa, Mycobacterium tuberculosis
SPRPRWPPNAA

SEQ ID NO: 1411478 - protein, 12 aa, Mycobacterium tuberculosis
SPSSGGGRPQPW

SEQ ID NO: 1411479 - protein, 4 aa, Mycobacterium tuberculosis
SPTD

SEQ ID NO: 1411480 - protein, 15 aa, Mycobacterium tuberculosis
SPTGAGPHANPNAAG

SEQ ID NO: 1411481 - protein, 19 aa, Mycobacterium tuberculosis
SPTRRIDDSYANGYANSKW

SEQ ID NO: 1411482 - protein, 8 aa, Mycobacterium tuberculosis
SPTSGSGC

SEQ ID NO: 1411483 - protein, 17 aa, Mycobacterium tuberculosis
SPTWDPRARGWWSEDPG

SEQ ID NO: 1411484 - protein, 6 aa, Mycobacterium tuberculosis
SPVGRF

SEQ ID NO: 1411485 - protein, 5 aa, Mycobacterium tuberculosis
SQDHS

SEQ ID NO: 1411486 - protein, 19 aa, Mycobacterium tuberculosis
SQPDPDTPALTGDRTARIA

SEQ ID NO: 1411487 - protein, 7 aa, Mycobacterium tuberculosis
SQTSRSA

SEQ ID NO: 1411488 - protein, 6 aa, Mycobacterium tuberculosis
SQVDLT

SEQ ID NO: 1411489 - protein, 8 aa, Mycobacterium tuberculosis
SRAKSQDT

SEQ ID NO: 1411490 - protein, 9 aa, Mycobacterium tuberculosis
SRDGPSRAY

SEQ ID NO: 1411491 - protein, 9 aa, Mycobacterium tuberculosis
SRDPERHPG

SEQ ID NO: 1411492 - protein, 8 aa, Mycobacterium tuberculosis
SRDTGRIQ

SEQ ID NO: 1411493 - protein, 9 aa, Mycobacterium tuberculosis
SRGEGHARS

SEQ ID NO: 1411494 - protein, 15 aa, Mycobacterium tuberculosis
SRGGSPKAEAASVPS

SEQ ID NO: 1411495 - protein, 4 aa, Mycobacterium tuberculosis
SRIG

SEQ ID NO: 1411496 - protein, 6 aa, Mycobacterium tuberculosis
SRPNGE

SEQ ID NO: 1411497 - protein, 6 aa, Mycobacterium tuberculosis
SRTNYG

SEQ ID NO: 1411498 - protein, 10 aa, Mycobacterium tuberculosis
SSDASPEEIK

SEQ ID NO: 1411499 - protein, 8 aa, Mycobacterium tuberculosis
SSEEDEPV

SEQ ID NO: 1411500 - protein, 8 aa, Mycobacterium tuberculosis
SSGAGTGW

SEQ ID NO: 1411501 - protein, 6 aa, Mycobacterium tuberculosis
SSGDLS

SEQ ID NO: 1411502 - protein, 6 aa, Mycobacterium tuberculosis
SSGGTC

SEQ ID NO: 1411503 - protein, 5 aa, Mycobacterium tuberculosis
SSGLG

SEQ ID NO: 1411504 - protein, 9 aa, Mycobacterium tuberculosis
SSGPGPGPV

SEQ ID NO: 1411505 - protein, 6 aa, Mycobacterium tuberculosis
SSHGTH

SEQ ID NO: 1411506 - protein, 9 aa, Mycobacterium tuberculosis
SSPGAFGES

SEQ ID NO: 1411507 - protein, 7 aa, Mycobacterium tuberculosis
SSPGPYE

SEQ ID NO: 1411508 - protein, 5 aa, Mycobacterium tuberculosis
SSPGY

SEQ ID NO: 1411509 - protein, 15 aa, Mycobacterium tuberculosis
SSPWWGGEDTGYASN

SEQ ID NO: 1411510 - protein, 5 aa, Mycobacterium tuberculosis
SSQLD

SEQ ID NO: 1411511 - protein, 6 aa, Mycobacterium tuberculosis
SSRRGE

SEQ ID NO: 1411512 - protein, 9 aa, Mycobacterium tuberculosis
SSRRTAGDT

SEQ ID NO: 1411513 - protein, 13 aa, Mycobacterium tuberculosis
SSSGAIGNSGLAN

SEQ ID NO: 1411514 - protein, 4 aa, Mycobacterium tuberculosis
SSSL

SEQ ID NO: 1411515 - protein, 7 aa, Mycobacterium tuberculosis
STADEGA

SEQ ID NO: 1411516 - protein, 21 aa, Mycobacterium tuberculosis
STDRENAAALGPDDEDVPDTG

SEQ ID NO: 1411517 - protein, 4 aa, Mycobacterium tuberculosis
STGL

SEQ ID NO: 1411518 - protein, 7 aa, Mycobacterium tuberculosis
STLATQR

SEQ ID NO: 1411519 - protein, 10 aa, Mycobacterium tuberculosis
STLQDDGDSV

SEQ ID NO: 1411520 - protein, 14 aa, Mycobacterium tuberculosis
STNRKLDKAASKGV

SEQ ID NO: 1411521 - protein, 6 aa, Mycobacterium tuberculosis
STPEQT

SEQ ID NO: 1411522 - protein, 5 aa, Mycobacterium tuberculosis
STRMP

SEQ ID NO: 1411523 - protein, 4 aa, Mycobacterium tuberculosis
STRR

SEQ ID NO: 1411524 - protein, 9 aa, Mycobacterium tuberculosis
STSAPSSGF

SEQ ID NO: 1411525 - protein, 9 aa, Mycobacterium tuberculosis
STTAGVAAS

SEQ ID NO: 1411526 - protein, 4 aa, Mycobacterium tuberculosis
STTI

SEQ ID NO: 1411527 - protein, 4 aa, Mycobacterium tuberculosis
STTV

SEQ ID NO: 1411528 - protein, 6 aa, Mycobacterium tuberculosis
STVEQA

SEQ ID NO: 1411529 - protein, 8 aa, Mycobacterium tuberculosis
SVDENHTH

SEQ ID NO: 1411530 - protein, 6 aa, Mycobacterium tuberculosis
SVEPAQ

SEQ ID NO: 1411531 - protein, 5 aa, Mycobacterium tuberculosis
SVGAT

SEQ ID NO: 1411532 - protein, 5 aa, Mycobacterium tuberculosis
SVGQQ

SEQ ID NO: 1411533 - protein, 7 aa, Mycobacterium tuberculosis
SVMAPTA

SEQ ID NO: 1411534 - protein, 7 aa, Mycobacterium tuberculosis
SWQGRSS

SEQ ID NO: 1411535 - protein, 6 aa, Mycobacterium tuberculosis
SWRDDA

SEQ ID NO: 1411536 - protein, 7 aa, Mycobacterium tuberculosis
SYDGSAA

SEQ ID NO: 1411537 - protein, 6 aa, Mycobacterium tuberculosis
SYGSAR

SEQ ID NO: 1411538 - protein, 6 aa, Mycobacterium tuberculosis
SYHSRT

SEQ ID NO: 1411539 - protein, 19 aa, Mycobacterium tuberculosis
SYRGPRDDSSEATKAAEAS

SEQ ID NO: 1411540 - protein, 7 aa, Mycobacterium tuberculosis
TAAAEGA

SEQ ID NO: 1411541 - protein, 6 aa, Mycobacterium tuberculosis
TAAATT

SEQ ID NO: 1411542 - protein, 11 aa, Mycobacterium tuberculosis
TAADSSPALAS

SEQ ID NO: 1411543 - protein, 15 aa, Mycobacterium tuberculosis
TAAEASAAANGRSLP

SEQ ID NO: 1411544 - protein, 9 aa, Mycobacterium tuberculosis
TAANQDGHT

SEQ ID NO: 1411545 - protein, 7 aa, Mycobacterium tuberculosis
TAAPGDY

SEQ ID NO: 1411546 - protein, 8 aa, Mycobacterium tuberculosis
TAAPPVSR

SEQ ID NO: 1411547 - protein, 8 aa, Mycobacterium tuberculosis
TAERGGQV

SEQ ID NO: 1411548 - protein, 5 aa, Mycobacterium tuberculosis
TAFGT

SEQ ID NO: 1411549 - protein, 9 aa, Mycobacterium tuberculosis
TAGPGITNG

SEQ ID NO: 1411550 - protein, 9 aa, Mycobacterium tuberculosis
TAGPGRAPK

SEQ ID NO: 1411551 - protein, 16 aa, Mycobacterium tuberculosis
TAGRTTLTGEGLQHAD

SEQ ID NO: 1411552 - protein, 6 aa, Mycobacterium tuberculosis
TAPATV

SEQ ID NO: 1411553 - protein, 9 aa, Mycobacterium tuberculosis
TAPTNGAAG

SEQ ID NO: 1411554 - protein, 9 aa, Mycobacterium tuberculosis
TAQQAARHA

SEQ ID NO: 1411555 - protein, 7 aa, Mycobacterium tuberculosis
TAQRDRA

SEQ ID NO: 1411556 - protein, 7 aa, Mycobacterium tuberculosis
TAREAAG

SEQ ID NO: 1411557 - protein, 6 aa, Mycobacterium tuberculosis
TAREPH

SEQ ID NO: 1411558 - protein, 14 aa, Mycobacterium tuberculosis
TARPYPPVADQRGA

SEQ ID NO: 1411559 - protein, 9 aa, Mycobacterium tuberculosis
TARQSGGQL

SEQ ID NO: 1411560 - protein, 8 aa, Mycobacterium tuberculosis
TASGHTPA

SEQ ID NO: 1411561 - protein, 9 aa, Mycobacterium tuberculosis
TATAGTDSL

SEQ ID NO: 1411562 - protein, 7 aa, Mycobacterium tuberculosis
TATGPGE

SEQ ID NO: 1411563 - protein, 7 aa, Mycobacterium tuberculosis
TATIDGQ

SEQ ID NO: 1411564 - protein, 11 aa, Mycobacterium tuberculosis
TATNDDQLGPL

SEQ ID NO: 1411565 - protein, 8 aa, Mycobacterium tuberculosis
TATTPAGR

SEQ ID NO: 1411566 - protein, 8 aa, Mycobacterium tuberculosis
TCAGPEPN

SEQ ID NO: 1411567 - protein, 10 aa, Mycobacterium tuberculosis
TCERPTEPVA

SEQ ID NO: 1411568 - protein, 6 aa, Mycobacterium tuberculosis
TDAESQ

SEQ ID NO: 1411569 - protein, 10 aa, Mycobacterium tuberculosis
TDAGVAPGRR

SEQ ID NO: 1411570 - protein, 8 aa, Mycobacterium tuberculosis
TDARPERV

SEQ ID NO: 1411571 - protein, 8 aa, Mycobacterium tuberculosis
TDATYTQT

SEQ ID NO: 1411572 - protein, 5 aa, Mycobacterium tuberculosis
TDDAR

SEQ ID NO: 1411573 - protein, 7 aa, Mycobacterium tuberculosis
TDGATER

SEQ ID NO: 1411574 - protein, 7 aa, Mycobacterium tuberculosis
TDGHARR

SEQ ID NO: 1411575 - protein, 6 aa, Mycobacterium tuberculosis
TDHPGY

SEQ ID NO: 1411576 - protein, 7 aa, Mycobacterium tuberculosis
TDKDWRE

SEQ ID NO: 1411577 - protein, 11 aa, Mycobacterium tuberculosis
TDKGQAEAVRS

SEQ ID NO: 1411578 - protein, 7 aa, Mycobacterium tuberculosis
TDPAGFT

SEQ ID NO: 1411579 - protein, 6 aa, Mycobacterium tuberculosis
TDPNGY

SEQ ID NO: 1411580 - protein, 40 aa, Mycobacterium tuberculosis; identical to SEQ ID NO: 195087

SEQ ID NO: 1411581 - protein, 5 aa, Mycobacterium tuberculosis
TDPQG

SEQ ID NO: 1411582 - protein, 15 aa, Mycobacterium tuberculosis
TDPSGASLAYSGDTG

SEQ ID NO: 1411583 - protein, 8 aa, Mycobacterium tuberculosis
TDPTNGTR

SEQ ID NO: 1411584 - protein, 6 aa, Mycobacterium tuberculosis
TDPVHT

SEQ ID NO: 1411585 - protein, 5 aa, Mycobacterium tuberculosis
TDRPR

SEQ ID NO: 1411586 - protein, 10 aa, Mycobacterium tuberculosis
TDSGKIDRAE

SEQ ID NO: 1411587 - protein, 21 aa, Mycobacterium tuberculosis
TDTGAAPGLDSLPPAASEAEA

SEQ ID NO: 1411588 - protein, 8 aa, Mycobacterium tuberculosis
TDTTAAQR

SEQ ID NO: 1411589 - protein, 9 aa, Mycobacterium tuberculosis
TEFDTSAPR

SEQ ID NO: 1411590 - protein, 10 aa, Mycobacterium tuberculosis
TEGAGGGHAP

SEQ ID NO: 1411591 - protein, 5 aa, Mycobacterium tuberculosis
TEGVA

SEQ ID NO: 1411592 - protein, 4 aa, Mycobacterium tuberculosis
TEMP

SEQ ID NO: 1411593 - protein, 5 aa, Mycobacterium tuberculosis
TEPDV

SEQ ID NO: 1411594 - protein, 4 aa, Mycobacterium tuberculosis
TEPV

SEQ ID NO: 1411595 - protein, 8 aa, Mycobacterium tuberculosis
TETGARGL

SEQ ID NO: 1411596 - protein, 10 aa, Mycobacterium tuberculosis
TETKASEGVI

SEQ ID NO: 1411597 - protein, 5 aa, Mycobacterium tuberculosis
TFGST

SEQ ID NO: 1411598 - protein, 15 aa, Mycobacterium tuberculosis
TFTTGYSGVGGNMPQ

SEQ ID NO: 1411599 - protein, 9 aa, Mycobacterium tuberculosis
TGAEGPRGV

SEQ ID NO: 1411600 - protein, 16 aa, Mycobacterium tuberculosis
TGAGGGSGFSNTGAGM

SEQ ID NO: 1411601 - protein, 4 aa, Mycobacterium tuberculosis
TGDM

SEQ ID NO: 1411602 - protein, 10 aa, Mycobacterium tuberculosis
TGDPANGGSM

SEQ ID NO: 1411603 - protein, 8 aa, Mycobacterium tuberculosis
TGDSNLGI

SEQ ID NO: 1411604 - protein, 16 aa, Mycobacterium tuberculosis
TGDYNTGVANTGNVNT

SEQ ID NO: 1411605 - protein, 4 aa, Mycobacterium tuberculosis
TGEI

SEQ ID NO: 1411606 - protein, 12 aa, Mycobacterium tuberculosis
TGFGNSGAGNTG

SEQ ID NO: 1411607 - protein, 5 aa, Mycobacterium tuberculosis
TGFPE

SEQ ID NO: 1411608 - protein, 15 aa, Mycobacterium tuberculosis
TGGAGVQGRTADVSR

SEQ ID NO: 1411609 - protein, 6 aa, Mycobacterium tuberculosis
TGGAQG

SEQ ID NO: 1411610 - protein, 31 aa, Mycobacterium tuberculosis; identical to SEQ ID NO: 189388

SEQ ID NO: 1411611 - protein, 20 aa, Mycobacterium tuberculosis
TGHEGGAGTVHANNPGEVPA

SEQ ID NO: 1411612 - protein, 9 aa, Mycobacterium tuberculosis
TGHPDSPEE

SEQ ID NO: 1411613 - protein, 11 aa, Mycobacterium tuberculosis
TGIANTGDVDT

SEQ ID NO: 1411614 - protein, 5 aa, Mycobacterium tuberculosis
TGKEI

SEQ ID NO: 1411615 - protein, 15 aa, Mycobacterium tuberculosis
TGKTPVSKDDAQQHA

SEQ ID NO: 1411616 - protein, 4 aa, Mycobacterium tuberculosis
TGKV

SEQ ID NO: 1411617 - protein, 22 aa, Mycobacterium tuberculosis
TGLNTKQVGASRNSFKHYVATA

SEQ ID NO: 1411618 - protein, 6 aa, Mycobacterium tuberculosis
TGNGQI

SEQ ID NO: 1411619 - protein, 5 aa, Mycobacterium tuberculosis
TGNTH

SEQ ID NO: 1411620 - protein, 8 aa, Mycobacterium tuberculosis
TGPVGGEV

SEQ ID NO: 1411621 - protein, 10 aa, Mycobacterium tuberculosis
TGQPAEAAQP

SEQ ID NO: 1411622 - protein, 7 aa, Mycobacterium tuberculosis
TGSAELD

SEQ ID NO: 1411623 - protein, 7 aa, Mycobacterium tuberculosis
TGSEPVR

SEQ ID NO: 1411624 - protein, 5 aa, Mycobacterium tuberculosis
TGSGA

SEQ ID NO: 1411625 - protein, 9 aa, Mycobacterium tuberculosis
TGSYNTGGF

SEQ ID NO: 1411626 - protein, 15 aa, Mycobacterium tuberculosis
TGTADYTVTGAGTEA

SEQ ID NO: 1411627 - protein, 5 aa, Mycobacterium tuberculosis
TGTAS

SEQ ID NO: 1411628 - protein, 7 aa, Mycobacterium tuberculosis
TGTDKPG

SEQ ID NO: 1411629 - protein, 15 aa, Mycobacterium tuberculosis
TGYDTATGAGSAYDR

SEQ ID NO: 1411630 - protein, 7 aa, Mycobacterium tuberculosis
THAGPGG

SEQ ID NO: 1411631 - protein, 5 aa, Mycobacterium tuberculosis
THPEE

SEQ ID NO: 1411632 - protein, 5 aa, Mycobacterium tuberculosis
THSPD

SEQ ID NO: 1411633 - protein, 9 aa, Mycobacterium tuberculosis
THSQTSGWS

SEQ ID NO: 1411634 - protein, 7 aa, Mycobacterium tuberculosis
THTGDGT

SEQ ID NO: 1411635 - protein, 13 aa, Mycobacterium tuberculosis
THTYSDSTVGPFD

SEQ ID NO: 1411636 - protein, 4 aa, Mycobacterium tuberculosis
TKFH

SEQ ID NO: 1411637 - protein, 5 aa, Mycobacterium tuberculosis
TLAGR

SEQ ID NO: 1411638 - protein, 5 aa, Mycobacterium tuberculosis
TLNET

SEQ ID NO: 1411639 - protein, 8 aa, Mycobacterium tuberculosis
TLPAPDTD

SEQ ID NO: 1411640 - protein, 14 aa, Mycobacterium tuberculosis
TLPPGATTGDARAE

SEQ ID NO: 1411641 - protein, 9 aa, Mycobacterium tuberculosis
TLRSSGAAL

SEQ ID NO: 1411642 - protein, 9 aa, Mycobacterium tuberculosis
TMSRPPDAH

SEQ ID NO: 1411643 - protein, 6 aa, Mycobacterium tuberculosis
TNRQRA

SEQ ID NO: 1411644 - protein, 32 aa, Mycobacterium tuberculosis; identical to SEQ ID NO: 189802

SEQ ID NO: 1411645 - protein, 6 aa, Mycobacterium tuberculosis
TPDERR

SEQ ID NO: 1411646 - protein, 6 aa, Mycobacterium tuberculosis
TPDEYN

SEQ ID NO: 1411647 - protein, 5 aa, Mycobacterium tuberculosis
TPDVR

SEQ ID NO: 1411648 - protein, 13 aa, Mycobacterium tuberculosis
TPEFADRQRRTLS

SEQ ID NO: 1411649 - protein, 5 aa, Mycobacterium tuberculosis
TPGCT

SEQ ID NO: 1411650 - protein, 6 aa, Mycobacterium tuberculosis
TPGDRS

SEQ ID NO: 1411651 - protein, 15 aa, Mycobacterium tuberculosis
TPHPASAAPISGGTD

SEQ ID NO: 1411652 - protein, 6 aa, Mycobacterium tuberculosis
TPISQS

SEQ ID NO: 1411653 - protein, 5 aa, Mycobacterium tuberculosis
TPMPI

SEQ ID NO: 1411654 - protein, 4 aa, Mycobacterium tuberculosis
TPQV

SEQ ID NO: 1411655 - protein, 9 aa, Mycobacterium tuberculosis
TPSDGQVAT

SEQ ID NO: 1411656 - protein, 26 aa, Mycobacterium tuberculosis
TPSLTKNAGVPTTDQPQKGKDFTSDQ

SEQ ID NO: 1411657 - protein, 11 aa, Mycobacterium tuberculosis
TPSPANQPPVR

SEQ ID NO: 1411658 - protein, 15 aa, Mycobacterium tuberculosis
TPTGSRHRSGAPPHL

SEQ ID NO: 1411659 - protein, 5 aa, Mycobacterium tuberculosis
TPTVC

SEQ ID NO: 1411660 - protein, 4 aa, Mycobacterium tuberculosis
TQAA

SEQ ID NO: 1411661 - protein, 10 aa, Mycobacterium tuberculosis
TQAPSGSGYA

SEQ ID NO: 1411662 - protein, 4 aa, Mycobacterium tuberculosis
TQAQ

SEQ ID NO: 1411663 - protein, 17 aa, Mycobacterium tuberculosis
TQNGELSAQYAEAASEV

SEQ ID NO: 1411664 - protein, 7 aa, Mycobacterium tuberculosis
TQPDVAE

SEQ ID NO: 1411665 - protein, 4 aa, Mycobacterium tuberculosis
TQPS

SEQ ID NO: 1411666 - protein, 7 aa, Mycobacterium tuberculosis
TRADADQ

SEQ ID NO: 1411667 - protein, 8 aa, Mycobacterium tuberculosis
TRDAAGNG

SEQ ID NO: 1411668 - protein, 5 aa, Mycobacterium tuberculosis
TRDTG

SEQ ID NO: 1411669 - protein, 6 aa, Mycobacterium tuberculosis
TRFTET

SEQ ID NO: 1411670 - protein, 20 aa, Mycobacterium tuberculosis
TRGGDGQGAPFGADVPTPRL

SEQ ID NO: 1411671 - protein, 6 aa, Mycobacterium tuberculosis
TRGGRV

SEQ ID NO: 1411672 - protein, 8 aa, Mycobacterium tuberculosis
TRGRGADS

SEQ ID NO: 1411673 - protein, 5 aa, Mycobacterium tuberculosis
TRKPF

SEQ ID NO: 1411674 - protein, 17 aa, Mycobacterium tuberculosis
TRNDEPERASRPFDKDR

SEQ ID NO: 1411675 - protein, 7 aa, Mycobacterium tuberculosis
TRPDGTE

SEQ ID NO: 1411676 - protein, 14 aa, Mycobacterium tuberculosis
TRPNPDDPTGRSTM

SEQ ID NO: 1411677 - protein, 8 aa, Mycobacterium tuberculosis
TRPSEPGV

SEQ ID NO: 1411678 - protein, 4 aa, Mycobacterium tuberculosis
TRPT

SEQ ID NO: 1411679 - protein, 6 aa, Mycobacterium tuberculosis
TRPTIG

SEQ ID NO: 1411680 - protein, 5 aa, Mycobacterium tuberculosis
TRYTA

SEQ ID NO: 1411681 - protein, 8 aa, Mycobacterium tuberculosis
TSATPARA

SEQ ID NO: 1411682 - protein, 6 aa, Mycobacterium tuberculosis
TSEERQ

SEQ ID NO: 1411683 - protein, 5 aa, Mycobacterium tuberculosis
TSEGV

SEQ ID NO: 1411684 - protein, 6 aa, Mycobacterium tuberculosis
TSFGPK

SEQ ID NO: 1411685 - protein, 9 aa, Mycobacterium tuberculosis
TSGGAIPDR

SEQ ID NO: 1411686 - protein, 4 aa, Mycobacterium tuberculosis
TSGL

SEQ ID NO: 1411687 - protein, 8 aa, Mycobacterium tuberculosis
TSGPGATN

SEQ ID NO: 1411688 - protein, 10 aa, Mycobacterium tuberculosis
TSGSTRAPAG

SEQ ID NO: 1411689 - protein, 9 aa, Mycobacterium tuberculosis
TSGTTGQPK

SEQ ID NO: 1411690 - protein, 9 aa, Mycobacterium tuberculosis
TSHDGRYTR

SEQ ID NO: 1411691 - protein, 8 aa, Mycobacterium tuberculosis
TSHPETTQ

SEQ ID NO: 1411692 - protein, 6 aa, Mycobacterium tuberculosis
TSHRNY

SEQ ID NO: 1411693 - protein, 5 aa, Mycobacterium tuberculosis
TSLED

SEQ ID NO: 1411694 - protein, 5 aa, Mycobacterium tuberculosis
TSLKG

SEQ ID NO: 1411695 - protein, 9 aa, Mycobacterium tuberculosis
TSMRDRGSP

SEQ ID NO: 1411696 - protein, 5 aa, Mycobacterium tuberculosis
TSPGS

SEQ ID NO: 1411697 - protein, 8 aa, Mycobacterium tuberculosis
TSPNPELR

SEQ ID NO: 1411698 - protein, 14 aa, Mycobacterium tuberculosis
TSPSPSKRRTASRA

SEQ ID NO: 1411699 - protein, 15 aa, Mycobacterium tuberculosis
TSQPLPAPSPGKDCS

SEQ ID NO: 1411700 - protein, 4 aa, Mycobacterium tuberculosis
TSRS

SEQ ID NO: 1411701 - protein, 10 aa, Mycobacterium tuberculosis
TSSDALRQTA

SEQ ID NO: 1411702 - protein, 7 aa, Mycobacterium tuberculosis
TSSETVN

SEQ ID NO: 1411703 - protein, 20 aa, Mycobacterium tuberculosis
TSSNPTAGGAAVGSGIGPTR

SEQ ID NO: 1411704 - protein, 9 aa, Mycobacterium tuberculosis
TSTATGREA

SEQ ID NO: 1411705 - protein, 4 aa, Mycobacterium tuberculosis
TSVD

SEQ ID NO: 1411706 - protein, 7 aa, Mycobacterium tuberculosis
TSVGPDL

SEQ ID NO: 1411707 - protein, 6 aa, Mycobacterium tuberculosis
TSYTGQ

SEQ ID NO: 1411708 - protein, 5 aa, Mycobacterium tuberculosis
TTAGT

SEQ ID NO: 1411709 - protein, 6 aa, Mycobacterium tuberculosis
TTATPV

SEQ ID NO: 1411710 - protein, 7 aa, Mycobacterium tuberculosis
TTATTPD

SEQ ID NO: 1411711 - protein, 7 aa, Mycobacterium tuberculosis
TTDDGTG

SEQ ID NO: 1411712 - protein, 10 aa, Mycobacterium tuberculosis
TTDEGSQRVS

SEQ ID NO: 1411713 - protein, 5 aa, Mycobacterium tuberculosis
TTGEP

SEQ ID NO: 1411714 - protein, 17 aa, Mycobacterium tuberculosis
TTGGRTTGNDATPPDAI

SEQ ID NO: 1411715 - protein, 15 aa, Mycobacterium tuberculosis
TTGGSQKAVNADRSG

SEQ ID NO: 1411716 - protein, 6 aa, Mycobacterium tuberculosis
TTGSSG

SEQ ID NO: 1411717 - protein, 21 aa, Mycobacterium tuberculosis
TTIPTKRSETFTTADDNQPSV

SEQ ID NO: 1411718 - protein, 9 aa, Mycobacterium tuberculosis
TTNTTDLSG

SEQ ID NO: 1411719 - protein, 9 aa, Mycobacterium tuberculosis
TTPAASPAV

SEQ ID NO: 1411720 - protein, 7 aa, Mycobacterium tuberculosis
TTRGDGV

SEQ ID NO: 1411721 - protein, 4 aa, Mycobacterium tuberculosis
TTTA

SEQ ID NO: 1411722 - protein, 5 aa, Mycobacterium tuberculosis
TTTGD

SEQ ID NO: 1411723 - protein, 9 aa, Mycobacterium tuberculosis
TTVQPGPLA

SEQ ID NO: 1411724 - protein, 6 aa, Mycobacterium tuberculosis
TVAGGG

SEQ ID NO: 1411725 - protein, 13 aa, Mycobacterium tuberculosis
TVPVGSAPTPSGW

SEQ ID NO: 1411726 - protein, 8 aa, Mycobacterium tuberculosis
TWSSDGSG

SEQ ID NO: 1411727 - protein, 13 aa, Mycobacterium tuberculosis
TYDTASAAASARG

SEQ ID NO: 1411728 - protein, 4 aa, Mycobacterium tuberculosis
TYGG

SEQ ID NO: 1411729 - protein, 7 aa, Mycobacterium tuberculosis
TYKPYGP

SEQ ID NO: 1411730 - protein, 7 aa, Mycobacterium tuberculosis
VAAEGVA

SEQ ID NO: 1411731 - protein, 7 aa, Mycobacterium tuberculosis
VAEADRE

SEQ ID NO: 1411732 - protein, 10 aa, Mycobacterium tuberculosis
VAERGKAGLD

SEQ ID NO: 1411733 - protein, 11 aa, Mycobacterium tuberculosis
VAESGGGRGAI

SEQ ID NO: 1411734 - protein, 14 aa, Mycobacterium tuberculosis
VAGEGAAAPPVDVS

SEQ ID NO: 1411735 - protein, 9 aa, Mycobacterium tuberculosis
VAPAAQRVR

SEQ ID NO: 1411736 - protein, 13 aa, Mycobacterium tuberculosis
VDAPPGSGLGSSS

SEQ ID NO: 1411737 - protein, 12 aa, Mycobacterium tuberculosis
VDDGADPQAAEH

SEQ ID NO: 1411738 - protein, 8 aa, Mycobacterium tuberculosis
VDDGPTAL

SEQ ID NO: 1411739 - protein, 5 aa, Mycobacterium tuberculosis
VDEQT

SEQ ID NO: 1411740 - protein, 7 aa, Mycobacterium tuberculosis
VDGAGRR

SEQ ID NO: 1411741 - protein, 5 aa, Mycobacterium tuberculosis
VDPAT

SEQ ID NO: 1411742 - protein, 11 aa, Mycobacterium tuberculosis
VDPDGPVSVQP

SEQ ID NO: 1411743 - protein, 7 aa, Mycobacterium tuberculosis
VDPEQPD

SEQ ID NO: 1411744 - protein, 7 aa, Mycobacterium tuberculosis
VDPGRAR

SEQ ID NO: 1411745 - protein, 10 aa, Mycobacterium tuberculosis
VDQRGWSSRA

SEQ ID NO: 1411746 - protein, 15 aa, Mycobacterium tuberculosis
VDSAPAQRLGSTGSP

SEQ ID NO: 1411747 - protein, 11 aa, Mycobacterium tuberculosis
VDSEKGESDAA

SEQ ID NO: 1411748 - protein, 4 aa, Mycobacterium tuberculosis
VEAP

SEQ ID NO: 1411749 - protein, 4 aa, Mycobacterium tuberculosis
VEDE

SEQ ID NO: 1411750 - protein, 11 aa, Mycobacterium tuberculosis
VEGNATGASTY

SEQ ID NO: 1411751 - protein, 4 aa, Mycobacterium tuberculosis
VEQT

SEQ ID NO: 1411752 - protein, 9 aa, Mycobacterium tuberculosis
VGAPDQRGL

SEQ ID NO: 1411753 - protein, 10 aa, Mycobacterium tuberculosis
VGATAADEAA

SEQ ID NO: 1411754 - protein, 11 aa, Mycobacterium tuberculosis
VGDGQARIRTT

SEQ ID NO: 1411755 - protein, 17 aa, Mycobacterium tuberculosis
VGDTNTGSYNPGDTNTG

SEQ ID NO: 1411756 - protein, 5 aa, Mycobacterium tuberculosis
VGEDA

SEQ ID NO: 1411757 - protein, 16 aa, Mycobacterium tuberculosis
VGEPPDGAEAWVQWPR

SEQ ID NO: 1411758 - protein, 5 aa, Mycobacterium tuberculosis
VGGEL

SEQ ID NO: 1411759 - protein, 9 aa, Mycobacterium tuberculosis
VGGPTTSIG

SEQ ID NO: 1411760 - protein, 18 aa, Mycobacterium tuberculosis
VGGQPADRNAANRSRGSK

SEQ ID NO: 1411761 - protein, 10 aa, Mycobacterium tuberculosis
VGNTNTGNFN

SEQ ID NO: 1411762 - protein, 6 aa, Mycobacterium tuberculosis
VGPGVT

SEQ ID NO: 1411763 - protein, 8 aa, Mycobacterium tuberculosis
VGQPAREV

SEQ ID NO: 1411764 - protein, 8 aa, Mycobacterium tuberculosis
VGQPGSVG

SEQ ID NO: 1411765 - protein, 8 aa, Mycobacterium tuberculosis
VGRGGDDT

SEQ ID NO: 1411766 - protein, 6 aa, Mycobacterium tuberculosis
VGSERA

SEQ ID NO: 1411767 - protein, 13 aa, Mycobacterium tuberculosis
VGSGSGAGDGYHG

SEQ ID NO: 1411768 - protein, 7 aa, Mycobacterium tuberculosis
VGTNPRE

SEQ ID NO: 1411769 - protein, 6 aa, Mycobacterium tuberculosis
VGVTAN

SEQ ID NO: 1411770 - protein, 7 aa, Mycobacterium tuberculosis
VHPGGPT

SEQ ID NO: 1411771 - protein, 12 aa, Mycobacterium tuberculosis
VKAGDGVINPDG

SEQ ID NO: 1411772 - protein, 9 aa, Mycobacterium tuberculosis
VKAGPGERV

SEQ ID NO: 1411773 - protein, 11 aa, Mycobacterium tuberculosis
VKPATAVSDTT

SEQ ID NO: 1411774 - protein, 13 aa, Mycobacterium tuberculosis
VMPGGTTAHPDRD

SEQ ID NO: 1411775 - protein, 8 aa, Mycobacterium tuberculosis
VNGPEAEK

SEQ ID NO: 1411776 - protein, 12 aa, Mycobacterium tuberculosis
VNPPGANQREIA

SEQ ID NO: 1411777 - protein, 6 aa, Mycobacterium tuberculosis
VNRAGT

SEQ ID NO: 1411778 - protein, 6 aa, Mycobacterium tuberculosis
VNSGQA

SEQ ID NO: 1411779 - protein, 5 aa, Mycobacterium tuberculosis
VNTQR

SEQ ID NO: 1411780 - protein, 14 aa, Mycobacterium tuberculosis
VPADTANLREGADL

SEQ ID NO: 1411781 - protein, 6 aa, Mycobacterium tuberculosis
VPEKPR

SEQ ID NO: 1411782 - protein, 6 aa, Mycobacterium tuberculosis
VPESLR

SEQ ID NO: 1411783 - protein, 6 aa, Mycobacterium tuberculosis
VPGAAR

SEQ ID NO: 1411784 - protein, 9 aa, Mycobacterium tuberculosis
VPGGEPAAL

SEQ ID NO: 1411785 - protein, 11 aa, Mycobacterium tuberculosis
VPHERNPEVQQ

SEQ ID NO: 1411786 - protein, 7 aa, Mycobacterium tuberculosis
VPNRESA

SEQ ID NO: 1411787 - protein, 8 aa, Mycobacterium tuberculosis
VPPAKTDE

SEQ ID NO: 1411788 - protein, 5 aa, Mycobacterium tuberculosis
VPPAV

SEQ ID NO: 1411789 - protein, 6 aa, Mycobacterium tuberculosis
VPPDDY

SEQ ID NO: 1411790 - protein, 12 aa, Mycobacterium tuberculosis
VPPPKGEPDAPL

SEQ ID NO: 1411791 - protein, 5 aa, Mycobacterium tuberculosis
VPPSV

SEQ ID NO: 1411792 - protein, 6 aa, Mycobacterium tuberculosis
VPPSWT

SEQ ID NO: 1411793 - protein, 4 aa, Mycobacterium tuberculosis
VPRE

SEQ ID NO: 1411794 - protein, 12 aa, Mycobacterium tuberculosis
VPRGPLAAASAA

SEQ ID NO: 1411795 - protein, 8 aa, Mycobacterium tuberculosis
VPTASTTA

SEQ ID NO: 1411796 - protein, 10 aa, Mycobacterium tuberculosis
VPVPGDTGGA

SEQ ID NO: 1411797 - protein, 6 aa, Mycobacterium tuberculosis
VPWSSE

SEQ ID NO: 1411798 - protein, 13 aa, Mycobacterium tuberculosis
VQAAEGADAEAAA

SEQ ID NO: 1411799 - protein, 10 aa, Mycobacterium tuberculosis
VQARRTAPDT

SEQ ID NO: 1411800 - protein, 5 aa, Mycobacterium tuberculosis
VQDGK

SEQ ID NO: 1411801 - protein, 5 aa, Mycobacterium tuberculosis
VQPGE

SEQ ID NO: 1411802 - protein, 12 aa, Mycobacterium tuberculosis
VQPHSGATANAA

SEQ ID NO: 1411803 - protein, 10 aa, Mycobacterium tuberculosis
VQRSSRYPGG

SEQ ID NO: 1411804 - protein, 5 aa, Mycobacterium tuberculosis
VRDGS

SEQ ID NO: 1411805 - protein, 21 aa, Mycobacterium tuberculosis
VREGGPSAGRRHHPGGNGAPL

SEQ ID NO: 1411806 - protein, 7 aa, Mycobacterium tuberculosis
VRGLTGK

SEQ ID NO: 1411807 - protein, 37 aa, Mycobacterium tuberculosis; identical to SEQ ID NO: 191304

SEQ ID NO: 1411808 - protein, 7 aa, Mycobacterium tuberculosis
VRSSADA

SEQ ID NO: 1411809 - protein, 7 aa, Mycobacterium tuberculosis
VRTGEAP

SEQ ID NO: 1411810 - protein, 16 aa, Mycobacterium tuberculosis
VRVNTQPDPALPGPDG

SEQ ID NO: 1411811 - protein, 10 aa, Mycobacterium tuberculosis
VSDPGGPVTA

SEQ ID NO: 1411812 - protein, 19 aa, Mycobacterium tuberculosis
VSETGVLGDPTTATAAEGR

SEQ ID NO: 1411813 - protein, 7 aa, Mycobacterium tuberculosis
VSGAGGG

SEQ ID NO: 1411814 - protein, 7 aa, Mycobacterium tuberculosis
VSGEAEL

SEQ ID NO: 1411815 - protein, 5 aa, Mycobacterium tuberculosis
VSGER

SEQ ID NO: 1411816 - protein, 10 aa, Mycobacterium tuberculosis
VSGGRADPAM

SEQ ID NO: 1411817 - protein, 5 aa, Mycobacterium tuberculosis
VSGGT

SEQ ID NO: 1411818 - protein, 10 aa, Mycobacterium tuberculosis
VSGKTAARVA

SEQ ID NO: 1411819 - protein, 9 aa, Mycobacterium tuberculosis
VSPDAAPGM

SEQ ID NO: 1411820 - protein, 10 aa, Mycobacterium tuberculosis
VSPNQPPETV

SEQ ID NO: 1411821 - protein, 5 aa, Mycobacterium tuberculosis
VSRTQ

SEQ ID NO: 1411822 - protein, 10 aa, Mycobacterium tuberculosis
VSSEPLPTGD

SEQ ID NO: 1411823 - protein, 6 aa, Mycobacterium tuberculosis
VSTDPA

SEQ ID NO: 1411824 - protein, 5 aa, Mycobacterium tuberculosis
VTAAQ

SEQ ID NO: 1411825 - protein, 4 aa, Mycobacterium tuberculosis
VTDL

SEQ ID NO: 1411826 - protein, 9 aa, Mycobacterium tuberculosis
VTDQRSRAT

SEQ ID NO: 1411827 - protein, 7 aa, Mycobacterium tuberculosis
VTGPDEY

SEQ ID NO: 1411828 - protein, 8 aa, Mycobacterium tuberculosis
VTGPGEGA

SEQ ID NO: 1411829 - protein, 4 aa, Mycobacterium tuberculosis
VTPA

SEQ ID NO: 1411830 - protein, 7 aa, Mycobacterium tuberculosis
VTRNGEQ

SEQ ID NO: 1411831 - protein, 8 aa, Mycobacterium tuberculosis
VTSAGTGN

SEQ ID NO: 1411832 - protein, 10 aa, Mycobacterium tuberculosis
VTSPGGTTAA

SEQ ID NO: 1411833 - protein, 13 aa, Mycobacterium tuberculosis
VVPATADTSSQLT

SEQ ID NO: 1411834 - protein, 4 aa, Mycobacterium tuberculosis
VYGN

SEQ ID NO: 1411835 - protein, 6 aa, Mycobacterium tuberculosis
WEAPDP

SEQ ID NO: 1411836 - protein, 4 aa, Mycobacterium tuberculosis
WGDP

SEQ ID NO: 1411837 - protein, 12 aa, Mycobacterium tuberculosis
WGPTGTKPRGPS

SEQ ID NO: 1411838 - protein, 7 aa, Mycobacterium tuberculosis
WGSTPAA

SEQ ID NO: 1411839 - protein, 13 aa, Mycobacterium tuberculosis
WKTRKNAKGDTEW

SEQ ID NO: 1411840 - protein, 12 aa, Mycobacterium tuberculosis
WLGPSSAGMAAA

SEQ ID NO: 1411841 - protein, 7 aa, Mycobacterium tuberculosis
WNTEARQ

SEQ ID NO: 1411842 - protein, 7 aa, Mycobacterium tuberculosis
WPDPPGL

SEQ ID NO: 1411843 - protein, 9 aa, Mycobacterium tuberculosis
WPPAAGRAS

SEQ ID NO: 1411844 - protein, 7 aa, Mycobacterium tuberculosis
WSQDKVS

SEQ ID NO: 1411845 - protein, 7 aa, Mycobacterium tuberculosis
YAASQRS

SEQ ID NO: 1411846 - protein, 16 aa, Mycobacterium tuberculosis
YAGEPDEVGGPPIEEA

SEQ ID NO: 1411847 - protein, 4 aa, Mycobacterium tuberculosis
YAKA

SEQ ID NO: 1411848 - protein, 5 aa, Mycobacterium tuberculosis
YAPGD

SEQ ID NO: 1411849 - protein, 9 aa, Mycobacterium tuberculosis
YAPKSALGH

SEQ ID NO: 1411850 - protein, 11 aa, Mycobacterium tuberculosis
YAPKSPERTRL

SEQ ID NO: 1411851 - protein, 4 aa, Mycobacterium tuberculosis
YDDG

SEQ ID NO: 1411852 - protein, 6 aa, Mycobacterium tuberculosis
YDDGSI

SEQ ID NO: 1411853 - protein, 7 aa, Mycobacterium tuberculosis
YDPDGDS

SEQ ID NO: 1411854 - protein, 13 aa, Mycobacterium tuberculosis
YDPDPDAEGKTYT

SEQ ID NO: 1411855 - protein, 5 aa, Mycobacterium tuberculosis
YDPRS

SEQ ID NO: 1411856 - protein, 10 aa, Mycobacterium tuberculosis
YENGGLPTNE

SEQ ID NO: 1411857 - protein, 26 aa, Mycobacterium tuberculosis
YEPPPRNIPPCGQSSHAARRPHTPQL

SEQ ID NO: 1411858 - protein, 7 aa, Mycobacterium tuberculosis
YGNDGPC

SEQ ID NO: 1411859 - protein, 5 aa, Mycobacterium tuberculosis
YGNPT

SEQ ID NO: 1411860 - protein, 11 aa, Mycobacterium tuberculosis
YGNRDTGGLQG

SEQ ID NO: 1411861 - protein, 6 aa, Mycobacterium tuberculosis
YGPPAS

SEQ ID NO: 1411862 - protein, 16 aa, Mycobacterium tuberculosis
YGPRTGGKSKVSGSLR

SEQ ID NO: 1411863 - protein, 18 aa, Mycobacterium tuberculosis
YGTQAPGPAPPGMRVPPS

SEQ ID NO: 1411864 - protein, 20 aa, Mycobacterium tuberculosis
YLSGPAPEYPDGDTRGERMG

SEQ ID NO: 1411865 - protein, 9 aa, Mycobacterium tuberculosis
YNPEQAKRE

SEQ ID NO: 1411866 - protein, 8 aa, Mycobacterium tuberculosis
YPEPSPGA

SEQ ID NO: 1411867 - protein, 8 aa, Mycobacterium tuberculosis
YPQGTTAR

SEQ ID NO: 1411868 - protein, 4 aa, Mycobacterium tuberculosis
YPTT

SEQ ID NO: 1411869 - protein, 9 aa, Mycobacterium tuberculosis
YQPSGGRPV

SEQ ID NO: 1411870 - protein, 9 aa, Mycobacterium tuberculosis
YQSRQDPAV

SEQ ID NO: 1411871 - protein, 8 aa, Mycobacterium tuberculosis
YQSSPVPG

SEQ ID NO: 1411872 - protein, 9 aa, Mycobacterium tuberculosis
YRTPRPNPR

SEQ ID NO: 1411873 - protein, 9 aa, Mycobacterium tuberculosis
YSPNSPLGG

SEQ ID NO: 1411874 - protein, 12 aa, Mycobacterium tuberculosis
YSQIDDGAAGVF

SEQ ID NO: 1411875 - protein, 5 aa, Mycobacterium tuberculosis
YSSGG

SEQ ID NO: 1411876 - protein, 9 aa, Mycobacterium tuberculosis
YSSTSTRDI

SEQ ID NO: 1411877 - protein, 8 aa, Mycobacterium tuberculosis
YSTPESPV

SEQ ID NO: 1411878 - protein, 9 aa, Mycobacterium tuberculosis
YTSGQPDPD

SEQ ID NO: 1411879 - protein, 7 aa, Mycobacterium tuberculosis
YTSPEDF

SEQ ID NO: 1411880 - protein, 21 aa, Mycobacterium tuberculosis
YYPEAPGGRPGGRSIEPKPFN

SEQ ID NO: 1411881 - protein, 10 aa, Mycobacterium tuberculosis
AAAADAGAKA

SEQ ID NO: 1411882 - protein, 6 aa, Mycobacterium tuberculosis
AAAGAR

SEQ ID NO: 1411883 - protein, 12 aa, Mycobacterium tuberculosis
AAAGSAGKVATS

SEQ ID NO: 1411884 - protein, 8 aa, Mycobacterium tuberculosis
AAAGVGKG

SEQ ID NO: 1411885 - protein, 9 aa, Mycobacterium tuberculosis
AAAPEHERE

SEQ ID NO: 1411886 - protein, 12 aa, Mycobacterium tuberculosis
AAAPTANGPGGV

SEQ ID NO: 1411887 - protein, 9 aa, Mycobacterium tuberculosis
AAAQGRQAY

SEQ ID NO: 1411888 - protein, 7 aa, Mycobacterium tuberculosis
AAAQQEL

SEQ ID NO: 1411889 - protein, 4 aa, Mycobacterium tuberculosis
AAAR

SEQ ID NO: 1411890 - protein, 7 aa, Mycobacterium tuberculosis
AADPTAQ

SEQ ID NO: 1411891 - protein, 7 aa, Mycobacterium tuberculosis
AADRPAH

SEQ ID NO: 1411892 - protein, 13 aa, Mycobacterium tuberculosis
AADTRCDGRSRGQ

SEQ ID NO: 1411893 - protein, 13 aa, Mycobacterium tuberculosis
AADTTFDDRTRGQ

SEQ ID NO: 1411894 - protein, 8 aa, Mycobacterium tuberculosis
AAEAERAQ

SEQ ID NO: 1411895 - protein, 17 aa, Mycobacterium tuberculosis
AAEATGRGLAALKRALH

SEQ ID NO: 1411896 - protein, 10 aa, Mycobacterium tuberculosis
AAESSGVPES

SEQ ID NO: 1411897 - protein, 7 aa, Mycobacterium tuberculosis
AAGERER

SEQ ID NO: 1411898 - protein, 10 aa, Mycobacterium tuberculosis
AAGRNPKLGY

SEQ ID NO: 1411899 - protein, 5 aa, Mycobacterium tuberculosis
AAGRS

SEQ ID NO: 1411900 - protein, 25 aa, Mycobacterium tuberculosis
AAGTDRRKADSDDGHGASTWDPDTP

SEQ ID NO: 1411901 - protein, 9 aa, Mycobacterium tuberculosis
AAHGANRTG

SEQ ID NO: 1411902 - protein, 15 aa, Mycobacterium tuberculosis
AAHPTTGDASLPDDR

SEQ ID NO: 1411903 - protein, 8 aa, Mycobacterium tuberculosis
AAKGRDRE

SEQ ID NO: 1411904 - protein, 10 aa, Mycobacterium tuberculosis
AAKKDGDTLG

SEQ ID NO: 1411905 - protein, 16 aa, Mycobacterium tuberculosis
AALDDAADESANPVPR

SEQ ID NO: 1411906 - protein, 20 aa, Mycobacterium tuberculosis
AALGTTGLKDRVDAALRAAV

SEQ ID NO: 1411907 - protein, 9 aa, Mycobacterium tuberculosis
AALTPRPGV

SEQ ID NO: 1411908 - protein, 9 aa, Mycobacterium tuberculosis
AANAENDRT

SEQ ID NO: 1411909 - protein, 7 aa, Mycobacterium tuberculosis
AANTPAQ

SEQ ID NO: 1411910 - protein, 12 aa, Mycobacterium tuberculosis
AAPAHTDIATRT

SEQ ID NO: 1411911 - protein, 6 aa, Mycobacterium tuberculosis
AAPEEV

SEQ ID NO: 1411912 - protein, 13 aa, Mycobacterium tuberculosis
AAQAAAGKRCPPT

SEQ ID NO: 1411913 - protein, 14 aa, Mycobacterium tuberculosis
AARAAGAAAQAKAV

SEQ ID NO: 1411914 - protein, 14 aa, Mycobacterium tuberculosis
AARAAGASAQAKAV

SEQ ID NO: 1411915 - protein, 10 aa, Mycobacterium tuberculosis
AARAGAPEVS

SEQ ID NO: 1411916 - protein, 5 aa, Mycobacterium tuberculosis
AARYG

SEQ ID NO: 1411917 - protein, 9 aa, Mycobacterium tuberculosis
ADAPLGPGQ

SEQ ID NO: 1411918 - protein, 4 aa, Mycobacterium tuberculosis
ADGR

SEQ ID NO: 1411919 - protein, 7 aa, Mycobacterium tuberculosis
ADGSEYR

SEQ ID NO: 1411920 - protein, 7 aa, Mycobacterium tuberculosis
ADGTPLA

SEQ ID NO: 1411921 - protein, 23 aa, Mycobacterium tuberculosis
ADLPGSTTDIDHPPRPGDAPWST

SEQ ID NO: 1411922 - protein, 7 aa, Mycobacterium tuberculosis
ADPEAKG

SEQ ID NO: 1411923 - protein, 7 aa, Mycobacterium tuberculosis
ADPGAAF

SEQ ID NO: 1411924 - protein, 9 aa, Mycobacterium tuberculosis
ADPGAGNLA

SEQ ID NO: 1411925 - protein, 8 aa, Mycobacterium tuberculosis
ADTRSRAT

SEQ ID NO: 1411926 - protein, 4 aa, Mycobacterium tuberculosis
ADVE

SEQ ID NO: 1411927 - protein, 10 aa, Mycobacterium tuberculosis
AEAQRAAAGR

SEQ ID NO: 1411928 - protein, 6 aa, Mycobacterium tuberculosis
AEASGV

SEQ ID NO: 1411929 - protein, 10 aa, Mycobacterium tuberculosis
AEDPTRKPEF

SEQ ID NO: 1411930 - protein, 5 aa, Mycobacterium tuberculosis
AEGRV

SEQ ID NO: 1411931 - protein, 14 aa, Mycobacterium tuberculosis
AEGTAGEGGEVSPK

SEQ ID NO: 1411932 - protein, 18 aa, Mycobacterium tuberculosis
AEHRPGRSTRRLEPRTLP

SEQ ID NO: 1411933 - protein, 6 aa, Mycobacterium tuberculosis
AEKGGY

SEQ ID NO: 1411934 - protein, 10 aa, Mycobacterium tuberculosis
AELAGNTDEH

SEQ ID NO: 1411935 - protein, 8 aa, Mycobacterium tuberculosis
AELPGPPV

SEQ ID NO: 1411936 - protein, 12 aa, Mycobacterium tuberculosis
AERGEQELKGVP

SEQ ID NO: 1411937 - protein, 4 aa, Mycobacterium tuberculosis
AGAD

SEQ ID NO: 1411938 - protein, 15 aa, Mycobacterium tuberculosis
AGAGSGVANAGTLSS

SEQ ID NO: 1411939 - protein, 6 aa, Mycobacterium tuberculosis
AGASAV

SEQ ID NO: 1411940 - protein, 11 aa, Mycobacterium tuberculosis
AGASDRRARAD

SEQ ID NO: 1411941 - protein, 8 aa, Mycobacterium tuberculosis
AGDCAPAA

SEQ ID NO: 1411942 - protein, 7 aa, Mycobacterium tuberculosis
AGDDGDT

SEQ ID NO: 1411943 - protein, 6 aa, Mycobacterium tuberculosis
AGDEVS

SEQ ID NO: 1411944 - protein, 5 aa, Mycobacterium tuberculosis
AGDPV

SEQ ID NO: 1411945 - protein, 8 aa, Mycobacterium tuberculosis
AGEAATAG

SEQ ID NO: 1411946 - protein, 18 aa, Mycobacterium tuberculosis
AGEATPTQRLVALTGRKP

SEQ ID NO: 1411947 - protein, 6 aa, Mycobacterium tuberculosis
AGEIDE

SEQ ID NO: 1411948 - protein, 5 aa, Mycobacterium tuberculosis
AGEQR

SEQ ID NO: 1411949 - protein, 8 aa, Mycobacterium tuberculosis
AGFGGGGV

SEQ ID NO: 1411950 - protein, 7 aa, Mycobacterium tuberculosis
AGGGGTL

SEQ ID NO: 1411951 - protein, 8 aa, Mycobacterium tuberculosis
AGGKSTID

SEQ ID NO: 1411952 - protein, 8 aa, Mycobacterium tuberculosis
AGGNSAGL

SEQ ID NO: 1411953 - protein, 4 aa, Mycobacterium tuberculosis
AGLP

SEQ ID NO: 1411954 - protein, 9 aa, Mycobacterium tuberculosis
AGNLGGSNL

SEQ ID NO: 1411955 - protein, 5 aa, Mycobacterium tuberculosis
AGPGD

SEQ ID NO: 1411956 - protein, 5 aa, Mycobacterium tuberculosis
AGPHG

SEQ ID NO: 1411957 - protein, 7 aa, Mycobacterium tuberculosis
AGPPEQV

SEQ ID NO: 1411958 - protein, 6 aa, Mycobacterium tuberculosis
AGPQFD

SEQ ID NO: 1411959 - protein, 4 aa, Mycobacterium tuberculosis
AGQG

SEQ ID NO: 1411960 - protein, 6 aa, Mycobacterium tuberculosis
AGQPRV

SEQ ID NO: 1411961 - protein, 7 aa, Mycobacterium tuberculosis
AGRPAQI

SEQ ID NO: 1411962 - protein, 4 aa, Mycobacterium tuberculosis
AGRY

SEQ ID NO: 1411963 - protein, 4 aa, Mycobacterium tuberculosis
AGSA

SEQ ID NO: 1411964 - protein, 14 aa, Mycobacterium tuberculosis
AGSGTGTGGAGPRY

SEQ ID NO: 1411965 - protein, 7 aa, Mycobacterium tuberculosis
AGTEPDH

SEQ ID NO: 1411966 - protein, 10 aa, Mycobacterium tuberculosis
AGTGGPDVRT

SEQ ID NO: 1411967 - protein, 5 aa, Mycobacterium tuberculosis
AGTGI

SEQ ID NO: 1411968 - protein, 16 aa, Mycobacterium tuberculosis
AGTGTPAGPPAPFGPD

SEQ ID NO: 1411969 - protein, 4 aa, Mycobacterium tuberculosis
AGTN

SEQ ID NO: 1411970 - protein, 9 aa, Mycobacterium tuberculosis
AGTRGPLTD

SEQ ID NO: 1411971 - protein, 9 aa, Mycobacterium tuberculosis
AHAGPPGPV

SEQ ID NO: 1411972 - protein, 6 aa, Mycobacterium tuberculosis
AHDDGS

SEQ ID NO: 1411973 - protein, 6 aa, Mycobacterium tuberculosis
AHPVTD

SEQ ID NO: 1411974 - protein, 16 aa, Mycobacterium tuberculosis
AIADGDSVTILPAVAG

SEQ ID NO: 1411975 - protein, 10 aa, Mycobacterium tuberculosis
AIDDTASALG

SEQ ID NO: 1411976 - protein, 6 aa, Mycobacterium tuberculosis
AIEDQS

SEQ ID NO: 1411977 - protein, 12 aa, Mycobacterium tuberculosis
AIEPADLDDPDA

SEQ ID NO: 1411978 - protein, 13 aa, Mycobacterium tuberculosis
AIHNGKKDADPYR

SEQ ID NO: 1411979 - protein, 21 aa, Mycobacterium tuberculosis
AINNDGSAKMGYAAPNPAAQA

SEQ ID NO: 1411980 - protein, 7 aa, Mycobacterium tuberculosis
AIPPDGP

SEQ ID NO: 1411981 - protein, 21 aa, Mycobacterium tuberculosis
AKASEKARKSVADDVHTGQPA

SEQ ID NO: 1411982 - protein, 7 aa, Mycobacterium tuberculosis
AKDPGRS

SEQ ID NO: 1411983 - protein, 8 aa, Mycobacterium tuberculosis
AKGERTWR

SEQ ID NO: 1411984 - protein, 15 aa, Mycobacterium tuberculosis
AKPGARFRQDRQNRL

SEQ ID NO: 1411985 - protein, 8 aa, Mycobacterium tuberculosis
AKQGTNIE

SEQ ID NO: 1411986 - protein, 7 aa, Mycobacterium tuberculosis
AKTDGNS

SEQ ID NO: 1411987 - protein, 14 aa, Mycobacterium tuberculosis
ALADGDGPEPPLRT

SEQ ID NO: 1411988 - protein, 4 aa, Mycobacterium tuberculosis
ALER

SEQ ID NO: 1411989 - protein, 13 aa, Mycobacterium tuberculosis
ALGPGGLSRERAG

SEQ ID NO: 1411990 - protein, 7 aa, Mycobacterium tuberculosis
ALPPTEP

SEQ ID NO: 1411991 - protein, 6 aa, Mycobacterium tuberculosis
ALRPGD

SEQ ID NO: 1411992 - protein, 13 aa, Mycobacterium tuberculosis
ALSPAVDSVSGGS

SEQ ID NO: 1411993 - protein, 8 aa, Mycobacterium tuberculosis
ALSPTGRC

SEQ ID NO: 1411994 - protein, 18 aa, Mycobacterium tuberculosis
AMGARGEGSGQEKPVEKR

SEQ ID NO: 1411995 - protein, 7 aa, Mycobacterium tuberculosis
ANIGGAN

SEQ ID NO: 1411996 - protein, 17 aa, Mycobacterium tuberculosis
ANIGNGNIGSGNIGSSN

SEQ ID NO: 1411997 - protein, 6 aa, Mycobacterium tuberculosis
ANLGDT

SEQ ID NO: 1411998 - protein, 7 aa, Mycobacterium tuberculosis
ANPDMEA

SEQ ID NO: 1411999 - protein, 5 aa, Mycobacterium tuberculosis
ANRDG

SEQ ID NO: 1412000 - protein, 7 aa, Mycobacterium tuberculosis
APDDGLR

SEQ ID NO: 1412001 - protein, 10 aa, Mycobacterium tuberculosis
APDSRYPASM

SEQ ID NO: 1412002 - protein, 4 aa, Mycobacterium tuberculosis
APEA

SEQ ID NO: 1412003 - protein, 13 aa, Mycobacterium tuberculosis
APGFGNSTQMPSS

SEQ ID NO: 1412004 - protein, 14 aa, Mycobacterium tuberculosis
APGFGNSTTTPSSG

SEQ ID NO: 1412005 - protein, 11 aa, Mycobacterium tuberculosis
APGSGADLTSP

SEQ ID NO: 1412006 - protein, 4 aa, Mycobacterium tuberculosis
APHE

SEQ ID NO: 1412007 - protein, 11 aa, Mycobacterium tuberculosis
APHGPAEAQGG

SEQ ID NO: 1412008 - protein, 23 aa, Mycobacterium tuberculosis
APPTEASAALEPALETPESPVET

SEQ ID NO: 1412009 - protein, 15 aa, Mycobacterium tuberculosis
APPTSVAASADHGES

SEQ ID NO: 1412010 - protein, 18 aa, Mycobacterium tuberculosis
APQAADALAAEQAERGRT

SEQ ID NO: 1412011 - protein, 6 aa, Mycobacterium tuberculosis
APRTVR

SEQ ID NO: 1412012 - protein, 9 aa, Mycobacterium tuberculosis
APSAGTPVG

SEQ ID NO: 1412013 - protein, 5 aa, Mycobacterium tuberculosis
APTQR

SEQ ID NO: 1412014 - protein, 10 aa, Mycobacterium tuberculosis
APYGVEPQQA

SEQ ID NO: 1412015 - protein, 7 aa, Mycobacterium tuberculosis
AQAAANA

SEQ ID NO: 1412016 - protein, 8 aa, Mycobacterium tuberculosis
AQGTPEDV

SEQ ID NO: 1412017 - protein, 12 aa, Mycobacterium tuberculosis
AQQPTSARPGDE

SEQ ID NO: 1412018 - protein, 8 aa, Mycobacterium tuberculosis
AQQRESFG

SEQ ID NO: 1412019 - protein, 12 aa, Mycobacterium tuberculosis
AQQSANPTLPRQ

SEQ ID NO: 1412020 - protein, 15 aa, Mycobacterium tuberculosis
AQRGAQCGQREKSCR

SEQ ID NO: 1412021 - protein, 8 aa, Mycobacterium tuberculosis
AQRRDPDA

SEQ ID NO: 1412022 - protein, 8 aa, Mycobacterium tuberculosis
AQVPPTQA

SEQ ID NO: 1412023 - protein, 18 aa, Mycobacterium tuberculosis
ARGGSSGRAGVKCRRPTG

SEQ ID NO: 1412024 - protein, 4 aa, Mycobacterium tuberculosis
ARGR

SEQ ID NO: 1412025 - protein, 11 aa, Mycobacterium tuberculosis
ARGTKYPDEVE

SEQ ID NO: 1412026 - protein, 6 aa, Mycobacterium tuberculosis
ARHSSG

SEQ ID NO: 1412027 - protein, 9 aa, Mycobacterium tuberculosis
ARKAADSTV

SEQ ID NO: 1412028 - protein, 5 aa, Mycobacterium tuberculosis
ARLAE

SEQ ID NO: 1412029 - protein, 5 aa, Mycobacterium tuberculosis
ARLAQ

SEQ ID NO: 1412030 - protein, 10 aa, Mycobacterium tuberculosis
ARPNSKASIG

SEQ ID NO: 1412031 - protein, 14 aa, Mycobacterium tuberculosis
ARRDDDAKRWADGQ

SEQ ID NO: 1412032 - protein, 6 aa, Mycobacterium tuberculosis
ARRDRP

SEQ ID NO: 1412033 - protein, 6 aa, Mycobacterium tuberculosis
ARRSAD

SEQ ID NO: 1412034 - protein, 4 aa, Mycobacterium tuberculosis
ARRW

SEQ ID NO: 1412035 - protein, 11 aa, Mycobacterium tuberculosis
ARSGDKGGSAN

SEQ ID NO: 1412036 - protein, 8 aa, Mycobacterium tuberculosis
ARTRSPLS

SEQ ID NO: 1412037 - protein, 8 aa, Mycobacterium tuberculosis
ARTTPEAA

SEQ ID NO: 1412038 - protein, 6 aa, Mycobacterium tuberculosis
ASAGRK

SEQ ID NO: 1412039 - protein, 6 aa, Mycobacterium tuberculosis
ASDPEG

SEQ ID NO: 1412040 - protein, 10 aa, Mycobacterium tuberculosis
ASDRGDAERG

SEQ ID NO: 1412041 - protein, 7 aa, Mycobacterium tuberculosis
ASEHTTG

SEQ ID NO: 1412042 - protein, 5 aa, Mycobacterium tuberculosis
ASEIK

SEQ ID NO: 1412043 - protein, 8 aa, Mycobacterium tuberculosis
ASGGIRTA

SEQ ID NO: 1412044 - protein, 7 aa, Mycobacterium tuberculosis
ASNTSSI

SEQ ID NO: 1412045 - protein, 16 aa, Mycobacterium tuberculosis
ASQQSRPVGSRAQLDN

SEQ ID NO: 1412046 - protein, 5 aa, Mycobacterium tuberculosis
ASQRA

SEQ ID NO: 1412047 - protein, 9 aa, Mycobacterium tuberculosis
ASRTATTAG

SEQ ID NO: 1412048 - protein, 9 aa, Mycobacterium tuberculosis
ASSADDVPR

SEQ ID NO: 1412049 - protein, 7 aa, Mycobacterium tuberculosis
ASSLRKA

SEQ ID NO: 1412050 - protein, 11 aa, Mycobacterium tuberculosis
ASSQDALRQTA

SEQ ID NO: 1412051 - protein, 8 aa, Mycobacterium tuberculosis
ASSRLDDE

SEQ ID NO: 1412052 - protein, 10 aa, Mycobacterium tuberculosis
ASTEVRADST

SEQ ID NO: 1412053 - protein, 6 aa, Mycobacterium tuberculosis
ASTGAT

SEQ ID NO: 1412054 - protein, 8 aa, Mycobacterium tuberculosis
ASYTGPDG

SEQ ID NO: 1412055 - protein, 6 aa, Mycobacterium tuberculosis
ATADQP

SEQ ID NO: 1412056 - protein, 13 aa, Mycobacterium tuberculosis
ATGRESDARNELA

SEQ ID NO: 1412057 - protein, 5 aa, Mycobacterium tuberculosis
ATIGG

SEQ ID NO: 1412058 - protein, 12 aa, Mycobacterium tuberculosis
ATKAALGDHDEN

SEQ ID NO: 1412059 - protein, 14 aa, Mycobacterium tuberculosis
ATRSSGQDSAGYGR

SEQ ID NO: 1412060 - protein, 4 aa, Mycobacterium tuberculosis
ATSL

SEQ ID NO: 1412061 - protein, 5 aa, Mycobacterium tuberculosis
ATTAG

SEQ ID NO: 1412062 - protein, 9 aa, Mycobacterium tuberculosis
AVDRGGAQL

SEQ ID NO: 1412063 - protein, 7 aa, Mycobacterium tuberculosis
AVGTPTM

SEQ ID NO: 1412064 - protein, 12 aa, Mycobacterium tuberculosis
AVKTTPKDAVEN

SEQ ID NO: 1412065 - protein, 5 aa, Mycobacterium tuberculosis
AVRDQ

SEQ ID NO: 1412066 - protein, 13 aa, Mycobacterium tuberculosis
AVRDSRPAVGQRG

SEQ ID NO: 1412067 - protein, 9 aa, Mycobacterium tuberculosis
AVSSSGPDR

SEQ ID NO: 1412068 - protein, 5 aa, Mycobacterium tuberculosis
CEPGR

SEQ ID NO: 1412069 - protein, 11 aa, Mycobacterium tuberculosis
CGGPPIAAATR

SEQ ID NO: 1412070 - protein, 6 aa, Mycobacterium tuberculosis
CKRGEV

SEQ ID NO: 1412071 - protein, 6 aa, Mycobacterium tuberculosis
CTNTEQ

SEQ ID NO: 1412072 - protein, 11 aa, Mycobacterium tuberculosis
DAAPDSPTAAK

SEQ ID NO: 1412073 - protein, 6 aa, Mycobacterium tuberculosis
DAGPTL

SEQ ID NO: 1412074 - protein, 22 aa, Mycobacterium tuberculosis
DAGPWQRDGALSRSAVAGRRRS

SEQ ID NO: 1412075 - protein, 6 aa, Mycobacterium tuberculosis
DAIAGG

SEQ ID NO: 1412076 - protein, 6 aa, Mycobacterium tuberculosis
DAPARY

SEQ ID NO: 1412077 - protein, 7 aa, Mycobacterium tuberculosis
DAPASEL

SEQ ID NO: 1412078 - protein, 5 aa, Mycobacterium tuberculosis
DAQAL

SEQ ID NO: 1412079 - protein, 12 aa, Mycobacterium tuberculosis
DAREGLDRPSDT

SEQ ID NO: 1412080 - protein, 6 aa, Mycobacterium tuberculosis
DATTPA

SEQ ID NO: 1412081 - protein, 12 aa, Mycobacterium tuberculosis
DCTNAASLQQQA

SEQ ID NO: 1412082 - protein, 7 aa, Mycobacterium tuberculosis
DDEAPAC

SEQ ID NO: 1412083 - protein, 6 aa, Mycobacterium tuberculosis
DDGPGL

SEQ ID NO: 1412084 - protein, 11 aa, Mycobacterium tuberculosis
DDGRRAVDAGA

SEQ ID NO: 1412085 - protein, 9 aa, Mycobacterium tuberculosis
DDKYDGSQN

SEQ ID NO: 1412086 - protein, 14 aa, Mycobacterium tuberculosis
DDPDATPGVCRASR

SEQ ID NO: 1412087 - protein, 8 aa, Mycobacterium tuberculosis
DDPEANHA

SEQ ID NO: 1412088 - protein, 17 aa, Mycobacterium tuberculosis
DDPQPGWYDTESGEMVD

SEQ ID NO: 1412089 - protein, 7 aa, Mycobacterium tuberculosis
DDPTDES

SEQ ID NO: 1412090 - protein, 4 aa, Mycobacterium tuberculosis
DENR

SEQ ID NO: 1412091 - protein, 9 aa, Mycobacterium tuberculosis
DEPALTASD

SEQ ID NO: 1412092 - protein, 10 aa, Mycobacterium tuberculosis
DERTSWAPDE

SEQ ID NO: 1412093 - protein, 5 aa, Mycobacterium tuberculosis
DFKRP

SEQ ID NO: 1412094 - protein, 4 aa, Mycobacterium tuberculosis
DGAA

SEQ ID NO: 1412095 - protein, 16 aa, Mycobacterium tuberculosis
DGAAGAPGTGQAGGAG

SEQ ID NO: 1412096 - protein, 7 aa, Mycobacterium tuberculosis
DGAASPV

SEQ ID NO: 1412097 - protein, 15 aa, Mycobacterium tuberculosis
DGANGGPGQNGGDGG

SEQ ID NO: 1412098 - protein, 4 aa, Mycobacterium tuberculosis
DGAP

SEQ ID NO: 1412099 - protein, 17 aa, Mycobacterium tuberculosis
DGASQLRDASAAQRQQR

SEQ ID NO: 1412100 - protein, 8 aa, Mycobacterium tuberculosis
DGDTGTVA

SEQ ID NO: 1412101 - protein, 8 aa, Mycobacterium tuberculosis
DGEDGEPQ

SEQ ID NO: 1412102 - protein, 9 aa, Mycobacterium tuberculosis
DGEREAEGV

SEQ ID NO: 1412103 - protein, 16 aa, Mycobacterium tuberculosis
DGERGRARTQREQRAK

SEQ ID NO: 1412104 - protein, 5 aa, Mycobacterium tuberculosis
DGGNT

SEQ ID NO: 1412105 - protein, 7 aa, Mycobacterium tuberculosis
DGGTRPY

SEQ ID NO: 1412106 - protein, 8 aa, Mycobacterium tuberculosis
DGGVPQTQ

SEQ ID NO: 1412107 - protein, 6 aa, Mycobacterium tuberculosis
DGLSPL

SEQ ID NO: 1412108 - protein, 10 aa, Mycobacterium tuberculosis
DGNDGLQAGR

SEQ ID NO: 1412109 - protein, 8 aa, Mycobacterium tuberculosis
DGPVRGNG

SEQ ID NO: 1412110 - protein, 7 aa, Mycobacterium tuberculosis
DGQPLGR

SEQ ID NO: 1412111 - protein, 8 aa, Mycobacterium tuberculosis
DGQPMPPV

SEQ ID NO: 1412112 - protein, 7 aa, Mycobacterium tuberculosis
DGRDGQT

SEQ ID NO: 1412113 - protein, 8 aa, Mycobacterium tuberculosis
DGRRPRQT

SEQ ID NO: 1412114 - protein, 9 aa, Mycobacterium tuberculosis
DGRRTRDMP

SEQ ID NO: 1412115 - protein, 16 aa, Mycobacterium tuberculosis
DGRSAAQAIEDGVEPR

SEQ ID NO: 1412116 - protein, 19 aa, Mycobacterium tuberculosis
DGSAETEISIPDEAPRHPG

SEQ ID NO: 1412117 - protein, 10 aa, Mycobacterium tuberculosis
DGSGAADETV

SEQ ID NO: 1412118 - protein, 5 aa, Mycobacterium tuberculosis
DGSMD

SEQ ID NO: 1412119 - protein, 12 aa, Mycobacterium tuberculosis
DGTHGGTGGGNH

SEQ ID NO: 1412120 - protein, 6 aa, Mycobacterium tuberculosis
DHGGSL

SEQ ID NO: 1412121 - protein, 6 aa, Mycobacterium tuberculosis
DITEDL

SEQ ID NO: 1412122 - protein, 5 aa, Mycobacterium tuberculosis
DKGKL

SEQ ID NO: 1412123 - protein, 4 aa, Mycobacterium tuberculosis
DLAS

SEQ ID NO: 1412124 - protein, 11 aa, Mycobacterium tuberculosis
DLDDEAAAAAE

SEQ ID NO: 1412125 - protein, 9 aa, Mycobacterium tuberculosis
DLTPQPPSI

SEQ ID NO: 1412126 - protein, 12 aa, Mycobacterium tuberculosis
DLVPEDRAGDHA

SEQ ID NO: 1412127 - protein, 6 aa, Mycobacterium tuberculosis
DNLPEA

SEQ ID NO: 1412128 - protein, 4 aa, Mycobacterium tuberculosis
DPAP

SEQ ID NO: 1412129 - protein, 7 aa, Mycobacterium tuberculosis
DPARGRA

SEQ ID NO: 1412130 - protein, 17 aa, Mycobacterium tuberculosis
DPASGEEITAQNGRYGP

SEQ ID NO: 1412131 - protein, 7 aa, Mycobacterium tuberculosis
DPATGRV

SEQ ID NO: 1412132 - protein, 7 aa, Mycobacterium tuberculosis
DPDASLG

SEQ ID NO: 1412133 - protein, 7 aa, Mycobacterium tuberculosis
DPDSGRT

SEQ ID NO: 1412134 - protein, 16 aa, Mycobacterium tuberculosis
DPEAAARYAANPERSI

SEQ ID NO: 1412135 - protein, 18 aa, Mycobacterium tuberculosis
DPERAPAARSLDAAKHQQ

SEQ ID NO: 1412136 - protein, 13 aa, Mycobacterium tuberculosis
DPGPRTSSATTIT

SEQ ID NO: 1412137 - protein, 8 aa, Mycobacterium tuberculosis
DPLEPGGR

SEQ ID NO: 1412138 - protein, 12 aa, Mycobacterium tuberculosis
DPTSVADDFTRP

SEQ ID NO: 1412139 - protein, 21 aa, Mycobacterium tuberculosis
DPTTNTVTGSPITVGTAPTGV

SEQ ID NO: 1412140 - protein, 6 aa, Mycobacterium tuberculosis
DQDELA

SEQ ID NO: 1412141 - protein, 6 aa, Mycobacterium tuberculosis
DQPGVT

SEQ ID NO: 1412142 - protein, 7 aa, Mycobacterium tuberculosis
DQPPFDL

SEQ ID NO: 1412143 - protein, 14 aa, Mycobacterium tuberculosis
DQRGYGGSSRPEAI

SEQ ID NO: 1412144 - protein, 8 aa, Mycobacterium tuberculosis
DRASAGAH

SEQ ID NO: 1412145 - protein, 6 aa, Mycobacterium tuberculosis
DRDPRT

SEQ ID NO: 1412146 - protein, 7 aa, Mycobacterium tuberculosis
DREELQP

SEQ ID NO: 1412147 - protein, 9 aa, Mycobacterium tuberculosis
DRGAGGEVQ

SEQ ID NO: 1412148 - protein, 19 aa, Mycobacterium tuberculosis
DRNLGPGHGARRISSDDSP

SEQ ID NO: 1412149 - protein, 12 aa, Mycobacterium tuberculosis
DRNPTGSIKDRP

SEQ ID NO: 1412150 - protein, 7 aa, Mycobacterium tuberculosis
DRPKEQY

SEQ ID NO: 1412151 - protein, 5 aa, Mycobacterium tuberculosis
DRRTT

SEQ ID NO: 1412152 - protein, 9 aa, Mycobacterium tuberculosis
DRSADDAAA

SEQ ID NO: 1412153 - protein, 4 aa, Mycobacterium tuberculosis
DRSG

SEQ ID NO: 1412154 - protein, 10 aa, Mycobacterium tuberculosis
DRVGRQSGAT

SEQ ID NO: 1412155 - protein, 5 aa, Mycobacterium tuberculosis
DSAAA

SEQ ID NO: 1412156 - protein, 5 aa, Mycobacterium tuberculosis
DSAEY

SEQ ID NO: 1412157 - protein, 5 aa, Mycobacterium tuberculosis
DSGYP

SEQ ID NO: 1412158 - protein, 7 aa, Mycobacterium tuberculosis
DSPALRT

SEQ ID NO: 1412159 - protein, 7 aa, Mycobacterium tuberculosis
DSPYVGT

SEQ ID NO: 1412160 - protein, 5 aa, Mycobacterium tuberculosis
DSRAA

SEQ ID NO: 1412161 - protein, 7 aa, Mycobacterium tuberculosis
DTDPRRA

SEQ ID NO: 1412162 - protein, 9 aa, Mycobacterium tuberculosis
DTGPDGDTT

SEQ ID NO: 1412163 - protein, 6 aa, Mycobacterium tuberculosis
DTGQAD

SEQ ID NO: 1412164 - protein, 10 aa, Mycobacterium tuberculosis
DTPAGPPGST

SEQ ID NO: 1412165 - protein, 7 aa, Mycobacterium tuberculosis
DVDNAER

SEQ ID NO: 1412166 - protein, 7 aa, Mycobacterium tuberculosis
DVGSNRV

SEQ ID NO: 1412167 - protein, 17 aa, Mycobacterium tuberculosis
DVTPQPHNGVRPPKRRR

SEQ ID NO: 1412168 - protein, 12 aa, Mycobacterium tuberculosis
EAAAGAGLTGGG

SEQ ID NO: 1412169 - protein, 8 aa, Mycobacterium tuberculosis
EAAAMDPQ

SEQ ID NO: 1412170 - protein, 17 aa, Mycobacterium tuberculosis
EADEGKAPAGRTPGLPG

SEQ ID NO: 1412171 - protein, 11 aa, Mycobacterium tuberculosis
EADSKATGPGV

SEQ ID NO: 1412172 - protein, 4 aa, Mycobacterium tuberculosis
EAEN

SEQ ID NO: 1412173 - protein, 7 aa, Mycobacterium tuberculosis
EAGGDPW

SEQ ID NO: 1412174 - protein, 25 aa, Mycobacterium tuberculosis
EAPPRSVPSHGEPLGSAAPEGLEGE

SEQ ID NO: 1412175 - protein, 9 aa, Mycobacterium tuberculosis
EAQRDTSTS

SEQ ID NO: 1412176 - protein, 5 aa, Mycobacterium tuberculosis
EARED

SEQ ID NO: 1412177 - protein, 4 aa, Mycobacterium tuberculosis
EDAQ

SEQ ID NO: 1412178 - protein, 15 aa, Mycobacterium tuberculosis
EDGSPVRGVSGGTDR

SEQ ID NO: 1412179 - protein, 9 aa, Mycobacterium tuberculosis
EDTGELTPT

SEQ ID NO: 1412180 - protein, 5 aa, Mycobacterium tuberculosis
EEAAS

SEQ ID NO: 1412181 - protein, 5 aa, Mycobacterium tuberculosis
EEGPW

SEQ ID NO: 1412182 - protein, 10 aa, Mycobacterium tuberculosis
EELESPPTNT

SEQ ID NO: 1412183 - protein, 4 aa, Mycobacterium tuberculosis
EFSE

SEQ ID NO: 1412184 - protein, 4 aa, Mycobacterium tuberculosis
EGFS

SEQ ID NO: 1412185 - protein, 5 aa, Mycobacterium tuberculosis
EGITT

SEQ ID NO: 1412186 - protein, 5 aa, Mycobacterium tuberculosis
EGKPA

SEQ ID NO: 1412187 - protein, 7 aa, Mycobacterium tuberculosis
EGLASGQ

SEQ ID NO: 1412188 - protein, 12 aa, Mycobacterium tuberculosis
EGPGADSLSAAA

SEQ ID NO: 1412189 - protein, 4 aa, Mycobacterium tuberculosis
EGRQ

SEQ ID NO: 1412190 - protein, 10 aa, Mycobacterium tuberculosis
EGRSLGDPET

SEQ ID NO: 1412191 - protein, 7 aa, Mycobacterium tuberculosis
EGSADPH

SEQ ID NO: 1412192 - protein, 5 aa, Mycobacterium tuberculosis
EHPTY

SEQ ID NO: 1412193 - protein, 11 aa, Mycobacterium tuberculosis
EHTGNTSAASI

SEQ ID NO: 1412194 - protein, 6 aa, Mycobacterium tuberculosis
EIGKSS

SEQ ID NO: 1412195 - protein, 11 aa, Mycobacterium tuberculosis
EIGPEDCPEAP

SEQ ID NO: 1412196 - protein, 6 aa, Mycobacterium tuberculosis
ELDPAG

SEQ ID NO: 1412197 - protein, 13 aa, Mycobacterium tuberculosis
ELGSAASSFGSVT

SEQ ID NO: 1412198 - protein, 8 aa, Mycobacterium tuberculosis
ELKAADSL

SEQ ID NO: 1412199 - protein, 12 aa, Mycobacterium tuberculosis
ELPGARDQLRGT

SEQ ID NO: 1412200 - protein, 10 aa, Mycobacterium tuberculosis
ELQSTAADYG

SEQ ID NO: 1412201 - protein, 4 aa, Mycobacterium tuberculosis
ELRT

SEQ ID NO: 1412202 - protein, 7 aa, Mycobacterium tuberculosis
ELTGRTR

SEQ ID NO: 1412203 - protein, 9 aa, Mycobacterium tuberculosis
EMDEPESRG

SEQ ID NO: 1412204 - protein, 9 aa, Mycobacterium tuberculosis
EMSEESRVR

SEQ ID NO: 1412205 - protein, 7 aa, Mycobacterium tuberculosis
ENPSARD

SEQ ID NO: 1412206 - protein, 5 aa, Mycobacterium tuberculosis
EPAKP

SEQ ID NO: 1412207 - protein, 9 aa, Mycobacterium tuberculosis
EPDGPPGVS

SEQ ID NO: 1412208 - protein, 4 aa, Mycobacterium tuberculosis
EPEL

SEQ ID NO: 1412209 - protein, 19 aa, Mycobacterium tuberculosis
EPGAGSDLASLATKATRVD

SEQ ID NO: 1412210 - protein, 13 aa, Mycobacterium tuberculosis
EPGTPPGSIGRGA

SEQ ID NO: 1412211 - protein, 15 aa, Mycobacterium tuberculosis
EPTTGAQLAGMFENL

SEQ ID NO: 1412212 - protein, 12 aa, Mycobacterium tuberculosis
EPTTRRAEFGDG

SEQ ID NO: 1412213 - protein, 8 aa, Mycobacterium tuberculosis
EPVDGPWA

SEQ ID NO: 1412214 - protein, 5 aa, Mycobacterium tuberculosis
EPVGR

SEQ ID NO: 1412215 - protein, 6 aa, Mycobacterium tuberculosis
EQPAAV

SEQ ID NO: 1412216 - protein, 10 aa, Mycobacterium tuberculosis
EQPEAGAAGN

SEQ ID NO: 1412217 - protein, 7 aa, Mycobacterium tuberculosis
EQRATEP

SEQ ID NO: 1412218 - protein, 11 aa, Mycobacterium tuberculosis
EQVPGESYEHG

SEQ ID NO: 1412219 - protein, 7 aa, Mycobacterium tuberculosis
EQVQPNT

SEQ ID NO: 1412220 - protein, 11 aa, Mycobacterium tuberculosis
ERADKVEKQFQ

SEQ ID NO: 1412221 - protein, 5 aa, Mycobacterium tuberculosis
ERAEN

SEQ ID NO: 1412222 - protein, 8 aa, Mycobacterium tuberculosis
ERGAPEIQ

SEQ ID NO: 1412223 - protein, 6 aa, Mycobacterium tuberculosis
ERHGGT

SEQ ID NO: 1412224 - protein, 6 aa, Mycobacterium tuberculosis
ERPGEV

SEQ ID NO: 1412225 - protein, 7 aa, Mycobacterium tuberculosis
ERSGVRP

SEQ ID NO: 1412226 - protein, 4 aa, Mycobacterium tuberculosis
ERTT

SEQ ID NO: 1412227 - protein, 8 aa, Mycobacterium tuberculosis
ERVEDGSR

SEQ ID NO: 1412228 - protein, 15 aa, Mycobacterium tuberculosis
ESAPWPAAAGPRRAA

SEQ ID NO: 1412229 - protein, 9 aa, Mycobacterium tuberculosis
ESGSRTPGL

SEQ ID NO: 1412230 - protein, 4 aa, Mycobacterium tuberculosis
ESNW

SEQ ID NO: 1412231 - protein, 7 aa, Mycobacterium tuberculosis
ESTGRGI

SEQ ID NO: 1412232 - protein, 10 aa, Mycobacterium tuberculosis
ETAGDPEHPP

SEQ ID NO: 1412233 - protein, 5 aa, Mycobacterium tuberculosis
ETGRE

SEQ ID NO: 1412234 - protein, 11 aa, Mycobacterium tuberculosis
ETTADLAGKTI

SEQ ID NO: 1412235 - protein, 6 aa, Mycobacterium tuberculosis
ETVTSW

SEQ ID NO: 1412236 - protein, 7 aa, Mycobacterium tuberculosis
EVSQPTI

SEQ ID NO: 1412237 - protein, 4 aa, Mycobacterium tuberculosis
EYRP

SEQ ID NO: 1412238 - protein, 9 aa, Mycobacterium tuberculosis
FANSGPAVG

SEQ ID NO: 1412239 - protein, 8 aa, Mycobacterium tuberculosis
FANTGDNN

SEQ ID NO: 1412240 - protein, 11 aa, Mycobacterium tuberculosis
FDRDDPRGGEA

SEQ ID NO: 1412241 - protein, 33 aa, Mycobacterium tuberculosis; identical to SEQ ID NO: 174391

SEQ ID NO: 1412242 - protein, 20 aa, Mycobacterium tuberculosis
FHPEKSGDAGAAVLSNWVDG

SEQ ID NO: 1412243 - protein, 6 aa, Mycobacterium tuberculosis
FQGGQA

SEQ ID NO: 1412244 - protein, 9 aa, Mycobacterium tuberculosis
FSKNSDTGA

SEQ ID NO: 1412245 - protein, 5 aa, Mycobacterium tuberculosis
FTDPE

SEQ ID NO: 1412246 - protein, 9 aa, Mycobacterium tuberculosis
FTRAPQNSV

SEQ ID NO: 1412247 - protein, 17 aa, Mycobacterium tuberculosis
GAANAPAAAAQGAAQGL

SEQ ID NO: 1412248 - protein, 7 aa, Mycobacterium tuberculosis
GAAPDTR

SEQ ID NO: 1412249 - protein, 4 aa, Mycobacterium tuberculosis
GAAV

SEQ ID NO: 1412250 - protein, 6 aa, Mycobacterium tuberculosis
GADPAV

SEQ ID NO: 1412251 - protein, 8 aa, Mycobacterium tuberculosis
GADPPHVR

SEQ ID NO: 1412252 - protein, 9 aa, Mycobacterium tuberculosis
GAGGSREST

SEQ ID NO: 1412253 - protein, 13 aa, Mycobacterium tuberculosis
GAGNRAGDGFDGA

SEQ ID NO: 1412254 - protein, 16 aa, Mycobacterium tuberculosis
GAHRGNAAQRRASQDA

SEQ ID NO: 1412255 - protein, 7 aa, Mycobacterium tuberculosis
GAITGPA

SEQ ID NO: 1412256 - protein, 13 aa, Mycobacterium tuberculosis
GALPKTTSGKISR

SEQ ID NO: 1412257 - protein, 6 aa, Mycobacterium tuberculosis
GAPDGV

SEQ ID NO: 1412258 - protein, 9 aa, Mycobacterium tuberculosis
GAPGQANYA

SEQ ID NO: 1412259 - protein, 5 aa, Mycobacterium tuberculosis
GAPQG

SEQ ID NO: 1412260 - protein, 12 aa, Mycobacterium tuberculosis
GAQAAAAGGDVQ

SEQ ID NO: 1412261 - protein, 18 aa, Mycobacterium tuberculosis
GARKGLADTALRTADSGY

SEQ ID NO: 1412262 - protein, 4 aa, Mycobacterium tuberculosis
GART

SEQ ID NO: 1412263 - protein, 12 aa, Mycobacterium tuberculosis
GASEIPPAQADL

SEQ ID NO: 1412264 - protein, 7 aa, Mycobacterium tuberculosis
GASLDGE

SEQ ID NO: 1412265 - protein, 8 aa, Mycobacterium tuberculosis
GASTPEEL

SEQ ID NO: 1412266 - protein, 12 aa, Mycobacterium tuberculosis
GDAPPSGPGSRA

SEQ ID NO: 1412267 - protein, 4 aa, Mycobacterium tuberculosis
GDDA

SEQ ID NO: 1412268 - protein, 7 aa, Mycobacterium tuberculosis
GDDDAAR

SEQ ID NO: 1412269 - protein, 19 aa, Mycobacterium tuberculosis
GDGADGASGPVGQPGGDGG

SEQ ID NO: 1412270 - protein, 5 aa, Mycobacterium tuberculosis
GDGTA

SEQ ID NO: 1412271 - protein, 10 aa, Mycobacterium tuberculosis
GDLDKPFATE

SEQ ID NO: 1412272 - protein, 7 aa, Mycobacterium tuberculosis
GDPDYPR

SEQ ID NO: 1412273 - protein, 6 aa, Mycobacterium tuberculosis
GDPGVA

SEQ ID NO: 1412274 - protein, 9 aa, Mycobacterium tuberculosis
GDPNTGGDE

SEQ ID NO: 1412275 - protein, 13 aa, Mycobacterium tuberculosis
GDPRSTDQRRADA

SEQ ID NO: 1412276 - protein, 6 aa, Mycobacterium tuberculosis
GDSRRA

SEQ ID NO: 1412277 - protein, 15 aa, Mycobacterium tuberculosis
GDTVGNPKLHGGDDQ

SEQ ID NO: 1412278 - protein, 4 aa, Mycobacterium tuberculosis
GDVH

SEQ ID NO: 1412279 - protein, 12 aa, Mycobacterium tuberculosis
GDYAPDQAAREF

SEQ ID NO: 1412280 - protein, 5 aa, Mycobacterium tuberculosis
GEAFG

SEQ ID NO: 1412281 - protein, 8 aa, Mycobacterium tuberculosis
GEDTGMPA

SEQ ID NO: 1412282 - protein, 4 aa, Mycobacterium tuberculosis
GEEE

SEQ ID NO: 1412283 - protein, 12 aa, Mycobacterium tuberculosis
GEFSAHRNSGES

SEQ ID NO: 1412284 - protein, 4 aa, Mycobacterium tuberculosis
GEFT

SEQ ID NO: 1412285 - protein, 16 aa, Mycobacterium tuberculosis
GEMGEGPVQAAGTGHG

SEQ ID NO: 1412286 - protein, 9 aa, Mycobacterium tuberculosis
GEPPPPTYK

SEQ ID NO: 1412287 - protein, 6 aa, Mycobacterium tuberculosis
GESFGA

SEQ ID NO: 1412288 - protein, 11 aa, Mycobacterium tuberculosis
GFDPARPTAFS

SEQ ID NO: 1412289 - protein, 10 aa, Mycobacterium tuberculosis
GFGNTGSGNI

SEQ ID NO: 1412290 - protein, 8 aa, Mycobacterium tuberculosis
GGAAYGPA

SEQ ID NO: 1412291 - protein, 6 aa, Mycobacterium tuberculosis
GGAKEQ

SEQ ID NO: 1412292 - protein, 4 aa, Mycobacterium tuberculosis
GGDI

SEQ ID NO: 1412293 - protein, 5 aa, Mycobacterium tuberculosis
GGDSQ

SEQ ID NO: 1412294 - protein, 25 aa, Mycobacterium tuberculosis
GGEPLPGPPPPGGCGGAIPSEQPNA

SEQ ID NO: 1412295 - protein, 9 aa, Mycobacterium tuberculosis
GGEYDDSEG

SEQ ID NO: 1412296 - protein, 6 aa, Mycobacterium tuberculosis
GGGDQW

SEQ ID NO: 1412297 - protein, 8 aa, Mycobacterium tuberculosis
GGGDTEVS

SEQ ID NO: 1412298 - protein, 16 aa, Mycobacterium tuberculosis
GGGGASFADGNAADIA

SEQ ID NO: 1412299 - protein, 6 aa, Mycobacterium tuberculosis
GGGGNF

SEQ ID NO: 1412300 - protein, 6 aa, Mycobacterium tuberculosis
GGGTSV

SEQ ID NO: 1412301 - protein, 4 aa, Mycobacterium tuberculosis
GGIE

SEQ ID NO: 1412302 - protein, 7 aa, Mycobacterium tuberculosis
GGIGGNH

SEQ ID NO: 1412303 - protein, 10 aa, Mycobacterium tuberculosis
GGNNVGGANA

SEQ ID NO: 1412304 - protein, 7 aa, Mycobacterium tuberculosis
GGPRGGV

SEQ ID NO: 1412305 - protein, 6 aa, Mycobacterium tuberculosis
GGQPVD

SEQ ID NO: 1412306 - protein, 4 aa, Mycobacterium tuberculosis
GGSA

SEQ ID NO: 1412307 - protein, 10 aa, Mycobacterium tuberculosis
GGSGTSAAAR

SEQ ID NO: 1412308 - protein, 4 aa, Mycobacterium tuberculosis
GGSP

SEQ ID NO: 1412309 - protein, 6 aa, Mycobacterium tuberculosis
GGSRAI

SEQ ID NO: 1412310 - protein, 8 aa, Mycobacterium tuberculosis
GGVDGPDG

SEQ ID NO: 1412311 - protein, 4 aa, Mycobacterium tuberculosis
GGYG

SEQ ID NO: 1412312 - protein, 25 aa, Mycobacterium tuberculosis
GGYQTPGGHSASPAHEAPPGGAEGL

SEQ ID NO: 1412313 - protein, 9 aa, Mycobacterium tuberculosis
GHGASPQAL

SEQ ID NO: 1412314 - protein, 12 aa, Mycobacterium tuberculosis
GHGRSGVPRRGA

SEQ ID NO: 1412315 - protein, 5 aa, Mycobacterium tuberculosis
GHIAG

SEQ ID NO: 1412316 - protein, 8 aa, Mycobacterium tuberculosis
GHNQQGFG

SEQ ID NO: 1412317 - protein, 4 aa, Mycobacterium tuberculosis
GHPS

SEQ ID NO: 1412318 - protein, 9 aa, Mycobacterium tuberculosis
GHRRSEYDA

SEQ ID NO: 1412319 - protein, 7 aa, Mycobacterium tuberculosis
GIEPRST

SEQ ID NO: 1412320 - protein, 8 aa, Mycobacterium tuberculosis
GIKDRTRA

SEQ ID NO: 1412321 - protein, 7 aa, Mycobacterium tuberculosis
GIKDTSD

SEQ ID NO: 1412322 - protein, 8 aa, Mycobacterium tuberculosis
GIPKTPEW

SEQ ID NO: 1412323 - protein, 12 aa, Mycobacterium tuberculosis
GIPPDSLSGTRT

SEQ ID NO: 1412324 - protein, 6 aa, Mycobacterium tuberculosis
GKQGRF

SEQ ID NO: 1412325 - protein, 4 aa, Mycobacterium tuberculosis
GKRT

SEQ ID NO: 1412326 - protein, 4 aa, Mycobacterium tuberculosis
GLDT

SEQ ID NO: 1412327 - protein, 11 aa, Mycobacterium tuberculosis
GLGGPGREHEA

SEQ ID NO: 1412328 - protein, 5 aa, Mycobacterium tuberculosis
GLGGT

SEQ ID NO: 1412329 - protein, 9 aa, Mycobacterium tuberculosis
GLGNAGTLA

SEQ ID NO: 1412330 - protein, 7 aa, Mycobacterium tuberculosis
GLGPEAR

SEQ ID NO: 1412331 - protein, 9 aa, Mycobacterium tuberculosis
GLGTDEAGA

SEQ ID NO: 1412332 - protein, 6 aa, Mycobacterium tuberculosis
GLKTSR

SEQ ID NO: 1412333 - protein, 5 aa, Mycobacterium tuberculosis
GLSGT

SEQ ID NO: 1412334 - protein, 7 aa, Mycobacterium tuberculosis
GLSPESV

SEQ ID NO: 1412335 - protein, 49 aa, Mycobacterium tuberculosis; identical to SEQ ID NO: 176335

SEQ ID NO: 1412336 - protein, 4 aa, Mycobacterium tuberculosis
GMGQ

SEQ ID NO: 1412337 - protein, 6 aa, Mycobacterium tuberculosis
GNGEQR

SEQ ID NO: 1412338 - protein, 5 aa, Mycobacterium tuberculosis
GNGQI

SEQ ID NO: 1412339 - protein, 4 aa, Mycobacterium tuberculosis
GNPV

SEQ ID NO: 1412340 - protein, 13 aa, Mycobacterium tuberculosis
GNRGSYNIGPANL

SEQ ID NO: 1412341 - protein, 7 aa, Mycobacterium tuberculosis
GNRVPKA

SEQ ID NO: 1412342 - protein, 8 aa, Mycobacterium tuberculosis
GPGAAAPL

SEQ ID NO: 1412343 - protein, 11 aa, Mycobacterium tuberculosis
GPKAAAGALSP

SEQ ID NO: 1412344 - protein, 5 aa, Mycobacterium tuberculosis
GPNAV

SEQ ID NO: 1412345 - protein, 21 aa, Mycobacterium tuberculosis
GPRASPSVAGGGAVGGVQTPQ

SEQ ID NO: 1412346 - protein, 5 aa, Mycobacterium tuberculosis
GPRRK

SEQ ID NO: 1412347 - protein, 7 aa, Mycobacterium tuberculosis
GQAFSAA

SEQ ID NO: 1412348 - protein, 4 aa, Mycobacterium tuberculosis
GQAP

SEQ ID NO: 1412349 - protein, 6 aa, Mycobacterium tuberculosis
GQDDAS

SEQ ID NO: 1412350 - protein, 5 aa, Mycobacterium tuberculosis
GQGGE

SEQ ID NO: 1412351 - protein, 4 aa, Mycobacterium tuberculosis
GQIE

SEQ ID NO: 1412352 - protein, 6 aa, Mycobacterium tuberculosis
GQLDGP

SEQ ID NO: 1412353 - protein, 11 aa, Mycobacterium tuberculosis
GQLPTGKGWED

SEQ ID NO: 1412354 - protein, 5 aa, Mycobacterium tuberculosis
GQPAE

SEQ ID NO: 1412355 - protein, 6 aa, Mycobacterium tuberculosis
GQPTEL

SEQ ID NO: 1412356 - protein, 16 aa, Mycobacterium tuberculosis
GQTATTQALPDNSDGI

SEQ ID NO: 1412357 - protein, 12 aa, Mycobacterium tuberculosis
GRAAGRGAAEDI

SEQ ID NO: 1412358 - protein, 14 aa, Mycobacterium tuberculosis
GRADAGAPSVPRDH

SEQ ID NO: 1412359 - protein, 6 aa, Mycobacterium tuberculosis
GRGGGF

SEQ ID NO: 1412360 - protein, 7 aa, Mycobacterium tuberculosis
GRPYEPQ

SEQ ID NO: 1412361 - protein, 9 aa, Mycobacterium tuberculosis
GRPYVPGST

SEQ ID NO: 1412362 - protein, 4 aa, Mycobacterium tuberculosis
GRRP

SEQ ID NO: 1412363 - protein, 4 aa, Mycobacterium tuberculosis
GRRT

SEQ ID NO: 1412364 - protein, 17 aa, Mycobacterium tuberculosis
GRSPGRDSGGRRVTPPA

SEQ ID NO: 1412365 - protein, 9 aa, Mycobacterium tuberculosis
GRSTRPPLD

SEQ ID NO: 1412366 - protein, 19 aa, Mycobacterium tuberculosis
GSATNSDGRSNGMTAPNAL

SEQ ID NO: 1412367 - protein, 6 aa, Mycobacterium tuberculosis
GSDGDA

SEQ ID NO: 1412368 - protein, 6 aa, Mycobacterium tuberculosis
GSESEL

SEQ ID NO: 1412369 - protein, 5 aa, Mycobacterium tuberculosis
GSGNF

SEQ ID NO: 1412370 - protein, 27 aa, Mycobacterium tuberculosis
GSGNIGGTNVGSGNVGGTNLGSGNYGS

SEQ ID NO: 1412371 - protein, 5 aa, Mycobacterium tuberculosis
GSGNL

SEQ ID NO: 1412372 - protein, 16 aa, Mycobacterium tuberculosis
GSQLGSSLGSSGLGAG

SEQ ID NO: 1412373 - protein, 7 aa, Mycobacterium tuberculosis
GSSTYPG

SEQ ID NO: 1412374 - protein, 8 aa, Mycobacterium tuberculosis
GSTRSINA

SEQ ID NO: 1412375 - protein, 11 aa, Mycobacterium tuberculosis
GSVGQDATNLA

SEQ ID NO: 1412376 - protein, 7 aa, Mycobacterium tuberculosis
GSVSDGD

SEQ ID NO: 1412377 - protein, 14 aa, Mycobacterium tuberculosis
GTAGNISARRSDGN

SEQ ID NO: 1412378 - protein, 13 aa, Mycobacterium tuberculosis
GTAPAAGDPNAPY

SEQ ID NO: 1412379 - protein, 16 aa, Mycobacterium tuberculosis
GTAPTGATPARPSAER

SEQ ID NO: 1412380 - protein, 7 aa, Mycobacterium tuberculosis
GTASTEQ

SEQ ID NO: 1412381 - protein, 4 aa, Mycobacterium tuberculosis
GTAT

SEQ ID NO: 1412382 - protein, 10 aa, Mycobacterium tuberculosis
GTDPAGDGFG

SEQ ID NO: 1412383 - protein, 5 aa, Mycobacterium tuberculosis
GTGNF

SEQ ID NO: 1412384 - protein, 27 aa, Mycobacterium tuberculosis
GTGNFGIGNSGSFNTGIGNSGTGSTGL

SEQ ID NO: 1412385 - protein, 16 aa, Mycobacterium tuberculosis
GTGNFGIGNTGTGNFG

SEQ ID NO: 1412386 - protein, 6 aa, Mycobacterium tuberculosis
GTGPAL

SEQ ID NO: 1412387 - protein, 9 aa, Mycobacterium tuberculosis
GTGTPLGDP

SEQ ID NO: 1412388 - protein, 17 aa, Mycobacterium tuberculosis
GTGTVSGVGNVGSNSSG

SEQ ID NO: 1412389 - protein, 5 aa, Mycobacterium tuberculosis
GTIGP

SEQ ID NO: 1412390 - protein, 13 aa, Mycobacterium tuberculosis
GTLSGKGSQAQRA

SEQ ID NO: 1412391 - protein, 4 aa, Mycobacterium tuberculosis
GTNQ

SEQ ID NO: 1412392 - protein, 4 aa, Mycobacterium tuberculosis
GTPP

SEQ ID NO: 1412393 - protein, 6 aa, Mycobacterium tuberculosis
GTSGGR

SEQ ID NO: 1412394 - protein, 9 aa, Mycobacterium tuberculosis
GTTAAQQTL

SEQ ID NO: 1412395 - protein, 5 aa, Mycobacterium tuberculosis
GTVNG

SEQ ID NO: 1412396 - protein, 4 aa, Mycobacterium tuberculosis
GVMP

SEQ ID NO: 1412397 - protein, 10 aa, Mycobacterium tuberculosis
GVPRDPDPLH

SEQ ID NO: 1412398 - protein, 6 aa, Mycobacterium tuberculosis
GVPTEQ

SEQ ID NO: 1412399 - protein, 5 aa, Mycobacterium tuberculosis
GYDSS

SEQ ID NO: 1412400 - protein, 10 aa, Mycobacterium tuberculosis
GYIDGNTADG

SEQ ID NO: 1412401 - protein, 5 aa, Mycobacterium tuberculosis
GYPRR

SEQ ID NO: 1412402 - protein, 10 aa, Mycobacterium tuberculosis
HGDPPPGGST

SEQ ID NO: 1412403 - protein, 4 aa, Mycobacterium tuberculosis
HGED

SEQ ID NO: 1412404 - protein, 15 aa, Mycobacterium tuberculosis
HGTATPIGDAAEANA

SEQ ID NO: 1412405 - protein, 6 aa, Mycobacterium tuberculosis
HGTGTV

SEQ ID NO: 1412406 - protein, 6 aa, Mycobacterium tuberculosis
HPDTQI

SEQ ID NO: 1412407 - protein, 13 aa, Mycobacterium tuberculosis
HPIPAEPADQLVN

SEQ ID NO: 1412408 - protein, 8 aa, Mycobacterium tuberculosis
HPPKSPNA

SEQ ID NO: 1412409 - protein, 9 aa, Mycobacterium tuberculosis
HPQGGGSEA

SEQ ID NO: 1412410 - protein, 5 aa, Mycobacterium tuberculosis
HPSPV

SEQ ID NO: 1412411 - protein, 5 aa, Mycobacterium tuberculosis
HQGQW

SEQ ID NO: 1412412 - protein, 18 aa, Mycobacterium tuberculosis
HREKRPARFGADPDPGAG

SEQ ID NO: 1412413 - protein, 12 aa, Mycobacterium tuberculosis
HRLPPSPKPGQK

SEQ ID NO: 1412414 - protein, 5 aa, Mycobacterium tuberculosis
HRTDD

SEQ ID NO: 1412415 - protein, 10 aa, Mycobacterium tuberculosis
HSGYSGGAGP

SEQ ID NO: 1412416 - protein, 12 aa, Mycobacterium tuberculosis
HSHRRTRRRWPP

SEQ ID NO: 1412417 - protein, 6 aa, Mycobacterium tuberculosis
HSTAGA

SEQ ID NO: 1412418 - protein, 14 aa, Mycobacterium tuberculosis
HTGPLRPSETGRPI

SEQ ID NO: 1412419 - protein, 6 aa, Mycobacterium tuberculosis
HTLPDE

SEQ ID NO: 1412420 - protein, 4 aa, Mycobacterium tuberculosis
HTPL

SEQ ID NO: 1412421 - protein, 8 aa, Mycobacterium tuberculosis
HTRGEFEN

SEQ ID NO: 1412422 - protein, 4 aa, Mycobacterium tuberculosis
HVAD

SEQ ID NO: 1412423 - protein, 6 aa, Mycobacterium tuberculosis
HYPDDN

SEQ ID NO: 1412424 - protein, 9 aa, Mycobacterium tuberculosis
IAASGRRSV

SEQ ID NO: 1412425 - protein, 16 aa, Mycobacterium tuberculosis
IADPAKLAQAYQDGGA

SEQ ID NO: 1412426 - protein, 30 aa, Mycobacterium tuberculosis; identical to SEQ ID NO: 178413

SEQ ID NO: 1412427 - protein, 21 aa, Mycobacterium tuberculosis
IANPSMNEGFSPNDTGKGLSR

SEQ ID NO: 1412428 - protein, 6 aa, Mycobacterium tuberculosis
IAPAST

SEQ ID NO: 1412429 - protein, 10 aa, Mycobacterium tuberculosis
IASSSGAERV

SEQ ID NO: 1412430 - protein, 8 aa, Mycobacterium tuberculosis
IDGPRDAQ

SEQ ID NO: 1412431 - protein, 6 aa, Mycobacterium tuberculosis
IDGSQY

SEQ ID NO: 1412432 - protein, 10 aa, Mycobacterium tuberculosis
IDPAHTRSKL

SEQ ID NO: 1412433 - protein, 10 aa, Mycobacterium tuberculosis
IDPTDATRGL

SEQ ID NO: 1412434 - protein, 8 aa, Mycobacterium tuberculosis
IEADPANP

SEQ ID NO: 1412435 - protein, 9 aa, Mycobacterium tuberculosis
IEAPPATMQ

SEQ ID NO: 1412436 - protein, 9 aa, Mycobacterium tuberculosis
IERAKGAAA

SEQ ID NO: 1412437 - protein, 7 aa, Mycobacterium tuberculosis
IGAPANV

SEQ ID NO: 1412438 - protein, 66 aa, Mycobacterium tuberculosis; identical to SEQ ID NO: 178576

SEQ ID NO: 1412439 - protein, 11 aa, Mycobacterium tuberculosis
IGNSGSTSTGL

SEQ ID NO: 1412440 - protein, 7 aa, Mycobacterium tuberculosis
IGNTGNY

SEQ ID NO: 1412441 - protein, 9 aa, Mycobacterium tuberculosis
IGPLTTPPI

SEQ ID NO: 1412442 - protein, 13 aa, Mycobacterium tuberculosis
IGPTSDEAGPAVA

SEQ ID NO: 1412443 - protein, 6 aa, Mycobacterium tuberculosis
IHSGDS

SEQ ID NO: 1412444 - protein, 8 aa, Mycobacterium tuberculosis
IPKTNPEL

SEQ ID NO: 1412445 - protein, 9 aa, Mycobacterium tuberculosis
ISGASTARR

SEQ ID NO: 1412446 - protein, 8 aa, Mycobacterium tuberculosis
ISQRATAD

SEQ ID NO: 1412447 - protein, 17 aa, Mycobacterium tuberculosis
ITPATRNSAGFAAPAAV

SEQ ID NO: 1412448 - protein, 13 aa, Mycobacterium tuberculosis
ITSGEDPGIARTG

SEQ ID NO: 1412449 - protein, 6 aa, Mycobacterium tuberculosis
KAAAEY

SEQ ID NO: 1412450 - protein, 7 aa, Mycobacterium tuberculosis
KAAGRPD

SEQ ID NO: 1412451 - protein, 9 aa, Mycobacterium tuberculosis
KAGGESARS

SEQ ID NO: 1412452 - protein, 6 aa, Mycobacterium tuberculosis
KAIDDD

SEQ ID NO: 1412453 - protein, 10 aa, Mycobacterium tuberculosis
KAPGQRIPRT

SEQ ID NO: 1412454 - protein, 8 aa, Mycobacterium tuberculosis
KAPSQEDH

SEQ ID NO: 1412455 - protein, 6 aa, Mycobacterium tuberculosis
KARGDD

SEQ ID NO: 1412456 - protein, 5 aa, Mycobacterium tuberculosis
KARRG

SEQ ID NO: 1412457 - protein, 6 aa, Mycobacterium tuberculosis
KARRTL

SEQ ID NO: 1412458 - protein, 10 aa, Mycobacterium tuberculosis
KDDKAGETVG

SEQ ID NO: 1412459 - protein, 8 aa, Mycobacterium tuberculosis
KDGRPKPV

SEQ ID NO: 1412460 - protein, 6 aa, Mycobacterium tuberculosis
KDPRMK

SEQ ID NO: 1412461 - protein, 4 aa, Mycobacterium tuberculosis
KDRE

SEQ ID NO: 1412462 - protein, 8 aa, Mycobacterium tuberculosis
KDRTPDQV

SEQ ID NO: 1412463 - protein, 9 aa, Mycobacterium tuberculosis
KGAQPQAAK

SEQ ID NO: 1412464 - protein, 14 aa, Mycobacterium tuberculosis
KGHGAADWSKRPLP

SEQ ID NO: 1412465 - protein, 15 aa, Mycobacterium tuberculosis
KGNKQRTVPFGQPAA

SEQ ID NO: 1412466 - protein, 12 aa, Mycobacterium tuberculosis
KGNSIESPEEAE

SEQ ID NO: 1412467 - protein, 18 aa, Mycobacterium tuberculosis
KGPDDDEELEFFGFAGPE

SEQ ID NO: 1412468 - protein, 8 aa, Mycobacterium tuberculosis
KGTAGAAV

SEQ ID NO: 1412469 - protein, 7 aa, Mycobacterium tuberculosis
KHPSDHV

SEQ ID NO: 1412470 - protein, 7 aa, Mycobacterium tuberculosis
KHSGLSD

SEQ ID NO: 1412471 - protein, 14 aa, Mycobacterium tuberculosis
KKDPVSRRPLQGPR

SEQ ID NO: 1412472 - protein, 15 aa, Mycobacterium tuberculosis
KNSISPRDALASAGK

SEQ ID NO: 1412473 - protein, 11 aa, Mycobacterium tuberculosis
KPGADPEDRET

SEQ ID NO: 1412474 - protein, 7 aa, Mycobacterium tuberculosis
KPTYGTV

SEQ ID NO: 1412475 - protein, 6 aa, Mycobacterium tuberculosis
KPVPDK

SEQ ID NO: 1412476 - protein, 14 aa, Mycobacterium tuberculosis
KQYGANKLQRVATF

SEQ ID NO: 1412477 - protein, 30 aa, Mycobacterium tuberculosis; identical to SEQ ID NO: 179452

SEQ ID NO: 1412478 - protein, 7 aa, Mycobacterium tuberculosis
KRGDIGA

SEQ ID NO: 1412479 - protein, 11 aa, Mycobacterium tuberculosis
KRRARERGQSL

SEQ ID NO: 1412480 - protein, 15 aa, Mycobacterium tuberculosis
KRSATTLPDGSQADL

SEQ ID NO: 1412481 - protein, 7 aa, Mycobacterium tuberculosis
KSATGLS

SEQ ID NO: 1412482 - protein, 8 aa, Mycobacterium tuberculosis
KSHPGGGD

SEQ ID NO: 1412483 - protein, 5 aa, Mycobacterium tuberculosis
KSTDF

SEQ ID NO: 1412484 - protein, 7 aa, Mycobacterium tuberculosis
KTAQRMA

SEQ ID NO: 1412485 - protein, 5 aa, Mycobacterium tuberculosis
KTDRF

SEQ ID NO: 1412486 - protein, 9 aa, Mycobacterium tuberculosis
KTEADGEPR

SEQ ID NO: 1412487 - protein, 5 aa, Mycobacterium tuberculosis
KTPPT

SEQ ID NO: 1412488 - protein, 4 aa, Mycobacterium tuberculosis
KTSI

SEQ ID NO: 1412489 - protein, 5 aa, Mycobacterium tuberculosis
KTYGG

SEQ ID NO: 1412490 - protein, 11 aa, Mycobacterium tuberculosis
KVDAARRVGGT

SEQ ID NO: 1412491 - protein, 8 aa, Mycobacterium tuberculosis
KVEQSPRE

SEQ ID NO: 1412492 - protein, 6 aa, Mycobacterium tuberculosis
LAGETG

SEQ ID NO: 1412493 - protein, 6 aa, Mycobacterium tuberculosis
LAGPGG

SEQ ID NO: 1412494 - protein, 11 aa, Mycobacterium tuberculosis
LAKTPDDRTQI

SEQ ID NO: 1412495 - protein, 5 aa, Mycobacterium tuberculosis
LARGH

SEQ ID NO: 1412496 - protein, 4 aa, Mycobacterium tuberculosis
LASE

SEQ ID NO: 1412497 - protein, 8 aa, Mycobacterium tuberculosis
LDAGDQAG

SEQ ID NO: 1412498 - protein, 12 aa, Mycobacterium tuberculosis
LDAPSVAGHERR

SEQ ID NO: 1412499 - protein, 7 aa, Mycobacterium tuberculosis
LDAYDRG

SEQ ID NO: 1412500 - protein, 5 aa, Mycobacterium tuberculosis
LDDRT

SEQ ID NO: 1412501 - protein, 18 aa, Mycobacterium tuberculosis
LDEAPSPTLSGPRAPTPR

SEQ ID NO: 1412502 - protein, 11 aa, Mycobacterium tuberculosis
LDEPSGDNCDL

SEQ ID NO: 1412503 - protein, 16 aa, Mycobacterium tuberculosis
LDPAAETEVAPQTERP

SEQ ID NO: 1412504 - protein, 8 aa, Mycobacterium tuberculosis
LDPARPPH

SEQ ID NO: 1412505 - protein, 16 aa, Mycobacterium tuberculosis
LDPGQVAKKPHDHTAG

SEQ ID NO: 1412506 - protein, 5 aa, Mycobacterium tuberculosis
LDRAK

SEQ ID NO: 1412507 - protein, 6 aa, Mycobacterium tuberculosis
LDRSDA

SEQ ID NO: 1412508 - protein, 4 aa, Mycobacterium tuberculosis
LEQD

SEQ ID NO: 1412509 - protein, 17 aa, Mycobacterium tuberculosis
LERRQKSRQTRASRDAL

SEQ ID NO: 1412510 - protein, 6 aa, Mycobacterium tuberculosis
LGDPRA

SEQ ID NO: 1412511 - protein, 10 aa, Mycobacterium tuberculosis
LGEDGPTHQP

SEQ ID NO: 1412512 - protein, 6 aa, Mycobacterium tuberculosis
LGESAA

SEQ ID NO: 1412513 - protein, 8 aa, Mycobacterium tuberculosis
LGGATETA

SEQ ID NO: 1412514 - protein, 13 aa, Mycobacterium tuberculosis
LGPDNKPTGSRSN

SEQ ID NO: 1412515 - protein, 6 aa, Mycobacterium tuberculosis
LGRQRD

SEQ ID NO: 1412516 - protein, 9 aa, Mycobacterium tuberculosis
LGSGGSAEQ

SEQ ID NO: 1412517 - protein, 17 aa, Mycobacterium tuberculosis
LGSQLGSSLGSSGLGAG

SEQ ID NO: 1412518 - protein, 8 aa, Mycobacterium tuberculosis
LGSTGGLQ

SEQ ID NO: 1412519 - protein, 7 aa, Mycobacterium tuberculosis
LNGPNGV

SEQ ID NO: 1412520 - protein, 21 aa, Mycobacterium tuberculosis
LPAPEYGDTNGYRAPAGPVEK

SEQ ID NO: 1412521 - protein, 8 aa, Mycobacterium tuberculosis
LPAPPAAD

SEQ ID NO: 1412522 - protein, 5 aa, Mycobacterium tuberculosis
LPDSA

SEQ ID NO: 1412523 - protein, 7 aa, Mycobacterium tuberculosis
LPEPLGS

SEQ ID NO: 1412524 - protein, 7 aa, Mycobacterium tuberculosis
LPESDPA

SEQ ID NO: 1412525 - protein, 13 aa, Mycobacterium tuberculosis
LPNEDADVSKEIE

SEQ ID NO: 1412526 - protein, 5 aa, Mycobacterium tuberculosis
LPPEI

SEQ ID NO: 1412527 - protein, 5 aa, Mycobacterium tuberculosis
LPPEL

SEQ ID NO: 1412528 - protein, 5 aa, Mycobacterium tuberculosis
LPPFE

SEQ ID NO: 1412529 - protein, 9 aa, Mycobacterium tuberculosis
LPPSPAGAV

SEQ ID NO: 1412530 - protein, 32 aa, Mycobacterium tuberculosis; identical to SEQ ID NO: 180432

SEQ ID NO: 1412531 - protein, 6 aa, Mycobacterium tuberculosis
LPSTPR

SEQ ID NO: 1412532 - protein, 5 aa, Mycobacterium tuberculosis
LPTDP

SEQ ID NO: 1412533 - protein, 5 aa, Mycobacterium tuberculosis
LPYGE

SEQ ID NO: 1412534 - protein, 15 aa, Mycobacterium tuberculosis
LQETNGSVKYSPSAS

SEQ ID NO: 1412535 - protein, 4 aa, Mycobacterium tuberculosis
LQNG

SEQ ID NO: 1412536 - protein, 16 aa, Mycobacterium tuberculosis
LQSLDDGGVLGKVVLE

SEQ ID NO: 1412537 - protein, 15 aa, Mycobacterium tuberculosis
LRAEQRRRGREAEEA

SEQ ID NO: 1412538 - protein, 7 aa, Mycobacterium tuberculosis
LRDKRTG

SEQ ID NO: 1412539 - protein, 24 aa, Mycobacterium tuberculosis
LRGGNGAKVEELTESDKDLLPIGL

SEQ ID NO: 1412540 - protein, 7 aa, Mycobacterium tuberculosis
LRGQGHT

SEQ ID NO: 1412541 - protein, 14 aa, Mycobacterium tuberculosis
LRKSGRPNTRPQDA

SEQ ID NO: 1412542 - protein, 20 aa, Mycobacterium tuberculosis
LRRGKDRRKVHYGDKTPVSL

SEQ ID NO: 1412543 - protein, 6 aa, Mycobacterium tuberculosis
LSDEAR

SEQ ID NO: 1412544 - protein, 15 aa, Mycobacterium tuberculosis
LSGGAGAPPMPADAE

SEQ ID NO: 1412545 - protein, 9 aa, Mycobacterium tuberculosis
LSNAGSNNW

SEQ ID NO: 1412546 - protein, 7 aa, Mycobacterium tuberculosis
LSRAPET

SEQ ID NO: 1412547 - protein, 8 aa, Mycobacterium tuberculosis
LSSGREAD

SEQ ID NO: 1412548 - protein, 10 aa, Mycobacterium tuberculosis
LSSNTAETAT

SEQ ID NO: 1412549 - protein, 15 aa, Mycobacterium tuberculosis
LSSSTAATSASGPSG

SEQ ID NO: 1412550 - protein, 9 aa, Mycobacterium tuberculosis
LSTPANVSG

SEQ ID NO: 1412551 - protein, 9 aa, Mycobacterium tuberculosis
LTDPKAGPL

SEQ ID NO: 1412552 - protein, 5 aa, Mycobacterium tuberculosis
LTPER

SEQ ID NO: 1412553 - protein, 32 aa, Mycobacterium tuberculosis; identical to SEQ ID NO: 194492

SEQ ID NO: 1412554 - protein, 5 aa, Mycobacterium tuberculosis
LYGPD

SEQ ID NO: 1412555 - protein, 6 aa, Mycobacterium tuberculosis
MADPPR

SEQ ID NO: 1412556 - protein, 5 aa, Mycobacterium tuberculosis
MGTGG

SEQ ID NO: 1412557 - protein, 5 aa, Mycobacterium tuberculosis
MKTGD

SEQ ID NO: 1412558 - protein, 10 aa, Mycobacterium tuberculosis
MNTTTPARTA

SEQ ID NO: 1412559 - protein, 7 aa, Mycobacterium tuberculosis
MSGTDSN

SEQ ID NO: 1412560 - protein, 12 aa, Mycobacterium tuberculosis
MTGLSEHSRSEL

SEQ ID NO: 1412561 - protein, 6 aa, Mycobacterium tuberculosis
NAARRE

SEQ ID NO: 1412562 - protein, 8 aa, Mycobacterium tuberculosis
NANVGHGN

SEQ ID NO: 1412563 - protein, 6 aa, Mycobacterium tuberculosis
NAPAIA

SEQ ID NO: 1412564 - protein, 10 aa, Mycobacterium tuberculosis
NAQAAPAKYP

SEQ ID NO: 1412565 - protein, 18 aa, Mycobacterium tuberculosis
NAQSQHSSSNNSGGADPV

SEQ ID NO: 1412566 - protein, 7 aa, Mycobacterium tuberculosis
NARGRPV

SEQ ID NO: 1412567 - protein, 7 aa, Mycobacterium tuberculosis
NATGQWA

SEQ ID NO: 1412568 - protein, 9 aa, Mycobacterium tuberculosis
NATHADAAA

SEQ ID NO: 1412569 - protein, 12 aa, Mycobacterium tuberculosis
NAVQAGSLNRPG

SEQ ID NO: 1412570 - protein, 6 aa, Mycobacterium tuberculosis
NDDGAI

SEQ ID NO: 1412571 - protein, 4 aa, Mycobacterium tuberculosis
NDPD

SEQ ID NO: 1412572 - protein, 7 aa, Mycobacterium tuberculosis
NDPNRHL

SEQ ID NO: 1412573 - protein, 11 aa, Mycobacterium tuberculosis
NEGADSTHSPE

SEQ ID NO: 1412574 - protein, 8 aa, Mycobacterium tuberculosis
NEGVPGDI

SEQ ID NO: 1412575 - protein, 9 aa, Mycobacterium tuberculosis
NGGPGTVSG

SEQ ID NO: 1412576 - protein, 4 aa, Mycobacterium tuberculosis
NGRP

SEQ ID NO: 1412577 - protein, 17 aa, Mycobacterium tuberculosis
NGRRGRPVTGPGNRPLK

SEQ ID NO: 1412578 - protein, 7 aa, Mycobacterium tuberculosis
NKAPGGV

SEQ ID NO: 1412579 - protein, 5 aa, Mycobacterium tuberculosis
NLGNT

SEQ ID NO: 1412580 - protein, 7 aa, Mycobacterium tuberculosis
NLGSGNV

SEQ ID NO: 1412581 - protein, 10 aa, Mycobacterium tuberculosis
NLSGGGNVGA

SEQ ID NO: 1412582 - protein, 5 aa, Mycobacterium tuberculosis
NNAAE

SEQ ID NO: 1412583 - protein, 20 aa, Mycobacterium tuberculosis
NNRARLSSPMRRRADGTYEE

SEQ ID NO: 1412584 - protein, 5 aa, Mycobacterium tuberculosis
NQWPG

SEQ ID NO: 1412585 - protein, 12 aa, Mycobacterium tuberculosis
NQYPPGPGSAPL

SEQ ID NO: 1412586 - protein, 6 aa, Mycobacterium tuberculosis
NRAPGV

SEQ ID NO: 1412587 - protein, 8 aa, Mycobacterium tuberculosis
NRPEKGNA

SEQ ID NO: 1412588 - protein, 9 aa, Mycobacterium tuberculosis
NRPQSRNAL

SEQ ID NO: 1412589 - protein, 8 aa, Mycobacterium tuberculosis
NRRPTGQR

SEQ ID NO: 1412590 - protein, 9 aa, Mycobacterium tuberculosis
NSESAEKAA

SEQ ID NO: 1412591 - protein, 5 aa, Mycobacterium tuberculosis
NSGHP

SEQ ID NO: 1412592 - protein, 21 aa, Mycobacterium tuberculosis
NSGTGGTSGFQNVGGGSSGVW

SEQ ID NO: 1412593 - protein, 19 aa, Mycobacterium tuberculosis
NSGTGSSSGFGNVGANNSG

SEQ ID NO: 1412594 - protein, 14 aa, Mycobacterium tuberculosis
NSPWPTAEGPRRAA

SEQ ID NO: 1412595 - protein, 5 aa, Mycobacterium tuberculosis
NSTDR

SEQ ID NO: 1412596 - protein, 6 aa, Mycobacterium tuberculosis
NTGNNN

SEQ ID NO: 1412597 - protein, 10 aa, Mycobacterium tuberculosis
NVGDSNAGLA

SEQ ID NO: 1412598 - protein, 11 aa, Mycobacterium tuberculosis
NVREAEAGGIT

SEQ ID NO: 1412599 - protein, 25 aa, Mycobacterium tuberculosis
PAAAENAARITAREPAVAGDRPELT

SEQ ID NO: 1412600 - protein, 11 aa, Mycobacterium tuberculosis
PAAGGDGPADV

SEQ ID NO: 1412601 - protein, 4 aa, Mycobacterium tuberculosis
PADR

SEQ ID NO: 1412602 - protein, 7 aa, Mycobacterium tuberculosis
PADTAAR

SEQ ID NO: 1412603 - protein, 7 aa, Mycobacterium tuberculosis
PAELGRP

SEQ ID NO: 1412604 - protein, 13 aa, Mycobacterium tuberculosis
PAGLLGGSGYQNF

SEQ ID NO: 1412605 - protein, 6 aa, Mycobacterium tuberculosis
PAGMTS

SEQ ID NO: 1412606 - protein, 10 aa, Mycobacterium tuberculosis
PAGRRAARRA

SEQ ID NO: 1412607 - protein, 16 aa, Mycobacterium tuberculosis
PAPGFGNSTTGPSSGF

SEQ ID NO: 1412608 - protein, 16 aa, Mycobacterium tuberculosis
PAPGIGNSTTNPSSGF

SEQ ID NO: 1412609 - protein, 8 aa, Mycobacterium tuberculosis
PAQVRTKT

SEQ ID NO: 1412610 - protein, 20 aa, Mycobacterium tuberculosis
PARRSPRSNARDRCQAGTRT

SEQ ID NO: 1412611 - protein, 7 aa, Mycobacterium tuberculosis
PASADEV

SEQ ID NO: 1412612 - protein, 6 aa, Mycobacterium tuberculosis
PATPDG

SEQ ID NO: 1412613 - protein, 5 aa, Mycobacterium tuberculosis
PAVRG

SEQ ID NO: 1412614 - protein, 10 aa, Mycobacterium tuberculosis
PAVRTTSEDP

SEQ ID NO: 1412615 - protein, 6 aa, Mycobacterium tuberculosis
PAYEDP

SEQ ID NO: 1412616 - protein, 34 aa, Mycobacterium tuberculosis; identical to SEQ ID NO: 182182

SEQ ID NO: 1412617 - protein, 18 aa, Mycobacterium tuberculosis
PDAGTSTAPNAAPEPVAR

SEQ ID NO: 1412618 - protein, 8 aa, Mycobacterium tuberculosis
PDDGGEEV

SEQ ID NO: 1412619 - protein, 6 aa, Mycobacterium tuberculosis
PDERID

SEQ ID NO: 1412620 - protein, 30 aa, Mycobacterium tuberculosis; identical to SEQ ID NO: 182336

SEQ ID NO: 1412621 - protein, 6 aa, Mycobacterium tuberculosis
PDTNSG

SEQ ID NO: 1412622 - protein, 7 aa, Mycobacterium tuberculosis
PDTREIG

SEQ ID NO: 1412623 - protein, 5 aa, Mycobacterium tuberculosis
PDVPE

SEQ ID NO: 1412624 - protein, 6 aa, Mycobacterium tuberculosis
PEAART

SEQ ID NO: 1412625 - protein, 7 aa, Mycobacterium tuberculosis
PEDPNQQ

SEQ ID NO: 1412626 - protein, 5 aa, Mycobacterium tuberculosis
PEFAQ

SEQ ID NO: 1412627 - protein, 11 aa, Mycobacterium tuberculosis
PEGANSKAEGV

SEQ ID NO: 1412628 - protein, 9 aa, Mycobacterium tuberculosis
PELAGEAGV

SEQ ID NO: 1412629 - protein, 11 aa, Mycobacterium tuberculosis
PELPDDADNPL

SEQ ID NO: 1412630 - protein, 7 aa, Mycobacterium tuberculosis
PENPRNV

SEQ ID NO: 1412631 - protein, 8 aa, Mycobacterium tuberculosis
PEPSHARE

SEQ ID NO: 1412632 - protein, 4 aa, Mycobacterium tuberculosis
PERC

SEQ ID NO: 1412633 - protein, 5 aa, Mycobacterium tuberculosis
PESAT

SEQ ID NO: 1412634 - protein, 21 aa, Mycobacterium tuberculosis
PESGTPAAVGYAQESGVPYGQ

SEQ ID NO: 1412635 - protein, 10 aa, Mycobacterium tuberculosis
PGARRQIPTE

SEQ ID NO: 1412636 - protein, 4 aa, Mycobacterium tuberculosis
PGEL

SEQ ID NO: 1412637 - protein, 6 aa, Mycobacterium tuberculosis
PGEPAA

SEQ ID NO: 1412638 - protein, 4 aa, Mycobacterium tuberculosis
PGER

SEQ ID NO: 1412639 - protein, 14 aa, Mycobacterium tuberculosis
PGFGNTTTAPSSGF

SEQ ID NO: 1412640 - protein, 7 aa, Mycobacterium tuberculosis
PGFSPAT

SEQ ID NO: 1412641 - protein, 9 aa, Mycobacterium tuberculosis
PGGVNSPDD

SEQ ID NO: 1412642 - protein, 6 aa, Mycobacterium tuberculosis
PGPAAY

SEQ ID NO: 1412643 - protein, 5 aa, Mycobacterium tuberculosis
PGQRI

SEQ ID NO: 1412644 - protein, 8 aa, Mycobacterium tuberculosis
PGRYGPYS

SEQ ID NO: 1412645 - protein, 7 aa, Mycobacterium tuberculosis
PGSHQDN

SEQ ID NO: 1412646 - protein, 19 aa, Mycobacterium tuberculosis
PGTQPADAQTATSATVRPL

SEQ ID NO: 1412647 - protein, 5 aa, Mycobacterium tuberculosis
PGTSI

SEQ ID NO: 1412648 - protein, 11 aa, Mycobacterium tuberculosis
PGVGSTTRGAL

SEQ ID NO: 1412649 - protein, 4 aa, Mycobacterium tuberculosis
PHEN

SEQ ID NO: 1412650 - protein, 7 aa, Mycobacterium tuberculosis
PHQAADG

SEQ ID NO: 1412651 - protein, 8 aa, Mycobacterium tuberculosis
PITGTGPA

SEQ ID NO: 1412652 - protein, 7 aa, Mycobacterium tuberculosis
PKEVGAD

SEQ ID NO: 1412653 - protein, 7 aa, Mycobacterium tuberculosis
PKPPFAQ

SEQ ID NO: 1412654 - protein, 11 aa, Mycobacterium tuberculosis
PKQPPRPAGDD

SEQ ID NO: 1412655 - protein, 9 aa, Mycobacterium tuberculosis
PKSGYPGHA

SEQ ID NO: 1412656 - protein, 7 aa, Mycobacterium tuberculosis
PLGPAAA

SEQ ID NO: 1412657 - protein, 4 aa, Mycobacterium tuberculosis
PLGS

SEQ ID NO: 1412658 - protein, 4 aa, Mycobacterium tuberculosis
PLPP

SEQ ID NO: 1412659 - protein, 7 aa, Mycobacterium tuberculosis
PLPPRRR

SEQ ID NO: 1412660 - protein, 5 aa, Mycobacterium tuberculosis
PLPTN

SEQ ID NO: 1412661 - protein, 7 aa, Mycobacterium tuberculosis
PLRDGGY

SEQ ID NO: 1412662 - protein, 7 aa, Mycobacterium tuberculosis
PLTPGRM

SEQ ID NO: 1412663 - protein, 6 aa, Mycobacterium tuberculosis
PMPGQP

SEQ ID NO: 1412664 - protein, 7 aa, Mycobacterium tuberculosis
PNGVGKT

SEQ ID NO: 1412665 - protein, 7 aa, Mycobacterium tuberculosis
PNGYGKT

SEQ ID NO: 1412666 - protein, 17 aa, Mycobacterium tuberculosis
PNNPERATPAKRPPRLK

SEQ ID NO: 1412667 - protein, 5 aa, Mycobacterium tuberculosis
PNPVV

SEQ ID NO: 1412668 - protein, 4 aa, Mycobacterium tuberculosis
PNQP

SEQ ID NO: 1412669 - protein, 11 aa, Mycobacterium tuberculosis
PNTNTECPPGT

SEQ ID NO: 1412670 - protein, 10 aa, Mycobacterium tuberculosis
PPAKTGAGTW

SEQ ID NO: 1412671 - protein, 5 aa, Mycobacterium tuberculosis
PPGAK

SEQ ID NO: 1412672 - protein, 6 aa, Mycobacterium tuberculosis
PPGDGP

SEQ ID NO: 1412673 - protein, 4 aa, Mycobacterium tuberculosis
PPPH

SEQ ID NO: 1412674 - protein, 22 aa, Mycobacterium tuberculosis
PPPSLSRPRREPAAEHKHSPDE

SEQ ID NO: 1412675 - protein, 6 aa, Mycobacterium tuberculosis
PPQGQD

SEQ ID NO: 1412676 - protein, 8 aa, Mycobacterium tuberculosis
PPSQDPVY

SEQ ID NO: 1412677 - protein, 8 aa, Mycobacterium tuberculosis
PPSTAIPS

SEQ ID NO: 1412678 - protein, 6 aa, Mycobacterium tuberculosis
PPTDRR

SEQ ID NO: 1412679 - protein, 12 aa, Mycobacterium tuberculosis
PQAQRAREGEVP

SEQ ID NO: 1412680 - protein, 4 aa, Mycobacterium tuberculosis
PQDP

SEQ ID NO: 1412681 - protein, 18 aa, Mycobacterium tuberculosis
PQQLPQVSQGTHPEPVDT

SEQ ID NO: 1412682 - protein, 4 aa, Mycobacterium tuberculosis
PQSV

SEQ ID NO: 1412683 - protein, 10 aa, Mycobacterium tuberculosis
PQTPTAATDE

SEQ ID NO: 1412684 - protein, 5 aa, Mycobacterium tuberculosis
PRAGM

SEQ ID NO: 1412685 - protein, 11 aa, Mycobacterium tuberculosis
PREASAMDPRQ

SEQ ID NO: 1412686 - protein, 7 aa, Mycobacterium tuberculosis
PRLSPAP

SEQ ID NO: 1412687 - protein, 4 aa, Mycobacterium tuberculosis
PRSP

SEQ ID NO: 1412688 - protein, 11 aa, Mycobacterium tuberculosis
PRWDDGRDGPH

SEQ ID NO: 1412689 - protein, 5 aa, Mycobacterium tuberculosis
PSDRP

SEQ ID NO: 1412690 - protein, 5 aa, Mycobacterium tuberculosis
PSNGV

SEQ ID NO: 1412691 - protein, 4 aa, Mycobacterium tuberculosis
PSPA

SEQ ID NO: 1412692 - protein, 18 aa, Mycobacterium tuberculosis
PTDEELADAGLPKATDVT

SEQ ID NO: 1412693 - protein, 15 aa, Mycobacterium tuberculosis
PTGEPDADYDTYKHH

SEQ ID NO: 1412694 - protein, 8 aa, Mycobacterium tuberculosis
PTGQSPTV

SEQ ID NO: 1412695 - protein, 9 aa, Mycobacterium tuberculosis
PTPLQPSDR

SEQ ID NO: 1412696 - protein, 4 aa, Mycobacterium tuberculosis
PTRG

SEQ ID NO: 1412697 - protein, 6 aa, Mycobacterium tuberculosis
PVGPSA

SEQ ID NO: 1412698 - protein, 14 aa, Mycobacterium tuberculosis
PVPGPRDDKYTQGV

SEQ ID NO: 1412699 - protein, 13 aa, Mycobacterium tuberculosis
PVPNADAPLGPGQ

SEQ ID NO: 1412700 - protein, 21 aa, Mycobacterium tuberculosis
PVPSVGAPPAAAGGETPTRSV

SEQ ID NO: 1412701 - protein, 7 aa, Mycobacterium tuberculosis
PVTDSPA

SEQ ID NO: 1412702 - protein, 10 aa, Mycobacterium tuberculosis
PVVPGANDNL

SEQ ID NO: 1412703 - protein, 14 aa, Mycobacterium tuberculosis
PWPGADQETPRRAA

SEQ ID NO: 1412704 - protein, 52 aa, Mycobacterium tuberculosis; identical to SEQ ID NO: 183771

SEQ ID NO: 1412705 - protein, 11 aa, Mycobacterium tuberculosis
QADTAAARQAA

SEQ ID NO: 1412706 - protein, 7 aa, Mycobacterium tuberculosis
QAGAGSL

SEQ ID NO: 1412707 - protein, 7 aa, Mycobacterium tuberculosis
QAGPNSG

SEQ ID NO: 1412708 - protein, 4 aa, Mycobacterium tuberculosis
QAGQ

SEQ ID NO: 1412709 - protein, 17 aa, Mycobacterium tuberculosis
QAPPPGAPGGMSSGDID

SEQ ID NO: 1412710 - protein, 6 aa, Mycobacterium tuberculosis
QAREPQ

SEQ ID NO: 1412711 - protein, 7 aa, Mycobacterium tuberculosis
QASSGYE

SEQ ID NO: 1412712 - protein, 7 aa, Mycobacterium tuberculosis
QDTDESE

SEQ ID NO: 1412713 - protein, 5 aa, Mycobacterium tuberculosis
QDTNH

SEQ ID NO: 1412714 - protein, 12 aa, Mycobacterium tuberculosis
QFRTSGDTIAAN

SEQ ID NO: 1412715 - protein, 5 aa, Mycobacterium tuberculosis
QFSEA

SEQ ID NO: 1412716 - protein, 13 aa, Mycobacterium tuberculosis
QGAVTSTSGPTSE

SEQ ID NO: 1412717 - protein, 12 aa, Mycobacterium tuberculosis
QGFPDEDGPPKM

SEQ ID NO: 1412718 - protein, 5 aa, Mycobacterium tuberculosis
QGGGP

SEQ ID NO: 1412719 - protein, 9 aa, Mycobacterium tuberculosis
QGGRRSAAD

SEQ ID NO: 1412720 - protein, 4 aa, Mycobacterium tuberculosis
QGRG

SEQ ID NO: 1412721 - protein, 7 aa, Mycobacterium tuberculosis
QGRTAED

SEQ ID NO: 1412722 - protein, 7 aa, Mycobacterium tuberculosis
QHAGGPG

SEQ ID NO: 1412723 - protein, 4 aa, Mycobacterium tuberculosis
QIGD

SEQ ID NO: 1412724 - protein, 7 aa, Mycobacterium tuberculosis
QLAGPTV

SEQ ID NO: 1412725 - protein, 6 aa, Mycobacterium tuberculosis
QLEGPV

SEQ ID NO: 1412726 - protein, 17 aa, Mycobacterium tuberculosis
QLGDPLAADNPPGAVDP

SEQ ID NO: 1412727 - protein, 12 aa, Mycobacterium tuberculosis
QLGKKSGRGFYT

SEQ ID NO: 1412728 - protein, 6 aa, Mycobacterium tuberculosis
QLPRTG

SEQ ID NO: 1412729 - protein, 7 aa, Mycobacterium tuberculosis
QLSPTEK

SEQ ID NO: 1412730 - protein, 5 aa, Mycobacterium tuberculosis
QNIKS

SEQ ID NO: 1412731 - protein, 8 aa, Mycobacterium tuberculosis
QNPSGPRP

SEQ ID NO: 1412732 - protein, 8 aa, Mycobacterium tuberculosis
QNPTGEQE

SEQ ID NO: 1412733 - protein, 10 aa, Mycobacterium tuberculosis
QNRASGAEIG

SEQ ID NO: 1412734 - protein, 11 aa, Mycobacterium tuberculosis
QNSNSASEPDR

SEQ ID NO: 1412735 - protein, 7 aa, Mycobacterium tuberculosis
QPAGPPH

SEQ ID NO: 1412736 - protein, 14 aa, Mycobacterium tuberculosis
QPPAGSFSPGGHDA

SEQ ID NO: 1412737 - protein, 5 aa, Mycobacterium tuberculosis
QPPER

SEQ ID NO: 1412738 - protein, 5 aa, Mycobacterium tuberculosis
QPPPV

SEQ ID NO: 1412739 - protein, 4 aa, Mycobacterium tuberculosis
QPRL

SEQ ID NO: 1412740 - protein, 7 aa, Mycobacterium tuberculosis
QQAPNST

SEQ ID NO: 1412741 - protein, 4 aa, Mycobacterium tuberculosis
QQDR

SEQ ID NO: 1412742 - protein, 10 aa, Mycobacterium tuberculosis
QQKAQAADSD

SEQ ID NO: 1412743 - protein, 7 aa, Mycobacterium tuberculosis
QQRPHDA

SEQ ID NO: 1412744 - protein, 9 aa, Mycobacterium tuberculosis
QRGSINPED

SEQ ID NO: 1412745 - protein, 4 aa, Mycobacterium tuberculosis
QRGV

SEQ ID NO: 1412746 - protein, 5 aa, Mycobacterium tuberculosis
QRPAA

SEQ ID NO: 1412747 - protein, 5 aa, Mycobacterium tuberculosis
QRSRG

SEQ ID NO: 1412748 - protein, 11 aa, Mycobacterium tuberculosis
QRTATAVVPTD

SEQ ID NO: 1412749 - protein, 14 aa, Mycobacterium tuberculosis
QSGQGEDAATSTLG

SEQ ID NO: 1412750 - protein, 11 aa, Mycobacterium tuberculosis
QSGSSGPPGAA

SEQ ID NO: 1412751 - protein, 6 aa, Mycobacterium tuberculosis
QSNEAY

SEQ ID NO: 1412752 - protein, 4 aa, Mycobacterium tuberculosis
QTAL

SEQ ID NO: 1412753 - protein, 14 aa, Mycobacterium tuberculosis
QTGIGGLNSGSGNI

SEQ ID NO: 1412754 - protein, 7 aa, Mycobacterium tuberculosis
QTNDPLG

SEQ ID NO: 1412755 - protein, 6 aa, Mycobacterium tuberculosis
QTPDAG

SEQ ID NO: 1412756 - protein, 6 aa, Mycobacterium tuberculosis
QTTPLT

SEQ ID NO: 1412757 - protein, 4 aa, Mycobacterium tuberculosis
QVGE

SEQ ID NO: 1412758 - protein, 10 aa, Mycobacterium tuberculosis
QVSTTNPRVT

SEQ ID NO: 1412759 - protein, 12 aa, Mycobacterium tuberculosis
RAAETESDNPLI

SEQ ID NO: 1412760 - protein, 10 aa, Mycobacterium tuberculosis
RAAGEPGEHK

SEQ ID NO: 1412761 - protein, 6 aa, Mycobacterium tuberculosis
RAAQAG

SEQ ID NO: 1412762 - protein, 4 aa, Mycobacterium tuberculosis
RAAV

SEQ ID NO: 1412763 - protein, 39 aa, Mycobacterium tuberculosis; identical to SEQ ID NO: 184673

SEQ ID NO: 1412764 - protein, 8 aa, Mycobacterium tuberculosis
RAGEHTES

SEQ ID NO: 1412765 - protein, 8 aa, Mycobacterium tuberculosis
RAGHADGN

SEQ ID NO: 1412766 - protein, 7 aa, Mycobacterium tuberculosis
RAKADAQ

SEQ ID NO: 1412767 - protein, 10 aa, Mycobacterium tuberculosis
RANTEPDAHP

SEQ ID NO: 1412768 - protein, 10 aa, Mycobacterium tuberculosis
RAQPRRDLGR

SEQ ID NO: 1412769 - protein, 7 aa, Mycobacterium tuberculosis
RARREPT

SEQ ID NO: 1412770 - protein, 10 aa, Mycobacterium tuberculosis
RATGAAEAIE

SEQ ID NO: 1412771 - protein, 5 aa, Mycobacterium tuberculosis
RATRD

SEQ ID NO: 1412772 - protein, 8 aa, Mycobacterium tuberculosis
RATSTRFG

SEQ ID NO: 1412773 - protein, 7 aa, Mycobacterium tuberculosis
RAYRGSH

SEQ ID NO: 1412774 - protein, 4 aa, Mycobacterium tuberculosis
RDAG

SEQ ID NO: 1412775 - protein, 6 aa, Mycobacterium tuberculosis
RDDPLG

SEQ ID NO: 1412776 - protein, 7 aa, Mycobacterium tuberculosis
RDEFAGP

SEQ ID NO: 1412777 - protein, 6 aa, Mycobacterium tuberculosis
RDGADP

SEQ ID NO: 1412778 - protein, 8 aa, Mycobacterium tuberculosis
RDGPADLP

SEQ ID NO: 1412779 - protein, 6 aa, Mycobacterium tuberculosis
RDTHGG

SEQ ID NO: 1412780 - protein, 4 aa, Mycobacterium tuberculosis
RDTT

SEQ ID NO: 1412781 - protein, 6 aa, Mycobacterium tuberculosis
REATRS

SEQ ID NO: 1412782 - protein, 7 aa, Mycobacterium tuberculosis
RERASAR

SEQ ID NO: 1412783 - protein, 8 aa, Mycobacterium tuberculosis
RESTGAST

SEQ ID NO: 1412784 - protein, 7 aa, Mycobacterium tuberculosis
RETGYTR

SEQ ID NO: 1412785 - protein, 12 aa, Mycobacterium tuberculosis
RFESATASAGTV

SEQ ID NO: 1412786 - protein, 8 aa, Mycobacterium tuberculosis
RGADGGTG

SEQ ID NO: 1412787 - protein, 6 aa, Mycobacterium tuberculosis
RGAKAT

SEQ ID NO: 1412788 - protein, 5 aa, Mycobacterium tuberculosis
RGDEI

SEQ ID NO: 1412789 - protein, 8 aa, Mycobacterium tuberculosis
RGDTGPEL

SEQ ID NO: 1412790 - protein, 4 aa, Mycobacterium tuberculosis
RGGL

SEQ ID NO: 1412791 - protein, 6 aa, Mycobacterium tuberculosis
RGGPAT

SEQ ID NO: 1412792 - protein, 9 aa, Mycobacterium tuberculosis
RGGSAPLHR

SEQ ID NO: 1412793 - protein, 14 aa, Mycobacterium tuberculosis
RGLPTVSSSDAVQQ

SEQ ID NO: 1412794 - protein, 9 aa, Mycobacterium tuberculosis
RGPNGSTFN

SEQ ID NO: 1412795 - protein, 5 aa, Mycobacterium tuberculosis
RGPTG

SEQ ID NO: 1412796 - protein, 10 aa, Mycobacterium tuberculosis
RGRDAKTPPV

SEQ ID NO: 1412797 - protein, 6 aa, Mycobacterium tuberculosis
RGRGPV

SEQ ID NO: 1412798 - protein, 9 aa, Mycobacterium tuberculosis
RGRKIDPQW

SEQ ID NO: 1412799 - protein, 7 aa, Mycobacterium tuberculosis
RGSATGV

SEQ ID NO: 1412800 - protein, 5 aa, Mycobacterium tuberculosis
RGSSL

SEQ ID NO: 1412801 - protein, 7 aa, Mycobacterium tuberculosis
RGVGPGD

SEQ ID NO: 1412802 - protein, 7 aa, Mycobacterium tuberculosis
RGVTGGA

SEQ ID NO: 1412803 - protein, 11 aa, Mycobacterium tuberculosis
RGYTSKGPSGL

SEQ ID NO: 1412804 - protein, 6 aa, Mycobacterium tuberculosis
RHPAAE

SEQ ID NO: 1412805 - protein, 7 aa, Mycobacterium tuberculosis
RHPGRRS

SEQ ID NO: 1412806 - protein, 20 aa, Mycobacterium tuberculosis
RHSETEPLQSINGAVAELRA

SEQ ID NO: 1412807 - protein, 5 aa, Mycobacterium tuberculosis
RIGDN

SEQ ID NO: 1412808 - protein, 5 aa, Mycobacterium tuberculosis
RIGTA

SEQ ID NO: 1412809 - protein, 4 aa, Mycobacterium tuberculosis
RKEG

SEQ ID NO: 1412810 - protein, 6 aa, Mycobacterium tuberculosis
RKFGGG

SEQ ID NO: 1412811 - protein, 8 aa, Mycobacterium tuberculosis
RKRDANGA

SEQ ID NO: 1412812 - protein, 13 aa, Mycobacterium tuberculosis
RKRPPDLAAARSG

SEQ ID NO: 1412813 - protein, 6 aa, Mycobacterium tuberculosis
RKSGAL

SEQ ID NO: 1412814 - protein, 12 aa, Mycobacterium tuberculosis
RKVGEAPVNSEE

SEQ ID NO: 1412815 - protein, 6 aa, Mycobacterium tuberculosis
RLARAG

SEQ ID NO: 1412816 - protein, 16 aa, Mycobacterium tuberculosis
RLESKKISKTQAVTSN

SEQ ID NO: 1412817 - protein, 9 aa, Mycobacterium tuberculosis
RLSRPDGSV

SEQ ID NO: 1412818 - protein, 8 aa, Mycobacterium tuberculosis
RNGPTKTV

SEQ ID NO: 1412819 - protein, 7 aa, Mycobacterium tuberculosis
RNKPTTA

SEQ ID NO: 1412820 - protein, 8 aa, Mycobacterium tuberculosis
RNTSTGTT

SEQ ID NO: 1412821 - protein, 17 aa, Mycobacterium tuberculosis
RPDPVRPVRSAAVSVSS

SEQ ID NO: 1412822 - protein, 12 aa, Mycobacterium tuberculosis
RPGIGASTPHQY

SEQ ID NO: 1412823 - protein, 9 aa, Mycobacterium tuberculosis
RPIGGPDAA

SEQ ID NO: 1412824 - protein, 20 aa, Mycobacterium tuberculosis
RPPRTRSGAALPRSSDPVTD

SEQ ID NO: 1412825 - protein, 36 aa, Mycobacterium tuberculosis
RPQSNHAFGAEPGVAPMSDNSSYRGGQGQGRPDEYY

SEQ ID NO: 1412826 - protein, 23 aa, Mycobacterium tuberculosis
RPSAIGSQLPDADTLDTRQPPLQ

SEQ ID NO: 1412827 - protein, 21 aa, Mycobacterium tuberculosis
RQHASSIRREARSHRKSVKLA

SEQ ID NO: 1412828 - protein, 10 aa, Mycobacterium tuberculosis
RQHGAQPASQ

SEQ ID NO: 1412829 - protein, 4 aa, Mycobacterium tuberculosis
RQRP

SEQ ID NO: 1412830 - protein, 5 aa, Mycobacterium tuberculosis
RQRVD

SEQ ID NO: 1412831 - protein, 14 aa, Mycobacterium tuberculosis
RRASGRGPRSLTPE

SEQ ID NO: 1412832 - protein, 5 aa, Mycobacterium tuberculosis
RRAYT

SEQ ID NO: 1412833 - protein, 9 aa, Mycobacterium tuberculosis
RRGARFSTA

SEQ ID NO: 1412834 - protein, 14 aa, Mycobacterium tuberculosis
RRHRELDGSGTVRG

SEQ ID NO: 1412835 - protein, 44 aa, Mycobacterium tuberculosis; identical to SEQ ID NO: 186136

SEQ ID NO: 1412836 - protein, 9 aa, Mycobacterium tuberculosis
RRPGDQPGK

SEQ ID NO: 1412837 - protein, 9 aa, Mycobacterium tuberculosis
RRPPAGDGW

SEQ ID NO: 1412838 - protein, 18 aa, Mycobacterium tuberculosis
RRRPTGPPSGSGSGDRAG

SEQ ID NO: 1412839 - protein, 6 aa, Mycobacterium tuberculosis
RRRTNR

SEQ ID NO: 1412840 - protein, 4 aa, Mycobacterium tuberculosis
RRSR

SEQ ID NO: 1412841 - protein, 14 aa, Mycobacterium tuberculosis
RSADFTARPAPDDV

SEQ ID NO: 1412842 - protein, 8 aa, Mycobacterium tuberculosis
RSDPRNAR

SEQ ID NO: 1412843 - protein, 9 aa, Mycobacterium tuberculosis
RSENLTSTG

SEQ ID NO: 1412844 - protein, 7 aa, Mycobacterium tuberculosis
RSGAKDQ

SEQ ID NO: 1412845 - protein, 10 aa, Mycobacterium tuberculosis
RSGDVAPDSV

SEQ ID NO: 1412846 - protein, 11 aa, Mycobacterium tuberculosis
RSLADKTRAAL

SEQ ID NO: 1412847 - protein, 6 aa, Mycobacterium tuberculosis
RSNVDD

SEQ ID NO: 1412848 - protein, 13 aa, Mycobacterium tuberculosis
RSPDRDRAGQASI

SEQ ID NO: 1412849 - protein, 5 aa, Mycobacterium tuberculosis
RSRGA

SEQ ID NO: 1412850 - protein, 9 aa, Mycobacterium tuberculosis
RSSGGDSGA

SEQ ID NO: 1412851 - protein, 9 aa, Mycobacterium tuberculosis
RSSRAEPYT

SEQ ID NO: 1412852 - protein, 4 aa, Mycobacterium tuberculosis
RTAP

SEQ ID NO: 1412853 - protein, 10 aa, Mycobacterium tuberculosis
RTGEPSGGSL

SEQ ID NO: 1412854 - protein, 6 aa, Mycobacterium tuberculosis
RTKGEY

SEQ ID NO: 1412855 - protein, 8 aa, Mycobacterium tuberculosis
RTPDGSRS

SEQ ID NO: 1412856 - protein, 5 aa, Mycobacterium tuberculosis
RTRSN

SEQ ID NO: 1412857 - protein, 6 aa, Mycobacterium tuberculosis
RVPEPS

SEQ ID NO: 1412858 - protein, 6 aa, Mycobacterium tuberculosis
RVRQRR

SEQ ID NO: 1412859 - protein, 8 aa, Mycobacterium tuberculosis
RYATGAAR

SEQ ID NO: 1412860 - protein, 7 aa, Mycobacterium tuberculosis
RYPGAPR

SEQ ID NO: 1412861 - protein, 14 aa, Mycobacterium tuberculosis
SAASSAPASPGRRP

SEQ ID NO: 1412862 - protein, 5 aa, Mycobacterium tuberculosis
SAATR

SEQ ID NO: 1412863 - protein, 8 aa, Mycobacterium tuberculosis
SADGSGDL

SEQ ID NO: 1412864 - protein, 16 aa, Mycobacterium tuberculosis
SADHPDGLRQTRVGDA

SEQ ID NO: 1412865 - protein, 7 aa, Mycobacterium tuberculosis
SAEETAK

SEQ ID NO: 1412866 - protein, 9 aa, Mycobacterium tuberculosis
SAGGQASSV

SEQ ID NO: 1412867 - protein, 12 aa, Mycobacterium tuberculosis
SAGLGGADGVRV

SEQ ID NO: 1412868 - protein, 14 aa, Mycobacterium tuberculosis
SAGQAKPCATGAGT

SEQ ID NO: 1412869 - protein, 9 aa, Mycobacterium tuberculosis
SAGQSTGGG

SEQ ID NO: 1412870 - protein, 8 aa, Mycobacterium tuberculosis
SAISTSHG

SEQ ID NO: 1412871 - protein, 21 aa, Mycobacterium tuberculosis
SAPTRRQVDDSVAAAKSKSAL

SEQ ID NO: 1412872 - protein, 8 aa, Mycobacterium tuberculosis
SAQAENPG

SEQ ID NO: 1412873 - protein, 7 aa, Mycobacterium tuberculosis
SAQAKEE

SEQ ID NO: 1412874 - protein, 7 aa, Mycobacterium tuberculosis
SARNETE

SEQ ID NO: 1412875 - protein, 6 aa, Mycobacterium tuberculosis
SARPDV

SEQ ID NO: 1412876 - protein, 5 aa, Mycobacterium tuberculosis
SDADP

SEQ ID NO: 1412877 - protein, 7 aa, Mycobacterium tuberculosis
SDAPVTG

SEQ ID NO: 1412878 - protein, 9 aa, Mycobacterium tuberculosis
SDDDDRTRL

SEQ ID NO: 1412879 - protein, 5 aa, Mycobacterium tuberculosis
SDDGR

SEQ ID NO: 1412880 - protein, 6 aa, Mycobacterium tuberculosis
SDDKEP

SEQ ID NO: 1412881 - protein, 4 aa, Mycobacterium tuberculosis
SDFD

SEQ ID NO: 1412882 - protein, 4 aa, Mycobacterium tuberculosis
SDKP

SEQ ID NO: 1412883 - protein, 10 aa, Mycobacterium tuberculosis
SDLTRQTPCT

SEQ ID NO: 1412884 - protein, 11 aa, Mycobacterium tuberculosis
SDPNDRASAEQ

SEQ ID NO: 1412885 - protein, 12 aa, Mycobacterium tuberculosis
SDQGLADRQKVP

SEQ ID NO: 1412886 - protein, 12 aa, Mycobacterium tuberculosis
SDRQGKVPWTAD

SEQ ID NO: 1412887 - protein, 6 aa, Mycobacterium tuberculosis
SEAGDS

SEQ ID NO: 1412888 - protein, 4 aa, Mycobacterium tuberculosis
SEDD

SEQ ID NO: 1412889 - protein, 5 aa, Mycobacterium tuberculosis
SEGGI

SEQ ID NO: 1412890 - protein, 7 aa, Mycobacterium tuberculosis
SEPNEEL

SEQ ID NO: 1412891 - protein, 9 aa, Mycobacterium tuberculosis
SERDTDAAL

SEQ ID NO: 1412892 - protein, 8 aa, Mycobacterium tuberculosis
SFDPREEP

SEQ ID NO: 1412893 - protein, 16 aa, Mycobacterium tuberculosis
SFNTGIGNSGTGSTGL

SEQ ID NO: 1412894 - protein, 16 aa, Mycobacterium tuberculosis
SGAGGNSGFGNNGSGL

SEQ ID NO: 1412895 - protein, 5 aa, Mycobacterium tuberculosis
SGAGP

SEQ ID NO: 1412896 - protein, 5 aa, Mycobacterium tuberculosis
SGASA

SEQ ID NO: 1412897 - protein, 8 aa, Mycobacterium tuberculosis
SGASAAAE

SEQ ID NO: 1412898 - protein, 6 aa, Mycobacterium tuberculosis
SGDALS

SEQ ID NO: 1412899 - protein, 69 aa, Mycobacterium tuberculosis; identical to SEQ ID NO: 187377

SEQ ID NO: 1412900 - protein, 13 aa, Mycobacterium tuberculosis
SGGANGSAPPAPV

SEQ ID NO: 1412901 - protein, 7 aa, Mycobacterium tuberculosis
SGGERPP

SEQ ID NO: 1412902 - protein, 6 aa, Mycobacterium tuberculosis
SGGGSV

SEQ ID NO: 1412903 - protein, 41 aa, Mycobacterium tuberculosis; identical to SEQ ID NO: 187446

SEQ ID NO: 1412904 - protein, 12 aa, Mycobacterium tuberculosis
SGQEQNPDLTGR

SEQ ID NO: 1412905 - protein, 10 aa, Mycobacterium tuberculosis
SGQSSGTMAA

SEQ ID NO: 1412906 - protein, 23 aa, Mycobacterium tuberculosis
SGRAGVASTTAPPDGQVPDGTNL

SEQ ID NO: 1412907 - protein, 6 aa, Mycobacterium tuberculosis
SGREPH

SEQ ID NO: 1412908 - protein, 4 aa, Mycobacterium tuberculosis
SGRK

SEQ ID NO: 1412909 - protein, 6 aa, Mycobacterium tuberculosis
SGRPGA

SEQ ID NO: 1412910 - protein, 9 aa, Mycobacterium tuberculosis
SGRTPVTGA

SEQ ID NO: 1412911 - protein, 35 aa, Mycobacterium tuberculosis; identical to SEQ ID NO: 187551

SEQ ID NO: 1412912 - protein, 17 aa, Mycobacterium tuberculosis
SGSITEAARRLMAHDDL

SEQ ID NO: 1412913 - protein, 25 aa, Mycobacterium tuberculosis
SGSPPEPGKGRPDTTPEQEVPVTAP

SEQ ID NO: 1412914 - protein, 9 aa, Mycobacterium tuberculosis
SGSSGISGV

SEQ ID NO: 1412915 - protein, 7 aa, Mycobacterium tuberculosis
SGTDTDW

SEQ ID NO: 1412916 - protein, 37 aa, Mycobacterium tuberculosis; identical to SEQ ID NO: 187583

SEQ ID NO: 1412917 - protein, 8 aa, Mycobacterium tuberculosis
SGTTGRSK

SEQ ID NO: 1412918 - protein, 7 aa, Mycobacterium tuberculosis
SHQSGLA

SEQ ID NO: 1412919 - protein, 5 aa, Mycobacterium tuberculosis
SHQYP

SEQ ID NO: 1412920 - protein, 16 aa, Mycobacterium tuberculosis
SIEPRRASRGRGGRMT

SEQ ID NO: 1412921 - protein, 8 aa, Mycobacterium tuberculosis
SIGEPGTQ

SEQ ID NO: 1412922 - protein, 10 aa, Mycobacterium tuberculosis
SLNSGAGNTG

SEQ ID NO: 1412923 - protein, 8 aa, Mycobacterium tuberculosis
SLPTDDEL

SEQ ID NO: 1412924 - protein, 10 aa, Mycobacterium tuberculosis
SMGQENDGLD

SEQ ID NO: 1412925 - protein, 5 aa, Mycobacterium tuberculosis
SNEPT

SEQ ID NO: 1412926 - protein, 7 aa, Mycobacterium tuberculosis
SNRQYGA

SEQ ID NO: 1412927 - protein, 7 aa, Mycobacterium tuberculosis
SPAHADG

SEQ ID NO: 1412928 - protein, 5 aa, Mycobacterium tuberculosis
SPALQ

SEQ ID NO: 1412929 - protein, 16 aa, Mycobacterium tuberculosis
SPASGQEDRPGAPFGE

SEQ ID NO: 1412930 - protein, 6 aa, Mycobacterium tuberculosis
SPDGGL

SEQ ID NO: 1412931 - protein, 6 aa, Mycobacterium tuberculosis
SPGNSY

SEQ ID NO: 1412932 - protein, 13 aa, Mycobacterium tuberculosis
SPGPGTPERAGAS

SEQ ID NO: 1412933 - protein, 17 aa, Mycobacterium tuberculosis
SPKNPDNWTFTPNGPPV

SEQ ID NO: 1412934 - protein, 12 aa, Mycobacterium tuberculosis
SPLAADAVTASP

SEQ ID NO: 1412935 - protein, 6 aa, Mycobacterium tuberculosis
SPLSSA

SEQ ID NO: 1412936 - protein, 4 aa, Mycobacterium tuberculosis
SPST

SEQ ID NO: 1412937 - protein, 9 aa, Mycobacterium tuberculosis
SPTPAAAGR

SEQ ID NO: 1412938 - protein, 7 aa, Mycobacterium tuberculosis
SQAPHAH

SEQ ID NO: 1412939 - protein, 7 aa, Mycobacterium tuberculosis
SQFEKPE

SEQ ID NO: 1412940 - protein, 5 aa, Mycobacterium tuberculosis
SQPDL

SEQ ID NO: 1412941 - protein, 9 aa, Mycobacterium tuberculosis
SQRGGERDL

SEQ ID NO: 1412942 - protein, 6 aa, Mycobacterium tuberculosis
SRAGGR

SEQ ID NO: 1412943 - protein, 10 aa, Mycobacterium tuberculosis
SRAGKRAGKR

SEQ ID NO: 1412944 - protein, 9 aa, Mycobacterium tuberculosis
SRKPGRKHQ

SEQ ID NO: 1412945 - protein, 6 aa, Mycobacterium tuberculosis
SRPGDV

SEQ ID NO: 1412946 - protein, 5 aa, Mycobacterium tuberculosis
SRPGS

SEQ ID NO: 1412947 - protein, 10 aa, Mycobacterium tuberculosis
SRRDPDGPYG

SEQ ID NO: 1412948 - protein, 8 aa, Mycobacterium tuberculosis
SRTSGASL

SEQ ID NO: 1412949 - protein, 9 aa, Mycobacterium tuberculosis
SSAIGNSGF

SEQ ID NO: 1412950 - protein, 4 aa, Mycobacterium tuberculosis
SSGT

SEQ ID NO: 1412951 - protein, 6 aa, Mycobacterium tuberculosis
SSITSE

SEQ ID NO: 1412952 - protein, 6 aa, Mycobacterium tuberculosis
SSSMGA

SEQ ID NO: 1412953 - protein, 7 aa, Mycobacterium tuberculosis
SSTPERL

SEQ ID NO: 1412954 - protein, 7 aa, Mycobacterium tuberculosis
SSVGHAG

SEQ ID NO: 1412955 - protein, 8 aa, Mycobacterium tuberculosis
STAMTGAA

SEQ ID NO: 1412956 - protein, 6 aa, Mycobacterium tuberculosis
STGTPH

SEQ ID NO: 1412957 - protein, 6 aa, Mycobacterium tuberculosis
STHEAN

SEQ ID NO: 1412958 - protein, 13 aa, Mycobacterium tuberculosis
STIPDADDPSIAE

SEQ ID NO: 1412959 - protein, 16 aa, Mycobacterium tuberculosis
STLSAANAAALAPTTG

SEQ ID NO: 1412960 - protein, 13 aa, Mycobacterium tuberculosis
STSSARSANERES

SEQ ID NO: 1412961 - protein, 12 aa, Mycobacterium tuberculosis
STTHKTLGGPRG

SEQ ID NO: 1412962 - protein, 15 aa, Mycobacterium tuberculosis
SVADDEPGTPAAASL

SEQ ID NO: 1412963 - protein, 7 aa, Mycobacterium tuberculosis
SVGRGRH

SEQ ID NO: 1412964 - protein, 23 aa, Mycobacterium tuberculosis
SVTGARSKGAVIGGSSRSTSDAI

SEQ ID NO: 1412965 - protein, 11 aa, Mycobacterium tuberculosis
SWNSGTANTGL

SEQ ID NO: 1412966 - protein, 10 aa, Mycobacterium tuberculosis
SWPGTAAREA

SEQ ID NO: 1412967 - protein, 7 aa, Mycobacterium tuberculosis
SYGPTEA

SEQ ID NO: 1412968 - protein, 25 aa, Mycobacterium tuberculosis
SYRRGGRHRNGRFTKADTWAAYEVV

SEQ ID NO: 1412969 - protein, 20 aa, Mycobacterium tuberculosis
TAAATDTHGPPPDPNDDPPP

SEQ ID NO: 1412970 - protein, 15 aa, Mycobacterium tuberculosis
TAADGPHKRERASDL

SEQ ID NO: 1412971 - protein, 8 aa, Mycobacterium tuberculosis
TAAGHQQG

SEQ ID NO: 1412972 - protein, 6 aa, Mycobacterium tuberculosis
TAATEL

SEQ ID NO: 1412973 - protein, 11 aa, Mycobacterium tuberculosis
TAGPDTDDAAA

SEQ ID NO: 1412974 - protein, 8 aa, Mycobacterium tuberculosis
TAKSHAGQ

SEQ ID NO: 1412975 - protein, 6 aa, Mycobacterium tuberculosis
TARAQE

SEQ ID NO: 1412976 - protein, 5 aa, Mycobacterium tuberculosis
TARDR

SEQ ID NO: 1412977 - protein, 9 aa, Mycobacterium tuberculosis
TARPPSGFG

SEQ ID NO: 1412978 - protein, 4 aa, Mycobacterium tuberculosis
TATP

SEQ ID NO: 1412979 - protein, 9 aa, Mycobacterium tuberculosis
TDDSDGRTR

SEQ ID NO: 1412980 - protein, 6 aa, Mycobacterium tuberculosis
TDDSGN

SEQ ID NO: 1412981 - protein, 4 aa, Mycobacterium tuberculosis
TDEA

SEQ ID NO: 1412982 - protein, 8 aa, Mycobacterium tuberculosis
TDGDPVTA

SEQ ID NO: 1412983 - protein, 6 aa, Mycobacterium tuberculosis
TDGPAA

SEQ ID NO: 1412984 - protein, 13 aa, Mycobacterium tuberculosis
TDHPDADTEETAS

SEQ ID NO: 1412985 - protein, 5 aa, Mycobacterium tuberculosis
TDKGM

SEQ ID NO: 1412986 - protein, 7 aa, Mycobacterium tuberculosis
TDLDPDL

SEQ ID NO: 1412987 - protein, 6 aa, Mycobacterium tuberculosis
TDPAAN

SEQ ID NO: 1412988 - protein, 12 aa, Mycobacterium tuberculosis
TDPDAAAPHVAE

SEQ ID NO: 1412989 - protein, 26 aa, Mycobacterium tuberculosis
TDPTDSCGGRDRPGQLPCAPLDYHRH

SEQ ID NO: 1412990 - protein, 5 aa, Mycobacterium tuberculosis
TDRGD

SEQ ID NO: 1412991 - protein, 7 aa, Mycobacterium tuberculosis
TDRPDAR

SEQ ID NO: 1412992 - protein, 10 aa, Mycobacterium tuberculosis
TDRSTRDERH

SEQ ID NO: 1412993 - protein, 9 aa, Mycobacterium tuberculosis
TDTATARAE

SEQ ID NO: 1412994 - protein, 5 aa, Mycobacterium tuberculosis
TEHRG

SEQ ID NO: 1412995 - protein, 8 aa, Mycobacterium tuberculosis
TGAAQAAA

SEQ ID NO: 1412996 - protein, 12 aa, Mycobacterium tuberculosis
TGAGGGSGIGNL

SEQ ID NO: 1412997 - protein, 27 aa, Mycobacterium tuberculosis
TGARGGDVVTGDGPYEAADLDEQGPFP

SEQ ID NO: 1412998 - protein, 6 aa, Mycobacterium tuberculosis
TGDSDV

SEQ ID NO: 1412999 - protein, 7 aa, Mycobacterium tuberculosis
TGDVNTG

SEQ ID NO: 1413000 - protein, 10 aa, Mycobacterium tuberculosis
TGFANQGDIA

SEQ ID NO: 1413001 - protein, 11 aa, Mycobacterium tuberculosis
TGGQPPSEAQV

SEQ ID NO: 1413002 - protein, 11 aa, Mycobacterium tuberculosis
TGIGNSGDYNT

SEQ ID NO: 1413003 - protein, 11 aa, Mycobacterium tuberculosis
TGQADDVDGIP

SEQ ID NO: 1413004 - protein, 8 aa, Mycobacterium tuberculosis
TGQAGELP

SEQ ID NO: 1413005 - protein, 10 aa, Mycobacterium tuberculosis
TGRDAAVPTP

SEQ ID NO: 1413006 - protein, 6 aa, Mycobacterium tuberculosis
TGRWRN

SEQ ID NO: 1413007 - protein, 10 aa, Mycobacterium tuberculosis
TGSTPGAFDS

SEQ ID NO: 1413008 - protein, 16 aa, Mycobacterium tuberculosis
TGTMEASSRGASDADG

SEQ ID NO: 1413009 - protein, 6 aa, Mycobacterium tuberculosis
THDGTC

SEQ ID NO: 1413010 - protein, 5 aa, Mycobacterium tuberculosis
THGDT

SEQ ID NO: 1413011 - protein, 4 aa, Mycobacterium tuberculosis
THRR

SEQ ID NO: 1413012 - protein, 13 aa, Mycobacterium tuberculosis
TKAGSPPTSTEFD

SEQ ID NO: 1413013 - protein, 4 aa, Mycobacterium tuberculosis
TKGG

SEQ ID NO: 1413014 - protein, 9 aa, Mycobacterium tuberculosis
TKNATKLRG

SEQ ID NO: 1413015 - protein, 9 aa, Mycobacterium tuberculosis
TLGAGTPAV

SEQ ID NO: 1413016 - protein, 6 aa, Mycobacterium tuberculosis
TLPPEQ

SEQ ID NO: 1413017 - protein, 5 aa, Mycobacterium tuberculosis
TNASR

SEQ ID NO: 1413018 - protein, 16 aa, Mycobacterium tuberculosis
TNATRHQHDAAAAAVD

SEQ ID NO: 1413019 - protein, 21 aa, Mycobacterium tuberculosis
TNPSPPGEDGRGRNTTIKERQ

SEQ ID NO: 1413020 - protein, 5 aa, Mycobacterium tuberculosis
TPAFG

SEQ ID NO: 1413021 - protein, 6 aa, Mycobacterium tuberculosis
TPAITT

SEQ ID NO: 1413022 - protein, 10 aa, Mycobacterium tuberculosis
TPEAIDPDKA

SEQ ID NO: 1413023 - protein, 12 aa, Mycobacterium tuberculosis
TPGHADFGGEVE

SEQ ID NO: 1413024 - protein, 4 aa, Mycobacterium tuberculosis
TPGL

SEQ ID NO: 1413025 - protein, 10 aa, Mycobacterium tuberculosis
TPNPHATAEQ

SEQ ID NO: 1413026 - protein, 4 aa, Mycobacterium tuberculosis
TPNR

SEQ ID NO: 1413027 - protein, 7 aa, Mycobacterium tuberculosis
TPPARPV

SEQ ID NO: 1413028 - protein, 6 aa, Mycobacterium tuberculosis
TPPIPD

SEQ ID NO: 1413029 - protein, 6 aa, Mycobacterium tuberculosis
TPTGED

SEQ ID NO: 1413030 - protein, 12 aa, Mycobacterium tuberculosis
TQIGTGRQRFEQ

SEQ ID NO: 1413031 - protein, 7 aa, Mycobacterium tuberculosis
TRGVDDR

SEQ ID NO: 1413032 - protein, 4 aa, Mycobacterium tuberculosis
TRLP

SEQ ID NO: 1413033 - protein, 5 aa, Mycobacterium tuberculosis
TRSAH

SEQ ID NO: 1413034 - protein, 6 aa, Mycobacterium tuberculosis
TSAGPL

SEQ ID NO: 1413035 - protein, 6 aa, Mycobacterium tuberculosis
TSERYT

SEQ ID NO: 1413036 - protein, 13 aa, Mycobacterium tuberculosis
TSGDGTRPLTGAP

SEQ ID NO: 1413037 - protein, 7 aa, Mycobacterium tuberculosis
TSKLDEE

SEQ ID NO: 1413038 - protein, 19 aa, Mycobacterium tuberculosis
TSNPEGAAVQNAAADGRSV

SEQ ID NO: 1413039 - protein, 11 aa, Mycobacterium tuberculosis
TSPTARGGWRE

SEQ ID NO: 1413040 - protein, 8 aa, Mycobacterium tuberculosis
TSQAETRV

SEQ ID NO: 1413041 - protein, 24 aa, Mycobacterium tuberculosis
TSSAHPKADLTDPEKQILSLQVTV

SEQ ID NO: 1413042 - protein, 8 aa, Mycobacterium tuberculosis
TSSEAGLV

SEQ ID NO: 1413043 - protein, 10 aa, Mycobacterium tuberculosis
TSSPEELGNI

SEQ ID NO: 1413044 - protein, 7 aa, Mycobacterium tuberculosis
TSYGRSS

SEQ ID NO: 1413045 - protein, 5 aa, Mycobacterium tuberculosis
TTADG

SEQ ID NO: 1413046 - protein, 15 aa, Mycobacterium tuberculosis
TTAEQLGARGGSNGG

SEQ ID NO: 1413047 - protein, 18 aa, Mycobacterium tuberculosis
TTAPATNPASASAVQAKD

SEQ ID NO: 1413048 - protein, 6 aa, Mycobacterium tuberculosis
TTEDSA

SEQ ID NO: 1413049 - protein, 5 aa, Mycobacterium tuberculosis
TTGGI

SEQ ID NO: 1413050 - protein, 5 aa, Mycobacterium tuberculosis
TTGLG

SEQ ID NO: 1413051 - protein, 17 aa, Mycobacterium tuberculosis
TTHTTHPPQTPHPPEPH

SEQ ID NO: 1413052 - protein, 17 aa, Mycobacterium tuberculosis
TTPDGDYQTYKANDGGY

SEQ ID NO: 1413053 - protein, 8 aa, Mycobacterium tuberculosis
TTSEHHKP

SEQ ID NO: 1413054 - protein, 14 aa, Mycobacterium tuberculosis
TTTIRSAKSSSSAV

SEQ ID NO: 1413055 - protein, 9 aa, Mycobacterium tuberculosis
TVAGRKEEF

SEQ ID NO: 1413056 - protein, 14 aa, Mycobacterium tuberculosis
TVDAPGKAQAKSMA

SEQ ID NO: 1413057 - protein, 9 aa, Mycobacterium tuberculosis
TVGPAPGQY

SEQ ID NO: 1413058 - protein, 4 aa, Mycobacterium tuberculosis
TVPS

SEQ ID NO: 1413059 - protein, 12 aa, Mycobacterium tuberculosis
TVSAGEDSPPGA

SEQ ID NO: 1413060 - protein, 5 aa, Mycobacterium tuberculosis
TYASS

SEQ ID NO: 1413061 - protein, 8 aa, Mycobacterium tuberculosis
TYGTYDDS

SEQ ID NO: 1413062 - protein, 7 aa, Mycobacterium tuberculosis
VAERTDE

SEQ ID NO: 1413063 - protein, 12 aa, Mycobacterium tuberculosis
VAGAGRGSVAAA

SEQ ID NO: 1413064 - protein, 28 aa, Mycobacterium tuberculosis
VARKTQKSETEAPREPAPVSDEKQTDVA

SEQ ID NO: 1413065 - protein, 23 aa, Mycobacterium tuberculosis
VATQPAWGTGEQAAQPLNGSTSR

SEQ ID NO: 1413066 - protein, 14 aa, Mycobacterium tuberculosis
VDETPAAESAEPIT

SEQ ID NO: 1413067 - protein, 9 aa, Mycobacterium tuberculosis
VDQPPHEPI

SEQ ID NO: 1413068 - protein, 6 aa, Mycobacterium tuberculosis
VEPAPT

SEQ ID NO: 1413069 - protein, 15 aa, Mycobacterium tuberculosis
VERSGDRSAPYAAPR

SEQ ID NO: 1413070 - protein, 14 aa, Mycobacterium tuberculosis
VESPTGTTRHPPGN

SEQ ID NO: 1413071 - protein, 23 aa, Mycobacterium tuberculosis
VETPTPRNAAGAALTSLADSADR

SEQ ID NO: 1413072 - protein, 10 aa, Mycobacterium tuberculosis
VEVEGDPECQ

SEQ ID NO: 1413073 - protein, 6 aa, Mycobacterium tuberculosis
VEYEQD

SEQ ID NO: 1413074 - protein, 31 aa, Mycobacterium tuberculosis; identical to SEQ ID NO: 190867

SEQ ID NO: 1413075 - protein, 4 aa, Mycobacterium tuberculosis
VGRG

SEQ ID NO: 1413076 - protein, 5 aa, Mycobacterium tuberculosis
VGSYT

SEQ ID NO: 1413077 - protein, 10 aa, Mycobacterium tuberculosis
VGTDSGGAAA

SEQ ID NO: 1413078 - protein, 8 aa, Mycobacterium tuberculosis
VKPPPSEG

SEQ ID NO: 1413079 - protein, 7 aa, Mycobacterium tuberculosis
VLPGGSD

SEQ ID NO: 1413080 - protein, 9 aa, Mycobacterium tuberculosis
VNDDGAEPD

SEQ ID NO: 1413081 - protein, 14 aa, Mycobacterium tuberculosis
VNPEPSAKREQTDE

SEQ ID NO: 1413082 - protein, 6 aa, Mycobacterium tuberculosis
VNPGRE

SEQ ID NO: 1413083 - protein, 9 aa, Mycobacterium tuberculosis
VNPQRSLSR

SEQ ID NO: 1413084 - protein, 13 aa, Mycobacterium tuberculosis
VPAPEPAAETTRG

SEQ ID NO: 1413085 - protein, 7 aa, Mycobacterium tuberculosis
VPDSGLR

SEQ ID NO: 1413086 - protein, 12 aa, Mycobacterium tuberculosis
VPERGPAGCGGL

SEQ ID NO: 1413087 - protein, 8 aa, Mycobacterium tuberculosis
VPPETTGF

SEQ ID NO: 1413088 - protein, 5 aa, Mycobacterium tuberculosis
VPPGA

SEQ ID NO: 1413089 - protein, 11 aa, Mycobacterium tuberculosis
VPRGKAPIADV

SEQ ID NO: 1413090 - protein, 8 aa, Mycobacterium tuberculosis
VPRGRKEA

SEQ ID NO: 1413091 - protein, 7 aa, Mycobacterium tuberculosis
VQDSNAG

SEQ ID NO: 1413092 - protein, 14 aa, Mycobacterium tuberculosis
VQHEPSAHAAAADV

SEQ ID NO: 1413093 - protein, 8 aa, Mycobacterium tuberculosis
VRAAEQLG

SEQ ID NO: 1413094 - protein, 7 aa, Mycobacterium tuberculosis
VRAGAGD

SEQ ID NO: 1413095 - protein, 6 aa, Mycobacterium tuberculosis
VRGPDG

SEQ ID NO: 1413096 - protein, 4 aa, Mycobacterium tuberculosis
VRSD

SEQ ID NO: 1413097 - protein, 9 aa, Mycobacterium tuberculosis
VSADPPSTA

SEQ ID NO: 1413098 - protein, 11 aa, Mycobacterium tuberculosis
VSEYNGDPAWA

SEQ ID NO: 1413099 - protein, 7 aa, Mycobacterium tuberculosis
VSPTITP

SEQ ID NO: 1413100 - protein, 15 aa, Mycobacterium tuberculosis
VSTGYHNADDALNRD

SEQ ID NO: 1413101 - protein, 11 aa, Mycobacterium tuberculosis
VTAGAPPDEFN

SEQ ID NO: 1413102 - protein, 11 aa, Mycobacterium tuberculosis
VTAGERPGRGA

SEQ ID NO: 1413103 - protein, 14 aa, Mycobacterium tuberculosis
VTAPAVPNGQPVKG

SEQ ID NO: 1413104 - protein, 4 aa, Mycobacterium tuberculosis
VTDQ

SEQ ID NO: 1413105 - protein, 13 aa, Mycobacterium tuberculosis
VTGPSEQSDTDRQ

SEQ ID NO: 1413106 - protein, 8 aa, Mycobacterium tuberculosis
VTPADSPL

SEQ ID NO: 1413107 - protein, 9 aa, Mycobacterium tuberculosis
VTRRGGREG

SEQ ID NO: 1413108 - protein, 6 aa, Mycobacterium tuberculosis
VTTGPK

SEQ ID NO: 1413109 - protein, 11 aa, Mycobacterium tuberculosis
VTTPKSDAGVR

SEQ ID NO: 1413110 - protein, 11 aa, Mycobacterium tuberculosis
WAPSTGSTVSW

SEQ ID NO: 1413111 - protein, 13 aa, Mycobacterium tuberculosis
WGAPPADPVDDDA

SEQ ID NO: 1413112 - protein, 4 aa, Mycobacterium tuberculosis
WRAP

SEQ ID NO: 1413113 - protein, 11 aa, Mycobacterium tuberculosis
WTDEHGTRPLA

SEQ ID NO: 1413114 - protein, 16 aa, Mycobacterium tuberculosis
YADRGEAFATAVRAVI

SEQ ID NO: 1413115 - protein, 15 aa, Mycobacterium tuberculosis
YARQSKSADYPSCTP

SEQ ID NO: 1413116 - protein, 12 aa, Mycobacterium tuberculosis
YDPDPSASGRMT

SEQ ID NO: 1413117 - protein, 9 aa, Mycobacterium tuberculosis
YESAQPVAD

SEQ ID NO: 1413118 - protein, 8 aa, Mycobacterium tuberculosis
YGDAQEAL

SEQ ID NO: 1413119 - protein, 8 aa, Mycobacterium tuberculosis
YGGDQEHR

SEQ ID NO: 1413120 - protein, 19 aa, Mycobacterium tuberculosis
YGPPPDPRLTSTTITPDPG

SEQ ID NO: 1413121 - protein, 5 aa, Mycobacterium tuberculosis
YGVPA

SEQ ID NO: 1413122 - protein, 5 aa, Mycobacterium tuberculosis
YPEHG

SEQ ID NO: 1413123 - protein, 12 aa, Mycobacterium tuberculosis
YPPSGGSRAIEG

SEQ ID NO: 1413124 - protein, 13 aa, Mycobacterium tuberculosis
YPQPMAPAAAAEH

SEQ ID NO: 1413125 - protein, 9 aa, Mycobacterium tuberculosis
YQNSRKRAV

SEQ ID NO: 1413126 - protein, 5 aa, Mycobacterium tuberculosis
YQRRD

SEQ ID NO: 1413127 - protein, 6 aa, Mycobacterium tuberculosis
AAAAEG

SEQ ID NO: 1413128 - protein, 8 aa, Mycobacterium tuberculosis
AAAASPGD

SEQ ID NO: 1413129 - protein, 19 aa, Mycobacterium tuberculosis
AAAGRGSGNSRNGSRNKKV

SEQ ID NO: 1413130 - protein, 6 aa, Mycobacterium tuberculosis
AAAGRQ

SEQ ID NO: 1413131 - protein, 5 aa, Mycobacterium tuberculosis
AAAQL

SEQ ID NO: 1413132 - protein, 7 aa, Mycobacterium tuberculosis
AAATEQP

SEQ ID NO: 1413133 - protein, 5 aa, Mycobacterium tuberculosis
AAATP

SEQ ID NO: 1413134 - protein, 6 aa, Mycobacterium tuberculosis
AAATTQ

SEQ ID NO: 1413135 - protein, 10 aa, Mycobacterium tuberculosis
AAAVSQATDP

SEQ ID NO: 1413136 - protein, 4 aa, Mycobacterium tuberculosis
AADA

SEQ ID NO: 1413137 - protein, 8 aa, Mycobacterium tuberculosis
AADAAGRG

SEQ ID NO: 1413138 - protein, 8 aa, Mycobacterium tuberculosis
AADEAGVP

SEQ ID NO: 1413139 - protein, 11 aa, Mycobacterium tuberculosis
AADGTGFSEGG

SEQ ID NO: 1413140 - protein, 5 aa, Mycobacterium tuberculosis
AADTG

SEQ ID NO: 1413141 - protein, 9 aa, Mycobacterium tuberculosis
AAEAAGYSS

SEQ ID NO: 1413142 - protein, 9 aa, Mycobacterium tuberculosis
AAEAGKDAA

SEQ ID NO: 1413143 - protein, 16 aa, Mycobacterium tuberculosis
AAEARGQQVDEAADAA

SEQ ID NO: 1413144 - protein, 10 aa, Mycobacterium tuberculosis
AAEPGAAGRH

SEQ ID NO: 1413145 - protein, 8 aa, Mycobacterium tuberculosis
AAGRDAAA

SEQ ID NO: 1413146 - protein, 22 aa, Mycobacterium tuberculosis
AAHDADDAATYPSDLTAKAAEL

SEQ ID NO: 1413147 - protein, 6 aa, Mycobacterium tuberculosis
AAHERK

SEQ ID NO: 1413148 - protein, 6 aa, Mycobacterium tuberculosis
AAKNDG

SEQ ID NO: 1413149 - protein, 17 aa, Mycobacterium tuberculosis
AAMGTSTAGQVSISSPE

SEQ ID NO: 1413150 - protein, 5 aa, Mycobacterium tuberculosis
AANQI

SEQ ID NO: 1413151 - protein, 10 aa, Mycobacterium tuberculosis
AANSDDLADT

SEQ ID NO: 1413152 - protein, 8 aa, Mycobacterium tuberculosis
AAPAGPAQ

SEQ ID NO: 1413153 - protein, 10 aa, Mycobacterium tuberculosis
AAPDYGRDEQ

SEQ ID NO: 1413154 - protein, 24 aa, Mycobacterium tuberculosis
AAPYGGPCRPPQHTSKAAAPRIPA

SEQ ID NO: 1413155 - protein, 11 aa, Mycobacterium tuberculosis
AAQAASTTAEK

SEQ ID NO: 1413156 - protein, 12 aa, Mycobacterium tuberculosis
AAQAQQAATQTR

SEQ ID NO: 1413157 - protein, 5 aa, Mycobacterium tuberculosis
AARAC

SEQ ID NO: 1413158 - protein, 7 aa, Mycobacterium tuberculosis
AARDRVG

SEQ ID NO: 1413159 - protein, 8 aa, Mycobacterium tuberculosis
AARTGAQA

SEQ ID NO: 1413160 - protein, 8 aa, Mycobacterium tuberculosis
AASEAGIE

SEQ ID NO: 1413161 - protein, 10 aa, Mycobacterium tuberculosis
AASSAAAAQL

SEQ ID NO: 1413162 - protein, 18 aa, Mycobacterium tuberculosis
AATETALKERKESVEDAV

SEQ ID NO: 1413163 - protein, 6 aa, Mycobacterium tuberculosis
AATPAI

SEQ ID NO: 1413164 - protein, 7 aa, Mycobacterium tuberculosis
AATPEQI

SEQ ID NO: 1413165 - protein, 20 aa, Mycobacterium tuberculosis
AATQKPPGDSFKDGSYDPSR

SEQ ID NO: 1413166 - protein, 17 aa, Mycobacterium tuberculosis
AATRGGWRAGGVRDGRI

SEQ ID NO: 1413167 - protein, 11 aa, Mycobacterium tuberculosis
AATSAGSTLGE

SEQ ID NO: 1413168 - protein, 5 aa, Mycobacterium tuberculosis
ADCAA

SEQ ID NO: 1413169 - protein, 4 aa, Mycobacterium tuberculosis
ADDD

SEQ ID NO: 1413170 - protein, 6 aa, Mycobacterium tuberculosis
ADGSSV

SEQ ID NO: 1413171 - protein, 14 aa, Mycobacterium tuberculosis
ADLPSALTTPEAPT

SEQ ID NO: 1413172 - protein, 7 aa, Mycobacterium tuberculosis
ADLTNRS

SEQ ID NO: 1413173 - protein, 12 aa, Mycobacterium tuberculosis
ADPAWGPAARPA

SEQ ID NO: 1413174 - protein, 7 aa, Mycobacterium tuberculosis
ADPGYPW

SEQ ID NO: 1413175 - protein, 7 aa, Mycobacterium tuberculosis
ADPIAAT

SEQ ID NO: 1413176 - protein, 8 aa, Mycobacterium tuberculosis
ADRARTKT

SEQ ID NO: 1413177 - protein, 6 aa, Mycobacterium tuberculosis
ADRRYS

SEQ ID NO: 1413178 - protein, 8 aa, Mycobacterium tuberculosis
ADRSDPLA

SEQ ID NO: 1413179 - protein, 5 aa, Mycobacterium tuberculosis
ADSDL

SEQ ID NO: 1413180 - protein, 11 aa, Mycobacterium tuberculosis
ADSTRRAEEDR

SEQ ID NO: 1413181 - protein, 6 aa, Mycobacterium tuberculosis
ADTPHV

SEQ ID NO: 1413182 - protein, 7 aa, Mycobacterium tuberculosis
AEAKPDI

SEQ ID NO: 1413183 - protein, 6 aa, Mycobacterium tuberculosis
AEAQAE

SEQ ID NO: 1413184 - protein, 16 aa, Mycobacterium tuberculosis
AEARREKESAIDAQDF

SEQ ID NO: 1413185 - protein, 15 aa, Mycobacterium tuberculosis
AEDLNAAREADTPAA

SEQ ID NO: 1413186 - protein, 13 aa, Mycobacterium tuberculosis
AEGKATELASREG

SEQ ID NO: 1413187 - protein, 6 aa, Mycobacterium tuberculosis
AEHPRD

SEQ ID NO: 1413188 - protein, 10 aa, Mycobacterium tuberculosis
AELNGDPART

SEQ ID NO: 1413189 - protein, 4 aa, Mycobacterium tuberculosis
AENN

SEQ ID NO: 1413190 - protein, 5 aa, Mycobacterium tuberculosis
AENQF

SEQ ID NO: 1413191 - protein, 11 aa, Mycobacterium tuberculosis
AERAYAAREAE

SEQ ID NO: 1413192 - protein, 7 aa, Mycobacterium tuberculosis
AEREDWA

SEQ ID NO: 1413193 - protein, 8 aa, Mycobacterium tuberculosis
AERPGDAV

SEQ ID NO: 1413194 - protein, 9 aa, Mycobacterium tuberculosis
AETETRTQA

SEQ ID NO: 1413195 - protein, 14 aa, Mycobacterium tuberculosis
AETRARRRNAQNVA

SEQ ID NO: 1413196 - protein, 5 aa, Mycobacterium tuberculosis
AEVER

SEQ ID NO: 1413197 - protein, 6 aa, Mycobacterium tuberculosis
AEYPQA

SEQ ID NO: 1413198 - protein, 4 aa, Mycobacterium tuberculosis
AGAA

SEQ ID NO: 1413199 - protein, 6 aa, Mycobacterium tuberculosis
AGAGGV

SEQ ID NO: 1413200 - protein, 21 aa, Mycobacterium tuberculosis
AGAGYQHNETASAQVLREVGG

SEQ ID NO: 1413201 - protein, 4 aa, Mycobacterium tuberculosis
AGAM

SEQ ID NO: 1413202 - protein, 14 aa, Mycobacterium tuberculosis
AGAPGRASANGTSM

SEQ ID NO: 1413203 - protein, 6 aa, Mycobacterium tuberculosis
AGASRV

SEQ ID NO: 1413204 - protein, 5 aa, Mycobacterium tuberculosis
AGDFN

SEQ ID NO: 1413205 - protein, 7 aa, Mycobacterium tuberculosis
AGDVSGA

SEQ ID NO: 1413206 - protein, 4 aa, Mycobacterium tuberculosis
AGEP

SEQ ID NO: 1413207 - protein, 14 aa, Mycobacterium tuberculosis
AGESRAIPTGSCPT

SEQ ID NO: 1413208 - protein, 16 aa, Mycobacterium tuberculosis
AGETGGNCELTEPGRT

SEQ ID NO: 1413209 - protein, 8 aa, Mycobacterium tuberculosis
AGGARPGG

SEQ ID NO: 1413210 - protein, 15 aa, Mycobacterium tuberculosis
AGGMHGSNRLGGNSL

SEQ ID NO: 1413211 - protein, 10 aa, Mycobacterium tuberculosis
AGIQRAKRTR

SEQ ID NO: 1413212 - protein, 6 aa, Mycobacterium tuberculosis
AGKALR

SEQ ID NO: 1413213 - protein, 6 aa, Mycobacterium tuberculosis
AGKGAS

SEQ ID NO: 1413214 - protein, 12 aa, Mycobacterium tuberculosis
AGKPKPDGTPTF

SEQ ID NO: 1413215 - protein, 26 aa, Mycobacterium tuberculosis
AGNTNTGSFNPGDYNTGGFNPGNYNT

SEQ ID NO: 1413216 - protein, 17 aa, Mycobacterium tuberculosis
AGPAGLATAANAAQRGH

SEQ ID NO: 1413217 - protein, 6 aa, Mycobacterium tuberculosis
AGPSAQ

SEQ ID NO: 1413218 - protein, 9 aa, Mycobacterium tuberculosis
AGPSGDIEE

SEQ ID NO: 1413219 - protein, 8 aa, Mycobacterium tuberculosis
AGPSRTAC

SEQ ID NO: 1413220 - protein, 8 aa, Mycobacterium tuberculosis
AGPVPQAE

SEQ ID NO: 1413221 - protein, 26 aa, Mycobacterium tuberculosis
AGQIKRSAAVPDRDGTSHAAPSNAPG

SEQ ID NO: 1413222 - protein, 18 aa, Mycobacterium tuberculosis
AGQLPPEPPIWPTTSTPT

SEQ ID NO: 1413223 - protein, 7 aa, Mycobacterium tuberculosis
AGQRPAT

SEQ ID NO: 1413224 - protein, 39 aa, Mycobacterium tuberculosis
AGRALAGTAVRSGAGAARVAGGSVTEDVASTTTIIVIPA

SEQ ID NO: 1413225 - protein, 9 aa, Mycobacterium tuberculosis
AGRDSNSRG

SEQ ID NO: 1413226 - protein, 4 aa, Mycobacterium tuberculosis
AGRE

SEQ ID NO: 1413227 - protein, 5 aa, Mycobacterium tuberculosis
AGRPP

SEQ ID NO: 1413228 - protein, 25 aa, Mycobacterium tuberculosis
AGRRTETHERPIDGTPVVDTDRGGK

SEQ ID NO: 1413229 - protein, 6 aa, Mycobacterium tuberculosis
AGSGPM

SEQ ID NO: 1413230 - protein, 48 aa, Mycobacterium tuberculosis; identical to SEQ ID NO: 168538

SEQ ID NO: 1413231 - protein, 7 aa, Mycobacterium tuberculosis
AGSSIPA

SEQ ID NO: 1413232 - protein, 7 aa, Mycobacterium tuberculosis
AGTAEQK

SEQ ID NO: 1413233 - protein, 16 aa, Mycobacterium tuberculosis
AGTGIGSATARRALAE

SEQ ID NO: 1413234 - protein, 8 aa, Mycobacterium tuberculosis
AGTSDGSH

SEQ ID NO: 1413235 - protein, 6 aa, Mycobacterium tuberculosis
AGTTVG

SEQ ID NO: 1413236 - protein, 7 aa, Mycobacterium tuberculosis
AGVSRPT

SEQ ID NO: 1413237 - protein, 14 aa, Mycobacterium tuberculosis
AGVTVTSDQGQAEA

SEQ ID NO: 1413238 - protein, 5 aa, Mycobacterium tuberculosis
AHRDT

SEQ ID NO: 1413239 - protein, 9 aa, Mycobacterium tuberculosis
AISTVPADR

SEQ ID NO: 1413240 - protein, 8 aa, Mycobacterium tuberculosis
AITDPGAV

SEQ ID NO: 1413241 - protein, 9 aa, Mycobacterium tuberculosis
AITGSESDQ

SEQ ID NO: 1413242 - protein, 13 aa, Mycobacterium tuberculosis
AKAVAEEATKRTV

SEQ ID NO: 1413243 - protein, 6 aa, Mycobacterium tuberculosis
AKPGKT

SEQ ID NO: 1413244 - protein, 11 aa, Mycobacterium tuberculosis
AKQALKERKTI

SEQ ID NO: 1413245 - protein, 20 aa, Mycobacterium tuberculosis
AKSQNKPPGPPPSLHAPPSW

SEQ ID NO: 1413246 - protein, 4 aa, Mycobacterium tuberculosis
AKTG

SEQ ID NO: 1413247 - protein, 8 aa, Mycobacterium tuberculosis
AKTPFTST

SEQ ID NO: 1413248 - protein, 10 aa, Mycobacterium tuberculosis
AKTPKQKRDR

SEQ ID NO: 1413249 - protein, 6 aa, Mycobacterium tuberculosis
ALAEAG

SEQ ID NO: 1413250 - protein, 28 aa, Mycobacterium tuberculosis
ALAEPSRQPDDMSAECADDQGARCHLGQ

SEQ ID NO: 1413251 - protein, 11 aa, Mycobacterium tuberculosis
ALAPRRTTLPG

SEQ ID NO: 1413252 - protein, 7 aa, Mycobacterium tuberculosis
ALASTPK

SEQ ID NO: 1413253 - protein, 9 aa, Mycobacterium tuberculosis
ALDRDGQKI

SEQ ID NO: 1413254 - protein, 8 aa, Mycobacterium tuberculosis
ALEGGAGP

SEQ ID NO: 1413255 - protein, 10 aa, Mycobacterium tuberculosis
ALGGERTSGF

SEQ ID NO: 1413256 - protein, 6 aa, Mycobacterium tuberculosis
ALKETS

SEQ ID NO: 1413257 - protein, 7 aa, Mycobacterium tuberculosis
ALPEDGD

SEQ ID NO: 1413258 - protein, 10 aa, Mycobacterium tuberculosis
ALPPGSGGPV

SEQ ID NO: 1413259 - protein, 8 aa, Mycobacterium tuberculosis
ALPSGASF

SEQ ID NO: 1413260 - protein, 17 aa, Mycobacterium tuberculosis
ALPSPPRGFTPAPPPQW

SEQ ID NO: 1413261 - protein, 12 aa, Mycobacterium tuberculosis
ALQPPGGGLSTF

SEQ ID NO: 1413262 - protein, 6 aa, Mycobacterium tuberculosis
ALTGRQ

SEQ ID NO: 1413263 - protein, 8 aa, Mycobacterium tuberculosis
AMKGNLAK

SEQ ID NO: 1413264 - protein, 5 aa, Mycobacterium tuberculosis
AMKPG

SEQ ID NO: 1413265 - protein, 10 aa, Mycobacterium tuberculosis
AMRSNPGAGG

SEQ ID NO: 1413266 - protein, 6 aa, Mycobacterium tuberculosis
AMTGGL

SEQ ID NO: 1413267 - protein, 4 aa, Mycobacterium tuberculosis
ANER

SEQ ID NO: 1413268 - protein, 22 aa, Mycobacterium tuberculosis
ANESHYAGEHAHGGADQLSRGP

SEQ ID NO: 1413269 - protein, 9 aa, Mycobacterium tuberculosis
ANGIPKAGR

SEQ ID NO: 1413270 - protein, 6 aa, Mycobacterium tuberculosis
ANPDVE

SEQ ID NO: 1413271 - protein, 5 aa, Mycobacterium tuberculosis
ANPRG

SEQ ID NO: 1413272 - protein, 6 aa, Mycobacterium tuberculosis
ANPSRL

SEQ ID NO: 1413273 - protein, 5 aa, Mycobacterium tuberculosis
ANQRA

SEQ ID NO: 1413274 - protein, 5 aa, Mycobacterium tuberculosis
ANRTD

SEQ ID NO: 1413275 - protein, 21 aa, Mycobacterium tuberculosis
ANSAAAAQTTAVAAAGADEVS

SEQ ID NO: 1413276 - protein, 5 aa, Mycobacterium tuberculosis
ANSGL

SEQ ID NO: 1413277 - protein, 11 aa, Mycobacterium tuberculosis
APAERQRQLQD

SEQ ID NO: 1413278 - protein, 8 aa, Mycobacterium tuberculosis
APAGDGTV

SEQ ID NO: 1413279 - protein, 14 aa, Mycobacterium tuberculosis
APASNTTGLTETSR

SEQ ID NO: 1413280 - protein, 8 aa, Mycobacterium tuberculosis
APDEKWGE

SEQ ID NO: 1413281 - protein, 4 aa, Mycobacterium tuberculosis
APFQ

SEQ ID NO: 1413282 - protein, 6 aa, Mycobacterium tuberculosis
APGFEA

SEQ ID NO: 1413283 - protein, 28 aa, Mycobacterium tuberculosis
APGFGGPGGSGGASLLGPPGLAGTNGAD

SEQ ID NO: 1413284 - protein, 9 aa, Mycobacterium tuberculosis
APGGDATAH

SEQ ID NO: 1413285 - protein, 6 aa, Mycobacterium tuberculosis
APGSAE

SEQ ID NO: 1413286 - protein, 14 aa, Mycobacterium tuberculosis
APGTYSSAGPVGDG

SEQ ID NO: 1413287 - protein, 5 aa, Mycobacterium tuberculosis
APHRD

SEQ ID NO: 1413288 - protein, 15 aa, Mycobacterium tuberculosis
APLGSPGGAAAVGPI

SEQ ID NO: 1413289 - protein, 8 aa, Mycobacterium tuberculosis
APLRPPNV

SEQ ID NO: 1413290 - protein, 21 aa, Mycobacterium tuberculosis
APPEPGAGRRRGHLRVLPDPA

SEQ ID NO: 1413291 - protein, 9 aa, Mycobacterium tuberculosis
APQYPVPAQ

SEQ ID NO: 1413292 - protein, 14 aa, Mycobacterium tuberculosis
APSGELKTKPTQHS

SEQ ID NO: 1413293 - protein, 7 aa, Mycobacterium tuberculosis
APSSSTS

SEQ ID NO: 1413294 - protein, 14 aa, Mycobacterium tuberculosis
APYALPKSGTKRPW

SEQ ID NO: 1413295 - protein, 8 aa, Mycobacterium tuberculosis
AQAETERD

SEQ ID NO: 1413296 - protein, 6 aa, Mycobacterium tuberculosis
AQAHPK

SEQ ID NO: 1413297 - protein, 7 aa, Mycobacterium tuberculosis
AQPNGGS

SEQ ID NO: 1413298 - protein, 7 aa, Mycobacterium tuberculosis
AQQTVTG

SEQ ID NO: 1413299 - protein, 15 aa, Mycobacterium tuberculosis
AQRGRGARKRPTSGW

SEQ ID NO: 1413300 - protein, 5 aa, Mycobacterium tuberculosis
AQSGR

SEQ ID NO: 1413301 - protein, 15 aa, Mycobacterium tuberculosis
AQSSTTGSPGPLPLQ

SEQ ID NO: 1413302 - protein, 6 aa, Mycobacterium tuberculosis
AQVKRN

SEQ ID NO: 1413303 - protein, 9 aa, Mycobacterium tuberculosis
ARAGGGPTL

SEQ ID NO: 1413304 - protein, 15 aa, Mycobacterium tuberculosis
ARAQARQSVKAATDE

SEQ ID NO: 1413305 - protein, 8 aa, Mycobacterium tuberculosis
ARDADGSL

SEQ ID NO: 1413306 - protein, 7 aa, Mycobacterium tuberculosis
ARDGDRD

SEQ ID NO: 1413307 - protein, 8 aa, Mycobacterium tuberculosis
AREARPEL

SEQ ID NO: 1413308 - protein, 4 aa, Mycobacterium tuberculosis
AREI

SEQ ID NO: 1413309 - protein, 5 aa, Mycobacterium tuberculosis
AREQL

SEQ ID NO: 1413310 - protein, 9 aa, Mycobacterium tuberculosis
ARGGSMSPA

SEQ ID NO: 1413311 - protein, 5 aa, Mycobacterium tuberculosis
ARGIG

SEQ ID NO: 1413312 - protein, 8 aa, Mycobacterium tuberculosis
ARGKSGRL

SEQ ID NO: 1413313 - protein, 6 aa, Mycobacterium tuberculosis
ARHGGS

SEQ ID NO: 1413314 - protein, 8 aa, Mycobacterium tuberculosis
ARKSGYGL

SEQ ID NO: 1413315 - protein, 5 aa, Mycobacterium tuberculosis
ARMAP

SEQ ID NO: 1413316 - protein, 5 aa, Mycobacterium tuberculosis
ARRHD

SEQ ID NO: 1413317 - protein, 5 aa, Mycobacterium tuberculosis
ARTAE

SEQ ID NO: 1413318 - protein, 5 aa, Mycobacterium tuberculosis
ARWAS

SEQ ID NO: 1413319 - protein, 8 aa, Mycobacterium tuberculosis
ARYSDDQS

SEQ ID NO: 1413320 - protein, 6 aa, Mycobacterium tuberculosis
ASADGS

SEQ ID NO: 1413321 - protein, 9 aa, Mycobacterium tuberculosis
ASADTGLPI

SEQ ID NO: 1413322 - protein, 6 aa, Mycobacterium tuberculosis
ASAEDL

SEQ ID NO: 1413323 - protein, 14 aa, Mycobacterium tuberculosis
ASAEEKPYARRPYP

SEQ ID NO: 1413324 - protein, 4 aa, Mycobacterium tuberculosis
ASAI

SEQ ID NO: 1413325 - protein, 10 aa, Mycobacterium tuberculosis
ASATPDTAVT

SEQ ID NO: 1413326 - protein, 8 aa, Mycobacterium tuberculosis
ASEQPTSR

SEQ ID NO: 1413327 - protein, 5 aa, Mycobacterium tuberculosis
ASGGG

SEQ ID NO: 1413328 - protein, 15 aa, Mycobacterium tuberculosis
ASLNEAAPDADRFRR

SEQ ID NO: 1413329 - protein, 7 aa, Mycobacterium tuberculosis
ASPGAGW

SEQ ID NO: 1413330 - protein, 15 aa, Mycobacterium tuberculosis
ASSGAFTTPQLETGP

SEQ ID NO: 1413331 - protein, 8 aa, Mycobacterium tuberculosis
ASSGIGRA

SEQ ID NO: 1413332 - protein, 5 aa, Mycobacterium tuberculosis
ASSPA

SEQ ID NO: 1413333 - protein, 7 aa, Mycobacterium tuberculosis
ATEAPEV

SEQ ID NO: 1413334 - protein, 7 aa, Mycobacterium tuberculosis
ATGASAV

SEQ ID NO: 1413335 - protein, 6 aa, Mycobacterium tuberculosis
ATGAVG

SEQ ID NO: 1413336 - protein, 4 aa, Mycobacterium tuberculosis
ATGV

SEQ ID NO: 1413337 - protein, 5 aa, Mycobacterium tuberculosis
ATHAP

SEQ ID NO: 1413338 - protein, 10 aa, Mycobacterium tuberculosis
ATIDNGSFGT

SEQ ID NO: 1413339 - protein, 4 aa, Mycobacterium tuberculosis
ATPA

SEQ ID NO: 1413340 - protein, 6 aa, Mycobacterium tuberculosis
ATPEVA

SEQ ID NO: 1413341 - protein, 10 aa, Mycobacterium tuberculosis
ATPIPSPAAE

SEQ ID NO: 1413342 - protein, 5 aa, Mycobacterium tuberculosis
ATPIT

SEQ ID NO: 1413343 - protein, 9 aa, Mycobacterium tuberculosis
ATPTGSRGT

SEQ ID NO: 1413344 - protein, 5 aa, Mycobacterium tuberculosis
ATQSM

SEQ ID NO: 1413345 - protein, 4 aa, Mycobacterium tuberculosis
ATTT

SEQ ID NO: 1413346 - protein, 9 aa, Mycobacterium tuberculosis
ATVKGGTYY

SEQ ID NO: 1413347 - protein, 5 aa, Mycobacterium tuberculosis
ATVPP

SEQ ID NO: 1413348 - protein, 6 aa, Mycobacterium tuberculosis
ATYDQV

SEQ ID NO: 1413349 - protein, 6 aa, Mycobacterium tuberculosis
AVAPAA

SEQ ID NO: 1413350 - protein, 26 aa, Mycobacterium tuberculosis
AVAPGQTADDDEEIAEPTEKDKASGD

SEQ ID NO: 1413351 - protein, 10 aa, Mycobacterium tuberculosis
AVDGATTGAL

SEQ ID NO: 1413352 - protein, 9 aa, Mycobacterium tuberculosis
AVDSATGHV

SEQ ID NO: 1413353 - protein, 5 aa, Mycobacterium tuberculosis
AVQTD

SEQ ID NO: 1413354 - protein, 13 aa, Mycobacterium tuberculosis
AVRDDAARAGVKP

SEQ ID NO: 1413355 - protein, 4 aa, Mycobacterium tuberculosis
AVTD

SEQ ID NO: 1413356 - protein, 5 aa, Mycobacterium tuberculosis
AWQNG

SEQ ID NO: 1413357 - protein, 5 aa, Mycobacterium tuberculosis
AYDSP

SEQ ID NO: 1413358 - protein, 6 aa, Mycobacterium tuberculosis
AYPPRL

SEQ ID NO: 1413359 - protein, 18 aa, Mycobacterium tuberculosis
CAGQQADVGPTPQHRCRG

SEQ ID NO: 1413360 - protein, 7 aa, Mycobacterium tuberculosis
CDRGGPG

SEQ ID NO: 1413361 - protein, 7 aa, Mycobacterium tuberculosis
CLPEGVP

SEQ ID NO: 1413362 - protein, 4 aa, Mycobacterium tuberculosis
CPSG

SEQ ID NO: 1413363 - protein, 6 aa, Mycobacterium tuberculosis
CRGGEY

SEQ ID NO: 1413364 - protein, 9 aa, Mycobacterium tuberculosis
CRRRPSDRA

SEQ ID NO: 1413365 - protein, 12 aa, Mycobacterium tuberculosis
CTTRNKRRAARL

SEQ ID NO: 1413366 - protein, 5 aa, Mycobacterium tuberculosis
DAADL

SEQ ID NO: 1413367 - protein, 7 aa, Mycobacterium tuberculosis
DAATDDA

SEQ ID NO: 1413368 - protein, 8 aa, Mycobacterium tuberculosis
DADHHEAS

SEQ ID NO: 1413369 - protein, 20 aa, Mycobacterium tuberculosis
DAESRRGGGDMQSSPKRSPS

SEQ ID NO: 1413370 - protein, 8 aa, Mycobacterium tuberculosis
DAGPADGP

SEQ ID NO: 1413371 - protein, 7 aa, Mycobacterium tuberculosis
DAGRAMA

SEQ ID NO: 1413372 - protein, 12 aa, Mycobacterium tuberculosis
DAIPGGNVKRGD

SEQ ID NO: 1413373 - protein, 14 aa, Mycobacterium tuberculosis
DAKTDRSAVAGATP

SEQ ID NO: 1413374 - protein, 6 aa, Mycobacterium tuberculosis
DANGQP

SEQ ID NO: 1413375 - protein, 5 aa, Mycobacterium tuberculosis
DAPHN

SEQ ID NO: 1413376 - protein, 7 aa, Mycobacterium tuberculosis
DAPSLNT

SEQ ID NO: 1413377 - protein, 8 aa, Mycobacterium tuberculosis
DAQDAGFN

SEQ ID NO: 1413378 - protein, 5 aa, Mycobacterium tuberculosis
DARPI

SEQ ID NO: 1413379 - protein, 11 aa, Mycobacterium tuberculosis
DATGDKATMPS

SEQ ID NO: 1413380 - protein, 4 aa, Mycobacterium tuberculosis
DATT

SEQ ID NO: 1413381 - protein, 8 aa, Mycobacterium tuberculosis
DAVPSDAE

SEQ ID NO: 1413382 - protein, 10 aa, Mycobacterium tuberculosis
DDAERQAAEK

SEQ ID NO: 1413383 - protein, 7 aa, Mycobacterium tuberculosis
DDASAND

SEQ ID NO: 1413384 - protein, 7 aa, Mycobacterium tuberculosis
DDDPEDA

SEQ ID NO: 1413385 - protein, 6 aa, Mycobacterium tuberculosis
DDEKPA

SEQ ID NO: 1413386 - protein, 19 aa, Mycobacterium tuberculosis
DDEYYDDRAPSRGYARPRF

SEQ ID NO: 1413387 - protein, 13 aa, Mycobacterium tuberculosis
DDIPESGKMTGRS

SEQ ID NO: 1413388 - protein, 17 aa, Mycobacterium tuberculosis
DDIRPRRRREIPHVREV

SEQ ID NO: 1413389 - protein, 8 aa, Mycobacterium tuberculosis
DDKSGDAE

SEQ ID NO: 1413390 - protein, 5 aa, Mycobacterium tuberculosis
DDKSY

SEQ ID NO: 1413391 - protein, 5 aa, Mycobacterium tuberculosis
DDPAV

SEQ ID NO: 1413392 - protein, 13 aa, Mycobacterium tuberculosis
DDSLAEPRAPYPH

SEQ ID NO: 1413393 - protein, 7 aa, Mycobacterium tuberculosis
DDSYGQD

SEQ ID NO: 1413394 - protein, 6 aa, Mycobacterium tuberculosis
DDTDRV

SEQ ID NO: 1413395 - protein, 6 aa, Mycobacterium tuberculosis
DEANKP

SEQ ID NO: 1413396 - protein, 7 aa, Mycobacterium tuberculosis
DEATTDT

SEQ ID NO: 1413397 - protein, 6 aa, Mycobacterium tuberculosis
DEEDRH

SEQ ID NO: 1413398 - protein, 8 aa, Mycobacterium tuberculosis
DEGDSWAR

SEQ ID NO: 1413399 - protein, 6 aa, Mycobacterium tuberculosis
DEGKGD

SEQ ID NO: 1413400 - protein, 4 aa, Mycobacterium tuberculosis
DEIS

SEQ ID NO: 1413401 - protein, 5 aa, Mycobacterium tuberculosis
DELTA

SEQ ID NO: 1413402 - protein, 5 aa, Mycobacterium tuberculosis
DENSA

SEQ ID NO: 1413403 - protein, 7 aa, Mycobacterium tuberculosis
DEPSREI

SEQ ID NO: 1413404 - protein, 22 aa, Mycobacterium tuberculosis
DESEALRQARKDAELTASADSV

SEQ ID NO: 1413405 - protein, 7 aa, Mycobacterium tuberculosis
DESSGTI

SEQ ID NO: 1413406 - protein, 8 aa, Mycobacterium tuberculosis
DETRSAAK

SEQ ID NO: 1413407 - protein, 5 aa, Mycobacterium tuberculosis
DFRDE

SEQ ID NO: 1413408 - protein, 5 aa, Mycobacterium tuberculosis
DGDTE

SEQ ID NO: 1413409 - protein, 4 aa, Mycobacterium tuberculosis
DGLS

SEQ ID NO: 1413410 - protein, 5 aa, Mycobacterium tuberculosis
DGMHG

SEQ ID NO: 1413411 - protein, 4 aa, Mycobacterium tuberculosis
DGPA

SEQ ID NO: 1413412 - protein, 6 aa, Mycobacterium tuberculosis
DGPHAH

SEQ ID NO: 1413413 - protein, 4 aa, Mycobacterium tuberculosis
DGPI

SEQ ID NO: 1413414 - protein, 8 aa, Mycobacterium tuberculosis
DGPQHTAA

SEQ ID NO: 1413415 - protein, 8 aa, Mycobacterium tuberculosis
DGRTIGGE

SEQ ID NO: 1413416 - protein, 5 aa, Mycobacterium tuberculosis
DHNVP

SEQ ID NO: 1413417 - protein, 9 aa, Mycobacterium tuberculosis
DIGDDPRTW

SEQ ID NO: 1413418 - protein, 10 aa, Mycobacterium tuberculosis
DKDFTNESAP

SEQ ID NO: 1413419 - protein, 9 aa, Mycobacterium tuberculosis
DKFTDGNAY

SEQ ID NO: 1413420 - protein, 4 aa, Mycobacterium tuberculosis
DKVG

SEQ ID NO: 1413421 - protein, 8 aa, Mycobacterium tuberculosis
DLARTGDR

SEQ ID NO: 1413422 - protein, 6 aa, Mycobacterium tuberculosis
DLDGQV

SEQ ID NO: 1413423 - protein, 8 aa, Mycobacterium tuberculosis
DLEGKSDN

SEQ ID NO: 1413424 - protein, 5 aa, Mycobacterium tuberculosis
DLGPV

SEQ ID NO: 1413425 - protein, 10 aa, Mycobacterium tuberculosis
DLPGGARSGL

SEQ ID NO: 1413426 - protein, 13 aa, Mycobacterium tuberculosis
DLRPKSLRDAMAE

SEQ ID NO: 1413427 - protein, 11 aa, Mycobacterium tuberculosis
DLSEGTVKGDE

SEQ ID NO: 1413428 - protein, 7 aa, Mycobacterium tuberculosis
DNAGTVE

SEQ ID NO: 1413429 - protein, 18 aa, Mycobacterium tuberculosis
DNATRSEAGYRDGLNGWS

SEQ ID NO: 1413430 - protein, 4 aa, Mycobacterium tuberculosis
DNDR

SEQ ID NO: 1413431 - protein, 12 aa, Mycobacterium tuberculosis
DNGLATHAKPGT

SEQ ID NO: 1413432 - protein, 8 aa, Mycobacterium tuberculosis
DNNLHSRG

SEQ ID NO: 1413433 - protein, 7 aa, Mycobacterium tuberculosis
DNRRRAS

SEQ ID NO: 1413434 - protein, 7 aa, Mycobacterium tuberculosis
DPADTRT

SEQ ID NO: 1413435 - protein, 5 aa, Mycobacterium tuberculosis
DPAGG

SEQ ID NO: 1413436 - protein, 5 aa, Mycobacterium tuberculosis
DPDAD

SEQ ID NO: 1413437 - protein, 7 aa, Mycobacterium tuberculosis
DPDAPTL

SEQ ID NO: 1413438 - protein, 10 aa, Mycobacterium tuberculosis
DPDRARRNDP

SEQ ID NO: 1413439 - protein, 7 aa, Mycobacterium tuberculosis
DPERTAE

SEQ ID NO: 1413440 - protein, 7 aa, Mycobacterium tuberculosis
DPMDNGQ

SEQ ID NO: 1413441 - protein, 5 aa, Mycobacterium tuberculosis
DPPLQ

SEQ ID NO: 1413442 - protein, 14 aa, Mycobacterium tuberculosis
DPPQVAEPHTRPPI

SEQ ID NO: 1413443 - protein, 4 aa, Mycobacterium tuberculosis
DPSR

SEQ ID NO: 1413444 - protein, 8 aa, Mycobacterium tuberculosis
DPTDAKQL

SEQ ID NO: 1413445 - protein, 6 aa, Mycobacterium tuberculosis
DPWPPA

SEQ ID NO: 1413446 - protein, 7 aa, Mycobacterium tuberculosis
DQGPLRG

SEQ ID NO: 1413447 - protein, 7 aa, Mycobacterium tuberculosis
DQHAADG

SEQ ID NO: 1413448 - protein, 12 aa, Mycobacterium tuberculosis
DQLDAHGDNPAN

SEQ ID NO: 1413449 - protein, 6 aa, Mycobacterium tuberculosis
DQRRSL

SEQ ID NO: 1413450 - protein, 9 aa, Mycobacterium tuberculosis
DQVPEAARR

SEQ ID NO: 1413451 - protein, 12 aa, Mycobacterium tuberculosis
DQYAQRQRAAAE

SEQ ID NO: 1413452 - protein, 5 aa, Mycobacterium tuberculosis
DRDRD

SEQ ID NO: 1413453 - protein, 5 aa, Mycobacterium tuberculosis
DRGYT

SEQ ID NO: 1413454 - protein, 8 aa, Mycobacterium tuberculosis
DRLRSGAD

SEQ ID NO: 1413455 - protein, 7 aa, Mycobacterium tuberculosis
DRNKQQR

SEQ ID NO: 1413456 - protein, 5 aa, Mycobacterium tuberculosis
DRPPM

SEQ ID NO: 1413457 - protein, 10 aa, Mycobacterium tuberculosis
DRPSSVDGIS

SEQ ID NO: 1413458 - protein, 5 aa, Mycobacterium tuberculosis
DRPTA

SEQ ID NO: 1413459 - protein, 12 aa, Mycobacterium tuberculosis
DRRPLRNTREAA

SEQ ID NO: 1413460 - protein, 18 aa, Mycobacterium tuberculosis
DRRSARKRNALAARSRKR

SEQ ID NO: 1413461 - protein, 7 aa, Mycobacterium tuberculosis
DSASVEH

SEQ ID NO: 1413462 - protein, 7 aa, Mycobacterium tuberculosis
DSGTEST

SEQ ID NO: 1413463 - protein, 4 aa, Mycobacterium tuberculosis
DSHA

SEQ ID NO: 1413464 - protein, 17 aa, Mycobacterium tuberculosis
DSPAGRRYGRTNGNLTV

SEQ ID NO: 1413465 - protein, 10 aa, Mycobacterium tuberculosis
DSRDPDPRAA

SEQ ID NO: 1413466 - protein, 4 aa, Mycobacterium tuberculosis
DTGG

SEQ ID NO: 1413467 - protein, 17 aa, Mycobacterium tuberculosis
DTLDDGRRQLDDLGEHR

SEQ ID NO: 1413468 - protein, 9 aa, Mycobacterium tuberculosis
DTNGDPGRC

SEQ ID NO: 1413469 - protein, 7 aa, Mycobacterium tuberculosis
DTPLAER

SEQ ID NO: 1413470 - protein, 9 aa, Mycobacterium tuberculosis
DTSKPAAAA

SEQ ID NO: 1413471 - protein, 14 aa, Mycobacterium tuberculosis
DTVTSGAAPAGVPG

SEQ ID NO: 1413472 - protein, 7 aa, Mycobacterium tuberculosis
DVDETSV

SEQ ID NO: 1413473 - protein, 7 aa, Mycobacterium tuberculosis
DVERTGA

SEQ ID NO: 1413474 - protein, 7 aa, Mycobacterium tuberculosis
DVTPDSV

SEQ ID NO: 1413475 - protein, 8 aa, Mycobacterium tuberculosis
DWDSSTDT

SEQ ID NO: 1413476 - protein, 18 aa, Mycobacterium tuberculosis
DYSEDSAVDKALETTRPL

SEQ ID NO: 1413477 - protein, 14 aa, Mycobacterium tuberculosis
EAAEAAAAAPAAVG

SEQ ID NO: 1413478 - protein, 7 aa, Mycobacterium tuberculosis
EADLGGT

SEQ ID NO: 1413479 - protein, 11 aa, Mycobacterium tuberculosis
EADPSNPDMQK

SEQ ID NO: 1413480 - protein, 9 aa, Mycobacterium tuberculosis
EAEARRARR

SEQ ID NO: 1413481 - protein, 4 aa, Mycobacterium tuberculosis
EAEG

SEQ ID NO: 1413482 - protein, 5 aa, Mycobacterium tuberculosis
EAETT

SEQ ID NO: 1413483 - protein, 5 aa, Mycobacterium tuberculosis
EALEG

SEQ ID NO: 1413484 - protein, 14 aa, Mycobacterium tuberculosis
EALRPMGRATSGVQ

SEQ ID NO: 1413485 - protein, 12 aa, Mycobacterium tuberculosis
EAPQNGPAEGDS

SEQ ID NO: 1413486 - protein, 6 aa, Mycobacterium tuberculosis
EATERI

SEQ ID NO: 1413487 - protein, 8 aa, Mycobacterium tuberculosis
EDDASGYT

SEQ ID NO: 1413488 - protein, 16 aa, Mycobacterium tuberculosis
EDYDRVPADEPNPEQI

SEQ ID NO: 1413489 - protein, 5 aa, Mycobacterium tuberculosis
EEAAD

SEQ ID NO: 1413490 - protein, 9 aa, Mycobacterium tuberculosis
EEGGQLTEK

SEQ ID NO: 1413491 - protein, 4 aa, Mycobacterium tuberculosis
EEGI

SEQ ID NO: 1413492 - protein, 7 aa, Mycobacterium tuberculosis
EEPARRL

SEQ ID NO: 1413493 - protein, 11 aa, Mycobacterium tuberculosis
EESTALDERIG

SEQ ID NO: 1413494 - protein, 4 aa, Mycobacterium tuberculosis
EGDA

SEQ ID NO: 1413495 - protein, 4 aa, Mycobacterium tuberculosis
EGDD

SEQ ID NO: 1413496 - protein, 7 aa, Mycobacterium tuberculosis
EGDLTGD

SEQ ID NO: 1413497 - protein, 13 aa, Mycobacterium tuberculosis
EGDPQPLDTGGTK

SEQ ID NO: 1413498 - protein, 7 aa, Mycobacterium tuberculosis
EGDTVEL

SEQ ID NO: 1413499 - protein, 14 aa, Mycobacterium tuberculosis
EGFAPGQVGSSAMP

SEQ ID NO: 1413500 - protein, 6 aa, Mycobacterium tuberculosis
EGGAGY

SEQ ID NO: 1413501 - protein, 17 aa, Mycobacterium tuberculosis
EGGSRDVAPAAQLQRRR

SEQ ID NO: 1413502 - protein, 12 aa, Mycobacterium tuberculosis
EGMDSQLSADEL

SEQ ID NO: 1413503 - protein, 9 aa, Mycobacterium tuberculosis
EGSARPGDT

SEQ ID NO: 1413504 - protein, 5 aa, Mycobacterium tuberculosis
EGTFT

SEQ ID NO: 1413505 - protein, 12 aa, Mycobacterium tuberculosis
EGVEPSAALADN

SEQ ID NO: 1413506 - protein, 5 aa, Mycobacterium tuberculosis
EHKSE

SEQ ID NO: 1413507 - protein, 9 aa, Mycobacterium tuberculosis
EHTVAEQDE

SEQ ID NO: 1413508 - protein, 6 aa, Mycobacterium tuberculosis
EIGGGS

SEQ ID NO: 1413509 - protein, 10 aa, Mycobacterium tuberculosis
EIGRTQYGNN

SEQ ID NO: 1413510 - protein, 4 aa, Mycobacterium tuberculosis
EISR

SEQ ID NO: 1413511 - protein, 5 aa, Mycobacterium tuberculosis
EKKQG

SEQ ID NO: 1413512 - protein, 21 aa, Mycobacterium tuberculosis
EKPSARWGSQRTQRDPARRRR

SEQ ID NO: 1413513 - protein, 5 aa, Mycobacterium tuberculosis
EKRAA

SEQ ID NO: 1413514 - protein, 9 aa, Mycobacterium tuberculosis
EKVRGTGPV

SEQ ID NO: 1413515 - protein, 6 aa, Mycobacterium tuberculosis
ELAPSN

SEQ ID NO: 1413516 - protein, 10 aa, Mycobacterium tuberculosis
ELDGQQAEDR

SEQ ID NO: 1413517 - protein, 5 aa, Mycobacterium tuberculosis
ELGEE

SEQ ID NO: 1413518 - protein, 15 aa, Mycobacterium tuberculosis
ELPEGVGDGRELPGG

SEQ ID NO: 1413519 - protein, 11 aa, Mycobacterium tuberculosis
ELPPQNDRARW

SEQ ID NO: 1413520 - protein, 10 aa, Mycobacterium tuberculosis
ELTEADGPTV

SEQ ID NO: 1413521 - protein, 16 aa, Mycobacterium tuberculosis
ENEVSGQLAATTGDVG

SEQ ID NO: 1413522 - protein, 7 aa, Mycobacterium tuberculosis
ENLGTAP

SEQ ID NO: 1413523 - protein, 7 aa, Mycobacterium tuberculosis
ENPRATR

SEQ ID NO: 1413524 - protein, 8 aa, Mycobacterium tuberculosis
EPAAGELG

SEQ ID NO: 1413525 - protein, 16 aa, Mycobacterium tuberculosis
EPELAGELDPGQPTQL

SEQ ID NO: 1413526 - protein, 6 aa, Mycobacterium tuberculosis
EPESAV

SEQ ID NO: 1413527 - protein, 4 aa, Mycobacterium tuberculosis
EPHA

SEQ ID NO: 1413528 - protein, 8 aa, Mycobacterium tuberculosis
EPKVNDRA

SEQ ID NO: 1413529 - protein, 5 aa, Mycobacterium tuberculosis
EPPVM

SEQ ID NO: 1413530 - protein, 4 aa, Mycobacterium tuberculosis
EPSA

SEQ ID NO: 1413531 - protein, 24 aa, Mycobacterium tuberculosis
EPSPADDGTYQGKDGSGKVKWTGS

SEQ ID NO: 1413532 - protein, 10 aa, Mycobacterium tuberculosis
EPTGRNLNAS

SEQ ID NO: 1413533 - protein, 4 aa, Mycobacterium tuberculosis
EPTN

SEQ ID NO: 1413534 - protein, 10 aa, Mycobacterium tuberculosis
EQAAAAGHSL

SEQ ID NO: 1413535 - protein, 9 aa, Mycobacterium tuberculosis
EQAAAHPSA

SEQ ID NO: 1413536 - protein, 6 aa, Mycobacterium tuberculosis
EQPDLN

SEQ ID NO: 1413537 - protein, 5 aa, Mycobacterium tuberculosis
EQPDS

SEQ ID NO: 1413538 - protein, 9 aa, Mycobacterium tuberculosis
EQRTRPGQL

SEQ ID NO: 1413539 - protein, 6 aa, Mycobacterium tuberculosis
EQSALN

SEQ ID NO: 1413540 - protein, 5 aa, Mycobacterium tuberculosis
EQTDR

SEQ ID NO: 1413541 - protein, 11 aa, Mycobacterium tuberculosis
EQTSGNSGQHP

SEQ ID NO: 1413542 - protein, 12 aa, Mycobacterium tuberculosis
EQVGKPAPSVSQ

SEQ ID NO: 1413543 - protein, 7 aa, Mycobacterium tuberculosis
ERAAADP

SEQ ID NO: 1413544 - protein, 13 aa, Mycobacterium tuberculosis
ERAASGEAVEMTG

SEQ ID NO: 1413545 - protein, 6 aa, Mycobacterium tuberculosis
ERDDPD

SEQ ID NO: 1413546 - protein, 7 aa, Mycobacterium tuberculosis
ERDPGTT

SEQ ID NO: 1413547 - protein, 5 aa, Mycobacterium tuberculosis
EREGA

SEQ ID NO: 1413548 - protein, 9 aa, Mycobacterium tuberculosis
ERGGERVRG

SEQ ID NO: 1413549 - protein, 16 aa, Mycobacterium tuberculosis
ERNGYPVRDHRVSAQS

SEQ ID NO: 1413550 - protein, 7 aa, Mycobacterium tuberculosis
ERPDGPV

SEQ ID NO: 1413551 - protein, 6 aa, Mycobacterium tuberculosis
ERREQQ

SEQ ID NO: 1413552 - protein, 12 aa, Mycobacterium tuberculosis
ERRGRRRAEPLG

SEQ ID NO: 1413553 - protein, 4 aa, Mycobacterium tuberculosis
ERTD

SEQ ID NO: 1413554 - protein, 6 aa, Mycobacterium tuberculosis
ERTTNT

SEQ ID NO: 1413555 - protein, 9 aa, Mycobacterium tuberculosis
ERYDSGQRC

SEQ ID NO: 1413556 - protein, 7 aa, Mycobacterium tuberculosis
ESAAQDL

SEQ ID NO: 1413557 - protein, 7 aa, Mycobacterium tuberculosis
ESARQFA

SEQ ID NO: 1413558 - protein, 14 aa, Mycobacterium tuberculosis
ESNMASTKRHWPTS

SEQ ID NO: 1413559 - protein, 5 aa, Mycobacterium tuberculosis
ETAPE

SEQ ID NO: 1413560 - protein, 4 aa, Mycobacterium tuberculosis
ETDA

SEQ ID NO: 1413561 - protein, 9 aa, Mycobacterium tuberculosis
ETKAPAVPV

SEQ ID NO: 1413562 - protein, 6 aa, Mycobacterium tuberculosis
ETSDPR

SEQ ID NO: 1413563 - protein, 6 aa, Mycobacterium tuberculosis
ETTPPG

SEQ ID NO: 1413564 - protein, 9 aa, Mycobacterium tuberculosis
EVADGLTRR

SEQ ID NO: 1413565 - protein, 4 aa, Mycobacterium tuberculosis
EVDP

SEQ ID NO: 1413566 - protein, 19 aa, Mycobacterium tuberculosis
EVGRQLGEKTVKATTAGHA

SEQ ID NO: 1413567 - protein, 7 aa, Mycobacterium tuberculosis
EVPPTSR

SEQ ID NO: 1413568 - protein, 11 aa, Mycobacterium tuberculosis
EYGGHDAGAPK

SEQ ID NO: 1413569 - protein, 4 aa, Mycobacterium tuberculosis
EYGQ

SEQ ID NO: 1413570 - protein, 4 aa, Mycobacterium tuberculosis
EYPP

SEQ ID NO: 1413571 - protein, 13 aa, Mycobacterium tuberculosis
FADEDRRTLAAAS

SEQ ID NO: 1413572 - protein, 12 aa, Mycobacterium tuberculosis
FADSNGDGVGDL

SEQ ID NO: 1413573 - protein, 5 aa, Mycobacterium tuberculosis
FANTG

SEQ ID NO: 1413574 - protein, 12 aa, Mycobacterium tuberculosis
FAPGGDPATVAA

SEQ ID NO: 1413575 - protein, 4 aa, Mycobacterium tuberculosis
FDGD

SEQ ID NO: 1413576 - protein, 12 aa, Mycobacterium tuberculosis
FDPEAPIPANQN

SEQ ID NO: 1413577 - protein, 8 aa, Mycobacterium tuberculosis
FDPNTGQI

SEQ ID NO: 1413578 - protein, 8 aa, Mycobacterium tuberculosis
FDRGTRAA

SEQ ID NO: 1413579 - protein, 7 aa, Mycobacterium tuberculosis
FGPGPYE

SEQ ID NO: 1413580 - protein, 6 aa, Mycobacterium tuberculosis
FGSGAP

SEQ ID NO: 1413581 - protein, 20 aa, Mycobacterium tuberculosis
FKPEPHSAANEPKHPAARPK

SEQ ID NO: 1413582 - protein, 12 aa, Mycobacterium tuberculosis
FNTGGVNPGTVN

SEQ ID NO: 1413583 - protein, 24 aa, Mycobacterium tuberculosis
FPQRDPHGDPIPGADGQVPTPPAR

SEQ ID NO: 1413584 - protein, 10 aa, Mycobacterium tuberculosis
FPTMRTPPGL

SEQ ID NO: 1413585 - protein, 13 aa, Mycobacterium tuberculosis
FRSPAANKKAITT

SEQ ID NO: 1413586 - protein, 6 aa, Mycobacterium tuberculosis
FSTPPI

SEQ ID NO: 1413587 - protein, 6 aa, Mycobacterium tuberculosis
GAEETN

SEQ ID NO: 1413588 - protein, 4 aa, Mycobacterium tuberculosis
GAEF

SEQ ID NO: 1413589 - protein, 16 aa, Mycobacterium tuberculosis
GAENDPSFTADHAEKL

SEQ ID NO: 1413590 - protein, 6 aa, Mycobacterium tuberculosis
GAESGD

SEQ ID NO: 1413591 - protein, 6 aa, Mycobacterium tuberculosis
GAGARW

SEQ ID NO: 1413592 - protein, 44 aa, Mycobacterium tuberculosis; identical to SEQ ID NO: 174646

SEQ ID NO: 1413593 - protein, 8 aa, Mycobacterium tuberculosis
GAGPESHD

SEQ ID NO: 1413594 - protein, 10 aa, Mycobacterium tuberculosis
GAKAQARSGE

SEQ ID NO: 1413595 - protein, 10 aa, Mycobacterium tuberculosis
GAMGGSASEE

SEQ ID NO: 1413596 - protein, 4 aa, Mycobacterium tuberculosis
GANT

SEQ ID NO: 1413597 - protein, 9 aa, Mycobacterium tuberculosis
GAPEPRHDE

SEQ ID NO: 1413598 - protein, 12 aa, Mycobacterium tuberculosis
GAPGQPGDTGQP

SEQ ID NO: 1413599 - protein, 8 aa, Mycobacterium tuberculosis
GAPPTQGT

SEQ ID NO: 1413600 - protein, 18 aa, Mycobacterium tuberculosis
GAQAELAARQARAAAGAF

SEQ ID NO: 1413601 - protein, 15 aa, Mycobacterium tuberculosis
GAYLGGDRRVSPRER

SEQ ID NO: 1413602 - protein, 7 aa, Mycobacterium tuberculosis
GDAAATE

SEQ ID NO: 1413603 - protein, 6 aa, Mycobacterium tuberculosis
GDDERR

SEQ ID NO: 1413604 - protein, 9 aa, Mycobacterium tuberculosis
GDDLGKTAR

SEQ ID NO: 1413605 - protein, 9 aa, Mycobacterium tuberculosis
GDDLQPRAA

SEQ ID NO: 1413606 - protein, 7 aa, Mycobacterium tuberculosis
GDGLSGF

SEQ ID NO: 1413607 - protein, 7 aa, Mycobacterium tuberculosis
GDGPFTR

SEQ ID NO: 1413608 - protein, 7 aa, Mycobacterium tuberculosis
GDGQHRV

SEQ ID NO: 1413609 - protein, 6 aa, Mycobacterium tuberculosis
GDGVDG

SEQ ID NO: 1413610 - protein, 4 aa, Mycobacterium tuberculosis
GDIE

SEQ ID NO: 1413611 - protein, 5 aa, Mycobacterium tuberculosis
GDNKG

SEQ ID NO: 1413612 - protein, 4 aa, Mycobacterium tuberculosis
GDPA

SEQ ID NO: 1413613 - protein, 5 aa, Mycobacterium tuberculosis
GDPDE

SEQ ID NO: 1413614 - protein, 5 aa, Mycobacterium tuberculosis
GDPFT

SEQ ID NO: 1413615 - protein, 9 aa, Mycobacterium tuberculosis
GDPGGSSSI

SEQ ID NO: 1413616 - protein, 8 aa, Mycobacterium tuberculosis
GDPGGSTA

SEQ ID NO: 1413617 - protein, 8 aa, Mycobacterium tuberculosis
GDQQRADA

SEQ ID NO: 1413618 - protein, 6 aa, Mycobacterium tuberculosis
GDRAKN

SEQ ID NO: 1413619 - protein, 8 aa, Mycobacterium tuberculosis
GDSPERAQ

SEQ ID NO: 1413620 - protein, 5 aa, Mycobacterium tuberculosis
GDSYL

SEQ ID NO: 1413621 - protein, 21 aa, Mycobacterium tuberculosis
GDTGEPTPQRANLSDSITPDE

SEQ ID NO: 1413622 - protein, 6 aa, Mycobacterium tuberculosis
GEATDA

SEQ ID NO: 1413623 - protein, 8 aa, Mycobacterium tuberculosis
GEIGSAAG

SEQ ID NO: 1413624 - protein, 4 aa, Mycobacterium tuberculosis
GEKR

SEQ ID NO: 1413625 - protein, 6 aa, Mycobacterium tuberculosis
GELTPA

SEQ ID NO: 1413626 - protein, 8 aa, Mycobacterium tuberculosis
GEPTDGIT

SEQ ID NO: 1413627 - protein, 15 aa, Mycobacterium tuberculosis
GEQLGPSADPGDGPA

SEQ ID NO: 1413628 - protein, 11 aa, Mycobacterium tuberculosis
GESGSGKSAAA

SEQ ID NO: 1413629 - protein, 6 aa, Mycobacterium tuberculosis
GESGYF

SEQ ID NO: 1413630 - protein, 8 aa, Mycobacterium tuberculosis
GESLANRR

SEQ ID NO: 1413631 - protein, 9 aa, Mycobacterium tuberculosis
GEVAEQKVK

SEQ ID NO: 1413632 - protein, 9 aa, Mycobacterium tuberculosis
GFSPGQNHQ

SEQ ID NO: 1413633 - protein, 10 aa, Mycobacterium tuberculosis
GGAAARPFAT

SEQ ID NO: 1413634 - protein, 8 aa, Mycobacterium tuberculosis
GGAASNVP

SEQ ID NO: 1413635 - protein, 10 aa, Mycobacterium tuberculosis
GGAGLEAETA

SEQ ID NO: 1413636 - protein, 10 aa, Mycobacterium tuberculosis
GGASAAAAQL

SEQ ID NO: 1413637 - protein, 9 aa, Mycobacterium tuberculosis
GGDAEERAA

SEQ ID NO: 1413638 - protein, 10 aa, Mycobacterium tuberculosis
GGDASAPLDT

SEQ ID NO: 1413639 - protein, 20 aa, Mycobacterium tuberculosis
GGDEKKFPGEISGGMRKRAG

SEQ ID NO: 1413640 - protein, 13 aa, Mycobacterium tuberculosis
GGDRDPGKRAPMG

SEQ ID NO: 1413641 - protein, 5 aa, Mycobacterium tuberculosis
GGEGA

SEQ ID NO: 1413642 - protein, 5 aa, Mycobacterium tuberculosis
GGEPT

SEQ ID NO: 1413643 - protein, 11 aa, Mycobacterium tuberculosis
GGGGPSGQAGA

SEQ ID NO: 1413644 - protein, 10 aa, Mycobacterium tuberculosis
GGGRAKSLAN

SEQ ID NO: 1413645 - protein, 8 aa, Mycobacterium tuberculosis
GGIGSGQQ

SEQ ID NO: 1413646 - protein, 6 aa, Mycobacterium tuberculosis
GGITET

SEQ ID NO: 1413647 - protein, 7 aa, Mycobacterium tuberculosis
GGKNVAP

SEQ ID NO: 1413648 - protein, 7 aa, Mycobacterium tuberculosis
GGKVTGV

SEQ ID NO: 1413649 - protein, 11 aa, Mycobacterium tuberculosis
GGLGADSRHAG

SEQ ID NO: 1413650 - protein, 8 aa, Mycobacterium tuberculosis
GGLNPAGL

SEQ ID NO: 1413651 - protein, 9 aa, Mycobacterium tuberculosis
GGMPAPPPL

SEQ ID NO: 1413652 - protein, 4 aa, Mycobacterium tuberculosis
GGNP

SEQ ID NO: 1413653 - protein, 14 aa, Mycobacterium tuberculosis
GGNSGFGNSGSGLS

SEQ ID NO: 1413654 - protein, 5 aa, Mycobacterium tuberculosis
GGPAG

SEQ ID NO: 1413655 - protein, 11 aa, Mycobacterium tuberculosis
GGPDASYVPGH

SEQ ID NO: 1413656 - protein, 6 aa, Mycobacterium tuberculosis
GGQTAL

SEQ ID NO: 1413657 - protein, 9 aa, Mycobacterium tuberculosis
GGQTRRSWG

SEQ ID NO: 1413658 - protein, 14 aa, Mycobacterium tuberculosis
GGRTVGAGRVTKII

SEQ ID NO: 1413659 - protein, 5 aa, Mycobacterium tuberculosis
GGSAG

SEQ ID NO: 1413660 - protein, 10 aa, Mycobacterium tuberculosis
GGSQDPALKL

SEQ ID NO: 1413661 - protein, 13 aa, Mycobacterium tuberculosis
GGVTRPVDQEVGS

SEQ ID NO: 1413662 - protein, 4 aa, Mycobacterium tuberculosis
GHAG

SEQ ID NO: 1413663 - protein, 11 aa, Mycobacterium tuberculosis
GHAKDSKFPPV

SEQ ID NO: 1413664 - protein, 6 aa, Mycobacterium tuberculosis
GHTNTG

SEQ ID NO: 1413665 - protein, 6 aa, Mycobacterium tuberculosis
GIAGEK

SEQ ID NO: 1413666 - protein, 7 aa, Mycobacterium tuberculosis
GIGPAEL

SEQ ID NO: 1413667 - protein, 6 aa, Mycobacterium tuberculosis
GKAEPL

SEQ ID NO: 1413668 - protein, 5 aa, Mycobacterium tuberculosis
GKGTV

SEQ ID NO: 1413669 - protein, 12 aa, Mycobacterium tuberculosis
GKHGDTGRSELD

SEQ ID NO: 1413670 - protein, 9 aa, Mycobacterium tuberculosis
GKNMSPANI

SEQ ID NO: 1413671 - protein, 7 aa, Mycobacterium tuberculosis
GKPDGST

SEQ ID NO: 1413672 - protein, 9 aa, Mycobacterium tuberculosis
GKSDQRTAG

SEQ ID NO: 1413673 - protein, 10 aa, Mycobacterium tuberculosis
GKVSPSAERV

SEQ ID NO: 1413674 - protein, 8 aa, Mycobacterium tuberculosis
GLAPMSPA

SEQ ID NO: 1413675 - protein, 6 aa, Mycobacterium tuberculosis
GLDGYS

SEQ ID NO: 1413676 - protein, 7 aa, Mycobacterium tuberculosis
GLDSPDR

SEQ ID NO: 1413677 - protein, 18 aa, Mycobacterium tuberculosis
GLESPEEESAARASGRVS

SEQ ID NO: 1413678 - protein, 5 aa, Mycobacterium tuberculosis
GLSTR

SEQ ID NO: 1413679 - protein, 22 aa, Mycobacterium tuberculosis
GMAEADARARIAAQASDQQRRA

SEQ ID NO: 1413680 - protein, 9 aa, Mycobacterium tuberculosis
GMSRADTRR

SEQ ID NO: 1413681 - protein, 14 aa, Mycobacterium tuberculosis
GNAGNQSVGFGNAG

SEQ ID NO: 1413682 - protein, 15 aa, Mycobacterium tuberculosis
GNANLGNNNLGSGNF

SEQ ID NO: 1413683 - protein, 5 aa, Mycobacterium tuberculosis
GNGDQ

SEQ ID NO: 1413684 - protein, 26 aa, Mycobacterium tuberculosis
GNGGNGGNAGSGGGTGFEGSAGQGGA

SEQ ID NO: 1413685 - protein, 26 aa, Mycobacterium tuberculosis
GNGNFGIGNSGNFNTGGWNSGHGNTG

SEQ ID NO: 1413686 - protein, 9 aa, Mycobacterium tuberculosis
GNLGQHNGL

SEQ ID NO: 1413687 - protein, 5 aa, Mycobacterium tuberculosis
GNNNV

SEQ ID NO: 1413688 - protein, 8 aa, Mycobacterium tuberculosis
GNPDTAAN

SEQ ID NO: 1413689 - protein, 24 aa, Mycobacterium tuberculosis
GNQRTAGELSRQEGGKVFGGGSRN

SEQ ID NO: 1413690 - protein, 39 aa, Mycobacterium tuberculosis; identical to SEQ ID NO: 194191

SEQ ID NO: 1413691 - protein, 5 aa, Mycobacterium tuberculosis
GNVDH

SEQ ID NO: 1413692 - protein, 7 aa, Mycobacterium tuberculosis
GNVTGPE

SEQ ID NO: 1413693 - protein, 8 aa, Mycobacterium tuberculosis
GPADGASN

SEQ ID NO: 1413694 - protein, 11 aa, Mycobacterium tuberculosis
GPDGTPTAERR

SEQ ID NO: 1413695 - protein, 6 aa, Mycobacterium tuberculosis
GPEGYR

SEQ ID NO: 1413696 - protein, 19 aa, Mycobacterium tuberculosis
GPEPDRSQTFACEASSHNQ

SEQ ID NO: 1413697 - protein, 5 aa, Mycobacterium tuberculosis
GPGAT

SEQ ID NO: 1413698 - protein, 7 aa, Mycobacterium tuberculosis
GPGSGPL

SEQ ID NO: 1413699 - protein, 6 aa, Mycobacterium tuberculosis
GPITSP

SEQ ID NO: 1413700 - protein, 4 aa, Mycobacterium tuberculosis
GPRF

SEQ ID NO: 1413701 - protein, 5 aa, Mycobacterium tuberculosis
GPSPA

SEQ ID NO: 1413702 - protein, 4 aa, Mycobacterium tuberculosis
GPSR

SEQ ID NO: 1413703 - protein, 9 aa, Mycobacterium tuberculosis
GPSYTRPAS

SEQ ID NO: 1413704 - protein, 5 aa, Mycobacterium tuberculosis
GQDLS

SEQ ID NO: 1413705 - protein, 14 aa, Mycobacterium tuberculosis
GQGEAGLRGAPSGD

SEQ ID NO: 1413706 - protein, 7 aa, Mycobacterium tuberculosis
GQIAGDS

SEQ ID NO: 1413707 - protein, 11 aa, Mycobacterium tuberculosis
GQMAGAGYGDG

SEQ ID NO: 1413708 - protein, 20 aa, Mycobacterium tuberculosis
GQMSASAGPVSGRMDPSPVA

SEQ ID NO: 1413709 - protein, 6 aa, Mycobacterium tuberculosis
GQNAHT

SEQ ID NO: 1413710 - protein, 7 aa, Mycobacterium tuberculosis
GQRSSIG

SEQ ID NO: 1413711 - protein, 9 aa, Mycobacterium tuberculosis
GRALRDDGS

SEQ ID NO: 1413712 - protein, 18 aa, Mycobacterium tuberculosis
GRATAGPDPLGRSRTAAA

SEQ ID NO: 1413713 - protein, 13 aa, Mycobacterium tuberculosis
GRGDKEGGDGAAV

SEQ ID NO: 1413714 - protein, 13 aa, Mycobacterium tuberculosis
GRGHGPVSPLFRL

SEQ ID NO: 1413715 - protein, 13 aa, Mycobacterium tuberculosis
GRGRRFSSATKES

SEQ ID NO: 1413716 - protein, 6 aa, Mycobacterium tuberculosis
GRIPAD

SEQ ID NO: 1413717 - protein, 5 aa, Mycobacterium tuberculosis
GRREV

SEQ ID NO: 1413718 - protein, 11 aa, Mycobacterium tuberculosis
GRTEITEATRE

SEQ ID NO: 1413719 - protein, 18 aa, Mycobacterium tuberculosis
GRTPAATDLQNPGAVTPD

SEQ ID NO: 1413720 - protein, 6 aa, Mycobacterium tuberculosis
GRWATQ

SEQ ID NO: 1413721 - protein, 6 aa, Mycobacterium tuberculosis
GSAVPE

SEQ ID NO: 1413722 - protein, 5 aa, Mycobacterium tuberculosis
GSAYN

SEQ ID NO: 1413723 - protein, 7 aa, Mycobacterium tuberculosis
GSCSTND

SEQ ID NO: 1413724 - protein, 8 aa, Mycobacterium tuberculosis
GSETNDGR

SEQ ID NO: 1413725 - protein, 8 aa, Mycobacterium tuberculosis
GSGAGLPG

SEQ ID NO: 1413726 - protein, 9 aa, Mycobacterium tuberculosis
GSGNIGNGS

SEQ ID NO: 1413727 - protein, 5 aa, Mycobacterium tuberculosis
GSGNV

SEQ ID NO: 1413728 - protein, 7 aa, Mycobacterium tuberculosis
GSGPNAL

SEQ ID NO: 1413729 - protein, 9 aa, Mycobacterium tuberculosis
GSGSAEVPA

SEQ ID NO: 1413730 - protein, 5 aa, Mycobacterium tuberculosis
GSGTL

SEQ ID NO: 1413731 - protein, 6 aa, Mycobacterium tuberculosis
GSMAAR

SEQ ID NO: 1413732 - protein, 15 aa, Mycobacterium tuberculosis
GSPLAPEKEGDADIR

SEQ ID NO: 1413733 - protein, 7 aa, Mycobacterium tuberculosis
GSRQGLA

SEQ ID NO: 1413734 - protein, 8 aa, Mycobacterium tuberculosis
GSRRADGM

SEQ ID NO: 1413735 - protein, 5 aa, Mycobacterium tuberculosis
GSSAL

SEQ ID NO: 1413736 - protein, 10 aa, Mycobacterium tuberculosis
GSSDVANPRG

SEQ ID NO: 1413737 - protein, 7 aa, Mycobacterium tuberculosis
GSTEGGV

SEQ ID NO: 1413738 - protein, 4 aa, Mycobacterium tuberculosis
GSVP

SEQ ID NO: 1413739 - protein, 4 aa, Mycobacterium tuberculosis
GSWE

SEQ ID NO: 1413740 - protein, 7 aa, Mycobacterium tuberculosis
GTALGNP

SEQ ID NO: 1413741 - protein, 16 aa, Mycobacterium tuberculosis
GTGNVGIANSGTGNWG

SEQ ID NO: 1413742 - protein, 16 aa, Mycobacterium tuberculosis
GTGTESIESVKHSDGS

SEQ ID NO: 1413743 - protein, 4 aa, Mycobacterium tuberculosis
GTGY

SEQ ID NO: 1413744 - protein, 4 aa, Mycobacterium tuberculosis
GTMP

SEQ ID NO: 1413745 - protein, 10 aa, Mycobacterium tuberculosis
GTPDHHGEFD

SEQ ID NO: 1413746 - protein, 4 aa, Mycobacterium tuberculosis
GTPL

SEQ ID NO: 1413747 - protein, 9 aa, Mycobacterium tuberculosis
GTSGDPKAV

SEQ ID NO: 1413748 - protein, 4 aa, Mycobacterium tuberculosis
GTTF

SEQ ID NO: 1413749 - protein, 26 aa, Mycobacterium tuberculosis
GTYGPGYHSDSTRTYSIGEPDSDVAQ

SEQ ID NO: 1413750 - protein, 17 aa, Mycobacterium tuberculosis
GTYNTGGYNVGSTNTGI

SEQ ID NO: 1413751 - protein, 4 aa, Mycobacterium tuberculosis
GVGS

SEQ ID NO: 1413752 - protein, 5 aa, Mycobacterium tuberculosis
GVRAQ

SEQ ID NO: 1413753 - protein, 10 aa, Mycobacterium tuberculosis
GVSSSGCGVA

SEQ ID NO: 1413754 - protein, 20 aa, Mycobacterium tuberculosis
GVTGSAGLQPGPSEETDEEL

SEQ ID NO: 1413755 - protein, 4 aa, Mycobacterium tuberculosis
GVVP

SEQ ID NO: 1413756 - protein, 14 aa, Mycobacterium tuberculosis
GYKMPGGTPSSPGL

SEQ ID NO: 1413757 - protein, 8 aa, Mycobacterium tuberculosis
GYKPTLPG

SEQ ID NO: 1413758 - protein, 23 aa, Mycobacterium tuberculosis
GYPPSDGPPRRGQAYTGTDRQVR

SEQ ID NO: 1413759 - protein, 6 aa, Mycobacterium tuberculosis
GYQPTL

SEQ ID NO: 1413760 - protein, 6 aa, Mycobacterium tuberculosis
GYTKEH

SEQ ID NO: 1413761 - protein, 6 aa, Mycobacterium tuberculosis
GYVPDD

SEQ ID NO: 1413762 - protein, 6 aa, Mycobacterium tuberculosis
HAAATQ

SEQ ID NO: 1413763 - protein, 7 aa, Mycobacterium tuberculosis
HAGPGIP

SEQ ID NO: 1413764 - protein, 7 aa, Mycobacterium tuberculosis
HDTLDND

SEQ ID NO: 1413765 - protein, 4 aa, Mycobacterium tuberculosis
HEPG

SEQ ID NO: 1413766 - protein, 4 aa, Mycobacterium tuberculosis
HGGR

SEQ ID NO: 1413767 - protein, 11 aa, Mycobacterium tuberculosis
HGHPAKNNYGS

SEQ ID NO: 1413768 - protein, 8 aa, Mycobacterium tuberculosis
HGIDPNAI

SEQ ID NO: 1413769 - protein, 7 aa, Mycobacterium tuberculosis
HGKPDGL

SEQ ID NO: 1413770 - protein, 12 aa, Mycobacterium tuberculosis
HGPPGTGKTYTA

SEQ ID NO: 1413771 - protein, 8 aa, Mycobacterium tuberculosis
HGPTTPPF

SEQ ID NO: 1413772 - protein, 8 aa, Mycobacterium tuberculosis
HGSVSTIG

SEQ ID NO: 1413773 - protein, 6 aa, Mycobacterium tuberculosis
HGTGAA

SEQ ID NO: 1413774 - protein, 5 aa, Mycobacterium tuberculosis
HGTGG

SEQ ID NO: 1413775 - protein, 10 aa, Mycobacterium tuberculosis
HGTGTSLGDR

SEQ ID NO: 1413776 - protein, 17 aa, Mycobacterium tuberculosis
HGTPDAYEAGTWGPESS

SEQ ID NO: 1413777 - protein, 7 aa, Mycobacterium tuberculosis
HHSNETV

SEQ ID NO: 1413778 - protein, 13 aa, Mycobacterium tuberculosis
HKRPRGRPRKDAV

SEQ ID NO: 1413779 - protein, 4 aa, Mycobacterium tuberculosis
HNEA

SEQ ID NO: 1413780 - protein, 24 aa, Mycobacterium tuberculosis
HPAAKRARAQPRRPVKRADETETV

SEQ ID NO: 1413781 - protein, 10 aa, Mycobacterium tuberculosis
HPDPKRDSQA

SEQ ID NO: 1413782 - protein, 16 aa, Mycobacterium tuberculosis
HPEAQGPATGTTVSPA

SEQ ID NO: 1413783 - protein, 4 aa, Mycobacterium tuberculosis
HPHK

SEQ ID NO: 1413784 - protein, 5 aa, Mycobacterium tuberculosis
HPRVS

SEQ ID NO: 1413785 - protein, 4 aa, Mycobacterium tuberculosis
HPRW

SEQ ID NO: 1413786 - protein, 4 aa, Mycobacterium tuberculosis
HPTV

SEQ ID NO: 1413787 - protein, 6 aa, Mycobacterium tuberculosis
HQDDAV

SEQ ID NO: 1413788 - protein, 6 aa, Mycobacterium tuberculosis
HQNMTS

SEQ ID NO: 1413789 - protein, 11 aa, Mycobacterium tuberculosis
HRPPRKPADRH

SEQ ID NO: 1413790 - protein, 13 aa, Mycobacterium tuberculosis
HRSGSLGGQDPRH

SEQ ID NO: 1413791 - protein, 10 aa, Mycobacterium tuberculosis
HSDGSDGAEH

SEQ ID NO: 1413792 - protein, 13 aa, Mycobacterium tuberculosis
HSHRRSRRRWSPN

SEQ ID NO: 1413793 - protein, 10 aa, Mycobacterium tuberculosis
HTAPVPGLTT

SEQ ID NO: 1413794 - protein, 24 aa, Mycobacterium tuberculosis
HTEPGLQGDRSSAGTKPATLQTGA

SEQ ID NO: 1413795 - protein, 4 aa, Mycobacterium tuberculosis
HTGR

SEQ ID NO: 1413796 - protein, 5 aa, Mycobacterium tuberculosis
HTYGQ

SEQ ID NO: 1413797 - protein, 6 aa, Mycobacterium tuberculosis
IADGRG

SEQ ID NO: 1413798 - protein, 11 aa, Mycobacterium tuberculosis
IAGGNDGGATL

SEQ ID NO: 1413799 - protein, 14 aa, Mycobacterium tuberculosis
IATDSTAAVPAPER

SEQ ID NO: 1413800 - protein, 4 aa, Mycobacterium tuberculosis
IDAP

SEQ ID NO: 1413801 - protein, 12 aa, Mycobacterium tuberculosis
IDPAQKKSTSEW

SEQ ID NO: 1413802 - protein, 6 aa, Mycobacterium tuberculosis
IEDPAK

SEQ ID NO: 1413803 - protein, 6 aa, Mycobacterium tuberculosis
IEGDRD

SEQ ID NO: 1413804 - protein, 6 aa, Mycobacterium tuberculosis
IGDRGG

SEQ ID NO: 1413805 - protein, 11 aa, Mycobacterium tuberculosis
IGNNSQKSRDL

SEQ ID NO: 1413806 - protein, 4 aa, Mycobacterium tuberculosis
IGPA

SEQ ID NO: 1413807 - protein, 6 aa, Mycobacterium tuberculosis
IGPPIT

SEQ ID NO: 1413808 - protein, 8 aa, Mycobacterium tuberculosis
IPGPTNPQ

SEQ ID NO: 1413809 - protein, 30 aa, Mycobacterium tuberculosis; identical to SEQ ID NO: 178725

SEQ ID NO: 1413810 - protein, 6 aa, Mycobacterium tuberculosis
IPPSLQ

SEQ ID NO: 1413811 - protein, 8 aa, Mycobacterium tuberculosis
IPSRNPIQ

SEQ ID NO: 1413812 - protein, 4 aa, Mycobacterium tuberculosis
IRQR

SEQ ID NO: 1413813 - protein, 7 aa, Mycobacterium tuberculosis
ISAPDNP

SEQ ID NO: 1413814 - protein, 11 aa, Mycobacterium tuberculosis
ISGSGNQRLPT

SEQ ID NO: 1413815 - protein, 22 aa, Mycobacterium tuberculosis
ISPRKVNKPLTGQYTAAGVNPR

SEQ ID NO: 1413816 - protein, 6 aa, Mycobacterium tuberculosis
ISRDKR

SEQ ID NO: 1413817 - protein, 7 aa, Mycobacterium tuberculosis
ITDPTQL

SEQ ID NO: 1413818 - protein, 9 aa, Mycobacterium tuberculosis
ITPGSGPKR

SEQ ID NO: 1413819 - protein, 6 aa, Mycobacterium tuberculosis
ITQGKG

SEQ ID NO: 1413820 - protein, 13 aa, Mycobacterium tuberculosis
KADAPSGTAARTA

SEQ ID NO: 1413821 - protein, 12 aa, Mycobacterium tuberculosis
KAGVPGADPSEW

SEQ ID NO: 1413822 - protein, 14 aa, Mycobacterium tuberculosis
KALERGRTTQERSD

SEQ ID NO: 1413823 - protein, 11 aa, Mycobacterium tuberculosis
KDPADEAKYAD

SEQ ID NO: 1413824 - protein, 13 aa, Mycobacterium tuberculosis
KDPMVPSAQSRAF

SEQ ID NO: 1413825 - protein, 12 aa, Mycobacterium tuberculosis
KDPRSSVTRTAT

SEQ ID NO: 1413826 - protein, 8 aa, Mycobacterium tuberculosis
KDRPELAS

SEQ ID NO: 1413827 - protein, 6 aa, Mycobacterium tuberculosis
KDRRQH

SEQ ID NO: 1413828 - protein, 9 aa, Mycobacterium tuberculosis
KDVIKSGGE

SEQ ID NO: 1413829 - protein, 9 aa, Mycobacterium tuberculosis
KEKDEAVKG

SEQ ID NO: 1413830 - protein, 19 aa, Mycobacterium tuberculosis
KFSGSARAKITAAGGSATE

SEQ ID NO: 1413831 - protein, 7 aa, Mycobacterium tuberculosis
KGDDVRK

SEQ ID NO: 1413832 - protein, 7 aa, Mycobacterium tuberculosis
KGLPDSV

SEQ ID NO: 1413833 - protein, 4 aa, Mycobacterium tuberculosis
KGSF

SEQ ID NO: 1413834 - protein, 5 aa, Mycobacterium tuberculosis
KHPWE

SEQ ID NO: 1413835 - protein, 9 aa, Mycobacterium tuberculosis
KKAAGNVDT

SEQ ID NO: 1413836 - protein, 6 aa, Mycobacterium tuberculosis
KKDHPC

SEQ ID NO: 1413837 - protein, 6 aa, Mycobacterium tuberculosis
KKSVGQ

SEQ ID NO: 1413838 - protein, 8 aa, Mycobacterium tuberculosis
KLASGDVN

SEQ ID NO: 1413839 - protein, 7 aa, Mycobacterium tuberculosis
KLEREPE

SEQ ID NO: 1413840 - protein, 12 aa, Mycobacterium tuberculosis
KMPSQTPPEPPT

SEQ ID NO: 1413841 - protein, 7 aa, Mycobacterium tuberculosis
KPGDKRA

SEQ ID NO: 1413842 - protein, 4 aa, Mycobacterium tuberculosis
KPGV

SEQ ID NO: 1413843 - protein, 15 aa, Mycobacterium tuberculosis
KPLGGPDGGNGGRGG

SEQ ID NO: 1413844 - protein, 11 aa, Mycobacterium tuberculosis
KPTKTGEGSDK

SEQ ID NO: 1413845 - protein, 7 aa, Mycobacterium tuberculosis
KQLEEPY

SEQ ID NO: 1413846 - protein, 10 aa, Mycobacterium tuberculosis
KRDARGQGHS

SEQ ID NO: 1413847 - protein, 14 aa, Mycobacterium tuberculosis
KRETSKNDDDRRAL

SEQ ID NO: 1413848 - protein, 7 aa, Mycobacterium tuberculosis
KRPGSGP

SEQ ID NO: 1413849 - protein, 13 aa, Mycobacterium tuberculosis
KRREESLHPVGED

SEQ ID NO: 1413850 - protein, 8 aa, Mycobacterium tuberculosis
KRRSEPEV

SEQ ID NO: 1413851 - protein, 8 aa, Mycobacterium tuberculosis
KRSPELSH

SEQ ID NO: 1413852 - protein, 8 aa, Mycobacterium tuberculosis
KSAARKRA

SEQ ID NO: 1413853 - protein, 5 aa, Mycobacterium tuberculosis
KSGTL

SEQ ID NO: 1413854 - protein, 6 aa, Mycobacterium tuberculosis
KSLRSR

SEQ ID NO: 1413855 - protein, 9 aa, Mycobacterium tuberculosis
KSPPARARR

SEQ ID NO: 1413856 - protein, 6 aa, Mycobacterium tuberculosis
KSQKQV

SEQ ID NO: 1413857 - protein, 6 aa, Mycobacterium tuberculosis
KSRSLK

SEQ ID NO: 1413858 - protein, 5 aa, Mycobacterium tuberculosis
KSTFR

SEQ ID NO: 1413859 - protein, 7 aa, Mycobacterium tuberculosis
KSTPAMT

SEQ ID NO: 1413860 - protein, 6 aa, Mycobacterium tuberculosis
KTAGLQ

SEQ ID NO: 1413861 - protein, 7 aa, Mycobacterium tuberculosis
KTANTHF

SEQ ID NO: 1413862 - protein, 13 aa, Mycobacterium tuberculosis
KTASALAAQAGRL

SEQ ID NO: 1413863 - protein, 8 aa, Mycobacterium tuberculosis
KTKTEALA

SEQ ID NO: 1413864 - protein, 6 aa, Mycobacterium tuberculosis
KTLNDD

SEQ ID NO: 1413865 - protein, 6 aa, Mycobacterium tuberculosis
KTRFQG

SEQ ID NO: 1413866 - protein, 9 aa, Mycobacterium tuberculosis
KTSADSGKL

SEQ ID NO: 1413867 - protein, 6 aa, Mycobacterium tuberculosis
KVDDQV

SEQ ID NO: 1413868 - protein, 9 aa, Mycobacterium tuberculosis
KVTGAGSTV

SEQ ID NO: 1413869 - protein, 4 aa, Mycobacterium tuberculosis
KVTL

SEQ ID NO: 1413870 - protein, 8 aa, Mycobacterium tuberculosis
LAAGASTA

SEQ ID NO: 1413871 - protein, 18 aa, Mycobacterium tuberculosis
LAAPANSTSIDRRLPSTR

SEQ ID NO: 1413872 - protein, 9 aa, Mycobacterium tuberculosis
LAASKSDLP

SEQ ID NO: 1413873 - protein, 4 aa, Mycobacterium tuberculosis
LAGG

SEQ ID NO: 1413874 - protein, 7 aa, Mycobacterium tuberculosis
LANGSAS

SEQ ID NO: 1413875 - protein, 12 aa, Mycobacterium tuberculosis
LAPGNADLSGLP

SEQ ID NO: 1413876 - protein, 6 aa, Mycobacterium tuberculosis
LAPPEL

SEQ ID NO: 1413877 - protein, 6 aa, Mycobacterium tuberculosis
LAPRTR

SEQ ID NO: 1413878 - protein, 12 aa, Mycobacterium tuberculosis
LARQPRDASPVR

SEQ ID NO: 1413879 - protein, 5 aa, Mycobacterium tuberculosis
LDAPT

SEQ ID NO: 1413880 - protein, 13 aa, Mycobacterium tuberculosis
LDTPAGALGPLPG

SEQ ID NO: 1413881 - protein, 17 aa, Mycobacterium tuberculosis
LEAATGKGVTGGGSRVP

SEQ ID NO: 1413882 - protein, 8 aa, Mycobacterium tuberculosis
LEAQKSDP

SEQ ID NO: 1413883 - protein, 15 aa, Mycobacterium tuberculosis
LENRTAKGKVVLRVR

SEQ ID NO: 1413884 - protein, 10 aa, Mycobacterium tuberculosis
LFDPDSALRA

SEQ ID NO: 1413885 - protein, 7 aa, Mycobacterium tuberculosis
LGAPANV

SEQ ID NO: 1413886 - protein, 6 aa, Mycobacterium tuberculosis
LGAVDE

SEQ ID NO: 1413887 - protein, 8 aa, Mycobacterium tuberculosis
LGESQYPI

SEQ ID NO: 1413888 - protein, 5 aa, Mycobacterium tuberculosis
LGGPR

SEQ ID NO: 1413889 - protein, 9 aa, Mycobacterium tuberculosis
LGRPPADVT

SEQ ID NO: 1413890 - protein, 5 aa, Mycobacterium tuberculosis
LGTGG

SEQ ID NO: 1413891 - protein, 6 aa, Mycobacterium tuberculosis
LGTLKQ

SEQ ID NO: 1413892 - protein, 12 aa, Mycobacterium tuberculosis
LKADGGSSWGNQ

SEQ ID NO: 1413893 - protein, 21 aa, Mycobacterium tuberculosis
LKPAGTTEFGTRTETKNVNSL

SEQ ID NO: 1413894 - protein, 7 aa, Mycobacterium tuberculosis
LKPEKDG

SEQ ID NO: 1413895 - protein, 9 aa, Mycobacterium tuberculosis
LKQKRSVTR

SEQ ID NO: 1413896 - protein, 6 aa, Mycobacterium tuberculosis
LNGEGI

SEQ ID NO: 1413897 - protein, 17 aa, Mycobacterium tuberculosis
LNSGTGNIGFGNSGNNN

SEQ ID NO: 1413898 - protein, 4 aa, Mycobacterium tuberculosis
LNTS

SEQ ID NO: 1413899 - protein, 7 aa, Mycobacterium tuberculosis
LNYSGGG

SEQ ID NO: 1413900 - protein, 8 aa, Mycobacterium tuberculosis
LPAAPSAL

SEQ ID NO: 1413901 - protein, 5 aa, Mycobacterium tuberculosis
LPADA

SEQ ID NO: 1413902 - protein, 5 aa, Mycobacterium tuberculosis
LPDHK

SEQ ID NO: 1413903 - protein, 4 aa, Mycobacterium tuberculosis
LPED

SEQ ID NO: 1413904 - protein, 19 aa, Mycobacterium tuberculosis
LPEGLTDAQAAAVTTASAT

SEQ ID NO: 1413905 - protein, 6 aa, Mycobacterium tuberculosis
LPGGDT

SEQ ID NO: 1413906 - protein, 20 aa, Mycobacterium tuberculosis
LPGGGFGHGYSSNGVGNPPL

SEQ ID NO: 1413907 - protein, 9 aa, Mycobacterium tuberculosis
LPLGTPKQR

SEQ ID NO: 1413908 - protein, 9 aa, Mycobacterium tuberculosis
LPPAPAPAV

SEQ ID NO: 1413909 - protein, 8 aa, Mycobacterium tuberculosis
LPPGAGEV

SEQ ID NO: 1413910 - protein, 9 aa, Mycobacterium tuberculosis
LPPGQGPWP

SEQ ID NO: 1413911 - protein, 4 aa, Mycobacterium tuberculosis
LPPH

SEQ ID NO: 1413912 - protein, 16 aa, Mycobacterium tuberculosis
LPPSFTARSNEDSAAW

SEQ ID NO: 1413913 - protein, 6 aa, Mycobacterium tuberculosis
LPRKSD

SEQ ID NO: 1413914 - protein, 13 aa, Mycobacterium tuberculosis
LPRRQDTSRRAAQ

SEQ ID NO: 1413915 - protein, 4 aa, Mycobacterium tuberculosis
LPTR

SEQ ID NO: 1413916 - protein, 4 aa, Mycobacterium tuberculosis
LQAG

SEQ ID NO: 1413917 - protein, 10 aa, Mycobacterium tuberculosis
LRAGSAEPTA

SEQ ID NO: 1413918 - protein, 9 aa, Mycobacterium tuberculosis
LRGPHRRRP

SEQ ID NO: 1413919 - protein, 11 aa, Mycobacterium tuberculosis
LRNAGSGSRHD

SEQ ID NO: 1413920 - protein, 16 aa, Mycobacterium tuberculosis
LRNPAGVGADDGARRD

SEQ ID NO: 1413921 - protein, 9 aa, Mycobacterium tuberculosis
LRPPGDQSA

SEQ ID NO: 1413922 - protein, 10 aa, Mycobacterium tuberculosis
LRTPGGNQTM

SEQ ID NO: 1413923 - protein, 7 aa, Mycobacterium tuberculosis
LSAPAVK

SEQ ID NO: 1413924 - protein, 10 aa, Mycobacterium tuberculosis
LSDDETERAV

SEQ ID NO: 1413925 - protein, 5 aa, Mycobacterium tuberculosis
LSDES

SEQ ID NO: 1413926 - protein, 5 aa, Mycobacterium tuberculosis
LSEDK

SEQ ID NO: 1413927 - protein, 5 aa, Mycobacterium tuberculosis
LSNKE

SEQ ID NO: 1413928 - protein, 9 aa, Mycobacterium tuberculosis
LSPASGRPL

SEQ ID NO: 1413929 - protein, 8 aa, Mycobacterium tuberculosis
LSPDAPAL

SEQ ID NO: 1413930 - protein, 6 aa, Mycobacterium tuberculosis
LSPDGR

SEQ ID NO: 1413931 - protein, 29 aa, Mycobacterium tuberculosis
LSPPSQTTNPGGLAAQSAAVGSAAATAAV

SEQ ID NO: 1413932 - protein, 7 aa, Mycobacterium tuberculosis
LSQLNST

SEQ ID NO: 1413933 - protein, 13 aa, Mycobacterium tuberculosis
LTAANAAAAVPTS

SEQ ID NO: 1413934 - protein, 13 aa, Mycobacterium tuberculosis
LTGRSGPGAGRTA

SEQ ID NO: 1413935 - protein, 7 aa, Mycobacterium tuberculosis
LTPEDTG

SEQ ID NO: 1413936 - protein, 6 aa, Mycobacterium tuberculosis
LTPRQY

SEQ ID NO: 1413937 - protein, 28 aa, Mycobacterium tuberculosis
LYAESGGQIADEGTISGTGSSEAARAAV

SEQ ID NO: 1413938 - protein, 9 aa, Mycobacterium tuberculosis
MKNPDRGYA

SEQ ID NO: 1413939 - protein, 6 aa, Mycobacterium tuberculosis
MPDSPF

SEQ ID NO: 1413940 - protein, 15 aa, Mycobacterium tuberculosis
MPGMPGAPGAPPVPG

SEQ ID NO: 1413941 - protein, 13 aa, Mycobacterium tuberculosis
MRETRGTSENVDS

SEQ ID NO: 1413942 - protein, 18 aa, Mycobacterium tuberculosis
MRPPAPPAAPPGAPGMPG

SEQ ID NO: 1413943 - protein, 16 aa, Mycobacterium tuberculosis
MRTDPSAQPAPEQPIA

SEQ ID NO: 1413944 - protein, 16 aa, Mycobacterium tuberculosis
MSGSRPTESGDPTSQV

SEQ ID NO: 1413945 - protein, 7 aa, Mycobacterium tuberculosis
MSSPGLA

SEQ ID NO: 1413946 - protein, 10 aa, Mycobacterium tuberculosis
MTPPERVTTA

SEQ ID NO: 1413947 - protein, 10 aa, Mycobacterium tuberculosis
MYSGPGSGPL

SEQ ID NO: 1413948 - protein, 13 aa, Mycobacterium tuberculosis
NAEQAGVNGPLPE

SEQ ID NO: 1413949 - protein, 7 aa, Mycobacterium tuberculosis
NARAGLA

SEQ ID NO: 1413950 - protein, 6 aa, Mycobacterium tuberculosis
NATTVV

SEQ ID NO: 1413951 - protein, 11 aa, Mycobacterium tuberculosis
NDDNQPGAPNR

SEQ ID NO: 1413952 - protein, 10 aa, Mycobacterium tuberculosis
NDEAAEAERM

SEQ ID NO: 1413953 - protein, 19 aa, Mycobacterium tuberculosis
NDGSNGESGESSQSINDAA

SEQ ID NO: 1413954 - protein, 5 aa, Mycobacterium tuberculosis
NFNAG

SEQ ID NO: 1413955 - protein, 19 aa, Mycobacterium tuberculosis
NFPQLPPAPDDYPTFPDTS

SEQ ID NO: 1413956 - protein, 5 aa, Mycobacterium tuberculosis
NGAGK

SEQ ID NO: 1413957 - protein, 37 aa, Mycobacterium tuberculosis; identical to SEQ ID NO: 181293

SEQ ID NO: 1413958 - protein, 11 aa, Mycobacterium tuberculosis
NGHNVSTRGRI

SEQ ID NO: 1413959 - protein, 6 aa, Mycobacterium tuberculosis
NGQPAA

SEQ ID NO: 1413960 - protein, 11 aa, Mycobacterium tuberculosis
NGRTAAPSTEA

SEQ ID NO: 1413961 - protein, 12 aa, Mycobacterium tuberculosis
NGTRTRAGQPLT

SEQ ID NO: 1413962 - protein, 9 aa, Mycobacterium tuberculosis
NHLGDTAAD

SEQ ID NO: 1413963 - protein, 6 aa, Mycobacterium tuberculosis
NHTSSA

SEQ ID NO: 1413964 - protein, 8 aa, Mycobacterium tuberculosis
NKPSNSDV

SEQ ID NO: 1413965 - protein, 6 aa, Mycobacterium tuberculosis
NKTPID

SEQ ID NO: 1413966 - protein, 5 aa, Mycobacterium tuberculosis
NLGDA

SEQ ID NO: 1413967 - protein, 16 aa, Mycobacterium tuberculosis
NLGDYNVGSGNVGSYN

SEQ ID NO: 1413968 - protein, 9 aa, Mycobacterium tuberculosis
NLRRSARAA

SEQ ID NO: 1413969 - protein, 15 aa, Mycobacterium tuberculosis
NMPTGGTLLRWSAPL

SEQ ID NO: 1413970 - protein, 10 aa, Mycobacterium tuberculosis
NMVDGRPEDL

SEQ ID NO: 1413971 - protein, 8 aa, Mycobacterium tuberculosis
NNGLTASE

SEQ ID NO: 1413972 - protein, 7 aa, Mycobacterium tuberculosis
NNPLSGL

SEQ ID NO: 1413973 - protein, 4 aa, Mycobacterium tuberculosis
NPGL

SEQ ID NO: 1413974 - protein, 13 aa, Mycobacterium tuberculosis
NPHRPRPSDPDGL

SEQ ID NO: 1413975 - protein, 6 aa, Mycobacterium tuberculosis
NPLNDS

SEQ ID NO: 1413976 - protein, 7 aa, Mycobacterium tuberculosis
NPQLPTV

SEQ ID NO: 1413977 - protein, 4 aa, Mycobacterium tuberculosis
NPRY

SEQ ID NO: 1413978 - protein, 7 aa, Mycobacterium tuberculosis
NPSRSLQ

SEQ ID NO: 1413979 - protein, 12 aa, Mycobacterium tuberculosis
NPVTAHKDGTIT

SEQ ID NO: 1413980 - protein, 6 aa, Mycobacterium tuberculosis
NRSDRV

SEQ ID NO: 1413981 - protein, 5 aa, Mycobacterium tuberculosis
NRSPG

SEQ ID NO: 1413982 - protein, 10 aa, Mycobacterium tuberculosis
NSGSPTGASA

SEQ ID NO: 1413983 - protein, 9 aa, Mycobacterium tuberculosis
NSGTGNTGL

SEQ ID NO: 1413984 - protein, 9 aa, Mycobacterium tuberculosis
NSPAGDSLA

SEQ ID NO: 1413985 - protein, 12 aa, Mycobacterium tuberculosis
NSRSGKREGKTM

SEQ ID NO: 1413986 - protein, 10 aa, Mycobacterium tuberculosis
NSSTDCRPSH

SEQ ID NO: 1413987 - protein, 13 aa, Mycobacterium tuberculosis
NTAGFNPGSYNTG

SEQ ID NO: 1413988 - protein, 15 aa, Mycobacterium tuberculosis
NTGNGNSGFSNAGPA

SEQ ID NO: 1413989 - protein, 17 aa, Mycobacterium tuberculosis
NTLRRQRTELTDQPEGS

SEQ ID NO: 1413990 - protein, 5 aa, Mycobacterium tuberculosis
NTLTA

SEQ ID NO: 1413991 - protein, 6 aa, Mycobacterium tuberculosis
NTSEDR

SEQ ID NO: 1413992 - protein, 9 aa, Mycobacterium tuberculosis
NTTTRTRRQ

SEQ ID NO: 1413993 - protein, 12 aa, Mycobacterium tuberculosis
NVDGKGASYGSH

SEQ ID NO: 1413994 - protein, 5 aa, Mycobacterium tuberculosis
NVDPA

SEQ ID NO: 1413995 - protein, 11 aa, Mycobacterium tuberculosis
NVPGPRERGRV

SEQ ID NO: 1413996 - protein, 8 aa, Mycobacterium tuberculosis
PAANSTRI

SEQ ID NO: 1413997 - protein, 7 aa, Mycobacterium tuberculosis
PAATKAD

SEQ ID NO: 1413998 - protein, 5 aa, Mycobacterium tuberculosis
PADQA

SEQ ID NO: 1413999 - protein, 9 aa, Mycobacterium tuberculosis
PADSDDPLQ

SEQ ID NO: 1414000 - protein, 5 aa, Mycobacterium tuberculosis
PAGAY

SEQ ID NO: 1414001 - protein, 16 aa, Mycobacterium tuberculosis
PAGESVAQVNDRADSA

SEQ ID NO: 1414002 - protein, 4 aa, Mycobacterium tuberculosis
PAGS

SEQ ID NO: 1414003 - protein, 7 aa, Mycobacterium tuberculosis
PAGTPTM

SEQ ID NO: 1414004 - protein, 9 aa, Mycobacterium tuberculosis
PAHRAGADQ

SEQ ID NO: 1414005 - protein, 9 aa, Mycobacterium tuberculosis
PALAGGPTA

SEQ ID NO: 1414006 - protein, 9 aa, Mycobacterium tuberculosis
PANRPGRAV

SEQ ID NO: 1414007 - protein, 8 aa, Mycobacterium tuberculosis
PAPGAPPL

SEQ ID NO: 1414008 - protein, 5 aa, Mycobacterium tuberculosis
PAQAE

SEQ ID NO: 1414009 - protein, 7 aa, Mycobacterium tuberculosis
PARIDTP

SEQ ID NO: 1414010 - protein, 9 aa, Mycobacterium tuberculosis
PASGPGTIA

SEQ ID NO: 1414011 - protein, 8 aa, Mycobacterium tuberculosis
PASPGSTM

SEQ ID NO: 1414012 - protein, 12 aa, Mycobacterium tuberculosis
PATNTVTGSPIP

SEQ ID NO: 1414013 - protein, 6 aa, Mycobacterium tuberculosis
PAVGER

SEQ ID NO: 1414014 - protein, 4 aa, Mycobacterium tuberculosis
PAVK

SEQ ID NO: 1414015 - protein, 7 aa, Mycobacterium tuberculosis
PAYSPGD

SEQ ID NO: 1414016 - protein, 6 aa, Mycobacterium tuberculosis
PCTGTG

SEQ ID NO: 1414017 - protein, 7 aa, Mycobacterium tuberculosis
PDAVDST

SEQ ID NO: 1414018 - protein, 5 aa, Mycobacterium tuberculosis
PDAVE

SEQ ID NO: 1414019 - protein, 5 aa, Mycobacterium tuberculosis
PDDGT

SEQ ID NO: 1414020 - protein, 8 aa, Mycobacterium tuberculosis
PDETSRTF

SEQ ID NO: 1414021 - protein, 5 aa, Mycobacterium tuberculosis
PDGAE

SEQ ID NO: 1414022 - protein, 16 aa, Mycobacterium tuberculosis
PDGQWTASPQEGHSVR

SEQ ID NO: 1414023 - protein, 9 aa, Mycobacterium tuberculosis
PDGSDAWDG

SEQ ID NO: 1414024 - protein, 6 aa, Mycobacterium tuberculosis
PDIQQQ

SEQ ID NO: 1414025 - protein, 7 aa, Mycobacterium tuberculosis
PDKGTVT

SEQ ID NO: 1414026 - protein, 5 aa, Mycobacterium tuberculosis
PDPFT

SEQ ID NO: 1414027 - protein, 8 aa, Mycobacterium tuberculosis
PDPTEGVK

SEQ ID NO: 1414028 - protein, 6 aa, Mycobacterium tuberculosis
PDRFDP

SEQ ID NO: 1414029 - protein, 13 aa, Mycobacterium tuberculosis
PDRNAGFSTANPG

SEQ ID NO: 1414030 - protein, 7 aa, Mycobacterium tuberculosis
PDSDFEA

SEQ ID NO: 1414031 - protein, 13 aa, Mycobacterium tuberculosis
PDTPPGEDRAERL

SEQ ID NO: 1414032 - protein, 4 aa, Mycobacterium tuberculosis
PEAE

SEQ ID NO: 1414033 - protein, 5 aa, Mycobacterium tuberculosis
PEPAG

SEQ ID NO: 1414034 - protein, 10 aa, Mycobacterium tuberculosis
PESRSASIGY

SEQ ID NO: 1414035 - protein, 7 aa, Mycobacterium tuberculosis
PFPAPTQ

SEQ ID NO: 1414036 - protein, 8 aa, Mycobacterium tuberculosis
PGALGDQR

SEQ ID NO: 1414037 - protein, 10 aa, Mycobacterium tuberculosis
PGARYRGDRG

SEQ ID NO: 1414038 - protein, 9 aa, Mycobacterium tuberculosis
PGASDTARF

SEQ ID NO: 1414039 - protein, 17 aa, Mycobacterium tuberculosis
PGASVSSRSVADRPNRK

SEQ ID NO: 1414040 - protein, 5 aa, Mycobacterium tuberculosis
PGATP

SEQ ID NO: 1414041 - protein, 4 aa, Mycobacterium tuberculosis
PGEY

SEQ ID NO: 1414042 - protein, 5 aa, Mycobacterium tuberculosis
PGFVG

SEQ ID NO: 1414043 - protein, 11 aa, Mycobacterium tuberculosis
PGGDPHAGHTE

SEQ ID NO: 1414044 - protein, 4 aa, Mycobacterium tuberculosis
PGGM

SEQ ID NO: 1414045 - protein, 23 aa, Mycobacterium tuberculosis
PGHGDDTELGAERPSLSEWRARG

SEQ ID NO: 1414046 - protein, 13 aa, Mycobacterium tuberculosis
PGKDAARIEGSKA

SEQ ID NO: 1414047 - protein, 9 aa, Mycobacterium tuberculosis
PGLGVRPAT

SEQ ID NO: 1414048 - protein, 5 aa, Mycobacterium tuberculosis
PGPDG

SEQ ID NO: 1414049 - protein, 7 aa, Mycobacterium tuberculosis
PGPYPGY

SEQ ID NO: 1414050 - protein, 12 aa, Mycobacterium tuberculosis
PGRATRGFHNHR

SEQ ID NO: 1414051 - protein, 10 aa, Mycobacterium tuberculosis
PGSDPIPRRS

SEQ ID NO: 1414052 - protein, 6 aa, Mycobacterium tuberculosis
PGTGNM

SEQ ID NO: 1414053 - protein, 5 aa, Mycobacterium tuberculosis
PGTMN

SEQ ID NO: 1414054 - protein, 8 aa, Mycobacterium tuberculosis
PGVTAVEP

SEQ ID NO: 1414055 - protein, 14 aa, Mycobacterium tuberculosis
PGWRRGATQGHSGT

SEQ ID NO: 1414056 - protein, 4 aa, Mycobacterium tuberculosis
PHEL

SEQ ID NO: 1414057 - protein, 13 aa, Mycobacterium tuberculosis
PHGELTQDPAAKR

SEQ ID NO: 1414058 - protein, 8 aa, Mycobacterium tuberculosis
PHLPPPTR

SEQ ID NO: 1414059 - protein, 7 aa, Mycobacterium tuberculosis
PHNPTGA

SEQ ID NO: 1414060 - protein, 16 aa, Mycobacterium tuberculosis
PHPTSDHGQPRTNTCR

SEQ ID NO: 1414061 - protein, 7 aa, Mycobacterium tuberculosis
PIGLSEA

SEQ ID NO: 1414062 - protein, 12 aa, Mycobacterium tuberculosis
PKGQARQAAEEL

SEQ ID NO: 1414063 - protein, 5 aa, Mycobacterium tuberculosis
PKGYQ

SEQ ID NO: 1414064 - protein, 4 aa, Mycobacterium tuberculosis
PKLE

SEQ ID NO: 1414065 - protein, 9 aa, Mycobacterium tuberculosis
PLDDERNAA

SEQ ID NO: 1414066 - protein, 7 aa, Mycobacterium tuberculosis
PLEDGTT

SEQ ID NO: 1414067 - protein, 8 aa, Mycobacterium tuberculosis
PLGSTDMG

SEQ ID NO: 1414068 - protein, 12 aa, Mycobacterium tuberculosis
PLPNTAGCRSAA

SEQ ID NO: 1414069 - protein, 11 aa, Mycobacterium tuberculosis
PLRDEGESYAK

SEQ ID NO: 1414070 - protein, 4 aa, Mycobacterium tuberculosis
PNSG

SEQ ID NO: 1414071 - protein, 5 aa, Mycobacterium tuberculosis
PPAGA

SEQ ID NO: 1414072 - protein, 4 aa, Mycobacterium tuberculosis
PPDR

SEQ ID NO: 1414073 - protein, 5 aa, Mycobacterium tuberculosis
PPGTG

SEQ ID NO: 1414074 - protein, 5 aa, Mycobacterium tuberculosis
PPKPS

SEQ ID NO: 1414075 - protein, 22 aa, Mycobacterium tuberculosis
PPNWAGASPSLAPTVGSASAPL

SEQ ID NO: 1414076 - protein, 7 aa, Mycobacterium tuberculosis
PPRPLPG

SEQ ID NO: 1414077 - protein, 9 aa, Mycobacterium tuberculosis
PPSAEAALA

SEQ ID NO: 1414078 - protein, 28 aa, Mycobacterium tuberculosis
PPSWAAPSTRPVSALSPAGLTTLPGTDV

SEQ ID NO: 1414079 - protein, 17 aa, Mycobacterium tuberculosis
PPTPGFGNTTATPSSGF

SEQ ID NO: 1414080 - protein, 13 aa, Mycobacterium tuberculosis
PQKAKPPKPVARQ

SEQ ID NO: 1414081 - protein, 8 aa, Mycobacterium tuberculosis
PQPVDPES

SEQ ID NO: 1414082 - protein, 7 aa, Mycobacterium tuberculosis
PRRAGGA

SEQ ID NO: 1414083 - protein, 10 aa, Mycobacterium tuberculosis
PRSTAEAFPG

SEQ ID NO: 1414084 - protein, 5 aa, Mycobacterium tuberculosis
PSANP

SEQ ID NO: 1414085 - protein, 16 aa, Mycobacterium tuberculosis
PSEDLADATDAELAGQ

SEQ ID NO: 1414086 - protein, 5 aa, Mycobacterium tuberculosis
PSEDR

SEQ ID NO: 1414087 - protein, 11 aa, Mycobacterium tuberculosis
PSSNTVSTANE

SEQ ID NO: 1414088 - protein, 9 aa, Mycobacterium tuberculosis
PSTRVPAGA

SEQ ID NO: 1414089 - protein, 5 aa, Mycobacterium tuberculosis
PSVAE

SEQ ID NO: 1414090 - protein, 10 aa, Mycobacterium tuberculosis
PTADGTEVTE

SEQ ID NO: 1414091 - protein, 6 aa, Mycobacterium tuberculosis
PTADQQ

SEQ ID NO: 1414092 - protein, 8 aa, Mycobacterium tuberculosis
PTPETRER

SEQ ID NO: 1414093 - protein, 10 aa, Mycobacterium tuberculosis
PTSAGSADIS

SEQ ID NO: 1414094 - protein, 11 aa, Mycobacterium tuberculosis
PTSDARLPQAV

SEQ ID NO: 1414095 - protein, 7 aa, Mycobacterium tuberculosis
PTSSAHI

SEQ ID NO: 1414096 - protein, 18 aa, Mycobacterium tuberculosis
PTVLPDPRSARQPDGVHA

SEQ ID NO: 1414097 - protein, 9 aa, Mycobacterium tuberculosis
PTVPAGTSR

SEQ ID NO: 1414098 - protein, 8 aa, Mycobacterium tuberculosis
PVAPTEAT

SEQ ID NO: 1414099 - protein, 7 aa, Mycobacterium tuberculosis
PVDESRK

SEQ ID NO: 1414100 - protein, 20 aa, Mycobacterium tuberculosis
PVPAPESGAPGDTPATPGID

SEQ ID NO: 1414101 - protein, 19 aa, Mycobacterium tuberculosis
PVPGPVPTSPANNDFKPGF

SEQ ID NO: 1414102 - protein, 9 aa, Mycobacterium tuberculosis
PVRRTNPAV

SEQ ID NO: 1414103 - protein, 5 aa, Mycobacterium tuberculosis
PWEDP

SEQ ID NO: 1414104 - protein, 10 aa, Mycobacterium tuberculosis
PWEPSADGEW

SEQ ID NO: 1414105 - protein, 8 aa, Mycobacterium tuberculosis
PYPRREDV

SEQ ID NO: 1414106 - protein, 12 aa, Mycobacterium tuberculosis
PYSRDPRNIARK

SEQ ID NO: 1414107 - protein, 7 aa, Mycobacterium tuberculosis
QAAGAAP

SEQ ID NO: 1414108 - protein, 14 aa, Mycobacterium tuberculosis
QAARRGESERGPSR

SEQ ID NO: 1414109 - protein, 8 aa, Mycobacterium tuberculosis
QAERGNKI

SEQ ID NO: 1414110 - protein, 20 aa, Mycobacterium tuberculosis
QALPGAAVAGSRGQELSTSA

SEQ ID NO: 1414111 - protein, 8 aa, Mycobacterium tuberculosis
QAPDAVDG

SEQ ID NO: 1414112 - protein, 6 aa, Mycobacterium tuberculosis
QAPGPV

SEQ ID NO: 1414113 - protein, 7 aa, Mycobacterium tuberculosis
QARTGMG

SEQ ID NO: 1414114 - protein, 6 aa, Mycobacterium tuberculosis
QATGGN

SEQ ID NO: 1414115 - protein, 5 aa, Mycobacterium tuberculosis
QDCRS

SEQ ID NO: 1414116 - protein, 25 aa, Mycobacterium tuberculosis
QDGPTPPPPGAPHPSGGADGPYSDP

SEQ ID NO: 1414117 - protein, 4 aa, Mycobacterium tuberculosis
QDPL

SEQ ID NO: 1414118 - protein, 7 aa, Mycobacterium tuberculosis
QEHKTRI

SEQ ID NO: 1414119 - protein, 7 aa, Mycobacterium tuberculosis
QGNPSNV

SEQ ID NO: 1414120 - protein, 4 aa, Mycobacterium tuberculosis
QGTS

SEQ ID NO: 1414121 - protein, 8 aa, Mycobacterium tuberculosis
QHRAATSI

SEQ ID NO: 1414122 - protein, 6 aa, Mycobacterium tuberculosis
QLKTGR

SEQ ID NO: 1414123 - protein, 6 aa, Mycobacterium tuberculosis
QLTRAG

SEQ ID NO: 1414124 - protein, 13 aa, Mycobacterium tuberculosis
QNAPAIAAAEATY

SEQ ID NO: 1414125 - protein, 10 aa, Mycobacterium tuberculosis
QNAPAIAATE

SEQ ID NO: 1414126 - protein, 15 aa, Mycobacterium tuberculosis
QNSGTAFSGAVQSGN

SEQ ID NO: 1414127 - protein, 5 aa, Mycobacterium tuberculosis
QPDLG

SEQ ID NO: 1414128 - protein, 5 aa, Mycobacterium tuberculosis
QPEVT

SEQ ID NO: 1414129 - protein, 17 aa, Mycobacterium tuberculosis
QPGALGGGADDRESPLG

SEQ ID NO: 1414130 - protein, 7 aa, Mycobacterium tuberculosis
QPNTMGD

SEQ ID NO: 1414131 - protein, 8 aa, Mycobacterium tuberculosis
QPRADEPV

SEQ ID NO: 1414132 - protein, 9 aa, Mycobacterium tuberculosis
QQATAAPVA

SEQ ID NO: 1414133 - protein, 4 aa, Mycobacterium tuberculosis
QQDL

SEQ ID NO: 1414134 - protein, 7 aa, Mycobacterium tuberculosis
QQNSAGR

SEQ ID NO: 1414135 - protein, 8 aa, Mycobacterium tuberculosis
QQSGNSPM

SEQ ID NO: 1414136 - protein, 12 aa, Mycobacterium tuberculosis
QRAEREKQWRSG

SEQ ID NO: 1414137 - protein, 4 aa, Mycobacterium tuberculosis
QRGQ

SEQ ID NO: 1414138 - protein, 19 aa, Mycobacterium tuberculosis
QRNSKTAGASVGDLATDPD

SEQ ID NO: 1414139 - protein, 12 aa, Mycobacterium tuberculosis
QRPDPPPPGPGQ

SEQ ID NO: 1414140 - protein, 6 aa, Mycobacterium tuberculosis
QRRGEV

SEQ ID NO: 1414141 - protein, 26 aa, Mycobacterium tuberculosis
QSKPGAAGGARGVGGFRESRADCGEQ

SEQ ID NO: 1414142 - protein, 4 aa, Mycobacterium tuberculosis
QSPQ

SEQ ID NO: 1414143 - protein, 14 aa, Mycobacterium tuberculosis
QSSEMGLARGTEAG

SEQ ID NO: 1414144 - protein, 7 aa, Mycobacterium tuberculosis
QSTAGPM

SEQ ID NO: 1414145 - protein, 11 aa, Mycobacterium tuberculosis
QTAGRGRHGRG

SEQ ID NO: 1414146 - protein, 4 aa, Mycobacterium tuberculosis
QTDK

SEQ ID NO: 1414147 - protein, 10 aa, Mycobacterium tuberculosis
QTNDPTAHAE

SEQ ID NO: 1414148 - protein, 8 aa, Mycobacterium tuberculosis
QTNYSAAK

SEQ ID NO: 1414149 - protein, 5 aa, Mycobacterium tuberculosis
QVTQR

SEQ ID NO: 1414150 - protein, 7 aa, Mycobacterium tuberculosis
RAAEPVE

SEQ ID NO: 1414151 - protein, 5 aa, Mycobacterium tuberculosis
RAAGV

SEQ ID NO: 1414152 - protein, 7 aa, Mycobacterium tuberculosis
RAARDNS

SEQ ID NO: 1414153 - protein, 10 aa, Mycobacterium tuberculosis
RAATTAPAGV

SEQ ID NO: 1414154 - protein, 12 aa, Mycobacterium tuberculosis
RADDTGSMSVVL

SEQ ID NO: 1414155 - protein, 11 aa, Mycobacterium tuberculosis
RADKSGTGSEI

SEQ ID NO: 1414156 - protein, 8 aa, Mycobacterium tuberculosis
RADRQPEF

SEQ ID NO: 1414157 - protein, 6 aa, Mycobacterium tuberculosis
RAGEAV

SEQ ID NO: 1414158 - protein, 8 aa, Mycobacterium tuberculosis
RAGNQQAK

SEQ ID NO: 1414159 - protein, 8 aa, Mycobacterium tuberculosis
RAKGEAAV

SEQ ID NO: 1414160 - protein, 9 aa, Mycobacterium tuberculosis
RANDTDDAH

SEQ ID NO: 1414161 - protein, 8 aa, Mycobacterium tuberculosis
RANGGGDI

SEQ ID NO: 1414162 - protein, 6 aa, Mycobacterium tuberculosis
RANSYP

SEQ ID NO: 1414163 - protein, 8 aa, Mycobacterium tuberculosis
RAPDADAA

SEQ ID NO: 1414164 - protein, 4 aa, Mycobacterium tuberculosis
RARA

SEQ ID NO: 1414165 - protein, 15 aa, Mycobacterium tuberculosis
RARGAEVSSALNPAQ

SEQ ID NO: 1414166 - protein, 8 aa, Mycobacterium tuberculosis
RARHPDSK

SEQ ID NO: 1414167 - protein, 7 aa, Mycobacterium tuberculosis
RARTTGT

SEQ ID NO: 1414168 - protein, 9 aa, Mycobacterium tuberculosis
RASDFNARS

SEQ ID NO: 1414169 - protein, 5 aa, Mycobacterium tuberculosis
RATVS

SEQ ID NO: 1414170 - protein, 13 aa, Mycobacterium tuberculosis
RCSRTDSKASYTQ

SEQ ID NO: 1414171 - protein, 12 aa, Mycobacterium tuberculosis
RDALSGEGARRF

SEQ ID NO: 1414172 - protein, 6 aa, Mycobacterium tuberculosis
RDAPRL

SEQ ID NO: 1414173 - protein, 8 aa, Mycobacterium tuberculosis
RDDNPHRD

SEQ ID NO: 1414174 - protein, 7 aa, Mycobacterium tuberculosis
RDELPAK

SEQ ID NO: 1414175 - protein, 7 aa, Mycobacterium tuberculosis
RDERNGG

SEQ ID NO: 1414176 - protein, 8 aa, Mycobacterium tuberculosis
RDKIAESG

SEQ ID NO: 1414177 - protein, 5 aa, Mycobacterium tuberculosis
RDNGV

SEQ ID NO: 1414178 - protein, 9 aa, Mycobacterium tuberculosis
RDPQEAAQL

SEQ ID NO: 1414179 - protein, 6 aa, Mycobacterium tuberculosis
RDPSLR

SEQ ID NO: 1414180 - protein, 6 aa, Mycobacterium tuberculosis
RDSQKG

SEQ ID NO: 1414181 - protein, 4 aa, Mycobacterium tuberculosis
REDL

SEQ ID NO: 1414182 - protein, 4 aa, Mycobacterium tuberculosis
REGA

SEQ ID NO: 1414183 - protein, 7 aa, Mycobacterium tuberculosis
REGHTQA

SEQ ID NO: 1414184 - protein, 8 aa, Mycobacterium tuberculosis
RENADNRL

SEQ ID NO: 1414185 - protein, 8 aa, Mycobacterium tuberculosis
RENGDTGH

SEQ ID NO: 1414186 - protein, 22 aa, Mycobacterium tuberculosis
REPGREYAEDIETGSAAAALGG

SEQ ID NO: 1414187 - protein, 20 aa, Mycobacterium tuberculosis
REQADTYMKSGGTEGTQLQG

SEQ ID NO: 1414188 - protein, 8 aa, Mycobacterium tuberculosis
REQSRPEL

SEQ ID NO: 1414189 - protein, 12 aa, Mycobacterium tuberculosis
RERSGVRQSKER

SEQ ID NO: 1414190 - protein, 5 aa, Mycobacterium tuberculosis
RFGAA

SEQ ID NO: 1414191 - protein, 9 aa, Mycobacterium tuberculosis
RGAAGTAAQ

SEQ ID NO: 1414192 - protein, 7 aa, Mycobacterium tuberculosis
RGDTTPM

SEQ ID NO: 1414193 - protein, 6 aa, Mycobacterium tuberculosis
RGFDPE

SEQ ID NO: 1414194 - protein, 8 aa, Mycobacterium tuberculosis
RGGGTYAD

SEQ ID NO: 1414195 - protein, 6 aa, Mycobacterium tuberculosis
RGHRPV

SEQ ID NO: 1414196 - protein, 5 aa, Mycobacterium tuberculosis
RGHTT

SEQ ID NO: 1414197 - protein, 26 aa, Mycobacterium tuberculosis
RGISSPPVVPPPAEPPPAMPARDEPL

SEQ ID NO: 1414198 - protein, 8 aa, Mycobacterium tuberculosis
RGITPAAA

SEQ ID NO: 1414199 - protein, 8 aa, Mycobacterium tuberculosis
RGKLTPRE

SEQ ID NO: 1414200 - protein, 8 aa, Mycobacterium tuberculosis
RGQEAAQV

SEQ ID NO: 1414201 - protein, 8 aa, Mycobacterium tuberculosis
RGSENLCP

SEQ ID NO: 1414202 - protein, 6 aa, Mycobacterium tuberculosis
RGSRAA

SEQ ID NO: 1414203 - protein, 11 aa, Mycobacterium tuberculosis
RGTVPGDEDVL

SEQ ID NO: 1414204 - protein, 4 aa, Mycobacterium tuberculosis
RGVS

SEQ ID NO: 1414205 - protein, 12 aa, Mycobacterium tuberculosis
RHATTAGATPVE

SEQ ID NO: 1414206 - protein, 6 aa, Mycobacterium tuberculosis
RHPETM

SEQ ID NO: 1414207 - protein, 15 aa, Mycobacterium tuberculosis
RHTADATVAEARQRA

SEQ ID NO: 1414208 - protein, 5 aa, Mycobacterium tuberculosis
RINPE

SEQ ID NO: 1414209 - protein, 42 aa, Mycobacterium tuberculosis
RKDADTYAAPISRKSVRPRPHRPAGARAAFKPEPAMQDEDYQ

SEQ ID NO: 1414210 - protein, 7 aa, Mycobacterium tuberculosis
RKGLGAD

SEQ ID NO: 1414211 - protein, 7 aa, Mycobacterium tuberculosis
RKPDGRV

SEQ ID NO: 1414212 - protein, 6 aa, Mycobacterium tuberculosis
RKQMQA

SEQ ID NO: 1414213 - protein, 31 aa, Mycobacterium tuberculosis; identical to SEQ ID NO: 155393

SEQ ID NO: 1414214 - protein, 8 aa, Mycobacterium tuberculosis
RKSPGKDY

SEQ ID NO: 1414215 - protein, 8 aa, Mycobacterium tuberculosis
RKSTGLDV

SEQ ID NO: 1414216 - protein, 91 aa, Mycobacterium tuberculosis; identical to SEQ ID NO: 185617

SEQ ID NO: 1414217 - protein, 17 aa, Mycobacterium tuberculosis
RLGEPRSNGCSYADSPH

SEQ ID NO: 1414218 - protein, 9 aa, Mycobacterium tuberculosis
RLGQPPSGY

SEQ ID NO: 1414219 - protein, 11 aa, Mycobacterium tuberculosis
RNNHPRAAGGE

SEQ ID NO: 1414220 - protein, 10 aa, Mycobacterium tuberculosis
RNPTGDTAPF

SEQ ID NO: 1414221 - protein, 11 aa, Mycobacterium tuberculosis
RPDETGAEPDW

SEQ ID NO: 1414222 - protein, 4 aa, Mycobacterium tuberculosis
RPEV

SEQ ID NO: 1414223 - protein, 4 aa, Mycobacterium tuberculosis
RPGI

SEQ ID NO: 1414224 - protein, 10 aa, Mycobacterium tuberculosis
RPKTQRESLG

SEQ ID NO: 1414225 - protein, 7 aa, Mycobacterium tuberculosis
RPQAGRY

SEQ ID NO: 1414226 - protein, 7 aa, Mycobacterium tuberculosis
RPRHPDD

SEQ ID NO: 1414227 - protein, 10 aa, Mycobacterium tuberculosis
RPSDTNTAGL

SEQ ID NO: 1414228 - protein, 9 aa, Mycobacterium tuberculosis
RPTLPAGAP

SEQ ID NO: 1414229 - protein, 4 aa, Mycobacterium tuberculosis
RQAA

SEQ ID NO: 1414230 - protein, 9 aa, Mycobacterium tuberculosis
RQGSRGAAY

SEQ ID NO: 1414231 - protein, 8 aa, Mycobacterium tuberculosis
RQVRKAQR

SEQ ID NO: 1414232 - protein, 14 aa, Mycobacterium tuberculosis
RRAGEVTSAEGKQQ

SEQ ID NO: 1414233 - protein, 11 aa, Mycobacterium tuberculosis
RRDGRPALTGE

SEQ ID NO: 1414234 - protein, 4 aa, Mycobacterium tuberculosis
RREP

SEQ ID NO: 1414235 - protein, 5 aa, Mycobacterium tuberculosis
RRGDR

SEQ ID NO: 1414236 - protein, 5 aa, Mycobacterium tuberculosis
RRGGV

SEQ ID NO: 1414237 - protein, 4 aa, Mycobacterium tuberculosis
RRGH

SEQ ID NO: 1414238 - protein, 16 aa, Mycobacterium tuberculosis
RRHTPGGSSGGSAAAV

SEQ ID NO: 1414239 - protein, 7 aa, Mycobacterium tuberculosis
RRPDELA

SEQ ID NO: 1414240 - protein, 6 aa, Mycobacterium tuberculosis
RRPPAG

SEQ ID NO: 1414241 - protein, 20 aa, Mycobacterium tuberculosis
RRRRGQEAVRPPRQPWRLSA

SEQ ID NO: 1414242 - protein, 14 aa, Mycobacterium tuberculosis
RRSHRAGSCARRNC

SEQ ID NO: 1414243 - protein, 7 aa, Mycobacterium tuberculosis
RRTAEEL

SEQ ID NO: 1414244 - protein, 9 aa, Mycobacterium tuberculosis
RSAGPPPVV

SEQ ID NO: 1414245 - protein, 8 aa, Mycobacterium tuberculosis
RSAGYDDV

SEQ ID NO: 1414246 - protein, 8 aa, Mycobacterium tuberculosis
RSAHSTVD

SEQ ID NO: 1414247 - protein, 6 aa, Mycobacterium tuberculosis
RSATPA

SEQ ID NO: 1414248 - protein, 6 aa, Mycobacterium tuberculosis
RSDTDL

SEQ ID NO: 1414249 - protein, 5 aa, Mycobacterium tuberculosis
RSGAK

SEQ ID NO: 1414250 - protein, 5 aa, Mycobacterium tuberculosis
RSGEE

SEQ ID NO: 1414251 - protein, 5 aa, Mycobacterium tuberculosis
RSGPP

SEQ ID NO: 1414252 - protein, 5 aa, Mycobacterium tuberculosis
RSLNA

SEQ ID NO: 1414253 - protein, 10 aa, Mycobacterium tuberculosis
RSQNRAEEAI

SEQ ID NO: 1414254 - protein, 9 aa, Mycobacterium tuberculosis
RSRAQAAQI

SEQ ID NO: 1414255 - protein, 6 aa, Mycobacterium tuberculosis
RSSNGV

SEQ ID NO: 1414256 - protein, 4 aa, Mycobacterium tuberculosis
RSTG

SEQ ID NO: 1414257 - protein, 4 aa, Mycobacterium tuberculosis
RSVS

SEQ ID NO: 1414258 - protein, 10 aa, Mycobacterium tuberculosis
RTAHQDVPSP

SEQ ID NO: 1414259 - protein, 4 aa, Mycobacterium tuberculosis
RTAL

SEQ ID NO: 1414260 - protein, 4 aa, Mycobacterium tuberculosis
RTES

SEQ ID NO: 1414261 - protein, 9 aa, Mycobacterium tuberculosis
RTGATEDAD

SEQ ID NO: 1414262 - protein, 9 aa, Mycobacterium tuberculosis
RTGSDGNTF

SEQ ID NO: 1414263 - protein, 15 aa, Mycobacterium tuberculosis
RTHGSSSSIGDGAAV

SEQ ID NO: 1414264 - protein, 10 aa, Mycobacterium tuberculosis
RTKPEDAAES

SEQ ID NO: 1414265 - protein, 5 aa, Mycobacterium tuberculosis
RTRPC

SEQ ID NO: 1414266 - protein, 5 aa, Mycobacterium tuberculosis
RTRTQ

SEQ ID NO: 1414267 - protein, 10 aa, Mycobacterium tuberculosis
RVTGLSGQRY

SEQ ID NO: 1414268 - protein, 5 aa, Mycobacterium tuberculosis
RYASK

SEQ ID NO: 1414269 - protein, 15 aa, Mycobacterium tuberculosis
RYNQARRSGGSTGWP

SEQ ID NO: 1414270 - protein, 13 aa, Mycobacterium tuberculosis
RYPSTDDVHRAQD

SEQ ID NO: 1414271 - protein, 8 aa, Mycobacterium tuberculosis
RYRAGSSA

SEQ ID NO: 1414272 - protein, 6 aa, Mycobacterium tuberculosis
RYSARD

SEQ ID NO: 1414273 - protein, 11 aa, Mycobacterium tuberculosis
SAADGPRLHPD

SEQ ID NO: 1414274 - protein, 17 aa, Mycobacterium tuberculosis
SAAGGEPAGLGARDTLR

SEQ ID NO: 1414275 - protein, 10 aa, Mycobacterium tuberculosis
SAASVSWSNP

SEQ ID NO: 1414276 - protein, 10 aa, Mycobacterium tuberculosis
SADGSPYATG

SEQ ID NO: 1414277 - protein, 10 aa, Mycobacterium tuberculosis
SADPSPAAQV

SEQ ID NO: 1414278 - protein, 4 aa, Mycobacterium tuberculosis
SAGD

SEQ ID NO: 1414279 - protein, 8 aa, Mycobacterium tuberculosis
SAGPQRNI

SEQ ID NO: 1414280 - protein, 8 aa, Mycobacterium tuberculosis
SAGTLSTG

SEQ ID NO: 1414281 - protein, 5 aa, Mycobacterium tuberculosis
SAGTT

SEQ ID NO: 1414282 - protein, 4 aa, Mycobacterium tuberculosis
SAGV

SEQ ID NO: 1414283 - protein, 12 aa, Mycobacterium tuberculosis
SAHRKTRPGPAA

SEQ ID NO: 1414284 - protein, 9 aa, Mycobacterium tuberculosis
SALAGSGSG

SEQ ID NO: 1414285 - protein, 14 aa, Mycobacterium tuberculosis
SAPYEGPPPRAEDL

SEQ ID NO: 1414286 - protein, 8 aa, Mycobacterium tuberculosis
SAQRSLRQ

SEQ ID NO: 1414287 - protein, 12 aa, Mycobacterium tuberculosis
SARAAANPTPRI

SEQ ID NO: 1414288 - protein, 12 aa, Mycobacterium tuberculosis
SARESHGGEGRI

SEQ ID NO: 1414289 - protein, 9 aa, Mycobacterium tuberculosis
SARGEGRSL

SEQ ID NO: 1414290 - protein, 5 aa, Mycobacterium tuberculosis
SASEL

SEQ ID NO: 1414291 - protein, 6 aa, Mycobacterium tuberculosis
SAVRDG

SEQ ID NO: 1414292 - protein, 7 aa, Mycobacterium tuberculosis
SDAGVDS

SEQ ID NO: 1414293 - protein, 5 aa, Mycobacterium tuberculosis
SDDTS

SEQ ID NO: 1414294 - protein, 7 aa, Mycobacterium tuberculosis
SDDTVGR

SEQ ID NO: 1414295 - protein, 4 aa, Mycobacterium tuberculosis
SDDV

SEQ ID NO: 1414296 - protein, 4 aa, Mycobacterium tuberculosis
SDHE

SEQ ID NO: 1414297 - protein, 19 aa, Mycobacterium tuberculosis
SDNKQRAKIATGLAKPAGI

SEQ ID NO: 1414298 - protein, 5 aa, Mycobacterium tuberculosis
SDQNL

SEQ ID NO: 1414299 - protein, 7 aa, Mycobacterium tuberculosis
SDRPQGI

SEQ ID NO: 1414300 - protein, 5 aa, Mycobacterium tuberculosis
SDTDL

SEQ ID NO: 1414301 - protein, 24 aa, Mycobacterium tuberculosis
SEAAAAASTPTTALASAGADEVSA

SEQ ID NO: 1414302 - protein, 4 aa, Mycobacterium tuberculosis
SEAL

SEQ ID NO: 1414303 - protein, 7 aa, Mycobacterium tuberculosis
SEGSAGI

SEQ ID NO: 1414304 - protein, 15 aa, Mycobacterium tuberculosis
SEHGGAAAVQATRDL

SEQ ID NO: 1414305 - protein, 9 aa, Mycobacterium tuberculosis
SELRTEAGQ

SEQ ID NO: 1414306 - protein, 4 aa, Mycobacterium tuberculosis
SEPM

SEQ ID NO: 1414307 - protein, 7 aa, Mycobacterium tuberculosis
SEPPLSA

SEQ ID NO: 1414308 - protein, 7 aa, Mycobacterium tuberculosis
SERIGRP

SEQ ID NO: 1414309 - protein, 5 aa, Mycobacterium tuberculosis
SFTEK

SEQ ID NO: 1414310 - protein, 10 aa, Mycobacterium tuberculosis
SFTENADAPI

SEQ ID NO: 1414311 - protein, 7 aa, Mycobacterium tuberculosis
SGAAQSI

SEQ ID NO: 1414312 - protein, 7 aa, Mycobacterium tuberculosis
SGAKAIV

SEQ ID NO: 1414313 - protein, 8 aa, Mycobacterium tuberculosis
SGAPAAAM

SEQ ID NO: 1414314 - protein, 9 aa, Mycobacterium tuberculosis
SGDGTDPRT

SEQ ID NO: 1414315 - protein, 4 aa, Mycobacterium tuberculosis
SGEF

SEQ ID NO: 1414316 - protein, 12 aa, Mycobacterium tuberculosis
SGEKRTSKEYHV

SEQ ID NO: 1414317 - protein, 12 aa, Mycobacterium tuberculosis
SGFSCDSASARE

SEQ ID NO: 1414318 - protein, 9 aa, Mycobacterium tuberculosis
SGGDNLTAT

SEQ ID NO: 1414319 - protein, 9 aa, Mycobacterium tuberculosis
SGLPGPTGR

SEQ ID NO: 1414320 - protein, 18 aa, Mycobacterium tuberculosis
SGNFGNSNIGSASLGNNN

SEQ ID NO: 1414321 - protein, 7 aa, Mycobacterium tuberculosis
SGPAADD

SEQ ID NO: 1414322 - protein, 9 aa, Mycobacterium tuberculosis
SGPGDPGLL

SEQ ID NO: 1414323 - protein, 16 aa, Mycobacterium tuberculosis
SGPTDAEPPDRPIPGP

SEQ ID NO: 1414324 - protein, 18 aa, Mycobacterium tuberculosis
SGRPFEDVESDLALAFSR

SEQ ID NO: 1414325 - protein, 8 aa, Mycobacterium tuberculosis
SGTANTGL

SEQ ID NO: 1414326 - protein, 16 aa, Mycobacterium tuberculosis
SGTGNIGIGNSGTGNW

SEQ ID NO: 1414327 - protein, 5 aa, Mycobacterium tuberculosis
SGTVP

SEQ ID NO: 1414328 - protein, 8 aa, Mycobacterium tuberculosis
SHTSTHGA

SEQ ID NO: 1414329 - protein, 6 aa, Mycobacterium tuberculosis
SITPDE

SEQ ID NO: 1414330 - protein, 11 aa, Mycobacterium tuberculosis
SKGEPLSDHSP

SEQ ID NO: 1414331 - protein, 7 aa, Mycobacterium tuberculosis
SKITERT

SEQ ID NO: 1414332 - protein, 18 aa, Mycobacterium tuberculosis
SKPEPASTGAASAAQLSG

SEQ ID NO: 1414333 - protein, 9 aa, Mycobacterium tuberculosis
SKSSSLAGY

SEQ ID NO: 1414334 - protein, 6 aa, Mycobacterium tuberculosis
SLDAEY

SEQ ID NO: 1414335 - protein, 7 aa, Mycobacterium tuberculosis
SLPPAHR

SEQ ID NO: 1414336 - protein, 18 aa, Mycobacterium tuberculosis
SLSASASWAANGKITSDD

SEQ ID NO: 1414337 - protein, 6 aa, Mycobacterium tuberculosis
SMDAGG

SEQ ID NO: 1414338 - protein, 17 aa, Mycobacterium tuberculosis
SMPTQETAPTRGIPSGL

SEQ ID NO: 1414339 - protein, 6 aa, Mycobacterium tuberculosis
SNPATI

SEQ ID NO: 1414340 - protein, 7 aa, Mycobacterium tuberculosis
SNPVAGH

SEQ ID NO: 1414341 - protein, 9 aa, Mycobacterium tuberculosis
SNSSETQSV

SEQ ID NO: 1414342 - protein, 8 aa, Mycobacterium tuberculosis
SNVQGDRT

SEQ ID NO: 1414343 - protein, 6 aa, Mycobacterium tuberculosis
SPDIES

SEQ ID NO: 1414344 - protein, 6 aa, Mycobacterium tuberculosis
SPEFGS

SEQ ID NO: 1414345 - protein, 6 aa, Mycobacterium tuberculosis
SPETRK

SEQ ID NO: 1414346 - protein, 6 aa, Mycobacterium tuberculosis
SPFSKP

SEQ ID NO: 1414347 - protein, 5 aa, Mycobacterium tuberculosis
SPHDV

SEQ ID NO: 1414348 - protein, 4 aa, Mycobacterium tuberculosis
SPPL

SEQ ID NO: 1414349 - protein, 9 aa, Mycobacterium tuberculosis
SQAGFDPGG

SEQ ID NO: 1414350 - protein, 4 aa, Mycobacterium tuberculosis
SQAH

SEQ ID NO: 1414351 - protein, 6 aa, Mycobacterium tuberculosis
SQHALS

SEQ ID NO: 1414352 - protein, 5 aa, Mycobacterium tuberculosis
SRASI

SEQ ID NO: 1414353 - protein, 14 aa, Mycobacterium tuberculosis
SRCSRAGAEALRQG

SEQ ID NO: 1414354 - protein, 5 aa, Mycobacterium tuberculosis
SREPI

SEQ ID NO: 1414355 - protein, 7 aa, Mycobacterium tuberculosis
SREQVTP

SEQ ID NO: 1414356 - protein, 8 aa, Mycobacterium tuberculosis
SRESIGVT

SEQ ID NO: 1414357 - protein, 6 aa, Mycobacterium tuberculosis
SRKKTL

SEQ ID NO: 1414358 - protein, 6 aa, Mycobacterium tuberculosis
SRLPDQ

SEQ ID NO: 1414359 - protein, 11 aa, Mycobacterium tuberculosis
SRNPSQFTDEV

SEQ ID NO: 1414360 - protein, 10 aa, Mycobacterium tuberculosis
SRPAKTARRP

SEQ ID NO: 1414361 - protein, 8 aa, Mycobacterium tuberculosis
SRQDHGLD

SEQ ID NO: 1414362 - protein, 9 aa, Mycobacterium tuberculosis
SRRREEGLH

SEQ ID NO: 1414363 - protein, 6 aa, Mycobacterium tuberculosis
SRSDTY

SEQ ID NO: 1414364 - protein, 14 aa, Mycobacterium tuberculosis
SRYPNQLSGGQRQR

SEQ ID NO: 1414365 - protein, 7 aa, Mycobacterium tuberculosis
SRYRGDF

SEQ ID NO: 1414366 - protein, 9 aa, Mycobacterium tuberculosis
SSDFKTGPA

SEQ ID NO: 1414367 - protein, 4 aa, Mycobacterium tuberculosis
SSGH

SEQ ID NO: 1414368 - protein, 4 aa, Mycobacterium tuberculosis
SSGP

SEQ ID NO: 1414369 - protein, 68 aa, Mycobacterium tuberculosis
SSLAGRGDEESGEPAAELAEQAGDQPPTDLDDTAQADFEDTEDTDEDEDELDADEDLEDLDDEDLDED

SEQ ID NO: 1414370 - protein, 5 aa, Mycobacterium tuberculosis
SSLER

SEQ ID NO: 1414371 - protein, 6 aa, Mycobacterium tuberculosis
SSLRSE

SEQ ID NO: 1414372 - protein, 11 aa, Mycobacterium tuberculosis
SSMGNSGFQNY

SEQ ID NO: 1414373 - protein, 6 aa, Mycobacterium tuberculosis
SSWGDY

SEQ ID NO: 1414374 - protein, 4 aa, Mycobacterium tuberculosis
STAD

SEQ ID NO: 1414375 - protein, 5 aa, Mycobacterium tuberculosis
STKVQ

SEQ ID NO: 1414376 - protein, 23 aa, Mycobacterium tuberculosis
STPASNPAQPRPTREQNRRSGSC

SEQ ID NO: 1414377 - protein, 13 aa, Mycobacterium tuberculosis
STPEEVARQAADN

SEQ ID NO: 1414378 - protein, 11 aa, Mycobacterium tuberculosis
STQHAAALGDD

SEQ ID NO: 1414379 - protein, 9 aa, Mycobacterium tuberculosis
SVESDTDLY

SEQ ID NO: 1414380 - protein, 5 aa, Mycobacterium tuberculosis
SVGPT

SEQ ID NO: 1414381 - protein, 9 aa, Mycobacterium tuberculosis
SVTDGQTID

SEQ ID NO: 1414382 - protein, 6 aa, Mycobacterium tuberculosis
SYGTLG

SEQ ID NO: 1414383 - protein, 23 aa, Mycobacterium tuberculosis
SYNTGSFNAGDTNTGGFNPGGVN

SEQ ID NO: 1414384 - protein, 8 aa, Mycobacterium tuberculosis
SYPEAEGI

SEQ ID NO: 1414385 - protein, 9 aa, Mycobacterium tuberculosis
TAAAADRSD

SEQ ID NO: 1414386 - protein, 10 aa, Mycobacterium tuberculosis
TAAAEAKRQN

SEQ ID NO: 1414387 - protein, 8 aa, Mycobacterium tuberculosis
TAAAGLGG

SEQ ID NO: 1414388 - protein, 18 aa, Mycobacterium tuberculosis
TAAGAYGSAEAANASPLQ

SEQ ID NO: 1414389 - protein, 12 aa, Mycobacterium tuberculosis
TAAGGASDQGPL

SEQ ID NO: 1414390 - protein, 10 aa, Mycobacterium tuberculosis
TAAGSAEATV

SEQ ID NO: 1414391 - protein, 12 aa, Mycobacterium tuberculosis
TAARLDGSDPVN

SEQ ID NO: 1414392 - protein, 9 aa, Mycobacterium tuberculosis
TADGQTHRA

SEQ ID NO: 1414393 - protein, 10 aa, Mycobacterium tuberculosis
TADQAAQAGH

SEQ ID NO: 1414394 - protein, 13 aa, Mycobacterium tuberculosis
TAEEIAADGTPAH

SEQ ID NO: 1414395 - protein, 5 aa, Mycobacterium tuberculosis
TAERH

SEQ ID NO: 1414396 - protein, 6 aa, Mycobacterium tuberculosis
TAGKPA

SEQ ID NO: 1414397 - protein, 9 aa, Mycobacterium tuberculosis
TAGNEKRRD

SEQ ID NO: 1414398 - protein, 13 aa, Mycobacterium tuberculosis
TAIPPDASYEPKW

SEQ ID NO: 1414399 - protein, 9 aa, Mycobacterium tuberculosis
TAKDGPLEQ

SEQ ID NO: 1414400 - protein, 8 aa, Mycobacterium tuberculosis
TALDPSAP

SEQ ID NO: 1414401 - protein, 5 aa, Mycobacterium tuberculosis
TALPS

SEQ ID NO: 1414402 - protein, 10 aa, Mycobacterium tuberculosis
TAPERAPSME

SEQ ID NO: 1414403 - protein, 5 aa, Mycobacterium tuberculosis
TAQAG

SEQ ID NO: 1414404 - protein, 16 aa, Mycobacterium tuberculosis
TARAEGAAAGAKAAAA

SEQ ID NO: 1414405 - protein, 5 aa, Mycobacterium tuberculosis
TARAT

SEQ ID NO: 1414406 - protein, 15 aa, Mycobacterium tuberculosis
TARQTPGSTPSSSPG

SEQ ID NO: 1414407 - protein, 16 aa, Mycobacterium tuberculosis
TASGDNASGSGRPWDR

SEQ ID NO: 1414408 - protein, 5 aa, Mycobacterium tuberculosis
TASHL

SEQ ID NO: 1414409 - protein, 8 aa, Mycobacterium tuberculosis
TATAASYS

SEQ ID NO: 1414410 - protein, 4 aa, Mycobacterium tuberculosis
TATQ

SEQ ID NO: 1414411 - protein, 8 aa, Mycobacterium tuberculosis
TATTPDLG

SEQ ID NO: 1414412 - protein, 8 aa, Mycobacterium tuberculosis
TATTRDVN

SEQ ID NO: 1414413 - protein, 10 aa, Mycobacterium tuberculosis
TAVAHSGDDA

SEQ ID NO: 1414414 - protein, 7 aa, Mycobacterium tuberculosis
TDAGRRI

SEQ ID NO: 1414415 - protein, 10 aa, Mycobacterium tuberculosis
TDANGAEQEV

SEQ ID NO: 1414416 - protein, 14 aa, Mycobacterium tuberculosis
TDKVDTEIPSPAAG

SEQ ID NO: 1414417 - protein, 12 aa, Mycobacterium tuberculosis
TDPDDWNPPEFD

SEQ ID NO: 1414418 - protein, 9 aa, Mycobacterium tuberculosis
TDPDRGANG

SEQ ID NO: 1414419 - protein, 11 aa, Mycobacterium tuberculosis
TDPNTEGEATA

SEQ ID NO: 1414420 - protein, 6 aa, Mycobacterium tuberculosis
TDPRRA

SEQ ID NO: 1414421 - protein, 5 aa, Mycobacterium tuberculosis
TDQPC

SEQ ID NO: 1414422 - protein, 10 aa, Mycobacterium tuberculosis
TDRRPEFGHD

SEQ ID NO: 1414423 - protein, 11 aa, Mycobacterium tuberculosis
TDSARARTVGR

SEQ ID NO: 1414424 - protein, 5 aa, Mycobacterium tuberculosis
TDTER

SEQ ID NO: 1414425 - protein, 6 aa, Mycobacterium tuberculosis
TDTGQR

SEQ ID NO: 1414426 - protein, 8 aa, Mycobacterium tuberculosis
TDYTPPNK

SEQ ID NO: 1414427 - protein, 11 aa, Mycobacterium tuberculosis
TEAKDYQREDL

SEQ ID NO: 1414428 - protein, 9 aa, Mycobacterium tuberculosis
TERGDAADH

SEQ ID NO: 1414429 - protein, 5 aa, Mycobacterium tuberculosis
TFERQ

SEQ ID NO: 1414430 - protein, 12 aa, Mycobacterium tuberculosis
TFTSDTTREALR

SEQ ID NO: 1414431 - protein, 8 aa, Mycobacterium tuberculosis
TGAAKPGD

SEQ ID NO: 1414432 - protein, 8 aa, Mycobacterium tuberculosis
TGAAQGCV

SEQ ID NO: 1414433 - protein, 6 aa, Mycobacterium tuberculosis
TGAQQL

SEQ ID NO: 1414434 - protein, 6 aa, Mycobacterium tuberculosis
TGDATA

SEQ ID NO: 1414435 - protein, 17 aa, Mycobacterium tuberculosis
TGDNQQGFGGWNSGTGN

SEQ ID NO: 1414436 - protein, 4 aa, Mycobacterium tuberculosis
TGDV

SEQ ID NO: 1414437 - protein, 12 aa, Mycobacterium tuberculosis
TGEPARSVCSAA

SEQ ID NO: 1414438 - protein, 11 aa, Mycobacterium tuberculosis
TGGLPKGDALA

SEQ ID NO: 1414439 - protein, 4 aa, Mycobacterium tuberculosis
TGHP

SEQ ID NO: 1414440 - protein, 6 aa, Mycobacterium tuberculosis
TGIAPG

SEQ ID NO: 1414441 - protein, 8 aa, Mycobacterium tuberculosis
TGKPGKHK

SEQ ID NO: 1414442 - protein, 27 aa, Mycobacterium tuberculosis
TGKRIQAAGGAVRTRVGDRSRAAGRRA

SEQ ID NO: 1414443 - protein, 10 aa, Mycobacterium tuberculosis
TGPGPGTTGE

SEQ ID NO: 1414444 - protein, 7 aa, Mycobacterium tuberculosis
TGQHHGP

SEQ ID NO: 1414445 - protein, 10 aa, Mycobacterium tuberculosis
TGQRSRGPSK

SEQ ID NO: 1414446 - protein, 32 aa, Mycobacterium tuberculosis; identical to SEQ ID NO: 189506

SEQ ID NO: 1414447 - protein, 7 aa, Mycobacterium tuberculosis
TGSEATV

SEQ ID NO: 1414448 - protein, 8 aa, Mycobacterium tuberculosis
TGTRNTGA

SEQ ID NO: 1414449 - protein, 13 aa, Mycobacterium tuberculosis
TGTVTAASEWGGI

SEQ ID NO: 1414450 - protein, 7 aa, Mycobacterium tuberculosis
THGGQLG

SEQ ID NO: 1414451 - protein, 7 aa, Mycobacterium tuberculosis
THGTGTV

SEQ ID NO: 1414452 - protein, 7 aa, Mycobacterium tuberculosis
TKCPDGQ

SEQ ID NO: 1414453 - protein, 17 aa, Mycobacterium tuberculosis
TKKPVGYTSTVNGRRKR

SEQ ID NO: 1414454 - protein, 12 aa, Mycobacterium tuberculosis
TKPGTTTPHTEF

SEQ ID NO: 1414455 - protein, 15 aa, Mycobacterium tuberculosis
TMQDGEGSGVAPTDA

SEQ ID NO: 1414456 - protein, 4 aa, Mycobacterium tuberculosis
TMTE

SEQ ID NO: 1414457 - protein, 4 aa, Mycobacterium tuberculosis
TNDL

SEQ ID NO: 1414458 - protein, 5 aa, Mycobacterium tuberculosis
TNGRI

SEQ ID NO: 1414459 - protein, 8 aa, Mycobacterium tuberculosis
TNHEPRRN

SEQ ID NO: 1414460 - protein, 12 aa, Mycobacterium tuberculosis
TNTGGGPTTNAN

SEQ ID NO: 1414461 - protein, 13 aa, Mycobacterium tuberculosis
TPALGKTGAPNRI

SEQ ID NO: 1414462 - protein, 11 aa, Mycobacterium tuberculosis
TPANITGPGPI

SEQ ID NO: 1414463 - protein, 9 aa, Mycobacterium tuberculosis
TPEEPATQP

SEQ ID NO: 1414464 - protein, 7 aa, Mycobacterium tuberculosis
TPEHTAR

SEQ ID NO: 1414465 - protein, 14 aa, Mycobacterium tuberculosis
TPFSPPAPIANPGA

SEQ ID NO: 1414466 - protein, 5 aa, Mycobacterium tuberculosis
TPHLN

SEQ ID NO: 1414467 - protein, 11 aa, Mycobacterium tuberculosis
TPIAPADLPGR

SEQ ID NO: 1414468 - protein, 5 aa, Mycobacterium tuberculosis
TPPPQ

SEQ ID NO: 1414469 - protein, 5 aa, Mycobacterium tuberculosis
TPPPT

SEQ ID NO: 1414470 - protein, 4 aa, Mycobacterium tuberculosis
TPPY

SEQ ID NO: 1414471 - protein, 8 aa, Mycobacterium tuberculosis
TPTSGMPT

SEQ ID NO: 1414472 - protein, 6 aa, Mycobacterium tuberculosis
TQDGEG

SEQ ID NO: 1414473 - protein, 6 aa, Mycobacterium tuberculosis
TQPRHR

SEQ ID NO: 1414474 - protein, 5 aa, Mycobacterium tuberculosis
TRAAP

SEQ ID NO: 1414475 - protein, 17 aa, Mycobacterium tuberculosis
TRADGSIGLAPTAKEVT

SEQ ID NO: 1414476 - protein, 11 aa, Mycobacterium tuberculosis
TRDEPHADADR

SEQ ID NO: 1414477 - protein, 26 aa, Mycobacterium tuberculosis
TRDTADPKGAKYGRDGNGELDGTAEE

SEQ ID NO: 1414478 - protein, 9 aa, Mycobacterium tuberculosis
TRGEVGQPY

SEQ ID NO: 1414479 - protein, 9 aa, Mycobacterium tuberculosis
TRNDKGKFT

SEQ ID NO: 1414480 - protein, 9 aa, Mycobacterium tuberculosis
TRNPADAED

SEQ ID NO: 1414481 - protein, 5 aa, Mycobacterium tuberculosis
TRQID

SEQ ID NO: 1414482 - protein, 14 aa, Mycobacterium tuberculosis
TRYPPDGVSADSVR

SEQ ID NO: 1414483 - protein, 10 aa, Mycobacterium tuberculosis
TSGATDAKQL

SEQ ID NO: 1414484 - protein, 6 aa, Mycobacterium tuberculosis
TSGNSM

SEQ ID NO: 1414485 - protein, 10 aa, Mycobacterium tuberculosis
TSGSTANPRG

SEQ ID NO: 1414486 - protein, 9 aa, Mycobacterium tuberculosis
TSGVSDATQ

SEQ ID NO: 1414487 - protein, 4 aa, Mycobacterium tuberculosis
TSIE

SEQ ID NO: 1414488 - protein, 6 aa, Mycobacterium tuberculosis
TSMEQG

SEQ ID NO: 1414489 - protein, 16 aa, Mycobacterium tuberculosis
TSRRGIAEEKPEAYKD

SEQ ID NO: 1414490 - protein, 8 aa, Mycobacterium tuberculosis
TSSGTPAM

SEQ ID NO: 1414491 - protein, 14 aa, Mycobacterium tuberculosis
TSSPVAADSRGLGS

SEQ ID NO: 1414492 - protein, 4 aa, Mycobacterium tuberculosis
TSVG

SEQ ID NO: 1414493 - protein, 16 aa, Mycobacterium tuberculosis
TTAAAAFDQPARDTLA

SEQ ID NO: 1414494 - protein, 9 aa, Mycobacterium tuberculosis
TTGPLGQGL

SEQ ID NO: 1414495 - protein, 10 aa, Mycobacterium tuberculosis
TTPAAATPPV

SEQ ID NO: 1414496 - protein, 6 aa, Mycobacterium tuberculosis
TTPANV

SEQ ID NO: 1414497 - protein, 21 aa, Mycobacterium tuberculosis
TTPGARSEQADTIAKWIAKRW

SEQ ID NO: 1414498 - protein, 5 aa, Mycobacterium tuberculosis
TTSLA

SEQ ID NO: 1414499 - protein, 6 aa, Mycobacterium tuberculosis
TTWTDR

SEQ ID NO: 1414500 - protein, 12 aa, Mycobacterium tuberculosis
TVGSPGQGNYSA

SEQ ID NO: 1414501 - protein, 5 aa, Mycobacterium tuberculosis
TVRDG

SEQ ID NO: 1414502 - protein, 7 aa, Mycobacterium tuberculosis
TWTGAGG

SEQ ID NO: 1414503 - protein, 5 aa, Mycobacterium tuberculosis
TYPGT

SEQ ID NO: 1414504 - protein, 8 aa, Mycobacterium tuberculosis
TYSDGRPH

SEQ ID NO: 1414505 - protein, 10 aa, Mycobacterium tuberculosis
VAADDNGRVT

SEQ ID NO: 1414506 - protein, 9 aa, Mycobacterium tuberculosis
VADDTRQRL

SEQ ID NO: 1414507 - protein, 10 aa, Mycobacterium tuberculosis
VANAGSYNTG

SEQ ID NO: 1414508 - protein, 7 aa, Mycobacterium tuberculosis
VANSDGR

SEQ ID NO: 1414509 - protein, 4 aa, Mycobacterium tuberculosis
VAPA

SEQ ID NO: 1414510 - protein, 5 aa, Mycobacterium tuberculosis
VAPRP

SEQ ID NO: 1414511 - protein, 11 aa, Mycobacterium tuberculosis
VAPTDAGGQQF

SEQ ID NO: 1414512 - protein, 36 aa, Mycobacterium tuberculosis; identical to SEQ ID NO: 193448

SEQ ID NO: 1414513 - protein, 19 aa, Mycobacterium tuberculosis
VATDTPESLTNSGKNPEVE

SEQ ID NO: 1414514 - protein, 11 aa, Mycobacterium tuberculosis
VDADEVTAAAR

SEQ ID NO: 1414515 - protein, 8 aa, Mycobacterium tuberculosis
VDASDDGL

SEQ ID NO: 1414516 - protein, 13 aa, Mycobacterium tuberculosis
VDDGSGETDEDQK

SEQ ID NO: 1414517 - protein, 6 aa, Mycobacterium tuberculosis
VDGGDY

SEQ ID NO: 1414518 - protein, 10 aa, Mycobacterium tuberculosis
VDGSDYPNLR

SEQ ID NO: 1414519 - protein, 6 aa, Mycobacterium tuberculosis
VDPNRP

SEQ ID NO: 1414520 - protein, 7 aa, Mycobacterium tuberculosis
VDRDRNA

SEQ ID NO: 1414521 - protein, 5 aa, Mycobacterium tuberculosis
VEAGE

SEQ ID NO: 1414522 - protein, 11 aa, Mycobacterium tuberculosis
VEEGPPPPLPA

SEQ ID NO: 1414523 - protein, 22 aa, Mycobacterium tuberculosis
VEELGRSGVGVAESGASYAARD

SEQ ID NO: 1414524 - protein, 5 aa, Mycobacterium tuberculosis
VEIPN

SEQ ID NO: 1414525 - protein, 8 aa, Mycobacterium tuberculosis
VESAGAEG

SEQ ID NO: 1414526 - protein, 11 aa, Mycobacterium tuberculosis
VGDGVDPNRVG

SEQ ID NO: 1414527 - protein, 14 aa, Mycobacterium tuberculosis
VGDTNTGGFNPGDI

SEQ ID NO: 1414528 - protein, 5 aa, Mycobacterium tuberculosis
VGEKS

SEQ ID NO: 1414529 - protein, 6 aa, Mycobacterium tuberculosis
VGGANN

SEQ ID NO: 1414530 - protein, 15 aa, Mycobacterium tuberculosis
VGGGNVGNANNGLAN

SEQ ID NO: 1414531 - protein, 7 aa, Mycobacterium tuberculosis
VGGPSTW

SEQ ID NO: 1414532 - protein, 19 aa, Mycobacterium tuberculosis
VGLTNANSAEFDPDTPDPV

SEQ ID NO: 1414533 - protein, 7 aa, Mycobacterium tuberculosis
VGNTGNY

SEQ ID NO: 1414534 - protein, 7 aa, Mycobacterium tuberculosis
VGPASLP

SEQ ID NO: 1414535 - protein, 6 aa, Mycobacterium tuberculosis
VGQHEA

SEQ ID NO: 1414536 - protein, 7 aa, Mycobacterium tuberculosis
VGSDHPV

SEQ ID NO: 1414537 - protein, 6 aa, Mycobacterium tuberculosis
VGTGAR

SEQ ID NO: 1414538 - protein, 7 aa, Mycobacterium tuberculosis
VKIPDED

SEQ ID NO: 1414539 - protein, 8 aa, Mycobacterium tuberculosis
VKKPETIN

SEQ ID NO: 1414540 - protein, 24 aa, Mycobacterium tuberculosis
VLPPPTMPSGPGPFGLPIPNPNYH

SEQ ID NO: 1414541 - protein, 4 aa, Mycobacterium tuberculosis
VNAA

SEQ ID NO: 1414542 - protein, 8 aa, Mycobacterium tuberculosis
VNAGSGIN

SEQ ID NO: 1414543 - protein, 7 aa, Mycobacterium tuberculosis
VPANEPV

SEQ ID NO: 1414544 - protein, 8 aa, Mycobacterium tuberculosis
VPDGAGTV

SEQ ID NO: 1414545 - protein, 6 aa, Mycobacterium tuberculosis
VPETLK

SEQ ID NO: 1414546 - protein, 6 aa, Mycobacterium tuberculosis
VPGFTG

SEQ ID NO: 1414547 - protein, 10 aa, Mycobacterium tuberculosis
VPGPNGETWP

SEQ ID NO: 1414548 - protein, 9 aa, Mycobacterium tuberculosis
VPPDTELSP

SEQ ID NO: 1414549 - protein, 6 aa, Mycobacterium tuberculosis
VPQTNS

SEQ ID NO: 1414550 - protein, 6 aa, Mycobacterium tuberculosis
VPSGSV

SEQ ID NO: 1414551 - protein, 7 aa, Mycobacterium tuberculosis
VPVPGRT

SEQ ID NO: 1414552 - protein, 8 aa, Mycobacterium tuberculosis
VQRARAAQ

SEQ ID NO: 1414553 - protein, 6 aa, Mycobacterium tuberculosis
VQRESG

SEQ ID NO: 1414554 - protein, 5 aa, Mycobacterium tuberculosis
VRPHT

SEQ ID NO: 1414555 - protein, 4 aa, Mycobacterium tuberculosis
VRTA

SEQ ID NO: 1414556 - protein, 23 aa, Mycobacterium tuberculosis
VSARHQARRRRRAAAKERGNADE

SEQ ID NO: 1414557 - protein, 5 aa, Mycobacterium tuberculosis
VSGGR

SEQ ID NO: 1414558 - protein, 9 aa, Mycobacterium tuberculosis
VSGSARTAE

SEQ ID NO: 1414559 - protein, 7 aa, Mycobacterium tuberculosis
VSNDIPS

SEQ ID NO: 1414560 - protein, 4 aa, Mycobacterium tuberculosis
VSPD

SEQ ID NO: 1414561 - protein, 9 aa, Mycobacterium tuberculosis
VSPREGRDD

SEQ ID NO: 1414562 - protein, 4 aa, Mycobacterium tuberculosis
VTAP

SEQ ID NO: 1414563 - protein, 8 aa, Mycobacterium tuberculosis
VTEGGSED

SEQ ID NO: 1414564 - protein, 9 aa, Mycobacterium tuberculosis
VTGSGADAD

SEQ ID NO: 1414565 - protein, 19 aa, Mycobacterium tuberculosis
VTGSGRVGIGPSGDEPGFQ

SEQ ID NO: 1414566 - protein, 5 aa, Mycobacterium tuberculosis
VTKGE

SEQ ID NO: 1414567 - protein, 5 aa, Mycobacterium tuberculosis
VTPAT

SEQ ID NO: 1414568 - protein, 7 aa, Mycobacterium tuberculosis
VTTPART

SEQ ID NO: 1414569 - protein, 8 aa, Mycobacterium tuberculosis
VTTSAKEA

SEQ ID NO: 1414570 - protein, 8 aa, Mycobacterium tuberculosis
VTTSTGKE

SEQ ID NO: 1414571 - protein, 21 aa, Mycobacterium tuberculosis
VTYKNGDPTIDNLGAGNRINK

SEQ ID NO: 1414572 - protein, 7 aa, Mycobacterium tuberculosis
VVDPATG

SEQ ID NO: 1414573 - protein, 6 aa, Mycobacterium tuberculosis
VVTDTS

SEQ ID NO: 1414574 - protein, 7 aa, Mycobacterium tuberculosis
WDSSGSV

SEQ ID NO: 1414575 - protein, 7 aa, Mycobacterium tuberculosis
WNSGTAN

SEQ ID NO: 1414576 - protein, 7 aa, Mycobacterium tuberculosis
WNSGTGN

SEQ ID NO: 1414577 - protein, 9 aa, Mycobacterium tuberculosis
WSSAGASDR

SEQ ID NO: 1414578 - protein, 10 aa, Mycobacterium tuberculosis
WSTDPRSRVP

SEQ ID NO: 1414579 - protein, 8 aa, Mycobacterium tuberculosis
WTNPDCRR

SEQ ID NO: 1414580 - protein, 17 aa, Mycobacterium tuberculosis
YEDRNSQHRLKADESYQ

SEQ ID NO: 1414581 - protein, 15 aa, Mycobacterium tuberculosis
YEHPGDPRQPDNTRR

SEQ ID NO: 1414582 - protein, 6 aa, Mycobacterium tuberculosis
YEPRDP

SEQ ID NO: 1414583 - protein, 5 aa, Mycobacterium tuberculosis
YGTAK

SEQ ID NO: 1414584 - protein, 12 aa, Mycobacterium tuberculosis
YNVPASQAAFDD

SEQ ID NO: 1414585 - protein, 4 aa, Mycobacterium tuberculosis
YQQY

SEQ ID NO: 1414586 - protein, 9 aa, Mycobacterium tuberculosis
YQRYESSGE

SEQ ID NO: 1414587 - protein, 5 aa, Mycobacterium tuberculosis
YRDDA

SEQ ID NO: 1414588 - protein, 8 aa, Mycobacterium tuberculosis
YRTATDTC

SEQ ID NO: 1414589 - protein, 9 aa, Mycobacterium tuberculosis
YSGPGSRPL

SEQ ID NO: 1414590 - protein, 4 aa, Mycobacterium tuberculosis
YSGT

SEQ ID NO: 1414591 - protein, 5 aa, Mycobacterium tuberculosis
AAAAD

SEQ ID NO: 1414592 - protein, 10 aa, Mycobacterium tuberculosis
AAAASDVARI

SEQ ID NO: 1414593 - protein, 10 aa, Mycobacterium tuberculosis
AAAEAAGRNV

SEQ ID NO: 1414594 - protein, 6 aa, Mycobacterium tuberculosis
AAAEDE

SEQ ID NO: 1414595 - protein, 7 aa, Mycobacterium tuberculosis
AAAEPPV

SEQ ID NO: 1414596 - protein, 36 aa, Mycobacterium tuberculosis; identical to SEQ ID NO: 166758

SEQ ID NO: 1414597 - protein, 8 aa, Mycobacterium tuberculosis
AAAFGSGA

SEQ ID NO: 1414598 - protein, 16 aa, Mycobacterium tuberculosis
AAAHAGSQAMASAAAY

SEQ ID NO: 1414599 - protein, 10 aa, Mycobacterium tuberculosis
AAAKPADVDA

SEQ ID NO: 1414600 - protein, 10 aa, Mycobacterium tuberculosis
AAALGESRTA

SEQ ID NO: 1414601 - protein, 14 aa, Mycobacterium tuberculosis
AAANAQNNGGLDPA

SEQ ID NO: 1414602 - protein, 8 aa, Mycobacterium tuberculosis
AAAPGGLS

SEQ ID NO: 1414603 - protein, 28 aa, Mycobacterium tuberculosis
AAAQAKAKKAAAMPTEESEAKPAEEGDV

SEQ ID NO: 1414604 - protein, 13 aa, Mycobacterium tuberculosis
AAASAESAAGQAR

SEQ ID NO: 1414605 - protein, 7 aa, Mycobacterium tuberculosis
AAATTAN

SEQ ID NO: 1414606 - protein, 19 aa, Mycobacterium tuberculosis
AADAGSAPLGGSSGPRDRL

SEQ ID NO: 1414607 - protein, 8 aa, Mycobacterium tuberculosis
AADPGFRT

SEQ ID NO: 1414608 - protein, 5 aa, Mycobacterium tuberculosis
AADQA

SEQ ID NO: 1414609 - protein, 7 aa, Mycobacterium tuberculosis
AADQARA

SEQ ID NO: 1414610 - protein, 6 aa, Mycobacterium tuberculosis
AADTGR

SEQ ID NO: 1414611 - protein, 12 aa, Mycobacterium tuberculosis
AAEAANASPLQT

SEQ ID NO: 1414612 - protein, 8 aa, Mycobacterium tuberculosis
AAEDEVST

SEQ ID NO: 1414613 - protein, 22 aa, Mycobacterium tuberculosis
AAEQAEAADTTALPSAAELSNA

SEQ ID NO: 1414614 - protein, 8 aa, Mycobacterium tuberculosis
AAERDSRA

SEQ ID NO: 1414615 - protein, 12 aa, Mycobacterium tuberculosis
AAEVDEKARFPE

SEQ ID NO: 1414616 - protein, 8 aa, Mycobacterium tuberculosis
AAEYTDDA

SEQ ID NO: 1414617 - protein, 11 aa, Mycobacterium tuberculosis
AAGAGSRRDTR

SEQ ID NO: 1414618 - protein, 7 aa, Mycobacterium tuberculosis
AAGERVR

SEQ ID NO: 1414619 - protein, 6 aa, Mycobacterium tuberculosis
AAGGGH

SEQ ID NO: 1414620 - protein, 17 aa, Mycobacterium tuberculosis
AAGGLQSVAKASATKDV

SEQ ID NO: 1414621 - protein, 8 aa, Mycobacterium tuberculosis
AAGGYGLD

SEQ ID NO: 1414622 - protein, 8 aa, Mycobacterium tuberculosis
AAGRASGV

SEQ ID NO: 1414623 - protein, 6 aa, Mycobacterium tuberculosis
AAGVDP

SEQ ID NO: 1414624 - protein, 9 aa, Mycobacterium tuberculosis
AAGVPSETI

SEQ ID NO: 1414625 - protein, 4 aa, Mycobacterium tuberculosis
AAHN

SEQ ID NO: 1414626 - protein, 10 aa, Mycobacterium tuberculosis
AAHPARPARR

SEQ ID NO: 1414627 - protein, 8 aa, Mycobacterium tuberculosis
AAHPGRPD

SEQ ID NO: 1414628 - protein, 4 aa, Mycobacterium tuberculosis
AAID

SEQ ID NO: 1414629 - protein, 8 aa, Mycobacterium tuberculosis
AAKANAKD

SEQ ID NO: 1414630 - protein, 7 aa, Mycobacterium tuberculosis
AAKDLEG

SEQ ID NO: 1414631 - protein, 4 aa, Mycobacterium tuberculosis
AAKN

SEQ ID NO: 1414632 - protein, 4 aa, Mycobacterium tuberculosis
AAKT

SEQ ID NO: 1414633 - protein, 6 aa, Mycobacterium tuberculosis
AALGGG

SEQ ID NO: 1414634 - protein, 16 aa, Mycobacterium tuberculosis
AALGGNERARKRHVSR

SEQ ID NO: 1414635 - protein, 13 aa, Mycobacterium tuberculosis
AAMDNSRDATQIH

SEQ ID NO: 1414636 - protein, 7 aa, Mycobacterium tuberculosis
AANDPER

SEQ ID NO: 1414637 - protein, 6 aa, Mycobacterium tuberculosis
AANGLQ

SEQ ID NO: 1414638 - protein, 18 aa, Mycobacterium tuberculosis
AANPDVADKIRGGKVAAA

SEQ ID NO: 1414639 - protein, 11 aa, Mycobacterium tuberculosis
AANRTDAPRPA

SEQ ID NO: 1414640 - protein, 5 aa, Mycobacterium tuberculosis
AAPDT

SEQ ID NO: 1414641 - protein, 6 aa, Mycobacterium tuberculosis
AAPEAR

SEQ ID NO: 1414642 - protein, 12 aa, Mycobacterium tuberculosis
AAPGNTPSLDEV

SEQ ID NO: 1414643 - protein, 6 aa, Mycobacterium tuberculosis
AAPGTV

SEQ ID NO: 1414644 - protein, 16 aa, Mycobacterium tuberculosis
AAPPPTTNAAGLATQG

SEQ ID NO: 1414645 - protein, 17 aa, Mycobacterium tuberculosis
AAPSLSDRDAAAPSFED

SEQ ID NO: 1414646 - protein, 6 aa, Mycobacterium tuberculosis
AAPSVA

SEQ ID NO: 1414647 - protein, 13 aa, Mycobacterium tuberculosis
AAQARKRGYQPVT

SEQ ID NO: 1414648 - protein, 8 aa, Mycobacterium tuberculosis
AAQATTLG

SEQ ID NO: 1414649 - protein, 4 aa, Mycobacterium tuberculosis
AAQG

SEQ ID NO: 1414650 - protein, 11 aa, Mycobacterium tuberculosis
AAQGSEAAEIA

SEQ ID NO: 1414651 - protein, 8 aa, Mycobacterium tuberculosis
AAQPPAMS

SEQ ID NO: 1414652 - protein, 12 aa, Mycobacterium tuberculosis
AAQRAESKALKA

SEQ ID NO: 1414653 - protein, 10 aa, Mycobacterium tuberculosis
AAQRQRTGEV

SEQ ID NO: 1414654 - protein, 6 aa, Mycobacterium tuberculosis
AAQVTD

SEQ ID NO: 1414655 - protein, 7 aa, Mycobacterium tuberculosis
AARDDAS

SEQ ID NO: 1414656 - protein, 13 aa, Mycobacterium tuberculosis
AARDEAEAVRTQK

SEQ ID NO: 1414657 - protein, 17 aa, Mycobacterium tuberculosis
AARENAKSAREVTSSET

SEQ ID NO: 1414658 - protein, 6 aa, Mycobacterium tuberculosis
AARNRA

SEQ ID NO: 1414659 - protein, 8 aa, Mycobacterium tuberculosis
AARNTEPA

SEQ ID NO: 1414660 - protein, 10 aa, Mycobacterium tuberculosis
AARPPDDPIA

SEQ ID NO: 1414661 - protein, 5 aa, Mycobacterium tuberculosis
AARQL

SEQ ID NO: 1414662 - protein, 6 aa, Mycobacterium tuberculosis
AASEKL

SEQ ID NO: 1414663 - protein, 19 aa, Mycobacterium tuberculosis
AASGKHGMGNNRDGAAGAD

SEQ ID NO: 1414664 - protein, 5 aa, Mycobacterium tuberculosis
AASNT

SEQ ID NO: 1414665 - protein, 17 aa, Mycobacterium tuberculosis
AASPVLSGGQKGPHPIQ

SEQ ID NO: 1414666 - protein, 6 aa, Mycobacterium tuberculosis
AASYIS

SEQ ID NO: 1414667 - protein, 4 aa, Mycobacterium tuberculosis
AATE

SEQ ID NO: 1414668 - protein, 5 aa, Mycobacterium tuberculosis
AATGL

SEQ ID NO: 1414669 - protein, 19 aa, Mycobacterium tuberculosis
AATKSMTAPTVDERPDIKK

SEQ ID NO: 1414670 - protein, 8 aa, Mycobacterium tuberculosis
AATRAEEG

SEQ ID NO: 1414671 - protein, 12 aa, Mycobacterium tuberculosis
AATREQEMTPER

SEQ ID NO: 1414672 - protein, 17 aa, Mycobacterium tuberculosis
AATRPTNDAGQDGGNNS

SEQ ID NO: 1414673 - protein, 7 aa, Mycobacterium tuberculosis
AATSASK

SEQ ID NO: 1414674 - protein, 8 aa, Mycobacterium tuberculosis
AATSVAER

SEQ ID NO: 1414675 - protein, 7 aa, Mycobacterium tuberculosis
AATVRGD

SEQ ID NO: 1414676 - protein, 17 aa, Mycobacterium tuberculosis
AAVDDVPGLARRSEQGQ

SEQ ID NO: 1414677 - protein, 4 aa, Mycobacterium tuberculosis
ACEQ

SEQ ID NO: 1414678 - protein, 5 aa, Mycobacterium tuberculosis
ACGTP

SEQ ID NO: 1414679 - protein, 5 aa, Mycobacterium tuberculosis
ACPAS

SEQ ID NO: 1414680 - protein, 6 aa, Mycobacterium tuberculosis
ADAAAI

SEQ ID NO: 1414681 - protein, 17 aa, Mycobacterium tuberculosis
ADAGAEIARRSRGTPRI

SEQ ID NO: 1414682 - protein, 8 aa, Mycobacterium tuberculosis
ADAIGTST

SEQ ID NO: 1414683 - protein, 11 aa, Mycobacterium tuberculosis
ADAPKSDPADV

SEQ ID NO: 1414684 - protein, 13 aa, Mycobacterium tuberculosis
ADDGLAGVIDKIF

SEQ ID NO: 1414685 - protein, 7 aa, Mycobacterium tuberculosis
ADDGQAY

SEQ ID NO: 1414686 - protein, 8 aa, Mycobacterium tuberculosis
ADDKERAE

SEQ ID NO: 1414687 - protein, 8 aa, Mycobacterium tuberculosis
ADDNDLRN

SEQ ID NO: 1414688 - protein, 5 aa, Mycobacterium tuberculosis
ADDQW

SEQ ID NO: 1414689 - protein, 5 aa, Mycobacterium tuberculosis
ADDSV

SEQ ID NO: 1414690 - protein, 13 aa, Mycobacterium tuberculosis
ADEPCSLDNERPA

SEQ ID NO: 1414691 - protein, 7 aa, Mycobacterium tuberculosis
ADESGHR

SEQ ID NO: 1414692 - protein, 12 aa, Mycobacterium tuberculosis
ADFGRGSGHPAG

SEQ ID NO: 1414693 - protein, 8 aa, Mycobacterium tuberculosis
ADGAARRT

SEQ ID NO: 1414694 - protein, 11 aa, Mycobacterium tuberculosis
ADGELAPETKI

SEQ ID NO: 1414695 - protein, 10 aa, Mycobacterium tuberculosis
ADGGTRTAAI

SEQ ID NO: 1414696 - protein, 5 aa, Mycobacterium tuberculosis
ADHSD

SEQ ID NO: 1414697 - protein, 14 aa, Mycobacterium tuberculosis
ADLDAKAADPAHES

SEQ ID NO: 1414698 - protein, 10 aa, Mycobacterium tuberculosis
ADLVTGRRRP

SEQ ID NO: 1414699 - protein, 15 aa, Mycobacterium tuberculosis
ADNCPNPACGSDTLE

SEQ ID NO: 1414700 - protein, 13 aa, Mycobacterium tuberculosis
ADPAAHPLGTPSG

SEQ ID NO: 1414701 - protein, 5 aa, Mycobacterium tuberculosis
ADPAK

SEQ ID NO: 1414702 - protein, 16 aa, Mycobacterium tuberculosis
ADPEVVAGRRNLANAL

SEQ ID NO: 1414703 - protein, 7 aa, Mycobacterium tuberculosis
ADPGGPV

SEQ ID NO: 1414704 - protein, 8 aa, Mycobacterium tuberculosis
ADPLGGAS

SEQ ID NO: 1414705 - protein, 4 aa, Mycobacterium tuberculosis
ADPY

SEQ ID NO: 1414706 - protein, 4 aa, Mycobacterium tuberculosis
ADQH

SEQ ID NO: 1414707 - protein, 7 aa, Mycobacterium tuberculosis
ADQVDQG

SEQ ID NO: 1414708 - protein, 10 aa, Mycobacterium tuberculosis
ADRDAADALR

SEQ ID NO: 1414709 - protein, 5 aa, Mycobacterium tuberculosis
ADRDG

SEQ ID NO: 1414710 - protein, 7 aa, Mycobacterium tuberculosis
ADRDGVD

SEQ ID NO: 1414711 - protein, 6 aa, Mycobacterium tuberculosis
ADTDGS

SEQ ID NO: 1414712 - protein, 11 aa, Mycobacterium tuberculosis
ADTERQRAQGT

SEQ ID NO: 1414713 - protein, 18 aa, Mycobacterium tuberculosis
ADTGEPDDWDAPVPGTGA

SEQ ID NO: 1414714 - protein, 8 aa, Mycobacterium tuberculosis
ADTGIFPS

SEQ ID NO: 1414715 - protein, 6 aa, Mycobacterium tuberculosis
ADTGLE

SEQ ID NO: 1414716 - protein, 4 aa, Mycobacterium tuberculosis
ADTH

SEQ ID NO: 1414717 - protein, 7 aa, Mycobacterium tuberculosis
ADVDGIG

SEQ ID NO: 1414718 - protein, 4 aa, Mycobacterium tuberculosis
AEAE

SEQ ID NO: 1414719 - protein, 4 aa, Mycobacterium tuberculosis
AEAK

SEQ ID NO: 1414720 - protein, 6 aa, Mycobacterium tuberculosis
AEARGA

SEQ ID NO: 1414721 - protein, 17 aa, Mycobacterium tuberculosis
AEATKQHFAQTKDADVG

SEQ ID NO: 1414722 - protein, 5 aa, Mycobacterium tuberculosis
AEAWR

SEQ ID NO: 1414723 - protein, 6 aa, Mycobacterium tuberculosis
AEDPAR

SEQ ID NO: 1414724 - protein, 9 aa, Mycobacterium tuberculosis
AEELAKTDQ

SEQ ID NO: 1414725 - protein, 12 aa, Mycobacterium tuberculosis
AEETLPQPVRDA

SEQ ID NO: 1414726 - protein, 19 aa, Mycobacterium tuberculosis
AEFASRQQDFSPPPPRYTT

SEQ ID NO: 1414727 - protein, 6 aa, Mycobacterium tuberculosis
AEGEDF

SEQ ID NO: 1414728 - protein, 5 aa, Mycobacterium tuberculosis
AEGQS

SEQ ID NO: 1414729 - protein, 5 aa, Mycobacterium tuberculosis
AEGRA

SEQ ID NO: 1414730 - protein, 5 aa, Mycobacterium tuberculosis
AEGTV

SEQ ID NO: 1414731 - protein, 10 aa, Mycobacterium tuberculosis
AEHHSDSTES

SEQ ID NO: 1414732 - protein, 11 aa, Mycobacterium tuberculosis
AELSGTRPHHP

SEQ ID NO: 1414733 - protein, 11 aa, Mycobacterium tuberculosis
AENPADTDREN

SEQ ID NO: 1414734 - protein, 13 aa, Mycobacterium tuberculosis
AEPAHPATPYPEP

SEQ ID NO: 1414735 - protein, 5 aa, Mycobacterium tuberculosis
AEPDE

SEQ ID NO: 1414736 - protein, 8 aa, Mycobacterium tuberculosis
AEPGKSLE

SEQ ID NO: 1414737 - protein, 13 aa, Mycobacterium tuberculosis
AEPLSGSQGEGGL

SEQ ID NO: 1414738 - protein, 8 aa, Mycobacterium tuberculosis
AEQSGHTQ

SEQ ID NO: 1414739 - protein, 6 aa, Mycobacterium tuberculosis
AEQSVE

SEQ ID NO: 1414740 - protein, 8 aa, Mycobacterium tuberculosis
AERLTEES

SEQ ID NO: 1414741 - protein, 4 aa, Mycobacterium tuberculosis
AERT

SEQ ID NO: 1414742 - protein, 9 aa, Mycobacterium tuberculosis
AESGPDERR

SEQ ID NO: 1414743 - protein, 8 aa, Mycobacterium tuberculosis
AESPSGED

SEQ ID NO: 1414744 - protein, 9 aa, Mycobacterium tuberculosis
AEYASAAQE

SEQ ID NO: 1414745 - protein, 11 aa, Mycobacterium tuberculosis
AFDSTDWSRNT

SEQ ID NO: 1414746 - protein, 12 aa, Mycobacterium tuberculosis
AFGGDGGATTSV

SEQ ID NO: 1414747 - protein, 4 aa, Mycobacterium tuberculosis
AFGI

SEQ ID NO: 1414748 - protein, 5 aa, Mycobacterium tuberculosis
AFGPS

SEQ ID NO: 1414749 - protein, 12 aa, Mycobacterium tuberculosis
AGAADNGPAEQQ

SEQ ID NO: 1414750 - protein, 5 aa, Mycobacterium tuberculosis
AGADA

SEQ ID NO: 1414751 - protein, 7 aa, Mycobacterium tuberculosis
AGAGERA

SEQ ID NO: 1414752 - protein, 7 aa, Mycobacterium tuberculosis
AGAIGRR

SEQ ID NO: 1414753 - protein, 5 aa, Mycobacterium tuberculosis
AGAPL

SEQ ID NO: 1414754 - protein, 10 aa, Mycobacterium tuberculosis
AGAPPGDDRV

SEQ ID NO: 1414755 - protein, 11 aa, Mycobacterium tuberculosis
AGARAPKGTRF

SEQ ID NO: 1414756 - protein, 12 aa, Mycobacterium tuberculosis
AGASQAAAQLPL

SEQ ID NO: 1414757 - protein, 8 aa, Mycobacterium tuberculosis
AGDEVSAA

SEQ ID NO: 1414758 - protein, 7 aa, Mycobacterium tuberculosis
AGDGKGM

SEQ ID NO: 1414759 - protein, 7 aa, Mycobacterium tuberculosis
AGDGNVR

SEQ ID NO: 1414760 - protein, 4 aa, Mycobacterium tuberculosis
AGDR

SEQ ID NO: 1414761 - protein, 7 aa, Mycobacterium tuberculosis
AGDSAVD

SEQ ID NO: 1414762 - protein, 8 aa, Mycobacterium tuberculosis
AGDTITGA

SEQ ID NO: 1414763 - protein, 12 aa, Mycobacterium tuberculosis
AGEFDARRRDQQ

SEQ ID NO: 1414764 - protein, 12 aa, Mycobacterium tuberculosis
AGESKGEHGAKS

SEQ ID NO: 1414765 - protein, 7 aa, Mycobacterium tuberculosis
AGGAGRV

SEQ ID NO: 1414766 - protein, 14 aa, Mycobacterium tuberculosis
AGGAPMYQRPGDRR

SEQ ID NO: 1414767 - protein, 4 aa, Mycobacterium tuberculosis
AGGD

SEQ ID NO: 1414768 - protein, 5 aa, Mycobacterium tuberculosis
AGGDA

SEQ ID NO: 1414769 - protein, 8 aa, Mycobacterium tuberculosis
AGGDSTVH

SEQ ID NO: 1414770 - protein, 11 aa, Mycobacterium tuberculosis
AGGEKGKPRYD

SEQ ID NO: 1414771 - protein, 9 aa, Mycobacterium tuberculosis
AGGGGRGMR

SEQ ID NO: 1414772 - protein, 7 aa, Mycobacterium tuberculosis
AGGGLGR

SEQ ID NO: 1414773 - protein, 7 aa, Mycobacterium tuberculosis
AGGGTRI

SEQ ID NO: 1414774 - protein, 8 aa, Mycobacterium tuberculosis
AGGRVTTM

SEQ ID NO: 1414775 - protein, 4 aa, Mycobacterium tuberculosis
AGGS

SEQ ID NO: 1414776 - protein, 4 aa, Mycobacterium tuberculosis
AGGY

SEQ ID NO: 1414777 - protein, 6 aa, Mycobacterium tuberculosis
AGIANR

SEQ ID NO: 1414778 - protein, 11 aa, Mycobacterium tuberculosis
AGKAGLPADEL

SEQ ID NO: 1414779 - protein, 11 aa, Mycobacterium tuberculosis
AGKGNKEPRNV

SEQ ID NO: 1414780 - protein, 4 aa, Mycobacterium tuberculosis
AGLN

SEQ ID NO: 1414781 - protein, 15 aa, Mycobacterium tuberculosis
AGLPPTATPPLLRDA

SEQ ID NO: 1414782 - protein, 15 aa, Mycobacterium tuberculosis
AGMTTGMPTPEGKPQ

SEQ ID NO: 1414783 - protein, 9 aa, Mycobacterium tuberculosis
AGNAVRPEQ

SEQ ID NO: 1414784 - protein, 18 aa, Mycobacterium tuberculosis
AGNINSSFGNSGDGNSGF

SEQ ID NO: 1414785 - protein, 8 aa, Mycobacterium tuberculosis
AGNLRAGD

SEQ ID NO: 1414786 - protein, 5 aa, Mycobacterium tuberculosis
AGNPR

SEQ ID NO: 1414787 - protein, 6 aa, Mycobacterium tuberculosis
AGPGDY

SEQ ID NO: 1414788 - protein, 9 aa, Mycobacterium tuberculosis
AGPITDDPY

SEQ ID NO: 1414789 - protein, 5 aa, Mycobacterium tuberculosis
AGPLA

SEQ ID NO: 1414790 - protein, 5 aa, Mycobacterium tuberculosis
AGPNV

SEQ ID NO: 1414791 - protein, 5 aa, Mycobacterium tuberculosis
AGPSA

SEQ ID NO: 1414792 - protein, 4 aa, Mycobacterium tuberculosis
AGPV

SEQ ID NO: 1414793 - protein, 8 aa, Mycobacterium tuberculosis
AGQTHRSA

SEQ ID NO: 1414794 - protein, 7 aa, Mycobacterium tuberculosis
AGRFEQA

SEQ ID NO: 1414795 - protein, 6 aa, Mycobacterium tuberculosis
AGRGGL

SEQ ID NO: 1414796 - protein, 12 aa, Mycobacterium tuberculosis
AGRSRPGARVQH

SEQ ID NO: 1414797 - protein, 5 aa, Mycobacterium tuberculosis
AGRTL

SEQ ID NO: 1414798 - protein, 6 aa, Mycobacterium tuberculosis
AGSASG

SEQ ID NO: 1414799 - protein, 7 aa, Mycobacterium tuberculosis
AGSEPIA

SEQ ID NO: 1414800 - protein, 17 aa, Mycobacterium tuberculosis
AGSGNISLPAAKTGATV

SEQ ID NO: 1414801 - protein, 9 aa, Mycobacterium tuberculosis
AGSSATASR

SEQ ID NO: 1414802 - protein, 19 aa, Mycobacterium tuberculosis
AGTAEGASNTGARLADAAG

SEQ ID NO: 1414803 - protein, 5 aa, Mycobacterium tuberculosis
AGTGG

SEQ ID NO: 1414804 - protein, 5 aa, Mycobacterium tuberculosis
AGTNE

SEQ ID NO: 1414805 - protein, 9 aa, Mycobacterium tuberculosis
AGTNPAYGP

SEQ ID NO: 1414806 - protein, 15 aa, Mycobacterium tuberculosis
AGTTRGRLDEQERAA

SEQ ID NO: 1414807 - protein, 5 aa, Mycobacterium tuberculosis
AGTTT

SEQ ID NO: 1414808 - protein, 13 aa, Mycobacterium tuberculosis
AGVPARGLNGEAY

SEQ ID NO: 1414809 - protein, 4 aa, Mycobacterium tuberculosis
AGWN

SEQ ID NO: 1414810 - protein, 6 aa, Mycobacterium tuberculosis
AGWPNY

SEQ ID NO: 1414811 - protein, 8 aa, Mycobacterium tuberculosis
AHASTAEF

SEQ ID NO: 1414812 - protein, 8 aa, Mycobacterium tuberculosis
AHEEGGER

SEQ ID NO: 1414813 - protein, 6 aa, Mycobacterium tuberculosis
AHKDEA

SEQ ID NO: 1414814 - protein, 6 aa, Mycobacterium tuberculosis
AHPAPA

SEQ ID NO: 1414815 - protein, 6 aa, Mycobacterium tuberculosis
AHPQGR

SEQ ID NO: 1414816 - protein, 10 aa, Mycobacterium tuberculosis
AHPSTQDRSL

SEQ ID NO: 1414817 - protein, 5 aa, Mycobacterium tuberculosis
AHQHS

SEQ ID NO: 1414818 - protein, 7 aa, Mycobacterium tuberculosis
AHRAGAA

SEQ ID NO: 1414819 - protein, 7 aa, Mycobacterium tuberculosis
AIAQNAA

SEQ ID NO: 1414820 - protein, 5 aa, Mycobacterium tuberculosis
AIGSS

SEQ ID NO: 1414821 - protein, 6 aa, Mycobacterium tuberculosis
AISGDK

SEQ ID NO: 1414822 - protein, 6 aa, Mycobacterium tuberculosis
AKAAVE

SEQ ID NO: 1414823 - protein, 7 aa, Mycobacterium tuberculosis
AKAQRHG

SEQ ID NO: 1414824 - protein, 7 aa, Mycobacterium tuberculosis
AKDGTLH

SEQ ID NO: 1414825 - protein, 9 aa, Mycobacterium tuberculosis
AKDPESVQW

SEQ ID NO: 1414826 - protein, 8 aa, Mycobacterium tuberculosis
AKDTRGEF

SEQ ID NO: 1414827 - protein, 10 aa, Mycobacterium tuberculosis
AKEGTDDQRA

SEQ ID NO: 1414828 - protein, 13 aa, Mycobacterium tuberculosis
AKEHGSSAGPPVS

SEQ ID NO: 1414829 - protein, 10 aa, Mycobacterium tuberculosis
AKHKGEEAKV

SEQ ID NO: 1414830 - protein, 14 aa, Mycobacterium tuberculosis
AKLAERQGEKSYAQ

SEQ ID NO: 1414831 - protein, 10 aa, Mycobacterium tuberculosis
AKPVGADTGL

SEQ ID NO: 1414832 - protein, 5 aa, Mycobacterium tuberculosis
AKQDV

SEQ ID NO: 1414833 - protein, 8 aa, Mycobacterium tuberculosis
AKRAVDAG

SEQ ID NO: 1414834 - protein, 18 aa, Mycobacterium tuberculosis
AKRKQAAENGSLPDTKAN

SEQ ID NO: 1414835 - protein, 8 aa, Mycobacterium tuberculosis
AKSGKTTI

SEQ ID NO: 1414836 - protein, 6 aa, Mycobacterium tuberculosis
AKTGNL

SEQ ID NO: 1414837 - protein, 16 aa, Mycobacterium tuberculosis
AKVGEAPKQSGVALPG

SEQ ID NO: 1414838 - protein, 11 aa, Mycobacterium tuberculosis
ALASPGDEREL

SEQ ID NO: 1414839 - protein, 7 aa, Mycobacterium tuberculosis
ALDGGAD

SEQ ID NO: 1414840 - protein, 12 aa, Mycobacterium tuberculosis
ALHSNPAEARRV

SEQ ID NO: 1414841 - protein, 17 aa, Mycobacterium tuberculosis
ALKTGKAQSEVKQTGRP

SEQ ID NO: 1414842 - protein, 5 aa, Mycobacterium tuberculosis
ALNGH

SEQ ID NO: 1414843 - protein, 5 aa, Mycobacterium tuberculosis
ALPDR

SEQ ID NO: 1414844 - protein, 6 aa, Mycobacterium tuberculosis
ALPNKP

SEQ ID NO: 1414845 - protein, 7 aa, Mycobacterium tuberculosis
ALPPKTS

SEQ ID NO: 1414846 - protein, 10 aa, Mycobacterium tuberculosis
ALRNSAGREV

SEQ ID NO: 1414847 - protein, 7 aa, Mycobacterium tuberculosis
ALSEARS

SEQ ID NO: 1414848 - protein, 5 aa, Mycobacterium tuberculosis
ALTEA

SEQ ID NO: 1414849 - protein, 6 aa, Mycobacterium tuberculosis
ALTPGR

SEQ ID NO: 1414850 - protein, 9 aa, Mycobacterium tuberculosis
ALTTSTDGW

SEQ ID NO: 1414851 - protein, 7 aa, Mycobacterium tuberculosis
AMSAPNL

SEQ ID NO: 1414852 - protein, 4 aa, Mycobacterium tuberculosis
AMTR

SEQ ID NO: 1414853 - protein, 12 aa, Mycobacterium tuberculosis
ANGFGKNETHAR

SEQ ID NO: 1414854 - protein, 19 aa, Mycobacterium tuberculosis
ANIGSTLGAANAAALGPTT

SEQ ID NO: 1414855 - protein, 7 aa, Mycobacterium tuberculosis
ANKREPK

SEQ ID NO: 1414856 - protein, 9 aa, Mycobacterium tuberculosis
ANLGEAAGT

SEQ ID NO: 1414857 - protein, 6 aa, Mycobacterium tuberculosis
ANPDPA

SEQ ID NO: 1414858 - protein, 9 aa, Mycobacterium tuberculosis
ANPGSVEAK

SEQ ID NO: 1414859 - protein, 6 aa, Mycobacterium tuberculosis
ANPIGA

SEQ ID NO: 1414860 - protein, 18 aa, Mycobacterium tuberculosis
ANRGPAAISSGSNSGRVL

SEQ ID NO: 1414861 - protein, 8 aa, Mycobacterium tuberculosis
ANRLGAGE

SEQ ID NO: 1414862 - protein, 4 aa, Mycobacterium tuberculosis
ANSG

SEQ ID NO: 1414863 - protein, 8 aa, Mycobacterium tuberculosis
ANTGSGNI

SEQ ID NO: 1414864 - protein, 7 aa, Mycobacterium tuberculosis
ANTITDR

SEQ ID NO: 1414865 - protein, 7 aa, Mycobacterium tuberculosis
ANTLSSY

SEQ ID NO: 1414866 - protein, 14 aa, Mycobacterium tuberculosis
APAAAQAVETAAEN

SEQ ID NO: 1414867 - protein, 6 aa, Mycobacterium tuberculosis
APADAR

SEQ ID NO: 1414868 - protein, 9 aa, Mycobacterium tuberculosis
APADTGTTV

SEQ ID NO: 1414869 - protein, 9 aa, Mycobacterium tuberculosis
APALSEKDI

SEQ ID NO: 1414870 - protein, 6 aa, Mycobacterium tuberculosis
APDADG

SEQ ID NO: 1414871 - protein, 14 aa, Mycobacterium tuberculosis
APDGTHHQNDAAAA

SEQ ID NO: 1414872 - protein, 7 aa, Mycobacterium tuberculosis
APDRNRI

SEQ ID NO: 1414873 - protein, 5 aa, Mycobacterium tuberculosis
APEHP

SEQ ID NO: 1414874 - protein, 8 aa, Mycobacterium tuberculosis
APEMTSAG

SEQ ID NO: 1414875 - protein, 6 aa, Mycobacterium tuberculosis
APEVTN

SEQ ID NO: 1414876 - protein, 9 aa, Mycobacterium tuberculosis
APGGVETAD

SEQ ID NO: 1414877 - protein, 6 aa, Mycobacterium tuberculosis
APGHSA

SEQ ID NO: 1414878 - protein, 7 aa, Mycobacterium tuberculosis
APGPGER

SEQ ID NO: 1414879 - protein, 13 aa, Mycobacterium tuberculosis
APGSRPIDLFGAP

SEQ ID NO: 1414880 - protein, 17 aa, Mycobacterium tuberculosis
APKPEWEDRIESDTGSV

SEQ ID NO: 1414881 - protein, 4 aa, Mycobacterium tuberculosis
APLT

SEQ ID NO: 1414882 - protein, 15 aa, Mycobacterium tuberculosis
APLVPGTPDPVKGAD

SEQ ID NO: 1414883 - protein, 4 aa, Mycobacterium tuberculosis
APND

SEQ ID NO: 1414884 - protein, 47 aa, Mycobacterium tuberculosis
APPATDEADDTTVPPSENPATTSPDTTTDNDEIDDSAAARGDNQHSW

SEQ ID NO: 1414885 - protein, 4 aa, Mycobacterium tuberculosis
APPG

SEQ ID NO: 1414886 - protein, 8 aa, Mycobacterium tuberculosis
APPNLVSG

SEQ ID NO: 1414887 - protein, 6 aa, Mycobacterium tuberculosis
APPPDV

SEQ ID NO: 1414888 - protein, 4 aa, Mycobacterium tuberculosis
APPS

SEQ ID NO: 1414889 - protein, 10 aa, Mycobacterium tuberculosis
APPVKRQEQY

SEQ ID NO: 1414890 - protein, 16 aa, Mycobacterium tuberculosis
APQTGDPDAESPVRGG

SEQ ID NO: 1414891 - protein, 5 aa, Mycobacterium tuberculosis
APRVR

SEQ ID NO: 1414892 - protein, 6 aa, Mycobacterium tuberculosis
APSKEL

SEQ ID NO: 1414893 - protein, 6 aa, Mycobacterium tuberculosis
APTLRE

SEQ ID NO: 1414894 - protein, 12 aa, Mycobacterium tuberculosis
APTTGDLDAQTD

SEQ ID NO: 1414895 - protein, 4 aa, Mycobacterium tuberculosis
APVK

SEQ ID NO: 1414896 - protein, 7 aa, Mycobacterium tuberculosis
APVPTGA

SEQ ID NO: 1414897 - protein, 17 aa, Mycobacterium tuberculosis
AQAAASAYNDAAGEQLT

SEQ ID NO: 1414898 - protein, 7 aa, Mycobacterium tuberculosis
AQAEHPG

SEQ ID NO: 1414899 - protein, 7 aa, Mycobacterium tuberculosis
AQAERAA

SEQ ID NO: 1414900 - protein, 6 aa, Mycobacterium tuberculosis
AQASEA

SEQ ID NO: 1414901 - protein, 14 aa, Mycobacterium tuberculosis
AQAVGANDEDFEGY

SEQ ID NO: 1414902 - protein, 8 aa, Mycobacterium tuberculosis
AQAVTDRP

SEQ ID NO: 1414903 - protein, 9 aa, Mycobacterium tuberculosis
AQDRPPRGK

SEQ ID NO: 1414904 - protein, 8 aa, Mycobacterium tuberculosis
AQGCSPDQ

SEQ ID NO: 1414905 - protein, 5 aa, Mycobacterium tuberculosis
AQNAS

SEQ ID NO: 1414906 - protein, 8 aa, Mycobacterium tuberculosis
AQPPQNHA

SEQ ID NO: 1414907 - protein, 10 aa, Mycobacterium tuberculosis
AQPRAGASTA

SEQ ID NO: 1414908 - protein, 6 aa, Mycobacterium tuberculosis
AQPRPL

SEQ ID NO: 1414909 - protein, 10 aa, Mycobacterium tuberculosis
AQPSNPTAVR

SEQ ID NO: 1414910 - protein, 4 aa, Mycobacterium tuberculosis
AQRG

SEQ ID NO: 1414911 - protein, 10 aa, Mycobacterium tuberculosis
AQRQLDGDAV

SEQ ID NO: 1414912 - protein, 4 aa, Mycobacterium tuberculosis
AQTP

SEQ ID NO: 1414913 - protein, 4 aa, Mycobacterium tuberculosis
AQTR

SEQ ID NO: 1414914 - protein, 7 aa, Mycobacterium tuberculosis
AQVDSES

SEQ ID NO: 1414915 - protein, 5 aa, Mycobacterium tuberculosis
AQWNE

SEQ ID NO: 1414916 - protein, 5 aa, Mycobacterium tuberculosis
AQYAK

SEQ ID NO: 1414917 - protein, 5 aa, Mycobacterium tuberculosis
AQYDE

SEQ ID NO: 1414918 - protein, 5 aa, Mycobacterium tuberculosis
AQYSQ

SEQ ID NO: 1414919 - protein, 13 aa, Mycobacterium tuberculosis
ARAAADLGSSEDL

SEQ ID NO: 1414920 - protein, 8 aa, Mycobacterium tuberculosis
ARAAAESR

SEQ ID NO: 1414921 - protein, 15 aa, Mycobacterium tuberculosis
ARAAATNAAAGAQRI

SEQ ID NO: 1414922 - protein, 5 aa, Mycobacterium tuberculosis
ARAAW

SEQ ID NO: 1414923 - protein, 6 aa, Mycobacterium tuberculosis
ARAEGG

SEQ ID NO: 1414924 - protein, 20 aa, Mycobacterium tuberculosis
ARAGGPELQRESTEKAPIGL

SEQ ID NO: 1414925 - protein, 7 aa, Mycobacterium tuberculosis
ARANAEQ

SEQ ID NO: 1414926 - protein, 39 aa, Mycobacterium tuberculosis
ARATDEQRRIRERANAERKAAALRAQAAKLGAKATKAVA

SEQ ID NO: 1414927 - protein, 4 aa, Mycobacterium tuberculosis
ARDL

SEQ ID NO: 1414928 - protein, 7 aa, Mycobacterium tuberculosis
ARDMGGP

SEQ ID NO: 1414929 - protein, 7 aa, Mycobacterium tuberculosis
ARDQHPD

SEQ ID NO: 1414930 - protein, 5 aa, Mycobacterium tuberculosis
ARGLT

SEQ ID NO: 1414931 - protein, 6 aa, Mycobacterium tuberculosis
ARGPGN

SEQ ID NO: 1414932 - protein, 5 aa, Mycobacterium tuberculosis
ARGRP

SEQ ID NO: 1414933 - protein, 22 aa, Mycobacterium tuberculosis
ARGRVPNASVARAQSVPSVGET

SEQ ID NO: 1414934 - protein, 11 aa, Mycobacterium tuberculosis
ARGYKDVRANT

SEQ ID NO: 1414935 - protein, 11 aa, Mycobacterium tuberculosis
ARLSRDEKAVT

SEQ ID NO: 1414936 - protein, 5 aa, Mycobacterium tuberculosis
ARPGH

SEQ ID NO: 1414937 - protein, 12 aa, Mycobacterium tuberculosis
ARPGTPLHDPGK

SEQ ID NO: 1414938 - protein, 13 aa, Mycobacterium tuberculosis
ARPHRVTHRKLTR

SEQ ID NO: 1414939 - protein, 9 aa, Mycobacterium tuberculosis
ARQAVDDGY

SEQ ID NO: 1414940 - protein, 8 aa, Mycobacterium tuberculosis
ARQGYQAE

SEQ ID NO: 1414941 - protein, 8 aa, Mycobacterium tuberculosis
ARRAAHRA

SEQ ID NO: 1414942 - protein, 9 aa, Mycobacterium tuberculosis
ARRDPPLDA

SEQ ID NO: 1414943 - protein, 8 aa, Mycobacterium tuberculosis
ARRENPYH

SEQ ID NO: 1414944 - protein, 9 aa, Mycobacterium tuberculosis
ARSGRDRSA

SEQ ID NO: 1414945 - protein, 13 aa, Mycobacterium tuberculosis
ARSREDHRTLGTY

SEQ ID NO: 1414946 - protein, 7 aa, Mycobacterium tuberculosis
ARTAATV

SEQ ID NO: 1414947 - protein, 5 aa, Mycobacterium tuberculosis
ARTDA

SEQ ID NO: 1414948 - protein, 14 aa, Mycobacterium tuberculosis
ARTKETDLSVPTRR

SEQ ID NO: 1414949 - protein, 6 aa, Mycobacterium tuberculosis
ARTPPV

SEQ ID NO: 1414950 - protein, 6 aa, Mycobacterium tuberculosis
ARTSQF

SEQ ID NO: 1414951 - protein, 5 aa, Mycobacterium tuberculosis
ARVDK

SEQ ID NO: 1414952 - protein, 7 aa, Mycobacterium tuberculosis
ARVEGAT

SEQ ID NO: 1414953 - protein, 6 aa, Mycobacterium tuberculosis
ARYRDE

SEQ ID NO: 1414954 - protein, 8 aa, Mycobacterium tuberculosis
ASAAQRAE

SEQ ID NO: 1414955 - protein, 8 aa, Mycobacterium tuberculosis
ASAARMAK

SEQ ID NO: 1414956 - protein, 7 aa, Mycobacterium tuberculosis
ASAGADA

SEQ ID NO: 1414957 - protein, 6 aa, Mycobacterium tuberculosis
ASAGIG

SEQ ID NO: 1414958 - protein, 8 aa, Mycobacterium tuberculosis
ASAGLGQA

SEQ ID NO: 1414959 - protein, 5 aa, Mycobacterium tuberculosis
ASDPV

SEQ ID NO: 1414960 - protein, 13 aa, Mycobacterium tuberculosis
ASDPWQPQYGSGQ

SEQ ID NO: 1414961 - protein, 11 aa, Mycobacterium tuberculosis
ASEGVKEDDIR

SEQ ID NO: 1414962 - protein, 5 aa, Mycobacterium tuberculosis
ASELR

SEQ ID NO: 1414963 - protein, 5 aa, Mycobacterium tuberculosis
ASERN

SEQ ID NO: 1414964 - protein, 6 aa, Mycobacterium tuberculosis
ASFNSV

SEQ ID NO: 1414965 - protein, 5 aa, Mycobacterium tuberculosis
ASGAA

SEQ ID NO: 1414966 - protein, 4 aa, Mycobacterium tuberculosis
ASGF

SEQ ID NO: 1414967 - protein, 5 aa, Mycobacterium tuberculosis
ASGGV

SEQ ID NO: 1414968 - protein, 10 aa, Mycobacterium tuberculosis
ASGTGDARKI

SEQ ID NO: 1414969 - protein, 10 aa, Mycobacterium tuberculosis
ASHPRDGRLG

SEQ ID NO: 1414970 - protein, 4 aa, Mycobacterium tuberculosis
ASIG

SEQ ID NO: 1414971 - protein, 5 aa, Mycobacterium tuberculosis
ASKLT

SEQ ID NO: 1414972 - protein, 53 aa, Mycobacterium tuberculosis
ASLGGGGGGGVPSAPLGSAIGGAESVRPAGAGDIAGLGQGRAGGGAALGGGGM

SEQ ID NO: 1414973 - protein, 10 aa, Mycobacterium tuberculosis
ASNASGQAGL

SEQ ID NO: 1414974 - protein, 40 aa, Mycobacterium tuberculosis; identical to SEQ ID NO: 170076

SEQ ID NO: 1414975 - protein, 6 aa, Mycobacterium tuberculosis
ASNPRF

SEQ ID NO: 1414976 - protein, 32 aa, Mycobacterium tuberculosis
ASPDWKPGAVPGDDLSRIGADAPAPAADPTAH

SEQ ID NO: 1414977 - protein, 10 aa, Mycobacterium tuberculosis
ASQGTTAHST

SEQ ID NO: 1414978 - protein, 4 aa, Mycobacterium tuberculosis
ASRD

SEQ ID NO: 1414979 - protein, 6 aa, Mycobacterium tuberculosis
ASRGKW

SEQ ID NO: 1414980 - protein, 5 aa, Mycobacterium tuberculosis
ASRRN

SEQ ID NO: 1414981 - protein, 15 aa, Mycobacterium tuberculosis
ASRTRLHASTDDVRD

SEQ ID NO: 1414982 - protein, 8 aa, Mycobacterium tuberculosis
ASRVGAPL

SEQ ID NO: 1414983 - protein, 8 aa, Mycobacterium tuberculosis
ASSDGVGT

SEQ ID NO: 1414984 - protein, 7 aa, Mycobacterium tuberculosis
ASSPDIE

SEQ ID NO: 1414985 - protein, 5 aa, Mycobacterium tuberculosis
ASTLK

SEQ ID NO: 1414986 - protein, 33 aa, Mycobacterium tuberculosis
ASTPKPAKTAGEKVTDEGEGGNQIVQYLVAQKI

SEQ ID NO: 1414987 - protein, 15 aa, Mycobacterium tuberculosis
ASTTSLPETPRGERN

SEQ ID NO: 1414988 - protein, 4 aa, Mycobacterium tuberculosis
ASVN

SEQ ID NO: 1414989 - protein, 10 aa, Mycobacterium tuberculosis
ASVSDNKKTV

SEQ ID NO: 1414990 - protein, 12 aa, Mycobacterium tuberculosis
ASYEARAYGARS

SEQ ID NO: 1414991 - protein, 5 aa, Mycobacterium tuberculosis
ATAAG

SEQ ID NO: 1414992 - protein, 8 aa, Mycobacterium tuberculosis
ATAARYGH

SEQ ID NO: 1414993 - protein, 18 aa, Mycobacterium tuberculosis
ATADLSQRLGRAPSASEL

SEQ ID NO: 1414994 - protein, 7 aa, Mycobacterium tuberculosis
ATAGAPA

SEQ ID NO: 1414995 - protein, 17 aa, Mycobacterium tuberculosis
ATARSAQLAGEQLSRGW

SEQ ID NO: 1414996 - protein, 14 aa, Mycobacterium tuberculosis
ATAVRGTLSSPADL

SEQ ID NO: 1414997 - protein, 10 aa, Mycobacterium tuberculosis
ATDGPSAQAA

SEQ ID NO: 1414998 - protein, 8 aa, Mycobacterium tuberculosis
ATDGRTAA

SEQ ID NO: 1414999 - protein, 6 aa, Mycobacterium tuberculosis
ATEARY

SEQ ID NO: 1415000 - protein, 6 aa, Mycobacterium tuberculosis
ATEPNH

SEQ ID NO: 1415001 - protein, 10 aa, Mycobacterium tuberculosis
ATEPPPTAGS

SEQ ID NO: 1415002 - protein, 12 aa, Mycobacterium tuberculosis
ATFGGGARSAAD

SEQ ID NO: 1415003 - protein, 13 aa, Mycobacterium tuberculosis
ATGEDVVTSAQSA

SEQ ID NO: 1415004 - protein, 6 aa, Mycobacterium tuberculosis
ATGKLA

SEQ ID NO: 1415005 - protein, 5 aa, Mycobacterium tuberculosis
ATGRR

SEQ ID NO: 1415006 - protein, 9 aa, Mycobacterium tuberculosis
ATGTTVSPP

SEQ ID NO: 1415007 - protein, 10 aa, Mycobacterium tuberculosis
ATISSTKIDG

SEQ ID NO: 1415008 - protein, 6 aa, Mycobacterium tuberculosis
ATLDTD

SEQ ID NO: 1415009 - protein, 5 aa, Mycobacterium tuberculosis
ATLGN

SEQ ID NO: 1415010 - protein, 5 aa, Mycobacterium tuberculosis
ATLRR

SEQ ID NO: 1415011 - protein, 5 aa, Mycobacterium tuberculosis
ATPAR

SEQ ID NO: 1415012 - protein, 6 aa, Mycobacterium tuberculosis
ATPDQM

SEQ ID NO: 1415013 - protein, 9 aa, Mycobacterium tuberculosis
ATQGHTQSL

SEQ ID NO: 1415014 - protein, 10 aa, Mycobacterium tuberculosis
ATQPNYPAEI

SEQ ID NO: 1415015 - protein, 4 aa, Mycobacterium tuberculosis
ATQR

SEQ ID NO: 1415016 - protein, 7 aa, Mycobacterium tuberculosis
ATRGAEM

SEQ ID NO: 1415017 - protein, 5 aa, Mycobacterium tuberculosis
ATRNP

SEQ ID NO: 1415018 - protein, 10 aa, Mycobacterium tuberculosis
ATSTPDGTPH

SEQ ID NO: 1415019 - protein, 10 aa, Mycobacterium tuberculosis
ATTKRAVEGV

SEQ ID NO: 1415020 - protein, 4 aa, Mycobacterium tuberculosis
ATTV

SEQ ID NO: 1415021 - protein, 5 aa, Mycobacterium tuberculosis
ATTYQ

SEQ ID NO: 1415022 - protein, 5 aa, Mycobacterium tuberculosis
AVAGQ

SEQ ID NO: 1415023 - protein, 13 aa, Mycobacterium tuberculosis
AVAPKDKHAARDN

SEQ ID NO: 1415024 - protein, 6 aa, Mycobacterium tuberculosis
AVAPSG

SEQ ID NO: 1415025 - protein, 13 aa, Mycobacterium tuberculosis
AVDPAALQATRDS

SEQ ID NO: 1415026 - protein, 7 aa, Mycobacterium tuberculosis
AVDVPES

SEQ ID NO: 1415027 - protein, 7 aa, Mycobacterium tuberculosis
AVEAQKG

SEQ ID NO: 1415028 - protein, 12 aa, Mycobacterium tuberculosis
AVEEASDTAAAN

SEQ ID NO: 1415029 - protein, 8 aa, Mycobacterium tuberculosis
AVGDSESY

SEQ ID NO: 1415030 - protein, 7 aa, Mycobacterium tuberculosis
AVGGAAD

SEQ ID NO: 1415031 - protein, 10 aa, Mycobacterium tuberculosis
AVGQAGALDT

SEQ ID NO: 1415032 - protein, 19 aa, Mycobacterium tuberculosis
AVNQDGKSNGIMAPNPSAQ

SEQ ID NO: 1415033 - protein, 6 aa, Mycobacterium tuberculosis
AVNSNR

SEQ ID NO: 1415034 - protein, 7 aa, Mycobacterium tuberculosis
AVSGAGG

SEQ ID NO: 1415035 - protein, 6 aa, Mycobacterium tuberculosis
AVTGGA

SEQ ID NO: 1415036 - protein, 6 aa, Mycobacterium tuberculosis
AVTGTD

SEQ ID NO: 1415037 - protein, 7 aa, Mycobacterium tuberculosis
AVTPTTE

SEQ ID NO: 1415038 - protein, 9 aa, Mycobacterium tuberculosis
AWSPATQHT

SEQ ID NO: 1415039 - protein, 8 aa, Mycobacterium tuberculosis
AYDERREA

SEQ ID NO: 1415040 - protein, 6 aa, Mycobacterium tuberculosis
AYRGES

SEQ ID NO: 1415041 - protein, 31 aa, Mycobacterium tuberculosis
AYSANPNPFGVSPQPPKPATAAWINPPTPDP

SEQ ID NO: 1415042 - protein, 12 aa, Mycobacterium tuberculosis
CAQPQPGQSAPS

SEQ ID NO: 1415043 - protein, 9 aa, Mycobacterium tuberculosis
CDPDDPRLD

SEQ ID NO: 1415044 - protein, 9 aa, Mycobacterium tuberculosis
CGASRGRVA

SEQ ID NO: 1415045 - protein, 4 aa, Mycobacterium tuberculosis
CGGG

SEQ ID NO: 1415046 - protein, 9 aa, Mycobacterium tuberculosis
CGGRGEVQT

SEQ ID NO: 1415047 - protein, 12 aa, Mycobacterium tuberculosis
CPFSTADSENLQ

SEQ ID NO: 1415048 - protein, 17 aa, Mycobacterium tuberculosis
CPPADEPVTNLSGGERR

SEQ ID NO: 1415049 - protein, 4 aa, Mycobacterium tuberculosis
CPPD

SEQ ID NO: 1415050 - protein, 7 aa, Mycobacterium tuberculosis
CPSGEVQ

SEQ ID NO: 1415051 - protein, 5 aa, Mycobacterium tuberculosis
CSAPV

SEQ ID NO: 1415052 - protein, 8 aa, Mycobacterium tuberculosis
CTAAGTSC

SEQ ID NO: 1415053 - protein, 5 aa, Mycobacterium tuberculosis
CTTGD

SEQ ID NO: 1415054 - protein, 14 aa, Mycobacterium tuberculosis
DAAADPDVAGDAFS

SEQ ID NO: 1415055 - protein, 5 aa, Mycobacterium tuberculosis
DAAAQ

SEQ ID NO: 1415056 - protein, 8 aa, Mycobacterium tuberculosis
DAAGADKD

SEQ ID NO: 1415057 - protein, 7 aa, Mycobacterium tuberculosis
DAARGRM

SEQ ID NO: 1415058 - protein, 13 aa, Mycobacterium tuberculosis
DAARQRHGQANSW

SEQ ID NO: 1415059 - protein, 5 aa, Mycobacterium tuberculosis
DADAE

SEQ ID NO: 1415060 - protein, 7 aa, Mycobacterium tuberculosis
DADQARV

SEQ ID NO: 1415061 - protein, 5 aa, Mycobacterium tuberculosis
DAEGT

SEQ ID NO: 1415062 - protein, 4 aa, Mycobacterium tuberculosis
DAEP

SEQ ID NO: 1415063 - protein, 8 aa, Mycobacterium tuberculosis
DAEPEHDP

SEQ ID NO: 1415064 - protein, 11 aa, Mycobacterium tuberculosis
DAFGGSPRTPM

SEQ ID NO: 1415065 - protein, 8 aa, Mycobacterium tuberculosis
DAGAATVS

SEQ ID NO: 1415066 - protein, 11 aa, Mycobacterium tuberculosis
DAGATGDERSF

SEQ ID NO: 1415067 - protein, 28 aa, Mycobacterium tuberculosis
DAGAVARPASVSSGRSLPATLTARGRAL

SEQ ID NO: 1415068 - protein, 6 aa, Mycobacterium tuberculosis
DAGGAA

SEQ ID NO: 1415069 - protein, 14 aa, Mycobacterium tuberculosis
DAGLTSSSWARGPH

SEQ ID NO: 1415070 - protein, 26 aa, Mycobacterium tuberculosis
DAGPKNVKTQIQGDEVRVTSKKRDDL

SEQ ID NO: 1415071 - protein, 6 aa, Mycobacterium tuberculosis
DAHGNE

SEQ ID NO: 1415072 - protein, 8 aa, Mycobacterium tuberculosis
DAHRRPKG

SEQ ID NO: 1415073 - protein, 7 aa, Mycobacterium tuberculosis
DAPDKEF

SEQ ID NO: 1415074 - protein, 9 aa, Mycobacterium tuberculosis
DAPLPPQTH

SEQ ID NO: 1415075 - protein, 7 aa, Mycobacterium tuberculosis
DAPLRPR

SEQ ID NO: 1415076 - protein, 9 aa, Mycobacterium tuberculosis
DAPQTPLDR

SEQ ID NO: 1415077 - protein, 29 aa, Mycobacterium tuberculosis
DAQSRSEAQLRQAQEKADALQADAERKHS

SEQ ID NO: 1415078 - protein, 8 aa, Mycobacterium tuberculosis
DARAQAGA

SEQ ID NO: 1415079 - protein, 4 aa, Mycobacterium tuberculosis
DARD

SEQ ID NO: 1415080 - protein, 23 aa, Mycobacterium tuberculosis
DARQAAVEAAGQARDELAGEAPS

SEQ ID NO: 1415081 - protein, 7 aa, Mycobacterium tuberculosis
DARTDGH

SEQ ID NO: 1415082 - protein, 6 aa, Mycobacterium tuberculosis
DASPNL

SEQ ID NO: 1415083 - protein, 14 aa, Mycobacterium tuberculosis
DASRKVEATGQPVK

SEQ ID NO: 1415084 - protein, 5 aa, Mycobacterium tuberculosis
DASSY

SEQ ID NO: 1415085 - protein, 9 aa, Mycobacterium tuberculosis
DASTDATPA

SEQ ID NO: 1415086 - protein, 6 aa, Mycobacterium tuberculosis
DATDPL

SEQ ID NO: 1415087 - protein, 4 aa, Mycobacterium tuberculosis
DATF

SEQ ID NO: 1415088 - protein, 9 aa, Mycobacterium tuberculosis
DATRGPGLT

SEQ ID NO: 1415089 - protein, 10 aa, Mycobacterium tuberculosis
DDAAARELTD

SEQ ID NO: 1415090 - protein, 5 aa, Mycobacterium tuberculosis
DDDDA

SEQ ID NO: 1415091 - protein, 8 aa, Mycobacterium tuberculosis
DDEEADHH

SEQ ID NO: 1415092 - protein, 5 aa, Mycobacterium tuberculosis
DDGRI

SEQ ID NO: 1415093 - protein, 7 aa, Mycobacterium tuberculosis
DDKTDPV

SEQ ID NO: 1415094 - protein, 6 aa, Mycobacterium tuberculosis
DDPVAA

SEQ ID NO: 1415095 - protein, 6 aa, Mycobacterium tuberculosis
DDRDVE

SEQ ID NO: 1415096 - protein, 7 aa, Mycobacterium tuberculosis
DDSGNSI

SEQ ID NO: 1415097 - protein, 10 aa, Mycobacterium tuberculosis
DDSVQPEQAQ

SEQ ID NO: 1415098 - protein, 9 aa, Mycobacterium tuberculosis
DDVAGSDSA

SEQ ID NO: 1415099 - protein, 7 aa, Mycobacterium tuberculosis
DEADIGV

SEQ ID NO: 1415100 - protein, 8 aa, Mycobacterium tuberculosis
DEAETGVN

SEQ ID NO: 1415101 - protein, 12 aa, Mycobacterium tuberculosis
DEEGQARTAQKK

SEQ ID NO: 1415102 - protein, 6 aa, Mycobacterium tuberculosis
DEEVSR

SEQ ID NO: 1415103 - protein, 8 aa, Mycobacterium tuberculosis
DEGYTPDF

SEQ ID NO: 1415104 - protein, 10 aa, Mycobacterium tuberculosis
DEKPDAESYV

SEQ ID NO: 1415105 - protein, 15 aa, Mycobacterium tuberculosis
DELEDEALLDATRRA

SEQ ID NO: 1415106 - protein, 5 aa, Mycobacterium tuberculosis
DELGP

SEQ ID NO: 1415107 - protein, 4 aa, Mycobacterium tuberculosis
DEQG

SEQ ID NO: 1415108 - protein, 5 aa, Mycobacterium tuberculosis
DERAA

SEQ ID NO: 1415109 - protein, 8 aa, Mycobacterium tuberculosis
DERTVAPS

SEQ ID NO: 1415110 - protein, 8 aa, Mycobacterium tuberculosis
DESGTTDN

SEQ ID NO: 1415111 - protein, 8 aa, Mycobacterium tuberculosis
DESMDPEA

SEQ ID NO: 1415112 - protein, 7 aa, Mycobacterium tuberculosis
DETRKSF

SEQ ID NO: 1415113 - protein, 11 aa, Mycobacterium tuberculosis
DEVGKAPNIAA

SEQ ID NO: 1415114 - protein, 5 aa, Mycobacterium tuberculosis
DFGSY

SEQ ID NO: 1415115 - protein, 10 aa, Mycobacterium tuberculosis
DFTADGTIEA

SEQ ID NO: 1415116 - protein, 6 aa, Mycobacterium tuberculosis
DGAQVF

SEQ ID NO: 1415117 - protein, 14 aa, Mycobacterium tuberculosis
DGASSVRLVNQTGY

SEQ ID NO: 1415118 - protein, 7 aa, Mycobacterium tuberculosis
DGDLPPR

SEQ ID NO: 1415119 - protein, 16 aa, Mycobacterium tuberculosis
DGDYGPGSAMARSTKR

SEQ ID NO: 1415120 - protein, 6 aa, Mycobacterium tuberculosis
DGEAAR

SEQ ID NO: 1415121 - protein, 7 aa, Mycobacterium tuberculosis
DGEQHRL

SEQ ID NO: 1415122 - protein, 15 aa, Mycobacterium tuberculosis
DGGAQPSRVGGRTIR

SEQ ID NO: 1415123 - protein, 18 aa, Mycobacterium tuberculosis
DGGATVDGTSGAMAGPGD

SEQ ID NO: 1415124 - protein, 5 aa, Mycobacterium tuberculosis
DGGDA

SEQ ID NO: 1415125 - protein, 6 aa, Mycobacterium tuberculosis
DGGDRQ

SEQ ID NO: 1415126 - protein, 5 aa, Mycobacterium tuberculosis
DGGEE

SEQ ID NO: 1415127 - protein, 7 aa, Mycobacterium tuberculosis
DGGPTAG

SEQ ID NO: 1415128 - protein, 6 aa, Mycobacterium tuberculosis
DGGRGY

SEQ ID NO: 1415129 - protein, 5 aa, Mycobacterium tuberculosis
DGGRK

SEQ ID NO: 1415130 - protein, 6 aa, Mycobacterium tuberculosis
DGHDQA

SEQ ID NO: 1415131 - protein, 4 aa, Mycobacterium tuberculosis
DGHP

SEQ ID NO: 1415132 - protein, 16 aa, Mycobacterium tuberculosis
DGHTPRQAADDPTRRA

SEQ ID NO: 1415133 - protein, 6 aa, Mycobacterium tuberculosis
DGIQAG

SEQ ID NO: 1415134 - protein, 4 aa, Mycobacterium tuberculosis
DGLP

SEQ ID NO: 1415135 - protein, 14 aa, Mycobacterium tuberculosis
DGLSGYPNRHESPH

SEQ ID NO: 1415136 - protein, 14 aa, Mycobacterium tuberculosis
DGNGAPGERTFRST

SEQ ID NO: 1415137 - protein, 8 aa, Mycobacterium tuberculosis
DGPDPECV

SEQ ID NO: 1415138 - protein, 5 aa, Mycobacterium tuberculosis
DGQAL

SEQ ID NO: 1415139 - protein, 9 aa, Mycobacterium tuberculosis
DGQQRGSGV

SEQ ID NO: 1415140 - protein, 20 aa, Mycobacterium tuberculosis
DGQRPRRGPRPRERRPASPS

SEQ ID NO: 1415141 - protein, 7 aa, Mycobacterium tuberculosis
DGRLGTR

SEQ ID NO: 1415142 - protein, 6 aa, Mycobacterium tuberculosis
DGRPHH

SEQ ID NO: 1415143 - protein, 8 aa, Mycobacterium tuberculosis
DGRRDVAA

SEQ ID NO: 1415144 - protein, 12 aa, Mycobacterium tuberculosis
DGRRRHRGGAAL

SEQ ID NO: 1415145 - protein, 6 aa, Mycobacterium tuberculosis
DGRTYN

SEQ ID NO: 1415146 - protein, 8 aa, Mycobacterium tuberculosis
DGSAGNSF

SEQ ID NO: 1415147 - protein, 11 aa, Mycobacterium tuberculosis
DGSGPQGTDVP

SEQ ID NO: 1415148 - protein, 12 aa, Mycobacterium tuberculosis
DGTPDKSRLGGN

SEQ ID NO: 1415149 - protein, 6 aa, Mycobacterium tuberculosis
DGVRST

SEQ ID NO: 1415150 - protein, 6 aa, Mycobacterium tuberculosis
DGWQPI

SEQ ID NO: 1415151 - protein, 8 aa, Mycobacterium tuberculosis
DGYEGEVR

SEQ ID NO: 1415152 - protein, 9 aa, Mycobacterium tuberculosis
DHGCSDDHR

SEQ ID NO: 1415153 - protein, 10 aa, Mycobacterium tuberculosis
DHQTFSSAQG

SEQ ID NO: 1415154 - protein, 17 aa, Mycobacterium tuberculosis
DINTGGFNGGNVNTGFG

SEQ ID NO: 1415155 - protein, 7 aa, Mycobacterium tuberculosis
DIPNDSP

SEQ ID NO: 1415156 - protein, 7 aa, Mycobacterium tuberculosis
DIRPERY

SEQ ID NO: 1415157 - protein, 5 aa, Mycobacterium tuberculosis
DITAR

SEQ ID NO: 1415158 - protein, 11 aa, Mycobacterium tuberculosis
DITEDPTPRGH

SEQ ID NO: 1415159 - protein, 12 aa, Mycobacterium tuberculosis
DITGADAKRLRS

SEQ ID NO: 1415160 - protein, 7 aa, Mycobacterium tuberculosis
DKAALEG

SEQ ID NO: 1415161 - protein, 6 aa, Mycobacterium tuberculosis
DKDSPE

SEQ ID NO: 1415162 - protein, 4 aa, Mycobacterium tuberculosis
DKDV

SEQ ID NO: 1415163 - protein, 7 aa, Mycobacterium tuberculosis
DKLAKEA

SEQ ID NO: 1415164 - protein, 4 aa, Mycobacterium tuberculosis
DKLP

SEQ ID NO: 1415165 - protein, 10 aa, Mycobacterium tuberculosis
DKPDDSINDV

SEQ ID NO: 1415166 - protein, 10 aa, Mycobacterium tuberculosis
DKPSHTQSAA

SEQ ID NO: 1415167 - protein, 6 aa, Mycobacterium tuberculosis
DLDSAR

SEQ ID NO: 1415168 - protein, 9 aa, Mycobacterium tuberculosis
DLESKASEL

SEQ ID NO: 1415169 - protein, 7 aa, Mycobacterium tuberculosis
DLSEGGL

SEQ ID NO: 1415170 - protein, 5 aa, Mycobacterium tuberculosis
DLSPE

SEQ ID NO: 1415171 - protein, 11 aa, Mycobacterium tuberculosis
DLSPKARDLGA

SEQ ID NO: 1415172 - protein, 12 aa, Mycobacterium tuberculosis
DMDPWRDRTTEE

SEQ ID NO: 1415173 - protein, 4 aa, Mycobacterium tuberculosis
DNDE

SEQ ID NO: 1415174 - protein, 11 aa, Mycobacterium tuberculosis
DNDSARRTPDL

SEQ ID NO: 1415175 - protein, 17 aa, Mycobacterium tuberculosis
DNEDQNDLMGTSRANAA

SEQ ID NO: 1415176 - protein, 4 aa, Mycobacterium tuberculosis
DNEV

SEQ ID NO: 1415177 - protein, 8 aa, Mycobacterium tuberculosis
DNPARYRD

SEQ ID NO: 1415178 - protein, 6 aa, Mycobacterium tuberculosis
DNPQQA

SEQ ID NO: 1415179 - protein, 5 aa, Mycobacterium tuberculosis
DNQGQ

SEQ ID NO: 1415180 - protein, 9 aa, Mycobacterium tuberculosis
DNRDLARGQ

SEQ ID NO: 1415181 - protein, 13 aa, Mycobacterium tuberculosis
DPAPTAASGAAAH

SEQ ID NO: 1415182 - protein, 14 aa, Mycobacterium tuberculosis
DPARGSEANNQRPA

SEQ ID NO: 1415183 - protein, 6 aa, Mycobacterium tuberculosis
DPASGN

SEQ ID NO: 1415184 - protein, 10 aa, Mycobacterium tuberculosis
DPATGETVPR

SEQ ID NO: 1415185 - protein, 9 aa, Mycobacterium tuberculosis
DPDADYSQA

SEQ ID NO: 1415186 - protein, 7 aa, Mycobacterium tuberculosis
DPDEADL

SEQ ID NO: 1415187 - protein, 8 aa, Mycobacterium tuberculosis
DPDEPWGS

SEQ ID NO: 1415188 - protein, 19 aa, Mycobacterium tuberculosis
DPDEVTESSTHGRHRPDAS

SEQ ID NO: 1415189 - protein, 9 aa, Mycobacterium tuberculosis
DPDGELPAN

SEQ ID NO: 1415190 - protein, 7 aa, Mycobacterium tuberculosis
DPDPDAC

SEQ ID NO: 1415191 - protein, 6 aa, Mycobacterium tuberculosis
DPDRSA

SEQ ID NO: 1415192 - protein, 8 aa, Mycobacterium tuberculosis
DPDRTLAQ

SEQ ID NO: 1415193 - protein, 7 aa, Mycobacterium tuberculosis
DPDTTYA

SEQ ID NO: 1415194 - protein, 4 aa, Mycobacterium tuberculosis
DPEL

SEQ ID NO: 1415195 - protein, 10 aa, Mycobacterium tuberculosis
DPGAQSPKET

SEQ ID NO: 1415196 - protein, 26 aa, Mycobacterium tuberculosis
DPHRASDDAVGVPPACGGRSDEEERR

SEQ ID NO: 1415197 - protein, 15 aa, Mycobacterium tuberculosis
DPITDDDATNPLTEG

SEQ ID NO: 1415198 - protein, 7 aa, Mycobacterium tuberculosis
DPKHSGP

SEQ ID NO: 1415199 - protein, 4 aa, Mycobacterium tuberculosis
DPLR

SEQ ID NO: 1415200 - protein, 8 aa, Mycobacterium tuberculosis
DPLSEDDW

SEQ ID NO: 1415201 - protein, 7 aa, Mycobacterium tuberculosis
DPNGAAA

SEQ ID NO: 1415202 - protein, 8 aa, Mycobacterium tuberculosis
DPPAGPAA

SEQ ID NO: 1415203 - protein, 6 aa, Mycobacterium tuberculosis
DPQKVN

SEQ ID NO: 1415204 - protein, 8 aa, Mycobacterium tuberculosis
DPQPGTGF

SEQ ID NO: 1415205 - protein, 6 aa, Mycobacterium tuberculosis
DPQRLQ

SEQ ID NO: 1415206 - protein, 13 aa, Mycobacterium tuberculosis
DPQRPGRGIGEPE

SEQ ID NO: 1415207 - protein, 9 aa, Mycobacterium tuberculosis
DPRAAARAR

SEQ ID NO: 1415208 - protein, 7 aa, Mycobacterium tuberculosis
DPRATEL

SEQ ID NO: 1415209 - protein, 13 aa, Mycobacterium tuberculosis
DPRLGDGGRGYRR

SEQ ID NO: 1415210 - protein, 8 aa, Mycobacterium tuberculosis
DPRQGPGV

SEQ ID NO: 1415211 - protein, 8 aa, Mycobacterium tuberculosis
DPRSGTHA

SEQ ID NO: 1415212 - protein, 7 aa, Mycobacterium tuberculosis
DPRTVNS

SEQ ID NO: 1415213 - protein, 4 aa, Mycobacterium tuberculosis
DPSG

SEQ ID NO: 1415214 - protein, 12 aa, Mycobacterium tuberculosis
DPSSTRTGGSIL

SEQ ID NO: 1415215 - protein, 17 aa, Mycobacterium tuberculosis
DPTSGTITVDGTDVSTV

SEQ ID NO: 1415216 - protein, 7 aa, Mycobacterium tuberculosis
DPYAGTP

SEQ ID NO: 1415217 - protein, 6 aa, Mycobacterium tuberculosis
DQGNVD

SEQ ID NO: 1415218 - protein, 12 aa, Mycobacterium tuberculosis
DQLRAKAPAGIT

SEQ ID NO: 1415219 - protein, 11 aa, Mycobacterium tuberculosis
DQPAKGFASHG

SEQ ID NO: 1415220 - protein, 14 aa, Mycobacterium tuberculosis
DQPDTPIEDEREGD

SEQ ID NO: 1415221 - protein, 6 aa, Mycobacterium tuberculosis
DQQPAV

SEQ ID NO: 1415222 - protein, 14 aa, Mycobacterium tuberculosis
DQRPGTKKCGHQGG

SEQ ID NO: 1415223 - protein, 14 aa, Mycobacterium tuberculosis
DQVSATELAGEPIT

SEQ ID NO: 1415224 - protein, 6 aa, Mycobacterium tuberculosis
DRAEAL

SEQ ID NO: 1415225 - protein, 9 aa, Mycobacterium tuberculosis
DRARKQGTE

SEQ ID NO: 1415226 - protein, 14 aa, Mycobacterium tuberculosis
DRATDTVNRYPDNG

SEQ ID NO: 1415227 - protein, 6 aa, Mycobacterium tuberculosis
DRDADL

SEQ ID NO: 1415228 - protein, 6 aa, Mycobacterium tuberculosis
DRDDAA

SEQ ID NO: 1415229 - protein, 5 aa, Mycobacterium tuberculosis
DREGI

SEQ ID NO: 1415230 - protein, 12 aa, Mycobacterium tuberculosis
DRERAGNDQRTR

SEQ ID NO: 1415231 - protein, 5 aa, Mycobacterium tuberculosis
DRFTS

SEQ ID NO: 1415232 - protein, 16 aa, Mycobacterium tuberculosis
DRGDRSVTLRPEGTAG

SEQ ID NO: 1415233 - protein, 10 aa, Mycobacterium tuberculosis
DRIETGAMPP

SEQ ID NO: 1415234 - protein, 6 aa, Mycobacterium tuberculosis
DRLPPA

SEQ ID NO: 1415235 - protein, 14 aa, Mycobacterium tuberculosis
DRLSDSPFRLSGGQ

SEQ ID NO: 1415236 - protein, 11 aa, Mycobacterium tuberculosis
DRNPDPDEQTI

SEQ ID NO: 1415237 - protein, 8 aa, Mycobacterium tuberculosis
DRNRHDPR

SEQ ID NO: 1415238 - protein, 5 aa, Mycobacterium tuberculosis
DRPED

SEQ ID NO: 1415239 - protein, 6 aa, Mycobacterium tuberculosis
DRPLGT

SEQ ID NO: 1415240 - protein, 4 aa, Mycobacterium tuberculosis
DRPT

SEQ ID NO: 1415241 - protein, 16 aa, Mycobacterium tuberculosis
DRPVRTSRGWSASPVR

SEQ ID NO: 1415242 - protein, 5 aa, Mycobacterium tuberculosis
DRRQP

SEQ ID NO: 1415243 - protein, 5 aa, Mycobacterium tuberculosis
DRSER

SEQ ID NO: 1415244 - protein, 9 aa, Mycobacterium tuberculosis
DRSTDDTAE

SEQ ID NO: 1415245 - protein, 8 aa, Mycobacterium tuberculosis
DSAAGNFE

SEQ ID NO: 1415246 - protein, 7 aa, Mycobacterium tuberculosis
DSAEGRV

SEQ ID NO: 1415247 - protein, 6 aa, Mycobacterium tuberculosis
DSAGGA

SEQ ID NO: 1415248 - protein, 8 aa, Mycobacterium tuberculosis
DSAHDSAA

SEQ ID NO: 1415249 - protein, 5 aa, Mycobacterium tuberculosis
DSCDA

SEQ ID NO: 1415250 - protein, 8 aa, Mycobacterium tuberculosis
DSETGQTV

SEQ ID NO: 1415251 - protein, 9 aa, Mycobacterium tuberculosis
DSGATMTAA

SEQ ID NO: 1415252 - protein, 4 aa, Mycobacterium tuberculosis
DSGH

SEQ ID NO: 1415253 - protein, 6 aa, Mycobacterium tuberculosis
DSGHDI

SEQ ID NO: 1415254 - protein, 16 aa, Mycobacterium tuberculosis
DSGYDDARDPAARTAR

SEQ ID NO: 1415255 - protein, 12 aa, Mycobacterium tuberculosis
DSICGDGNSPVA

SEQ ID NO: 1415256 - protein, 4 aa, Mycobacterium tuberculosis
DSIE

SEQ ID NO: 1415257 - protein, 6 aa, Mycobacterium tuberculosis
DSLQDK

SEQ ID NO: 1415258 - protein, 7 aa, Mycobacterium tuberculosis
DSLSDDI

SEQ ID NO: 1415259 - protein, 8 aa, Mycobacterium tuberculosis
DSPTGRPI

SEQ ID NO: 1415260 - protein, 8 aa, Mycobacterium tuberculosis
DSRANGSF

SEQ ID NO: 1415261 - protein, 7 aa, Mycobacterium tuberculosis
DSRDQAI

SEQ ID NO: 1415262 - protein, 6 aa, Mycobacterium tuberculosis
DSRFAT

SEQ ID NO: 1415263 - protein, 9 aa, Mycobacterium tuberculosis
DSRRSFSTT

SEQ ID NO: 1415264 - protein, 7 aa, Mycobacterium tuberculosis
DSVEPPI

SEQ ID NO: 1415265 - protein, 6 aa, Mycobacterium tuberculosis
DTAEFG

SEQ ID NO: 1415266 - protein, 5 aa, Mycobacterium tuberculosis
DTAER

SEQ ID NO: 1415267 - protein, 8 aa, Mycobacterium tuberculosis
DTAGAGSP

SEQ ID NO: 1415268 - protein, 7 aa, Mycobacterium tuberculosis
DTARGGS

SEQ ID NO: 1415269 - protein, 10 aa, Mycobacterium tuberculosis
DTATVDRRDT

SEQ ID NO: 1415270 - protein, 12 aa, Mycobacterium tuberculosis
DTDIEGANAAGL

SEQ ID NO: 1415271 - protein, 14 aa, Mycobacterium tuberculosis
DTETAKWRDPTGTV

SEQ ID NO: 1415272 - protein, 6 aa, Mycobacterium tuberculosis
DTPMGA

SEQ ID NO: 1415273 - protein, 8 aa, Mycobacterium tuberculosis
DTRDAATS

SEQ ID NO: 1415274 - protein, 6 aa, Mycobacterium tuberculosis
DTSASV

SEQ ID NO: 1415275 - protein, 15 aa, Mycobacterium tuberculosis
DTTDERVRYWCPACQ

SEQ ID NO: 1415276 - protein, 26 aa, Mycobacterium tuberculosis
DTWRDPSRSIQPNQLGQPHRGPASSP

SEQ ID NO: 1415277 - protein, 4 aa, Mycobacterium tuberculosis
DTWS

SEQ ID NO: 1415278 - protein, 13 aa, Mycobacterium tuberculosis
DTYIEKDSSINDD

SEQ ID NO: 1415279 - protein, 8 aa, Mycobacterium tuberculosis
DVAESEEL

SEQ ID NO: 1415280 - protein, 17 aa, Mycobacterium tuberculosis
DVAETYRRRATAAGQSL

SEQ ID NO: 1415281 - protein, 5 aa, Mycobacterium tuberculosis
DVARA

SEQ ID NO: 1415282 - protein, 4 aa, Mycobacterium tuberculosis
DVEE

SEQ ID NO: 1415283 - protein, 7 aa, Mycobacterium tuberculosis
DVEPDPG

SEQ ID NO: 1415284 - protein, 6 aa, Mycobacterium tuberculosis
DVGGPP

SEQ ID NO: 1415285 - protein, 6 aa, Mycobacterium tuberculosis
DVGRID

SEQ ID NO: 1415286 - protein, 7 aa, Mycobacterium tuberculosis
DVGSSAA

SEQ ID NO: 1415287 - protein, 7 aa, Mycobacterium tuberculosis
DVITEEE

SEQ ID NO: 1415288 - protein, 4 aa, Mycobacterium tuberculosis
DVMP

SEQ ID NO: 1415289 - protein, 32 aa, Mycobacterium tuberculosis
DVNSGVGNAGDVNTGLGNSGNINTGGFNPGTL

SEQ ID NO: 1415290 - protein, 23 aa, Mycobacterium tuberculosis
DVRRAAAEAAAHAREELAGGTPA

SEQ ID NO: 1415291 - protein, 19 aa, Mycobacterium tuberculosis
DVSARDQQQSDGQWTRAKG

SEQ ID NO: 1415292 - protein, 6 aa, Mycobacterium tuberculosis
DVSESV

SEQ ID NO: 1415293 - protein, 7 aa, Mycobacterium tuberculosis
DVSGGIG

SEQ ID NO: 1415294 - protein, 13 aa, Mycobacterium tuberculosis
DVTDDPADPSTIV

SEQ ID NO: 1415295 - protein, 7 aa, Mycobacterium tuberculosis
DVTGEDV

SEQ ID NO: 1415296 - protein, 14 aa, Mycobacterium tuberculosis
DVTGTSKGKGFAGT

SEQ ID NO: 1415297 - protein, 13 aa, Mycobacterium tuberculosis
DWDPSQSTLPRTI

SEQ ID NO: 1415298 - protein, 8 aa, Mycobacterium tuberculosis
DWGTETGA

SEQ ID NO: 1415299 - protein, 6 aa, Mycobacterium tuberculosis
DYAPAR

SEQ ID NO: 1415300 - protein, 9 aa, Mycobacterium tuberculosis
DYDGSGVEE

SEQ ID NO: 1415301 - protein, 17 aa, Mycobacterium tuberculosis
DYGVTPDQLRDALDAIA

SEQ ID NO: 1415302 - protein, 7 aa, Mycobacterium tuberculosis
DYPGVGP

SEQ ID NO: 1415303 - protein, 6 aa, Mycobacterium tuberculosis
DYPTLD

SEQ ID NO: 1415304 - protein, 6 aa, Mycobacterium tuberculosis
DYTDVS

SEQ ID NO: 1415305 - protein, 10 aa, Mycobacterium tuberculosis
EAAESARDDG

SEQ ID NO: 1415306 - protein, 8 aa, Mycobacterium tuberculosis
EAARATRK

SEQ ID NO: 1415307 - protein, 8 aa, Mycobacterium tuberculosis
EADSDRDR

SEQ ID NO: 1415308 - protein, 19 aa, Mycobacterium tuberculosis
EADTAEHGHDDEYDEFSDP

SEQ ID NO: 1415309 - protein, 13 aa, Mycobacterium tuberculosis
EAEEELSRLLLPS

SEQ ID NO: 1415310 - protein, 12 aa, Mycobacterium tuberculosis
EAERKAGESAEQ

SEQ ID NO: 1415311 - protein, 5 aa, Mycobacterium tuberculosis
EAETG

SEQ ID NO: 1415312 - protein, 7 aa, Mycobacterium tuberculosis
EAGKEDV

SEQ ID NO: 1415313 - protein, 4 aa, Mycobacterium tuberculosis
EAGN

SEQ ID NO: 1415314 - protein, 9 aa, Mycobacterium tuberculosis
EAGPDGHEY

SEQ ID NO: 1415315 - protein, 10 aa, Mycobacterium tuberculosis
EAGPEAQEEL

SEQ ID NO: 1415316 - protein, 10 aa, Mycobacterium tuberculosis
EAKQISAEST

SEQ ID NO: 1415317 - protein, 5 aa, Mycobacterium tuberculosis
EALTD

SEQ ID NO: 1415318 - protein, 4 aa, Mycobacterium tuberculosis
EAMT

SEQ ID NO: 1415319 - protein, 7 aa, Mycobacterium tuberculosis
EANAAEG

SEQ ID NO: 1415320 - protein, 11 aa, Mycobacterium tuberculosis
EANRDPQTRHS

SEQ ID NO: 1415321 - protein, 7 aa, Mycobacterium tuberculosis
EAPGGAH

SEQ ID NO: 1415322 - protein, 5 aa, Mycobacterium tuberculosis
EAPSR

SEQ ID NO: 1415323 - protein, 11 aa, Mycobacterium tuberculosis
EASERAGEEVP

SEQ ID NO: 1415324 - protein, 6 aa, Mycobacterium tuberculosis
EASGGS

SEQ ID NO: 1415325 - protein, 9 aa, Mycobacterium tuberculosis
EASTAHAAR

SEQ ID NO: 1415326 - protein, 5 aa, Mycobacterium tuberculosis
EASYF

SEQ ID NO: 1415327 - protein, 5 aa, Mycobacterium tuberculosis
EDAAK

SEQ ID NO: 1415328 - protein, 10 aa, Mycobacterium tuberculosis
EDAVRASRNF

SEQ ID NO: 1415329 - protein, 9 aa, Mycobacterium tuberculosis
EDAWNGRAG

SEQ ID NO: 1415330 - protein, 4 aa, Mycobacterium tuberculosis
EDDA

SEQ ID NO: 1415331 - protein, 15 aa, Mycobacterium tuberculosis
EDEAERARSAGGGNW

SEQ ID NO: 1415332 - protein, 14 aa, Mycobacterium tuberculosis
EDEGIRANTTAAAL

SEQ ID NO: 1415333 - protein, 18 aa, Mycobacterium tuberculosis
EDGGVMTGADAAKISDRA

SEQ ID NO: 1415334 - protein, 5 aa, Mycobacterium tuberculosis
EDGRC

SEQ ID NO: 1415335 - protein, 8 aa, Mycobacterium tuberculosis
EDIRTGGL

SEQ ID NO: 1415336 - protein, 5 aa, Mycobacterium tuberculosis
EDKPD

SEQ ID NO: 1415337 - protein, 12 aa, Mycobacterium tuberculosis
EDLADNAQQPCG

SEQ ID NO: 1415338 - protein, 8 aa, Mycobacterium tuberculosis
EDNAATRG

SEQ ID NO: 1415339 - protein, 7 aa, Mycobacterium tuberculosis
EDSDDVQ

SEQ ID NO: 1415340 - protein, 22 aa, Mycobacterium tuberculosis
EDSSCGRPGDTRVSGRSSGAVR

SEQ ID NO: 1415341 - protein, 15 aa, Mycobacterium tuberculosis
EDSVRAAGSPEIPSH

SEQ ID NO: 1415342 - protein, 8 aa, Mycobacterium tuberculosis
EDTDDDIR

SEQ ID NO: 1415343 - protein, 6 aa, Mycobacterium tuberculosis
EEAATV

SEQ ID NO: 1415344 - protein, 9 aa, Mycobacterium tuberculosis
EEADRREGL

SEQ ID NO: 1415345 - protein, 8 aa, Mycobacterium tuberculosis
EEDEKKMR

SEQ ID NO: 1415346 - protein, 10 aa, Mycobacterium tuberculosis
EEGYQAVGSG

SEQ ID NO: 1415347 - protein, 5 aa, Mycobacterium tuberculosis
EERRR

SEQ ID NO: 1415348 - protein, 5 aa, Mycobacterium tuberculosis
EERVA

SEQ ID NO: 1415349 - protein, 4 aa, Mycobacterium tuberculosis
EESK

SEQ ID NO: 1415350 - protein, 4 aa, Mycobacterium tuberculosis
EETH

SEQ ID NO: 1415351 - protein, 9 aa, Mycobacterium tuberculosis
EGFAGKSSL

SEQ ID NO: 1415352 - protein, 4 aa, Mycobacterium tuberculosis
EGFR

SEQ ID NO: 1415353 - protein, 6 aa, Mycobacterium tuberculosis
EGGSAR

SEQ ID NO: 1415354 - protein, 4 aa, Mycobacterium tuberculosis
EGKQ

SEQ ID NO: 1415355 - protein, 16 aa, Mycobacterium tuberculosis
EGKSAHNFQHEGPGYR

SEQ ID NO: 1415356 - protein, 24 aa, Mycobacterium tuberculosis
EGLQARAGLGRADGKPEAEAAEPL

SEQ ID NO: 1415357 - protein, 9 aa, Mycobacterium tuberculosis
EGNPPDPAV

SEQ ID NO: 1415358 - protein, 9 aa, Mycobacterium tuberculosis
EGPAPDQEA

SEQ ID NO: 1415359 - protein, 8 aa, Mycobacterium tuberculosis
EGRFDEQS

SEQ ID NO: 1415360 - protein, 5 aa, Mycobacterium tuberculosis
EGRGW

SEQ ID NO: 1415361 - protein, 8 aa, Mycobacterium tuberculosis
EGRKMTTD

SEQ ID NO: 1415362 - protein, 13 aa, Mycobacterium tuberculosis
EGRRGQPRLRPPF

SEQ ID NO: 1415363 - protein, 5 aa, Mycobacterium tuberculosis
EGTTV

SEQ ID NO: 1415364 - protein, 6 aa, Mycobacterium tuberculosis
EHAAQR

SEQ ID NO: 1415365 - protein, 18 aa, Mycobacterium tuberculosis
EHELGTKGPGQDGPGRET

SEQ ID NO: 1415366 - protein, 11 aa, Mycobacterium tuberculosis
EIDSPKSQAAQ

SEQ ID NO: 1415367 - protein, 12 aa, Mycobacterium tuberculosis
EIGRGRHTSTRS

SEQ ID NO: 1415368 - protein, 6 aa, Mycobacterium tuberculosis
EIHDSA

SEQ ID NO: 1415369 - protein, 7 aa, Mycobacterium tuberculosis
EIPPDRW

SEQ ID NO: 1415370 - protein, 7 aa, Mycobacterium tuberculosis
EKAGFTV

SEQ ID NO: 1415371 - protein, 8 aa, Mycobacterium tuberculosis
EKDAQRDK

SEQ ID NO: 1415372 - protein, 14 aa, Mycobacterium tuberculosis
EKGKPPKVFEDGGQ

SEQ ID NO: 1415373 - protein, 6 aa, Mycobacterium tuberculosis
EKGPRL

SEQ ID NO: 1415374 - protein, 9 aa, Mycobacterium tuberculosis
EKNKLERSL

SEQ ID NO: 1415375 - protein, 8 aa, Mycobacterium tuberculosis
EKPTTGDV

SEQ ID NO: 1415376 - protein, 17 aa, Mycobacterium tuberculosis
EKRPYPPGQHGRARIKE

SEQ ID NO: 1415377 - protein, 5 aa, Mycobacterium tuberculosis
EKSYA

SEQ ID NO: 1415378 - protein, 7 aa, Mycobacterium tuberculosis
ELAAERI

SEQ ID NO: 1415379 - protein, 17 aa, Mycobacterium tuberculosis
ELAGAQKELASTAAKLA

SEQ ID NO: 1415380 - protein, 12 aa, Mycobacterium tuberculosis
ELGGADHQASYG

SEQ ID NO: 1415381 - protein, 6 aa, Mycobacterium tuberculosis
ELGPDE

SEQ ID NO: 1415382 - protein, 29 aa, Mycobacterium tuberculosis
ELGTAASSFSSVTTGLTGQAWQGPASAAM

SEQ ID NO: 1415383 - protein, 6 aa, Mycobacterium tuberculosis
ELHGTG

SEQ ID NO: 1415384 - protein, 8 aa, Mycobacterium tuberculosis
ELPPAGSY

SEQ ID NO: 1415385 - protein, 5 aa, Mycobacterium tuberculosis
ELSGV

SEQ ID NO: 1415386 - protein, 5 aa, Mycobacterium tuberculosis
ELSQA

SEQ ID NO: 1415387 - protein, 13 aa, Mycobacterium tuberculosis
ELSREKSTFAAAV

SEQ ID NO: 1415388 - protein, 8 aa, Mycobacterium tuberculosis
ELSTRAES

SEQ ID NO: 1415389 - protein, 11 aa, Mycobacterium tuberculosis
ELTDEDAEGSA

SEQ ID NO: 1415390 - protein, 7 aa, Mycobacterium tuberculosis
ELTESDA

SEQ ID NO: 1415391 - protein, 4 aa, Mycobacterium tuberculosis
ENAD

SEQ ID NO: 1415392 - protein, 6 aa, Mycobacterium tuberculosis
ENARGP

SEQ ID NO: 1415393 - protein, 4 aa, Mycobacterium tuberculosis
ENDD

SEQ ID NO: 1415394 - protein, 9 aa, Mycobacterium tuberculosis
ENDYTERTT

SEQ ID NO: 1415395 - protein, 13 aa, Mycobacterium tuberculosis
ENFRPDMRDSRND

SEQ ID NO: 1415396 - protein, 7 aa, Mycobacterium tuberculosis
ENHPQRV

SEQ ID NO: 1415397 - protein, 5 aa, Mycobacterium tuberculosis
ENLKD

SEQ ID NO: 1415398 - protein, 8 aa, Mycobacterium tuberculosis
ENPPTDTR

SEQ ID NO: 1415399 - protein, 8 aa, Mycobacterium tuberculosis
ENRAAVEG

SEQ ID NO: 1415400 - protein, 9 aa, Mycobacterium tuberculosis
ENYPGRPRV

SEQ ID NO: 1415401 - protein, 6 aa, Mycobacterium tuberculosis
EPAPEA

SEQ ID NO: 1415402 - protein, 9 aa, Mycobacterium tuberculosis
EPDSGLDPV

SEQ ID NO: 1415403 - protein, 21 aa, Mycobacterium tuberculosis
EPDVGSDPAAMKTRARRDGPD

SEQ ID NO: 1415404 - protein, 6 aa, Mycobacterium tuberculosis
EPEEVG

SEQ ID NO: 1415405 - protein, 11 aa, Mycobacterium tuberculosis
EPGAGSDLASL

SEQ ID NO: 1415406 - protein, 16 aa, Mycobacterium tuberculosis
EPGSGNSTTTTSDPFS

SEQ ID NO: 1415407 - protein, 5 aa, Mycobacterium tuberculosis
EPKNA

SEQ ID NO: 1415408 - protein, 7 aa, Mycobacterium tuberculosis
EPMDDNP

SEQ ID NO: 1415409 - protein, 8 aa, Mycobacterium tuberculosis
EPQPELDG

SEQ ID NO: 1415410 - protein, 24 aa, Mycobacterium tuberculosis
EPRPEPEPDFRPEPRPSITRSADE

SEQ ID NO: 1415411 - protein, 5 aa, Mycobacterium tuberculosis
EPTRG

SEQ ID NO: 1415412 - protein, 9 aa, Mycobacterium tuberculosis
EPVGDRRTL

SEQ ID NO: 1415413 - protein, 9 aa, Mycobacterium tuberculosis
EPVSSRGAT

SEQ ID NO: 1415414 - protein, 8 aa, Mycobacterium tuberculosis
EQASEAGW

SEQ ID NO: 1415415 - protein, 5 aa, Mycobacterium tuberculosis
EQATP

SEQ ID NO: 1415416 - protein, 5 aa, Mycobacterium tuberculosis
EQEGE

SEQ ID NO: 1415417 - protein, 6 aa, Mycobacterium tuberculosis
EQGEGD

SEQ ID NO: 1415418 - protein, 4 aa, Mycobacterium tuberculosis
EQGH

SEQ ID NO: 1415419 - protein, 14 aa, Mycobacterium tuberculosis
EQGQEPDSPEARAE

SEQ ID NO: 1415420 - protein, 15 aa, Mycobacterium tuberculosis
EQHPELRTPDSPTQL

SEQ ID NO: 1415421 - protein, 5 aa, Mycobacterium tuberculosis
EQQRA

SEQ ID NO: 1415422 - protein, 16 aa, Mycobacterium tuberculosis
EQREAEGGSKVPEDTL

SEQ ID NO: 1415423 - protein, 6 aa, Mycobacterium tuberculosis
EQRRLE

SEQ ID NO: 1415424 - protein, 11 aa, Mycobacterium tuberculosis
ERAAQSPTEAA

SEQ ID NO: 1415425 - protein, 15 aa, Mycobacterium tuberculosis
ERAASRSLGNIIDGS

SEQ ID NO: 1415426 - protein, 4 aa, Mycobacterium tuberculosis
ERAG

SEQ ID NO: 1415427 - protein, 9 aa, Mycobacterium tuberculosis
ERAGESRAY

SEQ ID NO: 1415428 - protein, 15 aa, Mycobacterium tuberculosis
ERAGPTPAQTTAEPC

SEQ ID NO: 1415429 - protein, 11 aa, Mycobacterium tuberculosis
ERAHDTATPQF

SEQ ID NO: 1415430 - protein, 11 aa, Mycobacterium tuberculosis
ERAKATAARNI

SEQ ID NO: 1415431 - protein, 5 aa, Mycobacterium tuberculosis
ERALT

SEQ ID NO: 1415432 - protein, 7 aa, Mycobacterium tuberculosis
ERAPDGT

SEQ ID NO: 1415433 - protein, 4 aa, Mycobacterium tuberculosis
ERAR

SEQ ID NO: 1415434 - protein, 7 aa, Mycobacterium tuberculosis
ERECGGS

SEQ ID NO: 1415435 - protein, 6 aa, Mycobacterium tuberculosis
EREEQA

SEQ ID NO: 1415436 - protein, 8 aa, Mycobacterium tuberculosis
ERGRNGER

SEQ ID NO: 1415437 - protein, 11 aa, Mycobacterium tuberculosis
ERKIPKPGGLG

SEQ ID NO: 1415438 - protein, 11 aa, Mycobacterium tuberculosis
ERLTPGDDYPV

SEQ ID NO: 1415439 - protein, 20 aa, Mycobacterium tuberculosis
ERNGWKAEVNSTKLRSAEPR

SEQ ID NO: 1415440 - protein, 24 aa, Mycobacterium tuberculosis
ERNRDQSNALKATSLREAGGEELD

SEQ ID NO: 1415441 - protein, 4 aa, Mycobacterium tuberculosis
ERPA

SEQ ID NO: 1415442 - protein, 4 aa, Mycobacterium tuberculosis
ERPD

SEQ ID NO: 1415443 - protein, 15 aa, Mycobacterium tuberculosis
ERPHNTDSATAGVTS

SEQ ID NO: 1415444 - protein, 6 aa, Mycobacterium tuberculosis
ERPMPG

SEQ ID NO: 1415445 - protein, 9 aa, Mycobacterium tuberculosis
ERRGRTDTG

SEQ ID NO: 1415446 - protein, 6 aa, Mycobacterium tuberculosis
ERRQLG

SEQ ID NO: 1415447 - protein, 4 aa, Mycobacterium tuberculosis
ERRR

SEQ ID NO: 1415448 - protein, 14 aa, Mycobacterium tuberculosis
ERSLREAQSAVEAA

SEQ ID NO: 1415449 - protein, 8 aa, Mycobacterium tuberculosis
ERVGSTAA

SEQ ID NO: 1415450 - protein, 7 aa, Mycobacterium tuberculosis
ERYAKGQ

SEQ ID NO: 1415451 - protein, 5 aa, Mycobacterium tuberculosis
ESERR

SEQ ID NO: 1415452 - protein, 6 aa, Mycobacterium tuberculosis
ESEVTA

SEQ ID NO: 1415453 - protein, 9 aa, Mycobacterium tuberculosis
ESGSQISAG

SEQ ID NO: 1415454 - protein, 5 aa, Mycobacterium tuberculosis
ESLAG

SEQ ID NO: 1415455 - protein, 6 aa, Mycobacterium tuberculosis
ESNRTV

SEQ ID NO: 1415456 - protein, 7 aa, Mycobacterium tuberculosis
ESPALGA

SEQ ID NO: 1415457 - protein, 4 aa, Mycobacterium tuberculosis
ESQA

SEQ ID NO: 1415458 - protein, 9 aa, Mycobacterium tuberculosis
ESRPTRTEL

SEQ ID NO: 1415459 - protein, 6 aa, Mycobacterium tuberculosis
ESRTRE

SEQ ID NO: 1415460 - protein, 9 aa, Mycobacterium tuberculosis
ESSGAALTD

SEQ ID NO: 1415461 - protein, 9 aa, Mycobacterium tuberculosis
ESYKVTGTA

SEQ ID NO: 1415462 - protein, 12 aa, Mycobacterium tuberculosis
ETDDGLSGEEGT

SEQ ID NO: 1415463 - protein, 7 aa, Mycobacterium tuberculosis
ETDKDKW

SEQ ID NO: 1415464 - protein, 6 aa, Mycobacterium tuberculosis
ETEPAA

SEQ ID NO: 1415465 - protein, 11 aa, Mycobacterium tuberculosis
ETGAGQHGVAT

SEQ ID NO: 1415466 - protein, 4 aa, Mycobacterium tuberculosis
ETIQ

SEQ ID NO: 1415467 - protein, 4 aa, Mycobacterium tuberculosis
ETMA

SEQ ID NO: 1415468 - protein, 18 aa, Mycobacterium tuberculosis
ETPGGGGYGPASTSARRR

SEQ ID NO: 1415469 - protein, 4 aa, Mycobacterium tuberculosis
ETRG

SEQ ID NO: 1415470 - protein, 5 aa, Mycobacterium tuberculosis
ETSPR

SEQ ID NO: 1415471 - protein, 10 aa, Mycobacterium tuberculosis
ETSVAGEPIT

SEQ ID NO: 1415472 - protein, 5 aa, Mycobacterium tuberculosis
EVDSS

SEQ ID NO: 1415473 - protein, 8 aa, Mycobacterium tuberculosis
EVEGAGAT

SEQ ID NO: 1415474 - protein, 27 aa, Mycobacterium tuberculosis
EVPGDTGEYQPASGDHPETGVYSSPAE

SEQ ID NO: 1415475 - protein, 10 aa, Mycobacterium tuberculosis
EVPTATSVRA

SEQ ID NO: 1415476 - protein, 4 aa, Mycobacterium tuberculosis
EVTD

SEQ ID NO: 1415477 - protein, 5 aa, Mycobacterium tuberculosis
EWSDS

SEQ ID NO: 1415478 - protein, 10 aa, Mycobacterium tuberculosis
EWTPEGRLRQ

SEQ ID NO: 1415479 - protein, 14 aa, Mycobacterium tuberculosis
EYAGAAQGKWDPGN

SEQ ID NO: 1415480 - protein, 4 aa, Mycobacterium tuberculosis
EYGP

SEQ ID NO: 1415481 - protein, 14 aa, Mycobacterium tuberculosis
EYKANRSSTPDEFA

SEQ ID NO: 1415482 - protein, 12 aa, Mycobacterium tuberculosis
EYNAERQRRGGE

SEQ ID NO: 1415483 - protein, 6 aa, Mycobacterium tuberculosis
EYNGSI

SEQ ID NO: 1415484 - protein, 8 aa, Mycobacterium tuberculosis
EYNQDNDT

SEQ ID NO: 1415485 - protein, 4 aa, Mycobacterium tuberculosis
EYSR

SEQ ID NO: 1415486 - protein, 5 aa, Mycobacterium tuberculosis
FAPTR

SEQ ID NO: 1415487 - protein, 12 aa, Mycobacterium tuberculosis
FARPGARRSRED

SEQ ID NO: 1415488 - protein, 13 aa, Mycobacterium tuberculosis
FDDQGAKYDGDGN

SEQ ID NO: 1415489 - protein, 11 aa, Mycobacterium tuberculosis
FDNQSRRQTSF

SEQ ID NO: 1415490 - protein, 11 aa, Mycobacterium tuberculosis
FDPAAGHRCDP

SEQ ID NO: 1415491 - protein, 5 aa, Mycobacterium tuberculosis
FEASP

SEQ ID NO: 1415492 - protein, 16 aa, Mycobacterium tuberculosis
FERAAGRVRGQRWGPR

SEQ ID NO: 1415493 - protein, 6 aa, Mycobacterium tuberculosis
FERRSD

SEQ ID NO: 1415494 - protein, 17 aa, Mycobacterium tuberculosis
FESDSKYPYTPDGNREF

SEQ ID NO: 1415495 - protein, 10 aa, Mycobacterium tuberculosis
FESGEEGREQ

SEQ ID NO: 1415496 - protein, 8 aa, Mycobacterium tuberculosis
FGDPTGRH

SEQ ID NO: 1415497 - protein, 9 aa, Mycobacterium tuberculosis
FGEDPDVDA

SEQ ID NO: 1415498 - protein, 7 aa, Mycobacterium tuberculosis
FGEPGGR

SEQ ID NO: 1415499 - protein, 21 aa, Mycobacterium tuberculosis
FGGAEPRPYEPTDETAPQGVY

SEQ ID NO: 1415500 - protein, 8 aa, Mycobacterium tuberculosis
FGGAGGQH

SEQ ID NO: 1415501 - protein, 8 aa, Mycobacterium tuberculosis
FGGDPGNV

SEQ ID NO: 1415502 - protein, 20 aa, Mycobacterium tuberculosis
FGGGAASRGPIGRVRPGSDS

SEQ ID NO: 1415503 - protein, 18 aa, Mycobacterium tuberculosis
FGPKPQEPPPDPVPFPPY

SEQ ID NO: 1415504 - protein, 9 aa, Mycobacterium tuberculosis
FGQNTPAIA

SEQ ID NO: 1415505 - protein, 4 aa, Mycobacterium tuberculosis
FGSQ

SEQ ID NO: 1415506 - protein, 6 aa, Mycobacterium tuberculosis
FGVSGT

SEQ ID NO: 1415507 - protein, 20 aa, Mycobacterium tuberculosis
FGVSSSGGHPDGHRATRGAN

SEQ ID NO: 1415508 - protein, 5 aa, Mycobacterium tuberculosis
FHPSQ

SEQ ID NO: 1415509 - protein, 14 aa, Mycobacterium tuberculosis
FKPESDDVRDSPAL

SEQ ID NO: 1415510 - protein, 12 aa, Mycobacterium tuberculosis
FPAGPPDGYRER

SEQ ID NO: 1415511 - protein, 5 aa, Mycobacterium tuberculosis
FPRGA

SEQ ID NO: 1415512 - protein, 4 aa, Mycobacterium tuberculosis
FRSH

SEQ ID NO: 1415513 - protein, 11 aa, Mycobacterium tuberculosis
FRSPDSSGNPY

SEQ ID NO: 1415514 - protein, 4 aa, Mycobacterium tuberculosis
FRTE

SEQ ID NO: 1415515 - protein, 6 aa, Mycobacterium tuberculosis
FSDDEA

SEQ ID NO: 1415516 - protein, 8 aa, Mycobacterium tuberculosis
FSGRAQVG

SEQ ID NO: 1415517 - protein, 4 aa, Mycobacterium tuberculosis
FSHT

SEQ ID NO: 1415518 - protein, 17 aa, Mycobacterium tuberculosis
FSNPNQKATEDYISGRF

SEQ ID NO: 1415519 - protein, 9 aa, Mycobacterium tuberculosis
FSPGRDTPI

SEQ ID NO: 1415520 - protein, 16 aa, Mycobacterium tuberculosis
FSRPEPRHRAQRTVEE

SEQ ID NO: 1415521 - protein, 4 aa, Mycobacterium tuberculosis
FSSA

SEQ ID NO: 1415522 - protein, 9 aa, Mycobacterium tuberculosis
FSSAPTNHA

SEQ ID NO: 1415523 - protein, 12 aa, Mycobacterium tuberculosis
FSSTGAEWVGDR

SEQ ID NO: 1415524 - protein, 14 aa, Mycobacterium tuberculosis
FSSYTPAPATAGRS

SEQ ID NO: 1415525 - protein, 6 aa, Mycobacterium tuberculosis
FTAQTR

SEQ ID NO: 1415526 - protein, 15 aa, Mycobacterium tuberculosis
FTDGEPLDEDARPRQ

SEQ ID NO: 1415527 - protein, 8 aa, Mycobacterium tuberculosis
FTKSGGRL

SEQ ID NO: 1415528 - protein, 14 aa, Mycobacterium tuberculosis
FTPEATAEADGNLA

SEQ ID NO: 1415529 - protein, 6 aa, Mycobacterium tuberculosis
FTPSWG

SEQ ID NO: 1415530 - protein, 6 aa, Mycobacterium tuberculosis
FYPSTN

SEQ ID NO: 1415531 - protein, 11 aa, Mycobacterium tuberculosis
GAADGTAWSEG

SEQ ID NO: 1415532 - protein, 12 aa, Mycobacterium tuberculosis
GAAIGETEDERA

SEQ ID NO: 1415533 - protein, 13 aa, Mycobacterium tuberculosis
GAAITQGTVLAEI

SEQ ID NO: 1415534 - protein, 14 aa, Mycobacterium tuberculosis
GAAKSDFEMVEVAR

SEQ ID NO: 1415535 - protein, 14 aa, Mycobacterium tuberculosis
GAANEAAGPGPGSI

SEQ ID NO: 1415536 - protein, 8 aa, Mycobacterium tuberculosis
GAAQSEAL

SEQ ID NO: 1415537 - protein, 14 aa, Mycobacterium tuberculosis
GAASSAAPRAYRAA

SEQ ID NO: 1415538 - protein, 8 aa, Mycobacterium tuberculosis
GADEADAL

SEQ ID NO: 1415539 - protein, 8 aa, Mycobacterium tuberculosis
GADPPLGA

SEQ ID NO: 1415540 - protein, 11 aa, Mycobacterium tuberculosis
GADRADRLRTD

SEQ ID NO: 1415541 - protein, 9 aa, Mycobacterium tuberculosis
GAEDVNDLG

SEQ ID NO: 1415542 - protein, 5 aa, Mycobacterium tuberculosis
GAEPM

SEQ ID NO: 1415543 - protein, 6 aa, Mycobacterium tuberculosis
GAEPQH

SEQ ID NO: 1415544 - protein, 9 aa, Mycobacterium tuberculosis
GAGAGNAPV

SEQ ID NO: 1415545 - protein, 10 aa, Mycobacterium tuberculosis
GAGARAPQIA

SEQ ID NO: 1415546 - protein, 9 aa, Mycobacterium tuberculosis
GAGDYLPPY

SEQ ID NO: 1415547 - protein, 6 aa, Mycobacterium tuberculosis
GAGERK

SEQ ID NO: 1415548 - protein, 6 aa, Mycobacterium tuberculosis
GAGGHA

SEQ ID NO: 1415549 - protein, 5 aa, Mycobacterium tuberculosis
GAGGL

SEQ ID NO: 1415550 - protein, 8 aa, Mycobacterium tuberculosis
GAGRARDD

SEQ ID NO: 1415551 - protein, 5 aa, Mycobacterium tuberculosis
GAGRI

SEQ ID NO: 1415552 - protein, 16 aa, Mycobacterium tuberculosis
GAGSPPPQSDSSTDGL

SEQ ID NO: 1415553 - protein, 8 aa, Mycobacterium tuberculosis
GAGTDPES

SEQ ID NO: 1415554 - protein, 19 aa, Mycobacterium tuberculosis
GAHSDTTAPAGGSTPIYEP

SEQ ID NO: 1415555 - protein, 5 aa, Mycobacterium tuberculosis
GAHSP

SEQ ID NO: 1415556 - protein, 14 aa, Mycobacterium tuberculosis
GAHSYPDAARTDAE

SEQ ID NO: 1415557 - protein, 15 aa, Mycobacterium tuberculosis
GAKIGSKGRPLPGAG

SEQ ID NO: 1415558 - protein, 8 aa, Mycobacterium tuberculosis
GANLGYGT

SEQ ID NO: 1415559 - protein, 13 aa, Mycobacterium tuberculosis
GANNPARSGFENA

SEQ ID NO: 1415560 - protein, 9 aa, Mycobacterium tuberculosis
GANNVGNGN

SEQ ID NO: 1415561 - protein, 12 aa, Mycobacterium tuberculosis
GANSAIPHHRPT

SEQ ID NO: 1415562 - protein, 26 aa, Mycobacterium tuberculosis
GAPALAATRKGRSDRSAARGGSARTT

SEQ ID NO: 1415563 - protein, 6 aa, Mycobacterium tuberculosis
GAPGDG

SEQ ID NO: 1415564 - protein, 17 aa, Mycobacterium tuberculosis
GAPPSAVGGGGGAPKGW

SEQ ID NO: 1415565 - protein, 16 aa, Mycobacterium tuberculosis
GAQLGTIGAQGESADG

SEQ ID NO: 1415566 - protein, 6 aa, Mycobacterium tuberculosis
GAQNPR

SEQ ID NO: 1415567 - protein, 5 aa, Mycobacterium tuberculosis
GARAD

SEQ ID NO: 1415568 - protein, 8 aa, Mycobacterium tuberculosis
GARDADTV

SEQ ID NO: 1415569 - protein, 8 aa, Mycobacterium tuberculosis
GARDGRTV

SEQ ID NO: 1415570 - protein, 5 aa, Mycobacterium tuberculosis
GARRC

SEQ ID NO: 1415571 - protein, 8 aa, Mycobacterium tuberculosis
GASADEGR

SEQ ID NO: 1415572 - protein, 6 aa, Mycobacterium tuberculosis
GASAVA

SEQ ID NO: 1415573 - protein, 15 aa, Mycobacterium tuberculosis
GASSAFGGPCRTSTA

SEQ ID NO: 1415574 - protein, 17 aa, Mycobacterium tuberculosis
GASSGIGAATATELAGR

SEQ ID NO: 1415575 - protein, 5 aa, Mycobacterium tuberculosis
GASVE

SEQ ID NO: 1415576 - protein, 11 aa, Mycobacterium tuberculosis
GATADALPPRR

SEQ ID NO: 1415577 - protein, 8 aa, Mycobacterium tuberculosis
GATGPALG

SEQ ID NO: 1415578 - protein, 11 aa, Mycobacterium tuberculosis
GATGSRLVTGD

SEQ ID NO: 1415579 - protein, 5 aa, Mycobacterium tuberculosis
GATPR

SEQ ID NO: 1415580 - protein, 4 aa, Mycobacterium tuberculosis
GATR

SEQ ID NO: 1415581 - protein, 5 aa, Mycobacterium tuberculosis
GAVHR

SEQ ID NO: 1415582 - protein, 5 aa, Mycobacterium tuberculosis
GAVRK

SEQ ID NO: 1415583 - protein, 6 aa, Mycobacterium tuberculosis
GDANGA

SEQ ID NO: 1415584 - protein, 5 aa, Mycobacterium tuberculosis
GDDAT

SEQ ID NO: 1415585 - protein, 7 aa, Mycobacterium tuberculosis
GDDDNEA

SEQ ID NO: 1415586 - protein, 9 aa, Mycobacterium tuberculosis
GDDNSPTFN

SEQ ID NO: 1415587 - protein, 6 aa, Mycobacterium tuberculosis
GDDPYG

SEQ ID NO: 1415588 - protein, 6 aa, Mycobacterium tuberculosis
GDGADI

SEQ ID NO: 1415589 - protein, 9 aa, Mycobacterium tuberculosis
GDGLGGSSF

SEQ ID NO: 1415590 - protein, 6 aa, Mycobacterium tuberculosis
GDGTDA

SEQ ID NO: 1415591 - protein, 18 aa, Mycobacterium tuberculosis
GDINTGFGNAGDTNTGFG

SEQ ID NO: 1415592 - protein, 6 aa, Mycobacterium tuberculosis
GDKVSV

SEQ ID NO: 1415593 - protein, 11 aa, Mycobacterium tuberculosis
GDLADQESLGK

SEQ ID NO: 1415594 - protein, 10 aa, Mycobacterium tuberculosis
GDLDKVTGKR

SEQ ID NO: 1415595 - protein, 8 aa, Mycobacterium tuberculosis
GDLDPAAV

SEQ ID NO: 1415596 - protein, 8 aa, Mycobacterium tuberculosis
GDLPAEAH

SEQ ID NO: 1415597 - protein, 5 aa, Mycobacterium tuberculosis
GDNQV

SEQ ID NO: 1415598 - protein, 8 aa, Mycobacterium tuberculosis
GDPDEEFS

SEQ ID NO: 1415599 - protein, 11 aa, Mycobacterium tuberculosis
GDPGSRATEMG

SEQ ID NO: 1415600 - protein, 7 aa, Mycobacterium tuberculosis
GDPRLPQ

SEQ ID NO: 1415601 - protein, 9 aa, Mycobacterium tuberculosis
GDPSVPSGV

SEQ ID NO: 1415602 - protein, 9 aa, Mycobacterium tuberculosis
GDPTAWPGL

SEQ ID NO: 1415603 - protein, 5 aa, Mycobacterium tuberculosis
GDPWT

SEQ ID NO: 1415604 - protein, 8 aa, Mycobacterium tuberculosis
GDRGLKGA

SEQ ID NO: 1415605 - protein, 6 aa, Mycobacterium tuberculosis
GDRNGA

SEQ ID NO: 1415606 - protein, 7 aa, Mycobacterium tuberculosis
GDRPVQV

SEQ ID NO: 1415607 - protein, 7 aa, Mycobacterium tuberculosis
GDRVEAG

SEQ ID NO: 1415608 - protein, 8 aa, Mycobacterium tuberculosis
GDSDAEAE

SEQ ID NO: 1415609 - protein, 7 aa, Mycobacterium tuberculosis
GDSTKLR

SEQ ID NO: 1415610 - protein, 7 aa, Mycobacterium tuberculosis
GDSYRLK

SEQ ID NO: 1415611 - protein, 8 aa, Mycobacterium tuberculosis
GDVGNTAE

SEQ ID NO: 1415612 - protein, 5 aa, Mycobacterium tuberculosis
GEATA

SEQ ID NO: 1415613 - protein, 9 aa, Mycobacterium tuberculosis
GEDPDRDGL

SEQ ID NO: 1415614 - protein, 6 aa, Mycobacterium tuberculosis
GEEGEV

SEQ ID NO: 1415615 - protein, 13 aa, Mycobacterium tuberculosis
GEGGGTGTGGAPV

SEQ ID NO: 1415616 - protein, 4 aa, Mycobacterium tuberculosis
GEGP

SEQ ID NO: 1415617 - protein, 9 aa, Mycobacterium tuberculosis
GEGRGAELG

SEQ ID NO: 1415618 - protein, 9 aa, Mycobacterium tuberculosis
GEIDPATVH

SEQ ID NO: 1415619 - protein, 5 aa, Mycobacterium tuberculosis
GEIER

SEQ ID NO: 1415620 - protein, 7 aa, Mycobacterium tuberculosis
GEKMSKS

SEQ ID NO: 1415621 - protein, 18 aa, Mycobacterium tuberculosis
GEKPGEPSWPTPWGRGRP

SEQ ID NO: 1415622 - protein, 11 aa, Mycobacterium tuberculosis
GELARAGADGV

SEQ ID NO: 1415623 - protein, 12 aa, Mycobacterium tuberculosis
GELTGSGRITTE

SEQ ID NO: 1415624 - protein, 9 aa, Mycobacterium tuberculosis
GEPIGPKAL

SEQ ID NO: 1415625 - protein, 12 aa, Mycobacterium tuberculosis
GEPLSAEQTARA

SEQ ID NO: 1415626 - protein, 4 aa, Mycobacterium tuberculosis
GEQG

SEQ ID NO: 1415627 - protein, 9 aa, Mycobacterium tuberculosis
GEQSRPLSE

SEQ ID NO: 1415628 - protein, 5 aa, Mycobacterium tuberculosis
GEQTQ

SEQ ID NO: 1415629 - protein, 6 aa, Mycobacterium tuberculosis
GERPHA

SEQ ID NO: 1415630 - protein, 5 aa, Mycobacterium tuberculosis
GERVE

SEQ ID NO: 1415631 - protein, 5 aa, Mycobacterium tuberculosis
GESLQ

SEQ ID NO: 1415632 - protein, 11 aa, Mycobacterium tuberculosis
GESPRRSPRRQ

SEQ ID NO: 1415633 - protein, 8 aa, Mycobacterium tuberculosis
GETAEQTA

SEQ ID NO: 1415634 - protein, 5 aa, Mycobacterium tuberculosis
GETPV

SEQ ID NO: 1415635 - protein, 6 aa, Mycobacterium tuberculosis
GEVEYV

SEQ ID NO: 1415636 - protein, 5 aa, Mycobacterium tuberculosis
GEVSA

SEQ ID NO: 1415637 - protein, 6 aa, Mycobacterium tuberculosis
GEYDER

SEQ ID NO: 1415638 - protein, 6 aa, Mycobacterium tuberculosis
GEYKSA

SEQ ID NO: 1415639 - protein, 10 aa, Mycobacterium tuberculosis
GFDPQRPSAW

SEQ ID NO: 1415640 - protein, 5 aa, Mycobacterium tuberculosis
GFDPR

SEQ ID NO: 1415641 - protein, 9 aa, Mycobacterium tuberculosis
GFGGPDTFG

SEQ ID NO: 1415642 - protein, 30 aa, Mycobacterium tuberculosis
GFGNTGDANTGGGNTGNGNIGGGNTGNNNF

SEQ ID NO: 1415643 - protein, 6 aa, Mycobacterium tuberculosis
GFTPRQ

SEQ ID NO: 1415644 - protein, 7 aa, Mycobacterium tuberculosis
GFTSDGL

SEQ ID NO: 1415645 - protein, 19 aa, Mycobacterium tuberculosis
GGAAVGESATEEPMPDASN

SEQ ID NO: 1415646 - protein, 5 aa, Mycobacterium tuberculosis
GGAGL

SEQ ID NO: 1415647 - protein, 37 aa, Mycobacterium tuberculosis
GGAGYTGGNGGSAGLIGNGGTGGAGFAGGVGGMGGTG

SEQ ID NO: 1415648 - protein, 4 aa, Mycobacterium tuberculosis
GGAL

SEQ ID NO: 1415649 - protein, 8 aa, Mycobacterium tuberculosis
GGAPQVNA

SEQ ID NO: 1415650 - protein, 8 aa, Mycobacterium tuberculosis
GGAPRLPS

SEQ ID NO: 1415651 - protein, 6 aa, Mycobacterium tuberculosis
GGARGI

SEQ ID NO: 1415652 - protein, 7 aa, Mycobacterium tuberculosis
GGARLRE

SEQ ID NO: 1415653 - protein, 9 aa, Mycobacterium tuberculosis
GGASGLGLA

SEQ ID NO: 1415654 - protein, 5 aa, Mycobacterium tuberculosis
GGATA

SEQ ID NO: 1415655 - protein, 5 aa, Mycobacterium tuberculosis
GGDDG

SEQ ID NO: 1415656 - protein, 5 aa, Mycobacterium tuberculosis
GGDEA

SEQ ID NO: 1415657 - protein, 14 aa, Mycobacterium tuberculosis
GGDKVPRKGGPGVT

SEQ ID NO: 1415658 - protein, 15 aa, Mycobacterium tuberculosis
GGDPTGTGRGGPGYK

SEQ ID NO: 1415659 - protein, 4 aa, Mycobacterium tuberculosis
GGEL

SEQ ID NO: 1415660 - protein, 9 aa, Mycobacterium tuberculosis
GGENISPRE

SEQ ID NO: 1415661 - protein, 8 aa, Mycobacterium tuberculosis
GGFDAAEP

SEQ ID NO: 1415662 - protein, 4 aa, Mycobacterium tuberculosis
GGFP

SEQ ID NO: 1415663 - protein, 10 aa, Mycobacterium tuberculosis
GGGAPSLAEA

SEQ ID NO: 1415664 - protein, 5 aa, Mycobacterium tuberculosis
GGGHV

SEQ ID NO: 1415665 - protein, 9 aa, Mycobacterium tuberculosis
GGGSPRDTL

SEQ ID NO: 1415666 - protein, 4 aa, Mycobacterium tuberculosis
GGIG

SEQ ID NO: 1415667 - protein, 7 aa, Mycobacterium tuberculosis
GGKPITG

SEQ ID NO: 1415668 - protein, 6 aa, Mycobacterium tuberculosis
GGKSPN

SEQ ID NO: 1415669 - protein, 13 aa, Mycobacterium tuberculosis
GGKVAAGETERAA

SEQ ID NO: 1415670 - protein, 5 aa, Mycobacterium tuberculosis
GGLAQ

SEQ ID NO: 1415671 - protein, 27 aa, Mycobacterium tuberculosis
GGLGGNGGAATQIGGNGGNGGHGGNAG

SEQ ID NO: 1415672 - protein, 10 aa, Mycobacterium tuberculosis
GGMAGGSADA

SEQ ID NO: 1415673 - protein, 13 aa, Mycobacterium tuberculosis
GGNPGTGKSTLAR

SEQ ID NO: 1415674 - protein, 4 aa, Mycobacterium tuberculosis
GGNT

SEQ ID NO: 1415675 - protein, 9 aa, Mycobacterium tuberculosis
GGPEGPEQV

SEQ ID NO: 1415676 - protein, 4 aa, Mycobacterium tuberculosis
GGPK

SEQ ID NO: 1415677 - protein, 16 aa, Mycobacterium tuberculosis
GGPVAAGLGNAASVGK

SEQ ID NO: 1415678 - protein, 25 aa, Mycobacterium tuberculosis
GGQAPALSRLGGSDWANTKTKARRA

SEQ ID NO: 1415679 - protein, 8 aa, Mycobacterium tuberculosis
GGQESMTK

SEQ ID NO: 1415680 - protein, 6 aa, Mycobacterium tuberculosis
GGQGFG

SEQ ID NO: 1415681 - protein, 10 aa, Mycobacterium tuberculosis
GGQTPTSPLR

SEQ ID NO: 1415682 - protein, 8 aa, Mycobacterium tuberculosis
GGQTSAES

SEQ ID NO: 1415683 - protein, 9 aa, Mycobacterium tuberculosis
GGRAGGHHS

SEQ ID NO: 1415684 - protein, 19 aa, Mycobacterium tuberculosis
GGRGYETAESLAARGERAV

SEQ ID NO: 1415685 - protein, 6 aa, Mycobacterium tuberculosis
GGRTVG

SEQ ID NO: 1415686 - protein, 7 aa, Mycobacterium tuberculosis
GGSAGAH

SEQ ID NO: 1415687 - protein, 6 aa, Mycobacterium tuberculosis
GGSARL

SEQ ID NO: 1415688 - protein, 5 aa, Mycobacterium tuberculosis
GGSAV

SEQ ID NO: 1415689 - protein, 6 aa, Mycobacterium tuberculosis
GGSCGR

SEQ ID NO: 1415690 - protein, 10 aa, Mycobacterium tuberculosis
GGSGALAGHP

SEQ ID NO: 1415691 - protein, 7 aa, Mycobacterium tuberculosis
GGSGDDV

SEQ ID NO: 1415692 - protein, 4 aa, Mycobacterium tuberculosis
GGSL

SEQ ID NO: 1415693 - protein, 9 aa, Mycobacterium tuberculosis
GGSQTIGPI

SEQ ID NO: 1415694 - protein, 18 aa, Mycobacterium tuberculosis
GGSTNTGLANAGAGNTGF

SEQ ID NO: 1415695 - protein, 20 aa, Mycobacterium tuberculosis
GGSVNGHSDDSSGDAKQAAP

SEQ ID NO: 1415696 - protein, 8 aa, Mycobacterium tuberculosis
GGTFGGNP

SEQ ID NO: 1415697 - protein, 4 aa, Mycobacterium tuberculosis
GGTV

SEQ ID NO: 1415698 - protein, 6 aa, Mycobacterium tuberculosis
GGVDSA

SEQ ID NO: 1415699 - protein, 10 aa, Mycobacterium tuberculosis
GGVDSTALYP

SEQ ID NO: 1415700 - protein, 10 aa, Mycobacterium tuberculosis
GGVGKTTTAA

SEQ ID NO: 1415701 - protein, 6 aa, Mycobacterium tuberculosis
GGVRDT

SEQ ID NO: 1415702 - protein, 18 aa, Mycobacterium tuberculosis
GGVSGVDDAGVERVKVTS

SEQ ID NO: 1415703 - protein, 4 aa, Mycobacterium tuberculosis
GGWD

SEQ ID NO: 1415704 - protein, 8 aa, Mycobacterium tuberculosis
GGYRVGAG

SEQ ID NO: 1415705 - protein, 5 aa, Mycobacterium tuberculosis
GGYYG

SEQ ID NO: 1415706 - protein, 12 aa, Mycobacterium tuberculosis
GHAPDPARARPL

SEQ ID NO: 1415707 - protein, 11 aa, Mycobacterium tuberculosis
GHGPVTGPDGI

SEQ ID NO: 1415708 - protein, 14 aa, Mycobacterium tuberculosis
GHGYGDLKKDTAEA

SEQ ID NO: 1415709 - protein, 13 aa, Mycobacterium tuberculosis
GHPPYGHNGERAL

SEQ ID NO: 1415710 - protein, 16 aa, Mycobacterium tuberculosis
GHTNTGIANSGNVGTG

SEQ ID NO: 1415711 - protein, 20 aa, Mycobacterium tuberculosis
GHTRAAPHLGDEPMDEKPSW

SEQ ID NO: 1415712 - protein, 5 aa, Mycobacterium tuberculosis
GHTRG

SEQ ID NO: 1415713 - protein, 11 aa, Mycobacterium tuberculosis
GIAGEGNKEID

SEQ ID NO: 1415714 - protein, 10 aa, Mycobacterium tuberculosis
GIDDHSRTFN

SEQ ID NO: 1415715 - protein, 8 aa, Mycobacterium tuberculosis
GIDELTGD

SEQ ID NO: 1415716 - protein, 11 aa, Mycobacterium tuberculosis
GIGENDAAVRR

SEQ ID NO: 1415717 - protein, 41 aa, Mycobacterium tuberculosis
GIGRKSATRKSKGAKGKSGKKSKKGTRGPTPPKVKSPFGVP

SEQ ID NO: 1415718 - protein, 9 aa, Mycobacterium tuberculosis
GIGTPRRAA

SEQ ID NO: 1415719 - protein, 13 aa, Mycobacterium tuberculosis
GIQRAKAAELRER

SEQ ID NO: 1415720 - protein, 6 aa, Mycobacterium tuberculosis
GIRKST

SEQ ID NO: 1415721 - protein, 22 aa, Mycobacterium tuberculosis
GIRSSSTNDPQRPSPPAQEASP

SEQ ID NO: 1415722 - protein, 18 aa, Mycobacterium tuberculosis
GIRSTGRWRGRPKNQDAY

SEQ ID NO: 1415723 - protein, 7 aa, Mycobacterium tuberculosis
GISRASS

SEQ ID NO: 1415724 - protein, 8 aa, Mycobacterium tuberculosis
GITEPAGL

SEQ ID NO: 1415725 - protein, 6 aa, Mycobacterium tuberculosis
GKADTV

SEQ ID NO: 1415726 - protein, 7 aa, Mycobacterium tuberculosis
GKGEAKD

SEQ ID NO: 1415727 - protein, 7 aa, Mycobacterium tuberculosis
GKGKRIA

SEQ ID NO: 1415728 - protein, 9 aa, Mycobacterium tuberculosis
GKGPGATSI

SEQ ID NO: 1415729 - protein, 8 aa, Mycobacterium tuberculosis
GKLGSEPA

SEQ ID NO: 1415730 - protein, 7 aa, Mycobacterium tuberculosis
GKLTNTA

SEQ ID NO: 1415731 - protein, 7 aa, Mycobacterium tuberculosis
GKPFKKE

SEQ ID NO: 1415732 - protein, 7 aa, Mycobacterium tuberculosis
GKPLADA

SEQ ID NO: 1415733 - protein, 31 aa, Mycobacterium tuberculosis
GKPLQSVAKGEVDLSSEEDTSEAEREERQKE

SEQ ID NO: 1415734 - protein, 5 aa, Mycobacterium tuberculosis
GKRIS

SEQ ID NO: 1415735 - protein, 6 aa, Mycobacterium tuberculosis
GKSVVT

SEQ ID NO: 1415736 - protein, 9 aa, Mycobacterium tuberculosis
GKTLSDPNR

SEQ ID NO: 1415737 - protein, 14 aa, Mycobacterium tuberculosis
GKYSSSRGPSFSSY

SEQ ID NO: 1415738 - protein, 9 aa, Mycobacterium tuberculosis
GLDDQGGTA

SEQ ID NO: 1415739 - protein, 9 aa, Mycobacterium tuberculosis
GLETATTAR

SEQ ID NO: 1415740 - protein, 16 aa, Mycobacterium tuberculosis
GLGGADRKIEQALKPG

SEQ ID NO: 1415741 - protein, 11 aa, Mycobacterium tuberculosis
GLGGQTPVADM

SEQ ID NO: 1415742 - protein, 6 aa, Mycobacterium tuberculosis
GLGRTA

SEQ ID NO: 1415743 - protein, 4 aa, Mycobacterium tuberculosis
GLKR

SEQ ID NO: 1415744 - protein, 10 aa, Mycobacterium tuberculosis
GLQPSHNPQV

SEQ ID NO: 1415745 - protein, 10 aa, Mycobacterium tuberculosis
GLRSPDTARS

SEQ ID NO: 1415746 - protein, 11 aa, Mycobacterium tuberculosis
GLSDARDRQVR

SEQ ID NO: 1415747 - protein, 18 aa, Mycobacterium tuberculosis
GLSDDERAQMLPSGRQRT

SEQ ID NO: 1415748 - protein, 7 aa, Mycobacterium tuberculosis
GLSNKDI

SEQ ID NO: 1415749 - protein, 7 aa, Mycobacterium tuberculosis
GLTPTEV

SEQ ID NO: 1415750 - protein, 6 aa, Mycobacterium tuberculosis
GLTTGE

SEQ ID NO: 1415751 - protein, 5 aa, Mycobacterium tuberculosis
GMGGT

SEQ ID NO: 1415752 - protein, 4 aa, Mycobacterium tuberculosis
GMSN

SEQ ID NO: 1415753 - protein, 12 aa, Mycobacterium tuberculosis
GMSRRASRRRAE

SEQ ID NO: 1415754 - protein, 10 aa, Mycobacterium tuberculosis
GNAPESQYNT

SEQ ID NO: 1415755 - protein, 10 aa, Mycobacterium tuberculosis
GNETTRNSIT

SEQ ID NO: 1415756 - protein, 13 aa, Mycobacterium tuberculosis
GNGLKDPDTALKD

SEQ ID NO: 1415757 - protein, 18 aa, Mycobacterium tuberculosis
GNGTNGAPGTGQAGGPGG

SEQ ID NO: 1415758 - protein, 14 aa, Mycobacterium tuberculosis
GNHENEVGNGPIGY

SEQ ID NO: 1415759 - protein, 13 aa, Mycobacterium tuberculosis
GNKSRAIAAAREA

SEQ ID NO: 1415760 - protein, 4 aa, Mycobacterium tuberculosis
GNNN

SEQ ID NO: 1415761 - protein, 6 aa, Mycobacterium tuberculosis
GNNQVG

SEQ ID NO: 1415762 - protein, 15 aa, Mycobacterium tuberculosis
GNPASHQDDSHSTGL

SEQ ID NO: 1415763 - protein, 20 aa, Mycobacterium tuberculosis
GNSRETAKSIARGRPDLPGP

SEQ ID NO: 1415764 - protein, 7 aa, Mycobacterium tuberculosis
GNVGGQN

SEQ ID NO: 1415765 - protein, 14 aa, Mycobacterium tuberculosis
GNVNTGAFNSGSFN

SEQ ID NO: 1415766 - protein, 6 aa, Mycobacterium tuberculosis
GPALAA

SEQ ID NO: 1415767 - protein, 15 aa, Mycobacterium tuberculosis
GPDETPPQGWEQDPD

SEQ ID NO: 1415768 - protein, 5 aa, Mycobacterium tuberculosis
GPDGV

SEQ ID NO: 1415769 - protein, 6 aa, Mycobacterium tuberculosis
GPDLGG

SEQ ID NO: 1415770 - protein, 10 aa, Mycobacterium tuberculosis
GPDTTNLGEE

SEQ ID NO: 1415771 - protein, 10 aa, Mycobacterium tuberculosis
GPDVPTLSQA

SEQ ID NO: 1415772 - protein, 6 aa, Mycobacterium tuberculosis
GPGPFT

SEQ ID NO: 1415773 - protein, 7 aa, Mycobacterium tuberculosis
GPGVTDH

SEQ ID NO: 1415774 - protein, 9 aa, Mycobacterium tuberculosis
GPLHGGAPA

SEQ ID NO: 1415775 - protein, 10 aa, Mycobacterium tuberculosis
GPNGAGKSTA

SEQ ID NO: 1415776 - protein, 11 aa, Mycobacterium tuberculosis
GPNGAGKTTTV

SEQ ID NO: 1415777 - protein, 11 aa, Mycobacterium tuberculosis
GPNGSGKSTLS

SEQ ID NO: 1415778 - protein, 6 aa, Mycobacterium tuberculosis
GPPPAT

SEQ ID NO: 1415779 - protein, 7 aa, Mycobacterium tuberculosis
GPREQAI

SEQ ID NO: 1415780 - protein, 8 aa, Mycobacterium tuberculosis
GPSAVGKS

SEQ ID NO: 1415781 - protein, 13 aa, Mycobacterium tuberculosis
GPSGDQPLDAGTV

SEQ ID NO: 1415782 - protein, 6 aa, Mycobacterium tuberculosis
GPTISA

SEQ ID NO: 1415783 - protein, 4 aa, Mycobacterium tuberculosis
GPTL

SEQ ID NO: 1415784 - protein, 9 aa, Mycobacterium tuberculosis
GPTLPDGLA

SEQ ID NO: 1415785 - protein, 10 aa, Mycobacterium tuberculosis
GPVDDDAEVR

SEQ ID NO: 1415786 - protein, 12 aa, Mycobacterium tuberculosis
GPVRGANDQRWA

SEQ ID NO: 1415787 - protein, 9 aa, Mycobacterium tuberculosis
GPYGPVNPD

SEQ ID NO: 1415788 - protein, 9 aa, Mycobacterium tuberculosis
GQAGPDTLV

SEQ ID NO: 1415789 - protein, 6 aa, Mycobacterium tuberculosis
GQARGV

SEQ ID NO: 1415790 - protein, 5 aa, Mycobacterium tuberculosis
GQDDL

SEQ ID NO: 1415791 - protein, 5 aa, Mycobacterium tuberculosis
GQDGV

SEQ ID NO: 1415792 - protein, 8 aa, Mycobacterium tuberculosis
GQDPDKLP

SEQ ID NO: 1415793 - protein, 4 aa, Mycobacterium tuberculosis
GQGC

SEQ ID NO: 1415794 - protein, 5 aa, Mycobacterium tuberculosis
GQGIP

SEQ ID NO: 1415795 - protein, 7 aa, Mycobacterium tuberculosis
GQHPGSA

SEQ ID NO: 1415796 - protein, 14 aa, Mycobacterium tuberculosis
GQNTPAIATSEAQY

SEQ ID NO: 1415797 - protein, 14 aa, Mycobacterium tuberculosis
GQNTSAIAAAEAQY

SEQ ID NO: 1415798 - protein, 7 aa, Mycobacterium tuberculosis
GQPLPST

SEQ ID NO: 1415799 - protein, 14 aa, Mycobacterium tuberculosis
GQRNKYEVDHETGR

SEQ ID NO: 1415800 - protein, 5 aa, Mycobacterium tuberculosis
GQRSE

SEQ ID NO: 1415801 - protein, 5 aa, Mycobacterium tuberculosis
GQSGA

SEQ ID NO: 1415802 - protein, 4 aa, Mycobacterium tuberculosis
GQSI

SEQ ID NO: 1415803 - protein, 7 aa, Mycobacterium tuberculosis
GQSLTPE

SEQ ID NO: 1415804 - protein, 6 aa, Mycobacterium tuberculosis
GQTDSE

SEQ ID NO: 1415805 - protein, 7 aa, Mycobacterium tuberculosis
GRAAEAA

SEQ ID NO: 1415806 - protein, 12 aa, Mycobacterium tuberculosis
GRADREAAKTRL

SEQ ID NO: 1415807 - protein, 9 aa, Mycobacterium tuberculosis
GRAPRTDDI

SEQ ID NO: 1415808 - protein, 13 aa, Mycobacterium tuberculosis
GRDAVSDFPADRG

SEQ ID NO: 1415809 - protein, 15 aa, Mycobacterium tuberculosis
GRDPEQSFSATDLMR

SEQ ID NO: 1415810 - protein, 7 aa, Mycobacterium tuberculosis
GRDPYPV

SEQ ID NO: 1415811 - protein, 9 aa, Mycobacterium tuberculosis
GREAAGSID

SEQ ID NO: 1415812 - protein, 5 aa, Mycobacterium tuberculosis
GRENP

SEQ ID NO: 1415813 - protein, 4 aa, Mycobacterium tuberculosis
GRES

SEQ ID NO: 1415814 - protein, 10 aa, Mycobacterium tuberculosis
GREVDRSPAD

SEQ ID NO: 1415815 - protein, 9 aa, Mycobacterium tuberculosis
GREVNTAGD

SEQ ID NO: 1415816 - protein, 7 aa, Mycobacterium tuberculosis
GRGAGPL

SEQ ID NO: 1415817 - protein, 6 aa, Mycobacterium tuberculosis
GRGDGG

SEQ ID NO: 1415818 - protein, 7 aa, Mycobacterium tuberculosis
GRGFSSG

SEQ ID NO: 1415819 - protein, 5 aa, Mycobacterium tuberculosis
GRGGV

SEQ ID NO: 1415820 - protein, 7 aa, Mycobacterium tuberculosis
GRGSQWA

SEQ ID NO: 1415821 - protein, 4 aa, Mycobacterium tuberculosis
GRHN

SEQ ID NO: 1415822 - protein, 6 aa, Mycobacterium tuberculosis
GRIDEA

SEQ ID NO: 1415823 - protein, 7 aa, Mycobacterium tuberculosis
GRNAPTV

SEQ ID NO: 1415824 - protein, 8 aa, Mycobacterium tuberculosis
GRNSTLDS

SEQ ID NO: 1415825 - protein, 9 aa, Mycobacterium tuberculosis
GRPADGPPA

SEQ ID NO: 1415826 - protein, 7 aa, Mycobacterium tuberculosis
GRPAEAD

SEQ ID NO: 1415827 - protein, 6 aa, Mycobacterium tuberculosis
GRPDDT

SEQ ID NO: 1415828 - protein, 7 aa, Mycobacterium tuberculosis
GRPDRRI

SEQ ID NO: 1415829 - protein, 11 aa, Mycobacterium tuberculosis
GRPGISTEPEA

SEQ ID NO: 1415830 - protein, 5 aa, Mycobacterium tuberculosis
GRPHW

SEQ ID NO: 1415831 - protein, 14 aa, Mycobacterium tuberculosis
GRPSAEDVDPDTEF

SEQ ID NO: 1415832 - protein, 4 aa, Mycobacterium tuberculosis
GRPV

SEQ ID NO: 1415833 - protein, 19 aa, Mycobacterium tuberculosis
GRRPGQSQVPDRCTPRVTD

SEQ ID NO: 1415834 - protein, 23 aa, Mycobacterium tuberculosis
GRRRRPLPTGLGRPSADPSGELV

SEQ ID NO: 1415835 - protein, 7 aa, Mycobacterium tuberculosis
GRRTQFD

SEQ ID NO: 1415836 - protein, 5 aa, Mycobacterium tuberculosis
GRSPW

SEQ ID NO: 1415837 - protein, 6 aa, Mycobacterium tuberculosis
GRSVRS

SEQ ID NO: 1415838 - protein, 9 aa, Mycobacterium tuberculosis
GRTARLEEE

SEQ ID NO: 1415839 - protein, 13 aa, Mycobacterium tuberculosis
GRTDRDTRNGRKQ

SEQ ID NO: 1415840 - protein, 9 aa, Mycobacterium tuberculosis
GRTHPTVAA

SEQ ID NO: 1415841 - protein, 10 aa, Mycobacterium tuberculosis
GRTNYRNPAT

SEQ ID NO: 1415842 - protein, 9 aa, Mycobacterium tuberculosis
GRTPKAFGR

SEQ ID NO: 1415843 - protein, 7 aa, Mycobacterium tuberculosis
GRVKRDD

SEQ ID NO: 1415844 - protein, 11 aa, Mycobacterium tuberculosis
GRVSDSGEGRW

SEQ ID NO: 1415845 - protein, 4 aa, Mycobacterium tuberculosis
GRWP

SEQ ID NO: 1415846 - protein, 23 aa, Mycobacterium tuberculosis
GSAAARAVKGDVEKSLKQFAELY

SEQ ID NO: 1415847 - protein, 12 aa, Mycobacterium tuberculosis
GSAAGNSPIPYN

SEQ ID NO: 1415848 - protein, 16 aa, Mycobacterium tuberculosis
GSAPDIAGQGIADPTA

SEQ ID NO: 1415849 - protein, 7 aa, Mycobacterium tuberculosis
GSATALA

SEQ ID NO: 1415850 - protein, 7 aa, Mycobacterium tuberculosis
GSATVHG

SEQ ID NO: 1415851 - protein, 9 aa, Mycobacterium tuberculosis
GSDTGGSIR

SEQ ID NO: 1415852 - protein, 5 aa, Mycobacterium tuberculosis
GSGAL

SEQ ID NO: 1415853 - protein, 8 aa, Mycobacterium tuberculosis
GSGDDSLA

SEQ ID NO: 1415854 - protein, 9 aa, Mycobacterium tuberculosis
GSGDSAVPR

SEQ ID NO: 1415855 - protein, 36 aa, Mycobacterium tuberculosis
GSGNGNVGIGPSSFNVGSGNIGNANVGGGNSGDNNF

SEQ ID NO: 1415856 - protein, 7 aa, Mycobacterium tuberculosis
GSGPDPL

SEQ ID NO: 1415857 - protein, 7 aa, Mycobacterium tuberculosis
GSKEARI

SEQ ID NO: 1415858 - protein, 6 aa, Mycobacterium tuberculosis
GSLAGT

SEQ ID NO: 1415859 - protein, 7 aa, Mycobacterium tuberculosis
GSLESDA

SEQ ID NO: 1415860 - protein, 7 aa, Mycobacterium tuberculosis
GSPAFTA

SEQ ID NO: 1415861 - protein, 13 aa, Mycobacterium tuberculosis
GSPTDTRGLDDHE

SEQ ID NO: 1415862 - protein, 10 aa, Mycobacterium tuberculosis
GSRDEGATVA

SEQ ID NO: 1415863 - protein, 8 aa, Mycobacterium tuberculosis
GSSDPHRI

SEQ ID NO: 1415864 - protein, 6 aa, Mycobacterium tuberculosis
GSSNTV

SEQ ID NO: 1415865 - protein, 16 aa, Mycobacterium tuberculosis
GSTIGTANAAAAVPTT

SEQ ID NO: 1415866 - protein, 35 aa, Mycobacterium tuberculosis
GSTTGASAATSTAAATAAATNALRGANVGPGANKA

SEQ ID NO: 1415867 - protein, 13 aa, Mycobacterium tuberculosis
GSVAHADAPGRVR

SEQ ID NO: 1415868 - protein, 4 aa, Mycobacterium tuberculosis
GSWP

SEQ ID NO: 1415869 - protein, 12 aa, Mycobacterium tuberculosis
GSYNTGIGNSGI

SEQ ID NO: 1415870 - protein, 5 aa, Mycobacterium tuberculosis
GSYSA

SEQ ID NO: 1415871 - protein, 7 aa, Mycobacterium tuberculosis
GTAGQRC

SEQ ID NO: 1415872 - protein, 7 aa, Mycobacterium tuberculosis
GTAGTAT

SEQ ID NO: 1415873 - protein, 10 aa, Mycobacterium tuberculosis
GTAPENGYSA

SEQ ID NO: 1415874 - protein, 14 aa, Mycobacterium tuberculosis
GTAVGTGLNAPDDF

SEQ ID NO: 1415875 - protein, 7 aa, Mycobacterium tuberculosis
GTAYTEV

SEQ ID NO: 1415876 - protein, 5 aa, Mycobacterium tuberculosis
GTDEQ

SEQ ID NO: 1415877 - protein, 8 aa, Mycobacterium tuberculosis
GTDNQKQR

SEQ ID NO: 1415878 - protein, 7 aa, Mycobacterium tuberculosis
GTDRSWR

SEQ ID NO: 1415879 - protein, 4 aa, Mycobacterium tuberculosis
GTGL

SEQ ID NO: 1415880 - protein, 9 aa, Mycobacterium tuberculosis
GTGQQLKGF

SEQ ID NO: 1415881 - protein, 4 aa, Mycobacterium tuberculosis
GTHT

SEQ ID NO: 1415882 - protein, 6 aa, Mycobacterium tuberculosis
GTLPKS

SEQ ID NO: 1415883 - protein, 13 aa, Mycobacterium tuberculosis
GTPEAAASTNERI

SEQ ID NO: 1415884 - protein, 7 aa, Mycobacterium tuberculosis
GTPERAG

SEQ ID NO: 1415885 - protein, 10 aa, Mycobacterium tuberculosis
GTQPTGTENH

SEQ ID NO: 1415886 - protein, 5 aa, Mycobacterium tuberculosis
GTRDL

SEQ ID NO: 1415887 - protein, 4 aa, Mycobacterium tuberculosis
GTSL

SEQ ID NO: 1415888 - protein, 10 aa, Mycobacterium tuberculosis
GTSNDEIQAA

SEQ ID NO: 1415889 - protein, 7 aa, Mycobacterium tuberculosis
GTSPWPE

SEQ ID NO: 1415890 - protein, 11 aa, Mycobacterium tuberculosis
GTTHKASPGQV

SEQ ID NO: 1415891 - protein, 8 aa, Mycobacterium tuberculosis
GTTRTADQ

SEQ ID NO: 1415892 - protein, 8 aa, Mycobacterium tuberculosis
GTYSDGRV

SEQ ID NO: 1415893 - protein, 23 aa, Mycobacterium tuberculosis
GVAEAQKPAARNALRDTPLDPER

SEQ ID NO: 1415894 - protein, 4 aa, Mycobacterium tuberculosis
GVDD

SEQ ID NO: 1415895 - protein, 17 aa, Mycobacterium tuberculosis
GVDRKDYNSFGSRRGNH

SEQ ID NO: 1415896 - protein, 6 aa, Mycobacterium tuberculosis
GVDRKV

SEQ ID NO: 1415897 - protein, 5 aa, Mycobacterium tuberculosis
GVEVD

SEQ ID NO: 1415898 - protein, 8 aa, Mycobacterium tuberculosis
GVGGGSLN

SEQ ID NO: 1415899 - protein, 6 aa, Mycobacterium tuberculosis
GVNTPA

SEQ ID NO: 1415900 - protein, 6 aa, Mycobacterium tuberculosis
GVQTES

SEQ ID NO: 1415901 - protein, 15 aa, Mycobacterium tuberculosis
GVRGDGGVLKNSENS

SEQ ID NO: 1415902 - protein, 9 aa, Mycobacterium tuberculosis
GVRRTRSKF

SEQ ID NO: 1415903 - protein, 7 aa, Mycobacterium tuberculosis
GVSGLSP

SEQ ID NO: 1415904 - protein, 11 aa, Mycobacterium tuberculosis
GVTAEQVDAAA

SEQ ID NO: 1415905 - protein, 16 aa, Mycobacterium tuberculosis
GVTGARDAVSQAAPEL

SEQ ID NO: 1415906 - protein, 15 aa, Mycobacterium tuberculosis
GVTGHPDHRRATEAA

SEQ ID NO: 1415907 - protein, 9 aa, Mycobacterium tuberculosis
GVTKQAAQK

SEQ ID NO: 1415908 - protein, 7 aa, Mycobacterium tuberculosis
GVTKSGL

SEQ ID NO: 1415909 - protein, 10 aa, Mycobacterium tuberculosis
GVVDEGGRRV

SEQ ID NO: 1415910 - protein, 15 aa, Mycobacterium tuberculosis
GWTGNSTLEDCDTTS

SEQ ID NO: 1415911 - protein, 12 aa, Mycobacterium tuberculosis
GYASSADGRRRR

SEQ ID NO: 1415912 - protein, 5 aa, Mycobacterium tuberculosis
GYATD

SEQ ID NO: 1415913 - protein, 7 aa, Mycobacterium tuberculosis
GYHRRED

SEQ ID NO: 1415914 - protein, 13 aa, Mycobacterium tuberculosis
GYLNGDSRASGWI

SEQ ID NO: 1415915 - protein, 7 aa, Mycobacterium tuberculosis
GYPGRHS

SEQ ID NO: 1415916 - protein, 11 aa, Mycobacterium tuberculosis
GYRRATDGSEA

SEQ ID NO: 1415917 - protein, 5 aa, Mycobacterium tuberculosis
GYVKR

SEQ ID NO: 1415918 - protein, 10 aa, Mycobacterium tuberculosis
GYYAATPQGL

SEQ ID NO: 1415919 - protein, 7 aa, Mycobacterium tuberculosis
HAAGPHI

SEQ ID NO: 1415920 - protein, 11 aa, Mycobacterium tuberculosis
HALSDDGHCRP

SEQ ID NO: 1415921 - protein, 5 aa, Mycobacterium tuberculosis
HANAT

SEQ ID NO: 1415922 - protein, 6 aa, Mycobacterium tuberculosis
HAPTDP

SEQ ID NO: 1415923 - protein, 9 aa, Mycobacterium tuberculosis
HARSTGPYS

SEQ ID NO: 1415924 - protein, 4 aa, Mycobacterium tuberculosis
HASD

SEQ ID NO: 1415925 - protein, 7 aa, Mycobacterium tuberculosis
HAYTGGG

SEQ ID NO: 1415926 - protein, 8 aa, Mycobacterium tuberculosis
HDAAARVD

SEQ ID NO: 1415927 - protein, 5 aa, Mycobacterium tuberculosis
HDDDT

SEQ ID NO: 1415928 - protein, 5 aa, Mycobacterium tuberculosis
HDDPT

SEQ ID NO: 1415929 - protein, 5 aa, Mycobacterium tuberculosis
HDPAR

SEQ ID NO: 1415930 - protein, 5 aa, Mycobacterium tuberculosis
HEDQA

SEQ ID NO: 1415931 - protein, 9 aa, Mycobacterium tuberculosis
HEGAPGQQE

SEQ ID NO: 1415932 - protein, 6 aa, Mycobacterium tuberculosis
HENTRR

SEQ ID NO: 1415933 - protein, 7 aa, Mycobacterium tuberculosis
HESAVRS

SEQ ID NO: 1415934 - protein, 11 aa, Mycobacterium tuberculosis
HEVGSGGQAEI

SEQ ID NO: 1415935 - protein, 8 aa, Mycobacterium tuberculosis
HGAQPRAL

SEQ ID NO: 1415936 - protein, 9 aa, Mycobacterium tuberculosis
HGARKVEKA

SEQ ID NO: 1415937 - protein, 7 aa, Mycobacterium tuberculosis
HGEMTSA

SEQ ID NO: 1415938 - protein, 5 aa, Mycobacterium tuberculosis
HGLRP

SEQ ID NO: 1415939 - protein, 5 aa, Mycobacterium tuberculosis
HGMNA

SEQ ID NO: 1415940 - protein, 8 aa, Mycobacterium tuberculosis
HGPQVDKG

SEQ ID NO: 1415941 - protein, 12 aa, Mycobacterium tuberculosis
HGQSDKPRADYS

SEQ ID NO: 1415942 - protein, 8 aa, Mycobacterium tuberculosis
HGTDEAEA

SEQ ID NO: 1415943 - protein, 6 aa, Mycobacterium tuberculosis
HGVDPA

SEQ ID NO: 1415944 - protein, 5 aa, Mycobacterium tuberculosis
HGVPT

SEQ ID NO: 1415945 - protein, 4 aa, Mycobacterium tuberculosis
HGWY

SEQ ID NO: 1415946 - protein, 4 aa, Mycobacterium tuberculosis
HHRA

SEQ ID NO: 1415947 - protein, 6 aa, Mycobacterium tuberculosis
HHSGTL

SEQ ID NO: 1415948 - protein, 7 aa, Mycobacterium tuberculosis
HLRSGGS

SEQ ID NO: 1415949 - protein, 12 aa, Mycobacterium tuberculosis
HMRPDTTKEGLA

SEQ ID NO: 1415950 - protein, 16 aa, Mycobacterium tuberculosis
HNASSDEPTNRHPWPA

SEQ ID NO: 1415951 - protein, 10 aa, Mycobacterium tuberculosis
HNPTGSVHTA

SEQ ID NO: 1415952 - protein, 7 aa, Mycobacterium tuberculosis
HNQGNHE

SEQ ID NO: 1415953 - protein, 4 aa, Mycobacterium tuberculosis
HPAE

SEQ ID NO: 1415954 - protein, 7 aa, Mycobacterium tuberculosis
HPGARAA

SEQ ID NO: 1415955 - protein, 6 aa, Mycobacterium tuberculosis
HPGGGA

SEQ ID NO: 1415956 - protein, 36 aa, Mycobacterium tuberculosis
HPHGGGEGKTSGGRHPVSPWGKPEGRTRNANKSSNK

SEQ ID NO: 1415957 - protein, 6 aa, Mycobacterium tuberculosis
HPHTRG

SEQ ID NO: 1415958 - protein, 6 aa, Mycobacterium tuberculosis
HPKPEN

SEQ ID NO: 1415959 - protein, 4 aa, Mycobacterium tuberculosis
HPTM

SEQ ID NO: 1415960 - protein, 6 aa, Mycobacterium tuberculosis
HPYTRE

SEQ ID NO: 1415961 - protein, 10 aa, Mycobacterium tuberculosis
HQDSAGNSGV

SEQ ID NO: 1415962 - protein, 9 aa, Mycobacterium tuberculosis
HQEVADSGI

SEQ ID NO: 1415963 - protein, 11 aa, Mycobacterium tuberculosis
HQGERRAAYNG

SEQ ID NO: 1415964 - protein, 7 aa, Mycobacterium tuberculosis
HQRTADE

SEQ ID NO: 1415965 - protein, 10 aa, Mycobacterium tuberculosis
HQVTDDDVAA

SEQ ID NO: 1415966 - protein, 5 aa, Mycobacterium tuberculosis
HRKGD

SEQ ID NO: 1415967 - protein, 6 aa, Mycobacterium tuberculosis
HRPNQL

SEQ ID NO: 1415968 - protein, 7 aa, Mycobacterium tuberculosis
HRQRDAG

SEQ ID NO: 1415969 - protein, 5 aa, Mycobacterium tuberculosis
HRRPG

SEQ ID NO: 1415970 - protein, 8 aa, Mycobacterium tuberculosis
HSGDPSLY

SEQ ID NO: 1415971 - protein, 14 aa, Mycobacterium tuberculosis
HSPGRAAAAATEAI

SEQ ID NO: 1415972 - protein, 4 aa, Mycobacterium tuberculosis
HSPR

SEQ ID NO: 1415973 - protein, 8 aa, Mycobacterium tuberculosis
HSQSHYAA

SEQ ID NO: 1415974 - protein, 16 aa, Mycobacterium tuberculosis
HTAPGKSQIGGASNAG

SEQ ID NO: 1415975 - protein, 10 aa, Mycobacterium tuberculosis
HTDANAVDDA

SEQ ID NO: 1415976 - protein, 6 aa, Mycobacterium tuberculosis
HTSKTA

SEQ ID NO: 1415977 - protein, 7 aa, Mycobacterium tuberculosis
HVNEGQG

SEQ ID NO: 1415978 - protein, 8 aa, Mycobacterium tuberculosis
HWGGTRNG

SEQ ID NO: 1415979 - protein, 6 aa, Mycobacterium tuberculosis
IAAADA

SEQ ID NO: 1415980 - protein, 8 aa, Mycobacterium tuberculosis
IAATEAEY

SEQ ID NO: 1415981 - protein, 7 aa, Mycobacterium tuberculosis
IADSPEC

SEQ ID NO: 1415982 - protein, 7 aa, Mycobacterium tuberculosis
IADYDPD

SEQ ID NO: 1415983 - protein, 6 aa, Mycobacterium tuberculosis
IAGEGA

SEQ ID NO: 1415984 - protein, 8 aa, Mycobacterium tuberculosis
IANGSSLA

SEQ ID NO: 1415985 - protein, 9 aa, Mycobacterium tuberculosis
IAPAGPSAV

SEQ ID NO: 1415986 - protein, 6 aa, Mycobacterium tuberculosis
IAPATF

SEQ ID NO: 1415987 - protein, 9 aa, Mycobacterium tuberculosis
IAQTGNGYR

SEQ ID NO: 1415988 - protein, 12 aa, Mycobacterium tuberculosis
IAREPRGDGGFG

SEQ ID NO: 1415989 - protein, 10 aa, Mycobacterium tuberculosis
IATGGHTGDI

SEQ ID NO: 1415990 - protein, 15 aa, Mycobacterium tuberculosis
IATQVTSRSLEQNPL

SEQ ID NO: 1415991 - protein, 5 aa, Mycobacterium tuberculosis
IDASA

SEQ ID NO: 1415992 - protein, 6 aa, Mycobacterium tuberculosis
IDDGEV

SEQ ID NO: 1415993 - protein, 6 aa, Mycobacterium tuberculosis
IDEAGG

SEQ ID NO: 1415994 - protein, 6 aa, Mycobacterium tuberculosis
IDEPGI

SEQ ID NO: 1415995 - protein, 9 aa, Mycobacterium tuberculosis
IDGEGPGHQ

SEQ ID NO: 1415996 - protein, 6 aa, Mycobacterium tuberculosis
IDGRYP

SEQ ID NO: 1415997 - protein, 4 aa, Mycobacterium tuberculosis
IDGT

SEQ ID NO: 1415998 - protein, 8 aa, Mycobacterium tuberculosis
IDGTRRPL

SEQ ID NO: 1415999 - protein, 11 aa, Mycobacterium tuberculosis
IDHADPETKRI

SEQ ID NO: 1416000 - protein, 15 aa, Mycobacterium tuberculosis
IDKSDSDWDREKLGE

SEQ ID NO: 1416001 - protein, 21 aa, Mycobacterium tuberculosis
IDLPNTDPTRVGTHLSPPDRY

SEQ ID NO: 1416002 - protein, 17 aa, Mycobacterium tuberculosis
IDRATKSVVTAAGQRHR

SEQ ID NO: 1416003 - protein, 5 aa, Mycobacterium tuberculosis
IDRSQ

SEQ ID NO: 1416004 - protein, 7 aa, Mycobacterium tuberculosis
IDSDREP

SEQ ID NO: 1416005 - protein, 13 aa, Mycobacterium tuberculosis
IEHRGRKSGKPYQ

SEQ ID NO: 1416006 - protein, 9 aa, Mycobacterium tuberculosis
IEKEDESFC

SEQ ID NO: 1416007 - protein, 5 aa, Mycobacterium tuberculosis
IENDA

SEQ ID NO: 1416008 - protein, 15 aa, Mycobacterium tuberculosis
IEPERSEVRQPPPRL

SEQ ID NO: 1416009 - protein, 13 aa, Mycobacterium tuberculosis
IEQAAQLSSPASL

SEQ ID NO: 1416010 - protein, 6 aa, Mycobacterium tuberculosis
IETETG

SEQ ID NO: 1416011 - protein, 11 aa, Mycobacterium tuberculosis
IGADKEGPELR

SEQ ID NO: 1416012 - protein, 12 aa, Mycobacterium tuberculosis
IGAGQSGLGDNG

SEQ ID NO: 1416013 - protein, 8 aa, Mycobacterium tuberculosis
IGAKPTAI

SEQ ID NO: 1416014 - protein, 8 aa, Mycobacterium tuberculosis
IGATTEAQ

SEQ ID NO: 1416015 - protein, 10 aa, Mycobacterium tuberculosis
IGEESENAAF

SEQ ID NO: 1416016 - protein, 7 aa, Mycobacterium tuberculosis
IGEGTTE

SEQ ID NO: 1416017 - protein, 8 aa, Mycobacterium tuberculosis
IGKGSVTI

SEQ ID NO: 1416018 - protein, 41 aa, Mycobacterium tuberculosis
IGNAGPNMSSPAVPTPGNGNVGIGNGGNGNFGGGNTGNANI

SEQ ID NO: 1416019 - protein, 7 aa, Mycobacterium tuberculosis
IGNGVGD

SEQ ID NO: 1416020 - protein, 5 aa, Mycobacterium tuberculosis
IGPGL

SEQ ID NO: 1416021 - protein, 5 aa, Mycobacterium tuberculosis
IGPTQ

SEQ ID NO: 1416022 - protein, 10 aa, Mycobacterium tuberculosis
IGSDGAGSIR

SEQ ID NO: 1416023 - protein, 6 aa, Mycobacterium tuberculosis
IKDPDE

SEQ ID NO: 1416024 - protein, 9 aa, Mycobacterium tuberculosis
INAGPGGGA

SEQ ID NO: 1416025 - protein, 4 aa, Mycobacterium tuberculosis
INDG

SEQ ID NO: 1416026 - protein, 6 aa, Mycobacterium tuberculosis
IPERGG

SEQ ID NO: 1416027 - protein, 17 aa, Mycobacterium tuberculosis
IPETDGAEKGPTYNKVR

SEQ ID NO: 1416028 - protein, 4 aa, Mycobacterium tuberculosis
IPGP

SEQ ID NO: 1416029 - protein, 12 aa, Mycobacterium tuberculosis
IPITTSGKVRRG

SEQ ID NO: 1416030 - protein, 5 aa, Mycobacterium tuberculosis
IPPGD

SEQ ID NO: 1416031 - protein, 4 aa, Mycobacterium tuberculosis
IPQQ

SEQ ID NO: 1416032 - protein, 9 aa, Mycobacterium tuberculosis
IPRGEEAGK

SEQ ID NO: 1416033 - protein, 6 aa, Mycobacterium tuberculosis
IPRGVG

SEQ ID NO: 1416034 - protein, 10 aa, Mycobacterium tuberculosis
IPVPRSQVRP

SEQ ID NO: 1416035 - protein, 16 aa, Mycobacterium tuberculosis
IPVSKGADEPLGGRWP

SEQ ID NO: 1416036 - protein, 6 aa, Mycobacterium tuberculosis
IQSDAQ

SEQ ID NO: 1416037 - protein, 16 aa, Mycobacterium tuberculosis
IQSTSHFEDPPEMADD

SEQ ID NO: 1416038 - protein, 15 aa, Mycobacterium tuberculosis
IREKQARISTDIGAP

SEQ ID NO: 1416039 - protein, 9 aa, Mycobacterium tuberculosis
IRGEPTAQD

SEQ ID NO: 1416040 - protein, 4 aa, Mycobacterium tuberculosis
IRGG

SEQ ID NO: 1416041 - protein, 7 aa, Mycobacterium tuberculosis
IRQRAAP

SEQ ID NO: 1416042 - protein, 7 aa, Mycobacterium tuberculosis
IRSAQAL

SEQ ID NO: 1416043 - protein, 8 aa, Mycobacterium tuberculosis
ISDSGRAE

SEQ ID NO: 1416044 - protein, 10 aa, Mycobacterium tuberculosis
ISEDNPGVGR

SEQ ID NO: 1416045 - protein, 10 aa, Mycobacterium tuberculosis
ISGDPNALRA

SEQ ID NO: 1416046 - protein, 15 aa, Mycobacterium tuberculosis
ISSGKPGRDPEAGRY

SEQ ID NO: 1416047 - protein, 9 aa, Mycobacterium tuberculosis
ISTDPVRKQ

SEQ ID NO: 1416048 - protein, 11 aa, Mycobacterium tuberculosis
ITAPDEPKYDA

SEQ ID NO: 1416049 - protein, 9 aa, Mycobacterium tuberculosis
ITGKDEDEL

SEQ ID NO: 1416050 - protein, 7 aa, Mycobacterium tuberculosis
ITKNSEV

SEQ ID NO: 1416051 - protein, 9 aa, Mycobacterium tuberculosis
ITNSGTDIT

SEQ ID NO: 1416052 - protein, 6 aa, Mycobacterium tuberculosis
ITPGQR

SEQ ID NO: 1416053 - protein, 8 aa, Mycobacterium tuberculosis
ITSPRAHG

SEQ ID NO: 1416054 - protein, 14 aa, Mycobacterium tuberculosis
ITTDLDAANGRGTQ

SEQ ID NO: 1416055 - protein, 13 aa, Mycobacterium tuberculosis
ITTTEPKARALRP

SEQ ID NO: 1416056 - protein, 7 aa, Mycobacterium tuberculosis
IVPGGGA

SEQ ID NO: 1416057 - protein, 4 aa, Mycobacterium tuberculosis
IYSN

SEQ ID NO: 1416058 - protein, 12 aa, Mycobacterium tuberculosis
KAAAARRARAEL

SEQ ID NO: 1416059 - protein, 8 aa, Mycobacterium tuberculosis
KAERPGRK

SEQ ID NO: 1416060 - protein, 6 aa, Mycobacterium tuberculosis
KAESAA

SEQ ID NO: 1416061 - protein, 6 aa, Mycobacterium tuberculosis
KAFAAG

SEQ ID NO: 1416062 - protein, 6 aa, Mycobacterium tuberculosis
KAGEQL

SEQ ID NO: 1416063 - protein, 5 aa, Mycobacterium tuberculosis
KAKTV

SEQ ID NO: 1416064 - protein, 8 aa, Mycobacterium tuberculosis
KANEAGIG

SEQ ID NO: 1416065 - protein, 7 aa, Mycobacterium tuberculosis
KARKTSL

SEQ ID NO: 1416066 - protein, 9 aa, Mycobacterium tuberculosis
KARRNEAAS

SEQ ID NO: 1416067 - protein, 9 aa, Mycobacterium tuberculosis
KASGRDLSN

SEQ ID NO: 1416068 - protein, 18 aa, Mycobacterium tuberculosis
KATSRDTVRSRSFTGKPA

SEQ ID NO: 1416069 - protein, 7 aa, Mycobacterium tuberculosis
KCGRPRA

SEQ ID NO: 1416070 - protein, 8 aa, Mycobacterium tuberculosis
KCQNPPQL

SEQ ID NO: 1416071 - protein, 7 aa, Mycobacterium tuberculosis
KDASSTD

SEQ ID NO: 1416072 - protein, 4 aa, Mycobacterium tuberculosis
KDDV

SEQ ID NO: 1416073 - protein, 10 aa, Mycobacterium tuberculosis
KDGAIAGPRS

SEQ ID NO: 1416074 - protein, 5 aa, Mycobacterium tuberculosis
KDGQQ

SEQ ID NO: 1416075 - protein, 6 aa, Mycobacterium tuberculosis
KDIQAV

SEQ ID NO: 1416076 - protein, 4 aa, Mycobacterium tuberculosis
KDPR

SEQ ID NO: 1416077 - protein, 5 aa, Mycobacterium tuberculosis
KDREL

SEQ ID NO: 1416078 - protein, 14 aa, Mycobacterium tuberculosis
KDSPPSFDPSEVAG

SEQ ID NO: 1416079 - protein, 6 aa, Mycobacterium tuberculosis
KEGLRK

SEQ ID NO: 1416080 - protein, 8 aa, Mycobacterium tuberculosis
KELASDPI

SEQ ID NO: 1416081 - protein, 8 aa, Mycobacterium tuberculosis
KELRRGAT

SEQ ID NO: 1416082 - protein, 7 aa, Mycobacterium tuberculosis
KEPPKRV

SEQ ID NO: 1416083 - protein, 11 aa, Mycobacterium tuberculosis
KERKDNRDKSI

SEQ ID NO: 1416084 - protein, 10 aa, Mycobacterium tuberculosis
KERREASGND

SEQ ID NO: 1416085 - protein, 6 aa, Mycobacterium tuberculosis
KGAEYP

SEQ ID NO: 1416086 - protein, 11 aa, Mycobacterium tuberculosis
KGASIGDKTVE

SEQ ID NO: 1416087 - protein, 8 aa, Mycobacterium tuberculosis
KGATRSLP

SEQ ID NO: 1416088 - protein, 7 aa, Mycobacterium tuberculosis
KGAVADA

SEQ ID NO: 1416089 - protein, 6 aa, Mycobacterium tuberculosis
KGDSVT

SEQ ID NO: 1416090 - protein, 14 aa, Mycobacterium tuberculosis
KGEKPNTHDDAEYD

SEQ ID NO: 1416091 - protein, 11 aa, Mycobacterium tuberculosis
KGESARKAGRR

SEQ ID NO: 1416092 - protein, 23 aa, Mycobacterium tuberculosis
KGLPGARARRRGLSDSALGTPRR

SEQ ID NO: 1416093 - protein, 24 aa, Mycobacterium tuberculosis
KGLPPNPDATSTSLPGARGADVDG

SEQ ID NO: 1416094 - protein, 10 aa, Mycobacterium tuberculosis
KGPGSGRETA

SEQ ID NO: 1416095 - protein, 21 aa, Mycobacterium tuberculosis
KGQYSPTSEVGKVTKSTPMGS

SEQ ID NO: 1416096 - protein, 5 aa, Mycobacterium tuberculosis
KGRHR

SEQ ID NO: 1416097 - protein, 5 aa, Mycobacterium tuberculosis
KGSAL

SEQ ID NO: 1416098 - protein, 12 aa, Mycobacterium tuberculosis
KGSYEAARERLT

SEQ ID NO: 1416099 - protein, 8 aa, Mycobacterium tuberculosis
KGTGNAEL

SEQ ID NO: 1416100 - protein, 4 aa, Mycobacterium tuberculosis
KGYD

SEQ ID NO: 1416101 - protein, 9 aa, Mycobacterium tuberculosis
KHDAERENK

SEQ ID NO: 1416102 - protein, 10 aa, Mycobacterium tuberculosis
KHGTADARLS

SEQ ID NO: 1416103 - protein, 6 aa, Mycobacterium tuberculosis
KIDDEG

SEQ ID NO: 1416104 - protein, 8 aa, Mycobacterium tuberculosis
KKKGRDAD

SEQ ID NO: 1416105 - protein, 4 aa, Mycobacterium tuberculosis
KKRR

SEQ ID NO: 1416106 - protein, 6 aa, Mycobacterium tuberculosis
KLGGHD

SEQ ID NO: 1416107 - protein, 12 aa, Mycobacterium tuberculosis
KLRAQGSSTYME

SEQ ID NO: 1416108 - protein, 7 aa, Mycobacterium tuberculosis
KLSHYSD

SEQ ID NO: 1416109 - protein, 18 aa, Mycobacterium tuberculosis
KLSTGSANRCEPKTGTPL

SEQ ID NO: 1416110 - protein, 16 aa, Mycobacterium tuberculosis
KLTNKDDLEARGAKTL

SEQ ID NO: 1416111 - protein, 6 aa, Mycobacterium tuberculosis
KMQEQV

SEQ ID NO: 1416112 - protein, 20 aa, Mycobacterium tuberculosis
KMYGADGKLKDTKAVNPEST

SEQ ID NO: 1416113 - protein, 8 aa, Mycobacterium tuberculosis
KNDAEEAR

SEQ ID NO: 1416114 - protein, 13 aa, Mycobacterium tuberculosis
KNDMQAPPTPGAD

SEQ ID NO: 1416115 - protein, 7 aa, Mycobacterium tuberculosis
KNFASDG

SEQ ID NO: 1416116 - protein, 5 aa, Mycobacterium tuberculosis
KNRNN

SEQ ID NO: 1416117 - protein, 8 aa, Mycobacterium tuberculosis
KPAGHGIN

SEQ ID NO: 1416118 - protein, 4 aa, Mycobacterium tuberculosis
KPEA

SEQ ID NO: 1416119 - protein, 4 aa, Mycobacterium tuberculosis
KPGA

SEQ ID NO: 1416120 - protein, 10 aa, Mycobacterium tuberculosis
KPKGMSEEMT

SEQ ID NO: 1416121 - protein, 6 aa, Mycobacterium tuberculosis
KPLART

SEQ ID NO: 1416122 - protein, 7 aa, Mycobacterium tuberculosis
KPLTAAQ

SEQ ID NO: 1416123 - protein, 6 aa, Mycobacterium tuberculosis
KPPAFE

SEQ ID NO: 1416124 - protein, 5 aa, Mycobacterium tuberculosis
KPRQV

SEQ ID NO: 1416125 - protein, 6 aa, Mycobacterium tuberculosis
KPSYGM

SEQ ID NO: 1416126 - protein, 7 aa, Mycobacterium tuberculosis
KQGRSGS

SEQ ID NO: 1416127 - protein, 6 aa, Mycobacterium tuberculosis
KQRGHR

SEQ ID NO: 1416128 - protein, 11 aa, Mycobacterium tuberculosis
KQRKGSVQAPK

SEQ ID NO: 1416129 - protein, 7 aa, Mycobacterium tuberculosis
KQSESNA

SEQ ID NO: 1416130 - protein, 9 aa, Mycobacterium tuberculosis
KRAAAAQRF

SEQ ID NO: 1416131 - protein, 8 aa, Mycobacterium tuberculosis
KRASKIAR

SEQ ID NO: 1416132 - protein, 10 aa, Mycobacterium tuberculosis
KRASPSAGAL

SEQ ID NO: 1416133 - protein, 11 aa, Mycobacterium tuberculosis
KRDPYGRTARQ

SEQ ID NO: 1416134 - protein, 6 aa, Mycobacterium tuberculosis
KRDTVG

SEQ ID NO: 1416135 - protein, 11 aa, Mycobacterium tuberculosis
KRFRRTGTGKI

SEQ ID NO: 1416136 - protein, 52 aa, Mycobacterium tuberculosis
KRGEAPDENSPEAIKAREKEAERKARHQRSKRIAAQRKAAEEPVEVPERSDV

SEQ ID NO: 1416137 - protein, 13 aa, Mycobacterium tuberculosis
KRLGARTTGYDVR

SEQ ID NO: 1416138 - protein, 7 aa, Mycobacterium tuberculosis
KRLPDGL

SEQ ID NO: 1416139 - protein, 9 aa, Mycobacterium tuberculosis
KRPKAEIKA

SEQ ID NO: 1416140 - protein, 5 aa, Mycobacterium tuberculosis
KRRDE

SEQ ID NO: 1416141 - protein, 7 aa, Mycobacterium tuberculosis
KRRRGRL

SEQ ID NO: 1416142 - protein, 8 aa, Mycobacterium tuberculosis
KRRTPRAA

SEQ ID NO: 1416143 - protein, 6 aa, Mycobacterium tuberculosis
KSALAD

SEQ ID NO: 1416144 - protein, 7 aa, Mycobacterium tuberculosis
KSALGAG

SEQ ID NO: 1416145 - protein, 9 aa, Mycobacterium tuberculosis
KSGEGGEES

SEQ ID NO: 1416146 - protein, 11 aa, Mycobacterium tuberculosis
KSLREGQASLA

SEQ ID NO: 1416147 - protein, 8 aa, Mycobacterium tuberculosis
KSRVQGAD

SEQ ID NO: 1416148 - protein, 6 aa, Mycobacterium tuberculosis
KTAREL

SEQ ID NO: 1416149 - protein, 4 aa, Mycobacterium tuberculosis
KTGV

SEQ ID NO: 1416150 - protein, 8 aa, Mycobacterium tuberculosis
KTQASTET

SEQ ID NO: 1416151 - protein, 6 aa, Mycobacterium tuberculosis
KTTSVN

SEQ ID NO: 1416152 - protein, 11 aa, Mycobacterium tuberculosis
KTVPGDTAAEH

SEQ ID NO: 1416153 - protein, 5 aa, Mycobacterium tuberculosis
KTWQP

SEQ ID NO: 1416154 - protein, 8 aa, Mycobacterium tuberculosis
KVDPDNPA

SEQ ID NO: 1416155 - protein, 6 aa, Mycobacterium tuberculosis
KVGTFN

SEQ ID NO: 1416156 - protein, 6 aa, Mycobacterium tuberculosis
KVPKEK

SEQ ID NO: 1416157 - protein, 22 aa, Mycobacterium tuberculosis
KVREAGEADWSDPQARARAEQF

SEQ ID NO: 1416158 - protein, 24 aa, Mycobacterium tuberculosis
KVSGGPSRSGDLVPAGPVSLPPGT

SEQ ID NO: 1416159 - protein, 8 aa, Mycobacterium tuberculosis
KYAGRAGD

SEQ ID NO: 1416160 - protein, 19 aa, Mycobacterium tuberculosis
KYEAAQKARESRRNQQQTV

SEQ ID NO: 1416161 - protein, 4 aa, Mycobacterium tuberculosis
KYRR

SEQ ID NO: 1416162 - protein, 7 aa, Mycobacterium tuberculosis
LAAASAV

SEQ ID NO: 1416163 - protein, 7 aa, Mycobacterium tuberculosis
LAAASTY

SEQ ID NO: 1416164 - protein, 7 aa, Mycobacterium tuberculosis
LAAGPAA

SEQ ID NO: 1416165 - protein, 5 aa, Mycobacterium tuberculosis
LAAGR

SEQ ID NO: 1416166 - protein, 9 aa, Mycobacterium tuberculosis
LAATTNVSD

SEQ ID NO: 1416167 - protein, 12 aa, Mycobacterium tuberculosis
LADSTGVRASTD

SEQ ID NO: 1416168 - protein, 16 aa, Mycobacterium tuberculosis
LAEQVKAAEADEVEAE

SEQ ID NO: 1416169 - protein, 8 aa, Mycobacterium tuberculosis
LAESAEAL

SEQ ID NO: 1416170 - protein, 6 aa, Mycobacterium tuberculosis
LAGEDA

SEQ ID NO: 1416171 - protein, 7 aa, Mycobacterium tuberculosis
LAGPGVE

SEQ ID NO: 1416172 - protein, 5 aa, Mycobacterium tuberculosis
LAGRR

SEQ ID NO: 1416173 - protein, 10 aa, Mycobacterium tuberculosis
LAGSSGSRSV

SEQ ID NO: 1416174 - protein, 12 aa, Mycobacterium tuberculosis
LAGTPPPPHYPQ

SEQ ID NO: 1416175 - protein, 6 aa, Mycobacterium tuberculosis
LAKEMP

SEQ ID NO: 1416176 - protein, 8 aa, Mycobacterium tuberculosis
LAPAEPFG

SEQ ID NO: 1416177 - protein, 16 aa, Mycobacterium tuberculosis
LAPARRAELGDSPPVD

SEQ ID NO: 1416178 - protein, 7 aa, Mycobacterium tuberculosis
LAPEPAE

SEQ ID NO: 1416179 - protein, 19 aa, Mycobacterium tuberculosis
LAPGAVAPAPLGRKREGRD

SEQ ID NO: 1416180 - protein, 7 aa, Mycobacterium tuberculosis
LAPSAAA

SEQ ID NO: 1416181 - protein, 21 aa, Mycobacterium tuberculosis
LAPTRPRRRVAGRPAGPPIRL

SEQ ID NO: 1416182 - protein, 5 aa, Mycobacterium tuberculosis
LARNG

SEQ ID NO: 1416183 - protein, 7 aa, Mycobacterium tuberculosis
LASPRIA

SEQ ID NO: 1416184 - protein, 8 aa, Mycobacterium tuberculosis
LATAEERS

SEQ ID NO: 1416185 - protein, 11 aa, Mycobacterium tuberculosis
LATRGFGDTEF

SEQ ID NO: 1416186 - protein, 8 aa, Mycobacterium tuberculosis
LATTAEAY

SEQ ID NO: 1416187 - protein, 14 aa, Mycobacterium tuberculosis
LAVQGRKDAKLQKR

SEQ ID NO: 1416188 - protein, 11 aa, Mycobacterium tuberculosis
LDDLDDADDLA

SEQ ID NO: 1416189 - protein, 6 aa, Mycobacterium tuberculosis
LDEDDA

SEQ ID NO: 1416190 - protein, 5 aa, Mycobacterium tuberculosis
LDGAA

SEQ ID NO: 1416191 - protein, 6 aa, Mycobacterium tuberculosis
LDHPDE

SEQ ID NO: 1416192 - protein, 9 aa, Mycobacterium tuberculosis
LDPDRGGVE

SEQ ID NO: 1416193 - protein, 9 aa, Mycobacterium tuberculosis
LDPGTGPGH

SEQ ID NO: 1416194 - protein, 4 aa, Mycobacterium tuberculosis
LDSR

SEQ ID NO: 1416195 - protein, 7 aa, Mycobacterium tuberculosis
LDVSTDD

SEQ ID NO: 1416196 - protein, 5 aa, Mycobacterium tuberculosis
LDYSG

SEQ ID NO: 1416197 - protein, 4 aa, Mycobacterium tuberculosis
LEAR

SEQ ID NO: 1416198 - protein, 7 aa, Mycobacterium tuberculosis
LEEGGAM

SEQ ID NO: 1416199 - protein, 4 aa, Mycobacterium tuberculosis
LEER

SEQ ID NO: 1416200 - protein, 6 aa, Mycobacterium tuberculosis
LEERAE

SEQ ID NO: 1416201 - protein, 7 aa, Mycobacterium tuberculosis
LEGEMGD

SEQ ID NO: 1416202 - protein, 9 aa, Mycobacterium tuberculosis
LEGKSSQEY

SEQ ID NO: 1416203 - protein, 5 aa, Mycobacterium tuberculosis
LEKMG

SEQ ID NO: 1416204 - protein, 17 aa, Mycobacterium tuberculosis
LEPSDEPRGAPSSRKSV

SEQ ID NO: 1416205 - protein, 7 aa, Mycobacterium tuberculosis
LEQAKDA

SEQ ID NO: 1416206 - protein, 4 aa, Mycobacterium tuberculosis
LERA

SEQ ID NO: 1416207 - protein, 10 aa, Mycobacterium tuberculosis
LESRDAKQEL

SEQ ID NO: 1416208 - protein, 38 aa, Mycobacterium tuberculosis
LESVDDGTAVADTAENDQADQGNSADTSGEQAESEPSG

SEQ ID NO: 1416209 - protein, 10 aa, Mycobacterium tuberculosis
LETQARQRER

SEQ ID NO: 1416210 - protein, 9 aa, Mycobacterium tuberculosis
LGADDDTAI

SEQ ID NO: 1416211 - protein, 7 aa, Mycobacterium tuberculosis
LGAGGAR

SEQ ID NO: 1416212 - protein, 5 aa, Mycobacterium tuberculosis
LGDTH

SEQ ID NO: 1416213 - protein, 14 aa, Mycobacterium tuberculosis
LGGDEEATVYAGTG

SEQ ID NO: 1416214 - protein, 8 aa, Mycobacterium tuberculosis
LGGEARAK

SEQ ID NO: 1416215 - protein, 5 aa, Mycobacterium tuberculosis
LGGPL

SEQ ID NO: 1416216 - protein, 9 aa, Mycobacterium tuberculosis
LGGPTSGEI

SEQ ID NO: 1416217 - protein, 8 aa, Mycobacterium tuberculosis
LGGRAGYY

SEQ ID NO: 1416218 - protein, 18 aa, Mycobacterium tuberculosis
LGGTDPQATAAPRRRTSP

SEQ ID NO: 1416219 - protein, 5 aa, Mycobacterium tuberculosis
LGHSG

SEQ ID NO: 1416220 - protein, 13 aa, Mycobacterium tuberculosis
LGKAGGTIGRNNS

SEQ ID NO: 1416221 - protein, 10 aa, Mycobacterium tuberculosis
LGKPTPEPRL

SEQ ID NO: 1416222 - protein, 9 aa, Mycobacterium tuberculosis
LGNAGGNNW

SEQ ID NO: 1416223 - protein, 12 aa, Mycobacterium tuberculosis
LGNGTVQATVST

SEQ ID NO: 1416224 - protein, 8 aa, Mycobacterium tuberculosis
LGPAATLA

SEQ ID NO: 1416225 - protein, 7 aa, Mycobacterium tuberculosis
LGPRDAD

SEQ ID NO: 1416226 - protein, 6 aa, Mycobacterium tuberculosis
LGRGEE

SEQ ID NO: 1416227 - protein, 11 aa, Mycobacterium tuberculosis
LGSAGGLGGTV

SEQ ID NO: 1416228 - protein, 7 aa, Mycobacterium tuberculosis
LGTDRSA

SEQ ID NO: 1416229 - protein, 12 aa, Mycobacterium tuberculosis
LGTDTRTPIPVD

SEQ ID NO: 1416230 - protein, 12 aa, Mycobacterium tuberculosis
LGTPGQGAYAAA

SEQ ID NO: 1416231 - protein, 4 aa, Mycobacterium tuberculosis
LGYD

SEQ ID NO: 1416232 - protein, 6 aa, Mycobacterium tuberculosis
LKGDPM

SEQ ID NO: 1416233 - protein, 8 aa, Mycobacterium tuberculosis
LKQADGGR

SEQ ID NO: 1416234 - protein, 7 aa, Mycobacterium tuberculosis
LKSDQGL

SEQ ID NO: 1416235 - protein, 8 aa, Mycobacterium tuberculosis
LKSNPGIV

SEQ ID NO: 1416236 - protein, 6 aa, Mycobacterium tuberculosis
LKTEPA

SEQ ID NO: 1416237 - protein, 20 aa, Mycobacterium tuberculosis
LLPPPPQPPGREPVHRRALA

SEQ ID NO: 1416238 - protein, 9 aa, Mycobacterium tuberculosis
LNEDDRTAV

SEQ ID NO: 1416239 - protein, 15 aa, Mycobacterium tuberculosis
LNEPGAALPDRPATS

SEQ ID NO: 1416240 - protein, 4 aa, Mycobacterium tuberculosis
LNGT

SEQ ID NO: 1416241 - protein, 8 aa, Mycobacterium tuberculosis
LNPSPLGY

SEQ ID NO: 1416242 - protein, 25 aa, Mycobacterium tuberculosis
LPAEAKASLGQQVPHPSRLGNPDEY

SEQ ID NO: 1416243 - protein, 8 aa, Mycobacterium tuberculosis
LPAEPHTD

SEQ ID NO: 1416244 - protein, 13 aa, Mycobacterium tuberculosis
LPAGPTPAGDALD

SEQ ID NO: 1416245 - protein, 6 aa, Mycobacterium tuberculosis
LPAGSP

SEQ ID NO: 1416246 - protein, 9 aa, Mycobacterium tuberculosis
LPDAATRKS

SEQ ID NO: 1416247 - protein, 5 aa, Mycobacterium tuberculosis
LPDGS

SEQ ID NO: 1416248 - protein, 21 aa, Mycobacterium tuberculosis
LPDGTTVSTDDGPRPGTTYEK

SEQ ID NO: 1416249 - protein, 6 aa, Mycobacterium tuberculosis
LPDRPR

SEQ ID NO: 1416250 - protein, 7 aa, Mycobacterium tuberculosis
LPETSLT

SEQ ID NO: 1416251 - protein, 8 aa, Mycobacterium tuberculosis
LPGGESGF

SEQ ID NO: 1416252 - protein, 6 aa, Mycobacterium tuberculosis
LPGGQD

SEQ ID NO: 1416253 - protein, 9 aa, Mycobacterium tuberculosis
LPGVDPDKD

SEQ ID NO: 1416254 - protein, 4 aa, Mycobacterium tuberculosis
LPGW

SEQ ID NO: 1416255 - protein, 9 aa, Mycobacterium tuberculosis
LPHGTGKTA

SEQ ID NO: 1416256 - protein, 7 aa, Mycobacterium tuberculosis
LPKLGTR

SEQ ID NO: 1416257 - protein, 6 aa, Mycobacterium tuberculosis
LPNRDG

SEQ ID NO: 1416258 - protein, 10 aa, Mycobacterium tuberculosis
LPPIDEPDTY

SEQ ID NO: 1416259 - protein, 5 aa, Mycobacterium tuberculosis
LPPNT

SEQ ID NO: 1416260 - protein, 5 aa, Mycobacterium tuberculosis
LPPTV

SEQ ID NO: 1416261 - protein, 4 aa, Mycobacterium tuberculosis
LPQR

SEQ ID NO: 1416262 - protein, 6 aa, Mycobacterium tuberculosis
LPQTRV

SEQ ID NO: 1416263 - protein, 6 aa, Mycobacterium tuberculosis
LPRAGT

SEQ ID NO: 1416264 - protein, 5 aa, Mycobacterium tuberculosis
LPRAT

SEQ ID NO: 1416265 - protein, 7 aa, Mycobacterium tuberculosis
LPRSIRP

SEQ ID NO: 1416266 - protein, 8 aa, Mycobacterium tuberculosis
LPRTPNGK

SEQ ID NO: 1416267 - protein, 8 aa, Mycobacterium tuberculosis
LPSDTRTD

SEQ ID NO: 1416268 - protein, 8 aa, Mycobacterium tuberculosis
LPTTPIGK

SEQ ID NO: 1416269 - protein, 4 aa, Mycobacterium tuberculosis
LQAV

SEQ ID NO: 1416270 - protein, 9 aa, Mycobacterium tuberculosis
LQGAGSPGA

SEQ ID NO: 1416271 - protein, 10 aa, Mycobacterium tuberculosis
LQGDAPPSGE

SEQ ID NO: 1416272 - protein, 12 aa, Mycobacterium tuberculosis
LQPNAGSQGEYA

SEQ ID NO: 1416273 - protein, 9 aa, Mycobacterium tuberculosis
LQQGAVQGV

SEQ ID NO: 1416274 - protein, 7 aa, Mycobacterium tuberculosis
LQTLGGS

SEQ ID NO: 1416275 - protein, 6 aa, Mycobacterium tuberculosis
LQYSGD

SEQ ID NO: 1416276 - protein, 4 aa, Mycobacterium tuberculosis
LRAA

SEQ ID NO: 1416277 - protein, 23 aa, Mycobacterium tuberculosis
LREATAAAAGPTTGLAAAAADDV

SEQ ID NO: 1416278 - protein, 8 aa, Mycobacterium tuberculosis
LRGDTREP

SEQ ID NO: 1416279 - protein, 7 aa, Mycobacterium tuberculosis
LRGGPDA

SEQ ID NO: 1416280 - protein, 12 aa, Mycobacterium tuberculosis
LRPDSGRVTRRS

SEQ ID NO: 1416281 - protein, 5 aa, Mycobacterium tuberculosis
LRPWP

SEQ ID NO: 1416282 - protein, 5 aa, Mycobacterium tuberculosis
LRQED

SEQ ID NO: 1416283 - protein, 4 aa, Mycobacterium tuberculosis
LRST

SEQ ID NO: 1416284 - protein, 8 aa, Mycobacterium tuberculosis
LRTRKAGA

SEQ ID NO: 1416285 - protein, 13 aa, Mycobacterium tuberculosis
LSAGADDVGRAEE

SEQ ID NO: 1416286 - protein, 5 aa, Mycobacterium tuberculosis
LSAGS

SEQ ID NO: 1416287 - protein, 6 aa, Mycobacterium tuberculosis
LSDDDK

SEQ ID NO: 1416288 - protein, 18 aa, Mycobacterium tuberculosis
LSDGRAGTFPTVNPATEE

SEQ ID NO: 1416289 - protein, 6 aa, Mycobacterium tuberculosis
LSDGTV

SEQ ID NO: 1416290 - protein, 4 aa, Mycobacterium tuberculosis
LSDP

SEQ ID NO: 1416291 - protein, 11 aa, Mycobacterium tuberculosis
LSEHDSPGEAT

SEQ ID NO: 1416292 - protein, 6 aa, Mycobacterium tuberculosis
LSEPAT

SEQ ID NO: 1416293 - protein, 6 aa, Mycobacterium tuberculosis
LSESER

SEQ ID NO: 1416294 - protein, 6 aa, Mycobacterium tuberculosis
LSGADR

SEQ ID NO: 1416295 - protein, 7 aa, Mycobacterium tuberculosis
LSGGERL

SEQ ID NO: 1416296 - protein, 7 aa, Mycobacterium tuberculosis
LSGGERQ

SEQ ID NO: 1416297 - protein, 9 aa, Mycobacterium tuberculosis
LSKTGREFG

SEQ ID NO: 1416298 - protein, 6 aa, Mycobacterium tuberculosis
LSPANE

SEQ ID NO: 1416299 - protein, 7 aa, Mycobacterium tuberculosis
LSPDEKY

SEQ ID NO: 1416300 - protein, 7 aa, Mycobacterium tuberculosis
LSPRRGQ

SEQ ID NO: 1416301 - protein, 12 aa, Mycobacterium tuberculosis
LSQDAASVRRAA

SEQ ID NO: 1416302 - protein, 8 aa, Mycobacterium tuberculosis
LSRDDATA

SEQ ID NO: 1416303 - protein, 4 aa, Mycobacterium tuberculosis
LSRQ

SEQ ID NO: 1416304 - protein, 9 aa, Mycobacterium tuberculosis
LSSAATGYE

SEQ ID NO: 1416305 - protein, 9 aa, Mycobacterium tuberculosis
LSSRRRAQR

SEQ ID NO: 1416306 - protein, 11 aa, Mycobacterium tuberculosis
LSTASLAGTGV

SEQ ID NO: 1416307 - protein, 6 aa, Mycobacterium tuberculosis
LSTVAN

SEQ ID NO: 1416308 - protein, 6 aa, Mycobacterium tuberculosis
LTADAK

SEQ ID NO: 1416309 - protein, 19 aa, Mycobacterium tuberculosis
LTDRQAARQGVGGEVLAYV

SEQ ID NO: 1416310 - protein, 6 aa, Mycobacterium tuberculosis
LTEAGA

SEQ ID NO: 1416311 - protein, 6 aa, Mycobacterium tuberculosis
LTEQRN

SEQ ID NO: 1416312 - protein, 7 aa, Mycobacterium tuberculosis
LTGQHPA

SEQ ID NO: 1416313 - protein, 23 aa, Mycobacterium tuberculosis
LTGTAPSSEHKDAVKRAATSTWP

SEQ ID NO: 1416314 - protein, 7 aa, Mycobacterium tuberculosis
LTNEARQ

SEQ ID NO: 1416315 - protein, 7 aa, Mycobacterium tuberculosis
LTPQGTL

SEQ ID NO: 1416316 - protein, 6 aa, Mycobacterium tuberculosis
LTPRGV

SEQ ID NO: 1416317 - protein, 13 aa, Mycobacterium tuberculosis
LTRPSHITNPAGL

SEQ ID NO: 1416318 - protein, 22 aa, Mycobacterium tuberculosis
LTRTPGGKGANQAVAAARAGAQ

SEQ ID NO: 1416319 - protein, 18 aa, Mycobacterium tuberculosis
LTSAPAGDTFPTAAPRSL

SEQ ID NO: 1416320 - protein, 5 aa, Mycobacterium tuberculosis
LTTQQ

SEQ ID NO: 1416321 - protein, 9 aa, Mycobacterium tuberculosis
LVGPDDPRP

SEQ ID NO: 1416322 - protein, 13 aa, Mycobacterium tuberculosis
MAAAKAAGKVRIE

SEQ ID NO: 1416323 - protein, 7 aa, Mycobacterium tuberculosis
MDSPDFA

SEQ ID NO: 1416324 - protein, 9 aa, Mycobacterium tuberculosis
MGPPADPEC

SEQ ID NO: 1416325 - protein, 7 aa, Mycobacterium tuberculosis
MGPPIAS

SEQ ID NO: 1416326 - protein, 7 aa, Mycobacterium tuberculosis
MKPNTPV

SEQ ID NO: 1416327 - protein, 7 aa, Mycobacterium tuberculosis
MPDSSSR

SEQ ID NO: 1416328 - protein, 5 aa, Mycobacterium tuberculosis
MPGPL

SEQ ID NO: 1416329 - protein, 10 aa, Mycobacterium tuberculosis
MPRKPGGDLA

SEQ ID NO: 1416330 - protein, 31 aa, Mycobacterium tuberculosis
MPYPPNYPKMPGEPKRVQPSRDTDLKGGNTS

SEQ ID NO: 1416331 - protein, 14 aa, Mycobacterium tuberculosis
MRGRGGATSYSKDR

SEQ ID NO: 1416332 - protein, 5 aa, Mycobacterium tuberculosis
MRPDS

SEQ ID NO: 1416333 - protein, 6 aa, Mycobacterium tuberculosis
MSAQGS

SEQ ID NO: 1416334 - protein, 9 aa, Mycobacterium tuberculosis
MTQRRDEPA

SEQ ID NO: 1416335 - protein, 8 aa, Mycobacterium tuberculosis
MTRPTAAV

SEQ ID NO: 1416336 - protein, 9 aa, Mycobacterium tuberculosis
MYTGPGAGS

SEQ ID NO: 1416337 - protein, 9 aa, Mycobacterium tuberculosis
NAARDEPAI

SEQ ID NO: 1416338 - protein, 15 aa, Mycobacterium tuberculosis
NAATSSTTCAPRAGT

SEQ ID NO: 1416339 - protein, 7 aa, Mycobacterium tuberculosis
NAEANRA

SEQ ID NO: 1416340 - protein, 4 aa, Mycobacterium tuberculosis
NAES

SEQ ID NO: 1416341 - protein, 8 aa, Mycobacterium tuberculosis
NAFEDPAE

SEQ ID NO: 1416342 - protein, 15 aa, Mycobacterium tuberculosis
NAGNEDMGVGNGGSF

SEQ ID NO: 1416343 - protein, 9 aa, Mycobacterium tuberculosis
NAGSPEVDT

SEQ ID NO: 1416344 - protein, 7 aa, Mycobacterium tuberculosis
NAQTVRD

SEQ ID NO: 1416345 - protein, 4 aa, Mycobacterium tuberculosis
NARW

SEQ ID NO: 1416346 - protein, 4 aa, Mycobacterium tuberculosis
NASA

SEQ ID NO: 1416347 - protein, 9 aa, Mycobacterium tuberculosis
NASAQDQLH

SEQ ID NO: 1416348 - protein, 11 aa, Mycobacterium tuberculosis
NASGRSPSAWT

SEQ ID NO: 1416349 - protein, 8 aa, Mycobacterium tuberculosis
NATRELSE

SEQ ID NO: 1416350 - protein, 7 aa, Mycobacterium tuberculosis
NCDPDEV

SEQ ID NO: 1416351 - protein, 9 aa, Mycobacterium tuberculosis
NDGEALARQ

SEQ ID NO: 1416352 - protein, 5 aa, Mycobacterium tuberculosis
NDGGT

SEQ ID NO: 1416353 - protein, 13 aa, Mycobacterium tuberculosis
NDPDRRNAVTDEM

SEQ ID NO: 1416354 - protein, 5 aa, Mycobacterium tuberculosis
NDSTF

SEQ ID NO: 1416355 - protein, 11 aa, Mycobacterium tuberculosis
NDTPVASASIG

SEQ ID NO: 1416356 - protein, 5 aa, Mycobacterium tuberculosis
NEAED

SEQ ID NO: 1416357 - protein, 7 aa, Mycobacterium tuberculosis
NEHTAEL

SEQ ID NO: 1416358 - protein, 8 aa, Mycobacterium tuberculosis
NELGRRDD

SEQ ID NO: 1416359 - protein, 9 aa, Mycobacterium tuberculosis
NEPESPAEA

SEQ ID NO: 1416360 - protein, 4 aa, Mycobacterium tuberculosis
NEQV

SEQ ID NO: 1416361 - protein, 6 aa, Mycobacterium tuberculosis
NERRRG

SEQ ID NO: 1416362 - protein, 20 aa, Mycobacterium tuberculosis
NETETSGQDPALAPTAEQEI

SEQ ID NO: 1416363 - protein, 7 aa, Mycobacterium tuberculosis
NETSTGV

SEQ ID NO: 1416364 - protein, 10 aa, Mycobacterium tuberculosis
NFGHTQSTAG

SEQ ID NO: 1416365 - protein, 12 aa, Mycobacterium tuberculosis
NFKRSDAQLPAN

SEQ ID NO: 1416366 - protein, 4 aa, Mycobacterium tuberculosis
NFPD

SEQ ID NO: 1416367 - protein, 12 aa, Mycobacterium tuberculosis
NGAKEIADQHGK

SEQ ID NO: 1416368 - protein, 10 aa, Mycobacterium tuberculosis
NGARQVPGRH

SEQ ID NO: 1416369 - protein, 15 aa, Mycobacterium tuberculosis
NGASGEGGPNGSVNE

SEQ ID NO: 1416370 - protein, 14 aa, Mycobacterium tuberculosis
NGFDGGWTAEASHD

SEQ ID NO: 1416371 - protein, 7 aa, Mycobacterium tuberculosis
NGFGPAE

SEQ ID NO: 1416372 - protein, 33 aa, Mycobacterium tuberculosis; identical to SEQ ID NO: 181304

SEQ ID NO: 1416373 - protein, 4 aa, Mycobacterium tuberculosis
NGGY

SEQ ID NO: 1416374 - protein, 4 aa, Mycobacterium tuberculosis
NGHI

SEQ ID NO: 1416375 - protein, 6 aa, Mycobacterium tuberculosis
NGLPAG

SEQ ID NO: 1416376 - protein, 14 aa, Mycobacterium tuberculosis
NGNVGFGNSGLGAG

SEQ ID NO: 1416377 - protein, 12 aa, Mycobacterium tuberculosis
NGQTGVSCAPRD

SEQ ID NO: 1416378 - protein, 16 aa, Mycobacterium tuberculosis
NGSEAGPARDAEPNVT

SEQ ID NO: 1416379 - protein, 7 aa, Mycobacterium tuberculosis
NGSGVTV

SEQ ID NO: 1416380 - protein, 10 aa, Mycobacterium tuberculosis
NGSPSWSAAP

SEQ ID NO: 1416381 - protein, 4 aa, Mycobacterium tuberculosis
NGTM

SEQ ID NO: 1416382 - protein, 12 aa, Mycobacterium tuberculosis
NIGHAQAAAGGL

SEQ ID NO: 1416383 - protein, 11 aa, Mycobacterium tuberculosis
NIGHTSAAAGV

SEQ ID NO: 1416384 - protein, 6 aa, Mycobacterium tuberculosis
NKASTN

SEQ ID NO: 1416385 - protein, 4 aa, Mycobacterium tuberculosis
NKHE

SEQ ID NO: 1416386 - protein, 18 aa, Mycobacterium tuberculosis
NLIPGGKSLSGGSAHSPA

SEQ ID NO: 1416387 - protein, 13 aa, Mycobacterium tuberculosis
NLNPSQAHGSGDV

SEQ ID NO: 1416388 - protein, 6 aa, Mycobacterium tuberculosis
NLPEGY

SEQ ID NO: 1416389 - protein, 9 aa, Mycobacterium tuberculosis
NLPTPSGNT

SEQ ID NO: 1416390 - protein, 19 aa, Mycobacterium tuberculosis
NNPYGSRPSTIYPDDKLPD

SEQ ID NO: 1416391 - protein, 12 aa, Mycobacterium tuberculosis
NNSASTVSGSLS

SEQ ID NO: 1416392 - protein, 4 aa, Mycobacterium tuberculosis
NPAK

SEQ ID NO: 1416393 - protein, 4 aa, Mycobacterium tuberculosis
NPAT

SEQ ID NO: 1416394 - protein, 5 aa, Mycobacterium tuberculosis
NPDDW

SEQ ID NO: 1416395 - protein, 4 aa, Mycobacterium tuberculosis
NPDH

SEQ ID NO: 1416396 - protein, 10 aa, Mycobacterium tuberculosis
NPDPRTTSRV

SEQ ID NO: 1416397 - protein, 8 aa, Mycobacterium tuberculosis
NPEEGELR

SEQ ID NO: 1416398 - protein, 9 aa, Mycobacterium tuberculosis
NPHDSPTAR

SEQ ID NO: 1416399 - protein, 13 aa, Mycobacterium tuberculosis
NPLRDKRDKRLPR

SEQ ID NO: 1416400 - protein, 7 aa, Mycobacterium tuberculosis
NPPERLT

SEQ ID NO: 1416401 - protein, 5 aa, Mycobacterium tuberculosis
NPQRR

SEQ ID NO: 1416402 - protein, 8 aa, Mycobacterium tuberculosis
NPRLRARP

SEQ ID NO: 1416403 - protein, 5 aa, Mycobacterium tuberculosis
NPSPE

SEQ ID NO: 1416404 - protein, 6 aa, Mycobacterium tuberculosis
NPTDAK

SEQ ID NO: 1416405 - protein, 8 aa, Mycobacterium tuberculosis
NPTELSEE

SEQ ID NO: 1416406 - protein, 9 aa, Mycobacterium tuberculosis
NQDLAGKDE

SEQ ID NO: 1416407 - protein, 6 aa, Mycobacterium tuberculosis
NQHGPA

SEQ ID NO: 1416408 - protein, 8 aa, Mycobacterium tuberculosis
NRDESKFA

SEQ ID NO: 1416409 - protein, 5 aa, Mycobacterium tuberculosis
NRDQQ

SEQ ID NO: 1416410 - protein, 6 aa, Mycobacterium tuberculosis
NREPVD

SEQ ID NO: 1416411 - protein, 5 aa, Mycobacterium tuberculosis
NRGSD

SEQ ID NO: 1416412 - protein, 19 aa, Mycobacterium tuberculosis
NRKESRGGHAREDYPNRDD

SEQ ID NO: 1416413 - protein, 6 aa, Mycobacterium tuberculosis
NRLPEA

SEQ ID NO: 1416414 - protein, 16 aa, Mycobacterium tuberculosis
NRYAPPPPYPAPDPFE

SEQ ID NO: 1416415 - protein, 47 aa, Mycobacterium tuberculosis; identical to SEQ ID NO: 192901

SEQ ID NO: 1416416 - protein, 8 aa, Mycobacterium tuberculosis
NSAHPESL

SEQ ID NO: 1416417 - protein, 5 aa, Mycobacterium tuberculosis
NSAVH

SEQ ID NO: 1416418 - protein, 6 aa, Mycobacterium tuberculosis
NSENSV

SEQ ID NO: 1416419 - protein, 4 aa, Mycobacterium tuberculosis
NSGA

SEQ ID NO: 1416420 - protein, 6 aa, Mycobacterium tuberculosis
NSGAPV

SEQ ID NO: 1416421 - protein, 5 aa, Mycobacterium tuberculosis
NSPRA

SEQ ID NO: 1416422 - protein, 7 aa, Mycobacterium tuberculosis
NSQRHGI

SEQ ID NO: 1416423 - protein, 20 aa, Mycobacterium tuberculosis
NSQRLQPLKPTRGCSAPTDR

SEQ ID NO: 1416424 - protein, 13 aa, Mycobacterium tuberculosis
NSRPTRAEASDVA

SEQ ID NO: 1416425 - protein, 4 aa, Mycobacterium tuberculosis
NSRT

SEQ ID NO: 1416426 - protein, 6 aa, Mycobacterium tuberculosis
NSSVRA

SEQ ID NO: 1416427 - protein, 9 aa, Mycobacterium tuberculosis
NSTAGGAYV

SEQ ID NO: 1416428 - protein, 13 aa, Mycobacterium tuberculosis
NTAEQNAANAGKG

SEQ ID NO: 1416429 - protein, 6 aa, Mycobacterium tuberculosis
NTEGDS

SEQ ID NO: 1416430 - protein, 15 aa, Mycobacterium tuberculosis
NTESARKSVEQFERE

SEQ ID NO: 1416431 - protein, 5 aa, Mycobacterium tuberculosis
NTFGA

SEQ ID NO: 1416432 - protein, 4 aa, Mycobacterium tuberculosis
NTGG

SEQ ID NO: 1416433 - protein, 17 aa, Mycobacterium tuberculosis
NTGNNNIGNGLTGNNQI

SEQ ID NO: 1416434 - protein, 15 aa, Mycobacterium tuberculosis
NTGNNTYKAVQRSAG

SEQ ID NO: 1416435 - protein, 23 aa, Mycobacterium tuberculosis
NTSSGAGLQGSVGQGNYSAAKAG

SEQ ID NO: 1416436 - protein, 5 aa, Mycobacterium tuberculosis
NVAGT

SEQ ID NO: 1416437 - protein, 7 aa, Mycobacterium tuberculosis
NVGDGNL

SEQ ID NO: 1416438 - protein, 9 aa, Mycobacterium tuberculosis
NVGKPQVAY

SEQ ID NO: 1416439 - protein, 36 aa, Mycobacterium tuberculosis
NVNTGIGNAGSYNTGSYNAGDTNTGDLNPGNANTGY

SEQ ID NO: 1416440 - protein, 4 aa, Mycobacterium tuberculosis
NVSA

SEQ ID NO: 1416441 - protein, 5 aa, Mycobacterium tuberculosis
NVSGN

SEQ ID NO: 1416442 - protein, 4 aa, Mycobacterium tuberculosis
PAAA

SEQ ID NO: 1416443 - protein, 9 aa, Mycobacterium tuberculosis
PAANGVATA

SEQ ID NO: 1416444 - protein, 12 aa, Mycobacterium tuberculosis
PAAPPPDGLPGL

SEQ ID NO: 1416445 - protein, 7 aa, Mycobacterium tuberculosis
PAATPWD

SEQ ID NO: 1416446 - protein, 8 aa, Mycobacterium tuberculosis
PADFADPD

SEQ ID NO: 1416447 - protein, 10 aa, Mycobacterium tuberculosis
PADPSWPDQA

SEQ ID NO: 1416448 - protein, 5 aa, Mycobacterium tuberculosis
PAEGE

SEQ ID NO: 1416449 - protein, 9 aa, Mycobacterium tuberculosis
PAEIGKNRH

SEQ ID NO: 1416450 - protein, 21 aa, Mycobacterium tuberculosis
PAFRGDGTITAGSASQISDGA

SEQ ID NO: 1416451 - protein, 13 aa, Mycobacterium tuberculosis
PAGAGVDASRASA

SEQ ID NO: 1416452 - protein, 11 aa, Mycobacterium tuberculosis
PAGAPPGPYPV

SEQ ID NO: 1416453 - protein, 13 aa, Mycobacterium tuberculosis
PAGRRIGAGHNNA

SEQ ID NO: 1416454 - protein, 6 aa, Mycobacterium tuberculosis
PAGRRQ

SEQ ID NO: 1416455 - protein, 15 aa, Mycobacterium tuberculosis
PAGVGGTALTADLGN

SEQ ID NO: 1416456 - protein, 8 aa, Mycobacterium tuberculosis
PALSAKKI

SEQ ID NO: 1416457 - protein, 9 aa, Mycobacterium tuberculosis
PAPERTPPV

SEQ ID NO: 1416458 - protein, 5 aa, Mycobacterium tuberculosis
PARLP

SEQ ID NO: 1416459 - protein, 4 aa, Mycobacterium tuberculosis
PARV

SEQ ID NO: 1416460 - protein, 4 aa, Mycobacterium tuberculosis
PASA

SEQ ID NO: 1416461 - protein, 5 aa, Mycobacterium tuberculosis
PATTP

SEQ ID NO: 1416462 - protein, 24 aa, Mycobacterium tuberculosis
PAYEPEPGKPAPAAVSAGMNEEQA

SEQ ID NO: 1416463 - protein, 4 aa, Mycobacterium tuberculosis
PCDA

SEQ ID NO: 1416464 - protein, 21 aa, Mycobacterium tuberculosis
PDDPGYAAHGAAARKLAAAEN

SEQ ID NO: 1416465 - protein, 4 aa, Mycobacterium tuberculosis
PDDQ

SEQ ID NO: 1416466 - protein, 5 aa, Mycobacterium tuberculosis
PDELR

SEQ ID NO: 1416467 - protein, 6 aa, Mycobacterium tuberculosis
PDGETR

SEQ ID NO: 1416468 - protein, 7 aa, Mycobacterium tuberculosis
PDGGAQG

SEQ ID NO: 1416469 - protein, 4 aa, Mycobacterium tuberculosis
PDGN

SEQ ID NO: 1416470 - protein, 9 aa, Mycobacterium tuberculosis
PDGTAPGQA

SEQ ID NO: 1416471 - protein, 6 aa, Mycobacterium tuberculosis
PDGTVR

SEQ ID NO: 1416472 - protein, 5 aa, Mycobacterium tuberculosis
PDHDG

SEQ ID NO: 1416473 - protein, 6 aa, Mycobacterium tuberculosis
PDHPGL

SEQ ID NO: 1416474 - protein, 6 aa, Mycobacterium tuberculosis
PDKTAE

SEQ ID NO: 1416475 - protein, 8 aa, Mycobacterium tuberculosis
PDPDKPAN

SEQ ID NO: 1416476 - protein, 8 aa, Mycobacterium tuberculosis
PDPEDEEA

SEQ ID NO: 1416477 - protein, 23 aa, Mycobacterium tuberculosis
PDPEPLGAVTPPGRPAGKPWTYT

SEQ ID NO: 1416478 - protein, 4 aa, Mycobacterium tuberculosis
PDPG

SEQ ID NO: 1416479 - protein, 13 aa, Mycobacterium tuberculosis
PDQGRPLEVGEPA

SEQ ID NO: 1416480 - protein, 9 aa, Mycobacterium tuberculosis
PDQPGRSTV

SEQ ID NO: 1416481 - protein, 10 aa, Mycobacterium tuberculosis
PDREKHGALR

SEQ ID NO: 1416482 - protein, 34 aa, Mycobacterium tuberculosis; identical to SEQ ID NO: 182339

SEQ ID NO: 1416483 - protein, 8 aa, Mycobacterium tuberculosis
PDSNKTQI

SEQ ID NO: 1416484 - protein, 7 aa, Mycobacterium tuberculosis
PDVKPGV

SEQ ID NO: 1416485 - protein, 14 aa, Mycobacterium tuberculosis
PEATQGRRRGSQAT

SEQ ID NO: 1416486 - protein, 10 aa, Mycobacterium tuberculosis
PEDAEDDLHD

SEQ ID NO: 1416487 - protein, 7 aa, Mycobacterium tuberculosis
PEGIPDA

SEQ ID NO: 1416488 - protein, 5 aa, Mycobacterium tuberculosis
PEHQR

SEQ ID NO: 1416489 - protein, 4 aa, Mycobacterium tuberculosis
PEIA

SEQ ID NO: 1416490 - protein, 12 aa, Mycobacterium tuberculosis
PEIAASQATAQR

SEQ ID NO: 1416491 - protein, 10 aa, Mycobacterium tuberculosis
PEIPSPAAAL

SEQ ID NO: 1416492 - protein, 14 aa, Mycobacterium tuberculosis
PENAGELLDPRLGV

SEQ ID NO: 1416493 - protein, 11 aa, Mycobacterium tuberculosis
PERDDDADNPL

SEQ ID NO: 1416494 - protein, 15 aa, Mycobacterium tuberculosis
PERREALSSVQGEYG

SEQ ID NO: 1416495 - protein, 4 aa, Mycobacterium tuberculosis
PESA

SEQ ID NO: 1416496 - protein, 12 aa, Mycobacterium tuberculosis
PETDGLSVVGVA

SEQ ID NO: 1416497 - protein, 6 aa, Mycobacterium tuberculosis
PFAATG

SEQ ID NO: 1416498 - protein, 7 aa, Mycobacterium tuberculosis
PFGGSGA

SEQ ID NO: 1416499 - protein, 4 aa, Mycobacterium tuberculosis
PFSR

SEQ ID NO: 1416500 - protein, 6 aa, Mycobacterium tuberculosis
PGAAET

SEQ ID NO: 1416501 - protein, 13 aa, Mycobacterium tuberculosis
PGAATGPSRIGAY

SEQ ID NO: 1416502 - protein, 11 aa, Mycobacterium tuberculosis
PGAGRPRDPRI

SEQ ID NO: 1416503 - protein, 4 aa, Mycobacterium tuberculosis
PGAL

SEQ ID NO: 1416504 - protein, 25 aa, Mycobacterium tuberculosis
PGDPEFGDPLSTAGEGGPRAAARAA

SEQ ID NO: 1416505 - protein, 5 aa, Mycobacterium tuberculosis
PGEAG

SEQ ID NO: 1416506 - protein, 7 aa, Mycobacterium tuberculosis
PGESRAL

SEQ ID NO: 1416507 - protein, 4 aa, Mycobacterium tuberculosis
PGFA

SEQ ID NO: 1416508 - protein, 21 aa, Mycobacterium tuberculosis
PGGAAPEVTVESGVDSTGMSS

SEQ ID NO: 1416509 - protein, 5 aa, Mycobacterium tuberculosis
PGGQL

SEQ ID NO: 1416510 - protein, 5 aa, Mycobacterium tuberculosis
PGHAE

SEQ ID NO: 1416511 - protein, 4 aa, Mycobacterium tuberculosis
PGHI

SEQ ID NO: 1416512 - protein, 5 aa, Mycobacterium tuberculosis
PGIED

SEQ ID NO: 1416513 - protein, 9 aa, Mycobacterium tuberculosis
PGIGKRGAE

SEQ ID NO: 1416514 - protein, 6 aa, Mycobacterium tuberculosis
PGLNSV

SEQ ID NO: 1416515 - protein, 7 aa, Mycobacterium tuberculosis
PGMEDDA

SEQ ID NO: 1416516 - protein, 10 aa, Mycobacterium tuberculosis
PGMPRDTPYS

SEQ ID NO: 1416517 - protein, 7 aa, Mycobacterium tuberculosis
PGMTMPD

SEQ ID NO: 1416518 - protein, 19 aa, Mycobacterium tuberculosis
PGPGSEPGESRLYQPGDDV

SEQ ID NO: 1416519 - protein, 7 aa, Mycobacterium tuberculosis
PGPHGPQ

SEQ ID NO: 1416520 - protein, 10 aa, Mycobacterium tuberculosis
PGPSFPSYGS

SEQ ID NO: 1416521 - protein, 7 aa, Mycobacterium tuberculosis
PGPVATT

SEQ ID NO: 1416522 - protein, 15 aa, Mycobacterium tuberculosis
PGPVRTELPDASEAS

SEQ ID NO: 1416523 - protein, 4 aa, Mycobacterium tuberculosis
PGQT

SEQ ID NO: 1416524 - protein, 5 aa, Mycobacterium tuberculosis
PGSDA

SEQ ID NO: 1416525 - protein, 6 aa, Mycobacterium tuberculosis
PGTARR

SEQ ID NO: 1416526 - protein, 6 aa, Mycobacterium tuberculosis
PGTDFD

SEQ ID NO: 1416527 - protein, 12 aa, Mycobacterium tuberculosis
PGTNWKSNPNAM

SEQ ID NO: 1416528 - protein, 7 aa, Mycobacterium tuberculosis
PGTQQNL

SEQ ID NO: 1416529 - protein, 5 aa, Mycobacterium tuberculosis
PGVPA

SEQ ID NO: 1416530 - protein, 5 aa, Mycobacterium tuberculosis
PIARE

SEQ ID NO: 1416531 - protein, 7 aa, Mycobacterium tuberculosis
PIEQGDE

SEQ ID NO: 1416532 - protein, 4 aa, Mycobacterium tuberculosis
PIES

SEQ ID NO: 1416533 - protein, 16 aa, Mycobacterium tuberculosis
PIGPACGRRSKGPNHF

SEQ ID NO: 1416534 - protein, 4 aa, Mycobacterium tuberculosis
PING

SEQ ID NO: 1416535 - protein, 5 aa, Mycobacterium tuberculosis
PIPGQ

SEQ ID NO: 1416536 - protein, 4 aa, Mycobacterium tuberculosis
PIPR

SEQ ID NO: 1416537 - protein, 15 aa, Mycobacterium tuberculosis
PISHPDTAILAMLLA

SEQ ID NO: 1416538 - protein, 13 aa, Mycobacterium tuberculosis
PITNPANRHAAER

SEQ ID NO: 1416539 - protein, 7 aa, Mycobacterium tuberculosis
PKALREN

SEQ ID NO: 1416540 - protein, 7 aa, Mycobacterium tuberculosis
PKLRSAL

SEQ ID NO: 1416541 - protein, 4 aa, Mycobacterium tuberculosis
PKPI

SEQ ID NO: 1416542 - protein, 9 aa, Mycobacterium tuberculosis
PKPRNPRDD

SEQ ID NO: 1416543 - protein, 5 aa, Mycobacterium tuberculosis
PKSGA

SEQ ID NO: 1416544 - protein, 14 aa, Mycobacterium tuberculosis
PLASPLGSALGGTP

SEQ ID NO: 1416545 - protein, 6 aa, Mycobacterium tuberculosis
PLHRGR

SEQ ID NO: 1416546 - protein, 10 aa, Mycobacterium tuberculosis
PLPGGETAND

SEQ ID NO: 1416547 - protein, 24 aa, Mycobacterium tuberculosis
PLPGRRPARRSSSRSVRSQRVVDS

SEQ ID NO: 1416548 - protein, 15 aa, Mycobacterium tuberculosis
PLPISPTSEGTPMTE

SEQ ID NO: 1416549 - protein, 7 aa, Mycobacterium tuberculosis
PLPPTGP

SEQ ID NO: 1416550 - protein, 4 aa, Mycobacterium tuberculosis
PLRP

SEQ ID NO: 1416551 - protein, 11 aa, Mycobacterium tuberculosis
PLRPGSGMPPI

SEQ ID NO: 1416552 - protein, 6 aa, Mycobacterium tuberculosis
PNEGVA

SEQ ID NO: 1416553 - protein, 11 aa, Mycobacterium tuberculosis
PNLSRADLPKL

SEQ ID NO: 1416554 - protein, 10 aa, Mycobacterium tuberculosis
PNNPVAQYTP

SEQ ID NO: 1416555 - protein, 4 aa, Mycobacterium tuberculosis
PNPH

SEQ ID NO: 1416556 - protein, 17 aa, Mycobacterium tuberculosis
PNPVGSLAPPDGAAVPD

SEQ ID NO: 1416557 - protein, 6 aa, Mycobacterium tuberculosis
PNSTYV

SEQ ID NO: 1416558 - protein, 4 aa, Mycobacterium tuberculosis
PNTY

SEQ ID NO: 1416559 - protein, 9 aa, Mycobacterium tuberculosis
PPAADPVSL

SEQ ID NO: 1416560 - protein, 18 aa, Mycobacterium tuberculosis
PPAVTEPPQPIPFSGPAR

SEQ ID NO: 1416561 - protein, 6 aa, Mycobacterium tuberculosis
PPDAQN

SEQ ID NO: 1416562 - protein, 7 aa, Mycobacterium tuberculosis
PPDPRVP

SEQ ID NO: 1416563 - protein, 8 aa, Mycobacterium tuberculosis
PPEADHDV

SEQ ID NO: 1416564 - protein, 15 aa, Mycobacterium tuberculosis
PPGLTDEQAITAATA

SEQ ID NO: 1416565 - protein, 7 aa, Mycobacterium tuberculosis
PPGPAQA

SEQ ID NO: 1416566 - protein, 18 aa, Mycobacterium tuberculosis
PPGVDTDRFRPDPAARAE

SEQ ID NO: 1416567 - protein, 18 aa, Mycobacterium tuberculosis
PPIAPSLPTPVPHNEKPQ

SEQ ID NO: 1416568 - protein, 6 aa, Mycobacterium tuberculosis
PPIGPE

SEQ ID NO: 1416569 - protein, 8 aa, Mycobacterium tuberculosis
PPPQIAAN

SEQ ID NO: 1416570 - protein, 4 aa, Mycobacterium tuberculosis
PPQL

SEQ ID NO: 1416571 - protein, 4 aa, Mycobacterium tuberculosis
PPQM

SEQ ID NO: 1416572 - protein, 6 aa, Mycobacterium tuberculosis
PPRSWR

SEQ ID NO: 1416573 - protein, 11 aa, Mycobacterium tuberculosis
PPSAEPRATGH

SEQ ID NO: 1416574 - protein, 4 aa, Mycobacterium tuberculosis
PPSG

SEQ ID NO: 1416575 - protein, 5 aa, Mycobacterium tuberculosis
PPVTV

SEQ ID NO: 1416576 - protein, 7 aa, Mycobacterium tuberculosis
PQAGVDD

SEQ ID NO: 1416577 - protein, 5 aa, Mycobacterium tuberculosis
PQFPG

SEQ ID NO: 1416578 - protein, 7 aa, Mycobacterium tuberculosis
PQGALSA

SEQ ID NO: 1416579 - protein, 9 aa, Mycobacterium tuberculosis
PQHEDARAA

SEQ ID NO: 1416580 - protein, 9 aa, Mycobacterium tuberculosis
PQPPYGHGA

SEQ ID NO: 1416581 - protein, 5 aa, Mycobacterium tuberculosis
PQQPT

SEQ ID NO: 1416582 - protein, 7 aa, Mycobacterium tuberculosis
PRAQRRS

SEQ ID NO: 1416583 - protein, 8 aa, Mycobacterium tuberculosis
PRDPHDAD

SEQ ID NO: 1416584 - protein, 7 aa, Mycobacterium tuberculosis
PRGMHST

SEQ ID NO: 1416585 - protein, 5 aa, Mycobacterium tuberculosis
PRHEY

SEQ ID NO: 1416586 - protein, 4 aa, Mycobacterium tuberculosis
PRHR

SEQ ID NO: 1416587 - protein, 8 aa, Mycobacterium tuberculosis
PRITRAEA

SEQ ID NO: 1416588 - protein, 4 aa, Mycobacterium tuberculosis
PRMR

SEQ ID NO: 1416589 - protein, 8 aa, Mycobacterium tuberculosis
PRRGYGQP

SEQ ID NO: 1416590 - protein, 8 aa, Mycobacterium tuberculosis
PRRPGTPA

SEQ ID NO: 1416591 - protein, 7 aa, Mycobacterium tuberculosis
PRSGTVR

SEQ ID NO: 1416592 - protein, 7 aa, Mycobacterium tuberculosis
PRSLGYG

SEQ ID NO: 1416593 - protein, 7 aa, Mycobacterium tuberculosis
PRSMPAE

SEQ ID NO: 1416594 - protein, 7 aa, Mycobacterium tuberculosis
PRSPYGA

SEQ ID NO: 1416595 - protein, 4 aa, Mycobacterium tuberculosis
PRTP

SEQ ID NO: 1416596 - protein, 4 aa, Mycobacterium tuberculosis
PRVP

SEQ ID NO: 1416597 - protein, 7 aa, Mycobacterium tuberculosis
PRYPSPI

SEQ ID NO: 1416598 - protein, 4 aa, Mycobacterium tuberculosis
PSAI

SEQ ID NO: 1416599 - protein, 4 aa, Mycobacterium tuberculosis
PSCQ

SEQ ID NO: 1416600 - protein, 4 aa, Mycobacterium tuberculosis
PSEA

SEQ ID NO: 1416601 - protein, 8 aa, Mycobacterium tuberculosis
PSELGSPI

SEQ ID NO: 1416602 - protein, 9 aa, Mycobacterium tuberculosis
PSERDPSVP

SEQ ID NO: 1416603 - protein, 10 aa, Mycobacterium tuberculosis
PSGVGKTELS

SEQ ID NO: 1416604 - protein, 7 aa, Mycobacterium tuberculosis
PSGWGTA

SEQ ID NO: 1416605 - protein, 4 aa, Mycobacterium tuberculosis
PSHS

SEQ ID NO: 1416606 - protein, 42 aa, Mycobacterium tuberculosis; identical to SEQ ID NO: 183459

SEQ ID NO: 1416607 - protein, 7 aa, Mycobacterium tuberculosis
PSLRRPQ

SEQ ID NO: 1416608 - protein, 11 aa, Mycobacterium tuberculosis
PSPATPELPAD

SEQ ID NO: 1416609 - protein, 8 aa, Mycobacterium tuberculosis
PSRPNSAE

SEQ ID NO: 1416610 - protein, 10 aa, Mycobacterium tuberculosis
PSSIPADGSY

SEQ ID NO: 1416611 - protein, 5 aa, Mycobacterium tuberculosis
PSSPV

SEQ ID NO: 1416612 - protein, 7 aa, Mycobacterium tuberculosis
PSYETTF

SEQ ID NO: 1416613 - protein, 8 aa, Mycobacterium tuberculosis
PSYLENPK

SEQ ID NO: 1416614 - protein, 4 aa, Mycobacterium tuberculosis
PTAA

SEQ ID NO: 1416615 - protein, 12 aa, Mycobacterium tuberculosis
PTASQSASATPQ

SEQ ID NO: 1416616 - protein, 4 aa, Mycobacterium tuberculosis
PTDD

SEQ ID NO: 1416617 - protein, 6 aa, Mycobacterium tuberculosis
PTDRQI

SEQ ID NO: 1416618 - protein, 4 aa, Mycobacterium tuberculosis
PTHP

SEQ ID NO: 1416619 - protein, 4 aa, Mycobacterium tuberculosis
PTLA

SEQ ID NO: 1416620 - protein, 9 aa, Mycobacterium tuberculosis
PTNDNEITE

SEQ ID NO: 1416621 - protein, 5 aa, Mycobacterium tuberculosis
PTNHL

SEQ ID NO: 1416622 - protein, 16 aa, Mycobacterium tuberculosis
PTPRVTANHRGGRRAN

SEQ ID NO: 1416623 - protein, 18 aa, Mycobacterium tuberculosis
PTRTVDGGWAGGYGTSKW

SEQ ID NO: 1416624 - protein, 7 aa, Mycobacterium tuberculosis
PTSGNTG

SEQ ID NO: 1416625 - protein, 16 aa, Mycobacterium tuberculosis
PTTKDRQGNDRGTSYR

SEQ ID NO: 1416626 - protein, 5 aa, Mycobacterium tuberculosis
PTVTS

SEQ ID NO: 1416627 - protein, 6 aa, Mycobacterium tuberculosis
PVEGQT

SEQ ID NO: 1416628 - protein, 10 aa, Mycobacterium tuberculosis
PVNRDGQPEK

SEQ ID NO: 1416629 - protein, 16 aa, Mycobacterium tuberculosis
PVPGYHAPPDRTAGVA

SEQ ID NO: 1416630 - protein, 4 aa, Mycobacterium tuberculosis
PVQA

SEQ ID NO: 1416631 - protein, 29 aa, Mycobacterium tuberculosis
PVQKRSSYKESPGGRKEALRRSRATGTIT

SEQ ID NO: 1416632 - protein, 7 aa, Mycobacterium tuberculosis
PVSHKPR

SEQ ID NO: 1416633 - protein, 14 aa, Mycobacterium tuberculosis
PVSPGAQWPATRGT

SEQ ID NO: 1416634 - protein, 7 aa, Mycobacterium tuberculosis
PVTASYN

SEQ ID NO: 1416635 - protein, 5 aa, Mycobacterium tuberculosis
PVTGT

SEQ ID NO: 1416636 - protein, 4 aa, Mycobacterium tuberculosis
PYQQ

SEQ ID NO: 1416637 - protein, 10 aa, Mycobacterium tuberculosis
QAAGADAVHP

SEQ ID NO: 1416638 - protein, 9 aa, Mycobacterium tuberculosis
QAARDEVGV

SEQ ID NO: 1416639 - protein, 17 aa, Mycobacterium tuberculosis
QAEQAASQARAAAAAYE

SEQ ID NO: 1416640 - protein, 4 aa, Mycobacterium tuberculosis
QAFG

SEQ ID NO: 1416641 - protein, 13 aa, Mycobacterium tuberculosis
QAGEKGRDSRCEP

SEQ ID NO: 1416642 - protein, 6 aa, Mycobacterium tuberculosis
QAGYDK

SEQ ID NO: 1416643 - protein, 17 aa, Mycobacterium tuberculosis
QALTNQNPQPAASQEDA

SEQ ID NO: 1416644 - protein, 12 aa, Mycobacterium tuberculosis
QANEDYTEEFDP

SEQ ID NO: 1416645 - protein, 8 aa, Mycobacterium tuberculosis
QANKGQAI

SEQ ID NO: 1416646 - protein, 9 aa, Mycobacterium tuberculosis
QANYAASKA

SEQ ID NO: 1416647 - protein, 16 aa, Mycobacterium tuberculosis
QAPGYPTSLNEHPKAA

SEQ ID NO: 1416648 - protein, 7 aa, Mycobacterium tuberculosis
QAPTRAL

SEQ ID NO: 1416649 - protein, 9 aa, Mycobacterium tuberculosis
QAVDPGGEV

SEQ ID NO: 1416650 - protein, 9 aa, Mycobacterium tuberculosis
QCGSSQQAI

SEQ ID NO: 1416651 - protein, 17 aa, Mycobacterium tuberculosis
QDGGNSYVRGYSGGEQR

SEQ ID NO: 1416652 - protein, 10 aa, Mycobacterium tuberculosis
QDPHNTDRRF

SEQ ID NO: 1416653 - protein, 9 aa, Mycobacterium tuberculosis
QDRIEGRSW

SEQ ID NO: 1416654 - protein, 18 aa, Mycobacterium tuberculosis
QDTADRLTNTAKAESDKM

SEQ ID NO: 1416655 - protein, 13 aa, Mycobacterium tuberculosis
QDTPPNDQAGLEK

SEQ ID NO: 1416656 - protein, 7 aa, Mycobacterium tuberculosis
QEAEDTY

SEQ ID NO: 1416657 - protein, 5 aa, Mycobacterium tuberculosis
QELTG

SEQ ID NO: 1416658 - protein, 6 aa, Mycobacterium tuberculosis
QENRSL

SEQ ID NO: 1416659 - protein, 6 aa, Mycobacterium tuberculosis
QEPALA

SEQ ID NO: 1416660 - protein, 19 aa, Mycobacterium tuberculosis
QERAQKIAAEAAAAGSGDF

SEQ ID NO: 1416661 - protein, 4 aa, Mycobacterium tuberculosis
QGCG

SEQ ID NO: 1416662 - protein, 5 aa, Mycobacterium tuberculosis
QGEAP

SEQ ID NO: 1416663 - protein, 6 aa, Mycobacterium tuberculosis
QGGPIG

SEQ ID NO: 1416664 - protein, 6 aa, Mycobacterium tuberculosis
QGIEAQ

SEQ ID NO: 1416665 - protein, 4 aa, Mycobacterium tuberculosis
QGIS

SEQ ID NO: 1416666 - protein, 11 aa, Mycobacterium tuberculosis
QGISSENAKKI

SEQ ID NO: 1416667 - protein, 7 aa, Mycobacterium tuberculosis
QGNPVPS

SEQ ID NO: 1416668 - protein, 7 aa, Mycobacterium tuberculosis
QGPAAPW

SEQ ID NO: 1416669 - protein, 8 aa, Mycobacterium tuberculosis
QGQAGRLP

SEQ ID NO: 1416670 - protein, 8 aa, Mycobacterium tuberculosis
QGRGREAD

SEQ ID NO: 1416671 - protein, 13 aa, Mycobacterium tuberculosis
QGRNTGPTEGPAI

SEQ ID NO: 1416672 - protein, 4 aa, Mycobacterium tuberculosis
QGTE

SEQ ID NO: 1416673 - protein, 12 aa, Mycobacterium tuberculosis
QGTGEGATFARS

SEQ ID NO: 1416674 - protein, 4 aa, Mycobacterium tuberculosis
QHDD

SEQ ID NO: 1416675 - protein, 17 aa, Mycobacterium tuberculosis
QHHPRQRGIASGGTTVN

SEQ ID NO: 1416676 - protein, 6 aa, Mycobacterium tuberculosis
QHPEEQ

SEQ ID NO: 1416677 - protein, 4 aa, Mycobacterium tuberculosis
QHSM

SEQ ID NO: 1416678 - protein, 5 aa, Mycobacterium tuberculosis
QHTTE

SEQ ID NO: 1416679 - protein, 5 aa, Mycobacterium tuberculosis
QIPDE

SEQ ID NO: 1416680 - protein, 8 aa, Mycobacterium tuberculosis
QKDNAQQV

SEQ ID NO: 1416681 - protein, 6 aa, Mycobacterium tuberculosis
QKDRDA

SEQ ID NO: 1416682 - protein, 8 aa, Mycobacterium tuberculosis
QKIRDDPR

SEQ ID NO: 1416683 - protein, 13 aa, Mycobacterium tuberculosis
QKRPPDWSPFPRY

SEQ ID NO: 1416684 - protein, 5 aa, Mycobacterium tuberculosis
QKSID

SEQ ID NO: 1416685 - protein, 11 aa, Mycobacterium tuberculosis
QKVGNGHPGTA

SEQ ID NO: 1416686 - protein, 12 aa, Mycobacterium tuberculosis
QLAGGDAQANAA

SEQ ID NO: 1416687 - protein, 17 aa, Mycobacterium tuberculosis
QLAPRDDAERRKALEAG

SEQ ID NO: 1416688 - protein, 7 aa, Mycobacterium tuberculosis
QLGTGGF

SEQ ID NO: 1416689 - protein, 7 aa, Mycobacterium tuberculosis
QLNNNRR

SEQ ID NO: 1416690 - protein, 7 aa, Mycobacterium tuberculosis
QLPPTYD

SEQ ID NO: 1416691 - protein, 5 aa, Mycobacterium tuberculosis
QMPDG

SEQ ID NO: 1416692 - protein, 12 aa, Mycobacterium tuberculosis
QNAPAIAATEAQ

SEQ ID NO: 1416693 - protein, 6 aa, Mycobacterium tuberculosis
QNASGA

SEQ ID NO: 1416694 - protein, 6 aa, Mycobacterium tuberculosis
QNGQGV

SEQ ID NO: 1416695 - protein, 7 aa, Mycobacterium tuberculosis
QPATPQA

SEQ ID NO: 1416696 - protein, 6 aa, Mycobacterium tuberculosis
QPDKPD

SEQ ID NO: 1416697 - protein, 4 aa, Mycobacterium tuberculosis
QPEA

SEQ ID NO: 1416698 - protein, 11 aa, Mycobacterium tuberculosis
QPGFTDPRNGR

SEQ ID NO: 1416699 - protein, 10 aa, Mycobacterium tuberculosis
QPHTAVRRGG

SEQ ID NO: 1416700 - protein, 6 aa, Mycobacterium tuberculosis
QPIPDL

SEQ ID NO: 1416701 - protein, 5 aa, Mycobacterium tuberculosis
QPSRV

SEQ ID NO: 1416702 - protein, 4 aa, Mycobacterium tuberculosis
QPVG

SEQ ID NO: 1416703 - protein, 4 aa, Mycobacterium tuberculosis
QQEA

SEQ ID NO: 1416704 - protein, 6 aa, Mycobacterium tuberculosis
QQFTTP

SEQ ID NO: 1416705 - protein, 7 aa, Mycobacterium tuberculosis
QQNPEAA

SEQ ID NO: 1416706 - protein, 7 aa, Mycobacterium tuberculosis
QQYPPDE

SEQ ID NO: 1416707 - protein, 9 aa, Mycobacterium tuberculosis
QRAEWSEQR

SEQ ID NO: 1416708 - protein, 14 aa, Mycobacterium tuberculosis
QRARDRAEANRGAR

SEQ ID NO: 1416709 - protein, 5 aa, Mycobacterium tuberculosis
QRCES

SEQ ID NO: 1416710 - protein, 8 aa, Mycobacterium tuberculosis
QRCGEAGR

SEQ ID NO: 1416711 - protein, 6 aa, Mycobacterium tuberculosis
QRCPPR

SEQ ID NO: 1416712 - protein, 5 aa, Mycobacterium tuberculosis
QRGQE

SEQ ID NO: 1416713 - protein, 10 aa, Mycobacterium tuberculosis
QRGSGAGGVI

SEQ ID NO: 1416714 - protein, 11 aa, Mycobacterium tuberculosis
QRGYGRSSKYR

SEQ ID NO: 1416715 - protein, 6 aa, Mycobacterium tuberculosis
QRHDGL

SEQ ID NO: 1416716 - protein, 5 aa, Mycobacterium tuberculosis
QRNRS

SEQ ID NO: 1416717 - protein, 5 aa, Mycobacterium tuberculosis
QRVST

SEQ ID NO: 1416718 - protein, 6 aa, Mycobacterium tuberculosis
QSAAAE

SEQ ID NO: 1416719 - protein, 8 aa, Mycobacterium tuberculosis
QSGSGKST

SEQ ID NO: 1416720 - protein, 13 aa, Mycobacterium tuberculosis
QSGVGDTGDDVRA

SEQ ID NO: 1416721 - protein, 4 aa, Mycobacterium tuberculosis
QSIQ

SEQ ID NO: 1416722 - protein, 5 aa, Mycobacterium tuberculosis
QSPGL

SEQ ID NO: 1416723 - protein, 9 aa, Mycobacterium tuberculosis
QSPGLSSAE

SEQ ID NO: 1416724 - protein, 5 aa, Mycobacterium tuberculosis
QTEAM

SEQ ID NO: 1416725 - protein, 8 aa, Mycobacterium tuberculosis
QTEQEGIT

SEQ ID NO: 1416726 - protein, 5 aa, Mycobacterium tuberculosis
QTIGR

SEQ ID NO: 1416727 - protein, 21 aa, Mycobacterium tuberculosis
QTTVSAPGSGRGPNPGNVSVS

SEQ ID NO: 1416728 - protein, 5 aa, Mycobacterium tuberculosis
QVDLG

SEQ ID NO: 1416729 - protein, 12 aa, Mycobacterium tuberculosis
QVELGSRNERPM

SEQ ID NO: 1416730 - protein, 4 aa, Mycobacterium tuberculosis
QVGR

SEQ ID NO: 1416731 - protein, 5 aa, Mycobacterium tuberculosis
QVPDE

SEQ ID NO: 1416732 - protein, 5 aa, Mycobacterium tuberculosis
QVPED

SEQ ID NO: 1416733 - protein, 23 aa, Mycobacterium tuberculosis
QVPGGTSAAIPSASSTPSLPNLG

SEQ ID NO: 1416734 - protein, 6 aa, Mycobacterium tuberculosis
QVRDGK

SEQ ID NO: 1416735 - protein, 14 aa, Mycobacterium tuberculosis
QVRGRGAESAAPLG

SEQ ID NO: 1416736 - protein, 6 aa, Mycobacterium tuberculosis
QVRPEE

SEQ ID NO: 1416737 - protein, 4 aa, Mycobacterium tuberculosis
QVSR

SEQ ID NO: 1416738 - protein, 15 aa, Mycobacterium tuberculosis
QVVGPREGDTPRTRL

SEQ ID NO: 1416739 - protein, 6 aa, Mycobacterium tuberculosis
RAAELA

SEQ ID NO: 1416740 - protein, 10 aa, Mycobacterium tuberculosis
RAAGNRAARA

SEQ ID NO: 1416741 - protein, 9 aa, Mycobacterium tuberculosis
RAAGPSRAK

SEQ ID NO: 1416742 - protein, 12 aa, Mycobacterium tuberculosis
RAAGRVDGVRPG

SEQ ID NO: 1416743 - protein, 16 aa, Mycobacterium tuberculosis
RAEAEGTLRRGSAAEL

SEQ ID NO: 1416744 - protein, 8 aa, Mycobacterium tuberculosis
RAEARHPP

SEQ ID NO: 1416745 - protein, 12 aa, Mycobacterium tuberculosis
RAGGNSDATAEI

SEQ ID NO: 1416746 - protein, 31 aa, Mycobacterium tuberculosis
RAGRAAADYAARHQKSDRGPSSAVRAQARTE

SEQ ID NO: 1416747 - protein, 7 aa, Mycobacterium tuberculosis
RAGRELS

SEQ ID NO: 1416748 - protein, 7 aa, Mycobacterium tuberculosis
RAGRRTG

SEQ ID NO: 1416749 - protein, 16 aa, Mycobacterium tuberculosis
RAGSADTSGGDQPTLG

SEQ ID NO: 1416750 - protein, 6 aa, Mycobacterium tuberculosis
RAHAAD

SEQ ID NO: 1416751 - protein, 14 aa, Mycobacterium tuberculosis
RAHATSGEESAPVT

SEQ ID NO: 1416752 - protein, 7 aa, Mycobacterium tuberculosis
RALNSSE

SEQ ID NO: 1416753 - protein, 6 aa, Mycobacterium tuberculosis
RANVSK

SEQ ID NO: 1416754 - protein, 6 aa, Mycobacterium tuberculosis
RAPSVR

SEQ ID NO: 1416755 - protein, 7 aa, Mycobacterium tuberculosis
RAPTPPL

SEQ ID NO: 1416756 - protein, 5 aa, Mycobacterium tuberculosis
RAQNP

SEQ ID NO: 1416757 - protein, 6 aa, Mycobacterium tuberculosis
RAQRYR

SEQ ID NO: 1416758 - protein, 8 aa, Mycobacterium tuberculosis
RAQSAQRW

SEQ ID NO: 1416759 - protein, 11 aa, Mycobacterium tuberculosis
RARDNARKAGV

SEQ ID NO: 1416760 - protein, 20 aa, Mycobacterium tuberculosis
RARGGAHGAASDGMAHRIRF

SEQ ID NO: 1416761 - protein, 11 aa, Mycobacterium tuberculosis
RASAAERDVTT

SEQ ID NO: 1416762 - protein, 5 aa, Mycobacterium tuberculosis
RASDP

SEQ ID NO: 1416763 - protein, 13 aa, Mycobacterium tuberculosis
RASEETWRELANE

SEQ ID NO: 1416764 - protein, 6 aa, Mycobacterium tuberculosis
RASVRN

SEQ ID NO: 1416765 - protein, 4 aa, Mycobacterium tuberculosis
RATA

SEQ ID NO: 1416766 - protein, 7 aa, Mycobacterium tuberculosis
RATEETV

SEQ ID NO: 1416767 - protein, 15 aa, Mycobacterium tuberculosis
RATPAGRAALTEDRR

SEQ ID NO: 1416768 - protein, 14 aa, Mycobacterium tuberculosis
RATSGDNHLGGDDW

SEQ ID NO: 1416769 - protein, 8 aa, Mycobacterium tuberculosis
RAVPDQDQ

SEQ ID NO: 1416770 - protein, 7 aa, Mycobacterium tuberculosis
RCGEDAV

SEQ ID NO: 1416771 - protein, 5 aa, Mycobacterium tuberculosis
RCRRR

SEQ ID NO: 1416772 - protein, 5 aa, Mycobacterium tuberculosis
RDADL

SEQ ID NO: 1416773 - protein, 5 aa, Mycobacterium tuberculosis
RDADY

SEQ ID NO: 1416774 - protein, 10 aa, Mycobacterium tuberculosis
RDARPTSDPR

SEQ ID NO: 1416775 - protein, 7 aa, Mycobacterium tuberculosis
RDDPAAA

SEQ ID NO: 1416776 - protein, 9 aa, Mycobacterium tuberculosis
RDDPDEARP

SEQ ID NO: 1416777 - protein, 7 aa, Mycobacterium tuberculosis
RDDVPED

SEQ ID NO: 1416778 - protein, 6 aa, Mycobacterium tuberculosis
RDEDSV

SEQ ID NO: 1416779 - protein, 5 aa, Mycobacterium tuberculosis
RDEMT

SEQ ID NO: 1416780 - protein, 8 aa, Mycobacterium tuberculosis
RDGDAARD

SEQ ID NO: 1416781 - protein, 5 aa, Mycobacterium tuberculosis
RDGEY

SEQ ID NO: 1416782 - protein, 6 aa, Mycobacterium tuberculosis
RDGQNK

SEQ ID NO: 1416783 - protein, 4 aa, Mycobacterium tuberculosis
RDGR

SEQ ID NO: 1416784 - protein, 5 aa, Mycobacterium tuberculosis
RDGRE

SEQ ID NO: 1416785 - protein, 12 aa, Mycobacterium tuberculosis
RDGSYDAGERWP

SEQ ID NO: 1416786 - protein, 10 aa, Mycobacterium tuberculosis
RDKAGHSAFT

SEQ ID NO: 1416787 - protein, 4 aa, Mycobacterium tuberculosis
RDQP

SEQ ID NO: 1416788 - protein, 5 aa, Mycobacterium tuberculosis
RDRDY

SEQ ID NO: 1416789 - protein, 9 aa, Mycobacterium tuberculosis
RDRRARKGE

SEQ ID NO: 1416790 - protein, 6 aa, Mycobacterium tuberculosis
RDSAPS

SEQ ID NO: 1416791 - protein, 9 aa, Mycobacterium tuberculosis
REAEPGSDH

SEQ ID NO: 1416792 - protein, 4 aa, Mycobacterium tuberculosis
REEM

SEQ ID NO: 1416793 - protein, 4 aa, Mycobacterium tuberculosis
REFY

SEQ ID NO: 1416794 - protein, 9 aa, Mycobacterium tuberculosis
REGAVSAQS

SEQ ID NO: 1416795 - protein, 4 aa, Mycobacterium tuberculosis
REGG

SEQ ID NO: 1416796 - protein, 11 aa, Mycobacterium tuberculosis
REPQSAGACGS

SEQ ID NO: 1416797 - protein, 10 aa, Mycobacterium tuberculosis
RERRRRLAER

SEQ ID NO: 1416798 - protein, 7 aa, Mycobacterium tuberculosis
RFSTRAE

SEQ ID NO: 1416799 - protein, 12 aa, Mycobacterium tuberculosis
RGAAELDGATAT

SEQ ID NO: 1416800 - protein, 6 aa, Mycobacterium tuberculosis
RGADRP

SEQ ID NO: 1416801 - protein, 11 aa, Mycobacterium tuberculosis
RGAEIGPGTRL

SEQ ID NO: 1416802 - protein, 4 aa, Mycobacterium tuberculosis
RGAL

SEQ ID NO: 1416803 - protein, 14 aa, Mycobacterium tuberculosis
RGDAPDAFDDAARP

SEQ ID NO: 1416804 - protein, 13 aa, Mycobacterium tuberculosis
RGDPDSGTAALSA

SEQ ID NO: 1416805 - protein, 7 aa, Mycobacterium tuberculosis
RGEDESR

SEQ ID NO: 1416806 - protein, 9 aa, Mycobacterium tuberculosis
RGEKMSKSV

SEQ ID NO: 1416807 - protein, 5 aa, Mycobacterium tuberculosis
RGEQM

SEQ ID NO: 1416808 - protein, 6 aa, Mycobacterium tuberculosis
RGFPSP

SEQ ID NO: 1416809 - protein, 7 aa, Mycobacterium tuberculosis
RGGSGDW

SEQ ID NO: 1416810 - protein, 8 aa, Mycobacterium tuberculosis
RGGYDGRG

SEQ ID NO: 1416811 - protein, 4 aa, Mycobacterium tuberculosis
RGKI

SEQ ID NO: 1416812 - protein, 13 aa, Mycobacterium tuberculosis
RGKTIRPKTLNQK

SEQ ID NO: 1416813 - protein, 5 aa, Mycobacterium tuberculosis
RGLGR

SEQ ID NO: 1416814 - protein, 4 aa, Mycobacterium tuberculosis
RGNK

SEQ ID NO: 1416815 - protein, 12 aa, Mycobacterium tuberculosis
RGPGLRPAGAGI

SEQ ID NO: 1416816 - protein, 8 aa, Mycobacterium tuberculosis
RGPNGQDL

SEQ ID NO: 1416817 - protein, 6 aa, Mycobacterium tuberculosis
RGRDEG

SEQ ID NO: 1416818 - protein, 4 aa, Mycobacterium tuberculosis
RGRN

SEQ ID NO: 1416819 - protein, 10 aa, Mycobacterium tuberculosis
RGRRGSVAAT

SEQ ID NO: 1416820 - protein, 7 aa, Mycobacterium tuberculosis
RGSGLDW

SEQ ID NO: 1416821 - protein, 11 aa, Mycobacterium tuberculosis
RGSVPASTQLA

SEQ ID NO: 1416822 - protein, 16 aa, Mycobacterium tuberculosis
RGTKAKIRDTRKTLPG

SEQ ID NO: 1416823 - protein, 6 aa, Mycobacterium tuberculosis
RGTWTP

SEQ ID NO: 1416824 - protein, 17 aa, Mycobacterium tuberculosis
RGVGASEGQTPDTVTTM

SEQ ID NO: 1416825 - protein, 12 aa, Mycobacterium tuberculosis
RGYDSDHPRVQG

SEQ ID NO: 1416826 - protein, 6 aa, Mycobacterium tuberculosis
RGYDST

SEQ ID NO: 1416827 - protein, 13 aa, Mycobacterium tuberculosis
RGYGNTSSRDIAR

SEQ ID NO: 1416828 - protein, 7 aa, Mycobacterium tuberculosis
RHDPSDT

SEQ ID NO: 1416829 - protein, 4 aa, Mycobacterium tuberculosis
RHPE

SEQ ID NO: 1416830 - protein, 20 aa, Mycobacterium tuberculosis
RHTGGTEVELTDTGRTQAEL

SEQ ID NO: 1416831 - protein, 18 aa, Mycobacterium tuberculosis
RHTGKDAGVIRKDTDRDK

SEQ ID NO: 1416832 - protein, 17 aa, Mycobacterium tuberculosis
RIAEETARAEGKPEQAL

SEQ ID NO: 1416833 - protein, 10 aa, Mycobacterium tuberculosis
RIGEQTQQLA

SEQ ID NO: 1416834 - protein, 8 aa, Mycobacterium tuberculosis
RIPQAPNA

SEQ ID NO: 1416835 - protein, 6 aa, Mycobacterium tuberculosis
RIPTRH

SEQ ID NO: 1416836 - protein, 10 aa, Mycobacterium tuberculosis
RISGDTSAAH

SEQ ID NO: 1416837 - protein, 8 aa, Mycobacterium tuberculosis
RISSGTHS

SEQ ID NO: 1416838 - protein, 22 aa, Mycobacterium tuberculosis
RKAKVDGIPDTESVVTPDLLED

SEQ ID NO: 1416839 - protein, 7 aa, Mycobacterium tuberculosis
RKAQPLL

SEQ ID NO: 1416840 - protein, 5 aa, Mycobacterium tuberculosis
RKDIA

SEQ ID NO: 1416841 - protein, 17 aa, Mycobacterium tuberculosis
RKGRNNSPTAAPTDVGS

SEQ ID NO: 1416842 - protein, 12 aa, Mycobacterium tuberculosis
RKGWDGFALALV

SEQ ID NO: 1416843 - protein, 7 aa, Mycobacterium tuberculosis
RKQFGKP

SEQ ID NO: 1416844 - protein, 15 aa, Mycobacterium tuberculosis
RKRGVGVRPSLVSTA

SEQ ID NO: 1416845 - protein, 19 aa, Mycobacterium tuberculosis
RKSDREALTRAGSEPPSGD

SEQ ID NO: 1416846 - protein, 5 aa, Mycobacterium tuberculosis
RKSRS

SEQ ID NO: 1416847 - protein, 4 aa, Mycobacterium tuberculosis
RKTD

SEQ ID NO: 1416848 - protein, 5 aa, Mycobacterium tuberculosis
RLDPS

SEQ ID NO: 1416849 - protein, 7 aa, Mycobacterium tuberculosis
RLGANPG

SEQ ID NO: 1416850 - protein, 8 aa, Mycobacterium tuberculosis
RLGGAEMS

SEQ ID NO: 1416851 - protein, 8 aa, Mycobacterium tuberculosis
RLPDAATS

SEQ ID NO: 1416852 - protein, 8 aa, Mycobacterium tuberculosis
RLPPTDLT

SEQ ID NO: 1416853 - protein, 16 aa, Mycobacterium tuberculosis
RLQDGEPYLAGTARTP

SEQ ID NO: 1416854 - protein, 7 aa, Mycobacterium tuberculosis
RLSGTKV

SEQ ID NO: 1416855 - protein, 12 aa, Mycobacterium tuberculosis
RLTGKSKDEVTA

SEQ ID NO: 1416856 - protein, 19 aa, Mycobacterium tuberculosis
RLTGSSDLYEATGRRPSAS

SEQ ID NO: 1416857 - protein, 5 aa, Mycobacterium tuberculosis
RMKAG

SEQ ID NO: 1416858 - protein, 6 aa, Mycobacterium tuberculosis
RNGTGQ

SEQ ID NO: 1416859 - protein, 4 aa, Mycobacterium tuberculosis
RNPV

SEQ ID NO: 1416860 - protein, 4 aa, Mycobacterium tuberculosis
RNRG

SEQ ID NO: 1416861 - protein, 5 aa, Mycobacterium tuberculosis
RNTDV

SEQ ID NO: 1416862 - protein, 4 aa, Mycobacterium tuberculosis
RPAV

SEQ ID NO: 1416863 - protein, 8 aa, Mycobacterium tuberculosis
RPDERAHR

SEQ ID NO: 1416864 - protein, 7 aa, Mycobacterium tuberculosis
RPEEVTD

SEQ ID NO: 1416865 - protein, 16 aa, Mycobacterium tuberculosis
RPEGGWTPNVHGGREN

SEQ ID NO: 1416866 - protein, 6 aa, Mycobacterium tuberculosis
RPEPPS

SEQ ID NO: 1416867 - protein, 6 aa, Mycobacterium tuberculosis
RPERFA

SEQ ID NO: 1416868 - protein, 19 aa, Mycobacterium tuberculosis
RPEVSAYRRSSRAPARGAS

SEQ ID NO: 1416869 - protein, 8 aa, Mycobacterium tuberculosis
RPGERNGV

SEQ ID NO: 1416870 - protein, 5 aa, Mycobacterium tuberculosis
RPGGV

SEQ ID NO: 1416871 - protein, 8 aa, Mycobacterium tuberculosis
RPGKFGGD

SEQ ID NO: 1416872 - protein, 5 aa, Mycobacterium tuberculosis
RPGRI

SEQ ID NO: 1416873 - protein, 30 aa, Mycobacterium tuberculosis
RPHRESAHDPLDGDPATRTQTERGGAERGF

SEQ ID NO: 1416874 - protein, 8 aa, Mycobacterium tuberculosis
RPKSGSIK

SEQ ID NO: 1416875 - protein, 8 aa, Mycobacterium tuberculosis
RPNTNNVG

SEQ ID NO: 1416876 - protein, 6 aa, Mycobacterium tuberculosis
RPPESF

SEQ ID NO: 1416877 - protein, 5 aa, Mycobacterium tuberculosis
RPPIS

SEQ ID NO: 1416878 - protein, 10 aa, Mycobacterium tuberculosis
RPRAQSRGTA

SEQ ID NO: 1416879 - protein, 13 aa, Mycobacterium tuberculosis
RPSNPASHRGKGW

SEQ ID NO: 1416880 - protein, 4 aa, Mycobacterium tuberculosis
RPVR

SEQ ID NO: 1416881 - protein, 6 aa, Mycobacterium tuberculosis
RQCPPR

SEQ ID NO: 1416882 - protein, 4 aa, Mycobacterium tuberculosis
RQGD

SEQ ID NO: 1416883 - protein, 11 aa, Mycobacterium tuberculosis
RQGPRNRTRTV

SEQ ID NO: 1416884 - protein, 16 aa, Mycobacterium tuberculosis
RQLRPDAPDCDSGADE

SEQ ID NO: 1416885 - protein, 6 aa, Mycobacterium tuberculosis
RQRAEA

SEQ ID NO: 1416886 - protein, 10 aa, Mycobacterium tuberculosis
RQRAEQAGGE

SEQ ID NO: 1416887 - protein, 14 aa, Mycobacterium tuberculosis
RQRAGGGPGAGRLQ

SEQ ID NO: 1416888 - protein, 4 aa, Mycobacterium tuberculosis
RQSW

SEQ ID NO: 1416889 - protein, 6 aa, Mycobacterium tuberculosis
RQTDPY

SEQ ID NO: 1416890 - protein, 34 aa, Mycobacterium tuberculosis
RRAATRSGAGLRAPDHRGASRDRRAGADRGCRGG

SEQ ID NO: 1416891 - protein, 5 aa, Mycobacterium tuberculosis
RRADQ

SEQ ID NO: 1416892 - protein, 7 aa, Mycobacterium tuberculosis
RRAGYSG

SEQ ID NO: 1416893 - protein, 5 aa, Mycobacterium tuberculosis
RRARG

SEQ ID NO: 1416894 - protein, 11 aa, Mycobacterium tuberculosis
RRDLNDPKTIE

SEQ ID NO: 1416895 - protein, 10 aa, Mycobacterium tuberculosis
RRDSPARGSR

SEQ ID NO: 1416896 - protein, 5 aa, Mycobacterium tuberculosis
RREAG

SEQ ID NO: 1416897 - protein, 8 aa, Mycobacterium tuberculosis
RREHDEAA

SEQ ID NO: 1416898 - protein, 11 aa, Mycobacterium tuberculosis
RRGDRAEGAAE

SEQ ID NO: 1416899 - protein, 5 aa, Mycobacterium tuberculosis
RRGLD

SEQ ID NO: 1416900 - protein, 7 aa, Mycobacterium tuberculosis
RRGPAHS

SEQ ID NO: 1416901 - protein, 9 aa, Mycobacterium tuberculosis
RRPAEATGA

SEQ ID NO: 1416902 - protein, 6 aa, Mycobacterium tuberculosis
RRPGEP

SEQ ID NO: 1416903 - protein, 22 aa, Mycobacterium tuberculosis
RRPRRRQIDDTGDATSSKSALA

SEQ ID NO: 1416904 - protein, 7 aa, Mycobacterium tuberculosis
RRPYTYT

SEQ ID NO: 1416905 - protein, 6 aa, Mycobacterium tuberculosis
RRRGEN

SEQ ID NO: 1416906 - protein, 4 aa, Mycobacterium tuberculosis
RRRL

SEQ ID NO: 1416907 - protein, 8 aa, Mycobacterium tuberculosis
RRRSPEAH

SEQ ID NO: 1416908 - protein, 5 aa, Mycobacterium tuberculosis
RRRTD

SEQ ID NO: 1416909 - protein, 5 aa, Mycobacterium tuberculosis
RRSGY

SEQ ID NO: 1416910 - protein, 8 aa, Mycobacterium tuberculosis
RRSPTRGE

SEQ ID NO: 1416911 - protein, 7 aa, Mycobacterium tuberculosis
RRVGGAT

SEQ ID NO: 1416912 - protein, 10 aa, Mycobacterium tuberculosis
RRVGTYSGGM

SEQ ID NO: 1416913 - protein, 5 aa, Mycobacterium tuberculosis
RRYAS

SEQ ID NO: 1416914 - protein, 18 aa, Mycobacterium tuberculosis
RRYPEAGRATATKSSRHS

SEQ ID NO: 1416915 - protein, 7 aa, Mycobacterium tuberculosis
RSAGLGL

SEQ ID NO: 1416916 - protein, 10 aa, Mycobacterium tuberculosis
RSAGSIKKIT

SEQ ID NO: 1416917 - protein, 8 aa, Mycobacterium tuberculosis
RSALQNAA

SEQ ID NO: 1416918 - protein, 8 aa, Mycobacterium tuberculosis
RSALQSGA

SEQ ID NO: 1416919 - protein, 7 aa, Mycobacterium tuberculosis
RSASTDP

SEQ ID NO: 1416920 - protein, 14 aa, Mycobacterium tuberculosis
RSAVTDSERDIRYD

SEQ ID NO: 1416921 - protein, 4 aa, Mycobacterium tuberculosis
RSCE

SEQ ID NO: 1416922 - protein, 18 aa, Mycobacterium tuberculosis
RSDAHQASTTAPPPPGLT

SEQ ID NO: 1416923 - protein, 25 aa, Mycobacterium tuberculosis
RSDATRSRSRDRIRQSESNSPERSI

SEQ ID NO: 1416924 - protein, 6 aa, Mycobacterium tuberculosis
RSDDQV

SEQ ID NO: 1416925 - protein, 7 aa, Mycobacterium tuberculosis
RSDESLR

SEQ ID NO: 1416926 - protein, 5 aa, Mycobacterium tuberculosis
RSEEA

SEQ ID NO: 1416927 - protein, 8 aa, Mycobacterium tuberculosis
RSFTGSQA

SEQ ID NO: 1416928 - protein, 10 aa, Mycobacterium tuberculosis
RSGGPDRKRP

SEQ ID NO: 1416929 - protein, 7 aa, Mycobacterium tuberculosis
RSGRLKG

SEQ ID NO: 1416930 - protein, 18 aa, Mycobacterium tuberculosis
RSHKRQRKAAAKAEGKAP

SEQ ID NO: 1416931 - protein, 7 aa, Mycobacterium tuberculosis
RSHTDQA

SEQ ID NO: 1416932 - protein, 8 aa, Mycobacterium tuberculosis
RSKAARKV

SEQ ID NO: 1416933 - protein, 4 aa, Mycobacterium tuberculosis
RSLQ

SEQ ID NO: 1416934 - protein, 10 aa, Mycobacterium tuberculosis
RSPQALTNQA

SEQ ID NO: 1416935 - protein, 8 aa, Mycobacterium tuberculosis
RSRPDRAI

SEQ ID NO: 1416936 - protein, 4 aa, Mycobacterium tuberculosis
RSRY

SEQ ID NO: 1416937 - protein, 6 aa, Mycobacterium tuberculosis
RSSQQV

SEQ ID NO: 1416938 - protein, 8 aa, Mycobacterium tuberculosis
RTAERRGD

SEQ ID NO: 1416939 - protein, 4 aa, Mycobacterium tuberculosis
RTAQ

SEQ ID NO: 1416940 - protein, 6 aa, Mycobacterium tuberculosis
RTAQVE

SEQ ID NO: 1416941 - protein, 6 aa, Mycobacterium tuberculosis
RTEADR

SEQ ID NO: 1416942 - protein, 6 aa, Mycobacterium tuberculosis
RTEADV

SEQ ID NO: 1416943 - protein, 4 aa, Mycobacterium tuberculosis
RTFT

SEQ ID NO: 1416944 - protein, 4 aa, Mycobacterium tuberculosis
RTGD

SEQ ID NO: 1416945 - protein, 6 aa, Mycobacterium tuberculosis
RTGIPT

SEQ ID NO: 1416946 - protein, 4 aa, Mycobacterium tuberculosis
RTGL

SEQ ID NO: 1416947 - protein, 8 aa, Mycobacterium tuberculosis
RTHPRTRT

SEQ ID NO: 1416948 - protein, 8 aa, Mycobacterium tuberculosis
RTIPRDNG

SEQ ID NO: 1416949 - protein, 9 aa, Mycobacterium tuberculosis
RTPEPPERW

SEQ ID NO: 1416950 - protein, 5 aa, Mycobacterium tuberculosis
RTPRR

SEQ ID NO: 1416951 - protein, 5 aa, Mycobacterium tuberculosis
RTPVQ

SEQ ID NO: 1416952 - protein, 5 aa, Mycobacterium tuberculosis
RTRPV

SEQ ID NO: 1416953 - protein, 6 aa, Mycobacterium tuberculosis
RTRSNE

SEQ ID NO: 1416954 - protein, 20 aa, Mycobacterium tuberculosis
RTSRKAGTDVDRAAAAADGW

SEQ ID NO: 1416955 - protein, 6 aa, Mycobacterium tuberculosis
RTTEHR

SEQ ID NO: 1416956 - protein, 26 aa, Mycobacterium tuberculosis
RTVTTATGEGYRHSSYRDVGQRAGQL

SEQ ID NO: 1416957 - protein, 12 aa, Mycobacterium tuberculosis
RTYGTLSEGERK

SEQ ID NO: 1416958 - protein, 11 aa, Mycobacterium tuberculosis
RVDNPPGTGKI

SEQ ID NO: 1416959 - protein, 12 aa, Mycobacterium tuberculosis
RVGARADERLRS

SEQ ID NO: 1416960 - protein, 13 aa, Mycobacterium tuberculosis
RVGGGDPAGNPTL

SEQ ID NO: 1416961 - protein, 4 aa, Mycobacterium tuberculosis
RVGP

SEQ ID NO: 1416962 - protein, 8 aa, Mycobacterium tuberculosis
RVNKNGMP

SEQ ID NO: 1416963 - protein, 5 aa, Mycobacterium tuberculosis
RVPTP

SEQ ID NO: 1416964 - protein, 9 aa, Mycobacterium tuberculosis
RVSGPDPVP

SEQ ID NO: 1416965 - protein, 6 aa, Mycobacterium tuberculosis
RWPSAG

SEQ ID NO: 1416966 - protein, 5 aa, Mycobacterium tuberculosis
RWQGV

SEQ ID NO: 1416967 - protein, 14 aa, Mycobacterium tuberculosis
RYAAATSQTKGLIF

SEQ ID NO: 1416968 - protein, 6 aa, Mycobacterium tuberculosis
RYAGGM

SEQ ID NO: 1416969 - protein, 4 aa, Mycobacterium tuberculosis
RYQD

SEQ ID NO: 1416970 - protein, 5 aa, Mycobacterium tuberculosis
RYRSE

SEQ ID NO: 1416971 - protein, 5 aa, Mycobacterium tuberculosis
RYTGR

SEQ ID NO: 1416972 - protein, 7 aa, Mycobacterium tuberculosis
RYVPEKD

SEQ ID NO: 1416973 - protein, 7 aa, Mycobacterium tuberculosis
SAAAPAT

SEQ ID NO: 1416974 - protein, 9 aa, Mycobacterium tuberculosis
SAAARGLTA

SEQ ID NO: 1416975 - protein, 5 aa, Mycobacterium tuberculosis
SAAAY

SEQ ID NO: 1416976 - protein, 15 aa, Mycobacterium tuberculosis
SAAEPGAAGRHASDR

SEQ ID NO: 1416977 - protein, 10 aa, Mycobacterium tuberculosis
SAAHRRETYT

SEQ ID NO: 1416978 - protein, 10 aa, Mycobacterium tuberculosis
SAAPESLGGD

SEQ ID NO: 1416979 - protein, 6 aa, Mycobacterium tuberculosis
SAARGE

SEQ ID NO: 1416980 - protein, 7 aa, Mycobacterium tuberculosis
SAARQAG

SEQ ID NO: 1416981 - protein, 14 aa, Mycobacterium tuberculosis
SAATEDDQTYDGAA

SEQ ID NO: 1416982 - protein, 9 aa, Mycobacterium tuberculosis
SADPLPAGA

SEQ ID NO: 1416983 - protein, 8 aa, Mycobacterium tuberculosis
SAEATGID

SEQ ID NO: 1416984 - protein, 8 aa, Mycobacterium tuberculosis
SAEGGARP

SEQ ID NO: 1416985 - protein, 18 aa, Mycobacterium tuberculosis
SAEQAKWGQKAVEDEGLS

SEQ ID NO: 1416986 - protein, 4 aa, Mycobacterium tuberculosis
SAER

SEQ ID NO: 1416987 - protein, 7 aa, Mycobacterium tuberculosis
SAEVASA

SEQ ID NO: 1416988 - protein, 11 aa, Mycobacterium tuberculosis
SAFGNRGPWST

SEQ ID NO: 1416989 - protein, 8 aa, Mycobacterium tuberculosis
SAGPDYGG

SEQ ID NO: 1416990 - protein, 11 aa, Mycobacterium tuberculosis
SAGPGPASLQA

SEQ ID NO: 1416991 - protein, 7 aa, Mycobacterium tuberculosis
SAGSTVH

SEQ ID NO: 1416992 - protein, 7 aa, Mycobacterium tuberculosis
SAGVSAG

SEQ ID NO: 1416993 - protein, 6 aa, Mycobacterium tuberculosis
SAHPAS

SEQ ID NO: 1416994 - protein, 8 aa, Mycobacterium tuberculosis
SAHSADGH

SEQ ID NO: 1416995 - protein, 15 aa, Mycobacterium tuberculosis
SAISTANAAAAAATT

SEQ ID NO: 1416996 - protein, 9 aa, Mycobacterium tuberculosis
SAKHDAEHS

SEQ ID NO: 1416997 - protein, 16 aa, Mycobacterium tuberculosis
SAKSNMGHSTASAGTV

SEQ ID NO: 1416998 - protein, 22 aa, Mycobacterium tuberculosis
SALAAPPAATPAAISDQLPSDR

SEQ ID NO: 1416999 - protein, 6 aa, Mycobacterium tuberculosis
SAMTGG

SEQ ID NO: 1417000 - protein, 8 aa, Mycobacterium tuberculosis
SANIGSSN

SEQ ID NO: 1417001 - protein, 9 aa, Mycobacterium tuberculosis
SANTLGKES

SEQ ID NO: 1417002 - protein, 10 aa, Mycobacterium tuberculosis
SAPDSQRGER

SEQ ID NO: 1417003 - protein, 9 aa, Mycobacterium tuberculosis
SAPDVDNPV

SEQ ID NO: 1417004 - protein, 5 aa, Mycobacterium tuberculosis
SAPFT

SEQ ID NO: 1417005 - protein, 13 aa, Mycobacterium tuberculosis
SAPMGTDDDPRAV

SEQ ID NO: 1417006 - protein, 7 aa, Mycobacterium tuberculosis
SAPQDMG

SEQ ID NO: 1417007 - protein, 5 aa, Mycobacterium tuberculosis
SAPVR

SEQ ID NO: 1417008 - protein, 8 aa, Mycobacterium tuberculosis
SARPDQLD

SEQ ID NO: 1417009 - protein, 5 aa, Mycobacterium tuberculosis
SASLH

SEQ ID NO: 1417010 - protein, 6 aa, Mycobacterium tuberculosis
SATPRQ

SEQ ID NO: 1417011 - protein, 25 aa, Mycobacterium tuberculosis
SATTTGDAPRTNTTAEQAGSPQPKF

SEQ ID NO: 1417012 - protein, 9 aa, Mycobacterium tuberculosis
SAVSKNPFV

SEQ ID NO: 1417013 - protein, 12 aa, Mycobacterium tuberculosis
SCPTAPPPSGRQ

SEQ ID NO: 1417014 - protein, 13 aa, Mycobacterium tuberculosis
SDDCPAPDDESDP

SEQ ID NO: 1417015 - protein, 10 aa, Mycobacterium tuberculosis
SDDLGGGSLT

SEQ ID NO: 1417016 - protein, 10 aa, Mycobacterium tuberculosis
SDDPGSSARI

SEQ ID NO: 1417017 - protein, 13 aa, Mycobacterium tuberculosis
SDEAQPDNSRHPF

SEQ ID NO: 1417018 - protein, 9 aa, Mycobacterium tuberculosis
SDESMSDSF

SEQ ID NO: 1417019 - protein, 8 aa, Mycobacterium tuberculosis
SDGRPHAL

SEQ ID NO: 1417020 - protein, 13 aa, Mycobacterium tuberculosis
SDGTESALQHGSK

SEQ ID NO: 1417021 - protein, 6 aa, Mycobacterium tuberculosis
SDHPRP

SEQ ID NO: 1417022 - protein, 8 aa, Mycobacterium tuberculosis
SDLSSTDM

SEQ ID NO: 1417023 - protein, 6 aa, Mycobacterium tuberculosis
SDPDVD

SEQ ID NO: 1417024 - protein, 6 aa, Mycobacterium tuberculosis
SDPKGR

SEQ ID NO: 1417025 - protein, 8 aa, Mycobacterium tuberculosis
SDPLTRDG

SEQ ID NO: 1417026 - protein, 6 aa, Mycobacterium tuberculosis
SDQEHV

SEQ ID NO: 1417027 - protein, 8 aa, Mycobacterium tuberculosis
SDRMSREG

SEQ ID NO: 1417028 - protein, 4 aa, Mycobacterium tuberculosis
SDSP

SEQ ID NO: 1417029 - protein, 16 aa, Mycobacterium tuberculosis
SDTDPRKPEELEAEAQ

SEQ ID NO: 1417030 - protein, 7 aa, Mycobacterium tuberculosis
SDVDRAQ

SEQ ID NO: 1417031 - protein, 4 aa, Mycobacterium tuberculosis
SEAE

SEQ ID NO: 1417032 - protein, 7 aa, Mycobacterium tuberculosis
SEGAALN

SEQ ID NO: 1417033 - protein, 6 aa, Mycobacterium tuberculosis
SEGGGI

SEQ ID NO: 1417034 - protein, 13 aa, Mycobacterium tuberculosis
SEGVGKGISPRSC

SEQ ID NO: 1417035 - protein, 21 aa, Mycobacterium tuberculosis
SELGTGRGGPRCMSCPAARDP

SEQ ID NO: 1417036 - protein, 4 aa, Mycobacterium tuberculosis
SELN

SEQ ID NO: 1417037 - protein, 6 aa, Mycobacterium tuberculosis
SENLRS

SEQ ID NO: 1417038 - protein, 5 aa, Mycobacterium tuberculosis
SENTH

SEQ ID NO: 1417039 - protein, 12 aa, Mycobacterium tuberculosis
SERGEKLPAAQR

SEQ ID NO: 1417040 - protein, 5 aa, Mycobacterium tuberculosis
SERIR

SEQ ID NO: 1417041 - protein, 13 aa, Mycobacterium tuberculosis
SESDTVAHPDPST

SEQ ID NO: 1417042 - protein, 8 aa, Mycobacterium tuberculosis
SETPSSWD

SEQ ID NO: 1417043 - protein, 7 aa, Mycobacterium tuberculosis
SEVAVSP

SEQ ID NO: 1417044 - protein, 11 aa, Mycobacterium tuberculosis
SGAGNGRLKTE

SEQ ID NO: 1417045 - protein, 6 aa, Mycobacterium tuberculosis
SGAVDD

SEQ ID NO: 1417046 - protein, 6 aa, Mycobacterium tuberculosis
SGFGQM

SEQ ID NO: 1417047 - protein, 16 aa, Mycobacterium tuberculosis
SGGAQAYAAAEATNFG

SEQ ID NO: 1417048 - protein, 9 aa, Mycobacterium tuberculosis
SGGARGMGA

SEQ ID NO: 1417049 - protein, 6 aa, Mycobacterium tuberculosis
SGGQPI

SEQ ID NO: 1417050 - protein, 8 aa, Mycobacterium tuberculosis
SGGSAVNP

SEQ ID NO: 1417051 - protein, 22 aa, Mycobacterium tuberculosis
SGGVPGREGAVGQQNSCQHDGH

SEQ ID NO: 1417052 - protein, 16 aa, Mycobacterium tuberculosis
SGITDPSHERYKEAAE

SEQ ID NO: 1417053 - protein, 7 aa, Mycobacterium tuberculosis
SGKQIPA

SEQ ID NO: 1417054 - protein, 9 aa, Mycobacterium tuberculosis
SGKTGEGVS

SEQ ID NO: 1417055 - protein, 7 aa, Mycobacterium tuberculosis
SGLHSNG

SEQ ID NO: 1417056 - protein, 9 aa, Mycobacterium tuberculosis
SGLRGATQQ

SEQ ID NO: 1417057 - protein, 8 aa, Mycobacterium tuberculosis
SGLTPADV

SEQ ID NO: 1417058 - protein, 5 aa, Mycobacterium tuberculosis
SGNTP

SEQ ID NO: 1417059 - protein, 6 aa, Mycobacterium tuberculosis
SGPAAM

SEQ ID NO: 1417060 - protein, 5 aa, Mycobacterium tuberculosis
SGPER

SEQ ID NO: 1417061 - protein, 19 aa, Mycobacterium tuberculosis
SGPHGADPHHGYSDRELRE

SEQ ID NO: 1417062 - protein, 4 aa, Mycobacterium tuberculosis
SGQQ

SEQ ID NO: 1417063 - protein, 6 aa, Mycobacterium tuberculosis
SGREPD

SEQ ID NO: 1417064 - protein, 6 aa, Mycobacterium tuberculosis
SGRFAP

SEQ ID NO: 1417065 - protein, 11 aa, Mycobacterium tuberculosis
SGSEEDETAWR

SEQ ID NO: 1417066 - protein, 6 aa, Mycobacterium tuberculosis
SGSGNI

SEQ ID NO: 1417067 - protein, 8 aa, Mycobacterium tuberculosis
SGSPITIG

SEQ ID NO: 1417068 - protein, 15 aa, Mycobacterium tuberculosis
SGSSGTAAAKQEALE

SEQ ID NO: 1417069 - protein, 35 aa, Mycobacterium tuberculosis; identical to SEQ ID NO: 187584

SEQ ID NO: 1417070 - protein, 12 aa, Mycobacterium tuberculosis
SGTTEPDAGLTE

SEQ ID NO: 1417071 - protein, 5 aa, Mycobacterium tuberculosis
SGVAG

SEQ ID NO: 1417072 - protein, 4 aa, Mycobacterium tuberculosis
SGVG

SEQ ID NO: 1417073 - protein, 8 aa, Mycobacterium tuberculosis
SGVIGRGG

SEQ ID NO: 1417074 - protein, 4 aa, Mycobacterium tuberculosis
SHHA

SEQ ID NO: 1417075 - protein, 13 aa, Mycobacterium tuberculosis
SHKALDPRARREP

SEQ ID NO: 1417076 - protein, 6 aa, Mycobacterium tuberculosis
SHKRDH

SEQ ID NO: 1417077 - protein, 8 aa, Mycobacterium tuberculosis
SHPEYATA

SEQ ID NO: 1417078 - protein, 4 aa, Mycobacterium tuberculosis
SHPS

SEQ ID NO: 1417079 - protein, 5 aa, Mycobacterium tuberculosis
SIADE

SEQ ID NO: 1417080 - protein, 11 aa, Mycobacterium tuberculosis
SIAGPKRPQDR

SEQ ID NO: 1417081 - protein, 13 aa, Mycobacterium tuberculosis
SIEPTKRRPNQCY

SEQ ID NO: 1417082 - protein, 11 aa, Mycobacterium tuberculosis
SIPITTSGKIR

SEQ ID NO: 1417083 - protein, 10 aa, Mycobacterium tuberculosis
SKAGKAPKDI

SEQ ID NO: 1417084 - protein, 4 aa, Mycobacterium tuberculosis
SKDF

SEQ ID NO: 1417085 - protein, 7 aa, Mycobacterium tuberculosis
SKECYSS

SEQ ID NO: 1417086 - protein, 7 aa, Mycobacterium tuberculosis
SKEQAGA

SEQ ID NO: 1417087 - protein, 5 aa, Mycobacterium tuberculosis
SKPGL

SEQ ID NO: 1417088 - protein, 6 aa, Mycobacterium tuberculosis
SKQPGI

SEQ ID NO: 1417089 - protein, 7 aa, Mycobacterium tuberculosis
SKQRGRF

SEQ ID NO: 1417090 - protein, 9 aa, Mycobacterium tuberculosis
SLDAASKSA

SEQ ID NO: 1417091 - protein, 5 aa, Mycobacterium tuberculosis
SLDAS

SEQ ID NO: 1417092 - protein, 6 aa, Mycobacterium tuberculosis
SLDSGP

SEQ ID NO: 1417093 - protein, 5 aa, Mycobacterium tuberculosis
SLGDE

SEQ ID NO: 1417094 - protein, 22 aa, Mycobacterium tuberculosis
SLGPYAAQRGLDASPAALAADP

SEQ ID NO: 1417095 - protein, 8 aa, Mycobacterium tuberculosis
SLGSESAL

SEQ ID NO: 1417096 - protein, 20 aa, Mycobacterium tuberculosis
SLKDENAALKDTSPSAQAVT

SEQ ID NO: 1417097 - protein, 5 aa, Mycobacterium tuberculosis
SLNAG

SEQ ID NO: 1417098 - protein, 5 aa, Mycobacterium tuberculosis
SLREP

SEQ ID NO: 1417099 - protein, 7 aa, Mycobacterium tuberculosis
SLTPTER

SEQ ID NO: 1417100 - protein, 12 aa, Mycobacterium tuberculosis
SNRDGKPVTSAA

SEQ ID NO: 1417101 - protein, 6 aa, Mycobacterium tuberculosis
SNTDGQ

SEQ ID NO: 1417102 - protein, 9 aa, Mycobacterium tuberculosis
SPAYPIPED

SEQ ID NO: 1417103 - protein, 16 aa, Mycobacterium tuberculosis
SPDERTEMEKDRHGPA

SEQ ID NO: 1417104 - protein, 4 aa, Mycobacterium tuberculosis
SPDG

SEQ ID NO: 1417105 - protein, 7 aa, Mycobacterium tuberculosis
SPDLAGT

SEQ ID NO: 1417106 - protein, 8 aa, Mycobacterium tuberculosis
SPDSAIGK

SEQ ID NO: 1417107 - protein, 8 aa, Mycobacterium tuberculosis
SPEDEDRE

SEQ ID NO: 1417108 - protein, 20 aa, Mycobacterium tuberculosis
SPEEYTGKRTHMPDYPEEGA

SEQ ID NO: 1417109 - protein, 10 aa, Mycobacterium tuberculosis
SPEPKPCEGL

SEQ ID NO: 1417110 - protein, 6 aa, Mycobacterium tuberculosis
SPFGQG

SEQ ID NO: 1417111 - protein, 4 aa, Mycobacterium tuberculosis
SPGM

SEQ ID NO: 1417112 - protein, 11 aa, Mycobacterium tuberculosis
SPGSRSDIGGA

SEQ ID NO: 1417113 - protein, 11 aa, Mycobacterium tuberculosis
SPGVERPLTSE

SEQ ID NO: 1417114 - protein, 20 aa, Mycobacterium tuberculosis
SPLGGSASSLAAIPGASVPQ

SEQ ID NO: 1417115 - protein, 4 aa, Mycobacterium tuberculosis
SPLT

SEQ ID NO: 1417116 - protein, 8 aa, Mycobacterium tuberculosis
SPPRHGLG

SEQ ID NO: 1417117 - protein, 10 aa, Mycobacterium tuberculosis
SPSPQRLSGP

SEQ ID NO: 1417118 - protein, 4 aa, Mycobacterium tuberculosis
SPTT

SEQ ID NO: 1417119 - protein, 5 aa, Mycobacterium tuberculosis
SPWQA

SEQ ID NO: 1417120 - protein, 8 aa, Mycobacterium tuberculosis
SQADHTYG

SEQ ID NO: 1417121 - protein, 9 aa, Mycobacterium tuberculosis
SQAQPDDVS

SEQ ID NO: 1417122 - protein, 15 aa, Mycobacterium tuberculosis
SQGTADAYKTGRGSI

SEQ ID NO: 1417123 - protein, 8 aa, Mycobacterium tuberculosis
SQNRTSDL

SEQ ID NO: 1417124 - protein, 8 aa, Mycobacterium tuberculosis
SQRRAQRA

SEQ ID NO: 1417125 - protein, 19 aa, Mycobacterium tuberculosis
SQRSRNRHVGEQLGAGKPI

SEQ ID NO: 1417126 - protein, 9 aa, Mycobacterium tuberculosis
SQSLRERAR

SEQ ID NO: 1417127 - protein, 5 aa, Mycobacterium tuberculosis
SQVYA

SEQ ID NO: 1417128 - protein, 5 aa, Mycobacterium tuberculosis
SQYAP

SEQ ID NO: 1417129 - protein, 8 aa, Mycobacterium tuberculosis
SRAAEAAE

SEQ ID NO: 1417130 - protein, 4 aa, Mycobacterium tuberculosis
SRDP

SEQ ID NO: 1417131 - protein, 8 aa, Mycobacterium tuberculosis
SREEQDRW

SEQ ID NO: 1417132 - protein, 9 aa, Mycobacterium tuberculosis
SREHTDPFG

SEQ ID NO: 1417133 - protein, 7 aa, Mycobacterium tuberculosis
SREPDPD

SEQ ID NO: 1417134 - protein, 5 aa, Mycobacterium tuberculosis
SRHPA

SEQ ID NO: 1417135 - protein, 9 aa, Mycobacterium tuberculosis
SRLASGAAR

SEQ ID NO: 1417136 - protein, 4 aa, Mycobacterium tuberculosis
SRLK

SEQ ID NO: 1417137 - protein, 19 aa, Mycobacterium tuberculosis
SRPDTLPPRVPGTAGNTAA

SEQ ID NO: 1417138 - protein, 4 aa, Mycobacterium tuberculosis
SRPG

SEQ ID NO: 1417139 - protein, 4 aa, Mycobacterium tuberculosis
SRPH

SEQ ID NO: 1417140 - protein, 6 aa, Mycobacterium tuberculosis
SRPLNR

SEQ ID NO: 1417141 - protein, 7 aa, Mycobacterium tuberculosis
SRRDIPD

SEQ ID NO: 1417142 - protein, 4 aa, Mycobacterium tuberculosis
SRSE

SEQ ID NO: 1417143 - protein, 17 aa, Mycobacterium tuberculosis
SRSPGLNESSHMSGRIP

SEQ ID NO: 1417144 - protein, 9 aa, Mycobacterium tuberculosis
SRTNGIADP

SEQ ID NO: 1417145 - protein, 7 aa, Mycobacterium tuberculosis
SRTRGYA

SEQ ID NO: 1417146 - protein, 12 aa, Mycobacterium tuberculosis
SRTRTGGSATAI

SEQ ID NO: 1417147 - protein, 6 aa, Mycobacterium tuberculosis
SRVRKA

SEQ ID NO: 1417148 - protein, 10 aa, Mycobacterium tuberculosis
SSAADDPTLA

SEQ ID NO: 1417149 - protein, 6 aa, Mycobacterium tuberculosis
SSADDF

SEQ ID NO: 1417150 - protein, 5 aa, Mycobacterium tuberculosis
SSDVA

SEQ ID NO: 1417151 - protein, 24 aa, Mycobacterium tuberculosis
SSGLGSTAPAISAGASQAGSVGGM

SEQ ID NO: 1417152 - protein, 10 aa, Mycobacterium tuberculosis
SSLADTLRDA

SEQ ID NO: 1417153 - protein, 5 aa, Mycobacterium tuberculosis
SSPPV

SEQ ID NO: 1417154 - protein, 21 aa, Mycobacterium tuberculosis
SSRATAFATQGVSAEAQANRA

SEQ ID NO: 1417155 - protein, 10 aa, Mycobacterium tuberculosis
SSRPAVSAEA

SEQ ID NO: 1417156 - protein, 4 aa, Mycobacterium tuberculosis
SSTT

SEQ ID NO: 1417157 - protein, 6 aa, Mycobacterium tuberculosis
SSVQEI

SEQ ID NO: 1417158 - protein, 27 aa, Mycobacterium tuberculosis
SSVSASVSASAATSSIRESQRQQSLTT

SEQ ID NO: 1417159 - protein, 7 aa, Mycobacterium tuberculosis
STAAQEQ

SEQ ID NO: 1417160 - protein, 12 aa, Mycobacterium tuberculosis
STARDTFNRRRG

SEQ ID NO: 1417161 - protein, 6 aa, Mycobacterium tuberculosis
STAVSG

SEQ ID NO: 1417162 - protein, 5 aa, Mycobacterium tuberculosis
STDLD

SEQ ID NO: 1417163 - protein, 8 aa, Mycobacterium tuberculosis
STGGGASL

SEQ ID NO: 1417164 - protein, 5 aa, Mycobacterium tuberculosis
STHRE

SEQ ID NO: 1417165 - protein, 11 aa, Mycobacterium tuberculosis
STIRTGRANPG

SEQ ID NO: 1417166 - protein, 11 aa, Mycobacterium tuberculosis
STLETAQAAGV

SEQ ID NO: 1417167 - protein, 10 aa, Mycobacterium tuberculosis
STNSQGGSSI

SEQ ID NO: 1417168 - protein, 6 aa, Mycobacterium tuberculosis
STNVRA

SEQ ID NO: 1417169 - protein, 11 aa, Mycobacterium tuberculosis
STPESLTATRA

SEQ ID NO: 1417170 - protein, 8 aa, Mycobacterium tuberculosis
STQEKAEL

SEQ ID NO: 1417171 - protein, 8 aa, Mycobacterium tuberculosis
STTTWSGR

SEQ ID NO: 1417172 - protein, 6 aa, Mycobacterium tuberculosis
STTVEQ

SEQ ID NO: 1417173 - protein, 6 aa, Mycobacterium tuberculosis
SVAKTD

SEQ ID NO: 1417174 - protein, 7 aa, Mycobacterium tuberculosis
SVDGGQP

SEQ ID NO: 1417175 - protein, 9 aa, Mycobacterium tuberculosis
SVDPESKSV

SEQ ID NO: 1417176 - protein, 5 aa, Mycobacterium tuberculosis
SVEAD

SEQ ID NO: 1417177 - protein, 4 aa, Mycobacterium tuberculosis
SVEP

SEQ ID NO: 1417178 - protein, 23 aa, Mycobacterium tuberculosis
SVEPMAAKSPAAAATASGTVTTN

SEQ ID NO: 1417179 - protein, 7 aa, Mycobacterium tuberculosis
SVGPYGA

SEQ ID NO: 1417180 - protein, 10 aa, Mycobacterium tuberculosis
SVKGPKGTLG

SEQ ID NO: 1417181 - protein, 19 aa, Mycobacterium tuberculosis
SVPEPRELKQELEALRARR

SEQ ID NO: 1417182 - protein, 12 aa, Mycobacterium tuberculosis
SVPGGNGVTPID

SEQ ID NO: 1417183 - protein, 17 aa, Mycobacterium tuberculosis
SVQTGYEGLSRTPAPVA

SEQ ID NO: 1417184 - protein, 11 aa, Mycobacterium tuberculosis
SVSDDDDTTRL

SEQ ID NO: 1417185 - protein, 9 aa, Mycobacterium tuberculosis
SVTSRNKVA

SEQ ID NO: 1417186 - protein, 6 aa, Mycobacterium tuberculosis
SWTTDV

SEQ ID NO: 1417187 - protein, 12 aa, Mycobacterium tuberculosis
SYAPERARRSDT

SEQ ID NO: 1417188 - protein, 11 aa, Mycobacterium tuberculosis
SYGSSTSSSGV

SEQ ID NO: 1417189 - protein, 8 aa, Mycobacterium tuberculosis
SYPQSLKR

SEQ ID NO: 1417190 - protein, 5 aa, Mycobacterium tuberculosis
SYRGR

SEQ ID NO: 1417191 - protein, 5 aa, Mycobacterium tuberculosis
SYTES

SEQ ID NO: 1417192 - protein, 4 aa, Mycobacterium tuberculosis
SYTG

SEQ ID NO: 1417193 - protein, 11 aa, Mycobacterium tuberculosis
SYYATADPDTF

SEQ ID NO: 1417194 - protein, 8 aa, Mycobacterium tuberculosis
TAACNRDD

SEQ ID NO: 1417195 - protein, 4 aa, Mycobacterium tuberculosis
TAAD

SEQ ID NO: 1417196 - protein, 9 aa, Mycobacterium tuberculosis
TAAGGGRMR

SEQ ID NO: 1417197 - protein, 20 aa, Mycobacterium tuberculosis
TAAHTNRSATPVASEGPAVL

SEQ ID NO: 1417198 - protein, 5 aa, Mycobacterium tuberculosis
TAAPL

SEQ ID NO: 1417199 - protein, 6 aa, Mycobacterium tuberculosis
TAAQHG

SEQ ID NO: 1417200 - protein, 6 aa, Mycobacterium tuberculosis
TAATDV

SEQ ID NO: 1417201 - protein, 14 aa, Mycobacterium tuberculosis
TAATNGSPSGNAEL

SEQ ID NO: 1417202 - protein, 7 aa, Mycobacterium tuberculosis
TADGPAL

SEQ ID NO: 1417203 - protein, 8 aa, Mycobacterium tuberculosis
TADGRRAQ

SEQ ID NO: 1417204 - protein, 7 aa, Mycobacterium tuberculosis
TADREGL

SEQ ID NO: 1417205 - protein, 7 aa, Mycobacterium tuberculosis
TADRSRP

SEQ ID NO: 1417206 - protein, 6 aa, Mycobacterium tuberculosis
TAEEYG

SEQ ID NO: 1417207 - protein, 7 aa, Mycobacterium tuberculosis
TAEGGAM

SEQ ID NO: 1417208 - protein, 8 aa, Mycobacterium tuberculosis
TAEGNHLG

SEQ ID NO: 1417209 - protein, 7 aa, Mycobacterium tuberculosis
TAESPIP

SEQ ID NO: 1417210 - protein, 5 aa, Mycobacterium tuberculosis
TAGAD

SEQ ID NO: 1417211 - protein, 6 aa, Mycobacterium tuberculosis
TAGEKQ

SEQ ID NO: 1417212 - protein, 7 aa, Mycobacterium tuberculosis
TAGERAD

SEQ ID NO: 1417213 - protein, 16 aa, Mycobacterium tuberculosis
TAGETFGEVESTKSVS

SEQ ID NO: 1417214 - protein, 4 aa, Mycobacterium tuberculosis
TAGF

SEQ ID NO: 1417215 - protein, 5 aa, Mycobacterium tuberculosis
TAGGA

SEQ ID NO: 1417216 - protein, 7 aa, Mycobacterium tuberculosis
TAGITDE

SEQ ID NO: 1417217 - protein, 4 aa, Mycobacterium tuberculosis
TAGL

SEQ ID NO: 1417218 - protein, 8 aa, Mycobacterium tuberculosis
TAGPAWDR

SEQ ID NO: 1417219 - protein, 12 aa, Mycobacterium tuberculosis
TAGRSDLKTVPA

SEQ ID NO: 1417220 - protein, 7 aa, Mycobacterium tuberculosis
TAGSRLD

SEQ ID NO: 1417221 - protein, 7 aa, Mycobacterium tuberculosis
TAKAEAE

SEQ ID NO: 1417222 - protein, 9 aa, Mycobacterium tuberculosis
TALGAGAAE

SEQ ID NO: 1417223 - protein, 10 aa, Mycobacterium tuberculosis
TALGTGRGEE

SEQ ID NO: 1417224 - protein, 8 aa, Mycobacterium tuberculosis
TANGGLGP

SEQ ID NO: 1417225 - protein, 9 aa, Mycobacterium tuberculosis
TAPEGKTMG

SEQ ID NO: 1417226 - protein, 10 aa, Mycobacterium tuberculosis
TAPKSNAVTT

SEQ ID NO: 1417227 - protein, 11 aa, Mycobacterium tuberculosis
TARKVTAPAEI

SEQ ID NO: 1417228 - protein, 9 aa, Mycobacterium tuberculosis
TASQDPRGT

SEQ ID NO: 1417229 - protein, 4 aa, Mycobacterium tuberculosis
TASR

SEQ ID NO: 1417230 - protein, 6 aa, Mycobacterium tuberculosis
TASRIE

SEQ ID NO: 1417231 - protein, 14 aa, Mycobacterium tuberculosis
TASTRAAKAQLRSM

SEQ ID NO: 1417232 - protein, 4 aa, Mycobacterium tuberculosis
TATG

SEQ ID NO: 1417233 - protein, 7 aa, Mycobacterium tuberculosis
TATGGHL

SEQ ID NO: 1417234 - protein, 5 aa, Mycobacterium tuberculosis
TATSV

SEQ ID NO: 1417235 - protein, 13 aa, Mycobacterium tuberculosis
TAVPDERSHAEPP

SEQ ID NO: 1417236 - protein, 9 aa, Mycobacterium tuberculosis
TAVRDGDDY

SEQ ID NO: 1417237 - protein, 8 aa, Mycobacterium tuberculosis
TCRPDNTL

SEQ ID NO: 1417238 - protein, 5 aa, Mycobacterium tuberculosis
TCRPR

SEQ ID NO: 1417239 - protein, 13 aa, Mycobacterium tuberculosis
TDAADTGLSDASA

SEQ ID NO: 1417240 - protein, 9 aa, Mycobacterium tuberculosis
TDDGDRATA

SEQ ID NO: 1417241 - protein, 34 aa, Mycobacterium tuberculosis; identical to SEQ ID NO: 189023

SEQ ID NO: 1417242 - protein, 5 aa, Mycobacterium tuberculosis
TDEED

SEQ ID NO: 1417243 - protein, 9 aa, Mycobacterium tuberculosis
TDGDREGEA

SEQ ID NO: 1417244 - protein, 9 aa, Mycobacterium tuberculosis
TDLTDRVGE

SEQ ID NO: 1417245 - protein, 4 aa, Mycobacterium tuberculosis
TDNF

SEQ ID NO: 1417246 - protein, 16 aa, Mycobacterium tuberculosis
TDNGEDQRSDSGEGVD

SEQ ID NO: 1417247 - protein, 13 aa, Mycobacterium tuberculosis
TDPPKLKKQEKHD

SEQ ID NO: 1417248 - protein, 8 aa, Mycobacterium tuberculosis
TDQLPNRT

SEQ ID NO: 1417249 - protein, 6 aa, Mycobacterium tuberculosis
TDRLRE

SEQ ID NO: 1417250 - protein, 10 aa, Mycobacterium tuberculosis
TDRPGSSKYV

SEQ ID NO: 1417251 - protein, 4 aa, Mycobacterium tuberculosis
TDSM

SEQ ID NO: 1417252 - protein, 6 aa, Mycobacterium tuberculosis
TDTEND

SEQ ID NO: 1417253 - protein, 5 aa, Mycobacterium tuberculosis
TDTGT

SEQ ID NO: 1417254 - protein, 6 aa, Mycobacterium tuberculosis
TDTLEE

SEQ ID NO: 1417255 - protein, 5 aa, Mycobacterium tuberculosis
TEAAG

SEQ ID NO: 1417256 - protein, 12 aa, Mycobacterium tuberculosis
TEAGASVDPAEL

SEQ ID NO: 1417257 - protein, 10 aa, Mycobacterium tuberculosis
TEARPAALGD

SEQ ID NO: 1417258 - protein, 7 aa, Mycobacterium tuberculosis
TEDARVG

SEQ ID NO: 1417259 - protein, 6 aa, Mycobacterium tuberculosis
TEDDPN

SEQ ID NO: 1417260 - protein, 5 aa, Mycobacterium tuberculosis
TEDEL

SEQ ID NO: 1417261 - protein, 5 aa, Mycobacterium tuberculosis
TEDPT

SEQ ID NO: 1417262 - protein, 33 aa, Mycobacterium tuberculosis
TEEMGAAGDGSGGPAGSVDDEIRAAQKRVDDEE

SEQ ID NO: 1417263 - protein, 13 aa, Mycobacterium tuberculosis
TEETGAQISIEDD

SEQ ID NO: 1417264 - protein, 5 aa, Mycobacterium tuberculosis
TEGET

SEQ ID NO: 1417265 - protein, 5 aa, Mycobacterium tuberculosis
TEGVP

SEQ ID NO: 1417266 - protein, 6 aa, Mycobacterium tuberculosis
TENPLH

SEQ ID NO: 1417267 - protein, 18 aa, Mycobacterium tuberculosis
TEPGSGVRAQRDDLSASN

SEQ ID NO: 1417268 - protein, 32 aa, Mycobacterium tuberculosis; identical to SEQ ID NO: 189237

SEQ ID NO: 1417269 - protein, 7 aa, Mycobacterium tuberculosis
TERAGRK

SEQ ID NO: 1417270 - protein, 4 aa, Mycobacterium tuberculosis
TERF

SEQ ID NO: 1417271 - protein, 5 aa, Mycobacterium tuberculosis
TERVD

SEQ ID NO: 1417272 - protein, 6 aa, Mycobacterium tuberculosis
TESGVP

SEQ ID NO: 1417273 - protein, 4 aa, Mycobacterium tuberculosis
TETS

SEQ ID NO: 1417274 - protein, 12 aa, Mycobacterium tuberculosis
TFPGASKAVADL

SEQ ID NO: 1417275 - protein, 9 aa, Mycobacterium tuberculosis
TGADLSAAR

SEQ ID NO: 1417276 - protein, 13 aa, Mycobacterium tuberculosis
TGAKTSQPRTTSL

SEQ ID NO: 1417277 - protein, 6 aa, Mycobacterium tuberculosis
TGAQTG

SEQ ID NO: 1417278 - protein, 8 aa, Mycobacterium tuberculosis
TGASQNIG

SEQ ID NO: 1417279 - protein, 17 aa, Mycobacterium tuberculosis
TGDTNTGVANSGDVNTG

SEQ ID NO: 1417280 - protein, 15 aa, Mycobacterium tuberculosis
TGDYNTGMANTGNIN

SEQ ID NO: 1417281 - protein, 8 aa, Mycobacterium tuberculosis
TGESGGQL

SEQ ID NO: 1417282 - protein, 10 aa, Mycobacterium tuberculosis
TGFSRDDAKE

SEQ ID NO: 1417283 - protein, 7 aa, Mycobacterium tuberculosis
TGGKPYG

SEQ ID NO: 1417284 - protein, 8 aa, Mycobacterium tuberculosis
TGHEGAEA

SEQ ID NO: 1417285 - protein, 14 aa, Mycobacterium tuberculosis
TGIDPTKLRGSATG

SEQ ID NO: 1417286 - protein, 5 aa, Mycobacterium tuberculosis
TGIET

SEQ ID NO: 1417287 - protein, 5 aa, Mycobacterium tuberculosis
TGKNL

SEQ ID NO: 1417288 - protein, 10 aa, Mycobacterium tuberculosis
TGLGAQAGMG

SEQ ID NO: 1417289 - protein, 10 aa, Mycobacterium tuberculosis
TGLRAGRNGG

SEQ ID NO: 1417290 - protein, 6 aa, Mycobacterium tuberculosis
TGLTDD

SEQ ID NO: 1417291 - protein, 24 aa, Mycobacterium tuberculosis
TGPAAPSWRKGPRHIAGRGPRDTY

SEQ ID NO: 1417292 - protein, 6 aa, Mycobacterium tuberculosis
TGPEVT

SEQ ID NO: 1417293 - protein, 7 aa, Mycobacterium tuberculosis
TGPGESW

SEQ ID NO: 1417294 - protein, 18 aa, Mycobacterium tuberculosis
TGRDGASGVRRLTSEDRV

SEQ ID NO: 1417295 - protein, 4 aa, Mycobacterium tuberculosis
TGRL

SEQ ID NO: 1417296 - protein, 11 aa, Mycobacterium tuberculosis
TGSGKGGTKYG

SEQ ID NO: 1417297 - protein, 4 aa, Mycobacterium tuberculosis
TGSP

SEQ ID NO: 1417298 - protein, 5 aa, Mycobacterium tuberculosis
TGSVR

SEQ ID NO: 1417299 - protein, 6 aa, Mycobacterium tuberculosis
TGSYEQ

SEQ ID NO: 1417300 - protein, 4 aa, Mycobacterium tuberculosis
TGTN

SEQ ID NO: 1417301 - protein, 26 aa, Mycobacterium tuberculosis
TGTNNSGYANAGTFNSGFDNNARDEH

SEQ ID NO: 1417302 - protein, 10 aa, Mycobacterium tuberculosis
TGTSAQLDTN

SEQ ID NO: 1417303 - protein, 10 aa, Mycobacterium tuberculosis
TGTSGKTTTT

SEQ ID NO: 1417304 - protein, 14 aa, Mycobacterium tuberculosis
TGVDPKNLDDITTD

SEQ ID NO: 1417305 - protein, 11 aa, Mycobacterium tuberculosis
TGWDADGGYAE

SEQ ID NO: 1417306 - protein, 4 aa, Mycobacterium tuberculosis
THGR

SEQ ID NO: 1417307 - protein, 10 aa, Mycobacterium tuberculosis
THPGSGHTTA

SEQ ID NO: 1417308 - protein, 6 aa, Mycobacterium tuberculosis
THRTLS

SEQ ID NO: 1417309 - protein, 10 aa, Mycobacterium tuberculosis
TIGGGGNGQS

SEQ ID NO: 1417310 - protein, 10 aa, Mycobacterium tuberculosis
TIGRGSTEDT

SEQ ID NO: 1417311 - protein, 7 aa, Mycobacterium tuberculosis
TIPAQTR

SEQ ID NO: 1417312 - protein, 5 aa, Mycobacterium tuberculosis
TISGV

SEQ ID NO: 1417313 - protein, 4 aa, Mycobacterium tuberculosis
TITD

SEQ ID NO: 1417314 - protein, 8 aa, Mycobacterium tuberculosis
TKAYDGLP

SEQ ID NO: 1417315 - protein, 10 aa, Mycobacterium tuberculosis
TKDRKQFGES

SEQ ID NO: 1417316 - protein, 6 aa, Mycobacterium tuberculosis
TKRPNT

SEQ ID NO: 1417317 - protein, 10 aa, Mycobacterium tuberculosis
TLAPATAQRC

SEQ ID NO: 1417318 - protein, 4 aa, Mycobacterium tuberculosis
TLDG

SEQ ID NO: 1417319 - protein, 5 aa, Mycobacterium tuberculosis
TLRKG

SEQ ID NO: 1417320 - protein, 6 aa, Mycobacterium tuberculosis
TLSTGE

SEQ ID NO: 1417321 - protein, 15 aa, Mycobacterium tuberculosis
TMSTSEADGVTGGVT

SEQ ID NO: 1417322 - protein, 7 aa, Mycobacterium tuberculosis
TNAQRTL

SEQ ID NO: 1417323 - protein, 7 aa, Mycobacterium tuberculosis
TNEEGDL

SEQ ID NO: 1417324 - protein, 5 aa, Mycobacterium tuberculosis
TNGYR

SEQ ID NO: 1417325 - protein, 5 aa, Mycobacterium tuberculosis
TNHLD

SEQ ID NO: 1417326 - protein, 5 aa, Mycobacterium tuberculosis
TNHRG

SEQ ID NO: 1417327 - protein, 8 aa, Mycobacterium tuberculosis
TNPGQGVP

SEQ ID NO: 1417328 - protein, 6 aa, Mycobacterium tuberculosis
TNQRET

SEQ ID NO: 1417329 - protein, 8 aa, Mycobacterium tuberculosis
TPAACGRT

SEQ ID NO: 1417330 - protein, 11 aa, Mycobacterium tuberculosis
TPADEKNLDRW

SEQ ID NO: 1417331 - protein, 7 aa, Mycobacterium tuberculosis
TPAPGLP

SEQ ID NO: 1417332 - protein, 9 aa, Mycobacterium tuberculosis
TPATDSAGR

SEQ ID NO: 1417333 - protein, 7 aa, Mycobacterium tuberculosis
TPATRHE

SEQ ID NO: 1417334 - protein, 12 aa, Mycobacterium tuberculosis
TPEVDAELSEKV

SEQ ID NO: 1417335 - protein, 15 aa, Mycobacterium tuberculosis
TPEYPLGQADRALGD

SEQ ID NO: 1417336 - protein, 4 aa, Mycobacterium tuberculosis
TPGQ

SEQ ID NO: 1417337 - protein, 9 aa, Mycobacterium tuberculosis
TPHGKIDEN

SEQ ID NO: 1417338 - protein, 8 aa, Mycobacterium tuberculosis
TPLATDPV

SEQ ID NO: 1417339 - protein, 5 aa, Mycobacterium tuberculosis
TPLRS

SEQ ID NO: 1417340 - protein, 6 aa, Mycobacterium tuberculosis
TPPAAP

SEQ ID NO: 1417341 - protein, 14 aa, Mycobacterium tuberculosis
TPPGTVKGIPQKPM

SEQ ID NO: 1417342 - protein, 8 aa, Mycobacterium tuberculosis
TPQDVGRK

SEQ ID NO: 1417343 - protein, 4 aa, Mycobacterium tuberculosis
TPQH

SEQ ID NO: 1417344 - protein, 4 aa, Mycobacterium tuberculosis
TPQP

SEQ ID NO: 1417345 - protein, 10 aa, Mycobacterium tuberculosis
TPQRAPGYEE

SEQ ID NO: 1417346 - protein, 5 aa, Mycobacterium tuberculosis
TPQSY

SEQ ID NO: 1417347 - protein, 4 aa, Mycobacterium tuberculosis
TPTA

SEQ ID NO: 1417348 - protein, 9 aa, Mycobacterium tuberculosis
TPTADAADF

SEQ ID NO: 1417349 - protein, 4 aa, Mycobacterium tuberculosis
TPTV

SEQ ID NO: 1417350 - protein, 6 aa, Mycobacterium tuberculosis
TPVGNA

SEQ ID NO: 1417351 - protein, 6 aa, Mycobacterium tuberculosis
TQAAAR

SEQ ID NO: 1417352 - protein, 13 aa, Mycobacterium tuberculosis
TQAPEEVDPDATS

SEQ ID NO: 1417353 - protein, 6 aa, Mycobacterium tuberculosis
TQEFTT

SEQ ID NO: 1417354 - protein, 8 aa, Mycobacterium tuberculosis
TQETNSIE

SEQ ID NO: 1417355 - protein, 5 aa, Mycobacterium tuberculosis
TQHVD

SEQ ID NO: 1417356 - protein, 4 aa, Mycobacterium tuberculosis
TQSA

SEQ ID NO: 1417357 - protein, 14 aa, Mycobacterium tuberculosis
TQSPYPGGGPIPEK

SEQ ID NO: 1417358 - protein, 4 aa, Mycobacterium tuberculosis
TQSV

SEQ ID NO: 1417359 - protein, 9 aa, Mycobacterium tuberculosis
TQTSLAANG

SEQ ID NO: 1417360 - protein, 12 aa, Mycobacterium tuberculosis
TRAAEEAALFPC

SEQ ID NO: 1417361 - protein, 8 aa, Mycobacterium tuberculosis
TRATQADH

SEQ ID NO: 1417362 - protein, 5 aa, Mycobacterium tuberculosis
TRDLT

SEQ ID NO: 1417363 - protein, 5 aa, Mycobacterium tuberculosis
TREAT

SEQ ID NO: 1417364 - protein, 4 aa, Mycobacterium tuberculosis
TREF

SEQ ID NO: 1417365 - protein, 7 aa, Mycobacterium tuberculosis
TREQARR

SEQ ID NO: 1417366 - protein, 9 aa, Mycobacterium tuberculosis
TRESEHSLD

SEQ ID NO: 1417367 - protein, 5 aa, Mycobacterium tuberculosis
TRKGE

SEQ ID NO: 1417368 - protein, 15 aa, Mycobacterium tuberculosis
TRLGLSGTRAVLDGL

SEQ ID NO: 1417369 - protein, 17 aa, Mycobacterium tuberculosis
TRPGVGYPRTYEDQERW

SEQ ID NO: 1417370 - protein, 5 aa, Mycobacterium tuberculosis
TRREL

SEQ ID NO: 1417371 - protein, 14 aa, Mycobacterium tuberculosis
TRRPTVAGADRHPG

SEQ ID NO: 1417372 - protein, 4 aa, Mycobacterium tuberculosis
TRRV

SEQ ID NO: 1417373 - protein, 5 aa, Mycobacterium tuberculosis
TRSRA

SEQ ID NO: 1417374 - protein, 13 aa, Mycobacterium tuberculosis
TRSYRDAKSNTEV

SEQ ID NO: 1417375 - protein, 4 aa, Mycobacterium tuberculosis
TRTI

SEQ ID NO: 1417376 - protein, 8 aa, Mycobacterium tuberculosis
TSAFGANQ

SEQ ID NO: 1417377 - protein, 8 aa, Mycobacterium tuberculosis
TSAGGDPV

SEQ ID NO: 1417378 - protein, 8 aa, Mycobacterium tuberculosis
TSAKGEQL

SEQ ID NO: 1417379 - protein, 7 aa, Mycobacterium tuberculosis
TSAPAAA

SEQ ID NO: 1417380 - protein, 5 aa, Mycobacterium tuberculosis
TSCSS

SEQ ID NO: 1417381 - protein, 8 aa, Mycobacterium tuberculosis
TSDEGKVE

SEQ ID NO: 1417382 - protein, 8 aa, Mycobacterium tuberculosis
TSFDTGAD

SEQ ID NO: 1417383 - protein, 9 aa, Mycobacterium tuberculosis
TSGAIEARE

SEQ ID NO: 1417384 - protein, 19 aa, Mycobacterium tuberculosis
TSGEQRLSGHRGPTGGVSR

SEQ ID NO: 1417385 - protein, 5 aa, Mycobacterium tuberculosis
TSGMA

SEQ ID NO: 1417386 - protein, 6 aa, Mycobacterium tuberculosis
TSGTID

SEQ ID NO: 1417387 - protein, 6 aa, Mycobacterium tuberculosis
TSIEDP

SEQ ID NO: 1417388 - protein, 11 aa, Mycobacterium tuberculosis
TSLRDGSHHKR

SEQ ID NO: 1417389 - protein, 9 aa, Mycobacterium tuberculosis
TSNTEKVPI

SEQ ID NO: 1417390 - protein, 9 aa, Mycobacterium tuberculosis
TSPWPTDDA

SEQ ID NO: 1417391 - protein, 5 aa, Mycobacterium tuberculosis
TSQGD

SEQ ID NO: 1417392 - protein, 7 aa, Mycobacterium tuberculosis
TSTQSDI

SEQ ID NO: 1417393 - protein, 12 aa, Mycobacterium tuberculosis
TSTRQSRKGAIS

SEQ ID NO: 1417394 - protein, 18 aa, Mycobacterium tuberculosis
TTAGDGSSAIAAARRQRP

SEQ ID NO: 1417395 - protein, 10 aa, Mycobacterium tuberculosis
TTAPGNGAAL

SEQ ID NO: 1417396 - protein, 6 aa, Mycobacterium tuberculosis
TTASQL

SEQ ID NO: 1417397 - protein, 11 aa, Mycobacterium tuberculosis
TTAVRTPSGYR

SEQ ID NO: 1417398 - protein, 8 aa, Mycobacterium tuberculosis
TTDNDANV

SEQ ID NO: 1417399 - protein, 10 aa, Mycobacterium tuberculosis
TTDPTSLTEA

SEQ ID NO: 1417400 - protein, 9 aa, Mycobacterium tuberculosis
TTENSHGID

SEQ ID NO: 1417401 - protein, 17 aa, Mycobacterium tuberculosis
TTMNAQNAAAAAPTTGV

SEQ ID NO: 1417402 - protein, 6 aa, Mycobacterium tuberculosis
TTPADA

SEQ ID NO: 1417403 - protein, 5 aa, Mycobacterium tuberculosis
TTPPL

SEQ ID NO: 1417404 - protein, 5 aa, Mycobacterium tuberculosis
TTQEA

SEQ ID NO: 1417405 - protein, 10 aa, Mycobacterium tuberculosis
TTQERDQWDD

SEQ ID NO: 1417406 - protein, 7 aa, Mycobacterium tuberculosis
TTRLPRD

SEQ ID NO: 1417407 - protein, 12 aa, Mycobacterium tuberculosis
TVEPDHHGYDIH

SEQ ID NO: 1417408 - protein, 8 aa, Mycobacterium tuberculosis
TVGQPGNR

SEQ ID NO: 1417409 - protein, 19 aa, Mycobacterium tuberculosis
TVGRNPATIERSAAVDGGG

SEQ ID NO: 1417410 - protein, 13 aa, Mycobacterium tuberculosis
TVGVTTSGTFSPT

SEQ ID NO: 1417411 - protein, 11 aa, Mycobacterium tuberculosis
TVRARSDATAV

SEQ ID NO: 1417412 - protein, 10 aa, Mycobacterium tuberculosis
TVSYTSEGRL

SEQ ID NO: 1417413 - protein, 7 aa, Mycobacterium tuberculosis
TVTGTSD

SEQ ID NO: 1417414 - protein, 4 aa, Mycobacterium tuberculosis
TVVP

SEQ ID NO: 1417415 - protein, 14 aa, Mycobacterium tuberculosis
TWRPETDLAKTSEV

SEQ ID NO: 1417416 - protein, 18 aa, Mycobacterium tuberculosis
TYEPSRTHWTPDPGAFSG

SEQ ID NO: 1417417 - protein, 15 aa, Mycobacterium tuberculosis
TYNEPNTNLTSPETT

SEQ ID NO: 1417418 - protein, 11 aa, Mycobacterium tuberculosis
TYPGPGGTIGP

SEQ ID NO: 1417419 - protein, 6 aa, Mycobacterium tuberculosis
TYSTNN

SEQ ID NO: 1417420 - protein, 8 aa, Mycobacterium tuberculosis
VAANTPKG

SEQ ID NO: 1417421 - protein, 7 aa, Mycobacterium tuberculosis
VADEIEK

SEQ ID NO: 1417422 - protein, 18 aa, Mycobacterium tuberculosis
VADGDTVYQPAVGQDDRG

SEQ ID NO: 1417423 - protein, 5 aa, Mycobacterium tuberculosis
VADGS

SEQ ID NO: 1417424 - protein, 7 aa, Mycobacterium tuberculosis
VADGYPD

SEQ ID NO: 1417425 - protein, 7 aa, Mycobacterium tuberculosis
VADPRDI

SEQ ID NO: 1417426 - protein, 8 aa, Mycobacterium tuberculosis
VAEGNAKL

SEQ ID NO: 1417427 - protein, 9 aa, Mycobacterium tuberculosis
VAEGRSDAV

SEQ ID NO: 1417428 - protein, 4 aa, Mycobacterium tuberculosis
VAEH

SEQ ID NO: 1417429 - protein, 21 aa, Mycobacterium tuberculosis
VAEPEPNGQPDVEEVPDELTP

SEQ ID NO: 1417430 - protein, 10 aa, Mycobacterium tuberculosis
VAERHGRTRD

SEQ ID NO: 1417431 - protein, 10 aa, Mycobacterium tuberculosis
VAGDNAADVE

SEQ ID NO: 1417432 - protein, 8 aa, Mycobacterium tuberculosis
VAGEIDAR

SEQ ID NO: 1417433 - protein, 10 aa, Mycobacterium tuberculosis
VAGESAKFGI

SEQ ID NO: 1417434 - protein, 4 aa, Mycobacterium tuberculosis
VAGG

SEQ ID NO: 1417435 - protein, 9 aa, Mycobacterium tuberculosis
VAGSDGAEA

SEQ ID NO: 1417436 - protein, 15 aa, Mycobacterium tuberculosis
VAKHTAPRGSSRPLT

SEQ ID NO: 1417437 - protein, 10 aa, Mycobacterium tuberculosis
VAPRKREAAG

SEQ ID NO: 1417438 - protein, 8 aa, Mycobacterium tuberculosis
VARQSRRP

SEQ ID NO: 1417439 - protein, 7 aa, Mycobacterium tuberculosis
VASATTV

SEQ ID NO: 1417440 - protein, 14 aa, Mycobacterium tuberculosis
VASSLGKGLTASSL

SEQ ID NO: 1417441 - protein, 5 aa, Mycobacterium tuberculosis
VATDE

SEQ ID NO: 1417442 - protein, 6 aa, Mycobacterium tuberculosis
VDADTA

SEQ ID NO: 1417443 - protein, 24 aa, Mycobacterium tuberculosis
VDASGYEPHDQQPQQQQQQQQQAF

SEQ ID NO: 1417444 - protein, 11 aa, Mycobacterium tuberculosis
VDEQTQGNYSD

SEQ ID NO: 1417445 - protein, 7 aa, Mycobacterium tuberculosis
VDGPDEA

SEQ ID NO: 1417446 - protein, 5 aa, Mycobacterium tuberculosis
VDNDD

SEQ ID NO: 1417447 - protein, 6 aa, Mycobacterium tuberculosis
VDNDPD

SEQ ID NO: 1417448 - protein, 10 aa, Mycobacterium tuberculosis
VDPDSTPPMV

SEQ ID NO: 1417449 - protein, 15 aa, Mycobacterium tuberculosis
VDPGEGLREFAFAPL

SEQ ID NO: 1417450 - protein, 8 aa, Mycobacterium tuberculosis
VDPGSIPD

SEQ ID NO: 1417451 - protein, 7 aa, Mycobacterium tuberculosis
VDQPGTV

SEQ ID NO: 1417452 - protein, 8 aa, Mycobacterium tuberculosis
VDSPRRKE

SEQ ID NO: 1417453 - protein, 22 aa, Mycobacterium tuberculosis
VDVDPTGATVTDWSGKRNPNAR

SEQ ID NO: 1417454 - protein, 6 aa, Mycobacterium tuberculosis
VEADDG

SEQ ID NO: 1417455 - protein, 7 aa, Mycobacterium tuberculosis
VEDPARQ

SEQ ID NO: 1417456 - protein, 11 aa, Mycobacterium tuberculosis
VEDPGTQAHSV

SEQ ID NO: 1417457 - protein, 6 aa, Mycobacterium tuberculosis
VEDTGY

SEQ ID NO: 1417458 - protein, 13 aa, Mycobacterium tuberculosis
VEEGAPWQQEGET

SEQ ID NO: 1417459 - protein, 4 aa, Mycobacterium tuberculosis
VEHA

SEQ ID NO: 1417460 - protein, 5 aa, Mycobacterium tuberculosis
VEPAS

SEQ ID NO: 1417461 - protein, 13 aa, Mycobacterium tuberculosis
VEPYAGSVTRAGE

SEQ ID NO: 1417462 - protein, 18 aa, Mycobacterium tuberculosis
VEQGDSEEVFGNPKHEYT

SEQ ID NO: 1417463 - protein, 4 aa, Mycobacterium tuberculosis
VERP

SEQ ID NO: 1417464 - protein, 5 aa, Mycobacterium tuberculosis
VGANN

SEQ ID NO: 1417465 - protein, 9 aa, Mycobacterium tuberculosis
VGDEPELTD

SEQ ID NO: 1417466 - protein, 5 aa, Mycobacterium tuberculosis
VGDQT

SEQ ID NO: 1417467 - protein, 7 aa, Mycobacterium tuberculosis
VGEDQRQ

SEQ ID NO: 1417468 - protein, 13 aa, Mycobacterium tuberculosis
VGESREQEASAKM

SEQ ID NO: 1417469 - protein, 5 aa, Mycobacterium tuberculosis
VGGNE

SEQ ID NO: 1417470 - protein, 12 aa, Mycobacterium tuberculosis
VGISGDITESGL

SEQ ID NO: 1417471 - protein, 9 aa, Mycobacterium tuberculosis
VGKPVPGNS

SEQ ID NO: 1417472 - protein, 10 aa, Mycobacterium tuberculosis
VGPEPGADDA

SEQ ID NO: 1417473 - protein, 12 aa, Mycobacterium tuberculosis
VGPRQGATATQE

SEQ ID NO: 1417474 - protein, 17 aa, Mycobacterium tuberculosis
VGRGSPQGLAASKALTT

SEQ ID NO: 1417475 - protein, 10 aa, Mycobacterium tuberculosis
VGSAGTVTTL

SEQ ID NO: 1417476 - protein, 13 aa, Mycobacterium tuberculosis
VGSGPVGSIPTPV

SEQ ID NO: 1417477 - protein, 10 aa, Mycobacterium tuberculosis
VGTGGDGVNT

SEQ ID NO: 1417478 - protein, 5 aa, Mycobacterium tuberculosis
VGVDP

SEQ ID NO: 1417479 - protein, 7 aa, Mycobacterium tuberculosis
VGYPTDT

SEQ ID NO: 1417480 - protein, 6 aa, Mycobacterium tuberculosis
VHGPGG

SEQ ID NO: 1417481 - protein, 7 aa, Mycobacterium tuberculosis
VHRPTDT

SEQ ID NO: 1417482 - protein, 11 aa, Mycobacterium tuberculosis
VISGTAPGVTS

SEQ ID NO: 1417483 - protein, 13 aa, Mycobacterium tuberculosis
VKAHDEDSVAGIG

SEQ ID NO: 1417484 - protein, 5 aa, Mycobacterium tuberculosis
VKGGR

SEQ ID NO: 1417485 - protein, 8 aa, Mycobacterium tuberculosis
VKQYAGDL

SEQ ID NO: 1417486 - protein, 6 aa, Mycobacterium tuberculosis
VKRAET

SEQ ID NO: 1417487 - protein, 4 aa, Mycobacterium tuberculosis
VKRG

SEQ ID NO: 1417488 - protein, 6 aa, Mycobacterium tuberculosis
VKRPED

SEQ ID NO: 1417489 - protein, 7 aa, Mycobacterium tuberculosis
VKSGSDY

SEQ ID NO: 1417490 - protein, 12 aa, Mycobacterium tuberculosis
VLSGDTANEGTQ

SEQ ID NO: 1417491 - protein, 5 aa, Mycobacterium tuberculosis
VPATA

SEQ ID NO: 1417492 - protein, 11 aa, Mycobacterium tuberculosis
VPATKGNTRRL

SEQ ID NO: 1417493 - protein, 9 aa, Mycobacterium tuberculosis
VPDPGGAAF

SEQ ID NO: 1417494 - protein, 6 aa, Mycobacterium tuberculosis
VPDPQL

SEQ ID NO: 1417495 - protein, 6 aa, Mycobacterium tuberculosis
VPGRAD

SEQ ID NO: 1417496 - protein, 4 aa, Mycobacterium tuberculosis
VPKH

SEQ ID NO: 1417497 - protein, 4 aa, Mycobacterium tuberculosis
VPSP

SEQ ID NO: 1417498 - protein, 24 aa, Mycobacterium tuberculosis
VPSPPAEIAAGRPVTSTSCPTAAR

SEQ ID NO: 1417499 - protein, 21 aa, Mycobacterium tuberculosis
VPSTPGRVTDTAEGAKAIATE

SEQ ID NO: 1417500 - protein, 7 aa, Mycobacterium tuberculosis
VQGPNAV

SEQ ID NO: 1417501 - protein, 4 aa, Mycobacterium tuberculosis
VQPG

SEQ ID NO: 1417502 - protein, 13 aa, Mycobacterium tuberculosis
VQTGTARGDDDLA

SEQ ID NO: 1417503 - protein, 7 aa, Mycobacterium tuberculosis
VQWGPGS

SEQ ID NO: 1417504 - protein, 7 aa, Mycobacterium tuberculosis
VRAADDD

SEQ ID NO: 1417505 - protein, 12 aa, Mycobacterium tuberculosis
VRADASVAREDS

SEQ ID NO: 1417506 - protein, 7 aa, Mycobacterium tuberculosis
VRADTTV

SEQ ID NO: 1417507 - protein, 4 aa, Mycobacterium tuberculosis
VRAT

SEQ ID NO: 1417508 - protein, 8 aa, Mycobacterium tuberculosis
VRDAEDAA

SEQ ID NO: 1417509 - protein, 7 aa, Mycobacterium tuberculosis
VRGGGGS

SEQ ID NO: 1417510 - protein, 15 aa, Mycobacterium tuberculosis
VRGHPNAAGTAIKDR

SEQ ID NO: 1417511 - protein, 5 aa, Mycobacterium tuberculosis
VRGSD

SEQ ID NO: 1417512 - protein, 25 aa, Mycobacterium tuberculosis
VRNTGWSNSGLTNTGAFNAGSLNTG

SEQ ID NO: 1417513 - protein, 4 aa, Mycobacterium tuberculosis
VRPE

SEQ ID NO: 1417514 - protein, 8 aa, Mycobacterium tuberculosis
VRPETAAD

SEQ ID NO: 1417515 - protein, 15 aa, Mycobacterium tuberculosis
VRPHEPAYDPEPDSY

SEQ ID NO: 1417516 - protein, 4 aa, Mycobacterium tuberculosis
VRPP

SEQ ID NO: 1417517 - protein, 6 aa, Mycobacterium tuberculosis
VRPPEL

SEQ ID NO: 1417518 - protein, 7 aa, Mycobacterium tuberculosis
VRQDNNP

SEQ ID NO: 1417519 - protein, 5 aa, Mycobacterium tuberculosis
VRRGD

SEQ ID NO: 1417520 - protein, 11 aa, Mycobacterium tuberculosis
VRTAAGDTLTS

SEQ ID NO: 1417521 - protein, 9 aa, Mycobacterium tuberculosis
VSADNPVER

SEQ ID NO: 1417522 - protein, 9 aa, Mycobacterium tuberculosis
VSAGDGRTV

SEQ ID NO: 1417523 - protein, 6 aa, Mycobacterium tuberculosis
VSASTR

SEQ ID NO: 1417524 - protein, 13 aa, Mycobacterium tuberculosis
VSATLGNADTIGG

SEQ ID NO: 1417525 - protein, 18 aa, Mycobacterium tuberculosis
VSATTTDGLGLTGRGEGL

SEQ ID NO: 1417526 - protein, 5 aa, Mycobacterium tuberculosis
VSDPS

SEQ ID NO: 1417527 - protein, 8 aa, Mycobacterium tuberculosis
VSERPGVY

SEQ ID NO: 1417528 - protein, 12 aa, Mycobacterium tuberculosis
VSGADIDAPQIQ

SEQ ID NO: 1417529 - protein, 9 aa, Mycobacterium tuberculosis
VSLGPGSMS

SEQ ID NO: 1417530 - protein, 20 aa, Mycobacterium tuberculosis
VSLGRPDYRDDPSPAHQPGS

SEQ ID NO: 1417531 - protein, 4 aa, Mycobacterium tuberculosis
VSPT

SEQ ID NO: 1417532 - protein, 6 aa, Mycobacterium tuberculosis
VSPTPV

SEQ ID NO: 1417533 - protein, 9 aa, Mycobacterium tuberculosis
VSRERAAEL

SEQ ID NO: 1417534 - protein, 6 aa, Mycobacterium tuberculosis
VSRPAV

SEQ ID NO: 1417535 - protein, 14 aa, Mycobacterium tuberculosis
VSSIENGDIGSAQV

SEQ ID NO: 1417536 - protein, 15 aa, Mycobacterium tuberculosis
VSTAEKAKLSKDAGA

SEQ ID NO: 1417537 - protein, 5 aa, Mycobacterium tuberculosis
VSTGY

SEQ ID NO: 1417538 - protein, 12 aa, Mycobacterium tuberculosis
VSVEGEPKPLPN

SEQ ID NO: 1417539 - protein, 5 aa, Mycobacterium tuberculosis
VSYPT

SEQ ID NO: 1417540 - protein, 13 aa, Mycobacterium tuberculosis
VTATSDGQVYSFA

SEQ ID NO: 1417541 - protein, 23 aa, Mycobacterium tuberculosis
VTDTRTSRTFAEQAARQAQAQAL

SEQ ID NO: 1417542 - protein, 6 aa, Mycobacterium tuberculosis
VTELPA

SEQ ID NO: 1417543 - protein, 7 aa, Mycobacterium tuberculosis
VTERAPI

SEQ ID NO: 1417544 - protein, 10 aa, Mycobacterium tuberculosis
VTEVDPKDRD

SEQ ID NO: 1417545 - protein, 12 aa, Mycobacterium tuberculosis
VTGEPVAPSSLT

SEQ ID NO: 1417546 - protein, 9 aa, Mycobacterium tuberculosis
VTGPDGPVA

SEQ ID NO: 1417547 - protein, 10 aa, Mycobacterium tuberculosis
VTGSGAPTAN

SEQ ID NO: 1417548 - protein, 4 aa, Mycobacterium tuberculosis
VTGV

SEQ ID NO: 1417549 - protein, 7 aa, Mycobacterium tuberculosis
VTLTPGD

SEQ ID NO: 1417550 - protein, 5 aa, Mycobacterium tuberculosis
VTPHE

SEQ ID NO: 1417551 - protein, 13 aa, Mycobacterium tuberculosis
VTPKGETELTPEE

SEQ ID NO: 1417552 - protein, 7 aa, Mycobacterium tuberculosis
VTPKYPQ

SEQ ID NO: 1417553 - protein, 20 aa, Mycobacterium tuberculosis
VTSRWPSGIKDGAEFVIPTM

SEQ ID NO: 1417554 - protein, 4 aa, Mycobacterium tuberculosis
VTTT

SEQ ID NO: 1417555 - protein, 8 aa, Mycobacterium tuberculosis
VVDPDDIE

SEQ ID NO: 1417556 - protein, 7 aa, Mycobacterium tuberculosis
VVPTTGP

SEQ ID NO: 1417557 - protein, 6 aa, Mycobacterium tuberculosis
VVTDRA

SEQ ID NO: 1417558 - protein, 4 aa, Mycobacterium tuberculosis
WDGP

SEQ ID NO: 1417559 - protein, 17 aa, Mycobacterium tuberculosis
WDTPDGTPPPGTGLSPT

SEQ ID NO: 1417560 - protein, 8 aa, Mycobacterium tuberculosis
WDVTPGEL

SEQ ID NO: 1417561 - protein, 8 aa, Mycobacterium tuberculosis
WGPAQGGV

SEQ ID NO: 1417562 - protein, 15 aa, Mycobacterium tuberculosis
WGPPESAQVQVGDGE

SEQ ID NO: 1417563 - protein, 7 aa, Mycobacterium tuberculosis
WGPPPGE

SEQ ID NO: 1417564 - protein, 15 aa, Mycobacterium tuberculosis
WKPDQYANPEGPASH

SEQ ID NO: 1417565 - protein, 18 aa, Mycobacterium tuberculosis
WKQDPPSPMPGDPKDMTA

SEQ ID NO: 1417566 - protein, 5 aa, Mycobacterium tuberculosis
WPPEA

SEQ ID NO: 1417567 - protein, 5 aa, Mycobacterium tuberculosis
WPTPL

SEQ ID NO: 1417568 - protein, 16 aa, Mycobacterium tuberculosis
WQGEAQPLSDAGPTGW

SEQ ID NO: 1417569 - protein, 8 aa, Mycobacterium tuberculosis
WSDGSAPI

SEQ ID NO: 1417570 - protein, 4 aa, Mycobacterium tuberculosis
WSQA

SEQ ID NO: 1417571 - protein, 8 aa, Mycobacterium tuberculosis
WSQPPWRP

SEQ ID NO: 1417572 - protein, 8 aa, Mycobacterium tuberculosis
YAEEAGIK

SEQ ID NO: 1417573 - protein, 8 aa, Mycobacterium tuberculosis
YAEHEGKP

SEQ ID NO: 1417574 - protein, 7 aa, Mycobacterium tuberculosis
YAERASD

SEQ ID NO: 1417575 - protein, 10 aa, Mycobacterium tuberculosis
YAETEEEADQ

SEQ ID NO: 1417576 - protein, 12 aa, Mycobacterium tuberculosis
YAPHDRTAEELR

SEQ ID NO: 1417577 - protein, 7 aa, Mycobacterium tuberculosis
YASPNAL

SEQ ID NO: 1417578 - protein, 7 aa, Mycobacterium tuberculosis
YDAASEM

SEQ ID NO: 1417579 - protein, 15 aa, Mycobacterium tuberculosis
YDGDVQSDTVAQGYG

SEQ ID NO: 1417580 - protein, 20 aa, Mycobacterium tuberculosis
YDGPQHWTDPAQRARDIERS

SEQ ID NO: 1417581 - protein, 10 aa, Mycobacterium tuberculosis
YDGTPGTIAD

SEQ ID NO: 1417582 - protein, 9 aa, Mycobacterium tuberculosis
YDKPATPWQ

SEQ ID NO: 1417583 - protein, 7 aa, Mycobacterium tuberculosis
YDPDNTH

SEQ ID NO: 1417584 - protein, 5 aa, Mycobacterium tuberculosis
YDTSS

SEQ ID NO: 1417585 - protein, 7 aa, Mycobacterium tuberculosis
YEETSSI

SEQ ID NO: 1417586 - protein, 5 aa, Mycobacterium tuberculosis
YELRP

SEQ ID NO: 1417587 - protein, 13 aa, Mycobacterium tuberculosis
YEPDAEGKRPPEC

SEQ ID NO: 1417588 - protein, 5 aa, Mycobacterium tuberculosis
YERAT

SEQ ID NO: 1417589 - protein, 4 aa, Mycobacterium tuberculosis
YGAE

SEQ ID NO: 1417590 - protein, 8 aa, Mycobacterium tuberculosis
YGDDGTRI

SEQ ID NO: 1417591 - protein, 11 aa, Mycobacterium tuberculosis
YGEDEGGEEDL

SEQ ID NO: 1417592 - protein, 5 aa, Mycobacterium tuberculosis
YGEKH

SEQ ID NO: 1417593 - protein, 10 aa, Mycobacterium tuberculosis
YGETQAQSVS

SEQ ID NO: 1417594 - protein, 12 aa, Mycobacterium tuberculosis
YPDAAKYTPGAI

SEQ ID NO: 1417595 - protein, 8 aa, Mycobacterium tuberculosis
YPDSQVGT

SEQ ID NO: 1417596 - protein, 7 aa, Mycobacterium tuberculosis
YPEEVPG

SEQ ID NO: 1417597 - protein, 4 aa, Mycobacterium tuberculosis
YPGA

SEQ ID NO: 1417598 - protein, 13 aa, Mycobacterium tuberculosis
YPLPSNGDLTPWA

SEQ ID NO: 1417599 - protein, 8 aa, Mycobacterium tuberculosis
YPNYPAPS

SEQ ID NO: 1417600 - protein, 10 aa, Mycobacterium tuberculosis
YQQQADNHAD

SEQ ID NO: 1417601 - protein, 7 aa, Mycobacterium tuberculosis
YQSSTTD

SEQ ID NO: 1417602 - protein, 5 aa, Mycobacterium tuberculosis
YQSSV

SEQ ID NO: 1417603 - protein, 5 aa, Mycobacterium tuberculosis
YRDRG

SEQ ID NO: 1417604 - protein, 10 aa, Mycobacterium tuberculosis
YRGDGGGLET

SEQ ID NO: 1417605 - protein, 6 aa, Mycobacterium tuberculosis
YRGEFD

SEQ ID NO: 1417606 - protein, 6 aa, Mycobacterium tuberculosis
YRGQET

SEQ ID NO: 1417607 - protein, 7 aa, Mycobacterium tuberculosis
YRGVKGG

SEQ ID NO: 1417608 - protein, 9 aa, Mycobacterium tuberculosis
YRPKRPGSY

SEQ ID NO: 1417609 - protein, 5 aa, Mycobacterium tuberculosis
YRRRG

SEQ ID NO: 1417610 - protein, 4 aa, Mycobacterium tuberculosis
YRTE

SEQ ID NO: 1417611 - protein, 5 aa, Mycobacterium tuberculosis
YSGDD

SEQ ID NO: 1417612 - protein, 7 aa, Mycobacterium tuberculosis
YSGEDEP

SEQ ID NO: 1417613 - protein, 7 aa, Mycobacterium tuberculosis
YSGEGVT

SEQ ID NO: 1417614 - protein, 9 aa, Mycobacterium tuberculosis
YSKPPQRGL

SEQ ID NO: 1417615 - protein, 18 aa, Mycobacterium tuberculosis
YSQYAPTAGPYFSHGNLV

SEQ ID NO: 1417616 - protein, 5 aa, Mycobacterium tuberculosis
YSRGD

SEQ ID NO: 1417617 - protein, 9 aa, Mycobacterium tuberculosis
YSVTTDAGD

SEQ ID NO: 1417618 - protein, 43 aa, Mycobacterium tuberculosis; identical to SEQ ID NO: 192013

SEQ ID NO: 1417619 - protein, 8 aa, Mycobacterium tuberculosis
YTASLGDR

SEQ ID NO: 1417620 - protein, 5 aa, Mycobacterium tuberculosis
YTGAY

SEQ ID NO: 1417621 - protein, 9 aa, Mycobacterium tuberculosis
YTSHGKHRT

SEQ ID NO: 1417622 - protein, 7 aa, Mycobacterium tuberculosis
YYPDGSQ

SEQ ID NO: 1417623 - protein, 10 aa, Mycobacterium tuberculosis
AAAADATRRA

SEQ ID NO: 1417624 - protein, 9 aa, Mycobacterium tuberculosis
AAAAESAEL

SEQ ID NO: 1417625 - protein, 14 aa, Mycobacterium tuberculosis
AAAARRDYLDETGG

SEQ ID NO: 1417626 - protein, 4 aa, Mycobacterium tuberculosis
AAAD

SEQ ID NO: 1417627 - protein, 16 aa, Mycobacterium tuberculosis
AAAGAGSEKVTLRSGA

SEQ ID NO: 1417628 - protein, 23 aa, Mycobacterium tuberculosis
AAAGPRRTASGSVAVPGARARVA

SEQ ID NO: 1417629 - protein, 7 aa, Mycobacterium tuberculosis
AAAGTST

SEQ ID NO: 1417630 - protein, 8 aa, Mycobacterium tuberculosis
AAANPRIG

SEQ ID NO: 1417631 - protein, 12 aa, Mycobacterium tuberculosis
AAAPQTTPAPQI

SEQ ID NO: 1417632 - protein, 9 aa, Mycobacterium tuberculosis
AAAQTVRAG

SEQ ID NO: 1417633 - protein, 8 aa, Mycobacterium tuberculosis
AAARGRTG

SEQ ID NO: 1417634 - protein, 9 aa, Mycobacterium tuberculosis
AAARTAEQL

SEQ ID NO: 1417635 - protein, 8 aa, Mycobacterium tuberculosis
AAASTPGI

SEQ ID NO: 1417636 - protein, 12 aa, Mycobacterium tuberculosis
AADDESAASMAT

SEQ ID NO: 1417637 - protein, 8 aa, Mycobacterium tuberculosis
AADGSDRR

SEQ ID NO: 1417638 - protein, 10 aa, Mycobacterium tuberculosis
AADGTAGSTG

SEQ ID NO: 1417639 - protein, 16 aa, Mycobacterium tuberculosis
AADRSSVASAAWTGEL

SEQ ID NO: 1417640 - protein, 5 aa, Mycobacterium tuberculosis
AAEAK

SEQ ID NO: 1417641 - protein, 5 aa, Mycobacterium tuberculosis
AAEPV

SEQ ID NO: 1417642 - protein, 7 aa, Mycobacterium tuberculosis
AAETPLT

SEQ ID NO: 1417643 - protein, 4 aa, Mycobacterium tuberculosis
AAFE

SEQ ID NO: 1417644 - protein, 6 aa, Mycobacterium tuberculosis
AAFPGG

SEQ ID NO: 1417645 - protein, 5 aa, Mycobacterium tuberculosis
AAGAD

SEQ ID NO: 1417646 - protein, 7 aa, Mycobacterium tuberculosis
AAGDEVS

SEQ ID NO: 1417647 - protein, 5 aa, Mycobacterium tuberculosis
AAGGG

SEQ ID NO: 1417648 - protein, 6 aa, Mycobacterium tuberculosis
AAGGRP

SEQ ID NO: 1417649 - protein, 4 aa, Mycobacterium tuberculosis
AAGK

SEQ ID NO: 1417650 - protein, 4 aa, Mycobacterium tuberculosis
AAGP

SEQ ID NO: 1417651 - protein, 4 aa, Mycobacterium tuberculosis
AAGT

SEQ ID NO: 1417652 - protein, 16 aa, Mycobacterium tuberculosis
AAGVGSGTADHPGDPW

SEQ ID NO: 1417653 - protein, 9 aa, Mycobacterium tuberculosis
AAGVTAPGP

SEQ ID NO: 1417654 - protein, 14 aa, Mycobacterium tuberculosis
AAIETSRRTSRPLA

SEQ ID NO: 1417655 - protein, 7 aa, Mycobacterium tuberculosis
AAKAGRT

SEQ ID NO: 1417656 - protein, 5 aa, Mycobacterium tuberculosis
AAKDT

SEQ ID NO: 1417657 - protein, 7 aa, Mycobacterium tuberculosis
AAKVDRT

SEQ ID NO: 1417658 - protein, 6 aa, Mycobacterium tuberculosis
AAMRPA

SEQ ID NO: 1417659 - protein, 7 aa, Mycobacterium tuberculosis
AANEEAA

SEQ ID NO: 1417660 - protein, 6 aa, Mycobacterium tuberculosis
AANPSI

SEQ ID NO: 1417661 - protein, 16 aa, Mycobacterium tuberculosis
AAPGIGNSTTSPSSGF

SEQ ID NO: 1417662 - protein, 7 aa, Mycobacterium tuberculosis
AAPRASH

SEQ ID NO: 1417663 - protein, 5 aa, Mycobacterium tuberculosis
AAPTV

SEQ ID NO: 1417664 - protein, 9 aa, Mycobacterium tuberculosis
AAQAEQAAA

SEQ ID NO: 1417665 - protein, 6 aa, Mycobacterium tuberculosis
AAQDMT

SEQ ID NO: 1417666 - protein, 15 aa, Mycobacterium tuberculosis
AAQPGSRLYRNGERG

SEQ ID NO: 1417667 - protein, 9 aa, Mycobacterium tuberculosis
AAQRAGDAL

SEQ ID NO: 1417668 - protein, 9 aa, Mycobacterium tuberculosis
AAQTDDQQL

SEQ ID NO: 1417669 - protein, 12 aa, Mycobacterium tuberculosis
AARARAGDGPTL

SEQ ID NO: 1417670 - protein, 4 aa, Mycobacterium tuberculosis
AARE

SEQ ID NO: 1417671 - protein, 18 aa, Mycobacterium tuberculosis
AARNHDLTESELADAERD

SEQ ID NO: 1417672 - protein, 5 aa, Mycobacterium tuberculosis
AARNS

SEQ ID NO: 1417673 - protein, 6 aa, Mycobacterium tuberculosis
AARRAR

SEQ ID NO: 1417674 - protein, 8 aa, Mycobacterium tuberculosis
AASQYPNR

SEQ ID NO: 1417675 - protein, 4 aa, Mycobacterium tuberculosis
AASR

SEQ ID NO: 1417676 - protein, 10 aa, Mycobacterium tuberculosis
AASSQIQSES

SEQ ID NO: 1417677 - protein, 17 aa, Mycobacterium tuberculosis
AASTPDEIFQLIDSELG

SEQ ID NO: 1417678 - protein, 18 aa, Mycobacterium tuberculosis
AATADAYATTEAVNVVAT

SEQ ID NO: 1417679 - protein, 5 aa, Mycobacterium tuberculosis
AATPR

SEQ ID NO: 1417680 - protein, 14 aa, Mycobacterium tuberculosis
AATSNTLPEQLGEG

SEQ ID NO: 1417681 - protein, 9 aa, Mycobacterium tuberculosis
AATTGRSYG

SEQ ID NO: 1417682 - protein, 6 aa, Mycobacterium tuberculosis
AAVNSD

SEQ ID NO: 1417683 - protein, 8 aa, Mycobacterium tuberculosis
AAYHRPDT

SEQ ID NO: 1417684 - protein, 7 aa, Mycobacterium tuberculosis
ADAAALG

SEQ ID NO: 1417685 - protein, 9 aa, Mycobacterium tuberculosis
ADAGSRSQV

SEQ ID NO: 1417686 - protein, 10 aa, Mycobacterium tuberculosis
ADARAAGLNR

SEQ ID NO: 1417687 - protein, 4 aa, Mycobacterium tuberculosis
ADDL

SEQ ID NO: 1417688 - protein, 7 aa, Mycobacterium tuberculosis
ADDSGRI

SEQ ID NO: 1417689 - protein, 8 aa, Mycobacterium tuberculosis
ADDTSTVP

SEQ ID NO: 1417690 - protein, 6 aa, Mycobacterium tuberculosis
ADEAPG

SEQ ID NO: 1417691 - protein, 6 aa, Mycobacterium tuberculosis
ADEEKA

SEQ ID NO: 1417692 - protein, 6 aa, Mycobacterium tuberculosis
ADELGL

SEQ ID NO: 1417693 - protein, 5 aa, Mycobacterium tuberculosis
ADGDA

SEQ ID NO: 1417694 - protein, 6 aa, Mycobacterium tuberculosis
ADGIAS

SEQ ID NO: 1417695 - protein, 21 aa, Mycobacterium tuberculosis
ADGKRTTRTPAESDTERIEEA

SEQ ID NO: 1417696 - protein, 63 aa, Mycobacterium tuberculosis; identical to SEQ ID NO: 167567

SEQ ID NO: 1417697 - protein, 7 aa, Mycobacterium tuberculosis
ADGTDVD

SEQ ID NO: 1417698 - protein, 4 aa, Mycobacterium tuberculosis
ADGV

SEQ ID NO: 1417699 - protein, 10 aa, Mycobacterium tuberculosis
ADGYVPGDGG

SEQ ID NO: 1417700 - protein, 12 aa, Mycobacterium tuberculosis
ADIREPIPSRLQ

SEQ ID NO: 1417701 - protein, 13 aa, Mycobacterium tuberculosis
ADLADPQERSKLA

SEQ ID NO: 1417702 - protein, 9 aa, Mycobacterium tuberculosis
ADNGHSRVG

SEQ ID NO: 1417703 - protein, 8 aa, Mycobacterium tuberculosis
ADPLPVKP

SEQ ID NO: 1417704 - protein, 8 aa, Mycobacterium tuberculosis
ADPQPDPF

SEQ ID NO: 1417705 - protein, 5 aa, Mycobacterium tuberculosis
ADPYP

SEQ ID NO: 1417706 - protein, 9 aa, Mycobacterium tuberculosis
ADQDPVAGS

SEQ ID NO: 1417707 - protein, 6 aa, Mycobacterium tuberculosis
ADRDDA

SEQ ID NO: 1417708 - protein, 7 aa, Mycobacterium tuberculosis
ADSAPMT

SEQ ID NO: 1417709 - protein, 19 aa, Mycobacterium tuberculosis
ADSDRYGGGQGNDLDGAAP

SEQ ID NO: 1417710 - protein, 9 aa, Mycobacterium tuberculosis
ADSQSNELR

SEQ ID NO: 1417711 - protein, 14 aa, Mycobacterium tuberculosis
ADTPVQPGIPGRTE

SEQ ID NO: 1417712 - protein, 8 aa, Mycobacterium tuberculosis
ADVDHGKA

SEQ ID NO: 1417713 - protein, 16 aa, Mycobacterium tuberculosis
ADVRADAARSLNVESA

SEQ ID NO: 1417714 - protein, 7 aa, Mycobacterium tuberculosis
ADVRSGN

SEQ ID NO: 1417715 - protein, 4 aa, Mycobacterium tuberculosis
AEAV

SEQ ID NO: 1417716 - protein, 24 aa, Mycobacterium tuberculosis
AEEASGAQLAPGTEPSPAPLGQPR

SEQ ID NO: 1417717 - protein, 6 aa, Mycobacterium tuberculosis
AEETLQ

SEQ ID NO: 1417718 - protein, 10 aa, Mycobacterium tuberculosis
AEGGEPAAGR

SEQ ID NO: 1417719 - protein, 9 aa, Mycobacterium tuberculosis
AELDESAAR

SEQ ID NO: 1417720 - protein, 10 aa, Mycobacterium tuberculosis
AELESARADR

SEQ ID NO: 1417721 - protein, 9 aa, Mycobacterium tuberculosis
AELGAEGAG

SEQ ID NO: 1417722 - protein, 12 aa, Mycobacterium tuberculosis
AESGSEAAEADP

SEQ ID NO: 1417723 - protein, 8 aa, Mycobacterium tuberculosis
AESGYAAV

SEQ ID NO: 1417724 - protein, 15 aa, Mycobacterium tuberculosis
AETDSHPLGTLSGGT

SEQ ID NO: 1417725 - protein, 10 aa, Mycobacterium tuberculosis
AETGTPRFSA

SEQ ID NO: 1417726 - protein, 6 aa, Mycobacterium tuberculosis
AETSTP

SEQ ID NO: 1417727 - protein, 6 aa, Mycobacterium tuberculosis
AEVDPR

SEQ ID NO: 1417728 - protein, 7 aa, Mycobacterium tuberculosis
AEYDGDH

SEQ ID NO: 1417729 - protein, 4 aa, Mycobacterium tuberculosis
AFSE

SEQ ID NO: 1417730 - protein, 7 aa, Mycobacterium tuberculosis
AGADVSQ

SEQ ID NO: 1417731 - protein, 4 aa, Mycobacterium tuberculosis
AGAP

SEQ ID NO: 1417732 - protein, 35 aa, Mycobacterium tuberculosis; identical to SEQ ID NO: 168140

SEQ ID NO: 1417733 - protein, 13 aa, Mycobacterium tuberculosis
AGASTLAGSTTTM

SEQ ID NO: 1417734 - protein, 8 aa, Mycobacterium tuberculosis
AGATVDCD

SEQ ID NO: 1417735 - protein, 4 aa, Mycobacterium tuberculosis
AGAV

SEQ ID NO: 1417736 - protein, 13 aa, Mycobacterium tuberculosis
AGDAEASAAAPWQ

SEQ ID NO: 1417737 - protein, 5 aa, Mycobacterium tuberculosis
AGDDV

SEQ ID NO: 1417738 - protein, 9 aa, Mycobacterium tuberculosis
AGDKAFAAG

SEQ ID NO: 1417739 - protein, 8 aa, Mycobacterium tuberculosis
AGDRPKAG

SEQ ID NO: 1417740 - protein, 14 aa, Mycobacterium tuberculosis
AGERMRDAVAYLAA

SEQ ID NO: 1417741 - protein, 6 aa, Mycobacterium tuberculosis
AGESGL

SEQ ID NO: 1417742 - protein, 7 aa, Mycobacterium tuberculosis
AGFGTSG

SEQ ID NO: 1417743 - protein, 12 aa, Mycobacterium tuberculosis
AGGGPGSLSAAA

SEQ ID NO: 1417744 - protein, 4 aa, Mycobacterium tuberculosis
AGGM

SEQ ID NO: 1417745 - protein, 8 aa, Mycobacterium tuberculosis
AGGSCAPE

SEQ ID NO: 1417746 - protein, 11 aa, Mycobacterium tuberculosis
AGGTSEVTRNQ

SEQ ID NO: 1417747 - protein, 8 aa, Mycobacterium tuberculosis
AGIEQTNA

SEQ ID NO: 1417748 - protein, 5 aa, Mycobacterium tuberculosis
AGIRP

SEQ ID NO: 1417749 - protein, 4 aa, Mycobacterium tuberculosis
AGKS

SEQ ID NO: 1417750 - protein, 13 aa, Mycobacterium tuberculosis
AGKTADADAYEPF

SEQ ID NO: 1417751 - protein, 13 aa, Mycobacterium tuberculosis
AGLPAPKYGTATT

SEQ ID NO: 1417752 - protein, 10 aa, Mycobacterium tuberculosis
AGPAGSAAAA

SEQ ID NO: 1417753 - protein, 15 aa, Mycobacterium tuberculosis
AGPALSAAAEQGGLA

SEQ ID NO: 1417754 - protein, 7 aa, Mycobacterium tuberculosis
AGPEIGV

SEQ ID NO: 1417755 - protein, 7 aa, Mycobacterium tuberculosis
AGPGVPE

SEQ ID NO: 1417756 - protein, 8 aa, Mycobacterium tuberculosis
AGPMSDGD

SEQ ID NO: 1417757 - protein, 5 aa, Mycobacterium tuberculosis
AGPTV

SEQ ID NO: 1417758 - protein, 12 aa, Mycobacterium tuberculosis
AGPWAAGAQRGQ

SEQ ID NO: 1417759 - protein, 7 aa, Mycobacterium tuberculosis
AGQHAPG

SEQ ID NO: 1417760 - protein, 7 aa, Mycobacterium tuberculosis
AGQTRST

SEQ ID NO: 1417761 - protein, 6 aa, Mycobacterium tuberculosis
AGSDGL

SEQ ID NO: 1417762 - protein, 43 aa, Mycobacterium tuberculosis
AGSSASASAVTPFSTPPQIANPTAQGTQAAAVATAAGTAQSTL

SEQ ID NO: 1417763 - protein, 8 aa, Mycobacterium tuberculosis
AGSTVGQA

SEQ ID NO: 1417764 - protein, 6 aa, Mycobacterium tuberculosis
AGTDTA

SEQ ID NO: 1417765 - protein, 4 aa, Mycobacterium tuberculosis
AGTH

SEQ ID NO: 1417766 - protein, 7 aa, Mycobacterium tuberculosis
AGTPGKR

SEQ ID NO: 1417767 - protein, 6 aa, Mycobacterium tuberculosis
AGTPHC

SEQ ID NO: 1417768 - protein, 4 aa, Mycobacterium tuberculosis
AGVH

SEQ ID NO: 1417769 - protein, 17 aa, Mycobacterium tuberculosis
AGWSSAPRSRYTKTEMA

SEQ ID NO: 1417770 - protein, 20 aa, Mycobacterium tuberculosis
AGYANPADNPFRPEGGRLHA

SEQ ID NO: 1417771 - protein, 13 aa, Mycobacterium tuberculosis
AGYVATTTRVGGP

SEQ ID NO: 1417772 - protein, 18 aa, Mycobacterium tuberculosis
AHADGRVSNPVRVKSDEL

SEQ ID NO: 1417773 - protein, 9 aa, Mycobacterium tuberculosis
AHGTDGEDQ

SEQ ID NO: 1417774 - protein, 10 aa, Mycobacterium tuberculosis
AHPQPGNPAP

SEQ ID NO: 1417775 - protein, 7 aa, Mycobacterium tuberculosis
AHSRSPQ

SEQ ID NO: 1417776 - protein, 11 aa, Mycobacterium tuberculosis
AHTNEASPLDA

SEQ ID NO: 1417777 - protein, 8 aa, Mycobacterium tuberculosis
AIGAGNKL

SEQ ID NO: 1417778 - protein, 19 aa, Mycobacterium tuberculosis
AIGGADPVSVPAAGAVGRQ

SEQ ID NO: 1417779 - protein, 9 aa, Mycobacterium tuberculosis
AIPSGEYGA

SEQ ID NO: 1417780 - protein, 6 aa, Mycobacterium tuberculosis
AITERQ

SEQ ID NO: 1417781 - protein, 5 aa, Mycobacterium tuberculosis
AITPR

SEQ ID NO: 1417782 - protein, 13 aa, Mycobacterium tuberculosis
AKAAEGEVDADSV

SEQ ID NO: 1417783 - protein, 7 aa, Mycobacterium tuberculosis
AKATSRV

SEQ ID NO: 1417784 - protein, 15 aa, Mycobacterium tuberculosis
AKDAFGAQKRQRQMD

SEQ ID NO: 1417785 - protein, 7 aa, Mycobacterium tuberculosis
AKIGYPP

SEQ ID NO: 1417786 - protein, 11 aa, Mycobacterium tuberculosis
AKPDGPREGGY

SEQ ID NO: 1417787 - protein, 15 aa, Mycobacterium tuberculosis
AKREYEASVSRAQAE

SEQ ID NO: 1417788 - protein, 8 aa, Mycobacterium tuberculosis
AKRSGTGI

SEQ ID NO: 1417789 - protein, 14 aa, Mycobacterium tuberculosis
AKSAGPRSTPTVRG

SEQ ID NO: 1417790 - protein, 15 aa, Mycobacterium tuberculosis
AKSAKQQKESEDRGE

SEQ ID NO: 1417791 - protein, 8 aa, Mycobacterium tuberculosis
AKTHADSM

SEQ ID NO: 1417792 - protein, 5 aa, Mycobacterium tuberculosis
ALAAG

SEQ ID NO: 1417793 - protein, 9 aa, Mycobacterium tuberculosis
ALADDKTVT

SEQ ID NO: 1417794 - protein, 8 aa, Mycobacterium tuberculosis
ALASNGPS

SEQ ID NO: 1417795 - protein, 11 aa, Mycobacterium tuberculosis
ALDGPSGPAAD

SEQ ID NO: 1417796 - protein, 10 aa, Mycobacterium tuberculosis
ALDPDHDKPS

SEQ ID NO: 1417797 - protein, 7 aa, Mycobacterium tuberculosis
ALGPAQR

SEQ ID NO: 1417798 - protein, 12 aa, Mycobacterium tuberculosis
ALPGGDAIGSRP

SEQ ID NO: 1417799 - protein, 31 aa, Mycobacterium tuberculosis; identical to SEQ ID NO: 192161

SEQ ID NO: 1417800 - protein, 15 aa, Mycobacterium tuberculosis
ALTNSLGESKPPQVH

SEQ ID NO: 1417801 - protein, 5 aa, Mycobacterium tuberculosis
AMGTQ

SEQ ID NO: 1417802 - protein, 6 aa, Mycobacterium tuberculosis
ANHADG

SEQ ID NO: 1417803 - protein, 7 aa, Mycobacterium tuberculosis
ANKVPGA

SEQ ID NO: 1417804 - protein, 13 aa, Mycobacterium tuberculosis
ANLTRNAADFGGS

SEQ ID NO: 1417805 - protein, 4 aa, Mycobacterium tuberculosis
ANPA

SEQ ID NO: 1417806 - protein, 7 aa, Mycobacterium tuberculosis
ANTPPAF

SEQ ID NO: 1417807 - protein, 10 aa, Mycobacterium tuberculosis
APAAAAPPLD

SEQ ID NO: 1417808 - protein, 4 aa, Mycobacterium tuberculosis
APAE

SEQ ID NO: 1417809 - protein, 45 aa, Mycobacterium tuberculosis
APAEKAGRVTKVSSSGPNSTPLPAARIGPGTNNAPSAADTTTYAR

SEQ ID NO: 1417810 - protein, 7 aa, Mycobacterium tuberculosis
APALRPS

SEQ ID NO: 1417811 - protein, 7 aa, Mycobacterium tuberculosis
APARTCK

SEQ ID NO: 1417812 - protein, 5 aa, Mycobacterium tuberculosis
APATT

SEQ ID NO: 1417813 - protein, 10 aa, Mycobacterium tuberculosis
APDSERGLAP

SEQ ID NO: 1417814 - protein, 4 aa, Mycobacterium tuberculosis
APEL

SEQ ID NO: 1417815 - protein, 13 aa, Mycobacterium tuberculosis
APERRASNGRQQV

SEQ ID NO: 1417816 - protein, 5 aa, Mycobacterium tuberculosis
APEYS

SEQ ID NO: 1417817 - protein, 35 aa, Mycobacterium tuberculosis; identical to SEQ ID NO: 166089

SEQ ID NO: 1417818 - protein, 5 aa, Mycobacterium tuberculosis
APGAL

SEQ ID NO: 1417819 - protein, 11 aa, Mycobacterium tuberculosis
APGCGQPGGSI

SEQ ID NO: 1417820 - protein, 4 aa, Mycobacterium tuberculosis
APGG

SEQ ID NO: 1417821 - protein, 5 aa, Mycobacterium tuberculosis
APGLA

SEQ ID NO: 1417822 - protein, 7 aa, Mycobacterium tuberculosis
APGQPAR

SEQ ID NO: 1417823 - protein, 6 aa, Mycobacterium tuberculosis
APGRAI

SEQ ID NO: 1417824 - protein, 18 aa, Mycobacterium tuberculosis
APHEEPDRWQFSNAITLA

SEQ ID NO: 1417825 - protein, 4 aa, Mycobacterium tuberculosis
APIT

SEQ ID NO: 1417826 - protein, 7 aa, Mycobacterium tuberculosis
APLPDED

SEQ ID NO: 1417827 - protein, 15 aa, Mycobacterium tuberculosis
APLSPNGSSGAGGLP

SEQ ID NO: 1417828 - protein, 8 aa, Mycobacterium tuberculosis
APNTGNAI

SEQ ID NO: 1417829 - protein, 14 aa, Mycobacterium tuberculosis
APPHPRTPGATDKD

SEQ ID NO: 1417830 - protein, 12 aa, Mycobacterium tuberculosis
APPNPSKPNLDH

SEQ ID NO: 1417831 - protein, 6 aa, Mycobacterium tuberculosis
APPPAV

SEQ ID NO: 1417832 - protein, 12 aa, Mycobacterium tuberculosis
APQLSSSDGRGP

SEQ ID NO: 1417833 - protein, 4 aa, Mycobacterium tuberculosis
APRF

SEQ ID NO: 1417834 - protein, 9 aa, Mycobacterium tuberculosis
APSARQPAV

SEQ ID NO: 1417835 - protein, 7 aa, Mycobacterium tuberculosis
APTDASV

SEQ ID NO: 1417836 - protein, 16 aa, Mycobacterium tuberculosis
APTLTSTALDNRGPRT

SEQ ID NO: 1417837 - protein, 8 aa, Mycobacterium tuberculosis
APTRAFAP

SEQ ID NO: 1417838 - protein, 4 aa, Mycobacterium tuberculosis
APVR

SEQ ID NO: 1417839 - protein, 7 aa, Mycobacterium tuberculosis
APWDLSP

SEQ ID NO: 1417840 - protein, 8 aa, Mycobacterium tuberculosis
APWSNGHT

SEQ ID NO: 1417841 - protein, 10 aa, Mycobacterium tuberculosis
AQADAQSGKV

SEQ ID NO: 1417842 - protein, 9 aa, Mycobacterium tuberculosis
AQAEPVSTA

SEQ ID NO: 1417843 - protein, 12 aa, Mycobacterium tuberculosis
AQAERSRDPIGQ

SEQ ID NO: 1417844 - protein, 6 aa, Mycobacterium tuberculosis
AQALPT

SEQ ID NO: 1417845 - protein, 4 aa, Mycobacterium tuberculosis
AQAS

SEQ ID NO: 1417846 - protein, 22 aa, Mycobacterium tuberculosis
AQEEVWGEDPSTRISSSYAPMG

SEQ ID NO: 1417847 - protein, 7 aa, Mycobacterium tuberculosis
AQGESMD

SEQ ID NO: 1417848 - protein, 17 aa, Mycobacterium tuberculosis
AQGRLEAGQALASSPMK

SEQ ID NO: 1417849 - protein, 10 aa, Mycobacterium tuberculosis
AQHARHEAEV

SEQ ID NO: 1417850 - protein, 6 aa, Mycobacterium tuberculosis
AQQLAD

SEQ ID NO: 1417851 - protein, 6 aa, Mycobacterium tuberculosis
AQTDPE

SEQ ID NO: 1417852 - protein, 5 aa, Mycobacterium tuberculosis
AQTGI

SEQ ID NO: 1417853 - protein, 4 aa, Mycobacterium tuberculosis
AQVT

SEQ ID NO: 1417854 - protein, 10 aa, Mycobacterium tuberculosis
ARAATTGPIG

SEQ ID NO: 1417855 - protein, 18 aa, Mycobacterium tuberculosis
ARADGAAPAADHAEQVAQ

SEQ ID NO: 1417856 - protein, 16 aa, Mycobacterium tuberculosis
ARAGNAAVAGPTTGVV

SEQ ID NO: 1417857 - protein, 9 aa, Mycobacterium tuberculosis
ARAVGEEAL

SEQ ID NO: 1417858 - protein, 13 aa, Mycobacterium tuberculosis
ARAVSDGEQLPRS

SEQ ID NO: 1417859 - protein, 11 aa, Mycobacterium tuberculosis
ARDATDEERAE

SEQ ID NO: 1417860 - protein, 8 aa, Mycobacterium tuberculosis
ARDPATGG

SEQ ID NO: 1417861 - protein, 5 aa, Mycobacterium tuberculosis
ARDRG

SEQ ID NO: 1417862 - protein, 9 aa, Mycobacterium tuberculosis
ARELNPNET

SEQ ID NO: 1417863 - protein, 14 aa, Mycobacterium tuberculosis
AREQPLAGVSGASV

SEQ ID NO: 1417864 - protein, 19 aa, Mycobacterium tuberculosis
ARKGQKTRRREKKNVPHGA

SEQ ID NO: 1417865 - protein, 8 aa, Mycobacterium tuberculosis
ARKQPGAQ

SEQ ID NO: 1417866 - protein, 7 aa, Mycobacterium tuberculosis
ARRDDPL

SEQ ID NO: 1417867 - protein, 8 aa, Mycobacterium tuberculosis
ARRERGDL

SEQ ID NO: 1417868 - protein, 15 aa, Mycobacterium tuberculosis
ARRPRLGVDTDERTI

SEQ ID NO: 1417869 - protein, 8 aa, Mycobacterium tuberculosis
ARRRSGHL

SEQ ID NO: 1417870 - protein, 8 aa, Mycobacterium tuberculosis
ARRSTGTV

SEQ ID NO: 1417871 - protein, 5 aa, Mycobacterium tuberculosis
ARSRP

SEQ ID NO: 1417872 - protein, 8 aa, Mycobacterium tuberculosis
ARSRQQAA

SEQ ID NO: 1417873 - protein, 11 aa, Mycobacterium tuberculosis
ARTGDCTAAAT

SEQ ID NO: 1417874 - protein, 8 aa, Mycobacterium tuberculosis
ARTQDAAN

SEQ ID NO: 1417875 - protein, 15 aa, Mycobacterium tuberculosis
ARVEDPVGSQPQVGH

SEQ ID NO: 1417876 - protein, 19 aa, Mycobacterium tuberculosis
ASAEATRRYGTGCSGSPLL

SEQ ID NO: 1417877 - protein, 4 aa, Mycobacterium tuberculosis
ASAG

SEQ ID NO: 1417878 - protein, 24 aa, Mycobacterium tuberculosis
ASAPAPAAAAGATAAGPTPPATGF

SEQ ID NO: 1417879 - protein, 9 aa, Mycobacterium tuberculosis
ASARASKAT

SEQ ID NO: 1417880 - protein, 22 aa, Mycobacterium tuberculosis
ASARYVEPTGAGPLGSGTGFPV

SEQ ID NO: 1417881 - protein, 6 aa, Mycobacterium tuberculosis
ASAVTS

SEQ ID NO: 1417882 - protein, 7 aa, Mycobacterium tuberculosis
ASGDGAV

SEQ ID NO: 1417883 - protein, 8 aa, Mycobacterium tuberculosis
ASGKDTRV

SEQ ID NO: 1417884 - protein, 12 aa, Mycobacterium tuberculosis
ASGTPGQHTPSD

SEQ ID NO: 1417885 - protein, 11 aa, Mycobacterium tuberculosis
ASLAGSGVLTG

SEQ ID NO: 1417886 - protein, 6 aa, Mycobacterium tuberculosis
ASLDRL

SEQ ID NO: 1417887 - protein, 7 aa, Mycobacterium tuberculosis
ASLPTPF

SEQ ID NO: 1417888 - protein, 9 aa, Mycobacterium tuberculosis
ASQSQGLGA

SEQ ID NO: 1417889 - protein, 7 aa, Mycobacterium tuberculosis
ASRAGKV

SEQ ID NO: 1417890 - protein, 6 aa, Mycobacterium tuberculosis
ASRTPG

SEQ ID NO: 1417891 - protein, 8 aa, Mycobacterium tuberculosis
ASRYPYSR

SEQ ID NO: 1417892 - protein, 5 aa, Mycobacterium tuberculosis
ASSAC

SEQ ID NO: 1417893 - protein, 12 aa, Mycobacterium tuberculosis
ASSADALRQTAQ

SEQ ID NO: 1417894 - protein, 10 aa, Mycobacterium tuberculosis
ASSNLAAQRR

SEQ ID NO: 1417895 - protein, 9 aa, Mycobacterium tuberculosis
ASTATAVAS

SEQ ID NO: 1417896 - protein, 7 aa, Mycobacterium tuberculosis
ASTGSDH

SEQ ID NO: 1417897 - protein, 4 aa, Mycobacterium tuberculosis
ASYD

SEQ ID NO: 1417898 - protein, 13 aa, Mycobacterium tuberculosis
ATAADGSTSEHEA

SEQ ID NO: 1417899 - protein, 6 aa, Mycobacterium tuberculosis
ATAARI

SEQ ID NO: 1417900 - protein, 9 aa, Mycobacterium tuberculosis
ATADDATHQ

SEQ ID NO: 1417901 - protein, 14 aa, Mycobacterium tuberculosis
ATADGACCPVLVPD

SEQ ID NO: 1417902 - protein, 5 aa, Mycobacterium tuberculosis
ATAGE

SEQ ID NO: 1417903 - protein, 9 aa, Mycobacterium tuberculosis
ATAGPRDVP

SEQ ID NO: 1417904 - protein, 6 aa, Mycobacterium tuberculosis
ATATPL

SEQ ID NO: 1417905 - protein, 6 aa, Mycobacterium tuberculosis
ATDAET

SEQ ID NO: 1417906 - protein, 9 aa, Mycobacterium tuberculosis
ATDARPDVG

SEQ ID NO: 1417907 - protein, 9 aa, Mycobacterium tuberculosis
ATDKRDLST

SEQ ID NO: 1417908 - protein, 6 aa, Mycobacterium tuberculosis
ATDVAS

SEQ ID NO: 1417909 - protein, 4 aa, Mycobacterium tuberculosis
ATER

SEQ ID NO: 1417910 - protein, 11 aa, Mycobacterium tuberculosis
ATGADITTRAE

SEQ ID NO: 1417911 - protein, 9 aa, Mycobacterium tuberculosis
ATGAPGYSS

SEQ ID NO: 1417912 - protein, 5 aa, Mycobacterium tuberculosis
ATGEY

SEQ ID NO: 1417913 - protein, 7 aa, Mycobacterium tuberculosis
ATHSPRN

SEQ ID NO: 1417914 - protein, 14 aa, Mycobacterium tuberculosis
ATLTGSEPAGQSVG

SEQ ID NO: 1417915 - protein, 7 aa, Mycobacterium tuberculosis
ATPAQAR

SEQ ID NO: 1417916 - protein, 8 aa, Mycobacterium tuberculosis
ATPGQNNV

SEQ ID NO: 1417917 - protein, 17 aa, Mycobacterium tuberculosis
ATPLANPGNLDSRRRAA

SEQ ID NO: 1417918 - protein, 11 aa, Mycobacterium tuberculosis
ATQVGTKHDAT

SEQ ID NO: 1417919 - protein, 5 aa, Mycobacterium tuberculosis
ATRHH

SEQ ID NO: 1417920 - protein, 6 aa, Mycobacterium tuberculosis
ATRPAL

SEQ ID NO: 1417921 - protein, 18 aa, Mycobacterium tuberculosis
ATSASSYADTEAANAVVT

SEQ ID NO: 1417922 - protein, 8 aa, Mycobacterium tuberculosis
ATVEGRPK

SEQ ID NO: 1417923 - protein, 14 aa, Mycobacterium tuberculosis
AVADRKQLSDKISE

SEQ ID NO: 1417924 - protein, 7 aa, Mycobacterium tuberculosis
AVAGEVA

SEQ ID NO: 1417925 - protein, 7 aa, Mycobacterium tuberculosis
AVDPNAD

SEQ ID NO: 1417926 - protein, 17 aa, Mycobacterium tuberculosis
AVEDQRDGELEARAQKL

SEQ ID NO: 1417927 - protein, 12 aa, Mycobacterium tuberculosis
AVELTSSTEERV

SEQ ID NO: 1417928 - protein, 6 aa, Mycobacterium tuberculosis
AVERAG

SEQ ID NO: 1417929 - protein, 8 aa, Mycobacterium tuberculosis
AVGRPYPG

SEQ ID NO: 1417930 - protein, 18 aa, Mycobacterium tuberculosis
AVNQDGRSNGVTAPNTAA

SEQ ID NO: 1417931 - protein, 12 aa, Mycobacterium tuberculosis
AVPSGASTGEHE

SEQ ID NO: 1417932 - protein, 4 aa, Mycobacterium tuberculosis
AVPT

SEQ ID NO: 1417933 - protein, 6 aa, Mycobacterium tuberculosis
AVPTAR

SEQ ID NO: 1417934 - protein, 9 aa, Mycobacterium tuberculosis
AVRGTGSSV

SEQ ID NO: 1417935 - protein, 11 aa, Mycobacterium tuberculosis
AVSVPERNQPW

SEQ ID NO: 1417936 - protein, 6 aa, Mycobacterium tuberculosis
AVTGKG

SEQ ID NO: 1417937 - protein, 10 aa, Mycobacterium tuberculosis
AVTPEQAPLY

SEQ ID NO: 1417938 - protein, 22 aa, Mycobacterium tuberculosis
AVYEPSPRALPTDTATQRPAPQ

SEQ ID NO: 1417939 - protein, 4 aa, Mycobacterium tuberculosis
AWSD

SEQ ID NO: 1417940 - protein, 9 aa, Mycobacterium tuberculosis
AYERRSGER

SEQ ID NO: 1417941 - protein, 11 aa, Mycobacterium tuberculosis
AYPGTPPPMPA

SEQ ID NO: 1417942 - protein, 6 aa, Mycobacterium tuberculosis
AYTNPG

SEQ ID NO: 1417943 - protein, 4 aa, Mycobacterium tuberculosis
CADN

SEQ ID NO: 1417944 - protein, 4 aa, Mycobacterium tuberculosis
CDPK

SEQ ID NO: 1417945 - protein, 16 aa, Mycobacterium tuberculosis
CGRAPRPAHRCPARRH

SEQ ID NO: 1417946 - protein, 12 aa, Mycobacterium tuberculosis
CGTPDADAFDRG

SEQ ID NO: 1417947 - protein, 18 aa, Mycobacterium tuberculosis
CNEADAGVPARRRGRGVA

SEQ ID NO: 1417948 - protein, 4 aa, Mycobacterium tuberculosis
CPGK

SEQ ID NO: 1417949 - protein, 9 aa, Mycobacterium tuberculosis
CPPAGTGTH

SEQ ID NO: 1417950 - protein, 19 aa, Mycobacterium tuberculosis
CPSGTDPSTHPSSDEVTEG

SEQ ID NO: 1417951 - protein, 12 aa, Mycobacterium tuberculosis
CSSGYNAEAAAP

SEQ ID NO: 1417952 - protein, 9 aa, Mycobacterium tuberculosis
CTGSPGCAH

SEQ ID NO: 1417953 - protein, 7 aa, Mycobacterium tuberculosis
DAADLGA

SEQ ID NO: 1417954 - protein, 6 aa, Mycobacterium tuberculosis
DAAGPL

SEQ ID NO: 1417955 - protein, 13 aa, Mycobacterium tuberculosis
DAAGTKSSFRTGD

SEQ ID NO: 1417956 - protein, 7 aa, Mycobacterium tuberculosis
DAALGRP

SEQ ID NO: 1417957 - protein, 6 aa, Mycobacterium tuberculosis
DADDGY

SEQ ID NO: 1417958 - protein, 4 aa, Mycobacterium tuberculosis
DADE

SEQ ID NO: 1417959 - protein, 17 aa, Mycobacterium tuberculosis
DADVPGPLTGLPTHQDN

SEQ ID NO: 1417960 - protein, 7 aa, Mycobacterium tuberculosis
DAGEGAG

SEQ ID NO: 1417961 - protein, 8 aa, Mycobacterium tuberculosis
DAGETGWE

SEQ ID NO: 1417962 - protein, 6 aa, Mycobacterium tuberculosis
DAGIGD

SEQ ID NO: 1417963 - protein, 5 aa, Mycobacterium tuberculosis
DAGLV

SEQ ID NO: 1417964 - protein, 5 aa, Mycobacterium tuberculosis
DAGRC

SEQ ID NO: 1417965 - protein, 7 aa, Mycobacterium tuberculosis
DAIPEDY

SEQ ID NO: 1417966 - protein, 23 aa, Mycobacterium tuberculosis
DAIRDGASGRPAPSHFSTRTADL

SEQ ID NO: 1417967 - protein, 7 aa, Mycobacterium tuberculosis
DANPDAL

SEQ ID NO: 1417968 - protein, 22 aa, Mycobacterium tuberculosis
DAPTRATTSRVDSDLDAQSPAA

SEQ ID NO: 1417969 - protein, 7 aa, Mycobacterium tuberculosis
DAQRRAA

SEQ ID NO: 1417970 - protein, 8 aa, Mycobacterium tuberculosis
DATARQQL

SEQ ID NO: 1417971 - protein, 4 aa, Mycobacterium tuberculosis
DATV

SEQ ID NO: 1417972 - protein, 15 aa, Mycobacterium tuberculosis
DDADAQAHPDRLEAR

SEQ ID NO: 1417973 - protein, 7 aa, Mycobacterium tuberculosis
DDADTPF

SEQ ID NO: 1417974 - protein, 5 aa, Mycobacterium tuberculosis
DDFGD

SEQ ID NO: 1417975 - protein, 8 aa, Mycobacterium tuberculosis
DDLPATDV

SEQ ID NO: 1417976 - protein, 7 aa, Mycobacterium tuberculosis
DDPALTA

SEQ ID NO: 1417977 - protein, 5 aa, Mycobacterium tuberculosis
DDQAE

SEQ ID NO: 1417978 - protein, 9 aa, Mycobacterium tuberculosis
DDSVTPQQA

SEQ ID NO: 1417979 - protein, 8 aa, Mycobacterium tuberculosis
DDTPASYE

SEQ ID NO: 1417980 - protein, 7 aa, Mycobacterium tuberculosis
DDVDGGL

SEQ ID NO: 1417981 - protein, 18 aa, Mycobacterium tuberculosis
DDVEKLTDAELRAKTDEF

SEQ ID NO: 1417982 - protein, 13 aa, Mycobacterium tuberculosis
DDVGGTWRDNTYP

SEQ ID NO: 1417983 - protein, 6 aa, Mycobacterium tuberculosis
DDVPMA

SEQ ID NO: 1417984 - protein, 5 aa, Mycobacterium tuberculosis
DEADR

SEQ ID NO: 1417985 - protein, 4 aa, Mycobacterium tuberculosis
DEAF

SEQ ID NO: 1417986 - protein, 6 aa, Mycobacterium tuberculosis
DEARQP

SEQ ID NO: 1417987 - protein, 23 aa, Mycobacterium tuberculosis
DEELTGPPQKPAYAAKPATPEEV

SEQ ID NO: 1417988 - protein, 4 aa, Mycobacterium tuberculosis
DEFR

SEQ ID NO: 1417989 - protein, 11 aa, Mycobacterium tuberculosis
DEGYSPRFAGS

SEQ ID NO: 1417990 - protein, 6 aa, Mycobacterium tuberculosis
DELPPG

SEQ ID NO: 1417991 - protein, 20 aa, Mycobacterium tuberculosis
DEPAPGRGNPDLSAPDAMNG

SEQ ID NO: 1417992 - protein, 9 aa, Mycobacterium tuberculosis
DEPTPEQPA

SEQ ID NO: 1417993 - protein, 4 aa, Mycobacterium tuberculosis
DEQL

SEQ ID NO: 1417994 - protein, 5 aa, Mycobacterium tuberculosis
DESFA

SEQ ID NO: 1417995 - protein, 47 aa, Mycobacterium tuberculosis
DESLAGAARPQANANYGATSDPPLTHQPKPGSPTQVGPRSPSPPGLR

SEQ ID NO: 1417996 - protein, 8 aa, Mycobacterium tuberculosis
DESQTGAV

SEQ ID NO: 1417997 - protein, 4 aa, Mycobacterium tuberculosis
DETA

SEQ ID NO: 1417998 - protein, 5 aa, Mycobacterium tuberculosis
DETRA

SEQ ID NO: 1417999 - protein, 9 aa, Mycobacterium tuberculosis
DGAGDAGFE

SEQ ID NO: 1418000 - protein, 9 aa, Mycobacterium tuberculosis
DGAGPGSEV

SEQ ID NO: 1418001 - protein, 8 aa, Mycobacterium tuberculosis
DGDDEETL

SEQ ID NO: 1418002 - protein, 5 aa, Mycobacterium tuberculosis
DGDED

SEQ ID NO: 1418003 - protein, 6 aa, Mycobacterium tuberculosis
DGDHSY

SEQ ID NO: 1418004 - protein, 4 aa, Mycobacterium tuberculosis
DGEI

SEQ ID NO: 1418005 - protein, 9 aa, Mycobacterium tuberculosis
DGGHDPRRF

SEQ ID NO: 1418006 - protein, 8 aa, Mycobacterium tuberculosis
DGGLTRPA

SEQ ID NO: 1418007 - protein, 6 aa, Mycobacterium tuberculosis
DGGYGF

SEQ ID NO: 1418008 - protein, 8 aa, Mycobacterium tuberculosis
DGIGPEVT

SEQ ID NO: 1418009 - protein, 4 aa, Mycobacterium tuberculosis
DGKP

SEQ ID NO: 1418010 - protein, 6 aa, Mycobacterium tuberculosis
DGQTVH

SEQ ID NO: 1418011 - protein, 6 aa, Mycobacterium tuberculosis
DGRASV

SEQ ID NO: 1418012 - protein, 9 aa, Mycobacterium tuberculosis
DGSAQSNAA

SEQ ID NO: 1418013 - protein, 9 aa, Mycobacterium tuberculosis
DGSGQDDFG

SEQ ID NO: 1418014 - protein, 5 aa, Mycobacterium tuberculosis
DGSLG

SEQ ID NO: 1418015 - protein, 7 aa, Mycobacterium tuberculosis
DGSPAQV

SEQ ID NO: 1418016 - protein, 4 aa, Mycobacterium tuberculosis
DGTK

SEQ ID NO: 1418017 - protein, 5 aa, Mycobacterium tuberculosis
DGVPR

SEQ ID NO: 1418018 - protein, 5 aa, Mycobacterium tuberculosis
DGWQA

SEQ ID NO: 1418019 - protein, 12 aa, Mycobacterium tuberculosis
DGYGQNVKSGRY

SEQ ID NO: 1418020 - protein, 6 aa, Mycobacterium tuberculosis
DHEATD

SEQ ID NO: 1418021 - protein, 13 aa, Mycobacterium tuberculosis
DHEGQRREVTTAD

SEQ ID NO: 1418022 - protein, 15 aa, Mycobacterium tuberculosis
DHGDPLPPHTEGAQH

SEQ ID NO: 1418023 - protein, 12 aa, Mycobacterium tuberculosis
DIDPGKEASPRF

SEQ ID NO: 1418024 - protein, 6 aa, Mycobacterium tuberculosis
DIGDGP

SEQ ID NO: 1418025 - protein, 7 aa, Mycobacterium tuberculosis
DIHTSGE

SEQ ID NO: 1418026 - protein, 11 aa, Mycobacterium tuberculosis
DKAHPGSAGYT

SEQ ID NO: 1418027 - protein, 7 aa, Mycobacterium tuberculosis
DKNPELE

SEQ ID NO: 1418028 - protein, 6 aa, Mycobacterium tuberculosis
DKRRRR

SEQ ID NO: 1418029 - protein, 6 aa, Mycobacterium tuberculosis
DKTDLR

SEQ ID NO: 1418030 - protein, 11 aa, Mycobacterium tuberculosis
DLAAAVDKDGT

SEQ ID NO: 1418031 - protein, 8 aa, Mycobacterium tuberculosis
DLADPRRG

SEQ ID NO: 1418032 - protein, 11 aa, Mycobacterium tuberculosis
DLDPGEARRAV

SEQ ID NO: 1418033 - protein, 21 aa, Mycobacterium tuberculosis
DLDPSNSGNYRANAAEFSRGA

SEQ ID NO: 1418034 - protein, 9 aa, Mycobacterium tuberculosis
DLESASPQL

SEQ ID NO: 1418035 - protein, 10 aa, Mycobacterium tuberculosis
DLPAGSLDGA

SEQ ID NO: 1418036 - protein, 7 aa, Mycobacterium tuberculosis
DLPAKAR

SEQ ID NO: 1418037 - protein, 10 aa, Mycobacterium tuberculosis
DLPEDASPAY

SEQ ID NO: 1418038 - protein, 9 aa, Mycobacterium tuberculosis
DLSDSDLDD

SEQ ID NO: 1418039 - protein, 17 aa, Mycobacterium tuberculosis
DLTGSRVSAAEGKRLAA

SEQ ID NO: 1418040 - protein, 13 aa, Mycobacterium tuberculosis
DNEVPGATDRDRA

SEQ ID NO: 1418041 - protein, 8 aa, Mycobacterium tuberculosis
DNLPAERA

SEQ ID NO: 1418042 - protein, 5 aa, Mycobacterium tuberculosis
DNNFP

SEQ ID NO: 1418043 - protein, 9 aa, Mycobacterium tuberculosis
DNPVPGGGG

SEQ ID NO: 1418044 - protein, 7 aa, Mycobacterium tuberculosis
DNRPQRF

SEQ ID NO: 1418045 - protein, 14 aa, Mycobacterium tuberculosis
DNSRRGRTDTPHTP

SEQ ID NO: 1418046 - protein, 8 aa, Mycobacterium tuberculosis
DPATGLAR

SEQ ID NO: 1418047 - protein, 5 aa, Mycobacterium tuberculosis
DPDFR

SEQ ID NO: 1418048 - protein, 4 aa, Mycobacterium tuberculosis
DPEA

SEQ ID NO: 1418049 - protein, 14 aa, Mycobacterium tuberculosis
DPEGQLGSASRARF

SEQ ID NO: 1418050 - protein, 11 aa, Mycobacterium tuberculosis
DPGEGTQAKRR

SEQ ID NO: 1418051 - protein, 11 aa, Mycobacterium tuberculosis
DPKSSDAVTLR

SEQ ID NO: 1418052 - protein, 7 aa, Mycobacterium tuberculosis
DPLRDDG

SEQ ID NO: 1418053 - protein, 8 aa, Mycobacterium tuberculosis
DPLTGSHR

SEQ ID NO: 1418054 - protein, 20 aa, Mycobacterium tuberculosis
DPNAPFGRDPQGQPYTQERY

SEQ ID NO: 1418055 - protein, 5 aa, Mycobacterium tuberculosis
DPPDR

SEQ ID NO: 1418056 - protein, 7 aa, Mycobacterium tuberculosis
DPREAPA

SEQ ID NO: 1418057 - protein, 14 aa, Mycobacterium tuberculosis
DPSAAAQLADTTDQ

SEQ ID NO: 1418058 - protein, 6 aa, Mycobacterium tuberculosis
DPSVPD

SEQ ID NO: 1418059 - protein, 5 aa, Mycobacterium tuberculosis
DPTDI

SEQ ID NO: 1418060 - protein, 5 aa, Mycobacterium tuberculosis
DPTIT

SEQ ID NO: 1418061 - protein, 12 aa, Mycobacterium tuberculosis
DPTNLDAARQLP

SEQ ID NO: 1418062 - protein, 5 aa, Mycobacterium tuberculosis
DPVDS

SEQ ID NO: 1418063 - protein, 6 aa, Mycobacterium tuberculosis
DPVGPR

SEQ ID NO: 1418064 - protein, 6 aa, Mycobacterium tuberculosis
DPVPDS

SEQ ID NO: 1418065 - protein, 7 aa, Mycobacterium tuberculosis
DQAQPAR

SEQ ID NO: 1418066 - protein, 10 aa, Mycobacterium tuberculosis
DQPPMPSRGN

SEQ ID NO: 1418067 - protein, 14 aa, Mycobacterium tuberculosis
DQPRNTALDDTDGL

SEQ ID NO: 1418068 - protein, 9 aa, Mycobacterium tuberculosis
DQTDPNAPL

SEQ ID NO: 1418069 - protein, 10 aa, Mycobacterium tuberculosis
DQTDQTELGG

SEQ ID NO: 1418070 - protein, 7 aa, Mycobacterium tuberculosis
DRAGVSK

SEQ ID NO: 1418071 - protein, 11 aa, Mycobacterium tuberculosis
DRCGGPGLAGD

SEQ ID NO: 1418072 - protein, 13 aa, Mycobacterium tuberculosis
DRDSSSPSDELEE

SEQ ID NO: 1418073 - protein, 6 aa, Mycobacterium tuberculosis
DRGGIT

SEQ ID NO: 1418074 - protein, 8 aa, Mycobacterium tuberculosis
DRKAQDAK

SEQ ID NO: 1418075 - protein, 12 aa, Mycobacterium tuberculosis
DRKTDRAADSLP

SEQ ID NO: 1418076 - protein, 8 aa, Mycobacterium tuberculosis
DRLDDAQK

SEQ ID NO: 1418077 - protein, 5 aa, Mycobacterium tuberculosis
DRMRT

SEQ ID NO: 1418078 - protein, 6 aa, Mycobacterium tuberculosis
DRRDDF

SEQ ID NO: 1418079 - protein, 14 aa, Mycobacterium tuberculosis
DRRGPGGDSRPSLD

SEQ ID NO: 1418080 - protein, 27 aa, Mycobacterium tuberculosis
DRRKRSSRALPSAARRGRPSVPTARAR

SEQ ID NO: 1418081 - protein, 13 aa, Mycobacterium tuberculosis
DRRNRARELAQEA

SEQ ID NO: 1418082 - protein, 9 aa, Mycobacterium tuberculosis
DRTSGRADT

SEQ ID NO: 1418083 - protein, 7 aa, Mycobacterium tuberculosis
DRVGADD

SEQ ID NO: 1418084 - protein, 16 aa, Mycobacterium tuberculosis
DSAARKSGQRRGGGAI

SEQ ID NO: 1418085 - protein, 8 aa, Mycobacterium tuberculosis
DSALTERQ

SEQ ID NO: 1418086 - protein, 9 aa, Mycobacterium tuberculosis
DSEADGTAL

SEQ ID NO: 1418087 - protein, 5 aa, Mycobacterium tuberculosis
DSEGC

SEQ ID NO: 1418088 - protein, 7 aa, Mycobacterium tuberculosis
DSKPSAW

SEQ ID NO: 1418089 - protein, 7 aa, Mycobacterium tuberculosis
DSPLPVD

SEQ ID NO: 1418090 - protein, 11 aa, Mycobacterium tuberculosis
DSTGADYASAL

SEQ ID NO: 1418091 - protein, 5 aa, Mycobacterium tuberculosis
DSVQV

SEQ ID NO: 1418092 - protein, 6 aa, Mycobacterium tuberculosis
DSYLTP

SEQ ID NO: 1418093 - protein, 7 aa, Mycobacterium tuberculosis
DTEGLAE

SEQ ID NO: 1418094 - protein, 10 aa, Mycobacterium tuberculosis
DTGNGPYGPL

SEQ ID NO: 1418095 - protein, 12 aa, Mycobacterium tuberculosis
DTIAGPASPAAN

SEQ ID NO: 1418096 - protein, 6 aa, Mycobacterium tuberculosis
DTLQSI

SEQ ID NO: 1418097 - protein, 9 aa, Mycobacterium tuberculosis
DTPHTRPVP

SEQ ID NO: 1418098 - protein, 14 aa, Mycobacterium tuberculosis
DTPLRAQAATAGID

SEQ ID NO: 1418099 - protein, 6 aa, Mycobacterium tuberculosis
DTQTQD

SEQ ID NO: 1418100 - protein, 5 aa, Mycobacterium tuberculosis
DTVTE

SEQ ID NO: 1418101 - protein, 4 aa, Mycobacterium tuberculosis
DVAG

SEQ ID NO: 1418102 - protein, 11 aa, Mycobacterium tuberculosis
DVAGQPSMHGT

SEQ ID NO: 1418103 - protein, 8 aa, Mycobacterium tuberculosis
DVATDETV

SEQ ID NO: 1418104 - protein, 8 aa, Mycobacterium tuberculosis
DVDGRTYA

SEQ ID NO: 1418105 - protein, 12 aa, Mycobacterium tuberculosis
DVDTDGLADTEH

SEQ ID NO: 1418106 - protein, 8 aa, Mycobacterium tuberculosis
DVNPPGDE

SEQ ID NO: 1418107 - protein, 6 aa, Mycobacterium tuberculosis
DVPDGG

SEQ ID NO: 1418108 - protein, 11 aa, Mycobacterium tuberculosis
EAADKLRSPIS

SEQ ID NO: 1418109 - protein, 18 aa, Mycobacterium tuberculosis
EAAEKAKIELSSSQSTSI

SEQ ID NO: 1418110 - protein, 10 aa, Mycobacterium tuberculosis
EAAGAATPKR

SEQ ID NO: 1418111 - protein, 9 aa, Mycobacterium tuberculosis
EAAKRGLAN

SEQ ID NO: 1418112 - protein, 9 aa, Mycobacterium tuberculosis
EAAPTAGLM

SEQ ID NO: 1418113 - protein, 7 aa, Mycobacterium tuberculosis
EAASDAH

SEQ ID NO: 1418114 - protein, 9 aa, Mycobacterium tuberculosis
EAATKRRRG

SEQ ID NO: 1418115 - protein, 5 aa, Mycobacterium tuberculosis
EADDT

SEQ ID NO: 1418116 - protein, 7 aa, Mycobacterium tuberculosis
EADRDGF

SEQ ID NO: 1418117 - protein, 6 aa, Mycobacterium tuberculosis
EADWPD

SEQ ID NO: 1418118 - protein, 22 aa, Mycobacterium tuberculosis
EAGLASTSRGDGGHGSSGGHAS

SEQ ID NO: 1418119 - protein, 8 aa, Mycobacterium tuberculosis
EAGSGEHA

SEQ ID NO: 1418120 - protein, 9 aa, Mycobacterium tuberculosis
EAGTNAAHR

SEQ ID NO: 1418121 - protein, 13 aa, Mycobacterium tuberculosis
EAKLSAKNEARRI

SEQ ID NO: 1418122 - protein, 7 aa, Mycobacterium tuberculosis
EAMRPGD

SEQ ID NO: 1418123 - protein, 9 aa, Mycobacterium tuberculosis
EAMTQKPPL

SEQ ID NO: 1418124 - protein, 18 aa, Mycobacterium tuberculosis
EANGDAREGFPAGTGWDQ

SEQ ID NO: 1418125 - protein, 7 aa, Mycobacterium tuberculosis
EARAEAA

SEQ ID NO: 1418126 - protein, 11 aa, Mycobacterium tuberculosis
EARATATTISQ

SEQ ID NO: 1418127 - protein, 7 aa, Mycobacterium tuberculosis
EARQHSE

SEQ ID NO: 1418128 - protein, 7 aa, Mycobacterium tuberculosis
EASPEVR

SEQ ID NO: 1418129 - protein, 15 aa, Mycobacterium tuberculosis
EASTLGRTDRNLGEV

SEQ ID NO: 1418130 - protein, 7 aa, Mycobacterium tuberculosis
EATGGVQ

SEQ ID NO: 1418131 - protein, 4 aa, Mycobacterium tuberculosis
EAVD

SEQ ID NO: 1418132 - protein, 10 aa, Mycobacterium tuberculosis
EAVDPQYGEP

SEQ ID NO: 1418133 - protein, 4 aa, Mycobacterium tuberculosis
EDAG

SEQ ID NO: 1418134 - protein, 10 aa, Mycobacterium tuberculosis
EDAPERTSAL

SEQ ID NO: 1418135 - protein, 5 aa, Mycobacterium tuberculosis
EDGRE

SEQ ID NO: 1418136 - protein, 5 aa, Mycobacterium tuberculosis
EDKAN

SEQ ID NO: 1418137 - protein, 11 aa, Mycobacterium tuberculosis
EDLEQRDVEEL

SEQ ID NO: 1418138 - protein, 7 aa, Mycobacterium tuberculosis
EDTGYSY

SEQ ID NO: 1418139 - protein, 10 aa, Mycobacterium tuberculosis
EEFGGSTTFT

SEQ ID NO: 1418140 - protein, 5 aa, Mycobacterium tuberculosis
EEGEL

SEQ ID NO: 1418141 - protein, 6 aa, Mycobacterium tuberculosis
EERAGA

SEQ ID NO: 1418142 - protein, 4 aa, Mycobacterium tuberculosis
EFGA

SEQ ID NO: 1418143 - protein, 7 aa, Mycobacterium tuberculosis
EFPPPNT

SEQ ID NO: 1418144 - protein, 5 aa, Mycobacterium tuberculosis
EFTGE

SEQ ID NO: 1418145 - protein, 11 aa, Mycobacterium tuberculosis
EGASPTPASDV

SEQ ID NO: 1418146 - protein, 12 aa, Mycobacterium tuberculosis
EGDHHRTDRRTF

SEQ ID NO: 1418147 - protein, 7 aa, Mycobacterium tuberculosis
EGEGRSV

SEQ ID NO: 1418148 - protein, 9 aa, Mycobacterium tuberculosis
EGGALEDPA

SEQ ID NO: 1418149 - protein, 9 aa, Mycobacterium tuberculosis
EGGKGRGTV

SEQ ID NO: 1418150 - protein, 5 aa, Mycobacterium tuberculosis
EGGRI

SEQ ID NO: 1418151 - protein, 10 aa, Mycobacterium tuberculosis
EGKAFSSGGS

SEQ ID NO: 1418152 - protein, 6 aa, Mycobacterium tuberculosis
EGLTIT

SEQ ID NO: 1418153 - protein, 9 aa, Mycobacterium tuberculosis
EGRDPRAAA

SEQ ID NO: 1418154 - protein, 10 aa, Mycobacterium tuberculosis
EGRDTSAMPR

SEQ ID NO: 1418155 - protein, 8 aa, Mycobacterium tuberculosis
EGRNATHQ

SEQ ID NO: 1418156 - protein, 8 aa, Mycobacterium tuberculosis
EGTPAGGI

SEQ ID NO: 1418157 - protein, 15 aa, Mycobacterium tuberculosis
EGTPYKEATAAELAD

SEQ ID NO: 1418158 - protein, 5 aa, Mycobacterium tuberculosis
EGTTA

SEQ ID NO: 1418159 - protein, 12 aa, Mycobacterium tuberculosis
EGVERKPTDAAV

SEQ ID NO: 1418160 - protein, 16 aa, Mycobacterium tuberculosis
EGVPPQISATPGMPER

SEQ ID NO: 1418161 - protein, 4 aa, Mycobacterium tuberculosis
EGYG

SEQ ID NO: 1418162 - protein, 11 aa, Mycobacterium tuberculosis
EHAKARGAKPL

SEQ ID NO: 1418163 - protein, 5 aa, Mycobacterium tuberculosis
EHPAH

SEQ ID NO: 1418164 - protein, 14 aa, Mycobacterium tuberculosis
EHRPDGTSVVLAAT

SEQ ID NO: 1418165 - protein, 5 aa, Mycobacterium tuberculosis
EHRRT

SEQ ID NO: 1418166 - protein, 12 aa, Mycobacterium tuberculosis
EIAGARAAAAAG

SEQ ID NO: 1418167 - protein, 5 aa, Mycobacterium tuberculosis
EIDGP

SEQ ID NO: 1418168 - protein, 13 aa, Mycobacterium tuberculosis
EIPEADAVEQGRA

SEQ ID NO: 1418169 - protein, 22 aa, Mycobacterium tuberculosis
EIPPTSSIASERSHRGLARGQS

SEQ ID NO: 1418170 - protein, 5 aa, Mycobacterium tuberculosis
EIRPG

SEQ ID NO: 1418171 - protein, 5 aa, Mycobacterium tuberculosis
EKFSP

SEQ ID NO: 1418172 - protein, 6 aa, Mycobacterium tuberculosis
EKHKNS

SEQ ID NO: 1418173 - protein, 12 aa, Mycobacterium tuberculosis
EKPVTPKSNYAV

SEQ ID NO: 1418174 - protein, 6 aa, Mycobacterium tuberculosis
EKSDSL

SEQ ID NO: 1418175 - protein, 9 aa, Mycobacterium tuberculosis
EKTEPRDGE

SEQ ID NO: 1418176 - protein, 4 aa, Mycobacterium tuberculosis
ELAG

SEQ ID NO: 1418177 - protein, 4 aa, Mycobacterium tuberculosis
ELDE

SEQ ID NO: 1418178 - protein, 6 aa, Mycobacterium tuberculosis
ELENEP

SEQ ID NO: 1418179 - protein, 6 aa, Mycobacterium tuberculosis
ELGGKN

SEQ ID NO: 1418180 - protein, 10 aa, Mycobacterium tuberculosis
ELGKARDDAH

SEQ ID NO: 1418181 - protein, 14 aa, Mycobacterium tuberculosis
ELQSRAGHALTGGG

SEQ ID NO: 1418182 - protein, 12 aa, Mycobacterium tuberculosis
ELRAENRRRISP

SEQ ID NO: 1418183 - protein, 8 aa, Mycobacterium tuberculosis
ELRDAEND

SEQ ID NO: 1418184 - protein, 10 aa, Mycobacterium tuberculosis
ELRKANAQHT

SEQ ID NO: 1418185 - protein, 7 aa, Mycobacterium tuberculosis
EMNTRGV

SEQ ID NO: 1418186 - protein, 12 aa, Mycobacterium tuberculosis
ENFDPTRRSGRV

SEQ ID NO: 1418187 - protein, 5 aa, Mycobacterium tuberculosis
ENQYA

SEQ ID NO: 1418188 - protein, 9 aa, Mycobacterium tuberculosis
ENTEGIERR

SEQ ID NO: 1418189 - protein, 4 aa, Mycobacterium tuberculosis
EPEG

SEQ ID NO: 1418190 - protein, 5 aa, Mycobacterium tuberculosis
EPFAS

SEQ ID NO: 1418191 - protein, 8 aa, Mycobacterium tuberculosis
EPGGAADA

SEQ ID NO: 1418192 - protein, 7 aa, Mycobacterium tuberculosis
EPKTGAV

SEQ ID NO: 1418193 - protein, 4 aa, Mycobacterium tuberculosis
EPLS

SEQ ID NO: 1418194 - protein, 7 aa, Mycobacterium tuberculosis
EPTLPTA

SEQ ID NO: 1418195 - protein, 7 aa, Mycobacterium tuberculosis
EPTNDVD

SEQ ID NO: 1418196 - protein, 16 aa, Mycobacterium tuberculosis
EPVQTTNASGLAAQSA

SEQ ID NO: 1418197 - protein, 6 aa, Mycobacterium tuberculosis
EQRSSR

SEQ ID NO: 1418198 - protein, 13 aa, Mycobacterium tuberculosis
EQTYAKRSTAQLK

SEQ ID NO: 1418199 - protein, 9 aa, Mycobacterium tuberculosis
ERAGTTKSA

SEQ ID NO: 1418200 - protein, 14 aa, Mycobacterium tuberculosis
ERGGYDAQGHGNSV

SEQ ID NO: 1418201 - protein, 6 aa, Mycobacterium tuberculosis
ERGHGD

SEQ ID NO: 1418202 - protein, 8 aa, Mycobacterium tuberculosis
ERGQGKTR

SEQ ID NO: 1418203 - protein, 6 aa, Mycobacterium tuberculosis
ERKAFG

SEQ ID NO: 1418204 - protein, 9 aa, Mycobacterium tuberculosis
ERLEEGIER

SEQ ID NO: 1418205 - protein, 7 aa, Mycobacterium tuberculosis
ERLGAPR

SEQ ID NO: 1418206 - protein, 6 aa, Mycobacterium tuberculosis
ERQADG

SEQ ID NO: 1418207 - protein, 10 aa, Mycobacterium tuberculosis
ERRRELTGGR

SEQ ID NO: 1418208 - protein, 5 aa, Mycobacterium tuberculosis
ERSPI

SEQ ID NO: 1418209 - protein, 5 aa, Mycobacterium tuberculosis
ERTRD

SEQ ID NO: 1418210 - protein, 6 aa, Mycobacterium tuberculosis
ESAPAA

SEQ ID NO: 1418211 - protein, 10 aa, Mycobacterium tuberculosis
ESATDADDEV

SEQ ID NO: 1418212 - protein, 6 aa, Mycobacterium tuberculosis
ESAVSD

SEQ ID NO: 1418213 - protein, 14 aa, Mycobacterium tuberculosis
ESGGSELADELDQN

SEQ ID NO: 1418214 - protein, 4 aa, Mycobacterium tuberculosis
ESGP

SEQ ID NO: 1418215 - protein, 6 aa, Mycobacterium tuberculosis
ESGPSL

SEQ ID NO: 1418216 - protein, 9 aa, Mycobacterium tuberculosis
ESGTADMEL

SEQ ID NO: 1418217 - protein, 20 aa, Mycobacterium tuberculosis
ESIESTAAAVASGSPQLPST

SEQ ID NO: 1418218 - protein, 9 aa, Mycobacterium tuberculosis
ESKTGERAR

SEQ ID NO: 1418219 - protein, 4 aa, Mycobacterium tuberculosis
ESNT

SEQ ID NO: 1418220 - protein, 6 aa, Mycobacterium tuberculosis
ESPDGK

SEQ ID NO: 1418221 - protein, 17 aa, Mycobacterium tuberculosis
ESRPPPAAARQDRWRRT

SEQ ID NO: 1418222 - protein, 7 aa, Mycobacterium tuberculosis
ESRSGIA

SEQ ID NO: 1418223 - protein, 15 aa, Mycobacterium tuberculosis
ESYTAEDGVISIRPK

SEQ ID NO: 1418224 - protein, 4 aa, Mycobacterium tuberculosis
ETAT

SEQ ID NO: 1418225 - protein, 5 aa, Mycobacterium tuberculosis
ETEPT

SEQ ID NO: 1418226 - protein, 5 aa, Mycobacterium tuberculosis
ETGAD

SEQ ID NO: 1418227 - protein, 7 aa, Mycobacterium tuberculosis
ETGGRWQ

SEQ ID NO: 1418228 - protein, 11 aa, Mycobacterium tuberculosis
ETGSVPSPSQI

SEQ ID NO: 1418229 - protein, 4 aa, Mycobacterium tuberculosis
ETNP

SEQ ID NO: 1418230 - protein, 13 aa, Mycobacterium tuberculosis
ETNRDGETTRHAT

SEQ ID NO: 1418231 - protein, 4 aa, Mycobacterium tuberculosis
EVDQ

SEQ ID NO: 1418232 - protein, 8 aa, Mycobacterium tuberculosis
EVEGESAL

SEQ ID NO: 1418233 - protein, 5 aa, Mycobacterium tuberculosis
EVPIN

SEQ ID NO: 1418234 - protein, 8 aa, Mycobacterium tuberculosis
EVSDPDAH

SEQ ID NO: 1418235 - protein, 8 aa, Mycobacterium tuberculosis
EYEPGQPG

SEQ ID NO: 1418236 - protein, 13 aa, Mycobacterium tuberculosis
FDASADGYVRGEG

SEQ ID NO: 1418237 - protein, 66 aa, Mycobacterium tuberculosis
FDERGQEVRDPADYEHSNEPDERRADDREGADEDAGLGKSESPPQAPTTVTLPNGETVTAASPQLA

SEQ ID NO: 1418238 - protein, 8 aa, Mycobacterium tuberculosis
FDPQAKGL

SEQ ID NO: 1418239 - protein, 10 aa, Mycobacterium tuberculosis
FEGVDENGTP

SEQ ID NO: 1418240 - protein, 26 aa, Mycobacterium tuberculosis
FEHQAEKAAAAGRTKEADEAKANAEQ

SEQ ID NO: 1418241 - protein, 8 aa, Mycobacterium tuberculosis
FEPSGYPS

SEQ ID NO: 1418242 - protein, 14 aa, Mycobacterium tuberculosis
FESTTNAEVDDHGY

SEQ ID NO: 1418243 - protein, 4 aa, Mycobacterium tuberculosis
FETA

SEQ ID NO: 1418244 - protein, 15 aa, Mycobacterium tuberculosis
FGEPGGREPKVSGQP

SEQ ID NO: 1418245 - protein, 5 aa, Mycobacterium tuberculosis
FGEPL

SEQ ID NO: 1418246 - protein, 9 aa, Mycobacterium tuberculosis
FGNRGDANI

SEQ ID NO: 1418247 - protein, 7 aa, Mycobacterium tuberculosis
FGTPTFT

SEQ ID NO: 1418248 - protein, 4 aa, Mycobacterium tuberculosis
FGVE

SEQ ID NO: 1418249 - protein, 9 aa, Mycobacterium tuberculosis
FNPECASAG

SEQ ID NO: 1418250 - protein, 9 aa, Mycobacterium tuberculosis
FPPDAKSRI

SEQ ID NO: 1418251 - protein, 5 aa, Mycobacterium tuberculosis
FPRDG

SEQ ID NO: 1418252 - protein, 7 aa, Mycobacterium tuberculosis
FPRPSTQ

SEQ ID NO: 1418253 - protein, 6 aa, Mycobacterium tuberculosis
FPSGRR

SEQ ID NO: 1418254 - protein, 16 aa, Mycobacterium tuberculosis
FQDAAAPAEEVDPAAA

SEQ ID NO: 1418255 - protein, 4 aa, Mycobacterium tuberculosis
FQRP

SEQ ID NO: 1418256 - protein, 9 aa, Mycobacterium tuberculosis
FRSPAANKK

SEQ ID NO: 1418257 - protein, 12 aa, Mycobacterium tuberculosis
FSAASDEALGDI

SEQ ID NO: 1418258 - protein, 11 aa, Mycobacterium tuberculosis
FSADSRGQFPG

SEQ ID NO: 1418259 - protein, 9 aa, Mycobacterium tuberculosis
FSRGAKSYH

SEQ ID NO: 1418260 - protein, 12 aa, Mycobacterium tuberculosis
FTAAAAAKAPSL

SEQ ID NO: 1418261 - protein, 7 aa, Mycobacterium tuberculosis
FTAAEDA

SEQ ID NO: 1418262 - protein, 6 aa, Mycobacterium tuberculosis
FTPSGA

SEQ ID NO: 1418263 - protein, 9 aa, Mycobacterium tuberculosis
GAAAAARRR

SEQ ID NO: 1418264 - protein, 7 aa, Mycobacterium tuberculosis
GAAEGAI

SEQ ID NO: 1418265 - protein, 8 aa, Mycobacterium tuberculosis
GADATAAA

SEQ ID NO: 1418266 - protein, 8 aa, Mycobacterium tuberculosis
GADHRRRR

SEQ ID NO: 1418267 - protein, 9 aa, Mycobacterium tuberculosis
GAEPVEPAD

SEQ ID NO: 1418268 - protein, 7 aa, Mycobacterium tuberculosis
GAERGAQ

SEQ ID NO: 1418269 - protein, 6 aa, Mycobacterium tuberculosis
GAGAGI

SEQ ID NO: 1418270 - protein, 10 aa, Mycobacterium tuberculosis
GAGIQSVGAG

SEQ ID NO: 1418271 - protein, 10 aa, Mycobacterium tuberculosis
GAGPVAASAT

SEQ ID NO: 1418272 - protein, 7 aa, Mycobacterium tuberculosis
GAGTAGA

SEQ ID NO: 1418273 - protein, 8 aa, Mycobacterium tuberculosis
GAGTDVRV

SEQ ID NO: 1418274 - protein, 6 aa, Mycobacterium tuberculosis
GAGTLE

SEQ ID NO: 1418275 - protein, 9 aa, Mycobacterium tuberculosis
GAHNDGPAV

SEQ ID NO: 1418276 - protein, 13 aa, Mycobacterium tuberculosis
GALGSGVANVGNT

SEQ ID NO: 1418277 - protein, 5 aa, Mycobacterium tuberculosis
GALHN

SEQ ID NO: 1418278 - protein, 4 aa, Mycobacterium tuberculosis
GALT

SEQ ID NO: 1418279 - protein, 9 aa, Mycobacterium tuberculosis
GAPADAGSF

SEQ ID NO: 1418280 - protein, 9 aa, Mycobacterium tuberculosis
GAPHREQRF

SEQ ID NO: 1418281 - protein, 11 aa, Mycobacterium tuberculosis
GAPTPGRSRAA

SEQ ID NO: 1418282 - protein, 7 aa, Mycobacterium tuberculosis
GAREDLP

SEQ ID NO: 1418283 - protein, 8 aa, Mycobacterium tuberculosis
GASAAAEA

SEQ ID NO: 1418284 - protein, 8 aa, Mycobacterium tuberculosis
GASAAVQG

SEQ ID NO: 1418285 - protein, 19 aa, Mycobacterium tuberculosis
GASEPDAKAPEEPPAEAPE

SEQ ID NO: 1418286 - protein, 10 aa, Mycobacterium tuberculosis
GASPPPQNEL

SEQ ID NO: 1418287 - protein, 14 aa, Mycobacterium tuberculosis
GASSGIGEATARTL

SEQ ID NO: 1418288 - protein, 16 aa, Mycobacterium tuberculosis
GASTAEAQDRAGTDVA

SEQ ID NO: 1418289 - protein, 18 aa, Mycobacterium tuberculosis
GATDPACSANGRDSQAGP

SEQ ID NO: 1418290 - protein, 5 aa, Mycobacterium tuberculosis
GATEF

SEQ ID NO: 1418291 - protein, 16 aa, Mycobacterium tuberculosis
GATELDAESPQGRRLE

SEQ ID NO: 1418292 - protein, 6 aa, Mycobacterium tuberculosis
GATRRQ

SEQ ID NO: 1418293 - protein, 6 aa, Mycobacterium tuberculosis
GCGGAS

SEQ ID NO: 1418294 - protein, 7 aa, Mycobacterium tuberculosis
GCHGGPG

SEQ ID NO: 1418295 - protein, 5 aa, Mycobacterium tuberculosis
GDAHD

SEQ ID NO: 1418296 - protein, 17 aa, Mycobacterium tuberculosis
GDATMTAGNSTPLTDGA

SEQ ID NO: 1418297 - protein, 13 aa, Mycobacterium tuberculosis
GDDEVTMLKARYH

SEQ ID NO: 1418298 - protein, 7 aa, Mycobacterium tuberculosis
GDDHRRR

SEQ ID NO: 1418299 - protein, 5 aa, Mycobacterium tuberculosis
GDDPI

SEQ ID NO: 1418300 - protein, 13 aa, Mycobacterium tuberculosis
GDHDEKRLTSCGR

SEQ ID NO: 1418301 - protein, 4 aa, Mycobacterium tuberculosis
GDHT

SEQ ID NO: 1418302 - protein, 11 aa, Mycobacterium tuberculosis
GDIDAEKQSIE

SEQ ID NO: 1418303 - protein, 5 aa, Mycobacterium tuberculosis
GDIPK

SEQ ID NO: 1418304 - protein, 7 aa, Mycobacterium tuberculosis
GDKTYRR

SEQ ID NO: 1418305 - protein, 7 aa, Mycobacterium tuberculosis
GDLATAR

SEQ ID NO: 1418306 - protein, 11 aa, Mycobacterium tuberculosis
GDLRGRSPDVS

SEQ ID NO: 1418307 - protein, 7 aa, Mycobacterium tuberculosis
GDRNDAF

SEQ ID NO: 1418308 - protein, 9 aa, Mycobacterium tuberculosis
GDSGDGMQL

SEQ ID NO: 1418309 - protein, 4 aa, Mycobacterium tuberculosis
GDTA

SEQ ID NO: 1418310 - protein, 6 aa, Mycobacterium tuberculosis
GEAGVN

SEQ ID NO: 1418311 - protein, 7 aa, Mycobacterium tuberculosis
GEAKIEA

SEQ ID NO: 1418312 - protein, 4 aa, Mycobacterium tuberculosis
GEDA

SEQ ID NO: 1418313 - protein, 11 aa, Mycobacterium tuberculosis
GEEESGSPSLG

SEQ ID NO: 1418314 - protein, 4 aa, Mycobacterium tuberculosis
GEEI

SEQ ID NO: 1418315 - protein, 5 aa, Mycobacterium tuberculosis
GEKQM

SEQ ID NO: 1418316 - protein, 9 aa, Mycobacterium tuberculosis
GELAAPDDD

SEQ ID NO: 1418317 - protein, 6 aa, Mycobacterium tuberculosis
GEPADS

SEQ ID NO: 1418318 - protein, 6 aa, Mycobacterium tuberculosis
GEPCRD

SEQ ID NO: 1418319 - protein, 4 aa, Mycobacterium tuberculosis
GERI

SEQ ID NO: 1418320 - protein, 5 aa, Mycobacterium tuberculosis
GESVG

SEQ ID NO: 1418321 - protein, 9 aa, Mycobacterium tuberculosis
GFDSAAPTA

SEQ ID NO: 1418322 - protein, 5 aa, Mycobacterium tuberculosis
GFDSI

SEQ ID NO: 1418323 - protein, 4 aa, Mycobacterium tuberculosis
GFGG

SEQ ID NO: 1418324 - protein, 7 aa, Mycobacterium tuberculosis
GFPDSTL

SEQ ID NO: 1418325 - protein, 4 aa, Mycobacterium tuberculosis
GFVS

SEQ ID NO: 1418326 - protein, 5 aa, Mycobacterium tuberculosis
GGAGM

SEQ ID NO: 1418327 - protein, 5 aa, Mycobacterium tuberculosis
GGALS

SEQ ID NO: 1418328 - protein, 4 aa, Mycobacterium tuberculosis
GGAQ

SEQ ID NO: 1418329 - protein, 9 aa, Mycobacterium tuberculosis
GGAQAAFDK

SEQ ID NO: 1418330 - protein, 9 aa, Mycobacterium tuberculosis
GGASTVASQ

SEQ ID NO: 1418331 - protein, 7 aa, Mycobacterium tuberculosis
GGATQTV

SEQ ID NO: 1418332 - protein, 35 aa, Mycobacterium tuberculosis; identical to SEQ ID NO: 175600

SEQ ID NO: 1418333 - protein, 9 aa, Mycobacterium tuberculosis
GGEHRRSAA

SEQ ID NO: 1418334 - protein, 8 aa, Mycobacterium tuberculosis
GGESTAAL

SEQ ID NO: 1418335 - protein, 6 aa, Mycobacterium tuberculosis
GGFATT

SEQ ID NO: 1418336 - protein, 8 aa, Mycobacterium tuberculosis
GGGAATDV

SEQ ID NO: 1418337 - protein, 4 aa, Mycobacterium tuberculosis
GGGI

SEQ ID NO: 1418338 - protein, 9 aa, Mycobacterium tuberculosis
GGGTPGEAI

SEQ ID NO: 1418339 - protein, 9 aa, Mycobacterium tuberculosis
GGHQTPNGT

SEQ ID NO: 1418340 - protein, 9 aa, Mycobacterium tuberculosis
GGIRDDESL

SEQ ID NO: 1418341 - protein, 9 aa, Mycobacterium tuberculosis
GGKFDSDAY

SEQ ID NO: 1418342 - protein, 4 aa, Mycobacterium tuberculosis
GGLA

SEQ ID NO: 1418343 - protein, 5 aa, Mycobacterium tuberculosis
GGLAD

SEQ ID NO: 1418344 - protein, 17 aa, Mycobacterium tuberculosis
GGLGGAGGAGGVDGAIG

SEQ ID NO: 1418345 - protein, 5 aa, Mycobacterium tuberculosis
GGLTP

SEQ ID NO: 1418346 - protein, 75 aa, Mycobacterium tuberculosis
GGPPVESAPATAHQPQWATTPAAPAAAPHSTPGGVHSTESGPHGRSLSAHGSEPTHDGASHGSGHGSGSEPPGLH

SEQ ID NO: 1418347 - protein, 6 aa, Mycobacterium tuberculosis
GGPRAA

SEQ ID NO: 1418348 - protein, 8 aa, Mycobacterium tuberculosis
GGRPEGLD

SEQ ID NO: 1418349 - protein, 8 aa, Mycobacterium tuberculosis
GGRSELTT

SEQ ID NO: 1418350 - protein, 8 aa, Mycobacterium tuberculosis
GGRTADTP

SEQ ID NO: 1418351 - protein, 5 aa, Mycobacterium tuberculosis
GGSAD

SEQ ID NO: 1418352 - protein, 4 aa, Mycobacterium tuberculosis
GGSE

SEQ ID NO: 1418353 - protein, 5 aa, Mycobacterium tuberculosis
GGSLP

SEQ ID NO: 1418354 - protein, 9 aa, Mycobacterium tuberculosis
GGSSAGKTS

SEQ ID NO: 1418355 - protein, 10 aa, Mycobacterium tuberculosis
GGVGKTTITA

SEQ ID NO: 1418356 - protein, 4 aa, Mycobacterium tuberculosis
GGWG

SEQ ID NO: 1418357 - protein, 5 aa, Mycobacterium tuberculosis
GHDPD

SEQ ID NO: 1418358 - protein, 4 aa, Mycobacterium tuberculosis
GHDQ

SEQ ID NO: 1418359 - protein, 8 aa, Mycobacterium tuberculosis
GHEADSQT

SEQ ID NO: 1418360 - protein, 14 aa, Mycobacterium tuberculosis
GHEETEGTLGVAPR

SEQ ID NO: 1418361 - protein, 7 aa, Mycobacterium tuberculosis
GHGGGAS

SEQ ID NO: 1418362 - protein, 6 aa, Mycobacterium tuberculosis
GHGTGT

SEQ ID NO: 1418363 - protein, 5 aa, Mycobacterium tuberculosis
GHPSE

SEQ ID NO: 1418364 - protein, 9 aa, Mycobacterium tuberculosis
GHPSRGAWT

SEQ ID NO: 1418365 - protein, 4 aa, Mycobacterium tuberculosis
GHSY

SEQ ID NO: 1418366 - protein, 8 aa, Mycobacterium tuberculosis
GIASRRAA

SEQ ID NO: 1418367 - protein, 8 aa, Mycobacterium tuberculosis
GIDPGPTL

SEQ ID NO: 1418368 - protein, 11 aa, Mycobacterium tuberculosis
GIGGGSGFGGL

SEQ ID NO: 1418369 - protein, 7 aa, Mycobacterium tuberculosis
GIKDSLS

SEQ ID NO: 1418370 - protein, 6 aa, Mycobacterium tuberculosis
GISREG

SEQ ID NO: 1418371 - protein, 4 aa, Mycobacterium tuberculosis
GITN

SEQ ID NO: 1418372 - protein, 15 aa, Mycobacterium tuberculosis
GITPGSMPADSREIH

SEQ ID NO: 1418373 - protein, 6 aa, Mycobacterium tuberculosis
GIVGPQ

SEQ ID NO: 1418374 - protein, 14 aa, Mycobacterium tuberculosis
GKAVVSAGSRESME

SEQ ID NO: 1418375 - protein, 12 aa, Mycobacterium tuberculosis
GKDGGAQRRTVE

SEQ ID NO: 1418376 - protein, 9 aa, Mycobacterium tuberculosis
GKEGQNARL

SEQ ID NO: 1418377 - protein, 7 aa, Mycobacterium tuberculosis
GKENAAT

SEQ ID NO: 1418378 - protein, 6 aa, Mycobacterium tuberculosis
GKTVPG

SEQ ID NO: 1418379 - protein, 6 aa, Mycobacterium tuberculosis
GLASGL

SEQ ID NO: 1418380 - protein, 8 aa, Mycobacterium tuberculosis
GLASGNCY

SEQ ID NO: 1418381 - protein, 15 aa, Mycobacterium tuberculosis
GLDAPQSPVKPEEPI

SEQ ID NO: 1418382 - protein, 5 aa, Mycobacterium tuberculosis
GLDDP

SEQ ID NO: 1418383 - protein, 7 aa, Mycobacterium tuberculosis
GLDDSRA

SEQ ID NO: 1418384 - protein, 6 aa, Mycobacterium tuberculosis
GLDGEQ

SEQ ID NO: 1418385 - protein, 8 aa, Mycobacterium tuberculosis
GLDPKTTV

SEQ ID NO: 1418386 - protein, 6 aa, Mycobacterium tuberculosis
GLGGGL

SEQ ID NO: 1418387 - protein, 13 aa, Mycobacterium tuberculosis
GLNPPKPQAAGRY

SEQ ID NO: 1418388 - protein, 9 aa, Mycobacterium tuberculosis
GLNSGSGNI

SEQ ID NO: 1418389 - protein, 9 aa, Mycobacterium tuberculosis
GLPGEWPTG

SEQ ID NO: 1418390 - protein, 7 aa, Mycobacterium tuberculosis
GLPLPAG

SEQ ID NO: 1418391 - protein, 7 aa, Mycobacterium tuberculosis
GLPPIGS

SEQ ID NO: 1418392 - protein, 9 aa, Mycobacterium tuberculosis
GLRKPSADV

SEQ ID NO: 1418393 - protein, 6 aa, Mycobacterium tuberculosis
GLRPDQ

SEQ ID NO: 1418394 - protein, 6 aa, Mycobacterium tuberculosis
GLSTTD

SEQ ID NO: 1418395 - protein, 11 aa, Mycobacterium tuberculosis
GLTGATSGLSQ

SEQ ID NO: 1418396 - protein, 12 aa, Mycobacterium tuberculosis
GMPDPEPPHSDG

SEQ ID NO: 1418397 - protein, 37 aa, Mycobacterium tuberculosis; identical to SEQ ID NO: 176368

SEQ ID NO: 1418398 - protein, 7 aa, Mycobacterium tuberculosis
GNASAPM

SEQ ID NO: 1418399 - protein, 11 aa, Mycobacterium tuberculosis
GNEGTEGAERA

SEQ ID NO: 1418400 - protein, 6 aa, Mycobacterium tuberculosis
GNEQVG

SEQ ID NO: 1418401 - protein, 16 aa, Mycobacterium tuberculosis
GNGADGTAANPNGQAG

SEQ ID NO: 1418402 - protein, 18 aa, Mycobacterium tuberculosis
GNGANGVAGTGQNGGDGG

SEQ ID NO: 1418403 - protein, 23 aa, Mycobacterium tuberculosis
GNGGEGGDGGALGGNGGNGGNAQ

SEQ ID NO: 1418404 - protein, 22 aa, Mycobacterium tuberculosis
GNLESVGSALNEAAAAAAPATV

SEQ ID NO: 1418405 - protein, 15 aa, Mycobacterium tuberculosis
GNNNIGMGNSGNGVG

SEQ ID NO: 1418406 - protein, 10 aa, Mycobacterium tuberculosis
GNRAGPPSMA

SEQ ID NO: 1418407 - protein, 9 aa, Mycobacterium tuberculosis
GNRNFEGRI

SEQ ID NO: 1418408 - protein, 16 aa, Mycobacterium tuberculosis
GNSGVPGDVESSGLED

SEQ ID NO: 1418409 - protein, 36 aa, Mycobacterium tuberculosis
GNVNFGNGNTGDTNFGSGNLGSGNIGFGNKGSHNIG

SEQ ID NO: 1418410 - protein, 5 aa, Mycobacterium tuberculosis
GPAEI

SEQ ID NO: 1418411 - protein, 6 aa, Mycobacterium tuberculosis
GPAQRI

SEQ ID NO: 1418412 - protein, 6 aa, Mycobacterium tuberculosis
GPASDS

SEQ ID NO: 1418413 - protein, 12 aa, Mycobacterium tuberculosis
GPASESSIGSDG

SEQ ID NO: 1418414 - protein, 4 aa, Mycobacterium tuberculosis
GPDG

SEQ ID NO: 1418415 - protein, 6 aa, Mycobacterium tuberculosis
GPEIGG

SEQ ID NO: 1418416 - protein, 16 aa, Mycobacterium tuberculosis
GPEPHGAGLANSGFRR

SEQ ID NO: 1418417 - protein, 7 aa, Mycobacterium tuberculosis
GPGLDRA

SEQ ID NO: 1418418 - protein, 14 aa, Mycobacterium tuberculosis
GPGLPEPAEQVDGR

SEQ ID NO: 1418419 - protein, 12 aa, Mycobacterium tuberculosis
GPGTRMRSDTPK

SEQ ID NO: 1418420 - protein, 4 aa, Mycobacterium tuberculosis
GPLE

SEQ ID NO: 1418421 - protein, 14 aa, Mycobacterium tuberculosis
GPPLGPPGAKFPSG

SEQ ID NO: 1418422 - protein, 11 aa, Mycobacterium tuberculosis
GPRGPGNGGAR

SEQ ID NO: 1418423 - protein, 8 aa, Mycobacterium tuberculosis
GPRKVGDA

SEQ ID NO: 1418424 - protein, 9 aa, Mycobacterium tuberculosis
GPRPKEPVA

SEQ ID NO: 1418425 - protein, 12 aa, Mycobacterium tuberculosis
GPRTSGTAAERV

SEQ ID NO: 1418426 - protein, 8 aa, Mycobacterium tuberculosis
GPSDTWSR

SEQ ID NO: 1418427 - protein, 8 aa, Mycobacterium tuberculosis
GPSPGGLR

SEQ ID NO: 1418428 - protein, 5 aa, Mycobacterium tuberculosis
GPTTV

SEQ ID NO: 1418429 - protein, 14 aa, Mycobacterium tuberculosis
GPVRNPNLDSAPKK

SEQ ID NO: 1418430 - protein, 5 aa, Mycobacterium tuberculosis
GPWGQ

SEQ ID NO: 1418431 - protein, 13 aa, Mycobacterium tuberculosis
GQEATPEPPSALN

SEQ ID NO: 1418432 - protein, 10 aa, Mycobacterium tuberculosis
GQFDPTTMGT

SEQ ID NO: 1418433 - protein, 4 aa, Mycobacterium tuberculosis
GQGV

SEQ ID NO: 1418434 - protein, 6 aa, Mycobacterium tuberculosis
GQHGLD

SEQ ID NO: 1418435 - protein, 13 aa, Mycobacterium tuberculosis
GQNTPAIEANQAA

SEQ ID NO: 1418436 - protein, 6 aa, Mycobacterium tuberculosis
GQPASN

SEQ ID NO: 1418437 - protein, 9 aa, Mycobacterium tuberculosis
GQPRVRPGD

SEQ ID NO: 1418438 - protein, 18 aa, Mycobacterium tuberculosis
GQPWTPASRSALAGPPRV

SEQ ID NO: 1418439 - protein, 5 aa, Mycobacterium tuberculosis
GQQRT

SEQ ID NO: 1418440 - protein, 16 aa, Mycobacterium tuberculosis
GQSPTTIVAPPAAKTV

SEQ ID NO: 1418441 - protein, 8 aa, Mycobacterium tuberculosis
GQVDDEED

SEQ ID NO: 1418442 - protein, 9 aa, Mycobacterium tuberculosis
GRAFSGGYD

SEQ ID NO: 1418443 - protein, 9 aa, Mycobacterium tuberculosis
GRAPSRDTY

SEQ ID NO: 1418444 - protein, 11 aa, Mycobacterium tuberculosis
GRARAARAAQP

SEQ ID NO: 1418445 - protein, 6 aa, Mycobacterium tuberculosis
GRASAR

SEQ ID NO: 1418446 - protein, 9 aa, Mycobacterium tuberculosis
GRCDQGEHE

SEQ ID NO: 1418447 - protein, 8 aa, Mycobacterium tuberculosis
GREAGRTE

SEQ ID NO: 1418448 - protein, 10 aa, Mycobacterium tuberculosis
GRGRADDTDD

SEQ ID NO: 1418449 - protein, 6 aa, Mycobacterium tuberculosis
GRHGED

SEQ ID NO: 1418450 - protein, 7 aa, Mycobacterium tuberculosis
GRQEYAT

SEQ ID NO: 1418451 - protein, 8 aa, Mycobacterium tuberculosis
GRRGGSAM

SEQ ID NO: 1418452 - protein, 21 aa, Mycobacterium tuberculosis
GRRPTPGTAAYGAAKAGLENL

SEQ ID NO: 1418453 - protein, 9 aa, Mycobacterium tuberculosis
GRSTVEDAT

SEQ ID NO: 1418454 - protein, 10 aa, Mycobacterium tuberculosis
GRTRPDQEKP

SEQ ID NO: 1418455 - protein, 7 aa, Mycobacterium tuberculosis
GRWDPGK

SEQ ID NO: 1418456 - protein, 18 aa, Mycobacterium tuberculosis
GRWRDSGMAGTDQRSQRR

SEQ ID NO: 1418457 - protein, 8 aa, Mycobacterium tuberculosis
GSADQQAT

SEQ ID NO: 1418458 - protein, 11 aa, Mycobacterium tuberculosis
GSAEVSHVGDD

SEQ ID NO: 1418459 - protein, 11 aa, Mycobacterium tuberculosis
GSDSGGGAGIQ

SEQ ID NO: 1418460 - protein, 29 aa, Mycobacterium tuberculosis
GSGNIGSYNLGGGNTGDLNPGSGNTGTLN

SEQ ID NO: 1418461 - protein, 5 aa, Mycobacterium tuberculosis
GSGQI

SEQ ID NO: 1418462 - protein, 10 aa, Mycobacterium tuberculosis
GSGVANVGNT

SEQ ID NO: 1418463 - protein, 9 aa, Mycobacterium tuberculosis
GSHNAGFGN

SEQ ID NO: 1418464 - protein, 12 aa, Mycobacterium tuberculosis
GSIDGARSAAAT

SEQ ID NO: 1418465 - protein, 5 aa, Mycobacterium tuberculosis
GSIVN

SEQ ID NO: 1418466 - protein, 7 aa, Mycobacterium tuberculosis
GSKARDE

SEQ ID NO: 1418467 - protein, 6 aa, Mycobacterium tuberculosis
GSKIES

SEQ ID NO: 1418468 - protein, 19 aa, Mycobacterium tuberculosis
GSKTTGWLPPAGAFGYQGG

SEQ ID NO: 1418469 - protein, 10 aa, Mycobacterium tuberculosis
GSLSAAGDLS

SEQ ID NO: 1418470 - protein, 5 aa, Mycobacterium tuberculosis
GSNQI

SEQ ID NO: 1418471 - protein, 7 aa, Mycobacterium tuberculosis
GSPASTV

SEQ ID NO: 1418472 - protein, 4 aa, Mycobacterium tuberculosis
GSRA

SEQ ID NO: 1418473 - protein, 18 aa, Mycobacterium tuberculosis
GSRGCAPESAESEAHYPG

SEQ ID NO: 1418474 - protein, 10 aa, Mycobacterium tuberculosis
GSSGKTSTKD

SEQ ID NO: 1418475 - protein, 26 aa, Mycobacterium tuberculosis
GSSRGSSWSGPSSVGSCGSGSKCADA

SEQ ID NO: 1418476 - protein, 6 aa, Mycobacterium tuberculosis
GSVSVH

SEQ ID NO: 1418477 - protein, 5 aa, Mycobacterium tuberculosis
GSVTR

SEQ ID NO: 1418478 - protein, 11 aa, Mycobacterium tuberculosis
GTAGADTSVGA

SEQ ID NO: 1418479 - protein, 4 aa, Mycobacterium tuberculosis
GTAR

SEQ ID NO: 1418480 - protein, 9 aa, Mycobacterium tuberculosis
GTDAEGVAR

SEQ ID NO: 1418481 - protein, 9 aa, Mycobacterium tuberculosis
GTDHAGIAT

SEQ ID NO: 1418482 - protein, 7 aa, Mycobacterium tuberculosis
GTDKPDL

SEQ ID NO: 1418483 - protein, 9 aa, Mycobacterium tuberculosis
GTDNALPPL

SEQ ID NO: 1418484 - protein, 4 aa, Mycobacterium tuberculosis
GTDT

SEQ ID NO: 1418485 - protein, 9 aa, Mycobacterium tuberculosis
GTETAGHDR

SEQ ID NO: 1418486 - protein, 12 aa, Mycobacterium tuberculosis
GTFGSRQEEAQR

SEQ ID NO: 1418487 - protein, 11 aa, Mycobacterium tuberculosis
GTLDDDPWSPE

SEQ ID NO: 1418488 - protein, 5 aa, Mycobacterium tuberculosis
GTPED

SEQ ID NO: 1418489 - protein, 5 aa, Mycobacterium tuberculosis
GTPME

SEQ ID NO: 1418490 - protein, 11 aa, Mycobacterium tuberculosis
GTQIDDSRISQ

SEQ ID NO: 1418491 - protein, 4 aa, Mycobacterium tuberculosis
GTQV

SEQ ID NO: 1418492 - protein, 11 aa, Mycobacterium tuberculosis
GTRPARPSGVE

SEQ ID NO: 1418493 - protein, 12 aa, Mycobacterium tuberculosis
GTTGDVVAPGTT

SEQ ID NO: 1418494 - protein, 14 aa, Mycobacterium tuberculosis
GTTPVEVNRTPEEG

SEQ ID NO: 1418495 - protein, 8 aa, Mycobacterium tuberculosis
GTWDGPTA

SEQ ID NO: 1418496 - protein, 9 aa, Mycobacterium tuberculosis
GVADDRTGF

SEQ ID NO: 1418497 - protein, 9 aa, Mycobacterium tuberculosis
GVDATGRFA

SEQ ID NO: 1418498 - protein, 4 aa, Mycobacterium tuberculosis
GVED

SEQ ID NO: 1418499 - protein, 9 aa, Mycobacterium tuberculosis
GVGAAGSML

SEQ ID NO: 1418500 - protein, 8 aa, Mycobacterium tuberculosis
GVGPEKSA

SEQ ID NO: 1418501 - protein, 16 aa, Mycobacterium tuberculosis
GVKPAAASAGGDDDSW

SEQ ID NO: 1418502 - protein, 8 aa, Mycobacterium tuberculosis
GVPPGRRR

SEQ ID NO: 1418503 - protein, 6 aa, Mycobacterium tuberculosis
GVPVTS

SEQ ID NO: 1418504 - protein, 6 aa, Mycobacterium tuberculosis
GVQTPD

SEQ ID NO: 1418505 - protein, 6 aa, Mycobacterium tuberculosis
GVSSGI

SEQ ID NO: 1418506 - protein, 5 aa, Mycobacterium tuberculosis
GVTDE

SEQ ID NO: 1418507 - protein, 7 aa, Mycobacterium tuberculosis
GVTDTTF

SEQ ID NO: 1418508 - protein, 23 aa, Mycobacterium tuberculosis
GWSAPPGAGAKELAEAAGAGDPV

SEQ ID NO: 1418509 - protein, 9 aa, Mycobacterium tuberculosis
GYLPDTATA

SEQ ID NO: 1418510 - protein, 13 aa, Mycobacterium tuberculosis
GYRSDDPTDADRI

SEQ ID NO: 1418511 - protein, 8 aa, Mycobacterium tuberculosis
GYVEDSGM

SEQ ID NO: 1418512 - protein, 5 aa, Mycobacterium tuberculosis
HADPA

SEQ ID NO: 1418513 - protein, 6 aa, Mycobacterium tuberculosis
HAETEV

SEQ ID NO: 1418514 - protein, 8 aa, Mycobacterium tuberculosis
HAGGDGAA

SEQ ID NO: 1418515 - protein, 7 aa, Mycobacterium tuberculosis
HAGPAAV

SEQ ID NO: 1418516 - protein, 6 aa, Mycobacterium tuberculosis
HANSYP

SEQ ID NO: 1418517 - protein, 14 aa, Mycobacterium tuberculosis
HARGDLRADSDTGA

SEQ ID NO: 1418518 - protein, 12 aa, Mycobacterium tuberculosis
HDAHPAGADPGL

SEQ ID NO: 1418519 - protein, 8 aa, Mycobacterium tuberculosis
HDAPPATR

SEQ ID NO: 1418520 - protein, 4 aa, Mycobacterium tuberculosis
HDHD

SEQ ID NO: 1418521 - protein, 11 aa, Mycobacterium tuberculosis
HDNRSTSFAGG

SEQ ID NO: 1418522 - protein, 7 aa, Mycobacterium tuberculosis
HDSSHEL

SEQ ID NO: 1418523 - protein, 8 aa, Mycobacterium tuberculosis
HEIDDDTA

SEQ ID NO: 1418524 - protein, 14 aa, Mycobacterium tuberculosis
HEPPVTHTPPAPIE

SEQ ID NO: 1418525 - protein, 7 aa, Mycobacterium tuberculosis
HGAERAS

SEQ ID NO: 1418526 - protein, 13 aa, Mycobacterium tuberculosis
HGDTNATFPAGDV

SEQ ID NO: 1418527 - protein, 33 aa, Mycobacterium tuberculosis; identical to SEQ ID NO: 177995

SEQ ID NO: 1418528 - protein, 8 aa, Mycobacterium tuberculosis
HGGISGRY

SEQ ID NO: 1418529 - protein, 7 aa, Mycobacterium tuberculosis
HGGPEQL

SEQ ID NO: 1418530 - protein, 10 aa, Mycobacterium tuberculosis
HGLPSAAQQK

SEQ ID NO: 1418531 - protein, 13 aa, Mycobacterium tuberculosis
HGVQPSESVESDQ

SEQ ID NO: 1418532 - protein, 5 aa, Mycobacterium tuberculosis
HHDGV

SEQ ID NO: 1418533 - protein, 12 aa, Mycobacterium tuberculosis
HKAGGATTPIGT

SEQ ID NO: 1418534 - protein, 11 aa, Mycobacterium tuberculosis
HNLKEGERLDE

SEQ ID NO: 1418535 - protein, 5 aa, Mycobacterium tuberculosis
HNPVS

SEQ ID NO: 1418536 - protein, 10 aa, Mycobacterium tuberculosis
HPDDAAHSEW

SEQ ID NO: 1418537 - protein, 4 aa, Mycobacterium tuberculosis
HPEL

SEQ ID NO: 1418538 - protein, 14 aa, Mycobacterium tuberculosis
HPGASPESGPGDPV

SEQ ID NO: 1418539 - protein, 8 aa, Mycobacterium tuberculosis
HPPNPKAT

SEQ ID NO: 1418540 - protein, 4 aa, Mycobacterium tuberculosis
HPSA

SEQ ID NO: 1418541 - protein, 9 aa, Mycobacterium tuberculosis
HRDSGRRRL

SEQ ID NO: 1418542 - protein, 6 aa, Mycobacterium tuberculosis
HRPDIR

SEQ ID NO: 1418543 - protein, 6 aa, Mycobacterium tuberculosis
HRQSDL

SEQ ID NO: 1418544 - protein, 4 aa, Mycobacterium tuberculosis
HRSL

SEQ ID NO: 1418545 - protein, 12 aa, Mycobacterium tuberculosis
HSETAIDAAGAS

SEQ ID NO: 1418546 - protein, 14 aa, Mycobacterium tuberculosis
HSGTSLSAQISRAG

SEQ ID NO: 1418547 - protein, 10 aa, Mycobacterium tuberculosis
HSLTQVGSSG

SEQ ID NO: 1418548 - protein, 9 aa, Mycobacterium tuberculosis
HSPKHPPDL

SEQ ID NO: 1418549 - protein, 10 aa, Mycobacterium tuberculosis
HSRGSWRGRD

SEQ ID NO: 1418550 - protein, 5 aa, Mycobacterium tuberculosis
HTGPI

SEQ ID NO: 1418551 - protein, 9 aa, Mycobacterium tuberculosis
HTKKKESEI

SEQ ID NO: 1418552 - protein, 11 aa, Mycobacterium tuberculosis
HVGGGLPSYPH

SEQ ID NO: 1418553 - protein, 6 aa, Mycobacterium tuberculosis
IAAGTR

SEQ ID NO: 1418554 - protein, 8 aa, Mycobacterium tuberculosis
IAQPDTAD

SEQ ID NO: 1418555 - protein, 8 aa, Mycobacterium tuberculosis
IARGKEGI

SEQ ID NO: 1418556 - protein, 10 aa, Mycobacterium tuberculosis
IATGATAKAA

SEQ ID NO: 1418557 - protein, 12 aa, Mycobacterium tuberculosis
IATTRAAAGPGP

SEQ ID NO: 1418558 - protein, 7 aa, Mycobacterium tuberculosis
IDANPAA

SEQ ID NO: 1418559 - protein, 4 aa, Mycobacterium tuberculosis
IDEH

SEQ ID NO: 1418560 - protein, 9 aa, Mycobacterium tuberculosis
IDGDETDLR

SEQ ID NO: 1418561 - protein, 4 aa, Mycobacterium tuberculosis
IDNS

SEQ ID NO: 1418562 - protein, 10 aa, Mycobacterium tuberculosis
IDSAADATEL

SEQ ID NO: 1418563 - protein, 5 aa, Mycobacterium tuberculosis
IDSSG

SEQ ID NO: 1418564 - protein, 9 aa, Mycobacterium tuberculosis
IERDDEGLA

SEQ ID NO: 1418565 - protein, 10 aa, Mycobacterium tuberculosis
IERNPRSTPV

SEQ ID NO: 1418566 - protein, 6 aa, Mycobacterium tuberculosis
IETADD

SEQ ID NO: 1418567 - protein, 13 aa, Mycobacterium tuberculosis
IGDAARSVGRGRP

SEQ ID NO: 1418568 - protein, 10 aa, Mycobacterium tuberculosis
IGDARPEAGE

SEQ ID NO: 1418569 - protein, 5 aa, Mycobacterium tuberculosis
IGENT

SEQ ID NO: 1418570 - protein, 10 aa, Mycobacterium tuberculosis
IGGEPLPGEV

SEQ ID NO: 1418571 - protein, 5 aa, Mycobacterium tuberculosis
IGGGF

SEQ ID NO: 1418572 - protein, 13 aa, Mycobacterium tuberculosis
IGKDGQPTQGGYS

SEQ ID NO: 1418573 - protein, 4 aa, Mycobacterium tuberculosis
IGLP

SEQ ID NO: 1418574 - protein, 15 aa, Mycobacterium tuberculosis
IGNGGAGGAGGQGLP

SEQ ID NO: 1418575 - protein, 32 aa, Mycobacterium tuberculosis; identical to SEQ ID NO: 178594

SEQ ID NO: 1418576 - protein, 6 aa, Mycobacterium tuberculosis
IGNTTA

SEQ ID NO: 1418577 - protein, 6 aa, Mycobacterium tuberculosis
IGPGPH

SEQ ID NO: 1418578 - protein, 8 aa, Mycobacterium tuberculosis
IGPRAEQR

SEQ ID NO: 1418579 - protein, 11 aa, Mycobacterium tuberculosis
INATKGKKERL

SEQ ID NO: 1418580 - protein, 8 aa, Mycobacterium tuberculosis
INGATTLP

SEQ ID NO: 1418581 - protein, 4 aa, Mycobacterium tuberculosis
INTR

SEQ ID NO: 1418582 - protein, 13 aa, Mycobacterium tuberculosis
IPATERTETPTFG

SEQ ID NO: 1418583 - protein, 10 aa, Mycobacterium tuberculosis
IPGATVEDAG

SEQ ID NO: 1418584 - protein, 15 aa, Mycobacterium tuberculosis
IPGKTKVNPSGGPLA

SEQ ID NO: 1418585 - protein, 10 aa, Mycobacterium tuberculosis
IPKGAAGNTG

SEQ ID NO: 1418586 - protein, 6 aa, Mycobacterium tuberculosis
IPPGNL

SEQ ID NO: 1418587 - protein, 5 aa, Mycobacterium tuberculosis
IPPPV

SEQ ID NO: 1418588 - protein, 5 aa, Mycobacterium tuberculosis
IPPVP

SEQ ID NO: 1418589 - protein, 6 aa, Mycobacterium tuberculosis
IPRPTL

SEQ ID NO: 1418590 - protein, 5 aa, Mycobacterium tuberculosis
IPVQS

SEQ ID NO: 1418591 - protein, 9 aa, Mycobacterium tuberculosis
IRASGQKDL

SEQ ID NO: 1418592 - protein, 8 aa, Mycobacterium tuberculosis
IRGNGGTA

SEQ ID NO: 1418593 - protein, 7 aa, Mycobacterium tuberculosis
IRPPQRL

SEQ ID NO: 1418594 - protein, 6 aa, Mycobacterium tuberculosis
ISAGAA

SEQ ID NO: 1418595 - protein, 14 aa, Mycobacterium tuberculosis
ISPPSGATDVRDEV

SEQ ID NO: 1418596 - protein, 6 aa, Mycobacterium tuberculosis
ISTAEV

SEQ ID NO: 1418597 - protein, 7 aa, Mycobacterium tuberculosis
ITANGKP

SEQ ID NO: 1418598 - protein, 6 aa, Mycobacterium tuberculosis
ITANGP

SEQ ID NO: 1418599 - protein, 9 aa, Mycobacterium tuberculosis
ITDPDNPVN

SEQ ID NO: 1418600 - protein, 4 aa, Mycobacterium tuberculosis
ITGG

SEQ ID NO: 1418601 - protein, 16 aa, Mycobacterium tuberculosis
ITNTPLGYGGVDGDER

SEQ ID NO: 1418602 - protein, 4 aa, Mycobacterium tuberculosis
ITRR

SEQ ID NO: 1418603 - protein, 7 aa, Mycobacterium tuberculosis
KAAARGL

SEQ ID NO: 1418604 - protein, 7 aa, Mycobacterium tuberculosis
KAAGDDY

SEQ ID NO: 1418605 - protein, 13 aa, Mycobacterium tuberculosis
KAAKSSPDQDEIQ

SEQ ID NO: 1418606 - protein, 4 aa, Mycobacterium tuberculosis
KADR

SEQ ID NO: 1418607 - protein, 12 aa, Mycobacterium tuberculosis
KAGKNGTRKGRR

SEQ ID NO: 1418608 - protein, 10 aa, Mycobacterium tuberculosis
KAHGVGDPSG

SEQ ID NO: 1418609 - protein, 9 aa, Mycobacterium tuberculosis
KASQATAQR

SEQ ID NO: 1418610 - protein, 8 aa, Mycobacterium tuberculosis
KAVNDNDL

SEQ ID NO: 1418611 - protein, 17 aa, Mycobacterium tuberculosis
KDETTIVEGAGDTDAIA

SEQ ID NO: 1418612 - protein, 6 aa, Mycobacterium tuberculosis
KDKDMT

SEQ ID NO: 1418613 - protein, 13 aa, Mycobacterium tuberculosis
KDPVGHKGARLTT

SEQ ID NO: 1418614 - protein, 14 aa, Mycobacterium tuberculosis
KDTTTGDTLSDPNQ

SEQ ID NO: 1418615 - protein, 8 aa, Mycobacterium tuberculosis
KEIRNRAR

SEQ ID NO: 1418616 - protein, 5 aa, Mycobacterium tuberculosis
KEMTP

SEQ ID NO: 1418617 - protein, 8 aa, Mycobacterium tuberculosis
KERAAELG

SEQ ID NO: 1418618 - protein, 8 aa, Mycobacterium tuberculosis
KGDVGEDI

SEQ ID NO: 1418619 - protein, 11 aa, Mycobacterium tuberculosis
KGGAGKTTLTA

SEQ ID NO: 1418620 - protein, 15 aa, Mycobacterium tuberculosis
KGHETGQRGGGRVRP

SEQ ID NO: 1418621 - protein, 8 aa, Mycobacterium tuberculosis
KGNTVNPD

SEQ ID NO: 1418622 - protein, 8 aa, Mycobacterium tuberculosis
KGTSGIDL

SEQ ID NO: 1418623 - protein, 10 aa, Mycobacterium tuberculosis
KGTTYPKPPV

SEQ ID NO: 1418624 - protein, 5 aa, Mycobacterium tuberculosis
KGVDD

SEQ ID NO: 1418625 - protein, 10 aa, Mycobacterium tuberculosis
KGYSTPAHSR

SEQ ID NO: 1418626 - protein, 7 aa, Mycobacterium tuberculosis
KHRSTNF

SEQ ID NO: 1418627 - protein, 12 aa, Mycobacterium tuberculosis
KIAKDRGIGGPV

SEQ ID NO: 1418628 - protein, 4 aa, Mycobacterium tuberculosis
KKNT

SEQ ID NO: 1418629 - protein, 14 aa, Mycobacterium tuberculosis
KLAPTSKLAPVTPA

SEQ ID NO: 1418630 - protein, 6 aa, Mycobacterium tuberculosis
KLNRSS

SEQ ID NO: 1418631 - protein, 21 aa, Mycobacterium tuberculosis
KLPPGPIPGTGGQPLQPFKPS

SEQ ID NO: 1418632 - protein, 6 aa, Mycobacterium tuberculosis
KLRSEP

SEQ ID NO: 1418633 - protein, 9 aa, Mycobacterium tuberculosis
KLSGTAERP

SEQ ID NO: 1418634 - protein, 7 aa, Mycobacterium tuberculosis
KNAERVA

SEQ ID NO: 1418635 - protein, 7 aa, Mycobacterium tuberculosis
KNQAAHV

SEQ ID NO: 1418636 - protein, 9 aa, Mycobacterium tuberculosis
KNSKARGFY

SEQ ID NO: 1418637 - protein, 6 aa, Mycobacterium tuberculosis
KPAPVI

SEQ ID NO: 1418638 - protein, 8 aa, Mycobacterium tuberculosis
KPETTRAD

SEQ ID NO: 1418639 - protein, 5 aa, Mycobacterium tuberculosis
KPIDD

SEQ ID NO: 1418640 - protein, 11 aa, Mycobacterium tuberculosis
KPRAWGPQESG

SEQ ID NO: 1418641 - protein, 12 aa, Mycobacterium tuberculosis
KPRHWTPRRGVG

SEQ ID NO: 1418642 - protein, 15 aa, Mycobacterium tuberculosis
KQSGVGRELGPDAPL

SEQ ID NO: 1418643 - protein, 14 aa, Mycobacterium tuberculosis
KRAQDIGADGPDIL

SEQ ID NO: 1418644 - protein, 5 aa, Mycobacterium tuberculosis
KRDSE

SEQ ID NO: 1418645 - protein, 7 aa, Mycobacterium tuberculosis
KRGEEIN

SEQ ID NO: 1418646 - protein, 5 aa, Mycobacterium tuberculosis
KRGRD

SEQ ID NO: 1418647 - protein, 5 aa, Mycobacterium tuberculosis
KRGRV

SEQ ID NO: 1418648 - protein, 7 aa, Mycobacterium tuberculosis
KRHPDVQ

SEQ ID NO: 1418649 - protein, 18 aa, Mycobacterium tuberculosis
KRQASPGHAFSPDTPWQA

SEQ ID NO: 1418650 - protein, 8 aa, Mycobacterium tuberculosis
KSYARTGG

SEQ ID NO: 1418651 - protein, 6 aa, Mycobacterium tuberculosis
KTASAE

SEQ ID NO: 1418652 - protein, 4 aa, Mycobacterium tuberculosis
KTDA

SEQ ID NO: 1418653 - protein, 6 aa, Mycobacterium tuberculosis
KTGAAR

SEQ ID NO: 1418654 - protein, 4 aa, Mycobacterium tuberculosis
KTGS

SEQ ID NO: 1418655 - protein, 9 aa, Mycobacterium tuberculosis
KTSDDDMDG

SEQ ID NO: 1418656 - protein, 5 aa, Mycobacterium tuberculosis
KTVYR

SEQ ID NO: 1418657 - protein, 11 aa, Mycobacterium tuberculosis
KVAEPGQSLAD

SEQ ID NO: 1418658 - protein, 5 aa, Mycobacterium tuberculosis
KVEPV

SEQ ID NO: 1418659 - protein, 5 aa, Mycobacterium tuberculosis
KVNDE

SEQ ID NO: 1418660 - protein, 6 aa, Mycobacterium tuberculosis
LAAAAG

SEQ ID NO: 1418661 - protein, 18 aa, Mycobacterium tuberculosis
LAADRDALTAAATALGTD

SEQ ID NO: 1418662 - protein, 7 aa, Mycobacterium tuberculosis
LAAERGV

SEQ ID NO: 1418663 - protein, 12 aa, Mycobacterium tuberculosis
LAARADANPVLG

SEQ ID NO: 1418664 - protein, 5 aa, Mycobacterium tuberculosis
LADGG

SEQ ID NO: 1418665 - protein, 10 aa, Mycobacterium tuberculosis
LADKGEPAAY

SEQ ID NO: 1418666 - protein, 5 aa, Mycobacterium tuberculosis
LAEAR

SEQ ID NO: 1418667 - protein, 14 aa, Mycobacterium tuberculosis
LAGRGAARPTAQLA

SEQ ID NO: 1418668 - protein, 16 aa, Mycobacterium tuberculosis
LAKETATQARAAAEAF

SEQ ID NO: 1418669 - protein, 4 aa, Mycobacterium tuberculosis
LAPN

SEQ ID NO: 1418670 - protein, 6 aa, Mycobacterium tuberculosis
LAQPQG

SEQ ID NO: 1418671 - protein, 16 aa, Mycobacterium tuberculosis
LAREAAAQASAAAAAY

SEQ ID NO: 1418672 - protein, 7 aa, Mycobacterium tuberculosis
LARNGDN

SEQ ID NO: 1418673 - protein, 6 aa, Mycobacterium tuberculosis
LARPQR

SEQ ID NO: 1418674 - protein, 6 aa, Mycobacterium tuberculosis
LARSRK

SEQ ID NO: 1418675 - protein, 6 aa, Mycobacterium tuberculosis
LASRLD

SEQ ID NO: 1418676 - protein, 11 aa, Mycobacterium tuberculosis
LASTGGPEEFA

SEQ ID NO: 1418677 - protein, 5 aa, Mycobacterium tuberculosis
LATAA

SEQ ID NO: 1418678 - protein, 8 aa, Mycobacterium tuberculosis
LATAQGPR

SEQ ID NO: 1418679 - protein, 4 aa, Mycobacterium tuberculosis
LDDG

SEQ ID NO: 1418680 - protein, 5 aa, Mycobacterium tuberculosis
LDGGR

SEQ ID NO: 1418681 - protein, 12 aa, Mycobacterium tuberculosis
LDKAETKARYGE

SEQ ID NO: 1418682 - protein, 8 aa, Mycobacterium tuberculosis
LDKDRDLA

SEQ ID NO: 1418683 - protein, 5 aa, Mycobacterium tuberculosis
LDPAQ

SEQ ID NO: 1418684 - protein, 5 aa, Mycobacterium tuberculosis
LDPDY

SEQ ID NO: 1418685 - protein, 7 aa, Mycobacterium tuberculosis
LDPELEP

SEQ ID NO: 1418686 - protein, 13 aa, Mycobacterium tuberculosis
LDPTGYLNAAVLF

SEQ ID NO: 1418687 - protein, 41 aa, Mycobacterium tuberculosis
LDRKDAKGHKGVPRAPKTPSPTANRRISDGPARRLTRCCRQ

SEQ ID NO: 1418688 - protein, 6 aa, Mycobacterium tuberculosis
LDRNPF

SEQ ID NO: 1418689 - protein, 4 aa, Mycobacterium tuberculosis
LDSG

SEQ ID NO: 1418690 - protein, 14 aa, Mycobacterium tuberculosis
LEAEQQQLQSYITQ

SEQ ID NO: 1418691 - protein, 19 aa, Mycobacterium tuberculosis
LEGTGEVQTPLSGDAARRL

SEQ ID NO: 1418692 - protein, 5 aa, Mycobacterium tuberculosis
LEPGS

SEQ ID NO: 1418693 - protein, 15 aa, Mycobacterium tuberculosis
LEPLGTTVSAGGMPD

SEQ ID NO: 1418694 - protein, 9 aa, Mycobacterium tuberculosis
LETTATRSG

SEQ ID NO: 1418695 - protein, 8 aa, Mycobacterium tuberculosis
LGAGSRSE

SEQ ID NO: 1418696 - protein, 7 aa, Mycobacterium tuberculosis
LGDDRTE

SEQ ID NO: 1418697 - protein, 9 aa, Mycobacterium tuberculosis
LGEAGKSTI

SEQ ID NO: 1418698 - protein, 11 aa, Mycobacterium tuberculosis
LGEDTNADEAL

SEQ ID NO: 1418699 - protein, 11 aa, Mycobacterium tuberculosis
LGGGLGANSRH

SEQ ID NO: 1418700 - protein, 54 aa, Mycobacterium tuberculosis
LGGQAGGVIGGSAAGAIGAGVGGRLGGNGQIGVAGQGAVGAGVGAGVGGQAGIA

SEQ ID NO: 1418701 - protein, 7 aa, Mycobacterium tuberculosis
LGGSNFG

SEQ ID NO: 1418702 - protein, 6 aa, Mycobacterium tuberculosis
LGNARA

SEQ ID NO: 1418703 - protein, 4 aa, Mycobacterium tuberculosis
LGPG

SEQ ID NO: 1418704 - protein, 18 aa, Mycobacterium tuberculosis
LGPGDSDWMTPQSRRELA

SEQ ID NO: 1418705 - protein, 10 aa, Mycobacterium tuberculosis
LGPSGSGKTT

SEQ ID NO: 1418706 - protein, 6 aa, Mycobacterium tuberculosis
LGQDAE

SEQ ID NO: 1418707 - protein, 8 aa, Mycobacterium tuberculosis
LGQQQAQA

SEQ ID NO: 1418708 - protein, 14 aa, Mycobacterium tuberculosis
LGRSYGDNAQNGGG

SEQ ID NO: 1418709 - protein, 9 aa, Mycobacterium tuberculosis
LGSARGYRG

SEQ ID NO: 1418710 - protein, 18 aa, Mycobacterium tuberculosis
LGSEQTAAAEGKVGNVRR

SEQ ID NO: 1418711 - protein, 5 aa, Mycobacterium tuberculosis
LGSGI

SEQ ID NO: 1418712 - protein, 15 aa, Mycobacterium tuberculosis
LGSPDPAETYSNSPH

SEQ ID NO: 1418713 - protein, 14 aa, Mycobacterium tuberculosis
LGSSLGSSGLGGGV

SEQ ID NO: 1418714 - protein, 5 aa, Mycobacterium tuberculosis
LGTGS

SEQ ID NO: 1418715 - protein, 4 aa, Mycobacterium tuberculosis
LGTS

SEQ ID NO: 1418716 - protein, 6 aa, Mycobacterium tuberculosis
LHSNGR

SEQ ID NO: 1418717 - protein, 8 aa, Mycobacterium tuberculosis
LKAGKSTL

SEQ ID NO: 1418718 - protein, 11 aa, Mycobacterium tuberculosis
LKARRDSDRAA

SEQ ID NO: 1418719 - protein, 10 aa, Mycobacterium tuberculosis
LKKGSGHQEV

SEQ ID NO: 1418720 - protein, 5 aa, Mycobacterium tuberculosis
LKPAT

SEQ ID NO: 1418721 - protein, 8 aa, Mycobacterium tuberculosis
LMPGSGLA

SEQ ID NO: 1418722 - protein, 4 aa, Mycobacterium tuberculosis
LNDG

SEQ ID NO: 1418723 - protein, 6 aa, Mycobacterium tuberculosis
LNDGEL

SEQ ID NO: 1418724 - protein, 11 aa, Mycobacterium tuberculosis
LNQTEEAGRRR

SEQ ID NO: 1418725 - protein, 11 aa, Mycobacterium tuberculosis
LPAGAASLDAG

SEQ ID NO: 1418726 - protein, 11 aa, Mycobacterium tuberculosis
LPEPTASAAFG

SEQ ID NO: 1418727 - protein, 6 aa, Mycobacterium tuberculosis
LPEPTH

SEQ ID NO: 1418728 - protein, 13 aa, Mycobacterium tuberculosis
LPGDDPLSPYADR

SEQ ID NO: 1418729 - protein, 5 aa, Mycobacterium tuberculosis
LPGNG

SEQ ID NO: 1418730 - protein, 18 aa, Mycobacterium tuberculosis
LPGRSVGRRIEGTGTEVG

SEQ ID NO: 1418731 - protein, 4 aa, Mycobacterium tuberculosis
LPHR

SEQ ID NO: 1418732 - protein, 6 aa, Mycobacterium tuberculosis
LPNASA

SEQ ID NO: 1418733 - protein, 13 aa, Mycobacterium tuberculosis
LPNSSSSQPSYLG

SEQ ID NO: 1418734 - protein, 12 aa, Mycobacterium tuberculosis
LPPERQARALPS

SEQ ID NO: 1418735 - protein, 6 aa, Mycobacterium tuberculosis
LPPPDV

SEQ ID NO: 1418736 - protein, 8 aa, Mycobacterium tuberculosis
LPPRAGTA

SEQ ID NO: 1418737 - protein, 4 aa, Mycobacterium tuberculosis
LPRP

SEQ ID NO: 1418738 - protein, 5 aa, Mycobacterium tuberculosis
LPRPE

SEQ ID NO: 1418739 - protein, 8 aa, Mycobacterium tuberculosis
LPSHPGHE

SEQ ID NO: 1418740 - protein, 10 aa, Mycobacterium tuberculosis
LPTKNPKAAA

SEQ ID NO: 1418741 - protein, 8 aa, Mycobacterium tuberculosis
LPVSERRG

SEQ ID NO: 1418742 - protein, 12 aa, Mycobacterium tuberculosis
LQPGSATVAETA

SEQ ID NO: 1418743 - protein, 11 aa, Mycobacterium tuberculosis
LQRGRSYARKG

SEQ ID NO: 1418744 - protein, 5 aa, Mycobacterium tuberculosis
LQTET

SEQ ID NO: 1418745 - protein, 8 aa, Mycobacterium tuberculosis
LQTTEACG

SEQ ID NO: 1418746 - protein, 14 aa, Mycobacterium tuberculosis
LRDTNGDPVTARGA

SEQ ID NO: 1418747 - protein, 5 aa, Mycobacterium tuberculosis
LRETT

SEQ ID NO: 1418748 - protein, 18 aa, Mycobacterium tuberculosis
LRGESERAERDGDLAKAA

SEQ ID NO: 1418749 - protein, 56 aa, Mycobacterium tuberculosis
LRNAAKAYGEVDEEAATALDNDGEGTVQAESAGAVGGDSSAELTDTPRVATAGEPN

SEQ ID NO: 1418750 - protein, 8 aa, Mycobacterium tuberculosis
LRPDAGPS

SEQ ID NO: 1418751 - protein, 5 aa, Mycobacterium tuberculosis
LRPGE

SEQ ID NO: 1418752 - protein, 6 aa, Mycobacterium tuberculosis
LRQNTE

SEQ ID NO: 1418753 - protein, 4 aa, Mycobacterium tuberculosis
LRRK

SEQ ID NO: 1418754 - protein, 5 aa, Mycobacterium tuberculosis
LRSRT

SEQ ID NO: 1418755 - protein, 15 aa, Mycobacterium tuberculosis
LRTAAENGRLAADAP

SEQ ID NO: 1418756 - protein, 6 aa, Mycobacterium tuberculosis
LRTDRS

SEQ ID NO: 1418757 - protein, 6 aa, Mycobacterium tuberculosis
LRYGPD

SEQ ID NO: 1418758 - protein, 6 aa, Mycobacterium tuberculosis
LSGPGS

SEQ ID NO: 1418759 - protein, 7 aa, Mycobacterium tuberculosis
LSGQGTS

SEQ ID NO: 1418760 - protein, 10 aa, Mycobacterium tuberculosis
LSPGATYRST

SEQ ID NO: 1418761 - protein, 6 aa, Mycobacterium tuberculosis
LSPQEL

SEQ ID NO: 1418762 - protein, 6 aa, Mycobacterium tuberculosis
LSQADE

SEQ ID NO: 1418763 - protein, 14 aa, Mycobacterium tuberculosis
LSQDGLTSLGAPGA

SEQ ID NO: 1418764 - protein, 12 aa, Mycobacterium tuberculosis
LSQGGPAAAQRA

SEQ ID NO: 1418765 - protein, 10 aa, Mycobacterium tuberculosis
LSQSYPGASM

SEQ ID NO: 1418766 - protein, 9 aa, Mycobacterium tuberculosis
LSSTEQQTT

SEQ ID NO: 1418767 - protein, 5 aa, Mycobacterium tuberculosis
LTDGE

SEQ ID NO: 1418768 - protein, 7 aa, Mycobacterium tuberculosis
LTEDEKE

SEQ ID NO: 1418769 - protein, 5 aa, Mycobacterium tuberculosis
LTGKQ

SEQ ID NO: 1418770 - protein, 10 aa, Mycobacterium tuberculosis
LTNMRSSTAD

SEQ ID NO: 1418771 - protein, 6 aa, Mycobacterium tuberculosis
LTPDDG

SEQ ID NO: 1418772 - protein, 6 aa, Mycobacterium tuberculosis
LTPPPA

SEQ ID NO: 1418773 - protein, 11 aa, Mycobacterium tuberculosis
MAAGKTSGPVN

SEQ ID NO: 1418774 - protein, 5 aa, Mycobacterium tuberculosis
MASAA

SEQ ID NO: 1418775 - protein, 20 aa, Mycobacterium tuberculosis
MESNGKSTRADGSPVSADTG

SEQ ID NO: 1418776 - protein, 5 aa, Mycobacterium tuberculosis
MGATE

SEQ ID NO: 1418777 - protein, 4 aa, Mycobacterium tuberculosis
MGRG

SEQ ID NO: 1418778 - protein, 9 aa, Mycobacterium tuberculosis
MGSDEASVV

SEQ ID NO: 1418779 - protein, 4 aa, Mycobacterium tuberculosis
MPST

SEQ ID NO: 1418780 - protein, 9 aa, Mycobacterium tuberculosis
MREGRDKVA

SEQ ID NO: 1418781 - protein, 13 aa, Mycobacterium tuberculosis
MTQTHPSIPPELR

SEQ ID NO: 1418782 - protein, 13 aa, Mycobacterium tuberculosis
MYETGAGGSAPKH

SEQ ID NO: 1418783 - protein, 10 aa, Mycobacterium tuberculosis
MYSGPGPESM

SEQ ID NO: 1418784 - protein, 17 aa, Mycobacterium tuberculosis
NAAPNPELRATAKRAIG

SEQ ID NO: 1418785 - protein, 20 aa, Mycobacterium tuberculosis
NAATAEKEAELRANADAKEA

SEQ ID NO: 1418786 - protein, 12 aa, Mycobacterium tuberculosis
NAGDGTHEHPTQ

SEQ ID NO: 1418787 - protein, 8 aa, Mycobacterium tuberculosis
NAGLSAAD

SEQ ID NO: 1418788 - protein, 6 aa, Mycobacterium tuberculosis
NAPARS

SEQ ID NO: 1418789 - protein, 9 aa, Mycobacterium tuberculosis
NASRSADEV

SEQ ID NO: 1418790 - protein, 18 aa, Mycobacterium tuberculosis
NDGCDAEAGSGPPFFHVK

SEQ ID NO: 1418791 - protein, 9 aa, Mycobacterium tuberculosis
NDGGTESVT

SEQ ID NO: 1418792 - protein, 10 aa, Mycobacterium tuberculosis
NDQRGDGRSR

SEQ ID NO: 1418793 - protein, 5 aa, Mycobacterium tuberculosis
NDRGM

SEQ ID NO: 1418794 - protein, 14 aa, Mycobacterium tuberculosis
NEDAKRKAAAGLEA

SEQ ID NO: 1418795 - protein, 6 aa, Mycobacterium tuberculosis
NEITPT

SEQ ID NO: 1418796 - protein, 17 aa, Mycobacterium tuberculosis
NGADGSPGTGQAGGPGG

SEQ ID NO: 1418797 - protein, 16 aa, Mycobacterium tuberculosis
NGASASAIARGRPVET

SEQ ID NO: 1418798 - protein, 39 aa, Mycobacterium tuberculosis; identical to SEQ ID NO: 181262

SEQ ID NO: 1418799 - protein, 7 aa, Mycobacterium tuberculosis
NGLPPAE

SEQ ID NO: 1418800 - protein, 11 aa, Mycobacterium tuberculosis
NGTANGKAALA

SEQ ID NO: 1418801 - protein, 5 aa, Mycobacterium tuberculosis
NGVRK

SEQ ID NO: 1418802 - protein, 16 aa, Mycobacterium tuberculosis
NHRGGTVLGPGTSPLG

SEQ ID NO: 1418803 - protein, 12 aa, Mycobacterium tuberculosis
NHRTPGSGVSAR

SEQ ID NO: 1418804 - protein, 5 aa, Mycobacterium tuberculosis
NIDGD

SEQ ID NO: 1418805 - protein, 6 aa, Mycobacterium tuberculosis
NIDTVP

SEQ ID NO: 1418806 - protein, 11 aa, Mycobacterium tuberculosis
NIETLGKDELG

SEQ ID NO: 1418807 - protein, 11 aa, Mycobacterium tuberculosis
NKGRTVDTPYG

SEQ ID NO: 1418808 - protein, 12 aa, Mycobacterium tuberculosis
NKHRRRRAAQVE

SEQ ID NO: 1418809 - protein, 58 aa, Mycobacterium tuberculosis
NLGGGNTGDYNLGSGNSGNANVGSGNSGNANVGSGNDGATNLGSGNIGNTNLGSGNVG

SEQ ID NO: 1418810 - protein, 11 aa, Mycobacterium tuberculosis
NLGSGNRGFGN

SEQ ID NO: 1418811 - protein, 8 aa, Mycobacterium tuberculosis
NLPATATV

SEQ ID NO: 1418812 - protein, 11 aa, Mycobacterium tuberculosis
NLPSRRENDQL

SEQ ID NO: 1418813 - protein, 5 aa, Mycobacterium tuberculosis
NMNED

SEQ ID NO: 1418814 - protein, 14 aa, Mycobacterium tuberculosis
NNGSFRATDEAETV

SEQ ID NO: 1418815 - protein, 7 aa, Mycobacterium tuberculosis
NNPLGTA

SEQ ID NO: 1418816 - protein, 12 aa, Mycobacterium tuberculosis
NNSTDDTATVAA

SEQ ID NO: 1418817 - protein, 9 aa, Mycobacterium tuberculosis
NPGAAAHSQ

SEQ ID NO: 1418818 - protein, 6 aa, Mycobacterium tuberculosis
NPPEIT

SEQ ID NO: 1418819 - protein, 7 aa, Mycobacterium tuberculosis
NRGTLGG

SEQ ID NO: 1418820 - protein, 5 aa, Mycobacterium tuberculosis
NRRRF

SEQ ID NO: 1418821 - protein, 6 aa, Mycobacterium tuberculosis
NSAQGY

SEQ ID NO: 1418822 - protein, 10 aa, Mycobacterium tuberculosis
NSGAGGASGF

SEQ ID NO: 1418823 - protein, 8 aa, Mycobacterium tuberculosis
NSGEWDGE

SEQ ID NO: 1418824 - protein, 26 aa, Mycobacterium tuberculosis
NSGLTAGAAGLGNTGFGNAGSANYGF

SEQ ID NO: 1418825 - protein, 8 aa, Mycobacterium tuberculosis
NSGTGNVG

SEQ ID NO: 1418826 - protein, 6 aa, Mycobacterium tuberculosis
NSPRQT

SEQ ID NO: 1418827 - protein, 4 aa, Mycobacterium tuberculosis
NTCE

SEQ ID NO: 1418828 - protein, 5 aa, Mycobacterium tuberculosis
NTDEA

SEQ ID NO: 1418829 - protein, 6 aa, Mycobacterium tuberculosis
NTEASR

SEQ ID NO: 1418830 - protein, 6 aa, Mycobacterium tuberculosis
NTGLGH

SEQ ID NO: 1418831 - protein, 21 aa, Mycobacterium tuberculosis
NTLQRGQAALTGPVARGDAAA

SEQ ID NO: 1418832 - protein, 12 aa, Mycobacterium tuberculosis
NTPAIATTESQY

SEQ ID NO: 1418833 - protein, 8 aa, Mycobacterium tuberculosis
NTPTDTIS

SEQ ID NO: 1418834 - protein, 9 aa, Mycobacterium tuberculosis
NTSGQPDPD

SEQ ID NO: 1418835 - protein, 6 aa, Mycobacterium tuberculosis
NTSVER

SEQ ID NO: 1418836 - protein, 6 aa, Mycobacterium tuberculosis
NTTGSG

SEQ ID NO: 1418837 - protein, 7 aa, Mycobacterium tuberculosis
NVADNGD

SEQ ID NO: 1418838 - protein, 6 aa, Mycobacterium tuberculosis
PAAHVG

SEQ ID NO: 1418839 - protein, 8 aa, Mycobacterium tuberculosis
PAATNSAI

SEQ ID NO: 1418840 - protein, 11 aa, Mycobacterium tuberculosis
PADISTATLNE

SEQ ID NO: 1418841 - protein, 8 aa, Mycobacterium tuberculosis
PADPQRAG

SEQ ID NO: 1418842 - protein, 6 aa, Mycobacterium tuberculosis
PAERAE

SEQ ID NO: 1418843 - protein, 17 aa, Mycobacterium tuberculosis
PAGDRVASTGGTASGPV

SEQ ID NO: 1418844 - protein, 7 aa, Mycobacterium tuberculosis
PAGPGVR

SEQ ID NO: 1418845 - protein, 15 aa, Mycobacterium tuberculosis
PAGQSWAATAGSGDV

SEQ ID NO: 1418846 - protein, 7 aa, Mycobacterium tuberculosis
PAHPTGE

SEQ ID NO: 1418847 - protein, 4 aa, Mycobacterium tuberculosis
PALR

SEQ ID NO: 1418848 - protein, 4 aa, Mycobacterium tuberculosis
PALS

SEQ ID NO: 1418849 - protein, 7 aa, Mycobacterium tuberculosis
PAPADIA

SEQ ID NO: 1418850 - protein, 16 aa, Mycobacterium tuberculosis
PAPDRLEHDADEAWRR

SEQ ID NO: 1418851 - protein, 9 aa, Mycobacterium tuberculosis
PAPHSRTSI

SEQ ID NO: 1418852 - protein, 6 aa, Mycobacterium tuberculosis
PAQQRL

SEQ ID NO: 1418853 - protein, 11 aa, Mycobacterium tuberculosis
PASDTEGLGSV

SEQ ID NO: 1418854 - protein, 8 aa, Mycobacterium tuberculosis
PASYGADD

SEQ ID NO: 1418855 - protein, 9 aa, Mycobacterium tuberculosis
PATTSNEYE

SEQ ID NO: 1418856 - protein, 4 aa, Mycobacterium tuberculosis
PAVE

SEQ ID NO: 1418857 - protein, 11 aa, Mycobacterium tuberculosis
PAVGSPAPAFT

SEQ ID NO: 1418858 - protein, 9 aa, Mycobacterium tuberculosis
PAVSGRNYE

SEQ ID NO: 1418859 - protein, 20 aa, Mycobacterium tuberculosis
PAVTDGYRQDRAFDPSAGKP

SEQ ID NO: 1418860 - protein, 8 aa, Mycobacterium tuberculosis
PDADGNNV

SEQ ID NO: 1418861 - protein, 7 aa, Mycobacterium tuberculosis
PDDLPDS

SEQ ID NO: 1418862 - protein, 7 aa, Mycobacterium tuberculosis
PDDPIRY

SEQ ID NO: 1418863 - protein, 5 aa, Mycobacterium tuberculosis
PDGPQ

SEQ ID NO: 1418864 - protein, 13 aa, Mycobacterium tuberculosis
PDGSVSGSVSGGC

SEQ ID NO: 1418865 - protein, 25 aa, Mycobacterium tuberculosis
PDGTKTPGKTVPDPYFGGAGPARTG

SEQ ID NO: 1418866 - protein, 11 aa, Mycobacterium tuberculosis
PDHTNPDTPRR

SEQ ID NO: 1418867 - protein, 24 aa, Mycobacterium tuberculosis
PDKFTGSPLKERRAQPTGRGRHHR

SEQ ID NO: 1418868 - protein, 5 aa, Mycobacterium tuberculosis
PDLDP

SEQ ID NO: 1418869 - protein, 7 aa, Mycobacterium tuberculosis
PDLPPSH

SEQ ID NO: 1418870 - protein, 7 aa, Mycobacterium tuberculosis
PDQYGKR

SEQ ID NO: 1418871 - protein, 4 aa, Mycobacterium tuberculosis
PDSL

SEQ ID NO: 1418872 - protein, 6 aa, Mycobacterium tuberculosis
PDTGVS

SEQ ID NO: 1418873 - protein, 9 aa, Mycobacterium tuberculosis
PDYADNTKF

SEQ ID NO: 1418874 - protein, 12 aa, Mycobacterium tuberculosis
PEEPRPARPPHA

SEQ ID NO: 1418875 - protein, 7 aa, Mycobacterium tuberculosis
PEGDANL

SEQ ID NO: 1418876 - protein, 12 aa, Mycobacterium tuberculosis
PEGPNGNPDPMA

SEQ ID NO: 1418877 - protein, 4 aa, Mycobacterium tuberculosis
PEHA

SEQ ID NO: 1418878 - protein, 4 aa, Mycobacterium tuberculosis
PEIN

SEQ ID NO: 1418879 - protein, 4 aa, Mycobacterium tuberculosis
PEKA

SEQ ID NO: 1418880 - protein, 8 aa, Mycobacterium tuberculosis
PELGGQGF

SEQ ID NO: 1418881 - protein, 9 aa, Mycobacterium tuberculosis
PEMKSTGEV

SEQ ID NO: 1418882 - protein, 11 aa, Mycobacterium tuberculosis
PEQARIAEGAG

SEQ ID NO: 1418883 - protein, 4 aa, Mycobacterium tuberculosis
PEQS

SEQ ID NO: 1418884 - protein, 13 aa, Mycobacterium tuberculosis
PEQSGSVGERAAR

SEQ ID NO: 1418885 - protein, 17 aa, Mycobacterium tuberculosis
PERAPAARSLDAAKHQQ

SEQ ID NO: 1418886 - protein, 4 aa, Mycobacterium tuberculosis
PESQ

SEQ ID NO: 1418887 - protein, 4 aa, Mycobacterium tuberculosis
PETR

SEQ ID NO: 1418888 - protein, 4 aa, Mycobacterium tuberculosis
PGEG

SEQ ID NO: 1418889 - protein, 5 aa, Mycobacterium tuberculosis
PGFQA

SEQ ID NO: 1418890 - protein, 13 aa, Mycobacterium tuberculosis
PGFTATAPPGDGQ

SEQ ID NO: 1418891 - protein, 11 aa, Mycobacterium tuberculosis
PGGASQPRRTL

SEQ ID NO: 1418892 - protein, 6 aa, Mycobacterium tuberculosis
PGGDRP

SEQ ID NO: 1418893 - protein, 14 aa, Mycobacterium tuberculosis
PGGLYGTAGDNDGR

SEQ ID NO: 1418894 - protein, 10 aa, Mycobacterium tuberculosis
PGGPNGEDAV

SEQ ID NO: 1418895 - protein, 10 aa, Mycobacterium tuberculosis
PGGRAPKPGE

SEQ ID NO: 1418896 - protein, 6 aa, Mycobacterium tuberculosis
PGGSAN

SEQ ID NO: 1418897 - protein, 19 aa, Mycobacterium tuberculosis
PGHIPSTSHRRGTGDINRK

SEQ ID NO: 1418898 - protein, 7 aa, Mycobacterium tuberculosis
PGLQEKP

SEQ ID NO: 1418899 - protein, 6 aa, Mycobacterium tuberculosis
PGLRDE

SEQ ID NO: 1418900 - protein, 5 aa, Mycobacterium tuberculosis
PGSAA

SEQ ID NO: 1418901 - protein, 6 aa, Mycobacterium tuberculosis
PGSATA

SEQ ID NO: 1418902 - protein, 4 aa, Mycobacterium tuberculosis
PGSR

SEQ ID NO: 1418903 - protein, 7 aa, Mycobacterium tuberculosis
PGTTPEV

SEQ ID NO: 1418904 - protein, 4 aa, Mycobacterium tuberculosis
PHAD

SEQ ID NO: 1418905 - protein, 9 aa, Mycobacterium tuberculosis
PHPGKPQLR

SEQ ID NO: 1418906 - protein, 6 aa, Mycobacterium tuberculosis
PHPTSR

SEQ ID NO: 1418907 - protein, 6 aa, Mycobacterium tuberculosis
PHPVGG

SEQ ID NO: 1418908 - protein, 10 aa, Mycobacterium tuberculosis
PIPESGGSRM

SEQ ID NO: 1418909 - protein, 6 aa, Mycobacterium tuberculosis
PITRTP

SEQ ID NO: 1418910 - protein, 9 aa, Mycobacterium tuberculosis
PKAKEHEEI

SEQ ID NO: 1418911 - protein, 10 aa, Mycobacterium tuberculosis
PKASTPAPRR

SEQ ID NO: 1418912 - protein, 7 aa, Mycobacterium tuberculosis
PKAVPSR

SEQ ID NO: 1418913 - protein, 8 aa, Mycobacterium tuberculosis
PKISPPDL

SEQ ID NO: 1418914 - protein, 9 aa, Mycobacterium tuberculosis
PKPDYSAMS

SEQ ID NO: 1418915 - protein, 10 aa, Mycobacterium tuberculosis
PKRGPDLPAT

SEQ ID NO: 1418916 - protein, 4 aa, Mycobacterium tuberculosis
PLAA

SEQ ID NO: 1418917 - protein, 6 aa, Mycobacterium tuberculosis
PLAADG

SEQ ID NO: 1418918 - protein, 18 aa, Mycobacterium tuberculosis
PLAPPPPDPLAPPPPDPL

SEQ ID NO: 1418919 - protein, 15 aa, Mycobacterium tuberculosis
PLDAKKSAKTTAAGT

SEQ ID NO: 1418920 - protein, 6 aa, Mycobacterium tuberculosis
PLGPKG

SEQ ID NO: 1418921 - protein, 15 aa, Mycobacterium tuberculosis
PLTDATLPPNAAAWL

SEQ ID NO: 1418922 - protein, 11 aa, Mycobacterium tuberculosis
PMPPGAPEGMP

SEQ ID NO: 1418923 - protein, 14 aa, Mycobacterium tuberculosis
PNAHTAHPPRADEL

SEQ ID NO: 1418924 - protein, 5 aa, Mycobacterium tuberculosis
PNGDL

SEQ ID NO: 1418925 - protein, 7 aa, Mycobacterium tuberculosis
PNPDAAV

SEQ ID NO: 1418926 - protein, 6 aa, Mycobacterium tuberculosis
PNSPLA

SEQ ID NO: 1418927 - protein, 21 aa, Mycobacterium tuberculosis
PPAPPGMTDNPDRRAAGPAAV

SEQ ID NO: 1418928 - protein, 7 aa, Mycobacterium tuberculosis
PPGTGDV

SEQ ID NO: 1418929 - protein, 16 aa, Mycobacterium tuberculosis
PPGWPGPGALPPHERE

SEQ ID NO: 1418930 - protein, 5 aa, Mycobacterium tuberculosis
PPNLP

SEQ ID NO: 1418931 - protein, 13 aa, Mycobacterium tuberculosis
PPPNPLDTGSAGD

SEQ ID NO: 1418932 - protein, 10 aa, Mycobacterium tuberculosis
PPPPQRYPLS

SEQ ID NO: 1418933 - protein, 10 aa, Mycobacterium tuberculosis
PPQTAKPAVK

SEQ ID NO: 1418934 - protein, 8 aa, Mycobacterium tuberculosis
PPRNGDKL

SEQ ID NO: 1418935 - protein, 9 aa, Mycobacterium tuberculosis
PPTAAGHAG

SEQ ID NO: 1418936 - protein, 13 aa, Mycobacterium tuberculosis
PPTPANGPIPAVP

SEQ ID NO: 1418937 - protein, 11 aa, Mycobacterium tuberculosis
PPTPPPGTPGE

SEQ ID NO: 1418938 - protein, 6 aa, Mycobacterium tuberculosis
PPVATP

SEQ ID NO: 1418939 - protein, 4 aa, Mycobacterium tuberculosis
PPVP

SEQ ID NO: 1418940 - protein, 5 aa, Mycobacterium tuberculosis
PPVPG

SEQ ID NO: 1418941 - protein, 6 aa, Mycobacterium tuberculosis
PPYPPS

SEQ ID NO: 1418942 - protein, 8 aa, Mycobacterium tuberculosis
PQAPAGVR

SEQ ID NO: 1418943 - protein, 4 aa, Mycobacterium tuberculosis
PQDL

SEQ ID NO: 1418944 - protein, 7 aa, Mycobacterium tuberculosis
PQIGEHR

SEQ ID NO: 1418945 - protein, 6 aa, Mycobacterium tuberculosis
PQPPNY

SEQ ID NO: 1418946 - protein, 11 aa, Mycobacterium tuberculosis
PQPRPPRETWE

SEQ ID NO: 1418947 - protein, 7 aa, Mycobacterium tuberculosis
PRAAEES

SEQ ID NO: 1418948 - protein, 4 aa, Mycobacterium tuberculosis
PRDG

SEQ ID NO: 1418949 - protein, 7 aa, Mycobacterium tuberculosis
PRGFGEN

SEQ ID NO: 1418950 - protein, 15 aa, Mycobacterium tuberculosis
PRLRREPGLTCHTEF

SEQ ID NO: 1418951 - protein, 8 aa, Mycobacterium tuberculosis
PRNPYQRA

SEQ ID NO: 1418952 - protein, 8 aa, Mycobacterium tuberculosis
PRPVEESI

SEQ ID NO: 1418953 - protein, 9 aa, Mycobacterium tuberculosis
PRSLHAGEG

SEQ ID NO: 1418954 - protein, 6 aa, Mycobacterium tuberculosis
PSAGRD

SEQ ID NO: 1418955 - protein, 9 aa, Mycobacterium tuberculosis
PSAGSVDGE

SEQ ID NO: 1418956 - protein, 10 aa, Mycobacterium tuberculosis
PSALSGADHD

SEQ ID NO: 1418957 - protein, 12 aa, Mycobacterium tuberculosis
PSDGGWTANGEK

SEQ ID NO: 1418958 - protein, 6 aa, Mycobacterium tuberculosis
PSEPAE

SEQ ID NO: 1418959 - protein, 5 aa, Mycobacterium tuberculosis
PSPHL

SEQ ID NO: 1418960 - protein, 7 aa, Mycobacterium tuberculosis
PSRPSGK

SEQ ID NO: 1418961 - protein, 7 aa, Mycobacterium tuberculosis
PSSAGSM

SEQ ID NO: 1418962 - protein, 8 aa, Mycobacterium tuberculosis
PTATATTV

SEQ ID NO: 1418963 - protein, 22 aa, Mycobacterium tuberculosis
PTDTGGTPADRCTPATGGEFPT

SEQ ID NO: 1418964 - protein, 4 aa, Mycobacterium tuberculosis
PTDY

SEQ ID NO: 1418965 - protein, 16 aa, Mycobacterium tuberculosis
PTGEEELQSSEAKVGP

SEQ ID NO: 1418966 - protein, 4 aa, Mycobacterium tuberculosis
PTLD

SEQ ID NO: 1418967 - protein, 4 aa, Mycobacterium tuberculosis
PTNR

SEQ ID NO: 1418968 - protein, 7 aa, Mycobacterium tuberculosis
PTPEHGN

SEQ ID NO: 1418969 - protein, 5 aa, Mycobacterium tuberculosis
PTRPL

SEQ ID NO: 1418970 - protein, 4 aa, Mycobacterium tuberculosis
PVAD

SEQ ID NO: 1418971 - protein, 13 aa, Mycobacterium tuberculosis
PVAGPAELAAGRE

SEQ ID NO: 1418972 - protein, 11 aa, Mycobacterium tuberculosis
PVASRVNGKVD

SEQ ID NO: 1418973 - protein, 4 aa, Mycobacterium tuberculosis
PVGT

SEQ ID NO: 1418974 - protein, 7 aa, Mycobacterium tuberculosis
PVNDLSR

SEQ ID NO: 1418975 - protein, 17 aa, Mycobacterium tuberculosis
PVNPAQLTAEELDGRTI

SEQ ID NO: 1418976 - protein, 6 aa, Mycobacterium tuberculosis
PVPTGD

SEQ ID NO: 1418977 - protein, 12 aa, Mycobacterium tuberculosis
PVQEDRDRSLRD

SEQ ID NO: 1418978 - protein, 8 aa, Mycobacterium tuberculosis
PVRPGKGE

SEQ ID NO: 1418979 - protein, 17 aa, Mycobacterium tuberculosis
PWNTDYTAGASSSGSGA

SEQ ID NO: 1418980 - protein, 9 aa, Mycobacterium tuberculosis
PYDPSESQA

SEQ ID NO: 1418981 - protein, 4 aa, Mycobacterium tuberculosis
PYEG

SEQ ID NO: 1418982 - protein, 5 aa, Mycobacterium tuberculosis
PYGAC

SEQ ID NO: 1418983 - protein, 4 aa, Mycobacterium tuberculosis
PYPA

SEQ ID NO: 1418984 - protein, 8 aa, Mycobacterium tuberculosis
QAAERGLV

SEQ ID NO: 1418985 - protein, 7 aa, Mycobacterium tuberculosis
QAAREGR

SEQ ID NO: 1418986 - protein, 18 aa, Mycobacterium tuberculosis
QADPERRRRYQQARGKGG

SEQ ID NO: 1418987 - protein, 9 aa, Mycobacterium tuberculosis
QAEGSGTMN

SEQ ID NO: 1418988 - protein, 23 aa, Mycobacterium tuberculosis
QAEQARKAAEDELRKRGRERRPL

SEQ ID NO: 1418989 - protein, 4 aa, Mycobacterium tuberculosis
QAGL

SEQ ID NO: 1418990 - protein, 17 aa, Mycobacterium tuberculosis
QAGTGSPAPPADPGSPA

SEQ ID NO: 1418991 - protein, 8 aa, Mycobacterium tuberculosis
QAHDAPKG

SEQ ID NO: 1418992 - protein, 7 aa, Mycobacterium tuberculosis
QAKARQS

SEQ ID NO: 1418993 - protein, 8 aa, Mycobacterium tuberculosis
QAKEIGGP

SEQ ID NO: 1418994 - protein, 6 aa, Mycobacterium tuberculosis
QALDAS

SEQ ID NO: 1418995 - protein, 4 aa, Mycobacterium tuberculosis
QAND

SEQ ID NO: 1418996 - protein, 5 aa, Mycobacterium tuberculosis
QAQTF

SEQ ID NO: 1418997 - protein, 10 aa, Mycobacterium tuberculosis
QARREKTTVT

SEQ ID NO: 1418998 - protein, 4 aa, Mycobacterium tuberculosis
QAYR

SEQ ID NO: 1418999 - protein, 4 aa, Mycobacterium tuberculosis
QDAE

SEQ ID NO: 1419000 - protein, 5 aa, Mycobacterium tuberculosis
QDAVA

SEQ ID NO: 1419001 - protein, 4 aa, Mycobacterium tuberculosis
QDPM

SEQ ID NO: 1419002 - protein, 17 aa, Mycobacterium tuberculosis
QDQNLQDGPHKDLRRAR

SEQ ID NO: 1419003 - protein, 9 aa, Mycobacterium tuberculosis
QDVADGSFG

SEQ ID NO: 1419004 - protein, 5 aa, Mycobacterium tuberculosis
QECGA

SEQ ID NO: 1419005 - protein, 17 aa, Mycobacterium tuberculosis
QELRDAGVSDKTLADPA

SEQ ID NO: 1419006 - protein, 4 aa, Mycobacterium tuberculosis
QEPD

SEQ ID NO: 1419007 - protein, 6 aa, Mycobacterium tuberculosis
QEPDDV

SEQ ID NO: 1419008 - protein, 25 aa, Mycobacterium tuberculosis
QEVASKITAATAGIATTTFPETPSI

SEQ ID NO: 1419009 - protein, 12 aa, Mycobacterium tuberculosis
QFPTSSAVSSEL

SEQ ID NO: 1419010 - protein, 33 aa, Mycobacterium tuberculosis
QFRGPGKPFADEKPCPRERPPADQLAAFLGRTV

SEQ ID NO: 1419011 - protein, 9 aa, Mycobacterium tuberculosis
QGAAWTPAD

SEQ ID NO: 1419012 - protein, 8 aa, Mycobacterium tuberculosis
QGARTDLK

SEQ ID NO: 1419013 - protein, 24 aa, Mycobacterium tuberculosis
QGGFGGARGERPAAPEFPDRHPDA

SEQ ID NO: 1419014 - protein, 9 aa, Mycobacterium tuberculosis
QGREEFDTE

SEQ ID NO: 1419015 - protein, 21 aa, Mycobacterium tuberculosis
QGSSRAAFDAEARTASEKDVK

SEQ ID NO: 1419016 - protein, 7 aa, Mycobacterium tuberculosis
QGTMTAA

SEQ ID NO: 1419017 - protein, 22 aa, Mycobacterium tuberculosis
QGVQAGSTGAGQSTSAGENFGN

SEQ ID NO: 1419018 - protein, 7 aa, Mycobacterium tuberculosis
QGYASGE

SEQ ID NO: 1419019 - protein, 4 aa, Mycobacterium tuberculosis
QHKY

SEQ ID NO: 1419020 - protein, 6 aa, Mycobacterium tuberculosis
QITGRE

SEQ ID NO: 1419021 - protein, 10 aa, Mycobacterium tuberculosis
QKPDESERTF

SEQ ID NO: 1419022 - protein, 5 aa, Mycobacterium tuberculosis
QLGGS

SEQ ID NO: 1419023 - protein, 10 aa, Mycobacterium tuberculosis
QNAPAIAAAE

SEQ ID NO: 1419024 - protein, 12 aa, Mycobacterium tuberculosis
QNSAAIAATQAE

SEQ ID NO: 1419025 - protein, 5 aa, Mycobacterium tuberculosis
QNSVR

SEQ ID NO: 1419026 - protein, 6 aa, Mycobacterium tuberculosis
QNTPAI

SEQ ID NO: 1419027 - protein, 9 aa, Mycobacterium tuberculosis
QNTPAIAAT

SEQ ID NO: 1419028 - protein, 6 aa, Mycobacterium tuberculosis
QNTRGL

SEQ ID NO: 1419029 - protein, 21 aa, Mycobacterium tuberculosis
QPELANDPRFGASRSRVANRS

SEQ ID NO: 1419030 - protein, 4 aa, Mycobacterium tuberculosis
QPGF

SEQ ID NO: 1419031 - protein, 13 aa, Mycobacterium tuberculosis
QPLGGKAQFGGQR

SEQ ID NO: 1419032 - protein, 4 aa, Mycobacterium tuberculosis
QPLR

SEQ ID NO: 1419033 - protein, 7 aa, Mycobacterium tuberculosis
QPSATGR

SEQ ID NO: 1419034 - protein, 7 aa, Mycobacterium tuberculosis
QPWDTGD

SEQ ID NO: 1419035 - protein, 12 aa, Mycobacterium tuberculosis
QQETRSNRRAAL

SEQ ID NO: 1419036 - protein, 4 aa, Mycobacterium tuberculosis
QQRQ

SEQ ID NO: 1419037 - protein, 6 aa, Mycobacterium tuberculosis
QRAEEP

SEQ ID NO: 1419038 - protein, 8 aa, Mycobacterium tuberculosis
QRAEGDPD

SEQ ID NO: 1419039 - protein, 5 aa, Mycobacterium tuberculosis
QRDEL

SEQ ID NO: 1419040 - protein, 5 aa, Mycobacterium tuberculosis
QREEV

SEQ ID NO: 1419041 - protein, 9 aa, Mycobacterium tuberculosis
QRHQDRGVG

SEQ ID NO: 1419042 - protein, 4 aa, Mycobacterium tuberculosis
QRIP

SEQ ID NO: 1419043 - protein, 16 aa, Mycobacterium tuberculosis
QRRRPREPREQTQNRM

SEQ ID NO: 1419044 - protein, 5 aa, Mycobacterium tuberculosis
QRSIP

SEQ ID NO: 1419045 - protein, 12 aa, Mycobacterium tuberculosis
QRTEQEAVRTQT

SEQ ID NO: 1419046 - protein, 7 aa, Mycobacterium tuberculosis
QRVGENG

SEQ ID NO: 1419047 - protein, 11 aa, Mycobacterium tuberculosis
QSAERAAERQV

SEQ ID NO: 1419048 - protein, 16 aa, Mycobacterium tuberculosis
QSEETEPLCPDPGIAD

SEQ ID NO: 1419049 - protein, 9 aa, Mycobacterium tuberculosis
QSKPCIETT

SEQ ID NO: 1419050 - protein, 5 aa, Mycobacterium tuberculosis
QSKQV

SEQ ID NO: 1419051 - protein, 7 aa, Mycobacterium tuberculosis
QSKVGTV

SEQ ID NO: 1419052 - protein, 4 aa, Mycobacterium tuberculosis
QSQQ

SEQ ID NO: 1419053 - protein, 4 aa, Mycobacterium tuberculosis
QTAN

SEQ ID NO: 1419054 - protein, 10 aa, Mycobacterium tuberculosis
QTGGYSPPTN

SEQ ID NO: 1419055 - protein, 8 aa, Mycobacterium tuberculosis
QTGSTNAD

SEQ ID NO: 1419056 - protein, 5 aa, Mycobacterium tuberculosis
QTQDR

SEQ ID NO: 1419057 - protein, 4 aa, Mycobacterium tuberculosis
QTQP

SEQ ID NO: 1419058 - protein, 13 aa, Mycobacterium tuberculosis
QVDPKTSTASGTV

SEQ ID NO: 1419059 - protein, 11 aa, Mycobacterium tuberculosis
QVEGAGSPTMT

SEQ ID NO: 1419060 - protein, 16 aa, Mycobacterium tuberculosis
QVERVEPGRGRPGRPP

SEQ ID NO: 1419061 - protein, 5 aa, Mycobacterium tuberculosis
QVGPR

SEQ ID NO: 1419062 - protein, 9 aa, Mycobacterium tuberculosis
QVPGSKSAT

SEQ ID NO: 1419063 - protein, 11 aa, Mycobacterium tuberculosis
QVRKAGRQTKG

SEQ ID NO: 1419064 - protein, 7 aa, Mycobacterium tuberculosis
QVRSQNE

SEQ ID NO: 1419065 - protein, 6 aa, Mycobacterium tuberculosis
QYKSPR

SEQ ID NO: 1419066 - protein, 10 aa, Mycobacterium tuberculosis
RAAAENGDAL

SEQ ID NO: 1419067 - protein, 8 aa, Mycobacterium tuberculosis
RAALDSEG

SEQ ID NO: 1419068 - protein, 7 aa, Mycobacterium tuberculosis
RAAQASG

SEQ ID NO: 1419069 - protein, 9 aa, Mycobacterium tuberculosis
RAARATKLA

SEQ ID NO: 1419070 - protein, 15 aa, Mycobacterium tuberculosis
RAEAEAAQQRLDAGE

SEQ ID NO: 1419071 - protein, 9 aa, Mycobacterium tuberculosis
RAGASGLTG

SEQ ID NO: 1419072 - protein, 16 aa, Mycobacterium tuberculosis
RAGAVERTSASGDAGI

SEQ ID NO: 1419073 - protein, 5 aa, Mycobacterium tuberculosis
RAGDE

SEQ ID NO: 1419074 - protein, 9 aa, Mycobacterium tuberculosis
RAGDKPIRV

SEQ ID NO: 1419075 - protein, 5 aa, Mycobacterium tuberculosis
RAGDS

SEQ ID NO: 1419076 - protein, 8 aa, Mycobacterium tuberculosis
RAGGKGHI

SEQ ID NO: 1419077 - protein, 11 aa, Mycobacterium tuberculosis
RAGGVSAPPFD

SEQ ID NO: 1419078 - protein, 12 aa, Mycobacterium tuberculosis
RAGKRAGKTVGV

SEQ ID NO: 1419079 - protein, 19 aa, Mycobacterium tuberculosis
RAGRTPRTVTADRGYGEAA

SEQ ID NO: 1419080 - protein, 7 aa, Mycobacterium tuberculosis
RAGSRAA

SEQ ID NO: 1419081 - protein, 4 aa, Mycobacterium tuberculosis
RAHR

SEQ ID NO: 1419082 - protein, 4 aa, Mycobacterium tuberculosis
RANG

SEQ ID NO: 1419083 - protein, 4 aa, Mycobacterium tuberculosis
RAQG

SEQ ID NO: 1419084 - protein, 8 aa, Mycobacterium tuberculosis
RAQGDPPY

SEQ ID NO: 1419085 - protein, 9 aa, Mycobacterium tuberculosis
RAQQTRAEF

SEQ ID NO: 1419086 - protein, 5 aa, Mycobacterium tuberculosis
RARLD

SEQ ID NO: 1419087 - protein, 8 aa, Mycobacterium tuberculosis
RASAGVTG

SEQ ID NO: 1419088 - protein, 15 aa, Mycobacterium tuberculosis
RASPKLRRAKNPIQA

SEQ ID NO: 1419089 - protein, 6 aa, Mycobacterium tuberculosis
RAVGPG

SEQ ID NO: 1419090 - protein, 26 aa, Mycobacterium tuberculosis
RDADAGELESWQPQKLSTAALDAAKS

SEQ ID NO: 1419091 - protein, 5 aa, Mycobacterium tuberculosis
RDDAP

SEQ ID NO: 1419092 - protein, 10 aa, Mycobacterium tuberculosis
RDDPSSVDPS

SEQ ID NO: 1419093 - protein, 8 aa, Mycobacterium tuberculosis
RDGASYQR

SEQ ID NO: 1419094 - protein, 15 aa, Mycobacterium tuberculosis
RDGGDRYGGKGVQKA

SEQ ID NO: 1419095 - protein, 19 aa, Mycobacterium tuberculosis
RDGHRGRRRAARAGSAPAH

SEQ ID NO: 1419096 - protein, 5 aa, Mycobacterium tuberculosis
RDGNQ

SEQ ID NO: 1419097 - protein, 23 aa, Mycobacterium tuberculosis
RDGQLAGSMSTDDANPDGQNSAN

SEQ ID NO: 1419098 - protein, 24 aa, Mycobacterium tuberculosis
RDIGAQAKRGLDANTARSQEAIGR

SEQ ID NO: 1419099 - protein, 5 aa, Mycobacterium tuberculosis
RDPGE

SEQ ID NO: 1419100 - protein, 16 aa, Mycobacterium tuberculosis
RDPSPRASNWRATGTL

SEQ ID NO: 1419101 - protein, 11 aa, Mycobacterium tuberculosis
RDTADISDRQN

SEQ ID NO: 1419102 - protein, 12 aa, Mycobacterium tuberculosis
RDTNTGAETTLP

SEQ ID NO: 1419103 - protein, 10 aa, Mycobacterium tuberculosis
REALGDPTAH

SEQ ID NO: 1419104 - protein, 7 aa, Mycobacterium tuberculosis
REPQLPV

SEQ ID NO: 1419105 - protein, 6 aa, Mycobacterium tuberculosis
REPRPY

SEQ ID NO: 1419106 - protein, 6 aa, Mycobacterium tuberculosis
REQPLP

SEQ ID NO: 1419107 - protein, 9 aa, Mycobacterium tuberculosis
RESDEEMAP

SEQ ID NO: 1419108 - protein, 5 aa, Mycobacterium tuberculosis
RETTF

SEQ ID NO: 1419109 - protein, 8 aa, Mycobacterium tuberculosis
RFANPTPK

SEQ ID NO: 1419110 - protein, 5 aa, Mycobacterium tuberculosis
RFPPE

SEQ ID NO: 1419111 - protein, 17 aa, Mycobacterium tuberculosis
RGADGLRTAGERAVRSP

SEQ ID NO: 1419112 - protein, 21 aa, Mycobacterium tuberculosis
RGAHTKQLRADRRDCAHDLSR

SEQ ID NO: 1419113 - protein, 6 aa, Mycobacterium tuberculosis
RGAPRP

SEQ ID NO: 1419114 - protein, 4 aa, Mycobacterium tuberculosis
RGEA

SEQ ID NO: 1419115 - protein, 8 aa, Mycobacterium tuberculosis
RGGGHNVA

SEQ ID NO: 1419116 - protein, 12 aa, Mycobacterium tuberculosis
RGIPDEAIDPGG

SEQ ID NO: 1419117 - protein, 7 aa, Mycobacterium tuberculosis
RGKQAHE

SEQ ID NO: 1419118 - protein, 6 aa, Mycobacterium tuberculosis
RGLERT

SEQ ID NO: 1419119 - protein, 8 aa, Mycobacterium tuberculosis
RGLPPKRR

SEQ ID NO: 1419120 - protein, 5 aa, Mycobacterium tuberculosis
RGNDQ

SEQ ID NO: 1419121 - protein, 6 aa, Mycobacterium tuberculosis
RGPAVG

SEQ ID NO: 1419122 - protein, 7 aa, Mycobacterium tuberculosis
RGQAGIV

SEQ ID NO: 1419123 - protein, 33 aa, Mycobacterium tuberculosis
RGSKIARTRVGRGDGSKGKTAGRGTKGTRARKQ

SEQ ID NO: 1419124 - protein, 14 aa, Mycobacterium tuberculosis
RGSQTSDPVETPVE

SEQ ID NO: 1419125 - protein, 13 aa, Mycobacterium tuberculosis
RGTAAPAIKEGTP

SEQ ID NO: 1419126 - protein, 5 aa, Mycobacterium tuberculosis
RGTEP

SEQ ID NO: 1419127 - protein, 6 aa, Mycobacterium tuberculosis
RGTGDD

SEQ ID NO: 1419128 - protein, 11 aa, Mycobacterium tuberculosis
RGTTQKASRIR

SEQ ID NO: 1419129 - protein, 10 aa, Mycobacterium tuberculosis
RGVTPQQATE

SEQ ID NO: 1419130 - protein, 8 aa, Mycobacterium tuberculosis
RGWETDGG

SEQ ID NO: 1419131 - protein, 8 aa, Mycobacterium tuberculosis
RHDLGSKT

SEQ ID NO: 1419132 - protein, 13 aa, Mycobacterium tuberculosis
RHSSQPHAAVTPA

SEQ ID NO: 1419133 - protein, 8 aa, Mycobacterium tuberculosis
RHTDLDPG

SEQ ID NO: 1419134 - protein, 11 aa, Mycobacterium tuberculosis
RIEGIGRPRVE

SEQ ID NO: 1419135 - protein, 6 aa, Mycobacterium tuberculosis
RIGPGQ

SEQ ID NO: 1419136 - protein, 9 aa, Mycobacterium tuberculosis
RINGTDRRG

SEQ ID NO: 1419137 - protein, 6 aa, Mycobacterium tuberculosis
RIPKGN

SEQ ID NO: 1419138 - protein, 5 aa, Mycobacterium tuberculosis
RIRAN

SEQ ID NO: 1419139 - protein, 10 aa, Mycobacterium tuberculosis
RITGDGGTAM

SEQ ID NO: 1419140 - protein, 4 aa, Mycobacterium tuberculosis
RITP

SEQ ID NO: 1419141 - protein, 13 aa, Mycobacterium tuberculosis
RKPAKLSGGQRQR

SEQ ID NO: 1419142 - protein, 9 aa, Mycobacterium tuberculosis
RKVGQASGH

SEQ ID NO: 1419143 - protein, 12 aa, Mycobacterium tuberculosis
RLAATSPQVGQD

SEQ ID NO: 1419144 - protein, 12 aa, Mycobacterium tuberculosis
RLAGEERAPAPA

SEQ ID NO: 1419145 - protein, 6 aa, Mycobacterium tuberculosis
RLDEDS

SEQ ID NO: 1419146 - protein, 6 aa, Mycobacterium tuberculosis
RLGDTG

SEQ ID NO: 1419147 - protein, 8 aa, Mycobacterium tuberculosis
RLGPTDAL

SEQ ID NO: 1419148 - protein, 8 aa, Mycobacterium tuberculosis
RLPDPDRL

SEQ ID NO: 1419149 - protein, 7 aa, Mycobacterium tuberculosis
RLRDPRQ

SEQ ID NO: 1419150 - protein, 9 aa, Mycobacterium tuberculosis
RLTGKDTEL

SEQ ID NO: 1419151 - protein, 7 aa, Mycobacterium tuberculosis
RNGTRID

SEQ ID NO: 1419152 - protein, 8 aa, Mycobacterium tuberculosis
RNNNNGHE

SEQ ID NO: 1419153 - protein, 7 aa, Mycobacterium tuberculosis
RNQHADA

SEQ ID NO: 1419154 - protein, 5 aa, Mycobacterium tuberculosis
RNTVK

SEQ ID NO: 1419155 - protein, 7 aa, Mycobacterium tuberculosis
RNTYADR

SEQ ID NO: 1419156 - protein, 4 aa, Mycobacterium tuberculosis
RNVP

SEQ ID NO: 1419157 - protein, 13 aa, Mycobacterium tuberculosis
RNYTAPGGGQFTL

SEQ ID NO: 1419158 - protein, 6 aa, Mycobacterium tuberculosis
RPASWE

SEQ ID NO: 1419159 - protein, 4 aa, Mycobacterium tuberculosis
RPEA

SEQ ID NO: 1419160 - protein, 7 aa, Mycobacterium tuberculosis
RPEEVAA

SEQ ID NO: 1419161 - protein, 5 aa, Mycobacterium tuberculosis
RPERM

SEQ ID NO: 1419162 - protein, 6 aa, Mycobacterium tuberculosis
RPESPV

SEQ ID NO: 1419163 - protein, 7 aa, Mycobacterium tuberculosis
RPGDDLS

SEQ ID NO: 1419164 - protein, 4 aa, Mycobacterium tuberculosis
RPHP

SEQ ID NO: 1419165 - protein, 10 aa, Mycobacterium tuberculosis
RPKAKNAVNA

SEQ ID NO: 1419166 - protein, 7 aa, Mycobacterium tuberculosis
RPLTNVN

SEQ ID NO: 1419167 - protein, 7 aa, Mycobacterium tuberculosis
RPPGSDR

SEQ ID NO: 1419168 - protein, 9 aa, Mycobacterium tuberculosis
RPSIAPANP

SEQ ID NO: 1419169 - protein, 5 aa, Mycobacterium tuberculosis
RPSSA

SEQ ID NO: 1419170 - protein, 5 aa, Mycobacterium tuberculosis
RPYQP

SEQ ID NO: 1419171 - protein, 8 aa, Mycobacterium tuberculosis
RQGRAGSH

SEQ ID NO: 1419172 - protein, 10 aa, Mycobacterium tuberculosis
RQIPAADASL

SEQ ID NO: 1419173 - protein, 7 aa, Mycobacterium tuberculosis
RQNAEHP

SEQ ID NO: 1419174 - protein, 4 aa, Mycobacterium tuberculosis
RQPA

SEQ ID NO: 1419175 - protein, 6 aa, Mycobacterium tuberculosis
RQRHEA

SEQ ID NO: 1419176 - protein, 4 aa, Mycobacterium tuberculosis
RQVA

SEQ ID NO: 1419177 - protein, 6 aa, Mycobacterium tuberculosis
RQYNPG

SEQ ID NO: 1419178 - protein, 9 aa, Mycobacterium tuberculosis
RRAGGKAQI

SEQ ID NO: 1419179 - protein, 7 aa, Mycobacterium tuberculosis
RRARDLG

SEQ ID NO: 1419180 - protein, 6 aa, Mycobacterium tuberculosis
RRAREL

SEQ ID NO: 1419181 - protein, 13 aa, Mycobacterium tuberculosis
RRASKAPRSNPEA

SEQ ID NO: 1419182 - protein, 17 aa, Mycobacterium tuberculosis
RRDAASDTWQPPTPRRL

SEQ ID NO: 1419183 - protein, 7 aa, Mycobacterium tuberculosis
RRDDAAD

SEQ ID NO: 1419184 - protein, 7 aa, Mycobacterium tuberculosis
RRDKISK

SEQ ID NO: 1419185 - protein, 5 aa, Mycobacterium tuberculosis
RREPE

SEQ ID NO: 1419186 - protein, 6 aa, Mycobacterium tuberculosis
RREPGR

SEQ ID NO: 1419187 - protein, 11 aa, Mycobacterium tuberculosis
RRLAETSTRAT

SEQ ID NO: 1419188 - protein, 5 aa, Mycobacterium tuberculosis
RRQLP

SEQ ID NO: 1419189 - protein, 7 aa, Mycobacterium tuberculosis
RRRAEEA

SEQ ID NO: 1419190 - protein, 9 aa, Mycobacterium tuberculosis
RRRAGDTAA

SEQ ID NO: 1419191 - protein, 7 aa, Mycobacterium tuberculosis
RRRRTSK

SEQ ID NO: 1419192 - protein, 14 aa, Mycobacterium tuberculosis
RRRSAAGPGGNEDS

SEQ ID NO: 1419193 - protein, 14 aa, Mycobacterium tuberculosis
RRTARSASANRGAD

SEQ ID NO: 1419194 - protein, 21 aa, Mycobacterium tuberculosis
RRTDGRGSRPGCPDRRGTPRD

SEQ ID NO: 1419195 - protein, 6 aa, Mycobacterium tuberculosis
RRTEEV

SEQ ID NO: 1419196 - protein, 17 aa, Mycobacterium tuberculosis
RRTRAGDAHTAGQPGRA

SEQ ID NO: 1419197 - protein, 14 aa, Mycobacterium tuberculosis
RRYSPSIEATSKRG

SEQ ID NO: 1419198 - protein, 10 aa, Mycobacterium tuberculosis
RSAQARGVSA

SEQ ID NO: 1419199 - protein, 9 aa, Mycobacterium tuberculosis
RSDAADIDK

SEQ ID NO: 1419200 - protein, 6 aa, Mycobacterium tuberculosis
RSGITG

SEQ ID NO: 1419201 - protein, 13 aa, Mycobacterium tuberculosis
RSGNRTNPSGATM

SEQ ID NO: 1419202 - protein, 8 aa, Mycobacterium tuberculosis
RSGRVGRA

SEQ ID NO: 1419203 - protein, 9 aa, Mycobacterium tuberculosis
RSKTPVPQG

SEQ ID NO: 1419204 - protein, 6 aa, Mycobacterium tuberculosis
RSLPAD

SEQ ID NO: 1419205 - protein, 26 aa, Mycobacterium tuberculosis
RSPRRVDQIPDQGHDGDKSVSGVTIF

SEQ ID NO: 1419206 - protein, 6 aa, Mycobacterium tuberculosis
RSPTGE

SEQ ID NO: 1419207 - protein, 6 aa, Mycobacterium tuberculosis
RSQPGA

SEQ ID NO: 1419208 - protein, 13 aa, Mycobacterium tuberculosis
RSQPNPKARQTIE

SEQ ID NO: 1419209 - protein, 17 aa, Mycobacterium tuberculosis
RSTHDPDQVAAAAAGDA

SEQ ID NO: 1419210 - protein, 8 aa, Mycobacterium tuberculosis
RSVDPSRR

SEQ ID NO: 1419211 - protein, 6 aa, Mycobacterium tuberculosis
RTGKPH

SEQ ID NO: 1419212 - protein, 5 aa, Mycobacterium tuberculosis
RTGQP

SEQ ID NO: 1419213 - protein, 5 aa, Mycobacterium tuberculosis
RTKNA

SEQ ID NO: 1419214 - protein, 8 aa, Mycobacterium tuberculosis
RTLSEETT

SEQ ID NO: 1419215 - protein, 14 aa, Mycobacterium tuberculosis
RTPPNIQPGPGQNP

SEQ ID NO: 1419216 - protein, 7 aa, Mycobacterium tuberculosis
RTPRGAT

SEQ ID NO: 1419217 - protein, 8 aa, Mycobacterium tuberculosis
RTPSDAAL

SEQ ID NO: 1419218 - protein, 5 aa, Mycobacterium tuberculosis
RTRSD

SEQ ID NO: 1419219 - protein, 4 aa, Mycobacterium tuberculosis
RTTA

SEQ ID NO: 1419220 - protein, 4 aa, Mycobacterium tuberculosis
RTTT

SEQ ID NO: 1419221 - protein, 8 aa, Mycobacterium tuberculosis
RVPPTRPA

SEQ ID NO: 1419222 - protein, 15 aa, Mycobacterium tuberculosis
RVQPSGKGGLRPGVD

SEQ ID NO: 1419223 - protein, 7 aa, Mycobacterium tuberculosis
RVRATSS

SEQ ID NO: 1419224 - protein, 8 aa, Mycobacterium tuberculosis
RVRTPTTT

SEQ ID NO: 1419225 - protein, 20 aa, Mycobacterium tuberculosis
RVSEAGGFHDPELESSREQL

SEQ ID NO: 1419226 - protein, 5 aa, Mycobacterium tuberculosis
RYGGS

SEQ ID NO: 1419227 - protein, 8 aa, Mycobacterium tuberculosis
SAAEAAET

SEQ ID NO: 1419228 - protein, 8 aa, Mycobacterium tuberculosis
SADDPLQL

SEQ ID NO: 1419229 - protein, 7 aa, Mycobacterium tuberculosis
SAEDLAA

SEQ ID NO: 1419230 - protein, 4 aa, Mycobacterium tuberculosis
SAEG

SEQ ID NO: 1419231 - protein, 5 aa, Mycobacterium tuberculosis
SAGQI

SEQ ID NO: 1419232 - protein, 7 aa, Mycobacterium tuberculosis
SAGSETL

SEQ ID NO: 1419233 - protein, 22 aa, Mycobacterium tuberculosis
SAGTYAATEAANSSAAASPLSG

SEQ ID NO: 1419234 - protein, 9 aa, Mycobacterium tuberculosis
SAHESGQAT

SEQ ID NO: 1419235 - protein, 17 aa, Mycobacterium tuberculosis
SAIDRHEAAGTTHSAEY

SEQ ID NO: 1419236 - protein, 12 aa, Mycobacterium tuberculosis
SAIEANPRQPRQ

SEQ ID NO: 1419237 - protein, 8 aa, Mycobacterium tuberculosis
SAKQDGRN

SEQ ID NO: 1419238 - protein, 26 aa, Mycobacterium tuberculosis
SALASDGPPKYQRAAKGSVADEAEPR

SEQ ID NO: 1419239 - protein, 18 aa, Mycobacterium tuberculosis
SANLGSANLGSANLGNSN

SEQ ID NO: 1419240 - protein, 8 aa, Mycobacterium tuberculosis
SAPRPPGA

SEQ ID NO: 1419241 - protein, 6 aa, Mycobacterium tuberculosis
SAQAET

SEQ ID NO: 1419242 - protein, 5 aa, Mycobacterium tuberculosis
SARAG

SEQ ID NO: 1419243 - protein, 7 aa, Mycobacterium tuberculosis
SATPELH

SEQ ID NO: 1419244 - protein, 22 aa, Mycobacterium tuberculosis
SAVNQDGASSGVTVPNGPAQQA

SEQ ID NO: 1419245 - protein, 15 aa, Mycobacterium tuberculosis
SAVSTAGAAAAGPTC

SEQ ID NO: 1419246 - protein, 14 aa, Mycobacterium tuberculosis
SAWPENAAPSTADL

SEQ ID NO: 1419247 - protein, 14 aa, Mycobacterium tuberculosis
SAYRGERPPTDITG

SEQ ID NO: 1419248 - protein, 6 aa, Mycobacterium tuberculosis
SDAEPV

SEQ ID NO: 1419249 - protein, 7 aa, Mycobacterium tuberculosis
SDDNVSV

SEQ ID NO: 1419250 - protein, 4 aa, Mycobacterium tuberculosis
SDER

SEQ ID NO: 1419251 - protein, 5 aa, Mycobacterium tuberculosis
SDGGR

SEQ ID NO: 1419252 - protein, 4 aa, Mycobacterium tuberculosis
SDGS

SEQ ID NO: 1419253 - protein, 6 aa, Mycobacterium tuberculosis
SDMTEA

SEQ ID NO: 1419254 - protein, 5 aa, Mycobacterium tuberculosis
SDNPY

SEQ ID NO: 1419255 - protein, 5 aa, Mycobacterium tuberculosis
SDPAV

SEQ ID NO: 1419256 - protein, 18 aa, Mycobacterium tuberculosis
SDSDPASSDAFSADDYTR

SEQ ID NO: 1419257 - protein, 9 aa, Mycobacterium tuberculosis
SEAARRYER

SEQ ID NO: 1419258 - protein, 5 aa, Mycobacterium tuberculosis
SEELK

SEQ ID NO: 1419259 - protein, 9 aa, Mycobacterium tuberculosis
SEESGGSDL

SEQ ID NO: 1419260 - protein, 6 aa, Mycobacterium tuberculosis
SEGDDY

SEQ ID NO: 1419261 - protein, 15 aa, Mycobacterium tuberculosis
SEGGGVYSREQKAIP

SEQ ID NO: 1419262 - protein, 4 aa, Mycobacterium tuberculosis
SEGL

SEQ ID NO: 1419263 - protein, 5 aa, Mycobacterium tuberculosis
SEIAA

SEQ ID NO: 1419264 - protein, 17 aa, Mycobacterium tuberculosis
SEIPETMPDPDTDDEGC

SEQ ID NO: 1419265 - protein, 6 aa, Mycobacterium tuberculosis
SEKGIT

SEQ ID NO: 1419266 - protein, 11 aa, Mycobacterium tuberculosis
SELADQKEKLA

SEQ ID NO: 1419267 - protein, 11 aa, Mycobacterium tuberculosis
SEPGDGVPPAR

SEQ ID NO: 1419268 - protein, 9 aa, Mycobacterium tuberculosis
SEQALAGQA

SEQ ID NO: 1419269 - protein, 15 aa, Mycobacterium tuberculosis
SERYTEKLATPDTSV

SEQ ID NO: 1419270 - protein, 6 aa, Mycobacterium tuberculosis
SEVADL

SEQ ID NO: 1419271 - protein, 11 aa, Mycobacterium tuberculosis
SEVTKYRQGDR

SEQ ID NO: 1419272 - protein, 13 aa, Mycobacterium tuberculosis
SFPNHEANPLDPA

SEQ ID NO: 1419273 - protein, 10 aa, Mycobacterium tuberculosis
SGAATPADAI

SEQ ID NO: 1419274 - protein, 12 aa, Mycobacterium tuberculosis
SGAAYSAASARQ

SEQ ID NO: 1419275 - protein, 8 aa, Mycobacterium tuberculosis
SGAPQTLD

SEQ ID NO: 1419276 - protein, 4 aa, Mycobacterium tuberculosis
SGDI

SEQ ID NO: 1419277 - protein, 9 aa, Mycobacterium tuberculosis
SGDTTKSDN

SEQ ID NO: 1419278 - protein, 13 aa, Mycobacterium tuberculosis
SGESPSTASPESI

SEQ ID NO: 1419279 - protein, 5 aa, Mycobacterium tuberculosis
SGFRP

SEQ ID NO: 1419280 - protein, 4 aa, Mycobacterium tuberculosis
SGIN

SEQ ID NO: 1419281 - protein, 4 aa, Mycobacterium tuberculosis
SGKT

SEQ ID NO: 1419282 - protein, 5 aa, Mycobacterium tuberculosis
SGLPD

SEQ ID NO: 1419283 - protein, 26 aa, Mycobacterium tuberculosis
SGNGNLGIGNSSDANVGIGNSGATVG

SEQ ID NO: 1419284 - protein, 4 aa, Mycobacterium tuberculosis
SGNV

SEQ ID NO: 1419285 - protein, 16 aa, Mycobacterium tuberculosis
SGPGGQKAAIASAKLG

SEQ ID NO: 1419286 - protein, 6 aa, Mycobacterium tuberculosis
SGPRTM

SEQ ID NO: 1419287 - protein, 13 aa, Mycobacterium tuberculosis
SGQAVTASATDHP

SEQ ID NO: 1419288 - protein, 5 aa, Mycobacterium tuberculosis
SGREI

SEQ ID NO: 1419289 - protein, 12 aa, Mycobacterium tuberculosis
SGRISGVTEPGE

SEQ ID NO: 1419290 - protein, 12 aa, Mycobacterium tuberculosis
SGSLGNYNIGSG

SEQ ID NO: 1419291 - protein, 5 aa, Mycobacterium tuberculosis
SGTEL

SEQ ID NO: 1419292 - protein, 38 aa, Mycobacterium tuberculosis
SGTGNIGIGNTGTGNFGIGNSGTSYNTGIGNTGQANTG

SEQ ID NO: 1419293 - protein, 25 aa, Mycobacterium tuberculosis
SGTGNVGFGNSGTANTGFGNAGNVN

SEQ ID NO: 1419294 - protein, 5 aa, Mycobacterium tuberculosis
SGTQL

SEQ ID NO: 1419295 - protein, 13 aa, Mycobacterium tuberculosis
SGTTGRPKGCQLT

SEQ ID NO: 1419296 - protein, 12 aa, Mycobacterium tuberculosis
SGYQETLTDPSY

SEQ ID NO: 1419297 - protein, 4 aa, Mycobacterium tuberculosis
SHHR

SEQ ID NO: 1419298 - protein, 9 aa, Mycobacterium tuberculosis
SHPDDVDTP

SEQ ID NO: 1419299 - protein, 16 aa, Mycobacterium tuberculosis
SIDGRSAAADGSSQWI

SEQ ID NO: 1419300 - protein, 6 aa, Mycobacterium tuberculosis
SIDGTR

SEQ ID NO: 1419301 - protein, 13 aa, Mycobacterium tuberculosis
SIRNQSPLGTRKE

SEQ ID NO: 1419302 - protein, 7 aa, Mycobacterium tuberculosis
SKAGNEH

SEQ ID NO: 1419303 - protein, 11 aa, Mycobacterium tuberculosis
SKEEDEASAER

SEQ ID NO: 1419304 - protein, 11 aa, Mycobacterium tuberculosis
SKGGGENDYER

SEQ ID NO: 1419305 - protein, 4 aa, Mycobacterium tuberculosis
SKIA

SEQ ID NO: 1419306 - protein, 13 aa, Mycobacterium tuberculosis
SKQAIGRATNNVA

SEQ ID NO: 1419307 - protein, 17 aa, Mycobacterium tuberculosis
SKQRQLDREARTGKKVS

SEQ ID NO: 1419308 - protein, 17 aa, Mycobacterium tuberculosis
SKRYGAGQYRYFHAPYP

SEQ ID NO: 1419309 - protein, 7 aa, Mycobacterium tuberculosis
SKTRDAE

SEQ ID NO: 1419310 - protein, 7 aa, Mycobacterium tuberculosis
SLDPRDP

SEQ ID NO: 1419311 - protein, 7 aa, Mycobacterium tuberculosis
SLGQRTG

SEQ ID NO: 1419312 - protein, 8 aa, Mycobacterium tuberculosis
SLLGPDRP

SEQ ID NO: 1419313 - protein, 10 aa, Mycobacterium tuberculosis
SLRPARQRLP

SEQ ID NO: 1419314 - protein, 7 aa, Mycobacterium tuberculosis
SLSDEEK

SEQ ID NO: 1419315 - protein, 11 aa, Mycobacterium tuberculosis
SLSPYGPPVTD

SEQ ID NO: 1419316 - protein, 7 aa, Mycobacterium tuberculosis
SLTENEI

SEQ ID NO: 1419317 - protein, 10 aa, Mycobacterium tuberculosis
SLTTKGTDAI

SEQ ID NO: 1419318 - protein, 4 aa, Mycobacterium tuberculosis
SMPA

SEQ ID NO: 1419319 - protein, 8 aa, Mycobacterium tuberculosis
SNDPTELG

SEQ ID NO: 1419320 - protein, 17 aa, Mycobacterium tuberculosis
SNGDKPKVALPDTQLGS

SEQ ID NO: 1419321 - protein, 9 aa, Mycobacterium tuberculosis
SNGDTAAAP

SEQ ID NO: 1419322 - protein, 6 aa, Mycobacterium tuberculosis
SNLHTG

SEQ ID NO: 1419323 - protein, 4 aa, Mycobacterium tuberculosis
SNNR

SEQ ID NO: 1419324 - protein, 5 aa, Mycobacterium tuberculosis
SNPAI

SEQ ID NO: 1419325 - protein, 4 aa, Mycobacterium tuberculosis
SNPQ

SEQ ID NO: 1419326 - protein, 16 aa, Mycobacterium tuberculosis
SNTRERMSSPVRNNVS

SEQ ID NO: 1419327 - protein, 5 aa, Mycobacterium tuberculosis
SPAKA

SEQ ID NO: 1419328 - protein, 14 aa, Mycobacterium tuberculosis
SPDCGREGSYRDTI

SEQ ID NO: 1419329 - protein, 4 aa, Mycobacterium tuberculosis
SPDE

SEQ ID NO: 1419330 - protein, 5 aa, Mycobacterium tuberculosis
SPESL

SEQ ID NO: 1419331 - protein, 9 aa, Mycobacterium tuberculosis
SPHNRNALS

SEQ ID NO: 1419332 - protein, 8 aa, Mycobacterium tuberculosis
SPIAEGAV

SEQ ID NO: 1419333 - protein, 4 aa, Mycobacterium tuberculosis
SPNV

SEQ ID NO: 1419334 - protein, 4 aa, Mycobacterium tuberculosis
SPSI

SEQ ID NO: 1419335 - protein, 7 aa, Mycobacterium tuberculosis
SPSPIPT

SEQ ID NO: 1419336 - protein, 8 aa, Mycobacterium tuberculosis
SPTLMNSG

SEQ ID NO: 1419337 - protein, 8 aa, Mycobacterium tuberculosis
SPVGRRSG

SEQ ID NO: 1419338 - protein, 6 aa, Mycobacterium tuberculosis
SPVQTL

SEQ ID NO: 1419339 - protein, 8 aa, Mycobacterium tuberculosis
SQQSFEEV

SEQ ID NO: 1419340 - protein, 7 aa, Mycobacterium tuberculosis
SQVSAAS

SEQ ID NO: 1419341 - protein, 9 aa, Mycobacterium tuberculosis
SRDDEASLT

SEQ ID NO: 1419342 - protein, 4 aa, Mycobacterium tuberculosis
SRDR

SEQ ID NO: 1419343 - protein, 16 aa, Mycobacterium tuberculosis
SRGAAYPATQPNGPSI

SEQ ID NO: 1419344 - protein, 4 aa, Mycobacterium tuberculosis
SRGI

SEQ ID NO: 1419345 - protein, 6 aa, Mycobacterium tuberculosis
SRLETT

SEQ ID NO: 1419346 - protein, 4 aa, Mycobacterium tuberculosis
SRLP

SEQ ID NO: 1419347 - protein, 4 aa, Mycobacterium tuberculosis
SRLT

SEQ ID NO: 1419348 - protein, 6 aa, Mycobacterium tuberculosis
SRPKPL

SEQ ID NO: 1419349 - protein, 4 aa, Mycobacterium tuberculosis
SRPL

SEQ ID NO: 1419350 - protein, 10 aa, Mycobacterium tuberculosis
SRSASDEVTV

SEQ ID NO: 1419351 - protein, 5 aa, Mycobacterium tuberculosis
SRSTL

SEQ ID NO: 1419352 - protein, 9 aa, Mycobacterium tuberculosis
SSATGSRLA

SEQ ID NO: 1419353 - protein, 5 aa, Mycobacterium tuberculosis
SSERF

SEQ ID NO: 1419354 - protein, 7 aa, Mycobacterium tuberculosis
SSFSGTE

SEQ ID NO: 1419355 - protein, 5 aa, Mycobacterium tuberculosis
SSIPT

SEQ ID NO: 1419356 - protein, 9 aa, Mycobacterium tuberculosis
SSPNTPGLR

SEQ ID NO: 1419357 - protein, 5 aa, Mycobacterium tuberculosis
SSQGH

SEQ ID NO: 1419358 - protein, 7 aa, Mycobacterium tuberculosis
SSQLEDN

SEQ ID NO: 1419359 - protein, 6 aa, Mycobacterium tuberculosis
SSRKLA

SEQ ID NO: 1419360 - protein, 4 aa, Mycobacterium tuberculosis
SSSH

SEQ ID NO: 1419361 - protein, 4 aa, Mycobacterium tuberculosis
STAN

SEQ ID NO: 1419362 - protein, 10 aa, Mycobacterium tuberculosis
STARLRPAPL

SEQ ID NO: 1419363 - protein, 4 aa, Mycobacterium tuberculosis
STAT

SEQ ID NO: 1419364 - protein, 14 aa, Mycobacterium tuberculosis
STGDSGKGADVDKV

SEQ ID NO: 1419365 - protein, 8 aa, Mycobacterium tuberculosis
STIGTGTK

SEQ ID NO: 1419366 - protein, 10 aa, Mycobacterium tuberculosis
STINPDQPID

SEQ ID NO: 1419367 - protein, 7 aa, Mycobacterium tuberculosis
STPEEVE

SEQ ID NO: 1419368 - protein, 6 aa, Mycobacterium tuberculosis
STVAGA

SEQ ID NO: 1419369 - protein, 5 aa, Mycobacterium tuberculosis
SVADG

SEQ ID NO: 1419370 - protein, 7 aa, Mycobacterium tuberculosis
SVDDPGI

SEQ ID NO: 1419371 - protein, 4 aa, Mycobacterium tuberculosis
SVGA

SEQ ID NO: 1419372 - protein, 6 aa, Mycobacterium tuberculosis
SVQNYP

SEQ ID NO: 1419373 - protein, 12 aa, Mycobacterium tuberculosis
SVRSDGSSMQKK

SEQ ID NO: 1419374 - protein, 9 aa, Mycobacterium tuberculosis
SVSGGHVGR

SEQ ID NO: 1419375 - protein, 8 aa, Mycobacterium tuberculosis
SVTDEYRQ

SEQ ID NO: 1419376 - protein, 12 aa, Mycobacterium tuberculosis
SWPDHSRDQARR

SEQ ID NO: 1419377 - protein, 12 aa, Mycobacterium tuberculosis
SYGGPGTIPGPF

SEQ ID NO: 1419378 - protein, 4 aa, Mycobacterium tuberculosis
SYPA

SEQ ID NO: 1419379 - protein, 4 aa, Mycobacterium tuberculosis
SYSE

SEQ ID NO: 1419380 - protein, 6 aa, Mycobacterium tuberculosis
SYTEGR

SEQ ID NO: 1419381 - protein, 9 aa, Mycobacterium tuberculosis
TAAGSAVSA

SEQ ID NO: 1419382 - protein, 5 aa, Mycobacterium tuberculosis
TAAPE

SEQ ID NO: 1419383 - protein, 9 aa, Mycobacterium tuberculosis
TADDTDPTE

SEQ ID NO: 1419384 - protein, 8 aa, Mycobacterium tuberculosis
TADGLDGD

SEQ ID NO: 1419385 - protein, 8 aa, Mycobacterium tuberculosis
TAEQAPHD

SEQ ID NO: 1419386 - protein, 12 aa, Mycobacterium tuberculosis
TAGAQDARIEEE

SEQ ID NO: 1419387 - protein, 6 aa, Mycobacterium tuberculosis
TAGAQF

SEQ ID NO: 1419388 - protein, 22 aa, Mycobacterium tuberculosis
TAGDLEGADEDAHIADPRAGLP

SEQ ID NO: 1419389 - protein, 5 aa, Mycobacterium tuberculosis
TAGGI

SEQ ID NO: 1419390 - protein, 7 aa, Mycobacterium tuberculosis
TAGLDTA

SEQ ID NO: 1419391 - protein, 6 aa, Mycobacterium tuberculosis
TAGRNH

SEQ ID NO: 1419392 - protein, 4 aa, Mycobacterium tuberculosis
TAGV

SEQ ID NO: 1419393 - protein, 6 aa, Mycobacterium tuberculosis
TAQGTR

SEQ ID NO: 1419394 - protein, 6 aa, Mycobacterium tuberculosis
TASANL

SEQ ID NO: 1419395 - protein, 5 aa, Mycobacterium tuberculosis
TASHH

SEQ ID NO: 1419396 - protein, 7 aa, Mycobacterium tuberculosis
TATDGGV

SEQ ID NO: 1419397 - protein, 5 aa, Mycobacterium tuberculosis
TATER

SEQ ID NO: 1419398 - protein, 9 aa, Mycobacterium tuberculosis
TATSQRKID

SEQ ID NO: 1419399 - protein, 5 aa, Mycobacterium tuberculosis
TAVQA

SEQ ID NO: 1419400 - protein, 8 aa, Mycobacterium tuberculosis
TDAAESRA

SEQ ID NO: 1419401 - protein, 5 aa, Mycobacterium tuberculosis
TDDAA

SEQ ID NO: 1419402 - protein, 4 aa, Mycobacterium tuberculosis
TDDD

SEQ ID NO: 1419403 - protein, 6 aa, Mycobacterium tuberculosis
TDDEAR

SEQ ID NO: 1419404 - protein, 6 aa, Mycobacterium tuberculosis
TDGDSE

SEQ ID NO: 1419405 - protein, 8 aa, Mycobacterium tuberculosis
TDGPMPQT

SEQ ID NO: 1419406 - protein, 8 aa, Mycobacterium tuberculosis
TDHRPVTP

SEQ ID NO: 1419407 - protein, 4 aa, Mycobacterium tuberculosis
TDNR

SEQ ID NO: 1419408 - protein, 7 aa, Mycobacterium tuberculosis
TDPHNSE

SEQ ID NO: 1419409 - protein, 7 aa, Mycobacterium tuberculosis
TEAAQSR

SEQ ID NO: 1419410 - protein, 13 aa, Mycobacterium tuberculosis
TEAGGEPDARYEI

SEQ ID NO: 1419411 - protein, 6 aa, Mycobacterium tuberculosis
TEEQRD

SEQ ID NO: 1419412 - protein, 12 aa, Mycobacterium tuberculosis
TEIKNGQRKQVN

SEQ ID NO: 1419413 - protein, 11 aa, Mycobacterium tuberculosis
TEKQAASWDDL

SEQ ID NO: 1419414 - protein, 6 aa, Mycobacterium tuberculosis
TENQAV

SEQ ID NO: 1419415 - protein, 4 aa, Mycobacterium tuberculosis
TEPE

SEQ ID NO: 1419416 - protein, 5 aa, Mycobacterium tuberculosis
TEPEK

SEQ ID NO: 1419417 - protein, 13 aa, Mycobacterium tuberculosis
TEPGGGSDLQNMS

SEQ ID NO: 1419418 - protein, 9 aa, Mycobacterium tuberculosis
TEVPTGEQA

SEQ ID NO: 1419419 - protein, 6 aa, Mycobacterium tuberculosis
TEVTAT

SEQ ID NO: 1419420 - protein, 11 aa, Mycobacterium tuberculosis
TFAQDGVGGLR

SEQ ID NO: 1419421 - protein, 11 aa, Mycobacterium tuberculosis
TGAAPSMAGPR

SEQ ID NO: 1419422 - protein, 7 aa, Mycobacterium tuberculosis
TGAEEAE

SEQ ID NO: 1419423 - protein, 9 aa, Mycobacterium tuberculosis
TGAGGVSGF

SEQ ID NO: 1419424 - protein, 8 aa, Mycobacterium tuberculosis
TGAGSGIG

SEQ ID NO: 1419425 - protein, 13 aa, Mycobacterium tuberculosis
TGDGAHAARNAPI

SEQ ID NO: 1419426 - protein, 11 aa, Mycobacterium tuberculosis
TGGGDTSPGAA

SEQ ID NO: 1419427 - protein, 6 aa, Mycobacterium tuberculosis
TGGSMT

SEQ ID NO: 1419428 - protein, 20 aa, Mycobacterium tuberculosis
TGKSSSASRAIDTESNLGQY

SEQ ID NO: 1419429 - protein, 9 aa, Mycobacterium tuberculosis
TGLGAEPGE

SEQ ID NO: 1419430 - protein, 5 aa, Mycobacterium tuberculosis
TGNRD

SEQ ID NO: 1419431 - protein, 4 aa, Mycobacterium tuberculosis
TGNT

SEQ ID NO: 1419432 - protein, 12 aa, Mycobacterium tuberculosis
TGPGDVPPQNIR

SEQ ID NO: 1419433 - protein, 5 aa, Mycobacterium tuberculosis
TGPIT

SEQ ID NO: 1419434 - protein, 8 aa, Mycobacterium tuberculosis
TGPKEHAS

SEQ ID NO: 1419435 - protein, 4 aa, Mycobacterium tuberculosis
TGQA

SEQ ID NO: 1419436 - protein, 10 aa, Mycobacterium tuberculosis
TGRPVPAAHP

SEQ ID NO: 1419437 - protein, 4 aa, Mycobacterium tuberculosis
TGSD

SEQ ID NO: 1419438 - protein, 10 aa, Mycobacterium tuberculosis
TGSDEDISRL

SEQ ID NO: 1419439 - protein, 9 aa, Mycobacterium tuberculosis
TGSTTHGAR

SEQ ID NO: 1419440 - protein, 15 aa, Mycobacterium tuberculosis
TGTIAQSGRSGGRPA

SEQ ID NO: 1419441 - protein, 10 aa, Mycobacterium tuberculosis
THAEQGRLSD

SEQ ID NO: 1419442 - protein, 6 aa, Mycobacterium tuberculosis
TIAASD

SEQ ID NO: 1419443 - protein, 5 aa, Mycobacterium tuberculosis
TIDPS

SEQ ID NO: 1419444 - protein, 5 aa, Mycobacterium tuberculosis
TKASD

SEQ ID NO: 1419445 - protein, 7 aa, Mycobacterium tuberculosis
TKKQGND

SEQ ID NO: 1419446 - protein, 8 aa, Mycobacterium tuberculosis
TKLADQVA

SEQ ID NO: 1419447 - protein, 4 aa, Mycobacterium tuberculosis
TKYA

SEQ ID NO: 1419448 - protein, 8 aa, Mycobacterium tuberculosis
TLGGGRSG

SEQ ID NO: 1419449 - protein, 9 aa, Mycobacterium tuberculosis
TLGQPPSED

SEQ ID NO: 1419450 - protein, 4 aa, Mycobacterium tuberculosis
TLRG

SEQ ID NO: 1419451 - protein, 8 aa, Mycobacterium tuberculosis
TLRQGDRA

SEQ ID NO: 1419452 - protein, 10 aa, Mycobacterium tuberculosis
TLRQNSPGAL

SEQ ID NO: 1419453 - protein, 7 aa, Mycobacterium tuberculosis
TMAPESL

SEQ ID NO: 1419454 - protein, 5 aa, Mycobacterium tuberculosis
TMPPD

SEQ ID NO: 1419455 - protein, 7 aa, Mycobacterium tuberculosis
TNAEEGR

SEQ ID NO: 1419456 - protein, 9 aa, Mycobacterium tuberculosis
TNGSQIPRE

SEQ ID NO: 1419457 - protein, 4 aa, Mycobacterium tuberculosis
TNLT

SEQ ID NO: 1419458 - protein, 6 aa, Mycobacterium tuberculosis
TNPKVL

SEQ ID NO: 1419459 - protein, 6 aa, Mycobacterium tuberculosis
TNRPDL

SEQ ID NO: 1419460 - protein, 6 aa, Mycobacterium tuberculosis
TPEERR

SEQ ID NO: 1419461 - protein, 5 aa, Mycobacterium tuberculosis
TPELA

SEQ ID NO: 1419462 - protein, 17 aa, Mycobacterium tuberculosis
TPHSMKAADSKPARTVR

SEQ ID NO: 1419463 - protein, 5 aa, Mycobacterium tuberculosis
TPKLA

SEQ ID NO: 1419464 - protein, 5 aa, Mycobacterium tuberculosis
TPLPL

SEQ ID NO: 1419465 - protein, 11 aa, Mycobacterium tuberculosis
TPPASGPAPFP

SEQ ID NO: 1419466 - protein, 5 aa, Mycobacterium tuberculosis
TPPTV

SEQ ID NO: 1419467 - protein, 9 aa, Mycobacterium tuberculosis
TPQAREAVG

SEQ ID NO: 1419468 - protein, 9 aa, Mycobacterium tuberculosis
TPQKIGEYG

SEQ ID NO: 1419469 - protein, 6 aa, Mycobacterium tuberculosis
TPRPRW

SEQ ID NO: 1419470 - protein, 11 aa, Mycobacterium tuberculosis
TPSPGTPEGPW

SEQ ID NO: 1419471 - protein, 9 aa, Mycobacterium tuberculosis
TPTGDGRVT

SEQ ID NO: 1419472 - protein, 5 aa, Mycobacterium tuberculosis
TPTLK

SEQ ID NO: 1419473 - protein, 13 aa, Mycobacterium tuberculosis
TPWPNGNDHTPKR

SEQ ID NO: 1419474 - protein, 12 aa, Mycobacterium tuberculosis
TQERRAKRAERA

SEQ ID NO: 1419475 - protein, 6 aa, Mycobacterium tuberculosis
TQGWQP

SEQ ID NO: 1419476 - protein, 13 aa, Mycobacterium tuberculosis
TRDRRSQAQEEHG

SEQ ID NO: 1419477 - protein, 25 aa, Mycobacterium tuberculosis
TRGARVPTPQRRRPYRPPPRPNSEA

SEQ ID NO: 1419478 - protein, 4 aa, Mycobacterium tuberculosis
TRGP

SEQ ID NO: 1419479 - protein, 4 aa, Mycobacterium tuberculosis
TRIG

SEQ ID NO: 1419480 - protein, 8 aa, Mycobacterium tuberculosis
TRKPNPHL

SEQ ID NO: 1419481 - protein, 25 aa, Mycobacterium tuberculosis
TRKPPAEPDLAKAGAHSAGGPEPAA

SEQ ID NO: 1419482 - protein, 4 aa, Mycobacterium tuberculosis
TRVD

SEQ ID NO: 1419483 - protein, 8 aa, Mycobacterium tuberculosis
TRYEGPTG

SEQ ID NO: 1419484 - protein, 9 aa, Mycobacterium tuberculosis
TSAAGRGGC

SEQ ID NO: 1419485 - protein, 8 aa, Mycobacterium tuberculosis
TSAPRPRH

SEQ ID NO: 1419486 - protein, 12 aa, Mycobacterium tuberculosis
TSDLSTPAVNSG

SEQ ID NO: 1419487 - protein, 15 aa, Mycobacterium tuberculosis
TSDVGRPKVESAAEA

SEQ ID NO: 1419488 - protein, 7 aa, Mycobacterium tuberculosis
TSGEQRL

SEQ ID NO: 1419489 - protein, 21 aa, Mycobacterium tuberculosis
TSLSGEPKPPPQKKPKLPPPA

SEQ ID NO: 1419490 - protein, 9 aa, Mycobacterium tuberculosis
TSPPKGPNW

SEQ ID NO: 1419491 - protein, 5 aa, Mycobacterium tuberculosis
TSRAG

SEQ ID NO: 1419492 - protein, 9 aa, Mycobacterium tuberculosis
TSTDGIATT

SEQ ID NO: 1419493 - protein, 9 aa, Mycobacterium tuberculosis
TSTTRSEQL

SEQ ID NO: 1419494 - protein, 10 aa, Mycobacterium tuberculosis
TTAGDDLASD

SEQ ID NO: 1419495 - protein, 9 aa, Mycobacterium tuberculosis
TTATNTPFV

SEQ ID NO: 1419496 - protein, 6 aa, Mycobacterium tuberculosis
TTAVRD

SEQ ID NO: 1419497 - protein, 14 aa, Mycobacterium tuberculosis
TTDKASGIAQDPND

SEQ ID NO: 1419498 - protein, 13 aa, Mycobacterium tuberculosis
TTDPAGETPSVGA

SEQ ID NO: 1419499 - protein, 9 aa, Mycobacterium tuberculosis
TTDQSAAKK

SEQ ID NO: 1419500 - protein, 5 aa, Mycobacterium tuberculosis
TTGAH

SEQ ID NO: 1419501 - protein, 6 aa, Mycobacterium tuberculosis
TTGFPK

SEQ ID NO: 1419502 - protein, 5 aa, Mycobacterium tuberculosis
TTGNA

SEQ ID NO: 1419503 - protein, 10 aa, Mycobacterium tuberculosis
TTHNQAGYAR

SEQ ID NO: 1419504 - protein, 8 aa, Mycobacterium tuberculosis
TTLQRPPT

SEQ ID NO: 1419505 - protein, 6 aa, Mycobacterium tuberculosis
TTPLPP

SEQ ID NO: 1419506 - protein, 8 aa, Mycobacterium tuberculosis
TTRTERHR

SEQ ID NO: 1419507 - protein, 6 aa, Mycobacterium tuberculosis
TTSFER

SEQ ID NO: 1419508 - protein, 5 aa, Mycobacterium tuberculosis
TTSGM

SEQ ID NO: 1419509 - protein, 13 aa, Mycobacterium tuberculosis
TTSPNRHAGSTAM

SEQ ID NO: 1419510 - protein, 6 aa, Mycobacterium tuberculosis
TTTDLD

SEQ ID NO: 1419511 - protein, 4 aa, Mycobacterium tuberculosis
TTTF

SEQ ID NO: 1419512 - protein, 13 aa, Mycobacterium tuberculosis
TVASQTRAVGERA

SEQ ID NO: 1419513 - protein, 7 aa, Mycobacterium tuberculosis
TVGRRKE

SEQ ID NO: 1419514 - protein, 12 aa, Mycobacterium tuberculosis
TVGSGDAAISTI

SEQ ID NO: 1419515 - protein, 22 aa, Mycobacterium tuberculosis
TVPFPDSATGARGRQGSPARVA

SEQ ID NO: 1419516 - protein, 9 aa, Mycobacterium tuberculosis
TVPGASPVH

SEQ ID NO: 1419517 - protein, 17 aa, Mycobacterium tuberculosis
TVPPSAPTTKPTDGKPV

SEQ ID NO: 1419518 - protein, 7 aa, Mycobacterium tuberculosis
TVPRGGV

SEQ ID NO: 1419519 - protein, 4 aa, Mycobacterium tuberculosis
TVRD

SEQ ID NO: 1419520 - protein, 7 aa, Mycobacterium tuberculosis
TVRPPEE

SEQ ID NO: 1419521 - protein, 6 aa, Mycobacterium tuberculosis
TVSNDA

SEQ ID NO: 1419522 - protein, 6 aa, Mycobacterium tuberculosis
TVSRSA

SEQ ID NO: 1419523 - protein, 15 aa, Mycobacterium tuberculosis
TWRTRTGLRAKGSKL

SEQ ID NO: 1419524 - protein, 6 aa, Mycobacterium tuberculosis
TYGTNN

SEQ ID NO: 1419525 - protein, 20 aa, Mycobacterium tuberculosis
VAAAPRTPGRDGEVAPSEQG

SEQ ID NO: 1419526 - protein, 6 aa, Mycobacterium tuberculosis
VAAPDR

SEQ ID NO: 1419527 - protein, 10 aa, Mycobacterium tuberculosis
VADQGKRNVT

SEQ ID NO: 1419528 - protein, 21 aa, Mycobacterium tuberculosis
VAEAPKSASERAAESTAPHKV

SEQ ID NO: 1419529 - protein, 8 aa, Mycobacterium tuberculosis
VAERAATA

SEQ ID NO: 1419530 - protein, 12 aa, Mycobacterium tuberculosis
VAPTRGPDAISG

SEQ ID NO: 1419531 - protein, 8 aa, Mycobacterium tuberculosis
VARGDASA

SEQ ID NO: 1419532 - protein, 7 aa, Mycobacterium tuberculosis
VARPAET

SEQ ID NO: 1419533 - protein, 27 aa, Mycobacterium tuberculosis
VARPDTQDALNADRSAKLSRPVTGDEL

SEQ ID NO: 1419534 - protein, 4 aa, Mycobacterium tuberculosis
VASG

SEQ ID NO: 1419535 - protein, 9 aa, Mycobacterium tuberculosis
VASPTAASA

SEQ ID NO: 1419536 - protein, 4 aa, Mycobacterium tuberculosis
VASS

SEQ ID NO: 1419537 - protein, 8 aa, Mycobacterium tuberculosis
VDAGAQDA

SEQ ID NO: 1419538 - protein, 9 aa, Mycobacterium tuberculosis
VDDPHIDRD

SEQ ID NO: 1419539 - protein, 14 aa, Mycobacterium tuberculosis
VDEDGDGSGPGELT

SEQ ID NO: 1419540 - protein, 11 aa, Mycobacterium tuberculosis
VDEGPRESSLE

SEQ ID NO: 1419541 - protein, 8 aa, Mycobacterium tuberculosis
VDGARPHR

SEQ ID NO: 1419542 - protein, 8 aa, Mycobacterium tuberculosis
VDGHDERA

SEQ ID NO: 1419543 - protein, 6 aa, Mycobacterium tuberculosis
VDGKPV

SEQ ID NO: 1419544 - protein, 4 aa, Mycobacterium tuberculosis
VDGS

SEQ ID NO: 1419545 - protein, 15 aa, Mycobacterium tuberculosis
VDHATASVNPPPEVV

SEQ ID NO: 1419546 - protein, 63 aa, Mycobacterium tuberculosis; identical to SEQ ID NO: 190667

SEQ ID NO: 1419547 - protein, 14 aa, Mycobacterium tuberculosis
VDPKPSAGHQGRPR

SEQ ID NO: 1419548 - protein, 11 aa, Mycobacterium tuberculosis
VDQPPQTTRAR

SEQ ID NO: 1419549 - protein, 5 aa, Mycobacterium tuberculosis
VDSAE

SEQ ID NO: 1419550 - protein, 8 aa, Mycobacterium tuberculosis
VEASAASG

SEQ ID NO: 1419551 - protein, 8 aa, Mycobacterium tuberculosis
VENPRPLG

SEQ ID NO: 1419552 - protein, 10 aa, Mycobacterium tuberculosis
VEPPRSPAQM

SEQ ID NO: 1419553 - protein, 7 aa, Mycobacterium tuberculosis
VEREPGR

SEQ ID NO: 1419554 - protein, 31 aa, Mycobacterium tuberculosis
VERRDGPFGDYSQAPPELRPDPTHVITPDGS

SEQ ID NO: 1419555 - protein, 10 aa, Mycobacterium tuberculosis
VERTQRYAPH

SEQ ID NO: 1419556 - protein, 6 aa, Mycobacterium tuberculosis
VESAGT

SEQ ID NO: 1419557 - protein, 5 aa, Mycobacterium tuberculosis
VESQD

SEQ ID NO: 1419558 - protein, 8 aa, Mycobacterium tuberculosis
VETPSQAA

SEQ ID NO: 1419559 - protein, 10 aa, Mycobacterium tuberculosis
VFPQPDRFDP

SEQ ID NO: 1419560 - protein, 5 aa, Mycobacterium tuberculosis
VGAAI

SEQ ID NO: 1419561 - protein, 7 aa, Mycobacterium tuberculosis
VGAATAR

SEQ ID NO: 1419562 - protein, 20 aa, Mycobacterium tuberculosis
VGASGATAGLRKTHDGHHGC

SEQ ID NO: 1419563 - protein, 8 aa, Mycobacterium tuberculosis
VGEGDLAG

SEQ ID NO: 1419564 - protein, 7 aa, Mycobacterium tuberculosis
VGGAASH

SEQ ID NO: 1419565 - protein, 6 aa, Mycobacterium tuberculosis
VGGADT

SEQ ID NO: 1419566 - protein, 8 aa, Mycobacterium tuberculosis
VGGEPRRF

SEQ ID NO: 1419567 - protein, 4 aa, Mycobacterium tuberculosis
VGGH

SEQ ID NO: 1419568 - protein, 5 aa, Mycobacterium tuberculosis
VGGIP

SEQ ID NO: 1419569 - protein, 8 aa, Mycobacterium tuberculosis
VGGNRDHR

SEQ ID NO: 1419570 - protein, 5 aa, Mycobacterium tuberculosis
VGNDR

SEQ ID NO: 1419571 - protein, 12 aa, Mycobacterium tuberculosis
VGNIGNDNIGNA

SEQ ID NO: 1419572 - protein, 4 aa, Mycobacterium tuberculosis
VGPD

SEQ ID NO: 1419573 - protein, 7 aa, Mycobacterium tuberculosis
VGQPATE

SEQ ID NO: 1419574 - protein, 5 aa, Mycobacterium tuberculosis
VGQSE

SEQ ID NO: 1419575 - protein, 5 aa, Mycobacterium tuberculosis
VGSCR

SEQ ID NO: 1419576 - protein, 10 aa, Mycobacterium tuberculosis
VGTDADTGAV

SEQ ID NO: 1419577 - protein, 8 aa, Mycobacterium tuberculosis
VGTDAPLG

SEQ ID NO: 1419578 - protein, 5 aa, Mycobacterium tuberculosis
VGTDS

SEQ ID NO: 1419579 - protein, 14 aa, Mycobacterium tuberculosis
VGTYNKNDGAQDWQ

SEQ ID NO: 1419580 - protein, 6 aa, Mycobacterium tuberculosis
VGYTPY

SEQ ID NO: 1419581 - protein, 6 aa, Mycobacterium tuberculosis
VIRPGE

SEQ ID NO: 1419582 - protein, 12 aa, Mycobacterium tuberculosis
VISGEGGALLVN

SEQ ID NO: 1419583 - protein, 9 aa, Mycobacterium tuberculosis
VKPGKGPAF

SEQ ID NO: 1419584 - protein, 37 aa, Mycobacterium tuberculosis; identical to SEQ ID NO: 191001

SEQ ID NO: 1419585 - protein, 4 aa, Mycobacterium tuberculosis
VNRR

SEQ ID NO: 1419586 - protein, 7 aa, Mycobacterium tuberculosis
VPAHGTA

SEQ ID NO: 1419587 - protein, 4 aa, Mycobacterium tuberculosis
VPDK

SEQ ID NO: 1419588 - protein, 7 aa, Mycobacterium tuberculosis
VPDPAAE

SEQ ID NO: 1419589 - protein, 7 aa, Mycobacterium tuberculosis
VPDQTPV

SEQ ID NO: 1419590 - protein, 6 aa, Mycobacterium tuberculosis
VPDSTD

SEQ ID NO: 1419591 - protein, 5 aa, Mycobacterium tuberculosis
VPERG

SEQ ID NO: 1419592 - protein, 5 aa, Mycobacterium tuberculosis
VPGAD

SEQ ID NO: 1419593 - protein, 8 aa, Mycobacterium tuberculosis
VPGAGGEE

SEQ ID NO: 1419594 - protein, 5 aa, Mycobacterium tuberculosis
VPGGG

SEQ ID NO: 1419595 - protein, 7 aa, Mycobacterium tuberculosis
VPGGGDL

SEQ ID NO: 1419596 - protein, 4 aa, Mycobacterium tuberculosis
VPGL

SEQ ID NO: 1419597 - protein, 7 aa, Mycobacterium tuberculosis
VPGPGLT

SEQ ID NO: 1419598 - protein, 16 aa, Mycobacterium tuberculosis
VPNETNRKKNRQAGLD

SEQ ID NO: 1419599 - protein, 22 aa, Mycobacterium tuberculosis
VPPGDMPGGTAAADAAHTEDKV

SEQ ID NO: 1419600 - protein, 10 aa, Mycobacterium tuberculosis
VPRDYDPAYS

SEQ ID NO: 1419601 - protein, 5 aa, Mycobacterium tuberculosis
VPSDL

SEQ ID NO: 1419602 - protein, 8 aa, Mycobacterium tuberculosis
VPSPGPTR

SEQ ID NO: 1419603 - protein, 6 aa, Mycobacterium tuberculosis
VPSRVS

SEQ ID NO: 1419604 - protein, 4 aa, Mycobacterium tuberculosis
VPTE

SEQ ID NO: 1419605 - protein, 8 aa, Mycobacterium tuberculosis
VPTITGTA

SEQ ID NO: 1419606 - protein, 17 aa, Mycobacterium tuberculosis
VPVAPPAVGGPLSAEPA

SEQ ID NO: 1419607 - protein, 4 aa, Mycobacterium tuberculosis
VQDG

SEQ ID NO: 1419608 - protein, 8 aa, Mycobacterium tuberculosis
VQEKLEPG

SEQ ID NO: 1419609 - protein, 13 aa, Mycobacterium tuberculosis
VQPGVGRVKRGKT

SEQ ID NO: 1419610 - protein, 8 aa, Mycobacterium tuberculosis
VQTATEEF

SEQ ID NO: 1419611 - protein, 15 aa, Mycobacterium tuberculosis
VREQTQRRKQQQRTM

SEQ ID NO: 1419612 - protein, 4 aa, Mycobacterium tuberculosis
VRES

SEQ ID NO: 1419613 - protein, 7 aa, Mycobacterium tuberculosis
VRETGSA

SEQ ID NO: 1419614 - protein, 7 aa, Mycobacterium tuberculosis
VRGPGAA

SEQ ID NO: 1419615 - protein, 4 aa, Mycobacterium tuberculosis
VRPL

SEQ ID NO: 1419616 - protein, 6 aa, Mycobacterium tuberculosis
VRPPVP

SEQ ID NO: 1419617 - protein, 12 aa, Mycobacterium tuberculosis
VSAGGGLGGVGN

SEQ ID NO: 1419618 - protein, 15 aa, Mycobacterium tuberculosis
VSASRSGSVKTSELE

SEQ ID NO: 1419619 - protein, 4 aa, Mycobacterium tuberculosis
VSDG

SEQ ID NO: 1419620 - protein, 7 aa, Mycobacterium tuberculosis
VSEAPGY

SEQ ID NO: 1419621 - protein, 16 aa, Mycobacterium tuberculosis
VSGHVDDATAKGAKVI

SEQ ID NO: 1419622 - protein, 9 aa, Mycobacterium tuberculosis
VSGYDEAAG

SEQ ID NO: 1419623 - protein, 12 aa, Mycobacterium tuberculosis
VSNQHTASRRRV

SEQ ID NO: 1419624 - protein, 8 aa, Mycobacterium tuberculosis
VSPEQAVP

SEQ ID NO: 1419625 - protein, 10 aa, Mycobacterium tuberculosis
VSRGERFDTP

SEQ ID NO: 1419626 - protein, 12 aa, Mycobacterium tuberculosis
VSSADQKSDLDR

SEQ ID NO: 1419627 - protein, 4 aa, Mycobacterium tuberculosis
VTAV

SEQ ID NO: 1419628 - protein, 9 aa, Mycobacterium tuberculosis
VTETAKRLP

SEQ ID NO: 1419629 - protein, 14 aa, Mycobacterium tuberculosis
VTGAGAPDPDSPEL

SEQ ID NO: 1419630 - protein, 7 aa, Mycobacterium tuberculosis
VTGPEAE

SEQ ID NO: 1419631 - protein, 7 aa, Mycobacterium tuberculosis
VTKPYSA

SEQ ID NO: 1419632 - protein, 15 aa, Mycobacterium tuberculosis
VTQETASGNIEKPRI

SEQ ID NO: 1419633 - protein, 9 aa, Mycobacterium tuberculosis
VTRPGQYEA

SEQ ID NO: 1419634 - protein, 7 aa, Mycobacterium tuberculosis
VTSGSKG

SEQ ID NO: 1419635 - protein, 6 aa, Mycobacterium tuberculosis
WAARAG

SEQ ID NO: 1419636 - protein, 10 aa, Mycobacterium tuberculosis
WADPTPAPGW

SEQ ID NO: 1419637 - protein, 9 aa, Mycobacterium tuberculosis
WDGEGPGED

SEQ ID NO: 1419638 - protein, 7 aa, Mycobacterium tuberculosis
WESAASE

SEQ ID NO: 1419639 - protein, 14 aa, Mycobacterium tuberculosis
WPDRPRRRLTTPAE

SEQ ID NO: 1419640 - protein, 4 aa, Mycobacterium tuberculosis
WPED

SEQ ID NO: 1419641 - protein, 20 aa, Mycobacterium tuberculosis
WREKQTSDPPAKKESNGTKM

SEQ ID NO: 1419642 - protein, 6 aa, Mycobacterium tuberculosis
WRESRR

SEQ ID NO: 1419643 - protein, 7 aa, Mycobacterium tuberculosis
WRSSDTA

SEQ ID NO: 1419644 - protein, 6 aa, Mycobacterium tuberculosis
WSPGVG

SEQ ID NO: 1419645 - protein, 7 aa, Mycobacterium tuberculosis
WSQQRGT

SEQ ID NO: 1419646 - protein, 10 aa, Mycobacterium tuberculosis
WSRPPRQVPG

SEQ ID NO: 1419647 - protein, 4 aa, Mycobacterium tuberculosis
WTPA

SEQ ID NO: 1419648 - protein, 8 aa, Mycobacterium tuberculosis
WVPSPTAA

SEQ ID NO: 1419649 - protein, 6 aa, Mycobacterium tuberculosis
YADQVS

SEQ ID NO: 1419650 - protein, 4 aa, Mycobacterium tuberculosis
YARN

SEQ ID NO: 1419651 - protein, 7 aa, Mycobacterium tuberculosis
YARNAQR

SEQ ID NO: 1419652 - protein, 6 aa, Mycobacterium tuberculosis
YDATLS

SEQ ID NO: 1419653 - protein, 12 aa, Mycobacterium tuberculosis
YDPEPGVPGRTD

SEQ ID NO: 1419654 - protein, 11 aa, Mycobacterium tuberculosis
YDSSDKGFDGA

SEQ ID NO: 1419655 - protein, 10 aa, Mycobacterium tuberculosis
YENHGGTGTI

SEQ ID NO: 1419656 - protein, 6 aa, Mycobacterium tuberculosis
YERPKA

SEQ ID NO: 1419657 - protein, 9 aa, Mycobacterium tuberculosis
YGGTEIKYN

SEQ ID NO: 1419658 - protein, 4 aa, Mycobacterium tuberculosis
YGKT

SEQ ID NO: 1419659 - protein, 7 aa, Mycobacterium tuberculosis
YGNEAPK

SEQ ID NO: 1419660 - protein, 7 aa, Mycobacterium tuberculosis
YGPTETT

SEQ ID NO: 1419661 - protein, 13 aa, Mycobacterium tuberculosis
YHDRTQQNTPAWQ

SEQ ID NO: 1419662 - protein, 6 aa, Mycobacterium tuberculosis
YHQSTG

SEQ ID NO: 1419663 - protein, 4 aa, Mycobacterium tuberculosis
YIGG

SEQ ID NO: 1419664 - protein, 4 aa, Mycobacterium tuberculosis
YKSS

SEQ ID NO: 1419665 - protein, 14 aa, Mycobacterium tuberculosis
YNADGSLRKPGQDY

SEQ ID NO: 1419666 - protein, 11 aa, Mycobacterium tuberculosis
YNTGSFNAGSF

SEQ ID NO: 1419667 - protein, 4 aa, Mycobacterium tuberculosis
YPAG

SEQ ID NO: 1419668 - protein, 4 aa, Mycobacterium tuberculosis
YPGT

SEQ ID NO: 1419669 - protein, 19 aa, Mycobacterium tuberculosis
YPNLGEPALPPGDPTSPVR

SEQ ID NO: 1419670 - protein, 24 aa, Mycobacterium tuberculosis
YQGKEAAEAGTGGRGGESGSPSTS

SEQ ID NO: 1419671 - protein, 4 aa, Mycobacterium tuberculosis
YRNP

SEQ ID NO: 1419672 - protein, 5 aa, Mycobacterium tuberculosis
YRPER

SEQ ID NO: 1419673 - protein, 8 aa, Mycobacterium tuberculosis
YRRQDEVG

SEQ ID NO: 1419674 - protein, 9 aa, Mycobacterium tuberculosis
YRTDNGEEF

SEQ ID NO: 1419675 - protein, 20 aa, Mycobacterium tuberculosis
YRVGPDSAGADPGPACYRGG

SEQ ID NO: 1419676 - protein, 5 aa, Mycobacterium tuberculosis
YSCPP

SEQ ID NO: 1419677 - protein, 7 aa, Mycobacterium tuberculosis
YSDTQSL

SEQ ID NO: 1419678 - protein, 4 aa, Mycobacterium tuberculosis
YSGR

SEQ ID NO: 1419679 - protein, 7 aa, Mycobacterium tuberculosis
YSHQPNR

SEQ ID NO: 1419680 - protein, 24 aa, Mycobacterium tuberculosis
YTVTDRSTGGSRQQRAARLGQAQG

SEQ ID NO: 1419681 - protein, 13 aa, Mycobacterium tuberculosis
YVQPPEPENFDPE

SEQ ID NO: 1419682 - protein, 21 aa, Mycobacterium tuberculosis
AAAAAPQAPPKPADTAAAGNG

SEQ ID NO: 1419683 - protein, 11 aa, Mycobacterium tuberculosis
AAAAAPTTTGV

SEQ ID NO: 1419684 - protein, 7 aa, Mycobacterium tuberculosis
AAAAGAE

SEQ ID NO: 1419685 - protein, 7 aa, Mycobacterium tuberculosis
AAAATEK

SEQ ID NO: 1419686 - protein, 6 aa, Mycobacterium tuberculosis
AAAEMR

SEQ ID NO: 1419687 - protein, 12 aa, Mycobacterium tuberculosis
AAAPNLPAPSAQ

SEQ ID NO: 1419688 - protein, 10 aa, Mycobacterium tuberculosis
AAARTGSGVG

SEQ ID NO: 1419689 - protein, 8 aa, Mycobacterium tuberculosis
AAEDLPPQ

SEQ ID NO: 1419690 - protein, 7 aa, Mycobacterium tuberculosis
AAEDPTL

SEQ ID NO: 1419691 - protein, 6 aa, Mycobacterium tuberculosis
AAETAV

SEQ ID NO: 1419692 - protein, 6 aa, Mycobacterium tuberculosis
AAFGSV

SEQ ID NO: 1419693 - protein, 10 aa, Mycobacterium tuberculosis
AAGESGAGVA

SEQ ID NO: 1419694 - protein, 8 aa, Mycobacterium tuberculosis
AAGHDAEQ

SEQ ID NO: 1419695 - protein, 11 aa, Mycobacterium tuberculosis
AAGRAKLDHSY

SEQ ID NO: 1419696 - protein, 7 aa, Mycobacterium tuberculosis
AAGRDAC

SEQ ID NO: 1419697 - protein, 11 aa, Mycobacterium tuberculosis
AALAGDAAGAW

SEQ ID NO: 1419698 - protein, 12 aa, Mycobacterium tuberculosis
AANAAAAAPTAG

SEQ ID NO: 1419699 - protein, 21 aa, Mycobacterium tuberculosis
AAPAPEHQPGARASDCGAGPI

SEQ ID NO: 1419700 - protein, 7 aa, Mycobacterium tuberculosis
AAPDRQR

SEQ ID NO: 1419701 - protein, 7 aa, Mycobacterium tuberculosis
AAPLDRQ

SEQ ID NO: 1419702 - protein, 4 aa, Mycobacterium tuberculosis
AAQA

SEQ ID NO: 1419703 - protein, 4 aa, Mycobacterium tuberculosis
AAQQ

SEQ ID NO: 1419704 - protein, 13 aa, Mycobacterium tuberculosis
AAQRPTAGPPTEL

SEQ ID NO: 1419705 - protein, 5 aa, Mycobacterium tuberculosis
AARDA

SEQ ID NO: 1419706 - protein, 6 aa, Mycobacterium tuberculosis
AARQTK

SEQ ID NO: 1419707 - protein, 15 aa, Mycobacterium tuberculosis
AARRAQRAHPAGAPE

SEQ ID NO: 1419708 - protein, 5 aa, Mycobacterium tuberculosis
AARSA

SEQ ID NO: 1419709 - protein, 11 aa, Mycobacterium tuberculosis
AARSAHAGNDA

SEQ ID NO: 1419710 - protein, 9 aa, Mycobacterium tuberculosis
AASKTAQEH

SEQ ID NO: 1419711 - protein, 10 aa, Mycobacterium tuberculosis
AASPQDIQDA

SEQ ID NO: 1419712 - protein, 4 aa, Mycobacterium tuberculosis
AATR

SEQ ID NO: 1419713 - protein, 9 aa, Mycobacterium tuberculosis
AATRTSMEA

SEQ ID NO: 1419714 - protein, 12 aa, Mycobacterium tuberculosis
AAVDEDAEAPGA

SEQ ID NO: 1419715 - protein, 5 aa, Mycobacterium tuberculosis
ADAPD

SEQ ID NO: 1419716 - protein, 6 aa, Mycobacterium tuberculosis
ADASNL

SEQ ID NO: 1419717 - protein, 7 aa, Mycobacterium tuberculosis
ADDAQPK

SEQ ID NO: 1419718 - protein, 5 aa, Mycobacterium tuberculosis
ADDGR

SEQ ID NO: 1419719 - protein, 7 aa, Mycobacterium tuberculosis
ADEGVAQ

SEQ ID NO: 1419720 - protein, 8 aa, Mycobacterium tuberculosis
ADEPLEGG

SEQ ID NO: 1419721 - protein, 6 aa, Mycobacterium tuberculosis
ADEQRS

SEQ ID NO: 1419722 - protein, 21 aa, Mycobacterium tuberculosis
ADFRQPGHAEFEDRAATDPLE

SEQ ID NO: 1419723 - protein, 15 aa, Mycobacterium tuberculosis
ADGDGGNRGRQSRVR

SEQ ID NO: 1419724 - protein, 7 aa, Mycobacterium tuberculosis
ADGGEEL

SEQ ID NO: 1419725 - protein, 7 aa, Mycobacterium tuberculosis
ADGKTER

SEQ ID NO: 1419726 - protein, 6 aa, Mycobacterium tuberculosis
ADGQPV

SEQ ID NO: 1419727 - protein, 7 aa, Mycobacterium tuberculosis
ADGSLAP

SEQ ID NO: 1419728 - protein, 4 aa, Mycobacterium tuberculosis
ADLA

SEQ ID NO: 1419729 - protein, 7 aa, Mycobacterium tuberculosis
ADLSTPI

SEQ ID NO: 1419730 - protein, 12 aa, Mycobacterium tuberculosis
ADPGRIDETGRR

SEQ ID NO: 1419731 - protein, 7 aa, Mycobacterium tuberculosis
ADPKTEL

SEQ ID NO: 1419732 - protein, 11 aa, Mycobacterium tuberculosis
ADPQTAAQLGE

SEQ ID NO: 1419733 - protein, 8 aa, Mycobacterium tuberculosis
ADRAAAIE

SEQ ID NO: 1419734 - protein, 10 aa, Mycobacterium tuberculosis
ADRAKPAVPF

SEQ ID NO: 1419735 - protein, 9 aa, Mycobacterium tuberculosis
ADSNGPHGM

SEQ ID NO: 1419736 - protein, 16 aa, Mycobacterium tuberculosis
ADVPSAEQRRAQRQRD

SEQ ID NO: 1419737 - protein, 17 aa, Mycobacterium tuberculosis
AEADADIASGRTYGEDE

SEQ ID NO: 1419738 - protein, 11 aa, Mycobacterium tuberculosis
AEASLEQAQEN

SEQ ID NO: 1419739 - protein, 7 aa, Mycobacterium tuberculosis
AEAVAGQ

SEQ ID NO: 1419740 - protein, 7 aa, Mycobacterium tuberculosis
AEDREIP

SEQ ID NO: 1419741 - protein, 4 aa, Mycobacterium tuberculosis
AEEA

SEQ ID NO: 1419742 - protein, 5 aa, Mycobacterium tuberculosis
AEEDV

SEQ ID NO: 1419743 - protein, 7 aa, Mycobacterium tuberculosis
AEETGIR

SEQ ID NO: 1419744 - protein, 8 aa, Mycobacterium tuberculosis
AEHARESA

SEQ ID NO: 1419745 - protein, 9 aa, Mycobacterium tuberculosis
AEKSSSEPI

SEQ ID NO: 1419746 - protein, 10 aa, Mycobacterium tuberculosis
AELAGEPRPR

SEQ ID NO: 1419747 - protein, 8 aa, Mycobacterium tuberculosis
AELGYGSD

SEQ ID NO: 1419748 - protein, 6 aa, Mycobacterium tuberculosis
AELQNG

SEQ ID NO: 1419749 - protein, 9 aa, Mycobacterium tuberculosis
AEPDAESPH

SEQ ID NO: 1419750 - protein, 7 aa, Mycobacterium tuberculosis
AEPTNSA

SEQ ID NO: 1419751 - protein, 7 aa, Mycobacterium tuberculosis
AESLNAS

SEQ ID NO: 1419752 - protein, 5 aa, Mycobacterium tuberculosis
AFARE

SEQ ID NO: 1419753 - protein, 7 aa, Mycobacterium tuberculosis
AFRGGAD

SEQ ID NO: 1419754 - protein, 8 aa, Mycobacterium tuberculosis
AGAAGVGN

SEQ ID NO: 1419755 - protein, 9 aa, Mycobacterium tuberculosis
AGAKQIDGS

SEQ ID NO: 1419756 - protein, 6 aa, Mycobacterium tuberculosis
AGAPEH

SEQ ID NO: 1419757 - protein, 13 aa, Mycobacterium tuberculosis
AGARQADAQVRSS

SEQ ID NO: 1419758 - protein, 13 aa, Mycobacterium tuberculosis
AGARVGAGYGPGH

SEQ ID NO: 1419759 - protein, 4 aa, Mycobacterium tuberculosis
AGDA

SEQ ID NO: 1419760 - protein, 9 aa, Mycobacterium tuberculosis
AGDGPSRRF

SEQ ID NO: 1419761 - protein, 10 aa, Mycobacterium tuberculosis
AGDPAAAAAT

SEQ ID NO: 1419762 - protein, 9 aa, Mycobacterium tuberculosis
AGDSAGGTI

SEQ ID NO: 1419763 - protein, 15 aa, Mycobacterium tuberculosis
AGDSNTGFANAGNVN

SEQ ID NO: 1419764 - protein, 8 aa, Mycobacterium tuberculosis
AGELSANG

SEQ ID NO: 1419765 - protein, 4 aa, Mycobacterium tuberculosis
AGFR

SEQ ID NO: 1419766 - protein, 6 aa, Mycobacterium tuberculosis
AGGHTL

SEQ ID NO: 1419767 - protein, 5 aa, Mycobacterium tuberculosis
AGHTG

SEQ ID NO: 1419768 - protein, 4 aa, Mycobacterium tuberculosis
AGIK

SEQ ID NO: 1419769 - protein, 11 aa, Mycobacterium tuberculosis
AGNAKGHGRHI

SEQ ID NO: 1419770 - protein, 19 aa, Mycobacterium tuberculosis
AGNPGDPGGFGAAGADGLP

SEQ ID NO: 1419771 - protein, 8 aa, Mycobacterium tuberculosis
AGPGSGPM

SEQ ID NO: 1419772 - protein, 8 aa, Mycobacterium tuberculosis
AGPRLGKD

SEQ ID NO: 1419773 - protein, 12 aa, Mycobacterium tuberculosis
AGQHPDPTTNAR

SEQ ID NO: 1419774 - protein, 7 aa, Mycobacterium tuberculosis
AGRDGLP

SEQ ID NO: 1419775 - protein, 4 aa, Mycobacterium tuberculosis
AGRG

SEQ ID NO: 1419776 - protein, 22 aa, Mycobacterium tuberculosis
AGRIEARTDPWDPATEPGAEDF

SEQ ID NO: 1419777 - protein, 9 aa, Mycobacterium tuberculosis
AGRPTRANF

SEQ ID NO: 1419778 - protein, 5 aa, Mycobacterium tuberculosis
AGSTS

SEQ ID NO: 1419779 - protein, 25 aa, Mycobacterium tuberculosis
AGSYNTGSFNAGEANTGGFNPGSVN

SEQ ID NO: 1419780 - protein, 17 aa, Mycobacterium tuberculosis
AGTASNETVAAPAGLTT

SEQ ID NO: 1419781 - protein, 4 aa, Mycobacterium tuberculosis
AGTL

SEQ ID NO: 1419782 - protein, 18 aa, Mycobacterium tuberculosis
AGTPAGSRRAQPAADNVT

SEQ ID NO: 1419783 - protein, 7 aa, Mycobacterium tuberculosis
AGWQGGE

SEQ ID NO: 1419784 - protein, 6 aa, Mycobacterium tuberculosis
AHAPPE

SEQ ID NO: 1419785 - protein, 13 aa, Mycobacterium tuberculosis
AHGPVEQRSERQL

SEQ ID NO: 1419786 - protein, 5 aa, Mycobacterium tuberculosis
AHKRK

SEQ ID NO: 1419787 - protein, 11 aa, Mycobacterium tuberculosis
AIAAQSDASYT

SEQ ID NO: 1419788 - protein, 7 aa, Mycobacterium tuberculosis
AIDSDRW

SEQ ID NO: 1419789 - protein, 6 aa, Mycobacterium tuberculosis
AIGRPR

SEQ ID NO: 1419790 - protein, 9 aa, Mycobacterium tuberculosis
AIPADPNGR

SEQ ID NO: 1419791 - protein, 15 aa, Mycobacterium tuberculosis
AKGYRNPVSPDPFAE

SEQ ID NO: 1419792 - protein, 15 aa, Mycobacterium tuberculosis
AKNTDTREHDIADSD

SEQ ID NO: 1419793 - protein, 8 aa, Mycobacterium tuberculosis
AKTEAAAG

SEQ ID NO: 1419794 - protein, 6 aa, Mycobacterium tuberculosis
AKYPGT

SEQ ID NO: 1419795 - protein, 6 aa, Mycobacterium tuberculosis
ALAPDR

SEQ ID NO: 1419796 - protein, 9 aa, Mycobacterium tuberculosis
ALDGTERAR

SEQ ID NO: 1419797 - protein, 13 aa, Mycobacterium tuberculosis
ALDHAARDRNIRR

SEQ ID NO: 1419798 - protein, 8 aa, Mycobacterium tuberculosis
ALDPGKLP

SEQ ID NO: 1419799 - protein, 11 aa, Mycobacterium tuberculosis
ALETQKADPLA

SEQ ID NO: 1419800 - protein, 4 aa, Mycobacterium tuberculosis
ALPA

SEQ ID NO: 1419801 - protein, 13 aa, Mycobacterium tuberculosis
ALPATPIADSADD

SEQ ID NO: 1419802 - protein, 5 aa, Mycobacterium tuberculosis
AMPGQ

SEQ ID NO: 1419803 - protein, 15 aa, Mycobacterium tuberculosis
AMSNGRTDSRFTEAK

SEQ ID NO: 1419804 - protein, 5 aa, Mycobacterium tuberculosis
ANEAG

SEQ ID NO: 1419805 - protein, 5 aa, Mycobacterium tuberculosis
ANLPG

SEQ ID NO: 1419806 - protein, 5 aa, Mycobacterium tuberculosis
ANQQA

SEQ ID NO: 1419807 - protein, 14 aa, Mycobacterium tuberculosis
ANRDERQYGPDAAE

SEQ ID NO: 1419808 - protein, 11 aa, Mycobacterium tuberculosis
ANSAHSDADHQ

SEQ ID NO: 1419809 - protein, 8 aa, Mycobacterium tuberculosis
ANTGNGNI

SEQ ID NO: 1419810 - protein, 8 aa, Mycobacterium tuberculosis
ANTGSNNL

SEQ ID NO: 1419811 - protein, 27 aa, Mycobacterium tuberculosis
ANTGVGNAGNYNTGSYNPGNSNTGGFN

SEQ ID NO: 1419812 - protein, 8 aa, Mycobacterium tuberculosis
APAAVGAA

SEQ ID NO: 1419813 - protein, 12 aa, Mycobacterium tuberculosis
APADGPDDAALE

SEQ ID NO: 1419814 - protein, 11 aa, Mycobacterium tuberculosis
APAPEDGADVD

SEQ ID NO: 1419815 - protein, 31 aa, Mycobacterium tuberculosis
APAVATAPAVSPATTSAVAAESGSTPATKAQ

SEQ ID NO: 1419816 - protein, 5 aa, Mycobacterium tuberculosis
APDID

SEQ ID NO: 1419817 - protein, 6 aa, Mycobacterium tuberculosis
APFSAA

SEQ ID NO: 1419818 - protein, 10 aa, Mycobacterium tuberculosis
APGCDRPATQ

SEQ ID NO: 1419819 - protein, 4 aa, Mycobacterium tuberculosis
APGW

SEQ ID NO: 1419820 - protein, 12 aa, Mycobacterium tuberculosis
APKAAANSADDE

SEQ ID NO: 1419821 - protein, 10 aa, Mycobacterium tuberculosis
APKSAKSLSL

SEQ ID NO: 1419822 - protein, 4 aa, Mycobacterium tuberculosis
APLG

SEQ ID NO: 1419823 - protein, 5 aa, Mycobacterium tuberculosis
APMGG

SEQ ID NO: 1419824 - protein, 8 aa, Mycobacterium tuberculosis
APNALTST

SEQ ID NO: 1419825 - protein, 6 aa, Mycobacterium tuberculosis
APNGPM

SEQ ID NO: 1419826 - protein, 13 aa, Mycobacterium tuberculosis
APPAVPEERSGFR

SEQ ID NO: 1419827 - protein, 6 aa, Mycobacterium tuberculosis
APPGRA

SEQ ID NO: 1419828 - protein, 6 aa, Mycobacterium tuberculosis
APRGKL

SEQ ID NO: 1419829 - protein, 7 aa, Mycobacterium tuberculosis
APRRRHA

SEQ ID NO: 1419830 - protein, 8 aa, Mycobacterium tuberculosis
APTAAQAS

SEQ ID NO: 1419831 - protein, 9 aa, Mycobacterium tuberculosis
APTDRIGAD

SEQ ID NO: 1419832 - protein, 27 aa, Mycobacterium tuberculosis
APVTTSPAALAGQAAATVSSTVPPLAT

SEQ ID NO: 1419833 - protein, 28 aa, Mycobacterium tuberculosis
AQAASQATGAAHPGGEPGGAHPGSADDV

SEQ ID NO: 1419834 - protein, 5 aa, Mycobacterium tuberculosis
AQATV

SEQ ID NO: 1419835 - protein, 9 aa, Mycobacterium tuberculosis
AQDTDPRTC

SEQ ID NO: 1419836 - protein, 6 aa, Mycobacterium tuberculosis
AQEDLD

SEQ ID NO: 1419837 - protein, 11 aa, Mycobacterium tuberculosis
AQNTKDAGGTR

SEQ ID NO: 1419838 - protein, 6 aa, Mycobacterium tuberculosis
AQPKYV

SEQ ID NO: 1419839 - protein, 11 aa, Mycobacterium tuberculosis
AQPPVGTRARE

SEQ ID NO: 1419840 - protein, 14 aa, Mycobacterium tuberculosis
AQRKSDLRAAEDPI

SEQ ID NO: 1419841 - protein, 14 aa, Mycobacterium tuberculosis
AQTGPTAKLSSAPM

SEQ ID NO: 1419842 - protein, 6 aa, Mycobacterium tuberculosis
AQTPYH

SEQ ID NO: 1419843 - protein, 7 aa, Mycobacterium tuberculosis
ARAAATR

SEQ ID NO: 1419844 - protein, 15 aa, Mycobacterium tuberculosis
ARADATRVRSGADRA

SEQ ID NO: 1419845 - protein, 9 aa, Mycobacterium tuberculosis
ARAGDVQAG

SEQ ID NO: 1419846 - protein, 19 aa, Mycobacterium tuberculosis
ARDAATAAASARQRGRGDA

SEQ ID NO: 1419847 - protein, 13 aa, Mycobacterium tuberculosis
AREAARSRELAAQ

SEQ ID NO: 1419848 - protein, 7 aa, Mycobacterium tuberculosis
ARELAGD

SEQ ID NO: 1419849 - protein, 6 aa, Mycobacterium tuberculosis
ARFPTA

SEQ ID NO: 1419850 - protein, 17 aa, Mycobacterium tuberculosis
ARGASSAASAASATIDA

SEQ ID NO: 1419851 - protein, 7 aa, Mycobacterium tuberculosis
ARGCPGQ

SEQ ID NO: 1419852 - protein, 10 aa, Mycobacterium tuberculosis
ARGGTTATYA

SEQ ID NO: 1419853 - protein, 11 aa, Mycobacterium tuberculosis
ARGYRGRPELT

SEQ ID NO: 1419854 - protein, 24 aa, Mycobacterium tuberculosis
ARHSEETPVTKGKRTFQPNNRRRA

SEQ ID NO: 1419855 - protein, 15 aa, Mycobacterium tuberculosis
ARIGPGAAAKRDPQL

SEQ ID NO: 1419856 - protein, 7 aa, Mycobacterium tuberculosis
ARKHPHS

SEQ ID NO: 1419857 - protein, 7 aa, Mycobacterium tuberculosis
ARPTYAG

SEQ ID NO: 1419858 - protein, 6 aa, Mycobacterium tuberculosis
ARRARQ

SEQ ID NO: 1419859 - protein, 15 aa, Mycobacterium tuberculosis
ARRPVQRQSARAGDP

SEQ ID NO: 1419860 - protein, 14 aa, Mycobacterium tuberculosis
ARSGKSVAADAATS

SEQ ID NO: 1419861 - protein, 8 aa, Mycobacterium tuberculosis
ARTGETLT

SEQ ID NO: 1419862 - protein, 13 aa, Mycobacterium tuberculosis
ARTLGTDAVDEAG

SEQ ID NO: 1419863 - protein, 8 aa, Mycobacterium tuberculosis
ARTPEETA

SEQ ID NO: 1419864 - protein, 7 aa, Mycobacterium tuberculosis
ARTREQF

SEQ ID NO: 1419865 - protein, 5 aa, Mycobacterium tuberculosis
ARVSA

SEQ ID NO: 1419866 - protein, 12 aa, Mycobacterium tuberculosis
ASAATSPGPTPA

SEQ ID NO: 1419867 - protein, 9 aa, Mycobacterium tuberculosis
ASADADNPC

SEQ ID NO: 1419868 - protein, 7 aa, Mycobacterium tuberculosis
ASAESRS

SEQ ID NO: 1419869 - protein, 26 aa, Mycobacterium tuberculosis
ASENGVPVTARGSGCGLSGAARPVEG

SEQ ID NO: 1419870 - protein, 7 aa, Mycobacterium tuberculosis
ASGSRMR

SEQ ID NO: 1419871 - protein, 6 aa, Mycobacterium tuberculosis
ASHRNM

SEQ ID NO: 1419872 - protein, 6 aa, Mycobacterium tuberculosis
ASLPDA

SEQ ID NO: 1419873 - protein, 7 aa, Mycobacterium tuberculosis
ASLPSGG

SEQ ID NO: 1419874 - protein, 7 aa, Mycobacterium tuberculosis
ASPLADG

SEQ ID NO: 1419875 - protein, 17 aa, Mycobacterium tuberculosis
ASPQNVDAYSGTGNAHS

SEQ ID NO: 1419876 - protein, 5 aa, Mycobacterium tuberculosis
ASPRQ

SEQ ID NO: 1419877 - protein, 10 aa, Mycobacterium tuberculosis
ASRGARGPYR

SEQ ID NO: 1419878 - protein, 11 aa, Mycobacterium tuberculosis
ASSAQSHDEQL

SEQ ID NO: 1419879 - protein, 32 aa, Mycobacterium tuberculosis
ASSFGSVTSELAGGAWQGPASAAMANAAGPYA

SEQ ID NO: 1419880 - protein, 5 aa, Mycobacterium tuberculosis
ASVGP

SEQ ID NO: 1419881 - protein, 6 aa, Mycobacterium tuberculosis
ASVSKR

SEQ ID NO: 1419882 - protein, 8 aa, Mycobacterium tuberculosis
ATAAARHG

SEQ ID NO: 1419883 - protein, 7 aa, Mycobacterium tuberculosis
ATDEQLE

SEQ ID NO: 1419884 - protein, 7 aa, Mycobacterium tuberculosis
ATDEVGQ

SEQ ID NO: 1419885 - protein, 5 aa, Mycobacterium tuberculosis
ATEDR

SEQ ID NO: 1419886 - protein, 13 aa, Mycobacterium tuberculosis
ATEYVSGPSARSY

SEQ ID NO: 1419887 - protein, 4 aa, Mycobacterium tuberculosis
ATGA

SEQ ID NO: 1419888 - protein, 10 aa, Mycobacterium tuberculosis
ATGDGATAVR

SEQ ID NO: 1419889 - protein, 22 aa, Mycobacterium tuberculosis
ATGMIGDPRDVGERSLNEADTV

SEQ ID NO: 1419890 - protein, 8 aa, Mycobacterium tuberculosis
ATGSTETG

SEQ ID NO: 1419891 - protein, 5 aa, Mycobacterium tuberculosis
ATHHE

SEQ ID NO: 1419892 - protein, 8 aa, Mycobacterium tuberculosis
ATKLTGYT

SEQ ID NO: 1419893 - protein, 13 aa, Mycobacterium tuberculosis
ATLRGRDTRSISR

SEQ ID NO: 1419894 - protein, 10 aa, Mycobacterium tuberculosis
ATPGSWRREP

SEQ ID NO: 1419895 - protein, 7 aa, Mycobacterium tuberculosis
ATQESEM

SEQ ID NO: 1419896 - protein, 28 aa, Mycobacterium tuberculosis
ATRRNTELEGTRSTAATRADQNDYARGK

SEQ ID NO: 1419897 - protein, 7 aa, Mycobacterium tuberculosis
ATSAETI

SEQ ID NO: 1419898 - protein, 8 aa, Mycobacterium tuberculosis
ATSAVRPQ

SEQ ID NO: 1419899 - protein, 18 aa, Mycobacterium tuberculosis
ATYAPAPQRFEAGTPMTS

SEQ ID NO: 1419900 - protein, 6 aa, Mycobacterium tuberculosis
AVDEEL

SEQ ID NO: 1419901 - protein, 20 aa, Mycobacterium tuberculosis
AVRRTGSGETITPSFVLPMD

SEQ ID NO: 1419902 - protein, 9 aa, Mycobacterium tuberculosis
AVRSDQPGH

SEQ ID NO: 1419903 - protein, 7 aa, Mycobacterium tuberculosis
AYASTTA

SEQ ID NO: 1419904 - protein, 12 aa, Mycobacterium tuberculosis
AYERGRPSYPPE

SEQ ID NO: 1419905 - protein, 5 aa, Mycobacterium tuberculosis
AYSGY

SEQ ID NO: 1419906 - protein, 14 aa, Mycobacterium tuberculosis
AYSQAASGRLPDPL

SEQ ID NO: 1419907 - protein, 20 aa, Mycobacterium tuberculosis
AYYSGPDEGPASPAERPPYR

SEQ ID NO: 1419908 - protein, 6 aa, Mycobacterium tuberculosis
CEEADR

SEQ ID NO: 1419909 - protein, 5 aa, Mycobacterium tuberculosis
CPAPG

SEQ ID NO: 1419910 - protein, 6 aa, Mycobacterium tuberculosis
CPLNDG

SEQ ID NO: 1419911 - protein, 5 aa, Mycobacterium tuberculosis
CQTER

SEQ ID NO: 1419912 - protein, 12 aa, Mycobacterium tuberculosis
CRGGAPGTRETD

SEQ ID NO: 1419913 - protein, 10 aa, Mycobacterium tuberculosis
CRSTDPRKSE

SEQ ID NO: 1419914 - protein, 4 aa, Mycobacterium tuberculosis
CRTP

SEQ ID NO: 1419915 - protein, 13 aa, Mycobacterium tuberculosis
CSRSAGSSVRMGR

SEQ ID NO: 1419916 - protein, 8 aa, Mycobacterium tuberculosis
CTPSAEAN

SEQ ID NO: 1419917 - protein, 6 aa, Mycobacterium tuberculosis
DAADGY

SEQ ID NO: 1419918 - protein, 7 aa, Mycobacterium tuberculosis
DAHRKAH

SEQ ID NO: 1419919 - protein, 11 aa, Mycobacterium tuberculosis
DAHRPTKSAAK

SEQ ID NO: 1419920 - protein, 11 aa, Mycobacterium tuberculosis
DANASIPTPQP

SEQ ID NO: 1419921 - protein, 10 aa, Mycobacterium tuberculosis
DANPDRGTLS

SEQ ID NO: 1419922 - protein, 10 aa, Mycobacterium tuberculosis
DAPGGGLGGS

SEQ ID NO: 1419923 - protein, 7 aa, Mycobacterium tuberculosis
DAPLESD

SEQ ID NO: 1419924 - protein, 5 aa, Mycobacterium tuberculosis
DASDL

SEQ ID NO: 1419925 - protein, 6 aa, Mycobacterium tuberculosis
DAYRPT

SEQ ID NO: 1419926 - protein, 7 aa, Mycobacterium tuberculosis
DDDTGEL

SEQ ID NO: 1419927 - protein, 11 aa, Mycobacterium tuberculosis
DDGQEQRAQGA

SEQ ID NO: 1419928 - protein, 4 aa, Mycobacterium tuberculosis
DDMS

SEQ ID NO: 1419929 - protein, 9 aa, Mycobacterium tuberculosis
DDPADAEVA

SEQ ID NO: 1419930 - protein, 6 aa, Mycobacterium tuberculosis
DEASNR

SEQ ID NO: 1419931 - protein, 6 aa, Mycobacterium tuberculosis
DEDVER

SEQ ID NO: 1419932 - protein, 8 aa, Mycobacterium tuberculosis
DEGSRTRS

SEQ ID NO: 1419933 - protein, 8 aa, Mycobacterium tuberculosis
DEPSPRVD

SEQ ID NO: 1419934 - protein, 4 aa, Mycobacterium tuberculosis
DEVG

SEQ ID NO: 1419935 - protein, 7 aa, Mycobacterium tuberculosis
DEVGRGA

SEQ ID NO: 1419936 - protein, 10 aa, Mycobacterium tuberculosis
DGAAESDLAG

SEQ ID NO: 1419937 - protein, 11 aa, Mycobacterium tuberculosis
DGAYGEAKSAL

SEQ ID NO: 1419938 - protein, 26 aa, Mycobacterium tuberculosis
DGCDVGMDSGSPVSPDYAPGSNAFNG

SEQ ID NO: 1419939 - protein, 9 aa, Mycobacterium tuberculosis
DGCSAGGTD

SEQ ID NO: 1419940 - protein, 20 aa, Mycobacterium tuberculosis
DGGAGGAALSAGSAGRGGDA

SEQ ID NO: 1419941 - protein, 5 aa, Mycobacterium tuberculosis
DGGAH

SEQ ID NO: 1419942 - protein, 6 aa, Mycobacterium tuberculosis
DGKTQA

SEQ ID NO: 1419943 - protein, 8 aa, Mycobacterium tuberculosis
DGRCVPGA

SEQ ID NO: 1419944 - protein, 5 aa, Mycobacterium tuberculosis
DGRYS

SEQ ID NO: 1419945 - protein, 9 aa, Mycobacterium tuberculosis
DGSDSSMRA

SEQ ID NO: 1419946 - protein, 5 aa, Mycobacterium tuberculosis
DGTQT

SEQ ID NO: 1419947 - protein, 5 aa, Mycobacterium tuberculosis
DGTRR

SEQ ID NO: 1419948 - protein, 5 aa, Mycobacterium tuberculosis
DHAAA

SEQ ID NO: 1419949 - protein, 8 aa, Mycobacterium tuberculosis
DHGGASMA

SEQ ID NO: 1419950 - protein, 12 aa, Mycobacterium tuberculosis
DISPQDAAHRRV

SEQ ID NO: 1419951 - protein, 28 aa, Mycobacterium tuberculosis
DITRYRNADETKKGLDHNARNDPRNPSP

SEQ ID NO: 1419952 - protein, 12 aa, Mycobacterium tuberculosis
DKPISKSDAVEG

SEQ ID NO: 1419953 - protein, 10 aa, Mycobacterium tuberculosis
DKSDRPGRNQ

SEQ ID NO: 1419954 - protein, 12 aa, Mycobacterium tuberculosis
DKTNGQPFSDDD

SEQ ID NO: 1419955 - protein, 8 aa, Mycobacterium tuberculosis
DLDGREAI

SEQ ID NO: 1419956 - protein, 15 aa, Mycobacterium tuberculosis
DLGPGTSTSAASRAL

SEQ ID NO: 1419957 - protein, 6 aa, Mycobacterium tuberculosis
DLLPSD

SEQ ID NO: 1419958 - protein, 5 aa, Mycobacterium tuberculosis
DMPAA

SEQ ID NO: 1419959 - protein, 7 aa, Mycobacterium tuberculosis
DNEHDEA

SEQ ID NO: 1419960 - protein, 5 aa, Mycobacterium tuberculosis
DNLTG

SEQ ID NO: 1419961 - protein, 6 aa, Mycobacterium tuberculosis
DNPAAE

SEQ ID NO: 1419962 - protein, 9 aa, Mycobacterium tuberculosis
DNPSNDAAA

SEQ ID NO: 1419963 - protein, 4 aa, Mycobacterium tuberculosis
DNTN

SEQ ID NO: 1419964 - protein, 8 aa, Mycobacterium tuberculosis
DPATATPP

SEQ ID NO: 1419965 - protein, 5 aa, Mycobacterium tuberculosis
DPDEA

SEQ ID NO: 1419966 - protein, 5 aa, Mycobacterium tuberculosis
DPDLD

SEQ ID NO: 1419967 - protein, 8 aa, Mycobacterium tuberculosis
DPERGGAL

SEQ ID NO: 1419968 - protein, 4 aa, Mycobacterium tuberculosis
DPGA

SEQ ID NO: 1419969 - protein, 9 aa, Mycobacterium tuberculosis
DPGAESPRE

SEQ ID NO: 1419970 - protein, 9 aa, Mycobacterium tuberculosis
DPNDPADHE

SEQ ID NO: 1419971 - protein, 12 aa, Mycobacterium tuberculosis
DPSVAYPRRSNL

SEQ ID NO: 1419972 - protein, 4 aa, Mycobacterium tuberculosis
DPTS

SEQ ID NO: 1419973 - protein, 6 aa, Mycobacterium tuberculosis
DPTSGL

SEQ ID NO: 1419974 - protein, 7 aa, Mycobacterium tuberculosis
DPVDPAE

SEQ ID NO: 1419975 - protein, 5 aa, Mycobacterium tuberculosis
DPVKV

SEQ ID NO: 1419976 - protein, 6 aa, Mycobacterium tuberculosis
DQAAKL

SEQ ID NO: 1419977 - protein, 18 aa, Mycobacterium tuberculosis
DQDVQAYTERPLTDDENA

SEQ ID NO: 1419978 - protein, 8 aa, Mycobacterium tuberculosis
DQLASAPR

SEQ ID NO: 1419979 - protein, 17 aa, Mycobacterium tuberculosis
DQVGNRALGDRPSQYLT

SEQ ID NO: 1419980 - protein, 7 aa, Mycobacterium tuberculosis
DRAQREL

SEQ ID NO: 1419981 - protein, 5 aa, Mycobacterium tuberculosis
DRDGN

SEQ ID NO: 1419982 - protein, 9 aa, Mycobacterium tuberculosis
DRGSDGQWR

SEQ ID NO: 1419983 - protein, 4 aa, Mycobacterium tuberculosis
DRPL

SEQ ID NO: 1419984 - protein, 7 aa, Mycobacterium tuberculosis
DRQPRRA

SEQ ID NO: 1419985 - protein, 11 aa, Mycobacterium tuberculosis
DRSAPPGPFQR

SEQ ID NO: 1419986 - protein, 19 aa, Mycobacterium tuberculosis
DRSHDGRTARVPGDEITST

SEQ ID NO: 1419987 - protein, 4 aa, Mycobacterium tuberculosis
DRVT

SEQ ID NO: 1419988 - protein, 10 aa, Mycobacterium tuberculosis
DSELPDGSVD

SEQ ID NO: 1419989 - protein, 7 aa, Mycobacterium tuberculosis
DSGLDPH

SEQ ID NO: 1419990 - protein, 7 aa, Mycobacterium tuberculosis
DSPERFD

SEQ ID NO: 1419991 - protein, 4 aa, Mycobacterium tuberculosis
DSTT

SEQ ID NO: 1419992 - protein, 6 aa, Mycobacterium tuberculosis
DSYRIK

SEQ ID NO: 1419993 - protein, 9 aa, Mycobacterium tuberculosis
DSYRTDSPG

SEQ ID NO: 1419994 - protein, 22 aa, Mycobacterium tuberculosis
DTGDPLRDASGRVRRVPDGEPG

SEQ ID NO: 1419995 - protein, 7 aa, Mycobacterium tuberculosis
DTLGPAR

SEQ ID NO: 1419996 - protein, 5 aa, Mycobacterium tuberculosis
DTPFD

SEQ ID NO: 1419997 - protein, 5 aa, Mycobacterium tuberculosis
DTPGY

SEQ ID NO: 1419998 - protein, 16 aa, Mycobacterium tuberculosis
DTPTGLTCPYTTPLDV

SEQ ID NO: 1419999 - protein, 11 aa, Mycobacterium tuberculosis
DTRGFDDTTPP

SEQ ID NO: 1420000 - protein, 10 aa, Mycobacterium tuberculosis
DTSTTGNSAL

SEQ ID NO: 1420001 - protein, 6 aa, Mycobacterium tuberculosis
DTTAPA

SEQ ID NO: 1420002 - protein, 11 aa, Mycobacterium tuberculosis
DTYEGREKEVG

SEQ ID NO: 1420003 - protein, 5 aa, Mycobacterium tuberculosis
DVSPV

SEQ ID NO: 1420004 - protein, 5 aa, Mycobacterium tuberculosis
DVVGE

SEQ ID NO: 1420005 - protein, 5 aa, Mycobacterium tuberculosis
EAAEA

SEQ ID NO: 1420006 - protein, 7 aa, Mycobacterium tuberculosis
EAARTHR

SEQ ID NO: 1420007 - protein, 8 aa, Mycobacterium tuberculosis
EALGGDPQ

SEQ ID NO: 1420008 - protein, 10 aa, Mycobacterium tuberculosis
EALPGTDIDP

SEQ ID NO: 1420009 - protein, 19 aa, Mycobacterium tuberculosis
EAPAEASAPESSPGDAEVG

SEQ ID NO: 1420010 - protein, 10 aa, Mycobacterium tuberculosis
EAQPGSQALA

SEQ ID NO: 1420011 - protein, 6 aa, Mycobacterium tuberculosis
EARRTL

SEQ ID NO: 1420012 - protein, 11 aa, Mycobacterium tuberculosis
EASAGTPRSPW

SEQ ID NO: 1420013 - protein, 7 aa, Mycobacterium tuberculosis
EDAFGGT

SEQ ID NO: 1420014 - protein, 12 aa, Mycobacterium tuberculosis
EDASRAAVGREK

SEQ ID NO: 1420015 - protein, 6 aa, Mycobacterium tuberculosis
EDEQEK

SEQ ID NO: 1420016 - protein, 9 aa, Mycobacterium tuberculosis
EDGSERVLS

SEQ ID NO: 1420017 - protein, 5 aa, Mycobacterium tuberculosis
EDPYE

SEQ ID NO: 1420018 - protein, 12 aa, Mycobacterium tuberculosis
EDQYEPGSSRRW

SEQ ID NO: 1420019 - protein, 6 aa, Mycobacterium tuberculosis
EDRGAF

SEQ ID NO: 1420020 - protein, 15 aa, Mycobacterium tuberculosis
EEAPSPLLDPQTRER

SEQ ID NO: 1420021 - protein, 9 aa, Mycobacterium tuberculosis
EEGKAVAAE

SEQ ID NO: 1420022 - protein, 16 aa, Mycobacterium tuberculosis
EELGGGDLHSRTSGVT

SEQ ID NO: 1420023 - protein, 7 aa, Mycobacterium tuberculosis
EEQRVPD

SEQ ID NO: 1420024 - protein, 7 aa, Mycobacterium tuberculosis
EESGTIA

SEQ ID NO: 1420025 - protein, 5 aa, Mycobacterium tuberculosis
EESTV

SEQ ID NO: 1420026 - protein, 8 aa, Mycobacterium tuberculosis
EFDRSGGD

SEQ ID NO: 1420027 - protein, 10 aa, Mycobacterium tuberculosis
EFGPEKTAQI

SEQ ID NO: 1420028 - protein, 4 aa, Mycobacterium tuberculosis
EGAD

SEQ ID NO: 1420029 - protein, 6 aa, Mycobacterium tuberculosis
EGPDYA

SEQ ID NO: 1420030 - protein, 11 aa, Mycobacterium tuberculosis
EGQNPSTKSAR

SEQ ID NO: 1420031 - protein, 10 aa, Mycobacterium tuberculosis
EGSGLSKEDI

SEQ ID NO: 1420032 - protein, 11 aa, Mycobacterium tuberculosis
EGTRSPDGRLY

SEQ ID NO: 1420033 - protein, 8 aa, Mycobacterium tuberculosis
EGTSTITN

SEQ ID NO: 1420034 - protein, 10 aa, Mycobacterium tuberculosis
EHSDDAQPGV

SEQ ID NO: 1420035 - protein, 11 aa, Mycobacterium tuberculosis
EHSDPKRGEQL

SEQ ID NO: 1420036 - protein, 5 aa, Mycobacterium tuberculosis
EHSHS

SEQ ID NO: 1420037 - protein, 9 aa, Mycobacterium tuberculosis
EIDAGPTNN

SEQ ID NO: 1420038 - protein, 5 aa, Mycobacterium tuberculosis
EISPA

SEQ ID NO: 1420039 - protein, 4 aa, Mycobacterium tuberculosis
EITN

SEQ ID NO: 1420040 - protein, 10 aa, Mycobacterium tuberculosis
EKPDETERTF

SEQ ID NO: 1420041 - protein, 12 aa, Mycobacterium tuberculosis
EKSGEGGGNRVS

SEQ ID NO: 1420042 - protein, 13 aa, Mycobacterium tuberculosis
ELEGVSADRAPQI

SEQ ID NO: 1420043 - protein, 4 aa, Mycobacterium tuberculosis
ELGQ

SEQ ID NO: 1420044 - protein, 10 aa, Mycobacterium tuberculosis
ELGTTTIKDT

SEQ ID NO: 1420045 - protein, 4 aa, Mycobacterium tuberculosis
ELPA

SEQ ID NO: 1420046 - protein, 8 aa, Mycobacterium tuberculosis
ELPDQLGE

SEQ ID NO: 1420047 - protein, 28 aa, Mycobacterium tuberculosis
ELSGTGTDRLDGDGPSDDDSWNDEDDWR

SEQ ID NO: 1420048 - protein, 6 aa, Mycobacterium tuberculosis
ENLTAA

SEQ ID NO: 1420049 - protein, 4 aa, Mycobacterium tuberculosis
ENNG

SEQ ID NO: 1420050 - protein, 8 aa, Mycobacterium tuberculosis
ENPKHPPL

SEQ ID NO: 1420051 - protein, 7 aa, Mycobacterium tuberculosis
ENQATDR

SEQ ID NO: 1420052 - protein, 7 aa, Mycobacterium tuberculosis
ENQHDET

SEQ ID NO: 1420053 - protein, 6 aa, Mycobacterium tuberculosis
ENSAAK

SEQ ID NO: 1420054 - protein, 11 aa, Mycobacterium tuberculosis
EPKATPAQTQA

SEQ ID NO: 1420055 - protein, 7 aa, Mycobacterium tuberculosis
EPTPAER

SEQ ID NO: 1420056 - protein, 6 aa, Mycobacterium tuberculosis
EQSVDA

SEQ ID NO: 1420057 - protein, 6 aa, Mycobacterium tuberculosis
ERARDR

SEQ ID NO: 1420058 - protein, 14 aa, Mycobacterium tuberculosis
ERFGPDRVRTAENL

SEQ ID NO: 1420059 - protein, 7 aa, Mycobacterium tuberculosis
ERFPKGV

SEQ ID NO: 1420060 - protein, 7 aa, Mycobacterium tuberculosis
ERGTDPL

SEQ ID NO: 1420061 - protein, 7 aa, Mycobacterium tuberculosis
ERLSDKS

SEQ ID NO: 1420062 - protein, 6 aa, Mycobacterium tuberculosis
ERRTGE

SEQ ID NO: 1420063 - protein, 5 aa, Mycobacterium tuberculosis
ERTGE

SEQ ID NO: 1420064 - protein, 6 aa, Mycobacterium tuberculosis
ERVTTS

SEQ ID NO: 1420065 - protein, 7 aa, Mycobacterium tuberculosis
ESSRRAY

SEQ ID NO: 1420066 - protein, 19 aa, Mycobacterium tuberculosis
ESTAARVDYPAGRVRAESG

SEQ ID NO: 1420067 - protein, 6 aa, Mycobacterium tuberculosis
ETDEQA

SEQ ID NO: 1420068 - protein, 7 aa, Mycobacterium tuberculosis
ETEGRPR

SEQ ID NO: 1420069 - protein, 12 aa, Mycobacterium tuberculosis
ETEISGSGNGPL

SEQ ID NO: 1420070 - protein, 6 aa, Mycobacterium tuberculosis
ETGAIK

SEQ ID NO: 1420071 - protein, 9 aa, Mycobacterium tuberculosis
ETGRGSHED

SEQ ID NO: 1420072 - protein, 6 aa, Mycobacterium tuberculosis
ETPLSN

SEQ ID NO: 1420073 - protein, 11 aa, Mycobacterium tuberculosis
ETRMENPAGTV

SEQ ID NO: 1420074 - protein, 10 aa, Mycobacterium tuberculosis
ETYPSLDPQG

SEQ ID NO: 1420075 - protein, 5 aa, Mycobacterium tuberculosis
EVERQ

SEQ ID NO: 1420076 - protein, 8 aa, Mycobacterium tuberculosis
EVSTRTPV

SEQ ID NO: 1420077 - protein, 9 aa, Mycobacterium tuberculosis
EYPDAADEP

SEQ ID NO: 1420078 - protein, 107 aa, Mycobacterium tuberculosis
FAEDAADNADDGDDAHPEEADEAAEPKEATEPDEADEVDDADESVPAERAQDVAEEATLPPVAEPPPPAAPPVAEPPPPVAAPAPPGAPEPANGPSPEALSEGATPC

SEQ ID NO: 1420079 - protein, 7 aa, Mycobacterium tuberculosis
FANTGSY

SEQ ID NO: 1420080 - protein, 12 aa, Mycobacterium tuberculosis
FARSGPRRNAQV

SEQ ID NO: 1420081 - protein, 10 aa, Mycobacterium tuberculosis
FDKDGTALSS

SEQ ID NO: 1420082 - protein, 6 aa, Mycobacterium tuberculosis
FETERA

SEQ ID NO: 1420083 - protein, 12 aa, Mycobacterium tuberculosis
FGGDSLTTSGYP

SEQ ID NO: 1420084 - protein, 9 aa, Mycobacterium tuberculosis
FGGGNNGTL

SEQ ID NO: 1420085 - protein, 8 aa, Mycobacterium tuberculosis
FGKPANPD

SEQ ID NO: 1420086 - protein, 52 aa, Mycobacterium tuberculosis; identical to SEQ ID NO: 174380

SEQ ID NO: 1420087 - protein, 9 aa, Mycobacterium tuberculosis
FGNAGSSNF

SEQ ID NO: 1420088 - protein, 9 aa, Mycobacterium tuberculosis
FGNTGTNNL

SEQ ID NO: 1420089 - protein, 4 aa, Mycobacterium tuberculosis
FGPR

SEQ ID NO: 1420090 - protein, 6 aa, Mycobacterium tuberculosis
FGRGSN

SEQ ID NO: 1420091 - protein, 15 aa, Mycobacterium tuberculosis
FGTAPNPGGGLPYTQ

SEQ ID NO: 1420092 - protein, 6 aa, Mycobacterium tuberculosis
FGTEPD

SEQ ID NO: 1420093 - protein, 6 aa, Mycobacterium tuberculosis
FGVGGT

SEQ ID NO: 1420094 - protein, 9 aa, Mycobacterium tuberculosis
FKNAEPADI

SEQ ID NO: 1420095 - protein, 6 aa, Mycobacterium tuberculosis
FKTDYT

SEQ ID NO: 1420096 - protein, 15 aa, Mycobacterium tuberculosis
FNPDDPDAFAATGGW

SEQ ID NO: 1420097 - protein, 27 aa, Mycobacterium tuberculosis
FNPGNSNTGIANSGDVNTGAFNSGNYS

SEQ ID NO: 1420098 - protein, 18 aa, Mycobacterium tuberculosis
FNSGDGSASGFGNVGPGI

SEQ ID NO: 1420099 - protein, 7 aa, Mycobacterium tuberculosis
FNSGSGN

SEQ ID NO: 1420100 - protein, 11 aa, Mycobacterium tuberculosis
FQTRSTKPGGR

SEQ ID NO: 1420101 - protein, 9 aa, Mycobacterium tuberculosis
FRTDSNDSR

SEQ ID NO: 1420102 - protein, 6 aa, Mycobacterium tuberculosis
FSAPDD

SEQ ID NO: 1420103 - protein, 11 aa, Mycobacterium tuberculosis
FSAPPTPFNGP

SEQ ID NO: 1420104 - protein, 7 aa, Mycobacterium tuberculosis
FSGAKTA

SEQ ID NO: 1420105 - protein, 13 aa, Mycobacterium tuberculosis
FSTPGIATQANSG

SEQ ID NO: 1420106 - protein, 9 aa, Mycobacterium tuberculosis
GAASGQWTP

SEQ ID NO: 1420107 - protein, 18 aa, Mycobacterium tuberculosis
GAAVGASRAAVDSGYYPG

SEQ ID NO: 1420108 - protein, 5 aa, Mycobacterium tuberculosis
GADPA

SEQ ID NO: 1420109 - protein, 9 aa, Mycobacterium tuberculosis
GAFREKDGR

SEQ ID NO: 1420110 - protein, 12 aa, Mycobacterium tuberculosis
GAGDLPEGIEGG

SEQ ID NO: 1420111 - protein, 10 aa, Mycobacterium tuberculosis
GAGSDPGPKA

SEQ ID NO: 1420112 - protein, 11 aa, Mycobacterium tuberculosis
GAGSRFAERGH

SEQ ID NO: 1420113 - protein, 6 aa, Mycobacterium tuberculosis
GAGYRS

SEQ ID NO: 1420114 - protein, 15 aa, Mycobacterium tuberculosis
GAKDVGKRAERATAE

SEQ ID NO: 1420115 - protein, 16 aa, Mycobacterium tuberculosis
GAQLAPRDVDAPLETQ

SEQ ID NO: 1420116 - protein, 34 aa, Mycobacterium tuberculosis
GAQSPDIAQGVDTAHEARVEGAADPLDSQGAGDQ

SEQ ID NO: 1420117 - protein, 6 aa, Mycobacterium tuberculosis
GARTHA

SEQ ID NO: 1420118 - protein, 15 aa, Mycobacterium tuberculosis
GASRAVSASLARANK

SEQ ID NO: 1420119 - protein, 9 aa, Mycobacterium tuberculosis
GATAYRNTE

SEQ ID NO: 1420120 - protein, 8 aa, Mycobacterium tuberculosis
GATTLGGR

SEQ ID NO: 1420121 - protein, 9 aa, Mycobacterium tuberculosis
GAVDANQSI

SEQ ID NO: 1420122 - protein, 7 aa, Mycobacterium tuberculosis
GCPTSSV

SEQ ID NO: 1420123 - protein, 6 aa, Mycobacterium tuberculosis
GDAEVG

SEQ ID NO: 1420124 - protein, 18 aa, Mycobacterium tuberculosis
GDDAWDAPSPSALPAAQR

SEQ ID NO: 1420125 - protein, 19 aa, Mycobacterium tuberculosis
GDDPLGATQRITRRSQAAW

SEQ ID NO: 1420126 - protein, 4 aa, Mycobacterium tuberculosis
GDGW

SEQ ID NO: 1420127 - protein, 36 aa, Mycobacterium tuberculosis; identical to SEQ ID NO: 175084

SEQ ID NO: 1420128 - protein, 6 aa, Mycobacterium tuberculosis
GDLPAA

SEQ ID NO: 1420129 - protein, 7 aa, Mycobacterium tuberculosis
GDNSTEL

SEQ ID NO: 1420130 - protein, 23 aa, Mycobacterium tuberculosis
GDQRIRGRSGYQYASGDTADTVD

SEQ ID NO: 1420131 - protein, 5 aa, Mycobacterium tuberculosis
GDRLG

SEQ ID NO: 1420132 - protein, 4 aa, Mycobacterium tuberculosis
GDSV

SEQ ID NO: 1420133 - protein, 5 aa, Mycobacterium tuberculosis
GDTRE

SEQ ID NO: 1420134 - protein, 9 aa, Mycobacterium tuberculosis
GDYDSATKH

SEQ ID NO: 1420135 - protein, 11 aa, Mycobacterium tuberculosis
GEAGQSFATPF

SEQ ID NO: 1420136 - protein, 4 aa, Mycobacterium tuberculosis
GEER

SEQ ID NO: 1420137 - protein, 12 aa, Mycobacterium tuberculosis
GEGDTTPLREAG

SEQ ID NO: 1420138 - protein, 5 aa, Mycobacterium tuberculosis
GEGGE

SEQ ID NO: 1420139 - protein, 4 aa, Mycobacterium tuberculosis
GEGV

SEQ ID NO: 1420140 - protein, 12 aa, Mycobacterium tuberculosis
GEKGTAKSTAVR

SEQ ID NO: 1420141 - protein, 5 aa, Mycobacterium tuberculosis
GEPTV

SEQ ID NO: 1420142 - protein, 6 aa, Mycobacterium tuberculosis
GERTVT

SEQ ID NO: 1420143 - protein, 11 aa, Mycobacterium tuberculosis
GFDSSDALPQN

SEQ ID NO: 1420144 - protein, 7 aa, Mycobacterium tuberculosis
GFEGNAA

SEQ ID NO: 1420145 - protein, 12 aa, Mycobacterium tuberculosis
GFRGQGASHGAQ

SEQ ID NO: 1420146 - protein, 5 aa, Mycobacterium tuberculosis
GFSDR

SEQ ID NO: 1420147 - protein, 4 aa, Mycobacterium tuberculosis
GGEI

SEQ ID NO: 1420148 - protein, 4 aa, Mycobacterium tuberculosis
GGFG

SEQ ID NO: 1420149 - protein, 8 aa, Mycobacterium tuberculosis
GGGGRPLA

SEQ ID NO: 1420150 - protein, 10 aa, Mycobacterium tuberculosis
GGGSGIGKGV

SEQ ID NO: 1420151 - protein, 8 aa, Mycobacterium tuberculosis
GGGTAGHV

SEQ ID NO: 1420152 - protein, 6 aa, Mycobacterium tuberculosis
GGKGRA

SEQ ID NO: 1420153 - protein, 5 aa, Mycobacterium tuberculosis
GGKRE

SEQ ID NO: 1420154 - protein, 4 aa, Mycobacterium tuberculosis
GGLD

SEQ ID NO: 1420155 - protein, 6 aa, Mycobacterium tuberculosis
GGLDST

SEQ ID NO: 1420156 - protein, 8 aa, Mycobacterium tuberculosis
GGMGSGPV

SEQ ID NO: 1420157 - protein, 17 aa, Mycobacterium tuberculosis
GGNGGNGVNGGTGGSGG

SEQ ID NO: 1420158 - protein, 5 aa, Mycobacterium tuberculosis
GGNVG

SEQ ID NO: 1420159 - protein, 6 aa, Mycobacterium tuberculosis
GGPTFD

SEQ ID NO: 1420160 - protein, 12 aa, Mycobacterium tuberculosis
GGRANASQAERL

SEQ ID NO: 1420161 - protein, 5 aa, Mycobacterium tuberculosis
GGRGV

SEQ ID NO: 1420162 - protein, 5 aa, Mycobacterium tuberculosis
GGRLS

SEQ ID NO: 1420163 - protein, 17 aa, Mycobacterium tuberculosis
GGSTATTVSFVVSTTRG

SEQ ID NO: 1420164 - protein, 19 aa, Mycobacterium tuberculosis
GGTGGAGGAGAVGGVGGNG

SEQ ID NO: 1420165 - protein, 9 aa, Mycobacterium tuberculosis
GGTGPRRGI

SEQ ID NO: 1420166 - protein, 9 aa, Mycobacterium tuberculosis
GGTPRKRRD

SEQ ID NO: 1420167 - protein, 33 aa, Mycobacterium tuberculosis
GGTWGLPGGARDSHETPEQTAVRESSEEAGLSA

SEQ ID NO: 1420168 - protein, 21 aa, Mycobacterium tuberculosis
GGVVADSNGSYEYNEARNKAR

SEQ ID NO: 1420169 - protein, 5 aa, Mycobacterium tuberculosis
GHDEH

SEQ ID NO: 1420170 - protein, 21 aa, Mycobacterium tuberculosis
GHIAESAKTLQRAEARHGTKS

SEQ ID NO: 1420171 - protein, 9 aa, Mycobacterium tuberculosis
GHSYGGRQT

SEQ ID NO: 1420172 - protein, 43 aa, Mycobacterium tuberculosis
GIANSGNNLAGISNSGDDSSGAVNSGSQNSGAFNAGVGLSGFF

SEQ ID NO: 1420173 - protein, 7 aa, Mycobacterium tuberculosis
GINGTIP

SEQ ID NO: 1420174 - protein, 14 aa, Mycobacterium tuberculosis
GIPDSRTSKDFDTV

SEQ ID NO: 1420175 - protein, 5 aa, Mycobacterium tuberculosis
GIPPV

SEQ ID NO: 1420176 - protein, 11 aa, Mycobacterium tuberculosis
GIPVDDPDGYR

SEQ ID NO: 1420177 - protein, 5 aa, Mycobacterium tuberculosis
GIRDG

SEQ ID NO: 1420178 - protein, 6 aa, Mycobacterium tuberculosis
GITPEQ

SEQ ID NO: 1420179 - protein, 12 aa, Mycobacterium tuberculosis
GKAGSQTEYGSA

SEQ ID NO: 1420180 - protein, 5 aa, Mycobacterium tuberculosis
GKLAA

SEQ ID NO: 1420181 - protein, 7 aa, Mycobacterium tuberculosis
GKTDLPL

SEQ ID NO: 1420182 - protein, 5 aa, Mycobacterium tuberculosis
GKTYG

SEQ ID NO: 1420183 - protein, 8 aa, Mycobacterium tuberculosis
GLAASPSA

SEQ ID NO: 1420184 - protein, 24 aa, Mycobacterium tuberculosis
GLAPDGRCKPYAGRADGVGWSEGG

SEQ ID NO: 1420185 - protein, 7 aa, Mycobacterium tuberculosis
GLASPVT

SEQ ID NO: 1420186 - protein, 8 aa, Mycobacterium tuberculosis
GLGSPAEG

SEQ ID NO: 1420187 - protein, 4 aa, Mycobacterium tuberculosis
GLPQ

SEQ ID NO: 1420188 - protein, 19 aa, Mycobacterium tuberculosis
GLPQPGEHVPAQAPPATTL

SEQ ID NO: 1420189 - protein, 10 aa, Mycobacterium tuberculosis
GLTEDSDDLA

SEQ ID NO: 1420190 - protein, 6 aa, Mycobacterium tuberculosis
GLTGTS

SEQ ID NO: 1420191 - protein, 6 aa, Mycobacterium tuberculosis
GMAGPS

SEQ ID NO: 1420192 - protein, 5 aa, Mycobacterium tuberculosis
GNAGS

SEQ ID NO: 1420193 - protein, 9 aa, Mycobacterium tuberculosis
GNDDNRINR

SEQ ID NO: 1420194 - protein, 11 aa, Mycobacterium tuberculosis
GNGATPDSDAP

SEQ ID NO: 1420195 - protein, 27 aa, Mycobacterium tuberculosis
GNGNVGIGNSGNYNTGLGNVGNANTGL

SEQ ID NO: 1420196 - protein, 18 aa, Mycobacterium tuberculosis
GNGTNGAPGTGEAGGPGG

SEQ ID NO: 1420197 - protein, 4 aa, Mycobacterium tuberculosis
GNHP

SEQ ID NO: 1420198 - protein, 4 aa, Mycobacterium tuberculosis
GNHS

SEQ ID NO: 1420199 - protein, 8 aa, Mycobacterium tuberculosis
GNIYEKDG

SEQ ID NO: 1420200 - protein, 8 aa, Mycobacterium tuberculosis
GNPAHSLA

SEQ ID NO: 1420201 - protein, 4 aa, Mycobacterium tuberculosis
GNQD

SEQ ID NO: 1420202 - protein, 5 aa, Mycobacterium tuberculosis
GNSAQ

SEQ ID NO: 1420203 - protein, 18 aa, Mycobacterium tuberculosis
GNTGSGNFGFGNTGNNNI

SEQ ID NO: 1420204 - protein, 9 aa, Mycobacterium tuberculosis
GNVNPGRLK

SEQ ID NO: 1420205 - protein, 5 aa, Mycobacterium tuberculosis
GNYQA

SEQ ID NO: 1420206 - protein, 5 aa, Mycobacterium tuberculosis
GPAAA

SEQ ID NO: 1420207 - protein, 11 aa, Mycobacterium tuberculosis
GPADRQRRQRR

SEQ ID NO: 1420208 - protein, 7 aa, Mycobacterium tuberculosis
GPAFSAG

SEQ ID NO: 1420209 - protein, 6 aa, Mycobacterium tuberculosis
GPAGER

SEQ ID NO: 1420210 - protein, 7 aa, Mycobacterium tuberculosis
GPAPGVP

SEQ ID NO: 1420211 - protein, 16 aa, Mycobacterium tuberculosis
GPAVNAAADVDPGPAL

SEQ ID NO: 1420212 - protein, 13 aa, Mycobacterium tuberculosis
GPDDEIGLTAPDA

SEQ ID NO: 1420213 - protein, 11 aa, Mycobacterium tuberculosis
GPDGNYGEPEE

SEQ ID NO: 1420214 - protein, 6 aa, Mycobacterium tuberculosis
GPESTF

SEQ ID NO: 1420215 - protein, 11 aa, Mycobacterium tuberculosis
GPLPSHPDEDD

SEQ ID NO: 1420216 - protein, 25 aa, Mycobacterium tuberculosis
GPMAHGKKRRGHRSSGVAAGVTGPA

SEQ ID NO: 1420217 - protein, 4 aa, Mycobacterium tuberculosis
GPPD

SEQ ID NO: 1420218 - protein, 8 aa, Mycobacterium tuberculosis
GPPLTRSG

SEQ ID NO: 1420219 - protein, 10 aa, Mycobacterium tuberculosis
GPPPFRPPTF

SEQ ID NO: 1420220 - protein, 4 aa, Mycobacterium tuberculosis
GPRE

SEQ ID NO: 1420221 - protein, 7 aa, Mycobacterium tuberculosis
GPRLSGS

SEQ ID NO: 1420222 - protein, 4 aa, Mycobacterium tuberculosis
GPSA

SEQ ID NO: 1420223 - protein, 7 aa, Mycobacterium tuberculosis
GPSPADQ

SEQ ID NO: 1420224 - protein, 9 aa, Mycobacterium tuberculosis
GQATGRQVA

SEQ ID NO: 1420225 - protein, 11 aa, Mycobacterium tuberculosis
GQLAGTANELT

SEQ ID NO: 1420226 - protein, 4 aa, Mycobacterium tuberculosis
GQPD

SEQ ID NO: 1420227 - protein, 14 aa, Mycobacterium tuberculosis
GQPEESLAGRTVSD

SEQ ID NO: 1420228 - protein, 9 aa, Mycobacterium tuberculosis
GQPVSLSPT

SEQ ID NO: 1420229 - protein, 7 aa, Mycobacterium tuberculosis
GQQTVTT

SEQ ID NO: 1420230 - protein, 7 aa, Mycobacterium tuberculosis
GQTRTAK

SEQ ID NO: 1420231 - protein, 12 aa, Mycobacterium tuberculosis
GREVGGGDTRCD

SEQ ID NO: 1420232 - protein, 10 aa, Mycobacterium tuberculosis
GRGIPTGTCP

SEQ ID NO: 1420233 - protein, 8 aa, Mycobacterium tuberculosis
GRGRPAKR

SEQ ID NO: 1420234 - protein, 12 aa, Mycobacterium tuberculosis
GRKTVSIVGSTT

SEQ ID NO: 1420235 - protein, 10 aa, Mycobacterium tuberculosis
GRNGDGKSSL

SEQ ID NO: 1420236 - protein, 13 aa, Mycobacterium tuberculosis
GRPVPGPESEAGP

SEQ ID NO: 1420237 - protein, 6 aa, Mycobacterium tuberculosis
GRQVDD

SEQ ID NO: 1420238 - protein, 10 aa, Mycobacterium tuberculosis
GRSATTAEQA

SEQ ID NO: 1420239 - protein, 4 aa, Mycobacterium tuberculosis
GRSH

SEQ ID NO: 1420240 - protein, 6 aa, Mycobacterium tuberculosis
GRSNEH

SEQ ID NO: 1420241 - protein, 8 aa, Mycobacterium tuberculosis
GRTRQNLA

SEQ ID NO: 1420242 - protein, 9 aa, Mycobacterium tuberculosis
GSANRDDRV

SEQ ID NO: 1420243 - protein, 7 aa, Mycobacterium tuberculosis
GSDPLGD

SEQ ID NO: 1420244 - protein, 9 aa, Mycobacterium tuberculosis
GSGARYGRQ

SEQ ID NO: 1420245 - protein, 11 aa, Mycobacterium tuberculosis
GSGDWEATKTD

SEQ ID NO: 1420246 - protein, 14 aa, Mycobacterium tuberculosis
GSGMVGGKRHPTVG

SEQ ID NO: 1420247 - protein, 7 aa, Mycobacterium tuberculosis
GSGNFGI

SEQ ID NO: 1420248 - protein, 4 aa, Mycobacterium tuberculosis
GSHA

SEQ ID NO: 1420249 - protein, 7 aa, Mycobacterium tuberculosis
GSHGTKR

SEQ ID NO: 1420250 - protein, 6 aa, Mycobacterium tuberculosis
GSREAG

SEQ ID NO: 1420251 - protein, 10 aa, Mycobacterium tuberculosis
GSRKTHDDRM

SEQ ID NO: 1420252 - protein, 6 aa, Mycobacterium tuberculosis
GSRNAP

SEQ ID NO: 1420253 - protein, 5 aa, Mycobacterium tuberculosis
GSRYA

SEQ ID NO: 1420254 - protein, 10 aa, Mycobacterium tuberculosis
GSSDGSYAGL

SEQ ID NO: 1420255 - protein, 4 aa, Mycobacterium tuberculosis
GSTW

SEQ ID NO: 1420256 - protein, 8 aa, Mycobacterium tuberculosis
GSVTSELT

SEQ ID NO: 1420257 - protein, 6 aa, Mycobacterium tuberculosis
GTFGSG

SEQ ID NO: 1420258 - protein, 12 aa, Mycobacterium tuberculosis
GTGTSERDERDR

SEQ ID NO: 1420259 - protein, 8 aa, Mycobacterium tuberculosis
GTNCENLP

SEQ ID NO: 1420260 - protein, 7 aa, Mycobacterium tuberculosis
GTPPEAI

SEQ ID NO: 1420261 - protein, 9 aa, Mycobacterium tuberculosis
GTRGTRPAL

SEQ ID NO: 1420262 - protein, 6 aa, Mycobacterium tuberculosis
GTSMTN

SEQ ID NO: 1420263 - protein, 4 aa, Mycobacterium tuberculosis
GTSN

SEQ ID NO: 1420264 - protein, 5 aa, Mycobacterium tuberculosis
GTTPN

SEQ ID NO: 1420265 - protein, 9 aa, Mycobacterium tuberculosis
GTTTERHDQ

SEQ ID NO: 1420266 - protein, 5 aa, Mycobacterium tuberculosis
GTTTT

SEQ ID NO: 1420267 - protein, 5 aa, Mycobacterium tuberculosis
GTVAQ

SEQ ID NO: 1420268 - protein, 7 aa, Mycobacterium tuberculosis
GVASGAG

SEQ ID NO: 1420269 - protein, 20 aa, Mycobacterium tuberculosis
GVGTGAPGRRSRARNASGSV

SEQ ID NO: 1420270 - protein, 5 aa, Mycobacterium tuberculosis
GVKED

SEQ ID NO: 1420271 - protein, 7 aa, Mycobacterium tuberculosis
GVRGGGR

SEQ ID NO: 1420272 - protein, 10 aa, Mycobacterium tuberculosis
GWKTKEPGIE

SEQ ID NO: 1420273 - protein, 6 aa, Mycobacterium tuberculosis
GWQPGD

SEQ ID NO: 1420274 - protein, 15 aa, Mycobacterium tuberculosis
GYDAPFPDKTYQAGA

SEQ ID NO: 1420275 - protein, 5 aa, Mycobacterium tuberculosis
GYRPE

SEQ ID NO: 1420276 - protein, 5 aa, Mycobacterium tuberculosis
GYSES

SEQ ID NO: 1420277 - protein, 17 aa, Mycobacterium tuberculosis
GYTASGDAQVDETAAEI

SEQ ID NO: 1420278 - protein, 17 aa, Mycobacterium tuberculosis
HAAAGVPAQAAAAPVDV

SEQ ID NO: 1420279 - protein, 6 aa, Mycobacterium tuberculosis
HAAEGF

SEQ ID NO: 1420280 - protein, 16 aa, Mycobacterium tuberculosis
HADRRRTAAISAPQGL

SEQ ID NO: 1420281 - protein, 13 aa, Mycobacterium tuberculosis
HANTGLANAGTFG

SEQ ID NO: 1420282 - protein, 4 aa, Mycobacterium tuberculosis
HAPA

SEQ ID NO: 1420283 - protein, 6 aa, Mycobacterium tuberculosis
HAPKTV

SEQ ID NO: 1420284 - protein, 19 aa, Mycobacterium tuberculosis
HAQPHHRGGPTTATNGLGS

SEQ ID NO: 1420285 - protein, 11 aa, Mycobacterium tuberculosis
HARAGAAAAAV

SEQ ID NO: 1420286 - protein, 17 aa, Mycobacterium tuberculosis
HDGDTLTVTPPSWRPDL

SEQ ID NO: 1420287 - protein, 6 aa, Mycobacterium tuberculosis
HDGDTV

SEQ ID NO: 1420288 - protein, 6 aa, Mycobacterium tuberculosis
HDPAAR

SEQ ID NO: 1420289 - protein, 6 aa, Mycobacterium tuberculosis
HGGQTV

SEQ ID NO: 1420290 - protein, 5 aa, Mycobacterium tuberculosis
HGHGY

SEQ ID NO: 1420291 - protein, 9 aa, Mycobacterium tuberculosis
HGNRQRAHY

SEQ ID NO: 1420292 - protein, 7 aa, Mycobacterium tuberculosis
HGRGGFP

SEQ ID NO: 1420293 - protein, 12 aa, Mycobacterium tuberculosis
HGTATTLGDPIE

SEQ ID NO: 1420294 - protein, 10 aa, Mycobacterium tuberculosis
HHGDQRRATT

SEQ ID NO: 1420295 - protein, 4 aa, Mycobacterium tuberculosis
HHGV

SEQ ID NO: 1420296 - protein, 4 aa, Mycobacterium tuberculosis
HLPA

SEQ ID NO: 1420297 - protein, 4 aa, Mycobacterium tuberculosis
HNDG

SEQ ID NO: 1420298 - protein, 7 aa, Mycobacterium tuberculosis
HNPAAYN

SEQ ID NO: 1420299 - protein, 12 aa, Mycobacterium tuberculosis
HPEYSAPECTDP

SEQ ID NO: 1420300 - protein, 6 aa, Mycobacterium tuberculosis
HPHDAL

SEQ ID NO: 1420301 - protein, 4 aa, Mycobacterium tuberculosis
HPRL

SEQ ID NO: 1420302 - protein, 14 aa, Mycobacterium tuberculosis
HPTTDSLTESANRE

SEQ ID NO: 1420303 - protein, 6 aa, Mycobacterium tuberculosis
HRPPAR

SEQ ID NO: 1420304 - protein, 7 aa, Mycobacterium tuberculosis
HTEYDTG

SEQ ID NO: 1420305 - protein, 8 aa, Mycobacterium tuberculosis
HTRASNFT

SEQ ID NO: 1420306 - protein, 10 aa, Mycobacterium tuberculosis
HTSGQDVAES

SEQ ID NO: 1420307 - protein, 10 aa, Mycobacterium tuberculosis
HYGSPDKDPA

SEQ ID NO: 1420308 - protein, 12 aa, Mycobacterium tuberculosis
IADGTGVEPATH

SEQ ID NO: 1420309 - protein, 7 aa, Mycobacterium tuberculosis
IAEGAEE

SEQ ID NO: 1420310 - protein, 10 aa, Mycobacterium tuberculosis
IDEKPTASDN

SEQ ID NO: 1420311 - protein, 6 aa, Mycobacterium tuberculosis
IDNARR

SEQ ID NO: 1420312 - protein, 4 aa, Mycobacterium tuberculosis
IDSD

SEQ ID NO: 1420313 - protein, 9 aa, Mycobacterium tuberculosis
IEDSSAEKL

SEQ ID NO: 1420314 - protein, 9 aa, Mycobacterium tuberculosis
IGEDDVDAE

SEQ ID NO: 1420315 - protein, 7 aa, Mycobacterium tuberculosis
IGGAGNA

SEQ ID NO: 1420316 - protein, 6 aa, Mycobacterium tuberculosis
IGGEEA

SEQ ID NO: 1420317 - protein, 19 aa, Mycobacterium tuberculosis
IGGGTGPAEGTKATTVTPG

SEQ ID NO: 1420318 - protein, 59 aa, Mycobacterium tuberculosis; identical to SEQ ID NO: 178602

SEQ ID NO: 1420319 - protein, 8 aa, Mycobacterium tuberculosis
IGNSGLQN

SEQ ID NO: 1420320 - protein, 10 aa, Mycobacterium tuberculosis
IGSGLSSSAA

SEQ ID NO: 1420321 - protein, 17 aa, Mycobacterium tuberculosis
IGSTIGAANAAAAANTT

SEQ ID NO: 1420322 - protein, 10 aa, Mycobacterium tuberculosis
INAARTQARQ

SEQ ID NO: 1420323 - protein, 4 aa, Mycobacterium tuberculosis
IPGF

SEQ ID NO: 1420324 - protein, 9 aa, Mycobacterium tuberculosis
IPGHGRDKI

SEQ ID NO: 1420325 - protein, 4 aa, Mycobacterium tuberculosis
IPPH

SEQ ID NO: 1420326 - protein, 5 aa, Mycobacterium tuberculosis
IPPTG

SEQ ID NO: 1420327 - protein, 6 aa, Mycobacterium tuberculosis
IPTGGP

SEQ ID NO: 1420328 - protein, 5 aa, Mycobacterium tuberculosis
IQPNT

SEQ ID NO: 1420329 - protein, 8 aa, Mycobacterium tuberculosis
IRAGDGDA

SEQ ID NO: 1420330 - protein, 5 aa, Mycobacterium tuberculosis
IRKGQ

SEQ ID NO: 1420331 - protein, 13 aa, Mycobacterium tuberculosis
ISSPSDPTANPIL

SEQ ID NO: 1420332 - protein, 10 aa, Mycobacterium tuberculosis
ISTEPVAGAD

SEQ ID NO: 1420333 - protein, 9 aa, Mycobacterium tuberculosis
ITDVNGGGQ

SEQ ID NO: 1420334 - protein, 5 aa, Mycobacterium tuberculosis
ITEHG

SEQ ID NO: 1420335 - protein, 12 aa, Mycobacterium tuberculosis
ITPDEIRATNPP

SEQ ID NO: 1420336 - protein, 7 aa, Mycobacterium tuberculosis
ITTGQTS

SEQ ID NO: 1420337 - protein, 8 aa, Mycobacterium tuberculosis
IVDTGTRF

SEQ ID NO: 1420338 - protein, 13 aa, Mycobacterium tuberculosis
KAAGTSAGAAQSA

SEQ ID NO: 1420339 - protein, 12 aa, Mycobacterium tuberculosis
KAAQVATTLTGT

SEQ ID NO: 1420340 - protein, 4 aa, Mycobacterium tuberculosis
KAEV

SEQ ID NO: 1420341 - protein, 10 aa, Mycobacterium tuberculosis
KAKDAEGGSV

SEQ ID NO: 1420342 - protein, 5 aa, Mycobacterium tuberculosis
KANDI

SEQ ID NO: 1420343 - protein, 9 aa, Mycobacterium tuberculosis
KARKASLPF

SEQ ID NO: 1420344 - protein, 8 aa, Mycobacterium tuberculosis
KAVKSSLR

SEQ ID NO: 1420345 - protein, 8 aa, Mycobacterium tuberculosis
KDEGGRHT

SEQ ID NO: 1420346 - protein, 9 aa, Mycobacterium tuberculosis
KDWPASPLP

SEQ ID NO: 1420347 - protein, 7 aa, Mycobacterium tuberculosis
KETGCTS

SEQ ID NO: 1420348 - protein, 6 aa, Mycobacterium tuberculosis
KGARIS

SEQ ID NO: 1420349 - protein, 6 aa, Mycobacterium tuberculosis
KGDPHR

SEQ ID NO: 1420350 - protein, 8 aa, Mycobacterium tuberculosis
KGGDYLAD

SEQ ID NO: 1420351 - protein, 5 aa, Mycobacterium tuberculosis
KGNIP

SEQ ID NO: 1420352 - protein, 4 aa, Mycobacterium tuberculosis
KHGF

SEQ ID NO: 1420353 - protein, 8 aa, Mycobacterium tuberculosis
KHRDAVPR

SEQ ID NO: 1420354 - protein, 22 aa, Mycobacterium tuberculosis
KIGGRGKAGGVKYAATPQDAYE

SEQ ID NO: 1420355 - protein, 4 aa, Mycobacterium tuberculosis
KLDG

SEQ ID NO: 1420356 - protein, 4 aa, Mycobacterium tuberculosis
KLLG

SEQ ID NO: 1420357 - protein, 8 aa, Mycobacterium tuberculosis
KLTDAPRY

SEQ ID NO: 1420358 - protein, 5 aa, Mycobacterium tuberculosis
KNGQG

SEQ ID NO: 1420359 - protein, 12 aa, Mycobacterium tuberculosis
KNTRPTSETAEE

SEQ ID NO: 1420360 - protein, 6 aa, Mycobacterium tuberculosis
KPPQHG

SEQ ID NO: 1420361 - protein, 8 aa, Mycobacterium tuberculosis
KQPGEVRD

SEQ ID NO: 1420362 - protein, 6 aa, Mycobacterium tuberculosis
KQRTQF

SEQ ID NO: 1420363 - protein, 5 aa, Mycobacterium tuberculosis
KRPEL

SEQ ID NO: 1420364 - protein, 14 aa, Mycobacterium tuberculosis
KRPGTPAAQLDGQL

SEQ ID NO: 1420365 - protein, 7 aa, Mycobacterium tuberculosis
KRQTDQR

SEQ ID NO: 1420366 - protein, 13 aa, Mycobacterium tuberculosis
KRTAQKVADELTE

SEQ ID NO: 1420367 - protein, 6 aa, Mycobacterium tuberculosis
KSAVMG

SEQ ID NO: 1420368 - protein, 7 aa, Mycobacterium tuberculosis
KSEVGDR

SEQ ID NO: 1420369 - protein, 22 aa, Mycobacterium tuberculosis
KSGAAGVAERKQDPLTPAARDE

SEQ ID NO: 1420370 - protein, 5 aa, Mycobacterium tuberculosis
KSGKT

SEQ ID NO: 1420371 - protein, 7 aa, Mycobacterium tuberculosis
KTGQPGH

SEQ ID NO: 1420372 - protein, 16 aa, Mycobacterium tuberculosis
KTKKTPAGDAVNDYRA

SEQ ID NO: 1420373 - protein, 6 aa, Mycobacterium tuberculosis
KTPEQL

SEQ ID NO: 1420374 - protein, 6 aa, Mycobacterium tuberculosis
KTPPEL

SEQ ID NO: 1420375 - protein, 7 aa, Mycobacterium tuberculosis
KYGVTTE

SEQ ID NO: 1420376 - protein, 9 aa, Mycobacterium tuberculosis
KYSKDGQIT

SEQ ID NO: 1420377 - protein, 7 aa, Mycobacterium tuberculosis
LAAEGKR

SEQ ID NO: 1420378 - protein, 8 aa, Mycobacterium tuberculosis
LADDDEDA

SEQ ID NO: 1420379 - protein, 9 aa, Mycobacterium tuberculosis
LADTPEKVR

SEQ ID NO: 1420380 - protein, 13 aa, Mycobacterium tuberculosis
LAEAQQTHSGRAA

SEQ ID NO: 1420381 - protein, 6 aa, Mycobacterium tuberculosis
LAETST

SEQ ID NO: 1420382 - protein, 17 aa, Mycobacterium tuberculosis
LAGGTDPVQAAAPGTIR

SEQ ID NO: 1420383 - protein, 14 aa, Mycobacterium tuberculosis
LAKETSSTKQDATV

SEQ ID NO: 1420384 - protein, 30 aa, Mycobacterium tuberculosis
LAPPTRPAPTEPPPSPSPQRNSGRRAERRV

SEQ ID NO: 1420385 - protein, 6 aa, Mycobacterium tuberculosis
LAPSTV

SEQ ID NO: 1420386 - protein, 4 aa, Mycobacterium tuberculosis
LARD

SEQ ID NO: 1420387 - protein, 5 aa, Mycobacterium tuberculosis
LARQA

SEQ ID NO: 1420388 - protein, 6 aa, Mycobacterium tuberculosis
LARYSA

SEQ ID NO: 1420389 - protein, 9 aa, Mycobacterium tuberculosis
LASRAENPL

SEQ ID NO: 1420390 - protein, 7 aa, Mycobacterium tuberculosis
LDDADAE

SEQ ID NO: 1420391 - protein, 6 aa, Mycobacterium tuberculosis
LDGSYP

SEQ ID NO: 1420392 - protein, 8 aa, Mycobacterium tuberculosis
LDGYPRQG

SEQ ID NO: 1420393 - protein, 9 aa, Mycobacterium tuberculosis
LDPAKHRGY

SEQ ID NO: 1420394 - protein, 12 aa, Mycobacterium tuberculosis
LDPQGILNPGSA

SEQ ID NO: 1420395 - protein, 4 aa, Mycobacterium tuberculosis
LDQV

SEQ ID NO: 1420396 - protein, 6 aa, Mycobacterium tuberculosis
LEAAQS

SEQ ID NO: 1420397 - protein, 7 aa, Mycobacterium tuberculosis
LESGAVG

SEQ ID NO: 1420398 - protein, 23 aa, Mycobacterium tuberculosis
LGADLGPEHRPSAASGPDTTEAD

SEQ ID NO: 1420399 - protein, 11 aa, Mycobacterium tuberculosis
LGAGVGDPAEP

SEQ ID NO: 1420400 - protein, 12 aa, Mycobacterium tuberculosis
LGAPGPGPDESV

SEQ ID NO: 1420401 - protein, 11 aa, Mycobacterium tuberculosis
LGDPAKYGLSA

SEQ ID NO: 1420402 - protein, 33 aa, Mycobacterium tuberculosis; identical to SEQ ID NO: 180105

SEQ ID NO: 1420403 - protein, 9 aa, Mycobacterium tuberculosis
LGNAGSGSW

SEQ ID NO: 1420404 - protein, 5 aa, Mycobacterium tuberculosis
LGPRT

SEQ ID NO: 1420405 - protein, 12 aa, Mycobacterium tuberculosis
LGPSGKRPGAIA

SEQ ID NO: 1420406 - protein, 6 aa, Mycobacterium tuberculosis
LGRADD

SEQ ID NO: 1420407 - protein, 9 aa, Mycobacterium tuberculosis
LGRRGPAEA

SEQ ID NO: 1420408 - protein, 9 aa, Mycobacterium tuberculosis
LGRTGNAGH

SEQ ID NO: 1420409 - protein, 5 aa, Mycobacterium tuberculosis
LGSGV

SEQ ID NO: 1420410 - protein, 5 aa, Mycobacterium tuberculosis
LGSVD

SEQ ID NO: 1420411 - protein, 7 aa, Mycobacterium tuberculosis
LKSASDL

SEQ ID NO: 1420412 - protein, 6 aa, Mycobacterium tuberculosis
LNETRT

SEQ ID NO: 1420413 - protein, 7 aa, Mycobacterium tuberculosis
LNRSERD

SEQ ID NO: 1420414 - protein, 10 aa, Mycobacterium tuberculosis
LNTGYGNSGF

SEQ ID NO: 1420415 - protein, 10 aa, Mycobacterium tuberculosis
LPDGPDGPRA

SEQ ID NO: 1420416 - protein, 6 aa, Mycobacterium tuberculosis
LPDPRL

SEQ ID NO: 1420417 - protein, 13 aa, Mycobacterium tuberculosis
LPDTGLSARGRPL

SEQ ID NO: 1420418 - protein, 8 aa, Mycobacterium tuberculosis
LPEEPERH

SEQ ID NO: 1420419 - protein, 8 aa, Mycobacterium tuberculosis
LPEPDSTL

SEQ ID NO: 1420420 - protein, 5 aa, Mycobacterium tuberculosis
LPGAA

SEQ ID NO: 1420421 - protein, 16 aa, Mycobacterium tuberculosis
LPGGRLRNDEDMTSSV

SEQ ID NO: 1420422 - protein, 8 aa, Mycobacterium tuberculosis
LPPEGRFG

SEQ ID NO: 1420423 - protein, 7 aa, Mycobacterium tuberculosis
LPPEINS

SEQ ID NO: 1420424 - protein, 5 aa, Mycobacterium tuberculosis
LPPRA

SEQ ID NO: 1420425 - protein, 11 aa, Mycobacterium tuberculosis
LQGTTGGERDL

SEQ ID NO: 1420426 - protein, 7 aa, Mycobacterium tuberculosis
LQNATPT

SEQ ID NO: 1420427 - protein, 8 aa, Mycobacterium tuberculosis
LQSSNGPL

SEQ ID NO: 1420428 - protein, 7 aa, Mycobacterium tuberculosis
LRARRDR

SEQ ID NO: 1420429 - protein, 12 aa, Mycobacterium tuberculosis
LRESGDADAVRA

SEQ ID NO: 1420430 - protein, 11 aa, Mycobacterium tuberculosis
LRETANWPQGQ

SEQ ID NO: 1420431 - protein, 5 aa, Mycobacterium tuberculosis
LRPGG

SEQ ID NO: 1420432 - protein, 12 aa, Mycobacterium tuberculosis
LRSHRHPRPVTV

SEQ ID NO: 1420433 - protein, 13 aa, Mycobacterium tuberculosis
LSAKEMAKAPSAH

SEQ ID NO: 1420434 - protein, 5 aa, Mycobacterium tuberculosis
LSAKP

SEQ ID NO: 1420435 - protein, 8 aa, Mycobacterium tuberculosis
LSGGPDSL

SEQ ID NO: 1420436 - protein, 8 aa, Mycobacterium tuberculosis
LSGTSGGV

SEQ ID NO: 1420437 - protein, 4 aa, Mycobacterium tuberculosis
LSNY

SEQ ID NO: 1420438 - protein, 18 aa, Mycobacterium tuberculosis
LSPAPSPRPPATSTEGAS

SEQ ID NO: 1420439 - protein, 5 aa, Mycobacterium tuberculosis
LSPGE

SEQ ID NO: 1420440 - protein, 5 aa, Mycobacterium tuberculosis
LSPSV

SEQ ID NO: 1420441 - protein, 9 aa, Mycobacterium tuberculosis
LSQKGTAIA

SEQ ID NO: 1420442 - protein, 6 aa, Mycobacterium tuberculosis
LSQRAQ

SEQ ID NO: 1420443 - protein, 10 aa, Mycobacterium tuberculosis
LSTPPTLAQA

SEQ ID NO: 1420444 - protein, 11 aa, Mycobacterium tuberculosis
LTAPAPHHTRP

SEQ ID NO: 1420445 - protein, 8 aa, Mycobacterium tuberculosis
LTDSGRRA

SEQ ID NO: 1420446 - protein, 14 aa, Mycobacterium tuberculosis
LTEQSARQDAAEQA

SEQ ID NO: 1420447 - protein, 4 aa, Mycobacterium tuberculosis
LTPA

SEQ ID NO: 1420448 - protein, 7 aa, Mycobacterium tuberculosis
LTPRNTD

SEQ ID NO: 1420449 - protein, 10 aa, Mycobacterium tuberculosis
LVPSGEQSSL

SEQ ID NO: 1420450 - protein, 13 aa, Mycobacterium tuberculosis
LYGPGDNFSPSGS

SEQ ID NO: 1420451 - protein, 7 aa, Mycobacterium tuberculosis
LYPANSV

SEQ ID NO: 1420452 - protein, 5 aa, Mycobacterium tuberculosis
MADDP

SEQ ID NO: 1420453 - protein, 4 aa, Mycobacterium tuberculosis
MEGA

SEQ ID NO: 1420454 - protein, 13 aa, Mycobacterium tuberculosis
MEQTGGFEGRTKK

SEQ ID NO: 1420455 - protein, 10 aa, Mycobacterium tuberculosis
MESGSGGPGV

SEQ ID NO: 1420456 - protein, 19 aa, Mycobacterium tuberculosis
MGGRDSSSNLGRSQPTVSV

SEQ ID NO: 1420457 - protein, 11 aa, Mycobacterium tuberculosis
MGRPEYPTPVG

SEQ ID NO: 1420458 - protein, 6 aa, Mycobacterium tuberculosis
MPNGAA

SEQ ID NO: 1420459 - protein, 10 aa, Mycobacterium tuberculosis
MSEDGRSGRA

SEQ ID NO: 1420460 - protein, 16 aa, Mycobacterium tuberculosis
MTPNAASTGDSAKNTI

SEQ ID NO: 1420461 - protein, 4 aa, Mycobacterium tuberculosis
MTTQ

SEQ ID NO: 1420462 - protein, 6 aa, Mycobacterium tuberculosis
NAAAGY

SEQ ID NO: 1420463 - protein, 13 aa, Mycobacterium tuberculosis
NAANAAAAAPTTG

SEQ ID NO: 1420464 - protein, 12 aa, Mycobacterium tuberculosis
NADAANASRDAV

SEQ ID NO: 1420465 - protein, 5 aa, Mycobacterium tuberculosis
NAPTI

SEQ ID NO: 1420466 - protein, 6 aa, Mycobacterium tuberculosis
NDLNAL

SEQ ID NO: 1420467 - protein, 5 aa, Mycobacterium tuberculosis
NDYSV

SEQ ID NO: 1420468 - protein, 13 aa, Mycobacterium tuberculosis
NEDVPETSADPRV

SEQ ID NO: 1420469 - protein, 8 aa, Mycobacterium tuberculosis
NESGIDVS

SEQ ID NO: 1420470 - protein, 9 aa, Mycobacterium tuberculosis
NFTQTSDDE

SEQ ID NO: 1420471 - protein, 17 aa, Mycobacterium tuberculosis
NGANGAPGTGQAGGAGG

SEQ ID NO: 1420472 - protein, 37 aa, Mycobacterium tuberculosis; identical to SEQ ID NO: 181280

SEQ ID NO: 1420473 - protein, 18 aa, Mycobacterium tuberculosis
NGGAGASSFLGGGGAGGR

SEQ ID NO: 1420474 - protein, 28 aa, Mycobacterium tuberculosis
NGGAGGLGGTGVAGVNGGMGAAGGAGGN

SEQ ID NO: 1420475 - protein, 8 aa, Mycobacterium tuberculosis
NGPIASTG

SEQ ID NO: 1420476 - protein, 6 aa, Mycobacterium tuberculosis
NGPLQQ

SEQ ID NO: 1420477 - protein, 7 aa, Mycobacterium tuberculosis
NHDERNE

SEQ ID NO: 1420478 - protein, 8 aa, Mycobacterium tuberculosis
NHYERSKD

SEQ ID NO: 1420479 - protein, 7 aa, Mycobacterium tuberculosis
NIATNAG

SEQ ID NO: 1420480 - protein, 5 aa, Mycobacterium tuberculosis
NLAGQ

SEQ ID NO: 1420481 - protein, 6 aa, Mycobacterium tuberculosis
NLGDGN

SEQ ID NO: 1420482 - protein, 11 aa, Mycobacterium tuberculosis
NLGRAASVGSL

SEQ ID NO: 1420483 - protein, 15 aa, Mycobacterium tuberculosis
NPDQWADSDRDQVNT

SEQ ID NO: 1420484 - protein, 47 aa, Mycobacterium tuberculosis
NPGDLNTGSFNPGSFNTGGFNPGSGNTGYLNTGDYNTGVANTGDVDT

SEQ ID NO: 1420485 - protein, 18 aa, Mycobacterium tuberculosis
NPGPSNTGTFNTGGANTG

SEQ ID NO: 1420486 - protein, 8 aa, Mycobacterium tuberculosis
NPKGKYQS

SEQ ID NO: 1420487 - protein, 4 aa, Mycobacterium tuberculosis
NQGV

SEQ ID NO: 1420488 - protein, 7 aa, Mycobacterium tuberculosis
NQPPARY

SEQ ID NO: 1420489 - protein, 9 aa, Mycobacterium tuberculosis
NRGAGTEDA

SEQ ID NO: 1420490 - protein, 17 aa, Mycobacterium tuberculosis
NRSVPNGVAAGSPEERA

SEQ ID NO: 1420491 - protein, 20 aa, Mycobacterium tuberculosis
NSGGFNTGIGNAGSTNTGVF

SEQ ID NO: 1420492 - protein, 11 aa, Mycobacterium tuberculosis
NTAKSAARAYG

SEQ ID NO: 1420493 - protein, 4 aa, Mycobacterium tuberculosis
NTDS

SEQ ID NO: 1420494 - protein, 4 aa, Mycobacterium tuberculosis
NTGS

SEQ ID NO: 1420495 - protein, 10 aa, Mycobacterium tuberculosis
NTIDATGVGT

SEQ ID NO: 1420496 - protein, 11 aa, Mycobacterium tuberculosis
NTPAIAATEAQ

SEQ ID NO: 1420497 - protein, 9 aa, Mycobacterium tuberculosis
NTPDGDEAL

SEQ ID NO: 1420498 - protein, 10 aa, Mycobacterium tuberculosis
NTRSRRSQWK

SEQ ID NO: 1420499 - protein, 9 aa, Mycobacterium tuberculosis
NTSAVDSRR

SEQ ID NO: 1420500 - protein, 8 aa, Mycobacterium tuberculosis
NVGAGQRR

SEQ ID NO: 1420501 - protein, 7 aa, Mycobacterium tuberculosis
NVNEPPE

SEQ ID NO: 1420502 - protein, 19 aa, Mycobacterium tuberculosis
NVPASPGFGNSTTAPSSGF

SEQ ID NO: 1420503 - protein, 6 aa, Mycobacterium tuberculosis
NWASAA

SEQ ID NO: 1420504 - protein, 7 aa, Mycobacterium tuberculosis
NWERSGW

SEQ ID NO: 1420505 - protein, 9 aa, Mycobacterium tuberculosis
PAAAPTPAA

SEQ ID NO: 1420506 - protein, 8 aa, Mycobacterium tuberculosis
PAADPVSL

SEQ ID NO: 1420507 - protein, 5 aa, Mycobacterium tuberculosis
PAAFT

SEQ ID NO: 1420508 - protein, 26 aa, Mycobacterium tuberculosis
PAAGANSSCWPADPSQHHRIAESRAC

SEQ ID NO: 1420509 - protein, 7 aa, Mycobacterium tuberculosis
PADAGVS

SEQ ID NO: 1420510 - protein, 10 aa, Mycobacterium tuberculosis
PADERRGDFS

SEQ ID NO: 1420511 - protein, 28 aa, Mycobacterium tuberculosis
PADPTPTTGGPLLSSNGGYRDDSRLATR

SEQ ID NO: 1420512 - protein, 13 aa, Mycobacterium tuberculosis
PAFSPPAQALGGG

SEQ ID NO: 1420513 - protein, 6 aa, Mycobacterium tuberculosis
PAGSTE

SEQ ID NO: 1420514 - protein, 11 aa, Mycobacterium tuberculosis
PAMPDGVTDRR

SEQ ID NO: 1420515 - protein, 8 aa, Mycobacterium tuberculosis
PAPAAEPL

SEQ ID NO: 1420516 - protein, 8 aa, Mycobacterium tuberculosis
PAPGGRRE

SEQ ID NO: 1420517 - protein, 27 aa, Mycobacterium tuberculosis
PAPQAVPRPSAAAAEPKHQPAREPRPV

SEQ ID NO: 1420518 - protein, 7 aa, Mycobacterium tuberculosis
PAPRGHK

SEQ ID NO: 1420519 - protein, 25 aa, Mycobacterium tuberculosis
PARVTGRNVPSEQKAPYDPERADRA

SEQ ID NO: 1420520 - protein, 11 aa, Mycobacterium tuberculosis
PATEDPEFTER

SEQ ID NO: 1420521 - protein, 9 aa, Mycobacterium tuberculosis
PATTTPANI

SEQ ID NO: 1420522 - protein, 9 aa, Mycobacterium tuberculosis
PDGSTTVDT

SEQ ID NO: 1420523 - protein, 8 aa, Mycobacterium tuberculosis
PDGTDGGP

SEQ ID NO: 1420524 - protein, 5 aa, Mycobacterium tuberculosis
PDHRV

SEQ ID NO: 1420525 - protein, 4 aa, Mycobacterium tuberculosis
PDMG

SEQ ID NO: 1420526 - protein, 15 aa, Mycobacterium tuberculosis
PDPRTGCSTTAPNSV

SEQ ID NO: 1420527 - protein, 22 aa, Mycobacterium tuberculosis
PDPSVRAAAERRAQDTGASVTV

SEQ ID NO: 1420528 - protein, 9 aa, Mycobacterium tuberculosis
PDRVPGLSS

SEQ ID NO: 1420529 - protein, 6 aa, Mycobacterium tuberculosis
PDSPEA

SEQ ID NO: 1420530 - protein, 18 aa, Mycobacterium tuberculosis
PDTKSPVTGSLGSARADA

SEQ ID NO: 1420531 - protein, 5 aa, Mycobacterium tuberculosis
PDVRE

SEQ ID NO: 1420532 - protein, 12 aa, Mycobacterium tuberculosis
PEAPLRDAPAHR

SEQ ID NO: 1420533 - protein, 6 aa, Mycobacterium tuberculosis
PEATAS

SEQ ID NO: 1420534 - protein, 8 aa, Mycobacterium tuberculosis
PEAVHEPS

SEQ ID NO: 1420535 - protein, 13 aa, Mycobacterium tuberculosis
PEHGECAVHVNPV

SEQ ID NO: 1420536 - protein, 7 aa, Mycobacterium tuberculosis
PEHTGGG

SEQ ID NO: 1420537 - protein, 8 aa, Mycobacterium tuberculosis
PELPGSDA

SEQ ID NO: 1420538 - protein, 9 aa, Mycobacterium tuberculosis
PESQTGKST

SEQ ID NO: 1420539 - protein, 10 aa, Mycobacterium tuberculosis
PFEKPGRHRR

SEQ ID NO: 1420540 - protein, 18 aa, Mycobacterium tuberculosis
PFSTPEKAQRYQTENYRG

SEQ ID NO: 1420541 - protein, 4 aa, Mycobacterium tuberculosis
PGNR

SEQ ID NO: 1420542 - protein, 28 aa, Mycobacterium tuberculosis
PGPEPATSGKRAPLDESPRHEKLDGGAG

SEQ ID NO: 1420543 - protein, 9 aa, Mycobacterium tuberculosis
PGPPVPTTA

SEQ ID NO: 1420544 - protein, 13 aa, Mycobacterium tuberculosis
PGRAKLSDGSERD

SEQ ID NO: 1420545 - protein, 4 aa, Mycobacterium tuberculosis
PGRH

SEQ ID NO: 1420546 - protein, 9 aa, Mycobacterium tuberculosis
PKKKGKSLT

SEQ ID NO: 1420547 - protein, 10 aa, Mycobacterium tuberculosis
PLGGGATGGI

SEQ ID NO: 1420548 - protein, 7 aa, Mycobacterium tuberculosis
PLPQADR

SEQ ID NO: 1420549 - protein, 4 aa, Mycobacterium tuberculosis
PLQA

SEQ ID NO: 1420550 - protein, 5 aa, Mycobacterium tuberculosis
PLQRA

SEQ ID NO: 1420551 - protein, 4 aa, Mycobacterium tuberculosis
PLTP

SEQ ID NO: 1420552 - protein, 15 aa, Mycobacterium tuberculosis
PMGSDGGAMGLDPAT

SEQ ID NO: 1420553 - protein, 4 aa, Mycobacterium tuberculosis
PNAP

SEQ ID NO: 1420554 - protein, 6 aa, Mycobacterium tuberculosis
PNTAKL

SEQ ID NO: 1420555 - protein, 16 aa, Mycobacterium tuberculosis
PNVLPSSTNPTRPHTV

SEQ ID NO: 1420556 - protein, 7 aa, Mycobacterium tuberculosis
PPDREPA

SEQ ID NO: 1420557 - protein, 6 aa, Mycobacterium tuberculosis
PPEGFD

SEQ ID NO: 1420558 - protein, 6 aa, Mycobacterium tuberculosis
PPEINS

SEQ ID NO: 1420559 - protein, 5 aa, Mycobacterium tuberculosis
PPERT

SEQ ID NO: 1420560 - protein, 5 aa, Mycobacterium tuberculosis
PPFAN

SEQ ID NO: 1420561 - protein, 4 aa, Mycobacterium tuberculosis
PPRK

SEQ ID NO: 1420562 - protein, 4 aa, Mycobacterium tuberculosis
PPTE

SEQ ID NO: 1420563 - protein, 8 aa, Mycobacterium tuberculosis
PPVVNPGL

SEQ ID NO: 1420564 - protein, 15 aa, Mycobacterium tuberculosis
PPYSVGQSSANDLNA

SEQ ID NO: 1420565 - protein, 15 aa, Mycobacterium tuberculosis
PQATGASTQPQLSRE

SEQ ID NO: 1420566 - protein, 10 aa, Mycobacterium tuberculosis
PQFDTSKRRL

SEQ ID NO: 1420567 - protein, 9 aa, Mycobacterium tuberculosis
PRARKPQRR

SEQ ID NO: 1420568 - protein, 7 aa, Mycobacterium tuberculosis
PREAGDA

SEQ ID NO: 1420569 - protein, 10 aa, Mycobacterium tuberculosis
PRIPEHGDYA

SEQ ID NO: 1420570 - protein, 7 aa, Mycobacterium tuberculosis
PRKGQDT

SEQ ID NO: 1420571 - protein, 10 aa, Mycobacterium tuberculosis
PSHPTQGEGP

SEQ ID NO: 1420572 - protein, 4 aa, Mycobacterium tuberculosis
PSIS

SEQ ID NO: 1420573 - protein, 12 aa, Mycobacterium tuberculosis
PSSRSGPAPQSL

SEQ ID NO: 1420574 - protein, 9 aa, Mycobacterium tuberculosis
PSTGGTWQA

SEQ ID NO: 1420575 - protein, 12 aa, Mycobacterium tuberculosis
PSVTIDSGQSSS

SEQ ID NO: 1420576 - protein, 6 aa, Mycobacterium tuberculosis
PTDKAF

SEQ ID NO: 1420577 - protein, 4 aa, Mycobacterium tuberculosis
PTGG

SEQ ID NO: 1420578 - protein, 6 aa, Mycobacterium tuberculosis
PTGPVT

SEQ ID NO: 1420579 - protein, 4 aa, Mycobacterium tuberculosis
PTME

SEQ ID NO: 1420580 - protein, 4 aa, Mycobacterium tuberculosis
PTRD

SEQ ID NO: 1420581 - protein, 4 aa, Mycobacterium tuberculosis
PTSP

SEQ ID NO: 1420582 - protein, 10 aa, Mycobacterium tuberculosis
PVAGRSEANL

SEQ ID NO: 1420583 - protein, 5 aa, Mycobacterium tuberculosis
PVDDD

SEQ ID NO: 1420584 - protein, 4 aa, Mycobacterium tuberculosis
PVNA

SEQ ID NO: 1420585 - protein, 13 aa, Mycobacterium tuberculosis
PVNVSPDADSLIL

SEQ ID NO: 1420586 - protein, 4 aa, Mycobacterium tuberculosis
PWRP

SEQ ID NO: 1420587 - protein, 6 aa, Mycobacterium tuberculosis
PYLPPS

SEQ ID NO: 1420588 - protein, 10 aa, Mycobacterium tuberculosis
PYQGAATGVG

SEQ ID NO: 1420589 - protein, 17 aa, Mycobacterium tuberculosis
QAASAEASRDVSAAADW

SEQ ID NO: 1420590 - protein, 7 aa, Mycobacterium tuberculosis
QAEVDSG

SEQ ID NO: 1420591 - protein, 14 aa, Mycobacterium tuberculosis
QAGSGGTPLPLEDD

SEQ ID NO: 1420592 - protein, 8 aa, Mycobacterium tuberculosis
QAKQNSYA

SEQ ID NO: 1420593 - protein, 8 aa, Mycobacterium tuberculosis
QARQQLED

SEQ ID NO: 1420594 - protein, 6 aa, Mycobacterium tuberculosis
QARSIG

SEQ ID NO: 1420595 - protein, 12 aa, Mycobacterium tuberculosis
QAVKNSLSRAAK

SEQ ID NO: 1420596 - protein, 7 aa, Mycobacterium tuberculosis
QDGDGTQ

SEQ ID NO: 1420597 - protein, 6 aa, Mycobacterium tuberculosis
QDGITR

SEQ ID NO: 1420598 - protein, 24 aa, Mycobacterium tuberculosis
QDKGYAVPDYPADPKTDQEKAIKE

SEQ ID NO: 1420599 - protein, 6 aa, Mycobacterium tuberculosis
QDRASV

SEQ ID NO: 1420600 - protein, 6 aa, Mycobacterium tuberculosis
QEAQKR

SEQ ID NO: 1420601 - protein, 7 aa, Mycobacterium tuberculosis
QELRGSG

SEQ ID NO: 1420602 - protein, 8 aa, Mycobacterium tuberculosis
QERAARGA

SEQ ID NO: 1420603 - protein, 10 aa, Mycobacterium tuberculosis
QGAKTLRGGK

SEQ ID NO: 1420604 - protein, 4 aa, Mycobacterium tuberculosis
QGQL

SEQ ID NO: 1420605 - protein, 9 aa, Mycobacterium tuberculosis
QGQQAPSGH

SEQ ID NO: 1420606 - protein, 12 aa, Mycobacterium tuberculosis
QGTVAGRPNDGC

SEQ ID NO: 1420607 - protein, 23 aa, Mycobacterium tuberculosis
QHSAGACSDTLATGGTVELQEIR

SEQ ID NO: 1420608 - protein, 9 aa, Mycobacterium tuberculosis
QIGTPEELY

SEQ ID NO: 1420609 - protein, 8 aa, Mycobacterium tuberculosis
QISDPAQR

SEQ ID NO: 1420610 - protein, 7 aa, Mycobacterium tuberculosis
QKAKGLD

SEQ ID NO: 1420611 - protein, 22 aa, Mycobacterium tuberculosis
QKSGTQSAGEAVEAAGQVHNEH

SEQ ID NO: 1420612 - protein, 7 aa, Mycobacterium tuberculosis
QLYGPNG

SEQ ID NO: 1420613 - protein, 4 aa, Mycobacterium tuberculosis
QNEK

SEQ ID NO: 1420614 - protein, 10 aa, Mycobacterium tuberculosis
QNPTIQGRDA

SEQ ID NO: 1420615 - protein, 10 aa, Mycobacterium tuberculosis
QPHSGAQANA

SEQ ID NO: 1420616 - protein, 11 aa, Mycobacterium tuberculosis
QPIPVGTQGGT

SEQ ID NO: 1420617 - protein, 8 aa, Mycobacterium tuberculosis
QPLDPGLY

SEQ ID NO: 1420618 - protein, 9 aa, Mycobacterium tuberculosis
QPTEEARAA

SEQ ID NO: 1420619 - protein, 4 aa, Mycobacterium tuberculosis
QQLG

SEQ ID NO: 1420620 - protein, 7 aa, Mycobacterium tuberculosis
QQVDADE

SEQ ID NO: 1420621 - protein, 26 aa, Mycobacterium tuberculosis
QRAQQNAAASTDADRALSTPSGVTEI

SEQ ID NO: 1420622 - protein, 5 aa, Mycobacterium tuberculosis
QRESL

SEQ ID NO: 1420623 - protein, 6 aa, Mycobacterium tuberculosis
QRPGVG

SEQ ID NO: 1420624 - protein, 12 aa, Mycobacterium tuberculosis
QRSLRARNFDAD

SEQ ID NO: 1420625 - protein, 12 aa, Mycobacterium tuberculosis
QRTAGQSTRSAD

SEQ ID NO: 1420626 - protein, 4 aa, Mycobacterium tuberculosis
QSAW

SEQ ID NO: 1420627 - protein, 11 aa, Mycobacterium tuberculosis
QSEAERDGATG

SEQ ID NO: 1420628 - protein, 7 aa, Mycobacterium tuberculosis
QSGDGPP

SEQ ID NO: 1420629 - protein, 5 aa, Mycobacterium tuberculosis
QSGKY

SEQ ID NO: 1420630 - protein, 6 aa, Mycobacterium tuberculosis
QSNRVD

SEQ ID NO: 1420631 - protein, 11 aa, Mycobacterium tuberculosis
QTGEPQSGSEW

SEQ ID NO: 1420632 - protein, 27 aa, Mycobacterium tuberculosis
QTPITSSPTTPPPTTPPEIPTGGTVIS

SEQ ID NO: 1420633 - protein, 9 aa, Mycobacterium tuberculosis
QTSDEVTVE

SEQ ID NO: 1420634 - protein, 10 aa, Mycobacterium tuberculosis
QTVDDQPGGI

SEQ ID NO: 1420635 - protein, 6 aa, Mycobacterium tuberculosis
QVTKDG

SEQ ID NO: 1420636 - protein, 8 aa, Mycobacterium tuberculosis
RAARQLGQ

SEQ ID NO: 1420637 - protein, 9 aa, Mycobacterium tuberculosis
RADAPDKVN

SEQ ID NO: 1420638 - protein, 16 aa, Mycobacterium tuberculosis
RAEQAGAQAEAAAAAY

SEQ ID NO: 1420639 - protein, 5 aa, Mycobacterium tuberculosis
RAGRS

SEQ ID NO: 1420640 - protein, 8 aa, Mycobacterium tuberculosis
RAHTDRAA

SEQ ID NO: 1420641 - protein, 7 aa, Mycobacterium tuberculosis
RAKKNAI

SEQ ID NO: 1420642 - protein, 9 aa, Mycobacterium tuberculosis
RAPTEPVEP

SEQ ID NO: 1420643 - protein, 4 aa, Mycobacterium tuberculosis
RAPV

SEQ ID NO: 1420644 - protein, 11 aa, Mycobacterium tuberculosis
RARSTGQRPSW

SEQ ID NO: 1420645 - protein, 6 aa, Mycobacterium tuberculosis
RARSVG

SEQ ID NO: 1420646 - protein, 4 aa, Mycobacterium tuberculosis
RASA

SEQ ID NO: 1420647 - protein, 4 aa, Mycobacterium tuberculosis
RATK

SEQ ID NO: 1420648 - protein, 8 aa, Mycobacterium tuberculosis
RATREGNQ

SEQ ID NO: 1420649 - protein, 7 aa, Mycobacterium tuberculosis
RDAAEAA

SEQ ID NO: 1420650 - protein, 9 aa, Mycobacterium tuberculosis
RDANATANR

SEQ ID NO: 1420651 - protein, 12 aa, Mycobacterium tuberculosis
RDDDRRPQDRSD

SEQ ID NO: 1420652 - protein, 9 aa, Mycobacterium tuberculosis
RDEQTHQPV

SEQ ID NO: 1420653 - protein, 4 aa, Mycobacterium tuberculosis
RDGS

SEQ ID NO: 1420654 - protein, 5 aa, Mycobacterium tuberculosis
RDPEV

SEQ ID NO: 1420655 - protein, 10 aa, Mycobacterium tuberculosis
RDWRGSPDQF

SEQ ID NO: 1420656 - protein, 7 aa, Mycobacterium tuberculosis
REATAAF

SEQ ID NO: 1420657 - protein, 10 aa, Mycobacterium tuberculosis
REDEDELPAG

SEQ ID NO: 1420658 - protein, 8 aa, Mycobacterium tuberculosis
REDVERGQ

SEQ ID NO: 1420659 - protein, 9 aa, Mycobacterium tuberculosis
REGSEEYLD

SEQ ID NO: 1420660 - protein, 6 aa, Mycobacterium tuberculosis
REHTGR

SEQ ID NO: 1420661 - protein, 7 aa, Mycobacterium tuberculosis
REPDHDK

SEQ ID NO: 1420662 - protein, 4 aa, Mycobacterium tuberculosis
RERG

SEQ ID NO: 1420663 - protein, 9 aa, Mycobacterium tuberculosis
RGAPGGPQH

SEQ ID NO: 1420664 - protein, 15 aa, Mycobacterium tuberculosis
RGDTEAAAAAQASID

SEQ ID NO: 1420665 - protein, 4 aa, Mycobacterium tuberculosis
RGEG

SEQ ID NO: 1420666 - protein, 5 aa, Mycobacterium tuberculosis
RGGGE

SEQ ID NO: 1420667 - protein, 4 aa, Mycobacterium tuberculosis
RGGR

SEQ ID NO: 1420668 - protein, 9 aa, Mycobacterium tuberculosis
RGPDGTGVE

SEQ ID NO: 1420669 - protein, 23 aa, Mycobacterium tuberculosis
RGRIDKSTAELADERSAVTELGL

SEQ ID NO: 1420670 - protein, 16 aa, Mycobacterium tuberculosis
RGSDGAGDKQPGISFV

SEQ ID NO: 1420671 - protein, 9 aa, Mycobacterium tuberculosis
RGTAETAGT

SEQ ID NO: 1420672 - protein, 12 aa, Mycobacterium tuberculosis
RGTAGRATAHPR

SEQ ID NO: 1420673 - protein, 11 aa, Mycobacterium tuberculosis
RGVRDTPEAAR

SEQ ID NO: 1420674 - protein, 10 aa, Mycobacterium tuberculosis
RHPDRPAGVP

SEQ ID NO: 1420675 - protein, 9 aa, Mycobacterium tuberculosis
RHPNATAGN

SEQ ID NO: 1420676 - protein, 5 aa, Mycobacterium tuberculosis
RHPRG

SEQ ID NO: 1420677 - protein, 10 aa, Mycobacterium tuberculosis
RHPVSRKTWS

SEQ ID NO: 1420678 - protein, 5 aa, Mycobacterium tuberculosis
RHPYG

SEQ ID NO: 1420679 - protein, 5 aa, Mycobacterium tuberculosis
RIGGR

SEQ ID NO: 1420680 - protein, 5 aa, Mycobacterium tuberculosis
RIPTQ

SEQ ID NO: 1420681 - protein, 5 aa, Mycobacterium tuberculosis
RIQSK

SEQ ID NO: 1420682 - protein, 15 aa, Mycobacterium tuberculosis
RKGKPSQDRRAEEHR

SEQ ID NO: 1420683 - protein, 10 aa, Mycobacterium tuberculosis
RKPTGRKTTA

SEQ ID NO: 1420684 - protein, 11 aa, Mycobacterium tuberculosis
RKQGGEPAVNA

SEQ ID NO: 1420685 - protein, 7 aa, Mycobacterium tuberculosis
RKRRQPV

SEQ ID NO: 1420686 - protein, 7 aa, Mycobacterium tuberculosis
RLSDQEL

SEQ ID NO: 1420687 - protein, 13 aa, Mycobacterium tuberculosis
RLTPRPQPADGVS

SEQ ID NO: 1420688 - protein, 8 aa, Mycobacterium tuberculosis
RNAEDALQ

SEQ ID NO: 1420689 - protein, 7 aa, Mycobacterium tuberculosis
RNEEDPR

SEQ ID NO: 1420690 - protein, 16 aa, Mycobacterium tuberculosis
RNGIGTGISASDRATT

SEQ ID NO: 1420691 - protein, 14 aa, Mycobacterium tuberculosis
RNSPDGDEPLPADG

SEQ ID NO: 1420692 - protein, 9 aa, Mycobacterium tuberculosis
RPDPRDPTL

SEQ ID NO: 1420693 - protein, 8 aa, Mycobacterium tuberculosis
RPDSPTAE

SEQ ID NO: 1420694 - protein, 11 aa, Mycobacterium tuberculosis
RPENPDRTAGA

SEQ ID NO: 1420695 - protein, 8 aa, Mycobacterium tuberculosis
RPGAVTRR

SEQ ID NO: 1420696 - protein, 21 aa, Mycobacterium tuberculosis
RPGRFGSADLPEASDDNERTS

SEQ ID NO: 1420697 - protein, 11 aa, Mycobacterium tuberculosis
RPGRPSRTPAQ

SEQ ID NO: 1420698 - protein, 11 aa, Mycobacterium tuberculosis
RPGYGRSTFQA

SEQ ID NO: 1420699 - protein, 12 aa, Mycobacterium tuberculosis
RPKDDEGGGNAV

SEQ ID NO: 1420700 - protein, 6 aa, Mycobacterium tuberculosis
RPLSAT

SEQ ID NO: 1420701 - protein, 5 aa, Mycobacterium tuberculosis
RPNAG

SEQ ID NO: 1420702 - protein, 11 aa, Mycobacterium tuberculosis
RPPRASFDADP

SEQ ID NO: 1420703 - protein, 14 aa, Mycobacterium tuberculosis
RPQGELDESSRAAA

SEQ ID NO: 1420704 - protein, 16 aa, Mycobacterium tuberculosis
RQRSASVGSHVAIELH

SEQ ID NO: 1420705 - protein, 6 aa, Mycobacterium tuberculosis
RRAAGD

SEQ ID NO: 1420706 - protein, 6 aa, Mycobacterium tuberculosis
RRDAHD

SEQ ID NO: 1420707 - protein, 7 aa, Mycobacterium tuberculosis
RREQPEI

SEQ ID NO: 1420708 - protein, 7 aa, Mycobacterium tuberculosis
RRGPGGG

SEQ ID NO: 1420709 - protein, 8 aa, Mycobacterium tuberculosis
RRIARTAP

SEQ ID NO: 1420710 - protein, 11 aa, Mycobacterium tuberculosis
RRIPGSHGHRA

SEQ ID NO: 1420711 - protein, 14 aa, Mycobacterium tuberculosis
RRKVTRRRGALSLV

SEQ ID NO: 1420712 - protein, 5 aa, Mycobacterium tuberculosis
RRNGR

SEQ ID NO: 1420713 - protein, 16 aa, Mycobacterium tuberculosis
RRRDEPFGDYGRQASR

SEQ ID NO: 1420714 - protein, 11 aa, Mycobacterium tuberculosis
RRRDRSDAAAL

SEQ ID NO: 1420715 - protein, 8 aa, Mycobacterium tuberculosis
RRRTRQTY

SEQ ID NO: 1420716 - protein, 8 aa, Mycobacterium tuberculosis
RRRYESAA

SEQ ID NO: 1420717 - protein, 4 aa, Mycobacterium tuberculosis
RRST

SEQ ID NO: 1420718 - protein, 6 aa, Mycobacterium tuberculosis
RRYRGD

SEQ ID NO: 1420719 - protein, 5 aa, Mycobacterium tuberculosis
RSCPE

SEQ ID NO: 1420720 - protein, 20 aa, Mycobacterium tuberculosis
RSHQRSNPDDVTTRAPECAG

SEQ ID NO: 1420721 - protein, 4 aa, Mycobacterium tuberculosis
RSLA

SEQ ID NO: 1420722 - protein, 12 aa, Mycobacterium tuberculosis
RSPAGKQVKVTS

SEQ ID NO: 1420723 - protein, 9 aa, Mycobacterium tuberculosis
RSSLTGDAG

SEQ ID NO: 1420724 - protein, 7 aa, Mycobacterium tuberculosis
RSTEAQW

SEQ ID NO: 1420725 - protein, 8 aa, Mycobacterium tuberculosis
RTAQPVRV

SEQ ID NO: 1420726 - protein, 5 aa, Mycobacterium tuberculosis
RTENE

SEQ ID NO: 1420727 - protein, 8 aa, Mycobacterium tuberculosis
RTETPRTT

SEQ ID NO: 1420728 - protein, 10 aa, Mycobacterium tuberculosis
RTGDTHEVHE

SEQ ID NO: 1420729 - protein, 5 aa, Mycobacterium tuberculosis
RTGRI

SEQ ID NO: 1420730 - protein, 7 aa, Mycobacterium tuberculosis
RTPAEGR

SEQ ID NO: 1420731 - protein, 8 aa, Mycobacterium tuberculosis
RTRTRGEV

SEQ ID NO: 1420732 - protein, 5 aa, Mycobacterium tuberculosis
RTTGD

SEQ ID NO: 1420733 - protein, 9 aa, Mycobacterium tuberculosis
RVASAADAQ

SEQ ID NO: 1420734 - protein, 7 aa, Mycobacterium tuberculosis
RVDPDRL

SEQ ID NO: 1420735 - protein, 5 aa, Mycobacterium tuberculosis
RWPRA

SEQ ID NO: 1420736 - protein, 7 aa, Mycobacterium tuberculosis
RYAGTRQ

SEQ ID NO: 1420737 - protein, 9 aa, Mycobacterium tuberculosis
RYANPDVTA

SEQ ID NO: 1420738 - protein, 4 aa, Mycobacterium tuberculosis
RYRT

SEQ ID NO: 1420739 - protein, 10 aa, Mycobacterium tuberculosis
SAAGSGSQRL

SEQ ID NO: 1420740 - protein, 6 aa, Mycobacterium tuberculosis
SADENL

SEQ ID NO: 1420741 - protein, 5 aa, Mycobacterium tuberculosis
SADRR

SEQ ID NO: 1420742 - protein, 9 aa, Mycobacterium tuberculosis
SAEPAIRPG

SEQ ID NO: 1420743 - protein, 8 aa, Mycobacterium tuberculosis
SAGGATQH

SEQ ID NO: 1420744 - protein, 10 aa, Mycobacterium tuberculosis
SAGVTAARES

SEQ ID NO: 1420745 - protein, 8 aa, Mycobacterium tuberculosis
SAKARNVD

SEQ ID NO: 1420746 - protein, 4 aa, Mycobacterium tuberculosis
SALG

SEQ ID NO: 1420747 - protein, 12 aa, Mycobacterium tuberculosis
SALPAGRPRMAG

SEQ ID NO: 1420748 - protein, 7 aa, Mycobacterium tuberculosis
SALPNTY

SEQ ID NO: 1420749 - protein, 11 aa, Mycobacterium tuberculosis
SAPAGDERNPL

SEQ ID NO: 1420750 - protein, 7 aa, Mycobacterium tuberculosis
SARAEES

SEQ ID NO: 1420751 - protein, 14 aa, Mycobacterium tuberculosis
SAVRSIPDSVPPPR

SEQ ID NO: 1420752 - protein, 32 aa, Mycobacterium tuberculosis
SDEEGARRELERGDRHPGWNRGSARAAHADAE

SEQ ID NO: 1420753 - protein, 6 aa, Mycobacterium tuberculosis
SDFGSA

SEQ ID NO: 1420754 - protein, 11 aa, Mycobacterium tuberculosis
SDGNAAASYTK

SEQ ID NO: 1420755 - protein, 7 aa, Mycobacterium tuberculosis
SDGNFGN

SEQ ID NO: 1420756 - protein, 8 aa, Mycobacterium tuberculosis
SDGSQDAG

SEQ ID NO: 1420757 - protein, 9 aa, Mycobacterium tuberculosis
SDPDEAVEK

SEQ ID NO: 1420758 - protein, 5 aa, Mycobacterium tuberculosis
SDPDR

SEQ ID NO: 1420759 - protein, 18 aa, Mycobacterium tuberculosis
SDQRGDRSSDQPTPASVA

SEQ ID NO: 1420760 - protein, 6 aa, Mycobacterium tuberculosis
SEEAHD

SEQ ID NO: 1420761 - protein, 18 aa, Mycobacterium tuberculosis
SEQDEYAAASHQKAAAAW

SEQ ID NO: 1420762 - protein, 9 aa, Mycobacterium tuberculosis
SETARGATA

SEQ ID NO: 1420763 - protein, 12 aa, Mycobacterium tuberculosis
SEYEDRDGIRRS

SEQ ID NO: 1420764 - protein, 16 aa, Mycobacterium tuberculosis
SFNTGVGNSGTGSTGL

SEQ ID NO: 1420765 - protein, 11 aa, Mycobacterium tuberculosis
SGAARRRTPAR

SEQ ID NO: 1420766 - protein, 9 aa, Mycobacterium tuberculosis
SGDEADADI

SEQ ID NO: 1420767 - protein, 17 aa, Mycobacterium tuberculosis
SGELTASDIDDPERPNA

SEQ ID NO: 1420768 - protein, 6 aa, Mycobacterium tuberculosis
SGFPNA

SEQ ID NO: 1420769 - protein, 13 aa, Mycobacterium tuberculosis
SGFSNLGSGVSGF

SEQ ID NO: 1420770 - protein, 8 aa, Mycobacterium tuberculosis
SGGAESLN

SEQ ID NO: 1420771 - protein, 8 aa, Mycobacterium tuberculosis
SGGRTRTR

SEQ ID NO: 1420772 - protein, 21 aa, Mycobacterium tuberculosis
SGLRASRNQGHAIVTPDGSPA

SEQ ID NO: 1420773 - protein, 10 aa, Mycobacterium tuberculosis
SGNEGSGNLG

SEQ ID NO: 1420774 - protein, 54 aa, Mycobacterium tuberculosis
SGNIGSYNLGGGNLGSYNLGSGNTGDTNFGGGNTGNLNVGGGNTGNSNFGFGNT

SEQ ID NO: 1420775 - protein, 6 aa, Mycobacterium tuberculosis
SGPATL

SEQ ID NO: 1420776 - protein, 18 aa, Mycobacterium tuberculosis
SGRALGAPPTTATAGAHA

SEQ ID NO: 1420777 - protein, 4 aa, Mycobacterium tuberculosis
SGRT

SEQ ID NO: 1420778 - protein, 5 aa, Mycobacterium tuberculosis
SGSLA

SEQ ID NO: 1420779 - protein, 6 aa, Mycobacterium tuberculosis
SGSTEF

SEQ ID NO: 1420780 - protein, 12 aa, Mycobacterium tuberculosis
SGSTGAPKGAMY

SEQ ID NO: 1420781 - protein, 39 aa, Mycobacterium tuberculosis
SGTGNVGIGNSGTGNWGIGNSGNSYNTGFGNSGDANTGF

SEQ ID NO: 1420782 - protein, 7 aa, Mycobacterium tuberculosis
SGTPGFT

SEQ ID NO: 1420783 - protein, 5 aa, Mycobacterium tuberculosis
SGTSI

SEQ ID NO: 1420784 - protein, 7 aa, Mycobacterium tuberculosis
SGTVESL

SEQ ID NO: 1420785 - protein, 9 aa, Mycobacterium tuberculosis
SGVANVGNT

SEQ ID NO: 1420786 - protein, 6 aa, Mycobacterium tuberculosis
SGVPSF

SEQ ID NO: 1420787 - protein, 4 aa, Mycobacterium tuberculosis
SHDE

SEQ ID NO: 1420788 - protein, 11 aa, Mycobacterium tuberculosis
SIARSEGKSVG

SEQ ID NO: 1420789 - protein, 5 aa, Mycobacterium tuberculosis
SISNA

SEQ ID NO: 1420790 - protein, 7 aa, Mycobacterium tuberculosis
SKGGYEA

SEQ ID NO: 1420791 - protein, 8 aa, Mycobacterium tuberculosis
SKYRGEFE

SEQ ID NO: 1420792 - protein, 12 aa, Mycobacterium tuberculosis
SLASRECPQPAD

SEQ ID NO: 1420793 - protein, 18 aa, Mycobacterium tuberculosis
SLEEGQAEIKDLLLRALD

SEQ ID NO: 1420794 - protein, 11 aa, Mycobacterium tuberculosis
SLGGPETHHKK

SEQ ID NO: 1420795 - protein, 10 aa, Mycobacterium tuberculosis
SLLGSPGQAA

SEQ ID NO: 1420796 - protein, 8 aa, Mycobacterium tuberculosis
SLPPGNQV

SEQ ID NO: 1420797 - protein, 11 aa, Mycobacterium tuberculosis
SLPPPAPQPAL

SEQ ID NO: 1420798 - protein, 13 aa, Mycobacterium tuberculosis
SNAEHSSTGLRSA

SEQ ID NO: 1420799 - protein, 7 aa, Mycobacterium tuberculosis
SNQVPAT

SEQ ID NO: 1420800 - protein, 4 aa, Mycobacterium tuberculosis
SNRA

SEQ ID NO: 1420801 - protein, 9 aa, Mycobacterium tuberculosis
SPGGESNVA

SEQ ID NO: 1420802 - protein, 8 aa, Mycobacterium tuberculosis
SPHPSAGI

SEQ ID NO: 1420803 - protein, 9 aa, Mycobacterium tuberculosis
SPHRRVTGT

SEQ ID NO: 1420804 - protein, 6 aa, Mycobacterium tuberculosis
SPLRDA

SEQ ID NO: 1420805 - protein, 5 aa, Mycobacterium tuberculosis
SPRHA

SEQ ID NO: 1420806 - protein, 13 aa, Mycobacterium tuberculosis
SPRLRSPLGASRP

SEQ ID NO: 1420807 - protein, 10 aa, Mycobacterium tuberculosis
SQHTEQAPPV

SEQ ID NO: 1420808 - protein, 17 aa, Mycobacterium tuberculosis
SQRHPELSRTENDAVRA

SEQ ID NO: 1420809 - protein, 4 aa, Mycobacterium tuberculosis
SRAQ

SEQ ID NO: 1420810 - protein, 8 aa, Mycobacterium tuberculosis
SRDNTGDV

SEQ ID NO: 1420811 - protein, 7 aa, Mycobacterium tuberculosis
SRGHATL

SEQ ID NO: 1420812 - protein, 8 aa, Mycobacterium tuberculosis
SRRASELG

SEQ ID NO: 1420813 - protein, 6 aa, Mycobacterium tuberculosis
SRRNPV

SEQ ID NO: 1420814 - protein, 13 aa, Mycobacterium tuberculosis
SRVRARQAAEARV

SEQ ID NO: 1420815 - protein, 6 aa, Mycobacterium tuberculosis
SSEAIA

SEQ ID NO: 1420816 - protein, 5 aa, Mycobacterium tuberculosis
SSFRE

SEQ ID NO: 1420817 - protein, 4 aa, Mycobacterium tuberculosis
SSFY

SEQ ID NO: 1420818 - protein, 4 aa, Mycobacterium tuberculosis
SSGA

SEQ ID NO: 1420819 - protein, 8 aa, Mycobacterium tuberculosis
SSSANTRD

SEQ ID NO: 1420820 - protein, 21 aa, Mycobacterium tuberculosis
SSSLSGDRRTYQQEPGNAAEA

SEQ ID NO: 1420821 - protein, 14 aa, Mycobacterium tuberculosis
SSYGTGTGKDAITS

SEQ ID NO: 1420822 - protein, 18 aa, Mycobacterium tuberculosis
STDTDETGRHTAEFTTPT

SEQ ID NO: 1420823 - protein, 6 aa, Mycobacterium tuberculosis
STGGGR

SEQ ID NO: 1420824 - protein, 14 aa, Mycobacterium tuberculosis
STGGWDDDGNPVHG

SEQ ID NO: 1420825 - protein, 4 aa, Mycobacterium tuberculosis
STPG

SEQ ID NO: 1420826 - protein, 9 aa, Mycobacterium tuberculosis
STPWPGGEL

SEQ ID NO: 1420827 - protein, 5 aa, Mycobacterium tuberculosis
STRAA

SEQ ID NO: 1420828 - protein, 9 aa, Mycobacterium tuberculosis
SVADDAGLA

SEQ ID NO: 1420829 - protein, 12 aa, Mycobacterium tuberculosis
SVARGGGRTSYR

SEQ ID NO: 1420830 - protein, 6 aa, Mycobacterium tuberculosis
SVDPYN

SEQ ID NO: 1420831 - protein, 5 aa, Mycobacterium tuberculosis
SVGND

SEQ ID NO: 1420832 - protein, 7 aa, Mycobacterium tuberculosis
SVPGAGD

SEQ ID NO: 1420833 - protein, 6 aa, Mycobacterium tuberculosis
SVPHPT

SEQ ID NO: 1420834 - protein, 6 aa, Mycobacterium tuberculosis
SVSGAV

SEQ ID NO: 1420835 - protein, 29 aa, Mycobacterium tuberculosis
SWSKSRDFADDPQRAAAVREASRAERDRY

SEQ ID NO: 1420836 - protein, 7 aa, Mycobacterium tuberculosis
SYDRVSR

SEQ ID NO: 1420837 - protein, 6 aa, Mycobacterium tuberculosis
SYPRSA

SEQ ID NO: 1420838 - protein, 5 aa, Mycobacterium tuberculosis
TAARD

SEQ ID NO: 1420839 - protein, 5 aa, Mycobacterium tuberculosis
TADPR

SEQ ID NO: 1420840 - protein, 8 aa, Mycobacterium tuberculosis
TAFTDGEQ

SEQ ID NO: 1420841 - protein, 8 aa, Mycobacterium tuberculosis
TAGAAAAW

SEQ ID NO: 1420842 - protein, 17 aa, Mycobacterium tuberculosis
TAGAGAARTTLARRTSA

SEQ ID NO: 1420843 - protein, 7 aa, Mycobacterium tuberculosis
TAGFPAP

SEQ ID NO: 1420844 - protein, 9 aa, Mycobacterium tuberculosis
TAGNPAKRA

SEQ ID NO: 1420845 - protein, 15 aa, Mycobacterium tuberculosis
TAKPGAFRRPNGQAF

SEQ ID NO: 1420846 - protein, 19 aa, Mycobacterium tuberculosis
TAPAGAATGVTSRADAHSQ

SEQ ID NO: 1420847 - protein, 9 aa, Mycobacterium tuberculosis
TAPAPTPVS

SEQ ID NO: 1420848 - protein, 9 aa, Mycobacterium tuberculosis
TAPVHEGDT

SEQ ID NO: 1420849 - protein, 10 aa, Mycobacterium tuberculosis
TAQRSTTNPV

SEQ ID NO: 1420850 - protein, 5 aa, Mycobacterium tuberculosis
TARAA

SEQ ID NO: 1420851 - protein, 9 aa, Mycobacterium tuberculosis
TARGQPAAV

SEQ ID NO: 1420852 - protein, 5 aa, Mycobacterium tuberculosis
TASAD

SEQ ID NO: 1420853 - protein, 12 aa, Mycobacterium tuberculosis
TASRHSYSAGAS

SEQ ID NO: 1420854 - protein, 7 aa, Mycobacterium tuberculosis
TATAHPA

SEQ ID NO: 1420855 - protein, 7 aa, Mycobacterium tuberculosis
TATALRP

SEQ ID NO: 1420856 - protein, 8 aa, Mycobacterium tuberculosis
TATTAGMR

SEQ ID NO: 1420857 - protein, 13 aa, Mycobacterium tuberculosis
TCGGDTGDDDRPK

SEQ ID NO: 1420858 - protein, 8 aa, Mycobacterium tuberculosis
TDFDDADR

SEQ ID NO: 1420859 - protein, 5 aa, Mycobacterium tuberculosis
TDGLT

SEQ ID NO: 1420860 - protein, 7 aa, Mycobacterium tuberculosis
TDKSQIE

SEQ ID NO: 1420861 - protein, 8 aa, Mycobacterium tuberculosis
TDPDELPR

SEQ ID NO: 1420862 - protein, 5 aa, Mycobacterium tuberculosis
TDSPR

SEQ ID NO: 1420863 - protein, 8 aa, Mycobacterium tuberculosis
TEADPSMA

SEQ ID NO: 1420864 - protein, 9 aa, Mycobacterium tuberculosis
TEAGETAIG

SEQ ID NO: 1420865 - protein, 6 aa, Mycobacterium tuberculosis
TEEQKR

SEQ ID NO: 1420866 - protein, 13 aa, Mycobacterium tuberculosis
TEGPATPPQTPTE

SEQ ID NO: 1420867 - protein, 13 aa, Mycobacterium tuberculosis
TESEAPAALTPTV

SEQ ID NO: 1420868 - protein, 15 aa, Mycobacterium tuberculosis
TFPRDKPCGDGLTPR

SEQ ID NO: 1420869 - protein, 4 aa, Mycobacterium tuberculosis
TGAA

SEQ ID NO: 1420870 - protein, 17 aa, Mycobacterium tuberculosis
TGAGGASGFGNFGGANS

SEQ ID NO: 1420871 - protein, 11 aa, Mycobacterium tuberculosis
TGDDGTTGLSD

SEQ ID NO: 1420872 - protein, 12 aa, Mycobacterium tuberculosis
TGDISNASPLDS

SEQ ID NO: 1420873 - protein, 17 aa, Mycobacterium tuberculosis
TGDNQTGIGGLNSGAGN

SEQ ID NO: 1420874 - protein, 20 aa, Mycobacterium tuberculosis
TGEGRKDTVTARMSGRARDG

SEQ ID NO: 1420875 - protein, 12 aa, Mycobacterium tuberculosis
TGGPGTGKTTTV

SEQ ID NO: 1420876 - protein, 6 aa, Mycobacterium tuberculosis
TGGTIA

SEQ ID NO: 1420877 - protein, 10 aa, Mycobacterium tuberculosis
TGGWEPNAKG

SEQ ID NO: 1420878 - protein, 11 aa, Mycobacterium tuberculosis
TGQEESRRDGI

SEQ ID NO: 1420879 - protein, 5 aa, Mycobacterium tuberculosis
TGSFA

SEQ ID NO: 1420880 - protein, 14 aa, Mycobacterium tuberculosis
TGTGKTSNKTGNGV

SEQ ID NO: 1420881 - protein, 12 aa, Mycobacterium tuberculosis
TGTNGKSTTTRM

SEQ ID NO: 1420882 - protein, 11 aa, Mycobacterium tuberculosis
TGTRTQVGYGP

SEQ ID NO: 1420883 - protein, 8 aa, Mycobacterium tuberculosis
TGVGKTEL

SEQ ID NO: 1420884 - protein, 18 aa, Mycobacterium tuberculosis
THGRPTDRNAHPHRDAAG

SEQ ID NO: 1420885 - protein, 6 aa, Mycobacterium tuberculosis
TKTADW

SEQ ID NO: 1420886 - protein, 7 aa, Mycobacterium tuberculosis
TLANATG

SEQ ID NO: 1420887 - protein, 10 aa, Mycobacterium tuberculosis
TLASPTRRGE

SEQ ID NO: 1420888 - protein, 8 aa, Mycobacterium tuberculosis
TLGPKGRN

SEQ ID NO: 1420889 - protein, 16 aa, Mycobacterium tuberculosis
TLKSGTTVNLEVVDVG

SEQ ID NO: 1420890 - protein, 17 aa, Mycobacterium tuberculosis
TNAEIPGVGPSESEVGP

SEQ ID NO: 1420891 - protein, 10 aa, Mycobacterium tuberculosis
TNAGNGGSAR

SEQ ID NO: 1420892 - protein, 5 aa, Mycobacterium tuberculosis
TNGAR

SEQ ID NO: 1420893 - protein, 15 aa, Mycobacterium tuberculosis
TNGMGGDAYRTDPLD

SEQ ID NO: 1420894 - protein, 4 aa, Mycobacterium tuberculosis
TPDN

SEQ ID NO: 1420895 - protein, 7 aa, Mycobacterium tuberculosis
TPEGPNI

SEQ ID NO: 1420896 - protein, 8 aa, Mycobacterium tuberculosis
TPGSGKTS

SEQ ID NO: 1420897 - protein, 8 aa, Mycobacterium tuberculosis
TPLPPSRR

SEQ ID NO: 1420898 - protein, 8 aa, Mycobacterium tuberculosis
TPLTEEQI

SEQ ID NO: 1420899 - protein, 4 aa, Mycobacterium tuberculosis
TPRM

SEQ ID NO: 1420900 - protein, 4 aa, Mycobacterium tuberculosis
TPRR

SEQ ID NO: 1420901 - protein, 9 aa, Mycobacterium tuberculosis
TPRRGIGDR

SEQ ID NO: 1420902 - protein, 6 aa, Mycobacterium tuberculosis
TPTDNR

SEQ ID NO: 1420903 - protein, 7 aa, Mycobacterium tuberculosis
TQDGPLT

SEQ ID NO: 1420904 - protein, 6 aa, Mycobacterium tuberculosis
TQGAWT

SEQ ID NO: 1420905 - protein, 6 aa, Mycobacterium tuberculosis
TQGRPL

SEQ ID NO: 1420906 - protein, 4 aa, Mycobacterium tuberculosis
TRAR

SEQ ID NO: 1420907 - protein, 12 aa, Mycobacterium tuberculosis
TRDEPHADAEKY

SEQ ID NO: 1420908 - protein, 4 aa, Mycobacterium tuberculosis
TRPG

SEQ ID NO: 1420909 - protein, 7 aa, Mycobacterium tuberculosis
TRSNRHT

SEQ ID NO: 1420910 - protein, 4 aa, Mycobacterium tuberculosis
TRTV

SEQ ID NO: 1420911 - protein, 6 aa, Mycobacterium tuberculosis
TSAIPA

SEQ ID NO: 1420912 - protein, 5 aa, Mycobacterium tuberculosis
TSDGQ

SEQ ID NO: 1420913 - protein, 7 aa, Mycobacterium tuberculosis
TSGGVWG

SEQ ID NO: 1420914 - protein, 7 aa, Mycobacterium tuberculosis
TSPANPE

SEQ ID NO: 1420915 - protein, 4 aa, Mycobacterium tuberculosis
TSRR

SEQ ID NO: 1420916 - protein, 5 aa, Mycobacterium tuberculosis
TSTAA

SEQ ID NO: 1420917 - protein, 10 aa, Mycobacterium tuberculosis
TTAAPHGAAG

SEQ ID NO: 1420918 - protein, 5 aa, Mycobacterium tuberculosis
TTAGI

SEQ ID NO: 1420919 - protein, 13 aa, Mycobacterium tuberculosis
TTDAEAELRRGRR

SEQ ID NO: 1420920 - protein, 6 aa, Mycobacterium tuberculosis
TTDPQE

SEQ ID NO: 1420921 - protein, 8 aa, Mycobacterium tuberculosis
TTDRPTQV

SEQ ID NO: 1420922 - protein, 9 aa, Mycobacterium tuberculosis
TTGPKPLVQ

SEQ ID NO: 1420923 - protein, 6 aa, Mycobacterium tuberculosis
TTIQAQ

SEQ ID NO: 1420924 - protein, 7 aa, Mycobacterium tuberculosis
TTQAATV

SEQ ID NO: 1420925 - protein, 5 aa, Mycobacterium tuberculosis
TTRGP

SEQ ID NO: 1420926 - protein, 6 aa, Mycobacterium tuberculosis
TTRGRS

SEQ ID NO: 1420927 - protein, 5 aa, Mycobacterium tuberculosis
TTTGV

SEQ ID NO: 1420928 - protein, 8 aa, Mycobacterium tuberculosis
TTTLGRTG

SEQ ID NO: 1420929 - protein, 12 aa, Mycobacterium tuberculosis
TTVGNDAGRAAG

SEQ ID NO: 1420930 - protein, 12 aa, Mycobacterium tuberculosis
TTVNSRGATTTT

SEQ ID NO: 1420931 - protein, 4 aa, Mycobacterium tuberculosis
TTVT

SEQ ID NO: 1420932 - protein, 8 aa, Mycobacterium tuberculosis
TVARAEPL

SEQ ID NO: 1420933 - protein, 9 aa, Mycobacterium tuberculosis
TVESGASVD

SEQ ID NO: 1420934 - protein, 12 aa, Mycobacterium tuberculosis
TVRARSDATAVG

SEQ ID NO: 1420935 - protein, 4 aa, Mycobacterium tuberculosis
TVTN

SEQ ID NO: 1420936 - protein, 7 aa, Mycobacterium tuberculosis
TYGHGGD

SEQ ID NO: 1420937 - protein, 15 aa, Mycobacterium tuberculosis
VAATGGALSTNGHAV

SEQ ID NO: 1420938 - protein, 4 aa, Mycobacterium tuberculosis
VAER

SEQ ID NO: 1420939 - protein, 11 aa, Mycobacterium tuberculosis
VAPLPSAGAGL

SEQ ID NO: 1420940 - protein, 8 aa, Mycobacterium tuberculosis
VARDAEGV

SEQ ID NO: 1420941 - protein, 22 aa, Mycobacterium tuberculosis
VASTSSSPWGQPLSVGLRRRWR

SEQ ID NO: 1420942 - protein, 4 aa, Mycobacterium tuberculosis
VATS

SEQ ID NO: 1420943 - protein, 17 aa, Mycobacterium tuberculosis
VDAKGRSRNVSDGYRRL

SEQ ID NO: 1420944 - protein, 6 aa, Mycobacterium tuberculosis
VDEIPD

SEQ ID NO: 1420945 - protein, 8 aa, Mycobacterium tuberculosis
VDGAGAPI

SEQ ID NO: 1420946 - protein, 9 aa, Mycobacterium tuberculosis
VDGRPRRAA

SEQ ID NO: 1420947 - protein, 7 aa, Mycobacterium tuberculosis
VDHDPAG

SEQ ID NO: 1420948 - protein, 5 aa, Mycobacterium tuberculosis
VDLDS

SEQ ID NO: 1420949 - protein, 8 aa, Mycobacterium tuberculosis
VDTHREAV

SEQ ID NO: 1420950 - protein, 5 aa, Mycobacterium tuberculosis
VDYSG

SEQ ID NO: 1420951 - protein, 9 aa, Mycobacterium tuberculosis
VEDAQRREL

SEQ ID NO: 1420952 - protein, 13 aa, Mycobacterium tuberculosis
VELGPSVRPVTKT

SEQ ID NO: 1420953 - protein, 11 aa, Mycobacterium tuberculosis
VEPAREHPRPV

SEQ ID NO: 1420954 - protein, 5 aa, Mycobacterium tuberculosis
VEQGT

SEQ ID NO: 1420955 - protein, 7 aa, Mycobacterium tuberculosis
VGAGTGV

SEQ ID NO: 1420956 - protein, 12 aa, Mycobacterium tuberculosis
VGDDPAAVAANR

SEQ ID NO: 1420957 - protein, 9 aa, Mycobacterium tuberculosis
VGDMDPEGS

SEQ ID NO: 1420958 - protein, 5 aa, Mycobacterium tuberculosis
VGERR

SEQ ID NO: 1420959 - protein, 10 aa, Mycobacterium tuberculosis
VGGPPVEASA

SEQ ID NO: 1420960 - protein, 5 aa, Mycobacterium tuberculosis
VGGRR

SEQ ID NO: 1420961 - protein, 18 aa, Mycobacterium tuberculosis
VGKTPSATAALAREILLS

SEQ ID NO: 1420962 - protein, 15 aa, Mycobacterium tuberculosis
VGQAKRAENGSEGAN

SEQ ID NO: 1420963 - protein, 8 aa, Mycobacterium tuberculosis
VGSEEADK

SEQ ID NO: 1420964 - protein, 13 aa, Mycobacterium tuberculosis
VGTNPTFSGRTRT

SEQ ID NO: 1420965 - protein, 19 aa, Mycobacterium tuberculosis
VGTRVQHGDAETAPLPNPE

SEQ ID NO: 1420966 - protein, 10 aa, Mycobacterium tuberculosis
VHGRSGPIPV

SEQ ID NO: 1420967 - protein, 12 aa, Mycobacterium tuberculosis
VHPGAVSANRGR

SEQ ID NO: 1420968 - protein, 6 aa, Mycobacterium tuberculosis
VINRNQ

SEQ ID NO: 1420969 - protein, 7 aa, Mycobacterium tuberculosis
VKAARKD

SEQ ID NO: 1420970 - protein, 4 aa, Mycobacterium tuberculosis
VNGG

SEQ ID NO: 1420971 - protein, 6 aa, Mycobacterium tuberculosis
VNPDPV

SEQ ID NO: 1420972 - protein, 6 aa, Mycobacterium tuberculosis
VPASYT

SEQ ID NO: 1420973 - protein, 6 aa, Mycobacterium tuberculosis
VPGPQA

SEQ ID NO: 1420974 - protein, 6 aa, Mycobacterium tuberculosis
VPLDDG

SEQ ID NO: 1420975 - protein, 7 aa, Mycobacterium tuberculosis
VPLETPA

SEQ ID NO: 1420976 - protein, 5 aa, Mycobacterium tuberculosis
VPPPV

SEQ ID NO: 1420977 - protein, 7 aa, Mycobacterium tuberculosis
VPQPETL

SEQ ID NO: 1420978 - protein, 4 aa, Mycobacterium tuberculosis
VQAG

SEQ ID NO: 1420979 - protein, 20 aa, Mycobacterium tuberculosis
VQGGRPEALGGLGGAASSQL

SEQ ID NO: 1420980 - protein, 15 aa, Mycobacterium tuberculosis
VRAGTVKPSRDPRAR

SEQ ID NO: 1420981 - protein, 4 aa, Mycobacterium tuberculosis
VRRP

SEQ ID NO: 1420982 - protein, 8 aa, Mycobacterium tuberculosis
VRTGGDPH

SEQ ID NO: 1420983 - protein, 15 aa, Mycobacterium tuberculosis
VSASDPYRGQPDARL

SEQ ID NO: 1420984 - protein, 5 aa, Mycobacterium tuberculosis
VSDDG

SEQ ID NO: 1420985 - protein, 6 aa, Mycobacterium tuberculosis
VSGAGL

SEQ ID NO: 1420986 - protein, 5 aa, Mycobacterium tuberculosis
VSGEL

SEQ ID NO: 1420987 - protein, 8 aa, Mycobacterium tuberculosis
VSGSGPDR

SEQ ID NO: 1420988 - protein, 8 aa, Mycobacterium tuberculosis
VSPRGATA

SEQ ID NO: 1420989 - protein, 9 aa, Mycobacterium tuberculosis
VSTRSQISG

SEQ ID NO: 1420990 - protein, 7 aa, Mycobacterium tuberculosis
VTAPAGF

SEQ ID NO: 1420991 - protein, 5 aa, Mycobacterium tuberculosis
VTDQD

SEQ ID NO: 1420992 - protein, 11 aa, Mycobacterium tuberculosis
VTKSDQTPWYE

SEQ ID NO: 1420993 - protein, 10 aa, Mycobacterium tuberculosis
VTPVDSKGRF

SEQ ID NO: 1420994 - protein, 8 aa, Mycobacterium tuberculosis
VTRTAAPP

SEQ ID NO: 1420995 - protein, 6 aa, Mycobacterium tuberculosis
WDPQRA

SEQ ID NO: 1420996 - protein, 4 aa, Mycobacterium tuberculosis
WGGR

SEQ ID NO: 1420997 - protein, 8 aa, Mycobacterium tuberculosis
WNGGANDN

SEQ ID NO: 1420998 - protein, 17 aa, Mycobacterium tuberculosis
WNSGTGNSGLFNSGTNN

SEQ ID NO: 1420999 - protein, 4 aa, Mycobacterium tuberculosis
WPAD

SEQ ID NO: 1421000 - protein, 8 aa, Mycobacterium tuberculosis
WPPSGARA

SEQ ID NO: 1421001 - protein, 16 aa, Mycobacterium tuberculosis
WQGASSSAMAAAAAPY

SEQ ID NO: 1421002 - protein, 5 aa, Mycobacterium tuberculosis
WSDPC

SEQ ID NO: 1421003 - protein, 13 aa, Mycobacterium tuberculosis
WSKPNPKTATNAG

SEQ ID NO: 1421004 - protein, 6 aa, Mycobacterium tuberculosis
WTPQGE

SEQ ID NO: 1421005 - protein, 12 aa, Mycobacterium tuberculosis
YAARGADPDFHK

SEQ ID NO: 1421006 - protein, 9 aa, Mycobacterium tuberculosis
YAEGYPGRR

SEQ ID NO: 1421007 - protein, 4 aa, Mycobacterium tuberculosis
YDGR

SEQ ID NO: 1421008 - protein, 4 aa, Mycobacterium tuberculosis
YEDQ

SEQ ID NO: 1421009 - protein, 8 aa, Mycobacterium tuberculosis
YGAGPCSG

SEQ ID NO: 1421010 - protein, 11 aa, Mycobacterium tuberculosis
YGPDGQRRGEG

SEQ ID NO: 1421011 - protein, 5 aa, Mycobacterium tuberculosis
YGPQL

SEQ ID NO: 1421012 - protein, 13 aa, Mycobacterium tuberculosis
YGRGTADDKAGIA

SEQ ID NO: 1421013 - protein, 7 aa, Mycobacterium tuberculosis
YGTDGVE

SEQ ID NO: 1421014 - protein, 9 aa, Mycobacterium tuberculosis
YGTSSPSGY

SEQ ID NO: 1421015 - protein, 10 aa, Mycobacterium tuberculosis
YNANPDSMRA

SEQ ID NO: 1421016 - protein, 7 aa, Mycobacterium tuberculosis
YPGGLGR

SEQ ID NO: 1421017 - protein, 7 aa, Mycobacterium tuberculosis
YPGPDGE

SEQ ID NO: 1421018 - protein, 5 aa, Mycobacterium tuberculosis
YPHSP

SEQ ID NO: 1421019 - protein, 11 aa, Mycobacterium tuberculosis
YQVEGREVTPT

SEQ ID NO: 1421020 - protein, 13 aa, Mycobacterium tuberculosis
YREQGAFEGPPPW

SEQ ID NO: 1421021 - protein, 8 aa, Mycobacterium tuberculosis
YRGSRGIR

SEQ ID NO: 1421022 - protein, 4 aa, Mycobacterium tuberculosis
YRPK

SEQ ID NO: 1421023 - protein, 9 aa, Mycobacterium tuberculosis
YRSSGGLAD

SEQ ID NO: 1421024 - protein, 6 aa, Mycobacterium tuberculosis
YRSTQN

SEQ ID NO: 1421025 - protein, 9 aa, Mycobacterium tuberculosis
YSHPADNIP

SEQ ID NO: 1421026 - protein, 6 aa, Mycobacterium tuberculosis
YSSNAG

SEQ ID NO: 1421027 - protein, 9 aa, Mycobacterium tuberculosis
YTDPVASEK

SEQ ID NO: 1421028 - protein, 4 aa, Mycobacterium tuberculosis
YTSA

SEQ ID NO: 1421029 - protein, 15 aa, Mycobacterium tuberculosis
AAAAESRRLDHAPNA

SEQ ID NO: 1421030 - protein, 15 aa, Mycobacterium tuberculosis
AAADNSVDATAARDF

SEQ ID NO: 1421031 - protein, 5 aa, Mycobacterium tuberculosis
AAAGD

SEQ ID NO: 1421032 - protein, 4 aa, Mycobacterium tuberculosis
AAAL

SEQ ID NO: 1421033 - protein, 8 aa, Mycobacterium tuberculosis
AAARHDSK

SEQ ID NO: 1421034 - protein, 9 aa, Mycobacterium tuberculosis
AADAPDTRR

SEQ ID NO: 1421035 - protein, 8 aa, Mycobacterium tuberculosis
AADGIQSL

SEQ ID NO: 1421036 - protein, 7 aa, Mycobacterium tuberculosis
AAEDPRV

SEQ ID NO: 1421037 - protein, 11 aa, Mycobacterium tuberculosis
AAELGGDPSRI

SEQ ID NO: 1421038 - protein, 12 aa, Mycobacterium tuberculosis
AAELSYSDQPDA

SEQ ID NO: 1421039 - protein, 8 aa, Mycobacterium tuberculosis
AAERRTGL

SEQ ID NO: 1421040 - protein, 4 aa, Mycobacterium tuberculosis
AAGD

SEQ ID NO: 1421041 - protein, 38 aa, Mycobacterium tuberculosis; identical to SEQ ID NO: 167006

SEQ ID NO: 1421042 - protein, 7 aa, Mycobacterium tuberculosis
AAHTRPD

SEQ ID NO: 1421043 - protein, 12 aa, Mycobacterium tuberculosis
AALGSAAGSEAA

SEQ ID NO: 1421044 - protein, 9 aa, Mycobacterium tuberculosis
AANPAIAND

SEQ ID NO: 1421045 - protein, 12 aa, Mycobacterium tuberculosis
AAQSAGAAGQAR

SEQ ID NO: 1421046 - protein, 4 aa, Mycobacterium tuberculosis
AARR

SEQ ID NO: 1421047 - protein, 4 aa, Mycobacterium tuberculosis
AAST

SEQ ID NO: 1421048 - protein, 12 aa, Mycobacterium tuberculosis
AATGATAPLGSH

SEQ ID NO: 1421049 - protein, 14 aa, Mycobacterium tuberculosis
AATRTTPARLASKV

SEQ ID NO: 1421050 - protein, 13 aa, Mycobacterium tuberculosis
AATTPDQPQPYGE

SEQ ID NO: 1421051 - protein, 7 aa, Mycobacterium tuberculosis
AAVAPQD

SEQ ID NO: 1421052 - protein, 9 aa, Mycobacterium tuberculosis
ADAPQVASR

SEQ ID NO: 1421053 - protein, 12 aa, Mycobacterium tuberculosis
ADARGLTANEPS

SEQ ID NO: 1421054 - protein, 23 aa, Mycobacterium tuberculosis
ADASALGYAEADPTADVEGYDAA

SEQ ID NO: 1421055 - protein, 9 aa, Mycobacterium tuberculosis
ADPSRSVGN

SEQ ID NO: 1421056 - protein, 4 aa, Mycobacterium tuberculosis
ADPT

SEQ ID NO: 1421057 - protein, 8 aa, Mycobacterium tuberculosis
ADRAAHRD

SEQ ID NO: 1421058 - protein, 7 aa, Mycobacterium tuberculosis
ADRPALG

SEQ ID NO: 1421059 - protein, 8 aa, Mycobacterium tuberculosis
ADRPDQPL

SEQ ID NO: 1421060 - protein, 5 aa, Mycobacterium tuberculosis
ADTGI

SEQ ID NO: 1421061 - protein, 8 aa, Mycobacterium tuberculosis
AEAEGTDL

SEQ ID NO: 1421062 - protein, 5 aa, Mycobacterium tuberculosis
AEAES

SEQ ID NO: 1421063 - protein, 5 aa, Mycobacterium tuberculosis
AEGAA

SEQ ID NO: 1421064 - protein, 10 aa, Mycobacterium tuberculosis
AESTAGPDAR

SEQ ID NO: 1421065 - protein, 5 aa, Mycobacterium tuberculosis
AESTG

SEQ ID NO: 1421066 - protein, 4 aa, Mycobacterium tuberculosis
AETF

SEQ ID NO: 1421067 - protein, 16 aa, Mycobacterium tuberculosis
AETTTNGSVSPATVRD

SEQ ID NO: 1421068 - protein, 8 aa, Mycobacterium tuberculosis
AGAAGTSN

SEQ ID NO: 1421069 - protein, 13 aa, Mycobacterium tuberculosis
AGAALGQTVTLTL

SEQ ID NO: 1421070 - protein, 8 aa, Mycobacterium tuberculosis
AGAEGADV

SEQ ID NO: 1421071 - protein, 17 aa, Mycobacterium tuberculosis
AGAGAYASAEAAAAAPL

SEQ ID NO: 1421072 - protein, 11 aa, Mycobacterium tuberculosis
AGDDAALSGTE

SEQ ID NO: 1421073 - protein, 6 aa, Mycobacterium tuberculosis
AGDKKI

SEQ ID NO: 1421074 - protein, 9 aa, Mycobacterium tuberculosis
AGDSAGGGL

SEQ ID NO: 1421075 - protein, 6 aa, Mycobacterium tuberculosis
AGEDIS

SEQ ID NO: 1421076 - protein, 20 aa, Mycobacterium tuberculosis
AGEPPSPEPAASKPPTPPMP

SEQ ID NO: 1421077 - protein, 8 aa, Mycobacterium tuberculosis
AGFDPSKP

SEQ ID NO: 1421078 - protein, 8 aa, Mycobacterium tuberculosis
AGGGPPDV

SEQ ID NO: 1421079 - protein, 4 aa, Mycobacterium tuberculosis
AGGV

SEQ ID NO: 1421080 - protein, 16 aa, Mycobacterium tuberculosis
AGLRRAEAAQAHTGDL

SEQ ID NO: 1421081 - protein, 13 aa, Mycobacterium tuberculosis
AGQAEQAGAQAKI

SEQ ID NO: 1421082 - protein, 19 aa, Mycobacterium tuberculosis
AGQSRERMRKRGGGPGPAI

SEQ ID NO: 1421083 - protein, 5 aa, Mycobacterium tuberculosis
AGSGW

SEQ ID NO: 1421084 - protein, 21 aa, Mycobacterium tuberculosis
AGSVGADTVSGRADVGGSGGG

SEQ ID NO: 1421085 - protein, 5 aa, Mycobacterium tuberculosis
AIDAE

SEQ ID NO: 1421086 - protein, 5 aa, Mycobacterium tuberculosis
AIPNF

SEQ ID NO: 1421087 - protein, 5 aa, Mycobacterium tuberculosis
AIPSA

SEQ ID NO: 1421088 - protein, 6 aa, Mycobacterium tuberculosis
AITSPA

SEQ ID NO: 1421089 - protein, 18 aa, Mycobacterium tuberculosis
AKAARRDSAHSAGGGGTM

SEQ ID NO: 1421090 - protein, 19 aa, Mycobacterium tuberculosis
AKAGAGPPEHNRRLDSDAA

SEQ ID NO: 1421091 - protein, 8 aa, Mycobacterium tuberculosis
AKELAPGQ

SEQ ID NO: 1421092 - protein, 5 aa, Mycobacterium tuberculosis
AKHAR

SEQ ID NO: 1421093 - protein, 8 aa, Mycobacterium tuberculosis
AKQAPGWR

SEQ ID NO: 1421094 - protein, 5 aa, Mycobacterium tuberculosis
ALDAS

SEQ ID NO: 1421095 - protein, 12 aa, Mycobacterium tuberculosis
ALPKPKRDYGRL

SEQ ID NO: 1421096 - protein, 6 aa, Mycobacterium tuberculosis
AMKPPV

SEQ ID NO: 1421097 - protein, 5 aa, Mycobacterium tuberculosis
AMPDP

SEQ ID NO: 1421098 - protein, 6 aa, Mycobacterium tuberculosis
ANAEIP

SEQ ID NO: 1421099 - protein, 5 aa, Mycobacterium tuberculosis
ANDVD

SEQ ID NO: 1421100 - protein, 8 aa, Mycobacterium tuberculosis
ANPQHHRR

SEQ ID NO: 1421101 - protein, 11 aa, Mycobacterium tuberculosis
ANSATSGFNNY

SEQ ID NO: 1421102 - protein, 4 aa, Mycobacterium tuberculosis
ANSR

SEQ ID NO: 1421103 - protein, 4 aa, Mycobacterium tuberculosis
APAA

SEQ ID NO: 1421104 - protein, 4 aa, Mycobacterium tuberculosis
APET

SEQ ID NO: 1421105 - protein, 35 aa, Mycobacterium tuberculosis
APGACNPDDQTPVVDDTPDADAVRRDTRSQAQRHH

SEQ ID NO: 1421106 - protein, 6 aa, Mycobacterium tuberculosis
APGHAD

SEQ ID NO: 1421107 - protein, 5 aa, Mycobacterium tuberculosis
APPDL

SEQ ID NO: 1421108 - protein, 8 aa, Mycobacterium tuberculosis
APPGSFNN

SEQ ID NO: 1421109 - protein, 6 aa, Mycobacterium tuberculosis
APPGYR

SEQ ID NO: 1421110 - protein, 8 aa, Mycobacterium tuberculosis
APPSVASG

SEQ ID NO: 1421111 - protein, 6 aa, Mycobacterium tuberculosis
APSARF

SEQ ID NO: 1421112 - protein, 14 aa, Mycobacterium tuberculosis
APSSGGGATSTQGA

SEQ ID NO: 1421113 - protein, 4 aa, Mycobacterium tuberculosis
APVA

SEQ ID NO: 1421114 - protein, 6 aa, Mycobacterium tuberculosis
APVAGS

SEQ ID NO: 1421115 - protein, 14 aa, Mycobacterium tuberculosis
AQAPARRGRHKNIP

SEQ ID NO: 1421116 - protein, 7 aa, Mycobacterium tuberculosis
AQEAGNF

SEQ ID NO: 1421117 - protein, 9 aa, Mycobacterium tuberculosis
AQGPELAPA

SEQ ID NO: 1421118 - protein, 4 aa, Mycobacterium tuberculosis
AQVG

SEQ ID NO: 1421119 - protein, 6 aa, Mycobacterium tuberculosis
ARAPRV

SEQ ID NO: 1421120 - protein, 6 aa, Mycobacterium tuberculosis
ARARRT

SEQ ID NO: 1421121 - protein, 18 aa, Mycobacterium tuberculosis
ARDTATVGGMASTNAGGL

SEQ ID NO: 1421122 - protein, 4 aa, Mycobacterium tuberculosis
ARER

SEQ ID NO: 1421123 - protein, 5 aa, Mycobacterium tuberculosis
ARGDE

SEQ ID NO: 1421124 - protein, 8 aa, Mycobacterium tuberculosis
ARRTGATR

SEQ ID NO: 1421125 - protein, 12 aa, Mycobacterium tuberculosis
ARSSADPHPTTG

SEQ ID NO: 1421126 - protein, 4 aa, Mycobacterium tuberculosis
ARTP

SEQ ID NO: 1421127 - protein, 4 aa, Mycobacterium tuberculosis
ARTQ

SEQ ID NO: 1421128 - protein, 8 aa, Mycobacterium tuberculosis
ASANTGDG

SEQ ID NO: 1421129 - protein, 14 aa, Mycobacterium tuberculosis
ASAYDEAAATMSGK

SEQ ID NO: 1421130 - protein, 4 aa, Mycobacterium tuberculosis
ASEH

SEQ ID NO: 1421131 - protein, 8 aa, Mycobacterium tuberculosis
ASEQRDPA

SEQ ID NO: 1421132 - protein, 10 aa, Mycobacterium tuberculosis
ASGHGDALAS

SEQ ID NO: 1421133 - protein, 7 aa, Mycobacterium tuberculosis
ASKFGRE

SEQ ID NO: 1421134 - protein, 7 aa, Mycobacterium tuberculosis
ASKYGLR

SEQ ID NO: 1421135 - protein, 4 aa, Mycobacterium tuberculosis
ASPI

SEQ ID NO: 1421136 - protein, 6 aa, Mycobacterium tuberculosis
ASTLQA

SEQ ID NO: 1421137 - protein, 17 aa, Mycobacterium tuberculosis
ASTNTSYPGPATDPSTG

SEQ ID NO: 1421138 - protein, 8 aa, Mycobacterium tuberculosis
ASYPDGTN

SEQ ID NO: 1421139 - protein, 8 aa, Mycobacterium tuberculosis
ATANNPAF

SEQ ID NO: 1421140 - protein, 9 aa, Mycobacterium tuberculosis
ATATAIQRE

SEQ ID NO: 1421141 - protein, 10 aa, Mycobacterium tuberculosis
ATDQAADDVL

SEQ ID NO: 1421142 - protein, 5 aa, Mycobacterium tuberculosis
ATFAG

SEQ ID NO: 1421143 - protein, 17 aa, Mycobacterium tuberculosis
ATGEPPYPPAVGQDDRG

SEQ ID NO: 1421144 - protein, 8 aa, Mycobacterium tuberculosis
ATGRSSDF

SEQ ID NO: 1421145 - protein, 7 aa, Mycobacterium tuberculosis
ATLERTG

SEQ ID NO: 1421146 - protein, 7 aa, Mycobacterium tuberculosis
ATNPTVA

SEQ ID NO: 1421147 - protein, 21 aa, Mycobacterium tuberculosis
ATPPPAPPSLRRAPASTSPRL

SEQ ID NO: 1421148 - protein, 8 aa, Mycobacterium tuberculosis
ATPSEPIA

SEQ ID NO: 1421149 - protein, 9 aa, Mycobacterium tuberculosis
ATRVEQRTD

SEQ ID NO: 1421150 - protein, 4 aa, Mycobacterium tuberculosis
ATSD

SEQ ID NO: 1421151 - protein, 10 aa, Mycobacterium tuberculosis
ATSPAPGTAN

SEQ ID NO: 1421152 - protein, 8 aa, Mycobacterium tuberculosis
ATSSADQR

SEQ ID NO: 1421153 - protein, 14 aa, Mycobacterium tuberculosis
ATSTGELAQAAESA

SEQ ID NO: 1421154 - protein, 9 aa, Mycobacterium tuberculosis
ATTDPSSGF

SEQ ID NO: 1421155 - protein, 30 aa, Mycobacterium tuberculosis; identical to SEQ ID NO: 170500

SEQ ID NO: 1421156 - protein, 7 aa, Mycobacterium tuberculosis
ATTPNSF

SEQ ID NO: 1421157 - protein, 7 aa, Mycobacterium tuberculosis
ATVTTAD

SEQ ID NO: 1421158 - protein, 5 aa, Mycobacterium tuberculosis
AVDQA

SEQ ID NO: 1421159 - protein, 21 aa, Mycobacterium tuberculosis
AVSPYGSGALAGSSLGLDPDA

SEQ ID NO: 1421160 - protein, 13 aa, Mycobacterium tuberculosis
AVTATDGQARPPA

SEQ ID NO: 1421161 - protein, 4 aa, Mycobacterium tuberculosis
AYAD

SEQ ID NO: 1421162 - protein, 7 aa, Mycobacterium tuberculosis
CDPDGNR

SEQ ID NO: 1421163 - protein, 9 aa, Mycobacterium tuberculosis
CGTSTGEVT

SEQ ID NO: 1421164 - protein, 8 aa, Mycobacterium tuberculosis
CNSSNSRR

SEQ ID NO: 1421165 - protein, 5 aa, Mycobacterium tuberculosis
CPGQN

SEQ ID NO: 1421166 - protein, 5 aa, Mycobacterium tuberculosis
CSPNT

SEQ ID NO: 1421167 - protein, 6 aa, Mycobacterium tuberculosis
DAADCD

SEQ ID NO: 1421168 - protein, 5 aa, Mycobacterium tuberculosis
DAATL

SEQ ID NO: 1421169 - protein, 6 aa, Mycobacterium tuberculosis
DAEVPA

SEQ ID NO: 1421170 - protein, 4 aa, Mycobacterium tuberculosis
DAGD

SEQ ID NO: 1421171 - protein, 9 aa, Mycobacterium tuberculosis
DAGVREAER

SEQ ID NO: 1421172 - protein, 38 aa, Mycobacterium tuberculosis
DAKPHVEAEPDDKHHAPMSTSGLSPDELSALTASWDQW

SEQ ID NO: 1421173 - protein, 8 aa, Mycobacterium tuberculosis
DATDRARL

SEQ ID NO: 1421174 - protein, 7 aa, Mycobacterium tuberculosis
DAVRDGD

SEQ ID NO: 1421175 - protein, 12 aa, Mycobacterium tuberculosis
DDFGDGPTTPMV

SEQ ID NO: 1421176 - protein, 5 aa, Mycobacterium tuberculosis
DDIYG

SEQ ID NO: 1421177 - protein, 7 aa, Mycobacterium tuberculosis
DDPLSEE

SEQ ID NO: 1421178 - protein, 8 aa, Mycobacterium tuberculosis
DDPSTEVP

SEQ ID NO: 1421179 - protein, 7 aa, Mycobacterium tuberculosis
DDSRRMT

SEQ ID NO: 1421180 - protein, 14 aa, Mycobacterium tuberculosis
DDVGGTWRDNTYPG

SEQ ID NO: 1421181 - protein, 7 aa, Mycobacterium tuberculosis
DEANAAI

SEQ ID NO: 1421182 - protein, 4 aa, Mycobacterium tuberculosis
DEAV

SEQ ID NO: 1421183 - protein, 4 aa, Mycobacterium tuberculosis
DEFP

SEQ ID NO: 1421184 - protein, 10 aa, Mycobacterium tuberculosis
DELGSAAASF

SEQ ID NO: 1421185 - protein, 8 aa, Mycobacterium tuberculosis
DGAASITR

SEQ ID NO: 1421186 - protein, 6 aa, Mycobacterium tuberculosis
DGALPG

SEQ ID NO: 1421187 - protein, 5 aa, Mycobacterium tuberculosis
DGANN

SEQ ID NO: 1421188 - protein, 8 aa, Mycobacterium tuberculosis
DGAQATAP

SEQ ID NO: 1421189 - protein, 10 aa, Mycobacterium tuberculosis
DGERNGLDAD

SEQ ID NO: 1421190 - protein, 18 aa, Mycobacterium tuberculosis
DGFGTVTAADGSRRRAFA

SEQ ID NO: 1421191 - protein, 30 aa, Mycobacterium tuberculosis; identical to SEQ ID NO: 171460

SEQ ID NO: 1421192 - protein, 13 aa, Mycobacterium tuberculosis
DGGGGGDGGNGGL

SEQ ID NO: 1421193 - protein, 5 aa, Mycobacterium tuberculosis
DGREL

SEQ ID NO: 1421194 - protein, 4 aa, Mycobacterium tuberculosis
DGTP

SEQ ID NO: 1421195 - protein, 4 aa, Mycobacterium tuberculosis
DGTS

SEQ ID NO: 1421196 - protein, 6 aa, Mycobacterium tuberculosis
DGVGPV

SEQ ID NO: 1421197 - protein, 10 aa, Mycobacterium tuberculosis
DHDQTAARRE

SEQ ID NO: 1421198 - protein, 7 aa, Mycobacterium tuberculosis
DHDQTDR

SEQ ID NO: 1421199 - protein, 7 aa, Mycobacterium tuberculosis
DHNPIHT

SEQ ID NO: 1421200 - protein, 6 aa, Mycobacterium tuberculosis
DIDRAA

SEQ ID NO: 1421201 - protein, 9 aa, Mycobacterium tuberculosis
DIPEPDSGY

SEQ ID NO: 1421202 - protein, 4 aa, Mycobacterium tuberculosis
DITP

SEQ ID NO: 1421203 - protein, 6 aa, Mycobacterium tuberculosis
DKPDDV

SEQ ID NO: 1421204 - protein, 7 aa, Mycobacterium tuberculosis
DKRPGDI

SEQ ID NO: 1421205 - protein, 5 aa, Mycobacterium tuberculosis
DKTRE

SEQ ID NO: 1421206 - protein, 4 aa, Mycobacterium tuberculosis
DLGE

SEQ ID NO: 1421207 - protein, 9 aa, Mycobacterium tuberculosis
DLNYDNPAV

SEQ ID NO: 1421208 - protein, 34 aa, Mycobacterium tuberculosis; identical to SEQ ID NO: 229452

SEQ ID NO: 1421209 - protein, 26 aa, Mycobacterium tuberculosis
DNVKNSKQVGQFGGTVSRTRANVEIN

SEQ ID NO: 1421210 - protein, 8 aa, Mycobacterium tuberculosis
DPANPPPR

SEQ ID NO: 1421211 - protein, 4 aa, Mycobacterium tuberculosis
DPAV

SEQ ID NO: 1421212 - protein, 7 aa, Mycobacterium tuberculosis
DPETARI

SEQ ID NO: 1421213 - protein, 5 aa, Mycobacterium tuberculosis
DPGLA

SEQ ID NO: 1421214 - protein, 6 aa, Mycobacterium tuberculosis
DPNQQL

SEQ ID NO: 1421215 - protein, 17 aa, Mycobacterium tuberculosis
DPNTNTVTGSIPVGTGA

SEQ ID NO: 1421216 - protein, 9 aa, Mycobacterium tuberculosis
DPPVTPEEP

SEQ ID NO: 1421217 - protein, 28 aa, Mycobacterium tuberculosis
DPQRPASPRSQSSRGLPSSPGVTGAAAA

SEQ ID NO: 1421218 - protein, 5 aa, Mycobacterium tuberculosis
DPTFD

SEQ ID NO: 1421219 - protein, 4 aa, Mycobacterium tuberculosis
DPTR

SEQ ID NO: 1421220 - protein, 5 aa, Mycobacterium tuberculosis
DPTVG

SEQ ID NO: 1421221 - protein, 16 aa, Mycobacterium tuberculosis
DPTWERSGRTERGRDG

SEQ ID NO: 1421222 - protein, 14 aa, Mycobacterium tuberculosis
DQGERKVRDHPDFP

SEQ ID NO: 1421223 - protein, 12 aa, Mycobacterium tuberculosis
DQPNLGGSGGYS

SEQ ID NO: 1421224 - protein, 4 aa, Mycobacterium tuberculosis
DQQY

SEQ ID NO: 1421225 - protein, 26 aa, Mycobacterium tuberculosis
DQYYSPDFGAATGAAVPLDDYGYSDY

SEQ ID NO: 1421226 - protein, 8 aa, Mycobacterium tuberculosis
DRAASYRA

SEQ ID NO: 1421227 - protein, 9 aa, Mycobacterium tuberculosis
DRARDVADT

SEQ ID NO: 1421228 - protein, 4 aa, Mycobacterium tuberculosis
DRDA

SEQ ID NO: 1421229 - protein, 10 aa, Mycobacterium tuberculosis
DRDSLEPISR

SEQ ID NO: 1421230 - protein, 9 aa, Mycobacterium tuberculosis
DRGATSVTD

SEQ ID NO: 1421231 - protein, 4 aa, Mycobacterium tuberculosis
DRNS

SEQ ID NO: 1421232 - protein, 18 aa, Mycobacterium tuberculosis
DRRRRGERSGDGAEAELR

SEQ ID NO: 1421233 - protein, 12 aa, Mycobacterium tuberculosis
DSAAAAAGRAAP

SEQ ID NO: 1421234 - protein, 5 aa, Mycobacterium tuberculosis
DSEID

SEQ ID NO: 1421235 - protein, 6 aa, Mycobacterium tuberculosis
DSGATR

SEQ ID NO: 1421236 - protein, 5 aa, Mycobacterium tuberculosis
DSIPT

SEQ ID NO: 1421237 - protein, 4 aa, Mycobacterium tuberculosis
DSNG

SEQ ID NO: 1421238 - protein, 8 aa, Mycobacterium tuberculosis
DSPPKGVS

SEQ ID NO: 1421239 - protein, 6 aa, Mycobacterium tuberculosis
DVAPGR

SEQ ID NO: 1421240 - protein, 7 aa, Mycobacterium tuberculosis
EAAEDNY

SEQ ID NO: 1421241 - protein, 8 aa, Mycobacterium tuberculosis
EAARTTYR

SEQ ID NO: 1421242 - protein, 7 aa, Mycobacterium tuberculosis
EADDGTW

SEQ ID NO: 1421243 - protein, 5 aa, Mycobacterium tuberculosis
EAIGT

SEQ ID NO: 1421244 - protein, 41 aa, Mycobacterium tuberculosis; identical to SEQ ID NO: 172888

SEQ ID NO: 1421245 - protein, 7 aa, Mycobacterium tuberculosis
EAQTGRK

SEQ ID NO: 1421246 - protein, 8 aa, Mycobacterium tuberculosis
EARTPDAL

SEQ ID NO: 1421247 - protein, 6 aa, Mycobacterium tuberculosis
EASEAS

SEQ ID NO: 1421248 - protein, 6 aa, Mycobacterium tuberculosis
EAYGEA

SEQ ID NO: 1421249 - protein, 4 aa, Mycobacterium tuberculosis
EDEP

SEQ ID NO: 1421250 - protein, 28 aa, Mycobacterium tuberculosis
EEGKAPFANPRNSAAGSLRQKDPAVTAR

SEQ ID NO: 1421251 - protein, 13 aa, Mycobacterium tuberculosis
EETDNAEDKPETL

SEQ ID NO: 1421252 - protein, 10 aa, Mycobacterium tuberculosis
EEYGGGGNAD

SEQ ID NO: 1421253 - protein, 13 aa, Mycobacterium tuberculosis
EGAADGVDGPSML

SEQ ID NO: 1421254 - protein, 6 aa, Mycobacterium tuberculosis
EGETRR

SEQ ID NO: 1421255 - protein, 18 aa, Mycobacterium tuberculosis
EGNRALDAGDHDGALRSA

SEQ ID NO: 1421256 - protein, 4 aa, Mycobacterium tuberculosis
EGPA

SEQ ID NO: 1421257 - protein, 9 aa, Mycobacterium tuberculosis
EGTAVTPAS

SEQ ID NO: 1421258 - protein, 8 aa, Mycobacterium tuberculosis
EGWQGQAA

SEQ ID NO: 1421259 - protein, 6 aa, Mycobacterium tuberculosis
EHNPRA

SEQ ID NO: 1421260 - protein, 18 aa, Mycobacterium tuberculosis
EHPDAKDFGSAAALPADP

SEQ ID NO: 1421261 - protein, 11 aa, Mycobacterium tuberculosis
EIGPYGSSRTR

SEQ ID NO: 1421262 - protein, 6 aa, Mycobacterium tuberculosis
EKAMRE

SEQ ID NO: 1421263 - protein, 8 aa, Mycobacterium tuberculosis
ELGGSNPS

SEQ ID NO: 1421264 - protein, 9 aa, Mycobacterium tuberculosis
ELGTAAQSF

SEQ ID NO: 1421265 - protein, 10 aa, Mycobacterium tuberculosis
ELSPDGPDRV

SEQ ID NO: 1421266 - protein, 4 aa, Mycobacterium tuberculosis
ENAE

SEQ ID NO: 1421267 - protein, 5 aa, Mycobacterium tuberculosis
EPDER

SEQ ID NO: 1421268 - protein, 6 aa, Mycobacterium tuberculosis
EQHGDA

SEQ ID NO: 1421269 - protein, 8 aa, Mycobacterium tuberculosis
EQPPAEGV

SEQ ID NO: 1421270 - protein, 9 aa, Mycobacterium tuberculosis
EQSAKTGFT

SEQ ID NO: 1421271 - protein, 5 aa, Mycobacterium tuberculosis
EQTYL

SEQ ID NO: 1421272 - protein, 8 aa, Mycobacterium tuberculosis
ERGYGYGP

SEQ ID NO: 1421273 - protein, 7 aa, Mycobacterium tuberculosis
ERPDSDE

SEQ ID NO: 1421274 - protein, 5 aa, Mycobacterium tuberculosis
ERRAG

SEQ ID NO: 1421275 - protein, 6 aa, Mycobacterium tuberculosis
ERTGPS

SEQ ID NO: 1421276 - protein, 4 aa, Mycobacterium tuberculosis
ESDW

SEQ ID NO: 1421277 - protein, 25 aa, Mycobacterium tuberculosis
ESIGGSVSAALGKGSSAGSLSVPPD

SEQ ID NO: 1421278 - protein, 4 aa, Mycobacterium tuberculosis
ESTG

SEQ ID NO: 1421279 - protein, 10 aa, Mycobacterium tuberculosis
ETAASVNQAR

SEQ ID NO: 1421280 - protein, 5 aa, Mycobacterium tuberculosis
EVAPP

SEQ ID NO: 1421281 - protein, 14 aa, Mycobacterium tuberculosis
EVEAENRARYGGRL

SEQ ID NO: 1421282 - protein, 5 aa, Mycobacterium tuberculosis
EVGLP

SEQ ID NO: 1421283 - protein, 8 aa, Mycobacterium tuberculosis
EVNAEQQK

SEQ ID NO: 1421284 - protein, 5 aa, Mycobacterium tuberculosis
EYAKA

SEQ ID NO: 1421285 - protein, 27 aa, Mycobacterium tuberculosis
FDADGDVPRSRKRGAYQPPGRERVGSS

SEQ ID NO: 1421286 - protein, 9 aa, Mycobacterium tuberculosis
FDDAARAAG

SEQ ID NO: 1421287 - protein, 5 aa, Mycobacterium tuberculosis
FDDDE

SEQ ID NO: 1421288 - protein, 5 aa, Mycobacterium tuberculosis
FDPGL

SEQ ID NO: 1421289 - protein, 6 aa, Mycobacterium tuberculosis
FDRPRE

SEQ ID NO: 1421290 - protein, 11 aa, Mycobacterium tuberculosis
FGGPTVTNDGV

SEQ ID NO: 1421291 - protein, 6 aa, Mycobacterium tuberculosis
FGRGPN

SEQ ID NO: 1421292 - protein, 18 aa, Mycobacterium tuberculosis
FNSGSGNIGFGNSGTGNV

SEQ ID NO: 1421293 - protein, 10 aa, Mycobacterium tuberculosis
FSPGQQDAWS

SEQ ID NO: 1421294 - protein, 4 aa, Mycobacterium tuberculosis
FTGG

SEQ ID NO: 1421295 - protein, 12 aa, Mycobacterium tuberculosis
FTGTEDQPAAVE

SEQ ID NO: 1421296 - protein, 5 aa, Mycobacterium tuberculosis
FTTPD

SEQ ID NO: 1421297 - protein, 15 aa, Mycobacterium tuberculosis
GAAAYTGAEAASVSS

SEQ ID NO: 1421298 - protein, 10 aa, Mycobacterium tuberculosis
GAAPTTDRRT

SEQ ID NO: 1421299 - protein, 6 aa, Mycobacterium tuberculosis
GADDVS

SEQ ID NO: 1421300 - protein, 6 aa, Mycobacterium tuberculosis
GADEIS

SEQ ID NO: 1421301 - protein, 8 aa, Mycobacterium tuberculosis
GAGGGASY

SEQ ID NO: 1421302 - protein, 7 aa, Mycobacterium tuberculosis
GAGPAAM

SEQ ID NO: 1421303 - protein, 7 aa, Mycobacterium tuberculosis
GAQLDGP

SEQ ID NO: 1421304 - protein, 12 aa, Mycobacterium tuberculosis
GATFSDAAARDA

SEQ ID NO: 1421305 - protein, 5 aa, Mycobacterium tuberculosis
GATPA

SEQ ID NO: 1421306 - protein, 7 aa, Mycobacterium tuberculosis
GDADGSI

SEQ ID NO: 1421307 - protein, 4 aa, Mycobacterium tuberculosis
GDAY

SEQ ID NO: 1421308 - protein, 7 aa, Mycobacterium tuberculosis
GDPAARL

SEQ ID NO: 1421309 - protein, 6 aa, Mycobacterium tuberculosis
GDSTDV

SEQ ID NO: 1421310 - protein, 10 aa, Mycobacterium tuberculosis
GDVPLRPTTT

SEQ ID NO: 1421311 - protein, 6 aa, Mycobacterium tuberculosis
GDVRGR

SEQ ID NO: 1421312 - protein, 30 aa, Mycobacterium tuberculosis
GEALPAGGTTATPRPATETSGGAIAEQPYG

SEQ ID NO: 1421313 - protein, 12 aa, Mycobacterium tuberculosis
GEDSERLTGTAA

SEQ ID NO: 1421314 - protein, 9 aa, Mycobacterium tuberculosis
GEGDDAEAR

SEQ ID NO: 1421315 - protein, 8 aa, Mycobacterium tuberculosis
GEGGVGKT

SEQ ID NO: 1421316 - protein, 10 aa, Mycobacterium tuberculosis
GEGVTGHQVG

SEQ ID NO: 1421317 - protein, 7 aa, Mycobacterium tuberculosis
GELGQHK

SEQ ID NO: 1421318 - protein, 14 aa, Mycobacterium tuberculosis
GELRKGDRVAQPRR

SEQ ID NO: 1421319 - protein, 8 aa, Mycobacterium tuberculosis
GERSRESI

SEQ ID NO: 1421320 - protein, 10 aa, Mycobacterium tuberculosis
GERSSPVADH

SEQ ID NO: 1421321 - protein, 10 aa, Mycobacterium tuberculosis
GGADGEGAGF

SEQ ID NO: 1421322 - protein, 6 aa, Mycobacterium tuberculosis
GGAEGD

SEQ ID NO: 1421323 - protein, 16 aa, Mycobacterium tuberculosis
GGEGHSGAIGGVGEQV

SEQ ID NO: 1421324 - protein, 38 aa, Mycobacterium tuberculosis
GGHGGAGGNGGNATAPGGASAGFDGGAGGNGGSGGRGG

SEQ ID NO: 1421325 - protein, 7 aa, Mycobacterium tuberculosis
GGKLPRP

SEQ ID NO: 1421326 - protein, 6 aa, Mycobacterium tuberculosis
GGRLTS

SEQ ID NO: 1421327 - protein, 6 aa, Mycobacterium tuberculosis
GGRPPV

SEQ ID NO: 1421328 - protein, 15 aa, Mycobacterium tuberculosis
GHPPDPASVLGPDRL

SEQ ID NO: 1421329 - protein, 14 aa, Mycobacterium tuberculosis
GHYQGRISTPDVSY

SEQ ID NO: 1421330 - protein, 10 aa, Mycobacterium tuberculosis
GIANPGNHNT

SEQ ID NO: 1421331 - protein, 12 aa, Mycobacterium tuberculosis
GIPPDSLGGTRT

SEQ ID NO: 1421332 - protein, 9 aa, Mycobacterium tuberculosis
GKGRGTDHS

SEQ ID NO: 1421333 - protein, 5 aa, Mycobacterium tuberculosis
GKNGQ

SEQ ID NO: 1421334 - protein, 12 aa, Mycobacterium tuberculosis
GLGRAGVSATPR

SEQ ID NO: 1421335 - protein, 7 aa, Mycobacterium tuberculosis
GLPDPGI

SEQ ID NO: 1421336 - protein, 9 aa, Mycobacterium tuberculosis
GLPSGEAAA

SEQ ID NO: 1421337 - protein, 10 aa, Mycobacterium tuberculosis
GNGDPTEPRK

SEQ ID NO: 1421338 - protein, 6 aa, Mycobacterium tuberculosis
GNKPVA

SEQ ID NO: 1421339 - protein, 4 aa, Mycobacterium tuberculosis
GNPA

SEQ ID NO: 1421340 - protein, 7 aa, Mycobacterium tuberculosis
GNPKRGI

SEQ ID NO: 1421341 - protein, 9 aa, Mycobacterium tuberculosis
GNRLDTAGL

SEQ ID NO: 1421342 - protein, 7 aa, Mycobacterium tuberculosis
GNVGTGN

SEQ ID NO: 1421343 - protein, 13 aa, Mycobacterium tuberculosis
GNVNTGAFDTGDF

SEQ ID NO: 1421344 - protein, 5 aa, Mycobacterium tuberculosis
GPAKR

SEQ ID NO: 1421345 - protein, 9 aa, Mycobacterium tuberculosis
GPDTEPLQT

SEQ ID NO: 1421346 - protein, 15 aa, Mycobacterium tuberculosis
GPGGHKLDDDTEDQI

SEQ ID NO: 1421347 - protein, 22 aa, Mycobacterium tuberculosis
GPIAGSAKAYREIEAPGSGATL

SEQ ID NO: 1421348 - protein, 5 aa, Mycobacterium tuberculosis
GPTTA

SEQ ID NO: 1421349 - protein, 12 aa, Mycobacterium tuberculosis
GQANYAAAKAGI

SEQ ID NO: 1421350 - protein, 8 aa, Mycobacterium tuberculosis
GQGSQWAS

SEQ ID NO: 1421351 - protein, 7 aa, Mycobacterium tuberculosis
GQLVETG

SEQ ID NO: 1421352 - protein, 7 aa, Mycobacterium tuberculosis
GRDGDDL

SEQ ID NO: 1421353 - protein, 9 aa, Mycobacterium tuberculosis
GRDGWVGGK

SEQ ID NO: 1421354 - protein, 10 aa, Mycobacterium tuberculosis
GREVEATGSH

SEQ ID NO: 1421355 - protein, 5 aa, Mycobacterium tuberculosis
GRGKD

SEQ ID NO: 1421356 - protein, 6 aa, Mycobacterium tuberculosis
GRQVGA

SEQ ID NO: 1421357 - protein, 4 aa, Mycobacterium tuberculosis
GRRA

SEQ ID NO: 1421358 - protein, 8 aa, Mycobacterium tuberculosis
GRRRGRPE

SEQ ID NO: 1421359 - protein, 9 aa, Mycobacterium tuberculosis
GRSGAPPVG

SEQ ID NO: 1421360 - protein, 7 aa, Mycobacterium tuberculosis
GRSIRRP

SEQ ID NO: 1421361 - protein, 8 aa, Mycobacterium tuberculosis
GRVGGQAL

SEQ ID NO: 1421362 - protein, 14 aa, Mycobacterium tuberculosis
GSARVTSPEPEATY

SEQ ID NO: 1421363 - protein, 10 aa, Mycobacterium tuberculosis
GSGESSERVY

SEQ ID NO: 1421364 - protein, 8 aa, Mycobacterium tuberculosis
GSGGARGY

SEQ ID NO: 1421365 - protein, 5 aa, Mycobacterium tuberculosis
GSGLA

SEQ ID NO: 1421366 - protein, 6 aa, Mycobacterium tuberculosis
GSGNVG

SEQ ID NO: 1421367 - protein, 6 aa, Mycobacterium tuberculosis
GSGVTN

SEQ ID NO: 1421368 - protein, 8 aa, Mycobacterium tuberculosis
GSQPAFPG

SEQ ID NO: 1421369 - protein, 6 aa, Mycobacterium tuberculosis
GSQWAG

SEQ ID NO: 1421370 - protein, 14 aa, Mycobacterium tuberculosis
GSYASGGFATGTDY

SEQ ID NO: 1421371 - protein, 6 aa, Mycobacterium tuberculosis
GTGSTG

SEQ ID NO: 1421372 - protein, 4 aa, Mycobacterium tuberculosis
GTPN

SEQ ID NO: 1421373 - protein, 5 aa, Mycobacterium tuberculosis
GTSVT

SEQ ID NO: 1421374 - protein, 15 aa, Mycobacterium tuberculosis
GTTSQAPRVDEGRAE

SEQ ID NO: 1421375 - protein, 4 aa, Mycobacterium tuberculosis
GTVF

SEQ ID NO: 1421376 - protein, 9 aa, Mycobacterium tuberculosis
GVAADAAGL

SEQ ID NO: 1421377 - protein, 32 aa, Mycobacterium tuberculosis
GVASAGLAAGDPAHGSVGQGNFGGGDVGAGDV

SEQ ID NO: 1421378 - protein, 14 aa, Mycobacterium tuberculosis
GVEPPPVGSRRSRG

SEQ ID NO: 1421379 - protein, 9 aa, Mycobacterium tuberculosis
GVKDGIEEA

SEQ ID NO: 1421380 - protein, 9 aa, Mycobacterium tuberculosis
GVNGRRKAG

SEQ ID NO: 1421381 - protein, 11 aa, Mycobacterium tuberculosis
GVPGVGKSTAI

SEQ ID NO: 1421382 - protein, 7 aa, Mycobacterium tuberculosis
GYTSSLA

SEQ ID NO: 1421383 - protein, 8 aa, Mycobacterium tuberculosis
HANRDQED

SEQ ID NO: 1421384 - protein, 10 aa, Mycobacterium tuberculosis
HAPAKEDEEV

SEQ ID NO: 1421385 - protein, 5 aa, Mycobacterium tuberculosis
HAPRP

SEQ ID NO: 1421386 - protein, 9 aa, Mycobacterium tuberculosis
HDEAAATLD

SEQ ID NO: 1421387 - protein, 7 aa, Mycobacterium tuberculosis
HDGPVRL

SEQ ID NO: 1421388 - protein, 9 aa, Mycobacterium tuberculosis
HDNDGSGAA

SEQ ID NO: 1421389 - protein, 6 aa, Mycobacterium tuberculosis
HDTTNR

SEQ ID NO: 1421390 - protein, 16 aa, Mycobacterium tuberculosis
HEDVGADEVGGHQHPA

SEQ ID NO: 1421391 - protein, 6 aa, Mycobacterium tuberculosis
HEPTTS

SEQ ID NO: 1421392 - protein, 7 aa, Mycobacterium tuberculosis
HGLETEA

SEQ ID NO: 1421393 - protein, 6 aa, Mycobacterium tuberculosis
HGMTEP

SEQ ID NO: 1421394 - protein, 5 aa, Mycobacterium tuberculosis
HGQLP

SEQ ID NO: 1421395 - protein, 8 aa, Mycobacterium tuberculosis
HLPRERAD

SEQ ID NO: 1421396 - protein, 5 aa, Mycobacterium tuberculosis
HNPTM

SEQ ID NO: 1421397 - protein, 6 aa, Mycobacterium tuberculosis
HNTNTE

SEQ ID NO: 1421398 - protein, 8 aa, Mycobacterium tuberculosis
HQQDSRGT

SEQ ID NO: 1421399 - protein, 5 aa, Mycobacterium tuberculosis
HRGAG

SEQ ID NO: 1421400 - protein, 10 aa, Mycobacterium tuberculosis
HSHRRTSRRW

SEQ ID NO: 1421401 - protein, 7 aa, Mycobacterium tuberculosis
HYPDDIE

SEQ ID NO: 1421402 - protein, 9 aa, Mycobacterium tuberculosis
IAQSGNQQI

SEQ ID NO: 1421403 - protein, 8 aa, Mycobacterium tuberculosis
IATNPRAQ

SEQ ID NO: 1421404 - protein, 5 aa, Mycobacterium tuberculosis
IDHGG

SEQ ID NO: 1421405 - protein, 14 aa, Mycobacterium tuberculosis
IDKEGADPAKIRGQ

SEQ ID NO: 1421406 - protein, 9 aa, Mycobacterium tuberculosis
IDPPWETRS

SEQ ID NO: 1421407 - protein, 16 aa, Mycobacterium tuberculosis
IDQKSTNRNPRSTVGT

SEQ ID NO: 1421408 - protein, 4 aa, Mycobacterium tuberculosis
IDRG

SEQ ID NO: 1421409 - protein, 4 aa, Mycobacterium tuberculosis
IGGD

SEQ ID NO: 1421410 - protein, 8 aa, Mycobacterium tuberculosis
IPEATAQE

SEQ ID NO: 1421411 - protein, 18 aa, Mycobacterium tuberculosis
IPGGPGYFNSSTAPSSGF

SEQ ID NO: 1421412 - protein, 9 aa, Mycobacterium tuberculosis
IPPSAPPVI

SEQ ID NO: 1421413 - protein, 5 aa, Mycobacterium tuberculosis
IPSGT

SEQ ID NO: 1421414 - protein, 8 aa, Mycobacterium tuberculosis
IQPLPPKR

SEQ ID NO: 1421415 - protein, 15 aa, Mycobacterium tuberculosis
IRPPEAGIWHGEDFS

SEQ ID NO: 1421416 - protein, 14 aa, Mycobacterium tuberculosis
ITPTAVATTDGASH

SEQ ID NO: 1421417 - protein, 14 aa, Mycobacterium tuberculosis
IVSSRRRKGRRTLS

SEQ ID NO: 1421418 - protein, 13 aa, Mycobacterium tuberculosis
KAAKRLAKEVSAE

SEQ ID NO: 1421419 - protein, 7 aa, Mycobacterium tuberculosis
KAPAFTL

SEQ ID NO: 1421420 - protein, 5 aa, Mycobacterium tuberculosis
KDDAI

SEQ ID NO: 1421421 - protein, 6 aa, Mycobacterium tuberculosis
KDDEDL

SEQ ID NO: 1421422 - protein, 6 aa, Mycobacterium tuberculosis
KDFTPS

SEQ ID NO: 1421423 - protein, 6 aa, Mycobacterium tuberculosis
KGPIEA

SEQ ID NO: 1421424 - protein, 12 aa, Mycobacterium tuberculosis
KKAFAGAAGDQV

SEQ ID NO: 1421425 - protein, 5 aa, Mycobacterium tuberculosis
KLNGL

SEQ ID NO: 1421426 - protein, 6 aa, Mycobacterium tuberculosis
KNYSGM

SEQ ID NO: 1421427 - protein, 4 aa, Mycobacterium tuberculosis
KPGT

SEQ ID NO: 1421428 - protein, 5 aa, Mycobacterium tuberculosis
KPQVV

SEQ ID NO: 1421429 - protein, 12 aa, Mycobacterium tuberculosis
KQGAPTKKTGST

SEQ ID NO: 1421430 - protein, 7 aa, Mycobacterium tuberculosis
KSAGKWP

SEQ ID NO: 1421431 - protein, 4 aa, Mycobacterium tuberculosis
KSGH

SEQ ID NO: 1421432 - protein, 4 aa, Mycobacterium tuberculosis
KSYP

SEQ ID NO: 1421433 - protein, 18 aa, Mycobacterium tuberculosis
KTQIDQVESTAGSLQGQW

SEQ ID NO: 1421434 - protein, 8 aa, Mycobacterium tuberculosis
KTSEEDMA

SEQ ID NO: 1421435 - protein, 6 aa, Mycobacterium tuberculosis
KVAQPS

SEQ ID NO: 1421436 - protein, 6 aa, Mycobacterium tuberculosis
LADAGA

SEQ ID NO: 1421437 - protein, 9 aa, Mycobacterium tuberculosis
LAGAGSGIA

SEQ ID NO: 1421438 - protein, 13 aa, Mycobacterium tuberculosis
LAGETGLRPDFPR

SEQ ID NO: 1421439 - protein, 6 aa, Mycobacterium tuberculosis
LAGGDE

SEQ ID NO: 1421440 - protein, 8 aa, Mycobacterium tuberculosis
LAGVGAPY

SEQ ID NO: 1421441 - protein, 9 aa, Mycobacterium tuberculosis
LAPDVAAAT

SEQ ID NO: 1421442 - protein, 6 aa, Mycobacterium tuberculosis
LAPRER

SEQ ID NO: 1421443 - protein, 6 aa, Mycobacterium tuberculosis
LATAGK

SEQ ID NO: 1421444 - protein, 16 aa, Mycobacterium tuberculosis
LDGGPAAAGFGATSTV

SEQ ID NO: 1421445 - protein, 22 aa, Mycobacterium tuberculosis
LEAEGAKADARRKVRDGGEREM

SEQ ID NO: 1421446 - protein, 5 aa, Mycobacterium tuberculosis
LEAPE

SEQ ID NO: 1421447 - protein, 12 aa, Mycobacterium tuberculosis
LEGQNGENGLLP

SEQ ID NO: 1421448 - protein, 5 aa, Mycobacterium tuberculosis
LGDSD

SEQ ID NO: 1421449 - protein, 8 aa, Mycobacterium tuberculosis
LGEPPRLT

SEQ ID NO: 1421450 - protein, 21 aa, Mycobacterium tuberculosis
LGGGGGGQLRGQRFASERPTL

SEQ ID NO: 1421451 - protein, 14 aa, Mycobacterium tuberculosis
LGGRGVPAKSLSGF

SEQ ID NO: 1421452 - protein, 11 aa, Mycobacterium tuberculosis
LGNTGSTNTGF

SEQ ID NO: 1421453 - protein, 4 aa, Mycobacterium tuberculosis
LGRT

SEQ ID NO: 1421454 - protein, 7 aa, Mycobacterium tuberculosis
LGSAGAR

SEQ ID NO: 1421455 - protein, 6 aa, Mycobacterium tuberculosis
LGSRDG

SEQ ID NO: 1421456 - protein, 5 aa, Mycobacterium tuberculosis
LGVPE

SEQ ID NO: 1421457 - protein, 5 aa, Mycobacterium tuberculosis
LPLGT

SEQ ID NO: 1421458 - protein, 11 aa, Mycobacterium tuberculosis
LPPIDGDDAPF

SEQ ID NO: 1421459 - protein, 14 aa, Mycobacterium tuberculosis
LPTTTIGSYPQTSA

SEQ ID NO: 1421460 - protein, 4 aa, Mycobacterium tuberculosis
LQSG

SEQ ID NO: 1421461 - protein, 9 aa, Mycobacterium tuberculosis
LQTSAPVTG

SEQ ID NO: 1421462 - protein, 8 aa, Mycobacterium tuberculosis
LSAGQSWS

SEQ ID NO: 1421463 - protein, 17 aa, Mycobacterium tuberculosis
LSGDSQVGIGGTNSGSF

SEQ ID NO: 1421464 - protein, 5 aa, Mycobacterium tuberculosis
LSPAD

SEQ ID NO: 1421465 - protein, 15 aa, Mycobacterium tuberculosis
LTGQPAKQTPFAPLP

SEQ ID NO: 1421466 - protein, 11 aa, Mycobacterium tuberculosis
LTQTPSRLTTP

SEQ ID NO: 1421467 - protein, 5 aa, Mycobacterium tuberculosis
LTSDG

SEQ ID NO: 1421468 - protein, 20 aa, Mycobacterium tuberculosis
LTWPPPSKKERRAQHRKEGA

SEQ ID NO: 1421469 - protein, 4 aa, Mycobacterium tuberculosis
MAAT

SEQ ID NO: 1421470 - protein, 11 aa, Mycobacterium tuberculosis
MAPGDGERGTI

SEQ ID NO: 1421471 - protein, 7 aa, Mycobacterium tuberculosis
MKGPTEQ

SEQ ID NO: 1421472 - protein, 9 aa, Mycobacterium tuberculosis
MQRENPPQV

SEQ ID NO: 1421473 - protein, 7 aa, Mycobacterium tuberculosis
MRGATAP

SEQ ID NO: 1421474 - protein, 7 aa, Mycobacterium tuberculosis
MRRGGTV

SEQ ID NO: 1421475 - protein, 11 aa, Mycobacterium tuberculosis
MRSTNGQAKAE

SEQ ID NO: 1421476 - protein, 33 aa, Mycobacterium tuberculosis
MSGRGTDPRLDSNKRVGAAERKAARSRRREHGD

SEQ ID NO: 1421477 - protein, 4 aa, Mycobacterium tuberculosis
MSSF

SEQ ID NO: 1421478 - protein, 6 aa, Mycobacterium tuberculosis
MTAYGQ

SEQ ID NO: 1421479 - protein, 11 aa, Mycobacterium tuberculosis
MTKPAASVTAT

SEQ ID NO: 1421480 - protein, 43 aa, Mycobacterium tuberculosis
NADLGGANADIEGDDTDRRAHAADAARKFSANEANAAEQMQGV

SEQ ID NO: 1421481 - protein, 14 aa, Mycobacterium tuberculosis
NAGRTAAGDDNDAF

SEQ ID NO: 1421482 - protein, 4 aa, Mycobacterium tuberculosis
NAPA

SEQ ID NO: 1421483 - protein, 12 aa, Mycobacterium tuberculosis
NARRAHAPTRTS

SEQ ID NO: 1421484 - protein, 5 aa, Mycobacterium tuberculosis
NARVG

SEQ ID NO: 1421485 - protein, 4 aa, Mycobacterium tuberculosis
NAST

SEQ ID NO: 1421486 - protein, 15 aa, Mycobacterium tuberculosis
NDPERAGVGFGDGTT

SEQ ID NO: 1421487 - protein, 7 aa, Mycobacterium tuberculosis
NESDTAI

SEQ ID NO: 1421488 - protein, 12 aa, Mycobacterium tuberculosis
NFPDQTATSPMD

SEQ ID NO: 1421489 - protein, 21 aa, Mycobacterium tuberculosis
NGADGVAGTGSNAGGNGGPGG

SEQ ID NO: 1421490 - protein, 14 aa, Mycobacterium tuberculosis
NGGAGGPGASGGAL

SEQ ID NO: 1421491 - protein, 21 aa, Mycobacterium tuberculosis
NGGAGGSGAPGQVGGAGGAAG

SEQ ID NO: 1421492 - protein, 8 aa, Mycobacterium tuberculosis
NGPTETTF

SEQ ID NO: 1421493 - protein, 5 aa, Mycobacterium tuberculosis
NIGNY

SEQ ID NO: 1421494 - protein, 4 aa, Mycobacterium tuberculosis
NING

SEQ ID NO: 1421495 - protein, 6 aa, Mycobacterium tuberculosis
NKPADH

SEQ ID NO: 1421496 - protein, 10 aa, Mycobacterium tuberculosis
NLDEGEPFGL

SEQ ID NO: 1421497 - protein, 4 aa, Mycobacterium tuberculosis
NLGN

SEQ ID NO: 1421498 - protein, 4 aa, Mycobacterium tuberculosis
NNGS

SEQ ID NO: 1421499 - protein, 5 aa, Mycobacterium tuberculosis
NPLAG

SEQ ID NO: 1421500 - protein, 5 aa, Mycobacterium tuberculosis
NQTGS

SEQ ID NO: 1421501 - protein, 7 aa, Mycobacterium tuberculosis
NRGNLDT

SEQ ID NO: 1421502 - protein, 5 aa, Mycobacterium tuberculosis
NRISG

SEQ ID NO: 1421503 - protein, 10 aa, Mycobacterium tuberculosis
NRQSELPSRL

SEQ ID NO: 1421504 - protein, 13 aa, Mycobacterium tuberculosis
NRSNLGELRPGSR

SEQ ID NO: 1421505 - protein, 16 aa, Mycobacterium tuberculosis
NRSQQSGRRQPDSLSD

SEQ ID NO: 1421506 - protein, 8 aa, Mycobacterium tuberculosis
NRYAESQH

SEQ ID NO: 1421507 - protein, 6 aa, Mycobacterium tuberculosis
NSGTAI

SEQ ID NO: 1421508 - protein, 6 aa, Mycobacterium tuberculosis
NSGTNN

SEQ ID NO: 1421509 - protein, 20 aa, Mycobacterium tuberculosis
NTGGGGGSGFANVGAGTSGW

SEQ ID NO: 1421510 - protein, 7 aa, Mycobacterium tuberculosis
NVAPSPQ

SEQ ID NO: 1421511 - protein, 6 aa, Mycobacterium tuberculosis
NVPGAG

SEQ ID NO: 1421512 - protein, 9 aa, Mycobacterium tuberculosis
PAAAEGSVT

SEQ ID NO: 1421513 - protein, 12 aa, Mycobacterium tuberculosis
PADEATAAGEVA

SEQ ID NO: 1421514 - protein, 6 aa, Mycobacterium tuberculosis
PANADG

SEQ ID NO: 1421515 - protein, 18 aa, Mycobacterium tuberculosis
PAQVEGATKLPTSPGYTG

SEQ ID NO: 1421516 - protein, 10 aa, Mycobacterium tuberculosis
PASAAGGFAG

SEQ ID NO: 1421517 - protein, 9 aa, Mycobacterium tuberculosis
PASATTTAS

SEQ ID NO: 1421518 - protein, 5 aa, Mycobacterium tuberculosis
PASVE

SEQ ID NO: 1421519 - protein, 6 aa, Mycobacterium tuberculosis
PDERTL

SEQ ID NO: 1421520 - protein, 8 aa, Mycobacterium tuberculosis
PDGHTEDS

SEQ ID NO: 1421521 - protein, 8 aa, Mycobacterium tuberculosis
PDPQYAPG

SEQ ID NO: 1421522 - protein, 10 aa, Mycobacterium tuberculosis
PERQSSEELA

SEQ ID NO: 1421523 - protein, 8 aa, Mycobacterium tuberculosis
PETQDSDD

SEQ ID NO: 1421524 - protein, 5 aa, Mycobacterium tuberculosis
PFDPA

SEQ ID NO: 1421525 - protein, 6 aa, Mycobacterium tuberculosis
PGAGKT

SEQ ID NO: 1421526 - protein, 7 aa, Mycobacterium tuberculosis
PGGQTQF

SEQ ID NO: 1421527 - protein, 4 aa, Mycobacterium tuberculosis
PGHE

SEQ ID NO: 1421528 - protein, 6 aa, Mycobacterium tuberculosis
PGKPAT

SEQ ID NO: 1421529 - protein, 6 aa, Mycobacterium tuberculosis
PGPDRA

SEQ ID NO: 1421530 - protein, 8 aa, Mycobacterium tuberculosis
PGPIQGGS

SEQ ID NO: 1421531 - protein, 5 aa, Mycobacterium tuberculosis
PGPRD

SEQ ID NO: 1421532 - protein, 5 aa, Mycobacterium tuberculosis
PGRSM

SEQ ID NO: 1421533 - protein, 7 aa, Mycobacterium tuberculosis
PGTLPEP

SEQ ID NO: 1421534 - protein, 10 aa, Mycobacterium tuberculosis
PHAETAQPQY

SEQ ID NO: 1421535 - protein, 4 aa, Mycobacterium tuberculosis
PHGN

SEQ ID NO: 1421536 - protein, 8 aa, Mycobacterium tuberculosis
PHTPYPEL

SEQ ID NO: 1421537 - protein, 19 aa, Mycobacterium tuberculosis
PIATKADNPALPTSPEEIA

SEQ ID NO: 1421538 - protein, 5 aa, Mycobacterium tuberculosis
PIPDD

SEQ ID NO: 1421539 - protein, 6 aa, Mycobacterium tuberculosis
PKGEAE

SEQ ID NO: 1421540 - protein, 9 aa, Mycobacterium tuberculosis
PLGVGNGGL

SEQ ID NO: 1421541 - protein, 8 aa, Mycobacterium tuberculosis
PLRGSKAH

SEQ ID NO: 1421542 - protein, 11 aa, Mycobacterium tuberculosis
PMAGKSDIDAA

SEQ ID NO: 1421543 - protein, 6 aa, Mycobacterium tuberculosis
PNITGS

SEQ ID NO: 1421544 - protein, 8 aa, Mycobacterium tuberculosis
PPAGAGRG

SEQ ID NO: 1421545 - protein, 19 aa, Mycobacterium tuberculosis
PPAPAGRGLTAGQQRRRTI

SEQ ID NO: 1421546 - protein, 11 aa, Mycobacterium tuberculosis
PPASVTGTPKL

SEQ ID NO: 1421547 - protein, 9 aa, Mycobacterium tuberculosis
PPGATGVQA

SEQ ID NO: 1421548 - protein, 8 aa, Mycobacterium tuberculosis
PPGVEDGQ

SEQ ID NO: 1421549 - protein, 10 aa, Mycobacterium tuberculosis
PPTLPARSSM

SEQ ID NO: 1421550 - protein, 5 aa, Mycobacterium tuberculosis
PQPGW

SEQ ID NO: 1421551 - protein, 10 aa, Mycobacterium tuberculosis
PRPEVRARSP

SEQ ID NO: 1421552 - protein, 6 aa, Mycobacterium tuberculosis
PSITTA

SEQ ID NO: 1421553 - protein, 15 aa, Mycobacterium tuberculosis
PSRFGYGTSGRRANV

SEQ ID NO: 1421554 - protein, 6 aa, Mycobacterium tuberculosis
PSTRAS

SEQ ID NO: 1421555 - protein, 10 aa, Mycobacterium tuberculosis
PTASFAEQRQ

SEQ ID NO: 1421556 - protein, 10 aa, Mycobacterium tuberculosis
PTGSSPRAYY

SEQ ID NO: 1421557 - protein, 9 aa, Mycobacterium tuberculosis
PTLSSKQKW

SEQ ID NO: 1421558 - protein, 12 aa, Mycobacterium tuberculosis
PTPKARLRPPIR

SEQ ID NO: 1421559 - protein, 5 aa, Mycobacterium tuberculosis
PTPSH

SEQ ID NO: 1421560 - protein, 7 aa, Mycobacterium tuberculosis
PTRRQVD

SEQ ID NO: 1421561 - protein, 5 aa, Mycobacterium tuberculosis
PTSGT

SEQ ID NO: 1421562 - protein, 7 aa, Mycobacterium tuberculosis
PTSNIHS

SEQ ID NO: 1421563 - protein, 5 aa, Mycobacterium tuberculosis
PVDVD

SEQ ID NO: 1421564 - protein, 19 aa, Mycobacterium tuberculosis
PVTGQKLPGYETTWRVAVG

SEQ ID NO: 1421565 - protein, 5 aa, Mycobacterium tuberculosis
PYDDG

SEQ ID NO: 1421566 - protein, 11 aa, Mycobacterium tuberculosis
PYGNSGPRIDG

SEQ ID NO: 1421567 - protein, 9 aa, Mycobacterium tuberculosis
QAADPRSNL

SEQ ID NO: 1421568 - protein, 14 aa, Mycobacterium tuberculosis
QADDQSPAPALNES

SEQ ID NO: 1421569 - protein, 7 aa, Mycobacterium tuberculosis
QAESGAH

SEQ ID NO: 1421570 - protein, 6 aa, Mycobacterium tuberculosis
QAGKLT

SEQ ID NO: 1421571 - protein, 5 aa, Mycobacterium tuberculosis
QAHAD

SEQ ID NO: 1421572 - protein, 7 aa, Mycobacterium tuberculosis
QAHADGG

SEQ ID NO: 1421573 - protein, 9 aa, Mycobacterium tuberculosis
QAPDTAVAA

SEQ ID NO: 1421574 - protein, 4 aa, Mycobacterium tuberculosis
QETD

SEQ ID NO: 1421575 - protein, 11 aa, Mycobacterium tuberculosis
QFAAASPNEAI

SEQ ID NO: 1421576 - protein, 6 aa, Mycobacterium tuberculosis
QGRTAD

SEQ ID NO: 1421577 - protein, 5 aa, Mycobacterium tuberculosis
QHQRG

SEQ ID NO: 1421578 - protein, 6 aa, Mycobacterium tuberculosis
QIRTGT

SEQ ID NO: 1421579 - protein, 8 aa, Mycobacterium tuberculosis
QKTERDRT

SEQ ID NO: 1421580 - protein, 8 aa, Mycobacterium tuberculosis
QNLPFPDE

SEQ ID NO: 1421581 - protein, 14 aa, Mycobacterium tuberculosis
QPEATNRRSQLKSD

SEQ ID NO: 1421582 - protein, 4 aa, Mycobacterium tuberculosis
QPED

SEQ ID NO: 1421583 - protein, 12 aa, Mycobacterium tuberculosis
QPETITTEHKER

SEQ ID NO: 1421584 - protein, 9 aa, Mycobacterium tuberculosis
QPGGRASAA

SEQ ID NO: 1421585 - protein, 7 aa, Mycobacterium tuberculosis
QPRHQPG

SEQ ID NO: 1421586 - protein, 14 aa, Mycobacterium tuberculosis
QQADDNAARRVRER

SEQ ID NO: 1421587 - protein, 13 aa, Mycobacterium tuberculosis
QQPEMRPMNPPSG

SEQ ID NO: 1421588 - protein, 7 aa, Mycobacterium tuberculosis
QRDTLRA

SEQ ID NO: 1421589 - protein, 9 aa, Mycobacterium tuberculosis
QRFPTAPVS

SEQ ID NO: 1421590 - protein, 9 aa, Mycobacterium tuberculosis
QRPASPRLR

SEQ ID NO: 1421591 - protein, 5 aa, Mycobacterium tuberculosis
QRSYT

SEQ ID NO: 1421592 - protein, 10 aa, Mycobacterium tuberculosis
QRVSKGGNPL

SEQ ID NO: 1421593 - protein, 6 aa, Mycobacterium tuberculosis
QSRPSH

SEQ ID NO: 1421594 - protein, 6 aa, Mycobacterium tuberculosis
QTGRTA

SEQ ID NO: 1421595 - protein, 4 aa, Mycobacterium tuberculosis
QTIA

SEQ ID NO: 1421596 - protein, 6 aa, Mycobacterium tuberculosis
QTRDAI

SEQ ID NO: 1421597 - protein, 6 aa, Mycobacterium tuberculosis
QTYGAE

SEQ ID NO: 1421598 - protein, 5 aa, Mycobacterium tuberculosis
QYDQY

SEQ ID NO: 1421599 - protein, 6 aa, Mycobacterium tuberculosis
RAAGLD

SEQ ID NO: 1421600 - protein, 5 aa, Mycobacterium tuberculosis
RADVA

SEQ ID NO: 1421601 - protein, 6 aa, Mycobacterium tuberculosis
RAEPSV

SEQ ID NO: 1421602 - protein, 5 aa, Mycobacterium tuberculosis
RAGSD

SEQ ID NO: 1421603 - protein, 15 aa, Mycobacterium tuberculosis
RAKPPLEDAKDQYRA

SEQ ID NO: 1421604 - protein, 4 aa, Mycobacterium tuberculosis
RANP

SEQ ID NO: 1421605 - protein, 4 aa, Mycobacterium tuberculosis
RANY

SEQ ID NO: 1421606 - protein, 15 aa, Mycobacterium tuberculosis
RAREVASRLNVPDSR

SEQ ID NO: 1421607 - protein, 13 aa, Mycobacterium tuberculosis
RARSRQLRGPAGP

SEQ ID NO: 1421608 - protein, 7 aa, Mycobacterium tuberculosis
RASSETA

SEQ ID NO: 1421609 - protein, 8 aa, Mycobacterium tuberculosis
RATPVTPT

SEQ ID NO: 1421610 - protein, 6 aa, Mycobacterium tuberculosis
RATTRY

SEQ ID NO: 1421611 - protein, 6 aa, Mycobacterium tuberculosis
RDAGAQ

SEQ ID NO: 1421612 - protein, 9 aa, Mycobacterium tuberculosis
RDGRDDSGF

SEQ ID NO: 1421613 - protein, 5 aa, Mycobacterium tuberculosis
RDGSD

SEQ ID NO: 1421614 - protein, 5 aa, Mycobacterium tuberculosis
RDGVA

SEQ ID NO: 1421615 - protein, 12 aa, Mycobacterium tuberculosis
RDPDPANVGRQF

SEQ ID NO: 1421616 - protein, 17 aa, Mycobacterium tuberculosis
RDQDKDGVGSAGIDPDG

SEQ ID NO: 1421617 - protein, 13 aa, Mycobacterium tuberculosis
RDTQRSRRRHSDV

SEQ ID NO: 1421618 - protein, 6 aa, Mycobacterium tuberculosis
RFATSD

SEQ ID NO: 1421619 - protein, 6 aa, Mycobacterium tuberculosis
RGEHDD

SEQ ID NO: 1421620 - protein, 5 aa, Mycobacterium tuberculosis
RGKWD

SEQ ID NO: 1421621 - protein, 6 aa, Mycobacterium tuberculosis
RGLPGK

SEQ ID NO: 1421622 - protein, 9 aa, Mycobacterium tuberculosis
RGRVDNDAT

SEQ ID NO: 1421623 - protein, 4 aa, Mycobacterium tuberculosis
RGYR

SEQ ID NO: 1421624 - protein, 4 aa, Mycobacterium tuberculosis
RHAP

SEQ ID NO: 1421625 - protein, 4 aa, Mycobacterium tuberculosis
RHRP

SEQ ID NO: 1421626 - protein, 13 aa, Mycobacterium tuberculosis
RISRTDTPKPSPT

SEQ ID NO: 1421627 - protein, 9 aa, Mycobacterium tuberculosis
RKAQETQRV

SEQ ID NO: 1421628 - protein, 6 aa, Mycobacterium tuberculosis
RKATEA

SEQ ID NO: 1421629 - protein, 10 aa, Mycobacterium tuberculosis
RKPTKSPNQL

SEQ ID NO: 1421630 - protein, 10 aa, Mycobacterium tuberculosis
RNGKGQKKLR

SEQ ID NO: 1421631 - protein, 11 aa, Mycobacterium tuberculosis
RNGPNPVAEVD

SEQ ID NO: 1421632 - protein, 6 aa, Mycobacterium tuberculosis
RPDAPM

SEQ ID NO: 1421633 - protein, 6 aa, Mycobacterium tuberculosis
RPGGPV

SEQ ID NO: 1421634 - protein, 16 aa, Mycobacterium tuberculosis
RPKTPRGDGNSQAPCF

SEQ ID NO: 1421635 - protein, 4 aa, Mycobacterium tuberculosis
RPPV

SEQ ID NO: 1421636 - protein, 11 aa, Mycobacterium tuberculosis
RPQSVTGPTGV

SEQ ID NO: 1421637 - protein, 5 aa, Mycobacterium tuberculosis
RPTSL

SEQ ID NO: 1421638 - protein, 7 aa, Mycobacterium tuberculosis
RRATRES

SEQ ID NO: 1421639 - protein, 7 aa, Mycobacterium tuberculosis
RREGTSR

SEQ ID NO: 1421640 - protein, 5 aa, Mycobacterium tuberculosis
RREQI

SEQ ID NO: 1421641 - protein, 10 aa, Mycobacterium tuberculosis
RRKRMSKKKH

SEQ ID NO: 1421642 - protein, 14 aa, Mycobacterium tuberculosis
RRLTEANDSPAGEA

SEQ ID NO: 1421643 - protein, 7 aa, Mycobacterium tuberculosis
RRMGSKS

SEQ ID NO: 1421644 - protein, 8 aa, Mycobacterium tuberculosis
RRPTALER

SEQ ID NO: 1421645 - protein, 29 aa, Mycobacterium tuberculosis
RRSAVSAQPGTLGDGLHSDGPRNPFTPKR

SEQ ID NO: 1421646 - protein, 6 aa, Mycobacterium tuberculosis
RSGYAP

SEQ ID NO: 1421647 - protein, 9 aa, Mycobacterium tuberculosis
RSNAGAGTA

SEQ ID NO: 1421648 - protein, 4 aa, Mycobacterium tuberculosis
RSPA

SEQ ID NO: 1421649 - protein, 8 aa, Mycobacterium tuberculosis
RSQGNESA

SEQ ID NO: 1421650 - protein, 21 aa, Mycobacterium tuberculosis
RSRVAARRRAGQRAESRQHPS

SEQ ID NO: 1421651 - protein, 10 aa, Mycobacterium tuberculosis
RSTSELPGEL

SEQ ID NO: 1421652 - protein, 13 aa, Mycobacterium tuberculosis
RTAHGDEDHSGPL

SEQ ID NO: 1421653 - protein, 6 aa, Mycobacterium tuberculosis
RTDART

SEQ ID NO: 1421654 - protein, 9 aa, Mycobacterium tuberculosis
RTGEQYPDE

SEQ ID NO: 1421655 - protein, 11 aa, Mycobacterium tuberculosis
RTGQRHEPGTR

SEQ ID NO: 1421656 - protein, 7 aa, Mycobacterium tuberculosis
RTPFHEP

SEQ ID NO: 1421657 - protein, 9 aa, Mycobacterium tuberculosis
RTPNPEAYE

SEQ ID NO: 1421658 - protein, 7 aa, Mycobacterium tuberculosis
RTPPAGA

SEQ ID NO: 1421659 - protein, 5 aa, Mycobacterium tuberculosis
RTQVQ

SEQ ID NO: 1421660 - protein, 6 aa, Mycobacterium tuberculosis
RTRGGE

SEQ ID NO: 1421661 - protein, 6 aa, Mycobacterium tuberculosis
RVGGAA

SEQ ID NO: 1421662 - protein, 7 aa, Mycobacterium tuberculosis
SAASQGI

SEQ ID NO: 1421663 - protein, 8 aa, Mycobacterium tuberculosis
SAGARGRV

SEQ ID NO: 1421664 - protein, 8 aa, Mycobacterium tuberculosis
SAGNHAQG

SEQ ID NO: 1421665 - protein, 5 aa, Mycobacterium tuberculosis
SAGPI

SEQ ID NO: 1421666 - protein, 5 aa, Mycobacterium tuberculosis
SAGTF

SEQ ID NO: 1421667 - protein, 18 aa, Mycobacterium tuberculosis
SAGVQARNPKYSSYLPTK

SEQ ID NO: 1421668 - protein, 14 aa, Mycobacterium tuberculosis
SAGYATGGMSTAAL

SEQ ID NO: 1421669 - protein, 8 aa, Mycobacterium tuberculosis
SALPAPGR

SEQ ID NO: 1421670 - protein, 6 aa, Mycobacterium tuberculosis
SARRGT

SEQ ID NO: 1421671 - protein, 12 aa, Mycobacterium tuberculosis
SDAERAQKRSRL

SEQ ID NO: 1421672 - protein, 6 aa, Mycobacterium tuberculosis
SDCTDS

SEQ ID NO: 1421673 - protein, 8 aa, Mycobacterium tuberculosis
SDGPTATI

SEQ ID NO: 1421674 - protein, 6 aa, Mycobacterium tuberculosis
SDPAKL

SEQ ID NO: 1421675 - protein, 9 aa, Mycobacterium tuberculosis
SDPTVRGQG

SEQ ID NO: 1421676 - protein, 6 aa, Mycobacterium tuberculosis
SDVGYT

SEQ ID NO: 1421677 - protein, 12 aa, Mycobacterium tuberculosis
SEALGTAADAVA

SEQ ID NO: 1421678 - protein, 8 aa, Mycobacterium tuberculosis
SELPPPLH

SEQ ID NO: 1421679 - protein, 6 aa, Mycobacterium tuberculosis
SEPCGA

SEQ ID NO: 1421680 - protein, 4 aa, Mycobacterium tuberculosis
SEQC

SEQ ID NO: 1421681 - protein, 7 aa, Mycobacterium tuberculosis
SERTGSV

SEQ ID NO: 1421682 - protein, 20 aa, Mycobacterium tuberculosis
SESDTPAGMLDPGQAPKPGV

SEQ ID NO: 1421683 - protein, 6 aa, Mycobacterium tuberculosis
SESGAE

SEQ ID NO: 1421684 - protein, 8 aa, Mycobacterium tuberculosis
SGAGTVGI

SEQ ID NO: 1421685 - protein, 4 aa, Mycobacterium tuberculosis
SGAR

SEQ ID NO: 1421686 - protein, 10 aa, Mycobacterium tuberculosis
SGATALSNEA

SEQ ID NO: 1421687 - protein, 6 aa, Mycobacterium tuberculosis
SGESGL

SEQ ID NO: 1421688 - protein, 9 aa, Mycobacterium tuberculosis
SGGRRRGDT

SEQ ID NO: 1421689 - protein, 8 aa, Mycobacterium tuberculosis
SGIDSSTV

SEQ ID NO: 1421690 - protein, 8 aa, Mycobacterium tuberculosis
SGLTGVSS

SEQ ID NO: 1421691 - protein, 6 aa, Mycobacterium tuberculosis
SGLTNG

SEQ ID NO: 1421692 - protein, 8 aa, Mycobacterium tuberculosis
SGNIGSSN

SEQ ID NO: 1421693 - protein, 15 aa, Mycobacterium tuberculosis
SGNRPAHVVNPEVLG

SEQ ID NO: 1421694 - protein, 8 aa, Mycobacterium tuberculosis
SGPNRIGQ

SEQ ID NO: 1421695 - protein, 7 aa, Mycobacterium tuberculosis
SGRLATE

SEQ ID NO: 1421696 - protein, 10 aa, Mycobacterium tuberculosis
SGSTGEPKGV

SEQ ID NO: 1421697 - protein, 37 aa, Mycobacterium tuberculosis
SGTGNVGIGNSGTGNVGIGNTGTGNTGIGNSGNYNTG

SEQ ID NO: 1421698 - protein, 37 aa, Mycobacterium tuberculosis
SGTNNVGIGNSGTGNWGIGNSGSGNTGIGNTGSTNTG

SEQ ID NO: 1421699 - protein, 6 aa, Mycobacterium tuberculosis
SHPRGP

SEQ ID NO: 1421700 - protein, 6 aa, Mycobacterium tuberculosis
SIENHR

SEQ ID NO: 1421701 - protein, 22 aa, Mycobacterium tuberculosis
SIPHSGEDSIPPNLFVSAQRAT

SEQ ID NO: 1421702 - protein, 4 aa, Mycobacterium tuberculosis
SKTF

SEQ ID NO: 1421703 - protein, 11 aa, Mycobacterium tuberculosis
SLAGKDELTGK

SEQ ID NO: 1421704 - protein, 8 aa, Mycobacterium tuberculosis
SLDQGGPC

SEQ ID NO: 1421705 - protein, 7 aa, Mycobacterium tuberculosis
SLNDQDL

SEQ ID NO: 1421706 - protein, 4 aa, Mycobacterium tuberculosis
SLPN

SEQ ID NO: 1421707 - protein, 8 aa, Mycobacterium tuberculosis
SLRTEGRQ

SEQ ID NO: 1421708 - protein, 8 aa, Mycobacterium tuberculosis
SLSGTPAV

SEQ ID NO: 1421709 - protein, 7 aa, Mycobacterium tuberculosis
SLSSQEL

SEQ ID NO: 1421710 - protein, 5 aa, Mycobacterium tuberculosis
SNPGF

SEQ ID NO: 1421711 - protein, 10 aa, Mycobacterium tuberculosis
SNSWEYTGDG

SEQ ID NO: 1421712 - protein, 10 aa, Mycobacterium tuberculosis
SPAGEQVSGQ

SEQ ID NO: 1421713 - protein, 10 aa, Mycobacterium tuberculosis
SPESYTGTEL

SEQ ID NO: 1421714 - protein, 5 aa, Mycobacterium tuberculosis
SPGAD

SEQ ID NO: 1421715 - protein, 8 aa, Mycobacterium tuberculosis
SPGFDKKA

SEQ ID NO: 1421716 - protein, 9 aa, Mycobacterium tuberculosis
SPGQSLAGI

SEQ ID NO: 1421717 - protein, 6 aa, Mycobacterium tuberculosis
SPNARA

SEQ ID NO: 1421718 - protein, 5 aa, Mycobacterium tuberculosis
SPQAF

SEQ ID NO: 1421719 - protein, 12 aa, Mycobacterium tuberculosis
SQHPRPGGAPPA

SEQ ID NO: 1421720 - protein, 10 aa, Mycobacterium tuberculosis
SQTESEQMKE

SEQ ID NO: 1421721 - protein, 8 aa, Mycobacterium tuberculosis
SRKLPPSV

SEQ ID NO: 1421722 - protein, 8 aa, Mycobacterium tuberculosis
SRRASMPA

SEQ ID NO: 1421723 - protein, 32 aa, Mycobacterium tuberculosis
SRSGHFSPDEIRNRRSRKRSQSHMPPRTPPRG

SEQ ID NO: 1421724 - protein, 16 aa, Mycobacterium tuberculosis
SRYRSNALAQEKTGEA

SEQ ID NO: 1421725 - protein, 6 aa, Mycobacterium tuberculosis
SSPHPA

SEQ ID NO: 1421726 - protein, 10 aa, Mycobacterium tuberculosis
SSPSTPHREL

SEQ ID NO: 1421727 - protein, 5 aa, Mycobacterium tuberculosis
SSSDQ

SEQ ID NO: 1421728 - protein, 6 aa, Mycobacterium tuberculosis
SSSPRV

SEQ ID NO: 1421729 - protein, 11 aa, Mycobacterium tuberculosis
STASADGDGIA

SEQ ID NO: 1421730 - protein, 25 aa, Mycobacterium tuberculosis
STEAKAAGKCRPCRGRAAASARDGA

SEQ ID NO: 1421731 - protein, 8 aa, Mycobacterium tuberculosis
STGEPDRS

SEQ ID NO: 1421732 - protein, 16 aa, Mycobacterium tuberculosis
STGNTSASAAAYAARA

SEQ ID NO: 1421733 - protein, 6 aa, Mycobacterium tuberculosis
SVPGAA

SEQ ID NO: 1421734 - protein, 14 aa, Mycobacterium tuberculosis
SWARRGDPAPGGIG

SEQ ID NO: 1421735 - protein, 17 aa, Mycobacterium tuberculosis
SWDPDRDAPGSAEPGDR

SEQ ID NO: 1421736 - protein, 4 aa, Mycobacterium tuberculosis
SYDE

SEQ ID NO: 1421737 - protein, 16 aa, Mycobacterium tuberculosis
SYDGQGCSISQAATSV

SEQ ID NO: 1421738 - protein, 6 aa, Mycobacterium tuberculosis
SYGMTG

SEQ ID NO: 1421739 - protein, 7 aa, Mycobacterium tuberculosis
TAAATPG

SEQ ID NO: 1421740 - protein, 5 aa, Mycobacterium tuberculosis
TAEAG

SEQ ID NO: 1421741 - protein, 36 aa, Mycobacterium tuberculosis
TAEERANAVRGRADSLRRAAAAEREARVRAQQARAA

SEQ ID NO: 1421742 - protein, 8 aa, Mycobacterium tuberculosis
TAGDSAWA

SEQ ID NO: 1421743 - protein, 6 aa, Mycobacterium tuberculosis
TAKTVP

SEQ ID NO: 1421744 - protein, 13 aa, Mycobacterium tuberculosis
TALSPSSPIAQGS

SEQ ID NO: 1421745 - protein, 32 aa, Mycobacterium tuberculosis; identical to SEQ ID NO: 188880

SEQ ID NO: 1421746 - protein, 9 aa, Mycobacterium tuberculosis
TATGPTEVK

SEQ ID NO: 1421747 - protein, 6 aa, Mycobacterium tuberculosis
TATLAE

SEQ ID NO: 1421748 - protein, 21 aa, Mycobacterium tuberculosis
TATPEAFNKGQLDGPGPSAGP

SEQ ID NO: 1421749 - protein, 6 aa, Mycobacterium tuberculosis
TAVAEN

SEQ ID NO: 1421750 - protein, 14 aa, Mycobacterium tuberculosis
TAYADAAEARGTWD

SEQ ID NO: 1421751 - protein, 7 aa, Mycobacterium tuberculosis
TDDAREA

SEQ ID NO: 1421752 - protein, 7 aa, Mycobacterium tuberculosis
TDGRKRR

SEQ ID NO: 1421753 - protein, 4 aa, Mycobacterium tuberculosis
TDLA

SEQ ID NO: 1421754 - protein, 7 aa, Mycobacterium tuberculosis
TDLPRAT

SEQ ID NO: 1421755 - protein, 14 aa, Mycobacterium tuberculosis
TDPAKSRPLFGPGG

SEQ ID NO: 1421756 - protein, 9 aa, Mycobacterium tuberculosis
TDRKLTPAW

SEQ ID NO: 1421757 - protein, 4 aa, Mycobacterium tuberculosis
TDVE

SEQ ID NO: 1421758 - protein, 7 aa, Mycobacterium tuberculosis
TEADERL

SEQ ID NO: 1421759 - protein, 7 aa, Mycobacterium tuberculosis
TEEGHTV

SEQ ID NO: 1421760 - protein, 9 aa, Mycobacterium tuberculosis
TEELEEASQ

SEQ ID NO: 1421761 - protein, 9 aa, Mycobacterium tuberculosis
TEHTPDGEG

SEQ ID NO: 1421762 - protein, 6 aa, Mycobacterium tuberculosis
TETKSP

SEQ ID NO: 1421763 - protein, 9 aa, Mycobacterium tuberculosis
TGAATEDDA

SEQ ID NO: 1421764 - protein, 11 aa, Mycobacterium tuberculosis
TGAGGGSGFGN

SEQ ID NO: 1421765 - protein, 9 aa, Mycobacterium tuberculosis
TGASKGSIA

SEQ ID NO: 1421766 - protein, 5 aa, Mycobacterium tuberculosis
TGDRV

SEQ ID NO: 1421767 - protein, 8 aa, Mycobacterium tuberculosis
TGDYNTGF

SEQ ID NO: 1421768 - protein, 5 aa, Mycobacterium tuberculosis
TGEAA

SEQ ID NO: 1421769 - protein, 11 aa, Mycobacterium tuberculosis
TGELAGPDFGS

SEQ ID NO: 1421770 - protein, 5 aa, Mycobacterium tuberculosis
TGEPQ

SEQ ID NO: 1421771 - protein, 4 aa, Mycobacterium tuberculosis
TGFT

SEQ ID NO: 1421772 - protein, 7 aa, Mycobacterium tuberculosis
TGGVGKT

SEQ ID NO: 1421773 - protein, 7 aa, Mycobacterium tuberculosis
THPEPKV

SEQ ID NO: 1421774 - protein, 7 aa, Mycobacterium tuberculosis
THPQDRA

SEQ ID NO: 1421775 - protein, 5 aa, Mycobacterium tuberculosis
THTSG

SEQ ID NO: 1421776 - protein, 11 aa, Mycobacterium tuberculosis
TKAELPQAVPH

SEQ ID NO: 1421777 - protein, 12 aa, Mycobacterium tuberculosis
TKSTALELGPSG

SEQ ID NO: 1421778 - protein, 6 aa, Mycobacterium tuberculosis
TKTVPK

SEQ ID NO: 1421779 - protein, 5 aa, Mycobacterium tuberculosis
TLSQA

SEQ ID NO: 1421780 - protein, 6 aa, Mycobacterium tuberculosis
TLSTST

SEQ ID NO: 1421781 - protein, 9 aa, Mycobacterium tuberculosis
TMPYPTTDA

SEQ ID NO: 1421782 - protein, 8 aa, Mycobacterium tuberculosis
TNAGKSSL

SEQ ID NO: 1421783 - protein, 7 aa, Mycobacterium tuberculosis
TNPNEAL

SEQ ID NO: 1421784 - protein, 4 aa, Mycobacterium tuberculosis
TNQT

SEQ ID NO: 1421785 - protein, 5 aa, Mycobacterium tuberculosis
TNSEH

SEQ ID NO: 1421786 - protein, 5 aa, Mycobacterium tuberculosis
TPDYE

SEQ ID NO: 1421787 - protein, 6 aa, Mycobacterium tuberculosis
TPGATI

SEQ ID NO: 1421788 - protein, 4 aa, Mycobacterium tuberculosis
TPHR

SEQ ID NO: 1421789 - protein, 9 aa, Mycobacterium tuberculosis
TPRQTTADG

SEQ ID NO: 1421790 - protein, 4 aa, Mycobacterium tuberculosis
TPTE

SEQ ID NO: 1421791 - protein, 10 aa, Mycobacterium tuberculosis
TPTGRPTGEW

SEQ ID NO: 1421792 - protein, 5 aa, Mycobacterium tuberculosis
TPVPA

SEQ ID NO: 1421793 - protein, 6 aa, Mycobacterium tuberculosis
TPVQAS

SEQ ID NO: 1421794 - protein, 7 aa, Mycobacterium tuberculosis
TPVQTPV

SEQ ID NO: 1421795 - protein, 7 aa, Mycobacterium tuberculosis
TQLSPEH

SEQ ID NO: 1421796 - protein, 8 aa, Mycobacterium tuberculosis
TQQTAAPL

SEQ ID NO: 1421797 - protein, 4 aa, Mycobacterium tuberculosis
TRAP

SEQ ID NO: 1421798 - protein, 10 aa, Mycobacterium tuberculosis
TREPNSGIRD

SEQ ID NO: 1421799 - protein, 5 aa, Mycobacterium tuberculosis
TRKYS

SEQ ID NO: 1421800 - protein, 6 aa, Mycobacterium tuberculosis
TRNPGF

SEQ ID NO: 1421801 - protein, 6 aa, Mycobacterium tuberculosis
TSDRCS

SEQ ID NO: 1421802 - protein, 10 aa, Mycobacterium tuberculosis
TSGSPSEATS

SEQ ID NO: 1421803 - protein, 4 aa, Mycobacterium tuberculosis
TSLR

SEQ ID NO: 1421804 - protein, 6 aa, Mycobacterium tuberculosis
TSPSAA

SEQ ID NO: 1421805 - protein, 9 aa, Mycobacterium tuberculosis
TSQAGQPPE

SEQ ID NO: 1421806 - protein, 4 aa, Mycobacterium tuberculosis
TSQL

SEQ ID NO: 1421807 - protein, 13 aa, Mycobacterium tuberculosis
TSRTSEDADDALQ

SEQ ID NO: 1421808 - protein, 7 aa, Mycobacterium tuberculosis
TSYATHN

SEQ ID NO: 1421809 - protein, 5 aa, Mycobacterium tuberculosis
TTAEL

SEQ ID NO: 1421810 - protein, 9 aa, Mycobacterium tuberculosis
TTDARPDLA

SEQ ID NO: 1421811 - protein, 9 aa, Mycobacterium tuberculosis
TTRDARDIG

SEQ ID NO: 1421812 - protein, 11 aa, Mycobacterium tuberculosis
TVDQPNPSTRF

SEQ ID NO: 1421813 - protein, 5 aa, Mycobacterium tuberculosis
TVTGS

SEQ ID NO: 1421814 - protein, 13 aa, Mycobacterium tuberculosis
VANPVDPARISAG

SEQ ID NO: 1421815 - protein, 7 aa, Mycobacterium tuberculosis
VANTPQS

SEQ ID NO: 1421816 - protein, 6 aa, Mycobacterium tuberculosis
VAPDGV

SEQ ID NO: 1421817 - protein, 10 aa, Mycobacterium tuberculosis
VAPRGGGHSY

SEQ ID NO: 1421818 - protein, 7 aa, Mycobacterium tuberculosis
VDDGVRR

SEQ ID NO: 1421819 - protein, 9 aa, Mycobacterium tuberculosis
VEQADGECT

SEQ ID NO: 1421820 - protein, 5 aa, Mycobacterium tuberculosis
VETSR

SEQ ID NO: 1421821 - protein, 6 aa, Mycobacterium tuberculosis
VGAHTA

SEQ ID NO: 1421822 - protein, 8 aa, Mycobacterium tuberculosis
VGASTANG

SEQ ID NO: 1421823 - protein, 12 aa, Mycobacterium tuberculosis
VGEGNVGNGNVG

SEQ ID NO: 1421824 - protein, 10 aa, Mycobacterium tuberculosis
VGEGTRGAPT

SEQ ID NO: 1421825 - protein, 9 aa, Mycobacterium tuberculosis
VGGHDPHEL

SEQ ID NO: 1421826 - protein, 21 aa, Mycobacterium tuberculosis
VGGRRAGKPGRRLIVIQLRSS

SEQ ID NO: 1421827 - protein, 8 aa, Mycobacterium tuberculosis
VGGSTEAP

SEQ ID NO: 1421828 - protein, 7 aa, Mycobacterium tuberculosis
VGNGNVG

SEQ ID NO: 1421829 - protein, 13 aa, Mycobacterium tuberculosis
VGREVSRYGGGEI

SEQ ID NO: 1421830 - protein, 7 aa, Mycobacterium tuberculosis
VGRRARA

SEQ ID NO: 1421831 - protein, 6 aa, Mycobacterium tuberculosis
VGWSPT

SEQ ID NO: 1421832 - protein, 11 aa, Mycobacterium tuberculosis
VHTSPREVAGP

SEQ ID NO: 1421833 - protein, 7 aa, Mycobacterium tuberculosis
VKQGQGG

SEQ ID NO: 1421834 - protein, 5 aa, Mycobacterium tuberculosis
VPAGT

SEQ ID NO: 1421835 - protein, 8 aa, Mycobacterium tuberculosis
VPEATRSL

SEQ ID NO: 1421836 - protein, 18 aa, Mycobacterium tuberculosis
VPFPTGPRPDVRRADDHE

SEQ ID NO: 1421837 - protein, 8 aa, Mycobacterium tuberculosis
VPGATAPL

SEQ ID NO: 1421838 - protein, 4 aa, Mycobacterium tuberculosis
VPTQ

SEQ ID NO: 1421839 - protein, 6 aa, Mycobacterium tuberculosis
VQRPND

SEQ ID NO: 1421840 - protein, 21 aa, Mycobacterium tuberculosis
VQSPTQVEATRQGKSYTLTGT

SEQ ID NO: 1421841 - protein, 4 aa, Mycobacterium tuberculosis
VQTG

SEQ ID NO: 1421842 - protein, 15 aa, Mycobacterium tuberculosis
VRGADDAALPPVTEV

SEQ ID NO: 1421843 - protein, 29 aa, Mycobacterium tuberculosis
VRGDGGVGMASGDGGLSTGAAGASAEGGL

SEQ ID NO: 1421844 - protein, 7 aa, Mycobacterium tuberculosis
VRGQPGD

SEQ ID NO: 1421845 - protein, 5 aa, Mycobacterium tuberculosis
VRNTA

SEQ ID NO: 1421846 - protein, 7 aa, Mycobacterium tuberculosis
VRPGGTV

SEQ ID NO: 1421847 - protein, 16 aa, Mycobacterium tuberculosis
VRPPRDPGSHCCLAVN

SEQ ID NO: 1421848 - protein, 5 aa, Mycobacterium tuberculosis
VRQGK

SEQ ID NO: 1421849 - protein, 20 aa, Mycobacterium tuberculosis
VRQPTVSGFEKEPSDPKLST

SEQ ID NO: 1421850 - protein, 9 aa, Mycobacterium tuberculosis
VRRDNTGYD

SEQ ID NO: 1421851 - protein, 24 aa, Mycobacterium tuberculosis
VRTDSSLDSNLHGRAGLRSRSGKV

SEQ ID NO: 1421852 - protein, 7 aa, Mycobacterium tuberculosis
VSADTTV

SEQ ID NO: 1421853 - protein, 23 aa, Mycobacterium tuberculosis
VSAGYGNNGDVQSGINNTNSGGF

SEQ ID NO: 1421854 - protein, 6 aa, Mycobacterium tuberculosis
VSDTER

SEQ ID NO: 1421855 - protein, 20 aa, Mycobacterium tuberculosis
VSTPARALSKPGDRESPDAY

SEQ ID NO: 1421856 - protein, 10 aa, Mycobacterium tuberculosis
VTADTDAAMT

SEQ ID NO: 1421857 - protein, 6 aa, Mycobacterium tuberculosis
VTAQRG

SEQ ID NO: 1421858 - protein, 7 aa, Mycobacterium tuberculosis
VTGDTAT

SEQ ID NO: 1421859 - protein, 7 aa, Mycobacterium tuberculosis
VTGRGAG

SEQ ID NO: 1421860 - protein, 7 aa, Mycobacterium tuberculosis
VTNPKGE

SEQ ID NO: 1421861 - protein, 24 aa, Mycobacterium tuberculosis
WGNGGAGGAGAAGAAGANGQNPVS

SEQ ID NO: 1421862 - protein, 9 aa, Mycobacterium tuberculosis
WPDNASLDK

SEQ ID NO: 1421863 - protein, 17 aa, Mycobacterium tuberculosis
YAEGSSSTGGGGAYQGT

SEQ ID NO: 1421864 - protein, 4 aa, Mycobacterium tuberculosis
YDES

SEQ ID NO: 1421865 - protein, 5 aa, Mycobacterium tuberculosis
YDPET

SEQ ID NO: 1421866 - protein, 5 aa, Mycobacterium tuberculosis
YDPRI

SEQ ID NO: 1421867 - protein, 4 aa, Mycobacterium tuberculosis
YGED

SEQ ID NO: 1421868 - protein, 13 aa, Mycobacterium tuberculosis
YGLGKGQGESPCA

SEQ ID NO: 1421869 - protein, 8 aa, Mycobacterium tuberculosis
YPAPPGAP

SEQ ID NO: 1421870 - protein, 8 aa, Mycobacterium tuberculosis
YPATAEES

SEQ ID NO: 1421871 - protein, 6 aa, Mycobacterium tuberculosis
YPGEPL

SEQ ID NO: 1421872 - protein, 8 aa, Mycobacterium tuberculosis
YQSDGQTR

SEQ ID NO: 1421873 - protein, 7 aa, Mycobacterium tuberculosis
YRDGDLD

SEQ ID NO: 1421874 - protein, 6 aa, Mycobacterium tuberculosis
YSPAQL

SEQ ID NO: 1421875 - protein, 15 aa, Mycobacterium tuberculosis
YSTDLTARAREGKLD

SEQ ID NO: 1421876 - protein, 4 aa, Mycobacterium tuberculosis
YTDE

SEQ ID NO: 1421877 - protein, 9 aa, Mycobacterium tuberculosis
YTDPDGAKA

SEQ ID NO: 1421878 - protein, 9 aa, Mycobacterium tuberculosis
YTGDDGRTV

SEQ ID NO: 1421879 - protein, 11 aa, Mycobacterium tuberculosis
YTVATPRDAQD

SEQ ID NO: 1421880 - protein, 5 aa, Mycobacterium tuberculosis
AAAAG

SEQ ID NO: 1421881 - protein, 16 aa, Mycobacterium tuberculosis
AAAASLQPLDPPDGFT

SEQ ID NO: 1421882 - protein, 15 aa, Mycobacterium tuberculosis
AAAATSGASTAAHAG

SEQ ID NO: 1421883 - protein, 6 aa, Mycobacterium tuberculosis
AAASSY

SEQ ID NO: 1421884 - protein, 7 aa, Mycobacterium tuberculosis
AAATTAG

SEQ ID NO: 1421885 - protein, 10 aa, Mycobacterium tuberculosis
AADDPAENES

SEQ ID NO: 1421886 - protein, 23 aa, Mycobacterium tuberculosis
AADTGSATGTETGGAGQCAPSRS

SEQ ID NO: 1421887 - protein, 5 aa, Mycobacterium tuberculosis
AAEQR

SEQ ID NO: 1421888 - protein, 6 aa, Mycobacterium tuberculosis
AAETYG

SEQ ID NO: 1421889 - protein, 10 aa, Mycobacterium tuberculosis
AAGLDLGGRE

SEQ ID NO: 1421890 - protein, 5 aa, Mycobacterium tuberculosis
AAHPD

SEQ ID NO: 1421891 - protein, 15 aa, Mycobacterium tuberculosis
AAIPDGEIAGSAEAS

SEQ ID NO: 1421892 - protein, 9 aa, Mycobacterium tuberculosis
AAKEALADP

SEQ ID NO: 1421893 - protein, 16 aa, Mycobacterium tuberculosis
AAPGVGNTTTAPSSGF

SEQ ID NO: 1421894 - protein, 36 aa, Mycobacterium tuberculosis
AAPNDAEAIGAANAANVKGPKHTPRTPKPRGRRKTR

SEQ ID NO: 1421895 - protein, 9 aa, Mycobacterium tuberculosis
AARAETERT

SEQ ID NO: 1421896 - protein, 12 aa, Mycobacterium tuberculosis
AASAEQAAAQAV

SEQ ID NO: 1421897 - protein, 12 aa, Mycobacterium tuberculosis
AASASAAGPTTG

SEQ ID NO: 1421898 - protein, 4 aa, Mycobacterium tuberculosis
AASH

SEQ ID NO: 1421899 - protein, 13 aa, Mycobacterium tuberculosis
AATGRLSSTEPNL

SEQ ID NO: 1421900 - protein, 27 aa, Mycobacterium tuberculosis
AAVPTAGTPHSKNRVAAATDESVERGS

SEQ ID NO: 1421901 - protein, 18 aa, Mycobacterium tuberculosis
ACSVTTRPGNAAVDYGGA

SEQ ID NO: 1421902 - protein, 4 aa, Mycobacterium tuberculosis
ADAQ

SEQ ID NO: 1421903 - protein, 10 aa, Mycobacterium tuberculosis
ADDSALTAEA

SEQ ID NO: 1421904 - protein, 5 aa, Mycobacterium tuberculosis
ADERT

SEQ ID NO: 1421905 - protein, 12 aa, Mycobacterium tuberculosis
ADGAPQRPAKPV

SEQ ID NO: 1421906 - protein, 17 aa, Mycobacterium tuberculosis
ADGKSLNVAGSDNTLTV

SEQ ID NO: 1421907 - protein, 8 aa, Mycobacterium tuberculosis
ADGSLPAD

SEQ ID NO: 1421908 - protein, 9 aa, Mycobacterium tuberculosis
ADRARAENW

SEQ ID NO: 1421909 - protein, 5 aa, Mycobacterium tuberculosis
AEAGN

SEQ ID NO: 1421910 - protein, 11 aa, Mycobacterium tuberculosis
AEFASQGVPED

SEQ ID NO: 1421911 - protein, 10 aa, Mycobacterium tuberculosis
AETNRPPETV

SEQ ID NO: 1421912 - protein, 10 aa, Mycobacterium tuberculosis
AFDGEQKLAG

SEQ ID NO: 1421913 - protein, 13 aa, Mycobacterium tuberculosis
AGAENPEPGRYGG

SEQ ID NO: 1421914 - protein, 30 aa, Mycobacterium tuberculosis; identical to SEQ ID NO: 168111

SEQ ID NO: 1421915 - protein, 18 aa, Mycobacterium tuberculosis
AGAGGGSGFGNFGAGTSG

SEQ ID NO: 1421916 - protein, 8 aa, Mycobacterium tuberculosis
AGDAGEPW

SEQ ID NO: 1421917 - protein, 6 aa, Mycobacterium tuberculosis
AGELPA

SEQ ID NO: 1421918 - protein, 7 aa, Mycobacterium tuberculosis
AGGAVGG

SEQ ID NO: 1421919 - protein, 5 aa, Mycobacterium tuberculosis
AGMTT

SEQ ID NO: 1421920 - protein, 19 aa, Mycobacterium tuberculosis
AGNAPRPAGRSLSDADRSV

SEQ ID NO: 1421921 - protein, 15 aa, Mycobacterium tuberculosis
AGNMSGSGNFGAGNS

SEQ ID NO: 1421922 - protein, 54 aa, Mycobacterium tuberculosis; identical to SEQ ID NO: 193649

SEQ ID NO: 1421923 - protein, 15 aa, Mycobacterium tuberculosis
AGRAAPLPAPPPSGC

SEQ ID NO: 1421924 - protein, 9 aa, Mycobacterium tuberculosis
AGRKAHSRA

SEQ ID NO: 1421925 - protein, 8 aa, Mycobacterium tuberculosis
AGRQGQTD

SEQ ID NO: 1421926 - protein, 29 aa, Mycobacterium tuberculosis
AGSSATATKVTPFAPPPNTTSPSAAATQL

SEQ ID NO: 1421927 - protein, 10 aa, Mycobacterium tuberculosis
AGSTAEGQRI

SEQ ID NO: 1421928 - protein, 12 aa, Mycobacterium tuberculosis
AGTASDEAGAGE

SEQ ID NO: 1421929 - protein, 7 aa, Mycobacterium tuberculosis
AGTPCAL

SEQ ID NO: 1421930 - protein, 6 aa, Mycobacterium tuberculosis
AGVRPD

SEQ ID NO: 1421931 - protein, 6 aa, Mycobacterium tuberculosis
AHGGQA

SEQ ID NO: 1421932 - protein, 4 aa, Mycobacterium tuberculosis
AITP

SEQ ID NO: 1421933 - protein, 15 aa, Mycobacterium tuberculosis
AKAEVHGTASPQKHQ

SEQ ID NO: 1421934 - protein, 4 aa, Mycobacterium tuberculosis
AKDA

SEQ ID NO: 1421935 - protein, 9 aa, Mycobacterium tuberculosis
AKGSAGGEQ

SEQ ID NO: 1421936 - protein, 8 aa, Mycobacterium tuberculosis
AKPLSDGV

SEQ ID NO: 1421937 - protein, 9 aa, Mycobacterium tuberculosis
AKRKTTQRL

SEQ ID NO: 1421938 - protein, 15 aa, Mycobacterium tuberculosis
AKSDLERQESREKTG

SEQ ID NO: 1421939 - protein, 4 aa, Mycobacterium tuberculosis
AKTD

SEQ ID NO: 1421940 - protein, 4 aa, Mycobacterium tuberculosis
ALEN

SEQ ID NO: 1421941 - protein, 10 aa, Mycobacterium tuberculosis
ALEPGPNGRD

SEQ ID NO: 1421942 - protein, 38 aa, Mycobacterium tuberculosis
ALTGPGARGGSFGSVEGAGDLASPQSVGAGGFSGSGVQ

SEQ ID NO: 1421943 - protein, 6 aa, Mycobacterium tuberculosis
ANNAAR

SEQ ID NO: 1421944 - protein, 7 aa, Mycobacterium tuberculosis
ANNPSGH

SEQ ID NO: 1421945 - protein, 13 aa, Mycobacterium tuberculosis
ANSFEAQAARDGL

SEQ ID NO: 1421946 - protein, 4 aa, Mycobacterium tuberculosis
ANSS

SEQ ID NO: 1421947 - protein, 10 aa, Mycobacterium tuberculosis
ANTGDTNTGI

SEQ ID NO: 1421948 - protein, 21 aa, Mycobacterium tuberculosis
ANTGSYNTGSTNTGSFNDGDF

SEQ ID NO: 1421949 - protein, 18 aa, Mycobacterium tuberculosis
APAAAAQAVQTAAQNGVR

SEQ ID NO: 1421950 - protein, 5 aa, Mycobacterium tuberculosis
APAGY

SEQ ID NO: 1421951 - protein, 5 aa, Mycobacterium tuberculosis
APAND

SEQ ID NO: 1421952 - protein, 4 aa, Mycobacterium tuberculosis
APAQ

SEQ ID NO: 1421953 - protein, 10 aa, Mycobacterium tuberculosis
APLDEASRNR

SEQ ID NO: 1421954 - protein, 19 aa, Mycobacterium tuberculosis
AQEVSDDSPTLAQPAVPSY

SEQ ID NO: 1421955 - protein, 8 aa, Mycobacterium tuberculosis
AQRDVADD

SEQ ID NO: 1421956 - protein, 14 aa, Mycobacterium tuberculosis
AREGTLTPAELRGS

SEQ ID NO: 1421957 - protein, 29 aa, Mycobacterium tuberculosis
ARGGTNSAPGTATESARAPEPAASAPPEA

SEQ ID NO: 1421958 - protein, 7 aa, Mycobacterium tuberculosis
ARMPNNA

SEQ ID NO: 1421959 - protein, 4 aa, Mycobacterium tuberculosis
ARRH

SEQ ID NO: 1421960 - protein, 4 aa, Mycobacterium tuberculosis
ARRL

SEQ ID NO: 1421961 - protein, 10 aa, Mycobacterium tuberculosis
ARRSAGAHPY

SEQ ID NO: 1421962 - protein, 10 aa, Mycobacterium tuberculosis
ARSAEGDRVG

SEQ ID NO: 1421963 - protein, 8 aa, Mycobacterium tuberculosis
ARTTTRDV

SEQ ID NO: 1421964 - protein, 5 aa, Mycobacterium tuberculosis
ASDLT

SEQ ID NO: 1421965 - protein, 7 aa, Mycobacterium tuberculosis
ASEDEVE

SEQ ID NO: 1421966 - protein, 5 aa, Mycobacterium tuberculosis
ASENN

SEQ ID NO: 1421967 - protein, 7 aa, Mycobacterium tuberculosis
ASHEESA

SEQ ID NO: 1421968 - protein, 9 aa, Mycobacterium tuberculosis
ASPLSGNPG

SEQ ID NO: 1421969 - protein, 8 aa, Mycobacterium tuberculosis
ASPVPRQR

SEQ ID NO: 1421970 - protein, 4 aa, Mycobacterium tuberculosis
ASVE

SEQ ID NO: 1421971 - protein, 6 aa, Mycobacterium tuberculosis
ATAGLG

SEQ ID NO: 1421972 - protein, 12 aa, Mycobacterium tuberculosis
ATAVANRSGTEP

SEQ ID NO: 1421973 - protein, 5 aa, Mycobacterium tuberculosis
ATERP

SEQ ID NO: 1421974 - protein, 12 aa, Mycobacterium tuberculosis
ATFGGVESRNRQ

SEQ ID NO: 1421975 - protein, 8 aa, Mycobacterium tuberculosis
ATGPETGR

SEQ ID NO: 1421976 - protein, 12 aa, Mycobacterium tuberculosis
ATHLPGSQLDTT

SEQ ID NO: 1421977 - protein, 16 aa, Mycobacterium tuberculosis
ATPQADGGAFYGPRGR

SEQ ID NO: 1421978 - protein, 6 aa, Mycobacterium tuberculosis
ATQSRV

SEQ ID NO: 1421979 - protein, 7 aa, Mycobacterium tuberculosis
ATSAAPL

SEQ ID NO: 1421980 - protein, 14 aa, Mycobacterium tuberculosis
ATTDGTRFTNNRTG

SEQ ID NO: 1421981 - protein, 8 aa, Mycobacterium tuberculosis
ATTGPSSG

SEQ ID NO: 1421982 - protein, 12 aa, Mycobacterium tuberculosis
ATTRASVARPAP

SEQ ID NO: 1421983 - protein, 9 aa, Mycobacterium tuberculosis
AVSGGAPLG

SEQ ID NO: 1421984 - protein, 10 aa, Mycobacterium tuberculosis
AVSGLRGSED

SEQ ID NO: 1421985 - protein, 6 aa, Mycobacterium tuberculosis
AVTPRT

SEQ ID NO: 1421986 - protein, 9 aa, Mycobacterium tuberculosis
AYGREGENC

SEQ ID NO: 1421987 - protein, 8 aa, Mycobacterium tuberculosis
AYPRDAER

SEQ ID NO: 1421988 - protein, 10 aa, Mycobacterium tuberculosis
AYQAASAEAA

SEQ ID NO: 1421989 - protein, 7 aa, Mycobacterium tuberculosis
CANGPRI

SEQ ID NO: 1421990 - protein, 11 aa, Mycobacterium tuberculosis
CGDPGDLEGMG

SEQ ID NO: 1421991 - protein, 8 aa, Mycobacterium tuberculosis
CPPHSSLR

SEQ ID NO: 1421992 - protein, 7 aa, Mycobacterium tuberculosis
DAATGNA

SEQ ID NO: 1421993 - protein, 7 aa, Mycobacterium tuberculosis
DAGSNRE

SEQ ID NO: 1421994 - protein, 6 aa, Mycobacterium tuberculosis
DASGSV

SEQ ID NO: 1421995 - protein, 4 aa, Mycobacterium tuberculosis
DATR

SEQ ID NO: 1421996 - protein, 32 aa, Mycobacterium tuberculosis
DDGWPHTGDPCSPNSAASGKYGERPASVSTGD

SEQ ID NO: 1421997 - protein, 4 aa, Mycobacterium tuberculosis
DDHD

SEQ ID NO: 1421998 - protein, 12 aa, Mycobacterium tuberculosis
DDPTTHDDVRAD

SEQ ID NO: 1421999 - protein, 7 aa, Mycobacterium tuberculosis
DEAPKVP

SEQ ID NO: 1422000 - protein, 19 aa, Mycobacterium tuberculosis
DEARAAARARGQDAGRGRV

SEQ ID NO: 1422001 - protein, 8 aa, Mycobacterium tuberculosis
DEGAAATE

SEQ ID NO: 1422002 - protein, 6 aa, Mycobacterium tuberculosis
DEIRDG

SEQ ID NO: 1422003 - protein, 5 aa, Mycobacterium tuberculosis
DEKWG

SEQ ID NO: 1422004 - protein, 8 aa, Mycobacterium tuberculosis
DEQPGLAP

SEQ ID NO: 1422005 - protein, 5 aa, Mycobacterium tuberculosis
DERRV

SEQ ID NO: 1422006 - protein, 14 aa, Mycobacterium tuberculosis
DERVDDGTGSDTPK

SEQ ID NO: 1422007 - protein, 5 aa, Mycobacterium tuberculosis
DGPVT

SEQ ID NO: 1422008 - protein, 11 aa, Mycobacterium tuberculosis
DGRPEDLAGDP

SEQ ID NO: 1422009 - protein, 9 aa, Mycobacterium tuberculosis
DGVTPPGQM

SEQ ID NO: 1422010 - protein, 8 aa, Mycobacterium tuberculosis
DGYPPGVH

SEQ ID NO: 1422011 - protein, 5 aa, Mycobacterium tuberculosis
DHPGV

SEQ ID NO: 1422012 - protein, 12 aa, Mycobacterium tuberculosis
DHQESLMERHRS

SEQ ID NO: 1422013 - protein, 7 aa, Mycobacterium tuberculosis
DHTDEVT

SEQ ID NO: 1422014 - protein, 8 aa, Mycobacterium tuberculosis
DLDGRAPV

SEQ ID NO: 1422015 - protein, 9 aa, Mycobacterium tuberculosis
DLQEDKEPV

SEQ ID NO: 1422016 - protein, 6 aa, Mycobacterium tuberculosis
DLSGDA

SEQ ID NO: 1422017 - protein, 10 aa, Mycobacterium tuberculosis
DPDTGEPCPT

SEQ ID NO: 1422018 - protein, 4 aa, Mycobacterium tuberculosis
DPQG

SEQ ID NO: 1422019 - protein, 5 aa, Mycobacterium tuberculosis
DQASA

SEQ ID NO: 1422020 - protein, 9 aa, Mycobacterium tuberculosis
DQPAPDVRY

SEQ ID NO: 1422021 - protein, 16 aa, Mycobacterium tuberculosis
DRATGPHSSESRAADH

SEQ ID NO: 1422022 - protein, 7 aa, Mycobacterium tuberculosis
DRDRDAT

SEQ ID NO: 1422023 - protein, 10 aa, Mycobacterium tuberculosis
DSKATNPHAA

SEQ ID NO: 1422024 - protein, 6 aa, Mycobacterium tuberculosis
DSVEPA

SEQ ID NO: 1422025 - protein, 19 aa, Mycobacterium tuberculosis
DTAKGRRPSWNAAAPGAVA

SEQ ID NO: 1422026 - protein, 11 aa, Mycobacterium tuberculosis
DTKQANRAAEN

SEQ ID NO: 1422027 - protein, 6 aa, Mycobacterium tuberculosis
DTPTGL

SEQ ID NO: 1422028 - protein, 8 aa, Mycobacterium tuberculosis
DTVDDTTL

SEQ ID NO: 1422029 - protein, 4 aa, Mycobacterium tuberculosis
DVNT

SEQ ID NO: 1422030 - protein, 16 aa, Mycobacterium tuberculosis
EAARRAAASVAGAADP

SEQ ID NO: 1422031 - protein, 21 aa, Mycobacterium tuberculosis
EAKARQAADEQATARAEAEAC

SEQ ID NO: 1422032 - protein, 4 aa, Mycobacterium tuberculosis
EELG

SEQ ID NO: 1422033 - protein, 9 aa, Mycobacterium tuberculosis
EFDPERAGS

SEQ ID NO: 1422034 - protein, 4 aa, Mycobacterium tuberculosis
EFER

SEQ ID NO: 1422035 - protein, 7 aa, Mycobacterium tuberculosis
EFGTPRS

SEQ ID NO: 1422036 - protein, 8 aa, Mycobacterium tuberculosis
EGGPSRHH

SEQ ID NO: 1422037 - protein, 4 aa, Mycobacterium tuberculosis
EGTA

SEQ ID NO: 1422038 - protein, 8 aa, Mycobacterium tuberculosis
EHDPLRDD

SEQ ID NO: 1422039 - protein, 16 aa, Mycobacterium tuberculosis
ELDAEPDLDVEPGEDL

SEQ ID NO: 1422040 - protein, 7 aa, Mycobacterium tuberculosis
ELPTEPN

SEQ ID NO: 1422041 - protein, 7 aa, Mycobacterium tuberculosis
ELTNGRG

SEQ ID NO: 1422042 - protein, 8 aa, Mycobacterium tuberculosis
ENRANVGG

SEQ ID NO: 1422043 - protein, 4 aa, Mycobacterium tuberculosis
EPRV

SEQ ID NO: 1422044 - protein, 7 aa, Mycobacterium tuberculosis
EPYGGPD

SEQ ID NO: 1422045 - protein, 7 aa, Mycobacterium tuberculosis
EQERGIT

SEQ ID NO: 1422046 - protein, 8 aa, Mycobacterium tuberculosis
EQGFNSGD

SEQ ID NO: 1422047 - protein, 5 aa, Mycobacterium tuberculosis
EQPLP

SEQ ID NO: 1422048 - protein, 4 aa, Mycobacterium tuberculosis
EQRE

SEQ ID NO: 1422049 - protein, 8 aa, Mycobacterium tuberculosis
EQVPPDRW

SEQ ID NO: 1422050 - protein, 6 aa, Mycobacterium tuberculosis
ERDPDT

SEQ ID NO: 1422051 - protein, 9 aa, Mycobacterium tuberculosis
ESAMAEPRY

SEQ ID NO: 1422052 - protein, 6 aa, Mycobacterium tuberculosis
ESIGRS

SEQ ID NO: 1422053 - protein, 9 aa, Mycobacterium tuberculosis
ESYAENASL

SEQ ID NO: 1422054 - protein, 4 aa, Mycobacterium tuberculosis
ETAC

SEQ ID NO: 1422055 - protein, 9 aa, Mycobacterium tuberculosis
EVARESRDA

SEQ ID NO: 1422056 - protein, 8 aa, Mycobacterium tuberculosis
FADPSRGR

SEQ ID NO: 1422057 - protein, 8 aa, Mycobacterium tuberculosis
FDGTQPTA

SEQ ID NO: 1422058 - protein, 9 aa, Mycobacterium tuberculosis
FEDEEHRRF

SEQ ID NO: 1422059 - protein, 20 aa, Mycobacterium tuberculosis
FNPGSSNTGTFNTGNANTGF

SEQ ID NO: 1422060 - protein, 7 aa, Mycobacterium tuberculosis
FPGQQGG

SEQ ID NO: 1422061 - protein, 9 aa, Mycobacterium tuberculosis
FPGQQGGPL

SEQ ID NO: 1422062 - protein, 9 aa, Mycobacterium tuberculosis
FSGTSPDGH

SEQ ID NO: 1422063 - protein, 10 aa, Mycobacterium tuberculosis
FSTGGKTPLA

SEQ ID NO: 1422064 - protein, 13 aa, Mycobacterium tuberculosis
FTGDSNGKAPTAV

SEQ ID NO: 1422065 - protein, 7 aa, Mycobacterium tuberculosis
GADDPMR

SEQ ID NO: 1422066 - protein, 16 aa, Mycobacterium tuberculosis
GADGAPGTGQAGGAGG

SEQ ID NO: 1422067 - protein, 8 aa, Mycobacterium tuberculosis
GADRAALE

SEQ ID NO: 1422068 - protein, 8 aa, Mycobacterium tuberculosis
GAENSGFT

SEQ ID NO: 1422069 - protein, 7 aa, Mycobacterium tuberculosis
GAEPATA

SEQ ID NO: 1422070 - protein, 7 aa, Mycobacterium tuberculosis
GAGAGPI

SEQ ID NO: 1422071 - protein, 4 aa, Mycobacterium tuberculosis
GAGN

SEQ ID NO: 1422072 - protein, 7 aa, Mycobacterium tuberculosis
GAGPCPG

SEQ ID NO: 1422073 - protein, 5 aa, Mycobacterium tuberculosis
GAGTI

SEQ ID NO: 1422074 - protein, 6 aa, Mycobacterium tuberculosis
GARSDT

SEQ ID NO: 1422075 - protein, 8 aa, Mycobacterium tuberculosis
GARTGPTA

SEQ ID NO: 1422076 - protein, 9 aa, Mycobacterium tuberculosis
GATAAAAAS

SEQ ID NO: 1422077 - protein, 14 aa, Mycobacterium tuberculosis
GATARTERPDPPGP

SEQ ID NO: 1422078 - protein, 13 aa, Mycobacterium tuberculosis
GATTSHRSTATVG

SEQ ID NO: 1422079 - protein, 14 aa, Mycobacterium tuberculosis
GAWSNDSVSCPRSG

SEQ ID NO: 1422080 - protein, 5 aa, Mycobacterium tuberculosis
GDDIP

SEQ ID NO: 1422081 - protein, 5 aa, Mycobacterium tuberculosis
GDRGF

SEQ ID NO: 1422082 - protein, 16 aa, Mycobacterium tuberculosis
GDYQTGIGGLNSGAGN

SEQ ID NO: 1422083 - protein, 12 aa, Mycobacterium tuberculosis
GEAAERLRRQLV

SEQ ID NO: 1422084 - protein, 4 aa, Mycobacterium tuberculosis
GEAE

SEQ ID NO: 1422085 - protein, 8 aa, Mycobacterium tuberculosis
GELDQGEV

SEQ ID NO: 1422086 - protein, 20 aa, Mycobacterium tuberculosis
GEQAADAELTDRSTVAAGTA

SEQ ID NO: 1422087 - protein, 8 aa, Mycobacterium tuberculosis
GGADPAVR

SEQ ID NO: 1422088 - protein, 10 aa, Mycobacterium tuberculosis
GGAVTSPGVR

SEQ ID NO: 1422089 - protein, 24 aa, Mycobacterium tuberculosis
GGDGGNAGNGAMPANGGNGGNAGV

SEQ ID NO: 1422090 - protein, 36 aa, Mycobacterium tuberculosis; identical to SEQ ID NO: 175642

SEQ ID NO: 1422091 - protein, 4 aa, Mycobacterium tuberculosis
GGGN

SEQ ID NO: 1422092 - protein, 12 aa, Mycobacterium tuberculosis
GGGQGNHLGGAY

SEQ ID NO: 1422093 - protein, 12 aa, Mycobacterium tuberculosis
GGITADSDPDAE

SEQ ID NO: 1422094 - protein, 4 aa, Mycobacterium tuberculosis
GGKI

SEQ ID NO: 1422095 - protein, 11 aa, Mycobacterium tuberculosis
GGPTPAPRGLA

SEQ ID NO: 1422096 - protein, 13 aa, Mycobacterium tuberculosis
GGTGQLESTVSDE

SEQ ID NO: 1422097 - protein, 10 aa, Mycobacterium tuberculosis
GGTPRQVENA

SEQ ID NO: 1422098 - protein, 7 aa, Mycobacterium tuberculosis
GGYRSAN

SEQ ID NO: 1422099 - protein, 4 aa, Mycobacterium tuberculosis
GHGQ

SEQ ID NO: 1422100 - protein, 11 aa, Mycobacterium tuberculosis
GIQTPKPRCES

SEQ ID NO: 1422101 - protein, 11 aa, Mycobacterium tuberculosis
GKEGVEPQSEQ

SEQ ID NO: 1422102 - protein, 6 aa, Mycobacterium tuberculosis
GKIQLP

SEQ ID NO: 1422103 - protein, 8 aa, Mycobacterium tuberculosis
GLADPAGT

SEQ ID NO: 1422104 - protein, 13 aa, Mycobacterium tuberculosis
GLAGEAAARPGDD

SEQ ID NO: 1422105 - protein, 7 aa, Mycobacterium tuberculosis
GLAGTGL

SEQ ID NO: 1422106 - protein, 9 aa, Mycobacterium tuberculosis
GLDGGADDY

SEQ ID NO: 1422107 - protein, 19 aa, Mycobacterium tuberculosis
GLNSGSGNIGFGNSGTGNV

SEQ ID NO: 1422108 - protein, 14 aa, Mycobacterium tuberculosis
GLPDPAKQAGRYPH

SEQ ID NO: 1422109 - protein, 6 aa, Mycobacterium tuberculosis
GLPGVD

SEQ ID NO: 1422110 - protein, 11 aa, Mycobacterium tuberculosis
GLPPIAPHSGL

SEQ ID NO: 1422111 - protein, 8 aa, Mycobacterium tuberculosis
GLQPGGPV

SEQ ID NO: 1422112 - protein, 14 aa, Mycobacterium tuberculosis
GNGGNGGNGGAGSL

SEQ ID NO: 1422113 - protein, 5 aa, Mycobacterium tuberculosis
GNNQI

SEQ ID NO: 1422114 - protein, 10 aa, Mycobacterium tuberculosis
GNVGAGSSGW

SEQ ID NO: 1422115 - protein, 17 aa, Mycobacterium tuberculosis
GNYNTGVGNAGTASTGL

SEQ ID NO: 1422116 - protein, 7 aa, Mycobacterium tuberculosis
GPAPLGG

SEQ ID NO: 1422117 - protein, 6 aa, Mycobacterium tuberculosis
GPAVAA

SEQ ID NO: 1422118 - protein, 6 aa, Mycobacterium tuberculosis
GPDFPT

SEQ ID NO: 1422119 - protein, 19 aa, Mycobacterium tuberculosis
GPDGTRCQGDWPARQPSTP

SEQ ID NO: 1422120 - protein, 9 aa, Mycobacterium tuberculosis
GPLEPTNDA

SEQ ID NO: 1422121 - protein, 4 aa, Mycobacterium tuberculosis
GPQR

SEQ ID NO: 1422122 - protein, 5 aa, Mycobacterium tuberculosis
GPTTT

SEQ ID NO: 1422123 - protein, 12 aa, Mycobacterium tuberculosis
GPVAGQDPTPFV

SEQ ID NO: 1422124 - protein, 14 aa, Mycobacterium tuberculosis
GQGSQLAQRECPRP

SEQ ID NO: 1422125 - protein, 9 aa, Mycobacterium tuberculosis
GQSEGEPIG

SEQ ID NO: 1422126 - protein, 7 aa, Mycobacterium tuberculosis
GQTDTAA

SEQ ID NO: 1422127 - protein, 4 aa, Mycobacterium tuberculosis
GRFG

SEQ ID NO: 1422128 - protein, 5 aa, Mycobacterium tuberculosis
GRMGN

SEQ ID NO: 1422129 - protein, 5 aa, Mycobacterium tuberculosis
GSAVE

SEQ ID NO: 1422130 - protein, 4 aa, Mycobacterium tuberculosis
GSIG

SEQ ID NO: 1422131 - protein, 10 aa, Mycobacterium tuberculosis
GSLPRTSSGK

SEQ ID NO: 1422132 - protein, 7 aa, Mycobacterium tuberculosis
GSNNVGV

SEQ ID NO: 1422133 - protein, 6 aa, Mycobacterium tuberculosis
GSPGRR

SEQ ID NO: 1422134 - protein, 5 aa, Mycobacterium tuberculosis
GSQGT

SEQ ID NO: 1422135 - protein, 19 aa, Mycobacterium tuberculosis
GSRIAAETAPVHGEERRAE

SEQ ID NO: 1422136 - protein, 17 aa, Mycobacterium tuberculosis
GSTIAGANAAAAANTTS

SEQ ID NO: 1422137 - protein, 16 aa, Mycobacterium tuberculosis
GSTISAANAAASIPTT

SEQ ID NO: 1422138 - protein, 5 aa, Mycobacterium tuberculosis
GSTSR

SEQ ID NO: 1422139 - protein, 16 aa, Mycobacterium tuberculosis
GSYNTGIGNSGVASTG

SEQ ID NO: 1422140 - protein, 4 aa, Mycobacterium tuberculosis
GTGK

SEQ ID NO: 1422141 - protein, 5 aa, Mycobacterium tuberculosis
GTGQI

SEQ ID NO: 1422142 - protein, 4 aa, Mycobacterium tuberculosis
GTHP

SEQ ID NO: 1422143 - protein, 6 aa, Mycobacterium tuberculosis
GTKFDA

SEQ ID NO: 1422144 - protein, 4 aa, Mycobacterium tuberculosis
GTNG

SEQ ID NO: 1422145 - protein, 7 aa, Mycobacterium tuberculosis
GTPIESG

SEQ ID NO: 1422146 - protein, 23 aa, Mycobacterium tuberculosis
GTSEAAARQLASRARKAVTAQPA

SEQ ID NO: 1422147 - protein, 10 aa, Mycobacterium tuberculosis
GVAAGDGVKA

SEQ ID NO: 1422148 - protein, 12 aa, Mycobacterium tuberculosis
GVEVADDGRGIP

SEQ ID NO: 1422149 - protein, 6 aa, Mycobacterium tuberculosis
GVSQRK

SEQ ID NO: 1422150 - protein, 11 aa, Mycobacterium tuberculosis
GYAGPDPVARS

SEQ ID NO: 1422151 - protein, 4 aa, Mycobacterium tuberculosis
GYRA

SEQ ID NO: 1422152 - protein, 5 aa, Mycobacterium tuberculosis
GYVGE

SEQ ID NO: 1422153 - protein, 6 aa, Mycobacterium tuberculosis
HAAAAG

SEQ ID NO: 1422154 - protein, 9 aa, Mycobacterium tuberculosis
HDERTRAKA

SEQ ID NO: 1422155 - protein, 16 aa, Mycobacterium tuberculosis
HEAAGAAVRAAEQRGV

SEQ ID NO: 1422156 - protein, 4 aa, Mycobacterium tuberculosis
HEKC

SEQ ID NO: 1422157 - protein, 11 aa, Mycobacterium tuberculosis
HERNRRQRKSC

SEQ ID NO: 1422158 - protein, 7 aa, Mycobacterium tuberculosis
HGPFPKA

SEQ ID NO: 1422159 - protein, 6 aa, Mycobacterium tuberculosis
HGPQAG

SEQ ID NO: 1422160 - protein, 8 aa, Mycobacterium tuberculosis
HIGDSRTC

SEQ ID NO: 1422161 - protein, 5 aa, Mycobacterium tuberculosis
HRELD

SEQ ID NO: 1422162 - protein, 13 aa, Mycobacterium tuberculosis
HRPGDLSGGQQQR

SEQ ID NO: 1422163 - protein, 6 aa, Mycobacterium tuberculosis
HTERTA

SEQ ID NO: 1422164 - protein, 17 aa, Mycobacterium tuberculosis
HWEPGSKALATRAASGA

SEQ ID NO: 1422165 - protein, 19 aa, Mycobacterium tuberculosis
IASPAQPGEAGRHASDPVT

SEQ ID NO: 1422166 - protein, 4 aa, Mycobacterium tuberculosis
IDAS

SEQ ID NO: 1422167 - protein, 5 aa, Mycobacterium tuberculosis
IDGDE

SEQ ID NO: 1422168 - protein, 7 aa, Mycobacterium tuberculosis
IEQTRAH

SEQ ID NO: 1422169 - protein, 16 aa, Mycobacterium tuberculosis
INGGSVEDAKKRPEFG

SEQ ID NO: 1422170 - protein, 5 aa, Mycobacterium tuberculosis
IPDSH

SEQ ID NO: 1422171 - protein, 17 aa, Mycobacterium tuberculosis
IPRKPNGKIDSDNLPRL

SEQ ID NO: 1422172 - protein, 8 aa, Mycobacterium tuberculosis
IRSRNSTD

SEQ ID NO: 1422173 - protein, 5 aa, Mycobacterium tuberculosis
IRTDE

SEQ ID NO: 1422174 - protein, 10 aa, Mycobacterium tuberculosis
ISGDPDPAHN

SEQ ID NO: 1422175 - protein, 6 aa, Mycobacterium tuberculosis
ISPQDT

SEQ ID NO: 1422176 - protein, 9 aa, Mycobacterium tuberculosis
KAGRTSAPN

SEQ ID NO: 1422177 - protein, 8 aa, Mycobacterium tuberculosis
KALGSQGG

SEQ ID NO: 1422178 - protein, 4 aa, Mycobacterium tuberculosis
KAMR

SEQ ID NO: 1422179 - protein, 11 aa, Mycobacterium tuberculosis
KAPSNAERGTK

SEQ ID NO: 1422180 - protein, 9 aa, Mycobacterium tuberculosis
KATVHTGDT

SEQ ID NO: 1422181 - protein, 5 aa, Mycobacterium tuberculosis
KCTPC

SEQ ID NO: 1422182 - protein, 9 aa, Mycobacterium tuberculosis
KDADRAQRR

SEQ ID NO: 1422183 - protein, 13 aa, Mycobacterium tuberculosis
KGLPGARARRRAL

SEQ ID NO: 1422184 - protein, 10 aa, Mycobacterium tuberculosis
KLSDDERDYA

SEQ ID NO: 1422185 - protein, 17 aa, Mycobacterium tuberculosis
KNGAQQDRVPGGTQQIA

SEQ ID NO: 1422186 - protein, 5 aa, Mycobacterium tuberculosis
KNPNW

SEQ ID NO: 1422187 - protein, 8 aa, Mycobacterium tuberculosis
KPRREWPA

SEQ ID NO: 1422188 - protein, 27 aa, Mycobacterium tuberculosis
KQSALAATRVGGYGKLPADTHPSGGCS

SEQ ID NO: 1422189 - protein, 5 aa, Mycobacterium tuberculosis
KRADR

SEQ ID NO: 1422190 - protein, 10 aa, Mycobacterium tuberculosis
KRATDTVAGI

SEQ ID NO: 1422191 - protein, 8 aa, Mycobacterium tuberculosis
KSGEGRYV

SEQ ID NO: 1422192 - protein, 11 aa, Mycobacterium tuberculosis
KSGQFRPQPVR

SEQ ID NO: 1422193 - protein, 4 aa, Mycobacterium tuberculosis
KSLR

SEQ ID NO: 1422194 - protein, 8 aa, Mycobacterium tuberculosis
KTRNVDEV

SEQ ID NO: 1422195 - protein, 5 aa, Mycobacterium tuberculosis
KYPDD

SEQ ID NO: 1422196 - protein, 10 aa, Mycobacterium tuberculosis
LADTATPTAA

SEQ ID NO: 1422197 - protein, 14 aa, Mycobacterium tuberculosis
LAKAATSDAYDNAL

SEQ ID NO: 1422198 - protein, 9 aa, Mycobacterium tuberculosis
LAPGTGLRD

SEQ ID NO: 1422199 - protein, 5 aa, Mycobacterium tuberculosis
LASAS

SEQ ID NO: 1422200 - protein, 7 aa, Mycobacterium tuberculosis
LATSATA

SEQ ID NO: 1422201 - protein, 16 aa, Mycobacterium tuberculosis
LDAPPSALRASAKEVA

SEQ ID NO: 1422202 - protein, 7 aa, Mycobacterium tuberculosis
LDDSRGR

SEQ ID NO: 1422203 - protein, 13 aa, Mycobacterium tuberculosis
LDEDGQPPITAKG

SEQ ID NO: 1422204 - protein, 10 aa, Mycobacterium tuberculosis
LDPVETPEEY

SEQ ID NO: 1422205 - protein, 25 aa, Mycobacterium tuberculosis
LEANPDNNSATSGFGNSGKQDSGGF

SEQ ID NO: 1422206 - protein, 9 aa, Mycobacterium tuberculosis
LEDQLDPDD

SEQ ID NO: 1422207 - protein, 6 aa, Mycobacterium tuberculosis
LESSIA

SEQ ID NO: 1422208 - protein, 9 aa, Mycobacterium tuberculosis
LGFGNAGSY

SEQ ID NO: 1422209 - protein, 6 aa, Mycobacterium tuberculosis
LGLPDD

SEQ ID NO: 1422210 - protein, 11 aa, Mycobacterium tuberculosis
LGRAPSTVSRE

SEQ ID NO: 1422211 - protein, 9 aa, Mycobacterium tuberculosis
LNDNNSRSK

SEQ ID NO: 1422212 - protein, 8 aa, Mycobacterium tuberculosis
LNSGSGNI

SEQ ID NO: 1422213 - protein, 6 aa, Mycobacterium tuberculosis
LPARDS

SEQ ID NO: 1422214 - protein, 13 aa, Mycobacterium tuberculosis
LPDGFPARAVRTR

SEQ ID NO: 1422215 - protein, 6 aa, Mycobacterium tuberculosis
LPEPAG

SEQ ID NO: 1422216 - protein, 19 aa, Mycobacterium tuberculosis
LPGAAIGPRRGGECNPAPS

SEQ ID NO: 1422217 - protein, 5 aa, Mycobacterium tuberculosis
LPPRD

SEQ ID NO: 1422218 - protein, 13 aa, Mycobacterium tuberculosis
LPSGGFTEPNPAI

SEQ ID NO: 1422219 - protein, 6 aa, Mycobacterium tuberculosis
LPTTVK

SEQ ID NO: 1422220 - protein, 6 aa, Mycobacterium tuberculosis
LQGNLD

SEQ ID NO: 1422221 - protein, 4 aa, Mycobacterium tuberculosis
LQSA

SEQ ID NO: 1422222 - protein, 10 aa, Mycobacterium tuberculosis
LRAGRSRNDQ

SEQ ID NO: 1422223 - protein, 12 aa, Mycobacterium tuberculosis
LREGEDEDLERA

SEQ ID NO: 1422224 - protein, 4 aa, Mycobacterium tuberculosis
LRPT

SEQ ID NO: 1422225 - protein, 10 aa, Mycobacterium tuberculosis
LTDATQAALD

SEQ ID NO: 1422226 - protein, 13 aa, Mycobacterium tuberculosis
MDSSTSLADAEAA

SEQ ID NO: 1422227 - protein, 7 aa, Mycobacterium tuberculosis
MEKTGAD

SEQ ID NO: 1422228 - protein, 4 aa, Mycobacterium tuberculosis
MGGA

SEQ ID NO: 1422229 - protein, 13 aa, Mycobacterium tuberculosis
MGSTARRGSPRRA

SEQ ID NO: 1422230 - protein, 4 aa, Mycobacterium tuberculosis
MPDR

SEQ ID NO: 1422231 - protein, 9 aa, Mycobacterium tuberculosis
MSDGPGDPL

SEQ ID NO: 1422232 - protein, 13 aa, Mycobacterium tuberculosis
MTAGQKKQVRAEI

SEQ ID NO: 1422233 - protein, 4 aa, Mycobacterium tuberculosis
MTGS

SEQ ID NO: 1422234 - protein, 19 aa, Mycobacterium tuberculosis
NALGGNRPAVYAPKSALGH

SEQ ID NO: 1422235 - protein, 17 aa, Mycobacterium tuberculosis
NARKAGTTVTHEDKGGR

SEQ ID NO: 1422236 - protein, 10 aa, Mycobacterium tuberculosis
NDAGDAASDA

SEQ ID NO: 1422237 - protein, 30 aa, Mycobacterium tuberculosis; identical to SEQ ID NO: 181117

SEQ ID NO: 1422238 - protein, 5 aa, Mycobacterium tuberculosis
NDHEN

SEQ ID NO: 1422239 - protein, 8 aa, Mycobacterium tuberculosis
NDTPDEAP

SEQ ID NO: 1422240 - protein, 4 aa, Mycobacterium tuberculosis
NGLH

SEQ ID NO: 1422241 - protein, 5 aa, Mycobacterium tuberculosis
NGNAL

SEQ ID NO: 1422242 - protein, 5 aa, Mycobacterium tuberculosis
NKPFG

SEQ ID NO: 1422243 - protein, 5 aa, Mycobacterium tuberculosis
NLGAQ

SEQ ID NO: 1422244 - protein, 8 aa, Mycobacterium tuberculosis
NLGEAAGT

SEQ ID NO: 1422245 - protein, 7 aa, Mycobacterium tuberculosis
NLGSPKQ

SEQ ID NO: 1422246 - protein, 7 aa, Mycobacterium tuberculosis
NPIASES

SEQ ID NO: 1422247 - protein, 9 aa, Mycobacterium tuberculosis
NQAGSQYFP

SEQ ID NO: 1422248 - protein, 9 aa, Mycobacterium tuberculosis
NQRYESGAL

SEQ ID NO: 1422249 - protein, 5 aa, Mycobacterium tuberculosis
NRTDR

SEQ ID NO: 1422250 - protein, 17 aa, Mycobacterium tuberculosis
NSGAGSASGFGNFGGAA

SEQ ID NO: 1422251 - protein, 7 aa, Mycobacterium tuberculosis
NSGPGSF

SEQ ID NO: 1422252 - protein, 19 aa, Mycobacterium tuberculosis
NSGSFNTGLGNTGSTNTGL

SEQ ID NO: 1422253 - protein, 8 aa, Mycobacterium tuberculosis
NSGSNNIG

SEQ ID NO: 1422254 - protein, 10 aa, Mycobacterium tuberculosis
NTGDTNTGIA

SEQ ID NO: 1422255 - protein, 18 aa, Mycobacterium tuberculosis
NTGGGGGSGFSNSGSGMS

SEQ ID NO: 1422256 - protein, 19 aa, Mycobacterium tuberculosis
NTGSYNTGLANSGDVNTGG

SEQ ID NO: 1422257 - protein, 6 aa, Mycobacterium tuberculosis
NTLVPG

SEQ ID NO: 1422258 - protein, 5 aa, Mycobacterium tuberculosis
NVGNT

SEQ ID NO: 1422259 - protein, 14 aa, Mycobacterium tuberculosis
NYATSSKFSDDERA

SEQ ID NO: 1422260 - protein, 6 aa, Mycobacterium tuberculosis
PAAPLP

SEQ ID NO: 1422261 - protein, 25 aa, Mycobacterium tuberculosis
PAGDPVESGDDLGCDTNPDTPTGRA

SEQ ID NO: 1422262 - protein, 8 aa, Mycobacterium tuberculosis
PAHTPLDG

SEQ ID NO: 1422263 - protein, 10 aa, Mycobacterium tuberculosis
PALTGPHARL

SEQ ID NO: 1422264 - protein, 8 aa, Mycobacterium tuberculosis
PATAQGIA

SEQ ID NO: 1422265 - protein, 6 aa, Mycobacterium tuberculosis
PDAPKL

SEQ ID NO: 1422266 - protein, 21 aa, Mycobacterium tuberculosis
PDGLPEALNDDTRPRKLRPGD

SEQ ID NO: 1422267 - protein, 7 aa, Mycobacterium tuberculosis
PDRESEL

SEQ ID NO: 1422268 - protein, 4 aa, Mycobacterium tuberculosis
PDSS

SEQ ID NO: 1422269 - protein, 23 aa, Mycobacterium tuberculosis
PDWGPPPGEDPVTSTVASDRGAG

SEQ ID NO: 1422270 - protein, 9 aa, Mycobacterium tuberculosis
PEAAGGVGG

SEQ ID NO: 1422271 - protein, 8 aa, Mycobacterium tuberculosis
PEHPYPAG

SEQ ID NO: 1422272 - protein, 6 aa, Mycobacterium tuberculosis
PESGRA

SEQ ID NO: 1422273 - protein, 5 aa, Mycobacterium tuberculosis
PGART

SEQ ID NO: 1422274 - protein, 4 aa, Mycobacterium tuberculosis
PGGH

SEQ ID NO: 1422275 - protein, 5 aa, Mycobacterium tuberculosis
PGHGH

SEQ ID NO: 1422276 - protein, 5 aa, Mycobacterium tuberculosis
PGLPS

SEQ ID NO: 1422277 - protein, 4 aa, Mycobacterium tuberculosis
PGLR

SEQ ID NO: 1422278 - protein, 11 aa, Mycobacterium tuberculosis
PGQAPPLGAEG

SEQ ID NO: 1422279 - protein, 10 aa, Mycobacterium tuberculosis
PGQTAELYPG

SEQ ID NO: 1422280 - protein, 6 aa, Mycobacterium tuberculosis
PGSAPM

SEQ ID NO: 1422281 - protein, 7 aa, Mycobacterium tuberculosis
PHGNGET

SEQ ID NO: 1422282 - protein, 11 aa, Mycobacterium tuberculosis
PHHLPTSPGPR

SEQ ID NO: 1422283 - protein, 4 aa, Mycobacterium tuberculosis
PHTP

SEQ ID NO: 1422284 - protein, 6 aa, Mycobacterium tuberculosis
PKAINS

SEQ ID NO: 1422285 - protein, 6 aa, Mycobacterium tuberculosis
PLDPQA

SEQ ID NO: 1422286 - protein, 5 aa, Mycobacterium tuberculosis
PLGRD

SEQ ID NO: 1422287 - protein, 8 aa, Mycobacterium tuberculosis
PLNPPAAA

SEQ ID NO: 1422288 - protein, 12 aa, Mycobacterium tuberculosis
PLSVTTQLRTTW

SEQ ID NO: 1422289 - protein, 4 aa, Mycobacterium tuberculosis
PNGR

SEQ ID NO: 1422290 - protein, 6 aa, Mycobacterium tuberculosis
PPEAQD

SEQ ID NO: 1422291 - protein, 4 aa, Mycobacterium tuberculosis
PPGR

SEQ ID NO: 1422292 - protein, 5 aa, Mycobacterium tuberculosis
PPLGA

SEQ ID NO: 1422293 - protein, 6 aa, Mycobacterium tuberculosis
PPLPTT

SEQ ID NO: 1422294 - protein, 4 aa, Mycobacterium tuberculosis
PPQS

SEQ ID NO: 1422295 - protein, 8 aa, Mycobacterium tuberculosis
PPRGLTAT

SEQ ID NO: 1422296 - protein, 16 aa, Mycobacterium tuberculosis
PPTPGIGNSTITPSSG

SEQ ID NO: 1422297 - protein, 5 aa, Mycobacterium tuberculosis
PQAQN

SEQ ID NO: 1422298 - protein, 4 aa, Mycobacterium tuberculosis
PQHA

SEQ ID NO: 1422299 - protein, 6 aa, Mycobacterium tuberculosis
PQQRTL

SEQ ID NO: 1422300 - protein, 5 aa, Mycobacterium tuberculosis
PRKAR

SEQ ID NO: 1422301 - protein, 8 aa, Mycobacterium tuberculosis
PRNTTRDE

SEQ ID NO: 1422302 - protein, 14 aa, Mycobacterium tuberculosis
PRRGDTPGLSSTAA

SEQ ID NO: 1422303 - protein, 5 aa, Mycobacterium tuberculosis
PSDAP

SEQ ID NO: 1422304 - protein, 11 aa, Mycobacterium tuberculosis
PSGLSPDDGLP

SEQ ID NO: 1422305 - protein, 5 aa, Mycobacterium tuberculosis
PSHDL

SEQ ID NO: 1422306 - protein, 4 aa, Mycobacterium tuberculosis
PTDP

SEQ ID NO: 1422307 - protein, 6 aa, Mycobacterium tuberculosis
PVAGSR

SEQ ID NO: 1422308 - protein, 10 aa, Mycobacterium tuberculosis
PVGDSSDCGT

SEQ ID NO: 1422309 - protein, 19 aa, Mycobacterium tuberculosis
PVSVSSPQGRFADSASALN

SEQ ID NO: 1422310 - protein, 24 aa, Mycobacterium tuberculosis
PWQNTGSEGAAPAGVPGPEAGAQL

SEQ ID NO: 1422311 - protein, 7 aa, Mycobacterium tuberculosis
QASSTYA

SEQ ID NO: 1422312 - protein, 7 aa, Mycobacterium tuberculosis
QDDSRVT

SEQ ID NO: 1422313 - protein, 16 aa, Mycobacterium tuberculosis
QDPDRWTTTPDDEAKT

SEQ ID NO: 1422314 - protein, 8 aa, Mycobacterium tuberculosis
QDTSATCP

SEQ ID NO: 1422315 - protein, 10 aa, Mycobacterium tuberculosis
QEDHAELGDY

SEQ ID NO: 1422316 - protein, 6 aa, Mycobacterium tuberculosis
QGGRTS

SEQ ID NO: 1422317 - protein, 31 aa, Mycobacterium tuberculosis
QGQGGDQKVTSHAADEKQAAPPMRRRGDRHR

SEQ ID NO: 1422318 - protein, 6 aa, Mycobacterium tuberculosis
QHRHRR

SEQ ID NO: 1422319 - protein, 12 aa, Mycobacterium tuberculosis
QIPSQTDPWSPH

SEQ ID NO: 1422320 - protein, 5 aa, Mycobacterium tuberculosis
QLKSK

SEQ ID NO: 1422321 - protein, 4 aa, Mycobacterium tuberculosis
QPGV

SEQ ID NO: 1422322 - protein, 4 aa, Mycobacterium tuberculosis
QPLP

SEQ ID NO: 1422323 - protein, 9 aa, Mycobacterium tuberculosis
QRPDYSETD

SEQ ID NO: 1422324 - protein, 5 aa, Mycobacterium tuberculosis
QTQAA

SEQ ID NO: 1422325 - protein, 8 aa, Mycobacterium tuberculosis
RADETVRR

SEQ ID NO: 1422326 - protein, 4 aa, Mycobacterium tuberculosis
RAEV

SEQ ID NO: 1422327 - protein, 19 aa, Mycobacterium tuberculosis
RAGADAPDSGRVKESAPWS

SEQ ID NO: 1422328 - protein, 7 aa, Mycobacterium tuberculosis
RARPTPW

SEQ ID NO: 1422329 - protein, 25 aa, Mycobacterium tuberculosis
RCPATEDRAPATVATPSSTDPTASR

SEQ ID NO: 1422330 - protein, 5 aa, Mycobacterium tuberculosis
RDEKH

SEQ ID NO: 1422331 - protein, 8 aa, Mycobacterium tuberculosis
RDLPTAVS

SEQ ID NO: 1422332 - protein, 6 aa, Mycobacterium tuberculosis
RDRARR

SEQ ID NO: 1422333 - protein, 6 aa, Mycobacterium tuberculosis
REERPD

SEQ ID NO: 1422334 - protein, 4 aa, Mycobacterium tuberculosis
REEV

SEQ ID NO: 1422335 - protein, 6 aa, Mycobacterium tuberculosis
REGREG

SEQ ID NO: 1422336 - protein, 8 aa, Mycobacterium tuberculosis
RERQAQIT

SEQ ID NO: 1422337 - protein, 11 aa, Mycobacterium tuberculosis
RGGDDDSEMSD

SEQ ID NO: 1422338 - protein, 4 aa, Mycobacterium tuberculosis
RGYA

SEQ ID NO: 1422339 - protein, 14 aa, Mycobacterium tuberculosis
RHRREVENALAVLR

SEQ ID NO: 1422340 - protein, 6 aa, Mycobacterium tuberculosis
RKGYVS

SEQ ID NO: 1422341 - protein, 5 aa, Mycobacterium tuberculosis
RLAPG

SEQ ID NO: 1422342 - protein, 7 aa, Mycobacterium tuberculosis
RLEDKGV

SEQ ID NO: 1422343 - protein, 6 aa, Mycobacterium tuberculosis
RLPRTP

SEQ ID NO: 1422344 - protein, 7 aa, Mycobacterium tuberculosis
RLRESKE

SEQ ID NO: 1422345 - protein, 5 aa, Mycobacterium tuberculosis
RPDGG

SEQ ID NO: 1422346 - protein, 13 aa, Mycobacterium tuberculosis
RPEGNANPEIATG

SEQ ID NO: 1422347 - protein, 8 aa, Mycobacterium tuberculosis
RPGVGKST

SEQ ID NO: 1422348 - protein, 5 aa, Mycobacterium tuberculosis
RPSTV

SEQ ID NO: 1422349 - protein, 10 aa, Mycobacterium tuberculosis
RPVSGPHGKA

SEQ ID NO: 1422350 - protein, 6 aa, Mycobacterium tuberculosis
RQQNGF

SEQ ID NO: 1422351 - protein, 5 aa, Mycobacterium tuberculosis
RRADD

SEQ ID NO: 1422352 - protein, 4 aa, Mycobacterium tuberculosis
RREH

SEQ ID NO: 1422353 - protein, 9 aa, Mycobacterium tuberculosis
RRGDPLDAR

SEQ ID NO: 1422354 - protein, 10 aa, Mycobacterium tuberculosis
RRNGYRDNGL

SEQ ID NO: 1422355 - protein, 22 aa, Mycobacterium tuberculosis
RRRGRIGTKRSSISDTDYRRDS

SEQ ID NO: 1422356 - protein, 6 aa, Mycobacterium tuberculosis
RRSGAL

SEQ ID NO: 1422357 - protein, 9 aa, Mycobacterium tuberculosis
RRSHPEELE

SEQ ID NO: 1422358 - protein, 7 aa, Mycobacterium tuberculosis
RRSLDSA

SEQ ID NO: 1422359 - protein, 27 aa, Mycobacterium tuberculosis
RRVGGRRRGRSGSGRGRGAIDREQSAA

SEQ ID NO: 1422360 - protein, 10 aa, Mycobacterium tuberculosis
RSHDGQLATL

SEQ ID NO: 1422361 - protein, 5 aa, Mycobacterium tuberculosis
RSLPE

SEQ ID NO: 1422362 - protein, 7 aa, Mycobacterium tuberculosis
RTAPSRS

SEQ ID NO: 1422363 - protein, 9 aa, Mycobacterium tuberculosis
RTGGGAELA

SEQ ID NO: 1422364 - protein, 15 aa, Mycobacterium tuberculosis
RVDPAKDADGLHPTN

SEQ ID NO: 1422365 - protein, 6 aa, Mycobacterium tuberculosis
RVTADG

SEQ ID NO: 1422366 - protein, 4 aa, Mycobacterium tuberculosis
SAAW

SEQ ID NO: 1422367 - protein, 15 aa, Mycobacterium tuberculosis
SAETEAAAAGAAPAL

SEQ ID NO: 1422368 - protein, 7 aa, Mycobacterium tuberculosis
SAPLDSP

SEQ ID NO: 1422369 - protein, 5 aa, Mycobacterium tuberculosis
SARVG

SEQ ID NO: 1422370 - protein, 4 aa, Mycobacterium tuberculosis
SASE

SEQ ID NO: 1422371 - protein, 12 aa, Mycobacterium tuberculosis
SDDQPEGSNHQD

SEQ ID NO: 1422372 - protein, 12 aa, Mycobacterium tuberculosis
SDERGRAATEDA

SEQ ID NO: 1422373 - protein, 14 aa, Mycobacterium tuberculosis
SDLASQAWQGPAAA

SEQ ID NO: 1422374 - protein, 15 aa, Mycobacterium tuberculosis
SDYDDALGVDIDGGV

SEQ ID NO: 1422375 - protein, 11 aa, Mycobacterium tuberculosis
SEEKDEATMAE

SEQ ID NO: 1422376 - protein, 6 aa, Mycobacterium tuberculosis
SEMSDE

SEQ ID NO: 1422377 - protein, 12 aa, Mycobacterium tuberculosis
SEPEAGSDLASV

SEQ ID NO: 1422378 - protein, 5 aa, Mycobacterium tuberculosis
SEPPG

SEQ ID NO: 1422379 - protein, 18 aa, Mycobacterium tuberculosis
SEPQFEGQTKTKLGNTEV

SEQ ID NO: 1422380 - protein, 8 aa, Mycobacterium tuberculosis
SEQAARGL

SEQ ID NO: 1422381 - protein, 6 aa, Mycobacterium tuberculosis
SETFGD

SEQ ID NO: 1422382 - protein, 14 aa, Mycobacterium tuberculosis
SGAGGVSGFGNVGS

SEQ ID NO: 1422383 - protein, 4 aa, Mycobacterium tuberculosis
SGAL

SEQ ID NO: 1422384 - protein, 10 aa, Mycobacterium tuberculosis
SGATGNFTQT

SEQ ID NO: 1422385 - protein, 6 aa, Mycobacterium tuberculosis
SGDIAT

SEQ ID NO: 1422386 - protein, 18 aa, Mycobacterium tuberculosis
SGGAGGNGGTGGANSGSL

SEQ ID NO: 1422387 - protein, 7 aa, Mycobacterium tuberculosis
SGGGPRV

SEQ ID NO: 1422388 - protein, 8 aa, Mycobacterium tuberculosis
SGLGSSPA

SEQ ID NO: 1422389 - protein, 27 aa, Mycobacterium tuberculosis
SGSGNFGIGNAGTGNWGIGNSGAGNFG

SEQ ID NO: 1422390 - protein, 10 aa, Mycobacterium tuberculosis
SGVSAAGTTL

SEQ ID NO: 1422391 - protein, 4 aa, Mycobacterium tuberculosis
SGYE

SEQ ID NO: 1422392 - protein, 18 aa, Mycobacterium tuberculosis
SISGGAPLAGGDAQLPHG

SEQ ID NO: 1422393 - protein, 9 aa, Mycobacterium tuberculosis
SPEADTAGM

SEQ ID NO: 1422394 - protein, 6 aa, Mycobacterium tuberculosis
SPELTP

SEQ ID NO: 1422395 - protein, 6 aa, Mycobacterium tuberculosis
SPEQRR

SEQ ID NO: 1422396 - protein, 6 aa, Mycobacterium tuberculosis
SPEWTD

SEQ ID NO: 1422397 - protein, 14 aa, Mycobacterium tuberculosis
SPSRSRPHRAEARI

SEQ ID NO: 1422398 - protein, 5 aa, Mycobacterium tuberculosis
SQAAY

SEQ ID NO: 1422399 - protein, 6 aa, Mycobacterium tuberculosis
SQGAVS

SEQ ID NO: 1422400 - protein, 4 aa, Mycobacterium tuberculosis
SRAS

SEQ ID NO: 1422401 - protein, 8 aa, Mycobacterium tuberculosis
SRGDQSQG

SEQ ID NO: 1422402 - protein, 9 aa, Mycobacterium tuberculosis
SRGVGGRRR

SEQ ID NO: 1422403 - protein, 6 aa, Mycobacterium tuberculosis
SRLDPS

SEQ ID NO: 1422404 - protein, 7 aa, Mycobacterium tuberculosis
SRQLPDN

SEQ ID NO: 1422405 - protein, 5 aa, Mycobacterium tuberculosis
SRSPV

SEQ ID NO: 1422406 - protein, 16 aa, Mycobacterium tuberculosis
SSAESGGSPGRADRRQ

SEQ ID NO: 1422407 - protein, 17 aa, Mycobacterium tuberculosis
SSDPAAGSGVEPSTPGL

SEQ ID NO: 1422408 - protein, 5 aa, Mycobacterium tuberculosis
SSIPY

SEQ ID NO: 1422409 - protein, 19 aa, Mycobacterium tuberculosis
SSPGKLPTAQGYYCTSIRC

SEQ ID NO: 1422410 - protein, 75 aa, Mycobacterium tuberculosis; identical to SEQ ID NO: 195045

SEQ ID NO: 1422411 - protein, 35 aa, Mycobacterium tuberculosis; identical to SEQ ID NO: 193325

SEQ ID NO: 1422412 - protein, 6 aa, Mycobacterium tuberculosis
STQDPS

SEQ ID NO: 1422413 - protein, 4 aa, Mycobacterium tuberculosis
SVAS

SEQ ID NO: 1422414 - protein, 7 aa, Mycobacterium tuberculosis
SVTGEDV

SEQ ID NO: 1422415 - protein, 10 aa, Mycobacterium tuberculosis
TADPAAPDLA

SEQ ID NO: 1422416 - protein, 11 aa, Mycobacterium tuberculosis
TADPHSVTDEQ

SEQ ID NO: 1422417 - protein, 9 aa, Mycobacterium tuberculosis
TAGPGGFEG

SEQ ID NO: 1422418 - protein, 7 aa, Mycobacterium tuberculosis
TALPGAN

SEQ ID NO: 1422419 - protein, 6 aa, Mycobacterium tuberculosis
TAPIDS

SEQ ID NO: 1422420 - protein, 7 aa, Mycobacterium tuberculosis
TDIRDAQ

SEQ ID NO: 1422421 - protein, 9 aa, Mycobacterium tuberculosis
TDMTTGSRR

SEQ ID NO: 1422422 - protein, 7 aa, Mycobacterium tuberculosis
TDPGGEI

SEQ ID NO: 1422423 - protein, 4 aa, Mycobacterium tuberculosis
TEAA

SEQ ID NO: 1422424 - protein, 12 aa, Mycobacterium tuberculosis
TEAARRQLEETH

SEQ ID NO: 1422425 - protein, 4 aa, Mycobacterium tuberculosis
TEPI

SEQ ID NO: 1422426 - protein, 5 aa, Mycobacterium tuberculosis
TGADM

SEQ ID NO: 1422427 - protein, 17 aa, Mycobacterium tuberculosis
TGDNQSGIGGLNSGTGN

SEQ ID NO: 1422428 - protein, 27 aa, Mycobacterium tuberculosis
TGQGGNGGNAAFGKAGTGSVGVGGAGG

SEQ ID NO: 1422429 - protein, 7 aa, Mycobacterium tuberculosis
TGSSRIY

SEQ ID NO: 1422430 - protein, 5 aa, Mycobacterium tuberculosis
THPID

SEQ ID NO: 1422431 - protein, 4 aa, Mycobacterium tuberculosis
TLNQ

SEQ ID NO: 1422432 - protein, 15 aa, Mycobacterium tuberculosis
TLQTGQSLTSITPKH

SEQ ID NO: 1422433 - protein, 17 aa, Mycobacterium tuberculosis
TLQTREATYYSRSRAEQ

SEQ ID NO: 1422434 - protein, 12 aa, Mycobacterium tuberculosis
TMEPKSAATEAY

SEQ ID NO: 1422435 - protein, 5 aa, Mycobacterium tuberculosis
TNRTT

SEQ ID NO: 1422436 - protein, 7 aa, Mycobacterium tuberculosis
TPEARAT

SEQ ID NO: 1422437 - protein, 16 aa, Mycobacterium tuberculosis
TPGADGPADAAGLGLG

SEQ ID NO: 1422438 - protein, 12 aa, Mycobacterium tuberculosis
TPGFGNSTGGLS

SEQ ID NO: 1422439 - protein, 4 aa, Mycobacterium tuberculosis
TPPF

SEQ ID NO: 1422440 - protein, 14 aa, Mycobacterium tuberculosis
TPTRRFRDRRDAGR

SEQ ID NO: 1422441 - protein, 4 aa, Mycobacterium tuberculosis
TQAD

SEQ ID NO: 1422442 - protein, 6 aa, Mycobacterium tuberculosis
TQRAHT

SEQ ID NO: 1422443 - protein, 13 aa, Mycobacterium tuberculosis
TRPPIGGEMAGRS

SEQ ID NO: 1422444 - protein, 18 aa, Mycobacterium tuberculosis
TSARSARSLATTHPEAGH

SEQ ID NO: 1422445 - protein, 9 aa, Mycobacterium tuberculosis
TSDATRLAG

SEQ ID NO: 1422446 - protein, 5 aa, Mycobacterium tuberculosis
TSEAA

SEQ ID NO: 1422447 - protein, 20 aa, Mycobacterium tuberculosis
TSHPSTRKSRVGPGASEAPL

SEQ ID NO: 1422448 - protein, 9 aa, Mycobacterium tuberculosis
TSSSPGTLG

SEQ ID NO: 1422449 - protein, 16 aa, Mycobacterium tuberculosis
TSTAGAYASAEAANVE

SEQ ID NO: 1422450 - protein, 5 aa, Mycobacterium tuberculosis
TSTSG

SEQ ID NO: 1422451 - protein, 10 aa, Mycobacterium tuberculosis
TTARKKPPFG

SEQ ID NO: 1422452 - protein, 7 aa, Mycobacterium tuberculosis
TTATRDI

SEQ ID NO: 1422453 - protein, 27 aa, Mycobacterium tuberculosis
TTPERDRARRDRDHHPWSRSRSQLSPR

SEQ ID NO: 1422454 - protein, 9 aa, Mycobacterium tuberculosis
TTRGSQLTP

SEQ ID NO: 1422455 - protein, 4 aa, Mycobacterium tuberculosis
TVDG

SEQ ID NO: 1422456 - protein, 13 aa, Mycobacterium tuberculosis
TVGGAAPGGGAAA

SEQ ID NO: 1422457 - protein, 5 aa, Mycobacterium tuberculosis
TVPEH

SEQ ID NO: 1422458 - protein, 5 aa, Mycobacterium tuberculosis
TVPQA

SEQ ID NO: 1422459 - protein, 12 aa, Mycobacterium tuberculosis
TVQDSSPVAGQL

SEQ ID NO: 1422460 - protein, 4 aa, Mycobacterium tuberculosis
TVTD

SEQ ID NO: 1422461 - protein, 4 aa, Mycobacterium tuberculosis
VAHG

SEQ ID NO: 1422462 - protein, 8 aa, Mycobacterium tuberculosis
VAQNGDLE

SEQ ID NO: 1422463 - protein, 9 aa, Mycobacterium tuberculosis
VDDAPPPRL

SEQ ID NO: 1422464 - protein, 11 aa, Mycobacterium tuberculosis
VDPSGWAAYGR

SEQ ID NO: 1422465 - protein, 7 aa, Mycobacterium tuberculosis
VDTDGSE

SEQ ID NO: 1422466 - protein, 12 aa, Mycobacterium tuberculosis
VETENEETPAGS

SEQ ID NO: 1422467 - protein, 17 aa, Mycobacterium tuberculosis
VGGTRRRSVAPASGAVP

SEQ ID NO: 1422468 - protein, 6 aa, Mycobacterium tuberculosis
VGPGLT

SEQ ID NO: 1422469 - protein, 17 aa, Mycobacterium tuberculosis
VGSGNVGHGNIGDSNVG

SEQ ID NO: 1422470 - protein, 15 aa, Mycobacterium tuberculosis
VGVGNSGLTAGVPGL

SEQ ID NO: 1422471 - protein, 37 aa, Mycobacterium tuberculosis
VKRGADRKTGPGPAGGREARKATGHPAGEQPRDGVQV

SEQ ID NO: 1422472 - protein, 7 aa, Mycobacterium tuberculosis
VPGAPKY

SEQ ID NO: 1422473 - protein, 7 aa, Mycobacterium tuberculosis
VPPGPGQ

SEQ ID NO: 1422474 - protein, 6 aa, Mycobacterium tuberculosis
VQEAGA

SEQ ID NO: 1422475 - protein, 7 aa, Mycobacterium tuberculosis
VQPTSDS

SEQ ID NO: 1422476 - protein, 5 aa, Mycobacterium tuberculosis
VRNPG

SEQ ID NO: 1422477 - protein, 9 aa, Mycobacterium tuberculosis
VRPGSAEEV

SEQ ID NO: 1422478 - protein, 11 aa, Mycobacterium tuberculosis
VRWDPTNGQGR

SEQ ID NO: 1422479 - protein, 8 aa, Mycobacterium tuberculosis
VSAAGTAL

SEQ ID NO: 1422480 - protein, 12 aa, Mycobacterium tuberculosis
VSQGKAASYRAA

SEQ ID NO: 1422481 - protein, 10 aa, Mycobacterium tuberculosis
VTAGSTALTS

SEQ ID NO: 1422482 - protein, 4 aa, Mycobacterium tuberculosis
VTAT

SEQ ID NO: 1422483 - protein, 6 aa, Mycobacterium tuberculosis
VTGLKT

SEQ ID NO: 1422484 - protein, 4 aa, Mycobacterium tuberculosis
VTNG

SEQ ID NO: 1422485 - protein, 8 aa, Mycobacterium tuberculosis
VTSEGAEA

SEQ ID NO: 1422486 - protein, 6 aa, Mycobacterium tuberculosis
VTTDPD

SEQ ID NO: 1422487 - protein, 15 aa, Mycobacterium tuberculosis
VTVTSEPAAGGRADE

SEQ ID NO: 1422488 - protein, 10 aa, Mycobacterium tuberculosis
VVTSSPIKGT

SEQ ID NO: 1422489 - protein, 8 aa, Mycobacterium tuberculosis
WGEQRTRR

SEQ ID NO: 1422490 - protein, 17 aa, Mycobacterium tuberculosis
WKDGDQDSGAGRRGAQR

SEQ ID NO: 1422491 - protein, 17 aa, Mycobacterium tuberculosis
WNSGSGNSGLFNSGTNN

SEQ ID NO: 1422492 - protein, 18 aa, Mycobacterium tuberculosis
WSTGSSIMPQKKNPDIAE

SEQ ID NO: 1422493 - protein, 9 aa, Mycobacterium tuberculosis
WVPSPQTRD

SEQ ID NO: 1422494 - protein, 8 aa, Mycobacterium tuberculosis
YAAPKTGG

SEQ ID NO: 1422495 - protein, 6 aa, Mycobacterium tuberculosis
YAATTG

SEQ ID NO: 1422496 - protein, 6 aa, Mycobacterium tuberculosis
YAPGHE

SEQ ID NO: 1422497 - protein, 7 aa, Mycobacterium tuberculosis
YATAPGD

SEQ ID NO: 1422498 - protein, 8 aa, Mycobacterium tuberculosis
YGPERNIG

SEQ ID NO: 1422499 - protein, 7 aa, Mycobacterium tuberculosis
YQTLSTQ

SEQ ID NO: 1422500 - protein, 11 aa, Mycobacterium tuberculosis
YRPDPVEPTQA

SEQ ID NO: 1422501 - protein, 10 aa, Mycobacterium tuberculosis
YTGAAQAAGA

SEQ ID NO: 1422502 - protein, 8 aa, Mycobacterium tuberculosis
AAAAKPKQ

SEQ ID NO: 1422503 - protein, 6 aa, Mycobacterium tuberculosis
AAAATG

SEQ ID NO: 1422504 - protein, 8 aa, Mycobacterium tuberculosis
AAAELGDT

SEQ ID NO: 1422505 - protein, 11 aa, Mycobacterium tuberculosis
AAAKSGANAIH

SEQ ID NO: 1422506 - protein, 10 aa, Mycobacterium tuberculosis
AAAQRAGHLG

SEQ ID NO: 1422507 - protein, 16 aa, Mycobacterium tuberculosis
AAARGLTAAGAPAEAD

SEQ ID NO: 1422508 - protein, 7 aa, Mycobacterium tuberculosis
AAEGATA

SEQ ID NO: 1422509 - protein, 8 aa, Mycobacterium tuberculosis
AAESDRVT

SEQ ID NO: 1422510 - protein, 19 aa, Mycobacterium tuberculosis
AAGGAYSSAEAANASAQAL

SEQ ID NO: 1422511 - protein, 10 aa, Mycobacterium tuberculosis
AAGGPEVDEG

SEQ ID NO: 1422512 - protein, 9 aa, Mycobacterium tuberculosis
AAGKRARDV

SEQ ID NO: 1422513 - protein, 8 aa, Mycobacterium tuberculosis
AAGPGASA

SEQ ID NO: 1422514 - protein, 6 aa, Mycobacterium tuberculosis
AAGSPL

SEQ ID NO: 1422515 - protein, 8 aa, Mycobacterium tuberculosis
AAGTGIRG

SEQ ID NO: 1422516 - protein, 5 aa, Mycobacterium tuberculosis
AAHRA

SEQ ID NO: 1422517 - protein, 36 aa, Mycobacterium tuberculosis
AAPGMANPADDTPCLAGTPSQAAIEADTRSAGQRHH

SEQ ID NO: 1422518 - protein, 8 aa, Mycobacterium tuberculosis
AAPKYAEA

SEQ ID NO: 1422519 - protein, 5 aa, Mycobacterium tuberculosis
AARLG

SEQ ID NO: 1422520 - protein, 7 aa, Mycobacterium tuberculosis
AARVSDQ

SEQ ID NO: 1422521 - protein, 9 aa, Mycobacterium tuberculosis
AASASTQLG

SEQ ID NO: 1422522 - protein, 8 aa, Mycobacterium tuberculosis
AATADAGL

SEQ ID NO: 1422523 - protein, 7 aa, Mycobacterium tuberculosis
AATEASY

SEQ ID NO: 1422524 - protein, 12 aa, Mycobacterium tuberculosis
AATGQSTDLDPE

SEQ ID NO: 1422525 - protein, 10 aa, Mycobacterium tuberculosis
AATSKDAIDK

SEQ ID NO: 1422526 - protein, 8 aa, Mycobacterium tuberculosis
AATTKTLP

SEQ ID NO: 1422527 - protein, 6 aa, Mycobacterium tuberculosis
AAVTGG

SEQ ID NO: 1422528 - protein, 4 aa, Mycobacterium tuberculosis
ACER

SEQ ID NO: 1422529 - protein, 10 aa, Mycobacterium tuberculosis
ADADVAGTQT

SEQ ID NO: 1422530 - protein, 15 aa, Mycobacterium tuberculosis
ADDANAVCVQALVAV

SEQ ID NO: 1422531 - protein, 6 aa, Mycobacterium tuberculosis
ADDNRA

SEQ ID NO: 1422532 - protein, 7 aa, Mycobacterium tuberculosis
ADDRPGA

SEQ ID NO: 1422533 - protein, 9 aa, Mycobacterium tuberculosis
ADGGAEDEL

SEQ ID NO: 1422534 - protein, 6 aa, Mycobacterium tuberculosis
ADIKGG

SEQ ID NO: 1422535 - protein, 13 aa, Mycobacterium tuberculosis
ADKVRGGYYTPPA

SEQ ID NO: 1422536 - protein, 11 aa, Mycobacterium tuberculosis
ADPAKKAFGAR

SEQ ID NO: 1422537 - protein, 14 aa, Mycobacterium tuberculosis
ADPATAERYGHAGR

SEQ ID NO: 1422538 - protein, 8 aa, Mycobacterium tuberculosis
ADRTDAPV

SEQ ID NO: 1422539 - protein, 14 aa, Mycobacterium tuberculosis
ADSAVRKKGNDFAT

SEQ ID NO: 1422540 - protein, 7 aa, Mycobacterium tuberculosis
AEATDHL

SEQ ID NO: 1422541 - protein, 6 aa, Mycobacterium tuberculosis
AEAVEN

SEQ ID NO: 1422542 - protein, 5 aa, Mycobacterium tuberculosis
AEDRR

SEQ ID NO: 1422543 - protein, 7 aa, Mycobacterium tuberculosis
AEEAGPV

SEQ ID NO: 1422544 - protein, 13 aa, Mycobacterium tuberculosis
AEEQNAADERAQH

SEQ ID NO: 1422545 - protein, 6 aa, Mycobacterium tuberculosis
AEGADT

SEQ ID NO: 1422546 - protein, 16 aa, Mycobacterium tuberculosis
AEIQRSDAEIPGKQRR

SEQ ID NO: 1422547 - protein, 6 aa, Mycobacterium tuberculosis
AELGLS

SEQ ID NO: 1422548 - protein, 5 aa, Mycobacterium tuberculosis
AEQGL

SEQ ID NO: 1422549 - protein, 6 aa, Mycobacterium tuberculosis
AEQRDS

SEQ ID NO: 1422550 - protein, 8 aa, Mycobacterium tuberculosis
AESARRTL

SEQ ID NO: 1422551 - protein, 11 aa, Mycobacterium tuberculosis
AESDVQPLGRP

SEQ ID NO: 1422552 - protein, 12 aa, Mycobacterium tuberculosis
AETKRRTAEQLG

SEQ ID NO: 1422553 - protein, 5 aa, Mycobacterium tuberculosis
AETPM

SEQ ID NO: 1422554 - protein, 4 aa, Mycobacterium tuberculosis
AEVQ

SEQ ID NO: 1422555 - protein, 6 aa, Mycobacterium tuberculosis
AGADSL

SEQ ID NO: 1422556 - protein, 19 aa, Mycobacterium tuberculosis
AGAGSYAAAEAASAASITS

SEQ ID NO: 1422557 - protein, 9 aa, Mycobacterium tuberculosis
AGASGYAGG

SEQ ID NO: 1422558 - protein, 9 aa, Mycobacterium tuberculosis
AGDSAGGNI

SEQ ID NO: 1422559 - protein, 13 aa, Mycobacterium tuberculosis
AGESDDTSKLSRE

SEQ ID NO: 1422560 - protein, 5 aa, Mycobacterium tuberculosis
AGETI

SEQ ID NO: 1422561 - protein, 6 aa, Mycobacterium tuberculosis
AGGVDA

SEQ ID NO: 1422562 - protein, 4 aa, Mycobacterium tuberculosis
AGIP

SEQ ID NO: 1422563 - protein, 5 aa, Mycobacterium tuberculosis
AGKPL

SEQ ID NO: 1422564 - protein, 6 aa, Mycobacterium tuberculosis
AGNGRY

SEQ ID NO: 1422565 - protein, 8 aa, Mycobacterium tuberculosis
AGPGRVSR

SEQ ID NO: 1422566 - protein, 8 aa, Mycobacterium tuberculosis
AGQAWQGP

SEQ ID NO: 1422567 - protein, 16 aa, Mycobacterium tuberculosis
AGRGFSPGADHKSAGV

SEQ ID NO: 1422568 - protein, 4 aa, Mycobacterium tuberculosis
AGRH

SEQ ID NO: 1422569 - protein, 9 aa, Mycobacterium tuberculosis
AGSEADEVA

SEQ ID NO: 1422570 - protein, 8 aa, Mycobacterium tuberculosis
AGTSAATG

SEQ ID NO: 1422571 - protein, 5 aa, Mycobacterium tuberculosis
AGVAK

SEQ ID NO: 1422572 - protein, 8 aa, Mycobacterium tuberculosis
AGVSKSEV

SEQ ID NO: 1422573 - protein, 4 aa, Mycobacterium tuberculosis
AGYA

SEQ ID NO: 1422574 - protein, 10 aa, Mycobacterium tuberculosis
AIGPGGPVSL

SEQ ID NO: 1422575 - protein, 10 aa, Mycobacterium tuberculosis
AISAGDQSIG

SEQ ID NO: 1422576 - protein, 4 aa, Mycobacterium tuberculosis
AKIG

SEQ ID NO: 1422577 - protein, 18 aa, Mycobacterium tuberculosis
AKQLAEKKAAKKGGGPLR

SEQ ID NO: 1422578 - protein, 13 aa, Mycobacterium tuberculosis
ALDDSKKLSEQAR

SEQ ID NO: 1422579 - protein, 8 aa, Mycobacterium tuberculosis
ALSDPAAE

SEQ ID NO: 1422580 - protein, 10 aa, Mycobacterium tuberculosis
ALSDRARNGR

SEQ ID NO: 1422581 - protein, 9 aa, Mycobacterium tuberculosis
ALSGKGPVS

SEQ ID NO: 1422582 - protein, 7 aa, Mycobacterium tuberculosis
ANHRQPR

SEQ ID NO: 1422583 - protein, 6 aa, Mycobacterium tuberculosis
ANRPRR

SEQ ID NO: 1422584 - protein, 9 aa, Mycobacterium tuberculosis
APAAALSGR

SEQ ID NO: 1422585 - protein, 17 aa, Mycobacterium tuberculosis
APAAAQAVETAAQNGVQ

SEQ ID NO: 1422586 - protein, 12 aa, Mycobacterium tuberculosis
APAETPAAQASA

SEQ ID NO: 1422587 - protein, 14 aa, Mycobacterium tuberculosis
APDVEAGQIDPLSP

SEQ ID NO: 1422588 - protein, 4 aa, Mycobacterium tuberculosis
APGS

SEQ ID NO: 1422589 - protein, 14 aa, Mycobacterium tuberculosis
APKAPLGYRPARST

SEQ ID NO: 1422590 - protein, 12 aa, Mycobacterium tuberculosis
APNLSAQAAHRP

SEQ ID NO: 1422591 - protein, 17 aa, Mycobacterium tuberculosis
APPPPPPPPPPPPPTPM

SEQ ID NO: 1422592 - protein, 6 aa, Mycobacterium tuberculosis
APRRVA

SEQ ID NO: 1422593 - protein, 10 aa, Mycobacterium tuberculosis
APTLAPRRAT

SEQ ID NO: 1422594 - protein, 4 aa, Mycobacterium tuberculosis
APVG

SEQ ID NO: 1422595 - protein, 4 aa, Mycobacterium tuberculosis
AQQI

SEQ ID NO: 1422596 - protein, 11 aa, Mycobacterium tuberculosis
AQRPTPAYGGA

SEQ ID NO: 1422597 - protein, 6 aa, Mycobacterium tuberculosis
ARPERI

SEQ ID NO: 1422598 - protein, 8 aa, Mycobacterium tuberculosis
ARTESRGC

SEQ ID NO: 1422599 - protein, 8 aa, Mycobacterium tuberculosis
ARTSDVPA

SEQ ID NO: 1422600 - protein, 6 aa, Mycobacterium tuberculosis
ARTSSG

SEQ ID NO: 1422601 - protein, 11 aa, Mycobacterium tuberculosis
ASDTNPAPQLQ

SEQ ID NO: 1422602 - protein, 28 aa, Mycobacterium tuberculosis
ASFPPAPASANLPKPNGQTPPPTSDDLS

SEQ ID NO: 1422603 - protein, 7 aa, Mycobacterium tuberculosis
ASGAASV

SEQ ID NO: 1422604 - protein, 8 aa, Mycobacterium tuberculosis
ASGGPFRG

SEQ ID NO: 1422605 - protein, 4 aa, Mycobacterium tuberculosis
ASGL

SEQ ID NO: 1422606 - protein, 25 aa, Mycobacterium tuberculosis
ASLPGRESTPSDDGGSLHPSGRPRR

SEQ ID NO: 1422607 - protein, 16 aa, Mycobacterium tuberculosis
ASPGGTGGAGGHGGAG

SEQ ID NO: 1422608 - protein, 16 aa, Mycobacterium tuberculosis
ASQSDAPVGAPRQFRS

SEQ ID NO: 1422609 - protein, 9 aa, Mycobacterium tuberculosis
ASRWEPSRV

SEQ ID NO: 1422610 - protein, 10 aa, Mycobacterium tuberculosis
ASSATSAHAG

SEQ ID NO: 1422611 - protein, 13 aa, Mycobacterium tuberculosis
ASSTVAVSGERQA

SEQ ID NO: 1422612 - protein, 5 aa, Mycobacterium tuberculosis
ATADT

SEQ ID NO: 1422613 - protein, 5 aa, Mycobacterium tuberculosis
ATAPA

SEQ ID NO: 1422614 - protein, 12 aa, Mycobacterium tuberculosis
ATCSGADKPRYG

SEQ ID NO: 1422615 - protein, 18 aa, Mycobacterium tuberculosis
ATGDFRRGSISENYRRCG

SEQ ID NO: 1422616 - protein, 21 aa, Mycobacterium tuberculosis
ATGRLTGADSGAGRLPEAEEI

SEQ ID NO: 1422617 - protein, 8 aa, Mycobacterium tuberculosis
ATTDFTEA

SEQ ID NO: 1422618 - protein, 6 aa, Mycobacterium tuberculosis
ATTEPR

SEQ ID NO: 1422619 - protein, 13 aa, Mycobacterium tuberculosis
AVKPGTPGIQPKG

SEQ ID NO: 1422620 - protein, 15 aa, Mycobacterium tuberculosis
AVSGNSGVDPDQAAR

SEQ ID NO: 1422621 - protein, 7 aa, Mycobacterium tuberculosis
AWNDDGS

SEQ ID NO: 1422622 - protein, 6 aa, Mycobacterium tuberculosis
CPSSAI

SEQ ID NO: 1422623 - protein, 8 aa, Mycobacterium tuberculosis
DAAAEPAA

SEQ ID NO: 1422624 - protein, 13 aa, Mycobacterium tuberculosis
DAAAPAQTIDDNT

SEQ ID NO: 1422625 - protein, 24 aa, Mycobacterium tuberculosis
DAAAQQALSPFEGPKDGSAPENPY

SEQ ID NO: 1422626 - protein, 11 aa, Mycobacterium tuberculosis
DADADGREGST

SEQ ID NO: 1422627 - protein, 5 aa, Mycobacterium tuberculosis
DADTE

SEQ ID NO: 1422628 - protein, 45 aa, Mycobacterium tuberculosis
DAKDAGEAAAPAPEKVPAAQPESKPAPEPPPVQPTSGAPAGGDAK

SEQ ID NO: 1422629 - protein, 7 aa, Mycobacterium tuberculosis
DAQGTVA

SEQ ID NO: 1422630 - protein, 12 aa, Mycobacterium tuberculosis
DAYTMRRDSGDP

SEQ ID NO: 1422631 - protein, 4 aa, Mycobacterium tuberculosis
DCDA

SEQ ID NO: 1422632 - protein, 17 aa, Mycobacterium tuberculosis
DCPQHGPVDPLPRRRAD

SEQ ID NO: 1422633 - protein, 10 aa, Mycobacterium tuberculosis
DDALKRKASS

SEQ ID NO: 1422634 - protein, 10 aa, Mycobacterium tuberculosis
DDDDTDAETI

SEQ ID NO: 1422635 - protein, 13 aa, Mycobacterium tuberculosis
DDDTASRINPDLA

SEQ ID NO: 1422636 - protein, 6 aa, Mycobacterium tuberculosis
DDEQRK

SEQ ID NO: 1422637 - protein, 4 aa, Mycobacterium tuberculosis
DDLA

SEQ ID NO: 1422638 - protein, 10 aa, Mycobacterium tuberculosis
DDNPLRGAPH

SEQ ID NO: 1422639 - protein, 4 aa, Mycobacterium tuberculosis
DEER

SEQ ID NO: 1422640 - protein, 9 aa, Mycobacterium tuberculosis
DEKKTAETF

SEQ ID NO: 1422641 - protein, 4 aa, Mycobacterium tuberculosis
DELR

SEQ ID NO: 1422642 - protein, 7 aa, Mycobacterium tuberculosis
DFNPDRY

SEQ ID NO: 1422643 - protein, 9 aa, Mycobacterium tuberculosis
DGAASGLRA

SEQ ID NO: 1422644 - protein, 11 aa, Mycobacterium tuberculosis
DGGGTAEAVAN

SEQ ID NO: 1422645 - protein, 6 aa, Mycobacterium tuberculosis
DGIAAG

SEQ ID NO: 1422646 - protein, 6 aa, Mycobacterium tuberculosis
DGIERY

SEQ ID NO: 1422647 - protein, 8 aa, Mycobacterium tuberculosis
DGSMDAGD

SEQ ID NO: 1422648 - protein, 5 aa, Mycobacterium tuberculosis
DGSRV

SEQ ID NO: 1422649 - protein, 6 aa, Mycobacterium tuberculosis
DHAEID

SEQ ID NO: 1422650 - protein, 7 aa, Mycobacterium tuberculosis
DHRRRTP

SEQ ID NO: 1422651 - protein, 7 aa, Mycobacterium tuberculosis
DIGAQRP

SEQ ID NO: 1422652 - protein, 7 aa, Mycobacterium tuberculosis
DKNAAAQ

SEQ ID NO: 1422653 - protein, 4 aa, Mycobacterium tuberculosis
DKSF

SEQ ID NO: 1422654 - protein, 79 aa, Mycobacterium tuberculosis
DLGPGRQPSPASVPAQPSATAAITPAAALPPPDPVPAVTSRPVTPSDFGSAPGDGSATPAGVGSAGGFGDAGGTGGLGG

SEQ ID NO: 1422655 - protein, 6 aa, Mycobacterium tuberculosis
DLTDAE

SEQ ID NO: 1422656 - protein, 13 aa, Mycobacterium tuberculosis
DNLAGSPEIVPND

SEQ ID NO: 1422657 - protein, 22 aa, Mycobacterium tuberculosis
DNNIPNSKEASMSKAKAGRMAS

SEQ ID NO: 1422658 - protein, 7 aa, Mycobacterium tuberculosis
DNRRHHR

SEQ ID NO: 1422659 - protein, 7 aa, Mycobacterium tuberculosis
DNVAGKR

SEQ ID NO: 1422660 - protein, 11 aa, Mycobacterium tuberculosis
DPAADTGKTTQ

SEQ ID NO: 1422661 - protein, 5 aa, Mycobacterium tuberculosis
DPAEL

SEQ ID NO: 1422662 - protein, 8 aa, Mycobacterium tuberculosis
DPDPDVRH

SEQ ID NO: 1422663 - protein, 4 aa, Mycobacterium tuberculosis
DPIE

SEQ ID NO: 1422664 - protein, 36 aa, Mycobacterium tuberculosis
DPIPEGLTTGRSCQTDVDGANDDWNPASKRGERESF

SEQ ID NO: 1422665 - protein, 5 aa, Mycobacterium tuberculosis
DPLTR

SEQ ID NO: 1422666 - protein, 8 aa, Mycobacterium tuberculosis
DPRVNPEA

SEQ ID NO: 1422667 - protein, 6 aa, Mycobacterium tuberculosis
DPTRFD

SEQ ID NO: 1422668 - protein, 7 aa, Mycobacterium tuberculosis
DQGSDAV

SEQ ID NO: 1422669 - protein, 5 aa, Mycobacterium tuberculosis
DRDQL

SEQ ID NO: 1422670 - protein, 10 aa, Mycobacterium tuberculosis
DRITKDGGLL

SEQ ID NO: 1422671 - protein, 5 aa, Mycobacterium tuberculosis
DRRRG

SEQ ID NO: 1422672 - protein, 11 aa, Mycobacterium tuberculosis
DRSKAEAGDTD

SEQ ID NO: 1422673 - protein, 4 aa, Mycobacterium tuberculosis
DSFG

SEQ ID NO: 1422674 - protein, 11 aa, Mycobacterium tuberculosis
DSLASSASLPA

SEQ ID NO: 1422675 - protein, 10 aa, Mycobacterium tuberculosis
DSPGGSVTAS

SEQ ID NO: 1422676 - protein, 13 aa, Mycobacterium tuberculosis
DSPYQRPKNPDLR

SEQ ID NO: 1422677 - protein, 5 aa, Mycobacterium tuberculosis
DSWDP

SEQ ID NO: 1422678 - protein, 4 aa, Mycobacterium tuberculosis
DTHV

SEQ ID NO: 1422679 - protein, 19 aa, Mycobacterium tuberculosis
DTRTVNSDTPYGQPSAPIT

SEQ ID NO: 1422680 - protein, 5 aa, Mycobacterium tuberculosis
DTVHP

SEQ ID NO: 1422681 - protein, 35 aa, Mycobacterium tuberculosis; identical to SEQ ID NO: 193934

SEQ ID NO: 1422682 - protein, 6 aa, Mycobacterium tuberculosis
DVPGLP

SEQ ID NO: 1422683 - protein, 4 aa, Mycobacterium tuberculosis
DVTP

SEQ ID NO: 1422684 - protein, 5 aa, Mycobacterium tuberculosis
DYPGQ

SEQ ID NO: 1422685 - protein, 15 aa, Mycobacterium tuberculosis
DYRTGIGGLNSGTGN

SEQ ID NO: 1422686 - protein, 29 aa, Mycobacterium tuberculosis
EAAEGAASAAAAGLADSVTPAGLGASLGE

SEQ ID NO: 1422687 - protein, 11 aa, Mycobacterium tuberculosis
EAAIASTRQNQ

SEQ ID NO: 1422688 - protein, 12 aa, Mycobacterium tuberculosis
EALGDSAIEARR

SEQ ID NO: 1422689 - protein, 5 aa, Mycobacterium tuberculosis
EANAQ

SEQ ID NO: 1422690 - protein, 6 aa, Mycobacterium tuberculosis
EARGHD

SEQ ID NO: 1422691 - protein, 8 aa, Mycobacterium tuberculosis
EDDTVEVG

SEQ ID NO: 1422692 - protein, 5 aa, Mycobacterium tuberculosis
EDEVS

SEQ ID NO: 1422693 - protein, 11 aa, Mycobacterium tuberculosis
EEAQRTHQALT

SEQ ID NO: 1422694 - protein, 12 aa, Mycobacterium tuberculosis
EEATAAGTARYV

SEQ ID NO: 1422695 - protein, 13 aa, Mycobacterium tuberculosis
EELAEEPEGAEEV

SEQ ID NO: 1422696 - protein, 9 aa, Mycobacterium tuberculosis
EENKRQRAA

SEQ ID NO: 1422697 - protein, 5 aa, Mycobacterium tuberculosis
EEQDI

SEQ ID NO: 1422698 - protein, 6 aa, Mycobacterium tuberculosis
EEQRRT

SEQ ID NO: 1422699 - protein, 19 aa, Mycobacterium tuberculosis
EFPAKNERPITTEELLRFA

SEQ ID NO: 1422700 - protein, 6 aa, Mycobacterium tuberculosis
EGAGPA

SEQ ID NO: 1422701 - protein, 9 aa, Mycobacterium tuberculosis
EIREEVDNN

SEQ ID NO: 1422702 - protein, 10 aa, Mycobacterium tuberculosis
EKDNTVGTDE

SEQ ID NO: 1422703 - protein, 7 aa, Mycobacterium tuberculosis
EKTRRGL

SEQ ID NO: 1422704 - protein, 10 aa, Mycobacterium tuberculosis
ELASSQRRSL

SEQ ID NO: 1422705 - protein, 11 aa, Mycobacterium tuberculosis
ELDSSTADFNG

SEQ ID NO: 1422706 - protein, 5 aa, Mycobacterium tuberculosis
ELEGE

SEQ ID NO: 1422707 - protein, 7 aa, Mycobacterium tuberculosis
ELGTLDE

SEQ ID NO: 1422708 - protein, 4 aa, Mycobacterium tuberculosis
EPAT

SEQ ID NO: 1422709 - protein, 7 aa, Mycobacterium tuberculosis
EPVAPSR

SEQ ID NO: 1422710 - protein, 5 aa, Mycobacterium tuberculosis
EPWRG

SEQ ID NO: 1422711 - protein, 6 aa, Mycobacterium tuberculosis
EQEAMT

SEQ ID NO: 1422712 - protein, 17 aa, Mycobacterium tuberculosis
EQLGAGHATRVAPDAPN

SEQ ID NO: 1422713 - protein, 7 aa, Mycobacterium tuberculosis
ERADYPG

SEQ ID NO: 1422714 - protein, 8 aa, Mycobacterium tuberculosis
ERAFGAGP

SEQ ID NO: 1422715 - protein, 12 aa, Mycobacterium tuberculosis
ERDGRTDPFGQE

SEQ ID NO: 1422716 - protein, 4 aa, Mycobacterium tuberculosis
ERLG

SEQ ID NO: 1422717 - protein, 5 aa, Mycobacterium tuberculosis
ERSAE

SEQ ID NO: 1422718 - protein, 12 aa, Mycobacterium tuberculosis
ERVNEKAPKDRD

SEQ ID NO: 1422719 - protein, 7 aa, Mycobacterium tuberculosis
ESLERAA

SEQ ID NO: 1422720 - protein, 8 aa, Mycobacterium tuberculosis
ESVPLPDD

SEQ ID NO: 1422721 - protein, 18 aa, Mycobacterium tuberculosis
ETTRSSTGTGLQGVTSGL

SEQ ID NO: 1422722 - protein, 11 aa, Mycobacterium tuberculosis
ETTSDLGGYKD

SEQ ID NO: 1422723 - protein, 28 aa, Mycobacterium tuberculosis
EVAPGTVAPVAGASRPQLPTGDLTSVSA

SEQ ID NO: 1422724 - protein, 5 aa, Mycobacterium tuberculosis
EVPPD

SEQ ID NO: 1422725 - protein, 4 aa, Mycobacterium tuberculosis
EWTG

SEQ ID NO: 1422726 - protein, 9 aa, Mycobacterium tuberculosis
EYGGQGADS

SEQ ID NO: 1422727 - protein, 5 aa, Mycobacterium tuberculosis
FAAPT

SEQ ID NO: 1422728 - protein, 8 aa, Mycobacterium tuberculosis
FDDPDDYR

SEQ ID NO: 1422729 - protein, 6 aa, Mycobacterium tuberculosis
FGDQEI

SEQ ID NO: 1422730 - protein, 10 aa, Mycobacterium tuberculosis
FGNAGGTNVG

SEQ ID NO: 1422731 - protein, 7 aa, Mycobacterium tuberculosis
FHPGGAT

SEQ ID NO: 1422732 - protein, 31 aa, Mycobacterium tuberculosis
FNTGVANAGSYNTGSFNAGDTNTGGFNPGTI

SEQ ID NO: 1422733 - protein, 9 aa, Mycobacterium tuberculosis
FPASDPGQL

SEQ ID NO: 1422734 - protein, 17 aa, Mycobacterium tuberculosis
FPEKKLAEPPPGSGLKP

SEQ ID NO: 1422735 - protein, 4 aa, Mycobacterium tuberculosis
FPGD

SEQ ID NO: 1422736 - protein, 6 aa, Mycobacterium tuberculosis
GADGSV

SEQ ID NO: 1422737 - protein, 12 aa, Mycobacterium tuberculosis
GADPELKSTGFA

SEQ ID NO: 1422738 - protein, 5 aa, Mycobacterium tuberculosis
GAESE

SEQ ID NO: 1422739 - protein, 7 aa, Mycobacterium tuberculosis
GAGARIQ

SEQ ID NO: 1422740 - protein, 15 aa, Mycobacterium tuberculosis
GAGGDGLRQRTRADF

SEQ ID NO: 1422741 - protein, 7 aa, Mycobacterium tuberculosis
GAGPGPL

SEQ ID NO: 1422742 - protein, 14 aa, Mycobacterium tuberculosis
GAGQAAAKGAAARL

SEQ ID NO: 1422743 - protein, 9 aa, Mycobacterium tuberculosis
GALDSSSSA

SEQ ID NO: 1422744 - protein, 6 aa, Mycobacterium tuberculosis
GANVQD

SEQ ID NO: 1422745 - protein, 4 aa, Mycobacterium tuberculosis
GAPD

SEQ ID NO: 1422746 - protein, 23 aa, Mycobacterium tuberculosis
GAQRAHDVASKTVQRVYDRLGFL

SEQ ID NO: 1422747 - protein, 4 aa, Mycobacterium tuberculosis
GARA

SEQ ID NO: 1422748 - protein, 4 aa, Mycobacterium tuberculosis
GATP

SEQ ID NO: 1422749 - protein, 5 aa, Mycobacterium tuberculosis
GATVT

SEQ ID NO: 1422750 - protein, 5 aa, Mycobacterium tuberculosis
GAYGQ

SEQ ID NO: 1422751 - protein, 19 aa, Mycobacterium tuberculosis
GAYTSQWREDPPGRARQAN

SEQ ID NO: 1422752 - protein, 6 aa, Mycobacterium tuberculosis
GCTEPA

SEQ ID NO: 1422753 - protein, 5 aa, Mycobacterium tuberculosis
GDDDP

SEQ ID NO: 1422754 - protein, 8 aa, Mycobacterium tuberculosis
GDGARASA

SEQ ID NO: 1422755 - protein, 6 aa, Mycobacterium tuberculosis
GDSRSV

SEQ ID NO: 1422756 - protein, 4 aa, Mycobacterium tuberculosis
GDTD

SEQ ID NO: 1422757 - protein, 9 aa, Mycobacterium tuberculosis
GDTYSEQNT

SEQ ID NO: 1422758 - protein, 7 aa, Mycobacterium tuberculosis
GDVDGPE

SEQ ID NO: 1422759 - protein, 18 aa, Mycobacterium tuberculosis
GDYPRIGTERVSTPGENL

SEQ ID NO: 1422760 - protein, 5 aa, Mycobacterium tuberculosis
GEDYR

SEQ ID NO: 1422761 - protein, 12 aa, Mycobacterium tuberculosis
GEESKQALDRLI

SEQ ID NO: 1422762 - protein, 5 aa, Mycobacterium tuberculosis
GEGER

SEQ ID NO: 1422763 - protein, 15 aa, Mycobacterium tuberculosis
GEGTKKLSKRDPQSN

SEQ ID NO: 1422764 - protein, 7 aa, Mycobacterium tuberculosis
GEPATLG

SEQ ID NO: 1422765 - protein, 4 aa, Mycobacterium tuberculosis
GEQL

SEQ ID NO: 1422766 - protein, 6 aa, Mycobacterium tuberculosis
GFGGRR

SEQ ID NO: 1422767 - protein, 11 aa, Mycobacterium tuberculosis
GFGNTTAVPSS

SEQ ID NO: 1422768 - protein, 7 aa, Mycobacterium tuberculosis
GFTDQQA

SEQ ID NO: 1422769 - protein, 9 aa, Mycobacterium tuberculosis
GGASAGGGL

SEQ ID NO: 1422770 - protein, 20 aa, Mycobacterium tuberculosis
GGAWEGPSAEAYVAAHLPYL

SEQ ID NO: 1422771 - protein, 7 aa, Mycobacterium tuberculosis
GGCPFDP

SEQ ID NO: 1422772 - protein, 7 aa, Mycobacterium tuberculosis
GGDDGRW

SEQ ID NO: 1422773 - protein, 9 aa, Mycobacterium tuberculosis
GGEDRRPTL

SEQ ID NO: 1422774 - protein, 12 aa, Mycobacterium tuberculosis
GGHGGNGGNAGL

SEQ ID NO: 1422775 - protein, 7 aa, Mycobacterium tuberculosis
GGKLSYG

SEQ ID NO: 1422776 - protein, 4 aa, Mycobacterium tuberculosis
GGLH

SEQ ID NO: 1422777 - protein, 14 aa, Mycobacterium tuberculosis
GGLRPGRTERQVSR

SEQ ID NO: 1422778 - protein, 23 aa, Mycobacterium tuberculosis
GGNGGNAGTGFGANTGGNGGDTT

SEQ ID NO: 1422779 - protein, 7 aa, Mycobacterium tuberculosis
GGPAPRV

SEQ ID NO: 1422780 - protein, 15 aa, Mycobacterium tuberculosis
GGRCTPLAQRDTDVD

SEQ ID NO: 1422781 - protein, 8 aa, Mycobacterium tuberculosis
GGTSRRQL

SEQ ID NO: 1422782 - protein, 9 aa, Mycobacterium tuberculosis
GGVGKTRLA

SEQ ID NO: 1422783 - protein, 6 aa, Mycobacterium tuberculosis
GGVVSR

SEQ ID NO: 1422784 - protein, 6 aa, Mycobacterium tuberculosis
GHPKPR

SEQ ID NO: 1422785 - protein, 14 aa, Mycobacterium tuberculosis
GHTEPAERLRASTR

SEQ ID NO: 1422786 - protein, 7 aa, Mycobacterium tuberculosis
GIGNTGN

SEQ ID NO: 1422787 - protein, 10 aa, Mycobacterium tuberculosis
GIKQRPPTMR

SEQ ID NO: 1422788 - protein, 6 aa, Mycobacterium tuberculosis
GIPDEA

SEQ ID NO: 1422789 - protein, 5 aa, Mycobacterium tuberculosis
GITEN

SEQ ID NO: 1422790 - protein, 9 aa, Mycobacterium tuberculosis
GKARTTVAR

SEQ ID NO: 1422791 - protein, 11 aa, Mycobacterium tuberculosis
GKFTSAESRTL

SEQ ID NO: 1422792 - protein, 6 aa, Mycobacterium tuberculosis
GKPHAR

SEQ ID NO: 1422793 - protein, 7 aa, Mycobacterium tuberculosis
GKRKPYI

SEQ ID NO: 1422794 - protein, 8 aa, Mycobacterium tuberculosis
GKSIPLSS

SEQ ID NO: 1422795 - protein, 6 aa, Mycobacterium tuberculosis
GKSTLA

SEQ ID NO: 1422796 - protein, 4 aa, Mycobacterium tuberculosis
GKTF

SEQ ID NO: 1422797 - protein, 8 aa, Mycobacterium tuberculosis
GKYPSTEF

SEQ ID NO: 1422798 - protein, 8 aa, Mycobacterium tuberculosis
GLKESHPH

SEQ ID NO: 1422799 - protein, 17 aa, Mycobacterium tuberculosis
GLPPGSDYRNRAPKMSP

SEQ ID NO: 1422800 - protein, 18 aa, Mycobacterium tuberculosis
GLRGKGRLTDADIDATTR

SEQ ID NO: 1422801 - protein, 22 aa, Mycobacterium tuberculosis
GLTGRPPRAIPDPAPRSSHGPA

SEQ ID NO: 1422802 - protein, 10 aa, Mycobacterium tuberculosis
GMASDQPLAR

SEQ ID NO: 1422803 - protein, 8 aa, Mycobacterium tuberculosis
GMEAPDDM

SEQ ID NO: 1422804 - protein, 4 aa, Mycobacterium tuberculosis
GNAN

SEQ ID NO: 1422805 - protein, 13 aa, Mycobacterium tuberculosis
GNANTGSLNTGSY

SEQ ID NO: 1422806 - protein, 14 aa, Mycobacterium tuberculosis
GNFNQGIANTGNNN

SEQ ID NO: 1422807 - protein, 23 aa, Mycobacterium tuberculosis
GNGGNGGNAGKAGATPGAGGTGG

SEQ ID NO: 1422808 - protein, 5 aa, Mycobacterium tuberculosis
GNLPR

SEQ ID NO: 1422809 - protein, 9 aa, Mycobacterium tuberculosis
GNRLGRRGA

SEQ ID NO: 1422810 - protein, 8 aa, Mycobacterium tuberculosis
GPGNRSLP

SEQ ID NO: 1422811 - protein, 26 aa, Mycobacterium tuberculosis
GPGQGWGYPQPRSGQRARRATGQGSG

SEQ ID NO: 1422812 - protein, 7 aa, Mycobacterium tuberculosis
GPGSGPI

SEQ ID NO: 1422813 - protein, 8 aa, Mycobacterium tuberculosis
GPKTTKRL

SEQ ID NO: 1422814 - protein, 12 aa, Mycobacterium tuberculosis
GPPGTGKTSVAR

SEQ ID NO: 1422815 - protein, 8 aa, Mycobacterium tuberculosis
GPSETVDA

SEQ ID NO: 1422816 - protein, 6 aa, Mycobacterium tuberculosis
GQDPEL

SEQ ID NO: 1422817 - protein, 4 aa, Mycobacterium tuberculosis
GQGS

SEQ ID NO: 1422818 - protein, 16 aa, Mycobacterium tuberculosis
GQPIDGRGDVDSDTRR

SEQ ID NO: 1422819 - protein, 4 aa, Mycobacterium tuberculosis
GQPQ

SEQ ID NO: 1422820 - protein, 19 aa, Mycobacterium tuberculosis
GQRGDAGPDEWAAAPDPLD

SEQ ID NO: 1422821 - protein, 7 aa, Mycobacterium tuberculosis
GQRGDPI

SEQ ID NO: 1422822 - protein, 11 aa, Mycobacterium tuberculosis
GRCEACTGDGT

SEQ ID NO: 1422823 - protein, 8 aa, Mycobacterium tuberculosis
GRIGPGKA

SEQ ID NO: 1422824 - protein, 5 aa, Mycobacterium tuberculosis
GRKPK

SEQ ID NO: 1422825 - protein, 18 aa, Mycobacterium tuberculosis
GRPDVDDLGTSYGEAHLD

SEQ ID NO: 1422826 - protein, 6 aa, Mycobacterium tuberculosis
GRSTLA

SEQ ID NO: 1422827 - protein, 9 aa, Mycobacterium tuberculosis
GRTSRSELE

SEQ ID NO: 1422828 - protein, 8 aa, Mycobacterium tuberculosis
GRVDPQSD

SEQ ID NO: 1422829 - protein, 11 aa, Mycobacterium tuberculosis
GRWDPTPEPEI

SEQ ID NO: 1422830 - protein, 5 aa, Mycobacterium tuberculosis
GSAAT

SEQ ID NO: 1422831 - protein, 5 aa, Mycobacterium tuberculosis
GSCNG

SEQ ID NO: 1422832 - protein, 11 aa, Mycobacterium tuberculosis
GSDEGGHDTVH

SEQ ID NO: 1422833 - protein, 9 aa, Mycobacterium tuberculosis
GSGTPIPSA

SEQ ID NO: 1422834 - protein, 8 aa, Mycobacterium tuberculosis
GSKAPADM

SEQ ID NO: 1422835 - protein, 5 aa, Mycobacterium tuberculosis
GSLGP

SEQ ID NO: 1422836 - protein, 7 aa, Mycobacterium tuberculosis
GSPRPTL

SEQ ID NO: 1422837 - protein, 10 aa, Mycobacterium tuberculosis
GSRGGDGGVG

SEQ ID NO: 1422838 - protein, 5 aa, Mycobacterium tuberculosis
GSTLR

SEQ ID NO: 1422839 - protein, 13 aa, Mycobacterium tuberculosis
GSVGPDPGEATGL

SEQ ID NO: 1422840 - protein, 7 aa, Mycobacterium tuberculosis
GTAARSQ

SEQ ID NO: 1422841 - protein, 8 aa, Mycobacterium tuberculosis
GTKKAEAL

SEQ ID NO: 1422842 - protein, 15 aa, Mycobacterium tuberculosis
GTNARDTIGAELGGQ

SEQ ID NO: 1422843 - protein, 7 aa, Mycobacterium tuberculosis
GTNRYGT

SEQ ID NO: 1422844 - protein, 9 aa, Mycobacterium tuberculosis
GTPAAVSGI

SEQ ID NO: 1422845 - protein, 16 aa, Mycobacterium tuberculosis
GTPGFGNSTTTPSSGF

SEQ ID NO: 1422846 - protein, 15 aa, Mycobacterium tuberculosis
GTPHTTTGSATASAT

SEQ ID NO: 1422847 - protein, 5 aa, Mycobacterium tuberculosis
GTRGW

SEQ ID NO: 1422848 - protein, 13 aa, Mycobacterium tuberculosis
GTSGHRGSALTGT

SEQ ID NO: 1422849 - protein, 6 aa, Mycobacterium tuberculosis
GVAKSG

SEQ ID NO: 1422850 - protein, 5 aa, Mycobacterium tuberculosis
GVAPV

SEQ ID NO: 1422851 - protein, 10 aa, Mycobacterium tuberculosis
GVPDYVPPDS

SEQ ID NO: 1422852 - protein, 8 aa, Mycobacterium tuberculosis
GVPEPVDD

SEQ ID NO: 1422853 - protein, 5 aa, Mycobacterium tuberculosis
GWLGP

SEQ ID NO: 1422854 - protein, 14 aa, Mycobacterium tuberculosis
GYTSAGRTKETAED

SEQ ID NO: 1422855 - protein, 6 aa, Mycobacterium tuberculosis
HAEPKQ

SEQ ID NO: 1422856 - protein, 4 aa, Mycobacterium tuberculosis
HAEY

SEQ ID NO: 1422857 - protein, 7 aa, Mycobacterium tuberculosis
HAGAAPA

SEQ ID NO: 1422858 - protein, 15 aa, Mycobacterium tuberculosis
HASRRRAQRRLPDTP

SEQ ID NO: 1422859 - protein, 6 aa, Mycobacterium tuberculosis
HDDGDS

SEQ ID NO: 1422860 - protein, 5 aa, Mycobacterium tuberculosis
HDTLD

SEQ ID NO: 1422861 - protein, 8 aa, Mycobacterium tuberculosis
HGDQDVAP

SEQ ID NO: 1422862 - protein, 5 aa, Mycobacterium tuberculosis
HGKPS

SEQ ID NO: 1422863 - protein, 6 aa, Mycobacterium tuberculosis
HGQQYQ

SEQ ID NO: 1422864 - protein, 6 aa, Mycobacterium tuberculosis
HHPDGT

SEQ ID NO: 1422865 - protein, 6 aa, Mycobacterium tuberculosis
HKVDGA

SEQ ID NO: 1422866 - protein, 5 aa, Mycobacterium tuberculosis
HNHPS

SEQ ID NO: 1422867 - protein, 5 aa, Mycobacterium tuberculosis
HPDGF

SEQ ID NO: 1422868 - protein, 7 aa, Mycobacterium tuberculosis
HPHADTE

SEQ ID NO: 1422869 - protein, 11 aa, Mycobacterium tuberculosis
HPLGTGGGIAN

SEQ ID NO: 1422870 - protein, 54 aa, Mycobacterium tuberculosis
HPPGRRSRPGRQSRSISSRRAGPLRPAGHGLATPRRRPHRHRTRPQTRHHPEQP

SEQ ID NO: 1422871 - protein, 10 aa, Mycobacterium tuberculosis
HRDATDDQVT

SEQ ID NO: 1422872 - protein, 7 aa, Mycobacterium tuberculosis
HRNHQAR

SEQ ID NO: 1422873 - protein, 6 aa, Mycobacterium tuberculosis
HRQAPV

SEQ ID NO: 1422874 - protein, 7 aa, Mycobacterium tuberculosis
HSEPPVG

SEQ ID NO: 1422875 - protein, 5 aa, Mycobacterium tuberculosis
HTPRT

SEQ ID NO: 1422876 - protein, 9 aa, Mycobacterium tuberculosis
HTSAEQVGE

SEQ ID NO: 1422877 - protein, 7 aa, Mycobacterium tuberculosis
HVTPPQT

SEQ ID NO: 1422878 - protein, 5 aa, Mycobacterium tuberculosis
HYRSG

SEQ ID NO: 1422879 - protein, 16 aa, Mycobacterium tuberculosis
IAQAASGQARLVGTFE

SEQ ID NO: 1422880 - protein, 11 aa, Mycobacterium tuberculosis
IARGSADGRVR

SEQ ID NO: 1422881 - protein, 5 aa, Mycobacterium tuberculosis
IATAS

SEQ ID NO: 1422882 - protein, 13 aa, Mycobacterium tuberculosis
IDDGDTGYPYGTE

SEQ ID NO: 1422883 - protein, 4 aa, Mycobacterium tuberculosis
IDQR

SEQ ID NO: 1422884 - protein, 9 aa, Mycobacterium tuberculosis
IEAAQQTFE

SEQ ID NO: 1422885 - protein, 11 aa, Mycobacterium tuberculosis
IEPSEITPEKS

SEQ ID NO: 1422886 - protein, 10 aa, Mycobacterium tuberculosis
IGDPAANAAS

SEQ ID NO: 1422887 - protein, 7 aa, Mycobacterium tuberculosis
IGGPQPV

SEQ ID NO: 1422888 - protein, 15 aa, Mycobacterium tuberculosis
IGPPRQLPADSPQGQ

SEQ ID NO: 1422889 - protein, 12 aa, Mycobacterium tuberculosis
IGSETGRIHGAT

SEQ ID NO: 1422890 - protein, 5 aa, Mycobacterium tuberculosis
IKKRS

SEQ ID NO: 1422891 - protein, 7 aa, Mycobacterium tuberculosis
IKTSKQV

SEQ ID NO: 1422892 - protein, 11 aa, Mycobacterium tuberculosis
INPTSLADPAA

SEQ ID NO: 1422893 - protein, 16 aa, Mycobacterium tuberculosis
IQPSGSVARYESRVGD

SEQ ID NO: 1422894 - protein, 10 aa, Mycobacterium tuberculosis
IRAPSGGNVQ

SEQ ID NO: 1422895 - protein, 6 aa, Mycobacterium tuberculosis
IRPDGQ

SEQ ID NO: 1422896 - protein, 17 aa, Mycobacterium tuberculosis
IRRTRAGLKDPKRPSGS

SEQ ID NO: 1422897 - protein, 4 aa, Mycobacterium tuberculosis
ISSG

SEQ ID NO: 1422898 - protein, 10 aa, Mycobacterium tuberculosis
ISTTKPSPLL

SEQ ID NO: 1422899 - protein, 11 aa, Mycobacterium tuberculosis
ITDVTAASAAT

SEQ ID NO: 1422900 - protein, 4 aa, Mycobacterium tuberculosis
KAAL

SEQ ID NO: 1422901 - protein, 10 aa, Mycobacterium tuberculosis
KADGQPFSDD

SEQ ID NO: 1422902 - protein, 11 aa, Mycobacterium tuberculosis
KAEVEIPSPYA

SEQ ID NO: 1422903 - protein, 5 aa, Mycobacterium tuberculosis
KAQVA

SEQ ID NO: 1422904 - protein, 4 aa, Mycobacterium tuberculosis
KDAG

SEQ ID NO: 1422905 - protein, 8 aa, Mycobacterium tuberculosis
KDPTLRDE

SEQ ID NO: 1422906 - protein, 5 aa, Mycobacterium tuberculosis
KEAAA

SEQ ID NO: 1422907 - protein, 8 aa, Mycobacterium tuberculosis
KEAYADGI

SEQ ID NO: 1422908 - protein, 6 aa, Mycobacterium tuberculosis
KFTRDT

SEQ ID NO: 1422909 - protein, 14 aa, Mycobacterium tuberculosis
KHRPGDMSGGQQQR

SEQ ID NO: 1422910 - protein, 4 aa, Mycobacterium tuberculosis
KLSE

SEQ ID NO: 1422911 - protein, 6 aa, Mycobacterium tuberculosis
KLTTAG

SEQ ID NO: 1422912 - protein, 11 aa, Mycobacterium tuberculosis
KPSTRTRRLDG

SEQ ID NO: 1422913 - protein, 4 aa, Mycobacterium tuberculosis
KPVA

SEQ ID NO: 1422914 - protein, 6 aa, Mycobacterium tuberculosis
KQPERQ

SEQ ID NO: 1422915 - protein, 4 aa, Mycobacterium tuberculosis
KQRR

SEQ ID NO: 1422916 - protein, 7 aa, Mycobacterium tuberculosis
KRAESGM

SEQ ID NO: 1422917 - protein, 5 aa, Mycobacterium tuberculosis
KSARV

SEQ ID NO: 1422918 - protein, 15 aa, Mycobacterium tuberculosis
KSGTAHYAASGEQDA

SEQ ID NO: 1422919 - protein, 8 aa, Mycobacterium tuberculosis
KSMGDSEF

SEQ ID NO: 1422920 - protein, 44 aa, Mycobacterium tuberculosis; identical to SEQ ID NO: 179582

SEQ ID NO: 1422921 - protein, 8 aa, Mycobacterium tuberculosis
KVGAGEWP

SEQ ID NO: 1422922 - protein, 5 aa, Mycobacterium tuberculosis
KVPRA

SEQ ID NO: 1422923 - protein, 7 aa, Mycobacterium tuberculosis
LAAAGDR

SEQ ID NO: 1422924 - protein, 24 aa, Mycobacterium tuberculosis
LAAATTDRLRRQKQANRVRDDVPS

SEQ ID NO: 1422925 - protein, 17 aa, Mycobacterium tuberculosis
LAEGPAQRAVTEDRTVT

SEQ ID NO: 1422926 - protein, 5 aa, Mycobacterium tuberculosis
LAGEK

SEQ ID NO: 1422927 - protein, 11 aa, Mycobacterium tuberculosis
LAGYGAGDTDL

SEQ ID NO: 1422928 - protein, 7 aa, Mycobacterium tuberculosis
LAKTGTA

SEQ ID NO: 1422929 - protein, 21 aa, Mycobacterium tuberculosis
LAPAQEAPAQEAPAPRGQYDP

SEQ ID NO: 1422930 - protein, 14 aa, Mycobacterium tuberculosis
LAPRRGQSFDSGVS

SEQ ID NO: 1422931 - protein, 5 aa, Mycobacterium tuberculosis
LAPTA

SEQ ID NO: 1422932 - protein, 20 aa, Mycobacterium tuberculosis
LASAGRARPARKIKPPADPD

SEQ ID NO: 1422933 - protein, 16 aa, Mycobacterium tuberculosis
LATPDQGFTRSQEACR

SEQ ID NO: 1422934 - protein, 8 aa, Mycobacterium tuberculosis
LDAQEAAV

SEQ ID NO: 1422935 - protein, 6 aa, Mycobacterium tuberculosis
LDPEGE

SEQ ID NO: 1422936 - protein, 23 aa, Mycobacterium tuberculosis
LDTLGQAEAAGAVRVGPDSDTSE

SEQ ID NO: 1422937 - protein, 10 aa, Mycobacterium tuberculosis
LEPTSGNTGI

SEQ ID NO: 1422938 - protein, 6 aa, Mycobacterium tuberculosis
LEQTVG

SEQ ID NO: 1422939 - protein, 9 aa, Mycobacterium tuberculosis
LGDQAAVDA

SEQ ID NO: 1422940 - protein, 7 aa, Mycobacterium tuberculosis
LGEEGSG

SEQ ID NO: 1422941 - protein, 4 aa, Mycobacterium tuberculosis
LGEM

SEQ ID NO: 1422942 - protein, 6 aa, Mycobacterium tuberculosis
LGGGFR

SEQ ID NO: 1422943 - protein, 35 aa, Mycobacterium tuberculosis
LGNDRKPDESCARAAAAADPGPPTRPAHNAAGVSP

SEQ ID NO: 1422944 - protein, 8 aa, Mycobacterium tuberculosis
LGPGDPEL

SEQ ID NO: 1422945 - protein, 15 aa, Mycobacterium tuberculosis
LGPRSTLPGVGGMSP

SEQ ID NO: 1422946 - protein, 7 aa, Mycobacterium tuberculosis
LGRTPPF

SEQ ID NO: 1422947 - protein, 26 aa, Mycobacterium tuberculosis
LGSGNTGDTNVGSGNIGNTNLGGGNI

SEQ ID NO: 1422948 - protein, 10 aa, Mycobacterium tuberculosis
LGTDPASGKP

SEQ ID NO: 1422949 - protein, 12 aa, Mycobacterium tuberculosis
LGTGASQASERA

SEQ ID NO: 1422950 - protein, 5 aa, Mycobacterium tuberculosis
LGVGT

SEQ ID NO: 1422951 - protein, 9 aa, Mycobacterium tuberculosis
LGVNPTNDG

SEQ ID NO: 1422952 - protein, 19 aa, Mycobacterium tuberculosis
LGVTNPGYRPGDTATALPA

SEQ ID NO: 1422953 - protein, 7 aa, Mycobacterium tuberculosis
LNDPSMQ

SEQ ID NO: 1422954 - protein, 15 aa, Mycobacterium tuberculosis
LNDTKTKALTMCVAA

SEQ ID NO: 1422955 - protein, 6 aa, Mycobacterium tuberculosis
LNNTRE

SEQ ID NO: 1422956 - protein, 6 aa, Mycobacterium tuberculosis
LPAGTA

SEQ ID NO: 1422957 - protein, 5 aa, Mycobacterium tuberculosis
LPDGR

SEQ ID NO: 1422958 - protein, 4 aa, Mycobacterium tuberculosis
LPEA

SEQ ID NO: 1422959 - protein, 6 aa, Mycobacterium tuberculosis
LPESQL

SEQ ID NO: 1422960 - protein, 4 aa, Mycobacterium tuberculosis
LPGT

SEQ ID NO: 1422961 - protein, 10 aa, Mycobacterium tuberculosis
LPPAVKARAS

SEQ ID NO: 1422962 - protein, 8 aa, Mycobacterium tuberculosis
LPSRYGQA

SEQ ID NO: 1422963 - protein, 9 aa, Mycobacterium tuberculosis
LPTLPEETG

SEQ ID NO: 1422964 - protein, 4 aa, Mycobacterium tuberculosis
LQRT

SEQ ID NO: 1422965 - protein, 4 aa, Mycobacterium tuberculosis
LRES

SEQ ID NO: 1422966 - protein, 10 aa, Mycobacterium tuberculosis
LRSTGDPRRV

SEQ ID NO: 1422967 - protein, 8 aa, Mycobacterium tuberculosis
LSGRPDTL

SEQ ID NO: 1422968 - protein, 8 aa, Mycobacterium tuberculosis
LSKENRDF

SEQ ID NO: 1422969 - protein, 8 aa, Mycobacterium tuberculosis
LTDEQKRH

SEQ ID NO: 1422970 - protein, 9 aa, Mycobacterium tuberculosis
LTEPGRSSA

SEQ ID NO: 1422971 - protein, 11 aa, Mycobacterium tuberculosis
LTTVTGEVPAD

SEQ ID NO: 1422972 - protein, 10 aa, Mycobacterium tuberculosis
MADSYDEQGN

SEQ ID NO: 1422973 - protein, 4 aa, Mycobacterium tuberculosis
MGQR

SEQ ID NO: 1422974 - protein, 4 aa, Mycobacterium tuberculosis
MPEH

SEQ ID NO: 1422975 - protein, 7 aa, Mycobacterium tuberculosis
MPTGREE

SEQ ID NO: 1422976 - protein, 7 aa, Mycobacterium tuberculosis
MSRGEHR

SEQ ID NO: 1422977 - protein, 8 aa, Mycobacterium tuberculosis
MTAPETVT

SEQ ID NO: 1422978 - protein, 6 aa, Mycobacterium tuberculosis
NCETPA

SEQ ID NO: 1422979 - protein, 19 aa, Mycobacterium tuberculosis
NDAMDAAAQSAAADADPAK

SEQ ID NO: 1422980 - protein, 9 aa, Mycobacterium tuberculosis
NDSITPDDA

SEQ ID NO: 1422981 - protein, 7 aa, Mycobacterium tuberculosis
NDTRVSK

SEQ ID NO: 1422982 - protein, 9 aa, Mycobacterium tuberculosis
NEQATTEAF

SEQ ID NO: 1422983 - protein, 5 aa, Mycobacterium tuberculosis
NERQD

SEQ ID NO: 1422984 - protein, 5 aa, Mycobacterium tuberculosis
NFPTS

SEQ ID NO: 1422985 - protein, 16 aa, Mycobacterium tuberculosis
NGANGTAASPNGGDGG

SEQ ID NO: 1422986 - protein, 5 aa, Mycobacterium tuberculosis
NGDVD

SEQ ID NO: 1422987 - protein, 16 aa, Mycobacterium tuberculosis
NGGAGGAGGNGGDTTV

SEQ ID NO: 1422988 - protein, 25 aa, Mycobacterium tuberculosis
NGGAGGSGAGGASSAHGGAGGQAGL

SEQ ID NO: 1422989 - protein, 46 aa, Mycobacterium tuberculosis; identical to SEQ ID NO: 181319

SEQ ID NO: 1422990 - protein, 45 aa, Mycobacterium tuberculosis
NGGNGGDSTSPGVAGGAGGSAGLIGNGGRGGNGAPGGAGGNGGLG

SEQ ID NO: 1422991 - protein, 34 aa, Mycobacterium tuberculosis; identical to SEQ ID NO: 181326

SEQ ID NO: 1422992 - protein, 21 aa, Mycobacterium tuberculosis
NGGNGGSGAPGQTGGAGGAAG

SEQ ID NO: 1422993 - protein, 18 aa, Mycobacterium tuberculosis
NGGNGGSGASGGAAGHAG

SEQ ID NO: 1422994 - protein, 21 aa, Mycobacterium tuberculosis
NGGNGGSGGVGQAGGAGGSAG

SEQ ID NO: 1422995 - protein, 9 aa, Mycobacterium tuberculosis
NGGSAADAQ

SEQ ID NO: 1422996 - protein, 21 aa, Mycobacterium tuberculosis
NGPPASPAPPAAAPAGPLPAY

SEQ ID NO: 1422997 - protein, 9 aa, Mycobacterium tuberculosis
NGSIGEGGR

SEQ ID NO: 1422998 - protein, 8 aa, Mycobacterium tuberculosis
NHRYRGNN

SEQ ID NO: 1422999 - protein, 27 aa, Mycobacterium tuberculosis
NPAYPYESEAERSAARARRNARQQRSA

SEQ ID NO: 1423000 - protein, 12 aa, Mycobacterium tuberculosis
NPDETWRHHRRN

SEQ ID NO: 1423001 - protein, 9 aa, Mycobacterium tuberculosis
NPSDWPEGK

SEQ ID NO: 1423002 - protein, 7 aa, Mycobacterium tuberculosis
NQGSNTV

SEQ ID NO: 1423003 - protein, 16 aa, Mycobacterium tuberculosis
NRRDPAPGQLATHSVA

SEQ ID NO: 1423004 - protein, 6 aa, Mycobacterium tuberculosis
NSDLRQ

SEQ ID NO: 1423005 - protein, 4 aa, Mycobacterium tuberculosis
NSTV

SEQ ID NO: 1423006 - protein, 15 aa, Mycobacterium tuberculosis
NTGLANAGSYNTGSL

SEQ ID NO: 1423007 - protein, 4 aa, Mycobacterium tuberculosis
NTRM

SEQ ID NO: 1423008 - protein, 17 aa, Mycobacterium tuberculosis
NTVTGSITDGNGPSGVA

SEQ ID NO: 1423009 - protein, 6 aa, Mycobacterium tuberculosis
PAATTD

SEQ ID NO: 1423010 - protein, 10 aa, Mycobacterium tuberculosis
PADPDDAARL

SEQ ID NO: 1423011 - protein, 9 aa, Mycobacterium tuberculosis
PAGAGPELE

SEQ ID NO: 1423012 - protein, 15 aa, Mycobacterium tuberculosis
PAGPGYFNSSATPSL

SEQ ID NO: 1423013 - protein, 21 aa, Mycobacterium tuberculosis
PAGPPRVGQPSWNPQRASSMP

SEQ ID NO: 1423014 - protein, 9 aa, Mycobacterium tuberculosis
PAGSGGSVA

SEQ ID NO: 1423015 - protein, 4 aa, Mycobacterium tuberculosis
PAQT

SEQ ID NO: 1423016 - protein, 16 aa, Mycobacterium tuberculosis
PASLTAKVPDDVTSEV

SEQ ID NO: 1423017 - protein, 18 aa, Mycobacterium tuberculosis
PAVTGKPSGDDLKSGKRT

SEQ ID NO: 1423018 - protein, 12 aa, Mycobacterium tuberculosis
PAWAESSTSHYV

SEQ ID NO: 1423019 - protein, 7 aa, Mycobacterium tuberculosis
PCPPTGL

SEQ ID NO: 1423020 - protein, 18 aa, Mycobacterium tuberculosis
PDAGADGRPHRIPEAAGG

SEQ ID NO: 1423021 - protein, 6 aa, Mycobacterium tuberculosis
PDHGTE

SEQ ID NO: 1423022 - protein, 19 aa, Mycobacterium tuberculosis
PDNRLAEKGWTTHNNTHGH

SEQ ID NO: 1423023 - protein, 8 aa, Mycobacterium tuberculosis
PDPVGTGS

SEQ ID NO: 1423024 - protein, 5 aa, Mycobacterium tuberculosis
PDREG

SEQ ID NO: 1423025 - protein, 24 aa, Mycobacterium tuberculosis
PDSAPTPSPAPIAPPTTDNASAMT

SEQ ID NO: 1423026 - protein, 8 aa, Mycobacterium tuberculosis
PDSLADAQ

SEQ ID NO: 1423027 - protein, 7 aa, Mycobacterium tuberculosis
PEDFPDP

SEQ ID NO: 1423028 - protein, 4 aa, Mycobacterium tuberculosis
PEGY

SEQ ID NO: 1423029 - protein, 6 aa, Mycobacterium tuberculosis
PEHPYP

SEQ ID NO: 1423030 - protein, 7 aa, Mycobacterium tuberculosis
PEPQPVN

SEQ ID NO: 1423031 - protein, 5 aa, Mycobacterium tuberculosis
PERER

SEQ ID NO: 1423032 - protein, 13 aa, Mycobacterium tuberculosis
PERRTKSKALTLP

SEQ ID NO: 1423033 - protein, 11 aa, Mycobacterium tuberculosis
PGDREVDDKRL

SEQ ID NO: 1423034 - protein, 6 aa, Mycobacterium tuberculosis
PGFDPA

SEQ ID NO: 1423035 - protein, 8 aa, Mycobacterium tuberculosis
PGNAAVAD

SEQ ID NO: 1423036 - protein, 8 aa, Mycobacterium tuberculosis
PGQAGGQA

SEQ ID NO: 1423037 - protein, 7 aa, Mycobacterium tuberculosis
PGQGTVR

SEQ ID NO: 1423038 - protein, 7 aa, Mycobacterium tuberculosis
PGRRARV

SEQ ID NO: 1423039 - protein, 8 aa, Mycobacterium tuberculosis
PGTGRPAV

SEQ ID NO: 1423040 - protein, 9 aa, Mycobacterium tuberculosis
PGTGSDNDY

SEQ ID NO: 1423041 - protein, 14 aa, Mycobacterium tuberculosis
PHTPLNEPIAGARS

SEQ ID NO: 1423042 - protein, 10 aa, Mycobacterium tuberculosis
PITSSTLTEE

SEQ ID NO: 1423043 - protein, 8 aa, Mycobacterium tuberculosis
PKPRGWSN

SEQ ID NO: 1423044 - protein, 5 aa, Mycobacterium tuberculosis
PLPDA

SEQ ID NO: 1423045 - protein, 5 aa, Mycobacterium tuberculosis
PLPPV

SEQ ID NO: 1423046 - protein, 7 aa, Mycobacterium tuberculosis
PLRGDGR

SEQ ID NO: 1423047 - protein, 9 aa, Mycobacterium tuberculosis
PMGDAGLTG

SEQ ID NO: 1423048 - protein, 10 aa, Mycobacterium tuberculosis
PNNGFPGTSS

SEQ ID NO: 1423049 - protein, 13 aa, Mycobacterium tuberculosis
PPEGAESVDISDG

SEQ ID NO: 1423050 - protein, 13 aa, Mycobacterium tuberculosis
PPGVRRPAGIPAD

SEQ ID NO: 1423051 - protein, 15 aa, Mycobacterium tuberculosis
PPTPGIGNTTTVPSS

SEQ ID NO: 1423052 - protein, 4 aa, Mycobacterium tuberculosis
PQAR

SEQ ID NO: 1423053 - protein, 4 aa, Mycobacterium tuberculosis
PRAD

SEQ ID NO: 1423054 - protein, 8 aa, Mycobacterium tuberculosis
PRAPENAT

SEQ ID NO: 1423055 - protein, 7 aa, Mycobacterium tuberculosis
PRGRGPS

SEQ ID NO: 1423056 - protein, 23 aa, Mycobacterium tuberculosis
PRLPGPAEQVDGRSLRPRGFSDE

SEQ ID NO: 1423057 - protein, 10 aa, Mycobacterium tuberculosis
PRRTAPDGSN

SEQ ID NO: 1423058 - protein, 7 aa, Mycobacterium tuberculosis
PSATHER

SEQ ID NO: 1423059 - protein, 5 aa, Mycobacterium tuberculosis
PSGPA

SEQ ID NO: 1423060 - protein, 15 aa, Mycobacterium tuberculosis
PSRTAGRAAAGGHPC

SEQ ID NO: 1423061 - protein, 7 aa, Mycobacterium tuberculosis
PSSHDAI

SEQ ID NO: 1423062 - protein, 9 aa, Mycobacterium tuberculosis
PSSTDASEV

SEQ ID NO: 1423063 - protein, 11 aa, Mycobacterium tuberculosis
PTLPVDGEDPF

SEQ ID NO: 1423064 - protein, 6 aa, Mycobacterium tuberculosis
PTPTAV

SEQ ID NO: 1423065 - protein, 7 aa, Mycobacterium tuberculosis
PTSWEQA

SEQ ID NO: 1423066 - protein, 10 aa, Mycobacterium tuberculosis
PTYETSSAEQ

SEQ ID NO: 1423067 - protein, 5 aa, Mycobacterium tuberculosis
PYQNI

SEQ ID NO: 1423068 - protein, 9 aa, Mycobacterium tuberculosis
QAEAGGIDE

SEQ ID NO: 1423069 - protein, 7 aa, Mycobacterium tuberculosis
QAIADGK

SEQ ID NO: 1423070 - protein, 6 aa, Mycobacterium tuberculosis
QDEDEI

SEQ ID NO: 1423071 - protein, 4 aa, Mycobacterium tuberculosis
QDHA

SEQ ID NO: 1423072 - protein, 8 aa, Mycobacterium tuberculosis
QGHSEPAL

SEQ ID NO: 1423073 - protein, 4 aa, Mycobacterium tuberculosis
QGIG

SEQ ID NO: 1423074 - protein, 4 aa, Mycobacterium tuberculosis
QGRS

SEQ ID NO: 1423075 - protein, 8 aa, Mycobacterium tuberculosis
QGRTSDTT

SEQ ID NO: 1423076 - protein, 4 aa, Mycobacterium tuberculosis
QIQQ

SEQ ID NO: 1423077 - protein, 11 aa, Mycobacterium tuberculosis
QLGGSDAAVSR

SEQ ID NO: 1423078 - protein, 7 aa, Mycobacterium tuberculosis
QLRSEGR

SEQ ID NO: 1423079 - protein, 5 aa, Mycobacterium tuberculosis
QMGAE

SEQ ID NO: 1423080 - protein, 8 aa, Mycobacterium tuberculosis
QNRGRDTR

SEQ ID NO: 1423081 - protein, 12 aa, Mycobacterium tuberculosis
QNTASIAATEAQ

SEQ ID NO: 1423082 - protein, 5 aa, Mycobacterium tuberculosis
QPDRV

SEQ ID NO: 1423083 - protein, 5 aa, Mycobacterium tuberculosis
QPELE

SEQ ID NO: 1423084 - protein, 14 aa, Mycobacterium tuberculosis
QPEYVESGAPGRGN

SEQ ID NO: 1423085 - protein, 4 aa, Mycobacterium tuberculosis
QPHD

SEQ ID NO: 1423086 - protein, 6 aa, Mycobacterium tuberculosis
QQEERG

SEQ ID NO: 1423087 - protein, 4 aa, Mycobacterium tuberculosis
QQHA

SEQ ID NO: 1423088 - protein, 6 aa, Mycobacterium tuberculosis
QQTRQR

SEQ ID NO: 1423089 - protein, 6 aa, Mycobacterium tuberculosis
QRPRVE

SEQ ID NO: 1423090 - protein, 4 aa, Mycobacterium tuberculosis
QRRT

SEQ ID NO: 1423091 - protein, 11 aa, Mycobacterium tuberculosis
QRVGTDAATDV

SEQ ID NO: 1423092 - protein, 5 aa, Mycobacterium tuberculosis
QSEVY

SEQ ID NO: 1423093 - protein, 11 aa, Mycobacterium tuberculosis
QSFRRTAGAQF

SEQ ID NO: 1423094 - protein, 7 aa, Mycobacterium tuberculosis
QSGDTVR

SEQ ID NO: 1423095 - protein, 8 aa, Mycobacterium tuberculosis
QSRSELTE

SEQ ID NO: 1423096 - protein, 15 aa, Mycobacterium tuberculosis
QSWKAPKPRDDAAAL

SEQ ID NO: 1423097 - protein, 6 aa, Mycobacterium tuberculosis
QTLGTQ

SEQ ID NO: 1423098 - protein, 14 aa, Mycobacterium tuberculosis
QVRRGAPSANAQWG

SEQ ID NO: 1423099 - protein, 20 aa, Mycobacterium tuberculosis
RAAQNGAKRALAAAVGDAEA

SEQ ID NO: 1423100 - protein, 5 aa, Mycobacterium tuberculosis
RADEL

SEQ ID NO: 1423101 - protein, 7 aa, Mycobacterium tuberculosis
RADTTVA

SEQ ID NO: 1423102 - protein, 4 aa, Mycobacterium tuberculosis
RAFP

SEQ ID NO: 1423103 - protein, 7 aa, Mycobacterium tuberculosis
RAGDGVR

SEQ ID NO: 1423104 - protein, 6 aa, Mycobacterium tuberculosis
RALTPP

SEQ ID NO: 1423105 - protein, 4 aa, Mycobacterium tuberculosis
RARG

SEQ ID NO: 1423106 - protein, 5 aa, Mycobacterium tuberculosis
RARRD

SEQ ID NO: 1423107 - protein, 8 aa, Mycobacterium tuberculosis
RATDGETV

SEQ ID NO: 1423108 - protein, 4 aa, Mycobacterium tuberculosis
RATP

SEQ ID NO: 1423109 - protein, 15 aa, Mycobacterium tuberculosis
RAVSAGKVTERERDR

SEQ ID NO: 1423110 - protein, 12 aa, Mycobacterium tuberculosis
RDCGPAGTPLPA

SEQ ID NO: 1423111 - protein, 5 aa, Mycobacterium tuberculosis
RDRET

SEQ ID NO: 1423112 - protein, 4 aa, Mycobacterium tuberculosis
RDVD

SEQ ID NO: 1423113 - protein, 4 aa, Mycobacterium tuberculosis
RDVE

SEQ ID NO: 1423114 - protein, 9 aa, Mycobacterium tuberculosis
REAEDQGQG

SEQ ID NO: 1423115 - protein, 13 aa, Mycobacterium tuberculosis
REEPDPVTALEGA

SEQ ID NO: 1423116 - protein, 4 aa, Mycobacterium tuberculosis
REEY

SEQ ID NO: 1423117 - protein, 15 aa, Mycobacterium tuberculosis
RELAERDRPPSAKGR

SEQ ID NO: 1423118 - protein, 4 aa, Mycobacterium tuberculosis
RELY

SEQ ID NO: 1423119 - protein, 10 aa, Mycobacterium tuberculosis
REQWDDGNNT

SEQ ID NO: 1423120 - protein, 7 aa, Mycobacterium tuberculosis
RFPGSEL

SEQ ID NO: 1423121 - protein, 4 aa, Mycobacterium tuberculosis
RGAA

SEQ ID NO: 1423122 - protein, 9 aa, Mycobacterium tuberculosis
RGDQKNASL

SEQ ID NO: 1423123 - protein, 32 aa, Mycobacterium tuberculosis
RGRPAMGRGRGEQSSAADRRAAPPRHSRRNRA

SEQ ID NO: 1423124 - protein, 12 aa, Mycobacterium tuberculosis
RGRRAPVSSSDQ

SEQ ID NO: 1423125 - protein, 8 aa, Mycobacterium tuberculosis
RGSPPEFA

SEQ ID NO: 1423126 - protein, 18 aa, Mycobacterium tuberculosis
RITSSDTKDPNREHDTSD

SEQ ID NO: 1423127 - protein, 13 aa, Mycobacterium tuberculosis
RLPPGSPTDLTDD

SEQ ID NO: 1423128 - protein, 5 aa, Mycobacterium tuberculosis
RNNRL

SEQ ID NO: 1423129 - protein, 7 aa, Mycobacterium tuberculosis
RNPNPHL

SEQ ID NO: 1423130 - protein, 7 aa, Mycobacterium tuberculosis
RPAGTRR

SEQ ID NO: 1423131 - protein, 11 aa, Mycobacterium tuberculosis
RPNTGKSTLTN

SEQ ID NO: 1423132 - protein, 34 aa, Mycobacterium tuberculosis; identical to SEQ ID NO: 185885

SEQ ID NO: 1423133 - protein, 11 aa, Mycobacterium tuberculosis
RPTYDDAARSQ

SEQ ID NO: 1423134 - protein, 8 aa, Mycobacterium tuberculosis
RQPGPDPV

SEQ ID NO: 1423135 - protein, 6 aa, Mycobacterium tuberculosis
RQRDTL

SEQ ID NO: 1423136 - protein, 5 aa, Mycobacterium tuberculosis
RRADP

SEQ ID NO: 1423137 - protein, 7 aa, Mycobacterium tuberculosis
RRDTAGY

SEQ ID NO: 1423138 - protein, 5 aa, Mycobacterium tuberculosis
RRLRQ

SEQ ID NO: 1423139 - protein, 6 aa, Mycobacterium tuberculosis
RRRPEA

SEQ ID NO: 1423140 - protein, 12 aa, Mycobacterium tuberculosis
RRTDAESVAGQV

SEQ ID NO: 1423141 - protein, 6 aa, Mycobacterium tuberculosis
RRTHER

SEQ ID NO: 1423142 - protein, 4 aa, Mycobacterium tuberculosis
RRTL

SEQ ID NO: 1423143 - protein, 6 aa, Mycobacterium tuberculosis
RRTLDT

SEQ ID NO: 1423144 - protein, 23 aa, Mycobacterium tuberculosis
RRVAEAPKTAGLPGTEGQYRSDF

SEQ ID NO: 1423145 - protein, 6 aa, Mycobacterium tuberculosis
RSHPGV

SEQ ID NO: 1423146 - protein, 4 aa, Mycobacterium tuberculosis
RSIG

SEQ ID NO: 1423147 - protein, 4 aa, Mycobacterium tuberculosis
RSLG

SEQ ID NO: 1423148 - protein, 6 aa, Mycobacterium tuberculosis
RSPITK

SEQ ID NO: 1423149 - protein, 15 aa, Mycobacterium tuberculosis
RSVNEGFSGGEKKRH

SEQ ID NO: 1423150 - protein, 11 aa, Mycobacterium tuberculosis
RTDDGRISQRN

SEQ ID NO: 1423151 - protein, 10 aa, Mycobacterium tuberculosis
RTDPSAPKHN

SEQ ID NO: 1423152 - protein, 7 aa, Mycobacterium tuberculosis
RTELGNP

SEQ ID NO: 1423153 - protein, 7 aa, Mycobacterium tuberculosis
RTGDPLA

SEQ ID NO: 1423154 - protein, 7 aa, Mycobacterium tuberculosis
RTPEYGG

SEQ ID NO: 1423155 - protein, 16 aa, Mycobacterium tuberculosis
RTPKALPDGVSQATVG

SEQ ID NO: 1423156 - protein, 4 aa, Mycobacterium tuberculosis
RTQD

SEQ ID NO: 1423157 - protein, 7 aa, Mycobacterium tuberculosis
RTRSPAA

SEQ ID NO: 1423158 - protein, 8 aa, Mycobacterium tuberculosis
RTTSTSLP

SEQ ID NO: 1423159 - protein, 4 aa, Mycobacterium tuberculosis
RTYP

SEQ ID NO: 1423160 - protein, 9 aa, Mycobacterium tuberculosis
RVHTPDGPS

SEQ ID NO: 1423161 - protein, 6 aa, Mycobacterium tuberculosis
RVQGAD

SEQ ID NO: 1423162 - protein, 8 aa, Mycobacterium tuberculosis
RVRSQAAG

SEQ ID NO: 1423163 - protein, 12 aa, Mycobacterium tuberculosis
RYRDASGKPQIA

SEQ ID NO: 1423164 - protein, 37 aa, Mycobacterium tuberculosis
SAAAAGQARAAAAVDAARRAAEGAAGVPAARRGRGLA

SEQ ID NO: 1423165 - protein, 9 aa, Mycobacterium tuberculosis
SAAAAPRFH

SEQ ID NO: 1423166 - protein, 21 aa, Mycobacterium tuberculosis
SAAGDTDAWEQTVGDGVGDAP

SEQ ID NO: 1423167 - protein, 6 aa, Mycobacterium tuberculosis
SAAPAG

SEQ ID NO: 1423168 - protein, 7 aa, Mycobacterium tuberculosis
SAAVATN

SEQ ID NO: 1423169 - protein, 4 aa, Mycobacterium tuberculosis
SAEL

SEQ ID NO: 1423170 - protein, 6 aa, Mycobacterium tuberculosis
SAHGIN

SEQ ID NO: 1423171 - protein, 7 aa, Mycobacterium tuberculosis
SALPTYN

SEQ ID NO: 1423172 - protein, 5 aa, Mycobacterium tuberculosis
SAQLG

SEQ ID NO: 1423173 - protein, 8 aa, Mycobacterium tuberculosis
SARSYRGT

SEQ ID NO: 1423174 - protein, 8 aa, Mycobacterium tuberculosis
SAVPIEPD

SEQ ID NO: 1423175 - protein, 4 aa, Mycobacterium tuberculosis
SDDT

SEQ ID NO: 1423176 - protein, 5 aa, Mycobacterium tuberculosis
SDGAP

SEQ ID NO: 1423177 - protein, 12 aa, Mycobacterium tuberculosis
SDLPTEPHPSRE

SEQ ID NO: 1423178 - protein, 5 aa, Mycobacterium tuberculosis
SDVQA

SEQ ID NO: 1423179 - protein, 7 aa, Mycobacterium tuberculosis
SEAGPAR

SEQ ID NO: 1423180 - protein, 15 aa, Mycobacterium tuberculosis
SEGLGGGSVSAGIGR

SEQ ID NO: 1423181 - protein, 5 aa, Mycobacterium tuberculosis
SEGTL

SEQ ID NO: 1423182 - protein, 14 aa, Mycobacterium tuberculosis
SEPYDDDSGWGDVP

SEQ ID NO: 1423183 - protein, 6 aa, Mycobacterium tuberculosis
SERGRV

SEQ ID NO: 1423184 - protein, 6 aa, Mycobacterium tuberculosis
SGDNQI

SEQ ID NO: 1423185 - protein, 11 aa, Mycobacterium tuberculosis
SGDRPNLEQGG

SEQ ID NO: 1423186 - protein, 155 aa, Mycobacterium tuberculosis; identical to SEQ ID NO: 187381

SEQ ID NO: 1423187 - protein, 22 aa, Mycobacterium tuberculosis
SGGANACTGPAGFADTHATAEA

SEQ ID NO: 1423188 - protein, 8 aa, Mycobacterium tuberculosis
SGGTPPFD

SEQ ID NO: 1423189 - protein, 7 aa, Mycobacterium tuberculosis
SGGVSSL

SEQ ID NO: 1423190 - protein, 5 aa, Mycobacterium tuberculosis
SGIRT

SEQ ID NO: 1423191 - protein, 11 aa, Mycobacterium tuberculosis
SGLPGGGPEVA

SEQ ID NO: 1423192 - protein, 10 aa, Mycobacterium tuberculosis
SGPSDATGIP

SEQ ID NO: 1423193 - protein, 5 aa, Mycobacterium tuberculosis
SGSGE

SEQ ID NO: 1423194 - protein, 5 aa, Mycobacterium tuberculosis
SGSYS

SEQ ID NO: 1423195 - protein, 5 aa, Mycobacterium tuberculosis
SGVSV

SEQ ID NO: 1423196 - protein, 9 aa, Mycobacterium tuberculosis
SHNPATDNG

SEQ ID NO: 1423197 - protein, 14 aa, Mycobacterium tuberculosis
SLHGDTALGRPVGK

SEQ ID NO: 1423198 - protein, 5 aa, Mycobacterium tuberculosis
SNRAD

SEQ ID NO: 1423199 - protein, 8 aa, Mycobacterium tuberculosis
SNVPVYPG

SEQ ID NO: 1423200 - protein, 8 aa, Mycobacterium tuberculosis
SPDQRQER

SEQ ID NO: 1423201 - protein, 8 aa, Mycobacterium tuberculosis
SPGGSDAS

SEQ ID NO: 1423202 - protein, 7 aa, Mycobacterium tuberculosis
SPQSTVI

SEQ ID NO: 1423203 - protein, 15 aa, Mycobacterium tuberculosis
SPSQALRSARPHPFA

SEQ ID NO: 1423204 - protein, 6 aa, Mycobacterium tuberculosis
SQLRDT

SEQ ID NO: 1423205 - protein, 24 aa, Mycobacterium tuberculosis
SQRWEPPGQFGAARTDTGWPGRSV

SEQ ID NO: 1423206 - protein, 5 aa, Mycobacterium tuberculosis
SRASR

SEQ ID NO: 1423207 - protein, 4 aa, Mycobacterium tuberculosis
SRCR

SEQ ID NO: 1423208 - protein, 7 aa, Mycobacterium tuberculosis
SRDTTKL

SEQ ID NO: 1423209 - protein, 6 aa, Mycobacterium tuberculosis
SREARA

SEQ ID NO: 1423210 - protein, 5 aa, Mycobacterium tuberculosis
SREHP

SEQ ID NO: 1423211 - protein, 6 aa, Mycobacterium tuberculosis
SRGDVG

SEQ ID NO: 1423212 - protein, 7 aa, Mycobacterium tuberculosis
SRGNPTV

SEQ ID NO: 1423213 - protein, 10 aa, Mycobacterium tuberculosis
SRGYRGQRSR

SEQ ID NO: 1423214 - protein, 17 aa, Mycobacterium tuberculosis
SRRPKDLATKQAAASVG

SEQ ID NO: 1423215 - protein, 10 aa, Mycobacterium tuberculosis
SRSSPRAGDG

SEQ ID NO: 1423216 - protein, 9 aa, Mycobacterium tuberculosis
SRTQPTQKM

SEQ ID NO: 1423217 - protein, 11 aa, Mycobacterium tuberculosis
SSADQRSDLDR

SEQ ID NO: 1423218 - protein, 17 aa, Mycobacterium tuberculosis
SSFRGSDKRGGANGGRI

SEQ ID NO: 1423219 - protein, 6 aa, Mycobacterium tuberculosis
SSPAND

SEQ ID NO: 1423220 - protein, 12 aa, Mycobacterium tuberculosis
SSRFRKPLNPQK

SEQ ID NO: 1423221 - protein, 6 aa, Mycobacterium tuberculosis
STGRSI

SEQ ID NO: 1423222 - protein, 10 aa, Mycobacterium tuberculosis
STNSAQLHTD

SEQ ID NO: 1423223 - protein, 9 aa, Mycobacterium tuberculosis
STPIPPGED

SEQ ID NO: 1423224 - protein, 6 aa, Mycobacterium tuberculosis
STWDRR

SEQ ID NO: 1423225 - protein, 11 aa, Mycobacterium tuberculosis
STWPTRSVGPR

SEQ ID NO: 1423226 - protein, 4 aa, Mycobacterium tuberculosis
SVHT

SEQ ID NO: 1423227 - protein, 11 aa, Mycobacterium tuberculosis
SVRTGDRRMSQ

SEQ ID NO: 1423228 - protein, 8 aa, Mycobacterium tuberculosis
SWTEPKGG

SEQ ID NO: 1423229 - protein, 7 aa, Mycobacterium tuberculosis
TAAAQAV

SEQ ID NO: 1423230 - protein, 20 aa, Mycobacterium tuberculosis
TAAATDTHGPPPDHNDDPPP

SEQ ID NO: 1423231 - protein, 7 aa, Mycobacterium tuberculosis
TAAGGLD

SEQ ID NO: 1423232 - protein, 17 aa, Mycobacterium tuberculosis
TAGQAEQAGMQARAAAA

SEQ ID NO: 1423233 - protein, 7 aa, Mycobacterium tuberculosis
TANDIQA

SEQ ID NO: 1423234 - protein, 9 aa, Mycobacterium tuberculosis
TAPQAPDLS

SEQ ID NO: 1423235 - protein, 17 aa, Mycobacterium tuberculosis
TASGGTVINGQTSGIGN

SEQ ID NO: 1423236 - protein, 9 aa, Mycobacterium tuberculosis
TATALREDT

SEQ ID NO: 1423237 - protein, 7 aa, Mycobacterium tuberculosis
TCRETPD

SEQ ID NO: 1423238 - protein, 11 aa, Mycobacterium tuberculosis
TDAGPAPEFTD

SEQ ID NO: 1423239 - protein, 6 aa, Mycobacterium tuberculosis
TDDTKL

SEQ ID NO: 1423240 - protein, 18 aa, Mycobacterium tuberculosis
TDFSGSDRGGYRDLAGSE

SEQ ID NO: 1423241 - protein, 7 aa, Mycobacterium tuberculosis
TDIDPAA

SEQ ID NO: 1423242 - protein, 4 aa, Mycobacterium tuberculosis
TDKY

SEQ ID NO: 1423243 - protein, 23 aa, Mycobacterium tuberculosis
TDPMSAPAQPAPGVDGGDPSQAR

SEQ ID NO: 1423244 - protein, 8 aa, Mycobacterium tuberculosis
TDSPGAEA

SEQ ID NO: 1423245 - protein, 8 aa, Mycobacterium tuberculosis
TEDTGAAQ

SEQ ID NO: 1423246 - protein, 4 aa, Mycobacterium tuberculosis
TEQQ

SEQ ID NO: 1423247 - protein, 16 aa, Mycobacterium tuberculosis
TGANAAGATDAGATDA

SEQ ID NO: 1423248 - protein, 6 aa, Mycobacterium tuberculosis
TGGKHR

SEQ ID NO: 1423249 - protein, 7 aa, Mycobacterium tuberculosis
TGHRANL

SEQ ID NO: 1423250 - protein, 13 aa, Mycobacterium tuberculosis
TGIANPGSYNTGS

SEQ ID NO: 1423251 - protein, 12 aa, Mycobacterium tuberculosis
TGIGGLNSGAGN

SEQ ID NO: 1423252 - protein, 12 aa, Mycobacterium tuberculosis
TGIPASAWRGRY

SEQ ID NO: 1423253 - protein, 9 aa, Mycobacterium tuberculosis
TGIQTAKPS

SEQ ID NO: 1423254 - protein, 16 aa, Mycobacterium tuberculosis
TGKPAELDRDEPRRVA

SEQ ID NO: 1423255 - protein, 8 aa, Mycobacterium tuberculosis
TGMGRSTA

SEQ ID NO: 1423256 - protein, 5 aa, Mycobacterium tuberculosis
TGPAM

SEQ ID NO: 1423257 - protein, 4 aa, Mycobacterium tuberculosis
TGPD

SEQ ID NO: 1423258 - protein, 5 aa, Mycobacterium tuberculosis
TGPYT

SEQ ID NO: 1423259 - protein, 7 aa, Mycobacterium tuberculosis
THDVNST

SEQ ID NO: 1423260 - protein, 39 aa, Mycobacterium tuberculosis
TIQQSGTAGDGGGGRRQDSRRRNGPRRPARRGTSRGRRC

SEQ ID NO: 1423261 - protein, 10 aa, Mycobacterium tuberculosis
TKDGTLGGPN

SEQ ID NO: 1423262 - protein, 9 aa, Mycobacterium tuberculosis
TKDWSQAKD

SEQ ID NO: 1423263 - protein, 8 aa, Mycobacterium tuberculosis
TKSPAGAW

SEQ ID NO: 1423264 - protein, 17 aa, Mycobacterium tuberculosis
TKTTARGVQTIGGAARG

SEQ ID NO: 1423265 - protein, 11 aa, Mycobacterium tuberculosis
TLGEDMQQAPP

SEQ ID NO: 1423266 - protein, 4 aa, Mycobacterium tuberculosis
TLGG

SEQ ID NO: 1423267 - protein, 10 aa, Mycobacterium tuberculosis
TNENPHPPTR

SEQ ID NO: 1423268 - protein, 5 aa, Mycobacterium tuberculosis
TPERL

SEQ ID NO: 1423269 - protein, 5 aa, Mycobacterium tuberculosis
TPESV

SEQ ID NO: 1423270 - protein, 8 aa, Mycobacterium tuberculosis
TPGDPALA

SEQ ID NO: 1423271 - protein, 4 aa, Mycobacterium tuberculosis
TPIG

SEQ ID NO: 1423272 - protein, 6 aa, Mycobacterium tuberculosis
TPPSRN

SEQ ID NO: 1423273 - protein, 8 aa, Mycobacterium tuberculosis
TPQERADR

SEQ ID NO: 1423274 - protein, 12 aa, Mycobacterium tuberculosis
TPTDDNLYQTSK

SEQ ID NO: 1423275 - protein, 6 aa, Mycobacterium tuberculosis
TPTKWD

SEQ ID NO: 1423276 - protein, 11 aa, Mycobacterium tuberculosis
TQISAAGSFGR

SEQ ID NO: 1423277 - protein, 8 aa, Mycobacterium tuberculosis
TQSVGDET

SEQ ID NO: 1423278 - protein, 5 aa, Mycobacterium tuberculosis
TRPGG

SEQ ID NO: 1423279 - protein, 5 aa, Mycobacterium tuberculosis
TSESH

SEQ ID NO: 1423280 - protein, 8 aa, Mycobacterium tuberculosis
TSGDSGDL

SEQ ID NO: 1423281 - protein, 13 aa, Mycobacterium tuberculosis
TSGPGFGHTRNPW

SEQ ID NO: 1423282 - protein, 13 aa, Mycobacterium tuberculosis
TSRNGAGPAPDAP

SEQ ID NO: 1423283 - protein, 4 aa, Mycobacterium tuberculosis
TSSY

SEQ ID NO: 1423284 - protein, 10 aa, Mycobacterium tuberculosis
TTPVGVAGSS

SEQ ID NO: 1423285 - protein, 5 aa, Mycobacterium tuberculosis
TTPVT

SEQ ID NO: 1423286 - protein, 24 aa, Mycobacterium tuberculosis
TTRAGRPPGTVTADRGYGEKRVED

SEQ ID NO: 1423287 - protein, 8 aa, Mycobacterium tuberculosis
TVGGGQIN

SEQ ID NO: 1423288 - protein, 9 aa, Mycobacterium tuberculosis
TVTGGSANY

SEQ ID NO: 1423289 - protein, 7 aa, Mycobacterium tuberculosis
TYGPDRV

SEQ ID NO: 1423290 - protein, 9 aa, Mycobacterium tuberculosis
VAAASGSDI

SEQ ID NO: 1423291 - protein, 9 aa, Mycobacterium tuberculosis
VAEQRGRRG

SEQ ID NO: 1423292 - protein, 7 aa, Mycobacterium tuberculosis
VAPATDD

SEQ ID NO: 1423293 - protein, 5 aa, Mycobacterium tuberculosis
VAPGT

SEQ ID NO: 1423294 - protein, 11 aa, Mycobacterium tuberculosis
VDESESAESFE

SEQ ID NO: 1423295 - protein, 8 aa, Mycobacterium tuberculosis
VDPAGDGG

SEQ ID NO: 1423296 - protein, 4 aa, Mycobacterium tuberculosis
VDPL

SEQ ID NO: 1423297 - protein, 5 aa, Mycobacterium tuberculosis
VDSPA

SEQ ID NO: 1423298 - protein, 8 aa, Mycobacterium tuberculosis
VERYGASE

SEQ ID NO: 1423299 - protein, 15 aa, Mycobacterium tuberculosis
VESDEVGLANAGSTV

SEQ ID NO: 1423300 - protein, 10 aa, Mycobacterium tuberculosis
VGDGGLPAEL

SEQ ID NO: 1423301 - protein, 6 aa, Mycobacterium tuberculosis
VGHRDD

SEQ ID NO: 1423302 - protein, 9 aa, Mycobacterium tuberculosis
VGTGLSERE

SEQ ID NO: 1423303 - protein, 4 aa, Mycobacterium tuberculosis
VGTQ

SEQ ID NO: 1423304 - protein, 8 aa, Mycobacterium tuberculosis
VKGSQLGL

SEQ ID NO: 1423305 - protein, 13 aa, Mycobacterium tuberculosis
VKPTSVPAFRPGA

SEQ ID NO: 1423306 - protein, 10 aa, Mycobacterium tuberculosis
VKSDQSEQVA

SEQ ID NO: 1423307 - protein, 13 aa, Mycobacterium tuberculosis
VPAQTEQQRNDAL

SEQ ID NO: 1423308 - protein, 7 aa, Mycobacterium tuberculosis
VQEGDDV

SEQ ID NO: 1423309 - protein, 11 aa, Mycobacterium tuberculosis
VQGPVSKVSTE

SEQ ID NO: 1423310 - protein, 7 aa, Mycobacterium tuberculosis
VRNYDGS

SEQ ID NO: 1423311 - protein, 14 aa, Mycobacterium tuberculosis
VSADEFASDPARFG

SEQ ID NO: 1423312 - protein, 9 aa, Mycobacterium tuberculosis
VSTSTTELQ

SEQ ID NO: 1423313 - protein, 7 aa, Mycobacterium tuberculosis
VTKPYPP

SEQ ID NO: 1423314 - protein, 7 aa, Mycobacterium tuberculosis
VTRRGYG

SEQ ID NO: 1423315 - protein, 9 aa, Mycobacterium tuberculosis
VTSGDPRAA

SEQ ID NO: 1423316 - protein, 5 aa, Mycobacterium tuberculosis
VTTAN

SEQ ID NO: 1423317 - protein, 14 aa, Mycobacterium tuberculosis
WADGGPTSAHNGLG

SEQ ID NO: 1423318 - protein, 9 aa, Mycobacterium tuberculosis
WPGSSDRNF

SEQ ID NO: 1423319 - protein, 7 aa, Mycobacterium tuberculosis
WQGDTGI

SEQ ID NO: 1423320 - protein, 9 aa, Mycobacterium tuberculosis
WRNDDGGEF

SEQ ID NO: 1423321 - protein, 7 aa, Mycobacterium tuberculosis
WRSAPEH

SEQ ID NO: 1423322 - protein, 6 aa, Mycobacterium tuberculosis
WSGYSS

SEQ ID NO: 1423323 - protein, 16 aa, Mycobacterium tuberculosis
YEGQSAVKTAKTIDQA

SEQ ID NO: 1423324 - protein, 8 aa, Mycobacterium tuberculosis
YGNEAAVG

SEQ ID NO: 1423325 - protein, 12 aa, Mycobacterium tuberculosis
YGSRSTPVSGGA

SEQ ID NO: 1423326 - protein, 6 aa, Mycobacterium tuberculosis
YGVKRG

SEQ ID NO: 1423327 - protein, 7 aa, Mycobacterium tuberculosis
YGVTPKG

SEQ ID NO: 1423328 - protein, 9 aa, Mycobacterium tuberculosis
YHSGKAEVR

SEQ ID NO: 1423329 - protein, 5 aa, Mycobacterium tuberculosis
YPGTP

SEQ ID NO: 1423330 - protein, 17 aa, Mycobacterium tuberculosis
YPTTTEAQDSTLSPRGY

SEQ ID NO: 1423331 - protein, 4 aa, Mycobacterium tuberculosis
YQDR

SEQ ID NO: 1423332 - protein, 6 aa, Mycobacterium tuberculosis
YQQRSE

SEQ ID NO: 1423333 - protein, 7 aa, Mycobacterium tuberculosis
YRAQPDR

SEQ ID NO: 1423334 - protein, 8 aa, Mycobacterium tuberculosis
YRKPNEDH

SEQ ID NO: 1423335 - protein, 6 aa, Mycobacterium tuberculosis
YSPGPH

SEQ ID NO: 1423336 - protein, 4 aa, Mycobacterium tuberculosis
YTAN

SEQ ID NO: 1423337 - protein, 7 aa, Mycobacterium tuberculosis
YTATEAT

SEQ ID NO: 1423338 - protein, 11 aa, Mycobacterium tuberculosis
YTDVTSPTELS

SEQ ID NO: 1423339 - protein, 9 aa, Mycobacterium tuberculosis
AAAAEPAKS

SEQ ID NO: 1423340 - protein, 6 aa, Mycobacterium tuberculosis
AAAATD

SEQ ID NO: 1423341 - protein, 6 aa, Mycobacterium tuberculosis
AAAQLD

SEQ ID NO: 1423342 - protein, 16 aa, Mycobacterium tuberculosis
AAASYASVEAANASPL

SEQ ID NO: 1423343 - protein, 19 aa, Mycobacterium tuberculosis
AAATGRPDRLPGVGSSSHI

SEQ ID NO: 1423344 - protein, 9 aa, Mycobacterium tuberculosis
AADVPDQSG

SEQ ID NO: 1423345 - protein, 12 aa, Mycobacterium tuberculosis
AAEGQVSRQNPT

SEQ ID NO: 1423346 - protein, 6 aa, Mycobacterium tuberculosis
AAETEL

SEQ ID NO: 1423347 - protein, 17 aa, Mycobacterium tuberculosis
AAGNAYAHAEAANAARV

SEQ ID NO: 1423348 - protein, 21 aa, Mycobacterium tuberculosis
AAGNGKATAAPAKAADSGGAA

SEQ ID NO: 1423349 - protein, 6 aa, Mycobacterium tuberculosis
AAGQKG

SEQ ID NO: 1423350 - protein, 7 aa, Mycobacterium tuberculosis
AAGYASE

SEQ ID NO: 1423351 - protein, 10 aa, Mycobacterium tuberculosis
AAHSDGAAIR

SEQ ID NO: 1423352 - protein, 4 aa, Mycobacterium tuberculosis
AAIP

SEQ ID NO: 1423353 - protein, 8 aa, Mycobacterium tuberculosis
AALRSGTA

SEQ ID NO: 1423354 - protein, 23 aa, Mycobacterium tuberculosis
AANAAAAVPTTGALAPAADEVSA

SEQ ID NO: 1423355 - protein, 7 aa, Mycobacterium tuberculosis
AAPAYTA

SEQ ID NO: 1423356 - protein, 7 aa, Mycobacterium tuberculosis
AAPLAAG

SEQ ID NO: 1423357 - protein, 17 aa, Mycobacterium tuberculosis
AAPRRVPEPIDTQRMPE

SEQ ID NO: 1423358 - protein, 4 aa, Mycobacterium tuberculosis
AAPV

SEQ ID NO: 1423359 - protein, 18 aa, Mycobacterium tuberculosis
AAPVAGPEVAANRAGRQA

SEQ ID NO: 1423360 - protein, 8 aa, Mycobacterium tuberculosis
AAQGAMAS

SEQ ID NO: 1423361 - protein, 8 aa, Mycobacterium tuberculosis
AAQGNYAD

SEQ ID NO: 1423362 - protein, 6 aa, Mycobacterium tuberculosis
AAREPD

SEQ ID NO: 1423363 - protein, 7 aa, Mycobacterium tuberculosis
AASATPL

SEQ ID NO: 1423364 - protein, 8 aa, Mycobacterium tuberculosis
AASDRVRD

SEQ ID NO: 1423365 - protein, 5 aa, Mycobacterium tuberculosis
AATEA

SEQ ID NO: 1423366 - protein, 8 aa, Mycobacterium tuberculosis
AAYDGPGV

SEQ ID NO: 1423367 - protein, 16 aa, Mycobacterium tuberculosis
ADPARGPGRYHRTGEP

SEQ ID NO: 1423368 - protein, 4 aa, Mycobacterium tuberculosis
ADTG

SEQ ID NO: 1423369 - protein, 6 aa, Mycobacterium tuberculosis
AEFDGQ

SEQ ID NO: 1423370 - protein, 6 aa, Mycobacterium tuberculosis
AENGHE

SEQ ID NO: 1423371 - protein, 7 aa, Mycobacterium tuberculosis
AEPRYGE

SEQ ID NO: 1423372 - protein, 8 aa, Mycobacterium tuberculosis
AERARARG

SEQ ID NO: 1423373 - protein, 6 aa, Mycobacterium tuberculosis
AESQYD

SEQ ID NO: 1423374 - protein, 8 aa, Mycobacterium tuberculosis
AGAGSGAL

SEQ ID NO: 1423375 - protein, 10 aa, Mycobacterium tuberculosis
AGARTRRAGV

SEQ ID NO: 1423376 - protein, 10 aa, Mycobacterium tuberculosis
AGATVTQTDA

SEQ ID NO: 1423377 - protein, 22 aa, Mycobacterium tuberculosis
AGEGDPGATRAAGEEARSLADE

SEQ ID NO: 1423378 - protein, 7 aa, Mycobacterium tuberculosis
AGEPGAP

SEQ ID NO: 1423379 - protein, 4 aa, Mycobacterium tuberculosis
AGGF

SEQ ID NO: 1423380 - protein, 7 aa, Mycobacterium tuberculosis
AGGGVDV

SEQ ID NO: 1423381 - protein, 7 aa, Mycobacterium tuberculosis
AGGTGLN

SEQ ID NO: 1423382 - protein, 7 aa, Mycobacterium tuberculosis
AGKLETI

SEQ ID NO: 1423383 - protein, 7 aa, Mycobacterium tuberculosis
AGLAGSS

SEQ ID NO: 1423384 - protein, 4 aa, Mycobacterium tuberculosis
AGMS

SEQ ID NO: 1423385 - protein, 10 aa, Mycobacterium tuberculosis
AGPPPTPSRV

SEQ ID NO: 1423386 - protein, 6 aa, Mycobacterium tuberculosis
AGPTEQ

SEQ ID NO: 1423387 - protein, 7 aa, Mycobacterium tuberculosis
AGPTEQI

SEQ ID NO: 1423388 - protein, 31 aa, Mycobacterium tuberculosis
AGSGNVGSYNVGAGNVGSYNVGGGNIGGNNV

SEQ ID NO: 1423389 - protein, 7 aa, Mycobacterium tuberculosis
AGSLEAE

SEQ ID NO: 1423390 - protein, 10 aa, Mycobacterium tuberculosis
AHEDDSFDEE

SEQ ID NO: 1423391 - protein, 20 aa, Mycobacterium tuberculosis
AHPPTDQNTPAEGRRRYTTS

SEQ ID NO: 1423392 - protein, 7 aa, Mycobacterium tuberculosis
AHQRPGA

SEQ ID NO: 1423393 - protein, 12 aa, Mycobacterium tuberculosis
AIATERAGKPVQ

SEQ ID NO: 1423394 - protein, 14 aa, Mycobacterium tuberculosis
AKGEPTPQDGYAGS

SEQ ID NO: 1423395 - protein, 7 aa, Mycobacterium tuberculosis
AKLPQDR

SEQ ID NO: 1423396 - protein, 7 aa, Mycobacterium tuberculosis
ALPEPAR

SEQ ID NO: 1423397 - protein, 4 aa, Mycobacterium tuberculosis
AMPT

SEQ ID NO: 1423398 - protein, 8 aa, Mycobacterium tuberculosis
ANAYESAY

SEQ ID NO: 1423399 - protein, 6 aa, Mycobacterium tuberculosis
ANLGNT

SEQ ID NO: 1423400 - protein, 5 aa, Mycobacterium tuberculosis
ANVTA

SEQ ID NO: 1423401 - protein, 5 aa, Mycobacterium tuberculosis
APEST

SEQ ID NO: 1423402 - protein, 5 aa, Mycobacterium tuberculosis
APRSA

SEQ ID NO: 1423403 - protein, 22 aa, Mycobacterium tuberculosis
APVTPSDAPTPSGTPTTTNGPG

SEQ ID NO: 1423404 - protein, 6 aa, Mycobacterium tuberculosis
AQGEEI

SEQ ID NO: 1423405 - protein, 9 aa, Mycobacterium tuberculosis
AQSVPGSQF

SEQ ID NO: 1423406 - protein, 5 aa, Mycobacterium tuberculosis
AQTHV

SEQ ID NO: 1423407 - protein, 12 aa, Mycobacterium tuberculosis
ARDYAQADRTEL

SEQ ID NO: 1423408 - protein, 9 aa, Mycobacterium tuberculosis
ARGKGISDI

SEQ ID NO: 1423409 - protein, 8 aa, Mycobacterium tuberculosis
ARLDESVP

SEQ ID NO: 1423410 - protein, 7 aa, Mycobacterium tuberculosis
ARNRHTA

SEQ ID NO: 1423411 - protein, 18 aa, Mycobacterium tuberculosis
ARQALADRRAANCCVLSG

SEQ ID NO: 1423412 - protein, 4 aa, Mycobacterium tuberculosis
ARRQ

SEQ ID NO: 1423413 - protein, 7 aa, Mycobacterium tuberculosis
ARSGQPV

SEQ ID NO: 1423414 - protein, 6 aa, Mycobacterium tuberculosis
ARTATR

SEQ ID NO: 1423415 - protein, 26 aa, Mycobacterium tuberculosis
ASATRSSAGFGAPRYGAKPIVMPKPA

SEQ ID NO: 1423416 - protein, 5 aa, Mycobacterium tuberculosis
ASEPV

SEQ ID NO: 1423417 - protein, 7 aa, Mycobacterium tuberculosis
ASEQGRG

SEQ ID NO: 1423418 - protein, 7 aa, Mycobacterium tuberculosis
ASGPSLA

SEQ ID NO: 1423419 - protein, 15 aa, Mycobacterium tuberculosis
ASGPVPPVDPQRLNA

SEQ ID NO: 1423420 - protein, 6 aa, Mycobacterium tuberculosis
ASGRRK

SEQ ID NO: 1423421 - protein, 6 aa, Mycobacterium tuberculosis
ASLEAE

SEQ ID NO: 1423422 - protein, 10 aa, Mycobacterium tuberculosis
ASLKKGQTVR

SEQ ID NO: 1423423 - protein, 6 aa, Mycobacterium tuberculosis
ASLSDF

SEQ ID NO: 1423424 - protein, 21 aa, Mycobacterium tuberculosis
ASRARSRCTKGSRRYRERTTE

SEQ ID NO: 1423425 - protein, 13 aa, Mycobacterium tuberculosis
ASRPADLYGRRSR

SEQ ID NO: 1423426 - protein, 8 aa, Mycobacterium tuberculosis
ASSSQGTI

SEQ ID NO: 1423427 - protein, 19 aa, Mycobacterium tuberculosis
ASWSTAAPATAAGAALDGT

SEQ ID NO: 1423428 - protein, 10 aa, Mycobacterium tuberculosis
ATADGTAIEQ

SEQ ID NO: 1423429 - protein, 16 aa, Mycobacterium tuberculosis
ATATRRVNTIAELARR

SEQ ID NO: 1423430 - protein, 11 aa, Mycobacterium tuberculosis
ATDARRHTRAE

SEQ ID NO: 1423431 - protein, 10 aa, Mycobacterium tuberculosis
ATESNPTAAS

SEQ ID NO: 1423432 - protein, 11 aa, Mycobacterium tuberculosis
ATSAVAASRAA

SEQ ID NO: 1423433 - protein, 12 aa, Mycobacterium tuberculosis
ATTNPAGSTGDG

SEQ ID NO: 1423434 - protein, 12 aa, Mycobacterium tuberculosis
ATTRSGALTGPL

SEQ ID NO: 1423435 - protein, 10 aa, Mycobacterium tuberculosis
ATVGGSGAIN

SEQ ID NO: 1423436 - protein, 4 aa, Mycobacterium tuberculosis
ATVS

SEQ ID NO: 1423437 - protein, 11 aa, Mycobacterium tuberculosis
AVGHDGKAVPV

SEQ ID NO: 1423438 - protein, 9 aa, Mycobacterium tuberculosis
AVGQAGASA

SEQ ID NO: 1423439 - protein, 51 aa, Mycobacterium tuberculosis
AVSPPVGDPGDATGATDATDLPEAGDLPYEPPAPNGHPNGDAPLCSGPGCP

SEQ ID NO: 1423440 - protein, 26 aa, Mycobacterium tuberculosis
CGQPNTGRSRTGYRSGDPRIKGENAY

SEQ ID NO: 1423441 - protein, 5 aa, Mycobacterium tuberculosis
CPKDK

SEQ ID NO: 1423442 - protein, 9 aa, Mycobacterium tuberculosis
CQGRQVDDD

SEQ ID NO: 1423443 - protein, 15 aa, Mycobacterium tuberculosis
DAPHGSKQANTGGSI

SEQ ID NO: 1423444 - protein, 8 aa, Mycobacterium tuberculosis
DDDGTERK

SEQ ID NO: 1423445 - protein, 10 aa, Mycobacterium tuberculosis
DDNAKPANSH

SEQ ID NO: 1423446 - protein, 23 aa, Mycobacterium tuberculosis
DDVAPDADDDLDSGDDEDHEDLE

SEQ ID NO: 1423447 - protein, 13 aa, Mycobacterium tuberculosis
DDVGRDQFPDADV

SEQ ID NO: 1423448 - protein, 8 aa, Mycobacterium tuberculosis
DDYTTTQA

SEQ ID NO: 1423449 - protein, 6 aa, Mycobacterium tuberculosis
DEAQGA

SEQ ID NO: 1423450 - protein, 9 aa, Mycobacterium tuberculosis
DEDFAKPQI

SEQ ID NO: 1423451 - protein, 7 aa, Mycobacterium tuberculosis
DEEIGYG

SEQ ID NO: 1423452 - protein, 7 aa, Mycobacterium tuberculosis
DERTRSH

SEQ ID NO: 1423453 - protein, 7 aa, Mycobacterium tuberculosis
DGAYGAQ

SEQ ID NO: 1423454 - protein, 12 aa, Mycobacterium tuberculosis
DGDAADAAATKI

SEQ ID NO: 1423455 - protein, 77 aa, Mycobacterium tuberculosis; identical to SEQ ID NO: 192314

SEQ ID NO: 1423456 - protein, 6 aa, Mycobacterium tuberculosis
DGGGAV

SEQ ID NO: 1423457 - protein, 6 aa, Mycobacterium tuberculosis
DGPDRD

SEQ ID NO: 1423458 - protein, 8 aa, Mycobacterium tuberculosis
DHDEKGRV

SEQ ID NO: 1423459 - protein, 4 aa, Mycobacterium tuberculosis
DHPI

SEQ ID NO: 1423460 - protein, 8 aa, Mycobacterium tuberculosis
DHRSAEGA

SEQ ID NO: 1423461 - protein, 6 aa, Mycobacterium tuberculosis
DIASEQ

SEQ ID NO: 1423462 - protein, 6 aa, Mycobacterium tuberculosis
DIPEGK

SEQ ID NO: 1423463 - protein, 8 aa, Mycobacterium tuberculosis
DKAARTLT

SEQ ID NO: 1423464 - protein, 17 aa, Mycobacterium tuberculosis
DKPCLPGGEVPVGGGHQ

SEQ ID NO: 1423465 - protein, 14 aa, Mycobacterium tuberculosis
DLEDAAKSLPGKNG

SEQ ID NO: 1423466 - protein, 8 aa, Mycobacterium tuberculosis
DLPPPAAL

SEQ ID NO: 1423467 - protein, 7 aa, Mycobacterium tuberculosis
DLPTNTL

SEQ ID NO: 1423468 - protein, 5 aa, Mycobacterium tuberculosis
DNPEI

SEQ ID NO: 1423469 - protein, 5 aa, Mycobacterium tuberculosis
DNVPK

SEQ ID NO: 1423470 - protein, 8 aa, Mycobacterium tuberculosis
DPAGNTDR

SEQ ID NO: 1423471 - protein, 4 aa, Mycobacterium tuberculosis
DPAM

SEQ ID NO: 1423472 - protein, 8 aa, Mycobacterium tuberculosis
DPATWTEP

SEQ ID NO: 1423473 - protein, 8 aa, Mycobacterium tuberculosis
DPDEPTYD

SEQ ID NO: 1423474 - protein, 17 aa, Mycobacterium tuberculosis
DPDSGGHFGGPSGWGGR

SEQ ID NO: 1423475 - protein, 9 aa, Mycobacterium tuberculosis
DPELSQPWE

SEQ ID NO: 1423476 - protein, 18 aa, Mycobacterium tuberculosis
DPKPREGTETRRWPVNRR

SEQ ID NO: 1423477 - protein, 5 aa, Mycobacterium tuberculosis
DPRLT

SEQ ID NO: 1423478 - protein, 5 aa, Mycobacterium tuberculosis
DPSMV

SEQ ID NO: 1423479 - protein, 9 aa, Mycobacterium tuberculosis
DQAAAGALK

SEQ ID NO: 1423480 - protein, 11 aa, Mycobacterium tuberculosis
DQATDKQLAAR

SEQ ID NO: 1423481 - protein, 5 aa, Mycobacterium tuberculosis
DRDAM

SEQ ID NO: 1423482 - protein, 15 aa, Mycobacterium tuberculosis
DRQEVDNALNQAAKE

SEQ ID NO: 1423483 - protein, 8 aa, Mycobacterium tuberculosis
DSESPDTQ

SEQ ID NO: 1423484 - protein, 4 aa, Mycobacterium tuberculosis
DSNT

SEQ ID NO: 1423485 - protein, 7 aa, Mycobacterium tuberculosis
DSSSGRL

SEQ ID NO: 1423486 - protein, 12 aa, Mycobacterium tuberculosis
DSVPGSGGIRGP

SEQ ID NO: 1423487 - protein, 28 aa, Mycobacterium tuberculosis
DTAGGHWPKTARATAETDATANRGAKPS

SEQ ID NO: 1423488 - protein, 7 aa, Mycobacterium tuberculosis
DTPRALY

SEQ ID NO: 1423489 - protein, 4 aa, Mycobacterium tuberculosis
DTRI

SEQ ID NO: 1423490 - protein, 17 aa, Mycobacterium tuberculosis
DVGLSTKTERHRPGQPL

SEQ ID NO: 1423491 - protein, 5 aa, Mycobacterium tuberculosis
EAAIS

SEQ ID NO: 1423492 - protein, 8 aa, Mycobacterium tuberculosis
EADALKAD

SEQ ID NO: 1423493 - protein, 4 aa, Mycobacterium tuberculosis
EAQD

SEQ ID NO: 1423494 - protein, 8 aa, Mycobacterium tuberculosis
EAQRERRK

SEQ ID NO: 1423495 - protein, 14 aa, Mycobacterium tuberculosis
EAQRTADPVEGEQA

SEQ ID NO: 1423496 - protein, 20 aa, Mycobacterium tuberculosis
EASLRAARASSVLDGGPARL

SEQ ID NO: 1423497 - protein, 20 aa, Mycobacterium tuberculosis
EAYHGGHGHSVSDAPGTAAK

SEQ ID NO: 1423498 - protein, 6 aa, Mycobacterium tuberculosis
EDIRNT

SEQ ID NO: 1423499 - protein, 6 aa, Mycobacterium tuberculosis
EDPPMD

SEQ ID NO: 1423500 - protein, 4 aa, Mycobacterium tuberculosis
EEQR

SEQ ID NO: 1423501 - protein, 8 aa, Mycobacterium tuberculosis
EESGGQAP

SEQ ID NO: 1423502 - protein, 8 aa, Mycobacterium tuberculosis
EGQQAKTQ

SEQ ID NO: 1423503 - protein, 5 aa, Mycobacterium tuberculosis
EIAPH

SEQ ID NO: 1423504 - protein, 8 aa, Mycobacterium tuberculosis
ELDDESAA

SEQ ID NO: 1423505 - protein, 9 aa, Mycobacterium tuberculosis
ELEKTKVGL

SEQ ID NO: 1423506 - protein, 8 aa, Mycobacterium tuberculosis
ELRSKPGD

SEQ ID NO: 1423507 - protein, 5 aa, Mycobacterium tuberculosis
EPDLP

SEQ ID NO: 1423508 - protein, 7 aa, Mycobacterium tuberculosis
EPGVGKT

SEQ ID NO: 1423509 - protein, 5 aa, Mycobacterium tuberculosis
EQGEF

SEQ ID NO: 1423510 - protein, 6 aa, Mycobacterium tuberculosis
EQNRSA

SEQ ID NO: 1423511 - protein, 10 aa, Mycobacterium tuberculosis
EQVAKQARDI

SEQ ID NO: 1423512 - protein, 4 aa, Mycobacterium tuberculosis
ERSA

SEQ ID NO: 1423513 - protein, 13 aa, Mycobacterium tuberculosis
ERSPQAAAAHDRA

SEQ ID NO: 1423514 - protein, 8 aa, Mycobacterium tuberculosis
ESAPPTRE

SEQ ID NO: 1423515 - protein, 9 aa, Mycobacterium tuberculosis
ESARGSRRE

SEQ ID NO: 1423516 - protein, 6 aa, Mycobacterium tuberculosis
ESGKMT

SEQ ID NO: 1423517 - protein, 10 aa, Mycobacterium tuberculosis
ESISGTAPSR

SEQ ID NO: 1423518 - protein, 4 aa, Mycobacterium tuberculosis
ESQR

SEQ ID NO: 1423519 - protein, 6 aa, Mycobacterium tuberculosis
ESQTIA

SEQ ID NO: 1423520 - protein, 10 aa, Mycobacterium tuberculosis
ETHGKPPTRR

SEQ ID NO: 1423521 - protein, 15 aa, Mycobacterium tuberculosis
EVGTPEIATEAGVTR

SEQ ID NO: 1423522 - protein, 10 aa, Mycobacterium tuberculosis
EVRGPTGYDG

SEQ ID NO: 1423523 - protein, 8 aa, Mycobacterium tuberculosis
FNSGSENV

SEQ ID NO: 1423524 - protein, 15 aa, Mycobacterium tuberculosis
FNTGIGNSGTGSTGL

SEQ ID NO: 1423525 - protein, 4 aa, Mycobacterium tuberculosis
FTPA

SEQ ID NO: 1423526 - protein, 9 aa, Mycobacterium tuberculosis
GAAGADSRV

SEQ ID NO: 1423527 - protein, 6 aa, Mycobacterium tuberculosis
GAAGNL

SEQ ID NO: 1423528 - protein, 7 aa, Mycobacterium tuberculosis
GAAGSSA

SEQ ID NO: 1423529 - protein, 9 aa, Mycobacterium tuberculosis
GAAHTTAHT

SEQ ID NO: 1423530 - protein, 4 aa, Mycobacterium tuberculosis
GAAQ

SEQ ID NO: 1423531 - protein, 7 aa, Mycobacterium tuberculosis
GACHTGD

SEQ ID NO: 1423532 - protein, 13 aa, Mycobacterium tuberculosis
GADATDIAKRRQQ

SEQ ID NO: 1423533 - protein, 7 aa, Mycobacterium tuberculosis
GADEVSQ

SEQ ID NO: 1423534 - protein, 32 aa, Mycobacterium tuberculosis; identical to SEQ ID NO: 174676

SEQ ID NO: 1423535 - protein, 6 aa, Mycobacterium tuberculosis
GAQPAT

SEQ ID NO: 1423536 - protein, 11 aa, Mycobacterium tuberculosis
GDQTDVPESGD

SEQ ID NO: 1423537 - protein, 6 aa, Mycobacterium tuberculosis
GDRHDR

SEQ ID NO: 1423538 - protein, 13 aa, Mycobacterium tuberculosis
GDRHRAERDAHDA

SEQ ID NO: 1423539 - protein, 4 aa, Mycobacterium tuberculosis
GEDR

SEQ ID NO: 1423540 - protein, 16 aa, Mycobacterium tuberculosis
GEGAGPPVRRAPARTY

SEQ ID NO: 1423541 - protein, 4 aa, Mycobacterium tuberculosis
GEGN

SEQ ID NO: 1423542 - protein, 10 aa, Mycobacterium tuberculosis
GEGVAAKSLE

SEQ ID NO: 1423543 - protein, 7 aa, Mycobacterium tuberculosis
GEHRPTF

SEQ ID NO: 1423544 - protein, 7 aa, Mycobacterium tuberculosis
GEHSDWD

SEQ ID NO: 1423545 - protein, 16 aa, Mycobacterium tuberculosis
GELDPDELAEDEANGL

SEQ ID NO: 1423546 - protein, 7 aa, Mycobacterium tuberculosis
GEPQPEL

SEQ ID NO: 1423547 - protein, 10 aa, Mycobacterium tuberculosis
GEPTDPAGPV

SEQ ID NO: 1423548 - protein, 11 aa, Mycobacterium tuberculosis
GERAELGGDLS

SEQ ID NO: 1423549 - protein, 11 aa, Mycobacterium tuberculosis
GESGSGKSTTL

SEQ ID NO: 1423550 - protein, 17 aa, Mycobacterium tuberculosis
GEVSSPDEGNCVGPTID

SEQ ID NO: 1423551 - protein, 21 aa, Mycobacterium tuberculosis
GGAGGISPNGMGAGGSGGNGG

SEQ ID NO: 1423552 - protein, 18 aa, Mycobacterium tuberculosis
GGAGGNSGGGGGAGGIGG

SEQ ID NO: 1423553 - protein, 8 aa, Mycobacterium tuberculosis
GGALGGNN

SEQ ID NO: 1423554 - protein, 7 aa, Mycobacterium tuberculosis
GGARPTV

SEQ ID NO: 1423555 - protein, 55 aa, Mycobacterium tuberculosis
GGGPGIGFGSGQSAHAKAAASDSAAAESAAQASARAQARAARRGRSAAKARGHRD

SEQ ID NO: 1423556 - protein, 12 aa, Mycobacterium tuberculosis
GGQTVLSGTTSD

SEQ ID NO: 1423557 - protein, 7 aa, Mycobacterium tuberculosis
GGRPPLQ

SEQ ID NO: 1423558 - protein, 4 aa, Mycobacterium tuberculosis
GHGA

SEQ ID NO: 1423559 - protein, 9 aa, Mycobacterium tuberculosis
GIANPRERA

SEQ ID NO: 1423560 - protein, 8 aa, Mycobacterium tuberculosis
GIPARSAQ

SEQ ID NO: 1423561 - protein, 5 aa, Mycobacterium tuberculosis
GISHS

SEQ ID NO: 1423562 - protein, 9 aa, Mycobacterium tuberculosis
GKAKEVPAA

SEQ ID NO: 1423563 - protein, 6 aa, Mycobacterium tuberculosis
GKGEYG

SEQ ID NO: 1423564 - protein, 7 aa, Mycobacterium tuberculosis
GKGTQAV

SEQ ID NO: 1423565 - protein, 6 aa, Mycobacterium tuberculosis
GKGTRL

SEQ ID NO: 1423566 - protein, 12 aa, Mycobacterium tuberculosis
GKSLKNSVSPDE

SEQ ID NO: 1423567 - protein, 16 aa, Mycobacterium tuberculosis
GKVDKDWDADATKGIP

SEQ ID NO: 1423568 - protein, 5 aa, Mycobacterium tuberculosis
GLPDE

SEQ ID NO: 1423569 - protein, 5 aa, Mycobacterium tuberculosis
GLRAR

SEQ ID NO: 1423570 - protein, 16 aa, Mycobacterium tuberculosis
GNANTGIANSGNVDTG

SEQ ID NO: 1423571 - protein, 36 aa, Mycobacterium tuberculosis; identical to SEQ ID NO: 176409

SEQ ID NO: 1423572 - protein, 24 aa, Mycobacterium tuberculosis
GNGNFGSGNLGSGNTGSTNFGGGN

SEQ ID NO: 1423573 - protein, 7 aa, Mycobacterium tuberculosis
GNPKNIR

SEQ ID NO: 1423574 - protein, 14 aa, Mycobacterium tuberculosis
GNQRNTGSTTRPQR

SEQ ID NO: 1423575 - protein, 32 aa, Mycobacterium tuberculosis
GPGPAGGLPPSEVGNPNPATVNPANPTPGLAA

SEQ ID NO: 1423576 - protein, 5 aa, Mycobacterium tuberculosis
GPGRT

SEQ ID NO: 1423577 - protein, 6 aa, Mycobacterium tuberculosis
GPKALT

SEQ ID NO: 1423578 - protein, 9 aa, Mycobacterium tuberculosis
GPLDDPAAH

SEQ ID NO: 1423579 - protein, 11 aa, Mycobacterium tuberculosis
GPRHTAPATPG

SEQ ID NO: 1423580 - protein, 6 aa, Mycobacterium tuberculosis
GPRPTE

SEQ ID NO: 1423581 - protein, 7 aa, Mycobacterium tuberculosis
GPTRHPV

SEQ ID NO: 1423582 - protein, 15 aa, Mycobacterium tuberculosis
GPVGQNVADRARAGG

SEQ ID NO: 1423583 - protein, 4 aa, Mycobacterium tuberculosis
GQLT

SEQ ID NO: 1423584 - protein, 9 aa, Mycobacterium tuberculosis
GQNTPAIAA

SEQ ID NO: 1423585 - protein, 14 aa, Mycobacterium tuberculosis
GQPGQPGPPGQPGP

SEQ ID NO: 1423586 - protein, 14 aa, Mycobacterium tuberculosis
GRQDKAKQTPCPGY

SEQ ID NO: 1423587 - protein, 14 aa, Mycobacterium tuberculosis
GRSSHLGTGGMASK

SEQ ID NO: 1423588 - protein, 12 aa, Mycobacterium tuberculosis
GSAGARDERGWE

SEQ ID NO: 1423589 - protein, 4 aa, Mycobacterium tuberculosis
GSEA

SEQ ID NO: 1423590 - protein, 5 aa, Mycobacterium tuberculosis
GSGDP

SEQ ID NO: 1423591 - protein, 7 aa, Mycobacterium tuberculosis
GSGGRRV

SEQ ID NO: 1423592 - protein, 8 aa, Mycobacterium tuberculosis
GSGRRRGK

SEQ ID NO: 1423593 - protein, 10 aa, Mycobacterium tuberculosis
GSHAPTRSAR

SEQ ID NO: 1423594 - protein, 5 aa, Mycobacterium tuberculosis
GSIQT

SEQ ID NO: 1423595 - protein, 5 aa, Mycobacterium tuberculosis
GSLGV

SEQ ID NO: 1423596 - protein, 17 aa, Mycobacterium tuberculosis
GSYSTGVGNAGTASTGL

SEQ ID NO: 1423597 - protein, 5 aa, Mycobacterium tuberculosis
GTATA

SEQ ID NO: 1423598 - protein, 9 aa, Mycobacterium tuberculosis
GTENPSGPI

SEQ ID NO: 1423599 - protein, 17 aa, Mycobacterium tuberculosis
GTERPFTGEYTDTTTAG

SEQ ID NO: 1423600 - protein, 4 aa, Mycobacterium tuberculosis
GTGV

SEQ ID NO: 1423601 - protein, 5 aa, Mycobacterium tuberculosis
GVDVR

SEQ ID NO: 1423602 - protein, 29 aa, Mycobacterium tuberculosis
GVHGAGGTGGQGGAGGAGGAGGAAGAGTV

SEQ ID NO: 1423603 - protein, 9 aa, Mycobacterium tuberculosis
GVRAADGAG

SEQ ID NO: 1423604 - protein, 5 aa, Mycobacterium tuberculosis
GVSGV

SEQ ID NO: 1423605 - protein, 4 aa, Mycobacterium tuberculosis
GVTS

SEQ ID NO: 1423606 - protein, 4 aa, Mycobacterium tuberculosis
GWGS

SEQ ID NO: 1423607 - protein, 6 aa, Mycobacterium tuberculosis
GWQPEG

SEQ ID NO: 1423608 - protein, 8 aa, Mycobacterium tuberculosis
GWTGGRGA

SEQ ID NO: 1423609 - protein, 12 aa, Mycobacterium tuberculosis
GYESPPLPLGPD

SEQ ID NO: 1423610 - protein, 7 aa, Mycobacterium tuberculosis
HAGTLDP

SEQ ID NO: 1423611 - protein, 11 aa, Mycobacterium tuberculosis
HDARGLDASGL

SEQ ID NO: 1423612 - protein, 6 aa, Mycobacterium tuberculosis
HDDGVT

SEQ ID NO: 1423613 - protein, 14 aa, Mycobacterium tuberculosis
HDGSARATGSATIT

SEQ ID NO: 1423614 - protein, 8 aa, Mycobacterium tuberculosis
HDRVDPSS

SEQ ID NO: 1423615 - protein, 6 aa, Mycobacterium tuberculosis
HDTVSG

SEQ ID NO: 1423616 - protein, 8 aa, Mycobacterium tuberculosis
HEDPSGPV

SEQ ID NO: 1423617 - protein, 6 aa, Mycobacterium tuberculosis
HGQDYQ

SEQ ID NO: 1423618 - protein, 15 aa, Mycobacterium tuberculosis
HGSKDPRSAANARAI

SEQ ID NO: 1423619 - protein, 4 aa, Mycobacterium tuberculosis
HNPP

SEQ ID NO: 1423620 - protein, 6 aa, Mycobacterium tuberculosis
HPHGDA

SEQ ID NO: 1423621 - protein, 15 aa, Mycobacterium tuberculosis
HPKPLRPGADQTIGG

SEQ ID NO: 1423622 - protein, 8 aa, Mycobacterium tuberculosis
HPLNDPFT

SEQ ID NO: 1423623 - protein, 4 aa, Mycobacterium tuberculosis
HPRS

SEQ ID NO: 1423624 - protein, 5 aa, Mycobacterium tuberculosis
HPTFP

SEQ ID NO: 1423625 - protein, 8 aa, Mycobacterium tuberculosis
HRITSPDE

SEQ ID NO: 1423626 - protein, 6 aa, Mycobacterium tuberculosis
HSGSAP

SEQ ID NO: 1423627 - protein, 9 aa, Mycobacterium tuberculosis
HSRSSGRFG

SEQ ID NO: 1423628 - protein, 8 aa, Mycobacterium tuberculosis
HTDTGESV

SEQ ID NO: 1423629 - protein, 14 aa, Mycobacterium tuberculosis
HVATEEDRVDTRKV

SEQ ID NO: 1423630 - protein, 7 aa, Mycobacterium tuberculosis
IADGATE

SEQ ID NO: 1423631 - protein, 10 aa, Mycobacterium tuberculosis
IAQSRAAGDG

SEQ ID NO: 1423632 - protein, 12 aa, Mycobacterium tuberculosis
IATGNDADADRH

SEQ ID NO: 1423633 - protein, 10 aa, Mycobacterium tuberculosis
IDETERRRAK

SEQ ID NO: 1423634 - protein, 6 aa, Mycobacterium tuberculosis
IDKNPD

SEQ ID NO: 1423635 - protein, 8 aa, Mycobacterium tuberculosis
IDPENTDW

SEQ ID NO: 1423636 - protein, 6 aa, Mycobacterium tuberculosis
IDTATE

SEQ ID NO: 1423637 - protein, 43 aa, Mycobacterium tuberculosis
IGAAPAPKPAPKPVPEPAPTPKAEPAPSPPAAQPAGAAEGAPY

SEQ ID NO: 1423638 - protein, 7 aa, Mycobacterium tuberculosis
IGSCGRA

SEQ ID NO: 1423639 - protein, 8 aa, Mycobacterium tuberculosis
IGSDPQKI

SEQ ID NO: 1423640 - protein, 7 aa, Mycobacterium tuberculosis
IGTQVSD

SEQ ID NO: 1423641 - protein, 6 aa, Mycobacterium tuberculosis
IPADEP

SEQ ID NO: 1423642 - protein, 6 aa, Mycobacterium tuberculosis
IPAPPG

SEQ ID NO: 1423643 - protein, 26 aa, Mycobacterium tuberculosis
ITAATKAPARNQTLTRGHPFQQTFEK

SEQ ID NO: 1423644 - protein, 10 aa, Mycobacterium tuberculosis
ITESGPSVAG

SEQ ID NO: 1423645 - protein, 5 aa, Mycobacterium tuberculosis
KAGFS

SEQ ID NO: 1423646 - protein, 15 aa, Mycobacterium tuberculosis
KAHEAAAALASGASE

SEQ ID NO: 1423647 - protein, 9 aa, Mycobacterium tuberculosis
KARMASGGT

SEQ ID NO: 1423648 - protein, 6 aa, Mycobacterium tuberculosis
KDKGVR

SEQ ID NO: 1423649 - protein, 5 aa, Mycobacterium tuberculosis
KDLAT

SEQ ID NO: 1423650 - protein, 12 aa, Mycobacterium tuberculosis
KESGLRASAKGY

SEQ ID NO: 1423651 - protein, 6 aa, Mycobacterium tuberculosis
KGSLRG

SEQ ID NO: 1423652 - protein, 5 aa, Mycobacterium tuberculosis
KHTYG

SEQ ID NO: 1423653 - protein, 8 aa, Mycobacterium tuberculosis
KNYDGSWT

SEQ ID NO: 1423654 - protein, 5 aa, Mycobacterium tuberculosis
KPGNV

SEQ ID NO: 1423655 - protein, 12 aa, Mycobacterium tuberculosis
KPISPTKTRTRF

SEQ ID NO: 1423656 - protein, 30 aa, Mycobacterium tuberculosis
KPTSAAVSGTALDDGAEPALASDLVVADEH

SEQ ID NO: 1423657 - protein, 4 aa, Mycobacterium tuberculosis
KPYP

SEQ ID NO: 1423658 - protein, 5 aa, Mycobacterium tuberculosis
KRAEA

SEQ ID NO: 1423659 - protein, 10 aa, Mycobacterium tuberculosis
KRLPSTAQGA

SEQ ID NO: 1423660 - protein, 8 aa, Mycobacterium tuberculosis
KSAAYTMT

SEQ ID NO: 1423661 - protein, 7 aa, Mycobacterium tuberculosis
KTDSDAF

SEQ ID NO: 1423662 - protein, 7 aa, Mycobacterium tuberculosis
KTFTAPA

SEQ ID NO: 1423663 - protein, 5 aa, Mycobacterium tuberculosis
KTGSL

SEQ ID NO: 1423664 - protein, 8 aa, Mycobacterium tuberculosis
KTKRDRHV

SEQ ID NO: 1423665 - protein, 7 aa, Mycobacterium tuberculosis
LAGNPIR

SEQ ID NO: 1423666 - protein, 9 aa, Mycobacterium tuberculosis
LAGPTRGAP

SEQ ID NO: 1423667 - protein, 24 aa, Mycobacterium tuberculosis
LAGRAAAGSTGHPIGSAAAPAVGA

SEQ ID NO: 1423668 - protein, 5 aa, Mycobacterium tuberculosis
LANAT

SEQ ID NO: 1423669 - protein, 5 aa, Mycobacterium tuberculosis
LAPSG

SEQ ID NO: 1423670 - protein, 6 aa, Mycobacterium tuberculosis
LARGEL

SEQ ID NO: 1423671 - protein, 9 aa, Mycobacterium tuberculosis
LASPGSVSR

SEQ ID NO: 1423672 - protein, 5 aa, Mycobacterium tuberculosis
LDPVT

SEQ ID NO: 1423673 - protein, 40 aa, Mycobacterium tuberculosis
LDVEDSDSDDEDSDEDAADADVDEEDAAGLDGSPGEVDVP

SEQ ID NO: 1423674 - protein, 7 aa, Mycobacterium tuberculosis
LEEAQNA

SEQ ID NO: 1423675 - protein, 9 aa, Mycobacterium tuberculosis
LGGPDRNTF

SEQ ID NO: 1423676 - protein, 10 aa, Mycobacterium tuberculosis
LGGTARAERA

SEQ ID NO: 1423677 - protein, 8 aa, Mycobacterium tuberculosis
LGLPPGTY

SEQ ID NO: 1423678 - protein, 14 aa, Mycobacterium tuberculosis
LGNHANASSEVEYD

SEQ ID NO: 1423679 - protein, 10 aa, Mycobacterium tuberculosis
LNADKTVEQV

SEQ ID NO: 1423680 - protein, 6 aa, Mycobacterium tuberculosis
LPEEPW

SEQ ID NO: 1423681 - protein, 8 aa, Mycobacterium tuberculosis
LPGGPRAQ

SEQ ID NO: 1423682 - protein, 8 aa, Mycobacterium tuberculosis
LPPAPPTT

SEQ ID NO: 1423683 - protein, 13 aa, Mycobacterium tuberculosis
LPPPAAKPAATQI

SEQ ID NO: 1423684 - protein, 7 aa, Mycobacterium tuberculosis
LPPRFQS

SEQ ID NO: 1423685 - protein, 10 aa, Mycobacterium tuberculosis
LRERRPDRAI

SEQ ID NO: 1423686 - protein, 5 aa, Mycobacterium tuberculosis
LRGGA

SEQ ID NO: 1423687 - protein, 6 aa, Mycobacterium tuberculosis
LRGGLA

SEQ ID NO: 1423688 - protein, 25 aa, Mycobacterium tuberculosis
LRPGDPILGEEGGGPADVTATPSDR

SEQ ID NO: 1423689 - protein, 4 aa, Mycobacterium tuberculosis
LRPL

SEQ ID NO: 1423690 - protein, 13 aa, Mycobacterium tuberculosis
LRRNSRRDGQYRP

SEQ ID NO: 1423691 - protein, 7 aa, Mycobacterium tuberculosis
LSAPGSM

SEQ ID NO: 1423692 - protein, 4 aa, Mycobacterium tuberculosis
LSDG

SEQ ID NO: 1423693 - protein, 6 aa, Mycobacterium tuberculosis
LSDPRN

SEQ ID NO: 1423694 - protein, 8 aa, Mycobacterium tuberculosis
LSGGTGAV

SEQ ID NO: 1423695 - protein, 13 aa, Mycobacterium tuberculosis
LSPITSVAGRKGY

SEQ ID NO: 1423696 - protein, 5 aa, Mycobacterium tuberculosis
LSPSI

SEQ ID NO: 1423697 - protein, 7 aa, Mycobacterium tuberculosis
LSPTRPV

SEQ ID NO: 1423698 - protein, 8 aa, Mycobacterium tuberculosis
LTAEARSG

SEQ ID NO: 1423699 - protein, 4 aa, Mycobacterium tuberculosis
LTAN

SEQ ID NO: 1423700 - protein, 8 aa, Mycobacterium tuberculosis
LTARTGGV

SEQ ID NO: 1423701 - protein, 7 aa, Mycobacterium tuberculosis
LTLPPGA

SEQ ID NO: 1423702 - protein, 5 aa, Mycobacterium tuberculosis
LTPEQ

SEQ ID NO: 1423703 - protein, 6 aa, Mycobacterium tuberculosis
LTPEQG

SEQ ID NO: 1423704 - protein, 8 aa, Mycobacterium tuberculosis
LTPEQRHR

SEQ ID NO: 1423705 - protein, 16 aa, Mycobacterium tuberculosis
LTRASTRGDGRTGEDV

SEQ ID NO: 1423706 - protein, 7 aa, Mycobacterium tuberculosis
LTRDPAA

SEQ ID NO: 1423707 - protein, 12 aa, Mycobacterium tuberculosis
MASGGGPGTGKC

SEQ ID NO: 1423708 - protein, 10 aa, Mycobacterium tuberculosis
MYTGPGPGPM

SEQ ID NO: 1423709 - protein, 5 aa, Mycobacterium tuberculosis
NASRA

SEQ ID NO: 1423710 - protein, 12 aa, Mycobacterium tuberculosis
NEANGIDPQPLR

SEQ ID NO: 1423711 - protein, 8 aa, Mycobacterium tuberculosis
NFPPKRHK

SEQ ID NO: 1423712 - protein, 31 aa, Mycobacterium tuberculosis; identical to SEQ ID NO: 181283

SEQ ID NO: 1423713 - protein, 34 aa, Mycobacterium tuberculosis; identical to SEQ ID NO: 230565

SEQ ID NO: 1423714 - protein, 75 aa, Mycobacterium tuberculosis; identical to SEQ ID NO: 181337

SEQ ID NO: 1423715 - protein, 11 aa, Mycobacterium tuberculosis
NIPETSQRSPG

SEQ ID NO: 1423716 - protein, 12 aa, Mycobacterium tuberculosis
NIPGGAPIPQEE

SEQ ID NO: 1423717 - protein, 7 aa, Mycobacterium tuberculosis
NLDDPDA

SEQ ID NO: 1423718 - protein, 6 aa, Mycobacterium tuberculosis
NNTATA

SEQ ID NO: 1423719 - protein, 12 aa, Mycobacterium tuberculosis
NPEPTPLSGSAT

SEQ ID NO: 1423720 - protein, 6 aa, Mycobacterium tuberculosis
NPGTSE

SEQ ID NO: 1423721 - protein, 7 aa, Mycobacterium tuberculosis
NPNVTGS

SEQ ID NO: 1423722 - protein, 4 aa, Mycobacterium tuberculosis
NPTV

SEQ ID NO: 1423723 - protein, 12 aa, Mycobacterium tuberculosis
NRGPEQRTDKKP

SEQ ID NO: 1423724 - protein, 5 aa, Mycobacterium tuberculosis
NSGEG

SEQ ID NO: 1423725 - protein, 9 aa, Mycobacterium tuberculosis
NSKSPHWTG

SEQ ID NO: 1423726 - protein, 11 aa, Mycobacterium tuberculosis
NTANTAAAATT

SEQ ID NO: 1423727 - protein, 7 aa, Mycobacterium tuberculosis
NVATTQV

SEQ ID NO: 1423728 - protein, 14 aa, Mycobacterium tuberculosis
NYPEAWGDEDKRVA

SEQ ID NO: 1423729 - protein, 12 aa, Mycobacterium tuberculosis
PAAATGAPTGGG

SEQ ID NO: 1423730 - protein, 7 aa, Mycobacterium tuberculosis
PAAFATA

SEQ ID NO: 1423731 - protein, 5 aa, Mycobacterium tuberculosis
PAAGY

SEQ ID NO: 1423732 - protein, 7 aa, Mycobacterium tuberculosis
PADSAAD

SEQ ID NO: 1423733 - protein, 8 aa, Mycobacterium tuberculosis
PAGPAAES

SEQ ID NO: 1423734 - protein, 18 aa, Mycobacterium tuberculosis
PAGRAHQRQRADTAGRAG

SEQ ID NO: 1423735 - protein, 5 aa, Mycobacterium tuberculosis
PDGLG

SEQ ID NO: 1423736 - protein, 8 aa, Mycobacterium tuberculosis
PDGMPGGE

SEQ ID NO: 1423737 - protein, 8 aa, Mycobacterium tuberculosis
PEHGSAST

SEQ ID NO: 1423738 - protein, 5 aa, Mycobacterium tuberculosis
PEMPE

SEQ ID NO: 1423739 - protein, 4 aa, Mycobacterium tuberculosis
PEPG

SEQ ID NO: 1423740 - protein, 6 aa, Mycobacterium tuberculosis
PEPVSE

SEQ ID NO: 1423741 - protein, 4 aa, Mycobacterium tuberculosis
PESK

SEQ ID NO: 1423742 - protein, 13 aa, Mycobacterium tuberculosis
PFDPADRSEPGHW

SEQ ID NO: 1423743 - protein, 7 aa, Mycobacterium tuberculosis
PGASCAT

SEQ ID NO: 1423744 - protein, 6 aa, Mycobacterium tuberculosis
PGATGL

SEQ ID NO: 1423745 - protein, 14 aa, Mycobacterium tuberculosis
PGRPPAAKADETRK

SEQ ID NO: 1423746 - protein, 12 aa, Mycobacterium tuberculosis
PGSIPTTTSGKI

SEQ ID NO: 1423747 - protein, 8 aa, Mycobacterium tuberculosis
PGSVEPGA

SEQ ID NO: 1423748 - protein, 10 aa, Mycobacterium tuberculosis
PIAATDGAGA

SEQ ID NO: 1423749 - protein, 9 aa, Mycobacterium tuberculosis
PINPSGGLI

SEQ ID NO: 1423750 - protein, 140 aa, Mycobacterium tuberculosis; identical to SEQ ID NO: 182842

SEQ ID NO: 1423751 - protein, 15 aa, Mycobacterium tuberculosis
PMPPTAKNAACPLGP

SEQ ID NO: 1423752 - protein, 9 aa, Mycobacterium tuberculosis
PNPGTAEGI

SEQ ID NO: 1423753 - protein, 18 aa, Mycobacterium tuberculosis
PPPCPIPGQNPHNQHESA

SEQ ID NO: 1423754 - protein, 6 aa, Mycobacterium tuberculosis
PPPVRR

SEQ ID NO: 1423755 - protein, 11 aa, Mycobacterium tuberculosis
PPRRGRSKRHR

SEQ ID NO: 1423756 - protein, 14 aa, Mycobacterium tuberculosis
PPTEGKSTTNRDEG

SEQ ID NO: 1423757 - protein, 6 aa, Mycobacterium tuberculosis
PRPGET

SEQ ID NO: 1423758 - protein, 10 aa, Mycobacterium tuberculosis
PRRPQGELPA

SEQ ID NO: 1423759 - protein, 13 aa, Mycobacterium tuberculosis
PSAFQTRPSGLPG

SEQ ID NO: 1423760 - protein, 8 aa, Mycobacterium tuberculosis
PSLPAALG

SEQ ID NO: 1423761 - protein, 10 aa, Mycobacterium tuberculosis
PSPLSSGSAK

SEQ ID NO: 1423762 - protein, 9 aa, Mycobacterium tuberculosis
PTSATGGIP

SEQ ID NO: 1423763 - protein, 7 aa, Mycobacterium tuberculosis
PVDGGTE

SEQ ID NO: 1423764 - protein, 8 aa, Mycobacterium tuberculosis
PVQGSHVE

SEQ ID NO: 1423765 - protein, 9 aa, Mycobacterium tuberculosis
PYRDDAGHS

SEQ ID NO: 1423766 - protein, 5 aa, Mycobacterium tuberculosis
QAELD

SEQ ID NO: 1423767 - protein, 5 aa, Mycobacterium tuberculosis
QAPAR

SEQ ID NO: 1423768 - protein, 7 aa, Mycobacterium tuberculosis
QDVSPGD

SEQ ID NO: 1423769 - protein, 7 aa, Mycobacterium tuberculosis
QFPYQSK

SEQ ID NO: 1423770 - protein, 19 aa, Mycobacterium tuberculosis
QGADRPRRTPATVSRRAQL

SEQ ID NO: 1423771 - protein, 8 aa, Mycobacterium tuberculosis
QGAPPERA

SEQ ID NO: 1423772 - protein, 6 aa, Mycobacterium tuberculosis
QGGATL

SEQ ID NO: 1423773 - protein, 6 aa, Mycobacterium tuberculosis
QGNSIT

SEQ ID NO: 1423774 - protein, 8 aa, Mycobacterium tuberculosis
QHKPNGSH

SEQ ID NO: 1423775 - protein, 5 aa, Mycobacterium tuberculosis
QIAAS

SEQ ID NO: 1423776 - protein, 14 aa, Mycobacterium tuberculosis
QIPKLAESAELRSV

SEQ ID NO: 1423777 - protein, 5 aa, Mycobacterium tuberculosis
QLARG

SEQ ID NO: 1423778 - protein, 6 aa, Mycobacterium tuberculosis
QNITTA

SEQ ID NO: 1423779 - protein, 8 aa, Mycobacterium tuberculosis
QNTGAIAA

SEQ ID NO: 1423780 - protein, 17 aa, Mycobacterium tuberculosis
QPDAPAPQPVRGTGGGN

SEQ ID NO: 1423781 - protein, 5 aa, Mycobacterium tuberculosis
QPDQV

SEQ ID NO: 1423782 - protein, 6 aa, Mycobacterium tuberculosis
QPRTRL

SEQ ID NO: 1423783 - protein, 8 aa, Mycobacterium tuberculosis
QQADHGES

SEQ ID NO: 1423784 - protein, 10 aa, Mycobacterium tuberculosis
QQDAHGVTAA

SEQ ID NO: 1423785 - protein, 32 aa, Mycobacterium tuberculosis
QRAAEEAGIKQGPPTQNIGAGRAGGGQSSRAR

SEQ ID NO: 1423786 - protein, 10 aa, Mycobacterium tuberculosis
QRPRARAVPR

SEQ ID NO: 1423787 - protein, 6 aa, Mycobacterium tuberculosis
QSAEAH

SEQ ID NO: 1423788 - protein, 6 aa, Mycobacterium tuberculosis
QSGSDR

SEQ ID NO: 1423789 - protein, 34 aa, Mycobacterium tuberculosis
QTKRGGGGGDDDDIAGSTAAGQERREKLTEETDD

SEQ ID NO: 1423790 - protein, 4 aa, Mycobacterium tuberculosis
QTLS

SEQ ID NO: 1423791 - protein, 7 aa, Mycobacterium tuberculosis
QVPGSAS

SEQ ID NO: 1423792 - protein, 5 aa, Mycobacterium tuberculosis
RAAQT

SEQ ID NO: 1423793 - protein, 7 aa, Mycobacterium tuberculosis
RAGGRRP

SEQ ID NO: 1423794 - protein, 6 aa, Mycobacterium tuberculosis
RAGQRH

SEQ ID NO: 1423795 - protein, 8 aa, Mycobacterium tuberculosis
RAGSSPLG

SEQ ID NO: 1423796 - protein, 9 aa, Mycobacterium tuberculosis
RAQPARDDK

SEQ ID NO: 1423797 - protein, 15 aa, Mycobacterium tuberculosis
RARSRCTKGSRRYCE

SEQ ID NO: 1423798 - protein, 9 aa, Mycobacterium tuberculosis
RCQGPPTRY

SEQ ID NO: 1423799 - protein, 7 aa, Mycobacterium tuberculosis
RCTAEAN

SEQ ID NO: 1423800 - protein, 11 aa, Mycobacterium tuberculosis
RDAATPSRAYA

SEQ ID NO: 1423801 - protein, 6 aa, Mycobacterium tuberculosis
REGRTM

SEQ ID NO: 1423802 - protein, 4 aa, Mycobacterium tuberculosis
REGY

SEQ ID NO: 1423803 - protein, 9 aa, Mycobacterium tuberculosis
RENPQRTAA

SEQ ID NO: 1423804 - protein, 16 aa, Mycobacterium tuberculosis
RFSRTASSQPRPPAAT

SEQ ID NO: 1423805 - protein, 32 aa, Mycobacterium tuberculosis; identical to SEQ ID NO: 185221

SEQ ID NO: 1423806 - protein, 7 aa, Mycobacterium tuberculosis
RGDIAPG

SEQ ID NO: 1423807 - protein, 10 aa, Mycobacterium tuberculosis
RGGLGNAAGY

SEQ ID NO: 1423808 - protein, 4 aa, Mycobacterium tuberculosis
RGLT

SEQ ID NO: 1423809 - protein, 7 aa, Mycobacterium tuberculosis
RGSRHKN

SEQ ID NO: 1423810 - protein, 13 aa, Mycobacterium tuberculosis
RHDTGYGHRPEDV

SEQ ID NO: 1423811 - protein, 5 aa, Mycobacterium tuberculosis
RHTGS

SEQ ID NO: 1423812 - protein, 7 aa, Mycobacterium tuberculosis
RKKSDHL

SEQ ID NO: 1423813 - protein, 6 aa, Mycobacterium tuberculosis
RKSGPL

SEQ ID NO: 1423814 - protein, 5 aa, Mycobacterium tuberculosis
RKTTV

SEQ ID NO: 1423815 - protein, 8 aa, Mycobacterium tuberculosis
RLADGSAA

SEQ ID NO: 1423816 - protein, 12 aa, Mycobacterium tuberculosis
RLSHAEKSFTSD

SEQ ID NO: 1423817 - protein, 10 aa, Mycobacterium tuberculosis
RLTDGQGRTV

SEQ ID NO: 1423818 - protein, 8 aa, Mycobacterium tuberculosis
RMRPPRPA

SEQ ID NO: 1423819 - protein, 9 aa, Mycobacterium tuberculosis
RNAKAAVEE

SEQ ID NO: 1423820 - protein, 10 aa, Mycobacterium tuberculosis
RNANPPNAEL

SEQ ID NO: 1423821 - protein, 6 aa, Mycobacterium tuberculosis
RNGTRL

SEQ ID NO: 1423822 - protein, 4 aa, Mycobacterium tuberculosis
RNVT

SEQ ID NO: 1423823 - protein, 6 aa, Mycobacterium tuberculosis
RPDSLR

SEQ ID NO: 1423824 - protein, 18 aa, Mycobacterium tuberculosis
RPGESDGTCGRGEPQAGR

SEQ ID NO: 1423825 - protein, 9 aa, Mycobacterium tuberculosis
RPGSGREAT

SEQ ID NO: 1423826 - protein, 5 aa, Mycobacterium tuberculosis
RPGVT

SEQ ID NO: 1423827 - protein, 14 aa, Mycobacterium tuberculosis
RPPPASLTAPRPAT

SEQ ID NO: 1423828 - protein, 20 aa, Mycobacterium tuberculosis
RPPQVKSPHRGPLRTGRTHR

SEQ ID NO: 1423829 - protein, 5 aa, Mycobacterium tuberculosis
RPTDG

SEQ ID NO: 1423830 - protein, 4 aa, Mycobacterium tuberculosis
RRAT

SEQ ID NO: 1423831 - protein, 18 aa, Mycobacterium tuberculosis
RRDKPDPSTYIGSGKAAE

SEQ ID NO: 1423832 - protein, 11 aa, Mycobacterium tuberculosis
RRIDSDLTART

SEQ ID NO: 1423833 - protein, 16 aa, Mycobacterium tuberculosis
RRVDGAREAVDGSINT

SEQ ID NO: 1423834 - protein, 8 aa, Mycobacterium tuberculosis
RRYDGDER

SEQ ID NO: 1423835 - protein, 12 aa, Mycobacterium tuberculosis
RSFETREGEKRT

SEQ ID NO: 1423836 - protein, 9 aa, Mycobacterium tuberculosis
RSGRMSDDD

SEQ ID NO: 1423837 - protein, 7 aa, Mycobacterium tuberculosis
RSTDPAT

SEQ ID NO: 1423838 - protein, 7 aa, Mycobacterium tuberculosis
RSTTPHH

SEQ ID NO: 1423839 - protein, 4 aa, Mycobacterium tuberculosis
RTAT

SEQ ID NO: 1423840 - protein, 7 aa, Mycobacterium tuberculosis
RTGIGGL

SEQ ID NO: 1423841 - protein, 6 aa, Mycobacterium tuberculosis
RTPRMA

SEQ ID NO: 1423842 - protein, 6 aa, Mycobacterium tuberculosis
RTPTVT

SEQ ID NO: 1423843 - protein, 5 aa, Mycobacterium tuberculosis
RTRRR

SEQ ID NO: 1423844 - protein, 6 aa, Mycobacterium tuberculosis
RVAGAD

SEQ ID NO: 1423845 - protein, 12 aa, Mycobacterium tuberculosis
SAAEPGAAGRHA

SEQ ID NO: 1423846 - protein, 10 aa, Mycobacterium tuberculosis
SAAERGPGQM

SEQ ID NO: 1423847 - protein, 8 aa, Mycobacterium tuberculosis
SAAQTAPG

SEQ ID NO: 1423848 - protein, 7 aa, Mycobacterium tuberculosis
SADPTTI

SEQ ID NO: 1423849 - protein, 5 aa, Mycobacterium tuberculosis
SAHAE

SEQ ID NO: 1423850 - protein, 6 aa, Mycobacterium tuberculosis
SAKGIP

SEQ ID NO: 1423851 - protein, 5 aa, Mycobacterium tuberculosis
SAPTF

SEQ ID NO: 1423852 - protein, 4 aa, Mycobacterium tuberculosis
SARE

SEQ ID NO: 1423853 - protein, 9 aa, Mycobacterium tuberculosis
SASSTVEAP

SEQ ID NO: 1423854 - protein, 10 aa, Mycobacterium tuberculosis
SEIAESGAAP

SEQ ID NO: 1423855 - protein, 12 aa, Mycobacterium tuberculosis
SEIDKARSELAA

SEQ ID NO: 1423856 - protein, 4 aa, Mycobacterium tuberculosis
SENA

SEQ ID NO: 1423857 - protein, 19 aa, Mycobacterium tuberculosis
SERLTSAAAAAAGPPSAAG

SEQ ID NO: 1423858 - protein, 10 aa, Mycobacterium tuberculosis
SFTSGDHRLD

SEQ ID NO: 1423859 - protein, 7 aa, Mycobacterium tuberculosis
SGAGLSG

SEQ ID NO: 1423860 - protein, 17 aa, Mycobacterium tuberculosis
SGKVSEVNSDLDGTPQL

SEQ ID NO: 1423861 - protein, 5 aa, Mycobacterium tuberculosis
SGLNP

SEQ ID NO: 1423862 - protein, 8 aa, Mycobacterium tuberculosis
SGLPNQTD

SEQ ID NO: 1423863 - protein, 8 aa, Mycobacterium tuberculosis
SGPPQVPW

SEQ ID NO: 1423864 - protein, 8 aa, Mycobacterium tuberculosis
SGTDAAVA

SEQ ID NO: 1423865 - protein, 6 aa, Mycobacterium tuberculosis
SGTEID

SEQ ID NO: 1423866 - protein, 6 aa, Mycobacterium tuberculosis
SHASAA

SEQ ID NO: 1423867 - protein, 9 aa, Mycobacterium tuberculosis
SHATGRQLP

SEQ ID NO: 1423868 - protein, 8 aa, Mycobacterium tuberculosis
SISASRRV

SEQ ID NO: 1423869 - protein, 9 aa, Mycobacterium tuberculosis
SKSAAYTMT

SEQ ID NO: 1423870 - protein, 5 aa, Mycobacterium tuberculosis
SLEAE

SEQ ID NO: 1423871 - protein, 8 aa, Mycobacterium tuberculosis
SLNSGSNN

SEQ ID NO: 1423872 - protein, 11 aa, Mycobacterium tuberculosis
SLPEEAKSMAG

SEQ ID NO: 1423873 - protein, 4 aa, Mycobacterium tuberculosis
SLVA

SEQ ID NO: 1423874 - protein, 5 aa, Mycobacterium tuberculosis
SNLPD

SEQ ID NO: 1423875 - protein, 23 aa, Mycobacterium tuberculosis
SNSAQRDARNSRDESARASDTDR

SEQ ID NO: 1423876 - protein, 13 aa, Mycobacterium tuberculosis
SPAVRAGADERGL

SEQ ID NO: 1423877 - protein, 7 aa, Mycobacterium tuberculosis
SPHRSPI

SEQ ID NO: 1423878 - protein, 5 aa, Mycobacterium tuberculosis
SPLGP

SEQ ID NO: 1423879 - protein, 10 aa, Mycobacterium tuberculosis
SPTEQQRLRN

SEQ ID NO: 1423880 - protein, 20 aa, Mycobacterium tuberculosis
SPTKEFNEHREAYGDTSQLS

SEQ ID NO: 1423881 - protein, 8 aa, Mycobacterium tuberculosis
SQPGGPLK

SEQ ID NO: 1423882 - protein, 11 aa, Mycobacterium tuberculosis
SQSIPGPSNLG

SEQ ID NO: 1423883 - protein, 10 aa, Mycobacterium tuberculosis
SRPVSGAVET

SEQ ID NO: 1423884 - protein, 6 aa, Mycobacterium tuberculosis
SRRDAA

SEQ ID NO: 1423885 - protein, 12 aa, Mycobacterium tuberculosis
SRSGRDVTAEYP

SEQ ID NO: 1423886 - protein, 4 aa, Mycobacterium tuberculosis
SRSQ

SEQ ID NO: 1423887 - protein, 5 aa, Mycobacterium tuberculosis
SSKEW

SEQ ID NO: 1423888 - protein, 5 aa, Mycobacterium tuberculosis
SSNAA

SEQ ID NO: 1423889 - protein, 4 aa, Mycobacterium tuberculosis
SSTI

SEQ ID NO: 1423890 - protein, 8 aa, Mycobacterium tuberculosis
STLTRRDQ

SEQ ID NO: 1423891 - protein, 4 aa, Mycobacterium tuberculosis
STRP

SEQ ID NO: 1423892 - protein, 6 aa, Mycobacterium tuberculosis
STYGVP

SEQ ID NO: 1423893 - protein, 7 aa, Mycobacterium tuberculosis
SVAPTGT

SEQ ID NO: 1423894 - protein, 18 aa, Mycobacterium tuberculosis
SVPPGWSAPPATPQAQTV

SEQ ID NO: 1423895 - protein, 10 aa, Mycobacterium tuberculosis
SYEAGPTAAL

SEQ ID NO: 1423896 - protein, 6 aa, Mycobacterium tuberculosis
TAGQAA

SEQ ID NO: 1423897 - protein, 4 aa, Mycobacterium tuberculosis
TAGT

SEQ ID NO: 1423898 - protein, 5 aa, Mycobacterium tuberculosis
TAMRE

SEQ ID NO: 1423899 - protein, 5 aa, Mycobacterium tuberculosis
TATEI

SEQ ID NO: 1423900 - protein, 4 aa, Mycobacterium tuberculosis
TDEL

SEQ ID NO: 1423901 - protein, 4 aa, Mycobacterium tuberculosis
TDEQ

SEQ ID NO: 1423902 - protein, 12 aa, Mycobacterium tuberculosis
TDKVDTEIPSPV

SEQ ID NO: 1423903 - protein, 15 aa, Mycobacterium tuberculosis
TDSNVQSDPPTDGVH

SEQ ID NO: 1423904 - protein, 12 aa, Mycobacterium tuberculosis
TEQEADRALKAG

SEQ ID NO: 1423905 - protein, 11 aa, Mycobacterium tuberculosis
TFAESSEKHPD

SEQ ID NO: 1423906 - protein, 9 aa, Mycobacterium tuberculosis
TGAQRDRAW

SEQ ID NO: 1423907 - protein, 8 aa, Mycobacterium tuberculosis
TGDRKPIR

SEQ ID NO: 1423908 - protein, 10 aa, Mycobacterium tuberculosis
TGGASGIGLA

SEQ ID NO: 1423909 - protein, 7 aa, Mycobacterium tuberculosis
TGGTGKD

SEQ ID NO: 1423910 - protein, 14 aa, Mycobacterium tuberculosis
TGGTISTTAGPDGV

SEQ ID NO: 1423911 - protein, 19 aa, Mycobacterium tuberculosis
TGQAPAAYIGDNTRPDAIR

SEQ ID NO: 1423912 - protein, 5 aa, Mycobacterium tuberculosis
TGQGG

SEQ ID NO: 1423913 - protein, 5 aa, Mycobacterium tuberculosis
TGRLG

SEQ ID NO: 1423914 - protein, 9 aa, Mycobacterium tuberculosis
TGTAGYAGG

SEQ ID NO: 1423915 - protein, 9 aa, Mycobacterium tuberculosis
TGTIPSKTL

SEQ ID NO: 1423916 - protein, 8 aa, Mycobacterium tuberculosis
THGASVTT

SEQ ID NO: 1423917 - protein, 5 aa, Mycobacterium tuberculosis
TKPDA

SEQ ID NO: 1423918 - protein, 13 aa, Mycobacterium tuberculosis
TKPEAGRRSAEAK

SEQ ID NO: 1423919 - protein, 15 aa, Mycobacterium tuberculosis
TKTERRPVPSTELRK

SEQ ID NO: 1423920 - protein, 10 aa, Mycobacterium tuberculosis
TMPNQGSSNK

SEQ ID NO: 1423921 - protein, 12 aa, Mycobacterium tuberculosis
TNPAAEQPAATL

SEQ ID NO: 1423922 - protein, 11 aa, Mycobacterium tuberculosis
TNSPLRDGEHA

SEQ ID NO: 1423923 - protein, 62 aa, Mycobacterium tuberculosis
TNTGFANSGNINTGGFNAGNLNTGFGNTTDGLGENSGFGNAGSGNSGFNNSGRGNSGAQNVG

SEQ ID NO: 1423924 - protein, 10 aa, Mycobacterium tuberculosis
TPATPTATLT

SEQ ID NO: 1423925 - protein, 8 aa, Mycobacterium tuberculosis
TPLTEGEL

SEQ ID NO: 1423926 - protein, 5 aa, Mycobacterium tuberculosis
TPPAI

SEQ ID NO: 1423927 - protein, 19 aa, Mycobacterium tuberculosis
TPVANPQQVSVPEGGTVGP

SEQ ID NO: 1423928 - protein, 6 aa, Mycobacterium tuberculosis
TRFNAP

SEQ ID NO: 1423929 - protein, 7 aa, Mycobacterium tuberculosis
TRNRPGH

SEQ ID NO: 1423930 - protein, 8 aa, Mycobacterium tuberculosis
TRQRGEPQ

SEQ ID NO: 1423931 - protein, 9 aa, Mycobacterium tuberculosis
TRRDLPQSP

SEQ ID NO: 1423932 - protein, 10 aa, Mycobacterium tuberculosis
TSGSTRPPVG

SEQ ID NO: 1423933 - protein, 7 aa, Mycobacterium tuberculosis
TSTTWPK

SEQ ID NO: 1423934 - protein, 6 aa, Mycobacterium tuberculosis
TTDETH

SEQ ID NO: 1423935 - protein, 8 aa, Mycobacterium tuberculosis
TTDPPVEG

SEQ ID NO: 1423936 - protein, 10 aa, Mycobacterium tuberculosis
TTIGDEDRNF

SEQ ID NO: 1423937 - protein, 9 aa, Mycobacterium tuberculosis
TVSADDEPK

SEQ ID NO: 1423938 - protein, 6 aa, Mycobacterium tuberculosis
TVSGET

SEQ ID NO: 1423939 - protein, 8 aa, Mycobacterium tuberculosis
VADAGSPS

SEQ ID NO: 1423940 - protein, 17 aa, Mycobacterium tuberculosis
VADRNSGAGPKDPSPAG

SEQ ID NO: 1423941 - protein, 7 aa, Mycobacterium tuberculosis
VAGDRNA

SEQ ID NO: 1423942 - protein, 7 aa, Mycobacterium tuberculosis
VAKTGDY

SEQ ID NO: 1423943 - protein, 4 aa, Mycobacterium tuberculosis
VDVS

SEQ ID NO: 1423944 - protein, 7 aa, Mycobacterium tuberculosis
VEATGSA

SEQ ID NO: 1423945 - protein, 11 aa, Mycobacterium tuberculosis
VEGSTRLSQTR

SEQ ID NO: 1423946 - protein, 4 aa, Mycobacterium tuberculosis
VEPS

SEQ ID NO: 1423947 - protein, 8 aa, Mycobacterium tuberculosis
VEQEKNGI

SEQ ID NO: 1423948 - protein, 6 aa, Mycobacterium tuberculosis
VGATSE

SEQ ID NO: 1423949 - protein, 15 aa, Mycobacterium tuberculosis
VGDTNTGGFNPGSIN

SEQ ID NO: 1423950 - protein, 22 aa, Mycobacterium tuberculosis
VGGSGRNASRGRRAQGEPGRAV

SEQ ID NO: 1423951 - protein, 11 aa, Mycobacterium tuberculosis
VGSGGAGGSRG

SEQ ID NO: 1423952 - protein, 10 aa, Mycobacterium tuberculosis
VGVQPSGVEH

SEQ ID NO: 1423953 - protein, 23 aa, Mycobacterium tuberculosis
VKNAQEAHEAIRPAGETFATPDA

SEQ ID NO: 1423954 - protein, 14 aa, Mycobacterium tuberculosis
VKTAALKGSPQRRG

SEQ ID NO: 1423955 - protein, 5 aa, Mycobacterium tuberculosis
VLSGE

SEQ ID NO: 1423956 - protein, 6 aa, Mycobacterium tuberculosis
VNDPGN

SEQ ID NO: 1423957 - protein, 4 aa, Mycobacterium tuberculosis
VPDG

SEQ ID NO: 1423958 - protein, 5 aa, Mycobacterium tuberculosis
VPDTA

SEQ ID NO: 1423959 - protein, 10 aa, Mycobacterium tuberculosis
VQAEQTAAQA

SEQ ID NO: 1423960 - protein, 18 aa, Mycobacterium tuberculosis
VQPELRKGRYPDRKTARR

SEQ ID NO: 1423961 - protein, 8 aa, Mycobacterium tuberculosis
VQTNARLQ

SEQ ID NO: 1423962 - protein, 7 aa, Mycobacterium tuberculosis
VQTRREH

SEQ ID NO: 1423963 - protein, 14 aa, Mycobacterium tuberculosis
VRDYDPTQKRPSIV

SEQ ID NO: 1423964 - protein, 4 aa, Mycobacterium tuberculosis
VRGA

SEQ ID NO: 1423965 - protein, 4 aa, Mycobacterium tuberculosis
VRPG

SEQ ID NO: 1423966 - protein, 4 aa, Mycobacterium tuberculosis
VRSE

SEQ ID NO: 1423967 - protein, 13 aa, Mycobacterium tuberculosis
VRTPAGGGDAHNV

SEQ ID NO: 1423968 - protein, 10 aa, Mycobacterium tuberculosis
VSGPGSARVQ

SEQ ID NO: 1423969 - protein, 9 aa, Mycobacterium tuberculosis
VSSAQARIA

SEQ ID NO: 1423970 - protein, 6 aa, Mycobacterium tuberculosis
VSSLSD

SEQ ID NO: 1423971 - protein, 9 aa, Mycobacterium tuberculosis
VSTDASGRY

SEQ ID NO: 1423972 - protein, 21 aa, Mycobacterium tuberculosis
WPGPPLAPSPINGRPTMPGWA

SEQ ID NO: 1423973 - protein, 7 aa, Mycobacterium tuberculosis
YAEEPEL

SEQ ID NO: 1423974 - protein, 11 aa, Mycobacterium tuberculosis
YAKTDQSLGTS

SEQ ID NO: 1423975 - protein, 26 aa, Mycobacterium tuberculosis
YARGEGGFGGKRGPSGSDVAPERAPD

SEQ ID NO: 1423976 - protein, 9 aa, Mycobacterium tuberculosis
YDATTGRVT

SEQ ID NO: 1423977 - protein, 5 aa, Mycobacterium tuberculosis
YGADI

SEQ ID NO: 1423978 - protein, 5 aa, Mycobacterium tuberculosis
YGQDR

SEQ ID NO: 1423979 - protein, 10 aa, Mycobacterium tuberculosis
YKSSARPALD

SEQ ID NO: 1423980 - protein, 8 aa, Mycobacterium tuberculosis
YPAGTTVD

SEQ ID NO: 1423981 - protein, 9 aa, Mycobacterium tuberculosis
YPEPPPPGM

SEQ ID NO: 1423982 - protein, 14 aa, Mycobacterium tuberculosis
YPPPPGGPPPPADI

SEQ ID NO: 1423983 - protein, 6 aa, Mycobacterium tuberculosis
YPSGEG

SEQ ID NO: 1423984 - protein, 5 aa, Mycobacterium tuberculosis
YRGPL

SEQ ID NO: 1423985 - protein, 11 aa, Mycobacterium tuberculosis
YSHPDQAIASG

SEQ ID NO: 1423986 - protein, 13 aa, Mycobacterium tuberculosis
YTDEELAEHPGRR

SEQ ID NO: 1423987 - protein, 4 aa, Mycobacterium tuberculosis
AAAQ

SEQ ID NO: 1423988 - protein, 6 aa, Mycobacterium tuberculosis
AADEVS

SEQ ID NO: 1423989 - protein, 7 aa, Mycobacterium tuberculosis
AADPLPA

SEQ ID NO: 1423990 - protein, 4 aa, Mycobacterium tuberculosis
AAEQ

SEQ ID NO: 1423991 - protein, 5 aa, Mycobacterium tuberculosis
AAGCP

SEQ ID NO: 1423992 - protein, 6 aa, Mycobacterium tuberculosis
AAGNAY

SEQ ID NO: 1423993 - protein, 7 aa, Mycobacterium tuberculosis
AAGSGER

SEQ ID NO: 1423994 - protein, 8 aa, Mycobacterium tuberculosis
AAGSGERL

SEQ ID NO: 1423995 - protein, 4 aa, Mycobacterium tuberculosis
AAIG

SEQ ID NO: 1423996 - protein, 5 aa, Mycobacterium tuberculosis
AAKAL

SEQ ID NO: 1423997 - protein, 29 aa, Mycobacterium tuberculosis
AALGQAARRYAGQDTAAAAALGAVRPWGT

SEQ ID NO: 1423998 - protein, 55 aa, Mycobacterium tuberculosis; identical to SEQ ID NO: 193570

SEQ ID NO: 1423999 - protein, 6 aa, Mycobacterium tuberculosis
AARGTA

SEQ ID NO: 1424000 - protein, 27 aa, Mycobacterium tuberculosis
ACSQPAPRAIGASSRHASAGPVPPAPV

SEQ ID NO: 1424001 - protein, 8 aa, Mycobacterium tuberculosis
ADPTETNN

SEQ ID NO: 1424002 - protein, 10 aa, Mycobacterium tuberculosis
ADQAAAGALK

SEQ ID NO: 1424003 - protein, 10 aa, Mycobacterium tuberculosis
ADRLERDPAG

SEQ ID NO: 1424004 - protein, 16 aa, Mycobacterium tuberculosis
ADRNSGAGPKDPSPAG

SEQ ID NO: 1424005 - protein, 11 aa, Mycobacterium tuberculosis
ADSEQPELDPA

SEQ ID NO: 1424006 - protein, 16 aa, Mycobacterium tuberculosis
ADTVDRARDDTVADSW

SEQ ID NO: 1424007 - protein, 4 aa, Mycobacterium tuberculosis
ADVA

SEQ ID NO: 1424008 - protein, 9 aa, Mycobacterium tuberculosis
AEAGDPAGQ

SEQ ID NO: 1424009 - protein, 5 aa, Mycobacterium tuberculosis
AEGEP

SEQ ID NO: 1424010 - protein, 7 aa, Mycobacterium tuberculosis
AEKSFAG

SEQ ID NO: 1424011 - protein, 23 aa, Mycobacterium tuberculosis
AEPTSHDPDSGGHFGGPSGWGGR

SEQ ID NO: 1424012 - protein, 6 aa, Mycobacterium tuberculosis
AFPHDS

SEQ ID NO: 1424013 - protein, 10 aa, Mycobacterium tuberculosis
AGAGGAGGNA

SEQ ID NO: 1424014 - protein, 15 aa, Mycobacterium tuberculosis
AGAGSYASAEAANVQ

SEQ ID NO: 1424015 - protein, 8 aa, Mycobacterium tuberculosis
AGDGRSVE

SEQ ID NO: 1424016 - protein, 11 aa, Mycobacterium tuberculosis
AGEGGRSSGVG

SEQ ID NO: 1424017 - protein, 17 aa, Mycobacterium tuberculosis
AGENGAIDPRQRRCRAK

SEQ ID NO: 1424018 - protein, 11 aa, Mycobacterium tuberculosis
AGGAGGAGGAT

SEQ ID NO: 1424019 - protein, 15 aa, Mycobacterium tuberculosis
AGGGSYASAEIANAQ

SEQ ID NO: 1424020 - protein, 10 aa, Mycobacterium tuberculosis
AGGPSDALAA

SEQ ID NO: 1424021 - protein, 11 aa, Mycobacterium tuberculosis
AGHRERGVKQE

SEQ ID NO: 1424022 - protein, 8 aa, Mycobacterium tuberculosis
AGKRARDV

SEQ ID NO: 1424023 - protein, 8 aa, Mycobacterium tuberculosis
AGNTVAKD

SEQ ID NO: 1424024 - protein, 4 aa, Mycobacterium tuberculosis
AGPG

SEQ ID NO: 1424025 - protein, 10 aa, Mycobacterium tuberculosis
AGPQLPTGLQ

SEQ ID NO: 1424026 - protein, 5 aa, Mycobacterium tuberculosis
AGQKG

SEQ ID NO: 1424027 - protein, 18 aa, Mycobacterium tuberculosis
AGSCASAETTADAPTQAL

SEQ ID NO: 1424028 - protein, 8 aa, Mycobacterium tuberculosis
AGSEPMSA

SEQ ID NO: 1424029 - protein, 43 aa, Mycobacterium tuberculosis
AGTGNSGFGHNDPAGSGNSGIQNSGFGNSGYVNTSTTSMFGGN

SEQ ID NO: 1424030 - protein, 5 aa, Mycobacterium tuberculosis
AGVTP

SEQ ID NO: 1424031 - protein, 6 aa, Mycobacterium tuberculosis
AGYAGT

SEQ ID NO: 1424032 - protein, 13 aa, Mycobacterium tuberculosis
AGYTGTTQSLGAD

SEQ ID NO: 1424033 - protein, 19 aa, Mycobacterium tuberculosis
AHPPTDQNTPAEGRRRYTT

SEQ ID NO: 1424034 - protein, 8 aa, Mycobacterium tuberculosis
AHQRPGAQ

SEQ ID NO: 1424035 - protein, 5 aa, Mycobacterium tuberculosis
AHRPS

SEQ ID NO: 1424036 - protein, 23 aa, Mycobacterium tuberculosis
AIDPGTVDAGTVGNAVADAGSPS

SEQ ID NO: 1424037 - protein, 7 aa, Mycobacterium tuberculosis
AKKGGQH

SEQ ID NO: 1424038 - protein, 12 aa, Mycobacterium tuberculosis
AKRRDATQLLEV

SEQ ID NO: 1424039 - protein, 6 aa, Mycobacterium tuberculosis
AKTGSL

SEQ ID NO: 1424040 - protein, 9 aa, Mycobacterium tuberculosis
AKVEEERAA

SEQ ID NO: 1424041 - protein, 8 aa, Mycobacterium tuberculosis
ALARPGTR

SEQ ID NO: 1424042 - protein, 14 aa, Mycobacterium tuberculosis
ALEDNTNERVSASS

SEQ ID NO: 1424043 - protein, 9 aa, Mycobacterium tuberculosis
ALPGEDVTD

SEQ ID NO: 1424044 - protein, 7 aa, Mycobacterium tuberculosis
ALPPPAD

SEQ ID NO: 1424045 - protein, 11 aa, Mycobacterium tuberculosis
ANAGSYNTGSF

SEQ ID NO: 1424046 - protein, 5 aa, Mycobacterium tuberculosis
ANASP

SEQ ID NO: 1424047 - protein, 4 aa, Mycobacterium tuberculosis
ANAT

SEQ ID NO: 1424048 - protein, 16 aa, Mycobacterium tuberculosis
ANGGGCCGRPAREGVD

SEQ ID NO: 1424049 - protein, 5 aa, Mycobacterium tuberculosis
ANKRS

SEQ ID NO: 1424050 - protein, 4 aa, Mycobacterium tuberculosis
APAD

SEQ ID NO: 1424051 - protein, 8 aa, Mycobacterium tuberculosis
APDTENAA

SEQ ID NO: 1424052 - protein, 6 aa, Mycobacterium tuberculosis
APEAVA

SEQ ID NO: 1424053 - protein, 6 aa, Mycobacterium tuberculosis
APFGSP

SEQ ID NO: 1424054 - protein, 15 aa, Mycobacterium tuberculosis
APGFGNDTTAPSSGF

SEQ ID NO: 1424055 - protein, 5 aa, Mycobacterium tuberculosis
APGST

SEQ ID NO: 1424056 - protein, 5 aa, Mycobacterium tuberculosis
APHGH

SEQ ID NO: 1424057 - protein, 5 aa, Mycobacterium tuberculosis
APHSA

SEQ ID NO: 1424058 - protein, 4 aa, Mycobacterium tuberculosis
APII

SEQ ID NO: 1424059 - protein, 4 aa, Mycobacterium tuberculosis
APPD

SEQ ID NO: 1424060 - protein, 4 aa, Mycobacterium tuberculosis
APPI

SEQ ID NO: 1424061 - protein, 7 aa, Mycobacterium tuberculosis
APRPQRE

SEQ ID NO: 1424062 - protein, 4 aa, Mycobacterium tuberculosis
APRR

SEQ ID NO: 1424063 - protein, 8 aa, Mycobacterium tuberculosis
APTLDGAR

SEQ ID NO: 1424064 - protein, 24 aa, Mycobacterium tuberculosis
AQGGSGGLGGFGESTGGDGGLGGA

SEQ ID NO: 1424065 - protein, 8 aa, Mycobacterium tuberculosis
AQSYQAVS

SEQ ID NO: 1424066 - protein, 17 aa, Mycobacterium tuberculosis
ARGTAPSSPLNATVSRN

SEQ ID NO: 1424067 - protein, 5 aa, Mycobacterium tuberculosis
ARQRG

SEQ ID NO: 1424068 - protein, 5 aa, Mycobacterium tuberculosis
ARSHA

SEQ ID NO: 1424069 - protein, 7 aa, Mycobacterium tuberculosis
ARTAANY

SEQ ID NO: 1424070 - protein, 8 aa, Mycobacterium tuberculosis
ASAAENYG

SEQ ID NO: 1424071 - protein, 6 aa, Mycobacterium tuberculosis
ASAGEL

SEQ ID NO: 1424072 - protein, 13 aa, Mycobacterium tuberculosis
ASATASSTGVDGG

SEQ ID NO: 1424073 - protein, 6 aa, Mycobacterium tuberculosis
ASGPSF

SEQ ID NO: 1424074 - protein, 7 aa, Mycobacterium tuberculosis
ASLSSDE

SEQ ID NO: 1424075 - protein, 9 aa, Mycobacterium tuberculosis
ASSGGLARG

SEQ ID NO: 1424076 - protein, 35 aa, Mycobacterium tuberculosis; identical to SEQ ID NO: 170198

SEQ ID NO: 1424077 - protein, 10 aa, Mycobacterium tuberculosis
ASTRTLTGAT

SEQ ID NO: 1424078 - protein, 20 aa, Mycobacterium tuberculosis
ASWSTAAPATAAGAALDGTG

SEQ ID NO: 1424079 - protein, 11 aa, Mycobacterium tuberculosis
ATAPAGTPGEY

SEQ ID NO: 1424080 - protein, 5 aa, Mycobacterium tuberculosis
ATGTP

SEQ ID NO: 1424081 - protein, 28 aa, Mycobacterium tuberculosis
ATHGPVDTPANTSGAPPASTGTTGPVAP

SEQ ID NO: 1424082 - protein, 4 aa, Mycobacterium tuberculosis
ATNT

SEQ ID NO: 1424083 - protein, 5 aa, Mycobacterium tuberculosis
ATSCG

SEQ ID NO: 1424084 - protein, 6 aa, Mycobacterium tuberculosis
ATSSRL

SEQ ID NO: 1424085 - protein, 21 aa, Mycobacterium tuberculosis
AVASHDPSHTRPSRREAPDRN

SEQ ID NO: 1424086 - protein, 12 aa, Mycobacterium tuberculosis
AVGNAGHSATGL

SEQ ID NO: 1424087 - protein, 5 aa, Mycobacterium tuberculosis
AVRRP

SEQ ID NO: 1424088 - protein, 10 aa, Mycobacterium tuberculosis
AVSGAAADLA

SEQ ID NO: 1424089 - protein, 37 aa, Mycobacterium tuberculosis
AWSPTRSTRGGRTASSRSTAFSTRSSRGSWRPGRTTR

SEQ ID NO: 1424090 - protein, 10 aa, Mycobacterium tuberculosis
AWTRDETEQR

SEQ ID NO: 1424091 - protein, 12 aa, Mycobacterium tuberculosis
AYGSRDSQEQLD

SEQ ID NO: 1424092 - protein, 10 aa, Mycobacterium tuberculosis
CQGEVGSAAA

SEQ ID NO: 1424093 - protein, 6 aa, Mycobacterium tuberculosis
DAAESV

SEQ ID NO: 1424094 - protein, 14 aa, Mycobacterium tuberculosis
DAAQAAKGSTITPR

SEQ ID NO: 1424095 - protein, 12 aa, Mycobacterium tuberculosis
DAASLKKGQTVR

SEQ ID NO: 1424096 - protein, 13 aa, Mycobacterium tuberculosis
DADAVRRRKEYQA

SEQ ID NO: 1424097 - protein, 31 aa, Mycobacterium tuberculosis; identical to SEQ ID NO: 193828

SEQ ID NO: 1424098 - protein, 8 aa, Mycobacterium tuberculosis
DANERAEV

SEQ ID NO: 1424099 - protein, 9 aa, Mycobacterium tuberculosis
DANERAEVA

SEQ ID NO: 1424100 - protein, 6 aa, Mycobacterium tuberculosis
DCRGSG

SEQ ID NO: 1424101 - protein, 7 aa, Mycobacterium tuberculosis
DCRGSGS

SEQ ID NO: 1424102 - protein, 8 aa, Mycobacterium tuberculosis
DDAADLSD

SEQ ID NO: 1424103 - protein, 6 aa, Mycobacterium tuberculosis
DDERDP

SEQ ID NO: 1424104 - protein, 10 aa, Mycobacterium tuberculosis
DDTGALQPES

SEQ ID NO: 1424105 - protein, 12 aa, Mycobacterium tuberculosis
DDVGRDQFPDAD

SEQ ID NO: 1424106 - protein, 8 aa, Mycobacterium tuberculosis
DEDFAKPQ

SEQ ID NO: 1424107 - protein, 10 aa, Mycobacterium tuberculosis
DERGRPVNNN

SEQ ID NO: 1424108 - protein, 32 aa, Mycobacterium tuberculosis
DFGDEDNFPHPTLGPDTEPQDRMATTSRVRPP

SEQ ID NO: 1424109 - protein, 10 aa, Mycobacterium tuberculosis
DGAGGAGGTR

SEQ ID NO: 1424110 - protein, 13 aa, Mycobacterium tuberculosis
DGDAADAAATKIG

SEQ ID NO: 1424111 - protein, 11 aa, Mycobacterium tuberculosis
DGDQQARGRPI

SEQ ID NO: 1424112 - protein, 17 aa, Mycobacterium tuberculosis
DGHGSSAAAAANPAERI

SEQ ID NO: 1424113 - protein, 7 aa, Mycobacterium tuberculosis
DGPPVPD

SEQ ID NO: 1424114 - protein, 5 aa, Mycobacterium tuberculosis
DGQTV

SEQ ID NO: 1424115 - protein, 11 aa, Mycobacterium tuberculosis
DGRFDAEPDEL

SEQ ID NO: 1424116 - protein, 9 aa, Mycobacterium tuberculosis
DGSMDAGDL

SEQ ID NO: 1424117 - protein, 4 aa, Mycobacterium tuberculosis
DHPT

SEQ ID NO: 1424118 - protein, 55 aa, Mycobacterium tuberculosis
DHRHDQGDDKARPGNPLQRTDPAADAAKAGGSGASVLQPTASAESDHTENREECQ

SEQ ID NO: 1424119 - protein, 9 aa, Mycobacterium tuberculosis
DIDPEETSE

SEQ ID NO: 1424120 - protein, 7 aa, Mycobacterium tuberculosis
DKAARTL

SEQ ID NO: 1424121 - protein, 10 aa, Mycobacterium tuberculosis
DLAGPLSGAG

SEQ ID NO: 1424122 - protein, 8 aa, Mycobacterium tuberculosis
DNDDSVDA

SEQ ID NO: 1424123 - protein, 13 aa, Mycobacterium tuberculosis
DPDPRQRFTTAEE

SEQ ID NO: 1424124 - protein, 4 aa, Mycobacterium tuberculosis
DPHG

SEQ ID NO: 1424125 - protein, 11 aa, Mycobacterium tuberculosis
DPTDGDDVPAG

SEQ ID NO: 1424126 - protein, 12 aa, Mycobacterium tuberculosis
DQRNDNDEPEHQ

SEQ ID NO: 1424127 - protein, 9 aa, Mycobacterium tuberculosis
DQSTVEPAV

SEQ ID NO: 1424128 - protein, 9 aa, Mycobacterium tuberculosis
DRAQATEDL

SEQ ID NO: 1424129 - protein, 20 aa, Mycobacterium tuberculosis
DRSTKKEVKQVKPTNADVGS

SEQ ID NO: 1424130 - protein, 17 aa, Mycobacterium tuberculosis
DRYYGDPSNKPNPNLGE

SEQ ID NO: 1424131 - protein, 12 aa, Mycobacterium tuberculosis
DSGACADNRPEA

SEQ ID NO: 1424132 - protein, 10 aa, Mycobacterium tuberculosis
DSNIELGPGR

SEQ ID NO: 1424133 - protein, 5 aa, Mycobacterium tuberculosis
DSNTA

SEQ ID NO: 1424134 - protein, 14 aa, Mycobacterium tuberculosis
DSSNRQVREAAERA

SEQ ID NO: 1424135 - protein, 20 aa, Mycobacterium tuberculosis
DSSPPSEDYGRQPPQDLAAE

SEQ ID NO: 1424136 - protein, 8 aa, Mycobacterium tuberculosis
DTARGGQI

SEQ ID NO: 1424137 - protein, 4 aa, Mycobacterium tuberculosis
DTDE

SEQ ID NO: 1424138 - protein, 9 aa, Mycobacterium tuberculosis
DTGHGGDPH

SEQ ID NO: 1424139 - protein, 10 aa, Mycobacterium tuberculosis
DTLDPDGSHT

SEQ ID NO: 1424140 - protein, 5 aa, Mycobacterium tuberculosis
DTQRA

SEQ ID NO: 1424141 - protein, 8 aa, Mycobacterium tuberculosis
DVTGDIGP

SEQ ID NO: 1424142 - protein, 9 aa, Mycobacterium tuberculosis
EAGAGSGAL

SEQ ID NO: 1424143 - protein, 9 aa, Mycobacterium tuberculosis
EAGDGQEAV

SEQ ID NO: 1424144 - protein, 19 aa, Mycobacterium tuberculosis
EAPAPFEEPLPPEATDQWQ

SEQ ID NO: 1424145 - protein, 5 aa, Mycobacterium tuberculosis
EAVTE

SEQ ID NO: 1424146 - protein, 4 aa, Mycobacterium tuberculosis
EDTF

SEQ ID NO: 1424147 - protein, 14 aa, Mycobacterium tuberculosis
EEWHGPASASMTAA

SEQ ID NO: 1424148 - protein, 4 aa, Mycobacterium tuberculosis
EFGK

SEQ ID NO: 1424149 - protein, 6 aa, Mycobacterium tuberculosis
EGDIDA

SEQ ID NO: 1424150 - protein, 7 aa, Mycobacterium tuberculosis
EGELPQT

SEQ ID NO: 1424151 - protein, 5 aa, Mycobacterium tuberculosis
EGPLR

SEQ ID NO: 1424152 - protein, 11 aa, Mycobacterium tuberculosis
EGSHDRVSTTY

SEQ ID NO: 1424153 - protein, 11 aa, Mycobacterium tuberculosis
EGTGTVASTDQ

SEQ ID NO: 1424154 - protein, 5 aa, Mycobacterium tuberculosis
EGTGV

SEQ ID NO: 1424155 - protein, 4 aa, Mycobacterium tuberculosis
EHNL

SEQ ID NO: 1424156 - protein, 11 aa, Mycobacterium tuberculosis
EIAQSRAAGDG

SEQ ID NO: 1424157 - protein, 9 aa, Mycobacterium tuberculosis
EKDNTVGTD

SEQ ID NO: 1424158 - protein, 14 aa, Mycobacterium tuberculosis
ELAPVSEGGEDTGV

SEQ ID NO: 1424159 - protein, 9 aa, Mycobacterium tuberculosis
ELDDESAAE

SEQ ID NO: 1424160 - protein, 29 aa, Mycobacterium tuberculosis
EMYPGPDGVVRSTNRAGGLEGGMTNGQPL

SEQ ID NO: 1424161 - protein, 6 aa, Mycobacterium tuberculosis
EPGPLG

SEQ ID NO: 1424162 - protein, 5 aa, Mycobacterium tuberculosis
EPKTQ

SEQ ID NO: 1424163 - protein, 6 aa, Mycobacterium tuberculosis
EPRYGE

SEQ ID NO: 1424164 - protein, 7 aa, Mycobacterium tuberculosis
EQEKNGI

SEQ ID NO: 1424165 - protein, 5 aa, Mycobacterium tuberculosis
EQNRS

SEQ ID NO: 1424166 - protein, 8 aa, Mycobacterium tuberculosis
ERGYDGAT

SEQ ID NO: 1424167 - protein, 5 aa, Mycobacterium tuberculosis
ESAGR

SEQ ID NO: 1424168 - protein, 10 aa, Mycobacterium tuberculosis
ESARGSRRER

SEQ ID NO: 1424169 - protein, 7 aa, Mycobacterium tuberculosis
ESDQREK

SEQ ID NO: 1424170 - protein, 29 aa, Mycobacterium tuberculosis
ESFGGSKPAPAKGTAKSPGKGPDKSLDKA

SEQ ID NO: 1424171 - protein, 11 aa, Mycobacterium tuberculosis
ESGVPTFRDDK

SEQ ID NO: 1424172 - protein, 5 aa, Mycobacterium tuberculosis
ESPAG

SEQ ID NO: 1424173 - protein, 16 aa, Mycobacterium tuberculosis
ESTADRCAERLSGKKV

SEQ ID NO: 1424174 - protein, 14 aa, Mycobacterium tuberculosis
ESTPWSGVTRPTNI

SEQ ID NO: 1424175 - protein, 7 aa, Mycobacterium tuberculosis
ESTSGTL

SEQ ID NO: 1424176 - protein, 5 aa, Mycobacterium tuberculosis
EVAGI

SEQ ID NO: 1424177 - protein, 12 aa, Mycobacterium tuberculosis
EVDDQSRARAAL

SEQ ID NO: 1424178 - protein, 11 aa, Mycobacterium tuberculosis
EWARGKRDQLI

SEQ ID NO: 1424179 - protein, 4 aa, Mycobacterium tuberculosis
FEDG

SEQ ID NO: 1424180 - protein, 5 aa, Mycobacterium tuberculosis
FEETA

SEQ ID NO: 1424181 - protein, 10 aa, Mycobacterium tuberculosis
FGNTGTNNVG

SEQ ID NO: 1424182 - protein, 6 aa, Mycobacterium tuberculosis
FNKPGT

SEQ ID NO: 1424183 - protein, 16 aa, Mycobacterium tuberculosis
FNTGVANAGSYNTGSF

SEQ ID NO: 1424184 - protein, 10 aa, Mycobacterium tuberculosis
GAGGSDLDTT

SEQ ID NO: 1424185 - protein, 8 aa, Mycobacterium tuberculosis
GALPEPAR

SEQ ID NO: 1424186 - protein, 7 aa, Mycobacterium tuberculosis
GAPPERA

SEQ ID NO: 1424187 - protein, 4 aa, Mycobacterium tuberculosis
GAQA

SEQ ID NO: 1424188 - protein, 16 aa, Mycobacterium tuberculosis
GARADGHDHAASAVAA

SEQ ID NO: 1424189 - protein, 13 aa, Mycobacterium tuberculosis
GARKPHKSTVQKV

SEQ ID NO: 1424190 - protein, 16 aa, Mycobacterium tuberculosis
GAWSGPSSTSMASAAA

SEQ ID NO: 1424191 - protein, 5 aa, Mycobacterium tuberculosis
GCCDG

SEQ ID NO: 1424192 - protein, 5 aa, Mycobacterium tuberculosis
GDDVH

SEQ ID NO: 1424193 - protein, 32 aa, Mycobacterium tuberculosis; identical to SEQ ID NO: 192533

SEQ ID NO: 1424194 - protein, 4 aa, Mycobacterium tuberculosis
GDGV

SEQ ID NO: 1424195 - protein, 5 aa, Mycobacterium tuberculosis
GDGVV

SEQ ID NO: 1424196 - protein, 6 aa, Mycobacterium tuberculosis
GDTAGV

SEQ ID NO: 1424197 - protein, 5 aa, Mycobacterium tuberculosis
GEPTI

SEQ ID NO: 1424198 - protein, 13 aa, Mycobacterium tuberculosis
GERLSATKAGSAM

SEQ ID NO: 1424199 - protein, 7 aa, Mycobacterium tuberculosis
GFDNAQR

SEQ ID NO: 1424200 - protein, 23 aa, Mycobacterium tuberculosis
GGAGGGGGKGGNGAGGGLGGGSF

SEQ ID NO: 1424201 - protein, 23 aa, Mycobacterium tuberculosis
GGAGGSGAKGANGGAGGPGGAAG

SEQ ID NO: 1424202 - protein, 27 aa, Mycobacterium tuberculosis
GGDDDDIAGSTAAGQERREKLTEETDD

SEQ ID NO: 1424203 - protein, 31 aa, Mycobacterium tuberculosis
GGFEGAESLHESGTSDRADAAAHRDAIGSYT

SEQ ID NO: 1424204 - protein, 6 aa, Mycobacterium tuberculosis
GGIDSP

SEQ ID NO: 1424205 - protein, 14 aa, Mycobacterium tuberculosis
GGNVSSEHGVGSRK

SEQ ID NO: 1424206 - protein, 6 aa, Mycobacterium tuberculosis
GGPQPV

SEQ ID NO: 1424207 - protein, 9 aa, Mycobacterium tuberculosis
GGSIPETDI

SEQ ID NO: 1424208 - protein, 6 aa, Mycobacterium tuberculosis
GGVGTA

SEQ ID NO: 1424209 - protein, 4 aa, Mycobacterium tuberculosis
GGVV

SEQ ID NO: 1424210 - protein, 5 aa, Mycobacterium tuberculosis
GHRLG

SEQ ID NO: 1424211 - protein, 7 aa, Mycobacterium tuberculosis
GIGVTSA

SEQ ID NO: 1424212 - protein, 7 aa, Mycobacterium tuberculosis
GIKASGA

SEQ ID NO: 1424213 - protein, 9 aa, Mycobacterium tuberculosis
GKAPYGAPQ

SEQ ID NO: 1424214 - protein, 7 aa, Mycobacterium tuberculosis
GLAKPDG

SEQ ID NO: 1424215 - protein, 6 aa, Mycobacterium tuberculosis
GLPSSA

SEQ ID NO: 1424216 - protein, 6 aa, Mycobacterium tuberculosis
GLTSQQ

SEQ ID NO: 1424217 - protein, 9 aa, Mycobacterium tuberculosis
GNAGSGNVG

SEQ ID NO: 1424218 - protein, 8 aa, Mycobacterium tuberculosis
GNAGSTNV

SEQ ID NO: 1424219 - protein, 17 aa, Mycobacterium tuberculosis
GNGANGAPGTGANGGDA

SEQ ID NO: 1424220 - protein, 18 aa, Mycobacterium tuberculosis
GNGANGAPGTGANGGDGG

SEQ ID NO: 1424221 - protein, 27 aa, Mycobacterium tuberculosis
GNGGAGGAGGTATANNGIGGAGGAGGS

SEQ ID NO: 1424222 - protein, 23 aa, Mycobacterium tuberculosis
GNGGNGGNAGKAGGTAGAGGAGG

SEQ ID NO: 1424223 - protein, 4 aa, Mycobacterium tuberculosis
GNRR

SEQ ID NO: 1424224 - protein, 18 aa, Mycobacterium tuberculosis
GNRSIGAAEVATEAGITP

SEQ ID NO: 1424225 - protein, 4 aa, Mycobacterium tuberculosis
GPCS

SEQ ID NO: 1424226 - protein, 5 aa, Mycobacterium tuberculosis
GPCST

SEQ ID NO: 1424227 - protein, 10 aa, Mycobacterium tuberculosis
GPESVDTAQH

SEQ ID NO: 1424228 - protein, 7 aa, Mycobacterium tuberculosis
GPGLADP

SEQ ID NO: 1424229 - protein, 8 aa, Mycobacterium tuberculosis
GPGLADPG

SEQ ID NO: 1424230 - protein, 7 aa, Mycobacterium tuberculosis
GPLGAGK

SEQ ID NO: 1424231 - protein, 4 aa, Mycobacterium tuberculosis
GPLS

SEQ ID NO: 1424232 - protein, 4 aa, Mycobacterium tuberculosis
GPSS

SEQ ID NO: 1424233 - protein, 8 aa, Mycobacterium tuberculosis
GPSWEDDA

SEQ ID NO: 1424234 - protein, 6 aa, Mycobacterium tuberculosis
GPVPDI

SEQ ID NO: 1424235 - protein, 6 aa, Mycobacterium tuberculosis
GQDHSA

SEQ ID NO: 1424236 - protein, 6 aa, Mycobacterium tuberculosis
GQLARG

SEQ ID NO: 1424237 - protein, 8 aa, Mycobacterium tuberculosis
GRGEPADA

SEQ ID NO: 1424238 - protein, 8 aa, Mycobacterium tuberculosis
GRHERSDA

SEQ ID NO: 1424239 - protein, 4 aa, Mycobacterium tuberculosis
GRLD

SEQ ID NO: 1424240 - protein, 8 aa, Mycobacterium tuberculosis
GRLPDGVS

SEQ ID NO: 1424241 - protein, 10 aa, Mycobacterium tuberculosis
GRLTDGHGRT

SEQ ID NO: 1424242 - protein, 9 aa, Mycobacterium tuberculosis
GRRPRPTRE

SEQ ID NO: 1424243 - protein, 10 aa, Mycobacterium tuberculosis
GRSNRLGTPK

SEQ ID NO: 1424244 - protein, 7 aa, Mycobacterium tuberculosis
GRTAPSV

SEQ ID NO: 1424245 - protein, 11 aa, Mycobacterium tuberculosis
GRVCTSSGSPM

SEQ ID NO: 1424246 - protein, 4 aa, Mycobacterium tuberculosis
GSAM

SEQ ID NO: 1424247 - protein, 49 aa, Mycobacterium tuberculosis; identical to SEQ ID NO: 194248

SEQ ID NO: 1424248 - protein, 30 aa, Mycobacterium tuberculosis
GSGNTGSNNIGFGNTGSGNFGFGNTGNNNI

SEQ ID NO: 1424249 - protein, 4 aa, Mycobacterium tuberculosis
GSTG

SEQ ID NO: 1424250 - protein, 8 aa, Mycobacterium tuberculosis
GTDARTRA

SEQ ID NO: 1424251 - protein, 22 aa, Mycobacterium tuberculosis
GTGGAGGAGGAGAAGGAGGSGG

SEQ ID NO: 1424252 - protein, 7 aa, Mycobacterium tuberculosis
GTGGIKG

SEQ ID NO: 1424253 - protein, 9 aa, Mycobacterium tuberculosis
GTGHGGDPH

SEQ ID NO: 1424254 - protein, 27 aa, Mycobacterium tuberculosis
GTGNFGIGNSGRFNTGIGNSGTASTGL

SEQ ID NO: 1424255 - protein, 10 aa, Mycobacterium tuberculosis
GTGVGAGGTA

SEQ ID NO: 1424256 - protein, 9 aa, Mycobacterium tuberculosis
GTSDISKPV

SEQ ID NO: 1424257 - protein, 13 aa, Mycobacterium tuberculosis
GTTCQQRSVETTL

SEQ ID NO: 1424258 - protein, 13 aa, Mycobacterium tuberculosis
GVETHPPNRHESA

SEQ ID NO: 1424259 - protein, 11 aa, Mycobacterium tuberculosis
GVGEDITGGLP

SEQ ID NO: 1424260 - protein, 14 aa, Mycobacterium tuberculosis
GVGGAGGAGGNASL

SEQ ID NO: 1424261 - protein, 8 aa, Mycobacterium tuberculosis
GVHPGDPY

SEQ ID NO: 1424262 - protein, 6 aa, Mycobacterium tuberculosis
GVPAGA

SEQ ID NO: 1424263 - protein, 21 aa, Mycobacterium tuberculosis
GWTEANQANLAAGTEAEPNQA

SEQ ID NO: 1424264 - protein, 8 aa, Mycobacterium tuberculosis
GYDGAGLQ

SEQ ID NO: 1424265 - protein, 8 aa, Mycobacterium tuberculosis
GYSELSDP

SEQ ID NO: 1424266 - protein, 60 aa, Mycobacterium tuberculosis
HAAAQPDSITAATTGGRRRKRAAPDLDATQKSLRPAAKGPKVKKVKPQKPKATKPPKVVS

SEQ ID NO: 1424267 - protein, 16 aa, Mycobacterium tuberculosis
HDPEKAAQIREEDDAM

SEQ ID NO: 1424268 - protein, 12 aa, Mycobacterium tuberculosis
HDPRSREQRRAD

SEQ ID NO: 1424269 - protein, 4 aa, Mycobacterium tuberculosis
HEGQ

SEQ ID NO: 1424270 - protein, 5 aa, Mycobacterium tuberculosis
HGALD

SEQ ID NO: 1424271 - protein, 21 aa, Mycobacterium tuberculosis
HGGTGGAGGTGASGGKGGTGG

SEQ ID NO: 1424272 - protein, 4 aa, Mycobacterium tuberculosis
HNVA

SEQ ID NO: 1424273 - protein, 33 aa, Mycobacterium tuberculosis
HRGAKTRARARHPGEPAGGPPPKPTAGDSKAAP

SEQ ID NO: 1424274 - protein, 15 aa, Mycobacterium tuberculosis
HRPTRPGRHNHPQIS

SEQ ID NO: 1424275 - protein, 5 aa, Mycobacterium tuberculosis
HRSSV

SEQ ID NO: 1424276 - protein, 18 aa, Mycobacterium tuberculosis
HSPDDAGTPPTSTLQCEA

SEQ ID NO: 1424277 - protein, 10 aa, Mycobacterium tuberculosis
HTGSSLPSAP

SEQ ID NO: 1424278 - protein, 6 aa, Mycobacterium tuberculosis
IALPAG

SEQ ID NO: 1424279 - protein, 8 aa, Mycobacterium tuberculosis
IDDSTPNR

SEQ ID NO: 1424280 - protein, 17 aa, Mycobacterium tuberculosis
IDPDGQNGGPELQSPTF

SEQ ID NO: 1424281 - protein, 8 aa, Mycobacterium tuberculosis
IDPGADVA

SEQ ID NO: 1424282 - protein, 71 aa, Mycobacterium tuberculosis; identical to SEQ ID NO: 178523

SEQ ID NO: 1424283 - protein, 30 aa, Mycobacterium tuberculosis; identical to SEQ ID NO: 230237

SEQ ID NO: 1424284 - protein, 8 aa, Mycobacterium tuberculosis
IGDPGDLS

SEQ ID NO: 1424285 - protein, 7 aa, Mycobacterium tuberculosis
IGDQVTK

SEQ ID NO: 1424286 - protein, 8 aa, Mycobacterium tuberculosis
IGERGALE

SEQ ID NO: 1424287 - protein, 8 aa, Mycobacterium tuberculosis
IGNAGANN

SEQ ID NO: 1424288 - protein, 6 aa, Mycobacterium tuberculosis
IGPPVP

SEQ ID NO: 1424289 - protein, 5 aa, Mycobacterium tuberculosis
IGRGQ

SEQ ID NO: 1424290 - protein, 6 aa, Mycobacterium tuberculosis
IGTTAT

SEQ ID NO: 1424291 - protein, 22 aa, Mycobacterium tuberculosis
INGTGGAGGSRGQISGNPGTPG

SEQ ID NO: 1424292 - protein, 10 aa, Mycobacterium tuberculosis
IPETSQRSPG

SEQ ID NO: 1424293 - protein, 8 aa, Mycobacterium tuberculosis
IRPAPDTM

SEQ ID NO: 1424294 - protein, 6 aa, Mycobacterium tuberculosis
ISRANA

SEQ ID NO: 1424295 - protein, 9 aa, Mycobacterium tuberculosis
ITGENAPAI

SEQ ID NO: 1424296 - protein, 7 aa, Mycobacterium tuberculosis
KAAGAQL

SEQ ID NO: 1424297 - protein, 4 aa, Mycobacterium tuberculosis
KAST

SEQ ID NO: 1424298 - protein, 12 aa, Mycobacterium tuberculosis
KDKGTGKENTIR

SEQ ID NO: 1424299 - protein, 5 aa, Mycobacterium tuberculosis
KGGAM

SEQ ID NO: 1424300 - protein, 5 aa, Mycobacterium tuberculosis
KGSLR

SEQ ID NO: 1424301 - protein, 5 aa, Mycobacterium tuberculosis
KGVEK

SEQ ID NO: 1424302 - protein, 7 aa, Mycobacterium tuberculosis
KHADRSI

SEQ ID NO: 1424303 - protein, 11 aa, Mycobacterium tuberculosis
KKRTSTRISNP

SEQ ID NO: 1424304 - protein, 15 aa, Mycobacterium tuberculosis
KLGNHANASSEVEYD

SEQ ID NO: 1424305 - protein, 10 aa, Mycobacterium tuberculosis
KPHKSTVQKV

SEQ ID NO: 1424306 - protein, 9 aa, Mycobacterium tuberculosis
KQSADPRSD

SEQ ID NO: 1424307 - protein, 5 aa, Mycobacterium tuberculosis
KSHID

SEQ ID NO: 1424308 - protein, 7 aa, Mycobacterium tuberculosis
KSKQDHS

SEQ ID NO: 1424309 - protein, 8 aa, Mycobacterium tuberculosis
KSLTLDPQ

SEQ ID NO: 1424310 - protein, 14 aa, Mycobacterium tuberculosis
KSPAAELSMSGTAI

SEQ ID NO: 1424311 - protein, 5 aa, Mycobacterium tuberculosis
KSVYQ

SEQ ID NO: 1424312 - protein, 14 aa, Mycobacterium tuberculosis
KTERRPVPSTELRK

SEQ ID NO: 1424313 - protein, 5 aa, Mycobacterium tuberculosis
LANGR

SEQ ID NO: 1424314 - protein, 8 aa, Mycobacterium tuberculosis
LAPGPHET

SEQ ID NO: 1424315 - protein, 5 aa, Mycobacterium tuberculosis
LAPTT

SEQ ID NO: 1424316 - protein, 5 aa, Mycobacterium tuberculosis
LARDG

SEQ ID NO: 1424317 - protein, 4 aa, Mycobacterium tuberculosis
LDGN

SEQ ID NO: 1424318 - protein, 15 aa, Mycobacterium tuberculosis
LDSSNRQVREAAERA

SEQ ID NO: 1424319 - protein, 8 aa, Mycobacterium tuberculosis
LEGDTGAS

SEQ ID NO: 1424320 - protein, 9 aa, Mycobacterium tuberculosis
LEGDTGASL

SEQ ID NO: 1424321 - protein, 14 aa, Mycobacterium tuberculosis
LEKDPAIHDNRGFG

SEQ ID NO: 1424322 - protein, 9 aa, Mycobacterium tuberculosis
LEPATAPAA

SEQ ID NO: 1424323 - protein, 4 aa, Mycobacterium tuberculosis
LGDT

SEQ ID NO: 1424324 - protein, 18 aa, Mycobacterium tuberculosis
LGEEGGGPADVTATPSDR

SEQ ID NO: 1424325 - protein, 10 aa, Mycobacterium tuberculosis
LGPNPNWDSP

SEQ ID NO: 1424326 - protein, 10 aa, Mycobacterium tuberculosis
LNPTGSFKDR

SEQ ID NO: 1424327 - protein, 4 aa, Mycobacterium tuberculosis
LPPQ

SEQ ID NO: 1424328 - protein, 6 aa, Mycobacterium tuberculosis
LPTNTL

SEQ ID NO: 1424329 - protein, 7 aa, Mycobacterium tuberculosis
LRPGDPI

SEQ ID NO: 1424330 - protein, 12 aa, Mycobacterium tuberculosis
LRPGTALTPGDV

SEQ ID NO: 1424331 - protein, 17 aa, Mycobacterium tuberculosis
LRSSREVARRGPGRVPD

SEQ ID NO: 1424332 - protein, 5 aa, Mycobacterium tuberculosis
LSAEG

SEQ ID NO: 1424333 - protein, 9 aa, Mycobacterium tuberculosis
LSPDAIPAE

SEQ ID NO: 1424334 - protein, 10 aa, Mycobacterium tuberculosis
LSPDAIPAEM

SEQ ID NO: 1424335 - protein, 7 aa, Mycobacterium tuberculosis
LSPPDVR

SEQ ID NO: 1424336 - protein, 6 aa, Mycobacterium tuberculosis
LSSNAA

SEQ ID NO: 1424337 - protein, 6 aa, Mycobacterium tuberculosis
LTGGLA

SEQ ID NO: 1424338 - protein, 6 aa, Mycobacterium tuberculosis
LTPEQD

SEQ ID NO: 1424339 - protein, 14 aa, Mycobacterium tuberculosis
MGQNPDKSPHLTGE

SEQ ID NO: 1424340 - protein, 7 aa, Mycobacterium tuberculosis
MSAKGIP

SEQ ID NO: 1424341 - protein, 22 aa, Mycobacterium tuberculosis
NAEPRFEVPRSSSSVIPHSPAA

SEQ ID NO: 1424342 - protein, 4 aa, Mycobacterium tuberculosis
NAGG

SEQ ID NO: 1424343 - protein, 6 aa, Mycobacterium tuberculosis
NAGVTP

SEQ ID NO: 1424344 - protein, 11 aa, Mycobacterium tuberculosis
NAPRRNRVGRQ

SEQ ID NO: 1424345 - protein, 24 aa, Mycobacterium tuberculosis
NGGAGGFGGAGAVGGNGGAGGTAG

SEQ ID NO: 1424346 - protein, 14 aa, Mycobacterium tuberculosis
NGGAGGSGAPGGAG

SEQ ID NO: 1424347 - protein, 21 aa, Mycobacterium tuberculosis
NGGAGGSGAPGQAGGPGGAAG

SEQ ID NO: 1424348 - protein, 125 aa, Mycobacterium tuberculosis; identical to SEQ ID NO: 194532

SEQ ID NO: 1424349 - protein, 20 aa, Mycobacterium tuberculosis
NGGNGFSPAAGPGGNGGAAG

SEQ ID NO: 1424350 - protein, 34 aa, Mycobacterium tuberculosis
NGGNGGNAGAGGDGGAGVAGGVGGNGGGGGTATF

SEQ ID NO: 1424351 - protein, 32 aa, Mycobacterium tuberculosis; identical to SEQ ID NO: 181327

SEQ ID NO: 1424352 - protein, 10 aa, Mycobacterium tuberculosis
NGMRRGDAVT

SEQ ID NO: 1424353 - protein, 8 aa, Mycobacterium tuberculosis
NGSLAGGT

SEQ ID NO: 1424354 - protein, 4 aa, Mycobacterium tuberculosis
NIGG

SEQ ID NO: 1424355 - protein, 7 aa, Mycobacterium tuberculosis
NKEQGAW

SEQ ID NO: 1424356 - protein, 8 aa, Mycobacterium tuberculosis
NLDDPDAA

SEQ ID NO: 1424357 - protein, 15 aa, Mycobacterium tuberculosis
NNPSGVGTVVFNYPP

SEQ ID NO: 1424358 - protein, 4 aa, Mycobacterium tuberculosis
NPAP

SEQ ID NO: 1424359 - protein, 13 aa, Mycobacterium tuberculosis
NQKGGVGKTTTAV

SEQ ID NO: 1424360 - protein, 4 aa, Mycobacterium tuberculosis
NSGI

SEQ ID NO: 1424361 - protein, 12 aa, Mycobacterium tuberculosis
NSGSNDSGLRNT

SEQ ID NO: 1424362 - protein, 5 aa, Mycobacterium tuberculosis
NTAGQ

SEQ ID NO: 1424363 - protein, 6 aa, Mycobacterium tuberculosis
NTLTGG

SEQ ID NO: 1424364 - protein, 9 aa, Mycobacterium tuberculosis
PAGPAAESV

SEQ ID NO: 1424365 - protein, 18 aa, Mycobacterium tuberculosis
PAHPPALPDPLPAGPTRR

SEQ ID NO: 1424366 - protein, 17 aa, Mycobacterium tuberculosis
PAIDASPVRAYDKAAEA

SEQ ID NO: 1424367 - protein, 21 aa, Mycobacterium tuberculosis
PDAPPGTERFGPQPAQPAAGP

SEQ ID NO: 1424368 - protein, 8 aa, Mycobacterium tuberculosis
PDPPRHPI

SEQ ID NO: 1424369 - protein, 8 aa, Mycobacterium tuberculosis
PDSPPTDE

SEQ ID NO: 1424370 - protein, 5 aa, Mycobacterium tuberculosis
PEAVA

SEQ ID NO: 1424371 - protein, 10 aa, Mycobacterium tuberculosis
PEKLSAAKAL

SEQ ID NO: 1424372 - protein, 4 aa, Mycobacterium tuberculosis
PGAD

SEQ ID NO: 1424373 - protein, 9 aa, Mycobacterium tuberculosis
PGGVDSPET

SEQ ID NO: 1424374 - protein, 6 aa, Mycobacterium tuberculosis
PGKEPW

SEQ ID NO: 1424375 - protein, 5 aa, Mycobacterium tuberculosis
PGPVA

SEQ ID NO: 1424376 - protein, 4 aa, Mycobacterium tuberculosis
PHGH

SEQ ID NO: 1424377 - protein, 6 aa, Mycobacterium tuberculosis
PHPIDG

SEQ ID NO: 1424378 - protein, 7 aa, Mycobacterium tuberculosis
PHSGSAP

SEQ ID NO: 1424379 - protein, 8 aa, Mycobacterium tuberculosis
PINPSGGL

SEQ ID NO: 1424380 - protein, 14 aa, Mycobacterium tuberculosis
PLQSPSVTDDEPTR

SEQ ID NO: 1424381 - protein, 13 aa, Mycobacterium tuberculosis
PLQSSGCSNSDSC

SEQ ID NO: 1424382 - protein, 7 aa, Mycobacterium tuberculosis
PPATVGG

SEQ ID NO: 1424383 - protein, 12 aa, Mycobacterium tuberculosis
PPNLAGAAQEAL

SEQ ID NO: 1424384 - protein, 17 aa, Mycobacterium tuberculosis
PRFSRTASSQPRPPAAT

SEQ ID NO: 1424385 - protein, 16 aa, Mycobacterium tuberculosis
PRGYGNNAWARVALRV

SEQ ID NO: 1424386 - protein, 9 aa, Mycobacterium tuberculosis
PRSRGGAHS

SEQ ID NO: 1424387 - protein, 11 aa, Mycobacterium tuberculosis
PSAQAEPETCP

SEQ ID NO: 1424388 - protein, 17 aa, Mycobacterium tuberculosis
PSGQPEGPDAATPPMQP

SEQ ID NO: 1424389 - protein, 8 aa, Mycobacterium tuberculosis
PTARRRDA

SEQ ID NO: 1424390 - protein, 7 aa, Mycobacterium tuberculosis
PTEPIPR

SEQ ID NO: 1424391 - protein, 4 aa, Mycobacterium tuberculosis
PTKL

SEQ ID NO: 1424392 - protein, 8 aa, Mycobacterium tuberculosis
PTLQGDAA

SEQ ID NO: 1424393 - protein, 7 aa, Mycobacterium tuberculosis
PTLSSAQ

SEQ ID NO: 1424394 - protein, 29 aa, Mycobacterium tuberculosis
PTSAAVSGTALDDGAEPALASDLVVADEH

SEQ ID NO: 1424395 - protein, 16 aa, Mycobacterium tuberculosis
QALADASADRASQIRT

SEQ ID NO: 1424396 - protein, 5 aa, Mycobacterium tuberculosis
QARPV

SEQ ID NO: 1424397 - protein, 7 aa, Mycobacterium tuberculosis
QDEIPTD

SEQ ID NO: 1424398 - protein, 4 aa, Mycobacterium tuberculosis
QFGK

SEQ ID NO: 1424399 - protein, 6 aa, Mycobacterium tuberculosis
QGATAE

SEQ ID NO: 1424400 - protein, 8 aa, Mycobacterium tuberculosis
QGNRSAAG

SEQ ID NO: 1424401 - protein, 63 aa, Mycobacterium tuberculosis; identical to SEQ ID NO: 230924

SEQ ID NO: 1424402 - protein, 4 aa, Mycobacterium tuberculosis
QIGP

SEQ ID NO: 1424403 - protein, 14 aa, Mycobacterium tuberculosis
QKYDPSRVMFSGLN

SEQ ID NO: 1424404 - protein, 11 aa, Mycobacterium tuberculosis
QLDSTGPGQAI

SEQ ID NO: 1424405 - protein, 4 aa, Mycobacterium tuberculosis
QPDQ

SEQ ID NO: 1424406 - protein, 5 aa, Mycobacterium tuberculosis
QPERQ

SEQ ID NO: 1424407 - protein, 18 aa, Mycobacterium tuberculosis
QPTDPRTLPPDAPDDRKY

SEQ ID NO: 1424408 - protein, 17 aa, Mycobacterium tuberculosis
QRAAEEAGIKQRPPTMR

SEQ ID NO: 1424409 - protein, 12 aa, Mycobacterium tuberculosis
QRRQDEAMRPRT

SEQ ID NO: 1424410 - protein, 54 aa, Mycobacterium tuberculosis; identical to SEQ ID NO: 184470

SEQ ID NO: 1424411 - protein, 6 aa, Mycobacterium tuberculosis
RAIGPG

SEQ ID NO: 1424412 - protein, 8 aa, Mycobacterium tuberculosis
RDEAPADL

SEQ ID NO: 1424413 - protein, 6 aa, Mycobacterium tuberculosis
RDGCPS

SEQ ID NO: 1424414 - protein, 7 aa, Mycobacterium tuberculosis
RDRRDFD

SEQ ID NO: 1424415 - protein, 7 aa, Mycobacterium tuberculosis
RDSLRRA

SEQ ID NO: 1424416 - protein, 5 aa, Mycobacterium tuberculosis
RDTHG

SEQ ID NO: 1424417 - protein, 11 aa, Mycobacterium tuberculosis
REAYGDTSQLS

SEQ ID NO: 1424418 - protein, 8 aa, Mycobacterium tuberculosis
REDGQQSI

SEQ ID NO: 1424419 - protein, 8 aa, Mycobacterium tuberculosis
RENPQRTA

SEQ ID NO: 1424420 - protein, 6 aa, Mycobacterium tuberculosis
RFTSTE

SEQ ID NO: 1424421 - protein, 11 aa, Mycobacterium tuberculosis
RGAGGSDLDTT

SEQ ID NO: 1424422 - protein, 11 aa, Mycobacterium tuberculosis
RGDPNGAAAGD

SEQ ID NO: 1424423 - protein, 6 aa, Mycobacterium tuberculosis
RKATGL

SEQ ID NO: 1424424 - protein, 9 aa, Mycobacterium tuberculosis
RKDPSTPKI

SEQ ID NO: 1424425 - protein, 17 aa, Mycobacterium tuberculosis
RLDGSDRRNSGGGATRM

SEQ ID NO: 1424426 - protein, 5 aa, Mycobacterium tuberculosis
RLGET

SEQ ID NO: 1424427 - protein, 7 aa, Mycobacterium tuberculosis
RNDPDFS

SEQ ID NO: 1424428 - protein, 8 aa, Mycobacterium tuberculosis
RNDPDFSR

SEQ ID NO: 1424429 - protein, 10 aa, Mycobacterium tuberculosis
RPAATPPGPL

SEQ ID NO: 1424430 - protein, 4 aa, Mycobacterium tuberculosis
RPER

SEQ ID NO: 1424431 - protein, 6 aa, Mycobacterium tuberculosis
RPERHR

SEQ ID NO: 1424432 - protein, 5 aa, Mycobacterium tuberculosis
RPGET

SEQ ID NO: 1424433 - protein, 8 aa, Mycobacterium tuberculosis
RPGPVSTE

SEQ ID NO: 1424434 - protein, 4 aa, Mycobacterium tuberculosis
RPGR

SEQ ID NO: 1424435 - protein, 9 aa, Mycobacterium tuberculosis
RPIQDSPGR

SEQ ID NO: 1424436 - protein, 10 aa, Mycobacterium tuberculosis
RPIQDSPGRL

SEQ ID NO: 1424437 - protein, 8 aa, Mycobacterium tuberculosis
RPRGAGME

SEQ ID NO: 1424438 - protein, 9 aa, Mycobacterium tuberculosis
RPRGAGMER

SEQ ID NO: 1424439 - protein, 5 aa, Mycobacterium tuberculosis
RQEPR

SEQ ID NO: 1424440 - protein, 9 aa, Mycobacterium tuberculosis
RQLASTGAR

SEQ ID NO: 1424441 - protein, 7 aa, Mycobacterium tuberculosis
RQRGEPQ

SEQ ID NO: 1424442 - protein, 13 aa, Mycobacterium tuberculosis
RREQLTGDEAHER

SEQ ID NO: 1424443 - protein, 9 aa, Mycobacterium tuberculosis
RRRRARAGS

SEQ ID NO: 1424444 - protein, 4 aa, Mycobacterium tuberculosis
RRTI

SEQ ID NO: 1424445 - protein, 7 aa, Mycobacterium tuberculosis
RRTPRMA

SEQ ID NO: 1424446 - protein, 4 aa, Mycobacterium tuberculosis
RSEA

SEQ ID NO: 1424447 - protein, 9 aa, Mycobacterium tuberculosis
RTPPYPTAT

SEQ ID NO: 1424448 - protein, 16 aa, Mycobacterium tuberculosis
RVRSGEPTARLTGPPG

SEQ ID NO: 1424449 - protein, 9 aa, Mycobacterium tuberculosis
RYRPADSAA

SEQ ID NO: 1424450 - protein, 6 aa, Mycobacterium tuberculosis
SADGYR

SEQ ID NO: 1424451 - protein, 10 aa, Mycobacterium tuberculosis
SAEVDASYAA

SEQ ID NO: 1424452 - protein, 4 aa, Mycobacterium tuberculosis
SAGW

SEQ ID NO: 1424453 - protein, 6 aa, Mycobacterium tuberculosis
SALDGH

SEQ ID NO: 1424454 - protein, 18 aa, Mycobacterium tuberculosis
SAQFPRPAPRSSYSALSS

SEQ ID NO: 1424455 - protein, 22 aa, Mycobacterium tuberculosis
SAQSSAQAVTAQAVGSTVPGPL

SEQ ID NO: 1424456 - protein, 9 aa, Mycobacterium tuberculosis
SAVPGTDTM

SEQ ID NO: 1424457 - protein, 4 aa, Mycobacterium tuberculosis
SDAG

SEQ ID NO: 1424458 - protein, 15 aa, Mycobacterium tuberculosis
SGDGNTGFGNAGNIN

SEQ ID NO: 1424459 - protein, 4 aa, Mycobacterium tuberculosis
SGFS

SEQ ID NO: 1424460 - protein, 28 aa, Mycobacterium tuberculosis
SGGAGGNGGYSLNGTGGDGGTGGAGQIT

SEQ ID NO: 1424461 - protein, 8 aa, Mycobacterium tuberculosis
SGHQPDGY

SEQ ID NO: 1424462 - protein, 5 aa, Mycobacterium tuberculosis
SGKMT

SEQ ID NO: 1424463 - protein, 14 aa, Mycobacterium tuberculosis
SGRSTSEVTEEQIR

SEQ ID NO: 1424464 - protein, 6 aa, Mycobacterium tuberculosis
SGSHNT

SEQ ID NO: 1424465 - protein, 7 aa, Mycobacterium tuberculosis
SGTDGFN

SEQ ID NO: 1424466 - protein, 6 aa, Mycobacterium tuberculosis
SGTGNL

SEQ ID NO: 1424467 - protein, 5 aa, Mycobacterium tuberculosis
SLDGR

SEQ ID NO: 1424468 - protein, 19 aa, Mycobacterium tuberculosis
SLPTDFRTAPDAGRRARAR

SEQ ID NO: 1424469 - protein, 10 aa, Mycobacterium tuberculosis
SNLGGGNVGL

SEQ ID NO: 1424470 - protein, 9 aa, Mycobacterium tuberculosis
SPTKEFNEH

SEQ ID NO: 1424471 - protein, 4 aa, Mycobacterium tuberculosis
SQDI

SEQ ID NO: 1424472 - protein, 11 aa, Mycobacterium tuberculosis
SQTRDLSNEAT

SEQ ID NO: 1424473 - protein, 5 aa, Mycobacterium tuberculosis
SRANA

SEQ ID NO: 1424474 - protein, 9 aa, Mycobacterium tuberculosis
SRREAPDRN

SEQ ID NO: 1424475 - protein, 11 aa, Mycobacterium tuberculosis
STAPGGPAPPP

SEQ ID NO: 1424476 - protein, 8 aa, Mycobacterium tuberculosis
STAPVRRG

SEQ ID NO: 1424477 - protein, 20 aa, Mycobacterium tuberculosis
STGLAGRITTADTTPESAAD

SEQ ID NO: 1424478 - protein, 5 aa, Mycobacterium tuberculosis
STRPL

SEQ ID NO: 1424479 - protein, 6 aa, Mycobacterium tuberculosis
STTPHH

SEQ ID NO: 1424480 - protein, 4 aa, Mycobacterium tuberculosis
SWKG

SEQ ID NO: 1424481 - protein, 8 aa, Mycobacterium tuberculosis
TAPTDSAI

SEQ ID NO: 1424482 - protein, 10 aa, Mycobacterium tuberculosis
TASTRRPAVG

SEQ ID NO: 1424483 - protein, 7 aa, Mycobacterium tuberculosis
TDAEAAT

SEQ ID NO: 1424484 - protein, 9 aa, Mycobacterium tuberculosis
TDLEQATGA

SEQ ID NO: 1424485 - protein, 6 aa, Mycobacterium tuberculosis
TETDDR

SEQ ID NO: 1424486 - protein, 5 aa, Mycobacterium tuberculosis
TGDMT

SEQ ID NO: 1424487 - protein, 5 aa, Mycobacterium tuberculosis
TGEEV

SEQ ID NO: 1424488 - protein, 7 aa, Mycobacterium tuberculosis
TGFTEAD

SEQ ID NO: 1424489 - protein, 9 aa, Mycobacterium tuberculosis
TGGASGIGL

SEQ ID NO: 1424490 - protein, 6 aa, Mycobacterium tuberculosis
TGGTGK

SEQ ID NO: 1424491 - protein, 12 aa, Mycobacterium tuberculosis
TGPQRSTVKAAE

SEQ ID NO: 1424492 - protein, 7 aa, Mycobacterium tuberculosis
TGRKPSR

SEQ ID NO: 1424493 - protein, 6 aa, Mycobacterium tuberculosis
THGATS

SEQ ID NO: 1424494 - protein, 18 aa, Mycobacterium tuberculosis
TIAGRGRHPLPSGASLQA

SEQ ID NO: 1424495 - protein, 5 aa, Mycobacterium tuberculosis
TKATG

SEQ ID NO: 1424496 - protein, 10 aa, Mycobacterium tuberculosis
TKVPPPAADY

SEQ ID NO: 1424497 - protein, 5 aa, Mycobacterium tuberculosis
TLGPI

SEQ ID NO: 1424498 - protein, 6 aa, Mycobacterium tuberculosis
TLYDAG

SEQ ID NO: 1424499 - protein, 6 aa, Mycobacterium tuberculosis
TPQARA

SEQ ID NO: 1424500 - protein, 7 aa, Mycobacterium tuberculosis
TQALARQ

SEQ ID NO: 1424501 - protein, 13 aa, Mycobacterium tuberculosis
TRGAAAPSDCGCS

SEQ ID NO: 1424502 - protein, 6 aa, Mycobacterium tuberculosis
TSTTWP

SEQ ID NO: 1424503 - protein, 6 aa, Mycobacterium tuberculosis
TTAMRE

SEQ ID NO: 1424504 - protein, 8 aa, Mycobacterium tuberculosis
TTGADTPV

SEQ ID NO: 1424505 - protein, 14 aa, Mycobacterium tuberculosis
TTMQSAQRDEKELG

SEQ ID NO: 1424506 - protein, 5 aa, Mycobacterium tuberculosis
TTTQA

SEQ ID NO: 1424507 - protein, 12 aa, Mycobacterium tuberculosis
TVERSGLSADDV

SEQ ID NO: 1424508 - protein, 8 aa, Mycobacterium tuberculosis
TVETKDQV

SEQ ID NO: 1424509 - protein, 7 aa, Mycobacterium tuberculosis
TVSNAEE

SEQ ID NO: 1424510 - protein, 6 aa, Mycobacterium tuberculosis
TWSGTG

SEQ ID NO: 1424511 - protein, 11 aa, Mycobacterium tuberculosis
TYGQGGPAEQP

SEQ ID NO: 1424512 - protein, 10 aa, Mycobacterium tuberculosis
VAAGEPLPSA

SEQ ID NO: 1424513 - protein, 6 aa, Mycobacterium tuberculosis
VARTGL

SEQ ID NO: 1424514 - protein, 9 aa, Mycobacterium tuberculosis
VDGAPGPDM

SEQ ID NO: 1424515 - protein, 6 aa, Mycobacterium tuberculosis
VDGQPY

SEQ ID NO: 1424516 - protein, 11 aa, Mycobacterium tuberculosis
VDHTGRYRGRA

SEQ ID NO: 1424517 - protein, 18 aa, Mycobacterium tuberculosis
VDSGATPALQQFREVKWW

SEQ ID NO: 1424518 - protein, 9 aa, Mycobacterium tuberculosis
VDTEAEREL

SEQ ID NO: 1424519 - protein, 9 aa, Mycobacterium tuberculosis
VEPSDQLQG

SEQ ID NO: 1424520 - protein, 14 aa, Mycobacterium tuberculosis
VGGGGGNGGDPGLG

SEQ ID NO: 1424521 - protein, 16 aa, Mycobacterium tuberculosis
VGLSTKTERHRPGQPL

SEQ ID NO: 1424522 - protein, 18 aa, Mycobacterium tuberculosis
VGRQLGEKTVKATTAGHA

SEQ ID NO: 1424523 - protein, 5 aa, Mycobacterium tuberculosis
VNDPD

SEQ ID NO: 1424524 - protein, 6 aa, Mycobacterium tuberculosis
VPGSAS

SEQ ID NO: 1424525 - protein, 18 aa, Mycobacterium tuberculosis
VPSGQPEGPDAATPPMQP

SEQ ID NO: 1424526 - protein, 8 aa, Mycobacterium tuberculosis
VPTAANAG

SEQ ID NO: 1424527 - protein, 4 aa, Mycobacterium tuberculosis
VQRG

SEQ ID NO: 1424528 - protein, 8 aa, Mycobacterium tuberculosis
VRETKAAT

SEQ ID NO: 1424529 - protein, 6 aa, Mycobacterium tuberculosis
VRPPSM

SEQ ID NO: 1424530 - protein, 6 aa, Mycobacterium tuberculosis
VRSAEA

SEQ ID NO: 1424531 - protein, 6 aa, Mycobacterium tuberculosis
VSPSFE

SEQ ID NO: 1424532 - protein, 12 aa, Mycobacterium tuberculosis
VSSTSTLQGAGW

SEQ ID NO: 1424533 - protein, 7 aa, Mycobacterium tuberculosis
VTAGQAA

SEQ ID NO: 1424534 - protein, 7 aa, Mycobacterium tuberculosis
VTEEANA

SEQ ID NO: 1424535 - protein, 34 aa, Mycobacterium tuberculosis; identical to SEQ ID NO: 191481

SEQ ID NO: 1424536 - protein, 5 aa, Mycobacterium tuberculosis
WPGAG

SEQ ID NO: 1424537 - protein, 10 aa, Mycobacterium tuberculosis
WRGDQKNASL

SEQ ID NO: 1424538 - protein, 4 aa, Mycobacterium tuberculosis
WRRP

SEQ ID NO: 1424539 - protein, 9 aa, Mycobacterium tuberculosis
WTRDETEQR

SEQ ID NO: 1424540 - protein, 5 aa, Mycobacterium tuberculosis
YENQD

SEQ ID NO: 1424541 - protein, 4 aa, Mycobacterium tuberculosis
YGAD

SEQ ID NO: 1424542 - protein, 18 aa, Mycobacterium tuberculosis
YGASADQSRGVADGKPAD

SEQ ID NO: 1424543 - protein, 8 aa, Mycobacterium tuberculosis
YGETKRPE

SEQ ID NO: 1424544 - protein, 5 aa, Mycobacterium tuberculosis
YNGYT

SEQ ID NO: 1424545 - protein, 20 aa, Mycobacterium tuberculosis
YSEPGAGSDLASVATTAELD

SEQ ID NO: 1424546 - protein, 21 aa, Mycobacterium tuberculosis
YSEPGAGSDLASVATTAELDG

SEQ ID NO: 1424547 - protein, 8 aa, Mycobacterium tuberculosis
YSGPGPNS

SEQ ID NO: 1424548 - protein, 8 aa, Mycobacterium tuberculosis
YSPYENVT

SEQ ID NO: 1424549 - protein, 4 aa, Mycobacterium tuberculosis
YTAG

SEQ ID NO: 1424550 - protein, 4 aa, Mycobacterium tuberculosis
YTGE

SEQ ID NO: 1424551 - protein, 6 aa, Mycobacterium tuberculosis
AAAGDR

SEQ ID NO: 1424552 - protein, 6 aa, Mycobacterium tuberculosis
AAAGVY

SEQ ID NO: 1424553 - protein, 17 aa, Mycobacterium tuberculosis
AAASDDGEVSSSPQLPP

SEQ ID NO: 1424554 - protein, 8 aa, Mycobacterium tuberculosis
AAASGSDI

SEQ ID NO: 1424555 - protein, 5 aa, Mycobacterium tuberculosis
AAATG

SEQ ID NO: 1424556 - protein, 19 aa, Mycobacterium tuberculosis
AADDDHDHDHDHGGEPTPL

SEQ ID NO: 1424557 - protein, 7 aa, Mycobacterium tuberculosis
AADGTPL

SEQ ID NO: 1424558 - protein, 16 aa, Mycobacterium tuberculosis
AADLGQRRALTGEPLP

SEQ ID NO: 1424559 - protein, 10 aa, Mycobacterium tuberculosis
AAEAAAQPSH

SEQ ID NO: 1424560 - protein, 6 aa, Mycobacterium tuberculosis
AAERSE

SEQ ID NO: 1424561 - protein, 7 aa, Mycobacterium tuberculosis
AAERSEL

SEQ ID NO: 1424562 - protein, 20 aa, Mycobacterium tuberculosis
AAGDTDAWEQTVGDGVGDAP

SEQ ID NO: 1424563 - protein, 6 aa, Mycobacterium tuberculosis
AAGGAG

SEQ ID NO: 1424564 - protein, 6 aa, Mycobacterium tuberculosis
AAGGLD

SEQ ID NO: 1424565 - protein, 9 aa, Mycobacterium tuberculosis
AAGGPEVDE

SEQ ID NO: 1424566 - protein, 7 aa, Mycobacterium tuberculosis
AAGGVDA

SEQ ID NO: 1424567 - protein, 8 aa, Mycobacterium tuberculosis
AAGKTPVP

SEQ ID NO: 1424568 - protein, 17 aa, Mycobacterium tuberculosis
AAGNPLAAGSARPVQPA

SEQ ID NO: 1424569 - protein, 13 aa, Mycobacterium tuberculosis
AAKSDGGRNNQAG

SEQ ID NO: 1424570 - protein, 10 aa, Mycobacterium tuberculosis
AAKSGANAIH

SEQ ID NO: 1424571 - protein, 8 aa, Mycobacterium tuberculosis
AALGTPRR

SEQ ID NO: 1424572 - protein, 13 aa, Mycobacterium tuberculosis
AANAAAAAQTTGV

SEQ ID NO: 1424573 - protein, 19 aa, Mycobacterium tuberculosis
AAQGRGASTISGALRSRDT

SEQ ID NO: 1424574 - protein, 4 aa, Mycobacterium tuberculosis
AAQT

SEQ ID NO: 1424575 - protein, 10 aa, Mycobacterium tuberculosis
AARPEPSAAW

SEQ ID NO: 1424576 - protein, 7 aa, Mycobacterium tuberculosis
AASDRVR

SEQ ID NO: 1424577 - protein, 4 aa, Mycobacterium tuberculosis
ADDA

SEQ ID NO: 1424578 - protein, 5 aa, Mycobacterium tuberculosis
ADDNR

SEQ ID NO: 1424579 - protein, 9 aa, Mycobacterium tuberculosis
ADDPAAQVT

SEQ ID NO: 1424580 - protein, 10 aa, Mycobacterium tuberculosis
ADIVGPGEGI

SEQ ID NO: 1424581 - protein, 33 aa, Mycobacterium tuberculosis
ADPGMTSTELSRRGGQNVYSPAAETTVTAVASY

SEQ ID NO: 1424582 - protein, 15 aa, Mycobacterium tuberculosis
ADPPRRASVNEVGGT

SEQ ID NO: 1424583 - protein, 13 aa, Mycobacterium tuberculosis
ADQARAAAAGDDE

SEQ ID NO: 1424584 - protein, 4 aa, Mycobacterium tuberculosis
ADTE

SEQ ID NO: 1424585 - protein, 6 aa, Mycobacterium tuberculosis
ADTGAE

SEQ ID NO: 1424586 - protein, 6 aa, Mycobacterium tuberculosis
AEATDH

SEQ ID NO: 1424587 - protein, 5 aa, Mycobacterium tuberculosis
AEAVE

SEQ ID NO: 1424588 - protein, 19 aa, Mycobacterium tuberculosis
AEDLGERRALTGEPLPAQL

SEQ ID NO: 1424589 - protein, 5 aa, Mycobacterium tuberculosis
AEFDG

SEQ ID NO: 1424590 - protein, 6 aa, Mycobacterium tuberculosis
AEGATA

SEQ ID NO: 1424591 - protein, 6 aa, Mycobacterium tuberculosis
AEKSFA

SEQ ID NO: 1424592 - protein, 7 aa, Mycobacterium tuberculosis
AENGHEN

SEQ ID NO: 1424593 - protein, 9 aa, Mycobacterium tuberculosis
AEPHYRPSA

SEQ ID NO: 1424594 - protein, 7 aa, Mycobacterium tuberculosis
AEQRDSV

SEQ ID NO: 1424595 - protein, 7 aa, Mycobacterium tuberculosis
AESPDFG

SEQ ID NO: 1424596 - protein, 18 aa, Mycobacterium tuberculosis
AGAGSYAAAEAASAAPLE

SEQ ID NO: 1424597 - protein, 14 aa, Mycobacterium tuberculosis
AGCGDRLARGDQAC

SEQ ID NO: 1424598 - protein, 11 aa, Mycobacterium tuberculosis
AGCGRDPDSAI

SEQ ID NO: 1424599 - protein, 4 aa, Mycobacterium tuberculosis
AGEL

SEQ ID NO: 1424600 - protein, 10 aa, Mycobacterium tuberculosis
AGESAKVSEL

SEQ ID NO: 1424601 - protein, 19 aa, Mycobacterium tuberculosis
AGPLGSTSRAGHRSYGGVA

SEQ ID NO: 1424602 - protein, 13 aa, Mycobacterium tuberculosis
AGQAAAKGAAARL

SEQ ID NO: 1424603 - protein, 7 aa, Mycobacterium tuberculosis
AGQAGRE

SEQ ID NO: 1424604 - protein, 6 aa, Mycobacterium tuberculosis
AIADGK

SEQ ID NO: 1424605 - protein, 12 aa, Mycobacterium tuberculosis
AISTANGAAALP

SEQ ID NO: 1424606 - protein, 6 aa, Mycobacterium tuberculosis
AKASTL

SEQ ID NO: 1424607 - protein, 44 aa, Mycobacterium tuberculosis; identical to SEQ ID NO: 168796

SEQ ID NO: 1424608 - protein, 4 aa, Mycobacterium tuberculosis
AKGG

SEQ ID NO: 1424609 - protein, 14 aa, Mycobacterium tuberculosis
AKSDIGNNVDGAQR

SEQ ID NO: 1424610 - protein, 16 aa, Mycobacterium tuberculosis
AKSGTAHYAASGEQDA

SEQ ID NO: 1424611 - protein, 10 aa, Mycobacterium tuberculosis
AKTDQSLGTS

SEQ ID NO: 1424612 - protein, 6 aa, Mycobacterium tuberculosis
AKTGDY

SEQ ID NO: 1424613 - protein, 7 aa, Mycobacterium tuberculosis
AKTTTVA

SEQ ID NO: 1424614 - protein, 4 aa, Mycobacterium tuberculosis
AKTV

SEQ ID NO: 1424615 - protein, 8 aa, Mycobacterium tuberculosis
AKVEEERA

SEQ ID NO: 1424616 - protein, 7 aa, Mycobacterium tuberculosis
ALAAPSV

SEQ ID NO: 1424617 - protein, 10 aa, Mycobacterium tuberculosis
ALAGAGSGFA

SEQ ID NO: 1424618 - protein, 6 aa, Mycobacterium tuberculosis
ALRGGA

SEQ ID NO: 1424619 - protein, 7 aa, Mycobacterium tuberculosis
ALRGTAE

SEQ ID NO: 1424620 - protein, 8 aa, Mycobacterium tuberculosis
ALRGTAEN

SEQ ID NO: 1424621 - protein, 5 aa, Mycobacterium tuberculosis
ALTPP

SEQ ID NO: 1424622 - protein, 6 aa, Mycobacterium tuberculosis
ANHRQP

SEQ ID NO: 1424623 - protein, 20 aa, Mycobacterium tuberculosis
ANIGSTINAANAAAALPTTG

SEQ ID NO: 1424624 - protein, 11 aa, Mycobacterium tuberculosis
ANSAAAGSTTS

SEQ ID NO: 1424625 - protein, 6 aa, Mycobacterium tuberculosis
ANSEDL

SEQ ID NO: 1424626 - protein, 5 aa, Mycobacterium tuberculosis
ANVQD

SEQ ID NO: 1424627 - protein, 11 aa, Mycobacterium tuberculosis
APAETPAAQAS

SEQ ID NO: 1424628 - protein, 12 aa, Mycobacterium tuberculosis
APALPDDLATAA

SEQ ID NO: 1424629 - protein, 14 aa, Mycobacterium tuberculosis
APPKLGRAAVSRGR

SEQ ID NO: 1424630 - protein, 6 aa, Mycobacterium tuberculosis
APQMEP

SEQ ID NO: 1424631 - protein, 8 aa, Mycobacterium tuberculosis
APSPASSV

SEQ ID NO: 1424632 - protein, 4 aa, Mycobacterium tuberculosis
APVI

SEQ ID NO: 1424633 - protein, 116 aa, Mycobacterium tuberculosis
AQDRTGGTGTGQSRGAGGFGGVGQAGGKGWDGGPIGNGQVGEQHGAGQLGSTDGNPGVAGAAHGSGVSASHGSGATGAAGVADPGGSGAGVGSAAGNGTGAGSADAVGGAGTGRDI

SEQ ID NO: 1424634 - protein, 6 aa, Mycobacterium tuberculosis
AQGTVA

SEQ ID NO: 1424635 - protein, 6 aa, Mycobacterium tuberculosis
AQGYQT

SEQ ID NO: 1424636 - protein, 4 aa, Mycobacterium tuberculosis
AQPL

SEQ ID NO: 1424637 - protein, 4 aa, Mycobacterium tuberculosis
AQVA

SEQ ID NO: 1424638 - protein, 4 aa, Mycobacterium tuberculosis
ARAE

SEQ ID NO: 1424639 - protein, 5 aa, Mycobacterium tuberculosis
ARASG

SEQ ID NO: 1424640 - protein, 9 aa, Mycobacterium tuberculosis
ARATDGETV

SEQ ID NO: 1424641 - protein, 12 aa, Mycobacterium tuberculosis
ARGHRRDGSAGR

SEQ ID NO: 1424642 - protein, 6 aa, Mycobacterium tuberculosis
ARNRHT

SEQ ID NO: 1424643 - protein, 7 aa, Mycobacterium tuberculosis
ARPERIA

SEQ ID NO: 1424644 - protein, 11 aa, Mycobacterium tuberculosis
ARRQTTRSAAG

SEQ ID NO: 1424645 - protein, 5 aa, Mycobacterium tuberculosis
ARTAT

SEQ ID NO: 1424646 - protein, 7 aa, Mycobacterium tuberculosis
ARTGPTA

SEQ ID NO: 1424647 - protein, 5 aa, Mycobacterium tuberculosis
ARTSS

SEQ ID NO: 1424648 - protein, 6 aa, Mycobacterium tuberculosis
ARVSDQ

SEQ ID NO: 1424649 - protein, 19 aa, Mycobacterium tuberculosis
ASAGRARPARKIKPPADPD

SEQ ID NO: 1424650 - protein, 8 aa, Mycobacterium tuberculosis
ASASTQLG

SEQ ID NO: 1424651 - protein, 26 aa, Mycobacterium tuberculosis
ASATRSSAGFGAPRYGAKPIVVPKPA

SEQ ID NO: 1424652 - protein, 11 aa, Mycobacterium tuberculosis
ASGGGPGTGKC

SEQ ID NO: 1424653 - protein, 16 aa, Mycobacterium tuberculosis
ASGGTVINGQTSGIGN

SEQ ID NO: 1424654 - protein, 14 aa, Mycobacterium tuberculosis
ASGLTVKADPSMGI

SEQ ID NO: 1424655 - protein, 16 aa, Mycobacterium tuberculosis
ASGPVPPVDPQRLNAA

SEQ ID NO: 1424656 - protein, 19 aa, Mycobacterium tuberculosis
ASLRAARASSVLDGGPARL

SEQ ID NO: 1424657 - protein, 7 aa, Mycobacterium tuberculosis
ASPRELY

SEQ ID NO: 1424658 - protein, 10 aa, Mycobacterium tuberculosis
ASTRPTRPSV

SEQ ID NO: 1424659 - protein, 9 aa, Mycobacterium tuberculosis
ATADGTAIE

SEQ ID NO: 1424660 - protein, 11 aa, Mycobacterium tuberculosis
ATGNDADADRH

SEQ ID NO: 1424661 - protein, 20 aa, Mycobacterium tuberculosis
ATGRLTGADSGAGRLPEAEE

SEQ ID NO: 1424662 - protein, 6 aa, Mycobacterium tuberculosis
ATGTPL

SEQ ID NO: 1424663 - protein, 7 aa, Mycobacterium tuberculosis
ATSRRPD

SEQ ID NO: 1424664 - protein, 6 aa, Mycobacterium tuberculosis
ATTDFT

SEQ ID NO: 1424665 - protein, 22 aa, Mycobacterium tuberculosis
AVEAATAGKAVAAGRAVEAEMA

SEQ ID NO: 1424666 - protein, 13 aa, Mycobacterium tuberculosis
AVGNAGHSATGLT

SEQ ID NO: 1424667 - protein, 8 aa, Mycobacterium tuberculosis
AVNTRGGK

SEQ ID NO: 1424668 - protein, 28 aa, Mycobacterium tuberculosis
AVPSVPTAPVSGAPVAPSASSAPSAGGA

SEQ ID NO: 1424669 - protein, 10 aa, Mycobacterium tuberculosis
AWPGSSDRNF

SEQ ID NO: 1424670 - protein, 19 aa, Mycobacterium tuberculosis
AYHGGHGHSVSDAPGTAAK

SEQ ID NO: 1424671 - protein, 4 aa, Mycobacterium tuberculosis
CCDG

SEQ ID NO: 1424672 - protein, 9 aa, Mycobacterium tuberculosis
CPSKAGTDL

SEQ ID NO: 1424673 - protein, 10 aa, Mycobacterium tuberculosis
CRTEGRGESP

SEQ ID NO: 1424674 - protein, 12 aa, Mycobacterium tuberculosis
DAAAPAQTIDDN

SEQ ID NO: 1424675 - protein, 23 aa, Mycobacterium tuberculosis
DAAAQQALSPFEGPKDGSAPENP

SEQ ID NO: 1424676 - protein, 10 aa, Mycobacterium tuberculosis
DAATPSRAYA

SEQ ID NO: 1424677 - protein, 16 aa, Mycobacterium tuberculosis
DADATAAKAAAAGGQV

SEQ ID NO: 1424678 - protein, 4 aa, Mycobacterium tuberculosis
DADL

SEQ ID NO: 1424679 - protein, 9 aa, Mycobacterium tuberculosis
DAGKSAVTA

SEQ ID NO: 1424680 - protein, 19 aa, Mycobacterium tuberculosis
DAKEGPRAFAEKRAPNFQN

SEQ ID NO: 1424681 - protein, 10 aa, Mycobacterium tuberculosis
DARGLDASGL

SEQ ID NO: 1424682 - protein, 8 aa, Mycobacterium tuberculosis
DATTLDGL

SEQ ID NO: 1424683 - protein, 11 aa, Mycobacterium tuberculosis
DCGPAGTPLPA

SEQ ID NO: 1424684 - protein, 7 aa, Mycobacterium tuberculosis
DDAADLS

SEQ ID NO: 1424685 - protein, 9 aa, Mycobacterium tuberculosis
DDALKRKAS

SEQ ID NO: 1424686 - protein, 11 aa, Mycobacterium tuberculosis
DDATSGNGDYR

SEQ ID NO: 1424687 - protein, 4 aa, Mycobacterium tuberculosis
DDDP

SEQ ID NO: 1424688 - protein, 9 aa, Mycobacterium tuberculosis
DDDTDAETI

SEQ ID NO: 1424689 - protein, 8 aa, Mycobacterium tuberculosis
DDFNPDRY

SEQ ID NO: 1424690 - protein, 8 aa, Mycobacterium tuberculosis
DDGTEIRV

SEQ ID NO: 1424691 - protein, 27 aa, Mycobacterium tuberculosis
DDIDEELNEDLDKDVDDVAGERRVTND

SEQ ID NO: 1424692 - protein, 6 aa, Mycobacterium tuberculosis
DDLPTY

SEQ ID NO: 1424693 - protein, 6 aa, Mycobacterium tuberculosis
DDSNRV

SEQ ID NO: 1424694 - protein, 5 aa, Mycobacterium tuberculosis
DDYDD

SEQ ID NO: 1424695 - protein, 15 aa, Mycobacterium tuberculosis
DEEERRQRPAPATMQ

SEQ ID NO: 1424696 - protein, 8 aa, Mycobacterium tuberculosis
DGAGARIQ

SEQ ID NO: 1424697 - protein, 10 aa, Mycobacterium tuberculosis
DGAGERARTA

SEQ ID NO: 1424698 - protein, 16 aa, Mycobacterium tuberculosis
DGANGIDGTGQAGGNG

SEQ ID NO: 1424699 - protein, 8 aa, Mycobacterium tuberculosis
DGAPGPDM

SEQ ID NO: 1424700 - protein, 37 aa, Mycobacterium tuberculosis; identical to SEQ ID NO: 171414

SEQ ID NO: 1424701 - protein, 5 aa, Mycobacterium tuberculosis
DGPMR

SEQ ID NO: 1424702 - protein, 5 aa, Mycobacterium tuberculosis
DHGTE

SEQ ID NO: 1424703 - protein, 6 aa, Mycobacterium tuberculosis
DHRRRT

SEQ ID NO: 1424704 - protein, 6 aa, Mycobacterium tuberculosis
DIDPAA

SEQ ID NO: 1424705 - protein, 5 aa, Mycobacterium tuberculosis
DIPEG

SEQ ID NO: 1424706 - protein, 5 aa, Mycobacterium tuberculosis
DKGVR

SEQ ID NO: 1424707 - protein, 11 aa, Mycobacterium tuberculosis
DLAGPLSGAGP

SEQ ID NO: 1424708 - protein, 4 aa, Mycobacterium tuberculosis
DLED

SEQ ID NO: 1424709 - protein, 11 aa, Mycobacterium tuberculosis
DLPTEPHPSRE

SEQ ID NO: 1424710 - protein, 8 aa, Mycobacterium tuberculosis
DNGDPANR

SEQ ID NO: 1424711 - protein, 12 aa, Mycobacterium tuberculosis
DNLAGSPEIVPN

SEQ ID NO: 1424712 - protein, 21 aa, Mycobacterium tuberculosis
DNNIPNSKEASMSKAKAGRMA

SEQ ID NO: 1424713 - protein, 9 aa, Mycobacterium tuberculosis
DNPLRGAPH

SEQ ID NO: 1424714 - protein, 6 aa, Mycobacterium tuberculosis
DNVAGK

SEQ ID NO: 1424715 - protein, 10 aa, Mycobacterium tuberculosis
DPAADTGKTT

SEQ ID NO: 1424716 - protein, 10 aa, Mycobacterium tuberculosis
DPAKKAFGAR

SEQ ID NO: 1424717 - protein, 9 aa, Mycobacterium tuberculosis
DPALREHPN

SEQ ID NO: 1424718 - protein, 5 aa, Mycobacterium tuberculosis
DPEGE

SEQ ID NO: 1424719 - protein, 8 aa, Mycobacterium tuberculosis
DPELSQPW

SEQ ID NO: 1424720 - protein, 17 aa, Mycobacterium tuberculosis
DPETGHDPTGSPQGAGT

SEQ ID NO: 1424721 - protein, 7 aa, Mycobacterium tuberculosis
DPTLRDE

SEQ ID NO: 1424722 - protein, 5 aa, Mycobacterium tuberculosis
DPTRF

SEQ ID NO: 1424723 - protein, 7 aa, Mycobacterium tuberculosis
DPVGTGS

SEQ ID NO: 1424724 - protein, 9 aa, Mycobacterium tuberculosis
DQIPVPPGW

SEQ ID NO: 1424725 - protein, 5 aa, Mycobacterium tuberculosis
DQPGV

SEQ ID NO: 1424726 - protein, 10 aa, Mycobacterium tuberculosis
DQTDVPESGD

SEQ ID NO: 1424727 - protein, 9 aa, Mycobacterium tuberculosis
DRGSPPEFA

SEQ ID NO: 1424728 - protein, 6 aa, Mycobacterium tuberculosis
DRRRGE

SEQ ID NO: 1424729 - protein, 6 aa, Mycobacterium tuberculosis
DSGFVS

SEQ ID NO: 1424730 - protein, 4 aa, Mycobacterium tuberculosis
DSLP

SEQ ID NO: 1424731 - protein, 18 aa, Mycobacterium tuberculosis
DSNDTSVAGGAAGADSRV

SEQ ID NO: 1424732 - protein, 21 aa, Mycobacterium tuberculosis
DSNSWVPNKPDAATPVIPGPV

SEQ ID NO: 1424733 - protein, 14 aa, Mycobacterium tuberculosis
DSNVQSDPPTDGVH

SEQ ID NO: 1424734 - protein, 11 aa, Mycobacterium tuberculosis
DSPGGSVTASE

SEQ ID NO: 1424735 - protein, 14 aa, Mycobacterium tuberculosis
DSPYQRPKNPDLRL

SEQ ID NO: 1424736 - protein, 5 aa, Mycobacterium tuberculosis
DSRSV

SEQ ID NO: 1424737 - protein, 7 aa, Mycobacterium tuberculosis
DTGSGSI

SEQ ID NO: 1424738 - protein, 7 aa, Mycobacterium tuberculosis
DTPGFTA

SEQ ID NO: 1424739 - protein, 6 aa, Mycobacterium tuberculosis
DTPRAL

SEQ ID NO: 1424740 - protein, 15 aa, Mycobacterium tuberculosis
DTTLDASPGTTWRLR

SEQ ID NO: 1424741 - protein, 8 aa, Mycobacterium tuberculosis
EAAQQTFE

SEQ ID NO: 1424742 - protein, 11 aa, Mycobacterium tuberculosis
EAARRQLEETH

SEQ ID NO: 1424743 - protein, 8 aa, Mycobacterium tuberculosis
EAGDGQEA

SEQ ID NO: 1424744 - protein, 4 aa, Mycobacterium tuberculosis
EAGE

SEQ ID NO: 1424745 - protein, 11 aa, Mycobacterium tuberculosis
EAQRQRPLRTA

SEQ ID NO: 1424746 - protein, 6 aa, Mycobacterium tuberculosis
EATHRR

SEQ ID NO: 1424747 - protein, 8 aa, Mycobacterium tuberculosis
EDLTERQS

SEQ ID NO: 1424748 - protein, 10 aa, Mycobacterium tuberculosis
EDPSPGVDGQ

SEQ ID NO: 1424749 - protein, 5 aa, Mycobacterium tuberculosis
EDPVP

SEQ ID NO: 1424750 - protein, 6 aa, Mycobacterium tuberculosis
EEAQNA

SEQ ID NO: 1424751 - protein, 12 aa, Mycobacterium tuberculosis
EEQNAADERAQH

SEQ ID NO: 1424752 - protein, 7 aa, Mycobacterium tuberculosis
EESGGQA

SEQ ID NO: 1424753 - protein, 5 aa, Mycobacterium tuberculosis
EFPAK

SEQ ID NO: 1424754 - protein, 7 aa, Mycobacterium tuberculosis
EGAMTPG

SEQ ID NO: 1424755 - protein, 6 aa, Mycobacterium tuberculosis
EGDDVH

SEQ ID NO: 1424756 - protein, 10 aa, Mycobacterium tuberculosis
EGSHDRVSTT

SEQ ID NO: 1424757 - protein, 6 aa, Mycobacterium tuberculosis
EHGYPT

SEQ ID NO: 1424758 - protein, 6 aa, Mycobacterium tuberculosis
EKSPSF

SEQ ID NO: 1424759 - protein, 14 aa, Mycobacterium tuberculosis
ELAERDRPPSAKGR

SEQ ID NO: 1424760 - protein, 6 aa, Mycobacterium tuberculosis
ELEKTK

SEQ ID NO: 1424761 - protein, 4 aa, Mycobacterium tuberculosis
ELGI

SEQ ID NO: 1424762 - protein, 7 aa, Mycobacterium tuberculosis
ELRSKPG

SEQ ID NO: 1424763 - protein, 4 aa, Mycobacterium tuberculosis
EPDE

SEQ ID NO: 1424764 - protein, 11 aa, Mycobacterium tuberculosis
EPITSSTLTEE

SEQ ID NO: 1424765 - protein, 6 aa, Mycobacterium tuberculosis
EPLPPV

SEQ ID NO: 1424766 - protein, 10 aa, Mycobacterium tuberculosis
EPLPRAHGGP

SEQ ID NO: 1424767 - protein, 4 aa, Mycobacterium tuberculosis
EPRF

SEQ ID NO: 1424768 - protein, 9 aa, Mycobacterium tuberculosis
EPSQHEELP

SEQ ID NO: 1424769 - protein, 9 aa, Mycobacterium tuberculosis
EPTDPAGPV

SEQ ID NO: 1424770 - protein, 6 aa, Mycobacterium tuberculosis
EPVAPS

SEQ ID NO: 1424771 - protein, 5 aa, Mycobacterium tuberculosis
EPVSE

SEQ ID NO: 1424772 - protein, 10 aa, Mycobacterium tuberculosis
EQASSSTQPL

SEQ ID NO: 1424773 - protein, 5 aa, Mycobacterium tuberculosis
EQTLS

SEQ ID NO: 1424774 - protein, 45 aa, Mycobacterium tuberculosis
ERAASKAVAGQAGASSSTMAGASALSATAGATAGAVSARAAEQQR

SEQ ID NO: 1424775 - protein, 10 aa, Mycobacterium tuberculosis
ERNRRQRKSC

SEQ ID NO: 1424776 - protein, 5 aa, Mycobacterium tuberculosis
ERQAR

SEQ ID NO: 1424777 - protein, 29 aa, Mycobacterium tuberculosis
ERSAELAAATTDRLRRQKQANRVRDDVPS

SEQ ID NO: 1424778 - protein, 5 aa, Mycobacterium tuberculosis
ERSIG

SEQ ID NO: 1424779 - protein, 12 aa, Mycobacterium tuberculosis
ERSPQAAAAHDR

SEQ ID NO: 1424780 - protein, 6 aa, Mycobacterium tuberculosis
ESDQRE

SEQ ID NO: 1424781 - protein, 9 aa, Mycobacterium tuberculosis
ESGAPGRGN

SEQ ID NO: 1424782 - protein, 20 aa, Mycobacterium tuberculosis
ESKVAAARSPIKADLTGGLA

SEQ ID NO: 1424783 - protein, 11 aa, Mycobacterium tuberculosis
ETKRRTAEQLG

SEQ ID NO: 1424784 - protein, 15 aa, Mycobacterium tuberculosis
ETPRSGPADAAETRY

SEQ ID NO: 1424785 - protein, 17 aa, Mycobacterium tuberculosis
ETTRSSTGTGLQGVTSG

SEQ ID NO: 1424786 - protein, 23 aa, Mycobacterium tuberculosis
EVAGGGVREAKVPAAARNDADSK

SEQ ID NO: 1424787 - protein, 16 aa, Mycobacterium tuberculosis
EVPRSSSSVIPHSPAA

SEQ ID NO: 1424788 - protein, 12 aa, Mycobacterium tuberculosis
EYDRRGWGSGGA

SEQ ID NO: 1424789 - protein, 10 aa, Mycobacterium tuberculosis
FAESSEKHPD

SEQ ID NO: 1424790 - protein, 9 aa, Mycobacterium tuberculosis
FEGSRDDRP

SEQ ID NO: 1424791 - protein, 31 aa, Mycobacterium tuberculosis; identical to SEQ ID NO: 174359

SEQ ID NO: 1424792 - protein, 19 aa, Mycobacterium tuberculosis
FGLGGDRKRGGAGCGGSAR

SEQ ID NO: 1424793 - protein, 6 aa, Mycobacterium tuberculosis
FGNSGL

SEQ ID NO: 1424794 - protein, 16 aa, Mycobacterium tuberculosis
FPEKKLAEPPPGSGLK

SEQ ID NO: 1424795 - protein, 5 aa, Mycobacterium tuberculosis
FPGDD

SEQ ID NO: 1424796 - protein, 31 aa, Mycobacterium tuberculosis
FSTGIANTGDYNTGSFNAGDTNTGGFNPGGI

SEQ ID NO: 1424797 - protein, 8 aa, Mycobacterium tuberculosis
GADGEATV

SEQ ID NO: 1424798 - protein, 4 aa, Mycobacterium tuberculosis
GAEA

SEQ ID NO: 1424799 - protein, 14 aa, Mycobacterium tuberculosis
GAGGDGLRQRTRAD

SEQ ID NO: 1424800 - protein, 6 aa, Mycobacterium tuberculosis
GAIGPT

SEQ ID NO: 1424801 - protein, 10 aa, Mycobacterium tuberculosis
GALEGKNTEL

SEQ ID NO: 1424802 - protein, 11 aa, Mycobacterium tuberculosis
GALNGARGNSG

SEQ ID NO: 1424803 - protein, 6 aa, Mycobacterium tuberculosis
GALPGD

SEQ ID NO: 1424804 - protein, 12 aa, Mycobacterium tuberculosis
GAQRAHDVASKT

SEQ ID NO: 1424805 - protein, 4 aa, Mycobacterium tuberculosis
GDDY

SEQ ID NO: 1424806 - protein, 4 aa, Mycobacterium tuberculosis
GDEG

SEQ ID NO: 1424807 - protein, 17 aa, Mycobacterium tuberculosis
GDGADGTAPGQNGGAGG

SEQ ID NO: 1424808 - protein, 7 aa, Mycobacterium tuberculosis
GDGARAS

SEQ ID NO: 1424809 - protein, 24 aa, Mycobacterium tuberculosis
GDGGAGGTSNNNGGDGGAGGTAGG

SEQ ID NO: 1424810 - protein, 7 aa, Mycobacterium tuberculosis
GDLAGTE

SEQ ID NO: 1424811 - protein, 7 aa, Mycobacterium tuberculosis
GDLANAR

SEQ ID NO: 1424812 - protein, 6 aa, Mycobacterium tuberculosis
GDLDKP

SEQ ID NO: 1424813 - protein, 15 aa, Mycobacterium tuberculosis
GDLEDAAKSLPGKNG

SEQ ID NO: 1424814 - protein, 10 aa, Mycobacterium tuberculosis
GDLGSAAASF

SEQ ID NO: 1424815 - protein, 7 aa, Mycobacterium tuberculosis
GDPAPRV

SEQ ID NO: 1424816 - protein, 8 aa, Mycobacterium tuberculosis
GDPQRPGR

SEQ ID NO: 1424817 - protein, 4 aa, Mycobacterium tuberculosis
GDPS

SEQ ID NO: 1424818 - protein, 19 aa, Mycobacterium tuberculosis
GDTASAAQLSDNPNEAREA

SEQ ID NO: 1424819 - protein, 5 aa, Mycobacterium tuberculosis
GEAIQ

SEQ ID NO: 1424820 - protein, 6 aa, Mycobacterium tuberculosis
GEEGSG

SEQ ID NO: 1424821 - protein, 7 aa, Mycobacterium tuberculosis
GEHPDWD

SEQ ID NO: 1424822 - protein, 16 aa, Mycobacterium tuberculosis
GENGAIDPRQRRCRAK

SEQ ID NO: 1424823 - protein, 6 aa, Mycobacterium tuberculosis
GEPATL

SEQ ID NO: 1424824 - protein, 5 aa, Mycobacterium tuberculosis
GEQLR

SEQ ID NO: 1424825 - protein, 10 aa, Mycobacterium tuberculosis
GESGSGKSTT

SEQ ID NO: 1424826 - protein, 20 aa, Mycobacterium tuberculosis
GFGNNGDNNLGLGNNGNNNI

SEQ ID NO: 1424827 - protein, 6 aa, Mycobacterium tuberculosis
GFTDQQ

SEQ ID NO: 1424828 - protein, 22 aa, Mycobacterium tuberculosis
GGAAPVTRAGDDAEQSDGEERR

SEQ ID NO: 1424829 - protein, 24 aa, Mycobacterium tuberculosis
GGAGGAGGAAPTGNGGAGGNGGDA

SEQ ID NO: 1424830 - protein, 18 aa, Mycobacterium tuberculosis
GGAGGLGAAGAAGAAGVN

SEQ ID NO: 1424831 - protein, 32 aa, Mycobacterium tuberculosis; identical to SEQ ID NO: 175526

SEQ ID NO: 1424832 - protein, 10 aa, Mycobacterium tuberculosis
GGASAGGGLA

SEQ ID NO: 1424833 - protein, 28 aa, Mycobacterium tuberculosis
GGDGGNGGAGTAIGSNAGDGGAGGDSSA

SEQ ID NO: 1424834 - protein, 9 aa, Mycobacterium tuberculosis
GGGYPAARA

SEQ ID NO: 1424835 - protein, 5 aa, Mycobacterium tuberculosis
GGLGD

SEQ ID NO: 1424836 - protein, 5 aa, Mycobacterium tuberculosis
GGQPM

SEQ ID NO: 1424837 - protein, 7 aa, Mycobacterium tuberculosis
GGSSEYA

SEQ ID NO: 1424838 - protein, 4 aa, Mycobacterium tuberculosis
GGTT

SEQ ID NO: 1424839 - protein, 16 aa, Mycobacterium tuberculosis
GHGSSAAAAANPAERI

SEQ ID NO: 1424840 - protein, 4 aa, Mycobacterium tuberculosis
GHSE

SEQ ID NO: 1424841 - protein, 12 aa, Mycobacterium tuberculosis
GIDPTGLRGSAT

SEQ ID NO: 1424842 - protein, 12 aa, Mycobacterium tuberculosis
GIEPGGEPLSAE

SEQ ID NO: 1424843 - protein, 10 aa, Mycobacterium tuberculosis
GIGNAGANNF

SEQ ID NO: 1424844 - protein, 4 aa, Mycobacterium tuberculosis
GIQN

SEQ ID NO: 1424845 - protein, 8 aa, Mycobacterium tuberculosis
GIQTAKPS

SEQ ID NO: 1424846 - protein, 14 aa, Mycobacterium tuberculosis
GITDNDPATATNRR

SEQ ID NO: 1424847 - protein, 4 aa, Mycobacterium tuberculosis
GITE

SEQ ID NO: 1424848 - protein, 6 aa, Mycobacterium tuberculosis
GKLETI

SEQ ID NO: 1424849 - protein, 15 aa, Mycobacterium tuberculosis
GLGDQTDIGPMRRRD

SEQ ID NO: 1424850 - protein, 5 aa, Mycobacterium tuberculosis
GLGNG

SEQ ID NO: 1424851 - protein, 7 aa, Mycobacterium tuberculosis
GLPPGTY

SEQ ID NO: 1424852 - protein, 4 aa, Mycobacterium tuberculosis
GLRA

SEQ ID NO: 1424853 - protein, 4 aa, Mycobacterium tuberculosis
GLRR

SEQ ID NO: 1424854 - protein, 5 aa, Mycobacterium tuberculosis
GLTDA

SEQ ID NO: 1424855 - protein, 14 aa, Mycobacterium tuberculosis
GNDALDSLAQPYVI

SEQ ID NO: 1424856 - protein, 23 aa, Mycobacterium tuberculosis
GNGGHGGAGGTGVPNGSGGAGGL

SEQ ID NO: 1424857 - protein, 47 aa, Mycobacterium tuberculosis
GNGGNGGSSSTPGQPGGRGGAAGLIGNGGAGGAGGPGANGGAGGNGG

SEQ ID NO: 1424858 - protein, 4 aa, Mycobacterium tuberculosis
GNLP

SEQ ID NO: 1424859 - protein, 5 aa, Mycobacterium tuberculosis
GPAAE

SEQ ID NO: 1424860 - protein, 5 aa, Mycobacterium tuberculosis
GPAGQ

SEQ ID NO: 1424861 - protein, 5 aa, Mycobacterium tuberculosis
GPDRD

SEQ ID NO: 1424862 - protein, 7 aa, Mycobacterium tuberculosis
GPKTTKR

SEQ ID NO: 1424863 - protein, 11 aa, Mycobacterium tuberculosis
GPPGTGKTSVA

SEQ ID NO: 1424864 - protein, 8 aa, Mycobacterium tuberculosis
GQDLGDPE

SEQ ID NO: 1424865 - protein, 7 aa, Mycobacterium tuberculosis
GQDPELT

SEQ ID NO: 1424866 - protein, 5 aa, Mycobacterium tuberculosis
GQDYQ

SEQ ID NO: 1424867 - protein, 4 aa, Mycobacterium tuberculosis
GQNR

SEQ ID NO: 1424868 - protein, 17 aa, Mycobacterium tuberculosis
GQPIDGRGDVDSDTRRA

SEQ ID NO: 1424869 - protein, 25 aa, Mycobacterium tuberculosis
GRPLSSDPVSRPVTSYTASPPDNTI

SEQ ID NO: 1424870 - protein, 5 aa, Mycobacterium tuberculosis
GRPPL

SEQ ID NO: 1424871 - protein, 5 aa, Mycobacterium tuberculosis
GRSNG

SEQ ID NO: 1424872 - protein, 9 aa, Mycobacterium tuberculosis
GRSNRLGTP

SEQ ID NO: 1424873 - protein, 5 aa, Mycobacterium tuberculosis
GRSTL

SEQ ID NO: 1424874 - protein, 6 aa, Mycobacterium tuberculosis
GRTPPF

SEQ ID NO: 1424875 - protein, 7 aa, Mycobacterium tuberculosis
GRTSDTT

SEQ ID NO: 1424876 - protein, 8 aa, Mycobacterium tuberculosis
GRTSRSEL

SEQ ID NO: 1424877 - protein, 11 aa, Mycobacterium tuberculosis
GSAGARDERGW

SEQ ID NO: 1424878 - protein, 6 aa, Mycobacterium tuberculosis
GSCGRA

SEQ ID NO: 1424879 - protein, 10 aa, Mycobacterium tuberculosis
GSDEGGHDTV

SEQ ID NO: 1424880 - protein, 4 aa, Mycobacterium tuberculosis
GSEL

SEQ ID NO: 1424881 - protein, 8 aa, Mycobacterium tuberculosis
GSGTPIPS

SEQ ID NO: 1424882 - protein, 11 aa, Mycobacterium tuberculosis
GSIPTTTSGKI

SEQ ID NO: 1424883 - protein, 9 aa, Mycobacterium tuberculosis
GSSGAYEEA

SEQ ID NO: 1424884 - protein, 4 aa, Mycobacterium tuberculosis
GSSI

SEQ ID NO: 1424885 - protein, 18 aa, Mycobacterium tuberculosis
GSSIGAANAAAAGSTTSV

SEQ ID NO: 1424886 - protein, 4 aa, Mycobacterium tuberculosis
GSYS

SEQ ID NO: 1424887 - protein, 9 aa, Mycobacterium tuberculosis
GTARREAVA

SEQ ID NO: 1424888 - protein, 6 aa, Mycobacterium tuberculosis
GTATEI

SEQ ID NO: 1424889 - protein, 9 aa, Mycobacterium tuberculosis
GTDPASGKP

SEQ ID NO: 1424890 - protein, 11 aa, Mycobacterium tuberculosis
GTGASQASERA

SEQ ID NO: 1424891 - protein, 4 aa, Mycobacterium tuberculosis
GTGS

SEQ ID NO: 1424892 - protein, 15 aa, Mycobacterium tuberculosis
GTPGFGNSTTTPSSG

SEQ ID NO: 1424893 - protein, 10 aa, Mycobacterium tuberculosis
GTPPGRGGSA

SEQ ID NO: 1424894 - protein, 4 aa, Mycobacterium tuberculosis
GTRF

SEQ ID NO: 1424895 - protein, 12 aa, Mycobacterium tuberculosis
GTSGHRGSALTG

SEQ ID NO: 1424896 - protein, 4 aa, Mycobacterium tuberculosis
GVAK

SEQ ID NO: 1424897 - protein, 11 aa, Mycobacterium tuberculosis
GVGGAGGSGGT

SEQ ID NO: 1424898 - protein, 8 aa, Mycobacterium tuberculosis
GVNPTNDG

SEQ ID NO: 1424899 - protein, 11 aa, Mycobacterium tuberculosis
GVPDYVPPDSA

SEQ ID NO: 1424900 - protein, 7 aa, Mycobacterium tuberculosis
GVSKSEV

SEQ ID NO: 1424901 - protein, 18 aa, Mycobacterium tuberculosis
GVTNPGYRPGDTATALPA

SEQ ID NO: 1424902 - protein, 7 aa, Mycobacterium tuberculosis
GWQPEGV

SEQ ID NO: 1424903 - protein, 6 aa, Mycobacterium tuberculosis
HATAPF

SEQ ID NO: 1424904 - protein, 9 aa, Mycobacterium tuberculosis
HATGTQVGD

SEQ ID NO: 1424905 - protein, 8 aa, Mycobacterium tuberculosis
HDERTRAK

SEQ ID NO: 1424906 - protein, 8 aa, Mycobacterium tuberculosis
HERAGSGA

SEQ ID NO: 1424907 - protein, 19 aa, Mycobacterium tuberculosis
HEVSRADTVSVPRAPTQAE

SEQ ID NO: 1424908 - protein, 12 aa, Mycobacterium tuberculosis
HFSDRSALPTYN

SEQ ID NO: 1424909 - protein, 14 aa, Mycobacterium tuberculosis
HGDAENLLSSGADA

SEQ ID NO: 1424910 - protein, 7 aa, Mycobacterium tuberculosis
HISDSRS

SEQ ID NO: 1424911 - protein, 10 aa, Mycobacterium tuberculosis
HPLGTGGGIA

SEQ ID NO: 1424912 - protein, 4 aa, Mycobacterium tuberculosis
HPTP

SEQ ID NO: 1424913 - protein, 10 aa, Mycobacterium tuberculosis
HQGESAAAFQ

SEQ ID NO: 1424914 - protein, 4 aa, Mycobacterium tuberculosis
HQTY

SEQ ID NO: 1424915 - protein, 13 aa, Mycobacterium tuberculosis
HRPGDMSGGQQQR

SEQ ID NO: 1424916 - protein, 4 aa, Mycobacterium tuberculosis
HRPS

SEQ ID NO: 1424917 - protein, 4 aa, Mycobacterium tuberculosis
HSEL

SEQ ID NO: 1424918 - protein, 8 aa, Mycobacterium tuberculosis
HSRSSERF

SEQ ID NO: 1424919 - protein, 11 aa, Mycobacterium tuberculosis
HTKASQAPISD

SEQ ID NO: 1424920 - protein, 12 aa, Mycobacterium tuberculosis
IARGSADGRVRN

SEQ ID NO: 1424921 - protein, 15 aa, Mycobacterium tuberculosis
IASERTAPSRACQGD

SEQ ID NO: 1424922 - protein, 12 aa, Mycobacterium tuberculosis
IDDDESAAATIE

SEQ ID NO: 1424923 - protein, 14 aa, Mycobacterium tuberculosis
IDDGDTGYPYGTEY

SEQ ID NO: 1424924 - protein, 6 aa, Mycobacterium tuberculosis
IDQPGV

SEQ ID NO: 1424925 - protein, 29 aa, Mycobacterium tuberculosis
IDSGRRGIAHPPRGGLGHRSKHRGPRHLT

SEQ ID NO: 1424926 - protein, 7 aa, Mycobacterium tuberculosis
IEDNREE

SEQ ID NO: 1424927 - protein, 7 aa, Mycobacterium tuberculosis
IEGQKTA

SEQ ID NO: 1424928 - protein, 11 aa, Mycobacterium tuberculosis
IGDNTRPDAIR

SEQ ID NO: 1424929 - protein, 9 aa, Mycobacterium tuberculosis
IGDPAANAA

SEQ ID NO: 1424930 - protein, 54 aa, Mycobacterium tuberculosis
IGEPPPAPSRPSASPAEPPTRPAPQHSRRARRGHRYRTDTERNVGKVATGPSIQ

SEQ ID NO: 1424931 - protein, 7 aa, Mycobacterium tuberculosis
IGSDPQK

SEQ ID NO: 1424932 - protein, 11 aa, Mycobacterium tuberculosis
IGSETGRIHGA

SEQ ID NO: 1424933 - protein, 16 aa, Mycobacterium tuberculosis
IGTNARDTIGAELGGQ

SEQ ID NO: 1424934 - protein, 4 aa, Mycobacterium tuberculosis
IKKR

SEQ ID NO: 1424935 - protein, 6 aa, Mycobacterium tuberculosis
IKTSKQ

SEQ ID NO: 1424936 - protein, 10 aa, Mycobacterium tuberculosis
INDPTSSAQI

SEQ ID NO: 1424937 - protein, 7 aa, Mycobacterium tuberculosis
INGSDMA

SEQ ID NO: 1424938 - protein, 4 aa, Mycobacterium tuberculosis
IPKG

SEQ ID NO: 1424939 - protein, 15 aa, Mycobacterium tuberculosis
IPRAMSDSRTRYSPE

SEQ ID NO: 1424940 - protein, 6 aa, Mycobacterium tuberculosis
IQPVSG

SEQ ID NO: 1424941 - protein, 9 aa, Mycobacterium tuberculosis
IQRGEDRQR

SEQ ID NO: 1424942 - protein, 9 aa, Mycobacterium tuberculosis
ISTSSNTEH

SEQ ID NO: 1424943 - protein, 9 aa, Mycobacterium tuberculosis
ISTTKPSPL

SEQ ID NO: 1424944 - protein, 5 aa, Mycobacterium tuberculosis
ITGYG

SEQ ID NO: 1424945 - protein, 17 aa, Mycobacterium tuberculosis
ITSSDTKDPNREHDTSD

SEQ ID NO: 1424946 - protein, 11 aa, Mycobacterium tuberculosis
KADGQPFSDDD

SEQ ID NO: 1424947 - protein, 5 aa, Mycobacterium tuberculosis
KAGGF

SEQ ID NO: 1424948 - protein, 4 aa, Mycobacterium tuberculosis
KAGQ

SEQ ID NO: 1424949 - protein, 8 aa, Mycobacterium tuberculosis
KAKEVPAA

SEQ ID NO: 1424950 - protein, 5 aa, Mycobacterium tuberculosis
KAPGS

SEQ ID NO: 1424951 - protein, 6 aa, Mycobacterium tuberculosis
KATRDE

SEQ ID NO: 1424952 - protein, 16 aa, Mycobacterium tuberculosis
KDGDQDSGAGRRGAQR

SEQ ID NO: 1424953 - protein, 11 aa, Mycobacterium tuberculosis
KDKGTGKENTI

SEQ ID NO: 1424954 - protein, 12 aa, Mycobacterium tuberculosis
KGRYPDRKTARR

SEQ ID NO: 1424955 - protein, 4 aa, Mycobacterium tuberculosis
KHTY

SEQ ID NO: 1424956 - protein, 11 aa, Mycobacterium tuberculosis
KSLKNSVSPDE

SEQ ID NO: 1424957 - protein, 7 aa, Mycobacterium tuberculosis
KSPAGAW

SEQ ID NO: 1424958 - protein, 6 aa, Mycobacterium tuberculosis
KSVYQA

SEQ ID NO: 1424959 - protein, 8 aa, Mycobacterium tuberculosis
KTHDVNST

SEQ ID NO: 1424960 - protein, 4 aa, Mycobacterium tuberculosis
KTID

SEQ ID NO: 1424961 - protein, 6 aa, Mycobacterium tuberculosis
KTRRGL

SEQ ID NO: 1424962 - protein, 7 aa, Mycobacterium tuberculosis
KYGTTAE

SEQ ID NO: 1424963 - protein, 9 aa, Mycobacterium tuberculosis
LAAAADGAA

SEQ ID NO: 1424964 - protein, 5 aa, Mycobacterium tuberculosis
LADDY

SEQ ID NO: 1424965 - protein, 10 aa, Mycobacterium tuberculosis
LAGYGAGDTD

SEQ ID NO: 1424966 - protein, 4 aa, Mycobacterium tuberculosis
LAPS

SEQ ID NO: 1424967 - protein, 9 aa, Mycobacterium tuberculosis
LASSQRRSL

SEQ ID NO: 1424968 - protein, 10 aa, Mycobacterium tuberculosis
LDSSTADFNG

SEQ ID NO: 1424969 - protein, 10 aa, Mycobacterium tuberculosis
LEPATAPAAA

SEQ ID NO: 1424970 - protein, 12 aa, Mycobacterium tuberculosis
LIPDADKRWDAR

SEQ ID NO: 1424971 - protein, 37 aa, Mycobacterium tuberculosis
LKDPSYRLKTTTAEQIASRADPWDPGSVVTDNSGRER

SEQ ID NO: 1424972 - protein, 7 aa, Mycobacterium tuberculosis
LKESHPH

SEQ ID NO: 1424973 - protein, 16 aa, Mycobacterium tuberculosis
LNAGERLSATKAGSAM

SEQ ID NO: 1424974 - protein, 4 aa, Mycobacterium tuberculosis
LPAK

SEQ ID NO: 1424975 - protein, 6 aa, Mycobacterium tuberculosis
LPPPAD

SEQ ID NO: 1424976 - protein, 20 aa, Mycobacterium tuberculosis
LPSRYGQAVAESDVQPLGRP

SEQ ID NO: 1424977 - protein, 4 aa, Mycobacterium tuberculosis
LPTP

SEQ ID NO: 1424978 - protein, 6 aa, Mycobacterium tuberculosis
LRGDGR

SEQ ID NO: 1424979 - protein, 7 aa, Mycobacterium tuberculosis
LRQNPAP

SEQ ID NO: 1424980 - protein, 7 aa, Mycobacterium tuberculosis
LSDPAAE

SEQ ID NO: 1424981 - protein, 7 aa, Mycobacterium tuberculosis
LSDPRNL

SEQ ID NO: 1424982 - protein, 9 aa, Mycobacterium tuberculosis
LSDRARNGR

SEQ ID NO: 1424983 - protein, 12 aa, Mycobacterium tuberculosis
LSGDRPNLEQGG

SEQ ID NO: 1424984 - protein, 8 aa, Mycobacterium tuberculosis
LSGKGPVS

SEQ ID NO: 1424985 - protein, 7 aa, Mycobacterium tuberculosis
LSGRPDT

SEQ ID NO: 1424986 - protein, 6 aa, Mycobacterium tuberculosis
LSPGQV

SEQ ID NO: 1424987 - protein, 10 aa, Mycobacterium tuberculosis
LTAGAGGLGN

SEQ ID NO: 1424988 - protein, 7 aa, Mycobacterium tuberculosis
LTDEQKR

SEQ ID NO: 1424989 - protein, 17 aa, Mycobacterium tuberculosis
LTGANAAGATDAGATDA

SEQ ID NO: 1424990 - protein, 5 aa, Mycobacterium tuberculosis
LTPDR

SEQ ID NO: 1424991 - protein, 8 aa, Mycobacterium tuberculosis
MGDAGLTG

SEQ ID NO: 1424992 - protein, 11 aa, Mycobacterium tuberculosis
MGGDGGDGGEA

SEQ ID NO: 1424993 - protein, 4 aa, Mycobacterium tuberculosis
MITG

SEQ ID NO: 1424994 - protein, 5 aa, Mycobacterium tuberculosis
MSAEL

SEQ ID NO: 1424995 - protein, 8 aa, Mycobacterium tuberculosis
NAEPPPAV

SEQ ID NO: 1424996 - protein, 6 aa, Mycobacterium tuberculosis
NAEPRF

SEQ ID NO: 1424997 - protein, 25 aa, Mycobacterium tuberculosis
NAHGQKIQAAGSNMAQTDSAVGSSW

SEQ ID NO: 1424998 - protein, 7 aa, Mycobacterium tuberculosis
NALPRRG

SEQ ID NO: 1424999 - protein, 8 aa, Mycobacterium tuberculosis
NAPGTQSQ

SEQ ID NO: 1425000 - protein, 4 aa, Mycobacterium tuberculosis
NASR

SEQ ID NO: 1425001 - protein, 6 aa, Mycobacterium tuberculosis
NDPSMQ

SEQ ID NO: 1425002 - protein, 8 aa, Mycobacterium tuberculosis
NEENGALN

SEQ ID NO: 1425003 - protein, 8 aa, Mycobacterium tuberculosis
NESLRQQA

SEQ ID NO: 1425004 - protein, 9 aa, Mycobacterium tuberculosis
NFGAGSSGW

SEQ ID NO: 1425005 - protein, 4 aa, Mycobacterium tuberculosis
NFPT

SEQ ID NO: 1425006 - protein, 28 aa, Mycobacterium tuberculosis
NGGAGGPGGPTDVPAGTGGAGGAGGDAP

SEQ ID NO: 1425007 - protein, 10 aa, Mycobacterium tuberculosis
NGGAGGQGGL

SEQ ID NO: 1425008 - protein, 10 aa, Mycobacterium tuberculosis
NGGEDRRPTL

SEQ ID NO: 1425009 - protein, 33 aa, Mycobacterium tuberculosis; identical to SEQ ID NO: 181310

SEQ ID NO: 1425010 - protein, 20 aa, Mycobacterium tuberculosis
NGGNGAAGAVGQVGGAGGAA

SEQ ID NO: 1425011 - protein, 31 aa, Mycobacterium tuberculosis; identical to SEQ ID NO: 232262

SEQ ID NO: 1425012 - protein, 49 aa, Mycobacterium tuberculosis; identical to SEQ ID NO: 181330

SEQ ID NO: 1425013 - protein, 9 aa, Mycobacterium tuberculosis
NLSKENRDF

SEQ ID NO: 1425014 - protein, 4 aa, Mycobacterium tuberculosis
NNAR

SEQ ID NO: 1425015 - protein, 11 aa, Mycobacterium tuberculosis
NPAAEQPAATL

SEQ ID NO: 1425016 - protein, 4 aa, Mycobacterium tuberculosis
NRAD

SEQ ID NO: 1425017 - protein, 10 aa, Mycobacterium tuberculosis
NRGAAAADRP

SEQ ID NO: 1425018 - protein, 8 aa, Mycobacterium tuberculosis
NRLGRRGA

SEQ ID NO: 1425019 - protein, 5 aa, Mycobacterium tuberculosis
NSDLR

SEQ ID NO: 1425020 - protein, 15 aa, Mycobacterium tuberculosis
NSENRRAMNPWTDPS

SEQ ID NO: 1425021 - protein, 18 aa, Mycobacterium tuberculosis
NSGNYNTGLANSGNVNTG

SEQ ID NO: 1425022 - protein, 6 aa, Mycobacterium tuberculosis
NSGSGN

SEQ ID NO: 1425023 - protein, 10 aa, Mycobacterium tuberculosis
NTGFGSPVDQ

SEQ ID NO: 1425024 - protein, 5 aa, Mycobacterium tuberculosis
NVATS

SEQ ID NO: 1425025 - protein, 6 aa, Mycobacterium tuberculosis
NVATTQ

SEQ ID NO: 1425026 - protein, 4 aa, Mycobacterium tuberculosis
NVGQ

SEQ ID NO: 1425027 - protein, 6 aa, Mycobacterium tuberculosis
NVGQNP

SEQ ID NO: 1425028 - protein, 8 aa, Mycobacterium tuberculosis
NWKPPKNA

SEQ ID NO: 1425029 - protein, 32 aa, Mycobacterium tuberculosis
PAAEEAALEEGLEGAGLSELGAAEAAVGEAPI

SEQ ID NO: 1425030 - protein, 9 aa, Mycobacterium tuberculosis
PADGVSDGA

SEQ ID NO: 1425031 - protein, 6 aa, Mycobacterium tuberculosis
PADIPS

SEQ ID NO: 1425032 - protein, 7 aa, Mycobacterium tuberculosis
PAERAEV

SEQ ID NO: 1425033 - protein, 9 aa, Mycobacterium tuberculosis
PATPSNEYR

SEQ ID NO: 1425034 - protein, 4 aa, Mycobacterium tuberculosis
PDRE

SEQ ID NO: 1425035 - protein, 7 aa, Mycobacterium tuberculosis
PDTPEVR

SEQ ID NO: 1425036 - protein, 4 aa, Mycobacterium tuberculosis
PERE

SEQ ID NO: 1425037 - protein, 17 aa, Mycobacterium tuberculosis
PGAGGKGGTGGTGGTAH

SEQ ID NO: 1425038 - protein, 6 aa, Mycobacterium tuberculosis
PGASSV

SEQ ID NO: 1425039 - protein, 7 aa, Mycobacterium tuberculosis
PGASSVE

SEQ ID NO: 1425040 - protein, 10 aa, Mycobacterium tuberculosis
PGDREVDDKR

SEQ ID NO: 1425041 - protein, 8 aa, Mycobacterium tuberculosis
PGGVDSPE

SEQ ID NO: 1425042 - protein, 14 aa, Mycobacterium tuberculosis
PGHQTREHRQYGER

SEQ ID NO: 1425043 - protein, 9 aa, Mycobacterium tuberculosis
PGNAAVADE

SEQ ID NO: 1425044 - protein, 29 aa, Mycobacterium tuberculosis
PGNVNTGVGNTGSINTGSFNTGSTNTGSF

SEQ ID NO: 1425045 - protein, 4 aa, Mycobacterium tuberculosis
PGTV

SEQ ID NO: 1425046 - protein, 12 aa, Mycobacterium tuberculosis
PGWPTTTASRRP

SEQ ID NO: 1425047 - protein, 35 aa, Mycobacterium tuberculosis; identical to SEQ ID NO: 166532

SEQ ID NO: 1425048 - protein, 141 aa, Mycobacterium tuberculosis
PIPEPLADDEDVDDGPDYVADDSDADDEGQLDRPANRRRRRGRRGRGRGRGEQGGSDGDPVDQQSEPRAQQFTSADAAETDDGDDRDSEDTEAGDNGEDENGSLEAGNRRRRRRRRRKSASGDDNDAALEGPLPDDPPNTV

SEQ ID NO: 1425049 - protein, 8 aa, Mycobacterium tuberculosis
PLDDPAAH

SEQ ID NO: 1425050 - protein, 6 aa, Mycobacterium tuberculosis
PLGAGK

SEQ ID NO: 1425051 - protein, 4 aa, Mycobacterium tuberculosis
PLPD

SEQ ID NO: 1425052 - protein, 19 aa, Mycobacterium tuberculosis
PNEPDYPPPPGGPPPPADI

SEQ ID NO: 1425053 - protein, 8 aa, Mycobacterium tuberculosis
PNPGTAEG

SEQ ID NO: 1425054 - protein, 9 aa, Mycobacterium tuberculosis
PPAADPVSN

SEQ ID NO: 1425055 - protein, 11 aa, Mycobacterium tuberculosis
PPNLAGAAQEA

SEQ ID NO: 1425056 - protein, 15 aa, Mycobacterium tuberculosis
PPPLPQAATPTLAAG

SEQ ID NO: 1425057 - protein, 5 aa, Mycobacterium tuberculosis
PPPVR

SEQ ID NO: 1425058 - protein, 5 aa, Mycobacterium tuberculosis
PPSRT

SEQ ID NO: 1425059 - protein, 5 aa, Mycobacterium tuberculosis
PPTDE

SEQ ID NO: 1425060 - protein, 11 aa, Mycobacterium tuberculosis
PQEQSQRPGHI

SEQ ID NO: 1425061 - protein, 10 aa, Mycobacterium tuberculosis
PQPDSDRMTR

SEQ ID NO: 1425062 - protein, 8 aa, Mycobacterium tuberculosis
PRPAARTD

SEQ ID NO: 1425063 - protein, 12 aa, Mycobacterium tuberculosis
PRRRTERESDTG

SEQ ID NO: 1425064 - protein, 5 aa, Mycobacterium tuberculosis
PRWGA

SEQ ID NO: 1425065 - protein, 5 aa, Mycobacterium tuberculosis
PSCGD

SEQ ID NO: 1425066 - protein, 8 aa, Mycobacterium tuberculosis
PSSTDASE

SEQ ID NO: 1425067 - protein, 17 aa, Mycobacterium tuberculosis
PTAVAAATKAAEERGLT

SEQ ID NO: 1425068 - protein, 8 aa, Mycobacterium tuberculosis
PTSATGGI

SEQ ID NO: 1425069 - protein, 4 aa, Mycobacterium tuberculosis
PVSV

SEQ ID NO: 1425070 - protein, 6 aa, Mycobacterium tuberculosis
QAFNTP

SEQ ID NO: 1425071 - protein, 9 aa, Mycobacterium tuberculosis
QATDKQLAA

SEQ ID NO: 1425072 - protein, 7 aa, Mycobacterium tuberculosis
QDEDEIQ

SEQ ID NO: 1425073 - protein, 7 aa, Mycobacterium tuberculosis
QDLGDPE

SEQ ID NO: 1425074 - protein, 7 aa, Mycobacterium tuberculosis
QDRDLGN

SEQ ID NO: 1425075 - protein, 9 aa, Mycobacterium tuberculosis
QDSESPDTQ

SEQ ID NO: 1425076 - protein, 9 aa, Mycobacterium tuberculosis
QEDDTVEVG

SEQ ID NO: 1425077 - protein, 6 aa, Mycobacterium tuberculosis
QEYQTV

SEQ ID NO: 1425078 - protein, 16 aa, Mycobacterium tuberculosis
QGADRPRRTPATVSRR

SEQ ID NO: 1425079 - protein, 5 aa, Mycobacterium tuberculosis
QGATA

SEQ ID NO: 1425080 - protein, 9 aa, Mycobacterium tuberculosis
QINGVARDD

SEQ ID NO: 1425081 - protein, 5 aa, Mycobacterium tuberculosis
QKKFE

SEQ ID NO: 1425082 - protein, 16 aa, Mycobacterium tuberculosis
QLGAGHATRVAPDAPN

SEQ ID NO: 1425083 - protein, 10 aa, Mycobacterium tuberculosis
QLGGSDAAVS

SEQ ID NO: 1425084 - protein, 17 aa, Mycobacterium tuberculosis
QLSAAGEGGGQSAARAA

SEQ ID NO: 1425085 - protein, 4 aa, Mycobacterium tuberculosis
QNGV

SEQ ID NO: 1425086 - protein, 7 aa, Mycobacterium tuberculosis
QNRGRDT

SEQ ID NO: 1425087 - protein, 5 aa, Mycobacterium tuberculosis
QNTPA

SEQ ID NO: 1425088 - protein, 15 aa, Mycobacterium tuberculosis
QNYPEAWGDEDKRVA

SEQ ID NO: 1425089 - protein, 6 aa, Mycobacterium tuberculosis
QPELEE

SEQ ID NO: 1425090 - protein, 12 aa, Mycobacterium tuberculosis
QPGERVHTTSGL

SEQ ID NO: 1425091 - protein, 4 aa, Mycobacterium tuberculosis
QPPF

SEQ ID NO: 1425092 - protein, 5 aa, Mycobacterium tuberculosis
QPRTR

SEQ ID NO: 1425093 - protein, 9 aa, Mycobacterium tuberculosis
QRESAPVDV

SEQ ID NO: 1425094 - protein, 6 aa, Mycobacterium tuberculosis
QRGDPI

SEQ ID NO: 1425095 - protein, 8 aa, Mycobacterium tuberculosis
QRGEDRQR

SEQ ID NO: 1425096 - protein, 13 aa, Mycobacterium tuberculosis
QRSFETREGEKRT

SEQ ID NO: 1425097 - protein, 10 aa, Mycobacterium tuberculosis
QRVGTDAATD

SEQ ID NO: 1425098 - protein, 6 aa, Mycobacterium tuberculosis
QSGDTV

SEQ ID NO: 1425099 - protein, 5 aa, Mycobacterium tuberculosis
QSGSD

SEQ ID NO: 1425100 - protein, 6 aa, Mycobacterium tuberculosis
QSVQNT

SEQ ID NO: 1425101 - protein, 8 aa, Mycobacterium tuberculosis
QTAGEPVT

SEQ ID NO: 1425102 - protein, 4 aa, Mycobacterium tuberculosis
QTEG

SEQ ID NO: 1425103 - protein, 5 aa, Mycobacterium tuberculosis
QTLGG

SEQ ID NO: 1425104 - protein, 5 aa, Mycobacterium tuberculosis
QTQMG

SEQ ID NO: 1425105 - protein, 8 aa, Mycobacterium tuberculosis
QTYVTTPG

SEQ ID NO: 1425106 - protein, 6 aa, Mycobacterium tuberculosis
QYDDYQ

SEQ ID NO: 1425107 - protein, 10 aa, Mycobacterium tuberculosis
QYYTDSSRTI

SEQ ID NO: 1425108 - protein, 9 aa, Mycobacterium tuberculosis
RAAGRRAHT

SEQ ID NO: 1425109 - protein, 9 aa, Mycobacterium tuberculosis
RAAQNGAKR

SEQ ID NO: 1425110 - protein, 6 aa, Mycobacterium tuberculosis
RAATAA

SEQ ID NO: 1425111 - protein, 6 aa, Mycobacterium tuberculosis
RADTTV

SEQ ID NO: 1425112 - protein, 6 aa, Mycobacterium tuberculosis
RADYPG

SEQ ID NO: 1425113 - protein, 7 aa, Mycobacterium tuberculosis
RAGADSL

SEQ ID NO: 1425114 - protein, 12 aa, Mycobacterium tuberculosis
RAKAERSENTLR

SEQ ID NO: 1425115 - protein, 13 aa, Mycobacterium tuberculosis
RARRAALAAAGAS

SEQ ID NO: 1425116 - protein, 15 aa, Mycobacterium tuberculosis
RASGPDSGGKARFVP

SEQ ID NO: 1425117 - protein, 10 aa, Mycobacterium tuberculosis
RCEACTGDGT

SEQ ID NO: 1425118 - protein, 29 aa, Mycobacterium tuberculosis
RCPPEGPSKGSSGGSSQGPPDGAAAGFGD

SEQ ID NO: 1425119 - protein, 5 aa, Mycobacterium tuberculosis
RDRRW

SEQ ID NO: 1425120 - protein, 6 aa, Mycobacterium tuberculosis
RDTAGY

SEQ ID NO: 1425121 - protein, 4 aa, Mycobacterium tuberculosis
RELT

SEQ ID NO: 1425122 - protein, 9 aa, Mycobacterium tuberculosis
RERRPDRAI

SEQ ID NO: 1425123 - protein, 9 aa, Mycobacterium tuberculosis
RESAPPTRE

SEQ ID NO: 1425124 - protein, 6 aa, Mycobacterium tuberculosis
RFPGSE

SEQ ID NO: 1425125 - protein, 25 aa, Mycobacterium tuberculosis
RGATAPRPADAASPSCGSSPSADSV

SEQ ID NO: 1425126 - protein, 11 aa, Mycobacterium tuberculosis
RGGLGNAAGYS

SEQ ID NO: 1425127 - protein, 8 aa, Mycobacterium tuberculosis
RGHRGDRL

SEQ ID NO: 1425128 - protein, 8 aa, Mycobacterium tuberculosis
RGTATAAG

SEQ ID NO: 1425129 - protein, 12 aa, Mycobacterium tuberculosis
RHAGPATAADAG

SEQ ID NO: 1425130 - protein, 12 aa, Mycobacterium tuberculosis
RHDTGYGHRPED

SEQ ID NO: 1425131 - protein, 4 aa, Mycobacterium tuberculosis
RKPL

SEQ ID NO: 1425132 - protein, 7 aa, Mycobacterium tuberculosis
RKPNEDH

SEQ ID NO: 1425133 - protein, 7 aa, Mycobacterium tuberculosis
RLPDGVS

SEQ ID NO: 1425134 - protein, 5 aa, Mycobacterium tuberculosis
RLRPP

SEQ ID NO: 1425135 - protein, 7 aa, Mycobacterium tuberculosis
RNNTATA

SEQ ID NO: 1425136 - protein, 6 aa, Mycobacterium tuberculosis
RNPNPH

SEQ ID NO: 1425137 - protein, 6 aa, Mycobacterium tuberculosis
RPAGTR

SEQ ID NO: 1425138 - protein, 9 aa, Mycobacterium tuberculosis
RPRRGRPRA

SEQ ID NO: 1425139 - protein, 12 aa, Mycobacterium tuberculosis
RPSVRTNLSQLR

SEQ ID NO: 1425140 - protein, 12 aa, Mycobacterium tuberculosis
RPTYDDAARSQV

SEQ ID NO: 1425141 - protein, 4 aa, Mycobacterium tuberculosis
RRCA

SEQ ID NO: 1425142 - protein, 14 aa, Mycobacterium tuberculosis
RRGCEESAASSSTP

SEQ ID NO: 1425143 - protein, 9 aa, Mycobacterium tuberculosis
RRGGRGARQ

SEQ ID NO: 1425144 - protein, 6 aa, Mycobacterium tuberculosis
RRKTTV

SEQ ID NO: 1425145 - protein, 5 aa, Mycobacterium tuberculosis
RRPEA

SEQ ID NO: 1425146 - protein, 16 aa, Mycobacterium tuberculosis
RRPKDLATKQAAASVG

SEQ ID NO: 1425147 - protein, 7 aa, Mycobacterium tuberculosis
RRRDPFD

SEQ ID NO: 1425148 - protein, 5 aa, Mycobacterium tuberculosis
RRRHP

SEQ ID NO: 1425149 - protein, 5 aa, Mycobacterium tuberculosis
RRTTA

SEQ ID NO: 1425150 - protein, 9 aa, Mycobacterium tuberculosis
RSAVPIEPD

SEQ ID NO: 1425151 - protein, 5 aa, Mycobacterium tuberculosis
RSAVR

SEQ ID NO: 1425152 - protein, 6 aa, Mycobacterium tuberculosis
RSGQPV

SEQ ID NO: 1425153 - protein, 15 aa, Mycobacterium tuberculosis
RSGVDEDYHRGESAY

SEQ ID NO: 1425154 - protein, 5 aa, Mycobacterium tuberculosis
RSLGE

SEQ ID NO: 1425155 - protein, 5 aa, Mycobacterium tuberculosis
RSREA

SEQ ID NO: 1425156 - protein, 10 aa, Mycobacterium tuberculosis
RSSVVGPNAA

SEQ ID NO: 1425157 - protein, 10 aa, Mycobacterium tuberculosis
RTDDGRISQR

SEQ ID NO: 1425158 - protein, 11 aa, Mycobacterium tuberculosis
RTDPSAPKHNG

SEQ ID NO: 1425159 - protein, 10 aa, Mycobacterium tuberculosis
RTNERARLRN

SEQ ID NO: 1425160 - protein, 8 aa, Mycobacterium tuberculosis
RTQPTQKM

SEQ ID NO: 1425161 - protein, 6 aa, Mycobacterium tuberculosis
RTRSEL

SEQ ID NO: 1425162 - protein, 7 aa, Mycobacterium tuberculosis
RVDPQSD

SEQ ID NO: 1425163 - protein, 11 aa, Mycobacterium tuberculosis
RVGQPEPANMP

SEQ ID NO: 1425164 - protein, 11 aa, Mycobacterium tuberculosis
RVNEKAPKDRD

SEQ ID NO: 1425165 - protein, 5 aa, Mycobacterium tuberculosis
RVQGA

SEQ ID NO: 1425166 - protein, 9 aa, Mycobacterium tuberculosis
SAAERGPGQ

SEQ ID NO: 1425167 - protein, 13 aa, Mycobacterium tuberculosis
SADEFASDPARFG

SEQ ID NO: 1425168 - protein, 16 aa, Mycobacterium tuberculosis
SADGVADENRRDDLEA

SEQ ID NO: 1425169 - protein, 25 aa, Mycobacterium tuberculosis
SAPAPAERPAPPAMSGAQRRATEKE

SEQ ID NO: 1425170 - protein, 13 aa, Mycobacterium tuberculosis
SASYAAAAGPTTA

SEQ ID NO: 1425171 - protein, 7 aa, Mycobacterium tuberculosis
SATTSTG

SEQ ID NO: 1425172 - protein, 8 aa, Mycobacterium tuberculosis
SCATKYGT

SEQ ID NO: 1425173 - protein, 8 aa, Mycobacterium tuberculosis
SDVGSRAG

SEQ ID NO: 1425174 - protein, 4 aa, Mycobacterium tuberculosis
SDVY

SEQ ID NO: 1425175 - protein, 6 aa, Mycobacterium tuberculosis
SEPPVG

SEQ ID NO: 1425176 - protein, 13 aa, Mycobacterium tuberculosis
SEPYDDDSGWGDV

SEQ ID NO: 1425177 - protein, 20 aa, Mycobacterium tuberculosis
SERLPRGADPNTHTKLGRGG

SEQ ID NO: 1425178 - protein, 6 aa, Mycobacterium tuberculosis
SGAASV

SEQ ID NO: 1425179 - protein, 8 aa, Mycobacterium tuberculosis
SGAGLSGY

SEQ ID NO: 1425180 - protein, 5 aa, Mycobacterium tuberculosis
SGAQV

SEQ ID NO: 1425181 - protein, 6 aa, Mycobacterium tuberculosis
SGEDYR

SEQ ID NO: 1425182 - protein, 4 aa, Mycobacterium tuberculosis
SGER

SEQ ID NO: 1425183 - protein, 9 aa, Mycobacterium tuberculosis
SGGNTYFES

SEQ ID NO: 1425184 - protein, 7 aa, Mycobacterium tuberculosis
SGGPFRG

SEQ ID NO: 1425185 - protein, 6 aa, Mycobacterium tuberculosis
SGTDAA

SEQ ID NO: 1425186 - protein, 20 aa, Mycobacterium tuberculosis
SGTGHGAAGVPGRAAPGVRR

SEQ ID NO: 1425187 - protein, 8 aa, Mycobacterium tuberculosis
SHATGRQL

SEQ ID NO: 1425188 - protein, 10 aa, Mycobacterium tuberculosis
SHNPATDNGY

SEQ ID NO: 1425189 - protein, 5 aa, Mycobacterium tuberculosis
SHPGV

SEQ ID NO: 1425190 - protein, 54 aa, Mycobacterium tuberculosis; identical to SEQ ID NO: 194999

SEQ ID NO: 1425191 - protein, 21 aa, Mycobacterium tuberculosis
SIRESASQALPGLLERLPALL

SEQ ID NO: 1425192 - protein, 6 aa, Mycobacterium tuberculosis
SLSSDE

SEQ ID NO: 1425193 - protein, 17 aa, Mycobacterium tuberculosis
SMRTNSNQLRSYAAWTP

SEQ ID NO: 1425194 - protein, 40 aa, Mycobacterium tuberculosis
SMTANSPAGSPFGAAPSAPSHSTTTSGPPTAPTPTSPFGT

SEQ ID NO: 1425195 - protein, 4 aa, Mycobacterium tuberculosis
SNDG

SEQ ID NO: 1425196 - protein, 5 aa, Mycobacterium tuberculosis
SPAND

SEQ ID NO: 1425197 - protein, 5 aa, Mycobacterium tuberculosis
SPITK

SEQ ID NO: 1425198 - protein, 8 aa, Mycobacterium tuberculosis
SPQPSAAV

SEQ ID NO: 1425199 - protein, 9 aa, Mycobacterium tuberculosis
SPQPSAAVE

SEQ ID NO: 1425200 - protein, 12 aa, Mycobacterium tuberculosis
SQSIPGPSNLGY

SEQ ID NO: 1425201 - protein, 5 aa, Mycobacterium tuberculosis
SREGY

SEQ ID NO: 1425202 - protein, 9 aa, Mycobacterium tuberculosis
SRELRNNTA

SEQ ID NO: 1425203 - protein, 9 aa, Mycobacterium tuberculosis
SRGYRGQRS

SEQ ID NO: 1425204 - protein, 9 aa, Mycobacterium tuberculosis
SRNAESDSG

SEQ ID NO: 1425205 - protein, 8 aa, Mycobacterium tuberculosis
SRTSATGI

SEQ ID NO: 1425206 - protein, 10 aa, Mycobacterium tuberculosis
SSADQRSDLD

SEQ ID NO: 1425207 - protein, 16 aa, Mycobacterium tuberculosis
SSFRGSDKRGGANGGR

SEQ ID NO: 1425208 - protein, 7 aa, Mycobacterium tuberculosis
SSHASAA

SEQ ID NO: 1425209 - protein, 5 aa, Mycobacterium tuberculosis
SSLSD

SEQ ID NO: 1425210 - protein, 8 aa, Mycobacterium tuberculosis
STDASGRY

SEQ ID NO: 1425211 - protein, 8 aa, Mycobacterium tuberculosis
STGLAGRI

SEQ ID NO: 1425212 - protein, 5 aa, Mycobacterium tuberculosis
STGRS

SEQ ID NO: 1425213 - protein, 4 aa, Mycobacterium tuberculosis
STLR

SEQ ID NO: 1425214 - protein, 7 aa, Mycobacterium tuberculosis
STMPGGY

SEQ ID NO: 1425215 - protein, 9 aa, Mycobacterium tuberculosis
STPMPPGED

SEQ ID NO: 1425216 - protein, 9 aa, Mycobacterium tuberculosis
STRTLTGAT

SEQ ID NO: 1425217 - protein, 5 aa, Mycobacterium tuberculosis
SVEPA

SEQ ID NO: 1425218 - protein, 11 aa, Mycobacterium tuberculosis
SVLGTKKAEAL

SEQ ID NO: 1425219 - protein, 12 aa, Mycobacterium tuberculosis
SVRTTAESLNTT

SEQ ID NO: 1425220 - protein, 7 aa, Mycobacterium tuberculosis
SWTEPKG

SEQ ID NO: 1425221 - protein, 4 aa, Mycobacterium tuberculosis
SYRG

SEQ ID NO: 1425222 - protein, 17 aa, Mycobacterium tuberculosis
TAAQTKQTATQARAAAA

SEQ ID NO: 1425223 - protein, 5 aa, Mycobacterium tuberculosis
TADEA

SEQ ID NO: 1425224 - protein, 10 aa, Mycobacterium tuberculosis
TAPAPQGPWS

SEQ ID NO: 1425225 - protein, 7 aa, Mycobacterium tuberculosis
TARTGGV

SEQ ID NO: 1425226 - protein, 7 aa, Mycobacterium tuberculosis
TASKTNA

SEQ ID NO: 1425227 - protein, 5 aa, Mycobacterium tuberculosis
TDDTK

SEQ ID NO: 1425228 - protein, 8 aa, Mycobacterium tuberculosis
TDTPGFTA

SEQ ID NO: 1425229 - protein, 11 aa, Mycobacterium tuberculosis
TEDPSPGVDGQ

SEQ ID NO: 1425230 - protein, 6 aa, Mycobacterium tuberculosis
TELGNP

SEQ ID NO: 1425231 - protein, 6 aa, Mycobacterium tuberculosis
TEPWRG

SEQ ID NO: 1425232 - protein, 11 aa, Mycobacterium tuberculosis
TEQEADRALKA

SEQ ID NO: 1425233 - protein, 4 aa, Mycobacterium tuberculosis
TFEH

SEQ ID NO: 1425234 - protein, 10 aa, Mycobacterium tuberculosis
TFPASDPGQL

SEQ ID NO: 1425235 - protein, 8 aa, Mycobacterium tuberculosis
TGAADGYA

SEQ ID NO: 1425236 - protein, 9 aa, Mycobacterium tuberculosis
TGDRSGDQL

SEQ ID NO: 1425237 - protein, 12 aa, Mycobacterium tuberculosis
TGEQSEAARRSG

SEQ ID NO: 1425238 - protein, 7 aa, Mycobacterium tuberculosis
TGGKHRS

SEQ ID NO: 1425239 - protein, 6 aa, Mycobacterium tuberculosis
TGHRAN

SEQ ID NO: 1425240 - protein, 10 aa, Mycobacterium tuberculosis
TGKARTTVAR

SEQ ID NO: 1425241 - protein, 15 aa, Mycobacterium tuberculosis
TGKPAELDRDEPRRV

SEQ ID NO: 1425242 - protein, 8 aa, Mycobacterium tuberculosis
TGQAPAAY

SEQ ID NO: 1425243 - protein, 5 aa, Mycobacterium tuberculosis
TGRSM

SEQ ID NO: 1425244 - protein, 5 aa, Mycobacterium tuberculosis
TGWSS

SEQ ID NO: 1425245 - protein, 6 aa, Mycobacterium tuberculosis
THENTR

SEQ ID NO: 1425246 - protein, 8 aa, Mycobacterium tuberculosis
TKDWSQAK

SEQ ID NO: 1425247 - protein, 4 aa, Mycobacterium tuberculosis
TKKE

SEQ ID NO: 1425248 - protein, 9 aa, Mycobacterium tuberculosis
TKPDAARRI

SEQ ID NO: 1425249 - protein, 5 aa, Mycobacterium tuberculosis
TKQRR

SEQ ID NO: 1425250 - protein, 7 aa, Mycobacterium tuberculosis
TLGTTSR

SEQ ID NO: 1425251 - protein, 7 aa, Mycobacterium tuberculosis
TLSTTGP

SEQ ID NO: 1425252 - protein, 5 aa, Mycobacterium tuberculosis
TLTAN

SEQ ID NO: 1425253 - protein, 7 aa, Mycobacterium tuberculosis
TLTRRDQ

SEQ ID NO: 1425254 - protein, 13 aa, Mycobacterium tuberculosis
TMQSAQRDEKELG

SEQ ID NO: 1425255 - protein, 4 aa, Mycobacterium tuberculosis
TNHL

SEQ ID NO: 1425256 - protein, 6 aa, Mycobacterium tuberculosis
TNRYGT

SEQ ID NO: 1425257 - protein, 14 aa, Mycobacterium tuberculosis
TPDPEPDPPATHAP

SEQ ID NO: 1425258 - protein, 11 aa, Mycobacterium tuberculosis
TPGEASRRIAE

SEQ ID NO: 1425259 - protein, 7 aa, Mycobacterium tuberculosis
TPPSRNA

SEQ ID NO: 1425260 - protein, 12 aa, Mycobacterium tuberculosis
TPSPASDTDTVT

SEQ ID NO: 1425261 - protein, 11 aa, Mycobacterium tuberculosis
TPTDDNLYQTS

SEQ ID NO: 1425262 - protein, 5 aa, Mycobacterium tuberculosis
TPTEA

SEQ ID NO: 1425263 - protein, 5 aa, Mycobacterium tuberculosis
TPTKW

SEQ ID NO: 1425264 - protein, 5 aa, Mycobacterium tuberculosis
TPVPS

SEQ ID NO: 1425265 - protein, 6 aa, Mycobacterium tuberculosis
TRAERR

SEQ ID NO: 1425266 - protein, 23 aa, Mycobacterium tuberculosis
TRAGRPPGTVTADRGYGEKRVED

SEQ ID NO: 1425267 - protein, 11 aa, Mycobacterium tuberculosis
TRSEAKRRVAE

SEQ ID NO: 1425268 - protein, 8 aa, Mycobacterium tuberculosis
TSGDPRAA

SEQ ID NO: 1425269 - protein, 12 aa, Mycobacterium tuberculosis
TTADTTPESAAD

SEQ ID NO: 1425270 - protein, 4 aa, Mycobacterium tuberculosis
TTAN

SEQ ID NO: 1425271 - protein, 12 aa, Mycobacterium tuberculosis
TTGSVDELLALL

SEQ ID NO: 1425272 - protein, 5 aa, Mycobacterium tuberculosis
TTKDR

SEQ ID NO: 1425273 - protein, 9 aa, Mycobacterium tuberculosis
TVGGSGAIN

SEQ ID NO: 1425274 - protein, 7 aa, Mycobacterium tuberculosis
TVGPARA

SEQ ID NO: 1425275 - protein, 4 aa, Mycobacterium tuberculosis
TVHP

SEQ ID NO: 1425276 - protein, 8 aa, Mycobacterium tuberculosis
TVPGGLSA

SEQ ID NO: 1425277 - protein, 11 aa, Mycobacterium tuberculosis
TVPGSKSQTNR

SEQ ID NO: 1425278 - protein, 8 aa, Mycobacterium tuberculosis
TVSNAEEF

SEQ ID NO: 1425279 - protein, 16 aa, Mycobacterium tuberculosis
VAVGESGIGYAAGDAV

SEQ ID NO: 1425280 - protein, 6 aa, Mycobacterium tuberculosis
VDTQRA

SEQ ID NO: 1425281 - protein, 10 aa, Mycobacterium tuberculosis
VEGSTRLSQT

SEQ ID NO: 1425282 - protein, 7 aa, Mycobacterium tuberculosis
VERYGAS

SEQ ID NO: 1425283 - protein, 9 aa, Mycobacterium tuberculosis
VETNSEPRM

SEQ ID NO: 1425284 - protein, 7 aa, Mycobacterium tuberculosis
VGAGEWP

SEQ ID NO: 1425285 - protein, 5 aa, Mycobacterium tuberculosis
VGATA

SEQ ID NO: 1425286 - protein, 10 aa, Mycobacterium tuberculosis
VGLANAGSTV

SEQ ID NO: 1425287 - protein, 12 aa, Mycobacterium tuberculosis
VGPATPPPPWCE

SEQ ID NO: 1425288 - protein, 13 aa, Mycobacterium tuberculosis
VGPATPPPPWCEP

SEQ ID NO: 1425289 - protein, 11 aa, Mycobacterium tuberculosis
VGRSKAQSARD

SEQ ID NO: 1425290 - protein, 8 aa, Mycobacterium tuberculosis
VGTAARSQ

SEQ ID NO: 1425291 - protein, 14 aa, Mycobacterium tuberculosis
VGTPEIATEAGVTR

SEQ ID NO: 1425292 - protein, 4 aa, Mycobacterium tuberculosis
VHNP

SEQ ID NO: 1425293 - protein, 5 aa, Mycobacterium tuberculosis
VHNPT

SEQ ID NO: 1425294 - protein, 5 aa, Mycobacterium tuberculosis
VKDAG

SEQ ID NO: 1425295 - protein, 7 aa, Mycobacterium tuberculosis
VKGSQLG

SEQ ID NO: 1425296 - protein, 13 aa, Mycobacterium tuberculosis
VNAADAPAYGGHN

SEQ ID NO: 1425297 - protein, 5 aa, Mycobacterium tuberculosis
VNDPG

SEQ ID NO: 1425298 - protein, 20 aa, Mycobacterium tuberculosis
VNQDGASNGLTAPNGPSQQR

SEQ ID NO: 1425299 - protein, 63 aa, Mycobacterium tuberculosis
VPAGQGSMGNNGEPGGPGQPGTEFGQTGGTGGTGGTGLSVGGTGGTGGTGGTGGAGGSGGRGG

SEQ ID NO: 1425300 - protein, 12 aa, Mycobacterium tuberculosis
VPAQTEQQRNDA

SEQ ID NO: 1425301 - protein, 4 aa, Mycobacterium tuberculosis
VPDA

SEQ ID NO: 1425302 - protein, 11 aa, Mycobacterium tuberculosis
VPDLPTPWPQE

SEQ ID NO: 1425303 - protein, 13 aa, Mycobacterium tuberculosis
VPPAPASKKVARR

SEQ ID NO: 1425304 - protein, 12 aa, Mycobacterium tuberculosis
VPPEPPPSKLSP

SEQ ID NO: 1425305 - protein, 4 aa, Mycobacterium tuberculosis
VPRS

SEQ ID NO: 1425306 - protein, 8 aa, Mycobacterium tuberculosis
VPSSHDAI

SEQ ID NO: 1425307 - protein, 10 aa, Mycobacterium tuberculosis
VQGPVSKVST

SEQ ID NO: 1425308 - protein, 6 aa, Mycobacterium tuberculosis
VRNYDG

SEQ ID NO: 1425309 - protein, 13 aa, Mycobacterium tuberculosis
VRRGAPSANAQWG

SEQ ID NO: 1425310 - protein, 8 aa, Mycobacterium tuberculosis
VSADDEPK

SEQ ID NO: 1425311 - protein, 13 aa, Mycobacterium tuberculosis
VSARESHGGEGRI

SEQ ID NO: 1425312 - protein, 6 aa, Mycobacterium tuberculosis
VSGRGR

SEQ ID NO: 1425313 - protein, 8 aa, Mycobacterium tuberculosis
VSKDNGQT

SEQ ID NO: 1425314 - protein, 14 aa, Mycobacterium tuberculosis
VSPAVRAGADERGL

SEQ ID NO: 1425315 - protein, 4 aa, Mycobacterium tuberculosis
VSSS

SEQ ID NO: 1425316 - protein, 4 aa, Mycobacterium tuberculosis
VTHD

SEQ ID NO: 1425317 - protein, 6 aa, Mycobacterium tuberculosis
VTKPYP

SEQ ID NO: 1425318 - protein, 14 aa, Mycobacterium tuberculosis
VTRREPHPAVGDGQ

SEQ ID NO: 1425319 - protein, 20 aa, Mycobacterium tuberculosis
VTSGDASNRYSGSPVRQPGF

SEQ ID NO: 1425320 - protein, 23 aa, Mycobacterium tuberculosis
WGNGRGRGCRCGRGDRGGDRRDR

SEQ ID NO: 1425321 - protein, 8 aa, Mycobacterium tuberculosis
WKGSSSEW

SEQ ID NO: 1425322 - protein, 4 aa, Mycobacterium tuberculosis
WNPM

SEQ ID NO: 1425323 - protein, 14 aa, Mycobacterium tuberculosis
WPEPTGESGAWPTT

SEQ ID NO: 1425324 - protein, 9 aa, Mycobacterium tuberculosis
WPLGPTHPS

SEQ ID NO: 1425325 - protein, 11 aa, Mycobacterium tuberculosis
WRNRNRIKTSQ

SEQ ID NO: 1425326 - protein, 6 aa, Mycobacterium tuberculosis
WRSAPE

SEQ ID NO: 1425327 - protein, 12 aa, Mycobacterium tuberculosis
WTDRTIPIVVCE

SEQ ID NO: 1425328 - protein, 4 aa, Mycobacterium tuberculosis
WTRT

SEQ ID NO: 1425329 - protein, 7 aa, Mycobacterium tuberculosis
YAEDTGT

SEQ ID NO: 1425330 - protein, 6 aa, Mycobacterium tuberculosis
YAEEPE

SEQ ID NO: 1425331 - protein, 258 aa, Mycobacterium tuberculosis
YARPQEDPRGGPDPQGGSDPRGGYPPETGGYPPQPGYPRPRHPDQGDYPEQIGYPDQGGYPEQRGYPEQRGYPDQRGYQDQGRGYPDQGQGGYPPPYEQRPPVSPGPAAGYGAPGYDQGYRQSGGYGPSPGGGQPGYGGYGEYGRGPARHEEGSYVPSGPPGPPEQRPAYPDQGGYDQGYQQGATTYGRQDYGGGADYTRYTESPRVPGYAPQGGGYAEPAGRDYDYGQSGAPDYGQPAPGGYSGYGQGGYGSAGTSV

SEQ ID NO: 1425332 - protein, 4 aa, Mycobacterium tuberculosis
YENQ

SEQ ID NO: 1425333 - protein, 4 aa, Mycobacterium tuberculosis
YEQY

SEQ ID NO: 1425334 - protein, 9 aa, Mycobacterium tuberculosis
YGETKPPEL

SEQ ID NO: 1425335 - protein, 5 aa, Mycobacterium tuberculosis
YGVKR

SEQ ID NO: 1425336 - protein, 6 aa, Mycobacterium tuberculosis
YGVTPK

SEQ ID NO: 1425337 - protein, 11 aa, Mycobacterium tuberculosis
YNPDPDAAGAC

SEQ ID NO: 1425338 - protein, 5 aa, Mycobacterium tuberculosis
YPSGE

SEQ ID NO: 1425339 - protein, 17 aa, Mycobacterium tuberculosis
YPTTTEAQDSALSPRGY

SEQ ID NO: 1425340 - protein, 9 aa, Mycobacterium tuberculosis
YQQADHGES

SEQ ID NO: 1425341 - protein, 11 aa, Mycobacterium tuberculosis
YRDASGKPQIA

SEQ ID NO: 1425342 - protein, 8 aa, Mycobacterium tuberculosis
YSEEEPTT

SEQ ID NO: 1425343 - protein, 15 aa, Mycobacterium tuberculosis
YTQNGRGELAATEHA

SEQ ID NO: 1425344 - protein, 13 aa, Mycobacterium tuberculosis
YTSAGRTKETAED

SEQ ID NO: 1425345 - protein, 11 aa, Mycobacterium tuberculosis
YTSGSTRPPVG

SEQ ID NO: 1425346 - protein, 9 aa, Mycobacterium tuberculosis
YYTDSSRTI

SEQ ID NO: 1425347 - protein, 22 aa, Mycobacterium tuberculosis
AAAESAISAETEAAAAGAAPAL

SEQ ID NO: 1425348 - protein, 8 aa, Mycobacterium tuberculosis
AAAPPTLP

SEQ ID NO: 1425349 - protein, 9 aa, Mycobacterium tuberculosis
AAAQRAGHL

SEQ ID NO: 1425350 - protein, 18 aa, Mycobacterium tuberculosis
AAATGRPDRLPGVGSSSH

SEQ ID NO: 1425351 - protein, 7 aa, Mycobacterium tuberculosis
AADRAGR

SEQ ID NO: 1425352 - protein, 6 aa, Mycobacterium tuberculosis
AAEAET

SEQ ID NO: 1425353 - protein, 5 aa, Mycobacterium tuberculosis
AAGSP

SEQ ID NO: 1425354 - protein, 53 aa, Mycobacterium tuberculosis; identical to SEQ ID NO: 167072

SEQ ID NO: 1425355 - protein, 10 aa, Mycobacterium tuberculosis
AAIASTRQNQ

SEQ ID NO: 1425356 - protein, 11 aa, Mycobacterium tuberculosis
AALTSVSGAAI

SEQ ID NO: 1425357 - protein, 14 aa, Mycobacterium tuberculosis
AANSFEAQAARDGL

SEQ ID NO: 1425358 - protein, 5 aa, Mycobacterium tuberculosis
AAPAA

SEQ ID NO: 1425359 - protein, 7 aa, Mycobacterium tuberculosis
AAPKTGG

SEQ ID NO: 1425360 - protein, 9 aa, Mycobacterium tuberculosis
AAPKYAEAG

SEQ ID NO: 1425361 - protein, 5 aa, Mycobacterium tuberculosis
AAPSQ

SEQ ID NO: 1425362 - protein, 4 aa, Mycobacterium tuberculosis
AAPT

SEQ ID NO: 1425363 - protein, 6 aa, Mycobacterium tuberculosis
AARGGR

SEQ ID NO: 1425364 - protein, 4 aa, Mycobacterium tuberculosis
AARP

SEQ ID NO: 1425365 - protein, 5 aa, Mycobacterium tuberculosis
AARPR

SEQ ID NO: 1425366 - protein, 5 aa, Mycobacterium tuberculosis
AARRQ

SEQ ID NO: 1425367 - protein, 11 aa, Mycobacterium tuberculosis
AATGQSTDLDP

SEQ ID NO: 1425368 - protein, 5 aa, Mycobacterium tuberculosis
AATTG

SEQ ID NO: 1425369 - protein, 6 aa, Mycobacterium tuberculosis
AAVATN

SEQ ID NO: 1425370 - protein, 9 aa, Mycobacterium tuberculosis
ADDRGEAKR

SEQ ID NO: 1425371 - protein, 17 aa, Mycobacterium tuberculosis
ADFATPANLSGLSNVGA

SEQ ID NO: 1425372 - protein, 7 aa, Mycobacterium tuberculosis
ADGIAAG

SEQ ID NO: 1425373 - protein, 5 aa, Mycobacterium tuberculosis
ADIKG

SEQ ID NO: 1425374 - protein, 12 aa, Mycobacterium tuberculosis
ADKVRGGYYTPP

SEQ ID NO: 1425375 - protein, 5 aa, Mycobacterium tuberculosis
ADRGS

SEQ ID NO: 1425376 - protein, 6 aa, Mycobacterium tuberculosis
ADRGSW

SEQ ID NO: 1425377 - protein, 6 aa, Mycobacterium tuberculosis
ADTALD

SEQ ID NO: 1425378 - protein, 6 aa, Mycobacterium tuberculosis
ADTIGA

SEQ ID NO: 1425379 - protein, 6 aa, Mycobacterium tuberculosis
ADTQAE

SEQ ID NO: 1425380 - protein, 11 aa, Mycobacterium tuberculosis
ADVDSQPGPVR

SEQ ID NO: 1425381 - protein, 8 aa, Mycobacterium tuberculosis
ADVPDQSG

SEQ ID NO: 1425382 - protein, 6 aa, Mycobacterium tuberculosis
AEAARS

SEQ ID NO: 1425383 - protein, 15 aa, Mycobacterium tuberculosis
AEAQRTADPVEGEQA

SEQ ID NO: 1425384 - protein, 7 aa, Mycobacterium tuberculosis
AEATSLD

SEQ ID NO: 1425385 - protein, 10 aa, Mycobacterium tuberculosis
AEFASQGVPE

SEQ ID NO: 1425386 - protein, 9 aa, Mycobacterium tuberculosis
AEPPAGVRG

SEQ ID NO: 1425387 - protein, 5 aa, Mycobacterium tuberculosis
AEQRE

SEQ ID NO: 1425388 - protein, 6 aa, Mycobacterium tuberculosis
AEVSKA

SEQ ID NO: 1425389 - protein, 6 aa, Mycobacterium tuberculosis
AGDPNN

SEQ ID NO: 1425390 - protein, 6 aa, Mycobacterium tuberculosis
AGEGAL

SEQ ID NO: 1425391 - protein, 8 aa, Mycobacterium tuberculosis
AGGGGGIG

SEQ ID NO: 1425392 - protein, 7 aa, Mycobacterium tuberculosis
AGGVGTA

SEQ ID NO: 1425393 - protein, 6 aa, Mycobacterium tuberculosis
AGNRGL

SEQ ID NO: 1425394 - protein, 16 aa, Mycobacterium tuberculosis
AGPAKIPLPGPGPGQT

SEQ ID NO: 1425395 - protein, 12 aa, Mycobacterium tuberculosis
AGQAEQAGAQAK

SEQ ID NO: 1425396 - protein, 7 aa, Mycobacterium tuberculosis
AGRWSPT

SEQ ID NO: 1425397 - protein, 17 aa, Mycobacterium tuberculosis
AGSCASAETTADAPTQA

SEQ ID NO: 1425398 - protein, 7 aa, Mycobacterium tuberculosis
AGSEPMS

SEQ ID NO: 1425399 - protein, 13 aa, Mycobacterium tuberculosis
AGSSAVVGAVVGP

SEQ ID NO: 1425400 - protein, 11 aa, Mycobacterium tuberculosis
AGTASDEAGAG

SEQ ID NO: 1425401 - protein, 42 aa, Mycobacterium tuberculosis
AGTGNSGFGHNDPAGSGNSGIQNSGFGNSGYVNTSTTSMFGG

SEQ ID NO: 1425402 - protein, 34 aa, Mycobacterium tuberculosis
AHGGNGGAGGDAGHGGTGGDGGDGGHAGTGGRGG

SEQ ID NO: 1425403 - protein, 17 aa, Mycobacterium tuberculosis
AHPPALPDPLPAGPTRR

SEQ ID NO: 1425404 - protein, 9 aa, Mycobacterium tuberculosis
AISAGDQSI

SEQ ID NO: 1425405 - protein, 8 aa, Mycobacterium tuberculosis
AKEALADP

SEQ ID NO: 1425406 - protein, 8 aa, Mycobacterium tuberculosis
AKKGGQHL

SEQ ID NO: 1425407 - protein, 12 aa, Mycobacterium tuberculosis
AKKRTSTRISNP

SEQ ID NO: 1425408 - protein, 6 aa, Mycobacterium tuberculosis
AKTQGI

SEQ ID NO: 1425409 - protein, 9 aa, Mycobacterium tuberculosis
ALARPGTRR

SEQ ID NO: 1425410 - protein, 8 aa, Mycobacterium tuberculosis
ALASGASE

SEQ ID NO: 1425411 - protein, 18 aa, Mycobacterium tuberculosis
ALGGNRPAVYAPKSALGH

SEQ ID NO: 1425412 - protein, 4 aa, Mycobacterium tuberculosis
ALPG

SEQ ID NO: 1425413 - protein, 9 aa, Mycobacterium tuberculosis
ALTGPHARL

SEQ ID NO: 1425414 - protein, 26 aa, Mycobacterium tuberculosis
ANPAPGDNAARKTGRGGARQSPQSRV

SEQ ID NO: 1425415 - protein, 7 aa, Mycobacterium tuberculosis
ANPGLDP

SEQ ID NO: 1425416 - protein, 8 aa, Mycobacterium tuberculosis
ANTGTNNL

SEQ ID NO: 1425417 - protein, 18 aa, Mycobacterium tuberculosis
APAAAAQAVQTAAQNGVQ

SEQ ID NO: 1425418 - protein, 5 aa, Mycobacterium tuberculosis
APAQA

SEQ ID NO: 1425419 - protein, 9 aa, Mycobacterium tuberculosis
APDETATAM

SEQ ID NO: 1425420 - protein, 8 aa, Mycobacterium tuberculosis
APDGGPAQ

SEQ ID NO: 1425421 - protein, 5 aa, Mycobacterium tuberculosis
APGFQ

SEQ ID NO: 1425422 - protein, 5 aa, Mycobacterium tuberculosis
APIDS

SEQ ID NO: 1425423 - protein, 11 aa, Mycobacterium tuberculosis
APLDEASRNRL

SEQ ID NO: 1425424 - protein, 5 aa, Mycobacterium tuberculosis
APRRV

SEQ ID NO: 1425425 - protein, 5 aa, Mycobacterium tuberculosis
APTQA

SEQ ID NO: 1425426 - protein, 21 aa, Mycobacterium tuberculosis
AQAAQGRDGVGHGVARIAVGD

SEQ ID NO: 1425427 - protein, 15 aa, Mycobacterium tuberculosis
AQAASGQARLVGTFE

SEQ ID NO: 1425428 - protein, 10 aa, Mycobacterium tuberculosis
AQRQRPLRTA

SEQ ID NO: 1425429 - protein, 10 aa, Mycobacterium tuberculosis
ARGKGISDIS

SEQ ID NO: 1425430 - protein, 14 aa, Mycobacterium tuberculosis
ARLANDPTAPPPGQ

SEQ ID NO: 1425431 - protein, 13 aa, Mycobacterium tuberculosis
ARLNRSSVRSTRD

SEQ ID NO: 1425432 - protein, 6 aa, Mycobacterium tuberculosis
ARNVSG

SEQ ID NO: 1425433 - protein, 14 aa, Mycobacterium tuberculosis
ARPGIPPTRPVQGP

SEQ ID NO: 1425434 - protein, 6 aa, Mycobacterium tuberculosis
ARRAHD

SEQ ID NO: 1425435 - protein, 12 aa, Mycobacterium tuberculosis
ASDTNPAPQLQN

SEQ ID NO: 1425436 - protein, 13 aa, Mycobacterium tuberculosis
ASGLTVKADPSMG

SEQ ID NO: 1425437 - protein, 5 aa, Mycobacterium tuberculosis
ASPDG

SEQ ID NO: 1425438 - protein, 12 aa, Mycobacterium tuberculosis
ASYAAAAGPTTA

SEQ ID NO: 1425439 - protein, 7 aa, Mycobacterium tuberculosis
ATADTSM

SEQ ID NO: 1425440 - protein, 5 aa, Mycobacterium tuberculosis
ATDMP

SEQ ID NO: 1425441 - protein, 6 aa, Mycobacterium tuberculosis
ATDTGS

SEQ ID NO: 1425442 - protein, 6 aa, Mycobacterium tuberculosis
ATEASY

SEQ ID NO: 1425443 - protein, 8 aa, Mycobacterium tuberculosis
ATGGHLGP

SEQ ID NO: 1425444 - protein, 8 aa, Mycobacterium tuberculosis
ATGGLTPE

SEQ ID NO: 1425445 - protein, 12 aa, Mycobacterium tuberculosis
ATGRLSSTEPNL

SEQ ID NO: 1425446 - protein, 11 aa, Mycobacterium tuberculosis
ATLDRPGRPLG

SEQ ID NO: 1425447 - protein, 10 aa, Mycobacterium tuberculosis
ATPGCREGET

SEQ ID NO: 1425448 - protein, 4 aa, Mycobacterium tuberculosis
ATQI

SEQ ID NO: 1425449 - protein, 12 aa, Mycobacterium tuberculosis
ATTSHRSTATVG

SEQ ID NO: 1425450 - protein, 8 aa, Mycobacterium tuberculosis
ATVHTGDT

SEQ ID NO: 1425451 - protein, 4 aa, Mycobacterium tuberculosis
AVGG

SEQ ID NO: 1425452 - protein, 14 aa, Mycobacterium tuberculosis
AVGQAGASASARQV

SEQ ID NO: 1425453 - protein, 17 aa, Mycobacterium tuberculosis
CPAPARAGAARSSPGAS

SEQ ID NO: 1425454 - protein, 8 aa, Mycobacterium tuberculosis
DAAPGLAA

SEQ ID NO: 1425455 - protein, 8 aa, Mycobacterium tuberculosis
DAGKTKRA

SEQ ID NO: 1425456 - protein, 12 aa, Mycobacterium tuberculosis
DAPGRAPGRKSV

SEQ ID NO: 1425457 - protein, 7 aa, Mycobacterium tuberculosis
DARRSAD

SEQ ID NO: 1425458 - protein, 9 aa, Mycobacterium tuberculosis
DATNSSPDQ

SEQ ID NO: 1425459 - protein, 10 aa, Mycobacterium tuberculosis
DDATSGNGDY

SEQ ID NO: 1425460 - protein, 4 aa, Mycobacterium tuberculosis
DDEQ

SEQ ID NO: 1425461 - protein, 7 aa, Mycobacterium tuberculosis
DDNQPRA

SEQ ID NO: 1425462 - protein, 8 aa, Mycobacterium tuberculosis
DDVGGTWR

SEQ ID NO: 1425463 - protein, 6 aa, Mycobacterium tuberculosis
DDVRAA

SEQ ID NO: 1425464 - protein, 5 aa, Mycobacterium tuberculosis
DEEQR

SEQ ID NO: 1425465 - protein, 6 aa, Mycobacterium tuberculosis
DEPATN

SEQ ID NO: 1425466 - protein, 10 aa, Mycobacterium tuberculosis
DFTGEGAKLR

SEQ ID NO: 1425467 - protein, 12 aa, Mycobacterium tuberculosis
DGGVGVASTPSL

SEQ ID NO: 1425468 - protein, 6 aa, Mycobacterium tuberculosis
DGRLGG

SEQ ID NO: 1425469 - protein, 9 aa, Mycobacterium tuberculosis
DGYDGAGLQ

SEQ ID NO: 1425470 - protein, 4 aa, Mycobacterium tuberculosis
DHEN

SEQ ID NO: 1425471 - protein, 36 aa, Mycobacterium tuberculosis; identical to SEQ ID NO: 171690

SEQ ID NO: 1425472 - protein, 6 aa, Mycobacterium tuberculosis
DKAAEA

SEQ ID NO: 1425473 - protein, 7 aa, Mycobacterium tuberculosis
DLDGRAP

SEQ ID NO: 1425474 - protein, 8 aa, Mycobacterium tuberculosis
DLEQATGA

SEQ ID NO: 1425475 - protein, 7 aa, Mycobacterium tuberculosis
DLTDSGR

SEQ ID NO: 1425476 - protein, 6 aa, Mycobacterium tuberculosis
DNGDVD

SEQ ID NO: 1425477 - protein, 5 aa, Mycobacterium tuberculosis
DNTQT

SEQ ID NO: 1425478 - protein, 7 aa, Mycobacterium tuberculosis
DPAGDGG

SEQ ID NO: 1425479 - protein, 5 aa, Mycobacterium tuberculosis
DPAGV

SEQ ID NO: 1425480 - protein, 6 aa, Mycobacterium tuberculosis
DPARRT

SEQ ID NO: 1425481 - protein, 13 aa, Mycobacterium tuberculosis
DPATAERYGHAGR

SEQ ID NO: 1425482 - protein, 4 aa, Mycobacterium tuberculosis
DPDR

SEQ ID NO: 1425483 - protein, 73 aa, Mycobacterium tuberculosis
DPKVAAKAAPLSTTRVGQSAGSGIPESTLRTAQGQQASETSAAEETAPSLRPEAAAGQLRPRVRKDPKIQMRG

SEQ ID NO: 1425484 - protein, 10 aa, Mycobacterium tuberculosis
DPLPPTPRRE

SEQ ID NO: 1425485 - protein, 9 aa, Mycobacterium tuberculosis
DPSADSTTT

SEQ ID NO: 1425486 - protein, 10 aa, Mycobacterium tuberculosis
DPVCSSGGNW

SEQ ID NO: 1425487 - protein, 9 aa, Mycobacterium tuberculosis
DPVETPEEY

SEQ ID NO: 1425488 - protein, 4 aa, Mycobacterium tuberculosis
DRAG

SEQ ID NO: 1425489 - protein, 4 aa, Mycobacterium tuberculosis
DRNL

SEQ ID NO: 1425490 - protein, 4 aa, Mycobacterium tuberculosis
DRNR

SEQ ID NO: 1425491 - protein, 19 aa, Mycobacterium tuberculosis
DRSTKKEVKQVKPTNADVG

SEQ ID NO: 1425492 - protein, 4 aa, Mycobacterium tuberculosis
DSAE

SEQ ID NO: 1425493 - protein, 13 aa, Mycobacterium tuberculosis
DSAVRKKGNDFAT

SEQ ID NO: 1425494 - protein, 12 aa, Mycobacterium tuberculosis
DSLAAAKSKSAL

SEQ ID NO: 1425495 - protein, 8 aa, Mycobacterium tuberculosis
DSRGNPTV

SEQ ID NO: 1425496 - protein, 4 aa, Mycobacterium tuberculosis
DSWD

SEQ ID NO: 1425497 - protein, 29 aa, Mycobacterium tuberculosis
DTAGGHWPKTARATAETDATANRGAKPSI

SEQ ID NO: 1425498 - protein, 7 aa, Mycobacterium tuberculosis
DTPDEAP

SEQ ID NO: 1425499 - protein, 17 aa, Mycobacterium tuberculosis
DVAEEARPIQPYGSSIP

SEQ ID NO: 1425500 - protein, 4 aa, Mycobacterium tuberculosis
DYSG

SEQ ID NO: 1425501 - protein, 4 aa, Mycobacterium tuberculosis
EAAA

SEQ ID NO: 1425502 - protein, 23 aa, Mycobacterium tuberculosis
EAAADVGADAEAAIAASRSGSQI

SEQ ID NO: 1425503 - protein, 16 aa, Mycobacterium tuberculosis
EAAKGYATARARSGEE

SEQ ID NO: 1425504 - protein, 8 aa, Mycobacterium tuberculosis
EAGDPAGQ

SEQ ID NO: 1425505 - protein, 18 aa, Mycobacterium tuberculosis
EAHGTRAASIGTAKPGRR

SEQ ID NO: 1425506 - protein, 8 aa, Mycobacterium tuberculosis
EAVAPTAT

SEQ ID NO: 1425507 - protein, 11 aa, Mycobacterium tuberculosis
EEATAAGTARY

SEQ ID NO: 1425508 - protein, 5 aa, Mycobacterium tuberculosis
EEELR

SEQ ID NO: 1425509 - protein, 8 aa, Mycobacterium tuberculosis
EENKRQRA

SEQ ID NO: 1425510 - protein, 5 aa, Mycobacterium tuberculosis
EEQRR

SEQ ID NO: 1425511 - protein, 8 aa, Mycobacterium tuberculosis
EFDPERAG

SEQ ID NO: 1425512 - protein, 7 aa, Mycobacterium tuberculosis
EGAGPAG

SEQ ID NO: 1425513 - protein, 7 aa, Mycobacterium tuberculosis
EGGPTYW

SEQ ID NO: 1425514 - protein, 7 aa, Mycobacterium tuberculosis
EGQQAKT

SEQ ID NO: 1425515 - protein, 9 aa, Mycobacterium tuberculosis
EHPAVPAAA

SEQ ID NO: 1425516 - protein, 6 aa, Mycobacterium tuberculosis
EIPDSH

SEQ ID NO: 1425517 - protein, 9 aa, Mycobacterium tuberculosis
EKPGRREGW

SEQ ID NO: 1425518 - protein, 7 aa, Mycobacterium tuberculosis
EKSPSFH

SEQ ID NO: 1425519 - protein, 8 aa, Mycobacterium tuberculosis
ELATSATA

SEQ ID NO: 1425520 - protein, 5 aa, Mycobacterium tuberculosis
ELGSA

SEQ ID NO: 1425521 - protein, 18 aa, Mycobacterium tuberculosis
ELGTLDEDAARWMRRHGG

SEQ ID NO: 1425522 - protein, 6 aa, Mycobacterium tuberculosis
ELTNGR

SEQ ID NO: 1425523 - protein, 6 aa, Mycobacterium tuberculosis
EPGRWS

SEQ ID NO: 1425524 - protein, 6 aa, Mycobacterium tuberculosis
EPLGRD

SEQ ID NO: 1425525 - protein, 8 aa, Mycobacterium tuberculosis
EPLTDPLT

SEQ ID NO: 1425526 - protein, 7 aa, Mycobacterium tuberculosis
EPRPITS

SEQ ID NO: 1425527 - protein, 6 aa, Mycobacterium tuberculosis
EPSCGD

SEQ ID NO: 1425528 - protein, 6 aa, Mycobacterium tuberculosis
EQERGI

SEQ ID NO: 1425529 - protein, 4 aa, Mycobacterium tuberculosis
EQVD

SEQ ID NO: 1425530 - protein, 9 aa, Mycobacterium tuberculosis
EQWDDGNNT

SEQ ID NO: 1425531 - protein, 23 aa, Mycobacterium tuberculosis
ERAKHQTDSSRRAGATNRASSSR

SEQ ID NO: 1425532 - protein, 24 aa, Mycobacterium tuberculosis
ERPKAKQRQREGGDHGRQARYSGL

SEQ ID NO: 1425533 - protein, 45 aa, Mycobacterium tuberculosis
ERPKAKQRQREGGDHGRQARYSGLGSMEPKPESERDAHKADTAIS

SEQ ID NO: 1425534 - protein, 4 aa, Mycobacterium tuberculosis
ERPL

SEQ ID NO: 1425535 - protein, 7 aa, Mycobacterium tuberculosis
ERQAQIT

SEQ ID NO: 1425536 - protein, 16 aa, Mycobacterium tuberculosis
ESDTPNKLRATPTRGS

SEQ ID NO: 1425537 - protein, 5 aa, Mycobacterium tuberculosis
ESQTI

SEQ ID NO: 1425538 - protein, 10 aa, Mycobacterium tuberculosis
ESYAENASLT

SEQ ID NO: 1425539 - protein, 15 aa, Mycobacterium tuberculosis
ETPRPGPADAAETRY

SEQ ID NO: 1425540 - protein, 10 aa, Mycobacterium tuberculosis
ETTSDLGGYK

SEQ ID NO: 1425541 - protein, 5 aa, Mycobacterium tuberculosis
EYQTV

SEQ ID NO: 1425542 - protein, 9 aa, Mycobacterium tuberculosis
FANTGSGNI

SEQ ID NO: 1425543 - protein, 9 aa, Mycobacterium tuberculosis
FDGEQKLAG

SEQ ID NO: 1425544 - protein, 12 aa, Mycobacterium tuberculosis
FGGQGGNGGAGG

SEQ ID NO: 1425545 - protein, 55 aa, Mycobacterium tuberculosis; identical to SEQ ID NO: 174402

SEQ ID NO: 1425546 - protein, 9 aa, Mycobacterium tuberculosis
FNPGGMKDR

SEQ ID NO: 1425547 - protein, 5 aa, Mycobacterium tuberculosis
FQETT

SEQ ID NO: 1425548 - protein, 13 aa, Mycobacterium tuberculosis
FSANEADAAQQFQ

SEQ ID NO: 1425549 - protein, 20 aa, Mycobacterium tuberculosis
FSANEADAAQQFQGVGAQAE

SEQ ID NO: 1425550 - protein, 5 aa, Mycobacterium tuberculosis
FTSTE

SEQ ID NO: 1425551 - protein, 13 aa, Mycobacterium tuberculosis
FYEPDSEGNRQRA

SEQ ID NO: 1425552 - protein, 42 aa, Mycobacterium tuberculosis; identical to SEQ ID NO: 174559

SEQ ID NO: 1425553 - protein, 4 aa, Mycobacterium tuberculosis
GAAR

SEQ ID NO: 1425554 - protein, 13 aa, Mycobacterium tuberculosis
GAIGGKTGYTNAA

SEQ ID NO: 1425555 - protein, 14 aa, Mycobacterium tuberculosis
GAPDSGNGGTDHPT

SEQ ID NO: 1425556 - protein, 11 aa, Mycobacterium tuberculosis
GAQAEAQGATQ

SEQ ID NO: 1425557 - protein, 5 aa, Mycobacterium tuberculosis
GAREF

SEQ ID NO: 1425558 - protein, 36 aa, Mycobacterium tuberculosis
GASTRRSPNCSPWPPPLTSHPRSTPSWSPASPTRAS

SEQ ID NO: 1425559 - protein, 6 aa, Mycobacterium tuberculosis
GCPFDP

SEQ ID NO: 1425560 - protein, 7 aa, Mycobacterium tuberculosis
GDDEQRK

SEQ ID NO: 1425561 - protein, 25 aa, Mycobacterium tuberculosis
GDGGNGGNAGVGTPAGNVGAGGTGG

SEQ ID NO: 1425562 - protein, 4 aa, Mycobacterium tuberculosis
GDNQ

SEQ ID NO: 1425563 - protein, 4 aa, Mycobacterium tuberculosis
GDPV

SEQ ID NO: 1425564 - protein, 10 aa, Mycobacterium tuberculosis
GEGPDGRKTI

SEQ ID NO: 1425565 - protein, 19 aa, Mycobacterium tuberculosis
GEQAADAELTDRSTVAAGT

SEQ ID NO: 1425566 - protein, 13 aa, Mycobacterium tuberculosis
GERAELGGDLSGG

SEQ ID NO: 1425567 - protein, 5 aa, Mycobacterium tuberculosis
GFGGR

SEQ ID NO: 1425568 - protein, 15 aa, Mycobacterium tuberculosis
GGAGGNGGIGGAGTN

SEQ ID NO: 1425569 - protein, 12 aa, Mycobacterium tuberculosis
GGAGGPGGTGAM

SEQ ID NO: 1425570 - protein, 16 aa, Mycobacterium tuberculosis
GGAGGVGGAGGAGTTF

SEQ ID NO: 1425571 - protein, 9 aa, Mycobacterium tuberculosis
GGAVTSPGV

SEQ ID NO: 1425572 - protein, 12 aa, Mycobacterium tuberculosis
GGEINSRQLPDN

SEQ ID NO: 1425573 - protein, 24 aa, Mycobacterium tuberculosis
GGLTGRRDGGSGDSPTERSERVSE

SEQ ID NO: 1425574 - protein, 10 aa, Mycobacterium tuberculosis
GGPTPAPRGL

SEQ ID NO: 1425575 - protein, 6 aa, Mycobacterium tuberculosis
GGQPMD

SEQ ID NO: 1425576 - protein, 27 aa, Mycobacterium tuberculosis
GGTGGPGGPGGPGGVGGTGGAGGLGGT

SEQ ID NO: 1425577 - protein, 4 aa, Mycobacterium tuberculosis
GGTR

SEQ ID NO: 1425578 - protein, 5 aa, Mycobacterium tuberculosis
GGTRR

SEQ ID NO: 1425579 - protein, 24 aa, Mycobacterium tuberculosis
GGVGGAGGQSLLGGATGGAGGNAG

SEQ ID NO: 1425580 - protein, 5 aa, Mycobacterium tuberculosis
GHGQA

SEQ ID NO: 1425581 - protein, 5 aa, Mycobacterium tuberculosis
GHGRD

SEQ ID NO: 1425582 - protein, 5 aa, Mycobacterium tuberculosis
GIRRG

SEQ ID NO: 1425583 - protein, 12 aa, Mycobacterium tuberculosis
GITDVTAASAAT

SEQ ID NO: 1425584 - protein, 5 aa, Mycobacterium tuberculosis
GKPHA

SEQ ID NO: 1425585 - protein, 4 aa, Mycobacterium tuberculosis
GKPL

SEQ ID NO: 1425586 - protein, 15 aa, Mycobacterium tuberculosis
GLPDPAKQAGRYPHQ

SEQ ID NO: 1425587 - protein, 13 aa, Mycobacterium tuberculosis
GLRPGRTERQVSR

SEQ ID NO: 1425588 - protein, 38 aa, Mycobacterium tuberculosis; identical to SEQ ID NO: 192603

SEQ ID NO: 1425589 - protein, 17 aa, Mycobacterium tuberculosis
GNGADGAPGTGAAGGAG

SEQ ID NO: 1425590 - protein, 14 aa, Mycobacterium tuberculosis
GNGGAGGNGGASGS

SEQ ID NO: 1425591 - protein, 13 aa, Mycobacterium tuberculosis
GNGGNGGAGGIGG

SEQ ID NO: 1425592 - protein, 4 aa, Mycobacterium tuberculosis
GNGQ

SEQ ID NO: 1425593 - protein, 12 aa, Mycobacterium tuberculosis
GPAGRQARLDRR

SEQ ID NO: 1425594 - protein, 4 aa, Mycobacterium tuberculosis
GPLG

SEQ ID NO: 1425595 - protein, 7 aa, Mycobacterium tuberculosis
GPQRTPA

SEQ ID NO: 1425596 - protein, 7 aa, Mycobacterium tuberculosis
GQAGGQA

SEQ ID NO: 1425597 - protein, 9 aa, Mycobacterium tuberculosis
GRAESAMES

SEQ ID NO: 1425598 - protein, 28 aa, Mycobacterium tuberculosis
GRAGKAAAAHAAAAGRSRATSSATWPEP

SEQ ID NO: 1425599 - protein, 9 aa, Mycobacterium tuberculosis
GRIGPGKAQ

SEQ ID NO: 1425600 - protein, 9 aa, Mycobacterium tuberculosis
GRKGDGRIE

SEQ ID NO: 1425601 - protein, 5 aa, Mycobacterium tuberculosis
GRPLI

SEQ ID NO: 1425602 - protein, 13 aa, Mycobacterium tuberculosis
GRQDKAKQTPCPG

SEQ ID NO: 1425603 - protein, 9 aa, Mycobacterium tuberculosis
GRTTSTSLP

SEQ ID NO: 1425604 - protein, 13 aa, Mycobacterium tuberculosis
GSDERGRAATEDA

SEQ ID NO: 1425605 - protein, 14 aa, Mycobacterium tuberculosis
GSGGAGGDGGAATS

SEQ ID NO: 1425606 - protein, 4 aa, Mycobacterium tuberculosis
GSIQ

SEQ ID NO: 1425607 - protein, 11 aa, Mycobacterium tuberculosis
GSLPRTSSGKL

SEQ ID NO: 1425608 - protein, 21 aa, Mycobacterium tuberculosis
GSMEPKPESERDAHKADTAIS

SEQ ID NO: 1425609 - protein, 8 aa, Mycobacterium tuberculosis
GSSGAYEE

SEQ ID NO: 1425610 - protein, 7 aa, Mycobacterium tuberculosis
GSSSHQK

SEQ ID NO: 1425611 - protein, 11 aa, Mycobacterium tuberculosis
GSVAGTGGNGG

SEQ ID NO: 1425612 - protein, 7 aa, Mycobacterium tuberculosis
GSYRTDG

SEQ ID NO: 1425613 - protein, 5 aa, Mycobacterium tuberculosis
GTEID

SEQ ID NO: 1425614 - protein, 8 aa, Mycobacterium tuberculosis
GTPGPADV

SEQ ID NO: 1425615 - protein, 7 aa, Mycobacterium tuberculosis
GTSAATG

SEQ ID NO: 1425616 - protein, 8 aa, Mycobacterium tuberculosis
GTVESGSQ

SEQ ID NO: 1425617 - protein, 9 aa, Mycobacterium tuberculosis
GTVESGSQV

SEQ ID NO: 1425618 - protein, 14 aa, Mycobacterium tuberculosis
GTVGGAAPGGGAAA

SEQ ID NO: 1425619 - protein, 8 aa, Mycobacterium tuberculosis
GTYDPRRI

SEQ ID NO: 1425620 - protein, 30 aa, Mycobacterium tuberculosis
GVDDQGAGAVVPGTGHGSDEGIEEKIATET

SEQ ID NO: 1425621 - protein, 32 aa, Mycobacterium tuberculosis
GVGGDGGSGGSSLGVGGVGGAGGVGGKGGASG

SEQ ID NO: 1425622 - protein, 10 aa, Mycobacterium tuberculosis
GVPAGKSDRL

SEQ ID NO: 1425623 - protein, 5 aa, Mycobacterium tuberculosis
GVPEI

SEQ ID NO: 1425624 - protein, 8 aa, Mycobacterium tuberculosis
GYDPNGGY

SEQ ID NO: 1425625 - protein, 19 aa, Mycobacterium tuberculosis
GYTTTGSIDDAVASLRAAL

SEQ ID NO: 1425626 - protein, 4 aa, Mycobacterium tuberculosis
HAEI

SEQ ID NO: 1425627 - protein, 5 aa, Mycobacterium tuberculosis
HDDGV

SEQ ID NO: 1425628 - protein, 5 aa, Mycobacterium tuberculosis
HETDR

SEQ ID NO: 1425629 - protein, 5 aa, Mycobacterium tuberculosis
HFSDR

SEQ ID NO: 1425630 - protein, 4 aa, Mycobacterium tuberculosis
HGKP

SEQ ID NO: 1425631 - protein, 6 aa, Mycobacterium tuberculosis
HGLTPR

SEQ ID NO: 1425632 - protein, 14 aa, Mycobacterium tuberculosis
HGYPVTDKARDGRW

SEQ ID NO: 1425633 - protein, 7 aa, Mycobacterium tuberculosis
HLPRERA

SEQ ID NO: 1425634 - protein, 12 aa, Mycobacterium tuberculosis
HLSPEGRKTYRS

SEQ ID NO: 1425635 - protein, 11 aa, Mycobacterium tuberculosis
HPDLPIDTATE

SEQ ID NO: 1425636 - protein, 10 aa, Mycobacterium tuberculosis
HSSESRAADH

SEQ ID NO: 1425637 - protein, 15 aa, Mycobacterium tuberculosis
HVATEEDRVDTRKVT

SEQ ID NO: 1425638 - protein, 8 aa, Mycobacterium tuberculosis
HVGDARAT

SEQ ID NO: 1425639 - protein, 9 aa, Mycobacterium tuberculosis
HVGDARATE

SEQ ID NO: 1425640 - protein, 24 aa, Mycobacterium tuberculosis
IAADTGSATGTETGGAGQCAPSRS

SEQ ID NO: 1425641 - protein, 7 aa, Mycobacterium tuberculosis
IDHGPQP

SEQ ID NO: 1425642 - protein, 8 aa, Mycobacterium tuberculosis
IDPEETSE

SEQ ID NO: 1425643 - protein, 4 aa, Mycobacterium tuberculosis
IDPV

SEQ ID NO: 1425644 - protein, 31 aa, Mycobacterium tuberculosis
IEAAEGAASAAAAGLADSVTPAGLGASLGEA

SEQ ID NO: 1425645 - protein, 9 aa, Mycobacterium tuberculosis
IEEKIATET

SEQ ID NO: 1425646 - protein, 6 aa, Mycobacterium tuberculosis
IEQTRA

SEQ ID NO: 1425647 - protein, 9 aa, Mycobacterium tuberculosis
IGPGGPVSL

SEQ ID NO: 1425648 - protein, 7 aa, Mycobacterium tuberculosis
IIGRGQD

SEQ ID NO: 1425649 - protein, 13 aa, Mycobacterium tuberculosis
INGGSGGQGGHGG

SEQ ID NO: 1425650 - protein, 10 aa, Mycobacterium tuberculosis
INPTSLADPA

SEQ ID NO: 1425651 - protein, 11 aa, Mycobacterium tuberculosis
IPAPEADPPYD

SEQ ID NO: 1425652 - protein, 16 aa, Mycobacterium tuberculosis
IPDGAPLDAPRPMPPE

SEQ ID NO: 1425653 - protein, 12 aa, Mycobacterium tuberculosis
IPKSAPGSATGL

SEQ ID NO: 1425654 - protein, 9 aa, Mycobacterium tuberculosis
IRAPSGGNV

SEQ ID NO: 1425655 - protein, 5 aa, Mycobacterium tuberculosis
ISSGR

SEQ ID NO: 1425656 - protein, 9 aa, Mycobacterium tuberculosis
ITEDTGAAQ

SEQ ID NO: 1425657 - protein, 5 aa, Mycobacterium tuberculosis
ITGGE

SEQ ID NO: 1425658 - protein, 27 aa, Mycobacterium tuberculosis
IYARGEGGFGGKRGPSGSDVAPERAPD

SEQ ID NO: 1425659 - protein, 10 aa, Mycobacterium tuberculosis
KAQKQARRWS

SEQ ID NO: 1425660 - protein, 11 aa, Mycobacterium tuberculosis
KAQKQARRWSR

SEQ ID NO: 1425661 - protein, 10 aa, Mycobacterium tuberculosis
KDADRAQRRE

SEQ ID NO: 1425662 - protein, 6 aa, Mycobacterium tuberculosis
KEAAAE

SEQ ID NO: 1425663 - protein, 8 aa, Mycobacterium tuberculosis
KGARYGPV

SEQ ID NO: 1425664 - protein, 6 aa, Mycobacterium tuberculosis
KGKVGA

SEQ ID NO: 1425665 - protein, 7 aa, Mycobacterium tuberculosis
KGPDFPT

SEQ ID NO: 1425666 - protein, 6 aa, Mycobacterium tuberculosis
KKYGPI

SEQ ID NO: 1425667 - protein, 8 aa, Mycobacterium tuberculosis
KNERGEAE

SEQ ID NO: 1425668 - protein, 6 aa, Mycobacterium tuberculosis
KNGRHS

SEQ ID NO: 1425669 - protein, 4 aa, Mycobacterium tuberculosis
KPGN

SEQ ID NO: 1425670 - protein, 8 aa, Mycobacterium tuberculosis
KPGRSYTA

SEQ ID NO: 1425671 - protein, 8 aa, Mycobacterium tuberculosis
KPRNAGLR

SEQ ID NO: 1425672 - protein, 7 aa, Mycobacterium tuberculosis
KPRREWP

SEQ ID NO: 1425673 - protein, 7 aa, Mycobacterium tuberculosis
KSEPLGL

SEQ ID NO: 1425674 - protein, 8 aa, Mycobacterium tuberculosis
KSKQDHST

SEQ ID NO: 1425675 - protein, 4 aa, Mycobacterium tuberculosis
KTQT

SEQ ID NO: 1425676 - protein, 9 aa, Mycobacterium tuberculosis
KYSSPQTDF

SEQ ID NO: 1425677 - protein, 9 aa, Mycobacterium tuberculosis
LAGAGSGFA

SEQ ID NO: 1425678 - protein, 15 aa, Mycobacterium tuberculosis
LAPRRGQSFDSGVSD

SEQ ID NO: 1425679 - protein, 9 aa, Mycobacterium tuberculosis
LARTTTRDV

SEQ ID NO: 1425680 - protein, 12 aa, Mycobacterium tuberculosis
LDDSKKLSEQAR

SEQ ID NO: 1425681 - protein, 4 aa, Mycobacterium tuberculosis
LDDY

SEQ ID NO: 1425682 - protein, 8 aa, Mycobacterium tuberculosis
LDGGADDY

SEQ ID NO: 1425683 - protein, 13 aa, Mycobacterium tuberculosis
LDTPARPRPVTAE

SEQ ID NO: 1425684 - protein, 36 aa, Mycobacterium tuberculosis
LEANPDNNSATSGFGNSGKQDSGGFNSIDFVSGFFH

SEQ ID NO: 1425685 - protein, 6 aa, Mycobacterium tuberculosis
LEDKGV

SEQ ID NO: 1425686 - protein, 4 aa, Mycobacterium tuberculosis
LEGE

SEQ ID NO: 1425687 - protein, 9 aa, Mycobacterium tuberculosis
LGGTARAER

SEQ ID NO: 1425688 - protein, 11 aa, Mycobacterium tuberculosis
LGNAGELNTGF

SEQ ID NO: 1425689 - protein, 38 aa, Mycobacterium tuberculosis; identical to SEQ ID NO: 232825

SEQ ID NO: 1425690 - protein, 7 aa, Mycobacterium tuberculosis
LKATGDP

SEQ ID NO: 1425691 - protein, 14 aa, Mycobacterium tuberculosis
LNDDTRPRKLRPGD

SEQ ID NO: 1425692 - protein, 4 aa, Mycobacterium tuberculosis
LNGR

SEQ ID NO: 1425693 - protein, 9 aa, Mycobacterium tuberculosis
LNSGGGQHV

SEQ ID NO: 1425694 - protein, 7 aa, Mycobacterium tuberculosis
LNSGSNN

SEQ ID NO: 1425695 - protein, 4 aa, Mycobacterium tuberculosis
LPDE

SEQ ID NO: 1425696 - protein, 12 aa, Mycobacterium tuberculosis
LPPGSPTDLTDD

SEQ ID NO: 1425697 - protein, 14 aa, Mycobacterium tuberculosis
LPPGVRRPAGIPAD

SEQ ID NO: 1425698 - protein, 15 aa, Mycobacterium tuberculosis
LPRPGRQRAPRAGVH

SEQ ID NO: 1425699 - protein, 16 aa, Mycobacterium tuberculosis
LPSDTDLDTPGPQRSL

SEQ ID NO: 1425700 - protein, 5 aa, Mycobacterium tuberculosis
LPTTV

SEQ ID NO: 1425701 - protein, 4 aa, Mycobacterium tuberculosis
LQPE

SEQ ID NO: 1425702 - protein, 4 aa, Mycobacterium tuberculosis
LQPR

SEQ ID NO: 1425703 - protein, 19 aa, Mycobacterium tuberculosis
LQPTASAESDHTENREECQ

SEQ ID NO: 1425704 - protein, 8 aa, Mycobacterium tuberculosis
LRSRDEQR

SEQ ID NO: 1425705 - protein, 12 aa, Mycobacterium tuberculosis
LSAQSRDALTDA

SEQ ID NO: 1425706 - protein, 13 aa, Mycobacterium tuberculosis
LSPTSMSHPQQVR

SEQ ID NO: 1425707 - protein, 6 aa, Mycobacterium tuberculosis
LSSKEW

SEQ ID NO: 1425708 - protein, 5 aa, Mycobacterium tuberculosis
LTEPD

SEQ ID NO: 1425709 - protein, 8 aa, Mycobacterium tuberculosis
MAAPPGVD

SEQ ID NO: 1425710 - protein, 9 aa, Mycobacterium tuberculosis
MAGDAGEPW

SEQ ID NO: 1425711 - protein, 5 aa, Mycobacterium tuberculosis
MEKPI

SEQ ID NO: 1425712 - protein, 16 aa, Mycobacterium tuberculosis
MPTQETTPTRGIPSGP

SEQ ID NO: 1425713 - protein, 4 aa, Mycobacterium tuberculosis
MSGA

SEQ ID NO: 1425714 - protein, 8 aa, Mycobacterium tuberculosis
MSGTHESN

SEQ ID NO: 1425715 - protein, 20 aa, Mycobacterium tuberculosis
NAGADADGPVATTGLYPPGS

SEQ ID NO: 1425716 - protein, 14 aa, Mycobacterium tuberculosis
NAKNRPGAGFVPVP

SEQ ID NO: 1425717 - protein, 6 aa, Mycobacterium tuberculosis
NDAANT

SEQ ID NO: 1425718 - protein, 17 aa, Mycobacterium tuberculosis
NGADGAPGTGQPGGPGG

SEQ ID NO: 1425719 - protein, 16 aa, Mycobacterium tuberculosis
NGADGGPGQNGGPGGL

SEQ ID NO: 1425720 - protein, 16 aa, Mycobacterium tuberculosis
NGANGTPGTGADGGAG

SEQ ID NO: 1425721 - protein, 73 aa, Mycobacterium tuberculosis; identical to SEQ ID NO: 181285

SEQ ID NO: 1425722 - protein, 74 aa, Mycobacterium tuberculosis; identical to SEQ ID NO: 181287

SEQ ID NO: 1425723 - protein, 26 aa, Mycobacterium tuberculosis
NGGAGGNGGAATIPGGNGGAGGAGGN

SEQ ID NO: 1425724 - protein, 21 aa, Mycobacterium tuberculosis
NGGAGGSGAPGGIGAGGNGGN

SEQ ID NO: 1425725 - protein, 10 aa, Mycobacterium tuberculosis
NGGGPRGTDV

SEQ ID NO: 1425726 - protein, 45 aa, Mycobacterium tuberculosis; identical to SEQ ID NO: 181317

SEQ ID NO: 1425727 - protein, 15 aa, Mycobacterium tuberculosis
NGGSVEDAKKRPEFG

SEQ ID NO: 1425728 - protein, 4 aa, Mycobacterium tuberculosis
NGGV

SEQ ID NO: 1425729 - protein, 10 aa, Mycobacterium tuberculosis
NGHTYTTHPG

SEQ ID NO: 1425730 - protein, 10 aa, Mycobacterium tuberculosis
NGRPYRDGEV

SEQ ID NO: 1425731 - protein, 7 aa, Mycobacterium tuberculosis
NHAEPKQ

SEQ ID NO: 1425732 - protein, 12 aa, Mycobacterium tuberculosis
NMPSATAQRPGD

SEQ ID NO: 1425733 - protein, 13 aa, Mycobacterium tuberculosis
NMPSATAQRPGDV

SEQ ID NO: 1425734 - protein, 5 aa, Mycobacterium tuberculosis
NNNFG

SEQ ID NO: 1425735 - protein, 5 aa, Mycobacterium tuberculosis
NNRVR

SEQ ID NO: 1425736 - protein, 5 aa, Mycobacterium tuberculosis
NNTRE

SEQ ID NO: 1425737 - protein, 4 aa, Mycobacterium tuberculosis
NPGE

SEQ ID NO: 1425738 - protein, 5 aa, Mycobacterium tuberculosis
NPGEI

SEQ ID NO: 1425739 - protein, 5 aa, Mycobacterium tuberculosis
NPRDG

SEQ ID NO: 1425740 - protein, 8 aa, Mycobacterium tuberculosis
NPSDWPEG

SEQ ID NO: 1425741 - protein, 9 aa, Mycobacterium tuberculosis
NPTSITSNP

SEQ ID NO: 1425742 - protein, 8 aa, Mycobacterium tuberculosis
NQRYESGA

SEQ ID NO: 1425743 - protein, 5 aa, Mycobacterium tuberculosis
NRPRR

SEQ ID NO: 1425744 - protein, 50 aa, Mycobacterium tuberculosis
NSGSNDSGLRNTAVREPSTPGSGIPKSNFYPSPDRESAYASPRIGQPVGS

SEQ ID NO: 1425745 - protein, 6 aa, Mycobacterium tuberculosis
NSRVRA

SEQ ID NO: 1425746 - protein, 5 aa, Mycobacterium tuberculosis
NSTVP

SEQ ID NO: 1425747 - protein, 11 aa, Mycobacterium tuberculosis
NTASIAATEAQ

SEQ ID NO: 1425748 - protein, 41 aa, Mycobacterium tuberculosis; identical to SEQ ID NO: 230652

SEQ ID NO: 1425749 - protein, 14 aa, Mycobacterium tuberculosis
NTTVSRDGLTTPGV

SEQ ID NO: 1425750 - protein, 4 aa, Mycobacterium tuberculosis
NVVE

SEQ ID NO: 1425751 - protein, 8 aa, Mycobacterium tuberculosis
PAAFATAS

SEQ ID NO: 1425752 - protein, 5 aa, Mycobacterium tuberculosis
PAAVA

SEQ ID NO: 1425753 - protein, 16 aa, Mycobacterium tuberculosis
PAGPGYFNSSATPSSG

SEQ ID NO: 1425754 - protein, 9 aa, Mycobacterium tuberculosis
PAGSPEFQR

SEQ ID NO: 1425755 - protein, 6 aa, Mycobacterium tuberculosis
PALRSG

SEQ ID NO: 1425756 - protein, 5 aa, Mycobacterium tuberculosis
PARDS

SEQ ID NO: 1425757 - protein, 7 aa, Mycobacterium tuberculosis
PATLPES

SEQ ID NO: 1425758 - protein, 21 aa, Mycobacterium tuberculosis
PATNTVTGSPITIGNGPSGVA

SEQ ID NO: 1425759 - protein, 22 aa, Mycobacterium tuberculosis
PATNTVTGSPITIGNGPSGVAV

SEQ ID NO: 1425760 - protein, 7 aa, Mycobacterium tuberculosis
PATWTEP

SEQ ID NO: 1425761 - protein, 17 aa, Mycobacterium tuberculosis
PAVTGKPSGDDLKSGKR

SEQ ID NO: 1425762 - protein, 14 aa, Mycobacterium tuberculosis
PDAAATFRRTERHR

SEQ ID NO: 1425763 - protein, 7 aa, Mycobacterium tuberculosis
PDAPTGC

SEQ ID NO: 1425764 - protein, 9 aa, Mycobacterium tuberculosis
PDEQPGLAP

SEQ ID NO: 1425765 - protein, 7 aa, Mycobacterium tuberculosis
PDGLPEA

SEQ ID NO: 1425766 - protein, 10 aa, Mycobacterium tuberculosis
PDGSPCPCGG

SEQ ID NO: 1425767 - protein, 19 aa, Mycobacterium tuberculosis
PDNRLAEKGWTTHKNTHGH

SEQ ID NO: 1425768 - protein, 5 aa, Mycobacterium tuberculosis
PEAQD

SEQ ID NO: 1425769 - protein, 6 aa, Mycobacterium tuberculosis
PEARAT

SEQ ID NO: 1425770 - protein, 7 aa, Mycobacterium tuberculosis
PEHPYPA

SEQ ID NO: 1425771 - protein, 4 aa, Mycobacterium tuberculosis
PEPW

SEQ ID NO: 1425772 - protein, 12 aa, Mycobacterium tuberculosis
PEVAANRAGRQA

SEQ ID NO: 1425773 - protein, 10 aa, Mycobacterium tuberculosis
PGARNAAPLQ

SEQ ID NO: 1425774 - protein, 4 aa, Mycobacterium tuberculosis
PGDA

SEQ ID NO: 1425775 - protein, 10 aa, Mycobacterium tuberculosis
PGGQYRKREQ

SEQ ID NO: 1425776 - protein, 16 aa, Mycobacterium tuberculosis
PGNFTEPLSGHPPDGG

SEQ ID NO: 1425777 - protein, 6 aa, Mycobacterium tuberculosis
PGSGPI

SEQ ID NO: 1425778 - protein, 7 aa, Mycobacterium tuberculosis
PHAPADR

SEQ ID NO: 1425779 - protein, 7 aa, Mycobacterium tuberculosis
PHTPLNE

SEQ ID NO: 1425780 - protein, 6 aa, Mycobacterium tuberculosis
PIASES

SEQ ID NO: 1425781 - protein, 5 aa, Mycobacterium tuberculosis
PITAL

SEQ ID NO: 1425782 - protein, 8 aa, Mycobacterium tuberculosis
PLCTPSRG

SEQ ID NO: 1425783 - protein, 8 aa, Mycobacterium tuberculosis
PLEPTNDA

SEQ ID NO: 1425784 - protein, 4 aa, Mycobacterium tuberculosis
PLGP

SEQ ID NO: 1425785 - protein, 5 aa, Mycobacterium tuberculosis
PLPTT

SEQ ID NO: 1425786 - protein, 8 aa, Mycobacterium tuberculosis
PPNSSWPN

SEQ ID NO: 1425787 - protein, 4 aa, Mycobacterium tuberculosis
PPPV

SEQ ID NO: 1425788 - protein, 5 aa, Mycobacterium tuberculosis
PPSLL

SEQ ID NO: 1425789 - protein, 12 aa, Mycobacterium tuberculosis
PPTGHPLIPLGQ

SEQ ID NO: 1425790 - protein, 54 aa, Mycobacterium tuberculosis; identical to SEQ ID NO: 155741

SEQ ID NO: 1425791 - protein, 8 aa, Mycobacterium tuberculosis
PRGRGPSL

SEQ ID NO: 1425792 - protein, 8 aa, Mycobacterium tuberculosis
PRRRTDRR

SEQ ID NO: 1425793 - protein, 7 aa, Mycobacterium tuberculosis
PRSGGLR

SEQ ID NO: 1425794 - protein, 5 aa, Mycobacterium tuberculosis
PSGDD

SEQ ID NO: 1425795 - protein, 6 aa, Mycobacterium tuberculosis
PSGPAR

SEQ ID NO: 1425796 - protein, 9 aa, Mycobacterium tuberculosis
PSNAERGTK

SEQ ID NO: 1425797 - protein, 4 aa, Mycobacterium tuberculosis
PSQP

SEQ ID NO: 1425798 - protein, 6 aa, Mycobacterium tuberculosis
PSYPAS

SEQ ID NO: 1425799 - protein, 14 aa, Mycobacterium tuberculosis
PTADGPLPKSRSPV

SEQ ID NO: 1425800 - protein, 17 aa, Mycobacterium tuberculosis
PTDFRTAPDAGRRARAR

SEQ ID NO: 1425801 - protein, 5 aa, Mycobacterium tuberculosis
PVQPL

SEQ ID NO: 1425802 - protein, 5 aa, Mycobacterium tuberculosis
PWTTT

SEQ ID NO: 1425803 - protein, 5 aa, Mycobacterium tuberculosis
PYRAP

SEQ ID NO: 1425804 - protein, 7 aa, Mycobacterium tuberculosis
QAEQQAM

SEQ ID NO: 1425805 - protein, 9 aa, Mycobacterium tuberculosis
QAEQTAAQA

SEQ ID NO: 1425806 - protein, 8 aa, Mycobacterium tuberculosis
QAPDAPDW

SEQ ID NO: 1425807 - protein, 9 aa, Mycobacterium tuberculosis
QARQQDQER

SEQ ID NO: 1425808 - protein, 6 aa, Mycobacterium tuberculosis
QASERR

SEQ ID NO: 1425809 - protein, 6 aa, Mycobacterium tuberculosis
QDLTGK

SEQ ID NO: 1425810 - protein, 9 aa, Mycobacterium tuberculosis
QEDHAELGD

SEQ ID NO: 1425811 - protein, 5 aa, Mycobacterium tuberculosis
QEERG

SEQ ID NO: 1425812 - protein, 5 aa, Mycobacterium tuberculosis
QGGAT

SEQ ID NO: 1425813 - protein, 6 aa, Mycobacterium tuberculosis
QGSDAV

SEQ ID NO: 1425814 - protein, 8 aa, Mycobacterium tuberculosis
QIPVPPGW

SEQ ID NO: 1425815 - protein, 5 aa, Mycobacterium tuberculosis
QIRAS

SEQ ID NO: 1425816 - protein, 9 aa, Mycobacterium tuberculosis
QKSPPPPDV

SEQ ID NO: 1425817 - protein, 6 aa, Mycobacterium tuberculosis
QPLAAQ

SEQ ID NO: 1425818 - protein, 5 aa, Mycobacterium tuberculosis
QQNGF

SEQ ID NO: 1425819 - protein, 5 aa, Mycobacterium tuberculosis
QQRTL

SEQ ID NO: 1425820 - protein, 11 aa, Mycobacterium tuberculosis
QRPRARAVPRH

SEQ ID NO: 1425821 - protein, 4 aa, Mycobacterium tuberculosis
QSEV

SEQ ID NO: 1425822 - protein, 12 aa, Mycobacterium tuberculosis
QSFRRTAGAQFD

SEQ ID NO: 1425823 - protein, 14 aa, Mycobacterium tuberculosis
QSWKAPKPRDDAAA

SEQ ID NO: 1425824 - protein, 4 aa, Mycobacterium tuberculosis
QSYG

SEQ ID NO: 1425825 - protein, 4 aa, Mycobacterium tuberculosis
QTVG

SEQ ID NO: 1425826 - protein, 11 aa, Mycobacterium tuberculosis
QVPGSGGIRGP

SEQ ID NO: 1425827 - protein, 13 aa, Mycobacterium tuberculosis
QVTPGRNRHPGTM

SEQ ID NO: 1425828 - protein, 8 aa, Mycobacterium tuberculosis
QYKSYRGM

SEQ ID NO: 1425829 - protein, 10 aa, Mycobacterium tuberculosis
QYQSYGDTNV

SEQ ID NO: 1425830 - protein, 8 aa, Mycobacterium tuberculosis
RAAGRRAH

SEQ ID NO: 1425831 - protein, 13 aa, Mycobacterium tuberculosis
RAASASAAGPTTG

SEQ ID NO: 1425832 - protein, 4 aa, Mycobacterium tuberculosis
RADE

SEQ ID NO: 1425833 - protein, 17 aa, Mycobacterium tuberculosis
RAELADRERRAAEADRA

SEQ ID NO: 1425834 - protein, 9 aa, Mycobacterium tuberculosis
RAEVEQASD

SEQ ID NO: 1425835 - protein, 6 aa, Mycobacterium tuberculosis
RANEYA

SEQ ID NO: 1425836 - protein, 8 aa, Mycobacterium tuberculosis
RANNPSGH

SEQ ID NO: 1425837 - protein, 9 aa, Mycobacterium tuberculosis
RATDTVAGI

SEQ ID NO: 1425838 - protein, 8 aa, Mycobacterium tuberculosis
RDGEWTTN

SEQ ID NO: 1425839 - protein, 10 aa, Mycobacterium tuberculosis
RDLPTAVSRA

SEQ ID NO: 1425840 - protein, 4 aa, Mycobacterium tuberculosis
RDNG

SEQ ID NO: 1425841 - protein, 11 aa, Mycobacterium tuberculosis
REGEDEDLERA

SEQ ID NO: 1425842 - protein, 8 aa, Mycobacterium tuberculosis
REGGHSRR

SEQ ID NO: 1425843 - protein, 10 aa, Mycobacterium tuberculosis
RELTSTSNCT

SEQ ID NO: 1425844 - protein, 5 aa, Mycobacterium tuberculosis
REPRV

SEQ ID NO: 1425845 - protein, 12 aa, Mycobacterium tuberculosis
RGDPNGAAAGDL

SEQ ID NO: 1425846 - protein, 6 aa, Mycobacterium tuberculosis
RGVKQE

SEQ ID NO: 1425847 - protein, 4 aa, Mycobacterium tuberculosis
RGVP

SEQ ID NO: 1425848 - protein, 6 aa, Mycobacterium tuberculosis
RHPGDL

SEQ ID NO: 1425849 - protein, 6 aa, Mycobacterium tuberculosis
RHTGSL

SEQ ID NO: 1425850 - protein, 11 aa, Mycobacterium tuberculosis
RIPADADQHER

SEQ ID NO: 1425851 - protein, 7 aa, Mycobacterium tuberculosis
RKYTAPA

SEQ ID NO: 1425852 - protein, 9 aa, Mycobacterium tuberculosis
RLTDGHGRT

SEQ ID NO: 1425853 - protein, 9 aa, Mycobacterium tuberculosis
RLTGGDTIR

SEQ ID NO: 1425854 - protein, 4 aa, Mycobacterium tuberculosis
RNPG

SEQ ID NO: 1425855 - protein, 9 aa, Mycobacterium tuberculosis
RNPSSPVSL

SEQ ID NO: 1425856 - protein, 10 aa, Mycobacterium tuberculosis
RPADTGPATI

SEQ ID NO: 1425857 - protein, 10 aa, Mycobacterium tuberculosis
RPDPVEPTQA

SEQ ID NO: 1425858 - protein, 12 aa, Mycobacterium tuberculosis
RPEGNANPEIAT

SEQ ID NO: 1425859 - protein, 10 aa, Mycobacterium tuberculosis
RPEIESAPTF

SEQ ID NO: 1425860 - protein, 10 aa, Mycobacterium tuberculosis
RPKTPPPADA

SEQ ID NO: 1425861 - protein, 10 aa, Mycobacterium tuberculosis
RPNTGKSTLT

SEQ ID NO: 1425862 - protein, 11 aa, Mycobacterium tuberculosis
RPVSGPHGKAA

SEQ ID NO: 1425863 - protein, 25 aa, Mycobacterium tuberculosis
RQPIRPSGRAPAAVTSTAKSPRLRQ

SEQ ID NO: 1425864 - protein, 26 aa, Mycobacterium tuberculosis
RQPIRPSGRAPAAVTSTAKSPRLRQA

SEQ ID NO: 1425865 - protein, 9 aa, Mycobacterium tuberculosis
RRNGYRDNG

SEQ ID NO: 1425866 - protein, 7 aa, Mycobacterium tuberculosis
RRTHERA

SEQ ID NO: 1425867 - protein, 13 aa, Mycobacterium tuberculosis
RSAPDNSQVRSGD

SEQ ID NO: 1425868 - protein, 14 aa, Mycobacterium tuberculosis
RSAPDNSQVRSGDR

SEQ ID NO: 1425869 - protein, 5 aa, Mycobacterium tuberculosis
RSEAF

SEQ ID NO: 1425870 - protein, 7 aa, Mycobacterium tuberculosis
RSGNRQL

SEQ ID NO: 1425871 - protein, 9 aa, Mycobacterium tuberculosis
RSHDGQLAT

SEQ ID NO: 1425872 - protein, 8 aa, Mycobacterium tuberculosis
RSHPEELE

SEQ ID NO: 1425873 - protein, 7 aa, Mycobacterium tuberculosis
RSQGSTV

SEQ ID NO: 1425874 - protein, 4 aa, Mycobacterium tuberculosis
RSRE

SEQ ID NO: 1425875 - protein, 8 aa, Mycobacterium tuberculosis
RSTDPDGR

SEQ ID NO: 1425876 - protein, 16 aa, Mycobacterium tuberculosis
RSTSEQVHADLGVTPL

SEQ ID NO: 1425877 - protein, 4 aa, Mycobacterium tuberculosis
RSWT

SEQ ID NO: 1425878 - protein, 9 aa, Mycobacterium tuberculosis
RTASASTTD

SEQ ID NO: 1425879 - protein, 8 aa, Mycobacterium tuberculosis
RTGGGAEL

SEQ ID NO: 1425880 - protein, 10 aa, Mycobacterium tuberculosis
RTPPYPTATS

SEQ ID NO: 1425881 - protein, 10 aa, Mycobacterium tuberculosis
RVETNSEPRM

SEQ ID NO: 1425882 - protein, 7 aa, Mycobacterium tuberculosis
RVPGDDT

SEQ ID NO: 1425883 - protein, 5 aa, Mycobacterium tuberculosis
RVTAD

SEQ ID NO: 1425884 - protein, 7 aa, Mycobacterium tuberculosis
RYPQSNG

SEQ ID NO: 1425885 - protein, 30 aa, Mycobacterium tuberculosis
SAAAAADPGPGDAPTSASRISGHIRAALAA

SEQ ID NO: 1425886 - protein, 10 aa, Mycobacterium tuberculosis
SAQSRDALTD

SEQ ID NO: 1425887 - protein, 11 aa, Mycobacterium tuberculosis
SARESHGGEGR

SEQ ID NO: 1425888 - protein, 9 aa, Mycobacterium tuberculosis
SARSYRGTI

SEQ ID NO: 1425889 - protein, 4 aa, Mycobacterium tuberculosis
SDDM

SEQ ID NO: 1425890 - protein, 8 aa, Mycobacterium tuberculosis
SDEAPKVP

SEQ ID NO: 1425891 - protein, 15 aa, Mycobacterium tuberculosis
SDPLDGATPSGASSI

SEQ ID NO: 1425892 - protein, 10 aa, Mycobacterium tuberculosis
SDSLNDKELR

SEQ ID NO: 1425893 - protein, 15 aa, Mycobacterium tuberculosis
SELAPVSEGGEDTGV

SEQ ID NO: 1425894 - protein, 5 aa, Mycobacterium tuberculosis
SEPHD

SEQ ID NO: 1425895 - protein, 16 aa, Mycobacterium tuberculosis
SFAPPAPAATTQRHGS

SEQ ID NO: 1425896 - protein, 14 aa, Mycobacterium tuberculosis
SGDGNTGFGNAGNI

SEQ ID NO: 1425897 - protein, 7 aa, Mycobacterium tuberculosis
SGDIATA

SEQ ID NO: 1425898 - protein, 7 aa, Mycobacterium tuberculosis
SGEGRYV

SEQ ID NO: 1425899 - protein, 8 aa, Mycobacterium tuberculosis
SGFGGGGH

SEQ ID NO: 1425900 - protein, 31 aa, Mycobacterium tuberculosis; identical to SEQ ID NO: 187388

SEQ ID NO: 1425901 - protein, 8 aa, Mycobacterium tuberculosis
SGGNHGTL

SEQ ID NO: 1425902 - protein, 4 aa, Mycobacterium tuberculosis
SGIR

SEQ ID NO: 1425903 - protein, 9 aa, Mycobacterium tuberculosis
SGTSDPDRG

SEQ ID NO: 1425904 - protein, 8 aa, Mycobacterium tuberculosis
SGTSPDGH

SEQ ID NO: 1425905 - protein, 4 aa, Mycobacterium tuberculosis
SHDL

SEQ ID NO: 1425906 - protein, 6 aa, Mycobacterium tuberculosis
SIPATA

SEQ ID NO: 1425907 - protein, 7 aa, Mycobacterium tuberculosis
SISASRR

SEQ ID NO: 1425908 - protein, 19 aa, Mycobacterium tuberculosis
SKTGRPWNSTPEDSNYDPC

SEQ ID NO: 1425909 - protein, 10 aa, Mycobacterium tuberculosis
SLPEEAKSMA

SEQ ID NO: 1425910 - protein, 10 aa, Mycobacterium tuberculosis
SLTEPGRSSA

SEQ ID NO: 1425911 - protein, 17 aa, Mycobacterium tuberculosis
SMRTNSNQLRSYVAWTP

SEQ ID NO: 1425912 - protein, 6 aa, Mycobacterium tuberculosis
SNVDTD

SEQ ID NO: 1425913 - protein, 6 aa, Mycobacterium tuberculosis
SPEFQR

SEQ ID NO: 1425914 - protein, 9 aa, Mycobacterium tuberculosis
SPGTGRPAV

SEQ ID NO: 1425915 - protein, 11 aa, Mycobacterium tuberculosis
SPHGVSAGGSR

SEQ ID NO: 1425916 - protein, 8 aa, Mycobacterium tuberculosis
SPLSGNPG

SEQ ID NO: 1425917 - protein, 6 aa, Mycobacterium tuberculosis
SPYQNI

SEQ ID NO: 1425918 - protein, 4 aa, Mycobacterium tuberculosis
SQAA

SEQ ID NO: 1425919 - protein, 7 aa, Mycobacterium tuberculosis
SQRNSHD

SEQ ID NO: 1425920 - protein, 7 aa, Mycobacterium tuberculosis
SRQTRDR

SEQ ID NO: 1425921 - protein, 11 aa, Mycobacterium tuberculosis
SRSRASDDPEF

SEQ ID NO: 1425922 - protein, 9 aa, Mycobacterium tuberculosis
SRSSPRAGD

SEQ ID NO: 1425923 - protein, 18 aa, Mycobacterium tuberculosis
SSDPAAGSGVEPSTPGLR

SEQ ID NO: 1425924 - protein, 19 aa, Mycobacterium tuberculosis
SSFGSVTSGLAGQSWQGAA

SEQ ID NO: 1425925 - protein, 14 aa, Mycobacterium tuberculosis
SSQAQLDDDPHRSA

SEQ ID NO: 1425926 - protein, 13 aa, Mycobacterium tuberculosis
SSRFRKPLNPQKF

SEQ ID NO: 1425927 - protein, 6 aa, Mycobacterium tuberculosis
SSSGRL

SEQ ID NO: 1425928 - protein, 21 aa, Mycobacterium tuberculosis
SSSRSRTPLRPPVAPSEGVAA

SEQ ID NO: 1425929 - protein, 4 aa, Mycobacterium tuberculosis
SSTV

SEQ ID NO: 1425930 - protein, 4 aa, Mycobacterium tuberculosis
SVPG

SEQ ID NO: 1425931 - protein, 6 aa, Mycobacterium tuberculosis
TADTHA

SEQ ID NO: 1425932 - protein, 5 aa, Mycobacterium tuberculosis
TAGTE

SEQ ID NO: 1425933 - protein, 6 aa, Mycobacterium tuberculosis
TALTQS

SEQ ID NO: 1425934 - protein, 7 aa, Mycobacterium tuberculosis
TAPETVT

SEQ ID NO: 1425935 - protein, 9 aa, Mycobacterium tuberculosis
TARKKPPFG

SEQ ID NO: 1425936 - protein, 4 aa, Mycobacterium tuberculosis
TAVS

SEQ ID NO: 1425937 - protein, 14 aa, Mycobacterium tuberculosis
TDFSGSDRGGYRDL

SEQ ID NO: 1425938 - protein, 5 aa, Mycobacterium tuberculosis
TDRAA

SEQ ID NO: 1425939 - protein, 26 aa, Mycobacterium tuberculosis
TELSRRGGQNVYSPAAETTVTAVASY

SEQ ID NO: 1425940 - protein, 4 aa, Mycobacterium tuberculosis
TEQA

SEQ ID NO: 1425941 - protein, 4 aa, Mycobacterium tuberculosis
TERP

SEQ ID NO: 1425942 - protein, 6 aa, Mycobacterium tuberculosis
TFTAPA

SEQ ID NO: 1425943 - protein, 8 aa, Mycobacterium tuberculosis
TGCSPDAA

SEQ ID NO: 1425944 - protein, 72 aa, Mycobacterium tuberculosis; identical to SEQ ID NO: 189381

SEQ ID NO: 1425945 - protein, 22 aa, Mycobacterium tuberculosis
TGKSGSATLRPRSDINPDGPTT

SEQ ID NO: 1425946 - protein, 10 aa, Mycobacterium tuberculosis
TGPDSPNKTL

SEQ ID NO: 1425947 - protein, 5 aa, Mycobacterium tuberculosis
TGPTV

SEQ ID NO: 1425948 - protein, 12 aa, Mycobacterium tuberculosis
TGQTTGYAPPGT

SEQ ID NO: 1425949 - protein, 7 aa, Mycobacterium tuberculosis
THDETSR

SEQ ID NO: 1425950 - protein, 7 aa, Mycobacterium tuberculosis
TIRGTQT

SEQ ID NO: 1425951 - protein, 9 aa, Mycobacterium tuberculosis
TLDPDGSHT

SEQ ID NO: 1425952 - protein, 4 aa, Mycobacterium tuberculosis
TPDR

SEQ ID NO: 1425953 - protein, 4 aa, Mycobacterium tuberculosis
TPEI

SEQ ID NO: 1425954 - protein, 7 aa, Mycobacterium tuberculosis
TPEQRHR

SEQ ID NO: 1425955 - protein, 7 aa, Mycobacterium tuberculosis
TPQERAD

SEQ ID NO: 1425956 - protein, 6 aa, Mycobacterium tuberculosis
TPSAAD

SEQ ID NO: 1425957 - protein, 6 aa, Mycobacterium tuberculosis
TPSPPV

SEQ ID NO: 1425958 - protein, 8 aa, Mycobacterium tuberculosis
TPTGRNSW

SEQ ID NO: 1425959 - protein, 9 aa, Mycobacterium tuberculosis
TPVGVAGSS

SEQ ID NO: 1425960 - protein, 4 aa, Mycobacterium tuberculosis
TPVP

SEQ ID NO: 1425961 - protein, 10 aa, Mycobacterium tuberculosis
TQINGVARDD

SEQ ID NO: 1425962 - protein, 6 aa, Mycobacterium tuberculosis
TQLPTG

SEQ ID NO: 1425963 - protein, 5 aa, Mycobacterium tuberculosis
TQSRV

SEQ ID NO: 1425964 - protein, 5 aa, Mycobacterium tuberculosis
TRDAV

SEQ ID NO: 1425965 - protein, 6 aa, Mycobacterium tuberculosis
TRFQPT

SEQ ID NO: 1425966 - protein, 16 aa, Mycobacterium tuberculosis
TRPRPPQGNQPPASRI

SEQ ID NO: 1425967 - protein, 7 aa, Mycobacterium tuberculosis
TSGDSGD

SEQ ID NO: 1425968 - protein, 28 aa, Mycobacterium tuberculosis
TSGLSGGTSTNTNSSTPSSRAHRHHQPE

SEQ ID NO: 1425969 - protein, 10 aa, Mycobacterium tuberculosis
TSNYREDSDT

SEQ ID NO: 1425970 - protein, 8 aa, Mycobacterium tuberculosis
TSVAPTGT

SEQ ID NO: 1425971 - protein, 17 aa, Mycobacterium tuberculosis
TTASNSPVVTADPRLNT

SEQ ID NO: 1425972 - protein, 6 aa, Mycobacterium tuberculosis
TTQQAE

SEQ ID NO: 1425973 - protein, 7 aa, Mycobacterium tuberculosis
TVEQQAA

SEQ ID NO: 1425974 - protein, 9 aa, Mycobacterium tuberculosis
TVPGGLSAA

SEQ ID NO: 1425975 - protein, 7 aa, Mycobacterium tuberculosis
TYDPANK

SEQ ID NO: 1425976 - protein, 12 aa, Mycobacterium tuberculosis
VADSTDDTIEVD

SEQ ID NO: 1425977 - protein, 7 aa, Mycobacterium tuberculosis
VDDERDP

SEQ ID NO: 1425978 - protein, 6 aa, Mycobacterium tuberculosis
VDGGTE

SEQ ID NO: 1425979 - protein, 8 aa, Mycobacterium tuberculosis
VDTDGSEV

SEQ ID NO: 1425980 - protein, 17 aa, Mycobacterium tuberculosis
VEHRDRQQLAAQSGYSE

SEQ ID NO: 1425981 - protein, 10 aa, Mycobacterium tuberculosis
VETAQRRGEI

SEQ ID NO: 1425982 - protein, 6 aa, Mycobacterium tuberculosis
VGKSGR

SEQ ID NO: 1425983 - protein, 9 aa, Mycobacterium tuberculosis
VGVQPSGVE

SEQ ID NO: 1425984 - protein, 16 aa, Mycobacterium tuberculosis
VPDETGLGADAARARE

SEQ ID NO: 1425985 - protein, 8 aa, Mycobacterium tuberculosis
VPPGPGQI

SEQ ID NO: 1425986 - protein, 6 aa, Mycobacterium tuberculosis
VPPSWA

SEQ ID NO: 1425987 - protein, 15 aa, Mycobacterium tuberculosis
VPPTAPAEPQPTSEI

SEQ ID NO: 1425988 - protein, 14 aa, Mycobacterium tuberculosis
VPRADDADSDVPRY

SEQ ID NO: 1425989 - protein, 8 aa, Mycobacterium tuberculosis
VQPGASQN

SEQ ID NO: 1425990 - protein, 9 aa, Mycobacterium tuberculosis
VRAGASAND

SEQ ID NO: 1425991 - protein, 25 aa, Mycobacterium tuberculosis
VRPGHGPIPTGRKPRGANDRAPLPK

SEQ ID NO: 1425992 - protein, 21 aa, Mycobacterium tuberculosis
VSAEGGAAAVTGDDDSLDEHA

SEQ ID NO: 1425993 - protein, 5 aa, Mycobacterium tuberculosis
VSPSF

SEQ ID NO: 1425994 - protein, 11 aa, Mycobacterium tuberculosis
VSPTETVSGPM

SEQ ID NO: 1425995 - protein, 5 aa, Mycobacterium tuberculosis
VSQDI

SEQ ID NO: 1425996 - protein, 10 aa, Mycobacterium tuberculosis
VTDGVADGEA

SEQ ID NO: 1425997 - protein, 5 aa, Mycobacterium tuberculosis
VTGGH

SEQ ID NO: 1425998 - protein, 13 aa, Mycobacterium tuberculosis
VTGPADPAQQQCT

SEQ ID NO: 1425999 - protein, 6 aa, Mycobacterium tuberculosis
VTRPGG

SEQ ID NO: 1426000 - protein, 14 aa, Mycobacterium tuberculosis
VTWTETRTGSYGQS

SEQ ID NO: 1426001 - protein, 8 aa, Mycobacterium tuberculosis
WADDRPGA

SEQ ID NO: 1426002 - protein, 8 aa, Mycobacterium tuberculosis
WRNDDGGE

SEQ ID NO: 1426003 - protein, 7 aa, Mycobacterium tuberculosis
WTGSGAD

SEQ ID NO: 1426004 - protein, 22 aa, Mycobacterium tuberculosis
WTGSGQRRWRRSPPTGRYRSNS

SEQ ID NO: 1426005 - protein, 252 aa, Mycobacterium tuberculosis
YARPQEDPRGGPDPQGGSDPRGGYPPETGGYPPQPGYPRPRHPDQGDYPEQIGYPDQGGYPEQRGYPDQRGYQDQGRGYPDQGQGGYPPPYEQRPPVSPGPAAGYGAPGYDQGYRQSGGYGPSPGGGQPGYGGYGEYGRGPARHEEGSYVPSGPPGPPEQRPAYPDQGGYDQGYQQGATTYGRQDYGGGADYTRYTESPRVPGYAPQGGGYAEPAGRDYDYGQSGAPDYGQPAPGGYSGYGQGGYGSAGTSV

SEQ ID NO: 1426006 - protein, 9 aa, Mycobacterium tuberculosis
YEAGPTAAL

SEQ ID NO: 1426007 - protein, 15 aa, Mycobacterium tuberculosis
YERRPANAPAVQGQP

SEQ ID NO: 1426008 - protein, 7 aa, Mycobacterium tuberculosis
YGLTGST

SEQ ID NO: 1426009 - protein, 13 aa, Mycobacterium tuberculosis
YGSRSTPVSGGAA

SEQ ID NO: 1426010 - protein, 6 aa, Mycobacterium tuberculosis
YGTTAE

SEQ ID NO: 1426011 - protein, 9 aa, Mycobacterium tuberculosis
YHGDQDVAP

SEQ ID NO: 1426012 - protein, 4 aa, Mycobacterium tuberculosis
YITS

SEQ ID NO: 1426013 - protein, 7 aa, Mycobacterium tuberculosis
YKSYRGM

SEQ ID NO: 1426014 - protein, 4 aa, Mycobacterium tuberculosis
YPAD

SEQ ID NO: 1426015 - protein, 24 aa, Mycobacterium tuberculosis
YPGNDPLRDARPIEQDDDQGAGSP

SEQ ID NO: 1426016 - protein, 6 aa, Mycobacterium tuberculosis
YRAQPD

SEQ ID NO: 1426017 - protein, 6 aa, Mycobacterium tuberculosis
YSRGPQ

SEQ ID NO: 1426018 - protein, 8 aa, Mycobacterium tuberculosis
YSSPPRFP

SEQ ID NO: 1426019 - protein, 7 aa, Mycobacterium tuberculosis
AAAQGIP

SEQ ID NO: 1426020 - protein, 9 aa, Mycobacterium tuberculosis
AAAYPDERY

SEQ ID NO: 1426021 - protein, 7 aa, Mycobacterium tuberculosis
AAELGDT

SEQ ID NO: 1426022 - protein, 23 aa, Mycobacterium tuberculosis
AAGNGDAVVQPSGAGIHEVDVKI

SEQ ID NO: 1426023 - protein, 11 aa, Mycobacterium tuberculosis
AAHGPNPVLPP

SEQ ID NO: 1426024 - protein, 12 aa, Mycobacterium tuberculosis
AAHGPNPVLPPG

SEQ ID NO: 1426025 - protein, 8 aa, Mycobacterium tuberculosis
AANREERR

SEQ ID NO: 1426026 - protein, 5 aa, Mycobacterium tuberculosis
AAPVI

SEQ ID NO: 1426027 - protein, 4 aa, Mycobacterium tuberculosis
AATA

SEQ ID NO: 1426028 - protein, 7 aa, Mycobacterium tuberculosis
AATGRAG

SEQ ID NO: 1426029 - protein, 6 aa, Mycobacterium tuberculosis
AATGVS

SEQ ID NO: 1426030 - protein, 18 aa, Mycobacterium tuberculosis
AAVGGTGPVSAGLGNAAT

SEQ ID NO: 1426031 - protein, 6 aa, Mycobacterium tuberculosis
ACSPNT

SEQ ID NO: 1426032 - protein, 8 aa, Mycobacterium tuberculosis
ADATTGTI

SEQ ID NO: 1426033 - protein, 6 aa, Mycobacterium tuberculosis
ADDPMR

SEQ ID NO: 1426034 - protein, 39 aa, Mycobacterium tuberculosis
ADGDAPIPADSGPPVGPEGLTPTQLASDANEERLREERA

SEQ ID NO: 1426035 - protein, 6 aa, Mycobacterium tuberculosis
ADPKLA

SEQ ID NO: 1426036 - protein, 8 aa, Mycobacterium tuberculosis
ADPSRSVG

SEQ ID NO: 1426037 - protein, 9 aa, Mycobacterium tuberculosis
ADRSEPGHW

SEQ ID NO: 1426038 - protein, 9 aa, Mycobacterium tuberculosis
ADTTADSLN

SEQ ID NO: 1426039 - protein, 8 aa, Mycobacterium tuberculosis
ADYSPAGV

SEQ ID NO: 1426040 - protein, 23 aa, Mycobacterium tuberculosis
AEEMTGRHATTATSFSITDQSCA

SEQ ID NO: 1426041 - protein, 5 aa, Mycobacterium tuberculosis
AEHAA

SEQ ID NO: 1426042 - protein, 16 aa, Mycobacterium tuberculosis
AELADRERRAAEADRA

SEQ ID NO: 1426043 - protein, 7 aa, Mycobacterium tuberculosis
AENSGFT

SEQ ID NO: 1426044 - protein, 9 aa, Mycobacterium tuberculosis
AEPATPAEL

SEQ ID NO: 1426045 - protein, 4 aa, Mycobacterium tuberculosis
AEPG

SEQ ID NO: 1426046 - protein, 6 aa, Mycobacterium tuberculosis
AESPDF

SEQ ID NO: 1426047 - protein, 9 aa, Mycobacterium tuberculosis
AGAGGNGGL

SEQ ID NO: 1426048 - protein, 10 aa, Mycobacterium tuberculosis
AGEGGRSSGV

SEQ ID NO: 1426049 - protein, 7 aa, Mycobacterium tuberculosis
AGFTDTK

SEQ ID NO: 1426050 - protein, 14 aa, Mycobacterium tuberculosis
AGGDGGTGGVGGHG

SEQ ID NO: 1426051 - protein, 76 aa, Mycobacterium tuberculosis; identical to SEQ ID NO: 193646

SEQ ID NO: 1426052 - protein, 4 aa, Mycobacterium tuberculosis
AGNL

SEQ ID NO: 1426053 - protein, 14 aa, Mycobacterium tuberculosis
AGRDQNVAHPPAST

SEQ ID NO: 1426054 - protein, 8 aa, Mycobacterium tuberculosis
AGSGGRRV

SEQ ID NO: 1426055 - protein, 7 aa, Mycobacterium tuberculosis
AHTPLDG

SEQ ID NO: 1426056 - protein, 6 aa, Mycobacterium tuberculosis
ALPDGT

SEQ ID NO: 1426057 - protein, 12 aa, Mycobacterium tuberculosis
ALPDGVSQATVG

SEQ ID NO: 1426058 - protein, 8 aa, Mycobacterium tuberculosis
AMQAGQGA

SEQ ID NO: 1426059 - protein, 5 aa, Mycobacterium tuberculosis
AMSSF

SEQ ID NO: 1426060 - protein, 6 aa, Mycobacterium tuberculosis
ANGKSV

SEQ ID NO: 1426061 - protein, 8 aa, Mycobacterium tuberculosis
ANPAIAND

SEQ ID NO: 1426062 - protein, 6 aa, Mycobacterium tuberculosis
APANDH

SEQ ID NO: 1426063 - protein, 6 aa, Mycobacterium tuberculosis
APARGQ

SEQ ID NO: 1426064 - protein, 7 aa, Mycobacterium tuberculosis
APDERTL

SEQ ID NO: 1426065 - protein, 13 aa, Mycobacterium tuberculosis
APDVEAGQIDPLS

SEQ ID NO: 1426066 - protein, 10 aa, Mycobacterium tuberculosis
APGDGERGTI

SEQ ID NO: 1426067 - protein, 6 aa, Mycobacterium tuberculosis
APGPGE

SEQ ID NO: 1426068 - protein, 5 aa, Mycobacterium tuberculosis
APLDE

SEQ ID NO: 1426069 - protein, 5 aa, Mycobacterium tuberculosis
APPGY

SEQ ID NO: 1426070 - protein, 6 aa, Mycobacterium tuberculosis
APQPGW

SEQ ID NO: 1426071 - protein, 8 aa, Mycobacterium tuberculosis
APTPADPA

SEQ ID NO: 1426072 - protein, 8 aa, Mycobacterium tuberculosis
APTTGGPY

SEQ ID NO: 1426073 - protein, 12 aa, Mycobacterium tuberculosis
AQAKTRSAAHTP

SEQ ID NO: 1426074 - protein, 9 aa, Mycobacterium tuberculosis
AQASEEELG

SEQ ID NO: 1426075 - protein, 115 aa, Mycobacterium tuberculosis
AQDRTGGTGTGQSRGAGGFGGVGQAGGKGWDGGPIGNGQVGEQHGAGQLGSTDGNPGVAGAAHGSGVSASHGSGATGAAGVADPGGSGAGVGSAAGNGTGAGSADAVGGAGTGRD

SEQ ID NO: 1426076 - protein, 4 aa, Mycobacterium tuberculosis
ARLE

SEQ ID NO: 1426077 - protein, 14 aa, Mycobacterium tuberculosis
ARPGTPPTRPVQGP

SEQ ID NO: 1426078 - protein, 5 aa, Mycobacterium tuberculosis
ARQLD

SEQ ID NO: 1426079 - protein, 6 aa, Mycobacterium tuberculosis
ARRADD

SEQ ID NO: 1426080 - protein, 9 aa, Mycobacterium tuberculosis
ARSTQHDAA

SEQ ID NO: 1426081 - protein, 6 aa, Mycobacterium tuberculosis
ASKYGL

SEQ ID NO: 1426082 - protein, 8 aa, Mycobacterium tuberculosis
ASLRDREK

SEQ ID NO: 1426083 - protein, 6 aa, Mycobacterium tuberculosis
ASPLAD

SEQ ID NO: 1426084 - protein, 4 aa, Mycobacterium tuberculosis
ATDA

SEQ ID NO: 1426085 - protein, 13 aa, Mycobacterium tuberculosis
ATGSITKIYLRAT

SEQ ID NO: 1426086 - protein, 9 aa, Mycobacterium tuberculosis
ATIANNREE

SEQ ID NO: 1426087 - protein, 10 aa, Mycobacterium tuberculosis
ATLDRPGRPL

SEQ ID NO: 1426088 - protein, 15 aa, Mycobacterium tuberculosis
ATPDQGFTRSQEACR

SEQ ID NO: 1426089 - protein, 15 aa, Mycobacterium tuberculosis
ATPQADGGAFYGPRG

SEQ ID NO: 1426090 - protein, 6 aa, Mycobacterium tuberculosis
ATSCGG

SEQ ID NO: 1426091 - protein, 14 aa, Mycobacterium tuberculosis
ATSTPHPAAPAGAG

SEQ ID NO: 1426092 - protein, 7 aa, Mycobacterium tuberculosis
ATTATPH

SEQ ID NO: 1426093 - protein, 39 aa, Mycobacterium tuberculosis
ATTQAQPSNPTPPLASATAAATTGAAAGDTSRRAAEQQR

SEQ ID NO: 1426094 - protein, 9 aa, Mycobacterium tuberculosis
ATVSPGATA

SEQ ID NO: 1426095 - protein, 23 aa, Mycobacterium tuberculosis
AVRESTGIEEQAGLTELSEEAGM

SEQ ID NO: 1426096 - protein, 14 aa, Mycobacterium tuberculosis
AVSAGKVTERERDR

SEQ ID NO: 1426097 - protein, 4 aa, Mycobacterium tuberculosis
AVTE

SEQ ID NO: 1426098 - protein, 22 aa, Mycobacterium tuberculosis
AVVSGGPDIRPALGDPADVAKT

SEQ ID NO: 1426099 - protein, 30 aa, Mycobacterium tuberculosis
AVVSGGPDIRPALGDPADVAKTLTAEARSG

SEQ ID NO: 1426100 - protein, 16 aa, Mycobacterium tuberculosis
AYAHSSYHRGVFAPAR

SEQ ID NO: 1426101 - protein, 14 aa, Mycobacterium tuberculosis
CARSPACPLGTDSA

SEQ ID NO: 1426102 - protein, 18 aa, Mycobacterium tuberculosis
CGGPGAQIAAEGAENAGP

SEQ ID NO: 1426103 - protein, 11 aa, Mycobacterium tuberculosis
CRGGGAVTSRD

SEQ ID NO: 1426104 - protein, 13 aa, Mycobacterium tuberculosis
DAAATFRRTERHR

SEQ ID NO: 1426105 - protein, 6 aa, Mycobacterium tuberculosis
DAAHPD

SEQ ID NO: 1426106 - protein, 6 aa, Mycobacterium tuberculosis
DADPRK

SEQ ID NO: 1426107 - protein, 8 aa, Mycobacterium tuberculosis
DARPDRLP

SEQ ID NO: 1426108 - protein, 7 aa, Mycobacterium tuberculosis
DATTLDG

SEQ ID NO: 1426109 - protein, 20 aa, Mycobacterium tuberculosis
DDAKEGPRAFAEKRAPNFQN

SEQ ID NO: 1426110 - protein, 9 aa, Mycobacterium tuberculosis
DDPSTEVPI

SEQ ID NO: 1426111 - protein, 6 aa, Mycobacterium tuberculosis
DDSRVT

SEQ ID NO: 1426112 - protein, 7 aa, Mycobacterium tuberculosis
DEIRDGA

SEQ ID NO: 1426113 - protein, 172 aa, Mycobacterium tuberculosis; identical to SEQ ID NO: 193855

SEQ ID NO: 1426114 - protein, 12 aa, Mycobacterium tuberculosis
DGGAGGQGGPAV

SEQ ID NO: 1426115 - protein, 60 aa, Mycobacterium tuberculosis; identical to SEQ ID NO: 171478

SEQ ID NO: 1426116 - protein, 8 aa, Mycobacterium tuberculosis
DKLPLGGG

SEQ ID NO: 1426117 - protein, 13 aa, Mycobacterium tuberculosis
DLQGRRAAGTGAR

SEQ ID NO: 1426118 - protein, 5 aa, Mycobacterium tuberculosis
DLRGP

SEQ ID NO: 1426119 - protein, 13 aa, Mycobacterium tuberculosis
DLRPGTALTPGDV

SEQ ID NO: 1426120 - protein, 7 aa, Mycobacterium tuberculosis
DLSGDAF

SEQ ID NO: 1426121 - protein, 6 aa, Mycobacterium tuberculosis
DLTSDG

SEQ ID NO: 1426122 - protein, 13 aa, Mycobacterium tuberculosis
DNYTGHVERGKAA

SEQ ID NO: 1426123 - protein, 11 aa, Mycobacterium tuberculosis
DPDPRQRFTTA

SEQ ID NO: 1426124 - protein, 18 aa, Mycobacterium tuberculosis
DPETGHDPTGSPQGAGTL

SEQ ID NO: 1426125 - protein, 4 aa, Mycobacterium tuberculosis
DPFH

SEQ ID NO: 1426126 - protein, 73 aa, Mycobacterium tuberculosis; identical to SEQ ID NO: 172057

SEQ ID NO: 1426127 - protein, 9 aa, Mycobacterium tuberculosis
DPPPAPEPL

SEQ ID NO: 1426128 - protein, 7 aa, Mycobacterium tuberculosis
DPPRHPI

SEQ ID NO: 1426129 - protein, 10 aa, Mycobacterium tuberculosis
DPPVTPEEPL

SEQ ID NO: 1426130 - protein, 4 aa, Mycobacterium tuberculosis
DPSM

SEQ ID NO: 1426131 - protein, 5 aa, Mycobacterium tuberculosis
DPTGA

SEQ ID NO: 1426132 - protein, 6 aa, Mycobacterium tuberculosis
DPTGAA

SEQ ID NO: 1426133 - protein, 16 aa, Mycobacterium tuberculosis
DPVDPVDPVDPVDPVD

SEQ ID NO: 1426134 - protein, 14 aa, Mycobacterium tuberculosis
DRANRGAEQRLAQR

SEQ ID NO: 1426135 - protein, 19 aa, Mycobacterium tuberculosis
DRRRRGERSGDGAEAELRE

SEQ ID NO: 1426136 - protein, 10 aa, Mycobacterium tuberculosis
DSLASSASLP

SEQ ID NO: 1426137 - protein, 14 aa, Mycobacterium tuberculosis
DSPRPRLPADHPGV

SEQ ID NO: 1426138 - protein, 11 aa, Mycobacterium tuberculosis
DTPPAPAPPPF

SEQ ID NO: 1426139 - protein, 5 aa, Mycobacterium tuberculosis
DVPGL

SEQ ID NO: 1426140 - protein, 16 aa, Mycobacterium tuberculosis
DYRAQESTRHGASRHG

SEQ ID NO: 1426141 - protein, 9 aa, Mycobacterium tuberculosis
EAAERRTGL

SEQ ID NO: 1426142 - protein, 4 aa, Mycobacterium tuberculosis
EAIQ

SEQ ID NO: 1426143 - protein, 9 aa, Mycobacterium tuberculosis
EAPAPLQNT

SEQ ID NO: 1426144 - protein, 9 aa, Mycobacterium tuberculosis
EDDAGDGAR

SEQ ID NO: 1426145 - protein, 4 aa, Mycobacterium tuberculosis
EEIA

SEQ ID NO: 1426146 - protein, 5 aa, Mycobacterium tuberculosis
EESLA

SEQ ID NO: 1426147 - protein, 4 aa, Mycobacterium tuberculosis
EGAA

SEQ ID NO: 1426148 - protein, 10 aa, Mycobacterium tuberculosis
EGTGTVASTD

SEQ ID NO: 1426149 - protein, 14 aa, Mycobacterium tuberculosis
EGTKKLSKRDPQSN

SEQ ID NO: 1426150 - protein, 9 aa, Mycobacterium tuberculosis
EIPNPLRGQ

SEQ ID NO: 1426151 - protein, 4 aa, Mycobacterium tuberculosis
EKTA

SEQ ID NO: 1426152 - protein, 6 aa, Mycobacterium tuberculosis
ELPTEP

SEQ ID NO: 1426153 - protein, 5 aa, Mycobacterium tuberculosis
ELTPS

SEQ ID NO: 1426154 - protein, 8 aa, Mycobacterium tuberculosis
EMRGATAP

SEQ ID NO: 1426155 - protein, 10 aa, Mycobacterium tuberculosis
ENWKGSSSDL

SEQ ID NO: 1426156 - protein, 25 aa, Mycobacterium tuberculosis
EPRPEPEPDFRPDPRPSITRSADEQ

SEQ ID NO: 1426157 - protein, 5 aa, Mycobacterium tuberculosis
EPTTS

SEQ ID NO: 1426158 - protein, 107 aa, Mycobacterium tuberculosis
EPVKRTATKSPAASASGAKTGAKRTAAKSASGSPPAKRATKPAARSVKPASAPQDTTTSTIPKRKTRAAAKSAAAKAPSARGHATKPRAPKDAQHEAATDPEDALDS

SEQ ID NO: 1426159 - protein, 18 aa, Mycobacterium tuberculosis
EQDTAHGGFGGAPKFPPS

SEQ ID NO: 1426160 - protein, 4 aa, Mycobacterium tuberculosis
EQIN

SEQ ID NO: 1426161 - protein, 4 aa, Mycobacterium tuberculosis
EQTY

SEQ ID NO: 1426162 - protein, 15 aa, Mycobacterium tuberculosis
ERHRREVENALAVLR

SEQ ID NO: 1426163 - protein, 9 aa, Mycobacterium tuberculosis
ESDGPTATI

SEQ ID NO: 1426164 - protein, 21 aa, Mycobacterium tuberculosis
ESERLPRGADPNTHTKLGRGG

SEQ ID NO: 1426165 - protein, 15 aa, Mycobacterium tuberculosis
ESTADRCAERLSGKK

SEQ ID NO: 1426166 - protein, 5 aa, Mycobacterium tuberculosis
ETSAG

SEQ ID NO: 1426167 - protein, 11 aa, Mycobacterium tuberculosis
ETTAESLEDEL

SEQ ID NO: 1426168 - protein, 20 aa, Mycobacterium tuberculosis
EVARGPDELPAGDAARRGRC

SEQ ID NO: 1426169 - protein, 4 aa, Mycobacterium tuberculosis
EVDD

SEQ ID NO: 1426170 - protein, 13 aa, Mycobacterium tuberculosis
EVEAENRARYGGR

SEQ ID NO: 1426171 - protein, 11 aa, Mycobacterium tuberculosis
EVTADTDAAMT

SEQ ID NO: 1426172 - protein, 5 aa, Mycobacterium tuberculosis
FAEPG

SEQ ID NO: 1426173 - protein, 15 aa, Mycobacterium tuberculosis
FAPPAPAATTQRHGS

SEQ ID NO: 1426174 - protein, 20 aa, Mycobacterium tuberculosis
FASGGTGGAGGTGGAGGRGG

SEQ ID NO: 1426175 - protein, 4 aa, Mycobacterium tuberculosis
FDPA

SEQ ID NO: 1426176 - protein, 45 aa, Mycobacterium tuberculosis
FDSPDPEAEPDVVGGKGGDGGKGGSGLGVGGAGGTGGAGGNGGAG

SEQ ID NO: 1426177 - protein, 10 aa, Mycobacterium tuberculosis
FEKPGRREGW

SEQ ID NO: 1426178 - protein, 6 aa, Mycobacterium tuberculosis
FGAYGQ

SEQ ID NO: 1426179 - protein, 36 aa, Mycobacterium tuberculosis
FGNGGTGGVGGKGGTSSDLASATSGAGGAGGAGGVG

SEQ ID NO: 1426180 - protein, 7 aa, Mycobacterium tuberculosis
FPTAPVS

SEQ ID NO: 1426181 - protein, 4 aa, Mycobacterium tuberculosis
FTPG

SEQ ID NO: 1426182 - protein, 4 aa, Mycobacterium tuberculosis
GAAD

SEQ ID NO: 1426183 - protein, 5 aa, Mycobacterium tuberculosis
GAAPH

SEQ ID NO: 1426184 - protein, 5 aa, Mycobacterium tuberculosis
GAATD

SEQ ID NO: 1426185 - protein, 33 aa, Mycobacterium tuberculosis; identical to SEQ ID NO: 174666

SEQ ID NO: 1426186 - protein, 23 aa, Mycobacterium tuberculosis
GAGGVGGSSEDVGGTGGAGGAGR

SEQ ID NO: 1426187 - protein, 10 aa, Mycobacterium tuberculosis
GALDSSSSAL

SEQ ID NO: 1426188 - protein, 5 aa, Mycobacterium tuberculosis
GAPDE

SEQ ID NO: 1426189 - protein, 6 aa, Mycobacterium tuberculosis
GAPDSV

SEQ ID NO: 1426190 - protein, 5 aa, Mycobacterium tuberculosis
GARIS

SEQ ID NO: 1426191 - protein, 4 aa, Mycobacterium tuberculosis
GASV

SEQ ID NO: 1426192 - protein, 4 aa, Mycobacterium tuberculosis
GATQ

SEQ ID NO: 1426193 - protein, 14 aa, Mycobacterium tuberculosis
GAYASAEAANAGPN

SEQ ID NO: 1426194 - protein, 32 aa, Mycobacterium tuberculosis; identical to SEQ ID NO: 174975

SEQ ID NO: 1426195 - protein, 10 aa, Mycobacterium tuberculosis
GDTDDNAAGA

SEQ ID NO: 1426196 - protein, 4 aa, Mycobacterium tuberculosis
GDVE

SEQ ID NO: 1426197 - protein, 36 aa, Mycobacterium tuberculosis
GDVNTGGFNPGSYNTGNFNTGNYNTGSFNAGNYNTG

SEQ ID NO: 1426198 - protein, 5 aa, Mycobacterium tuberculosis
GDVRV

SEQ ID NO: 1426199 - protein, 10 aa, Mycobacterium tuberculosis
GEGDDAEARI

SEQ ID NO: 1426200 - protein, 9 aa, Mycobacterium tuberculosis
GEGVTGHQV

SEQ ID NO: 1426201 - protein, 5 aa, Mycobacterium tuberculosis
GEPIG

SEQ ID NO: 1426202 - protein, 9 aa, Mycobacterium tuberculosis
GESAKVSEL

SEQ ID NO: 1426203 - protein, 9 aa, Mycobacterium tuberculosis
GGAGGAGGI

SEQ ID NO: 1426204 - protein, 19 aa, Mycobacterium tuberculosis
GGAGGAGGSGGGSGGAGGN

SEQ ID NO: 1426205 - protein, 29 aa, Mycobacterium tuberculosis
GGAGGNGGVGVAGDPGGVGGAGGAGGAAG

SEQ ID NO: 1426206 - protein, 5 aa, Mycobacterium tuberculosis
GGALP

SEQ ID NO: 1426207 - protein, 10 aa, Mycobacterium tuberculosis
GGGYPAARAG

SEQ ID NO: 1426208 - protein, 11 aa, Mycobacterium tuberculosis
GGPGDSGAPVT

SEQ ID NO: 1426209 - protein, 8 aa, Mycobacterium tuberculosis
GGSIPETD

SEQ ID NO: 1426210 - protein, 5 aa, Mycobacterium tuberculosis
GGSLE

SEQ ID NO: 1426211 - protein, 30 aa, Mycobacterium tuberculosis
GGVGGRGGNGGFSSAGTSGGDGGIGGAGGI

SEQ ID NO: 1426212 - protein, 11 aa, Mycobacterium tuberculosis
GHAPAKEDEEV

SEQ ID NO: 1426213 - protein, 5 aa, Mycobacterium tuberculosis
GHDKA

SEQ ID NO: 1426214 - protein, 13 aa, Mycobacterium tuberculosis
GHPDPSSGTIDAP

SEQ ID NO: 1426215 - protein, 5 aa, Mycobacterium tuberculosis
GIERY

SEQ ID NO: 1426216 - protein, 29 aa, Mycobacterium tuberculosis
GIGGTGGTGLGAPDPGGTGGKGGVGGIGG

SEQ ID NO: 1426217 - protein, 5 aa, Mycobacterium tuberculosis
GITGA

SEQ ID NO: 1426218 - protein, 9 aa, Mycobacterium tuberculosis
GKKYESRQV

SEQ ID NO: 1426219 - protein, 5 aa, Mycobacterium tuberculosis
GKSTL

SEQ ID NO: 1426220 - protein, 8 aa, Mycobacterium tuberculosis
GMRRGDAV

SEQ ID NO: 1426221 - protein, 18 aa, Mycobacterium tuberculosis
GNGANGADGTGAPGGPGG

SEQ ID NO: 1426222 - protein, 26 aa, Mycobacterium tuberculosis
GNGGAGGAGGSATAGAAGAGGNGGAG

SEQ ID NO: 1426223 - protein, 22 aa, Mycobacterium tuberculosis
GNGGAGGSGAPGQAGEWDSDDR

SEQ ID NO: 1426224 - protein, 49 aa, Mycobacterium tuberculosis; identical to SEQ ID NO: 176411

SEQ ID NO: 1426225 - protein, 25 aa, Mycobacterium tuberculosis
GNIGTGNSGFNNSGDANSGFQNTNT

SEQ ID NO: 1426226 - protein, 4 aa, Mycobacterium tuberculosis
GPAQ

SEQ ID NO: 1426227 - protein, 8 aa, Mycobacterium tuberculosis
GPDPVARS

SEQ ID NO: 1426228 - protein, 8 aa, Mycobacterium tuberculosis
GPPPDEPN

SEQ ID NO: 1426229 - protein, 9 aa, Mycobacterium tuberculosis
GPSSATTGS

SEQ ID NO: 1426230 - protein, 10 aa, Mycobacterium tuberculosis
GQGGNGGAGG

SEQ ID NO: 1426231 - protein, 10 aa, Mycobacterium tuberculosis
GRAESAMESE

SEQ ID NO: 1426232 - protein, 17 aa, Mycobacterium tuberculosis
GSAVPSPNVSPTPRRRA

SEQ ID NO: 1426233 - protein, 6 aa, Mycobacterium tuberculosis
GSDEQF

SEQ ID NO: 1426234 - protein, 4 aa, Mycobacterium tuberculosis
GSGA

SEQ ID NO: 1426235 - protein, 31 aa, Mycobacterium tuberculosis
GSGGGGGDGGNGGQAPTPGNAGDGGAGGNAR

SEQ ID NO: 1426236 - protein, 8 aa, Mycobacterium tuberculosis
GSGNQGDI

SEQ ID NO: 1426237 - protein, 11 aa, Mycobacterium tuberculosis
GSHAPTRSARD

SEQ ID NO: 1426238 - protein, 29 aa, Mycobacterium tuberculosis
GSHGAGGAGGSGGDGGAPGDGGNGATGTW

SEQ ID NO: 1426239 - protein, 4 aa, Mycobacterium tuberculosis
GSRE

SEQ ID NO: 1426240 - protein, 8 aa, Mycobacterium tuberculosis
GSSPFAGK

SEQ ID NO: 1426241 - protein, 4 aa, Mycobacterium tuberculosis
GSTS

SEQ ID NO: 1426242 - protein, 17 aa, Mycobacterium tuberculosis
GSYNTGIGNSGTGSTGL

SEQ ID NO: 1426243 - protein, 9 aa, Mycobacterium tuberculosis
GTAPSPYGP

SEQ ID NO: 1426244 - protein, 16 aa, Mycobacterium tuberculosis
GTERPFTGEYTDTTTA

SEQ ID NO: 1426245 - protein, 5 aa, Mycobacterium tuberculosis
GVQRG

SEQ ID NO: 1426246 - protein, 4 aa, Mycobacterium tuberculosis
GWTG

SEQ ID NO: 1426247 - protein, 185 aa, Mycobacterium tuberculosis; identical to SEQ ID NO: 177882

SEQ ID NO: 1426248 - protein, 10 aa, Mycobacterium tuberculosis
HATGTQVGDL

SEQ ID NO: 1426249 - protein, 6 aa, Mycobacterium tuberculosis
HATTNR

SEQ ID NO: 1426250 - protein, 6 aa, Mycobacterium tuberculosis
HCPKDK

SEQ ID NO: 1426251 - protein, 24 aa, Mycobacterium tuberculosis
HDKPSPAPSAPTFTSQQISDAKEN

SEQ ID NO: 1426252 - protein, 17 aa, Mycobacterium tuberculosis
HEDVGADEVGGHQHPAD

SEQ ID NO: 1426253 - protein, 6 aa, Mycobacterium tuberculosis
HEHTGE

SEQ ID NO: 1426254 - protein, 13 aa, Mycobacterium tuberculosis
HGDAENLLSSGAD

SEQ ID NO: 1426255 - protein, 21 aa, Mycobacterium tuberculosis
HGGNGGVGALGANGGAGGTGG

SEQ ID NO: 1426256 - protein, 5 aa, Mycobacterium tuberculosis
HGLTP

SEQ ID NO: 1426257 - protein, 4 aa, Mycobacterium tuberculosis
HGQL

SEQ ID NO: 1426258 - protein, 4 aa, Mycobacterium tuberculosis
HGRA

SEQ ID NO: 1426259 - protein, 6 aa, Mycobacterium tuberculosis
HNHPSY

SEQ ID NO: 1426260 - protein, 5 aa, Mycobacterium tuberculosis
HPDGT

SEQ ID NO: 1426261 - protein, 9 aa, Mycobacterium tuberculosis
HPDHPSRSA

SEQ ID NO: 1426262 - protein, 4 aa, Mycobacterium tuberculosis
HPID

SEQ ID NO: 1426263 - protein, 6 aa, Mycobacterium tuberculosis
HPPRPC

SEQ ID NO: 1426264 - protein, 6 aa, Mycobacterium tuberculosis
HPQAQN

SEQ ID NO: 1426265 - protein, 8 aa, Mycobacterium tuberculosis
HRGREGGY

SEQ ID NO: 1426266 - protein, 5 aa, Mycobacterium tuberculosis
HRHRR

SEQ ID NO: 1426267 - protein, 7 aa, Mycobacterium tuberculosis
HRSAEGA

SEQ ID NO: 1426268 - protein, 23 aa, Mycobacterium tuberculosis
HTNTGGFNTGNVNTGAFNSGSFN

SEQ ID NO: 1426269 - protein, 10 aa, Mycobacterium tuberculosis
IAEPPAGVRG

SEQ ID NO: 1426270 - protein, 28 aa, Mycobacterium tuberculosis
IARTEPKWGRGRPGKNAAPRPGRERARR

SEQ ID NO: 1426271 - protein, 5 aa, Mycobacterium tuberculosis
IASAD

SEQ ID NO: 1426272 - protein, 4 aa, Mycobacterium tuberculosis
IATA

SEQ ID NO: 1426273 - protein, 4 aa, Mycobacterium tuberculosis
IDPR

SEQ ID NO: 1426274 - protein, 10 aa, Mycobacterium tuberculosis
IEARGESMSG

SEQ ID NO: 1426275 - protein, 8 aa, Mycobacterium tuberculosis
IEGPPGHR

SEQ ID NO: 1426276 - protein, 6 aa, Mycobacterium tuberculosis
IEGQKT

SEQ ID NO: 1426277 - protein, 5 aa, Mycobacterium tuberculosis
IETAC

SEQ ID NO: 1426278 - protein, 8 aa, Mycobacterium tuberculosis
IGESDAAH

SEQ ID NO: 1426279 - protein, 19 aa, Mycobacterium tuberculosis
IGNGGNGGAGGAGGDVSAD

SEQ ID NO: 1426280 - protein, 19 aa, Mycobacterium tuberculosis
IGNGGNGGGGGNGGTGADG

SEQ ID NO: 1426281 - protein, 7 aa, Mycobacterium tuberculosis
IGPDPSF

SEQ ID NO: 1426282 - protein, 4 aa, Mycobacterium tuberculosis
IGPE

SEQ ID NO: 1426283 - protein, 8 aa, Mycobacterium tuberculosis
IGTPIESG

SEQ ID NO: 1426284 - protein, 6 aa, Mycobacterium tuberculosis
IRSTDG

SEQ ID NO: 1426285 - protein, 11 aa, Mycobacterium tuberculosis
ISVGPSETVDA

SEQ ID NO: 1426286 - protein, 4 aa, Mycobacterium tuberculosis
ITGY

SEQ ID NO: 1426287 - protein, 4 aa, Mycobacterium tuberculosis
KALD

SEQ ID NO: 1426288 - protein, 9 aa, Mycobacterium tuberculosis
KDDGTEIRV

SEQ ID NO: 1426289 - protein, 4 aa, Mycobacterium tuberculosis
KDKV

SEQ ID NO: 1426290 - protein, 5 aa, Mycobacterium tuberculosis
KFTRD

SEQ ID NO: 1426291 - protein, 8 aa, Mycobacterium tuberculosis
KGGKLPRP

SEQ ID NO: 1426292 - protein, 16 aa, Mycobacterium tuberculosis
KPCLPGGEVPVGGGHQ

SEQ ID NO: 1426293 - protein, 5 aa, Mycobacterium tuberculosis
KPDDV

SEQ ID NO: 1426294 - protein, 8 aa, Mycobacterium tuberculosis
KRKGRIYS

SEQ ID NO: 1426295 - protein, 5 aa, Mycobacterium tuberculosis
KSGPL

SEQ ID NO: 1426296 - protein, 4 aa, Mycobacterium tuberculosis
KTAI

SEQ ID NO: 1426297 - protein, 10 aa, Mycobacterium tuberculosis
LAAAADGAAV

SEQ ID NO: 1426298 - protein, 7 aa, Mycobacterium tuberculosis
LAGAGSG

SEQ ID NO: 1426299 - protein, 11 aa, Mycobacterium tuberculosis
LAGGDAQLPHG

SEQ ID NO: 1426300 - protein, 22 aa, Mycobacterium tuberculosis
LAGTPSQAAIEADTRSAGQRHH

SEQ ID NO: 1426301 - protein, 19 aa, Mycobacterium tuberculosis
LANIGSSISAASAAAAGPT

SEQ ID NO: 1426302 - protein, 6 aa, Mycobacterium tuberculosis
LDDSRG

SEQ ID NO: 1426303 - protein, 6 aa, Mycobacterium tuberculosis
LENRNP

SEQ ID NO: 1426304 - protein, 6 aa, Mycobacterium tuberculosis
LETGDR

SEQ ID NO: 1426305 - protein, 12 aa, Mycobacterium tuberculosis
LGNAGELNTGFG

SEQ ID NO: 1426306 - protein, 9 aa, Mycobacterium tuberculosis
LGPNPNWDS

SEQ ID NO: 1426307 - protein, 15 aa, Mycobacterium tuberculosis
LGSATSSQLPSTSPS

SEQ ID NO: 1426308 - protein, 7 aa, Mycobacterium tuberculosis
LNPDQNS

SEQ ID NO: 1426309 - protein, 5 aa, Mycobacterium tuberculosis
LPAGD

SEQ ID NO: 1426310 - protein, 12 aa, Mycobacterium tuberculosis
LQGRRAAGTGAR

SEQ ID NO: 1426311 - protein, 5 aa, Mycobacterium tuberculosis
MAATA

SEQ ID NO: 1426312 - protein, 10 aa, Mycobacterium tuberculosis
MGPDTEPLQT

SEQ ID NO: 1426313 - protein, 12 aa, Mycobacterium tuberculosis
MPGAGGNGGNAN

SEQ ID NO: 1426314 - protein, 13 aa, Mycobacterium tuberculosis
MSAGAQGNSNVTN

SEQ ID NO: 1426315 - protein, 12 aa, Mycobacterium tuberculosis
MTAGQKKQVRAE

SEQ ID NO: 1426316 - protein, 9 aa, Mycobacterium tuberculosis
NAPAIAATE

SEQ ID NO: 1426317 - protein, 18 aa, Mycobacterium tuberculosis
NAQPDASGRTPAGAVGSV

SEQ ID NO: 1426318 - protein, 13 aa, Mycobacterium tuberculosis
NDPSLDADERHTA

SEQ ID NO: 1426319 - protein, 9 aa, Mycobacterium tuberculosis
NESLRQQAT

SEQ ID NO: 1426320 - protein, 64 aa, Mycobacterium tuberculosis; identical to SEQ ID NO: 192862

SEQ ID NO: 1426321 - protein, 15 aa, Mycobacterium tuberculosis
NGAAPPHRCALHRRR

SEQ ID NO: 1426322 - protein, 17 aa, Mycobacterium tuberculosis
NGANGAPGTGANGGDGG

SEQ ID NO: 1426323 - protein, 21 aa, Mycobacterium tuberculosis
NGGAGGAGGAGGIGAGGAGGF

SEQ ID NO: 1426324 - protein, 22 aa, Mycobacterium tuberculosis
NGGAGGSGAAGMPGGNGGAAGL

SEQ ID NO: 1426325 - protein, 57 aa, Mycobacterium tuberculosis
NGGDGGAGGVGGVGGAGAAGAIGGHGGDGGSVNTPIGGSEAGDGGKGGLGGDGGGRG

SEQ ID NO: 1426326 - protein, 37 aa, Mycobacterium tuberculosis
NGGNGGSGAPGQAGGAGGAAGLIGNGGAGGAGGQGLP

SEQ ID NO: 1426327 - protein, 8 aa, Mycobacterium tuberculosis
NGSIGEGG

SEQ ID NO: 1426328 - protein, 14 aa, Mycobacterium tuberculosis
NGVGGLGGQGGQGA

SEQ ID NO: 1426329 - protein, 5 aa, Mycobacterium tuberculosis
NINGH

SEQ ID NO: 1426330 - protein, 13 aa, Mycobacterium tuberculosis
NNSSTPQSQGPIS

SEQ ID NO: 1426331 - protein, 6 aa, Mycobacterium tuberculosis
NPDQNS

SEQ ID NO: 1426332 - protein, 17 aa, Mycobacterium tuberculosis
NPGLATPVTPAANGGNG

SEQ ID NO: 1426333 - protein, 25 aa, Mycobacterium tuberculosis
NRSHEPPINSEEPGGAGSIRGTACL

SEQ ID NO: 1426334 - protein, 4 aa, Mycobacterium tuberculosis
NSDQ

SEQ ID NO: 1426335 - protein, 35 aa, Mycobacterium tuberculosis; identical to SEQ ID NO: 181740

SEQ ID NO: 1426336 - protein, 5 aa, Mycobacterium tuberculosis
NSPRQ

SEQ ID NO: 1426337 - protein, 16 aa, Mycobacterium tuberculosis
NSPTVGSSVSAGTNNL

SEQ ID NO: 1426338 - protein, 6 aa, Mycobacterium tuberculosis
NSSSDQ

SEQ ID NO: 1426339 - protein, 13 aa, Mycobacterium tuberculosis
PAAATGAPTGGGV

SEQ ID NO: 1426340 - protein, 6 aa, Mycobacterium tuberculosis
PADGRR

SEQ ID NO: 1426341 - protein, 9 aa, Mycobacterium tuberculosis
PAGGEEVSA

SEQ ID NO: 1426342 - protein, 14 aa, Mycobacterium tuberculosis
PARPDLQAQRQALA

SEQ ID NO: 1426343 - protein, 9 aa, Mycobacterium tuberculosis
PAVSPIEES

SEQ ID NO: 1426344 - protein, 21 aa, Mycobacterium tuberculosis
PDAPPGTERFGSQPAQPAAGP

SEQ ID NO: 1426345 - protein, 19 aa, Mycobacterium tuberculosis
PDNRLAEKGWTTRKNTHGH

SEQ ID NO: 1426346 - protein, 4 aa, Mycobacterium tuberculosis
PEDR

SEQ ID NO: 1426347 - protein, 4 aa, Mycobacterium tuberculosis
PGDD

SEQ ID NO: 1426348 - protein, 7 aa, Mycobacterium tuberculosis
PGGPRAQ

SEQ ID NO: 1426349 - protein, 6 aa, Mycobacterium tuberculosis
PGGQTQ

SEQ ID NO: 1426350 - protein, 34 aa, Mycobacterium tuberculosis
PGNVNTGVGNTGSINTGSINTGSFNTGSTNTGSF

SEQ ID NO: 1426351 - protein, 6 aa, Mycobacterium tuberculosis
PGSGPM

SEQ ID NO: 1426352 - protein, 9 aa, Mycobacterium tuberculosis
PGSVEPGAD

SEQ ID NO: 1426353 - protein, 7 aa, Mycobacterium tuberculosis
PHKVDGA

SEQ ID NO: 1426354 - protein, 6 aa, Mycobacterium tuberculosis
PITALG

SEQ ID NO: 1426355 - protein, 11 aa, Mycobacterium tuberculosis
PKHDTAPANRY

SEQ ID NO: 1426356 - protein, 11 aa, Mycobacterium tuberculosis
PLPADPSPTLS

SEQ ID NO: 1426357 - protein, 4 aa, Mycobacterium tuberculosis
PLSD

SEQ ID NO: 1426358 - protein, 7 aa, Mycobacterium tuberculosis
PNGEPGV

SEQ ID NO: 1426359 - protein, 5 aa, Mycobacterium tuberculosis
PPEIN

SEQ ID NO: 1426360 - protein, 7 aa, Mycobacterium tuberculosis
PPLHKGD

SEQ ID NO: 1426361 - protein, 9 aa, Mycobacterium tuberculosis
PRGVGHSTP

SEQ ID NO: 1426362 - protein, 8 aa, Mycobacterium tuberculosis
PSERTGSV

SEQ ID NO: 1426363 - protein, 5 aa, Mycobacterium tuberculosis
PSPRV

SEQ ID NO: 1426364 - protein, 12 aa, Mycobacterium tuberculosis
PSRAPDLRPLHP

SEQ ID NO: 1426365 - protein, 10 aa, Mycobacterium tuberculosis
PSTDSIEPVQ

SEQ ID NO: 1426366 - protein, 13 aa, Mycobacterium tuberculosis
PTGEQSEAARRSG

SEQ ID NO: 1426367 - protein, 4 aa, Mycobacterium tuberculosis
PVPA

SEQ ID NO: 1426368 - protein, 25 aa, Mycobacterium tuberculosis
PVPAPAEAPVEASESTGGRGRRWCR

SEQ ID NO: 1426369 - protein, 8 aa, Mycobacterium tuberculosis
PYSGPTTA

SEQ ID NO: 1426370 - protein, 4 aa, Mycobacterium tuberculosis
PYTG

SEQ ID NO: 1426371 - protein, 4 aa, Mycobacterium tuberculosis
QAGE

SEQ ID NO: 1426372 - protein, 10 aa, Mycobacterium tuberculosis
QAMQAGQGAM

SEQ ID NO: 1426373 - protein, 10 aa, Mycobacterium tuberculosis
QGFANTGNNN

SEQ ID NO: 1426374 - protein, 11 aa, Mycobacterium tuberculosis
QKKKAQDEYGA

SEQ ID NO: 1426375 - protein, 13 aa, Mycobacterium tuberculosis
QKPGKTSDPRGLS

SEQ ID NO: 1426376 - protein, 8 aa, Mycobacterium tuberculosis
QLASTGAR

SEQ ID NO: 1426377 - protein, 13 aa, Mycobacterium tuberculosis
QLKRNEANDLRNE

SEQ ID NO: 1426378 - protein, 4 aa, Mycobacterium tuberculosis
QLRT

SEQ ID NO: 1426379 - protein, 4 aa, Mycobacterium tuberculosis
QQYQ

SEQ ID NO: 1426380 - protein, 7 aa, Mycobacterium tuberculosis
QRGSDAG

SEQ ID NO: 1426381 - protein, 7 aa, Mycobacterium tuberculosis
QSRSELT

SEQ ID NO: 1426382 - protein, 8 aa, Mycobacterium tuberculosis
QTAELYPG

SEQ ID NO: 1426383 - protein, 5 aa, Mycobacterium tuberculosis
QTGEP

SEQ ID NO: 1426384 - protein, 22 aa, Mycobacterium tuberculosis
QTIERTDADERVDDGTGSDTPK

SEQ ID NO: 1426385 - protein, 8 aa, Mycobacterium tuberculosis
QTPPAAVG

SEQ ID NO: 1426386 - protein, 7 aa, Mycobacterium tuberculosis
QTRFQPT

SEQ ID NO: 1426387 - protein, 5 aa, Mycobacterium tuberculosis
QTVGE

SEQ ID NO: 1426388 - protein, 11 aa, Mycobacterium tuberculosis
RAKAERSENTL

SEQ ID NO: 1426389 - protein, 6 aa, Mycobacterium tuberculosis
RARASG

SEQ ID NO: 1426390 - protein, 12 aa, Mycobacterium tuberculosis
RDGRHDNKAPLT

SEQ ID NO: 1426391 - protein, 6 aa, Mycobacterium tuberculosis
RDRDAT

SEQ ID NO: 1426392 - protein, 5 aa, Mycobacterium tuberculosis
REAAD

SEQ ID NO: 1426393 - protein, 12 aa, Mycobacterium tuberculosis
REAAGPGHRRRR

SEQ ID NO: 1426394 - protein, 8 aa, Mycobacterium tuberculosis
RELRNNTA

SEQ ID NO: 1426395 - protein, 5 aa, Mycobacterium tuberculosis
RGDVG

SEQ ID NO: 1426396 - protein, 9 aa, Mycobacterium tuberculosis
RHRHAGGEY

SEQ ID NO: 1426397 - protein, 7 aa, Mycobacterium tuberculosis
RHRSPGI

SEQ ID NO: 1426398 - protein, 10 aa, Mycobacterium tuberculosis
RIPADADQHE

SEQ ID NO: 1426399 - protein, 5 aa, Mycobacterium tuberculosis
RLPRT

SEQ ID NO: 1426400 - protein, 5 aa, Mycobacterium tuberculosis
RLSGE

SEQ ID NO: 1426401 - protein, 4 aa, Mycobacterium tuberculosis
RMPG

SEQ ID NO: 1426402 - protein, 6 aa, Mycobacterium tuberculosis
RMTSSQ

SEQ ID NO: 1426403 - protein, 8 aa, Mycobacterium tuberculosis
RNAESDSG

SEQ ID NO: 1426404 - protein, 20 aa, Mycobacterium tuberculosis
RPGATEPSDPALLAKIHANS

SEQ ID NO: 1426405 - protein, 9 aa, Mycobacterium tuberculosis
RPGRRRPRF

SEQ ID NO: 1426406 - protein, 10 aa, Mycobacterium tuberculosis
RPQSVTGPTG

SEQ ID NO: 1426407 - protein, 4 aa, Mycobacterium tuberculosis
RQAD

SEQ ID NO: 1426408 - protein, 8 aa, Mycobacterium tuberculosis
RQPGKPSW

SEQ ID NO: 1426409 - protein, 21 aa, Mycobacterium tuberculosis
RRGAQGPQPGRGHPESRYPSL

SEQ ID NO: 1426410 - protein, 29 aa, Mycobacterium tuberculosis
RRPPDRSTFATPPTAMPAPSHLTDVDRSA

SEQ ID NO: 1426411 - protein, 8 aa, Mycobacterium tuberculosis
RRRDPFDD

SEQ ID NO: 1426412 - protein, 16 aa, Mycobacterium tuberculosis
RRSSSSLRSASSPAVV

SEQ ID NO: 1426413 - protein, 6 aa, Mycobacterium tuberculosis
RRTRAA

SEQ ID NO: 1426414 - protein, 15 aa, Mycobacterium tuberculosis
RRVDGAREAVDGSIN

SEQ ID NO: 1426415 - protein, 6 aa, Mycobacterium tuberculosis
RSEEVE

SEQ ID NO: 1426416 - protein, 4 aa, Mycobacterium tuberculosis
RSSG

SEQ ID NO: 1426417 - protein, 7 aa, Mycobacterium tuberculosis
RTAGGDL

SEQ ID NO: 1426418 - protein, 14 aa, Mycobacterium tuberculosis
RTARRGPPTRGLPK

SEQ ID NO: 1426419 - protein, 8 aa, Mycobacterium tuberculosis
RTPFHEPD

SEQ ID NO: 1426420 - protein, 9 aa, Mycobacterium tuberculosis
RVGEPGKPV

SEQ ID NO: 1426421 - protein, 7 aa, Mycobacterium tuberculosis
RVGGAAQ

SEQ ID NO: 1426422 - protein, 9 aa, Mycobacterium tuberculosis
RVGGSTEAP

SEQ ID NO: 1426423 - protein, 18 aa, Mycobacterium tuberculosis
SAAPTDPSSSSTDSPVDA

SEQ ID NO: 1426424 - protein, 10 aa, Mycobacterium tuberculosis
SADDPAAQVT

SEQ ID NO: 1426425 - protein, 9 aa, Mycobacterium tuberculosis
SAEALTAQA

SEQ ID NO: 1426426 - protein, 16 aa, Mycobacterium tuberculosis
SAGAGAYANAEAANVQ

SEQ ID NO: 1426427 - protein, 7 aa, Mycobacterium tuberculosis
SAGARGR

SEQ ID NO: 1426428 - protein, 4 aa, Mycobacterium tuberculosis
SAHA

SEQ ID NO: 1426429 - protein, 25 aa, Mycobacterium tuberculosis
SALDAQPDPHLSGDEPPSRPLTPET

SEQ ID NO: 1426430 - protein, 17 aa, Mycobacterium tuberculosis
SALLGAGSGVGNVGTLG

SEQ ID NO: 1426431 - protein, 11 aa, Mycobacterium tuberculosis
SASANASPDRV

SEQ ID NO: 1426432 - protein, 7 aa, Mycobacterium tuberculosis
SCATKYG

SEQ ID NO: 1426433 - protein, 10 aa, Mycobacterium tuberculosis
SEKGDSGGPV

SEQ ID NO: 1426434 - protein, 4 aa, Mycobacterium tuberculosis
SEPV

SEQ ID NO: 1426435 - protein, 11 aa, Mycobacterium tuberculosis
SGATALSNEAP

SEQ ID NO: 1426436 - protein, 53 aa, Mycobacterium tuberculosis
SGFGGAGGAGGASDTGAGGNGGAGGKAGLYGNGGDGGAGGDGATSGKGGAGGN

SEQ ID NO: 1426437 - protein, 26 aa, Mycobacterium tuberculosis
SGGAGGPGGVGNTGTGGLGGDGGAAG

SEQ ID NO: 1426438 - protein, 8 aa, Mycobacterium tuberculosis
SGLAKPDG

SEQ ID NO: 1426439 - protein, 59 aa, Mycobacterium tuberculosis
SGSSGLGGAAGSGGNGGGGGEPGVAGSPGVGPAGRGGDGNLGQFGPEGAPGQPGQPGQP

SEQ ID NO: 1426440 - protein, 6 aa, Mycobacterium tuberculosis
SGVHER

SEQ ID NO: 1426441 - protein, 11 aa, Mycobacterium tuberculosis
SHSHRRTSRRW

SEQ ID NO: 1426442 - protein, 6 aa, Mycobacterium tuberculosis
SKSALR

SEQ ID NO: 1426443 - protein, 8 aa, Mycobacterium tuberculosis
SKSPHWTG

SEQ ID NO: 1426444 - protein, 13 aa, Mycobacterium tuberculosis
SLIPDADKRWDAR

SEQ ID NO: 1426445 - protein, 13 aa, Mycobacterium tuberculosis
SLPGEAGSAARTP

SEQ ID NO: 1426446 - protein, 8 aa, Mycobacterium tuberculosis
SNSTGMSG

SEQ ID NO: 1426447 - protein, 8 aa, Mycobacterium tuberculosis
SNTAAQEE

SEQ ID NO: 1426448 - protein, 6 aa, Mycobacterium tuberculosis
SQLHDT

SEQ ID NO: 1426449 - protein, 18 aa, Mycobacterium tuberculosis
SQLSAAGEGGGQSAARAA

SEQ ID NO: 1426450 - protein, 7 aa, Mycobacterium tuberculosis
SRADDSV

SEQ ID NO: 1426451 - protein, 20 aa, Mycobacterium tuberculosis
SRARSRCTKGSRRYRERTTE

SEQ ID NO: 1426452 - protein, 9 aa, Mycobacterium tuberculosis
SSGPGPGSV

SEQ ID NO: 1426453 - protein, 19 aa, Mycobacterium tuberculosis
SSTGAPPPKKSREQRVREN

SEQ ID NO: 1426454 - protein, 8 aa, Mycobacterium tuberculosis
STEQHGPH

SEQ ID NO: 1426455 - protein, 4 aa, Mycobacterium tuberculosis
STSG

SEQ ID NO: 1426456 - protein, 4 aa, Mycobacterium tuberculosis
STYD

SEQ ID NO: 1426457 - protein, 5 aa, Mycobacterium tuberculosis
SVQNT

SEQ ID NO: 1426458 - protein, 10 aa, Mycobacterium tuberculosis
SWPDNASLDK

SEQ ID NO: 1426459 - protein, 11 aa, Mycobacterium tuberculosis
TAAAALAEEGA

SEQ ID NO: 1426460 - protein, 9 aa, Mycobacterium tuberculosis
TADPVAGSR

SEQ ID NO: 1426461 - protein, 7 aa, Mycobacterium tuberculosis
TAGEPVT

SEQ ID NO: 1426462 - protein, 13 aa, Mycobacterium tuberculosis
TAGQAEQAGMQAR

SEQ ID NO: 1426463 - protein, 7 aa, Mycobacterium tuberculosis
TAGQATA

SEQ ID NO: 1426464 - protein, 13 aa, Mycobacterium tuberculosis
TAPAVPNGQPVKG

SEQ ID NO: 1426465 - protein, 14 aa, Mycobacterium tuberculosis
TAPGGPGGAGGAGG

SEQ ID NO: 1426466 - protein, 11 aa, Mycobacterium tuberculosis
TAPRLPDGTPF

SEQ ID NO: 1426467 - protein, 9 aa, Mycobacterium tuberculosis
TAQQRTSLA

SEQ ID NO: 1426468 - protein, 4 aa, Mycobacterium tuberculosis
TASV

SEQ ID NO: 1426469 - protein, 5 aa, Mycobacterium tuberculosis
TATGL

SEQ ID NO: 1426470 - protein, 7 aa, Mycobacterium tuberculosis
TAVAENI

SEQ ID NO: 1426471 - protein, 13 aa, Mycobacterium tuberculosis
TDPAKSRPLFGPG

SEQ ID NO: 1426472 - protein, 13 aa, Mycobacterium tuberculosis
TEDGRNVPTGPEQ

SEQ ID NO: 1426473 - protein, 7 aa, Mycobacterium tuberculosis
TENAEQY

SEQ ID NO: 1426474 - protein, 5 aa, Mycobacterium tuberculosis
TEPRK

SEQ ID NO: 1426475 - protein, 4 aa, Mycobacterium tuberculosis
TGGG

SEQ ID NO: 1426476 - protein, 32 aa, Mycobacterium tuberculosis
TGNGGTGGTGGTGTGNQLVGGEGGAGGAGGNA

SEQ ID NO: 1426477 - protein, 4 aa, Mycobacterium tuberculosis
TGRT

SEQ ID NO: 1426478 - protein, 6 aa, Mycobacterium tuberculosis
TGSAPR

SEQ ID NO: 1426479 - protein, 11 aa, Mycobacterium tuberculosis
THDPATPYQSG

SEQ ID NO: 1426480 - protein, 4 aa, Mycobacterium tuberculosis
THGA

SEQ ID NO: 1426481 - protein, 6 aa, Mycobacterium tuberculosis
TIRGTQ

SEQ ID NO: 1426482 - protein, 5 aa, Mycobacterium tuberculosis
TKDQV

SEQ ID NO: 1426483 - protein, 4 aa, Mycobacterium tuberculosis
TKRY

SEQ ID NO: 1426484 - protein, 5 aa, Mycobacterium tuberculosis
TLAGT

SEQ ID NO: 1426485 - protein, 9 aa, Mycobacterium tuberculosis
TMPYPTPDA

SEQ ID NO: 1426486 - protein, 8 aa, Mycobacterium tuberculosis
TNPNEALG

SEQ ID NO: 1426487 - protein, 15 aa, Mycobacterium tuberculosis
TNQANPVPGDPTGDL

SEQ ID NO: 1426488 - protein, 12 aa, Mycobacterium tuberculosis
TPERGLIALPCG

SEQ ID NO: 1426489 - protein, 15 aa, Mycobacterium tuberculosis
TPGFGNATATPSSGF

SEQ ID NO: 1426490 - protein, 11 aa, Mycobacterium tuberculosis
TPLGGGATGGI

SEQ ID NO: 1426491 - protein, 4 aa, Mycobacterium tuberculosis
TPLR

SEQ ID NO: 1426492 - protein, 4 aa, Mycobacterium tuberculosis
TPTL

SEQ ID NO: 1426493 - protein, 18 aa, Mycobacterium tuberculosis
TSGGGAYAAAEAAATSPL

SEQ ID NO: 1426494 - protein, 6 aa, Mycobacterium tuberculosis
TSPQAF

SEQ ID NO: 1426495 - protein, 9 aa, Mycobacterium tuberculosis
TSPTSWEQA

SEQ ID NO: 1426496 - protein, 7 aa, Mycobacterium tuberculosis
TSQTGVR

SEQ ID NO: 1426497 - protein, 6 aa, Mycobacterium tuberculosis
TVASRP

SEQ ID NO: 1426498 - protein, 10 aa, Mycobacterium tuberculosis
TVATPRDAQD

SEQ ID NO: 1426499 - protein, 15 aa, Mycobacterium tuberculosis
TVPSVPRTWSERVRA

SEQ ID NO: 1426500 - protein, 4 aa, Mycobacterium tuberculosis
TVTE

SEQ ID NO: 1426501 - protein, 4 aa, Mycobacterium tuberculosis
VALT

SEQ ID NO: 1426502 - protein, 5 aa, Mycobacterium tuberculosis
VARGT

SEQ ID NO: 1426503 - protein, 6 aa, Mycobacterium tuberculosis
VDGPVT

SEQ ID NO: 1426504 - protein, 31 aa, Mycobacterium tuberculosis
VDPQPKFGDPQRADIDDQPKKEWMCRGWDKS

SEQ ID NO: 1426505 - protein, 16 aa, Mycobacterium tuberculosis
VEHRDRQQLAAQSGYS

SEQ ID NO: 1426506 - protein, 8 aa, Mycobacterium tuberculosis
VEPNDGHR

SEQ ID NO: 1426507 - protein, 6 aa, Mycobacterium tuberculosis
VEQQAA

SEQ ID NO: 1426508 - protein, 7 aa, Mycobacterium tuberculosis
VERGKAA

SEQ ID NO: 1426509 - protein, 7 aa, Mycobacterium tuberculosis
VETPGPV

SEQ ID NO: 1426510 - protein, 11 aa, Mycobacterium tuberculosis
VEVADDGRGIP

SEQ ID NO: 1426511 - protein, 6 aa, Mycobacterium tuberculosis
VGGAKN

SEQ ID NO: 1426512 - protein, 8 aa, Mycobacterium tuberculosis
VGGEPGSI

SEQ ID NO: 1426513 - protein, 14 aa, Mycobacterium tuberculosis
VGKPAAQEGSEPWV

SEQ ID NO: 1426514 - protein, 55 aa, Mycobacterium tuberculosis
VHPPGRRSRPGRQSRSISSRRAGPLRPAGHGLATPRRRPHRHRTRPQTRHHPEQP

SEQ ID NO: 1426515 - protein, 16 aa, Mycobacterium tuberculosis
VKRGADRKTGPGPAGW

SEQ ID NO: 1426516 - protein, 5 aa, Mycobacterium tuberculosis
VNAPA

SEQ ID NO: 1426517 - protein, 10 aa, Mycobacterium tuberculosis
VPASATTTAS

SEQ ID NO: 1426518 - protein, 5 aa, Mycobacterium tuberculosis
VPDSS

SEQ ID NO: 1426519 - protein, 5 aa, Mycobacterium tuberculosis
VPEQA

SEQ ID NO: 1426520 - protein, 18 aa, Mycobacterium tuberculosis
VPFPTGPRPDVRRADNHE

SEQ ID NO: 1426521 - protein, 10 aa, Mycobacterium tuberculosis
VPGVGKSTAI

SEQ ID NO: 1426522 - protein, 5 aa, Mycobacterium tuberculosis
VPPGR

SEQ ID NO: 1426523 - protein, 20 aa, Mycobacterium tuberculosis
VPPSVPVKSADDKPVVTKST

SEQ ID NO: 1426524 - protein, 14 aa, Mycobacterium tuberculosis
VPPTAPAEPQPTSE

SEQ ID NO: 1426525 - protein, 13 aa, Mycobacterium tuberculosis
VPRADDADSDVPR

SEQ ID NO: 1426526 - protein, 20 aa, Mycobacterium tuberculosis
VQEGDDVLDEDGQPPITAKG

SEQ ID NO: 1426527 - protein, 7 aa, Mycobacterium tuberculosis
VRSQAAG

SEQ ID NO: 1426528 - protein, 5 aa, Mycobacterium tuberculosis
VSGET

SEQ ID NO: 1426529 - protein, 9 aa, Mycobacterium tuberculosis
VSGPGSARV

SEQ ID NO: 1426530 - protein, 11 aa, Mycobacterium tuberculosis
VSSHDGPDAGR

SEQ ID NO: 1426531 - protein, 5 aa, Mycobacterium tuberculosis
VTEQE

SEQ ID NO: 1426532 - protein, 9 aa, Mycobacterium tuberculosis
WGPGESPGT

SEQ ID NO: 1426533 - protein, 36 aa, Mycobacterium tuberculosis; identical to SEQ ID NO: 191591

SEQ ID NO: 1426534 - protein, 16 aa, Mycobacterium tuberculosis
YDGRDADGHYSNDQDA

SEQ ID NO: 1426535 - protein, 8 aa, Mycobacterium tuberculosis
YEAQTGRK

SEQ ID NO: 1426536 - protein, 7 aa, Mycobacterium tuberculosis
YGDCGRS

SEQ ID NO: 1426537 - protein, 7 aa, Mycobacterium tuberculosis
YHPHGDA

SEQ ID NO: 1426538 - protein, 11 aa, Mycobacterium tuberculosis
YPQTETEPANC

SEQ ID NO: 1426539 - protein, 9 aa, Mycobacterium tuberculosis
YSEEEPTTL

SEQ ID NO: 1426540 - protein, 6 aa, Mycobacterium tuberculosis
YSLDGR

SEQ ID NO: 1426541 - protein, 4 aa, Mycobacterium tuberculosis
YSPE

SEQ ID NO: 1426542 - protein, 7 aa, Mycobacterium tuberculosis
YSPYENV

SEQ ID NO: 1426543 - protein, 11 aa, Mycobacterium tuberculosis
YSTAAERVGSA

SEQ ID NO: 1426544 - protein, 10 aa, Mycobacterium tuberculosis
YTDVTSPTEL

SEQ ID NO: 1426545 - protein, 5 aa, Mycobacterium tuberculosis
YTGEL

SEQ ID NO: 1426546 - protein, 16 aa, Mycobacterium tuberculosis
YTQNGRGELAATEHAE

SEQ ID NO: 1426547 - protein, 15 aa, Mycobacterium tuberculosis
YVGKPAAQEGSEPWV

SEQ ID NO: 1426548 - protein, 10 aa, Mycobacterium tuberculosis
AAAAAPTTTG

SEQ ID NO: 1426549 - protein, 6 aa, Mycobacterium tuberculosis
AAAAGA

SEQ ID NO: 1426550 - protein, 14 aa, Mycobacterium tuberculosis
AAAESRRLDHAPNA

SEQ ID NO: 1426551 - protein, 7 aa, Mycobacterium tuberculosis
AADEVST

SEQ ID NO: 1426552 - protein, 10 aa, Mycobacterium tuberculosis
AADVDAAAPA

SEQ ID NO: 1426553 - protein, 4 aa, Mycobacterium tuberculosis
AAEA

SEQ ID NO: 1426554 - protein, 5 aa, Mycobacterium tuberculosis
AAETA

SEQ ID NO: 1426555 - protein, 10 aa, Mycobacterium tuberculosis
AAGAGGAGGF

SEQ ID NO: 1426556 - protein, 8 aa, Mycobacterium tuberculosis
AAGGGLAS

SEQ ID NO: 1426557 - protein, 6 aa, Mycobacterium tuberculosis
AAPADQ

SEQ ID NO: 1426558 - protein, 7 aa, Mycobacterium tuberculosis
AARQLGQ

SEQ ID NO: 1426559 - protein, 15 aa, Mycobacterium tuberculosis
AARRAAASVAGAADP

SEQ ID NO: 1426560 - protein, 9 aa, Mycobacterium tuberculosis
AARTGSGVG

SEQ ID NO: 1426561 - protein, 8 aa, Mycobacterium tuberculosis
AASGTVVK

SEQ ID NO: 1426562 - protein, 9 aa, Mycobacterium tuberculosis
AASLRDREK

SEQ ID NO: 1426563 - protein, 10 aa, Mycobacterium tuberculosis
ADAAGGDECG

SEQ ID NO: 1426564 - protein, 8 aa, Mycobacterium tuberculosis
ADAPDTRR

SEQ ID NO: 1426565 - protein, 8 aa, Mycobacterium tuberculosis
ADDAQPKF

SEQ ID NO: 1426566 - protein, 9 aa, Mycobacterium tuberculosis
ADGTAGSTG

SEQ ID NO: 1426567 - protein, 19 aa, Mycobacterium tuberculosis
ADQDVQAYTERPLTDDENA

SEQ ID NO: 1426568 - protein, 17 aa, Mycobacterium tuberculosis
ADRKRGASAGRGGSAPS

SEQ ID NO: 1426569 - protein, 4 aa, Mycobacterium tuberculosis
ADRR

SEQ ID NO: 1426570 - protein, 10 aa, Mycobacterium tuberculosis
ADTPDGDEAL

SEQ ID NO: 1426571 - protein, 5 aa, Mycobacterium tuberculosis
AEAAR

SEQ ID NO: 1426572 - protein, 4 aa, Mycobacterium tuberculosis
AEAG

SEQ ID NO: 1426573 - protein, 4 aa, Mycobacterium tuberculosis
AEFT

SEQ ID NO: 1426574 - protein, 5 aa, Mycobacterium tuberculosis
AEPSA

SEQ ID NO: 1426575 - protein, 6 aa, Mycobacterium tuberculosis
AESTGE

SEQ ID NO: 1426576 - protein, 5 aa, Mycobacterium tuberculosis
AETEL

SEQ ID NO: 1426577 - protein, 9 aa, Mycobacterium tuberculosis
AEVPAAGGP

SEQ ID NO: 1426578 - protein, 7 aa, Mycobacterium tuberculosis
AEVSKAI

SEQ ID NO: 1426579 - protein, 17 aa, Mycobacterium tuberculosis
AEVSKAIGTARMASGGT

SEQ ID NO: 1426580 - protein, 14 aa, Mycobacterium tuberculosis
AGDDEPDGDDTPPW

SEQ ID NO: 1426581 - protein, 11 aa, Mycobacterium tuberculosis
AGEGVEELGRS

SEQ ID NO: 1426582 - protein, 28 aa, Mycobacterium tuberculosis
AGGAGGAGGVGGAGGAGGTGGGGGNGGA

SEQ ID NO: 1426583 - protein, 25 aa, Mycobacterium tuberculosis
AGGHGGAGGPGPIGGVGGHGGVGGA

SEQ ID NO: 1426584 - protein, 25 aa, Mycobacterium tuberculosis
AGGIGGIGGNANGGAGGNGGTGGQL

SEQ ID NO: 1426585 - protein, 12 aa, Mycobacterium tuberculosis
AGGTAGAGGTGG

SEQ ID NO: 1426586 - protein, 16 aa, Mycobacterium tuberculosis
AGGTDPVQAAAPGTIR

SEQ ID NO: 1426587 - protein, 7 aa, Mycobacterium tuberculosis
AGNPAKR

SEQ ID NO: 1426588 - protein, 8 aa, Mycobacterium tuberculosis
AGNPDYAP

SEQ ID NO: 1426589 - protein, 5 aa, Mycobacterium tuberculosis
AGPQV

SEQ ID NO: 1426590 - protein, 21 aa, Mycobacterium tuberculosis
AGRIEARTDPWDPATEPGAED

SEQ ID NO: 1426591 - protein, 4 aa, Mycobacterium tuberculosis
AGSD

SEQ ID NO: 1426592 - protein, 6 aa, Mycobacterium tuberculosis
AGSLEA

SEQ ID NO: 1426593 - protein, 4 aa, Mycobacterium tuberculosis
AGTE

SEQ ID NO: 1426594 - protein, 9 aa, Mycobacterium tuberculosis
AGTGGQAAL

SEQ ID NO: 1426595 - protein, 4 aa, Mycobacterium tuberculosis
AGTI

SEQ ID NO: 1426596 - protein, 4 aa, Mycobacterium tuberculosis
AGTY

SEQ ID NO: 1426597 - protein, 9 aa, Mycobacterium tuberculosis
AGVTAARES

SEQ ID NO: 1426598 - protein, 7 aa, Mycobacterium tuberculosis
AHGVTAA

SEQ ID NO: 1426599 - protein, 12 aa, Mycobacterium tuberculosis
AHTKASQAPISD

SEQ ID NO: 1426600 - protein, 6 aa, Mycobacterium tuberculosis
AIDAET

SEQ ID NO: 1426601 - protein, 10 aa, Mycobacterium tuberculosis
AIDASPVRAY

SEQ ID NO: 1426602 - protein, 15 aa, Mycobacterium tuberculosis
AIDPGTVDAGTVGNA

SEQ ID NO: 1426603 - protein, 14 aa, Mycobacterium tuberculosis
AIRPAGETFATPDA

SEQ ID NO: 1426604 - protein, 4 aa, Mycobacterium tuberculosis
AITG

SEQ ID NO: 1426605 - protein, 14 aa, Mycobacterium tuberculosis
AKDVGKRAERATAE

SEQ ID NO: 1426606 - protein, 4 aa, Mycobacterium tuberculosis
AKHA

SEQ ID NO: 1426607 - protein, 6 aa, Mycobacterium tuberculosis
AKKNAI

SEQ ID NO: 1426608 - protein, 9 aa, Mycobacterium tuberculosis
AKVGEDSGL

SEQ ID NO: 1426609 - protein, 9 aa, Mycobacterium tuberculosis
ALEGKNTEL

SEQ ID NO: 1426610 - protein, 7 aa, Mycobacterium tuberculosis
ANAYESA

SEQ ID NO: 1426611 - protein, 4 aa, Mycobacterium tuberculosis
ANEA

SEQ ID NO: 1426612 - protein, 6 aa, Mycobacterium tuberculosis
ANKRSA

SEQ ID NO: 1426613 - protein, 7 aa, Mycobacterium tuberculosis
ANLGNTV

SEQ ID NO: 1426614 - protein, 6 aa, Mycobacterium tuberculosis
ANPDAL

SEQ ID NO: 1426615 - protein, 7 aa, Mycobacterium tuberculosis
ANSGLTP

SEQ ID NO: 1426616 - protein, 9 aa, Mycobacterium tuberculosis
APDGTALPR

SEQ ID NO: 1426617 - protein, 5 aa, Mycobacterium tuberculosis
APGHA

SEQ ID NO: 1426618 - protein, 4 aa, Mycobacterium tuberculosis
APLA

SEQ ID NO: 1426619 - protein, 5 aa, Mycobacterium tuberculosis
APNGP

SEQ ID NO: 1426620 - protein, 9 aa, Mycobacterium tuberculosis
APPKLGRAA

SEQ ID NO: 1426621 - protein, 11 aa, Mycobacterium tuberculosis
APPLTDEQRTR

SEQ ID NO: 1426622 - protein, 12 aa, Mycobacterium tuberculosis
APPMRRRGDRHR

SEQ ID NO: 1426623 - protein, 17 aa, Mycobacterium tuberculosis
APRYIRDTGGSLGGGRR

SEQ ID NO: 1426624 - protein, 8 aa, Mycobacterium tuberculosis
AQAHADGG

SEQ ID NO: 1426625 - protein, 14 aa, Mycobacterium tuberculosis
AQASRDVSAAADWP

SEQ ID NO: 1426626 - protein, 19 aa, Mycobacterium tuberculosis
AQEVSDDSPALAQPAVPNY

SEQ ID NO: 1426627 - protein, 10 aa, Mycobacterium tuberculosis
AQPPVGTRAR

SEQ ID NO: 1426628 - protein, 4 aa, Mycobacterium tuberculosis
AQSR

SEQ ID NO: 1426629 - protein, 15 aa, Mycobacterium tuberculosis
ARAFQDAKNRADQYA

SEQ ID NO: 1426630 - protein, 5 aa, Mycobacterium tuberculosis
ARANY

SEQ ID NO: 1426631 - protein, 5 aa, Mycobacterium tuberculosis
ARERR

SEQ ID NO: 1426632 - protein, 5 aa, Mycobacterium tuberculosis
ARGGR

SEQ ID NO: 1426633 - protein, 8 aa, Mycobacterium tuberculosis
ARGQSVHT

SEQ ID NO: 1426634 - protein, 4 aa, Mycobacterium tuberculosis
ARIG

SEQ ID NO: 1426635 - protein, 8 aa, Mycobacterium tuberculosis
ARKLKSAG

SEQ ID NO: 1426636 - protein, 8 aa, Mycobacterium tuberculosis
ARNEEDPR

SEQ ID NO: 1426637 - protein, 6 aa, Mycobacterium tuberculosis
ARPTYA

SEQ ID NO: 1426638 - protein, 10 aa, Mycobacterium tuberculosis
ARRQTTRSAA

SEQ ID NO: 1426639 - protein, 10 aa, Mycobacterium tuberculosis
ARSAHAGNDA

SEQ ID NO: 1426640 - protein, 7 aa, Mycobacterium tuberculosis
ARTGETL

SEQ ID NO: 1426641 - protein, 7 aa, Mycobacterium tuberculosis
ARTSDVP

SEQ ID NO: 1426642 - protein, 9 aa, Mycobacterium tuberculosis
ASANTGDGI

SEQ ID NO: 1426643 - protein, 8 aa, Mycobacterium tuberculosis
ASAQQKST

SEQ ID NO: 1426644 - protein, 4 aa, Mycobacterium tuberculosis
ASAT

SEQ ID NO: 1426645 - protein, 20 aa, Mycobacterium tuberculosis
ATATAPARTEAPTPTRPAAA

SEQ ID NO: 1426646 - protein, 7 aa, Mycobacterium tuberculosis
ATDNPVG

SEQ ID NO: 1426647 - protein, 4 aa, Mycobacterium tuberculosis
ATEF

SEQ ID NO: 1426648 - protein, 6 aa, Mycobacterium tuberculosis
ATFAGR

SEQ ID NO: 1426649 - protein, 7 aa, Mycobacterium tuberculosis
ATGRSSD

SEQ ID NO: 1426650 - protein, 9 aa, Mycobacterium tuberculosis
ATKAEADAA

SEQ ID NO: 1426651 - protein, 12 aa, Mycobacterium tuberculosis
ATLRGRDTRSIS

SEQ ID NO: 1426652 - protein, 11 aa, Mycobacterium tuberculosis
ATPPNSTRPNL

SEQ ID NO: 1426653 - protein, 7 aa, Mycobacterium tuberculosis
ATPSAAD

SEQ ID NO: 1426654 - protein, 7 aa, Mycobacterium tuberculosis
ATREGNQ

SEQ ID NO: 1426655 - protein, 29 aa, Mycobacterium tuberculosis
ATRRNTELEGTRSTAATRADQNDYARGKI

SEQ ID NO: 1426656 - protein, 4 aa, Mycobacterium tuberculosis
AVAA

SEQ ID NO: 1426657 - protein, 7 aa, Mycobacterium tuberculosis
AVDGQPY

SEQ ID NO: 1426658 - protein, 6 aa, Mycobacterium tuberculosis
AVDQAG

SEQ ID NO: 1426659 - protein, 11 aa, Mycobacterium tuberculosis
AVPGSGGIRGP

SEQ ID NO: 1426660 - protein, 6 aa, Mycobacterium tuberculosis
AVTATN

SEQ ID NO: 1426661 - protein, 9 aa, Mycobacterium tuberculosis
AYQSDTESP

SEQ ID NO: 1426662 - protein, 4 aa, Mycobacterium tuberculosis
CGKA

SEQ ID NO: 1426663 - protein, 6 aa, Mycobacterium tuberculosis
CNSTRT

SEQ ID NO: 1426664 - protein, 8 aa, Mycobacterium tuberculosis
CPSKAGTD

SEQ ID NO: 1426665 - protein, 4 aa, Mycobacterium tuberculosis
CTPC

SEQ ID NO: 1426666 - protein, 25 aa, Mycobacterium tuberculosis
CTSPRSRNRSFGERLGRGETLQSAG

SEQ ID NO: 1426667 - protein, 26 aa, Mycobacterium tuberculosis
DAAEARLRDGPRAAALPASGTSEGRQ

SEQ ID NO: 1426668 - protein, 6 aa, Mycobacterium tuberculosis
DAATLT

SEQ ID NO: 1426669 - protein, 13 aa, Mycobacterium tuberculosis
DADAVRRRKEYRA

SEQ ID NO: 1426670 - protein, 8 aa, Mycobacterium tuberculosis
DANDLNAL

SEQ ID NO: 1426671 - protein, 6 aa, Mycobacterium tuberculosis
DANLPG

SEQ ID NO: 1426672 - protein, 8 aa, Mycobacterium tuberculosis
DASASSQF

SEQ ID NO: 1426673 - protein, 4 aa, Mycobacterium tuberculosis
DEAN

SEQ ID NO: 1426674 - protein, 10 aa, Mycobacterium tuberculosis
DEIARRESAA

SEQ ID NO: 1426675 - protein, 7 aa, Mycobacterium tuberculosis
DEPLEGG

SEQ ID NO: 1426676 - protein, 6 aa, Mycobacterium tuberculosis
DETGII

SEQ ID NO: 1426677 - protein, 9 aa, Mycobacterium tuberculosis
DFTGEGAKL

SEQ ID NO: 1426678 - protein, 5 aa, Mycobacterium tuberculosis
DFTPA

SEQ ID NO: 1426679 - protein, 16 aa, Mycobacterium tuberculosis
DGAHGAPGTGQAGGAG

SEQ ID NO: 1426680 - protein, 15 aa, Mycobacterium tuberculosis
DGAHGTAPGQPGGAG

SEQ ID NO: 1426681 - protein, 9 aa, Mycobacterium tuberculosis
DGERNGLDA

SEQ ID NO: 1426682 - protein, 47 aa, Mycobacterium tuberculosis; identical to SEQ ID NO: 171457

SEQ ID NO: 1426683 - protein, 24 aa, Mycobacterium tuberculosis
DGGAGGAGGVGSTTGGAGGAGGNA

SEQ ID NO: 1426684 - protein, 68 aa, Mycobacterium tuberculosis
DGGAGGIGGTGGEGGIGARGGTGGQGGMGGAGQPGVGGDAGDGGNGGIGGDGGAGGDGGAGGAGGAGG

SEQ ID NO: 1426685 - protein, 28 aa, Mycobacterium tuberculosis
DGGAGGNGGDIRGQGGGAGGAGGAGGQL

SEQ ID NO: 1426686 - protein, 9 aa, Mycobacterium tuberculosis
DGGDPSQAR

SEQ ID NO: 1426687 - protein, 11 aa, Mycobacterium tuberculosis
DGGKPTQVHRG

SEQ ID NO: 1426688 - protein, 7 aa, Mycobacterium tuberculosis
DGRCVPG

SEQ ID NO: 1426689 - protein, 10 aa, Mycobacterium tuberculosis
DGRRRAGARV

SEQ ID NO: 1426690 - protein, 8 aa, Mycobacterium tuberculosis
DGSDSSMR

SEQ ID NO: 1426691 - protein, 7 aa, Mycobacterium tuberculosis
DGSREAG

SEQ ID NO: 1426692 - protein, 4 aa, Mycobacterium tuberculosis
DGSS

SEQ ID NO: 1426693 - protein, 5 aa, Mycobacterium tuberculosis
DGSYP

SEQ ID NO: 1426694 - protein, 7 aa, Mycobacterium tuberculosis
DGYPRQG

SEQ ID NO: 1426695 - protein, 6 aa, Mycobacterium tuberculosis
DHAAAG

SEQ ID NO: 1426696 - protein, 4 aa, Mycobacterium tuberculosis
DKPD

SEQ ID NO: 1426697 - protein, 9 aa, Mycobacterium tuberculosis
DKSGTSDNF

SEQ ID NO: 1426698 - protein, 11 aa, Mycobacterium tuberculosis
DKTNGQPFSDD

SEQ ID NO: 1426699 - protein, 5 aa, Mycobacterium tuberculosis
DLPAA

SEQ ID NO: 1426700 - protein, 12 aa, Mycobacterium tuberculosis
DLPAASRGSGTV

SEQ ID NO: 1426701 - protein, 6 aa, Mycobacterium tuberculosis
DLPRAT

SEQ ID NO: 1426702 - protein, 4 aa, Mycobacterium tuberculosis
DLSR

SEQ ID NO: 1426703 - protein, 9 aa, Mycobacterium tuberculosis
DNTGGSSSI

SEQ ID NO: 1426704 - protein, 10 aa, Mycobacterium tuberculosis
DNTPSGSTVA

SEQ ID NO: 1426705 - protein, 4 aa, Mycobacterium tuberculosis
DPAK

SEQ ID NO: 1426706 - protein, 8 aa, Mycobacterium tuberculosis
DPDRPLSD

SEQ ID NO: 1426707 - protein, 11 aa, Mycobacterium tuberculosis
DPGRIDETGRR

SEQ ID NO: 1426708 - protein, 5 aa, Mycobacterium tuberculosis
DPHGL

SEQ ID NO: 1426709 - protein, 15 aa, Mycobacterium tuberculosis
DPHSTLRATTDGSGA

SEQ ID NO: 1426710 - protein, 10 aa, Mycobacterium tuberculosis
DPNDPADHER

SEQ ID NO: 1426711 - protein, 7 aa, Mycobacterium tuberculosis
DPRVNPE

SEQ ID NO: 1426712 - protein, 4 aa, Mycobacterium tuberculosis
DPTA

SEQ ID NO: 1426713 - protein, 8 aa, Mycobacterium tuberculosis
DPVEVTGS

SEQ ID NO: 1426714 - protein, 4 aa, Mycobacterium tuberculosis
DPVT

SEQ ID NO: 1426715 - protein, 12 aa, Mycobacterium tuberculosis
DQDRGQTGDSLE

SEQ ID NO: 1426716 - protein, 10 aa, Mycobacterium tuberculosis
DRARDVADTV

SEQ ID NO: 1426717 - protein, 10 aa, Mycobacterium tuberculosis
DRSAPPGPFQ

SEQ ID NO: 1426718 - protein, 6 aa, Mycobacterium tuberculosis
DRTTGD

SEQ ID NO: 1426719 - protein, 6 aa, Mycobacterium tuberculosis
DSPERF

SEQ ID NO: 1426720 - protein, 5 aa, Mycobacterium tuberculosis
DSTDV

SEQ ID NO: 1426721 - protein, 5 aa, Mycobacterium tuberculosis
DSYRI

SEQ ID NO: 1426722 - protein, 5 aa, Mycobacterium tuberculosis
DTEAA

SEQ ID NO: 1426723 - protein, 7 aa, Mycobacterium tuberculosis
DTENAYL

SEQ ID NO: 1426724 - protein, 6 aa, Mycobacterium tuberculosis
DTGLDA

SEQ ID NO: 1426725 - protein, 9 aa, Mycobacterium tuberculosis
DWRGSPDQF

SEQ ID NO: 1426726 - protein, 22 aa, Mycobacterium tuberculosis
EAAADVGADAEAAIAASRSGSQ

SEQ ID NO: 1426727 - protein, 4 aa, Mycobacterium tuberculosis
EAAR

SEQ ID NO: 1426728 - protein, 8 aa, Mycobacterium tuberculosis
EAGETAIG

SEQ ID NO: 1426729 - protein, 5 aa, Mycobacterium tuberculosis
EAGIK

SEQ ID NO: 1426730 - protein, 14 aa, Mycobacterium tuberculosis
EAPSPLLDPQTRER

SEQ ID NO: 1426731 - protein, 7 aa, Mycobacterium tuberculosis
EASEASW

SEQ ID NO: 1426732 - protein, 6 aa, Mycobacterium tuberculosis
EATAAF

SEQ ID NO: 1426733 - protein, 9 aa, Mycobacterium tuberculosis
EDEDELPAG

SEQ ID NO: 1426734 - protein, 8 aa, Mycobacterium tuberculosis
EDQLDPDD

SEQ ID NO: 1426735 - protein, 5 aa, Mycobacterium tuberculosis
EEAHD

SEQ ID NO: 1426736 - protein, 17 aa, Mycobacterium tuberculosis
EELGGGDLHSRTSGVTD

SEQ ID NO: 1426737 - protein, 6 aa, Mycobacterium tuberculosis
EETGIR

SEQ ID NO: 1426738 - protein, 4 aa, Mycobacterium tuberculosis
EEVE

SEQ ID NO: 1426739 - protein, 11 aa, Mycobacterium tuberculosis
EEYGGQGADSV

SEQ ID NO: 1426740 - protein, 11 aa, Mycobacterium tuberculosis
EGAGHFNRGTQ

SEQ ID NO: 1426741 - protein, 4 aa, Mycobacterium tuberculosis
EGFT

SEQ ID NO: 1426742 - protein, 19 aa, Mycobacterium tuberculosis
EGNRALDAGDHDGALRSAS

SEQ ID NO: 1426743 - protein, 5 aa, Mycobacterium tuberculosis
EGTMN

SEQ ID NO: 1426744 - protein, 25 aa, Mycobacterium tuberculosis
EGTTTRIREPTSTREQTQKSPISGE

SEQ ID NO: 1426745 - protein, 6 aa, Mycobacterium tuberculosis
EHRSSV

SEQ ID NO: 1426746 - protein, 6 aa, Mycobacterium tuberculosis
EHTGGG

SEQ ID NO: 1426747 - protein, 20 aa, Mycobacterium tuberculosis
EKSEPLGLKQGAPTKKTGST

SEQ ID NO: 1426748 - protein, 5 aa, Mycobacterium tuberculosis
ELGID

SEQ ID NO: 1426749 - protein, 6 aa, Mycobacterium tuberculosis
ELGSAA

SEQ ID NO: 1426750 - protein, 9 aa, Mycobacterium tuberculosis
ELTSTSNCT

SEQ ID NO: 1426751 - protein, 4 aa, Mycobacterium tuberculosis
EPKM

SEQ ID NO: 1426752 - protein, 9 aa, Mycobacterium tuberculosis
EPTSGNTGI

SEQ ID NO: 1426753 - protein, 6 aa, Mycobacterium tuberculosis
EREPGR

SEQ ID NO: 1426754 - protein, 4 aa, Mycobacterium tuberculosis
ERGL

SEQ ID NO: 1426755 - protein, 6 aa, Mycobacterium tuberculosis
ERPNAG

SEQ ID NO: 1426756 - protein, 11 aa, Mycobacterium tuberculosis
ERRQNHAARQR

SEQ ID NO: 1426757 - protein, 10 aa, Mycobacterium tuberculosis
ERTEDGFGQG

SEQ ID NO: 1426758 - protein, 11 aa, Mycobacterium tuberculosis
ESGLRASAKGY

SEQ ID NO: 1426759 - protein, 4 aa, Mycobacterium tuberculosis
ESGM

SEQ ID NO: 1426760 - protein, 4 aa, Mycobacterium tuberculosis
ESRA

SEQ ID NO: 1426761 - protein, 6 aa, Mycobacterium tuberculosis
ETEGRP

SEQ ID NO: 1426762 - protein, 4 aa, Mycobacterium tuberculosis
ETEI

SEQ ID NO: 1426763 - protein, 13 aa, Mycobacterium tuberculosis
EWHGPASASMTAA

SEQ ID NO: 1426764 - protein, 4 aa, Mycobacterium tuberculosis
FEGE

SEQ ID NO: 1426765 - protein, 23 aa, Mycobacterium tuberculosis
FGGLGGGSNGTGGAGGAGGTGAT

SEQ ID NO: 1426766 - protein, 9 aa, Mycobacterium tuberculosis
FGPEKTAQI

SEQ ID NO: 1426767 - protein, 35 aa, Mycobacterium tuberculosis; identical to SEQ ID NO: 174397

SEQ ID NO: 1426768 - protein, 5 aa, Mycobacterium tuberculosis
FGPPD

SEQ ID NO: 1426769 - protein, 5 aa, Mycobacterium tuberculosis
FGQSL

SEQ ID NO: 1426770 - protein, 5 aa, Mycobacterium tuberculosis
FRDGS

SEQ ID NO: 1426771 - protein, 11 aa, Mycobacterium tuberculosis
FRGQGASHGAQ

SEQ ID NO: 1426772 - protein, 7 aa, Mycobacterium tuberculosis
FSARRGT

SEQ ID NO: 1426773 - protein, 5 aa, Mycobacterium tuberculosis
GAEGD

SEQ ID NO: 1426774 - protein, 23 aa, Mycobacterium tuberculosis
GAGGAGGAATTGTGGAGGAGSNA

SEQ ID NO: 1426775 - protein, 24 aa, Mycobacterium tuberculosis
GAGGAGGTGTNVTGGAGGAGGNGG

SEQ ID NO: 1426776 - protein, 5 aa, Mycobacterium tuberculosis
GALPG

SEQ ID NO: 1426777 - protein, 5 aa, Mycobacterium tuberculosis
GAPEH

SEQ ID NO: 1426778 - protein, 5 aa, Mycobacterium tuberculosis
GAPPI

SEQ ID NO: 1426779 - protein, 8 aa, Mycobacterium tuberculosis
GAQLDGPE

SEQ ID NO: 1426780 - protein, 5 aa, Mycobacterium tuberculosis
GARTH

SEQ ID NO: 1426781 - protein, 7 aa, Mycobacterium tuberculosis
GAYSRDR

SEQ ID NO: 1426782 - protein, 8 aa, Mycobacterium tuberculosis
GCSAGGTD

SEQ ID NO: 1426783 - protein, 4 aa, Mycobacterium tuberculosis
GDKK

SEQ ID NO: 1426784 - protein, 9 aa, Mycobacterium tuberculosis
GDLTGEAAQ

SEQ ID NO: 1426785 - protein, 8 aa, Mycobacterium tuberculosis
GDNSTELA

SEQ ID NO: 1426786 - protein, 5 aa, Mycobacterium tuberculosis
GDPGT

SEQ ID NO: 1426787 - protein, 22 aa, Mycobacterium tuberculosis
GDQRIRGRSGYQYASGDTADTV

SEQ ID NO: 1426788 - protein, 8 aa, Mycobacterium tuberculosis
GDSAGGGL

SEQ ID NO: 1426789 - protein, 7 aa, Mycobacterium tuberculosis
GDVAPGR

SEQ ID NO: 1426790 - protein, 8 aa, Mycobacterium tuberculosis
GDVDGPES

SEQ ID NO: 1426791 - protein, 5 aa, Mycobacterium tuberculosis
GEAPV

SEQ ID NO: 1426792 - protein, 16 aa, Mycobacterium tuberculosis
GEDGTTPGGNGGAGGV

SEQ ID NO: 1426793 - protein, 4 aa, Mycobacterium tuberculosis
GEDI

SEQ ID NO: 1426794 - protein, 8 aa, Mycobacterium tuberculosis
GEGELPQT

SEQ ID NO: 1426795 - protein, 7 aa, Mycobacterium tuberculosis
GEIDGRN

SEQ ID NO: 1426796 - protein, 16 aa, Mycobacterium tuberculosis
GELAPGDVITSAGVFL

SEQ ID NO: 1426797 - protein, 13 aa, Mycobacterium tuberculosis
GELRKGDRVAQPR

SEQ ID NO: 1426798 - protein, 16 aa, Mycobacterium tuberculosis
GELTASDIDDPERPNA

SEQ ID NO: 1426799 - protein, 9 aa, Mycobacterium tuberculosis
GERSSPVAD

SEQ ID NO: 1426800 - protein, 5 aa, Mycobacterium tuberculosis
GFPNA

SEQ ID NO: 1426801 - protein, 12 aa, Mycobacterium tuberculosis
GGAGGAGGAATS

SEQ ID NO: 1426802 - protein, 45 aa, Mycobacterium tuberculosis; identical to SEQ ID NO: 175515

SEQ ID NO: 1426803 - protein, 27 aa, Mycobacterium tuberculosis
GGAGGHGGAGTNGGAGGAGGAGGSSGT

SEQ ID NO: 1426804 - protein, 4 aa, Mycobacterium tuberculosis
GGAM

SEQ ID NO: 1426805 - protein, 73 aa, Mycobacterium tuberculosis; identical to SEQ ID NO: 175660

SEQ ID NO: 1426806 - protein, 4 aa, Mycobacterium tuberculosis
GGGH

SEQ ID NO: 1426807 - protein, 7 aa, Mycobacterium tuberculosis
GGGPPDV

SEQ ID NO: 1426808 - protein, 9 aa, Mycobacterium tuberculosis
GGGSGIGKG

SEQ ID NO: 1426809 - protein, 8 aa, Mycobacterium tuberculosis
GGHGPAER

SEQ ID NO: 1426810 - protein, 5 aa, Mycobacterium tuberculosis
GGLDS

SEQ ID NO: 1426811 - protein, 21 aa, Mycobacterium tuberculosis
GGMGGSGGGIGAGTTTVVPPD

SEQ ID NO: 1426812 - protein, 53 aa, Mycobacterium tuberculosis; identical to SEQ ID NO: 229863

SEQ ID NO: 1426813 - protein, 6 aa, Mycobacterium tuberculosis
GGNVGA

SEQ ID NO: 1426814 - protein, 7 aa, Mycobacterium tuberculosis
GGPGAGF

SEQ ID NO: 1426815 - protein, 4 aa, Mycobacterium tuberculosis
GGQT

SEQ ID NO: 1426816 - protein, 5 aa, Mycobacterium tuberculosis
GGRLT

SEQ ID NO: 1426817 - protein, 6 aa, Mycobacterium tuberculosis
GGSTAT

SEQ ID NO: 1426818 - protein, 27 aa, Mycobacterium tuberculosis
GGVGGSGGAGVGAGVAGGHGGAGGAAG

SEQ ID NO: 1426819 - protein, 6 aa, Mycobacterium tuberculosis
GHDEHG

SEQ ID NO: 1426820 - protein, 6 aa, Mycobacterium tuberculosis
GIGVTS

SEQ ID NO: 1426821 - protein, 13 aa, Mycobacterium tuberculosis
GINDDTIEQAAEA

SEQ ID NO: 1426822 - protein, 8 aa, Mycobacterium tuberculosis
GKRHPTVG

SEQ ID NO: 1426823 - protein, 12 aa, Mycobacterium tuberculosis
GKTGEAEFPGGS

SEQ ID NO: 1426824 - protein, 10 aa, Mycobacterium tuberculosis
GLAAADTGLN

SEQ ID NO: 1426825 - protein, 8 aa, Mycobacterium tuberculosis
GLAENAEA

SEQ ID NO: 1426826 - protein, 5 aa, Mycobacterium tuberculosis
GLASG

SEQ ID NO: 1426827 - protein, 6 aa, Mycobacterium tuberculosis
GLETEA

SEQ ID NO: 1426828 - protein, 15 aa, Mycobacterium tuberculosis
GLHSDGPRNPFTPKR

SEQ ID NO: 1426829 - protein, 6 aa, Mycobacterium tuberculosis
GLPDEV

SEQ ID NO: 1426830 - protein, 14 aa, Mycobacterium tuberculosis
GLPGNGGAGGNAGL

SEQ ID NO: 1426831 - protein, 7 aa, Mycobacterium tuberculosis
GLTGVSS

SEQ ID NO: 1426832 - protein, 13 aa, Mycobacterium tuberculosis
GMGGNGGATSVGG

SEQ ID NO: 1426833 - protein, 25 aa, Mycobacterium tuberculosis
GNGGAGGAGGDGPGNGAAGGAGGAG

SEQ ID NO: 1426834 - protein, 11 aa, Mycobacterium tuberculosis
GNGGAGGSGGS

SEQ ID NO: 1426835 - protein, 40 aa, Mycobacterium tuberculosis
GNGGNAGAGSGLAGADGGLFGNGGDGGSSTSKAGGAGGNA

SEQ ID NO: 1426836 - protein, 11 aa, Mycobacterium tuberculosis
GNGGNGGAGGF

SEQ ID NO: 1426837 - protein, 36 aa, Mycobacterium tuberculosis; identical to SEQ ID NO: 176415

SEQ ID NO: 1426838 - protein, 19 aa, Mycobacterium tuberculosis
GNGGNGGMGGAGAAGVNAV

SEQ ID NO: 1426839 - protein, 72 aa, Mycobacterium tuberculosis
GNGGQGGAGGTGGDHSGGNGIGGKGGASGNGGNAGQVFGDGGTGGTGGAGGAGSGTKAGGTGSDGGHGGNAT

SEQ ID NO: 1426840 - protein, 26 aa, Mycobacterium tuberculosis
GNGNVGIGNSGNYNTGLGNVGNANTG

SEQ ID NO: 1426841 - protein, 4 aa, Mycobacterium tuberculosis
GNIP

SEQ ID NO: 1426842 - protein, 7 aa, Mycobacterium tuberculosis
GPADNLT

SEQ ID NO: 1426843 - protein, 6 aa, Mycobacterium tuberculosis
GPAFSA

SEQ ID NO: 1426844 - protein, 7 aa, Mycobacterium tuberculosis
GPAGERY

SEQ ID NO: 1426845 - protein, 6 aa, Mycobacterium tuberculosis
GPAKRM

SEQ ID NO: 1426846 - protein, 6 aa, Mycobacterium tuberculosis
GPASTN

SEQ ID NO: 1426847 - protein, 7 aa, Mycobacterium tuberculosis
GPDAADP

SEQ ID NO: 1426848 - protein, 20 aa, Mycobacterium tuberculosis
GPDNRLAEKGWTTRKNTHGH

SEQ ID NO: 1426849 - protein, 5 aa, Mycobacterium tuberculosis
GPDRL

SEQ ID NO: 1426850 - protein, 27 aa, Mycobacterium tuberculosis
GPEPATSGKRAPLDESPRHEKLDGGAG

SEQ ID NO: 1426851 - protein, 5 aa, Mycobacterium tuberculosis
GPGRV

SEQ ID NO: 1426852 - protein, 7 aa, Mycobacterium tuberculosis
GPIASTG

SEQ ID NO: 1426853 - protein, 11 aa, Mycobacterium tuberculosis
GPNTGTPITSV

SEQ ID NO: 1426854 - protein, 5 aa, Mycobacterium tuberculosis
GPRHI

SEQ ID NO: 1426855 - protein, 16 aa, Mycobacterium tuberculosis
GPSDVVGRAGPDRAHT

SEQ ID NO: 1426856 - protein, 5 aa, Mycobacterium tuberculosis
GPSIS

SEQ ID NO: 1426857 - protein, 4 aa, Mycobacterium tuberculosis
GPTT

SEQ ID NO: 1426858 - protein, 31 aa, Mycobacterium tuberculosis
GPVAAPAAPVVGGSAVPAGPLPAYGSDLRPP

SEQ ID NO: 1426859 - protein, 8 aa, Mycobacterium tuberculosis
GPWSGPAS

SEQ ID NO: 1426860 - protein, 5 aa, Mycobacterium tuberculosis
GPYGY

SEQ ID NO: 1426861 - protein, 7 aa, Mycobacterium tuberculosis
GQAWQGP

SEQ ID NO: 1426862 - protein, 9 aa, Mycobacterium tuberculosis
GQLAKADGA

SEQ ID NO: 1426863 - protein, 10 aa, Mycobacterium tuberculosis
GQNPSTKSAR

SEQ ID NO: 1426864 - protein, 5 aa, Mycobacterium tuberculosis
GRPPV

SEQ ID NO: 1426865 - protein, 5 aa, Mycobacterium tuberculosis
GRQVD

SEQ ID NO: 1426866 - protein, 9 aa, Mycobacterium tuberculosis
GRSGPEQAA

SEQ ID NO: 1426867 - protein, 13 aa, Mycobacterium tuberculosis
GRSSHLGTGGMAS

SEQ ID NO: 1426868 - protein, 5 aa, Mycobacterium tuberculosis
GRVSR

SEQ ID NO: 1426869 - protein, 19 aa, Mycobacterium tuberculosis
GSAAPTDPSSSSTDSPVDA

SEQ ID NO: 1426870 - protein, 10 aa, Mycobacterium tuberculosis
GSAKQAERSY

SEQ ID NO: 1426871 - protein, 13 aa, Mycobacterium tuberculosis
GSDAERAQKRSRL

SEQ ID NO: 1426872 - protein, 10 aa, Mycobacterium tuberculosis
GSDPTVRGQG

SEQ ID NO: 1426873 - protein, 55 aa, Mycobacterium tuberculosis
GSGGAGGEGGAALSVGDTGGAGGVGGSAGLIGTGGNGGNGGTGANAGSPGTGGAG

SEQ ID NO: 1426874 - protein, 6 aa, Mycobacterium tuberculosis
GSGMVG

SEQ ID NO: 1426875 - protein, 4 aa, Mycobacterium tuberculosis
GSGN

SEQ ID NO: 1426876 - protein, 9 aa, Mycobacterium tuberculosis
GSNAPVSTS

SEQ ID NO: 1426877 - protein, 62 aa, Mycobacterium tuberculosis; identical to SEQ ID NO: 177441

SEQ ID NO: 1426878 - protein, 16 aa, Mycobacterium tuberculosis
GTGGIKGFKNAEPADI

SEQ ID NO: 1426879 - protein, 7 aa, Mycobacterium tuberculosis
GTMSGMQ

SEQ ID NO: 1426880 - protein, 5 aa, Mycobacterium tuberculosis
GTTSL

SEQ ID NO: 1426881 - protein, 12 aa, Mycobacterium tuberculosis
GVGASGNNGTSA

SEQ ID NO: 1426882 - protein, 19 aa, Mycobacterium tuberculosis
GVGGLGGAGAAGGNGGAGG

SEQ ID NO: 1426883 - protein, 5 aa, Mycobacterium tuberculosis
GVGGS

SEQ ID NO: 1426884 - protein, 18 aa, Mycobacterium tuberculosis
GVPARNEPPSDPSAPIPG

SEQ ID NO: 1426885 - protein, 8 aa, Mycobacterium tuberculosis
GVRPGDPY

SEQ ID NO: 1426886 - protein, 6 aa, Mycobacterium tuberculosis
GWQGGE

SEQ ID NO: 1426887 - protein, 16 aa, Mycobacterium tuberculosis
GYERRPANAPAVQGQP

SEQ ID NO: 1426888 - protein, 4 aa, Mycobacterium tuberculosis
GYRP

SEQ ID NO: 1426889 - protein, 8 aa, Mycobacterium tuberculosis
GYRPTGRS

SEQ ID NO: 1426890 - protein, 5 aa, Mycobacterium tuberculosis
HAPKT

SEQ ID NO: 1426891 - protein, 5 aa, Mycobacterium tuberculosis
HAPPE

SEQ ID NO: 1426892 - protein, 9 aa, Mycobacterium tuberculosis
HDQTAARRE

SEQ ID NO: 1426893 - protein, 12 aa, Mycobacterium tuberculosis
HENASAAASTTA

SEQ ID NO: 1426894 - protein, 14 aa, Mycobacterium tuberculosis
HGGAGGAGGDRAGA

SEQ ID NO: 1426895 - protein, 6 aa, Mycobacterium tuberculosis
HNPAAY

SEQ ID NO: 1426896 - protein, 5 aa, Mycobacterium tuberculosis
HPDLP

SEQ ID NO: 1426897 - protein, 13 aa, Mycobacterium tuberculosis
HPTTDSLTESANR

SEQ ID NO: 1426898 - protein, 9 aa, Mycobacterium tuberculosis
HRNAEDALQ

SEQ ID NO: 1426899 - protein, 10 aa, Mycobacterium tuberculosis
HSDPKRGEQL

SEQ ID NO: 1426900 - protein, 6 aa, Mycobacterium tuberculosis
HTEYDT

SEQ ID NO: 1426901 - protein, 4 aa, Mycobacterium tuberculosis
HTSG

SEQ ID NO: 1426902 - protein, 5 aa, Mycobacterium tuberculosis
HVRGQ

SEQ ID NO: 1426903 - protein, 7 aa, Mycobacterium tuberculosis
HYERSKD

SEQ ID NO: 1426904 - protein, 11 aa, Mycobacterium tuberculosis
HYGSPDKDPAV

SEQ ID NO: 1426905 - protein, 12 aa, Mycobacterium tuberculosis
IAGGPEKCALLT

SEQ ID NO: 1426906 - protein, 8 aa, Mycobacterium tuberculosis
IDAGPTNN

SEQ ID NO: 1426907 - protein, 8 aa, Mycobacterium tuberculosis
IDPPWETR

SEQ ID NO: 1426908 - protein, 12 aa, Mycobacterium tuberculosis
IGDGNRGSGNVG

SEQ ID NO: 1426909 - protein, 9 aa, Mycobacterium tuberculosis
IGERGALET

SEQ ID NO: 1426910 - protein, 24 aa, Mycobacterium tuberculosis
IGGTGGSGGIGTTGQGGTGGTGGA

SEQ ID NO: 1426911 - protein, 12 aa, Mycobacterium tuberculosis
IGGTGGTGGNAG

SEQ ID NO: 1426912 - protein, 6 aa, Mycobacterium tuberculosis
INEGSA

SEQ ID NO: 1426913 - protein, 5 aa, Mycobacterium tuberculosis
IPDEA

SEQ ID NO: 1426914 - protein, 8 aa, Mycobacterium tuberculosis
IPGHGRDK

SEQ ID NO: 1426915 - protein, 16 aa, Mycobacterium tuberculosis
IPRKPNGKIDSDNLPR

SEQ ID NO: 1426916 - protein, 4 aa, Mycobacterium tuberculosis
IPTQ

SEQ ID NO: 1426917 - protein, 4 aa, Mycobacterium tuberculosis
IRPP

SEQ ID NO: 1426918 - protein, 5 aa, Mycobacterium tuberculosis
IRTGT

SEQ ID NO: 1426919 - protein, 9 aa, Mycobacterium tuberculosis
ISNSGTGFN

SEQ ID NO: 1426920 - protein, 6 aa, Mycobacterium tuberculosis
ITDSPR

SEQ ID NO: 1426921 - protein, 6 aa, Mycobacterium tuberculosis
KAFARE

SEQ ID NO: 1426922 - protein, 6 aa, Mycobacterium tuberculosis
KAKGLD

SEQ ID NO: 1426923 - protein, 14 aa, Mycobacterium tuberculosis
KARLNRSSVRSTRD

SEQ ID NO: 1426924 - protein, 20 aa, Mycobacterium tuberculosis
KASTPRRPMPGRRLGVNVVF

SEQ ID NO: 1426925 - protein, 7 aa, Mycobacterium tuberculosis
KASVSKR

SEQ ID NO: 1426926 - protein, 8 aa, Mycobacterium tuberculosis
KCESASGV

SEQ ID NO: 1426927 - protein, 7 aa, Mycobacterium tuberculosis
KGGDYLA

SEQ ID NO: 1426928 - protein, 12 aa, Mycobacterium tuberculosis
KIGGRGKAGGVK

SEQ ID NO: 1426929 - protein, 4 aa, Mycobacterium tuberculosis
KIQL

SEQ ID NO: 1426930 - protein, 11 aa, Mycobacterium tuberculosis
KKRDTAKAGDN

SEQ ID NO: 1426931 - protein, 4 aa, Mycobacterium tuberculosis
KPID

SEQ ID NO: 1426932 - protein, 5 aa, Mycobacterium tuberculosis
KPIDP

SEQ ID NO: 1426933 - protein, 10 aa, Mycobacterium tuberculosis
KQGRTTGNSC

SEQ ID NO: 1426934 - protein, 7 aa, Mycobacterium tuberculosis
KQPGEVR

SEQ ID NO: 1426935 - protein, 6 aa, Mycobacterium tuberculosis
KRPELR

SEQ ID NO: 1426936 - protein, 6 aa, Mycobacterium tuberculosis
KSEVGD

SEQ ID NO: 1426937 - protein, 7 aa, Mycobacterium tuberculosis
KSLTLDP

SEQ ID NO: 1426938 - protein, 6 aa, Mycobacterium tuberculosis
KTDLPL

SEQ ID NO: 1426939 - protein, 5 aa, Mycobacterium tuberculosis
KTPEQ

SEQ ID NO: 1426940 - protein, 7 aa, Mycobacterium tuberculosis
KVAPDGV

SEQ ID NO: 1426941 - protein, 8 aa, Mycobacterium tuberculosis
KVGDGSGL

SEQ ID NO: 1426942 - protein, 16 aa, Mycobacterium tuberculosis
KYDSAPANRYRLPDGT

SEQ ID NO: 1426943 - protein, 4 aa, Mycobacterium tuberculosis
KYST

SEQ ID NO: 1426944 - protein, 17 aa, Mycobacterium tuberculosis
LADTVDRARDDTVADSW

SEQ ID NO: 1426945 - protein, 11 aa, Mycobacterium tuberculosis
LAEKRPPPAPR

SEQ ID NO: 1426946 - protein, 8 aa, Mycobacterium tuberculosis
LAEPTNSA

SEQ ID NO: 1426947 - protein, 8 aa, Mycobacterium tuberculosis
LARPGTEI

SEQ ID NO: 1426948 - protein, 15 aa, Mycobacterium tuberculosis
LATSTGELAQAAESA

SEQ ID NO: 1426949 - protein, 7 aa, Mycobacterium tuberculosis
LDAEVPA

SEQ ID NO: 1426950 - protein, 80 aa, Mycobacterium tuberculosis
LDGKGQAGNGGNGGNGAAGGAGGGGTGAGGNGGAGGNGGDGGPSQGGGNPGFGGDGGTGGPGGVGVPDGIGGANGAQGKH

SEQ ID NO: 1426951 - protein, 7 aa, Mycobacterium tuberculosis
LDGPTTA

SEQ ID NO: 1426952 - protein, 5 aa, Mycobacterium tuberculosis
LDSDP

SEQ ID NO: 1426953 - protein, 19 aa, Mycobacterium tuberculosis
LDTTTEGPVTTSGATCADN

SEQ ID NO: 1426954 - protein, 13 aa, Mycobacterium tuberculosis
LGGNGGDGGDGGG

SEQ ID NO: 1426955 - protein, 4 aa, Mycobacterium tuberculosis
LGGV

SEQ ID NO: 1426956 - protein, 6 aa, Mycobacterium tuberculosis
LGKTYG

SEQ ID NO: 1426957 - protein, 26 aa, Mycobacterium tuberculosis
LGNGNTGNANLGSGNTGQANLGSGNT

SEQ ID NO: 1426958 - protein, 7 aa, Mycobacterium tuberculosis
LGRPVGK

SEQ ID NO: 1426959 - protein, 10 aa, Mycobacterium tuberculosis
LGRRPRPTRE

SEQ ID NO: 1426960 - protein, 11 aa, Mycobacterium tuberculosis
LGSGNDGNGNF

SEQ ID NO: 1426961 - protein, 4 aa, Mycobacterium tuberculosis
LGSP

SEQ ID NO: 1426962 - protein, 5 aa, Mycobacterium tuberculosis
LGTPQ

SEQ ID NO: 1426963 - protein, 7 aa, Mycobacterium tuberculosis
LKPPQHG

SEQ ID NO: 1426964 - protein, 12 aa, Mycobacterium tuberculosis
LKRNEANDLRNE

SEQ ID NO: 1426965 - protein, 4 aa, Mycobacterium tuberculosis
LMPG

SEQ ID NO: 1426966 - protein, 9 aa, Mycobacterium tuberculosis
LNPTGSFKD

SEQ ID NO: 1426967 - protein, 33 aa, Mycobacterium tuberculosis
LPAAEEAALEEGLEGAGLSELGAAEAAVGEAPI

SEQ ID NO: 1426968 - protein, 9 aa, Mycobacterium tuberculosis
LPETRDAAK

SEQ ID NO: 1426969 - protein, 15 aa, Mycobacterium tuberculosis
LPGPNGPEPDPRTAP

SEQ ID NO: 1426970 - protein, 10 aa, Mycobacterium tuberculosis
LPPGATGVQA

SEQ ID NO: 1426971 - protein, 11 aa, Mycobacterium tuberculosis
LPPNESRLRPE

SEQ ID NO: 1426972 - protein, 8 aa, Mycobacterium tuberculosis
LPREAGDA

SEQ ID NO: 1426973 - protein, 11 aa, Mycobacterium tuberculosis
LPSGRALESRP

SEQ ID NO: 1426974 - protein, 7 aa, Mycobacterium tuberculosis
LQSRPSH

SEQ ID NO: 1426975 - protein, 8 aa, Mycobacterium tuberculosis
LRDDGTTT

SEQ ID NO: 1426976 - protein, 10 aa, Mycobacterium tuberculosis
LRSNPEDDRA

SEQ ID NO: 1426977 - protein, 11 aa, Mycobacterium tuberculosis
LRSNPEDDRSE

SEQ ID NO: 1426978 - protein, 9 aa, Mycobacterium tuberculosis
LRSRDEQRG

SEQ ID NO: 1426979 - protein, 4 aa, Mycobacterium tuberculosis
LSCS

SEQ ID NO: 1426980 - protein, 27 aa, Mycobacterium tuberculosis
LSGTGTDRLDGDGPSDDDSWNDEDDWR

SEQ ID NO: 1426981 - protein, 8 aa, Mycobacterium tuberculosis
LSQKGTAI

SEQ ID NO: 1426982 - protein, 4 aa, Mycobacterium tuberculosis
LSQV

SEQ ID NO: 1426983 - protein, 4 aa, Mycobacterium tuberculosis
LSST

SEQ ID NO: 1426984 - protein, 10 aa, Mycobacterium tuberculosis
LTDEQRAAAL

SEQ ID NO: 1426985 - protein, 4 aa, Mycobacterium tuberculosis
LTEP

SEQ ID NO: 1426986 - protein, 16 aa, Mycobacterium tuberculosis
LTGQPAKQTPFAPLPG

SEQ ID NO: 1426987 - protein, 5 aa, Mycobacterium tuberculosis
LTPAE

SEQ ID NO: 1426988 - protein, 4 aa, Mycobacterium tuberculosis
LYRN

SEQ ID NO: 1426989 - protein, 4 aa, Mycobacterium tuberculosis
MEKP

SEQ ID NO: 1426990 - protein, 4 aa, Mycobacterium tuberculosis
MGQG

SEQ ID NO: 1426991 - protein, 5 aa, Mycobacterium tuberculosis
MNTTG

SEQ ID NO: 1426992 - protein, 5 aa, Mycobacterium tuberculosis
MPTSP

SEQ ID NO: 1426993 - protein, 10 aa, Mycobacterium tuberculosis
MTSGSSSGFK

SEQ ID NO: 1426994 - protein, 12 aa, Mycobacterium tuberculosis
NAADAPAYGGHN

SEQ ID NO: 1426995 - protein, 9 aa, Mycobacterium tuberculosis
NAARTQARQ

SEQ ID NO: 1426996 - protein, 16 aa, Mycobacterium tuberculosis
NAEIPGVGPSESEVGP

SEQ ID NO: 1426997 - protein, 9 aa, Mycobacterium tuberculosis
NANGSGAGV

SEQ ID NO: 1426998 - protein, 31 aa, Mycobacterium tuberculosis
NDAQSQPFTTEPELRPQPSSTPPPPPPLPPV

SEQ ID NO: 1426999 - protein, 4 aa, Mycobacterium tuberculosis
NDPH

SEQ ID NO: 1427000 - protein, 8 aa, Mycobacterium tuberculosis
NDSITPDD

SEQ ID NO: 1427001 - protein, 5 aa, Mycobacterium tuberculosis
NETRT

SEQ ID NO: 1427002 - protein, 17 aa, Mycobacterium tuberculosis
NGADGAPGTGQAGGAGG

SEQ ID NO: 1427003 - protein, 17 aa, Mycobacterium tuberculosis
NGANGAPGTGQAGGDGG

SEQ ID NO: 1427004 - protein, 20 aa, Mycobacterium tuberculosis
NGGAGGAGGFGANGGTGGNG

SEQ ID NO: 1427005 - protein, 20 aa, Mycobacterium tuberculosis
NGGAGGNGGSAAAAGGAGGN

SEQ ID NO: 1427006 - protein, 14 aa, Mycobacterium tuberculosis
NGGAGGSGGPTQIP

SEQ ID NO: 1427007 - protein, 9 aa, Mycobacterium tuberculosis
NGGGPRGTD

SEQ ID NO: 1427008 - protein, 47 aa, Mycobacterium tuberculosis
NGGNGGSGAPGQRGGAGGAAGLIGNGGNGGAGGVGTTGGAGGHGGAG

SEQ ID NO: 1427009 - protein, 22 aa, Mycobacterium tuberculosis
NGGNGGSGVAGVGGPGGSGGAA

SEQ ID NO: 1427010 - protein, 25 aa, Mycobacterium tuberculosis
NGGTGGSGGAGGAGSVGNGGAGGNA

SEQ ID NO: 1427011 - protein, 8 aa, Mycobacterium tuberculosis
NGTAKEIA

SEQ ID NO: 1427012 - protein, 4 aa, Mycobacterium tuberculosis
NLDK

SEQ ID NO: 1427013 - protein, 5 aa, Mycobacterium tuberculosis
NLTAA

SEQ ID NO: 1427014 - protein, 14 aa, Mycobacterium tuberculosis
NLYGPGDNFSPSGS

SEQ ID NO: 1427015 - protein, 26 aa, Mycobacterium tuberculosis
NPAPYRGRQRGADRCADADAPAHPDR

SEQ ID NO: 1427016 - protein, 8 aa, Mycobacterium tuberculosis
NPATGETV

SEQ ID NO: 1427017 - protein, 8 aa, Mycobacterium tuberculosis
NPDRTAGA

SEQ ID NO: 1427018 - protein, 19 aa, Mycobacterium tuberculosis
NPGPSNTGTFNTGGANTGW

SEQ ID NO: 1427019 - protein, 7 aa, Mycobacterium tuberculosis
NPKGKYQ

SEQ ID NO: 1427020 - protein, 6 aa, Mycobacterium tuberculosis
NPKRGI

SEQ ID NO: 1427021 - protein, 6 aa, Mycobacterium tuberculosis
NQGAPM

SEQ ID NO: 1427022 - protein, 12 aa, Mycobacterium tuberculosis
NQKGGVGKTTTA

SEQ ID NO: 1427023 - protein, 6 aa, Mycobacterium tuberculosis
NQTGSA

SEQ ID NO: 1427024 - protein, 6 aa, Mycobacterium tuberculosis
NRAPNN

SEQ ID NO: 1427025 - protein, 9 aa, Mycobacterium tuberculosis
NRQSELPSR

SEQ ID NO: 1427026 - protein, 17 aa, Mycobacterium tuberculosis
NRSQQSGRRQPDSLSDY

SEQ ID NO: 1427027 - protein, 17 aa, Mycobacterium tuberculosis
NSGDGSASGFGNVGPGI

SEQ ID NO: 1427028 - protein, 10 aa, Mycobacterium tuberculosis
NSGTDLPPTP

SEQ ID NO: 1427029 - protein, 5 aa, Mycobacterium tuberculosis
NSTRT

SEQ ID NO: 1427030 - protein, 18 aa, Mycobacterium tuberculosis
NTSVPAANRLTAAPDRAN

SEQ ID NO: 1427031 - protein, 29 aa, Mycobacterium tuberculosis
NTTVSRDGLTTPGVDRLGPGGISGPPLAQ

SEQ ID NO: 1427032 - protein, 6 aa, Mycobacterium tuberculosis
NVATSR

SEQ ID NO: 1427033 - protein, 5 aa, Mycobacterium tuberculosis
NVVER

SEQ ID NO: 1427034 - protein, 8 aa, Mycobacterium tuberculosis
PAAAEGSV

SEQ ID NO: 1427035 - protein, 13 aa, Mycobacterium tuberculosis
PADEATAAGEVAV

SEQ ID NO: 1427036 - protein, 26 aa, Mycobacterium tuberculosis
PAGQRRRLPGKPAIDDRALAGASRSA

SEQ ID NO: 1427037 - protein, 7 aa, Mycobacterium tuberculosis
PANPPPR

SEQ ID NO: 1427038 - protein, 18 aa, Mycobacterium tuberculosis
PAQVEGATKLPTSPGYTE

SEQ ID NO: 1427039 - protein, 12 aa, Mycobacterium tuberculosis
PASNDFASSDFP

SEQ ID NO: 1427040 - protein, 10 aa, Mycobacterium tuberculosis
PATEDPEFTE

SEQ ID NO: 1427041 - protein, 8 aa, Mycobacterium tuberculosis
PATTTPAN

SEQ ID NO: 1427042 - protein, 22 aa, Mycobacterium tuberculosis
PDDDGSDGAAKARAYERSATQA

SEQ ID NO: 1427043 - protein, 6 aa, Mycobacterium tuberculosis
PDDPIR

SEQ ID NO: 1427044 - protein, 9 aa, Mycobacterium tuberculosis
PDGSPCPCG

SEQ ID NO: 1427045 - protein, 18 aa, Mycobacterium tuberculosis
PDGTRCQGDWPARQPSTP

SEQ ID NO: 1427046 - protein, 10 aa, Mycobacterium tuberculosis
PDLPTPWPQE

SEQ ID NO: 1427047 - protein, 5 aa, Mycobacterium tuberculosis
PDPRL

SEQ ID NO: 1427048 - protein, 9 aa, Mycobacterium tuberculosis
PDQPQPYGE

SEQ ID NO: 1427049 - protein, 10 aa, Mycobacterium tuberculosis
PDRASGRTAR

SEQ ID NO: 1427050 - protein, 7 aa, Mycobacterium tuberculosis
PDSLADA

SEQ ID NO: 1427051 - protein, 12 aa, Mycobacterium tuberculosis
PDTGLSARGRPL

SEQ ID NO: 1427052 - protein, 11 aa, Mycobacterium tuberculosis
PEAPLRDAPAH

SEQ ID NO: 1427053 - protein, 5 aa, Mycobacterium tuberculosis
PEATA

SEQ ID NO: 1427054 - protein, 5 aa, Mycobacterium tuberculosis
PEKLS

SEQ ID NO: 1427055 - protein, 4 aa, Mycobacterium tuberculosis
PEPI

SEQ ID NO: 1427056 - protein, 9 aa, Mycobacterium tuberculosis
PERQSSEEL

SEQ ID NO: 1427057 - protein, 9 aa, Mycobacterium tuberculosis
PETQDSDDV

SEQ ID NO: 1427058 - protein, 5 aa, Mycobacterium tuberculosis
PGAGK

SEQ ID NO: 1427059 - protein, 34 aa, Mycobacterium tuberculosis
PGALGAGAEGANKDKPVEKRVTAPAVPNGQPVKG

SEQ ID NO: 1427060 - protein, 14 aa, Mycobacterium tuberculosis
PGGHKLDDDTEDQI

SEQ ID NO: 1427061 - protein, 15 aa, Mycobacterium tuberculosis
PGGRLRNDEDMTSSV

SEQ ID NO: 1427062 - protein, 21 aa, Mycobacterium tuberculosis
PGLNGSGGDGGDGGNGAPGGV

SEQ ID NO: 1427063 - protein, 16 aa, Mycobacterium tuberculosis
PGLSQPSDVLPADDGA

SEQ ID NO: 1427064 - protein, 4 aa, Mycobacterium tuberculosis
PGPR

SEQ ID NO: 1427065 - protein, 4 aa, Mycobacterium tuberculosis
PGTP

SEQ ID NO: 1427066 - protein, 5 aa, Mycobacterium tuberculosis
PHPLS

SEQ ID NO: 1427067 - protein, 17 aa, Mycobacterium tuberculosis
PIDDPMRATSEAAAATV

SEQ ID NO: 1427068 - protein, 8 aa, Mycobacterium tuberculosis
PISDKAAV

SEQ ID NO: 1427069 - protein, 4 aa, Mycobacterium tuberculosis
PKLG

SEQ ID NO: 1427070 - protein, 8 aa, Mycobacterium tuberculosis
PKTGQPGH

SEQ ID NO: 1427071 - protein, 8 aa, Mycobacterium tuberculosis
PLEPGQQT

SEQ ID NO: 1427072 - protein, 5 aa, Mycobacterium tuberculosis
PLGPD

SEQ ID NO: 1427073 - protein, 20 aa, Mycobacterium tuberculosis
PMGGRDSSSNLGRSQPTVSV

SEQ ID NO: 1427074 - protein, 16 aa, Mycobacterium tuberculosis
PMGSDGGAMGLDPATN

SEQ ID NO: 1427075 - protein, 5 aa, Mycobacterium tuberculosis
PNGAA

SEQ ID NO: 1427076 - protein, 5 aa, Mycobacterium tuberculosis
PPADY

SEQ ID NO: 1427077 - protein, 9 aa, Mycobacterium tuberculosis
PPGPRLSGS

SEQ ID NO: 1427078 - protein, 7 aa, Mycobacterium tuberculosis
PPRGLTA

SEQ ID NO: 1427079 - protein, 7 aa, Mycobacterium tuberculosis
PPVVNPG

SEQ ID NO: 1427080 - protein, 19 aa, Mycobacterium tuberculosis
PQPPLPPDSSSQDCDPTAS

SEQ ID NO: 1427081 - protein, 10 aa, Mycobacterium tuberculosis
PRARKPQRRV

SEQ ID NO: 1427082 - protein, 8 aa, Mycobacterium tuberculosis
PRDSPITK

SEQ ID NO: 1427083 - protein, 5 aa, Mycobacterium tuberculosis
PRGKL

SEQ ID NO: 1427084 - protein, 4 aa, Mycobacterium tuberculosis
PRPE

SEQ ID NO: 1427085 - protein, 8 aa, Mycobacterium tuberculosis
PRQTTADG

SEQ ID NO: 1427086 - protein, 4 aa, Mycobacterium tuberculosis
PRVN

SEQ ID NO: 1427087 - protein, 7 aa, Mycobacterium tuberculosis
PSAGRDQ

SEQ ID NO: 1427088 - protein, 22 aa, Mycobacterium tuberculosis
PTGPERGEAATHSPVRWTGGRD

SEQ ID NO: 1427089 - protein, 4 aa, Mycobacterium tuberculosis
PTKI

SEQ ID NO: 1427090 - protein, 9 aa, Mycobacterium tuberculosis
PTLQGDAAL

SEQ ID NO: 1427091 - protein, 11 aa, Mycobacterium tuberculosis
PTPKARLRPPI

SEQ ID NO: 1427092 - protein, 19 aa, Mycobacterium tuberculosis
PTRRQVDDSLAAAKSKSAL

SEQ ID NO: 1427093 - protein, 5 aa, Mycobacterium tuberculosis
PTSER

SEQ ID NO: 1427094 - protein, 4 aa, Mycobacterium tuberculosis
PTSG

SEQ ID NO: 1427095 - protein, 15 aa, Mycobacterium tuberculosis
PTWERSGRTERGRDG

SEQ ID NO: 1427096 - protein, 24 aa, Mycobacterium tuberculosis
PVPAPAEAPVEASESTGGRGPRPS

SEQ ID NO: 1427097 - protein, 15 aa, Mycobacterium tuberculosis
PWADGGPTSAHNGLG

SEQ ID NO: 1427098 - protein, 10 aa, Mycobacterium tuberculosis
PYGNSGPRID

SEQ ID NO: 1427099 - protein, 10 aa, Mycobacterium tuberculosis
PYRDDAGHSL

SEQ ID NO: 1427100 - protein, 10 aa, Mycobacterium tuberculosis
QAAVAQTGLT

SEQ ID NO: 1427101 - protein, 8 aa, Mycobacterium tuberculosis
QAETSNGA

SEQ ID NO: 1427102 - protein, 17 aa, Mycobacterium tuberculosis
QALADASADRASQIRTV

SEQ ID NO: 1427103 - protein, 5 aa, Mycobacterium tuberculosis
QANTQ

SEQ ID NO: 1427104 - protein, 5 aa, Mycobacterium tuberculosis
QARSI

SEQ ID NO: 1427105 - protein, 7 aa, Mycobacterium tuberculosis
QASERRY

SEQ ID NO: 1427106 - protein, 4 aa, Mycobacterium tuberculosis
QATV

SEQ ID NO: 1427107 - protein, 4 aa, Mycobacterium tuberculosis
QDLA

SEQ ID NO: 1427108 - protein, 5 aa, Mycobacterium tuberculosis
QEAMT

SEQ ID NO: 1427109 - protein, 9 aa, Mycobacterium tuberculosis
QFDTSKRRL

SEQ ID NO: 1427110 - protein, 5 aa, Mycobacterium tuberculosis
QFGKP

SEQ ID NO: 1427111 - protein, 5 aa, Mycobacterium tuberculosis
QGLSL

SEQ ID NO: 1427112 - protein, 7 aa, Mycobacterium tuberculosis
QGNPIRV

SEQ ID NO: 1427113 - protein, 7 aa, Mycobacterium tuberculosis
QGRQPRD

SEQ ID NO: 1427114 - protein, 5 aa, Mycobacterium tuberculosis
QGYQT

SEQ ID NO: 1427115 - protein, 18 aa, Mycobacterium tuberculosis
QHGDAGPDEWAAAPDPLD

SEQ ID NO: 1427116 - protein, 6 aa, Mycobacterium tuberculosis
QHNARG

SEQ ID NO: 1427117 - protein, 4 aa, Mycobacterium tuberculosis
QKKF

SEQ ID NO: 1427118 - protein, 9 aa, Mycobacterium tuberculosis
QNPTIQGRD

SEQ ID NO: 1427119 - protein, 8 aa, Mycobacterium tuberculosis
QNTPAIAA

SEQ ID NO: 1427120 - protein, 12 aa, Mycobacterium tuberculosis
QPEESLAGRTVS

SEQ ID NO: 1427121 - protein, 7 aa, Mycobacterium tuberculosis
QPGGPGG

SEQ ID NO: 1427122 - protein, 6 aa, Mycobacterium tuberculosis
QPPSLL

SEQ ID NO: 1427123 - protein, 4 aa, Mycobacterium tuberculosis
QPRQ

SEQ ID NO: 1427124 - protein, 8 aa, Mycobacterium tuberculosis
QPVSLSPT

SEQ ID NO: 1427125 - protein, 12 aa, Mycobacterium tuberculosis
QQGVRIPGRLQP

SEQ ID NO: 1427126 - protein, 15 aa, Mycobacterium tuberculosis
QRSASVGSHVAIELH

SEQ ID NO: 1427127 - protein, 11 aa, Mycobacterium tuberculosis
QRTAGQSTRSA

SEQ ID NO: 1427128 - protein, 4 aa, Mycobacterium tuberculosis
QSGK

SEQ ID NO: 1427129 - protein, 10 aa, Mycobacterium tuberculosis
QTGEPQSGSE

SEQ ID NO: 1427130 - protein, 5 aa, Mycobacterium tuberculosis
QTGRT

SEQ ID NO: 1427131 - protein, 5 aa, Mycobacterium tuberculosis
QTLGT

SEQ ID NO: 1427132 - protein, 18 aa, Mycobacterium tuberculosis
QTRAQRVTSELSHTQGEL

SEQ ID NO: 1427133 - protein, 5 aa, Mycobacterium tuberculosis
QTRDA

SEQ ID NO: 1427134 - protein, 8 aa, Mycobacterium tuberculosis
QTTDGSIT

SEQ ID NO: 1427135 - protein, 9 aa, Mycobacterium tuberculosis
QVAKQARDI

SEQ ID NO: 1427136 - protein, 6 aa, Mycobacterium tuberculosis
QVDADE

SEQ ID NO: 1427137 - protein, 8 aa, Mycobacterium tuberculosis
RAAERSAE

SEQ ID NO: 1427138 - protein, 18 aa, Mycobacterium tuberculosis
RAAGAKAGISVKPGTPLE

SEQ ID NO: 1427139 - protein, 16 aa, Mycobacterium tuberculosis
RAARRAQRAHPAGAPE

SEQ ID NO: 1427140 - protein, 4 aa, Mycobacterium tuberculosis
RAER

SEQ ID NO: 1427141 - protein, 14 aa, Mycobacterium tuberculosis
RAGTVKPSRDPRAR

SEQ ID NO: 1427142 - protein, 7 aa, Mycobacterium tuberculosis
RAHTDRA

SEQ ID NO: 1427143 - protein, 12 aa, Mycobacterium tuberculosis
RANDDDAGAAGI

SEQ ID NO: 1427144 - protein, 6 aa, Mycobacterium tuberculosis
RASASS

SEQ ID NO: 1427145 - protein, 5 aa, Mycobacterium tuberculosis
RATKG

SEQ ID NO: 1427146 - protein, 6 aa, Mycobacterium tuberculosis
RAVRES

SEQ ID NO: 1427147 - protein, 8 aa, Mycobacterium tuberculosis
RDATDDQV

SEQ ID NO: 1427148 - protein, 7 aa, Mycobacterium tuberculosis
RDLATPE

SEQ ID NO: 1427149 - protein, 4 aa, Mycobacterium tuberculosis
RDPE

SEQ ID NO: 1427150 - protein, 6 aa, Mycobacterium tuberculosis
RDQASA

SEQ ID NO: 1427151 - protein, 8 aa, Mycobacterium tuberculosis
RDRRDFDG

SEQ ID NO: 1427152 - protein, 12 aa, Mycobacterium tuberculosis
REEPDPVTALEG

SEQ ID NO: 1427153 - protein, 12 aa, Mycobacterium tuberculosis
REGAGHFNRGTQ

SEQ ID NO: 1427154 - protein, 10 aa, Mycobacterium tuberculosis
REGSEEYLDS

SEQ ID NO: 1427155 - protein, 11 aa, Mycobacterium tuberculosis
RELTSTSNCTT

SEQ ID NO: 1427156 - protein, 8 aa, Mycobacterium tuberculosis
RGDPLDAR

SEQ ID NO: 1427157 - protein, 10 aa, Mycobacterium tuberculosis
RGERSMKSPG

SEQ ID NO: 1427158 - protein, 12 aa, Mycobacterium tuberculosis
RGGDDDSEMSDG

SEQ ID NO: 1427159 - protein, 6 aa, Mycobacterium tuberculosis
RGPGGG

SEQ ID NO: 1427160 - protein, 4 aa, Mycobacterium tuberculosis
RGRD

SEQ ID NO: 1427161 - protein, 4 aa, Mycobacterium tuberculosis
RGSL

SEQ ID NO: 1427162 - protein, 6 aa, Mycobacterium tuberculosis
RGTDPL

SEQ ID NO: 1427163 - protein, 11 aa, Mycobacterium tuberculosis
RGWKTKEPGIE

SEQ ID NO: 1427164 - protein, 6 aa, Mycobacterium tuberculosis
RKGQDT

SEQ ID NO: 1427165 - protein, 7 aa, Mycobacterium tuberculosis
RKGRIYS

SEQ ID NO: 1427166 - protein, 9 aa, Mycobacterium tuberculosis
RKPTKSPNQ

SEQ ID NO: 1427167 - protein, 13 aa, Mycobacterium tuberculosis
RKVTRRRGALSLV

SEQ ID NO: 1427168 - protein, 10 aa, Mycobacterium tuberculosis
RNGPNPVAEV

SEQ ID NO: 1427169 - protein, 9 aa, Mycobacterium tuberculosis
RPGYGRSTF

SEQ ID NO: 1427170 - protein, 11 aa, Mycobacterium tuberculosis
RPKDDEGGGNA

SEQ ID NO: 1427171 - protein, 22 aa, Mycobacterium tuberculosis
RPLIGNGTNGAPGTGANGGDGG

SEQ ID NO: 1427172 - protein, 5 aa, Mycobacterium tuberculosis
RPVAG

SEQ ID NO: 1427173 - protein, 13 aa, Mycobacterium tuberculosis
RPVGQSRRERGPA

SEQ ID NO: 1427174 - protein, 17 aa, Mycobacterium tuberculosis
RQASTARLAEAADNPRS

SEQ ID NO: 1427175 - protein, 9 aa, Mycobacterium tuberculosis
RQPGKPSWN

SEQ ID NO: 1427176 - protein, 7 aa, Mycobacterium tuberculosis
RQPTVSG

SEQ ID NO: 1427177 - protein, 8 aa, Mycobacterium tuberculosis
RQSCDGCQ

SEQ ID NO: 1427178 - protein, 6 aa, Mycobacterium tuberculosis
RQTDQR

SEQ ID NO: 1427179 - protein, 26 aa, Mycobacterium tuberculosis
RRCPATEDRAPATVATPSSADPTASR

SEQ ID NO: 1427180 - protein, 10 aa, Mycobacterium tuberculosis
RRIPGSHGHR

SEQ ID NO: 1427181 - protein, 6 aa, Mycobacterium tuberculosis
RRNGRT

SEQ ID NO: 1427182 - protein, 9 aa, Mycobacterium tuberculosis
RRPTALERP

SEQ ID NO: 1427183 - protein, 10 aa, Mycobacterium tuberculosis
RRRDRSDAAA

SEQ ID NO: 1427184 - protein, 10 aa, Mycobacterium tuberculosis
RRRRARAGSI

SEQ ID NO: 1427185 - protein, 15 aa, Mycobacterium tuberculosis
RRRTDRGAEQRLAQR

SEQ ID NO: 1427186 - protein, 7 aa, Mycobacterium tuberculosis
RRRTRQT

SEQ ID NO: 1427187 - protein, 14 aa, Mycobacterium tuberculosis
RRSAVSAQPGTLGD

SEQ ID NO: 1427188 - protein, 11 aa, Mycobacterium tuberculosis
RSAEVDASYAA

SEQ ID NO: 1427189 - protein, 9 aa, Mycobacterium tuberculosis
RSATTAEQA

SEQ ID NO: 1427190 - protein, 32 aa, Mycobacterium tuberculosis
RSGVDEDYHRGESAYDRYYGDPSNKPNPNLGE

SEQ ID NO: 1427191 - protein, 8 aa, Mycobacterium tuberculosis
RSRGGAHS

SEQ ID NO: 1427192 - protein, 7 aa, Mycobacterium tuberculosis
RSRNSTD

SEQ ID NO: 1427193 - protein, 4 aa, Mycobacterium tuberculosis
RSSM

SEQ ID NO: 1427194 - protein, 12 aa, Mycobacterium tuberculosis
RSTAEAWLSLLD

SEQ ID NO: 1427195 - protein, 6 aa, Mycobacterium tuberculosis
RSTGDD

SEQ ID NO: 1427196 - protein, 9 aa, Mycobacterium tuberculosis
RSTSELPGE

SEQ ID NO: 1427197 - protein, 12 aa, Mycobacterium tuberculosis
RTAHGDEDHSGP

SEQ ID NO: 1427198 - protein, 10 aa, Mycobacterium tuberculosis
RTGEQYPDEI

SEQ ID NO: 1427199 - protein, 10 aa, Mycobacterium tuberculosis
RTGSGRCNRL

SEQ ID NO: 1427200 - protein, 8 aa, Mycobacterium tuberculosis
RTPNPEAY

SEQ ID NO: 1427201 - protein, 4 aa, Mycobacterium tuberculosis
RTRF

SEQ ID NO: 1427202 - protein, 7 aa, Mycobacterium tuberculosis
RTRTRGE

SEQ ID NO: 1427203 - protein, 5 aa, Mycobacterium tuberculosis
RTRYP

SEQ ID NO: 1427204 - protein, 7 aa, Mycobacterium tuberculosis
RTSAEAA

SEQ ID NO: 1427205 - protein, 12 aa, Mycobacterium tuberculosis
RVAPAERCQTPQ

SEQ ID NO: 1427206 - protein, 10 aa, Mycobacterium tuberculosis
RVASAADAQE

SEQ ID NO: 1427207 - protein, 5 aa, Mycobacterium tuberculosis
RVTTS

SEQ ID NO: 1427208 - protein, 10 aa, Mycobacterium tuberculosis
RWAPPYAEAG

SEQ ID NO: 1427209 - protein, 6 aa, Mycobacterium tuberculosis
RWPRAG

SEQ ID NO: 1427210 - protein, 9 aa, Mycobacterium tuberculosis
SAAGSGSQR

SEQ ID NO: 1427211 - protein, 4 aa, Mycobacterium tuberculosis
SAAL

SEQ ID NO: 1427212 - protein, 15 aa, Mycobacterium tuberculosis
SADGVADENRRDDLE

SEQ ID NO: 1427213 - protein, 4 aa, Mycobacterium tuberculosis
SAGA

SEQ ID NO: 1427214 - protein, 8 aa, Mycobacterium tuberculosis
SAGPDPVA

SEQ ID NO: 1427215 - protein, 4 aa, Mycobacterium tuberculosis
SAKP

SEQ ID NO: 1427216 - protein, 23 aa, Mycobacterium tuberculosis
SAKVDCGGKKTLKASGSTAQANA

SEQ ID NO: 1427217 - protein, 5 aa, Mycobacterium tuberculosis
SAQAQ

SEQ ID NO: 1427218 - protein, 8 aa, Mycobacterium tuberculosis
SATTSTGW

SEQ ID NO: 1427219 - protein, 10 aa, Mycobacterium tuberculosis
SAYPDRESEL

SEQ ID NO: 1427220 - protein, 8 aa, Mycobacterium tuberculosis
SDATRLAG

SEQ ID NO: 1427221 - protein, 8 aa, Mycobacterium tuberculosis
SDGNFGNP

SEQ ID NO: 1427222 - protein, 5 aa, Mycobacterium tuberculosis
SDLSG

SEQ ID NO: 1427223 - protein, 26 aa, Mycobacterium tuberculosis
SDPDDGNSTPKNRPHGSNSLSTTQLH

SEQ ID NO: 1427224 - protein, 19 aa, Mycobacterium tuberculosis
SEASGAAPTHEAPAPPRGL

SEQ ID NO: 1427225 - protein, 18 aa, Mycobacterium tuberculosis
SEAVTVTSEPAAGGRADE

SEQ ID NO: 1427226 - protein, 24 aa, Mycobacterium tuberculosis
SELAGGAWQGPASAAMANAAGPYA

SEQ ID NO: 1427227 - protein, 10 aa, Mycobacterium tuberculosis
SEPEAGSDLA

SEQ ID NO: 1427228 - protein, 8 aa, Mycobacterium tuberculosis
SERFPKGV

SEQ ID NO: 1427229 - protein, 13 aa, Mycobacterium tuberculosis
SETSAEAAARHET

SEQ ID NO: 1427230 - protein, 6 aa, Mycobacterium tuberculosis
SGASAV

SEQ ID NO: 1427231 - protein, 4 aa, Mycobacterium tuberculosis
SGGT

SEQ ID NO: 1427232 - protein, 24 aa, Mycobacterium tuberculosis
SGGTGGSGGFGLDTGGAGGRGGDA

SEQ ID NO: 1427233 - protein, 5 aa, Mycobacterium tuberculosis
SGNGN

SEQ ID NO: 1427234 - protein, 14 aa, Mycobacterium tuberculosis
SGNTANTNFGSGNL

SEQ ID NO: 1427235 - protein, 5 aa, Mycobacterium tuberculosis
SGPAT

SEQ ID NO: 1427236 - protein, 17 aa, Mycobacterium tuberculosis
SGSVPPPQATPPITTPP

SEQ ID NO: 1427237 - protein, 4 aa, Mycobacterium tuberculosis
SGTI

SEQ ID NO: 1427238 - protein, 6 aa, Mycobacterium tuberculosis
SGTPGF

SEQ ID NO: 1427239 - protein, 6 aa, Mycobacterium tuberculosis
SGTVES

SEQ ID NO: 1427240 - protein, 6 aa, Mycobacterium tuberculosis
SGVSGI

SEQ ID NO: 1427241 - protein, 8 aa, Mycobacterium tuberculosis
SIGDDSQL

SEQ ID NO: 1427242 - protein, 12 aa, Mycobacterium tuberculosis
SKPNPKTATNAG

SEQ ID NO: 1427243 - protein, 11 aa, Mycobacterium tuberculosis
SLAAAKSKSAL

SEQ ID NO: 1427244 - protein, 5 aa, Mycobacterium tuberculosis
SLATD

SEQ ID NO: 1427245 - protein, 6 aa, Mycobacterium tuberculosis
SLATDS

SEQ ID NO: 1427246 - protein, 9 aa, Mycobacterium tuberculosis
SLDQGGPCA

SEQ ID NO: 1427247 - protein, 6 aa, Mycobacterium tuberculosis
SLNDQD

SEQ ID NO: 1427248 - protein, 5 aa, Mycobacterium tuberculosis
SLPDA

SEQ ID NO: 1427249 - protein, 7 aa, Mycobacterium tuberculosis
SLPPGNQ

SEQ ID NO: 1427250 - protein, 5 aa, Mycobacterium tuberculosis
SMITG

SEQ ID NO: 1427251 - protein, 23 aa, Mycobacterium tuberculosis
SMSPKDVDDLATQQDVDDGQSIE

SEQ ID NO: 1427252 - protein, 5 aa, Mycobacterium tuberculosis
SNPVA

SEQ ID NO: 1427253 - protein, 5 aa, Mycobacterium tuberculosis
SNRVD

SEQ ID NO: 1427254 - protein, 7 aa, Mycobacterium tuberculosis
SPIAEGA

SEQ ID NO: 1427255 - protein, 6 aa, Mycobacterium tuberculosis
SPRHGE

SEQ ID NO: 1427256 - protein, 8 aa, Mycobacterium tuberculosis
SPWSPRET

SEQ ID NO: 1427257 - protein, 4 aa, Mycobacterium tuberculosis
SQGT

SEQ ID NO: 1427258 - protein, 11 aa, Mycobacterium tuberculosis
SQHPRPGGAPP

SEQ ID NO: 1427259 - protein, 4 aa, Mycobacterium tuberculosis
SQPD

SEQ ID NO: 1427260 - protein, 5 aa, Mycobacterium tuberculosis
SQRGT

SEQ ID NO: 1427261 - protein, 4 aa, Mycobacterium tuberculosis
SQSP

SEQ ID NO: 1427262 - protein, 8 aa, Mycobacterium tuberculosis
SRAAETAE

SEQ ID NO: 1427263 - protein, 16 aa, Mycobacterium tuberculosis
SRHPLAGGSGASAGAG

SEQ ID NO: 1427264 - protein, 10 aa, Mycobacterium tuberculosis
SRLPPRGLTQ

SEQ ID NO: 1427265 - protein, 5 aa, Mycobacterium tuberculosis
SRTTV

SEQ ID NO: 1427266 - protein, 13 aa, Mycobacterium tuberculosis
SRVPSPPVPPAPL

SEQ ID NO: 1427267 - protein, 14 aa, Mycobacterium tuberculosis
SRVRARQAAEARVE

SEQ ID NO: 1427268 - protein, 7 aa, Mycobacterium tuberculosis
SSANTRD

SEQ ID NO: 1427269 - protein, 7 aa, Mycobacterium tuberculosis
SSGVPSF

SEQ ID NO: 1427270 - protein, 10 aa, Mycobacterium tuberculosis
SSHDGPDAGR

SEQ ID NO: 1427271 - protein, 9 aa, Mycobacterium tuberculosis
SSPSTPHRE

SEQ ID NO: 1427272 - protein, 4 aa, Mycobacterium tuberculosis
SSQL

SEQ ID NO: 1427273 - protein, 11 aa, Mycobacterium tuberculosis
SSRSGPAPQSL

SEQ ID NO: 1427274 - protein, 5 aa, Mycobacterium tuberculosis
STGGG

SEQ ID NO: 1427275 - protein, 13 aa, Mycobacterium tuberculosis
STGGWDDDGNPVH

SEQ ID NO: 1427276 - protein, 5 aa, Mycobacterium tuberculosis
STPGS

SEQ ID NO: 1427277 - protein, 10 aa, Mycobacterium tuberculosis
SVADDAGLAA

SEQ ID NO: 1427278 - protein, 6 aa, Mycobacterium tuberculosis
SVDPDR

SEQ ID NO: 1427279 - protein, 4 aa, Mycobacterium tuberculosis
SVYD

SEQ ID NO: 1427280 - protein, 4 aa, Mycobacterium tuberculosis
SYSD

SEQ ID NO: 1427281 - protein, 4 aa, Mycobacterium tuberculosis
TAAG

SEQ ID NO: 1427282 - protein, 5 aa, Mycobacterium tuberculosis
TADPV

SEQ ID NO: 1427283 - protein, 12 aa, Mycobacterium tuberculosis
TAELPQTSTAAV

SEQ ID NO: 1427284 - protein, 7 aa, Mycobacterium tuberculosis
TAFTDGE

SEQ ID NO: 1427285 - protein, 10 aa, Mycobacterium tuberculosis
TAPAPHHTRP

SEQ ID NO: 1427286 - protein, 6 aa, Mycobacterium tuberculosis
TARAAE

SEQ ID NO: 1427287 - protein, 5 aa, Mycobacterium tuberculosis
TATLA

SEQ ID NO: 1427288 - protein, 7 aa, Mycobacterium tuberculosis
TATPRAY

SEQ ID NO: 1427289 - protein, 7 aa, Mycobacterium tuberculosis
TATTAGM

SEQ ID NO: 1427290 - protein, 4 aa, Mycobacterium tuberculosis
TDAA

SEQ ID NO: 1427291 - protein, 7 aa, Mycobacterium tuberculosis
TDFDDAD

SEQ ID NO: 1427292 - protein, 6 aa, Mycobacterium tuberculosis
TEADER

SEQ ID NO: 1427293 - protein, 8 aa, Mycobacterium tuberculosis
TEELEEAS

SEQ ID NO: 1427294 - protein, 12 aa, Mycobacterium tuberculosis
TEGPATPPQTPT

SEQ ID NO: 1427295 - protein, 8 aa, Mycobacterium tuberculosis
TEHTPDGE

SEQ ID NO: 1427296 - protein, 6 aa, Mycobacterium tuberculosis
TEPIPR

SEQ ID NO: 1427297 - protein, 9 aa, Mycobacterium tuberculosis
TESVGKTIA

SEQ ID NO: 1427298 - protein, 13 aa, Mycobacterium tuberculosis
TEYDRRGWGSGGA

SEQ ID NO: 1427299 - protein, 7 aa, Mycobacterium tuberculosis
TFGRGPN

SEQ ID NO: 1427300 - protein, 7 aa, Mycobacterium tuberculosis
TGAADGY

SEQ ID NO: 1427301 - protein, 10 aa, Mycobacterium tuberculosis
TGATAAAAAS

SEQ ID NO: 1427302 - protein, 8 aa, Mycobacterium tuberculosis
TGDRSGDQ

SEQ ID NO: 1427303 - protein, 6 aa, Mycobacterium tuberculosis
TGDTAT

SEQ ID NO: 1427304 - protein, 9 aa, Mycobacterium tuberculosis
TGGDATRIS

SEQ ID NO: 1427305 - protein, 5 aa, Mycobacterium tuberculosis
TGGTI

SEQ ID NO: 1427306 - protein, 10 aa, Mycobacterium tuberculosis
TGHVERGKAA

SEQ ID NO: 1427307 - protein, 9 aa, Mycobacterium tuberculosis
TGNIYEKDG

SEQ ID NO: 1427308 - protein, 5 aa, Mycobacterium tuberculosis
TGNPA

SEQ ID NO: 1427309 - protein, 6 aa, Mycobacterium tuberculosis
TGPTVA

SEQ ID NO: 1427310 - protein, 12 aa, Mycobacterium tuberculosis
TGQEESRRDGIE

SEQ ID NO: 1427311 - protein, 6 aa, Mycobacterium tuberculosis
TGSEAD

SEQ ID NO: 1427312 - protein, 4 aa, Mycobacterium tuberculosis
TGSF

SEQ ID NO: 1427313 - protein, 6 aa, Mycobacterium tuberculosis
TGSRDY

SEQ ID NO: 1427314 - protein, 13 aa, Mycobacterium tuberculosis
TGTGKTSNKTGNG

SEQ ID NO: 1427315 - protein, 6 aa, Mycobacterium tuberculosis
TGTSDQ

SEQ ID NO: 1427316 - protein, 4 aa, Mycobacterium tuberculosis
TGVG

SEQ ID NO: 1427317 - protein, 6 aa, Mycobacterium tuberculosis
TGWSSL

SEQ ID NO: 1427318 - protein, 5 aa, Mycobacterium tuberculosis
THDPV

SEQ ID NO: 1427319 - protein, 30 aa, Mycobacterium tuberculosis
TIDSGRRGIAHPPRGGLGHRSKHRGPRHLT

SEQ ID NO: 1427320 - protein, 11 aa, Mycobacterium tuberculosis
TISTTAGPDGV

SEQ ID NO: 1427321 - protein, 10 aa, Mycobacterium tuberculosis
TKNSGGKMTR

SEQ ID NO: 1427322 - protein, 10 aa, Mycobacterium tuberculosis
TKSDQTPWYE

SEQ ID NO: 1427323 - protein, 7 aa, Mycobacterium tuberculosis
TKTDTAI

SEQ ID NO: 1427324 - protein, 8 aa, Mycobacterium tuberculosis
TLANATGR

SEQ ID NO: 1427325 - protein, 6 aa, Mycobacterium tuberculosis
TLERTG

SEQ ID NO: 1427326 - protein, 6 aa, Mycobacterium tuberculosis
TPAAEQ

SEQ ID NO: 1427327 - protein, 6 aa, Mycobacterium tuberculosis
TPDSFY

SEQ ID NO: 1427328 - protein, 5 aa, Mycobacterium tuberculosis
TPDSR

SEQ ID NO: 1427329 - protein, 7 aa, Mycobacterium tuberculosis
TPLTEEQ

SEQ ID NO: 1427330 - protein, 12 aa, Mycobacterium tuberculosis
TPPTAPPGTPGE

SEQ ID NO: 1427331 - protein, 5 aa, Mycobacterium tuberculosis
TPVQA

SEQ ID NO: 1427332 - protein, 11 aa, Mycobacterium tuberculosis
TPVTADSALNR

SEQ ID NO: 1427333 - protein, 6 aa, Mycobacterium tuberculosis
TQALAR

SEQ ID NO: 1427334 - protein, 15 aa, Mycobacterium tuberculosis
TQETTPVRGTPSGLC

SEQ ID NO: 1427335 - protein, 7 aa, Mycobacterium tuberculosis
TQGAWTG

SEQ ID NO: 1427336 - protein, 11 aa, Mycobacterium tuberculosis
TQLDPCQSPRP

SEQ ID NO: 1427337 - protein, 27 aa, Mycobacterium tuberculosis
TRSEAKRRVAEAADLGQRRALTGEPLP

SEQ ID NO: 1427338 - protein, 15 aa, Mycobacterium tuberculosis
TRSGSSGAPAGVNPA

SEQ ID NO: 1427339 - protein, 17 aa, Mycobacterium tuberculosis
TSLSAANATAAASTTSV

SEQ ID NO: 1427340 - protein, 5 aa, Mycobacterium tuberculosis
TSMTN

SEQ ID NO: 1427341 - protein, 5 aa, Mycobacterium tuberculosis
TSPSA

SEQ ID NO: 1427342 - protein, 12 aa, Mycobacterium tuberculosis
TSRTSEDADDAL

SEQ ID NO: 1427343 - protein, 4 aa, Mycobacterium tuberculosis
TSSP

SEQ ID NO: 1427344 - protein, 6 aa, Mycobacterium tuberculosis
TSYPKR

SEQ ID NO: 1427345 - protein, 8 aa, Mycobacterium tuberculosis
TTDGALPS

SEQ ID NO: 1427346 - protein, 8 aa, Mycobacterium tuberculosis
TTGFTEAD

SEQ ID NO: 1427347 - protein, 10 aa, Mycobacterium tuberculosis
TTGPKPLVQD

SEQ ID NO: 1427348 - protein, 4 aa, Mycobacterium tuberculosis
TTPD

SEQ ID NO: 1427349 - protein, 18 aa, Mycobacterium tuberculosis
TTPERDRARRDRDHHPWS

SEQ ID NO: 1427350 - protein, 4 aa, Mycobacterium tuberculosis
TTRA

SEQ ID NO: 1427351 - protein, 13 aa, Mycobacterium tuberculosis
TVERSGLSADDVA

SEQ ID NO: 1427352 - protein, 8 aa, Mycobacterium tuberculosis
TVESGASV

SEQ ID NO: 1427353 - protein, 10 aa, Mycobacterium tuberculosis
TVTGSVPPTV

SEQ ID NO: 1427354 - protein, 13 aa, Mycobacterium tuberculosis
TVYRRDQSVAVSE

SEQ ID NO: 1427355 - protein, 13 aa, Mycobacterium tuberculosis
TWTETRTGSYGQS

SEQ ID NO: 1427356 - protein, 10 aa, Mycobacterium tuberculosis
TYEGREKEVG

SEQ ID NO: 1427357 - protein, 6 aa, Mycobacterium tuberculosis
TYGPDR

SEQ ID NO: 1427358 - protein, 14 aa, Mycobacterium tuberculosis
VAATGGALSTNGHA

SEQ ID NO: 1427359 - protein, 8 aa, Mycobacterium tuberculosis
VAGRAPGA

SEQ ID NO: 1427360 - protein, 16 aa, Mycobacterium tuberculosis
VAPGDDGDGLNPFAPD

SEQ ID NO: 1427361 - protein, 14 aa, Mycobacterium tuberculosis
VAPVGGTGGNGGRA

SEQ ID NO: 1427362 - protein, 11 aa, Mycobacterium tuberculosis
VARGGGRTSYR

SEQ ID NO: 1427363 - protein, 13 aa, Mycobacterium tuberculosis
VASAPQTTPAPPI

SEQ ID NO: 1427364 - protein, 7 aa, Mycobacterium tuberculosis
VDEIPDD

SEQ ID NO: 1427365 - protein, 5 aa, Mycobacterium tuberculosis
VDPAG

SEQ ID NO: 1427366 - protein, 10 aa, Mycobacterium tuberculosis
VDPVSSSTGT

SEQ ID NO: 1427367 - protein, 8 aa, Mycobacterium tuberculosis
VDTEAERE

SEQ ID NO: 1427368 - protein, 15 aa, Mycobacterium tuberculosis
VEATRQGKSYTLTGT

SEQ ID NO: 1427369 - protein, 5 aa, Mycobacterium tuberculosis
VEPDR

SEQ ID NO: 1427370 - protein, 8 aa, Mycobacterium tuberculosis
VEQADGEC

SEQ ID NO: 1427371 - protein, 12 aa, Mycobacterium tuberculosis
VGTNPTFSGRTR

SEQ ID NO: 1427372 - protein, 6 aa, Mycobacterium tuberculosis
VNEPPE

SEQ ID NO: 1427373 - protein, 17 aa, Mycobacterium tuberculosis
VNSYASAEAANASPLQA

SEQ ID NO: 1427374 - protein, 7 aa, Mycobacterium tuberculosis
VPNTAKL

SEQ ID NO: 1427375 - protein, 26 aa, Mycobacterium tuberculosis
VSAPAPAERPAPPAMSGAQRRATEKE

SEQ ID NO: 1427376 - protein, 7 aa, Mycobacterium tuberculosis
VSGRGRD

SEQ ID NO: 1427377 - protein, 5 aa, Mycobacterium tuberculosis
VSRGR

SEQ ID NO: 1427378 - protein, 23 aa, Mycobacterium tuberculosis
VVASTSSSPWGQPLSVGLRRRWR

SEQ ID NO: 1427379 - protein, 10 aa, Mycobacterium tuberculosis
VYGADDPAAA

SEQ ID NO: 1427380 - protein, 4 aa, Mycobacterium tuberculosis
WPDD

SEQ ID NO: 1427381 - protein, 10 aa, Mycobacterium tuberculosis
YAATPQDAYE

SEQ ID NO: 1427382 - protein, 9 aa, Mycobacterium tuberculosis
YAGPGPDSM

SEQ ID NO: 1427383 - protein, 14 aa, Mycobacterium tuberculosis
YDAPFPDKTYQAGA

SEQ ID NO: 1427384 - protein, 12 aa, Mycobacterium tuberculosis
YEPDSEGNRQRA

SEQ ID NO: 1427385 - protein, 11 aa, Mycobacterium tuberculosis
YERGRPSYPPE

SEQ ID NO: 1427386 - protein, 14 aa, Mycobacterium tuberculosis
YERRPANAPAVQGQ

SEQ ID NO: 1427387 - protein, 11 aa, Mycobacterium tuberculosis
YGPVRGADDGR

SEQ ID NO: 1427388 - protein, 9 aa, Mycobacterium tuberculosis
YPDATTGTA

SEQ ID NO: 1427389 - protein, 9 aa, Mycobacterium tuberculosis
YRPTQPGSY

SEQ ID NO: 1427390 - protein, 8 aa, Mycobacterium tuberculosis
YTATEATD

SEQ ID NO: 1427391 - protein, 5 aa, Mycobacterium tuberculosis
YTRAP

SEQ ID NO: 1427392 - protein, 9 aa, Mycobacterium tuberculosis
AAAASDVAR

SEQ ID NO: 1427393 - protein, 25 aa, Mycobacterium tuberculosis
AAAGDLANVGSTISAANKAAAAATT

SEQ ID NO: 1427394 - protein, 8 aa, Mycobacterium tuberculosis
AAAPTPAA

SEQ ID NO: 1427395 - protein, 15 aa, Mycobacterium tuberculosis
AAAVTNSGAINTNDM

SEQ ID NO: 1427396 - protein, 13 aa, Mycobacterium tuberculosis
AADAGDGGAGGDG

SEQ ID NO: 1427397 - protein, 8 aa, Mycobacterium tuberculosis
AADPRSNL

SEQ ID NO: 1427398 - protein, 12 aa, Mycobacterium tuberculosis
AAGDDAALSGTE

SEQ ID NO: 1427399 - protein, 9 aa, Mycobacterium tuberculosis
AAGEPLPSA

SEQ ID NO: 1427400 - protein, 8 aa, Mycobacterium tuberculosis
AAGQTRST

SEQ ID NO: 1427401 - protein, 10 aa, Mycobacterium tuberculosis
AAGRDAGAEV

SEQ ID NO: 1427402 - protein, 5 aa, Mycobacterium tuberculosis
AAGTR

SEQ ID NO: 1427403 - protein, 35 aa, Mycobacterium tuberculosis; identical to SEQ ID NO: 167205

SEQ ID NO: 1427404 - protein, 11 aa, Mycobacterium tuberculosis
AAPNLPAPSAQ

SEQ ID NO: 1427405 - protein, 9 aa, Mycobacterium tuberculosis
AAPTAAQAS

SEQ ID NO: 1427406 - protein, 4 aa, Mycobacterium tuberculosis
AAPY

SEQ ID NO: 1427407 - protein, 9 aa, Mycobacterium tuberculosis
AAQGAMASY

SEQ ID NO: 1427408 - protein, 5 aa, Mycobacterium tuberculosis
AAQLD

SEQ ID NO: 1427409 - protein, 9 aa, Mycobacterium tuberculosis
AARAQGRSH

SEQ ID NO: 1427410 - protein, 6 aa, Mycobacterium tuberculosis
AARNSK

SEQ ID NO: 1427411 - protein, 5 aa, Mycobacterium tuberculosis
AARRA

SEQ ID NO: 1427412 - protein, 24 aa, Mycobacterium tuberculosis
AASNECHRSQDRQRPAQPAGDRPL

SEQ ID NO: 1427413 - protein, 4 aa, Mycobacterium tuberculosis
AATD

SEQ ID NO: 1427414 - protein, 19 aa, Mycobacterium tuberculosis
AAVGGTGPVSAGLGNAATI

SEQ ID NO: 1427415 - protein, 6 aa, Mycobacterium tuberculosis
ADASAL

SEQ ID NO: 1427416 - protein, 7 aa, Mycobacterium tuberculosis
ADDDEDA

SEQ ID NO: 1427417 - protein, 8 aa, Mycobacterium tuberculosis
ADDSRRMT

SEQ ID NO: 1427418 - protein, 4 aa, Mycobacterium tuberculosis
ADDY

SEQ ID NO: 1427419 - protein, 6 aa, Mycobacterium tuberculosis
ADGTRR

SEQ ID NO: 1427420 - protein, 13 aa, Mycobacterium tuberculosis
ADITAAASRQEGL

SEQ ID NO: 1427421 - protein, 4 aa, Mycobacterium tuberculosis
ADLV

SEQ ID NO: 1427422 - protein, 7 aa, Mycobacterium tuberculosis
ADPQRAG

SEQ ID NO: 1427423 - protein, 9 aa, Mycobacterium tuberculosis
ADRLERDPA

SEQ ID NO: 1427424 - protein, 10 aa, Mycobacterium tuberculosis
ADVNPEEGKT

SEQ ID NO: 1427425 - protein, 5 aa, Mycobacterium tuberculosis
AEDAG

SEQ ID NO: 1427426 - protein, 9 aa, Mycobacterium tuberculosis
AEGSAGGEQ

SEQ ID NO: 1427427 - protein, 33 aa, Mycobacterium tuberculosis; identical to SEQ ID NO: 228901

SEQ ID NO: 1427428 - protein, 5 aa, Mycobacterium tuberculosis
AESQR

SEQ ID NO: 1427429 - protein, 9 aa, Mycobacterium tuberculosis
AETGTPRFS

SEQ ID NO: 1427430 - protein, 12 aa, Mycobacterium tuberculosis
AFSPPAQALGGG

SEQ ID NO: 1427431 - protein, 28 aa, Mycobacterium tuberculosis
AGAAGGDASTGVGGPGGPGGTGTASSPF

SEQ ID NO: 1427432 - protein, 115 aa, Mycobacterium tuberculosis; identical to SEQ ID NO: 193618

SEQ ID NO: 1427433 - protein, 10 aa, Mycobacterium tuberculosis
AGDDSTQGVA

SEQ ID NO: 1427434 - protein, 7 aa, Mycobacterium tuberculosis
AGESGTM

SEQ ID NO: 1427435 - protein, 6 aa, Mycobacterium tuberculosis
AGFGTS

SEQ ID NO: 1427436 - protein, 27 aa, Mycobacterium tuberculosis
AGGAGGAGALGGGATGVGGAGGNGGTA

SEQ ID NO: 1427437 - protein, 25 aa, Mycobacterium tuberculosis
AGGAGGAGGSGGSDTAGHGGTGGAG

SEQ ID NO: 1427438 - protein, 4 aa, Mycobacterium tuberculosis
AGGG

SEQ ID NO: 1427439 - protein, 9 aa, Mycobacterium tuberculosis
AGGNGGDGG

SEQ ID NO: 1427440 - protein, 29 aa, Mycobacterium tuberculosis
AGGNGGNAGTGVGVNGANGGNGGSATGAL

SEQ ID NO: 1427441 - protein, 26 aa, Mycobacterium tuberculosis
AGGTGGAGGSSGGTFGGNGGSGGNAG

SEQ ID NO: 1427442 - protein, 21 aa, Mycobacterium tuberculosis
AGGTGGAGTLGADGGAGGHGG

SEQ ID NO: 1427443 - protein, 9 aa, Mycobacterium tuberculosis
AGHALTGGG

SEQ ID NO: 1427444 - protein, 5 aa, Mycobacterium tuberculosis
AGKLT

SEQ ID NO: 1427445 - protein, 11 aa, Mycobacterium tuberculosis
AGKNGTRKGRR

SEQ ID NO: 1427446 - protein, 10 aa, Mycobacterium tuberculosis
AGLRSRSGKV

SEQ ID NO: 1427447 - protein, 14 aa, Mycobacterium tuberculosis
AGPGADSMRAASQQ

SEQ ID NO: 1427448 - protein, 7 aa, Mycobacterium tuberculosis
AGPQEGW

SEQ ID NO: 1427449 - protein, 8 aa, Mycobacterium tuberculosis
AGQDVDEA

SEQ ID NO: 1427450 - protein, 23 aa, Mycobacterium tuberculosis
AGRAAAGSTGHPIGSAAAPAVGA

SEQ ID NO: 1427451 - protein, 10 aa, Mycobacterium tuberculosis
AGRPTRANFR

SEQ ID NO: 1427452 - protein, 7 aa, Mycobacterium tuberculosis
AGSAQRR

SEQ ID NO: 1427453 - protein, 8 aa, Mycobacterium tuberculosis
AGSGPTLA

SEQ ID NO: 1427454 - protein, 5 aa, Mycobacterium tuberculosis
AGSLT

SEQ ID NO: 1427455 - protein, 10 aa, Mycobacterium tuberculosis
AGTATKERRV

SEQ ID NO: 1427456 - protein, 164 aa, Mycobacterium tuberculosis; identical to SEQ ID NO: 193663

SEQ ID NO: 1427457 - protein, 8 aa, Mycobacterium tuberculosis
AGTPGKRM

SEQ ID NO: 1427458 - protein, 6 aa, Mycobacterium tuberculosis
AGTRGW

SEQ ID NO: 1427459 - protein, 42 aa, Mycobacterium tuberculosis; identical to SEQ ID NO: 229008

SEQ ID NO: 1427460 - protein, 11 aa, Mycobacterium tuberculosis
AHAEAANAARV

SEQ ID NO: 1427461 - protein, 6 aa, Mycobacterium tuberculosis
AHPDGF

SEQ ID NO: 1427462 - protein, 6 aa, Mycobacterium tuberculosis
AHTRPD

SEQ ID NO: 1427463 - protein, 9 aa, Mycobacterium tuberculosis
AIKRSAPRR

SEQ ID NO: 1427464 - protein, 7 aa, Mycobacterium tuberculosis
AKQRTQF

SEQ ID NO: 1427465 - protein, 8 aa, Mycobacterium tuberculosis
AKRKTTQR

SEQ ID NO: 1427466 - protein, 5 aa, Mycobacterium tuberculosis
ALAPD

SEQ ID NO: 1427467 - protein, 8 aa, Mycobacterium tuberculosis
ALEGKNTE

SEQ ID NO: 1427468 - protein, 13 aa, Mycobacterium tuberculosis
ALGQGVSPTSIGQ

SEQ ID NO: 1427469 - protein, 9 aa, Mycobacterium tuberculosis
ALPGTDIDP

SEQ ID NO: 1427470 - protein, 9 aa, Mycobacterium tuberculosis
ALSGKLNPD

SEQ ID NO: 1427471 - protein, 13 aa, Mycobacterium tuberculosis
ALTKQGRSGRDRQ

SEQ ID NO: 1427472 - protein, 22 aa, Mycobacterium tuberculosis
ANAAAAVPTTGALAPAADEVSA

SEQ ID NO: 1427473 - protein, 8 aa, Mycobacterium tuberculosis
ANASPLQS

SEQ ID NO: 1427474 - protein, 57 aa, Mycobacterium tuberculosis
ANNIGGTGGAGGNGGPAILSGNGGNGGAGGAGGAGGAGGGAGGVGGAGGAPGTGGTL

SEQ ID NO: 1427475 - protein, 7 aa, Mycobacterium tuberculosis
ANPRERA

SEQ ID NO: 1427476 - protein, 13 aa, Mycobacterium tuberculosis
ANRDERQYGPDAA

SEQ ID NO: 1427477 - protein, 25 aa, Mycobacterium tuberculosis
ANSPHTNLGGENPEINTSDDGDHDP

SEQ ID NO: 1427478 - protein, 5 aa, Mycobacterium tuberculosis
ANSYP

SEQ ID NO: 1427479 - protein, 6 aa, Mycobacterium tuberculosis
ANTPPA

SEQ ID NO: 1427480 - protein, 17 aa, Mycobacterium tuberculosis
APAAAQAVETAAQNGVR

SEQ ID NO: 1427481 - protein, 10 aa, Mycobacterium tuberculosis
APLPSAGAGL

SEQ ID NO: 1427482 - protein, 6 aa, Mycobacterium tuberculosis
APLTTE

SEQ ID NO: 1427483 - protein, 11 aa, Mycobacterium tuberculosis
APPDPSPPNLD

SEQ ID NO: 1427484 - protein, 14 aa, Mycobacterium tuberculosis
APPHPRAPGATDKD

SEQ ID NO: 1427485 - protein, 7 aa, Mycobacterium tuberculosis
APPPAVA

SEQ ID NO: 1427486 - protein, 6 aa, Mycobacterium tuberculosis
APSAAD

SEQ ID NO: 1427487 - protein, 5 aa, Mycobacterium tuberculosis
APSAR

SEQ ID NO: 1427488 - protein, 7 aa, Mycobacterium tuberculosis
APSSLPA

SEQ ID NO: 1427489 - protein, 8 aa, Mycobacterium tuberculosis
AQAAREGR

SEQ ID NO: 1427490 - protein, 11 aa, Mycobacterium tuberculosis
AQAAVAQTGLT

SEQ ID NO: 1427491 - protein, 5 aa, Mycobacterium tuberculosis
AQEEV

SEQ ID NO: 1427492 - protein, 7 aa, Mycobacterium tuberculosis
AQRAPQL

SEQ ID NO: 1427493 - protein, 7 aa, Mycobacterium tuberculosis
AQRDVAD

SEQ ID NO: 1427494 - protein, 11 aa, Mycobacterium tuberculosis
AQTPIERKPPW

SEQ ID NO: 1427495 - protein, 22 aa, Mycobacterium tuberculosis
ARAARDAATAAASARQRGRGDA

SEQ ID NO: 1427496 - protein, 8 aa, Mycobacterium tuberculosis
ARAETERT

SEQ ID NO: 1427497 - protein, 12 aa, Mycobacterium tuberculosis
AREAARSRELAA

SEQ ID NO: 1427498 - protein, 10 aa, Mycobacterium tuberculosis
ARGASTSKEV

SEQ ID NO: 1427499 - protein, 5 aa, Mycobacterium tuberculosis
ARGHD

SEQ ID NO: 1427500 - protein, 7 aa, Mycobacterium tuberculosis
ARHGALD

SEQ ID NO: 1427501 - protein, 17 aa, Mycobacterium tuberculosis
ARNHDLTESELADAERD

SEQ ID NO: 1427502 - protein, 4 aa, Mycobacterium tuberculosis
ARQA

SEQ ID NO: 1427503 - protein, 21 aa, Mycobacterium tuberculosis
ARRVPRQRRQRINRQAPPRLR

SEQ ID NO: 1427504 - protein, 8 aa, Mycobacterium tuberculosis
ARTGNAMA

SEQ ID NO: 1427505 - protein, 4 aa, Mycobacterium tuberculosis
ASDL

SEQ ID NO: 1427506 - protein, 11 aa, Mycobacterium tuberculosis
ASDTSNGRTPG

SEQ ID NO: 1427507 - protein, 5 aa, Mycobacterium tuberculosis
ASGLP

SEQ ID NO: 1427508 - protein, 7 aa, Mycobacterium tuberculosis
ASGYAGG

SEQ ID NO: 1427509 - protein, 9 aa, Mycobacterium tuberculosis
ASSATSAHA

SEQ ID NO: 1427510 - protein, 12 aa, Mycobacterium tuberculosis
ASSTVAVSGERQ

SEQ ID NO: 1427511 - protein, 6 aa, Mycobacterium tuberculosis
ASTGSD

SEQ ID NO: 1427512 - protein, 7 aa, Mycobacterium tuberculosis
ATARQQL

SEQ ID NO: 1427513 - protein, 12 aa, Mycobacterium tuberculosis
ATDARRHTRAET

SEQ ID NO: 1427514 - protein, 9 aa, Mycobacterium tuberculosis
ATPGSGKTS

SEQ ID NO: 1427515 - protein, 10 aa, Mycobacterium tuberculosis
ATRPPRPGRR

SEQ ID NO: 1427516 - protein, 5 aa, Mycobacterium tuberculosis
ATSAS

SEQ ID NO: 1427517 - protein, 8 aa, Mycobacterium tuberculosis
ATSRRKDQ

SEQ ID NO: 1427518 - protein, 6 aa, Mycobacterium tuberculosis
ATTPNS

SEQ ID NO: 1427519 - protein, 8 aa, Mycobacterium tuberculosis
AVRPGGTV

SEQ ID NO: 1427520 - protein, 13 aa, Mycobacterium tuberculosis
AYADAAEARGTWD

SEQ ID NO: 1427521 - protein, 4 aa, Mycobacterium tuberculosis
CAAG

SEQ ID NO: 1427522 - protein, 6 aa, Mycobacterium tuberculosis
CANGPR

SEQ ID NO: 1427523 - protein, 8 aa, Mycobacterium tuberculosis
CESGGNWS

SEQ ID NO: 1427524 - protein, 20 aa, Mycobacterium tuberculosis
CPGQTGATLPAGTTGPEPVG

SEQ ID NO: 1427525 - protein, 9 aa, Mycobacterium tuberculosis
CQGEVGSAA

SEQ ID NO: 1427526 - protein, 8 aa, Mycobacterium tuberculosis
CQGRQVDD

SEQ ID NO: 1427527 - protein, 9 aa, Mycobacterium tuberculosis
CRSTDPRKS

SEQ ID NO: 1427528 - protein, 7 aa, Mycobacterium tuberculosis
DAADGLR

SEQ ID NO: 1427529 - protein, 13 aa, Mycobacterium tuberculosis
DAASNVVGMSDQQ

SEQ ID NO: 1427530 - protein, 5 aa, Mycobacterium tuberculosis
DAATA

SEQ ID NO: 1427531 - protein, 9 aa, Mycobacterium tuberculosis
DADVAGTQT

SEQ ID NO: 1427532 - protein, 7 aa, Mycobacterium tuberculosis
DAGAQDA

SEQ ID NO: 1427533 - protein, 7 aa, Mycobacterium tuberculosis
DAGETGW

SEQ ID NO: 1427534 - protein, 4 aa, Mycobacterium tuberculosis
DAGL

SEQ ID NO: 1427535 - protein, 5 aa, Mycobacterium tuberculosis
DAGSH

SEQ ID NO: 1427536 - protein, 12 aa, Mycobacterium tuberculosis
DAPARPRPVTAE

SEQ ID NO: 1427537 - protein, 5 aa, Mycobacterium tuberculosis
DATAC

SEQ ID NO: 1427538 - protein, 7 aa, Mycobacterium tuberculosis
DAVSTDD

SEQ ID NO: 1427539 - protein, 4 aa, Mycobacterium tuberculosis
DDAA

SEQ ID NO: 1427540 - protein, 12 aa, Mycobacterium tuberculosis
DDEVTMLKARYH

SEQ ID NO: 1427541 - protein, 5 aa, Mycobacterium tuberculosis
DDPSL

SEQ ID NO: 1427542 - protein, 24 aa, Mycobacterium tuberculosis
DDVAPDADDDLDSGDDEDHEDLEA

SEQ ID NO: 1427543 - protein, 8 aa, Mycobacterium tuberculosis
DDVDGGLV

SEQ ID NO: 1427544 - protein, 17 aa, Mycobacterium tuberculosis
DEAAKGYATARARSGEE

SEQ ID NO: 1427545 - protein, 5 aa, Mycobacterium tuberculosis
DEGLA

SEQ ID NO: 1427546 - protein, 11 aa, Mycobacterium tuberculosis
DELGKARDDAH

SEQ ID NO: 1427547 - protein, 30 aa, Mycobacterium tuberculosis; identical to SEQ ID NO: 31508

SEQ ID NO: 1427548 - protein, 8 aa, Mycobacterium tuberculosis
DEPRPITS

SEQ ID NO: 1427549 - protein, 5 aa, Mycobacterium tuberculosis
DEQVD

SEQ ID NO: 1427550 - protein, 9 aa, Mycobacterium tuberculosis
DGAAESDLA

SEQ ID NO: 1427551 - protein, 19 aa, Mycobacterium tuberculosis
DGASNGAWGKGASETFNGG

SEQ ID NO: 1427552 - protein, 5 aa, Mycobacterium tuberculosis
DGDHS

SEQ ID NO: 1427553 - protein, 4 aa, Mycobacterium tuberculosis
DGDV

SEQ ID NO: 1427554 - protein, 93 aa, Mycobacterium tuberculosis
DGGAGGHGGQGGTGVSSGGNGGAGGTGGDGRGLSGSGGAGGRGGQTGVGGKVGENNFGGAGGAGGTGGLIGNGGAGGNGGQGAISGAGGAGGN

SEQ ID NO: 1427555 - protein, 31 aa, Mycobacterium tuberculosis
DGGNGGAGGAGGIGGDGATGGPGGSGGNAGI

SEQ ID NO: 1427556 - protein, 5 aa, Mycobacterium tuberculosis
DGRAS

SEQ ID NO: 1427557 - protein, 11 aa, Mycobacterium tuberculosis
DGRSQDNIKAN

SEQ ID NO: 1427558 - protein, 4 aa, Mycobacterium tuberculosis
DGRY

SEQ ID NO: 1427559 - protein, 9 aa, Mycobacterium tuberculosis
DGWSNSGGA

SEQ ID NO: 1427560 - protein, 5 aa, Mycobacterium tuberculosis
DHTGV

SEQ ID NO: 1427561 - protein, 4 aa, Mycobacterium tuberculosis
DKAN

SEQ ID NO: 1427562 - protein, 6 aa, Mycobacterium tuberculosis
DKRPGD

SEQ ID NO: 1427563 - protein, 7 aa, Mycobacterium tuberculosis
DKTVEQV

SEQ ID NO: 1427564 - protein, 7 aa, Mycobacterium tuberculosis
DLPATDV

SEQ ID NO: 1427565 - protein, 8 aa, Mycobacterium tuberculosis
DLPGQLNE

SEQ ID NO: 1427566 - protein, 4 aa, Mycobacterium tuberculosis
DNNF

SEQ ID NO: 1427567 - protein, 10 aa, Mycobacterium tuberculosis
DNRSTSFAGG

SEQ ID NO: 1427568 - protein, 11 aa, Mycobacterium tuberculosis
DPAPAAPEGPW

SEQ ID NO: 1427569 - protein, 10 aa, Mycobacterium tuberculosis
DPDPDAAGAC

SEQ ID NO: 1427570 - protein, 6 aa, Mycobacterium tuberculosis
DPPQGL

SEQ ID NO: 1427571 - protein, 9 aa, Mycobacterium tuberculosis
DPQPDPGKW

SEQ ID NO: 1427572 - protein, 27 aa, Mycobacterium tuberculosis
DPQRPASPRSQSSRGLPSSPGVTGAAA

SEQ ID NO: 1427573 - protein, 6 aa, Mycobacterium tuberculosis
DPRLPL

SEQ ID NO: 1427574 - protein, 4 aa, Mycobacterium tuberculosis
DQDE

SEQ ID NO: 1427575 - protein, 28 aa, Mycobacterium tuberculosis
DQTPITSSPTTPPPTTPPEIPTGGTVIS

SEQ ID NO: 1427576 - protein, 7 aa, Mycobacterium tuberculosis
DRAAAIE

SEQ ID NO: 1427577 - protein, 11 aa, Mycobacterium tuberculosis
DRDDPGQRGHN

SEQ ID NO: 1427578 - protein, 6 aa, Mycobacterium tuberculosis
DRDGSD

SEQ ID NO: 1427579 - protein, 12 aa, Mycobacterium tuberculosis
DRDSSSPSDELE

SEQ ID NO: 1427580 - protein, 7 aa, Mycobacterium tuberculosis
DRGGITP

SEQ ID NO: 1427581 - protein, 16 aa, Mycobacterium tuberculosis
DRQEVDNALNQAAKEL

SEQ ID NO: 1427582 - protein, 17 aa, Mycobacterium tuberculosis
DRSAPRPNARASGRSIG

SEQ ID NO: 1427583 - protein, 4 aa, Mycobacterium tuberculosis
DSEI

SEQ ID NO: 1427584 - protein, 6 aa, Mycobacterium tuberculosis
DSGHNT

SEQ ID NO: 1427585 - protein, 11 aa, Mycobacterium tuberculosis
DSKATNPHAAR

SEQ ID NO: 1427586 - protein, 8 aa, Mycobacterium tuberculosis
DSNGPHGM

SEQ ID NO: 1427587 - protein, 10 aa, Mycobacterium tuberculosis
DSSDKGFDGA

SEQ ID NO: 1427588 - protein, 9 aa, Mycobacterium tuberculosis
DSTSGFQNI

SEQ ID NO: 1427589 - protein, 4 aa, Mycobacterium tuberculosis
DSVQ

SEQ ID NO: 1427590 - protein, 5 aa, Mycobacterium tuberculosis
DTAGV

SEQ ID NO: 1427591 - protein, 6 aa, Mycobacterium tuberculosis
DTLGPA

SEQ ID NO: 1427592 - protein, 4 aa, Mycobacterium tuberculosis
DTTD

SEQ ID NO: 1427593 - protein, 19 aa, Mycobacterium tuberculosis
DVDPPGPAQAGRRRRAIAM

SEQ ID NO: 1427594 - protein, 15 aa, Mycobacterium tuberculosis
DVTNQPQGNGQAVGN

SEQ ID NO: 1427595 - protein, 7 aa, Mycobacterium tuberculosis
DWAQTEQ

SEQ ID NO: 1427596 - protein, 8 aa, Mycobacterium tuberculosis
EAAGGVGG

SEQ ID NO: 1427597 - protein, 7 aa, Mycobacterium tuberculosis
EADPSMA

SEQ ID NO: 1427598 - protein, 6 aa, Mycobacterium tuberculosis
EAGPAR

SEQ ID NO: 1427599 - protein, 9 aa, Mycobacterium tuberculosis
EAHGTTARG

SEQ ID NO: 1427600 - protein, 5 aa, Mycobacterium tuberculosis
EARRT

SEQ ID NO: 1427601 - protein, 10 aa, Mycobacterium tuberculosis
EATPTLPLPT

SEQ ID NO: 1427602 - protein, 5 aa, Mycobacterium tuberculosis
ECTPD

SEQ ID NO: 1427603 - protein, 6 aa, Mycobacterium tuberculosis
EDCSST

SEQ ID NO: 1427604 - protein, 13 aa, Mycobacterium tuberculosis
EDDPRTLAQRRAD

SEQ ID NO: 1427605 - protein, 6 aa, Mycobacterium tuberculosis
EDGREY

SEQ ID NO: 1427606 - protein, 11 aa, Mycobacterium tuberculosis
EDQYEPGSSRR

SEQ ID NO: 1427607 - protein, 11 aa, Mycobacterium tuberculosis
EEYGGGGNADF

SEQ ID NO: 1427608 - protein, 11 aa, Mycobacterium tuberculosis
EGDTTPLREAG

SEQ ID NO: 1427609 - protein, 8 aa, Mycobacterium tuberculosis
EGPRADSL

SEQ ID NO: 1427610 - protein, 8 aa, Mycobacterium tuberculosis
EGREVTPT

SEQ ID NO: 1427611 - protein, 6 aa, Mycobacterium tuberculosis
EGVDVR

SEQ ID NO: 1427612 - protein, 4 aa, Mycobacterium tuberculosis
EGVS

SEQ ID NO: 1427613 - protein, 6 aa, Mycobacterium tuberculosis
EHEPSD

SEQ ID NO: 1427614 - protein, 8 aa, Mycobacterium tuberculosis
EKGTNRSR

SEQ ID NO: 1427615 - protein, 4 aa, Mycobacterium tuberculosis
EKPV

SEQ ID NO: 1427616 - protein, 8 aa, Mycobacterium tuberculosis
EKSEPLGL

SEQ ID NO: 1427617 - protein, 8 aa, Mycobacterium tuberculosis
EKSSSEPI

SEQ ID NO: 1427618 - protein, 8 aa, Mycobacterium tuberculosis
ELAAPDDD

SEQ ID NO: 1427619 - protein, 12 aa, Mycobacterium tuberculosis
ELAEEPEGAEEV

SEQ ID NO: 1427620 - protein, 7 aa, Mycobacterium tuberculosis
ELGYGSD

SEQ ID NO: 1427621 - protein, 4 aa, Mycobacterium tuberculosis
ELRP

SEQ ID NO: 1427622 - protein, 8 aa, Mycobacterium tuberculosis
ELSHTQGE

SEQ ID NO: 1427623 - protein, 9 aa, Mycobacterium tuberculosis
ENHGGTGTI

SEQ ID NO: 1427624 - protein, 10 aa, Mycobacterium tuberculosis
EPAREHPRPV

SEQ ID NO: 1427625 - protein, 8 aa, Mycobacterium tuberculosis
EPDAESPH

SEQ ID NO: 1427626 - protein, 6 aa, Mycobacterium tuberculosis
EPKTQK

SEQ ID NO: 1427627 - protein, 5 aa, Mycobacterium tuberculosis
EPLTP

SEQ ID NO: 1427628 - protein, 8 aa, Mycobacterium tuberculosis
EPTPEQPA

SEQ ID NO: 1427629 - protein, 8 aa, Mycobacterium tuberculosis
EQATTEAF

SEQ ID NO: 1427630 - protein, 25 aa, Mycobacterium tuberculosis
EQGSNEPEAPDGSGRGGGDGLPHDS

SEQ ID NO: 1427631 - protein, 5 aa, Mycobacterium tuberculosis
ERAGA

SEQ ID NO: 1427632 - protein, 11 aa, Mycobacterium tuberculosis
ERANSVRSDGG

SEQ ID NO: 1427633 - protein, 4 aa, Mycobacterium tuberculosis
ERGA

SEQ ID NO: 1427634 - protein, 12 aa, Mycobacterium tuberculosis
ERLATRRRQSLS

SEQ ID NO: 1427635 - protein, 6 aa, Mycobacterium tuberculosis
ESAASE

SEQ ID NO: 1427636 - protein, 4 aa, Mycobacterium tuberculosis
ESDE

SEQ ID NO: 1427637 - protein, 14 aa, Mycobacterium tuberculosis
ESKVAAARSPIKAD

SEQ ID NO: 1427638 - protein, 6 aa, Mycobacterium tuberculosis
ESLERA

SEQ ID NO: 1427639 - protein, 5 aa, Mycobacterium tuberculosis
ESLVA

SEQ ID NO: 1427640 - protein, 15 aa, Mycobacterium tuberculosis
ESTSWPGVTRPTNIG

SEQ ID NO: 1427641 - protein, 19 aa, Mycobacterium tuberculosis
ETVLGGSTACTSPKANCDR

SEQ ID NO: 1427642 - protein, 4 aa, Mycobacterium tuberculosis
ETWP

SEQ ID NO: 1427643 - protein, 4 aa, Mycobacterium tuberculosis
ETYG

SEQ ID NO: 1427644 - protein, 4 aa, Mycobacterium tuberculosis
EVAS

SEQ ID NO: 1427645 - protein, 7 aa, Mycobacterium tuberculosis
EVEGESA

SEQ ID NO: 1427646 - protein, 5 aa, Mycobacterium tuberculosis
EYDGR

SEQ ID NO: 1427647 - protein, 20 aa, Mycobacterium tuberculosis
EYPNLGEPALPPGDPTSPVR

SEQ ID NO: 1427648 - protein, 62 aa, Mycobacterium tuberculosis
FADTGGKGGNGGNGANAVAPGGTGASGGAGGNAGAGGKGGENIIGDGGGGNGGAGGKGGAGT

SEQ ID NO: 1427649 - protein, 14 aa, Mycobacterium tuberculosis
FAPGGGSGGNGGNG

SEQ ID NO: 1427650 - protein, 8 aa, Mycobacterium tuberculosis
FEDEEHRR

SEQ ID NO: 1427651 - protein, 9 aa, Mycobacterium tuberculosis
FEKPGRHRR

SEQ ID NO: 1427652 - protein, 7 aa, Mycobacterium tuberculosis
FGAGNSG

SEQ ID NO: 1427653 - protein, 14 aa, Mycobacterium tuberculosis
FGEPGGREPKVSGQ

SEQ ID NO: 1427654 - protein, 42 aa, Mycobacterium tuberculosis; identical to SEQ ID NO: 174368

SEQ ID NO: 1427655 - protein, 35 aa, Mycobacterium tuberculosis; identical to SEQ ID NO: 174383

SEQ ID NO: 1427656 - protein, 9 aa, Mycobacterium tuberculosis
FGNTGNGNI

SEQ ID NO: 1427657 - protein, 14 aa, Mycobacterium tuberculosis
FGTAPNPGGGLPYT

SEQ ID NO: 1427658 - protein, 8 aa, Mycobacterium tuberculosis
FNRPDQLS

SEQ ID NO: 1427659 - protein, 6 aa, Mycobacterium tuberculosis
FPPPNT

SEQ ID NO: 1427660 - protein, 14 aa, Mycobacterium tuberculosis
FPRDKPCGDGLTPR

SEQ ID NO: 1427661 - protein, 28 aa, Mycobacterium tuberculosis
FSAEPHATDGSPVANRVEPGKRPRSSMA

SEQ ID NO: 1427662 - protein, 4 aa, Mycobacterium tuberculosis
FSDR

SEQ ID NO: 1427663 - protein, 18 aa, Mycobacterium tuberculosis
FSGPPGTGGPDATGAVGG

SEQ ID NO: 1427664 - protein, 8 aa, Mycobacterium tuberculosis
FTGEGAKL

SEQ ID NO: 1427665 - protein, 20 aa, Mycobacterium tuberculosis
FTTGMTTGTPAAAGAQALSA

SEQ ID NO: 1427666 - protein, 8 aa, Mycobacterium tuberculosis
GAAAKGDV

SEQ ID NO: 1427667 - protein, 26 aa, Mycobacterium tuberculosis
GAAGAGGAATGDGATGGAGGFGGAGA

SEQ ID NO: 1427668 - protein, 7 aa, Mycobacterium tuberculosis
GAAGTSN

SEQ ID NO: 1427669 - protein, 26 aa, Mycobacterium tuberculosis
GAGGAGGTATGTGGNGGAGGGGGLSS

SEQ ID NO: 1427670 - protein, 7 aa, Mycobacterium tuberculosis
GAGPELE

SEQ ID NO: 1427671 - protein, 9 aa, Mycobacterium tuberculosis
GAKTLRGGK

SEQ ID NO: 1427672 - protein, 7 aa, Mycobacterium tuberculosis
GAPPGTL

SEQ ID NO: 1427673 - protein, 4 aa, Mycobacterium tuberculosis
GARI

SEQ ID NO: 1427674 - protein, 8 aa, Mycobacterium tuberculosis
GATAYRNT

SEQ ID NO: 1427675 - protein, 6 aa, Mycobacterium tuberculosis
GATPPD

SEQ ID NO: 1427676 - protein, 8 aa, Mycobacterium tuberculosis
GAVDANQS

SEQ ID NO: 1427677 - protein, 5 aa, Mycobacterium tuberculosis
GCGKT

SEQ ID NO: 1427678 - protein, 6 aa, Mycobacterium tuberculosis
GCPTSS

SEQ ID NO: 1427679 - protein, 9 aa, Mycobacterium tuberculosis
GDARPEAGE

SEQ ID NO: 1427680 - protein, 4 aa, Mycobacterium tuberculosis
GDDP

SEQ ID NO: 1427681 - protein, 9 aa, Mycobacterium tuberculosis
GDEFGNGPR

SEQ ID NO: 1427682 - protein, 31 aa, Mycobacterium tuberculosis; identical to SEQ ID NO: 175034

SEQ ID NO: 1427683 - protein, 11 aa, Mycobacterium tuberculosis
GDLGSAAASFS

SEQ ID NO: 1427684 - protein, 9 aa, Mycobacterium tuberculosis
GDPAAAAAT

SEQ ID NO: 1427685 - protein, 5 aa, Mycobacterium tuberculosis
GDQEI

SEQ ID NO: 1427686 - protein, 4 aa, Mycobacterium tuberculosis
GDSN

SEQ ID NO: 1427687 - protein, 41 aa, Mycobacterium tuberculosis; identical to SEQ ID NO: 194109

SEQ ID NO: 1427688 - protein, 4 aa, Mycobacterium tuberculosis
GDVR

SEQ ID NO: 1427689 - protein, 9 aa, Mycobacterium tuberculosis
GDYDAYRPT

SEQ ID NO: 1427690 - protein, 7 aa, Mycobacterium tuberculosis
GDYPRIG

SEQ ID NO: 1427691 - protein, 5 aa, Mycobacterium tuberculosis
GEAGV

SEQ ID NO: 1427692 - protein, 13 aa, Mycobacterium tuberculosis
GEIAGARAAAAAG

SEQ ID NO: 1427693 - protein, 5 aa, Mycobacterium tuberculosis
GEPCR

SEQ ID NO: 1427694 - protein, 7 aa, Mycobacterium tuberculosis
GEQDRLR

SEQ ID NO: 1427695 - protein, 24 aa, Mycobacterium tuberculosis
GEQRDQPAGRAHQRQRADTAGRAG

SEQ ID NO: 1427696 - protein, 10 aa, Mycobacterium tuberculosis
GERDRARMTQ

SEQ ID NO: 1427697 - protein, 13 aa, Mycobacterium tuberculosis
GERDSNTRPVRGK

SEQ ID NO: 1427698 - protein, 7 aa, Mycobacterium tuberculosis
GERSRES

SEQ ID NO: 1427699 - protein, 6 aa, Mycobacterium tuberculosis
GESDAA

SEQ ID NO: 1427700 - protein, 14 aa, Mycobacterium tuberculosis
GFGAGTGGNGGVGG

SEQ ID NO: 1427701 - protein, 10 aa, Mycobacterium tuberculosis
GFNAPASTPL

SEQ ID NO: 1427702 - protein, 6 aa, Mycobacterium tuberculosis
GFTDTK

SEQ ID NO: 1427703 - protein, 27 aa, Mycobacterium tuberculosis
GGAGGAGGSASGAPGAGGAGGDGGRGG

SEQ ID NO: 1427704 - protein, 23 aa, Mycobacterium tuberculosis
GGAGGNGGAATTGTGGAGGTGGF

SEQ ID NO: 1427705 - protein, 9 aa, Mycobacterium tuberculosis
GGAGPARTG

SEQ ID NO: 1427706 - protein, 6 aa, Mycobacterium tuberculosis
GGANDN

SEQ ID NO: 1427707 - protein, 6 aa, Mycobacterium tuberculosis
GGARNA

SEQ ID NO: 1427708 - protein, 12 aa, Mycobacterium tuberculosis
GGASAAAAALPS

SEQ ID NO: 1427709 - protein, 9 aa, Mycobacterium tuberculosis
GGDATGAEV

SEQ ID NO: 1427710 - protein, 10 aa, Mycobacterium tuberculosis
GGDATGAEVQ

SEQ ID NO: 1427711 - protein, 14 aa, Mycobacterium tuberculosis
GGGGTDVEPYSSQF

SEQ ID NO: 1427712 - protein, 16 aa, Mycobacterium tuberculosis
GGHGGDGGTGGTGGAV

SEQ ID NO: 1427713 - protein, 9 aa, Mycobacterium tuberculosis
GGIGGNTGE

SEQ ID NO: 1427714 - protein, 6 aa, Mycobacterium tuberculosis
GGKLSY

SEQ ID NO: 1427715 - protein, 31 aa, Mycobacterium tuberculosis; identical to SEQ ID NO: 229857

SEQ ID NO: 1427716 - protein, 29 aa, Mycobacterium tuberculosis
GGMGGAGGFGDHGTLGTGGAGGDGGGGGL

SEQ ID NO: 1427717 - protein, 4 aa, Mycobacterium tuberculosis
GGRG

SEQ ID NO: 1427718 - protein, 13 aa, Mycobacterium tuberculosis
GGRGVPAKSLSGF

SEQ ID NO: 1427719 - protein, 8 aa, Mycobacterium tuberculosis
GGSAADAQ

SEQ ID NO: 1427720 - protein, 13 aa, Mycobacterium tuberculosis
GGTTGDVVAPGTT

SEQ ID NO: 1427721 - protein, 24 aa, Mycobacterium tuberculosis
GGVGGAGGQGHTGGAGGAGGAGGL

SEQ ID NO: 1427722 - protein, 44 aa, Mycobacterium tuberculosis
GHGGAGGHGAEGVAGAAGEDLSPHGTSGGVGGDAGDGGTGGRGG

SEQ ID NO: 1427723 - protein, 37 aa, Mycobacterium tuberculosis; identical to SEQ ID NO: 175981

SEQ ID NO: 1427724 - protein, 9 aa, Mycobacterium tuberculosis
GHGGDGGNA

SEQ ID NO: 1427725 - protein, 8 aa, Mycobacterium tuberculosis
GHGGGASY

SEQ ID NO: 1427726 - protein, 11 aa, Mycobacterium tuberculosis
GHNGGPASGTR

SEQ ID NO: 1427727 - protein, 7 aa, Mycobacterium tuberculosis
GIDNARR

SEQ ID NO: 1427728 - protein, 4 aa, Mycobacterium tuberculosis
GKAV

SEQ ID NO: 1427729 - protein, 6 aa, Mycobacterium tuberculosis
GKGGAG

SEQ ID NO: 1427730 - protein, 40 aa, Mycobacterium tuberculosis; identical to SEQ ID NO: 194164

SEQ ID NO: 1427731 - protein, 7 aa, Mycobacterium tuberculosis
GKGGTGL

SEQ ID NO: 1427732 - protein, 13 aa, Mycobacterium tuberculosis
GKPAAQEGSEPWV

SEQ ID NO: 1427733 - protein, 16 aa, Mycobacterium tuberculosis
GKPDCPSGAGNDERAA

SEQ ID NO: 1427734 - protein, 8 aa, Mycobacterium tuberculosis
GKPESMAN

SEQ ID NO: 1427735 - protein, 9 aa, Mycobacterium tuberculosis
GKRRMNNGD

SEQ ID NO: 1427736 - protein, 19 aa, Mycobacterium tuberculosis
GKSSSASRAIDTESNLGQY

SEQ ID NO: 1427737 - protein, 5 aa, Mycobacterium tuberculosis
GLDGE

SEQ ID NO: 1427738 - protein, 4 aa, Mycobacterium tuberculosis
GLGN

SEQ ID NO: 1427739 - protein, 12 aa, Mycobacterium tuberculosis
GLNPPKPQAAGR

SEQ ID NO: 1427740 - protein, 5 aa, Mycobacterium tuberculosis
GLPGK

SEQ ID NO: 1427741 - protein, 11 aa, Mycobacterium tuberculosis
GLTAGAGGLGN

SEQ ID NO: 1427742 - protein, 8 aa, Mycobacterium tuberculosis
GLTEDEKE

SEQ ID NO: 1427743 - protein, 22 aa, Mycobacterium tuberculosis
GLTGRPPRAIPDPTPRSSHGPA

SEQ ID NO: 1427744 - protein, 5 aa, Mycobacterium tuberculosis
GLTSQ

SEQ ID NO: 1427745 - protein, 6 aa, Mycobacterium tuberculosis
GMADPS

SEQ ID NO: 1427746 - protein, 7 aa, Mycobacterium tuberculosis
GMGSGPV

SEQ ID NO: 1427747 - protein, 9 aa, Mycobacterium tuberculosis
GNAGSNNVG

SEQ ID NO: 1427748 - protein, 10 aa, Mycobacterium tuberculosis
GNGATPDSDA

SEQ ID NO: 1427749 - protein, 27 aa, Mycobacterium tuberculosis
GNGGAGGAGGNVASGTAGFGGAGGAGG

SEQ ID NO: 1427750 - protein, 15 aa, Mycobacterium tuberculosis
GNGGAGGAGSAGTGV

SEQ ID NO: 1427751 - protein, 8 aa, Mycobacterium tuberculosis
GNGGAGGI

SEQ ID NO: 1427752 - protein, 47 aa, Mycobacterium tuberculosis
GNGGNGAAGVNAGIAGGSGGAAGLIGNGGSGGAGGAGAAGGSGGQGG

SEQ ID NO: 1427753 - protein, 21 aa, Mycobacterium tuberculosis
GNGGNGGDGGAGANGGAGGTA

SEQ ID NO: 1427754 - protein, 17 aa, Mycobacterium tuberculosis
GNGGNGGNGGNGGAGSL

SEQ ID NO: 1427755 - protein, 32 aa, Mycobacterium tuberculosis
GNGGNGGNGGNSGNAGKSGGAPGPSGAGGAGG

SEQ ID NO: 1427756 - protein, 7 aa, Mycobacterium tuberculosis
GNKPVAE

SEQ ID NO: 1427757 - protein, 6 aa, Mycobacterium tuberculosis
GNPGLS

SEQ ID NO: 1427758 - protein, 42 aa, Mycobacterium tuberculosis
GNSGAYNTGSFNSGTLNTGDLNSGDFNTGWANSGDINTGGFH

SEQ ID NO: 1427759 - protein, 4 aa, Mycobacterium tuberculosis
GNTG

SEQ ID NO: 1427760 - protein, 19 aa, Mycobacterium tuberculosis
GNTGNGNIGIGNTGTGNIG

SEQ ID NO: 1427761 - protein, 9 aa, Mycobacterium tuberculosis
GPAGGDRTT

SEQ ID NO: 1427762 - protein, 5 aa, Mycobacterium tuberculosis
GPEST

SEQ ID NO: 1427763 - protein, 7 aa, Mycobacterium tuberculosis
GPGNRSL

SEQ ID NO: 1427764 - protein, 5 aa, Mycobacterium tuberculosis
GPNLA

SEQ ID NO: 1427765 - protein, 7 aa, Mycobacterium tuberculosis
GPRAEQR

SEQ ID NO: 1427766 - protein, 6 aa, Mycobacterium tuberculosis
GPRHIS

SEQ ID NO: 1427767 - protein, 8 aa, Mycobacterium tuberculosis
GPRPKEPV

SEQ ID NO: 1427768 - protein, 5 aa, Mycobacterium tuberculosis
GPSKA

SEQ ID NO: 1427769 - protein, 22 aa, Mycobacterium tuberculosis
GPVATTTALRTPSTWMTRATAT

SEQ ID NO: 1427770 - protein, 6 aa, Mycobacterium tuberculosis
GPVSTE

SEQ ID NO: 1427771 - protein, 7 aa, Mycobacterium tuberculosis
GQRPRVE

SEQ ID NO: 1427772 - protein, 18 aa, Mycobacterium tuberculosis
GQSRERMRKRGGGPGPAI

SEQ ID NO: 1427773 - protein, 6 aa, Mycobacterium tuberculosis
GQTDTA

SEQ ID NO: 1427774 - protein, 7 aa, Mycobacterium tuberculosis
GQVDDEE

SEQ ID NO: 1427775 - protein, 5 aa, Mycobacterium tuberculosis
GRASA

SEQ ID NO: 1427776 - protein, 5 aa, Mycobacterium tuberculosis
GRDGV

SEQ ID NO: 1427777 - protein, 4 aa, Mycobacterium tuberculosis
GREI

SEQ ID NO: 1427778 - protein, 10 aa, Mycobacterium tuberculosis
GRIEPGPGAR

SEQ ID NO: 1427779 - protein, 11 aa, Mycobacterium tuberculosis
GRISGVTEPGE

SEQ ID NO: 1427780 - protein, 4 aa, Mycobacterium tuberculosis
GRLG

SEQ ID NO: 1427781 - protein, 5 aa, Mycobacterium tuberculosis
GRLGG

SEQ ID NO: 1427782 - protein, 4 aa, Mycobacterium tuberculosis
GRLQ

SEQ ID NO: 1427783 - protein, 7 aa, Mycobacterium tuberculosis
GRPGFAE

SEQ ID NO: 1427784 - protein, 18 aa, Mycobacterium tuberculosis
GRSPGRDSGGRKVPESPK

SEQ ID NO: 1427785 - protein, 4 aa, Mycobacterium tuberculosis
GRVG

SEQ ID NO: 1427786 - protein, 4 aa, Mycobacterium tuberculosis
GSAD

SEQ ID NO: 1427787 - protein, 8 aa, Mycobacterium tuberculosis
GSADPTTI

SEQ ID NO: 1427788 - protein, 10 aa, Mycobacterium tuberculosis
GSANHGSPNV

SEQ ID NO: 1427789 - protein, 4 aa, Mycobacterium tuberculosis
GSAP

SEQ ID NO: 1427790 - protein, 4 aa, Mycobacterium tuberculosis
GSCN

SEQ ID NO: 1427791 - protein, 183 aa, Mycobacterium tuberculosis; identical to SEQ ID NO: 177158

SEQ ID NO: 1427792 - protein, 29 aa, Mycobacterium tuberculosis
GSGGQGGDSAMGSGGAGGAGGSGGAASPF

SEQ ID NO: 1427793 - protein, 4 aa, Mycobacterium tuberculosis
GSGI

SEQ ID NO: 1427794 - protein, 7 aa, Mycobacterium tuberculosis
GSGVTNV

SEQ ID NO: 1427795 - protein, 6 aa, Mycobacterium tuberculosis
GSHKGP

SEQ ID NO: 1427796 - protein, 5 aa, Mycobacterium tuberculosis
GSPGG

SEQ ID NO: 1427797 - protein, 10 aa, Mycobacterium tuberculosis
GSRPATSLTG

SEQ ID NO: 1427798 - protein, 15 aa, Mycobacterium tuberculosis
GSSISAASAAAAGPT

SEQ ID NO: 1427799 - protein, 13 aa, Mycobacterium tuberculosis
GSTRPQWQPPPKF

SEQ ID NO: 1427800 - protein, 7 aa, Mycobacterium tuberculosis
GTDAPLG

SEQ ID NO: 1427801 - protein, 14 aa, Mycobacterium tuberculosis
GTIAQSGRSGGRPA

SEQ ID NO: 1427802 - protein, 6 aa, Mycobacterium tuberculosis
GTNEIQ

SEQ ID NO: 1427803 - protein, 10 aa, Mycobacterium tuberculosis
GTPAQGNYAA

SEQ ID NO: 1427804 - protein, 8 aa, Mycobacterium tuberculosis
GTRDGDLN

SEQ ID NO: 1427805 - protein, 15 aa, Mycobacterium tuberculosis
GTTCQQRSVETTLQG

SEQ ID NO: 1427806 - protein, 5 aa, Mycobacterium tuberculosis
GVDGG

SEQ ID NO: 1427807 - protein, 7 aa, Mycobacterium tuberculosis
GVGKTEL

SEQ ID NO: 1427808 - protein, 4 aa, Mycobacterium tuberculosis
GVGT

SEQ ID NO: 1427809 - protein, 8 aa, Mycobacterium tuberculosis
GWHPDPEA

SEQ ID NO: 1427810 - protein, 19 aa, Mycobacterium tuberculosis
GYANPADNPFRPEGGRLHA

SEQ ID NO: 1427811 - protein, 11 aa, Mycobacterium tuberculosis
GYNAPESTSPW

SEQ ID NO: 1427812 - protein, 7 aa, Mycobacterium tuberculosis
GYSQGAA

SEQ ID NO: 1427813 - protein, 5 aa, Mycobacterium tuberculosis
GYSTE

SEQ ID NO: 1427814 - protein, 31 aa, Mycobacterium tuberculosis
HATTNPGNAAHQGNPADPGNSARRADGGRDE

SEQ ID NO: 1427815 - protein, 14 aa, Mycobacterium tuberculosis
HAVTATDGQARPPA

SEQ ID NO: 1427816 - protein, 16 aa, Mycobacterium tuberculosis
HDGRTARVPGDEITST

SEQ ID NO: 1427817 - protein, 6 aa, Mycobacterium tuberculosis
HDPSDT

SEQ ID NO: 1427818 - protein, 8 aa, Mycobacterium tuberculosis
HERSDEGI

SEQ ID NO: 1427819 - protein, 28 aa, Mycobacterium tuberculosis
HESNTYVAEPGPDAPALTGDRSARSAIP

SEQ ID NO: 1427820 - protein, 24 aa, Mycobacterium tuberculosis
HGGNGGAGGSNAAGAGGVGGAGGA

SEQ ID NO: 1427821 - protein, 20 aa, Mycobacterium tuberculosis
HGGSGGAGGSGAAGGAGGHG

SEQ ID NO: 1427822 - protein, 26 aa, Mycobacterium tuberculosis
HGNAGGVNVGSGNAGLANTGDFNSGG

SEQ ID NO: 1427823 - protein, 6 aa, Mycobacterium tuberculosis
HGRALD

SEQ ID NO: 1427824 - protein, 5 aa, Mycobacterium tuberculosis
HGRTP

SEQ ID NO: 1427825 - protein, 12 aa, Mycobacterium tuberculosis
HGVQPSESVESD

SEQ ID NO: 1427826 - protein, 14 aa, Mycobacterium tuberculosis
HKVAPSAAEQQSMS

SEQ ID NO: 1427827 - protein, 10 aa, Mycobacterium tuberculosis
HNLKEGERLD

SEQ ID NO: 1427828 - protein, 6 aa, Mycobacterium tuberculosis
HNPIHT

SEQ ID NO: 1427829 - protein, 6 aa, Mycobacterium tuberculosis
HNPTMN

SEQ ID NO: 1427830 - protein, 6 aa, Mycobacterium tuberculosis
HPHADT

SEQ ID NO: 1427831 - protein, 5 aa, Mycobacterium tuberculosis
HPRLG

SEQ ID NO: 1427832 - protein, 5 aa, Mycobacterium tuberculosis
HQSTG

SEQ ID NO: 1427833 - protein, 4 aa, Mycobacterium tuberculosis
HRGP

SEQ ID NO: 1427834 - protein, 6 aa, Mycobacterium tuberculosis
HRSTNF

SEQ ID NO: 1427835 - protein, 5 aa, Mycobacterium tuberculosis
HRTRP

SEQ ID NO: 1427836 - protein, 7 aa, Mycobacterium tuberculosis
HSGKAEV

SEQ ID NO: 1427837 - protein, 7 aa, Mycobacterium tuberculosis
HTRASNF

SEQ ID NO: 1427838 - protein, 4 aa, Mycobacterium tuberculosis
HYRS

SEQ ID NO: 1427839 - protein, 4 aa, Mycobacterium tuberculosis
IAPH

SEQ ID NO: 1427840 - protein, 28 aa, Mycobacterium tuberculosis
IAQQHPAGTAITTGRPGPTQTPNTAIAD

SEQ ID NO: 1427841 - protein, 9 aa, Mycobacterium tuberculosis
IASAGANAF

SEQ ID NO: 1427842 - protein, 12 aa, Mycobacterium tuberculosis
IDPAGTDGGPQL

SEQ ID NO: 1427843 - protein, 5 aa, Mycobacterium tuberculosis
IDTVP

SEQ ID NO: 1427844 - protein, 43 aa, Mycobacterium tuberculosis; identical to SEQ ID NO: 178558

SEQ ID NO: 1427845 - protein, 9 aa, Mycobacterium tuberculosis
IGDPGDLSQ

SEQ ID NO: 1427846 - protein, 6 aa, Mycobacterium tuberculosis
IGDQVT

SEQ ID NO: 1427847 - protein, 11 aa, Mycobacterium tuberculosis
IGGAGGRGGDA

SEQ ID NO: 1427848 - protein, 54 aa, Mycobacterium tuberculosis
IGGDGGAGGRAGAIGNGGDGGNGGTSNTPGGSGGDGGNGGNAGLIGNGGNGGNA

SEQ ID NO: 1427849 - protein, 30 aa, Mycobacterium tuberculosis
IGNGGTGGAGGTVTSPNGLGGAGGAGGSAG

SEQ ID NO: 1427850 - protein, 10 aa, Mycobacterium tuberculosis
IGNSGAGNFG

SEQ ID NO: 1427851 - protein, 10 aa, Mycobacterium tuberculosis
IGPGQEGLDQ

SEQ ID NO: 1427852 - protein, 8 aa, Mycobacterium tuberculosis
INTGNGYY

SEQ ID NO: 1427853 - protein, 5 aa, Mycobacterium tuberculosis
IPKGY

SEQ ID NO: 1427854 - protein, 8 aa, Mycobacterium tuberculosis
IQANTQCT

SEQ ID NO: 1427855 - protein, 15 aa, Mycobacterium tuberculosis
IQPSGSVARYESRVG

SEQ ID NO: 1427856 - protein, 9 aa, Mycobacterium tuberculosis
IRGDTDGYG

SEQ ID NO: 1427857 - protein, 6 aa, Mycobacterium tuberculosis
IRPPQR

SEQ ID NO: 1427858 - protein, 4 aa, Mycobacterium tuberculosis
ISNN

SEQ ID NO: 1427859 - protein, 6 aa, Mycobacterium tuberculosis
ITGGRA

SEQ ID NO: 1427860 - protein, 5 aa, Mycobacterium tuberculosis
ITSPA

SEQ ID NO: 1427861 - protein, 8 aa, Mycobacterium tuberculosis
KAAARDRV

SEQ ID NO: 1427862 - protein, 9 aa, Mycobacterium tuberculosis
KAGELSANG

SEQ ID NO: 1427863 - protein, 13 aa, Mycobacterium tuberculosis
KATSSPSPRTVDS

SEQ ID NO: 1427864 - protein, 7 aa, Mycobacterium tuberculosis
KEACGAS

SEQ ID NO: 1427865 - protein, 12 aa, Mycobacterium tuberculosis
KGESARKAGRRA

SEQ ID NO: 1427866 - protein, 10 aa, Mycobacterium tuberculosis
KGGAGKTTLT

SEQ ID NO: 1427867 - protein, 6 aa, Mycobacterium tuberculosis
KGVEKD

SEQ ID NO: 1427868 - protein, 5 aa, Mycobacterium tuberculosis
KHAPA

SEQ ID NO: 1427869 - protein, 7 aa, Mycobacterium tuberculosis
KPKQTAQ

SEQ ID NO: 1427870 - protein, 10 aa, Mycobacterium tuberculosis
KPSTRTRRLD

SEQ ID NO: 1427871 - protein, 12 aa, Mycobacterium tuberculosis
KQVAAGEPLPSA

SEQ ID NO: 1427872 - protein, 12 aa, Mycobacterium tuberculosis
KRERGIDAPGPH

SEQ ID NO: 1427873 - protein, 9 aa, Mycobacterium tuberculosis
KRKGRIYSD

SEQ ID NO: 1427874 - protein, 6 aa, Mycobacterium tuberculosis
KRYEGD

SEQ ID NO: 1427875 - protein, 21 aa, Mycobacterium tuberculosis
KSGAAGVAERKQDPLTPAARD

SEQ ID NO: 1427876 - protein, 9 aa, Mycobacterium tuberculosis
KSSARPALD

SEQ ID NO: 1427877 - protein, 12 aa, Mycobacterium tuberculosis
KSYQSGDLANAR

SEQ ID NO: 1427878 - protein, 19 aa, Mycobacterium tuberculosis
KTPTGRSAIAADRGIDEHC

SEQ ID NO: 1427879 - protein, 8 aa, Mycobacterium tuberculosis
KTSDDDMD

SEQ ID NO: 1427880 - protein, 8 aa, Mycobacterium tuberculosis
KTSSAPAA

SEQ ID NO: 1427881 - protein, 11 aa, Mycobacterium tuberculosis
KVDGSGGIRGP

SEQ ID NO: 1427882 - protein, 8 aa, Mycobacterium tuberculosis
KVRKATEA

SEQ ID NO: 1427883 - protein, 16 aa, Mycobacterium tuberculosis
LAEGTGAAIAPAEGAR

SEQ ID NO: 1427884 - protein, 10 aa, Mycobacterium tuberculosis
LAGKDELTGK

SEQ ID NO: 1427885 - protein, 6 aa, Mycobacterium tuberculosis
LAGNPI

SEQ ID NO: 1427886 - protein, 4 aa, Mycobacterium tuberculosis
LANA

SEQ ID NO: 1427887 - protein, 5 aa, Mycobacterium tuberculosis
LAPEL

SEQ ID NO: 1427888 - protein, 5 aa, Mycobacterium tuberculosis
LARPQ

SEQ ID NO: 1427889 - protein, 13 aa, Mycobacterium tuberculosis
LASTTGRGQDHEM

SEQ ID NO: 1427890 - protein, 9 aa, Mycobacterium tuberculosis
LDEGEPFGL

SEQ ID NO: 1427891 - protein, 6 aa, Mycobacterium tuberculosis
LDGKAG

SEQ ID NO: 1427892 - protein, 6 aa, Mycobacterium tuberculosis
LDPDYA

SEQ ID NO: 1427893 - protein, 7 aa, Mycobacterium tuberculosis
LDPGKLP

SEQ ID NO: 1427894 - protein, 12 aa, Mycobacterium tuberculosis
LDTLGQAEAAGA

SEQ ID NO: 1427895 - protein, 13 aa, Mycobacterium tuberculosis
LEDNTNERVSASS

SEQ ID NO: 1427896 - protein, 8 aa, Mycobacterium tuberculosis
LGANGATL

SEQ ID NO: 1427897 - protein, 74 aa, Mycobacterium tuberculosis
LGGGGGAGGVGGTGGIGGIGGAGGNGGAGGAGTTTGGGATIGGGGGTGGVGGAGGTGGTGGAGGTTGGSGGAGG

SEQ ID NO: 1427898 - protein, 15 aa, Mycobacterium tuberculosis
LGGGNTGNANLGGGN

SEQ ID NO: 1427899 - protein, 4 aa, Mycobacterium tuberculosis
LGPR

SEQ ID NO: 1427900 - protein, 5 aa, Mycobacterium tuberculosis
LGTSQ

SEQ ID NO: 1427901 - protein, 29 aa, Mycobacterium tuberculosis
LNASGGAGGSGGSSLSGKAGAGGAGGSAG

SEQ ID NO: 1427902 - protein, 4 aa, Mycobacterium tuberculosis
LNDP

SEQ ID NO: 1427903 - protein, 7 aa, Mycobacterium tuberculosis
LNPDENS

SEQ ID NO: 1427904 - protein, 12 aa, Mycobacterium tuberculosis
LPATARDPRVEN

SEQ ID NO: 1427905 - protein, 12 aa, Mycobacterium tuberculosis
LPATPIADSADD

SEQ ID NO: 1427906 - protein, 7 aa, Mycobacterium tuberculosis
LPDPDRL

SEQ ID NO: 1427907 - protein, 27 aa, Mycobacterium tuberculosis
LPEPDPQPADAPPPGDVTEAPAETPQV

SEQ ID NO: 1427908 - protein, 8 aa, Mycobacterium tuberculosis
LPGAAQRA

SEQ ID NO: 1427909 - protein, 10 aa, Mycobacterium tuberculosis
LPGDRPAVCE

SEQ ID NO: 1427910 - protein, 16 aa, Mycobacterium tuberculosis
LPNPTAPALASGPAAL

SEQ ID NO: 1427911 - protein, 7 aa, Mycobacterium tuberculosis
LPPEGRF

SEQ ID NO: 1427912 - protein, 10 aa, Mycobacterium tuberculosis
LPPPAPQPAL

SEQ ID NO: 1427913 - protein, 6 aa, Mycobacterium tuberculosis
LPQADR

SEQ ID NO: 1427914 - protein, 6 aa, Mycobacterium tuberculosis
LPRDEG

SEQ ID NO: 1427915 - protein, 12 aa, Mycobacterium tuberculosis
LPSGGFTEPNPA

SEQ ID NO: 1427916 - protein, 6 aa, Mycobacterium tuberculosis
LPVPQT

SEQ ID NO: 1427917 - protein, 10 aa, Mycobacterium tuberculosis
LQGTTGGERD

SEQ ID NO: 1427918 - protein, 11 aa, Mycobacterium tuberculosis
LRAPSAGEPCR

SEQ ID NO: 1427919 - protein, 6 aa, Mycobacterium tuberculosis
LRDPRQ

SEQ ID NO: 1427920 - protein, 4 aa, Mycobacterium tuberculosis
LRGR

SEQ ID NO: 1427921 - protein, 5 aa, Mycobacterium tuberculosis
LRGSR

SEQ ID NO: 1427922 - protein, 9 aa, Mycobacterium tuberculosis
LRKANAQHT

SEQ ID NO: 1427923 - protein, 14 aa, Mycobacterium tuberculosis
LRPAQSYPQKPPVG

SEQ ID NO: 1427924 - protein, 12 aa, Mycobacterium tuberculosis
LRRPPPSRFNSK

SEQ ID NO: 1427925 - protein, 18 aa, Mycobacterium tuberculosis
LRSSREVARRGPGRVPDG

SEQ ID NO: 1427926 - protein, 8 aa, Mycobacterium tuberculosis
LSGTAERP

SEQ ID NO: 1427927 - protein, 4 aa, Mycobacterium tuberculosis
LSPQ

SEQ ID NO: 1427928 - protein, 4 aa, Mycobacterium tuberculosis
LTDA

SEQ ID NO: 1427929 - protein, 4 aa, Mycobacterium tuberculosis
LTGK

SEQ ID NO: 1427930 - protein, 8 aa, Mycobacterium tuberculosis
LTLPPGAR

SEQ ID NO: 1427931 - protein, 6 aa, Mycobacterium tuberculosis
LTPDRV

SEQ ID NO: 1427932 - protein, 12 aa, Mycobacterium tuberculosis
LTPRPQPADGVS

SEQ ID NO: 1427933 - protein, 5 aa, Mycobacterium tuberculosis
LTQRL

SEQ ID NO: 1427934 - protein, 15 aa, Mycobacterium tuberculosis
LVDPPSSLDCRVPFP

SEQ ID NO: 1427935 - protein, 5 aa, Mycobacterium tuberculosis
MGRGQ

SEQ ID NO: 1427936 - protein, 13 aa, Mycobacterium tuberculosis
MGTGTSERDERDR

SEQ ID NO: 1427937 - protein, 8 aa, Mycobacterium tuberculosis
MSGRARDG

SEQ ID NO: 1427938 - protein, 11 aa, Mycobacterium tuberculosis
MSQTESEQMKE

SEQ ID NO: 1427939 - protein, 43 aa, Mycobacterium tuberculosis; identical to SEQ ID NO: 181021

SEQ ID NO: 1427940 - protein, 12 aa, Mycobacterium tuberculosis
NANTGSLNTGSY

SEQ ID NO: 1427941 - protein, 6 aa, Mycobacterium tuberculosis
NDTRVS

SEQ ID NO: 1427942 - protein, 10 aa, Mycobacterium tuberculosis
NDTSLSRNGY

SEQ ID NO: 1427943 - protein, 10 aa, Mycobacterium tuberculosis
NEGTEGAERA

SEQ ID NO: 1427944 - protein, 7 aa, Mycobacterium tuberculosis
NEITPTN

SEQ ID NO: 1427945 - protein, 9 aa, Mycobacterium tuberculosis
NEPTQALTG

SEQ ID NO: 1427946 - protein, 6 aa, Mycobacterium tuberculosis
NESDTA

SEQ ID NO: 1427947 - protein, 8 aa, Mycobacterium tuberculosis
NFTQTSDD

SEQ ID NO: 1427948 - protein, 15 aa, Mycobacterium tuberculosis
NGADGGPGQNGGPGG

SEQ ID NO: 1427949 - protein, 7 aa, Mycobacterium tuberculosis
NGAGARV

SEQ ID NO: 1427950 - protein, 17 aa, Mycobacterium tuberculosis
NGAGGGGGVGGNGATGP

SEQ ID NO: 1427951 - protein, 5 aa, Mycobacterium tuberculosis
NGFGA

SEQ ID NO: 1427952 - protein, 38 aa, Mycobacterium tuberculosis; identical to SEQ ID NO: 181290

SEQ ID NO: 1427953 - protein, 4 aa, Mycobacterium tuberculosis
NGGE

SEQ ID NO: 1427954 - protein, 18 aa, Mycobacterium tuberculosis
NGGEGGIGALAGKSGFGG

SEQ ID NO: 1427955 - protein, 57 aa, Mycobacterium tuberculosis; identical to SEQ ID NO: 181311

SEQ ID NO: 1427956 - protein, 15 aa, Mycobacterium tuberculosis
NGGLGGAGGDGGNAG

SEQ ID NO: 1427957 - protein, 44 aa, Mycobacterium tuberculosis; identical to SEQ ID NO: 181323

SEQ ID NO: 1427958 - protein, 20 aa, Mycobacterium tuberculosis
NGGNGGSGAPGQAGGAGGAA

SEQ ID NO: 1427959 - protein, 22 aa, Mycobacterium tuberculosis
NGGNGGSGAPGQRGGAGGAAGL

SEQ ID NO: 1427960 - protein, 22 aa, Mycobacterium tuberculosis
NGGPGGLGGPGTSAGNGGMGGN

SEQ ID NO: 1427961 - protein, 27 aa, Mycobacterium tuberculosis
NGGSGGHGGAVTAGNTGIGGAGGVGGD

SEQ ID NO: 1427962 - protein, 19 aa, Mycobacterium tuberculosis
NGHTSGHTSPASEPGGRYP

SEQ ID NO: 1427963 - protein, 10 aa, Mycobacterium tuberculosis
NGSGNGEPTG

SEQ ID NO: 1427964 - protein, 6 aa, Mycobacterium tuberculosis
NHYPDD

SEQ ID NO: 1427965 - protein, 4 aa, Mycobacterium tuberculosis
NKTL

SEQ ID NO: 1427966 - protein, 6 aa, Mycobacterium tuberculosis
NKVPGA

SEQ ID NO: 1427967 - protein, 4 aa, Mycobacterium tuberculosis
NNFG

SEQ ID NO: 1427968 - protein, 6 aa, Mycobacterium tuberculosis
NNRVRI

SEQ ID NO: 1427969 - protein, 6 aa, Mycobacterium tuberculosis
NPKLPG

SEQ ID NO: 1427970 - protein, 8 aa, Mycobacterium tuberculosis
NPSSPVSL

SEQ ID NO: 1427971 - protein, 4 aa, Mycobacterium tuberculosis
NRAG

SEQ ID NO: 1427972 - protein, 7 aa, Mycobacterium tuberculosis
NRIKTSQ

SEQ ID NO: 1427973 - protein, 17 aa, Mycobacterium tuberculosis
NRSVPDGVAAGSPEERA

SEQ ID NO: 1427974 - protein, 17 aa, Mycobacterium tuberculosis
NSGNYNTGLANSGNVNT

SEQ ID NO: 1427975 - protein, 7 aa, Mycobacterium tuberculosis
NSGSNNI

SEQ ID NO: 1427976 - protein, 10 aa, Mycobacterium tuberculosis
NSQPAQRTRH

SEQ ID NO: 1427977 - protein, 9 aa, Mycobacterium tuberculosis
NSTIGTGTK

SEQ ID NO: 1427978 - protein, 4 aa, Mycobacterium tuberculosis
NSTR

SEQ ID NO: 1427979 - protein, 4 aa, Mycobacterium tuberculosis
NTDE

SEQ ID NO: 1427980 - protein, 11 aa, Mycobacterium tuberculosis
NTGGLPPGTPA

SEQ ID NO: 1427981 - protein, 14 aa, Mycobacterium tuberculosis
NTGIANPGSYNTGS

SEQ ID NO: 1427982 - protein, 31 aa, Mycobacterium tuberculosis
NTGLANAGSYNTGSLNAGNTNTGGFNPGNVN

SEQ ID NO: 1427983 - protein, 30 aa, Mycobacterium tuberculosis; identical to SEQ ID NO: 181843

SEQ ID NO: 1427984 - protein, 7 aa, Mycobacterium tuberculosis
NVGGGNV

SEQ ID NO: 1427985 - protein, 4 aa, Mycobacterium tuberculosis
NVPK

SEQ ID NO: 1427986 - protein, 10 aa, Mycobacterium tuberculosis
NWGDPGRRST

SEQ ID NO: 1427987 - protein, 23 aa, Mycobacterium tuberculosis
NWRSDSANHALRGSRNHADADQV

SEQ ID NO: 1427988 - protein, 17 aa, Mycobacterium tuberculosis
PAAATAAVTPPALNTGL

SEQ ID NO: 1427989 - protein, 15 aa, Mycobacterium tuberculosis
PAARPAPHFCDVRCS

SEQ ID NO: 1427990 - protein, 6 aa, Mycobacterium tuberculosis
PAATPW

SEQ ID NO: 1427991 - protein, 24 aa, Mycobacterium tuberculosis
PAGDPVESGDDLGCDTNPDTPTGR

SEQ ID NO: 1427992 - protein, 6 aa, Mycobacterium tuberculosis
PAHPTG

SEQ ID NO: 1427993 - protein, 15 aa, Mycobacterium tuberculosis
PAPDRLEHDADEAWR

SEQ ID NO: 1427994 - protein, 10 aa, Mycobacterium tuberculosis
PAQPTAAEAN

SEQ ID NO: 1427995 - protein, 14 aa, Mycobacterium tuberculosis
PAVTVDQPNPSTRF

SEQ ID NO: 1427996 - protein, 4 aa, Mycobacterium tuberculosis
PDEA

SEQ ID NO: 1427997 - protein, 4 aa, Mycobacterium tuberculosis
PDFR

SEQ ID NO: 1427998 - protein, 7 aa, Mycobacterium tuberculosis
PDGHTED

SEQ ID NO: 1427999 - protein, 20 aa, Mycobacterium tuberculosis
PDGSPKPAGTRLTNPAYSKT

SEQ ID NO: 1428000 - protein, 16 aa, Mycobacterium tuberculosis
PDGTKTPGKTVPDPYF

SEQ ID NO: 1428001 - protein, 8 aa, Mycobacterium tuberculosis
PDRVPGLS

SEQ ID NO: 1428002 - protein, 5 aa, Mycobacterium tuberculosis
PEPTH

SEQ ID NO: 1428003 - protein, 23 aa, Mycobacterium tuberculosis
PEPVPQADPGQPWPGRLPDPSPA

SEQ ID NO: 1428004 - protein, 18 aa, Mycobacterium tuberculosis
PFAPPPNTTSPSAAATQL

SEQ ID NO: 1428005 - protein, 5 aa, Mycobacterium tuberculosis
PFGSP

SEQ ID NO: 1428006 - protein, 15 aa, Mycobacterium tuberculosis
PFNTGFGNGGNTNFG

SEQ ID NO: 1428007 - protein, 4 aa, Mycobacterium tuberculosis
PGAA

SEQ ID NO: 1428008 - protein, 7 aa, Mycobacterium tuberculosis
PGAGGEE

SEQ ID NO: 1428009 - protein, 5 aa, Mycobacterium tuberculosis
PGATG

SEQ ID NO: 1428010 - protein, 9 aa, Mycobacterium tuberculosis
PGCDAPAYH

SEQ ID NO: 1428011 - protein, 7 aa, Mycobacterium tuberculosis
PGEAAIS

SEQ ID NO: 1428012 - protein, 6 aa, Mycobacterium tuberculosis
PGFGKS

SEQ ID NO: 1428013 - protein, 12 aa, Mycobacterium tuberculosis
PGFGNTTAVPSS

SEQ ID NO: 1428014 - protein, 13 aa, Mycobacterium tuberculosis
PGHQTREHRQYGE

SEQ ID NO: 1428015 - protein, 7 aa, Mycobacterium tuberculosis
PGKATAV

SEQ ID NO: 1428016 - protein, 4 aa, Mycobacterium tuberculosis
PGLP

SEQ ID NO: 1428017 - protein, 6 aa, Mycobacterium tuberculosis
PGPDGE

SEQ ID NO: 1428018 - protein, 8 aa, Mycobacterium tuberculosis
PGPPVPTT

SEQ ID NO: 1428019 - protein, 10 aa, Mycobacterium tuberculosis
PGRPSRTPAQ

SEQ ID NO: 1428020 - protein, 6 aa, Mycobacterium tuberculosis
PGRRAR

SEQ ID NO: 1428021 - protein, 4 aa, Mycobacterium tuberculosis
PGRS

SEQ ID NO: 1428022 - protein, 4 aa, Mycobacterium tuberculosis
PGRV

SEQ ID NO: 1428023 - protein, 5 aa, Mycobacterium tuberculosis
PGSPD

SEQ ID NO: 1428024 - protein, 10 aa, Mycobacterium tuberculosis
PKATPAQTQA

SEQ ID NO: 1428025 - protein, 7 aa, Mycobacterium tuberculosis
PKTAPHG

SEQ ID NO: 1428026 - protein, 4 aa, Mycobacterium tuberculosis
PKTQ

SEQ ID NO: 1428027 - protein, 12 aa, Mycobacterium tuberculosis
PLGYGGVDGDER

SEQ ID NO: 1428028 - protein, 7 aa, Mycobacterium tuberculosis
PLNDPFT

SEQ ID NO: 1428029 - protein, 4 aa, Mycobacterium tuberculosis
PLQR

SEQ ID NO: 1428030 - protein, 5 aa, Mycobacterium tuberculosis
PLSAT

SEQ ID NO: 1428031 - protein, 5 aa, Mycobacterium tuberculosis
PPGIG

SEQ ID NO: 1428032 - protein, 9 aa, Mycobacterium tuberculosis
PPGVEDGQR

SEQ ID NO: 1428033 - protein, 9 aa, Mycobacterium tuberculosis
PPKGLSQEE

SEQ ID NO: 1428034 - protein, 60 aa, Mycobacterium tuberculosis
PPKPPRPPWAKPPVNSSANPPFPPSPPRPPGAPAPPMPPLPPAPPAPPLPINPALLPAPR

SEQ ID NO: 1428035 - protein, 4 aa, Mycobacterium tuberculosis
PPNL

SEQ ID NO: 1428036 - protein, 7 aa, Mycobacterium tuberculosis
PPVATPT

SEQ ID NO: 1428037 - protein, 14 aa, Mycobacterium tuberculosis
PQCTDPDVPPAPDD

SEQ ID NO: 1428038 - protein, 5 aa, Mycobacterium tuberculosis
PQDPM

SEQ ID NO: 1428039 - protein, 12 aa, Mycobacterium tuberculosis
PQPRPPRETWES

SEQ ID NO: 1428040 - protein, 22 aa, Mycobacterium tuberculosis
PQYSNPEPAGTATITGYRADND

SEQ ID NO: 1428041 - protein, 5 aa, Mycobacterium tuberculosis
PRPRW

SEQ ID NO: 1428042 - protein, 6 aa, Mycobacterium tuberculosis
PRTGEG

SEQ ID NO: 1428043 - protein, 6 aa, Mycobacterium tuberculosis
PSREDA

SEQ ID NO: 1428044 - protein, 4 aa, Mycobacterium tuberculosis
PSTV

SEQ ID NO: 1428045 - protein, 5 aa, Mycobacterium tuberculosis
PTDAA

SEQ ID NO: 1428046 - protein, 7 aa, Mycobacterium tuberculosis
PTEALTG

SEQ ID NO: 1428047 - protein, 4 aa, Mycobacterium tuberculosis
PTLK

SEQ ID NO: 1428048 - protein, 5 aa, Mycobacterium tuberculosis
PTSGL

SEQ ID NO: 1428049 - protein, 6 aa, Mycobacterium tuberculosis
PTSNIH

SEQ ID NO: 1428050 - protein, 4 aa, Mycobacterium tuberculosis
PTWE

SEQ ID NO: 1428051 - protein, 6 aa, Mycobacterium tuberculosis
PTYPGD

SEQ ID NO: 1428052 - protein, 12 aa, Mycobacterium tuberculosis
PVAGPAELAAGR

SEQ ID NO: 1428053 - protein, 7 aa, Mycobacterium tuberculosis
PVGTTDR

SEQ ID NO: 1428054 - protein, 15 aa, Mycobacterium tuberculosis
PVQTTNASGLAAQSA

SEQ ID NO: 1428055 - protein, 12 aa, Mycobacterium tuberculosis
PVSVDAADGLRA

SEQ ID NO: 1428056 - protein, 4 aa, Mycobacterium tuberculosis
PWEG

SEQ ID NO: 1428057 - protein, 10 aa, Mycobacterium tuberculosis
PYDHDEKGRV

SEQ ID NO: 1428058 - protein, 8 aa, Mycobacterium tuberculosis
PYDPSESQ

SEQ ID NO: 1428059 - protein, 5 aa, Mycobacterium tuberculosis
PYLPP

SEQ ID NO: 1428060 - protein, 9 aa, Mycobacterium tuberculosis
QAADPRSDL

SEQ ID NO: 1428061 - protein, 10 aa, Mycobacterium tuberculosis
QACEEELGGT

SEQ ID NO: 1428062 - protein, 6 aa, Mycobacterium tuberculosis
QAEHPG

SEQ ID NO: 1428063 - protein, 6 aa, Mycobacterium tuberculosis
QAEVDS

SEQ ID NO: 1428064 - protein, 13 aa, Mycobacterium tuberculosis
QAGSGGTPLPLED

SEQ ID NO: 1428065 - protein, 8 aa, Mycobacterium tuberculosis
QAGSQYFP

SEQ ID NO: 1428066 - protein, 6 aa, Mycobacterium tuberculosis
QAQPAR

SEQ ID NO: 1428067 - protein, 9 aa, Mycobacterium tuberculosis
QARTRSVAN

SEQ ID NO: 1428068 - protein, 15 aa, Mycobacterium tuberculosis
QASPSRIDGTHQTLQ

SEQ ID NO: 1428069 - protein, 9 aa, Mycobacterium tuberculosis
QATTRAGPY

SEQ ID NO: 1428070 - protein, 4 aa, Mycobacterium tuberculosis
QGMG

SEQ ID NO: 1428071 - protein, 16 aa, Mycobacterium tuberculosis
QGNPAQQRYPPWPASY

SEQ ID NO: 1428072 - protein, 5 aa, Mycobacterium tuberculosis
QGWQP

SEQ ID NO: 1428073 - protein, 14 aa, Mycobacterium tuberculosis
QHLSPEGRKTYRST

SEQ ID NO: 1428074 - protein, 8 aa, Mycobacterium tuberculosis
QIGTPEEL

SEQ ID NO: 1428075 - protein, 9 aa, Mycobacterium tuberculosis
QKLSTRRAK

SEQ ID NO: 1428076 - protein, 6 aa, Mycobacterium tuberculosis
QNATPT

SEQ ID NO: 1428077 - protein, 10 aa, Mycobacterium tuberculosis
QNTKDAGGTR

SEQ ID NO: 1428078 - protein, 5 aa, Mycobacterium tuberculosis
QPKYV

SEQ ID NO: 1428079 - protein, 16 aa, Mycobacterium tuberculosis
QPLDAKKSAKTTAAGT

SEQ ID NO: 1428080 - protein, 12 aa, Mycobacterium tuberculosis
QPLGGKAQFGGQ

SEQ ID NO: 1428081 - protein, 11 aa, Mycobacterium tuberculosis
QQRYPPWPASY

SEQ ID NO: 1428082 - protein, 5 aa, Mycobacterium tuberculosis
QRAGR

SEQ ID NO: 1428083 - protein, 31 aa, Mycobacterium tuberculosis; identical to SEQ ID NO: 1369939

SEQ ID NO: 1428084 - protein, 15 aa, Mycobacterium tuberculosis
QRTPPNIQPGPGQNP

SEQ ID NO: 1428085 - protein, 23 aa, Mycobacterium tuberculosis
QRWEPPGQFGAARTDTGWPGRSV

SEQ ID NO: 1428086 - protein, 9 aa, Mycobacterium tuberculosis
QSEETEPLC

SEQ ID NO: 1428087 - protein, 7 aa, Mycobacterium tuberculosis
QSSNGPL

SEQ ID NO: 1428088 - protein, 11 aa, Mycobacterium tuberculosis
QTEVAGAGSGF

SEQ ID NO: 1428089 - protein, 7 aa, Mycobacterium tuberculosis
QTLPPGR

SEQ ID NO: 1428090 - protein, 7 aa, Mycobacterium tuberculosis
QTPPQPL

SEQ ID NO: 1428091 - protein, 9 aa, Mycobacterium tuberculosis
QTRAQRVTS

SEQ ID NO: 1428092 - protein, 21 aa, Mycobacterium tuberculosis
QVESSDTLPNTKIRGFDGPSV

SEQ ID NO: 1428093 - protein, 7 aa, Mycobacterium tuberculosis
RAATAAH

SEQ ID NO: 1428094 - protein, 14 aa, Mycobacterium tuberculosis
RAEQRRRGREAEEA

SEQ ID NO: 1428095 - protein, 10 aa, Mycobacterium tuberculosis
RAGAKQIDGS

SEQ ID NO: 1428096 - protein, 4 aa, Mycobacterium tuberculosis
RAGD

SEQ ID NO: 1428097 - protein, 21 aa, Mycobacterium tuberculosis
RAGHPAQDTRHGRPTLSAGTA

SEQ ID NO: 1428098 - protein, 18 aa, Mycobacterium tuberculosis
RAGRTPRTVTADRGYGEA

SEQ ID NO: 1428099 - protein, 18 aa, Mycobacterium tuberculosis
RANGGSGSAANASREEQI

SEQ ID NO: 1428100 - protein, 6 aa, Mycobacterium tuberculosis
RAPDID

SEQ ID NO: 1428101 - protein, 8 aa, Mycobacterium tuberculosis
RAQATEDL

SEQ ID NO: 1428102 - protein, 6 aa, Mycobacterium tuberculosis
RASDAA

SEQ ID NO: 1428103 - protein, 12 aa, Mycobacterium tuberculosis
RASKAPRSNPEA

SEQ ID NO: 1428104 - protein, 13 aa, Mycobacterium tuberculosis
RAVRDGEQLPRSV

SEQ ID NO: 1428105 - protein, 28 aa, Mycobacterium tuberculosis
RCPPEGPSKGSSGGSSQGPPDGAAAGFG

SEQ ID NO: 1428106 - protein, 7 aa, Mycobacterium tuberculosis
REHTDPF

SEQ ID NO: 1428107 - protein, 7 aa, Mycobacterium tuberculosis
REPRPYP

SEQ ID NO: 1428108 - protein, 8 aa, Mycobacterium tuberculosis
RESDEEMA

SEQ ID NO: 1428109 - protein, 12 aa, Mycobacterium tuberculosis
REVTSAISKSHS

SEQ ID NO: 1428110 - protein, 12 aa, Mycobacterium tuberculosis
RGCGRRGRVTTK

SEQ ID NO: 1428111 - protein, 12 aa, Mycobacterium tuberculosis
RGLAAGNAATMP

SEQ ID NO: 1428112 - protein, 7 aa, Mycobacterium tuberculosis
RGNGGTA

SEQ ID NO: 1428113 - protein, 33 aa, Mycobacterium tuberculosis; identical to SEQ ID NO: 185420

SEQ ID NO: 1428114 - protein, 8 aa, Mycobacterium tuberculosis
RGTAETAG

SEQ ID NO: 1428115 - protein, 26 aa, Mycobacterium tuberculosis
RHHRRQDRRRGGLGPGPAPSPSHRAG

SEQ ID NO: 1428116 - protein, 4 aa, Mycobacterium tuberculosis
RIQS

SEQ ID NO: 1428117 - protein, 9 aa, Mycobacterium tuberculosis
RITGDGGTA

SEQ ID NO: 1428118 - protein, 7 aa, Mycobacterium tuberculosis
RITSPDE

SEQ ID NO: 1428119 - protein, 7 aa, Mycobacterium tuberculosis
RKDIRTT

SEQ ID NO: 1428120 - protein, 7 aa, Mycobacterium tuberculosis
RKPPIEH

SEQ ID NO: 1428121 - protein, 11 aa, Mycobacterium tuberculosis
RLATRRRQSLS

SEQ ID NO: 1428122 - protein, 6 aa, Mycobacterium tuberculosis
RLGETR

SEQ ID NO: 1428123 - protein, 5 aa, Mycobacterium tuberculosis
RLQRT

SEQ ID NO: 1428124 - protein, 27 aa, Mycobacterium tuberculosis
RLRSPPNPNRADPPHPAPPRLRSPLGQ

SEQ ID NO: 1428125 - protein, 11 aa, Mycobacterium tuberculosis
RLTDGQGRTVD

SEQ ID NO: 1428126 - protein, 6 aa, Mycobacterium tuberculosis
RMGSKS

SEQ ID NO: 1428127 - protein, 5 aa, Mycobacterium tuberculosis
RMPGG

SEQ ID NO: 1428128 - protein, 9 aa, Mycobacterium tuberculosis
RNARDRPTA

SEQ ID NO: 1428129 - protein, 6 aa, Mycobacterium tuberculosis
RNDGTW

SEQ ID NO: 1428130 - protein, 8 aa, Mycobacterium tuberculosis
RNGDGKSS

SEQ ID NO: 1428131 - protein, 6 aa, Mycobacterium tuberculosis
RNRISG

SEQ ID NO: 1428132 - protein, 5 aa, Mycobacterium tuberculosis
RNSAN

SEQ ID NO: 1428133 - protein, 6 aa, Mycobacterium tuberculosis
RNSRDS

SEQ ID NO: 1428134 - protein, 4 aa, Mycobacterium tuberculosis
RNVS

SEQ ID NO: 1428135 - protein, 6 aa, Mycobacterium tuberculosis
RPDQLS

SEQ ID NO: 1428136 - protein, 7 aa, Mycobacterium tuberculosis
RPEPPSW

SEQ ID NO: 1428137 - protein, 7 aa, Mycobacterium tuberculosis
RPGEGRT

SEQ ID NO: 1428138 - protein, 13 aa, Mycobacterium tuberculosis
RPGIPPTRPVQGP

SEQ ID NO: 1428139 - protein, 8 aa, Mycobacterium tuberculosis
RPGRRRPR

SEQ ID NO: 1428140 - protein, 6 aa, Mycobacterium tuberculosis
RPLTNV

SEQ ID NO: 1428141 - protein, 13 aa, Mycobacterium tuberculosis
RPTAVEGDATPIS

SEQ ID NO: 1428142 - protein, 4 aa, Mycobacterium tuberculosis
RPYQ

SEQ ID NO: 1428143 - protein, 9 aa, Mycobacterium tuberculosis
RQGARTDLK

SEQ ID NO: 1428144 - protein, 4 aa, Mycobacterium tuberculosis
RQLD

SEQ ID NO: 1428145 - protein, 21 aa, Mycobacterium tuberculosis
RRDKISKVKTAALKGSPQRRG

SEQ ID NO: 1428146 - protein, 7 aa, Mycobacterium tuberculosis
RRGEPRG

SEQ ID NO: 1428147 - protein, 17 aa, Mycobacterium tuberculosis
RRGRARSVTGIAPAGGW

SEQ ID NO: 1428148 - protein, 7 aa, Mycobacterium tuberculosis
RRGSTAE

SEQ ID NO: 1428149 - protein, 8 aa, Mycobacterium tuberculosis
RRNGDKLS

SEQ ID NO: 1428150 - protein, 6 aa, Mycobacterium tuberculosis
RRRHPQ

SEQ ID NO: 1428151 - protein, 5 aa, Mycobacterium tuberculosis
RRVTG

SEQ ID NO: 1428152 - protein, 5 aa, Mycobacterium tuberculosis
RSGAL

SEQ ID NO: 1428153 - protein, 5 aa, Mycobacterium tuberculosis
RSLPN

SEQ ID NO: 1428154 - protein, 8 aa, Mycobacterium tuberculosis
RSPAANKK

SEQ ID NO: 1428155 - protein, 8 aa, Mycobacterium tuberculosis
RSSLTGDA

SEQ ID NO: 1428156 - protein, 6 aa, Mycobacterium tuberculosis
RSTEAQ

SEQ ID NO: 1428157 - protein, 6 aa, Mycobacterium tuberculosis
RTDRNS

SEQ ID NO: 1428158 - protein, 5 aa, Mycobacterium tuberculosis
RTGKP

SEQ ID NO: 1428159 - protein, 7 aa, Mycobacterium tuberculosis
RTGPTVA

SEQ ID NO: 1428160 - protein, 6 aa, Mycobacterium tuberculosis
RTPRDR

SEQ ID NO: 1428161 - protein, 7 aa, Mycobacterium tuberculosis
RTPSDAA

SEQ ID NO: 1428162 - protein, 4 aa, Mycobacterium tuberculosis
RYGG

SEQ ID NO: 1428163 - protein, 5 aa, Mycobacterium tuberculosis
RYGPD

SEQ ID NO: 1428164 - protein, 13 aa, Mycobacterium tuberculosis
RYSPSIEATSKRG

SEQ ID NO: 1428165 - protein, 6 aa, Mycobacterium tuberculosis
SAAAAG

SEQ ID NO: 1428166 - protein, 7 aa, Mycobacterium tuberculosis
SADQQAT

SEQ ID NO: 1428167 - protein, 6 aa, Mycobacterium tuberculosis
SADREE

SEQ ID NO: 1428168 - protein, 4 aa, Mycobacterium tuberculosis
SAEA

SEQ ID NO: 1428169 - protein, 7 aa, Mycobacterium tuberculosis
SAISGGA

SEQ ID NO: 1428170 - protein, 5 aa, Mycobacterium tuberculosis
SAPDD

SEQ ID NO: 1428171 - protein, 18 aa, Mycobacterium tuberculosis
SAQFPRPAPRPSYSALSS

SEQ ID NO: 1428172 - protein, 11 aa, Mycobacterium tuberculosis
SATPDGVSERE

SEQ ID NO: 1428173 - protein, 13 aa, Mycobacterium tuberculosis
SAWPENAAPSTAD

SEQ ID NO: 1428174 - protein, 17 aa, Mycobacterium tuberculosis
SDAHQASTTAPPPPGLT

SEQ ID NO: 1428175 - protein, 23 aa, Mycobacterium tuberculosis
SDSGFGPSTGDHGAQASERGAGT

SEQ ID NO: 1428176 - protein, 6 aa, Mycobacterium tuberculosis
SDSGRA

SEQ ID NO: 1428177 - protein, 8 aa, Mycobacterium tuberculosis
SEARAEAA

SEQ ID NO: 1428178 - protein, 6 aa, Mycobacterium tuberculosis
SEDEVE

SEQ ID NO: 1428179 - protein, 17 aa, Mycobacterium tuberculosis
SEQDEYAAASHQKAAAA

SEQ ID NO: 1428180 - protein, 6 aa, Mycobacterium tuberculosis
SESLRS

SEQ ID NO: 1428181 - protein, 7 aa, Mycobacterium tuberculosis
SEYAAAG

SEQ ID NO: 1428182 - protein, 5 aa, Mycobacterium tuberculosis
SGAGL

SEQ ID NO: 1428183 - protein, 16 aa, Mycobacterium tuberculosis
SGDGNTGFGNAGDVNT

SEQ ID NO: 1428184 - protein, 7 aa, Mycobacterium tuberculosis
SGDHPGI

SEQ ID NO: 1428185 - protein, 4 aa, Mycobacterium tuberculosis
SGFD

SEQ ID NO: 1428186 - protein, 53 aa, Mycobacterium tuberculosis
SGGAGGAGGSGRTDLGGAGGAGGKAGLIGNGGNGGAGGAGGNGGGDGGPGGAA

SEQ ID NO: 1428187 - protein, 7 aa, Mycobacterium tuberculosis
SGGATVT

SEQ ID NO: 1428188 - protein, 12 aa, Mycobacterium tuberculosis
SGGTGGNGGNSI

SEQ ID NO: 1428189 - protein, 10 aa, Mycobacterium tuberculosis
SGGVGGAGGF

SEQ ID NO: 1428190 - protein, 26 aa, Mycobacterium tuberculosis
SGIGGNTGSFNSGNLNTGFGNAGDLN

SEQ ID NO: 1428191 - protein, 6 aa, Mycobacterium tuberculosis
SGIRRG

SEQ ID NO: 1428192 - protein, 7 aa, Mycobacterium tuberculosis
SGKDTRV

SEQ ID NO: 1428193 - protein, 4 aa, Mycobacterium tuberculosis
SGNF

SEQ ID NO: 1428194 - protein, 8 aa, Mycobacterium tuberculosis
SGNSNEGF

SEQ ID NO: 1428195 - protein, 7 aa, Mycobacterium tuberculosis
SGPRTMD

SEQ ID NO: 1428196 - protein, 18 aa, Mycobacterium tuberculosis
SGSFNTGLGNTGSTNTGL

SEQ ID NO: 1428197 - protein, 11 aa, Mycobacterium tuberculosis
SGSTGEPKGVE

SEQ ID NO: 1428198 - protein, 17 aa, Mycobacterium tuberculosis
SGTGNIGIGNTGTGNFG

SEQ ID NO: 1428199 - protein, 41 aa, Mycobacterium tuberculosis; identical to SEQ ID NO: 194996

SEQ ID NO: 1428200 - protein, 4 aa, Mycobacterium tuberculosis
SHPE

SEQ ID NO: 1428201 - protein, 12 aa, Mycobacterium tuberculosis
SIPITTSGKIRR

SEQ ID NO: 1428202 - protein, 8 aa, Mycobacterium tuberculosis
SKRYGAGQ

SEQ ID NO: 1428203 - protein, 7 aa, Mycobacterium tuberculosis
SLQPETR

SEQ ID NO: 1428204 - protein, 6 aa, Mycobacterium tuberculosis
SLSDEE

SEQ ID NO: 1428205 - protein, 4 aa, Mycobacterium tuberculosis
SLYE

SEQ ID NO: 1428206 - protein, 8 aa, Mycobacterium tuberculosis
SMPPRSQH

SEQ ID NO: 1428207 - protein, 19 aa, Mycobacterium tuberculosis
SNGDKPKVALPDTQLGSHS

SEQ ID NO: 1428208 - protein, 5 aa, Mycobacterium tuberculosis
SNNRE

SEQ ID NO: 1428209 - protein, 4 aa, Mycobacterium tuberculosis
SPAD

SEQ ID NO: 1428210 - protein, 9 aa, Mycobacterium tuberculosis
SPASTPSEF

SEQ ID NO: 1428211 - protein, 4 aa, Mycobacterium tuberculosis
SPIA

SEQ ID NO: 1428212 - protein, 4 aa, Mycobacterium tuberculosis
SPML

SEQ ID NO: 1428213 - protein, 9 aa, Mycobacterium tuberculosis
SPQALTNQA

SEQ ID NO: 1428214 - protein, 11 aa, Mycobacterium tuberculosis
SPSEADKMDPQ

SEQ ID NO: 1428215 - protein, 13 aa, Mycobacterium tuberculosis
SPVSVDAADGLRA

SEQ ID NO: 1428216 - protein, 6 aa, Mycobacterium tuberculosis
SQQRGT

SEQ ID NO: 1428217 - protein, 7 aa, Mycobacterium tuberculosis
SQSAEAH

SEQ ID NO: 1428218 - protein, 6 aa, Mycobacterium tuberculosis
SQTSAK

SEQ ID NO: 1428219 - protein, 10 aa, Mycobacterium tuberculosis
SRPVGGAVET

SEQ ID NO: 1428220 - protein, 11 aa, Mycobacterium tuberculosis
SRSGRDVTAEY

SEQ ID NO: 1428221 - protein, 10 aa, Mycobacterium tuberculosis
SRSTPSPHAT

SEQ ID NO: 1428222 - protein, 15 aa, Mycobacterium tuberculosis
SSAGAYASAEATNVE

SEQ ID NO: 1428223 - protein, 7 aa, Mycobacterium tuberculosis
SSAGRGA

SEQ ID NO: 1428224 - protein, 25 aa, Mycobacterium tuberculosis
SSDRATVVDRGPPARIAAAGSRRRG

SEQ ID NO: 1428225 - protein, 18 aa, Mycobacterium tuberculosis
SSFGSVTSGLAGQSWQGA

SEQ ID NO: 1428226 - protein, 11 aa, Mycobacterium tuberculosis
SSTSTLQGAGW

SEQ ID NO: 1428227 - protein, 14 aa, Mycobacterium tuberculosis
SSYGTGTGKDAITT

SEQ ID NO: 1428228 - protein, 4 aa, Mycobacterium tuberculosis
STAR

SEQ ID NO: 1428229 - protein, 11 aa, Mycobacterium tuberculosis
STEKNRSRSLA

SEQ ID NO: 1428230 - protein, 4 aa, Mycobacterium tuberculosis
STGE

SEQ ID NO: 1428231 - protein, 7 aa, Mycobacterium tuberculosis
STGPAEI

SEQ ID NO: 1428232 - protein, 17 aa, Mycobacterium tuberculosis
STPPALAGHSTPPALAG

SEQ ID NO: 1428233 - protein, 14 aa, Mycobacterium tuberculosis
SVANSRRRPVHPGQ

SEQ ID NO: 1428234 - protein, 4 aa, Mycobacterium tuberculosis
SVGN

SEQ ID NO: 1428235 - protein, 4 aa, Mycobacterium tuberculosis
SWPM

SEQ ID NO: 1428236 - protein, 15 aa, Mycobacterium tuberculosis
SYDGQGCSISQAATS

SEQ ID NO: 1428237 - protein, 12 aa, Mycobacterium tuberculosis
SYRPRKRPGRTT

SEQ ID NO: 1428238 - protein, 4 aa, Mycobacterium tuberculosis
TAAQ

SEQ ID NO: 1428239 - protein, 10 aa, Mycobacterium tuberculosis
TADDTDPTER

SEQ ID NO: 1428240 - protein, 6 aa, Mycobacterium tuberculosis
TAEQQA

SEQ ID NO: 1428241 - protein, 9 aa, Mycobacterium tuberculosis
TAGDSAWAK

SEQ ID NO: 1428242 - protein, 10 aa, Mycobacterium tuberculosis
TAKSAARAYG

SEQ ID NO: 1428243 - protein, 9 aa, Mycobacterium tuberculosis
TANAGSFNV

SEQ ID NO: 1428244 - protein, 6 aa, Mycobacterium tuberculosis
TANGKP

SEQ ID NO: 1428245 - protein, 4 aa, Mycobacterium tuberculosis
TAPT

SEQ ID NO: 1428246 - protein, 9 aa, Mycobacterium tuberculosis
TAQEGRRTV

SEQ ID NO: 1428247 - protein, 10 aa, Mycobacterium tuberculosis
TASADGDGIA

SEQ ID NO: 1428248 - protein, 8 aa, Mycobacterium tuberculosis
TASASTTD

SEQ ID NO: 1428249 - protein, 16 aa, Mycobacterium tuberculosis
TAVAAATKAAEERGLT

SEQ ID NO: 1428250 - protein, 4 aa, Mycobacterium tuberculosis
TDFP

SEQ ID NO: 1428251 - protein, 5 aa, Mycobacterium tuberculosis
TDPQE

SEQ ID NO: 1428252 - protein, 10 aa, Mycobacterium tuberculosis
TDQSTVEPAV

SEQ ID NO: 1428253 - protein, 4 aa, Mycobacterium tuberculosis
TDRA

SEQ ID NO: 1428254 - protein, 5 aa, Mycobacterium tuberculosis
TEASR

SEQ ID NO: 1428255 - protein, 4 aa, Mycobacterium tuberculosis
TEIG

SEQ ID NO: 1428256 - protein, 14 aa, Mycobacterium tuberculosis
TEPGGGSDLQNMST

SEQ ID NO: 1428257 - protein, 28 aa, Mycobacterium tuberculosis
TEPLPPPAPPPTTPTVTTPTVATATTAG

SEQ ID NO: 1428258 - protein, 5 aa, Mycobacterium tuberculosis
TERTA

SEQ ID NO: 1428259 - protein, 11 aa, Mycobacterium tuberculosis
TERVSTPGENL

SEQ ID NO: 1428260 - protein, 11 aa, Mycobacterium tuberculosis
TGDISNASPLD

SEQ ID NO: 1428261 - protein, 4 aa, Mycobacterium tuberculosis
TGDL

SEQ ID NO: 1428262 - protein, 17 aa, Mycobacterium tuberculosis
TGDNQTGFGGLNSGAGN

SEQ ID NO: 1428263 - protein, 4 aa, Mycobacterium tuberculosis
TGEE

SEQ ID NO: 1428264 - protein, 12 aa, Mycobacterium tuberculosis
TGEGRKDTVTAR

SEQ ID NO: 1428265 - protein, 9 aa, Mycobacterium tuberculosis
TGETCGTVE

SEQ ID NO: 1428266 - protein, 21 aa, Mycobacterium tuberculosis
TGGAGGNGGPGGDGGTGATVG

SEQ ID NO: 1428267 - protein, 6 aa, Mycobacterium tuberculosis
TGGEPL

SEQ ID NO: 1428268 - protein, 30 aa, Mycobacterium tuberculosis
TGGSGGVGGNGGIGGDGAGGGNATSTSSIP

SEQ ID NO: 1428269 - protein, 11 aa, Mycobacterium tuberculosis
TGPQRSTVKAA

SEQ ID NO: 1428270 - protein, 5 aa, Mycobacterium tuberculosis
TGPVG

SEQ ID NO: 1428271 - protein, 6 aa, Mycobacterium tuberculosis
TGRRRP

SEQ ID NO: 1428272 - protein, 6 aa, Mycobacterium tuberculosis
TGSGAD

SEQ ID NO: 1428273 - protein, 17 aa, Mycobacterium tuberculosis
TGTPTLPNSGDDESAFT

SEQ ID NO: 1428274 - protein, 9 aa, Mycobacterium tuberculosis
THQRDDNAA

SEQ ID NO: 1428275 - protein, 12 aa, Mycobacterium tuberculosis
TIPGSISGTEFN

SEQ ID NO: 1428276 - protein, 4 aa, Mycobacterium tuberculosis
TLAG

SEQ ID NO: 1428277 - protein, 7 aa, Mycobacterium tuberculosis
TLHSNGR

SEQ ID NO: 1428278 - protein, 9 aa, Mycobacterium tuberculosis
TLRQNSPGA

SEQ ID NO: 1428279 - protein, 4 aa, Mycobacterium tuberculosis
TMPP

SEQ ID NO: 1428280 - protein, 7 aa, Mycobacterium tuberculosis
TNHGGVQ

SEQ ID NO: 1428281 - protein, 6 aa, Mycobacterium tuberculosis
TNSAGK

SEQ ID NO: 1428282 - protein, 62 aa, Mycobacterium tuberculosis
TNTGFANSGNINTGGFNAGNLNTGFGNTTDGLGENSGFGNAGSGNSGFNNSGKGNSGAQNVG

SEQ ID NO: 1428283 - protein, 19 aa, Mycobacterium tuberculosis
TPATAKRSRSRSPRRGSTR

SEQ ID NO: 1428284 - protein, 10 aa, Mycobacterium tuberculosis
TPATPPATLT

SEQ ID NO: 1428285 - protein, 7 aa, Mycobacterium tuberculosis
TPLPPSR

SEQ ID NO: 1428286 - protein, 7 aa, Mycobacterium tuberculosis
TPLTEGE

SEQ ID NO: 1428287 - protein, 4 aa, Mycobacterium tuberculosis
TQPV

SEQ ID NO: 1428288 - protein, 7 aa, Mycobacterium tuberculosis
TQQTAAP

SEQ ID NO: 1428289 - protein, 5 aa, Mycobacterium tuberculosis
TQRAH

SEQ ID NO: 1428290 - protein, 15 aa, Mycobacterium tuberculosis
TRASTRGDGRTGEDV

SEQ ID NO: 1428291 - protein, 9 aa, Mycobacterium tuberculosis
TRDLSNEAT

SEQ ID NO: 1428292 - protein, 5 aa, Mycobacterium tuberculosis
TRGRS

SEQ ID NO: 1428293 - protein, 9 aa, Mycobacterium tuberculosis
TSAKQDGRN

SEQ ID NO: 1428294 - protein, 4 aa, Mycobacterium tuberculosis
TSGG

SEQ ID NO: 1428295 - protein, 8 aa, Mycobacterium tuberculosis
TSGQPDPD

SEQ ID NO: 1428296 - protein, 9 aa, Mycobacterium tuberculosis
TSGSSSGFK

SEQ ID NO: 1428297 - protein, 8 aa, Mycobacterium tuberculosis
TSIAPANP

SEQ ID NO: 1428298 - protein, 6 aa, Mycobacterium tuberculosis
TSSAEQ

SEQ ID NO: 1428299 - protein, 8 aa, Mycobacterium tuberculosis
TSTTRSEQ

SEQ ID NO: 1428300 - protein, 8 aa, Mycobacterium tuberculosis
TSYATHNE

SEQ ID NO: 1428301 - protein, 9 aa, Mycobacterium tuberculosis
TTAGDDLAS

SEQ ID NO: 1428302 - protein, 5 aa, Mycobacterium tuberculosis
TTATG

SEQ ID NO: 1428303 - protein, 9 aa, Mycobacterium tuberculosis
TTGAASNGC

SEQ ID NO: 1428304 - protein, 6 aa, Mycobacterium tuberculosis
TTPFTR

SEQ ID NO: 1428305 - protein, 5 aa, Mycobacterium tuberculosis
TTPRM

SEQ ID NO: 1428306 - protein, 11 aa, Mycobacterium tuberculosis
TTRSGALTGPL

SEQ ID NO: 1428307 - protein, 4 aa, Mycobacterium tuberculosis
TTTS

SEQ ID NO: 1428308 - protein, 7 aa, Mycobacterium tuberculosis
TVGGGQI

SEQ ID NO: 1428309 - protein, 11 aa, Mycobacterium tuberculosis
TVNSRGATTTT

SEQ ID NO: 1428310 - protein, 4 aa, Mycobacterium tuberculosis
TVPC

SEQ ID NO: 1428311 - protein, 13 aa, Mycobacterium tuberculosis
TVRARSDATAVGY

SEQ ID NO: 1428312 - protein, 7 aa, Mycobacterium tuberculosis
TVSASEG

SEQ ID NO: 1428313 - protein, 12 aa, Mycobacterium tuberculosis
TWQDKGSSYLPS

SEQ ID NO: 1428314 - protein, 5 aa, Mycobacterium tuberculosis
TWSGT

SEQ ID NO: 1428315 - protein, 6 aa, Mycobacterium tuberculosis
TYDPAN

SEQ ID NO: 1428316 - protein, 19 aa, Mycobacterium tuberculosis
TYEPSRTHWTPDPGAFSGA

SEQ ID NO: 1428317 - protein, 5 aa, Mycobacterium tuberculosis
TYSPE

SEQ ID NO: 1428318 - protein, 8 aa, Mycobacterium tuberculosis
VADPKTEL

SEQ ID NO: 1428319 - protein, 20 aa, Mycobacterium tuberculosis
VAEPPTRGRYSSRHRCASKE

SEQ ID NO: 1428320 - protein, 4 aa, Mycobacterium tuberculosis
VARA

SEQ ID NO: 1428321 - protein, 7 aa, Mycobacterium tuberculosis
VASTVGR

SEQ ID NO: 1428322 - protein, 9 aa, Mycobacterium tuberculosis
VDGAGAPIE

SEQ ID NO: 1428323 - protein, 9 aa, Mycobacterium tuberculosis
VDPSGWAAY

SEQ ID NO: 1428324 - protein, 10 aa, Mycobacterium tuberculosis
VEETSTPQKL

SEQ ID NO: 1428325 - protein, 8 aa, Mycobacterium tuberculosis
VEGGGNQD

SEQ ID NO: 1428326 - protein, 15 aa, Mycobacterium tuberculosis
VESGGSELADELDQN

SEQ ID NO: 1428327 - protein, 7 aa, Mycobacterium tuberculosis
VGEGDLA

SEQ ID NO: 1428328 - protein, 25 aa, Mycobacterium tuberculosis
VGGAGGHGGGASVGTGGSGGAGGDG

SEQ ID NO: 1428329 - protein, 5 aa, Mycobacterium tuberculosis
VGPDA

SEQ ID NO: 1428330 - protein, 17 aa, Mycobacterium tuberculosis
VGRQLGEKTVKATTAGH

SEQ ID NO: 1428331 - protein, 9 aa, Mycobacterium tuberculosis
VHEDPSGPV

SEQ ID NO: 1428332 - protein, 6 aa, Mycobacterium tuberculosis
VISGEG

SEQ ID NO: 1428333 - protein, 9 aa, Mycobacterium tuberculosis
VKNAQEAHE

SEQ ID NO: 1428334 - protein, 12 aa, Mycobacterium tuberculosis
VKPTSVPAFRPG

SEQ ID NO: 1428335 - protein, 12 aa, Mycobacterium tuberculosis
VNPDGDQGGPQI

SEQ ID NO: 1428336 - protein, 5 aa, Mycobacterium tuberculosis
VPAGA

SEQ ID NO: 1428337 - protein, 4 aa, Mycobacterium tuberculosis
VPPS

SEQ ID NO: 1428338 - protein, 19 aa, Mycobacterium tuberculosis
VPPSVPVKSADDKPVVTKS

SEQ ID NO: 1428339 - protein, 4 aa, Mycobacterium tuberculosis
VPRA

SEQ ID NO: 1428340 - protein, 7 aa, Mycobacterium tuberculosis
VPSPTAA

SEQ ID NO: 1428341 - protein, 5 aa, Mycobacterium tuberculosis
VQPEL

SEQ ID NO: 1428342 - protein, 14 aa, Mycobacterium tuberculosis
VQVDPKTSTASGTV

SEQ ID NO: 1428343 - protein, 4 aa, Mycobacterium tuberculosis
VRAG

SEQ ID NO: 1428344 - protein, 14 aa, Mycobacterium tuberculosis
VRDTQRSRRRHSDV

SEQ ID NO: 1428345 - protein, 7 aa, Mycobacterium tuberculosis
VRGSRHK

SEQ ID NO: 1428346 - protein, 5 aa, Mycobacterium tuberculosis
VRPPV

SEQ ID NO: 1428347 - protein, 11 aa, Mycobacterium tuberculosis
VRVGPDSDTSE

SEQ ID NO: 1428348 - protein, 6 aa, Mycobacterium tuberculosis
VSADTT

SEQ ID NO: 1428349 - protein, 27 aa, Mycobacterium tuberculosis
VSAEGGAAAVTGDDDSLDEHAHDTVSG

SEQ ID NO: 1428350 - protein, 27 aa, Mycobacterium tuberculosis
VSAPAPAERPAPPAMSGAQRRATEKEL

SEQ ID NO: 1428351 - protein, 16 aa, Mycobacterium tuberculosis
VSARDCRGGTAPGRVA

SEQ ID NO: 1428352 - protein, 17 aa, Mycobacterium tuberculosis
VSASDPYRGQPDARLEP

SEQ ID NO: 1428353 - protein, 8 aa, Mycobacterium tuberculosis
VSGAAADL

SEQ ID NO: 1428354 - protein, 10 aa, Mycobacterium tuberculosis
VSGAGNVGQQ

SEQ ID NO: 1428355 - protein, 9 aa, Mycobacterium tuberculosis
VSTGEPDRS

SEQ ID NO: 1428356 - protein, 10 aa, Mycobacterium tuberculosis
VSVPERNQPW

SEQ ID NO: 1428357 - protein, 6 aa, Mycobacterium tuberculosis
VTGEEV

SEQ ID NO: 1428358 - protein, 9 aa, Mycobacterium tuberculosis
VTGTGGASL

SEQ ID NO: 1428359 - protein, 13 aa, Mycobacterium tuberculosis
VTSAMNQTNDRQQ

SEQ ID NO: 1428360 - protein, 7 aa, Mycobacterium tuberculosis
WDPQRAA

SEQ ID NO: 1428361 - protein, 9 aa, Mycobacterium tuberculosis
WDTTPEPEI

SEQ ID NO: 1428362 - protein, 8 aa, Mycobacterium tuberculosis
WNGEAGQA

SEQ ID NO: 1428363 - protein, 9 aa, Mycobacterium tuberculosis
WPPSGARAS

SEQ ID NO: 1428364 - protein, 4 aa, Mycobacterium tuberculosis
WRNR

SEQ ID NO: 1428365 - protein, 5 aa, Mycobacterium tuberculosis
WSGYS

SEQ ID NO: 1428366 - protein, 7 aa, Mycobacterium tuberculosis
WTGGRGA

SEQ ID NO: 1428367 - protein, 8 aa, Mycobacterium tuberculosis
WTRSNRHT

SEQ ID NO: 1428368 - protein, 14 aa, Mycobacterium tuberculosis
YAPSKVDLNGGRPT

SEQ ID NO: 1428369 - protein, 8 aa, Mycobacterium tuberculosis
YGAGPCPG

SEQ ID NO: 1428370 - protein, 27 aa, Mycobacterium tuberculosis
YGGAGGLGGAATGAGGTGGTGGVGAGG

SEQ ID NO: 1428371 - protein, 11 aa, Mycobacterium tuberculosis
YGGQLSGELEG

SEQ ID NO: 1428372 - protein, 14 aa, Mycobacterium tuberculosis
YGNAATLTTTVESS

SEQ ID NO: 1428373 - protein, 11 aa, Mycobacterium tuberculosis
YGSRDSQEQLD

SEQ ID NO: 1428374 - protein, 6 aa, Mycobacterium tuberculosis
YNPTAT

SEQ ID NO: 1428375 - protein, 11 aa, Mycobacterium tuberculosis
YNTGDTNTGIA

SEQ ID NO: 1428376 - protein, 20 aa, Mycobacterium tuberculosis
YPQTTPVQESGPARPIPSGI

SEQ ID NO: 1428377 - protein, 6 aa, Mycobacterium tuberculosis
YRDGDL

SEQ ID NO: 1428378 - protein, 26 aa, Mycobacterium tuberculosis
YRRSRDGCDWGSRGDRGSRGDRGSRC

SEQ ID NO: 1428379 - protein, 6 aa, Mycobacterium tuberculosis
YSELSD

SEQ ID NO: 1428380 - protein, 4 aa, Mycobacterium tuberculosis
YSES

SEQ ID NO: 1428381 - protein, 9 aa, Mycobacterium tuberculosis
YSPAASAAT

SEQ ID NO: 1428382 - protein, 8 aa, Mycobacterium tuberculosis
AAAAAGDA

SEQ ID NO: 1428383 - protein, 10 aa, Mycobacterium tuberculosis
AAAAAKAPSL

SEQ ID NO: 1428384 - protein, 8 aa, Mycobacterium tuberculosis
AAAAARRR

SEQ ID NO: 1428385 - protein, 8 aa, Mycobacterium tuberculosis
AAAADGAA

SEQ ID NO: 1428386 - protein, 8 aa, Mycobacterium tuberculosis
AAAAGTST

SEQ ID NO: 1428387 - protein, 20 aa, Mycobacterium tuberculosis
AAAAPQAPPKPADTAAAGNG

SEQ ID NO: 1428388 - protein, 8 aa, Mycobacterium tuberculosis
AAAARRDY

SEQ ID NO: 1428389 - protein, 9 aa, Mycobacterium tuberculosis
AAADATRRA

SEQ ID NO: 1428390 - protein, 5 aa, Mycobacterium tuberculosis
AAADL

SEQ ID NO: 1428391 - protein, 5 aa, Mycobacterium tuberculosis
AAAED

SEQ ID NO: 1428392 - protein, 7 aa, Mycobacterium tuberculosis
AAAEPAA

SEQ ID NO: 1428393 - protein, 8 aa, Mycobacterium tuberculosis
AAAEPAKS

SEQ ID NO: 1428394 - protein, 6 aa, Mycobacterium tuberculosis
AAAEVQ

SEQ ID NO: 1428395 - protein, 6 aa, Mycobacterium tuberculosis
AAAGDL

SEQ ID NO: 1428396 - protein, 7 aa, Mycobacterium tuberculosis
AAAGLGG

SEQ ID NO: 1428397 - protein, 19 aa, Mycobacterium tuberculosis
AAAGPRRTASGSVAVPGAR

SEQ ID NO: 1428398 - protein, 9 aa, Mycobacterium tuberculosis
AAAKPADVD

SEQ ID NO: 1428399 - protein, 13 aa, Mycobacterium tuberculosis
AAANAQNNGGLDP

SEQ ID NO: 1428400 - protein, 11 aa, Mycobacterium tuberculosis
AAAPQTTPAPQ

SEQ ID NO: 1428401 - protein, 6 aa, Mycobacterium tuberculosis
AAARGL

SEQ ID NO: 1428402 - protein, 7 aa, Mycobacterium tuberculosis
AAARGRT

SEQ ID NO: 1428403 - protein, 7 aa, Mycobacterium tuberculosis
AAASARR

SEQ ID NO: 1428404 - protein, 4 aa, Mycobacterium tuberculosis
AAAT

SEQ ID NO: 1428405 - protein, 14 aa, Mycobacterium tuberculosis
AAATSGASTAAHAG

SEQ ID NO: 1428406 - protein, 11 aa, Mycobacterium tuberculosis
AADDESAASMA

SEQ ID NO: 1428407 - protein, 9 aa, Mycobacterium tuberculosis
AADLGQRRA

SEQ ID NO: 1428408 - protein, 7 aa, Mycobacterium tuberculosis
AADPGFR

SEQ ID NO: 1428409 - protein, 6 aa, Mycobacterium tuberculosis
AADQAR

SEQ ID NO: 1428410 - protein, 6 aa, Mycobacterium tuberculosis
AADQAT

SEQ ID NO: 1428411 - protein, 15 aa, Mycobacterium tuberculosis
AADRSSVASAAWTGE

SEQ ID NO: 1428412 - protein, 12 aa, Mycobacterium tuberculosis
AAEAAAAGSGDF

SEQ ID NO: 1428413 - protein, 7 aa, Mycobacterium tuberculosis
AAEAAET

SEQ ID NO: 1428414 - protein, 9 aa, Mycobacterium tuberculosis
AAEAAGRNV

SEQ ID NO: 1428415 - protein, 25 aa, Mycobacterium tuberculosis
AAEARLRDGPRAAALPASGTSEGRQ

SEQ ID NO: 1428416 - protein, 5 aa, Mycobacterium tuberculosis
AAEGF

SEQ ID NO: 1428417 - protein, 6 aa, Mycobacterium tuberculosis
AAEGKR

SEQ ID NO: 1428418 - protein, 5 aa, Mycobacterium tuberculosis
AAELA

SEQ ID NO: 1428419 - protein, 5 aa, Mycobacterium tuberculosis
AAEMR

SEQ ID NO: 1428420 - protein, 21 aa, Mycobacterium tuberculosis
AAEQAEAADTTALPSAAELSN

SEQ ID NO: 1428421 - protein, 6 aa, Mycobacterium tuberculosis
AAERGV

SEQ ID NO: 1428422 - protein, 9 aa, Mycobacterium tuberculosis
AAESARDDG

SEQ ID NO: 1428423 - protein, 7 aa, Mycobacterium tuberculosis
AAESDRV

SEQ ID NO: 1428424 - protein, 8 aa, Mycobacterium tuberculosis
AAETPLTA

SEQ ID NO: 1428425 - protein, 5 aa, Mycobacterium tuberculosis
AAEVQ

SEQ ID NO: 1428426 - protein, 7 aa, Mycobacterium tuberculosis
AAEYTDD

SEQ ID NO: 1428427 - protein, 5 aa, Mycobacterium tuberculosis
AAFPG

SEQ ID NO: 1428428 - protein, 4 aa, Mycobacterium tuberculosis
AAFT

SEQ ID NO: 1428429 - protein, 9 aa, Mycobacterium tuberculosis
AAGAATPKR

SEQ ID NO: 1428430 - protein, 7 aa, Mycobacterium tuberculosis
AAGAGAA

SEQ ID NO: 1428431 - protein, 10 aa, Mycobacterium tuberculosis
AAGAGSRRDT

SEQ ID NO: 1428432 - protein, 6 aa, Mycobacterium tuberculosis
AAGERV

SEQ ID NO: 1428433 - protein, 14 aa, Mycobacterium tuberculosis
AAGGAGGPGGAGGL

SEQ ID NO: 1428434 - protein, 7 aa, Mycobacterium tuberculosis
AAGHDAE

SEQ ID NO: 1428435 - protein, 8 aa, Mycobacterium tuberculosis
AAGHRSPL

SEQ ID NO: 1428436 - protein, 5 aa, Mycobacterium tuberculosis
AAGKL

SEQ ID NO: 1428437 - protein, 10 aa, Mycobacterium tuberculosis
AAGKTSGPVN

SEQ ID NO: 1428438 - protein, 5 aa, Mycobacterium tuberculosis
AAGLD

SEQ ID NO: 1428439 - protein, 9 aa, Mycobacterium tuberculosis
AAGLDLGGR

SEQ ID NO: 1428440 - protein, 6 aa, Mycobacterium tuberculosis
AAGPAA

SEQ ID NO: 1428441 - protein, 11 aa, Mycobacterium tuberculosis
AAGPQLPTGLQ

SEQ ID NO: 1428442 - protein, 7 aa, Mycobacterium tuberculosis
AAGTGIR

SEQ ID NO: 1428443 - protein, 8 aa, Mycobacterium tuberculosis
AAGVPSET

SEQ ID NO: 1428444 - protein, 8 aa, Mycobacterium tuberculosis
AAGVTAPG

SEQ ID NO: 1428445 - protein, 6 aa, Mycobacterium tuberculosis
AAHRAD

SEQ ID NO: 1428446 - protein, 7 aa, Mycobacterium tuberculosis
AAHTTAH

SEQ ID NO: 1428447 - protein, 9 aa, Mycobacterium tuberculosis
AAIAATQAE

SEQ ID NO: 1428448 - protein, 5 aa, Mycobacterium tuberculosis
AAIDG

SEQ ID NO: 1428449 - protein, 11 aa, Mycobacterium tuberculosis
AAIGETEDERA

SEQ ID NO: 1428450 - protein, 12 aa, Mycobacterium tuberculosis
AAITQGTVLAEI

SEQ ID NO: 1428451 - protein, 7 aa, Mycobacterium tuberculosis
AAKANAK

SEQ ID NO: 1428452 - protein, 53 aa, Mycobacterium tuberculosis; identical to SEQ ID NO: 167099

SEQ ID NO: 1428453 - protein, 6 aa, Mycobacterium tuberculosis
AAKDLE

SEQ ID NO: 1428454 - protein, 8 aa, Mycobacterium tuberculosis
AAKRGLAN

SEQ ID NO: 1428455 - protein, 8 aa, Mycobacterium tuberculosis
AAKRLAKE

SEQ ID NO: 1428456 - protein, 13 aa, Mycobacterium tuberculosis
AAKSDFEMVEVAR

SEQ ID NO: 1428457 - protein, 5 aa, Mycobacterium tuberculosis
AALGG

SEQ ID NO: 1428458 - protein, 15 aa, Mycobacterium tuberculosis
AALGGNERARKRHVS

SEQ ID NO: 1428459 - protein, 17 aa, Mycobacterium tuberculosis
AALGKGSSAGSLSVPPD

SEQ ID NO: 1428460 - protein, 12 aa, Mycobacterium tuberculosis
AAMDNSRDATQI

SEQ ID NO: 1428461 - protein, 16 aa, Mycobacterium tuberculosis
AANPDVADKIRGGKVA

SEQ ID NO: 1428462 - protein, 7 aa, Mycobacterium tuberculosis
AANPRIG

SEQ ID NO: 1428463 - protein, 7 aa, Mycobacterium tuberculosis
AANTPKG

SEQ ID NO: 1428464 - protein, 5 aa, Mycobacterium tuberculosis
AAPEA

SEQ ID NO: 1428465 - protein, 7 aa, Mycobacterium tuberculosis
AAPGAVA

SEQ ID NO: 1428466 - protein, 11 aa, Mycobacterium tuberculosis
AAPGNTPSLDE

SEQ ID NO: 1428467 - protein, 5 aa, Mycobacterium tuberculosis
AAPGT

SEQ ID NO: 1428468 - protein, 4 aa, Mycobacterium tuberculosis
AAPL

SEQ ID NO: 1428469 - protein, 18 aa, Mycobacterium tuberculosis
AAPRASHEWARGKRDQLI

SEQ ID NO: 1428470 - protein, 16 aa, Mycobacterium tuberculosis
AAPSLSDRDAAAPSFE

SEQ ID NO: 1428471 - protein, 27 aa, Mycobacterium tuberculosis
AAQAKAKKAAAMPTEESEAKPAEEGDV

SEQ ID NO: 1428472 - protein, 12 aa, Mycobacterium tuberculosis
AAQARKRGYQPV

SEQ ID NO: 1428473 - protein, 6 aa, Mycobacterium tuberculosis
AAQASG

SEQ ID NO: 1428474 - protein, 7 aa, Mycobacterium tuberculosis
AAQATTL

SEQ ID NO: 1428475 - protein, 7 aa, Mycobacterium tuberculosis
AAQGAMA

SEQ ID NO: 1428476 - protein, 10 aa, Mycobacterium tuberculosis
AAQGSEAAEI

SEQ ID NO: 1428477 - protein, 5 aa, Mycobacterium tuberculosis
AAQHG

SEQ ID NO: 1428478 - protein, 12 aa, Mycobacterium tuberculosis
AAQRPTAGPPTE

SEQ ID NO: 1428479 - protein, 13 aa, Mycobacterium tuberculosis
AAQSAGAAGQARA

SEQ ID NO: 1428480 - protein, 7 aa, Mycobacterium tuberculosis
AAQSEAL

SEQ ID NO: 1428481 - protein, 8 aa, Mycobacterium tuberculosis
AAQTDDQQ

SEQ ID NO: 1428482 - protein, 11 aa, Mycobacterium tuberculosis
AAQVATTLTGT

SEQ ID NO: 1428483 - protein, 11 aa, Mycobacterium tuberculosis
AARARAGDGPT

SEQ ID NO: 1428484 - protein, 8 aa, Mycobacterium tuberculosis
AARATKLA

SEQ ID NO: 1428485 - protein, 6 aa, Mycobacterium tuberculosis
AARDDA

SEQ ID NO: 1428486 - protein, 16 aa, Mycobacterium tuberculosis
AARENAKSAREVTSSE

SEQ ID NO: 1428487 - protein, 7 aa, Mycobacterium tuberculosis
AARHDSK

SEQ ID NO: 1428488 - protein, 7 aa, Mycobacterium tuberculosis
AARNTEP

SEQ ID NO: 1428489 - protein, 9 aa, Mycobacterium tuberculosis
AARPPDDPI

SEQ ID NO: 1428490 - protein, 12 aa, Mycobacterium tuberculosis
AARQRHGQANSW

SEQ ID NO: 1428491 - protein, 7 aa, Mycobacterium tuberculosis
AARRQRP

SEQ ID NO: 1428492 - protein, 9 aa, Mycobacterium tuberculosis
AARRRSGHL

SEQ ID NO: 1428493 - protein, 6 aa, Mycobacterium tuberculosis
AARTHR

SEQ ID NO: 1428494 - protein, 11 aa, Mycobacterium tuberculosis
AASAEQAAAQA

SEQ ID NO: 1428495 - protein, 4 aa, Mycobacterium tuberculosis
AASN

SEQ ID NO: 1428496 - protein, 6 aa, Mycobacterium tuberculosis
AASTPD

SEQ ID NO: 1428497 - protein, 7 aa, Mycobacterium tuberculosis
AATEAEY

SEQ ID NO: 1428498 - protein, 4 aa, Mycobacterium tuberculosis
AATG

SEQ ID NO: 1428499 - protein, 12 aa, Mycobacterium tuberculosis
AATKAAEERGLT

SEQ ID NO: 1428500 - protein, 18 aa, Mycobacterium tuberculosis
AATKSMTAPTVDERPDIK

SEQ ID NO: 1428501 - protein, 7 aa, Mycobacterium tuberculosis
AATNSAI

SEQ ID NO: 1428502 - protein, 4 aa, Mycobacterium tuberculosis
AATP

SEQ ID NO: 1428503 - protein, 11 aa, Mycobacterium tuberculosis
AATREQEMTPE

SEQ ID NO: 1428504 - protein, 8 aa, Mycobacterium tuberculosis
AATRTSME

SEQ ID NO: 1428505 - protein, 9 aa, Mycobacterium tuberculosis
AATSKDAID

SEQ ID NO: 1428506 - protein, 4 aa, Mycobacterium tuberculosis
AATT

SEQ ID NO: 1428507 - protein, 5 aa, Mycobacterium tuberculosis
AATTD

SEQ ID NO: 1428508 - protein, 8 aa, Mycobacterium tuberculosis
AATTNVSD

SEQ ID NO: 1428509 - protein, 6 aa, Mycobacterium tuberculosis
AATVRG

SEQ ID NO: 1428510 - protein, 7 aa, Mycobacterium tuberculosis
AAVDGGG

SEQ ID NO: 1428511 - protein, 16 aa, Mycobacterium tuberculosis
AAVGASRAAVDSGYYP

SEQ ID NO: 1428512 - protein, 13 aa, Mycobacterium tuberculosis
AAVPSGASTGEHE

SEQ ID NO: 1428513 - protein, 6 aa, Mycobacterium tuberculosis
AAVSGI

SEQ ID NO: 1428514 - protein, 5 aa, Mycobacterium tuberculosis
AAVTG

SEQ ID NO: 1428515 - protein, 6 aa, Mycobacterium tuberculosis
ADAEGT

SEQ ID NO: 1428516 - protein, 5 aa, Mycobacterium tuberculosis
ADAEL

SEQ ID NO: 1428517 - protein, 8 aa, Mycobacterium tuberculosis
ADAGSRSQ

SEQ ID NO: 1428518 - protein, 8 aa, Mycobacterium tuberculosis
ADAPQVAS

SEQ ID NO: 1428519 - protein, 5 aa, Mycobacterium tuberculosis
ADASN

SEQ ID NO: 1428520 - protein, 14 aa, Mycobacterium tuberculosis
ADATAAKAAAAGGQ

SEQ ID NO: 1428521 - protein, 6 aa, Mycobacterium tuberculosis
ADDGTW

SEQ ID NO: 1428522 - protein, 4 aa, Mycobacterium tuberculosis
ADDP

SEQ ID NO: 1428523 - protein, 7 aa, Mycobacterium tuberculosis
ADDPLQL

SEQ ID NO: 1428524 - protein, 6 aa, Mycobacterium tuberculosis
ADEKWG

SEQ ID NO: 1428525 - protein, 5 aa, Mycobacterium tuberculosis
ADENL

SEQ ID NO: 1428526 - protein, 13 aa, Mycobacterium tuberculosis
ADFATPANLSGLS

SEQ ID NO: 1428527 - protein, 14 aa, Mycobacterium tuberculosis
ADFATPANLSGLSN

SEQ ID NO: 1428528 - protein, 6 aa, Mycobacterium tuberculosis
ADFGGS

SEQ ID NO: 1428529 - protein, 9 aa, Mycobacterium tuberculosis
ADGAAEDEL

SEQ ID NO: 1428530 - protein, 5 aa, Mycobacterium tuberculosis
ADGAT

SEQ ID NO: 1428531 - protein, 4 aa, Mycobacterium tuberculosis
ADGG

SEQ ID NO: 1428532 - protein, 6 aa, Mycobacterium tuberculosis
ADGGEE

SEQ ID NO: 1428533 - protein, 10 aa, Mycobacterium tuberculosis
ADGGPASGRG

SEQ ID NO: 1428534 - protein, 9 aa, Mycobacterium tuberculosis
ADGGTRTAA

SEQ ID NO: 1428535 - protein, 16 aa, Mycobacterium tuberculosis
ADGKSLNVAGSDNTLT

SEQ ID NO: 1428536 - protein, 7 aa, Mycobacterium tuberculosis
ADGLDGD

SEQ ID NO: 1428537 - protein, 6 aa, Mycobacterium tuberculosis
ADGPAL

SEQ ID NO: 1428538 - protein, 14 aa, Mycobacterium tuberculosis
ADGVADENRRDDLE

SEQ ID NO: 1428539 - protein, 13 aa, Mycobacterium tuberculosis
ADGVLGRRGPAEA

SEQ ID NO: 1428540 - protein, 6 aa, Mycobacterium tuberculosis
ADHTYG

SEQ ID NO: 1428541 - protein, 5 aa, Mycobacterium tuberculosis
ADIPS

SEQ ID NO: 1428542 - protein, 9 aa, Mycobacterium tuberculosis
ADISTATLN

SEQ ID NO: 1428543 - protein, 9 aa, Mycobacterium tuberculosis
ADKGEPAAY

SEQ ID NO: 1428544 - protein, 14 aa, Mycobacterium tuberculosis
ADNCPNPACGSDTL

SEQ ID NO: 1428545 - protein, 14 aa, Mycobacterium tuberculosis
ADNGHSRVGHPTFP

SEQ ID NO: 1428546 - protein, 4 aa, Mycobacterium tuberculosis
ADPD

SEQ ID NO: 1428547 - protein, 17 aa, Mycobacterium tuberculosis
ADPERRRRYQQARGKGG

SEQ ID NO: 1428548 - protein, 5 aa, Mycobacterium tuberculosis
ADPEV

SEQ ID NO: 1428549 - protein, 7 aa, Mycobacterium tuberculosis
ADPLGGA

SEQ ID NO: 1428550 - protein, 8 aa, Mycobacterium tuberculosis
ADPLPAGA

SEQ ID NO: 1428551 - protein, 4 aa, Mycobacterium tuberculosis
ADPR

SEQ ID NO: 1428552 - protein, 6 aa, Mycobacterium tuberculosis
ADPRDI

SEQ ID NO: 1428553 - protein, 7 aa, Mycobacterium tuberculosis
ADPSRGR

SEQ ID NO: 1428554 - protein, 9 aa, Mycobacterium tuberculosis
ADPSWPDQA

SEQ ID NO: 1428555 - protein, 8 aa, Mycobacterium tuberculosis
ADPTPAPG

SEQ ID NO: 1428556 - protein, 6 aa, Mycobacterium tuberculosis
ADQARV

SEQ ID NO: 1428557 - protein, 6 aa, Mycobacterium tuberculosis
ADQPYG

SEQ ID NO: 1428558 - protein, 6 aa, Mycobacterium tuberculosis
ADQVDQ

SEQ ID NO: 1428559 - protein, 5 aa, Mycobacterium tuberculosis
ADQVS

SEQ ID NO: 1428560 - protein, 9 aa, Mycobacterium tuberculosis
ADRDAADAL

SEQ ID NO: 1428561 - protein, 6 aa, Mycobacterium tuberculosis
ADRDGV

SEQ ID NO: 1428562 - protein, 9 aa, Mycobacterium tuberculosis
ADRGAAEKA

SEQ ID NO: 1428563 - protein, 17 aa, Mycobacterium tuberculosis
ADRKRGACAGRGGSAPS

SEQ ID NO: 1428564 - protein, 6 aa, Mycobacterium tuberculosis
ADRSRP

SEQ ID NO: 1428565 - protein, 6 aa, Mycobacterium tuberculosis
ADSAPM

SEQ ID NO: 1428566 - protein, 8 aa, Mycobacterium tuberculosis
ADSQSNEL

SEQ ID NO: 1428567 - protein, 11 aa, Mycobacterium tuberculosis
ADSTGVRASTD

SEQ ID NO: 1428568 - protein, 8 aa, Mycobacterium tuberculosis
ADSYDEQG

SEQ ID NO: 1428569 - protein, 18 aa, Mycobacterium tuberculosis
ADTAEHGHDDEYDEFSDP

SEQ ID NO: 1428570 - protein, 5 aa, Mycobacterium tuberculosis
ADTAT

SEQ ID NO: 1428571 - protein, 9 aa, Mycobacterium tuberculosis
ADTATPTAA

SEQ ID NO: 1428572 - protein, 10 aa, Mycobacterium tuberculosis
ADTGEPDDWD

SEQ ID NO: 1428573 - protein, 7 aa, Mycobacterium tuberculosis
ADTGIFP

SEQ ID NO: 1428574 - protein, 5 aa, Mycobacterium tuberculosis
ADTGL

SEQ ID NO: 1428575 - protein, 9 aa, Mycobacterium tuberculosis
ADTHATAEA

SEQ ID NO: 1428576 - protein, 13 aa, Mycobacterium tuberculosis
ADTPVQPGIPGRT

SEQ ID NO: 1428577 - protein, 6 aa, Mycobacterium tuberculosis
ADVRSG

SEQ ID NO: 1428578 - protein, 5 aa, Mycobacterium tuberculosis
ADWPD

SEQ ID NO: 1428579 - protein, 6 aa, Mycobacterium tuberculosis
AEANRA

SEQ ID NO: 1428580 - protein, 20 aa, Mycobacterium tuberculosis
AEAPKSASERAAESTAPHKV

SEQ ID NO: 1428581 - protein, 12 aa, Mycobacterium tuberculosis
AEARTASEKDVK

SEQ ID NO: 1428582 - protein, 106 aa, Mycobacterium tuberculosis; identical to SEQ ID NO: 167814

SEQ ID NO: 1428583 - protein, 5 aa, Mycobacterium tuberculosis
AEDLA

SEQ ID NO: 1428584 - protein, 6 aa, Mycobacterium tuberculosis
AEDPRV

SEQ ID NO: 1428585 - protein, 21 aa, Mycobacterium tuberculosis
AEEAALEEGLEGAGLSELGAA

SEQ ID NO: 1428586 - protein, 8 aa, Mycobacterium tuberculosis
AEEAGPVT

SEQ ID NO: 1428587 - protein, 4 aa, Mycobacterium tuberculosis
AEED

SEQ ID NO: 1428588 - protein, 12 aa, Mycobacterium tuberculosis
AEEELSRLLLPS

SEQ ID NO: 1428589 - protein, 8 aa, Mycobacterium tuberculosis
AEELAKTD

SEQ ID NO: 1428590 - protein, 9 aa, Mycobacterium tuberculosis
AEELDGRTI

SEQ ID NO: 1428591 - protein, 5 aa, Mycobacterium tuberculosis
AEGAD

SEQ ID NO: 1428592 - protein, 6 aa, Mycobacterium tuberculosis
AEGAEE

SEQ ID NO: 1428593 - protein, 6 aa, Mycobacterium tuberculosis
AEGGAM

SEQ ID NO: 1428594 - protein, 7 aa, Mycobacterium tuberculosis
AEGGARP

SEQ ID NO: 1428595 - protein, 7 aa, Mycobacterium tuberculosis
AEGNHLG

SEQ ID NO: 1428596 - protein, 8 aa, Mycobacterium tuberculosis
AEGYPGRR

SEQ ID NO: 1428597 - protein, 7 aa, Mycobacterium tuberculosis
AEHEGKP

SEQ ID NO: 1428598 - protein, 10 aa, Mycobacterium tuberculosis
AEKRPPPAPR

SEQ ID NO: 1428599 - protein, 8 aa, Mycobacterium tuberculosis
AEPAIRPG

SEQ ID NO: 1428600 - protein, 7 aa, Mycobacterium tuberculosis
AEPGKSL

SEQ ID NO: 1428601 - protein, 6 aa, Mycobacterium tuberculosis
AEQAPH

SEQ ID NO: 1428602 - protein, 6 aa, Mycobacterium tuberculosis
AEQGLQ

SEQ ID NO: 1428603 - protein, 6 aa, Mycobacterium tuberculosis
AERGAQ

SEQ ID NO: 1428604 - protein, 9 aa, Mycobacterium tuberculosis
AERHGRTRD

SEQ ID NO: 1428605 - protein, 7 aa, Mycobacterium tuberculosis
AERLTEE

SEQ ID NO: 1428606 - protein, 5 aa, Mycobacterium tuberculosis
AESAA

SEQ ID NO: 1428607 - protein, 6 aa, Mycobacterium tuberculosis
AESGAH

SEQ ID NO: 1428608 - protein, 8 aa, Mycobacterium tuberculosis
AESGPDER

SEQ ID NO: 1428609 - protein, 7 aa, Mycobacterium tuberculosis
AESGYAA

SEQ ID NO: 1428610 - protein, 6 aa, Mycobacterium tuberculosis
AESLNA

SEQ ID NO: 1428611 - protein, 6 aa, Mycobacterium tuberculosis
AESPIP

SEQ ID NO: 1428612 - protein, 9 aa, Mycobacterium tuberculosis
AESTAGPDA

SEQ ID NO: 1428613 - protein, 4 aa, Mycobacterium tuberculosis
AETG

SEQ ID NO: 1428614 - protein, 4 aa, Mycobacterium tuberculosis
AETP

SEQ ID NO: 1428615 - protein, 5 aa, Mycobacterium tuberculosis
AEVDP

SEQ ID NO: 1428616 - protein, 4 aa, Mycobacterium tuberculosis
AEVE

SEQ ID NO: 1428617 - protein, 9 aa, Mycobacterium tuberculosis
AEVEIPSPY

SEQ ID NO: 1428618 - protein, 8 aa, Mycobacterium tuberculosis
AEVEQASD

SEQ ID NO: 1428619 - protein, 6 aa, Mycobacterium tuberculosis
AEYDGD

SEQ ID NO: 1428620 - protein, 5 aa, Mycobacterium tuberculosis
AFAAG

SEQ ID NO: 1428621 - protein, 8 aa, Mycobacterium tuberculosis
AFREKDGR

SEQ ID NO: 1428622 - protein, 15 aa, Mycobacterium tuberculosis
AGAGAYANAEAANVQ

SEQ ID NO: 1428623 - protein, 6 aa, Mycobacterium tuberculosis
AGAGER

SEQ ID NO: 1428624 - protein, 6 aa, Mycobacterium tuberculosis
AGAGPI

SEQ ID NO: 1428625 - protein, 17 aa, Mycobacterium tuberculosis
AGAGSYAAAEAASAAPL

SEQ ID NO: 1428626 - protein, 14 aa, Mycobacterium tuberculosis
AGAGSYASAEAANV

SEQ ID NO: 1428627 - protein, 11 aa, Mycobacterium tuberculosis
AGARQADAQVR

SEQ ID NO: 1428628 - protein, 10 aa, Mycobacterium tuberculosis
AGATGDERSF

SEQ ID NO: 1428629 - protein, 15 aa, Mycobacterium tuberculosis
AGAVERTSASGDAGI

SEQ ID NO: 1428630 - protein, 9 aa, Mycobacterium tuberculosis
AGDDSTQGV

SEQ ID NO: 1428631 - protein, 6 aa, Mycobacterium tuberculosis
AGDGNV

SEQ ID NO: 1428632 - protein, 10 aa, Mycobacterium tuberculosis
AGDGTHEHPT

SEQ ID NO: 1428633 - protein, 8 aa, Mycobacterium tuberculosis
AGDKPIRV

SEQ ID NO: 1428634 - protein, 11 aa, Mycobacterium tuberculosis
AGDLPEGIEGG

SEQ ID NO: 1428635 - protein, 4 aa, Mycobacterium tuberculosis
AGDQ

SEQ ID NO: 1428636 - protein, 4 aa, Mycobacterium tuberculosis
AGDS

SEQ ID NO: 1428637 - protein, 6 aa, Mycobacterium tuberculosis
AGEAPS

SEQ ID NO: 1428638 - protein, 5 aa, Mycobacterium tuberculosis
AGEAV

SEQ ID NO: 1428639 - protein, 5 aa, Mycobacterium tuberculosis
AGEDA

SEQ ID NO: 1428640 - protein, 5 aa, Mycobacterium tuberculosis
AGEGA

SEQ ID NO: 1428641 - protein, 21 aa, Mycobacterium tuberculosis
AGEGDPGATRAAGEEARSLAD

SEQ ID NO: 1428642 - protein, 5 aa, Mycobacterium tuberculosis
AGEKQ

SEQ ID NO: 1428643 - protein, 6 aa, Mycobacterium tuberculosis
AGEPGA

SEQ ID NO: 1428644 - protein, 5 aa, Mycobacterium tuberculosis
AGERK

SEQ ID NO: 1428645 - protein, 9 aa, Mycobacterium tuberculosis
AGESAKFGI

SEQ ID NO: 1428646 - protein, 5 aa, Mycobacterium tuberculosis
AGESG

SEQ ID NO: 1428647 - protein, 15 aa, Mycobacterium tuberculosis
AGETFGEVESTKSVS

SEQ ID NO: 1428648 - protein, 8 aa, Mycobacterium tuberculosis
AGFDPKVP

SEQ ID NO: 1428649 - protein, 7 aa, Mycobacterium tuberculosis
AGFDPSK

SEQ ID NO: 1428650 - protein, 6 aa, Mycobacterium tuberculosis
AGFPAP

SEQ ID NO: 1428651 - protein, 5 aa, Mycobacterium tuberculosis
AGGAA

SEQ ID NO: 1428652 - protein, 15 aa, Mycobacterium tuberculosis
AGGAGAYAAAEAQVE

SEQ ID NO: 1428653 - protein, 29 aa, Mycobacterium tuberculosis
AGGAGGAGGRAGGGVGGIGGAGGAGGNGG

SEQ ID NO: 1428654 - protein, 13 aa, Mycobacterium tuberculosis
AGGAPMYQRPGDR

SEQ ID NO: 1428655 - protein, 7 aa, Mycobacterium tuberculosis
AGGATQH

SEQ ID NO: 1428656 - protein, 7 aa, Mycobacterium tuberculosis
AGGDSTV

SEQ ID NO: 1428657 - protein, 8 aa, Mycobacterium tuberculosis
AGGGGRGM

SEQ ID NO: 1428658 - protein, 5 aa, Mycobacterium tuberculosis
AGGGH

SEQ ID NO: 1428659 - protein, 11 aa, Mycobacterium tuberculosis
AGGGPGSLSAA

SEQ ID NO: 1428660 - protein, 21 aa, Mycobacterium tuberculosis
AGGGVREAKVPAAARNDADSK

SEQ ID NO: 1428661 - protein, 5 aa, Mycobacterium tuberculosis
AGGHT

SEQ ID NO: 1428662 - protein, 4 aa, Mycobacterium tuberculosis
AGGI

SEQ ID NO: 1428663 - protein, 16 aa, Mycobacterium tuberculosis
AGGLQSVAKASATKDV

SEQ ID NO: 1428664 - protein, 19 aa, Mycobacterium tuberculosis
AGGNGGAGGAGGAGGAGGA

SEQ ID NO: 1428665 - protein, 5 aa, Mycobacterium tuberculosis
AGGRP

SEQ ID NO: 1428666 - protein, 10 aa, Mycobacterium tuberculosis
AGGTSEVTRN

SEQ ID NO: 1428667 - protein, 5 aa, Mycobacterium tuberculosis
AGGYG

SEQ ID NO: 1428668 - protein, 6 aa, Mycobacterium tuberculosis
AGHRCD

SEQ ID NO: 1428669 - protein, 10 aa, Mycobacterium tuberculosis
AGKGNKEPRN

SEQ ID NO: 1428670 - protein, 10 aa, Mycobacterium tuberculosis
AGKRAGKTVG

SEQ ID NO: 1428671 - protein, 21 aa, Mycobacterium tuberculosis
AGLASTSRGDGGHGSSGGHAS

SEQ ID NO: 1428672 - protein, 15 aa, Mycobacterium tuberculosis
AGLRRAEAAQAHTGD

SEQ ID NO: 1428673 - protein, 8 aa, Mycobacterium tuberculosis
AGMNEEQA

SEQ ID NO: 1428674 - protein, 14 aa, Mycobacterium tuberculosis
AGMTTGMPTPEGKP

SEQ ID NO: 1428675 - protein, 10 aa, Mycobacterium tuberculosis
AGNAKGHGRH

SEQ ID NO: 1428676 - protein, 18 aa, Mycobacterium tuberculosis
AGNAPRPAGRSLSDADRS

SEQ ID NO: 1428677 - protein, 8 aa, Mycobacterium tuberculosis
AGNAVRPE

SEQ ID NO: 1428678 - protein, 9 aa, Mycobacterium tuberculosis
AGPAGSAAA

SEQ ID NO: 1428679 - protein, 7 aa, Mycobacterium tuberculosis
AGPAWDR

SEQ ID NO: 1428680 - protein, 9 aa, Mycobacterium tuberculosis
AGPEAQEEL

SEQ ID NO: 1428681 - protein, 6 aa, Mycobacterium tuberculosis
AGPEIG

SEQ ID NO: 1428682 - protein, 6 aa, Mycobacterium tuberculosis
AGPGVR

SEQ ID NO: 1428683 - protein, 4 aa, Mycobacterium tuberculosis
AGPL

SEQ ID NO: 1428684 - protein, 9 aa, Mycobacterium tuberculosis
AGPQLPTGL

SEQ ID NO: 1428685 - protein, 7 aa, Mycobacterium tuberculosis
AGPRLGK

SEQ ID NO: 1428686 - protein, 4 aa, Mycobacterium tuberculosis
AGPS

SEQ ID NO: 1428687 - protein, 4 aa, Mycobacterium tuberculosis
AGPT

SEQ ID NO: 1428688 - protein, 9 aa, Mycobacterium tuberculosis
AGPTRRRID

SEQ ID NO: 1428689 - protein, 11 aa, Mycobacterium tuberculosis
AGQHPDPTTNA

SEQ ID NO: 1428690 - protein, 30 aa, Mycobacterium tuberculosis; identical to SEQ ID NO: 168451

SEQ ID NO: 1428691 - protein, 10 aa, Mycobacterium tuberculosis
AGRAKLDHSY

SEQ ID NO: 1428692 - protein, 7 aa, Mycobacterium tuberculosis
AGRASGV

SEQ ID NO: 1428693 - protein, 6 aa, Mycobacterium tuberculosis
AGRDGL

SEQ ID NO: 1428694 - protein, 4 aa, Mycobacterium tuberculosis
AGRI

SEQ ID NO: 1428695 - protein, 6 aa, Mycobacterium tuberculosis
AGRKGY

SEQ ID NO: 1428696 - protein, 15 aa, Mycobacterium tuberculosis
AGRPVTSTSCPTAAR

SEQ ID NO: 1428697 - protein, 12 aa, Mycobacterium tuberculosis
AGRRIGAGHNNA

SEQ ID NO: 1428698 - protein, 6 aa, Mycobacterium tuberculosis
AGRRTG

SEQ ID NO: 1428699 - protein, 11 aa, Mycobacterium tuberculosis
AGRSRPGARVQ

SEQ ID NO: 1428700 - protein, 4 aa, Mycobacterium tuberculosis
AGRT

SEQ ID NO: 1428701 - protein, 12 aa, Mycobacterium tuberculosis
AGRVRGQRWGPR

SEQ ID NO: 1428702 - protein, 16 aa, Mycobacterium tuberculosis
AGSGNISLPAAKTGAT

SEQ ID NO: 1428703 - protein, 8 aa, Mycobacterium tuberculosis
AGSPEVDT

SEQ ID NO: 1428704 - protein, 15 aa, Mycobacterium tuberculosis
AGSPPPQSDSSTDGL

SEQ ID NO: 1428705 - protein, 6 aa, Mycobacterium tuberculosis
AGSRAA

SEQ ID NO: 1428706 - protein, 10 aa, Mycobacterium tuberculosis
AGSRFAERGH

SEQ ID NO: 1428707 - protein, 31 aa, Mycobacterium tuberculosis; identical to SEQ ID NO: 168553

SEQ ID NO: 1428708 - protein, 10 aa, Mycobacterium tuberculosis
AGSSATATKV

SEQ ID NO: 1428709 - protein, 9 aa, Mycobacterium tuberculosis
AGSSGSRSV

SEQ ID NO: 1428710 - protein, 18 aa, Mycobacterium tuberculosis
AGTAEGASNTGARLADAA

SEQ ID NO: 1428711 - protein, 6 aa, Mycobacterium tuberculosis
AGTAGA

SEQ ID NO: 1428712 - protein, 6 aa, Mycobacterium tuberculosis
AGTDVR

SEQ ID NO: 1428713 - protein, 25 aa, Mycobacterium tuberculosis
AGTGGHGAAGGVPAGVGGAGGNGGL

SEQ ID NO: 1428714 - protein, 8 aa, Mycobacterium tuberculosis
AGTNPAYG

SEQ ID NO: 1428715 - protein, 17 aa, Mycobacterium tuberculosis
AGTPAGSRRAQPAADNV

SEQ ID NO: 1428716 - protein, 24 aa, Mycobacterium tuberculosis
AGTPCALGSAKSNMGHSTASAGTV

SEQ ID NO: 1428717 - protein, 58 aa, Mycobacterium tuberculosis; identical to SEQ ID NO: 168600

SEQ ID NO: 1428718 - protein, 6 aa, Mycobacterium tuberculosis
AGTPMT

SEQ ID NO: 1428719 - protein, 15 aa, Mycobacterium tuberculosis
AGVGSGTADHPGDPW

SEQ ID NO: 1428720 - protein, 6 aa, Mycobacterium tuberculosis
AGVSRP

SEQ ID NO: 1428721 - protein, 4 aa, Mycobacterium tuberculosis
AGVT

SEQ ID NO: 1428722 - protein, 5 aa, Mycobacterium tuberculosis
AGWPN

SEQ ID NO: 1428723 - protein, 16 aa, Mycobacterium tuberculosis
AGWSSAPRSRYTKTEM

SEQ ID NO: 1428724 - protein, 4 aa, Mycobacterium tuberculosis
AHAA

SEQ ID NO: 1428725 - protein, 8 aa, Mycobacterium tuberculosis
AHAAAAGA

SEQ ID NO: 1428726 - protein, 13 aa, Mycobacterium tuberculosis
AHATSGEESAPVT

SEQ ID NO: 1428727 - protein, 7 aa, Mycobacterium tuberculosis
AHDAPKG

SEQ ID NO: 1428728 - protein, 5 aa, Mycobacterium tuberculosis
AHEAA

SEQ ID NO: 1428729 - protein, 7 aa, Mycobacterium tuberculosis
AHEEGGE

SEQ ID NO: 1428730 - protein, 8 aa, Mycobacterium tuberculosis
AHESGQAT

SEQ ID NO: 1428731 - protein, 10 aa, Mycobacterium tuberculosis
AHGLTANEPS

SEQ ID NO: 1428732 - protein, 5 aa, Mycobacterium tuberculosis
AHGNE

SEQ ID NO: 1428733 - protein, 9 aa, Mycobacterium tuberculosis
AHGVGDPSG

SEQ ID NO: 1428734 - protein, 8 aa, Mycobacterium tuberculosis
AHNDGPAV

SEQ ID NO: 1428735 - protein, 9 aa, Mycobacterium tuberculosis
AHNGYADDG

SEQ ID NO: 1428736 - protein, 9 aa, Mycobacterium tuberculosis
AHPARPARR

SEQ ID NO: 1428737 - protein, 5 aa, Mycobacterium tuberculosis
AHPAS

SEQ ID NO: 1428738 - protein, 7 aa, Mycobacterium tuberculosis
AHPGRPD

SEQ ID NO: 1428739 - protein, 4 aa, Mycobacterium tuberculosis
AHRA

SEQ ID NO: 1428740 - protein, 18 aa, Mycobacterium tuberculosis
AHSDTTAPAGGSTPIYEP

SEQ ID NO: 1428741 - protein, 13 aa, Mycobacterium tuberculosis
AHSYPDAARTDAE

SEQ ID NO: 1428742 - protein, 6 aa, Mycobacterium tuberculosis
AIDSDR

SEQ ID NO: 1428743 - protein, 4 aa, Mycobacterium tuberculosis
AIGS

SEQ ID NO: 1428744 - protein, 14 aa, Mycobacterium tuberculosis
AIPDGEIAGSAEAS

SEQ ID NO: 1428745 - protein, 5 aa, Mycobacterium tuberculosis
AISGD

SEQ ID NO: 1428746 - protein, 6 aa, Mycobacterium tuberculosis
AITEHG

SEQ ID NO: 1428747 - protein, 14 aa, Mycobacterium tuberculosis
AKAAEGEVDADSVR

SEQ ID NO: 1428748 - protein, 30 aa, Mycobacterium tuberculosis
AKAATLGATSTHATTPSGLDGPGGSGASTA

SEQ ID NO: 1428749 - protein, 12 aa, Mycobacterium tuberculosis
AKAATSDAYDNA

SEQ ID NO: 1428750 - protein, 6 aa, Mycobacterium tuberculosis
AKAEAE

SEQ ID NO: 1428751 - protein, 18 aa, Mycobacterium tuberculosis
AKAGAGPPEHNRRLDSDA

SEQ ID NO: 1428752 - protein, 6 aa, Mycobacterium tuberculosis
AKAGRT

SEQ ID NO: 1428753 - protein, 6 aa, Mycobacterium tuberculosis
AKAQRH

SEQ ID NO: 1428754 - protein, 6 aa, Mycobacterium tuberculosis
AKARQS

SEQ ID NO: 1428755 - protein, 6 aa, Mycobacterium tuberculosis
AKATSR

SEQ ID NO: 1428756 - protein, 16 aa, Mycobacterium tuberculosis
AKDAFGAQKRQRQMDR

SEQ ID NO: 1428757 - protein, 8 aa, Mycobacterium tuberculosis
AKDPESVQ

SEQ ID NO: 1428758 - protein, 4 aa, Mycobacterium tuberculosis
AKDT

SEQ ID NO: 1428759 - protein, 7 aa, Mycobacterium tuberculosis
AKEIGGP

SEQ ID NO: 1428760 - protein, 4 aa, Mycobacterium tuberculosis
AKEM

SEQ ID NO: 1428761 - protein, 14 aa, Mycobacterium tuberculosis
AKGYRNPVSPDPFA

SEQ ID NO: 1428762 - protein, 7 aa, Mycobacterium tuberculosis
AKHDAEH

SEQ ID NO: 1428763 - protein, 9 aa, Mycobacterium tuberculosis
AKHKGEEAK

SEQ ID NO: 1428764 - protein, 14 aa, Mycobacterium tuberculosis
AKHTAPRGSSRPLT

SEQ ID NO: 1428765 - protein, 14 aa, Mycobacterium tuberculosis
AKIGSKGRPLPGAG

SEQ ID NO: 1428766 - protein, 12 aa, Mycobacterium tuberculosis
AKLSAKNEARRI

SEQ ID NO: 1428767 - protein, 14 aa, Mycobacterium tuberculosis
AKNTDTREHDIADS

SEQ ID NO: 1428768 - protein, 10 aa, Mycobacterium tuberculosis
AKPDGPREGG

SEQ ID NO: 1428769 - protein, 37 aa, Mycobacterium tuberculosis; identical to SEQ ID NO: 168868

SEQ ID NO: 1428770 - protein, 11 aa, Mycobacterium tuberculosis
AKPVGADTGLT

SEQ ID NO: 1428771 - protein, 7 aa, Mycobacterium tuberculosis
AKQAPGW

SEQ ID NO: 1428772 - protein, 7 aa, Mycobacterium tuberculosis
AKQNSYA

SEQ ID NO: 1428773 - protein, 7 aa, Mycobacterium tuberculosis
AKRAVDA

SEQ ID NO: 1428774 - protein, 14 aa, Mycobacterium tuberculosis
AKREYEASVSRAQA

SEQ ID NO: 1428775 - protein, 7 aa, Mycobacterium tuberculosis
AKTHADS

SEQ ID NO: 1428776 - protein, 6 aa, Mycobacterium tuberculosis
AKVDRT

SEQ ID NO: 1428777 - protein, 7 aa, Mycobacterium tuberculosis
AKYPGTQ

SEQ ID NO: 1428778 - protein, 4 aa, Mycobacterium tuberculosis
ALAA

SEQ ID NO: 1428779 - protein, 21 aa, Mycobacterium tuberculosis
ALAAPPAATPAAISDQLPSDR

SEQ ID NO: 1428780 - protein, 8 aa, Mycobacterium tuberculosis
ALAGAGAA

SEQ ID NO: 1428781 - protein, 25 aa, Mycobacterium tuberculosis
ALASDGPPKYQRAAKGSVADEAEPR

SEQ ID NO: 1428782 - protein, 4 aa, Mycobacterium tuberculosis
ALDA

SEQ ID NO: 1428783 - protein, 6 aa, Mycobacterium tuberculosis
ALDGGA

SEQ ID NO: 1428784 - protein, 11 aa, Mycobacterium tuberculosis
ALGSAAGSEAA

SEQ ID NO: 1428785 - protein, 7 aa, Mycobacterium tuberculosis
ALGSQGG

SEQ ID NO: 1428786 - protein, 8 aa, Mycobacterium tuberculosis
ALGTTGLK

SEQ ID NO: 1428787 - protein, 16 aa, Mycobacterium tuberculosis
ALLGAGSGVGNVGTLG

SEQ ID NO: 1428788 - protein, 6 aa, Mycobacterium tuberculosis
ALNSSE

SEQ ID NO: 1428789 - protein, 5 aa, Mycobacterium tuberculosis
ALPNT

SEQ ID NO: 1428790 - protein, 6 aa, Mycobacterium tuberculosis
ALPPKT

SEQ ID NO: 1428791 - protein, 4 aa, Mycobacterium tuberculosis
ALQA

SEQ ID NO: 1428792 - protein, 9 aa, Mycobacterium tuberculosis
ALRNSAGRE

SEQ ID NO: 1428793 - protein, 10 aa, Mycobacterium tuberculosis
ALSDDGHCRP

SEQ ID NO: 1428794 - protein, 8 aa, Mycobacterium tuberculosis
ALSGAGPS

SEQ ID NO: 1428795 - protein, 4 aa, Mycobacterium tuberculosis
ALTE

SEQ ID NO: 1428796 - protein, 37 aa, Mycobacterium tuberculosis; identical to SEQ ID NO: 169024

SEQ ID NO: 1428797 - protein, 16 aa, Mycobacterium tuberculosis
ALTNQNPQPAASQEDA

SEQ ID NO: 1428798 - protein, 10 aa, Mycobacterium tuberculosis
AMPDGVTDRR

SEQ ID NO: 1428799 - protein, 5 aa, Mycobacterium tuberculosis
AMRPA

SEQ ID NO: 1428800 - protein, 14 aa, Mycobacterium tuberculosis
AMSNGRTDSRFTEA

SEQ ID NO: 1428801 - protein, 5 aa, Mycobacterium tuberculosis
AMTGG

SEQ ID NO: 1428802 - protein, 8 aa, Mycobacterium tuberculosis
ANALPRRG

SEQ ID NO: 1428803 - protein, 10 aa, Mycobacterium tuberculosis
ANASIPTPQP

SEQ ID NO: 1428804 - protein, 6 aa, Mycobacterium tuberculosis
ANDPER

SEQ ID NO: 1428805 - protein, 4 aa, Mycobacterium tuberculosis
ANDV

SEQ ID NO: 1428806 - protein, 6 aa, Mycobacterium tuberculosis
ANEEAA

SEQ ID NO: 1428807 - protein, 7 aa, Mycobacterium tuberculosis
ANGEERS

SEQ ID NO: 1428808 - protein, 11 aa, Mycobacterium tuberculosis
ANGFGKNETHA

SEQ ID NO: 1428809 - protein, 7 aa, Mycobacterium tuberculosis
ANGGLGP

SEQ ID NO: 1428810 - protein, 5 aa, Mycobacterium tuberculosis
ANGLQ

SEQ ID NO: 1428811 - protein, 5 aa, Mycobacterium tuberculosis
ANHAD

SEQ ID NO: 1428812 - protein, 6 aa, Mycobacterium tuberculosis
ANKREP

SEQ ID NO: 1428813 - protein, 6 aa, Mycobacterium tuberculosis
ANLRPS

SEQ ID NO: 1428814 - protein, 7 aa, Mycobacterium tuberculosis
ANLTRNA

SEQ ID NO: 1428815 - protein, 9 aa, Mycobacterium tuberculosis
ANPDRGTLS

SEQ ID NO: 1428816 - protein, 5 aa, Mycobacterium tuberculosis
ANPSI

SEQ ID NO: 1428817 - protein, 10 aa, Mycobacterium tuberculosis
ANRDPQTRHS

SEQ ID NO: 1428818 - protein, 7 aa, Mycobacterium tuberculosis
ANRLGAG

SEQ ID NO: 1428819 - protein, 10 aa, Mycobacterium tuberculosis
ANRTDAPRPA

SEQ ID NO: 1428820 - protein, 10 aa, Mycobacterium tuberculosis
ANSATSGFNN

SEQ ID NO: 1428821 - protein, 6 aa, Mycobacterium tuberculosis
ANTGSY

SEQ ID NO: 1428822 - protein, 20 aa, Mycobacterium tuberculosis
ANTGSYNTGSTNTGSFNDGD

SEQ ID NO: 1428823 - protein, 26 aa, Mycobacterium tuberculosis
ANTGVGNAGNYNTGSYNPGNSNTGGF

SEQ ID NO: 1428824 - protein, 5 aa, Mycobacterium tuberculosis
ANTKK

SEQ ID NO: 1428825 - protein, 5 aa, Mycobacterium tuberculosis
ANVSK

SEQ ID NO: 1428826 - protein, 4 aa, Mycobacterium tuberculosis
ANVT

SEQ ID NO: 1428827 - protein, 8 aa, Mycobacterium tuberculosis
APAAALSG

SEQ ID NO: 1428828 - protein, 18 aa, Mycobacterium tuberculosis
APAAAQAVETAAQNGVQA

SEQ ID NO: 1428829 - protein, 8 aa, Mycobacterium tuberculosis
APADAGSF

SEQ ID NO: 1428830 - protein, 11 aa, Mycobacterium tuberculosis
APADGPDDAAL

SEQ ID NO: 1428831 - protein, 8 aa, Mycobacterium tuberculosis
APADTGTT

SEQ ID NO: 1428832 - protein, 18 aa, Mycobacterium tuberculosis
APAEASAPESSPGDAEVG

SEQ ID NO: 1428833 - protein, 25 aa, Mycobacterium tuberculosis
APALAATRKGRSDRSAARGGSARTT

SEQ ID NO: 1428834 - protein, 8 aa, Mycobacterium tuberculosis
APALPDDL

SEQ ID NO: 1428835 - protein, 10 aa, Mycobacterium tuberculosis
APAPEDGADV

SEQ ID NO: 1428836 - protein, 17 aa, Mycobacterium tuberculosis
APAPFEEPLPPEATDQW

SEQ ID NO: 1428837 - protein, 8 aa, Mycobacterium tuberculosis
APAPTPVS

SEQ ID NO: 1428838 - protein, 20 aa, Mycobacterium tuberculosis
APAQEAPAQEAPAPRGQYDP

SEQ ID NO: 1428839 - protein, 6 aa, Mycobacterium tuberculosis
APARTC

SEQ ID NO: 1428840 - protein, 5 aa, Mycobacterium tuberculosis
APASA

SEQ ID NO: 1428841 - protein, 5 aa, Mycobacterium tuberculosis
APATD

SEQ ID NO: 1428842 - protein, 5 aa, Mycobacterium tuberculosis
APDAD

SEQ ID NO: 1428843 - protein, 13 aa, Mycobacterium tuberculosis
APDGTHHQNDAAA

SEQ ID NO: 1428844 - protein, 6 aa, Mycobacterium tuberculosis
APDRNR

SEQ ID NO: 1428845 - protein, 6 aa, Mycobacterium tuberculosis
APDRQR

SEQ ID NO: 1428846 - protein, 9 aa, Mycobacterium tuberculosis
APDSERGLA

SEQ ID NO: 1428847 - protein, 8 aa, Mycobacterium tuberculosis
APDTAVAA

SEQ ID NO: 1428848 - protein, 6 aa, Mycobacterium tuberculosis
APEPAE

SEQ ID NO: 1428849 - protein, 22 aa, Mycobacterium tuberculosis
APEPSPDSDAAVKRGARNSLDE

SEQ ID NO: 1428850 - protein, 4 aa, Mycobacterium tuberculosis
APFT

SEQ ID NO: 1428851 - protein, 14 aa, Mycobacterium tuberculosis
APGAIGGAGGPAGL

SEQ ID NO: 1428852 - protein, 10 aa, Mycobacterium tuberculosis
APGCGQPGGS

SEQ ID NO: 1428853 - protein, 5 aa, Mycobacterium tuberculosis
APGDG

SEQ ID NO: 1428854 - protein, 6 aa, Mycobacterium tuberculosis
APGGAH

SEQ ID NO: 1428855 - protein, 8 aa, Mycobacterium tuberculosis
APGGVETA

SEQ ID NO: 1428856 - protein, 15 aa, Mycobacterium tuberculosis
APGIGNSTTSPSSGF

SEQ ID NO: 1428857 - protein, 13 aa, Mycobacterium tuberculosis
APGMANPADDTPC

SEQ ID NO: 1428858 - protein, 4 aa, Mycobacterium tuberculosis
APGR

SEQ ID NO: 1428859 - protein, 15 aa, Mycobacterium tuberculosis
APGVGNTTTAPSSGF

SEQ ID NO: 1428860 - protein, 11 aa, Mycobacterium tuberculosis
APHDRTAEELR

SEQ ID NO: 1428861 - protein, 8 aa, Mycobacterium tuberculosis
APHSRTSI

SEQ ID NO: 1428862 - protein, 11 aa, Mycobacterium tuberculosis
APKAAANSADD

SEQ ID NO: 1428863 - protein, 8 aa, Mycobacterium tuberculosis
APKPEWED

SEQ ID NO: 1428864 - protein, 6 aa, Mycobacterium tuberculosis
APLAAG

SEQ ID NO: 1428865 - protein, 6 aa, Mycobacterium tuberculosis
APLDRQ

SEQ ID NO: 1428866 - protein, 7 aa, Mycobacterium tuberculosis
APPAAKT

SEQ ID NO: 1428867 - protein, 46 aa, Mycobacterium tuberculosis; identical to SEQ ID NO: 166283

SEQ ID NO: 1428868 - protein, 7 aa, Mycobacterium tuberculosis
APPKLGR

SEQ ID NO: 1428869 - protein, 5 aa, Mycobacterium tuberculosis
APPLN

SEQ ID NO: 1428870 - protein, 7 aa, Mycobacterium tuberculosis
APPSVAS

SEQ ID NO: 1428871 - protein, 9 aa, Mycobacterium tuberculosis
APPVKRQEQ

SEQ ID NO: 1428872 - protein, 6 aa, Mycobacterium tuberculosis
APQDMG

SEQ ID NO: 1428873 - protein, 8 aa, Mycobacterium tuberculosis
APQTPLDR

SEQ ID NO: 1428874 - protein, 9 aa, Mycobacterium tuberculosis
APRKREAAG

SEQ ID NO: 1428875 - protein, 6 aa, Mycobacterium tuberculosis
APRRRH

SEQ ID NO: 1428876 - protein, 6 aa, Mycobacterium tuberculosis
APSAAA

SEQ ID NO: 1428877 - protein, 5 aa, Mycobacterium tuberculosis
APSKE

SEQ ID NO: 1428878 - protein, 13 aa, Mycobacterium tuberculosis
APSSGGGATSTQG

SEQ ID NO: 1428879 - protein, 6 aa, Mycobacterium tuberculosis
APTDAS

SEQ ID NO: 1428880 - protein, 7 aa, Mycobacterium tuberculosis
APTDSAI

SEQ ID NO: 1428881 - protein, 7 aa, Mycobacterium tuberculosis
APTLDGA

SEQ ID NO: 1428882 - protein, 9 aa, Mycobacterium tuberculosis
APTPGRSRA

SEQ ID NO: 1428883 - protein, 4 aa, Mycobacterium tuberculosis
APTR

SEQ ID NO: 1428884 - protein, 8 aa, Mycobacterium tuberculosis
APTRPRRR

SEQ ID NO: 1428885 - protein, 11 aa, Mycobacterium tuberculosis
APTTGDLDAQT

SEQ ID NO: 1428886 - protein, 9 aa, Mycobacterium tuberculosis
APTTGGPYA

SEQ ID NO: 1428887 - protein, 11 aa, Mycobacterium tuberculosis
APVDVNPPGDE

SEQ ID NO: 1428888 - protein, 4 aa, Mycobacterium tuberculosis
APVH

SEQ ID NO: 1428889 - protein, 8 aa, Mycobacterium tuberculosis
APVPGTGA

SEQ ID NO: 1428890 - protein, 5 aa, Mycobacterium tuberculosis
APWVP

SEQ ID NO: 1428891 - protein, 16 aa, Mycobacterium tuberculosis
AQAAASAYNDAAGEQL

SEQ ID NO: 1428892 - protein, 6 aa, Mycobacterium tuberculosis
AQAERA

SEQ ID NO: 1428893 - protein, 11 aa, Mycobacterium tuberculosis
AQAERSRDPIG

SEQ ID NO: 1428894 - protein, 5 aa, Mycobacterium tuberculosis
AQASE

SEQ ID NO: 1428895 - protein, 13 aa, Mycobacterium tuberculosis
AQAVGANDEDFEG

SEQ ID NO: 1428896 - protein, 6 aa, Mycobacterium tuberculosis
AQEAGN

SEQ ID NO: 1428897 - protein, 8 aa, Mycobacterium tuberculosis
AQGRLEAG

SEQ ID NO: 1428898 - protein, 5 aa, Mycobacterium tuberculosis
AQGSA

SEQ ID NO: 1428899 - protein, 5 aa, Mycobacterium tuberculosis
AQGTR

SEQ ID NO: 1428900 - protein, 9 aa, Mycobacterium tuberculosis
AQHARHEAE

SEQ ID NO: 1428901 - protein, 7 aa, Mycobacterium tuberculosis
AQNGDLE

SEQ ID NO: 1428902 - protein, 7 aa, Mycobacterium tuberculosis
AQPDTAD

SEQ ID NO: 1428903 - protein, 18 aa, Mycobacterium tuberculosis
AQPHHRGGPTTATNGLGS

SEQ ID NO: 1428904 - protein, 7 aa, Mycobacterium tuberculosis
AQPPQNH

SEQ ID NO: 1428905 - protein, 5 aa, Mycobacterium tuberculosis
AQPQG

SEQ ID NO: 1428906 - protein, 9 aa, Mycobacterium tuberculosis
AQPRAGAST

SEQ ID NO: 1428907 - protein, 7 aa, Mycobacterium tuberculosis
AQRAGDA

SEQ ID NO: 1428908 - protein, 8 aa, Mycobacterium tuberculosis
AQRDTDVD

SEQ ID NO: 1428909 - protein, 9 aa, Mycobacterium tuberculosis
AQRQLDGDA

SEQ ID NO: 1428910 - protein, 9 aa, Mycobacterium tuberculosis
AQRQRTGEV

SEQ ID NO: 1428911 - protein, 6 aa, Mycobacterium tuberculosis
AQRSLR

SEQ ID NO: 1428912 - protein, 9 aa, Mycobacterium tuberculosis
AQRSTTNPV

SEQ ID NO: 1428913 - protein, 4 aa, Mycobacterium tuberculosis
AQRY

SEQ ID NO: 1428914 - protein, 10 aa, Mycobacterium tuberculosis
AQSPDIAQGV

SEQ ID NO: 1428915 - protein, 9 aa, Mycobacterium tuberculosis
AQSQANADG

SEQ ID NO: 1428916 - protein, 28 aa, Mycobacterium tuberculosis
AQSRSEAQLRQAQEKADALQADAERKHS

SEQ ID NO: 1428917 - protein, 5 aa, Mycobacterium tuberculosis
AQTDP

SEQ ID NO: 1428918 - protein, 21 aa, Mycobacterium tuberculosis
AQTGAVADQQGQIAGLGRAGR

SEQ ID NO: 1428919 - protein, 8 aa, Mycobacterium tuberculosis
AQTGNGYR

SEQ ID NO: 1428920 - protein, 5 aa, Mycobacterium tuberculosis
AQVTD

SEQ ID NO: 1428921 - protein, 4 aa, Mycobacterium tuberculosis
ARAA

SEQ ID NO: 1428922 - protein, 9 aa, Mycobacterium tuberculosis
ARAATTGPI

SEQ ID NO: 1428923 - protein, 14 aa, Mycobacterium tuberculosis
ARADATRVRSGADR

SEQ ID NO: 1428924 - protein, 17 aa, Mycobacterium tuberculosis
ARADGAAPAADHAEQVA

SEQ ID NO: 1428925 - protein, 5 aa, Mycobacterium tuberculosis
ARAEG

SEQ ID NO: 1428926 - protein, 6 aa, Mycobacterium tuberculosis
ARAEPL

SEQ ID NO: 1428927 - protein, 9 aa, Mycobacterium tuberculosis
ARAGGDHRR

SEQ ID NO: 1428928 - protein, 19 aa, Mycobacterium tuberculosis
ARAGGPELQRESTEKAPIG

SEQ ID NO: 1428929 - protein, 5 aa, Mycobacterium tuberculosis
ARARR

SEQ ID NO: 1428930 - protein, 4 aa, Mycobacterium tuberculosis
ARAS

SEQ ID NO: 1428931 - protein, 7 aa, Mycobacterium tuberculosis
ARDADTV

SEQ ID NO: 1428932 - protein, 12 aa, Mycobacterium tuberculosis
ARDEAEAVRTQK

SEQ ID NO: 1428933 - protein, 7 aa, Mycobacterium tuberculosis
ARDPATG

SEQ ID NO: 1428934 - protein, 4 aa, Mycobacterium tuberculosis
AREE

SEQ ID NO: 1428935 - protein, 5 aa, Mycobacterium tuberculosis
AREPD

SEQ ID NO: 1428936 - protein, 7 aa, Mycobacterium tuberculosis
ARGDASA

SEQ ID NO: 1428937 - protein, 13 aa, Mycobacterium tuberculosis
ARGDLRADSDTGA

SEQ ID NO: 1428938 - protein, 4 aa, Mycobacterium tuberculosis
ARGE

SEQ ID NO: 1428939 - protein, 5 aa, Mycobacterium tuberculosis
ARGFY

SEQ ID NO: 1428940 - protein, 9 aa, Mycobacterium tuberculosis
ARGGTTATY

SEQ ID NO: 1428941 - protein, 15 aa, Mycobacterium tuberculosis
ARGTAPSSPLNATVS

SEQ ID NO: 1428942 - protein, 10 aa, Mycobacterium tuberculosis
ARGYRGRPEL

SEQ ID NO: 1428943 - protein, 16 aa, Mycobacterium tuberculosis
ARKAGTTVTHEDKGGR

SEQ ID NO: 1428944 - protein, 7 aa, Mycobacterium tuberculosis
ARKASLP

SEQ ID NO: 1428945 - protein, 5 aa, Mycobacterium tuberculosis
ARKSS

SEQ ID NO: 1428946 - protein, 6 aa, Mycobacterium tuberculosis
ARKSSI

SEQ ID NO: 1428947 - protein, 12 aa, Mycobacterium tuberculosis
ARLNRSSVRSTR

SEQ ID NO: 1428948 - protein, 4 aa, Mycobacterium tuberculosis
ARLP

SEQ ID NO: 1428949 - protein, 10 aa, Mycobacterium tuberculosis
ARLSRDEKAV

SEQ ID NO: 1428950 - protein, 6 aa, Mycobacterium tuberculosis
ARNAQR

SEQ ID NO: 1428951 - protein, 4 aa, Mycobacterium tuberculosis
ARNG

SEQ ID NO: 1428952 - protein, 5 aa, Mycobacterium tuberculosis
ARNVS

SEQ ID NO: 1428953 - protein, 6 aa, Mycobacterium tuberculosis
ARPAET

SEQ ID NO: 1428954 - protein, 11 aa, Mycobacterium tuberculosis
ARPGTPLHDPG

SEQ ID NO: 1428955 - protein, 8 aa, Mycobacterium tuberculosis
ARQAVDDG

SEQ ID NO: 1428956 - protein, 6 aa, Mycobacterium tuberculosis
ARQHSE

SEQ ID NO: 1428957 - protein, 7 aa, Mycobacterium tuberculosis
ARQSRRP

SEQ ID NO: 1428958 - protein, 8 aa, Mycobacterium tuberculosis
ARRDPPLD

SEQ ID NO: 1428959 - protein, 7 aa, Mycobacterium tuberculosis
ARRERGD

SEQ ID NO: 1428960 - protein, 8 aa, Mycobacterium tuberculosis
ARRPRLGV

SEQ ID NO: 1428961 - protein, 10 aa, Mycobacterium tuberculosis
ARRRAGDTAA

SEQ ID NO: 1428962 - protein, 4 aa, Mycobacterium tuberculosis
ARRS

SEQ ID NO: 1428963 - protein, 13 aa, Mycobacterium tuberculosis
ARRTDAESVAGQV

SEQ ID NO: 1428964 - protein, 9 aa, Mycobacterium tuberculosis
ARSAEGDRV

SEQ ID NO: 1428965 - protein, 4 aa, Mycobacterium tuberculosis
ARSG

SEQ ID NO: 1428966 - protein, 13 aa, Mycobacterium tuberculosis
ARSGKSVAADAAT

SEQ ID NO: 1428967 - protein, 11 aa, Mycobacterium tuberculosis
ARSGPRRNAQV

SEQ ID NO: 1428968 - protein, 4 aa, Mycobacterium tuberculosis
ARSR

SEQ ID NO: 1428969 - protein, 5 aa, Mycobacterium tuberculosis
ARSRK

SEQ ID NO: 1428970 - protein, 7 aa, Mycobacterium tuberculosis
ARSRQQA

SEQ ID NO: 1428971 - protein, 10 aa, Mycobacterium tuberculosis
ARSTGQRPSW

SEQ ID NO: 1428972 - protein, 10 aa, Mycobacterium tuberculosis
ARTGDCTAAA

SEQ ID NO: 1428973 - protein, 5 aa, Mycobacterium tuberculosis
ARTPP

SEQ ID NO: 1428974 - protein, 6 aa, Mycobacterium tuberculosis
ARTREQ

SEQ ID NO: 1428975 - protein, 4 aa, Mycobacterium tuberculosis
ARVS

SEQ ID NO: 1428976 - protein, 5 aa, Mycobacterium tuberculosis
ARYRD

SEQ ID NO: 1428977 - protein, 5 aa, Mycobacterium tuberculosis
ARYSA

SEQ ID NO: 1428978 - protein, 7 aa, Mycobacterium tuberculosis
ASAARMA

SEQ ID NO: 1428979 - protein, 12 aa, Mycobacterium tuberculosis
ASAASAAGEAAV

SEQ ID NO: 1428980 - protein, 18 aa, Mycobacterium tuberculosis
ASAEATRRYGTGCSGSPL

SEQ ID NO: 1428981 - protein, 7 aa, Mycobacterium tuberculosis
ASAGLGQ

SEQ ID NO: 1428982 - protein, 30 aa, Mycobacterium tuberculosis; identical to SEQ ID NO: 169943

SEQ ID NO: 1428983 - protein, 4 aa, Mycobacterium tuberculosis
ASAS

SEQ ID NO: 1428984 - protein, 5 aa, Mycobacterium tuberculosis
ASAVT

SEQ ID NO: 1428985 - protein, 14 aa, Mycobacterium tuberculosis
ASAYDEAAATMSGE

SEQ ID NO: 1428986 - protein, 7 aa, Mycobacterium tuberculosis
ASEAGIE

SEQ ID NO: 1428987 - protein, 12 aa, Mycobacterium tuberculosis
ASEETWRELANE

SEQ ID NO: 1428988 - protein, 4 aa, Mycobacterium tuberculosis
ASEL

SEQ ID NO: 1428989 - protein, 25 aa, Mycobacterium tuberculosis
ASENGVPVTARGSGCGLSGAARPVE

SEQ ID NO: 1428990 - protein, 13 aa, Mycobacterium tuberculosis
ASERTAPSRACQG

SEQ ID NO: 1428991 - protein, 30 aa, Mycobacterium tuberculosis; identical to SEQ ID NO: 170015

SEQ ID NO: 1428992 - protein, 23 aa, Mycobacterium tuberculosis
ASGGNPSPASGGHRRGKPRVPGL

SEQ ID NO: 1428993 - protein, 10 aa, Mycobacterium tuberculosis
ASGGSGGFGG

SEQ ID NO: 1428994 - protein, 18 aa, Mycobacterium tuberculosis
ASGKHGMGNNRDGAAGAD

SEQ ID NO: 1428995 - protein, 5 aa, Mycobacterium tuberculosis
ASGSV

SEQ ID NO: 1428996 - protein, 9 aa, Mycobacterium tuberculosis
ASGTGDARK

SEQ ID NO: 1428997 - protein, 6 aa, Mycobacterium tuberculosis
ASHEES

SEQ ID NO: 1428998 - protein, 11 aa, Mycobacterium tuberculosis
ASHPRDGRLGT

SEQ ID NO: 1428999 - protein, 8 aa, Mycobacterium tuberculosis
ASLAGTGV

SEQ ID NO: 1429000 - protein, 5 aa, Mycobacterium tuberculosis
ASLDR

SEQ ID NO: 1429001 - protein, 15 aa, Mycobacterium tuberculosis
ASLTAKVPDDVTSEV

SEQ ID NO: 1429002 - protein, 7 aa, Mycobacterium tuberculosis
ASNPRFS

SEQ ID NO: 1429003 - protein, 9 aa, Mycobacterium tuberculosis
ASPPPQNEL

SEQ ID NO: 1429004 - protein, 9 aa, Mycobacterium tuberculosis
ASPQDIQDA

SEQ ID NO: 1429005 - protein, 6 aa, Mycobacterium tuberculosis
ASPRIA

SEQ ID NO: 1429006 - protein, 10 aa, Mycobacterium tuberculosis
ASQAWQGPAA

SEQ ID NO: 1429007 - protein, 8 aa, Mycobacterium tuberculosis
ASQDPRGT

SEQ ID NO: 1429008 - protein, 8 aa, Mycobacterium tuberculosis
ASQSQGLG

SEQ ID NO: 1429009 - protein, 8 aa, Mycobacterium tuberculosis
ASRAENPL

SEQ ID NO: 1429010 - protein, 13 aa, Mycobacterium tuberculosis
ASRKVEATGQPVK

SEQ ID NO: 1429011 - protein, 5 aa, Mycobacterium tuberculosis
ASRLD

SEQ ID NO: 1429012 - protein, 4 aa, Mycobacterium tuberculosis
ASRR

SEQ ID NO: 1429013 - protein, 13 aa, Mycobacterium tuberculosis
ASRRRAQRRLPDT

SEQ ID NO: 1429014 - protein, 7 aa, Mycobacterium tuberculosis
ASRYPYS

SEQ ID NO: 1429015 - protein, 4 aa, Mycobacterium tuberculosis
ASSA

SEQ ID NO: 1429016 - protein, 10 aa, Mycobacterium tuberculosis
ASSANLGPGF

SEQ ID NO: 1429017 - protein, 6 aa, Mycobacterium tuberculosis
ASSETA

SEQ ID NO: 1429018 - protein, 9 aa, Mycobacterium tuberculosis
ASSNLAAQR

SEQ ID NO: 1429019 - protein, 6 aa, Mycobacterium tuberculosis
ASSPDI

SEQ ID NO: 1429020 - protein, 6 aa, Mycobacterium tuberculosis
ASSPMV

SEQ ID NO: 1429021 - protein, 9 aa, Mycobacterium tuberculosis
ASSQIQSES

SEQ ID NO: 1429022 - protein, 4 aa, Mycobacterium tuberculosis
ASSY

SEQ ID NO: 1429023 - protein, 15 aa, Mycobacterium tuberculosis
ASTAEAQDRAGTDVA

SEQ ID NO: 1429024 - protein, 8 aa, Mycobacterium tuberculosis
ASTATAVA

SEQ ID NO: 1429025 - protein, 4 aa, Mycobacterium tuberculosis
ASTL

SEQ ID NO: 1429026 - protein, 14 aa, Mycobacterium tuberculosis
ASTLGRTDRNLGEV

SEQ ID NO: 1429027 - protein, 22 aa, Mycobacterium tuberculosis
ASTPKPAKTAGEKVTDEGEGGN

SEQ ID NO: 1429028 - protein, 5 aa, Mycobacterium tuberculosis
ASVRN

SEQ ID NO: 1429029 - protein, 11 aa, Mycobacterium tuberculosis
ASYEARAYGAR

SEQ ID NO: 1429030 - protein, 5 aa, Mycobacterium tuberculosis
ASYIS

SEQ ID NO: 1429031 - protein, 12 aa, Mycobacterium tuberculosis
ATAADGSTSEHE

SEQ ID NO: 1429032 - protein, 11 aa, Mycobacterium tuberculosis
ATAAGTAQSTL

SEQ ID NO: 1429033 - protein, 17 aa, Mycobacterium tuberculosis
ATADAYATTEAVNVVAT

SEQ ID NO: 1429034 - protein, 8 aa, Mycobacterium tuberculosis
ATAGPRDV

SEQ ID NO: 1429035 - protein, 7 aa, Mycobacterium tuberculosis
ATALRED

SEQ ID NO: 1429036 - protein, 8 aa, Mycobacterium tuberculosis
ATALREDT

SEQ ID NO: 1429037 - protein, 27 aa, Mycobacterium tuberculosis
ATAPAVSPATTSAVAAESGSTPATKAQ

SEQ ID NO: 1429038 - protein, 6 aa, Mycobacterium tuberculosis
ATAPGD

SEQ ID NO: 1429039 - protein, 7 aa, Mycobacterium tuberculosis
ATAQGPR

SEQ ID NO: 1429040 - protein, 13 aa, Mycobacterium tuberculosis
ATARTERPDPPGP

SEQ ID NO: 1429041 - protein, 8 aa, Mycobacterium tuberculosis
ATDARPDV

SEQ ID NO: 1429042 - protein, 4 aa, Mycobacterium tuberculosis
ATDE

SEQ ID NO: 1429043 - protein, 6 aa, Mycobacterium tuberculosis
ATDEQL

SEQ ID NO: 1429044 - protein, 6 aa, Mycobacterium tuberculosis
ATDGGV

SEQ ID NO: 1429045 - protein, 7 aa, Mycobacterium tuberculosis
ATDGRTA

SEQ ID NO: 1429046 - protein, 17 aa, Mycobacterium tuberculosis
ATDPACSANGRDSQAGP

SEQ ID NO: 1429047 - protein, 8 aa, Mycobacterium tuberculosis
ATEAGITP

SEQ ID NO: 1429048 - protein, 5 aa, Mycobacterium tuberculosis
ATEAR

SEQ ID NO: 1429049 - protein, 30 aa, Mycobacterium tuberculosis
ATEPLPPPAPPPTTPTVTTPTVATATTAGI

SEQ ID NO: 1429050 - protein, 11 aa, Mycobacterium tuberculosis
ATFGGGARSAA

SEQ ID NO: 1429051 - protein, 19 aa, Mycobacterium tuberculosis
ATGDFRRGSISENYRRCGK

SEQ ID NO: 1429052 - protein, 9 aa, Mycobacterium tuberculosis
ATGDGATAV

SEQ ID NO: 1429053 - protein, 19 aa, Mycobacterium tuberculosis
ATGGGAYAAAEAASVSPLQ

SEQ ID NO: 1429054 - protein, 6 aa, Mycobacterium tuberculosis
ATGGHL

SEQ ID NO: 1429055 - protein, 7 aa, Mycobacterium tuberculosis
ATGGLTP

SEQ ID NO: 1429056 - protein, 7 aa, Mycobacterium tuberculosis
ATGPALG

SEQ ID NO: 1429057 - protein, 6 aa, Mycobacterium tuberculosis
ATHSPR

SEQ ID NO: 1429058 - protein, 8 aa, Mycobacterium tuberculosis
ATISSTKI

SEQ ID NO: 1429059 - protein, 6 aa, Mycobacterium tuberculosis
ATNPTV

SEQ ID NO: 1429060 - protein, 14 aa, Mycobacterium tuberculosis
ATPAGRAALTEDRR

SEQ ID NO: 1429061 - protein, 7 aa, Mycobacterium tuberculosis
ATPGSWR

SEQ ID NO: 1429062 - protein, 5 aa, Mycobacterium tuberculosis
ATPRQ

SEQ ID NO: 1429063 - protein, 7 aa, Mycobacterium tuberculosis
ATPSEPI

SEQ ID NO: 1429064 - protein, 8 aa, Mycobacterium tuberculosis
ATPSNEYR

SEQ ID NO: 1429065 - protein, 6 aa, Mycobacterium tuberculosis
ATQHHP

SEQ ID NO: 1429066 - protein, 9 aa, Mycobacterium tuberculosis
ATQPNYPAE

SEQ ID NO: 1429067 - protein, 14 aa, Mycobacterium tuberculosis
ATQVTSRSLEQNPL

SEQ ID NO: 1429068 - protein, 7 aa, Mycobacterium tuberculosis
ATRAEEG

SEQ ID NO: 1429069 - protein, 8 aa, Mycobacterium tuberculosis
ATRNPRAI

SEQ ID NO: 1429070 - protein, 16 aa, Mycobacterium tuberculosis
ATRPTNDAGQDGGNNS

SEQ ID NO: 1429071 - protein, 7 aa, Mycobacterium tuberculosis
ATSAVRP

SEQ ID NO: 1429072 - protein, 17 aa, Mycobacterium tuberculosis
ATSRDTVRSRSFTGKPA

SEQ ID NO: 1429073 - protein, 7 aa, Mycobacterium tuberculosis
ATSSADQ

SEQ ID NO: 1429074 - protein, 4 aa, Mycobacterium tuberculosis
ATSV

SEQ ID NO: 1429075 - protein, 6 aa, Mycobacterium tuberculosis
ATSVAE

SEQ ID NO: 1429076 - protein, 8 aa, Mycobacterium tuberculosis
ATTGRSYG

SEQ ID NO: 1429077 - protein, 9 aa, Mycobacterium tuberculosis
ATTKRAVEG

SEQ ID NO: 1429078 - protein, 6 aa, Mycobacterium tuberculosis
ATTLDG

SEQ ID NO: 1429079 - protein, 11 aa, Mycobacterium tuberculosis
ATTRAAAGPGP

SEQ ID NO: 1429080 - protein, 5 aa, Mycobacterium tuberculosis
ATTRY

SEQ ID NO: 1429081 - protein, 6 aa, Mycobacterium tuberculosis
ATTSTG

SEQ ID NO: 1429082 - protein, 4 aa, Mycobacterium tuberculosis
ATTY

SEQ ID NO: 1429083 - protein, 7 aa, Mycobacterium tuberculosis
ATVEGRP

SEQ ID NO: 1429084 - protein, 8 aa, Mycobacterium tuberculosis
ATVSPGAT

SEQ ID NO: 1429085 - protein, 11 aa, Mycobacterium tuberculosis
ATYAPAPQRFE

SEQ ID NO: 1429086 - protein, 13 aa, Mycobacterium tuberculosis
AVADRKQLSDKIS

SEQ ID NO: 1429087 - protein, 4 aa, Mycobacterium tuberculosis
AVAG

SEQ ID NO: 1429088 - protein, 6 aa, Mycobacterium tuberculosis
AVAPQD

SEQ ID NO: 1429089 - protein, 16 aa, Mycobacterium tuberculosis
AVDDVPGLARRSEQGQ

SEQ ID NO: 1429090 - protein, 11 aa, Mycobacterium tuberculosis
AVDEDAEAPGA

SEQ ID NO: 1429091 - protein, 5 aa, Mycobacterium tuberculosis
AVDEE

SEQ ID NO: 1429092 - protein, 9 aa, Mycobacterium tuberculosis
AVDPQYGEP

SEQ ID NO: 1429093 - protein, 6 aa, Mycobacterium tuberculosis
AVEAQK

SEQ ID NO: 1429094 - protein, 7 aa, Mycobacterium tuberculosis
AVGDSES

SEQ ID NO: 1429095 - protein, 6 aa, Mycobacterium tuberculosis
AVGGAA

SEQ ID NO: 1429096 - protein, 17 aa, Mycobacterium tuberculosis
AVGGTGPVSAGLGNAAT

SEQ ID NO: 1429097 - protein, 9 aa, Mycobacterium tuberculosis
AVGQAGALD

SEQ ID NO: 1429098 - protein, 7 aa, Mycobacterium tuberculosis
AVKSSLR

SEQ ID NO: 1429099 - protein, 7 aa, Mycobacterium tuberculosis
AVNDNDL

SEQ ID NO: 1429100 - protein, 20 aa, Mycobacterium tuberculosis
AVNQDGASNGLTAPNGPSQQ

SEQ ID NO: 1429101 - protein, 21 aa, Mycobacterium tuberculosis
AVNQDGASSGVTVPNGPAQQA

SEQ ID NO: 1429102 - protein, 5 aa, Mycobacterium tuberculosis
AVPDA

SEQ ID NO: 1429103 - protein, 12 aa, Mycobacterium tuberculosis
AVPDERSHAEPP

SEQ ID NO: 1429104 - protein, 26 aa, Mycobacterium tuberculosis
AVPTAGTPHSKNRVAAATDESVERGS

SEQ ID NO: 1429105 - protein, 4 aa, Mycobacterium tuberculosis
AVQA

SEQ ID NO: 1429106 - protein, 13 aa, Mycobacterium tuberculosis
AVQGRKDAKLQKR

SEQ ID NO: 1429107 - protein, 6 aa, Mycobacterium tuberculosis
AVRDGD

SEQ ID NO: 1429108 - protein, 8 aa, Mycobacterium tuberculosis
AVRGTGSS

SEQ ID NO: 1429109 - protein, 4 aa, Mycobacterium tuberculosis
AVRK

SEQ ID NO: 1429110 - protein, 8 aa, Mycobacterium tuberculosis
AVSGRNYE

SEQ ID NO: 1429111 - protein, 5 aa, Mycobacterium tuberculosis
AVTGG

SEQ ID NO: 1429112 - protein, 21 aa, Mycobacterium tuberculosis
AVYEPSPRALPTDTATQRPAP

SEQ ID NO: 1429113 - protein, 15 aa, Mycobacterium tuberculosis
AWSGPSSTSMASAAA

SEQ ID NO: 1429114 - protein, 7 aa, Mycobacterium tuberculosis
AYDERRE

SEQ ID NO: 1429115 - protein, 8 aa, Mycobacterium tuberculosis
AYERRSGE

SEQ ID NO: 1429116 - protein, 4 aa, Mycobacterium tuberculosis
AYGE

SEQ ID NO: 1429117 - protein, 10 aa, Mycobacterium tuberculosis
AYGRDGENCR

SEQ ID NO: 1429118 - protein, 6 aa, Mycobacterium tuberculosis
AYPDDE

SEQ ID NO: 1429119 - protein, 10 aa, Mycobacterium tuberculosis
AYPGTPPPMP

SEQ ID NO: 1429120 - protein, 5 aa, Mycobacterium tuberculosis
AYRGE

SEQ ID NO: 1429121 - protein, 13 aa, Mycobacterium tuberculosis
AYSQAASGRLPDP

SEQ ID NO: 1429122 - protein, 6 aa, Mycobacterium tuberculosis
AYTGGG

SEQ ID NO: 1429123 - protein, 13 aa, Mycobacterium tuberculosis
AYTGGPDPLAPPV

SEQ ID NO: 1429124 - protein, 6 aa, Mycobacterium tuberculosis
CATKYG

SEQ ID NO: 1429125 - protein, 12 aa, Mycobacterium tuberculosis
CGGDTGDDDRPK

SEQ ID NO: 1429126 - protein, 14 aa, Mycobacterium tuberculosis
CGGGDRRRPVGSGI

SEQ ID NO: 1429127 - protein, 6 aa, Mycobacterium tuberculosis
CGGSAR

SEQ ID NO: 1429128 - protein, 5 aa, Mycobacterium tuberculosis
CGRPR

SEQ ID NO: 1429129 - protein, 4 aa, Mycobacterium tuberculosis
CGRT

SEQ ID NO: 1429130 - protein, 11 aa, Mycobacterium tuberculosis
CGTPDADAFDR

SEQ ID NO: 1429131 - protein, 7 aa, Mycobacterium tuberculosis
CGTSTGE

SEQ ID NO: 1429132 - protein, 7 aa, Mycobacterium tuberculosis
CIPAPPG

SEQ ID NO: 1429133 - protein, 8 aa, Mycobacterium tuberculosis
CIPAPPGY

SEQ ID NO: 1429134 - protein, 4 aa, Mycobacterium tuberculosis
CPAP

SEQ ID NO: 1429135 - protein, 5 aa, Mycobacterium tuberculosis
CPLND

SEQ ID NO: 1429136 - protein, 8 aa, Mycobacterium tuberculosis
CPPAGTGT

SEQ ID NO: 1429137 - protein, 6 aa, Mycobacterium tuberculosis
CPSGEV

SEQ ID NO: 1429138 - protein, 18 aa, Mycobacterium tuberculosis
CPSGTDPSTHPSSDEVTE

SEQ ID NO: 1429139 - protein, 7 aa, Mycobacterium tuberculosis
CQNPPQL

SEQ ID NO: 1429140 - protein, 4 aa, Mycobacterium tuberculosis
CRPR

SEQ ID NO: 1429141 - protein, 7 aa, Mycobacterium tuberculosis
CSGPGCP

SEQ ID NO: 1429142 - protein, 17 aa, Mycobacterium tuberculosis
CSVTTRPGNAAVDYGGA

SEQ ID NO: 1429143 - protein, 7 aa, Mycobacterium tuberculosis
CTPSAEA

SEQ ID NO: 1429144 - protein, 4 aa, Mycobacterium tuberculosis
CTTG

SEQ ID NO: 1429145 - protein, 4 aa, Mycobacterium tuberculosis
DAAA

SEQ ID NO: 1429146 - protein, 13 aa, Mycobacterium tuberculosis
DAAADPDVAGDAF

SEQ ID NO: 1429147 - protein, 5 aa, Mycobacterium tuberculosis
DAAAI

SEQ ID NO: 1429148 - protein, 6 aa, Mycobacterium tuberculosis
DAAALG

SEQ ID NO: 1429149 - protein, 7 aa, Mycobacterium tuberculosis
DAAATFR

SEQ ID NO: 1429150 - protein, 5 aa, Mycobacterium tuberculosis
DAADC

SEQ ID NO: 1429151 - protein, 8 aa, Mycobacterium tuberculosis
DAADLGEQ

SEQ ID NO: 1429152 - protein, 4 aa, Mycobacterium tuberculosis
DAAQ

SEQ ID NO: 1429153 - protein, 26 aa, Mycobacterium tuberculosis
DADGDVPRSRKRGAYQPPGRERVGSS

SEQ ID NO: 1429154 - protein, 9 aa, Mycobacterium tuberculosis
DADVPGPLT

SEQ ID NO: 1429155 - protein, 11 aa, Mycobacterium tuberculosis
DAELRAKTDEF

SEQ ID NO: 1429156 - protein, 6 aa, Mycobacterium tuberculosis
DAFGGT

SEQ ID NO: 1429157 - protein, 7 aa, Mycobacterium tuberculosis
DAGAATV

SEQ ID NO: 1429158 - protein, 6 aa, Mycobacterium tuberculosis
DAGRCQ

SEQ ID NO: 1429159 - protein, 4 aa, Mycobacterium tuberculosis
DAHD

SEQ ID NO: 1429160 - protein, 7 aa, Mycobacterium tuberculosis
DAHRRPK

SEQ ID NO: 1429161 - protein, 7 aa, Mycobacterium tuberculosis
DAIGTST

SEQ ID NO: 1429162 - protein, 5 aa, Mycobacterium tuberculosis
DANGA

SEQ ID NO: 1429163 - protein, 4 aa, Mycobacterium tuberculosis
DAPD

SEQ ID NO: 1429164 - protein, 6 aa, Mycobacterium tuberculosis
DAPDKE

SEQ ID NO: 1429165 - protein, 5 aa, Mycobacterium tuberculosis
DAPKL

SEQ ID NO: 1429166 - protein, 10 aa, Mycobacterium tuberculosis
DAPKSDPADV

SEQ ID NO: 1429167 - protein, 8 aa, Mycobacterium tuberculosis
DAPLPPQT

SEQ ID NO: 1429168 - protein, 6 aa, Mycobacterium tuberculosis
DAQRRA

SEQ ID NO: 1429169 - protein, 9 aa, Mycobacterium tuberculosis
DARAAGLNR

SEQ ID NO: 1429170 - protein, 8 aa, Mycobacterium tuberculosis
DARANAEQ

SEQ ID NO: 1429171 - protein, 4 aa, Mycobacterium tuberculosis
DASD

SEQ ID NO: 1429172 - protein, 5 aa, Mycobacterium tuberculosis
DASPN

SEQ ID NO: 1429173 - protein, 6 aa, Mycobacterium tuberculosis
DASSTD

SEQ ID NO: 1429174 - protein, 8 aa, Mycobacterium tuberculosis
DASTDATP

SEQ ID NO: 1429175 - protein, 7 aa, Mycobacterium tuberculosis
DATDRAR

SEQ ID NO: 1429176 - protein, 5 aa, Mycobacterium tuberculosis
DCDAS

SEQ ID NO: 1429177 - protein, 6 aa, Mycobacterium tuberculosis
DDADAE

SEQ ID NO: 1429178 - protein, 13 aa, Mycobacterium tuberculosis
DDADAQAHPDRLE

SEQ ID NO: 1429179 - protein, 16 aa, Mycobacterium tuberculosis
DDAGLDPNAAAGPDAV

SEQ ID NO: 1429180 - protein, 8 aa, Mycobacterium tuberculosis
DDAPPPRL

SEQ ID NO: 1429181 - protein, 17 aa, Mycobacterium tuberculosis
DDAWDAPSPSALPAAQR

SEQ ID NO: 1429182 - protein, 12 aa, Mycobacterium tuberculosis
DDCPAPDDESDP

SEQ ID NO: 1429183 - protein, 4 aa, Mycobacterium tuberculosis
DDDD

SEQ ID NO: 1429184 - protein, 11 aa, Mycobacterium tuberculosis
DDDRRPQDRSD

SEQ ID NO: 1429185 - protein, 4 aa, Mycobacterium tuberculosis
DDDT

SEQ ID NO: 1429186 - protein, 12 aa, Mycobacterium tuberculosis
DDDTASRINPDL

SEQ ID NO: 1429187 - protein, 5 aa, Mycobacterium tuberculosis
DDEDL

SEQ ID NO: 1429188 - protein, 7 aa, Mycobacterium tuberculosis
DDEEADH

SEQ ID NO: 1429189 - protein, 5 aa, Mycobacterium tuberculosis
DDGEV

SEQ ID NO: 1429190 - protein, 12 aa, Mycobacterium tuberculosis
DDGLAGVIDKIF

SEQ ID NO: 1429191 - protein, 6 aa, Mycobacterium tuberculosis
DDGQAY

SEQ ID NO: 1429192 - protein, 7 aa, Mycobacterium tuberculosis
DDGTEIR

SEQ ID NO: 1429193 - protein, 8 aa, Mycobacterium tuberculosis
DDHSRTFN

SEQ ID NO: 1429194 - protein, 4 aa, Mycobacterium tuberculosis
DDIP

SEQ ID NO: 1429195 - protein, 6 aa, Mycobacterium tuberculosis
DDKTDP

SEQ ID NO: 1429196 - protein, 10 aa, Mycobacterium tuberculosis
DDLDDADDLA

SEQ ID NO: 1429197 - protein, 7 aa, Mycobacterium tuberculosis
DDNDLRN

SEQ ID NO: 1429198 - protein, 8 aa, Mycobacterium tuberculosis
DDNSPTFN

SEQ ID NO: 1429199 - protein, 8 aa, Mycobacterium tuberculosis
DDPADAEV

SEQ ID NO: 1429200 - protein, 6 aa, Mycobacterium tuberculosis
DDPALT

SEQ ID NO: 1429201 - protein, 8 aa, Mycobacterium tuberculosis
DDPGSSAR

SEQ ID NO: 1429202 - protein, 9 aa, Mycobacterium tuberculosis
DDPTTHDDV

SEQ ID NO: 1429203 - protein, 5 aa, Mycobacterium tuberculosis
DDPVA

SEQ ID NO: 1429204 - protein, 4 aa, Mycobacterium tuberculosis
DDQA

SEQ ID NO: 1429205 - protein, 13 aa, Mycobacterium tuberculosis
DDRAPTGLPDPGI

SEQ ID NO: 1429206 - protein, 6 aa, Mycobacterium tuberculosis
DDSGRI

SEQ ID NO: 1429207 - protein, 9 aa, Mycobacterium tuberculosis
DDSVQPEQA

SEQ ID NO: 1429208 - protein, 11 aa, Mycobacterium tuberculosis
DDTASRINPDL

SEQ ID NO: 1429209 - protein, 5 aa, Mycobacterium tuberculosis
DDTGE

SEQ ID NO: 1429210 - protein, 7 aa, Mycobacterium tuberculosis
DDTSTVP

SEQ ID NO: 1429211 - protein, 7 aa, Mycobacterium tuberculosis
DEAAATL

SEQ ID NO: 1429212 - protein, 7 aa, Mycobacterium tuberculosis
DEAETGV

SEQ ID NO: 1429213 - protein, 5 aa, Mycobacterium tuberculosis
DEAGG

SEQ ID NO: 1429214 - protein, 6 aa, Mycobacterium tuberculosis
DEANAA

SEQ ID NO: 1429215 - protein, 5 aa, Mycobacterium tuberculosis
DEANK

SEQ ID NO: 1429216 - protein, 13 aa, Mycobacterium tuberculosis
DEDGDGSGPGELT

SEQ ID NO: 1429217 - protein, 5 aa, Mycobacterium tuberculosis
DEDSV

SEQ ID NO: 1429218 - protein, 28 aa, Mycobacterium tuberculosis
DEEERRLTSAGDDAERSDEEERRLTSAE

SEQ ID NO: 1429219 - protein, 62 aa, Mycobacterium tuberculosis
DEEERRLTSAGDDAERSDEEERRLTSAGDDAERSDEEERRLTSAGDDAERSDEEERRLTSAE

SEQ ID NO: 1429220 - protein, 79 aa, Mycobacterium tuberculosis; identical to SEQ ID NO: 171253

SEQ ID NO: 1429221 - protein, 5 aa, Mycobacterium tuberculosis
DEEKA

SEQ ID NO: 1429222 - protein, 6 aa, Mycobacterium tuberculosis
DEGVAQ

SEQ ID NO: 1429223 - protein, 9 aa, Mycobacterium tuberculosis
DEKPTASDN

SEQ ID NO: 1429224 - protein, 4 aa, Mycobacterium tuberculosis
DELE

SEQ ID NO: 1429225 - protein, 4 aa, Mycobacterium tuberculosis
DELT

SEQ ID NO: 1429226 - protein, 5 aa, Mycobacterium tuberculosis
DELTE

SEQ ID NO: 1429227 - protein, 7 aa, Mycobacterium tuberculosis
DEQDREL

SEQ ID NO: 1429228 - protein, 7 aa, Mycobacterium tuberculosis
DEQTHQP

SEQ ID NO: 1429229 - protein, 10 aa, Mycobacterium tuberculosis
DEQTQGNYSD

SEQ ID NO: 1429230 - protein, 4 aa, Mycobacterium tuberculosis
DERA

SEQ ID NO: 1429231 - protein, 64 aa, Mycobacterium tuberculosis; identical to SEQ ID NO: 171325

SEQ ID NO: 1429232 - protein, 4 aa, Mycobacterium tuberculosis
DERT

SEQ ID NO: 1429233 - protein, 4 aa, Mycobacterium tuberculosis
DESF

SEQ ID NO: 1429234 - protein, 7 aa, Mycobacterium tuberculosis
DESQTGA

SEQ ID NO: 1429235 - protein, 16 aa, Mycobacterium tuberculosis
DETTIVEGAGDTDAIA

SEQ ID NO: 1429236 - protein, 6 aa, Mycobacterium tuberculosis
DEVTVE

SEQ ID NO: 1429237 - protein, 11 aa, Mycobacterium tuberculosis
DFGRGSGHPAG

SEQ ID NO: 1429238 - protein, 8 aa, Mycobacterium tuberculosis
DFTADGTI

SEQ ID NO: 1429239 - protein, 5 aa, Mycobacterium tuberculosis
DFTPS

SEQ ID NO: 1429240 - protein, 8 aa, Mycobacterium tuberculosis
DGAAEDEL

SEQ ID NO: 1429241 - protein, 7 aa, Mycobacterium tuberculosis
DGAARRT

SEQ ID NO: 1429242 - protein, 5 aa, Mycobacterium tuberculosis
DGADI

SEQ ID NO: 1429243 - protein, 8 aa, Mycobacterium tuberculosis
DGAGDAGF

SEQ ID NO: 1429244 - protein, 16 aa, Mycobacterium tuberculosis
DGANATTPGGAGGDGG

SEQ ID NO: 1429245 - protein, 10 aa, Mycobacterium tuberculosis
DGAPQRPAKP

SEQ ID NO: 1429246 - protein, 9 aa, Mycobacterium tuberculosis
DGAQATAPL

SEQ ID NO: 1429247 - protein, 7 aa, Mycobacterium tuberculosis
DGARPHR

SEQ ID NO: 1429248 - protein, 7 aa, Mycobacterium tuberculosis
DGASYQR

SEQ ID NO: 1429249 - protein, 10 aa, Mycobacterium tuberculosis
DGAYGEAKSA

SEQ ID NO: 1429250 - protein, 17 aa, Mycobacterium tuberculosis
DGCDAEAGSGPPFFHVK

SEQ ID NO: 1429251 - protein, 7 aa, Mycobacterium tuberculosis
DGDAARD

SEQ ID NO: 1429252 - protein, 4 aa, Mycobacterium tuberculosis
DGDE

SEQ ID NO: 1429253 - protein, 6 aa, Mycobacterium tuberculosis
DGDGTQ

SEQ ID NO: 1429254 - protein, 8 aa, Mycobacterium tuberculosis
DGDREGEA

SEQ ID NO: 1429255 - protein, 16 aa, Mycobacterium tuberculosis
DGDTLTVTPPSWRPDL

SEQ ID NO: 1429256 - protein, 8 aa, Mycobacterium tuberculosis
DGEALARQ

SEQ ID NO: 1429257 - protein, 4 aa, Mycobacterium tuberculosis
DGEF

SEQ ID NO: 1429258 - protein, 8 aa, Mycobacterium tuberculosis
DGEGPGHQ

SEQ ID NO: 1429259 - protein, 10 aa, Mycobacterium tuberculosis
DGELAPETKI

SEQ ID NO: 1429260 - protein, 6 aa, Mycobacterium tuberculosis
DGFGTV

SEQ ID NO: 1429261 - protein, 30 aa, Mycobacterium tuberculosis; identical to SEQ ID NO: 171462

SEQ ID NO: 1429262 - protein, 14 aa, Mycobacterium tuberculosis
DGGAQPSRVGGRTI

SEQ ID NO: 1429263 - protein, 17 aa, Mycobacterium tuberculosis
DGGATVDGTSGAMAGPG

SEQ ID NO: 1429264 - protein, 8 aa, Mycobacterium tuberculosis
DGGHDPRR

SEQ ID NO: 1429265 - protein, 7 aa, Mycobacterium tuberculosis
DGGLTRP

SEQ ID NO: 1429266 - protein, 4 aa, Mycobacterium tuberculosis
DGGR

SEQ ID NO: 1429267 - protein, 5 aa, Mycobacterium tuberculosis
DGGRG

SEQ ID NO: 1429268 - protein, 4 aa, Mycobacterium tuberculosis
DGGT

SEQ ID NO: 1429269 - protein, 8 aa, Mycobacterium tuberculosis
DGGTESVT

SEQ ID NO: 1429270 - protein, 5 aa, Mycobacterium tuberculosis
DGHDQ

SEQ ID NO: 1429271 - protein, 18 aa, Mycobacterium tuberculosis
DGHRGRRRAARAGSAPAH

SEQ ID NO: 1429272 - protein, 5 aa, Mycobacterium tuberculosis
DGIQA

SEQ ID NO: 1429273 - protein, 5 aa, Mycobacterium tuberculosis
DGKPV

SEQ ID NO: 1429274 - protein, 20 aa, Mycobacterium tuberculosis
DGKRTTRTPAESDTERIEEA

SEQ ID NO: 1429275 - protein, 6 aa, Mycobacterium tuberculosis
DGKTER

SEQ ID NO: 1429276 - protein, 10 aa, Mycobacterium tuberculosis
DGNAAASYTK

SEQ ID NO: 1429277 - protein, 16 aa, Mycobacterium tuberculosis
DGPDPECVQGHSEPAL

SEQ ID NO: 1429278 - protein, 7 aa, Mycobacterium tuberculosis
DGPMPQT

SEQ ID NO: 1429279 - protein, 4 aa, Mycobacterium tuberculosis
DGPQ

SEQ ID NO: 1429280 - protein, 5 aa, Mycobacterium tuberculosis
DGPQH

SEQ ID NO: 1429281 - protein, 5 aa, Mycobacterium tuberculosis
DGPVR

SEQ ID NO: 1429282 - protein, 4 aa, Mycobacterium tuberculosis
DGQA

SEQ ID NO: 1429283 - protein, 9 aa, Mycobacterium tuberculosis
DGQEQRAQG

SEQ ID NO: 1429284 - protein, 7 aa, Mycobacterium tuberculosis
DGQPRTL

SEQ ID NO: 1429285 - protein, 8 aa, Mycobacterium tuberculosis
DGQQRGSG

SEQ ID NO: 1429286 - protein, 5 aa, Mycobacterium tuberculosis
DGRPH

SEQ ID NO: 1429287 - protein, 7 aa, Mycobacterium tuberculosis
DGRRDVA

SEQ ID NO: 1429288 - protein, 12 aa, Mycobacterium tuberculosis
DGSARATGSATI

SEQ ID NO: 1429289 - protein, 10 aa, Mycobacterium tuberculosis
DGSGPQGTDV

SEQ ID NO: 1429290 - protein, 6 aa, Mycobacterium tuberculosis
DGSPAQ

SEQ ID NO: 1429291 - protein, 7 aa, Mycobacterium tuberculosis
DGSQDAG

SEQ ID NO: 1429292 - protein, 11 aa, Mycobacterium tuberculosis
DGTESALQHGS

SEQ ID NO: 1429293 - protein, 11 aa, Mycobacterium tuberculosis
DGTPDKSRLGG

SEQ ID NO: 1429294 - protein, 8 aa, Mycobacterium tuberculosis
DGVTPPGQ

SEQ ID NO: 1429295 - protein, 5 aa, Mycobacterium tuberculosis
DGWQT

SEQ ID NO: 1429296 - protein, 11 aa, Mycobacterium tuberculosis
DGYGQNVKSGR

SEQ ID NO: 1429297 - protein, 10 aa, Mycobacterium tuberculosis
DHADPETKRI

SEQ ID NO: 1429298 - protein, 6 aa, Mycobacterium tuberculosis
DHDRLG

SEQ ID NO: 1429299 - protein, 14 aa, Mycobacterium tuberculosis
DHGDPLPPHTEGAQ

SEQ ID NO: 1429300 - protein, 6 aa, Mycobacterium tuberculosis
DHGPQP

SEQ ID NO: 1429301 - protein, 9 aa, Mycobacterium tuberculosis
DHQTFSSAQ

SEQ ID NO: 1429302 - protein, 10 aa, Mycobacterium tuberculosis
DHSGDRPNYS

SEQ ID NO: 1429303 - protein, 10 aa, Mycobacterium tuberculosis
DHTNPDTPRR

SEQ ID NO: 1429304 - protein, 5 aa, Mycobacterium tuberculosis
DIDRA

SEQ ID NO: 1429305 - protein, 6 aa, Mycobacterium tuberculosis
DIRDAQ

SEQ ID NO: 1429306 - protein, 4 aa, Mycobacterium tuberculosis
DIRN

SEQ ID NO: 1429307 - protein, 6 aa, Mycobacterium tuberculosis
DIRPER

SEQ ID NO: 1429308 - protein, 10 aa, Mycobacterium tuberculosis
DITGADAKRL

SEQ ID NO: 1429309 - protein, 4 aa, Mycobacterium tuberculosis
DITR

SEQ ID NO: 1429310 - protein, 6 aa, Mycobacterium tuberculosis
DKAALE

SEQ ID NO: 1429311 - protein, 11 aa, Mycobacterium tuberculosis
DKAETKARYGE

SEQ ID NO: 1429312 - protein, 5 aa, Mycobacterium tuberculosis
DKDMT

SEQ ID NO: 1429313 - protein, 6 aa, Mycobacterium tuberculosis
DKLAKE

SEQ ID NO: 1429314 - protein, 7 aa, Mycobacterium tuberculosis
DKPATPW

SEQ ID NO: 1429315 - protein, 9 aa, Mycobacterium tuberculosis
DKPDDSIND

SEQ ID NO: 1429316 - protein, 7 aa, Mycobacterium tuberculosis
DKSGDAE

SEQ ID NO: 1429317 - protein, 10 aa, Mycobacterium tuberculosis
DKVDTEIPSP

SEQ ID NO: 1429318 - protein, 5 aa, Mycobacterium tuberculosis
DKVSV

SEQ ID NO: 1429319 - protein, 4 aa, Mycobacterium tuberculosis
DLAT

SEQ ID NO: 1429320 - protein, 5 aa, Mycobacterium tuberculosis
DLATA

SEQ ID NO: 1429321 - protein, 13 aa, Mycobacterium tuberculosis
DLDAKAADPAHES

SEQ ID NO: 1429322 - protein, 10 aa, Mycobacterium tuberculosis
DLDPGEARRA

SEQ ID NO: 1429323 - protein, 13 aa, Mycobacterium tuberculosis
DLDPSNSGNYRAN

SEQ ID NO: 1429324 - protein, 4 aa, Mycobacterium tuberculosis
DLDS

SEQ ID NO: 1429325 - protein, 9 aa, Mycobacterium tuberculosis
DLEQRDVEE

SEQ ID NO: 1429326 - protein, 8 aa, Mycobacterium tuberculosis
DLESASPQ

SEQ ID NO: 1429327 - protein, 14 aa, Mycobacterium tuberculosis
DLGPGTSTSAASRA

SEQ ID NO: 1429328 - protein, 5 aa, Mycobacterium tuberculosis
DLLPS

SEQ ID NO: 1429329 - protein, 7 aa, Mycobacterium tuberculosis
DLPAEAH

SEQ ID NO: 1429330 - protein, 9 aa, Mycobacterium tuberculosis
DLPAGSLDG

SEQ ID NO: 1429331 - protein, 6 aa, Mycobacterium tuberculosis
DLPAKA

SEQ ID NO: 1429332 - protein, 5 aa, Mycobacterium tuberculosis
DLPKL

SEQ ID NO: 1429333 - protein, 20 aa, Mycobacterium tuberculosis
DLPNTDPTRVGTHLSPPDRY

SEQ ID NO: 1429334 - protein, 5 aa, Mycobacterium tuberculosis
DLPPS

SEQ ID NO: 1429335 - protein, 10 aa, Mycobacterium tuberculosis
DLRGRSPDVS

SEQ ID NO: 1429336 - protein, 10 aa, Mycobacterium tuberculosis
DLSPKARDLG

SEQ ID NO: 1429337 - protein, 6 aa, Mycobacterium tuberculosis
DLSTPI

SEQ ID NO: 1429338 - protein, 5 aa, Mycobacterium tuberculosis
DLTDA

SEQ ID NO: 1429339 - protein, 18 aa, Mycobacterium tuberculosis
DMPGSGLSADGKAEAQQV

SEQ ID NO: 1429340 - protein, 10 aa, Mycobacterium tuberculosis
DNDSARRTPD

SEQ ID NO: 1429341 - protein, 9 aa, Mycobacterium tuberculosis
DNEDQNDLM

SEQ ID NO: 1429342 - protein, 12 aa, Mycobacterium tuberculosis
DNEVPGATDRDR

SEQ ID NO: 1429343 - protein, 16 aa, Mycobacterium tuberculosis
DNGASGEGGPNGSVNE

SEQ ID NO: 1429344 - protein, 7 aa, Mycobacterium tuberculosis
DNLPAER

SEQ ID NO: 1429345 - protein, 7 aa, Mycobacterium tuberculosis
DNPARYR

SEQ ID NO: 1429346 - protein, 5 aa, Mycobacterium tuberculosis
DNPQQ

SEQ ID NO: 1429347 - protein, 7 aa, Mycobacterium tuberculosis
DNPSAND

SEQ ID NO: 1429348 - protein, 10 aa, Mycobacterium tuberculosis
DNQSRRQTSF

SEQ ID NO: 1429349 - protein, 6 aa, Mycobacterium tuberculosis
DNRPQR

SEQ ID NO: 1429350 - protein, 6 aa, Mycobacterium tuberculosis
DNRRHH

SEQ ID NO: 1429351 - protein, 13 aa, Mycobacterium tuberculosis
DNSRRGRTDTPHT

SEQ ID NO: 1429352 - protein, 5 aa, Mycobacterium tuberculosis
DNTYP

SEQ ID NO: 1429353 - protein, 10 aa, Mycobacterium tuberculosis
DPAEIGKNRH

SEQ ID NO: 1429354 - protein, 6 aa, Mycobacterium tuberculosis
DPAELP

SEQ ID NO: 1429355 - protein, 8 aa, Mycobacterium tuberculosis
DPALREHP

SEQ ID NO: 1429356 - protein, 7 aa, Mycobacterium tuberculosis
DPATGLA

SEQ ID NO: 1429357 - protein, 8 aa, Mycobacterium tuberculosis
DPDADYSQ

SEQ ID NO: 1429358 - protein, 8 aa, Mycobacterium tuberculosis
DPDDPRLD

SEQ ID NO: 1429359 - protein, 7 aa, Mycobacterium tuberculosis
DPDEPWG

SEQ ID NO: 1429360 - protein, 6 aa, Mycobacterium tuberculosis
DPDTTY

SEQ ID NO: 1429361 - protein, 13 aa, Mycobacterium tuberculosis
DPEGQLGSASRAR

SEQ ID NO: 1429362 - protein, 15 aa, Mycobacterium tuberculosis
DPEKAAQIREEDDAM

SEQ ID NO: 1429363 - protein, 4 aa, Mycobacterium tuberculosis
DPET

SEQ ID NO: 1429364 - protein, 6 aa, Mycobacterium tuberculosis
DPETAR

SEQ ID NO: 1429365 - protein, 12 aa, Mycobacterium tuberculosis
DPGEGTQAKRRA

SEQ ID NO: 1429366 - protein, 6 aa, Mycobacterium tuberculosis
DPGIAD

SEQ ID NO: 1429367 - protein, 15 aa, Mycobacterium tuberculosis
DPGNNDTPTPLHPNC

SEQ ID NO: 1429368 - protein, 10 aa, Mycobacterium tuberculosis
DPGQAPKPGV

SEQ ID NO: 1429369 - protein, 9 aa, Mycobacterium tuberculosis
DPGSRATEM

SEQ ID NO: 1429370 - protein, 8 aa, Mycobacterium tuberculosis
DPGTGPGH

SEQ ID NO: 1429371 - protein, 13 aa, Mycobacterium tuberculosis
DPHAPPNPVVRRA

SEQ ID NO: 1429372 - protein, 6 aa, Mycobacterium tuberculosis
DPHNSE

SEQ ID NO: 1429373 - protein, 9 aa, Mycobacterium tuberculosis
DPHNTDRRF

SEQ ID NO: 1429374 - protein, 6 aa, Mycobacterium tuberculosis
DPLRDD

SEQ ID NO: 1429375 - protein, 7 aa, Mycobacterium tuberculosis
DPLTRDG

SEQ ID NO: 1429376 - protein, 5 aa, Mycobacterium tuberculosis
DPNQQ

SEQ ID NO: 1429377 - protein, 7 aa, Mycobacterium tuberculosis
DPQPGTG

SEQ ID NO: 1429378 - protein, 5 aa, Mycobacterium tuberculosis
DPQRL

SEQ ID NO: 1429379 - protein, 4 aa, Mycobacterium tuberculosis
DPRL

SEQ ID NO: 1429380 - protein, 12 aa, Mycobacterium tuberculosis
DPRLGDGGRGYR

SEQ ID NO: 1429381 - protein, 5 aa, Mycobacterium tuberculosis
DPRLP

SEQ ID NO: 1429382 - protein, 9 aa, Mycobacterium tuberculosis
DPRQGPGAL

SEQ ID NO: 1429383 - protein, 11 aa, Mycobacterium tuberculosis
DPSSTRTGGSI

SEQ ID NO: 1429384 - protein, 5 aa, Mycobacterium tuberculosis
DPSVP

SEQ ID NO: 1429385 - protein, 4 aa, Mycobacterium tuberculosis
DPTD

SEQ ID NO: 1429386 - protein, 5 aa, Mycobacterium tuberculosis
DPTDH

SEQ ID NO: 1429387 - protein, 4 aa, Mycobacterium tuberculosis
DPTI

SEQ ID NO: 1429388 - protein, 7 aa, Mycobacterium tuberculosis
DPTNLDA

SEQ ID NO: 1429389 - protein, 16 aa, Mycobacterium tuberculosis
DPTSGTITVDGTDVST

SEQ ID NO: 1429390 - protein, 4 aa, Mycobacterium tuberculosis
DPTV

SEQ ID NO: 1429391 - protein, 5 aa, Mycobacterium tuberculosis
DPTVA

SEQ ID NO: 1429392 - protein, 4 aa, Mycobacterium tuberculosis
DPVD

SEQ ID NO: 1429393 - protein, 7 aa, Mycobacterium tuberculosis
DPVDPVD

SEQ ID NO: 1429394 - protein, 5 aa, Mycobacterium tuberculosis
DPVPD

SEQ ID NO: 1429395 - protein, 4 aa, Mycobacterium tuberculosis
DPYP

SEQ ID NO: 1429396 - protein, 12 aa, Mycobacterium tuberculosis
DQARAAAAGDDE

SEQ ID NO: 1429397 - protein, 5 aa, Mycobacterium tuberculosis
DQGNV

SEQ ID NO: 1429398 - protein, 11 aa, Mycobacterium tuberculosis
DQLRAKAPAGI

SEQ ID NO: 1429399 - protein, 10 aa, Mycobacterium tuberculosis
DQPAKGFASH

SEQ ID NO: 1429400 - protein, 13 aa, Mycobacterium tuberculosis
DQPDTPIEDEREG

SEQ ID NO: 1429401 - protein, 9 aa, Mycobacterium tuberculosis
DQPPMPSRG

SEQ ID NO: 1429402 - protein, 5 aa, Mycobacterium tuberculosis
DQQPA

SEQ ID NO: 1429403 - protein, 8 aa, Mycobacterium tuberculosis
DQRGDGRS

SEQ ID NO: 1429404 - protein, 8 aa, Mycobacterium tuberculosis
DQSTVEPA

SEQ ID NO: 1429405 - protein, 9 aa, Mycobacterium tuberculosis
DQTDQTELG

SEQ ID NO: 1429406 - protein, 13 aa, Mycobacterium tuberculosis
DQVESTAGSLQGQ

SEQ ID NO: 1429407 - protein, 13 aa, Mycobacterium tuberculosis
DQVSATELAGEPI

SEQ ID NO: 1429408 - protein, 7 aa, Mycobacterium tuberculosis
DRAASYR

SEQ ID NO: 1429409 - protein, 7 aa, Mycobacterium tuberculosis
DRAEALA

SEQ ID NO: 1429410 - protein, 9 aa, Mycobacterium tuberculosis
DRAKPAVPF

SEQ ID NO: 1429411 - protein, 6 aa, Mycobacterium tuberculosis
DRALGD

SEQ ID NO: 1429412 - protein, 8 aa, Mycobacterium tuberculosis
DRARKQGT

SEQ ID NO: 1429413 - protein, 10 aa, Mycobacterium tuberculosis
DRCGGPGLAG

SEQ ID NO: 1429414 - protein, 4 aa, Mycobacterium tuberculosis
DRDG

SEQ ID NO: 1429415 - protein, 6 aa, Mycobacterium tuberculosis
DRDGRE

SEQ ID NO: 1429416 - protein, 9 aa, Mycobacterium tuberculosis
DRDSLEPIS

SEQ ID NO: 1429417 - protein, 5 aa, Mycobacterium tuberculosis
DRDVE

SEQ ID NO: 1429418 - protein, 4 aa, Mycobacterium tuberculosis
DRDY

SEQ ID NO: 1429419 - protein, 4 aa, Mycobacterium tuberculosis
DREG

SEQ ID NO: 1429420 - protein, 9 aa, Mycobacterium tuberculosis
DREKHGALR

SEQ ID NO: 1429421 - protein, 4 aa, Mycobacterium tuberculosis
DRET

SEQ ID NO: 1429422 - protein, 12 aa, Mycobacterium tuberculosis
DRFRPDPAARAE

SEQ ID NO: 1429423 - protein, 4 aa, Mycobacterium tuberculosis
DRFT

SEQ ID NO: 1429424 - protein, 7 aa, Mycobacterium tuberculosis
DRGDRSV

SEQ ID NO: 1429425 - protein, 4 aa, Mycobacterium tuberculosis
DRGM

SEQ ID NO: 1429426 - protein, 14 aa, Mycobacterium tuberculosis
DRHEAAGTTHSAEY

SEQ ID NO: 1429427 - protein, 9 aa, Mycobacterium tuberculosis
DRITKDGGL

SEQ ID NO: 1429428 - protein, 7 aa, Mycobacterium tuberculosis
DRKAQDA

SEQ ID NO: 1429429 - protein, 40 aa, Mycobacterium tuberculosis; identical to SEQ ID NO: 172322

SEQ ID NO: 1429430 - protein, 11 aa, Mycobacterium tuberculosis
DRKTDRAADSL

SEQ ID NO: 1429431 - protein, 6 aa, Mycobacterium tuberculosis
DRNDAF

SEQ ID NO: 1429432 - protein, 6 aa, Mycobacterium tuberculosis
DRPALG

SEQ ID NO: 1429433 - protein, 7 aa, Mycobacterium tuberculosis
DRPDQPL

SEQ ID NO: 1429434 - protein, 5 aa, Mycobacterium tuberculosis
DRPVQ

SEQ ID NO: 1429435 - protein, 15 aa, Mycobacterium tuberculosis
DRPVRTSRGWSASPV

SEQ ID NO: 1429436 - protein, 7 aa, Mycobacterium tuberculosis
DRQEVDN

SEQ ID NO: 1429437 - protein, 6 aa, Mycobacterium tuberculosis
DRQPRR

SEQ ID NO: 1429438 - protein, 15 aa, Mycobacterium tuberculosis
DRRAEQVRAGGPDIL

SEQ ID NO: 1429439 - protein, 8 aa, Mycobacterium tuberculosis
DRRARKGE

SEQ ID NO: 1429440 - protein, 13 aa, Mycobacterium tuberculosis
DRRGPGGDSRPSL

SEQ ID NO: 1429441 - protein, 6 aa, Mycobacterium tuberculosis
DRVEAG

SEQ ID NO: 1429442 - protein, 9 aa, Mycobacterium tuberculosis
DSAADATEL

SEQ ID NO: 1429443 - protein, 7 aa, Mycobacterium tuberculosis
DSAAGNF

SEQ ID NO: 1429444 - protein, 8 aa, Mycobacterium tuberculosis
DSAIEARR

SEQ ID NO: 1429445 - protein, 9 aa, Mycobacterium tuberculosis
DSELPDGSV

SEQ ID NO: 1429446 - protein, 7 aa, Mycobacterium tuberculosis
DSELPTD

SEQ ID NO: 1429447 - protein, 10 aa, Mycobacterium tuberculosis
DSEQPELDPA

SEQ ID NO: 1429448 - protein, 5 aa, Mycobacterium tuberculosis
DSFGE

SEQ ID NO: 1429449 - protein, 9 aa, Mycobacterium tuberculosis
DSGAHARSA

SEQ ID NO: 1429450 - protein, 5 aa, Mycobacterium tuberculosis
DSGAT

SEQ ID NO: 1429451 - protein, 5 aa, Mycobacterium tuberculosis
DSGFV

SEQ ID NO: 1429452 - protein, 6 aa, Mycobacterium tuberculosis
DSGNSI

SEQ ID NO: 1429453 - protein, 9 aa, Mycobacterium tuberculosis
DSNIELGPG

SEQ ID NO: 1429454 - protein, 7 aa, Mycobacterium tuberculosis
DSNKTQI

SEQ ID NO: 1429455 - protein, 7 aa, Mycobacterium tuberculosis
DSPERAQ

SEQ ID NO: 1429456 - protein, 6 aa, Mycobacterium tuberculosis
DSPPML

SEQ ID NO: 1429457 - protein, 7 aa, Mycobacterium tuberculosis
DSPTGRP

SEQ ID NO: 1429458 - protein, 7 aa, Mycobacterium tuberculosis
DSRANGS

SEQ ID NO: 1429459 - protein, 5 aa, Mycobacterium tuberculosis
DSRDR

SEQ ID NO: 1429460 - protein, 27 aa, Mycobacterium tuberculosis
DSRETPPYVPKATTVDATTPAPAAEPL

SEQ ID NO: 1429461 - protein, 7 aa, Mycobacterium tuberculosis
DSTALYP

SEQ ID NO: 1429462 - protein, 9 aa, Mycobacterium tuberculosis
DSTDWSRNT

SEQ ID NO: 1429463 - protein, 4 aa, Mycobacterium tuberculosis
DSTF

SEQ ID NO: 1429464 - protein, 10 aa, Mycobacterium tuberculosis
DSTGADYASA

SEQ ID NO: 1429465 - protein, 11 aa, Mycobacterium tuberculosis
DSVPGSGGIRG

SEQ ID NO: 1429466 - protein, 8 aa, Mycobacterium tuberculosis
DSVTPQQA

SEQ ID NO: 1429467 - protein, 5 aa, Mycobacterium tuberculosis
DSYLT

SEQ ID NO: 1429468 - protein, 7 aa, Mycobacterium tuberculosis
DTAKGRR

SEQ ID NO: 1429469 - protein, 7 aa, Mycobacterium tuberculosis
DTDERTI

SEQ ID NO: 1429470 - protein, 6 aa, Mycobacterium tuberculosis
DTEGLA

SEQ ID NO: 1429471 - protein, 5 aa, Mycobacterium tuberculosis
DTEND

SEQ ID NO: 1429472 - protein, 10 aa, Mycobacterium tuberculosis
DTERQRAQGT

SEQ ID NO: 1429473 - protein, 9 aa, Mycobacterium tuberculosis
DTGNGPYGP

SEQ ID NO: 1429474 - protein, 5 aa, Mycobacterium tuberculosis
DTGVS

SEQ ID NO: 1429475 - protein, 6 aa, Mycobacterium tuberculosis
DTHREA

SEQ ID NO: 1429476 - protein, 5 aa, Mycobacterium tuberculosis
DTLQS

SEQ ID NO: 1429477 - protein, 10 aa, Mycobacterium tuberculosis
DTNTGAETTL

SEQ ID NO: 1429478 - protein, 7 aa, Mycobacterium tuberculosis
DTPASYE

SEQ ID NO: 1429479 - protein, 16 aa, Mycobacterium tuberculosis
DTPDGTPPPGTGLSPT

SEQ ID NO: 1429480 - protein, 18 aa, Mycobacterium tuberculosis
DTRTVNSDTPYGQPSAPI

SEQ ID NO: 1429481 - protein, 5 aa, Mycobacterium tuberculosis
DTSAS

SEQ ID NO: 1429482 - protein, 9 aa, Mycobacterium tuberculosis
DTSTTGNSA

SEQ ID NO: 1429483 - protein, 13 aa, Mycobacterium tuberculosis
DTTTGDTLSDPNQ

SEQ ID NO: 1429484 - protein, 15 aa, Mycobacterium tuberculosis
DTVDRARDDTVADSW

SEQ ID NO: 1429485 - protein, 7 aa, Mycobacterium tuberculosis
DTYSEQN

SEQ ID NO: 1429486 - protein, 7 aa, Mycobacterium tuberculosis
DVAESEE

SEQ ID NO: 1429487 - protein, 9 aa, Mycobacterium tuberculosis
DVATDETVH

SEQ ID NO: 1429488 - protein, 6 aa, Mycobacterium tuberculosis
DVDHGK

SEQ ID NO: 1429489 - protein, 10 aa, Mycobacterium tuberculosis
DVDPKGPAAC

SEQ ID NO: 1429490 - protein, 38 aa, Mycobacterium tuberculosis; identical to SEQ ID NO: 172691

SEQ ID NO: 1429491 - protein, 5 aa, Mycobacterium tuberculosis
DVPMA

SEQ ID NO: 1429492 - protein, 4 aa, Mycobacterium tuberculosis
DVQA

SEQ ID NO: 1429493 - protein, 15 aa, Mycobacterium tuberculosis
DVRADAARSLNVESA

SEQ ID NO: 1429494 - protein, 6 aa, Mycobacterium tuberculosis
DVRANT

SEQ ID NO: 1429495 - protein, 18 aa, Mycobacterium tuberculosis
DVSARDQQQSDGQWTRAK

SEQ ID NO: 1429496 - protein, 10 aa, Mycobacterium tuberculosis
DVSGYDEAAG

SEQ ID NO: 1429497 - protein, 6 aa, Mycobacterium tuberculosis
DVSTDD

SEQ ID NO: 1429498 - protein, 13 aa, Mycobacterium tuberculosis
DVTGTSKGKGFAG

SEQ ID NO: 1429499 - protein, 7 aa, Mycobacterium tuberculosis
DVTPGEL

SEQ ID NO: 1429500 - protein, 8 aa, Mycobacterium tuberculosis
DWPASPLP

SEQ ID NO: 1429501 - protein, 7 aa, Mycobacterium tuberculosis
DYADNTK

SEQ ID NO: 1429502 - protein, 8 aa, Mycobacterium tuberculosis
DYDGSGVE

SEQ ID NO: 1429503 - protein, 6 aa, Mycobacterium tuberculosis
DYLPPY

SEQ ID NO: 1429504 - protein, 15 aa, Mycobacterium tuberculosis
DYQTGIGGLNSGAGN

SEQ ID NO: 1429505 - protein, 5 aa, Mycobacterium tuberculosis
DYTDV

SEQ ID NO: 1429506 - protein, 10 aa, Mycobacterium tuberculosis
EAADKLRSPI

SEQ ID NO: 1429507 - protein, 6 aa, Mycobacterium tuberculosis
EAAEDN

SEQ ID NO: 1429508 - protein, 10 aa, Mycobacterium tuberculosis
EAASATPLQQ

SEQ ID NO: 1429509 - protein, 6 aa, Mycobacterium tuberculosis
EAASDA

SEQ ID NO: 1429510 - protein, 5 aa, Mycobacterium tuberculosis
EAATE

SEQ ID NO: 1429511 - protein, 9 aa, Mycobacterium tuberculosis
EAAVGEAPI

SEQ ID NO: 1429512 - protein, 16 aa, Mycobacterium tuberculosis
EADADIASGRTYGEDE

SEQ ID NO: 1429513 - protein, 8 aa, Mycobacterium tuberculosis
EADASGDL

SEQ ID NO: 1429514 - protein, 5 aa, Mycobacterium tuberculosis
EADDG

SEQ ID NO: 1429515 - protein, 4 aa, Mycobacterium tuberculosis
EADP

SEQ ID NO: 1429516 - protein, 7 aa, Mycobacterium tuberculosis
EADSDRD

SEQ ID NO: 1429517 - protein, 7 aa, Mycobacterium tuberculosis
EAEGADT

SEQ ID NO: 1429518 - protein, 8 aa, Mycobacterium tuberculosis
EAEPGSDH

SEQ ID NO: 1429519 - protein, 13 aa, Mycobacterium tuberculosis
EAEQQQLQSYITQ

SEQ ID NO: 1429520 - protein, 7 aa, Mycobacterium tuberculosis
EAEYEKV

SEQ ID NO: 1429521 - protein, 6 aa, Mycobacterium tuberculosis
EAGKED

SEQ ID NO: 1429522 - protein, 8 aa, Mycobacterium tuberculosis
EAGPDGHE

SEQ ID NO: 1429523 - protein, 7 aa, Mycobacterium tuberculosis
EAGSGEH

SEQ ID NO: 1429524 - protein, 8 aa, Mycobacterium tuberculosis
EAGTNAAH

SEQ ID NO: 1429525 - protein, 20 aa, Mycobacterium tuberculosis
EAKARQAADEQATARAEAEA

SEQ ID NO: 1429526 - protein, 9 aa, Mycobacterium tuberculosis
EAKQISAES

SEQ ID NO: 1429527 - protein, 29 aa, Mycobacterium tuberculosis
EALPAGGTTATPRPATETSGGAIAEQPYG

SEQ ID NO: 1429528 - protein, 6 aa, Mycobacterium tuberculosis
EAMRPG

SEQ ID NO: 1429529 - protein, 8 aa, Mycobacterium tuberculosis
EAMTQKPP

SEQ ID NO: 1429530 - protein, 4 aa, Mycobacterium tuberculosis
EANA

SEQ ID NO: 1429531 - protein, 6 aa, Mycobacterium tuberculosis
EANAQA

SEQ ID NO: 1429532 - protein, 17 aa, Mycobacterium tuberculosis
EANGDAREGFPAGTGWD

SEQ ID NO: 1429533 - protein, 5 aa, Mycobacterium tuberculosis
EAQKR

SEQ ID NO: 1429534 - protein, 5 aa, Mycobacterium tuberculosis
EARGA

SEQ ID NO: 1429535 - protein, 5 aa, Mycobacterium tuberculosis
EARQP

SEQ ID NO: 1429536 - protein, 7 aa, Mycobacterium tuberculosis
EARTPDA

SEQ ID NO: 1429537 - protein, 7 aa, Mycobacterium tuberculosis
EASAASG

SEQ ID NO: 1429538 - protein, 6 aa, Mycobacterium tuberculosis
EASPEV

SEQ ID NO: 1429539 - protein, 4 aa, Mycobacterium tuberculosis
EASY

SEQ ID NO: 1429540 - protein, 13 aa, Mycobacterium tuberculosis
EATQGRRRGSQAT

SEQ ID NO: 1429541 - protein, 4 aa, Mycobacterium tuberculosis
EAWR

SEQ ID NO: 1429542 - protein, 4 aa, Mycobacterium tuberculosis
ECGA

SEQ ID NO: 1429543 - protein, 12 aa, Mycobacterium tuberculosis
EDAKRKAAAGLE

SEQ ID NO: 1429544 - protein, 9 aa, Mycobacterium tuberculosis
EDAPERTSA

SEQ ID NO: 1429545 - protein, 9 aa, Mycobacterium tuberculosis
EDAVRASRN

SEQ ID NO: 1429546 - protein, 8 aa, Mycobacterium tuberculosis
EDAWNGRA

SEQ ID NO: 1429547 - protein, 7 aa, Mycobacterium tuberculosis
EDDVDAE

SEQ ID NO: 1429548 - protein, 5 aa, Mycobacterium tuberculosis
EDEQE

SEQ ID NO: 1429549 - protein, 5 aa, Mycobacterium tuberculosis
EDFPD

SEQ ID NO: 1429550 - protein, 6 aa, Mycobacterium tuberculosis
EDFPDP

SEQ ID NO: 1429551 - protein, 5 aa, Mycobacterium tuberculosis
EDIRN

SEQ ID NO: 1429552 - protein, 7 aa, Mycobacterium tuberculosis
EDNAATR

SEQ ID NO: 1429553 - protein, 8 aa, Mycobacterium tuberculosis
EDPDRDGL

SEQ ID NO: 1429554 - protein, 4 aa, Mycobacterium tuberculosis
EDPY

SEQ ID NO: 1429555 - protein, 10 aa, Mycobacterium tuberculosis
EDRAATDPLE

SEQ ID NO: 1429556 - protein, 5 aa, Mycobacterium tuberculosis
EDRGA

SEQ ID NO: 1429557 - protein, 4 aa, Mycobacterium tuberculosis
EDRR

SEQ ID NO: 1429558 - protein, 6 aa, Mycobacterium tuberculosis
EDSDDV

SEQ ID NO: 1429559 - protein, 14 aa, Mycobacterium tuberculosis
EDSVRAAGSPEIPS

SEQ ID NO: 1429560 - protein, 7 aa, Mycobacterium tuberculosis
EDTDDDI

SEQ ID NO: 1429561 - protein, 5 aa, Mycobacterium tuberculosis
EDTGY

SEQ ID NO: 1429562 - protein, 6 aa, Mycobacterium tuberculosis
EDTGYS

SEQ ID NO: 1429563 - protein, 12 aa, Mycobacterium tuberculosis
EDVPETSADPRV

SEQ ID NO: 1429564 - protein, 5 aa, Mycobacterium tuberculosis
EEAAT

SEQ ID NO: 1429565 - protein, 4 aa, Mycobacterium tuberculosis
EEAD

SEQ ID NO: 1429566 - protein, 7 aa, Mycobacterium tuberculosis
EEDEKKM

SEQ ID NO: 1429567 - protein, 12 aa, Mycobacterium tuberculosis
EEGAPWQQEGET

SEQ ID NO: 1429568 - protein, 6 aa, Mycobacterium tuberculosis
EEGKAV

SEQ ID NO: 1429569 - protein, 11 aa, Mycobacterium tuberculosis
EEGQARTAQKK

SEQ ID NO: 1429570 - protein, 32 aa, Mycobacterium tuberculosis; identical to SEQ ID NO: 173094

SEQ ID NO: 1429571 - protein, 6 aa, Mycobacterium tuberculosis
EEPARR

SEQ ID NO: 1429572 - protein, 4 aa, Mycobacterium tuberculosis
EEQD

SEQ ID NO: 1429573 - protein, 5 aa, Mycobacterium tuberculosis
EERAE

SEQ ID NO: 1429574 - protein, 4 aa, Mycobacterium tuberculosis
EFAP

SEQ ID NO: 1429575 - protein, 5 aa, Mycobacterium tuberculosis
EFERS

SEQ ID NO: 1429576 - protein, 9 aa, Mycobacterium tuberculosis
EFGGSTTFT

SEQ ID NO: 1429577 - protein, 5 aa, Mycobacterium tuberculosis
EFTGG

SEQ ID NO: 1429578 - protein, 6 aa, Mycobacterium tuberculosis
EFTTPT

SEQ ID NO: 1429579 - protein, 8 aa, Mycobacterium tuberculosis
EGAPGQQE

SEQ ID NO: 1429580 - protein, 6 aa, Mycobacterium tuberculosis
EGDANL

SEQ ID NO: 1429581 - protein, 4 aa, Mycobacterium tuberculosis
EGDT

SEQ ID NO: 1429582 - protein, 6 aa, Mycobacterium tuberculosis
EGEGRS

SEQ ID NO: 1429583 - protein, 24 aa, Mycobacterium tuberculosis
EGEPETDLAGDDAEDWSRTGPAER

SEQ ID NO: 1429584 - protein, 4 aa, Mycobacterium tuberculosis
EGET

SEQ ID NO: 1429585 - protein, 8 aa, Mycobacterium tuberculosis
EGFAGKSS

SEQ ID NO: 1429586 - protein, 4 aa, Mycobacterium tuberculosis
EGGA

SEQ ID NO: 1429587 - protein, 5 aa, Mycobacterium tuberculosis
EGGAG

SEQ ID NO: 1429588 - protein, 4 aa, Mycobacterium tuberculosis
EGGG

SEQ ID NO: 1429589 - protein, 8 aa, Mycobacterium tuberculosis
EGGPPEVA

SEQ ID NO: 1429590 - protein, 7 aa, Mycobacterium tuberculosis
EGGPSRH

SEQ ID NO: 1429591 - protein, 12 aa, Mycobacterium tuberculosis
EGIRANTTAAAL

SEQ ID NO: 1429592 - protein, 7 aa, Mycobacterium tuberculosis
EGKSAHN

SEQ ID NO: 1429593 - protein, 14 aa, Mycobacterium tuberculosis
EGLGGGSVSAGIGR

SEQ ID NO: 1429594 - protein, 5 aa, Mycobacterium tuberculosis
EGLTI

SEQ ID NO: 1429595 - protein, 8 aa, Mycobacterium tuberculosis
EGNPPDPA

SEQ ID NO: 1429596 - protein, 8 aa, Mycobacterium tuberculosis
EGPAPDQE

SEQ ID NO: 1429597 - protein, 5 aa, Mycobacterium tuberculosis
EGPGA

SEQ ID NO: 1429598 - protein, 5 aa, Mycobacterium tuberculosis
EGQKT

SEQ ID NO: 1429599 - protein, 4 aa, Mycobacterium tuberculosis
EGQS

SEQ ID NO: 1429600 - protein, 7 aa, Mycobacterium tuberculosis
EGRFDEQ

SEQ ID NO: 1429601 - protein, 7 aa, Mycobacterium tuberculosis
EGSRTRS

SEQ ID NO: 1429602 - protein, 7 aa, Mycobacterium tuberculosis
EGTPAGG

SEQ ID NO: 1429603 - protein, 10 aa, Mycobacterium tuberculosis
EGTRSPDGRL

SEQ ID NO: 1429604 - protein, 4 aa, Mycobacterium tuberculosis
EGTV

SEQ ID NO: 1429605 - protein, 9 aa, Mycobacterium tuberculosis
EGVDENGTP

SEQ ID NO: 1429606 - protein, 4 aa, Mycobacterium tuberculosis
EGVP

SEQ ID NO: 1429607 - protein, 6 aa, Mycobacterium tuberculosis
EGVSGV

SEQ ID NO: 1429608 - protein, 9 aa, Mycobacterium tuberculosis
EGYSPRFAG

SEQ ID NO: 1429609 - protein, 7 aa, Mycobacterium tuberculosis
EGYTPDF

SEQ ID NO: 1429610 - protein, 8 aa, Mycobacterium tuberculosis
EHAGPGIP

SEQ ID NO: 1429611 - protein, 17 aa, Mycobacterium tuberculosis
EHELGTKGPGQDGPGRE

SEQ ID NO: 1429612 - protein, 5 aa, Mycobacterium tuberculosis
EHGYP

SEQ ID NO: 1429613 - protein, 4 aa, Mycobacterium tuberculosis
EHPA

SEQ ID NO: 1429614 - protein, 25 aa, Mycobacterium tuberculosis
EHQAEKAAAAGRTKEADEAKANAEQ

SEQ ID NO: 1429615 - protein, 44 aa, Mycobacterium tuberculosis
EHQDQRRDRHQLPRQQKRRHRARGRHQQHRRDEQRHHRHRDPTE

SEQ ID NO: 1429616 - protein, 12 aa, Mycobacterium tuberculosis
EHRGRKSGKPYQ

SEQ ID NO: 1429617 - protein, 5 aa, Mycobacterium tuberculosis
EHTGR

SEQ ID NO: 1429618 - protein, 4 aa, Mycobacterium tuberculosis
EIDG

SEQ ID NO: 1429619 - protein, 10 aa, Mycobacterium tuberculosis
EIDKARSELA

SEQ ID NO: 1429620 - protein, 11 aa, Mycobacterium tuberculosis
EIDKARSELAA

SEQ ID NO: 1429621 - protein, 10 aa, Mycobacterium tuberculosis
EIEAPGSGAT

SEQ ID NO: 1429622 - protein, 4 aa, Mycobacterium tuberculosis
EIER

SEQ ID NO: 1429623 - protein, 10 aa, Mycobacterium tuberculosis
EIGPYGSSRT

SEQ ID NO: 1429624 - protein, 5 aa, Mycobacterium tuberculosis
EIHDS

SEQ ID NO: 1429625 - protein, 11 aa, Mycobacterium tuberculosis
EIKNGQRKQVN

SEQ ID NO: 1429626 - protein, 8 aa, Mycobacterium tuberculosis
EIREEVDN

SEQ ID NO: 1429627 - protein, 6 aa, Mycobacterium tuberculosis
EIRNRA

SEQ ID NO: 1429628 - protein, 6 aa, Mycobacterium tuberculosis
EKDPDT

SEQ ID NO: 1429629 - protein, 5 aa, Mycobacterium tuberculosis
EKGPR

SEQ ID NO: 1429630 - protein, 5 aa, Mycobacterium tuberculosis
EKHKN

SEQ ID NO: 1429631 - protein, 4 aa, Mycobacterium tuberculosis
EKMG

SEQ ID NO: 1429632 - protein, 6 aa, Mycobacterium tuberculosis
EKMSKS

SEQ ID NO: 1429633 - protein, 11 aa, Mycobacterium tuberculosis
EKPVTPKSNYA

SEQ ID NO: 1429634 - protein, 4 aa, Mycobacterium tuberculosis
EKQM

SEQ ID NO: 1429635 - protein, 9 aa, Mycobacterium tuberculosis
EKRPPSGSA

SEQ ID NO: 1429636 - protein, 11 aa, Mycobacterium tuberculosis
EKSGEGGGNRV

SEQ ID NO: 1429637 - protein, 9 aa, Mycobacterium tuberculosis
ELAGEPRPR

SEQ ID NO: 1429638 - protein, 10 aa, Mycobacterium tuberculosis
ELARAGADGV

SEQ ID NO: 1429639 - protein, 8 aa, Mycobacterium tuberculosis
ELDESAAR

SEQ ID NO: 1429640 - protein, 11 aa, Mycobacterium tuberculosis
ELGGADHQASY

SEQ ID NO: 1429641 - protein, 7 aa, Mycobacterium tuberculosis
ELGGQGF

SEQ ID NO: 1429642 - protein, 4 aa, Mycobacterium tuberculosis
ELGP

SEQ ID NO: 1429643 - protein, 9 aa, Mycobacterium tuberculosis
ELGSAAASF

SEQ ID NO: 1429644 - protein, 8 aa, Mycobacterium tuberculosis
ELGTAAQS

SEQ ID NO: 1429645 - protein, 7 aa, Mycobacterium tuberculosis
ELPGEPP

SEQ ID NO: 1429646 - protein, 7 aa, Mycobacterium tuberculosis
ELPGSDA

SEQ ID NO: 1429647 - protein, 5 aa, Mycobacterium tuberculosis
ELPPG

SEQ ID NO: 1429648 - protein, 4 aa, Mycobacterium tuberculosis
ELQN

SEQ ID NO: 1429649 - protein, 5 aa, Mycobacterium tuberculosis
ELQSR

SEQ ID NO: 1429650 - protein, 16 aa, Mycobacterium tuberculosis
ELRDAGVSDKTLADPA

SEQ ID NO: 1429651 - protein, 5 aa, Mycobacterium tuberculosis
ELRGS

SEQ ID NO: 1429652 - protein, 7 aa, Mycobacterium tuberculosis
ELRRGAT

SEQ ID NO: 1429653 - protein, 4 aa, Mycobacterium tuberculosis
ELSQ

SEQ ID NO: 1429654 - protein, 10 aa, Mycobacterium tuberculosis
ELSYSDQPDA

SEQ ID NO: 1429655 - protein, 4 aa, Mycobacterium tuberculosis
ELTG

SEQ ID NO: 1429656 - protein, 6 aa, Mycobacterium tuberculosis
EMNTRG

SEQ ID NO: 1429657 - protein, 4 aa, Mycobacterium tuberculosis
EMTP

SEQ ID NO: 1429658 - protein, 4 aa, Mycobacterium tuberculosis
ENDA

SEQ ID NO: 1429659 - protein, 6 aa, Mycobacterium tuberculosis
ENHPQR

SEQ ID NO: 1429660 - protein, 4 aa, Mycobacterium tuberculosis
ENPL

SEQ ID NO: 1429661 - protein, 6 aa, Mycobacterium tuberculosis
ENPPGV

SEQ ID NO: 1429662 - protein, 7 aa, Mycobacterium tuberculosis
ENPRPLG

SEQ ID NO: 1429663 - protein, 5 aa, Mycobacterium tuberculosis
ENQAV

SEQ ID NO: 1429664 - protein, 5 aa, Mycobacterium tuberculosis
ENRSL

SEQ ID NO: 1429665 - protein, 4 aa, Mycobacterium tuberculosis
ENTH

SEQ ID NO: 1429666 - protein, 5 aa, Mycobacterium tuberculosis
EPADS

SEQ ID NO: 1429667 - protein, 4 aa, Mycobacterium tuberculosis
EPAS

SEQ ID NO: 1429668 - protein, 5 aa, Mycobacterium tuberculosis
EPDDV

SEQ ID NO: 1429669 - protein, 4 aa, Mycobacterium tuberculosis
EPDL

SEQ ID NO: 1429670 - protein, 8 aa, Mycobacterium tuberculosis
EPDNPARV

SEQ ID NO: 1429671 - protein, 5 aa, Mycobacterium tuberculosis
EPEEV

SEQ ID NO: 1429672 - protein, 4 aa, Mycobacterium tuberculosis
EPFA

SEQ ID NO: 1429673 - protein, 10 aa, Mycobacterium tuberculosis
EPGAGSDLAS

SEQ ID NO: 1429674 - protein, 8 aa, Mycobacterium tuberculosis
EPIGPKAL

SEQ ID NO: 1429675 - protein, 4 aa, Mycobacterium tuberculosis
EPKN

SEQ ID NO: 1429676 - protein, 14 aa, Mycobacterium tuberculosis
EPLGTTVSAGGMPD

SEQ ID NO: 1429677 - protein, 4 aa, Mycobacterium tuberculosis
EPPG

SEQ ID NO: 1429678 - protein, 9 aa, Mycobacterium tuberculosis
EPPRSPAQM

SEQ ID NO: 1429679 - protein, 74 aa, Mycobacterium tuberculosis; identical to SEQ ID NO: 150830

SEQ ID NO: 1429680 - protein, 4 aa, Mycobacterium tuberculosis
EPPV

SEQ ID NO: 1429681 - protein, 13 aa, Mycobacterium tuberculosis
EPPVTHTPPAPIE

SEQ ID NO: 1429682 - protein, 29 aa, Mycobacterium tuberculosis
EPQAATGTAGSAGDPTGGNGGPGTPGSPM

SEQ ID NO: 1429683 - protein, 16 aa, Mycobacterium tuberculosis
EPQFEGQTKTKLGNTE

SEQ ID NO: 1429684 - protein, 25 aa, Mycobacterium tuberculosis
EPRPEPEPDFRPEPRPSITRSADEQ

SEQ ID NO: 1429685 - protein, 7 aa, Mycobacterium tuberculosis
EPTDKAF

SEQ ID NO: 1429686 - protein, 4 aa, Mycobacterium tuberculosis
EPTR

SEQ ID NO: 1429687 - protein, 8 aa, Mycobacterium tuberculosis
EPVGDRRT

SEQ ID NO: 1429688 - protein, 6 aa, Mycobacterium tuberculosis
EQAKDA

SEQ ID NO: 1429689 - protein, 4 aa, Mycobacterium tuberculosis
EQEG

SEQ ID NO: 1429690 - protein, 4 aa, Mycobacterium tuberculosis
EQGL

SEQ ID NO: 1429691 - protein, 9 aa, Mycobacterium tuberculosis
EQLGAGKPI

SEQ ID NO: 1429692 - protein, 5 aa, Mycobacterium tuberculosis
EQQAA

SEQ ID NO: 1429693 - protein, 4 aa, Mycobacterium tuberculosis
EQQR

SEQ ID NO: 1429694 - protein, 5 aa, Mycobacterium tuberculosis
EQRSS

SEQ ID NO: 1429695 - protein, 9 aa, Mycobacterium tuberculosis
EQRSSTAET

SEQ ID NO: 1429696 - protein, 6 aa, Mycobacterium tuberculosis
EQRVPD

SEQ ID NO: 1429697 - protein, 7 aa, Mycobacterium tuberculosis
EQSGHTQ

SEQ ID NO: 1429698 - protein, 8 aa, Mycobacterium tuberculosis
EQSRPLSE

SEQ ID NO: 1429699 - protein, 5 aa, Mycobacterium tuberculosis
EQSVE

SEQ ID NO: 1429700 - protein, 11 aa, Mycobacterium tuberculosis
EQTGGFEGRTK

SEQ ID NO: 1429701 - protein, 6 aa, Mycobacterium tuberculosis
ERAAEL

SEQ ID NO: 1429702 - protein, 10 aa, Mycobacterium tuberculosis
ERAAQSPTEA

SEQ ID NO: 1429703 - protein, 7 aa, Mycobacterium tuberculosis
ERAARGA

SEQ ID NO: 1429704 - protein, 8 aa, Mycobacterium tuberculosis
ERAGESRA

SEQ ID NO: 1429705 - protein, 14 aa, Mycobacterium tuberculosis
ERAGPTPAQTTAEP

SEQ ID NO: 1429706 - protein, 6 aa, Mycobacterium tuberculosis
ERAGRK

SEQ ID NO: 1429707 - protein, 8 aa, Mycobacterium tuberculosis
ERAGTTKS

SEQ ID NO: 1429708 - protein, 10 aa, Mycobacterium tuberculosis
ERAHDTATPQ

SEQ ID NO: 1429709 - protein, 4 aa, Mycobacterium tuberculosis
EREI

SEQ ID NO: 1429710 - protein, 8 aa, Mycobacterium tuberculosis
ERFGPDRV

SEQ ID NO: 1429711 - protein, 8 aa, Mycobacterium tuberculosis
ERGGERVR

SEQ ID NO: 1429712 - protein, 8 aa, Mycobacterium tuberculosis
ERGSGLDW

SEQ ID NO: 1429713 - protein, 7 aa, Mycobacterium tuberculosis
ERGYDGA

SEQ ID NO: 1429714 - protein, 7 aa, Mycobacterium tuberculosis
ERGYDST

SEQ ID NO: 1429715 - protein, 10 aa, Mycobacterium tuberculosis
ERKDNRDKSI

SEQ ID NO: 1429716 - protein, 5 aa, Mycobacterium tuberculosis
ERLAT

SEQ ID NO: 1429717 - protein, 8 aa, Mycobacterium tuberculosis
ERLRESKE

SEQ ID NO: 1429718 - protein, 19 aa, Mycobacterium tuberculosis
ERNGWKAEVNSTKLRSAEP

SEQ ID NO: 1429719 - protein, 9 aa, Mycobacterium tuberculosis
ERNPRSTPV

SEQ ID NO: 1429720 - protein, 23 aa, Mycobacterium tuberculosis
ERNRDQSNALKATSLREAGGEEL

SEQ ID NO: 1429721 - protein, 6 aa, Mycobacterium tuberculosis
ERPDSD

SEQ ID NO: 1429722 - protein, 5 aa, Mycobacterium tuberculosis
ERPHA

SEQ ID NO: 1429723 - protein, 14 aa, Mycobacterium tuberculosis
ERPHNTDSATAGVT

SEQ ID NO: 1429724 - protein, 30 aa, Mycobacterium tuberculosis; identical to SEQ ID NO: 173962

SEQ ID NO: 1429725 - protein, 9 aa, Mycobacterium tuberculosis
ERREASGND

SEQ ID NO: 1429726 - protein, 9 aa, Mycobacterium tuberculosis
ERRRRLAER

SEQ ID NO: 1429727 - protein, 4 aa, Mycobacterium tuberculosis
ERSP

SEQ ID NO: 1429728 - protein, 7 aa, Mycobacterium tuberculosis
ERTGPSI

SEQ ID NO: 1429729 - protein, 9 aa, Mycobacterium tuberculosis
ERTQRYAPH

SEQ ID NO: 1429730 - protein, 4 aa, Mycobacterium tuberculosis
ERVA

SEQ ID NO: 1429731 - protein, 6 aa, Mycobacterium tuberculosis
ERYAKG

SEQ ID NO: 1429732 - protein, 9 aa, Mycobacterium tuberculosis
ESAEGRQKY

SEQ ID NO: 1429733 - protein, 7 aa, Mycobacterium tuberculosis
ESARRTL

SEQ ID NO: 1429734 - protein, 6 aa, Mycobacterium tuberculosis
ESAVRS

SEQ ID NO: 1429735 - protein, 4 aa, Mycobacterium tuberculosis
ESER

SEQ ID NO: 1429736 - protein, 5 aa, Mycobacterium tuberculosis
ESGAV

SEQ ID NO: 1429737 - protein, 9 aa, Mycobacterium tuberculosis
ESGEEGREQ

SEQ ID NO: 1429738 - protein, 5 aa, Mycobacterium tuberculosis
ESGRA

SEQ ID NO: 1429739 - protein, 9 aa, Mycobacterium tuberculosis
ESGSGGPGV

SEQ ID NO: 1429740 - protein, 8 aa, Mycobacterium tuberculosis
ESGSQISA

SEQ ID NO: 1429741 - protein, 8 aa, Mycobacterium tuberculosis
ESGTADME

SEQ ID NO: 1429742 - protein, 5 aa, Mycobacterium tuberculosis
ESGVP

SEQ ID NO: 1429743 - protein, 8 aa, Mycobacterium tuberculosis
ESIGGSVS

SEQ ID NO: 1429744 - protein, 4 aa, Mycobacterium tuberculosis
ESLA

SEQ ID NO: 1429745 - protein, 46 aa, Mycobacterium tuberculosis; identical to SEQ ID NO: 174078

SEQ ID NO: 1429746 - protein, 7 aa, Mycobacterium tuberculosis
ESLRQQA

SEQ ID NO: 1429747 - protein, 7 aa, Mycobacterium tuberculosis
ESMDPEA

SEQ ID NO: 1429748 - protein, 18 aa, Mycobacterium tuberculosis
ESNGKSTRADGSPVSADT

SEQ ID NO: 1429749 - protein, 5 aa, Mycobacterium tuberculosis
ESPDF

SEQ ID NO: 1429750 - protein, 5 aa, Mycobacterium tuberculosis
ESPDG

SEQ ID NO: 1429751 - protein, 7 aa, Mycobacterium tuberculosis
ESPSGED

SEQ ID NO: 1429752 - protein, 4 aa, Mycobacterium tuberculosis
ESQD

SEQ ID NO: 1429753 - protein, 15 aa, Mycobacterium tuberculosis
ESRPPPAAARQDRWR

SEQ ID NO: 1429754 - protein, 8 aa, Mycobacterium tuberculosis
ESRPTRTE

SEQ ID NO: 1429755 - protein, 5 aa, Mycobacterium tuberculosis
ESRTR

SEQ ID NO: 1429756 - protein, 7 aa, Mycobacterium tuberculosis
ESTWDRR

SEQ ID NO: 1429757 - protein, 8 aa, Mycobacterium tuberculosis
ETARGATA

SEQ ID NO: 1429758 - protein, 6 aa, Mycobacterium tuberculosis
ETDKDK

SEQ ID NO: 1429759 - protein, 4 aa, Mycobacterium tuberculosis
ETEP

SEQ ID NO: 1429760 - protein, 4 aa, Mycobacterium tuberculosis
ETET

SEQ ID NO: 1429761 - protein, 10 aa, Mycobacterium tuberculosis
ETGAGQHGVA

SEQ ID NO: 1429762 - protein, 5 aa, Mycobacterium tuberculosis
ETGAI

SEQ ID NO: 1429763 - protein, 6 aa, Mycobacterium tuberculosis
ETGCTS

SEQ ID NO: 1429764 - protein, 7 aa, Mycobacterium tuberculosis
ETPSQAA

SEQ ID NO: 1429765 - protein, 6 aa, Mycobacterium tuberculosis
ETRKSF

SEQ ID NO: 1429766 - protein, 11 aa, Mycobacterium tuberculosis
ETRRRSPTRGE

SEQ ID NO: 1429767 - protein, 9 aa, Mycobacterium tuberculosis
ETSVAGEPI

SEQ ID NO: 1429768 - protein, 8 aa, Mycobacterium tuberculosis
ETTATRSG

SEQ ID NO: 1429769 - protein, 24 aa, Mycobacterium tuberculosis
EVAGGGVREAKVPAAARNDADSKR

SEQ ID NO: 1429770 - protein, 26 aa, Mycobacterium tuberculosis
EVAPGTVAPVAGASRPQLPTGDLTSV

SEQ ID NO: 1429771 - protein, 7 aa, Mycobacterium tuberculosis
EVEGAGA

SEQ ID NO: 1429772 - protein, 6 aa, Mycobacterium tuberculosis
EVGRGA

SEQ ID NO: 1429773 - protein, 4 aa, Mycobacterium tuberculosis
EVPP

SEQ ID NO: 1429774 - protein, 4 aa, Mycobacterium tuberculosis
EVSA

SEQ ID NO: 1429775 - protein, 5 aa, Mycobacterium tuberculosis
EYDER

SEQ ID NO: 1429776 - protein, 13 aa, Mycobacterium tuberculosis
EYKANRSSTPDEF

SEQ ID NO: 1429777 - protein, 5 aa, Mycobacterium tuberculosis
EYNGS

SEQ ID NO: 1429778 - protein, 10 aa, Mycobacterium tuberculosis
FAAASPNEAI

SEQ ID NO: 1429779 - protein, 5 aa, Mycobacterium tuberculosis
FAATG

SEQ ID NO: 1429780 - protein, 9 aa, Mycobacterium tuberculosis
FADPAGGTG

SEQ ID NO: 1429781 - protein, 4 aa, Mycobacterium tuberculosis
FAGR

SEQ ID NO: 1429782 - protein, 11 aa, Mycobacterium tuberculosis
FARPGARRSRE

SEQ ID NO: 1429783 - protein, 17 aa, Mycobacterium tuberculosis
FASTGTGGAGGTGGAGG

SEQ ID NO: 1429784 - protein, 12 aa, Mycobacterium tuberculosis
FDDQGAKYDGDG

SEQ ID NO: 1429785 - protein, 4 aa, Mycobacterium tuberculosis
FDPR

SEQ ID NO: 1429786 - protein, 5 aa, Mycobacterium tuberculosis
FDRPR

SEQ ID NO: 1429787 - protein, 8 aa, Mycobacterium tuberculosis
FDSAAPTA

SEQ ID NO: 1429788 - protein, 4 aa, Mycobacterium tuberculosis
FDSI

SEQ ID NO: 1429789 - protein, 10 aa, Mycobacterium tuberculosis
FDSSDALPQN

SEQ ID NO: 1429790 - protein, 4 aa, Mycobacterium tuberculosis
FEAS

SEQ ID NO: 1429791 - protein, 9 aa, Mycobacterium tuberculosis
FEGHPDNAA

SEQ ID NO: 1429792 - protein, 11 aa, Mycobacterium tuberculosis
FEKEPSDPKLS

SEQ ID NO: 1429793 - protein, 7 aa, Mycobacterium tuberculosis
FEPSGYP

SEQ ID NO: 1429794 - protein, 5 aa, Mycobacterium tuberculosis
FERRS

SEQ ID NO: 1429795 - protein, 12 aa, Mycobacterium tuberculosis
FGAPYSEPGAAA

SEQ ID NO: 1429796 - protein, 6 aa, Mycobacterium tuberculosis
FGDGTT

SEQ ID NO: 1429797 - protein, 11 aa, Mycobacterium tuberculosis
FGGDGGATTSV

SEQ ID NO: 1429798 - protein, 7 aa, Mycobacterium tuberculosis
FGGDPGN

SEQ ID NO: 1429799 - protein, 12 aa, Mycobacterium tuberculosis
FGGGAASRGPIG

SEQ ID NO: 1429800 - protein, 8 aa, Mycobacterium tuberculosis
FGGGNNGT

SEQ ID NO: 1429801 - protein, 5 aa, Mycobacterium tuberculosis
FGGSG

SEQ ID NO: 1429802 - protein, 6 aa, Mycobacterium tuberculosis
FGNAGS

SEQ ID NO: 1429803 - protein, 8 aa, Mycobacterium tuberculosis
FGNRGDAN

SEQ ID NO: 1429804 - protein, 5 aa, Mycobacterium tuberculosis
FGNSG

SEQ ID NO: 1429805 - protein, 9 aa, Mycobacterium tuberculosis
FGNTGTNNV

SEQ ID NO: 1429806 - protein, 10 aa, Mycobacterium tuberculosis
FGNTTAVPSS

SEQ ID NO: 1429807 - protein, 19 aa, Mycobacterium tuberculosis
FGPKPQEPPPDPVPFPPYQ

SEQ ID NO: 1429808 - protein, 4 aa, Mycobacterium tuberculosis
FGPS

SEQ ID NO: 1429809 - protein, 4 aa, Mycobacterium tuberculosis
FGSY

SEQ ID NO: 1429810 - protein, 6 aa, Mycobacterium tuberculosis
FHPSQL

SEQ ID NO: 1429811 - protein, 11 aa, Mycobacterium tuberculosis
FKRSDAQLPAN

SEQ ID NO: 1429812 - protein, 14 aa, Mycobacterium tuberculosis
FNPDDPDAFAATGG

SEQ ID NO: 1429813 - protein, 6 aa, Mycobacterium tuberculosis
FNPECA

SEQ ID NO: 1429814 - protein, 19 aa, Mycobacterium tuberculosis
FNPGSSNTGTFNTGNANTG

SEQ ID NO: 1429815 - protein, 7 aa, Mycobacterium tuberculosis
FNSGTNN

SEQ ID NO: 1429816 - protein, 12 aa, Mycobacterium tuberculosis
FPNHEANPLDPA

SEQ ID NO: 1429817 - protein, 6 aa, Mycobacterium tuberculosis
FPRPQT

SEQ ID NO: 1429818 - protein, 8 aa, Mycobacterium tuberculosis
FPSDNGEQ

SEQ ID NO: 1429819 - protein, 11 aa, Mycobacterium tuberculosis
FPTSSAVSSEL

SEQ ID NO: 1429820 - protein, 5 aa, Mycobacterium tuberculosis
FPYQS

SEQ ID NO: 1429821 - protein, 6 aa, Mycobacterium tuberculosis
FPYQSK

SEQ ID NO: 1429822 - protein, 5 aa, Mycobacterium tuberculosis
FRGGA

SEQ ID NO: 1429823 - protein, 32 aa, Mycobacterium tuberculosis; identical to SEQ ID NO: 174465

SEQ ID NO: 1429824 - protein, 5 aa, Mycobacterium tuberculosis
FSDDE

SEQ ID NO: 1429825 - protein, 6 aa, Mycobacterium tuberculosis
FSGAKT

SEQ ID NO: 1429826 - protein, 7 aa, Mycobacterium tuberculosis
FSGRAQV

SEQ ID NO: 1429827 - protein, 9 aa, Mycobacterium tuberculosis
FSPGQQDAW

SEQ ID NO: 1429828 - protein, 15 aa, Mycobacterium tuberculosis
FSRPEPRHRAQRTVE

SEQ ID NO: 1429829 - protein, 11 aa, Mycobacterium tuberculosis
FSTGGKTPLAE

SEQ ID NO: 1429830 - protein, 4 aa, Mycobacterium tuberculosis
FTGT

SEQ ID NO: 1429831 - protein, 13 aa, Mycobacterium tuberculosis
FTPEATAEADGNL

SEQ ID NO: 1429832 - protein, 5 aa, Mycobacterium tuberculosis
FTPRQ

SEQ ID NO: 1429833 - protein, 5 aa, Mycobacterium tuberculosis
FTSDG

SEQ ID NO: 1429834 - protein, 10 aa, Mycobacterium tuberculosis
FTSSPPPGPV

SEQ ID NO: 1429835 - protein, 28 aa, Mycobacterium tuberculosis
FVGNGGAGGNGQLGSGAVSSAGGMGGNG

SEQ ID NO: 1429836 - protein, 5 aa, Mycobacterium tuberculosis
FYPST

SEQ ID NO: 1429837 - protein, 11 aa, Mycobacterium tuberculosis
GAADNGPAEQQ

SEQ ID NO: 1429838 - protein, 14 aa, Mycobacterium tuberculosis
GAAGAASAAGAAGV

SEQ ID NO: 1429839 - protein, 8 aa, Mycobacterium tuberculosis
GAAHTTAH

SEQ ID NO: 1429840 - protein, 4 aa, Mycobacterium tuberculosis
GAAI

SEQ ID NO: 1429841 - protein, 12 aa, Mycobacterium tuberculosis
GAALGQTVTLTL

SEQ ID NO: 1429842 - protein, 8 aa, Mycobacterium tuberculosis
GAAPSGPV

SEQ ID NO: 1429843 - protein, 10 aa, Mycobacterium tuberculosis
GAAPSMAGPR

SEQ ID NO: 1429844 - protein, 10 aa, Mycobacterium tuberculosis
GAARRRTPAR

SEQ ID NO: 1429845 - protein, 8 aa, Mycobacterium tuberculosis
GAATEDDA

SEQ ID NO: 1429846 - protein, 18 aa, Mycobacterium tuberculosis
GAAVGESATEEPMPDASN

SEQ ID NO: 1429847 - protein, 7 aa, Mycobacterium tuberculosis
GADEADA

SEQ ID NO: 1429848 - protein, 7 aa, Mycobacterium tuberculosis
GADEVST

SEQ ID NO: 1429849 - protein, 16 aa, Mycobacterium tuberculosis
GADGLRTAGERAVRSP

SEQ ID NO: 1429850 - protein, 5 aa, Mycobacterium tuberculosis
GADGS

SEQ ID NO: 1429851 - protein, 7 aa, Mycobacterium tuberculosis
GADHRRR

SEQ ID NO: 1429852 - protein, 10 aa, Mycobacterium tuberculosis
GADKEGPELR

SEQ ID NO: 1429853 - protein, 22 aa, Mycobacterium tuberculosis
GADLGPEHRPSAASGPDTTEAD

SEQ ID NO: 1429854 - protein, 4 aa, Mycobacterium tuberculosis
GADM

SEQ ID NO: 1429855 - protein, 9 aa, Mycobacterium tuberculosis
GADPPLGAR

SEQ ID NO: 1429856 - protein, 7 aa, Mycobacterium tuberculosis
GADQQSE

SEQ ID NO: 1429857 - protein, 6 aa, Mycobacterium tuberculosis
GADVSQ

SEQ ID NO: 1429858 - protein, 8 aa, Mycobacterium tuberculosis
GAEDVNDL

SEQ ID NO: 1429859 - protein, 12 aa, Mycobacterium tuberculosis
GAENPEPGRYGG

SEQ ID NO: 1429860 - protein, 5 aa, Mycobacterium tuberculosis
GAEPQ

SEQ ID NO: 1429861 - protein, 6 aa, Mycobacterium tuberculosis
GAERAS

SEQ ID NO: 1429862 - protein, 5 aa, Mycobacterium tuberculosis
GAEYP

SEQ ID NO: 1429863 - protein, 8 aa, Mycobacterium tuberculosis
GAFGPNGN

SEQ ID NO: 1429864 - protein, 22 aa, Mycobacterium tuberculosis
GAGAQGGAGTSGATGGAGGDGV

SEQ ID NO: 1429865 - protein, 4 aa, Mycobacterium tuberculosis
GAGG

SEQ ID NO: 1429866 - protein, 22 aa, Mycobacterium tuberculosis
GAGGAGGAGGVGGTGGAGGAGF

SEQ ID NO: 1429867 - protein, 11 aa, Mycobacterium tuberculosis
GAGGAGGDSAV

SEQ ID NO: 1429868 - protein, 26 aa, Mycobacterium tuberculosis
GAGGAGGPGGAASAGSGGHGGTGGDA

SEQ ID NO: 1429869 - protein, 6 aa, Mycobacterium tuberculosis
GAGGAR

SEQ ID NO: 1429870 - protein, 7 aa, Mycobacterium tuberculosis
GAGGGAS

SEQ ID NO: 1429871 - protein, 17 aa, Mycobacterium tuberculosis
GAGGGSGFGNFGAGTSG

SEQ ID NO: 1429872 - protein, 5 aa, Mycobacterium tuberculosis
GAGGH

SEQ ID NO: 1429873 - protein, 10 aa, Mycobacterium tuberculosis
GAGHFNRGTQ

SEQ ID NO: 1429874 - protein, 11 aa, Mycobacterium tuberculosis
GAGPVAASATL

SEQ ID NO: 1429875 - protein, 7 aa, Mycobacterium tuberculosis
GAGRARD

SEQ ID NO: 1429876 - protein, 7 aa, Mycobacterium tuberculosis
GAGSGIG

SEQ ID NO: 1429877 - protein, 7 aa, Mycobacterium tuberculosis
GAGSRSE

SEQ ID NO: 1429878 - protein, 7 aa, Mycobacterium tuberculosis
GAGTDPE

SEQ ID NO: 1429879 - protein, 10 aa, Mycobacterium tuberculosis
GAGVGDPAEP

SEQ ID NO: 1429880 - protein, 14 aa, Mycobacterium tuberculosis
GAHGTAPGQPGGAG

SEQ ID NO: 1429881 - protein, 5 aa, Mycobacterium tuberculosis
GAHTA

SEQ ID NO: 1429882 - protein, 6 aa, Mycobacterium tuberculosis
GAIGRR

SEQ ID NO: 1429883 - protein, 11 aa, Mycobacterium tuberculosis
GAKEIADQHGK

SEQ ID NO: 1429884 - protein, 7 aa, Mycobacterium tuberculosis
GALGSGV

SEQ ID NO: 1429885 - protein, 6 aa, Mycobacterium tuberculosis
GALHNR

SEQ ID NO: 1429886 - protein, 8 aa, Mycobacterium tuberculosis
GALSEPAT

SEQ ID NO: 1429887 - protein, 15 aa, Mycobacterium tuberculosis
GANAPASTNPLHTAQ

SEQ ID NO: 1429888 - protein, 4 aa, Mycobacterium tuberculosis
GANN

SEQ ID NO: 1429889 - protein, 11 aa, Mycobacterium tuberculosis
GANNPARSGFE

SEQ ID NO: 1429890 - protein, 11 aa, Mycobacterium tuberculosis
GANSAIPHHRP

SEQ ID NO: 1429891 - protein, 8 aa, Mycobacterium tuberculosis
GAPHREQR

SEQ ID NO: 1429892 - protein, 7 aa, Mycobacterium tuberculosis
GAPPPDV

SEQ ID NO: 1429893 - protein, 7 aa, Mycobacterium tuberculosis
GAPQVNA

SEQ ID NO: 1429894 - protein, 8 aa, Mycobacterium tuberculosis
GAQAAFDK

SEQ ID NO: 1429895 - protein, 5 aa, Mycobacterium tuberculosis
GAQNP

SEQ ID NO: 1429896 - protein, 8 aa, Mycobacterium tuberculosis
GAQRDRAW

SEQ ID NO: 1429897 - protein, 4 aa, Mycobacterium tuberculosis
GAQT

SEQ ID NO: 1429898 - protein, 7 aa, Mycobacterium tuberculosis
GARAPQI

SEQ ID NO: 1429899 - protein, 7 aa, Mycobacterium tuberculosis
GARDGRT

SEQ ID NO: 1429900 - protein, 9 aa, Mycobacterium tuberculosis
GARQVPGRH

SEQ ID NO: 1429901 - protein, 4 aa, Mycobacterium tuberculosis
GARR

SEQ ID NO: 1429902 - protein, 7 aa, Mycobacterium tuberculosis
GASAAVQ

SEQ ID NO: 1429903 - protein, 8 aa, Mycobacterium tuberculosis
GASKGSIA

SEQ ID NO: 1429904 - protein, 10 aa, Mycobacterium tuberculosis
GASPTPASDV

SEQ ID NO: 1429905 - protein, 16 aa, Mycobacterium tuberculosis
GASSGIGAATATELAG

SEQ ID NO: 1429906 - protein, 13 aa, Mycobacterium tuberculosis
GASSGIGEATART

SEQ ID NO: 1429907 - protein, 10 aa, Mycobacterium tuberculosis
GATADALPPR

SEQ ID NO: 1429908 - protein, 5 aa, Mycobacterium tuberculosis
GATRR

SEQ ID NO: 1429909 - protein, 7 aa, Mycobacterium tuberculosis
GATTLGG

SEQ ID NO: 1429910 - protein, 9 aa, Mycobacterium tuberculosis
GATVTQTDA

SEQ ID NO: 1429911 - protein, 19 aa, Mycobacterium tuberculosis
GAWEGPSAEAYVAAHLPYL

SEQ ID NO: 1429912 - protein, 9 aa, Mycobacterium tuberculosis
GAWQGPSAA

SEQ ID NO: 1429913 - protein, 13 aa, Mycobacterium tuberculosis
GAWSNDSVSCPRS

SEQ ID NO: 1429914 - protein, 6 aa, Mycobacterium tuberculosis
GAYSRD

SEQ ID NO: 1429915 - protein, 5 aa, Mycobacterium tuberculosis
GCDVG

SEQ ID NO: 1429916 - protein, 12 aa, Mycobacterium tuberculosis
GDAARSVGRGRP

SEQ ID NO: 1429917 - protein, 16 aa, Mycobacterium tuberculosis
GDATMTAGNSTPLTDG

SEQ ID NO: 1429918 - protein, 6 aa, Mycobacterium tuberculosis
GDDDNE

SEQ ID NO: 1429919 - protein, 7 aa, Mycobacterium tuberculosis
GDDEETL

SEQ ID NO: 1429920 - protein, 18 aa, Mycobacterium tuberculosis
GDDPLGATQRITRRSQAA

SEQ ID NO: 1429921 - protein, 7 aa, Mycobacterium tuberculosis
GDEVSAA

SEQ ID NO: 1429922 - protein, 54 aa, Mycobacterium tuberculosis; identical to SEQ ID NO: 175031

SEQ ID NO: 1429923 - protein, 9 aa, Mycobacterium tuberculosis
GDGGAGGNA

SEQ ID NO: 1429924 - protein, 65 aa, Mycobacterium tuberculosis; identical to SEQ ID NO: 192534

SEQ ID NO: 1429925 - protein, 8 aa, Mycobacterium tuberculosis
GDGLGGSS

SEQ ID NO: 1429926 - protein, 20 aa, Mycobacterium tuberculosis
GDGNLGSGNVGSTNLGSGNF

SEQ ID NO: 1429927 - protein, 21 aa, Mycobacterium tuberculosis
GDGQRPRRGPRPRERRPASPS

SEQ ID NO: 1429928 - protein, 12 aa, Mycobacterium tuberculosis
GDHDEKRLTSCG

SEQ ID NO: 1429929 - protein, 11 aa, Mycobacterium tuberculosis
GDHHRTDRRTF

SEQ ID NO: 1429930 - protein, 6 aa, Mycobacterium tuberculosis
GDHSRL

SEQ ID NO: 1429931 - protein, 8 aa, Mycobacterium tuberculosis
GDKAFAAG

SEQ ID NO: 1429932 - protein, 6 aa, Mycobacterium tuberculosis
GDKTYR

SEQ ID NO: 1429933 - protein, 13 aa, Mycobacterium tuberculosis
GDKVPRKGGPGVT

SEQ ID NO: 1429934 - protein, 10 aa, Mycobacterium tuberculosis
GDLADQESLG

SEQ ID NO: 1429935 - protein, 6 aa, Mycobacterium tuberculosis
GDLANA

SEQ ID NO: 1429936 - protein, 9 aa, Mycobacterium tuberculosis
GDLDKVTGK

SEQ ID NO: 1429937 - protein, 6 aa, Mycobacterium tuberculosis
GDLPPR

SEQ ID NO: 1429938 - protein, 8 aa, Mycobacterium tuberculosis
GDMDPEGS

SEQ ID NO: 1429939 - protein, 6 aa, Mycobacterium tuberculosis
GDPAAR

SEQ ID NO: 1429940 - protein, 10 aa, Mycobacterium tuberculosis
GDPAKYGLSA

SEQ ID NO: 1429941 - protein, 10 aa, Mycobacterium tuberculosis
GDPDEDAGTA

SEQ ID NO: 1429942 - protein, 4 aa, Mycobacterium tuberculosis
GDPF

SEQ ID NO: 1429943 - protein, 10 aa, Mycobacterium tuberculosis
GDPGDLEGMG

SEQ ID NO: 1429944 - protein, 8 aa, Mycobacterium tuberculosis
GDPSVPSG

SEQ ID NO: 1429945 - protein, 8 aa, Mycobacterium tuberculosis
GDPTAWPG

SEQ ID NO: 1429946 - protein, 4 aa, Mycobacterium tuberculosis
GDQT

SEQ ID NO: 1429947 - protein, 7 aa, Mycobacterium tuberculosis
GDRGLKG

SEQ ID NO: 1429948 - protein, 12 aa, Mycobacterium tuberculosis
GDRHRAERDAHD

SEQ ID NO: 1429949 - protein, 5 aa, Mycobacterium tuberculosis
GDRNG

SEQ ID NO: 1429950 - protein, 7 aa, Mycobacterium tuberculosis
GDRSGDQ

SEQ ID NO: 1429951 - protein, 8 aa, Mycobacterium tuberculosis
GDSAGGTI

SEQ ID NO: 1429952 - protein, 14 aa, Mycobacterium tuberculosis
GDSNTGFANAGNVN

SEQ ID NO: 1429953 - protein, 5 aa, Mycobacterium tuberculosis
GDSVT

SEQ ID NO: 1429954 - protein, 7 aa, Mycobacterium tuberculosis
GDTITGA

SEQ ID NO: 1429955 - protein, 7 aa, Mycobacterium tuberculosis
GDVGNTA

SEQ ID NO: 1429956 - protein, 5 aa, Mycobacterium tuberculosis
GDVRG

SEQ ID NO: 1429957 - protein, 18 aa, Mycobacterium tuberculosis
GDVRVTDAADTGLSDASA

SEQ ID NO: 1429958 - protein, 8 aa, Mycobacterium tuberculosis
GDYDSATK

SEQ ID NO: 1429959 - protein, 10 aa, Mycobacterium tuberculosis
GEAGQSFATP

SEQ ID NO: 1429960 - protein, 4 aa, Mycobacterium tuberculosis
GEAT

SEQ ID NO: 1429961 - protein, 15 aa, Mycobacterium tuberculosis
GEDPSTRISSSYAPM

SEQ ID NO: 1429962 - protein, 6 aa, Mycobacterium tuberculosis
GEDQRQ

SEQ ID NO: 1429963 - protein, 11 aa, Mycobacterium tuberculosis
GEDSERLTGTA

SEQ ID NO: 1429964 - protein, 10 aa, Mycobacterium tuberculosis
GEDTNADEAL

SEQ ID NO: 1429965 - protein, 10 aa, Mycobacterium tuberculosis
GEEESGSPSL

SEQ ID NO: 1429966 - protein, 11 aa, Mycobacterium tuberculosis
GEFDARRRDQQ

SEQ ID NO: 1429967 - protein, 12 aa, Mycobacterium tuberculosis
GEGGGTGTGGAP

SEQ ID NO: 1429968 - protein, 6 aa, Mycobacterium tuberculosis
GEGTGL

SEQ ID NO: 1429969 - protein, 6 aa, Mycobacterium tuberculosis
GEGTTE

SEQ ID NO: 1429970 - protein, 9 aa, Mycobacterium tuberculosis
GEGVAAKSL

SEQ ID NO: 1429971 - protein, 8 aa, Mycobacterium tuberculosis
GEIDPATV

SEQ ID NO: 1429972 - protein, 8 aa, Mycobacterium tuberculosis
GEKMSKSV

SEQ ID NO: 1429973 - protein, 17 aa, Mycobacterium tuberculosis
GEKPGEPSWPTPWGRGR

SEQ ID NO: 1429974 - protein, 13 aa, Mycobacterium tuberculosis
GEKPNTHDDAEYD

SEQ ID NO: 1429975 - protein, 6 aa, Mycobacterium tuberculosis
GELPQT

SEQ ID NO: 1429976 - protein, 8 aa, Mycobacterium tuberculosis
GELRPGSR

SEQ ID NO: 1429977 - protein, 11 aa, Mycobacterium tuberculosis
GELTGSGRITT

SEQ ID NO: 1429978 - protein, 5 aa, Mycobacterium tuberculosis
GEMTS

SEQ ID NO: 1429979 - protein, 8 aa, Mycobacterium tuberculosis
GENISPRE

SEQ ID NO: 1429980 - protein, 6 aa, Mycobacterium tuberculosis
GEPGGR

SEQ ID NO: 1429981 - protein, 11 aa, Mycobacterium tuberculosis
GEPLSAEQTAR

SEQ ID NO: 1429982 - protein, 4 aa, Mycobacterium tuberculosis
GEQM

SEQ ID NO: 1429983 - protein, 7 aa, Mycobacterium tuberculosis
GEQRTRR

SEQ ID NO: 1429984 - protein, 4 aa, Mycobacterium tuberculosis
GEQT

SEQ ID NO: 1429985 - protein, 6 aa, Mycobacterium tuberculosis
GERGAL

SEQ ID NO: 1429986 - protein, 5 aa, Mycobacterium tuberculosis
GERTV

SEQ ID NO: 1429987 - protein, 4 aa, Mycobacterium tuberculosis
GERV

SEQ ID NO: 1429988 - protein, 8 aa, Mycobacterium tuberculosis
GESAKVSE

SEQ ID NO: 1429989 - protein, 11 aa, Mycobacterium tuberculosis
GESDDTSKLSR

SEQ ID NO: 1429990 - protein, 12 aa, Mycobacterium tuberculosis
GESDDTSKLSRE

SEQ ID NO: 1429991 - protein, 4 aa, Mycobacterium tuberculosis
GESV

SEQ ID NO: 1429992 - protein, 4 aa, Mycobacterium tuberculosis
GETP

SEQ ID NO: 1429993 - protein, 22 aa, Mycobacterium tuberculosis
GEVDLSSEEDTSEAEREERQKE

SEQ ID NO: 1429994 - protein, 5 aa, Mycobacterium tuberculosis
GEVEY

SEQ ID NO: 1429995 - protein, 5 aa, Mycobacterium tuberculosis
GEYKS

SEQ ID NO: 1429996 - protein, 7 aa, Mycobacterium tuberculosis
GFDAAEP

SEQ ID NO: 1429997 - protein, 5 aa, Mycobacterium tuberculosis
GFDPA

SEQ ID NO: 1429998 - protein, 9 aa, Mycobacterium tuberculosis
GFDPQRPSA

SEQ ID NO: 1429999 - protein, 19 aa, Mycobacterium tuberculosis
GFGNNGDNNLGLGNNGNNN

SEQ ID NO: 1430000 - protein, 6 aa, Mycobacterium tuberculosis
GFGPAE

SEQ ID NO: 1430001 - protein, 6 aa, Mycobacterium tuberculosis
GFPDST

SEQ ID NO: 1430002 - protein, 6 aa, Mycobacterium tuberculosis
GGAASH

SEQ ID NO: 1430003 - protein, 9 aa, Mycobacterium tuberculosis
GGAATTPTS

SEQ ID NO: 1430004 - protein, 7 aa, Mycobacterium tuberculosis
GGADPAV

SEQ ID NO: 1430005 - protein, 20 aa, Mycobacterium tuberculosis
GGAEPRPYEPTDETAPQGVY

SEQ ID NO: 1430006 - protein, 9 aa, Mycobacterium tuberculosis
GGAGGAGGA

SEQ ID NO: 1430007 - protein, 25 aa, Mycobacterium tuberculosis
GGAGGAGGAVTGTGATGGSGGAGGG

SEQ ID NO: 1430008 - protein, 25 aa, Mycobacterium tuberculosis
GGAGGAGGDSSFANGAAGGAGGAGG

SEQ ID NO: 1430009 - protein, 26 aa, Mycobacterium tuberculosis
GGAGGAGGSGGSGAAGGAGGAGGAGG

SEQ ID NO: 1430010 - protein, 15 aa, Mycobacterium tuberculosis
GGAGGAGGSSGIGGF

SEQ ID NO: 1430011 - protein, 10 aa, Mycobacterium tuberculosis
GGAGGDGGGA

SEQ ID NO: 1430012 - protein, 36 aa, Mycobacterium tuberculosis; identical to SEQ ID NO: 229824

SEQ ID NO: 1430013 - protein, 19 aa, Mycobacterium tuberculosis
GGAGGLGGTGASGGAGGAG

SEQ ID NO: 1430014 - protein, 7 aa, Mycobacterium tuberculosis
GGAGGQH

SEQ ID NO: 1430015 - protein, 28 aa, Mycobacterium tuberculosis
GGAGGTGGLSVNGGTGGTGGTGGGGGLF

SEQ ID NO: 1430016 - protein, 9 aa, Mycobacterium tuberculosis
GGAGGVGGL

SEQ ID NO: 1430017 - protein, 60 aa, Mycobacterium tuberculosis
GGAGGVGGVGAAGANGATPGQDGAAGVAGSDDGAGGDGLAGSDGGDGGAGGVGGNGGRGG

SEQ ID NO: 1430018 - protein, 4 aa, Mycobacterium tuberculosis
GGAH

SEQ ID NO: 1430019 - protein, 10 aa, Mycobacterium tuberculosis
GGALAQYDET

SEQ ID NO: 1430020 - protein, 8 aa, Mycobacterium tuberculosis
GGALEDPA

SEQ ID NO: 1430021 - protein, 6 aa, Mycobacterium tuberculosis
GGARLR

SEQ ID NO: 1430022 - protein, 6 aa, Mycobacterium tuberculosis
GGARPT

SEQ ID NO: 1430023 - protein, 8 aa, Mycobacterium tuberculosis
GGASGLGL

SEQ ID NO: 1430024 - protein, 10 aa, Mycobacterium tuberculosis
GGASQPRRTL

SEQ ID NO: 1430025 - protein, 4 aa, Mycobacterium tuberculosis
GGAT

SEQ ID NO: 1430026 - protein, 13 aa, Mycobacterium tuberculosis
GGDEEATVYAGTG

SEQ ID NO: 1430027 - protein, 5 aa, Mycobacterium tuberculosis
GGDPV

SEQ ID NO: 1430028 - protein, 5 aa, Mycobacterium tuberculosis
GGDRQ

SEQ ID NO: 1430029 - protein, 11 aa, Mycobacterium tuberculosis
GGDSLTTSGYP

SEQ ID NO: 1430030 - protein, 5 aa, Mycobacterium tuberculosis
GGEEA

SEQ ID NO: 1430031 - protein, 15 aa, Mycobacterium tuberculosis
GGEGHSGAIGGVGEQ

SEQ ID NO: 1430032 - protein, 9 aa, Mycobacterium tuberculosis
GGEPLPGEV

SEQ ID NO: 1430033 - protein, 18 aa, Mycobacterium tuberculosis
GGFGGAGGLGAAGGVGGA

SEQ ID NO: 1430034 - protein, 9 aa, Mycobacterium tuberculosis
GGGAATDVA

SEQ ID NO: 1430035 - protein, 9 aa, Mycobacterium tuberculosis
GGGAPSLAE

SEQ ID NO: 1430036 - protein, 24 aa, Mycobacterium tuberculosis
GGGGVGGMGGAGGGAGGAGGNAGL

SEQ ID NO: 1430037 - protein, 11 aa, Mycobacterium tuberculosis
GGGGYPAARAG

SEQ ID NO: 1430038 - protein, 9 aa, Mycobacterium tuberculosis
GGGNLGGQN

SEQ ID NO: 1430039 - protein, 11 aa, Mycobacterium tuberculosis
GGGQGNHLGGA

SEQ ID NO: 1430040 - protein, 9 aa, Mycobacterium tuberculosis
GGGTAEAVA

SEQ ID NO: 1430041 - protein, 10 aa, Mycobacterium tuberculosis
GGGTAEAVAN

SEQ ID NO: 1430042 - protein, 20 aa, Mycobacterium tuberculosis
GGGTGGSGVSGGAGGDGGAG

SEQ ID NO: 1430043 - protein, 18 aa, Mycobacterium tuberculosis
GGGTGPAEGTKATTVTPG

SEQ ID NO: 1430044 - protein, 8 aa, Mycobacterium tuberculosis
GGGTPGEA

SEQ ID NO: 1430045 - protein, 6 aa, Mycobacterium tuberculosis
GGGTRI

SEQ ID NO: 1430046 - protein, 5 aa, Mycobacterium tuberculosis
GGGVD

SEQ ID NO: 1430047 - protein, 21 aa, Mycobacterium tuberculosis
GGHGGAGGIGGGSGGAGGNGG

SEQ ID NO: 1430048 - protein, 4 aa, Mycobacterium tuberculosis
GGHV

SEQ ID NO: 1430049 - protein, 5 aa, Mycobacterium tuberculosis
GGKGR

SEQ ID NO: 1430050 - protein, 8 aa, Mycobacterium tuberculosis
GGKGRGTV

SEQ ID NO: 1430051 - protein, 4 aa, Mycobacterium tuberculosis
GGKR

SEQ ID NO: 1430052 - protein, 5 aa, Mycobacterium tuberculosis
GGLAT

SEQ ID NO: 1430053 - protein, 26 aa, Mycobacterium tuberculosis
GGLGGAGGMGGTGGGTGGTGGNGGNG

SEQ ID NO: 1430054 - protein, 9 aa, Mycobacterium tuberculosis
GGLNSGAGN

SEQ ID NO: 1430055 - protein, 13 aa, Mycobacterium tuberculosis
GGLYGTAGDNDGR

SEQ ID NO: 1430056 - protein, 12 aa, Mycobacterium tuberculosis
GGNGGDGGDGGG

SEQ ID NO: 1430057 - protein, 7 aa, Mycobacterium tuberculosis
GGNRDHR

SEQ ID NO: 1430058 - protein, 15 aa, Mycobacterium tuberculosis
GGNVSSEHGVGSRKR

SEQ ID NO: 1430059 - protein, 4 aa, Mycobacterium tuberculosis
GGPD

SEQ ID NO: 1430060 - protein, 7 aa, Mycobacterium tuberculosis
GGPRAAR

SEQ ID NO: 1430061 - protein, 5 aa, Mycobacterium tuberculosis
GGPTF

SEQ ID NO: 1430062 - protein, 8 aa, Mycobacterium tuberculosis
GGPTQPRS

SEQ ID NO: 1430063 - protein, 10 aa, Mycobacterium tuberculosis
GGPTVTNDGV

SEQ ID NO: 1430064 - protein, 15 aa, Mycobacterium tuberculosis
GGPVAAGLGNAASVG

SEQ ID NO: 1430065 - protein, 5 aa, Mycobacterium tuberculosis
GGQGF

SEQ ID NO: 1430066 - protein, 5 aa, Mycobacterium tuberculosis
GGQGS

SEQ ID NO: 1430067 - protein, 9 aa, Mycobacterium tuberculosis
GGQTPTSPL

SEQ ID NO: 1430068 - protein, 9 aa, Mycobacterium tuberculosis
GGQTSAESY

SEQ ID NO: 1430069 - protein, 9 aa, Mycobacterium tuberculosis
GGRAPKPGE

SEQ ID NO: 1430070 - protein, 4 aa, Mycobacterium tuberculosis
GGRC

SEQ ID NO: 1430071 - protein, 8 aa, Mycobacterium tuberculosis
GGRGEVQT

SEQ ID NO: 1430072 - protein, 4 aa, Mycobacterium tuberculosis
GGRI

SEQ ID NO: 1430073 - protein, 4 aa, Mycobacterium tuberculosis
GGRL

SEQ ID NO: 1430074 - protein, 7 aa, Mycobacterium tuberculosis
GGRPEGL

SEQ ID NO: 1430075 - protein, 4 aa, Mycobacterium tuberculosis
GGRR

SEQ ID NO: 1430076 - protein, 20 aa, Mycobacterium tuberculosis
GGRRAGKPGRRLIVIQLRSS

SEQ ID NO: 1430077 - protein, 7 aa, Mycobacterium tuberculosis
GGRTADT

SEQ ID NO: 1430078 - protein, 7 aa, Mycobacterium tuberculosis
GGRTRTR

SEQ ID NO: 1430079 - protein, 5 aa, Mycobacterium tuberculosis
GGRTV

SEQ ID NO: 1430080 - protein, 6 aa, Mycobacterium tuberculosis
GGSAGA

SEQ ID NO: 1430081 - protein, 5 aa, Mycobacterium tuberculosis
GGSAR

SEQ ID NO: 1430082 - protein, 7 aa, Mycobacterium tuberculosis
GGSCAPE

SEQ ID NO: 1430083 - protein, 9 aa, Mycobacterium tuberculosis
GGSGALAGH

SEQ ID NO: 1430084 - protein, 6 aa, Mycobacterium tuberculosis
GGSGDD

SEQ ID NO: 1430085 - protein, 21 aa, Mycobacterium tuberculosis
GGSGRNASRGRRAQGEPGRAV

SEQ ID NO: 1430086 - protein, 8 aa, Mycobacterium tuberculosis
GGSQTIGP

SEQ ID NO: 1430087 - protein, 8 aa, Mycobacterium tuberculosis
GGSTDETL

SEQ ID NO: 1430088 - protein, 17 aa, Mycobacterium tuberculosis
GGTDPQATAAPRRRTSP

SEQ ID NO: 1430089 - protein, 25 aa, Mycobacterium tuberculosis
GGTGGIGGTGAPGAMGGTGGNGGNG

SEQ ID NO: 1430090 - protein, 12 aa, Mycobacterium tuberculosis
GGVGEDITGGLP

SEQ ID NO: 1430091 - protein, 18 aa, Mycobacterium tuberculosis
GGVGGAGGIGGGTGGAGG

SEQ ID NO: 1430092 - protein, 32 aa, Mycobacterium tuberculosis; identical to SEQ ID NO: 175938

SEQ ID NO: 1430093 - protein, 26 aa, Mycobacterium tuberculosis
GGVGGTGGGAGSGGTGGVGGTGGAGG

SEQ ID NO: 1430094 - protein, 9 aa, Mycobacterium tuberculosis
GGWEPNAKG

SEQ ID NO: 1430095 - protein, 5 aa, Mycobacterium tuberculosis
GGYGF

SEQ ID NO: 1430096 - protein, 6 aa, Mycobacterium tuberculosis
GGYRVG

SEQ ID NO: 1430097 - protein, 4 aa, Mycobacterium tuberculosis
GHAE

SEQ ID NO: 1430098 - protein, 4 aa, Mycobacterium tuberculosis
GHDP

SEQ ID NO: 1430099 - protein, 5 aa, Mycobacterium tuberculosis
GHGAR

SEQ ID NO: 1430100 - protein, 4 aa, Mycobacterium tuberculosis
GHGY

SEQ ID NO: 1430101 - protein, 6 aa, Mycobacterium tuberculosis
GHGYGD

SEQ ID NO: 1430102 - protein, 20 aa, Mycobacterium tuberculosis
GHPEKDGGRRHSAGQPAEQV

SEQ ID NO: 1430103 - protein, 4 aa, Mycobacterium tuberculosis
GHRL

SEQ ID NO: 1430104 - protein, 7 aa, Mycobacterium tuberculosis
GHSEPAL

SEQ ID NO: 1430105 - protein, 15 aa, Mycobacterium tuberculosis
GHTPRQAADDPTRRA

SEQ ID NO: 1430106 - protein, 10 aa, Mycobacterium tuberculosis
GIAGEGNKEI

SEQ ID NO: 1430107 - protein, 5 aa, Mycobacterium tuberculosis
GIANR

SEQ ID NO: 1430108 - protein, 7 aa, Mycobacterium tuberculosis
GIDELTG

SEQ ID NO: 1430109 - protein, 12 aa, Mycobacterium tuberculosis
GIEPSEITPEKS

SEQ ID NO: 1430110 - protein, 7 aa, Mycobacterium tuberculosis
GIEQTNA

SEQ ID NO: 1430111 - protein, 22 aa, Mycobacterium tuberculosis
GIGGAGGPGFNGGAGGAGGRSG

SEQ ID NO: 1430112 - protein, 8 aa, Mycobacterium tuberculosis
GIGKRGAE

SEQ ID NO: 1430113 - protein, 6 aa, Mycobacterium tuberculosis
GIGNTG

SEQ ID NO: 1430114 - protein, 7 aa, Mycobacterium tuberculosis
GIGPEVT

SEQ ID NO: 1430115 - protein, 8 aa, Mycobacterium tuberculosis
GIGTPRRA

SEQ ID NO: 1430116 - protein, 5 aa, Mycobacterium tuberculosis
GIGVT

SEQ ID NO: 1430117 - protein, 11 aa, Mycobacterium tuberculosis
GIPDEAIDPGG

SEQ ID NO: 1430118 - protein, 4 aa, Mycobacterium tuberculosis
GIPP

SEQ ID NO: 1430119 - protein, 11 aa, Mycobacterium tuberculosis
GIPPDSLGGTR

SEQ ID NO: 1430120 - protein, 12 aa, Mycobacterium tuberculosis
GIQRAKAAELRE

SEQ ID NO: 1430121 - protein, 5 aa, Mycobacterium tuberculosis
GIRKS

SEQ ID NO: 1430122 - protein, 11 aa, Mycobacterium tuberculosis
GISGDITESGL

SEQ ID NO: 1430123 - protein, 14 aa, Mycobacterium tuberculosis
GITDPSHERYKEAA

SEQ ID NO: 1430124 - protein, 7 aa, Mycobacterium tuberculosis
GITEPAG

SEQ ID NO: 1430125 - protein, 5 aa, Mycobacterium tuberculosis
GITPE

SEQ ID NO: 1430126 - protein, 9 aa, Mycobacterium tuberculosis
GKAFSSGGS

SEQ ID NO: 1430127 - protein, 12 aa, Mycobacterium tuberculosis
GKAGGTIGRNNS

SEQ ID NO: 1430128 - protein, 12 aa, Mycobacterium tuberculosis
GKDGQPTQGGYS

SEQ ID NO: 1430129 - protein, 8 aa, Mycobacterium tuberculosis
GKEGQNAR

SEQ ID NO: 1430130 - protein, 6 aa, Mycobacterium tuberculosis
GKGKRI

SEQ ID NO: 1430131 - protein, 8 aa, Mycobacterium tuberculosis
GKLGQHNG

SEQ ID NO: 1430132 - protein, 6 aa, Mycobacterium tuberculosis
GKLTNT

SEQ ID NO: 1430133 - protein, 7 aa, Mycobacterium tuberculosis
GKPANPD

SEQ ID NO: 1430134 - protein, 9 aa, Mycobacterium tuberculosis
GKPLQSVAK

SEQ ID NO: 1430135 - protein, 6 aa, Mycobacterium tuberculosis
GKQAHE

SEQ ID NO: 1430136 - protein, 4 aa, Mycobacterium tuberculosis
GKRI

SEQ ID NO: 1430137 - protein, 5 aa, Mycobacterium tuberculosis
GKTQA

SEQ ID NO: 1430138 - protein, 11 aa, Mycobacterium tuberculosis
GKVAAGETERA

SEQ ID NO: 1430139 - protein, 16 aa, Mycobacterium tuberculosis
GKVSEVNSDLDGTPQL

SEQ ID NO: 1430140 - protein, 9 aa, Mycobacterium tuberculosis
GLAAADTGL

SEQ ID NO: 1430141 - protein, 4 aa, Mycobacterium tuberculosis
GLAD

SEQ ID NO: 1430142 - protein, 26 aa, Mycobacterium tuberculosis
GLAGGAGGGGGQGFDTGGAGGPGGDA

SEQ ID NO: 1430143 - protein, 23 aa, Mycobacterium tuberculosis
GLAPDGRCKPYAGRADGVGWSEG

SEQ ID NO: 1430144 - protein, 6 aa, Mycobacterium tuberculosis
GLASPV

SEQ ID NO: 1430145 - protein, 7 aa, Mycobacterium tuberculosis
GLDPKTT

SEQ ID NO: 1430146 - protein, 5 aa, Mycobacterium tuberculosis
GLERT

SEQ ID NO: 1430147 - protein, 17 aa, Mycobacterium tuberculosis
GLESPEEESAARASGRV

SEQ ID NO: 1430148 - protein, 16 aa, Mycobacterium tuberculosis
GLGGAGGAGGVDGAIG

SEQ ID NO: 1430149 - protein, 14 aa, Mycobacterium tuberculosis
GLGGQTPVADMTDD

SEQ ID NO: 1430150 - protein, 13 aa, Mycobacterium tuberculosis
GLGNAGELNTGFG

SEQ ID NO: 1430151 - protein, 10 aa, Mycobacterium tuberculosis
GLGNAGSLAS

SEQ ID NO: 1430152 - protein, 5 aa, Mycobacterium tuberculosis
GLGRT

SEQ ID NO: 1430153 - protein, 6 aa, Mycobacterium tuberculosis
GLHSNG

SEQ ID NO: 1430154 - protein, 11 aa, Mycobacterium tuberculosis
GLNPTGSFKDR

SEQ ID NO: 1430155 - protein, 5 aa, Mycobacterium tuberculosis
GLPAG

SEQ ID NO: 1430156 - protein, 12 aa, Mycobacterium tuberculosis
GLPGARARRRAL

SEQ ID NO: 1430157 - protein, 22 aa, Mycobacterium tuberculosis
GLPGARARRRGLSDSALGTPRR

SEQ ID NO: 1430158 - protein, 8 aa, Mycobacterium tuberculosis
GLPGEWPT

SEQ ID NO: 1430159 - protein, 6 aa, Mycobacterium tuberculosis
GLPPAE

SEQ ID NO: 1430160 - protein, 7 aa, Mycobacterium tuberculosis
GLPPKRR

SEQ ID NO: 1430161 - protein, 8 aa, Mycobacterium tuberculosis
GLPSAAQQ

SEQ ID NO: 1430162 - protein, 8 aa, Mycobacterium tuberculosis
GLPTHQDN

SEQ ID NO: 1430163 - protein, 23 aa, Mycobacterium tuberculosis
GLQARAGLGRADGKPEAEAAEPL

SEQ ID NO: 1430164 - protein, 5 aa, Mycobacterium tuberculosis
GLQEK

SEQ ID NO: 1430165 - protein, 9 aa, Mycobacterium tuberculosis
GLRAKGSKL

SEQ ID NO: 1430166 - protein, 4 aa, Mycobacterium tuberculosis
GLRD

SEQ ID NO: 1430167 - protein, 8 aa, Mycobacterium tuberculosis
GLRGATQQ

SEQ ID NO: 1430168 - protein, 8 aa, Mycobacterium tuberculosis
GLRKPSAD

SEQ ID NO: 1430169 - protein, 10 aa, Mycobacterium tuberculosis
GLSDARDRQV

SEQ ID NO: 1430170 - protein, 6 aa, Mycobacterium tuberculosis
GLTGST

SEQ ID NO: 1430171 - protein, 4 aa, Mycobacterium tuberculosis
GLTP

SEQ ID NO: 1430172 - protein, 7 aa, Mycobacterium tuberculosis
GLTPADV

SEQ ID NO: 1430173 - protein, 6 aa, Mycobacterium tuberculosis
GLTPTE

SEQ ID NO: 1430174 - protein, 9 aa, Mycobacterium tuberculosis
GMASDQPLA

SEQ ID NO: 1430175 - protein, 4 aa, Mycobacterium tuberculosis
GMGG

SEQ ID NO: 1430176 - protein, 13 aa, Mycobacterium tuberculosis
GMPDPEPPHSDGP

SEQ ID NO: 1430177 - protein, 5 aa, Mycobacterium tuberculosis
GMTEP

SEQ ID NO: 1430178 - protein, 9 aa, Mycobacterium tuberculosis
GNAGGTNVG

SEQ ID NO: 1430179 - protein, 40 aa, Mycobacterium tuberculosis; identical to SEQ ID NO: 176373

SEQ ID NO: 1430180 - protein, 16 aa, Mycobacterium tuberculosis
GNANTGVANSGNVDTG

SEQ ID NO: 1430181 - protein, 6 aa, Mycobacterium tuberculosis
GNASAP

SEQ ID NO: 1430182 - protein, 4 aa, Mycobacterium tuberculosis
GNDR

SEQ ID NO: 1430183 - protein, 9 aa, Mycobacterium tuberculosis
GNETTRNSI

SEQ ID NO: 1430184 - protein, 18 aa, Mycobacterium tuberculosis
GNGADGSTPGQAGGPGGL

SEQ ID NO: 1430185 - protein, 25 aa, Mycobacterium tuberculosis
GNGGAGGAASGVGNGGVGGAGGAGG

SEQ ID NO: 1430186 - protein, 33 aa, Mycobacterium tuberculosis; identical to SEQ ID NO: 229981

SEQ ID NO: 1430187 - protein, 24 aa, Mycobacterium tuberculosis
GNGGNGGSSSTPGQPGGRGGAAGL

SEQ ID NO: 1430188 - protein, 8 aa, Mycobacterium tuberculosis
GNGGPGGF

SEQ ID NO: 1430189 - protein, 37 aa, Mycobacterium tuberculosis; identical to SEQ ID NO: 176423

SEQ ID NO: 1430190 - protein, 12 aa, Mycobacterium tuberculosis
GNGLKDPDTALK

SEQ ID NO: 1430191 - protein, 25 aa, Mycobacterium tuberculosis
GNGNLGIGNSSDANVGIGNSGATVG

SEQ ID NO: 1430192 - protein, 6 aa, Mycobacterium tuberculosis
GNGVGD

SEQ ID NO: 1430193 - protein, 13 aa, Mycobacterium tuberculosis
GNHENEVGNGPIG

SEQ ID NO: 1430194 - protein, 12 aa, Mycobacterium tuberculosis
GNKSRAIAAARE

SEQ ID NO: 1430195 - protein, 7 aa, Mycobacterium tuberculosis
GNLRAGD

SEQ ID NO: 1430196 - protein, 12 aa, Mycobacterium tuberculosis
GNPGTGKSTLAR

SEQ ID NO: 1430197 - protein, 6 aa, Mycobacterium tuberculosis
GNPVPS

SEQ ID NO: 1430198 - protein, 14 aa, Mycobacterium tuberculosis
GNRPAHVVNPEVLG

SEQ ID NO: 1430199 - protein, 9 aa, Mycobacterium tuberculosis
GNRRPTGQR

SEQ ID NO: 1430200 - protein, 9 aa, Mycobacterium tuberculosis
GNTGSGNFG

SEQ ID NO: 1430201 - protein, 7 aa, Mycobacterium tuberculosis
GNTVNPD

SEQ ID NO: 1430202 - protein, 5 aa, Mycobacterium tuberculosis
GNVGN

SEQ ID NO: 1430203 - protein, 12 aa, Mycobacterium tuberculosis
GNVNTGAFDTGD

SEQ ID NO: 1430204 - protein, 16 aa, Mycobacterium tuberculosis
GNYNTGVGNAGTASTG

SEQ ID NO: 1430205 - protein, 6 aa, Mycobacterium tuberculosis
GPAAPW

SEQ ID NO: 1430206 - protein, 7 aa, Mycobacterium tuberculosis
GPAFPRA

SEQ ID NO: 1430207 - protein, 14 aa, Mycobacterium tuberculosis
GPALSAAAEQGGLA

SEQ ID NO: 1430208 - protein, 5 aa, Mycobacterium tuberculosis
GPAQR

SEQ ID NO: 1430209 - protein, 5 aa, Mycobacterium tuberculosis
GPAVA

SEQ ID NO: 1430210 - protein, 5 aa, Mycobacterium tuberculosis
GPAVG

SEQ ID NO: 1430211 - protein, 7 aa, Mycobacterium tuberculosis
GPDDEIG

SEQ ID NO: 1430212 - protein, 14 aa, Mycobacterium tuberculosis
GPDETPPQGWEQDP

SEQ ID NO: 1430213 - protein, 8 aa, Mycobacterium tuberculosis
GPDGTGVE

SEQ ID NO: 1430214 - protein, 9 aa, Mycobacterium tuberculosis
GPDTTNLGE

SEQ ID NO: 1430215 - protein, 9 aa, Mycobacterium tuberculosis
GPDVPTLSQ

SEQ ID NO: 1430216 - protein, 8 aa, Mycobacterium tuberculosis
GPEGPEQV

SEQ ID NO: 1430217 - protein, 5 aa, Mycobacterium tuberculosis
GPEIG

SEQ ID NO: 1430218 - protein, 9 aa, Mycobacterium tuberculosis
GPEPGADDA

SEQ ID NO: 1430219 - protein, 15 aa, Mycobacterium tuberculosis
GPEPHGAGLANSGFR

SEQ ID NO: 1430220 - protein, 9 aa, Mycobacterium tuberculosis
GPESVDTAQ

SEQ ID NO: 1430221 - protein, 6 aa, Mycobacterium tuberculosis
GPFPKA

SEQ ID NO: 1430222 - protein, 7 aa, Mycobacterium tuberculosis
GPGDPEL

SEQ ID NO: 1430223 - protein, 4 aa, Mycobacterium tuberculosis
GPGL

SEQ ID NO: 1430224 - protein, 6 aa, Mycobacterium tuberculosis
GPGVTD

SEQ ID NO: 1430225 - protein, 9 aa, Mycobacterium tuberculosis
GPIAGSAKA

SEQ ID NO: 1430226 - protein, 7 aa, Mycobacterium tuberculosis
GPKEHAS

SEQ ID NO: 1430227 - protein, 10 aa, Mycobacterium tuberculosis
GPLPSHPDED

SEQ ID NO: 1430228 - protein, 9 aa, Mycobacterium tuberculosis
GPNGAGKST

SEQ ID NO: 1430229 - protein, 10 aa, Mycobacterium tuberculosis
GPNGSGKSTL

SEQ ID NO: 1430230 - protein, 7 aa, Mycobacterium tuberculosis
GPNRIGQ

SEQ ID NO: 1430231 - protein, 4 aa, Mycobacterium tuberculosis
GPNV

SEQ ID NO: 1430232 - protein, 14 aa, Mycobacterium tuberculosis
GPPESAQVQVGDGE

SEQ ID NO: 1430233 - protein, 7 aa, Mycobacterium tuberculosis
GPPLTRS

SEQ ID NO: 1430234 - protein, 5 aa, Mycobacterium tuberculosis
GPPPA

SEQ ID NO: 1430235 - protein, 14 aa, Mycobacterium tuberculosis
GPPRQLPADSPQGQ

SEQ ID NO: 1430236 - protein, 17 aa, Mycobacterium tuberculosis
GPQDSESGAPDETATAM

SEQ ID NO: 1430237 - protein, 6 aa, Mycobacterium tuberculosis
GPRDAD

SEQ ID NO: 1430238 - protein, 6 aa, Mycobacterium tuberculosis
GPREQA

SEQ ID NO: 1430239 - protein, 11 aa, Mycobacterium tuberculosis
GPRTSGTAAER

SEQ ID NO: 1430240 - protein, 7 aa, Mycobacterium tuberculosis
GPSDTWS

SEQ ID NO: 1430241 - protein, 12 aa, Mycobacterium tuberculosis
GPSGDQPLDAGT

SEQ ID NO: 1430242 - protein, 11 aa, Mycobacterium tuberculosis
GPSGKRPGAIA

SEQ ID NO: 1430243 - protein, 9 aa, Mycobacterium tuberculosis
GPSGSGKTT

SEQ ID NO: 1430244 - protein, 6 aa, Mycobacterium tuberculosis
GPTETT

SEQ ID NO: 1430245 - protein, 9 aa, Mycobacterium tuberculosis
GPVDDDAEV

SEQ ID NO: 1430246 - protein, 4 aa, Mycobacterium tuberculosis
GPVR

SEQ ID NO: 1430247 - protein, 11 aa, Mycobacterium tuberculosis
GPVRGANDQRW

SEQ ID NO: 1430248 - protein, 14 aa, Mycobacterium tuberculosis
GPVRTELPDASEAS

SEQ ID NO: 1430249 - protein, 4 aa, Mycobacterium tuberculosis
GPWG

SEQ ID NO: 1430250 - protein, 8 aa, Mycobacterium tuberculosis
GQAGPDTL

SEQ ID NO: 1430251 - protein, 7 aa, Mycobacterium tuberculosis
GQAGRLP

SEQ ID NO: 1430252 - protein, 14 aa, Mycobacterium tuberculosis
GQAKRAENGSEGAN

SEQ ID NO: 1430253 - protein, 4 aa, Mycobacterium tuberculosis
GQAN

SEQ ID NO: 1430254 - protein, 6 aa, Mycobacterium tuberculosis
GQAPAR

SEQ ID NO: 1430255 - protein, 10 aa, Mycobacterium tuberculosis
GQAPDASGYW

SEQ ID NO: 1430256 - protein, 10 aa, Mycobacterium tuberculosis
GQAPPLGAEG

SEQ ID NO: 1430257 - protein, 5 aa, Mycobacterium tuberculosis
GQDAE

SEQ ID NO: 1430258 - protein, 4 aa, Mycobacterium tuberculosis
GQDG

SEQ ID NO: 1430259 - protein, 6 aa, Mycobacterium tuberculosis
GQEPVS

SEQ ID NO: 1430260 - protein, 7 aa, Mycobacterium tuberculosis
GQESMTK

SEQ ID NO: 1430261 - protein, 9 aa, Mycobacterium tuberculosis
GQFDPTTMG

SEQ ID NO: 1430262 - protein, 7 aa, Mycobacterium tuberculosis
GQGSQWA

SEQ ID NO: 1430263 - protein, 5 aa, Mycobacterium tuberculosis
GQLTR

SEQ ID NO: 1430264 - protein, 19 aa, Mycobacterium tuberculosis
GQMSASAGPVSGRMDPSPV

SEQ ID NO: 1430265 - protein, 5 aa, Mycobacterium tuberculosis
GQPAS

SEQ ID NO: 1430266 - protein, 6 aa, Mycobacterium tuberculosis
GQPATE

SEQ ID NO: 1430267 - protein, 17 aa, Mycobacterium tuberculosis
GQPWTPASRSALAGPPR

SEQ ID NO: 1430268 - protein, 7 aa, Mycobacterium tuberculosis
GQQQAQA

SEQ ID NO: 1430269 - protein, 8 aa, Mycobacterium tuberculosis
GQQTVTTA

SEQ ID NO: 1430270 - protein, 9 aa, Mycobacterium tuberculosis
GQRKQPTDV

SEQ ID NO: 1430271 - protein, 7 aa, Mycobacterium tuberculosis
GQRNKYE

SEQ ID NO: 1430272 - protein, 4 aa, Mycobacterium tuberculosis
GQSE

SEQ ID NO: 1430273 - protein, 6 aa, Mycobacterium tuberculosis
GQSGAL

SEQ ID NO: 1430274 - protein, 32 aa, Mycobacterium tuberculosis
GQSGQPGQFGSPGADGRGGAGGAGGGGGAGGS

SEQ ID NO: 1430275 - protein, 6 aa, Mycobacterium tuberculosis
GQSLTP

SEQ ID NO: 1430276 - protein, 7 aa, Mycobacterium tuberculosis
GQSPTTI

SEQ ID NO: 1430277 - protein, 7 aa, Mycobacterium tuberculosis
GQTHRSA

SEQ ID NO: 1430278 - protein, 4 aa, Mycobacterium tuberculosis
GQTV

SEQ ID NO: 1430279 - protein, 20 aa, Mycobacterium tuberculosis
GQYSPTSEVGKVTKSTPMGS

SEQ ID NO: 1430280 - protein, 6 aa, Mycobacterium tuberculosis
GRAAEA

SEQ ID NO: 1430281 - protein, 6 aa, Mycobacterium tuberculosis
GRAARG

SEQ ID NO: 1430282 - protein, 11 aa, Mycobacterium tuberculosis
GRADREAAKTR

SEQ ID NO: 1430283 - protein, 8 aa, Mycobacterium tuberculosis
GRAGGHHS

SEQ ID NO: 1430284 - protein, 10 aa, Mycobacterium tuberculosis
GRAGVSATPR

SEQ ID NO: 1430285 - protein, 5 aa, Mycobacterium tuberculosis
GRALA

SEQ ID NO: 1430286 - protein, 15 aa, Mycobacterium tuberculosis
GRAPRPAHRCPARRH

SEQ ID NO: 1430287 - protein, 8 aa, Mycobacterium tuberculosis
GRAPRTDD

SEQ ID NO: 1430288 - protein, 8 aa, Mycobacterium tuberculosis
GRCDQGEH

SEQ ID NO: 1430289 - protein, 7 aa, Mycobacterium tuberculosis
GRDGWVG

SEQ ID NO: 1430290 - protein, 6 aa, Mycobacterium tuberculosis
GRDPYP

SEQ ID NO: 1430291 - protein, 5 aa, Mycobacterium tuberculosis
GRFEQ

SEQ ID NO: 1430292 - protein, 9 aa, Mycobacterium tuberculosis
GRGRADDTD

SEQ ID NO: 1430293 - protein, 10 aa, Mycobacterium tuberculosis
GRGRHTSTRS

SEQ ID NO: 1430294 - protein, 16 aa, Mycobacterium tuberculosis
GRGSPQGLAASKALTT

SEQ ID NO: 1430295 - protein, 12 aa, Mycobacterium tuberculosis
GRGTADDKAGIA

SEQ ID NO: 1430296 - protein, 17 aa, Mycobacterium tuberculosis
GRGYETAESLAARGERA

SEQ ID NO: 1430297 - protein, 5 aa, Mycobacterium tuberculosis
GRHGE

SEQ ID NO: 1430298 - protein, 4 aa, Mycobacterium tuberculosis
GRHR

SEQ ID NO: 1430299 - protein, 5 aa, Mycobacterium tuberculosis
GRIDE

SEQ ID NO: 1430300 - protein, 13 aa, Mycobacterium tuberculosis
GRKGWDGFALALV

SEQ ID NO: 1430301 - protein, 7 aa, Mycobacterium tuberculosis
GRKMTTD

SEQ ID NO: 1430302 - protein, 6 aa, Mycobacterium tuberculosis
GRKTGR

SEQ ID NO: 1430303 - protein, 6 aa, Mycobacterium tuberculosis
GRLGTR

SEQ ID NO: 1430304 - protein, 6 aa, Mycobacterium tuberculosis
GRPAEA

SEQ ID NO: 1430305 - protein, 6 aa, Mycobacterium tuberculosis
GRPDRR

SEQ ID NO: 1430306 - protein, 15 aa, Mycobacterium tuberculosis
GRPDVDDLGTSYGEA

SEQ ID NO: 1430307 - protein, 17 aa, Mycobacterium tuberculosis
GRPDVDDLGTSYGEAHL

SEQ ID NO: 1430308 - protein, 4 aa, Mycobacterium tuberculosis
GRPH

SEQ ID NO: 1430309 - protein, 9 aa, Mycobacterium tuberculosis
GRPVPAAHP

SEQ ID NO: 1430310 - protein, 7 aa, Mycobacterium tuberculosis
GRQGQTD

SEQ ID NO: 1430311 - protein, 5 aa, Mycobacterium tuberculosis
GRQVG

SEQ ID NO: 1430312 - protein, 10 aa, Mycobacterium tuberculosis
GRRAAGTGAR

SEQ ID NO: 1430313 - protein, 26 aa, Mycobacterium tuberculosis
GRRADKTVTRGDRVGASGSLDALPAL

SEQ ID NO: 1430314 - protein, 6 aa, Mycobacterium tuberculosis
GRRARA

SEQ ID NO: 1430315 - protein, 20 aa, Mycobacterium tuberculosis
GRRPTPGTAAYGAAKAGLEN

SEQ ID NO: 1430316 - protein, 7 aa, Mycobacterium tuberculosis
GRRRGRP

SEQ ID NO: 1430317 - protein, 10 aa, Mycobacterium tuberculosis
GRRRHRGGAA

SEQ ID NO: 1430318 - protein, 19 aa, Mycobacterium tuberculosis
GRSASKGIAGTSPGTSTRL

SEQ ID NO: 1430319 - protein, 6 aa, Mycobacterium tuberculosis
GRSIRR

SEQ ID NO: 1430320 - protein, 13 aa, Mycobacterium tuberculosis
GRSYGDNAQNGGG

SEQ ID NO: 1430321 - protein, 12 aa, Mycobacterium tuberculosis
GRTDRDTRNGRK

SEQ ID NO: 1430322 - protein, 8 aa, Mycobacterium tuberculosis
GRTHPTVA

SEQ ID NO: 1430323 - protein, 11 aa, Mycobacterium tuberculosis
GRTNYRNPATD

SEQ ID NO: 1430324 - protein, 9 aa, Mycobacterium tuberculosis
GRTRPDQEK

SEQ ID NO: 1430325 - protein, 7 aa, Mycobacterium tuberculosis
GRTRQNL

SEQ ID NO: 1430326 - protein, 5 aa, Mycobacterium tuberculosis
GRTYN

SEQ ID NO: 1430327 - protein, 7 aa, Mycobacterium tuberculosis
GRVGGQA

SEQ ID NO: 1430328 - protein, 6 aa, Mycobacterium tuberculosis
GSAATI

SEQ ID NO: 1430329 - protein, 10 aa, Mycobacterium tuberculosis
GSAEVSHVGD

SEQ ID NO: 1430330 - protein, 6 aa, Mycobacterium tuberculosis
GSAGAR

SEQ ID NO: 1430331 - protein, 7 aa, Mycobacterium tuberculosis
GSAGNSF

SEQ ID NO: 1430332 - protein, 7 aa, Mycobacterium tuberculosis
GSAQSNA

SEQ ID NO: 1430333 - protein, 6 aa, Mycobacterium tuberculosis
GSATAL

SEQ ID NO: 1430334 - protein, 4 aa, Mycobacterium tuberculosis
GSAV

SEQ ID NO: 1430335 - protein, 4 aa, Mycobacterium tuberculosis
GSCR

SEQ ID NO: 1430336 - protein, 4 aa, Mycobacterium tuberculosis
GSDA

SEQ ID NO: 1430337 - protein, 8 aa, Mycobacterium tuberculosis
GSDEASVV

SEQ ID NO: 1430338 - protein, 10 aa, Mycobacterium tuberculosis
GSDSGGGAGI

SEQ ID NO: 1430339 - protein, 8 aa, Mycobacterium tuberculosis
GSDTGGSI

SEQ ID NO: 1430340 - protein, 7 aa, Mycobacterium tuberculosis
GSEADEV

SEQ ID NO: 1430341 - protein, 8 aa, Mycobacterium tuberculosis
GSEADEVA

SEQ ID NO: 1430342 - protein, 5 aa, Mycobacterium tuberculosis
GSEAE

SEQ ID NO: 1430343 - protein, 6 aa, Mycobacterium tuberculosis
GSEPIA

SEQ ID NO: 1430344 - protein, 17 aa, Mycobacterium tuberculosis
GSEQTAAAEGKVGNVRR

SEQ ID NO: 1430345 - protein, 5 aa, Mycobacterium tuberculosis
GSGAP

SEQ ID NO: 1430346 - protein, 7 aa, Mycobacterium tuberculosis
GSGDDSL

SEQ ID NO: 1430347 - protein, 9 aa, Mycobacterium tuberculosis
GSGESSERV

SEQ ID NO: 1430348 - protein, 9 aa, Mycobacterium tuberculosis
GSGGAGGSR

SEQ ID NO: 1430349 - protein, 4 aa, Mycobacterium tuberculosis
GSGL

SEQ ID NO: 1430350 - protein, 8 aa, Mycobacterium tuberculosis
GSGLSSSA

SEQ ID NO: 1430351 - protein, 6 aa, Mycobacterium tuberculosis
GSGNFG

SEQ ID NO: 1430352 - protein, 14 aa, Mycobacterium tuberculosis
GSGNGNVGIGPSSF

SEQ ID NO: 1430353 - protein, 9 aa, Mycobacterium tuberculosis
GSGNVGSYN

SEQ ID NO: 1430354 - protein, 8 aa, Mycobacterium tuberculosis
GSGQDDFG

SEQ ID NO: 1430355 - protein, 9 aa, Mycobacterium tuberculosis
GSGRRRGKL

SEQ ID NO: 1430356 - protein, 4 aa, Mycobacterium tuberculosis
GSGV

SEQ ID NO: 1430357 - protein, 6 aa, Mycobacterium tuberculosis
GSGVTV

SEQ ID NO: 1430358 - protein, 11 aa, Mycobacterium tuberculosis
GSIDGARSAAA

SEQ ID NO: 1430359 - protein, 4 aa, Mycobacterium tuberculosis
GSIV

SEQ ID NO: 1430360 - protein, 6 aa, Mycobacterium tuberculosis
GSKEAR

SEQ ID NO: 1430361 - protein, 8 aa, Mycobacterium tuberculosis
GSKTTGWL

SEQ ID NO: 1430362 - protein, 6 aa, Mycobacterium tuberculosis
GSLESD

SEQ ID NO: 1430363 - protein, 9 aa, Mycobacterium tuberculosis
GSLSAAGDL

SEQ ID NO: 1430364 - protein, 6 aa, Mycobacterium tuberculosis
GSNNVG

SEQ ID NO: 1430365 - protein, 4 aa, Mycobacterium tuberculosis
GSNQ

SEQ ID NO: 1430366 - protein, 5 aa, Mycobacterium tuberculosis
GSPGR

SEQ ID NO: 1430367 - protein, 12 aa, Mycobacterium tuberculosis
GSPTDTRGLDDH

SEQ ID NO: 1430368 - protein, 6 aa, Mycobacterium tuberculosis
GSRAAT

SEQ ID NO: 1430369 - protein, 5 aa, Mycobacterium tuberculosis
GSRDG

SEQ ID NO: 1430370 - protein, 19 aa, Mycobacterium tuberculosis
GSRGCAPESAESEAHYPGT

SEQ ID NO: 1430371 - protein, 4 aa, Mycobacterium tuberculosis
GSRV

SEQ ID NO: 1430372 - protein, 4 aa, Mycobacterium tuberculosis
GSRY

SEQ ID NO: 1430373 - protein, 8 aa, Mycobacterium tuberculosis
GSSPGGLR

SEQ ID NO: 1430374 - protein, 8 aa, Mycobacterium tuberculosis
GSTAEGQR

SEQ ID NO: 1430375 - protein, 7 aa, Mycobacterium tuberculosis
GSTALTS

SEQ ID NO: 1430376 - protein, 5 aa, Mycobacterium tuberculosis
GSTVG

SEQ ID NO: 1430377 - protein, 5 aa, Mycobacterium tuberculosis
GSVSV

SEQ ID NO: 1430378 - protein, 7 aa, Mycobacterium tuberculosis
GSYPQTS

SEQ ID NO: 1430379 - protein, 16 aa, Mycobacterium tuberculosis
GSYSTGVGNAGTASTG

SEQ ID NO: 1430380 - protein, 9 aa, Mycobacterium tuberculosis
GTAPENGYS

SEQ ID NO: 1430381 - protein, 16 aa, Mycobacterium tuberculosis
GTASNETVAAPAGLTT

SEQ ID NO: 1430382 - protein, 13 aa, Mycobacterium tuberculosis
GTAVGTGLNAPDD

SEQ ID NO: 1430383 - protein, 33 aa, Mycobacterium tuberculosis; identical to SEQ ID NO: 177395

SEQ ID NO: 1430384 - protein, 8 aa, Mycobacterium tuberculosis
GTAVTPAS

SEQ ID NO: 1430385 - protein, 6 aa, Mycobacterium tuberculosis
GTAYTE

SEQ ID NO: 1430386 - protein, 9 aa, Mycobacterium tuberculosis
GTDADTGAV

SEQ ID NO: 1430387 - protein, 6 aa, Mycobacterium tuberculosis
GTDGVE

SEQ ID NO: 1430388 - protein, 8 aa, Mycobacterium tuberculosis
GTDHAGIA

SEQ ID NO: 1430389 - protein, 6 aa, Mycobacterium tuberculosis
GTDKPD

SEQ ID NO: 1430390 - protein, 6 aa, Mycobacterium tuberculosis
GTDRSW

SEQ ID NO: 1430391 - protein, 4 aa, Mycobacterium tuberculosis
GTEL

SEQ ID NO: 1430392 - protein, 4 aa, Mycobacterium tuberculosis
GTEP

SEQ ID NO: 1430393 - protein, 7 aa, Mycobacterium tuberculosis
GTFGGNP

SEQ ID NO: 1430394 - protein, 5 aa, Mycobacterium tuberculosis
GTFGS

SEQ ID NO: 1430395 - protein, 6 aa, Mycobacterium tuberculosis
GTGGIK

SEQ ID NO: 1430396 - protein, 7 aa, Mycobacterium tuberculosis
GTGLSER

SEQ ID NO: 1430397 - protein, 8 aa, Mycobacterium tuberculosis
GTGLSERE

SEQ ID NO: 1430398 - protein, 8 aa, Mycobacterium tuberculosis
GTGNFGIG

SEQ ID NO: 1430399 - protein, 11 aa, Mycobacterium tuberculosis
GTGQLESTVSD

SEQ ID NO: 1430400 - protein, 8 aa, Mycobacterium tuberculosis
GTGQQLKG

SEQ ID NO: 1430401 - protein, 75 aa, Mycobacterium tuberculosis
GTGTLSGGRGGAGGNAGTFYGSGGAGGAGGESDNGDGGNGGVGGKAGLVGEGGNGGDGGATIAGKGGSGGNGGNA

SEQ ID NO: 1430402 - protein, 15 aa, Mycobacterium tuberculosis
GTKAKIRDTRKTLPG

SEQ ID NO: 1430403 - protein, 5 aa, Mycobacterium tuberculosis
GTKFD

SEQ ID NO: 1430404 - protein, 6 aa, Mycobacterium tuberculosis
GTLPEP

SEQ ID NO: 1430405 - protein, 4 aa, Mycobacterium tuberculosis
GTNE

SEQ ID NO: 1430406 - protein, 11 aa, Mycobacterium tuberculosis
GTNGKSTTTRM

SEQ ID NO: 1430407 - protein, 16 aa, Mycobacterium tuberculosis
GTNNVGIGNSGTGNWG

SEQ ID NO: 1430408 - protein, 11 aa, Mycobacterium tuberculosis
GTNWKSNPNAM

SEQ ID NO: 1430409 - protein, 17 aa, Mycobacterium tuberculosis
GTPADRCTPATGGEFPT

SEQ ID NO: 1430410 - protein, 14 aa, Mycobacterium tuberculosis
GTPEAAASTNERIA

SEQ ID NO: 1430411 - protein, 5 aa, Mycobacterium tuberculosis
GTPHC

SEQ ID NO: 1430412 - protein, 6 aa, Mycobacterium tuberculosis
GTPPEA

SEQ ID NO: 1430413 - protein, 6 aa, Mycobacterium tuberculosis
GTPTFT

SEQ ID NO: 1430414 - protein, 6 aa, Mycobacterium tuberculosis
GTQQNL

SEQ ID NO: 1430415 - protein, 10 aa, Mycobacterium tuberculosis
GTRTQVGYGP

SEQ ID NO: 1430416 - protein, 8 aa, Mycobacterium tuberculosis
GTSDISKP

SEQ ID NO: 1430417 - protein, 18 aa, Mycobacterium tuberculosis
GTSLSAANATAAASTTSV

SEQ ID NO: 1430418 - protein, 9 aa, Mycobacterium tuberculosis
GTSNDEIQA

SEQ ID NO: 1430419 - protein, 8 aa, Mycobacterium tuberculosis
GTSRANAA

SEQ ID NO: 1430420 - protein, 4 aa, Mycobacterium tuberculosis
GTTA

SEQ ID NO: 1430421 - protein, 6 aa, Mycobacterium tuberculosis
GTTPVE

SEQ ID NO: 1430422 - protein, 14 aa, Mycobacterium tuberculosis
GTTRGRLDEQERAA

SEQ ID NO: 1430423 - protein, 11 aa, Mycobacterium tuberculosis
GTVAGRPNDGC

SEQ ID NO: 1430424 - protein, 7 aa, Mycobacterium tuberculosis
GTWDGPT

SEQ ID NO: 1430425 - protein, 32 aa, Mycobacterium tuberculosis; identical to SEQ ID NO: 177617

SEQ ID NO: 1430426 - protein, 5 aa, Mycobacterium tuberculosis
GTWTP

SEQ ID NO: 1430427 - protein, 8 aa, Mycobacterium tuberculosis
GVAADAAG

SEQ ID NO: 1430428 - protein, 9 aa, Mycobacterium tuberculosis
GVAAGDGVK

SEQ ID NO: 1430429 - protein, 5 aa, Mycobacterium tuberculosis
GVAKS

SEQ ID NO: 1430430 - protein, 5 aa, Mycobacterium tuberculosis
GVDSA

SEQ ID NO: 1430431 - protein, 4 aa, Mycobacterium tuberculosis
GVEV

SEQ ID NO: 1430432 - protein, 7 aa, Mycobacterium tuberculosis
GVGGGSL

SEQ ID NO: 1430433 - protein, 8 aa, Mycobacterium tuberculosis
GVGGPGGF

SEQ ID NO: 1430434 - protein, 5 aa, Mycobacterium tuberculosis
GVGGT

SEQ ID NO: 1430435 - protein, 25 aa, Mycobacterium tuberculosis
GVGGVGGAATDTGGNGGAGGSGTGL

SEQ ID NO: 1430436 - protein, 9 aa, Mycobacterium tuberculosis
GVGKTTTAA

SEQ ID NO: 1430437 - protein, 7 aa, Mycobacterium tuberculosis
GVGPEKS

SEQ ID NO: 1430438 - protein, 6 aa, Mycobacterium tuberculosis
GVIGRG

SEQ ID NO: 1430439 - protein, 4 aa, Mycobacterium tuberculosis
GVKE

SEQ ID NO: 1430440 - protein, 7 aa, Mycobacterium tuberculosis
GVPEPVD

SEQ ID NO: 1430441 - protein, 7 aa, Mycobacterium tuberculosis
GVPPGRR

SEQ ID NO: 1430442 - protein, 15 aa, Mycobacterium tuberculosis
GVPPQISATPGMPER

SEQ ID NO: 1430443 - protein, 9 aa, Mycobacterium tuberculosis
GVPQARRAD

SEQ ID NO: 1430444 - protein, 4 aa, Mycobacterium tuberculosis
GVPR

SEQ ID NO: 1430445 - protein, 5 aa, Mycobacterium tuberculosis
GVPVT

SEQ ID NO: 1430446 - protein, 21 aa, Mycobacterium tuberculosis
GVQAGSTGAGQSTSAGENFGN

SEQ ID NO: 1430447 - protein, 5 aa, Mycobacterium tuberculosis
GVQTP

SEQ ID NO: 1430448 - protein, 10 aa, Mycobacterium tuberculosis
GVRDTPEAAR

SEQ ID NO: 1430449 - protein, 5 aa, Mycobacterium tuberculosis
GVRPD

SEQ ID NO: 1430450 - protein, 8 aa, Mycobacterium tuberculosis
GVRRTRSK

SEQ ID NO: 1430451 - protein, 4 aa, Mycobacterium tuberculosis
GVSA

SEQ ID NO: 1430452 - protein, 17 aa, Mycobacterium tuberculosis
GVSGDGTPGTGGNGGYA

SEQ ID NO: 1430453 - protein, 5 aa, Mycobacterium tuberculosis
GVSQR

SEQ ID NO: 1430454 - protein, 5 aa, Mycobacterium tuberculosis
GVSSG

SEQ ID NO: 1430455 - protein, 4 aa, Mycobacterium tuberculosis
GVTD

SEQ ID NO: 1430456 - protein, 15 aa, Mycobacterium tuberculosis
GVTGARDAVSQAAPE

SEQ ID NO: 1430457 - protein, 20 aa, Mycobacterium tuberculosis
GVVADSNGSYEYNEARNKAR

SEQ ID NO: 1430458 - protein, 4 aa, Mycobacterium tuberculosis
GWLG

SEQ ID NO: 1430459 - protein, 6 aa, Mycobacterium tuberculosis
GWLGPA

SEQ ID NO: 1430460 - protein, 13 aa, Mycobacterium tuberculosis
GWNPETQALDPTG

SEQ ID NO: 1430461 - protein, 5 aa, Mycobacterium tuberculosis
GWQPI

SEQ ID NO: 1430462 - protein, 13 aa, Mycobacterium tuberculosis
GWRRGATQGHSGT

SEQ ID NO: 1430463 - protein, 5 aa, Mycobacterium tuberculosis
GYCPG

SEQ ID NO: 1430464 - protein, 7 aa, Mycobacterium tuberculosis
GYEGEVR

SEQ ID NO: 1430465 - protein, 6 aa, Mycobacterium tuberculosis
GYHRRE

SEQ ID NO: 1430466 - protein, 6 aa, Mycobacterium tuberculosis
GYPGRH

SEQ ID NO: 1430467 - protein, 7 aa, Mycobacterium tuberculosis
GYPPGVH

SEQ ID NO: 1430468 - protein, 8 aa, Mycobacterium tuberculosis
GYQAVGSG

SEQ ID NO: 1430469 - protein, 12 aa, Mycobacterium tuberculosis
GYVATTTRVGGP

SEQ ID NO: 1430470 - protein, 59 aa, Mycobacterium tuberculosis; identical to SEQ ID NO: 194292

SEQ ID NO: 1430471 - protein, 5 aa, Mycobacterium tuberculosis
HAAQR

SEQ ID NO: 1430472 - protein, 7 aa, Mycobacterium tuberculosis
HAGGDGA

SEQ ID NO: 1430473 - protein, 6 aa, Mycobacterium tuberculosis
HAGPAA

SEQ ID NO: 1430474 - protein, 11 aa, Mycobacterium tuberculosis
HAPDPARARPL

SEQ ID NO: 1430475 - protein, 8 aa, Mycobacterium tuberculosis
HARSTGPY

SEQ ID NO: 1430476 - protein, 15 aa, Mycobacterium tuberculosis
HATGTQVGDLAEGRA

SEQ ID NO: 1430477 - protein, 23 aa, Mycobacterium tuberculosis
HATVDPSGGTVTPLTPGSHAAGA

SEQ ID NO: 1430478 - protein, 7 aa, Mycobacterium tuberculosis
HDAAARV

SEQ ID NO: 1430479 - protein, 8 aa, Mycobacterium tuberculosis
HDAERENK

SEQ ID NO: 1430480 - protein, 7 aa, Mycobacterium tuberculosis
HDAPPAT

SEQ ID NO: 1430481 - protein, 4 aa, Mycobacterium tuberculosis
HDDP

SEQ ID NO: 1430482 - protein, 7 aa, Mycobacterium tuberculosis
HDLGSKT

SEQ ID NO: 1430483 - protein, 15 aa, Mycobacterium tuberculosis
HDNPGVAPKDELRDQ

SEQ ID NO: 1430484 - protein, 4 aa, Mycobacterium tuberculosis
HDPA

SEQ ID NO: 1430485 - protein, 8 aa, Mycobacterium tuberculosis
HDPAARAR

SEQ ID NO: 1430486 - protein, 7 aa, Mycobacterium tuberculosis
HDPLRDD

SEQ ID NO: 1430487 - protein, 11 aa, Mycobacterium tuberculosis
HDRTQQNTPAW

SEQ ID NO: 1430488 - protein, 6 aa, Mycobacterium tuberculosis
HDSSHE

SEQ ID NO: 1430489 - protein, 7 aa, Mycobacterium tuberculosis
HEAAGAA

SEQ ID NO: 1430490 - protein, 7 aa, Mycobacterium tuberculosis
HEADSQT

SEQ ID NO: 1430491 - protein, 10 aa, Mycobacterium tuberculosis
HEVGSGGQAE

SEQ ID NO: 1430492 - protein, 4 aa, Mycobacterium tuberculosis
HGAL

SEQ ID NO: 1430493 - protein, 7 aa, Mycobacterium tuberculosis
HGAQPRA

SEQ ID NO: 1430494 - protein, 7 aa, Mycobacterium tuberculosis
HGCSDDH

SEQ ID NO: 1430495 - protein, 9 aa, Mycobacterium tuberculosis
HGDQRRATT

SEQ ID NO: 1430496 - protein, 7 aa, Mycobacterium tuberculosis
HGDYTLP

SEQ ID NO: 1430497 - protein, 5 aa, Mycobacterium tuberculosis
HGEGY

SEQ ID NO: 1430498 - protein, 5 aa, Mycobacterium tuberculosis
HGETV

SEQ ID NO: 1430499 - protein, 8 aa, Mycobacterium tuberculosis
HGGPEQLR

SEQ ID NO: 1430500 - protein, 18 aa, Mycobacterium tuberculosis
HGGPSDVVGRAGPDRAHT

SEQ ID NO: 1430501 - protein, 7 aa, Mycobacterium tuberculosis
HGKASGQ

SEQ ID NO: 1430502 - protein, 4 aa, Mycobacterium tuberculosis
HGMN

SEQ ID NO: 1430503 - protein, 8 aa, Mycobacterium tuberculosis
HGNRQRAH

SEQ ID NO: 1430504 - protein, 7 aa, Mycobacterium tuberculosis
HGPQVDK

SEQ ID NO: 1430505 - protein, 10 aa, Mycobacterium tuberculosis
HGPVTGPDGI

SEQ ID NO: 1430506 - protein, 5 aa, Mycobacterium tuberculosis
HGQQY

SEQ ID NO: 1430507 - protein, 11 aa, Mycobacterium tuberculosis
HGTATTLGDPI

SEQ ID NO: 1430508 - protein, 7 aa, Mycobacterium tuberculosis
HGTDEAE

SEQ ID NO: 1430509 - protein, 8 aa, Mycobacterium tuberculosis
HGTDGEDQ

SEQ ID NO: 1430510 - protein, 4 aa, Mycobacterium tuberculosis
HGTG

SEQ ID NO: 1430511 - protein, 7 aa, Mycobacterium tuberculosis
HIGDSRT

SEQ ID NO: 1430512 - protein, 11 aa, Mycobacterium tuberculosis
HKALDPRARRE

SEQ ID NO: 1430513 - protein, 4 aa, Mycobacterium tuberculosis
HKDE

SEQ ID NO: 1430514 - protein, 5 aa, Mycobacterium tuberculosis
HKRDH

SEQ ID NO: 1430515 - protein, 6 aa, Mycobacterium tuberculosis
HLRSGG

SEQ ID NO: 1430516 - protein, 13 aa, Mycobacterium tuberculosis
HLSPEGRKTYRST

SEQ ID NO: 1430517 - protein, 4 aa, Mycobacterium tuberculosis
HNPR

SEQ ID NO: 1430518 - protein, 9 aa, Mycobacterium tuberculosis
HNPTGSVHT

SEQ ID NO: 1430519 - protein, 17 aa, Mycobacterium tuberculosis
HPDAKDFGSAAALPADP

SEQ ID NO: 1430520 - protein, 5 aa, Mycobacterium tuberculosis
HPEEQ

SEQ ID NO: 1430521 - protein, 6 aa, Mycobacterium tuberculosis
HPGARA

SEQ ID NO: 1430522 - protein, 11 aa, Mycobacterium tuberculosis
HPGAVSANRGR

SEQ ID NO: 1430523 - protein, 5 aa, Mycobacterium tuberculosis
HPGGG

SEQ ID NO: 1430524 - protein, 8 aa, Mycobacterium tuberculosis
HPGKPQLR

SEQ ID NO: 1430525 - protein, 35 aa, Mycobacterium tuberculosis; identical to SEQ ID NO: 178170

SEQ ID NO: 1430526 - protein, 4 aa, Mycobacterium tuberculosis
HPHL

SEQ ID NO: 1430527 - protein, 4 aa, Mycobacterium tuberculosis
HPHS

SEQ ID NO: 1430528 - protein, 5 aa, Mycobacterium tuberculosis
HPKPE

SEQ ID NO: 1430529 - protein, 12 aa, Mycobacterium tuberculosis
HPPYGHNGERAL

SEQ ID NO: 1430530 - protein, 5 aa, Mycobacterium tuberculosis
HPQGR

SEQ ID NO: 1430531 - protein, 13 aa, Mycobacterium tuberculosis
HPRGEAANALGAT

SEQ ID NO: 1430532 - protein, 4 aa, Mycobacterium tuberculosis
HPRV

SEQ ID NO: 1430533 - protein, 5 aa, Mycobacterium tuberculosis
HPSIE

SEQ ID NO: 1430534 - protein, 8 aa, Mycobacterium tuberculosis
HPSRGAWT

SEQ ID NO: 1430535 - protein, 4 aa, Mycobacterium tuberculosis
HPYA

SEQ ID NO: 1430536 - protein, 6 aa, Mycobacterium tuberculosis
HPYDDG

SEQ ID NO: 1430537 - protein, 4 aa, Mycobacterium tuberculosis
HPYG

SEQ ID NO: 1430538 - protein, 9 aa, Mycobacterium tuberculosis
HQDSAGNSG

SEQ ID NO: 1430539 - protein, 6 aa, Mycobacterium tuberculosis
HQGGDD

SEQ ID NO: 1430540 - protein, 6 aa, Mycobacterium tuberculosis
HQRTAD

SEQ ID NO: 1430541 - protein, 13 aa, Mycobacterium tuberculosis
HRPDGTSVVLAAT

SEQ ID NO: 1430542 - protein, 5 aa, Mycobacterium tuberculosis
HRPDI

SEQ ID NO: 1430543 - protein, 5 aa, Mycobacterium tuberculosis
HRPNQ

SEQ ID NO: 1430544 - protein, 5 aa, Mycobacterium tuberculosis
HRQAP

SEQ ID NO: 1430545 - protein, 4 aa, Mycobacterium tuberculosis
HRSS

SEQ ID NO: 1430546 - protein, 5 aa, Mycobacterium tuberculosis
HRTLS

SEQ ID NO: 1430547 - protein, 11 aa, Mycobacterium tuberculosis
HRTPGSGVSAR

SEQ ID NO: 1430548 - protein, 15 aa, Mycobacterium tuberculosis
HRTQKKRKDREMPQG

SEQ ID NO: 1430549 - protein, 9 aa, Mycobacterium tuberculosis
HSDDAQPGV

SEQ ID NO: 1430550 - protein, 11 aa, Mycobacterium tuberculosis
HSETAIDAAGA

SEQ ID NO: 1430551 - protein, 56 aa, Mycobacterium tuberculosis; identical to SEQ ID NO: 178294

SEQ ID NO: 1430552 - protein, 5 aa, Mycobacterium tuberculosis
HSGTL

SEQ ID NO: 1430553 - protein, 13 aa, Mycobacterium tuberculosis
HSGTSLSAQISRA

SEQ ID NO: 1430554 - protein, 10 aa, Mycobacterium tuberculosis
HSHRRSRRRW

SEQ ID NO: 1430555 - protein, 14 aa, Mycobacterium tuberculosis
HSPGMTDRSPRAAI

SEQ ID NO: 1430556 - protein, 13 aa, Mycobacterium tuberculosis
HSPGRAAAAATEA

SEQ ID NO: 1430557 - protein, 8 aa, Mycobacterium tuberculosis
HSPKHPPD

SEQ ID NO: 1430558 - protein, 10 aa, Mycobacterium tuberculosis
HSRGLGSSAA

SEQ ID NO: 1430559 - protein, 6 aa, Mycobacterium tuberculosis
HSRSPQ

SEQ ID NO: 1430560 - protein, 12 aa, Mycobacterium tuberculosis
HSSQPHAAVTPA

SEQ ID NO: 1430561 - protein, 4 aa, Mycobacterium tuberculosis
HSTR

SEQ ID NO: 1430562 - protein, 8 aa, Mycobacterium tuberculosis
HSYGGRQT

SEQ ID NO: 1430563 - protein, 19 aa, Mycobacterium tuberculosis
HTIAGRGRHPLPSGASLQA

SEQ ID NO: 1430564 - protein, 10 aa, Mycobacterium tuberculosis
HTKASQAPIS

SEQ ID NO: 1430565 - protein, 10 aa, Mycobacterium tuberculosis
HTKKKESEIR

SEQ ID NO: 1430566 - protein, 9 aa, Mycobacterium tuberculosis
HTNEASPLD

SEQ ID NO: 1430567 - protein, 4 aa, Mycobacterium tuberculosis
HTPR

SEQ ID NO: 1430568 - protein, 6 aa, Mycobacterium tuberculosis
HTPYPE

SEQ ID NO: 1430569 - protein, 7 aa, Mycobacterium tuberculosis
HTRAAPH

SEQ ID NO: 1430570 - protein, 4 aa, Mycobacterium tuberculosis
HTRG

SEQ ID NO: 1430571 - protein, 5 aa, Mycobacterium tuberculosis
HTSKT

SEQ ID NO: 1430572 - protein, 4 aa, Mycobacterium tuberculosis
HTTE

SEQ ID NO: 1430573 - protein, 16 aa, Mycobacterium tuberculosis
HWEPGSKALATRAASG

SEQ ID NO: 1430574 - protein, 5 aa, Mycobacterium tuberculosis
IAAAD

SEQ ID NO: 1430575 - protein, 13 aa, Mycobacterium tuberculosis
IAAANAAAAANTT

SEQ ID NO: 1430576 - protein, 9 aa, Mycobacterium tuberculosis
IAATDGAGA

SEQ ID NO: 1430577 - protein, 6 aa, Mycobacterium tuberculosis
IADGAT

SEQ ID NO: 1430578 - protein, 6 aa, Mycobacterium tuberculosis
IADSPE

SEQ ID NO: 1430579 - protein, 6 aa, Mycobacterium tuberculosis
IADYDP

SEQ ID NO: 1430580 - protein, 12 aa, Mycobacterium tuberculosis
IAGEGVEELGRS

SEQ ID NO: 1430581 - protein, 11 aa, Mycobacterium tuberculosis
IAGPGPNGRPR

SEQ ID NO: 1430582 - protein, 10 aa, Mycobacterium tuberculosis
IAGPKRPQDR

SEQ ID NO: 1430583 - protein, 16 aa, Mycobacterium tuberculosis
IAGRGRHPLPSGASLQ

SEQ ID NO: 1430584 - protein, 15 aa, Mycobacterium tuberculosis
IAKSNRKYYENGYPA

SEQ ID NO: 1430585 - protein, 9 aa, Mycobacterium tuberculosis
IANPGNHNT

SEQ ID NO: 1430586 - protein, 6 aa, Mycobacterium tuberculosis
IAQNAA

SEQ ID NO: 1430587 - protein, 4 aa, Mycobacterium tuberculosis
IARE

SEQ ID NO: 1430588 - protein, 7 aa, Mycobacterium tuberculosis
IARGKEG

SEQ ID NO: 1430589 - protein, 5 aa, Mycobacterium tuberculosis
IATET

SEQ ID NO: 1430590 - protein, 9 aa, Mycobacterium tuberculosis
IATGATAKA

SEQ ID NO: 1430591 - protein, 9 aa, Mycobacterium tuberculosis
IATGGHTGD

SEQ ID NO: 1430592 - protein, 5 aa, Mycobacterium tuberculosis
IATNA

SEQ ID NO: 1430593 - protein, 8 aa, Mycobacterium tuberculosis
IDGDETDL

SEQ ID NO: 1430594 - protein, 5 aa, Mycobacterium tuberculosis
IDGTR

SEQ ID NO: 1430595 - protein, 7 aa, Mycobacterium tuberculosis
IDGTRRP

SEQ ID NO: 1430596 - protein, 8 aa, Mycobacterium tuberculosis
IDHGPQPL

SEQ ID NO: 1430597 - protein, 14 aa, Mycobacterium tuberculosis
IDKSDSDWDREKLG

SEQ ID NO: 1430598 - protein, 7 aa, Mycobacterium tuberculosis
IDPENTD

SEQ ID NO: 1430599 - protein, 11 aa, Mycobacterium tuberculosis
IDPGKEASPRF

SEQ ID NO: 1430600 - protein, 7 aa, Mycobacterium tuberculosis
IDPGPTL

SEQ ID NO: 1430601 - protein, 14 aa, Mycobacterium tuberculosis
IDPGTVDAGTVGNA

SEQ ID NO: 1430602 - protein, 15 aa, Mycobacterium tuberculosis
IDQKSTNRNPRSTVG

SEQ ID NO: 1430603 - protein, 6 aa, Mycobacterium tuberculosis
IDRDQL

SEQ ID NO: 1430604 - protein, 6 aa, Mycobacterium tuberculosis
IDSDRE

SEQ ID NO: 1430605 - protein, 28 aa, Mycobacterium tuberculosis
IDSGRRGIAHPPRGGLGHRSKHRGPRHL

SEQ ID NO: 1430606 - protein, 10 aa, Mycobacterium tuberculosis
IDSPKSQAAQ

SEQ ID NO: 1430607 - protein, 8 aa, Mycobacterium tuberculosis
IEDSSAEK

SEQ ID NO: 1430608 - protein, 6 aa, Mycobacterium tuberculosis
IEGRSW

SEQ ID NO: 1430609 - protein, 4 aa, Mycobacterium tuberculosis
IENH

SEQ ID NO: 1430610 - protein, 14 aa, Mycobacterium tuberculosis
IEPERSEVRQPPPR

SEQ ID NO: 1430611 - protein, 10 aa, Mycobacterium tuberculosis
IEPSEITPEK

SEQ ID NO: 1430612 - protein, 6 aa, Mycobacterium tuberculosis
IEQGDE

SEQ ID NO: 1430613 - protein, 8 aa, Mycobacterium tuberculosis
IETGAMPP

SEQ ID NO: 1430614 - protein, 7 aa, Mycobacterium tuberculosis
IGAGNKL

SEQ ID NO: 1430615 - protein, 7 aa, Mycobacterium tuberculosis
IGATTEA

SEQ ID NO: 1430616 - protein, 9 aa, Mycobacterium tuberculosis
IGEQTQQLA

SEQ ID NO: 1430617 - protein, 18 aa, Mycobacterium tuberculosis
IGGADPVSVPAAGAVGRQ

SEQ ID NO: 1430618 - protein, 7 aa, Mycobacterium tuberculosis
IGKGSVT

SEQ ID NO: 1430619 - protein, 26 aa, Mycobacterium tuberculosis
IGNGGAGGAGGAGGAGGAGGAGGTGG

SEQ ID NO: 1430620 - protein, 23 aa, Mycobacterium tuberculosis
IGNGGAGGAGGPGANGGAGGNGG

SEQ ID NO: 1430621 - protein, 31 aa, Mycobacterium tuberculosis
IGNGGAGGDGGNGGLSNTGASGGAGGAGGAA

SEQ ID NO: 1430622 - protein, 25 aa, Mycobacterium tuberculosis
IGNGGNGGAGGVGTTGGAGGHGGAG

SEQ ID NO: 1430623 - protein, 17 aa, Mycobacterium tuberculosis
IGNGGNGGNGGKGGTGL

SEQ ID NO: 1430624 - protein, 36 aa, Mycobacterium tuberculosis; identical to SEQ ID NO: 178599

SEQ ID NO: 1430625 - protein, 59 aa, Mycobacterium tuberculosis
IGNQGNANLGGGNTGSGNIGNGNKGSSNFGGGNIGNNNIGSGNRGSDNFGAGNVGTGNI

SEQ ID NO: 1430626 - protein, 20 aa, Mycobacterium tuberculosis
IGNSGSGNTGIGNTGSTNTG

SEQ ID NO: 1430627 - protein, 21 aa, Mycobacterium tuberculosis
IGNSGTSYNTGIGNTGQANTG

SEQ ID NO: 1430628 - protein, 5 aa, Mycobacterium tuberculosis
IGNTT

SEQ ID NO: 1430629 - protein, 5 aa, Mycobacterium tuberculosis
IGPPI

SEQ ID NO: 1430630 - protein, 9 aa, Mycobacterium tuberculosis
IGRGSTEDT

SEQ ID NO: 1430631 - protein, 5 aa, Mycobacterium tuberculosis
IGRPR

SEQ ID NO: 1430632 - protein, 9 aa, Mycobacterium tuberculosis
IGSDGAGSI

SEQ ID NO: 1430633 - protein, 6 aa, Mycobacterium tuberculosis
IHTSGE

SEQ ID NO: 1430634 - protein, 6 aa, Mycobacterium tuberculosis
IKASGA

SEQ ID NO: 1430635 - protein, 6 aa, Mycobacterium tuberculosis
IKDSLS

SEQ ID NO: 1430636 - protein, 8 aa, Mycobacterium tuberculosis
IKRSAPRR

SEQ ID NO: 1430637 - protein, 8 aa, Mycobacterium tuberculosis
INAGPGGG

SEQ ID NO: 1430638 - protein, 7 aa, Mycobacterium tuberculosis
INGATTL

SEQ ID NO: 1430639 - protein, 8 aa, Mycobacterium tuberculosis
INGTDRRG

SEQ ID NO: 1430640 - protein, 9 aa, Mycobacterium tuberculosis
IPADADQHE

SEQ ID NO: 1430641 - protein, 8 aa, Mycobacterium tuberculosis
IPADPNGR

SEQ ID NO: 1430642 - protein, 12 aa, Mycobacterium tuberculosis
IPATERTETPTF

SEQ ID NO: 1430643 - protein, 4 aa, Mycobacterium tuberculosis
IPDE

SEQ ID NO: 1430644 - protein, 12 aa, Mycobacterium tuberculosis
IPDSRTSKDFDT

SEQ ID NO: 1430645 - protein, 5 aa, Mycobacterium tuberculosis
IPERG

SEQ ID NO: 1430646 - protein, 6 aa, Mycobacterium tuberculosis
IPNDSP

SEQ ID NO: 1430647 - protein, 6 aa, Mycobacterium tuberculosis
IPPDRW

SEQ ID NO: 1430648 - protein, 8 aa, Mycobacterium tuberculosis
IPRGEEAG

SEQ ID NO: 1430649 - protein, 4 aa, Mycobacterium tuberculosis
IPSA

SEQ ID NO: 1430650 - protein, 8 aa, Mycobacterium tuberculosis
IPSGEYGA

SEQ ID NO: 1430651 - protein, 4 aa, Mycobacterium tuberculosis
IPVP

SEQ ID NO: 1430652 - protein, 4 aa, Mycobacterium tuberculosis
IPVQ

SEQ ID NO: 1430653 - protein, 15 aa, Mycobacterium tuberculosis
IPVSKGADEPLGGRW

SEQ ID NO: 1430654 - protein, 5 aa, Mycobacterium tuberculosis
IQSDA

SEQ ID NO: 1430655 - protein, 4 aa, Mycobacterium tuberculosis
IRDG

SEQ ID NO: 1430656 - protein, 5 aa, Mycobacterium tuberculosis
IRGTQ

SEQ ID NO: 1430657 - protein, 9 aa, Mycobacterium tuberculosis
IRKDTDRDK

SEQ ID NO: 1430658 - protein, 12 aa, Mycobacterium tuberculosis
IRNQSPLGTRKE

SEQ ID NO: 1430659 - protein, 6 aa, Mycobacterium tuberculosis
IRSAQA

SEQ ID NO: 1430660 - protein, 21 aa, Mycobacterium tuberculosis
IRSSSTNDPQRPSPPAQEASP

SEQ ID NO: 1430661 - protein, 17 aa, Mycobacterium tuberculosis
IRSTGRWRGRPKNQDAY

SEQ ID NO: 1430662 - protein, 4 aa, Mycobacterium tuberculosis
IRTD

SEQ ID NO: 1430663 - protein, 14 aa, Mycobacterium tuberculosis
ISAANAAAAAPTTA

SEQ ID NO: 1430664 - protein, 10 aa, Mycobacterium tuberculosis
ISGTAPGVTS

SEQ ID NO: 1430665 - protein, 4 aa, Mycobacterium tuberculosis
ISHS

SEQ ID NO: 1430666 - protein, 6 aa, Mycobacterium tuberculosis
ISRASS

SEQ ID NO: 1430667 - protein, 5 aa, Mycobacterium tuberculosis
ISREG

SEQ ID NO: 1430668 - protein, 4 aa, Mycobacterium tuberculosis
ITAR

SEQ ID NO: 1430669 - protein, 8 aa, Mycobacterium tuberculosis
ITDPDNPV

SEQ ID NO: 1430670 - protein, 10 aa, Mycobacterium tuberculosis
ITEDPTPRGH

SEQ ID NO: 1430671 - protein, 5 aa, Mycobacterium tuberculosis
ITERQ

SEQ ID NO: 1430672 - protein, 8 aa, Mycobacterium tuberculosis
ITGKDEDE

SEQ ID NO: 1430673 - protein, 5 aa, Mycobacterium tuberculosis
ITGRE

SEQ ID NO: 1430674 - protein, 8 aa, Mycobacterium tuberculosis
ITGTSSSI

SEQ ID NO: 1430675 - protein, 8 aa, Mycobacterium tuberculosis
ITNSGTDI

SEQ ID NO: 1430676 - protein, 11 aa, Mycobacterium tuberculosis
ITPDEIRATNP

SEQ ID NO: 1430677 - protein, 6 aa, Mycobacterium tuberculosis
ITPSQR

SEQ ID NO: 1430678 - protein, 5 aa, Mycobacterium tuberculosis
ITRTP

SEQ ID NO: 1430679 - protein, 6 aa, Mycobacterium tuberculosis
ITTGQT

SEQ ID NO: 1430680 - protein, 6 aa, Mycobacterium tuberculosis
IVPGGG

SEQ ID NO: 1430681 - protein, 11 aa, Mycobacterium tuberculosis
KAAEADEVEAE

SEQ ID NO: 1430682 - protein, 5 aa, Mycobacterium tuberculosis
KAAVE

SEQ ID NO: 1430683 - protein, 10 aa, Mycobacterium tuberculosis
KAELPQAVPH

SEQ ID NO: 1430684 - protein, 14 aa, Mycobacterium tuberculosis
KAEVHGTASPQKHQ

SEQ ID NO: 1430685 - protein, 11 aa, Mycobacterium tuberculosis
KAFAGAAGDQV

SEQ ID NO: 1430686 - protein, 6 aa, Mycobacterium tuberculosis
KAGFTV

SEQ ID NO: 1430687 - protein, 11 aa, Mycobacterium tuberculosis
KAGGATTPIGT

SEQ ID NO: 1430688 - protein, 9 aa, Mycobacterium tuberculosis
KAGKAPKDI

SEQ ID NO: 1430689 - protein, 6 aa, Mycobacterium tuberculosis
KAGNEH

SEQ ID NO: 1430690 - protein, 8 aa, Mycobacterium tuberculosis
KAGRTSAP

SEQ ID NO: 1430691 - protein, 21 aa, Mycobacterium tuberculosis
KAKVDGIPDTESVVTPDLLED

SEQ ID NO: 1430692 - protein, 6 aa, Mycobacterium tuberculosis
KALREN

SEQ ID NO: 1430693 - protein, 7 aa, Mycobacterium tuberculosis
KANEAGI

SEQ ID NO: 1430694 - protein, 7 aa, Mycobacterium tuberculosis
KAQETQR

SEQ ID NO: 1430695 - protein, 10 aa, Mycobacterium tuberculosis
KARRDSDRAA

SEQ ID NO: 1430696 - protein, 4 aa, Mycobacterium tuberculosis
KASD

SEQ ID NO: 1430697 - protein, 8 aa, Mycobacterium tuberculosis
KASGRDLS

SEQ ID NO: 1430698 - protein, 7 aa, Mycobacterium tuberculosis
KDAQRDK

SEQ ID NO: 1430699 - protein, 9 aa, Mycobacterium tuberculosis
KDGAIAGPR

SEQ ID NO: 1430700 - protein, 10 aa, Mycobacterium tuberculosis
KDGGAQRRTV

SEQ ID NO: 1430701 - protein, 4 aa, Mycobacterium tuberculosis
KDGP

SEQ ID NO: 1430702 - protein, 4 aa, Mycobacterium tuberculosis
KDIQ

SEQ ID NO: 1430703 - protein, 6 aa, Mycobacterium tuberculosis
KDLATI

SEQ ID NO: 1430704 - protein, 10 aa, Mycobacterium tuberculosis
KDPADEAKYA

SEQ ID NO: 1430705 - protein, 12 aa, Mycobacterium tuberculosis
KDPVGHKGARLT

SEQ ID NO: 1430706 - protein, 9 aa, Mycobacterium tuberculosis
KDRKQFGES

SEQ ID NO: 1430707 - protein, 5 aa, Mycobacterium tuberculosis
KDSPE

SEQ ID NO: 1430708 - protein, 13 aa, Mycobacterium tuberculosis
KDSPPSFDPSEVA

SEQ ID NO: 1430709 - protein, 10 aa, Mycobacterium tuberculosis
KEEDEASAER

SEQ ID NO: 1430710 - protein, 5 aa, Mycobacterium tuberculosis
KEGLR

SEQ ID NO: 1430711 - protein, 9 aa, Mycobacterium tuberculosis
KEGVEPQSE

SEQ ID NO: 1430712 - protein, 12 aa, Mycobacterium tuberculosis
KEHGSSAGPPVS

SEQ ID NO: 1430713 - protein, 7 aa, Mycobacterium tuberculosis
KELAPGQ

SEQ ID NO: 1430714 - protein, 7 aa, Mycobacterium tuberculosis
KELASDP

SEQ ID NO: 1430715 - protein, 6 aa, Mycobacterium tuberculosis
KEPPKR

SEQ ID NO: 1430716 - protein, 6 aa, Mycobacterium tuberculosis
KEQAGA

SEQ ID NO: 1430717 - protein, 4 aa, Mycobacterium tuberculosis
KFSP

SEQ ID NO: 1430718 - protein, 9 aa, Mycobacterium tuberculosis
KFTSAESRT

SEQ ID NO: 1430719 - protein, 10 aa, Mycobacterium tuberculosis
KGASIGDKTV

SEQ ID NO: 1430720 - protein, 13 aa, Mycobacterium tuberculosis
KGATFSDAAARDA

SEQ ID NO: 1430721 - protein, 4 aa, Mycobacterium tuberculosis
KGEA

SEQ ID NO: 1430722 - protein, 6 aa, Mycobacterium tuberculosis
KGEAKD

SEQ ID NO: 1430723 - protein, 15 aa, Mycobacterium tuberculosis
KGGAGGTGGRGGAAG

SEQ ID NO: 1430724 - protein, 14 aa, Mycobacterium tuberculosis
KGHETGQRGGGRVR

SEQ ID NO: 1430725 - protein, 8 aa, Mycobacterium tuberculosis
KGLPPIGS

SEQ ID NO: 1430726 - protein, 23 aa, Mycobacterium tuberculosis
KGLPPNPDATSTSLPGARGADVD

SEQ ID NO: 1430727 - protein, 4 aa, Mycobacterium tuberculosis
KGNL

SEQ ID NO: 1430728 - protein, 8 aa, Mycobacterium tuberculosis
KGPGATSI

SEQ ID NO: 1430729 - protein, 7 aa, Mycobacterium tuberculosis
KGPNGDL

SEQ ID NO: 1430730 - protein, 6 aa, Mycobacterium tuberculosis
KGPTEQ

SEQ ID NO: 1430731 - protein, 5 aa, Mycobacterium tuberculosis
KGTRL

SEQ ID NO: 1430732 - protein, 10 aa, Mycobacterium tuberculosis
KGTTYPNPPV

SEQ ID NO: 1430733 - protein, 4 aa, Mycobacterium tuberculosis
KGVD

SEQ ID NO: 1430734 - protein, 9 aa, Mycobacterium tuberculosis
KGYSTPAHS

SEQ ID NO: 1430735 - protein, 5 aa, Mycobacterium tuberculosis
KGYVS

SEQ ID NO: 1430736 - protein, 9 aa, Mycobacterium tuberculosis
KHGTADARL

SEQ ID NO: 1430737 - protein, 7 aa, Mycobacterium tuberculosis
KHRDAVP

SEQ ID NO: 1430738 - protein, 7 aa, Mycobacterium tuberculosis
KIRDDPR

SEQ ID NO: 1430739 - protein, 6 aa, Mycobacterium tuberculosis
KKGANH

SEQ ID NO: 1430740 - protein, 7 aa, Mycobacterium tuberculosis
KKGRDAD

SEQ ID NO: 1430741 - protein, 6 aa, Mycobacterium tuberculosis
KKHGND

SEQ ID NO: 1430742 - protein, 8 aa, Mycobacterium tuberculosis
KKKGKSLT

SEQ ID NO: 1430743 - protein, 5 aa, Mycobacterium tuberculosis
KKRRS

SEQ ID NO: 1430744 - protein, 7 aa, Mycobacterium tuberculosis
KLAAAEN

SEQ ID NO: 1430745 - protein, 13 aa, Mycobacterium tuberculosis
KLAERQGEKSYAQ

SEQ ID NO: 1430746 - protein, 9 aa, Mycobacterium tuberculosis
KLATPDTSV

SEQ ID NO: 1430747 - protein, 6 aa, Mycobacterium tuberculosis
KLGSEP

SEQ ID NO: 1430748 - protein, 4 aa, Mycobacterium tuberculosis
KLPD

SEQ ID NO: 1430749 - protein, 17 aa, Mycobacterium tuberculosis
KLSTGSANRCEPKTGTP

SEQ ID NO: 1430750 - protein, 7 aa, Mycobacterium tuberculosis
KLTDAPR

SEQ ID NO: 1430751 - protein, 6 aa, Mycobacterium tuberculosis
KNAERV

SEQ ID NO: 1430752 - protein, 7 aa, Mycobacterium tuberculosis
KNDAEEA

SEQ ID NO: 1430753 - protein, 4 aa, Mycobacterium tuberculosis
KNGQ

SEQ ID NO: 1430754 - protein, 8 aa, Mycobacterium tuberculosis
KNKLERSL

SEQ ID NO: 1430755 - protein, 6 aa, Mycobacterium tuberculosis
KNPELE

SEQ ID NO: 1430756 - protein, 5 aa, Mycobacterium tuberculosis
KPAPV

SEQ ID NO: 1430757 - protein, 4 aa, Mycobacterium tuberculosis
KPFG

SEQ ID NO: 1430758 - protein, 6 aa, Mycobacterium tuberculosis
KPFKKE

SEQ ID NO: 1430759 - protein, 8 aa, Mycobacterium tuberculosis
KPGKGPAF

SEQ ID NO: 1430760 - protein, 11 aa, Mycobacterium tuberculosis
KPISKSDAVEG

SEQ ID NO: 1430761 - protein, 6 aa, Mycobacterium tuberculosis
KPLTAA

SEQ ID NO: 1430762 - protein, 5 aa, Mycobacterium tuberculosis
KPPAF

SEQ ID NO: 1430763 - protein, 10 aa, Mycobacterium tuberculosis
KPRAWGPQES

SEQ ID NO: 1430764 - protein, 12 aa, Mycobacterium tuberculosis
KQAIGRATNNVA

SEQ ID NO: 1430765 - protein, 6 aa, Mycobacterium tuberculosis
KQFGKP

SEQ ID NO: 1430766 - protein, 9 aa, Mycobacterium tuberculosis
KQGGEPAVN

SEQ ID NO: 1430767 - protein, 6 aa, Mycobacterium tuberculosis
KQGQGG

SEQ ID NO: 1430768 - protein, 16 aa, Mycobacterium tuberculosis
KQLAEKKAAKKGGGPL

SEQ ID NO: 1430769 - protein, 17 aa, Mycobacterium tuberculosis
KQLAEKKAAKKGGGPLR

SEQ ID NO: 1430770 - protein, 16 aa, Mycobacterium tuberculosis
KQRQLDREARTGKKVS

SEQ ID NO: 1430771 - protein, 6 aa, Mycobacterium tuberculosis
KQSESN

SEQ ID NO: 1430772 - protein, 8 aa, Mycobacterium tuberculosis
KRAAAAQR

SEQ ID NO: 1430773 - protein, 5 aa, Mycobacterium tuberculosis
KRDTV

SEQ ID NO: 1430774 - protein, 10 aa, Mycobacterium tuberculosis
KRFRRTGTGK

SEQ ID NO: 1430775 - protein, 4 aa, Mycobacterium tuberculosis
KRGR

SEQ ID NO: 1430776 - protein, 14 aa, Mycobacterium tuberculosis
KRGVGVRPSLVSTA

SEQ ID NO: 1430777 - protein, 5 aa, Mycobacterium tuberculosis
KRKPY

SEQ ID NO: 1430778 - protein, 17 aa, Mycobacterium tuberculosis
KRKQAAENGSLPDTKAN

SEQ ID NO: 1430779 - protein, 6 aa, Mycobacterium tuberculosis
KRLPDG

SEQ ID NO: 1430780 - protein, 13 aa, Mycobacterium tuberculosis
KRPGTPAAQLDGQ

SEQ ID NO: 1430781 - protein, 8 aa, Mycobacterium tuberculosis
KRPKAEIK

SEQ ID NO: 1430782 - protein, 12 aa, Mycobacterium tuberculosis
KRPPDWSPFPRY

SEQ ID NO: 1430783 - protein, 5 aa, Mycobacterium tuberculosis
KRRQP

SEQ ID NO: 1430784 - protein, 5 aa, Mycobacterium tuberculosis
KRRRR

SEQ ID NO: 1430785 - protein, 7 aa, Mycobacterium tuberculosis
KRRTPRA

SEQ ID NO: 1430786 - protein, 7 aa, Mycobacterium tuberculosis
KRSGTGI

SEQ ID NO: 1430787 - protein, 8 aa, Mycobacterium tuberculosis
KRTAQKVA

SEQ ID NO: 1430788 - protein, 6 aa, Mycobacterium tuberculosis
KRWDAR

SEQ ID NO: 1430789 - protein, 14 aa, Mycobacterium tuberculosis
KSAKQQKESEDRGE

SEQ ID NO: 1430790 - protein, 6 aa, Mycobacterium tuberculosis
KSASDL

SEQ ID NO: 1430791 - protein, 5 aa, Mycobacterium tuberculosis
KSAVM

SEQ ID NO: 1430792 - protein, 14 aa, Mycobacterium tuberculosis
KSDLERQESREKTG

SEQ ID NO: 1430793 - protein, 6 aa, Mycobacterium tuberculosis
KSDQGL

SEQ ID NO: 1430794 - protein, 5 aa, Mycobacterium tuberculosis
KSDSI

SEQ ID NO: 1430795 - protein, 7 aa, Mycobacterium tuberculosis
KSGKTTI

SEQ ID NO: 1430796 - protein, 6 aa, Mycobacterium tuberculosis
KSGSDY

SEQ ID NO: 1430797 - protein, 6 aa, Mycobacterium tuberculosis
KSIPLS

SEQ ID NO: 1430798 - protein, 4 aa, Mycobacterium tuberculosis
KTDL

SEQ ID NO: 1430799 - protein, 7 aa, Mycobacterium tuberculosis
KTEAAAG

SEQ ID NO: 1430800 - protein, 5 aa, Mycobacterium tuberculosis
KTEPA

SEQ ID NO: 1430801 - protein, 7 aa, Mycobacterium tuberculosis
KTGAARM

SEQ ID NO: 1430802 - protein, 7 aa, Mycobacterium tuberculosis
KTLSDPN

SEQ ID NO: 1430803 - protein, 8 aa, Mycobacterium tuberculosis
KTPTGRSA

SEQ ID NO: 1430804 - protein, 6 aa, Mycobacterium tuberculosis
KTRDAE

SEQ ID NO: 1430805 - protein, 7 aa, Mycobacterium tuberculosis
KTRFNAP

SEQ ID NO: 1430806 - protein, 5 aa, Mycobacterium tuberculosis
KTVPG

SEQ ID NO: 1430807 - protein, 7 aa, Mycobacterium tuberculosis
KVDPDNP

SEQ ID NO: 1430808 - protein, 14 aa, Mycobacterium tuberculosis
KVGEAPKQSGVALP

SEQ ID NO: 1430809 - protein, 10 aa, Mycobacterium tuberculosis
KVGNGHPGTA

SEQ ID NO: 1430810 - protein, 21 aa, Mycobacterium tuberculosis
KVREAGEADWSDPQARARAEQ

SEQ ID NO: 1430811 - protein, 12 aa, Mycobacterium tuberculosis
KYSSSRGPSFSS

SEQ ID NO: 1430812 - protein, 8 aa, Mycobacterium tuberculosis
LAAADTGL

SEQ ID NO: 1430813 - protein, 6 aa, Mycobacterium tuberculosis
LAAASA

SEQ ID NO: 1430814 - protein, 6 aa, Mycobacterium tuberculosis
LAAAST

SEQ ID NO: 1430815 - protein, 10 aa, Mycobacterium tuberculosis
LAAAVDKDGT

SEQ ID NO: 1430816 - protein, 8 aa, Mycobacterium tuberculosis
LAAQSGYS

SEQ ID NO: 1430817 - protein, 13 aa, Mycobacterium tuberculosis
LAARADANPVLGD

SEQ ID NO: 1430818 - protein, 7 aa, Mycobacterium tuberculosis
LAASPSA

SEQ ID NO: 1430819 - protein, 6 aa, Mycobacterium tuberculosis
LADGSA

SEQ ID NO: 1430820 - protein, 8 aa, Mycobacterium tuberculosis
LADPGTGE

SEQ ID NO: 1430821 - protein, 8 aa, Mycobacterium tuberculosis
LADTPEKV

SEQ ID NO: 1430822 - protein, 12 aa, Mycobacterium tuberculosis
LAEAQQTHSGRA

SEQ ID NO: 1430823 - protein, 4 aa, Mycobacterium tuberculosis
LAEQ

SEQ ID NO: 1430824 - protein, 16 aa, Mycobacterium tuberculosis
LAGAQKELASTAAKLA

SEQ ID NO: 1430825 - protein, 11 aa, Mycobacterium tuberculosis
LAGEERAPAPA

SEQ ID NO: 1430826 - protein, 12 aa, Mycobacterium tuberculosis
LAGETGLRPDFP

SEQ ID NO: 1430827 - protein, 11 aa, Mycobacterium tuberculosis
LAGGDAQANAA

SEQ ID NO: 1430828 - protein, 13 aa, Mycobacterium tuberculosis
LAGRGAARPTAQL

SEQ ID NO: 1430829 - protein, 15 aa, Mycobacterium tuberculosis
LAKETATQARAAAEA

SEQ ID NO: 1430830 - protein, 13 aa, Mycobacterium tuberculosis
LAKETSSTKQDAT

SEQ ID NO: 1430831 - protein, 7 aa, Mycobacterium tuberculosis
LAPAEPF

SEQ ID NO: 1430832 - protein, 22 aa, Mycobacterium tuberculosis
LAPAQEAPAQEAPAPRGQYDPL

SEQ ID NO: 1430833 - protein, 9 aa, Mycobacterium tuberculosis
LAPATAQRC

SEQ ID NO: 1430834 - protein, 5 aa, Mycobacterium tuberculosis
LAPRE

SEQ ID NO: 1430835 - protein, 13 aa, Mycobacterium tuberculosis
LAPTSKLAPVTPA

SEQ ID NO: 1430836 - protein, 9 aa, Mycobacterium tuberculosis
LAQADREHA

SEQ ID NO: 1430837 - protein, 9 aa, Mycobacterium tuberculosis
LAQRDTDVD

SEQ ID NO: 1430838 - protein, 6 aa, Mycobacterium tuberculosis
LARNGD

SEQ ID NO: 1430839 - protein, 7 aa, Mycobacterium tuberculosis
LASNGPS

SEQ ID NO: 1430840 - protein, 10 aa, Mycobacterium tuberculosis
LASPGDEREL

SEQ ID NO: 1430841 - protein, 10 aa, Mycobacterium tuberculosis
LASTGGPEEF

SEQ ID NO: 1430842 - protein, 4 aa, Mycobacterium tuberculosis
LATA

SEQ ID NO: 1430843 - protein, 5 aa, Mycobacterium tuberculosis
LATAG

SEQ ID NO: 1430844 - protein, 10 aa, Mycobacterium tuberculosis
LATRRRQSLS

SEQ ID NO: 1430845 - protein, 10 aa, Mycobacterium tuberculosis
LDAANGRGTQ

SEQ ID NO: 1430846 - protein, 6 aa, Mycobacterium tuberculosis
LDAQEA

SEQ ID NO: 1430847 - protein, 7 aa, Mycobacterium tuberculosis
LDAQEAA

SEQ ID NO: 1430848 - protein, 8 aa, Mycobacterium tuberculosis
LDDQGGTA

SEQ ID NO: 1430849 - protein, 6 aa, Mycobacterium tuberculosis
LDDSRA

SEQ ID NO: 1430850 - protein, 5 aa, Mycobacterium tuberculosis
LDEDD

SEQ ID NO: 1430851 - protein, 6 aa, Mycobacterium tuberculosis
LDETGG

SEQ ID NO: 1430852 - protein, 4 aa, Mycobacterium tuberculosis
LDGA

SEQ ID NO: 1430853 - protein, 15 aa, Mycobacterium tuberculosis
LDGGPAAAGFGATST

SEQ ID NO: 1430854 - protein, 10 aa, Mycobacterium tuberculosis
LDGPSGPAAD

SEQ ID NO: 1430855 - protein, 7 aa, Mycobacterium tuberculosis
LDGREAI

SEQ ID NO: 1430856 - protein, 8 aa, Mycobacterium tuberculosis
LDGTERAR

SEQ ID NO: 1430857 - protein, 7 aa, Mycobacterium tuberculosis
LDKDRDL

SEQ ID NO: 1430858 - protein, 9 aa, Mycobacterium tuberculosis
LDPDHDKPS

SEQ ID NO: 1430859 - protein, 8 aa, Mycobacterium tuberculosis
LDPDRGGV

SEQ ID NO: 1430860 - protein, 4 aa, Mycobacterium tuberculosis
LDPS

SEQ ID NO: 1430861 - protein, 5 aa, Mycobacterium tuberculosis
LDRNP

SEQ ID NO: 1430862 - protein, 4 aa, Mycobacterium tuberculosis
LDSA

SEQ ID NO: 1430863 - protein, 39 aa, Mycobacterium tuberculosis
LDVEDSDSDDEDSDEDAADADVDEEDAAGLDGSPGEVDV

SEQ ID NO: 1430864 - protein, 4 aa, Mycobacterium tuberculosis
LEAP

SEQ ID NO: 1430865 - protein, 12 aa, Mycobacterium tuberculosis
LEDNTNERVSAS

SEQ ID NO: 1430866 - protein, 6 aa, Mycobacterium tuberculosis
LEEGGA

SEQ ID NO: 1430867 - protein, 4 aa, Mycobacterium tuberculosis
LEEN

SEQ ID NO: 1430868 - protein, 6 aa, Mycobacterium tuberculosis
LEGEMG

SEQ ID NO: 1430869 - protein, 18 aa, Mycobacterium tuberculosis
LEGTGEVQTPLSGDAARR

SEQ ID NO: 1430870 - protein, 9 aa, Mycobacterium tuberculosis
LEKDPAIHD

SEQ ID NO: 1430871 - protein, 5 aa, Mycobacterium tuberculosis
LENEP

SEQ ID NO: 1430872 - protein, 9 aa, Mycobacterium tuberculosis
LEPGPNGRD

SEQ ID NO: 1430873 - protein, 8 aa, Mycobacterium tuberculosis
LESARADR

SEQ ID NO: 1430874 - protein, 9 aa, Mycobacterium tuberculosis
LESRDAKQE

SEQ ID NO: 1430875 - protein, 5 aa, Mycobacterium tuberculosis
LESSI

SEQ ID NO: 1430876 - protein, 4 aa, Mycobacterium tuberculosis
LGAA

SEQ ID NO: 1430877 - protein, 8 aa, Mycobacterium tuberculosis
LGADDDTA

SEQ ID NO: 1430878 - protein, 7 aa, Mycobacterium tuberculosis
LGAEPGE

SEQ ID NO: 1430879 - protein, 4 aa, Mycobacterium tuberculosis
LGAG

SEQ ID NO: 1430880 - protein, 13 aa, Mycobacterium tuberculosis
LGAGSGVGNVGTL

SEQ ID NO: 1430881 - protein, 4 aa, Mycobacterium tuberculosis
LGAQ

SEQ ID NO: 1430882 - protein, 12 aa, Mycobacterium tuberculosis
LGDEPMDEKPSW

SEQ ID NO: 1430883 - protein, 8 aa, Mycobacterium tuberculosis
LGDQAAVD

SEQ ID NO: 1430884 - protein, 8 aa, Mycobacterium tuberculosis
LGEAGKST

SEQ ID NO: 1430885 - protein, 5 aa, Mycobacterium tuberculosis
LGEGP

SEQ ID NO: 1430886 - protein, 4 aa, Mycobacterium tuberculosis
LGET

SEQ ID NO: 1430887 - protein, 7 aa, Mycobacterium tuberculosis
LGGAEMS

SEQ ID NO: 1430888 - protein, 7 aa, Mycobacterium tuberculosis
LGGEARA

SEQ ID NO: 1430889 - protein, 5 aa, Mycobacterium tuberculosis
LGGGL

SEQ ID NO: 1430890 - protein, 8 aa, Mycobacterium tuberculosis
LGGPTSGE

SEQ ID NO: 1430891 - protein, 20 aa, Mycobacterium tuberculosis
LGGQAGGVIGGSAAGAIGAG

SEQ ID NO: 1430892 - protein, 7 aa, Mycobacterium tuberculosis
LGGRAGY

SEQ ID NO: 1430893 - protein, 4 aa, Mycobacterium tuberculosis
LGGS

SEQ ID NO: 1430894 - protein, 7 aa, Mycobacterium tuberculosis
LGGSNPS

SEQ ID NO: 1430895 - protein, 4 aa, Mycobacterium tuberculosis
LGHS

SEQ ID NO: 1430896 - protein, 4 aa, Mycobacterium tuberculosis
LGLS

SEQ ID NO: 1430897 - protein, 10 aa, Mycobacterium tuberculosis
LGNAGSGNVG

SEQ ID NO: 1430898 - protein, 5 aa, Mycobacterium tuberculosis
LGNAR

SEQ ID NO: 1430899 - protein, 7 aa, Mycobacterium tuberculosis
LGPAATL

SEQ ID NO: 1430900 - protein, 6 aa, Mycobacterium tuberculosis
LGPAQR

SEQ ID NO: 1430901 - protein, 5 aa, Mycobacterium tuberculosis
LGPDE

SEQ ID NO: 1430902 - protein, 5 aa, Mycobacterium tuberculosis
LGPDL

SEQ ID NO: 1430903 - protein, 9 aa, Mycobacterium tuberculosis
LGPGDSDWM

SEQ ID NO: 1430904 - protein, 4 aa, Mycobacterium tuberculosis
LGPK

SEQ ID NO: 1430905 - protein, 12 aa, Mycobacterium tuberculosis
LGPRGPGNGGAR

SEQ ID NO: 1430906 - protein, 12 aa, Mycobacterium tuberculosis
LGPRSTLPGVGG

SEQ ID NO: 1430907 - protein, 5 aa, Mycobacterium tuberculosis
LGQNP

SEQ ID NO: 1430908 - protein, 132 aa, Mycobacterium tuberculosis
LGQPGGNGGQGDAGQAGGAGGAGGAGGAGGSVSGDGGAGGNGGAGGNGGVGASGGAGARGANGIDSIGGTGGAGGGGGDGGAGGVGGHGGDGGVGGAAPSGTVGSHGTGGVGGDGGLGGAGGVGGAGGNGGI

SEQ ID NO: 1430909 - protein, 6 aa, Mycobacterium tuberculosis
LGQRTG

SEQ ID NO: 1430910 - protein, 10 aa, Mycobacterium tuberculosis
LGRAPSASEL

SEQ ID NO: 1430911 - protein, 16 aa, Mycobacterium tuberculosis
LGRHTDQSQIAIFIGL

SEQ ID NO: 1430912 - protein, 9 aa, Mycobacterium tuberculosis
LGRSSSVDI

SEQ ID NO: 1430913 - protein, 10 aa, Mycobacterium tuberculosis
LGSAGGLGGT

SEQ ID NO: 1430914 - protein, 9 aa, Mycobacterium tuberculosis
LGSGNQGDI

SEQ ID NO: 1430915 - protein, 31 aa, Mycobacterium tuberculosis; identical to SEQ ID NO: 180190

SEQ ID NO: 1430916 - protein, 8 aa, Mycobacterium tuberculosis
LGSKARDE

SEQ ID NO: 1430917 - protein, 7 aa, Mycobacterium tuberculosis
LGSPAEG

SEQ ID NO: 1430918 - protein, 14 aa, Mycobacterium tuberculosis
LGSPDPAETYSNSP

SEQ ID NO: 1430919 - protein, 5 aa, Mycobacterium tuberculosis
LGSPK

SEQ ID NO: 1430920 - protein, 13 aa, Mycobacterium tuberculosis
LGTDTRTPIPVDT

SEQ ID NO: 1430921 - protein, 11 aa, Mycobacterium tuberculosis
LGTPGQGAYAA

SEQ ID NO: 1430922 - protein, 8 aa, Mycobacterium tuberculosis
LGTTTIKD

SEQ ID NO: 1430923 - protein, 5 aa, Mycobacterium tuberculosis
LHRGR

SEQ ID NO: 1430924 - protein, 29 aa, Mycobacterium tuberculosis
LIGSSSGDTAAASAAAYAPPPEVNACVNW

SEQ ID NO: 1430925 - protein, 6 aa, Mycobacterium tuberculosis
LIPDAD

SEQ ID NO: 1430926 - protein, 7 aa, Mycobacterium tuberculosis
LKAGKST

SEQ ID NO: 1430927 - protein, 19 aa, Mycobacterium tuberculosis
LKDENAALKDTSPSAQAVT

SEQ ID NO: 1430928 - protein, 5 aa, Mycobacterium tuberculosis
LKGDP

SEQ ID NO: 1430929 - protein, 8 aa, Mycobacterium tuberculosis
LKKDTAEA

SEQ ID NO: 1430930 - protein, 4 aa, Mycobacterium tuberculosis
LKPA

SEQ ID NO: 1430931 - protein, 7 aa, Mycobacterium tuberculosis
LKSNPGI

SEQ ID NO: 1430932 - protein, 16 aa, Mycobacterium tuberculosis
LKTGKAQSEVKQTGRP

SEQ ID NO: 1430933 - protein, 7 aa, Mycobacterium tuberculosis
LLGPDRP

SEQ ID NO: 1430934 - protein, 9 aa, Mycobacterium tuberculosis
LLGSPGQAA

SEQ ID NO: 1430935 - protein, 6 aa, Mycobacterium tuberculosis
LLPGNG

SEQ ID NO: 1430936 - protein, 15 aa, Mycobacterium tuberculosis
LNDTKTKALKMCVAA

SEQ ID NO: 1430937 - protein, 44 aa, Mycobacterium tuberculosis; identical to SEQ ID NO: 180260

SEQ ID NO: 1430938 - protein, 35 aa, Mycobacterium tuberculosis; identical to SEQ ID NO: 180261

SEQ ID NO: 1430939 - protein, 4 aa, Mycobacterium tuberculosis
LNGH

SEQ ID NO: 1430940 - protein, 7 aa, Mycobacterium tuberculosis
LNQAAKE

SEQ ID NO: 1430941 - protein, 5 aa, Mycobacterium tuberculosis
LNRSS

SEQ ID NO: 1430942 - protein, 19 aa, Mycobacterium tuberculosis
LNSGNYNTGLANSGNVNTG

SEQ ID NO: 1430943 - protein, 8 aa, Mycobacterium tuberculosis
LNYDNPAV

SEQ ID NO: 1430944 - protein, 11 aa, Mycobacterium tuberculosis
LPAASRGSGTV

SEQ ID NO: 1430945 - protein, 14 aa, Mycobacterium tuberculosis
LPAGPTPAGDALDR

SEQ ID NO: 1430946 - protein, 7 aa, Mycobacterium tuberculosis
LPAGTAK

SEQ ID NO: 1430947 - protein, 7 aa, Mycobacterium tuberculosis
LPATATV

SEQ ID NO: 1430948 - protein, 20 aa, Mycobacterium tuberculosis
LPDGTTVSTDDGPRPGTTYE

SEQ ID NO: 1430949 - protein, 6 aa, Mycobacterium tuberculosis
LPDQLG

SEQ ID NO: 1430950 - protein, 4 aa, Mycobacterium tuberculosis
LPDR

SEQ ID NO: 1430951 - protein, 9 aa, Mycobacterium tuberculosis
LPEDASPAY

SEQ ID NO: 1430952 - protein, 4 aa, Mycobacterium tuberculosis
LPEG

SEQ ID NO: 1430953 - protein, 5 aa, Mycobacterium tuberculosis
LPEGT

SEQ ID NO: 1430954 - protein, 7 aa, Mycobacterium tuberculosis
LPEPDST

SEQ ID NO: 1430955 - protein, 10 aa, Mycobacterium tuberculosis
LPEPTASAAF

SEQ ID NO: 1430956 - protein, 12 aa, Mycobacterium tuberculosis
LPGDDPLSPYAD

SEQ ID NO: 1430957 - protein, 5 aa, Mycobacterium tuberculosis
LPGDG

SEQ ID NO: 1430958 - protein, 6 aa, Mycobacterium tuberculosis
LPGEDV

SEQ ID NO: 1430959 - protein, 8 aa, Mycobacterium tuberculosis
LPGEDVTD

SEQ ID NO: 1430960 - protein, 9 aa, Mycobacterium tuberculosis
LPGGETAND

SEQ ID NO: 1430961 - protein, 5 aa, Mycobacterium tuberculosis
LPGGQ

SEQ ID NO: 1430962 - protein, 23 aa, Mycobacterium tuberculosis
LPGRRPARRSSSRSVRSQRVVDS

SEQ ID NO: 1430963 - protein, 6 aa, Mycobacterium tuberculosis
LPGRSV

SEQ ID NO: 1430964 - protein, 10 aa, Mycobacterium tuberculosis
LPKPKRDYGR

SEQ ID NO: 1430965 - protein, 6 aa, Mycobacterium tuberculosis
LPLPAG

SEQ ID NO: 1430966 - protein, 5 aa, Mycobacterium tuberculosis
LPNKP

SEQ ID NO: 1430967 - protein, 12 aa, Mycobacterium tuberculosis
LPNSSSSQPSYL

SEQ ID NO: 1430968 - protein, 7 aa, Mycobacterium tuberculosis
LPPAGSY

SEQ ID NO: 1430969 - protein, 7 aa, Mycobacterium tuberculosis
LPPGAGE

SEQ ID NO: 1430970 - protein, 21 aa, Mycobacterium tuberculosis
LPPGDPPAPPAPPLPPSAKSP

SEQ ID NO: 1430971 - protein, 5 aa, Mycobacterium tuberculosis
LPPPD

SEQ ID NO: 1430972 - protein, 19 aa, Mycobacterium tuberculosis
LPPPPQPPGREPVHRRALA

SEQ ID NO: 1430973 - protein, 7 aa, Mycobacterium tuberculosis
LPPRAGT

SEQ ID NO: 1430974 - protein, 5 aa, Mycobacterium tuberculosis
LPPRF

SEQ ID NO: 1430975 - protein, 4 aa, Mycobacterium tuberculosis
LPPT

SEQ ID NO: 1430976 - protein, 6 aa, Mycobacterium tuberculosis
LPPTYD

SEQ ID NO: 1430977 - protein, 18 aa, Mycobacterium tuberculosis
LPQPGEHVPAQAPPATTL

SEQ ID NO: 1430978 - protein, 4 aa, Mycobacterium tuberculosis
LPRA

SEQ ID NO: 1430979 - protein, 7 aa, Mycobacterium tuberculosis
LPREEWP

SEQ ID NO: 1430980 - protein, 8 aa, Mycobacterium tuberculosis
LPTLPEET

SEQ ID NO: 1430981 - protein, 8 aa, Mycobacterium tuberculosis
LPTSPGPR

SEQ ID NO: 1430982 - protein, 6 aa, Mycobacterium tuberculosis
LPTTTI

SEQ ID NO: 1430983 - protein, 8 aa, Mycobacterium tuberculosis
LQEDKEPV

SEQ ID NO: 1430984 - protein, 5 aa, Mycobacterium tuberculosis
LQGNL

SEQ ID NO: 1430985 - protein, 5 aa, Mycobacterium tuberculosis
LQGTE

SEQ ID NO: 1430986 - protein, 11 aa, Mycobacterium tuberculosis
LQPGSATVAET

SEQ ID NO: 1430987 - protein, 11 aa, Mycobacterium tuberculosis
LQPNAGSQGEY

SEQ ID NO: 1430988 - protein, 9 aa, Mycobacterium tuberculosis
LQPSHNPQV

SEQ ID NO: 1430989 - protein, 7 aa, Mycobacterium tuberculosis
LQTTEAC

SEQ ID NO: 1430990 - protein, 5 aa, Mycobacterium tuberculosis
LQYSG

SEQ ID NO: 1430991 - protein, 11 aa, Mycobacterium tuberculosis
LRAQGSSTYME

SEQ ID NO: 1430992 - protein, 7 aa, Mycobacterium tuberculosis
LRDAEND

SEQ ID NO: 1430993 - protein, 4 aa, Mycobacterium tuberculosis
LRET

SEQ ID NO: 1430994 - protein, 7 aa, Mycobacterium tuberculosis
LRGDTRE

SEQ ID NO: 1430995 - protein, 4 aa, Mycobacterium tuberculosis
LRKG

SEQ ID NO: 1430996 - protein, 6 aa, Mycobacterium tuberculosis
LRKSRS

SEQ ID NO: 1430997 - protein, 12 aa, Mycobacterium tuberculosis
LRPNSGRVTRRS

SEQ ID NO: 1430998 - protein, 4 aa, Mycobacterium tuberculosis
LRQE

SEQ ID NO: 1430999 - protein, 5 aa, Mycobacterium tuberculosis
LRSEG

SEQ ID NO: 1431000 - protein, 5 aa, Mycobacterium tuberculosis
LSAKE

SEQ ID NO: 1431001 - protein, 6 aa, Mycobacterium tuberculosis
LSAPGS

SEQ ID NO: 1431002 - protein, 9 aa, Mycobacterium tuberculosis
LSDDERDYA

SEQ ID NO: 1431003 - protein, 6 aa, Mycobacterium tuberculosis
LSDQEL

SEQ ID NO: 1431004 - protein, 6 aa, Mycobacterium tuberculosis
LSEARS

SEQ ID NO: 1431005 - protein, 4 aa, Mycobacterium tuberculosis
LSGA

SEQ ID NO: 1431006 - protein, 5 aa, Mycobacterium tuberculosis
LSGAD

SEQ ID NO: 1431007 - protein, 6 aa, Mycobacterium tuberculosis
LSGGER

SEQ ID NO: 1431008 - protein, 6 aa, Mycobacterium tuberculosis
LSGTKV

SEQ ID NO: 1431009 - protein, 4 aa, Mycobacterium tuberculosis
LSGV

SEQ ID NO: 1431010 - protein, 7 aa, Mycobacterium tuberculosis
LSHTQGE

SEQ ID NO: 1431011 - protein, 6 aa, Mycobacterium tuberculosis
LSHYSD

SEQ ID NO: 1431012 - protein, 9 aa, Mycobacterium tuberculosis
LSPDGPDRV

SEQ ID NO: 1431013 - protein, 4 aa, Mycobacterium tuberculosis
LSPE

SEQ ID NO: 1431014 - protein, 9 aa, Mycobacterium tuberculosis
LSPGATYRS

SEQ ID NO: 1431015 - protein, 4 aa, Mycobacterium tuberculosis
LSPI

SEQ ID NO: 1431016 - protein, 4 aa, Mycobacterium tuberculosis
LSPS

SEQ ID NO: 1431017 - protein, 4 aa, Mycobacterium tuberculosis
LSQA

SEQ ID NO: 1431018 - protein, 13 aa, Mycobacterium tuberculosis
LSQDGLTSLGAPG

SEQ ID NO: 1431019 - protein, 8 aa, Mycobacterium tuberculosis
LSSAATGY

SEQ ID NO: 1431020 - protein, 9 aa, Mycobacterium tuberculosis
LSTPPTLAQ

SEQ ID NO: 1431021 - protein, 7 aa, Mycobacterium tuberculosis
LSTRAES

SEQ ID NO: 1431022 - protein, 5 aa, Mycobacterium tuberculosis
LSTTD

SEQ ID NO: 1431023 - protein, 5 aa, Mycobacterium tuberculosis
LTADA

SEQ ID NO: 1431024 - protein, 14 aa, Mycobacterium tuberculosis
LTDATLPPNAAAWL

SEQ ID NO: 1431025 - protein, 10 aa, Mycobacterium tuberculosis
LTDEDAEGSA

SEQ ID NO: 1431026 - protein, 11 aa, Mycobacterium tuberculosis
LTDTGRTQAEL

SEQ ID NO: 1431027 - protein, 9 aa, Mycobacterium tuberculosis
LTEDATADR

SEQ ID NO: 1431028 - protein, 9 aa, Mycobacterium tuberculosis
LTEDSDDLA

SEQ ID NO: 1431029 - protein, 13 aa, Mycobacterium tuberculosis
LTEQSARQDAAEQ

SEQ ID NO: 1431030 - protein, 6 aa, Mycobacterium tuberculosis
LTESDA

SEQ ID NO: 1431031 - protein, 7 aa, Mycobacterium tuberculosis
LTGEPLP

SEQ ID NO: 1431032 - protein, 8 aa, Mycobacterium tuberculosis
LTGKDTEL

SEQ ID NO: 1431033 - protein, 6 aa, Mycobacterium tuberculosis
LTGQHP

SEQ ID NO: 1431034 - protein, 15 aa, Mycobacterium tuberculosis
LTNKDDLEARGAKTL

SEQ ID NO: 1431035 - protein, 14 aa, Mycobacterium tuberculosis
LTNSLGESKPPQVH

SEQ ID NO: 1431036 - protein, 10 aa, Mycobacterium tuberculosis
LTPPADQPAA

SEQ ID NO: 1431037 - protein, 5 aa, Mycobacterium tuberculosis
LTPRG

SEQ ID NO: 1431038 - protein, 6 aa, Mycobacterium tuberculosis
LTPRNT

SEQ ID NO: 1431039 - protein, 6 aa, Mycobacterium tuberculosis
LTPTER

SEQ ID NO: 1431040 - protein, 16 aa, Mycobacterium tuberculosis
LTSAAAAAAGPPSAAG

SEQ ID NO: 1431041 - protein, 5 aa, Mycobacterium tuberculosis
LTTGE

SEQ ID NO: 1431042 - protein, 8 aa, Mycobacterium tuberculosis
LTTSTDGW

SEQ ID NO: 1431043 - protein, 4 aa, Mycobacterium tuberculosis
LTTV

SEQ ID NO: 1431044 - protein, 8 aa, Mycobacterium tuberculosis
LVGPDDPR

SEQ ID NO: 1431045 - protein, 6 aa, Mycobacterium tuberculosis
LYGPNG

SEQ ID NO: 1431046 - protein, 9 aa, Mycobacterium tuberculosis
MADSYDEQG

SEQ ID NO: 1431047 - protein, 6 aa, Mycobacterium tuberculosis
MAEPRY

SEQ ID NO: 1431048 - protein, 9 aa, Mycobacterium tuberculosis
MAGKSDIDA

SEQ ID NO: 1431049 - protein, 6 aa, Mycobacterium tuberculosis
MAPESL

SEQ ID NO: 1431050 - protein, 8 aa, Mycobacterium tuberculosis
MASDQPLA

SEQ ID NO: 1431051 - protein, 16 aa, Mycobacterium tuberculosis
MDAAAQSAAADADPAK

SEQ ID NO: 1431052 - protein, 6 aa, Mycobacterium tuberculosis
MDSPDF

SEQ ID NO: 1431053 - protein, 6 aa, Mycobacterium tuberculosis
MEKTGA

SEQ ID NO: 1431054 - protein, 14 aa, Mycobacterium tuberculosis
MESETMKRQTTGPA

SEQ ID NO: 1431055 - protein, 8 aa, Mycobacterium tuberculosis
MGPPADPE

SEQ ID NO: 1431056 - protein, 6 aa, Mycobacterium tuberculosis
MGPPIA

SEQ ID NO: 1431057 - protein, 4 aa, Mycobacterium tuberculosis
MGTQ

SEQ ID NO: 1431058 - protein, 4 aa, Mycobacterium tuberculosis
MKAG

SEQ ID NO: 1431059 - protein, 8 aa, Mycobacterium tuberculosis
MKNPADSA

SEQ ID NO: 1431060 - protein, 4 aa, Mycobacterium tuberculosis
MPDG

SEQ ID NO: 1431061 - protein, 4 aa, Mycobacterium tuberculosis
MPDP

SEQ ID NO: 1431062 - protein, 9 aa, Mycobacterium tuberculosis
MPDYPEEGA

SEQ ID NO: 1431063 - protein, 4 aa, Mycobacterium tuberculosis
MPGQ

SEQ ID NO: 1431064 - protein, 7 aa, Mycobacterium tuberculosis
MPGSGLA

SEQ ID NO: 1431065 - protein, 11 aa, Mycobacterium tuberculosis
MPSATAQRPGD

SEQ ID NO: 1431066 - protein, 14 aa, Mycobacterium tuberculosis
MPTSMGKDSTPTAN

SEQ ID NO: 1431067 - protein, 15 aa, Mycobacterium tuberculosis
MPVSPGAQWPATRGT

SEQ ID NO: 1431068 - protein, 5 aa, Mycobacterium tuberculosis
MQEQV

SEQ ID NO: 1431069 - protein, 13 aa, Mycobacterium tuberculosis
MRGRGGATSYSKD

SEQ ID NO: 1431070 - protein, 10 aa, Mycobacterium tuberculosis
MRPDTTKEGL

SEQ ID NO: 1431071 - protein, 5 aa, Mycobacterium tuberculosis
MSAPN

SEQ ID NO: 1431072 - protein, 6 aa, Mycobacterium tuberculosis
MSRGEH

SEQ ID NO: 1431073 - protein, 39 aa, Mycobacterium tuberculosis; identical to SEQ ID NO: 194508

SEQ ID NO: 1431074 - protein, 8 aa, Mycobacterium tuberculosis
MTGASSAE

SEQ ID NO: 1431075 - protein, 8 aa, Mycobacterium tuberculosis
MTQRRDEP

SEQ ID NO: 1431076 - protein, 12 aa, Mycobacterium tuberculosis
MTQTHPSIPPEL

SEQ ID NO: 1431077 - protein, 4 aa, Mycobacterium tuberculosis
MTRP

SEQ ID NO: 1431078 - protein, 30 aa, Mycobacterium tuberculosis
MTTLPGGDAPAAGVPGLPGMPASGAGRAGV

SEQ ID NO: 1431079 - protein, 10 aa, Mycobacterium tuberculosis
NAAPNPELRA

SEQ ID NO: 1431080 - protein, 8 aa, Mycobacterium tuberculosis
NAARDEPA

SEQ ID NO: 1431081 - protein, 19 aa, Mycobacterium tuberculosis
NAATAEKEAELRANADAKE

SEQ ID NO: 1431082 - protein, 6 aa, Mycobacterium tuberculosis
NAEEGR

SEQ ID NO: 1431083 - protein, 12 aa, Mycobacterium tuberculosis
NAEHSSTGLRSA

SEQ ID NO: 1431084 - protein, 7 aa, Mycobacterium tuberculosis
NAGLSAA

SEQ ID NO: 1431085 - protein, 13 aa, Mycobacterium tuberculosis
NAGRTAAGDDNDA

SEQ ID NO: 1431086 - protein, 13 aa, Mycobacterium tuberculosis
NAHTAHPPRADEL

SEQ ID NO: 1431087 - protein, 7 aa, Mycobacterium tuberculosis
NAKAAVE

SEQ ID NO: 1431088 - protein, 8 aa, Mycobacterium tuberculosis
NAKAAVEE

SEQ ID NO: 1431089 - protein, 6 aa, Mycobacterium tuberculosis
NALPRR

SEQ ID NO: 1431090 - protein, 5 aa, Mycobacterium tuberculosis
NAPAR

SEQ ID NO: 1431091 - protein, 10 aa, Mycobacterium tuberculosis
NAPRRNRVGR

SEQ ID NO: 1431092 - protein, 4 aa, Mycobacterium tuberculosis
NAPT

SEQ ID NO: 1431093 - protein, 6 aa, Mycobacterium tuberculosis
NAQTVR

SEQ ID NO: 1431094 - protein, 4 aa, Mycobacterium tuberculosis
NARV

SEQ ID NO: 1431095 - protein, 8 aa, Mycobacterium tuberculosis
NASAQDQL

SEQ ID NO: 1431096 - protein, 8 aa, Mycobacterium tuberculosis
NASRSADE

SEQ ID NO: 1431097 - protein, 10 aa, Mycobacterium tuberculosis
NATKGKKERL

SEQ ID NO: 1431098 - protein, 7 aa, Mycobacterium tuberculosis
NATRELS

SEQ ID NO: 1431099 - protein, 6 aa, Mycobacterium tuberculosis
NCDPDE

SEQ ID NO: 1431100 - protein, 8 aa, Mycobacterium tuberculosis
NDDADTPF

SEQ ID NO: 1431101 - protein, 5 aa, Mycobacterium tuberculosis
NDGEL

SEQ ID NO: 1431102 - protein, 12 aa, Mycobacterium tuberculosis
NDMQAPPTPGAD

SEQ ID NO: 1431103 - protein, 9 aa, Mycobacterium tuberculosis
NDPERAGVG

SEQ ID NO: 1431104 - protein, 9 aa, Mycobacterium tuberculosis
NDPQNRINR

SEQ ID NO: 1431105 - protein, 9 aa, Mycobacterium tuberculosis
NDPTSSAQI

SEQ ID NO: 1431106 - protein, 10 aa, Mycobacterium tuberculosis
NDTPVASASI

SEQ ID NO: 1431107 - protein, 8 aa, Mycobacterium tuberculosis
NDYTERTT

SEQ ID NO: 1431108 - protein, 17 aa, Mycobacterium tuberculosis
NEADAGVPARRRGRGVA

SEQ ID NO: 1431109 - protein, 4 aa, Mycobacterium tuberculosis
NEAE

SEQ ID NO: 1431110 - protein, 8 aa, Mycobacterium tuberculosis
NEDDRTAV

SEQ ID NO: 1431111 - protein, 12 aa, Mycobacterium tuberculosis
NEGFSGGEKKRH

SEQ ID NO: 1431112 - protein, 6 aa, Mycobacterium tuberculosis
NEHDEA

SEQ ID NO: 1431113 - protein, 7 aa, Mycobacterium tuberculosis
NELGRRD

SEQ ID NO: 1431114 - protein, 8 aa, Mycobacterium tuberculosis
NEPESPAE

SEQ ID NO: 1431115 - protein, 14 aa, Mycobacterium tuberculosis
NEPGAALPDRPATS

SEQ ID NO: 1431116 - protein, 4 aa, Mycobacterium tuberculosis
NERQ

SEQ ID NO: 1431117 - protein, 7 aa, Mycobacterium tuberculosis
NESGIDV

SEQ ID NO: 1431118 - protein, 19 aa, Mycobacterium tuberculosis
NETETSGQDPALAPTAEQE

SEQ ID NO: 1431119 - protein, 6 aa, Mycobacterium tuberculosis
NETSTG

SEQ ID NO: 1431120 - protein, 6 aa, Mycobacterium tuberculosis
NFASDG

SEQ ID NO: 1431121 - protein, 10 aa, Mycobacterium tuberculosis
NFDPTRRSGR

SEQ ID NO: 1431122 - protein, 9 aa, Mycobacterium tuberculosis
NFGHTQSTA

SEQ ID NO: 1431123 - protein, 23 aa, Mycobacterium tuberculosis
NFYPSPDRESAYASPRIGQPVGS

SEQ ID NO: 1431124 - protein, 16 aa, Mycobacterium tuberculosis
NGADGAPGTGAAGGAG

SEQ ID NO: 1431125 - protein, 16 aa, Mycobacterium tuberculosis
NGADGSTPGQAGGPGG

SEQ ID NO: 1431126 - protein, 16 aa, Mycobacterium tuberculosis
NGANATTPGGNGGDGG

SEQ ID NO: 1431127 - protein, 17 aa, Mycobacterium tuberculosis
NGANGADGTGAPGGPGG

SEQ ID NO: 1431128 - protein, 16 aa, Mycobacterium tuberculosis
NGANGAPGSGAPGGHG

SEQ ID NO: 1431129 - protein, 16 aa, Mycobacterium tuberculosis
NGANGTPGTGAAGGAG

SEQ ID NO: 1431130 - protein, 17 aa, Mycobacterium tuberculosis
NGANGVAGTGQNGGDGG

SEQ ID NO: 1431131 - protein, 16 aa, Mycobacterium tuberculosis
NGAQQDRVPGGTQQIA

SEQ ID NO: 1431132 - protein, 15 aa, Mycobacterium tuberculosis
NGASASAIARGRPVE

SEQ ID NO: 1431133 - protein, 8 aa, Mycobacterium tuberculosis
NGDTAAAP

SEQ ID NO: 1431134 - protein, 13 aa, Mycobacterium tuberculosis
NGFDGGWTAEASH

SEQ ID NO: 1431135 - protein, 8 aa, Mycobacterium tuberculosis
NGGANDGW

SEQ ID NO: 1431136 - protein, 39 aa, Mycobacterium tuberculosis; identical to SEQ ID NO: 181315

SEQ ID NO: 1431137 - protein, 23 aa, Mycobacterium tuberculosis
NGGNGGAGAAGTNGSAGGAGGAG

SEQ ID NO: 1431138 - protein, 57 aa, Mycobacterium tuberculosis; identical to SEQ ID NO: 181320

SEQ ID NO: 1431139 - protein, 12 aa, Mycobacterium tuberculosis
NGGNGGAGGIGG

SEQ ID NO: 1431140 - protein, 42 aa, Mycobacterium tuberculosis
NGGNGGAGGNGGAAGLIGNGGAGGAGGAGGAGGAGGAGGTGG

SEQ ID NO: 1431141 - protein, 22 aa, Mycobacterium tuberculosis
NGGNGGNGGKAGGTPGAGGTSG

SEQ ID NO: 1431142 - protein, 20 aa, Mycobacterium tuberculosis
NGGNGGSGATGQAGGAGGAA

SEQ ID NO: 1431143 - protein, 24 aa, Mycobacterium tuberculosis
NGGNGGSGGTGAPAGTAGAGGLGG

SEQ ID NO: 1431144 - protein, 26 aa, Mycobacterium tuberculosis
NGGPGGAAGLGTAGGVSPAGGAGGAA

SEQ ID NO: 1431145 - protein, 28 aa, Mycobacterium tuberculosis
NGGTGGAGGAAGATLVGGTGGVGGATGL

SEQ ID NO: 1431146 - protein, 38 aa, Mycobacterium tuberculosis; identical to SEQ ID NO: 181356

SEQ ID NO: 1431147 - protein, 13 aa, Mycobacterium tuberculosis
NGMGGDAYRTDPL

SEQ ID NO: 1431148 - protein, 4 aa, Mycobacterium tuberculosis
NGNA

SEQ ID NO: 1431149 - protein, 23 aa, Mycobacterium tuberculosis
NGNFGSGNLGSGNTGSTNFGGGN

SEQ ID NO: 1431150 - protein, 5 aa, Mycobacterium tuberculosis
NGQSI

SEQ ID NO: 1431151 - protein, 5 aa, Mycobacterium tuberculosis
NGQTG

SEQ ID NO: 1431152 - protein, 18 aa, Mycobacterium tuberculosis
NGSCGDGGDGGNGAPGGV

SEQ ID NO: 1431153 - protein, 13 aa, Mycobacterium tuberculosis
NGSFRATDEAETV

SEQ ID NO: 1431154 - protein, 9 aa, Mycobacterium tuberculosis
NGSPSWSAA

SEQ ID NO: 1431155 - protein, 8 aa, Mycobacterium tuberculosis
NGSQIPRE

SEQ ID NO: 1431156 - protein, 10 aa, Mycobacterium tuberculosis
NGTANGKAAL

SEQ ID NO: 1431157 - protein, 5 aa, Mycobacterium tuberculosis
NGTGQ

SEQ ID NO: 1431158 - protein, 6 aa, Mycobacterium tuberculosis
NGTRID

SEQ ID NO: 1431159 - protein, 6 aa, Mycobacterium tuberculosis
NHRGGT

SEQ ID NO: 1431160 - protein, 4 aa, Mycobacterium tuberculosis
NIGN

SEQ ID NO: 1431161 - protein, 11 aa, Mycobacterium tuberculosis
NIPGGAPIPQE

SEQ ID NO: 1431162 - protein, 10 aa, Mycobacterium tuberculosis
NKGRTVDTPY

SEQ ID NO: 1431163 - protein, 11 aa, Mycobacterium tuberculosis
NKHRRRRAAQV

SEQ ID NO: 1431164 - protein, 4 aa, Mycobacterium tuberculosis
NKRS

SEQ ID NO: 1431165 - protein, 7 aa, Mycobacterium tuberculosis
NLGDGNV

SEQ ID NO: 1431166 - protein, 8 aa, Mycobacterium tuberculosis
NLGGGNVG

SEQ ID NO: 1431167 - protein, 4 aa, Mycobacterium tuberculosis
NLKD

SEQ ID NO: 1431168 - protein, 12 aa, Mycobacterium tuberculosis
NLNPSQAHGSGD

SEQ ID NO: 1431169 - protein, 7 aa, Mycobacterium tuberculosis
NLPFPDE

SEQ ID NO: 1431170 - protein, 10 aa, Mycobacterium tuberculosis
NLPSRRENDQ

SEQ ID NO: 1431171 - protein, 10 aa, Mycobacterium tuberculosis
NLPTPSGNTF

SEQ ID NO: 1431172 - protein, 4 aa, Mycobacterium tuberculosis
NLSR

SEQ ID NO: 1431173 - protein, 4 aa, Mycobacterium tuberculosis
NMNE

SEQ ID NO: 1431174 - protein, 14 aa, Mycobacterium tuberculosis
NNNIGMGNSGNGVG

SEQ ID NO: 1431175 - protein, 7 aa, Mycobacterium tuberculosis
NNNNGHE

SEQ ID NO: 1431176 - protein, 14 aa, Mycobacterium tuberculosis
NNPYGSRPSTIYPD

SEQ ID NO: 1431177 - protein, 4 aa, Mycobacterium tuberculosis
NNTA

SEQ ID NO: 1431178 - protein, 14 aa, Mycobacterium tuberculosis
NPASHQDDSHSTGL

SEQ ID NO: 1431179 - protein, 5 aa, Mycobacterium tuberculosis
NPDPA

SEQ ID NO: 1431180 - protein, 9 aa, Mycobacterium tuberculosis
NPDPDAAGA

SEQ ID NO: 1431181 - protein, 5 aa, Mycobacterium tuberculosis
NPGTS

SEQ ID NO: 1431182 - protein, 5 aa, Mycobacterium tuberculosis
NPIGA

SEQ ID NO: 1431183 - protein, 6 aa, Mycobacterium tuberculosis
NPKHEY

SEQ ID NO: 1431184 - protein, 7 aa, Mycobacterium tuberculosis
NPKHPPL

SEQ ID NO: 1431185 - protein, 5 aa, Mycobacterium tuberculosis
NPNPH

SEQ ID NO: 1431186 - protein, 4 aa, Mycobacterium tuberculosis
NPQR

SEQ ID NO: 1431187 - protein, 5 aa, Mycobacterium tuberculosis
NPSRL

SEQ ID NO: 1431188 - protein, 5 aa, Mycobacterium tuberculosis
NQAAH

SEQ ID NO: 1431189 - protein, 10 aa, Mycobacterium tuberculosis
NQANYAASKA

SEQ ID NO: 1431190 - protein, 6 aa, Mycobacterium tuberculosis
NQGNHE

SEQ ID NO: 1431191 - protein, 6 aa, Mycobacterium tuberculosis
NQHADA

SEQ ID NO: 1431192 - protein, 5 aa, Mycobacterium tuberculosis
NQHDE

SEQ ID NO: 1431193 - protein, 5 aa, Mycobacterium tuberculosis
NQHGP

SEQ ID NO: 1431194 - protein, 4 aa, Mycobacterium tuberculosis
NQQA

SEQ ID NO: 1431195 - protein, 5 aa, Mycobacterium tuberculosis
NQRET

SEQ ID NO: 1431196 - protein, 10 aa, Mycobacterium tuberculosis
NQTEEAGRRR

SEQ ID NO: 1431197 - protein, 4 aa, Mycobacterium tuberculosis
NQYA

SEQ ID NO: 1431198 - protein, 6 aa, Mycobacterium tuberculosis
NRAAAR

SEQ ID NO: 1431199 - protein, 7 aa, Mycobacterium tuberculosis
NRANVGG

SEQ ID NO: 1431200 - protein, 7 aa, Mycobacterium tuberculosis
NRDESKF

SEQ ID NO: 1431201 - protein, 8 aa, Mycobacterium tuberculosis
NRDLARGQ

SEQ ID NO: 1431202 - protein, 5 aa, Mycobacterium tuberculosis
NREPV

SEQ ID NO: 1431203 - protein, 8 aa, Mycobacterium tuberculosis
NRNFEGRI

SEQ ID NO: 1431204 - protein, 5 aa, Mycobacterium tuberculosis
NRPDL

SEQ ID NO: 1431205 - protein, 5 aa, Mycobacterium tuberculosis
NRRHH

SEQ ID NO: 1431206 - protein, 5 aa, Mycobacterium tuberculosis
NSAGK

SEQ ID NO: 1431207 - protein, 7 aa, Mycobacterium tuberculosis
NSAHPES

SEQ ID NO: 1431208 - protein, 10 aa, Mycobacterium tuberculosis
NSAHSDADHQ

SEQ ID NO: 1431209 - protein, 5 aa, Mycobacterium tuberculosis
NSENS

SEQ ID NO: 1431210 - protein, 10 aa, Mycobacterium tuberculosis
NSGDGGVSGF

SEQ ID NO: 1431211 - protein, 19 aa, Mycobacterium tuberculosis
NSGGFNTGIGNAGSTNTGV

SEQ ID NO: 1431212 - protein, 6 aa, Mycobacterium tuberculosis
NSGPGS

SEQ ID NO: 1431213 - protein, 19 aa, Mycobacterium tuberculosis
NSGRFNTGIGNSGTASTGL

SEQ ID NO: 1431214 - protein, 17 aa, Mycobacterium tuberculosis
NSGSGNIGFGNSGTGNV

SEQ ID NO: 1431215 - protein, 5 aa, Mycobacterium tuberculosis
NSGTA

SEQ ID NO: 1431216 - protein, 12 aa, Mycobacterium tuberculosis
NSRPTRAEASDV

SEQ ID NO: 1431217 - protein, 6 aa, Mycobacterium tuberculosis
NSSNSR

SEQ ID NO: 1431218 - protein, 4 aa, Mycobacterium tuberculosis
NSSV

SEQ ID NO: 1431219 - protein, 5 aa, Mycobacterium tuberculosis
NTEGD

SEQ ID NO: 1431220 - protein, 14 aa, Mycobacterium tuberculosis
NTESARKSVEQFER

SEQ ID NO: 1431221 - protein, 9 aa, Mycobacterium tuberculosis
NTGDTNTGI

SEQ ID NO: 1431222 - protein, 11 aa, Mycobacterium tuberculosis
NTGGGGGSGFA

SEQ ID NO: 1431223 - protein, 11 aa, Mycobacterium tuberculosis
NTGGGGGSGIA

SEQ ID NO: 1431224 - protein, 5 aa, Mycobacterium tuberculosis
NTGLG

SEQ ID NO: 1431225 - protein, 16 aa, Mycobacterium tuberculosis
NTGNNNIGNGLTGNNQ

SEQ ID NO: 1431226 - protein, 14 aa, Mycobacterium tuberculosis
NTGVANAGSYNTGS

SEQ ID NO: 1431227 - protein, 9 aa, Mycobacterium tuberculosis
NTIDATGVG

SEQ ID NO: 1431228 - protein, 6 aa, Mycobacterium tuberculosis
NTITDR

SEQ ID NO: 1431229 - protein, 6 aa, Mycobacterium tuberculosis
NTLSSY

SEQ ID NO: 1431230 - protein, 5 aa, Mycobacterium tuberculosis
NTLTG

SEQ ID NO: 1431231 - protein, 7 aa, Mycobacterium tuberculosis
NTPAIAA

SEQ ID NO: 1431232 - protein, 10 aa, Mycobacterium tuberculosis
NTPAIAATEA

SEQ ID NO: 1431233 - protein, 6 aa, Mycobacterium tuberculosis
NVADNG

SEQ ID NO: 1431234 - protein, 4 aa, Mycobacterium tuberculosis
NVDE

SEQ ID NO: 1431235 - protein, 9 aa, Mycobacterium tuberculosis
NVGAGSSGW

SEQ ID NO: 1431236 - protein, 9 aa, Mycobacterium tuberculosis
NVGAGTSGW

SEQ ID NO: 1431237 - protein, 17 aa, Mycobacterium tuberculosis
NVGAQNLGAANAGSGNF

SEQ ID NO: 1431238 - protein, 8 aa, Mycobacterium tuberculosis
NVGKPQVA

SEQ ID NO: 1431239 - protein, 22 aa, Mycobacterium tuberculosis
NVGSGNIGNANVGGGNSGDNNF

SEQ ID NO: 1431240 - protein, 35 aa, Mycobacterium tuberculosis; identical to SEQ ID NO: 181893

SEQ ID NO: 1431241 - protein, 8 aa, Mycobacterium tuberculosis
NYPGRPRV

SEQ ID NO: 1431242 - protein, 8 aa, Mycobacterium tuberculosis
PAANGVAT

SEQ ID NO: 1431243 - protein, 11 aa, Mycobacterium tuberculosis
PAAPPPDGLPG

SEQ ID NO: 1431244 - protein, 18 aa, Mycobacterium tuberculosis
PAASPVLSGGQKGPHPIQ

SEQ ID NO: 1431245 - protein, 10 aa, Mycobacterium tuberculosis
PADEKNLDRW

SEQ ID NO: 1431246 - protein, 5 aa, Mycobacterium tuberculosis
PADEP

SEQ ID NO: 1431247 - protein, 14 aa, Mycobacterium tuberculosis
PADLADPQERSKLA

SEQ ID NO: 1431248 - protein, 24 aa, Mycobacterium tuberculosis
PAEAKASLGQQVPHPSRLGNPDEY

SEQ ID NO: 1431249 - protein, 5 aa, Mycobacterium tuberculosis
PAEFE

SEQ ID NO: 1431250 - protein, 12 aa, Mycobacterium tuberculosis
PAGAGVDASRAS

SEQ ID NO: 1431251 - protein, 16 aa, Mycobacterium tuberculosis
PAGDRVASTGGTASGP

SEQ ID NO: 1431252 - protein, 7 aa, Mycobacterium tuberculosis
PAGHGIN

SEQ ID NO: 1431253 - protein, 11 aa, Mycobacterium tuberculosis
PAGPPDGYRER

SEQ ID NO: 1431254 - protein, 20 aa, Mycobacterium tuberculosis
PAGPPRVGQPSWNPQRASSM

SEQ ID NO: 1431255 - protein, 8 aa, Mycobacterium tuberculosis
PAGSGGSV

SEQ ID NO: 1431256 - protein, 5 aa, Mycobacterium tuberculosis
PAGSP

SEQ ID NO: 1431257 - protein, 5 aa, Mycobacterium tuberculosis
PAGTA

SEQ ID NO: 1431258 - protein, 14 aa, Mycobacterium tuberculosis
PAGVGGTALTADLG

SEQ ID NO: 1431259 - protein, 4 aa, Mycobacterium tuberculosis
PAGY

SEQ ID NO: 1431260 - protein, 5 aa, Mycobacterium tuberculosis
PAHGT

SEQ ID NO: 1431261 - protein, 8 aa, Mycobacterium tuberculosis
PAKIPTGT

SEQ ID NO: 1431262 - protein, 5 aa, Mycobacterium tuberculosis
PALAA

SEQ ID NO: 1431263 - protein, 6 aa, Mycobacterium tuberculosis
PALRPS

SEQ ID NO: 1431264 - protein, 7 aa, Mycobacterium tuberculosis
PALSAKK

SEQ ID NO: 1431265 - protein, 7 aa, Mycobacterium tuberculosis
PALSEKD

SEQ ID NO: 1431266 - protein, 9 aa, Mycobacterium tuberculosis
PAPAESQYD

SEQ ID NO: 1431267 - protein, 5 aa, Mycobacterium tuberculosis
PAPAQ

SEQ ID NO: 1431268 - protein, 5 aa, Mycobacterium tuberculosis
PAPEA

SEQ ID NO: 1431269 - protein, 6 aa, Mycobacterium tuberculosis
PAPGLP

SEQ ID NO: 1431270 - protein, 7 aa, Mycobacterium tuberculosis
PAPPGAP

SEQ ID NO: 1431271 - protein, 26 aa, Mycobacterium tuberculosis
PAPQAVPRPSAAAAEPKHQPAREPRP

SEQ ID NO: 1431272 - protein, 6 aa, Mycobacterium tuberculosis
PAPRGH

SEQ ID NO: 1431273 - protein, 5 aa, Mycobacterium tuberculosis
PAPTV

SEQ ID NO: 1431274 - protein, 5 aa, Mycobacterium tuberculosis
PAQQR

SEQ ID NO: 1431275 - protein, 9 aa, Mycobacterium tuberculosis
PASAAGGFA

SEQ ID NO: 1431276 - protein, 5 aa, Mycobacterium tuberculosis
PASDS

SEQ ID NO: 1431277 - protein, 17 aa, Mycobacterium tuberculosis
PASLTAKVPDDVTSEVA

SEQ ID NO: 1431278 - protein, 8 aa, Mycobacterium tuberculosis
PASSLRGQ

SEQ ID NO: 1431279 - protein, 7 aa, Mycobacterium tuberculosis
PASYGAD

SEQ ID NO: 1431280 - protein, 9 aa, Mycobacterium tuberculosis
PATGETVPR

SEQ ID NO: 1431281 - protein, 17 aa, Mycobacterium tuberculosis
PATPGFGNTTTAPSSGF

SEQ ID NO: 1431282 - protein, 4 aa, Mycobacterium tuberculosis
PATT

SEQ ID NO: 1431283 - protein, 8 aa, Mycobacterium tuberculosis
PATTSNEY

SEQ ID NO: 1431284 - protein, 10 aa, Mycobacterium tuberculosis
PAVTDGYRQD

SEQ ID NO: 1431285 - protein, 16 aa, Mycobacterium tuberculosis
PAYEPEPGKPAPAAVS

SEQ ID NO: 1431286 - protein, 8 aa, Mycobacterium tuberculosis
PAYPIPED

SEQ ID NO: 1431287 - protein, 5 aa, Mycobacterium tuberculosis
PDAQN

SEQ ID NO: 1431288 - protein, 9 aa, Mycobacterium tuberculosis
PDDAAHSEW

SEQ ID NO: 1431289 - protein, 14 aa, Mycobacterium tuberculosis
PDDPGYAAHGAAAR

SEQ ID NO: 1431290 - protein, 6 aa, Mycobacterium tuberculosis
PDEADL

SEQ ID NO: 1431291 - protein, 4 aa, Mycobacterium tuberculosis
PDEL

SEQ ID NO: 1431292 - protein, 15 aa, Mycobacterium tuberculosis
PDERTEMEKDRHGPA

SEQ ID NO: 1431293 - protein, 4 aa, Mycobacterium tuberculosis
PDGE

SEQ ID NO: 1431294 - protein, 8 aa, Mycobacterium tuberculosis
PDGELPAN

SEQ ID NO: 1431295 - protein, 5 aa, Mycobacterium tuberculosis
PDGET

SEQ ID NO: 1431296 - protein, 6 aa, Mycobacterium tuberculosis
PDGGAQ

SEQ ID NO: 1431297 - protein, 9 aa, Mycobacterium tuberculosis
PDGPDGPRA

SEQ ID NO: 1431298 - protein, 4 aa, Mycobacterium tuberculosis
PDGS

SEQ ID NO: 1431299 - protein, 8 aa, Mycobacterium tuberculosis
PDGTAPGQ

SEQ ID NO: 1431300 - protein, 4 aa, Mycobacterium tuberculosis
PDHD

SEQ ID NO: 1431301 - protein, 5 aa, Mycobacterium tuberculosis
PDHPG

SEQ ID NO: 1431302 - protein, 5 aa, Mycobacterium tuberculosis
PDKTA

SEQ ID NO: 1431303 - protein, 4 aa, Mycobacterium tuberculosis
PDLD

SEQ ID NO: 1431304 - protein, 4 aa, Mycobacterium tuberculosis
PDLP

SEQ ID NO: 1431305 - protein, 5 aa, Mycobacterium tuberculosis
PDLSA

SEQ ID NO: 1431306 - protein, 7 aa, Mycobacterium tuberculosis
PDPEDEE

SEQ ID NO: 1431307 - protein, 5 aa, Mycobacterium tuberculosis
PDPGM

SEQ ID NO: 1431308 - protein, 15 aa, Mycobacterium tuberculosis
PDPRTRCSTTAPNSV

SEQ ID NO: 1431309 - protein, 12 aa, Mycobacterium tuberculosis
PDQGRPLEVGEP

SEQ ID NO: 1431310 - protein, 6 aa, Mycobacterium tuberculosis
PDQYGK

SEQ ID NO: 1431311 - protein, 5 aa, Mycobacterium tuberculosis
PDRPR

SEQ ID NO: 1431312 - protein, 5 aa, Mycobacterium tuberculosis
PDRSA

SEQ ID NO: 1431313 - protein, 9 aa, Mycobacterium tuberculosis
PDTGEPCPT

SEQ ID NO: 1431314 - protein, 4 aa, Mycobacterium tuberculosis
PDVN

SEQ ID NO: 1431315 - protein, 4 aa, Mycobacterium tuberculosis
PDVR

SEQ ID NO: 1431316 - protein, 4 aa, Mycobacterium tuberculosis
PDWQ

SEQ ID NO: 1431317 - protein, 10 aa, Mycobacterium tuberculosis
PEAGAAPKTV

SEQ ID NO: 1431318 - protein, 7 aa, Mycobacterium tuberculosis
PEATAQE

SEQ ID NO: 1431319 - protein, 7 aa, Mycobacterium tuberculosis
PEAVHEP

SEQ ID NO: 1431320 - protein, 5 aa, Mycobacterium tuberculosis
PEERR

SEQ ID NO: 1431321 - protein, 6 aa, Mycobacterium tuberculosis
PEGIPD

SEQ ID NO: 1431322 - protein, 11 aa, Mycobacterium tuberculosis
PEGPNGNPDPM

SEQ ID NO: 1431323 - protein, 4 aa, Mycobacterium tuberculosis
PEHQ

SEQ ID NO: 1431324 - protein, 11 aa, Mycobacterium tuberculosis
PEIAASQATAQ

SEQ ID NO: 1431325 - protein, 5 aa, Mycobacterium tuberculosis
PEKAD

SEQ ID NO: 1431326 - protein, 5 aa, Mycobacterium tuberculosis
PELTP

SEQ ID NO: 1431327 - protein, 6 aa, Mycobacterium tuberculosis
PEPDRA

SEQ ID NO: 1431328 - protein, 5 aa, Mycobacterium tuberculosis
PEQRR

SEQ ID NO: 1431329 - protein, 16 aa, Mycobacterium tuberculosis
PETDGAEKGPTYNKVR

SEQ ID NO: 1431330 - protein, 7 aa, Mycobacterium tuberculosis
PETTRAD

SEQ ID NO: 1431331 - protein, 18 aa, Mycobacterium tuberculosis
PEVSAYRRSSRAPARGAS

SEQ ID NO: 1431332 - protein, 18 aa, Mycobacterium tuberculosis
PGAAIGPRRGGECNPAPS

SEQ ID NO: 1431333 - protein, 11 aa, Mycobacterium tuberculosis
PGAATGPSRIG

SEQ ID NO: 1431334 - protein, 8 aa, Mycobacterium tuberculosis
PGAESPRE

SEQ ID NO: 1431335 - protein, 20 aa, Mycobacterium tuberculosis
PGALGAGAEGANKDKPVEKR

SEQ ID NO: 1431336 - protein, 7 aa, Mycobacterium tuberculosis
PGASPVH

SEQ ID NO: 1431337 - protein, 8 aa, Mycobacterium tuberculosis
PGATVEDA

SEQ ID NO: 1431338 - protein, 9 aa, Mycobacterium tuberculosis
PGCDRPATQ

SEQ ID NO: 1431339 - protein, 4 aa, Mycobacterium tuberculosis
PGDG

SEQ ID NO: 1431340 - protein, 46 aa, Mycobacterium tuberculosis; identical to SEQ ID NO: 182570

SEQ ID NO: 1431341 - protein, 24 aa, Mycobacterium tuberculosis
PGDPEFGDPLSTAGEGGPRAAARA

SEQ ID NO: 1431342 - protein, 6 aa, Mycobacterium tuberculosis
PGESRA

SEQ ID NO: 1431343 - protein, 7 aa, Mycobacterium tuberculosis
PGFDKKA

SEQ ID NO: 1431344 - protein, 7 aa, Mycobacterium tuberculosis
PGFDPAA

SEQ ID NO: 1431345 - protein, 5 aa, Mycobacterium tuberculosis
PGFGG

SEQ ID NO: 1431346 - protein, 12 aa, Mycobacterium tuberculosis
PGFGNSTELPSS

SEQ ID NO: 1431347 - protein, 6 aa, Mycobacterium tuberculosis
PGFHGQ

SEQ ID NO: 1431348 - protein, 4 aa, Mycobacterium tuberculosis
PGFQ

SEQ ID NO: 1431349 - protein, 10 aa, Mycobacterium tuberculosis
PGFTDPRNGR

SEQ ID NO: 1431350 - protein, 10 aa, Mycobacterium tuberculosis
PGGAAPEVTV

SEQ ID NO: 1431351 - protein, 7 aa, Mycobacterium tuberculosis
PGGESGF

SEQ ID NO: 1431352 - protein, 5 aa, Mycobacterium tuberculosis
PGGGD

SEQ ID NO: 1431353 - protein, 6 aa, Mycobacterium tuberculosis
PGGLGR

SEQ ID NO: 1431354 - protein, 17 aa, Mycobacterium tuberculosis
PGGPGYFNSSTAPSSGF

SEQ ID NO: 1431355 - protein, 8 aa, Mycobacterium tuberculosis
PGGRASAA

SEQ ID NO: 1431356 - protein, 5 aa, Mycobacterium tuberculosis
PGGSA

SEQ ID NO: 1431357 - protein, 18 aa, Mycobacterium tuberculosis
PGHIPSTSHRRGTGDINR

SEQ ID NO: 1431358 - protein, 4 aa, Mycobacterium tuberculosis
PGKT

SEQ ID NO: 1431359 - protein, 14 aa, Mycobacterium tuberculosis
PGKTKVNPSGGPLA

SEQ ID NO: 1431360 - protein, 6 aa, Mycobacterium tuberculosis
PGMTMP

SEQ ID NO: 1431361 - protein, 9 aa, Mycobacterium tuberculosis
PGNDFDSND

SEQ ID NO: 1431362 - protein, 5 aa, Mycobacterium tuberculosis
PGPFT

SEQ ID NO: 1431363 - protein, 18 aa, Mycobacterium tuberculosis
PGPGSEPGESRLYQPGDD

SEQ ID NO: 1431364 - protein, 6 aa, Mycobacterium tuberculosis
PGPHGP

SEQ ID NO: 1431365 - protein, 7 aa, Mycobacterium tuberculosis
PGPVSTE

SEQ ID NO: 1431366 - protein, 6 aa, Mycobacterium tuberculosis
PGQQGG

SEQ ID NO: 1431367 - protein, 7 aa, Mycobacterium tuberculosis
PGQQGGP

SEQ ID NO: 1431368 - protein, 5 aa, Mycobacterium tuberculosis
PGRAD

SEQ ID NO: 1431369 - protein, 14 aa, Mycobacterium tuberculosis
PGRAKLSDGSERDV

SEQ ID NO: 1431370 - protein, 4 aa, Mycobacterium tuberculosis
PGSA

SEQ ID NO: 1431371 - protein, 5 aa, Mycobacterium tuberculosis
PGSAT

SEQ ID NO: 1431372 - protein, 12 aa, Mycobacterium tuberculosis
PGSRPIDLFGAP

SEQ ID NO: 1431373 - protein, 35 aa, Mycobacterium tuberculosis; identical to SEQ ID NO: 182752

SEQ ID NO: 1431374 - protein, 5 aa, Mycobacterium tuberculosis
PGTAR

SEQ ID NO: 1431375 - protein, 5 aa, Mycobacterium tuberculosis
PGTDF

SEQ ID NO: 1431376 - protein, 6 aa, Mycobacterium tuberculosis
PGTTPE

SEQ ID NO: 1431377 - protein, 8 aa, Mycobacterium tuberculosis
PGVDPDKD

SEQ ID NO: 1431378 - protein, 10 aa, Mycobacterium tuberculosis
PHANRDQEDK

SEQ ID NO: 1431379 - protein, 8 aa, Mycobacterium tuberculosis
PHDSPTAR

SEQ ID NO: 1431380 - protein, 5 aa, Mycobacterium tuberculosis
PHPVG

SEQ ID NO: 1431381 - protein, 10 aa, Mycobacterium tuberculosis
PHRYSQSEIT

SEQ ID NO: 1431382 - protein, 6 aa, Mycobacterium tuberculosis
PIAGAR

SEQ ID NO: 1431383 - protein, 7 aa, Mycobacterium tuberculosis
PIAGARS

SEQ ID NO: 1431384 - protein, 10 aa, Mycobacterium tuberculosis
PIPVGTQGGT

SEQ ID NO: 1431385 - protein, 7 aa, Mycobacterium tuberculosis
PISDKAA

SEQ ID NO: 1431386 - protein, 9 aa, Mycobacterium tuberculosis
PKAKNAVNA

SEQ ID NO: 1431387 - protein, 6 aa, Mycobacterium tuberculosis
PKAVPS

SEQ ID NO: 1431388 - protein, 9 aa, Mycobacterium tuberculosis
PKGAAGNTG

SEQ ID NO: 1431389 - protein, 9 aa, Mycobacterium tuberculosis
PKGMSEEMT

SEQ ID NO: 1431390 - protein, 6 aa, Mycobacterium tuberculosis
PKLGTR

SEQ ID NO: 1431391 - protein, 8 aa, Mycobacterium tuberculosis
PKPDYSAM

SEQ ID NO: 1431392 - protein, 13 aa, Mycobacterium tuberculosis
PKPLRPGADQTIG

SEQ ID NO: 1431393 - protein, 14 aa, Mycobacterium tuberculosis
PKPLRPGADQTIGG

SEQ ID NO: 1431394 - protein, 7 aa, Mycobacterium tuberculosis
PKPRGWS

SEQ ID NO: 1431395 - protein, 9 aa, Mycobacterium tuberculosis
PKRGPDLPA

SEQ ID NO: 1431396 - protein, 7 aa, Mycobacterium tuberculosis
PKSGSIK

SEQ ID NO: 1431397 - protein, 6 aa, Mycobacterium tuberculosis
PKTGAV

SEQ ID NO: 1431398 - protein, 5 aa, Mycobacterium tuberculosis
PLAAD

SEQ ID NO: 1431399 - protein, 4 aa, Mycobacterium tuberculosis
PLAR

SEQ ID NO: 1431400 - protein, 15 aa, Mycobacterium tuberculosis
PLASPLGSALGGTPM

SEQ ID NO: 1431401 - protein, 6 aa, Mycobacterium tuberculosis
PLETPA

SEQ ID NO: 1431402 - protein, 4 aa, Mycobacterium tuberculosis
PLGA

SEQ ID NO: 1431403 - protein, 7 aa, Mycobacterium tuberculosis
PLGVGNG

SEQ ID NO: 1431404 - protein, 8 aa, Mycobacterium tuberculosis
PLHGGAPA

SEQ ID NO: 1431405 - protein, 17 aa, Mycobacterium tuberculosis
PLPPSPPSPPSPPRPVA

SEQ ID NO: 1431406 - protein, 7 aa, Mycobacterium tuberculosis
PLSEDDW

SEQ ID NO: 1431407 - protein, 14 aa, Mycobacterium tuberculosis
PLSPNGSSGAGGLP

SEQ ID NO: 1431408 - protein, 7 aa, Mycobacterium tuberculosis
PLTGSHR

SEQ ID NO: 1431409 - protein, 14 aa, Mycobacterium tuberculosis
PLVPGTPDPVKGAD

SEQ ID NO: 1431410 - protein, 6 aa, Mycobacterium tuberculosis
PMDDNP

SEQ ID NO: 1431411 - protein, 20 aa, Mycobacterium tuberculosis
PMSVPPGWSAPPATPQAQTV

SEQ ID NO: 1431412 - protein, 19 aa, Mycobacterium tuberculosis
PNAPFGRDPQGQPYTQERY

SEQ ID NO: 1431413 - protein, 5 aa, Mycobacterium tuberculosis
PNEGV

SEQ ID NO: 1431414 - protein, 10 aa, Mycobacterium tuberculosis
PNGAGKTTTV

SEQ ID NO: 1431415 - protein, 5 aa, Mycobacterium tuberculosis
PNITG

SEQ ID NO: 1431416 - protein, 6 aa, Mycobacterium tuberculosis
PNPDAA

SEQ ID NO: 1431417 - protein, 5 aa, Mycobacterium tuberculosis
PNRDG

SEQ ID NO: 1431418 - protein, 5 aa, Mycobacterium tuberculosis
PNSTY

SEQ ID NO: 1431419 - protein, 16 aa, Mycobacterium tuberculosis
PPADEPVTNLSGGERR

SEQ ID NO: 1431420 - protein, 7 aa, Mycobacterium tuberculosis
PPAGPAA

SEQ ID NO: 1431421 - protein, 20 aa, Mycobacterium tuberculosis
PPAPAGRGLTAGQQRRRTIG

SEQ ID NO: 1431422 - protein, 20 aa, Mycobacterium tuberculosis
PPAPPGMTDNPDRRAAGPAA

SEQ ID NO: 1431423 - protein, 8 aa, Mycobacterium tuberculosis
PPDAKSRI

SEQ ID NO: 1431424 - protein, 7 aa, Mycobacterium tuberculosis
PPEADHD

SEQ ID NO: 1431425 - protein, 11 aa, Mycobacterium tuberculosis
PPEGAESVDIS

SEQ ID NO: 1431426 - protein, 5 aa, Mycobacterium tuberculosis
PPEIT

SEQ ID NO: 1431427 - protein, 11 aa, Mycobacterium tuberculosis
PPERQARALPS

SEQ ID NO: 1431428 - protein, 5 aa, Mycobacterium tuberculosis
PPESF

SEQ ID NO: 1431429 - protein, 4 aa, Mycobacterium tuberculosis
PPFA

SEQ ID NO: 1431430 - protein, 4 aa, Mycobacterium tuberculosis
PPGD

SEQ ID NO: 1431431 - protein, 14 aa, Mycobacterium tuberculosis
PPGLTDEQAITAAT

SEQ ID NO: 1431432 - protein, 6 aa, Mycobacterium tuberculosis
PPGPAQ

SEQ ID NO: 1431433 - protein, 6 aa, Mycobacterium tuberculosis
PPGTGD

SEQ ID NO: 1431434 - protein, 5 aa, Mycobacterium tuberculosis
PPGVD

SEQ ID NO: 1431435 - protein, 15 aa, Mycobacterium tuberculosis
PPGWPGPGALPPHER

SEQ ID NO: 1431436 - protein, 6 aa, Mycobacterium tuberculosis
PPHSSL

SEQ ID NO: 1431437 - protein, 5 aa, Mycobacterium tuberculosis
PPIGP

SEQ ID NO: 1431438 - protein, 4 aa, Mycobacterium tuberculosis
PPIS

SEQ ID NO: 1431439 - protein, 9 aa, Mycobacterium tuberculosis
PPLFGTEPD

SEQ ID NO: 1431440 - protein, 5 aa, Mycobacterium tuberculosis
PPPHR

SEQ ID NO: 1431441 - protein, 12 aa, Mycobacterium tuberculosis
PPPNPLDTGSAG

SEQ ID NO: 1431442 - protein, 8 aa, Mycobacterium tuberculosis
PPPPQRYP

SEQ ID NO: 1431443 - protein, 7 aa, Mycobacterium tuberculosis
PPPQIAA

SEQ ID NO: 1431444 - protein, 5 aa, Mycobacterium tuberculosis
PPRFQ

SEQ ID NO: 1431445 - protein, 10 aa, Mycobacterium tuberculosis
PPSAEPRATG

SEQ ID NO: 1431446 - protein, 8 aa, Mycobacterium tuberculosis
PPSAPPVI

SEQ ID NO: 1431447 - protein, 8 aa, Mycobacterium tuberculosis
PPTAAGHA

SEQ ID NO: 1431448 - protein, 13 aa, Mycobacterium tuberculosis
PPTAPAEPQPTSE

SEQ ID NO: 1431449 - protein, 4 aa, Mycobacterium tuberculosis
PPTG

SEQ ID NO: 1431450 - protein, 15 aa, Mycobacterium tuberculosis
PPTPGIGNSTITPSS

SEQ ID NO: 1431451 - protein, 4 aa, Mycobacterium tuberculosis
PPVT

SEQ ID NO: 1431452 - protein, 6 aa, Mycobacterium tuberculosis
PQAGVD

SEQ ID NO: 1431453 - protein, 9 aa, Mycobacterium tuberculosis
PQAPAGVRG

SEQ ID NO: 1431454 - protein, 14 aa, Mycobacterium tuberculosis
PQATGASTQPQLSR

SEQ ID NO: 1431455 - protein, 6 aa, Mycobacterium tuberculosis
PQGALS

SEQ ID NO: 1431456 - protein, 15 aa, Mycobacterium tuberculosis
PQHGPVDPLPRRRAD

SEQ ID NO: 1431457 - protein, 5 aa, Mycobacterium tuberculosis
PQKVN

SEQ ID NO: 1431458 - protein, 25 aa, Mycobacterium tuberculosis
PQPALPADAASLADATGGAGTPVPA

SEQ ID NO: 1431459 - protein, 5 aa, Mycobacterium tuberculosis
PQPPN

SEQ ID NO: 1431460 - protein, 12 aa, Mycobacterium tuberculosis
PQRPGRGIGEPE

SEQ ID NO: 1431461 - protein, 9 aa, Mycobacterium tuberculosis
PQSSGIGGG

SEQ ID NO: 1431462 - protein, 15 aa, Mycobacterium tuberculosis
PQTGDPDAESPVRGG

SEQ ID NO: 1431463 - protein, 6 aa, Mycobacterium tuberculosis
PREAPA

SEQ ID NO: 1431464 - protein, 6 aa, Mycobacterium tuberculosis
PRGFGE

SEQ ID NO: 1431465 - protein, 5 aa, Mycobacterium tuberculosis
PRGMH

SEQ ID NO: 1431466 - protein, 7 aa, Mycobacterium tuberculosis
PRLRARP

SEQ ID NO: 1431467 - protein, 5 aa, Mycobacterium tuberculosis
PRPTL

SEQ ID NO: 1431468 - protein, 7 aa, Mycobacterium tuberculosis
PRPVEES

SEQ ID NO: 1431469 - protein, 8 aa, Mycobacterium tuberculosis
PRRGIGDR

SEQ ID NO: 1431470 - protein, 7 aa, Mycobacterium tuberculosis
PRRGYGQ

SEQ ID NO: 1431471 - protein, 7 aa, Mycobacterium tuberculosis
PRRPGTP

SEQ ID NO: 1431472 - protein, 6 aa, Mycobacterium tuberculosis
PRSIRP

SEQ ID NO: 1431473 - protein, 6 aa, Mycobacterium tuberculosis
PRSLGY

SEQ ID NO: 1431474 - protein, 7 aa, Mycobacterium tuberculosis
PRTPNGK

SEQ ID NO: 1431475 - protein, 6 aa, Mycobacterium tuberculosis
PRTVNS

SEQ ID NO: 1431476 - protein, 6 aa, Mycobacterium tuberculosis
PRYPSP

SEQ ID NO: 1431477 - protein, 13 aa, Mycobacterium tuberculosis
PSAAAQLADTTDQ

SEQ ID NO: 1431478 - protein, 5 aa, Mycobacterium tuberculosis
PSATH

SEQ ID NO: 1431479 - protein, 11 aa, Mycobacterium tuberculosis
PSDGGWTANGE

SEQ ID NO: 1431480 - protein, 5 aa, Mycobacterium tuberculosis
PSEPA

SEQ ID NO: 1431481 - protein, 8 aa, Mycobacterium tuberculosis
PSERDPSV

SEQ ID NO: 1431482 - protein, 7 aa, Mycobacterium tuberculosis
PSGRQRT

SEQ ID NO: 1431483 - protein, 5 aa, Mycobacterium tuberculosis
PSGRR

SEQ ID NO: 1431484 - protein, 4 aa, Mycobacterium tuberculosis
PSHE

SEQ ID NO: 1431485 - protein, 7 aa, Mycobacterium tuberculosis
PSHPGHE

SEQ ID NO: 1431486 - protein, 14 aa, Mycobacterium tuberculosis
PSIEPTKRRPNQCY

SEQ ID NO: 1431487 - protein, 7 aa, Mycobacterium tuberculosis
PSKAGTD

SEQ ID NO: 1431488 - protein, 10 aa, Mycobacterium tuberculosis
PSPATPELPA

SEQ ID NO: 1431489 - protein, 9 aa, Mycobacterium tuberculosis
PSPQRLSGP

SEQ ID NO: 1431490 - protein, 7 aa, Mycobacterium tuberculosis
PSRPNSA

SEQ ID NO: 1431491 - protein, 8 aa, Mycobacterium tuberculosis
PSRPSGKA

SEQ ID NO: 1431492 - protein, 4 aa, Mycobacterium tuberculosis
PSRV

SEQ ID NO: 1431493 - protein, 9 aa, Mycobacterium tuberculosis
PSSIPADGS

SEQ ID NO: 1431494 - protein, 4 aa, Mycobacterium tuberculosis
PSSP

SEQ ID NO: 1431495 - protein, 8 aa, Mycobacterium tuberculosis
PSTGGTWQ

SEQ ID NO: 1431496 - protein, 9 aa, Mycobacterium tuberculosis
PSVRPVTKT

SEQ ID NO: 1431497 - protein, 4 aa, Mycobacterium tuberculosis
PSWA

SEQ ID NO: 1431498 - protein, 7 aa, Mycobacterium tuberculosis
PSYLENP

SEQ ID NO: 1431499 - protein, 8 aa, Mycobacterium tuberculosis
PTAIRPSY

SEQ ID NO: 1431500 - protein, 7 aa, Mycobacterium tuberculosis
PTATATT

SEQ ID NO: 1431501 - protein, 6 aa, Mycobacterium tuberculosis
PTDEED

SEQ ID NO: 1431502 - protein, 8 aa, Mycobacterium tuberculosis
PTDRIGAD

SEQ ID NO: 1431503 - protein, 4 aa, Mycobacterium tuberculosis
PTFP

SEQ ID NO: 1431504 - protein, 8 aa, Mycobacterium tuberculosis
PTGDGRVT

SEQ ID NO: 1431505 - protein, 5 aa, Mycobacterium tuberculosis
PTGPV

SEQ ID NO: 1431506 - protein, 9 aa, Mycobacterium tuberculosis
PTGRPTGEW

SEQ ID NO: 1431507 - protein, 11 aa, Mycobacterium tuberculosis
PTGTRCGTRHG

SEQ ID NO: 1431508 - protein, 9 aa, Mycobacterium tuberculosis
PTKNPKAAA

SEQ ID NO: 1431509 - protein, 7 aa, Mycobacterium tuberculosis
PTLPEET

SEQ ID NO: 1431510 - protein, 6 aa, Mycobacterium tuberculosis
PTLPTA

SEQ ID NO: 1431511 - protein, 6 aa, Mycobacterium tuberculosis
PTLSSA

SEQ ID NO: 1431512 - protein, 15 aa, Mycobacterium tuberculosis
PTLTSTALDNRGPRT

SEQ ID NO: 1431513 - protein, 8 aa, Mycobacterium tuberculosis
PTNDNEIT

SEQ ID NO: 1431514 - protein, 6 aa, Mycobacterium tuberculosis
PTNDVD

SEQ ID NO: 1431515 - protein, 5 aa, Mycobacterium tuberculosis
PTPTA

SEQ ID NO: 1431516 - protein, 4 aa, Mycobacterium tuberculosis
PTQT

SEQ ID NO: 1431517 - protein, 7 aa, Mycobacterium tuberculosis
PTQTQAA

SEQ ID NO: 1431518 - protein, 9 aa, Mycobacterium tuberculosis
PTRAEDGCR

SEQ ID NO: 1431519 - protein, 6 aa, Mycobacterium tuberculosis
PTRAFA

SEQ ID NO: 1431520 - protein, 4 aa, Mycobacterium tuberculosis
PTRP

SEQ ID NO: 1431521 - protein, 4 aa, Mycobacterium tuberculosis
PTVG

SEQ ID NO: 1431522 - protein, 4 aa, Mycobacterium tuberculosis
PTVT

SEQ ID NO: 1431523 - protein, 16 aa, Mycobacterium tuberculosis
PVAPPAVGGPLSAEPA

SEQ ID NO: 1431524 - protein, 10 aa, Mycobacterium tuberculosis
PVASRVNGKV

SEQ ID NO: 1431525 - protein, 6 aa, Mycobacterium tuberculosis
PVDPAE

SEQ ID NO: 1431526 - protein, 7 aa, Mycobacterium tuberculosis
PVEVTGS

SEQ ID NO: 1431527 - protein, 5 aa, Mycobacterium tuberculosis
PVGPR

SEQ ID NO: 1431528 - protein, 6 aa, Mycobacterium tuberculosis
PVNDLS

SEQ ID NO: 1431529 - protein, 8 aa, Mycobacterium tuberculosis
PVNPAQLT

SEQ ID NO: 1431530 - protein, 13 aa, Mycobacterium tuberculosis
PVQEDRDRSLRDG

SEQ ID NO: 1431531 - protein, 7 aa, Mycobacterium tuberculosis
PVQGSHV

SEQ ID NO: 1431532 - protein, 7 aa, Mycobacterium tuberculosis
PVSERRG

SEQ ID NO: 1431533 - protein, 4 aa, Mycobacterium tuberculosis
PVTG

SEQ ID NO: 1431534 - protein, 26 aa, Mycobacterium tuberculosis
PVTTSPAALAGQAAATVSSTVPPLAT

SEQ ID NO: 1431535 - protein, 4 aa, Mycobacterium tuberculosis
PWDT

SEQ ID NO: 1431536 - protein, 7 aa, Mycobacterium tuberculosis
PWSNGHT

SEQ ID NO: 1431537 - protein, 6 aa, Mycobacterium tuberculosis
PYGGPD

SEQ ID NO: 1431538 - protein, 8 aa, Mycobacterium tuberculosis
PYGPVNPD

SEQ ID NO: 1431539 - protein, 30 aa, Mycobacterium tuberculosis; identical to SEQ ID NO: 183749

SEQ ID NO: 1431540 - protein, 5 aa, Mycobacterium tuberculosis
PYTRE

SEQ ID NO: 1431541 - protein, 7 aa, Mycobacterium tuberculosis
QAADTGA

SEQ ID NO: 1431542 - protein, 7 aa, Mycobacterium tuberculosis
QAAERGL

SEQ ID NO: 1431543 - protein, 5 aa, Mycobacterium tuberculosis
QAAKL

SEQ ID NO: 1431544 - protein, 8 aa, Mycobacterium tuberculosis
QAARDEVG

SEQ ID NO: 1431545 - protein, 26 aa, Mycobacterium tuberculosis
QAASQATGAAHPGGEPGGAHPGSADD

SEQ ID NO: 1431546 - protein, 8 aa, Mycobacterium tuberculosis
QAEGSGTM

SEQ ID NO: 1431547 - protein, 12 aa, Mycobacterium tuberculosis
QAGEKGRDSRCE

SEQ ID NO: 1431548 - protein, 5 aa, Mycobacterium tuberculosis
QAGPS

SEQ ID NO: 1431549 - protein, 7 aa, Mycobacterium tuberculosis
QAGRGGL

SEQ ID NO: 1431550 - protein, 16 aa, Mycobacterium tuberculosis
QAGTGSPAPPADPGSP

SEQ ID NO: 1431551 - protein, 5 aa, Mycobacterium tuberculosis
QAGYD

SEQ ID NO: 1431552 - protein, 9 aa, Mycobacterium tuberculosis
QALASSPMK

SEQ ID NO: 1431553 - protein, 4 aa, Mycobacterium tuberculosis
QALP

SEQ ID NO: 1431554 - protein, 11 aa, Mycobacterium tuberculosis
QANEDYTEEFD

SEQ ID NO: 1431555 - protein, 7 aa, Mycobacterium tuberculosis
QANKGQA

SEQ ID NO: 1431556 - protein, 11 aa, Mycobacterium tuberculosis
QANYAAAKAGI

SEQ ID NO: 1431557 - protein, 4 aa, Mycobacterium tuberculosis
QAPA

SEQ ID NO: 1431558 - protein, 15 aa, Mycobacterium tuberculosis
QAPGYPTSLNEHPKA

SEQ ID NO: 1431559 - protein, 6 aa, Mycobacterium tuberculosis
QAPTRA

SEQ ID NO: 1431560 - protein, 8 aa, Mycobacterium tuberculosis
QAQPDDVS

SEQ ID NO: 1431561 - protein, 4 aa, Mycobacterium tuberculosis
QAQT

SEQ ID NO: 1431562 - protein, 5 aa, Mycobacterium tuberculosis
QARGV

SEQ ID NO: 1431563 - protein, 7 aa, Mycobacterium tuberculosis
QASEAGW

SEQ ID NO: 1431564 - protein, 6 aa, Mycobacterium tuberculosis
QATGRR

SEQ ID NO: 1431565 - protein, 4 aa, Mycobacterium tuberculosis
QATP

SEQ ID NO: 1431566 - protein, 7 aa, Mycobacterium tuberculosis
QAVTDRP

SEQ ID NO: 1431567 - protein, 8 aa, Mycobacterium tuberculosis
QCGSSQQA

SEQ ID NO: 1431568 - protein, 15 aa, Mycobacterium tuberculosis
QDAAAPAEEVDPAAA

SEQ ID NO: 1431569 - protein, 4 aa, Mycobacterium tuberculosis
QDDL

SEQ ID NO: 1431570 - protein, 8 aa, Mycobacterium tuberculosis
QDGGNSYV

SEQ ID NO: 1431571 - protein, 8 aa, Mycobacterium tuberculosis
QDLAGKDE

SEQ ID NO: 1431572 - protein, 5 aa, Mycobacterium tuberculosis
QDLTG

SEQ ID NO: 1431573 - protein, 7 aa, Mycobacterium tuberculosis
QDPDKLP

SEQ ID NO: 1431574 - protein, 15 aa, Mycobacterium tuberculosis
QDPDRWTTTPDDEAK

SEQ ID NO: 1431575 - protein, 16 aa, Mycobacterium tuberculosis
QDQNLQDGPHKDLRRA

SEQ ID NO: 1431576 - protein, 5 aa, Mycobacterium tuberculosis
QDRAS

SEQ ID NO: 1431577 - protein, 8 aa, Mycobacterium tuberculosis
QDRPPRGK

SEQ ID NO: 1431578 - protein, 17 aa, Mycobacterium tuberculosis
QDTADRLTNTAKAESDK

SEQ ID NO: 1431579 - protein, 6 aa, Mycobacterium tuberculosis
QDVSPG

SEQ ID NO: 1431580 - protein, 6 aa, Mycobacterium tuberculosis
QEAEDT

SEQ ID NO: 1431581 - protein, 5 aa, Mycobacterium tuberculosis
QEAGA

SEQ ID NO: 1431582 - protein, 4 aa, Mycobacterium tuberculosis
QEDL

SEQ ID NO: 1431583 - protein, 5 aa, Mycobacterium tuberculosis
QEFTT

SEQ ID NO: 1431584 - protein, 7 aa, Mycobacterium tuberculosis
QEKLEPG

SEQ ID NO: 1431585 - protein, 5 aa, Mycobacterium tuberculosis
QEPAL

SEQ ID NO: 1431586 - protein, 7 aa, Mycobacterium tuberculosis
QERAQKI

SEQ ID NO: 1431587 - protein, 7 aa, Mycobacterium tuberculosis
QEVADSG

SEQ ID NO: 1431588 - protein, 18 aa, Mycobacterium tuberculosis
QEVSDDSPTLAQPAVPSY

SEQ ID NO: 1431589 - protein, 5 aa, Mycobacterium tuberculosis
QFTTP

SEQ ID NO: 1431590 - protein, 7 aa, Mycobacterium tuberculosis
QGCSPDQ

SEQ ID NO: 1431591 - protein, 9 aa, Mycobacterium tuberculosis
QGDAPPSGE

SEQ ID NO: 1431592 - protein, 4 aa, Mycobacterium tuberculosis
QGEA

SEQ ID NO: 1431593 - protein, 5 aa, Mycobacterium tuberculosis
QGGPI

SEQ ID NO: 1431594 - protein, 10 aa, Mycobacterium tuberculosis
QGISSENAKK

SEQ ID NO: 1431595 - protein, 6 aa, Mycobacterium tuberculosis
QGPLRG

SEQ ID NO: 1431596 - protein, 6 aa, Mycobacterium tuberculosis
QGPNAV

SEQ ID NO: 1431597 - protein, 10 aa, Mycobacterium tuberculosis
QGPRNRTRTV

SEQ ID NO: 1431598 - protein, 7 aa, Mycobacterium tuberculosis
QGRAGSH

SEQ ID NO: 1431599 - protein, 5 aa, Mycobacterium tuberculosis
QGRPL

SEQ ID NO: 1431600 - protein, 7 aa, Mycobacterium tuberculosis
QGRQVDD

SEQ ID NO: 1431601 - protein, 6 aa, Mycobacterium tuberculosis
QGRSGS

SEQ ID NO: 1431602 - protein, 9 aa, Mycobacterium tuberculosis
QGSSRAAFD

SEQ ID NO: 1431603 - protein, 11 aa, Mycobacterium tuberculosis
QGTGEGATFAR

SEQ ID NO: 1431604 - protein, 7 aa, Mycobacterium tuberculosis
QHEDARA

SEQ ID NO: 1431605 - protein, 8 aa, Mycobacterium tuberculosis
QHEGPGYR

SEQ ID NO: 1431606 - protein, 11 aa, Mycobacterium tuberculosis
QHFAQTKDADV

SEQ ID NO: 1431607 - protein, 4 aa, Mycobacterium tuberculosis
QHGL

SEQ ID NO: 1431608 - protein, 16 aa, Mycobacterium tuberculosis
QHHPRQRGIASGGTTV

SEQ ID NO: 1431609 - protein, 4 aa, Mycobacterium tuberculosis
QHQR

SEQ ID NO: 1431610 - protein, 5 aa, Mycobacterium tuberculosis
QIGEH

SEQ ID NO: 1431611 - protein, 5 aa, Mycobacterium tuberculosis
QKDRD

SEQ ID NO: 1431612 - protein, 12 aa, Mycobacterium tuberculosis
QKGGVAKTTTVA

SEQ ID NO: 1431613 - protein, 11 aa, Mycobacterium tuberculosis
QKGGVGKTTTA

SEQ ID NO: 1431614 - protein, 11 aa, Mycobacterium tuberculosis
QKPDESERTFG

SEQ ID NO: 1431615 - protein, 15 aa, Mycobacterium tuberculosis
QKSGTQSAGEAVEAA

SEQ ID NO: 1431616 - protein, 13 aa, Mycobacterium tuberculosis
QLAPRDDAERRKA

SEQ ID NO: 1431617 - protein, 7 aa, Mycobacterium tuberculosis
QLASAPR

SEQ ID NO: 1431618 - protein, 11 aa, Mycobacterium tuberculosis
QLDAHGDNPAN

SEQ ID NO: 1431619 - protein, 4 aa, Mycobacterium tuberculosis
QLKS

SEQ ID NO: 1431620 - protein, 6 aa, Mycobacterium tuberculosis
QLNNNR

SEQ ID NO: 1431621 - protein, 16 aa, Mycobacterium tuberculosis
QLSAAGEGGGQSAARA

SEQ ID NO: 1431622 - protein, 9 aa, Mycobacterium tuberculosis
QNAPAIAAA

SEQ ID NO: 1431623 - protein, 11 aa, Mycobacterium tuberculosis
QNAPAIAATEA

SEQ ID NO: 1431624 - protein, 4 aa, Mycobacterium tuberculosis
QNAS

SEQ ID NO: 1431625 - protein, 6 aa, Mycobacterium tuberculosis
QNPEAA

SEQ ID NO: 1431626 - protein, 9 aa, Mycobacterium tuberculosis
QNTGAIAAA

SEQ ID NO: 1431627 - protein, 11 aa, Mycobacterium tuberculosis
QNTPAIEANQA

SEQ ID NO: 1431628 - protein, 5 aa, Mycobacterium tuberculosis
QNTRG

SEQ ID NO: 1431629 - protein, 13 aa, Mycobacterium tuberculosis
QNTSAIAAAEAQY

SEQ ID NO: 1431630 - protein, 6 aa, Mycobacterium tuberculosis
QPATPQ

SEQ ID NO: 1431631 - protein, 10 aa, Mycobacterium tuberculosis
QPAVGQDDRG

SEQ ID NO: 1431632 - protein, 4 aa, Mycobacterium tuberculosis
QPDR

SEQ ID NO: 1431633 - protein, 11 aa, Mycobacterium tuberculosis
QPETITTEHKE

SEQ ID NO: 1431634 - protein, 5 aa, Mycobacterium tuberculosis
QPEYV

SEQ ID NO: 1431635 - protein, 9 aa, Mycobacterium tuberculosis
QPHSGAQAN

SEQ ID NO: 1431636 - protein, 9 aa, Mycobacterium tuberculosis
QPHTAVRRG

SEQ ID NO: 1431637 - protein, 4 aa, Mycobacterium tuberculosis
QPIA

SEQ ID NO: 1431638 - protein, 6 aa, Mycobacterium tuberculosis
QPLDPG

SEQ ID NO: 1431639 - protein, 6 aa, Mycobacterium tuberculosis
QPLPST

SEQ ID NO: 1431640 - protein, 4 aa, Mycobacterium tuberculosis
QPNA

SEQ ID NO: 1431641 - protein, 4 aa, Mycobacterium tuberculosis
QPNT

SEQ ID NO: 1431642 - protein, 6 aa, Mycobacterium tuberculosis
QPPAEG

SEQ ID NO: 1431643 - protein, 8 aa, Mycobacterium tuberculosis
QPPYGHGA

SEQ ID NO: 1431644 - protein, 4 aa, Mycobacterium tuberculosis
QPQF

SEQ ID NO: 1431645 - protein, 15 aa, Mycobacterium tuberculosis
QPQKLSTAALDAAKS

SEQ ID NO: 1431646 - protein, 13 aa, Mycobacterium tuberculosis
QPRNTALDDTDGL

SEQ ID NO: 1431647 - protein, 7 aa, Mycobacterium tuberculosis
QPRVRPG

SEQ ID NO: 1431648 - protein, 8 aa, Mycobacterium tuberculosis
QQGAVQGV

SEQ ID NO: 1431649 - protein, 5 aa, Mycobacterium tuberculosis
QQLAD

SEQ ID NO: 1431650 - protein, 9 aa, Mycobacterium tuberculosis
QQQADNHAD

SEQ ID NO: 1431651 - protein, 7 aa, Mycobacterium tuberculosis
QQSFEEV

SEQ ID NO: 1431652 - protein, 4 aa, Mycobacterium tuberculosis
QRAE

SEQ ID NO: 1431653 - protein, 9 aa, Mycobacterium tuberculosis
QRAEQAGGE

SEQ ID NO: 1431654 - protein, 8 aa, Mycobacterium tuberculosis
QRAEWSEQ

SEQ ID NO: 1431655 - protein, 13 aa, Mycobacterium tuberculosis
QRAGGGPGAGRLQ

SEQ ID NO: 1431656 - protein, 25 aa, Mycobacterium tuberculosis
QRAQQNAAASTDADRALSTPSGVTE

SEQ ID NO: 1431657 - protein, 5 aa, Mycobacterium tuberculosis
QRCPP

SEQ ID NO: 1431658 - protein, 5 aa, Mycobacterium tuberculosis
QRGHR

SEQ ID NO: 1431659 - protein, 10 aa, Mycobacterium tuberculosis
QRGRSYARKG

SEQ ID NO: 1431660 - protein, 9 aa, Mycobacterium tuberculosis
QRGSGAGGV

SEQ ID NO: 1431661 - protein, 5 aa, Mycobacterium tuberculosis
QRHDG

SEQ ID NO: 1431662 - protein, 16 aa, Mycobacterium tuberculosis
QRHPELSRTENDAVRA

SEQ ID NO: 1431663 - protein, 13 aa, Mycobacterium tuberculosis
QRKSDLRAAEDPI

SEQ ID NO: 1431664 - protein, 5 aa, Mycobacterium tuberculosis
QRPND

SEQ ID NO: 1431665 - protein, 26 aa, Mycobacterium tuberculosis
QRSADSLRESHGHADRNTQGRGSINE

SEQ ID NO: 1431666 - protein, 4 aa, Mycobacterium tuberculosis
QRSE

SEQ ID NO: 1431667 - protein, 4 aa, Mycobacterium tuberculosis
QRSI

SEQ ID NO: 1431668 - protein, 6 aa, Mycobacterium tuberculosis
QRVGEN

SEQ ID NO: 1431669 - protein, 5 aa, Mycobacterium tuberculosis
QSAEA

SEQ ID NO: 1431670 - protein, 10 aa, Mycobacterium tuberculosis
QSAERAAERQ

SEQ ID NO: 1431671 - protein, 6 aa, Mycobacterium tuberculosis
QSGNTP

SEQ ID NO: 1431672 - protein, 31 aa, Mycobacterium tuberculosis; identical to SEQ ID NO: 184464

SEQ ID NO: 1431673 - protein, 8 aa, Mycobacterium tuberculosis
QSKPCIET

SEQ ID NO: 1431674 - protein, 27 aa, Mycobacterium tuberculosis
QSKTAASPSPSRPQSSSNNSVPGAPNR

SEQ ID NO: 1431675 - protein, 8 aa, Mycobacterium tuberculosis
QSLRERAR

SEQ ID NO: 1431676 - protein, 15 aa, Mycobacterium tuberculosis
QSTSHFEDPPEMADD

SEQ ID NO: 1431677 - protein, 5 aa, Mycobacterium tuberculosis
QSWSD

SEQ ID NO: 1431678 - protein, 21 aa, Mycobacterium tuberculosis
QTAAATDTHGPPPDHNDDPPP

SEQ ID NO: 1431679 - protein, 5 aa, Mycobacterium tuberculosis
QTDSE

SEQ ID NO: 1431680 - protein, 6 aa, Mycobacterium tuberculosis
QTEAMT

SEQ ID NO: 1431681 - protein, 7 aa, Mycobacterium tuberculosis
QTEQEGI

SEQ ID NO: 1431682 - protein, 9 aa, Mycobacterium tuberculosis
QTGGYSPPT

SEQ ID NO: 1431683 - protein, 6 aa, Mycobacterium tuberculosis
QTLGGS

SEQ ID NO: 1431684 - protein, 4 aa, Mycobacterium tuberculosis
QTQD

SEQ ID NO: 1431685 - protein, 4 aa, Mycobacterium tuberculosis
QTQR

SEQ ID NO: 1431686 - protein, 17 aa, Mycobacterium tuberculosis
QTRAQRVTSELSHTQGE

SEQ ID NO: 1431687 - protein, 6 aa, Mycobacterium tuberculosis
QTRTAK

SEQ ID NO: 1431688 - protein, 7 aa, Mycobacterium tuberculosis
QTSAPVT

SEQ ID NO: 1431689 - protein, 9 aa, Mycobacterium tuberculosis
QTVDDQPGG

SEQ ID NO: 1431690 - protein, 16 aa, Mycobacterium tuberculosis
QVGNRALGDRPSQYLT

SEQ ID NO: 1431691 - protein, 4 aa, Mycobacterium tuberculosis
QVPE

SEQ ID NO: 1431692 - protein, 23 aa, Mycobacterium tuberculosis
QVPGGTSAAIPSASSAPSLPNLG

SEQ ID NO: 1431693 - protein, 8 aa, Mycobacterium tuberculosis
QVPGSKSA

SEQ ID NO: 1431694 - protein, 5 aa, Mycobacterium tuberculosis
QVRDG

SEQ ID NO: 1431695 - protein, 5 aa, Mycobacterium tuberculosis
QVTKD

SEQ ID NO: 1431696 - protein, 22 aa, Mycobacterium tuberculosis
QVTTDRSRYRARERHEESAQPV

SEQ ID NO: 1431697 - protein, 14 aa, Mycobacterium tuberculosis
QVVGPREGDTPRTR

SEQ ID NO: 1431698 - protein, 4 aa, Mycobacterium tuberculosis
QYAP

SEQ ID NO: 1431699 - protein, 5 aa, Mycobacterium tuberculosis
QYNPG

SEQ ID NO: 1431700 - protein, 6 aa, Mycobacterium tuberculosis
QYPPDE

SEQ ID NO: 1431701 - protein, 9 aa, Mycobacterium tuberculosis
RAAAENGDA

SEQ ID NO: 1431702 - protein, 7 aa, Mycobacterium tuberculosis
RAAAESR

SEQ ID NO: 1431703 - protein, 14 aa, Mycobacterium tuberculosis
RAAATNAAAGAQRI

SEQ ID NO: 1431704 - protein, 6 aa, Mycobacterium tuberculosis
RAAATR

SEQ ID NO: 1431705 - protein, 4 aa, Mycobacterium tuberculosis
RAAE

SEQ ID NO: 1431706 - protein, 8 aa, Mycobacterium tuberculosis
RAAEQRGV

SEQ ID NO: 1431707 - protein, 4 aa, Mycobacterium tuberculosis
RAAG

SEQ ID NO: 1431708 - protein, 9 aa, Mycobacterium tuberculosis
RAAGNRAAR

SEQ ID NO: 1431709 - protein, 16 aa, Mycobacterium tuberculosis
RAAHGQQRKPPPAWAR

SEQ ID NO: 1431710 - protein, 14 aa, Mycobacterium tuberculosis
RAASRSLGNIIDGS

SEQ ID NO: 1431711 - protein, 5 aa, Mycobacterium tuberculosis
RAATV

SEQ ID NO: 1431712 - protein, 8 aa, Mycobacterium tuberculosis
RADAPDKV

SEQ ID NO: 1431713 - protein, 11 aa, Mycobacterium tuberculosis
RADASVAREDS

SEQ ID NO: 1431714 - protein, 4 aa, Mycobacterium tuberculosis
RADP

SEQ ID NO: 1431715 - protein, 4 aa, Mycobacterium tuberculosis
RADR

SEQ ID NO: 1431716 - protein, 14 aa, Mycobacterium tuberculosis
RAEAEAAQQRLDAG

SEQ ID NO: 1431717 - protein, 5 aa, Mycobacterium tuberculosis
RAEEP

SEQ ID NO: 1431718 - protein, 7 aa, Mycobacterium tuberculosis
RAEGDPD

SEQ ID NO: 1431719 - protein, 15 aa, Mycobacterium tuberculosis
RAEQAGAQAEAAAAA

SEQ ID NO: 1431720 - protein, 10 aa, Mycobacterium tuberculosis
RAFDPSAGKP

SEQ ID NO: 1431721 - protein, 6 aa, Mycobacterium tuberculosis
RAFGAG

SEQ ID NO: 1431722 - protein, 6 aa, Mycobacterium tuberculosis
RAGATH

SEQ ID NO: 1431723 - protein, 6 aa, Mycobacterium tuberculosis
RAGDGD

SEQ ID NO: 1431724 - protein, 28 aa, Mycobacterium tuberculosis
RAGDGGAGGGGGLGGAPGDGGAGGNGGS

SEQ ID NO: 1431725 - protein, 8 aa, Mycobacterium tuberculosis
RAGDVQAG

SEQ ID NO: 1431726 - protein, 8 aa, Mycobacterium tuberculosis
RAGGKAQI

SEQ ID NO: 1431727 - protein, 7 aa, Mycobacterium tuberculosis
RAGGKGH

SEQ ID NO: 1431728 - protein, 11 aa, Mycobacterium tuberculosis
RAGGNSDATAE

SEQ ID NO: 1431729 - protein, 10 aa, Mycobacterium tuberculosis
RAGGVSAPPF

SEQ ID NO: 1431730 - protein, 14 aa, Mycobacterium tuberculosis
RAGNAAVAGPTTGV

SEQ ID NO: 1431731 - protein, 6 aa, Mycobacterium tuberculosis
RAGREL

SEQ ID NO: 1431732 - protein, 17 aa, Mycobacterium tuberculosis
RAGRFDQAGHDHSRTHE

SEQ ID NO: 1431733 - protein, 9 aa, Mycobacterium tuberculosis
RAGRSRNDQ

SEQ ID NO: 1431734 - protein, 5 aa, Mycobacterium tuberculosis
RAGYS

SEQ ID NO: 1431735 - protein, 8 aa, Mycobacterium tuberculosis
RAHQRRHR

SEQ ID NO: 1431736 - protein, 7 aa, Mycobacterium tuberculosis
RAPSRDT

SEQ ID NO: 1431737 - protein, 5 aa, Mycobacterium tuberculosis
RAPSV

SEQ ID NO: 1431738 - protein, 8 aa, Mycobacterium tuberculosis
RAPTEPVE

SEQ ID NO: 1431739 - protein, 6 aa, Mycobacterium tuberculosis
RAPTPP

SEQ ID NO: 1431740 - protein, 7 aa, Mycobacterium tuberculosis
RAQATED

SEQ ID NO: 1431741 - protein, 13 aa, Mycobacterium tuberculosis
RAQDIGADGPDIL

SEQ ID NO: 1431742 - protein, 6 aa, Mycobacterium tuberculosis
RAQNPL

SEQ ID NO: 1431743 - protein, 8 aa, Mycobacterium tuberculosis
RAQQTRAE

SEQ ID NO: 1431744 - protein, 6 aa, Mycobacterium tuberculosis
RAQRRS

SEQ ID NO: 1431745 - protein, 7 aa, Mycobacterium tuberculosis
RAQSAQR

SEQ ID NO: 1431746 - protein, 10 aa, Mycobacterium tuberculosis
RARAARAAQP

SEQ ID NO: 1431747 - protein, 10 aa, Mycobacterium tuberculosis
RARDNARKAG

SEQ ID NO: 1431748 - protein, 4 aa, Mycobacterium tuberculosis
RARE

SEQ ID NO: 1431749 - protein, 5 aa, Mycobacterium tuberculosis
RAREL

SEQ ID NO: 1431750 - protein, 13 aa, Mycobacterium tuberculosis
RARSRCTKGSRRY

SEQ ID NO: 1431751 - protein, 17 aa, Mycobacterium tuberculosis
RARSRCTKGSRRYCERT

SEQ ID NO: 1431752 - protein, 10 aa, Mycobacterium tuberculosis
RASAAERDVT

SEQ ID NO: 1431753 - protein, 4 aa, Mycobacterium tuberculosis
RASD

SEQ ID NO: 1431754 - protein, 8 aa, Mycobacterium tuberculosis
RASGQKDL

SEQ ID NO: 1431755 - protein, 15 aa, Mycobacterium tuberculosis
RASPKLRRARNPIQA

SEQ ID NO: 1431756 - protein, 7 aa, Mycobacterium tuberculosis
RATATPL

SEQ ID NO: 1431757 - protein, 38 aa, Mycobacterium tuberculosis; identical to SEQ ID NO: 184854

SEQ ID NO: 1431758 - protein, 6 aa, Mycobacterium tuberculosis
RATEET

SEQ ID NO: 1431759 - protein, 6 aa, Mycobacterium tuberculosis
RATGTL

SEQ ID NO: 1431760 - protein, 7 aa, Mycobacterium tuberculosis
RATQADH

SEQ ID NO: 1431761 - protein, 8 aa, Mycobacterium tuberculosis
RAVGEEAL

SEQ ID NO: 1431762 - protein, 5 aa, Mycobacterium tuberculosis
RAVGP

SEQ ID NO: 1431763 - protein, 7 aa, Mycobacterium tuberculosis
RAVPDQD

SEQ ID NO: 1431764 - protein, 7 aa, Mycobacterium tuberculosis
RCGEAGR

SEQ ID NO: 1431765 - protein, 26 aa, Mycobacterium tuberculosis
RCPATEDRAPATVATPSSTDPTASRA

SEQ ID NO: 1431766 - protein, 4 aa, Mycobacterium tuberculosis
RCRR

SEQ ID NO: 1431767 - protein, 6 aa, Mycobacterium tuberculosis
RDAAEA

SEQ ID NO: 1431768 - protein, 4 aa, Mycobacterium tuberculosis
RDAD

SEQ ID NO: 1431769 - protein, 7 aa, Mycobacterium tuberculosis
RDAEDAA

SEQ ID NO: 1431770 - protein, 10 aa, Mycobacterium tuberculosis
RDATDEERAE

SEQ ID NO: 1431771 - protein, 5 aa, Mycobacterium tuberculosis
RDDAA

SEQ ID NO: 1431772 - protein, 4 aa, Mycobacterium tuberculosis
RDDF

SEQ ID NO: 1431773 - protein, 6 aa, Mycobacterium tuberculosis
RDDPAA

SEQ ID NO: 1431774 - protein, 8 aa, Mycobacterium tuberculosis
RDDPDEAR

SEQ ID NO: 1431775 - protein, 9 aa, Mycobacterium tuberculosis
RDDPSSVDP

SEQ ID NO: 1431776 - protein, 6 aa, Mycobacterium tuberculosis
RDDVPE

SEQ ID NO: 1431777 - protein, 4 aa, Mycobacterium tuberculosis
RDEL

SEQ ID NO: 1431778 - protein, 10 aa, Mycobacterium tuberculosis
RDEPHADAEK

SEQ ID NO: 1431779 - protein, 7 aa, Mycobacterium tuberculosis
RDGEAAR

SEQ ID NO: 1431780 - protein, 14 aa, Mycobacterium tuberculosis
RDGGDRYGGKGVQK

SEQ ID NO: 1431781 - protein, 5 aa, Mycobacterium tuberculosis
RDHQL

SEQ ID NO: 1431782 - protein, 9 aa, Mycobacterium tuberculosis
RDKAGHSAF

SEQ ID NO: 1431783 - protein, 17 aa, Mycobacterium tuberculosis
RDKPDPSTYIGSGKAAE

SEQ ID NO: 1431784 - protein, 4 aa, Mycobacterium tuberculosis
RDLT

SEQ ID NO: 1431785 - protein, 11 aa, Mycobacterium tuberculosis
RDPDPANVGRQ

SEQ ID NO: 1431786 - protein, 4 aa, Mycobacterium tuberculosis
RDPG

SEQ ID NO: 1431787 - protein, 10 aa, Mycobacterium tuberculosis
RDPSPRASNW

SEQ ID NO: 1431788 - protein, 6 aa, Mycobacterium tuberculosis
RDQHPD

SEQ ID NO: 1431789 - protein, 4 aa, Mycobacterium tuberculosis
RDQQ

SEQ ID NO: 1431790 - protein, 5 aa, Mycobacterium tuberculosis
RDRAR

SEQ ID NO: 1431791 - protein, 4 aa, Mycobacterium tuberculosis
RDRG

SEQ ID NO: 1431792 - protein, 10 aa, Mycobacterium tuberculosis
RDTADISDRQ

SEQ ID NO: 1431793 - protein, 4 aa, Mycobacterium tuberculosis
RDYA

SEQ ID NO: 1431794 - protein, 10 aa, Mycobacterium tuberculosis
RDYAQADRTE

SEQ ID NO: 1431795 - protein, 11 aa, Mycobacterium tuberculosis
RDYAQADRTEL

SEQ ID NO: 1431796 - protein, 12 aa, Mycobacterium tuberculosis
RDYDPTQKRPSI

SEQ ID NO: 1431797 - protein, 9 aa, Mycobacterium tuberculosis
REALGDPTA

SEQ ID NO: 1431798 - protein, 5 aa, Mycobacterium tuberculosis
REARA

SEQ ID NO: 1431799 - protein, 10 aa, Mycobacterium tuberculosis
REASRAERDR

SEQ ID NO: 1431800 - protein, 8 aa, Mycobacterium tuberculosis
REGRDKVA

SEQ ID NO: 1431801 - protein, 5 aa, Mycobacterium tuberculosis
REGTS

SEQ ID NO: 1431802 - protein, 4 aa, Mycobacterium tuberculosis
REGW

SEQ ID NO: 1431803 - protein, 6 aa, Mycobacterium tuberculosis
RELAGD

SEQ ID NO: 1431804 - protein, 4 aa, Mycobacterium tuberculosis
RENP

SEQ ID NO: 1431805 - protein, 6 aa, Mycobacterium tuberculosis
REPDHD

SEQ ID NO: 1431806 - protein, 12 aa, Mycobacterium tuberculosis
REQLTGDEAHER

SEQ ID NO: 1431807 - protein, 14 aa, Mycobacterium tuberculosis
REQTQRRKQQQRTM

SEQ ID NO: 1431808 - protein, 11 aa, Mycobacterium tuberculosis
RERAGNDQRTR

SEQ ID NO: 1431809 - protein, 6 aa, Mycobacterium tuberculosis
RETGSA

SEQ ID NO: 1431810 - protein, 4 aa, Mycobacterium tuberculosis
RETT

SEQ ID NO: 1431811 - protein, 9 aa, Mycobacterium tuberculosis
REVDRSPAD

SEQ ID NO: 1431812 - protein, 9 aa, Mycobacterium tuberculosis
RFANPTPKG

SEQ ID NO: 1431813 - protein, 7 aa, Mycobacterium tuberculosis
RFPDPKD

SEQ ID NO: 1431814 - protein, 11 aa, Mycobacterium tuberculosis
RGAAELDGATA

SEQ ID NO: 1431815 - protein, 15 aa, Mycobacterium tuberculosis
RGAAYPATQPNGPSI

SEQ ID NO: 1431816 - protein, 5 aa, Mycobacterium tuberculosis
RGADR

SEQ ID NO: 1431817 - protein, 10 aa, Mycobacterium tuberculosis
RGAEIGPGTR

SEQ ID NO: 1431818 - protein, 8 aa, Mycobacterium tuberculosis
RGAGTEDA

SEQ ID NO: 1431819 - protein, 4 aa, Mycobacterium tuberculosis
RGAI

SEQ ID NO: 1431820 - protein, 6 aa, Mycobacterium tuberculosis
RGAPDD

SEQ ID NO: 1431821 - protein, 24 aa, Mycobacterium tuberculosis
RGARVPTPQRRRPYRPPPRPNSEA

SEQ ID NO: 1431822 - protein, 15 aa, Mycobacterium tuberculosis
RGASSAASAASATID

SEQ ID NO: 1431823 - protein, 25 aa, Mycobacterium tuberculosis
RGATAPRPADAASPSCGSSPSADSL

SEQ ID NO: 1431824 - protein, 6 aa, Mycobacterium tuberculosis
RGCPGQ

SEQ ID NO: 1431825 - protein, 13 aa, Mycobacterium tuberculosis
RGDAPDAFDDAAR

SEQ ID NO: 1431826 - protein, 9 aa, Mycobacterium tuberculosis
RGDGGGLET

SEQ ID NO: 1431827 - protein, 11 aa, Mycobacterium tuberculosis
RGDPDSGTAAL

SEQ ID NO: 1431828 - protein, 6 aa, Mycobacterium tuberculosis
RGEEIN

SEQ ID NO: 1431829 - protein, 18 aa, Mycobacterium tuberculosis
RGEPERAPCGREPPPDLA

SEQ ID NO: 1431830 - protein, 8 aa, Mycobacterium tuberculosis
RGEPTAQD

SEQ ID NO: 1431831 - protein, 16 aa, Mycobacterium tuberculosis
RGESERAERDGDLAKA

SEQ ID NO: 1431832 - protein, 6 aa, Mycobacterium tuberculosis
RGGGGS

SEQ ID NO: 1431833 - protein, 6 aa, Mycobacterium tuberculosis
RGGPDA

SEQ ID NO: 1431834 - protein, 6 aa, Mycobacterium tuberculosis
RGGSGD

SEQ ID NO: 1431835 - protein, 14 aa, Mycobacterium tuberculosis
RGHPNAAGTAIKDR

SEQ ID NO: 1431836 - protein, 9 aa, Mycobacterium tuberculosis
RGKRTQSTL

SEQ ID NO: 1431837 - protein, 12 aa, Mycobacterium tuberculosis
RGKTIRPKTLNQ

SEQ ID NO: 1431838 - protein, 4 aa, Mycobacterium tuberculosis
RGLD

SEQ ID NO: 1431839 - protein, 4 aa, Mycobacterium tuberculosis
RGND

SEQ ID NO: 1431840 - protein, 6 aa, Mycobacterium tuberculosis
RGNLDT

SEQ ID NO: 1431841 - protein, 6 aa, Mycobacterium tuberculosis
RGPGAA

SEQ ID NO: 1431842 - protein, 5 aa, Mycobacterium tuberculosis
RGPGN

SEQ ID NO: 1431843 - protein, 4 aa, Mycobacterium tuberculosis
RGPL

SEQ ID NO: 1431844 - protein, 6 aa, Mycobacterium tuberculosis
RGQAGI

SEQ ID NO: 1431845 - protein, 4 aa, Mycobacterium tuberculosis
RGQE

SEQ ID NO: 1431846 - protein, 14 aa, Mycobacterium tuberculosis
RGQEATPEPPSALN

SEQ ID NO: 1431847 - protein, 6 aa, Mycobacterium tuberculosis
RGQGKT

SEQ ID NO: 1431848 - protein, 13 aa, Mycobacterium tuberculosis
RGRKTVSIVGSTT

SEQ ID NO: 1431849 - protein, 11 aa, Mycobacterium tuberculosis
RGRRGSVAATL

SEQ ID NO: 1431850 - protein, 21 aa, Mycobacterium tuberculosis
RGRVPNASVARAQSVPSVGET

SEQ ID NO: 1431851 - protein, 4 aa, Mycobacterium tuberculosis
RGSA

SEQ ID NO: 1431852 - protein, 4 aa, Mycobacterium tuberculosis
RGSR

SEQ ID NO: 1431853 - protein, 7 aa, Mycobacterium tuberculosis
RGSRGIR

SEQ ID NO: 1431854 - protein, 10 aa, Mycobacterium tuberculosis
RGSVPASTQL

SEQ ID NO: 1431855 - protein, 11 aa, Mycobacterium tuberculosis
RGTAGRATAHP

SEQ ID NO: 1431856 - protein, 10 aa, Mycobacterium tuberculosis
RGTTQKASRI

SEQ ID NO: 1431857 - protein, 6 aa, Mycobacterium tuberculosis
RGVKGG

SEQ ID NO: 1431858 - protein, 11 aa, Mycobacterium tuberculosis
RGYDSDHPRVQ

SEQ ID NO: 1431859 - protein, 10 aa, Mycobacterium tuberculosis
RGYGRSSKYR

SEQ ID NO: 1431860 - protein, 6 aa, Mycobacterium tuberculosis
RGYGYG

SEQ ID NO: 1431861 - protein, 9 aa, Mycobacterium tuberculosis
RGYSGGEQR

SEQ ID NO: 1431862 - protein, 4 aa, Mycobacterium tuberculosis
RHEY

SEQ ID NO: 1431863 - protein, 12 aa, Mycobacterium tuberculosis
RHIAGRGPRDTY

SEQ ID NO: 1431864 - protein, 4 aa, Mycobacterium tuberculosis
RHPA

SEQ ID NO: 1431865 - protein, 6 aa, Mycobacterium tuberculosis
RHPDVQ

SEQ ID NO: 1431866 - protein, 8 aa, Mycobacterium tuberculosis
RHPNATAG

SEQ ID NO: 1431867 - protein, 4 aa, Mycobacterium tuberculosis
RHPR

SEQ ID NO: 1431868 - protein, 8 aa, Mycobacterium tuberculosis
RHRKRHGD

SEQ ID NO: 1431869 - protein, 7 aa, Mycobacterium tuberculosis
RHTDLDP

SEQ ID NO: 1431870 - protein, 9 aa, Mycobacterium tuberculosis
RHTGGTEVE

SEQ ID NO: 1431871 - protein, 9 aa, Mycobacterium tuberculosis
RHTGKDAGV

SEQ ID NO: 1431872 - protein, 7 aa, Mycobacterium tuberculosis
RIARTAP

SEQ ID NO: 1431873 - protein, 5 aa, Mycobacterium tuberculosis
RIGPG

SEQ ID NO: 1431874 - protein, 6 aa, Mycobacterium tuberculosis
RIKTSQ

SEQ ID NO: 1431875 - protein, 9 aa, Mycobacterium tuberculosis
RIPEHGDYA

SEQ ID NO: 1431876 - protein, 5 aa, Mycobacterium tuberculosis
RIPKG

SEQ ID NO: 1431877 - protein, 7 aa, Mycobacterium tuberculosis
RIPQAPN

SEQ ID NO: 1431878 - protein, 7 aa, Mycobacterium tuberculosis
RISSGTH

SEQ ID NO: 1431879 - protein, 5 aa, Mycobacterium tuberculosis
RKAFG

SEQ ID NO: 1431880 - protein, 18 aa, Mycobacterium tuberculosis
RKESRGGHAREDYPNRDD

SEQ ID NO: 1431881 - protein, 16 aa, Mycobacterium tuberculosis
RKGKPSQDRRAEEHRK

SEQ ID NO: 1431882 - protein, 18 aa, Mycobacterium tuberculosis
RKGRNNSPTAAPTDVGSP

SEQ ID NO: 1431883 - protein, 7 aa, Mycobacterium tuberculosis
RKPNPHL

SEQ ID NO: 1431884 - protein, 9 aa, Mycobacterium tuberculosis
RKSLTLDPQ

SEQ ID NO: 1431885 - protein, 4 aa, Mycobacterium tuberculosis
RKYS

SEQ ID NO: 1431886 - protein, 6 aa, Mycobacterium tuberculosis
RKYTAP

SEQ ID NO: 1431887 - protein, 5 aa, Mycobacterium tuberculosis
RLAPD

SEQ ID NO: 1431888 - protein, 8 aa, Mycobacterium tuberculosis
RLASGAAR

SEQ ID NO: 1431889 - protein, 6 aa, Mycobacterium tuberculosis
RLGAPR

SEQ ID NO: 1431890 - protein, 14 aa, Mycobacterium tuberculosis
RLGLSGTRAVLDGL

SEQ ID NO: 1431891 - protein, 7 aa, Mycobacterium tuberculosis
RLGPTDA

SEQ ID NO: 1431892 - protein, 6 aa, Mycobacterium tuberculosis
RLPAKA

SEQ ID NO: 1431893 - protein, 7 aa, Mycobacterium tuberculosis
RLPDAAT

SEQ ID NO: 1431894 - protein, 5 aa, Mycobacterium tuberculosis
RLPPA

SEQ ID NO: 1431895 - protein, 7 aa, Mycobacterium tuberculosis
RLPPTDL

SEQ ID NO: 1431896 - protein, 15 aa, Mycobacterium tuberculosis
RLQDGEPYLAGTART

SEQ ID NO: 1431897 - protein, 14 aa, Mycobacterium tuberculosis
RLRREPGLTCHTEF

SEQ ID NO: 1431898 - protein, 14 aa, Mycobacterium tuberculosis
RLSAGADDVGRAEE

SEQ ID NO: 1431899 - protein, 8 aa, Mycobacterium tuberculosis
RLTGSSDL

SEQ ID NO: 1431900 - protein, 6 aa, Mycobacterium tuberculosis
RMPSPE

SEQ ID NO: 1431901 - protein, 15 aa, Mycobacterium tuberculosis
RNGIGTGISASDRAT

SEQ ID NO: 1431902 - protein, 4 aa, Mycobacterium tuberculosis
RNRS

SEQ ID NO: 1431903 - protein, 12 aa, Mycobacterium tuberculosis
RNRTNERARLRN

SEQ ID NO: 1431904 - protein, 6 aa, Mycobacterium tuberculosis
RNSTLD

SEQ ID NO: 1431905 - protein, 4 aa, Mycobacterium tuberculosis
RNTD

SEQ ID NO: 1431906 - protein, 4 aa, Mycobacterium tuberculosis
RNTV

SEQ ID NO: 1431907 - protein, 6 aa, Mycobacterium tuberculosis
RNTYAD

SEQ ID NO: 1431908 - protein, 12 aa, Mycobacterium tuberculosis
RNYTAPGGGQFT

SEQ ID NO: 1431909 - protein, 8 aa, Mycobacterium tuberculosis
RPADGPPA

SEQ ID NO: 1431910 - protein, 5 aa, Mycobacterium tuberculosis
RPAPL

SEQ ID NO: 1431911 - protein, 5 aa, Mycobacterium tuberculosis
RPASW

SEQ ID NO: 1431912 - protein, 7 aa, Mycobacterium tuberculosis
RPDAGPS

SEQ ID NO: 1431913 - protein, 7 aa, Mycobacterium tuberculosis
RPDARSA

SEQ ID NO: 1431914 - protein, 5 aa, Mycobacterium tuberculosis
RPDDT

SEQ ID NO: 1431915 - protein, 7 aa, Mycobacterium tuberculosis
RPDERAH

SEQ ID NO: 1431916 - protein, 8 aa, Mycobacterium tuberculosis
RPDPRDPT

SEQ ID NO: 1431917 - protein, 6 aa, Mycobacterium tuberculosis
RPEEVT

SEQ ID NO: 1431918 - protein, 5 aa, Mycobacterium tuberculosis
RPERF

SEQ ID NO: 1431919 - protein, 8 aa, Mycobacterium tuberculosis
RPGAKPSL

SEQ ID NO: 1431920 - protein, 8 aa, Mycobacterium tuberculosis
RPGDDLSA

SEQ ID NO: 1431921 - protein, 5 aa, Mycobacterium tuberculosis
RPGEP

SEQ ID NO: 1431922 - protein, 7 aa, Mycobacterium tuberculosis
RPGERNG

SEQ ID NO: 1431923 - protein, 5 aa, Mycobacterium tuberculosis
RPGGP

SEQ ID NO: 1431924 - protein, 4 aa, Mycobacterium tuberculosis
RPGH

SEQ ID NO: 1431925 - protein, 10 aa, Mycobacterium tuberculosis
RPGISTEPEA

SEQ ID NO: 1431926 - protein, 7 aa, Mycobacterium tuberculosis
RPGKFGG

SEQ ID NO: 1431927 - protein, 13 aa, Mycobacterium tuberculosis
RPGMSGDSSSWKG

SEQ ID NO: 1431928 - protein, 11 aa, Mycobacterium tuberculosis
RPGPLRPAERR

SEQ ID NO: 1431929 - protein, 29 aa, Mycobacterium tuberculosis
RPHRESAHDPLDGDPATRTQTERGGAERG

SEQ ID NO: 1431930 - protein, 12 aa, Mycobacterium tuberculosis
RPHRVTHRKLTR

SEQ ID NO: 1431931 - protein, 5 aa, Mycobacterium tuberculosis
RPKPL

SEQ ID NO: 1431932 - protein, 5 aa, Mycobacterium tuberculosis
RPLGT

SEQ ID NO: 1431933 - protein, 5 aa, Mycobacterium tuberculosis
RPMPG

SEQ ID NO: 1431934 - protein, 7 aa, Mycobacterium tuberculosis
RPNTNNV

SEQ ID NO: 1431935 - protein, 4 aa, Mycobacterium tuberculosis
RPPA

SEQ ID NO: 1431936 - protein, 5 aa, Mycobacterium tuberculosis
RPPEL

SEQ ID NO: 1431937 - protein, 9 aa, Mycobacterium tuberculosis
RPPRASFDA

SEQ ID NO: 1431938 - protein, 13 aa, Mycobacterium tuberculosis
RPQGELDESSRAA

SEQ ID NO: 1431939 - protein, 11 aa, Mycobacterium tuberculosis
RPRAQSRGTAM

SEQ ID NO: 1431940 - protein, 12 aa, Mycobacterium tuberculosis
RPSNPASHRGKG

SEQ ID NO: 1431941 - protein, 4 aa, Mycobacterium tuberculosis
RPSS

SEQ ID NO: 1431942 - protein, 12 aa, Mycobacterium tuberculosis
RPVPGPESEAGP

SEQ ID NO: 1431943 - protein, 9 aa, Mycobacterium tuberculosis
RPVSGAVET

SEQ ID NO: 1431944 - protein, 5 aa, Mycobacterium tuberculosis
RQADG

SEQ ID NO: 1431945 - protein, 17 aa, Mycobacterium tuberculosis
RQALADRRAANCCVLSG

SEQ ID NO: 1431946 - protein, 16 aa, Mycobacterium tuberculosis
RQASPGHAFSPDTPWQ

SEQ ID NO: 1431947 - protein, 5 aa, Mycobacterium tuberculosis
RQCPP

SEQ ID NO: 1431948 - protein, 6 aa, Mycobacterium tuberculosis
RQDEVG

SEQ ID NO: 1431949 - protein, 6 aa, Mycobacterium tuberculosis
RQEYAT

SEQ ID NO: 1431950 - protein, 4 aa, Mycobacterium tuberculosis
RQGS

SEQ ID NO: 1431951 - protein, 8 aa, Mycobacterium tuberculosis
RQIPAADA

SEQ ID NO: 1431952 - protein, 4 aa, Mycobacterium tuberculosis
RQLP

SEQ ID NO: 1431953 - protein, 6 aa, Mycobacterium tuberculosis
RQNAEH

SEQ ID NO: 1431954 - protein, 6 aa, Mycobacterium tuberculosis
RQRDAG

SEQ ID NO: 1431955 - protein, 17 aa, Mycobacterium tuberculosis
RQRRAARQKAERGHPNW

SEQ ID NO: 1431956 - protein, 7 aa, Mycobacterium tuberculosis
RQTDPYT

SEQ ID NO: 1431957 - protein, 8 aa, Mycobacterium tuberculosis
RRAATAAH

SEQ ID NO: 1431958 - protein, 6 aa, Mycobacterium tuberculosis
RRADPA

SEQ ID NO: 1431959 - protein, 6 aa, Mycobacterium tuberculosis
RRAEEA

SEQ ID NO: 1431960 - protein, 5 aa, Mycobacterium tuberculosis
RRAHD

SEQ ID NO: 1431961 - protein, 7 aa, Mycobacterium tuberculosis
RRASELG

SEQ ID NO: 1431962 - protein, 6 aa, Mycobacterium tuberculosis
RRATRE

SEQ ID NO: 1431963 - protein, 5 aa, Mycobacterium tuberculosis
RRDAH

SEQ ID NO: 1431964 - protein, 4 aa, Mycobacterium tuberculosis
RRDE

SEQ ID NO: 1431965 - protein, 15 aa, Mycobacterium tuberculosis
RRDEPFGDYGRQASR

SEQ ID NO: 1431966 - protein, 19 aa, Mycobacterium tuberculosis
RRDKPDPSTYIGSGKAAEL

SEQ ID NO: 1431967 - protein, 4 aa, Mycobacterium tuberculosis
RRDT

SEQ ID NO: 1431968 - protein, 9 aa, Mycobacterium tuberculosis
RREHDEAAA

SEQ ID NO: 1431969 - protein, 7 aa, Mycobacterium tuberculosis
RRENPYH

SEQ ID NO: 1431970 - protein, 4 aa, Mycobacterium tuberculosis
RRGD

SEQ ID NO: 1431971 - protein, 5 aa, Mycobacterium tuberculosis
RRGEN

SEQ ID NO: 1431972 - protein, 6 aa, Mycobacterium tuberculosis
RRGPAH

SEQ ID NO: 1431973 - protein, 20 aa, Mycobacterium tuberculosis
RRGRIGTKRSSISDTDYRRD

SEQ ID NO: 1431974 - protein, 18 aa, Mycobacterium tuberculosis
RRIAEETARAEGKPEQAL

SEQ ID NO: 1431975 - protein, 11 aa, Mycobacterium tuberculosis
RRIEGTGTEVG

SEQ ID NO: 1431976 - protein, 26 aa, Mycobacterium tuberculosis
RRKRSSRALPSAARRGRPSVPTARAR

SEQ ID NO: 1431977 - protein, 12 aa, Mycobacterium tuberculosis
RRNRARELAQEA

SEQ ID NO: 1431978 - protein, 14 aa, Mycobacterium tuberculosis
RRPPARCSTPNRSY

SEQ ID NO: 1431979 - protein, 8 aa, Mycobacterium tuberculosis
RRPRPTRE

SEQ ID NO: 1431980 - protein, 14 aa, Mycobacterium tuberculosis
RRPVQRQSARAGDP

SEQ ID NO: 1431981 - protein, 6 aa, Mycobacterium tuberculosis
RRPYTY

SEQ ID NO: 1431982 - protein, 4 aa, Mycobacterium tuberculosis
RRQL

SEQ ID NO: 1431983 - protein, 5 aa, Mycobacterium tuberculosis
RRQLG

SEQ ID NO: 1431984 - protein, 9 aa, Mycobacterium tuberculosis
RRQTTRSAA

SEQ ID NO: 1431985 - protein, 8 aa, Mycobacterium tuberculosis
RRRARAGS

SEQ ID NO: 1431986 - protein, 5 aa, Mycobacterium tuberculosis
RRRGR

SEQ ID NO: 1431987 - protein, 7 aa, Mycobacterium tuberculosis
RRRYESA

SEQ ID NO: 1431988 - protein, 13 aa, Mycobacterium tuberculosis
RRSAAGPGGNEDS

SEQ ID NO: 1431989 - protein, 11 aa, Mycobacterium tuberculosis
RRTDAESVAGQ

SEQ ID NO: 1431990 - protein, 5 aa, Mycobacterium tuberculosis
RRTGE

SEQ ID NO: 1431991 - protein, 5 aa, Mycobacterium tuberculosis
RRTLD

SEQ ID NO: 1431992 - protein, 22 aa, Mycobacterium tuberculosis
RRVAEAPKTAGLPGTEGQYRSD

SEQ ID NO: 1431993 - protein, 26 aa, Mycobacterium tuberculosis
RRVGGRRRGRSGSGRGRGAIDREQSA

SEQ ID NO: 1431994 - protein, 9 aa, Mycobacterium tuberculosis
RRVGTYSGG

SEQ ID NO: 1431995 - protein, 9 aa, Mycobacterium tuberculosis
RSAGSIKKI

SEQ ID NO: 1431996 - protein, 9 aa, Mycobacterium tuberculosis
RSAQARGVS

SEQ ID NO: 1431997 - protein, 21 aa, Mycobacterium tuberculosis
RSAVTDSERDIRYDPDVKPGV

SEQ ID NO: 1431998 - protein, 8 aa, Mycobacterium tuberculosis
RSDAADID

SEQ ID NO: 1431999 - protein, 5 aa, Mycobacterium tuberculosis
RSDDG

SEQ ID NO: 1432000 - protein, 4 aa, Mycobacterium tuberculosis
RSDS

SEQ ID NO: 1432001 - protein, 10 aa, Mycobacterium tuberculosis
RSEAKRRVAE

SEQ ID NO: 1432002 - protein, 4 aa, Mycobacterium tuberculosis
RSEE

SEQ ID NO: 1432003 - protein, 4 aa, Mycobacterium tuberculosis
RSEP

SEQ ID NO: 1432004 - protein, 4 aa, Mycobacterium tuberculosis
RSER

SEQ ID NO: 1432005 - protein, 9 aa, Mycobacterium tuberculosis
RSFTGSQAG

SEQ ID NO: 1432006 - protein, 12 aa, Mycobacterium tuberculosis
RSGNRTNPSGAT

SEQ ID NO: 1432007 - protein, 8 aa, Mycobacterium tuberculosis
RSGRDRSA

SEQ ID NO: 1432008 - protein, 4 aa, Mycobacterium tuberculosis
RSGY

SEQ ID NO: 1432009 - protein, 5 aa, Mycobacterium tuberculosis
RSGYA

SEQ ID NO: 1432010 - protein, 4 aa, Mycobacterium tuberculosis
RSHA

SEQ ID NO: 1432011 - protein, 19 aa, Mycobacterium tuberculosis
RSHQRSNPDDVTTRAPECA

SEQ ID NO: 1432012 - protein, 8 aa, Mycobacterium tuberculosis
RSKTPVPQ

SEQ ID NO: 1432013 - protein, 6 aa, Mycobacterium tuberculosis
RSLDSA

SEQ ID NO: 1432014 - protein, 8 aa, Mycobacterium tuberculosis
RSLHAGEG

SEQ ID NO: 1432015 - protein, 13 aa, Mycobacterium tuberculosis
RSLREAQSAVEAA

SEQ ID NO: 1432016 - protein, 10 aa, Mycobacterium tuberculosis
RSNPEDDRSE

SEQ ID NO: 1432017 - protein, 11 aa, Mycobacterium tuberculosis
RSPAGKQVKVT

SEQ ID NO: 1432018 - protein, 10 aa, Mycobacterium tuberculosis
RSPDSSGNPY

SEQ ID NO: 1432019 - protein, 5 aa, Mycobacterium tuberculosis
RSPTG

SEQ ID NO: 1432020 - protein, 4 aa, Mycobacterium tuberculosis
RSPW

SEQ ID NO: 1432021 - protein, 6 aa, Mycobacterium tuberculosis
RSPYGA

SEQ ID NO: 1432022 - protein, 12 aa, Mycobacterium tuberculosis
RSQPNPKARQTI

SEQ ID NO: 1432023 - protein, 6 aa, Mycobacterium tuberculosis
RSQVRP

SEQ ID NO: 1432024 - protein, 5 aa, Mycobacterium tuberculosis
RSRCR

SEQ ID NO: 1432025 - protein, 7 aa, Mycobacterium tuberculosis
RSRPDRA

SEQ ID NO: 1432026 - protein, 11 aa, Mycobacterium tuberculosis
RSRQLRGPAGP

SEQ ID NO: 1432027 - protein, 13 aa, Mycobacterium tuberculosis
RSRSGRDVTAEYP

SEQ ID NO: 1432028 - protein, 4 aa, Mycobacterium tuberculosis
RSRT

SEQ ID NO: 1432029 - protein, 6 aa, Mycobacterium tuberculosis
RSSDTA

SEQ ID NO: 1432030 - protein, 5 aa, Mycobacterium tuberculosis
RSSQQ

SEQ ID NO: 1432031 - protein, 16 aa, Mycobacterium tuberculosis
RSSREVARRGPGRVPD

SEQ ID NO: 1432032 - protein, 7 aa, Mycobacterium tuberculosis
RSTDDTA

SEQ ID NO: 1432033 - protein, 6 aa, Mycobacterium tuberculosis
RSTDPA

SEQ ID NO: 1432034 - protein, 9 aa, Mycobacterium tuberculosis
RSTHDPDQV

SEQ ID NO: 1432035 - protein, 7 aa, Mycobacterium tuberculosis
RSTVEDA

SEQ ID NO: 1432036 - protein, 4 aa, Mycobacterium tuberculosis
RSYT

SEQ ID NO: 1432037 - protein, 14 aa, Mycobacterium tuberculosis
RTAAENGRLAADAP

SEQ ID NO: 1432038 - protein, 10 aa, Mycobacterium tuberculosis
RTAAGDTLTS

SEQ ID NO: 1432039 - protein, 6 aa, Mycobacterium tuberculosis
RTAATV

SEQ ID NO: 1432040 - protein, 5 aa, Mycobacterium tuberculosis
RTAEN

SEQ ID NO: 1432041 - protein, 7 aa, Mycobacterium tuberculosis
RTAERRG

SEQ ID NO: 1432042 - protein, 8 aa, Mycobacterium tuberculosis
RTARLEEE

SEQ ID NO: 1432043 - protein, 13 aa, Mycobacterium tuberculosis
RTARSASANRGAD

SEQ ID NO: 1432044 - protein, 20 aa, Mycobacterium tuberculosis
RTDGRGSRPGCPDRRGTPRD

SEQ ID NO: 1432045 - protein, 7 aa, Mycobacterium tuberculosis
RTDNGEE

SEQ ID NO: 1432046 - protein, 5 aa, Mycobacterium tuberculosis
RTDRS

SEQ ID NO: 1432047 - protein, 8 aa, Mycobacterium tuberculosis
RTDSNDSR

SEQ ID NO: 1432048 - protein, 8 aa, Mycobacterium tuberculosis
RTDTGESV

SEQ ID NO: 1432049 - protein, 5 aa, Mycobacterium tuberculosis
RTEAD

SEQ ID NO: 1432050 - protein, 5 aa, Mycobacterium tuberculosis
RTEEV

SEQ ID NO: 1432051 - protein, 11 aa, Mycobacterium tuberculosis
RTEQEAVRTQT

SEQ ID NO: 1432052 - protein, 9 aa, Mycobacterium tuberculosis
RTERQRDQA

SEQ ID NO: 1432053 - protein, 7 aa, Mycobacterium tuberculosis
RTGDTHE

SEQ ID NO: 1432054 - protein, 5 aa, Mycobacterium tuberculosis
RTGGL

SEQ ID NO: 1432055 - protein, 6 aa, Mycobacterium tuberculosis
RTGIGG

SEQ ID NO: 1432056 - protein, 5 aa, Mycobacterium tuberculosis
RTGKL

SEQ ID NO: 1432057 - protein, 6 aa, Mycobacterium tuberculosis
RTGNAM

SEQ ID NO: 1432058 - protein, 6 aa, Mycobacterium tuberculosis
RTGQPS

SEQ ID NO: 1432059 - protein, 4 aa, Mycobacterium tuberculosis
RTGR

SEQ ID NO: 1432060 - protein, 7 aa, Mycobacterium tuberculosis
RTIPRDN

SEQ ID NO: 1432061 - protein, 13 aa, Mycobacterium tuberculosis
RTKETDLSVPTRR

SEQ ID NO: 1432062 - protein, 4 aa, Mycobacterium tuberculosis
RTLD

SEQ ID NO: 1432063 - protein, 8 aa, Mycobacterium tuberculosis
RTNERARL

SEQ ID NO: 1432064 - protein, 6 aa, Mycobacterium tuberculosis
RTPAEG

SEQ ID NO: 1432065 - protein, 4 aa, Mycobacterium tuberculosis
RTPV

SEQ ID NO: 1432066 - protein, 5 aa, Mycobacterium tuberculosis
RTPVR

SEQ ID NO: 1432067 - protein, 4 aa, Mycobacterium tuberculosis
RTQV

SEQ ID NO: 1432068 - protein, 16 aa, Mycobacterium tuberculosis
RTRAGDAHTAGQPGRA

SEQ ID NO: 1432069 - protein, 4 aa, Mycobacterium tuberculosis
RTRD

SEQ ID NO: 1432070 - protein, 5 aa, Mycobacterium tuberculosis
RTRGG

SEQ ID NO: 1432071 - protein, 4 aa, Mycobacterium tuberculosis
RTRR

SEQ ID NO: 1432072 - protein, 8 aa, Mycobacterium tuberculosis
RTSDQDMA

SEQ ID NO: 1432073 - protein, 22 aa, Mycobacterium tuberculosis
RTSLSGEPKPPPQKKPKLPPPA

SEQ ID NO: 1432074 - protein, 19 aa, Mycobacterium tuberculosis
RTSRKAGTDVDRAAAAADG

SEQ ID NO: 1432075 - protein, 6 aa, Mycobacterium tuberculosis
RTTVTA

SEQ ID NO: 1432076 - protein, 14 aa, Mycobacterium tuberculosis
RVDPAKDADGLHPT

SEQ ID NO: 1432077 - protein, 6 aa, Mycobacterium tuberculosis
RVDPDR

SEQ ID NO: 1432078 - protein, 6 aa, Mycobacterium tuberculosis
RVEGAT

SEQ ID NO: 1432079 - protein, 6 aa, Mycobacterium tuberculosis
RVGGAT

SEQ ID NO: 1432080 - protein, 7 aa, Mycobacterium tuberculosis
RVGSTAA

SEQ ID NO: 1432081 - protein, 6 aa, Mycobacterium tuberculosis
RVKRDD

SEQ ID NO: 1432082 - protein, 7 aa, Mycobacterium tuberculosis
RVPPTRP

SEQ ID NO: 1432083 - protein, 14 aa, Mycobacterium tuberculosis
RVQPSGKGGLRPGV

SEQ ID NO: 1432084 - protein, 10 aa, Mycobacterium tuberculosis
RVSGPDPVPG

SEQ ID NO: 1432085 - protein, 9 aa, Mycobacterium tuberculosis
RVSKGGNPL

SEQ ID NO: 1432086 - protein, 4 aa, Mycobacterium tuberculosis
RVST

SEQ ID NO: 1432087 - protein, 6 aa, Mycobacterium tuberculosis
RWDPGK

SEQ ID NO: 1432088 - protein, 5 aa, Mycobacterium tuberculosis
RWPSA

SEQ ID NO: 1432089 - protein, 4 aa, Mycobacterium tuberculosis
RWQG

SEQ ID NO: 1432090 - protein, 16 aa, Mycobacterium tuberculosis
RWRDSGMAGTDQRSQR

SEQ ID NO: 1432091 - protein, 15 aa, Mycobacterium tuberculosis
RYAPPPPYPAPDPFE

SEQ ID NO: 1432092 - protein, 17 aa, Mycobacterium tuberculosis
RYPEAGRATATKSSRHS

SEQ ID NO: 1432093 - protein, 14 aa, Mycobacterium tuberculosis
SAAAAGQARAAAAV

SEQ ID NO: 1432094 - protein, 17 aa, Mycobacterium tuberculosis
SAAAKGEPTPQDGYAGS

SEQ ID NO: 1432095 - protein, 22 aa, Mycobacterium tuberculosis
SAAARAVKGDVEKSLKQFAELY

SEQ ID NO: 1432096 - protein, 8 aa, Mycobacterium tuberculosis
SAAARGLT

SEQ ID NO: 1432097 - protein, 9 aa, Mycobacterium tuberculosis
SAAESDRVT

SEQ ID NO: 1432098 - protein, 11 aa, Mycobacterium tuberculosis
SAAGNSPIPYN

SEQ ID NO: 1432099 - protein, 13 aa, Mycobacterium tuberculosis
SAANAAAAAPTTA

SEQ ID NO: 1432100 - protein, 11 aa, Mycobacterium tuberculosis
SAAPESLGGDG

SEQ ID NO: 1432101 - protein, 7 aa, Mycobacterium tuberculosis
SAAQRAE

SEQ ID NO: 1432102 - protein, 5 aa, Mycobacterium tuberculosis
SAARG

SEQ ID NO: 1432103 - protein, 15 aa, Mycobacterium tuberculosis
SAARKSGQRRGGGAI

SEQ ID NO: 1432104 - protein, 6 aa, Mycobacterium tuberculosis
SAASQG

SEQ ID NO: 1432105 - protein, 13 aa, Mycobacterium tuberculosis
SAATEDDQTYDGA

SEQ ID NO: 1432106 - protein, 8 aa, Mycobacterium tuberculosis
SADADNPC

SEQ ID NO: 1432107 - protein, 5 aa, Mycobacterium tuberculosis
SADDF

SEQ ID NO: 1432108 - protein, 10 aa, Mycobacterium tuberculosis
SADSRGQFPG

SEQ ID NO: 1432109 - protein, 7 aa, Mycobacterium tuberculosis
SAEATGI

SEQ ID NO: 1432110 - protein, 5 aa, Mycobacterium tuberculosis
SAEDL

SEQ ID NO: 1432111 - protein, 6 aa, Mycobacterium tuberculosis
SAEGRV

SEQ ID NO: 1432112 - protein, 17 aa, Mycobacterium tuberculosis
SAEQAKWGQKAVEDEGL

SEQ ID NO: 1432113 - protein, 6 aa, Mycobacterium tuberculosis
SAEVAS

SEQ ID NO: 1432114 - protein, 9 aa, Mycobacterium tuberculosis
SAEVDASYA

SEQ ID NO: 1432115 - protein, 7 aa, Mycobacterium tuberculosis
SAFGANQ

SEQ ID NO: 1432116 - protein, 10 aa, Mycobacterium tuberculosis
SAFGNRGPWS

SEQ ID NO: 1432117 - protein, 8 aa, Mycobacterium tuberculosis
SAGDGRTV

SEQ ID NO: 1432118 - protein, 6 aa, Mycobacterium tuberculosis
SAGLGL

SEQ ID NO: 1432119 - protein, 7 aa, Mycobacterium tuberculosis
SAGNHAQ

SEQ ID NO: 1432120 - protein, 15 aa, Mycobacterium tuberculosis
SAGPGPGSLQAAAAG

SEQ ID NO: 1432121 - protein, 10 aa, Mycobacterium tuberculosis
SAGPITDDPY

SEQ ID NO: 1432122 - protein, 4 aa, Mycobacterium tuberculosis
SAGQ

SEQ ID NO: 1432123 - protein, 6 aa, Mycobacterium tuberculosis
SAGSET

SEQ ID NO: 1432124 - protein, 6 aa, Mycobacterium tuberculosis
SAGSTV

SEQ ID NO: 1432125 - protein, 21 aa, Mycobacterium tuberculosis
SAGTYAATEAANSSAAASPLS

SEQ ID NO: 1432126 - protein, 6 aa, Mycobacterium tuberculosis
SAGVSA

SEQ ID NO: 1432127 - protein, 12 aa, Mycobacterium tuberculosis
SAGYATGGMSTA

SEQ ID NO: 1432128 - protein, 4 aa, Mycobacterium tuberculosis
SAHG

SEQ ID NO: 1432129 - protein, 7 aa, Mycobacterium tuberculosis
SAKARNV

SEQ ID NO: 1432130 - protein, 11 aa, Mycobacterium tuberculosis
SALPAGRPRMA

SEQ ID NO: 1432131 - protein, 7 aa, Mycobacterium tuberculosis
SALTERQ

SEQ ID NO: 1432132 - protein, 8 aa, Mycobacterium tuberculosis
SANTLGKE

SEQ ID NO: 1432133 - protein, 5 aa, Mycobacterium tuberculosis
SAPAA

SEQ ID NO: 1432134 - protein, 6 aa, Mycobacterium tuberculosis
SAPAAA

SEQ ID NO: 1432135 - protein, 10 aa, Mycobacterium tuberculosis
SAPAGDERNP

SEQ ID NO: 1432136 - protein, 7 aa, Mycobacterium tuberculosis
SAPAGVT

SEQ ID NO: 1432137 - protein, 15 aa, Mycobacterium tuberculosis
SAPDIAGQGIADPTA

SEQ ID NO: 1432138 - protein, 12 aa, Mycobacterium tuberculosis
SAPDNSQVRSGD

SEQ ID NO: 1432139 - protein, 8 aa, Mycobacterium tuberculosis
SAPDVDNP

SEQ ID NO: 1432140 - protein, 5 aa, Mycobacterium tuberculosis
SAPGS

SEQ ID NO: 1432141 - protein, 5 aa, Mycobacterium tuberculosis
SAQGS

SEQ ID NO: 1432142 - protein, 11 aa, Mycobacterium tuberculosis
SARAAANPTPR

SEQ ID NO: 1432143 - protein, 5 aa, Mycobacterium tuberculosis
SARDA

SEQ ID NO: 1432144 - protein, 15 aa, Mycobacterium tuberculosis
SARDCRGGTAPGRVA

SEQ ID NO: 1432145 - protein, 6 aa, Mycobacterium tuberculosis
SARTTY

SEQ ID NO: 1432146 - protein, 4 aa, Mycobacterium tuberculosis
SARV

SEQ ID NO: 1432147 - protein, 13 aa, Mycobacterium tuberculosis
SARVTSPEPEATY

SEQ ID NO: 1432148 - protein, 20 aa, Mycobacterium tuberculosis
SARYVEPTGAGPLGSGTGFP

SEQ ID NO: 1432149 - protein, 4 aa, Mycobacterium tuberculosis
SASL

SEQ ID NO: 1432150 - protein, 14 aa, Mycobacterium tuberculosis
SASRSGSVKTSELE

SEQ ID NO: 1432151 - protein, 5 aa, Mycobacterium tuberculosis
SASTR

SEQ ID NO: 1432152 - protein, 6 aa, Mycobacterium tuberculosis
SATPEL

SEQ ID NO: 1432153 - protein, 13 aa, Mycobacterium tuberculosis
SAVNSDLDGTPQL

SEQ ID NO: 1432154 - protein, 4 aa, Mycobacterium tuberculosis
SAVS

SEQ ID NO: 1432155 - protein, 13 aa, Mycobacterium tuberculosis
SAYRGERPPTDIT

SEQ ID NO: 1432156 - protein, 4 aa, Mycobacterium tuberculosis
SCDA

SEQ ID NO: 1432157 - protein, 4 aa, Mycobacterium tuberculosis
SDAA

SEQ ID NO: 1432158 - protein, 24 aa, Mycobacterium tuberculosis
SDATRSRSRDRIRQSESNSPERSI

SEQ ID NO: 1432159 - protein, 4 aa, Mycobacterium tuberculosis
SDDD

SEQ ID NO: 1432160 - protein, 4 aa, Mycobacterium tuberculosis
SDDG

SEQ ID NO: 1432161 - protein, 9 aa, Mycobacterium tuberculosis
SDDLGGGSL

SEQ ID NO: 1432162 - protein, 5 aa, Mycobacterium tuberculosis
SDDQV

SEQ ID NO: 1432163 - protein, 12 aa, Mycobacterium tuberculosis
SDEAQPDNSRHP

SEQ ID NO: 1432164 - protein, 31 aa, Mycobacterium tuberculosis; identical to SEQ ID NO: 187045

SEQ ID NO: 1432165 - protein, 7 aa, Mycobacterium tuberculosis
SDEGKVE

SEQ ID NO: 1432166 - protein, 4 aa, Mycobacterium tuberculosis
SDES

SEQ ID NO: 1432167 - protein, 5 aa, Mycobacterium tuberculosis
SDESL

SEQ ID NO: 1432168 - protein, 8 aa, Mycobacterium tuberculosis
SDESMSDS

SEQ ID NO: 1432169 - protein, 5 aa, Mycobacterium tuberculosis
SDFGS

SEQ ID NO: 1432170 - protein, 7 aa, Mycobacterium tuberculosis
SDGSAPI

SEQ ID NO: 1432171 - protein, 4 aa, Mycobacterium tuberculosis
SDIT

SEQ ID NO: 1432172 - protein, 13 aa, Mycobacterium tuberculosis
SDLGAEPATERRT

SEQ ID NO: 1432173 - protein, 4 aa, Mycobacterium tuberculosis
SDLT

SEQ ID NO: 1432174 - protein, 7 aa, Mycobacterium tuberculosis
SDLTART

SEQ ID NO: 1432175 - protein, 5 aa, Mycobacterium tuberculosis
SDMTE

SEQ ID NO: 1432176 - protein, 8 aa, Mycobacterium tuberculosis
SDPDEAVE

SEQ ID NO: 1432177 - protein, 5 aa, Mycobacterium tuberculosis
SDPDV

SEQ ID NO: 1432178 - protein, 6 aa, Mycobacterium tuberculosis
SDPLGD

SEQ ID NO: 1432179 - protein, 5 aa, Mycobacterium tuberculosis
SDQEH

SEQ ID NO: 1432180 - protein, 17 aa, Mycobacterium tuberculosis
SDSDPASSDAFSADDYT

SEQ ID NO: 1432181 - protein, 7 aa, Mycobacterium tuberculosis
SDSGRAE

SEQ ID NO: 1432182 - protein, 4 aa, Mycobacterium tuberculosis
SDTD

SEQ ID NO: 1432183 - protein, 15 aa, Mycobacterium tuberculosis
SDTDPRKPEELEAEA

SEQ ID NO: 1432184 - protein, 5 aa, Mycobacterium tuberculosis
SDVGY

SEQ ID NO: 1432185 - protein, 13 aa, Mycobacterium tuberculosis
SDVQASNVPVYPG

SEQ ID NO: 1432186 - protein, 11 aa, Mycobacterium tuberculosis
SEALGTAADAV

SEQ ID NO: 1432187 - protein, 6 aa, Mycobacterium tuberculosis
SEAPGY

SEQ ID NO: 1432188 - protein, 9 aa, Mycobacterium tuberculosis
SEDGRSGRA

SEQ ID NO: 1432189 - protein, 4 aa, Mycobacterium tuberculosis
SEEL

SEQ ID NO: 1432190 - protein, 8 aa, Mycobacterium tuberculosis
SEESGGSD

SEQ ID NO: 1432191 - protein, 10 aa, Mycobacterium tuberculosis
SEGGGVYSRE

SEQ ID NO: 1432192 - protein, 12 aa, Mycobacterium tuberculosis
SEGVGKGISPRS

SEQ ID NO: 1432193 - protein, 10 aa, Mycobacterium tuberculosis
SEGVKEDDIR

SEQ ID NO: 1432194 - protein, 10 aa, Mycobacterium tuberculosis
SEHDSPGEAT

SEQ ID NO: 1432195 - protein, 6 aa, Mycobacterium tuberculosis
SEHPSF

SEQ ID NO: 1432196 - protein, 4 aa, Mycobacterium tuberculosis
SEIA

SEQ ID NO: 1432197 - protein, 16 aa, Mycobacterium tuberculosis
SEIPETMPDPDTDDEG

SEQ ID NO: 1432198 - protein, 7 aa, Mycobacterium tuberculosis
SEKGITV

SEQ ID NO: 1432199 - protein, 10 aa, Mycobacterium tuberculosis
SELGTGRGGP

SEQ ID NO: 1432200 - protein, 4 aa, Mycobacterium tuberculosis
SELP

SEQ ID NO: 1432201 - protein, 4 aa, Mycobacterium tuberculosis
SENN

SEQ ID NO: 1432202 - protein, 7 aa, Mycobacterium tuberculosis
SEQRDPA

SEQ ID NO: 1432203 - protein, 5 aa, Mycobacterium tuberculosis
SERGR

SEQ ID NO: 1432204 - protein, 6 aa, Mycobacterium tuberculosis
SERYTE

SEQ ID NO: 1432205 - protein, 9 aa, Mycobacterium tuberculosis
SESDTPAGM

SEQ ID NO: 1432206 - protein, 12 aa, Mycobacterium tuberculosis
SESEKDRRLAES

SEQ ID NO: 1432207 - protein, 7 aa, Mycobacterium tuberculosis
SETGQTV

SEQ ID NO: 1432208 - protein, 4 aa, Mycobacterium tuberculosis
SETL

SEQ ID NO: 1432209 - protein, 6 aa, Mycobacterium tuberculosis
SEYAAA

SEQ ID NO: 1432210 - protein, 11 aa, Mycobacterium tuberculosis
SEYEDRDGIRR

SEQ ID NO: 1432211 - protein, 17 aa, Mycobacterium tuberculosis
SFGSVTSGLAGQSWQGA

SEQ ID NO: 1432212 - protein, 9 aa, Mycobacterium tuberculosis
SGAATPADA

SEQ ID NO: 1432213 - protein, 9 aa, Mycobacterium tuberculosis
SGAGGASGF

SEQ ID NO: 1432214 - protein, 10 aa, Mycobacterium tuberculosis
SGAGNGRLKT

SEQ ID NO: 1432215 - protein, 7 aa, Mycobacterium tuberculosis
SGAGTVG

SEQ ID NO: 1432216 - protein, 8 aa, Mycobacterium tuberculosis
SGATMTAA

SEQ ID NO: 1432217 - protein, 13 aa, Mycobacterium tuberculosis
SGDPITDVNGGGQ

SEQ ID NO: 1432218 - protein, 8 aa, Mycobacterium tuberculosis
SGDSAVPR

SEQ ID NO: 1432219 - protein, 15 aa, Mycobacterium tuberculosis
SGDSQVGIGGTNSGS

SEQ ID NO: 1432220 - protein, 10 aa, Mycobacterium tuberculosis
SGDTANEGTQ

SEQ ID NO: 1432221 - protein, 6 aa, Mycobacterium tuberculosis
SGEGVT

SEQ ID NO: 1432222 - protein, 4 aa, Mycobacterium tuberculosis
SGEL

SEQ ID NO: 1432223 - protein, 12 aa, Mycobacterium tuberculosis
SGESPSTASPES

SEQ ID NO: 1432224 - protein, 7 aa, Mycobacterium tuberculosis
SGEWDGE

SEQ ID NO: 1432225 - protein, 5 aa, Mycobacterium tuberculosis
SGFGQ

SEQ ID NO: 1432226 - protein, 9 aa, Mycobacterium tuberculosis
SGGAGGAGG

SEQ ID NO: 1432227 - protein, 23 aa, Mycobacterium tuberculosis
SGGAGGFGGFGTAGGVGGAGGNA

SEQ ID NO: 1432228 - protein, 21 aa, Mycobacterium tuberculosis
SGGAGGSGAAGMAGGNGGAAG

SEQ ID NO: 1432229 - protein, 30 aa, Mycobacterium tuberculosis; identical to SEQ ID NO: 194973

SEQ ID NO: 1432230 - protein, 13 aa, Mycobacterium tuberculosis
SGGANACTGPAGF

SEQ ID NO: 1432231 - protein, 6 aa, Mycobacterium tuberculosis
SGGERQ

SEQ ID NO: 1432232 - protein, 46 aa, Mycobacterium tuberculosis; identical to SEQ ID NO: 187403

SEQ ID NO: 1432233 - protein, 7 aa, Mycobacterium tuberculosis
SGGSCGR

SEQ ID NO: 1432234 - protein, 12 aa, Mycobacterium tuberculosis
SGGSGGSGQPSI

SEQ ID NO: 1432235 - protein, 7 aa, Mycobacterium tuberculosis
SGIDSST

SEQ ID NO: 1432236 - protein, 7 aa, Mycobacterium tuberculosis
SGIRRGD

SEQ ID NO: 1432237 - protein, 6 aa, Mycobacterium tuberculosis
SGLDPH

SEQ ID NO: 1432238 - protein, 10 aa, Mycobacterium tuberculosis
SGLRASRNQG

SEQ ID NO: 1432239 - protein, 9 aa, Mycobacterium tuberculosis
SGLSPDDGL

SEQ ID NO: 1432240 - protein, 4 aa, Mycobacterium tuberculosis
SGMA

SEQ ID NO: 1432241 - protein, 62 aa, Mycobacterium tuberculosis
SGNEGSGNLGFGNAGDDNTGWGNSGDTNTGGFNSGDLNTGIGSPVTQGVANSGFGNTGTGHS

SEQ ID NO: 1432242 - protein, 19 aa, Mycobacterium tuberculosis
SGNIGNTNFGNGNQGNLNF

SEQ ID NO: 1432243 - protein, 18 aa, Mycobacterium tuberculosis
SGNIGSYNLGGGNLGSYN

SEQ ID NO: 1432244 - protein, 4 aa, Mycobacterium tuberculosis
SGPE

SEQ ID NO: 1432245 - protein, 38 aa, Mycobacterium tuberculosis; identical to SEQ ID NO: 187494

SEQ ID NO: 1432246 - protein, 4 aa, Mycobacterium tuberculosis
SGRE

SEQ ID NO: 1432247 - protein, 5 aa, Mycobacterium tuberculosis
SGREP

SEQ ID NO: 1432248 - protein, 5 aa, Mycobacterium tuberculosis
SGRFA

SEQ ID NO: 1432249 - protein, 5 aa, Mycobacterium tuberculosis
SGRGR

SEQ ID NO: 1432250 - protein, 5 aa, Mycobacterium tuberculosis
SGRLA

SEQ ID NO: 1432251 - protein, 7 aa, Mycobacterium tuberculosis
SGRRRGK

SEQ ID NO: 1432252 - protein, 13 aa, Mycobacterium tuberculosis
SGRSTSEVTEEQI

SEQ ID NO: 1432253 - protein, 10 aa, Mycobacterium tuberculosis
SGSEEDETAW

SEQ ID NO: 1432254 - protein, 4 aa, Mycobacterium tuberculosis
SGSG

SEQ ID NO: 1432255 - protein, 5 aa, Mycobacterium tuberculosis
SGSHN

SEQ ID NO: 1432256 - protein, 7 aa, Mycobacterium tuberculosis
SGSPITI

SEQ ID NO: 1432257 - protein, 6 aa, Mycobacterium tuberculosis
SGSRMR

SEQ ID NO: 1432258 - protein, 11 aa, Mycobacterium tuberculosis
SGSTGAPKGAM

SEQ ID NO: 1432259 - protein, 36 aa, Mycobacterium tuberculosis; identical to SEQ ID NO: 187588

SEQ ID NO: 1432260 - protein, 38 aa, Mycobacterium tuberculosis; identical to SEQ ID NO: 187589

SEQ ID NO: 1432261 - protein, 11 aa, Mycobacterium tuberculosis
SGTTEPDAGLT

SEQ ID NO: 1432262 - protein, 14 aa, Mycobacterium tuberculosis
SGVDEDYHRGESAY

SEQ ID NO: 1432263 - protein, 10 aa, Mycobacterium tuberculosis
SGVDSTGMSS

SEQ ID NO: 1432264 - protein, 12 aa, Mycobacterium tuberculosis
SGVGDTGDDVRA

SEQ ID NO: 1432265 - protein, 4 aa, Mycobacterium tuberculosis
SGWG

SEQ ID NO: 1432266 - protein, 17 aa, Mycobacterium tuberculosis
SHKRQRKAAAKAEGKAP

SEQ ID NO: 1432267 - protein, 7 aa, Mycobacterium tuberculosis
SHPADNI

SEQ ID NO: 1432268 - protein, 7 aa, Mycobacterium tuberculosis
SHPEYAT

SEQ ID NO: 1432269 - protein, 7 aa, Mycobacterium tuberculosis
SHRQAPV

SEQ ID NO: 1432270 - protein, 15 aa, Mycobacterium tuberculosis
SIDGRSAAADGSSQW

SEQ ID NO: 1432271 - protein, 19 aa, Mycobacterium tuberculosis
SIESTAAAVASGSPQLPST

SEQ ID NO: 1432272 - protein, 5 aa, Mycobacterium tuberculosis
SIHNT

SEQ ID NO: 1432273 - protein, 10 aa, Mycobacterium tuberculosis
SIPITTSGKI

SEQ ID NO: 1432274 - protein, 4 aa, Mycobacterium tuberculosis
SIPT

SEQ ID NO: 1432275 - protein, 7 aa, Mycobacterium tuberculosis
SITPDEL

SEQ ID NO: 1432276 - protein, 4 aa, Mycobacterium tuberculosis
SITT

SEQ ID NO: 1432277 - protein, 26 aa, Mycobacterium tuberculosis
SKHAQQPHADPGNAHARSDDPAGRRC

SEQ ID NO: 1432278 - protein, 4 aa, Mycobacterium tuberculosis
SKHR

SEQ ID NO: 1432279 - protein, 4 aa, Mycobacterium tuberculosis
SKIE

SEQ ID NO: 1432280 - protein, 4 aa, Mycobacterium tuberculosis
SKLT

SEQ ID NO: 1432281 - protein, 8 aa, Mycobacterium tuberculosis
SKPPQRGL

SEQ ID NO: 1432282 - protein, 5 aa, Mycobacterium tuberculosis
SKQPG

SEQ ID NO: 1432283 - protein, 6 aa, Mycobacterium tuberculosis
SKQRGR

SEQ ID NO: 1432284 - protein, 4 aa, Mycobacterium tuberculosis
SKQV

SEQ ID NO: 1432285 - protein, 16 aa, Mycobacterium tuberculosis
SKSRDFADDPQRAAAV

SEQ ID NO: 1432286 - protein, 8 aa, Mycobacterium tuberculosis
SKTGERAR

SEQ ID NO: 1432287 - protein, 6 aa, Mycobacterium tuberculosis
SKVGTV

SEQ ID NO: 1432288 - protein, 7 aa, Mycobacterium tuberculosis
SKYRGEF

SEQ ID NO: 1432289 - protein, 11 aa, Mycobacterium tuberculosis
SLASRECPQPA

SEQ ID NO: 1432290 - protein, 8 aa, Mycobacterium tuberculosis
SLDAASKS

SEQ ID NO: 1432291 - protein, 5 aa, Mycobacterium tuberculosis
SLGDP

SEQ ID NO: 1432292 - protein, 8 aa, Mycobacterium tuberculosis
SLGPGSMS

SEQ ID NO: 1432293 - protein, 19 aa, Mycobacterium tuberculosis
SLGRPDYRDDPSPAHQPGS

SEQ ID NO: 1432294 - protein, 6 aa, Mycobacterium tuberculosis
SLHGDT

SEQ ID NO: 1432295 - protein, 6 aa, Mycobacterium tuberculosis
SLPTPF

SEQ ID NO: 1432296 - protein, 60 aa, Mycobacterium tuberculosis; identical to SEQ ID NO: 187805

SEQ ID NO: 1432297 - protein, 5 aa, Mycobacterium tuberculosis
SLQDK

SEQ ID NO: 1432298 - protein, 4 aa, Mycobacterium tuberculosis
SLRE

SEQ ID NO: 1432299 - protein, 9 aa, Mycobacterium tuberculosis
SLREGQASL

SEQ ID NO: 1432300 - protein, 6 aa, Mycobacterium tuberculosis
SLRRPQ

SEQ ID NO: 1432301 - protein, 10 aa, Mycobacterium tuberculosis
SLSPYGPPVT

SEQ ID NO: 1432302 - protein, 6 aa, Mycobacterium tuberculosis
SLTENE

SEQ ID NO: 1432303 - protein, 9 aa, Mycobacterium tuberculosis
SLTQVGSSG

SEQ ID NO: 1432304 - protein, 7 aa, Mycobacterium tuberculosis
SMGDSEF

SEQ ID NO: 1432305 - protein, 8 aa, Mycobacterium tuberculosis
SNAGAGTA

SEQ ID NO: 1432306 - protein, 7 aa, Mycobacterium tuberculosis
SNDPTEL

SEQ ID NO: 1432307 - protein, 29 aa, Mycobacterium tuberculosis
SNGGAGGAGGFGVSGSAGGNGGTGGDGGI

SEQ ID NO: 1432308 - protein, 5 aa, Mycobacterium tuberculosis
SNLHT

SEQ ID NO: 1432309 - protein, 13 aa, Mycobacterium tuberculosis
SNMGHTQAAAGVA

SEQ ID NO: 1432310 - protein, 6 aa, Mycobacterium tuberculosis
SNPAIA

SEQ ID NO: 1432311 - protein, 16 aa, Mycobacterium tuberculosis
SNPNQKATEDYISGRF

SEQ ID NO: 1432312 - protein, 5 aa, Mycobacterium tuberculosis
SNTDG

SEQ ID NO: 1432313 - protein, 6 aa, Mycobacterium tuberculosis
SPALGA

SEQ ID NO: 1432314 - protein, 5 aa, Mycobacterium tuberculosis
SPANE

SEQ ID NO: 1432315 - protein, 17 aa, Mycobacterium tuberculosis
SPAPSPRPPATSTEGAS

SEQ ID NO: 1432316 - protein, 5 aa, Mycobacterium tuberculosis
SPAQL

SEQ ID NO: 1432317 - protein, 6 aa, Mycobacterium tuberculosis
SPDEKY

SEQ ID NO: 1432318 - protein, 6 aa, Mycobacterium tuberculosis
SPDLAG

SEQ ID NO: 1432319 - protein, 7 aa, Mycobacterium tuberculosis
SPDSAIG

SEQ ID NO: 1432320 - protein, 10 aa, Mycobacterium tuberculosis
SPDTQDTRAV

SEQ ID NO: 1432321 - protein, 11 aa, Mycobacterium tuberculosis
SPEEYTGKRTH

SEQ ID NO: 1432322 - protein, 5 aa, Mycobacterium tuberculosis
SPEFQ

SEQ ID NO: 1432323 - protein, 9 aa, Mycobacterium tuberculosis
SPEPKPCEG

SEQ ID NO: 1432324 - protein, 5 aa, Mycobacterium tuberculosis
SPEWT

SEQ ID NO: 1432325 - protein, 8 aa, Mycobacterium tuberculosis
SPGGESNV

SEQ ID NO: 1432326 - protein, 4 aa, Mycobacterium tuberculosis
SPGL

SEQ ID NO: 1432327 - protein, 5 aa, Mycobacterium tuberculosis
SPGPH

SEQ ID NO: 1432328 - protein, 8 aa, Mycobacterium tuberculosis
SPGRDTPI

SEQ ID NO: 1432329 - protein, 10 aa, Mycobacterium tuberculosis
SPGSRSDIGG

SEQ ID NO: 1432330 - protein, 10 aa, Mycobacterium tuberculosis
SPGVERPLTS

SEQ ID NO: 1432331 - protein, 4 aa, Mycobacterium tuberculosis
SPHL

SEQ ID NO: 1432332 - protein, 8 aa, Mycobacterium tuberculosis
SPHNRNAL

SEQ ID NO: 1432333 - protein, 6 aa, Mycobacterium tuberculosis
SPLPVD

SEQ ID NO: 1432334 - protein, 11 aa, Mycobacterium tuberculosis
SPPAEEAPPVP

SEQ ID NO: 1432335 - protein, 7 aa, Mycobacterium tuberculosis
SPPRHGL

SEQ ID NO: 1432336 - protein, 4 aa, Mycobacterium tuberculosis
SPPV

SEQ ID NO: 1432337 - protein, 5 aa, Mycobacterium tuberculosis
SPQQA

SEQ ID NO: 1432338 - protein, 6 aa, Mycobacterium tuberculosis
SPRRGQ

SEQ ID NO: 1432339 - protein, 13 aa, Mycobacterium tuberculosis
SPSRSRPHRAEAR

SEQ ID NO: 1432340 - protein, 4 aa, Mycobacterium tuberculosis
SPSV

SEQ ID NO: 1432341 - protein, 10 aa, Mycobacterium tuberculosis
SPTETVSGPM

SEQ ID NO: 1432342 - protein, 5 aa, Mycobacterium tuberculosis
SPTPV

SEQ ID NO: 1432343 - protein, 5 aa, Mycobacterium tuberculosis
SPVQT

SEQ ID NO: 1432344 - protein, 8 aa, Mycobacterium tuberculosis
SQAGQPPE

SEQ ID NO: 1432345 - protein, 5 aa, Mycobacterium tuberculosis
SQGAV

SEQ ID NO: 1432346 - protein, 15 aa, Mycobacterium tuberculosis
SQGTADAYKTSRGSI

SEQ ID NO: 1432347 - protein, 9 aa, Mycobacterium tuberculosis
SQHTEQAPP

SEQ ID NO: 1432348 - protein, 7 aa, Mycobacterium tuberculosis
SQPAFPG

SEQ ID NO: 1432349 - protein, 5 aa, Mycobacterium tuberculosis
SQPGA

SEQ ID NO: 1432350 - protein, 5 aa, Mycobacterium tuberculosis
SQRAQ

SEQ ID NO: 1432351 - protein, 5 aa, Mycobacterium tuberculosis
SQREA

SEQ ID NO: 1432352 - protein, 10 aa, Mycobacterium tuberculosis
SQRSRNRHVG

SEQ ID NO: 1432353 - protein, 9 aa, Mycobacterium tuberculosis
SQSYPGASM

SEQ ID NO: 1432354 - protein, 17 aa, Mycobacterium tuberculosis
SQYAPTAGPYFSHGNLV

SEQ ID NO: 1432355 - protein, 6 aa, Mycobacterium tuberculosis
SRAGKV

SEQ ID NO: 1432356 - protein, 9 aa, Mycobacterium tuberculosis
SRDEGATVA

SEQ ID NO: 1432357 - protein, 5 aa, Mycobacterium tuberculosis
SREAR

SEQ ID NO: 1432358 - protein, 7 aa, Mycobacterium tuberculosis
SREEQDR

SEQ ID NO: 1432359 - protein, 6 aa, Mycobacterium tuberculosis
SREPDP

SEQ ID NO: 1432360 - protein, 9 aa, Mycobacterium tuberculosis
SRGARGPYR

SEQ ID NO: 1432361 - protein, 4 aa, Mycobacterium tuberculosis
SRGD

SEQ ID NO: 1432362 - protein, 5 aa, Mycobacterium tuberculosis
SRGEH

SEQ ID NO: 1432363 - protein, 4 aa, Mycobacterium tuberculosis
SRGR

SEQ ID NO: 1432364 - protein, 4 aa, Mycobacterium tuberculosis
SRKL

SEQ ID NO: 1432365 - protein, 5 aa, Mycobacterium tuberculosis
SRLET

SEQ ID NO: 1432366 - protein, 5 aa, Mycobacterium tuberculosis
SRNAP

SEQ ID NO: 1432367 - protein, 5 aa, Mycobacterium tuberculosis
SRPAV

SEQ ID NO: 1432368 - protein, 5 aa, Mycobacterium tuberculosis
SRPDG

SEQ ID NO: 1432369 - protein, 7 aa, Mycobacterium tuberculosis
SRPLNRD

SEQ ID NO: 1432370 - protein, 9 aa, Mycobacterium tuberculosis
SRPPRQVPG

SEQ ID NO: 1432371 - protein, 6 aa, Mycobacterium tuberculosis
SRRDIP

SEQ ID NO: 1432372 - protein, 5 aa, Mycobacterium tuberculosis
SRRNP

SEQ ID NO: 1432373 - protein, 9 aa, Mycobacterium tuberculosis
SRSASDEVT

SEQ ID NO: 1432374 - protein, 6 aa, Mycobacterium tuberculosis
SRSGIA

SEQ ID NO: 1432375 - protein, 8 aa, Mycobacterium tuberculosis
SRSQLSPR

SEQ ID NO: 1432376 - protein, 4 aa, Mycobacterium tuberculosis
SRST

SEQ ID NO: 1432377 - protein, 8 aa, Mycobacterium tuberculosis
SRTNGIAD

SEQ ID NO: 1432378 - protein, 6 aa, Mycobacterium tuberculosis
SRTRGY

SEQ ID NO: 1432379 - protein, 6 aa, Mycobacterium tuberculosis
SRVQGA

SEQ ID NO: 1432380 - protein, 6 aa, Mycobacterium tuberculosis
SRYRSN

SEQ ID NO: 1432381 - protein, 9 aa, Mycobacterium tuberculosis
SSAADDPTL

SEQ ID NO: 1432382 - protein, 11 aa, Mycobacterium tuberculosis
SSADALRQTAQ

SEQ ID NO: 1432383 - protein, 9 aa, Mycobacterium tuberculosis
SSAQSHDEQ

SEQ ID NO: 1432384 - protein, 7 aa, Mycobacterium tuberculosis
SSDGVGT

SEQ ID NO: 1432385 - protein, 4 aa, Mycobacterium tuberculosis
SSDV

SEQ ID NO: 1432386 - protein, 5 aa, Mycobacterium tuberculosis
SSEAI

SEQ ID NO: 1432387 - protein, 7 aa, Mycobacterium tuberculosis
SSFGSVT

SEQ ID NO: 1432388 - protein, 6 aa, Mycobacterium tuberculosis
SSFSGT

SEQ ID NO: 1432389 - protein, 8 aa, Mycobacterium tuberculosis
SSGAALTD

SEQ ID NO: 1432390 - protein, 14 aa, Mycobacterium tuberculosis
SSGKPGRDPEAGRY

SEQ ID NO: 1432391 - protein, 23 aa, Mycobacterium tuberculosis
SSGLGSTAPAISAGASQAGSVGG

SEQ ID NO: 1432392 - protein, 49 aa, Mycobacterium tuberculosis; identical to SEQ ID NO: 193314

SEQ ID NO: 1432393 - protein, 11 aa, Mycobacterium tuberculosis
SSGYNAEAAAP

SEQ ID NO: 1432394 - protein, 13 aa, Mycobacterium tuberculosis
SSIENGDIGSAQV

SEQ ID NO: 1432395 - protein, 10 aa, Mycobacterium tuberculosis
SSISQVPPQR

SEQ ID NO: 1432396 - protein, 9 aa, Mycobacterium tuberculosis
SSLADTLRD

SEQ ID NO: 1432397 - protein, 5 aa, Mycobacterium tuberculosis
SSLYP

SEQ ID NO: 1432398 - protein, 18 aa, Mycobacterium tuberculosis
SSPMAADQQTAGPLAGEL

SEQ ID NO: 1432399 - protein, 4 aa, Mycobacterium tuberculosis
SSRA

SEQ ID NO: 1432400 - protein, 18 aa, Mycobacterium tuberculosis
SSTGAPPKKSREQRVREN

SEQ ID NO: 1432401 - protein, 14 aa, Mycobacterium tuberculosis
SSTGAPPQKKVGNS

SEQ ID NO: 1432402 - protein, 6 aa, Mycobacterium tuberculosis
SSTNDY

SEQ ID NO: 1432403 - protein, 13 aa, Mycobacterium tuberculosis
SSTNGFNAASPAF

SEQ ID NO: 1432404 - protein, 10 aa, Mycobacterium tuberculosis
SSTSTLQGAG

SEQ ID NO: 1432405 - protein, 4 aa, Mycobacterium tuberculosis
STAE

SEQ ID NO: 1432406 - protein, 14 aa, Mycobacterium tuberculosis
STAEKAKLSKDAGA

SEQ ID NO: 1432407 - protein, 15 aa, Mycobacterium tuberculosis
STAGGAGGAGGAGGL

SEQ ID NO: 1432408 - protein, 5 aa, Mycobacterium tuberculosis
STANL

SEQ ID NO: 1432409 - protein, 7 aa, Mycobacterium tuberculosis
STAPVRR

SEQ ID NO: 1432410 - protein, 11 aa, Mycobacterium tuberculosis
STARDTFNRRR

SEQ ID NO: 1432411 - protein, 13 aa, Mycobacterium tuberculosis
STDLTARAREGKL

SEQ ID NO: 1432412 - protein, 8 aa, Mycobacterium tuberculosis
STDPVRKQ

SEQ ID NO: 1432413 - protein, 12 aa, Mycobacterium tuberculosis
STDTDETGRHTA

SEQ ID NO: 1432414 - protein, 8 aa, Mycobacterium tuberculosis
STEPVAGA

SEQ ID NO: 1432415 - protein, 13 aa, Mycobacterium tuberculosis
STGDSGKGADVDK

SEQ ID NO: 1432416 - protein, 7 aa, Mycobacterium tuberculosis
STGGGAS

SEQ ID NO: 1432417 - protein, 30 aa, Mycobacterium tuberculosis; identical to SEQ ID NO: 188505

SEQ ID NO: 1432418 - protein, 15 aa, Mycobacterium tuberculosis
STGNTSASAAAYAAR

SEQ ID NO: 1432419 - protein, 4 aa, Mycobacterium tuberculosis
STGY

SEQ ID NO: 1432420 - protein, 10 aa, Mycobacterium tuberculosis
STLSPASAAA

SEQ ID NO: 1432421 - protein, 10 aa, Mycobacterium tuberculosis
STPESLTATR

SEQ ID NO: 1432422 - protein, 12 aa, Mycobacterium tuberculosis
STPGIATQANSG

SEQ ID NO: 1432423 - protein, 5 aa, Mycobacterium tuberculosis
STPPI

SEQ ID NO: 1432424 - protein, 8 aa, Mycobacterium tuberculosis
STPWPGGE

SEQ ID NO: 1432425 - protein, 8 aa, Mycobacterium tuberculosis
STSTTELQ

SEQ ID NO: 1432426 - protein, 5 aa, Mycobacterium tuberculosis
STTVE

SEQ ID NO: 1432427 - protein, 5 aa, Mycobacterium tuberculosis
STWDR

SEQ ID NO: 1432428 - protein, 12 aa, Mycobacterium tuberculosis
SVAHADAPGRVR

SEQ ID NO: 1432429 - protein, 5 aa, Mycobacterium tuberculosis
SVAKT

SEQ ID NO: 1432430 - protein, 8 aa, Mycobacterium tuberculosis
SVDPESKS

SEQ ID NO: 1432431 - protein, 11 aa, Mycobacterium tuberculosis
SVEGEPKPLPN

SEQ ID NO: 1432432 - protein, 6 aa, Mycobacterium tuberculosis
SVEPPI

SEQ ID NO: 1432433 - protein, 6 aa, Mycobacterium tuberculosis
SVGPYG

SEQ ID NO: 1432434 - protein, 4 aa, Mycobacterium tuberculosis
SVLP

SEQ ID NO: 1432435 - protein, 8 aa, Mycobacterium tuberculosis
SVPEPREL

SEQ ID NO: 1432436 - protein, 5 aa, Mycobacterium tuberculosis
SVQEI

SEQ ID NO: 1432437 - protein, 16 aa, Mycobacterium tuberculosis
SVQTGYEGLSRTPAPV

SEQ ID NO: 1432438 - protein, 10 aa, Mycobacterium tuberculosis
SVRTGDRRMS

SEQ ID NO: 1432439 - protein, 17 aa, Mycobacterium tuberculosis
SVSARDCRGGTAPGRVA

SEQ ID NO: 1432440 - protein, 10 aa, Mycobacterium tuberculosis
SVSDDDDTTR

SEQ ID NO: 1432441 - protein, 9 aa, Mycobacterium tuberculosis
SVSDNKKTV

SEQ ID NO: 1432442 - protein, 5 aa, Mycobacterium tuberculosis
SVSGA

SEQ ID NO: 1432443 - protein, 8 aa, Mycobacterium tuberculosis
SVSGGHVG

SEQ ID NO: 1432444 - protein, 7 aa, Mycobacterium tuberculosis
SVTDEYR

SEQ ID NO: 1432445 - protein, 11 aa, Mycobacterium tuberculosis
SVTIDSGQSSS

SEQ ID NO: 1432446 - protein, 4 aa, Mycobacterium tuberculosis
SVTR

SEQ ID NO: 1432447 - protein, 7 aa, Mycobacterium tuberculosis
SVTSELT

SEQ ID NO: 1432448 - protein, 10 aa, Mycobacterium tuberculosis
SYAVSGPGNV

SEQ ID NO: 1432449 - protein, 8 aa, Mycobacterium tuberculosis
SYDRVSRH

SEQ ID NO: 1432450 - protein, 6 aa, Mycobacterium tuberculosis
SYETTF

SEQ ID NO: 1432451 - protein, 8 aa, Mycobacterium tuberculosis
SYKVTGTA

SEQ ID NO: 1432452 - protein, 14 aa, Mycobacterium tuberculosis
SYTAEDGVISIRPK

SEQ ID NO: 1432453 - protein, 5 aa, Mycobacterium tuberculosis
SYTEG

SEQ ID NO: 1432454 - protein, 6 aa, Mycobacterium tuberculosis
TAAARH

SEQ ID NO: 1432455 - protein, 11 aa, Mycobacterium tuberculosis
TAADGSRRRAF

SEQ ID NO: 1432456 - protein, 6 aa, Mycobacterium tuberculosis
TAAEDA

SEQ ID NO: 1432457 - protein, 8 aa, Mycobacterium tuberculosis
TAAGSAVS

SEQ ID NO: 1432458 - protein, 7 aa, Mycobacterium tuberculosis
TAAGTSC

SEQ ID NO: 1432459 - protein, 19 aa, Mycobacterium tuberculosis
TAAHTNRSATPVASEGPAV

SEQ ID NO: 1432460 - protein, 12 aa, Mycobacterium tuberculosis
TAALKGSPQRRG

SEQ ID NO: 1432461 - protein, 9 aa, Mycobacterium tuberculosis
TAAPHGAAG

SEQ ID NO: 1432462 - protein, 6 aa, Mycobacterium tuberculosis
TAAQEQ

SEQ ID NO: 1432463 - protein, 5 aa, Mycobacterium tuberculosis
TAARI

SEQ ID NO: 1432464 - protein, 7 aa, Mycobacterium tuberculosis
TAARYGH

SEQ ID NO: 1432465 - protein, 13 aa, Mycobacterium tuberculosis
TAATNGSPSGNAE

SEQ ID NO: 1432466 - protein, 7 aa, Mycobacterium tuberculosis
TADDNTK

SEQ ID NO: 1432467 - protein, 9 aa, Mycobacterium tuberculosis
TADPAAPDL

SEQ ID NO: 1432468 - protein, 5 aa, Mycobacterium tuberculosis
TAEEY

SEQ ID NO: 1432469 - protein, 4 aa, Mycobacterium tuberculosis
TAEL

SEQ ID NO: 1432470 - protein, 10 aa, Mycobacterium tuberculosis
TAGADTSVGA

SEQ ID NO: 1432471 - protein, 16 aa, Mycobacterium tuberculosis
TAGAGAARTTLARRTS

SEQ ID NO: 1432472 - protein, 7 aa, Mycobacterium tuberculosis
TAGAGSP

SEQ ID NO: 1432473 - protein, 21 aa, Mycobacterium tuberculosis
TAGDLEGADEDAHIADPRAGL

SEQ ID NO: 1432474 - protein, 6 aa, Mycobacterium tuberculosis
TAGEPV

SEQ ID NO: 1432475 - protein, 4 aa, Mycobacterium tuberculosis
TAGG

SEQ ID NO: 1432476 - protein, 6 aa, Mycobacterium tuberculosis
TAGITD

SEQ ID NO: 1432477 - protein, 8 aa, Mycobacterium tuberculosis
TAGPGGFE

SEQ ID NO: 1432478 - protein, 16 aa, Mycobacterium tuberculosis
TAGQARPCGTDGSVGT

SEQ ID NO: 1432479 - protein, 11 aa, Mycobacterium tuberculosis
TAGRSDLKTVP

SEQ ID NO: 1432480 - protein, 6 aa, Mycobacterium tuberculosis
TAGSRL

SEQ ID NO: 1432481 - protein, 6 aa, Mycobacterium tuberculosis
TAGTAT

SEQ ID NO: 1432482 - protein, 9 aa, Mycobacterium tuberculosis
TALELGPSG

SEQ ID NO: 1432483 - protein, 8 aa, Mycobacterium tuberculosis
TALGAGAA

SEQ ID NO: 1432484 - protein, 11 aa, Mycobacterium tuberculosis
TALGTGRGEEL

SEQ ID NO: 1432485 - protein, 5 aa, Mycobacterium tuberculosis
TANGP

SEQ ID NO: 1432486 - protein, 7 aa, Mycobacterium tuberculosis
TANNPAF

SEQ ID NO: 1432487 - protein, 8 aa, Mycobacterium tuberculosis
TANWPQGQ

SEQ ID NO: 1432488 - protein, 15 aa, Mycobacterium tuberculosis
TAPGKSQIGGASNAG

SEQ ID NO: 1432489 - protein, 9 aa, Mycobacterium tuberculosis
TAPKSNAVT

SEQ ID NO: 1432490 - protein, 8 aa, Mycobacterium tuberculosis
TAPQAPDL

SEQ ID NO: 1432491 - protein, 5 aa, Mycobacterium tuberculosis
TAQRG

SEQ ID NO: 1432492 - protein, 5 aa, Mycobacterium tuberculosis
TAQTR

SEQ ID NO: 1432493 - protein, 6 aa, Mycobacterium tuberculosis
TARGGS

SEQ ID NO: 1432494 - protein, 4 aa, Mycobacterium tuberculosis
TASA

SEQ ID NO: 1432495 - protein, 9 aa, Mycobacterium tuberculosis
TASFAEQRQ

SEQ ID NO: 1432496 - protein, 13 aa, Mycobacterium tuberculosis
TASGSDQQSLSDR

SEQ ID NO: 1432497 - protein, 7 aa, Mycobacterium tuberculosis
TASLGDR

SEQ ID NO: 1432498 - protein, 11 aa, Mycobacterium tuberculosis
TASRHSYSAGA

SEQ ID NO: 1432499 - protein, 5 aa, Mycobacterium tuberculosis
TASRI

SEQ ID NO: 1432500 - protein, 13 aa, Mycobacterium tuberculosis
TASTRAAKAQLRS

SEQ ID NO: 1432501 - protein, 6 aa, Mycobacterium tuberculosis
TATALR

SEQ ID NO: 1432502 - protein, 4 aa, Mycobacterium tuberculosis
TATE

SEQ ID NO: 1432503 - protein, 8 aa, Mycobacterium tuberculosis
TATGPTEV

SEQ ID NO: 1432504 - protein, 8 aa, Mycobacterium tuberculosis
TATPEAFN

SEQ ID NO: 1432505 - protein, 9 aa, Mycobacterium tuberculosis
TATVDRRDT

SEQ ID NO: 1432506 - protein, 4 aa, Mycobacterium tuberculosis
TAVA

SEQ ID NO: 1432507 - protein, 5 aa, Mycobacterium tuberculosis
TAVRD

SEQ ID NO: 1432508 - protein, 8 aa, Mycobacterium tuberculosis
TAVRDGDD

SEQ ID NO: 1432509 - protein, 10 aa, Mycobacterium tuberculosis
TAVRTPSGYR

SEQ ID NO: 1432510 - protein, 7 aa, Mycobacterium tuberculosis
TDAEAAN

SEQ ID NO: 1432511 - protein, 5 aa, Mycobacterium tuberculosis
TDAET

SEQ ID NO: 1432512 - protein, 4 aa, Mycobacterium tuberculosis
TDAR

SEQ ID NO: 1432513 - protein, 8 aa, Mycobacterium tuberculosis
TDARPDLA

SEQ ID NO: 1432514 - protein, 10 aa, Mycobacterium tuberculosis
TDARRHTRAE

SEQ ID NO: 1432515 - protein, 8 aa, Mycobacterium tuberculosis
TDATQAAL

SEQ ID NO: 1432516 - protein, 8 aa, Mycobacterium tuberculosis
TDDGDRAT

SEQ ID NO: 1432517 - protein, 11 aa, Mycobacterium tuberculosis
TDDGLSGEEGT

SEQ ID NO: 1432518 - protein, 12 aa, Mycobacterium tuberculosis
TDEELAEHPGRR

SEQ ID NO: 1432519 - protein, 109 aa, Mycobacterium tuberculosis
TDEPVKRTATKSPAASASGAKTGAKRTAAKSASGSPPAKRATKPAARSVKPASAPQDTTTSTIPKRKTRAAAKSAAAKAPSARGHATKPRAPKDAQHEAATDPEDALDS

SEQ ID NO: 1432520 - protein, 28 aa, Mycobacterium tuberculosis
TDFAGSDVPLNPSTGQPDRSAERCGSPA

SEQ ID NO: 1432521 - protein, 4 aa, Mycobacterium tuberculosis
TDGE

SEQ ID NO: 1432522 - protein, 14 aa, Mycobacterium tuberculosis
TDGEPLDEDARPRQ

SEQ ID NO: 1432523 - protein, 9 aa, Mycobacterium tuberculosis
TDGPSAQAA

SEQ ID NO: 1432524 - protein, 9 aa, Mycobacterium tuberculosis
TDGVADGEA

SEQ ID NO: 1432525 - protein, 7 aa, Mycobacterium tuberculosis
TDHRPVT

SEQ ID NO: 1432526 - protein, 11 aa, Mycobacterium tuberculosis
TDIEGANAAGL

SEQ ID NO: 1432527 - protein, 12 aa, Mycobacterium tuberculosis
TDIRDGQTVAER

SEQ ID NO: 1432528 - protein, 8 aa, Mycobacterium tuberculosis
TDKRDLST

SEQ ID NO: 1432529 - protein, 6 aa, Mycobacterium tuberculosis
TDLRGP

SEQ ID NO: 1432530 - protein, 8 aa, Mycobacterium tuberculosis
TDNALPPL

SEQ ID NO: 1432531 - protein, 15 aa, Mycobacterium tuberculosis
TDNGEDQRSDSGEGV

SEQ ID NO: 1432532 - protein, 12 aa, Mycobacterium tuberculosis
TDPAGETPSVGA

SEQ ID NO: 1432533 - protein, 8 aa, Mycobacterium tuberculosis
TDPVASEK

SEQ ID NO: 1432534 - protein, 5 aa, Mycobacterium tuberculosis
TDRLR

SEQ ID NO: 1432535 - protein, 9 aa, Mycobacterium tuberculosis
TDRPGSSKY

SEQ ID NO: 1432536 - protein, 7 aa, Mycobacterium tuberculosis
TDRPTQV

SEQ ID NO: 1432537 - protein, 5 aa, Mycobacterium tuberculosis
TDRQI

SEQ ID NO: 1432538 - protein, 7 aa, Mycobacterium tuberculosis
TDSGRRA

SEQ ID NO: 1432539 - protein, 10 aa, Mycobacterium tuberculosis
TDSSPSSDAE

SEQ ID NO: 1432540 - protein, 4 aa, Mycobacterium tuberculosis
TDTG

SEQ ID NO: 1432541 - protein, 7 aa, Mycobacterium tuberculosis
TDTGESV

SEQ ID NO: 1432542 - protein, 5 aa, Mycobacterium tuberculosis
TDTLE

SEQ ID NO: 1432543 - protein, 5 aa, Mycobacterium tuberculosis
TDVAS

SEQ ID NO: 1432544 - protein, 9 aa, Mycobacterium tuberculosis
TEARPAALG

SEQ ID NO: 1432545 - protein, 5 aa, Mycobacterium tuberculosis
TEDDP

SEQ ID NO: 1432546 - protein, 6 aa, Mycobacterium tuberculosis
TEEGHT

SEQ ID NO: 1432547 - protein, 14 aa, Mycobacterium tuberculosis
TELDAESPQGRRLE

SEQ ID NO: 1432548 - protein, 5 aa, Mycobacterium tuberculosis
TELPA

SEQ ID NO: 1432549 - protein, 4 aa, Mycobacterium tuberculosis
TENE

SEQ ID NO: 1432550 - protein, 5 aa, Mycobacterium tuberculosis
TEPAA

SEQ ID NO: 1432551 - protein, 17 aa, Mycobacterium tuberculosis
TEPGSGVRAQRDDLSAS

SEQ ID NO: 1432552 - protein, 5 aa, Mycobacterium tuberculosis
TEPIP

SEQ ID NO: 1432553 - protein, 12 aa, Mycobacterium tuberculosis
TEPLSGHPPDGG

SEQ ID NO: 1432554 - protein, 9 aa, Mycobacterium tuberculosis
TEPPPTAGS

SEQ ID NO: 1432555 - protein, 5 aa, Mycobacterium tuberculosis
TEQQA

SEQ ID NO: 1432556 - protein, 5 aa, Mycobacterium tuberculosis
TEQRN

SEQ ID NO: 1432557 - protein, 6 aa, Mycobacterium tuberculosis
TERAPI

SEQ ID NO: 1432558 - protein, 13 aa, Mycobacterium tuberculosis
TERRPRPYGPRKT

SEQ ID NO: 1432559 - protein, 4 aa, Mycobacterium tuberculosis
TERV

SEQ ID NO: 1432560 - protein, 8 aa, Mycobacterium tuberculosis
TETAGHDR

SEQ ID NO: 1432561 - protein, 8 aa, Mycobacterium tuberculosis
TEVPTGEQ

SEQ ID NO: 1432562 - protein, 5 aa, Mycobacterium tuberculosis
TEVTA

SEQ ID NO: 1432563 - protein, 12 aa, Mycobacterium tuberculosis
TEYVSGPSARSY

SEQ ID NO: 1432564 - protein, 4 aa, Mycobacterium tuberculosis
TFGA

SEQ ID NO: 1432565 - protein, 11 aa, Mycobacterium tuberculosis
TFGGVESRNRQ

SEQ ID NO: 1432566 - protein, 9 aa, Mycobacterium tuberculosis
TFPGASKAV

SEQ ID NO: 1432567 - protein, 8 aa, Mycobacterium tuberculosis
TGADLSAA

SEQ ID NO: 1432568 - protein, 6 aa, Mycobacterium tuberculosis
TGAEEA

SEQ ID NO: 1432569 - protein, 13 aa, Mycobacterium tuberculosis
TGAGAPDPDSPEL

SEQ ID NO: 1432570 - protein, 16 aa, Mycobacterium tuberculosis
TGAGGASGFGNFGGAN

SEQ ID NO: 1432571 - protein, 7 aa, Mycobacterium tuberculosis
TGAPGYS

SEQ ID NO: 1432572 - protein, 4 aa, Mycobacterium tuberculosis
TGDD

SEQ ID NO: 1432573 - protein, 21 aa, Mycobacterium tuberculosis
TGDPLRDASGRVRRVPDGEPG

SEQ ID NO: 1432574 - protein, 7 aa, Mycobacterium tuberculosis
TGDYNTG

SEQ ID NO: 1432575 - protein, 11 aa, Mycobacterium tuberculosis
TGEQSEAARRS

SEQ ID NO: 1432576 - protein, 24 aa, Mycobacterium tuberculosis
TGGAGGAGGVGTAGAGGAGGAGGS

SEQ ID NO: 1432577 - protein, 7 aa, Mycobacterium tuberculosis
TGGHLGP

SEQ ID NO: 1432578 - protein, 4 aa, Mycobacterium tuberculosis
TGGI

SEQ ID NO: 1432579 - protein, 6 aa, Mycobacterium tuberculosis
TGGKPY

SEQ ID NO: 1432580 - protein, 25 aa, Mycobacterium tuberculosis
TGGNGGTGGIATGAGGIGGAGGAGG

SEQ ID NO: 1432581 - protein, 11 aa, Mycobacterium tuberculosis
TGGPGTGKTTT

SEQ ID NO: 1432582 - protein, 5 aa, Mycobacterium tuberculosis
TGGSM

SEQ ID NO: 1432583 - protein, 7 aa, Mycobacterium tuberculosis
TGHEGAE

SEQ ID NO: 1432584 - protein, 5 aa, Mycobacterium tuberculosis
TGKLA

SEQ ID NO: 1432585 - protein, 5 aa, Mycobacterium tuberculosis
TGLTD

SEQ ID NO: 1432586 - protein, 20 aa, Mycobacterium tuberculosis
TGMIGDPRDVGERSLNEADT

SEQ ID NO: 1432587 - protein, 18 aa, Mycobacterium tuberculosis
TGMTTGTPAAAGAQALSA

SEQ ID NO: 1432588 - protein, 12 aa, Mycobacterium tuberculosis
TGPAAPSWRKGP

SEQ ID NO: 1432589 - protein, 6 aa, Mycobacterium tuberculosis
TGPEAE

SEQ ID NO: 1432590 - protein, 11 aa, Mycobacterium tuberculosis
TGPGDVPPQNI

SEQ ID NO: 1432591 - protein, 6 aa, Mycobacterium tuberculosis
TGPGES

SEQ ID NO: 1432592 - protein, 4 aa, Mycobacterium tuberculosis
TGPI

SEQ ID NO: 1432593 - protein, 10 aa, Mycobacterium tuberculosis
TGPQRSTVKA

SEQ ID NO: 1432594 - protein, 4 aa, Mycobacterium tuberculosis
TGPY

SEQ ID NO: 1432595 - protein, 10 aa, Mycobacterium tuberculosis
TGQRHEPGTR

SEQ ID NO: 1432596 - protein, 17 aa, Mycobacterium tuberculosis
TGRDGASGVRRLTSEDR

SEQ ID NO: 1432597 - protein, 12 aa, Mycobacterium tuberculosis
TGRSGPGAGRTA

SEQ ID NO: 1432598 - protein, 9 aa, Mycobacterium tuberculosis
TGSDEDISR

SEQ ID NO: 1432599 - protein, 9 aa, Mycobacterium tuberculosis
TGSGAPTAN

SEQ ID NO: 1432600 - protein, 10 aa, Mycobacterium tuberculosis
TGSGKGGTKY

SEQ ID NO: 1432601 - protein, 12 aa, Mycobacterium tuberculosis
TGSITKIYLRAT

SEQ ID NO: 1432602 - protein, 8 aa, Mycobacterium tuberculosis
TGSPGCAH

SEQ ID NO: 1432603 - protein, 4 aa, Mycobacterium tuberculosis
TGSS

SEQ ID NO: 1432604 - protein, 19 aa, Mycobacterium tuberculosis
TGSVQAYDGREVAPAAATE

SEQ ID NO: 1432605 - protein, 5 aa, Mycobacterium tuberculosis
TGSYE

SEQ ID NO: 1432606 - protein, 18 aa, Mycobacterium tuberculosis
TGSYNTGLANSGDVNTGG

SEQ ID NO: 1432607 - protein, 22 aa, Mycobacterium tuberculosis
TGTAPSSEHKDAVKRAATSTWP

SEQ ID NO: 1432608 - protein, 8 aa, Mycobacterium tuberculosis
TGTGGASL

SEQ ID NO: 1432609 - protein, 4 aa, Mycobacterium tuberculosis
TGTS

SEQ ID NO: 1432610 - protein, 9 aa, Mycobacterium tuberculosis
TGTSAQLDT

SEQ ID NO: 1432611 - protein, 42 aa, Mycobacterium tuberculosis
TGTSGTTGTAGATAAGAARLADQPSAGPARATEAGGSAGTAV

SEQ ID NO: 1432612 - protein, 10 aa, Mycobacterium tuberculosis
TGWDADGGYA

SEQ ID NO: 1432613 - protein, 9 aa, Mycobacterium tuberculosis
THAEQGRLS

SEQ ID NO: 1432614 - protein, 17 aa, Mycobacterium tuberculosis
THGRPTDRNAHPHRDAA

SEQ ID NO: 1432615 - protein, 9 aa, Mycobacterium tuberculosis
THPGSGHTT

SEQ ID NO: 1432616 - protein, 6 aa, Mycobacterium tuberculosis
THPRTR

SEQ ID NO: 1432617 - protein, 12 aa, Mycobacterium tuberculosis
THVEQTAANCPQ

SEQ ID NO: 1432618 - protein, 11 aa, Mycobacterium tuberculosis
TIAGPASPAAN

SEQ ID NO: 1432619 - protein, 4 aa, Mycobacterium tuberculosis
TIDP

SEQ ID NO: 1432620 - protein, 4 aa, Mycobacterium tuberculosis
TIGR

SEQ ID NO: 1432621 - protein, 10 aa, Mycobacterium tuberculosis
TIRTGRANPG

SEQ ID NO: 1432622 - protein, 7 aa, Mycobacterium tuberculosis
TKASSED

SEQ ID NO: 1432623 - protein, 7 aa, Mycobacterium tuberculosis
TKAYDGL

SEQ ID NO: 1432624 - protein, 4 aa, Mycobacterium tuberculosis
TKDD

SEQ ID NO: 1432625 - protein, 5 aa, Mycobacterium tuberculosis
TKDKV

SEQ ID NO: 1432626 - protein, 7 aa, Mycobacterium tuberculosis
TKLADQV

SEQ ID NO: 1432627 - protein, 7 aa, Mycobacterium tuberculosis
TKLTGYT

SEQ ID NO: 1432628 - protein, 9 aa, Mycobacterium tuberculosis
TKPEDAAES

SEQ ID NO: 1432629 - protein, 9 aa, Mycobacterium tuberculosis
TKTTARGVQ

SEQ ID NO: 1432630 - protein, 5 aa, Mycobacterium tuberculosis
TLDGN

SEQ ID NO: 1432631 - protein, 9 aa, Mycobacterium tuberculosis
TLDRPGRPL

SEQ ID NO: 1432632 - protein, 10 aa, Mycobacterium tuberculosis
TLETAQAAGV

SEQ ID NO: 1432633 - protein, 7 aa, Mycobacterium tuberculosis
TLGPKGR

SEQ ID NO: 1432634 - protein, 6 aa, Mycobacterium tuberculosis
TLMNSG

SEQ ID NO: 1432635 - protein, 5 aa, Mycobacterium tuberculosis
TLPKS

SEQ ID NO: 1432636 - protein, 6 aa, Mycobacterium tuberculosis
TLPPGA

SEQ ID NO: 1432637 - protein, 7 aa, Mycobacterium tuberculosis
TLQGDAA

SEQ ID NO: 1432638 - protein, 20 aa, Mycobacterium tuberculosis
TLQRGQAALTGPVARGDAAA

SEQ ID NO: 1432639 - protein, 7 aa, Mycobacterium tuberculosis
TLQRPPT

SEQ ID NO: 1432640 - protein, 14 aa, Mycobacterium tuberculosis
TLQTGQSLTSITPK

SEQ ID NO: 1432641 - protein, 9 aa, Mycobacterium tuberculosis
TLRPEGTAG

SEQ ID NO: 1432642 - protein, 7 aa, Mycobacterium tuberculosis
TLRQGDR

SEQ ID NO: 1432643 - protein, 7 aa, Mycobacterium tuberculosis
TLSEETT

SEQ ID NO: 1432644 - protein, 5 aa, Mycobacterium tuberculosis
TLSTG

SEQ ID NO: 1432645 - protein, 13 aa, Mycobacterium tuberculosis
TLTGSEPAGQSVG

SEQ ID NO: 1432646 - protein, 4 aa, Mycobacterium tuberculosis
TLVP

SEQ ID NO: 1432647 - protein, 5 aa, Mycobacterium tuberculosis
TMRSD

SEQ ID NO: 1432648 - protein, 14 aa, Mycobacterium tuberculosis
TMSTSEADGVTGGV

SEQ ID NO: 1432649 - protein, 7 aa, Mycobacterium tuberculosis
TNAGKSS

SEQ ID NO: 1432650 - protein, 6 aa, Mycobacterium tuberculosis
TNAQRT

SEQ ID NO: 1432651 - protein, 6 aa, Mycobacterium tuberculosis
TNEARQ

SEQ ID NO: 1432652 - protein, 6 aa, Mycobacterium tuberculosis
TNEEGD

SEQ ID NO: 1432653 - protein, 4 aa, Mycobacterium tuberculosis
TNGY

SEQ ID NO: 1432654 - protein, 9 aa, Mycobacterium tuberculosis
TNMRSSTAD

SEQ ID NO: 1432655 - protein, 7 aa, Mycobacterium tuberculosis
TNPGQGV

SEQ ID NO: 1432656 - protein, 6 aa, Mycobacterium tuberculosis
TNPKGE

SEQ ID NO: 1432657 - protein, 4 aa, Mycobacterium tuberculosis
TNRT

SEQ ID NO: 1432658 - protein, 18 aa, Mycobacterium tuberculosis
TNTGFANSGNINTGGFNA

SEQ ID NO: 1432659 - protein, 10 aa, Mycobacterium tuberculosis
TPAIATTESQ

SEQ ID NO: 1432660 - protein, 10 aa, Mycobacterium tuberculosis
TPATDSAGRL

SEQ ID NO: 1432661 - protein, 9 aa, Mycobacterium tuberculosis
TPATPTATL

SEQ ID NO: 1432662 - protein, 5 aa, Mycobacterium tuberculosis
TPDDG

SEQ ID NO: 1432663 - protein, 8 aa, Mycobacterium tuberculosis
TPEPPERW

SEQ ID NO: 1432664 - protein, 6 aa, Mycobacterium tuberculosis
TPERAG

SEQ ID NO: 1432665 - protein, 8 aa, Mycobacterium tuberculosis
TPERRQRE

SEQ ID NO: 1432666 - protein, 11 aa, Mycobacterium tuberculosis
TPEVDAELSEK

SEQ ID NO: 1432667 - protein, 8 aa, Mycobacterium tuberculosis
TPEYPLGQ

SEQ ID NO: 1432668 - protein, 14 aa, Mycobacterium tuberculosis
TPGADGPADAAGLG

SEQ ID NO: 1432669 - protein, 17 aa, Mycobacterium tuberculosis
TPGGGGYGPASTSARRR

SEQ ID NO: 1432670 - protein, 7 aa, Mycobacterium tuberculosis
TPGQNNV

SEQ ID NO: 1432671 - protein, 4 aa, Mycobacterium tuberculosis
TPGY

SEQ ID NO: 1432672 - protein, 8 aa, Mycobacterium tuberculosis
TPHGKIDE

SEQ ID NO: 1432673 - protein, 16 aa, Mycobacterium tuberculosis
TPHSMKAADSKPARTV

SEQ ID NO: 1432674 - protein, 16 aa, Mycobacterium tuberculosis
TPLANPGNLDSRRRAA

SEQ ID NO: 1432675 - protein, 4 aa, Mycobacterium tuberculosis
TPLP

SEQ ID NO: 1432676 - protein, 5 aa, Mycobacterium tuberculosis
TPLSN

SEQ ID NO: 1432677 - protein, 6 aa, Mycobacterium tuberculosis
TPLTEG

SEQ ID NO: 1432678 - protein, 5 aa, Mycobacterium tuberculosis
TPMGA

SEQ ID NO: 1432679 - protein, 15 aa, Mycobacterium tuberculosis
TPPGTVKGIPQKPMD

SEQ ID NO: 1432680 - protein, 8 aa, Mycobacterium tuberculosis
TPQAREAV

SEQ ID NO: 1432681 - protein, 6 aa, Mycobacterium tuberculosis
TPQDVG

SEQ ID NO: 1432682 - protein, 4 aa, Mycobacterium tuberculosis
TPQG

SEQ ID NO: 1432683 - protein, 6 aa, Mycobacterium tuberculosis
TPQGTL

SEQ ID NO: 1432684 - protein, 8 aa, Mycobacterium tuberculosis
TPQKIGEY

SEQ ID NO: 1432685 - protein, 9 aa, Mycobacterium tuberculosis
TPQRAPGYE

SEQ ID NO: 1432686 - protein, 9 aa, Mycobacterium tuberculosis
TPQSRRELA

SEQ ID NO: 1432687 - protein, 5 aa, Mycobacterium tuberculosis
TPRGA

SEQ ID NO: 1432688 - protein, 5 aa, Mycobacterium tuberculosis
TPSGA

SEQ ID NO: 1432689 - protein, 8 aa, Mycobacterium tuberculosis
TPTADAAD

SEQ ID NO: 1432690 - protein, 5 aa, Mycobacterium tuberculosis
TPTDN

SEQ ID NO: 1432691 - protein, 8 aa, Mycobacterium tuberculosis
TPTPAPLH

SEQ ID NO: 1432692 - protein, 5 aa, Mycobacterium tuberculosis
TPVGN

SEQ ID NO: 1432693 - protein, 4 aa, Mycobacterium tuberculosis
TPVQ

SEQ ID NO: 1432694 - protein, 6 aa, Mycobacterium tuberculosis
TPVQTP

SEQ ID NO: 1432695 - protein, 5 aa, Mycobacterium tuberculosis
TQAAT

SEQ ID NO: 1432696 - protein, 12 aa, Mycobacterium tuberculosis
TQAPEEVDPDAT

SEQ ID NO: 1432697 - protein, 7 aa, Mycobacterium tuberculosis
TQEKAEL

SEQ ID NO: 1432698 - protein, 14 aa, Mycobacterium tuberculosis
TQETASGNIEKPRI

SEQ ID NO: 1432699 - protein, 7 aa, Mycobacterium tuberculosis
TQETNSI

SEQ ID NO: 1432700 - protein, 14 aa, Mycobacterium tuberculosis
TQNGRGELAATEHA

SEQ ID NO: 1432701 - protein, 7 aa, Mycobacterium tuberculosis
TQSVGDE

SEQ ID NO: 1432702 - protein, 10 aa, Mycobacterium tuberculosis
TQTPSRLTTP

SEQ ID NO: 1432703 - protein, 4 aa, Mycobacterium tuberculosis
TQTQ

SEQ ID NO: 1432704 - protein, 8 aa, Mycobacterium tuberculosis
TQTSLAAN

SEQ ID NO: 1432705 - protein, 10 aa, Mycobacterium tuberculosis
TQVGTKHDAT

SEQ ID NO: 1432706 - protein, 12 aa, Mycobacterium tuberculosis
TRDRRSQAQEEH

SEQ ID NO: 1432707 - protein, 6 aa, Mycobacterium tuberculosis
TREQAR

SEQ ID NO: 1432708 - protein, 5 aa, Mycobacterium tuberculosis
TRFNA

SEQ ID NO: 1432709 - protein, 5 aa, Mycobacterium tuberculosis
TRFQP

SEQ ID NO: 1432710 - protein, 8 aa, Mycobacterium tuberculosis
TRGTRPAL

SEQ ID NO: 1432711 - protein, 10 aa, Mycobacterium tuberculosis
TRMENPAGTV

SEQ ID NO: 1432712 - protein, 5 aa, Mycobacterium tuberculosis
TRPAL

SEQ ID NO: 1432713 - protein, 16 aa, Mycobacterium tuberculosis
TRPGVGYPRTYEDQER

SEQ ID NO: 1432714 - protein, 4 aa, Mycobacterium tuberculosis
TRQV

SEQ ID NO: 1432715 - protein, 4 aa, Mycobacterium tuberculosis
TRRE

SEQ ID NO: 1432716 - protein, 5 aa, Mycobacterium tuberculosis
TRSCE

SEQ ID NO: 1432717 - protein, 14 aa, Mycobacterium tuberculosis
TRSYRDAKSNTEVR

SEQ ID NO: 1432718 - protein, 7 aa, Mycobacterium tuberculosis
TRTAAPP

SEQ ID NO: 1432719 - protein, 21 aa, Mycobacterium tuberculosis
TRTPGGKGANQAVAAARAGAQ

SEQ ID NO: 1432720 - protein, 8 aa, Mycobacterium tuberculosis
TRVEQRTD

SEQ ID NO: 1432721 - protein, 8 aa, Mycobacterium tuberculosis
TSAAGRGG

SEQ ID NO: 1432722 - protein, 6 aa, Mycobacterium tuberculosis
TSAETI

SEQ ID NO: 1432723 - protein, 7 aa, Mycobacterium tuberculosis
TSAKGEQ

SEQ ID NO: 1432724 - protein, 8 aa, Mycobacterium tuberculosis
TSAPGPRH

SEQ ID NO: 1432725 - protein, 17 aa, Mycobacterium tuberculosis
TSASSYADTEAANAVVT

SEQ ID NO: 1432726 - protein, 8 aa, Mycobacterium tuberculosis
TSAVDSRR

SEQ ID NO: 1432727 - protein, 4 aa, Mycobacterium tuberculosis
TSCS

SEQ ID NO: 1432728 - protein, 14 aa, Mycobacterium tuberculosis
TSDVGRPKVESAAE

SEQ ID NO: 1432729 - protein, 6 aa, Mycobacterium tuberculosis
TSEGAE

SEQ ID NO: 1432730 - protein, 7 aa, Mycobacterium tuberculosis
TSFDTGA

SEQ ID NO: 1432731 - protein, 6 aa, Mycobacterium tuberculosis
TSGAIE

SEQ ID NO: 1432732 - protein, 8 aa, Mycobacterium tuberculosis
TSGDHRLD

SEQ ID NO: 1432733 - protein, 5 aa, Mycobacterium tuberculosis
TSGGV

SEQ ID NO: 1432734 - protein, 6 aa, Mycobacterium tuberculosis
TSGNTG

SEQ ID NO: 1432735 - protein, 5 aa, Mycobacterium tuberculosis
TSGTI

SEQ ID NO: 1432736 - protein, 8 aa, Mycobacterium tuberculosis
TSHGKHRT

SEQ ID NO: 1432737 - protein, 5 aa, Mycobacterium tuberculosis
TSIED

SEQ ID NO: 1432738 - protein, 9 aa, Mycobacterium tuberculosis
TSLRDGSHH

SEQ ID NO: 1432739 - protein, 15 aa, Mycobacterium tuberculosis
TSPGEVAGEGSPDPF

SEQ ID NO: 1432740 - protein, 6 aa, Mycobacterium tuberculosis
TSPRAH

SEQ ID NO: 1432741 - protein, 6 aa, Mycobacterium tuberculosis
TSPWPE

SEQ ID NO: 1432742 - protein, 8 aa, Mycobacterium tuberculosis
TSPWPTDD

SEQ ID NO: 1432743 - protein, 19 aa, Mycobacterium tuberculosis
TSRWPSGIKDGAEFVIPTM

SEQ ID NO: 1432744 - protein, 22 aa, Mycobacterium tuberculosis
TSSGAGLQGSVGQGNYSAAKAG

SEQ ID NO: 1432745 - protein, 4 aa, Mycobacterium tuberculosis
TSTA

SEQ ID NO: 1432746 - protein, 8 aa, Mycobacterium tuberculosis
TSTDGIAT

SEQ ID NO: 1432747 - protein, 8 aa, Mycobacterium tuberculosis
TSTMPGGY

SEQ ID NO: 1432748 - protein, 6 aa, Mycobacterium tuberculosis
TSTQSD

SEQ ID NO: 1432749 - protein, 11 aa, Mycobacterium tuberculosis
TSTRQSRKGAI

SEQ ID NO: 1432750 - protein, 9 aa, Mycobacterium tuberculosis
TSVAGRKGY

SEQ ID NO: 1432751 - protein, 4 aa, Mycobacterium tuberculosis
TTAG

SEQ ID NO: 1432752 - protein, 11 aa, Mycobacterium tuberculosis
TTAGDGSSAIA

SEQ ID NO: 1432753 - protein, 5 aa, Mycobacterium tuberculosis
TTAPA

SEQ ID NO: 1432754 - protein, 5 aa, Mycobacterium tuberculosis
TTASQ

SEQ ID NO: 1432755 - protein, 9 aa, Mycobacterium tuberculosis
TTATLNDGD

SEQ ID NO: 1432756 - protein, 10 aa, Mycobacterium tuberculosis
TTCQQRSVET

SEQ ID NO: 1432757 - protein, 12 aa, Mycobacterium tuberculosis
TTDAEAELRRGR

SEQ ID NO: 1432758 - protein, 7 aa, Mycobacterium tuberculosis
TTDNDAN

SEQ ID NO: 1432759 - protein, 8 aa, Mycobacterium tuberculosis
TTDPSSGF

SEQ ID NO: 1432760 - protein, 9 aa, Mycobacterium tuberculosis
TTDPTSLTE

SEQ ID NO: 1432761 - protein, 7 aa, Mycobacterium tuberculosis
TTDSGLT

SEQ ID NO: 1432762 - protein, 12 aa, Mycobacterium tuberculosis
TTEDDDIAAATE

SEQ ID NO: 1432763 - protein, 5 aa, Mycobacterium tuberculosis
TTEHR

SEQ ID NO: 1432764 - protein, 5 aa, Mycobacterium tuberculosis
TTEPR

SEQ ID NO: 1432765 - protein, 6 aa, Mycobacterium tuberculosis
TTFTKR

SEQ ID NO: 1432766 - protein, 4 aa, Mycobacterium tuberculosis
TTGA

SEQ ID NO: 1432767 - protein, 13 aa, Mycobacterium tuberculosis
TTGGGAYAAAEAA

SEQ ID NO: 1432768 - protein, 9 aa, Mycobacterium tuberculosis
TTGGPNGVG

SEQ ID NO: 1432769 - protein, 4 aa, Mycobacterium tuberculosis
TTGN

SEQ ID NO: 1432770 - protein, 8 aa, Mycobacterium tuberculosis
TTGPLGQG

SEQ ID NO: 1432771 - protein, 7 aa, Mycobacterium tuberculosis
TTGPSSG

SEQ ID NO: 1432772 - protein, 5 aa, Mycobacterium tuberculosis
TTGSG

SEQ ID NO: 1432773 - protein, 5 aa, Mycobacterium tuberculosis
TTIQA

SEQ ID NO: 1432774 - protein, 7 aa, Mycobacterium tuberculosis
TTLGRTG

SEQ ID NO: 1432775 - protein, 7 aa, Mycobacterium tuberculosis
TTNPPVE

SEQ ID NO: 1432776 - protein, 5 aa, Mycobacterium tuberculosis
TTPAD

SEQ ID NO: 1432777 - protein, 4 aa, Mycobacterium tuberculosis
TTQQ

SEQ ID NO: 1432778 - protein, 7 aa, Mycobacterium tuberculosis
TTRTADQ

SEQ ID NO: 1432779 - protein, 14 aa, Mycobacterium tuberculosis
TTSQAPRVDEGRAE

SEQ ID NO: 1432780 - protein, 12 aa, Mycobacterium tuberculosis
TTTEPKARALRP

SEQ ID NO: 1432781 - protein, 4 aa, Mycobacterium tuberculosis
TTTT

SEQ ID NO: 1432782 - protein, 9 aa, Mycobacterium tuberculosis
TTVTGEVPA

SEQ ID NO: 1432783 - protein, 10 aa, Mycobacterium tuberculosis
TTVTGEVPAD

SEQ ID NO: 1432784 - protein, 12 aa, Mycobacterium tuberculosis
TTWQRESAPVDV

SEQ ID NO: 1432785 - protein, 5 aa, Mycobacterium tuberculosis
TVAEH

SEQ ID NO: 1432786 - protein, 5 aa, Mycobacterium tuberculosis
TVAGA

SEQ ID NO: 1432787 - protein, 12 aa, Mycobacterium tuberculosis
TVASQTRAVGER

SEQ ID NO: 1432788 - protein, 6 aa, Mycobacterium tuberculosis
TVDDTT

SEQ ID NO: 1432789 - protein, 7 aa, Mycobacterium tuberculosis
TVESGSQ

SEQ ID NO: 1432790 - protein, 12 aa, Mycobacterium tuberculosis
TVGVTTSGTFSP

SEQ ID NO: 1432791 - protein, 10 aa, Mycobacterium tuberculosis
TVPGDTAAEH

SEQ ID NO: 1432792 - protein, 7 aa, Mycobacterium tuberculosis
TVSPGAT

SEQ ID NO: 1432793 - protein, 23 aa, Mycobacterium tuberculosis
TVTDRSTGGSRQQRAARLGQAQG

SEQ ID NO: 1432794 - protein, 6 aa, Mycobacterium tuberculosis
TVTGTS

SEQ ID NO: 1432795 - protein, 25 aa, Mycobacterium tuberculosis
TVTTATGEGYRHSSYRDVGQRAGQL

SEQ ID NO: 1432796 - protein, 25 aa, Mycobacterium tuberculosis
TWRDPSRSIQPNQLGQPHRGPASSP

SEQ ID NO: 1432797 - protein, 13 aa, Mycobacterium tuberculosis
TWRPETDLAKTSE

SEQ ID NO: 1432798 - protein, 5 aa, Mycobacterium tuberculosis
TWRTR

SEQ ID NO: 1432799 - protein, 10 aa, Mycobacterium tuberculosis
TYGQGGPAEQ

SEQ ID NO: 1432800 - protein, 10 aa, Mycobacterium tuberculosis
TYGQGRPAEQ

SEQ ID NO: 1432801 - protein, 11 aa, Mycobacterium tuberculosis
TYGTLSEGERK

SEQ ID NO: 1432802 - protein, 5 aa, Mycobacterium tuberculosis
TYGVP

SEQ ID NO: 1432803 - protein, 10 aa, Mycobacterium tuberculosis
TYPGPGGTIG

SEQ ID NO: 1432804 - protein, 9 aa, Mycobacterium tuberculosis
TYPSLDPQG

SEQ ID NO: 1432805 - protein, 7 aa, Mycobacterium tuberculosis
TYSDGRV

SEQ ID NO: 1432806 - protein, 6 aa, Mycobacterium tuberculosis
VAANGS

SEQ ID NO: 1432807 - protein, 6 aa, Mycobacterium tuberculosis
VADEIE

SEQ ID NO: 1432808 - protein, 8 aa, Mycobacterium tuberculosis
VADGDTVY

SEQ ID NO: 1432809 - protein, 20 aa, Mycobacterium tuberculosis
VAEAPKTAGLPGTEGQYRSD

SEQ ID NO: 1432810 - protein, 10 aa, Mycobacterium tuberculosis
VAEGNAKLSR

SEQ ID NO: 1432811 - protein, 8 aa, Mycobacterium tuberculosis
VAEGRSDA

SEQ ID NO: 1432812 - protein, 20 aa, Mycobacterium tuberculosis
VAEPEPNGQPDVEEVPDELT

SEQ ID NO: 1432813 - protein, 10 aa, Mycobacterium tuberculosis
VAEPGQSLAD

SEQ ID NO: 1432814 - protein, 7 aa, Mycobacterium tuberculosis
VAERAAT

SEQ ID NO: 1432815 - protein, 4 aa, Mycobacterium tuberculosis
VAGI

SEQ ID NO: 1432816 - protein, 12 aa, Mycobacterium tuberculosis
VAGRPAGPPIRL

SEQ ID NO: 1432817 - protein, 5 aa, Mycobacterium tuberculosis
VAPAE

SEQ ID NO: 1432818 - protein, 10 aa, Mycobacterium tuberculosis
VAPPPPTPIT

SEQ ID NO: 1432819 - protein, 10 aa, Mycobacterium tuberculosis
VAPPSRAGGA

SEQ ID NO: 1432820 - protein, 4 aa, Mycobacterium tuberculosis
VAPR

SEQ ID NO: 1432821 - protein, 19 aa, Mycobacterium tuberculosis
VAQPGRGQHRSGRHEGEAL

SEQ ID NO: 1432822 - protein, 7 aa, Mycobacterium tuberculosis
VARDAEG

SEQ ID NO: 1432823 - protein, 26 aa, Mycobacterium tuberculosis
VARPDTQDALNADRSAKLSRPVTGDE

SEQ ID NO: 1432824 - protein, 6 aa, Mycobacterium tuberculosis
VASATT

SEQ ID NO: 1432825 - protein, 13 aa, Mycobacterium tuberculosis
VASSLGKGLTASS

SEQ ID NO: 1432826 - protein, 9 aa, Mycobacterium tuberculosis
VATEAGITP

SEQ ID NO: 1432827 - protein, 16 aa, Mycobacterium tuberculosis
VDAKGRSRNVSDGYRR

SEQ ID NO: 1432828 - protein, 8 aa, Mycobacterium tuberculosis
VDATGRFA

SEQ ID NO: 1432829 - protein, 6 aa, Mycobacterium tuberculosis
VDDPGI

SEQ ID NO: 1432830 - protein, 7 aa, Mycobacterium tuberculosis
VDDPHID

SEQ ID NO: 1432831 - protein, 5 aa, Mycobacterium tuberculosis
VDDQV

SEQ ID NO: 1432832 - protein, 12 aa, Mycobacterium tuberculosis
VDESESAESFEL

SEQ ID NO: 1432833 - protein, 12 aa, Mycobacterium tuberculosis
VDGEGGDQVPLG

SEQ ID NO: 1432834 - protein, 7 aa, Mycobacterium tuberculosis
VDGHDER

SEQ ID NO: 1432835 - protein, 5 aa, Mycobacterium tuberculosis
VDGQP

SEQ ID NO: 1432836 - protein, 7 aa, Mycobacterium tuberculosis
VDGRTYA

SEQ ID NO: 1432837 - protein, 6 aa, Mycobacterium tuberculosis
VDHDPA

SEQ ID NO: 1432838 - protein, 7 aa, Mycobacterium tuberculosis
VDHETGR

SEQ ID NO: 1432839 - protein, 4 aa, Mycobacterium tuberculosis
VDLG

SEQ ID NO: 1432840 - protein, 4 aa, Mycobacterium tuberculosis
VDND

SEQ ID NO: 1432841 - protein, 7 aa, Mycobacterium tuberculosis
VDNDETV

SEQ ID NO: 1432842 - protein, 5 aa, Mycobacterium tuberculosis
VDNDP

SEQ ID NO: 1432843 - protein, 10 aa, Mycobacterium tuberculosis
VDNPPGTGKI

SEQ ID NO: 1432844 - protein, 12 aa, Mycobacterium tuberculosis
VDPAALQATRDS

SEQ ID NO: 1432845 - protein, 6 aa, Mycobacterium tuberculosis
VDPDDI

SEQ ID NO: 1432846 - protein, 9 aa, Mycobacterium tuberculosis
VDPDSTPPM

SEQ ID NO: 1432847 - protein, 6 aa, Mycobacterium tuberculosis
VDPNAD

SEQ ID NO: 1432848 - protein, 10 aa, Mycobacterium tuberculosis
VDPRAAARAR

SEQ ID NO: 1432849 - protein, 6 aa, Mycobacterium tuberculosis
VDQPGT

SEQ ID NO: 1432850 - protein, 10 aa, Mycobacterium tuberculosis
VDQPPQTTRA

SEQ ID NO: 1432851 - protein, 15 aa, Mycobacterium tuberculosis
VDRKDYNSFGSRRGN

SEQ ID NO: 1432852 - protein, 4 aa, Mycobacterium tuberculosis
VDSN

SEQ ID NO: 1432853 - protein, 4 aa, Mycobacterium tuberculosis
VDSP

SEQ ID NO: 1432854 - protein, 4 aa, Mycobacterium tuberculosis
VDSS

SEQ ID NO: 1432855 - protein, 11 aa, Mycobacterium tuberculosis
VDTDGLADTEH

SEQ ID NO: 1432856 - protein, 5 aa, Mycobacterium tuberculosis
VDVPE

SEQ ID NO: 1432857 - protein, 4 aa, Mycobacterium tuberculosis
VEGQ

SEQ ID NO: 1432858 - protein, 4 aa, Mycobacterium tuberculosis
VEKL

SEQ ID NO: 1432859 - protein, 11 aa, Mycobacterium tuberculosis
VELGSRNERPM

SEQ ID NO: 1432860 - protein, 11 aa, Mycobacterium tuberculosis
VELTSSTEERV

SEQ ID NO: 1432861 - protein, 11 aa, Mycobacterium tuberculosis
VEQGDSEEVFG

SEQ ID NO: 1432862 - protein, 4 aa, Mycobacterium tuberculosis
VERQ

SEQ ID NO: 1432863 - protein, 20 aa, Mycobacterium tuberculosis
VERRSRRSSRCGDRRPLDGA

SEQ ID NO: 1432864 - protein, 5 aa, Mycobacterium tuberculosis
VESAG

SEQ ID NO: 1432865 - protein, 13 aa, Mycobacterium tuberculosis
VETEISGSGNGPL

SEQ ID NO: 1432866 - protein, 4 aa, Mycobacterium tuberculosis
VGAA

SEQ ID NO: 1432867 - protein, 5 aa, Mycobacterium tuberculosis
VGAAG

SEQ ID NO: 1432868 - protein, 7 aa, Mycobacterium tuberculosis
VGADGSV

SEQ ID NO: 1432869 - protein, 21 aa, Mycobacterium tuberculosis
VGAGNVGSYNVGGGNIGGNNV

SEQ ID NO: 1432870 - protein, 7 aa, Mycobacterium tuberculosis
VGAGQRR

SEQ ID NO: 1432871 - protein, 6 aa, Mycobacterium tuberculosis
VGAGTG

SEQ ID NO: 1432872 - protein, 4 aa, Mycobacterium tuberculosis
VGAN

SEQ ID NO: 1432873 - protein, 20 aa, Mycobacterium tuberculosis
VGASEPDAKAPEEPPAEAPE

SEQ ID NO: 1432874 - protein, 11 aa, Mycobacterium tuberculosis
VGDDPAAVAAN

SEQ ID NO: 1432875 - protein, 8 aa, Mycobacterium tuberculosis
VGDEPELT

SEQ ID NO: 1432876 - protein, 11 aa, Mycobacterium tuberculosis
VGEGNVGNGNV

SEQ ID NO: 1432877 - protein, 12 aa, Mycobacterium tuberculosis
VGESREQEASAK

SEQ ID NO: 1432878 - protein, 26 aa, Mycobacterium tuberculosis
VGGAGAAGGDATSGTGGFGGAGGSAR

SEQ ID NO: 1432879 - protein, 22 aa, Mycobacterium tuberculosis
VGGAGGAGGAATETGGIGGAGG

SEQ ID NO: 1432880 - protein, 41 aa, Mycobacterium tuberculosis; identical to SEQ ID NO: 193464

SEQ ID NO: 1432881 - protein, 7 aa, Mycobacterium tuberculosis
VGGEPRR

SEQ ID NO: 1432882 - protein, 8 aa, Mycobacterium tuberculosis
VGGMGGTG

SEQ ID NO: 1432883 - protein, 21 aa, Mycobacterium tuberculosis
VGGQPAISTSTGTTSPTAPTT

SEQ ID NO: 1432884 - protein, 34 aa, Mycobacterium tuberculosis; identical to SEQ ID NO: 190877

SEQ ID NO: 1432885 - protein, 7 aa, Mycobacterium tuberculosis
VGGVGGD

SEQ ID NO: 1432886 - protein, 11 aa, Mycobacterium tuberculosis
VGKAPDSIDES

SEQ ID NO: 1432887 - protein, 9 aa, Mycobacterium tuberculosis
VGKAPNIAA

SEQ ID NO: 1432888 - protein, 4 aa, Mycobacterium tuberculosis
VGLP

SEQ ID NO: 1432889 - protein, 11 aa, Mycobacterium tuberculosis
VGNIGNDNIGN

SEQ ID NO: 1432890 - protein, 6 aa, Mycobacterium tuberculosis
VGPASL

SEQ ID NO: 1432891 - protein, 4 aa, Mycobacterium tuberculosis
VGPR

SEQ ID NO: 1432892 - protein, 7 aa, Mycobacterium tuberculosis
VGPRQPG

SEQ ID NO: 1432893 - protein, 7 aa, Mycobacterium tuberculosis
VGQPGNR

SEQ ID NO: 1432894 - protein, 9 aa, Mycobacterium tuberculosis
VGRGRPAKR

SEQ ID NO: 1432895 - protein, 5 aa, Mycobacterium tuberculosis
VGRID

SEQ ID NO: 1432896 - protein, 11 aa, Mycobacterium tuberculosis
VGRNPATIERS

SEQ ID NO: 1432897 - protein, 23 aa, Mycobacterium tuberculosis
VGRQSPRPATMDGAGFEAPCMPY

SEQ ID NO: 1432898 - protein, 5 aa, Mycobacterium tuberculosis
VGRRK

SEQ ID NO: 1432899 - protein, 7 aa, Mycobacterium tuberculosis
VGSEEAD

SEQ ID NO: 1432900 - protein, 16 aa, Mycobacterium tuberculosis
VGSGNVGHGNIGDSNV

SEQ ID NO: 1432901 - protein, 12 aa, Mycobacterium tuberculosis
VGSGPVGSIPTP

SEQ ID NO: 1432902 - protein, 6 aa, Mycobacterium tuberculosis
VGSSAA

SEQ ID NO: 1432903 - protein, 7 aa, Mycobacterium tuberculosis
VGSSNTV

SEQ ID NO: 1432904 - protein, 103 aa, Mycobacterium tuberculosis
VGSTGGLGGNGGSGGLGGGGGSLFGNGGAGGVGATGGNGGSGIGPASVGGNGGKGGVGAAGGLAGQIGNGGSGGSGGAGGNGGTGDTAGNGGNGGAGAVGGNA

SEQ ID NO: 1432905 - protein, 4 aa, Mycobacterium tuberculosis
VGTD

SEQ ID NO: 1432906 - protein, 6 aa, Mycobacterium tuberculosis
VGTEQR

SEQ ID NO: 1432907 - protein, 9 aa, Mycobacterium tuberculosis
VGTGGDGVN

SEQ ID NO: 1432908 - protein, 4 aa, Mycobacterium tuberculosis
VGVD

SEQ ID NO: 1432909 - protein, 5 aa, Mycobacterium tuberculosis
VGYTP

SEQ ID NO: 1432910 - protein, 7 aa, Mycobacterium tuberculosis
VHGGREN

SEQ ID NO: 1432911 - protein, 10 aa, Mycobacterium tuberculosis
VHTSPREVAG

SEQ ID NO: 1432912 - protein, 6 aa, Mycobacterium tuberculosis
VITEEE

SEQ ID NO: 1432913 - protein, 6 aa, Mycobacterium tuberculosis
VKPTVS

SEQ ID NO: 1432914 - protein, 12 aa, Mycobacterium tuberculosis
VKQRKGSVQAPK

SEQ ID NO: 1432915 - protein, 5 aa, Mycobacterium tuberculosis
VKRAE

SEQ ID NO: 1432916 - protein, 5 aa, Mycobacterium tuberculosis
VKRPE

SEQ ID NO: 1432917 - protein, 10 aa, Mycobacterium tuberculosis
VLGPGTSPLG

SEQ ID NO: 1432918 - protein, 8 aa, Mycobacterium tuberculosis
VLSGTTSD

SEQ ID NO: 1432919 - protein, 6 aa, Mycobacterium tuberculosis
VNAEQQ

SEQ ID NO: 1432920 - protein, 13 aa, Mycobacterium tuberculosis
VNEGFSGGEKKRH

SEQ ID NO: 1432921 - protein, 6 aa, Mycobacterium tuberculosis
VNEGQG

SEQ ID NO: 1432922 - protein, 33 aa, Mycobacterium tuberculosis; identical to SEQ ID NO: 191027

SEQ ID NO: 1432923 - protein, 7 aa, Mycobacterium tuberculosis
VNKNGMP

SEQ ID NO: 1432924 - protein, 5 aa, Mycobacterium tuberculosis
VNPDP

SEQ ID NO: 1432925 - protein, 9 aa, Mycobacterium tuberculosis
VNRDGQPEK

SEQ ID NO: 1432926 - protein, 8 aa, Mycobacterium tuberculosis
VNRTPEEG

SEQ ID NO: 1432927 - protein, 4 aa, Mycobacterium tuberculosis
VNSN

SEQ ID NO: 1432928 - protein, 4 aa, Mycobacterium tuberculosis
VPAT

SEQ ID NO: 1432929 - protein, 4 aa, Mycobacterium tuberculosis
VPDE

SEQ ID NO: 1432930 - protein, 5 aa, Mycobacterium tuberculosis
VPDGG

SEQ ID NO: 1432931 - protein, 6 aa, Mycobacterium tuberculosis
VPDPAA

SEQ ID NO: 1432932 - protein, 10 aa, Mycobacterium tuberculosis
VPDPGGAAFY

SEQ ID NO: 1432933 - protein, 5 aa, Mycobacterium tuberculosis
VPDPQ

SEQ ID NO: 1432934 - protein, 5 aa, Mycobacterium tuberculosis
VPDST

SEQ ID NO: 1432935 - protein, 4 aa, Mycobacterium tuberculosis
VPEQ

SEQ ID NO: 1432936 - protein, 4 aa, Mycobacterium tuberculosis
VPER

SEQ ID NO: 1432937 - protein, 20 aa, Mycobacterium tuberculosis
VPFPDSATGARGRQGSPARV

SEQ ID NO: 1432938 - protein, 4 aa, Mycobacterium tuberculosis
VPGA

SEQ ID NO: 1432939 - protein, 7 aa, Mycobacterium tuberculosis
VPGATAP

SEQ ID NO: 1432940 - protein, 5 aa, Mycobacterium tuberculosis
VPGGA

SEQ ID NO: 1432941 - protein, 11 aa, Mycobacterium tuberculosis
VPGGNGVTPID

SEQ ID NO: 1432942 - protein, 6 aa, Mycobacterium tuberculosis
VPGPGL

SEQ ID NO: 1432943 - protein, 4 aa, Mycobacterium tuberculosis
VPIN

SEQ ID NO: 1432944 - protein, 5 aa, Mycobacterium tuberculosis
VPLDD

SEQ ID NO: 1432945 - protein, 24 aa, Mycobacterium tuberculosis
VPLGSGGDAAGKVEGGRTPQPFVQ

SEQ ID NO: 1432946 - protein, 21 aa, Mycobacterium tuberculosis
VPPGDMPGGTAAADAAHTEDK

SEQ ID NO: 1432947 - protein, 4 aa, Mycobacterium tuberculosis
VPPP

SEQ ID NO: 1432948 - protein, 16 aa, Mycobacterium tuberculosis
VPPSAPTTKPTDGKPV

SEQ ID NO: 1432949 - protein, 6 aa, Mycobacterium tuberculosis
VPQPET

SEQ ID NO: 1432950 - protein, 9 aa, Mycobacterium tuberculosis
VPSGEQSSL

SEQ ID NO: 1432951 - protein, 9 aa, Mycobacterium tuberculosis
VPSPPAEIA

SEQ ID NO: 1432952 - protein, 8 aa, Mycobacterium tuberculosis
VPSPQTRD

SEQ ID NO: 1432953 - protein, 5 aa, Mycobacterium tuberculosis
VPTGD

SEQ ID NO: 1432954 - protein, 4 aa, Mycobacterium tuberculosis
VPTP

SEQ ID NO: 1432955 - protein, 5 aa, Mycobacterium tuberculosis
VPTTG

SEQ ID NO: 1432956 - protein, 28 aa, Mycobacterium tuberculosis
VQKRSSYKESPGGRKEALRRSRATGTIT

SEQ ID NO: 1432957 - protein, 33 aa, Mycobacterium tuberculosis; identical to SEQ ID NO: 191228

SEQ ID NO: 1432958 - protein, 14 aa, Mycobacterium tuberculosis
VQSPGAERLDDRRY

SEQ ID NO: 1432959 - protein, 7 aa, Mycobacterium tuberculosis
VQTATEE

SEQ ID NO: 1432960 - protein, 5 aa, Mycobacterium tuberculosis
VQTES

SEQ ID NO: 1432961 - protein, 7 aa, Mycobacterium tuberculosis
VQTNARL

SEQ ID NO: 1432962 - protein, 9 aa, Mycobacterium tuberculosis
VQTNARLQD

SEQ ID NO: 1432963 - protein, 6 aa, Mycobacterium tuberculosis
VQWGPG

SEQ ID NO: 1432964 - protein, 5 aa, Mycobacterium tuberculosis
VRATS

SEQ ID NO: 1432965 - protein, 13 aa, Mycobacterium tuberculosis
VRDYDPTQKRPSI

SEQ ID NO: 1432966 - protein, 14 aa, Mycobacterium tuberculosis
VREPSTPGSGIPKS

SEQ ID NO: 1432967 - protein, 14 aa, Mycobacterium tuberculosis
VRGDGGVLKNSENS

SEQ ID NO: 1432968 - protein, 4 aa, Mycobacterium tuberculosis
VRGR

SEQ ID NO: 1432969 - protein, 13 aa, Mycobacterium tuberculosis
VRGRGAESAAPLG

SEQ ID NO: 1432970 - protein, 4 aa, Mycobacterium tuberculosis
VRKA

SEQ ID NO: 1432971 - protein, 10 aa, Mycobacterium tuberculosis
VRKAGRQTKG

SEQ ID NO: 1432972 - protein, 5 aa, Mycobacterium tuberculosis
VRPEE

SEQ ID NO: 1432973 - protein, 7 aa, Mycobacterium tuberculosis
VRPETAA

SEQ ID NO: 1432974 - protein, 7 aa, Mycobacterium tuberculosis
VRPGKGE

SEQ ID NO: 1432975 - protein, 14 aa, Mycobacterium tuberculosis
VRPHEPAYDPEPDS

SEQ ID NO: 1432976 - protein, 6 aa, Mycobacterium tuberculosis
VRPPEE

SEQ ID NO: 1432977 - protein, 11 aa, Mycobacterium tuberculosis
VRSDGSSMQKK

SEQ ID NO: 1432978 - protein, 8 aa, Mycobacterium tuberculosis
VRSDQPGH

SEQ ID NO: 1432979 - protein, 15 aa, Mycobacterium tuberculosis
VRSGEPTARLTGPPG

SEQ ID NO: 1432980 - protein, 12 aa, Mycobacterium tuberculosis
VRTDSSLDSNLH

SEQ ID NO: 1432981 - protein, 8 aa, Mycobacterium tuberculosis
VRTGDRRM

SEQ ID NO: 1432982 - protein, 7 aa, Mycobacterium tuberculosis
VRTPTTT

SEQ ID NO: 1432983 - protein, 11 aa, Mycobacterium tuberculosis
VRVTSKKRDDL

SEQ ID NO: 1432984 - protein, 7 aa, Mycobacterium tuberculosis
VSAAGTA

SEQ ID NO: 1432985 - protein, 11 aa, Mycobacterium tuberculosis
VSAGGGLGGVG

SEQ ID NO: 1432986 - protein, 10 aa, Mycobacterium tuberculosis
VSAGSRESME

SEQ ID NO: 1432987 - protein, 22 aa, Mycobacterium tuberculosis
VSAGYGNNGDVQSGINNTNSGG

SEQ ID NO: 1432988 - protein, 5 aa, Mycobacterium tuberculosis
VSAQS

SEQ ID NO: 1432989 - protein, 7 aa, Mycobacterium tuberculosis
VSASAQT

SEQ ID NO: 1432990 - protein, 17 aa, Mycobacterium tuberculosis
VSATTTDGLGLTGRGEG

SEQ ID NO: 1432991 - protein, 7 aa, Mycobacterium tuberculosis
VSCAPRD

SEQ ID NO: 1432992 - protein, 6 aa, Mycobacterium tuberculosis
VSDTKR

SEQ ID NO: 1432993 - protein, 19 aa, Mycobacterium tuberculosis
VSEAGGFHDPELESSREQL

SEQ ID NO: 1432994 - protein, 14 aa, Mycobacterium tuberculosis
VSESDTVAHPDPST

SEQ ID NO: 1432995 - protein, 11 aa, Mycobacterium tuberculosis
VSGADIDAPQI

SEQ ID NO: 1432996 - protein, 6 aa, Mycobacterium tuberculosis
VSGAGG

SEQ ID NO: 1432997 - protein, 8 aa, Mycobacterium tuberculosis
VSGLRGSE

SEQ ID NO: 1432998 - protein, 4 aa, Mycobacterium tuberculosis
VSGV

SEQ ID NO: 1432999 - protein, 11 aa, Mycobacterium tuberculosis
VSNQHTASRRR

SEQ ID NO: 1433000 - protein, 43 aa, Mycobacterium tuberculosis
VSPPVGDPGDATGATDATDLPEAGDLPYEPPAPNGHPNGDAPL

SEQ ID NO: 1433001 - protein, 9 aa, Mycobacterium tuberculosis
VSRDNTGDV

SEQ ID NO: 1433002 - protein, 8 aa, Mycobacterium tuberculosis
VSRERAAE

SEQ ID NO: 1433003 - protein, 8 aa, Mycobacterium tuberculosis
VSRYGGGE

SEQ ID NO: 1433004 - protein, 8 aa, Mycobacterium tuberculosis
VSSAQARI

SEQ ID NO: 1433005 - protein, 10 aa, Mycobacterium tuberculosis
VSSAQARIAA

SEQ ID NO: 1433006 - protein, 6 aa, Mycobacterium tuberculosis
VSYPTD

SEQ ID NO: 1433007 - protein, 9 aa, Mycobacterium tuberculosis
VSYTSEGRL

SEQ ID NO: 1433008 - protein, 6 aa, Mycobacterium tuberculosis
VTASYN

SEQ ID NO: 1433009 - protein, 22 aa, Mycobacterium tuberculosis
VTDTRTSRTFAEQAARQAQAQA

SEQ ID NO: 1433010 - protein, 5 aa, Mycobacterium tuberculosis
VTDTT

SEQ ID NO: 1433011 - protein, 9 aa, Mycobacterium tuberculosis
VTEVDPKDR

SEQ ID NO: 1433012 - protein, 6 aa, Mycobacterium tuberculosis
VTGEDV

SEQ ID NO: 1433013 - protein, 5 aa, Mycobacterium tuberculosis
VTGLK

SEQ ID NO: 1433014 - protein, 8 aa, Mycobacterium tuberculosis
VTGPDGPV

SEQ ID NO: 1433015 - protein, 5 aa, Mycobacterium tuberculosis
VTGTD

SEQ ID NO: 1433016 - protein, 8 aa, Mycobacterium tuberculosis
VTKQAAQK

SEQ ID NO: 1433017 - protein, 6 aa, Mycobacterium tuberculosis
VTKSGL

SEQ ID NO: 1433018 - protein, 6 aa, Mycobacterium tuberculosis
VTLTPG

SEQ ID NO: 1433019 - protein, 5 aa, Mycobacterium tuberculosis
VTPIP

SEQ ID NO: 1433020 - protein, 12 aa, Mycobacterium tuberculosis
VTPKGETELTPE

SEQ ID NO: 1433021 - protein, 6 aa, Mycobacterium tuberculosis
VTPKYP

SEQ ID NO: 1433022 - protein, 5 aa, Mycobacterium tuberculosis
VTPRT

SEQ ID NO: 1433023 - protein, 9 aa, Mycobacterium tuberculosis
VTPVDSKGR

SEQ ID NO: 1433024 - protein, 9 aa, Mycobacterium tuberculosis
VVDEGGRRV

SEQ ID NO: 1433025 - protein, 5 aa, Mycobacterium tuberculosis
VVTDR

SEQ ID NO: 1433026 - protein, 9 aa, Mycobacterium tuberculosis
WAAGAQRGQ

SEQ ID NO: 1433027 - protein, 13 aa, Mycobacterium tuberculosis
WARRGDPAPGGIG

SEQ ID NO: 1433028 - protein, 4 aa, Mycobacterium tuberculosis
WDLS

SEQ ID NO: 1433029 - protein, 6 aa, Mycobacterium tuberculosis
WERSGW

SEQ ID NO: 1433030 - protein, 7 aa, Mycobacterium tuberculosis
WGGTRNG

SEQ ID NO: 1433031 - protein, 10 aa, Mycobacterium tuberculosis
WGPLSAPKLE

SEQ ID NO: 1433032 - protein, 14 aa, Mycobacterium tuberculosis
WKPDQYANPEGPAS

SEQ ID NO: 1433033 - protein, 17 aa, Mycobacterium tuberculosis
WKQDPPSPMPGDPKDMT

SEQ ID NO: 1433034 - protein, 16 aa, Mycobacterium tuberculosis
WNSGSGNSGLFNSGTN

SEQ ID NO: 1433035 - protein, 10 aa, Mycobacterium tuberculosis
WNSGTGNSGL

SEQ ID NO: 1433036 - protein, 11 aa, Mycobacterium tuberculosis
WPDHSRDQARR

SEQ ID NO: 1433037 - protein, 13 aa, Mycobacterium tuberculosis
WPDRPRRRLTTPA

SEQ ID NO: 1433038 - protein, 4 aa, Mycobacterium tuberculosis
WPPE

SEQ ID NO: 1433039 - protein, 4 aa, Mycobacterium tuberculosis
WPTP

SEQ ID NO: 1433040 - protein, 15 aa, Mycobacterium tuberculosis
WQGASSSAMAAAAAP

SEQ ID NO: 1433041 - protein, 15 aa, Mycobacterium tuberculosis
WQGEAQPLSDAGPTG

SEQ ID NO: 1433042 - protein, 4 aa, Mycobacterium tuberculosis
WQST

SEQ ID NO: 1433043 - protein, 16 aa, Mycobacterium tuberculosis
WRESAAERGDVNPVGG

SEQ ID NO: 1433044 - protein, 4 aa, Mycobacterium tuberculosis
WSDP

SEQ ID NO: 1433045 - protein, 4 aa, Mycobacterium tuberculosis
WSDS

SEQ ID NO: 1433046 - protein, 10 aa, Mycobacterium tuberculosis
WSGKRNPNAR

SEQ ID NO: 1433047 - protein, 8 aa, Mycobacterium tuberculosis
WSPATQHT

SEQ ID NO: 1433048 - protein, 17 aa, Mycobacterium tuberculosis
WSTGSSIMPQKKNPDIA

SEQ ID NO: 1433049 - protein, 4 aa, Mycobacterium tuberculosis
WSTQ

SEQ ID NO: 1433050 - protein, 14 aa, Mycobacterium tuberculosis
WTDPAQRARDIERS

SEQ ID NO: 1433051 - protein, 12 aa, Mycobacterium tuberculosis
WTETRTGSYGQS

SEQ ID NO: 1433052 - protein, 14 aa, Mycobacterium tuberculosis
WTGNSTLEDCDTTS

SEQ ID NO: 1433053 - protein, 5 aa, Mycobacterium tuberculosis
WTTDV

SEQ ID NO: 1433054 - protein, 13 aa, Mycobacterium tuberculosis
YAAATSQTKGLIF

SEQ ID NO: 1433055 - protein, 16 aa, Mycobacterium tuberculosis
YAEADPTADVEGYDAA

SEQ ID NO: 1433056 - protein, 7 aa, Mycobacterium tuberculosis
YAEEAGI

SEQ ID NO: 1433057 - protein, 16 aa, Mycobacterium tuberculosis
YAEGSSSTGGGGAYQG

SEQ ID NO: 1433058 - protein, 27 aa, Mycobacterium tuberculosis
YAESGGQIADEGTISGTGSSEAARAAV

SEQ ID NO: 1433059 - protein, 9 aa, Mycobacterium tuberculosis
YAETEEEAD

SEQ ID NO: 1433060 - protein, 5 aa, Mycobacterium tuberculosis
YAGGM

SEQ ID NO: 1433061 - protein, 6 aa, Mycobacterium tuberculosis
YAGTRQ

SEQ ID NO: 1433062 - protein, 5 aa, Mycobacterium tuberculosis
YAPAR

SEQ ID NO: 1433063 - protein, 11 aa, Mycobacterium tuberculosis
YASSADGRRRR

SEQ ID NO: 1433064 - protein, 6 aa, Mycobacterium tuberculosis
YASTTA

SEQ ID NO: 1433065 - protein, 4 aa, Mycobacterium tuberculosis
YATD

SEQ ID NO: 1433066 - protein, 6 aa, Mycobacterium tuberculosis
YDAASE

SEQ ID NO: 1433067 - protein, 5 aa, Mycobacterium tuberculosis
YDATL

SEQ ID NO: 1433068 - protein, 14 aa, Mycobacterium tuberculosis
YDGDVQSDTVAQGY

SEQ ID NO: 1433069 - protein, 9 aa, Mycobacterium tuberculosis
YDGTPGTIA

SEQ ID NO: 1433070 - protein, 11 aa, Mycobacterium tuberculosis
YDKPSHTQSAA

SEQ ID NO: 1433071 - protein, 6 aa, Mycobacterium tuberculosis
YDPDNT

SEQ ID NO: 1433072 - protein, 11 aa, Mycobacterium tuberculosis
YDPEPGVPGRT

SEQ ID NO: 1433073 - protein, 4 aa, Mycobacterium tuberculosis
YDTS

SEQ ID NO: 1433074 - protein, 18 aa, Mycobacterium tuberculosis
YEAAQKARESRRNQQQTV

SEQ ID NO: 1433075 - protein, 6 aa, Mycobacterium tuberculosis
YEETSS

SEQ ID NO: 1433076 - protein, 11 aa, Mycobacterium tuberculosis
YEPDSEGNRQR

SEQ ID NO: 1433077 - protein, 4 aa, Mycobacterium tuberculosis
YERA

SEQ ID NO: 1433078 - protein, 12 aa, Mycobacterium tuberculosis
YETGAGGSAPKH

SEQ ID NO: 1433079 - protein, 24 aa, Mycobacterium tuberculosis
YFGTGGGGGVGGDGAPGGDGGAGP

SEQ ID NO: 1433080 - protein, 10 aa, Mycobacterium tuberculosis
YGGHDAGAPK

SEQ ID NO: 1433081 - protein, 9 aa, Mycobacterium tuberculosis
YGGQLSGEL

SEQ ID NO: 1433082 - protein, 7 aa, Mycobacterium tuberculosis
YGPERNI

SEQ ID NO: 1433083 - protein, 4 aa, Mycobacterium tuberculosis
YGQD

SEQ ID NO: 1433084 - protein, 9 aa, Mycobacterium tuberculosis
YGSPDPSSV

SEQ ID NO: 1433085 - protein, 9 aa, Mycobacterium tuberculosis
YGSSTSSSG

SEQ ID NO: 1433086 - protein, 4 aa, Mycobacterium tuberculosis
YGTA

SEQ ID NO: 1433087 - protein, 8 aa, Mycobacterium tuberculosis
YGTSSPSG

SEQ ID NO: 1433088 - protein, 16 aa, Mycobacterium tuberculosis
YGVTPDQLRDALDAIA

SEQ ID NO: 1433089 - protein, 5 aa, Mycobacterium tuberculosis
YKSPR

SEQ ID NO: 1433090 - protein, 6 aa, Mycobacterium tuberculosis
YKSYRG

SEQ ID NO: 1433091 - protein, 13 aa, Mycobacterium tuberculosis
YNADGSLRKPGQD

SEQ ID NO: 1433092 - protein, 9 aa, Mycobacterium tuberculosis
YNANPDSMR

SEQ ID NO: 1433093 - protein, 6 aa, Mycobacterium tuberculosis
YNQDND

SEQ ID NO: 1433094 - protein, 6 aa, Mycobacterium tuberculosis
YPANSV

SEQ ID NO: 1433095 - protein, 8 aa, Mycobacterium tuberculosis
YPDAADEP

SEQ ID NO: 1433096 - protein, 6 aa, Mycobacterium tuberculosis
YPDGSQ

SEQ ID NO: 1433097 - protein, 6 aa, Mycobacterium tuberculosis
YPEEVP

SEQ ID NO: 1433098 - protein, 5 aa, Mycobacterium tuberculosis
YPGEP

SEQ ID NO: 1433099 - protein, 6 aa, Mycobacterium tuberculosis
YPGVGP

SEQ ID NO: 1433100 - protein, 4 aa, Mycobacterium tuberculosis
YPHS

SEQ ID NO: 1433101 - protein, 7 aa, Mycobacterium tuberculosis
YPNYPAP

SEQ ID NO: 1433102 - protein, 8 aa, Mycobacterium tuberculosis
YPPAPRKP

SEQ ID NO: 1433103 - protein, 10 aa, Mycobacterium tuberculosis
YQETLTDPSY

SEQ ID NO: 1433104 - protein, 9 aa, Mycobacterium tuberculosis
YQGAATGVG

SEQ ID NO: 1433105 - protein, 7 aa, Mycobacterium tuberculosis
YQSDGQT

SEQ ID NO: 1433106 - protein, 4 aa, Mycobacterium tuberculosis
YQSS

SEQ ID NO: 1433107 - protein, 6 aa, Mycobacterium tuberculosis
YQSSTT

SEQ ID NO: 1433108 - protein, 9 aa, Mycobacterium tuberculosis
YRAGPGPVA

SEQ ID NO: 1433109 - protein, 13 aa, Mycobacterium tuberculosis
YREQGAFEGAPPW

SEQ ID NO: 1433110 - protein, 5 aa, Mycobacterium tuberculosis
YRGEF

SEQ ID NO: 1433111 - protein, 5 aa, Mycobacterium tuberculosis
YRGQE

SEQ ID NO: 1433112 - protein, 24 aa, Mycobacterium tuberculosis
YRNADETKKGLDHNARNDPRNPSP

SEQ ID NO: 1433113 - protein, 7 aa, Mycobacterium tuberculosis
YRPRDER

SEQ ID NO: 1433114 - protein, 10 aa, Mycobacterium tuberculosis
YRRATDGSEA

SEQ ID NO: 1433115 - protein, 4 aa, Mycobacterium tuberculosis
YRRR

SEQ ID NO: 1433116 - protein, 11 aa, Mycobacterium tuberculosis
YRSDDPTDADR

SEQ ID NO: 1433117 - protein, 4 aa, Mycobacterium tuberculosis
YRSE

SEQ ID NO: 1433118 - protein, 5 aa, Mycobacterium tuberculosis
YRSTQ

SEQ ID NO: 1433119 - protein, 17 aa, Mycobacterium tuberculosis
YRVGPDSAGADPGPACY

SEQ ID NO: 1433120 - protein, 30 aa, Mycobacterium tuberculosis; identical to SEQ ID NO: 191981

SEQ ID NO: 1433121 - protein, 4 aa, Mycobacterium tuberculosis
YSCP

SEQ ID NO: 1433122 - protein, 6 aa, Mycobacterium tuberculosis
YSDTQS

SEQ ID NO: 1433123 - protein, 4 aa, Mycobacterium tuberculosis
YSGD

SEQ ID NO: 1433124 - protein, 6 aa, Mycobacterium tuberculosis
YSGEDE

SEQ ID NO: 1433125 - protein, 18 aa, Mycobacterium tuberculosis
YSGPDEGPASPAERPPYR

SEQ ID NO: 1433126 - protein, 5 aa, Mycobacterium tuberculosis
YSTNN

SEQ ID NO: 1433127 - protein, 15 aa, Mycobacterium tuberculosis
YTASGDAQVDETAAE

SEQ ID NO: 1433128 - protein, 8 aa, Mycobacterium tuberculosis
YTDPDGAK

SEQ ID NO: 1433129 - protein, 4 aa, Mycobacterium tuberculosis
YTES

SEQ ID NO: 1433130 - protein, 6 aa, Mycobacterium tuberculosis
YTGAYS

SEQ ID NO: 1433131 - protein, 8 aa, Mycobacterium tuberculosis
YTGDDGRT

SEQ ID NO: 1433132 - protein, 4 aa, Mycobacterium tuberculosis
YVKR

SEQ ID NO: 1433133 - protein, 6 aa, Mycobacterium tuberculosis
YVPEKD

SEQ ID NO: 1433134 - protein, 9 aa, Mycobacterium tuberculosis
YYAATPQGL

SEQ ID NO: 1433135 - protein, 10 aa, Mycobacterium tuberculosis
YYATADPDTF

SEQ ID NO: 1433136 - protein, 30 aa, Mycobacterium tuberculosis
AAAAAADPGPGDAPTSASRISGHIRAALAA

SEQ ID NO: 1433137 - protein, 22 aa, Mycobacterium tuberculosis
AAAAADPGPPTRPAHNAAGVSP

SEQ ID NO: 1433138 - protein, 7 aa, Mycobacterium tuberculosis
AAAADDV

SEQ ID NO: 1433139 - protein, 8 aa, Mycobacterium tuberculosis
AAAADRSD

SEQ ID NO: 1433140 - protein, 5 aa, Mycobacterium tuberculosis
AAAAE

SEQ ID NO: 1433141 - protein, 10 aa, Mycobacterium tuberculosis
AAAAESAELG

SEQ ID NO: 1433142 - protein, 7 aa, Mycobacterium tuberculosis
AAAAGGW

SEQ ID NO: 1433143 - protein, 11 aa, Mycobacterium tuberculosis
AAAARRARAEL

SEQ ID NO: 1433144 - protein, 5 aa, Mycobacterium tuberculosis
AAAAT

SEQ ID NO: 1433145 - protein, 14 aa, Mycobacterium tuberculosis
AAADNSVDATAARD

SEQ ID NO: 1433146 - protein, 11 aa, Mycobacterium tuberculosis
AAAGAGSEKVT

SEQ ID NO: 1433147 - protein, 7 aa, Mycobacterium tuberculosis
AAAGEAS

SEQ ID NO: 1433148 - protein, 18 aa, Mycobacterium tuberculosis
AAAGRGSGNSRNGSRNKK

SEQ ID NO: 1433149 - protein, 14 aa, Mycobacterium tuberculosis
AAAHAGSQAMASAA

SEQ ID NO: 1433150 - protein, 11 aa, Mycobacterium tuberculosis
AAAKAAGKVRI

SEQ ID NO: 1433151 - protein, 7 aa, Mycobacterium tuberculosis
AAAKPKQ

SEQ ID NO: 1433152 - protein, 6 aa, Mycobacterium tuberculosis
AAAPAT

SEQ ID NO: 1433153 - protein, 7 aa, Mycobacterium tuberculosis
AAAPGGL

SEQ ID NO: 1433154 - protein, 7 aa, Mycobacterium tuberculosis
AAARSGD

SEQ ID NO: 1433155 - protein, 9 aa, Mycobacterium tuberculosis
AAARTGAQA

SEQ ID NO: 1433156 - protein, 7 aa, Mycobacterium tuberculosis
AAASPGD

SEQ ID NO: 1433157 - protein, 5 aa, Mycobacterium tuberculosis
AAAVN

SEQ ID NO: 1433158 - protein, 18 aa, Mycobacterium tuberculosis
AACGGAATATGRAAGGRL

SEQ ID NO: 1433159 - protein, 6 aa, Mycobacterium tuberculosis
AACNRD

SEQ ID NO: 1433160 - protein, 9 aa, Mycobacterium tuberculosis
AADDNGRVT

SEQ ID NO: 1433161 - protein, 7 aa, Mycobacterium tuberculosis
AADGSDR

SEQ ID NO: 1433162 - protein, 8 aa, Mycobacterium tuberculosis
AADTPDGF

SEQ ID NO: 1433163 - protein, 8 aa, Mycobacterium tuberculosis
AAEAAGYS

SEQ ID NO: 1433164 - protein, 6 aa, Mycobacterium tuberculosis
AAEGNA

SEQ ID NO: 1433165 - protein, 7 aa, Mycobacterium tuberculosis
AAEHPRD

SEQ ID NO: 1433166 - protein, 6 aa, Mycobacterium tuberculosis
AAEPPV

SEQ ID NO: 1433167 - protein, 6 aa, Mycobacterium tuberculosis
AAEPVE

SEQ ID NO: 1433168 - protein, 6 aa, Mycobacterium tuberculosis
AAFGSG

SEQ ID NO: 1433169 - protein, 15 aa, Mycobacterium tuberculosis
AAFKPEPAMQDEDYQ

SEQ ID NO: 1433170 - protein, 29 aa, Mycobacterium tuberculosis
AAGAAGAAGAAGAPVAGGATWAAGTAKSC

SEQ ID NO: 1433171 - protein, 7 aa, Mycobacterium tuberculosis
AAGADKD

SEQ ID NO: 1433172 - protein, 8 aa, Mycobacterium tuberculosis
AAGDEVSA

SEQ ID NO: 1433173 - protein, 8 aa, Mycobacterium tuberculosis
AAGGGRMR

SEQ ID NO: 1433174 - protein, 6 aa, Mycobacterium tuberculosis
AAGPHI

SEQ ID NO: 1433175 - protein, 5 aa, Mycobacterium tuberculosis
AAGPL

SEQ ID NO: 1433176 - protein, 8 aa, Mycobacterium tuberculosis
AAGPSRAK

SEQ ID NO: 1433177 - protein, 5 aa, Mycobacterium tuberculosis
AAGRQ

SEQ ID NO: 1433178 - protein, 7 aa, Mycobacterium tuberculosis
AAGRRAH

SEQ ID NO: 1433179 - protein, 9 aa, Mycobacterium tuberculosis
AAGRSDAAA

SEQ ID NO: 1433180 - protein, 7 aa, Mycobacterium tuberculosis
AAGVNPR

SEQ ID NO: 1433181 - protein, 21 aa, Mycobacterium tuberculosis
AAHDADDAATYPSDLTAKAAE

SEQ ID NO: 1433182 - protein, 5 aa, Mycobacterium tuberculosis
AAHER

SEQ ID NO: 1433183 - protein, 11 aa, Mycobacterium tuberculosis
AAHESSMSGEE

SEQ ID NO: 1433184 - protein, 27 aa, Mycobacterium tuberculosis
AAHETEHKKARQRRAARQKAERGHPNW

SEQ ID NO: 1433185 - protein, 12 aa, Mycobacterium tuberculosis
AAKSSPDQDEIQ

SEQ ID NO: 1433186 - protein, 7 aa, Mycobacterium tuberculosis
AALDSEG

SEQ ID NO: 1433187 - protein, 7 aa, Mycobacterium tuberculosis
AALGQAA

SEQ ID NO: 1433188 - protein, 6 aa, Mycobacterium tuberculosis
AALGRP

SEQ ID NO: 1433189 - protein, 53 aa, Mycobacterium tuberculosis; identical to SEQ ID NO: 167134

SEQ ID NO: 1433190 - protein, 6 aa, Mycobacterium tuberculosis
AANCPQ

SEQ ID NO: 1433191 - protein, 9 aa, Mycobacterium tuberculosis
AANSDDLAD

SEQ ID NO: 1433192 - protein, 17 aa, Mycobacterium tuberculosis
AAPANSTSIDRRLPSTR

SEQ ID NO: 1433193 - protein, 11 aa, Mycobacterium tuberculosis
AAPARPARTAD

SEQ ID NO: 1433194 - protein, 9 aa, Mycobacterium tuberculosis
AAPDYGRDE

SEQ ID NO: 1433195 - protein, 14 aa, Mycobacterium tuberculosis
AAPGMANPADDTPC

SEQ ID NO: 1433196 - protein, 15 aa, Mycobacterium tuberculosis
AAPPPTTNAAGLATQ

SEQ ID NO: 1433197 - protein, 10 aa, Mycobacterium tuberculosis
AAQAASTTAE

SEQ ID NO: 1433198 - protein, 10 aa, Mycobacterium tuberculosis
AAQAEQAAAQ

SEQ ID NO: 1433199 - protein, 11 aa, Mycobacterium tuberculosis
AAQARQTATQI

SEQ ID NO: 1433200 - protein, 11 aa, Mycobacterium tuberculosis
AAQASDQQRRA

SEQ ID NO: 1433201 - protein, 8 aa, Mycobacterium tuberculosis
AAQPGSRL

SEQ ID NO: 1433202 - protein, 13 aa, Mycobacterium tuberculosis
AAQRAESKALKAQ

SEQ ID NO: 1433203 - protein, 8 aa, Mycobacterium tuberculosis
AAQTVRAG

SEQ ID NO: 1433204 - protein, 7 aa, Mycobacterium tuberculosis
AARATRK

SEQ ID NO: 1433205 - protein, 6 aa, Mycobacterium tuberculosis
AARATY

SEQ ID NO: 1433206 - protein, 8 aa, Mycobacterium tuberculosis
AARDRNIR

SEQ ID NO: 1433207 - protein, 10 aa, Mycobacterium tuberculosis
AARGADPDFH

SEQ ID NO: 1433208 - protein, 4 aa, Mycobacterium tuberculosis
AARS

SEQ ID NO: 1433209 - protein, 7 aa, Mycobacterium tuberculosis
AASFNSV

SEQ ID NO: 1433210 - protein, 7 aa, Mycobacterium tuberculosis
AATADAG

SEQ ID NO: 1433211 - protein, 6 aa, Mycobacterium tuberculosis
AATEAQ

SEQ ID NO: 1433212 - protein, 6 aa, Mycobacterium tuberculosis
AATEQP

SEQ ID NO: 1433213 - protein, 17 aa, Mycobacterium tuberculosis
AATETALKERKESVEDA

SEQ ID NO: 1433214 - protein, 5 aa, Mycobacterium tuberculosis
AATGF

SEQ ID NO: 1433215 - protein, 9 aa, Mycobacterium tuberculosis
AATRGGWRA

SEQ ID NO: 1433216 - protein, 7 aa, Mycobacterium tuberculosis
AATTSRE

SEQ ID NO: 1433217 - protein, 8 aa, Mycobacterium tuberculosis
AAVPTASA

SEQ ID NO: 1433218 - protein, 9 aa, Mycobacterium tuberculosis
AAVSQATDP

SEQ ID NO: 1433219 - protein, 10 aa, Mycobacterium tuberculosis
ADADVAGTRT

SEQ ID NO: 1433220 - protein, 6 aa, Mycobacterium tuberculosis
ADAGVS

SEQ ID NO: 1433221 - protein, 10 aa, Mycobacterium tuberculosis
ADAPQVASRI

SEQ ID NO: 1433222 - protein, 11 aa, Mycobacterium tuberculosis
ADATDKDRTRV

SEQ ID NO: 1433223 - protein, 12 aa, Mycobacterium tuberculosis
ADATDKDRTRVE

SEQ ID NO: 1433224 - protein, 9 aa, Mycobacterium tuberculosis
ADDPAENES

SEQ ID NO: 1433225 - protein, 12 aa, Mycobacterium tuberculosis
ADDQSPAPALNE

SEQ ID NO: 1433226 - protein, 8 aa, Mycobacterium tuberculosis
ADEQDREL

SEQ ID NO: 1433227 - protein, 7 aa, Mycobacterium tuberculosis
ADFADPD

SEQ ID NO: 1433228 - protein, 8 aa, Mycobacterium tuberculosis
ADFRQPGH

SEQ ID NO: 1433229 - protein, 7 aa, Mycobacterium tuberculosis
ADHHEAS

SEQ ID NO: 1433230 - protein, 4 aa, Mycobacterium tuberculosis
ADKI

SEQ ID NO: 1433231 - protein, 6 aa, Mycobacterium tuberculosis
ADLGGT

SEQ ID NO: 1433232 - protein, 14 aa, Mycobacterium tuberculosis
ADPAAHPLGTPSGR

SEQ ID NO: 1433233 - protein, 8 aa, Mycobacterium tuberculosis
ADPGESQM

SEQ ID NO: 1433234 - protein, 6 aa, Mycobacterium tuberculosis
ADPGYP

SEQ ID NO: 1433235 - protein, 6 aa, Mycobacterium tuberculosis
ADPIAA

SEQ ID NO: 1433236 - protein, 26 aa, Mycobacterium tuberculosis
ADPTPTTGGPLLSSNGGYRDDSRLAT

SEQ ID NO: 1433237 - protein, 9 aa, Mycobacterium tuberculosis
ADQAAQAGH

SEQ ID NO: 1433238 - protein, 6 aa, Mycobacterium tuberculosis
ADRAAL

SEQ ID NO: 1433239 - protein, 9 aa, Mycobacterium tuberculosis
ADRADRLRT

SEQ ID NO: 1433240 - protein, 8 aa, Mycobacterium tuberculosis
ADRARAEN

SEQ ID NO: 1433241 - protein, 4 aa, Mycobacterium tuberculosis
ADRD

SEQ ID NO: 1433242 - protein, 15 aa, Mycobacterium tuberculosis
ADRRRTAAISAPQGL

SEQ ID NO: 1433243 - protein, 7 aa, Mycobacterium tuberculosis
ADRTDAP

SEQ ID NO: 1433244 - protein, 8 aa, Mycobacterium tuberculosis
ADSDDPLQ

SEQ ID NO: 1433245 - protein, 6 aa, Mycobacterium tuberculosis
ADSGVT

SEQ ID NO: 1433246 - protein, 7 aa, Mycobacterium tuberculosis
ADSGVTA

SEQ ID NO: 1433247 - protein, 5 aa, Mycobacterium tuberculosis
ADTDR

SEQ ID NO: 1433248 - protein, 5 aa, Mycobacterium tuberculosis
ADTPH

SEQ ID NO: 1433249 - protein, 10 aa, Mycobacterium tuberculosis
ADTTRDTDGQ

SEQ ID NO: 1433250 - protein, 8 aa, Mycobacterium tuberculosis
ADVDPGPA

SEQ ID NO: 1433251 - protein, 8 aa, Mycobacterium tuberculosis
AEAGGIDE

SEQ ID NO: 1433252 - protein, 8 aa, Mycobacterium tuberculosis
AEAGKDAA

SEQ ID NO: 1433253 - protein, 6 aa, Mycobacterium tuberculosis
AEAKPD

SEQ ID NO: 1433254 - protein, 4 aa, Mycobacterium tuberculosis
AEAR

SEQ ID NO: 1433255 - protein, 7 aa, Mycobacterium tuberculosis
AEARHPP

SEQ ID NO: 1433256 - protein, 15 aa, Mycobacterium tuberculosis
AECADDQGARCHLGQ

SEQ ID NO: 1433257 - protein, 6 aa, Mycobacterium tuberculosis
AEDLPP

SEQ ID NO: 1433258 - protein, 5 aa, Mycobacterium tuberculosis
AEDPA

SEQ ID NO: 1433259 - protein, 5 aa, Mycobacterium tuberculosis
AEDPT

SEQ ID NO: 1433260 - protein, 7 aa, Mycobacterium tuberculosis
AEDTRRV

SEQ ID NO: 1433261 - protein, 13 aa, Mycobacterium tuberculosis
AEETLPQPVRDAD

SEQ ID NO: 1433262 - protein, 5 aa, Mycobacterium tuberculosis
AEETN

SEQ ID NO: 1433263 - protein, 7 aa, Mycobacterium tuberculosis
AEFASRQ

SEQ ID NO: 1433264 - protein, 6 aa, Mycobacterium tuberculosis
AEFSRG

SEQ ID NO: 1433265 - protein, 8 aa, Mycobacterium tuberculosis
AEKSFTSD

SEQ ID NO: 1433266 - protein, 15 aa, Mycobacterium tuberculosis
AELADRERRAAEADR

SEQ ID NO: 1433267 - protein, 8 aa, Mycobacterium tuberculosis
AELGAEGA

SEQ ID NO: 1433268 - protein, 5 aa, Mycobacterium tuberculosis
AENAE

SEQ ID NO: 1433269 - protein, 7 aa, Mycobacterium tuberculosis
AENRDTA

SEQ ID NO: 1433270 - protein, 94 aa, Mycobacterium tuberculosis
AEPAEATAATGAAGGTCGDGPRATEAAETAETKEDAEAAATALPPVATGPTGACSKGPRVAGAAGAPGATHPAPATDAGKTIAAKAARTSVATH

SEQ ID NO: 1433271 - protein, 12 aa, Mycobacterium tuberculosis
AEPLSGSQGEGG

SEQ ID NO: 1433272 - protein, 8 aa, Mycobacterium tuberculosis
AEPVEPAD

SEQ ID NO: 1433273 - protein, 6 aa, Mycobacterium tuberculosis
AEQATG

SEQ ID NO: 1433274 - protein, 7 aa, Mycobacterium tuberculosis
AEQRGRR

SEQ ID NO: 1433275 - protein, 7 aa, Mycobacterium tuberculosis
AERALTN

SEQ ID NO: 1433276 - protein, 10 aa, Mycobacterium tuberculosis
AERAYAAREA

SEQ ID NO: 1433277 - protein, 6 aa, Mycobacterium tuberculosis
AEREDW

SEQ ID NO: 1433278 - protein, 5 aa, Mycobacterium tuberculosis
AERPD

SEQ ID NO: 1433279 - protein, 7 aa, Mycobacterium tuberculosis
AERPGDA

SEQ ID NO: 1433280 - protein, 5 aa, Mycobacterium tuberculosis
AERSA

SEQ ID NO: 1433281 - protein, 7 aa, Mycobacterium tuberculosis
AERSREA

SEQ ID NO: 1433282 - protein, 17 aa, Mycobacterium tuberculosis
AESAKTLQRAEARHGTK

SEQ ID NO: 1433283 - protein, 5 aa, Mycobacterium tuberculosis
AESGD

SEQ ID NO: 1433284 - protein, 12 aa, Mycobacterium tuberculosis
AESGDDSREVIG

SEQ ID NO: 1433285 - protein, 11 aa, Mycobacterium tuberculosis
AESGSEAAEAD

SEQ ID NO: 1433286 - protein, 7 aa, Mycobacterium tuberculosis
AESNRTV

SEQ ID NO: 1433287 - protein, 4 aa, Mycobacterium tuberculosis
AETE

SEQ ID NO: 1433288 - protein, 8 aa, Mycobacterium tuberculosis
AETETRTQ

SEQ ID NO: 1433289 - protein, 9 aa, Mycobacterium tuberculosis
AETNRPPET

SEQ ID NO: 1433290 - protein, 15 aa, Mycobacterium tuberculosis
AETTTNGSVSPATVR

SEQ ID NO: 1433291 - protein, 11 aa, Mycobacterium tuberculosis
AEVDEKARFPE

SEQ ID NO: 1433292 - protein, 16 aa, Mycobacterium tuberculosis
AFATQGVSAEAQANRA

SEQ ID NO: 1433293 - protein, 27 aa, Mycobacterium tuberculosis
AFGGDGGNGSDGVAAGSGGGSGGAGGG

SEQ ID NO: 1433294 - protein, 20 aa, Mycobacterium tuberculosis
AFRGDGTITAGSASQISDGA

SEQ ID NO: 1433295 - protein, 6 aa, Mycobacterium tuberculosis
AGAAAA

SEQ ID NO: 1433296 - protein, 33 aa, Mycobacterium tuberculosis
AGAGGAGAAGGAGTGDTESFGGHGGAGGDGGAV

SEQ ID NO: 1433297 - protein, 28 aa, Mycobacterium tuberculosis
AGAGGAGGSGANALGAGTGGTGGDGGHA

SEQ ID NO: 1433298 - protein, 8 aa, Mycobacterium tuberculosis
AGAGNAPV

SEQ ID NO: 1433299 - protein, 11 aa, Mycobacterium tuberculosis
AGAKSQEPRHS

SEQ ID NO: 1433300 - protein, 13 aa, Mycobacterium tuberculosis
AGAPGRASANGTS

SEQ ID NO: 1433301 - protein, 5 aa, Mycobacterium tuberculosis
AGAQF

SEQ ID NO: 1433302 - protein, 10 aa, Mycobacterium tuberculosis
AGARAPKGTR

SEQ ID NO: 1433303 - protein, 10 aa, Mycobacterium tuberculosis
AGASQAAAQL

SEQ ID NO: 1433304 - protein, 12 aa, Mycobacterium tuberculosis
AGASTLAGSTTT

SEQ ID NO: 1433305 - protein, 18 aa, Mycobacterium tuberculosis
AGATTSPTGTTGAAVAEQ

SEQ ID NO: 1433306 - protein, 97 aa, Mycobacterium tuberculosis
AGDGGAGGHGGDPGLGGAGGAGGASGGAGARAGANGLAAGNDGPVSGGNGGKGGNGAHAPVAGGHGGNGGAGGNGGLVGDGGAGGHGGDGAAGAGYA

SEQ ID NO: 1433307 - protein, 9 aa, Mycobacterium tuberculosis
AGDQRRPAG

SEQ ID NO: 1433308 - protein, 11 aa, Mycobacterium tuberculosis
AGEELGVTNKG

SEQ ID NO: 1433309 - protein, 6 aa, Mycobacterium tuberculosis
AGEGAG

SEQ ID NO: 1433310 - protein, 10 aa, Mycobacterium tuberculosis
AGEGGHSSGV

SEQ ID NO: 1433311 - protein, 4 aa, Mycobacterium tuberculosis
AGEK

SEQ ID NO: 1433312 - protein, 4 aa, Mycobacterium tuberculosis
AGEM

SEQ ID NO: 1433313 - protein, 25 aa, Mycobacterium tuberculosis
AGGAGGLGGQGNHTGGHGGAGGSAG

SEQ ID NO: 1433314 - protein, 7 aa, Mycobacterium tuberculosis
AGGDCGR

SEQ ID NO: 1433315 - protein, 5 aa, Mycobacterium tuberculosis
AGGDE

SEQ ID NO: 1433316 - protein, 25 aa, Mycobacterium tuberculosis
AGGGAGGAGGSGNNVGGAGGAGGVG

SEQ ID NO: 1433317 - protein, 33 aa, Mycobacterium tuberculosis; identical to SEQ ID NO: 168254

SEQ ID NO: 1433318 - protein, 6 aa, Mycobacterium tuberculosis
AGGGVD

SEQ ID NO: 1433319 - protein, 5 aa, Mycobacterium tuberculosis
AGGMH

SEQ ID NO: 1433320 - protein, 10 aa, Mycobacterium tuberculosis
AGGNDGGATL

SEQ ID NO: 1433321 - protein, 8 aa, Mycobacterium tuberculosis
AGGPSDAL

SEQ ID NO: 1433322 - protein, 7 aa, Mycobacterium tuberculosis
AGGRVTT

SEQ ID NO: 1433323 - protein, 10 aa, Mycobacterium tuberculosis
AGGTGGPGGF

SEQ ID NO: 1433324 - protein, 6 aa, Mycobacterium tuberculosis
AGGTGL

SEQ ID NO: 1433325 - protein, 11 aa, Mycobacterium tuberculosis
AGIGDRCTEAT

SEQ ID NO: 1433326 - protein, 4 aa, Mycobacterium tuberculosis
AGIR

SEQ ID NO: 1433327 - protein, 5 aa, Mycobacterium tuberculosis
AGKPA

SEQ ID NO: 1433328 - protein, 23 aa, Mycobacterium tuberculosis
AGNLESVGSALNEAAAAAAPATV

SEQ ID NO: 1433329 - protein, 5 aa, Mycobacterium tuberculosis
AGNPI

SEQ ID NO: 1433330 - protein, 16 aa, Mycobacterium tuberculosis
AGPAGLATAANAAQRG

SEQ ID NO: 1433331 - protein, 5 aa, Mycobacterium tuberculosis
AGPDR

SEQ ID NO: 1433332 - protein, 7 aa, Mycobacterium tuberculosis
AGPDYGG

SEQ ID NO: 1433333 - protein, 14 aa, Mycobacterium tuberculosis
AGPGEGIGPTTSVP

SEQ ID NO: 1433334 - protein, 6 aa, Mycobacterium tuberculosis
AGPGPL

SEQ ID NO: 1433335 - protein, 16 aa, Mycobacterium tuberculosis
AGPGTRRQPGIGGQPR

SEQ ID NO: 1433336 - protein, 7 aa, Mycobacterium tuberculosis
AGPVPQA

SEQ ID NO: 1433337 - protein, 15 aa, Mycobacterium tuberculosis
AGRGFSSGADHKSAG

SEQ ID NO: 1433338 - protein, 5 aa, Mycobacterium tuberculosis
AGRNH

SEQ ID NO: 1433339 - protein, 17 aa, Mycobacterium tuberculosis
AGRRTETHERPIDGTPV

SEQ ID NO: 1433340 - protein, 8 aa, Mycobacterium tuberculosis
AGRSSERL

SEQ ID NO: 1433341 - protein, 7 aa, Mycobacterium tuberculosis
AGRTSAP

SEQ ID NO: 1433342 - protein, 25 aa, Mycobacterium tuberculosis
AGRYGSGGGRGGGNSWAVARAAAPA

SEQ ID NO: 1433343 - protein, 15 aa, Mycobacterium tuberculosis
AGSADTSGGDQPTLG

SEQ ID NO: 1433344 - protein, 4 aa, Mycobacterium tuberculosis
AGSE

SEQ ID NO: 1433345 - protein, 11 aa, Mycobacterium tuberculosis
AGSGGFGGAGG

SEQ ID NO: 1433346 - protein, 8 aa, Mycobacterium tuberculosis
AGTAEQKR

SEQ ID NO: 1433347 - protein, 8 aa, Mycobacterium tuberculosis
AGTAGQRC

SEQ ID NO: 1433348 - protein, 8 aa, Mycobacterium tuberculosis
AGTANELT

SEQ ID NO: 1433349 - protein, 52 aa, Mycobacterium tuberculosis
AGTGGEGGTGGAAGAGGAAGARGALTSGGLAGGVGAGGTGGTGGTGGNGADA

SEQ ID NO: 1433350 - protein, 9 aa, Mycobacterium tuberculosis
AGTGGPDVR

SEQ ID NO: 1433351 - protein, 15 aa, Mycobacterium tuberculosis
AGTGIGSATARRALA

SEQ ID NO: 1433352 - protein, 10 aa, Mycobacterium tuberculosis
AGTPATTMPI

SEQ ID NO: 1433353 - protein, 10 aa, Mycobacterium tuberculosis
AGTPVISDPG

SEQ ID NO: 1433354 - protein, 5 aa, Mycobacterium tuberculosis
AGTTV

SEQ ID NO: 1433355 - protein, 5 aa, Mycobacterium tuberculosis
AGVDP

SEQ ID NO: 1433356 - protein, 5 aa, Mycobacterium tuberculosis
AGVGS

SEQ ID NO: 1433357 - protein, 8 aa, Mycobacterium tuberculosis
AGVREAER

SEQ ID NO: 1433358 - protein, 6 aa, Mycobacterium tuberculosis
AGYASE

SEQ ID NO: 1433359 - protein, 11 aa, Mycobacterium tuberculosis
AGYTGTTQSLG

SEQ ID NO: 1433360 - protein, 12 aa, Mycobacterium tuberculosis
AHADGRVSNPVR

SEQ ID NO: 1433361 - protein, 12 aa, Mycobacterium tuberculosis
AHEARPGVARTP

SEQ ID NO: 1433362 - protein, 4 aa, Mycobacterium tuberculosis
AHGR

SEQ ID NO: 1433363 - protein, 4 aa, Mycobacterium tuberculosis
AHKR

SEQ ID NO: 1433364 - protein, 5 aa, Mycobacterium tuberculosis
AHNEA

SEQ ID NO: 1433365 - protein, 8 aa, Mycobacterium tuberculosis
AHRAGADQ

SEQ ID NO: 1433366 - protein, 11 aa, Mycobacterium tuberculosis
AHRKTRPGPAA

SEQ ID NO: 1433367 - protein, 5 aa, Mycobacterium tuberculosis
AIGPG

SEQ ID NO: 1433368 - protein, 11 aa, Mycobacterium tuberculosis
AIPGGNVKRGD

SEQ ID NO: 1433369 - protein, 11 aa, Mycobacterium tuberculosis
AKAAADEAGVP

SEQ ID NO: 1433370 - protein, 14 aa, Mycobacterium tuberculosis
AKAAGTSAGAAQSA

SEQ ID NO: 1433371 - protein, 12 aa, Mycobacterium tuberculosis
AKAEVEIPSPYA

SEQ ID NO: 1433372 - protein, 8 aa, Mycobacterium tuberculosis
AKDAEGGS

SEQ ID NO: 1433373 - protein, 5 aa, Mycobacterium tuberculosis
AKNDG

SEQ ID NO: 1433374 - protein, 8 aa, Mycobacterium tuberculosis
AKQLEEPY

SEQ ID NO: 1433375 - protein, 4 aa, Mycobacterium tuberculosis
AKRA

SEQ ID NO: 1433376 - protein, 11 aa, Mycobacterium tuberculosis
AKRRRKPRSLK

SEQ ID NO: 1433377 - protein, 7 aa, Mycobacterium tuberculosis
AKSHAGQ

SEQ ID NO: 1433378 - protein, 13 aa, Mycobacterium tuberculosis
AKTDRSAVAGATP

SEQ ID NO: 1433379 - protein, 5 aa, Mycobacterium tuberculosis
AKTGN

SEQ ID NO: 1433380 - protein, 14 aa, Mycobacterium tuberculosis
ALADASADRASQIR

SEQ ID NO: 1433381 - protein, 8 aa, Mycobacterium tuberculosis
ALADDKTV

SEQ ID NO: 1433382 - protein, 13 aa, Mycobacterium tuberculosis
ALAEPSRQPDDMS

SEQ ID NO: 1433383 - protein, 9 aa, Mycobacterium tuberculosis
ALAQEKTGE

SEQ ID NO: 1433384 - protein, 8 aa, Mycobacterium tuberculosis
ALDRDGQK

SEQ ID NO: 1433385 - protein, 13 aa, Mycobacterium tuberculosis
ALERGRTTQERSD

SEQ ID NO: 1433386 - protein, 8 aa, Mycobacterium tuberculosis
ALETTRPL

SEQ ID NO: 1433387 - protein, 19 aa, Mycobacterium tuberculosis
ALGAPTSPEADAADGARYA

SEQ ID NO: 1433388 - protein, 6 aa, Mycobacterium tuberculosis
ALGGPL

SEQ ID NO: 1433389 - protein, 19 aa, Mycobacterium tuberculosis
ALPGAAVAGSRGQELSTSA

SEQ ID NO: 1433390 - protein, 4 aa, Mycobacterium tuberculosis
ALRP

SEQ ID NO: 1433391 - protein, 11 aa, Mycobacterium tuberculosis
ALSPSSPIAQG

SEQ ID NO: 1433392 - protein, 7 aa, Mycobacterium tuberculosis
ALSPTGQ

SEQ ID NO: 1433393 - protein, 6 aa, Mycobacterium tuberculosis
AMGDED

SEQ ID NO: 1433394 - protein, 6 aa, Mycobacterium tuberculosis
ANAAEG

SEQ ID NO: 1433395 - protein, 16 aa, Mycobacterium tuberculosis
ANDPRFGASRSRVANR

SEQ ID NO: 1433396 - protein, 8 aa, Mycobacterium tuberculosis
ANESHYAG

SEQ ID NO: 1433397 - protein, 50 aa, Mycobacterium tuberculosis
ANGGVGGSGGNATLIGNGGNGGNGGVGSAPGKGGAGGTAGLLGLNGSPGL

SEQ ID NO: 1433398 - protein, 6 aa, Mycobacterium tuberculosis
ANGSSL

SEQ ID NO: 1433399 - protein, 10 aa, Mycobacterium tuberculosis
ANGVSGSASY

SEQ ID NO: 1433400 - protein, 7 aa, Mycobacterium tuberculosis
ANKPDSH

SEQ ID NO: 1433401 - protein, 14 aa, Mycobacterium tuberculosis
ANNPVDKGAAKALA

SEQ ID NO: 1433402 - protein, 6 aa, Mycobacterium tuberculosis
ANPDRI

SEQ ID NO: 1433403 - protein, 5 aa, Mycobacterium tuberculosis
ANPDV

SEQ ID NO: 1433404 - protein, 8 aa, Mycobacterium tuberculosis
ANPGSVEA

SEQ ID NO: 1433405 - protein, 5 aa, Mycobacterium tuberculosis
ANPRS

SEQ ID NO: 1433406 - protein, 11 aa, Mycobacterium tuberculosis
ANPVDPARISA

SEQ ID NO: 1433407 - protein, 4 aa, Mycobacterium tuberculosis
ANQR

SEQ ID NO: 1433408 - protein, 17 aa, Mycobacterium tuberculosis
ANRGPAAISSGSNSGRV

SEQ ID NO: 1433409 - protein, 4 aa, Mycobacterium tuberculosis
ANRT

SEQ ID NO: 1433410 - protein, 7 aa, Mycobacterium tuberculosis
ANTGTNN

SEQ ID NO: 1433411 - protein, 10 aa, Mycobacterium tuberculosis
ANTPDGDEAL

SEQ ID NO: 1433412 - protein, 10 aa, Mycobacterium tuberculosis
ANVGPGANKA

SEQ ID NO: 1433413 - protein, 5 aa, Mycobacterium tuberculosis
ANYPG

SEQ ID NO: 1433414 - protein, 9 aa, Mycobacterium tuberculosis
APAERQRQL

SEQ ID NO: 1433415 - protein, 14 aa, Mycobacterium tuberculosis
APARRAELGDSPPV

SEQ ID NO: 1433416 - protein, 8 aa, Mycobacterium tuberculosis
APARTPPV

SEQ ID NO: 1433417 - protein, 13 aa, Mycobacterium tuberculosis
APASNTTGLTETS

SEQ ID NO: 1433418 - protein, 4 aa, Mycobacterium tuberculosis
APAT

SEQ ID NO: 1433419 - protein, 5 aa, Mycobacterium tuberculosis
APDGR

SEQ ID NO: 1433420 - protein, 6 aa, Mycobacterium tuberculosis
APDSEA

SEQ ID NO: 1433421 - protein, 9 aa, Mycobacterium tuberculosis
APDSQRGER

SEQ ID NO: 1433422 - protein, 4 aa, Mycobacterium tuberculosis
APDT

SEQ ID NO: 1433423 - protein, 7 aa, Mycobacterium tuberculosis
APEMTSA

SEQ ID NO: 1433424 - protein, 12 aa, Mycobacterium tuberculosis
APERRASNGRQQ

SEQ ID NO: 1433425 - protein, 5 aa, Mycobacterium tuberculosis
APFSA

SEQ ID NO: 1433426 - protein, 35 aa, Mycobacterium tuberculosis
APGACNPDDQTPLVDDTPDADAVRRDTRSQAQRHH

SEQ ID NO: 1433427 - protein, 34 aa, Mycobacterium tuberculosis
APGACNPDDQTPVVDDTPDADAVRRDTRSQAQRH

SEQ ID NO: 1433428 - protein, 18 aa, Mycobacterium tuberculosis
APGAVAPAPLGRKREGRD

SEQ ID NO: 1433429 - protein, 5 aa, Mycobacterium tuberculosis
APGFE

SEQ ID NO: 1433430 - protein, 8 aa, Mycobacterium tuberculosis
APGGDATA

SEQ ID NO: 1433431 - protein, 6 aa, Mycobacterium tuberculosis
APGQPA

SEQ ID NO: 1433432 - protein, 5 aa, Mycobacterium tuberculosis
APGRA

SEQ ID NO: 1433433 - protein, 5 aa, Mycobacterium tuberculosis
APGSA

SEQ ID NO: 1433434 - protein, 8 aa, Mycobacterium tuberculosis
APGTGLRD

SEQ ID NO: 1433435 - protein, 5 aa, Mycobacterium tuberculosis
APHAE

SEQ ID NO: 1433436 - protein, 21 aa, Mycobacterium tuberculosis
APHDVSQDNQISALSSSAGSV

SEQ ID NO: 1433437 - protein, 4 aa, Mycobacterium tuberculosis
APHN

SEQ ID NO: 1433438 - protein, 9 aa, Mycobacterium tuberculosis
APKSAKSLS

SEQ ID NO: 1433439 - protein, 6 aa, Mycobacterium tuberculosis
APLPDE

SEQ ID NO: 1433440 - protein, 7 aa, Mycobacterium tuberculosis
APLRPPN

SEQ ID NO: 1433441 - protein, 12 aa, Mycobacterium tuberculosis
APMGTDDDPRAV

SEQ ID NO: 1433442 - protein, 6 aa, Mycobacterium tuberculosis
APNPAA

SEQ ID NO: 1433443 - protein, 7 aa, Mycobacterium tuberculosis
APNTGNA

SEQ ID NO: 1433444 - protein, 6 aa, Mycobacterium tuberculosis
APPDLR

SEQ ID NO: 1433445 - protein, 5 aa, Mycobacterium tuberculosis
APPEL

SEQ ID NO: 1433446 - protein, 7 aa, Mycobacterium tuberculosis
APPGSFN

SEQ ID NO: 1433447 - protein, 37 aa, Mycobacterium tuberculosis; identical to SEQ ID NO: 229107

SEQ ID NO: 1433448 - protein, 5 aa, Mycobacterium tuberculosis
APQME

SEQ ID NO: 1433449 - protein, 4 aa, Mycobacterium tuberculosis
APRP

SEQ ID NO: 1433450 - protein, 6 aa, Mycobacterium tuberculosis
APRRAT

SEQ ID NO: 1433451 - protein, 21 aa, Mycobacterium tuberculosis
APRRNVADPDGSLVAGQGSAR

SEQ ID NO: 1433452 - protein, 9 aa, Mycobacterium tuberculosis
APRRVPEPI

SEQ ID NO: 1433453 - protein, 8 aa, Mycobacterium tuberculosis
APSSLPAP

SEQ ID NO: 1433454 - protein, 5 aa, Mycobacterium tuberculosis
APTTE

SEQ ID NO: 1433455 - protein, 7 aa, Mycobacterium tuberculosis
APVESQY

SEQ ID NO: 1433456 - protein, 10 aa, Mycobacterium tuberculosis
AQAAQGRDGV

SEQ ID NO: 1433457 - protein, 5 aa, Mycobacterium tuberculosis
AQAET

SEQ ID NO: 1433458 - protein, 7 aa, Mycobacterium tuberculosis
AQDAGFN

SEQ ID NO: 1433459 - protein, 5 aa, Mycobacterium tuberculosis
AQDMT

SEQ ID NO: 1433460 - protein, 8 aa, Mycobacterium tuberculosis
AQGRNQPS

SEQ ID NO: 1433461 - protein, 9 aa, Mycobacterium tuberculosis
AQKQARRWS

SEQ ID NO: 1433462 - protein, 7 aa, Mycobacterium tuberculosis
AQPRPLD

SEQ ID NO: 1433463 - protein, 11 aa, Mycobacterium tuberculosis
AQPTAANDPIY

SEQ ID NO: 1433464 - protein, 12 aa, Mycobacterium tuberculosis
AQPTAANDPIYA

SEQ ID NO: 1433465 - protein, 6 aa, Mycobacterium tuberculosis
AQQTVT

SEQ ID NO: 1433466 - protein, 6 aa, Mycobacterium tuberculosis
AQSGRR

SEQ ID NO: 1433467 - protein, 14 aa, Mycobacterium tuberculosis
AQSSTTGSPGPLPL

SEQ ID NO: 1433468 - protein, 95 aa, Mycobacterium tuberculosis; identical to SEQ ID NO: 169606

SEQ ID NO: 1433469 - protein, 4 aa, Mycobacterium tuberculosis
AQYA

SEQ ID NO: 1433470 - protein, 15 aa, Mycobacterium tuberculosis
ARADGHDHAASAVAA

SEQ ID NO: 1433471 - protein, 8 aa, Mycobacterium tuberculosis
ARAGGGPT

SEQ ID NO: 1433472 - protein, 13 aa, Mycobacterium tuberculosis
ARAGLAAADTGLN

SEQ ID NO: 1433473 - protein, 34 aa, Mycobacterium tuberculosis
ARAGTAGGAGRGPVGGIGGAGGVGGAGGAAGAVT

SEQ ID NO: 1433474 - protein, 19 aa, Mycobacterium tuberculosis
ARARPRGSSAAHPSPHRRH

SEQ ID NO: 1433475 - protein, 8 aa, Mycobacterium tuberculosis
ARATATTI

SEQ ID NO: 1433476 - protein, 7 aa, Mycobacterium tuberculosis
ARDADGS

SEQ ID NO: 1433477 - protein, 6 aa, Mycobacterium tuberculosis
ARDRVG

SEQ ID NO: 1433478 - protein, 15 aa, Mycobacterium tuberculosis
AREAAAQASAAAAAY

SEQ ID NO: 1433479 - protein, 8 aa, Mycobacterium tuberculosis
AREAGRVA

SEQ ID NO: 1433480 - protein, 11 aa, Mycobacterium tuberculosis
AREGTLTPAEL

SEQ ID NO: 1433481 - protein, 15 aa, Mycobacterium tuberculosis
AREGTLTPAELRGST

SEQ ID NO: 1433482 - protein, 4 aa, Mycobacterium tuberculosis
AREQ

SEQ ID NO: 1433483 - protein, 5 aa, Mycobacterium tuberculosis
ARGDV

SEQ ID NO: 1433484 - protein, 22 aa, Mycobacterium tuberculosis
ARGRGLAGAAGRTTTGRRIRGR

SEQ ID NO: 1433485 - protein, 7 aa, Mycobacterium tuberculosis
ARHSSGL

SEQ ID NO: 1433486 - protein, 21 aa, Mycobacterium tuberculosis
ARIGPGTNNAPSAADTTTYAR

SEQ ID NO: 1433487 - protein, 18 aa, Mycobacterium tuberculosis
ARKGQKTRRREKKNVPHG

SEQ ID NO: 1433488 - protein, 10 aa, Mycobacterium tuberculosis
ARKVTAPAEI

SEQ ID NO: 1433489 - protein, 10 aa, Mycobacterium tuberculosis
ARLDGSDPVN

SEQ ID NO: 1433490 - protein, 10 aa, Mycobacterium tuberculosis
ARLPGSAAAA

SEQ ID NO: 1433491 - protein, 8 aa, Mycobacterium tuberculosis
ARMASGGT

SEQ ID NO: 1433492 - protein, 6 aa, Mycobacterium tuberculosis
ARPTPW

SEQ ID NO: 1433493 - protein, 11 aa, Mycobacterium tuberculosis
ARQARAAAGAF

SEQ ID NO: 1433494 - protein, 11 aa, Mycobacterium tuberculosis
ARQPRDASPVR

SEQ ID NO: 1433495 - protein, 7 aa, Mycobacterium tuberculosis
ARQQLED

SEQ ID NO: 1433496 - protein, 7 aa, Mycobacterium tuberculosis
ARQQPEA

SEQ ID NO: 1433497 - protein, 4 aa, Mycobacterium tuberculosis
ARQT

SEQ ID NO: 1433498 - protein, 15 aa, Mycobacterium tuberculosis
ARRDSAHSAGGGGTM

SEQ ID NO: 1433499 - protein, 9 aa, Mycobacterium tuberculosis
ARRSAGAHP

SEQ ID NO: 1433500 - protein, 9 aa, Mycobacterium tuberculosis
ARRTGRTRS

SEQ ID NO: 1433501 - protein, 12 aa, Mycobacterium tuberculosis
ARSREDHRTLGT

SEQ ID NO: 1433502 - protein, 12 aa, Mycobacterium tuberculosis
ARTLGTDAVDEA

SEQ ID NO: 1433503 - protein, 6 aa, Mycobacterium tuberculosis
ARTTGT

SEQ ID NO: 1433504 - protein, 13 aa, Mycobacterium tuberculosis
ARVGPRSSPTSTR

SEQ ID NO: 1433505 - protein, 22 aa, Mycobacterium tuberculosis
ASAASAAGTAIGTGSTPGSTLT

SEQ ID NO: 1433506 - protein, 7 aa, Mycobacterium tuberculosis
ASADEGR

SEQ ID NO: 1433507 - protein, 9 aa, Mycobacterium tuberculosis
ASADGGVPR

SEQ ID NO: 1433508 - protein, 16 aa, Mycobacterium tuberculosis
ASAEATDSKAAARLGS

SEQ ID NO: 1433509 - protein, 4 aa, Mycobacterium tuberculosis
ASAN

SEQ ID NO: 1433510 - protein, 12 aa, Mycobacterium tuberculosis
ASAPQTTPAPPI

SEQ ID NO: 1433511 - protein, 7 aa, Mycobacterium tuberculosis
ASASSQF

SEQ ID NO: 1433512 - protein, 4 aa, Mycobacterium tuberculosis
ASAV

SEQ ID NO: 1433513 - protein, 8 aa, Mycobacterium tuberculosis
ASDAGTHH

SEQ ID NO: 1433514 - protein, 8 aa, Mycobacterium tuberculosis
ASDFNARS

SEQ ID NO: 1433515 - protein, 4 aa, Mycobacterium tuberculosis
ASDP

SEQ ID NO: 1433516 - protein, 7 aa, Mycobacterium tuberculosis
ASEQPTS

SEQ ID NO: 1433517 - protein, 4 aa, Mycobacterium tuberculosis
ASER

SEQ ID NO: 1433518 - protein, 27 aa, Mycobacterium tuberculosis
ASFPPAPASANLPKPNGQTPPPTSDDL

SEQ ID NO: 1433519 - protein, 26 aa, Mycobacterium tuberculosis
ASGGAGGAGGSGGTGGAGGTGGAGGL

SEQ ID NO: 1433520 - protein, 6 aa, Mycobacterium tuberculosis
ASGGGV

SEQ ID NO: 1433521 - protein, 7 aa, Mycobacterium tuberculosis
ASGGQCG

SEQ ID NO: 1433522 - protein, 19 aa, Mycobacterium tuberculosis
ASGGTGGAGGTGGAGGRGG

SEQ ID NO: 1433523 - protein, 11 aa, Mycobacterium tuberculosis
ASGHGDALASD

SEQ ID NO: 1433524 - protein, 18 aa, Mycobacterium tuberculosis
ASGHGDALASDGMLAQPR

SEQ ID NO: 1433525 - protein, 6 aa, Mycobacterium tuberculosis
ASGLTV

SEQ ID NO: 1433526 - protein, 6 aa, Mycobacterium tuberculosis
ASGPSL

SEQ ID NO: 1433527 - protein, 11 aa, Mycobacterium tuberculosis
ASGRGGQAADI

SEQ ID NO: 1433528 - protein, 12 aa, Mycobacterium tuberculosis
ASGRGGQAADIA

SEQ ID NO: 1433529 - protein, 5 aa, Mycobacterium tuberculosis
ASGRL

SEQ ID NO: 1433530 - protein, 11 aa, Mycobacterium tuberculosis
ASGTPGQHTPS

SEQ ID NO: 1433531 - protein, 4 aa, Mycobacterium tuberculosis
ASHH

SEQ ID NO: 1433532 - protein, 9 aa, Mycobacterium tuberculosis
ASLEQAQEN

SEQ ID NO: 1433533 - protein, 52 aa, Mycobacterium tuberculosis; identical to SEQ ID NO: 170067

SEQ ID NO: 1433534 - protein, 7 aa, Mycobacterium tuberculosis
ASLRDRE

SEQ ID NO: 1433535 - protein, 9 aa, Mycobacterium tuberculosis
ASNASGQAG

SEQ ID NO: 1433536 - protein, 9 aa, Mycobacterium tuberculosis
ASNDEADEL

SEQ ID NO: 1433537 - protein, 16 aa, Mycobacterium tuberculosis
ASPDWKPGAVPGDDLS

SEQ ID NO: 1433538 - protein, 6 aa, Mycobacterium tuberculosis
ASPGAG

SEQ ID NO: 1433539 - protein, 6 aa, Mycobacterium tuberculosis
ASPNAL

SEQ ID NO: 1433540 - protein, 16 aa, Mycobacterium tuberculosis
ASPQNVDAYSGTGNAH

SEQ ID NO: 1433541 - protein, 6 aa, Mycobacterium tuberculosis
ASPRQT

SEQ ID NO: 1433542 - protein, 7 aa, Mycobacterium tuberculosis
ASQYPNR

SEQ ID NO: 1433543 - protein, 6 aa, Mycobacterium tuberculosis
ASRPAD

SEQ ID NO: 1433544 - protein, 14 aa, Mycobacterium tuberculosis
ASRTRLHASTDDVR

SEQ ID NO: 1433545 - protein, 9 aa, Mycobacterium tuberculosis
ASSAAAAQL

SEQ ID NO: 1433546 - protein, 8 aa, Mycobacterium tuberculosis
ASSGGLAR

SEQ ID NO: 1433547 - protein, 5 aa, Mycobacterium tuberculosis
ASSIG

SEQ ID NO: 1433548 - protein, 5 aa, Mycobacterium tuberculosis
ASTLQ

SEQ ID NO: 1433549 - protein, 4 aa, Mycobacterium tuberculosis
ASVG

SEQ ID NO: 1433550 - protein, 6 aa, Mycobacterium tuberculosis
ASYEES

SEQ ID NO: 1433551 - protein, 6 aa, Mycobacterium tuberculosis
ATADLS

SEQ ID NO: 1433552 - protein, 7 aa, Mycobacterium tuberculosis
ATAEERS

SEQ ID NO: 1433553 - protein, 7 aa, Mycobacterium tuberculosis
ATAGLGP

SEQ ID NO: 1433554 - protein, 10 aa, Mycobacterium tuberculosis
ATAGNEKRRD

SEQ ID NO: 1433555 - protein, 6 aa, Mycobacterium tuberculosis
ATAIQR

SEQ ID NO: 1433556 - protein, 7 aa, Mycobacterium tuberculosis
ATALGTD

SEQ ID NO: 1433557 - protein, 9 aa, Mycobacterium tuberculosis
ATAPGGPVG

SEQ ID NO: 1433558 - protein, 6 aa, Mycobacterium tuberculosis
ATASSY

SEQ ID NO: 1433559 - protein, 7 aa, Mycobacterium tuberculosis
ATATGLP

SEQ ID NO: 1433560 - protein, 7 aa, Mycobacterium tuberculosis
ATDIDGI

SEQ ID NO: 1433561 - protein, 11 aa, Mycobacterium tuberculosis
ATGATAPLGSH

SEQ ID NO: 1433562 - protein, 15 aa, Mycobacterium tuberculosis
ATGDFRRGSISENYR

SEQ ID NO: 1433563 - protein, 10 aa, Mycobacterium tuberculosis
ATGDKATMPS

SEQ ID NO: 1433564 - protein, 12 aa, Mycobacterium tuberculosis
ATGEDVVTSAQS

SEQ ID NO: 1433565 - protein, 10 aa, Mycobacterium tuberculosis
ATGQNQPATG

SEQ ID NO: 1433566 - protein, 5 aa, Mycobacterium tuberculosis
ATIAA

SEQ ID NO: 1433567 - protein, 11 aa, Mycobacterium tuberculosis
ATKAALGDHDE

SEQ ID NO: 1433568 - protein, 5 aa, Mycobacterium tuberculosis
ATLDT

SEQ ID NO: 1433569 - protein, 16 aa, Mycobacterium tuberculosis
ATLTDGAGPVNSKTVQ

SEQ ID NO: 1433570 - protein, 7 aa, Mycobacterium tuberculosis
ATNPRAQ

SEQ ID NO: 1433571 - protein, 8 aa, Mycobacterium tuberculosis
ATPAGPAQ

SEQ ID NO: 1433572 - protein, 6 aa, Mycobacterium tuberculosis
ATPAQA

SEQ ID NO: 1433573 - protein, 5 aa, Mycobacterium tuberculosis
ATPDQ

SEQ ID NO: 1433574 - protein, 6 aa, Mycobacterium tuberculosis
ATPEQI

SEQ ID NO: 1433575 - protein, 7 aa, Mycobacterium tuberculosis
ATPGDGW

SEQ ID NO: 1433576 - protein, 7 aa, Mycobacterium tuberculosis
ATPVTPT

SEQ ID NO: 1433577 - protein, 10 aa, Mycobacterium tuberculosis
ATRGFGDTEF

SEQ ID NO: 1433578 - protein, 10 aa, Mycobacterium tuberculosis
ATSAAARTLT

SEQ ID NO: 1433579 - protein, 13 aa, Mycobacterium tuberculosis
ATSNTLPEQLGEG

SEQ ID NO: 1433580 - protein, 8 aa, Mycobacterium tuberculosis
ATSQRKID

SEQ ID NO: 1433581 - protein, 36 aa, Mycobacterium tuberculosis; identical to SEQ ID NO: 231986

SEQ ID NO: 1433582 - protein, 14 aa, Mycobacterium tuberculosis
ATTAAANGLTQSLG

SEQ ID NO: 1433583 - protein, 7 aa, Mycobacterium tuberculosis
ATTAEAY

SEQ ID NO: 1433584 - protein, 7 aa, Mycobacterium tuberculosis
ATTAPVD

SEQ ID NO: 1433585 - protein, 8 aa, Mycobacterium tuberculosis
ATVKGGTY

SEQ ID NO: 1433586 - protein, 5 aa, Mycobacterium tuberculosis
ATYDQ

SEQ ID NO: 1433587 - protein, 8 aa, Mycobacterium tuberculosis
AVDPGGEV

SEQ ID NO: 1433588 - protein, 15 aa, Mycobacterium tuberculosis
AVGESGIGYAAGDAV

SEQ ID NO: 1433589 - protein, 9 aa, Mycobacterium tuberculosis
AVGSPAPAF

SEQ ID NO: 1433590 - protein, 4 aa, Mycobacterium tuberculosis
AVQT

SEQ ID NO: 1433591 - protein, 12 aa, Mycobacterium tuberculosis
AVRDDAARAGVK

SEQ ID NO: 1433592 - protein, 5 aa, Mycobacterium tuberculosis
AVRDG

SEQ ID NO: 1433593 - protein, 38 aa, Mycobacterium tuberculosis
AVREPSTPGSGIPKSNFYPSPDRESAYASPRIGQPVGS

SEQ ID NO: 1433594 - protein, 5 aa, Mycobacterium tuberculosis
AVSEK

SEQ ID NO: 1433595 - protein, 9 aa, Mycobacterium tuberculosis
AVSGLRGSE

SEQ ID NO: 1433596 - protein, 20 aa, Mycobacterium tuberculosis
AVSPYGSGALAGSSLGLDPD

SEQ ID NO: 1433597 - protein, 5 aa, Mycobacterium tuberculosis
AVTGK

SEQ ID NO: 1433598 - protein, 8 aa, Mycobacterium tuberculosis
AVTPEQAP

SEQ ID NO: 1433599 - protein, 16 aa, Mycobacterium tuberculosis
AVTPPGRPAGKPWTYT

SEQ ID NO: 1433600 - protein, 20 aa, Mycobacterium tuberculosis
AVVSGGPDIRPALGDPADVA

SEQ ID NO: 1433601 - protein, 7 aa, Mycobacterium tuberculosis
AYHRPDT

SEQ ID NO: 1433602 - protein, 4 aa, Mycobacterium tuberculosis
AYKS

SEQ ID NO: 1433603 - protein, 15 aa, Mycobacterium tuberculosis
AYNDTRRKVVPPEEI

SEQ ID NO: 1433604 - protein, 9 aa, Mycobacterium tuberculosis
AYQAASAQA

SEQ ID NO: 1433605 - protein, 6 aa, Mycobacterium tuberculosis
AYSPGD

SEQ ID NO: 1433606 - protein, 5 aa, Mycobacterium tuberculosis
AYTNP

SEQ ID NO: 1433607 - protein, 13 aa, Mycobacterium tuberculosis
CAQPQPGQSAPSI

SEQ ID NO: 1433608 - protein, 4 aa, Mycobacterium tuberculosis
CARA

SEQ ID NO: 1433609 - protein, 14 aa, Mycobacterium tuberculosis
CASDPSSDSASTAT

SEQ ID NO: 1433610 - protein, 4 aa, Mycobacterium tuberculosis
CGGA

SEQ ID NO: 1433611 - protein, 7 aa, Mycobacterium tuberculosis
CGSPTTA

SEQ ID NO: 1433612 - protein, 4 aa, Mycobacterium tuberculosis
CGTP

SEQ ID NO: 1433613 - protein, 6 aa, Mycobacterium tuberculosis
CLPEGV

SEQ ID NO: 1433614 - protein, 4 aa, Mycobacterium tuberculosis
CPAS

SEQ ID NO: 1433615 - protein, 6 aa, Mycobacterium tuberculosis
CPSALN

SEQ ID NO: 1433616 - protein, 8 aa, Mycobacterium tuberculosis
CQGEVGSA

SEQ ID NO: 1433617 - protein, 4 aa, Mycobacterium tuberculosis
CQTE

SEQ ID NO: 1433618 - protein, 22 aa, Mycobacterium tuberculosis
CRNTTDHHHDDETTNITNQLVQ

SEQ ID NO: 1433619 - protein, 4 aa, Mycobacterium tuberculosis
CSAP

SEQ ID NO: 1433620 - protein, 13 aa, Mycobacterium tuberculosis
CSAVDHSSRTPYR

SEQ ID NO: 1433621 - protein, 26 aa, Mycobacterium tuberculosis
CSQPAPRAIGASSRHASAGPVPPAPV

SEQ ID NO: 1433622 - protein, 9 aa, Mycobacterium tuberculosis
CTPDEVDPD

SEQ ID NO: 1433623 - protein, 11 aa, Mycobacterium tuberculosis
CTTRNKRRAAR

SEQ ID NO: 1433624 - protein, 9 aa, Mycobacterium tuberculosis
DAAARELTD

SEQ ID NO: 1433625 - protein, 19 aa, Mycobacterium tuberculosis
DAADAEALATAAAADAEPD

SEQ ID NO: 1433626 - protein, 8 aa, Mycobacterium tuberculosis
DAADGLRA

SEQ ID NO: 1433627 - protein, 22 aa, Mycobacterium tuberculosis
DAARRAAEGAAGVPAARRGRGL

SEQ ID NO: 1433628 - protein, 6 aa, Mycobacterium tuberculosis
DADGSI

SEQ ID NO: 1433629 - protein, 8 aa, Mycobacterium tuberculosis
DADRNGTM

SEQ ID NO: 1433630 - protein, 5 aa, Mycobacterium tuberculosis
DAEPV

SEQ ID NO: 1433631 - protein, 8 aa, Mycobacterium tuberculosis
DAERQAAE

SEQ ID NO: 1433632 - protein, 16 aa, Mycobacterium tuberculosis
DAGAEIARRSRGTPRI

SEQ ID NO: 1433633 - protein, 5 aa, Mycobacterium tuberculosis
DAGAQ

SEQ ID NO: 1433634 - protein, 25 aa, Mycobacterium tuberculosis
DAGAVARPASVSSGRSLPATLTARG

SEQ ID NO: 1433635 - protein, 8 aa, Mycobacterium tuberculosis
DAGKSAVT

SEQ ID NO: 1433636 - protein, 15 aa, Mycobacterium tuberculosis
DAGPKNVKTQIQGDE

SEQ ID NO: 1433637 - protein, 8 aa, Mycobacterium tuberculosis
DAGSNREA

SEQ ID NO: 1433638 - protein, 5 aa, Mycobacterium tuberculosis
DAHNV

SEQ ID NO: 1433639 - protein, 10 aa, Mycobacterium tuberculosis
DAHRPTKSAA

SEQ ID NO: 1433640 - protein, 19 aa, Mycobacterium tuberculosis
DAIRDGASGRPAPSHFSTR

SEQ ID NO: 1433641 - protein, 8 aa, Mycobacterium tuberculosis
DAKEGPRA

SEQ ID NO: 1433642 - protein, 18 aa, Mycobacterium tuberculosis
DAMDAAAQSAAADADPAK

SEQ ID NO: 1433643 - protein, 5 aa, Mycobacterium tuberculosis
DANGQ

SEQ ID NO: 1433644 - protein, 11 aa, Mycobacterium tuberculosis
DAPGGGLGGSS

SEQ ID NO: 1433645 - protein, 6 aa, Mycobacterium tuberculosis
DAPGRR

SEQ ID NO: 1433646 - protein, 7 aa, Mycobacterium tuberculosis
DAPLETQ

SEQ ID NO: 1433647 - protein, 5 aa, Mycobacterium tuberculosis
DAPRL

SEQ ID NO: 1433648 - protein, 6 aa, Mycobacterium tuberculosis
DAQPIT

SEQ ID NO: 1433649 - protein, 6 aa, Mycobacterium tuberculosis
DARPIG

SEQ ID NO: 1433650 - protein, 9 aa, Mycobacterium tuberculosis
DARPTSDPR

SEQ ID NO: 1433651 - protein, 12 aa, Mycobacterium tuberculosis
DASADGYVRGEG

SEQ ID NO: 1433652 - protein, 6 aa, Mycobacterium tuberculosis
DASAND

SEQ ID NO: 1433653 - protein, 23 aa, Mycobacterium tuberculosis
DASGYEPHDQQPQQQQQQQQQAF

SEQ ID NO: 1433654 - protein, 6 aa, Mycobacterium tuberculosis
DASPRL

SEQ ID NO: 1433655 - protein, 8 aa, Mycobacterium tuberculosis
DASYEPKW

SEQ ID NO: 1433656 - protein, 4 aa, Mycobacterium tuberculosis
DAVA

SEQ ID NO: 1433657 - protein, 4 aa, Mycobacterium tuberculosis
DAVE

SEQ ID NO: 1433658 - protein, 7 aa, Mycobacterium tuberculosis
DAVPSDA

SEQ ID NO: 1433659 - protein, 5 aa, Mycobacterium tuberculosis
DDEAR

SEQ ID NO: 1433660 - protein, 5 aa, Mycobacterium tuberculosis
DDGPA

SEQ ID NO: 1433661 - protein, 12 aa, Mycobacterium tuberculosis
DDGSGETDEDQK

SEQ ID NO: 1433662 - protein, 4 aa, Mycobacterium tuberculosis
DDGV

SEQ ID NO: 1433663 - protein, 6 aa, Mycobacterium tuberculosis
DDHRRR

SEQ ID NO: 1433664 - protein, 7 aa, Mycobacterium tuberculosis
DDKERAE

SEQ ID NO: 1433665 - protein, 6 aa, Mycobacterium tuberculosis
DDPDDY

SEQ ID NO: 1433666 - protein, 13 aa, Mycobacterium tuberculosis
DDPTTHDDVRADH

SEQ ID NO: 1433667 - protein, 10 aa, Mycobacterium tuberculosis
DDRRRQRGRC

SEQ ID NO: 1433668 - protein, 4 aa, Mycobacterium tuberculosis
DDSV

SEQ ID NO: 1433669 - protein, 5 aa, Mycobacterium tuberculosis
DDTDR

SEQ ID NO: 1433670 - protein, 17 aa, Mycobacterium tuberculosis
DDVTGQDGSGDGTDPRT

SEQ ID NO: 1433671 - protein, 5 aa, Mycobacterium tuberculosis
DEEDR

SEQ ID NO: 1433672 - protein, 45 aa, Mycobacterium tuberculosis
DEEERRLTSAGDDAERSDEEERRLTSAGDDAERSDEEERRLTSAE

SEQ ID NO: 1433673 - protein, 9 aa, Mycobacterium tuberculosis
DEGAAATEL

SEQ ID NO: 1433674 - protein, 7 aa, Mycobacterium tuberculosis
DEGDSWA

SEQ ID NO: 1433675 - protein, 9 aa, Mycobacterium tuberculosis
DEGPRESSL

SEQ ID NO: 1433676 - protein, 4 aa, Mycobacterium tuberculosis
DEKW

SEQ ID NO: 1433677 - protein, 6 aa, Mycobacterium tuberculosis
DELPAK

SEQ ID NO: 1433678 - protein, 4 aa, Mycobacterium tuberculosis
DENS

SEQ ID NO: 1433679 - protein, 6 aa, Mycobacterium tuberculosis
DERNGG

SEQ ID NO: 1433680 - protein, 8 aa, Mycobacterium tuberculosis
DERPNTLR

SEQ ID NO: 1433681 - protein, 7 aa, Mycobacterium tuberculosis
DERTVAP

SEQ ID NO: 1433682 - protein, 6 aa, Mycobacterium tuberculosis
DETAGQ

SEQ ID NO: 1433683 - protein, 8 aa, Mycobacterium tuberculosis
DETERRRA

SEQ ID NO: 1433684 - protein, 5 aa, Mycobacterium tuberculosis
DETGV

SEQ ID NO: 1433685 - protein, 7 aa, Mycobacterium tuberculosis
DETSRTF

SEQ ID NO: 1433686 - protein, 16 aa, Mycobacterium tuberculosis
DGADGTAPGQNGGAGG

SEQ ID NO: 1433687 - protein, 15 aa, Mycobacterium tuberculosis
DGANGAPGQPGGPGG

SEQ ID NO: 1433688 - protein, 15 aa, Mycobacterium tuberculosis
DGANGTAENPDGQNG

SEQ ID NO: 1433689 - protein, 11 aa, Mycobacterium tuberculosis
DGAPQRPAKPV

SEQ ID NO: 1433690 - protein, 7 aa, Mycobacterium tuberculosis
DGDPQLA

SEQ ID NO: 1433691 - protein, 5 aa, Mycobacterium tuberculosis
DGEMD

SEQ ID NO: 1433692 - protein, 9 aa, Mycobacterium tuberculosis
DGGADPAVR

SEQ ID NO: 1433693 - protein, 72 aa, Mycobacterium tuberculosis; identical to SEQ ID NO: 171461

SEQ ID NO: 1433694 - protein, 32 aa, Mycobacterium tuberculosis
DGGAGGHGGQGAIGLGGGAGGDGGQGGAGRGL

SEQ ID NO: 1433695 - protein, 60 aa, Mycobacterium tuberculosis; identical to SEQ ID NO: 171479

SEQ ID NO: 1433696 - protein, 17 aa, Mycobacterium tuberculosis
DGGVMTGADAAKISDRA

SEQ ID NO: 1433697 - protein, 13 aa, Mycobacterium tuberculosis
DGLSGYPNRHESP

SEQ ID NO: 1433698 - protein, 6 aa, Mycobacterium tuberculosis
DGMHGS

SEQ ID NO: 1433699 - protein, 13 aa, Mycobacterium tuberculosis
DGNGAPGERTFRS

SEQ ID NO: 1433700 - protein, 4 aa, Mycobacterium tuberculosis
DGNQ

SEQ ID NO: 1433701 - protein, 7 aa, Mycobacterium tuberculosis
DGPPPGQ

SEQ ID NO: 1433702 - protein, 24 aa, Mycobacterium tuberculosis
DGPTPPPPGAPHPSGGADGPYSDP

SEQ ID NO: 1433703 - protein, 22 aa, Mycobacterium tuberculosis
DGQLAGSMSTDDANPDGQNSAN

SEQ ID NO: 1433704 - protein, 5 aa, Mycobacterium tuberculosis
DGSVA

SEQ ID NO: 1433705 - protein, 10 aa, Mycobacterium tuberculosis
DGTDAEGVAR

SEQ ID NO: 1433706 - protein, 5 aa, Mycobacterium tuberculosis
DGTDV

SEQ ID NO: 1433707 - protein, 8 aa, Mycobacterium tuberculosis
DGVADGEA

SEQ ID NO: 1433708 - protein, 21 aa, Mycobacterium tuberculosis
DGVTGSAGLQPGPSEETDEEL

SEQ ID NO: 1433709 - protein, 9 aa, Mycobacterium tuberculosis
DGYVPGDGG

SEQ ID NO: 1433710 - protein, 12 aa, Mycobacterium tuberculosis
DHEGQRREVTTA

SEQ ID NO: 1433711 - protein, 4 aa, Mycobacterium tuberculosis
DHGP

SEQ ID NO: 1433712 - protein, 4 aa, Mycobacterium tuberculosis
DHNV

SEQ ID NO: 1433713 - protein, 4 aa, Mycobacterium tuberculosis
DHPD

SEQ ID NO: 1433714 - protein, 4 aa, Mycobacterium tuberculosis
DHSD

SEQ ID NO: 1433715 - protein, 6 aa, Mycobacterium tuberculosis
DHSDDV

SEQ ID NO: 1433716 - protein, 23 aa, Mycobacterium tuberculosis
DIGAQAKRGLDANTARSQEAIGR

SEQ ID NO: 1433717 - protein, 6 aa, Mycobacterium tuberculosis
DIGAQR

SEQ ID NO: 1433718 - protein, 11 aa, Mycobacterium tuberculosis
DIGEESENAAF

SEQ ID NO: 1433719 - protein, 8 aa, Mycobacterium tuberculosis
DIPEPDSG

SEQ ID NO: 1433720 - protein, 16 aa, Mycobacterium tuberculosis
DIRPRRRREIPHVREV

SEQ ID NO: 1433721 - protein, 9 aa, Mycobacterium tuberculosis
DKDFTNESA

SEQ ID NO: 1433722 - protein, 6 aa, Mycobacterium tuberculosis
DKGTVT

SEQ ID NO: 1433723 - protein, 7 aa, Mycobacterium tuberculosis
DKIAESG

SEQ ID NO: 1433724 - protein, 5 aa, Mycobacterium tuberculosis
DKSQI

SEQ ID NO: 1433725 - protein, 12 aa, Mycobacterium tuberculosis
DKTTAKDGPLEQ

SEQ ID NO: 1433726 - protein, 5 aa, Mycobacterium tuberculosis
DLAGI

SEQ ID NO: 1433727 - protein, 5 aa, Mycobacterium tuberculosis
DLDGQ

SEQ ID NO: 1433728 - protein, 6 aa, Mycobacterium tuberculosis
DLDPAA

SEQ ID NO: 1433729 - protein, 8 aa, Mycobacterium tuberculosis
DLESKASE

SEQ ID NO: 1433730 - protein, 4 aa, Mycobacterium tuberculosis
DLGP

SEQ ID NO: 1433731 - protein, 26 aa, Mycobacterium tuberculosis
DLGPGRQPSPASVPAQPSATAAITPA

SEQ ID NO: 1433732 - protein, 9 aa, Mycobacterium tuberculosis
DLGSAAASF

SEQ ID NO: 1433733 - protein, 4 aa, Mycobacterium tuberculosis
DLPP

SEQ ID NO: 1433734 - protein, 7 aa, Mycobacterium tuberculosis
DLPPRPC

SEQ ID NO: 1433735 - protein, 5 aa, Mycobacterium tuberculosis
DLRPP

SEQ ID NO: 1433736 - protein, 6 aa, Mycobacterium tuberculosis
DLSEGG

SEQ ID NO: 1433737 - protein, 18 aa, Mycobacterium tuberculosis
DLTGSRVSAAEGKRLAAK

SEQ ID NO: 1433738 - protein, 8 aa, Mycobacterium tuberculosis
DLYGRRSR

SEQ ID NO: 1433739 - protein, 18 aa, Mycobacterium tuberculosis
DNAGRPAIRSQRVGNTGR

SEQ ID NO: 1433740 - protein, 15 aa, Mycobacterium tuberculosis
DNATRSELAAWAARH

SEQ ID NO: 1433741 - protein, 4 aa, Mycobacterium tuberculosis
DNGV

SEQ ID NO: 1433742 - protein, 6 aa, Mycobacterium tuberculosis
DNTYPG

SEQ ID NO: 1433743 - protein, 7 aa, Mycobacterium tuberculosis
DPAAHVG

SEQ ID NO: 1433744 - protein, 6 aa, Mycobacterium tuberculosis
DPADTR

SEQ ID NO: 1433745 - protein, 8 aa, Mycobacterium tuberculosis
DPAKHRGY

SEQ ID NO: 1433746 - protein, 12 aa, Mycobacterium tuberculosis
DPAPTAASGAAA

SEQ ID NO: 1433747 - protein, 10 aa, Mycobacterium tuberculosis
DPDDWNPPEF

SEQ ID NO: 1433748 - protein, 8 aa, Mycobacterium tuberculosis
DPDRGANG

SEQ ID NO: 1433749 - protein, 12 aa, Mycobacterium tuberculosis
DPDRRNAVTDEM

SEQ ID NO: 1433750 - protein, 7 aa, Mycobacterium tuberculosis
DPDRTLA

SEQ ID NO: 1433751 - protein, 6 aa, Mycobacterium tuberculosis
DPENTD

SEQ ID NO: 1433752 - protein, 6 aa, Mycobacterium tuberculosis
DPFRRP

SEQ ID NO: 1433753 - protein, 14 aa, Mycobacterium tuberculosis
DPITDDDATNPLTE

SEQ ID NO: 1433754 - protein, 6 aa, Mycobacterium tuberculosis
DPLPVK

SEQ ID NO: 1433755 - protein, 6 aa, Mycobacterium tuberculosis
DPMDNG

SEQ ID NO: 1433756 - protein, 5 aa, Mycobacterium tuberculosis
DPNRP

SEQ ID NO: 1433757 - protein, 10 aa, Mycobacterium tuberculosis
DPNTEGEATA

SEQ ID NO: 1433758 - protein, 7 aa, Mycobacterium tuberculosis
DPNTGQI

SEQ ID NO: 1433759 - protein, 11 aa, Mycobacterium tuberculosis
DPPDRWRESRR

SEQ ID NO: 1433760 - protein, 7 aa, Mycobacterium tuberculosis
DPQPDPF

SEQ ID NO: 1433761 - protein, 7 aa, Mycobacterium tuberculosis
DPRSGTH

SEQ ID NO: 1433762 - protein, 4 aa, Mycobacterium tuberculosis
DPRV

SEQ ID NO: 1433763 - protein, 6 aa, Mycobacterium tuberculosis
DPSRDA

SEQ ID NO: 1433764 - protein, 8 aa, Mycobacterium tuberculosis
DPTAPEIP

SEQ ID NO: 1433765 - protein, 7 aa, Mycobacterium tuberculosis
DPWPPAA

SEQ ID NO: 1433766 - protein, 4 aa, Mycobacterium tuberculosis
DPWT

SEQ ID NO: 1433767 - protein, 9 aa, Mycobacterium tuberculosis
DQAPDAVDG

SEQ ID NO: 1433768 - protein, 4 aa, Mycobacterium tuberculosis
DQER

SEQ ID NO: 1433769 - protein, 5 aa, Mycobacterium tuberculosis
DQGEV

SEQ ID NO: 1433770 - protein, 6 aa, Mycobacterium tuberculosis
DQHAAD

SEQ ID NO: 1433771 - protein, 7 aa, Mycobacterium tuberculosis
DQLPNRT

SEQ ID NO: 1433772 - protein, 4 aa, Mycobacterium tuberculosis
DQNL

SEQ ID NO: 1433773 - protein, 13 aa, Mycobacterium tuberculosis
DQRPGTKKCGHQG

SEQ ID NO: 1433774 - protein, 8 aa, Mycobacterium tuberculosis
DQTDPNAP

SEQ ID NO: 1433775 - protein, 7 aa, Mycobacterium tuberculosis
DRARTKT

SEQ ID NO: 1433776 - protein, 6 aa, Mycobacterium tuberculosis
DRATAD

SEQ ID NO: 1433777 - protein, 13 aa, Mycobacterium tuberculosis
DRATDTVNRYPDN

SEQ ID NO: 1433778 - protein, 5 aa, Mycobacterium tuberculosis
DRDDA

SEQ ID NO: 1433779 - protein, 6 aa, Mycobacterium tuberculosis
DRDRNA

SEQ ID NO: 1433780 - protein, 5 aa, Mycobacterium tuberculosis
DRFDP

SEQ ID NO: 1433781 - protein, 4 aa, Mycobacterium tuberculosis
DRGF

SEQ ID NO: 1433782 - protein, 7 aa, Mycobacterium tuberculosis
DRGTRAA

SEQ ID NO: 1433783 - protein, 5 aa, Mycobacterium tuberculosis
DRHDR

SEQ ID NO: 1433784 - protein, 6 aa, Mycobacterium tuberculosis
DRIEAD

SEQ ID NO: 1433785 - protein, 8 aa, Mycobacterium tuberculosis
DRLERDPA

SEQ ID NO: 1433786 - protein, 7 aa, Mycobacterium tuberculosis
DRLRSGA

SEQ ID NO: 1433787 - protein, 4 aa, Mycobacterium tuberculosis
DRMR

SEQ ID NO: 1433788 - protein, 7 aa, Mycobacterium tuberculosis
DRMSREG

SEQ ID NO: 1433789 - protein, 9 aa, Mycobacterium tuberculosis
DRPSSVDGI

SEQ ID NO: 1433790 - protein, 6 aa, Mycobacterium tuberculosis
DRRDFD

SEQ ID NO: 1433791 - protein, 11 aa, Mycobacterium tuberculosis
DRRPLRNTREA

SEQ ID NO: 1433792 - protein, 4 aa, Mycobacterium tuberculosis
DRRQ

SEQ ID NO: 1433793 - protein, 20 aa, Mycobacterium tuberculosis
DRRQQKRAGRHRGTTGTEAA

SEQ ID NO: 1433794 - protein, 7 aa, Mycobacterium tuberculosis
DRSDPLA

SEQ ID NO: 1433795 - protein, 5 aa, Mycobacterium tuberculosis
DRTQA

SEQ ID NO: 1433796 - protein, 6 aa, Mycobacterium tuberculosis
DRVGAD

SEQ ID NO: 1433797 - protein, 13 aa, Mycobacterium tuberculosis
DSAGGAAVAAGAG

SEQ ID NO: 1433798 - protein, 8 aa, Mycobacterium tuberculosis
DSEADGTA

SEQ ID NO: 1433799 - protein, 5 aa, Mycobacterium tuberculosis
DSGHD

SEQ ID NO: 1433800 - protein, 19 aa, Mycobacterium tuberculosis
DSGSPVSPDYAPGSNAFNG

SEQ ID NO: 1433801 - protein, 6 aa, Mycobacterium tuberculosis
DSKPSA

SEQ ID NO: 1433802 - protein, 14 aa, Mycobacterium tuberculosis
DSKYPYTPDGNREF

SEQ ID NO: 1433803 - protein, 8 aa, Mycobacterium tuberculosis
DSLDRPSD

SEQ ID NO: 1433804 - protein, 6 aa, Mycobacterium tuberculosis
DSLSDD

SEQ ID NO: 1433805 - protein, 10 aa, Mycobacterium tuberculosis
DSNGDGVGDL

SEQ ID NO: 1433806 - protein, 7 aa, Mycobacterium tuberculosis
DSPRRKE

SEQ ID NO: 1433807 - protein, 6 aa, Mycobacterium tuberculosis
DSSGSV

SEQ ID NO: 1433808 - protein, 19 aa, Mycobacterium tuberculosis
DSSPPSEDYGRQPPQDLAA

SEQ ID NO: 1433809 - protein, 12 aa, Mycobacterium tuberculosis
DSSTSLADAEAA

SEQ ID NO: 1433810 - protein, 4 aa, Mycobacterium tuberculosis
DSYL

SEQ ID NO: 1433811 - protein, 5 aa, Mycobacterium tuberculosis
DTAEF

SEQ ID NO: 1433812 - protein, 23 aa, Mycobacterium tuberculosis
DTAHEARVEGAADPLDSQGAGDQ

SEQ ID NO: 1433813 - protein, 12 aa, Mycobacterium tuberculosis
DTDPGGQPPGTS

SEQ ID NO: 1433814 - protein, 7 aa, Mycobacterium tuberculosis
DTEAERE

SEQ ID NO: 1433815 - protein, 4 aa, Mycobacterium tuberculosis
DTER

SEQ ID NO: 1433816 - protein, 13 aa, Mycobacterium tuberculosis
DTETAKWRDPTGT

SEQ ID NO: 1433817 - protein, 5 aa, Mycobacterium tuberculosis
DTGAE

SEQ ID NO: 1433818 - protein, 6 aa, Mycobacterium tuberculosis
DTHDPV

SEQ ID NO: 1433819 - protein, 6 aa, Mycobacterium tuberculosis
DTLDND

SEQ ID NO: 1433820 - protein, 12 aa, Mycobacterium tuberculosis
DTPLRAQAATAG

SEQ ID NO: 1433821 - protein, 7 aa, Mycobacterium tuberculosis
DTQRMPE

SEQ ID NO: 1433822 - protein, 18 aa, Mycobacterium tuberculosis
DTTTEGPVTTSGATCADN

SEQ ID NO: 1433823 - protein, 7 aa, Mycobacterium tuberculosis
DTVDDTT

SEQ ID NO: 1433824 - protein, 14 aa, Mycobacterium tuberculosis
DTVGNPKLHGGDDQ

SEQ ID NO: 1433825 - protein, 4 aa, Mycobacterium tuberculosis
DTYI

SEQ ID NO: 1433826 - protein, 17 aa, Mycobacterium tuberculosis
DVAGRAAPLPAPPPSGC

SEQ ID NO: 1433827 - protein, 8 aa, Mycobacterium tuberculosis
DVIKSGGE

SEQ ID NO: 1433828 - protein, 12 aa, Mycobacterium tuberculosis
DWDPSQSTLPRT

SEQ ID NO: 1433829 - protein, 10 aa, Mycobacterium tuberculosis
DYSEDSAVDK

SEQ ID NO: 1433830 - protein, 4 aa, Mycobacterium tuberculosis
DYSV

SEQ ID NO: 1433831 - protein, 7 aa, Mycobacterium tuberculosis
EAAEKAK

SEQ ID NO: 1433832 - protein, 22 aa, Mycobacterium tuberculosis
EAAKGYATARARSGEELKVLLT

SEQ ID NO: 1433833 - protein, 8 aa, Mycobacterium tuberculosis
EAAPTAGL

SEQ ID NO: 1433834 - protein, 8 aa, Mycobacterium tuberculosis
EAARRYER

SEQ ID NO: 1433835 - protein, 7 aa, Mycobacterium tuberculosis
EAARTTY

SEQ ID NO: 1433836 - protein, 7 aa, Mycobacterium tuberculosis
EADALKA

SEQ ID NO: 1433837 - protein, 8 aa, Mycobacterium tuberculosis
EAEARRAR

SEQ ID NO: 1433838 - protein, 21 aa, Mycobacterium tuberculosis
EAEGAKADARRKVRDGGEREM

SEQ ID NO: 1433839 - protein, 4 aa, Mycobacterium tuberculosis
EAES

SEQ ID NO: 1433840 - protein, 7 aa, Mycobacterium tuberculosis
EAGGDWN

SEQ ID NO: 1433841 - protein, 4 aa, Mycobacterium tuberculosis
EAIG

SEQ ID NO: 1433842 - protein, 5 aa, Mycobacterium tuberculosis
EAKIE

SEQ ID NO: 1433843 - protein, 10 aa, Mycobacterium tuberculosis
EANGIDPQPL

SEQ ID NO: 1433844 - protein, 8 aa, Mycobacterium tuberculosis
EANSEPRM

SEQ ID NO: 1433845 - protein, 4 aa, Mycobacterium tuberculosis
EAPS

SEQ ID NO: 1433846 - protein, 4 aa, Mycobacterium tuberculosis
EAQI

SEQ ID NO: 1433847 - protein, 10 aa, Mycobacterium tuberculosis
EAQRTHQALT

SEQ ID NO: 1433848 - protein, 18 aa, Mycobacterium tuberculosis
EARAAARARGQDAGRGRV

SEQ ID NO: 1433849 - protein, 10 aa, Mycobacterium tuberculosis
EAREREPRGD

SEQ ID NO: 1433850 - protein, 10 aa, Mycobacterium tuberculosis
EASAGTPRSP

SEQ ID NO: 1433851 - protein, 8 aa, Mycobacterium tuberculosis
EASTAHAA

SEQ ID NO: 1433852 - protein, 5 aa, Mycobacterium tuberculosis
EATER

SEQ ID NO: 1433853 - protein, 10 aa, Mycobacterium tuberculosis
EATGRRPSAS

SEQ ID NO: 1433854 - protein, 4 aa, Mycobacterium tuberculosis
EATK

SEQ ID NO: 1433855 - protein, 6 aa, Mycobacterium tuberculosis
EATTDT

SEQ ID NO: 1433856 - protein, 5 aa, Mycobacterium tuberculosis
EATTV

SEQ ID NO: 1433857 - protein, 4 aa, Mycobacterium tuberculosis
EAVT

SEQ ID NO: 1433858 - protein, 6 aa, Mycobacterium tuberculosis
EAVTED

SEQ ID NO: 1433859 - protein, 4 aa, Mycobacterium tuberculosis
EDAA

SEQ ID NO: 1433860 - protein, 8 aa, Mycobacterium tuberculosis
EDGSERVL

SEQ ID NO: 1433861 - protein, 14 aa, Mycobacterium tuberculosis
EDLNAAREADTPAA

SEQ ID NO: 1433862 - protein, 7 aa, Mycobacterium tuberculosis
EDMPAAD

SEQ ID NO: 1433863 - protein, 5 aa, Mycobacterium tuberculosis
EDPAK

SEQ ID NO: 1433864 - protein, 10 aa, Mycobacterium tuberculosis
EDPGTQAHSV

SEQ ID NO: 1433865 - protein, 4 aa, Mycobacterium tuberculosis
EDPT

SEQ ID NO: 1433866 - protein, 10 aa, Mycobacterium tuberculosis
EDSHRSHTGA

SEQ ID NO: 1433867 - protein, 5 aa, Mycobacterium tuberculosis
EDVER

SEQ ID NO: 1433868 - protein, 15 aa, Mycobacterium tuberculosis
EDYDRVPADEPNPEQ

SEQ ID NO: 1433869 - protein, 8 aa, Mycobacterium tuberculosis
EEADRREG

SEQ ID NO: 1433870 - protein, 6 aa, Mycobacterium tuberculosis
EEAGPV

SEQ ID NO: 1433871 - protein, 12 aa, Mycobacterium tuberculosis
EEAQRTHQALTQ

SEQ ID NO: 1433872 - protein, 4 aa, Mycobacterium tuberculosis
EEGE

SEQ ID NO: 1433873 - protein, 5 aa, Mycobacterium tuberculosis
EEGEV

SEQ ID NO: 1433874 - protein, 27 aa, Mycobacterium tuberculosis
EEGKAPFANPRNSAAGSLRQKDPAVTA

SEQ ID NO: 1433875 - protein, 6 aa, Mycobacterium tuberculosis
EEIGYG

SEQ ID NO: 1433876 - protein, 14 aa, Mycobacterium tuberculosis
EELAEEPEGAEEVA

SEQ ID NO: 1433877 - protein, 22 aa, Mycobacterium tuberculosis
EELTGPPQKPAYAAKPATPEEV

SEQ ID NO: 1433878 - protein, 11 aa, Mycobacterium tuberculosis
EEPRPARPPHA

SEQ ID NO: 1433879 - protein, 5 aa, Mycobacterium tuberculosis
EETLQ

SEQ ID NO: 1433880 - protein, 5 aa, Mycobacterium tuberculosis
EEVSR

SEQ ID NO: 1433881 - protein, 15 aa, Mycobacterium tuberculosis
EEWHGPASASMTAAA

SEQ ID NO: 1433882 - protein, 7 aa, Mycobacterium tuberculosis
EGAAATE

SEQ ID NO: 1433883 - protein, 6 aa, Mycobacterium tuberculosis
EGAALN

SEQ ID NO: 1433884 - protein, 7 aa, Mycobacterium tuberculosis
EGDIDAD

SEQ ID NO: 1433885 - protein, 5 aa, Mycobacterium tuberculosis
EGEDF

SEQ ID NO: 1433886 - protein, 19 aa, Mycobacterium tuberculosis
EGHRKPPRYGWAGSTPSSI

SEQ ID NO: 1433887 - protein, 5 aa, Mycobacterium tuberculosis
EGKGD

SEQ ID NO: 1433888 - protein, 12 aa, Mycobacterium tuberculosis
EGKREEAERDAH

SEQ ID NO: 1433889 - protein, 8 aa, Mycobacterium tuberculosis
EGKSSQEY

SEQ ID NO: 1433890 - protein, 6 aa, Mycobacterium tuberculosis
EGMDSQ

SEQ ID NO: 1433891 - protein, 9 aa, Mycobacterium tuberculosis
EGPAYSEGL

SEQ ID NO: 1433892 - protein, 7 aa, Mycobacterium tuberculosis
EGRNATH

SEQ ID NO: 1433893 - protein, 12 aa, Mycobacterium tuberculosis
EGRRGQPRLRPP

SEQ ID NO: 1433894 - protein, 9 aa, Mycobacterium tuberculosis
EGSGLSKED

SEQ ID NO: 1433895 - protein, 4 aa, Mycobacterium tuberculosis
EGTM

SEQ ID NO: 1433896 - protein, 16 aa, Mycobacterium tuberculosis
EGTPYKEATAAELADR

SEQ ID NO: 1433897 - protein, 4 aa, Mycobacterium tuberculosis
EGTT

SEQ ID NO: 1433898 - protein, 18 aa, Mycobacterium tuberculosis
EGVAATAATAINANAASK

SEQ ID NO: 1433899 - protein, 7 aa, Mycobacterium tuberculosis
EGWQGQA

SEQ ID NO: 1433900 - protein, 14 aa, Mycobacterium tuberculosis
EHAHGGADQLSRGP

SEQ ID NO: 1433901 - protein, 10 aa, Mycobacterium tuberculosis
EHAKARGAKP

SEQ ID NO: 1433902 - protein, 8 aa, Mycobacterium tuberculosis
EHHSDSTE

SEQ ID NO: 1433903 - protein, 4 aa, Mycobacterium tuberculosis
EHKS

SEQ ID NO: 1433904 - protein, 6 aa, Mycobacterium tuberculosis
EHTVAE

SEQ ID NO: 1433905 - protein, 9 aa, Mycobacterium tuberculosis
EIAESGAAP

SEQ ID NO: 1433906 - protein, 5 aa, Mycobacterium tuberculosis
EIGGG

SEQ ID NO: 1433907 - protein, 9 aa, Mycobacterium tuberculosis
EIGRTQYGN

SEQ ID NO: 1433908 - protein, 12 aa, Mycobacterium tuberculosis
EIPEADAVEQGR

SEQ ID NO: 1433909 - protein, 4 aa, Mycobacterium tuberculosis
EIPN

SEQ ID NO: 1433910 - protein, 6 aa, Mycobacterium tuberculosis
EIREEV

SEQ ID NO: 1433911 - protein, 4 aa, Mycobacterium tuberculosis
EISP

SEQ ID NO: 1433912 - protein, 5 aa, Mycobacterium tuberculosis
EKAMR

SEQ ID NO: 1433913 - protein, 8 aa, Mycobacterium tuberculosis
EKDEAVKG

SEQ ID NO: 1433914 - protein, 9 aa, Mycobacterium tuberculosis
EKDSSINDD

SEQ ID NO: 1433915 - protein, 7 aa, Mycobacterium tuberculosis
EKEDESF

SEQ ID NO: 1433916 - protein, 4 aa, Mycobacterium tuberculosis
EKKQ

SEQ ID NO: 1433917 - protein, 10 aa, Mycobacterium tuberculosis
EKPDETQRTF

SEQ ID NO: 1433918 - protein, 12 aa, Mycobacterium tuberculosis
EKQARISTDIGA

SEQ ID NO: 1433919 - protein, 4 aa, Mycobacterium tuberculosis
EKRA

SEQ ID NO: 1433920 - protein, 16 aa, Mycobacterium tuberculosis
EKRPYPPGQHGRARIK

SEQ ID NO: 1433921 - protein, 4 aa, Mycobacterium tuberculosis
EKSY

SEQ ID NO: 1433922 - protein, 8 aa, Mycobacterium tuberculosis
EKVRGTGP

SEQ ID NO: 1433923 - protein, 9 aa, Mycobacterium tuberculosis
ELADQKEKL

SEQ ID NO: 1433924 - protein, 18 aa, Mycobacterium tuberculosis
ELGTAASSFSSVTTGLTG

SEQ ID NO: 1433925 - protein, 10 aa, Mycobacterium tuberculosis
ELPPQNDRAR

SEQ ID NO: 1433926 - protein, 9 aa, Mycobacterium tuberculosis
ELQSAAETY

SEQ ID NO: 1433927 - protein, 8 aa, Mycobacterium tuberculosis
ELRTEAGQ

SEQ ID NO: 1433928 - protein, 9 aa, Mycobacterium tuberculosis
ELSGPPADG

SEQ ID NO: 1433929 - protein, 7 aa, Mycobacterium tuberculosis
ELSQADE

SEQ ID NO: 1433930 - protein, 7 aa, Mycobacterium tuberculosis
EMKSTGE

SEQ ID NO: 1433931 - protein, 9 aa, Mycobacterium tuberculosis
EMYPGPDGV

SEQ ID NO: 1433932 - protein, 7 aa, Mycobacterium tuberculosis
ENADNRL

SEQ ID NO: 1433933 - protein, 15 aa, Mycobacterium tuberculosis
ENEVSGQLAATTGDV

SEQ ID NO: 1433934 - protein, 9 aa, Mycobacterium tuberculosis
ENPADTDRE

SEQ ID NO: 1433935 - protein, 6 aa, Mycobacterium tuberculosis
ENRAAV

SEQ ID NO: 1433936 - protein, 14 aa, Mycobacterium tuberculosis
ENRTAKGKVVLRVR

SEQ ID NO: 1433937 - protein, 5 aa, Mycobacterium tuberculosis
ENTRR

SEQ ID NO: 1433938 - protein, 12 aa, Mycobacterium tuberculosis
EPALASPRRPQA

SEQ ID NO: 1433939 - protein, 8 aa, Mycobacterium tuberculosis
EPDADSDI

SEQ ID NO: 1433940 - protein, 12 aa, Mycobacterium tuberculosis
EPDAEGKRPPEC

SEQ ID NO: 1433941 - protein, 7 aa, Mycobacterium tuberculosis
EPDNPAR

SEQ ID NO: 1433942 - protein, 20 aa, Mycobacterium tuberculosis
EPDVGSDPAAMKTRARRDGP

SEQ ID NO: 1433943 - protein, 4 aa, Mycobacterium tuberculosis
EPEH

SEQ ID NO: 1433944 - protein, 4 aa, Mycobacterium tuberculosis
EPEK

SEQ ID NO: 1433945 - protein, 5 aa, Mycobacterium tuberculosis
EPELA

SEQ ID NO: 1433946 - protein, 21 aa, Mycobacterium tuberculosis
EPGREYAEDIETGSAAAALGG

SEQ ID NO: 1433947 - protein, 11 aa, Mycobacterium tuberculosis
EPLSGHPPDGG

SEQ ID NO: 1433948 - protein, 6 aa, Mycobacterium tuberculosis
EPPGAA

SEQ ID NO: 1433949 - protein, 5 aa, Mycobacterium tuberculosis
EPQLP

SEQ ID NO: 1433950 - protein, 7 aa, Mycobacterium tuberculosis
EPQPELD

SEQ ID NO: 1433951 - protein, 9 aa, Mycobacterium tuberculosis
EPQSAGACG

SEQ ID NO: 1433952 - protein, 24 aa, Mycobacterium tuberculosis
EPRPEPEPDFRPDPRPSITRSADE

SEQ ID NO: 1433953 - protein, 7 aa, Mycobacterium tuberculosis
EPSCGDG

SEQ ID NO: 1433954 - protein, 23 aa, Mycobacterium tuberculosis
EPSPADDGTYQGKDGSGKVKWTG

SEQ ID NO: 1433955 - protein, 6 aa, Mycobacterium tuberculosis
EPSREI

SEQ ID NO: 1433956 - protein, 5 aa, Mycobacterium tuberculosis
EPTNH

SEQ ID NO: 1433957 - protein, 106 aa, Mycobacterium tuberculosis; identical to SEQ ID NO: 192452

SEQ ID NO: 1433958 - protein, 8 aa, Mycobacterium tuberculosis
EPVSSRGA

SEQ ID NO: 1433959 - protein, 11 aa, Mycobacterium tuberculosis
EPYAGSVTRAG

SEQ ID NO: 1433960 - protein, 9 aa, Mycobacterium tuberculosis
EQAAAAGHS

SEQ ID NO: 1433961 - protein, 9 aa, Mycobacterium tuberculosis
EQARIAEGA

SEQ ID NO: 1433962 - protein, 5 aa, Mycobacterium tuberculosis
EQPDL

SEQ ID NO: 1433963 - protein, 8 aa, Mycobacterium tuberculosis
EQRTRPGQ

SEQ ID NO: 1433964 - protein, 8 aa, Mycobacterium tuberculosis
EQSAKTGF

SEQ ID NO: 1433965 - protein, 7 aa, Mycobacterium tuberculosis
EQSRPEL

SEQ ID NO: 1433966 - protein, 4 aa, Mycobacterium tuberculosis
EQTD

SEQ ID NO: 1433967 - protein, 7 aa, Mycobacterium tuberculosis
EQVPPDR

SEQ ID NO: 1433968 - protein, 7 aa, Mycobacterium tuberculosis
ERARARG

SEQ ID NO: 1433969 - protein, 7 aa, Mycobacterium tuberculosis
ERGRNGE

SEQ ID NO: 1433970 - protein, 7 aa, Mycobacterium tuberculosis
ERIRTDE

SEQ ID NO: 1433971 - protein, 7 aa, Mycobacterium tuberculosis
ERKDKLE

SEQ ID NO: 1433972 - protein, 18 aa, Mycobacterium tuberculosis
ERLTSAAAAAAGPPSAAG

SEQ ID NO: 1433973 - protein, 7 aa, Mycobacterium tuberculosis
ERQSDAL

SEQ ID NO: 1433974 - protein, 14 aa, Mycobacterium tuberculosis
ERREALSSVQGEYG

SEQ ID NO: 1433975 - protein, 5 aa, Mycobacterium tuberculosis
ERRRG

SEQ ID NO: 1433976 - protein, 9 aa, Mycobacterium tuberculosis
ERRRSPEAH

SEQ ID NO: 1433977 - protein, 12 aa, Mycobacterium tuberculosis
ERRTKSKALTLP

SEQ ID NO: 1433978 - protein, 16 aa, Mycobacterium tuberculosis
ERVDPAKDADGLHPTN

SEQ ID NO: 1433979 - protein, 4 aa, Mycobacterium tuberculosis
ESAG

SEQ ID NO: 1433980 - protein, 5 aa, Mycobacterium tuberculosis
ESAVS

SEQ ID NO: 1433981 - protein, 12 aa, Mycobacterium tuberculosis
ESEAPAALTPTV

SEQ ID NO: 1433982 - protein, 22 aa, Mycobacterium tuberculosis
ESERLPRGADPNTHTKLGRGGL

SEQ ID NO: 1433983 - protein, 4 aa, Mycobacterium tuberculosis
ESHT

SEQ ID NO: 1433984 - protein, 13 aa, Mycobacterium tuberculosis
ESKVAAARSPIKA

SEQ ID NO: 1433985 - protein, 10 aa, Mycobacterium tuberculosis
ESPRRSPRRQ

SEQ ID NO: 1433986 - protein, 5 aa, Mycobacterium tuberculosis
ESRDA

SEQ ID NO: 1433987 - protein, 7 aa, Mycobacterium tuberculosis
ESRDVTR

SEQ ID NO: 1433988 - protein, 4 aa, Mycobacterium tuberculosis
ESSI

SEQ ID NO: 1433989 - protein, 6 aa, Mycobacterium tuberculosis
ESSRRA

SEQ ID NO: 1433990 - protein, 17 aa, Mycobacterium tuberculosis
ESTAARVDYPAGRVRAE

SEQ ID NO: 1433991 - protein, 14 aa, Mycobacterium tuberculosis
ESTADRCAERLSGK

SEQ ID NO: 1433992 - protein, 10 aa, Mycobacterium tuberculosis
ESTALDERIG

SEQ ID NO: 1433993 - protein, 15 aa, Mycobacterium tuberculosis
ESTPWPGVTRPTNIG

SEQ ID NO: 1433994 - protein, 37 aa, Mycobacterium tuberculosis
ESVDDGTAVADTAENDQADQGNSADTSGEQAESEPSG

SEQ ID NO: 1433995 - protein, 7 aa, Mycobacterium tuberculosis
ETAEQTA

SEQ ID NO: 1433996 - protein, 6 aa, Mycobacterium tuberculosis
ETGGRW

SEQ ID NO: 1433997 - protein, 10 aa, Mycobacterium tuberculosis
ETGSVPSPSQ

SEQ ID NO: 1433998 - protein, 5 aa, Mycobacterium tuberculosis
ETIQS

SEQ ID NO: 1433999 - protein, 27 aa, Mycobacterium tuberculosis
ETPADIDGSAADAGVGGVGGSTTGASG

SEQ ID NO: 1434000 - protein, 4 aa, Mycobacterium tuberculosis
ETPG

SEQ ID NO: 1434001 - protein, 5 aa, Mycobacterium tuberculosis
ETSDP

SEQ ID NO: 1434002 - protein, 7 aa, Mycobacterium tuberculosis
ETTPPGL

SEQ ID NO: 1434003 - protein, 14 aa, Mycobacterium tuberculosis
ETYRRRATAAGQSL

SEQ ID NO: 1434004 - protein, 5 aa, Mycobacterium tuberculosis
EVAVS

SEQ ID NO: 1434005 - protein, 8 aa, Mycobacterium tuberculosis
EVPVPGRT

SEQ ID NO: 1434006 - protein, 4 aa, Mycobacterium tuberculosis
EVQG

SEQ ID NO: 1434007 - protein, 15 aa, Mycobacterium tuberculosis
EVSSPDEGNCVGPTI

SEQ ID NO: 1434008 - protein, 10 aa, Mycobacterium tuberculosis
EWARGKRDQL

SEQ ID NO: 1434009 - protein, 9 aa, Mycobacterium tuberculosis
FAQDGVGGL

SEQ ID NO: 1434010 - protein, 11 aa, Mycobacterium tuberculosis
FASATPDTAVT

SEQ ID NO: 1434011 - protein, 8 aa, Mycobacterium tuberculosis
FDAEPDEL

SEQ ID NO: 1434012 - protein, 4 aa, Mycobacterium tuberculosis
FDAN

SEQ ID NO: 1434013 - protein, 7 aa, Mycobacterium tuberculosis
FDPQAKG

SEQ ID NO: 1434014 - protein, 6 aa, Mycobacterium tuberculosis
FEGNAA

SEQ ID NO: 1434015 - protein, 4 aa, Mycobacterium tuberculosis
FERQ

SEQ ID NO: 1434016 - protein, 9 aa, Mycobacterium tuberculosis
FERTPNGGV

SEQ ID NO: 1434017 - protein, 11 aa, Mycobacterium tuberculosis
FESATASAGTV

SEQ ID NO: 1434018 - protein, 5 aa, Mycobacterium tuberculosis
FETER

SEQ ID NO: 1434019 - protein, 4 aa, Mycobacterium tuberculosis
FGAA

SEQ ID NO: 1434020 - protein, 8 aa, Mycobacterium tuberculosis
FGAATGAA

SEQ ID NO: 1434021 - protein, 34 aa, Mycobacterium tuberculosis; identical to SEQ ID NO: 174361

SEQ ID NO: 1434022 - protein, 8 aa, Mycobacterium tuberculosis
FGEDPDVD

SEQ ID NO: 1434023 - protein, 7 aa, Mycobacterium tuberculosis
FGGRDNS

SEQ ID NO: 1434024 - protein, 10 aa, Mycobacterium tuberculosis
FGNAGNNNFG

SEQ ID NO: 1434025 - protein, 4 aa, Mycobacterium tuberculosis
FGNT

SEQ ID NO: 1434026 - protein, 29 aa, Mycobacterium tuberculosis
FGNTGDANTGGGNTGNGNIGGGNTGNNNF

SEQ ID NO: 1434027 - protein, 6 aa, Mycobacterium tuberculosis
FGPGPY

SEQ ID NO: 1434028 - protein, 19 aa, Mycobacterium tuberculosis
FGVSSSGGHPDGHRATRGA

SEQ ID NO: 1434029 - protein, 4 aa, Mycobacterium tuberculosis
FNAG

SEQ ID NO: 1434030 - protein, 27 aa, Mycobacterium tuberculosis
FNPGNSNTGFANSGDVNTGAFNSGNYS

SEQ ID NO: 1434031 - protein, 11 aa, Mycobacterium tuberculosis
FNPTTKTQAAL

SEQ ID NO: 1434032 - protein, 7 aa, Mycobacterium tuberculosis
FNSGSEN

SEQ ID NO: 1434033 - protein, 9 aa, Mycobacterium tuberculosis
FPAPGAPPL

SEQ ID NO: 1434034 - protein, 9 aa, Mycobacterium tuberculosis
FPAPGVKPH

SEQ ID NO: 1434035 - protein, 13 aa, Mycobacterium tuberculosis
FPDSGRVDSTTKL

SEQ ID NO: 1434036 - protein, 4 aa, Mycobacterium tuberculosis
FPEI

SEQ ID NO: 1434037 - protein, 7 aa, Mycobacterium tuberculosis
FPSDNGE

SEQ ID NO: 1434038 - protein, 18 aa, Mycobacterium tuberculosis
FQSNRGSHNSERTNQATL

SEQ ID NO: 1434039 - protein, 9 aa, Mycobacterium tuberculosis
FRADRQPEF

SEQ ID NO: 1434040 - protein, 18 aa, Mycobacterium tuberculosis
FSGSARAKITAAGGSATE

SEQ ID NO: 1434041 - protein, 9 aa, Mycobacterium tuberculosis
FSNTGNNNI

SEQ ID NO: 1434042 - protein, 8 aa, Mycobacterium tuberculosis
FSPGQNHQ

SEQ ID NO: 1434043 - protein, 4 aa, Mycobacterium tuberculosis
FTEK

SEQ ID NO: 1434044 - protein, 5 aa, Mycobacterium tuberculosis
FTPSW

SEQ ID NO: 1434045 - protein, 14 aa, Mycobacterium tuberculosis
GAAAYTGAEAASVS

SEQ ID NO: 1434046 - protein, 31 aa, Mycobacterium tuberculosis; identical to SEQ ID NO: 174544

SEQ ID NO: 1434047 - protein, 8 aa, Mycobacterium tuberculosis
GAAGTAAQ

SEQ ID NO: 1434048 - protein, 13 aa, Mycobacterium tuberculosis
GAASSAAPRAYRA

SEQ ID NO: 1434049 - protein, 6 aa, Mycobacterium tuberculosis
GACHTG

SEQ ID NO: 1434050 - protein, 10 aa, Mycobacterium tuberculosis
GADATDIAKR

SEQ ID NO: 1434051 - protein, 8 aa, Mycobacterium tuberculosis
GADGEGAG

SEQ ID NO: 1434052 - protein, 9 aa, Mycobacterium tuberculosis
GADITTRAE

SEQ ID NO: 1434053 - protein, 7 aa, Mycobacterium tuberculosis
GADRAAL

SEQ ID NO: 1434054 - protein, 15 aa, Mycobacterium tuberculosis
GAENDPSFTADHAEK

SEQ ID NO: 1434055 - protein, 6 aa, Mycobacterium tuberculosis
GAEPAQ

SEQ ID NO: 1434056 - protein, 7 aa, Mycobacterium tuberculosis
GAGAGPM

SEQ ID NO: 1434057 - protein, 14 aa, Mycobacterium tuberculosis
GAGAYAGAEAADAA

SEQ ID NO: 1434058 - protein, 13 aa, Mycobacterium tuberculosis
GAGDRGGAGGTGF

SEQ ID NO: 1434059 - protein, 19 aa, Mycobacterium tuberculosis
GAGGAGGAGAPGGTGGTGG

SEQ ID NO: 1434060 - protein, 12 aa, Mycobacterium tuberculosis
GAGGAGGHGGAA

SEQ ID NO: 1434061 - protein, 25 aa, Mycobacterium tuberculosis
GAGGAGSGTKAGGTGSDGGHGGNAT

SEQ ID NO: 1434062 - protein, 29 aa, Mycobacterium tuberculosis
GAGGDGGAGGSGLTTGGAAGNGGNAGTLS

SEQ ID NO: 1434063 - protein, 138 aa, Mycobacterium tuberculosis; identical to SEQ ID NO: 174661

SEQ ID NO: 1434064 - protein, 23 aa, Mycobacterium tuberculosis
GAGGMGGQGGTGGMGGAGGDGTT

SEQ ID NO: 1434065 - protein, 27 aa, Mycobacterium tuberculosis
GAGGTGGAAGSGGSGITTGGGGHGGNA

SEQ ID NO: 1434066 - protein, 93 aa, Mycobacterium tuberculosis; identical to SEQ ID NO: 174678

SEQ ID NO: 1434067 - protein, 12 aa, Mycobacterium tuberculosis
GAGGTGGSGGTS

SEQ ID NO: 1434068 - protein, 26 aa, Mycobacterium tuberculosis
GAGGTGGSSGIGSSGGTGGDGGTAGV

SEQ ID NO: 1434069 - protein, 6 aa, Mycobacterium tuberculosis
GAGHTG

SEQ ID NO: 1434070 - protein, 20 aa, Mycobacterium tuberculosis
GAGYQHNETASAQVLREVGG

SEQ ID NO: 1434071 - protein, 7 aa, Mycobacterium tuberculosis
GAGYRSK

SEQ ID NO: 1434072 - protein, 20 aa, Mycobacterium tuberculosis
GAHTKQLRADRRDCAHDLSR

SEQ ID NO: 1434073 - protein, 7 aa, Mycobacterium tuberculosis
GAKPTAI

SEQ ID NO: 1434074 - protein, 7 aa, Mycobacterium tuberculosis
GALGGNN

SEQ ID NO: 1434075 - protein, 9 aa, Mycobacterium tuberculosis
GAMGGSASE

SEQ ID NO: 1434076 - protein, 6 aa, Mycobacterium tuberculosis
GAPATS

SEQ ID NO: 1434077 - protein, 8 aa, Mycobacterium tuberculosis
GAPEPRHD

SEQ ID NO: 1434078 - protein, 7 aa, Mycobacterium tuberculosis
GAPQTLD

SEQ ID NO: 1434079 - protein, 5 aa, Mycobacterium tuberculosis
GAPRP

SEQ ID NO: 1434080 - protein, 7 aa, Mycobacterium tuberculosis
GAQAELA

SEQ ID NO: 1434081 - protein, 9 aa, Mycobacterium tuberculosis
GAQLAPRDV

SEQ ID NO: 1434082 - protein, 9 aa, Mycobacterium tuberculosis
GARDANDYE

SEQ ID NO: 1434083 - protein, 5 aa, Mycobacterium tuberculosis
GARKV

SEQ ID NO: 1434084 - protein, 8 aa, Mycobacterium tuberculosis
GARSGEPQ

SEQ ID NO: 1434085 - protein, 8 aa, Mycobacterium tuberculosis
GARTRGGY

SEQ ID NO: 1434086 - protein, 10 aa, Mycobacterium tuberculosis
GASDRRARAD

SEQ ID NO: 1434087 - protein, 7 aa, Mycobacterium tuberculosis
GASQNIG

SEQ ID NO: 1434088 - protein, 14 aa, Mycobacterium tuberculosis
GASSAFGGPCRTST

SEQ ID NO: 1434089 - protein, 5 aa, Mycobacterium tuberculosis
GASVT

SEQ ID NO: 1434090 - protein, 4 aa, Mycobacterium tuberculosis
GATG

SEQ ID NO: 1434091 - protein, 15 aa, Mycobacterium tuberculosis
GATGGAGGAGGNGGL

SEQ ID NO: 1434092 - protein, 9 aa, Mycobacterium tuberculosis
GATGNFTQT

SEQ ID NO: 1434093 - protein, 7 aa, Mycobacterium tuberculosis
GATRSLP

SEQ ID NO: 1434094 - protein, 4 aa, Mycobacterium tuberculosis
GAVD

SEQ ID NO: 1434095 - protein, 4 aa, Mycobacterium tuberculosis
GAVH

SEQ ID NO: 1434096 - protein, 14 aa, Mycobacterium tuberculosis
GAWPSAELAIWTTL

SEQ ID NO: 1434097 - protein, 5 aa, Mycobacterium tuberculosis
GAYLG

SEQ ID NO: 1434098 - protein, 16 aa, Mycobacterium tuberculosis
GCDSHNSGSLGADPRQ

SEQ ID NO: 1434099 - protein, 6 aa, Mycobacterium tuberculosis
GCHGGP

SEQ ID NO: 1434100 - protein, 7 aa, Mycobacterium tuberculosis
GDADDGY

SEQ ID NO: 1434101 - protein, 8 aa, Mycobacterium tuberculosis
GDADGSIA

SEQ ID NO: 1434102 - protein, 11 aa, Mycobacterium tuberculosis
GDAEASAAAPW

SEQ ID NO: 1434103 - protein, 4 aa, Mycobacterium tuberculosis
GDDG

SEQ ID NO: 1434104 - protein, 6 aa, Mycobacterium tuberculosis
GDDVRK

SEQ ID NO: 1434105 - protein, 12 aa, Mycobacterium tuberculosis
GDGAHAARNAPI

SEQ ID NO: 1434106 - protein, 26 aa, Mycobacterium tuberculosis
GDGGAGGAGGAATTGTGGAGGAGGKA

SEQ ID NO: 1434107 - protein, 16 aa, Mycobacterium tuberculosis
GDGGAGGTGGLGDVNG

SEQ ID NO: 1434108 - protein, 6 aa, Mycobacterium tuberculosis
GDGKGM

SEQ ID NO: 1434109 - protein, 90 aa, Mycobacterium tuberculosis; identical to SEQ ID NO: 232081

SEQ ID NO: 1434110 - protein, 5 aa, Mycobacterium tuberculosis
GDGVD

SEQ ID NO: 1434111 - protein, 13 aa, Mycobacterium tuberculosis
GDGVGGTDPTDAF

SEQ ID NO: 1434112 - protein, 169 aa, Mycobacterium tuberculosis
GDHGGPATNPGSGSRGGAGGSGGNGGAGGNATGSGGKGGAGGNGGDGSFGATSGPASIGVTGAPGGNGGKGGAGGSNPNGSGGDGGKGGNGGAGGNGGSIGANSGIVGGSGGAGGAGGAGGNGSLSSGEGGKGGDGGHGGDGVGGNSSVTQGGSGGGGGAGGAGGSGFF

SEQ ID NO: 1434113 - protein, 4 aa, Mycobacterium tuberculosis
GDID

SEQ ID NO: 1434114 - protein, 12 aa, Mycobacterium tuberculosis
GDIDAEKQSIEP

SEQ ID NO: 1434115 - protein, 4 aa, Mycobacterium tuberculosis
GDIP

SEQ ID NO: 1434116 - protein, 8 aa, Mycobacterium tuberculosis
GDKTPVSL

SEQ ID NO: 1434117 - protein, 46 aa, Mycobacterium tuberculosis
GDLNTGSLNPGSYNTGSVNTGSVNTGSVNTGSVNTGGFNAGNYNTG

SEQ ID NO: 1434118 - protein, 26 aa, Mycobacterium tuberculosis
GDNGGDGGNGGMGGAGGAGGPGGAGG

SEQ ID NO: 1434119 - protein, 6 aa, Mycobacterium tuberculosis
GDNKGF

SEQ ID NO: 1434120 - protein, 16 aa, Mycobacterium tuberculosis
GDNQQGFGGWNSGTGN

SEQ ID NO: 1434121 - protein, 7 aa, Mycobacterium tuberculosis
GDPATSG

SEQ ID NO: 1434122 - protein, 7 aa, Mycobacterium tuberculosis
GDPDEEF

SEQ ID NO: 1434123 - protein, 8 aa, Mycobacterium tuberculosis
GDPGDLSQ

SEQ ID NO: 1434124 - protein, 12 aa, Mycobacterium tuberculosis
GDPQPLDTGGTK

SEQ ID NO: 1434125 - protein, 7 aa, Mycobacterium tuberculosis
GDPTGRH

SEQ ID NO: 1434126 - protein, 13 aa, Mycobacterium tuberculosis
GDPTGTGRGGPGY

SEQ ID NO: 1434127 - protein, 7 aa, Mycobacterium tuberculosis
GDQQRAD

SEQ ID NO: 1434128 - protein, 5 aa, Mycobacterium tuberculosis
GDRGG

SEQ ID NO: 1434129 - protein, 6 aa, Mycobacterium tuberculosis
GDRGYT

SEQ ID NO: 1434130 - protein, 10 aa, Mycobacterium tuberculosis
GDRRVSPRER

SEQ ID NO: 1434131 - protein, 8 aa, Mycobacterium tuberculosis
GDSAGGNI

SEQ ID NO: 1434132 - protein, 9 aa, Mycobacterium tuberculosis
GDSEFDPQR

SEQ ID NO: 1434133 - protein, 8 aa, Mycobacterium tuberculosis
GDSGDGMQ

SEQ ID NO: 1434134 - protein, 6 aa, Mycobacterium tuberculosis
GDSYRL

SEQ ID NO: 1434135 - protein, 21 aa, Mycobacterium tuberculosis
GDTGEPTPQRANLSESITPDE

SEQ ID NO: 1434136 - protein, 12 aa, Mycobacterium tuberculosis
GDTNATFPAGDV

SEQ ID NO: 1434137 - protein, 26 aa, Mycobacterium tuberculosis
GDTNTGFGNAGFTNTGFGNAGSGNFG

SEQ ID NO: 1434138 - protein, 8 aa, Mycobacterium tuberculosis
GDTYSEQN

SEQ ID NO: 1434139 - protein, 5 aa, Mycobacterium tuberculosis
GDYDD

SEQ ID NO: 1434140 - protein, 14 aa, Mycobacterium tuberculosis
GDYGPGSAMARSTK

SEQ ID NO: 1434141 - protein, 14 aa, Mycobacterium tuberculosis
GDYNVGSGNVGSYN

SEQ ID NO: 1434142 - protein, 6 aa, Mycobacterium tuberculosis
GEAAIS

SEQ ID NO: 1434143 - protein, 6 aa, Mycobacterium tuberculosis
GEALEG

SEQ ID NO: 1434144 - protein, 7 aa, Mycobacterium tuberculosis
GEEPAQV

SEQ ID NO: 1434145 - protein, 4 aa, Mycobacterium tuberculosis
GEGE

SEQ ID NO: 1434146 - protein, 8 aa, Mycobacterium tuberculosis
GEGRGAEL

SEQ ID NO: 1434147 - protein, 7 aa, Mycobacterium tuberculosis
GEIGSAA

SEQ ID NO: 1434148 - protein, 4 aa, Mycobacterium tuberculosis
GEKS

SEQ ID NO: 1434149 - protein, 10 aa, Mycobacterium tuberculosis
GELAGPDFGS

SEQ ID NO: 1434150 - protein, 11 aa, Mycobacterium tuberculosis
GELDPGQPTQL

SEQ ID NO: 1434151 - protein, 9 aa, Mycobacterium tuberculosis
GELDQGEVG

SEQ ID NO: 1434152 - protein, 5 aa, Mycobacterium tuberculosis
GENTA

SEQ ID NO: 1434153 - protein, 53 aa, Mycobacterium tuberculosis; identical to SEQ ID NO: 194116

SEQ ID NO: 1434154 - protein, 8 aa, Mycobacterium tuberculosis
GEQAAAAA

SEQ ID NO: 1434155 - protein, 6 aa, Mycobacterium tuberculosis
GEQHRL

SEQ ID NO: 1434156 - protein, 10 aa, Mycobacterium tuberculosis
GESGSGKSAA

SEQ ID NO: 1434157 - protein, 11 aa, Mycobacterium tuberculosis
GESKGEHGAKS

SEQ ID NO: 1434158 - protein, 4 aa, Mycobacterium tuberculosis
GESL

SEQ ID NO: 1434159 - protein, 15 aa, Mycobacterium tuberculosis
GETGGNCELTEPGRT

SEQ ID NO: 1434160 - protein, 8 aa, Mycobacterium tuberculosis
GEVAEQKV

SEQ ID NO: 1434161 - protein, 36 aa, Mycobacterium tuberculosis; identical to SEQ ID NO: 175457

SEQ ID NO: 1434162 - protein, 8 aa, Mycobacterium tuberculosis
GFDTPTPL

SEQ ID NO: 1434163 - protein, 14 aa, Mycobacterium tuberculosis
GFGAGTGGSGGVGG

SEQ ID NO: 1434164 - protein, 52 aa, Mycobacterium tuberculosis; identical to SEQ ID NO: 194121

SEQ ID NO: 1434165 - protein, 8 aa, Mycobacterium tuberculosis
GFGGPDTF

SEQ ID NO: 1434166 - protein, 5 aa, Mycobacterium tuberculosis
GFPSP

SEQ ID NO: 1434167 - protein, 4 aa, Mycobacterium tuberculosis
GFRP

SEQ ID NO: 1434168 - protein, 5 aa, Mycobacterium tuberculosis
GFSGK

SEQ ID NO: 1434169 - protein, 12 aa, Mycobacterium tuberculosis
GFSNLGSGVSGF

SEQ ID NO: 1434170 - protein, 9 aa, Mycobacterium tuberculosis
GFSRDDAKE

SEQ ID NO: 1434171 - protein, 13 aa, Mycobacterium tuberculosis
GGAANAANGALGA

SEQ ID NO: 1434172 - protein, 7 aa, Mycobacterium tuberculosis
GGAASNV

SEQ ID NO: 1434173 - protein, 4 aa, Mycobacterium tuberculosis
GGAD

SEQ ID NO: 1434174 - protein, 14 aa, Mycobacterium tuberculosis
GGAGAYAAAEAQVE

SEQ ID NO: 1434175 - protein, 41 aa, Mycobacterium tuberculosis
GGAGGAGGLGGKAGLIGDGGDGGAGGNGTGAKGGDGGAGGG

SEQ ID NO: 1434176 - protein, 75 aa, Mycobacterium tuberculosis; identical to SEQ ID NO: 175514

SEQ ID NO: 1434177 - protein, 11 aa, Mycobacterium tuberculosis
GGAGGDGGGAL

SEQ ID NO: 1434178 - protein, 12 aa, Mycobacterium tuberculosis
GGAGGDGGSGGL

SEQ ID NO: 1434179 - protein, 7 aa, Mycobacterium tuberculosis
GGAGGFG

SEQ ID NO: 1434180 - protein, 14 aa, Mycobacterium tuberculosis
GGAGGNGGIGGAGT

SEQ ID NO: 1434181 - protein, 25 aa, Mycobacterium tuberculosis
GGAGGQLYGNGGDGGPGGQGGQAFG

SEQ ID NO: 1434182 - protein, 56 aa, Mycobacterium tuberculosis
GGAGGSSTATTTTGTPPTGATGGNGGNGGAGGTAGFTGSGGIGGNGGAGGTGGNAG

SEQ ID NO: 1434183 - protein, 29 aa, Mycobacterium tuberculosis
GGAGYTGGNGGSAGLIGNGGTGGAGFAGG

SEQ ID NO: 1434184 - protein, 5 aa, Mycobacterium tuberculosis
GGAND

SEQ ID NO: 1434185 - protein, 7 aa, Mycobacterium tuberculosis
GGARPGG

SEQ ID NO: 1434186 - protein, 8 aa, Mycobacterium tuberculosis
GGASTVAS

SEQ ID NO: 1434187 - protein, 45 aa, Mycobacterium tuberculosis; identical to SEQ ID NO: 175587

SEQ ID NO: 1434188 - protein, 8 aa, Mycobacterium tuberculosis
GGDNLTAT

SEQ ID NO: 1434189 - protein, 6 aa, Mycobacterium tuberculosis
GGEGKR

SEQ ID NO: 1434190 - protein, 8 aa, Mycobacterium tuberculosis
GGEHRRSA

SEQ ID NO: 1434191 - protein, 7 aa, Mycobacterium tuberculosis
GGESTAA

SEQ ID NO: 1434192 - protein, 15 aa, Mycobacterium tuberculosis
GGFGAGTGGSGGVGG

SEQ ID NO: 1434193 - protein, 14 aa, Mycobacterium tuberculosis
GGFGGQGGNGGQSG

SEQ ID NO: 1434194 - protein, 13 aa, Mycobacterium tuberculosis
GGGGGNGGDPGLG

SEQ ID NO: 1434195 - protein, 9 aa, Mycobacterium tuberculosis
GGGLPSYPH

SEQ ID NO: 1434196 - protein, 54 aa, Mycobacterium tuberculosis; identical to SEQ ID NO: 175679

SEQ ID NO: 1434197 - protein, 10 aa, Mycobacterium tuberculosis
GGGPSGQAGA

SEQ ID NO: 1434198 - protein, 8 aa, Mycobacterium tuberculosis
GGGSPRDT

SEQ ID NO: 1434199 - protein, 21 aa, Mycobacterium tuberculosis
GGGTGGAGGIGGGNGGHGGNG

SEQ ID NO: 1434200 - protein, 8 aa, Mycobacterium tuberculosis
GGHADRSW

SEQ ID NO: 1434201 - protein, 20 aa, Mycobacterium tuberculosis
GGIGGAGGTGGGAGGTGGNA

SEQ ID NO: 1434202 - protein, 10 aa, Mycobacterium tuberculosis
GGIGKTTITA

SEQ ID NO: 1434203 - protein, 15 aa, Mycobacterium tuberculosis
GGKAGGTPGAGGTSG

SEQ ID NO: 1434204 - protein, 5 aa, Mycobacterium tuberculosis
GGKLS

SEQ ID NO: 1434205 - protein, 5 aa, Mycobacterium tuberculosis
GGKSP

SEQ ID NO: 1434206 - protein, 5 aa, Mycobacterium tuberculosis
GGKVT

SEQ ID NO: 1434207 - protein, 6 aa, Mycobacterium tuberculosis
GGLAQA

SEQ ID NO: 1434208 - protein, 10 aa, Mycobacterium tuberculosis
GGLPKGDALA

SEQ ID NO: 1434209 - protein, 4 aa, Mycobacterium tuberculosis
GGNE

SEQ ID NO: 1434210 - protein, 18 aa, Mycobacterium tuberculosis
GGNGFSPAAGPGGNGGAA

SEQ ID NO: 1434211 - protein, 11 aa, Mycobacterium tuberculosis
GGNGGAGGDAG

SEQ ID NO: 1434212 - protein, 23 aa, Mycobacterium tuberculosis
GGNGGHGATGADGGDGGSGGAGG

SEQ ID NO: 1434213 - protein, 9 aa, Mycobacterium tuberculosis
GGNGGPGGF

SEQ ID NO: 1434214 - protein, 13 aa, Mycobacterium tuberculosis
GGNSGFGNSGSGL

SEQ ID NO: 1434215 - protein, 6 aa, Mycobacterium tuberculosis
GGPGAG

SEQ ID NO: 1434216 - protein, 5 aa, Mycobacterium tuberculosis
GGPKI

SEQ ID NO: 1434217 - protein, 4 aa, Mycobacterium tuberculosis
GGPR

SEQ ID NO: 1434218 - protein, 26 aa, Mycobacterium tuberculosis
GGQAPALSRLGGSDWANTKTKARRAV

SEQ ID NO: 1434219 - protein, 13 aa, Mycobacterium tuberculosis
GGQPEFRQHSEHR

SEQ ID NO: 1434220 - protein, 11 aa, Mycobacterium tuberculosis
GGRANASQAER

SEQ ID NO: 1434221 - protein, 5 aa, Mycobacterium tuberculosis
GGRCT

SEQ ID NO: 1434222 - protein, 6 aa, Mycobacterium tuberculosis
GGSAGG

SEQ ID NO: 1434223 - protein, 9 aa, Mycobacterium tuberculosis
GGSQDPALK

SEQ ID NO: 1434224 - protein, 8 aa, Mycobacterium tuberculosis
GGTGMAGS

SEQ ID NO: 1434225 - protein, 13 aa, Mycobacterium tuberculosis
GGTISTTAGPDGV

SEQ ID NO: 1434226 - protein, 8 aa, Mycobacterium tuberculosis
GGTLPGID

SEQ ID NO: 1434227 - protein, 5 aa, Mycobacterium tuberculosis
GGTPR

SEQ ID NO: 1434228 - protein, 9 aa, Mycobacterium tuberculosis
GGVESRNRQ

SEQ ID NO: 1434229 - protein, 26 aa, Mycobacterium tuberculosis
GGVGGAGGATDAGTGGAGGSGGNGGL

SEQ ID NO: 1434230 - protein, 14 aa, Mycobacterium tuberculosis
GGVGGPGGSGGASA

SEQ ID NO: 1434231 - protein, 8 aa, Mycobacterium tuberculosis
GGVGKTRL

SEQ ID NO: 1434232 - protein, 17 aa, Mycobacterium tuberculosis
GGVKPAAASAGGDDDSW

SEQ ID NO: 1434233 - protein, 5 aa, Mycobacterium tuberculosis
GGVRD

SEQ ID NO: 1434234 - protein, 7 aa, Mycobacterium tuberculosis
GGVRDGR

SEQ ID NO: 1434235 - protein, 6 aa, Mycobacterium tuberculosis
GGVSSL

SEQ ID NO: 1434236 - protein, 12 aa, Mycobacterium tuberculosis
GGVTRPVDQEVG

SEQ ID NO: 1434237 - protein, 7 aa, Mycobacterium tuberculosis
GHDKNGD

SEQ ID NO: 1434238 - protein, 22 aa, Mycobacterium tuberculosis
GHGDDTELGAERPSLSEWRARG

SEQ ID NO: 1434239 - protein, 10 aa, Mycobacterium tuberculosis
GHPAKNNYGS

SEQ ID NO: 1434240 - protein, 11 aa, Mycobacterium tuberculosis
GHPDPKRDSQA

SEQ ID NO: 1434241 - protein, 9 aa, Mycobacterium tuberculosis
GHPPDPASV

SEQ ID NO: 1434242 - protein, 12 aa, Mycobacterium tuberculosis
GHQTREHRQYGE

SEQ ID NO: 1434243 - protein, 5 aa, Mycobacterium tuberculosis
GHRDD

SEQ ID NO: 1434244 - protein, 8 aa, Mycobacterium tuberculosis
GHTEPAER

SEQ ID NO: 1434245 - protein, 13 aa, Mycobacterium tuberculosis
GHYQGRISTPDVS

SEQ ID NO: 1434246 - protein, 10 aa, Mycobacterium tuberculosis
GIAASGRRSV

SEQ ID NO: 1434247 - protein, 5 aa, Mycobacterium tuberculosis
GIAGE

SEQ ID NO: 1434248 - protein, 8 aa, Mycobacterium tuberculosis
GIANPRER

SEQ ID NO: 1434249 - protein, 7 aa, Mycobacterium tuberculosis
GIDPNAI

SEQ ID NO: 1434250 - protein, 11 aa, Mycobacterium tuberculosis
GIEPGGEPLSA

SEQ ID NO: 1434251 - protein, 10 aa, Mycobacterium tuberculosis
GIGENDAAVR

SEQ ID NO: 1434252 - protein, 7 aa, Mycobacterium tuberculosis
GIGSGQQ

SEQ ID NO: 1434253 - protein, 13 aa, Mycobacterium tuberculosis
GIPPGTLRRSATG

SEQ ID NO: 1434254 - protein, 7 aa, Mycobacterium tuberculosis
GIPRRAS

SEQ ID NO: 1434255 - protein, 25 aa, Mycobacterium tuberculosis
GISSPPVVPPPAEPPPAMPARDEPL

SEQ ID NO: 1434256 - protein, 5 aa, Mycobacterium tuberculosis
GIVGP

SEQ ID NO: 1434257 - protein, 5 aa, Mycobacterium tuberculosis
GKAEP

SEQ ID NO: 1434258 - protein, 10 aa, Mycobacterium tuberculosis
GKAGLPADEL

SEQ ID NO: 1434259 - protein, 4 aa, Mycobacterium tuberculosis
GKAL

SEQ ID NO: 1434260 - protein, 18 aa, Mycobacterium tuberculosis
GKARRTTIADPATARPAD

SEQ ID NO: 1434261 - protein, 12 aa, Mycobacterium tuberculosis
GKDAARIEGSKA

SEQ ID NO: 1434262 - protein, 10 aa, Mycobacterium tuberculosis
GKEGVEPQSE

SEQ ID NO: 1434263 - protein, 6 aa, Mycobacterium tuberculosis
GKENAA

SEQ ID NO: 1434264 - protein, 7 aa, Mycobacterium tuberculosis
GKFDSDA

SEQ ID NO: 1434265 - protein, 11 aa, Mycobacterium tuberculosis
GKHGDTGRSEL

SEQ ID NO: 1434266 - protein, 8 aa, Mycobacterium tuberculosis
GKKYESRQ

SEQ ID NO: 1434267 - protein, 4 aa, Mycobacterium tuberculosis
GKLA

SEQ ID NO: 1434268 - protein, 6 aa, Mycobacterium tuberculosis
GKPLAD

SEQ ID NO: 1434269 - protein, 8 aa, Mycobacterium tuberculosis
GKPRHAGV

SEQ ID NO: 1434270 - protein, 4 aa, Mycobacterium tuberculosis
GKQR

SEQ ID NO: 1434271 - protein, 6 aa, Mycobacterium tuberculosis
GKRKPY

SEQ ID NO: 1434272 - protein, 8 aa, Mycobacterium tuberculosis
GKTGEGVS

SEQ ID NO: 1434273 - protein, 9 aa, Mycobacterium tuberculosis
GKVSPSAER

SEQ ID NO: 1434274 - protein, 7 aa, Mycobacterium tuberculosis
GKYPSTE

SEQ ID NO: 1434275 - protein, 5 aa, Mycobacterium tuberculosis
GLAGS

SEQ ID NO: 1434276 - protein, 6 aa, Mycobacterium tuberculosis
GLAGSS

SEQ ID NO: 1434277 - protein, 6 aa, Mycobacterium tuberculosis
GLDSPD

SEQ ID NO: 1434278 - protein, 5 aa, Mycobacterium tuberculosis
GLEQA

SEQ ID NO: 1434279 - protein, 10 aa, Mycobacterium tuberculosis
GLGGADRKIE

SEQ ID NO: 1434280 - protein, 28 aa, Mycobacterium tuberculosis
GLGGTGGSGGTGGDGGAPGNGGAGGAGQ

SEQ ID NO: 1434281 - protein, 8 aa, Mycobacterium tuberculosis
GLNSGSGN

SEQ ID NO: 1434282 - protein, 12 aa, Mycobacterium tuberculosis
GLPAPKYGTATT

SEQ ID NO: 1434283 - protein, 5 aa, Mycobacterium tuberculosis
GLPAT

SEQ ID NO: 1434284 - protein, 6 aa, Mycobacterium tuberculosis
GLPDSV

SEQ ID NO: 1434285 - protein, 8 aa, Mycobacterium tuberculosis
GLPGPTGR

SEQ ID NO: 1434286 - protein, 8 aa, Mycobacterium tuberculosis
GLPPGQYP

SEQ ID NO: 1434287 - protein, 16 aa, Mycobacterium tuberculosis
GLPPGSDYRNRAPKMS

SEQ ID NO: 1434288 - protein, 10 aa, Mycobacterium tuberculosis
GLPPIAPHSG

SEQ ID NO: 1434289 - protein, 14 aa, Mycobacterium tuberculosis
GLPPTATPPLLRDA

SEQ ID NO: 1434290 - protein, 7 aa, Mycobacterium tuberculosis
GLPRKSD

SEQ ID NO: 1434291 - protein, 13 aa, Mycobacterium tuberculosis
GLRGKGRLTDADI

SEQ ID NO: 1434292 - protein, 10 aa, Mycobacterium tuberculosis
GLSDDERAQM

SEQ ID NO: 1434293 - protein, 6 aa, Mycobacterium tuberculosis
GLSNKD

SEQ ID NO: 1434294 - protein, 10 aa, Mycobacterium tuberculosis
GLTGATSGLS

SEQ ID NO: 1434295 - protein, 18 aa, Mycobacterium tuberculosis
GLTNANSAEFDPDTPDPV

SEQ ID NO: 1434296 - protein, 10 aa, Mycobacterium tuberculosis
GMAEADARAR

SEQ ID NO: 1434297 - protein, 5 aa, Mycobacterium tuberculosis
GMEDD

SEQ ID NO: 1434298 - protein, 6 aa, Mycobacterium tuberculosis
GMGPGP

SEQ ID NO: 1434299 - protein, 5 aa, Mycobacterium tuberculosis
GMKRQ

SEQ ID NO: 1434300 - protein, 8 aa, Mycobacterium tuberculosis
GMPAPPPL

SEQ ID NO: 1434301 - protein, 6 aa, Mycobacterium tuberculosis
GMPGPL

SEQ ID NO: 1434302 - protein, 11 aa, Mycobacterium tuberculosis
GNAPESQYNTS

SEQ ID NO: 1434303 - protein, 12 aa, Mycobacterium tuberculosis
GNDRKPDESCAR

SEQ ID NO: 1434304 - protein, 5 aa, Mycobacterium tuberculosis
GNEQV

SEQ ID NO: 1434305 - protein, 18 aa, Mycobacterium tuberculosis
GNGDSGTPGTGDDGGAGG

SEQ ID NO: 1434306 - protein, 23 aa, Mycobacterium tuberculosis
GNGGAGGAGAAGAAGANGQNPVS

SEQ ID NO: 1434307 - protein, 22 aa, Mycobacterium tuberculosis
GNGGAGGAGGAGGGAGGAGGNA

SEQ ID NO: 1434308 - protein, 23 aa, Mycobacterium tuberculosis
GNGGDGGATIAGKGGSGGNGGNA

SEQ ID NO: 1434309 - protein, 8 aa, Mycobacterium tuberculosis
GNGGDGGC

SEQ ID NO: 1434310 - protein, 22 aa, Mycobacterium tuberculosis
GNGGNGGSGATGQAGGAGGAAG

SEQ ID NO: 1434311 - protein, 7 aa, Mycobacterium tuberculosis
GNGPLPG

SEQ ID NO: 1434312 - protein, 8 aa, Mycobacterium tuberculosis
GNLGQHNG

SEQ ID NO: 1434313 - protein, 10 aa, Mycobacterium tuberculosis
GNNSQKSRDL

SEQ ID NO: 1434314 - protein, 8 aa, Mycobacterium tuberculosis
GNQPGSWP

SEQ ID NO: 1434315 - protein, 8 aa, Mycobacterium tuberculosis
GNRLDTAG

SEQ ID NO: 1434316 - protein, 6 aa, Mycobacterium tuberculosis
GNRRRF

SEQ ID NO: 1434317 - protein, 9 aa, Mycobacterium tuberculosis
GNRSIGAAE

SEQ ID NO: 1434318 - protein, 9 aa, Mycobacterium tuberculosis
GNTDCPGNA

SEQ ID NO: 1434319 - protein, 28 aa, Mycobacterium tuberculosis
GNTGNGNIGIGNTGTGNIGFGNTGNGNI

SEQ ID NO: 1434320 - protein, 7 aa, Mycobacterium tuberculosis
GNTGNNN

SEQ ID NO: 1434321 - protein, 7 aa, Mycobacterium tuberculosis
GNTGTNN

SEQ ID NO: 1434322 - protein, 7 aa, Mycobacterium tuberculosis
GNTVAKD

SEQ ID NO: 1434323 - protein, 10 aa, Mycobacterium tuberculosis
GNTVSGSYNT

SEQ ID NO: 1434324 - protein, 33 aa, Mycobacterium tuberculosis
GNVNTGVGNTGSINTGSINTGSFNTGSTNTGSF

SEQ ID NO: 1434325 - protein, 4 aa, Mycobacterium tuberculosis
GPAM

SEQ ID NO: 1434326 - protein, 5 aa, Mycobacterium tuberculosis
GPAQT

SEQ ID NO: 1434327 - protein, 5 aa, Mycobacterium tuberculosis
GPAVN

SEQ ID NO: 1434328 - protein, 10 aa, Mycobacterium tuberculosis
GPDASYVPGH

SEQ ID NO: 1434329 - protein, 6 aa, Mycobacterium tuberculosis
GPDVTE

SEQ ID NO: 1434330 - protein, 4 aa, Mycobacterium tuberculosis
GPGA

SEQ ID NO: 1434331 - protein, 5 aa, Mycobacterium tuberculosis
GPGAA

SEQ ID NO: 1434332 - protein, 5 aa, Mycobacterium tuberculosis
GPGAD

SEQ ID NO: 1434333 - protein, 6 aa, Mycobacterium tuberculosis
GPGDPE

SEQ ID NO: 1434334 - protein, 17 aa, Mycobacterium tuberculosis
GPGNFTEPLSGHPPDGG

SEQ ID NO: 1434335 - protein, 6 aa, Mycobacterium tuberculosis
GPGNRS

SEQ ID NO: 1434336 - protein, 9 aa, Mycobacterium tuberculosis
GPGSGRETA

SEQ ID NO: 1434337 - protein, 11 aa, Mycobacterium tuberculosis
GPGTRMRSDTP

SEQ ID NO: 1434338 - protein, 6 aa, Mycobacterium tuberculosis
GPIQGG

SEQ ID NO: 1434339 - protein, 4 aa, Mycobacterium tuberculosis
GPIS

SEQ ID NO: 1434340 - protein, 4 aa, Mycobacterium tuberculosis
GPIT

SEQ ID NO: 1434341 - protein, 5 aa, Mycobacterium tuberculosis
GPITS

SEQ ID NO: 1434342 - protein, 5 aa, Mycobacterium tuberculosis
GPKAL

SEQ ID NO: 1434343 - protein, 4 aa, Mycobacterium tuberculosis
GPPA

SEQ ID NO: 1434344 - protein, 5 aa, Mycobacterium tuberculosis
GPPPG

SEQ ID NO: 1434345 - protein, 74 aa, Mycobacterium tuberculosis; identical to SEQ ID NO: 176649

SEQ ID NO: 1434346 - protein, 4 aa, Mycobacterium tuberculosis
GPQA

SEQ ID NO: 1434347 - protein, 5 aa, Mycobacterium tuberculosis
GPQAG

SEQ ID NO: 1434348 - protein, 33 aa, Mycobacterium tuberculosis
GPQNGPRRSQAITPEPGAAGRHHQPRGDRKPRA

SEQ ID NO: 1434349 - protein, 7 aa, Mycobacterium tuberculosis
GPRKVGD

SEQ ID NO: 1434350 - protein, 9 aa, Mycobacterium tuberculosis
GPSDATGIP

SEQ ID NO: 1434351 - protein, 8 aa, Mycobacterium tuberculosis
GPSGDIEE

SEQ ID NO: 1434352 - protein, 8 aa, Mycobacterium tuberculosis
GPSYTRPA

SEQ ID NO: 1434353 - protein, 8 aa, Mycobacterium tuberculosis
GPTLSSAQ

SEQ ID NO: 1434354 - protein, 12 aa, Mycobacterium tuberculosis
GPVAAPAAPVVG

SEQ ID NO: 1434355 - protein, 5 aa, Mycobacterium tuberculosis
GPVAT

SEQ ID NO: 1434356 - protein, 7 aa, Mycobacterium tuberculosis
GPVPDTS

SEQ ID NO: 1434357 - protein, 4 aa, Mycobacterium tuberculosis
GPYA

SEQ ID NO: 1434358 - protein, 6 aa, Mycobacterium tuberculosis
GPYPGY

SEQ ID NO: 1434359 - protein, 10 aa, Mycobacterium tuberculosis
GQATGRQVAD

SEQ ID NO: 1434360 - protein, 7 aa, Mycobacterium tuberculosis
GQCSAEA

SEQ ID NO: 1434361 - protein, 4 aa, Mycobacterium tuberculosis
GQDL

SEQ ID NO: 1434362 - protein, 13 aa, Mycobacterium tuberculosis
GQEGDAFPGALRR

SEQ ID NO: 1434363 - protein, 6 aa, Mycobacterium tuberculosis
GQHAPG

SEQ ID NO: 1434364 - protein, 5 aa, Mycobacterium tuberculosis
GQHEA

SEQ ID NO: 1434365 - protein, 6 aa, Mycobacterium tuberculosis
GQHPGS

SEQ ID NO: 1434366 - protein, 13 aa, Mycobacterium tuberculosis
GQNPDKSPHLTGE

SEQ ID NO: 1434367 - protein, 7 aa, Mycobacterium tuberculosis
GQNTPAI

SEQ ID NO: 1434368 - protein, 10 aa, Mycobacterium tuberculosis
GQQRGEHREP

SEQ ID NO: 1434369 - protein, 4 aa, Mycobacterium tuberculosis
GQTN

SEQ ID NO: 1434370 - protein, 6 aa, Mycobacterium tuberculosis
GQVHNE

SEQ ID NO: 1434371 - protein, 7 aa, Mycobacterium tuberculosis
GQVQGVP

SEQ ID NO: 1434372 - protein, 7 aa, Mycobacterium tuberculosis
GRAFTSG

SEQ ID NO: 1434373 - protein, 8 aa, Mycobacterium tuberculosis
GRALRDDG

SEQ ID NO: 1434374 - protein, 6 aa, Mycobacterium tuberculosis
GRAPRG

SEQ ID NO: 1434375 - protein, 6 aa, Mycobacterium tuberculosis
GRDGDD

SEQ ID NO: 1434376 - protein, 34 aa, Mycobacterium tuberculosis; identical to SEQ ID NO: 176897

SEQ ID NO: 1434377 - protein, 8 aa, Mycobacterium tuberculosis
GRDPRAAA

SEQ ID NO: 1434378 - protein, 7 aa, Mycobacterium tuberculosis
GREEFDT

SEQ ID NO: 1434379 - protein, 4 aa, Mycobacterium tuberculosis
GREL

SEQ ID NO: 1434380 - protein, 11 aa, Mycobacterium tuberculosis
GREVGGGDTRC

SEQ ID NO: 1434381 - protein, 12 aa, Mycobacterium tuberculosis
GRGDKEGGDGAA

SEQ ID NO: 1434382 - protein, 15 aa, Mycobacterium tuberculosis
GRGFSPGADHKSAGV

SEQ ID NO: 1434383 - protein, 17 aa, Mycobacterium tuberculosis
GRHGGPAGPDHLDQRDH

SEQ ID NO: 1434384 - protein, 22 aa, Mycobacterium tuberculosis
GRIDKSTAELADERSAVTELGL

SEQ ID NO: 1434385 - protein, 10 aa, Mycobacterium tuberculosis
GRKGYDSTAV

SEQ ID NO: 1434386 - protein, 4 aa, Mycobacterium tuberculosis
GRLR

SEQ ID NO: 1434387 - protein, 6 aa, Mycobacterium tuberculosis
GRMGND

SEQ ID NO: 1434388 - protein, 9 aa, Mycobacterium tuberculosis
GRPAGREHR

SEQ ID NO: 1434389 - protein, 19 aa, Mycobacterium tuberculosis
GRPATTRGVEGISCSPQMM

SEQ ID NO: 1434390 - protein, 4 aa, Mycobacterium tuberculosis
GRRE

SEQ ID NO: 1434391 - protein, 8 aa, Mycobacterium tuberculosis
GRRTQFDR

SEQ ID NO: 1434392 - protein, 4 aa, Mycobacterium tuberculosis
GRSA

SEQ ID NO: 1434393 - protein, 10 aa, Mycobacterium tuberculosis
GRTEITEATR

SEQ ID NO: 1434394 - protein, 7 aa, Mycobacterium tuberculosis
GRTIGGE

SEQ ID NO: 1434395 - protein, 8 aa, Mycobacterium tuberculosis
GRTPKAFG

SEQ ID NO: 1434396 - protein, 11 aa, Mycobacterium tuberculosis
GRTRCAGRSGV

SEQ ID NO: 1434397 - protein, 11 aa, Mycobacterium tuberculosis
GSAKQAERSYG

SEQ ID NO: 1434398 - protein, 6 aa, Mycobacterium tuberculosis
GSDHPV

SEQ ID NO: 1434399 - protein, 48 aa, Mycobacterium tuberculosis; identical to SEQ ID NO: 177138

SEQ ID NO: 1434400 - protein, 12 aa, Mycobacterium tuberculosis
GSEVTKYRQGDR

SEQ ID NO: 1434401 - protein, 10 aa, Mycobacterium tuberculosis
GSGDWEATKT

SEQ ID NO: 1434402 - protein, 46 aa, Mycobacterium tuberculosis
GSGGAADIGGNGGAGNGGGTDGNGGNGGSGGGAGSGGDGGGAGGNG

SEQ ID NO: 1434403 - protein, 22 aa, Mycobacterium tuberculosis
GSGGVGGAGGLGGPTDGTVQGV

SEQ ID NO: 1434404 - protein, 16 aa, Mycobacterium tuberculosis
GSGNFGIGNAGTGNWG

SEQ ID NO: 1434405 - protein, 8 aa, Mycobacterium tuberculosis
GSGNIGSY

SEQ ID NO: 1434406 - protein, 13 aa, Mycobacterium tuberculosis
GSHNESPDGMTPP

SEQ ID NO: 1434407 - protein, 7 aa, Mycobacterium tuberculosis
GSHPRTP

SEQ ID NO: 1434408 - protein, 14 aa, Mycobacterium tuberculosis
GSKDPRSAANARAI

SEQ ID NO: 1434409 - protein, 13 aa, Mycobacterium tuberculosis
GSLAPPDGAAVPD

SEQ ID NO: 1434410 - protein, 8 aa, Mycobacterium tuberculosis
GSLEEAAD

SEQ ID NO: 1434411 - protein, 9 aa, Mycobacterium tuberculosis
GSNNPQERL

SEQ ID NO: 1434412 - protein, 10 aa, Mycobacterium tuberculosis
GSNRLGGNSL

SEQ ID NO: 1434413 - protein, 5 aa, Mycobacterium tuberculosis
GSQWA

SEQ ID NO: 1434414 - protein, 7 aa, Mycobacterium tuberculosis
GSSDPHR

SEQ ID NO: 1434415 - protein, 6 aa, Mycobacterium tuberculosis
GSSGHL

SEQ ID NO: 1434416 - protein, 12 aa, Mycobacterium tuberculosis
GSTARRGSPRRA

SEQ ID NO: 1434417 - protein, 5 aa, Mycobacterium tuberculosis
GSTEF

SEQ ID NO: 1434418 - protein, 25 aa, Mycobacterium tuberculosis
GSTTGASAATSTAAATAAATNALRG

SEQ ID NO: 1434419 - protein, 7 aa, Mycobacterium tuberculosis
GSTVGQA

SEQ ID NO: 1434420 - protein, 7 aa, Mycobacterium tuberculosis
GSVATYS

SEQ ID NO: 1434421 - protein, 20 aa, Mycobacterium tuberculosis
GSVGADTVSGRADVGGSGGG

SEQ ID NO: 1434422 - protein, 4 aa, Mycobacterium tuberculosis
GSVR

SEQ ID NO: 1434423 - protein, 16 aa, Mycobacterium tuberculosis
GSYNTGVGNAGTASTG

SEQ ID NO: 1434424 - protein, 12 aa, Mycobacterium tuberculosis
GTAAPAIKEGTP

SEQ ID NO: 1434425 - protein, 8 aa, Mycobacterium tuberculosis
GTFAESGG

SEQ ID NO: 1434426 - protein, 14 aa, Mycobacterium tuberculosis
GTFGTNGAGGTGGL

SEQ ID NO: 1434427 - protein, 15 aa, Mycobacterium tuberculosis
GTFPTNSQLTNESAA

SEQ ID NO: 1434428 - protein, 5 aa, Mycobacterium tuberculosis
GTGAR

SEQ ID NO: 1434429 - protein, 14 aa, Mycobacterium tuberculosis
GTGGIGGGPGGNGG

SEQ ID NO: 1434430 - protein, 6 aa, Mycobacterium tuberculosis
GTGNAE

SEQ ID NO: 1434431 - protein, 12 aa, Mycobacterium tuberculosis
GTIGAQGESADG

SEQ ID NO: 1434432 - protein, 7 aa, Mycobacterium tuberculosis
GTIPSKT

SEQ ID NO: 1434433 - protein, 5 aa, Mycobacterium tuberculosis
GTLKQ

SEQ ID NO: 1434434 - protein, 5 aa, Mycobacterium tuberculosis
GTMPA

SEQ ID NO: 1434435 - protein, 7 aa, Mycobacterium tuberculosis
GTNCENL

SEQ ID NO: 1434436 - protein, 25 aa, Mycobacterium tuberculosis
GTNNSGYANAGTFNSGFDNNARDEH

SEQ ID NO: 1434437 - protein, 6 aa, Mycobacterium tuberculosis
GTPCAL

SEQ ID NO: 1434438 - protein, 9 aa, Mycobacterium tuberculosis
GTPDHHGEF

SEQ ID NO: 1434439 - protein, 13 aa, Mycobacterium tuberculosis
GTPPTAAAAESGM

SEQ ID NO: 1434440 - protein, 10 aa, Mycobacterium tuberculosis
GTPRPAPRTT

SEQ ID NO: 1434441 - protein, 8 aa, Mycobacterium tuberculosis
GTPRQVEN

SEQ ID NO: 1434442 - protein, 5 aa, Mycobacterium tuberculosis
GTQVS

SEQ ID NO: 1434443 - protein, 11 aa, Mycobacterium tuberculosis
GTRTRAGQPLT

SEQ ID NO: 1434444 - protein, 22 aa, Mycobacterium tuberculosis
GTSEAAARQLASRARKAVTAQP

SEQ ID NO: 1434445 - protein, 7 aa, Mycobacterium tuberculosis
GTTGFPK

SEQ ID NO: 1434446 - protein, 4 aa, Mycobacterium tuberculosis
GTTT

SEQ ID NO: 1434447 - protein, 7 aa, Mycobacterium tuberculosis
GTYPSTE

SEQ ID NO: 1434448 - protein, 79 aa, Mycobacterium tuberculosis; identical to SEQ ID NO: 177626

SEQ ID NO: 1434449 - protein, 8 aa, Mycobacterium tuberculosis
GVDPGPKV

SEQ ID NO: 1434450 - protein, 4 aa, Mycobacterium tuberculosis
GVEK

SEQ ID NO: 1434451 - protein, 8 aa, Mycobacterium tuberculosis
GVEQPDKH

SEQ ID NO: 1434452 - protein, 11 aa, Mycobacterium tuberculosis
GVERKPTDAAV

SEQ ID NO: 1434453 - protein, 5 aa, Mycobacterium tuberculosis
GVGAA

SEQ ID NO: 1434454 - protein, 15 aa, Mycobacterium tuberculosis
GVGASEGQTPDTVTT

SEQ ID NO: 1434455 - protein, 10 aa, Mycobacterium tuberculosis
GVGEDITGGL

SEQ ID NO: 1434456 - protein, 12 aa, Mycobacterium tuberculosis
GVGGAGGSGGTA

SEQ ID NO: 1434457 - protein, 14 aa, Mycobacterium tuberculosis
GVGNSGLTAGVPGL

SEQ ID NO: 1434458 - protein, 5 aa, Mycobacterium tuberculosis
GVGPV

SEQ ID NO: 1434459 - protein, 11 aa, Mycobacterium tuberculosis
GVPARGLNGEA

SEQ ID NO: 1434460 - protein, 5 aa, Mycobacterium tuberculosis
GVRST

SEQ ID NO: 1434461 - protein, 6 aa, Mycobacterium tuberculosis
GVSGLS

SEQ ID NO: 1434462 - protein, 5 aa, Mycobacterium tuberculosis
GVSGT

SEQ ID NO: 1434463 - protein, 5 aa, Mycobacterium tuberculosis
GVSSR

SEQ ID NO: 1434464 - protein, 9 aa, Mycobacterium tuberculosis
GVSSSGCGV

SEQ ID NO: 1434465 - protein, 19 aa, Mycobacterium tuberculosis
GVTGEGAGPPVRRAPARTY

SEQ ID NO: 1434466 - protein, 14 aa, Mycobacterium tuberculosis
GVTGHPDHRRATEA

SEQ ID NO: 1434467 - protein, 9 aa, Mycobacterium tuberculosis
GVTPQQATE

SEQ ID NO: 1434468 - protein, 14 aa, Mycobacterium tuberculosis
GVTTGGAGGTGGAA

SEQ ID NO: 1434469 - protein, 4 aa, Mycobacterium tuberculosis
GWSP

SEQ ID NO: 1434470 - protein, 4 aa, Mycobacterium tuberculosis
GWSS

SEQ ID NO: 1434471 - protein, 5 aa, Mycobacterium tuberculosis
GYASG

SEQ ID NO: 1434472 - protein, 6 aa, Mycobacterium tuberculosis
GYTSSL

SEQ ID NO: 1434473 - protein, 7 aa, Mycobacterium tuberculosis
GYVEDSG

SEQ ID NO: 1434474 - protein, 4 aa, Mycobacterium tuberculosis
GYYG

SEQ ID NO: 1434475 - protein, 5 aa, Mycobacterium tuberculosis
HAAAT

SEQ ID NO: 1434476 - protein, 9 aa, Mycobacterium tuberculosis
HAASETERA

SEQ ID NO: 1434477 - protein, 9 aa, Mycobacterium tuberculosis
HAEAANAAR

SEQ ID NO: 1434478 - protein, 5 aa, Mycobacterium tuberculosis
HAETE

SEQ ID NO: 1434479 - protein, 8 aa, Mycobacterium tuberculosis
HAGTLDPM

SEQ ID NO: 1434480 - protein, 10 aa, Mycobacterium tuberculosis
HAKDSKFPPV

SEQ ID NO: 1434481 - protein, 19 aa, Mycobacterium tuberculosis
HAPPTMPQMPPPDSDPEEV

SEQ ID NO: 1434482 - protein, 9 aa, Mycobacterium tuberculosis
HAPTLDGAR

SEQ ID NO: 1434483 - protein, 14 aa, Mycobacterium tuberculosis
HASRRRAQRRLPDT

SEQ ID NO: 1434484 - protein, 11 aa, Mycobacterium tuberculosis
HATTAGATPVE

SEQ ID NO: 1434485 - protein, 22 aa, Mycobacterium tuberculosis
HDGSARATGSATITVSERPGVY

SEQ ID NO: 1434486 - protein, 6 aa, Mycobacterium tuberculosis
HDKNGD

SEQ ID NO: 1434487 - protein, 9 aa, Mycobacterium tuberculosis
HEDDSFDEE

SEQ ID NO: 1434488 - protein, 4 aa, Mycobacterium tuberculosis
HEDQ

SEQ ID NO: 1434489 - protein, 4 aa, Mycobacterium tuberculosis
HEER

SEQ ID NO: 1434490 - protein, 5 aa, Mycobacterium tuberculosis
HESNT

SEQ ID NO: 1434491 - protein, 4 aa, Mycobacterium tuberculosis
HETD

SEQ ID NO: 1434492 - protein, 7 aa, Mycobacterium tuberculosis
HGASVTT

SEQ ID NO: 1434493 - protein, 5 aa, Mycobacterium tuberculosis
HGDAE

SEQ ID NO: 1434494 - protein, 6 aa, Mycobacterium tuberculosis
HGDDLA

SEQ ID NO: 1434495 - protein, 20 aa, Mycobacterium tuberculosis
HGGAGGLGGTGASGGAGGAG

SEQ ID NO: 1434496 - protein, 6 aa, Mycobacterium tuberculosis
HGGASM

SEQ ID NO: 1434497 - protein, 4 aa, Mycobacterium tuberculosis
HGGQ

SEQ ID NO: 1434498 - protein, 51 aa, Mycobacterium tuberculosis
HGGTGGAGGHSAQGPDGNGGIGGAGGAGGNGGQLYGTGGTGGTGGKGGDGF

SEQ ID NO: 1434499 - protein, 57 aa, Mycobacterium tuberculosis; identical to SEQ ID NO: 178010

SEQ ID NO: 1434500 - protein, 8 aa, Mycobacterium tuberculosis
HGPFPKAD

SEQ ID NO: 1434501 - protein, 11 aa, Mycobacterium tuberculosis
HGPVEQRSERQ

SEQ ID NO: 1434502 - protein, 11 aa, Mycobacterium tuberculosis
HGQSDKPRADY

SEQ ID NO: 1434503 - protein, 8 aa, Mycobacterium tuberculosis
HGRSGPIP

SEQ ID NO: 1434504 - protein, 7 aa, Mycobacterium tuberculosis
HGSVSTI

SEQ ID NO: 1434505 - protein, 5 aa, Mycobacterium tuberculosis
HGTGA

SEQ ID NO: 1434506 - protein, 5 aa, Mycobacterium tuberculosis
HGTGT

SEQ ID NO: 1434507 - protein, 16 aa, Mycobacterium tuberculosis
HGTPDAYEAGTWGPES

SEQ ID NO: 1434508 - protein, 4 aa, Mycobacterium tuberculosis
HGVP

SEQ ID NO: 1434509 - protein, 10 aa, Mycobacterium tuberculosis
HHLPTSPGPR

SEQ ID NO: 1434510 - protein, 8 aa, Mycobacterium tuberculosis
HLGDTAAD

SEQ ID NO: 1434511 - protein, 8 aa, Mycobacterium tuberculosis
HLPSKENG

SEQ ID NO: 1434512 - protein, 8 aa, Mycobacterium tuberculosis
HNGYADDG

SEQ ID NO: 1434513 - protein, 8 aa, Mycobacterium tuberculosis
HPAATKAD

SEQ ID NO: 1434514 - protein, 15 aa, Mycobacterium tuberculosis
HPGASPESGPGDPVA

SEQ ID NO: 1434515 - protein, 8 aa, Mycobacterium tuberculosis
HPGKPNCV

SEQ ID NO: 1434516 - protein, 5 aa, Mycobacterium tuberculosis
HPHKL

SEQ ID NO: 1434517 - protein, 4 aa, Mycobacterium tuberculosis
HPVA

SEQ ID NO: 1434518 - protein, 8 aa, Mycobacterium tuberculosis
HPVSRKTW

SEQ ID NO: 1434519 - protein, 10 aa, Mycobacterium tuberculosis
HQGERRAAYN

SEQ ID NO: 1434520 - protein, 20 aa, Mycobacterium tuberculosis
HRAAGAGRRQRRRRSGDGQW

SEQ ID NO: 1434521 - protein, 6 aa, Mycobacterium tuberculosis
HRAGAA

SEQ ID NO: 1434522 - protein, 6 aa, Mycobacterium tuberculosis
HRGAGT

SEQ ID NO: 1434523 - protein, 7 aa, Mycobacterium tuberculosis
HRKASGQ

SEQ ID NO: 1434524 - protein, 8 aa, Mycobacterium tuberculosis
HSGKAEVR

SEQ ID NO: 1434525 - protein, 7 aa, Mycobacterium tuberculosis
HSGSTAR

SEQ ID NO: 1434526 - protein, 6 aa, Mycobacterium tuberculosis
HSGVPG

SEQ ID NO: 1434527 - protein, 4 aa, Mycobacterium tuberculosis
HSHS

SEQ ID NO: 1434528 - protein, 27 aa, Mycobacterium tuberculosis
HSMGSARPGDFGAPTAVAPPVPEHGTS

SEQ ID NO: 1434529 - protein, 6 aa, Mycobacterium tuberculosis
HSNETV

SEQ ID NO: 1434530 - protein, 7 aa, Mycobacterium tuberculosis
HSQSHYA

SEQ ID NO: 1434531 - protein, 18 aa, Mycobacterium tuberculosis
HTDANAVDDAVQRARAAQ

SEQ ID NO: 1434532 - protein, 23 aa, Mycobacterium tuberculosis
HTEPGLQGDRSSAGTKPATLQTG

SEQ ID NO: 1434533 - protein, 8 aa, Mycobacterium tuberculosis
HTSAEQVG

SEQ ID NO: 1434534 - protein, 9 aa, Mycobacterium tuberculosis
HTSGQDVAE

SEQ ID NO: 1434535 - protein, 4 aa, Mycobacterium tuberculosis
HVAG

SEQ ID NO: 1434536 - protein, 4 aa, Mycobacterium tuberculosis
HVRG

SEQ ID NO: 1434537 - protein, 16 aa, Mycobacterium tuberculosis
IAAETAPVHGEERRAE

SEQ ID NO: 1434538 - protein, 4 aa, Mycobacterium tuberculosis
IAAS

SEQ ID NO: 1434539 - protein, 6 aa, Mycobacterium tuberculosis
IAATEA

SEQ ID NO: 1434540 - protein, 11 aa, Mycobacterium tuberculosis
IAKDRGIGGPV

SEQ ID NO: 1434541 - protein, 42 aa, Mycobacterium tuberculosis; identical to SEQ ID NO: 194337

SEQ ID NO: 1434542 - protein, 5 aa, Mycobacterium tuberculosis
IASGA

SEQ ID NO: 1434543 - protein, 13 aa, Mycobacterium tuberculosis
IATDSTAAVPAPE

SEQ ID NO: 1434544 - protein, 4 aa, Mycobacterium tuberculosis
IDHG

SEQ ID NO: 1434545 - protein, 12 aa, Mycobacterium tuberculosis
IDKEGADPAKIR

SEQ ID NO: 1434546 - protein, 23 aa, Mycobacterium tuberculosis
IDPEWSRPPGSITDDHVFDAPLH

SEQ ID NO: 1434547 - protein, 8 aa, Mycobacterium tuberculosis
IDRATKSV

SEQ ID NO: 1434548 - protein, 4 aa, Mycobacterium tuberculosis
IDST

SEQ ID NO: 1434549 - protein, 13 aa, Mycobacterium tuberculosis
IDTAKGSRAGPVE

SEQ ID NO: 1434550 - protein, 4 aa, Mycobacterium tuberculosis
IEEK

SEQ ID NO: 1434551 - protein, 9 aa, Mycobacterium tuberculosis
IEGIGRPRV

SEQ ID NO: 1434552 - protein, 11 aa, Mycobacterium tuberculosis
IELSSSQSTSI

SEQ ID NO: 1434553 - protein, 8 aa, Mycobacterium tuberculosis
IESDTGSV

SEQ ID NO: 1434554 - protein, 10 aa, Mycobacterium tuberculosis
IETLGKDELG

SEQ ID NO: 1434555 - protein, 4 aa, Mycobacterium tuberculosis
IGDG

SEQ ID NO: 1434556 - protein, 17 aa, Mycobacterium tuberculosis
IGDTPKRQIRAEAARRG

SEQ ID NO: 1434557 - protein, 7 aa, Mycobacterium tuberculosis
IGGAARG

SEQ ID NO: 1434558 - protein, 10 aa, Mycobacterium tuberculosis
IGGGSGFGGL

SEQ ID NO: 1434559 - protein, 12 aa, Mycobacterium tuberculosis
IGNGGAGGTGGA

SEQ ID NO: 1434560 - protein, 36 aa, Mycobacterium tuberculosis
IGNGGDGGHGGNGGHGNSGGAGGAGGAGGAGGAGGH

SEQ ID NO: 1434561 - protein, 23 aa, Mycobacterium tuberculosis
IGNGGNGGSGGMGDAPGGTGVGG

SEQ ID NO: 1434562 - protein, 33 aa, Mycobacterium tuberculosis; identical to SEQ ID NO: 194351

SEQ ID NO: 1434563 - protein, 4 aa, Mycobacterium tuberculosis
IGNL

SEQ ID NO: 1434564 - protein, 6 aa, Mycobacterium tuberculosis
IGNSGL

SEQ ID NO: 1434565 - protein, 5 aa, Mycobacterium tuberculosis
IGNTG

SEQ ID NO: 1434566 - protein, 4 aa, Mycobacterium tuberculosis
IGPT

SEQ ID NO: 1434567 - protein, 40 aa, Mycobacterium tuberculosis; identical to SEQ ID NO: 194357

SEQ ID NO: 1434568 - protein, 8 aa, Mycobacterium tuberculosis
INGVARDD

SEQ ID NO: 1434569 - protein, 7 aa, Mycobacterium tuberculosis
IPADEPV

SEQ ID NO: 1434570 - protein, 10 aa, Mycobacterium tuberculosis
IPANRPGRAV

SEQ ID NO: 1434571 - protein, 5 aa, Mycobacterium tuberculosis
IPEDY

SEQ ID NO: 1434572 - protein, 4 aa, Mycobacterium tuberculosis
IPNN

SEQ ID NO: 1434573 - protein, 5 aa, Mycobacterium tuberculosis
IPPGN

SEQ ID NO: 1434574 - protein, 7 aa, Mycobacterium tuberculosis
IPSRNPI

SEQ ID NO: 1434575 - protein, 4 aa, Mycobacterium tuberculosis
IPTR

SEQ ID NO: 1434576 - protein, 4 aa, Mycobacterium tuberculosis
IPYG

SEQ ID NO: 1434577 - protein, 9 aa, Mycobacterium tuberculosis
IQPSGSVAR

SEQ ID NO: 1434578 - protein, 7 aa, Mycobacterium tuberculosis
IQSVGAG

SEQ ID NO: 1434579 - protein, 4 aa, Mycobacterium tuberculosis
IRAD

SEQ ID NO: 1434580 - protein, 4 aa, Mycobacterium tuberculosis
IRAS

SEQ ID NO: 1434581 - protein, 7 aa, Mycobacterium tuberculosis
IREGREG

SEQ ID NO: 1434582 - protein, 13 aa, Mycobacterium tuberculosis
IRPAGETFATPDA

SEQ ID NO: 1434583 - protein, 7 aa, Mycobacterium tuberculosis
IRPAPDT

SEQ ID NO: 1434584 - protein, 5 aa, Mycobacterium tuberculosis
IRPGE

SEQ ID NO: 1434585 - protein, 5 aa, Mycobacterium tuberculosis
ISAGA

SEQ ID NO: 1434586 - protein, 4 aa, Mycobacterium tuberculosis
ISAR

SEQ ID NO: 1434587 - protein, 9 aa, Mycobacterium tuberculosis
ISGDPNALR

SEQ ID NO: 1434588 - protein, 4 aa, Mycobacterium tuberculosis
ISGL

SEQ ID NO: 1434589 - protein, 10 aa, Mycobacterium tuberculosis
ISGSGNQRLP

SEQ ID NO: 1434590 - protein, 11 aa, Mycobacterium tuberculosis
ISLTTKGTDAI

SEQ ID NO: 1434591 - protein, 4 aa, Mycobacterium tuberculosis
ISNA

SEQ ID NO: 1434592 - protein, 15 aa, Mycobacterium tuberculosis
ISPRKVNKPLTGQYT

SEQ ID NO: 1434593 - protein, 4 aa, Mycobacterium tuberculosis
ITES

SEQ ID NO: 1434594 - protein, 10 aa, Mycobacterium tuberculosis
ITPGSGPKRS

SEQ ID NO: 1434595 - protein, 5 aa, Mycobacterium tuberculosis
ITQGK

SEQ ID NO: 1434596 - protein, 7 aa, Mycobacterium tuberculosis
IVEPGGD

SEQ ID NO: 1434597 - protein, 14 aa, Mycobacterium tuberculosis
IVESTTKTKRDRHV

SEQ ID NO: 1434598 - protein, 4 aa, Mycobacterium tuberculosis
KAAG

SEQ ID NO: 1434599 - protein, 8 aa, Mycobacterium tuberculosis
KAAGAQLV

SEQ ID NO: 1434600 - protein, 8 aa, Mycobacterium tuberculosis
KAAGNVDT

SEQ ID NO: 1434601 - protein, 5 aa, Mycobacterium tuberculosis
KAARK

SEQ ID NO: 1434602 - protein, 29 aa, Mycobacterium tuberculosis
KAATLGATSTHATTPSGLDGPGGSGASTA

SEQ ID NO: 1434603 - protein, 12 aa, Mycobacterium tuberculosis
KADAPSGTAART

SEQ ID NO: 1434604 - protein, 7 aa, Mycobacterium tuberculosis
KADESYQ

SEQ ID NO: 1434605 - protein, 11 aa, Mycobacterium tuberculosis
KADGGSSWGNQ

SEQ ID NO: 1434606 - protein, 7 aa, Mycobacterium tuberculosis
KADPSMG

SEQ ID NO: 1434607 - protein, 5 aa, Mycobacterium tuberculosis
KAGEQ

SEQ ID NO: 1434608 - protein, 8 aa, Mycobacterium tuberculosis
KAGTDYAD

SEQ ID NO: 1434609 - protein, 7 aa, Mycobacterium tuberculosis
KAHEAAA

SEQ ID NO: 1434610 - protein, 8 aa, Mycobacterium tuberculosis
KAKEHEEI

SEQ ID NO: 1434611 - protein, 5 aa, Mycobacterium tuberculosis
KAMRE

SEQ ID NO: 1434612 - protein, 9 aa, Mycobacterium tuberculosis
KAPGQRIPR

SEQ ID NO: 1434613 - protein, 4 aa, Mycobacterium tuberculosis
KATV

SEQ ID NO: 1434614 - protein, 12 aa, Mycobacterium tuberculosis
KAVAEEATKRTV

SEQ ID NO: 1434615 - protein, 373 aa, Mycobacterium tuberculosis; identical to SEQ ID NO: 179035

SEQ ID NO: 1434616 - protein, 7 aa, Mycobacterium tuberculosis
KDGIEEA

SEQ ID NO: 1434617 - protein, 4 aa, Mycobacterium tuberculosis
KDGQ

SEQ ID NO: 1434618 - protein, 9 aa, Mycobacterium tuberculosis
KDGTLGGPN

SEQ ID NO: 1434619 - protein, 6 aa, Mycobacterium tuberculosis
KDGTLH

SEQ ID NO: 1434620 - protein, 7 aa, Mycobacterium tuberculosis
KDNAQQV

SEQ ID NO: 1434621 - protein, 12 aa, Mycobacterium tuberculosis
KDPMVPSAQSRA

SEQ ID NO: 1434622 - protein, 6 aa, Mycobacterium tuberculosis
KDRELR

SEQ ID NO: 1434623 - protein, 6 aa, Mycobacterium tuberculosis
KECYSS

SEQ ID NO: 1434624 - protein, 5 aa, Mycobacterium tuberculosis
KEVAR

SEQ ID NO: 1434625 - protein, 10 aa, Mycobacterium tuberculosis
KFTSAESRTL

SEQ ID NO: 1434626 - protein, 6 aa, Mycobacterium tuberculosis
KGAVAD

SEQ ID NO: 1434627 - protein, 5 aa, Mycobacterium tuberculosis
KGDPH

SEQ ID NO: 1434628 - protein, 7 aa, Mycobacterium tuberculosis
KGDVGED

SEQ ID NO: 1434629 - protein, 4 aa, Mycobacterium tuberculosis
KGGR

SEQ ID NO: 1434630 - protein, 6 aa, Mycobacterium tuberculosis
KGLGAD

SEQ ID NO: 1434631 - protein, 13 aa, Mycobacterium tuberculosis
KGQLDGPGPSAGP

SEQ ID NO: 1434632 - protein, 7 aa, Mycobacterium tuberculosis
KGTSGID

SEQ ID NO: 1434633 - protein, 4 aa, Mycobacterium tuberculosis
KGTV

SEQ ID NO: 1434634 - protein, 4 aa, Mycobacterium tuberculosis
KHPW

SEQ ID NO: 1434635 - protein, 6 aa, Mycobacterium tuberculosis
KIGYPP

SEQ ID NO: 1434636 - protein, 6 aa, Mycobacterium tuberculosis
KIPDED

SEQ ID NO: 1434637 - protein, 20 aa, Mycobacterium tuberculosis
KITAATAGIATTTFPETPSI

SEQ ID NO: 1434638 - protein, 6 aa, Mycobacterium tuberculosis
KITERT

SEQ ID NO: 1434639 - protein, 9 aa, Mycobacterium tuberculosis
KKGSGHQEV

SEQ ID NO: 1434640 - protein, 16 aa, Mycobacterium tuberculosis
KKPVGYTSTVNGRRKR

SEQ ID NO: 1434641 - protein, 4 aa, Mycobacterium tuberculosis
KLNG

SEQ ID NO: 1434642 - protein, 42 aa, Mycobacterium tuberculosis
KNGAQQDRVPGGHSRSPRRPPPNSAHASCSTPRCVASTGTER

SEQ ID NO: 1434643 - protein, 8 aa, Mycobacterium tuberculosis
KNMSPANI

SEQ ID NO: 1434644 - protein, 4 aa, Mycobacterium tuberculosis
KNPF

SEQ ID NO: 1434645 - protein, 11 aa, Mycobacterium tuberculosis
KNTRPTSETAE

SEQ ID NO: 1434646 - protein, 13 aa, Mycobacterium tuberculosis
KPESDDVRDSPAL

SEQ ID NO: 1434647 - protein, 6 aa, Mycobacterium tuberculosis
KPGDKR

SEQ ID NO: 1434648 - protein, 13 aa, Mycobacterium tuberculosis
KPNTVIGGRGYRL

SEQ ID NO: 1434649 - protein, 9 aa, Mycobacterium tuberculosis
KPSTRTRRL

SEQ ID NO: 1434650 - protein, 7 aa, Mycobacterium tuberculosis
KQADGGR

SEQ ID NO: 1434651 - protein, 10 aa, Mycobacterium tuberculosis
KQALKERKTI

SEQ ID NO: 1434652 - protein, 5 aa, Mycobacterium tuberculosis
KQASA

SEQ ID NO: 1434653 - protein, 8 aa, Mycobacterium tuberculosis
KQKRSVTR

SEQ ID NO: 1434654 - protein, 7 aa, Mycobacterium tuberculosis
KQRGKTT

SEQ ID NO: 1434655 - protein, 7 aa, Mycobacterium tuberculosis
KRASKIA

SEQ ID NO: 1434656 - protein, 13 aa, Mycobacterium tuberculosis
KRETSKNDDDRRA

SEQ ID NO: 1434657 - protein, 51 aa, Mycobacterium tuberculosis; identical to SEQ ID NO: 179461

SEQ ID NO: 1434658 - protein, 7 aa, Mycobacterium tuberculosis
KRHWPTS

SEQ ID NO: 1434659 - protein, 6 aa, Mycobacterium tuberculosis
KRIRAN

SEQ ID NO: 1434660 - protein, 5 aa, Mycobacterium tuberculosis
KRPNT

SEQ ID NO: 1434661 - protein, 9 aa, Mycobacterium tuberculosis
KRSPELSHT

SEQ ID NO: 1434662 - protein, 9 aa, Mycobacterium tuberculosis
KRTETPRTT

SEQ ID NO: 1434663 - protein, 9 aa, Mycobacterium tuberculosis
KSAARKRAA

SEQ ID NO: 1434664 - protein, 4 aa, Mycobacterium tuberculosis
KSDE

SEQ ID NO: 1434665 - protein, 5 aa, Mycobacterium tuberculosis
KSDSL

SEQ ID NO: 1434666 - protein, 5 aa, Mycobacterium tuberculosis
KSGAL

SEQ ID NO: 1434667 - protein, 7 aa, Mycobacterium tuberculosis
KSIPLSS

SEQ ID NO: 1434668 - protein, 4 aa, Mycobacterium tuberculosis
KSLN

SEQ ID NO: 1434669 - protein, 5 aa, Mycobacterium tuberculosis
KSPSF

SEQ ID NO: 1434670 - protein, 8 aa, Mycobacterium tuberculosis
KSSARPAL

SEQ ID NO: 1434671 - protein, 4 aa, Mycobacterium tuberculosis
KSTF

SEQ ID NO: 1434672 - protein, 7 aa, Mycobacterium tuberculosis
KSTGLDV

SEQ ID NO: 1434673 - protein, 5 aa, Mycobacterium tuberculosis
KSVGQ

SEQ ID NO: 1434674 - protein, 5 aa, Mycobacterium tuberculosis
KSVVT

SEQ ID NO: 1434675 - protein, 4 aa, Mycobacterium tuberculosis
KTAD

SEQ ID NO: 1434676 - protein, 8 aa, Mycobacterium tuberculosis
KTEADGEP

SEQ ID NO: 1434677 - protein, 5 aa, Mycobacterium tuberculosis
KTGVR

SEQ ID NO: 1434678 - protein, 7 aa, Mycobacterium tuberculosis
KTKTEAL

SEQ ID NO: 1434679 - protein, 5 aa, Mycobacterium tuberculosis
KTLND

SEQ ID NO: 1434680 - protein, 7 aa, Mycobacterium tuberculosis
KTPFTST

SEQ ID NO: 1434681 - protein, 12 aa, Mycobacterium tuberculosis
KTPHIRARGAPS

SEQ ID NO: 1434682 - protein, 4 aa, Mycobacterium tuberculosis
KTRE

SEQ ID NO: 1434683 - protein, 8 aa, Mycobacterium tuberculosis
KTSADSGK

SEQ ID NO: 1434684 - protein, 7 aa, Mycobacterium tuberculosis
KTSEEDM

SEQ ID NO: 1434685 - protein, 7 aa, Mycobacterium tuberculosis
KTTSVSK

SEQ ID NO: 1434686 - protein, 6 aa, Mycobacterium tuberculosis
KTWQPA

SEQ ID NO: 1434687 - protein, 4 aa, Mycobacterium tuberculosis
KVAV

SEQ ID NO: 1434688 - protein, 8 aa, Mycobacterium tuberculosis
KVGQASGH

SEQ ID NO: 1434689 - protein, 5 aa, Mycobacterium tuberculosis
KVPKE

SEQ ID NO: 1434690 - protein, 17 aa, Mycobacterium tuberculosis
KVSGGPSRSGDLVPAGP

SEQ ID NO: 1434691 - protein, 4 aa, Mycobacterium tuberculosis
KVSP

SEQ ID NO: 1434692 - protein, 8 aa, Mycobacterium tuberculosis
KVTGAGST

SEQ ID NO: 1434693 - protein, 9 aa, Mycobacterium tuberculosis
LAAASTPGI

SEQ ID NO: 1434694 - protein, 11 aa, Mycobacterium tuberculosis
LAADRDALTAA

SEQ ID NO: 1434695 - protein, 9 aa, Mycobacterium tuberculosis
LAAGTGIRG

SEQ ID NO: 1434696 - protein, 8 aa, Mycobacterium tuberculosis
LAAGTSTA

SEQ ID NO: 1434697 - protein, 4 aa, Mycobacterium tuberculosis
LAAH

SEQ ID NO: 1434698 - protein, 19 aa, Mycobacterium tuberculosis
LAATGQASQRAAGASGGVT

SEQ ID NO: 1434699 - protein, 23 aa, Mycobacterium tuberculosis
LAATRVGGYGKLPADTHPSGGCS

SEQ ID NO: 1434700 - protein, 11 aa, Mycobacterium tuberculosis
LAATSPQVGQD

SEQ ID NO: 1434701 - protein, 5 aa, Mycobacterium tuberculosis
LADAG

SEQ ID NO: 1434702 - protein, 7 aa, Mycobacterium tuberculosis
LADGSAA

SEQ ID NO: 1434703 - protein, 6 aa, Mycobacterium tuberculosis
LADPRR

SEQ ID NO: 1434704 - protein, 4 aa, Mycobacterium tuberculosis
LAEA

SEQ ID NO: 1434705 - protein, 5 aa, Mycobacterium tuberculosis
LAEAG

SEQ ID NO: 1434706 - protein, 16 aa, Mycobacterium tuberculosis
LAEGPAQRAVTEDRTV

SEQ ID NO: 1434707 - protein, 8 aa, Mycobacterium tuberculosis
LAEPKSNA

SEQ ID NO: 1434708 - protein, 125 aa, Mycobacterium tuberculosis
LAEQPGVPGQHAGGGTQSGPAHADESAASVTPAAASGVPGARAAAAAPSGTAVGAGARSSVGTAAASGAGSHAATGRAPVATSDKAAAPSTRAASARTAPPARPPSTDHIDKPDRSESADDGTPV

SEQ ID NO: 1434709 - protein, 13 aa, Mycobacterium tuberculosis
LAGKPKPDGTPTF

SEQ ID NO: 1434710 - protein, 4 aa, Mycobacterium tuberculosis
LAGV

SEQ ID NO: 1434711 - protein, 5 aa, Mycobacterium tuberculosis
LAGVG

SEQ ID NO: 1434712 - protein, 13 aa, Mycobacterium tuberculosis
LAKAATSDAYDNA

SEQ ID NO: 1434713 - protein, 5 aa, Mycobacterium tuberculosis
LAPGR

SEQ ID NO: 1434714 - protein, 7 aa, Mycobacterium tuberculosis
LARTGDR

SEQ ID NO: 1434715 - protein, 7 aa, Mycobacterium tuberculosis
LASGDVN

SEQ ID NO: 1434716 - protein, 9 aa, Mycobacterium tuberculosis
LASPTRRGE

SEQ ID NO: 1434717 - protein, 6 aa, Mycobacterium tuberculosis
LASTPK

SEQ ID NO: 1434718 - protein, 6 aa, Mycobacterium tuberculosis
LATPQG

SEQ ID NO: 1434719 - protein, 15 aa, Mycobacterium tuberculosis
LDAEPDLDVEPGEDL

SEQ ID NO: 1434720 - protein, 4 aa, Mycobacterium tuberculosis
LDAP

SEQ ID NO: 1434721 - protein, 14 aa, Mycobacterium tuberculosis
LDAPQSPVKPEEPI

SEQ ID NO: 1434722 - protein, 9 aa, Mycobacterium tuberculosis
LDDDPWSPE

SEQ ID NO: 1434723 - protein, 4 aa, Mycobacterium tuberculosis
LDPQ

SEQ ID NO: 1434724 - protein, 5 aa, Mycobacterium tuberculosis
LDSGP

SEQ ID NO: 1434725 - protein, 10 aa, Mycobacterium tuberculosis
LDSRSSQELR

SEQ ID NO: 1434726 - protein, 6 aa, Mycobacterium tuberculosis
LEEGQA

SEQ ID NO: 1434727 - protein, 11 aa, Mycobacterium tuberculosis
LEGVSADRAPQ

SEQ ID NO: 1434728 - protein, 10 aa, Mycobacterium tuberculosis
LEKDPAIHDN

SEQ ID NO: 1434729 - protein, 8 aa, Mycobacterium tuberculosis
LERAAADP

SEQ ID NO: 1434730 - protein, 10 aa, Mycobacterium tuberculosis
LETGRGSHED

SEQ ID NO: 1434731 - protein, 6 aa, Mycobacterium tuberculosis
LGANPG

SEQ ID NO: 1434732 - protein, 6 aa, Mycobacterium tuberculosis
LGDDRT

SEQ ID NO: 1434733 - protein, 8 aa, Mycobacterium tuberculosis
LGGCGGGA

SEQ ID NO: 1434734 - protein, 5 aa, Mycobacterium tuberculosis
LGGKN

SEQ ID NO: 1434735 - protein, 10 aa, Mycobacterium tuberculosis
LGGPETHHKK

SEQ ID NO: 1434736 - protein, 5 aa, Mycobacterium tuberculosis
LGGSN

SEQ ID NO: 1434737 - protein, 7 aa, Mycobacterium tuberculosis
LGLPPGM

SEQ ID NO: 1434738 - protein, 11 aa, Mycobacterium tuberculosis
LGNGTVQATVS

SEQ ID NO: 1434739 - protein, 182 aa, Mycobacterium tuberculosis; identical to SEQ ID NO: 192803

SEQ ID NO: 1434740 - protein, 4 aa, Mycobacterium tuberculosis
LGNT

SEQ ID NO: 1434741 - protein, 4 aa, Mycobacterium tuberculosis
LGNV

SEQ ID NO: 1434742 - protein, 16 aa, Mycobacterium tuberculosis
LGPRSTLPGVGGMSPV

SEQ ID NO: 1434743 - protein, 20 aa, Mycobacterium tuberculosis
LGPYAAQRGLDASPAALAAD

SEQ ID NO: 1434744 - protein, 6 aa, Mycobacterium tuberculosis
LGQGIP

SEQ ID NO: 1434745 - protein, 8 aa, Mycobacterium tuberculosis
LGQPPSED

SEQ ID NO: 1434746 - protein, 8 aa, Mycobacterium tuberculosis
LGQPPSGY

SEQ ID NO: 1434747 - protein, 9 aa, Mycobacterium tuberculosis
LGRAASVGS

SEQ ID NO: 1434748 - protein, 5 aa, Mycobacterium tuberculosis
LGRGE

SEQ ID NO: 1434749 - protein, 14 aa, Mycobacterium tuberculosis
LGRGHGPVSPLFRL

SEQ ID NO: 1434750 - protein, 7 aa, Mycobacterium tuberculosis
LGSESAL

SEQ ID NO: 1434751 - protein, 6 aa, Mycobacterium tuberculosis
LGSPKQ

SEQ ID NO: 1434752 - protein, 7 aa, Mycobacterium tuberculosis
LGSTDMG

SEQ ID NO: 1434753 - protein, 6 aa, Mycobacterium tuberculosis
LGTDRS

SEQ ID NO: 1434754 - protein, 6 aa, Mycobacterium tuberculosis
LGTGGF

SEQ ID NO: 1434755 - protein, 4 aa, Mycobacterium tuberculosis
LGYG

SEQ ID NO: 1434756 - protein, 11 aa, Mycobacterium tuberculosis
LHSNPAEARRV

SEQ ID NO: 1434757 - protein, 17 aa, Mycobacterium tuberculosis
LIPGGKSLSGGSAHSPA

SEQ ID NO: 1434758 - protein, 20 aa, Mycobacterium tuberculosis
LKPAGTTEFGTRTETKNVNS

SEQ ID NO: 1434759 - protein, 12 aa, Mycobacterium tuberculosis
LKQNERLKRENR

SEQ ID NO: 1434760 - protein, 15 aa, Mycobacterium tuberculosis
LKSGTTVNLEVVDVG

SEQ ID NO: 1434761 - protein, 12 aa, Mycobacterium tuberculosis
LNASGRSPSAWT

SEQ ID NO: 1434762 - protein, 9 aa, Mycobacterium tuberculosis
LNKPSNSDV

SEQ ID NO: 1434763 - protein, 6 aa, Mycobacterium tuberculosis
LNPSPE

SEQ ID NO: 1434764 - protein, 6 aa, Mycobacterium tuberculosis
LNSGSH

SEQ ID NO: 1434765 - protein, 9 aa, Mycobacterium tuberculosis
LNTGYGNSG

SEQ ID NO: 1434766 - protein, 11 aa, Mycobacterium tuberculosis
LPAPTGTAPIE

SEQ ID NO: 1434767 - protein, 6 aa, Mycobacterium tuberculosis
LPEDGD

SEQ ID NO: 1434768 - protein, 18 aa, Mycobacterium tuberculosis
LPEGLTDAQAAAVTTASA

SEQ ID NO: 1434769 - protein, 21 aa, Mycobacterium tuberculosis
LPGATAGARSTDIENSRGSAN

SEQ ID NO: 1434770 - protein, 9 aa, Mycobacterium tuberculosis
LPGGARSGL

SEQ ID NO: 1434771 - protein, 5 aa, Mycobacterium tuberculosis
LPGGS

SEQ ID NO: 1434772 - protein, 13 aa, Mycobacterium tuberculosis
LPISPTSEGTPMT

SEQ ID NO: 1434773 - protein, 5 aa, Mycobacterium tuberculosis
LPNAS

SEQ ID NO: 1434774 - protein, 10 aa, Mycobacterium tuberculosis
LPPAPAPPVR

SEQ ID NO: 1434775 - protein, 9 aa, Mycobacterium tuberculosis
LPPIDEPDT

SEQ ID NO: 1434776 - protein, 6 aa, Mycobacterium tuberculosis
LPPRFQ

SEQ ID NO: 1434777 - protein, 8 aa, Mycobacterium tuberculosis
LPTRATGA

SEQ ID NO: 1434778 - protein, 6 aa, Mycobacterium tuberculosis
LQRDTD

SEQ ID NO: 1434779 - protein, 12 aa, Mycobacterium tuberculosis
LQSGSQEDETAW

SEQ ID NO: 1434780 - protein, 13 aa, Mycobacterium tuberculosis
LQTGQSLTSITPK

SEQ ID NO: 1434781 - protein, 16 aa, Mycobacterium tuberculosis
LQTREATYYSRSRAEQ

SEQ ID NO: 1434782 - protein, 6 aa, Mycobacterium tuberculosis
LRASTR

SEQ ID NO: 1434783 - protein, 16 aa, Mycobacterium tuberculosis
LREATAAAAGPTTGLA

SEQ ID NO: 1434784 - protein, 6 aa, Mycobacterium tuberculosis
LRESKE

SEQ ID NO: 1434785 - protein, 5 aa, Mycobacterium tuberculosis
LRQNT

SEQ ID NO: 1434786 - protein, 8 aa, Mycobacterium tuberculosis
LRRSARAA

SEQ ID NO: 1434787 - protein, 5 aa, Mycobacterium tuberculosis
LRSGA

SEQ ID NO: 1434788 - protein, 8 aa, Mycobacterium tuberculosis
LRSPDTAR

SEQ ID NO: 1434789 - protein, 9 aa, Mycobacterium tuberculosis
LRTPGGNQT

SEQ ID NO: 1434790 - protein, 6 aa, Mycobacterium tuberculosis
LSADEL

SEQ ID NO: 1434791 - protein, 4 aa, Mycobacterium tuberculosis
LSAE

SEQ ID NO: 1434792 - protein, 7 aa, Mycobacterium tuberculosis
LSDCDAH

SEQ ID NO: 1434793 - protein, 17 aa, Mycobacterium tuberculosis
LSDGRAGTFPTVNPATE

SEQ ID NO: 1434794 - protein, 4 aa, Mycobacterium tuberculosis
LSEA

SEQ ID NO: 1434795 - protein, 4 aa, Mycobacterium tuberculosis
LSED

SEQ ID NO: 1434796 - protein, 10 aa, Mycobacterium tuberculosis
LSEGTVKGDE

SEQ ID NO: 1434797 - protein, 11 aa, Mycobacterium tuberculosis
LSGVSAAGTTL

SEQ ID NO: 1434798 - protein, 8 aa, Mycobacterium tuberculosis
LSKTGREF

SEQ ID NO: 1434799 - protein, 9 aa, Mycobacterium tuberculosis
LSPGGSDAS

SEQ ID NO: 1434800 - protein, 7 aa, Mycobacterium tuberculosis
LSRDDAT

SEQ ID NO: 1434801 - protein, 12 aa, Mycobacterium tuberculosis
LSREKSTFAAAV

SEQ ID NO: 1434802 - protein, 11 aa, Mycobacterium tuberculosis
LSRGNDNALGP

SEQ ID NO: 1434803 - protein, 6 aa, Mycobacterium tuberculosis
LSSGAD

SEQ ID NO: 1434804 - protein, 7 aa, Mycobacterium tuberculosis
LSSPIDA

SEQ ID NO: 1434805 - protein, 6 aa, Mycobacterium tuberculosis
LSSQEL

SEQ ID NO: 1434806 - protein, 8 aa, Mycobacterium tuberculosis
LSSRRRAQ

SEQ ID NO: 1434807 - protein, 4 aa, Mycobacterium tuberculosis
LSTR

SEQ ID NO: 1434808 - protein, 4 aa, Mycobacterium tuberculosis
LSTS

SEQ ID NO: 1434809 - protein, 11 aa, Mycobacterium tuberculosis
LTAPEGTPGEW

SEQ ID NO: 1434810 - protein, 5 aa, Mycobacterium tuberculosis
LTDAE

SEQ ID NO: 1434811 - protein, 14 aa, Mycobacterium tuberculosis
LTDPPKLKKQEKHD

SEQ ID NO: 1434812 - protein, 9 aa, Mycobacterium tuberculosis
LTEADGPTV

SEQ ID NO: 1434813 - protein, 11 aa, Mycobacterium tuberculosis
LTGKSKDEVTA

SEQ ID NO: 1434814 - protein, 21 aa, Mycobacterium tuberculosis
LTGRPPRAIPDPAPRSSHGPA

SEQ ID NO: 1434815 - protein, 5 aa, Mycobacterium tuberculosis
LTGRQ

SEQ ID NO: 1434816 - protein, 4 aa, Mycobacterium tuberculosis
LTPS

SEQ ID NO: 1434817 - protein, 4 aa, Mycobacterium tuberculosis
LTQR

SEQ ID NO: 1434818 - protein, 10 aa, Mycobacterium tuberculosis
LTSRPGGGGW

SEQ ID NO: 1434819 - protein, 13 aa, Mycobacterium tuberculosis
LTTGGPGAAGGDA

SEQ ID NO: 1434820 - protein, 38 aa, Mycobacterium tuberculosis; identical to SEQ ID NO: 192837

SEQ ID NO: 1434821 - protein, 8 aa, Mycobacterium tuberculosis
MAGGSADA

SEQ ID NO: 1434822 - protein, 30 aa, Mycobacterium tuberculosis
MARGGTNSAPGTATESARAPEPAASAPPEA

SEQ ID NO: 1434823 - protein, 9 aa, Mycobacterium tuberculosis
MASTDAAAQ

SEQ ID NO: 1434824 - protein, 11 aa, Mycobacterium tuberculosis
MDPWRDRTTEE

SEQ ID NO: 1434825 - protein, 11 aa, Mycobacterium tuberculosis
MEPKSAATEAY

SEQ ID NO: 1434826 - protein, 5 aa, Mycobacterium tuberculosis
MEPVP

SEQ ID NO: 1434827 - protein, 5 aa, Mycobacterium tuberculosis
MGEKD

SEQ ID NO: 1434828 - protein, 9 aa, Mycobacterium tuberculosis
MGRATSGVQ

SEQ ID NO: 1434829 - protein, 10 aa, Mycobacterium tuberculosis
MHGSASEACG

SEQ ID NO: 1434830 - protein, 4 aa, Mycobacterium tuberculosis
MKPG

SEQ ID NO: 1434831 - protein, 6 aa, Mycobacterium tuberculosis
MKPNTP

SEQ ID NO: 1434832 - protein, 15 aa, Mycobacterium tuberculosis
MNAQNAAAAAPTTGV

SEQ ID NO: 1434833 - protein, 7 aa, Mycobacterium tuberculosis
MPSSGGV

SEQ ID NO: 1434834 - protein, 14 aa, Mycobacterium tuberculosis
MPTGGTLLRWSAPL

SEQ ID NO: 1434835 - protein, 4 aa, Mycobacterium tuberculosis
MRPD

SEQ ID NO: 1434836 - protein, 30 aa, Mycobacterium tuberculosis
MRPPAPPAAPPGAPGMPGMPGMPGAPPVPG

SEQ ID NO: 1434837 - protein, 9 aa, Mycobacterium tuberculosis
MRSNPGAGG

SEQ ID NO: 1434838 - protein, 10 aa, Mycobacterium tuberculosis
MRSTNGQAKA

SEQ ID NO: 1434839 - protein, 15 aa, Mycobacterium tuberculosis
MRTDPSAQPAPEQPI

SEQ ID NO: 1434840 - protein, 12 aa, Mycobacterium tuberculosis
MSAGAQGNSNVT

SEQ ID NO: 1434841 - protein, 12 aa, Mycobacterium tuberculosis
MSEGKDEATMAE

SEQ ID NO: 1434842 - protein, 7 aa, Mycobacterium tuberculosis
MSPEFGS

SEQ ID NO: 1434843 - protein, 22 aa, Mycobacterium tuberculosis
MTRPSPPRPGSPTLPVDGEDPF

SEQ ID NO: 1434844 - protein, 9 aa, Mycobacterium tuberculosis
MVDGRPEDL

SEQ ID NO: 1434845 - protein, 19 aa, Mycobacterium tuberculosis
MYGADGKLKDTKAVNPEST

SEQ ID NO: 1434846 - protein, 9 aa, Mycobacterium tuberculosis
MYSGPGAGS

SEQ ID NO: 1434847 - protein, 10 aa, Mycobacterium tuberculosis
NAAAAAPTAG

SEQ ID NO: 1434848 - protein, 21 aa, Mycobacterium tuberculosis
NAAAAVPTTGALAPAADEVSA

SEQ ID NO: 1434849 - protein, 12 aa, Mycobacterium tuberculosis
NAANAAAALPTT

SEQ ID NO: 1434850 - protein, 11 aa, Mycobacterium tuberculosis
NADAANASRDA

SEQ ID NO: 1434851 - protein, 8 aa, Mycobacterium tuberculosis
NADKTVEQ

SEQ ID NO: 1434852 - protein, 7 aa, Mycobacterium tuberculosis
NAFEDPA

SEQ ID NO: 1434853 - protein, 5 aa, Mycobacterium tuberculosis
NAGAK

SEQ ID NO: 1434854 - protein, 8 aa, Mycobacterium tuberculosis
NAGMQPSE

SEQ ID NO: 1434855 - protein, 7 aa, Mycobacterium tuberculosis
NAHPTGE

SEQ ID NO: 1434856 - protein, 14 aa, Mycobacterium tuberculosis
NANLGNNNLGSGNF

SEQ ID NO: 1434857 - protein, 5 aa, Mycobacterium tuberculosis
NAPAI

SEQ ID NO: 1434858 - protein, 27 aa, Mycobacterium tuberculosis
NASGGAGGSGGSSLSGKAGAGGAGGSA

SEQ ID NO: 1434859 - protein, 8 aa, Mycobacterium tuberculosis
NATPQSPR

SEQ ID NO: 1434860 - protein, 5 aa, Mycobacterium tuberculosis
NATTV

SEQ ID NO: 1434861 - protein, 7 aa, Mycobacterium tuberculosis
NDDNRIN

SEQ ID NO: 1434862 - protein, 4 aa, Mycobacterium tuberculosis
NDHI

SEQ ID NO: 1434863 - protein, 6 aa, Mycobacterium tuberculosis
NDPPEE

SEQ ID NO: 1434864 - protein, 7 aa, Mycobacterium tuberculosis
NEFPDPT

SEQ ID NO: 1434865 - protein, 26 aa, Mycobacterium tuberculosis
NEFRPTRRDGPQGSRYRPHGGTGHRA

SEQ ID NO: 1434866 - protein, 39 aa, Mycobacterium tuberculosis
NGASGGSAGIAGNGGDTGLVGNGGAGGNGGNGAAGSALG

SEQ ID NO: 1434867 - protein, 4 aa, Mycobacterium tuberculosis
NGDQ

SEQ ID NO: 1434868 - protein, 5 aa, Mycobacterium tuberculosis
NGEGI

SEQ ID NO: 1434869 - protein, 4 aa, Mycobacterium tuberculosis
NGEV

SEQ ID NO: 1434870 - protein, 25 aa, Mycobacterium tuberculosis
NGGAGGAGGTGSTAGGAGGAGGAGG

SEQ ID NO: 1434871 - protein, 20 aa, Mycobacterium tuberculosis
NGGAGGNGGSAAAAGRAGGN

SEQ ID NO: 1434872 - protein, 24 aa, Mycobacterium tuberculosis
NGGAGGSGAGGASSAHGGAGGQAG

SEQ ID NO: 1434873 - protein, 68 aa, Mycobacterium tuberculosis; identical to SEQ ID NO: 181305

SEQ ID NO: 1434874 - protein, 16 aa, Mycobacterium tuberculosis
NGGNGGAGGNGGAAGL

SEQ ID NO: 1434875 - protein, 27 aa, Mycobacterium tuberculosis
NGGNGGLGGDGDGGTGGGHGGNGGNPG

SEQ ID NO: 1434876 - protein, 22 aa, Mycobacterium tuberculosis
NGGNGGSGAAGQAGGAGGPAGL

SEQ ID NO: 1434877 - protein, 15 aa, Mycobacterium tuberculosis
NGGTGGAGGAAGATL

SEQ ID NO: 1434878 - protein, 8 aa, Mycobacterium tuberculosis
NGIPKAGR

SEQ ID NO: 1434879 - protein, 11 aa, Mycobacterium tuberculosis
NGLATHAKPGT

SEQ ID NO: 1434880 - protein, 7 aa, Mycobacterium tuberculosis
NGPTETT

SEQ ID NO: 1434881 - protein, 5 aa, Mycobacterium tuberculosis
NGQPA

SEQ ID NO: 1434882 - protein, 4 aa, Mycobacterium tuberculosis
NGRI

SEQ ID NO: 1434883 - protein, 4 aa, Mycobacterium tuberculosis
NGYT

SEQ ID NO: 1434884 - protein, 7 aa, Mycobacterium tuberculosis
NHEPRRN

SEQ ID NO: 1434885 - protein, 6 aa, Mycobacterium tuberculosis
NHRELD

SEQ ID NO: 1434886 - protein, 14 aa, Mycobacterium tuberculosis
NHRPGDLSGGQQQR

SEQ ID NO: 1434887 - protein, 6 aa, Mycobacterium tuberculosis
NHTTSA

SEQ ID NO: 1434888 - protein, 4 aa, Mycobacterium tuberculosis
NIDG

SEQ ID NO: 1434889 - protein, 9 aa, Mycobacterium tuberculosis
NIGEPQPEL

SEQ ID NO: 1434890 - protein, 5 aa, Mycobacterium tuberculosis
NIGST

SEQ ID NO: 1434891 - protein, 5 aa, Mycobacterium tuberculosis
NITTA

SEQ ID NO: 1434892 - protein, 6 aa, Mycobacterium tuberculosis
NKPFGR

SEQ ID NO: 1434893 - protein, 7 aa, Mycobacterium tuberculosis
NKTPIDK

SEQ ID NO: 1434894 - protein, 8 aa, Mycobacterium tuberculosis
NLGHTEAA

SEQ ID NO: 1434895 - protein, 8 aa, Mycobacterium tuberculosis
NLGKDERH

SEQ ID NO: 1434896 - protein, 10 aa, Mycobacterium tuberculosis
NMGHTQAAAG

SEQ ID NO: 1434897 - protein, 7 aa, Mycobacterium tuberculosis
NNGLTAS

SEQ ID NO: 1434898 - protein, 56 aa, Mycobacterium tuberculosis; identical to SEQ ID NO: 181509

SEQ ID NO: 1434899 - protein, 7 aa, Mycobacterium tuberculosis
NNLHSRG

SEQ ID NO: 1434900 - protein, 6 aa, Mycobacterium tuberculosis
NNPLGT

SEQ ID NO: 1434901 - protein, 9 aa, Mycobacterium tuberculosis
NNPVAQYTP

SEQ ID NO: 1434902 - protein, 5 aa, Mycobacterium tuberculosis
NNQVG

SEQ ID NO: 1434903 - protein, 4 aa, Mycobacterium tuberculosis
NNRL

SEQ ID NO: 1434904 - protein, 11 aa, Mycobacterium tuberculosis
NNSTDDTATVA

SEQ ID NO: 1434905 - protein, 4 aa, Mycobacterium tuberculosis
NPAR

SEQ ID NO: 1434906 - protein, 5 aa, Mycobacterium tuberculosis
NPAVP

SEQ ID NO: 1434907 - protein, 9 aa, Mycobacterium tuberculosis
NPDPRTTSR

SEQ ID NO: 1434908 - protein, 4 aa, Mycobacterium tuberculosis
NPGF

SEQ ID NO: 1434909 - protein, 12 aa, Mycobacterium tuberculosis
NPHRPRPSDPDG

SEQ ID NO: 1434910 - protein, 4 aa, Mycobacterium tuberculosis
NPKV

SEQ ID NO: 1434911 - protein, 6 aa, Mycobacterium tuberculosis
NPPERL

SEQ ID NO: 1434912 - protein, 6 aa, Mycobacterium tuberculosis
NPQLPT

SEQ ID NO: 1434913 - protein, 6 aa, Mycobacterium tuberculosis
NPSRSL

SEQ ID NO: 1434914 - protein, 9 aa, Mycobacterium tuberculosis
NPTGDTAPF

SEQ ID NO: 1434915 - protein, 15 aa, Mycobacterium tuberculosis
NPTQLDPAGRTSDAV

SEQ ID NO: 1434916 - protein, 8 aa, Mycobacterium tuberculosis
NPTQTQAA

SEQ ID NO: 1434917 - protein, 11 aa, Mycobacterium tuberculosis
NRDGKPVTSAA

SEQ ID NO: 1434918 - protein, 4 aa, Mycobacterium tuberculosis
NRGS

SEQ ID NO: 1434919 - protein, 14 aa, Mycobacterium tuberculosis
NRPGMSGDSSSWKG

SEQ ID NO: 1434920 - protein, 6 aa, Mycobacterium tuberculosis
NRSIGA

SEQ ID NO: 1434921 - protein, 8 aa, Mycobacterium tuberculosis
NRYAGSQH

SEQ ID NO: 1434922 - protein, 8 aa, Mycobacterium tuberculosis
NRYSAPTP

SEQ ID NO: 1434923 - protein, 4 aa, Mycobacterium tuberculosis
NSAV

SEQ ID NO: 1434924 - protein, 10 aa, Mycobacterium tuberculosis
NSDAQRSDAI

SEQ ID NO: 1434925 - protein, 5 aa, Mycobacterium tuberculosis
NSGAP

SEQ ID NO: 1434926 - protein, 5 aa, Mycobacterium tuberculosis
NSGTN

SEQ ID NO: 1434927 - protein, 8 aa, Mycobacterium tuberculosis
NSNQVPAT

SEQ ID NO: 1434928 - protein, 11 aa, Mycobacterium tuberculosis
NSRSGKREGKT

SEQ ID NO: 1434929 - protein, 8 aa, Mycobacterium tuberculosis
NSSETQSV

SEQ ID NO: 1434930 - protein, 10 aa, Mycobacterium tuberculosis
NSTAGGAYVP

SEQ ID NO: 1434931 - protein, 41 aa, Mycobacterium tuberculosis
NTGFGNTTDGLGENSGFGNAGSGNSGFNNSGRGNSGAQNVG

SEQ ID NO: 1434932 - protein, 6 aa, Mycobacterium tuberculosis
NTGSNN

SEQ ID NO: 1434933 - protein, 14 aa, Mycobacterium tuberculosis
NTGVANPGSYNTGS

SEQ ID NO: 1434934 - protein, 4 aa, Mycobacterium tuberculosis
NTLT

SEQ ID NO: 1434935 - protein, 5 aa, Mycobacterium tuberculosis
NTLVP

SEQ ID NO: 1434936 - protein, 4 aa, Mycobacterium tuberculosis
NTQT

SEQ ID NO: 1434937 - protein, 5 aa, Mycobacterium tuberculosis
NTSED

SEQ ID NO: 1434938 - protein, 4 aa, Mycobacterium tuberculosis
NVDH

SEQ ID NO: 1434939 - protein, 6 aa, Mycobacterium tuberculosis
NVDPAT

SEQ ID NO: 1434940 - protein, 16 aa, Mycobacterium tuberculosis
NVGEQLSGLSSAGTAL

SEQ ID NO: 1434941 - protein, 14 aa, Mycobacterium tuberculosis
NVLPSSTNPTRPHT

SEQ ID NO: 1434942 - protein, 11 aa, Mycobacterium tuberculosis
NVPASQAAFDD

SEQ ID NO: 1434943 - protein, 6 aa, Mycobacterium tuberculosis
NYSGGG

SEQ ID NO: 1434944 - protein, 4 aa, Mycobacterium tuberculosis
PAAG

SEQ ID NO: 1434945 - protein, 9 aa, Mycobacterium tuberculosis
PAAGANSSC

SEQ ID NO: 1434946 - protein, 11 aa, Mycobacterium tuberculosis
PAAGLDLGGRE

SEQ ID NO: 1434947 - protein, 5 aa, Mycobacterium tuberculosis
PAAPL

SEQ ID NO: 1434948 - protein, 8 aa, Mycobacterium tuberculosis
PAAPQTTR

SEQ ID NO: 1434949 - protein, 7 aa, Mycobacterium tuberculosis
PAAVGAA

SEQ ID NO: 1434950 - protein, 9 aa, Mycobacterium tuberculosis
PADERRGDF

SEQ ID NO: 1434951 - protein, 10 aa, Mycobacterium tuberculosis
PADRQRRQRR

SEQ ID NO: 1434952 - protein, 4 aa, Mycobacterium tuberculosis
PADT

SEQ ID NO: 1434953 - protein, 4 aa, Mycobacterium tuberculosis
PAEG

SEQ ID NO: 1434954 - protein, 23 aa, Mycobacterium tuberculosis
PAEKAGRVTKVSSSGPNSTPLPA

SEQ ID NO: 1434955 - protein, 4 aa, Mycobacterium tuberculosis
PAEL

SEQ ID NO: 1434956 - protein, 7 aa, Mycobacterium tuberculosis
PAGESVA

SEQ ID NO: 1434957 - protein, 4 aa, Mycobacterium tuberculosis
PAGG

SEQ ID NO: 1434958 - protein, 5 aa, Mycobacterium tuberculosis
PAGRR

SEQ ID NO: 1434959 - protein, 5 aa, Mycobacterium tuberculosis
PAGST

SEQ ID NO: 1434960 - protein, 6 aa, Mycobacterium tuberculosis
PALDPP

SEQ ID NO: 1434961 - protein, 14 aa, Mycobacterium tuberculosis
PAPGVDGGDPSQAR

SEQ ID NO: 1434962 - protein, 7 aa, Mycobacterium tuberculosis
PAQVRTK

SEQ ID NO: 1434963 - protein, 24 aa, Mycobacterium tuberculosis
PARVTGRNVPSEQKAPYDPERADR

SEQ ID NO: 1434964 - protein, 8 aa, Mycobacterium tuberculosis
PASPDQRG

SEQ ID NO: 1434965 - protein, 5 aa, Mycobacterium tuberculosis
PASYT

SEQ ID NO: 1434966 - protein, 7 aa, Mycobacterium tuberculosis
PATAQGI

SEQ ID NO: 1434967 - protein, 6 aa, Mycobacterium tuberculosis
PATQRD

SEQ ID NO: 1434968 - protein, 5 aa, Mycobacterium tuberculosis
PAVGE

SEQ ID NO: 1434969 - protein, 8 aa, Mycobacterium tuberculosis
PDAATRKS

SEQ ID NO: 1434970 - protein, 16 aa, Mycobacterium tuberculosis
PDAPAPQPVRGTGGGN

SEQ ID NO: 1434971 - protein, 6 aa, Mycobacterium tuberculosis
PDAPTL

SEQ ID NO: 1434972 - protein, 6 aa, Mycobacterium tuberculosis
PDAVDS

SEQ ID NO: 1434973 - protein, 4 aa, Mycobacterium tuberculosis
PDDG

SEQ ID NO: 1434974 - protein, 4 aa, Mycobacterium tuberculosis
PDDW

SEQ ID NO: 1434975 - protein, 7 aa, Mycobacterium tuberculosis
PDEKWGE

SEQ ID NO: 1434976 - protein, 13 aa, Mycobacterium tuberculosis
PDGPGGQSGLAGG

SEQ ID NO: 1434977 - protein, 4 aa, Mycobacterium tuberculosis
PDGR

SEQ ID NO: 1434978 - protein, 12 aa, Mycobacterium tuberculosis
PDGRPEDLAGDP

SEQ ID NO: 1434979 - protein, 8 aa, Mycobacterium tuberculosis
PDGSDAWD

SEQ ID NO: 1434980 - protein, 8 aa, Mycobacterium tuberculosis
PDGSTTVD

SEQ ID NO: 1434981 - protein, 21 aa, Mycobacterium tuberculosis
PDIAPPSSGLQTPPGPPNAYD

SEQ ID NO: 1434982 - protein, 5 aa, Mycobacterium tuberculosis
PDKPD

SEQ ID NO: 1434983 - protein, 5 aa, Mycobacterium tuberculosis
PDNTY

SEQ ID NO: 1434984 - protein, 8 aa, Mycobacterium tuberculosis
PDPAGDEV

SEQ ID NO: 1434985 - protein, 7 aa, Mycobacterium tuberculosis
PDPDKPA

SEQ ID NO: 1434986 - protein, 7 aa, Mycobacterium tuberculosis
PDPEPLG

SEQ ID NO: 1434987 - protein, 6 aa, Mycobacterium tuberculosis
PDPPRH

SEQ ID NO: 1434988 - protein, 7 aa, Mycobacterium tuberculosis
PDPQYAP

SEQ ID NO: 1434989 - protein, 21 aa, Mycobacterium tuberculosis
PDPSVRAAAERRAQDTGASVT

SEQ ID NO: 1434990 - protein, 7 aa, Mycobacterium tuberculosis
PDPTEGV

SEQ ID NO: 1434991 - protein, 6 aa, Mycobacterium tuberculosis
PDPTEL

SEQ ID NO: 1434992 - protein, 14 aa, Mycobacterium tuberculosis
PDQWADSDRDQVNT

SEQ ID NO: 1434993 - protein, 8 aa, Mycobacterium tuberculosis
PDRGFTNA

SEQ ID NO: 1434994 - protein, 6 aa, Mycobacterium tuberculosis
PDSDFE

SEQ ID NO: 1434995 - protein, 8 aa, Mycobacterium tuberculosis
PDSGLDPV

SEQ ID NO: 1434996 - protein, 4 aa, Mycobacterium tuberculosis
PDSP

SEQ ID NO: 1434997 - protein, 5 aa, Mycobacterium tuberculosis
PDTGA

SEQ ID NO: 1434998 - protein, 12 aa, Mycobacterium tuberculosis
PDTPPGEDRAER

SEQ ID NO: 1434999 - protein, 4 aa, Mycobacterium tuberculosis
PDYE

SEQ ID NO: 1435000 - protein, 6 aa, Mycobacterium tuberculosis
PEATRS

SEQ ID NO: 1435001 - protein, 8 aa, Mycobacterium tuberculosis
PEEPATQP

SEQ ID NO: 1435002 - protein, 6 aa, Mycobacterium tuberculosis
PEEPER

SEQ ID NO: 1435003 - protein, 4 aa, Mycobacterium tuberculosis
PEKL

SEQ ID NO: 1435004 - protein, 12 aa, Mycobacterium tuberculosis
PEQSGSVGERAA

SEQ ID NO: 1435005 - protein, 12 aa, Mycobacterium tuberculosis
PERAATTAPAGV

SEQ ID NO: 1435006 - protein, 14 aa, Mycobacterium tuberculosis
PERRTKSKALTLPG

SEQ ID NO: 1435007 - protein, 9 aa, Mycobacterium tuberculosis
PESRSASIG

SEQ ID NO: 1435008 - protein, 8 aa, Mycobacterium tuberculosis
PESYTGTE

SEQ ID NO: 1435009 - protein, 5 aa, Mycobacterium tuberculosis
PETRK

SEQ ID NO: 1435010 - protein, 5 aa, Mycobacterium tuberculosis
PETSL

SEQ ID NO: 1435011 - protein, 5 aa, Mycobacterium tuberculosis
PEVTN

SEQ ID NO: 1435012 - protein, 11 aa, Mycobacterium tuberculosis
PFSTADSENLQ

SEQ ID NO: 1435013 - protein, 17 aa, Mycobacterium tuberculosis
PFSTPEKAQRYQTENYR

SEQ ID NO: 1435014 - protein, 34 aa, Mycobacterium tuberculosis; identical to SEQ ID NO: 230747

SEQ ID NO: 1435015 - protein, 11 aa, Mycobacterium tuberculosis
PGAGRQRDPRI

SEQ ID NO: 1435016 - protein, 16 aa, Mycobacterium tuberculosis
PGALGGGADDRESPLG

SEQ ID NO: 1435017 - protein, 4 aa, Mycobacterium tuberculosis
PGAN

SEQ ID NO: 1435018 - protein, 7 aa, Mycobacterium tuberculosis
PGAPPMR

SEQ ID NO: 1435019 - protein, 8 aa, Mycobacterium tuberculosis
PGASDTAR

SEQ ID NO: 1435020 - protein, 4 aa, Mycobacterium tuberculosis
PGAT

SEQ ID NO: 1435021 - protein, 5 aa, Mycobacterium tuberculosis
PGDAA

SEQ ID NO: 1435022 - protein, 10 aa, Mycobacterium tuberculosis
PGEMNTPEQT

SEQ ID NO: 1435023 - protein, 12 aa, Mycobacterium tuberculosis
PGGDPHAGHTET

SEQ ID NO: 1435024 - protein, 5 aa, Mycobacterium tuberculosis
PGGDR

SEQ ID NO: 1435025 - protein, 10 aa, Mycobacterium tuberculosis
PGLGVRPATQ

SEQ ID NO: 1435026 - protein, 5 aa, Mycobacterium tuberculosis
PGLNS

SEQ ID NO: 1435027 - protein, 15 aa, Mycobacterium tuberculosis
PGLSQPSDVLPADDG

SEQ ID NO: 1435028 - protein, 5 aa, Mycobacterium tuberculosis
PGNFT

SEQ ID NO: 1435029 - protein, 31 aa, Mycobacterium tuberculosis; identical to SEQ ID NO: 182676

SEQ ID NO: 1435030 - protein, 6 aa, Mycobacterium tuberculosis
PGPSAV

SEQ ID NO: 1435031 - protein, 22 aa, Mycobacterium tuberculosis
PGPVPPTPAPVGAPLPAEAGGG

SEQ ID NO: 1435032 - protein, 18 aa, Mycobacterium tuberculosis
PGQRVDPTGPMRLHPWWR

SEQ ID NO: 1435033 - protein, 5 aa, Mycobacterium tuberculosis
PGRFG

SEQ ID NO: 1435034 - protein, 5 aa, Mycobacterium tuberculosis
PGRRA

SEQ ID NO: 1435035 - protein, 7 aa, Mycobacterium tuberculosis
PGVTAVE

SEQ ID NO: 1435036 - protein, 14 aa, Mycobacterium tuberculosis
PGWSAPPATPQAQT

SEQ ID NO: 1435037 - protein, 4 aa, Mycobacterium tuberculosis
PHDV

SEQ ID NO: 1435038 - protein, 12 aa, Mycobacterium tuberculosis
PHGELTQDPAAK

SEQ ID NO: 1435039 - protein, 8 aa, Mycobacterium tuberculosis
PHGTGKTA

SEQ ID NO: 1435040 - protein, 5 aa, Mycobacterium tuberculosis
PHPID

SEQ ID NO: 1435041 - protein, 19 aa, Mycobacterium tuberculosis
PHTDEGGERRNVPVSVVAA

SEQ ID NO: 1435042 - protein, 17 aa, Mycobacterium tuberculosis
PIAPSLPTPVPHNEKPQ

SEQ ID NO: 1435043 - protein, 18 aa, Mycobacterium tuberculosis
PIATKADNPALPTSPEEI

SEQ ID NO: 1435044 - protein, 5 aa, Mycobacterium tuberculosis
PIESG

SEQ ID NO: 1435045 - protein, 9 aa, Mycobacterium tuberculosis
PIGPRGRAA

SEQ ID NO: 1435046 - protein, 13 aa, Mycobacterium tuberculosis
PIHGHPRNPYQRA

SEQ ID NO: 1435047 - protein, 9 aa, Mycobacterium tuberculosis
PIPESGGSR

SEQ ID NO: 1435048 - protein, 6 aa, Mycobacterium tuberculosis
PISHPD

SEQ ID NO: 1435049 - protein, 10 aa, Mycobacterium tuberculosis
PKAAAGALSP

SEQ ID NO: 1435050 - protein, 5 aa, Mycobacterium tuberculosis
PKAIN

SEQ ID NO: 1435051 - protein, 11 aa, Mycobacterium tuberculosis
PKGQARQAAEE

SEQ ID NO: 1435052 - protein, 5 aa, Mycobacterium tuberculosis
PKPMA

SEQ ID NO: 1435053 - protein, 9 aa, Mycobacterium tuberculosis
PKPRGWSNV

SEQ ID NO: 1435054 - protein, 10 aa, Mycobacterium tuberculosis
PKSSDAVTLR

SEQ ID NO: 1435055 - protein, 7 aa, Mycobacterium tuberculosis
PKVNDRA

SEQ ID NO: 1435056 - protein, 9 aa, Mycobacterium tuberculosis
PLAESAEAL

SEQ ID NO: 1435057 - protein, 6 aa, Mycobacterium tuberculosis
PLATDP

SEQ ID NO: 1435058 - protein, 6 aa, Mycobacterium tuberculosis
PLEDGT

SEQ ID NO: 1435059 - protein, 14 aa, Mycobacterium tuberculosis
PLGGPDGGNGGRGG

SEQ ID NO: 1435060 - protein, 14 aa, Mycobacterium tuberculosis
PLGSPGGAAAVGPI

SEQ ID NO: 1435061 - protein, 5 aa, Mycobacterium tuberculosis
PLNDP

SEQ ID NO: 1435062 - protein, 19 aa, Mycobacterium tuberculosis
PLPTGPDAAPACPTGGAGL

SEQ ID NO: 1435063 - protein, 10 aa, Mycobacterium tuberculosis
PLRDEGESYA

SEQ ID NO: 1435064 - protein, 7 aa, Mycobacterium tuberculosis
PLRGSKA

SEQ ID NO: 1435065 - protein, 10 aa, Mycobacterium tuberculosis
PLRPGSGMPP

SEQ ID NO: 1435066 - protein, 4 aa, Mycobacterium tuberculosis
PLRS

SEQ ID NO: 1435067 - protein, 5 aa, Mycobacterium tuberculosis
PLRSP

SEQ ID NO: 1435068 - protein, 10 aa, Mycobacterium tuberculosis
PLSHRNTQPG

SEQ ID NO: 1435069 - protein, 7 aa, Mycobacterium tuberculosis
PNALTST

SEQ ID NO: 1435070 - protein, 13 aa, Mycobacterium tuberculosis
PNAVQAGSLNRPG

SEQ ID NO: 1435071 - protein, 6 aa, Mycobacterium tuberculosis
PNGAAA

SEQ ID NO: 1435072 - protein, 13 aa, Mycobacterium tuberculosis
PNKAAGDAARGDM

SEQ ID NO: 1435073 - protein, 32 aa, Mycobacterium tuberculosis
PNLPPAPDAAPVDTPPAPEDAGFDPNLPPPLA

SEQ ID NO: 1435074 - protein, 4 aa, Mycobacterium tuberculosis
PNPV

SEQ ID NO: 1435075 - protein, 10 aa, Mycobacterium tuberculosis
PNRHAGSTAM

SEQ ID NO: 1435076 - protein, 6 aa, Mycobacterium tuberculosis
PNTMGD

SEQ ID NO: 1435077 - protein, 17 aa, Mycobacterium tuberculosis
PPAAGEEGVTAAPEMGP

SEQ ID NO: 1435078 - protein, 11 aa, Mycobacterium tuberculosis
PPAAKADETRK

SEQ ID NO: 1435079 - protein, 5 aa, Mycobacterium tuberculosis
PPAAP

SEQ ID NO: 1435080 - protein, 13 aa, Mycobacterium tuberculosis
PPATIANNREERR

SEQ ID NO: 1435081 - protein, 17 aa, Mycobacterium tuberculosis
PPAVTEPPQPIPFSGPA

SEQ ID NO: 1435082 - protein, 13 aa, Mycobacterium tuberculosis
PPCPPSPPFPPAP

SEQ ID NO: 1435083 - protein, 6 aa, Mycobacterium tuberculosis
PPDPRV

SEQ ID NO: 1435084 - protein, 8 aa, Mycobacterium tuberculosis
PPDTELSP

SEQ ID NO: 1435085 - protein, 13 aa, Mycobacterium tuberculosis
PPEQVRTSRPDGA

SEQ ID NO: 1435086 - protein, 4 aa, Mycobacterium tuberculosis
PPGI

SEQ ID NO: 1435087 - protein, 8 aa, Mycobacterium tuberculosis
PPGQGPWP

SEQ ID NO: 1435088 - protein, 4 aa, Mycobacterium tuberculosis
PPGT

SEQ ID NO: 1435089 - protein, 5 aa, Mycobacterium tuberculosis
PPGTV

SEQ ID NO: 1435090 - protein, 5 aa, Mycobacterium tuberculosis
PPIAP

SEQ ID NO: 1435091 - protein, 4 aa, Mycobacterium tuberculosis
PPKP

SEQ ID NO: 1435092 - protein, 49 aa, Mycobacterium tuberculosis
PPKPPLPPLPPLPPSAPLPPKPPAPPEPAVPPVPAPPALPPAPPLPPSP

SEQ ID NO: 1435093 - protein, 7 aa, Mycobacterium tuberculosis
PPLGQQL

SEQ ID NO: 1435094 - protein, 6 aa, Mycobacterium tuberculosis
PPNLVS

SEQ ID NO: 1435095 - protein, 17 aa, Mycobacterium tuberculosis
PPPCPIPGQNPHNQHES

SEQ ID NO: 1435096 - protein, 4 aa, Mycobacterium tuberculosis
PPPT

SEQ ID NO: 1435097 - protein, 5 aa, Mycobacterium tuberculosis
PPRPC

SEQ ID NO: 1435098 - protein, 5 aa, Mycobacterium tuberculosis
PPRSW

SEQ ID NO: 1435099 - protein, 8 aa, Mycobacterium tuberculosis
PPSAEAAL

SEQ ID NO: 1435100 - protein, 15 aa, Mycobacterium tuberculosis
PPSFTARSNEDSAAW

SEQ ID NO: 1435101 - protein, 11 aa, Mycobacterium tuberculosis
PPYDHDKKGRV

SEQ ID NO: 1435102 - protein, 5 aa, Mycobacterium tuberculosis
PPYPP

SEQ ID NO: 1435103 - protein, 6 aa, Mycobacterium tuberculosis
PQAGRY

SEQ ID NO: 1435104 - protein, 7 aa, Mycobacterium tuberculosis
PQPDRFD

SEQ ID NO: 1435105 - protein, 7 aa, Mycobacterium tuberculosis
PQPVDPE

SEQ ID NO: 1435106 - protein, 6 aa, Mycobacterium tuberculosis
PQQPTV

SEQ ID NO: 1435107 - protein, 10 aa, Mycobacterium tuberculosis
PQSPRGTPVD

SEQ ID NO: 1435108 - protein, 12 aa, Mycobacterium tuberculosis
PQSTTPPITTPP

SEQ ID NO: 1435109 - protein, 5 aa, Mycobacterium tuberculosis
PQTNS

SEQ ID NO: 1435110 - protein, 5 aa, Mycobacterium tuberculosis
PQTRV

SEQ ID NO: 1435111 - protein, 7 aa, Mycobacterium tuberculosis
PRAHHTA

SEQ ID NO: 1435112 - protein, 6 aa, Mycobacterium tuberculosis
PRATEL

SEQ ID NO: 1435113 - protein, 4 aa, Mycobacterium tuberculosis
PRDL

SEQ ID NO: 1435114 - protein, 7 aa, Mycobacterium tuberculosis
PRDPHDA

SEQ ID NO: 1435115 - protein, 8 aa, Mycobacterium tuberculosis
PRERPSFT

SEQ ID NO: 1435116 - protein, 6 aa, Mycobacterium tuberculosis
PRGGRL

SEQ ID NO: 1435117 - protein, 5 aa, Mycobacterium tuberculosis
PRGVG

SEQ ID NO: 1435118 - protein, 6 aa, Mycobacterium tuberculosis
PRHQPG

SEQ ID NO: 1435119 - protein, 7 aa, Mycobacterium tuberculosis
PRKGAAR

SEQ ID NO: 1435120 - protein, 9 aa, Mycobacterium tuberculosis
PRKPGGDLA

SEQ ID NO: 1435121 - protein, 11 aa, Mycobacterium tuberculosis
PRPEVRARSPR

SEQ ID NO: 1435122 - protein, 4 aa, Mycobacterium tuberculosis
PRPL

SEQ ID NO: 1435123 - protein, 6 aa, Mycobacterium tuberculosis
PRPLPG

SEQ ID NO: 1435124 - protein, 6 aa, Mycobacterium tuberculosis
PRPQTQ

SEQ ID NO: 1435125 - protein, 8 aa, Mycobacterium tuberculosis
PRRYREPN

SEQ ID NO: 1435126 - protein, 6 aa, Mycobacterium tuberculosis
PRSGTV

SEQ ID NO: 1435127 - protein, 9 aa, Mycobacterium tuberculosis
PRSTAEAFP

SEQ ID NO: 1435128 - protein, 10 aa, Mycobacterium tuberculosis
PRVTPPGQQV

SEQ ID NO: 1435129 - protein, 9 aa, Mycobacterium tuberculosis
PSALSGADH

SEQ ID NO: 1435130 - protein, 4 aa, Mycobacterium tuberculosis
PSAN

SEQ ID NO: 1435131 - protein, 7 aa, Mycobacterium tuberculosis
PSDTRTD

SEQ ID NO: 1435132 - protein, 15 aa, Mycobacterium tuberculosis
PSEDLADATDAELAG

SEQ ID NO: 1435133 - protein, 5 aa, Mycobacterium tuberculosis
PSELG

SEQ ID NO: 1435134 - protein, 7 aa, Mycobacterium tuberculosis
PSERGRV

SEQ ID NO: 1435135 - protein, 13 aa, Mycobacterium tuberculosis
PSGELKTKPTQHS

SEQ ID NO: 1435136 - protein, 7 aa, Mycobacterium tuberculosis
PSLPAAL

SEQ ID NO: 1435137 - protein, 5 aa, Mycobacterium tuberculosis
PSTGE

SEQ ID NO: 1435138 - protein, 27 aa, Mycobacterium tuberculosis
PSWAAPSTRPVSALSPAGLTTLPGTDV

SEQ ID NO: 1435139 - protein, 4 aa, Mycobacterium tuberculosis
PSWP

SEQ ID NO: 1435140 - protein, 7 aa, Mycobacterium tuberculosis
PTAANAG

SEQ ID NO: 1435141 - protein, 9 aa, Mycobacterium tuberculosis
PTADGTEVT

SEQ ID NO: 1435142 - protein, 5 aa, Mycobacterium tuberculosis
PTADQ

SEQ ID NO: 1435143 - protein, 7 aa, Mycobacterium tuberculosis
PTAVTGK

SEQ ID NO: 1435144 - protein, 7 aa, Mycobacterium tuberculosis
PTDAKQL

SEQ ID NO: 1435145 - protein, 22 aa, Mycobacterium tuberculosis
PTGPADGESGPPTLGPRMGSAT

SEQ ID NO: 1435146 - protein, 12 aa, Mycobacterium tuberculosis
PTGTAAAGADEQ

SEQ ID NO: 1435147 - protein, 6 aa, Mycobacterium tuberculosis
PTITGT

SEQ ID NO: 1435148 - protein, 7 aa, Mycobacterium tuberculosis
PTLPAGA

SEQ ID NO: 1435149 - protein, 4 aa, Mycobacterium tuberculosis
PTLQ

SEQ ID NO: 1435150 - protein, 15 aa, Mycobacterium tuberculosis
PTPRVTANHRGGRRA

SEQ ID NO: 1435151 - protein, 15 aa, Mycobacterium tuberculosis
PTTKDRQGNDRGTSY

SEQ ID NO: 1435152 - protein, 7 aa, Mycobacterium tuberculosis
PTTPIGK

SEQ ID NO: 1435153 - protein, 6 aa, Mycobacterium tuberculosis
PVDESR

SEQ ID NO: 1435154 - protein, 11 aa, Mycobacterium tuberculosis
PVTAHKDGTIT

SEQ ID NO: 1435155 - protein, 12 aa, Mycobacterium tuberculosis
PWPNGNDHTPKR

SEQ ID NO: 1435156 - protein, 13 aa, Mycobacterium tuberculosis
PYALPKSGTKRPW

SEQ ID NO: 1435157 - protein, 7 aa, Mycobacterium tuberculosis
PYPRRED

SEQ ID NO: 1435158 - protein, 11 aa, Mycobacterium tuberculosis
PYSRDPRNIAR

SEQ ID NO: 1435159 - protein, 6 aa, Mycobacterium tuberculosis
QAAGAA

SEQ ID NO: 1435160 - protein, 9 aa, Mycobacterium tuberculosis
QAAGADAVH

SEQ ID NO: 1435161 - protein, 7 aa, Mycobacterium tuberculosis
QAANGSL

SEQ ID NO: 1435162 - protein, 14 aa, Mycobacterium tuberculosis
QAASAEASRDVSAA

SEQ ID NO: 1435163 - protein, 9 aa, Mycobacterium tuberculosis
QAATRRRDP

SEQ ID NO: 1435164 - protein, 8 aa, Mycobacterium tuberculosis
QAEPVSTA

SEQ ID NO: 1435165 - protein, 16 aa, Mycobacterium tuberculosis
QAEQAASQARAAAAAY

SEQ ID NO: 1435166 - protein, 7 aa, Mycobacterium tuberculosis
QAETERD

SEQ ID NO: 1435167 - protein, 6 aa, Mycobacterium tuberculosis
QAHADG

SEQ ID NO: 1435168 - protein, 6 aa, Mycobacterium tuberculosis
QALKPG

SEQ ID NO: 1435169 - protein, 13 aa, Mycobacterium tuberculosis
QAPARRGRHKNIP

SEQ ID NO: 1435170 - protein, 16 aa, Mycobacterium tuberculosis
QAPPPGAPGGMSSGDI

SEQ ID NO: 1435171 - protein, 6 aa, Mycobacterium tuberculosis
QAVSAD

SEQ ID NO: 1435172 - protein, 10 aa, Mycobacterium tuberculosis
QAWQGPASAA

SEQ ID NO: 1435173 - protein, 6 aa, Mycobacterium tuberculosis
QDCRSG

SEQ ID NO: 1435174 - protein, 5 aa, Mycobacterium tuberculosis
QDDAV

SEQ ID NO: 1435175 - protein, 11 aa, Mycobacterium tuberculosis
QDFSPPPPRYT

SEQ ID NO: 1435176 - protein, 23 aa, Mycobacterium tuberculosis
QDKGYAVPDYPADPKTDQEKAIK

SEQ ID NO: 1435177 - protein, 17 aa, Mycobacterium tuberculosis
QDTAHGGFGGAPKFPPS

SEQ ID NO: 1435178 - protein, 11 aa, Mycobacterium tuberculosis
QDTPPNDQAGL

SEQ ID NO: 1435179 - protein, 11 aa, Mycobacterium tuberculosis
QERRAKRAERA

SEQ ID NO: 1435180 - protein, 10 aa, Mycobacterium tuberculosis
QETRSNRRAA

SEQ ID NO: 1435181 - protein, 14 aa, Mycobacterium tuberculosis
QEVRPAPGQGLSPA

SEQ ID NO: 1435182 - protein, 16 aa, Mycobacterium tuberculosis
QFPRPAPRSSYSALSS

SEQ ID NO: 1435183 - protein, 6 aa, Mycobacterium tuberculosis
QGNPSN

SEQ ID NO: 1435184 - protein, 13 aa, Mycobacterium tuberculosis
QGQEPDSPEARAE

SEQ ID NO: 1435185 - protein, 13 aa, Mycobacterium tuberculosis
QGSQLAQRECPRP

SEQ ID NO: 1435186 - protein, 8 aa, Mycobacterium tuberculosis
QGSRGAAY

SEQ ID NO: 1435187 - protein, 6 aa, Mycobacterium tuberculosis
QGTMTA

SEQ ID NO: 1435188 - protein, 5 aa, Mycobacterium tuberculosis
QGTSF

SEQ ID NO: 1435189 - protein, 26 aa, Mycobacterium tuberculosis
QGVGGSGGKGGAGGLAGDGGNGANGN

SEQ ID NO: 1435190 - protein, 6 aa, Mycobacterium tuberculosis
QGYQAA

SEQ ID NO: 1435191 - protein, 5 aa, Mycobacterium tuberculosis
QHGDA

SEQ ID NO: 1435192 - protein, 4 aa, Mycobacterium tuberculosis
QHVD

SEQ ID NO: 1435193 - protein, 4 aa, Mycobacterium tuberculosis
QIGG

SEQ ID NO: 1435194 - protein, 7 aa, Mycobacterium tuberculosis
QIPVPPG

SEQ ID NO: 1435195 - protein, 9 aa, Mycobacterium tuberculosis
QISSPGGVR

SEQ ID NO: 1435196 - protein, 7 aa, Mycobacterium tuberculosis
QKTERDR

SEQ ID NO: 1435197 - protein, 10 aa, Mycobacterium tuberculosis
QLDPCQSPRP

SEQ ID NO: 1435198 - protein, 7 aa, Mycobacterium tuberculosis
QLGGARP

SEQ ID NO: 1435199 - protein, 5 aa, Mycobacterium tuberculosis
QLKTG

SEQ ID NO: 1435200 - protein, 15 aa, Mycobacterium tuberculosis
QLRPDAPDCDSGADE

SEQ ID NO: 1435201 - protein, 6 aa, Mycobacterium tuberculosis
QLRSEG

SEQ ID NO: 1435202 - protein, 5 aa, Mycobacterium tuberculosis
QLSPE

SEQ ID NO: 1435203 - protein, 5 aa, Mycobacterium tuberculosis
QLTRA

SEQ ID NO: 1435204 - protein, 7 aa, Mycobacterium tuberculosis
QNAPAIA

SEQ ID NO: 1435205 - protein, 5 aa, Mycobacterium tuberculosis
QNMTS

SEQ ID NO: 1435206 - protein, 17 aa, Mycobacterium tuberculosis
QNPERGRKLGACHRRRH

SEQ ID NO: 1435207 - protein, 13 aa, Mycobacterium tuberculosis
QNSGTAFSGAVQS

SEQ ID NO: 1435208 - protein, 4 aa, Mycobacterium tuberculosis
QNSV

SEQ ID NO: 1435209 - protein, 28 aa, Mycobacterium tuberculosis
QPDVPRRRARRHRPRRCSAKTGSSSSTM

SEQ ID NO: 1435210 - protein, 4 aa, Mycobacterium tuberculosis
QPEV

SEQ ID NO: 1435211 - protein, 5 aa, Mycobacterium tuberculosis
QPIPD

SEQ ID NO: 1435212 - protein, 14 aa, Mycobacterium tuberculosis
QPIQPSPAPLARGS

SEQ ID NO: 1435213 - protein, 6 aa, Mycobacterium tuberculosis
QPNGGS

SEQ ID NO: 1435214 - protein, 11 aa, Mycobacterium tuberculosis
QPQRAAAMTAS

SEQ ID NO: 1435215 - protein, 7 aa, Mycobacterium tuberculosis
QPRADEP

SEQ ID NO: 1435216 - protein, 9 aa, Mycobacterium tuberculosis
QPSNPTAVR

SEQ ID NO: 1435217 - protein, 4 aa, Mycobacterium tuberculosis
QPSS

SEQ ID NO: 1435218 - protein, 8 aa, Mycobacterium tuberculosis
QPTEEARA

SEQ ID NO: 1435219 - protein, 12 aa, Mycobacterium tuberculosis
QQADDNAARRVR

SEQ ID NO: 1435220 - protein, 13 aa, Mycobacterium tuberculosis
QQADDNAARRVRE

SEQ ID NO: 1435221 - protein, 8 aa, Mycobacterium tuberculosis
QQATAAPV

SEQ ID NO: 1435222 - protein, 14 aa, Mycobacterium tuberculosis
QQRGAGRGQARRLS

SEQ ID NO: 1435223 - protein, 5 aa, Mycobacterium tuberculosis
QQRSE

SEQ ID NO: 1435224 - protein, 4 aa, Mycobacterium tuberculosis
QRCE

SEQ ID NO: 1435225 - protein, 10 aa, Mycobacterium tuberculosis
QRESAPVDVT

SEQ ID NO: 1435226 - protein, 7 aa, Mycobacterium tuberculosis
QRPGVGV

SEQ ID NO: 1435227 - protein, 31 aa, Mycobacterium tuberculosis
QRPSYQHSHSTRQASHTAAQTPNRRSRNLKP

SEQ ID NO: 1435228 - protein, 6 aa, Mycobacterium tuberculosis
QRRADQ

SEQ ID NO: 1435229 - protein, 6 aa, Mycobacterium tuberculosis
QRRPGG

SEQ ID NO: 1435230 - protein, 5 aa, Mycobacterium tuberculosis
QRRSL

SEQ ID NO: 1435231 - protein, 8 aa, Mycobacterium tuberculosis
QRYESSGE

SEQ ID NO: 1435232 - protein, 6 aa, Mycobacterium tuberculosis
QSALAA

SEQ ID NO: 1435233 - protein, 13 aa, Mycobacterium tuberculosis
QSGVGRELGPDAP

SEQ ID NO: 1435234 - protein, 13 aa, Mycobacterium tuberculosis
QSPGAERLDDRRY

SEQ ID NO: 1435235 - protein, 8 aa, Mycobacterium tuberculosis
QSPGLSSA

SEQ ID NO: 1435236 - protein, 6 aa, Mycobacterium tuberculosis
QSSLER

SEQ ID NO: 1435237 - protein, 17 aa, Mycobacterium tuberculosis
QSYERGPLGLPTSAEIQ

SEQ ID NO: 1435238 - protein, 11 aa, Mycobacterium tuberculosis
QTAGRGRHSRG

SEQ ID NO: 1435239 - protein, 17 aa, Mycobacterium tuberculosis
QTAPTSPNNQHRAATSI

SEQ ID NO: 1435240 - protein, 5 aa, Mycobacterium tuberculosis
QTDKR

SEQ ID NO: 1435241 - protein, 14 aa, Mycobacterium tuberculosis
QTEWPATGHPRRAG

SEQ ID NO: 1435242 - protein, 7 aa, Mycobacterium tuberculosis
QTGSTNA

SEQ ID NO: 1435243 - protein, 9 aa, Mycobacterium tuberculosis
QTNDPTAHA

SEQ ID NO: 1435244 - protein, 5 aa, Mycobacterium tuberculosis
QTPYH

SEQ ID NO: 1435245 - protein, 7 aa, Mycobacterium tuberculosis
QTSSPAH

SEQ ID NO: 1435246 - protein, 6 aa, Mycobacterium tuberculosis
QTTGRA

SEQ ID NO: 1435247 - protein, 7 aa, Mycobacterium tuberculosis
QTTTGRA

SEQ ID NO: 1435248 - protein, 6 aa, Mycobacterium tuberculosis
QVDSES

SEQ ID NO: 1435249 - protein, 11 aa, Mycobacterium tuberculosis
QVGKPAPSVSQ

SEQ ID NO: 1435250 - protein, 9 aa, Mycobacterium tuberculosis
QVNDRADSA

SEQ ID NO: 1435251 - protein, 6 aa, Mycobacterium tuberculosis
QVRSQN

SEQ ID NO: 1435252 - protein, 4 aa, Mycobacterium tuberculosis
QVTQ

SEQ ID NO: 1435253 - protein, 6 aa, Mycobacterium tuberculosis
QYYSPD

SEQ ID NO: 1435254 - protein, 12 aa, Mycobacterium tuberculosis
RAAADLGSSEDL

SEQ ID NO: 1435255 - protein, 6 aa, Mycobacterium tuberculosis
RAADDD

SEQ ID NO: 1435256 - protein, 11 aa, Mycobacterium tuberculosis
RAAGRVDGVRP

SEQ ID NO: 1435257 - protein, 6 aa, Mycobacterium tuberculosis
RAFSGG

SEQ ID NO: 1435258 - protein, 10 aa, Mycobacterium tuberculosis
RAGAEALRQG

SEQ ID NO: 1435259 - protein, 6 aa, Mycobacterium tuberculosis
RAGPPE

SEQ ID NO: 1435260 - protein, 4 aa, Mycobacterium tuberculosis
RAHD

SEQ ID NO: 1435261 - protein, 10 aa, Mycobacterium tuberculosis
RAKATAARNI

SEQ ID NO: 1435262 - protein, 8 aa, Mycobacterium tuberculosis
RANDTDDA

SEQ ID NO: 1435263 - protein, 7 aa, Mycobacterium tuberculosis
RANGGGD

SEQ ID NO: 1435264 - protein, 7 aa, Mycobacterium tuberculosis
RAPDADA

SEQ ID NO: 1435265 - protein, 14 aa, Mycobacterium tuberculosis
RAQARQSVKAATDE

SEQ ID NO: 1435266 - protein, 9 aa, Mycobacterium tuberculosis
RAREAGRIA

SEQ ID NO: 1435267 - protein, 7 aa, Mycobacterium tuberculosis
RARHPDS

SEQ ID NO: 1435268 - protein, 6 aa, Mycobacterium tuberculosis
RARRHD

SEQ ID NO: 1435269 - protein, 10 aa, Mycobacterium tuberculosis
RASDRYNQEG

SEQ ID NO: 1435270 - protein, 12 aa, Mycobacterium tuberculosis
RASHDASEGKHN

SEQ ID NO: 1435271 - protein, 5 aa, Mycobacterium tuberculosis
RATSR

SEQ ID NO: 1435272 - protein, 15 aa, Mycobacterium tuberculosis
RDAASDTWQPPTPRR

SEQ ID NO: 1435273 - protein, 10 aa, Mycobacterium tuberculosis
RDADAGELES

SEQ ID NO: 1435274 - protein, 11 aa, Mycobacterium tuberculosis
RDALSGEGARR

SEQ ID NO: 1435275 - protein, 9 aa, Mycobacterium tuberculosis
RDARGQGHS

SEQ ID NO: 1435276 - protein, 22 aa, Mycobacterium tuberculosis
RDASALNGTVNGDSVLQGVAED

SEQ ID NO: 1435277 - protein, 6 aa, Mycobacterium tuberculosis
RDDAAD

SEQ ID NO: 1435278 - protein, 8 aa, Mycobacterium tuberculosis
RDDDPEDA

SEQ ID NO: 1435279 - protein, 6 aa, Mycobacterium tuberculosis
RDDGTT

SEQ ID NO: 1435280 - protein, 6 aa, Mycobacterium tuberculosis
RDGDRD

SEQ ID NO: 1435281 - protein, 11 aa, Mycobacterium tuberculosis
RDGITDLPDGR

SEQ ID NO: 1435282 - protein, 10 aa, Mycobacterium tuberculosis
RDGRPALTGE

SEQ ID NO: 1435283 - protein, 6 aa, Mycobacterium tuberculosis
RDMGGP

SEQ ID NO: 1435284 - protein, 8 aa, Mycobacterium tuberculosis
RDPQEAAQ

SEQ ID NO: 1435285 - protein, 9 aa, Mycobacterium tuberculosis
RDPYGRTAR

SEQ ID NO: 1435286 - protein, 4 aa, Mycobacterium tuberculosis
RDRL

SEQ ID NO: 1435287 - protein, 6 aa, Mycobacterium tuberculosis
RDRLNP

SEQ ID NO: 1435288 - protein, 8 aa, Mycobacterium tuberculosis
RDRRDAGR

SEQ ID NO: 1435289 - protein, 5 aa, Mycobacterium tuberculosis
RDSAP

SEQ ID NO: 1435290 - protein, 5 aa, Mycobacterium tuberculosis
RDSLR

SEQ ID NO: 1435291 - protein, 5 aa, Mycobacterium tuberculosis
RDSQK

SEQ ID NO: 1435292 - protein, 25 aa, Mycobacterium tuberculosis
RDTADPKGAKYGRDGNGELDGTAEE

SEQ ID NO: 1435293 - protein, 6 aa, Mycobacterium tuberculosis
RDTHGA

SEQ ID NO: 1435294 - protein, 13 aa, Mycobacterium tuberculosis
RDTNGDPVTARGA

SEQ ID NO: 1435295 - protein, 4 aa, Mycobacterium tuberculosis
REAG

SEQ ID NO: 1435296 - protein, 4 aa, Mycobacterium tuberculosis
REAT

SEQ ID NO: 1435297 - protein, 7 aa, Mycobacterium tuberculosis
REDVERG

SEQ ID NO: 1435298 - protein, 6 aa, Mycobacterium tuberculosis
REGHTQ

SEQ ID NO: 1435299 - protein, 5 aa, Mycobacterium tuberculosis
REGRT

SEQ ID NO: 1435300 - protein, 9 aa, Mycobacterium tuberculosis
REGSYRDTI

SEQ ID NO: 1435301 - protein, 11 aa, Mycobacterium tuberculosis
REQLTGDEAHE

SEQ ID NO: 1435302 - protein, 5 aa, Mycobacterium tuberculosis
REQPE

SEQ ID NO: 1435303 - protein, 12 aa, Mycobacterium tuberculosis
REQPLAGVSGAS

SEQ ID NO: 1435304 - protein, 6 aa, Mycobacterium tuberculosis
REQVTP

SEQ ID NO: 1435305 - protein, 7 aa, Mycobacterium tuberculosis
RERARDR

SEQ ID NO: 1435306 - protein, 11 aa, Mycobacterium tuberculosis
RERSGVRQSKE

SEQ ID NO: 1435307 - protein, 11 aa, Mycobacterium tuberculosis
RESGDADAVRA

SEQ ID NO: 1435308 - protein, 6 aa, Mycobacterium tuberculosis
RETKAA

SEQ ID NO: 1435309 - protein, 7 aa, Mycobacterium tuberculosis
RETKAAT

SEQ ID NO: 1435310 - protein, 12 aa, Mycobacterium tuberculosis
RETRGTSENVDS

SEQ ID NO: 1435311 - protein, 8 aa, Mycobacterium tuberculosis
REVNTAGD

SEQ ID NO: 1435312 - protein, 13 aa, Mycobacterium tuberculosis
RFAPGGDPATVAA

SEQ ID NO: 1435313 - protein, 5 aa, Mycobacterium tuberculosis
RFATS

SEQ ID NO: 1435314 - protein, 6 aa, Mycobacterium tuberculosis
RFPDPK

SEQ ID NO: 1435315 - protein, 8 aa, Mycobacterium tuberculosis
RGAARTSA

SEQ ID NO: 1435316 - protein, 13 aa, Mycobacterium tuberculosis
RGADDAALPPVTE

SEQ ID NO: 1435317 - protein, 6 aa, Mycobacterium tuberculosis
RGAGPL

SEQ ID NO: 1435318 - protein, 6 aa, Mycobacterium tuberculosis
RGAGTI

SEQ ID NO: 1435319 - protein, 6 aa, Mycobacterium tuberculosis
RGEDES

SEQ ID NO: 1435320 - protein, 7 aa, Mycobacterium tuberculosis
RGEPADA

SEQ ID NO: 1435321 - protein, 5 aa, Mycobacterium tuberculosis
RGFDP

SEQ ID NO: 1435322 - protein, 6 aa, Mycobacterium tuberculosis
RGFSSG

SEQ ID NO: 1435323 - protein, 10 aa, Mycobacterium tuberculosis
RGGAPGTRET

SEQ ID NO: 1435324 - protein, 5 aa, Mycobacterium tuberculosis
RGGAS

SEQ ID NO: 1435325 - protein, 5 aa, Mycobacterium tuberculosis
RGGEY

SEQ ID NO: 1435326 - protein, 7 aa, Mycobacterium tuberculosis
RGGGHNV

SEQ ID NO: 1435327 - protein, 7 aa, Mycobacterium tuberculosis
RGGGTYA

SEQ ID NO: 1435328 - protein, 9 aa, Mycobacterium tuberculosis
RGGRSELTT

SEQ ID NO: 1435329 - protein, 24 aa, Mycobacterium tuberculosis
RGGTGGAGGYGGDGGGGGDGFDGT

SEQ ID NO: 1435330 - protein, 4 aa, Mycobacterium tuberculosis
RGHD

SEQ ID NO: 1435331 - protein, 4 aa, Mycobacterium tuberculosis
RGHT

SEQ ID NO: 1435332 - protein, 4 aa, Mycobacterium tuberculosis
RGIG

SEQ ID NO: 1435333 - protein, 4 aa, Mycobacterium tuberculosis
RGKW

SEQ ID NO: 1435334 - protein, 11 aa, Mycobacterium tuberculosis
RGPGLRPAGAG

SEQ ID NO: 1435335 - protein, 12 aa, Mycobacterium tuberculosis
RGRAAASARDGA

SEQ ID NO: 1435336 - protein, 5 aa, Mycobacterium tuberculosis
RGRDE

SEQ ID NO: 1435337 - protein, 8 aa, Mycobacterium tuberculosis
RGRPEDSP

SEQ ID NO: 1435338 - protein, 8 aa, Mycobacterium tuberculosis
RGSDGQWR

SEQ ID NO: 1435339 - protein, 7 aa, Mycobacterium tuberculosis
RGSENLC

SEQ ID NO: 1435340 - protein, 6 aa, Mycobacterium tuberculosis
RGSQTG

SEQ ID NO: 1435341 - protein, 13 aa, Mycobacterium tuberculosis
RGSQTSDPVETPV

SEQ ID NO: 1435342 - protein, 6 aa, Mycobacterium tuberculosis
RGSRHK

SEQ ID NO: 1435343 - protein, 5 aa, Mycobacterium tuberculosis
RGTLG

SEQ ID NO: 1435344 - protein, 10 aa, Mycobacterium tuberculosis
RGTVPGDEDV

SEQ ID NO: 1435345 - protein, 12 aa, Mycobacterium tuberculosis
RGYGNTSSRDIA

SEQ ID NO: 1435346 - protein, 4 aa, Mycobacterium tuberculosis
RHAS

SEQ ID NO: 1435347 - protein, 5 aa, Mycobacterium tuberculosis
RHGGS

SEQ ID NO: 1435348 - protein, 9 aa, Mycobacterium tuberculosis
RHPDRPAGV

SEQ ID NO: 1435349 - protein, 5 aa, Mycobacterium tuberculosis
RHPTT

SEQ ID NO: 1435350 - protein, 16 aa, Mycobacterium tuberculosis
RHTADATVAEARQRAD

SEQ ID NO: 1435351 - protein, 10 aa, Mycobacterium tuberculosis
RIDSDLTART

SEQ ID NO: 1435352 - protein, 9 aa, Mycobacterium tuberculosis
RIEPGPGAR

SEQ ID NO: 1435353 - protein, 16 aa, Mycobacterium tuberculosis
RIGADAPAPAADPTAH

SEQ ID NO: 1435354 - protein, 6 aa, Mycobacterium tuberculosis
RINPEA

SEQ ID NO: 1435355 - protein, 5 aa, Mycobacterium tuberculosis
RIPAD

SEQ ID NO: 1435356 - protein, 6 aa, Mycobacterium tuberculosis
RISART

SEQ ID NO: 1435357 - protein, 9 aa, Mycobacterium tuberculosis
RISGDTSAA

SEQ ID NO: 1435358 - protein, 6 aa, Mycobacterium tuberculosis
RITRAE

SEQ ID NO: 1435359 - protein, 6 aa, Mycobacterium tuberculosis
RKAQPL

SEQ ID NO: 1435360 - protein, 27 aa, Mycobacterium tuberculosis
RKDADTYAAPISRKSVRPRPHRPAGAR

SEQ ID NO: 1435361 - protein, 6 aa, Mycobacterium tuberculosis
RKECQK

SEQ ID NO: 1435362 - protein, 4 aa, Mycobacterium tuberculosis
RKGE

SEQ ID NO: 1435363 - protein, 14 aa, Mycobacterium tuberculosis
RKNGDDGKSEGSGV

SEQ ID NO: 1435364 - protein, 5 aa, Mycobacterium tuberculosis
RKQMQ

SEQ ID NO: 1435365 - protein, 7 aa, Mycobacterium tuberculosis
RKQPGAQ

SEQ ID NO: 1435366 - protein, 8 aa, Mycobacterium tuberculosis
RKRPATGW

SEQ ID NO: 1435367 - protein, 10 aa, Mycobacterium tuberculosis
RLAETSTRAT

SEQ ID NO: 1435368 - protein, 9 aa, Mycobacterium tuberculosis
RLDRPEDAA

SEQ ID NO: 1435369 - protein, 5 aa, Mycobacterium tuberculosis
RLEEG

SEQ ID NO: 1435370 - protein, 11 aa, Mycobacterium tuberculosis
RLGARTTGYDV

SEQ ID NO: 1435371 - protein, 16 aa, Mycobacterium tuberculosis
RLGEPRSNGCSYADSP

SEQ ID NO: 1435372 - protein, 13 aa, Mycobacterium tuberculosis
RLGPGGISGPPLA

SEQ ID NO: 1435373 - protein, 6 aa, Mycobacterium tuberculosis
RLSDKS

SEQ ID NO: 1435374 - protein, 13 aa, Mycobacterium tuberculosis
RLSDSPFRLSGGQ

SEQ ID NO: 1435375 - protein, 9 aa, Mycobacterium tuberculosis
RNGKGQKKL

SEQ ID NO: 1435376 - protein, 6 aa, Mycobacterium tuberculosis
RNKQQR

SEQ ID NO: 1435377 - protein, 8 aa, Mycobacterium tuberculosis
RNPADAED

SEQ ID NO: 1435378 - protein, 10 aa, Mycobacterium tuberculosis
RNPDPDEQTI

SEQ ID NO: 1435379 - protein, 7 aa, Mycobacterium tuberculosis
RNRHDPR

SEQ ID NO: 1435380 - protein, 11 aa, Mycobacterium tuberculosis
RNSCSSPRAGL

SEQ ID NO: 1435381 - protein, 4 aa, Mycobacterium tuberculosis
RNTA

SEQ ID NO: 1435382 - protein, 24 aa, Mycobacterium tuberculosis
RNTGWSNSGLTNTGAFNAGSLNTG

SEQ ID NO: 1435383 - protein, 7 aa, Mycobacterium tuberculosis
RNTTRDE

SEQ ID NO: 1435384 - protein, 7 aa, Mycobacterium tuberculosis
RPAARTD

SEQ ID NO: 1435385 - protein, 5 aa, Mycobacterium tuberculosis
RPDGQ

SEQ ID NO: 1435386 - protein, 8 aa, Mycobacterium tuberculosis
RPEEVAAR

SEQ ID NO: 1435387 - protein, 8 aa, Mycobacterium tuberculosis
RPEGGWTP

SEQ ID NO: 1435388 - protein, 5 aa, Mycobacterium tuberculosis
RPEHA

SEQ ID NO: 1435389 - protein, 5 aa, Mycobacterium tuberculosis
RPESP

SEQ ID NO: 1435390 - protein, 7 aa, Mycobacterium tuberculosis
RPGAVTR

SEQ ID NO: 1435391 - protein, 8 aa, Mycobacterium tuberculosis
RPGRDLAP

SEQ ID NO: 1435392 - protein, 14 aa, Mycobacterium tuberculosis
RPKTQRRLPRPRWQ

SEQ ID NO: 1435393 - protein, 4 aa, Mycobacterium tuberculosis
RPPM

SEQ ID NO: 1435394 - protein, 5 aa, Mycobacterium tuberculosis
RPPSM

SEQ ID NO: 1435395 - protein, 9 aa, Mycobacterium tuberculosis
RPSDTNTAG

SEQ ID NO: 1435396 - protein, 10 aa, Mycobacterium tuberculosis
RPSHITNPAG

SEQ ID NO: 1435397 - protein, 10 aa, Mycobacterium tuberculosis
RPSPGTRATV

SEQ ID NO: 1435398 - protein, 14 aa, Mycobacterium tuberculosis
RPTAVEGDATPISQ

SEQ ID NO: 1435399 - protein, 6 aa, Mycobacterium tuberculosis
RQDNNP

SEQ ID NO: 1435400 - protein, 7 aa, Mycobacterium tuberculosis
RQGYQAE

SEQ ID NO: 1435401 - protein, 15 aa, Mycobacterium tuberculosis
RQHQTRVASQRTTPE

SEQ ID NO: 1435402 - protein, 15 aa, Mycobacterium tuberculosis
RQKYDPSRVMFSGLN

SEQ ID NO: 1435403 - protein, 9 aa, Mycobacterium tuberculosis
RQPGPDPVD

SEQ ID NO: 1435404 - protein, 13 aa, Mycobacterium tuberculosis
RQPSTPPLQTPGR

SEQ ID NO: 1435405 - protein, 5 aa, Mycobacterium tuberculosis
RRAAG

SEQ ID NO: 1435406 - protein, 5 aa, Mycobacterium tuberculosis
RRAAH

SEQ ID NO: 1435407 - protein, 20 aa, Mycobacterium tuberculosis
RRADRQRRQRRQRRQSRGHA

SEQ ID NO: 1435408 - protein, 78 aa, Mycobacterium tuberculosis
RRAPSPGSPPLPPPPPTPISPASPPRPPLPPNPAKPSLETPVPASPPLPPEPAAPPLPYSSPPAPPNWPKPPLPPLPP

SEQ ID NO: 1435409 - protein, 11 aa, Mycobacterium tuberculosis
RRASSSGYARA

SEQ ID NO: 1435410 - protein, 6 aa, Mycobacterium tuberculosis
RRDDPL

SEQ ID NO: 1435411 - protein, 12 aa, Mycobacterium tuberculosis
RREESLHPVGED

SEQ ID NO: 1435412 - protein, 15 aa, Mycobacterium tuberculosis
RRGDRAGQQPQRVVP

SEQ ID NO: 1435413 - protein, 5 aa, Mycobacterium tuberculosis
RRGEV

SEQ ID NO: 1435414 - protein, 6 aa, Mycobacterium tuberculosis
RRGGDV

SEQ ID NO: 1435415 - protein, 7 aa, Mycobacterium tuberculosis
RRGGSAM

SEQ ID NO: 1435416 - protein, 6 aa, Mycobacterium tuberculosis
RRGGVT

SEQ ID NO: 1435417 - protein, 7 aa, Mycobacterium tuberculosis
RRHPGAQ

SEQ ID NO: 1435418 - protein, 9 aa, Mycobacterium tuberculosis
RRRELTGGR

SEQ ID NO: 1435419 - protein, 4 aa, Mycobacterium tuberculosis
RRRT

SEQ ID NO: 1435420 - protein, 7 aa, Mycobacterium tuberculosis
RRSEPEV

SEQ ID NO: 1435421 - protein, 12 aa, Mycobacterium tuberculosis
RRSVAPASGAVP

SEQ ID NO: 1435422 - protein, 15 aa, Mycobacterium tuberculosis
RRTRAGLKDPKRPSG

SEQ ID NO: 1435423 - protein, 22 aa, Mycobacterium tuberculosis
RRYAGQDTAAAAALGAVRPWGT

SEQ ID NO: 1435424 - protein, 7 aa, Mycobacterium tuberculosis
RRYDGDE

SEQ ID NO: 1435425 - protein, 7 aa, Mycobacterium tuberculosis
RSAHSTV

SEQ ID NO: 1435426 - protein, 5 aa, Mycobacterium tuberculosis
RSANN

SEQ ID NO: 1435427 - protein, 5 aa, Mycobacterium tuberculosis
RSDRV

SEQ ID NO: 1435428 - protein, 4 aa, Mycobacterium tuberculosis
RSGA

SEQ ID NO: 1435429 - protein, 10 aa, Mycobacterium tuberculosis
RSGEQADRAA

SEQ ID NO: 1435430 - protein, 9 aa, Mycobacterium tuberculosis
RSGHFSPDE

SEQ ID NO: 1435431 - protein, 19 aa, Mycobacterium tuberculosis
RSGLAGRGRIPAHSARRRG

SEQ ID NO: 1435432 - protein, 6 aa, Mycobacterium tuberculosis
RSGRLK

SEQ ID NO: 1435433 - protein, 7 aa, Mycobacterium tuberculosis
RSGRVGR

SEQ ID NO: 1435434 - protein, 23 aa, Mycobacterium tuberculosis
RSIPHSGEDSIPPNLFVSAQRAT

SEQ ID NO: 1435435 - protein, 10 aa, Mycobacterium tuberculosis
RSKAEAGDTD

SEQ ID NO: 1435436 - protein, 6 aa, Mycobacterium tuberculosis
RSKSND

SEQ ID NO: 1435437 - protein, 12 aa, Mycobacterium tuberculosis
RSPAANKKAITT

SEQ ID NO: 1435438 - protein, 7 aa, Mycobacterium tuberculosis
RSRQPKF

SEQ ID NO: 1435439 - protein, 8 aa, Mycobacterium tuberculosis
RSRSRPVR

SEQ ID NO: 1435440 - protein, 7 aa, Mycobacterium tuberculosis
RSSGGLA

SEQ ID NO: 1435441 - protein, 11 aa, Mycobacterium tuberculosis
RSSHLGTGGMA

SEQ ID NO: 1435442 - protein, 5 aa, Mycobacterium tuberculosis
RSSNG

SEQ ID NO: 1435443 - protein, 5 aa, Mycobacterium tuberculosis
RSTGW

SEQ ID NO: 1435444 - protein, 4 aa, Mycobacterium tuberculosis
RSVR

SEQ ID NO: 1435445 - protein, 9 aa, Mycobacterium tuberculosis
RTAHQDVPS

SEQ ID NO: 1435446 - protein, 7 aa, Mycobacterium tuberculosis
RTAQPVR

SEQ ID NO: 1435447 - protein, 5 aa, Mycobacterium tuberculosis
RTAQV

SEQ ID NO: 1435448 - protein, 11 aa, Mycobacterium tuberculosis
RTASSDPEARR

SEQ ID NO: 1435449 - protein, 7 aa, Mycobacterium tuberculosis
RTATDTC

SEQ ID NO: 1435450 - protein, 4 aa, Mycobacterium tuberculosis
RTDV

SEQ ID NO: 1435451 - protein, 5 aa, Mycobacterium tuberculosis
RTERH

SEQ ID NO: 1435452 - protein, 8 aa, Mycobacterium tuberculosis
RTGAAGRS

SEQ ID NO: 1435453 - protein, 7 aa, Mycobacterium tuberculosis
RTGGDPH

SEQ ID NO: 1435454 - protein, 5 aa, Mycobacterium tuberculosis
RTGIP

SEQ ID NO: 1435455 - protein, 5 aa, Mycobacterium tuberculosis
RTHAT

SEQ ID NO: 1435456 - protein, 14 aa, Mycobacterium tuberculosis
RTHGSSSSIGDGAA

SEQ ID NO: 1435457 - protein, 17 aa, Mycobacterium tuberculosis
RTPAATDLQNPGAVTPD

SEQ ID NO: 1435458 - protein, 11 aa, Mycobacterium tuberculosis
RTPTPAPTPPS

SEQ ID NO: 1435459 - protein, 6 aa, Mycobacterium tuberculosis
RTQDAA

SEQ ID NO: 1435460 - protein, 6 aa, Mycobacterium tuberculosis
RTRKAG

SEQ ID NO: 1435461 - protein, 4 aa, Mycobacterium tuberculosis
RTRS

SEQ ID NO: 1435462 - protein, 4 aa, Mycobacterium tuberculosis
RTRT

SEQ ID NO: 1435463 - protein, 5 aa, Mycobacterium tuberculosis
RTTEP

SEQ ID NO: 1435464 - protein, 5 aa, Mycobacterium tuberculosis
RTTLG

SEQ ID NO: 1435465 - protein, 6 aa, Mycobacterium tuberculosis
RVDQGR

SEQ ID NO: 1435466 - protein, 13 aa, Mycobacterium tuberculosis
RVDSDLDAQSPAA

SEQ ID NO: 1435467 - protein, 13 aa, Mycobacterium tuberculosis
RVEDPVGSQPQVG

SEQ ID NO: 1435468 - protein, 11 aa, Mycobacterium tuberculosis
RVGARADERLR

SEQ ID NO: 1435469 - protein, 7 aa, Mycobacterium tuberculosis
RVRPGSD

SEQ ID NO: 1435470 - protein, 5 aa, Mycobacterium tuberculosis
RVRQR

SEQ ID NO: 1435471 - protein, 10 aa, Mycobacterium tuberculosis
RVSDSGEGRW

SEQ ID NO: 1435472 - protein, 8 aa, Mycobacterium tuberculosis
RVTGRGAG

SEQ ID NO: 1435473 - protein, 4 aa, Mycobacterium tuberculosis
RWAS

SEQ ID NO: 1435474 - protein, 10 aa, Mycobacterium tuberculosis
RWDPTNGQGR

SEQ ID NO: 1435475 - protein, 10 aa, Mycobacterium tuberculosis
RWDPTPEPEI

SEQ ID NO: 1435476 - protein, 7 aa, Mycobacterium tuberculosis
RYAESQH

SEQ ID NO: 1435477 - protein, 8 aa, Mycobacterium tuberculosis
RYANPDVT

SEQ ID NO: 1435478 - protein, 12 aa, Mycobacterium tuberculosis
RYPSTDDVHRAQ

SEQ ID NO: 1435479 - protein, 5 aa, Mycobacterium tuberculosis
RYRGD

SEQ ID NO: 1435480 - protein, 16 aa, Mycobacterium tuberculosis
RYYGDPSNKPNPNLGE

SEQ ID NO: 1435481 - protein, 13 aa, Mycobacterium tuberculosis
SAAAAAAPPPADI

SEQ ID NO: 1435482 - protein, 11 aa, Mycobacterium tuberculosis
SAAAAAGRAAP

SEQ ID NO: 1435483 - protein, 16 aa, Mycobacterium tuberculosis
SAAGGEPAGLGARDTL

SEQ ID NO: 1435484 - protein, 8 aa, Mycobacterium tuberculosis
SADGGVPR

SEQ ID NO: 1435485 - protein, 8 aa, Mycobacterium tuberculosis
SADGMVRG

SEQ ID NO: 1435486 - protein, 15 aa, Mycobacterium tuberculosis
SADLPEASDDNERTS

SEQ ID NO: 1435487 - protein, 13 aa, Mycobacterium tuberculosis
SAEEKPYARRPYP

SEQ ID NO: 1435488 - protein, 4 aa, Mycobacterium tuberculosis
SAGP

SEQ ID NO: 1435489 - protein, 7 aa, Mycobacterium tuberculosis
SAGPQRN

SEQ ID NO: 1435490 - protein, 34 aa, Mycobacterium tuberculosis
SAGPRGPYDNDLDSSSPANRDISSITSRSRRGGT

SEQ ID NO: 1435491 - protein, 6 aa, Mycobacterium tuberculosis
SAGQSW

SEQ ID NO: 1435492 - protein, 4 aa, Mycobacterium tuberculosis
SAGS

SEQ ID NO: 1435493 - protein, 11 aa, Mycobacterium tuberculosis
SAGSSYTTFPG

SEQ ID NO: 1435494 - protein, 7 aa, Mycobacterium tuberculosis
SAGTLST

SEQ ID NO: 1435495 - protein, 16 aa, Mycobacterium tuberculosis
SAGVQARNPKYSSYLP

SEQ ID NO: 1435496 - protein, 5 aa, Mycobacterium tuberculosis
SAHGI

SEQ ID NO: 1435497 - protein, 7 aa, Mycobacterium tuberculosis
SAHSADG

SEQ ID NO: 1435498 - protein, 5 aa, Mycobacterium tuberculosis
SAIPA

SEQ ID NO: 1435499 - protein, 4 aa, Mycobacterium tuberculosis
SALA

SEQ ID NO: 1435500 - protein, 19 aa, Mycobacterium tuberculosis
SANEADAAQQFQGVGAQAE

SEQ ID NO: 1435501 - protein, 6 aa, Mycobacterium tuberculosis
SAPAVK

SEQ ID NO: 1435502 - protein, 4 aa, Mycobacterium tuberculosis
SAQV

SEQ ID NO: 1435503 - protein, 4 aa, Mycobacterium tuberculosis
SARA

SEQ ID NO: 1435504 - protein, 7 aa, Mycobacterium tuberculosis
SARPDQL

SEQ ID NO: 1435505 - protein, 6 aa, Mycobacterium tuberculosis
SARQFA

SEQ ID NO: 1435506 - protein, 6 aa, Mycobacterium tuberculosis
SASTDP

SEQ ID NO: 1435507 - protein, 4 aa, Mycobacterium tuberculosis
SATH

SEQ ID NO: 1435508 - protein, 11 aa, Mycobacterium tuberculosis
SATLGNADTIG

SEQ ID NO: 1435509 - protein, 5 aa, Mycobacterium tuberculosis
SATVH

SEQ ID NO: 1435510 - protein, 9 aa, Mycobacterium tuberculosis
SAVDDASER

SEQ ID NO: 1435511 - protein, 13 aa, Mycobacterium tuberculosis
SAVPAGPLPAYGS

SEQ ID NO: 1435512 - protein, 5 aa, Mycobacterium tuberculosis
SAVPE

SEQ ID NO: 1435513 - protein, 14 aa, Mycobacterium tuberculosis
SAVSTAGAAAAGPT

SEQ ID NO: 1435514 - protein, 4 aa, Mycobacterium tuberculosis
SAYN

SEQ ID NO: 1435515 - protein, 14 aa, Mycobacterium tuberculosis
SDAAPQLRDDPEAR

SEQ ID NO: 1435516 - protein, 7 aa, Mycobacterium tuberculosis
SDAPEYS

SEQ ID NO: 1435517 - protein, 6 aa, Mycobacterium tuberculosis
SDDTVG

SEQ ID NO: 1435518 - protein, 7 aa, Mycobacterium tuberculosis
SDGRPHA

SEQ ID NO: 1435519 - protein, 7 aa, Mycobacterium tuberculosis
SDLSSTD

SEQ ID NO: 1435520 - protein, 10 aa, Mycobacterium tuberculosis
SDNKQRAKIA

SEQ ID NO: 1435521 - protein, 4 aa, Mycobacterium tuberculosis
SDNP

SEQ ID NO: 1435522 - protein, 5 aa, Mycobacterium tuberculosis
SDPKG

SEQ ID NO: 1435523 - protein, 9 aa, Mycobacterium tuberculosis
SDPSKPNGQ

SEQ ID NO: 1435524 - protein, 6 aa, Mycobacterium tuberculosis
SDVDRA

SEQ ID NO: 1435525 - protein, 8 aa, Mycobacterium tuberculosis
SEADPLTA

SEQ ID NO: 1435526 - protein, 7 aa, Mycobacterium tuberculosis
SEFPADR

SEQ ID NO: 1435527 - protein, 5 aa, Mycobacterium tuberculosis
SEGDD

SEQ ID NO: 1435528 - protein, 5 aa, Mycobacterium tuberculosis
SEGGG

SEQ ID NO: 1435529 - protein, 11 aa, Mycobacterium tuberculosis
SEGKDEATMAE

SEQ ID NO: 1435530 - protein, 6 aa, Mycobacterium tuberculosis
SEGSAG

SEQ ID NO: 1435531 - protein, 6 aa, Mycobacterium tuberculosis
SEHERA

SEQ ID NO: 1435532 - protein, 9 aa, Mycobacterium tuberculosis
SEIAESGAA

SEQ ID NO: 1435533 - protein, 10 aa, Mycobacterium tuberculosis
SEPGDGVPPA

SEQ ID NO: 1435534 - protein, 4 aa, Mycobacterium tuberculosis
SERI

SEQ ID NO: 1435535 - protein, 5 aa, Mycobacterium tuberculosis
SESER

SEQ ID NO: 1435536 - protein, 6 aa, Mycobacterium tuberculosis
SGAAQS

SEQ ID NO: 1435537 - protein, 4 aa, Mycobacterium tuberculosis
SGAG

SEQ ID NO: 1435538 - protein, 8 aa, Mycobacterium tuberculosis
SGAGGVSG

SEQ ID NO: 1435539 - protein, 6 aa, Mycobacterium tuberculosis
SGAKAI

SEQ ID NO: 1435540 - protein, 6 aa, Mycobacterium tuberculosis
SGDGAV

SEQ ID NO: 1435541 - protein, 4 aa, Mycobacterium tuberculosis
SGDP

SEQ ID NO: 1435542 - protein, 9 aa, Mycobacterium tuberculosis
SGDPDPAHN

SEQ ID NO: 1435543 - protein, 6 aa, Mycobacterium tuberculosis
SGDPSL

SEQ ID NO: 1435544 - protein, 8 aa, Mycobacterium tuberculosis
SGEGGEES

SEQ ID NO: 1435545 - protein, 17 aa, Mycobacterium tuberculosis
SGEQRLSGHRGPTGGVS

SEQ ID NO: 1435546 - protein, 14 aa, Mycobacterium tuberculosis
SGGAANAANGALGA

SEQ ID NO: 1435547 - protein, 30 aa, Mycobacterium tuberculosis; identical to SEQ ID NO: 194974

SEQ ID NO: 1435548 - protein, 28 aa, Mycobacterium tuberculosis
SGGFGGAGGAAAGVGTTGGVGGSGGVGG

SEQ ID NO: 1435549 - protein, 10 aa, Mycobacterium tuberculosis
SGGGGGTGGF

SEQ ID NO: 1435550 - protein, 5 aa, Mycobacterium tuberculosis
SGGLI

SEQ ID NO: 1435551 - protein, 44 aa, Mycobacterium tuberculosis; identical to SEQ ID NO: 187404

SEQ ID NO: 1435552 - protein, 7 aa, Mycobacterium tuberculosis
SGGSTIP

SEQ ID NO: 1435553 - protein, 24 aa, Mycobacterium tuberculosis
SGGTGGVGGAATTTGGVGGAGGNA

SEQ ID NO: 1435554 - protein, 5 aa, Mycobacterium tuberculosis
SGITG

SEQ ID NO: 1435555 - protein, 9 aa, Mycobacterium tuberculosis
SGLAKPDGI

SEQ ID NO: 1435556 - protein, 8 aa, Mycobacterium tuberculosis
SGLDAAGV

SEQ ID NO: 1435557 - protein, 8 aa, Mycobacterium tuberculosis
SGNIGNGS

SEQ ID NO: 1435558 - protein, 5 aa, Mycobacterium tuberculosis
SGNMG

SEQ ID NO: 1435559 - protein, 5 aa, Mycobacterium tuberculosis
SGNNN

SEQ ID NO: 1435560 - protein, 5 aa, Mycobacterium tuberculosis
SGPAA

SEQ ID NO: 1435561 - protein, 6 aa, Mycobacterium tuberculosis
SGPAAD

SEQ ID NO: 1435562 - protein, 10 aa, Mycobacterium tuberculosis
SGQFRPQPVR

SEQ ID NO: 1435563 - protein, 4 aa, Mycobacterium tuberculosis
SGQG

SEQ ID NO: 1435564 - protein, 5 aa, Mycobacterium tuberculosis
SGQGG

SEQ ID NO: 1435565 - protein, 32 aa, Mycobacterium tuberculosis; identical to SEQ ID NO: 187520

SEQ ID NO: 1435566 - protein, 12 aa, Mycobacterium tuberculosis
SGRHRAGPARRG

SEQ ID NO: 1435567 - protein, 7 aa, Mycobacterium tuberculosis
SGRPFED

SEQ ID NO: 1435568 - protein, 4 aa, Mycobacterium tuberculosis
SGSL

SEQ ID NO: 1435569 - protein, 8 aa, Mycobacterium tuberculosis
SGSLGNYN

SEQ ID NO: 1435570 - protein, 4 aa, Mycobacterium tuberculosis
SGVP

SEQ ID NO: 1435571 - protein, 4 aa, Mycobacterium tuberculosis
SGVS

SEQ ID NO: 1435572 - protein, 8 aa, Mycobacterium tuberculosis
SGVSDATQ

SEQ ID NO: 1435573 - protein, 11 aa, Mycobacterium tuberculosis
SHQEGEPARRA

SEQ ID NO: 1435574 - protein, 6 aa, Mycobacterium tuberculosis
SHQPNR

SEQ ID NO: 1435575 - protein, 6 aa, Mycobacterium tuberculosis
SHTPQV

SEQ ID NO: 1435576 - protein, 7 aa, Mycobacterium tuberculosis
SHTSTHG

SEQ ID NO: 1435577 - protein, 4 aa, Mycobacterium tuberculosis
SIAD

SEQ ID NO: 1435578 - protein, 4 aa, Mycobacterium tuberculosis
SIHN

SEQ ID NO: 1435579 - protein, 15 aa, Mycobacterium tuberculosis
SIQQGGAGGAGGNGG

SEQ ID NO: 1435580 - protein, 9 aa, Mycobacterium tuberculosis
SISGTAPSR

SEQ ID NO: 1435581 - protein, 4 aa, Mycobacterium tuberculosis
SKPG

SEQ ID NO: 1435582 - protein, 6 aa, Mycobacterium tuberculosis
SKSPVA

SEQ ID NO: 1435583 - protein, 8 aa, Mycobacterium tuberculosis
SKSSSLAG

SEQ ID NO: 1435584 - protein, 19 aa, Mycobacterium tuberculosis
SKTTGDPPFPGQPPPVAND

SEQ ID NO: 1435585 - protein, 67 aa, Mycobacterium tuberculosis; identical to SEQ ID NO: 187763

SEQ ID NO: 1435586 - protein, 10 aa, Mycobacterium tuberculosis
SLAGSGVLTG

SEQ ID NO: 1435587 - protein, 5 aa, Mycobacterium tuberculosis
SLAGT

SEQ ID NO: 1435588 - protein, 4 aa, Mycobacterium tuberculosis
SLDG

SEQ ID NO: 1435589 - protein, 4 aa, Mycobacterium tuberculosis
SLEA

SEQ ID NO: 1435590 - protein, 5 aa, Mycobacterium tuberculosis
SLERA

SEQ ID NO: 1435591 - protein, 4 aa, Mycobacterium tuberculosis
SLGD

SEQ ID NO: 1435592 - protein, 14 aa, Mycobacterium tuberculosis
SLNEAAPDADRFRR

SEQ ID NO: 1435593 - protein, 6 aa, Mycobacterium tuberculosis
SLPPAH

SEQ ID NO: 1435594 - protein, 4 aa, Mycobacterium tuberculosis
SLSD

SEQ ID NO: 1435595 - protein, 9 aa, Mycobacterium tuberculosis
SMSGTHESN

SEQ ID NO: 1435596 - protein, 4 aa, Mycobacterium tuberculosis
SNGD

SEQ ID NO: 1435597 - protein, 8 aa, Mycobacterium tuberculosis
SNIELGPG

SEQ ID NO: 1435598 - protein, 13 aa, Mycobacterium tuberculosis
SNIGHAQAAAGGL

SEQ ID NO: 1435599 - protein, 15 aa, Mycobacterium tuberculosis
SNTRERMSSPVRNNV

SEQ ID NO: 1435600 - protein, 7 aa, Mycobacterium tuberculosis
SNVQGDR

SEQ ID NO: 1435601 - protein, 13 aa, Mycobacterium tuberculosis
SPAANAPDAGPPQ

SEQ ID NO: 1435602 - protein, 5 aa, Mycobacterium tuberculosis
SPADQ

SEQ ID NO: 1435603 - protein, 6 aa, Mycobacterium tuberculosis
SPAFTA

SEQ ID NO: 1435604 - protein, 22 aa, Mycobacterium tuberculosis
SPDTWPPPSGVASKPNLNRRCV

SEQ ID NO: 1435605 - protein, 6 aa, Mycobacterium tuberculosis
SPFGQR

SEQ ID NO: 1435606 - protein, 11 aa, Mycobacterium tuberculosis
SPGQRSRGPSK

SEQ ID NO: 1435607 - protein, 6 aa, Mycobacterium tuberculosis
SPGQSL

SEQ ID NO: 1435608 - protein, 6 aa, Mycobacterium tuberculosis
SPHRSP

SEQ ID NO: 1435609 - protein, 4 aa, Mycobacterium tuberculosis
SPIG

SEQ ID NO: 1435610 - protein, 15 aa, Mycobacterium tuberculosis
SPKCGNGNDPLDKAG

SEQ ID NO: 1435611 - protein, 8 aa, Mycobacterium tuberculosis
SPKDAEGI

SEQ ID NO: 1435612 - protein, 6 aa, Mycobacterium tuberculosis
SPKGYQ

SEQ ID NO: 1435613 - protein, 7 aa, Mycobacterium tuberculosis
SPNARAA

SEQ ID NO: 1435614 - protein, 6 aa, Mycobacterium tuberculosis
SPQSTV

SEQ ID NO: 1435615 - protein, 14 aa, Mycobacterium tuberculosis
SPQSTVIGGATQTV

SEQ ID NO: 1435616 - protein, 8 aa, Mycobacterium tuberculosis
SPREGRDD

SEQ ID NO: 1435617 - protein, 4 aa, Mycobacterium tuberculosis
SPRH

SEQ ID NO: 1435618 - protein, 5 aa, Mycobacterium tuberculosis
SPSNA

SEQ ID NO: 1435619 - protein, 5 aa, Mycobacterium tuberculosis
SPTHA

SEQ ID NO: 1435620 - protein, 14 aa, Mycobacterium tuberculosis
SPTSTVVGGATQSI

SEQ ID NO: 1435621 - protein, 8 aa, Mycobacterium tuberculosis
SQAGFDPG

SEQ ID NO: 1435622 - protein, 10 aa, Mycobacterium tuberculosis
SQDAASVRRA

SEQ ID NO: 1435623 - protein, 4 aa, Mycobacterium tuberculosis
SQGH

SEQ ID NO: 1435624 - protein, 11 aa, Mycobacterium tuberculosis
SQGKAASYRAA

SEQ ID NO: 1435625 - protein, 8 aa, Mycobacterium tuberculosis
SQGTTAHS

SEQ ID NO: 1435626 - protein, 5 aa, Mycobacterium tuberculosis
SQLNS

SEQ ID NO: 1435627 - protein, 8 aa, Mycobacterium tuberculosis
SQNRAEEA

SEQ ID NO: 1435628 - protein, 5 aa, Mycobacterium tuberculosis
SQPLT

SEQ ID NO: 1435629 - protein, 7 aa, Mycobacterium tuberculosis
SQPPWRP

SEQ ID NO: 1435630 - protein, 19 aa, Mycobacterium tuberculosis
SQRLQPLKPTRGCSAPTDR

SEQ ID NO: 1435631 - protein, 7 aa, Mycobacterium tuberculosis
SQRRAQR

SEQ ID NO: 1435632 - protein, 5 aa, Mycobacterium tuberculosis
SQSPQ

SEQ ID NO: 1435633 - protein, 7 aa, Mycobacterium tuberculosis
SRAQAAQ

SEQ ID NO: 1435634 - protein, 4 aa, Mycobacterium tuberculosis
SRDA

SEQ ID NO: 1435635 - protein, 13 aa, Mycobacterium tuberculosis
SRDESARASDTDR

SEQ ID NO: 1435636 - protein, 5 aa, Mycobacterium tuberculosis
SRDPV

SEQ ID NO: 1435637 - protein, 6 aa, Mycobacterium tuberculosis
SRDQAI

SEQ ID NO: 1435638 - protein, 7 aa, Mycobacterium tuberculosis
SRESIGV

SEQ ID NO: 1435639 - protein, 7 aa, Mycobacterium tuberculosis
SRGDQSQ

SEQ ID NO: 1435640 - protein, 9 aa, Mycobacterium tuberculosis
SRGERFDTP

SEQ ID NO: 1435641 - protein, 9 aa, Mycobacterium tuberculosis
SRGGDGGVG

SEQ ID NO: 1435642 - protein, 6 aa, Mycobacterium tuberculosis
SRGHAT

SEQ ID NO: 1435643 - protein, 8 aa, Mycobacterium tuberculosis
SRGSWRGR

SEQ ID NO: 1435644 - protein, 9 aa, Mycobacterium tuberculosis
SRGSWRGRD

SEQ ID NO: 1435645 - protein, 10 aa, Mycobacterium tuberculosis
SRGVGGRRRR

SEQ ID NO: 1435646 - protein, 28 aa, Mycobacterium tuberculosis
SRHGIGRRTGLPGSPTRGPANSITSAGQ

SEQ ID NO: 1435647 - protein, 5 aa, Mycobacterium tuberculosis
SRKKT

SEQ ID NO: 1435648 - protein, 5 aa, Mycobacterium tuberculosis
SRLDP

SEQ ID NO: 1435649 - protein, 10 aa, Mycobacterium tuberculosis
SRNPSQFTDE

SEQ ID NO: 1435650 - protein, 8 aa, Mycobacterium tuberculosis
SRPAVSAE

SEQ ID NO: 1435651 - protein, 18 aa, Mycobacterium tuberculosis
SRPDTLPPRVPGTAGNTA

SEQ ID NO: 1435652 - protein, 7 aa, Mycobacterium tuberculosis
SRQDHGL

SEQ ID NO: 1435653 - protein, 6 aa, Mycobacterium tuberculosis
SRQGLA

SEQ ID NO: 1435654 - protein, 8 aa, Mycobacterium tuberculosis
SRRSFSTT

SEQ ID NO: 1435655 - protein, 7 aa, Mycobacterium tuberculosis
SRSDTYP

SEQ ID NO: 1435656 - protein, 7 aa, Mycobacterium tuberculosis
SRSPDFV

SEQ ID NO: 1435657 - protein, 7 aa, Mycobacterium tuberculosis
SRSRCTP

SEQ ID NO: 1435658 - protein, 7 aa, Mycobacterium tuberculosis
SRSTEFA

SEQ ID NO: 1435659 - protein, 4 aa, Mycobacterium tuberculosis
SRTP

SEQ ID NO: 1435660 - protein, 19 aa, Mycobacterium tuberculosis
SRVAARRRAGQRAESRQHP

SEQ ID NO: 1435661 - protein, 7 aa, Mycobacterium tuberculosis
SRWEPSR

SEQ ID NO: 1435662 - protein, 13 aa, Mycobacterium tuberculosis
SRYPNQLSGGQRQ

SEQ ID NO: 1435663 - protein, 11 aa, Mycobacterium tuberculosis
SSADQKSDLDR

SEQ ID NO: 1435664 - protein, 23 aa, Mycobacterium tuberculosis
SSAHPKADLTDPEKQILSLQVTV

SEQ ID NO: 1435665 - protein, 4 aa, Mycobacterium tuberculosis
SSAL

SEQ ID NO: 1435666 - protein, 8 aa, Mycobacterium tuberculosis
SSATGSRL

SEQ ID NO: 1435667 - protein, 23 aa, Mycobacterium tuberculosis
SSDGGAGGDGGDGGNGGAGGTGG

SEQ ID NO: 1435668 - protein, 5 aa, Mycobacterium tuberculosis
SSETA

SEQ ID NO: 1435669 - protein, 4 aa, Mycobacterium tuberculosis
SSFR

SEQ ID NO: 1435670 - protein, 15 aa, Mycobacterium tuberculosis
SSIAAANAAAAANTT

SEQ ID NO: 1435671 - protein, 17 aa, Mycobacterium tuberculosis
SSIGAANAAAAGSTTSV

SEQ ID NO: 1435672 - protein, 5 aa, Mycobacterium tuberculosis
SSLRS

SEQ ID NO: 1435673 - protein, 5 aa, Mycobacterium tuberculosis
SSNAG

SEQ ID NO: 1435674 - protein, 10 aa, Mycobacterium tuberculosis
SSNTVSTANE

SEQ ID NO: 1435675 - protein, 6 aa, Mycobacterium tuberculosis
SSPGLA

SEQ ID NO: 1435676 - protein, 5 aa, Mycobacterium tuberculosis
SSPHP

SEQ ID NO: 1435677 - protein, 13 aa, Mycobacterium tuberculosis
SSPVAADSRGLGS

SEQ ID NO: 1435678 - protein, 6 aa, Mycobacterium tuberculosis
SSQLED

SEQ ID NO: 1435679 - protein, 7 aa, Mycobacterium tuberculosis
SSRGPEY

SEQ ID NO: 1435680 - protein, 10 aa, Mycobacterium tuberculosis
SSSPPQPPKD

SEQ ID NO: 1435681 - protein, 11 aa, Mycobacterium tuberculosis
SSSSPLRNPFP

SEQ ID NO: 1435682 - protein, 15 aa, Mycobacterium tuberculosis
SSTGSTAPHRLPPPR

SEQ ID NO: 1435683 - protein, 11 aa, Mycobacterium tuberculosis
SSTVAVSGERQ

SEQ ID NO: 1435684 - protein, 13 aa, Mycobacterium tuberculosis
SSYTPAPATAGRS

SEQ ID NO: 1435685 - protein, 4 aa, Mycobacterium tuberculosis
STDL

SEQ ID NO: 1435686 - protein, 13 aa, Mycobacterium tuberculosis
STEAKAAGKCRPC

SEQ ID NO: 1435687 - protein, 8 aa, Mycobacterium tuberculosis
STENAEQY

SEQ ID NO: 1435688 - protein, 11 aa, Mycobacterium tuberculosis
STINPDQPIDT

SEQ ID NO: 1435689 - protein, 4 aa, Mycobacterium tuberculosis
STKV

SEQ ID NO: 1435690 - protein, 10 aa, Mycobacterium tuberculosis
STQHAAALGD

SEQ ID NO: 1435691 - protein, 8 aa, Mycobacterium tuberculosis
STRVPAGA

SEQ ID NO: 1435692 - protein, 7 aa, Mycobacterium tuberculosis
STSYQEV

SEQ ID NO: 1435693 - protein, 14 aa, Mycobacterium tuberculosis
STTSLPETPRGERN

SEQ ID NO: 1435694 - protein, 7 aa, Mycobacterium tuberculosis
STTTWSG

SEQ ID NO: 1435695 - protein, 5 aa, Mycobacterium tuberculosis
STVAN

SEQ ID NO: 1435696 - protein, 6 aa, Mycobacterium tuberculosis
SVDGGQ

SEQ ID NO: 1435697 - protein, 6 aa, Mycobacterium tuberculosis
SVDPSR

SEQ ID NO: 1435698 - protein, 4 aa, Mycobacterium tuberculosis
SVEA

SEQ ID NO: 1435699 - protein, 8 aa, Mycobacterium tuberculosis
SVESDTDL

SEQ ID NO: 1435700 - protein, 9 aa, Mycobacterium tuberculosis
SVKGPKGTL

SEQ ID NO: 1435701 - protein, 18 aa, Mycobacterium tuberculosis
SVNGHSDDSSGDAKQAAP

SEQ ID NO: 1435702 - protein, 5 aa, Mycobacterium tuberculosis
SVPGA

SEQ ID NO: 1435703 - protein, 30 aa, Mycobacterium tuberculosis
SVRGDGGVGMASGDGGLSTGAAGASAEGGL

SEQ ID NO: 1435704 - protein, 7 aa, Mycobacterium tuberculosis
SWEYTGD

SEQ ID NO: 1435705 - protein, 11 aa, Mycobacterium tuberculosis
SYGGQGRVPGD

SEQ ID NO: 1435706 - protein, 5 aa, Mycobacterium tuberculosis
SYGTL

SEQ ID NO: 1435707 - protein, 14 aa, Mycobacterium tuberculosis
SYLAGTPPPPHYPQ

SEQ ID NO: 1435708 - protein, 8 aa, Mycobacterium tuberculosis
SYRTDSPG

SEQ ID NO: 1435709 - protein, 11 aa, Mycobacterium tuberculosis
TAAALGESRTA

SEQ ID NO: 1435710 - protein, 8 aa, Mycobacterium tuberculosis
TAAGQRHR

SEQ ID NO: 1435711 - protein, 9 aa, Mycobacterium tuberculosis
TAASVNQAR

SEQ ID NO: 1435712 - protein, 13 aa, Mycobacterium tuberculosis
TADGACCPVLVPD

SEQ ID NO: 1435713 - protein, 8 aa, Mycobacterium tuberculosis
TADGQTHR

SEQ ID NO: 1435714 - protein, 7 aa, Mycobacterium tuberculosis
TADGRRA

SEQ ID NO: 1435715 - protein, 6 aa, Mycobacterium tuberculosis
TADREG

SEQ ID NO: 1435716 - protein, 6 aa, Mycobacterium tuberculosis
TAGERA

SEQ ID NO: 1435717 - protein, 5 aa, Mycobacterium tuberculosis
TAGLG

SEQ ID NO: 1435718 - protein, 18 aa, Mycobacterium tuberculosis
TAKGRRPSWNAAAPGAVA

SEQ ID NO: 1435719 - protein, 6 aa, Mycobacterium tuberculosis
TALGNP

SEQ ID NO: 1435720 - protein, 7 aa, Mycobacterium tuberculosis
TAPTDSA

SEQ ID NO: 1435721 - protein, 9 aa, Mycobacterium tuberculosis
TAPVPGLTT

SEQ ID NO: 1435722 - protein, 4 aa, Mycobacterium tuberculosis
TARA

SEQ ID NO: 1435723 - protein, 8 aa, Mycobacterium tuberculosis
TARREAVA

SEQ ID NO: 1435724 - protein, 15 aa, Mycobacterium tuberculosis
TARSAQLAGEQLSRG

SEQ ID NO: 1435725 - protein, 5 aa, Mycobacterium tuberculosis
TASAE

SEQ ID NO: 1435726 - protein, 4 aa, Mycobacterium tuberculosis
TASH

SEQ ID NO: 1435727 - protein, 7 aa, Mycobacterium tuberculosis
TATPTAA

SEQ ID NO: 1435728 - protein, 15 aa, Mycobacterium tuberculosis
TATRRVNTIAELARR

SEQ ID NO: 1435729 - protein, 12 aa, Mycobacterium tuberculosis
TATSDGQVYSFA

SEQ ID NO: 1435730 - protein, 7 aa, Mycobacterium tuberculosis
TATTPDL

SEQ ID NO: 1435731 - protein, 11 aa, Mycobacterium tuberculosis
TAVANRSGTEP

SEQ ID NO: 1435732 - protein, 5 aa, Mycobacterium tuberculosis
TAYGQ

SEQ ID NO: 1435733 - protein, 7 aa, Mycobacterium tuberculosis
TCRPDNT

SEQ ID NO: 1435734 - protein, 7 aa, Mycobacterium tuberculosis
TDAAESR

SEQ ID NO: 1435735 - protein, 9 aa, Mycobacterium tuberculosis
TDANGAEQE

SEQ ID NO: 1435736 - protein, 8 aa, Mycobacterium tuberculosis
TDAQRDGD

SEQ ID NO: 1435737 - protein, 7 aa, Mycobacterium tuberculosis
TDASRRI

SEQ ID NO: 1435738 - protein, 6 aa, Mycobacterium tuberculosis
TDDARE

SEQ ID NO: 1435739 - protein, 6 aa, Mycobacterium tuberculosis
TDEVGQ

SEQ ID NO: 1435740 - protein, 8 aa, Mycobacterium tuberculosis
TDGGPTAG

SEQ ID NO: 1435741 - protein, 4 aa, Mycobacterium tuberculosis
TDGL

SEQ ID NO: 1435742 - protein, 7 aa, Mycobacterium tuberculosis
TDPASGN

SEQ ID NO: 1435743 - protein, 7 aa, Mycobacterium tuberculosis
TDPDELP

SEQ ID NO: 1435744 - protein, 5 aa, Mycobacterium tuberculosis
TDPRR

SEQ ID NO: 1435745 - protein, 6 aa, Mycobacterium tuberculosis
TDPTQL

SEQ ID NO: 1435746 - protein, 4 aa, Mycobacterium tuberculosis
TDQD

SEQ ID NO: 1435747 - protein, 6 aa, Mycobacterium tuberculosis
TDRKLT

SEQ ID NO: 1435748 - protein, 18 aa, Mycobacterium tuberculosis
TDRQAARQGVGGEVLAYV

SEQ ID NO: 1435749 - protein, 9 aa, Mycobacterium tuberculosis
TDRRPEFGH

SEQ ID NO: 1435750 - protein, 9 aa, Mycobacterium tuberculosis
TDRSTRDER

SEQ ID NO: 1435751 - protein, 10 aa, Mycobacterium tuberculosis
TEADNIDPQQ

SEQ ID NO: 1435752 - protein, 6 aa, Mycobacterium tuberculosis
TEDARV

SEQ ID NO: 1435753 - protein, 9 aa, Mycobacterium tuberculosis
TEFGTPRSL

SEQ ID NO: 1435754 - protein, 8 aa, Mycobacterium tuberculosis
TEKQAASW

SEQ ID NO: 1435755 - protein, 5 aa, Mycobacterium tuberculosis
TEPNH

SEQ ID NO: 1435756 - protein, 13 aa, Mycobacterium tuberculosis
TEPSLSGPGRDDL

SEQ ID NO: 1435757 - protein, 7 aa, Mycobacterium tuberculosis
TETAKRL

SEQ ID NO: 1435758 - protein, 23 aa, Mycobacterium tuberculosis
TETAREAKALAGATDGATATSAD

SEQ ID NO: 1435759 - protein, 11 aa, Mycobacterium tuberculosis
TFGSRQEEAQR

SEQ ID NO: 1435760 - protein, 7 aa, Mycobacterium tuberculosis
TGAAQGC

SEQ ID NO: 1435761 - protein, 42 aa, Mycobacterium tuberculosis
TGAGGTGGNGGTAGLIGNGGNGGAAGVSGDGTPGTGGNGGYA

SEQ ID NO: 1435762 - protein, 12 aa, Mycobacterium tuberculosis
TGAKTSQPRTTS

SEQ ID NO: 1435763 - protein, 5 aa, Mycobacterium tuberculosis
TGAQQ

SEQ ID NO: 1435764 - protein, 17 aa, Mycobacterium tuberculosis
TGAQRDRAWARRSTGTV

SEQ ID NO: 1435765 - protein, 5 aa, Mycobacterium tuberculosis
TGDAT

SEQ ID NO: 1435766 - protein, 26 aa, Mycobacterium tuberculosis
TGDPCSPNSAASGKYGERPASVSTGD

SEQ ID NO: 1435767 - protein, 12 aa, Mycobacterium tuberculosis
TGDSNGKAPTAV

SEQ ID NO: 1435768 - protein, 4 aa, Mycobacterium tuberculosis
TGEA

SEQ ID NO: 1435769 - protein, 14 aa, Mycobacterium tuberculosis
TGEEELQSSEAKVG

SEQ ID NO: 1435770 - protein, 4 aa, Mycobacterium tuberculosis
TGEP

SEQ ID NO: 1435771 - protein, 6 aa, Mycobacterium tuberculosis
TGFTEA

SEQ ID NO: 1435772 - protein, 26 aa, Mycobacterium tuberculosis
TGGAGGAGGNGGNGGKAGFSPGPTNF

SEQ ID NO: 1435773 - protein, 6 aa, Mycobacterium tuberculosis
TGGHLG

SEQ ID NO: 1435774 - protein, 6 aa, Mycobacterium tuberculosis
TGGVGK

SEQ ID NO: 1435775 - protein, 12 aa, Mycobacterium tuberculosis
TGKLPDTDTYCP

SEQ ID NO: 1435776 - protein, 4 aa, Mycobacterium tuberculosis
TGKN

SEQ ID NO: 1435777 - protein, 13 aa, Mycobacterium tuberculosis
TGLANAGSYNTGS

SEQ ID NO: 1435778 - protein, 4 aa, Mycobacterium tuberculosis
TGLG

SEQ ID NO: 1435779 - protein, 8 aa, Mycobacterium tuberculosis
TGLGAQAG

SEQ ID NO: 1435780 - protein, 9 aa, Mycobacterium tuberculosis
TGLRAGRNG

SEQ ID NO: 1435781 - protein, 14 aa, Mycobacterium tuberculosis
TGNNTYKAVQRSAG

SEQ ID NO: 1435782 - protein, 21 aa, Mycobacterium tuberculosis
TGPIATKADNPALPTSPEEIA

SEQ ID NO: 1435783 - protein, 9 aa, Mycobacterium tuberculosis
TGPPTGGLT

SEQ ID NO: 1435784 - protein, 15 aa, Mycobacterium tuberculosis
TGQPAAAGAHSLSEG

SEQ ID NO: 1435785 - protein, 6 aa, Mycobacterium tuberculosis
TGRGKD

SEQ ID NO: 1435786 - protein, 11 aa, Mycobacterium tuberculosis
TGRRTGADQRA

SEQ ID NO: 1435787 - protein, 8 aa, Mycobacterium tuberculosis
TGSGADAD

SEQ ID NO: 1435788 - protein, 5 aa, Mycobacterium tuberculosis
TGSTG

SEQ ID NO: 1435789 - protein, 15 aa, Mycobacterium tuberculosis
TGTESIESVKHSDGS

SEQ ID NO: 1435790 - protein, 7 aa, Mycobacterium tuberculosis
TGTGGAS

SEQ ID NO: 1435791 - protein, 8 aa, Mycobacterium tuberculosis
TGTTVSPP

SEQ ID NO: 1435792 - protein, 15 aa, Mycobacterium tuberculosis
TGVDPKNLDDITTDE

SEQ ID NO: 1435793 - protein, 9 aa, Mycobacterium tuberculosis
TGVGAGGTA

SEQ ID NO: 1435794 - protein, 4 aa, Mycobacterium tuberculosis
THDP

SEQ ID NO: 1435795 - protein, 6 aa, Mycobacterium tuberculosis
THGGQL

SEQ ID NO: 1435796 - protein, 11 aa, Mycobacterium tuberculosis
THLPGSQLDTT

SEQ ID NO: 1435797 - protein, 6 aa, Mycobacterium tuberculosis
THVEQT

SEQ ID NO: 1435798 - protein, 9 aa, Mycobacterium tuberculosis
TIGGGGNRQ

SEQ ID NO: 1435799 - protein, 9 aa, Mycobacterium tuberculosis
TITSPKSGV

SEQ ID NO: 1435800 - protein, 10 aa, Mycobacterium tuberculosis
TITSPKSGVV

SEQ ID NO: 1435801 - protein, 6 aa, Mycobacterium tuberculosis
TKATGA

SEQ ID NO: 1435802 - protein, 4 aa, Mycobacterium tuberculosis
TKNA

SEQ ID NO: 1435803 - protein, 6 aa, Mycobacterium tuberculosis
TKNSEV

SEQ ID NO: 1435804 - protein, 10 aa, Mycobacterium tuberculosis
TKPAASVTAT

SEQ ID NO: 1435805 - protein, 13 aa, Mycobacterium tuberculosis
TKPEAGRRIAEAK

SEQ ID NO: 1435806 - protein, 6 aa, Mycobacterium tuberculosis
TKPYSA

SEQ ID NO: 1435807 - protein, 13 aa, Mycobacterium tuberculosis
TKSCTGQDSFADP

SEQ ID NO: 1435808 - protein, 7 aa, Mycobacterium tuberculosis
TKSGGRL

SEQ ID NO: 1435809 - protein, 10 aa, Mycobacterium tuberculosis
TKTTARGVQT

SEQ ID NO: 1435810 - protein, 5 aa, Mycobacterium tuberculosis
TKTVP

SEQ ID NO: 1435811 - protein, 7 aa, Mycobacterium tuberculosis
TLGGGRS

SEQ ID NO: 1435812 - protein, 15 aa, Mycobacterium tuberculosis
TLPSSTSAMPAVSSR

SEQ ID NO: 1435813 - protein, 15 aa, Mycobacterium tuberculosis
TLTTDRGAEPELGAQ

SEQ ID NO: 1435814 - protein, 14 aa, Mycobacterium tuberculosis
TMQDGEGSGVAPTD

SEQ ID NO: 1435815 - protein, 4 aa, Mycobacterium tuberculosis
TNPG

SEQ ID NO: 1435816 - protein, 11 aa, Mycobacterium tuberculosis
TNRDGETTRHA

SEQ ID NO: 1435817 - protein, 9 aa, Mycobacterium tuberculosis
TNSQGGSSI

SEQ ID NO: 1435818 - protein, 4 aa, Mycobacterium tuberculosis
TNVE

SEQ ID NO: 1435819 - protein, 7 aa, Mycobacterium tuberculosis
TNYSAAK

SEQ ID NO: 1435820 - protein, 4 aa, Mycobacterium tuberculosis
TPAA

SEQ ID NO: 1435821 - protein, 12 aa, Mycobacterium tuberculosis
TPALGKTGAPNR

SEQ ID NO: 1435822 - protein, 6 aa, Mycobacterium tuberculosis
TPATRH

SEQ ID NO: 1435823 - protein, 14 aa, Mycobacterium tuberculosis
TPDTDLSPSWPWSG

SEQ ID NO: 1435824 - protein, 7 aa, Mycobacterium tuberculosis
TPEDTGL

SEQ ID NO: 1435825 - protein, 12 aa, Mycobacterium tuberculosis
TPEEVARQAADN

SEQ ID NO: 1435826 - protein, 6 aa, Mycobacterium tuberculosis
TPEEVE

SEQ ID NO: 1435827 - protein, 6 aa, Mycobacterium tuberculosis
TPEGPN

SEQ ID NO: 1435828 - protein, 12 aa, Mycobacterium tuberculosis
TPERDDDADNPL

SEQ ID NO: 1435829 - protein, 5 aa, Mycobacterium tuberculosis
TPEVA

SEQ ID NO: 1435830 - protein, 4 aa, Mycobacterium tuberculosis
TPFD

SEQ ID NO: 1435831 - protein, 20 aa, Mycobacterium tuberculosis
TPGARSEQADTIAKWIAKRW

SEQ ID NO: 1435832 - protein, 9 aa, Mycobacterium tuberculosis
TPGETPGSW

SEQ ID NO: 1435833 - protein, 13 aa, Mycobacterium tuberculosis
TPGFGNSTGGLSS

SEQ ID NO: 1435834 - protein, 7 aa, Mycobacterium tuberculosis
TPGQQDR

SEQ ID NO: 1435835 - protein, 18 aa, Mycobacterium tuberculosis
TPGVEGHPYRQRATPIPT

SEQ ID NO: 1435836 - protein, 4 aa, Mycobacterium tuberculosis
TPHL

SEQ ID NO: 1435837 - protein, 11 aa, Mycobacterium tuberculosis
TPIAPEDLPGR

SEQ ID NO: 1435838 - protein, 4 aa, Mycobacterium tuberculosis
TPIT

SEQ ID NO: 1435839 - protein, 4 aa, Mycobacterium tuberculosis
TPKL

SEQ ID NO: 1435840 - protein, 17 aa, Mycobacterium tuberculosis
TPKPGTGPSRKTQERGH

SEQ ID NO: 1435841 - protein, 25 aa, Mycobacterium tuberculosis
TPLATRPPSGPTVPPEHFTLPTHPI

SEQ ID NO: 1435842 - protein, 5 aa, Mycobacterium tuberculosis
TPLPP

SEQ ID NO: 1435843 - protein, 9 aa, Mycobacterium tuberculosis
TPNDPRFQP

SEQ ID NO: 1435844 - protein, 4 aa, Mycobacterium tuberculosis
TPPA

SEQ ID NO: 1435845 - protein, 6 aa, Mycobacterium tuberculosis
TPQSYL

SEQ ID NO: 1435846 - protein, 14 aa, Mycobacterium tuberculosis
TPRPGPADAAETRY

SEQ ID NO: 1435847 - protein, 10 aa, Mycobacterium tuberculosis
TPSPGTPEGP

SEQ ID NO: 1435848 - protein, 7 aa, Mycobacterium tuberculosis
TPTSGMP

SEQ ID NO: 1435849 - protein, 5 aa, Mycobacterium tuberculosis
TQAAA

SEQ ID NO: 1435850 - protein, 5 aa, Mycobacterium tuberculosis
TQALA

SEQ ID NO: 1435851 - protein, 4 aa, Mycobacterium tuberculosis
TQAV

SEQ ID NO: 1435852 - protein, 4 aa, Mycobacterium tuberculosis
TQEA

SEQ ID NO: 1435853 - protein, 7 aa, Mycobacterium tuberculosis
TQGHTQS

SEQ ID NO: 1435854 - protein, 10 aa, Mycobacterium tuberculosis
TQIDDSRISQ

SEQ ID NO: 1435855 - protein, 6 aa, Mycobacterium tuberculosis
TQPDRV

SEQ ID NO: 1435856 - protein, 5 aa, Mycobacterium tuberculosis
TQPRH

SEQ ID NO: 1435857 - protein, 4 aa, Mycobacterium tuberculosis
TQSM

SEQ ID NO: 1435858 - protein, 4 aa, Mycobacterium tuberculosis
TRAA

SEQ ID NO: 1435859 - protein, 7 aa, Mycobacterium tuberculosis
TRAQRVT

SEQ ID NO: 1435860 - protein, 14 aa, Mycobacterium tuberculosis
TREATYYSRSRAEQ

SEQ ID NO: 1435861 - protein, 8 aa, Mycobacterium tuberculosis
TRESEHSL

SEQ ID NO: 1435862 - protein, 8 aa, Mycobacterium tuberculosis
TRGEVGQP

SEQ ID NO: 1435863 - protein, 7 aa, Mycobacterium tuberculosis
TRINQET

SEQ ID NO: 1435864 - protein, 10 aa, Mycobacterium tuberculosis
TRNDKGKFTD

SEQ ID NO: 1435865 - protein, 7 aa, Mycobacterium tuberculosis
TRNVDEV

SEQ ID NO: 1435866 - protein, 12 aa, Mycobacterium tuberculosis
TRPPIGGEMAGR

SEQ ID NO: 1435867 - protein, 13 aa, Mycobacterium tuberculosis
TRPPVGGEMAGRS

SEQ ID NO: 1435868 - protein, 4 aa, Mycobacterium tuberculosis
TRQI

SEQ ID NO: 1435869 - protein, 13 aa, Mycobacterium tuberculosis
TRRPTVAGADRHP

SEQ ID NO: 1435870 - protein, 4 aa, Mycobacterium tuberculosis
TRSN

SEQ ID NO: 1435871 - protein, 17 aa, Mycobacterium tuberculosis
TRTVDGGWAGGYGTSKW

SEQ ID NO: 1435872 - protein, 19 aa, Mycobacterium tuberculosis
TRVGGYGKLPADTHPSGGC

SEQ ID NO: 1435873 - protein, 13 aa, Mycobacterium tuberculosis
TRYPPDGVSADSV

SEQ ID NO: 1435874 - protein, 16 aa, Mycobacterium tuberculosis
TSAPAGDTFPTAAPRS

SEQ ID NO: 1435875 - protein, 16 aa, Mycobacterium tuberculosis
TSARDGAPITVCSGPN

SEQ ID NO: 1435876 - protein, 4 aa, Mycobacterium tuberculosis
TSCG

SEQ ID NO: 1435877 - protein, 11 aa, Mycobacterium tuberculosis
TSDLSTPAVNS

SEQ ID NO: 1435878 - protein, 5 aa, Mycobacterium tuberculosis
TSDRC

SEQ ID NO: 1435879 - protein, 7 aa, Mycobacterium tuberculosis
TSEGAEA

SEQ ID NO: 1435880 - protein, 9 aa, Mycobacterium tuberculosis
TSGATDAKQ

SEQ ID NO: 1435881 - protein, 6 aa, Mycobacterium tuberculosis
TSGEQR

SEQ ID NO: 1435882 - protein, 11 aa, Mycobacterium tuberculosis
TSGPGFGHTRN

SEQ ID NO: 1435883 - protein, 30 aa, Mycobacterium tuberculosis; identical to SEQ ID NO: 601603

SEQ ID NO: 1435884 - protein, 5 aa, Mycobacterium tuberculosis
TSGSK

SEQ ID NO: 1435885 - protein, 9 aa, Mycobacterium tuberculosis
TSGSTRTPA

SEQ ID NO: 1435886 - protein, 8 aa, Mycobacterium tuberculosis
TSNTEKVP

SEQ ID NO: 1435887 - protein, 16 aa, Mycobacterium tuberculosis
TSPGEVAGEGSPDPFG

SEQ ID NO: 1435888 - protein, 12 aa, Mycobacterium tuberculosis
TSRRTGNDQRAD

SEQ ID NO: 1435889 - protein, 6 aa, Mycobacterium tuberculosis
TSSACE

SEQ ID NO: 1435890 - protein, 9 aa, Mycobacterium tuberculosis
TSSPPPGPV

SEQ ID NO: 1435891 - protein, 10 aa, Mycobacterium tuberculosis
TSSSRAGECE

SEQ ID NO: 1435892 - protein, 15 aa, Mycobacterium tuberculosis
TSTAGAYASAEAANV

SEQ ID NO: 1435893 - protein, 5 aa, Mycobacterium tuberculosis
TSVER

SEQ ID NO: 1435894 - protein, 11 aa, Mycobacterium tuberculosis
TTAPGNGAALG

SEQ ID NO: 1435895 - protein, 19 aa, Mycobacterium tuberculosis
TTDAGSAKPNAPSYYRGPR

SEQ ID NO: 1435896 - protein, 13 aa, Mycobacterium tuberculosis
TTGGAPMRPPRPP

SEQ ID NO: 1435897 - protein, 5 aa, Mycobacterium tuberculosis
TTPAN

SEQ ID NO: 1435898 - protein, 6 aa, Mycobacterium tuberculosis
TTPART

SEQ ID NO: 1435899 - protein, 9 aa, Mycobacterium tuberculosis
TTQERDQWD

SEQ ID NO: 1435900 - protein, 10 aa, Mycobacterium tuberculosis
TTRSGALTGP

SEQ ID NO: 1435901 - protein, 46 aa, Mycobacterium tuberculosis
TTSAAARQLTPFSSPQQTTNPAGLAAQNAAVTQAATNSAGNTPTAL

SEQ ID NO: 1435902 - protein, 7 aa, Mycobacterium tuberculosis
TTSAKEA

SEQ ID NO: 1435903 - protein, 5 aa, Mycobacterium tuberculosis
TTSFE

SEQ ID NO: 1435904 - protein, 4 aa, Mycobacterium tuberculosis
TTSL

SEQ ID NO: 1435905 - protein, 10 aa, Mycobacterium tuberculosis
TTTDLDDATV

SEQ ID NO: 1435906 - protein, 9 aa, Mycobacterium tuberculosis
TTTTTGARY

SEQ ID NO: 1435907 - protein, 6 aa, Mycobacterium tuberculosis
TVGPAR

SEQ ID NO: 1435908 - protein, 4 aa, Mycobacterium tuberculosis
TVPQ

SEQ ID NO: 1435909 - protein, 6 aa, Mycobacterium tuberculosis
TVPRGG

SEQ ID NO: 1435910 - protein, 19 aa, Mycobacterium tuberculosis
TVSAPGSGRGPNPGNVSVS

SEQ ID NO: 1435911 - protein, 5 aa, Mycobacterium tuberculosis
TVSRS

SEQ ID NO: 1435912 - protein, 13 aa, Mycobacterium tuberculosis
TVTSGAAPAGVPG

SEQ ID NO: 1435913 - protein, 6 aa, Mycobacterium tuberculosis
TYGHGG

SEQ ID NO: 1435914 - protein, 13 aa, Mycobacterium tuberculosis
TYQDAPTKSINVG

SEQ ID NO: 1435915 - protein, 10 aa, Mycobacterium tuberculosis
TYSEEEPTTL

SEQ ID NO: 1435916 - protein, 19 aa, Mycobacterium tuberculosis
VAAAPRTPGRDGEVAPSEQ

SEQ ID NO: 1435917 - protein, 5 aa, Mycobacterium tuberculosis
VAATT

SEQ ID NO: 1435918 - protein, 8 aa, Mycobacterium tuberculosis
VADDTRQR

SEQ ID NO: 1435919 - protein, 4 aa, Mycobacterium tuberculosis
VADG

SEQ ID NO: 1435920 - protein, 22 aa, Mycobacterium tuberculosis
VAEAQKPAARNALRDTPLDPER

SEQ ID NO: 1435921 - protein, 9 aa, Mycobacterium tuberculosis
VAGDNAADV

SEQ ID NO: 1435922 - protein, 7 aa, Mycobacterium tuberculosis
VAGEIDA

SEQ ID NO: 1435923 - protein, 6 aa, Mycobacterium tuberculosis
VAGEVA

SEQ ID NO: 1435924 - protein, 10 aa, Mycobacterium tuberculosis
VAGQPSMHGT

SEQ ID NO: 1435925 - protein, 8 aa, Mycobacterium tuberculosis
VAGRSEAN

SEQ ID NO: 1435926 - protein, 10 aa, Mycobacterium tuberculosis
VAGSDAEGLT

SEQ ID NO: 1435927 - protein, 4 aa, Mycobacterium tuberculosis
VAGT

SEQ ID NO: 1435928 - protein, 8 aa, Mycobacterium tuberculosis
VAKQARDI

SEQ ID NO: 1435929 - protein, 6 aa, Mycobacterium tuberculosis
VANSDG

SEQ ID NO: 1435930 - protein, 12 aa, Mycobacterium tuberculosis
VAPKDKHAARDN

SEQ ID NO: 1435931 - protein, 7 aa, Mycobacterium tuberculosis
VAPTEAT

SEQ ID NO: 1435932 - protein, 11 aa, Mycobacterium tuberculosis
VAPTRGPDAIS

SEQ ID NO: 1435933 - protein, 31 aa, Mycobacterium tuberculosis; identical to SEQ ID NO: 190577

SEQ ID NO: 1435934 - protein, 18 aa, Mycobacterium tuberculosis
VATGETPYPPAVGQDDRG

SEQ ID NO: 1435935 - protein, 7 aa, Mycobacterium tuberculosis
VATSQGV

SEQ ID NO: 1435936 - protein, 9 aa, Mycobacterium tuberculosis
VAVDGGDPL

SEQ ID NO: 1435937 - protein, 5 aa, Mycobacterium tuberculosis
VDADT

SEQ ID NO: 1435938 - protein, 6 aa, Mycobacterium tuberculosis
VDETSV

SEQ ID NO: 1435939 - protein, 9 aa, Mycobacterium tuberculosis
VDGATTGAL

SEQ ID NO: 1435940 - protein, 6 aa, Mycobacterium tuberculosis
VDGPDE

SEQ ID NO: 1435941 - protein, 9 aa, Mycobacterium tuberculosis
VDGSDYPNL

SEQ ID NO: 1435942 - protein, 14 aa, Mycobacterium tuberculosis
VDHATASVNPPPEV

SEQ ID NO: 1435943 - protein, 5 aa, Mycobacterium tuberculosis
VDPYN

SEQ ID NO: 1435944 - protein, 5 aa, Mycobacterium tuberculosis
VDQQY

SEQ ID NO: 1435945 - protein, 8 aa, Mycobacterium tuberculosis
VDTDRGGK

SEQ ID NO: 1435946 - protein, 6 aa, Mycobacterium tuberculosis
VDTGTR

SEQ ID NO: 1435947 - protein, 4 aa, Mycobacterium tuberculosis
VDVD

SEQ ID NO: 1435948 - protein, 12 aa, Mycobacterium tuberculosis
VDVDPTGATVTD

SEQ ID NO: 1435949 - protein, 4 aa, Mycobacterium tuberculosis
VEAG

SEQ ID NO: 1435950 - protein, 8 aa, Mycobacterium tuberculosis
VEDGTGEL

SEQ ID NO: 1435951 - protein, 11 aa, Mycobacterium tuberculosis
VEEASDTAAAN

SEQ ID NO: 1435952 - protein, 7 aa, Mycobacterium tuberculosis
VEHRDRQ

SEQ ID NO: 1435953 - protein, 6 aa, Mycobacterium tuberculosis
VEPDPG

SEQ ID NO: 1435954 - protein, 6 aa, Mycobacterium tuberculosis
VEPGGA

SEQ ID NO: 1435955 - protein, 4 aa, Mycobacterium tuberculosis
VERA

SEQ ID NO: 1435956 - protein, 5 aa, Mycobacterium tuberculosis
VESDE

SEQ ID NO: 1435957 - protein, 11 aa, Mycobacterium tuberculosis
VETHPPNRHES

SEQ ID NO: 1435958 - protein, 9 aa, Mycobacterium tuberculosis
VGAGYGPGH

SEQ ID NO: 1435959 - protein, 100 aa, Mycobacterium tuberculosis; identical to SEQ ID NO: 233012

SEQ ID NO: 1435960 - protein, 5 aa, Mycobacterium tuberculosis
VGAPL

SEQ ID NO: 1435961 - protein, 14 aa, Mycobacterium tuberculosis
VGAQSTSVASASDV

SEQ ID NO: 1435962 - protein, 19 aa, Mycobacterium tuberculosis
VGASGATAGLRKTHDGHHG

SEQ ID NO: 1435963 - protein, 7 aa, Mycobacterium tuberculosis
VGDARAT

SEQ ID NO: 1435964 - protein, 12 aa, Mycobacterium tuberculosis
VGGAGGAGGNAS

SEQ ID NO: 1435965 - protein, 12 aa, Mycobacterium tuberculosis
VGGGDPAGNPTL

SEQ ID NO: 1435966 - protein, 16 aa, Mycobacterium tuberculosis
VGGGLSVGQRGGRVHR

SEQ ID NO: 1435967 - protein, 6 aa, Mycobacterium tuberculosis
VGGGQI

SEQ ID NO: 1435968 - protein, 6 aa, Mycobacterium tuberculosis
VGGPST

SEQ ID NO: 1435969 - protein, 13 aa, Mycobacterium tuberculosis
VGGTGGVGGATGL

SEQ ID NO: 1435970 - protein, 204 aa, Mycobacterium tuberculosis
VGNGGAGGNGANGAAGTNASDSGAVGGKGNSGGNGGQGGAGGDGGTLAGNGGAGGTGGRGADGGLGGSGAEGANATTAGERGQDGGKGGNGGVGGTGGNAVAPGANGGHGGNGGNPGFSGAGGLGGLSGDGVTRAAQGATPDFADTGGKGGNGGNGANAVAPGGTGASGGAGGNAGAGGKGGENIIGDGGGGNGGAGGKGGAGT

SEQ ID NO: 1435971 - protein, 8 aa, Mycobacterium tuberculosis
VGPAPGQY

SEQ ID NO: 1435972 - protein, 10 aa, Mycobacterium tuberculosis
VGPPPPSAVG

SEQ ID NO: 1435973 - protein, 11 aa, Mycobacterium tuberculosis
VGQAPAAAHPG

SEQ ID NO: 1435974 - protein, 4 aa, Mycobacterium tuberculosis
VGRE

SEQ ID NO: 1435975 - protein, 6 aa, Mycobacterium tuberculosis
VGRPYP

SEQ ID NO: 1435976 - protein, 11 aa, Mycobacterium tuberculosis
VGSGDAAISTI

SEQ ID NO: 1435977 - protein, 25 aa, Mycobacterium tuberculosis
VGSYNTGSFNAGNTNTGGFNPGNVN

SEQ ID NO: 1435978 - protein, 4 aa, Mycobacterium tuberculosis
VGTF

SEQ ID NO: 1435979 - protein, 6 aa, Mycobacterium tuberculosis
VGTGAH

SEQ ID NO: 1435980 - protein, 18 aa, Mycobacterium tuberculosis
VGTRVQHGDAETAPLPNP

SEQ ID NO: 1435981 - protein, 6 aa, Mycobacterium tuberculosis
VHRPTD

SEQ ID NO: 1435982 - protein, 4 aa, Mycobacterium tuberculosis
VINR

SEQ ID NO: 1435983 - protein, 12 aa, Mycobacterium tuberculosis
VKAHDEDSVAGI

SEQ ID NO: 1435984 - protein, 9 aa, Mycobacterium tuberculosis
VKPTSVPAF

SEQ ID NO: 1435985 - protein, 23 aa, Mycobacterium tuberculosis
VLPPPTPSGPGPFGLPIPNPNYH

SEQ ID NO: 1435986 - protein, 217 aa, Mycobacterium tuberculosis; identical to SEQ ID NO: 193472

SEQ ID NO: 1435987 - protein, 93 aa, Mycobacterium tuberculosis; identical to SEQ ID NO: 191030

SEQ ID NO: 1435988 - protein, 12 aa, Mycobacterium tuberculosis
VNPAEGSPGPGT

SEQ ID NO: 1435989 - protein, 6 aa, Mycobacterium tuberculosis
VNPGAR

SEQ ID NO: 1435990 - protein, 10 aa, Mycobacterium tuberculosis
VNQDGRSNGL

SEQ ID NO: 1435991 - protein, 11 aa, Mycobacterium tuberculosis
VNSDAQRSDAI

SEQ ID NO: 1435992 - protein, 16 aa, Mycobacterium tuberculosis
VNSYASAEAANASPLQ

SEQ ID NO: 1435993 - protein, 10 aa, Mycobacterium tuberculosis
VPATKGNTRR

SEQ ID NO: 1435994 - protein, 8 aa, Mycobacterium tuberculosis
VPAYSGAQ

SEQ ID NO: 1435995 - protein, 6 aa, Mycobacterium tuberculosis
VPGADA

SEQ ID NO: 1435996 - protein, 6 aa, Mycobacterium tuberculosis
VPGAGD

SEQ ID NO: 1435997 - protein, 6 aa, Mycobacterium tuberculosis
VPGAPK

SEQ ID NO: 1435998 - protein, 7 aa, Mycobacterium tuberculosis
VPGAPTY

SEQ ID NO: 1435999 - protein, 7 aa, Mycobacterium tuberculosis
VPGFTGS

SEQ ID NO: 1436000 - protein, 9 aa, Mycobacterium tuberculosis
VPGPNGETW

SEQ ID NO: 1436001 - protein, 15 aa, Mycobacterium tuberculosis
VPGYHAPPDRTAGVA

SEQ ID NO: 1436002 - protein, 4 aa, Mycobacterium tuberculosis
VPHQ

SEQ ID NO: 1436003 - protein, 13 aa, Mycobacterium tuberculosis
VPIPPPPPGPDVI

SEQ ID NO: 1436004 - protein, 12 aa, Mycobacterium tuberculosis
VPPAPASKKVAR

SEQ ID NO: 1436005 - protein, 12 aa, Mycobacterium tuberculosis
VPPSWAAATPAI

SEQ ID NO: 1436006 - protein, 9 aa, Mycobacterium tuberculosis
VPRDYDPAY

SEQ ID NO: 1436007 - protein, 5 aa, Mycobacterium tuberculosis
VPSGS

SEQ ID NO: 1436008 - protein, 17 aa, Mycobacterium tuberculosis
VPSTPGRVTDTAEGAKA

SEQ ID NO: 1436009 - protein, 10 aa, Mycobacterium tuberculosis
VPTARSDAPL

SEQ ID NO: 1436010 - protein, 7 aa, Mycobacterium tuberculosis
VQNASGA

SEQ ID NO: 1436011 - protein, 6 aa, Mycobacterium tuberculosis
VQPELR

SEQ ID NO: 1436012 - protein, 12 aa, Mycobacterium tuberculosis
VQPPEPENFDPE

SEQ ID NO: 1436013 - protein, 12 aa, Mycobacterium tuberculosis
VRSIPDSVPPPR

SEQ ID NO: 1436014 - protein, 20 aa, Mycobacterium tuberculosis
VRSTNRAGGLEGGMTNGQPL

SEQ ID NO: 1436015 - protein, 12 aa, Mycobacterium tuberculosis
VRTPAGGGDAHN

SEQ ID NO: 1436016 - protein, 8 aa, Mycobacterium tuberculosis
VSADNPVE

SEQ ID NO: 1436017 - protein, 13 aa, Mycobacterium tuberculosis
VSARESHDGEGRI

SEQ ID NO: 1436018 - protein, 4 aa, Mycobacterium tuberculosis
VSAS

SEQ ID NO: 1436019 - protein, 9 aa, Mycobacterium tuberculosis
VSDGGLRAG

SEQ ID NO: 1436020 - protein, 4 aa, Mycobacterium tuberculosis
VSGG

SEQ ID NO: 1436021 - protein, 8 aa, Mycobacterium tuberculosis
VSGGAPLG

SEQ ID NO: 1436022 - protein, 8 aa, Mycobacterium tuberculosis
VSGSARTA

SEQ ID NO: 1436023 - protein, 16 aa, Mycobacterium tuberculosis
VSGVDDAGVERVKVTS

SEQ ID NO: 1436024 - protein, 5 aa, Mycobacterium tuberculosis
VSHKP

SEQ ID NO: 1436025 - protein, 7 aa, Mycobacterium tuberculosis
VSLPPGT

SEQ ID NO: 1436026 - protein, 5 aa, Mycobacterium tuberculosis
VSNDA

SEQ ID NO: 1436027 - protein, 5 aa, Mycobacterium tuberculosis
VSNDI

SEQ ID NO: 1436028 - protein, 15 aa, Mycobacterium tuberculosis
VSSPNSAPFADPGNP

SEQ ID NO: 1436029 - protein, 19 aa, Mycobacterium tuberculosis
VSTPARALSKPGDRESPDA

SEQ ID NO: 1436030 - protein, 8 aa, Mycobacterium tuberculosis
VSTRSQIS

SEQ ID NO: 1436031 - protein, 10 aa, Mycobacterium tuberculosis
VSTSTTELQT

SEQ ID NO: 1436032 - protein, 9 aa, Mycobacterium tuberculosis
VTAGSTALT

SEQ ID NO: 1436033 - protein, 12 aa, Mycobacterium tuberculosis
VTDDPADPSTIV

SEQ ID NO: 1436034 - protein, 8 aa, Mycobacterium tuberculosis
VTDGQTID

SEQ ID NO: 1436035 - protein, 7 aa, Mycobacterium tuberculosis
VTDSGSG

SEQ ID NO: 1436036 - protein, 4 aa, Mycobacterium tuberculosis
VTEQ

SEQ ID NO: 1436037 - protein, 5 aa, Mycobacterium tuberculosis
VTGED

SEQ ID NO: 1436038 - protein, 11 aa, Mycobacterium tuberculosis
VTGEPVAPSSL

SEQ ID NO: 1436039 - protein, 4 aa, Mycobacterium tuberculosis
VTKG

SEQ ID NO: 1436040 - protein, 4 aa, Mycobacterium tuberculosis
VTPV

SEQ ID NO: 1436041 - protein, 8 aa, Mycobacterium tuberculosis
VTRPGQYE

SEQ ID NO: 1436042 - protein, 7 aa, Mycobacterium tuberculosis
VTTDAGD

SEQ ID NO: 1436043 - protein, 7 aa, Mycobacterium tuberculosis
VTTSTGK

SEQ ID NO: 1436044 - protein, 4 aa, Mycobacterium tuberculosis
VVGE

SEQ ID NO: 1436045 - protein, 6 aa, Mycobacterium tuberculosis
VVPPEE

SEQ ID NO: 1436046 - protein, 5 aa, Mycobacterium tuberculosis
VVTDT

SEQ ID NO: 1436047 - protein, 11 aa, Mycobacterium tuberculosis
VVTGGTENCSI

SEQ ID NO: 1436048 - protein, 5 aa, Mycobacterium tuberculosis
WASAA

SEQ ID NO: 1436049 - protein, 7 aa, Mycobacterium tuberculosis
WDSSTDT

SEQ ID NO: 1436050 - protein, 9 aa, Mycobacterium tuberculosis
WEPSADGEW

SEQ ID NO: 1436051 - protein, 9 aa, Mycobacterium tuberculosis
WKPPHPLSD

SEQ ID NO: 1436052 - protein, 17 aa, Mycobacterium tuberculosis
WPADPSQHHRIAESRAC

SEQ ID NO: 1436053 - protein, 11 aa, Mycobacterium tuberculosis
WPGPSFPSYGS

SEQ ID NO: 1436054 - protein, 4 aa, Mycobacterium tuberculosis
WQNG

SEQ ID NO: 1436055 - protein, 23 aa, Mycobacterium tuberculosis
WQNTGSEGAAPAGVPGPEAGAQL

SEQ ID NO: 1436056 - protein, 5 aa, Mycobacterium tuberculosis
WQPGD

SEQ ID NO: 1436057 - protein, 4 aa, Mycobacterium tuberculosis
WSGY

SEQ ID NO: 1436058 - protein, 5 aa, Mycobacterium tuberculosis
WSPGV

SEQ ID NO: 1436059 - protein, 9 aa, Mycobacterium tuberculosis
WSTDPRSRV

SEQ ID NO: 1436060 - protein, 6 aa, Mycobacterium tuberculosis
WTGAGG

SEQ ID NO: 1436061 - protein, 6 aa, Mycobacterium tuberculosis
WTGGRG

SEQ ID NO: 1436062 - protein, 7 aa, Mycobacterium tuberculosis
WTPEGRL

SEQ ID NO: 1436063 - protein, 6 aa, Mycobacterium tuberculosis
YAERAS

SEQ ID NO: 1436064 - protein, 8 aa, Mycobacterium tuberculosis
YAGPGSAS

SEQ ID NO: 1436065 - protein, 7 aa, Mycobacterium tuberculosis
YAGRAGD

SEQ ID NO: 1436066 - protein, 10 aa, Mycobacterium tuberculosis
YAPERARRSD

SEQ ID NO: 1436067 - protein, 4 aa, Mycobacterium tuberculosis
YASK

SEQ ID NO: 1436068 - protein, 8 aa, Mycobacterium tuberculosis
YDATTGRV

SEQ ID NO: 1436069 - protein, 20 aa, Mycobacterium tuberculosis
YDDEYYDDRAPSRGYARPRF

SEQ ID NO: 1436070 - protein, 5 aa, Mycobacterium tuberculosis
YDPAN

SEQ ID NO: 1436071 - protein, 10 aa, Mycobacterium tuberculosis
YEDRNSQHRL

SEQ ID NO: 1436072 - protein, 6 aa, Mycobacterium tuberculosis
YESRVG

SEQ ID NO: 1436073 - protein, 4 aa, Mycobacterium tuberculosis
YGEK

SEQ ID NO: 1436074 - protein, 5 aa, Mycobacterium tuberculosis
YGGPD

SEQ ID NO: 1436075 - protein, 18 aa, Mycobacterium tuberculosis
YGGQLSGELEGYGLTGST

SEQ ID NO: 1436076 - protein, 10 aa, Mycobacterium tuberculosis
YGGTEIKYNG

SEQ ID NO: 1436077 - protein, 5 aa, Mycobacterium tuberculosis
YGKTE

SEQ ID NO: 1436078 - protein, 12 aa, Mycobacterium tuberculosis
YGLGKGQGESPC

SEQ ID NO: 1436079 - protein, 5 aa, Mycobacterium tuberculosis
YGMTG

SEQ ID NO: 1436080 - protein, 6 aa, Mycobacterium tuberculosis
YGNEAA

SEQ ID NO: 1436081 - protein, 7 aa, Mycobacterium tuberculosis
YGNEAAV

SEQ ID NO: 1436082 - protein, 5 aa, Mycobacterium tuberculosis
YGPDR

SEQ ID NO: 1436083 - protein, 6 aa, Mycobacterium tuberculosis
YGRRSR

SEQ ID NO: 1436084 - protein, 5 aa, Mycobacterium tuberculosis
YGTTA

SEQ ID NO: 1436085 - protein, 13 aa, Mycobacterium tuberculosis
YGVPVNSPNGYRT

SEQ ID NO: 1436086 - protein, 6 aa, Mycobacterium tuberculosis
YHNKTL

SEQ ID NO: 1436087 - protein, 13 aa, Mycobacterium tuberculosis
YKMPGGTPSSPGL

SEQ ID NO: 1436088 - protein, 12 aa, Mycobacterium tuberculosis
YLNGDSRASGWI

SEQ ID NO: 1436089 - protein, 8 aa, Mycobacterium tuberculosis
YLPDTATA

SEQ ID NO: 1436090 - protein, 11 aa, Mycobacterium tuberculosis
YNAERQRRGGE

SEQ ID NO: 1436091 - protein, 8 aa, Mycobacterium tuberculosis
YPGGAGFA

SEQ ID NO: 1436092 - protein, 12 aa, Mycobacterium tuberculosis
YPLPSNGDLTPW

SEQ ID NO: 1436093 - protein, 5 aa, Mycobacterium tuberculosis
YPPRL

SEQ ID NO: 1436094 - protein, 7 aa, Mycobacterium tuberculosis
YPRDAER

SEQ ID NO: 1436095 - protein, 5 aa, Mycobacterium tuberculosis
YQPTL

SEQ ID NO: 1436096 - protein, 7 aa, Mycobacterium tuberculosis
YRAGSSA

SEQ ID NO: 1436097 - protein, 10 aa, Mycobacterium tuberculosis
YRDANATANR

SEQ ID NO: 1436098 - protein, 7 aa, Mycobacterium tuberculosis
YRNGERG

SEQ ID NO: 1436099 - protein, 38 aa, Mycobacterium tuberculosis
YRRSRDGCDWGSRGDRGSRRDRGSRGDRGSRRDRGSRC

SEQ ID NO: 1436100 - protein, 6 aa, Mycobacterium tuberculosis
YRTGIG

SEQ ID NO: 1436101 - protein, 8 aa, Mycobacterium tuberculosis
YSKDGQIT

SEQ ID NO: 1436102 - protein, 7 aa, Mycobacterium tuberculosis
YSTGNGV

SEQ ID NO: 1436103 - protein, 12 aa, Mycobacterium tuberculosis
YTGGPDPLAPPV

SEQ ID NO: 1436104 - protein, 8 aa, Mycobacterium tuberculosis
YTGPGAGS

SEQ ID NO: 1436105 - protein, 5 aa, Mycobacterium tuberculosis
YTKEH

SEQ ID NO: 1436106 - protein, 5 aa, Mycobacterium tuberculosis
YVPDD

SEQ ID NO: 1436107 - protein, 9 aa, Mycobacterium tuberculosis
AAARRERTQ

SEQ ID NO: 1436108 - protein, 14 aa, Mycobacterium tuberculosis
AAASLQPLDPPDGF

SEQ ID NO: 1436109 - protein, 11 aa, Mycobacterium tuberculosis
AADAGFTAPAT

SEQ ID NO: 1436110 - protein, 11 aa, Mycobacterium tuberculosis
AADGVGGHRGR

SEQ ID NO: 1436111 - protein, 7 aa, Mycobacterium tuberculosis
AAEDLPP

SEQ ID NO: 1436112 - protein, 11 aa, Mycobacterium tuberculosis
AAERARNDRRA

SEQ ID NO: 1436113 - protein, 6 aa, Mycobacterium tuberculosis
AAERDS

SEQ ID NO: 1436114 - protein, 14 aa, Mycobacterium tuberculosis
AAERERPQLGGEDR

SEQ ID NO: 1436115 - protein, 17 aa, Mycobacterium tuberculosis
AAGAGRRGQRTDPQPAV

SEQ ID NO: 1436116 - protein, 12 aa, Mycobacterium tuberculosis
AAGDLDKPFATE

SEQ ID NO: 1436117 - protein, 40 aa, Mycobacterium tuberculosis; identical to SEQ ID NO: 193551

SEQ ID NO: 1436118 - protein, 16 aa, Mycobacterium tuberculosis
AAGQLRQGVGRSSAHY

SEQ ID NO: 1436119 - protein, 8 aa, Mycobacterium tuberculosis
AAHSDRAA

SEQ ID NO: 1436120 - protein, 22 aa, Mycobacterium tuberculosis
AALASSQTSRTPWCRSLPLNWR

SEQ ID NO: 1436121 - protein, 5 aa, Mycobacterium tuberculosis
AAQAA

SEQ ID NO: 1436122 - protein, 34 aa, Mycobacterium tuberculosis
AARASGQDDAQGRGREHERDPRDLSGRRAPIAQP

SEQ ID NO: 1436123 - protein, 8 aa, Mycobacterium tuberculosis
AARPSPVA

SEQ ID NO: 1436124 - protein, 6 aa, Mycobacterium tuberculosis
AARQAG

SEQ ID NO: 1436125 - protein, 15 aa, Mycobacterium tuberculosis
AARRDPGAVAARPRR

SEQ ID NO: 1436126 - protein, 8 aa, Mycobacterium tuberculosis
AARTAEQL

SEQ ID NO: 1436127 - protein, 35 aa, Mycobacterium tuberculosis
AASGQNGSQGAGGDGGAGGNGGTPGNGGHGAAGAL

SEQ ID NO: 1436128 - protein, 11 aa, Mycobacterium tuberculosis
AASRSTRRSPI

SEQ ID NO: 1436129 - protein, 8 aa, Mycobacterium tuberculosis
AATANPLA

SEQ ID NO: 1436130 - protein, 20 aa, Mycobacterium tuberculosis
AATQKPPGDSFKDGSYGPSR

SEQ ID NO: 1436131 - protein, 16 aa, Mycobacterium tuberculosis
AATRALSAAAQAKAAA

SEQ ID NO: 1436132 - protein, 7 aa, Mycobacterium tuberculosis
AATRPNL

SEQ ID NO: 1436133 - protein, 14 aa, Mycobacterium tuberculosis
AATSSTTCAPRAGT

SEQ ID NO: 1436134 - protein, 7 aa, Mycobacterium tuberculosis
AAYGGDP

SEQ ID NO: 1436135 - protein, 12 aa, Mycobacterium tuberculosis
AAYRDAGTARRA

SEQ ID NO: 1436136 - protein, 6 aa, Mycobacterium tuberculosis
ACGGDA

SEQ ID NO: 1436137 - protein, 26 aa, Mycobacterium tuberculosis
ACSQPAPRAIGASSRHASAGPVRPAP

SEQ ID NO: 1436138 - protein, 12 aa, Mycobacterium tuberculosis
ADARHTREGLQG

SEQ ID NO: 1436139 - protein, 7 aa, Mycobacterium tuberculosis
ADATAAA

SEQ ID NO: 1436140 - protein, 15 aa, Mycobacterium tuberculosis
ADDDELFTTGVSWNV

SEQ ID NO: 1436141 - protein, 8 aa, Mycobacterium tuberculosis
ADGSEYRG

SEQ ID NO: 1436142 - protein, 7 aa, Mycobacterium tuberculosis
ADIAPRK

SEQ ID NO: 1436143 - protein, 13 aa, Mycobacterium tuberculosis
ADPAWGPAARPAV

SEQ ID NO: 1436144 - protein, 19 aa, Mycobacterium tuberculosis
ADPGAGNLADRVGDNRARP

SEQ ID NO: 1436145 - protein, 6 aa, Mycobacterium tuberculosis
ADPQGL

SEQ ID NO: 1436146 - protein, 8 aa, Mycobacterium tuberculosis
ADQAPDAV

SEQ ID NO: 1436147 - protein, 14 aa, Mycobacterium tuberculosis
ADQARAAAAGDDET

SEQ ID NO: 1436148 - protein, 5 aa, Mycobacterium tuberculosis
ADQPY

SEQ ID NO: 1436149 - protein, 6 aa, Mycobacterium tuberculosis
ADRAGR

SEQ ID NO: 1436150 - protein, 5 aa, Mycobacterium tuberculosis
ADRGA

SEQ ID NO: 1436151 - protein, 18 aa, Mycobacterium tuberculosis
ADRTGAGAVSATGGFPER

SEQ ID NO: 1436152 - protein, 7 aa, Mycobacterium tuberculosis
ADTGLDA

SEQ ID NO: 1436153 - protein, 10 aa, Mycobacterium tuberculosis
ADTPPDPAAA

SEQ ID NO: 1436154 - protein, 6 aa, Mycobacterium tuberculosis
ADTTGG

SEQ ID NO: 1436155 - protein, 9 aa, Mycobacterium tuberculosis
ADTWRQTEP

SEQ ID NO: 1436156 - protein, 9 aa, Mycobacterium tuberculosis
ADVDPGPAL

SEQ ID NO: 1436157 - protein, 12 aa, Mycobacterium tuberculosis
AEEIAADGTPAH

SEQ ID NO: 1436158 - protein, 17 aa, Mycobacterium tuberculosis
AEGNDRKNVRSRGEAEQ

SEQ ID NO: 1436159 - protein, 4 aa, Mycobacterium tuberculosis
AELD

SEQ ID NO: 1436160 - protein, 5 aa, Mycobacterium tuberculosis
AEPAT

SEQ ID NO: 1436161 - protein, 10 aa, Mycobacterium tuberculosis
AEPDSSDRDI

SEQ ID NO: 1436162 - protein, 5 aa, Mycobacterium tuberculosis
AEPDV

SEQ ID NO: 1436163 - protein, 4 aa, Mycobacterium tuberculosis
AEQG

SEQ ID NO: 1436164 - protein, 5 aa, Mycobacterium tuberculosis
AETDP

SEQ ID NO: 1436165 - protein, 6 aa, Mycobacterium tuberculosis
AGADEV

SEQ ID NO: 1436166 - protein, 8 aa, Mycobacterium tuberculosis
AGASGLTG

SEQ ID NO: 1436167 - protein, 6 aa, Mycobacterium tuberculosis
AGATVD

SEQ ID NO: 1436168 - protein, 4 aa, Mycobacterium tuberculosis
AGCP

SEQ ID NO: 1436169 - protein, 70 aa, Mycobacterium tuberculosis; identical to SEQ ID NO: 168233

SEQ ID NO: 1436170 - protein, 24 aa, Mycobacterium tuberculosis
AGGAGGSGGGGSVAGDGGAGGNAG

SEQ ID NO: 1436171 - protein, 53 aa, Mycobacterium tuberculosis
AGGDGGRGGFGGDGLDASSGGNGGDGGHGGDGFRTAGAGGRGGDGGKGADPGG

SEQ ID NO: 1436172 - protein, 74 aa, Mycobacterium tuberculosis; identical to SEQ ID NO: 168256

SEQ ID NO: 1436173 - protein, 5 aa, Mycobacterium tuberculosis
AGGNS

SEQ ID NO: 1436174 - protein, 71 aa, Mycobacterium tuberculosis; identical to SEQ ID NO: 168282

SEQ ID NO: 1436175 - protein, 15 aa, Mycobacterium tuberculosis
AGKPGTSSGHRSVPH

SEQ ID NO: 1436176 - protein, 5 aa, Mycobacterium tuberculosis
AGLSA

SEQ ID NO: 1436177 - protein, 4 aa, Mycobacterium tuberculosis
AGNF

SEQ ID NO: 1436178 - protein, 6 aa, Mycobacterium tuberculosis
AGPELE

SEQ ID NO: 1436179 - protein, 24 aa, Mycobacterium tuberculosis
AGQGRRPPAGRPAGNAARNGKGAQ

SEQ ID NO: 1436180 - protein, 6 aa, Mycobacterium tuberculosis
AGQIKR

SEQ ID NO: 1436181 - protein, 7 aa, Mycobacterium tuberculosis
AGRGKCD

SEQ ID NO: 1436182 - protein, 18 aa, Mycobacterium tuberculosis
AGRQPAPGQHGVALRRRH

SEQ ID NO: 1436183 - protein, 10 aa, Mycobacterium tuberculosis
AGRSGRRGQG

SEQ ID NO: 1436184 - protein, 10 aa, Mycobacterium tuberculosis
AGSRLGYQES

SEQ ID NO: 1436185 - protein, 9 aa, Mycobacterium tuberculosis
AGSTAEGQR

SEQ ID NO: 1436186 - protein, 24 aa, Mycobacterium tuberculosis
AGTDRRKADSDDGHGASTWDPDTP

SEQ ID NO: 1436187 - protein, 129 aa, Mycobacterium tuberculosis; identical to SEQ ID NO: 168580

SEQ ID NO: 1436188 - protein, 11 aa, Mycobacterium tuberculosis
AGVPPPPGSWE

SEQ ID NO: 1436189 - protein, 6 aa, Mycobacterium tuberculosis
AHPGVR

SEQ ID NO: 1436190 - protein, 12 aa, Mycobacterium tuberculosis
AIETSRRTSRPL

SEQ ID NO: 1436191 - protein, 13 aa, Mycobacterium tuberculosis
AIRSQQSAYASHP

SEQ ID NO: 1436192 - protein, 6 aa, Mycobacterium tuberculosis
AKAGVD

SEQ ID NO: 1436193 - protein, 13 aa, Mycobacterium tuberculosis
AKGEPTPQDGYAG

SEQ ID NO: 1436194 - protein, 15 aa, Mycobacterium tuberculosis
AKSDLERQESGEKTG

SEQ ID NO: 1436195 - protein, 25 aa, Mycobacterium tuberculosis
AKSQGERPPGGNAEANREKGEGWGG

SEQ ID NO: 1436196 - protein, 8 aa, Mycobacterium tuberculosis
AKYGVTTE

SEQ ID NO: 1436197 - protein, 5 aa, Mycobacterium tuberculosis
ALPAG

SEQ ID NO: 1436198 - protein, 9 aa, Mycobacterium tuberculosis
ALPDNSDGI

SEQ ID NO: 1436199 - protein, 6 aa, Mycobacterium tuberculosis
ALRGDN

SEQ ID NO: 1436200 - protein, 11 aa, Mycobacterium tuberculosis
ALSRSTAGDRG

SEQ ID NO: 1436201 - protein, 56 aa, Mycobacterium tuberculosis; identical to SEQ ID NO: 229048

SEQ ID NO: 1436202 - protein, 33 aa, Mycobacterium tuberculosis
ANDASIGRQVPTGRGGTKNCQASGTSTNSGYPE

SEQ ID NO: 1436203 - protein, 9 aa, Mycobacterium tuberculosis
ANGALTGAL

SEQ ID NO: 1436204 - protein, 14 aa, Mycobacterium tuberculosis
ANGGVGGSGGNATL

SEQ ID NO: 1436205 - protein, 4 aa, Mycobacterium tuberculosis
ANKD

SEQ ID NO: 1436206 - protein, 8 aa, Mycobacterium tuberculosis
ANNVGNGN

SEQ ID NO: 1436207 - protein, 6 aa, Mycobacterium tuberculosis
ANPGLD

SEQ ID NO: 1436208 - protein, 5 aa, Mycobacterium tuberculosis
ANPLA

SEQ ID NO: 1436209 - protein, 6 aa, Mycobacterium tuberculosis
ANTPGA

SEQ ID NO: 1436210 - protein, 16 aa, Mycobacterium tuberculosis
APDDVEITDSSAAAEY

SEQ ID NO: 1436211 - protein, 14 aa, Mycobacterium tuberculosis
APGFGNDTTAPSSG

SEQ ID NO: 1436212 - protein, 7 aa, Mycobacterium tuberculosis
APHEEPD

SEQ ID NO: 1436213 - protein, 6 aa, Mycobacterium tuberculosis
APHRDV

SEQ ID NO: 1436214 - protein, 11 aa, Mycobacterium tuberculosis
APHSPAEAQGG

SEQ ID NO: 1436215 - protein, 10 aa, Mycobacterium tuberculosis
APMANSLPGQ

SEQ ID NO: 1436216 - protein, 9 aa, Mycobacterium tuberculosis
APNAPTRQV

SEQ ID NO: 1436217 - protein, 9 aa, Mycobacterium tuberculosis
APPAEIAPG

SEQ ID NO: 1436218 - protein, 6 aa, Mycobacterium tuberculosis
APPAQL

SEQ ID NO: 1436219 - protein, 8 aa, Mycobacterium tuberculosis
APPHGNAL

SEQ ID NO: 1436220 - protein, 18 aa, Mycobacterium tuberculosis
APPIPSPQPLKSGDTIGL

SEQ ID NO: 1436221 - protein, 5 aa, Mycobacterium tuberculosis
APRIG

SEQ ID NO: 1436222 - protein, 10 aa, Mycobacterium tuberculosis
APRLPDGTPF

SEQ ID NO: 1436223 - protein, 8 aa, Mycobacterium tuberculosis
APRSASVR

SEQ ID NO: 1436224 - protein, 8 aa, Mycobacterium tuberculosis
APVATAVT

SEQ ID NO: 1436225 - protein, 5 aa, Mycobacterium tuberculosis
AQAPK

SEQ ID NO: 1436226 - protein, 8 aa, Mycobacterium tuberculosis
AQGPELAP

SEQ ID NO: 1436227 - protein, 6 aa, Mycobacterium tuberculosis
AQPYGG

SEQ ID NO: 1436228 - protein, 7 aa, Mycobacterium tuberculosis
AQTRNGD

SEQ ID NO: 1436229 - protein, 8 aa, Mycobacterium tuberculosis
AQTRNGDL

SEQ ID NO: 1436230 - protein, 7 aa, Mycobacterium tuberculosis
ARANTEI

SEQ ID NO: 1436231 - protein, 6 aa, Mycobacterium tuberculosis
ARDRET

SEQ ID NO: 1436232 - protein, 11 aa, Mycobacterium tuberculosis
AREPRGDGGFG

SEQ ID NO: 1436233 - protein, 15 aa, Mycobacterium tuberculosis
ARGESGEQLSDSEIR

SEQ ID NO: 1436234 - protein, 16 aa, Mycobacterium tuberculosis
ARGTAPSSPLNATVSR

SEQ ID NO: 1436235 - protein, 21 aa, Mycobacterium tuberculosis
ARHSETEPLQSINGAVAELRA

SEQ ID NO: 1436236 - protein, 18 aa, Mycobacterium tuberculosis
ARQALADRRAANCCVLRG

SEQ ID NO: 1436237 - protein, 9 aa, Mycobacterium tuberculosis
ARQPGDRPS

SEQ ID NO: 1436238 - protein, 48 aa, Mycobacterium tuberculosis
ARRAGRLGAAGRAQGGRQPAGSRQRAAGPTRRGGAAIGANDRSRHPGH

SEQ ID NO: 1436239 - protein, 8 aa, Mycobacterium tuberculosis
ARRNEAAS

SEQ ID NO: 1436240 - protein, 7 aa, Mycobacterium tuberculosis
ARSPIGR

SEQ ID NO: 1436241 - protein, 6 aa, Mycobacterium tuberculosis
ARSSAS

SEQ ID NO: 1436242 - protein, 4 aa, Mycobacterium tuberculosis
ARTD

SEQ ID NO: 1436243 - protein, 6 aa, Mycobacterium tuberculosis
ARVPGA

SEQ ID NO: 1436244 - protein, 5 aa, Mycobacterium tuberculosis
ASAGI

SEQ ID NO: 1436245 - protein, 31 aa, Mycobacterium tuberculosis
ASAPGAAGSPGGNGGNGGPGGAGGEGGAGGL

SEQ ID NO: 1436246 - protein, 11 aa, Mycobacterium tuberculosis
ASENPAELAPG

SEQ ID NO: 1436247 - protein, 18 aa, Mycobacterium tuberculosis
ASKTGTAEHGTDPRHTPP

SEQ ID NO: 1436248 - protein, 6 aa, Mycobacterium tuberculosis
ASLDGE

SEQ ID NO: 1436249 - protein, 38 aa, Mycobacterium tuberculosis
ASNSSVRPLTTGGSWTPTSISSTDGGKAQGHDTHDRQI

SEQ ID NO: 1436250 - protein, 4 aa, Mycobacterium tuberculosis
ASPA

SEQ ID NO: 1436251 - protein, 15 aa, Mycobacterium tuberculosis
ASQQSRPVGSRAQLD

SEQ ID NO: 1436252 - protein, 13 aa, Mycobacterium tuberculosis
ASRAVSASLARAN

SEQ ID NO: 1436253 - protein, 7 aa, Mycobacterium tuberculosis
ASRGKWD

SEQ ID NO: 1436254 - protein, 7 aa, Mycobacterium tuberculosis
ASRPDNV

SEQ ID NO: 1436255 - protein, 15 aa, Mycobacterium tuberculosis
ASVSSRSVADRPNRK

SEQ ID NO: 1436256 - protein, 4 aa, Mycobacterium tuberculosis
ATAG

SEQ ID NO: 1436257 - protein, 6 aa, Mycobacterium tuberculosis
ATASAT

SEQ ID NO: 1436258 - protein, 5 aa, Mycobacterium tuberculosis
ATDYD

SEQ ID NO: 1436259 - protein, 7 aa, Mycobacterium tuberculosis
ATEGSGV

SEQ ID NO: 1436260 - protein, 10 aa, Mycobacterium tuberculosis
ATGPFPPTTF

SEQ ID NO: 1436261 - protein, 14 aa, Mycobacterium tuberculosis
ATGRESDARNELAP

SEQ ID NO: 1436262 - protein, 5 aa, Mycobacterium tuberculosis
ATGVS

SEQ ID NO: 1436263 - protein, 8 aa, Mycobacterium tuberculosis
ATKAPEVR

SEQ ID NO: 1436264 - protein, 6 aa, Mycobacterium tuberculosis
ATPEES

SEQ ID NO: 1436265 - protein, 33 aa, Mycobacterium tuberculosis
ATPNQPAASTAPPTTLQTQTSPRADGKTIHTEN

SEQ ID NO: 1436266 - protein, 7 aa, Mycobacterium tuberculosis
ATQPNTH

SEQ ID NO: 1436267 - protein, 13 aa, Mycobacterium tuberculosis
ATSPTSGRLTDTW

SEQ ID NO: 1436268 - protein, 6 aa, Mycobacterium tuberculosis
ATSRPD

SEQ ID NO: 1436269 - protein, 6 aa, Mycobacterium tuberculosis
ATTRGT

SEQ ID NO: 1436270 - protein, 11 aa, Mycobacterium tuberculosis
ATTSISPDIES

SEQ ID NO: 1436271 - protein, 8 aa, Mycobacterium tuberculosis
AVDDEPER

SEQ ID NO: 1436272 - protein, 12 aa, Mycobacterium tuberculosis
AVGPVDDDVTDL

SEQ ID NO: 1436273 - protein, 10 aa, Mycobacterium tuberculosis
AVNRPTPDRV

SEQ ID NO: 1436274 - protein, 51 aa, Mycobacterium tuberculosis
AVSPPVGDPGDATGATDATDLPQAGDLPYEPPAPNGHPNGDAPLCSGPGCP

SEQ ID NO: 1436275 - protein, 9 aa, Mycobacterium tuberculosis
AVTEGGSED

SEQ ID NO: 1436276 - protein, 10 aa, Mycobacterium tuberculosis
AYGREGENCR

SEQ ID NO: 1436277 - protein, 7 aa, Mycobacterium tuberculosis
AYNDTRR

SEQ ID NO: 1436278 - protein, 8 aa, Mycobacterium tuberculosis
AYRDGTLP

SEQ ID NO: 1436279 - protein, 7 aa, Mycobacterium tuberculosis
CDDEKPA

SEQ ID NO: 1436280 - protein, 5 aa, Mycobacterium tuberculosis
CEEAD

SEQ ID NO: 1436281 - protein, 8 aa, Mycobacterium tuberculosis
CGGGTDPD

SEQ ID NO: 1436282 - protein, 21 aa, Mycobacterium tuberculosis
CGHPSSSIASTVAPGSSRQPC

SEQ ID NO: 1436283 - protein, 4 aa, Mycobacterium tuberculosis
CPGQ

SEQ ID NO: 1436284 - protein, 5 aa, Mycobacterium tuberculosis
CPSAL

SEQ ID NO: 1436285 - protein, 8 aa, Mycobacterium tuberculosis
CQGPPTRY

SEQ ID NO: 1436286 - protein, 11 aa, Mycobacterium tuberculosis
CRGGTAPGRVA

SEQ ID NO: 1436287 - protein, 12 aa, Mycobacterium tuberculosis
CRGPGAGTRAPA

SEQ ID NO: 1436288 - protein, 13 aa, Mycobacterium tuberculosis
CRSPRSKKPRRRC

SEQ ID NO: 1436289 - protein, 4 aa, Mycobacterium tuberculosis
CTAE

SEQ ID NO: 1436290 - protein, 5 aa, Mycobacterium tuberculosis
CTAEA

SEQ ID NO: 1436291 - protein, 4 aa, Mycobacterium tuberculosis
CWSA

SEQ ID NO: 1436292 - protein, 7 aa, Mycobacterium tuberculosis
DAAPVTQ

SEQ ID NO: 1436293 - protein, 7 aa, Mycobacterium tuberculosis
DAGVQHT

SEQ ID NO: 1436294 - protein, 18 aa, Mycobacterium tuberculosis
DAPPPGDVTEAPAETPQV

SEQ ID NO: 1436295 - protein, 5 aa, Mycobacterium tuberculosis
DCGRD

SEQ ID NO: 1436296 - protein, 8 aa, Mycobacterium tuberculosis
DDARRDGD

SEQ ID NO: 1436297 - protein, 21 aa, Mycobacterium tuberculosis
DDDGSDGAAKARAYERSATQA

SEQ ID NO: 1436298 - protein, 10 aa, Mycobacterium tuberculosis
DDDPRTIAQR

SEQ ID NO: 1436299 - protein, 25 aa, Mycobacterium tuberculosis
DDERPEQAREPELRSNRSQREEELS

SEQ ID NO: 1436300 - protein, 5 aa, Mycobacterium tuberculosis
DDGPG

SEQ ID NO: 1436301 - protein, 9 aa, Mycobacterium tuberculosis
DDGPGMSQE

SEQ ID NO: 1436302 - protein, 13 aa, Mycobacterium tuberculosis
DDIPESGKMTSRS

SEQ ID NO: 1436303 - protein, 9 aa, Mycobacterium tuberculosis
DDPGATVEA

SEQ ID NO: 1436304 - protein, 4 aa, Mycobacterium tuberculosis
DEAD

SEQ ID NO: 1436305 - protein, 113 aa, Mycobacterium tuberculosis
DEEERRLTSAGDDAERSDEEERRLTSAGDDAERSDEEERRLTSAGDDAERSDEEERRLTSAGDDAERSDEEERRLTSAGDDAERSDEEERRLTSAGDDAERSDEEERRLTSAE

SEQ ID NO: 1436306 - protein, 4 aa, Mycobacterium tuberculosis
DEHR

SEQ ID NO: 1436307 - protein, 8 aa, Mycobacterium tuberculosis
DERRGDFS

SEQ ID NO: 1436308 - protein, 10 aa, Mycobacterium tuberculosis
DESESAESFE

SEQ ID NO: 1436309 - protein, 8 aa, Mycobacterium tuberculosis
DGAASGLR

SEQ ID NO: 1436310 - protein, 8 aa, Mycobacterium tuberculosis
DGAGPGSE

SEQ ID NO: 1436311 - protein, 6 aa, Mycobacterium tuberculosis
DGATGE

SEQ ID NO: 1436312 - protein, 38 aa, Mycobacterium tuberculosis
DGDAPIPADSGPPVGPEGLTPTQLASDANEERLREERA

SEQ ID NO: 1436313 - protein, 8 aa, Mycobacterium tuberculosis
DGDDGEPQ

SEQ ID NO: 1436314 - protein, 13 aa, Mycobacterium tuberculosis
DGGAGGHGGQGAI

SEQ ID NO: 1436315 - protein, 216 aa, Mycobacterium tuberculosis
DGGNGGHGGHGAASGGNGGPGGHGGNGGNGGTGANGGNGGIGGTGGAGSTGAKGVLGTNEGDGGDGGRGGNGGRGGNGGQGLTGAGGNGGTGGTPGNGGNGGNGASGDLVTSPGDGGGGGRGGDAGRGGDAGLGGSSGPGGTPGDWGTGGTGGTGGTGGQGANGGLTGGRGGTGGNGGNGNTGGTGGAGGTGGTGHNGSQPGMGGNGGAGGFGGNG

SEQ ID NO: 1436316 - protein, 8 aa, Mycobacterium tuberculosis
DGGTAADA

SEQ ID NO: 1436317 - protein, 4 aa, Mycobacterium tuberculosis
DGKA

SEQ ID NO: 1436318 - protein, 5 aa, Mycobacterium tuberculosis
DGKPG

SEQ ID NO: 1436319 - protein, 7 aa, Mycobacterium tuberculosis
DGPQHTA

SEQ ID NO: 1436320 - protein, 5 aa, Mycobacterium tuberculosis
DGSSH

SEQ ID NO: 1436321 - protein, 7 aa, Mycobacterium tuberculosis
DGTSEPF

SEQ ID NO: 1436322 - protein, 18 aa, Mycobacterium tuberculosis
DHPEPIATTPQEARARRG

SEQ ID NO: 1436323 - protein, 35 aa, Mycobacterium tuberculosis
DHTTVSAPTKPHSPTFKPEPHSAANEPKHPAARPK

SEQ ID NO: 1436324 - protein, 16 aa, Mycobacterium tuberculosis
DINTGGFNGGNVNTGF

SEQ ID NO: 1436325 - protein, 9 aa, Mycobacterium tuberculosis
DKAAPPRLR

SEQ ID NO: 1436326 - protein, 12 aa, Mycobacterium tuberculosis
DKRRLARSTTWS

SEQ ID NO: 1436327 - protein, 13 aa, Mycobacterium tuberculosis
DKVDTEIPSPAAG

SEQ ID NO: 1436328 - protein, 11 aa, Mycobacterium tuberculosis
DKVDTEIPSPV

SEQ ID NO: 1436329 - protein, 6 aa, Mycobacterium tuberculosis
DLATPE

SEQ ID NO: 1436330 - protein, 8 aa, Mycobacterium tuberculosis
DLGGPNGV

SEQ ID NO: 1436331 - protein, 4 aa, Mycobacterium tuberculosis
DLQP

SEQ ID NO: 1436332 - protein, 13 aa, Mycobacterium tuberculosis
DLRPKSLRDAMVE

SEQ ID NO: 1436333 - protein, 6 aa, Mycobacterium tuberculosis
DMPAAD

SEQ ID NO: 1436334 - protein, 11 aa, Mycobacterium tuberculosis
DNATHSDDKEI

SEQ ID NO: 1436335 - protein, 23 aa, Mycobacterium tuberculosis
DNGASRVPPVDETPAAESAEPIT

SEQ ID NO: 1436336 - protein, 14 aa, Mycobacterium tuberculosis
DNGRPVAGRLSPDG

SEQ ID NO: 1436337 - protein, 7 aa, Mycobacterium tuberculosis
DNLTGIG

SEQ ID NO: 1436338 - protein, 6 aa, Mycobacterium tuberculosis
DNPRAR

SEQ ID NO: 1436339 - protein, 5 aa, Mycobacterium tuberculosis
DNQPA

SEQ ID NO: 1436340 - protein, 13 aa, Mycobacterium tuberculosis
DPARGSEANNQRP

SEQ ID NO: 1436341 - protein, 18 aa, Mycobacterium tuberculosis
DPASGEEITAQNGRYGPY

SEQ ID NO: 1436342 - protein, 9 aa, Mycobacterium tuberculosis
DPDEDAGTA

SEQ ID NO: 1436343 - protein, 5 aa, Mycobacterium tuberculosis
DPDVE

SEQ ID NO: 1436344 - protein, 6 aa, Mycobacterium tuberculosis
DPEEVR

SEQ ID NO: 1436345 - protein, 7 aa, Mycobacterium tuberculosis
DPGADVA

SEQ ID NO: 1436346 - protein, 10 aa, Mycobacterium tuberculosis
DPGAKSARPA

SEQ ID NO: 1436347 - protein, 5 aa, Mycobacterium tuberculosis
DPGAL

SEQ ID NO: 1436348 - protein, 9 aa, Mycobacterium tuberculosis
DPGPRTSSA

SEQ ID NO: 1436349 - protein, 9 aa, Mycobacterium tuberculosis
DPLEPGGRL

SEQ ID NO: 1436350 - protein, 10 aa, Mycobacterium tuberculosis
DPRDKKTPSL

SEQ ID NO: 1436351 - protein, 9 aa, Mycobacterium tuberculosis
DPREGWPPA

SEQ ID NO: 1436352 - protein, 9 aa, Mycobacterium tuberculosis
DQGAGGEVQ

SEQ ID NO: 1436353 - protein, 20 aa, Mycobacterium tuberculosis
DQIPDQGHDGDKSVSGVTIF

SEQ ID NO: 1436354 - protein, 10 aa, Mycobacterium tuberculosis
DQLADNPGKT

SEQ ID NO: 1436355 - protein, 9 aa, Mycobacterium tuberculosis
DQSAKTGFT

SEQ ID NO: 1436356 - protein, 13 aa, Mycobacterium tuberculosis
DRAGGGYDAEPRE

SEQ ID NO: 1436357 - protein, 10 aa, Mycobacterium tuberculosis
DRGATSVTDA

SEQ ID NO: 1436358 - protein, 9 aa, Mycobacterium tuberculosis
DRPAATHRP

SEQ ID NO: 1436359 - protein, 10 aa, Mycobacterium tuberculosis
DRRGWGSGGA

SEQ ID NO: 1436360 - protein, 11 aa, Mycobacterium tuberculosis
DRSKAEAGDTG

SEQ ID NO: 1436361 - protein, 7 aa, Mycobacterium tuberculosis
DRVDPSS

SEQ ID NO: 1436362 - protein, 7 aa, Mycobacterium tuberculosis
DRYATGT

SEQ ID NO: 1436363 - protein, 18 aa, Mycobacterium tuberculosis
DSDRYGGGQGNDLDGAAP

SEQ ID NO: 1436364 - protein, 6 aa, Mycobacterium tuberculosis
DSDRYR

SEQ ID NO: 1436365 - protein, 5 aa, Mycobacterium tuberculosis
DSGIN

SEQ ID NO: 1436366 - protein, 4 aa, Mycobacterium tuberculosis
DSLA

SEQ ID NO: 1436367 - protein, 7 aa, Mycobacterium tuberculosis
DSRPSRY

SEQ ID NO: 1436368 - protein, 13 aa, Mycobacterium tuberculosis
DSSRARASGGTGL

SEQ ID NO: 1436369 - protein, 22 aa, Mycobacterium tuberculosis
DTPCPRAAGDSDPPGIATGGQW

SEQ ID NO: 1436370 - protein, 8 aa, Mycobacterium tuberculosis
DTPLAERR

SEQ ID NO: 1436371 - protein, 11 aa, Mycobacterium tuberculosis
DTVTGTASDAQ

SEQ ID NO: 1436372 - protein, 5 aa, Mycobacterium tuberculosis
DVDGI

SEQ ID NO: 1436373 - protein, 13 aa, Mycobacterium tuberculosis
DVDGPDAADGVQV

SEQ ID NO: 1436374 - protein, 13 aa, Mycobacterium tuberculosis
DVSASTGKRRPAY

SEQ ID NO: 1436375 - protein, 18 aa, Mycobacterium tuberculosis
EAAAGAGSPAGVRSCPYR

SEQ ID NO: 1436376 - protein, 6 aa, Mycobacterium tuberculosis
EAAAVN

SEQ ID NO: 1436377 - protein, 4 aa, Mycobacterium tuberculosis
EAAI

SEQ ID NO: 1436378 - protein, 13 aa, Mycobacterium tuberculosis
EAAKYGATTESSL

SEQ ID NO: 1436379 - protein, 10 aa, Mycobacterium tuberculosis
EAATKRRRGE

SEQ ID NO: 1436380 - protein, 5 aa, Mycobacterium tuberculosis
EAEYE

SEQ ID NO: 1436381 - protein, 13 aa, Mycobacterium tuberculosis
EAIGTASDKLASI

SEQ ID NO: 1436382 - protein, 12 aa, Mycobacterium tuberculosis
EAPQNGPAEGDP

SEQ ID NO: 1436383 - protein, 6 aa, Mycobacterium tuberculosis
EAPTGW

SEQ ID NO: 1436384 - protein, 13 aa, Mycobacterium tuberculosis
EAQQSANPTLPRQ

SEQ ID NO: 1436385 - protein, 5 aa, Mycobacterium tuberculosis
EARTT

SEQ ID NO: 1436386 - protein, 10 aa, Mycobacterium tuberculosis
EASLEQAQEN

SEQ ID NO: 1436387 - protein, 6 aa, Mycobacterium tuberculosis
EATGGV

SEQ ID NO: 1436388 - protein, 9 aa, Mycobacterium tuberculosis
EAVGGGEAF

SEQ ID NO: 1436389 - protein, 5 aa, Mycobacterium tuberculosis
EAYGE

SEQ ID NO: 1436390 - protein, 6 aa, Mycobacterium tuberculosis
EDPEPV

SEQ ID NO: 1436391 - protein, 6 aa, Mycobacterium tuberculosis
EDPGYA

SEQ ID NO: 1436392 - protein, 4 aa, Mycobacterium tuberculosis
EEEL

SEQ ID NO: 1436393 - protein, 8 aa, Mycobacterium tuberculosis
EFGTPRSL

SEQ ID NO: 1436394 - protein, 6 aa, Mycobacterium tuberculosis
EGAMTP

SEQ ID NO: 1436395 - protein, 6 aa, Mycobacterium tuberculosis
EGDTVE

SEQ ID NO: 1436396 - protein, 7 aa, Mycobacterium tuberculosis
EGGDIGD

SEQ ID NO: 1436397 - protein, 5 aa, Mycobacterium tuberculosis
EGRKD

SEQ ID NO: 1436398 - protein, 8 aa, Mycobacterium tuberculosis
EHPADRTA

SEQ ID NO: 1436399 - protein, 5 aa, Mycobacterium tuberculosis
EHSAG

SEQ ID NO: 1436400 - protein, 5 aa, Mycobacterium tuberculosis
EIATG

SEQ ID NO: 1436401 - protein, 8 aa, Mycobacterium tuberculosis
EINGSDMA

SEQ ID NO: 1436402 - protein, 28 aa, Mycobacterium tuberculosis
ELGQAANSFSSATAALADTAWQGPAATA

SEQ ID NO: 1436403 - protein, 14 aa, Mycobacterium tuberculosis
ELPEGVGDGCELPG

SEQ ID NO: 1436404 - protein, 7 aa, Mycobacterium tuberculosis
ELPEVPQ

SEQ ID NO: 1436405 - protein, 7 aa, Mycobacterium tuberculosis
ELPGPPV

SEQ ID NO: 1436406 - protein, 5 aa, Mycobacterium tuberculosis
ENATL

SEQ ID NO: 1436407 - protein, 20 aa, Mycobacterium tuberculosis
EPGAGSDLASLATKATRVDG

SEQ ID NO: 1436408 - protein, 4 aa, Mycobacterium tuberculosis
EPGV

SEQ ID NO: 1436409 - protein, 8 aa, Mycobacterium tuberculosis
EPHITGPR

SEQ ID NO: 1436410 - protein, 17 aa, Mycobacterium tuberculosis
EPQFEGQTKTKLGNTEV

SEQ ID NO: 1436411 - protein, 6 aa, Mycobacterium tuberculosis
EPSHAF

SEQ ID NO: 1436412 - protein, 8 aa, Mycobacterium tuberculosis
EPSLPAAL

SEQ ID NO: 1436413 - protein, 9 aa, Mycobacterium tuberculosis
EPTGRNLNA

SEQ ID NO: 1436414 - protein, 4 aa, Mycobacterium tuberculosis
EPWS

SEQ ID NO: 1436415 - protein, 7 aa, Mycobacterium tuberculosis
EQAARGL

SEQ ID NO: 1436416 - protein, 36 aa, Mycobacterium tuberculosis
EQPPVSGPGVEEPDVAGAGVEQPQVAGTGVQAAEPG

SEQ ID NO: 1436417 - protein, 5 aa, Mycobacterium tuberculosis
EQRRL

SEQ ID NO: 1436418 - protein, 6 aa, Mycobacterium tuberculosis
EQVDGR

SEQ ID NO: 1436419 - protein, 16 aa, Mycobacterium tuberculosis
ERDDPDYVIYQRLIDG

SEQ ID NO: 1436420 - protein, 4 aa, Mycobacterium tuberculosis
EREH

SEQ ID NO: 1436421 - protein, 7 aa, Mycobacterium tuberculosis
ERGAPEI

SEQ ID NO: 1436422 - protein, 7 aa, Mycobacterium tuberculosis
ERREQQN

SEQ ID NO: 1436423 - protein, 9 aa, Mycobacterium tuberculosis
ERRGRTGTG

SEQ ID NO: 1436424 - protein, 7 aa, Mycobacterium tuberculosis
ERRRTNR

SEQ ID NO: 1436425 - protein, 19 aa, Mycobacterium tuberculosis
ERRSRRSSRCGDRRPLDGA

SEQ ID NO: 1436426 - protein, 17 aa, Mycobacterium tuberculosis
ERSPSLTHKRTKRQPAI

SEQ ID NO: 1436427 - protein, 9 aa, Mycobacterium tuberculosis
ERTEDGFGQ

SEQ ID NO: 1436428 - protein, 8 aa, Mycobacterium tuberculosis
ERTGPSIR

SEQ ID NO: 1436429 - protein, 8 aa, Mycobacterium tuberculosis
ERYDSGQR

SEQ ID NO: 1436430 - protein, 25 aa, Mycobacterium tuberculosis
ESLHESGTSDRADAAAHRDAIGSYT

SEQ ID NO: 1436431 - protein, 7 aa, Mycobacterium tuberculosis
ESNMAST

SEQ ID NO: 1436432 - protein, 7 aa, Mycobacterium tuberculosis
ESTGAST

SEQ ID NO: 1436433 - protein, 13 aa, Mycobacterium tuberculosis
ESTTNAEVDDHGY

SEQ ID NO: 1436434 - protein, 9 aa, Mycobacterium tuberculosis
ETDDAVDAQ

SEQ ID NO: 1436435 - protein, 10 aa, Mycobacterium tuberculosis
ETEQVQSSHI

SEQ ID NO: 1436436 - protein, 23 aa, Mycobacterium tuberculosis
ETNPPFTPDRRPGHPGIHPREKK

SEQ ID NO: 1436437 - protein, 9 aa, Mycobacterium tuberculosis
ETQKADPLA

SEQ ID NO: 1436438 - protein, 12 aa, Mycobacterium tuberculosis
ETRDHRRRGAQR

SEQ ID NO: 1436439 - protein, 7 aa, Mycobacterium tuberculosis
ETSYPKR

SEQ ID NO: 1436440 - protein, 13 aa, Mycobacterium tuberculosis
EVDDQSRARAALR

SEQ ID NO: 1436441 - protein, 4 aa, Mycobacterium tuberculosis
EVED

SEQ ID NO: 1436442 - protein, 10 aa, Mycobacterium tuberculosis
EVKKSAEQAE

SEQ ID NO: 1436443 - protein, 15 aa, Mycobacterium tuberculosis
EWPEPAESLPPPYDN

SEQ ID NO: 1436444 - protein, 5 aa, Mycobacterium tuberculosis
EYEQD

SEQ ID NO: 1436445 - protein, 21 aa, Mycobacterium tuberculosis
FDAESRRGGGDMQSSPKRSPS

SEQ ID NO: 1436446 - protein, 6 aa, Mycobacterium tuberculosis
FDETSD

SEQ ID NO: 1436447 - protein, 7 aa, Mycobacterium tuberculosis
FDGTQPT

SEQ ID NO: 1436448 - protein, 4 aa, Mycobacterium tuberculosis
FDTP

SEQ ID NO: 1436449 - protein, 8 aa, Mycobacterium tuberculosis
FGAGSSGW

SEQ ID NO: 1436450 - protein, 31 aa, Mycobacterium tuberculosis
FGSGNTGSNNIGFGNTGSGNFGFGNTGNNNI

SEQ ID NO: 1436451 - protein, 20 aa, Mycobacterium tuberculosis
FHPEKSGDAGAAVLSSWVDG

SEQ ID NO: 1436452 - protein, 4 aa, Mycobacterium tuberculosis
FKTD

SEQ ID NO: 1436453 - protein, 5 aa, Mycobacterium tuberculosis
FKTDY

SEQ ID NO: 1436454 - protein, 4 aa, Mycobacterium tuberculosis
FNPP

SEQ ID NO: 1436455 - protein, 5 aa, Mycobacterium tuberculosis
FNPPL

SEQ ID NO: 1436456 - protein, 18 aa, Mycobacterium tuberculosis
FPTEPGAAGLDGEPGRSV

SEQ ID NO: 1436457 - protein, 10 aa, Mycobacterium tuberculosis
FQDRPDGSLI

SEQ ID NO: 1436458 - protein, 15 aa, Mycobacterium tuberculosis
FSADADGYTRSEGGG

SEQ ID NO: 1436459 - protein, 9 aa, Mycobacterium tuberculosis
FTSGDHRLD

SEQ ID NO: 1436460 - protein, 18 aa, Mycobacterium tuberculosis
FTTGMTTGTPAAAGAQAL

SEQ ID NO: 1436461 - protein, 14 aa, Mycobacterium tuberculosis
GAAGDFDAVGEADQ

SEQ ID NO: 1436462 - protein, 5 aa, Mycobacterium tuberculosis
GAAGS

SEQ ID NO: 1436463 - protein, 7 aa, Mycobacterium tuberculosis
GADARGV

SEQ ID NO: 1436464 - protein, 4 aa, Mycobacterium tuberculosis
GADF

SEQ ID NO: 1436465 - protein, 15 aa, Mycobacterium tuberculosis
GADRLSATGGALAAP

SEQ ID NO: 1436466 - protein, 6 aa, Mycobacterium tuberculosis
GAESLN

SEQ ID NO: 1436467 - protein, 5 aa, Mycobacterium tuberculosis
GAGAL

SEQ ID NO: 1436468 - protein, 46 aa, Mycobacterium tuberculosis
GAGGAGGAGGAGGAGGSGGAGGHGDTTSGKNGSSGTAGFDGNPGQP

SEQ ID NO: 1436469 - protein, 79 aa, Mycobacterium tuberculosis; identical to SEQ ID NO: 192510

SEQ ID NO: 1436470 - protein, 8 aa, Mycobacterium tuberculosis
GAGGGGHG

SEQ ID NO: 1436471 - protein, 36 aa, Mycobacterium tuberculosis; identical to SEQ ID NO: 174669

SEQ ID NO: 1436472 - protein, 19 aa, Mycobacterium tuberculosis
GAGGNGGMGGVAPSTGPSM

SEQ ID NO: 1436473 - protein, 142 aa, Mycobacterium tuberculosis
GAGGTGGNGGNPGAGGAGGAGGASVGGSAHGANGAPGTTSTSGGNGGDGGKGADAISSGQTGANGGRGGDGGQVGNGGAGGAGGRGGAGGLGFGSEAPGRPGGAGGTGGAGGNGGTQAGDGGTGGAGGAGGDGGSGGAGSIG

SEQ ID NO: 1436474 - protein, 10 aa, Mycobacterium tuberculosis
GAGKGFTGGG

SEQ ID NO: 1436475 - protein, 19 aa, Mycobacterium tuberculosis
GAIRSSTAENSACHRSGST

SEQ ID NO: 1436476 - protein, 19 aa, Mycobacterium tuberculosis
GALGAGAEGANKDKPVEKR

SEQ ID NO: 1436477 - protein, 7 aa, Mycobacterium tuberculosis
GALGDQR

SEQ ID NO: 1436478 - protein, 9 aa, Mycobacterium tuberculosis
GAPPTQGTY

SEQ ID NO: 1436479 - protein, 6 aa, Mycobacterium tuberculosis
GAQDPV

SEQ ID NO: 1436480 - protein, 13 aa, Mycobacterium tuberculosis
GASSVRLVNQTGY

SEQ ID NO: 1436481 - protein, 44 aa, Mycobacterium tuberculosis
GASVTGTGGNGGAGGNGVQIGNGGNGGSGGTGAAAGKAGLGGLG

SEQ ID NO: 1436482 - protein, 7 aa, Mycobacterium tuberculosis
GAYTSQW

SEQ ID NO: 1436483 - protein, 11 aa, Mycobacterium tuberculosis
GCGNGGRAEGD

SEQ ID NO: 1436484 - protein, 5 aa, Mycobacterium tuberculosis
GDADY

SEQ ID NO: 1436485 - protein, 6 aa, Mycobacterium tuberculosis
GDARNV

SEQ ID NO: 1436486 - protein, 8 aa, Mycobacterium tuberculosis
GDCRGAQG

SEQ ID NO: 1436487 - protein, 13 aa, Mycobacterium tuberculosis
GDDAEVADGLTRR

SEQ ID NO: 1436488 - protein, 35 aa, Mycobacterium tuberculosis
GDGGAGGAGDSPNSGANGARGGDGGNGAAGGAGGR

SEQ ID NO: 1436489 - protein, 7 aa, Mycobacterium tuberculosis
GDIDGPE

SEQ ID NO: 1436490 - protein, 12 aa, Mycobacterium tuberculosis
GDKAHPGSAGYT

SEQ ID NO: 1436491 - protein, 13 aa, Mycobacterium tuberculosis
GDLDDRGRYRQSG

SEQ ID NO: 1436492 - protein, 5 aa, Mycobacterium tuberculosis
GDLDK

SEQ ID NO: 1436493 - protein, 6 aa, Mycobacterium tuberculosis
GDNQGQ

SEQ ID NO: 1436494 - protein, 6 aa, Mycobacterium tuberculosis
GDPVTA

SEQ ID NO: 1436495 - protein, 29 aa, Mycobacterium tuberculosis
GDRRVDDARLPGAARPAAGQHRQQAIDGH

SEQ ID NO: 1436496 - protein, 5 aa, Mycobacterium tuberculosis
GDSAV

SEQ ID NO: 1436497 - protein, 7 aa, Mycobacterium tuberculosis
GEATDAD

SEQ ID NO: 1436498 - protein, 9 aa, Mycobacterium tuberculosis
GEGTRGAPT

SEQ ID NO: 1436499 - protein, 16 aa, Mycobacterium tuberculosis
GELDPDKLAEDEANGL

SEQ ID NO: 1436500 - protein, 4 aa, Mycobacterium tuberculosis
GEQQ

SEQ ID NO: 1436501 - protein, 5 aa, Mycobacterium tuberculosis
GESGY

SEQ ID NO: 1436502 - protein, 7 aa, Mycobacterium tuberculosis
GETSRFT

SEQ ID NO: 1436503 - protein, 6 aa, Mycobacterium tuberculosis
GFDKKA

SEQ ID NO: 1436504 - protein, 10 aa, Mycobacterium tuberculosis
GFGNNGNNNI

SEQ ID NO: 1436505 - protein, 9 aa, Mycobacterium tuberculosis
GGADGEGAG

SEQ ID NO: 1436506 - protein, 10 aa, Mycobacterium tuberculosis
GGAGGAGGFG

SEQ ID NO: 1436507 - protein, 23 aa, Mycobacterium tuberculosis
GGAGGHGASGGAGDRGGAGGTGF

SEQ ID NO: 1436508 - protein, 32 aa, Mycobacterium tuberculosis
GGAGGNGGNGGTTADGALEGSTGGIGGTGGSA

SEQ ID NO: 1436509 - protein, 51 aa, Mycobacterium tuberculosis
GGAGGSGAAGVNGGAGGNGGAGGLIGNGGAGGAGGRASTGTGGAGGAGGAA

SEQ ID NO: 1436510 - protein, 16 aa, Mycobacterium tuberculosis
GGAPIAPADAARNRAR

SEQ ID NO: 1436511 - protein, 21 aa, Mycobacterium tuberculosis
GGASTNTTGGAGGAGGDGGNA

SEQ ID NO: 1436512 - protein, 18 aa, Mycobacterium tuberculosis
GGDEKKFPGEISGGMRKR

SEQ ID NO: 1436513 - protein, 7 aa, Mycobacterium tuberculosis
GGDTEVS

SEQ ID NO: 1436514 - protein, 6 aa, Mycobacterium tuberculosis
GGFEGA

SEQ ID NO: 1436515 - protein, 6 aa, Mycobacterium tuberculosis
GGGARG

SEQ ID NO: 1436516 - protein, 38 aa, Mycobacterium tuberculosis
GGGARGEAGAGGGTSTGTNPGKAGAPGTQGDSGDPGPP

SEQ ID NO: 1436517 - protein, 4 aa, Mycobacterium tuberculosis
GGGE

SEQ ID NO: 1436518 - protein, 6 aa, Mycobacterium tuberculosis
GGGGTL

SEQ ID NO: 1436519 - protein, 6 aa, Mycobacterium tuberculosis
GGGLGR

SEQ ID NO: 1436520 - protein, 9 aa, Mycobacterium tuberculosis
GGGRAKSLA

SEQ ID NO: 1436521 - protein, 9 aa, Mycobacterium tuberculosis
GGHADRSWG

SEQ ID NO: 1436522 - protein, 16 aa, Mycobacterium tuberculosis
GGNAHQGSSGSPTRSC

SEQ ID NO: 1436523 - protein, 7 aa, Mycobacterium tuberculosis
GGNASAW

SEQ ID NO: 1436524 - protein, 5 aa, Mycobacterium tuberculosis
GGPQH

SEQ ID NO: 1436525 - protein, 7 aa, Mycobacterium tuberculosis
GGQALPQ

SEQ ID NO: 1436526 - protein, 7 aa, Mycobacterium tuberculosis
GGQVQSS

SEQ ID NO: 1436527 - protein, 23 aa, Mycobacterium tuberculosis
GGSGLGVGGAGGTGGAGGNGGAG

SEQ ID NO: 1436528 - protein, 13 aa, Mycobacterium tuberculosis
GGSRSAPPADDAG

SEQ ID NO: 1436529 - protein, 7 aa, Mycobacterium tuberculosis
GGSVTTA

SEQ ID NO: 1436530 - protein, 9 aa, Mycobacterium tuberculosis
GGTPRQVEN

SEQ ID NO: 1436531 - protein, 7 aa, Mycobacterium tuberculosis
GGTRRSC

SEQ ID NO: 1436532 - protein, 10 aa, Mycobacterium tuberculosis
GGVGGNGGAA

SEQ ID NO: 1436533 - protein, 37 aa, Mycobacterium tuberculosis
GGVGGTGGASALTIGNGSSAGAGGAGGAGGTGGTGGY

SEQ ID NO: 1436534 - protein, 4 aa, Mycobacterium tuberculosis
GGVT

SEQ ID NO: 1436535 - protein, 10 aa, Mycobacterium tuberculosis
GHDASPASDV

SEQ ID NO: 1436536 - protein, 10 aa, Mycobacterium tuberculosis
GHPPDPASVL

SEQ ID NO: 1436537 - protein, 7 aa, Mycobacterium tuberculosis
GIASRRA

SEQ ID NO: 1436538 - protein, 10 aa, Mycobacterium tuberculosis
GIETTEPGQI

SEQ ID NO: 1436539 - protein, 8 aa, Mycobacterium tuberculosis
GINDAPAL

SEQ ID NO: 1436540 - protein, 10 aa, Mycobacterium tuberculosis
GKPEPPPVDS

SEQ ID NO: 1436541 - protein, 9 aa, Mycobacterium tuberculosis
GKPTPEPRL

SEQ ID NO: 1436542 - protein, 12 aa, Mycobacterium tuberculosis
GKRNGAPSGGHE

SEQ ID NO: 1436543 - protein, 12 aa, Mycobacterium tuberculosis
GKTADADAYEPF

SEQ ID NO: 1436544 - protein, 17 aa, Mycobacterium tuberculosis
GKTAQDTSFDGRSDYDG

SEQ ID NO: 1436545 - protein, 7 aa, Mycobacterium tuberculosis
GLAENAE

SEQ ID NO: 1436546 - protein, 9 aa, Mycobacterium tuberculosis
GLAGIGGNA

SEQ ID NO: 1436547 - protein, 6 aa, Mycobacterium tuberculosis
GLASGQ

SEQ ID NO: 1436548 - protein, 9 aa, Mycobacterium tuberculosis
GLDPEGPDV

SEQ ID NO: 1436549 - protein, 10 aa, Mycobacterium tuberculosis
GLDSDGADTT

SEQ ID NO: 1436550 - protein, 18 aa, Mycobacterium tuberculosis
GLGGGAGGDGGQGGAGRG

SEQ ID NO: 1436551 - protein, 12 aa, Mycobacterium tuberculosis
GLNRPGESGDSL

SEQ ID NO: 1436552 - protein, 4 aa, Mycobacterium tuberculosis
GLPD

SEQ ID NO: 1436553 - protein, 32 aa, Mycobacterium tuberculosis
GLRPDTPVASGQLPSTSIRSRRSGISKAQRET

SEQ ID NO: 1436554 - protein, 6 aa, Mycobacterium tuberculosis
GLTAGA

SEQ ID NO: 1436555 - protein, 7 aa, Mycobacterium tuberculosis
GLYGRSD

SEQ ID NO: 1436556 - protein, 8 aa, Mycobacterium tuberculosis
GNAGSGNV

SEQ ID NO: 1436557 - protein, 18 aa, Mycobacterium tuberculosis
GNGAAGGAGWSPDSDLKG

SEQ ID NO: 1436558 - protein, 17 aa, Mycobacterium tuberculosis
GNGADGTAANPNGGAGG

SEQ ID NO: 1436559 - protein, 39 aa, Mycobacterium tuberculosis; identical to SEQ ID NO: 232132

SEQ ID NO: 1436560 - protein, 46 aa, Mycobacterium tuberculosis
GNGGNGAAGGPNQAGGAGGNAGLIGNGGAGGAGGVGAVGGKGGTGG

SEQ ID NO: 1436561 - protein, 46 aa, Mycobacterium tuberculosis; identical to SEQ ID NO: 194182

SEQ ID NO: 1436562 - protein, 24 aa, Mycobacterium tuberculosis
GNGGNGAAGVNAGIAGGSGGAAGL

SEQ ID NO: 1436563 - protein, 16 aa, Mycobacterium tuberculosis
GNGVNGGTGGTGGSGG

SEQ ID NO: 1436564 - protein, 4 aa, Mycobacterium tuberculosis
GNNM

SEQ ID NO: 1436565 - protein, 10 aa, Mycobacterium tuberculosis
GNRAGPPSIA

SEQ ID NO: 1436566 - protein, 7 aa, Mycobacterium tuberculosis
GNRAPGV

SEQ ID NO: 1436567 - protein, 8 aa, Mycobacterium tuberculosis
GNTGTNNL

SEQ ID NO: 1436568 - protein, 5 aa, Mycobacterium tuberculosis
GNTKA

SEQ ID NO: 1436569 - protein, 9 aa, Mycobacterium tuberculosis
GPAFPRAKS

SEQ ID NO: 1436570 - protein, 20 aa, Mycobacterium tuberculosis
GPDIRDPQPLGKAARELAKK

SEQ ID NO: 1436571 - protein, 5 aa, Mycobacterium tuberculosis
GPEVG

SEQ ID NO: 1436572 - protein, 8 aa, Mycobacterium tuberculosis
GPNGVGKT

SEQ ID NO: 1436573 - protein, 17 aa, Mycobacterium tuberculosis
GPRGDGVDGGSGPCYPQ

SEQ ID NO: 1436574 - protein, 6 aa, Mycobacterium tuberculosis
GPSWED

SEQ ID NO: 1436575 - protein, 8 aa, Mycobacterium tuberculosis
GPTNAPEL

SEQ ID NO: 1436576 - protein, 6 aa, Mycobacterium tuberculosis
GQAGVA

SEQ ID NO: 1436577 - protein, 14 aa, Mycobacterium tuberculosis
GQPAAAGAHSLSEG

SEQ ID NO: 1436578 - protein, 7 aa, Mycobacterium tuberculosis
GQPDPEV

SEQ ID NO: 1436579 - protein, 25 aa, Mycobacterium tuberculosis
GQPNTGRSRTGYRSGDPRIKGENAY

SEQ ID NO: 1436580 - protein, 5 aa, Mycobacterium tuberculosis
GQQYQ

SEQ ID NO: 1436581 - protein, 9 aa, Mycobacterium tuberculosis
GQTSPANVV

SEQ ID NO: 1436582 - protein, 26 aa, Mycobacterium tuberculosis
GRADGAHPDVGEAAKPIHQYRDRDTF

SEQ ID NO: 1436583 - protein, 28 aa, Mycobacterium tuberculosis
GRAGKAAAAHAAAAGRSRAISSATWPEP

SEQ ID NO: 1436584 - protein, 31 aa, Mycobacterium tuberculosis
GRDGGPGGNGGAGGQLYGNGGDGAPGTGGTL

SEQ ID NO: 1436585 - protein, 10 aa, Mycobacterium tuberculosis
GRDGPGQRDG

SEQ ID NO: 1436586 - protein, 15 aa, Mycobacterium tuberculosis
GRDPEQSFSATDLMH

SEQ ID NO: 1436587 - protein, 5 aa, Mycobacterium tuberculosis
GRGHE

SEQ ID NO: 1436588 - protein, 6 aa, Mycobacterium tuberculosis
GRKPSR

SEQ ID NO: 1436589 - protein, 12 aa, Mycobacterium tuberculosis
GRPAGSSDTRER

SEQ ID NO: 1436590 - protein, 10 aa, Mycobacterium tuberculosis
GRPEYPTPVG

SEQ ID NO: 1436591 - protein, 5 aa, Mycobacterium tuberculosis
GRPGA

SEQ ID NO: 1436592 - protein, 6 aa, Mycobacterium tuberculosis
GRPGFA

SEQ ID NO: 1436593 - protein, 4 aa, Mycobacterium tuberculosis
GRPL

SEQ ID NO: 1436594 - protein, 11 aa, Mycobacterium tuberculosis
GRRAPVSSSDQ

SEQ ID NO: 1436595 - protein, 11 aa, Mycobacterium tuberculosis
GRRPGQSQVPD

SEQ ID NO: 1436596 - protein, 22 aa, Mycobacterium tuberculosis
GRRRRPLPTGLGRPSADPSGEL

SEQ ID NO: 1436597 - protein, 17 aa, Mycobacterium tuberculosis
GRSPGRDSGGRKVPESP

SEQ ID NO: 1436598 - protein, 5 aa, Mycobacterium tuberculosis
GRTTV

SEQ ID NO: 1436599 - protein, 8 aa, Mycobacterium tuberculosis
GRVPEPSV

SEQ ID NO: 1436600 - protein, 9 aa, Mycobacterium tuberculosis
GRVPNPALP

SEQ ID NO: 1436601 - protein, 14 aa, Mycobacterium tuberculosis
GSADGSADSTGRVP

SEQ ID NO: 1436602 - protein, 5 aa, Mycobacterium tuberculosis
GSAPA

SEQ ID NO: 1436603 - protein, 7 aa, Mycobacterium tuberculosis
GSARGYR

SEQ ID NO: 1436604 - protein, 15 aa, Mycobacterium tuberculosis
GSGAGVQVIEHAAGT

SEQ ID NO: 1436605 - protein, 84 aa, Mycobacterium tuberculosis; identical to SEQ ID NO: 232768

SEQ ID NO: 1436606 - protein, 29 aa, Mycobacterium tuberculosis
GSGGFGGAGGAAAGVGTTGGVGGSGGVGG

SEQ ID NO: 1436607 - protein, 21 aa, Mycobacterium tuberculosis
GSGNTGSNNIGFGNTGSGNFG

SEQ ID NO: 1436608 - protein, 9 aa, Mycobacterium tuberculosis
GSPGVPGLT

SEQ ID NO: 1436609 - protein, 15 aa, Mycobacterium tuberculosis
GSPSWNARKPRSANA

SEQ ID NO: 1436610 - protein, 11 aa, Mycobacterium tuberculosis
GSQPLADDAEE

SEQ ID NO: 1436611 - protein, 9 aa, Mycobacterium tuberculosis
GSQRGADAA

SEQ ID NO: 1436612 - protein, 6 aa, Mycobacterium tuberculosis
GSRPDG

SEQ ID NO: 1436613 - protein, 8 aa, Mycobacterium tuberculosis
GSSAGKTS

SEQ ID NO: 1436614 - protein, 11 aa, Mycobacterium tuberculosis
GSTVDRSLPGG

SEQ ID NO: 1436615 - protein, 7 aa, Mycobacterium tuberculosis
GSVPPTV

SEQ ID NO: 1436616 - protein, 18 aa, Mycobacterium tuberculosis
GTADEPFDPNYHQKTDTL

SEQ ID NO: 1436617 - protein, 6 aa, Mycobacterium tuberculosis
GTAKEI

SEQ ID NO: 1436618 - protein, 15 aa, Mycobacterium tuberculosis
GTARAGIGAGADPAV

SEQ ID NO: 1436619 - protein, 17 aa, Mycobacterium tuberculosis
GTATRSGLWSPGKIRIG

SEQ ID NO: 1436620 - protein, 4 aa, Mycobacterium tuberculosis
GTEV

SEQ ID NO: 1436621 - protein, 7 aa, Mycobacterium tuberculosis
GTFAESG

SEQ ID NO: 1436622 - protein, 5 aa, Mycobacterium tuberculosis
GTFEH

SEQ ID NO: 1436623 - protein, 5 aa, Mycobacterium tuberculosis
GTGTD

SEQ ID NO: 1436624 - protein, 13 aa, Mycobacterium tuberculosis
GTLPGKGSQAQRA

SEQ ID NO: 1436625 - protein, 16 aa, Mycobacterium tuberculosis
GTPLQAGATPTGSRGT

SEQ ID NO: 1436626 - protein, 13 aa, Mycobacterium tuberculosis
GVDPTAADPAGWP

SEQ ID NO: 1436627 - protein, 6 aa, Mycobacterium tuberculosis
GVEPAG

SEQ ID NO: 1436628 - protein, 5 aa, Mycobacterium tuberculosis
GVERA

SEQ ID NO: 1436629 - protein, 7 aa, Mycobacterium tuberculosis
GVGGAGG

SEQ ID NO: 1436630 - protein, 8 aa, Mycobacterium tuberculosis
GVGGVGGD

SEQ ID NO: 1436631 - protein, 7 aa, Mycobacterium tuberculosis
GVHPGDP

SEQ ID NO: 1436632 - protein, 7 aa, Mycobacterium tuberculosis
GVNDAPA

SEQ ID NO: 1436633 - protein, 17 aa, Mycobacterium tuberculosis
GVPARNEPPSDPSAPIP

SEQ ID NO: 1436634 - protein, 9 aa, Mycobacterium tuberculosis
GVPPPPGSW

SEQ ID NO: 1436635 - protein, 8 aa, Mycobacterium tuberculosis
GVSPNPRL

SEQ ID NO: 1436636 - protein, 4 aa, Mycobacterium tuberculosis
GVSR

SEQ ID NO: 1436637 - protein, 8 aa, Mycobacterium tuberculosis
GWDSDPPD

SEQ ID NO: 1436638 - protein, 7 aa, Mycobacterium tuberculosis
GYGYGPA

SEQ ID NO: 1436639 - protein, 7 aa, Mycobacterium tuberculosis
GYSELSD

SEQ ID NO: 1436640 - protein, 9 aa, Mycobacterium tuberculosis
HAGAQAGGD

SEQ ID NO: 1436641 - protein, 93 aa, Mycobacterium tuberculosis
HATDGADGTTGPDGNGTDAGSGSNAVNPGVGGGAGGIGGDGTNLGQTDVSGGLGGAGGNGGAGGGGGTGFNPGAPGDPGTQGATGANGQHGLN

SEQ ID NO: 1436642 - protein, 11 aa, Mycobacterium tuberculosis
HDDAGNPVDSW

SEQ ID NO: 1436643 - protein, 19 aa, Mycobacterium tuberculosis
HDGDTVPVNVSPDADSLIL

SEQ ID NO: 1436644 - protein, 5 aa, Mycobacterium tuberculosis
HDTPR

SEQ ID NO: 1436645 - protein, 9 aa, Mycobacterium tuberculosis
HEETEGTLG

SEQ ID NO: 1436646 - protein, 6 aa, Mycobacterium tuberculosis
HETTAT

SEQ ID NO: 1436647 - protein, 7 aa, Mycobacterium tuberculosis
HGGISGR

SEQ ID NO: 1436648 - protein, 21 aa, Mycobacterium tuberculosis
HGGNGGVGALGANGGAGGTSG

SEQ ID NO: 1436649 - protein, 9 aa, Mycobacterium tuberculosis
HGLTANEPS

SEQ ID NO: 1436650 - protein, 7 aa, Mycobacterium tuberculosis
HGQPRTN

SEQ ID NO: 1436651 - protein, 5 aa, Mycobacterium tuberculosis
HGSTG

SEQ ID NO: 1436652 - protein, 7 aa, Mycobacterium tuberculosis
HKPNGSH

SEQ ID NO: 1436653 - protein, 5 aa, Mycobacterium tuberculosis
HPAHR

SEQ ID NO: 1436654 - protein, 22 aa, Mycobacterium tuberculosis
HPGDPRSSTPSPRPSTCRRRLS

SEQ ID NO: 1436655 - protein, 8 aa, Mycobacterium tuberculosis
HPKYPNDP

SEQ ID NO: 1436656 - protein, 8 aa, Mycobacterium tuberculosis
HPPVPGAR

SEQ ID NO: 1436657 - protein, 4 aa, Mycobacterium tuberculosis
HQHS

SEQ ID NO: 1436658 - protein, 9 aa, Mycobacterium tuberculosis
HRDATDDQV

SEQ ID NO: 1436659 - protein, 14 aa, Mycobacterium tuberculosis
HRPSDTDNRSHTCG

SEQ ID NO: 1436660 - protein, 19 aa, Mycobacterium tuberculosis
HRQGGAAARADCSKLPRCA

SEQ ID NO: 1436661 - protein, 6 aa, Mycobacterium tuberculosis
HRSPRR

SEQ ID NO: 1436662 - protein, 9 aa, Mycobacterium tuberculosis
HSDADLSNA

SEQ ID NO: 1436663 - protein, 15 aa, Mycobacterium tuberculosis
HVPSAAARSAGLSES

SEQ ID NO: 1436664 - protein, 6 aa, Mycobacterium tuberculosis
IAEPDV

SEQ ID NO: 1436665 - protein, 11 aa, Mycobacterium tuberculosis
IAQAGERPHHR

SEQ ID NO: 1436666 - protein, 5 aa, Mycobacterium tuberculosis
IDDEG

SEQ ID NO: 1436667 - protein, 39 aa, Mycobacterium tuberculosis
IDTKFNDAAGRRWPRDTHNQQPPQSSRQPAQYTAVARTR

SEQ ID NO: 1436668 - protein, 6 aa, Mycobacterium tuberculosis
IEPGAH

SEQ ID NO: 1436669 - protein, 11 aa, Mycobacterium tuberculosis
IGAANAAAAVP

SEQ ID NO: 1436670 - protein, 174 aa, Mycobacterium tuberculosis
IGAGGDGGVGGVGAPGTNGMNPPPNQTSQAANGSPGANNGAGSGGAGLPGNPGAVPGRAGGAGGLGGSGSDTSEGPVTGGNGGNGGDGGPGAPGGNGAPGGIGVNTGTGWAYGGNGGNGGDGGAGARGGDGGNGGNGLALNGGNGIGGNGGAGGRGGTGAAGGNGGIGGGATGT

SEQ ID NO: 1436671 - protein, 7 aa, Mycobacterium tuberculosis
IGDVRGR

SEQ ID NO: 1436672 - protein, 22 aa, Mycobacterium tuberculosis
IGGRKRKSDREAAMTDSEHVGK

SEQ ID NO: 1436673 - protein, 23 aa, Mycobacterium tuberculosis
IGNGGSGGAGGAGAAGGSGGQGG

SEQ ID NO: 1436674 - protein, 11 aa, Mycobacterium tuberculosis
IGSAARPRAVN

SEQ ID NO: 1436675 - protein, 5 aa, Mycobacterium tuberculosis
IGSEG

SEQ ID NO: 1436676 - protein, 4 aa, Mycobacterium tuberculosis
IGSG

SEQ ID NO: 1436677 - protein, 8 aa, Mycobacterium tuberculosis
IGTGTRRC

SEQ ID NO: 1436678 - protein, 23 aa, Mycobacterium tuberculosis
INPPPKEDQPTQLNRPGESGDSL

SEQ ID NO: 1436679 - protein, 11 aa, Mycobacterium tuberculosis
IPPGADPDPGV

SEQ ID NO: 1436680 - protein, 7 aa, Mycobacterium tuberculosis
ISPGSTI

SEQ ID NO: 1436681 - protein, 12 aa, Mycobacterium tuberculosis
ISSPSDPTANPI

SEQ ID NO: 1436682 - protein, 11 aa, Mycobacterium tuberculosis
ISTANGAAALP

SEQ ID NO: 1436683 - protein, 14 aa, Mycobacterium tuberculosis
ITPGSMPADSREIH

SEQ ID NO: 1436684 - protein, 17 aa, Mycobacterium tuberculosis
KAARRDSAHSAGGGGTM

SEQ ID NO: 1436685 - protein, 6 aa, Mycobacterium tuberculosis
KADRRT

SEQ ID NO: 1436686 - protein, 30 aa, Mycobacterium tuberculosis
KAGLVSATGPADEDDKDPEDRRDQPSGERL

SEQ ID NO: 1436687 - protein, 6 aa, Mycobacterium tuberculosis
KAPAFT

SEQ ID NO: 1436688 - protein, 23 aa, Mycobacterium tuberculosis
KARQRRNVDDRDVDGSGAAENVE

SEQ ID NO: 1436689 - protein, 9 aa, Mycobacterium tuberculosis
KASGGIRTA

SEQ ID NO: 1436690 - protein, 7 aa, Mycobacterium tuberculosis
KATFAGD

SEQ ID NO: 1436691 - protein, 6 aa, Mycobacterium tuberculosis
KATGDP

SEQ ID NO: 1436692 - protein, 14 aa, Mycobacterium tuberculosis
KEPPPPLPPDLPPN

SEQ ID NO: 1436693 - protein, 17 aa, Mycobacterium tuberculosis
KEQREAEGGSKVPEDTL

SEQ ID NO: 1436694 - protein, 5 aa, Mycobacterium tuberculosis
KFRTG

SEQ ID NO: 1436695 - protein, 6 aa, Mycobacterium tuberculosis
KGPDLA

SEQ ID NO: 1436696 - protein, 13 aa, Mycobacterium tuberculosis
KGTAKKGEVPARP

SEQ ID NO: 1436697 - protein, 13 aa, Mycobacterium tuberculosis
KKAFAGAAGDQVD

SEQ ID NO: 1436698 - protein, 9 aa, Mycobacterium tuberculosis
KLPASTIDE

SEQ ID NO: 1436699 - protein, 7 aa, Mycobacterium tuberculosis
KLRDPAV

SEQ ID NO: 1436700 - protein, 8 aa, Mycobacterium tuberculosis
KLSEERKV

SEQ ID NO: 1436701 - protein, 8 aa, Mycobacterium tuberculosis
KNAQEAHE

SEQ ID NO: 1436702 - protein, 8 aa, Mycobacterium tuberculosis
KPETIPAM

SEQ ID NO: 1436703 - protein, 5 aa, Mycobacterium tuberculosis
KPPGL

SEQ ID NO: 1436704 - protein, 17 aa, Mycobacterium tuberculosis
KPPSRFGYGTSGRRANV

SEQ ID NO: 1436705 - protein, 5 aa, Mycobacterium tuberculosis
KPVNQ

SEQ ID NO: 1436706 - protein, 11 aa, Mycobacterium tuberculosis
KRERGIDAPGP

SEQ ID NO: 1436707 - protein, 6 aa, Mycobacterium tuberculosis
KRHSGT

SEQ ID NO: 1436708 - protein, 9 aa, Mycobacterium tuberculosis
KSGSRTPGL

SEQ ID NO: 1436709 - protein, 4 aa, Mycobacterium tuberculosis
KSHI

SEQ ID NO: 1436710 - protein, 19 aa, Mycobacterium tuberculosis
KTAEREHTPTATATTPSVA

SEQ ID NO: 1436711 - protein, 8 aa, Mycobacterium tuberculosis
KTEPRDGE

SEQ ID NO: 1436712 - protein, 11 aa, Mycobacterium tuberculosis
KTGEAEFPGGS

SEQ ID NO: 1436713 - protein, 7 aa, Mycobacterium tuberculosis
KTKRDRH

SEQ ID NO: 1436714 - protein, 17 aa, Mycobacterium tuberculosis
KTQIDQVESTAGSLQGQ

SEQ ID NO: 1436715 - protein, 11 aa, Mycobacterium tuberculosis
KVAQQKGAIPG

SEQ ID NO: 1436716 - protein, 5 aa, Mycobacterium tuberculosis
LAETS

SEQ ID NO: 1436717 - protein, 8 aa, Mycobacterium tuberculosis
LAGESGTM

SEQ ID NO: 1436718 - protein, 4 aa, Mycobacterium tuberculosis
LANT

SEQ ID NO: 1436719 - protein, 10 aa, Mycobacterium tuberculosis
LAPDVAAATA

SEQ ID NO: 1436720 - protein, 9 aa, Mycobacterium tuberculosis
LARPDTAPA

SEQ ID NO: 1436721 - protein, 5 aa, Mycobacterium tuberculosis
LATPR

SEQ ID NO: 1436722 - protein, 4 aa, Mycobacterium tuberculosis
LCTD

SEQ ID NO: 1436723 - protein, 7 aa, Mycobacterium tuberculosis
LEGGAGP

SEQ ID NO: 1436724 - protein, 9 aa, Mycobacterium tuberculosis
LERAEQTAD

SEQ ID NO: 1436725 - protein, 9 aa, Mycobacterium tuberculosis
LETQARQRE

SEQ ID NO: 1436726 - protein, 8 aa, Mycobacterium tuberculosis
LETQEADP

SEQ ID NO: 1436727 - protein, 9 aa, Mycobacterium tuberculosis
LGDQAAVGA

SEQ ID NO: 1436728 - protein, 4 aa, Mycobacterium tuberculosis
LGDS

SEQ ID NO: 1436729 - protein, 7 aa, Mycobacterium tuberculosis
LGGAATR

SEQ ID NO: 1436730 - protein, 19 aa, Mycobacterium tuberculosis
LGPDNKPTGSRSNVRGPDG

SEQ ID NO: 1436731 - protein, 13 aa, Mycobacterium tuberculosis
LGRLTPSSREWRK

SEQ ID NO: 1436732 - protein, 6 aa, Mycobacterium tuberculosis
LGSGSI

SEQ ID NO: 1436733 - protein, 13 aa, Mycobacterium tuberculosis
LGSSLGSSGLGAG

SEQ ID NO: 1436734 - protein, 5 aa, Mycobacterium tuberculosis
LGTSG

SEQ ID NO: 1436735 - protein, 8 aa, Mycobacterium tuberculosis
LKDPPYRL

SEQ ID NO: 1436736 - protein, 6 aa, Mycobacterium tuberculosis
LKTNSS

SEQ ID NO: 1436737 - protein, 6 aa, Mycobacterium tuberculosis
LNEGRG

SEQ ID NO: 1436738 - protein, 18 aa, Mycobacterium tuberculosis
LNSGSGNIGFGNSGTGNV

SEQ ID NO: 1436739 - protein, 6 aa, Mycobacterium tuberculosis
LPAAGD

SEQ ID NO: 1436740 - protein, 17 aa, Mycobacterium tuberculosis
LPAGRPGRLRLLSGAAT

SEQ ID NO: 1436741 - protein, 5 aa, Mycobacterium tuberculosis
LPAKA

SEQ ID NO: 1436742 - protein, 4 aa, Mycobacterium tuberculosis
LPGQ

SEQ ID NO: 1436743 - protein, 5 aa, Mycobacterium tuberculosis
LPGVD

SEQ ID NO: 1436744 - protein, 8 aa, Mycobacterium tuberculosis
LPKPNNQT

SEQ ID NO: 1436745 - protein, 5 aa, Mycobacterium tuberculosis
LPPAR

SEQ ID NO: 1436746 - protein, 4 aa, Mycobacterium tuberculosis
LPPF

SEQ ID NO: 1436747 - protein, 8 aa, Mycobacterium tuberculosis
LPSASAGG

SEQ ID NO: 1436748 - protein, 5 aa, Mycobacterium tuberculosis
LPTRT

SEQ ID NO: 1436749 - protein, 7 aa, Mycobacterium tuberculosis
LQAQGTE

SEQ ID NO: 1436750 - protein, 6 aa, Mycobacterium tuberculosis
LQDGPD

SEQ ID NO: 1436751 - protein, 5 aa, Mycobacterium tuberculosis
LQETN

SEQ ID NO: 1436752 - protein, 15 aa, Mycobacterium tuberculosis
LRAAAAGSFEQASDH

SEQ ID NO: 1436753 - protein, 6 aa, Mycobacterium tuberculosis
LRDADD

SEQ ID NO: 1436754 - protein, 17 aa, Mycobacterium tuberculosis
LRGKGRLTDADIDATTR

SEQ ID NO: 1436755 - protein, 6 aa, Mycobacterium tuberculosis
LRNGEA

SEQ ID NO: 1436756 - protein, 8 aa, Mycobacterium tuberculosis
LRPGEGRT

SEQ ID NO: 1436757 - protein, 4 aa, Mycobacterium tuberculosis
LRRG

SEQ ID NO: 1436758 - protein, 12 aa, Mycobacterium tuberculosis
LRRGKDRRKVHY

SEQ ID NO: 1436759 - protein, 8 aa, Mycobacterium tuberculosis
LRSADDSH

SEQ ID NO: 1436760 - protein, 7 aa, Mycobacterium tuberculosis
LSDTRNT

SEQ ID NO: 1436761 - protein, 4 aa, Mycobacterium tuberculosis
LSGE

SEQ ID NO: 1436762 - protein, 39 aa, Mycobacterium tuberculosis
LSGPVGDSGNGGAGGDGGAGVSATDIAGTGGRGGNGGHG

SEQ ID NO: 1436763 - protein, 11 aa, Mycobacterium tuberculosis
LSSAEKGAAAS

SEQ ID NO: 1436764 - protein, 15 aa, Mycobacterium tuberculosis
LSSSTAATFASGPSG

SEQ ID NO: 1436765 - protein, 6 aa, Mycobacterium tuberculosis
LTRDPA

SEQ ID NO: 1436766 - protein, 15 aa, Mycobacterium tuberculosis
LTSGGGAYAAAEAAA

SEQ ID NO: 1436767 - protein, 4 aa, Mycobacterium tuberculosis
LTTL

SEQ ID NO: 1436768 - protein, 39 aa, Mycobacterium tuberculosis
MAAPGAAVASAAAPASAPAASTVASATPAPPPAPGAAGF

SEQ ID NO: 1436769 - protein, 34 aa, Mycobacterium tuberculosis
MAGAAADPQERVGPRGRRGLAGQQQCRGRPGPSL

SEQ ID NO: 1436770 - protein, 4 aa, Mycobacterium tuberculosis
MANT

SEQ ID NO: 1436771 - protein, 7 aa, Mycobacterium tuberculosis
MEAPDDM

SEQ ID NO: 1436772 - protein, 4 aa, Mycobacterium tuberculosis
MHPG

SEQ ID NO: 1436773 - protein, 6 aa, Mycobacterium tuberculosis
MPDSSS

SEQ ID NO: 1436774 - protein, 11 aa, Mycobacterium tuberculosis
MPQPPGYDTNA

SEQ ID NO: 1436775 - protein, 17 aa, Mycobacterium tuberculosis
MRADKSAPAARSNGSRW

SEQ ID NO: 1436776 - protein, 9 aa, Mycobacterium tuberculosis
NAGRSIRRP

SEQ ID NO: 1436777 - protein, 9 aa, Mycobacterium tuberculosis
NANPPNAEL

SEQ ID NO: 1436778 - protein, 6 aa, Mycobacterium tuberculosis
NANYPQ

SEQ ID NO: 1436779 - protein, 5 aa, Mycobacterium tuberculosis
NAPTL

SEQ ID NO: 1436780 - protein, 10 aa, Mycobacterium tuberculosis
NDAGDAAGDA

SEQ ID NO: 1436781 - protein, 20 aa, Mycobacterium tuberculosis
NDGSNGESGESSQSINDAAT

SEQ ID NO: 1436782 - protein, 7 aa, Mycobacterium tuberculosis
NDNNGRQ

SEQ ID NO: 1436783 - protein, 16 aa, Mycobacterium tuberculosis
NDPERAGVGFGDGTTH

SEQ ID NO: 1436784 - protein, 4 aa, Mycobacterium tuberculosis
NDTL

SEQ ID NO: 1436785 - protein, 13 aa, Mycobacterium tuberculosis
NFNQGIANTGNNN

SEQ ID NO: 1436786 - protein, 16 aa, Mycobacterium tuberculosis
NGADGTAANPNGGAGG

SEQ ID NO: 1436787 - protein, 46 aa, Mycobacterium tuberculosis; identical to SEQ ID NO: 181284

SEQ ID NO: 1436788 - protein, 57 aa, Mycobacterium tuberculosis; identical to SEQ ID NO: 181300

SEQ ID NO: 1436789 - protein, 28 aa, Mycobacterium tuberculosis
NGGGAGGAGGSGVSGGAGGEGGAGGAGG

SEQ ID NO: 1436790 - protein, 49 aa, Mycobacterium tuberculosis
NGGNGGAGGPDGGAGGNGGAAGLIGNGGAGGAGGAGGAGGAGGAGGTGG

SEQ ID NO: 1436791 - protein, 24 aa, Mycobacterium tuberculosis
NGGNGGHGATNTAATATGGAGGAG

SEQ ID NO: 1436792 - protein, 7 aa, Mycobacterium tuberculosis
NGKPLPK

SEQ ID NO: 1436793 - protein, 11 aa, Mycobacterium tuberculosis
NGMRGGDAVTG

SEQ ID NO: 1436794 - protein, 20 aa, Mycobacterium tuberculosis
NGNIGLNGATGGIGSTTLTN

SEQ ID NO: 1436795 - protein, 7 aa, Mycobacterium tuberculosis
NGQTPAG

SEQ ID NO: 1436796 - protein, 6 aa, Mycobacterium tuberculosis
NGRDNY

SEQ ID NO: 1436797 - protein, 5 aa, Mycobacterium tuberculosis
NGSPF

SEQ ID NO: 1436798 - protein, 19 aa, Mycobacterium tuberculosis
NHESAGKRHHGVRRTGNQH

SEQ ID NO: 1436799 - protein, 4 aa, Mycobacterium tuberculosis
NIAS

SEQ ID NO: 1436800 - protein, 17 aa, Mycobacterium tuberculosis
NISGAGWSGQAEATSLD

SEQ ID NO: 1436801 - protein, 6 aa, Mycobacterium tuberculosis
NLGDAK

SEQ ID NO: 1436802 - protein, 41 aa, Mycobacterium tuberculosis
NLGSGNIGSTNVGSGNIGSTNVGSGNIGDTNFGNGNNGNFN

SEQ ID NO: 1436803 - protein, 6 aa, Mycobacterium tuberculosis
NNNFGF

SEQ ID NO: 1436804 - protein, 4 aa, Mycobacterium tuberculosis
NNPM

SEQ ID NO: 1436805 - protein, 10 aa, Mycobacterium tuberculosis
NPDPDAAGAC

SEQ ID NO: 1436806 - protein, 8 aa, Mycobacterium tuberculosis
NPSNDAAA

SEQ ID NO: 1436807 - protein, 7 aa, Mycobacterium tuberculosis
NPTNTAY

SEQ ID NO: 1436808 - protein, 9 aa, Mycobacterium tuberculosis
NRAGPPSMA

SEQ ID NO: 1436809 - protein, 4 aa, Mycobacterium tuberculosis
NRDG

SEQ ID NO: 1436810 - protein, 9 aa, Mycobacterium tuberculosis
NRGGATAED

SEQ ID NO: 1436811 - protein, 10 aa, Mycobacterium tuberculosis
NRPQSSNALS

SEQ ID NO: 1436812 - protein, 16 aa, Mycobacterium tuberculosis
NRVDPGAGDGDRRNVD

SEQ ID NO: 1436813 - protein, 10 aa, Mycobacterium tuberculosis
NSAAAGSTTS

SEQ ID NO: 1436814 - protein, 22 aa, Mycobacterium tuberculosis
NSAQRDARNSRDESARASDTDR

SEQ ID NO: 1436815 - protein, 6 aa, Mycobacterium tuberculosis
NSGLTP

SEQ ID NO: 1436816 - protein, 4 aa, Mycobacterium tuberculosis
NSGQ

SEQ ID NO: 1436817 - protein, 5 aa, Mycobacterium tuberculosis
NTGAI

SEQ ID NO: 1436818 - protein, 6 aa, Mycobacterium tuberculosis
NTRIGQ

SEQ ID NO: 1436819 - protein, 8 aa, Mycobacterium tuberculosis
NVVDPATG

SEQ ID NO: 1436820 - protein, 26 aa, Mycobacterium tuberculosis
PAAAENAARITAREPAVAGDRPELTE

SEQ ID NO: 1436821 - protein, 12 aa, Mycobacterium tuberculosis
PAAPDDVEPGGL

SEQ ID NO: 1436822 - protein, 10 aa, Mycobacterium tuberculosis
PAGAASLDAG

SEQ ID NO: 1436823 - protein, 4 aa, Mycobacterium tuberculosis
PALD

SEQ ID NO: 1436824 - protein, 7 aa, Mycobacterium tuberculosis
PALPDDL

SEQ ID NO: 1436825 - protein, 13 aa, Mycobacterium tuberculosis
PAQGPSATPAQGL

SEQ ID NO: 1436826 - protein, 9 aa, Mycobacterium tuberculosis
PARPERSSL

SEQ ID NO: 1436827 - protein, 11 aa, Mycobacterium tuberculosis
PARQSESGDGF

SEQ ID NO: 1436828 - protein, 5 aa, Mycobacterium tuberculosis
PARRP

SEQ ID NO: 1436829 - protein, 11 aa, Mycobacterium tuberculosis
PASPRLRSSRR

SEQ ID NO: 1436830 - protein, 12 aa, Mycobacterium tuberculosis
PASPRLRSSRRH

SEQ ID NO: 1436831 - protein, 7 aa, Mycobacterium tuberculosis
PATTDFP

SEQ ID NO: 1436832 - protein, 5 aa, Mycobacterium tuberculosis
PDDAG

SEQ ID NO: 1436833 - protein, 6 aa, Mycobacterium tuberculosis
PDERRV

SEQ ID NO: 1436834 - protein, 10 aa, Mycobacterium tuberculosis
PDGNYGEPEE

SEQ ID NO: 1436835 - protein, 28 aa, Mycobacterium tuberculosis
PDGQWTASPQEGHSVRDHQESLMERHRS

SEQ ID NO: 1436836 - protein, 30 aa, Mycobacterium tuberculosis
PDIAPPPPGTNLPGPPNAYDESNPLPPPWY

SEQ ID NO: 1436837 - protein, 7 aa, Mycobacterium tuberculosis
PDPAGQP

SEQ ID NO: 1436838 - protein, 6 aa, Mycobacterium tuberculosis
PDPDVR

SEQ ID NO: 1436839 - protein, 8 aa, Mycobacterium tuberculosis
PDPETARI

SEQ ID NO: 1436840 - protein, 9 aa, Mycobacterium tuberculosis
PDPHQPDMT

SEQ ID NO: 1436841 - protein, 4 aa, Mycobacterium tuberculosis
PDPL

SEQ ID NO: 1436842 - protein, 6 aa, Mycobacterium tuberculosis
PDPLDG

SEQ ID NO: 1436843 - protein, 7 aa, Mycobacterium tuberculosis
PDRGFTN

SEQ ID NO: 1436844 - protein, 5 aa, Mycobacterium tuberculosis
PDSGY

SEQ ID NO: 1436845 - protein, 10 aa, Mycobacterium tuberculosis
PEAARTPSTT

SEQ ID NO: 1436846 - protein, 9 aa, Mycobacterium tuberculosis
PEDAEDDLH

SEQ ID NO: 1436847 - protein, 5 aa, Mycobacterium tuberculosis
PEESQ

SEQ ID NO: 1436848 - protein, 11 aa, Mycobacterium tuberculosis
PEKELDTDRPF

SEQ ID NO: 1436849 - protein, 7 aa, Mycobacterium tuberculosis
PENPRDV

SEQ ID NO: 1436850 - protein, 19 aa, Mycobacterium tuberculosis
PEQQAENLTTGISAGTGNR

SEQ ID NO: 1436851 - protein, 4 aa, Mycobacterium tuberculosis
PERD

SEQ ID NO: 1436852 - protein, 4 aa, Mycobacterium tuberculosis
PERL

SEQ ID NO: 1436853 - protein, 5 aa, Mycobacterium tuberculosis
PESQL

SEQ ID NO: 1436854 - protein, 11 aa, Mycobacterium tuberculosis
PEYSAPECTDP

SEQ ID NO: 1436855 - protein, 18 aa, Mycobacterium tuberculosis
PGAPTGGDDGDAPPGNSL

SEQ ID NO: 1436856 - protein, 9 aa, Mycobacterium tuberculosis
PGARYRGDR

SEQ ID NO: 1436857 - protein, 5 aa, Mycobacterium tuberculosis
PGATQ

SEQ ID NO: 1436858 - protein, 16 aa, Mycobacterium tuberculosis
PGESDGTCGRGEPQAG

SEQ ID NO: 1436859 - protein, 7 aa, Mycobacterium tuberculosis
PGGHTGG

SEQ ID NO: 1436860 - protein, 9 aa, Mycobacterium tuberculosis
PGGPNGEDA

SEQ ID NO: 1436861 - protein, 7 aa, Mycobacterium tuberculosis
PGKRAPT

SEQ ID NO: 1436862 - protein, 13 aa, Mycobacterium tuberculosis
PGLPEPAEQVDGR

SEQ ID NO: 1436863 - protein, 5 aa, Mycobacterium tuberculosis
PGPDR

SEQ ID NO: 1436864 - protein, 13 aa, Mycobacterium tuberculosis
PGYPPEPPQVPYP

SEQ ID NO: 1436865 - protein, 9 aa, Mycobacterium tuberculosis
PHANRDQED

SEQ ID NO: 1436866 - protein, 5 aa, Mycobacterium tuberculosis
PHIPA

SEQ ID NO: 1436867 - protein, 7 aa, Mycobacterium tuberculosis
PHNTNTE

SEQ ID NO: 1436868 - protein, 6 aa, Mycobacterium tuberculosis
PHRRRP

SEQ ID NO: 1436869 - protein, 7 aa, Mycobacterium tuberculosis
PHTRTQD

SEQ ID NO: 1436870 - protein, 7 aa, Mycobacterium tuberculosis
PIANPGA

SEQ ID NO: 1436871 - protein, 18 aa, Mycobacterium tuberculosis
PIDDPMRATSEAAAATVS

SEQ ID NO: 1436872 - protein, 5 aa, Mycobacterium tuberculosis
PIEGR

SEQ ID NO: 1436873 - protein, 4 aa, Mycobacterium tuberculosis
PIEP

SEQ ID NO: 1436874 - protein, 9 aa, Mycobacterium tuberculosis
PKTPRGDGN

SEQ ID NO: 1436875 - protein, 16 aa, Mycobacterium tuberculosis
PKTPRGDGNPHGGTWT

SEQ ID NO: 1436876 - protein, 13 aa, Mycobacterium tuberculosis
PLPNTAGSRSAAE

SEQ ID NO: 1436877 - protein, 5 aa, Mycobacterium tuberculosis
PLSGL

SEQ ID NO: 1436878 - protein, 10 aa, Mycobacterium tuberculosis
PMAGKSDIDA

SEQ ID NO: 1436879 - protein, 4 aa, Mycobacterium tuberculosis
PNKG

SEQ ID NO: 1436880 - protein, 9 aa, Mycobacterium tuberculosis
PNRRPTGQR

SEQ ID NO: 1436881 - protein, 7 aa, Mycobacterium tuberculosis
PPAPPAL

SEQ ID NO: 1436882 - protein, 4 aa, Mycobacterium tuberculosis
PPAT

SEQ ID NO: 1436883 - protein, 6 aa, Mycobacterium tuberculosis
PPATVG

SEQ ID NO: 1436884 - protein, 7 aa, Mycobacterium tuberculosis
PPGTGKT

SEQ ID NO: 1436885 - protein, 12 aa, Mycobacterium tuberculosis
PPLENYNPASSP

SEQ ID NO: 1436886 - protein, 6 aa, Mycobacterium tuberculosis
PPLGQQ

SEQ ID NO: 1436887 - protein, 5 aa, Mycobacterium tuberculosis
PPLPP

SEQ ID NO: 1436888 - protein, 14 aa, Mycobacterium tuberculosis
PPPLPQAATPTLAA

SEQ ID NO: 1436889 - protein, 13 aa, Mycobacterium tuberculosis
PPPVTAPPPVTGA

SEQ ID NO: 1436890 - protein, 4 aa, Mycobacterium tuberculosis
PPQD

SEQ ID NO: 1436891 - protein, 14 aa, Mycobacterium tuberculosis
PPSAIEANPRQPRQ

SEQ ID NO: 1436892 - protein, 6 aa, Mycobacterium tuberculosis
PPWDPG

SEQ ID NO: 1436893 - protein, 14 aa, Mycobacterium tuberculosis
PPYSVGQSSANDLN

SEQ ID NO: 1436894 - protein, 11 aa, Mycobacterium tuberculosis
PQATPPITTPP

SEQ ID NO: 1436895 - protein, 18 aa, Mycobacterium tuberculosis
PQPASLPAAGATGQPGPG

SEQ ID NO: 1436896 - protein, 26 aa, Mycobacterium tuberculosis
PQPDSAAAAAAAAAVRDQARARRRRR

SEQ ID NO: 1436897 - protein, 14 aa, Mycobacterium tuberculosis
PRAMSDSRTRYSPE

SEQ ID NO: 1436898 - protein, 16 aa, Mycobacterium tuberculosis
PRASTATPGSPAERHK

SEQ ID NO: 1436899 - protein, 4 aa, Mycobacterium tuberculosis
PRDP

SEQ ID NO: 1436900 - protein, 8 aa, Mycobacterium tuberculosis
PREGWPPA

SEQ ID NO: 1436901 - protein, 22 aa, Mycobacterium tuberculosis
PREQVSQPATAASDYSAGGAES

SEQ ID NO: 1436902 - protein, 10 aa, Mycobacterium tuberculosis
PRRGRSKRHR

SEQ ID NO: 1436903 - protein, 4 aa, Mycobacterium tuberculosis
PSED

SEQ ID NO: 1436904 - protein, 4 aa, Mycobacterium tuberculosis
PSGD

SEQ ID NO: 1436905 - protein, 4 aa, Mycobacterium tuberculosis
PSGG

SEQ ID NO: 1436906 - protein, 5 aa, Mycobacterium tuberculosis
PSREF

SEQ ID NO: 1436907 - protein, 6 aa, Mycobacterium tuberculosis
PTGDDA

SEQ ID NO: 1436908 - protein, 15 aa, Mycobacterium tuberculosis
PTGEPDANYDTYKHH

SEQ ID NO: 1436909 - protein, 7 aa, Mycobacterium tuberculosis
PTKDTSV

SEQ ID NO: 1436910 - protein, 9 aa, Mycobacterium tuberculosis
PTSLGAAPV

SEQ ID NO: 1436911 - protein, 8 aa, Mycobacterium tuberculosis
PTVQQPNS

SEQ ID NO: 1436912 - protein, 18 aa, Mycobacterium tuberculosis
PVDPASRQAFGRPSGVQG

SEQ ID NO: 1436913 - protein, 25 aa, Mycobacterium tuberculosis
PWQNTGSEGAAPAGVPGPEAGAQLQ

SEQ ID NO: 1436914 - protein, 22 aa, Mycobacterium tuberculosis
QAAGGAVRTRVGDRSRAAGRRA

SEQ ID NO: 1436915 - protein, 9 aa, Mycobacterium tuberculosis
QADAQSGKV

SEQ ID NO: 1436916 - protein, 10 aa, Mycobacterium tuberculosis
QAMKTQDKLR

SEQ ID NO: 1436917 - protein, 7 aa, Mycobacterium tuberculosis
QANTQCT

SEQ ID NO: 1436918 - protein, 8 aa, Mycobacterium tuberculosis
QARPNEVT

SEQ ID NO: 1436919 - protein, 7 aa, Mycobacterium tuberculosis
QARRSRV

SEQ ID NO: 1436920 - protein, 15 aa, Mycobacterium tuberculosis
QASTQPSADSEAPSR

SEQ ID NO: 1436921 - protein, 7 aa, Mycobacterium tuberculosis
QAVTPAA

SEQ ID NO: 1436922 - protein, 9 aa, Mycobacterium tuberculosis
QDAHGVTAA

SEQ ID NO: 1436923 - protein, 13 aa, Mycobacterium tuberculosis
QDPVATAASNNPM

SEQ ID NO: 1436924 - protein, 6 aa, Mycobacterium tuberculosis
QEGRGA

SEQ ID NO: 1436925 - protein, 4 aa, Mycobacterium tuberculosis
QELP

SEQ ID NO: 1436926 - protein, 23 aa, Mycobacterium tuberculosis
QETDYPSVGPDRPEYEPRGCPRG

SEQ ID NO: 1436927 - protein, 9 aa, Mycobacterium tuberculosis
QGDEPGWDD

SEQ ID NO: 1436928 - protein, 37 aa, Mycobacterium tuberculosis
QGDGIDFDGADRNIGYADAERDCRDVDGRDDQGSEVE

SEQ ID NO: 1436929 - protein, 56 aa, Mycobacterium tuberculosis; identical to SEQ ID NO: 230912

SEQ ID NO: 1436930 - protein, 23 aa, Mycobacterium tuberculosis
QGGFGGARGERPAAPEFPDRHPD

SEQ ID NO: 1436931 - protein, 12 aa, Mycobacterium tuberculosis
QGRAGRGRPGLH

SEQ ID NO: 1436932 - protein, 5 aa, Mycobacterium tuberculosis
QIQQE

SEQ ID NO: 1436933 - protein, 10 aa, Mycobacterium tuberculosis
QISAAGSFGR

SEQ ID NO: 1436934 - protein, 6 aa, Mycobacterium tuberculosis
QKYDPS

SEQ ID NO: 1436935 - protein, 26 aa, Mycobacterium tuberculosis
QLHGGTASLENSPLGGARLVLRLPGP

SEQ ID NO: 1436936 - protein, 6 aa, Mycobacterium tuberculosis
QLVETG

SEQ ID NO: 1436937 - protein, 5 aa, Mycobacterium tuberculosis
QPAEQ

SEQ ID NO: 1436938 - protein, 4 aa, Mycobacterium tuberculosis
QPAY

SEQ ID NO: 1436939 - protein, 8 aa, Mycobacterium tuberculosis
QPGGSGDE

SEQ ID NO: 1436940 - protein, 5 aa, Mycobacterium tuberculosis
QPPAT

SEQ ID NO: 1436941 - protein, 44 aa, Mycobacterium tuberculosis
QPQQRPSVAGRQPGSDRPRHRRRHSRNPDCERRREYPDSHTDHR

SEQ ID NO: 1436942 - protein, 8 aa, Mycobacterium tuberculosis
QPQYGSGQ

SEQ ID NO: 1436943 - protein, 13 aa, Mycobacterium tuberculosis
QPTAQPLPQSPAE

SEQ ID NO: 1436944 - protein, 17 aa, Mycobacterium tuberculosis
QPTDPRTLPPDAPDDRK

SEQ ID NO: 1436945 - protein, 9 aa, Mycobacterium tuberculosis
QQDPDKLPR

SEQ ID NO: 1436946 - protein, 5 aa, Mycobacterium tuberculosis
QQPEM

SEQ ID NO: 1436947 - protein, 15 aa, Mycobacterium tuberculosis
QQPLTDKPGAQRQTT

SEQ ID NO: 1436948 - protein, 6 aa, Mycobacterium tuberculosis
QRDHQL

SEQ ID NO: 1436949 - protein, 13 aa, Mycobacterium tuberculosis
QRERRQPVTTRRS

SEQ ID NO: 1436950 - protein, 5 aa, Mycobacterium tuberculosis
QRPSM

SEQ ID NO: 1436951 - protein, 15 aa, Mycobacterium tuberculosis
QRQGQSAQRCRSKGY

SEQ ID NO: 1436952 - protein, 6 aa, Mycobacterium tuberculosis
QRSSIG

SEQ ID NO: 1436953 - protein, 13 aa, Mycobacterium tuberculosis
QSGQGEDAATSTL

SEQ ID NO: 1436954 - protein, 11 aa, Mycobacterium tuberculosis
QSRPAKTARRP

SEQ ID NO: 1436955 - protein, 8 aa, Mycobacterium tuberculosis
QSSSTGGP

SEQ ID NO: 1436956 - protein, 21 aa, Mycobacterium tuberculosis
QTAAATDTHGPPPDPNDDPPP

SEQ ID NO: 1436957 - protein, 16 aa, Mycobacterium tuberculosis
QTQNPERGRKLAPTLS

SEQ ID NO: 1436958 - protein, 12 aa, Mycobacterium tuberculosis
QTYAKRSTAQLK

SEQ ID NO: 1436959 - protein, 7 aa, Mycobacterium tuberculosis
QVRKAQR

SEQ ID NO: 1436960 - protein, 9 aa, Mycobacterium tuberculosis
RAAPQRPIP

SEQ ID NO: 1436961 - protein, 5 aa, Mycobacterium tuberculosis
RAATQ

SEQ ID NO: 1436962 - protein, 8 aa, Mycobacterium tuberculosis
RADPRLGE

SEQ ID NO: 1436963 - protein, 15 aa, Mycobacterium tuberculosis
RAEAEGTLRRGSAAE

SEQ ID NO: 1436964 - protein, 5 aa, Mycobacterium tuberculosis
RAERD

SEQ ID NO: 1436965 - protein, 7 aa, Mycobacterium tuberculosis
RAGATHD

SEQ ID NO: 1436966 - protein, 33 aa, Mycobacterium tuberculosis; identical to SEQ ID NO: 194775

SEQ ID NO: 1436967 - protein, 33 aa, Mycobacterium tuberculosis; identical to SEQ ID NO: 194777

SEQ ID NO: 1436968 - protein, 6 aa, Mycobacterium tuberculosis
RAQREL

SEQ ID NO: 1436969 - protein, 13 aa, Mycobacterium tuberculosis
RARDRAEANRGAR

SEQ ID NO: 1436970 - protein, 9 aa, Mycobacterium tuberculosis
RARSSTEHS

SEQ ID NO: 1436971 - protein, 9 aa, Mycobacterium tuberculosis
RASEQRDPA

SEQ ID NO: 1436972 - protein, 11 aa, Mycobacterium tuberculosis
RAVRRASGRRK

SEQ ID NO: 1436973 - protein, 7 aa, Mycobacterium tuberculosis
RAVSPQV

SEQ ID NO: 1436974 - protein, 13 aa, Mycobacterium tuberculosis
RCSRTDSKTSYTQ

SEQ ID NO: 1436975 - protein, 7 aa, Mycobacterium tuberculosis
RDAGAQT

SEQ ID NO: 1436976 - protein, 4 aa, Mycobacterium tuberculosis
RDGG

SEQ ID NO: 1436977 - protein, 4 aa, Mycobacterium tuberculosis
RDGV

SEQ ID NO: 1436978 - protein, 7 aa, Mycobacterium tuberculosis
RDREVRR

SEQ ID NO: 1436979 - protein, 12 aa, Mycobacterium tuberculosis
REDPPGRARQAN

SEQ ID NO: 1436980 - protein, 7 aa, Mycobacterium tuberculosis
REGGHSR

SEQ ID NO: 1436981 - protein, 19 aa, Mycobacterium tuberculosis
REKQTSDPPAKKESNGTKM

SEQ ID NO: 1436982 - protein, 4 aa, Mycobacterium tuberculosis
RERR

SEQ ID NO: 1436983 - protein, 9 aa, Mycobacterium tuberculosis
RESRNGEGL

SEQ ID NO: 1436984 - protein, 15 aa, Mycobacterium tuberculosis
RFGSTGALRRNTRRD

SEQ ID NO: 1436985 - protein, 10 aa, Mycobacterium tuberculosis
RGAQQRDQAQ

SEQ ID NO: 1436986 - protein, 4 aa, Mycobacterium tuberculosis
RGEP

SEQ ID NO: 1436987 - protein, 5 aa, Mycobacterium tuberculosis
RGGLA

SEQ ID NO: 1436988 - protein, 12 aa, Mycobacterium tuberculosis
RGHEQPTRLAVP

SEQ ID NO: 1436989 - protein, 8 aa, Mycobacterium tuberculosis
RGNLTPRE

SEQ ID NO: 1436990 - protein, 8 aa, Mycobacterium tuberculosis
RGQSAQVS

SEQ ID NO: 1436991 - protein, 7 aa, Mycobacterium tuberculosis
RHGEHRQ

SEQ ID NO: 1436992 - protein, 6 aa, Mycobacterium tuberculosis
RIDRSQ

SEQ ID NO: 1436993 - protein, 5 aa, Mycobacterium tuberculosis
RIGSR

SEQ ID NO: 1436994 - protein, 5 aa, Mycobacterium tuberculosis
RKDKL

SEQ ID NO: 1436995 - protein, 8 aa, Mycobacterium tuberculosis
RKKAAAAE

SEQ ID NO: 1436996 - protein, 13 aa, Mycobacterium tuberculosis
RKPFPRTVSTGQA

SEQ ID NO: 1436997 - protein, 6 aa, Mycobacterium tuberculosis
RKPPIE

SEQ ID NO: 1436998 - protein, 19 aa, Mycobacterium tuberculosis
RKSDRGALTRAGSEPPSGD

SEQ ID NO: 1436999 - protein, 56 aa, Mycobacterium tuberculosis
RLDEGSHRRDRTPAGQADRLQRGQRNRPTAAAQKDRRHPRSGLSGGRRHRRRRGRR

SEQ ID NO: 1437000 - protein, 14 aa, Mycobacterium tuberculosis
RLGPGGISGPPLAQ

SEQ ID NO: 1437001 - protein, 4 aa, Mycobacterium tuberculosis
RLPK

SEQ ID NO: 1437002 - protein, 8 aa, Mycobacterium tuberculosis
RLPPRGLT

SEQ ID NO: 1437003 - protein, 12 aa, Mycobacterium tuberculosis
RLTAAAEAKRQN

SEQ ID NO: 1437004 - protein, 6 aa, Mycobacterium tuberculosis
RNDGIA

SEQ ID NO: 1437005 - protein, 6 aa, Mycobacterium tuberculosis
RNPTRW

SEQ ID NO: 1437006 - protein, 18 aa, Mycobacterium tuberculosis
RNSVDSGGRDVDRRNVDG

SEQ ID NO: 1437007 - protein, 7 aa, Mycobacterium tuberculosis
RPMNPPS

SEQ ID NO: 1437008 - protein, 7 aa, Mycobacterium tuberculosis
RPPAPLT

SEQ ID NO: 1437009 - protein, 8 aa, Mycobacterium tuberculosis
RPPTDDEP

SEQ ID NO: 1437010 - protein, 6 aa, Mycobacterium tuberculosis
RPQRFR

SEQ ID NO: 1437011 - protein, 5 aa, Mycobacterium tuberculosis
RPRGL

SEQ ID NO: 1437012 - protein, 5 aa, Mycobacterium tuberculosis
RPRHP

SEQ ID NO: 1437013 - protein, 45 aa, Mycobacterium tuberculosis
RPSASPAEPPTRPAPQHSRRARRGHRYRTDTERNVGKVATGPSIQ

SEQ ID NO: 1437014 - protein, 9 aa, Mycobacterium tuberculosis
RPSRAEPYT

SEQ ID NO: 1437015 - protein, 10 aa, Mycobacterium tuberculosis
RQAPYGLAGS

SEQ ID NO: 1437016 - protein, 27 aa, Mycobacterium tuberculosis
RQPIRPSGRAPAAVTSTAKSPRLRQAG

SEQ ID NO: 1437017 - protein, 10 aa, Mycobacterium tuberculosis
RQRPATLGVD

SEQ ID NO: 1437018 - protein, 6 aa, Mycobacterium tuberculosis
RRAEQR

SEQ ID NO: 1437019 - protein, 21 aa, Mycobacterium tuberculosis
RRDADSTGRGVNQHPLTGAQR

SEQ ID NO: 1437020 - protein, 11 aa, Mycobacterium tuberculosis
RREQIKKDHPC

SEQ ID NO: 1437021 - protein, 13 aa, Mycobacterium tuberculosis
RRGDEVRMATWHW

SEQ ID NO: 1437022 - protein, 5 aa, Mycobacterium tuberculosis
RRGGD

SEQ ID NO: 1437023 - protein, 21 aa, Mycobacterium tuberculosis
RRGRIGTKRSSISDTDYRRDS

SEQ ID NO: 1437024 - protein, 9 aa, Mycobacterium tuberculosis
RRKRMSKKK

SEQ ID NO: 1437025 - protein, 8 aa, Mycobacterium tuberculosis
RRPARGAA

SEQ ID NO: 1437026 - protein, 23 aa, Mycobacterium tuberculosis
RRPRSAAADNRPAFRDGPAIPPG

SEQ ID NO: 1437027 - protein, 14 aa, Mycobacterium tuberculosis
RRRCGGPPIAAATR

SEQ ID NO: 1437028 - protein, 7 aa, Mycobacterium tuberculosis
RSADDSH

SEQ ID NO: 1437029 - protein, 15 aa, Mycobacterium tuberculosis
RSAGTEPAGQVNPTA

SEQ ID NO: 1437030 - protein, 4 aa, Mycobacterium tuberculosis
RSAL

SEQ ID NO: 1437031 - protein, 12 aa, Mycobacterium tuberculosis
RSLADKTRAALG

SEQ ID NO: 1437032 - protein, 16 aa, Mycobacterium tuberculosis
RSMPAHGPGPRPKNPL

SEQ ID NO: 1437033 - protein, 20 aa, Mycobacterium tuberculosis
RSNPPIGPACGRRSKGPNHF

SEQ ID NO: 1437034 - protein, 27 aa, Mycobacterium tuberculosis
RSPVEPGSGWPGDPATPQTPVAADAAQ

SEQ ID NO: 1437035 - protein, 6 aa, Mycobacterium tuberculosis
RSRSYR

SEQ ID NO: 1437036 - protein, 4 aa, Mycobacterium tuberculosis
RSWG

SEQ ID NO: 1437037 - protein, 10 aa, Mycobacterium tuberculosis
RSWRNTEPAV

SEQ ID NO: 1437038 - protein, 5 aa, Mycobacterium tuberculosis
RTAPR

SEQ ID NO: 1437039 - protein, 17 aa, Mycobacterium tuberculosis
RTGPSTDQWPKCGQTSQ

SEQ ID NO: 1437040 - protein, 16 aa, Mycobacterium tuberculosis
RTGRSHARESSQGPNQ

SEQ ID NO: 1437041 - protein, 9 aa, Mycobacterium tuberculosis
RTGSGRCNR

SEQ ID NO: 1437042 - protein, 47 aa, Mycobacterium tuberculosis
RTKPDQREHKYGGADPVADCPEAGEPVGTPGRRQHHQPDQDCDESQL

SEQ ID NO: 1437043 - protein, 8 aa, Mycobacterium tuberculosis
RTLSTSAD

SEQ ID NO: 1437044 - protein, 13 aa, Mycobacterium tuberculosis
RTREATKQAQTLT

SEQ ID NO: 1437045 - protein, 12 aa, Mycobacterium tuberculosis
RTSPNADSSSPT

SEQ ID NO: 1437046 - protein, 21 aa, Mycobacterium tuberculosis
RTTAGTSLAARTAAAAGPALA

SEQ ID NO: 1437047 - protein, 10 aa, Mycobacterium tuberculosis
RVCTSSGSPM

SEQ ID NO: 1437048 - protein, 18 aa, Mycobacterium tuberculosis
RVDPGSDDVGAPLGQRVP

SEQ ID NO: 1437049 - protein, 6 aa, Mycobacterium tuberculosis
RVNGPH
